United States Patent 12,606,847 (ENGINEERED VIRAL CAPSID POLYPEPTIDES AND USES THEREOF) - sequence listing, part 6

SEQ ID NO: 112005 - protein, 29 aa, Artificial Sequence
  Description of Artificial Sequence: Synthetic peptide
QENEIATTNPVATECYGHVSECLQHEELN

SEQ ID NO: 112006 - protein, 34 aa, Artificial Sequence
  Description of Artificial Sequence: Synthetic polypeptide
DESEIRTTNPVATEHWGSDVSCINEPQDREGENG

SEQ ID NO: 112007 - protein, 29 aa, Artificial Sequence
  Description of Artificial Sequence: Synthetic peptide
QENEIATTNPVATECYGHVSECLRQHEEL

SEQ ID NO: 112008 - protein, 28 aa, Artificial Sequence
  Description of Artificial Sequence: Synthetic peptide
QENEIATTNPVATECYGHVSECVQHEEL

SEQ ID NO: 112009 - protein, 29 aa, Artificial Sequence
  Description of Artificial Sequence: Synthetic peptide
QENEIATTNPVATECYGHVSEVLQIEEVL

SEQ ID NO: 112010 - protein, 33 aa, Artificial Sequence
  Description of Artificial Sequence: Synthetic polypeptide
DEQEIATTNPVATEQYGSVPSATDLEDHEGEDL

SEQ ID NO: 112011 - protein, 29 aa, Artificial Sequence
  Description of Artificial Sequence: Synthetic peptide
QENEIATTNPVATECYGIVSYECLQHEEL

SEQ ID NO: 112012 - protein, 32 aa, Artificial Sequence
  Description of Artificial Sequence: Synthetic polypeptide
DEQEIATTNPVATEQYGSMSATDLPDHEGEDL

SEQ ID NO: 112013 - protein, 33 aa, Artificial Sequence
  Description of Artificial Sequence: Synthetic polypeptide
DEQEIATTNPVATEQYGSVPSATDLEDHEGEDH

SEQ ID NO: 112014 - protein, 32 aa, Artificial Sequence
  Description of Artificial Sequence: Synthetic polypeptide
DEQEIATTNPVATEQYGSVPATDLEDHEGGDL

SEQ ID NO: 112015 - protein, 32 aa, Artificial Sequence
  Description of Artificial Sequence: Synthetic polypeptide
DEQEIATTNPVATEQYGSVPATDLEDHEGEDL

SEQ ID NO: 112016 - protein, 33 aa, Artificial Sequence
  Description of Artificial Sequence: Synthetic polypeptide
DEQEIATTNPVATEQYGSVNSATDLEDHEGEDL

SEQ ID NO: 112017 - protein, 32 aa, Artificial Sequence
  Description of Artificial Sequence: Synthetic polypeptide
DEQEIATTNPVATEQYGSVNATDLEDHEGMDL

SEQ ID NO: 112018 - protein, 30 aa, Artificial Sequence
  Description of Artificial Sequence: Synthetic polypeptide
QENEIATTNPVATECYGKVSCECLQTEGEL

SEQ ID NO: 112019 - protein, 30 aa, Artificial Sequence
  Description of Artificial Sequence: Synthetic polypeptide
QENEIATTNPVATECYGKVSCESLQHEENL

SEQ ID NO: 112020 - protein, 32 aa, Artificial Sequence
  Description of Artificial Sequence: Synthetic polypeptide
DEQEIATTNPVATEQYGSVNATDLEDHEGEDL

SEQ ID NO: 112021 - protein, 33 aa, Artificial Sequence
  Description of Artificial Sequence: Synthetic polypeptide
DEQEIATTNPVATEQYGSVMSATDLIDHEGEDL

SEQ ID NO: 112022 - protein, 33 aa, Artificial Sequence
  Description of Artificial Sequence: Synthetic polypeptide
DEQEIATTNPVATEQYGSVMSATDLEDHEGEDL

SEQ ID NO: 112023 - protein, 33 aa, Artificial Sequence
  Description of Artificial Sequence: Synthetic polypeptide
DESEIRTTNPVATEIWGLVSCINEPQDREGENG

SEQ ID NO: 112024 - protein, 34 aa, Artificial Sequence
  Description of Artificial Sequence: Synthetic polypeptide
DESEIRTTNPVATEIWGSVPSCINEPQDREGENG

SEQ ID NO: 112025 - protein, 29 aa, Artificial Sequence
  Description of Artificial Sequence: Synthetic peptide
QENEIATTNPVATECYGKVSECLQHEESL

SEQ ID NO: 112026 - protein, 29 aa, Artificial Sequence
  Description of Artificial Sequence: Synthetic peptide
QENEIATTNPVATECYGKVSCECLQHEEM

SEQ ID NO: 112027 - protein, 32 aa, Artificial Sequence
  Description of Artificial Sequence: Synthetic polypeptide
DEQEIATTNPVATEQYGSMSATDLLDHEGEDL

SEQ ID NO: 112028 - protein, 32 aa, Artificial Sequence
  Description of Artificial Sequence: Synthetic polypeptide
DEQEIATTNPVATEQYGSMSATDLEHHEGEDL

SEQ ID NO: 112029 - protein, 33 aa, Artificial Sequence
  Description of Artificial Sequence: Synthetic polypeptide
DESEIRTTNPVATENWGSVSCIDEPQDREGENG

SEQ ID NO: 112030 - protein, 32 aa, Artificial Sequence
  Description of Artificial Sequence: Synthetic polypeptide
DEQEIATTNPVATEQYGGVSATDLEDHEGEDL

SEQ ID NO: 112031 - protein, 32 aa, Artificial Sequence
  Description of Artificial Sequence: Synthetic polypeptide
DEQEIATTNPVATEQYGFVSWTDLEDHEGEDL

SEQ ID NO: 112032 - protein, 32 aa, Artificial Sequence
  Description of Artificial Sequence: Synthetic polypeptide
DEQEIATTNPVATEQYGFVSATDLEDIEGEDL

SEQ ID NO: 112033 - protein, 32 aa, Artificial Sequence
  Description of Artificial Sequence: Synthetic polypeptide
DEQEIATTNPVATEQYGFVSATDLEDHEGEDL

SEQ ID NO: 112034 - protein, 32 aa, Artificial Sequence
  Description of Artificial Sequence: Synthetic polypeptide
DEQEIATTNPVATEQYGFVSATDLEDHEGEDG

SEQ ID NO: 112035 - protein, 33 aa, Artificial Sequence
  Description of Artificial Sequence: Synthetic polypeptide
DEQEIATTNPVATEQYGFSVSATELEDHEGEDL

SEQ ID NO: 112036 - protein, 33 aa, Artificial Sequence
  Description of Artificial Sequence: Synthetic polypeptide
DEQEIATTNPVATEQYGFSVSATDLEWHEGEDL

SEQ ID NO: 112037 - protein, 33 aa, Artificial Sequence
  Description of Artificial Sequence: Synthetic polypeptide
DEQEIATTNPVATEQYGFSVSATDLEDHEGEDT

SEQ ID NO: 112038 - protein, 33 aa, Artificial Sequence
  Description of Artificial Sequence: Synthetic polypeptide
DEQEIATTNPVATEQYGFSVSATDLEDHEGEDL

SEQ ID NO: 112039 - protein, 33 aa, Artificial Sequence
  Description of Artificial Sequence: Synthetic polypeptide
DEQEIATTNPVATEQYGEVVTTGNMDDQNNGSR

SEQ ID NO: 112040 - protein, 29 aa, Artificial Sequence
  Description of Artificial Sequence: Synthetic peptide
QENEIATTNPVATEGYGDVSSEQLQHEEL

SEQ ID NO: 112041 - protein, 32 aa, Artificial Sequence
  Description of Artificial Sequence: Synthetic polypeptide
DEQEIATTNPVATEQYGEVSWTDLEDHQQEDS

SEQ ID NO: 112042 - protein, 31 aa, Artificial Sequence
  Description of Artificial Sequence: Synthetic polypeptide
DEQEIATTNPVATEQYGEVSTVCQDHEEEDL

SEQ ID NO: 112043 - protein, 31 aa, Artificial Sequence
  Description of Artificial Sequence: Synthetic polypeptide
DEQEIATTNPVATEQYGEVSTVCEDHEGEDL

SEQ ID NO: 112044 - protein, 29 aa, Artificial Sequence
  Description of Artificial Sequence: Synthetic peptide
QENEIATTNPVATEGYGDVVSECLQHEEL

SEQ ID NO: 112045 - protein, 33 aa, Artificial Sequence
  Description of Artificial Sequence: Synthetic polypeptide
DESEIRTTNPVATEPYGTVSMENEQQDQNGENG

SEQ ID NO: 112046 - protein, 29 aa, Artificial Sequence
  Description of Artificial Sequence: Synthetic peptide
DESEIRTTNPVATEQWGDMSETEMAAEDI

SEQ ID NO: 112047 - protein, 36 aa, Artificial Sequence
  Description of Artificial Sequence: Synthetic polypeptide
AEEEIRTTNPVATEQYGSVVTVTNNNLQAGEGGNND

SEQ ID NO: 112048 - protein, 31 aa, Artificial Sequence
  Description of Artificial Sequence: Synthetic polypeptide
DEQEIATTNPVATEQYGEVSTDCEDHEGEDL

SEQ ID NO: 112049 - protein, 31 aa, Artificial Sequence
  Description of Artificial Sequence: Synthetic polypeptide
DEQEIATTNPVATEQYGEVSATVCEDHGEDL

SEQ ID NO: 112050 - protein, 32 aa, Artificial Sequence
  Description of Artificial Sequence: Synthetic polypeptide
DEQEIATTNPVATEQYGEVSATDLEDHEGEDL

SEQ ID NO: 112051 - protein, 32 aa, Artificial Sequence
  Description of Artificial Sequence: Synthetic polypeptide
DEQEIATTNPVATEQYGEVSATDLEDHEGEDK

SEQ ID NO: 112052 - protein, 29 aa, Artificial Sequence
  Description of Artificial Sequence: Synthetic peptide
QENEIATTNPVATEHYGCVSWELQHEELA

SEQ ID NO: 112053 - protein, 33 aa, Artificial Sequence
  Description of Artificial Sequence: Synthetic polypeptide
DEQEIATTNPVATEQYGESVSATKLEDHEGEDL

SEQ ID NO: 112054 - protein, 29 aa, Artificial Sequence
  Description of Artificial Sequence: Synthetic peptide
QENEIATTNPVATEHYGDVSECLQHEEFL

SEQ ID NO: 112055 - protein, 33 aa, Artificial Sequence
  Description of Artificial Sequence: Synthetic polypeptide
DEQEIATTNPVATEQYGHSVSATDLEDHEGEDL

SEQ ID NO: 112056 - protein, 28 aa, Artificial Sequence
  Description of Artificial Sequence: Synthetic peptide
QEEEIATTNPCSSEQYGIVPCNLQSETK

SEQ ID NO: 112057 - protein, 32 aa, Artificial Sequence
  Description of Artificial Sequence: Synthetic polypeptide
DEQEIATTNPVATEQYGHVSATDLEDHEGEDL

SEQ ID NO: 112058 - protein, 33 aa, Artificial Sequence
  Description of Artificial Sequence: Synthetic polypeptide
DEQEIATTNPVATEQYGISVSATDLDDHEGEDL

SEQ ID NO: 112059 - protein, 32 aa, Artificial Sequence
  Description of Artificial Sequence: Synthetic polypeptide
DEQEIATTNPVATEQYGLVSATDLEEHEGEDL

SEQ ID NO: 112060 - protein, 32 aa, Artificial Sequence
  Description of Artificial Sequence: Synthetic polypeptide
DEQEIATTNPVATEQYGLVSATDLEDHEGEDL

SEQ ID NO: 112061 - protein, 29 aa, Artificial Sequence
  Description of Artificial Sequence: Synthetic peptide
QENEIATTNPVATEGYGCVSWPLQHIELG

SEQ ID NO: 112062 - protein, 33 aa, Artificial Sequence
  Description of Artificial Sequence: Synthetic polypeptide
DEQEIATTNPVATEQYGLSVSATDLEDHEGEML

SEQ ID NO: 112063 - protein, 33 aa, Artificial Sequence
  Description of Artificial Sequence: Synthetic polypeptide
DEQEIATTNPVATEQYGLSVSATDLEDHEGEDL

SEQ ID NO: 112064 - protein, 32 aa, Artificial Sequence
  Description of Artificial Sequence: Synthetic polypeptide
DEQEIATTNPVATEQYGKVSATDLSDHEGEDL

SEQ ID NO: 112065 - protein, 29 aa, Artificial Sequence
  Description of Artificial Sequence: Synthetic peptide
QENEIATTNPVATEGYGCVSWYLQHSSEL

SEQ ID NO: 112066 - protein, 28 aa, Artificial Sequence
  Description of Artificial Sequence: Synthetic peptide
QENEIATTNPVATEGYGDMASTLQHEDI

SEQ ID NO: 112067 - protein, 32 aa, Artificial Sequence
  Description of Artificial Sequence: Synthetic polypeptide
DEQEIATTNPVATEQYGKVSATDLEDHVGEDL

SEQ ID NO: 112068 - protein, 32 aa, Artificial Sequence
  Description of Artificial Sequence: Synthetic polypeptide
DEQEIATTNPVATEQYGKVSATDLEDHEGEDL

SEQ ID NO: 112069 - protein, 28 aa, Artificial Sequence
  Description of Artificial Sequence: Synthetic peptide
QENEIATTNPVATEGYGDMASTLQHEDL

SEQ ID NO: 112070 - protein, 29 aa, Artificial Sequence
  Description of Artificial Sequence: Synthetic peptide
QENEIATTNPVATEGYGDVAECLQHVEER

SEQ ID NO: 112071 - protein, 28 aa, Artificial Sequence
  Description of Artificial Sequence: Synthetic peptide
QEEEIATTNPIATEQYGEAPEVCQHEER

SEQ ID NO: 112072 - protein, 33 aa, Artificial Sequence
  Description of Artificial Sequence: Synthetic polypeptide
DEQEIATTNPVATEQYGKSVSATDLEDHEGEDL

SEQ ID NO: 112073 - protein, 29 aa, Artificial Sequence
  Description of Artificial Sequence: Synthetic peptide
QENEIATTNPVATEGYGDVSAQLQHEELN

SEQ ID NO: 112074 - protein, 32 aa, Artificial Sequence
  Description of Artificial Sequence: Synthetic polypeptide
DESEIRTTNPVATEPYGTISMENEQQDQNGNG

SEQ ID NO: 112075 - protein, 33 aa, Artificial Sequence
  Description of Artificial Sequence: Synthetic polypeptide
DESEIRTTNPVATEPYGTVSMENEPQDQNGENG

SEQ ID NO: 112076 - protein, 32 aa, Artificial Sequence
  Description of Artificial Sequence: Synthetic polypeptide
DEQEIATTNPVATEQYGIVSATHLEDHEGEDL

SEQ ID NO: 112077 - protein, 32 aa, Artificial Sequence
  Description of Artificial Sequence: Synthetic polypeptide
DEQEIATTNPVATEQYGIVSATDLEDSEGTDL

SEQ ID NO: 112078 - protein, 32 aa, Artificial Sequence
  Description of Artificial Sequence: Synthetic polypeptide
DEQEIATTNPVATEQYGIVSATDLEDHEGTDL

SEQ ID NO: 112079 - protein, 32 aa, Artificial Sequence
  Description of Artificial Sequence: Synthetic polypeptide
DEQEIATTNPVATEQYGIVSATDLEDHEGEDL

SEQ ID NO: 112080 - protein, 32 aa, Artificial Sequence
  Description of Artificial Sequence: Synthetic polypeptide
DEQEIATTNPVATEQYGIVSACNLEDHEGEDL

SEQ ID NO: 112081 - protein, 33 aa, Artificial Sequence
  Description of Artificial Sequence: Synthetic polypeptide
DEQEIATTNPVATEQYGISVSATDLIDHEGEDL

SEQ ID NO: 112082 - protein, 33 aa, Artificial Sequence
  Description of Artificial Sequence: Synthetic polypeptide
DEQEIATTNPVATEQYGISVSATDLEDHPGEDL

SEQ ID NO: 112083 - protein, 33 aa, Artificial Sequence
  Description of Artificial Sequence: Synthetic polypeptide
DEQEIATTNPVATEQYGISVSATDLEDHEGEDL

SEQ ID NO: 112084 - protein, 32 aa, Artificial Sequence
  Description of Artificial Sequence: Synthetic polypeptide
DEQEIATTNPVATEQYGHVSTTDLEDHEGEDL

SEQ ID NO: 112085 - protein, 33 aa, Artificial Sequence
  Description of Artificial Sequence: Synthetic polypeptide
DEQEIATTNPVATEQYGESVSATDLEDHEGEDL

SEQ ID NO: 112086 - protein, 32 aa, Artificial Sequence
  Description of Artificial Sequence: Synthetic polypeptide
DEQEIATTNPVATEQYGEASATVLQDHEGEDL

SEQ ID NO: 112087 - protein, 32 aa, Artificial Sequence
  Description of Artificial Sequence: Synthetic polypeptide
DEQEIATTNPVATEQYGEASATDLQDHEGEDL

SEQ ID NO: 112088 - protein, 30 aa, Artificial Sequence
  Description of Artificial Sequence: Synthetic polypeptide
DESEIRTTNPVATEQWGDVSEIETNAAEDA

SEQ ID NO: 112089 - protein, 32 aa, Artificial Sequence
  Description of Artificial Sequence: Synthetic polypeptide
DESEIRTTNPVATEQWGDVSENEPQNAAEENA

SEQ ID NO: 112090 - protein, 29 aa, Artificial Sequence
  Description of Artificial Sequence: Synthetic peptide
QENEIATTNPVATEPYGDVSECIQQHENL

SEQ ID NO: 112091 - protein, 30 aa, Artificial Sequence
  Description of Artificial Sequence: Synthetic polypeptide
DESEIRTTNPVATEQWGDVSETEMNAAEDA

SEQ ID NO: 112092 - protein, 29 aa, Artificial Sequence
  Description of Artificial Sequence: Synthetic peptide
QENEIATTNPVATEPYGDVSIECLQHEEL

SEQ ID NO: 112093 - protein, 30 aa, Artificial Sequence
  Description of Artificial Sequence: Synthetic polypeptide
QENEIATTNPVATEPYGDVSMECIQQHGNL

SEQ ID NO: 112094 - protein, 30 aa, Artificial Sequence
  Description of Artificial Sequence: Synthetic polypeptide
DESEIRTTNPVATEQWGDVSETIMNAAEDA

SEQ ID NO: 112095 - protein, 30 aa, Artificial Sequence
  Description of Artificial Sequence: Synthetic polypeptide
DESEIRTTNPVATEQWGDVSSIEMNAAGDA

SEQ ID NO: 112096 - protein, 32 aa, Artificial Sequence
  Description of Artificial Sequence: Synthetic polypeptide
DEQEIATTNPVATEQYGCVAATNLDDNNNNEE

SEQ ID NO: 112097 - protein, 31 aa, Artificial Sequence
  Description of Artificial Sequence: Synthetic polypeptide
DEQEIATTNPVATEQYGCVAANNPADSGNEH

SEQ ID NO: 112098 - protein, 29 aa, Artificial Sequence
  Description of Artificial Sequence: Synthetic peptide
QENEIATTNPVATEPYGNVSAPLQHPEQL

SEQ ID NO: 112099 - protein, 29 aa, Artificial Sequence
  Description of Artificial Sequence: Synthetic peptide
QENEIATTNPVATEPYGNVSGHLQHDDQN

SEQ ID NO: 112100 - protein, 32 aa, Artificial Sequence
  Description of Artificial Sequence: Synthetic polypeptide
DEQEIATTNPVATEQYGCVAANNNQDSGNDNH

SEQ ID NO: 112101 - protein, 32 aa, Artificial Sequence
  Description of Artificial Sequence: Synthetic polypeptide
DEQEIATTNPVATEQYGCVAANNLQDGHPIEE

SEQ ID NO: 112102 - protein, 32 aa, Artificial Sequence
  Description of Artificial Sequence: Synthetic polypeptide
DEQEIATTNPVATEQYGCVAANNGLTDAENRP

SEQ ID NO: 112103 - protein, 29 aa, Artificial Sequence
  Description of Artificial Sequence: Synthetic peptide
QENEIATTNPVATEPYGNVSGHLQHWDDL

SEQ ID NO: 112104 - protein, 29 aa, Artificial Sequence
  Description of Artificial Sequence: Synthetic peptide
QENEIATTNPVATEPYGTISECLQQHENL

SEQ ID NO: 112105 - protein, 31 aa, Artificial Sequence
  Description of Artificial Sequence: Synthetic polypeptide
QENEIATTNPVATEPYGTVSEGLSQHEGENL

SEQ ID NO: 112106 - protein, 29 aa, Artificial Sequence
  Description of Artificial Sequence: Synthetic peptide
QENEIATTNPVATEPYGTVSEHLSQHEEL

SEQ ID NO: 112107 - protein, 28 aa, Artificial Sequence
  Description of Artificial Sequence: Synthetic peptide
QENEIATTNPVATEQWGDVSECEQAEDA

SEQ ID NO: 112108 - protein, 33 aa, Artificial Sequence
  Description of Artificial Sequence: Synthetic polypeptide
DEQEIATTNPVATEQYGCVAANGDQTDGGNPRQ

SEQ ID NO: 112109 - protein, 32 aa, Artificial Sequence
  Description of Artificial Sequence: Synthetic polypeptide
DEQEIATTNPVATEQYGCVAANGDQNTDGNPT

SEQ ID NO: 112110 - protein, 31 aa, Artificial Sequence
  Description of Artificial Sequence: Synthetic polypeptide
DESEIRTTNPVATEQWGKVSEIEMNAAEDNA

SEQ ID NO: 112111 - protein, 33 aa, Artificial Sequence
  Description of Artificial Sequence: Synthetic polypeptide
DEQEIATTNPVATEQYGCSVSATDLEDHEGSDL

SEQ ID NO: 112112 - protein, 30 aa, Artificial Sequence
  Description of Artificial Sequence: Synthetic polypeptide
DESEIRTTNPVATEQWGLVSWIEMRAAEDA

SEQ ID NO: 112113 - protein, 32 aa, Artificial Sequence
  Description of Artificial Sequence: Synthetic polypeptide
DEQEIATTNPVATEQYGCVATNLTQENIDEAV

SEQ ID NO: 112114 - protein, 29 aa, Artificial Sequence
  Description of Artificial Sequence: Synthetic peptide
QENEIATTNPVATEPYGDVSAPLQHEEEL

SEQ ID NO: 112115 - protein, 32 aa, Artificial Sequence
  Description of Artificial Sequence: Synthetic polypeptide
DEQEIATTNPVATEQYGCVSATDLEDHEGEDK

SEQ ID NO: 112116 - protein, 29 aa, Artificial Sequence
  Description of Artificial Sequence: Synthetic peptide
DESEIRTTNPVATEQWGDVSEIEMAAEDI

SEQ ID NO: 112117 - protein, 28 aa, Artificial Sequence
  Description of Artificial Sequence: Synthetic peptide
QEEEIATTNPCATEQYGEAPEVCQHEER

SEQ ID NO: 112118 - protein, 31 aa, Artificial Sequence
  Description of Artificial Sequence: Synthetic polypeptide
DEQEIATTNPVATEQYGEASAEVLQDHEGEK

SEQ ID NO: 112119 - protein, 31 aa, Artificial Sequence
  Description of Artificial Sequence: Synthetic polypeptide
DEQEIATTNPVATEQYGDVSTDLMNHEEEDL

SEQ ID NO: 112120 - protein, 31 aa, Artificial Sequence
  Description of Artificial Sequence: Synthetic polypeptide
DEQEIATTNPVATEQYGDVSTDLMNHEEEDA

SEQ ID NO: 112121 - protein, 29 aa, Artificial Sequence
  Description of Artificial Sequence: Synthetic peptide
QENEIATTNPVATEIYGCVSWELQHSELM

SEQ ID NO: 112122 - protein, 31 aa, Artificial Sequence
  Description of Artificial Sequence: Synthetic polypeptide
DEQEIATTNPVATEQYGDVSTDLEDHEEEDL

SEQ ID NO: 112123 - protein, 29 aa, Artificial Sequence
  Description of Artificial Sequence: Synthetic peptide
DESEIRTTNPVATEQWGDVAEIEQAAEDA

SEQ ID NO: 112124 - protein, 32 aa, Artificial Sequence
  Description of Artificial Sequence: Synthetic polypeptide
DEQEIATTNPVATEQYGDVSGTDLEDHMGEDL

SEQ ID NO: 112125 - protein, 28 aa, Artificial Sequence
  Description of Artificial Sequence: Synthetic peptide
QENEIATTNPVATEKYGDVMECLQHEEL

SEQ ID NO: 112126 - protein, 29 aa, Artificial Sequence
  Description of Artificial Sequence: Synthetic peptide
DESEIRTTNPVATEQWGDVAETEQAAEDA

SEQ ID NO: 112127 - protein, 31 aa, Artificial Sequence
  Description of Artificial Sequence: Synthetic polypeptide
DEQEIATTNPVATEQYGDVSATDLMNHEEDA

SEQ ID NO: 112128 - protein, 31 aa, Artificial Sequence
  Description of Artificial Sequence: Synthetic polypeptide
DEQEIATTNPVATEQYGDVSATDLENHEEDA

SEQ ID NO: 112129 - protein, 32 aa, Artificial Sequence
  Description of Artificial Sequence: Synthetic polypeptide
DEQEIATTNPVATEQYGLVSYTDLEDHNEEDL

SEQ ID NO: 112130 - protein, 32 aa, Artificial Sequence
  Description of Artificial Sequence: Synthetic polypeptide
DEQEIATTNPVATEQYGDVSATDLEDHEGEDL

SEQ ID NO: 112131 - protein, 33 aa, Artificial Sequence
  Description of Artificial Sequence: Synthetic polypeptide
DESEIRTTNPVATEQWGDVSCINEPQDAEGENG

SEQ ID NO: 112132 - protein, 32 aa, Artificial Sequence
  Description of Artificial Sequence: Synthetic polypeptide
DEQEIATTNPVATEQYGDVSATCLEDHEGEDL

SEQ ID NO: 112133 - protein, 32 aa, Artificial Sequence
  Description of Artificial Sequence: Synthetic polypeptide
DEQEIATTNPVATEQYGCVSVTDLEDHSGEDQ

SEQ ID NO: 112134 - protein, 32 aa, Artificial Sequence
  Description of Artificial Sequence: Synthetic polypeptide
DEQEIATTNPVATEQYGCVSATGLFDHQGEDL

SEQ ID NO: 112135 - protein, 32 aa, Artificial Sequence
  Description of Artificial Sequence: Synthetic polypeptide
DEQEIATTNPVATEQYGCVSATGLEDHGGEDQ

SEQ ID NO: 112136 - protein, 32 aa, Artificial Sequence
  Description of Artificial Sequence: Synthetic polypeptide
DEQEIATTNPVATEQYGCVSATDLEDHSGEDL

SEQ ID NO: 112137 - protein, 28 aa, Artificial Sequence
  Description of Artificial Sequence: Synthetic peptide
QEEEIATTNPCATEQYGEAPENCQHEEK

SEQ ID NO: 112138 - protein, 32 aa, Artificial Sequence
  Description of Artificial Sequence: Synthetic polypeptide
DEQEIATTNPVATEQYGCVSATDLEDHEGEDS

SEQ ID NO: 112139 - protein, 29 aa, Artificial Sequence
  Description of Artificial Sequence: Synthetic peptide
DESEIRTTNPVATEQWGDVSEIEMAAEDA

SEQ ID NO: 112140 - protein, 29 aa, Artificial Sequence
  Description of Artificial Sequence: Synthetic peptide
QENEIATTNPVATEPYGDCVSECLQHEEL

SEQ ID NO: 112141 - protein, 32 aa, Artificial Sequence
  Description of Artificial Sequence: Synthetic polypeptide
DEQEIATTNPVATEQYGCVSATDLEDHEGEDL

SEQ ID NO: 112142 - protein, 29 aa, Artificial Sequence
  Description of Artificial Sequence: Synthetic peptide
QENEIATTNPVATEPYGDISECLQQHENL

SEQ ID NO: 112143 - protein, 31 aa, Artificial Sequence
  Description of Artificial Sequence: Synthetic polypeptide
DEQEIATTNPVATEQYGDVSATDEEDHEGEL

SEQ ID NO: 112144 - protein, 28 aa, Artificial Sequence
  Description of Artificial Sequence: Synthetic peptide
QEEEIASTNPIATEQYGSMAETLMHGDI

SEQ ID NO: 112145 - protein, 33 aa, Artificial Sequence
  Description of Artificial Sequence: Synthetic polypeptide
DEQEIATTNPVATEQYGMSVSATDLEDHEGEDL

SEQ ID NO: 112146 - protein, 28 aa, Artificial Sequence
  Description of Artificial Sequence: Synthetic peptide
QEEEIATTNPIATEQYGEASEVCMHENK

SEQ ID NO: 112147 - protein, 33 aa, Artificial Sequence
  Description of Artificial Sequence: Synthetic polypeptide
DEQEIATTNPVATEQYGSISATDLEDHEGNEDL

SEQ ID NO: 112148 - protein, 32 aa, Artificial Sequence
  Description of Artificial Sequence: Synthetic polypeptide
DEQEIATTNPVATEQYGSISATDLEDHEGEDL

SEQ ID NO: 112149 - protein, 32 aa, Artificial Sequence
  Description of Artificial Sequence: Synthetic polypeptide
DEQEIATTNPVATEQYGSISATDLEDHEGEDH

SEQ ID NO: 112150 - protein, 29 aa, Artificial Sequence
  Description of Artificial Sequence: Synthetic peptide
QENEIATTNPVATECYGTVSMECLQHEEH

SEQ ID NO: 112151 - protein, 33 aa, Artificial Sequence
  Description of Artificial Sequence: Synthetic polypeptide
DEQEIATTNPVATEQYGSHVSATDLEDHEGEDL

SEQ ID NO: 112152 - protein, 32 aa, Artificial Sequence
  Description of Artificial Sequence: Synthetic polypeptide
DEQEIATTNPVATEQYGSHSATGLEDHEGEDL

SEQ ID NO: 112153 - protein, 32 aa, Artificial Sequence
  Description of Artificial Sequence: Synthetic polypeptide
DEQEIATTNPVATEQYGSHSATDLEDHEGEPL

SEQ ID NO: 112154 - protein, 32 aa, Artificial Sequence
  Description of Artificial Sequence: Synthetic polypeptide
DEQEIATTNPVATEQYGSHSATDLEDHEGEDL

SEQ ID NO: 112155 - protein, 28 aa, Artificial Sequence
  Description of Artificial Sequence: Synthetic peptide
QEEEIATTNPVATECYGEASECCQHEEL

SEQ ID NO: 112156 - protein, 29 aa, Artificial Sequence
  Description of Artificial Sequence: Synthetic peptide
QENEIATTNPVATECYGTVSMELQHQEEL

SEQ ID NO: 112157 - protein, 33 aa, Artificial Sequence
  Description of Artificial Sequence: Synthetic polypeptide
DEQEIATTNPVATEQYGSGVSLTDLEDHEGEDL

SEQ ID NO: 112158 - protein, 33 aa, Artificial Sequence
  Description of Artificial Sequence: Synthetic polypeptide
DEQEIATTNPVATEQYGSGVSATDLWDHEGEDL

SEQ ID NO: 112159 - protein, 33 aa, Artificial Sequence
  Description of Artificial Sequence: Synthetic polypeptide
DEQEIATTNPVATEQYGSGVSATDLEVHEGEDL

SEQ ID NO: 112160 - protein, 33 aa, Artificial Sequence
  Description of Artificial Sequence: Synthetic polypeptide
DEQEIATTNPVATEQYGSGVSATDLEDHEGEDL

SEQ ID NO: 112161 - protein, 28 aa, Artificial Sequence
  Description of Artificial Sequence: Synthetic peptide
QEEEIATTNPVATECYGEASECCQHEEK

SEQ ID NO: 112162 - protein, 32 aa, Artificial Sequence
  Description of Artificial Sequence: Synthetic polypeptide
DEQEIATTNPVATEQYGSGSATDLEDHSGEDL

SEQ ID NO: 112163 - protein, 30 aa, Artificial Sequence
  Description of Artificial Sequence: Synthetic polypeptide
QENEIATTNPVATECYGTVSTDCPQFEGEL

SEQ ID NO: 112164 - protein, 32 aa, Artificial Sequence
  Description of Artificial Sequence: Synthetic polypeptide
DEQEIATTNPVATEQYGSGSATDLEDHEGEDL

SEQ ID NO: 112165 - protein, 33 aa, Artificial Sequence
  Description of Artificial Sequence: Synthetic polypeptide
DEQEIATTNPVATEQYGSFVSATDLEDHEGGDL

SEQ ID NO: 112166 - protein, 33 aa, Artificial Sequence
  Description of Artificial Sequence: Synthetic polypeptide
DEQEIATTNPVATEQYGSFVSATDLEDHEGEML

SEQ ID NO: 112167 - protein, 28 aa, Artificial Sequence
  Description of Artificial Sequence: Synthetic peptide
QENEIATTNPVATECYGVMSETLQHEEI

SEQ ID NO: 112168 - protein, 33 aa, Artificial Sequence
  Description of Artificial Sequence: Synthetic polypeptide
DEQEIATTNPVATEQYGSFVSATDLEDHEGEDL

SEQ ID NO: 112169 - protein, 28 aa, Artificial Sequence
  Description of Artificial Sequence: Synthetic peptide
QEEEIATTNPVATECYGEAPEVCQHGEK

SEQ ID NO: 112170 - protein, 33 aa, Artificial Sequence
  Description of Artificial Sequence: Synthetic polypeptide
DEQEIATTNPVATEQYGSFVSATDLEDHEGAYL

SEQ ID NO: 112171 - protein, 28 aa, Artificial Sequence
  Description of Artificial Sequence: Synthetic peptide
QENEIATTNPVATECYGVMSETLQHEEL

SEQ ID NO: 112172 - protein, 33 aa, Artificial Sequence
  Description of Artificial Sequence: Synthetic polypeptide
QEEEIATTNPVATECYGEVSCINEPQDREGENG

SEQ ID NO: 112173 - protein, 32 aa, Artificial Sequence
  Description of Artificial Sequence: Synthetic polypeptide
DEQEIATTNPVATEQYGSFSATDLEDHEGEDL

SEQ ID NO: 112174 - protein, 29 aa, Artificial Sequence
  Description of Artificial Sequence: Synthetic peptide
QEEEIATTNPVATECYGEVSEVEQHEEEK

SEQ ID NO: 112175 - protein, 30 aa, Artificial Sequence
  Description of Artificial Sequence: Synthetic polypeptide
QENEIATTNPVATECYGTVSEDCLQHEGEL

SEQ ID NO: 112176 - protein, 32 aa, Artificial Sequence
  Description of Artificial Sequence: Synthetic polypeptide
DEQEIATTNPVATEQYGSMSATDLEDHEGEDL

SEQ ID NO: 112177 - protein, 32 aa, Artificial Sequence
  Description of Artificial Sequence: Synthetic polypeptide
DEQEIATTNPVATEQYGSMAATDLQDHEGEDL

SEQ ID NO: 112178 - protein, 29 aa, Artificial Sequence
  Description of Artificial Sequence: Synthetic peptide
QENEIATTNPVATECYGTVSATCLEHEEL

SEQ ID NO: 112179 - protein, 34 aa, Artificial Sequence
  Description of Artificial Sequence: Synthetic polypeptide
DESEIRTTNPVATENWSGSVSCINEPQDREGENG

SEQ ID NO: 112180 - protein, 32 aa, Artificial Sequence
  Description of Artificial Sequence: Synthetic polypeptide
DEQEIATTNPVATEQYGSMAATDLQDHEGDDI

SEQ ID NO: 112181 - protein, 33 aa, Artificial Sequence
  Description of Artificial Sequence: Synthetic polypeptide
DESEIRTTNPVATEPWGSISCENEPQDREGENH

SEQ ID NO: 112182 - protein, 33 aa, Artificial Sequence
  Description of Artificial Sequence: Synthetic polypeptide
DESEIRTTNPVATEPWGSISCENEPQQREGENH

SEQ ID NO: 112183 - protein, 29 aa, Artificial Sequence
  Description of Artificial Sequence: Synthetic peptide
QENEIATTNPVATECYGTVSCEPLQHEEL

SEQ ID NO: 112184 - protein, 33 aa, Artificial Sequence
  Description of Artificial Sequence: Synthetic polypeptide
DESEIRTTNPVATEPWGSISCINEPQDREGENG

SEQ ID NO: 112185 - protein, 33 aa, Artificial Sequence
  Description of Artificial Sequence: Synthetic polypeptide
DEQEIATTNPVATEQYGSLVSQTDLEDHEGEDL

SEQ ID NO: 112186 - protein, 34 aa, Artificial Sequence
  Description of Artificial Sequence: Synthetic polypeptide
DEQEIATTNPVATEQYGSLVSATDLQEDHEGEDL

SEQ ID NO: 112187 - protein, 33 aa, Artificial Sequence
  Description of Artificial Sequence: Synthetic polypeptide
DEQEIATTNPVATEQYGSLVSATDLEDHLGEDL

SEQ ID NO: 112188 - protein, 33 aa, Artificial Sequence
  Description of Artificial Sequence: Synthetic polypeptide
DEQEIATTNPVATEQYGSLVSATDLEDHEGEDL

SEQ ID NO: 112189 - protein, 29 aa, Artificial Sequence
  Description of Artificial Sequence: Synthetic peptide
QENEIATTNPVATECYGTVSECCLQHEEL

SEQ ID NO: 112190 - protein, 32 aa, Artificial Sequence
  Description of Artificial Sequence: Synthetic polypeptide
DEQEIATTNPVATEQYGSLSATDLEDHEGEDL

SEQ ID NO: 112191 - protein, 33 aa, Artificial Sequence
  Description of Artificial Sequence: Synthetic polypeptide
DEQEIATTNPVATEQYGSKVSATDLEDHVGEDL

SEQ ID NO: 112192 - protein, 33 aa, Artificial Sequence
  Description of Artificial Sequence: Synthetic polypeptide
DEQEIATTNPVATEQYGSKVSATDLEDHEGEKL

SEQ ID NO: 112193 - protein, 33 aa, Artificial Sequence
  Description of Artificial Sequence: Synthetic polypeptide
DESEIRTTNPVATEPWGSISCINEQQDREGENG

SEQ ID NO: 112194 - protein, 32 aa, Artificial Sequence
  Description of Artificial Sequence: Synthetic polypeptide
DEQEIATTNPVATEQYGSKSATILEDHEGEDL

SEQ ID NO: 112195 - protein, 32 aa, Artificial Sequence
  Description of Artificial Sequence: Synthetic polypeptide
DESEIRTTNPVATEPWGSISMINIQQQQNGNG

SEQ ID NO: 112196 - protein, 33 aa, Artificial Sequence
  Description of Artificial Sequence: Synthetic polypeptide
DEQEIATTNPVATEQYGSIVSATDLEDHEGEDL

SEQ ID NO: 112197 - protein, 33 aa, Artificial Sequence
  Description of Artificial Sequence: Synthetic polypeptide
DESEIRTTNPVATEPWGSISMINIQQQRNGENG

SEQ ID NO: 112198 - protein, 34 aa, Artificial Sequence
  Description of Artificial Sequence: Synthetic polypeptide
DESEIRTTNPVATEPWGSTVSCPNEPQDREGGNG

SEQ ID NO: 112199 - protein, 29 aa, Artificial Sequence
  Description of Artificial Sequence: Synthetic peptide
QENEIATTNPVATECYGTVSECLQSHEEL

SEQ ID NO: 112200 - protein, 34 aa, Artificial Sequence
  Description of Artificial Sequence: Synthetic polypeptide
DESEIRTTNPVATEPWGSVPSCINESQDREGGNG

SEQ ID NO: 112201 - protein, 32 aa, Artificial Sequence
  Description of Artificial Sequence: Synthetic polypeptide
DEQEIATTNPVATEQYGSISATDLYDHEGEDL

SEQ ID NO: 112202 - protein, 33 aa, Artificial Sequence
  Description of Artificial Sequence: Synthetic polypeptide
DESEIRTTNPVATEPWGSVSMINEQQDQEGENG

SEQ ID NO: 112203 - protein, 28 aa, Artificial Sequence
  Description of Artificial Sequence: Synthetic peptide
QENEIATTNPVATECYGVMSSTLQHEEI

SEQ ID NO: 112204 - protein, 33 aa, Artificial Sequence
  Description of Artificial Sequence: Synthetic polypeptide
DEQEIATTNPVATEQYGSCVSATDLEDHEGEDL

SEQ ID NO: 112205 - protein, 32 aa, Artificial Sequence
  Description of Artificial Sequence: Synthetic polypeptide
DEQEIATTNPVATEQYGSASATDLEDHEGEDL

SEQ ID NO: 112206 - protein, 32 aa, Artificial Sequence
  Description of Artificial Sequence: Synthetic polypeptide
CEDEIACTNPVATEQYGSVATNLQGAIAEAND

SEQ ID NO: 112207 - protein, 28 aa, Artificial Sequence
  Description of Artificial Sequence: Synthetic peptide
QEEEIATTNPVASEQYGEVPEVCQSEEK

SEQ ID NO: 112208 - protein, 33 aa, Artificial Sequence
  Description of Artificial Sequence: Synthetic polypeptide
DEQEIATTNPVATEQYGRVSATFLQDHDGEDLH

SEQ ID NO: 112209 - protein, 32 aa, Artificial Sequence
  Description of Artificial Sequence: Synthetic polypeptide
DEQEIATTNPVATEQYGRVSATDLHDHEGEDL

SEQ ID NO: 112210 - protein, 32 aa, Artificial Sequence
  Description of Artificial Sequence: Synthetic polypeptide
DEQEIATTNPVATEQYGRVSATDLEDHEGEDL

SEQ ID NO: 112211 - protein, 32 aa, Artificial Sequence
  Description of Artificial Sequence: Synthetic polypeptide
DEQEIATTNPVATEQYGRVSATDLEDFEGEDL

SEQ ID NO: 112212 - protein, 33 aa, Artificial Sequence
  Description of Artificial Sequence: Synthetic polypeptide
DEQEIATTNPVATEQYGRSVSATPLEDHEGEDL

SEQ ID NO: 112213 - protein, 28 aa, Artificial Sequence
  Description of Artificial Sequence: Synthetic peptide
QENEIATTNPVATEFYGDVSVQGQHEEL

SEQ ID NO: 112214 - protein, 29 aa, Artificial Sequence
  Description of Artificial Sequence: Synthetic peptide
QENEIATTNPVATEGYGCVCSEELQHIEL

SEQ ID NO: 112215 - protein, 33 aa, Artificial Sequence
  Description of Artificial Sequence: Synthetic polypeptide
DEQEIATTNPVATEQYGRSVSATDLEDHEGEDL

SEQ ID NO: 112216 - protein, 29 aa, Artificial Sequence
  Description of Artificial Sequence: Synthetic peptide
QENEIATTNPVATEGYGCVSAPLQHESEL

SEQ ID NO: 112217 - protein, 29 aa, Artificial Sequence
  Description of Artificial Sequence: Synthetic peptide
QENEIATTNPVATEGYGCVSNWELQHIEL

SEQ ID NO: 112218 - protein, 32 aa, Artificial Sequence
  Description of Artificial Sequence: Synthetic polypeptide
DEQEIATTNPVATEQYGQVSATDLEDHEGEDL

SEQ ID NO: 112219 - protein, 33 aa, Artificial Sequence
  Description of Artificial Sequence: Synthetic polypeptide
DEQEIATTNPVATEQYGQSVSATDLEDHEGEDL

SEQ ID NO: 112220 - protein, 32 aa, Artificial Sequence
  Description of Artificial Sequence: Synthetic polypeptide
DEQEIATTNPVATEQYGNVSATTLEDHEGEDL

SEQ ID NO: 112221 - protein, 32 aa, Artificial Sequence
  Description of Artificial Sequence: Synthetic polypeptide
DEQEIATTNPVATEQYGNVSATDLESHEGEDL

SEQ ID NO: 112222 - protein, 29 aa, Artificial Sequence
  Description of Artificial Sequence: Synthetic peptide
QENEIATTNPVATEGYGCVSSPLQHFIEL

SEQ ID NO: 112223 - protein, 32 aa, Artificial Sequence
  Description of Artificial Sequence: Synthetic polypeptide
DEQEIATTNPVATEQYGNVSATDLEDHEGEDL

SEQ ID NO: 112224 - protein, 33 aa, Artificial Sequence
  Description of Artificial Sequence: Synthetic polypeptide
DEQEIATTNPVATEQYGNSVSATDLEKHEGEDL

SEQ ID NO: 112225 - protein, 33 aa, Artificial Sequence
  Description of Artificial Sequence: Synthetic polypeptide
DEQEIATTNPVATEQYGNSVSATDLEDMEGEDL

SEQ ID NO: 112226 - protein, 33 aa, Artificial Sequence
  Description of Artificial Sequence: Synthetic polypeptide
DEQEIATTNPVATEQYGNSVSATDLEDHEREDL

SEQ ID NO: 112227 - protein, 29 aa, Artificial Sequence
  Description of Artificial Sequence: Synthetic peptide
QENEIATTNPVATEGYGCVSWGELQHSEL

SEQ ID NO: 112228 - protein, 33 aa, Artificial Sequence
  Description of Artificial Sequence: Synthetic polypeptide
DEQEIATTNPVATEQYGNSVSATDLEDHEGEDL

SEQ ID NO: 112229 - protein, 32 aa, Artificial Sequence
  Description of Artificial Sequence: Synthetic polypeptide
DEQEIATTNPVATEQYGMVSATDLYDHEGEDL

SEQ ID NO: 112230 - protein, 29 aa, Artificial Sequence
  Description of Artificial Sequence: Synthetic peptide
QENEIATTNPVATECYGYVSECQLQHEEL

SEQ ID NO: 112231 - protein, 32 aa, Artificial Sequence
  Description of Artificial Sequence: Synthetic polypeptide
DEQEIATTNPVATEQYGSASATVLEDHEGEDL

SEQ ID NO: 112232 - protein, 32 aa, Artificial Sequence
  Description of Artificial Sequence: Synthetic polypeptide
QEEEIATTNPVATAQWGSVSVAGNPDEAGNRN

SEQ ID NO: 112233 - protein, 29 aa, Artificial Sequence
  Description of Artificial Sequence: Synthetic peptide
QEEEIATTNPVATECWGSVPCNCQHEEEG

SEQ ID NO: 112234 - protein, 33 aa, Artificial Sequence
  Description of Artificial Sequence: Synthetic polypeptide
DEQEIATTNPVATEQYGSCVSATDLEDHEGEDG

SEQ ID NO: 112235 - protein, 32 aa, Artificial Sequence
  Description of Artificial Sequence: Synthetic polypeptide
DEQEIATTNPVATEQYGSCSATDNNDHEGEDH

SEQ ID NO: 112236 - protein, 32 aa, Artificial Sequence
  Description of Artificial Sequence: Synthetic polypeptide
DEQEIATTNPVATEQYGSCSATDNEDHKGEDL

SEQ ID NO: 112237 - protein, 32 aa, Artificial Sequence
  Description of Artificial Sequence: Synthetic polypeptide
DEQEIATTNPVATEQYGSCSATDLNDHVGEDL

SEQ ID NO: 112238 - protein, 32 aa, Artificial Sequence
  Description of Artificial Sequence: Synthetic polypeptide
DEQEIATTNPVATEQYGSCSATDLFDHEGEDL

SEQ ID NO: 112239 - protein, 32 aa, Artificial Sequence
  Description of Artificial Sequence: Synthetic polypeptide
DEQEIATTNPVATEQYGSCSATDLEDHPGEDQ

SEQ ID NO: 112240 - protein, 32 aa, Artificial Sequence
  Description of Artificial Sequence: Synthetic polypeptide
DEQEIATTNPVATEQYGSCSATDLEDHNGQDL

SEQ ID NO: 112241 - protein, 32 aa, Artificial Sequence
  Description of Artificial Sequence: Synthetic polypeptide
DEQEIATTNPVATEQYGSCSATDLEDHEGEDS

SEQ ID NO: 112242 - protein, 32 aa, Artificial Sequence
  Description of Artificial Sequence: Synthetic polypeptide
DEQEIATTNPVATEQYGSCSATDLEDHEGEDL

SEQ ID NO: 112243 - protein, 28 aa, Artificial Sequence
  Description of Artificial Sequence: Synthetic peptide
QENEIATTNPVATECYGVMSSTLQHEEL

SEQ ID NO: 112244 - protein, 28 aa, Artificial Sequence
  Description of Artificial Sequence: Synthetic peptide
QEEEIATTNPVATECYGEAPECLQHEEL

SEQ ID NO: 112245 - protein, 29 aa, Artificial Sequence
  Description of Artificial Sequence: Synthetic peptide
QENEIATTNPVATECYGVVSAALQHEEGL

SEQ ID NO: 112246 - protein, 32 aa, Artificial Sequence
  Description of Artificial Sequence: Synthetic polypeptide
DEQEIATTNPVATEQYGMVSATDLEDHEGEDL

SEQ ID NO: 112247 - protein, 33 aa, Artificial Sequence
  Description of Artificial Sequence: Synthetic polypeptide
DEQEIATTNPVATEQYGSAVSATDLVDHEGEDL

SEQ ID NO: 112248 - protein, 31 aa, Artificial Sequence
  Description of Artificial Sequence: Synthetic polypeptide
QEEEIATTNPVATECYGDVSTTCLPQHEMEV

SEQ ID NO: 112249 - protein, 32 aa, Artificial Sequence
  Description of Artificial Sequence: Synthetic polypeptide
QEEEIATTNPVATECYGDVSSTTALQHEMNPV

SEQ ID NO: 112250 - protein, 33 aa, Artificial Sequence
  Description of Artificial Sequence: Synthetic polypeptide
DEQEIATTNPVATEQYGSAVSATDLEDHEGEDL

SEQ ID NO: 112251 - protein, 35 aa, Artificial Sequence
  Description of Artificial Sequence: Synthetic polypeptide
AEEEIRTTNPVATEQYGSVVTVTNLQQNDENNNNS

SEQ ID NO: 112252 - protein, 28 aa, Artificial Sequence
  Description of Artificial Sequence: Synthetic peptide
QENEIATTNPVATECYGVVSECLYHEEL

SEQ ID NO: 112253 - protein, 32 aa, Artificial Sequence
  Description of Artificial Sequence: Synthetic polypeptide
DEQEIATTNPVATEQYGSASPTDLEDHEGEDL

SEQ ID NO: 112254 - protein, 32 aa, Artificial Sequence
  Description of Artificial Sequence: Synthetic polypeptide
DEQEIATTNPVATEQYGSASATYLEDHEGEDL

SEQ ID NO: 112255 - protein, 29 aa, Artificial Sequence
  Description of Artificial Sequence: Synthetic peptide
QENEIATTNPVATECYGVVSEGLQQHEEL

SEQ ID NO: 112256 - protein, 28 aa, Artificial Sequence
  Description of Artificial Sequence: Synthetic peptide
QENEIATTNPVATECYGVVSEHGQHEEL

SEQ ID NO: 112257 - protein, 29 aa, Artificial Sequence
  Description of Artificial Sequence: Synthetic peptide
QENEIATTNPVATECYGVVSPVLVQHEEL

SEQ ID NO: 112258 - protein, 29 aa, Artificial Sequence
  Description of Artificial Sequence: Synthetic peptide
QENEIATTNPVATECYGVVSSALQHEELM

SEQ ID NO: 112259 - protein, 29 aa, Artificial Sequence
  Description of Artificial Sequence: Synthetic peptide
QENEIATTNPVATECYGWVMSECLQHEEL

SEQ ID NO: 112260 - protein, 29 aa, Artificial Sequence
  Description of Artificial Sequence: Synthetic peptide
QENEIATTNPVATECYGVVSEALQHPEEL

SEQ ID NO: 112261 - protein, 28 aa, Artificial Sequence
  Description of Artificial Sequence: Synthetic peptide
QDGEIASTNPCSSEQYGNVSCNLQSGTR

SEQ ID NO: 112262 - protein, 34 aa, Artificial Sequence
  Description of Artificial Sequence: Synthetic polypeptide
DEPEIRTTNPVATEQYGSVITNTNTGQGEGQDGN

SEQ ID NO: 112263 - protein, 34 aa, Artificial Sequence
  Description of Artificial Sequence: Synthetic polypeptide
DEPEIRTTNPVATEQYGSVITDNNTGQGEGGQEI

SEQ ID NO: 112264 - protein, 29 aa, Artificial Sequence
  Description of Artificial Sequence: Synthetic peptide
QESEIATTNPVATECYGSASCVCQHEENK

SEQ ID NO: 112265 - protein, 35 aa, Artificial Sequence
  Description of Artificial Sequence: Synthetic polypeptide
DESEIRTTNPVATEQYGSVSCTGNQSPSTGTKNIV

SEQ ID NO: 112266 - protein, 29 aa, Artificial Sequence
  Description of Artificial Sequence: Synthetic peptide
QESEIATTNPVATECYGSVPENEQHEEEK

SEQ ID NO: 112267 - protein, 34 aa, Artificial Sequence
  Description of Artificial Sequence: Synthetic polypeptide
DESEIRTTNPVATEQYGSVSDWANLEDERDEVII

SEQ ID NO: 112268 - protein, 33 aa, Artificial Sequence
  Description of Artificial Sequence: Synthetic polypeptide
QESEIATTNPVATECYGSVSCINEPQDREGENG

SEQ ID NO: 112269 - protein, 32 aa, Artificial Sequence
  Description of Artificial Sequence: Synthetic polypeptide
QESEIATTNPVATECYGSVSCINEQDSEGENG

SEQ ID NO: 112270 - protein, 30 aa, Artificial Sequence
  Description of Artificial Sequence: Synthetic polypeptide
QECEICTTNPVATESYGVVSTELLQHEEQL

SEQ ID NO: 112271 - protein, 31 aa, Artificial Sequence
  Description of Artificial Sequence: Synthetic polypeptide
QESEIATTNPVATECYGSVSCVCPQREEENG

SEQ ID NO: 112272 - protein, 35 aa, Artificial Sequence
  Description of Artificial Sequence: Synthetic polypeptide
DESEIRTTNPVATEQYGSVSDWNLEDERDEVVIRT

SEQ ID NO: 112273 - protein, 29 aa, Artificial Sequence
  Description of Artificial Sequence: Synthetic peptide
QECEICTTNPVATESYGVVSEQLQLEELG

SEQ ID NO: 112274 - protein, 29 aa, Artificial Sequence
  Description of Artificial Sequence: Synthetic peptide
QECEICTTNPVATESYGVVSELLQNEETL

SEQ ID NO: 112275 - protein, 34 aa, Artificial Sequence
  Description of Artificial Sequence: Synthetic polypeptide
DENEIRTTNPVATEQYGTVSSMEAIPNQRNGNPH

SEQ ID NO: 112276 - protein, 28 aa, Artificial Sequence
  Description of Artificial Sequence: Synthetic peptide
QESEIATTNPVATECYGVMSSCLQHEEI

SEQ ID NO: 112277 - protein, 30 aa, Artificial Sequence
  Description of Artificial Sequence: Synthetic polypeptide
DENEIRTTNPVATEQYGTVSEIPENFEEDA

SEQ ID NO: 112278 - protein, 28 aa, Artificial Sequence
  Description of Artificial Sequence: Synthetic peptide
QESEIATTNPVATECYGVMSSTLQHEDI

SEQ ID NO: 112279 - protein, 30 aa, Artificial Sequence
  Description of Artificial Sequence: Synthetic polypeptide
DENEIRTTNPVATEQYGTVSEIEMNAAEDH

SEQ ID NO: 112280 - protein, 29 aa, Artificial Sequence
  Description of Artificial Sequence: Synthetic peptide
QECEICTTNPVATECYGVVSNEQLQQEEL

SEQ ID NO: 112281 - protein, 30 aa, Artificial Sequence
  Description of Artificial Sequence: Synthetic polypeptide
DENEIRTTNPVATEQYGTVSEIEMNAAEDA

SEQ ID NO: 112282 - protein, 32 aa, Artificial Sequence
  Description of Artificial Sequence: Synthetic polypeptide
DENEIRTTNPVATEQYGTVSEEIIQMNQAGDH

SEQ ID NO: 112283 - protein, 32 aa, Artificial Sequence
  Description of Artificial Sequence: Synthetic polypeptide
DENEIRTTNPVATEQYGTVSEEIEQMNQAGDH

SEQ ID NO: 112284 - protein, 32 aa, Artificial Sequence
  Description of Artificial Sequence: Synthetic polypeptide
DENEIRTTNPVATEQYGTVSEEDIQMNQAGDH

SEQ ID NO: 112285 - protein, 28 aa, Artificial Sequence
  Description of Artificial Sequence: Synthetic peptide
QESEIATTNPVATEGYGDMASTLQHEDI

SEQ ID NO: 112286 - protein, 29 aa, Artificial Sequence
  Description of Artificial Sequence: Synthetic peptide
QECEICTTNPVATECYGVVSEQLQGAEEL

SEQ ID NO: 112287 - protein, 36 aa, Artificial Sequence
  Description of Artificial Sequence: Synthetic polypeptide
DESEIRTTNPVATEQYGSVSSATPAGPNMRNGMNPR

SEQ ID NO: 112288 - protein, 33 aa, Artificial Sequence
  Description of Artificial Sequence: Synthetic polypeptide
DENEIRTTNPVATEQYGTVCSMEDPVEQFNGNH

SEQ ID NO: 112289 - protein, 30 aa, Artificial Sequence
  Description of Artificial Sequence: Synthetic polypeptide
QESEIATTNPVATECYGSASCVCPQREENK

SEQ ID NO: 112290 - protein, 29 aa, Artificial Sequence
  Description of Artificial Sequence: Synthetic peptide
QECEICTTNPVATECYGVVSEQLEQTEEL

SEQ ID NO: 112291 - protein, 30 aa, Artificial Sequence
  Description of Artificial Sequence: Synthetic polypeptide
QESEIATTNPVATECYGSASCVCPQREENG

SEQ ID NO: 112292 - protein, 30 aa, Artificial Sequence
  Description of Artificial Sequence: Synthetic polypeptide
QESEIATTNPVATECYGNVSAECLQRVEQL

SEQ ID NO: 112293 - protein, 35 aa, Artificial Sequence
  Description of Artificial Sequence: Synthetic polypeptide
DESEIRTTNPVATEQYGSVSATTPTGPQRNGMDPV

SEQ ID NO: 112294 - protein, 30 aa, Artificial Sequence
  Description of Artificial Sequence: Synthetic polypeptide
QESEIATTNPVATECYGDVSANTIQHVGEL

SEQ ID NO: 112295 - protein, 29 aa, Artificial Sequence
  Description of Artificial Sequence: Synthetic peptide
QESEIATTNPVATECYGDVSCCEPQHGEL

SEQ ID NO: 112296 - protein, 29 aa, Artificial Sequence
  Description of Artificial Sequence: Synthetic peptide
QESEIATTNPVATECYGDVSCCLPQHEEL

SEQ ID NO: 112297 - protein, 29 aa, Artificial Sequence
  Description of Artificial Sequence: Synthetic peptide
QESEIATTNPVATECYGDVSCNEQHEEEL

SEQ ID NO: 112298 - protein, 29 aa, Artificial Sequence
  Description of Artificial Sequence: Synthetic peptide
QESEIATTNPVATECYGDVSECLQDHEEL

SEQ ID NO: 112299 - protein, 34 aa, Artificial Sequence
  Description of Artificial Sequence: Synthetic polypeptide
CEEEIRTTNPVATEQYGQCVCSTEDTQNFGSNQM

SEQ ID NO: 112300 - protein, 28 aa, Artificial Sequence
  Description of Artificial Sequence: Synthetic peptide
QEDEIATTNPVATECYGDVSECFQHEEL

SEQ ID NO: 112301 - protein, 33 aa, Artificial Sequence
  Description of Artificial Sequence: Synthetic polypeptide
CEEEIRTTNPVATEQYGQCVCSTEHQNFGSETD

SEQ ID NO: 112302 - protein, 34 aa, Artificial Sequence
  Description of Artificial Sequence: Synthetic polypeptide
DESEIRTTNPVATEQYGSVSCINEPEDREGEEDL

SEQ ID NO: 112303 - protein, 34 aa, Artificial Sequence
  Description of Artificial Sequence: Synthetic polypeptide
CEEEIRTTNPVATEQYGQCVCSTELNQNFGSEQN

SEQ ID NO: 112304 - protein, 34 aa, Artificial Sequence
  Description of Artificial Sequence: Synthetic polypeptide
DENEIRTTNPVATESYGSVVNNGLDQQRGQTGDG

SEQ ID NO: 112305 - protein, 29 aa, Artificial Sequence
  Description of Artificial Sequence: Synthetic peptide
QESEIATTNPVATECYGDVSECLQHVEQL

SEQ ID NO: 112306 - protein, 28 aa, Artificial Sequence
  Description of Artificial Sequence: Synthetic peptide
QEDEIAPTNPCSSEGYGIVSCNLQSGTR

SEQ ID NO: 112307 - protein, 35 aa, Artificial Sequence
  Description of Artificial Sequence: Synthetic polypeptide
DESEIRTTNPVATEQYGSVSCTGIQSQWTGGKNGV

SEQ ID NO: 112308 - protein, 34 aa, Artificial Sequence
  Description of Artificial Sequence: Synthetic polypeptide
DENEIRTTNPVATEQYGVVSVVVLHNQNTQNDRN

SEQ ID NO: 112309 - protein, 34 aa, Artificial Sequence
  Description of Artificial Sequence: Synthetic polypeptide
CEEEIRTTNPVATEQYGQCVCSTMNHQGFGSEQA

SEQ ID NO: 112310 - protein, 34 aa, Artificial Sequence
  Description of Artificial Sequence: Synthetic polypeptide
CEEEIRTTNPVATEQYGQCVCSTNHQEGFGSEQS

SEQ ID NO: 112311 - protein, 34 aa, Artificial Sequence
  Description of Artificial Sequence: Synthetic polypeptide
CEEEIRTTNPVATEQYGQCVCSTNHQHFNSETQA

SEQ ID NO: 112312 - protein, 28 aa, Artificial Sequence
  Description of Artificial Sequence: Synthetic peptide
QEDEIAPTNPCSSEEYGIVSCNLQSGTR

SEQ ID NO: 112313 - protein, 30 aa, Artificial Sequence
  Description of Artificial Sequence: Synthetic polypeptide
QECEICTTNPVATESYGVVSTEQLQHIEEL

SEQ ID NO: 112314 - protein, 34 aa, Artificial Sequence
  Description of Artificial Sequence: Synthetic polypeptide
CEEEIRTTNPVATEQYGQCVCSTNHQNFISNNQE

SEQ ID NO: 112315 - protein, 29 aa, Artificial Sequence
  Description of Artificial Sequence: Synthetic peptide
QESEIATTNPVATECYGKVSECLSQHVEL

SEQ ID NO: 112316 - protein, 30 aa, Artificial Sequence
  Description of Artificial Sequence: Synthetic polypeptide
QESEIATTNPVATECYGKVSEGLQHTEGEL

SEQ ID NO: 112317 - protein, 31 aa, Artificial Sequence
  Description of Artificial Sequence: Synthetic polypeptide
QESEIATTNPVATECYGKVSWGLSQHEGENL

SEQ ID NO: 112318 - protein, 29 aa, Artificial Sequence
  Description of Artificial Sequence: Synthetic peptide
QESEIATTNPVATECYGNVSECLQHVEQL

SEQ ID NO: 112319 - protein, 33 aa, Artificial Sequence
  Description of Artificial Sequence: Synthetic polypeptide
CEEEIRTTNPVATEQYGQCVCSSELQNFNSNQD

SEQ ID NO: 112320 - protein, 28 aa, Artificial Sequence
  Description of Artificial Sequence: Synthetic peptide
QESEIATTNPVATEGYGVMASTLQHEDI

SEQ ID NO: 112321 - protein, 33 aa, Artificial Sequence
  Description of Artificial Sequence: Synthetic polypeptide
DENEIRTTNPVATEQYGTVCSATDGPVEFEGND

SEQ ID NO: 112322 - protein, 36 aa, Artificial Sequence
  Description of Artificial Sequence: Synthetic polypeptide
DESEIRTTNPVATEQYGSVSSTSPAGPQMRNGMNPI

SEQ ID NO: 112323 - protein, 34 aa, Artificial Sequence
  Description of Artificial Sequence: Synthetic polypeptide
DENEIRTTNPVATEQYGSVYTWNMNQAESSEERA

SEQ ID NO: 112324 - protein, 34 aa, Artificial Sequence
  Description of Artificial Sequence: Synthetic polypeptide
DENEIRTTNPVATEQYGSVYTWNMIQHNSSQERA

SEQ ID NO: 112325 - protein, 30 aa, Artificial Sequence
  Description of Artificial Sequence: Synthetic polypeptide
QESEIATTNPVATEQYGSASCVCPQREEEK

SEQ ID NO: 112326 - protein, 33 aa, Artificial Sequence
  Description of Artificial Sequence: Synthetic polypeptide
DENEIRTTNPVATEQYGSVYTWLMIQTESSEED

SEQ ID NO: 112327 - protein, 36 aa, Artificial Sequence
  Description of Artificial Sequence: Synthetic polypeptide
DESEIRTTNPVATEQYGSVSSTSPAGPQMRNGMNPV

SEQ ID NO: 112328 - protein, 35 aa, Artificial Sequence
  Description of Artificial Sequence: Synthetic polypeptide
DESEIRTTNPVATEQYGSVSSTSPTGPNMRNGMNV

SEQ ID NO: 112329 - protein, 30 aa, Artificial Sequence
  Description of Artificial Sequence: Synthetic polypeptide
QESEIATTNPVATEQYGTVSSTPVEFEGDD

SEQ ID NO: 112330 - protein, 35 aa, Artificial Sequence
  Description of Artificial Sequence: Synthetic polypeptide
DESEIRTTNPVATEQYGSVSSTTAGPNMRNGMNPV

SEQ ID NO: 112331 - protein, 34 aa, Artificial Sequence
  Description of Artificial Sequence: Synthetic polypeptide
DENEIRTTNPVATEQYGSVYSDWNMESRFDNQDE

SEQ ID NO: 112332 - protein, 32 aa, Artificial Sequence
  Description of Artificial Sequence: Synthetic polypeptide
DENEIRTTNPVATEQYGSVYPYDQENGDLLQK

SEQ ID NO: 112333 - protein, 34 aa, Artificial Sequence
  Description of Artificial Sequence: Synthetic polypeptide
DENEIRTTNPVATEQYGSVYPDWDLIQRQGVQDN

SEQ ID NO: 112334 - protein, 33 aa, Artificial Sequence
  Description of Artificial Sequence: Synthetic polypeptide
DENEIRTTNPVATEQYGSVYPANSNQESGQESE

SEQ ID NO: 112335 - protein, 35 aa, Artificial Sequence
  Description of Artificial Sequence: Synthetic polypeptide
AEEEIRTTNPVATEQYGSVSTVVNDNGTVGNNNAG

SEQ ID NO: 112336 - protein, 35 aa, Artificial Sequence
  Description of Artificial Sequence: Synthetic polypeptide
DESEIRTTNPVATEQYGSVSSTTPAGNMRNGMNPV

SEQ ID NO: 112337 - protein, 31 aa, Artificial Sequence
  Description of Artificial Sequence: Synthetic polypeptide
QESEIATTNPVAYDHYGSVSTNELSQNVNYM

SEQ ID NO: 112338 - protein, 33 aa, Artificial Sequence
  Description of Artificial Sequence: Synthetic polypeptide
DENEIRTTNPVATEQYGSVYPAMDLQIENMDQQ

SEQ ID NO: 112339 - protein, 36 aa, Artificial Sequence
  Description of Artificial Sequence: Synthetic polypeptide
AEEEIRTTNPVATEQYGSVSTVVNDGGNNQLGGNDD

SEQ ID NO: 112340 - protein, 35 aa, Artificial Sequence
  Description of Artificial Sequence: Synthetic polypeptide
DESEIRTTNPVATEQYGSVSSTTPAGNSRNGMNPV

SEQ ID NO: 112341 - protein, 28 aa, Artificial Sequence
  Description of Artificial Sequence: Synthetic peptide
QESEIATTNPVGTECYGDVAETLQHGDI

SEQ ID NO: 112342 - protein, 34 aa, Artificial Sequence
  Description of Artificial Sequence: Synthetic polypeptide
DENEIRTTNPVATEQYGSVYANSTQGESGQESRM

SEQ ID NO: 112343 - protein, 33 aa, Artificial Sequence
  Description of Artificial Sequence: Synthetic polypeptide
DENEIRTTNPVATEQYGSVYANSNIESGQESRM

SEQ ID NO: 112344 - protein, 33 aa, Artificial Sequence
  Description of Artificial Sequence: Synthetic polypeptide
DENEIRTTNPVATEQYGSVYANMIQDESSEERN

SEQ ID NO: 112345 - protein, 28 aa, Artificial Sequence
  Description of Artificial Sequence: Synthetic peptide
QESEIATTNPVGTECYGDVAETLQHGDL

SEQ ID NO: 112346 - protein, 33 aa, Artificial Sequence
  Description of Artificial Sequence: Synthetic polypeptide
DENEIRTTNPVATEQYGSVYANMDQIEGSEEHN

SEQ ID NO: 112347 - protein, 30 aa, Artificial Sequence
  Description of Artificial Sequence: Synthetic polypeptide
QESEIATTNPVATEQYGSASCVCPQREEEG

SEQ ID NO: 112348 - protein, 29 aa, Artificial Sequence
  Description of Artificial Sequence: Synthetic peptide
QECEICTTNPVATECYGVVSELLQGEEEL

SEQ ID NO: 112349 - protein, 35 aa, Artificial Sequence
  Description of Artificial Sequence: Synthetic polypeptide
DESEIRTTNPVATEQYGSVSSTSPAGPQMRNGDPI

SEQ ID NO: 112350 - protein, 28 aa, Artificial Sequence
  Description of Artificial Sequence: Synthetic peptide
QESEIATTNPVATEQYGSAPCVCQHEEK

SEQ ID NO: 112351 - protein, 30 aa, Artificial Sequence
  Description of Artificial Sequence: Synthetic polypeptide
QESEIATTNPVATEPYGKVSEGLSQHEGEL

SEQ ID NO: 112352 - protein, 29 aa, Artificial Sequence
  Description of Artificial Sequence: Synthetic peptide
QESEIATTNPVATEPYGQVSECLSQHEEL

SEQ ID NO: 112353 - protein, 28 aa, Artificial Sequence
  Description of Artificial Sequence: Synthetic peptide
QESEIATTNPVATEQWGSVPEVCQHEEK

SEQ ID NO: 112354 - protein, 34 aa, Artificial Sequence
  Description of Artificial Sequence: Synthetic polypeptide
DENEIRTTNPVATEQYGTISTTPDGQNMRNGMNV

SEQ ID NO: 112355 - protein, 29 aa, Artificial Sequence
  Description of Artificial Sequence: Synthetic peptide
QECEICTTNPVATECYGVVSELLQEEEIL

SEQ ID NO: 112356 - protein, 34 aa, Artificial Sequence
  Description of Artificial Sequence: Synthetic polypeptide
DENEIRTTNPVATEQYGTISTTPDGQNMRNGMNH

SEQ ID NO: 112357 - protein, 33 aa, Artificial Sequence
  Description of Artificial Sequence: Synthetic polypeptide
QESEIATTNPVATEQWGSVSCINEPQDREGENG

SEQ ID NO: 112358 - protein, 28 aa, Artificial Sequence
  Description of Artificial Sequence: Synthetic peptide
QESEIATTNPVATEQYGDMAETLQHEDA

SEQ ID NO: 112359 - protein, 32 aa, Artificial Sequence
  Description of Artificial Sequence: Synthetic polypeptide
DENEIRTTNPVATEQYGTISMEDLQEDQNGEL

SEQ ID NO: 112360 - protein, 32 aa, Artificial Sequence
  Description of Artificial Sequence: Synthetic polypeptide
DENEIRTTNPVATEQYGTISMEDLQEDQNGEH

SEQ ID NO: 112361 - protein, 32 aa, Artificial Sequence
  Description of Artificial Sequence: Synthetic polypeptide
DENEIRTTNPVATEQYGTISMEDIQQQQNGNH

SEQ ID NO: 112362 - protein, 32 aa, Artificial Sequence
  Description of Artificial Sequence: Synthetic polypeptide
DENEIRTTNPVATEQYGTISMEDIQQQQNGNA

SEQ ID NO: 112363 - protein, 32 aa, Artificial Sequence
  Description of Artificial Sequence: Synthetic polypeptide
DENEIRTTNPVATEQYGTISMEDIQQQANGNA

SEQ ID NO: 112364 - protein, 28 aa, Artificial Sequence
  Description of Artificial Sequence: Synthetic peptide
QESEIATTNPVATEQYGEAASTCQHEEI

SEQ ID NO: 112365 - protein, 31 aa, Artificial Sequence
  Description of Artificial Sequence: Synthetic polypeptide
DENEIRTTNPVATEQYGTISMDEQQQQAENA

SEQ ID NO: 112366 - protein, 36 aa, Artificial Sequence
  Description of Artificial Sequence: Synthetic polypeptide
DESEIRTTNPVATEQYGSVSSTNPAGPNMRNGMNPV

SEQ ID NO: 112367 - protein, 28 aa, Artificial Sequence
  Description of Artificial Sequence: Synthetic peptide
QESEIATTNPVATEQYGEAPEVCQHEER

SEQ ID NO: 112368 - protein, 32 aa, Artificial Sequence
  Description of Artificial Sequence: Synthetic polypeptide
DENEIRTTNPVATEQYGTISEEDIQQQQNGNH

SEQ ID NO: 112369 - protein, 31 aa, Artificial Sequence
  Description of Artificial Sequence: Synthetic polypeptide
DENEIRTTNPVATEQYGTISEEDIQQQNGGH

SEQ ID NO: 112370 - protein, 28 aa, Artificial Sequence
  Description of Artificial Sequence: Synthetic peptide
QESEIATTNPVATEQYGEAPEVCQHGEK

SEQ ID NO: 112371 - protein, 29 aa, Artificial Sequence
  Description of Artificial Sequence: Synthetic peptide
QESEIATTNPVATEQYGEASEVCQREEEK

SEQ ID NO: 112372 - protein, 28 aa, Artificial Sequence
  Description of Artificial Sequence: Synthetic peptide
QESEIATTNPVATEQYGEMPEVLQHEEK

SEQ ID NO: 112373 - protein, 33 aa, Artificial Sequence
  Description of Artificial Sequence: Synthetic polypeptide
DENEIRTTNPVATEQYGTISATEDIQQQEGNDL

SEQ ID NO: 112374 - protein, 33 aa, Artificial Sequence
  Description of Artificial Sequence: Synthetic polypeptide
DENEIRTTNPVATEQYGTISATEDIEQQEGNDL

SEQ ID NO: 112375 - protein, 33 aa, Artificial Sequence
  Description of Artificial Sequence: Synthetic polypeptide
DENEIRTTNPVATEQYGTISATEDIEQHNGNDH

SEQ ID NO: 112376 - protein, 34 aa, Artificial Sequence
  Description of Artificial Sequence: Synthetic polypeptide
DENEIRTTNPVATEQYGSYISVTHDLQTGEEQQD

SEQ ID NO: 112377 - protein, 32 aa, Artificial Sequence
  Description of Artificial Sequence: Synthetic polypeptide
DENEIRTTNPVATWHYGSVSTNQEEHRSTPGS

SEQ ID NO: 112378 - protein, 29 aa, Artificial Sequence
  Description of Artificial Sequence: Synthetic peptide
QESEIATTNPVATECYGDVSAETLQHEEL

SEQ ID NO: 112379 - protein, 28 aa, Artificial Sequence
  Description of Artificial Sequence: Synthetic peptide
QESEIATTNPVATECYGDVAETLQHEEL

SEQ ID NO: 112380 - protein, 28 aa, Artificial Sequence
  Description of Artificial Sequence: Synthetic peptide
QESEIASTNPVGTEQYGVMASTGQHGNI

SEQ ID NO: 112381 - protein, 32 aa, Artificial Sequence
  Description of Artificial Sequence: Synthetic polypeptide
DENEIRTTNPVSTEPYGSISMENEQQDQEGNG

SEQ ID NO: 112382 - protein, 28 aa, Artificial Sequence
  Description of Artificial Sequence: Synthetic peptide
QESEIASTNPVGTEQYGVMASTLQAGDI

SEQ ID NO: 112383 - protein, 28 aa, Artificial Sequence
  Description of Artificial Sequence: Synthetic peptide
QESEIASTNPVGTEQYGVMASTLQHGDI

SEQ ID NO: 112384 - protein, 28 aa, Artificial Sequence
  Description of Artificial Sequence: Synthetic peptide
QESEIASTNPVGTEQYGVMASTLQHGDQ

SEQ ID NO: 112385 - protein, 31 aa, Artificial Sequence
  Description of Artificial Sequence: Synthetic polypeptide
DENEIRTTNPVSTEPYGSISMEDIQQQNGNH

SEQ ID NO: 112386 - protein, 34 aa, Artificial Sequence
  Description of Artificial Sequence: Synthetic polypeptide
AEEEIRTTNPVATEQYGSVVVSVTANGNQEQETD

SEQ ID NO: 112387 - protein, 32 aa, Artificial Sequence
  Description of Artificial Sequence: Synthetic polypeptide
DENEIRTTNPVSTEPYGSISCENIPQQQNGNH

SEQ ID NO: 112388 - protein, 33 aa, Artificial Sequence
  Description of Artificial Sequence: Synthetic polypeptide
DENEIRTTNPVSTEPYGSISATEDLQEQQNGNH

SEQ ID NO: 112389 - protein, 28 aa, Artificial Sequence
  Description of Artificial Sequence: Synthetic peptide
QESEIASTNPVGTEQYGVMASTLQHGTI

SEQ ID NO: 112390 - protein, 35 aa, Artificial Sequence
  Description of Artificial Sequence: Synthetic polypeptide
DESEIRTTNPVATEQYGSVFNTLNLHVIEGSNEDV

SEQ ID NO: 112391 - protein, 28 aa, Artificial Sequence
  Description of Artificial Sequence: Synthetic peptide
QESEIASTNPVGTEQYGVMASTLQSGDI

SEQ ID NO: 112392 - protein, 28 aa, Artificial Sequence
  Description of Artificial Sequence: Synthetic peptide
QEEEIACTNPIATEQYGEASEVCMHENR

SEQ ID NO: 112393 - protein, 31 aa, Artificial Sequence
  Description of Artificial Sequence: Synthetic polypeptide
DENEIRTTNPVSTEPYGNIAMETIQQQNGNR

SEQ ID NO: 112394 - protein, 32 aa, Artificial Sequence
  Description of Artificial Sequence: Synthetic polypeptide
DENEIRTTNPVSTEPYGKISVLDIQQLQIGNH

SEQ ID NO: 112395 - protein, 28 aa, Artificial Sequence
  Description of Artificial Sequence: Synthetic peptide
QESEIASTNPVGTEQYGVMSSTLQHGDI

SEQ ID NO: 112396 - protein, 29 aa, Artificial Sequence
  Description of Artificial Sequence: Synthetic peptide
QESEIASTNPVGTEQYGVMSTTLQHEGDI

SEQ ID NO: 112397 - protein, 28 aa, Artificial Sequence
  Description of Artificial Sequence: Synthetic peptide
QEEEIACTNPIATEQYGEAPENCQHEER

SEQ ID NO: 112398 - protein, 31 aa, Artificial Sequence
  Description of Artificial Sequence: Synthetic polypeptide
DENEIRTTNPVSTEPYGIVSCDIQQQQNGNH

SEQ ID NO: 112399 - protein, 28 aa, Artificial Sequence
  Description of Artificial Sequence: Synthetic peptide
QESEIASTNPVGTEQYGVVADTLQHGDI

SEQ ID NO: 112400 - protein, 32 aa, Artificial Sequence
  Description of Artificial Sequence: Synthetic polypeptide
DENEIRTTNPVSTEPYGEISMENIQQQRNGNH

SEQ ID NO: 112401 - protein, 31 aa, Artificial Sequence
  Description of Artificial Sequence: Synthetic polypeptide
DENEIRTTNPVSTEPYGEISMEDIQQQNGNR

SEQ ID NO: 112402 - protein, 30 aa, Artificial Sequence
  Description of Artificial Sequence: Synthetic polypeptide
DENEIRTTNPVSTEPYGEISEEDCQQQGNH

SEQ ID NO: 112403 - protein, 30 aa, Artificial Sequence
  Description of Artificial Sequence: Synthetic polypeptide
DENEIRTTNPVSTEPWGTVSEDIQQQNGNH

SEQ ID NO: 112404 - protein, 30 aa, Artificial Sequence
  Description of Artificial Sequence: Synthetic polypeptide
DENEIRTTNPVSTEPWGTVSEDIQNQNGNH

SEQ ID NO: 112405 - protein, 32 aa, Artificial Sequence
  Description of Artificial Sequence: Synthetic polypeptide
DENEIRTTNPVSTEPYGSVSMEDIQEQQNGNH

SEQ ID NO: 112406 - protein, 32 aa, Artificial Sequence
  Description of Artificial Sequence: Synthetic polypeptide
DENEIRTTNPVSTEPWGSVSMENIQQQQNGNH

SEQ ID NO: 112407 - protein, 29 aa, Artificial Sequence
  Description of Artificial Sequence: Synthetic peptide
QESEIASTNPVGTEQYGVMASTELQHGDI

SEQ ID NO: 112408 - protein, 28 aa, Artificial Sequence
  Description of Artificial Sequence: Synthetic peptide
QESEIASTNPVGTEQYGVMASNLQSGDI

SEQ ID NO: 112409 - protein, 30 aa, Artificial Sequence
  Description of Artificial Sequence: Synthetic polypeptide
DENEIRTTNPVSTEPYGTISEDIQQQQGNH

SEQ ID NO: 112410 - protein, 29 aa, Artificial Sequence
  Description of Artificial Sequence: Synthetic peptide
DENEIRTTNPVSTEPYGTISEDIQQQGEL

SEQ ID NO: 112411 - protein, 30 aa, Artificial Sequence
  Description of Artificial Sequence: Synthetic polypeptide
DENEIRTTNPVSTEPYGTISEDCQQQQGNK

SEQ ID NO: 112412 - protein, 30 aa, Artificial Sequence
  Description of Artificial Sequence: Synthetic polypeptide
DENEIRTTNPVSTEPYGTISEDCQQQQGNH

SEQ ID NO: 112413 - protein, 30 aa, Artificial Sequence
  Description of Artificial Sequence: Synthetic polypeptide
DENEIRTTNPVSTEPYGTISCDIQQQQGNH

SEQ ID NO: 112414 - protein, 32 aa, Artificial Sequence
  Description of Artificial Sequence: Synthetic polypeptide
DENEIRTTNPVSTEPYGTISATEDLQDHNGNH

SEQ ID NO: 112415 - protein, 32 aa, Artificial Sequence
  Description of Artificial Sequence: Synthetic polypeptide
DENEIRTTNPVSTEPYGTISATEDLQDHEGNH

SEQ ID NO: 112416 - protein, 28 aa, Artificial Sequence
  Description of Artificial Sequence: Synthetic peptide
QESEIASTNPVGTEQYGEMAENLQHGDI

SEQ ID NO: 112417 - protein, 32 aa, Artificial Sequence
  Description of Artificial Sequence: Synthetic polypeptide
DENEIRTTNPVSTEPYGTISATDLQQQHNGNH

SEQ ID NO: 112418 - protein, 28 aa, Artificial Sequence
  Description of Artificial Sequence: Synthetic peptide
QESEIASTNPVGTEQYGEMAETLQRGDI

SEQ ID NO: 112419 - protein, 28 aa, Artificial Sequence
  Description of Artificial Sequence: Synthetic peptide
QESEIASTNPVGTEQYGEMASTLQHGDI

SEQ ID NO: 112420 - protein, 33 aa, Artificial Sequence
  Description of Artificial Sequence: Synthetic polypeptide
QEEEIACTNPVATEAYGSVATNLTGAPGNQDRY

SEQ ID NO: 112421 - protein, 32 aa, Artificial Sequence
  Description of Artificial Sequence: Synthetic polypeptide
DENEIRTTNPVSTEPYGTISATDLQQHNGNDH

SEQ ID NO: 112422 - protein, 32 aa, Artificial Sequence
  Description of Artificial Sequence: Synthetic polypeptide
DENEIRTTNPVSTEPYGTISATDLEQHNGNDH

SEQ ID NO: 112423 - protein, 35 aa, Artificial Sequence
  Description of Artificial Sequence: Synthetic polypeptide
AEEEIRTTNPVATEQYGSVSTVVNEQQGDEQTTDE

SEQ ID NO: 112424 - protein, 30 aa, Artificial Sequence
  Description of Artificial Sequence: Synthetic polypeptide
DENEIRTTNPVSTEPYGTIASETIQQQGDH

SEQ ID NO: 112425 - protein, 31 aa, Artificial Sequence
  Description of Artificial Sequence: Synthetic polypeptide
DENEIRTTNPVSTEPYGTIAMETIQQQNGNR

SEQ ID NO: 112426 - protein, 32 aa, Artificial Sequence
  Description of Artificial Sequence: Synthetic polypeptide
DENEIRTTNPVSTEPYGTASMEDLQQQQNGNR

SEQ ID NO: 112427 - protein, 34 aa, Artificial Sequence
  Description of Artificial Sequence: Synthetic polypeptide
DENEIRTTNPVSTEPYGSVSSTTPDIQNQQNGNV

SEQ ID NO: 112428 - protein, 29 aa, Artificial Sequence
  Description of Artificial Sequence: Synthetic peptide
QESEIASTNPVGTEQYGSMSSTLQHNGDI

SEQ ID NO: 112429 - protein, 28 aa, Artificial Sequence
  Description of Artificial Sequence: Synthetic peptide
QESEIASTNPVGTEQYGVMADNLQHGDQ

SEQ ID NO: 112430 - protein, 33 aa, Artificial Sequence
  Description of Artificial Sequence: Synthetic polypeptide
DENEIRTTNPVSTEPYGSVSMENEQQDQEGENG

SEQ ID NO: 112431 - protein, 28 aa, Artificial Sequence
  Description of Artificial Sequence: Synthetic peptide
QESEIASTNPVGTEQYGVMADNLQSGDI

SEQ ID NO: 112432 - protein, 28 aa, Artificial Sequence
  Description of Artificial Sequence: Synthetic peptide
QESEIASTNPVGTEQYGVMAETLQRGDI

SEQ ID NO: 112433 - protein, 28 aa, Artificial Sequence
  Description of Artificial Sequence: Synthetic peptide
QESEIASTNPVGTEQYGVMASNLQHGDI

SEQ ID NO: 112434 - protein, 32 aa, Artificial Sequence
  Description of Artificial Sequence: Synthetic polypeptide
DENEIRTTNPVSTEPYGSVSMEDIQQQQNGNH

SEQ ID NO: 112435 - protein, 32 aa, Artificial Sequence
  Description of Artificial Sequence: Synthetic polypeptide
DENEIRTTNPVSTEPWGSVSMENEQQQQNGNH

SEQ ID NO: 112436 - protein, 29 aa, Artificial Sequence
  Description of Artificial Sequence: Synthetic peptide
QESEIASTNPVGTEQYGVVASTLQHGMDI

SEQ ID NO: 112437 - protein, 32 aa, Artificial Sequence
  Description of Artificial Sequence: Synthetic polypeptide
DENEIRTTNPVSTEPWGSVSMENEQQDQNGNG

SEQ ID NO: 112438 - protein, 28 aa, Artificial Sequence
  Description of Artificial Sequence: Synthetic peptide
QESEIASVNPVCTEQYGVVADNLQHGDQ

SEQ ID NO: 112439 - protein, 30 aa, Artificial Sequence
  Description of Artificial Sequence: Synthetic polypeptide
DENEIRTTNPVGTEPYGTMSMDIQQQQGNH

SEQ ID NO: 112440 - protein, 30 aa, Artificial Sequence
  Description of Artificial Sequence: Synthetic polypeptide
DENEIRTTNPVGTEPYGTISMDIQQQQGNH

SEQ ID NO: 112441 - protein, 31 aa, Artificial Sequence
  Description of Artificial Sequence: Synthetic polypeptide
DENEIRTTNPVCTEQYGVISDEDIQQQNGNQ

SEQ ID NO: 112442 - protein, 28 aa, Artificial Sequence
  Description of Artificial Sequence: Synthetic peptide
QESEIASVNPVCTEQYGVVADNLQSGDQ

SEQ ID NO: 112443 - protein, 35 aa, Artificial Sequence
  Description of Artificial Sequence: Synthetic polypeptide
AEEEIRTTNPVATEQYGSVVVSVTNGNNQEQENED

SEQ ID NO: 112444 - protein, 34 aa, Artificial Sequence
  Description of Artificial Sequence: Synthetic polypeptide
CEEEIRTTNPVATEQYGDVSVGDLGQRFNINEQV

SEQ ID NO: 112445 - protein, 28 aa, Artificial Sequence
  Description of Artificial Sequence: Synthetic peptide
QESEIASVNPVGTEQYGVMASNLQSGNI

SEQ ID NO: 112446 - protein, 28 aa, Artificial Sequence
  Description of Artificial Sequence: Synthetic peptide
QESEIASVNPVGTEQYGVVASTLQHGDQ

SEQ ID NO: 112447 - protein, 28 aa, Artificial Sequence
  Description of Artificial Sequence: Synthetic peptide
QESEIASVNPVGTEQYGVVSDTLQHGDQ

SEQ ID NO: 112448 - protein, 29 aa, Artificial Sequence
  Description of Artificial Sequence: Synthetic peptide
QEDEICSTNPVCTEAYGSVNTSTLQNGDI

SEQ ID NO: 112449 - protein, 28 aa, Artificial Sequence
  Description of Artificial Sequence: Synthetic peptide
QESEIASVNPVGTEQYGVVSSTLQHGDQ

SEQ ID NO: 112450 - protein, 31 aa, Artificial Sequence
  Description of Artificial Sequence: Synthetic polypeptide
DENEIRTTNPVAYEQWGKVSETEMNAAEGDA

SEQ ID NO: 112451 - protein, 32 aa, Artificial Sequence
  Description of Artificial Sequence: Synthetic polypeptide
QESEIATTNPCASECWGSVSCNLPQDREGENR

SEQ ID NO: 112452 - protein, 30 aa, Artificial Sequence
  Description of Artificial Sequence: Synthetic polypeptide
QESEIATTNPCASEQWGSVSCNEPQDSGTR

SEQ ID NO: 112453 - protein, 32 aa, Artificial Sequence
  Description of Artificial Sequence: Synthetic polypeptide
QESEIATTNPCATECYGSVSCINLQDSEGENG

SEQ ID NO: 112454 - protein, 28 aa, Artificial Sequence
  Description of Artificial Sequence: Synthetic peptide
QESEIATTNPVATECWGDVSCCLQHEEL

SEQ ID NO: 112455 - protein, 29 aa, Artificial Sequence
  Description of Artificial Sequence: Synthetic peptide
QESEIATTNPVATECWGDVSCCLQREEEL

SEQ ID NO: 112456 - protein, 29 aa, Artificial Sequence
  Description of Artificial Sequence: Synthetic peptide
QESEIATTNPVATECWGDVSENLQDHEEL

SEQ ID NO: 112457 - protein, 32 aa, Artificial Sequence
  Description of Artificial Sequence: Synthetic polypeptide
QESEIATTNPVATECWGSVSCNEPQDREGENG

SEQ ID NO: 112458 - protein, 36 aa, Artificial Sequence
  Description of Artificial Sequence: Synthetic polypeptide
AEEEIRTTNPVATEQYGSVSTVVNDQQGVNGEIGNT

SEQ ID NO: 112459 - protein, 35 aa, Artificial Sequence
  Description of Artificial Sequence: Synthetic polypeptide
DESEIRTTNPVATEQYGSVSATTPAINSRNGMNPV

SEQ ID NO: 112460 - protein, 28 aa, Artificial Sequence
  Description of Artificial Sequence: Synthetic peptide
QESEIATTNPVATECYGDMAETLQHGDI

SEQ ID NO: 112461 - protein, 28 aa, Artificial Sequence
  Description of Artificial Sequence: Synthetic peptide
QESEIATTNPVATECYGDVAECLQHEEL

SEQ ID NO: 112462 - protein, 33 aa, Artificial Sequence
  Description of Artificial Sequence: Synthetic polypeptide
DENEIRTTNPVAVEQYGSCSCANLEVELLVNPR

SEQ ID NO: 112463 - protein, 28 aa, Artificial Sequence
  Description of Artificial Sequence: Synthetic peptide
QESEIASVNPVCTEQYGVMSDNLQSGDQ

SEQ ID NO: 112464 - protein, 28 aa, Artificial Sequence
  Description of Artificial Sequence: Synthetic peptide
QESEIASVNPVCTEQYGVMSDNLQSGDI

SEQ ID NO: 112465 - protein, 28 aa, Artificial Sequence
  Description of Artificial Sequence: Synthetic peptide
QESEIASVNPVCTEGYGVVADNLQSGNQ

SEQ ID NO: 112466 - protein, 28 aa, Artificial Sequence
  Description of Artificial Sequence: Synthetic peptide
QESEIASTNPVSTEQYGIMACNLQHGTI

SEQ ID NO: 112467 - protein, 28 aa, Artificial Sequence
  Description of Artificial Sequence: Synthetic peptide
QESEIASTNPVGTEWYGVSASTLQHGDI

SEQ ID NO: 112468 - protein, 32 aa, Artificial Sequence
  Description of Artificial Sequence: Synthetic polypeptide
DENEIRTTNPVSTEPWGSVSMENEPQDQNGNG

SEQ ID NO: 112469 - protein, 30 aa, Artificial Sequence
  Description of Artificial Sequence: Synthetic polypeptide
DENEIRTTNPVSTEGYGTMASETIQQQGDH

SEQ ID NO: 112470 - protein, 31 aa, Artificial Sequence
  Description of Artificial Sequence: Synthetic polypeptide
DENEIRTTNPVSTEGYGTISMDIQQQRNGQR

SEQ ID NO: 112471 - protein, 28 aa, Artificial Sequence
  Description of Artificial Sequence: Synthetic peptide
QESEIASTNPVSSEGYGIVSCTLQSGTR

SEQ ID NO: 112472 - protein, 28 aa, Artificial Sequence
  Description of Artificial Sequence: Synthetic peptide
QESEIASTNPVSTECYGDVAECLQREQR

SEQ ID NO: 112473 - protein, 30 aa, Artificial Sequence
  Description of Artificial Sequence: Synthetic polypeptide
DENEIRTTNPVSTEGYGTIASETIQQQGDH

SEQ ID NO: 112474 - protein, 30 aa, Artificial Sequence
  Description of Artificial Sequence: Synthetic polypeptide
DENEIRTTNPVSTEGWGDVANIEQNRAGDR

SEQ ID NO: 112475 - protein, 31 aa, Artificial Sequence
  Description of Artificial Sequence: Synthetic polypeptide
DENEIRTTNPVSTECYGTVSMEDIQQHNGNH

SEQ ID NO: 112476 - protein, 32 aa, Artificial Sequence
  Description of Artificial Sequence: Synthetic polypeptide
DENEIRTTNPVSTECYGTVSCENIQQDQNGNG

SEQ ID NO: 112477 - protein, 32 aa, Artificial Sequence
  Description of Artificial Sequence: Synthetic polypeptide
DENEIRTTNPVSTECYGTVSCENIPQDQNGNG

SEQ ID NO: 112478 - protein, 32 aa, Artificial Sequence
  Description of Artificial Sequence: Synthetic polypeptide
DENEIRTTNPVSTECYGTVSCENIPQDQEGNG

SEQ ID NO: 112479 - protein, 28 aa, Artificial Sequence
  Description of Artificial Sequence: Synthetic peptide
QESEIATTNPVGTECYGDVSETLQHEEL

SEQ ID NO: 112480 - protein, 30 aa, Artificial Sequence
  Description of Artificial Sequence: Synthetic polypeptide
DENEIRTTNPVSTECYGTISMDLQQQQGEL

SEQ ID NO: 112481 - protein, 31 aa, Artificial Sequence
  Description of Artificial Sequence: Synthetic polypeptide
QEECIRTTNPVAWEQYGQCCTINVQGGNENV

SEQ ID NO: 112482 - protein, 34 aa, Artificial Sequence
  Description of Artificial Sequence: Synthetic polypeptide
AEEEIRTTNPVATEQYGSVVVSVTNANQEQETDT

SEQ ID NO: 112483 - protein, 28 aa, Artificial Sequence
  Description of Artificial Sequence: Synthetic peptide
QESEIASTNPVSTEGYGVMSSNLQHGDI

SEQ ID NO: 112484 - protein, 28 aa, Artificial Sequence
  Description of Artificial Sequence: Synthetic peptide
QESEIASTNPVSTEGYGVVACTLQSGTR

SEQ ID NO: 112485 - protein, 30 aa, Artificial Sequence
  Description of Artificial Sequence: Synthetic polypeptide
DENEIRTTNPVSTECYGTISEECIQQQGNL

SEQ ID NO: 112486 - protein, 32 aa, Artificial Sequence
  Description of Artificial Sequence: Synthetic polypeptide
DENEIRTTNPVSTECYGSISMEDIQQQREGNH

SEQ ID NO: 112487 - protein, 32 aa, Artificial Sequence
  Description of Artificial Sequence: Synthetic polypeptide
DENEIRTTNPVSTECYGSISMEDIQQDREGNH

SEQ ID NO: 112488 - protein, 30 aa, Artificial Sequence
  Description of Artificial Sequence: Synthetic polypeptide
DENEIRTTNPVSSEQYGTISCDIQQQQGNH

SEQ ID NO: 112489 - protein, 31 aa, Artificial Sequence
  Description of Artificial Sequence: Synthetic polypeptide
DENEIRTTNPVSSEPYGTISMENIQQQQGNR

SEQ ID NO: 112490 - protein, 29 aa, Artificial Sequence
  Description of Artificial Sequence: Synthetic peptide
DENEIRTTNPVSSEPYGIISMDIQSNGNH

SEQ ID NO: 112491 - protein, 29 aa, Artificial Sequence
  Description of Artificial Sequence: Synthetic peptide
DENEIRTTNPVGTEQWGDVSEIEQAAEDA

SEQ ID NO: 112492 - protein, 31 aa, Artificial Sequence
  Description of Artificial Sequence: Synthetic polypeptide
DENEIRTTNPVGTEPYGVMSSDLQQQQNGNI

SEQ ID NO: 112493 - protein, 28 aa, Artificial Sequence
  Description of Artificial Sequence: Synthetic peptide
QESEIASTNPVSTEGYGIVACTLQSGTR

SEQ ID NO: 112494 - protein, 31 aa, Artificial Sequence
  Description of Artificial Sequence: Synthetic polypeptide
DENEIRTTNPVSTEPYGTISEDIQQQQNGNR

SEQ ID NO: 112495 - protein, 33 aa, Artificial Sequence
  Description of Artificial Sequence: Synthetic polypeptide
DENEIRTTNPVATEQYGSVYAGSNQHESGQESR

SEQ ID NO: 112496 - protein, 34 aa, Artificial Sequence
  Description of Artificial Sequence: Synthetic polypeptide
DENEIRTTNPVATEQYGSVWYANLTQESGQESGQ

SEQ ID NO: 112497 - protein, 34 aa, Artificial Sequence
  Description of Artificial Sequence: Synthetic polypeptide
AEEEIRTTNPVATEQYGSVVVSVTNNGQEQVETD

SEQ ID NO: 112498 - protein, 30 aa, Artificial Sequence
  Description of Artificial Sequence: Synthetic polypeptide
QESEIRTTNPVATECYGDVSCNEPQHEEEL

SEQ ID NO: 112499 - protein, 35 aa, Artificial Sequence
  Description of Artificial Sequence: Synthetic polypeptide
DENEIRTTNPVATEQYGSVSTDDMIQFESSENDRP

SEQ ID NO: 112500 - protein, 33 aa, Artificial Sequence
  Description of Artificial Sequence: Synthetic polypeptide
DENEIRTTNPVATEQYGSVSTAGSMEEENNEDN

SEQ ID NO: 112501 - protein, 35 aa, Artificial Sequence
  Description of Artificial Sequence: Synthetic polypeptide
AEEEIRTTNPVATEQYGSVVVSVTNNNNQEQDEND

SEQ ID NO: 112502 - protein, 33 aa, Artificial Sequence
  Description of Artificial Sequence: Synthetic polypeptide
QESEIRTTNPVATECYGSVPEINCPQDREGENK

SEQ ID NO: 112503 - protein, 34 aa, Artificial Sequence
  Description of Artificial Sequence: Synthetic polypeptide
DENEIRTTNPVATEQYGSVSTAGSLEEENNEDQQ

SEQ ID NO: 112504 - protein, 32 aa, Artificial Sequence
  Description of Artificial Sequence: Synthetic polypeptide
DESEIRTTNPVATEQYGVMATSAGQRNGMDPI

SEQ ID NO: 112505 - protein, 31 aa, Artificial Sequence
  Description of Artificial Sequence: Synthetic polypeptide
DESEIRTTNPVATEQYGVMATSTGQHNGDPI

SEQ ID NO: 112506 - protein, 33 aa, Artificial Sequence
  Description of Artificial Sequence: Synthetic polypeptide
DESEIRTTNPVATEQYGVVCSTEEHQNFNSNQS

SEQ ID NO: 112507 - protein, 32 aa, Artificial Sequence
  Description of Artificial Sequence: Synthetic polypeptide
QEAEIATTNPVATECYGSVVTNLNGGPADNAA

SEQ ID NO: 112508 - protein, 34 aa, Artificial Sequence
  Description of Artificial Sequence: Synthetic polypeptide
DENEIRTTNPVATEQYGSVSTAGELESENNEDTN

SEQ ID NO: 112509 - protein, 33 aa, Artificial Sequence
  Description of Artificial Sequence: Synthetic polypeptide
QESEIRTTNPVATECYGSVSCIVEPQDREGENG

SEQ ID NO: 112510 - protein, 32 aa, Artificial Sequence
  Description of Artificial Sequence: Synthetic polypeptide
QESEIRTTNPVATECYGSVSCIVEPQREEENG

SEQ ID NO: 112511 - protein, 28 aa, Artificial Sequence
  Description of Artificial Sequence: Synthetic peptide
QEAEIATTNPVATECYGNVSECMQHEEL

SEQ ID NO: 112512 - protein, 34 aa, Artificial Sequence
  Description of Artificial Sequence: Synthetic polypeptide
DENEIRTTNPVATEQYGSVSSWDVTVTVTEGNNQ

SEQ ID NO: 112513 - protein, 32 aa, Artificial Sequence
  Description of Artificial Sequence: Synthetic polypeptide
QESEIRTTNPVATECYGSVSEINEPQREEEEL

SEQ ID NO: 112514 - protein, 29 aa, Artificial Sequence
  Description of Artificial Sequence: Synthetic peptide
QEAEIATTNPVATECYGEVSEDLSQHEEL

SEQ ID NO: 112515 - protein, 29 aa, Artificial Sequence
  Description of Artificial Sequence: Synthetic peptide
QEAEIATTNPVATECYGDVSEECLQHEEL

SEQ ID NO: 112516 - protein, 34 aa, Artificial Sequence
  Description of Artificial Sequence: Synthetic polypeptide
DENEIRTTNPVATEQYGSVSSTTPIGNMRNGDPA

SEQ ID NO: 112517 - protein, 36 aa, Artificial Sequence
  Description of Artificial Sequence: Synthetic polypeptide
DENEIRTTNPVATEQYGSVSSTTPALPNMRNGMNPV

SEQ ID NO: 112518 - protein, 36 aa, Artificial Sequence
  Description of Artificial Sequence: Synthetic polypeptide
DENEIRTTNPVATEQYGSVSSTTPAIPNMQNGMNPV

SEQ ID NO: 112519 - protein, 36 aa, Artificial Sequence
  Description of Artificial Sequence: Synthetic polypeptide
DENEIRTTNPVATEQYGSVSSTTPAGQNMRNGMNPV

SEQ ID NO: 112520 - protein, 35 aa, Artificial Sequence
  Description of Artificial Sequence: Synthetic polypeptide
DENEIRTTNPVATEQYGSVSSTTPAGPNMANGNPV

SEQ ID NO: 112521 - protein, 34 aa, Artificial Sequence
  Description of Artificial Sequence: Synthetic polypeptide
DENEIRTTNPVATEQYGSVSSTTPAGNMRNGDPA

SEQ ID NO: 112522 - protein, 35 aa, Artificial Sequence
  Description of Artificial Sequence: Synthetic polypeptide
DENEIRTTNPVATEQYGSVSTDTIEQPNGGQNSVQ

SEQ ID NO: 112523 - protein, 33 aa, Artificial Sequence
  Description of Artificial Sequence: Synthetic polypeptide
QESEIRTTNPVATECYGVVSCINEPQDREGENG

SEQ ID NO: 112524 - protein, 32 aa, Artificial Sequence
  Description of Artificial Sequence: Synthetic polypeptide
QESEIRTTNPVATECWGSVSEIVEPQDREGNG

SEQ ID NO: 112525 - protein, 32 aa, Artificial Sequence
  Description of Artificial Sequence: Synthetic polypeptide
QESEIRTTNPVATECWGSVSEINEPQREGEEL

SEQ ID NO: 112526 - protein, 32 aa, Artificial Sequence
  Description of Artificial Sequence: Synthetic polypeptide
QESEIRSTNPVGTEQYGSVSASPTLQRNGDPV

SEQ ID NO: 112527 - protein, 33 aa, Artificial Sequence
  Description of Artificial Sequence: Synthetic polypeptide
DESEIRTTNPVATEQYGTHYMDMNNNQRGEDRQ

SEQ ID NO: 112528 - protein, 34 aa, Artificial Sequence
  Description of Artificial Sequence: Synthetic polypeptide
DESEIRTTNPVATEQYGTVCSATDNPPEFEGEND

SEQ ID NO: 112529 - protein, 30 aa, Artificial Sequence
  Description of Artificial Sequence: Synthetic polypeptide
QESEIRSTNPVGTEQYGVVASTGNHNGMNV

SEQ ID NO: 112530 - protein, 33 aa, Artificial Sequence
  Description of Artificial Sequence: Synthetic polypeptide
DESEIRTTNPVATEQYGTVCSATIGPVEFEGND

SEQ ID NO: 112531 - protein, 32 aa, Artificial Sequence
  Description of Artificial Sequence: Synthetic polypeptide
QESEIRTTNPCSTECWGIVSCINLPQDRGENR

SEQ ID NO: 112532 - protein, 35 aa, Artificial Sequence
  Description of Artificial Sequence: Synthetic polypeptide
CEEEIRTTNPVATEQYGSVSTVNGFGQENDGEGGG

SEQ ID NO: 112533 - protein, 29 aa, Artificial Sequence
  Description of Artificial Sequence: Synthetic peptide
QECEIATTNPVATECYGVVSVEQLQEEEL

SEQ ID NO: 112534 - protein, 34 aa, Artificial Sequence
  Description of Artificial Sequence: Synthetic polypeptide
DESEIRTTNPVATEQYGTVSACINEPQDFEGENG

SEQ ID NO: 112535 - protein, 35 aa, Artificial Sequence
  Description of Artificial Sequence: Synthetic polypeptide
CEEEIRTTNPVATEQYGSVSVGDNGQQRFNNNEQI

SEQ ID NO: 112536 - protein, 31 aa, Artificial Sequence
  Description of Artificial Sequence: Synthetic polypeptide
QESEIRTTNPVATECWGSVACITEPQRGEDG

SEQ ID NO: 112537 - protein, 29 aa, Artificial Sequence
  Description of Artificial Sequence: Synthetic peptide
QECEIATTNPVATECYGVVSEQLQDEEEL

SEQ ID NO: 112538 - protein, 30 aa, Artificial Sequence
  Description of Artificial Sequence: Synthetic polypeptide
QESEIRTTNPVATECWGSVACITEQRGEDG

SEQ ID NO: 112539 - protein, 29 aa, Artificial Sequence
  Description of Artificial Sequence: Synthetic peptide
QECEIATTNPVATECYGVVSELLQGEEQL

SEQ ID NO: 112540 - protein, 35 aa, Artificial Sequence
  Description of Artificial Sequence: Synthetic polypeptide
DENEIRTTNPVATEQYGSVSTNEEENMDGGQTSRS

SEQ ID NO: 112541 - protein, 33 aa, Artificial Sequence
  Description of Artificial Sequence: Synthetic polypeptide
DESEIRTTNPVATEQYGTVSATDGEVEFEGEND

SEQ ID NO: 112542 - protein, 33 aa, Artificial Sequence
  Description of Artificial Sequence: Synthetic polypeptide
QESEIRTTNPVATECWGSVSCINEPQDREGENG

SEQ ID NO: 112543 - protein, 34 aa, Artificial Sequence
  Description of Artificial Sequence: Synthetic polypeptide
DENEIRTTNPVATEQYGSVSTLWQQMENDEDDNQ

SEQ ID NO: 112544 - protein, 34 aa, Artificial Sequence
  Description of Artificial Sequence: Synthetic polypeptide
DESEIRTTNPVATEQYGTVSATINEPEDFEGEND

SEQ ID NO: 112545 - protein, 32 aa, Artificial Sequence
  Description of Artificial Sequence: Synthetic polypeptide
QESEIRTTNPVATECWGSVSCINEPQDSEGNG

SEQ ID NO: 112546 - protein, 28 aa, Artificial Sequence
  Description of Artificial Sequence: Synthetic peptide
QECEIAPTNPCSSEAYGIVSCNLQSGTR

SEQ ID NO: 112547 - protein, 32 aa, Artificial Sequence
  Description of Artificial Sequence: Synthetic polypeptide
QESEIRTTNPVATECWGSVSCITEPQREGEDG

SEQ ID NO: 112548 - protein, 30 aa, Artificial Sequence
  Description of Artificial Sequence: Synthetic polypeptide
QEAVICCTNPVAYEQYGSVAMNEQPRGGNS

SEQ ID NO: 112549 - protein, 28 aa, Artificial Sequence
  Description of Artificial Sequence: Synthetic peptide
QEAEICATNPISSEQYGVVSVNLQSGTM

SEQ ID NO: 112550 - protein, 34 aa, Artificial Sequence
  Description of Artificial Sequence: Synthetic polypeptide
AEEEIRTTNPVATEQYGSVVVSVTNNDQEQETDE

SEQ ID NO: 112551 - protein, 34 aa, Artificial Sequence
  Description of Artificial Sequence: Synthetic polypeptide
AEEEIRTTNPVATEQYGSVVVSVTNNEQEQEQTD

SEQ ID NO: 112552 - protein, 34 aa, Artificial Sequence
  Description of Artificial Sequence: Synthetic polypeptide
DENEIRTTNPVATEQYGSVSTNNADINLSGSIVE

SEQ ID NO: 112553 - protein, 33 aa, Artificial Sequence
  Description of Artificial Sequence: Synthetic polypeptide
QESEIRTTNPVATECYGVVSCITEPQDREGENG

SEQ ID NO: 112554 - protein, 35 aa, Artificial Sequence
  Description of Artificial Sequence: Synthetic polypeptide
DENEIRTTNPVATEQYGSVSSTTAGPNMRNGMNPV

SEQ ID NO: 112555 - protein, 30 aa, Artificial Sequence
  Description of Artificial Sequence: Synthetic polypeptide
QDNEIATTNPVSTEGYGNVSANTLQSRGEL

SEQ ID NO: 112556 - protein, 29 aa, Artificial Sequence
  Description of Artificial Sequence: Synthetic peptide
QESEIRTTNPVGTEGYGVMASTLQDHGDI

SEQ ID NO: 112557 - protein, 29 aa, Artificial Sequence
  Description of Artificial Sequence: Synthetic peptide
QESEIRTTNPVGTEGYGVVSETLMAAGDI

SEQ ID NO: 112558 - protein, 34 aa, Artificial Sequence
  Description of Artificial Sequence: Synthetic polypeptide
DENEIRTTNPVATEQYGSVSPTNATEYEGSDMSF

SEQ ID NO: 112559 - protein, 30 aa, Artificial Sequence
  Description of Artificial Sequence: Synthetic polypeptide
QESEIRTTNPVGTEQYGSMATTGPQHNGDV

SEQ ID NO: 112560 - protein, 34 aa, Artificial Sequence
  Description of Artificial Sequence: Synthetic polypeptide
DENEIRTTNPVATEQYGSVSPTLAEQERSFETTN

SEQ ID NO: 112561 - protein, 28 aa, Artificial Sequence
  Description of Artificial Sequence: Synthetic peptide
QDNEIATTNPVATECYGDVSECLQHHEL

SEQ ID NO: 112562 - protein, 36 aa, Artificial Sequence
  Description of Artificial Sequence: Synthetic polypeptide
DENEIRTTNPVATEQYGSVSPPTNNLIELTGENQIQ

SEQ ID NO: 112563 - protein, 28 aa, Artificial Sequence
  Description of Artificial Sequence: Synthetic peptide
QDNEIATTNPVATECYGDVSECLQHEEL

SEQ ID NO: 112564 - protein, 29 aa, Artificial Sequence
  Description of Artificial Sequence: Synthetic peptide
QESEIRTTNPVSTEGYGVMASETLQHGDI

SEQ ID NO: 112565 - protein, 29 aa, Artificial Sequence
  Description of Artificial Sequence: Synthetic peptide
QESEIRTTNPVSTEGYGVMASETLQQGDI

SEQ ID NO: 112566 - protein, 29 aa, Artificial Sequence
  Description of Artificial Sequence: Synthetic peptide
QDGEIASTNPVSTEGYGIVACNLQSRGTR

SEQ ID NO: 112567 - protein, 29 aa, Artificial Sequence
  Description of Artificial Sequence: Synthetic peptide
QESEIRTTNPVSTEPYGVMASEDLQQGDI

SEQ ID NO: 112568 - protein, 29 aa, Artificial Sequence
  Description of Artificial Sequence: Synthetic peptide
QESEIRTTNPVSTEPYGVMASETLQQGDI

SEQ ID NO: 112569 - protein, 34 aa, Artificial Sequence
  Description of Artificial Sequence: Synthetic polypeptide
DESEIRTTNPVATERWGSVSCINEPQDREGENGM

SEQ ID NO: 112570 - protein, 34 aa, Artificial Sequence
  Description of Artificial Sequence: Synthetic polypeptide
DESEIRTTNPVATERWGSVSCINQEPQDREGENG

SEQ ID NO: 112571 - protein, 33 aa, Artificial Sequence
  Description of Artificial Sequence: Synthetic polypeptide
DENEIRTTNPVATEQYGSVSMDNTQMETDQIAV

SEQ ID NO: 112572 - protein, 33 aa, Artificial Sequence
  Description of Artificial Sequence: Synthetic polypeptide
DENEIRTTNPVATEQYGSVSMDMTTMETMQIGT

SEQ ID NO: 112573 - protein, 34 aa, Artificial Sequence
  Description of Artificial Sequence: Synthetic polypeptide
DENEIRTTNPVATEQYGSVSMDMTQMETMQIGDG

SEQ ID NO: 112574 - protein, 33 aa, Artificial Sequence
  Description of Artificial Sequence: Synthetic polypeptide
DENEIRTTNPVATEQYGSVSMDMTQHESMQEGM

SEQ ID NO: 112575 - protein, 30 aa, Artificial Sequence
  Description of Artificial Sequence: Synthetic polypeptide
QESEIVSTNPVGTEQYGTVASDGLVQFGNI

SEQ ID NO: 112576 - protein, 30 aa, Artificial Sequence
  Description of Artificial Sequence: Synthetic polypeptide
QESEIVSTNPVGTEQYGTVSSDGLVQFGNI

SEQ ID NO: 112577 - protein, 35 aa, Artificial Sequence
  Description of Artificial Sequence: Synthetic polypeptide
DENEIRTTNPVATEQYGSVSITMTTQPEEGQQENE

SEQ ID NO: 112578 - protein, 28 aa, Artificial Sequence
  Description of Artificial Sequence: Synthetic peptide
QESEIVSTNPVGTEQYGVVATGLEHGDI

SEQ ID NO: 112579 - protein, 29 aa, Artificial Sequence
  Description of Artificial Sequence: Synthetic peptide
QESEIVSTNPVGTEQYGVVSTGLVEHGDD

SEQ ID NO: 112580 - protein, 34 aa, Artificial Sequence
  Description of Artificial Sequence: Synthetic polypeptide
DENEIRTTNPVATEQYGSVSPTWDETNSGQNDIS

SEQ ID NO: 112581 - protein, 28 aa, Artificial Sequence
  Description of Artificial Sequence: Synthetic peptide
QEAEIATTNPVATECYGDVSECLSHEEL

SEQ ID NO: 112582 - protein, 33 aa, Artificial Sequence
  Description of Artificial Sequence: Synthetic polypeptide
DESEIRTTNPVATEQYGVVSELNDNQLEGEDVE

SEQ ID NO: 112583 - protein, 34 aa, Artificial Sequence
  Description of Artificial Sequence: Synthetic polypeptide
DENEIRTTNPVATEQYGSVSPWNILTQEILDDGV

SEQ ID NO: 112584 - protein, 33 aa, Artificial Sequence
  Description of Artificial Sequence: Synthetic polypeptide
QESEIRTTNPVATEFWGSVSIINEPQEREGENG

SEQ ID NO: 112585 - protein, 28 aa, Artificial Sequence
  Description of Artificial Sequence: Synthetic peptide
QEAEIATTNPVATECYGAVSECLIHEEL

SEQ ID NO: 112586 - protein, 31 aa, Artificial Sequence
  Description of Artificial Sequence: Synthetic polypeptide
QESEIRTTNPVATEGYGVVSSTLPQHEGEDG

SEQ ID NO: 112587 - protein, 28 aa, Artificial Sequence
  Description of Artificial Sequence: Synthetic peptide
QEAEIATTNPVATECFGDVSECLQHEEL

SEQ ID NO: 112588 - protein, 34 aa, Artificial Sequence
  Description of Artificial Sequence: Synthetic polypeptide
DENEIRTTNPVATEQYGSVSSTIGPNMANGMDPV

SEQ ID NO: 112589 - protein, 28 aa, Artificial Sequence
  Description of Artificial Sequence: Synthetic peptide
QEAEIAPTNPCSSSQYGIVSCNLQSGTR

SEQ ID NO: 112590 - protein, 33 aa, Artificial Sequence
  Description of Artificial Sequence: Synthetic polypeptide
DENEIRTTNPVATEQYGSVSSTIGMMANGMDPV

SEQ ID NO: 112591 - protein, 33 aa, Artificial Sequence
  Description of Artificial Sequence: Synthetic polypeptide
QESEIRTTNPVATEMWGSVSCINEPQDREGENG

SEQ ID NO: 112592 - protein, 28 aa, Artificial Sequence
  Description of Artificial Sequence: Synthetic peptide
QEAEIAPTNPCSSEQYGIVSCNLQSGTS

SEQ ID NO: 112593 - protein, 36 aa, Artificial Sequence
  Description of Artificial Sequence: Synthetic polypeptide
DENEIRTTNPVATEQYGSVSSTEPNGPNMRNGMNPV

SEQ ID NO: 112594 - protein, 28 aa, Artificial Sequence
  Description of Artificial Sequence: Synthetic peptide
QEAEIAPTNPCSSEQYGIVSCNLQSGTE

SEQ ID NO: 112595 - protein, 35 aa, Artificial Sequence
  Description of Artificial Sequence: Synthetic polypeptide
DENEIRTTNPVATEQYGSVSSTEPAGPNMRNGMNV

SEQ ID NO: 112596 - protein, 29 aa, Artificial Sequence
  Description of Artificial Sequence: Synthetic peptide
QEAEIAPTNPCSSEQYGAVSCNLQSGGTR

SEQ ID NO: 112597 - protein, 28 aa, Artificial Sequence
  Description of Artificial Sequence: Synthetic peptide
QEAEIAPTNPCSSEAYGIVSCNLQSGTR

SEQ ID NO: 112598 - protein, 31 aa, Artificial Sequence
  Description of Artificial Sequence: Synthetic polypeptide
QESEIRTTNPVATEQYGSAPEINEQDHEGEG

SEQ ID NO: 112599 - protein, 34 aa, Artificial Sequence
  Description of Artificial Sequence: Synthetic polypeptide
DENEIRTTNPVATEQYGSVSSTEPAGNMHNEMNV

SEQ ID NO: 112600 - protein, 28 aa, Artificial Sequence
  Description of Artificial Sequence: Synthetic peptide
QDSEIATTNPVATEGYGNVANVIQRGQK

SEQ ID NO: 112601 - protein, 34 aa, Artificial Sequence
  Description of Artificial Sequence: Synthetic polypeptide
QESEIRTTNPVATEQYGSVSATPTGPQRNGMDPV

SEQ ID NO: 112602 - protein, 34 aa, Artificial Sequence
  Description of Artificial Sequence: Synthetic polypeptide
DENEIRTTNPVATEQYGSVSSTAGPNMRNGMDPV

SEQ ID NO: 112603 - protein, 34 aa, Artificial Sequence
  Description of Artificial Sequence: Synthetic polypeptide
DENEIRTTNPVATEQYGSVSSTAGPNMANGMDPV

SEQ ID NO: 112604 - protein, 31 aa, Artificial Sequence
  Description of Artificial Sequence: Synthetic polypeptide
QESEIRTTNPVGTECYGVVSCINEQREGEDG

SEQ ID NO: 112605 - protein, 28 aa, Artificial Sequence
  Description of Artificial Sequence: Synthetic peptide
QDSEIASTNPVSTEGYGVVASTLQRGQI

SEQ ID NO: 112606 - protein, 28 aa, Artificial Sequence
  Description of Artificial Sequence: Synthetic peptide
QDSEIASTNPVGTEGYGVVASTLQRGQI

SEQ ID NO: 112607 - protein, 30 aa, Artificial Sequence
  Description of Artificial Sequence: Synthetic polypeptide
QESEIRTTNPVGTEGWGSMSCTLQDHGENI

SEQ ID NO: 112608 - protein, 30 aa, Artificial Sequence
  Description of Artificial Sequence: Synthetic polypeptide
QESEIRTTNPVGTEGWGSMSSTLQDHGENI

SEQ ID NO: 112609 - protein, 29 aa, Artificial Sequence
  Description of Artificial Sequence: Synthetic peptide
QESEIRTTNPVGTEGWGVMSSNEQRGEDI

SEQ ID NO: 112610 - protein, 35 aa, Artificial Sequence
  Description of Artificial Sequence: Synthetic polypeptide
DENEIRTTNPVATEQYGSVSTNNADQKLSGSIVEA

SEQ ID NO: 112611 - protein, 31 aa, Artificial Sequence
  Description of Artificial Sequence: Synthetic polypeptide
QESEIRSTNPVGTEQYGSVATSTGNHNGMNV

SEQ ID NO: 112612 - protein, 28 aa, Artificial Sequence
  Description of Artificial Sequence: Synthetic peptide
QESEIRSTNPVGTEQWGVMASTLQHGDI

SEQ ID NO: 112613 - protein, 35 aa, Artificial Sequence
  Description of Artificial Sequence: Synthetic polypeptide
DENEIRTTNPVATEQYGSVTPTPFLQDIIDENFRI

SEQ ID NO: 112614 - protein, 34 aa, Artificial Sequence
  Description of Artificial Sequence: Synthetic polypeptide
DESEIRTTNPVATEQYGSVSSYNDAEQHSGQEDH

SEQ ID NO: 112615 - protein, 35 aa, Artificial Sequence
  Description of Artificial Sequence: Synthetic polypeptide
DESEIRTTNPVATEQYGSVSSYNDSEQHSGQEDNF

SEQ ID NO: 112616 - protein, 28 aa, Artificial Sequence
  Description of Artificial Sequence: Synthetic peptide
QESEIATTNPVGTEQYGVMASTLQHEEI

SEQ ID NO: 112617 - protein, 35 aa, Artificial Sequence
  Description of Artificial Sequence: Synthetic polypeptide
DESEIRTTNPVATEQYGSVSTEDLEFPGFDQNDML

SEQ ID NO: 112618 - protein, 33 aa, Artificial Sequence
  Description of Artificial Sequence: Synthetic polypeptide
QECEICTTNPVATEAYGVVSTNQNLQQGNEEQL

SEQ ID NO: 112619 - protein, 28 aa, Artificial Sequence
  Description of Artificial Sequence: Synthetic peptide
QESEIATTNPVSTECYGDVSECLQHEEL

SEQ ID NO: 112620 - protein, 28 aa, Artificial Sequence
  Description of Artificial Sequence: Synthetic peptide
QESEIATTNPVSTECYGDVSNCLQHEEL

SEQ ID NO: 112621 - protein, 32 aa, Artificial Sequence
  Description of Artificial Sequence: Synthetic polypeptide
CEAEIKTTNPVATDAWGSVCCTNLSQEPGPNR

SEQ ID NO: 112622 - protein, 31 aa, Artificial Sequence
  Description of Artificial Sequence: Synthetic polypeptide
QECEICTTNPVATEAYGVVSTEQLQGNEEQD

SEQ ID NO: 112623 - protein, 31 aa, Artificial Sequence
  Description of Artificial Sequence: Synthetic polypeptide
QECEICTTNPVATEAYGVVSTEQLQGEEQND

SEQ ID NO: 112624 - protein, 29 aa, Artificial Sequence
  Description of Artificial Sequence: Synthetic peptide
QESEIATTNPVSTEPYGVISMTIQQQGNH

SEQ ID NO: 112625 - protein, 29 aa, Artificial Sequence
  Description of Artificial Sequence: Synthetic peptide
QESEIATTNPVSTEQYGEVAEVCQRVEER

SEQ ID NO: 112626 - protein, 29 aa, Artificial Sequence
  Description of Artificial Sequence: Synthetic peptide
QESEICSTNPVCTEIYGSVNASTLQEGDT

SEQ ID NO: 112627 - protein, 29 aa, Artificial Sequence
  Description of Artificial Sequence: Synthetic peptide
QESEICSTNPVCTEIYGSVSASTLQNGDI

SEQ ID NO: 112628 - protein, 31 aa, Artificial Sequence
  Description of Artificial Sequence: Synthetic polypeptide
QECEICTTNPVATEAYGVVSTEQLQGEENLQ

SEQ ID NO: 112629 - protein, 28 aa, Artificial Sequence
  Description of Artificial Sequence: Synthetic peptide
QESEIQSTNPVGTEQYGVMASTLQHGDI

SEQ ID NO: 112630 - protein, 28 aa, Artificial Sequence
  Description of Artificial Sequence: Synthetic peptide
QESEIRCTNPIATEGYGSMASTLMHGDI

SEQ ID NO: 112631 - protein, 34 aa, Artificial Sequence
  Description of Artificial Sequence: Synthetic polypeptide
DENEIRTTNPVATEQYGSVSVYWNLFDSRIDQED

SEQ ID NO: 112632 - protein, 33 aa, Artificial Sequence
  Description of Artificial Sequence: Synthetic polypeptide
CEAEIACTNPVATEQYGSVATNLQDNPGENAEE

SEQ ID NO: 112633 - protein, 34 aa, Artificial Sequence
  Description of Artificial Sequence: Synthetic polypeptide
DENEIRTTNPVATEQYGSVSVVYVDLEIGGTHRM

SEQ ID NO: 112634 - protein, 30 aa, Artificial Sequence
  Description of Artificial Sequence: Synthetic polypeptide
QECEICTTNPVATEAYGVVSTEQLQDEEQL

SEQ ID NO: 112635 - protein, 35 aa, Artificial Sequence
  Description of Artificial Sequence: Synthetic polypeptide
DENEIRTTNPVATEQYGSVSVTVYAEQPMNNEVER

SEQ ID NO: 112636 - protein, 35 aa, Artificial Sequence
  Description of Artificial Sequence: Synthetic polypeptide
DENEIRTTNPVATEQYGSVSVTVYAEQPGNNEVIA

SEQ ID NO: 112637 - protein, 34 aa, Artificial Sequence
  Description of Artificial Sequence: Synthetic polypeptide
DENEIRTTNPVATEQYGSVSVTVVAEEPGNNEVE

SEQ ID NO: 112638 - protein, 29 aa, Artificial Sequence
  Description of Artificial Sequence: Synthetic peptide
QESEIATTNPVGTEPYGVISMTLQQQGNI

SEQ ID NO: 112639 - protein, 34 aa, Artificial Sequence
  Description of Artificial Sequence: Synthetic polypeptide
DENEIRTTNPVATEQYGSVSVTVLLPEGGTFSFG

SEQ ID NO: 112640 - protein, 30 aa, Artificial Sequence
  Description of Artificial Sequence: Synthetic polypeptide
QECEICTTNPVATEAYGVVSVENLLQHEEL

SEQ ID NO: 112641 - protein, 35 aa, Artificial Sequence
  Description of Artificial Sequence: Synthetic polypeptide
DESEIRTTNPVATEQYGSVSSTTPTGPNMRNGMNV

SEQ ID NO: 112642 - protein, 28 aa, Artificial Sequence
  Description of Artificial Sequence: Synthetic peptide
QESEIATTNPVGTECYGVVAETLQHGDI

SEQ ID NO: 112643 - protein, 34 aa, Artificial Sequence
  Description of Artificial Sequence: Synthetic polypeptide
DENEIRTTNPVATEQYGSVWVTVNMNAFEGQNQT

SEQ ID NO: 112644 - protein, 28 aa, Artificial Sequence
  Description of Artificial Sequence: Synthetic peptide
QESEIATTNPVGTEGYGDMASTLQHGDI

SEQ ID NO: 112645 - protein, 28 aa, Artificial Sequence
  Description of Artificial Sequence: Synthetic peptide
QESEIATTNPVGTEGYGSMASALNHGNI

SEQ ID NO: 112646 - protein, 34 aa, Artificial Sequence
  Description of Artificial Sequence: Synthetic polypeptide
DENEIRTTNPVATEQYGSVWTIALENPGENQNDA

SEQ ID NO: 112647 - protein, 36 aa, Artificial Sequence
  Description of Artificial Sequence: Synthetic polypeptide
DESEIRTTNPVATEQYGSVSSTTPAGPNMRNGMNPR

SEQ ID NO: 112648 - protein, 35 aa, Artificial Sequence
  Description of Artificial Sequence: Synthetic polypeptide
DESEIRTTNPVATEQYGSVSSTTPAGPNRNGMNPV

SEQ ID NO: 112649 - protein, 36 aa, Artificial Sequence
  Description of Artificial Sequence: Synthetic polypeptide
DESEIRTTNPVATEQYGSVSSTTPAGPQMRNGMNPV

SEQ ID NO: 112650 - protein, 34 aa, Artificial Sequence
  Description of Artificial Sequence: Synthetic polypeptide
DENEIRTTNPVATEQYGSVWSCIGPLEQGDIENN

SEQ ID NO: 112651 - protein, 35 aa, Artificial Sequence
  Description of Artificial Sequence: Synthetic polypeptide
DENEIRTTNPVATEQYGSVWMTYVNLERGGDQSQN

SEQ ID NO: 112652 - protein, 32 aa, Artificial Sequence
  Description of Artificial Sequence: Synthetic polypeptide
DENEIRTTNPVATEQYGSVWMEVLLQNISEID

SEQ ID NO: 112653 - protein, 34 aa, Artificial Sequence
  Description of Artificial Sequence: Synthetic polypeptide
DENEIRTTNPVATEQYGSVWELPQMLQRDILGED

SEQ ID NO: 112654 - protein, 35 aa, Artificial Sequence
  Description of Artificial Sequence: Synthetic polypeptide
DESEIRTTNPVATEQYGSVSSTTPAINSRNGMNPV

SEQ ID NO: 112655 - protein, 29 aa, Artificial Sequence
  Description of Artificial Sequence: Synthetic peptide
QESEIATTNPVGTEGYGSMATSALNHGNI

SEQ ID NO: 112656 - protein, 28 aa, Artificial Sequence
  Description of Artificial Sequence: Synthetic peptide
QESEIATTNPVGTEGYGTMSSTLQHGDI

SEQ ID NO: 112657 - protein, 28 aa, Artificial Sequence
  Description of Artificial Sequence: Synthetic peptide
QESEIATTNPVGTEGYGVIASTLQHGDI

SEQ ID NO: 112658 - protein, 28 aa, Artificial Sequence
  Description of Artificial Sequence: Synthetic peptide
QESEIATTNPVGTEGYGVMASTLNHGNI

SEQ ID NO: 112659 - protein, 28 aa, Artificial Sequence
  Description of Artificial Sequence: Synthetic peptide
QESEIATTNPVGTEGYGVMASTLQHGDD

SEQ ID NO: 112660 - protein, 28 aa, Artificial Sequence
  Description of Artificial Sequence: Synthetic peptide
QESEIATTNPVGTEGYGVMASTLQHGDI

SEQ ID NO: 112661 - protein, 28 aa, Artificial Sequence
  Description of Artificial Sequence: Synthetic peptide
QESEIATTNPVGTEGYGVMASTLQHGDL

SEQ ID NO: 112662 - protein, 28 aa, Artificial Sequence
  Description of Artificial Sequence: Synthetic peptide
QESEIATTNPVGTEGYGVMASTLQHGEI

SEQ ID NO: 112663 - protein, 28 aa, Artificial Sequence
  Description of Artificial Sequence: Synthetic peptide
QESEIATTNPVGTEGYGVVASDLQHGDI

SEQ ID NO: 112664 - protein, 28 aa, Artificial Sequence
  Description of Artificial Sequence: Synthetic peptide
QESEIATTNPVGTEGYGVVSSTLQHEDL

SEQ ID NO: 112665 - protein, 28 aa, Artificial Sequence
  Description of Artificial Sequence: Synthetic peptide
QESEIATTNPVGTEGYGVVSSTLQHEEL

SEQ ID NO: 112666 - protein, 29 aa, Artificial Sequence
  Description of Artificial Sequence: Synthetic peptide
QESEIATTNPVGTEPYGVISMTIQQQGNH

SEQ ID NO: 112667 - protein, 29 aa, Artificial Sequence
  Description of Artificial Sequence: Synthetic peptide
QESEIATTNPVGTEPYGVISMTIQQQGNI

SEQ ID NO: 112668 - protein, 32 aa, Artificial Sequence
  Description of Artificial Sequence: Synthetic polypeptide
QECEICTTNPVATEAYGVVSTENQLQGGEELQ

SEQ ID NO: 112669 - protein, 31 aa, Artificial Sequence
  Description of Artificial Sequence: Synthetic polypeptide
QECEICTTNPVATEAYGVVSTELQLQQGEES

SEQ ID NO: 112670 - protein, 30 aa, Artificial Sequence
  Description of Artificial Sequence: Synthetic polypeptide
QECEICTTNPVATEAYGVVSTELQLQHEEN

SEQ ID NO: 112671 - protein, 29 aa, Artificial Sequence
  Description of Artificial Sequence: Synthetic peptide
QESEIRSTNPVATEGYGSVASAGQHGMDV

SEQ ID NO: 112672 - protein, 35 aa, Artificial Sequence
  Description of Artificial Sequence: Synthetic polypeptide
CEEEIRTTNPVATEQYGSVSDGVTGLGGNQGGQGG

SEQ ID NO: 112673 - protein, 30 aa, Artificial Sequence
  Description of Artificial Sequence: Synthetic polypeptide
QECEICTTNPVATEAYGVVSEQLQQGEEEL

SEQ ID NO: 112674 - protein, 34 aa, Artificial Sequence
  Description of Artificial Sequence: Synthetic polypeptide
DENEIRTTNPVATEQYGSVSTTEPVIQEGLEDHP

SEQ ID NO: 112675 - protein, 30 aa, Artificial Sequence
  Description of Artificial Sequence: Synthetic polypeptide
QESEIRSTNPVATEGYGVVSSTLQHEGEDI

SEQ ID NO: 112676 - protein, 30 aa, Artificial Sequence
  Description of Artificial Sequence: Synthetic polypeptide
QECEICTTNPVATEAYGVVSENQLQGEEQL

SEQ ID NO: 112677 - protein, 36 aa, Artificial Sequence
  Description of Artificial Sequence: Synthetic polypeptide
DENEIRTTNPVATEQYGSVSTTAMLTQLRYGQEDHI

SEQ ID NO: 112678 - protein, 29 aa, Artificial Sequence
  Description of Artificial Sequence: Synthetic peptide
QECEICTTNPVATEAYGVVSELLQSAEEL

SEQ ID NO: 112679 - protein, 35 aa, Artificial Sequence
  Description of Artificial Sequence: Synthetic polypeptide
DENEIRTTNPVATEQYGSVSTPYNADQTEGSEEHC

SEQ ID NO: 112680 - protein, 34 aa, Artificial Sequence
  Description of Artificial Sequence: Synthetic polypeptide
DENEIRTTNPVATEQYGSVSTPVNDSIEGSEEHS

SEQ ID NO: 112681 - protein, 35 aa, Artificial Sequence
  Description of Artificial Sequence: Synthetic polypeptide
DENEIRTTNPVATEQYGSVSTPSNHDQTEGSEEHS

SEQ ID NO: 112682 - protein, 35 aa, Artificial Sequence
  Description of Artificial Sequence: Synthetic polypeptide
DENEIRTTNPVATEQYGSVSTPNADQIEGSIEEHS

SEQ ID NO: 112683 - protein, 35 aa, Artificial Sequence
  Description of Artificial Sequence: Synthetic polypeptide
DENEIRTTNPVATEQYGSVSTPNADLTEGSEEEHS

SEQ ID NO: 112684 - protein, 29 aa, Artificial Sequence
  Description of Artificial Sequence: Synthetic peptide
QECEICTTNPVATEAYGVVSELLQDEEEL

SEQ ID NO: 112685 - protein, 28 aa, Artificial Sequence
  Description of Artificial Sequence: Synthetic peptide
QESEIRSTNPVGTEGWGVMSCTLQHGNI

SEQ ID NO: 112686 - protein, 33 aa, Artificial Sequence
  Description of Artificial Sequence: Synthetic polypeptide
DENEIRTTNPVATEQYGSVSTPAGPNMANEDPA

SEQ ID NO: 112687 - protein, 29 aa, Artificial Sequence
  Description of Artificial Sequence: Synthetic peptide
QESEIRSTNPVGTEGYGDVASTLQAAGDI

SEQ ID NO: 112688 - protein, 35 aa, Artificial Sequence
  Description of Artificial Sequence: Synthetic polypeptide
CEEEIRTTNPVATEQYGSVSNVGDLGQRFNMNEQD

SEQ ID NO: 112689 - protein, 34 aa, Artificial Sequence
  Description of Artificial Sequence: Synthetic polypeptide
DENEIRTTNPVATEQYGSVSTNPYDSESGQIDGI

SEQ ID NO: 112690 - protein, 29 aa, Artificial Sequence
  Description of Artificial Sequence: Synthetic peptide
QECEICATNPCTTEIYGVVSTNTLQNGDT

SEQ ID NO: 112691 - protein, 29 aa, Artificial Sequence
  Description of Artificial Sequence: Synthetic peptide
QECEIATTNPVAYTECYGDVSECLQHEEL

SEQ ID NO: 112692 - protein, 35 aa, Artificial Sequence
  Description of Artificial Sequence: Synthetic polypeptide
CEEEIRTTNPVATEQYGSVSPTTNNYERGFDIQEG

SEQ ID NO: 112693 - protein, 28 aa, Artificial Sequence
  Description of Artificial Sequence: Synthetic peptide
QESEIRSTNPVGTEQWGDMASTLQHGDA

SEQ ID NO: 112694 - protein, 32 aa, Artificial Sequence
  Description of Artificial Sequence: Synthetic polypeptide
DESEIRTTNPVATEQYGSVYPEDLTENGMEKN

SEQ ID NO: 112695 - protein, 28 aa, Artificial Sequence
  Description of Artificial Sequence: Synthetic peptide
QESEIRSTNPVGTEQWGVMASTLQHGDA

SEQ ID NO: 112696 - protein, 33 aa, Artificial Sequence
  Description of Artificial Sequence: Synthetic polypeptide
DESEIRTTNPVATEQYGSVYDANDLHGMFNIDG

SEQ ID NO: 112697 - protein, 34 aa, Artificial Sequence
  Description of Artificial Sequence: Synthetic polypeptide
DENEIRTTNPVATEQYGSVSTTNATEYEGYSDQS

SEQ ID NO: 112698 - protein, 31 aa, Artificial Sequence
  Description of Artificial Sequence: Synthetic polypeptide
QESEIRSTNPVATEGWGSVACNEPQREGENG

SEQ ID NO: 112699 - protein, 31 aa, Artificial Sequence
  Description of Artificial Sequence: Synthetic polypeptide
QECEICTTNPVATEAYGVVSEQLQQGNEELQ

SEQ ID NO: 112700 - protein, 31 aa, Artificial Sequence
  Description of Artificial Sequence: Synthetic polypeptide
QECEICTTNPVATEAYGVVSTELQLPQGEEL

SEQ ID NO: 112701 - protein, 28 aa, Artificial Sequence
  Description of Artificial Sequence: Synthetic peptide
QESEIRCTNPIGTEGYGVVSETLMHGNI

SEQ ID NO: 112702 - protein, 28 aa, Artificial Sequence
  Description of Artificial Sequence: Synthetic peptide
QESEIRCTNPVGTEGYGVMASTLQHGDI

SEQ ID NO: 112703 - protein, 36 aa, Artificial Sequence
  Description of Artificial Sequence: Synthetic polypeptide
AEEEIRTTNPVATEQYGSVSTVTVSNLGNTEAGNQM

SEQ ID NO: 112704 - protein, 32 aa, Artificial Sequence
  Description of Artificial Sequence: Synthetic polypeptide
QESEIRPTNPVASECWGSVSCINEPQDREGNR

SEQ ID NO: 112705 - protein, 30 aa, Artificial Sequence
  Description of Artificial Sequence: Synthetic polypeptide
QECEICTTNPVATEAYGVVSTELLQNEEAL

SEQ ID NO: 112706 - protein, 32 aa, Artificial Sequence
  Description of Artificial Sequence: Synthetic polypeptide
QESEIRPTNPVATECWGSVSCINEPQDREGNG

SEQ ID NO: 112707 - protein, 32 aa, Artificial Sequence
  Description of Artificial Sequence: Synthetic polypeptide
DENEIRTTNPVATEQYGSVSVPLAANSDQEEH

SEQ ID NO: 112708 - protein, 30 aa, Artificial Sequence
  Description of Artificial Sequence: Synthetic polypeptide
QECEICTTNPVATEAYGVVSTELLQLEELY

SEQ ID NO: 112709 - protein, 30 aa, Artificial Sequence
  Description of Artificial Sequence: Synthetic polypeptide
QECEICTTNPVATEAYGVVSTELLQHEEET

SEQ ID NO: 112710 - protein, 31 aa, Artificial Sequence
  Description of Artificial Sequence: Synthetic polypeptide
QECEICTTNPVATEAYGVVSTELLQAGEELE

SEQ ID NO: 112711 - protein, 30 aa, Artificial Sequence
  Description of Artificial Sequence: Synthetic polypeptide
QECEICTTNPVATEAYGVVSTEALLQQEEL

SEQ ID NO: 112712 - protein, 35 aa, Artificial Sequence
  Description of Artificial Sequence: Synthetic polypeptide
DENEIRTTNPVATEQYGSVWYTAELTQTESGQESR

SEQ ID NO: 112713 - protein, 29 aa, Artificial Sequence
  Description of Artificial Sequence: Synthetic peptide
QECEICTTNPVATEAYGVVSSELLQHEEL

SEQ ID NO: 112714 - protein, 29 aa, Artificial Sequence
  Description of Artificial Sequence: Synthetic peptide
QECEICTTNPVATEAYGVVSSELLQGEEL

SEQ ID NO: 112715 - protein, 28 aa, Artificial Sequence
  Description of Artificial Sequence: Synthetic peptide
QESEIRSTNPIGTEGYGVVASTLMHGNI

SEQ ID NO: 112716 - protein, 28 aa, Artificial Sequence
  Description of Artificial Sequence: Synthetic peptide
QESEIRSTNPIGTEGYGVVASTLQHGDI

SEQ ID NO: 112717 - protein, 35 aa, Artificial Sequence
  Description of Artificial Sequence: Synthetic polypeptide
DESEIRTTNPVATEQYGSVSVTGNQSPETGTKNGV

SEQ ID NO: 112718 - protein, 31 aa, Artificial Sequence
  Description of Artificial Sequence: Synthetic polypeptide
QESEIRSTNPVATECWGSMSCITLPQDRGNG

SEQ ID NO: 112719 - protein, 34 aa, Artificial Sequence
  Description of Artificial Sequence: Synthetic polypeptide
DENEIRTTNPVATEQYGSVSTVWDDETNSGQNNG

SEQ ID NO: 112720 - protein, 35 aa, Artificial Sequence
  Description of Artificial Sequence: Synthetic polypeptide
CEEEIRTTNPVATEQYGSVQDQSTEGQEGGGENGG

SEQ ID NO: 112721 - protein, 35 aa, Artificial Sequence
  Description of Artificial Sequence: Synthetic polypeptide
DESEIRTTNPVATEQYGSVSVTHNNLEDTRQEDDY

SEQ ID NO: 112722 - protein, 35 aa, Artificial Sequence
  Description of Artificial Sequence: Synthetic polypeptide
DESEIRTTNPVATEQYGSVTPTNGDENTQSGQDNQ

SEQ ID NO: 112723 - protein, 33 aa, Artificial Sequence
  Description of Artificial Sequence: Synthetic polypeptide
QESEIRSTNPVATECWGSVSCINLPQDREGENG

SEQ ID NO: 112724 - protein, 29 aa, Artificial Sequence
  Description of Artificial Sequence: Synthetic peptide
QESEIRSTNPVATECWGVVACTLQRGEDG

SEQ ID NO: 112725 - protein, 30 aa, Artificial Sequence
  Description of Artificial Sequence: Synthetic polypeptide
QECEICTTNPVATEAYGVVSNELLQHEENL

SEQ ID NO: 112726 - protein, 31 aa, Artificial Sequence
  Description of Artificial Sequence: Synthetic polypeptide
QESEIRPTNPVATECYGIVSCNEQDREGETG

SEQ ID NO: 112727 - protein, 30 aa, Artificial Sequence
  Description of Artificial Sequence: Synthetic polypeptide
DENEIRTTNPVSTEPYGTISEECIQQQGNL

SEQ ID NO: 112728 - protein, 28 aa, Artificial Sequence
  Description of Artificial Sequence: Synthetic peptide
QESEIASTNPVGTEQYGEAAETLQRGDI

SEQ ID NO: 112729 - protein, 28 aa, Artificial Sequence
  Description of Artificial Sequence: Synthetic peptide
QESEIASTNPVGTEPYGVMSSTLQHGNI

SEQ ID NO: 112730 - protein, 33 aa, Artificial Sequence
  Description of Artificial Sequence: Synthetic polypeptide
DEPEIATTNPVATEQYGSVSATDLEDGEGQEDG

SEQ ID NO: 112731 - protein, 29 aa, Artificial Sequence
  Description of Artificial Sequence: Synthetic peptide
QESEIAATNPCSSEQYGQVSCNLQSGQTR

SEQ ID NO: 112732 - protein, 28 aa, Artificial Sequence
  Description of Artificial Sequence: Synthetic peptide
QESEIACTNPIATEQYGVMASTLQHGDI

SEQ ID NO: 112733 - protein, 28 aa, Artificial Sequence
  Description of Artificial Sequence: Synthetic peptide
QESEIACTNPVATEGYGVAAENLQHGDI

SEQ ID NO: 112734 - protein, 35 aa, Artificial Sequence
  Description of Artificial Sequence: Synthetic polypeptide
CEEEIRTTNPVATEQYGCVCSTGELNQNFGSENQA

SEQ ID NO: 112735 - protein, 32 aa, Artificial Sequence
  Description of Artificial Sequence: Synthetic polypeptide
QEEEIACTNPVATEQYGSVATNDQATPGEEAA

SEQ ID NO: 112736 - protein, 32 aa, Artificial Sequence
  Description of Artificial Sequence: Synthetic polypeptide
DEPEIATTNPVATCQYGSVSATDLEDHEGEDL

SEQ ID NO: 112737 - protein, 35 aa, Artificial Sequence
  Description of Artificial Sequence: Synthetic polypeptide
AEEEIRTTNPVATEQYGSVSTVVNGNNNDEGGNSD

SEQ ID NO: 112738 - protein, 34 aa, Artificial Sequence
  Description of Artificial Sequence: Synthetic polypeptide
CEEEIRTTNPVATEQYGCVCSTGELQENFGSEQS

SEQ ID NO: 112739 - protein, 36 aa, Artificial Sequence
  Description of Artificial Sequence: Synthetic polypeptide
AEEEIRTTNPVATEQYGSVSTVVNGGNNQDEGNNTD

SEQ ID NO: 112740 - protein, 33 aa, Artificial Sequence
  Description of Artificial Sequence: Synthetic polypeptide
DENVIRYTNPVATEQYGSVSVPNQNDRIGSNMH

SEQ ID NO: 112741 - protein, 32 aa, Artificial Sequence
  Description of Artificial Sequence: Synthetic polypeptide
DENVIRYTNPVATEQYGSVSVPNQNDHGSTSR

SEQ ID NO: 112742 - protein, 34 aa, Artificial Sequence
  Description of Artificial Sequence: Synthetic polypeptide
CEEEIRTTNPVATEQYGCVCSTGNDQNFGSETQS

SEQ ID NO: 112743 - protein, 33 aa, Artificial Sequence
  Description of Artificial Sequence: Synthetic polypeptide
CEEEIRTTNPVATEQYGCVCSTGNHQNFFSEQA

SEQ ID NO: 112744 - protein, 28 aa, Artificial Sequence
  Description of Artificial Sequence: Synthetic peptide
QEEEIACTNPVATEQYGEAPEVLMREEK

SEQ ID NO: 112745 - protein, 28 aa, Artificial Sequence
  Description of Artificial Sequence: Synthetic peptide
QEEEIACTNPVATEQYGEAPENCQHEEK

SEQ ID NO: 112746 - protein, 28 aa, Artificial Sequence
  Description of Artificial Sequence: Synthetic peptide
QESEIACTNPVGTEGYGVAAETLQRGDR

SEQ ID NO: 112747 - protein, 28 aa, Artificial Sequence
  Description of Artificial Sequence: Synthetic peptide
QESEIACTNPVGTEGYGVASSNLQHGDI

SEQ ID NO: 112748 - protein, 28 aa, Artificial Sequence
  Description of Artificial Sequence: Synthetic peptide
QEEEIACTNPVATEQYGEAPENCMHGEK

SEQ ID NO: 112749 - protein, 34 aa, Artificial Sequence
  Description of Artificial Sequence: Synthetic polypeptide
CEEEIRTTNPVATEQYGCVCSTNHQEHFNSNNQA

SEQ ID NO: 112750 - protein, 28 aa, Artificial Sequence
  Description of Artificial Sequence: Synthetic peptide
QESEIACTNPVGTEGYGVMAETLQRGDR

SEQ ID NO: 112751 - protein, 28 aa, Artificial Sequence
  Description of Artificial Sequence: Synthetic peptide
QESEIACTNPVGTEGYGVMASTLQHGDR

SEQ ID NO: 112752 - protein, 28 aa, Artificial Sequence
  Description of Artificial Sequence: Synthetic peptide
QESEIACTNPVGTEGYGVMASTLQRGDI

SEQ ID NO: 112753 - protein, 28 aa, Artificial Sequence
  Description of Artificial Sequence: Synthetic peptide
QESEIACTNPVGTEGYGVMSSNLQHGDI

SEQ ID NO: 112754 - protein, 28 aa, Artificial Sequence
  Description of Artificial Sequence: Synthetic peptide
QESEIACTNPVGTEQYGEMAETLQRGDI

SEQ ID NO: 112755 - protein, 28 aa, Artificial Sequence
  Description of Artificial Sequence: Synthetic peptide
QEREIAPTNPCSSEQYGIVSCNLQSGTI

SEQ ID NO: 112756 - protein, 28 aa, Artificial Sequence
  Description of Artificial Sequence: Synthetic peptide
QESEIAPTNPCGSEQYGIVSCNLQSGDI

SEQ ID NO: 112757 - protein, 33 aa, Artificial Sequence
  Description of Artificial Sequence: Synthetic polypeptide
DEPEIATTNPVATEQYGSVSATDLEVHQGEDIF

SEQ ID NO: 112758 - protein, 29 aa, Artificial Sequence
  Description of Artificial Sequence: Synthetic peptide
QEREIACTNPCSYEQYGCVSCNLNQSGDR

SEQ ID NO: 112759 - protein, 34 aa, Artificial Sequence
  Description of Artificial Sequence: Synthetic polypeptide
AEEEIRTTNPVATEQYGSVVVNTNDESGTVNNVT

SEQ ID NO: 112760 - protein, 34 aa, Artificial Sequence
  Description of Artificial Sequence: Synthetic polypeptide
AEEEIRTTNPVATEQYGSVVVNTNDESGVNNDTT

SEQ ID NO: 112761 - protein, 34 aa, Artificial Sequence
  Description of Artificial Sequence: Synthetic polypeptide
AEEEIRTTNPVATEQYGSVVVNTNDESGVNNSTV

SEQ ID NO: 112762 - protein, 34 aa, Artificial Sequence
  Description of Artificial Sequence: Synthetic polypeptide
AEEEIRTTNPVATEQYGSVVVNTNDESGVVNNTV

SEQ ID NO: 112763 - protein, 37 aa, Artificial Sequence
  Description of Artificial Sequence: Synthetic polypeptide
AEEEIRTTNPVATEQYGSVSTVVNLNNAQGEQGTNVE

SEQ ID NO: 112764 - protein, 37 aa, Artificial Sequence
  Description of Artificial Sequence: Synthetic polypeptide
AEEEIRTTNPVATEQYGSVSTVVNLNAQNEQGTNPAE

SEQ ID NO: 112765 - protein, 37 aa, Artificial Sequence
  Description of Artificial Sequence: Synthetic polypeptide
AEEEIRTTNPVATEQYGSVSTVVNLNAQGEQGTNTEE

SEQ ID NO: 112766 - protein, 36 aa, Artificial Sequence
  Description of Artificial Sequence: Synthetic polypeptide
AEEEIRTTNPVATEQYGSVSTVVNLNAGSEQGTNVE

SEQ ID NO: 112767 - protein, 36 aa, Artificial Sequence
  Description of Artificial Sequence: Synthetic polypeptide
AEEEIRTTNPVATEQYGSVSTVVNLLNNNIGTNQTE

SEQ ID NO: 112768 - protein, 36 aa, Artificial Sequence
  Description of Artificial Sequence: Synthetic polypeptide
AEEEIRTTNPVATEQYGSVSTVVNLGNNAEEGTNSD

SEQ ID NO: 112769 - protein, 31 aa, Artificial Sequence
  Description of Artificial Sequence: Synthetic polypeptide
QEQEIATTNPVATEQYGVVSATTLEHEGEDL

SEQ ID NO: 112770 - protein, 33 aa, Artificial Sequence
  Description of Artificial Sequence: Synthetic polypeptide
CEEEIRTTNPVATEQYGCVCSTGEDQGFGSDQS

SEQ ID NO: 112771 - protein, 29 aa, Artificial Sequence
  Description of Artificial Sequence: Synthetic peptide
QEQEIATTNPVGTEGYGVVASTLQDHGDL

SEQ ID NO: 112772 - protein, 33 aa, Artificial Sequence
  Description of Artificial Sequence: Synthetic polypeptide
DEPEIATTNPVATEQYGYSVSATDLEDHEGEDL

SEQ ID NO: 112773 - protein, 35 aa, Artificial Sequence
  Description of Artificial Sequence: Synthetic polypeptide
AEEEIRTTNPVATEQYGSVVVSATTNLNQGTEAGT

SEQ ID NO: 112774 - protein, 31 aa, Artificial Sequence
  Description of Artificial Sequence: Synthetic polypeptide
QEQEIATTNPVSTEQYGIVSTNLEDSEGEDL

SEQ ID NO: 112775 - protein, 32 aa, Artificial Sequence
  Description of Artificial Sequence: Synthetic polypeptide
DEPEIATTNPVATEQYGSVSSNNLAEVETEQI

SEQ ID NO: 112776 - protein, 32 aa, Artificial Sequence
  Description of Artificial Sequence: Synthetic polypeptide
DEPEIATTNPVATEQYGSVSSNNEAVVGEEEF

SEQ ID NO: 112777 - protein, 33 aa, Artificial Sequence
  Description of Artificial Sequence: Synthetic polypeptide
DEPEIATTNPVATEQYGSVSSNLNQAEVEFEVI

SEQ ID NO: 112778 - protein, 33 aa, Artificial Sequence
  Description of Artificial Sequence: Synthetic polypeptide
AEEEIRTTNPVATEQYGSVVVSNILGNTNNAND

SEQ ID NO: 112779 - protein, 33 aa, Artificial Sequence
  Description of Artificial Sequence: Synthetic polypeptide
CEEEIRTTNPVATEQYGCVCSTGEHQHFGSEQA

SEQ ID NO: 112780 - protein, 33 aa, Artificial Sequence
  Description of Artificial Sequence: Synthetic polypeptide
DEPEIATTNPVATEQYGSVSSNINQAGVEFEQY

SEQ ID NO: 112781 - protein, 32 aa, Artificial Sequence
  Description of Artificial Sequence: Synthetic polypeptide
QEQEIATTNPVSTEQYGSVSATNLEDHEGEDL

SEQ ID NO: 112782 - protein, 32 aa, Artificial Sequence
  Description of Artificial Sequence: Synthetic polypeptide
DEPEIATTNPVATEQYGSVSSNGQAVVEFEEF

SEQ ID NO: 112783 - protein, 32 aa, Artificial Sequence
  Description of Artificial Sequence: Synthetic polypeptide
QEQEIATTNPVSTEQYGSVSATNLEDSEGEDL

SEQ ID NO: 112784 - protein, 29 aa, Artificial Sequence
  Description of Artificial Sequence: Synthetic peptide
QEREIACTNPCSYEQYGCVSSNLQSGTRF

SEQ ID NO: 112785 - protein, 32 aa, Artificial Sequence
  Description of Artificial Sequence: Synthetic polypeptide
QEQEIATTNPVATEQYGSVSATDLQDHEEEDL

SEQ ID NO: 112786 - protein, 35 aa, Artificial Sequence
  Description of Artificial Sequence: Synthetic polypeptide
CEEEIRTTNPVATEQYGCVCSTPEDLQNFGSENQA

SEQ ID NO: 112787 - protein, 33 aa, Artificial Sequence
  Description of Artificial Sequence: Synthetic polypeptide
CEEEIRTTNPVATEQYGCVCSTPEHQNFGSEQQ

SEQ ID NO: 112788 - protein, 28 aa, Artificial Sequence
  Description of Artificial Sequence: Synthetic peptide
QESEIAPTNPVSSEGYGIVACNLQSGDR

SEQ ID NO: 112789 - protein, 29 aa, Artificial Sequence
  Description of Artificial Sequence: Synthetic peptide
DENEVACTNPVATEGYGEAAENIQSRGGR

SEQ ID NO: 112790 - protein, 32 aa, Artificial Sequence
  Description of Artificial Sequence: Synthetic polypeptide
DENENATTNPVAYEQWGSVCSTNDQGEGNNNL

SEQ ID NO: 112791 - protein, 28 aa, Artificial Sequence
  Description of Artificial Sequence: Synthetic peptide
QESEIAPTNPVSSEGYGIVACNLQSGTR

SEQ ID NO: 112792 - protein, 33 aa, Artificial Sequence
  Description of Artificial Sequence: Synthetic polypeptide
DENEIYTTNPVATECWGSVSCINEPQDREGENG

SEQ ID NO: 112793 - protein, 29 aa, Artificial Sequence
  Description of Artificial Sequence: Synthetic peptide
QESEIAPTNPVSSEQYGNVSANNIQSGTR

SEQ ID NO: 112794 - protein, 28 aa, Artificial Sequence
  Description of Artificial Sequence: Synthetic peptide
QESEIAPTNPVSTEGYGIMSSNLQSGDI

SEQ ID NO: 112795 - protein, 28 aa, Artificial Sequence
  Description of Artificial Sequence: Synthetic peptide
QESEIAPTNPVSTEGYGIMSSNLQSGTI

SEQ ID NO: 112796 - protein, 28 aa, Artificial Sequence
  Description of Artificial Sequence: Synthetic peptide
QESEIASTNPCSSEGYGIVSSNLQHGTR

SEQ ID NO: 112797 - protein, 28 aa, Artificial Sequence
  Description of Artificial Sequence: Synthetic peptide
QESEIASTNPCSTEGYGIVSCNLQHGDI

SEQ ID NO: 112798 - protein, 31 aa, Artificial Sequence
  Description of Artificial Sequence: Synthetic polypeptide
DENEIVTTNPVSTEQYGTVSMDDIQQFEGND

SEQ ID NO: 112799 - protein, 31 aa, Artificial Sequence
  Description of Artificial Sequence: Synthetic polypeptide
DENEIVTTNPVSTEQYGTVSMDDIQEQNGND

SEQ ID NO: 112800 - protein, 32 aa, Artificial Sequence
  Description of Artificial Sequence: Synthetic polypeptide
DENEIVTTNPVSTEQYGTVSATDGPVEQNGNH

SEQ ID NO: 112801 - protein, 32 aa, Artificial Sequence
  Description of Artificial Sequence: Synthetic polypeptide
DENEIVTTNPVSTEQYGTVSATDDPVEQNGNH

SEQ ID NO: 112802 - protein, 28 aa, Artificial Sequence
  Description of Artificial Sequence: Synthetic peptide
QESEIASTNPCSTEGYGIVSSNLQHGTI

SEQ ID NO: 112803 - protein, 28 aa, Artificial Sequence
  Description of Artificial Sequence: Synthetic peptide
QESEIASTNPIATEQYGVMASTLQHGDI

SEQ ID NO: 112804 - protein, 32 aa, Artificial Sequence
  Description of Artificial Sequence: Synthetic polypeptide
DENEIVTTNPVSTEQYGTVSATDDPQEQNGNH

SEQ ID NO: 112805 - protein, 28 aa, Artificial Sequence
  Description of Artificial Sequence: Synthetic peptide
QESEIASTNPVATECWGVMASTLQRGDG

SEQ ID NO: 112806 - protein, 28 aa, Artificial Sequence
  Description of Artificial Sequence: Synthetic peptide
QESEIASTNPVATECYGDVASCLQHGDI

SEQ ID NO: 112807 - protein, 28 aa, Artificial Sequence
  Description of Artificial Sequence: Synthetic peptide
QESEIASTNPVATECYGDVSECLQHEDI

SEQ ID NO: 112808 - protein, 28 aa, Artificial Sequence
  Description of Artificial Sequence: Synthetic peptide
QESEIASTNPVATECYGVVSETLQHEDI

SEQ ID NO: 112809 - protein, 30 aa, Artificial Sequence
  Description of Artificial Sequence: Synthetic polypeptide
QESEIASTNPVATEGWGSMSCITLPQRGNI

SEQ ID NO: 112810 - protein, 32 aa, Artificial Sequence
  Description of Artificial Sequence: Synthetic polypeptide
DENEIVTTNPVATEQYGTVSMDDIVQQFNGNH

SEQ ID NO: 112811 - protein, 30 aa, Artificial Sequence
  Description of Artificial Sequence: Synthetic polypeptide
DENEIVTTNPVATEQYGTVSEIPENFEGDD

SEQ ID NO: 112812 - protein, 30 aa, Artificial Sequence
  Description of Artificial Sequence: Synthetic polypeptide
QESEIASTNPVATEGWGSVACNEQREGENG

SEQ ID NO: 112813 - protein, 31 aa, Artificial Sequence
  Description of Artificial Sequence: Synthetic polypeptide
QESEIAPTNPVSSECYGSVSCINLQDREGTR

SEQ ID NO: 112814 - protein, 32 aa, Artificial Sequence
  Description of Artificial Sequence: Synthetic polypeptide
DENTIRTTNPVATEQYGMVNETDPEVENGNRP

SEQ ID NO: 112815 - protein, 28 aa, Artificial Sequence
  Description of Artificial Sequence: Synthetic peptide
QESEIAPTNPVGTEGYGVVASTLQHGDI

SEQ ID NO: 112816 - protein, 28 aa, Artificial Sequence
  Description of Artificial Sequence: Synthetic peptide
QESEIAPTNPCSTEGYGVVASNLQHGTR

SEQ ID NO: 112817 - protein, 28 aa, Artificial Sequence
  Description of Artificial Sequence: Synthetic peptide
QESEIAPTNPCGSEQYGIVSCNLQSGTI

SEQ ID NO: 112818 - protein, 35 aa, Artificial Sequence
  Description of Artificial Sequence: Synthetic polypeptide
CEEEIRTTNPVATEQYGCVCSTTGEHQRFGSDNQS

SEQ ID NO: 112819 - protein, 28 aa, Artificial Sequence
  Description of Artificial Sequence: Synthetic peptide
QESEIAPTNPCGSEQYGIVSCTLQSGTR

SEQ ID NO: 112820 - protein, 32 aa, Artificial Sequence
  Description of Artificial Sequence: Synthetic polypeptide
QEEEIACTNPVATEQYGCVATTNLQDGMGEAA

SEQ ID NO: 112821 - protein, 28 aa, Artificial Sequence
  Description of Artificial Sequence: Synthetic peptide
QESEIAPTNPCSSEGYGIVSCNLQSGTR

SEQ ID NO: 112822 - protein, 31 aa, Artificial Sequence
  Description of Artificial Sequence: Synthetic polypeptide
DENSIHTTNPLATEQFGSVSCENLEGPPNGR

SEQ ID NO: 112823 - protein, 28 aa, Artificial Sequence
  Description of Artificial Sequence: Synthetic peptide
QESEIAPTNPCSSEQWGIVSCNLQSGTR

SEQ ID NO: 112824 - protein, 31 aa, Artificial Sequence
  Description of Artificial Sequence: Synthetic polypeptide
DENEVRTTNPVSTEPYGTVSMEDIQQRNGNH

SEQ ID NO: 112825 - protein, 28 aa, Artificial Sequence
  Description of Artificial Sequence: Synthetic peptide
QESEIAPTNPCSSEQYGIVACNLQSGTR

SEQ ID NO: 112826 - protein, 28 aa, Artificial Sequence
  Description of Artificial Sequence: Synthetic peptide
QESEIAPTNPCSSEQYGIVASNLQHGTR

SEQ ID NO: 112827 - protein, 28 aa, Artificial Sequence
  Description of Artificial Sequence: Synthetic peptide
QESEIAPTNPCSSEQYGIVASNLQSGTR

SEQ ID NO: 112828 - protein, 29 aa, Artificial Sequence
  Description of Artificial Sequence: Synthetic peptide
DENEVATTNPVSTEGYGNVSNCIQHVGQR

SEQ ID NO: 112829 - protein, 28 aa, Artificial Sequence
  Description of Artificial Sequence: Synthetic peptide
DENEVATTNPVSTEGYGNVSNCIQHEQR

SEQ ID NO: 112830 - protein, 28 aa, Artificial Sequence
  Description of Artificial Sequence: Synthetic peptide
DENEVATTNPVSTECYGNVSNCIQHEQR

SEQ ID NO: 112831 - protein, 28 aa, Artificial Sequence
  Description of Artificial Sequence: Synthetic peptide
DENEVATTNPVSTECYGDVSNCIQHEQR

SEQ ID NO: 112832 - protein, 29 aa, Artificial Sequence
  Description of Artificial Sequence: Synthetic peptide
DENEVATTNPVATECYGDVSECIQSHEQR

SEQ ID NO: 112833 - protein, 28 aa, Artificial Sequence
  Description of Artificial Sequence: Synthetic peptide
QESEIAPTNPCSSEQYGIVSCNIQSGTR

SEQ ID NO: 112834 - protein, 29 aa, Artificial Sequence
  Description of Artificial Sequence: Synthetic peptide
DENEVASTNPVSTEGYGNVSNTLQSHGQR

SEQ ID NO: 112835 - protein, 31 aa, Artificial Sequence
  Description of Artificial Sequence: Synthetic polypeptide
DENEVASTNPVSTEGYGNVSANTLQSRVGQR

SEQ ID NO: 112836 - protein, 29 aa, Artificial Sequence
  Description of Artificial Sequence: Synthetic peptide
DENEVASTNPVSTEGYGNVANTLQSRGQR

SEQ ID NO: 112837 - protein, 29 aa, Artificial Sequence
  Description of Artificial Sequence: Synthetic peptide
QESEIAPTNPCSSEQYGIVSCNLPQSGTR

SEQ ID NO: 112838 - protein, 28 aa, Artificial Sequence
  Description of Artificial Sequence: Synthetic peptide
QESEIAPTNPCSSEQYGIVSCNLQHGDI

SEQ ID NO: 112839 - protein, 31 aa, Artificial Sequence
  Description of Artificial Sequence: Synthetic polypeptide
DENEVASTNPVSTEGYGEVSANTLQSRVGQR

SEQ ID NO: 112840 - protein, 29 aa, Artificial Sequence
  Description of Artificial Sequence: Synthetic peptide
QESEIAPTNPCSSEQYGIVSCNLQSGQTR

SEQ ID NO: 112841 - protein, 28 aa, Artificial Sequence
  Description of Artificial Sequence: Synthetic peptide
QESEIAPTNPCSTEGYGIVSSNLQSGTI

SEQ ID NO: 112842 - protein, 29 aa, Artificial Sequence
  Description of Artificial Sequence: Synthetic peptide
DENEVACTNPVSTEGYGEVANNIQSRGGR

SEQ ID NO: 112843 - protein, 33 aa, Artificial Sequence
  Description of Artificial Sequence: Synthetic polypeptide
DEPEIGTTNPVATECWGSVSCINEPQDREGENG

SEQ ID NO: 112844 - protein, 32 aa, Artificial Sequence
  Description of Artificial Sequence: Synthetic polypeptide
QEQEIATTNPVATEQYGSVSATDLEDHEGEDL

SEQ ID NO: 112845 - protein, 33 aa, Artificial Sequence
  Description of Artificial Sequence: Synthetic polypeptide
DEPEIGTTNPVATEQYGSVSTGGQNQEEMGDGQ

SEQ ID NO: 112846 - protein, 28 aa, Artificial Sequence
  Description of Artificial Sequence: Synthetic peptide
QENNIATTNPVATECYGDVSECLQHEEL

SEQ ID NO: 112847 - protein, 28 aa, Artificial Sequence
  Description of Artificial Sequence: Synthetic peptide
QENQIATTNPVATECYGDVSECLQHEEL

SEQ ID NO: 112848 - protein, 35 aa, Artificial Sequence
  Description of Artificial Sequence: Synthetic polypeptide
DESEIRTTNPVATEQYGCVSTWNLPHEIMGGNEVE

SEQ ID NO: 112849 - protein, 28 aa, Artificial Sequence
  Description of Artificial Sequence: Synthetic peptide
QENSIATTNPVATECYGDVSECLQHEEL

SEQ ID NO: 112850 - protein, 28 aa, Artificial Sequence
  Description of Artificial Sequence: Synthetic peptide
QENSIATTNPVATECYGDVSECLQHVEL

SEQ ID NO: 112851 - protein, 28 aa, Artificial Sequence
  Description of Artificial Sequence: Synthetic peptide
QENTIATTNPVATECYGDVSECLQHEEL

SEQ ID NO: 112852 - protein, 28 aa, Artificial Sequence
  Description of Artificial Sequence: Synthetic peptide
QENVIATTNPVATECYGDVSECLQHEEL

SEQ ID NO: 112853 - protein, 36 aa, Artificial Sequence
  Description of Artificial Sequence: Synthetic polypeptide
AEEEIRTTNPVATEQYGSVVTVVNNLEQGTEGGNDT

SEQ ID NO: 112854 - protein, 28 aa, Artificial Sequence
  Description of Artificial Sequence: Synthetic peptide
QENVIATTNPVATEMYGDVSECLQHEEL

SEQ ID NO: 112855 - protein, 35 aa, Artificial Sequence
  Description of Artificial Sequence: Synthetic polypeptide
DESEIRTTNPVATEQYGDVSVTGDLGQRGEGIEDG

SEQ ID NO: 112856 - protein, 28 aa, Artificial Sequence
  Description of Artificial Sequence: Synthetic peptide
QEEEIAPTNPCSTEQYGEAPCVLQSGER

SEQ ID NO: 112857 - protein, 29 aa, Artificial Sequence
  Description of Artificial Sequence: Synthetic peptide
QEPEIAPTNPCSSEQYGQVSCNLQSLGTR

SEQ ID NO: 112858 - protein, 29 aa, Artificial Sequence
  Description of Artificial Sequence: Synthetic peptide
QEPEIATTNPVATECYGDVSECLMQHEEL

SEQ ID NO: 112859 - protein, 34 aa, Artificial Sequence
  Description of Artificial Sequence: Synthetic polypeptide
DESEIRTTNPVATEQYGETVPFHNMLSPRGGNPS

SEQ ID NO: 112860 - protein, 29 aa, Artificial Sequence
  Description of Artificial Sequence: Synthetic peptide
QEPEIATTNPVATECYGDVSGCCLQCEEL

SEQ ID NO: 112861 - protein, 33 aa, Artificial Sequence
  Description of Artificial Sequence: Synthetic polypeptide
DEPEIRTTNPVATEQYGETYTTLLEQFRQGDSV

SEQ ID NO: 112862 - protein, 28 aa, Artificial Sequence
  Description of Artificial Sequence: Synthetic peptide
QEPEIATTNPVATECYGMVEVVLQHEEL

SEQ ID NO: 112863 - protein, 33 aa, Artificial Sequence
  Description of Artificial Sequence: Synthetic polypeptide
DEPEIRTTNPVATEQYGETSTTQLEQFRQADSS

SEQ ID NO: 112864 - protein, 31 aa, Artificial Sequence
  Description of Artificial Sequence: Synthetic polypeptide
CEDEIACTNPVATEQYGCASANLQMVPGQRE

SEQ ID NO: 112865 - protein, 31 aa, Artificial Sequence
  Description of Artificial Sequence: Synthetic polypeptide
CEDEIACTNPVATEQYGCASANLQMPPDGQR

SEQ ID NO: 112866 - protein, 32 aa, Artificial Sequence
  Description of Artificial Sequence: Synthetic polypeptide
QEPEIRGTNPVATDQYGDVSTNGQGEGGGNNT

SEQ ID NO: 112867 - protein, 30 aa, Artificial Sequence
  Description of Artificial Sequence: Synthetic polypeptide
CEDEIACTNPVATEQYGCASANLQMPGQVH

SEQ ID NO: 112868 - protein, 28 aa, Artificial Sequence
  Description of Artificial Sequence: Synthetic peptide
QEQEIAPTNPCSSEQYGIVSCCLQSGTR

SEQ ID NO: 112869 - protein, 28 aa, Artificial Sequence
  Description of Artificial Sequence: Synthetic peptide
QEQEIAPTNPCSSEQYGIVSCNHQSGTR

SEQ ID NO: 112870 - protein, 33 aa, Artificial Sequence
  Description of Artificial Sequence: Synthetic polypeptide
CEEEIRTTNPVATEQYGCVCSSELNQNFGSEQE

SEQ ID NO: 112871 - protein, 34 aa, Artificial Sequence
  Description of Artificial Sequence: Synthetic polypeptide
DEPEIRTTNPVATEQYGSSSTGLTSVQHEGEETN

SEQ ID NO: 112872 - protein, 32 aa, Artificial Sequence
  Description of Artificial Sequence: Synthetic polypeptide
CEEEIRTTNPVATEQYGCVCSSEPQNFNSNQM

SEQ ID NO: 112873 - protein, 28 aa, Artificial Sequence
  Description of Artificial Sequence: Synthetic peptide
QENMIATTNPVATECYGDVSECLQHEEL

SEQ ID NO: 112874 - protein, 28 aa, Artificial Sequence
  Description of Artificial Sequence: Synthetic peptide
QENIIATTNPVATECYGDVSERLQHEEL

SEQ ID NO: 112875 - protein, 29 aa, Artificial Sequence
  Description of Artificial Sequence: Synthetic peptide
QENEIRTTNPVSSEPYGTISCDIQQSGNR

SEQ ID NO: 112876 - protein, 29 aa, Artificial Sequence
  Description of Artificial Sequence: Synthetic peptide
QENEIRTTNPVSTEPYGTISMCLQQHGEL

SEQ ID NO: 112877 - protein, 35 aa, Artificial Sequence
  Description of Artificial Sequence: Synthetic polypeptide
DEPEIRTTNPVATEQYGSVISTNTTGQGEGQDDGN

SEQ ID NO: 112878 - protein, 30 aa, Artificial Sequence
  Description of Artificial Sequence: Synthetic polypeptide
QENEIRTTNPVSTEQYGTISMDIQQQNGNH

SEQ ID NO: 112879 - protein, 28 aa, Artificial Sequence
  Description of Artificial Sequence: Synthetic peptide
QENEISTTNPVATECYGDVCECLQHEEL

SEQ ID NO: 112880 - protein, 32 aa, Artificial Sequence
  Description of Artificial Sequence: Synthetic polypeptide
CEDEIACTNPVATEQYGCVAGTNLQTMNPDER

SEQ ID NO: 112881 - protein, 28 aa, Artificial Sequence
  Description of Artificial Sequence: Synthetic peptide
QEEEIAPTNPVSTEQYGEAPCNLQHEEK

SEQ ID NO: 112882 - protein, 29 aa, Artificial Sequence
  Description of Artificial Sequence: Synthetic peptide
QENEISTTNPVATECYGQVSEWLQHEEEL

SEQ ID NO: 112883 - protein, 34 aa, Artificial Sequence
  Description of Artificial Sequence: Synthetic polypeptide
DESEIRTTNPVATEQYGCVSTVNHMEESNIQHGN

SEQ ID NO: 112884 - protein, 34 aa, Artificial Sequence
  Description of Artificial Sequence: Synthetic polypeptide
DEPEIRTTNPVATEQYGSVIDTNTGQGEGGGQEQ

SEQ ID NO: 112885 - protein, 28 aa, Artificial Sequence
  Description of Artificial Sequence: Synthetic peptide
QENELATTNPVATECYGDVSECLQHEEL

SEQ ID NO: 112886 - protein, 28 aa, Artificial Sequence
  Description of Artificial Sequence: Synthetic peptide
QENELATTNPVATECYGDVSEQLQHEEL

SEQ ID NO: 112887 - protein, 28 aa, Artificial Sequence
  Description of Artificial Sequence: Synthetic peptide
QEEEIAPTNPVATEQYGEAPEVCQHENK

SEQ ID NO: 112888 - protein, 28 aa, Artificial Sequence
  Description of Artificial Sequence: Synthetic peptide
QENEVASTNPVATECYGNVSETLQREEL

SEQ ID NO: 112889 - protein, 28 aa, Artificial Sequence
  Description of Artificial Sequence: Synthetic peptide
QENEVASTNPVATECYGNVSETLQREQL

SEQ ID NO: 112890 - protein, 33 aa, Artificial Sequence
  Description of Artificial Sequence: Synthetic polypeptide
DEPEIRTTNPVATEQYGSVIDGNTGQGEGEDGN

SEQ ID NO: 112891 - protein, 28 aa, Artificial Sequence
  Description of Artificial Sequence: Synthetic peptide
QENEVATTNPVATECYGDVSECLQHEQL

SEQ ID NO: 112892 - protein, 28 aa, Artificial Sequence
  Description of Artificial Sequence: Synthetic peptide
QENEVATTNPVATECYGGVSECLQHEEL

SEQ ID NO: 112893 - protein, 29 aa, Artificial Sequence
  Description of Artificial Sequence: Synthetic peptide
QENEVATTNPVSTEGYGNVSNTLQSHGQR

SEQ ID NO: 112894 - protein, 28 aa, Artificial Sequence
  Description of Artificial Sequence: Synthetic peptide
QENHIATTNPVATECYGDVSECLQHEEL

SEQ ID NO: 112895 - protein, 35 aa, Artificial Sequence
  Description of Artificial Sequence: Synthetic polypeptide
DEPEIRTTNPVATEQYGSVCSPTNLEERNDDTQES

SEQ ID NO: 112896 - protein, 28 aa, Artificial Sequence
  Description of Artificial Sequence: Synthetic peptide
QENHIATTNPVATECYGFVSECLQHEEL

SEQ ID NO: 112897 - protein, 28 aa, Artificial Sequence
  Description of Artificial Sequence: Synthetic peptide
QENIIATTNPVATECYGDVSECLQHEEL

SEQ ID NO: 112898 - protein, 33 aa, Artificial Sequence
  Description of Artificial Sequence: Synthetic polypeptide
DESEIRTTNPVATEQYGCVSTVPYPPEGEEMRN

SEQ ID NO: 112899 - protein, 28 aa, Artificial Sequence
  Description of Artificial Sequence: Synthetic peptide
QENIIATTNPVATECYGDVSECLQHEES

SEQ ID NO: 112900 - protein, 28 aa, Artificial Sequence
  Description of Artificial Sequence: Synthetic peptide
QENLIATTNPVATECYGDVSECLQHEEL

SEQ ID NO: 112901 - protein, 31 aa, Artificial Sequence
  Description of Artificial Sequence: Synthetic polypeptide
CEDEIACTNPVATEQYGCASANLQEAEGGQR

SEQ ID NO: 112902 - protein, 30 aa, Artificial Sequence
  Description of Artificial Sequence: Synthetic polypeptide
QEQEIAPTNPCSTEQYGIVSTNLQSEGEDL

SEQ ID NO: 112903 - protein, 35 aa, Artificial Sequence
  Description of Artificial Sequence: Synthetic polypeptide
DESEIRTTNPVATEQYGEVSTTNGNGNRNEDNQRD

SEQ ID NO: 112904 - protein, 30 aa, Artificial Sequence
  Description of Artificial Sequence: Synthetic polypeptide
QEQEIATTNPVATEGYGSMAATTLQHGDDI

SEQ ID NO: 112905 - protein, 30 aa, Artificial Sequence
  Description of Artificial Sequence: Synthetic polypeptide
QEQEIATTNPVATEGYGVVSATTLEHGEDI

SEQ ID NO: 112906 - protein, 30 aa, Artificial Sequence
  Description of Artificial Sequence: Synthetic polypeptide
QEQEIATTNPVATEGYGVVSATTLEHGEDL

SEQ ID NO: 112907 - protein, 32 aa, Artificial Sequence
  Description of Artificial Sequence: Synthetic polypeptide
QEQEIATTNPVATEQYGDVSATDLQDHEGEDL

SEQ ID NO: 112908 - protein, 33 aa, Artificial Sequence
  Description of Artificial Sequence: Synthetic polypeptide
DEPEIRTTNPVATDQYGDVSTNGNEEGGEGGNI

SEQ ID NO: 112909 - protein, 36 aa, Artificial Sequence
  Description of Artificial Sequence: Synthetic polypeptide
AEEEIRTTNPVATEQYGSVSTVVNLNNEELGNNQIS

SEQ ID NO: 112910 - protein, 34 aa, Artificial Sequence
  Description of Artificial Sequence: Synthetic polypeptide
CEEEIRTTNPVATEQYGCVCSTEHQEGFNSNNQE

SEQ ID NO: 112911 - protein, 31 aa, Artificial Sequence
  Description of Artificial Sequence: Synthetic polypeptide
QEQEIATTNPVATEQYGDVSTDLEDHEGEDL

SEQ ID NO: 112912 - protein, 28 aa, Artificial Sequence
  Description of Artificial Sequence: Synthetic peptide
QEQEIATTNPVATEQYGEAPEDCQHGEK

SEQ ID NO: 112913 - protein, 28 aa, Artificial Sequence
  Description of Artificial Sequence: Synthetic peptide
QEQEIATTNPVATEQYGEAPEDLQHEEK

SEQ ID NO: 112914 - protein, 31 aa, Artificial Sequence
  Description of Artificial Sequence: Synthetic polypeptide
QEQEIATTNPVATEQYGIVSATDLEDHEGEL

SEQ ID NO: 112915 - protein, 33 aa, Artificial Sequence
  Description of Artificial Sequence: Synthetic polypeptide
CEEEIRTTNPVATEQYGCVCSTEHTNFGSNNAE

SEQ ID NO: 112916 - protein, 31 aa, Artificial Sequence
  Description of Artificial Sequence: Synthetic polypeptide
QEQEIATTNPVATEQYGSASTVLEDHEGEDL

SEQ ID NO: 112917 - protein, 33 aa, Artificial Sequence
  Description of Artificial Sequence: Synthetic polypeptide
CEEEIRTTNPVATEQYGCVCSTELEEHFNSNQE

SEQ ID NO: 112918 - protein, 31 aa, Artificial Sequence
  Description of Artificial Sequence: Synthetic polypeptide
QEQEIATTNPVATEQYGSVAATDLEDHGEDL

SEQ ID NO: 112919 - protein, 31 aa, Artificial Sequence
  Description of Artificial Sequence: Synthetic polypeptide
QEQEIATTNPVATEQYGSVPTDLEDHEGEDL

SEQ ID NO: 112920 - protein, 34 aa, Artificial Sequence
  Description of Artificial Sequence: Synthetic polypeptide
AEEEIRTTNPVATEQYGSVVVATNLEQGTDELGT

SEQ ID NO: 112921 - protein, 31 aa, Artificial Sequence
  Description of Artificial Sequence: Synthetic polypeptide
QEQEIATTNPVATEQYGSVSAECLQDHEEEL

SEQ ID NO: 112922 - protein, 33 aa, Artificial Sequence
  Description of Artificial Sequence: Synthetic polypeptide
DEPEIRTTNPVAHECWGSVSCINEPQDREGENV

SEQ ID NO: 112923 - protein, 32 aa, Artificial Sequence
  Description of Artificial Sequence: Synthetic polypeptide
QEQEIATTNPVATEQYGSVSAECLQDHEGEDL

SEQ ID NO: 112924 - protein, 31 aa, Artificial Sequence
  Description of Artificial Sequence: Synthetic polypeptide
QEQEIATTNPVATEQYGSVSAEDLEDHEGEL

SEQ ID NO: 112925 - protein, 31 aa, Artificial Sequence
  Description of Artificial Sequence: Synthetic polypeptide
QEQEIATTNPVATEQYGSVSAEDLEHEGEDL

SEQ ID NO: 112926 - protein, 34 aa, Artificial Sequence
  Description of Artificial Sequence: Synthetic polypeptide
AEEEIRTTNPVATEQYGSVVVATNQLEQGTEAGT

SEQ ID NO: 112927 - protein, 34 aa, Artificial Sequence
  Description of Artificial Sequence: Synthetic polypeptide
AEEEIRTTNPVATEQYGSVVVATTNLGQGTEAGT

SEQ ID NO: 112928 - protein, 33 aa, Artificial Sequence
  Description of Artificial Sequence: Synthetic polypeptide
CEEEIRTTNPVATEQYGCVCSTEPQENFGSDQN

SEQ ID NO: 112929 - protein, 29 aa, Artificial Sequence
  Description of Artificial Sequence: Synthetic peptide
QEQEIATTNPVATECYGVVSECLQHESEL

SEQ ID NO: 112930 - protein, 34 aa, Artificial Sequence
  Description of Artificial Sequence: Synthetic polypeptide
CEEEIRTTNPVATEQYGCVCSTEEHQRFNSNNQE

SEQ ID NO: 112931 - protein, 31 aa, Artificial Sequence
  Description of Artificial Sequence: Synthetic polypeptide
QEQEIATTNPVATECYGSVSAEDLQHEGEDL

SEQ ID NO: 112932 - protein, 30 aa, Artificial Sequence
  Description of Artificial Sequence: Synthetic polypeptide
CEDEIACTNPVATEQYGCASANLNMPGQRL

SEQ ID NO: 112933 - protein, 33 aa, Artificial Sequence
  Description of Artificial Sequence: Synthetic polypeptide
DEPEIRTTNPVATEQYGCVQTWVLQEFIEDNEG

SEQ ID NO: 112934 - protein, 36 aa, Artificial Sequence
  Description of Artificial Sequence: Synthetic polypeptide
DEPEIRTTNPVATEQWGYSNVSATNELQHQRPGQGD

SEQ ID NO: 112935 - protein, 32 aa, Artificial Sequence
  Description of Artificial Sequence: Synthetic polypeptide
DEPEIRTTNPVATEQWGDVSVIEQMETRENDT

SEQ ID NO: 112936 - protein, 30 aa, Artificial Sequence
  Description of Artificial Sequence: Synthetic polypeptide
DEPEIRTTNPVATEQWGDVSVIEEIAANDA

SEQ ID NO: 112937 - protein, 30 aa, Artificial Sequence
  Description of Artificial Sequence: Synthetic polypeptide
DEPEIRTTNPVATEQWGDVSETEFIAAEDA

SEQ ID NO: 112938 - protein, 30 aa, Artificial Sequence
  Description of Artificial Sequence: Synthetic polypeptide
DEPEIRTTNPVATEQWGAVSEINMEAADDA

SEQ ID NO: 112939 - protein, 33 aa, Artificial Sequence
  Description of Artificial Sequence: Synthetic polypeptide
DEPEIRTTNPVATEGWGAVSCINEQQERVGENG

SEQ ID NO: 112940 - protein, 28 aa, Artificial Sequence
  Description of Artificial Sequence: Synthetic peptide
QEEEIAPTNPCSSEQYGEVPCNLQHGEK

SEQ ID NO: 112941 - protein, 31 aa, Artificial Sequence
  Description of Artificial Sequence: Synthetic polypeptide
CEDEIACTNPVATEQYGCASANLQDMNPGQR

SEQ ID NO: 112942 - protein, 30 aa, Artificial Sequence
  Description of Artificial Sequence: Synthetic polypeptide
QEQEIAPTNPVSTEQYGSVSCNLEDSEGEL

SEQ ID NO: 112943 - protein, 30 aa, Artificial Sequence
  Description of Artificial Sequence: Synthetic polypeptide
QEQEIAPTNPVSTEQYGSVSCNLEDSEGTL

SEQ ID NO: 112944 - protein, 30 aa, Artificial Sequence
  Description of Artificial Sequence: Synthetic polypeptide
QEQEIAPTNPVSTEQYGSVSTDLEDSEGEL

SEQ ID NO: 112945 - protein, 28 aa, Artificial Sequence
  Description of Artificial Sequence: Synthetic peptide
QESEIASTNPVATEGWGVMASTLQRGDG

SEQ ID NO: 112946 - protein, 28 aa, Artificial Sequence
  Description of Artificial Sequence: Synthetic peptide
QEEEIAPTNPCATEQYGEAPEVLQHGTK

SEQ ID NO: 112947 - protein, 28 aa, Artificial Sequence
  Description of Artificial Sequence: Synthetic peptide
QEQEIASTNPVGTEGYGVVASTLQHGDI

SEQ ID NO: 112948 - protein, 28 aa, Artificial Sequence
  Description of Artificial Sequence: Synthetic peptide
QEEEIAPTNPCATEQYGEAPEVCQSGER

SEQ ID NO: 112949 - protein, 28 aa, Artificial Sequence
  Description of Artificial Sequence: Synthetic peptide
QEEEIAPTNPCATEQYGEAPEVCQHGER

SEQ ID NO: 112950 - protein, 34 aa, Artificial Sequence
  Description of Artificial Sequence: Synthetic polypeptide
DEPEIRTTNPVATECWGSVSCINEPQDRYGENQG

SEQ ID NO: 112951 - protein, 30 aa, Artificial Sequence
  Description of Artificial Sequence: Synthetic polypeptide
QEQEIATTNPCSTEQYGIVSTNLESEGEDL

SEQ ID NO: 112952 - protein, 28 aa, Artificial Sequence
  Description of Artificial Sequence: Synthetic peptide
QEEEIAPTNPCATEQYGEAPCVCQSGER

SEQ ID NO: 112953 - protein, 28 aa, Artificial Sequence
  Description of Artificial Sequence: Synthetic peptide
QEQEIATTNPVATECYGDVSECAQHEEL

SEQ ID NO: 112954 - protein, 33 aa, Artificial Sequence
  Description of Artificial Sequence: Synthetic polypeptide
DEPEIRTTNPVATECWGSVSCINEPQDREPENG

SEQ ID NO: 112955 - protein, 33 aa, Artificial Sequence
  Description of Artificial Sequence: Synthetic polypeptide
DEPEIRTTNPVATECWGSVSCINEPQDREAENG

SEQ ID NO: 112956 - protein, 33 aa, Artificial Sequence
  Description of Artificial Sequence: Synthetic polypeptide
DEPEIRTTNPVATECWGSGSCKNEPQDREGENG

SEQ ID NO: 112957 - protein, 29 aa, Artificial Sequence
  Description of Artificial Sequence: Synthetic peptide
QEQEIATTNPVATECYGQVSECLQHNEEL

SEQ ID NO: 112958 - protein, 30 aa, Artificial Sequence
  Description of Artificial Sequence: Synthetic polypeptide
QEQEIATTNPVATECYGSVSAEDLQHEEDL

SEQ ID NO: 112959 - protein, 31 aa, Artificial Sequence
  Description of Artificial Sequence: Synthetic polypeptide
QEQEIASTNPVATEQYGSVSATDLEHEGEDL

SEQ ID NO: 112960 - protein, 32 aa, Artificial Sequence
  Description of Artificial Sequence: Synthetic polypeptide
DENEIVTTNPVATEQYGTVCSTIPVMNFEGNA

SEQ ID NO: 112961 - protein, 31 aa, Artificial Sequence
  Description of Artificial Sequence: Synthetic polypeptide
DENEIVTTNPVATEQYGTVCSTIPMNFEENA

SEQ ID NO: 112962 - protein, 31 aa, Artificial Sequence
  Description of Artificial Sequence: Synthetic polypeptide
DENEIVTTNPVATEQYGTVCSTIPMNAEENA

SEQ ID NO: 112963 - protein, 32 aa, Artificial Sequence
  Description of Artificial Sequence: Synthetic polypeptide
DENEIRTTNPVSTEPYGTVSTEAIQQQQNGNH

SEQ ID NO: 112964 - protein, 32 aa, Artificial Sequence
  Description of Artificial Sequence: Synthetic polypeptide
DENEIRTTNPVSTEPYGTVSTEAIQQMQNGNH

SEQ ID NO: 112965 - protein, 32 aa, Artificial Sequence
  Description of Artificial Sequence: Synthetic polypeptide
QEEEIACTNPVATEQYGCVATNLQAMPGGEQH

SEQ ID NO: 112966 - protein, 28 aa, Artificial Sequence
  Description of Artificial Sequence: Synthetic peptide
QESEIASTNPVGTEGYGVMASTLQRGQI

SEQ ID NO: 112967 - protein, 33 aa, Artificial Sequence
  Description of Artificial Sequence: Synthetic polypeptide
DENEIRTTNPVSTEPYGTVSSTPDIQNQQNGNV

SEQ ID NO: 112968 - protein, 32 aa, Artificial Sequence
  Description of Artificial Sequence: Synthetic polypeptide
DENEIRTTNPVSTEPYGTVSMPDIQNQQNGNH

SEQ ID NO: 112969 - protein, 30 aa, Artificial Sequence
  Description of Artificial Sequence: Synthetic polypeptide
DENEIRTTNPVSTEPYGTVSMIIQQQNENA

SEQ ID NO: 112970 - protein, 28 aa, Artificial Sequence
  Description of Artificial Sequence: Synthetic peptide
QESEIASTNPVGTEGYGVMASTLQRGRI

SEQ ID NO: 112971 - protein, 31 aa, Artificial Sequence
  Description of Artificial Sequence: Synthetic polypeptide
DENEIRTTNPVSTEPYGTVSMEDIQQQNGNH

SEQ ID NO: 112972 - protein, 29 aa, Artificial Sequence
  Description of Artificial Sequence: Synthetic peptide
QESEIASTNPVGTEGYGVMASTLQRVGQR

SEQ ID NO: 112973 - protein, 32 aa, Artificial Sequence
  Description of Artificial Sequence: Synthetic polypeptide
DENEIRTTNPVSTEPYGTVSMEDIQNQQNGNH

SEQ ID NO: 112974 - protein, 31 aa, Artificial Sequence
  Description of Artificial Sequence: Synthetic polypeptide
DENEIRTTNPVSTEPYGTVSMEDIMQQNGNH

SEQ ID NO: 112975 - protein, 32 aa, Artificial Sequence
  Description of Artificial Sequence: Synthetic polypeptide
DENEIRTTNPVSTEPYGTVSMEAGQNQQNGNH

SEQ ID NO: 112976 - protein, 31 aa, Artificial Sequence
  Description of Artificial Sequence: Synthetic polypeptide
DENEIRTTNPVSTEPYGTVSMDIQQQQNGNH

SEQ ID NO: 112977 - protein, 31 aa, Artificial Sequence
  Description of Artificial Sequence: Synthetic polypeptide
DENEIRTTNPVSTEPYGTVSMDIQMQQAGNH

SEQ ID NO: 112978 - protein, 31 aa, Artificial Sequence
  Description of Artificial Sequence: Synthetic polypeptide
DENEIRTTNPVSTEPYGTVSMDIQMQQAGNA

SEQ ID NO: 112979 - protein, 35 aa, Artificial Sequence
  Description of Artificial Sequence: Synthetic polypeptide
AEEEIRTTNPVATEQYGSVVVSTTNLGLGGTEAGT

SEQ ID NO: 112980 - protein, 28 aa, Artificial Sequence
  Description of Artificial Sequence: Synthetic peptide
QESEIASTNPVGTEGYGVMASTLQSGTR

SEQ ID NO: 112981 - protein, 29 aa, Artificial Sequence
  Description of Artificial Sequence: Synthetic peptide
QESEIASTNPVGTEGYGVMASTNLQHGDI

SEQ ID NO: 112982 - protein, 29 aa, Artificial Sequence
  Description of Artificial Sequence: Synthetic peptide
QESEIASTNPVGTEGYGVMASTSLQRGDI

SEQ ID NO: 112983 - protein, 32 aa, Artificial Sequence
  Description of Artificial Sequence: Synthetic polypeptide
DENEIRTTNPVSTEPYGTVSCINIQQQQNGNH

SEQ ID NO: 112984 - protein, 32 aa, Artificial Sequence
  Description of Artificial Sequence: Synthetic polypeptide
DENEIRTTNPVSTEPYGTVSCENIQQQQNGNH

SEQ ID NO: 112985 - protein, 31 aa, Artificial Sequence
  Description of Artificial Sequence: Synthetic polypeptide
DENEIRTTNPVSTEPYGTVSCDIQQQQNGNH

SEQ ID NO: 112986 - protein, 28 aa, Artificial Sequence
  Description of Artificial Sequence: Synthetic peptide
QESEIASTNPVGTEGYGVMSETLQHGDR

SEQ ID NO: 112987 - protein, 28 aa, Artificial Sequence
  Description of Artificial Sequence: Synthetic peptide
QESEIASTNPVGTEGYGVMSSTLQHGDR

SEQ ID NO: 112988 - protein, 32 aa, Artificial Sequence
  Description of Artificial Sequence: Synthetic polypeptide
DENEIRTTNPVSTEPYGTVSTEDIQEQFEGNH

SEQ ID NO: 112989 - protein, 28 aa, Artificial Sequence
  Description of Artificial Sequence: Synthetic peptide
QESEIASTNPVGTEGYGVMSSTLQRGDI

SEQ ID NO: 112990 - protein, 32 aa, Artificial Sequence
  Description of Artificial Sequence: Synthetic polypeptide
DENEIRTTNPVSTEPYGTVSTEDIQEQFNGNH

SEQ ID NO: 112991 - protein, 28 aa, Artificial Sequence
  Description of Artificial Sequence: Synthetic peptide
QESEIASTNPVGTEGYGVMASTLQKGNI

SEQ ID NO: 112992 - protein, 30 aa, Artificial Sequence
  Description of Artificial Sequence: Synthetic polypeptide
DENEIRTTNPVSTEQWGDVSEDEQQQAENH

SEQ ID NO: 112993 - protein, 30 aa, Artificial Sequence
  Description of Artificial Sequence: Synthetic polypeptide
DENEIRTTNPVSTEQWGDVSEDEQQAAENH

SEQ ID NO: 112994 - protein, 29 aa, Artificial Sequence
  Description of Artificial Sequence: Synthetic peptide
QESEIASTNPVGTEGYGSVMASTLQHGDI

SEQ ID NO: 112995 - protein, 31 aa, Artificial Sequence
  Description of Artificial Sequence: Synthetic polypeptide
DENEIRTTNPVSTEPYGVVSMDIQQQQNGNH

SEQ ID NO: 112996 - protein, 29 aa, Artificial Sequence
  Description of Artificial Sequence: Synthetic peptide
QESEIASTNPVGTEGYGSVMASTLQHGSI

SEQ ID NO: 112997 - protein, 31 aa, Artificial Sequence
  Description of Artificial Sequence: Synthetic polypeptide
DENEIRTTNPVSTEPYGVMSSDLQQQQNGNI

SEQ ID NO: 112998 - protein, 31 aa, Artificial Sequence
  Description of Artificial Sequence: Synthetic polypeptide
DENEIRTTNPVSTEPYGVISSEDLQQQQGNH

SEQ ID NO: 112999 - protein, 28 aa, Artificial Sequence
  Description of Artificial Sequence: Synthetic peptide
QESEIASTNPVGTEGYGTMASTLQHGND

SEQ ID NO: 113000 - protein, 28 aa, Artificial Sequence
  Description of Artificial Sequence: Synthetic peptide
QESEIASTNPVGTEGYGTMASTLQHGNI

SEQ ID NO: 113001 - protein, 29 aa, Artificial Sequence
  Description of Artificial Sequence: Synthetic peptide
QESEIASTNPVGTEGYGTVATTLQFEGNI

SEQ ID NO: 113002 - protein, 31 aa, Artificial Sequence
  Description of Artificial Sequence: Synthetic polypeptide
DENEIRTTNPVSTEPYGVISMEDLQQQQGNH

SEQ ID NO: 113003 - protein, 28 aa, Artificial Sequence
  Description of Artificial Sequence: Synthetic peptide
QESEIASTNPVGTEGYGTVATTLQFGDI

SEQ ID NO: 113004 - protein, 30 aa, Artificial Sequence
  Description of Artificial Sequence: Synthetic polypeptide
DENEIRTTNPVSTEPYGVISMDIQQQQGNH

SEQ ID NO: 113005 - protein, 30 aa, Artificial Sequence
  Description of Artificial Sequence: Synthetic polypeptide
DENEIRTTNPVSTEPYGVISDDIQQQQGNH

SEQ ID NO: 113006 - protein, 29 aa, Artificial Sequence
  Description of Artificial Sequence: Synthetic peptide
QESEIASTNPVGTEGYGTVFASTLQHGNM

SEQ ID NO: 113007 - protein, 28 aa, Artificial Sequence
  Description of Artificial Sequence: Synthetic peptide
QESEIASTNPVGTEGYGVAAENLQHGGR

SEQ ID NO: 113008 - protein, 31 aa, Artificial Sequence
  Description of Artificial Sequence: Synthetic polypeptide
QEEEIACTNPVATEQYGCVATNLQANEEDTN

SEQ ID NO: 113009 - protein, 28 aa, Artificial Sequence
  Description of Artificial Sequence: Synthetic peptide
QESEIASTNPVGTEGYGVIASTLQHGNI

SEQ ID NO: 113010 - protein, 28 aa, Artificial Sequence
  Description of Artificial Sequence: Synthetic peptide
QESEIASTNPVGTEGYGVMANTLQHGDR

SEQ ID NO: 113011 - protein, 28 aa, Artificial Sequence
  Description of Artificial Sequence: Synthetic peptide
QESEIASTNPVGTEGYGVMANTLQHGQR

SEQ ID NO: 113012 - protein, 32 aa, Artificial Sequence
  Description of Artificial Sequence: Synthetic polypeptide
DENEIRTTNPVSTEPYGTVSTEGPQEQFEGNH

SEQ ID NO: 113013 - protein, 32 aa, Artificial Sequence
  Description of Artificial Sequence: Synthetic polypeptide
DENEIRTTNPVSTEPYGTVSTEGIQEQFEGNH

SEQ ID NO: 113014 - protein, 28 aa, Artificial Sequence
  Description of Artificial Sequence: Synthetic peptide
QESEIASTNPVGTEGYGVMASTLQHGDR

SEQ ID NO: 113015 - protein, 28 aa, Artificial Sequence
  Description of Artificial Sequence: Synthetic peptide
QESEIASTNPVGTEGYGVMASTLQHGNI

SEQ ID NO: 113016 - protein, 28 aa, Artificial Sequence
  Description of Artificial Sequence: Synthetic peptide
QESEIASTNPVGTEGYGVMASTLQHGTR

SEQ ID NO: 113017 - protein, 28 aa, Artificial Sequence
  Description of Artificial Sequence: Synthetic peptide
QESEIASTNPVGTEGYGVMASTLQRGDI

SEQ ID NO: 113018 - protein, 28 aa, Artificial Sequence
  Description of Artificial Sequence: Synthetic peptide
QESEIASTNPVGTEGYGVMSTTLQHGEI

SEQ ID NO: 113019 - protein, 29 aa, Artificial Sequence
  Description of Artificial Sequence: Synthetic peptide
QESEIASTNPVGTEGYGVMVSTDLQHGDI

SEQ ID NO: 113020 - protein, 28 aa, Artificial Sequence
  Description of Artificial Sequence: Synthetic peptide
QESEIASTNPVGTEGYGVMVSTLQHGDI

SEQ ID NO: 113021 - protein, 30 aa, Artificial Sequence
  Description of Artificial Sequence: Synthetic polypeptide
QESEIASTNPVGTEGYGVVSSITLQRGENI

SEQ ID NO: 113022 - protein, 31 aa, Artificial Sequence
  Description of Artificial Sequence: Synthetic polypeptide
DENEIRTTNPVSTEPYGTISSDLQQQQNGNI

SEQ ID NO: 113023 - protein, 31 aa, Artificial Sequence
  Description of Artificial Sequence: Synthetic polypeptide
DENEIRTTNPVSTEPYGTISSDLQQQQNGNH

SEQ ID NO: 113024 - protein, 30 aa, Artificial Sequence
  Description of Artificial Sequence: Synthetic polypeptide
DENEIRTTNPVSTEPYGTISMIIQQQNGNH

SEQ ID NO: 113025 - protein, 30 aa, Artificial Sequence
  Description of Artificial Sequence: Synthetic polypeptide
DENEIRTTNPVSTEPYGTISMIIQQQAGNH

SEQ ID NO: 113026 - protein, 31 aa, Artificial Sequence
  Description of Artificial Sequence: Synthetic polypeptide
DENEIRTTNPVSTEPYGTISMETIQQQQGNH

SEQ ID NO: 113027 - protein, 28 aa, Artificial Sequence
  Description of Artificial Sequence: Synthetic peptide
QESEIASTNPVGTEGYGVVSSTLQHGDI

SEQ ID NO: 113028 - protein, 30 aa, Artificial Sequence
  Description of Artificial Sequence: Synthetic polypeptide
DENEIRTTNPVSTEPYGTISMETIQQQGDH

SEQ ID NO: 113029 - protein, 32 aa, Artificial Sequence
  Description of Artificial Sequence: Synthetic polypeptide
DENEIRTTNPVSTEPYGTISMESINQQQNGNH

SEQ ID NO: 113030 - protein, 31 aa, Artificial Sequence
  Description of Artificial Sequence: Synthetic polypeptide
DENEIRTTNPVSTEPYGTISMENIQQQQGNH

SEQ ID NO: 113031 - protein, 32 aa, Artificial Sequence
  Description of Artificial Sequence: Synthetic polypeptide
DENEIRTTNPVSTEPYGTISMEDLQQQQNGNR

SEQ ID NO: 113032 - protein, 31 aa, Artificial Sequence
  Description of Artificial Sequence: Synthetic polypeptide
DENEIRTTNPVSTEPYGTISMEDLQQQQGNH

SEQ ID NO: 113033 - protein, 31 aa, Artificial Sequence
  Description of Artificial Sequence: Synthetic polypeptide
DENEIRTTNPVSTEPYGTISMEDLQDHNGNH

SEQ ID NO: 113034 - protein, 31 aa, Artificial Sequence
  Description of Artificial Sequence: Synthetic polypeptide
DENEIRTTNPVSTEPYGTISMEDIQQRNGNH

SEQ ID NO: 113035 - protein, 30 aa, Artificial Sequence
  Description of Artificial Sequence: Synthetic polypeptide
DENEIRTTNPVSTEPYGTISMEDIQQQGNH

SEQ ID NO: 113036 - protein, 31 aa, Artificial Sequence
  Description of Artificial Sequence: Synthetic polypeptide
DENEIRTTNPVSTEPYGTISMEDIQMQNGNR

SEQ ID NO: 113037 - protein, 28 aa, Artificial Sequence
  Description of Artificial Sequence: Synthetic peptide
QESEIASTNPVGTEGYGVVSSTLQHGDQ

SEQ ID NO: 113038 - protein, 30 aa, Artificial Sequence
  Description of Artificial Sequence: Synthetic polypeptide
DENEIRTTNPVSTEPYGTISMECIQQQGNL

SEQ ID NO: 113039 - protein, 28 aa, Artificial Sequence
  Description of Artificial Sequence: Synthetic peptide
QESEIASTNPVGTEGYGVVSSTLQHGDV

SEQ ID NO: 113040 - protein, 29 aa, Artificial Sequence
  Description of Artificial Sequence: Synthetic peptide
QESEIASTNPVGTEGYGVVSSTLQRNGDV

SEQ ID NO: 113041 - protein, 29 aa, Artificial Sequence
  Description of Artificial Sequence: Synthetic peptide
QESEIASTNPVGTEGYGYVMASTLQRGDI

SEQ ID NO: 113042 - protein, 30 aa, Artificial Sequence
  Description of Artificial Sequence: Synthetic polypeptide
DENEIRTTNPVSTEPYGTISMDIQQQQGNH

SEQ ID NO: 113043 - protein, 30 aa, Artificial Sequence
  Description of Artificial Sequence: Synthetic polypeptide
DENEIRTTNPVSTEPYGTISMDIQQQNGNH

SEQ ID NO: 113044 - protein, 28 aa, Artificial Sequence
  Description of Artificial Sequence: Synthetic peptide
QESEIASTNPVGTEPYGTMSSTLQHGNH

SEQ ID NO: 113045 - protein, 28 aa, Artificial Sequence
  Description of Artificial Sequence: Synthetic peptide
QESEIASTNPVGTEPYGVMSSTLQHGNH

SEQ ID NO: 113046 - protein, 31 aa, Artificial Sequence
  Description of Artificial Sequence: Synthetic polypeptide
DENEIRTTNPVSTEPYGTISSEDLQQQQGNH

SEQ ID NO: 113047 - protein, 30 aa, Artificial Sequence
  Description of Artificial Sequence: Synthetic polypeptide
DENEIRTTNPVSTEPYGTISSETIQQQGDH

SEQ ID NO: 113048 - protein, 31 aa, Artificial Sequence
  Description of Artificial Sequence: Synthetic polypeptide
DENEIRTTNPVSTEPYGTISTDDIQQQNGNH

SEQ ID NO: 113049 - protein, 31 aa, Artificial Sequence
  Description of Artificial Sequence: Synthetic polypeptide
DENEIRTTNPVSTEPYGTISTDDPQQQEGNH

SEQ ID NO: 113050 - protein, 28 aa, Artificial Sequence
  Description of Artificial Sequence: Synthetic peptide
QESEIASTNPVGTEGYGVSASTLQHGDI

SEQ ID NO: 113051 - protein, 29 aa, Artificial Sequence
  Description of Artificial Sequence: Synthetic peptide
QESEIASTNPVGTEGYGVSASTTLQHGDE

SEQ ID NO: 113052 - protein, 28 aa, Artificial Sequence
  Description of Artificial Sequence: Synthetic peptide
QESEIASTNPVGTEGYGVSGSTLQHGDQ

SEQ ID NO: 113053 - protein, 29 aa, Artificial Sequence
  Description of Artificial Sequence: Synthetic peptide
QESEIASTNPVGTEGYGVSVSTLQHFGDI

SEQ ID NO: 113054 - protein, 28 aa, Artificial Sequence
  Description of Artificial Sequence: Synthetic peptide
QESEIASTNPVGTEGYGVVACNLQHGDG

SEQ ID NO: 113055 - protein, 28 aa, Artificial Sequence
  Description of Artificial Sequence: Synthetic peptide
QESEIASTNPVGTEGYGVVACNLQHGDI

SEQ ID NO: 113056 - protein, 28 aa, Artificial Sequence
  Description of Artificial Sequence: Synthetic peptide
QESEIASTNPVGTEGYGVVASNLQHGDI

SEQ ID NO: 113057 - protein, 28 aa, Artificial Sequence
  Description of Artificial Sequence: Synthetic peptide
QESEIASTNPVGTEGYGVVASNLQSGDI

SEQ ID NO: 113058 - protein, 28 aa, Artificial Sequence
  Description of Artificial Sequence: Synthetic peptide
QESEIASTNPVGTEGYGVVASNLQSGTI

SEQ ID NO: 113059 - protein, 28 aa, Artificial Sequence
  Description of Artificial Sequence: Synthetic peptide
QESEIASTNPVGTEGYGVVASTLQHGDI

SEQ ID NO: 113060 - protein, 28 aa, Artificial Sequence
  Description of Artificial Sequence: Synthetic peptide
QESEIASTNPVGTEGYGVVASTLQHGDQ

SEQ ID NO: 113061 - protein, 32 aa, Artificial Sequence
  Description of Artificial Sequence: Synthetic polypeptide
QEEEIACTNPVATEQYGCVATNLADAQGENQD

SEQ ID NO: 113062 - protein, 30 aa, Artificial Sequence
  Description of Artificial Sequence: Synthetic polypeptide
DENEIRTTNPVSTEQWGDVSEIEQNAAENA

SEQ ID NO: 113063 - protein, 28 aa, Artificial Sequence
  Description of Artificial Sequence: Synthetic peptide
QESEIASTNPVGTEGYGVVASTLQHGDV

SEQ ID NO: 113064 - protein, 28 aa, Artificial Sequence
  Description of Artificial Sequence: Synthetic peptide
QESEIASTNPVGTEGYGVVASTLQHGQI

SEQ ID NO: 113065 - protein, 28 aa, Artificial Sequence
  Description of Artificial Sequence: Synthetic peptide
QESEIASTNPVGTEGYGVVASTLQHGTI

SEQ ID NO: 113066 - protein, 33 aa, Artificial Sequence
  Description of Artificial Sequence: Synthetic polypeptide
QEEEIACTNPVATEQYGCVAAATNLATGIGNER

SEQ ID NO: 113067 - protein, 28 aa, Artificial Sequence
  Description of Artificial Sequence: Synthetic peptide
QESEIASTNPVGTEGYGVVASTLQSGDI

SEQ ID NO: 113068 - protein, 32 aa, Artificial Sequence
  Description of Artificial Sequence: Synthetic polypeptide
DENEIRTTNPVSTEPYGTISVSDIQQQYNGNH

SEQ ID NO: 113069 - protein, 29 aa, Artificial Sequence
  Description of Artificial Sequence: Synthetic peptide
QESEIASTNPVGTEGYGVVASTSLQHGDI

SEQ ID NO: 113070 - protein, 28 aa, Artificial Sequence
  Description of Artificial Sequence: Synthetic peptide
QESEIASTNPVGTEGYGVVATDLQHGEI

SEQ ID NO: 113071 - protein, 29 aa, Artificial Sequence
  Description of Artificial Sequence: Synthetic peptide
QESEIASTNPVGTEGYGVVATSTLQHGNI

SEQ ID NO: 113072 - protein, 32 aa, Artificial Sequence
  Description of Artificial Sequence: Synthetic polypeptide
DENEIRTTNPVSTEPYGTISVEDETQPQSGNH

SEQ ID NO: 113073 - protein, 28 aa, Artificial Sequence
  Description of Artificial Sequence: Synthetic peptide
QESEIASTNPVGTEGYGVVSDTLQHGDI

SEQ ID NO: 113074 - protein, 31 aa, Artificial Sequence
  Description of Artificial Sequence: Synthetic polypeptide
DENEIRTTNPVSTEPYGTISTEDPQQQEGNH

SEQ ID NO: 113075 - protein, 30 aa, Artificial Sequence
  Description of Artificial Sequence: Synthetic polypeptide
QESEIASTNPVGTEGYGVVSSITLQRGENG

SEQ ID NO: 113076 - protein, 31 aa, Artificial Sequence
  Description of Artificial Sequence: Synthetic polypeptide
QEEEIACTNPVATEQYGCVAATNLEQPSVDD

SEQ ID NO: 113077 - protein, 29 aa, Artificial Sequence
  Description of Artificial Sequence: Synthetic peptide
QENEIRTTNPVSSEPYGTISCDIQQQGNR

SEQ ID NO: 113078 - protein, 28 aa, Artificial Sequence
  Description of Artificial Sequence: Synthetic peptide
QESEIASTNPVGTEGYGSRASTLQHGDI

SEQ ID NO: 113079 - protein, 30 aa, Artificial Sequence
  Description of Artificial Sequence: Synthetic polypeptide
DENEIRTTNPVSTEQWGDVSEIEQNAAENH

SEQ ID NO: 113080 - protein, 28 aa, Artificial Sequence
  Description of Artificial Sequence: Synthetic peptide
QESEIASTNPVATEGYGVMASTLQHGDG

SEQ ID NO: 113081 - protein, 28 aa, Artificial Sequence
  Description of Artificial Sequence: Synthetic peptide
QESEIASTNPVATEGYGVMASTLQHGDI

SEQ ID NO: 113082 - protein, 31 aa, Artificial Sequence
  Description of Artificial Sequence: Synthetic polypeptide
DENEIVTTNPVATEQYGDVSATGEVEFAGDA

SEQ ID NO: 113083 - protein, 32 aa, Artificial Sequence
  Description of Artificial Sequence: Synthetic polypeptide
DENEIVTTNPVATEQYGDVSATDGPVEHEGNL

SEQ ID NO: 113084 - protein, 32 aa, Artificial Sequence
  Description of Artificial Sequence: Synthetic polypeptide
DENEIVTTNPVATEQYGDVSATDGPVEFEGNL

SEQ ID NO: 113085 - protein, 32 aa, Artificial Sequence
  Description of Artificial Sequence: Synthetic polypeptide
DENEIVTTNPVATEQYGDVSATDGPVEFEGND

SEQ ID NO: 113086 - protein, 32 aa, Artificial Sequence
  Description of Artificial Sequence: Synthetic polypeptide
DENEIVTTNPVATEQYGDVSATDCPVEHEGNL

SEQ ID NO: 113087 - protein, 31 aa, Artificial Sequence
  Description of Artificial Sequence: Synthetic polypeptide
DENEIVTTNPVATEQYGDVCSATGPEHEENL

SEQ ID NO: 113088 - protein, 31 aa, Artificial Sequence
  Description of Artificial Sequence: Synthetic polypeptide
DENEIVTTNPVATEQYGDVCSATGPEHEEND

SEQ ID NO: 113089 - protein, 28 aa, Artificial Sequence
  Description of Artificial Sequence: Synthetic peptide
QESEIASTNPVATEGYGVMASTLQHGDK

SEQ ID NO: 113090 - protein, 31 aa, Artificial Sequence
  Description of Artificial Sequence: Synthetic polypeptide
DENEIVTTNPVATEQYGDVCSATGPEFEEND

SEQ ID NO: 113091 - protein, 32 aa, Artificial Sequence
  Description of Artificial Sequence: Synthetic polypeptide
DENEIVTTNPVATEQYGDVCSAEDGPQFEGNL

SEQ ID NO: 113092 - protein, 32 aa, Artificial Sequence
  Description of Artificial Sequence: Synthetic polypeptide
DENEIVTTNPVATEQYGDVCSAEDGPQFEGND

SEQ ID NO: 113093 - protein, 32 aa, Artificial Sequence
  Description of Artificial Sequence: Synthetic polypeptide
QEEEIACTNPVATEQYGCVATNLQPDPQGDTA

SEQ ID NO: 113094 - protein, 31 aa, Artificial Sequence
  Description of Artificial Sequence: Synthetic polypeptide
DENEIVTTNPVATEQWGTVSTIPVMNAEGNA

SEQ ID NO: 113095 - protein, 28 aa, Artificial Sequence
  Description of Artificial Sequence: Synthetic peptide
QESEIASTNPVATEGYGVMASTLQHGEI

SEQ ID NO: 113096 - protein, 30 aa, Artificial Sequence
  Description of Artificial Sequence: Synthetic polypeptide
DENEIVTTNPVATEQWGTVSATGPEFEEND

SEQ ID NO: 113097 - protein, 32 aa, Artificial Sequence
  Description of Artificial Sequence: Synthetic polypeptide
QEEEIACTNPVATEQYGCVATNLQPAEDPGEE

SEQ ID NO: 113098 - protein, 31 aa, Artificial Sequence
  Description of Artificial Sequence: Synthetic polypeptide
DENEIVTTNPVATEQWGTVCSATGPEFEGND

SEQ ID NO: 113099 - protein, 29 aa, Artificial Sequence
  Description of Artificial Sequence: Synthetic peptide
QESEIASTNPVATEGYGVMASTNLQHQDC

SEQ ID NO: 113100 - protein, 28 aa, Artificial Sequence
  Description of Artificial Sequence: Synthetic peptide
QESEIASTNPVATEGYGVMATTLQHGDL

SEQ ID NO: 113101 - protein, 32 aa, Artificial Sequence
  Description of Artificial Sequence: Synthetic polypeptide
QEEEIACTNPVATEQYGCVATNLQMAGGDIEH

SEQ ID NO: 113102 - protein, 29 aa, Artificial Sequence
  Description of Artificial Sequence: Synthetic peptide
QESEIASTNPVATEGYGVMSSITLQHGNI

SEQ ID NO: 113103 - protein, 31 aa, Artificial Sequence
  Description of Artificial Sequence: Synthetic polypeptide
DENEIVTTNPVATEPYGTVSMEDIVQQEGND

SEQ ID NO: 113104 - protein, 29 aa, Artificial Sequence
  Description of Artificial Sequence: Synthetic peptide
QESEIASTNPVATEGYGVVAATDLQHGEI

SEQ ID NO: 113105 - protein, 29 aa, Artificial Sequence
  Description of Artificial Sequence: Synthetic peptide
QESEIASTNPVATEGYGVMASTLQHEGNI

SEQ ID NO: 113106 - protein, 28 aa, Artificial Sequence
  Description of Artificial Sequence: Synthetic peptide
QESEIASTNPVATEGYGVVAETLQHGDI

SEQ ID NO: 113107 - protein, 30 aa, Artificial Sequence
  Description of Artificial Sequence: Synthetic polypeptide
QESEIASTNPVATEGYGVMASPALQRGMNI

SEQ ID NO: 113108 - protein, 30 aa, Artificial Sequence
  Description of Artificial Sequence: Synthetic polypeptide
DENEIVTTNPVATEQYGDVSTGEVEFAEDA

SEQ ID NO: 113109 - protein, 31 aa, Artificial Sequence
  Description of Artificial Sequence: Synthetic polypeptide
DENEIVTTNPVATEQYGTVCSTIPMNAAENA

SEQ ID NO: 113110 - protein, 28 aa, Artificial Sequence
  Description of Artificial Sequence: Synthetic peptide
QESEIASTNPVATEGYGEMASTLQHGDI

SEQ ID NO: 113111 - protein, 31 aa, Artificial Sequence
  Description of Artificial Sequence: Synthetic polypeptide
DENEIVTTNPVATEQYGTVCSTDGPVEFGGD

SEQ ID NO: 113112 - protein, 32 aa, Artificial Sequence
  Description of Artificial Sequence: Synthetic polypeptide
DENEIVTTNPVATEQYGTVCSTDGPVEFEGND

SEQ ID NO: 113113 - protein, 29 aa, Artificial Sequence
  Description of Artificial Sequence: Synthetic peptide
QESEIASTNPVATEGYGSMAASTLQHGDI

SEQ ID NO: 113114 - protein, 29 aa, Artificial Sequence
  Description of Artificial Sequence: Synthetic peptide
QESEIASTNPVATEGYGSMAASTLQHGEI

SEQ ID NO: 113115 - protein, 32 aa, Artificial Sequence
  Description of Artificial Sequence: Synthetic polypeptide
DENEIVTTNPVATEQYGTVCSMEGPVQQEGND

SEQ ID NO: 113116 - protein, 32 aa, Artificial Sequence
  Description of Artificial Sequence: Synthetic polypeptide
DENEIVTTNPVATEQYGTVCSATGPVEFEGND

SEQ ID NO: 113117 - protein, 31 aa, Artificial Sequence
  Description of Artificial Sequence: Synthetic polypeptide
QESEIASTNPVATEGYGSMATSPALQRGMNI

SEQ ID NO: 113118 - protein, 33 aa, Artificial Sequence
  Description of Artificial Sequence: Synthetic polypeptide
DENEIVTTNPVATEQYGTVCSATDNPVQFEGGD

SEQ ID NO: 113119 - protein, 33 aa, Artificial Sequence
  Description of Artificial Sequence: Synthetic polypeptide
DENEIVTTNPVATEQYGTVCSATDGPVQQEGND

SEQ ID NO: 113120 - protein, 29 aa, Artificial Sequence
  Description of Artificial Sequence: Synthetic peptide
QESEIASTNPVATEGYGSMATTLQHGDDI

SEQ ID NO: 113121 - protein, 33 aa, Artificial Sequence
  Description of Artificial Sequence: Synthetic polypeptide
DENEIVTTNPVATEQYGTVCSATDGPVQFEGND

SEQ ID NO: 113122 - protein, 32 aa, Artificial Sequence
  Description of Artificial Sequence: Synthetic polypeptide
DENEIVTTNPVATEQYGTVCSATDGPVEFGND

SEQ ID NO: 113123 - protein, 32 aa, Artificial Sequence
  Description of Artificial Sequence: Synthetic polypeptide
DENEIVTTNPVATEQYGTVCSATDGPEFEGND

SEQ ID NO: 113124 - protein, 30 aa, Artificial Sequence
  Description of Artificial Sequence: Synthetic polypeptide
QESEIASTNPVATEGYGTVCSTTLEFEGNI

SEQ ID NO: 113125 - protein, 32 aa, Artificial Sequence
  Description of Artificial Sequence: Synthetic polypeptide
DENEIVTTNPVATEQYGTVCSATDGLEFEGGD

SEQ ID NO: 113126 - protein, 33 aa, Artificial Sequence
  Description of Artificial Sequence: Synthetic polypeptide
DENEIVTTNPVATEQYGTVCSATDDPQEFEGND

SEQ ID NO: 113127 - protein, 32 aa, Artificial Sequence
  Description of Artificial Sequence: Synthetic polypeptide
DENEIVTTNPVATEQYGTVCSAEDGPEFEGNR

SEQ ID NO: 113128 - protein, 28 aa, Artificial Sequence
  Description of Artificial Sequence: Synthetic peptide
QESEIASTNPVATEGYGVMAETLQHGDR

SEQ ID NO: 113129 - protein, 32 aa, Artificial Sequence
  Description of Artificial Sequence: Synthetic polypeptide
DENEIVTTNPVATEQYGEVSATDGPVEFEGND

SEQ ID NO: 113130 - protein, 28 aa, Artificial Sequence
  Description of Artificial Sequence: Synthetic peptide
QESEIASTNPVATEGYGVMASALQRGDI

SEQ ID NO: 113131 - protein, 29 aa, Artificial Sequence
  Description of Artificial Sequence: Synthetic peptide
QESEIASTNPVATEGYGVMASALQRGMNI

SEQ ID NO: 113132 - protein, 30 aa, Artificial Sequence
  Description of Artificial Sequence: Synthetic polypeptide
DENEIVTTNPVATEQYGDVSTGEVMAAEDA

SEQ ID NO: 113133 - protein, 28 aa, Artificial Sequence
  Description of Artificial Sequence: Synthetic peptide
QESEIASTNPVATEGYGVMASNLQHGDI

SEQ ID NO: 113134 - protein, 30 aa, Artificial Sequence
  Description of Artificial Sequence: Synthetic polypeptide
DENEIVTTNPVATEQYGDVSTGEVEAAEDA

SEQ ID NO: 113135 - protein, 32 aa, Artificial Sequence
  Description of Artificial Sequence: Synthetic polypeptide
QEEEIACTNPVATEQYGCVATNLQEMEEDTRW

SEQ ID NO: 113136 - protein, 31 aa, Artificial Sequence
  Description of Artificial Sequence: Synthetic polypeptide
QEEEIACTNPVATEQYGCVATNLQEEEATLH

SEQ ID NO: 113137 - protein, 28 aa, Artificial Sequence
  Description of Artificial Sequence: Synthetic peptide
QESEIASTNPVATEGYGVVSETLQHEDI

SEQ ID NO: 113138 - protein, 32 aa, Artificial Sequence
  Description of Artificial Sequence: Synthetic polypeptide
DENEIRTTNPVSTEQYGTVSMDDIVQQFNGNH

SEQ ID NO: 113139 - protein, 32 aa, Artificial Sequence
  Description of Artificial Sequence: Synthetic polypeptide
DENEIRTTNPVSTEQYGTVSMDDIQQQFNGNH

SEQ ID NO: 113140 - protein, 32 aa, Artificial Sequence
  Description of Artificial Sequence: Synthetic polypeptide
DENEIRTTNPVSTEQYGTISTEDIQQQHNGNH

SEQ ID NO: 113141 - protein, 32 aa, Artificial Sequence
  Description of Artificial Sequence: Synthetic polypeptide
DENEIRTTNPVSTEQYGTISTDIQEQHNGNDH

SEQ ID NO: 113142 - protein, 32 aa, Artificial Sequence
  Description of Artificial Sequence: Synthetic polypeptide
DENEIRTTNPVSTEQYGTISMEDLQQQQNGNH

SEQ ID NO: 113143 - protein, 31 aa, Artificial Sequence
  Description of Artificial Sequence: Synthetic polypeptide
QEEEIACTNPVATEQYGCVATNLQDAIDIEH

SEQ ID NO: 113144 - protein, 31 aa, Artificial Sequence
  Description of Artificial Sequence: Synthetic polypeptide
DENEIRTTNPVSTEQYGTISMDIQQQQNGNH

SEQ ID NO: 113145 - protein, 31 aa, Artificial Sequence
  Description of Artificial Sequence: Synthetic polypeptide
DENEIRTTNPVSTEQYGTISEEDIQQQQGNH

SEQ ID NO: 113146 - protein, 28 aa, Artificial Sequence
  Description of Artificial Sequence: Synthetic peptide
QESEIASTNPVGTEGYGEMSSNLQHGGI

SEQ ID NO: 113147 - protein, 31 aa, Artificial Sequence
  Description of Artificial Sequence: Synthetic polypeptide
DENEIRTTNPVSTEQYGTISCEDIQQQQGNH

SEQ ID NO: 113148 - protein, 31 aa, Artificial Sequence
  Description of Artificial Sequence: Synthetic polypeptide
QEEEIACTNPVATEQYGCVATNLQDAEEDTH

SEQ ID NO: 113149 - protein, 28 aa, Artificial Sequence
  Description of Artificial Sequence: Synthetic peptide
QESEIASTNPVGTEGYGEMSSTLQRGDI

SEQ ID NO: 113150 - protein, 30 aa, Artificial Sequence
  Description of Artificial Sequence: Synthetic polypeptide
DENEIRTTNPVSTEQYGTIPEEDIQQQGNH

SEQ ID NO: 113151 - protein, 30 aa, Artificial Sequence
  Description of Artificial Sequence: Synthetic polypeptide
QESEIASTNPVGTEGYGEVAASTNLQHGDI

SEQ ID NO: 113152 - protein, 28 aa, Artificial Sequence
  Description of Artificial Sequence: Synthetic peptide
QESEIASTNPVGTEGYGIMASTLQHGDR

SEQ ID NO: 113153 - protein, 28 aa, Artificial Sequence
  Description of Artificial Sequence: Synthetic peptide
QESEIASTNPVGTEGYGIMASTLQSGTR

SEQ ID NO: 113154 - protein, 28 aa, Artificial Sequence
  Description of Artificial Sequence: Synthetic peptide
QESEIASTNPVGTEGYGIVACNLQHGDI

SEQ ID NO: 113155 - protein, 28 aa, Artificial Sequence
  Description of Artificial Sequence: Synthetic peptide
QESEIASTNPVGTEGYGIVASTLQHGTI

SEQ ID NO: 113156 - protein, 32 aa, Artificial Sequence
  Description of Artificial Sequence: Synthetic polypeptide
DENEIRTTNPVSTEQYGEISMEVCQQQQNGNH

SEQ ID NO: 113157 - protein, 31 aa, Artificial Sequence
  Description of Artificial Sequence: Synthetic polypeptide
DENEIRTTNPVSTEQYGEISMDIQQQQNGNH

SEQ ID NO: 113158 - protein, 31 aa, Artificial Sequence
  Description of Artificial Sequence: Synthetic polypeptide
DENEIRTTNPVSTEQYGEISEEVCQQQQGNH

SEQ ID NO: 113159 - protein, 28 aa, Artificial Sequence
  Description of Artificial Sequence: Synthetic peptide
QESEIASTNPVGTEGYGNVASTLQHGDI

SEQ ID NO: 113160 - protein, 28 aa, Artificial Sequence
  Description of Artificial Sequence: Synthetic peptide
QESEIASTNPVGTEGYGSMASTLQHGDI

SEQ ID NO: 113161 - protein, 29 aa, Artificial Sequence
  Description of Artificial Sequence: Synthetic peptide
DENEIRTTNPVSTEQWGIVSEIEMAAGDA

SEQ ID NO: 113162 - protein, 30 aa, Artificial Sequence
  Description of Artificial Sequence: Synthetic polypeptide
DENEIRTTNPVSTEQWGDVSEIEQQAAENH

SEQ ID NO: 113163 - protein, 32 aa, Artificial Sequence
  Description of Artificial Sequence: Synthetic polypeptide
DENEIRTTNPVSTEQYGTVSTDIQEQHNGEDH

SEQ ID NO: 113164 - protein, 33 aa, Artificial Sequence
  Description of Artificial Sequence: Synthetic polypeptide
DENEIRTTNPVSTEQYGTVSTEDIQQMQNGMNH

SEQ ID NO: 113165 - protein, 28 aa, Artificial Sequence
  Description of Artificial Sequence: Synthetic peptide
QESEIASTNPVGTEGYGEMASTLQRGDI

SEQ ID NO: 113166 - protein, 28 aa, Artificial Sequence
  Description of Artificial Sequence: Synthetic peptide
QESEIASTNPVGTEGYGEMAENLQRGDI

SEQ ID NO: 113167 - protein, 30 aa, Artificial Sequence
  Description of Artificial Sequence: Synthetic polypeptide
DENEIVTTNPVATECYGTVSAEDCLQFEEL

SEQ ID NO: 113168 - protein, 31 aa, Artificial Sequence
  Description of Artificial Sequence: Synthetic polypeptide
DENEIVTTNPVATECYGTVCSAEDCLQFGED

SEQ ID NO: 113169 - protein, 28 aa, Artificial Sequence
  Description of Artificial Sequence: Synthetic peptide
QESEIASTNPVATEQYGDMASTLQHEDA

SEQ ID NO: 113170 - protein, 28 aa, Artificial Sequence
  Description of Artificial Sequence: Synthetic peptide
QESEIASTNPVATEQYGEMPEVLQHGEI

SEQ ID NO: 113171 - protein, 31 aa, Artificial Sequence
  Description of Artificial Sequence: Synthetic polypeptide
DENEIVCTNPVATEQYGTVSAEDGPVEFGNR

SEQ ID NO: 113172 - protein, 33 aa, Artificial Sequence
  Description of Artificial Sequence: Synthetic polypeptide
CEEEIRTTNPVATEQYGCVCSWGELQHFGSDQS

SEQ ID NO: 113173 - protein, 30 aa, Artificial Sequence
  Description of Artificial Sequence: Synthetic polypeptide
QESEIASTNPVATEQYGSMASTLPQMHGDI

SEQ ID NO: 113174 - protein, 30 aa, Artificial Sequence
  Description of Artificial Sequence: Synthetic polypeptide
QESEIASTNPVATEQYGSMSATDLEHGEDI

SEQ ID NO: 113175 - protein, 33 aa, Artificial Sequence
  Description of Artificial Sequence: Synthetic polypeptide
DENEISTTNPVATEIYGSVCCNENLQRDGMTDM

SEQ ID NO: 113176 - protein, 31 aa, Artificial Sequence
  Description of Artificial Sequence: Synthetic polypeptide
QESEIASTNPVATEQYGSVATSTLPQMHGDI

SEQ ID NO: 113177 - protein, 31 aa, Artificial Sequence
  Description of Artificial Sequence: Synthetic polypeptide
QESEIASTNPVATEQYGSVSATDLEHEGEDL

SEQ ID NO: 113178 - protein, 28 aa, Artificial Sequence
  Description of Artificial Sequence: Synthetic peptide
QESEIASTNPVATEQYGVMASTCQHGDI

SEQ ID NO: 113179 - protein, 28 aa, Artificial Sequence
  Description of Artificial Sequence: Synthetic peptide
QESEIASTNPVGTEGYGSMASTLQHGDV

SEQ ID NO: 113180 - protein, 28 aa, Artificial Sequence
  Description of Artificial Sequence: Synthetic peptide
QESEIASTNPVATEQYGVMASTGQHGDI

SEQ ID NO: 113181 - protein, 28 aa, Artificial Sequence
  Description of Artificial Sequence: Synthetic peptide
QESEIASTNPVATEQYGVMPSTCQHGDI

SEQ ID NO: 113182 - protein, 29 aa, Artificial Sequence
  Description of Artificial Sequence: Synthetic peptide
QESEIASTNPVATEQYGVVASTGQMHGDI

SEQ ID NO: 113183 - protein, 28 aa, Artificial Sequence
  Description of Artificial Sequence: Synthetic peptide
QESEIASTNPVCTEGYGVMASNLQHGNQ

SEQ ID NO: 113184 - protein, 28 aa, Artificial Sequence
  Description of Artificial Sequence: Synthetic peptide
QESEIASTNPVCTEGYGVVASTLQHGDQ

SEQ ID NO: 113185 - protein, 28 aa, Artificial Sequence
  Description of Artificial Sequence: Synthetic peptide
QESEIASTNPVCTEQYGVMASTLQHGDI

SEQ ID NO: 113186 - protein, 32 aa, Artificial Sequence
  Description of Artificial Sequence: Synthetic polypeptide
QEEEIACTNPVATEQYGCVATNLQDQGGISEE

SEQ ID NO: 113187 - protein, 28 aa, Artificial Sequence
  Description of Artificial Sequence: Synthetic peptide
QESEIASTNPVCTEQYGVVADTLQHGDQ

SEQ ID NO: 113188 - protein, 28 aa, Artificial Sequence
  Description of Artificial Sequence: Synthetic peptide
QESEIASTNPVGTECYGVVACNLQHGDG

SEQ ID NO: 113189 - protein, 28 aa, Artificial Sequence
  Description of Artificial Sequence: Synthetic peptide
QESEIASTNPVGTEEYGVMASTLQHGNI

SEQ ID NO: 113190 - protein, 30 aa, Artificial Sequence
  Description of Artificial Sequence: Synthetic polypeptide
DENEIRTVNPVATEQWGDVSENEQNSAEDA

SEQ ID NO: 113191 - protein, 28 aa, Artificial Sequence
  Description of Artificial Sequence: Synthetic peptide
QESEIASTNPVGTEGYGAMASTLQRGDI

SEQ ID NO: 113192 - protein, 28 aa, Artificial Sequence
  Description of Artificial Sequence: Synthetic peptide
QESEIASTNPVGTEGYGEASSTLQRGDI

SEQ ID NO: 113193 - protein, 31 aa, Artificial Sequence
  Description of Artificial Sequence: Synthetic polypeptide
DENEIRTVNPVSTEPYGTVSMENIQQQNGNH

SEQ ID NO: 113194 - protein, 34 aa, Artificial Sequence
  Description of Artificial Sequence: Synthetic polypeptide
DEEEIRTTNPVAYEQYGQVTTAGTNDLLQRSQIP

SEQ ID NO: 113195 - protein, 32 aa, Artificial Sequence
  Description of Artificial Sequence: Synthetic polypeptide
DENEIRTTNPVATECWGSISCEDEQQQREGNH

SEQ ID NO: 113196 - protein, 33 aa, Artificial Sequence
  Description of Artificial Sequence: Synthetic polypeptide
DEDEIRTTNPVAYEQWGSVCSTNIGDNHGGNTV

SEQ ID NO: 113197 - protein, 35 aa, Artificial Sequence
  Description of Artificial Sequence: Synthetic polypeptide
DEDEIRTTNPVATQQYGCVVPSCTNLSERGGNNPD

SEQ ID NO: 113198 - protein, 33 aa, Artificial Sequence
  Description of Artificial Sequence: Synthetic polypeptide
DEDEIRTTNPVATQQYGCVVSCINLSEEGGNNP

SEQ ID NO: 113199 - protein, 35 aa, Artificial Sequence
  Description of Artificial Sequence: Synthetic polypeptide
DEEEIRTTNPVATEQYGQCVCSTMEPQHFGSENQS

SEQ ID NO: 113200 - protein, 35 aa, Artificial Sequence
  Description of Artificial Sequence: Synthetic polypeptide
DEDEIRTTNPVATQQYGCVVSCTNLSERTLGNNPC

SEQ ID NO: 113201 - protein, 34 aa, Artificial Sequence
  Description of Artificial Sequence: Synthetic polypeptide
DEDEIRTTNPVATQQYGCVVSCTNVSEDGGNNPR

SEQ ID NO: 113202 - protein, 34 aa, Artificial Sequence
  Description of Artificial Sequence: Synthetic polypeptide
DEDEIRTTNPVATQQYGCVVVSCTNLSEAGGNNP

SEQ ID NO: 113203 - protein, 35 aa, Artificial Sequence
  Description of Artificial Sequence: Synthetic polypeptide
DEEEIRTTNPVATEQYGSVSPTNTQMMDVIPEQLL

SEQ ID NO: 113204 - protein, 34 aa, Artificial Sequence
  Description of Artificial Sequence: Synthetic polypeptide
DEDEIRTTNPVATHQYGCVVSCTNVSERTGGNNP

SEQ ID NO: 113205 - protein, 35 aa, Artificial Sequence
  Description of Artificial Sequence: Synthetic polypeptide
DEEEIRTTNPVATEQYGSVSPTNTPAQLVEDVTVE

SEQ ID NO: 113206 - protein, 36 aa, Artificial Sequence
  Description of Artificial Sequence: Synthetic polypeptide
DEEEIRTTNPVATEQYGSVSPTNSYGAEFQGDANEE

SEQ ID NO: 113207 - protein, 34 aa, Artificial Sequence
  Description of Artificial Sequence: Synthetic polypeptide
DEEEIRTTNPVATEQYGQCVCSTNHQENFFSDQS

SEQ ID NO: 113208 - protein, 33 aa, Artificial Sequence
  Description of Artificial Sequence: Synthetic polypeptide
DEAEIACTNPVATEQYGSCATNLQESGNDSLEN

SEQ ID NO: 113209 - protein, 35 aa, Artificial Sequence
  Description of Artificial Sequence: Synthetic polypeptide
DEEEIRGTNPVATEQYGSVYSTDNLEQNEAPDFDQ

SEQ ID NO: 113210 - protein, 34 aa, Artificial Sequence
  Description of Artificial Sequence: Synthetic polypeptide
DEDEIRTTNPVATTAYGSVSTNLQQGATTTEEDE

SEQ ID NO: 113211 - protein, 34 aa, Artificial Sequence
  Description of Artificial Sequence: Synthetic polypeptide
DEDEIRTTNPVATTAYGSVSTNLQQGATTTTEMG

SEQ ID NO: 113212 - protein, 36 aa, Artificial Sequence
  Description of Artificial Sequence: Synthetic polypeptide
DEEEIRTTNPVATEQYGSVSPTNQMMMQEEGEFEVN

SEQ ID NO: 113213 - protein, 34 aa, Artificial Sequence
  Description of Artificial Sequence: Synthetic polypeptide
DEDEIRTTNPVATTAYGSVSTNLQAGSTTDETET

SEQ ID NO: 113214 - protein, 34 aa, Artificial Sequence
  Description of Artificial Sequence: Synthetic polypeptide
DEDEIRTTNPVATTAYGSVSTNLQQGSTTEETEQ

SEQ ID NO: 113215 - protein, 33 aa, Artificial Sequence
  Description of Artificial Sequence: Synthetic polypeptide
DEDEIRTTNPVATEYWGSVSAINEGQDGEGENV

SEQ ID NO: 113216 - protein, 33 aa, Artificial Sequence
  Description of Artificial Sequence: Synthetic polypeptide
DEDEIRTTNPVATERYGETTSCTNANSQRGGDS

SEQ ID NO: 113217 - protein, 35 aa, Artificial Sequence
  Description of Artificial Sequence: Synthetic polypeptide
DEEEIRTTNPVATEQYGQCVCSTGEHQNFGSNFQT

SEQ ID NO: 113218 - protein, 34 aa, Artificial Sequence
  Description of Artificial Sequence: Synthetic polypeptide
DEEEIRTTNPVATEQYGQCVCSTGEHQNFGSVDY

SEQ ID NO: 113219 - protein, 35 aa, Artificial Sequence
  Description of Artificial Sequence: Synthetic polypeptide
DEEEIRTTNPVATEQYGQCVCSTGELAHFGSENQS

SEQ ID NO: 113220 - protein, 36 aa, Artificial Sequence
  Description of Artificial Sequence: Synthetic polypeptide
DEEEIRTTNPVATEQYGQCVCSTGELDQNFGSENQP

SEQ ID NO: 113221 - protein, 34 aa, Artificial Sequence
  Description of Artificial Sequence: Synthetic polypeptide
DEEEIRTTNPVATEQYGSVSPTPPQLNVEMMEFE

SEQ ID NO: 113222 - protein, 35 aa, Artificial Sequence
  Description of Artificial Sequence: Synthetic polypeptide
DEEEIRTTNPVATEQYGQCVCSTGELNQNFNSDQS

SEQ ID NO: 113223 - protein, 35 aa, Artificial Sequence
  Description of Artificial Sequence: Synthetic polypeptide
DEEEIRTTNPVATEQYGQCVCSTGENINFGSENQS

SEQ ID NO: 113224 - protein, 34 aa, Artificial Sequence
  Description of Artificial Sequence: Synthetic polypeptide
DEEEIRTTNPVATEQYGQCVCSTMEDQFFNSDQE

SEQ ID NO: 113225 - protein, 36 aa, Artificial Sequence
  Description of Artificial Sequence: Synthetic polypeptide
DEDEIRTTNPVATEQYGVVSVVVTNLQAGNNNEEDD

SEQ ID NO: 113226 - protein, 31 aa, Artificial Sequence
  Description of Artificial Sequence: Synthetic polypeptide
DEAEIACTNPVATEQYGSCATNLQAEDSEEP

SEQ ID NO: 113227 - protein, 35 aa, Artificial Sequence
  Description of Artificial Sequence: Synthetic polypeptide
DEEEIRTTNPVATEQYGQCVCSTGNHDQNFGSDQT

SEQ ID NO: 113228 - protein, 35 aa, Artificial Sequence
  Description of Artificial Sequence: Synthetic polypeptide
DEEEIRTTNPVATEQYGSVSPTPNMPVAMLVDSLY

SEQ ID NO: 113229 - protein, 35 aa, Artificial Sequence
  Description of Artificial Sequence: Synthetic polypeptide
DEEEIRTTNPVATEQYGQCVCSTGNHNQNFGSEQA

SEQ ID NO: 113230 - protein, 34 aa, Artificial Sequence
  Description of Artificial Sequence: Synthetic polypeptide
DEEEIRTTNPVATEQYGQCVCSTGNHQGFQSEQA

SEQ ID NO: 113231 - protein, 35 aa, Artificial Sequence
  Description of Artificial Sequence: Synthetic polypeptide
DEEEIRTTNPVATEQYGQCVCSTGNHQNSNSDNQS

SEQ ID NO: 113232 - protein, 35 aa, Artificial Sequence
  Description of Artificial Sequence: Synthetic polypeptide
DEEEIRTTNPVATEQYGQCVCSTGNPQFFNSNFQS

SEQ ID NO: 113233 - protein, 34 aa, Artificial Sequence
  Description of Artificial Sequence: Synthetic polypeptide
DEEEIRTTNPVATEQYGQCVCSTGNDENFGSDDP

SEQ ID NO: 113234 - protein, 35 aa, Artificial Sequence
  Description of Artificial Sequence: Synthetic polypeptide
DEEEIRTTNPVATEQYGQCVCSTGEHQNFGSNFIP

SEQ ID NO: 113235 - protein, 34 aa, Artificial Sequence
  Description of Artificial Sequence: Synthetic polypeptide
DEDEIRTTNPVATTAYGSVSTNLQSGSTTQEEDT

SEQ ID NO: 113236 - protein, 34 aa, Artificial Sequence
  Description of Artificial Sequence: Synthetic polypeptide
DEEEIRTTNPVATEQYGQCVCSTNPQEFFISEQS

SEQ ID NO: 113237 - protein, 36 aa, Artificial Sequence
  Description of Artificial Sequence: Synthetic polypeptide
DEEEIRTTNPVATEQYGSVSPTNNMMMQLLGEEEVN

SEQ ID NO: 113238 - protein, 36 aa, Artificial Sequence
  Description of Artificial Sequence: Synthetic polypeptide
DEEEIRTTNPVATEQYGSVSPTNNMMMQESGEEEVV

SEQ ID NO: 113239 - protein, 36 aa, Artificial Sequence
  Description of Artificial Sequence: Synthetic polypeptide
DEEEIRTTNPVATEQYGSVSPTNNMMMQEEGEEFVT

SEQ ID NO: 113240 - protein, 36 aa, Artificial Sequence
  Description of Artificial Sequence: Synthetic polypeptide
DEEEIRTTNPVATEQYGSVSPTNNMMMQEEGEEEDL

SEQ ID NO: 113241 - protein, 36 aa, Artificial Sequence
  Description of Artificial Sequence: Synthetic polypeptide
DEEEIRTTNPVATEQYGSVSPTNNMMMDESGEERVN

SEQ ID NO: 113242 - protein, 36 aa, Artificial Sequence
  Description of Artificial Sequence: Synthetic polypeptide
DEEEIRTTNPVATEQYGSVSPTNNMMIQMSGEEEVN

SEQ ID NO: 113243 - protein, 35 aa, Artificial Sequence
  Description of Artificial Sequence: Synthetic polypeptide
DEEEIRTTNPVATEQYGSVSPTNNMMEMEIGAEED

SEQ ID NO: 113244 - protein, 36 aa, Artificial Sequence
  Description of Artificial Sequence: Synthetic polypeptide
DEEEIRTTNPVATEQYGSVSPTNNMMMQQGGEEEVI

SEQ ID NO: 113245 - protein, 36 aa, Artificial Sequence
  Description of Artificial Sequence: Synthetic polypeptide
DEEEIRTTNPVATEQYGSVSPTNNMEMQEEGEEEFN

SEQ ID NO: 113246 - protein, 35 aa, Artificial Sequence
  Description of Artificial Sequence: Synthetic polypeptide
DEDEIRTTNPVATTQYGSVSTTQELQQGTTNNTTD

SEQ ID NO: 113247 - protein, 36 aa, Artificial Sequence
  Description of Artificial Sequence: Synthetic polypeptide
DEEEIRTTNPVATEQYGSVSPTNNIMDMRSLENDFV

SEQ ID NO: 113248 - protein, 35 aa, Artificial Sequence
  Description of Artificial Sequence: Synthetic polypeptide
DEEEIRTTNPVATEQYGSVSPTNNHIEEIGAEDED

SEQ ID NO: 113249 - protein, 35 aa, Artificial Sequence
  Description of Artificial Sequence: Synthetic polypeptide
DEDEIRTTNPVATTQYGSVSTTQQLQQGTNNNTTN

SEQ ID NO: 113250 - protein, 34 aa, Artificial Sequence
  Description of Artificial Sequence: Synthetic polypeptide
DEEEIRTTNPVATEQYGQCVCSWEHNQFFGSNQS

SEQ ID NO: 113251 - protein, 35 aa, Artificial Sequence
  Description of Artificial Sequence: Synthetic polypeptide
DEEEIRTTNPVATEQYGSVSPTNMVMPETGEEEEN

SEQ ID NO: 113252 - protein, 36 aa, Artificial Sequence
  Description of Artificial Sequence: Synthetic polypeptide
DEEEIRTTNPVATEQYGSVSPTNMMQQESPGEEEVY

SEQ ID NO: 113253 - protein, 36 aa, Artificial Sequence
  Description of Artificial Sequence: Synthetic polypeptide
DEDEIRTTNPVATTQYGSVSTTNQNLQQGTNNNTDG

SEQ ID NO: 113254 - protein, 34 aa, Artificial Sequence
  Description of Artificial Sequence: Synthetic polypeptide
DEDEIRTTNPVATTAYGSVSTNLQSGSVTEETET

SEQ ID NO: 113255 - protein, 36 aa, Artificial Sequence
  Description of Artificial Sequence: Synthetic polypeptide
DEEEIRTTNPVATEQYGSVSPTNNMMMQVEGEEEGN

SEQ ID NO: 113256 - protein, 36 aa, Artificial Sequence
  Description of Artificial Sequence: Synthetic polypeptide
DEEEIRTTNPVATEQYGSVSPTNNMMVQEEGEEEVN

SEQ ID NO: 113257 - protein, 34 aa, Artificial Sequence
  Description of Artificial Sequence: Synthetic polypeptide
DEDEIRTTNPVATTAYGSVSTTNANQQGTTNAED

SEQ ID NO: 113258 - protein, 30 aa, Artificial Sequence
  Description of Artificial Sequence: Synthetic polypeptide
DEAEIACTNPVATEQYGSVAANPTEAGDSL

SEQ ID NO: 113259 - protein, 34 aa, Artificial Sequence
  Description of Artificial Sequence: Synthetic polypeptide
DEEEIRTTNPVATEQYGQCVCSTPSHQNFNSDQS

SEQ ID NO: 113260 - protein, 35 aa, Artificial Sequence
  Description of Artificial Sequence: Synthetic polypeptide
DEDEIRTTNPVATTAYGSVSTTNLQAGSTTQQNDD

SEQ ID NO: 113261 - protein, 37 aa, Artificial Sequence
  Description of Artificial Sequence: Synthetic polypeptide
DEEEIRTTNPVATEQYGSVSPTNPGLLLERNGPILDQ

SEQ ID NO: 113262 - protein, 37 aa, Artificial Sequence
  Description of Artificial Sequence: Synthetic polypeptide
DEEEIRTTNPVATEQYGSVSPTNPGELLIRNGPLLDT

SEQ ID NO: 113263 - protein, 36 aa, Artificial Sequence
  Description of Artificial Sequence: Synthetic polypeptide
DEEEIRTTNPVATEQYGSVSPTNNSGINVIDQVQRI

SEQ ID NO: 113264 - protein, 36 aa, Artificial Sequence
  Description of Artificial Sequence: Synthetic polypeptide
DEEEIRTTNPVATEQYGSVSPTNNMMSQEPGEEEKN

SEQ ID NO: 113265 - protein, 35 aa, Artificial Sequence
  Description of Artificial Sequence: Synthetic polypeptide
DEEEIRTTNPVATEQYGQCVCSTTGELQYFGSEQQ

SEQ ID NO: 113266 - protein, 36 aa, Artificial Sequence
  Description of Artificial Sequence: Synthetic polypeptide
DEDEIRTTNPVATTQYGSVSTNLQQLQQGTNVATEV

SEQ ID NO: 113267 - protein, 36 aa, Artificial Sequence
  Description of Artificial Sequence: Synthetic polypeptide
DEDEIRTTNPVATTQYGSVSTNLQQLQQGTVNVATD

SEQ ID NO: 113268 - protein, 35 aa, Artificial Sequence
  Description of Artificial Sequence: Synthetic polypeptide
DEDEIRTTNPVATTQYGSVSTNQQQLEQGTNNATD

SEQ ID NO: 113269 - protein, 36 aa, Artificial Sequence
  Description of Artificial Sequence: Synthetic polypeptide
DEDEIRTTNPVATTQYGSVSTTNLQLQQGTNNNTDN

SEQ ID NO: 113270 - protein, 31 aa, Artificial Sequence
  Description of Artificial Sequence: Synthetic polypeptide
DEAEIACTNPVATEQYGSVAATTNLADPPSP

SEQ ID NO: 113271 - protein, 36 aa, Artificial Sequence
  Description of Artificial Sequence: Synthetic polypeptide
DEDEIRTTNPVATTQYGSVSTTNLQLQQGTNVATEV

SEQ ID NO: 113272 - protein, 35 aa, Artificial Sequence
  Description of Artificial Sequence: Synthetic polypeptide
DEEEIRTTNPVATEQYGSVSPTNNNLLTTSIDMQM

SEQ ID NO: 113273 - protein, 36 aa, Artificial Sequence
  Description of Artificial Sequence: Synthetic polypeptide
DEDEIRTTNPVATTQYGSVSTNLQQLQQGTNNATDQ

SEQ ID NO: 113274 - protein, 35 aa, Artificial Sequence
  Description of Artificial Sequence: Synthetic polypeptide
DEEEIRTTNPVATEQYGQCVCSTGEHQHSGSDNQP

SEQ ID NO: 113275 - protein, 36 aa, Artificial Sequence
  Description of Artificial Sequence: Synthetic polypeptide
DEEEIRTTNPVATEQYGSVSPTSLMEVQAPMENIHL

SEQ ID NO: 113276 - protein, 35 aa, Artificial Sequence
  Description of Artificial Sequence: Synthetic polypeptide
DEEEIRTTNPVATEQYGSVSPTSLVQVDVVPILVD

SEQ ID NO: 113277 - protein, 36 aa, Artificial Sequence
  Description of Artificial Sequence: Synthetic polypeptide
DEDEIRTTNPVATEQYGVVSTVSTTNNLQAGSTTSE

SEQ ID NO: 113278 - protein, 33 aa, Artificial Sequence
  Description of Artificial Sequence: Synthetic polypeptide
DEEEIRGTNPVGTEIYGSVSTDNGQGGGGQPTT

SEQ ID NO: 113279 - protein, 36 aa, Artificial Sequence
  Description of Artificial Sequence: Synthetic polypeptide
DEEEIRTTNPVATEQYGSVSPTVSELEQEISNNQQD

SEQ ID NO: 113280 - protein, 34 aa, Artificial Sequence
  Description of Artificial Sequence: Synthetic polypeptide
DEEEIRTTNPVATEQYGSVSPTVSALRIEEELVI

SEQ ID NO: 113281 - protein, 34 aa, Artificial Sequence
  Description of Artificial Sequence: Synthetic polypeptide
DEEEIRTTNPVATEQYGQCVCSTEDHQHSNSDQA

SEQ ID NO: 113282 - protein, 34 aa, Artificial Sequence
  Description of Artificial Sequence: Synthetic polypeptide
DEEEIRTTNPVATEQYGSVSPTVNSMIEIPTEIG

SEQ ID NO: 113283 - protein, 35 aa, Artificial Sequence
  Description of Artificial Sequence: Synthetic polypeptide
DEEEIRTTNPVATEQYGSVSPTVNSLELAIPTEEG

SEQ ID NO: 113284 - protein, 31 aa, Artificial Sequence
  Description of Artificial Sequence: Synthetic polypeptide
DEAEIACTNPVATEQYGCVATNLQGAEAEHH

SEQ ID NO: 113285 - protein, 33 aa, Artificial Sequence
  Description of Artificial Sequence: Synthetic polypeptide
DEEEIRTTNPVATEQYGQCVCSTEDINFGSEQA

SEQ ID NO: 113286 - protein, 35 aa, Artificial Sequence
  Description of Artificial Sequence: Synthetic polypeptide
DEEEIRTTNPVATEQYGQCVCSTEDQENFGSNNQA

SEQ ID NO: 113287 - protein, 36 aa, Artificial Sequence
  Description of Artificial Sequence: Synthetic polypeptide
DEEEIRTTNPVATEQYGSVSPTVNMMWQEFGELEVM

SEQ ID NO: 113288 - protein, 35 aa, Artificial Sequence
  Description of Artificial Sequence: Synthetic polypeptide
DEEEIRTTNPVATEQYGQCVCSTEEDQFFGSENQA

SEQ ID NO: 113289 - protein, 36 aa, Artificial Sequence
  Description of Artificial Sequence: Synthetic polypeptide
DEEEIRTTNPVATEQYGSVSPTVNMMMQESGEETVM

SEQ ID NO: 113290 - protein, 36 aa, Artificial Sequence
  Description of Artificial Sequence: Synthetic polypeptide
DEEEIRTTNPVATEQYGSVSPTVNMLLENNINNFLV

SEQ ID NO: 113291 - protein, 36 aa, Artificial Sequence
  Description of Artificial Sequence: Synthetic polypeptide
DEDEIRTTNPVATEQYGVVSTVTNNLQAGNNNQEDE

SEQ ID NO: 113292 - protein, 33 aa, Artificial Sequence
  Description of Artificial Sequence: Synthetic polypeptide
DEAEIRTTNPVATEQYGSTISWTIMQESGQEFQ

SEQ ID NO: 113293 - protein, 35 aa, Artificial Sequence
  Description of Artificial Sequence: Synthetic polypeptide
DEEEIRTTNPVATEQYGQCVCSTEDQENFGSENQG

SEQ ID NO: 113294 - protein, 35 aa, Artificial Sequence
  Description of Artificial Sequence: Synthetic polypeptide
DEEEIRTTNPVATEQYGSVSPTVMMIQESGEEEVM

SEQ ID NO: 113295 - protein, 32 aa, Artificial Sequence
  Description of Artificial Sequence: Synthetic polypeptide
DEAEIACTNPVATEQYGCVATNLQESMGDEQA

SEQ ID NO: 113296 - protein, 36 aa, Artificial Sequence
  Description of Artificial Sequence: Synthetic polypeptide
DEDEIRTTNPVATEQYGVVSTVSNTTNLQAGTTTET

SEQ ID NO: 113297 - protein, 36 aa, Artificial Sequence
  Description of Artificial Sequence: Synthetic polypeptide
DEEEIRTTNPVATEQYGSVSPVENLTQPQQMEENMV

SEQ ID NO: 113298 - protein, 34 aa, Artificial Sequence
  Description of Artificial Sequence: Synthetic polypeptide
DEEEIRTTNPVATEQYGQCVCSNWNTQNFNSEQQ

SEQ ID NO: 113299 - protein, 36 aa, Artificial Sequence
  Description of Artificial Sequence: Synthetic polypeptide
DEEEIRTTNPVATEQYGSVSPVENLTQPQQGEEVEV

SEQ ID NO: 113300 - protein, 33 aa, Artificial Sequence
  Description of Artificial Sequence: Synthetic polypeptide
DEEEIRTTNPVATEQYGQCVCSSEHQYFGSDQA

SEQ ID NO: 113301 - protein, 37 aa, Artificial Sequence
  Description of Artificial Sequence: Synthetic polypeptide
DEEEIRTTNPVATEQYGSVSPVENELVMPQQGEENNE

SEQ ID NO: 113302 - protein, 32 aa, Artificial Sequence
  Description of Artificial Sequence: Synthetic polypeptide
DEAEIACTNPVATEQYGCVATNLENRDGDTQM

SEQ ID NO: 113303 - protein, 34 aa, Artificial Sequence
  Description of Artificial Sequence: Synthetic polypeptide
DEAEIRTTNPVATEQYGSTVSWPNAMQFSGQEFQ

SEQ ID NO: 113304 - protein, 36 aa, Artificial Sequence
  Description of Artificial Sequence: Synthetic polypeptide
DEEEIRTTNPVATEQYGSVSPTWILEQPDLGEAGFE

SEQ ID NO: 113305 - protein, 32 aa, Artificial Sequence
  Description of Artificial Sequence: Synthetic polypeptide
DEAEIACTNPVATEQYGCVATNLQEASGTDDD

SEQ ID NO: 113306 - protein, 34 aa, Artificial Sequence
  Description of Artificial Sequence: Synthetic polypeptide
DEEEIRTTNPVATEQYGQCVCSSENHQNFGSDQV

SEQ ID NO: 113307 - protein, 36 aa, Artificial Sequence
  Description of Artificial Sequence: Synthetic polypeptide
DEEEIRTTNPVATEQYGSVSPTYNMMMQEEGEEEMN

SEQ ID NO: 113308 - protein, 33 aa, Artificial Sequence
  Description of Artificial Sequence: Synthetic polypeptide
DEEEIRTTNPVATEQYGQCVCSSGEHQFFGSDQ

SEQ ID NO: 113309 - protein, 35 aa, Artificial Sequence
  Description of Artificial Sequence: Synthetic polypeptide
DEEEIRTTNPVATEQYGSVSPTYNGLGETSAEELE

SEQ ID NO: 113310 - protein, 36 aa, Artificial Sequence
  Description of Artificial Sequence: Synthetic polypeptide
DEDEIRTTNPVATEQYGVVSTVNQQLQAGNNNQEQD

SEQ ID NO: 113311 - protein, 34 aa, Artificial Sequence
  Description of Artificial Sequence: Synthetic polypeptide
DEEEIRTTNPVATEQYGQCVCSSGNDQNFNSNQS

SEQ ID NO: 113312 - protein, 34 aa, Artificial Sequence
  Description of Artificial Sequence: Synthetic polypeptide
DEEEIRTTNPVATEQYGSVSPTWQELLTSEEDHD

SEQ ID NO: 113313 - protein, 33 aa, Artificial Sequence
  Description of Artificial Sequence: Synthetic polypeptide
DEEEIRGTNPVSTEQYGSVNTNFNEGQGEGQGT

SEQ ID NO: 113314 - protein, 35 aa, Artificial Sequence
  Description of Artificial Sequence: Synthetic polypeptide
DEEEIRTTNPVATEQYGQCVCSTEHDQERFGSDQL

SEQ ID NO: 113315 - protein, 37 aa, Artificial Sequence
  Description of Artificial Sequence: Synthetic polypeptide
DEEEIRTTNPVAVEQYGSVSTNNNNNLQSGTEEGNTE

SEQ ID NO: 113316 - protein, 36 aa, Artificial Sequence
  Description of Artificial Sequence: Synthetic polypeptide
DEEEIRTTNPVAVEQYGSVSTNNNNLLQGTEEGTTE

SEQ ID NO: 113317 - protein, 34 aa, Artificial Sequence
  Description of Artificial Sequence: Synthetic polypeptide
DEEEIRTTNPVATEQYGQCVCSTEPNQFFNSDQG

SEQ ID NO: 113318 - protein, 34 aa, Artificial Sequence
  Description of Artificial Sequence: Synthetic polypeptide
DEEEIRTTNPVATEQYGQCVCSTEPNQNFNSQQS

SEQ ID NO: 113319 - protein, 36 aa, Artificial Sequence
  Description of Artificial Sequence: Synthetic polypeptide
DEEEIRTTNPVATEQYGSVSPTTPAGPNMVNGMNPV

SEQ ID NO: 113320 - protein, 36 aa, Artificial Sequence
  Description of Artificial Sequence: Synthetic polypeptide
DEEEIRTTNPVATEQYGSVSPTTPAGPNMRNGMNPV

SEQ ID NO: 113321 - protein, 34 aa, Artificial Sequence
  Description of Artificial Sequence: Synthetic polypeptide
DEEEIRTTNPVATEQYGQCVCSTETQEHFGSEQA

SEQ ID NO: 113322 - protein, 34 aa, Artificial Sequence
  Description of Artificial Sequence: Synthetic polypeptide
DEEEIRTTNPVATEQYGQCVCSTGAHQNFGSQQS

SEQ ID NO: 113323 - protein, 36 aa, Artificial Sequence
  Description of Artificial Sequence: Synthetic polypeptide
DEDEIRTTNPVATEQYGVVSTVVNNLQAGNNDEEED

SEQ ID NO: 113324 - protein, 34 aa, Artificial Sequence
  Description of Artificial Sequence: Synthetic polypeptide
DEEEIRTTNPVATEQYGQCVCSTEPNENFGSDQS

SEQ ID NO: 113325 - protein, 35 aa, Artificial Sequence
  Description of Artificial Sequence: Synthetic polypeptide
DEEEIRTTNPVATEQYGSVSPTTMMMQEFGEEISN

SEQ ID NO: 113326 - protein, 36 aa, Artificial Sequence
  Description of Artificial Sequence: Synthetic polypeptide
DEDEIRTTNPVATEQYGVVSTVVNTTNLQAGSTNSS

SEQ ID NO: 113327 - protein, 36 aa, Artificial Sequence
  Description of Artificial Sequence: Synthetic polypeptide
DEEEIRTTNPVATEQYGSVSPTTLEPAESMINPERN

SEQ ID NO: 113328 - protein, 36 aa, Artificial Sequence
  Description of Artificial Sequence: Synthetic polypeptide
DEDEIRTTNPVATEQYGVVSTVVTNLQAGTNEDEDD

SEQ ID NO: 113329 - protein, 36 aa, Artificial Sequence
  Description of Artificial Sequence: Synthetic polypeptide
DEDEIRTTNPVATEQYGVVSTVVTNLQSGNNEEEDD

SEQ ID NO: 113330 - protein, 36 aa, Artificial Sequence
  Description of Artificial Sequence: Synthetic polypeptide
DEDEIRTTNPVATEQYGVVSTVVTTTNLQAGSTNVD

SEQ ID NO: 113331 - protein, 36 aa, Artificial Sequence
  Description of Artificial Sequence: Synthetic polypeptide
DEEEIRTTNPVATEQYGSVSPTSNMEHQPAMMNIVT

SEQ ID NO: 113332 - protein, 37 aa, Artificial Sequence
  Description of Artificial Sequence: Synthetic polypeptide
DEEEIRTTNPVATEQYGSVSPTSNGLEQTSNGEDHMY

SEQ ID NO: 113333 - protein, 36 aa, Artificial Sequence
  Description of Artificial Sequence: Synthetic polypeptide
DEEEIRTTNPVATEQYGSVSPTTMAGPNMSNGMNPV

SEQ ID NO: 113334 - protein, 36 aa, Artificial Sequence
  Description of Artificial Sequence: Synthetic polypeptide
DEEEIRTTNPVATEQYGSVSPTTPEGPNMRNGMNPV

SEQ ID NO: 113335 - protein, 35 aa, Artificial Sequence
  Description of Artificial Sequence: Synthetic polypeptide
DEEEIRTTNPVATEQYGSVSPTTPVGPNHNGMNPV

SEQ ID NO: 113336 - protein, 35 aa, Artificial Sequence
  Description of Artificial Sequence: Synthetic polypeptide
DEEEIRTTNPVATEQYGSVSPTTPVGPNMHNEMNV

SEQ ID NO: 113337 - protein, 34 aa, Artificial Sequence
  Description of Artificial Sequence: Synthetic polypeptide
DEEEIRTTNPVATEQYGQCVCSTEHEQYFGSEQS

SEQ ID NO: 113338 - protein, 34 aa, Artificial Sequence
  Description of Artificial Sequence: Synthetic polypeptide
DEEEIRTTNPVATEQYGQCVCSTEHNANFGSEQA

SEQ ID NO: 113339 - protein, 34 aa, Artificial Sequence
  Description of Artificial Sequence: Synthetic polypeptide
DEEEIRTTNPVATEQYGQCVCSTEHNQGFGSEQS

SEQ ID NO: 113340 - protein, 34 aa, Artificial Sequence
  Description of Artificial Sequence: Synthetic polypeptide
DEEEIRTTNPVATEQYGQCVCSTEHNQHSNSEQA

SEQ ID NO: 113341 - protein, 34 aa, Artificial Sequence
  Description of Artificial Sequence: Synthetic polypeptide
DEEEIRTTNPVATEQYGQCVCSTEHNQNFTSNQS

SEQ ID NO: 113342 - protein, 34 aa, Artificial Sequence
  Description of Artificial Sequence: Synthetic polypeptide
DEEEIRTTNPVATEQYGQCVCSTEHNQYFGSDQS

SEQ ID NO: 113343 - protein, 36 aa, Artificial Sequence
  Description of Artificial Sequence: Synthetic polypeptide
DEEEIRTTNPVATEQYGSVSPTTPVGPNMRNGMNPV

SEQ ID NO: 113344 - protein, 34 aa, Artificial Sequence
  Description of Artificial Sequence: Synthetic polypeptide
DEEEIRTTNPVATEQYGQCVCSTEHQEYFGSQQA

SEQ ID NO: 113345 - protein, 34 aa, Artificial Sequence
  Description of Artificial Sequence: Synthetic polypeptide
DEEEIRTTNPVATEQYGQCVCSTEHQGFGSDTQG

SEQ ID NO: 113346 - protein, 34 aa, Artificial Sequence
  Description of Artificial Sequence: Synthetic polypeptide
DEEEIRTTNPVATEQYGQCVCSTEHQHFGSQFQT

SEQ ID NO: 113347 - protein, 34 aa, Artificial Sequence
  Description of Artificial Sequence: Synthetic polypeptide
DEEEIRTTNPVATEQYGQCVCSTEHQNFGSETQL

SEQ ID NO: 113348 - protein, 34 aa, Artificial Sequence
  Description of Artificial Sequence: Synthetic polypeptide
DEEEIRTTNPVATEQYGQCVCSTEHQNFGSQTQV

SEQ ID NO: 113349 - protein, 35 aa, Artificial Sequence
  Description of Artificial Sequence: Synthetic polypeptide
DEEEIRTTNPVATEQYGQCVCSTELDQENFGSDQS

SEQ ID NO: 113350 - protein, 35 aa, Artificial Sequence
  Description of Artificial Sequence: Synthetic polypeptide
DEEEIRTTNPVATEQYGQCVCSTELEQSFGSETQG

SEQ ID NO: 113351 - protein, 35 aa, Artificial Sequence
  Description of Artificial Sequence: Synthetic polypeptide
DEEEIRTTNPVATEQYGQCVCSTELLQENFNSNQA

SEQ ID NO: 113352 - protein, 34 aa, Artificial Sequence
  Description of Artificial Sequence: Synthetic polypeptide
DEEEIRTTNPVATEQYGQCVCSTELQGFQSETQA

SEQ ID NO: 113353 - protein, 36 aa, Artificial Sequence
  Description of Artificial Sequence: Synthetic polypeptide
DEEEIRTTNPVATEQYGSVSPTTPVGPNMHNGMNPV

SEQ ID NO: 113354 - protein, 36 aa, Artificial Sequence
  Description of Artificial Sequence: Synthetic polypeptide
DEEEIRTTNPVATEQYGSVSPTNMMMQMWSGEEESN

SEQ ID NO: 113355 - protein, 37 aa, Artificial Sequence
  Description of Artificial Sequence: Synthetic polypeptide
DEEEIRTTNPVATEQYGSVSPVENTLTQPQQGEENNV

SEQ ID NO: 113356 - protein, 36 aa, Artificial Sequence
  Description of Artificial Sequence: Synthetic polypeptide
DEEEIRTTNPVATEQYGSVSPTNMMMQESQGEEPVE

SEQ ID NO: 113357 - protein, 33 aa, Artificial Sequence
  Description of Artificial Sequence: Synthetic polypeptide
DEEEIRTTNPVATEQYGQCVCSWEHQHFNSDQM

SEQ ID NO: 113358 - protein, 30 aa, Artificial Sequence
  Description of Artificial Sequence: Synthetic polypeptide
DEAEIACTNPVAYEQYGSCAPTNLQAPAEG

SEQ ID NO: 113359 - protein, 35 aa, Artificial Sequence
  Description of Artificial Sequence: Synthetic polypeptide
DEEEIRTTNPVATEQYGSVSVTYNEIIVANSNEPF

SEQ ID NO: 113360 - protein, 34 aa, Artificial Sequence
  Description of Artificial Sequence: Synthetic polypeptide
DEEEIRGTNPVATEQWGVVNVSGTNILQHMGGGF

SEQ ID NO: 113361 - protein, 31 aa, Artificial Sequence
  Description of Artificial Sequence: Synthetic polypeptide
DEAEIACTNPVAYEQYGSVANNLVDDGDNQD

SEQ ID NO: 113362 - protein, 35 aa, Artificial Sequence
  Description of Artificial Sequence: Synthetic polypeptide
DEEEIRTTNPVATEQYGSVSPTLEVLQTMMEIEDT

SEQ ID NO: 113363 - protein, 36 aa, Artificial Sequence
  Description of Artificial Sequence: Synthetic polypeptide
DEEEIRTTNPVATEQYGSVSPTLEVLIHEGFENENP

SEQ ID NO: 113364 - protein, 34 aa, Artificial Sequence
  Description of Artificial Sequence: Synthetic polypeptide
DEEEIRGTNPVATEQWGSSNVSGENVLQHMGGGF

SEQ ID NO: 113365 - protein, 34 aa, Artificial Sequence
  Description of Artificial Sequence: Synthetic polypeptide
DEEEIRTTNPVATEQYGSVSVTYMGLGETAEELE

SEQ ID NO: 113366 - protein, 36 aa, Artificial Sequence
  Description of Artificial Sequence: Synthetic polypeptide
DEEEIRTTNPVATEQYGSVSPTIQGITDEGTENSRF

SEQ ID NO: 113367 - protein, 35 aa, Artificial Sequence
  Description of Artificial Sequence: Synthetic polypeptide
DEDEIRTTNPVAYEQWGSVCSTDNGLNQDREQNDQ

SEQ ID NO: 113368 - protein, 36 aa, Artificial Sequence
  Description of Artificial Sequence: Synthetic polypeptide
DEEEIRTTNPVATGQYGSVSSTTPALPNMRNGMNPV

SEQ ID NO: 113369 - protein, 36 aa, Artificial Sequence
  Description of Artificial Sequence: Synthetic polypeptide
DEEEIRTTNPVATEQYGSVSPTINLMEMFQQPEPYT

SEQ ID NO: 113370 - protein, 36 aa, Artificial Sequence
  Description of Artificial Sequence: Synthetic polypeptide
DEEEIRTTNPVATEQYGSVSPTINLMEASQQFEAYT

SEQ ID NO: 113371 - protein, 35 aa, Artificial Sequence
  Description of Artificial Sequence: Synthetic polypeptide
DEEEIRTTNPVATEQYGSVSPTIMGLQTNLEEVLE

SEQ ID NO: 113372 - protein, 34 aa, Artificial Sequence
  Description of Artificial Sequence: Synthetic polypeptide
DEEEIRTTNPVATEQYGSVSVWLNWIHETQPEGD

SEQ ID NO: 113373 - protein, 33 aa, Artificial Sequence
  Description of Artificial Sequence: Synthetic polypeptide
DEDEIRTTNPVAYEQWGSVCSTDNGQQDNNNVA

SEQ ID NO: 113374 - protein, 36 aa, Artificial Sequence
  Description of Artificial Sequence: Synthetic polypeptide
DEEEIRTTNPVATEQYGSVSPTINMVMQETGEEEVN

SEQ ID NO: 113375 - protein, 35 aa, Artificial Sequence
  Description of Artificial Sequence: Synthetic polypeptide
DEEEIRTTNPVATEQYGQSVPSYTDEPPESVGNDQ

SEQ ID NO: 113376 - protein, 34 aa, Artificial Sequence
  Description of Artificial Sequence: Synthetic polypeptide
DEDEIRTTNPVAYEQWGSVCSTDNGDGKQGGNKN

SEQ ID NO: 113377 - protein, 33 aa, Artificial Sequence
  Description of Artificial Sequence: Synthetic polypeptide
DEDEIRTTNPVAYEQWGSVCSTDNDGKQQNNQG

SEQ ID NO: 113378 - protein, 35 aa, Artificial Sequence
  Description of Artificial Sequence: Synthetic polypeptide
DEEEIRTTNPVATEQYGSVSPTLPAAEVHGVNNQV

SEQ ID NO: 113379 - protein, 36 aa, Artificial Sequence
  Description of Artificial Sequence: Synthetic polypeptide
DEEEIRTTNPVATEQYGSVSPTLPAAEQLGMNNNQS

SEQ ID NO: 113380 - protein, 36 aa, Artificial Sequence
  Description of Artificial Sequence: Synthetic polypeptide
DEEEIRTTNPVATEQYGSVSPTLPAAEQHGMNNQEG

SEQ ID NO: 113381 - protein, 35 aa, Artificial Sequence
  Description of Artificial Sequence: Synthetic polypeptide
DEEEIRTTNPVATEQYGSVSPTLPAAEEHGMSNQV

SEQ ID NO: 113382 - protein, 34 aa, Artificial Sequence
  Description of Artificial Sequence: Synthetic polypeptide
DEEEIRGTNPVATEQYGSVCTTLGEIEVDMNMRL

SEQ ID NO: 113383 - protein, 36 aa, Artificial Sequence
  Description of Artificial Sequence: Synthetic polypeptide
DEEEIRTTNPVATEQYGSVSPTLNMTMQEENEEELN

SEQ ID NO: 113384 - protein, 36 aa, Artificial Sequence
  Description of Artificial Sequence: Synthetic polypeptide
DEEEIRTTNPVATEQYGSVSPTLNMMMQIEGEEEDN

SEQ ID NO: 113385 - protein, 35 aa, Artificial Sequence
  Description of Artificial Sequence: Synthetic polypeptide
DEDEIRTTNPVAYEQWGSVCSTDNDQQIEGGHNER

SEQ ID NO: 113386 - protein, 34 aa, Artificial Sequence
  Description of Artificial Sequence: Synthetic polypeptide
DEEEIRGTNPVATEQYGSVCSVVGDHRQVSNSRN

SEQ ID NO: 113387 - protein, 33 aa, Artificial Sequence
  Description of Artificial Sequence: Synthetic polypeptide
DEDEIRTTNPVAYEQWGSVCSTDNDGKQGGDKP

SEQ ID NO: 113388 - protein, 33 aa, Artificial Sequence
  Description of Artificial Sequence: Synthetic polypeptide
DEEEIRTTNPVATHQYGSVAYIFHSGRTGGNNS

SEQ ID NO: 113389 - protein, 35 aa, Artificial Sequence
  Description of Artificial Sequence: Synthetic polypeptide
DEEEIRGTNPVATEQYGMSVSSVVLQHDVGAVSNV

SEQ ID NO: 113390 - protein, 33 aa, Artificial Sequence
  Description of Artificial Sequence: Synthetic polypeptide
DEDEIRTTNPVAYEQWGSVCSTDNDGKQGNGQN

SEQ ID NO: 113391 - protein, 33 aa, Artificial Sequence
  Description of Artificial Sequence: Synthetic polypeptide
DEEEIRGTNPVATEQYGDVVMTNGFTGGGNNNG

SEQ ID NO: 113392 - protein, 34 aa, Artificial Sequence
  Description of Artificial Sequence: Synthetic polypeptide
DEEEIRGTNPVATEQYGDVVMTNGFQGGGDTNNN

SEQ ID NO: 113393 - protein, 34 aa, Artificial Sequence
  Description of Artificial Sequence: Synthetic polypeptide
DEDEIRTTNPVAYEQWGSVCSTDNDGKQQGNNPS

SEQ ID NO: 113394 - protein, 33 aa, Artificial Sequence
  Description of Artificial Sequence: Synthetic polypeptide
DEEEIRGTNPVATEQYGNVLMTVGPVQVGENGP

SEQ ID NO: 113395 - protein, 38 aa, Artificial Sequence
  Description of Artificial Sequence: Synthetic polypeptide
DEEEIRTTNPVATEQYGSVSVTVSNLQAGTEQGTNQEQ

SEQ ID NO: 113396 - protein, 36 aa, Artificial Sequence
  Description of Artificial Sequence: Synthetic polypeptide
DEEEIRTTNPVATEQYGQSVPSYTGEPPESAVGNDR

SEQ ID NO: 113397 - protein, 34 aa, Artificial Sequence
  Description of Artificial Sequence: Synthetic polypeptide
DEDEIRTTNPVAYEQWGSVCSTDNLIQGDTNGDA

SEQ ID NO: 113398 - protein, 35 aa, Artificial Sequence
  Description of Artificial Sequence: Synthetic polypeptide
DEEEIRTTNPVATEQYGSVSPTGVDLLFQDEVVSM

SEQ ID NO: 113399 - protein, 36 aa, Artificial Sequence
  Description of Artificial Sequence: Synthetic polypeptide
DEDEIRTTNPVAYEQWGSVCSTDNLLDQDRGGNNDQ

SEQ ID NO: 113400 - protein, 34 aa, Artificial Sequence
  Description of Artificial Sequence: Synthetic polypeptide
DEDEIRTTNPVAYEQWGSVCSTDNNDHHAGENDR

SEQ ID NO: 113401 - protein, 35 aa, Artificial Sequence
  Description of Artificial Sequence: Synthetic polypeptide
DEEEIRTTNPVATEQYGQTVCSNTEELQFFGSEQA

SEQ ID NO: 113402 - protein, 35 aa, Artificial Sequence
  Description of Artificial Sequence: Synthetic polypeptide
DEDEIRTTNPVAYEQWGSVCSTDNNDLDHRGTNDL

SEQ ID NO: 113403 - protein, 35 aa, Artificial Sequence
  Description of Artificial Sequence: Synthetic polypeptide
DEEEIRTTNPVATEQYGSVSPTGMMWQESGEEEVE

SEQ ID NO: 113404 - protein, 34 aa, Artificial Sequence
  Description of Artificial Sequence: Synthetic polypeptide
DEDEIRTTNPVAYEQWGSVCSTEDNGGHQGENMR

SEQ ID NO: 113405 - protein, 34 aa, Artificial Sequence
  Description of Artificial Sequence: Synthetic polypeptide
DEEEIRTTNPVATEQYGSVSWDVGPQVCPNSQDN

SEQ ID NO: 113406 - protein, 33 aa, Artificial Sequence
  Description of Artificial Sequence: Synthetic polypeptide
DEDEIRTTNPVAYEQWGSVCSTENDGHQGGQKS

SEQ ID NO: 113407 - protein, 35 aa, Artificial Sequence
  Description of Artificial Sequence: Synthetic polypeptide
DEEEIRTTNPVATEQYGQVSTDGMGNQGEGGNEIF

SEQ ID NO: 113408 - protein, 34 aa, Artificial Sequence
  Description of Artificial Sequence: Synthetic polypeptide
DEEEIRTTNPVATEQYGQVSTMTDGPEGGGENIF

SEQ ID NO: 113409 - protein, 33 aa, Artificial Sequence
  Description of Artificial Sequence: Synthetic polypeptide
DEDEIRTTNPVAYEQWGSVCSTENDQGDTNGGL

SEQ ID NO: 113410 - protein, 33 aa, Artificial Sequence
  Description of Artificial Sequence: Synthetic polypeptide
DEEEIRCTNPVATEQYGTVCSAEDGPVEREGND

SEQ ID NO: 113411 - protein, 34 aa, Artificial Sequence
  Description of Artificial Sequence: Synthetic polypeptide
DEEEIRCTNPVATEQYGSVYGDNGQDEGGQNSTN

SEQ ID NO: 113412 - protein, 34 aa, Artificial Sequence
  Description of Artificial Sequence: Synthetic polypeptide
DEEEIRTTNPVATEQYGQVTDTNNMGMTGEGGNG

SEQ ID NO: 113413 - protein, 35 aa, Artificial Sequence
  Description of Artificial Sequence: Synthetic polypeptide
DEEEIRCTNPVATEQYGSVSVGVGNLNGGGNDEGT

SEQ ID NO: 113414 - protein, 35 aa, Artificial Sequence
  Description of Artificial Sequence: Synthetic polypeptide
DEDEIRTTNPVAYEQWGSVCSTENDLGEQEGGNHM

SEQ ID NO: 113415 - protein, 34 aa, Artificial Sequence
  Description of Artificial Sequence: Synthetic polypeptide
DEEEIRGTNPVATEQWGMVVSTLLINRGGGNVGD

SEQ ID NO: 113416 - protein, 34 aa, Artificial Sequence
  Description of Artificial Sequence: Synthetic polypeptide
DEEEIRTTNPVATEQYGSVSWDVEPQVRPFSQDQ

SEQ ID NO: 113417 - protein, 35 aa, Artificial Sequence
  Description of Artificial Sequence: Synthetic polypeptide
DEDEIRTTNPVAYEQWGSVCSTDNLLDQDRGGHDD

SEQ ID NO: 113418 - protein, 35 aa, Artificial Sequence
  Description of Artificial Sequence: Synthetic polypeptide
DEEEIRTTNPVATEQYGSVSPTHMLLQQPIVEEDL

SEQ ID NO: 113419 - protein, 30 aa, Artificial Sequence
  Description of Artificial Sequence: Synthetic polypeptide
DEAEIACTNPVAYEQYGSVATNGTAENPNE

SEQ ID NO: 113420 - protein, 37 aa, Artificial Sequence
  Description of Artificial Sequence: Synthetic polypeptide
DEEEIRTTNPVATEQYGSVSPTHLALPQSRPNFAIEL

SEQ ID NO: 113421 - protein, 36 aa, Artificial Sequence
  Description of Artificial Sequence: Synthetic polypeptide
DEEEIRTTNPVATEQYGSVSPTHDLLQQRIVEELDL

SEQ ID NO: 113422 - protein, 34 aa, Artificial Sequence
  Description of Artificial Sequence: Synthetic polypeptide
DEEEIRTTNPVATEQYGSVSPTGVPVIVETGPQL

SEQ ID NO: 113423 - protein, 32 aa, Artificial Sequence
  Description of Artificial Sequence: Synthetic polypeptide
DEAEIACTNPVAYEQYGSVATNLAGAPMEGNH

SEQ ID NO: 113424 - protein, 33 aa, Artificial Sequence
  Description of Artificial Sequence: Synthetic polypeptide
DEEEIRGTNPVATEQWGAVVSTLLILGGGNDGQ

SEQ ID NO: 113425 - protein, 33 aa, Artificial Sequence
  Description of Artificial Sequence: Synthetic polypeptide
DEEEIRTTNPVATEQYGSVSWDPGPQVIPFSQD

SEQ ID NO: 113426 - protein, 35 aa, Artificial Sequence
  Description of Artificial Sequence: Synthetic polypeptide
DEEEIRTTNPVATEQYGSVSVYPNDLFDSRIMQEG

SEQ ID NO: 113427 - protein, 31 aa, Artificial Sequence
  Description of Artificial Sequence: Synthetic polypeptide
DEAEIACTNPVAYEQYGSVATNLQAHPAKDE

SEQ ID NO: 113428 - protein, 32 aa, Artificial Sequence
  Description of Artificial Sequence: Synthetic polypeptide
DEAEIACTNPVAYEQYGSVATNLQEHGGDIEA

SEQ ID NO: 113429 - protein, 35 aa, Artificial Sequence
  Description of Artificial Sequence: Synthetic polypeptide
DEEEIRTTNPVATEQYGSVSVYPYLFDSRINQEIS

SEQ ID NO: 113430 - protein, 32 aa, Artificial Sequence
  Description of Artificial Sequence: Synthetic polypeptide
DEAEIACTNPVAYEQYGSVATNLQEHGGGEAP

SEQ ID NO: 113431 - protein, 33 aa, Artificial Sequence
  Description of Artificial Sequence: Synthetic polypeptide
DEEEIRTTNPVATEQYGSVSWDADQQAVEEKFN

SEQ ID NO: 113432 - protein, 35 aa, Artificial Sequence
  Description of Artificial Sequence: Synthetic polypeptide
DEEEIRTTNPVATEQYGSVSWDNEAPQVEIMNDQN

SEQ ID NO: 113433 - protein, 35 aa, Artificial Sequence
  Description of Artificial Sequence: Synthetic polypeptide
DEEEIRTTNPVATEQYGSVSWDNIAVQRESEEEHM

SEQ ID NO: 113434 - protein, 35 aa, Artificial Sequence
  Description of Artificial Sequence: Synthetic polypeptide
DEEEIRTTNPVATEQYGSVSVYPNLFDSRIMQDSI

SEQ ID NO: 113435 - protein, 37 aa, Artificial Sequence
  Description of Artificial Sequence: Synthetic polypeptide
DEEEIRTTNPVATEQYGSVSVTVNTNLQAGTTTEESD

SEQ ID NO: 113436 - protein, 34 aa, Artificial Sequence
  Description of Artificial Sequence: Synthetic polypeptide
DEDEIRTTNPVAYEQWGSVCSGDNNGDQRNGNVK

SEQ ID NO: 113437 - protein, 38 aa, Artificial Sequence
  Description of Artificial Sequence: Synthetic polypeptide
DEEEIRTTNPVATEQYGSVSVTVNNQQLQQGTTEAGND

SEQ ID NO: 113438 - protein, 31 aa, Artificial Sequence
  Description of Artificial Sequence: Synthetic polypeptide
DEDEIRTTNPVAYECWGSVCGDDLQEGGDNT

SEQ ID NO: 113439 - protein, 33 aa, Artificial Sequence
  Description of Artificial Sequence: Synthetic polypeptide
DEDEIRTTNPVAYECWGSVSGDNMNQQRGNEDS

SEQ ID NO: 113440 - protein, 33 aa, Artificial Sequence
  Description of Artificial Sequence: Synthetic polypeptide
DEDEIRTTNPVAYECWGSVSGGQNLQDSGGNES

SEQ ID NO: 113441 - protein, 34 aa, Artificial Sequence
  Description of Artificial Sequence: Synthetic polypeptide
DEDEIRTTNPVAYECWGSVSNDNLGEERQGNDSR

SEQ ID NO: 113442 - protein, 35 aa, Artificial Sequence
  Description of Artificial Sequence: Synthetic polypeptide
DEEEIRTTNPVATEQYGSVSPTNLMETSAMPSHES

SEQ ID NO: 113443 - protein, 32 aa, Artificial Sequence
  Description of Artificial Sequence: Synthetic polypeptide
DEDEIRTTNPVAYEGWGTVATNLQGEDGNNTN

SEQ ID NO: 113444 - protein, 33 aa, Artificial Sequence
  Description of Artificial Sequence: Synthetic polypeptide
DEDEIRTTNPVAYEHYGEVSTQNNLGAEDGNTI

SEQ ID NO: 113445 - protein, 36 aa, Artificial Sequence
  Description of Artificial Sequence: Synthetic polypeptide
DEEEIRTTNPVATEQYGSVSVTPTVLSMTEGENPLA

SEQ ID NO: 113446 - protein, 33 aa, Artificial Sequence
  Description of Artificial Sequence: Synthetic polypeptide
DEDEIRTTNPVAYEHYGEVSTTQNQQAEDGNTI

SEQ ID NO: 113447 - protein, 33 aa, Artificial Sequence
  Description of Artificial Sequence: Synthetic polypeptide
DEDEIRTTNPVAYEKWGEVSTQNNLQGEDGNTS

SEQ ID NO: 113448 - protein, 34 aa, Artificial Sequence
  Description of Artificial Sequence: Synthetic polypeptide
DEEEIRTTNPVATEQYGSVSVTQMIIARVDQQLQ

SEQ ID NO: 113449 - protein, 36 aa, Artificial Sequence
  Description of Artificial Sequence: Synthetic polypeptide
DEEEIRTTNPVATEQYGSVSVTQPAGPNMRNGMNPV

SEQ ID NO: 113450 - protein, 36 aa, Artificial Sequence
  Description of Artificial Sequence: Synthetic polypeptide
DEEEIRTTNPVATEQYGSVSPTNINVETLNGLENTD

SEQ ID NO: 113451 - protein, 35 aa, Artificial Sequence
  Description of Artificial Sequence: Synthetic polypeptide
DEEEIRTTNPVATEQYGSVSPTNINTMLGGLELTD

SEQ ID NO: 113452 - protein, 34 aa, Artificial Sequence
  Description of Artificial Sequence: Synthetic polypeptide
DEAEIRTTNPVATEQYGSSSWSNDEQMNGQNDDI

SEQ ID NO: 113453 - protein, 35 aa, Artificial Sequence
  Description of Artificial Sequence: Synthetic polypeptide
DEEEIRTTNPVATEQYGSVSPTNIGPQIAITQLGE

SEQ ID NO: 113454 - protein, 33 aa, Artificial Sequence
  Description of Artificial Sequence: Synthetic polypeptide
DEDEIRTTNPVAYEHYGEVVVTQNLQGEDGNTI

SEQ ID NO: 113455 - protein, 36 aa, Artificial Sequence
  Description of Artificial Sequence: Synthetic polypeptide
DEEEIRTTNPVATEQYGSVSVTTDAGTNAENGVNPV

SEQ ID NO: 113456 - protein, 35 aa, Artificial Sequence
  Description of Artificial Sequence: Synthetic polypeptide
DEEEIRTTNPVATEQYGSVSVTPSQQGAIEVVEHD

SEQ ID NO: 113457 - protein, 36 aa, Artificial Sequence
  Description of Artificial Sequence: Synthetic polypeptide
DEEEIRTTNPVATEQYGSVSVTPLMTSQVEMENPLA

SEQ ID NO: 113458 - protein, 34 aa, Artificial Sequence
  Description of Artificial Sequence: Synthetic polypeptide
DEEEIRTTNPVATEQYGQCVCSWELNQGFGSEQS

SEQ ID NO: 113459 - protein, 35 aa, Artificial Sequence
  Description of Artificial Sequence: Synthetic polypeptide
DEEEIRTTNPVATEQYGSVSPTNMMMQESLEELVM

SEQ ID NO: 113460 - protein, 35 aa, Artificial Sequence
  Description of Artificial Sequence: Synthetic polypeptide
DEEEIRTTNPVATEQYGSVSPTNMMMIESQEEEVM

SEQ ID NO: 113461 - protein, 33 aa, Artificial Sequence
  Description of Artificial Sequence: Synthetic polypeptide
DEEEIRTTNPVATEQYGQCVCSWEPQNFGSDQA

SEQ ID NO: 113462 - protein, 35 aa, Artificial Sequence
  Description of Artificial Sequence: Synthetic polypeptide
DEEEIRTTNPVATEQYGSVSPTNMEMQEHQEEEVN

SEQ ID NO: 113463 - protein, 34 aa, Artificial Sequence
  Description of Artificial Sequence: Synthetic polypeptide
DEDEIRTTNPVATTQYGVVSTNNNNEQYGTNQNQ

SEQ ID NO: 113464 - protein, 33 aa, Artificial Sequence
  Description of Artificial Sequence: Synthetic polypeptide
DEDEIRTTNPVATTQYGVVSTQNNTEQGTNNQT

SEQ ID NO: 113465 - protein, 32 aa, Artificial Sequence
  Description of Artificial Sequence: Synthetic polypeptide
DEDEIRTTNPVAYECWGSVATNLNGEHGGNSD

SEQ ID NO: 113466 - protein, 32 aa, Artificial Sequence
  Description of Artificial Sequence: Synthetic polypeptide
DEDEIRTTNPVATTQYGVVSTSNTEQGTEQGT

SEQ ID NO: 113467 - protein, 33 aa, Artificial Sequence
  Description of Artificial Sequence: Synthetic polypeptide
DEDEIRTTNPVATTQYGVVSTTNNTEEGTNNQQ

SEQ ID NO: 113468 - protein, 35 aa, Artificial Sequence
  Description of Artificial Sequence: Synthetic polypeptide
DEDEIRTTNPVAWEQYGKVPSCINELSTQAGQNRH

SEQ ID NO: 113469 - protein, 32 aa, Artificial Sequence
  Description of Artificial Sequence: Synthetic polypeptide
DEDEIRTTNPVAYEAWGSVSTNGAGEHGGNSD

SEQ ID NO: 113470 - protein, 33 aa, Artificial Sequence
  Description of Artificial Sequence: Synthetic polypeptide
DEDEIRTTNPVAYEAWGTVATNLNRGEDQNMGR

SEQ ID NO: 113471 - protein, 32 aa, Artificial Sequence
  Description of Artificial Sequence: Synthetic polypeptide
DEDEIRTTNPVAYEAWGVVSTNLAGEHGNNSD

SEQ ID NO: 113472 - protein, 35 aa, Artificial Sequence
  Description of Artificial Sequence: Synthetic polypeptide
DEEEIRTTNPVATEQYGSVSVTPAIEERLELNENV

SEQ ID NO: 113473 - protein, 36 aa, Artificial Sequence
  Description of Artificial Sequence: Synthetic polypeptide
DEEEIRTTNPVATEQYGSVSVTPEGLEETRQGQETP

SEQ ID NO: 113474 - protein, 33 aa, Artificial Sequence
  Description of Artificial Sequence: Synthetic polypeptide
DEDEIRTTNPVATTQYGVVSTTNNLEQGSTQGE

SEQ ID NO: 113475 - protein, 35 aa, Artificial Sequence
  Description of Artificial Sequence: Synthetic polypeptide
DEEEIRTTNPVATEQYGSVSVTTGLEEFTQGQETP

SEQ ID NO: 113476 - protein, 32 aa, Artificial Sequence
  Description of Artificial Sequence: Synthetic polypeptide
DEDEIRTTNPVAYEQWGATSTNLNQGEGDGSD

SEQ ID NO: 113477 - protein, 33 aa, Artificial Sequence
  Description of Artificial Sequence: Synthetic polypeptide
DEEEIRTTNPVATEQYGQCVCSWGEHQSFGSEQ

SEQ ID NO: 113478 - protein, 32 aa, Artificial Sequence
  Description of Artificial Sequence: Synthetic polypeptide
DEEEIRGTNPVATEQYGSVSVVQHDMGAVSVN

SEQ ID NO: 113479 - protein, 33 aa, Artificial Sequence
  Description of Artificial Sequence: Synthetic polypeptide
DEEEIRGTNPVATEQYGSVSVVQHAPVGAVSRN

SEQ ID NO: 113480 - protein, 32 aa, Artificial Sequence
  Description of Artificial Sequence: Synthetic polypeptide
DEDEIRTTNPVAYEQWGEVSGGNDDDRGNGGA

SEQ ID NO: 113481 - protein, 33 aa, Artificial Sequence
  Description of Artificial Sequence: Synthetic polypeptide
DEDEIRTTNPVAYEQWGEVSTTNHNNDAGDNMR

SEQ ID NO: 113482 - protein, 36 aa, Artificial Sequence
  Description of Artificial Sequence: Synthetic polypeptide
DEEEIRTTNPVATEQYGSVSPTNATENQNTSQDERM

SEQ ID NO: 113483 - protein, 36 aa, Artificial Sequence
  Description of Artificial Sequence: Synthetic polypeptide
DEEEIRTTNPVATEQYGSVSPTNAMMMQEIGEEEVN

SEQ ID NO: 113484 - protein, 35 aa, Artificial Sequence
  Description of Artificial Sequence: Synthetic polypeptide
DEEEIRTTNPVATEQYGSVSPTMYMEGSAMENIAT

SEQ ID NO: 113485 - protein, 34 aa, Artificial Sequence
  Description of Artificial Sequence: Synthetic polypeptide
DEEEIRGTNPVATEQYGSVSVVVQHDIVGAESRN

SEQ ID NO: 113486 - protein, 33 aa, Artificial Sequence
  Description of Artificial Sequence: Synthetic polypeptide
DEDEIRTTNPVAYEQWGSVACTGGLQWDGNGED

SEQ ID NO: 113487 - protein, 36 aa, Artificial Sequence
  Description of Artificial Sequence: Synthetic polypeptide
DEEEIRTTNPVATEQYGSVSPTMNMLTVNLNELVEA

SEQ ID NO: 113488 - protein, 37 aa, Artificial Sequence
  Description of Artificial Sequence: Synthetic polypeptide
DEEEIRTTNPVATEQYGSVSPTMNMLNQPQAGAIQTQ

SEQ ID NO: 113489 - protein, 34 aa, Artificial Sequence
  Description of Artificial Sequence: Synthetic polypeptide
DEAEIRTTNPVATEQYGSSCPAVVHNAEREGQER

SEQ ID NO: 113490 - protein, 33 aa, Artificial Sequence
  Description of Artificial Sequence: Synthetic polypeptide
DEDEIRTTNPVAYEQWGSVACTGMQWDGNGEDR

SEQ ID NO: 113491 - protein, 37 aa, Artificial Sequence
  Description of Artificial Sequence: Synthetic polypeptide
DEEEIRTTNPVATEQYGSVSPTMNAVHFALIQLENDD

SEQ ID NO: 113492 - protein, 38 aa, Artificial Sequence
  Description of Artificial Sequence: Synthetic polypeptide
DEEEIRTTNPVATEQYGSVSVTVNNNNLQAGNNTEDED

SEQ ID NO: 113493 - protein, 35 aa, Artificial Sequence
  Description of Artificial Sequence: Synthetic polypeptide
DEEEIRTTNPVATEQYGSVSPTMGSWETRMGVIEN

SEQ ID NO: 113494 - protein, 34 aa, Artificial Sequence
  Description of Artificial Sequence: Synthetic polypeptide
DEEEIRGTNPVATEQYGSVSQVVSGDRQVSNSRN

SEQ ID NO: 113495 - protein, 33 aa, Artificial Sequence
  Description of Artificial Sequence: Synthetic polypeptide
DEEEIRGTNPVATEQYGSVSVVVQHDVGAVSLP

SEQ ID NO: 113496 - protein, 32 aa, Artificial Sequence
  Description of Artificial Sequence: Synthetic polypeptide
DEDEIRTTNPVAYEQWGEVCSTENDEHDGNNE

SEQ ID NO: 113497 - protein, 33 aa, Artificial Sequence
  Description of Artificial Sequence: Synthetic polypeptide
DEEEIRTTNPVATEQYGQCVCSYEHQNFGSEAS

SEQ ID NO: 113498 - protein, 33 aa, Artificial Sequence
  Description of Artificial Sequence: Synthetic polypeptide
DEDEIRTTNPVAYEQWGCATTNLQGNAGEGGNR

SEQ ID NO: 113499 - protein, 32 aa, Artificial Sequence
  Description of Artificial Sequence: Synthetic polypeptide
DEDEIRTTNPVAYEQWGCTSTNLNGNAGEGND

SEQ ID NO: 113500 - protein, 34 aa, Artificial Sequence
  Description of Artificial Sequence: Synthetic polypeptide
DEEEIRTTNPVATEQYGQCVCSWGELQNFGSEQN

SEQ ID NO: 113501 - protein, 35 aa, Artificial Sequence
  Description of Artificial Sequence: Synthetic polypeptide
DEEEIRTTNPVATEQYGSVSVTTNQLMHEASVEEF

SEQ ID NO: 113502 - protein, 36 aa, Artificial Sequence
  Description of Artificial Sequence: Synthetic polypeptide
DEEEIRTTNPVATEQYGSVSVTTPAGPDMRNGMNPV

SEQ ID NO: 113503 - protein, 36 aa, Artificial Sequence
  Description of Artificial Sequence: Synthetic polypeptide
DEEEIRTTNPVATEQYGSVSVTTPAGPNMRNGMNPV

SEQ ID NO: 113504 - protein, 36 aa, Artificial Sequence
  Description of Artificial Sequence: Synthetic polypeptide
DEEEIRTTNPVATEQYGSVSVTTQAGQNGENGVNPV

SEQ ID NO: 113505 - protein, 35 aa, Artificial Sequence
  Description of Artificial Sequence: Synthetic polypeptide
DEEEIRTTNPVATEQYGQCVCSWGNHQNFGSENQS

SEQ ID NO: 113506 - protein, 36 aa, Artificial Sequence
  Description of Artificial Sequence: Synthetic polypeptide
DEEEIRTTNPVATEQYGSVSVTTQAGTNQENGVNNV

SEQ ID NO: 113507 - protein, 35 aa, Artificial Sequence
  Description of Artificial Sequence: Synthetic polypeptide
DEEEIRTTNPVATEQYGSVSVTTQDQLTDGEMLPQ

SEQ ID NO: 113508 - protein, 38 aa, Artificial Sequence
  Description of Artificial Sequence: Synthetic polypeptide
DEEEIRTTNPVATEQYGSVSVTTTNLQAGNQQGTTTVD

SEQ ID NO: 113509 - protein, 38 aa, Artificial Sequence
  Description of Artificial Sequence: Synthetic polypeptide
DEEEIRTTNPVATEQYGSVSVTTTNLQAGTQAGTTNVE

SEQ ID NO: 113510 - protein, 36 aa, Artificial Sequence
  Description of Artificial Sequence: Synthetic polypeptide
DEEEIRTTNPVATEQYGSVSPTNHLMETSAMPEMRS

SEQ ID NO: 113511 - protein, 35 aa, Artificial Sequence
  Description of Artificial Sequence: Synthetic polypeptide
DEEEIRTTNPVATEQYGSVSVTVEQDMANDIQELW

SEQ ID NO: 113512 - protein, 34 aa, Artificial Sequence
  Description of Artificial Sequence: Synthetic polypeptide
DEEEIRTTNPVATEQYGQCVCSWGYHQRFGSEQS

SEQ ID NO: 113513 - protein, 35 aa, Artificial Sequence
  Description of Artificial Sequence: Synthetic polypeptide
DEEEIRTTNPVATEQYGSVSPTNHHHAMEIGAEED

SEQ ID NO: 113514 - protein, 35 aa, Artificial Sequence
  Description of Artificial Sequence: Synthetic polypeptide
DEEEIRTTNPVATEQYGQCVCSWNHQENFGSNFQT

SEQ ID NO: 113515 - protein, 36 aa, Artificial Sequence
  Description of Artificial Sequence: Synthetic polypeptide
DEEEIRTTNPVATEQYGSVSPTNMMMQESMGELEVN

SEQ ID NO: 113516 - protein, 36 aa, Artificial Sequence
  Description of Artificial Sequence: Synthetic polypeptide
DEEEIRTTNPVATEQYGSVSPVFNAQAARDGVVPEI

SEQ ID NO: 113517 - protein, 37 aa, Artificial Sequence
  Description of Artificial Sequence: Synthetic polypeptide
DEEEIRTTNPVATEQYGSVSPVINLLPQVRELEALNT

SEQ ID NO: 113518 - protein, 36 aa, Artificial Sequence
  Description of Artificial Sequence: Synthetic polypeptide
DEEEIRTTNPVATEQYGSVSPVLPAAEQHGMNNQVM

SEQ ID NO: 113519 - protein, 34 aa, Artificial Sequence
  Description of Artificial Sequence: Synthetic polypeptide
DEEEIRSTNPVATEQYGSVGTGNMDNGGGENNGE

SEQ ID NO: 113520 - protein, 34 aa, Artificial Sequence
  Description of Artificial Sequence: Synthetic polypeptide
DEEEIRSTNPVATEQYGSVDNSTGDEGQGGETED

SEQ ID NO: 113521 - protein, 37 aa, Artificial Sequence
  Description of Artificial Sequence: Synthetic polypeptide
DEEEIRTTNPVATEQYGSVSSKTPANGPNMRNGMNPV

SEQ ID NO: 113522 - protein, 35 aa, Artificial Sequence
  Description of Artificial Sequence: Synthetic polypeptide
DEAEIRTTNPVATEQYGSVCSENELDENRSEENQE

SEQ ID NO: 113523 - protein, 36 aa, Artificial Sequence
  Description of Artificial Sequence: Synthetic polypeptide
DEEEIRTTNPVATEQYGSVSVTMPAGPNMINGMNSV

SEQ ID NO: 113524 - protein, 35 aa, Artificial Sequence
  Description of Artificial Sequence: Synthetic polypeptide
DEEEIRTTNPVATEQYGMVSVEGMGNLNGEGNEGT

SEQ ID NO: 113525 - protein, 35 aa, Artificial Sequence
  Description of Artificial Sequence: Synthetic polypeptide
DEEEIRTTNPVATEQYGMVSVTGIGNQNQEGEGGN

SEQ ID NO: 113526 - protein, 34 aa, Artificial Sequence
  Description of Artificial Sequence: Synthetic polypeptide
DEEEIRSTNPVATEQYGSVINGSNGQDEGGQNDT

SEQ ID NO: 113527 - protein, 36 aa, Artificial Sequence
  Description of Artificial Sequence: Synthetic polypeptide
DEEEIRTTNPVATEQYGSVSVTMPAGPNMINGQNPQ

SEQ ID NO: 113528 - protein, 36 aa, Artificial Sequence
  Description of Artificial Sequence: Synthetic polypeptide
DEEEIRTTNPVATEQYGSVSSKTPAGPNMRNGMNPV

SEQ ID NO: 113529 - protein, 34 aa, Artificial Sequence
  Description of Artificial Sequence: Synthetic polypeptide
DEEEIRSTNPVATEQYGNVATTPAIQMRVGMNPV

SEQ ID NO: 113530 - protein, 36 aa, Artificial Sequence
  Description of Artificial Sequence: Synthetic polypeptide
DEEEIRTTNPVATEQYGSVSSITPMGPNMRNGMNPV

SEQ ID NO: 113531 - protein, 33 aa, Artificial Sequence
  Description of Artificial Sequence: Synthetic polypeptide
DEEEIRTTNPVATEQYGMYTIMTDEGQENGNGN

SEQ ID NO: 113532 - protein, 34 aa, Artificial Sequence
  Description of Artificial Sequence: Synthetic polypeptide
DEEEIRTTNPVATEQYGMYTIMTNGGQGGGNGGQ

SEQ ID NO: 113533 - protein, 36 aa, Artificial Sequence
  Description of Artificial Sequence: Synthetic polypeptide
DEEEIRTTNPVATEQYGSVSSITPAGPNMRNGMNPV

SEQ ID NO: 113534 - protein, 36 aa, Artificial Sequence
  Description of Artificial Sequence: Synthetic polypeptide
DEEEIRTTNPVATEQYGSVSSITPAAPNMRNGMNPV

SEQ ID NO: 113535 - protein, 35 aa, Artificial Sequence
  Description of Artificial Sequence: Synthetic polypeptide
DEEEIRSTNPVATEQYGNVSTTPAIPQMRNGMNPV

SEQ ID NO: 113536 - protein, 34 aa, Artificial Sequence
  Description of Artificial Sequence: Synthetic polypeptide
DEEEIRTTNPVAWEQYGQCVCSNTELQHFNSEQS

SEQ ID NO: 113537 - protein, 35 aa, Artificial Sequence
  Description of Artificial Sequence: Synthetic polypeptide
DEEEIRTTNPVATEQYGSVSVTMGLSERELVFPEM

SEQ ID NO: 113538 - protein, 36 aa, Artificial Sequence
  Description of Artificial Sequence: Synthetic polypeptide
DEEEIRTTNPVATEQYGSVSSLNPAGPNMRNGMNPV

SEQ ID NO: 113539 - protein, 34 aa, Artificial Sequence
  Description of Artificial Sequence: Synthetic polypeptide
DEEEIRSTNPVATEQYGSVSSTDGFGQGNGEETG

SEQ ID NO: 113540 - protein, 36 aa, Artificial Sequence
  Description of Artificial Sequence: Synthetic polypeptide
DEEEIRTTNPVATEQYGSVSSMTPAGPNMRNGMNPV

SEQ ID NO: 113541 - protein, 36 aa, Artificial Sequence
  Description of Artificial Sequence: Synthetic polypeptide
DEEEIRTTNPVATEQYGSVSSMTPAGPNMRIGMNPV

SEQ ID NO: 113542 - protein, 36 aa, Artificial Sequence
  Description of Artificial Sequence: Synthetic polypeptide
DEEEIRTTNPVATEQYGSVSSMTPAGPNMNNGMNPV

SEQ ID NO: 113543 - protein, 36 aa, Artificial Sequence
  Description of Artificial Sequence: Synthetic polypeptide
DEEEIRTTNPVATEQYGSVSSMGPAGQNPRNGMNPV

SEQ ID NO: 113544 - protein, 33 aa, Artificial Sequence
  Description of Artificial Sequence: Synthetic polypeptide
DEAEIRTTNPVATEQYGSVCSLDQTEQGQNEDS

SEQ ID NO: 113545 - protein, 36 aa, Artificial Sequence
  Description of Artificial Sequence: Synthetic polypeptide
DEEEIRTTNPVATEQYGSVSSLTPAGPNMRNGMNYV

SEQ ID NO: 113546 - protein, 34 aa, Artificial Sequence
  Description of Artificial Sequence: Synthetic polypeptide
DEEEIRSTNPVATEQYGSVMGTNDQGGGEDEQGG

SEQ ID NO: 113547 - protein, 35 aa, Artificial Sequence
  Description of Artificial Sequence: Synthetic polypeptide
DEEEIRSTNPVATEQYGSVSNGSNGQLGEGGQNDT

SEQ ID NO: 113548 - protein, 35 aa, Artificial Sequence
  Description of Artificial Sequence: Synthetic polypeptide
DEEEIRSTNPVATEQYGSVSNGDNGQDEGGQNVTL

SEQ ID NO: 113549 - protein, 36 aa, Artificial Sequence
  Description of Artificial Sequence: Synthetic polypeptide
DEEEIRTTNPVATEQYGSVSSLTPAGPNMRNGMNPV

SEQ ID NO: 113550 - protein, 36 aa, Artificial Sequence
  Description of Artificial Sequence: Synthetic polypeptide
DEEEIRSTNPVATEQYGSVSATTPTGPQMRNGMNPI

SEQ ID NO: 113551 - protein, 36 aa, Artificial Sequence
  Description of Artificial Sequence: Synthetic polypeptide
DEEEIRTTNPVATEQYGSVSSLTPAGPNMRNGMNPL

SEQ ID NO: 113552 - protein, 35 aa, Artificial Sequence
  Description of Artificial Sequence: Synthetic polypeptide
DEEEIRSTNPVATEQYGSVNSDDNQAEGQTGNEGE

SEQ ID NO: 113553 - protein, 34 aa, Artificial Sequence
  Description of Artificial Sequence: Synthetic polypeptide
DEEEIRSTNPVATEQYGSVNMGTDLQNEMGEGEN

SEQ ID NO: 113554 - protein, 34 aa, Artificial Sequence
  Description of Artificial Sequence: Synthetic polypeptide
DEEEIRSTNPVATEQYGSVNGNGQVGQDETGNND

SEQ ID NO: 113555 - protein, 35 aa, Artificial Sequence
  Description of Artificial Sequence: Synthetic polypeptide
DEEEIRSTNPVATEQYGSVSNGDNGQNDEGGQNST

SEQ ID NO: 113556 - protein, 35 aa, Artificial Sequence
  Description of Artificial Sequence: Synthetic polypeptide
DEEEIRSTNPVATEQYGSVSSTTPAGNMRNGMNPV

SEQ ID NO: 113557 - protein, 36 aa, Artificial Sequence
  Description of Artificial Sequence: Synthetic polypeptide
DEEEIRTTNPVATEQYGSVSSILPAGPNMRNGMNPV

SEQ ID NO: 113558 - protein, 36 aa, Artificial Sequence
  Description of Artificial Sequence: Synthetic polypeptide
DEEEIRTTNPVAWEQYGKIVPSCINELSTQNGQNRA

SEQ ID NO: 113559 - protein, 36 aa, Artificial Sequence
  Description of Artificial Sequence: Synthetic polypeptide
DEEEIRTTNPVATEQYGSVSSFTPAGPNMRNGHNPV

SEQ ID NO: 113560 - protein, 36 aa, Artificial Sequence
  Description of Artificial Sequence: Synthetic polypeptide
DEEEIRTTNPVATEQYGSVSSFTPAGPNMRIGMNPV

SEQ ID NO: 113561 - protein, 36 aa, Artificial Sequence
  Description of Artificial Sequence: Synthetic polypeptide
DEEEIRTTNPVATEQYGSVSSETPSGPNMRNGMNPV

SEQ ID NO: 113562 - protein, 36 aa, Artificial Sequence
  Description of Artificial Sequence: Synthetic polypeptide
DEEEIRTTNPVATEQYGSVSSETPAGPNMRNGMNPV

SEQ ID NO: 113563 - protein, 35 aa, Artificial Sequence
  Description of Artificial Sequence: Synthetic polypeptide
DEEEIRTTNPVATEQYGNVSSTVNMQDQGEGQGGT

SEQ ID NO: 113564 - protein, 30 aa, Artificial Sequence
  Description of Artificial Sequence: Synthetic polypeptide
DEEEIRSTNPVATEQWGDVSEILMNSAEDA

SEQ ID NO: 113565 - protein, 34 aa, Artificial Sequence
  Description of Artificial Sequence: Synthetic polypeptide
DEEEIRTTNPVATEQYGSVSSEPTQMWQTNEEIY

SEQ ID NO: 113566 - protein, 36 aa, Artificial Sequence
  Description of Artificial Sequence: Synthetic polypeptide
DEEEIRTTNPVATEQYGSVSSFTPAGPNMRNGMNPV

SEQ ID NO: 113567 - protein, 35 aa, Artificial Sequence
  Description of Artificial Sequence: Synthetic polypeptide
DEEEIRTTNPVATEQYGNVSTMTNGFEGGGENGIF

SEQ ID NO: 113568 - protein, 29 aa, Artificial Sequence
  Description of Artificial Sequence: Synthetic peptide
DEEEIRSTNPVATEQWGDVSDIEMNAEDQ

SEQ ID NO: 113569 - protein, 34 aa, Artificial Sequence
  Description of Artificial Sequence: Synthetic polypeptide
DEEEIRSTNPVATEPYGSVCIWVNDQDQRGSNSA

SEQ ID NO: 113570 - protein, 35 aa, Artificial Sequence
  Description of Artificial Sequence: Synthetic polypeptide
DEEEIRSTNPVATEHYGSVCIWVNDQGDQRGSNSR

SEQ ID NO: 113571 - protein, 32 aa, Artificial Sequence
  Description of Artificial Sequence: Synthetic polypeptide
DEEEIRSTNPVATEGYGSVSSTAGNMHGMDPV

SEQ ID NO: 113572 - protein, 36 aa, Artificial Sequence
  Description of Artificial Sequence: Synthetic polypeptide
DEEEIRTTNPVATEQYGSVSSDTPAGPNMRNGMNPV

SEQ ID NO: 113573 - protein, 36 aa, Artificial Sequence
  Description of Artificial Sequence: Synthetic polypeptide
DEEEIRTTNPVATEQYGSVSSDTPAGPIMRNGMNPV

SEQ ID NO: 113574 - protein, 36 aa, Artificial Sequence
  Description of Artificial Sequence: Synthetic polypeptide
DEEEIRTTNPVATEQYGSVSSDTMAGPNMRNGMNPV

SEQ ID NO: 113575 - protein, 34 aa, Artificial Sequence
  Description of Artificial Sequence: Synthetic polypeptide
DEEEIRTTNPVATEQYGSVSSEPAGPNMRAEMNV

SEQ ID NO: 113576 - protein, 36 aa, Artificial Sequence
  Description of Artificial Sequence: Synthetic polypeptide
DEEEIRTTNPVATEQYGSVSSHTPAGPNMRNGMNPV

SEQ ID NO: 113577 - protein, 36 aa, Artificial Sequence
  Description of Artificial Sequence: Synthetic polypeptide
DEEEIRTTNPVATEQYGSVSSFTQAGPNMRQGMNPV

SEQ ID NO: 113578 - protein, 36 aa, Artificial Sequence
  Description of Artificial Sequence: Synthetic polypeptide
DEEEIRTTNPVATEQYGSVSSGTPAGPNMRNGMNPV

SEQ ID NO: 113579 - protein, 37 aa, Artificial Sequence
  Description of Artificial Sequence: Synthetic polypeptide
DEEEIRTTNPVATEQYGNSVSSTTPAGLNMRNGMNPV

SEQ ID NO: 113580 - protein, 35 aa, Artificial Sequence
  Description of Artificial Sequence: Synthetic polypeptide
DEAEAEIATTNPVAYEQWGSVSTNLQGEEDREGDA

SEQ ID NO: 113581 - protein, 36 aa, Artificial Sequence
  Description of Artificial Sequence: Synthetic polypeptide
DEEEIRTTNPVATEQYGSVSSHTPAGPNMREGMNFV

SEQ ID NO: 113582 - protein, 36 aa, Artificial Sequence
  Description of Artificial Sequence: Synthetic polypeptide
DEEEIRTTNPVATEQYGSVSSHTPAGPNMGNGMNPV

SEQ ID NO: 113583 - protein, 33 aa, Artificial Sequence
  Description of Artificial Sequence: Synthetic polypeptide
DEAEIRTTNPVATEQYGSVCPWDTLERLESNSD

SEQ ID NO: 113584 - protein, 36 aa, Artificial Sequence
  Description of Artificial Sequence: Synthetic polypeptide
DEEEIRTTNPVATEQYGSVSSHTLAGPNMRNGMNPV

SEQ ID NO: 113585 - protein, 34 aa, Artificial Sequence
  Description of Artificial Sequence: Synthetic polypeptide
DEEEIRSTNPVATEQYGDVSTGNGGGDGEGNETS

SEQ ID NO: 113586 - protein, 36 aa, Artificial Sequence
  Description of Artificial Sequence: Synthetic polypeptide
DEEEIRTTNPVATEQYGNVSSTTPAGPNMRNGMNPR

SEQ ID NO: 113587 - protein, 36 aa, Artificial Sequence
  Description of Artificial Sequence: Synthetic polypeptide
DEEEIRTTNPVATEQYGSVSSGTPPGPNMRNGMNPV

SEQ ID NO: 113588 - protein, 36 aa, Artificial Sequence
  Description of Artificial Sequence: Synthetic polypeptide
DEEEIRTTNPVATEQYGSVSSGTPAMPNMRNGMNPV

SEQ ID NO: 113589 - protein, 36 aa, Artificial Sequence
  Description of Artificial Sequence: Synthetic polypeptide
DEEEIRTTNPVATEQYGSVSSGTPAGPNRRNGMNPV

SEQ ID NO: 113590 - protein, 35 aa, Artificial Sequence
  Description of Artificial Sequence: Synthetic polypeptide
DEEEIRTTNPVATEQYGNVMTTVNGQGQEGGENNE

SEQ ID NO: 113591 - protein, 32 aa, Artificial Sequence
  Description of Artificial Sequence: Synthetic polypeptide
DEAEEATTNPVAYEAWGTVSTNLQGDVGDNER

SEQ ID NO: 113592 - protein, 32 aa, Artificial Sequence
  Description of Artificial Sequence: Synthetic polypeptide
DEEEIRSTNPVATEQYGDVSDGQGGGNGNGDE

SEQ ID NO: 113593 - protein, 35 aa, Artificial Sequence
  Description of Artificial Sequence: Synthetic polypeptide
DEEEIRTTNPVATEQYGNVSATTPAGPQSRNGMQV

SEQ ID NO: 113594 - protein, 36 aa, Artificial Sequence
  Description of Artificial Sequence: Synthetic polypeptide
DEEEIRTTNPVATEQYGSVSSGTPAGPNMRNGMNVV

SEQ ID NO: 113595 - protein, 34 aa, Artificial Sequence
  Description of Artificial Sequence: Synthetic polypeptide
DEEEIRTTNPVATEQYGNVMTTDFNGQEGGQDEI

SEQ ID NO: 113596 - protein, 36 aa, Artificial Sequence
  Description of Artificial Sequence: Synthetic polypeptide
DEEEIRTTNPVATEQYGSVSSMTPQGVNMRNGMNPV

SEQ ID NO: 113597 - protein, 35 aa, Artificial Sequence
  Description of Artificial Sequence: Synthetic polypeptide
DEDEIRTTNPVATEQYGSVSSTTAGPNMRNGMNPV

SEQ ID NO: 113598 - protein, 36 aa, Artificial Sequence
  Description of Artificial Sequence: Synthetic polypeptide
DEEEIRSTNPVATEQYGSVSSTTPAIPQMRNGMNPV

SEQ ID NO: 113599 - protein, 36 aa, Artificial Sequence
  Description of Artificial Sequence: Synthetic polypeptide
DEEEIRTTNPVATEQYGMVSIDETDNGGQGQGGNGN

SEQ ID NO: 113600 - protein, 36 aa, Artificial Sequence
  Description of Artificial Sequence: Synthetic polypeptide
DEDEIRTTNPVATEQYGSVATTQTNLQIGTTNNANE

SEQ ID NO: 113601 - protein, 36 aa, Artificial Sequence
  Description of Artificial Sequence: Synthetic polypeptide
DEDEIRTTNPVATEQYGSVATVNANLQAGTTENGNE

SEQ ID NO: 113602 - protein, 33 aa, Artificial Sequence
  Description of Artificial Sequence: Synthetic polypeptide
DEEEIRTTNPVATEQYGMVSIFDNGIGGGQDEG

SEQ ID NO: 113603 - protein, 36 aa, Artificial Sequence
  Description of Artificial Sequence: Synthetic polypeptide
DEEEIRTTNPVATEQYGSVSSPTPAGPTSRQGMNPV

SEQ ID NO: 113604 - protein, 36 aa, Artificial Sequence
  Description of Artificial Sequence: Synthetic polypeptide
DEEEIRTTNPVATEQYGSVSSPTPAGPNQRQDMNPV

SEQ ID NO: 113605 - protein, 34 aa, Artificial Sequence
  Description of Artificial Sequence: Synthetic polypeptide
DEEEIRTTNPVATEQYGMVSIFGMGQGGNQNSQN

SEQ ID NO: 113606 - protein, 36 aa, Artificial Sequence
  Description of Artificial Sequence: Synthetic polypeptide
DEEEIRTTNPVATEQYGSVSSQTPAGPNMRNGKNPV

SEQ ID NO: 113607 - protein, 36 aa, Artificial Sequence
  Description of Artificial Sequence: Synthetic polypeptide
DEEEIRTTNPVATEQYGSVSSPTPAGPNNRQGMNVV

SEQ ID NO: 113608 - protein, 36 aa, Artificial Sequence
  Description of Artificial Sequence: Synthetic polypeptide
DEEEIRTTNPVATEQYGSVSSPTPAGPNMRNGMNPV

SEQ ID NO: 113609 - protein, 36 aa, Artificial Sequence
  Description of Artificial Sequence: Synthetic polypeptide
DEEEIRTTNPVATEQYGSVSSPTPAGPNMRNGMNHV

SEQ ID NO: 113610 - protein, 36 aa, Artificial Sequence
  Description of Artificial Sequence: Synthetic polypeptide
DEEEIRTTNPVATEQYGSVSSPTPAGPNMENGMNPV

SEQ ID NO: 113611 - protein, 34 aa, Artificial Sequence
  Description of Artificial Sequence: Synthetic polypeptide
DEEEIRTTNPVATEQYGMVSIFTGVGQGDNNDQN

SEQ ID NO: 113612 - protein, 35 aa, Artificial Sequence
  Description of Artificial Sequence: Synthetic polypeptide
DEEEIRTTNPVATEQYGMVSIFTGVGQGTGNEGGE

SEQ ID NO: 113613 - protein, 34 aa, Artificial Sequence
  Description of Artificial Sequence: Synthetic polypeptide
DEEEIRTTNPVATEQYGMVSIFTGVGQNTNEGGN

SEQ ID NO: 113614 - protein, 34 aa, Artificial Sequence
  Description of Artificial Sequence: Synthetic polypeptide
DEEEIRTTNPVATEQYGMVSIFTGVGQTGDEGGN

SEQ ID NO: 113615 - protein, 33 aa, Artificial Sequence
  Description of Artificial Sequence: Synthetic polypeptide
DEEEIRTTNPVATEQYGMVSIFTGIGQTNVEQN

SEQ ID NO: 113616 - protein, 34 aa, Artificial Sequence
  Description of Artificial Sequence: Synthetic polypeptide
DEEEIRTTNPVATEQYGMVSIFTGVGQTNDNGQN

SEQ ID NO: 113617 - protein, 34 aa, Artificial Sequence
  Description of Artificial Sequence: Synthetic polypeptide
DEEEIRTTNPVATEQYGMVSAEGNGGNLNGENGD

SEQ ID NO: 113618 - protein, 36 aa, Artificial Sequence
  Description of Artificial Sequence: Synthetic polypeptide
DEEEIRTTNPVATEQYGSVSSQTPFGPNMRNGMNPV

SEQ ID NO: 113619 - protein, 33 aa, Artificial Sequence
  Description of Artificial Sequence: Synthetic polypeptide
DEEEIRTTNPVATEQYGMVNFENGQDEGGGEQG

SEQ ID NO: 113620 - protein, 36 aa, Artificial Sequence
  Description of Artificial Sequence: Synthetic polypeptide
DEEEIRTTNPVATEQYGSVSSTAPDGPNERKGMNYV

SEQ ID NO: 113621 - protein, 36 aa, Artificial Sequence
  Description of Artificial Sequence: Synthetic polypeptide
DEEEIRTTNPVATEQYGSVSSTAPAGPNMRNGMNPV

SEQ ID NO: 113622 - protein, 36 aa, Artificial Sequence
  Description of Artificial Sequence: Synthetic polypeptide
DEEEIRTTNPVATEQYGSVSSTAPAGPNMRFGMNPV

SEQ ID NO: 113623 - protein, 36 aa, Artificial Sequence
  Description of Artificial Sequence: Synthetic polypeptide
DEEEIRTTNPVATEQYGSVSSTAPAGPNMPNGMNPV

SEQ ID NO: 113624 - protein, 33 aa, Artificial Sequence
  Description of Artificial Sequence: Synthetic polypeptide
DEEEIRTTNPVATEQYGMVNGSMDDEFGPGGNE

SEQ ID NO: 113625 - protein, 35 aa, Artificial Sequence
  Description of Artificial Sequence: Synthetic polypeptide
DEEEIRTTNPVATEQYGSVSSTANTQVIPQTQEDQ

SEQ ID NO: 113626 - protein, 36 aa, Artificial Sequence
  Description of Artificial Sequence: Synthetic polypeptide
DEEEIRTTNPVATEQYGSVSSQTPAGPNMRNGMNPV

SEQ ID NO: 113627 - protein, 32 aa, Artificial Sequence
  Description of Artificial Sequence: Synthetic polypeptide
DEEEIRTTNPVATEQYGMVNGSMDGEFGPGDN

SEQ ID NO: 113628 - protein, 35 aa, Artificial Sequence
  Description of Artificial Sequence: Synthetic polypeptide
DEDEIRTTNPVATEQYGSVATTQQLQIGTTENGSE

SEQ ID NO: 113629 - protein, 36 aa, Artificial Sequence
  Description of Artificial Sequence: Synthetic polypeptide
DEEEIRTTNPVATEQYGSVSSSSNWTSPRVGEDENT

SEQ ID NO: 113630 - protein, 37 aa, Artificial Sequence
  Description of Artificial Sequence: Synthetic polypeptide
DEEEIRTTNPVATEQYGSVSSSSNNNILMRVGEQNET

SEQ ID NO: 113631 - protein, 35 aa, Artificial Sequence
  Description of Artificial Sequence: Synthetic polypeptide
DEEEIRTTNPVATEQYGSVSSSPNDMEQWTDNQIH

SEQ ID NO: 113632 - protein, 36 aa, Artificial Sequence
  Description of Artificial Sequence: Synthetic polypeptide
DEEEIRTTNPVATEQYGSVSSRTYAGPNMRNGMNPV

SEQ ID NO: 113633 - protein, 36 aa, Artificial Sequence
  Description of Artificial Sequence: Synthetic polypeptide
DEEEIRTTNPVATEQYGSVSSRTPAGPNMRNGMNPV

SEQ ID NO: 113634 - protein, 36 aa, Artificial Sequence
  Description of Artificial Sequence: Synthetic polypeptide
DEEEIRTTNPVATEQYGSVSSRNPAGPNMRNGMNPV

SEQ ID NO: 113635 - protein, 36 aa, Artificial Sequence
  Description of Artificial Sequence: Synthetic polypeptide
DEEEIRTTNPVATEQYGSVSSSTPAGPNMRNGMNPV

SEQ ID NO: 113636 - protein, 36 aa, Artificial Sequence
  Description of Artificial Sequence: Synthetic polypeptide
DEEEIRTTNPVATEQYGSVSSPTPACPTMRNGKNPV

SEQ ID NO: 113637 - protein, 33 aa, Artificial Sequence
  Description of Artificial Sequence: Synthetic polypeptide
DEEEIRTTNPVATEQYGMVSIFTGVGQTNEFQN

SEQ ID NO: 113638 - protein, 34 aa, Artificial Sequence
  Description of Artificial Sequence: Synthetic polypeptide
DEEEIRTTNPVATEQYGMVSIFTGVGQTNEGMQN

SEQ ID NO: 113639 - protein, 34 aa, Artificial Sequence
  Description of Artificial Sequence: Synthetic polypeptide
DEEEIRTTNPVATEQYGMVSIVVGLTGFGGNEDG

SEQ ID NO: 113640 - protein, 34 aa, Artificial Sequence
  Description of Artificial Sequence: Synthetic polypeptide
DEEEIRTTNPVATEQYGMVSNMNFTDDNGNNGQE

SEQ ID NO: 113641 - protein, 34 aa, Artificial Sequence
  Description of Artificial Sequence: Synthetic polypeptide
DEEEIRTTNPVATEQYGMVSNMNGEMQEGGGEGI

SEQ ID NO: 113642 - protein, 34 aa, Artificial Sequence
  Description of Artificial Sequence: Synthetic polypeptide
DEEEIRTTNPVATEQYGMVSNMNGGGQEEAEGGQ

SEQ ID NO: 113643 - protein, 35 aa, Artificial Sequence
  Description of Artificial Sequence: Synthetic polypeptide
DEDEIRTTNPVATEQYGSVCSAANNNLQRTTPDEE

SEQ ID NO: 113644 - protein, 35 aa, Artificial Sequence
  Description of Artificial Sequence: Synthetic polypeptide
DEDEIRTTNPVATEQYGSVCSTNPEQNEHDDNDAQ

SEQ ID NO: 113645 - protein, 36 aa, Artificial Sequence
  Description of Artificial Sequence: Synthetic polypeptide
DEDEIRTTNPVATEQYGSVFSTTNLLHQGGGEEDFD

SEQ ID NO: 113646 - protein, 35 aa, Artificial Sequence
  Description of Artificial Sequence: Synthetic polypeptide
DEDEIRTTNPVATEQYGSVCATNPMQQGNQTEGDP

SEQ ID NO: 113647 - protein, 34 aa, Artificial Sequence
  Description of Artificial Sequence: Synthetic polypeptide
DEEEIRSTNPVATEQYGVVSDTGLQDEMDGGFEQ

SEQ ID NO: 113648 - protein, 34 aa, Artificial Sequence
  Description of Artificial Sequence: Synthetic polypeptide
DEEEIRSTNPVATEQYGVVGSGTNDGQGEGGEQT

SEQ ID NO: 113649 - protein, 36 aa, Artificial Sequence
  Description of Artificial Sequence: Synthetic polypeptide
DEEEIRSTNPVATEQYGTVCSFTSQLSQQRDGNFMN

SEQ ID NO: 113650 - protein, 35 aa, Artificial Sequence
  Description of Artificial Sequence: Synthetic polypeptide
DEEEIRSTNPVATEQYGSVVTDNGQGEEFNGEGNE

SEQ ID NO: 113651 - protein, 34 aa, Artificial Sequence
  Description of Artificial Sequence: Synthetic polypeptide
DEEEIRTTNPVAYEAFGQSVVSCTYALSLRNGNS

SEQ ID NO: 113652 - protein, 36 aa, Artificial Sequence
  Description of Artificial Sequence: Synthetic polypeptide
DEEEIRTTNPVATEQYGSVSSNAPAGPNMRNGMNPV

SEQ ID NO: 113653 - protein, 33 aa, Artificial Sequence
  Description of Artificial Sequence: Synthetic polypeptide
DEEEIRTTNPVAYEAFGQSVVACTYALLRGGNT

SEQ ID NO: 113654 - protein, 36 aa, Artificial Sequence
  Description of Artificial Sequence: Synthetic polypeptide
DEEEIRSTNPVATEQYGSVSSTTPALPNMRNGMNPV

SEQ ID NO: 113655 - protein, 30 aa, Artificial Sequence
  Description of Artificial Sequence: Synthetic polypeptide
DEEEIRSTNPVATEQYGVVSDIEMNAAEDA

SEQ ID NO: 113656 - protein, 33 aa, Artificial Sequence
  Description of Artificial Sequence: Synthetic polypeptide
DEEEIRTTNPVATEQYGMVSIVAGMGQGTNGEI

SEQ ID NO: 113657 - protein, 35 aa, Artificial Sequence
  Description of Artificial Sequence: Synthetic polypeptide
DEEEIRTTNPVATEQYGMVSITINNMNLNGENEGD

SEQ ID NO: 113658 - protein, 35 aa, Artificial Sequence
  Description of Artificial Sequence: Synthetic polypeptide
DEEEIRTTNPVATEQYGMVSIMTVGQMTGNGNDQN

SEQ ID NO: 113659 - protein, 34 aa, Artificial Sequence
  Description of Artificial Sequence: Synthetic polypeptide
DEEEIRTTNPVATEQYGMVSIFTGVGQTNIEGEN

SEQ ID NO: 113660 - protein, 36 aa, Artificial Sequence
  Description of Artificial Sequence: Synthetic polypeptide
DEEEIRTTNPVATEQYGSVSSNWPAGPNLRQGVQPV

SEQ ID NO: 113661 - protein, 33 aa, Artificial Sequence
  Description of Artificial Sequence: Synthetic polypeptide
DEDEIRTTNPVATEQYGSVCAGEGGQHGDNSAM

SEQ ID NO: 113662 - protein, 35 aa, Artificial Sequence
  Description of Artificial Sequence: Synthetic polypeptide
DEDEIRTTNPVATEQYGSVCAPTNLQNGDPMDQDD

SEQ ID NO: 113663 - protein, 35 aa, Artificial Sequence
  Description of Artificial Sequence: Synthetic polypeptide
DEDEIRTTNPVATEQYGSVCATNNPMQQGNQTEGE

SEQ ID NO: 113664 - protein, 32 aa, Artificial Sequence
  Description of Artificial Sequence: Synthetic polypeptide
DEEEIRTTNPVAYEAYGKTPSTAEHSQVGGNH

SEQ ID NO: 113665 - protein, 33 aa, Artificial Sequence
  Description of Artificial Sequence: Synthetic polypeptide
DEEEIRTTNPVATEQYGMVSIMDNGIGGDGDEG

SEQ ID NO: 113666 - protein, 35 aa, Artificial Sequence
  Description of Artificial Sequence: Synthetic polypeptide
DEEEIRTTNPVAYEAYGIWVSDNNLSQQKAGGNNR

SEQ ID NO: 113667 - protein, 36 aa, Artificial Sequence
  Description of Artificial Sequence: Synthetic polypeptide
DEEEIRTTNPVATEQYGSVSSNTQAGENMENGVNPV

SEQ ID NO: 113668 - protein, 34 aa, Artificial Sequence
  Description of Artificial Sequence: Synthetic polypeptide
DEEEIRTTNPVATEQYGMVSIMGNGFEGGGQNGE

SEQ ID NO: 113669 - protein, 36 aa, Artificial Sequence
  Description of Artificial Sequence: Synthetic polypeptide
DEEEIRTTNPVATEQYGSVSSNTPAGPNMRWGMNPV

SEQ ID NO: 113670 - protein, 36 aa, Artificial Sequence
  Description of Artificial Sequence: Synthetic polypeptide
DEEEIRTTNPVATEQYGSVSSNTPAGPNMRQGMNPV

SEQ ID NO: 113671 - protein, 36 aa, Artificial Sequence
  Description of Artificial Sequence: Synthetic polypeptide
DEEEIRTTNPVATEQYGSVSSNTPAGPNMRNGMNPV

SEQ ID NO: 113672 - protein, 34 aa, Artificial Sequence
  Description of Artificial Sequence: Synthetic polypeptide
DEEEIRTTNPVATEQYGMVSIMTGVGQTENGQGN

SEQ ID NO: 113673 - protein, 35 aa, Artificial Sequence
  Description of Artificial Sequence: Synthetic polypeptide
DEEEIRTTNPVATEQYGMVSIMTNGFEGGGQEGFN

SEQ ID NO: 113674 - protein, 34 aa, Artificial Sequence
  Description of Artificial Sequence: Synthetic polypeptide
DEEEIRTTNPVATEQYGMVSIMTVGFTGNGNGQN

SEQ ID NO: 113675 - protein, 36 aa, Artificial Sequence
  Description of Artificial Sequence: Synthetic polypeptide
DEEEIRTTNPVATEQYGSVSSNTPAGPNMRLGMNPV

SEQ ID NO: 113676 - protein, 37 aa, Artificial Sequence
  Description of Artificial Sequence: Synthetic polypeptide
DEDEIRTTNPVATEQYGSVSTTNNLQAGNQQGNNTTD

SEQ ID NO: 113677 - protein, 35 aa, Artificial Sequence
  Description of Artificial Sequence: Synthetic polypeptide
DEEEIRTTNPVAVEQYGVVSTVVNNNNNNQTGNTD

SEQ ID NO: 113678 - protein, 33 aa, Artificial Sequence
  Description of Artificial Sequence: Synthetic polypeptide
DEAEIRTTNPVATEQYGSVCILDQLEEGQNEDH

SEQ ID NO: 113679 - protein, 36 aa, Artificial Sequence
  Description of Artificial Sequence: Synthetic polypeptide
DEEEIRTTNPVATEQYGSVSSCTPSGPNMRNGMNPV

SEQ ID NO: 113680 - protein, 37 aa, Artificial Sequence
  Description of Artificial Sequence: Synthetic polypeptide
DEEEIRTTNPVATEQYGSVSQPTPAGPNEQNGMNDPI

SEQ ID NO: 113681 - protein, 37 aa, Artificial Sequence
  Description of Artificial Sequence: Synthetic polypeptide
DEEEIRTTNPVATEQYGSVSQPTPADPNMQNGMNPVV

SEQ ID NO: 113682 - protein, 34 aa, Artificial Sequence
  Description of Artificial Sequence: Synthetic polypeptide
DEEEIRTTNPVATEQYGQCVCSNTEDQGFGSEQF

SEQ ID NO: 113683 - protein, 37 aa, Artificial Sequence
  Description of Artificial Sequence: Synthetic polypeptide
DEEEIRTTNPVATEQYGSVSQPTFAGLIEQNGMNDVV

SEQ ID NO: 113684 - protein, 34 aa, Artificial Sequence
  Description of Artificial Sequence: Synthetic polypeptide
DEEEIRTTNPVATEQYGSVSQPNQLTESEMTEPV

SEQ ID NO: 113685 - protein, 34 aa, Artificial Sequence
  Description of Artificial Sequence: Synthetic polypeptide
DEEEIRTTNPVATEQYGSVSQPNDLTEEEMTEPQ

SEQ ID NO: 113686 - protein, 34 aa, Artificial Sequence
  Description of Artificial Sequence: Synthetic polypeptide
DEEEIRTTNPVATEQYGQCVCSNTEHQNFGSDQE

SEQ ID NO: 113687 - protein, 34 aa, Artificial Sequence
  Description of Artificial Sequence: Synthetic polypeptide
DEEEIRPTNPVASEQYGSVSSTTPAGNMSNGMTR

SEQ ID NO: 113688 - protein, 35 aa, Artificial Sequence
  Description of Artificial Sequence: Synthetic polypeptide
DEEEIRTTNPVATEQYGQCVCSNTELNQNFGSDQS

SEQ ID NO: 113689 - protein, 36 aa, Artificial Sequence
  Description of Artificial Sequence: Synthetic polypeptide
DEEEIRTTNPVATEQYGQCVCSNTELQENSGSDNQP

SEQ ID NO: 113690 - protein, 34 aa, Artificial Sequence
  Description of Artificial Sequence: Synthetic polypeptide
DEEEIRTTNPVATEQYGQCVCSNTELQFFSSEQV

SEQ ID NO: 113691 - protein, 35 aa, Artificial Sequence
  Description of Artificial Sequence: Synthetic polypeptide
DEEEIRTTNPVATEQYGSVSQNNCNLVIDVGEVVI

SEQ ID NO: 113692 - protein, 34 aa, Artificial Sequence
  Description of Artificial Sequence: Synthetic polypeptide
DEEEIRTTNPVATEQYGQCVCSNTETQGFGSEQQ

SEQ ID NO: 113693 - protein, 35 aa, Artificial Sequence
  Description of Artificial Sequence: Synthetic polypeptide
DEEEIRTTNPVATEQYGQCVCSNTGALQNFGSDQS

SEQ ID NO: 113694 - protein, 34 aa, Artificial Sequence
  Description of Artificial Sequence: Synthetic polypeptide
DEEEIRTTNPVATEQYGSVSQLMVNLIDVEQLPE

SEQ ID NO: 113695 - protein, 35 aa, Artificial Sequence
  Description of Artificial Sequence: Synthetic polypeptide
DEEEIRTTNPVATEQYGSVSQGQNSGLGEGGGEGN

SEQ ID NO: 113696 - protein, 36 aa, Artificial Sequence
  Description of Artificial Sequence: Synthetic polypeptide
DEEEIRTTNPVATEQYGQCVCSNTELQEHFGSNNQA

SEQ ID NO: 113697 - protein, 33 aa, Artificial Sequence
  Description of Artificial Sequence: Synthetic polypeptide
DEAEIRTTNPVATEQYGSVCETPDDLPIEGEEQ

SEQ ID NO: 113698 - protein, 37 aa, Artificial Sequence
  Description of Artificial Sequence: Synthetic polypeptide
DEEEIRTTNPVATEQYGSVSQPTPAGPNEQNGMNVSV

SEQ ID NO: 113699 - protein, 37 aa, Artificial Sequence
  Description of Artificial Sequence: Synthetic polypeptide
DEEEIRTTNPVATEQYGSVSQPTPAGPNMQNGMNDVD

SEQ ID NO: 113700 - protein, 36 aa, Artificial Sequence
  Description of Artificial Sequence: Synthetic polypeptide
DEEEIRTTNPVAVEQYGSVSTVNNNQQLGNNGNGTD

SEQ ID NO: 113701 - protein, 36 aa, Artificial Sequence
  Description of Artificial Sequence: Synthetic polypeptide
DEEEIRTTNPVATEQYGQCVCSMTEELQSFGSDNQV

SEQ ID NO: 113702 - protein, 37 aa, Artificial Sequence
  Description of Artificial Sequence: Synthetic polypeptide
DEEEIRTTNPVATEQYGSVSQTGNLVNQAQQNEIPDE

SEQ ID NO: 113703 - protein, 37 aa, Artificial Sequence
  Description of Artificial Sequence: Synthetic polypeptide
DEEEIRTTNPVATEQYGSVSQTGNLSQYPQQNEEPLI

SEQ ID NO: 113704 - protein, 37 aa, Artificial Sequence
  Description of Artificial Sequence: Synthetic polypeptide
DEEEIRTTNPVATEQYGSVSQTGNLSQQMQQNEEVLE

SEQ ID NO: 113705 - protein, 36 aa, Artificial Sequence
  Description of Artificial Sequence: Synthetic polypeptide
DEEEIRTTNPVATEQYGSVSQTGLLSQYQVNEEPLE

SEQ ID NO: 113706 - protein, 36 aa, Artificial Sequence
  Description of Artificial Sequence: Synthetic polypeptide
DEEEIRTTNPVATEQYGSVSQTGLLSQQMQNEEPLS

SEQ ID NO: 113707 - protein, 37 aa, Artificial Sequence
  Description of Artificial Sequence: Synthetic polypeptide
DEEEIRTTNPVATEQYGSVSQPTPAGPNIQNGSNDVV

SEQ ID NO: 113708 - protein, 35 aa, Artificial Sequence
  Description of Artificial Sequence: Synthetic polypeptide
DEEEIRTTNPVATEQYGSVSQTFNGLEVIEPEVQF

SEQ ID NO: 113709 - protein, 35 aa, Artificial Sequence
  Description of Artificial Sequence: Synthetic polypeptide
DEEEIRTTNPVATEQYGSVSQSYHNLTPRIVEESD

SEQ ID NO: 113710 - protein, 36 aa, Artificial Sequence
  Description of Artificial Sequence: Synthetic polypeptide
DEEEIRTTNPVAVEQYGSVSTVNNNQQLGNNENNED

SEQ ID NO: 113711 - protein, 33 aa, Artificial Sequence
  Description of Artificial Sequence: Synthetic polypeptide
DEAEIRTTNPVATEQYGSVCFPLQSEEGQDEDH

SEQ ID NO: 113712 - protein, 35 aa, Artificial Sequence
  Description of Artificial Sequence: Synthetic polypeptide
DEEEIRTTNPVATEQYGSVSQSNMMWQESGEEEVE

SEQ ID NO: 113713 - protein, 37 aa, Artificial Sequence
  Description of Artificial Sequence: Synthetic polypeptide
DEEEIRTTNPVATEQYGSVSQPTVAGWNEQNGMNDVV

SEQ ID NO: 113714 - protein, 37 aa, Artificial Sequence
  Description of Artificial Sequence: Synthetic polypeptide
DEEEIRTTNPVATEQYGSVSQPTPAGSNMQNGPNPVV

SEQ ID NO: 113715 - protein, 36 aa, Artificial Sequence
  Description of Artificial Sequence: Synthetic polypeptide
DEEEIRTTNPVATEQYGSVSQPTPAGPNMQNLMNPV

SEQ ID NO: 113716 - protein, 33 aa, Artificial Sequence
  Description of Artificial Sequence: Synthetic polypeptide
DEEEIRPTNPVASEQYGSVSSTTPAGNSNGMTR

SEQ ID NO: 113717 - protein, 35 aa, Artificial Sequence
  Description of Artificial Sequence: Synthetic polypeptide
DEDEIRTTNPVATEQYGVVSTTSTGNLQAGTTESG

SEQ ID NO: 113718 - protein, 35 aa, Artificial Sequence
  Description of Artificial Sequence: Synthetic polypeptide
DEEEIRTTNPVATEQYGQCVCSNTGELQHFGSEQG

SEQ ID NO: 113719 - protein, 35 aa, Artificial Sequence
  Description of Artificial Sequence: Synthetic polypeptide
DEEEIRTTNPVATEQYGSVSQANNNLPQGQLEVDQ

SEQ ID NO: 113720 - protein, 35 aa, Artificial Sequence
  Description of Artificial Sequence: Synthetic polypeptide
DEAEIRTTNPVATEQYGSVAITDNQDDQRQGGGMN

SEQ ID NO: 113721 - protein, 35 aa, Artificial Sequence
  Description of Artificial Sequence: Synthetic polypeptide
DEEEIRTTNPVATEQYGSVSPWDNQPAAFEGQTRE

SEQ ID NO: 113722 - protein, 34 aa, Artificial Sequence
  Description of Artificial Sequence: Synthetic polypeptide
DEEEIRTTNPVATEQYGSVSPWATLQQSEEDEEI

SEQ ID NO: 113723 - protein, 36 aa, Artificial Sequence
  Description of Artificial Sequence: Synthetic polypeptide
DEEEIRTTNPVATEQYGSVSPVWNNVQPQQGEENNV

SEQ ID NO: 113724 - protein, 36 aa, Artificial Sequence
  Description of Artificial Sequence: Synthetic polypeptide
DEEEIRTTNPVATEQYGSVSPVVSELSQPEMGNILL

SEQ ID NO: 113725 - protein, 36 aa, Artificial Sequence
  Description of Artificial Sequence: Synthetic polypeptide
DEEEIRTTNPVATEQYGSVSPVVNPLLLRESVAGLA

SEQ ID NO: 113726 - protein, 35 aa, Artificial Sequence
  Description of Artificial Sequence: Synthetic polypeptide
DEEEIRTTNPVATEQYGSVSPVTTGQQPPQVGECI

SEQ ID NO: 113727 - protein, 32 aa, Artificial Sequence
  Description of Artificial Sequence: Synthetic polypeptide
DEAEIRTTNPVATEQYGSVANPNDPAEANPEV

SEQ ID NO: 113728 - protein, 34 aa, Artificial Sequence
  Description of Artificial Sequence: Synthetic polypeptide
DEEEIRTTNPVATEQYGSVSPVSQDVLTAGQSLT

SEQ ID NO: 113729 - protein, 36 aa, Artificial Sequence
  Description of Artificial Sequence: Synthetic polypeptide
DEEEIRTTNPVAVEQYGSVSTTVTNNQQLGNNNEDE

SEQ ID NO: 113730 - protein, 33 aa, Artificial Sequence
  Description of Artificial Sequence: Synthetic polypeptide
DEEEIRTTNPVATEQYGSVSPVNTTDTIEDIQD

SEQ ID NO: 113731 - protein, 31 aa, Artificial Sequence
  Description of Artificial Sequence: Synthetic polypeptide
DEAEIACTNPVATEQWGSVATNLTENPGDSF

SEQ ID NO: 113732 - protein, 36 aa, Artificial Sequence
  Description of Artificial Sequence: Synthetic polypeptide
DEEEIRTTNPVATEQYGSVSPVMQNDVLTAGNQSFT

SEQ ID NO: 113733 - protein, 34 aa, Artificial Sequence
  Description of Artificial Sequence: Synthetic polypeptide
DEEEIRTTNPVATEQYGSVSPVMQDVLTPGQSMG

SEQ ID NO: 113734 - protein, 34 aa, Artificial Sequence
  Description of Artificial Sequence: Synthetic polypeptide
DEEEIRTTNPVATEQYGSVSPVMQDVLTAGQVTT

SEQ ID NO: 113735 - protein, 35 aa, Artificial Sequence
  Description of Artificial Sequence: Synthetic polypeptide
DEEEIRTTNPVATEQYGSVSPVMQDVLTAGNMLKT

SEQ ID NO: 113736 - protein, 35 aa, Artificial Sequence
  Description of Artificial Sequence: Synthetic polypeptide
DEEEIRTTNPVATEQYGSVSPVPNLMANDGVSQEI

SEQ ID NO: 113737 - protein, 36 aa, Artificial Sequence
  Description of Artificial Sequence: Synthetic polypeptide
DEEEIRTTNPVATEQYGSVSVTNLGLSQVPFFVHEA

SEQ ID NO: 113738 - protein, 35 aa, Artificial Sequence
  Description of Artificial Sequence: Synthetic polypeptide
DEEEIRTTNPVATEQYGSVSPWINNEQGVVENQNH

SEQ ID NO: 113739 - protein, 36 aa, Artificial Sequence
  Description of Artificial Sequence: Synthetic polypeptide
DEEEIRTTNPVATEQYGSVSPWVNLGVIDNQVANLN

SEQ ID NO: 113740 - protein, 36 aa, Artificial Sequence
  Description of Artificial Sequence: Synthetic polypeptide
DEEEIRTTNPVATEQYGQCVCSNTGNLQESFGSEQE

SEQ ID NO: 113741 - protein, 36 aa, Artificial Sequence
  Description of Artificial Sequence: Synthetic polypeptide
DEEEIRTTNPVATEQYGQCVCSNTGNNQNFGSENQS

SEQ ID NO: 113742 - protein, 33 aa, Artificial Sequence
  Description of Artificial Sequence: Synthetic polypeptide
DEEEIRTTNPVATEQYGSVSPYVTAVMFSIEGD

SEQ ID NO: 113743 - protein, 34 aa, Artificial Sequence
  Description of Artificial Sequence: Synthetic polypeptide
DEEEIRTTNPVATEQYGSVSPYSNMPDETQNEED

SEQ ID NO: 113744 - protein, 36 aa, Artificial Sequence
  Description of Artificial Sequence: Synthetic polypeptide
DEEEIRTTNPVAVEQYGSVSTVNNNNQQGNNQDEDD

SEQ ID NO: 113745 - protein, 36 aa, Artificial Sequence
  Description of Artificial Sequence: Synthetic polypeptide
DEEEIRTTNPVAVEQYGSVSTVNNNNNQQQNGNTDE

SEQ ID NO: 113746 - protein, 36 aa, Artificial Sequence
  Description of Artificial Sequence: Synthetic polypeptide
DEEEIRTTNPVAVEQYGSVSTVNNNNNQQGTNQDED

SEQ ID NO: 113747 - protein, 34 aa, Artificial Sequence
  Description of Artificial Sequence: Synthetic polypeptide
DEEEIRTTNPVATEQYGSVSPYSNAPDTQMLEED

SEQ ID NO: 113748 - protein, 36 aa, Artificial Sequence
  Description of Artificial Sequence: Synthetic polypeptide
DEEEIRTTNPVAVEQYGSVSTVNNNNNQQAGNTTDG

SEQ ID NO: 113749 - protein, 34 aa, Artificial Sequence
  Description of Artificial Sequence: Synthetic polypeptide
DEEEIRTTNPVATEQYGSVSPYSNAPDDQNEDED

SEQ ID NO: 113750 - protein, 35 aa, Artificial Sequence
  Description of Artificial Sequence: Synthetic polypeptide
DEEEIRTTNPVATEQYGQCVCSNTNHQENFGSDQS

SEQ ID NO: 113751 - protein, 34 aa, Artificial Sequence
  Description of Artificial Sequence: Synthetic polypeptide
DEEEIRTTNPVATEQYGQCVCSNTYDQNFNSDQA

SEQ ID NO: 113752 - protein, 34 aa, Artificial Sequence
  Description of Artificial Sequence: Synthetic polypeptide
DEEEIRPTNPVASEQYGSVSSTTAGNMRNGMNPV

SEQ ID NO: 113753 - protein, 35 aa, Artificial Sequence
  Description of Artificial Sequence: Synthetic polypeptide
DEEEIRTTNPVATEQYGSVSPYQNEATEGNMVDGN

SEQ ID NO: 113754 - protein, 36 aa, Artificial Sequence
  Description of Artificial Sequence: Synthetic polypeptide
DEEEIRTTNPVATEQYGSVSPWWVLLETREEDNQRM

SEQ ID NO: 113755 - protein, 36 aa, Artificial Sequence
  Description of Artificial Sequence: Synthetic polypeptide
DEEEIRTTNPVAVEQYGSVSTVNNNNLLQEDEIGTN

SEQ ID NO: 113756 - protein, 36 aa, Artificial Sequence
  Description of Artificial Sequence: Synthetic polypeptide
DEEEIRTTNPVAVEQYGSVSTVNNNNEQQGNNQDEE

SEQ ID NO: 113757 - protein, 35 aa, Artificial Sequence
  Description of Artificial Sequence: Synthetic polypeptide
DEEEIRTTNPVAVEQYGSVSTVNNNTDEQGNNNVD

SEQ ID NO: 113758 - protein, 35 aa, Artificial Sequence
  Description of Artificial Sequence: Synthetic polypeptide
DEEEIRTTNPVATEQYGSVSPTEVSLNMRSQDADN

SEQ ID NO: 113759 - protein, 35 aa, Artificial Sequence
  Description of Artificial Sequence: Synthetic polypeptide
DEEEIRTTNPVAVEQYGSVSTVNNQNLQQNEEETD

SEQ ID NO: 113760 - protein, 36 aa, Artificial Sequence
  Description of Artificial Sequence: Synthetic polypeptide
DEEEIRTTNPVAVEQYGSVSTVNTNNLQQNEIGTTV

SEQ ID NO: 113761 - protein, 36 aa, Artificial Sequence
  Description of Artificial Sequence: Synthetic polypeptide
DEEEIRTTNPVATEQYGSVSSATPAPPNMFNGMNPV

SEQ ID NO: 113762 - protein, 36 aa, Artificial Sequence
  Description of Artificial Sequence: Synthetic polypeptide
DEEEIRTTNPVATEQYGSVSSATPAPPNMFEGMNPV

SEQ ID NO: 113763 - protein, 36 aa, Artificial Sequence
  Description of Artificial Sequence: Synthetic polypeptide
DEEEIRTTNPVATEQYGSVSSATPAGVEMRNGMNPV

SEQ ID NO: 113764 - protein, 35 aa, Artificial Sequence
  Description of Artificial Sequence: Synthetic polypeptide
DEEEIRTTNPVATEQYGQCSCSTGNPHQYFNSDQS

SEQ ID NO: 113765 - protein, 36 aa, Artificial Sequence
  Description of Artificial Sequence: Synthetic polypeptide
DEEEIRTTNPVATEQYGSVSSATPAGPNMRNGMNPV

SEQ ID NO: 113766 - protein, 35 aa, Artificial Sequence
  Description of Artificial Sequence: Synthetic polypeptide
DEEEIRTTNPVATEQYGSVSSATPAGPNMRNGEPV

SEQ ID NO: 113767 - protein, 36 aa, Artificial Sequence
  Description of Artificial Sequence: Synthetic polypeptide
DEEEIRTTNPVATEQYGSVSSATPAGPNMREGMNPV

SEQ ID NO: 113768 - protein, 36 aa, Artificial Sequence
  Description of Artificial Sequence: Synthetic polypeptide
DEEEIRTTNPVATEQYGSVSSATPAPPNMRNGMNPV

SEQ ID NO: 113769 - protein, 36 aa, Artificial Sequence
  Description of Artificial Sequence: Synthetic polypeptide
DEEEIRTTNPVATEQYGSVSSATPAGPNMREGMNDV

SEQ ID NO: 113770 - protein, 36 aa, Artificial Sequence
  Description of Artificial Sequence: Synthetic polypeptide
DEEEIRTTNPVATEQYGSVSSATPAGPNKRNGMNPV

SEQ ID NO: 113771 - protein, 35 aa, Artificial Sequence
  Description of Artificial Sequence: Synthetic polypeptide
DEEEIRTTNPVATEQYGSVSSATPAGPNFNGMNPV

SEQ ID NO: 113772 - protein, 36 aa, Artificial Sequence
  Description of Artificial Sequence: Synthetic polypeptide
DEEEIRTTNPVAVEQYGSVSTVVNNQQAGNNANEDN

SEQ ID NO: 113773 - protein, 36 aa, Artificial Sequence
  Description of Artificial Sequence: Synthetic polypeptide
DEEEIRTTNPVAVEQYGSVSTVVNNNNQQQGGNTTE

SEQ ID NO: 113774 - protein, 36 aa, Artificial Sequence
  Description of Artificial Sequence: Synthetic polypeptide
DEEEIRTTNPVAVEQYGSVSTVVNNNNQNDEQGNTE

SEQ ID NO: 113775 - protein, 36 aa, Artificial Sequence
  Description of Artificial Sequence: Synthetic polypeptide
DEEEIRTTNPVAVEQYGSVSTVVNNNNNQQGNTTTE

SEQ ID NO: 113776 - protein, 36 aa, Artificial Sequence
  Description of Artificial Sequence: Synthetic polypeptide
DEEEIRTTNPVAVEQYGSVSTVVNNNNNQNGNTEDE

SEQ ID NO: 113777 - protein, 36 aa, Artificial Sequence
  Description of Artificial Sequence: Synthetic polypeptide
DEEEIRTTNPVATEQYGSVSSATPAGPNMFNGMNPV

SEQ ID NO: 113778 - protein, 35 aa, Artificial Sequence
  Description of Artificial Sequence: Synthetic polypeptide
DEEEIRTTNPVATEQYGSVSSATPAGPNFEGMNPV

SEQ ID NO: 113779 - protein, 35 aa, Artificial Sequence
  Description of Artificial Sequence: Synthetic polypeptide
DEEEIRTTNPVATEQYGSVSSATPDGEMREGMEDV

SEQ ID NO: 113780 - protein, 36 aa, Artificial Sequence
  Description of Artificial Sequence: Synthetic polypeptide
DEEEIRTTNPVATEQYGSVSSATPDGPNMREGMNDV

SEQ ID NO: 113781 - protein, 36 aa, Artificial Sequence
  Description of Artificial Sequence: Synthetic polypeptide
DEEEIRTTNPVATEQYGSVSSCTPSGPNMENGMNDK

SEQ ID NO: 113782 - protein, 33 aa, Artificial Sequence
  Description of Artificial Sequence: Synthetic polypeptide
DEAEIRTTNPVATEQYGSVCFTNDDETRNQEFI

SEQ ID NO: 113783 - protein, 36 aa, Artificial Sequence
  Description of Artificial Sequence: Synthetic polypeptide
DEEEIRTTNPVATEQYGSVSSCTPAGSNIRNGMNPV

SEQ ID NO: 113784 - protein, 34 aa, Artificial Sequence
  Description of Artificial Sequence: Synthetic polypeptide
DEEEIRTTNPVATEQYGNVVDDNNNGQNGGNQGE

SEQ ID NO: 113785 - protein, 35 aa, Artificial Sequence
  Description of Artificial Sequence: Synthetic polypeptide
DEEEIRTTNPVATEQYGNVVDTMNFGQGGETQNDG

SEQ ID NO: 113786 - protein, 31 aa, Artificial Sequence
  Description of Artificial Sequence: Synthetic polypeptide
DEAEIACTNPVATAQWGCVATNLERGGDNPM

SEQ ID NO: 113787 - protein, 34 aa, Artificial Sequence
  Description of Artificial Sequence: Synthetic polypeptide
DEEEIRTTNPVATEQYGNVVDTMNGGQGGQEEDG

SEQ ID NO: 113788 - protein, 35 aa, Artificial Sequence
  Description of Artificial Sequence: Synthetic polypeptide
DEEEIRTTNPVATEQYGQCAVCSTGEPQNFGSNQA

SEQ ID NO: 113789 - protein, 36 aa, Artificial Sequence
  Description of Artificial Sequence: Synthetic polypeptide
DEEEIRTTNPVATEQYGSVSSCTPAGPNMRNGMNPV

SEQ ID NO: 113790 - protein, 35 aa, Artificial Sequence
  Description of Artificial Sequence: Synthetic polypeptide
DEEEIRPTNPVATEQYGSVSSTTPAGPNMRNGMTR

SEQ ID NO: 113791 - protein, 35 aa, Artificial Sequence
  Description of Artificial Sequence: Synthetic polypeptide
DEEEIRPTNPVATEQYGSVSSTTPAGPNMRNGMNV

SEQ ID NO: 113792 - protein, 36 aa, Artificial Sequence
  Description of Artificial Sequence: Synthetic polypeptide
DEEEIRTTNPVATEQYGSVSSCTPAGMNMRNGMNPV

SEQ ID NO: 113793 - protein, 35 aa, Artificial Sequence
  Description of Artificial Sequence: Synthetic polypeptide
DEEEIRTTNPVATEQYGSVSSCPAGPNMRNGENPV

SEQ ID NO: 113794 - protein, 36 aa, Artificial Sequence
  Description of Artificial Sequence: Synthetic polypeptide
DEEEIRTTNPVATEQYGSVSSATPHGPNMRMGMNPV

SEQ ID NO: 113795 - protein, 33 aa, Artificial Sequence
  Description of Artificial Sequence: Synthetic polypeptide
DEEEIRTTNPVATEQYGQAMMNNLDQTNEENVE

SEQ ID NO: 113796 - protein, 36 aa, Artificial Sequence
  Description of Artificial Sequence: Synthetic polypeptide
DEEEIRTTNPVATEQYGSVSSATPGGPNMFNGMNPV

SEQ ID NO: 113797 - protein, 36 aa, Artificial Sequence
  Description of Artificial Sequence: Synthetic polypeptide
DEEEIRTTNPVATEQYGSVSSCTPAGPNERTGGNPV

SEQ ID NO: 113798 - protein, 35 aa, Artificial Sequence
  Description of Artificial Sequence: Synthetic polypeptide
DEEEIRTTNPVATEQYGSVSSATDAGVEMFNGNPD

SEQ ID NO: 113799 - protein, 36 aa, Artificial Sequence
  Description of Artificial Sequence: Synthetic polypeptide
DEEEIRTTNPVATEQYGSVSSATDAGPNMFNGMNPV

SEQ ID NO: 113800 - protein, 36 aa, Artificial Sequence
  Description of Artificial Sequence: Synthetic polypeptide
DEEEIRTTNPVATEQYGSVSRTTYAGPNMRNGMNPV

SEQ ID NO: 113801 - protein, 35 aa, Artificial Sequence
  Description of Artificial Sequence: Synthetic polypeptide
DEEEIRTTNPVAVEQYGSVSTVTNNNLQQNAEEED

SEQ ID NO: 113802 - protein, 36 aa, Artificial Sequence
  Description of Artificial Sequence: Synthetic polypeptide
DEDEIRTTNPVATEQYGSVSTVTNQQQLQEGTEETE

SEQ ID NO: 113803 - protein, 34 aa, Artificial Sequence
  Description of Artificial Sequence: Synthetic polypeptide
DEEEIRTTNPVATEQYGQCVCSDTEHQYFNSNQS

SEQ ID NO: 113804 - protein, 35 aa, Artificial Sequence
  Description of Artificial Sequence: Synthetic polypeptide
DEDEIRTTNPVATEQYGSVSTVTNQTQNQEGTEEQ

SEQ ID NO: 113805 - protein, 35 aa, Artificial Sequence
  Description of Artificial Sequence: Synthetic polypeptide
DEDEIRTTNPVATEQYGSVSTVTNTQQQEGDEEQE

SEQ ID NO: 113806 - protein, 35 aa, Artificial Sequence
  Description of Artificial Sequence: Synthetic polypeptide
DEDEIRTTNPVATEQYGSVSTVTNTQQQQEGTEQE

SEQ ID NO: 113807 - protein, 35 aa, Artificial Sequence
  Description of Artificial Sequence: Synthetic polypeptide
DEEEIRTTNPVAVEQYGSVSTVTNNDEQGNNNVTD

SEQ ID NO: 113808 - protein, 36 aa, Artificial Sequence
  Description of Artificial Sequence: Synthetic polypeptide
DEDEIRTTNPVATEQYGSVSTVTNNQQLQQGTEETT

SEQ ID NO: 113809 - protein, 35 aa, Artificial Sequence
  Description of Artificial Sequence: Synthetic polypeptide
DEEEIRTTNPVAVEQYGSVSTVTNNDEQGNNNVNV

SEQ ID NO: 113810 - protein, 37 aa, Artificial Sequence
  Description of Artificial Sequence: Synthetic polypeptide
DEDEIRTTNPVATEQYGSVSTVVNNQQQLQQGTEENT

SEQ ID NO: 113811 - protein, 36 aa, Artificial Sequence
  Description of Artificial Sequence: Synthetic polypeptide
DEDEIRTTNPVATEQYGSVSTVVNTQQLQEGEETQT

SEQ ID NO: 113812 - protein, 34 aa, Artificial Sequence
  Description of Artificial Sequence: Synthetic polypeptide
DEEEIRTTNPVATEQYGQCVCSMTADQNFGSEQA

SEQ ID NO: 113813 - protein, 34 aa, Artificial Sequence
  Description of Artificial Sequence: Synthetic polypeptide
DEDEIRTTNPVATEQYGSVSVPLIDEILTGQEDR

SEQ ID NO: 113814 - protein, 35 aa, Artificial Sequence
  Description of Artificial Sequence: Synthetic polypeptide
DEDEIRTTNPVATEQYGSVSWNDNGLQDKGGGDSN

SEQ ID NO: 113815 - protein, 33 aa, Artificial Sequence
  Description of Artificial Sequence: Synthetic polypeptide
DEDEIRTTNPVATEQYGSVTGPNNGNHGEGNLL

SEQ ID NO: 113816 - protein, 35 aa, Artificial Sequence
  Description of Artificial Sequence: Synthetic polypeptide
DEDEIRTTNPVATEQYGSVWSTINWNTQEDEENQN

SEQ ID NO: 113817 - protein, 37 aa, Artificial Sequence
  Description of Artificial Sequence: Synthetic polypeptide
DEDEIRTTNPVATEQYGSVSTVVNNLQAGGNNDEEQD

SEQ ID NO: 113818 - protein, 37 aa, Artificial Sequence
  Description of Artificial Sequence: Synthetic polypeptide
DEDEIRTTNPVATEQYGSVSTVTNNLQAGENNNNEDN

SEQ ID NO: 113819 - protein, 36 aa, Artificial Sequence
  Description of Artificial Sequence: Synthetic polypeptide
DEDEIRTTNPVATEQYGSVSTVQNSNQAGNNNNEDE

SEQ ID NO: 113820 - protein, 36 aa, Artificial Sequence
  Description of Artificial Sequence: Synthetic polypeptide
DEDEIRTTNPVATEQYGSVSTVNNQQQLQEGTEEQT

SEQ ID NO: 113821 - protein, 36 aa, Artificial Sequence
  Description of Artificial Sequence: Synthetic polypeptide
DEEEIRTTNPVATEQYGSVSRTTPAGPNMRNGMNPV

SEQ ID NO: 113822 - protein, 36 aa, Artificial Sequence
  Description of Artificial Sequence: Synthetic polypeptide
DEEEIRTTNPVAVEQYGSVSTVVNNNNNNQTGNTNF

SEQ ID NO: 113823 - protein, 37 aa, Artificial Sequence
  Description of Artificial Sequence: Synthetic polypeptide
DEEEIRTTNPVAVEQYGSVSTVVNNNNLQAGTNQDED

SEQ ID NO: 113824 - protein, 36 aa, Artificial Sequence
  Description of Artificial Sequence: Synthetic polypeptide
DEEEIRTTNPVATEQYGSVSQVTPAGPNMRNGVNPV

SEQ ID NO: 113825 - protein, 37 aa, Artificial Sequence
  Description of Artificial Sequence: Synthetic polypeptide
DEEEIRTTNPVATEQYGSVSQVTFAGPNEQNGDNDVV

SEQ ID NO: 113826 - protein, 35 aa, Artificial Sequence
  Description of Artificial Sequence: Synthetic polypeptide
DEEEIRTTNPVATEQYGSVSQVMNMIAEDVGVNVF

SEQ ID NO: 113827 - protein, 35 aa, Artificial Sequence
  Description of Artificial Sequence: Synthetic polypeptide
DEEEIRTTNPVATEQYGSVSQTVQVDLNASNVLSI

SEQ ID NO: 113828 - protein, 34 aa, Artificial Sequence
  Description of Artificial Sequence: Synthetic polypeptide
DEEEIRTTNPVATEQYGSVSQTTTGATAAVIANG

SEQ ID NO: 113829 - protein, 35 aa, Artificial Sequence
  Description of Artificial Sequence: Synthetic polypeptide
DEEEIRTTNPVAVEQYGSVSTVVNNDEQGNNNVDD

SEQ ID NO: 113830 - protein, 36 aa, Artificial Sequence
  Description of Artificial Sequence: Synthetic polypeptide
DEEEIRTTNPVATEQYGSVSQTTPAGPNMRNGMNPV

SEQ ID NO: 113831 - protein, 36 aa, Artificial Sequence
  Description of Artificial Sequence: Synthetic polypeptide
DEEEIRTTNPVAVEQYGSVSTVTNNQQNGNNQNETD

SEQ ID NO: 113832 - protein, 36 aa, Artificial Sequence
  Description of Artificial Sequence: Synthetic polypeptide
DEEEIRTTNPVATEQYGSVSQTSPAGPNMRVGMNPV

SEQ ID NO: 113833 - protein, 35 aa, Artificial Sequence
  Description of Artificial Sequence: Synthetic polypeptide
DEDEIRTTNPVATEQYGSVSTTVTNTQQGQEGEQE

SEQ ID NO: 113834 - protein, 36 aa, Artificial Sequence
  Description of Artificial Sequence: Synthetic polypeptide
DEEEIRTTNPVAVEQYGSVSTVTNNQQNGNGNEEDE

SEQ ID NO: 113835 - protein, 36 aa, Artificial Sequence
  Description of Artificial Sequence: Synthetic polypeptide
DEEEIRTTNPVAVEQYGSVSTVTNNQQLGNNGNETE

SEQ ID NO: 113836 - protein, 36 aa, Artificial Sequence
  Description of Artificial Sequence: Synthetic polypeptide
DEEEIRTTNPVAVEQYGSVSTVTNNQQGGNENNEDE

SEQ ID NO: 113837 - protein, 35 aa, Artificial Sequence
  Description of Artificial Sequence: Synthetic polypeptide
DEEEIRTTNPVATEQYGSVSQTPEGYERSVFVDRF

SEQ ID NO: 113838 - protein, 35 aa, Artificial Sequence
  Description of Artificial Sequence: Synthetic polypeptide
DEEEIRTTNPVATEQYGQCVCSMTEEDQSFGSNQV

SEQ ID NO: 113839 - protein, 35 aa, Artificial Sequence
  Description of Artificial Sequence: Synthetic polypeptide
DEEEIRTTNPVATEQYGSVSWMMLEQPIENEQLIE

SEQ ID NO: 113840 - protein, 36 aa, Artificial Sequence
  Description of Artificial Sequence: Synthetic polypeptide
DEEEIRTTNPVATEQYGRVSSTAPALPNMREGMRPV

SEQ ID NO: 113841 - protein, 34 aa, Artificial Sequence
  Description of Artificial Sequence: Synthetic polypeptide
DEDEIRTTNPVAYEQWGSVCSTENGDDQQSGDAR

SEQ ID NO: 113842 - protein, 34 aa, Artificial Sequence
  Description of Artificial Sequence: Synthetic polypeptide
DEEAIRTTNPVATEQYGCVCSTEENLNFGSDTQS

SEQ ID NO: 113843 - protein, 34 aa, Artificial Sequence
  Description of Artificial Sequence: Synthetic polypeptide
DEEEIRTTNPVATEQYGSVSNNYVSVMELEVPGL

SEQ ID NO: 113844 - protein, 34 aa, Artificial Sequence
  Description of Artificial Sequence: Synthetic polypeptide
DEEEIRTTNPVATESYGSVDSDMQENEGEGNNQG

SEQ ID NO: 113845 - protein, 32 aa, Artificial Sequence
  Description of Artificial Sequence: Synthetic polypeptide
DEEAIRTTNPVATEQYGCVTTENDCTFGQSCI

SEQ ID NO: 113846 - protein, 36 aa, Artificial Sequence
  Description of Artificial Sequence: Synthetic polypeptide
DEEEIRTTNPVATEQYGSVSNNNNMDQGGGETNNDT

SEQ ID NO: 113847 - protein, 34 aa, Artificial Sequence
  Description of Artificial Sequence: Synthetic polypeptide
DEEEIRTTNPVATEQYGSCSPWNLLADDVMVNVM

SEQ ID NO: 113848 - protein, 33 aa, Artificial Sequence
  Description of Artificial Sequence: Synthetic polypeptide
DEEEIRATNPVTTEQYGSVATNNNNQQGTTTTA

SEQ ID NO: 113849 - protein, 32 aa, Artificial Sequence
  Description of Artificial Sequence: Synthetic polypeptide
DEEAIRTTNPVATEQYGCVCSSGEHQSFNSDQ

SEQ ID NO: 113850 - protein, 33 aa, Artificial Sequence
  Description of Artificial Sequence: Synthetic polypeptide
DEEEIRATNPVTTEQYGSVATNNATEQYGTVVD

SEQ ID NO: 113851 - protein, 33 aa, Artificial Sequence
  Description of Artificial Sequence: Synthetic polypeptide
DEEEIRTTNPVATESYGSTYMTENLSMTIENNG

SEQ ID NO: 113852 - protein, 35 aa, Artificial Sequence
  Description of Artificial Sequence: Synthetic polypeptide
DEEEIRTTNPVATEQYGSCSSTTPAGPNMRGMNPV

SEQ ID NO: 113853 - protein, 34 aa, Artificial Sequence
  Description of Artificial Sequence: Synthetic polypeptide
DEEAIRTTNPVATEQYGSVCNTVNSERSGQEDIT

SEQ ID NO: 113854 - protein, 35 aa, Artificial Sequence
  Description of Artificial Sequence: Synthetic polypeptide
DEEAIRTTNPVATEQYGSVCSPTNNLERNDDTQEN

SEQ ID NO: 113855 - protein, 34 aa, Artificial Sequence
  Description of Artificial Sequence: Synthetic polypeptide
DEEEIRTTNPVATEQYGSVTPVMNDVLTAGQLMT

SEQ ID NO: 113856 - protein, 34 aa, Artificial Sequence
  Description of Artificial Sequence: Synthetic polypeptide
DEEEIRTTNPVATEQYGSVTPWDGSEQTQGQDRQ

SEQ ID NO: 113857 - protein, 35 aa, Artificial Sequence
  Description of Artificial Sequence: Synthetic polypeptide
DEEEIRTTNPVATEQYGSVTPYNGSETTQSGQDRQ

SEQ ID NO: 113858 - protein, 34 aa, Artificial Sequence
  Description of Artificial Sequence: Synthetic polypeptide
DEEEIRATNPVTTEQYGSVATNNATEQYGSVNTD

SEQ ID NO: 113859 - protein, 35 aa, Artificial Sequence
  Description of Artificial Sequence: Synthetic polypeptide
DEEEIRTTNPVATEQYGSVTQEMLLQGEFEQGERE

SEQ ID NO: 113860 - protein, 33 aa, Artificial Sequence
  Description of Artificial Sequence: Synthetic polypeptide
DEEEIRATNPVTTEQYGSVATNNNNTEQGTTNQ

SEQ ID NO: 113861 - protein, 32 aa, Artificial Sequence
  Description of Artificial Sequence: Synthetic polypeptide
DEEEIRATNPVTTEQYGSVATNNNTEQGTTVT

SEQ ID NO: 113862 - protein, 34 aa, Artificial Sequence
  Description of Artificial Sequence: Synthetic polypeptide
DEEEIRTTNPVATESYGSVMGMTGGQGGGNNGQQ

SEQ ID NO: 113863 - protein, 34 aa, Artificial Sequence
  Description of Artificial Sequence: Synthetic polypeptide
DEEEIRTTNPVATEQYGSCSPEPTQQEVFQAGVD

SEQ ID NO: 113864 - protein, 36 aa, Artificial Sequence
  Description of Artificial Sequence: Synthetic polypeptide
DEEEIRTTNPVATEQYGSVTPTNGGDEDTQSGQDRQ

SEQ ID NO: 113865 - protein, 35 aa, Artificial Sequence
  Description of Artificial Sequence: Synthetic polypeptide
DEEEIRTTNPVATESYGSVMGGTNQQEQGNGGGQG

SEQ ID NO: 113866 - protein, 31 aa, Artificial Sequence
  Description of Artificial Sequence: Synthetic polypeptide
DEEEIRTTNPVATEQYGSCSPLYAETESLQD

SEQ ID NO: 113867 - protein, 34 aa, Artificial Sequence
  Description of Artificial Sequence: Synthetic polypeptide
DEEAIRTTNPVATEQWGQCVCGTNNLQHFGSNQL

SEQ ID NO: 113868 - protein, 34 aa, Artificial Sequence
  Description of Artificial Sequence: Synthetic polypeptide
DEEEIRATNPVTTEQYGSVATNVATEQYGTTNSD

SEQ ID NO: 113869 - protein, 33 aa, Artificial Sequence
  Description of Artificial Sequence: Synthetic polypeptide
DEEEIRATNPVTTEQYGSVATNNNTEIGTTNTQ

SEQ ID NO: 113870 - protein, 34 aa, Artificial Sequence
  Description of Artificial Sequence: Synthetic polypeptide
DEEAIRTTNPVATEQWGSVYHWTNDHQKTMGHER

SEQ ID NO: 113871 - protein, 35 aa, Artificial Sequence
  Description of Artificial Sequence: Synthetic polypeptide
DEEEIRTTNPVATEQYGSVTPTNMMIQESGEEEVN

SEQ ID NO: 113872 - protein, 37 aa, Artificial Sequence
  Description of Artificial Sequence: Synthetic polypeptide
DEEEIRTTNPVATEQYGSVSNSVGGNNLQSEFGNGGI

SEQ ID NO: 113873 - protein, 35 aa, Artificial Sequence
  Description of Artificial Sequence: Synthetic polypeptide
DEEEIRTTNPVATEQYGSCSPTMEPLFPTGENETL

SEQ ID NO: 113874 - protein, 35 aa, Artificial Sequence
  Description of Artificial Sequence: Synthetic polypeptide
DEEEIRTTNPVATEQYGSVTPTNNLAEEELGEELD

SEQ ID NO: 113875 - protein, 35 aa, Artificial Sequence
  Description of Artificial Sequence: Synthetic polypeptide
DEEEIRTTNPVATEQYGSVSNSNQLGTEVTHEQRF

SEQ ID NO: 113876 - protein, 35 aa, Artificial Sequence
  Description of Artificial Sequence: Synthetic polypeptide
DEEEIRTTNPVATEQYGSVTPTNTDETTQSMQDNQ

SEQ ID NO: 113877 - protein, 32 aa, Artificial Sequence
  Description of Artificial Sequence: Synthetic polypeptide
DEEAIRTTNPVATEQYGCVCSSEHQNFGSQQA

SEQ ID NO: 113878 - protein, 36 aa, Artificial Sequence
  Description of Artificial Sequence: Synthetic polypeptide
DEEEIRTTNPVATEQYGSVSNSYTSEEQRFNSSVVA

SEQ ID NO: 113879 - protein, 34 aa, Artificial Sequence
  Description of Artificial Sequence: Synthetic polypeptide
DEEEIRCTNPAATEFYGSVCTSTNLAREGGGDGE

SEQ ID NO: 113880 - protein, 35 aa, Artificial Sequence
  Description of Artificial Sequence: Synthetic polypeptide
DEEEIRTTNPVATEQYGSCSTDDLDTTSGGQNHEM

SEQ ID NO: 113881 - protein, 35 aa, Artificial Sequence
  Description of Artificial Sequence: Synthetic polypeptide
DEEAIRTTNPVATEQYGSVNSTEQDDTTRGNQEEG

SEQ ID NO: 113882 - protein, 36 aa, Artificial Sequence
  Description of Artificial Sequence: Synthetic polypeptide
DEEEIRATNPVATEQYGVVSTVNNQQLQLGNGNQQD

SEQ ID NO: 113883 - protein, 36 aa, Artificial Sequence
  Description of Artificial Sequence: Synthetic polypeptide
DEEEIRATNPVATEQYGVVSTTVNQQLQEGIGTNFN

SEQ ID NO: 113884 - protein, 36 aa, Artificial Sequence
  Description of Artificial Sequence: Synthetic polypeptide
DEEEIRATNPVATEQYGVVSTTVNQLLQEGIGTNET

SEQ ID NO: 113885 - protein, 36 aa, Artificial Sequence
  Description of Artificial Sequence: Synthetic polypeptide
DEEEIRATNPVATEQYGVVSTTTNQLLQQGNGTNDE

SEQ ID NO: 113886 - protein, 33 aa, Artificial Sequence
  Description of Artificial Sequence: Synthetic polypeptide
DEAEIATTNPVATEQYFGSVSATDLEDHEGEDL

SEQ ID NO: 113887 - protein, 35 aa, Artificial Sequence
  Description of Artificial Sequence: Synthetic polypeptide
DEEEIRTTNPVATESYGETVFCLNMLSQARGGSPR

SEQ ID NO: 113888 - protein, 36 aa, Artificial Sequence
  Description of Artificial Sequence: Synthetic polypeptide
DEEEIRATNPVATEQYGVVSTTNQQQLQQGNNQQGS

SEQ ID NO: 113889 - protein, 36 aa, Artificial Sequence
  Description of Artificial Sequence: Synthetic polypeptide
DEEEIRATNPVATEQYGVVSTVNQNQLQQGNNQQED

SEQ ID NO: 113890 - protein, 36 aa, Artificial Sequence
  Description of Artificial Sequence: Synthetic polypeptide
DEEEIRATNPVATEQYGVVSTTNQQQLQQGNNEEED

SEQ ID NO: 113891 - protein, 34 aa, Artificial Sequence
  Description of Artificial Sequence: Synthetic polypeptide
DEEEIRTTNPVATEQYGSVSNMFLDDNENVVVEF

SEQ ID NO: 113892 - protein, 36 aa, Artificial Sequence
  Description of Artificial Sequence: Synthetic polypeptide
DEEEIRATNPVATEQYGVVSTTNQLLQQGNIGNQDN

SEQ ID NO: 113893 - protein, 36 aa, Artificial Sequence
  Description of Artificial Sequence: Synthetic polypeptide
DEEEIRATNPVATEQYGVVSTTNNQQLQLGGNNQED

SEQ ID NO: 113894 - protein, 35 aa, Artificial Sequence
  Description of Artificial Sequence: Synthetic polypeptide
DEEEIRTTNPVATEQYGSVSNLGNLEEPQAQVEEE

SEQ ID NO: 113895 - protein, 35 aa, Artificial Sequence
  Description of Artificial Sequence: Synthetic polypeptide
DEEEIRTTNPVATEQYGSVSNHNLEEPAMANVEEE

SEQ ID NO: 113896 - protein, 34 aa, Artificial Sequence
  Description of Artificial Sequence: Synthetic polypeptide
DEEEIRTTNPVATEQYGSVSNGNLVEPAIAVEEE

SEQ ID NO: 113897 - protein, 34 aa, Artificial Sequence
  Description of Artificial Sequence: Synthetic polypeptide
DEEEIRTTNPVATEQYGSVSNGNLNEVAALVEEE

SEQ ID NO: 113898 - protein, 36 aa, Artificial Sequence
  Description of Artificial Sequence: Synthetic polypeptide
DEEEIRATNPVATEQYGVVSTTNQQQLQAGNGNQQQ

SEQ ID NO: 113899 - protein, 32 aa, Artificial Sequence
  Description of Artificial Sequence: Synthetic polypeptide
DEEEIRATNPVTTEQYGSVATNANVEQGTTTT

SEQ ID NO: 113900 - protein, 37 aa, Artificial Sequence
  Description of Artificial Sequence: Synthetic polypeptide
DEEEIRTTNPVATEQYGSVSNMSGGNNLQSEFGNNGS

SEQ ID NO: 113901 - protein, 36 aa, Artificial Sequence
  Description of Artificial Sequence: Synthetic polypeptide
DEEEIRATNPVATEQYGVVSTVVNQQLQAGNNTEDE

SEQ ID NO: 113902 - protein, 30 aa, Artificial Sequence
  Description of Artificial Sequence: Synthetic polypeptide
DEEEIRATNPVAYEQWGVVTGWNDHQGGDM

SEQ ID NO: 113903 - protein, 32 aa, Artificial Sequence
  Description of Artificial Sequence: Synthetic polypeptide
DEEEIRATNPVAYEQWGVVSGWNDHQQGGNSP

SEQ ID NO: 113904 - protein, 34 aa, Artificial Sequence
  Description of Artificial Sequence: Synthetic polypeptide
DEEEIRTTNPVATEQYGSCSTDYLTTTEETQNDD

SEQ ID NO: 113905 - protein, 34 aa, Artificial Sequence
  Description of Artificial Sequence: Synthetic polypeptide
DEEAIRTTNPVATEQYGSVSPTMNEHTGTEGLDE

SEQ ID NO: 113906 - protein, 35 aa, Artificial Sequence
  Description of Artificial Sequence: Synthetic polypeptide
DEEAIRTTNPVATEQYGSVSPTMNNEHTGNELFDE

SEQ ID NO: 113907 - protein, 31 aa, Artificial Sequence
  Description of Artificial Sequence: Synthetic polypeptide
DEEEIRATNPVAYEQWGMVTGDNDHQTGGNN

SEQ ID NO: 113908 - protein, 33 aa, Artificial Sequence
  Description of Artificial Sequence: Synthetic polypeptide
DEEAIRTTNPVATEQYGSVTPSYLETRQELQEN

SEQ ID NO: 113909 - protein, 34 aa, Artificial Sequence
  Description of Artificial Sequence: Synthetic polypeptide
DEEEIRTTNPVATEQYGSVSNNAYGASSTQIDRP

SEQ ID NO: 113910 - protein, 35 aa, Artificial Sequence
  Description of Artificial Sequence: Synthetic polypeptide
DEEEIRTTNPVATEQYGSVSNNGTIEGGGGENTTT

SEQ ID NO: 113911 - protein, 33 aa, Artificial Sequence
  Description of Artificial Sequence: Synthetic polypeptide
DEEAIRTTNPVATEQYRYCAVSMEVLQRGDGQG

SEQ ID NO: 113912 - protein, 32 aa, Artificial Sequence
  Description of Artificial Sequence: Synthetic polypeptide
DEEAIRTTNPVATEQYRYCFVNFEVLQRGDGQ

SEQ ID NO: 113913 - protein, 33 aa, Artificial Sequence
  Description of Artificial Sequence: Synthetic polypeptide
DEEAIRTTNPVATEQYRYCVKSMEVLQRGDGQS

SEQ ID NO: 113914 - protein, 33 aa, Artificial Sequence
  Description of Artificial Sequence: Synthetic polypeptide
DEEEIRATNPVATERWGCVPSCTNGSQEDLNNR

SEQ ID NO: 113915 - protein, 32 aa, Artificial Sequence
  Description of Artificial Sequence: Synthetic polypeptide
DEEAIRTTNPVATEQYRYCVKVEVLQRGDGQN

SEQ ID NO: 113916 - protein, 33 aa, Artificial Sequence
  Description of Artificial Sequence: Synthetic polypeptide
DEEAIRTTNPVATEQYRYCVSMEVNLQGGDGQG

SEQ ID NO: 113917 - protein, 36 aa, Artificial Sequence
  Description of Artificial Sequence: Synthetic polypeptide
DEEEIRATNPVATEQYGVVSTVVNQQLQAGNTEEND

SEQ ID NO: 113918 - protein, 33 aa, Artificial Sequence
  Description of Artificial Sequence: Synthetic polypeptide
DEEAIRTTNPVATEQYGSYSPTMNEHTGELQDE

SEQ ID NO: 113919 - protein, 33 aa, Artificial Sequence
  Description of Artificial Sequence: Synthetic polypeptide
DEEAIRTTNPVATEQWGCVCGTNNLQGFGSEQA

SEQ ID NO: 113920 - protein, 35 aa, Artificial Sequence
  Description of Artificial Sequence: Synthetic polypeptide
DEEEIRTTNPVATEQYGSVSNTDNDNNEEFGEGGI

SEQ ID NO: 113921 - protein, 35 aa, Artificial Sequence
  Description of Artificial Sequence: Synthetic polypeptide
DEEEIRTTNPVATEQYGSVTPTNGDETPQSGQDLQ

SEQ ID NO: 113922 - protein, 34 aa, Artificial Sequence
  Description of Artificial Sequence: Synthetic polypeptide
DEEAICTVNPVATEAYGSVSTDNQLQNNNQGNQD

SEQ ID NO: 113923 - protein, 35 aa, Artificial Sequence
  Description of Artificial Sequence: Synthetic polypeptide
DEEEIRTTNPVATEQYGSVSNTMNGTNEFGQGTGT

SEQ ID NO: 113924 - protein, 34 aa, Artificial Sequence
  Description of Artificial Sequence: Synthetic polypeptide
DEEEIRTTNPVATEQYGSVTMANPELQLNIPLDN

SEQ ID NO: 113925 - protein, 36 aa, Artificial Sequence
  Description of Artificial Sequence: Synthetic polypeptide
DEEEIRTTNPVATEQYGSVTMTDNGIGQEDDGENNG

SEQ ID NO: 113926 - protein, 36 aa, Artificial Sequence
  Description of Artificial Sequence: Synthetic polypeptide
DEEEIRTTNPVATEQYGSVTMTDNGIGQEDGENQGL

SEQ ID NO: 113927 - protein, 34 aa, Artificial Sequence
  Description of Artificial Sequence: Synthetic polypeptide
DEEEIRTTNPVATEQYGSVSNTMGFGNPPVNIEA

SEQ ID NO: 113928 - protein, 33 aa, Artificial Sequence
  Description of Artificial Sequence: Synthetic polypeptide
DEEEIRTTNPVATEQYGSCSAGNAPGQHPDAQA

SEQ ID NO: 113929 - protein, 34 aa, Artificial Sequence
  Description of Artificial Sequence: Synthetic polypeptide
DEEAICTVNPVATEAYGSVSTDNQLQNNNGNNTQ

SEQ ID NO: 113930 - protein, 34 aa, Artificial Sequence
  Description of Artificial Sequence: Synthetic polypeptide
DEEEIRTTNPVATEQYGSCSAGNMLGQHPDAQAG

SEQ ID NO: 113931 - protein, 35 aa, Artificial Sequence
  Description of Artificial Sequence: Synthetic polypeptide
DEEEIRCTNPIATEQYGSVSSTTPALPNMRNGNPV

SEQ ID NO: 113932 - protein, 35 aa, Artificial Sequence
  Description of Artificial Sequence: Synthetic polypeptide
DEEEIRTTNPVATESYGSVSSTTPAGNMRNGMNPV

SEQ ID NO: 113933 - protein, 35 aa, Artificial Sequence
  Description of Artificial Sequence: Synthetic polypeptide
DEEEIRTTNPVATEQYGSVSNTMDITNEFGVNEED

SEQ ID NO: 113934 - protein, 36 aa, Artificial Sequence
  Description of Artificial Sequence: Synthetic polypeptide
DEEEIRTTNPVATEQYGSVTMTNGIQQEDDGENEGQ

SEQ ID NO: 113935 - protein, 35 aa, Artificial Sequence
  Description of Artificial Sequence: Synthetic polypeptide
DEEEIRTTNPVATESYGSVSNTDNMNIIDGGNNDG

SEQ ID NO: 113936 - protein, 34 aa, Artificial Sequence
  Description of Artificial Sequence: Synthetic polypeptide
DEEEIRTTNPVATEQYGSCSDENFLDVRAFEEMK

SEQ ID NO: 113937 - protein, 35 aa, Artificial Sequence
  Description of Artificial Sequence: Synthetic polypeptide
DEEEIRTTNPVATEQYGSVTNTGNSGQTEGEDGEG

SEQ ID NO: 113938 - protein, 32 aa, Artificial Sequence
  Description of Artificial Sequence: Synthetic polypeptide
DEEEIRCTNPIATEQYGTVCSAEDGPEREGND

SEQ ID NO: 113939 - protein, 35 aa, Artificial Sequence
  Description of Artificial Sequence: Synthetic polypeptide
DEEEIRTTNPVATEQYGSVTNTNGDETTQSQQDNQ

SEQ ID NO: 113940 - protein, 36 aa, Artificial Sequence
  Description of Artificial Sequence: Synthetic polypeptide
DEEEIRTTNPVATEQYGSVSNTNDGAEGAYSGLDER

SEQ ID NO: 113941 - protein, 34 aa, Artificial Sequence
  Description of Artificial Sequence: Synthetic polypeptide
DEEAICTVNPVATEAYGSVSTDNLQNNNNGNNAQ

SEQ ID NO: 113942 - protein, 34 aa, Artificial Sequence
  Description of Artificial Sequence: Synthetic polypeptide
DEEEIRTTNPVATESYGSVYGDGNNLQGEFNNGQ

SEQ ID NO: 113943 - protein, 34 aa, Artificial Sequence
  Description of Artificial Sequence: Synthetic polypeptide
DEEAEIRTTNPVAYEEWGSVATNLNQGDAGQNQP

SEQ ID NO: 113944 - protein, 34 aa, Artificial Sequence
  Description of Artificial Sequence: Synthetic polypeptide
DEEAEIRTTNPVAYEGWGSVATGNLQGEDGNNTN

SEQ ID NO: 113945 - protein, 34 aa, Artificial Sequence
  Description of Artificial Sequence: Synthetic polypeptide
DEEEIRTTNPVATEQYGSVTHTGEDHNGEYGEEQ

SEQ ID NO: 113946 - protein, 34 aa, Artificial Sequence
  Description of Artificial Sequence: Synthetic polypeptide
DEEAEIRTTNPVAYEGWGSVATNLNQGDVGQNGS

SEQ ID NO: 113947 - protein, 34 aa, Artificial Sequence
  Description of Artificial Sequence: Synthetic polypeptide
DEEAEIRTTNPVAYEHYGEVSTGNQQGNTGGDAR

SEQ ID NO: 113948 - protein, 35 aa, Artificial Sequence
  Description of Artificial Sequence: Synthetic polypeptide
DEEEIRTTNPVATEQYGSVTHTTEDHNDRGEEMRI

SEQ ID NO: 113949 - protein, 33 aa, Artificial Sequence
  Description of Artificial Sequence: Synthetic polypeptide
DEEEIRCTNPVATECWGSVSCINEPMDREGENG

SEQ ID NO: 113950 - protein, 33 aa, Artificial Sequence
  Description of Artificial Sequence: Synthetic polypeptide
DEEAEIRTTNPVAYEQWGSVTTQGNQGNMGNGH

SEQ ID NO: 113951 - protein, 32 aa, Artificial Sequence
  Description of Artificial Sequence: Synthetic polypeptide
DEEAICTTNPVATECYGEVTTGGDHQREGSDR

SEQ ID NO: 113952 - protein, 34 aa, Artificial Sequence
  Description of Artificial Sequence: Synthetic polypeptide
DEEEIRTTNPVATEQYGSCQGPTNMEQIQNENSD

SEQ ID NO: 113953 - protein, 35 aa, Artificial Sequence
  Description of Artificial Sequence: Synthetic polypeptide
DEEEIRTTNPVATEQYGSVSNTNDPMTNLGGTQFQ

SEQ ID NO: 113954 - protein, 34 aa, Artificial Sequence
  Description of Artificial Sequence: Synthetic polypeptide
DEEAICTVNPVATEAYGSVSTDNLQEGNEGGNQQ

SEQ ID NO: 113955 - protein, 32 aa, Artificial Sequence
  Description of Artificial Sequence: Synthetic polypeptide
DEAEIATTNPVATEQWGSVAANLQDTDDNFNM

SEQ ID NO: 113956 - protein, 34 aa, Artificial Sequence
  Description of Artificial Sequence: Synthetic polypeptide
DEEAICTVNPVATEAYGSVSTDNLQENNEEGNEQ

SEQ ID NO: 113957 - protein, 34 aa, Artificial Sequence
  Description of Artificial Sequence: Synthetic polypeptide
DEEAICTVNPVATEAYGSVSTDNLQENNEGGNQD

SEQ ID NO: 113958 - protein, 32 aa, Artificial Sequence
  Description of Artificial Sequence: Synthetic polypeptide
DEEAIATTNPVSTEQYGSVSWNEMDRQGMDSG

SEQ ID NO: 113959 - protein, 33 aa, Artificial Sequence
  Description of Artificial Sequence: Synthetic polypeptide
DEAEIRTTNPVATEQYGETCSTGELQHFGSDQS

SEQ ID NO: 113960 - protein, 35 aa, Artificial Sequence
  Description of Artificial Sequence: Synthetic polypeptide
DEEEIRTTNPVATEQYGSVSNTLDGESGQSNNNGD

SEQ ID NO: 113961 - protein, 34 aa, Artificial Sequence
  Description of Artificial Sequence: Synthetic polypeptide
DEAEIATTNPVATEQWGSVSGPNGNQGNGGNGRD

SEQ ID NO: 113962 - protein, 33 aa, Artificial Sequence
  Description of Artificial Sequence: Synthetic polypeptide
DEEEIRTTNPVATESYGSVMGSQGEGGGNNGQV

SEQ ID NO: 113963 - protein, 32 aa, Artificial Sequence
  Description of Artificial Sequence: Synthetic polypeptide
DEEAIRTTNPVATECYGHHITWNELQPPSNEF

SEQ ID NO: 113964 - protein, 32 aa, Artificial Sequence
  Description of Artificial Sequence: Synthetic polypeptide
DEEAIRTTNPVATEEYGCVCSTEHQNFGSEQF

SEQ ID NO: 113965 - protein, 35 aa, Artificial Sequence
  Description of Artificial Sequence: Synthetic polypeptide
DEEEIRTTNPVATEQYGSVSNTDNVEMGEFGEFFA

SEQ ID NO: 113966 - protein, 36 aa, Artificial Sequence
  Description of Artificial Sequence: Synthetic polypeptide
DEEEIRTTNPVATEQYGSVTPTNGDDETTQSGQSRQ

SEQ ID NO: 113967 - protein, 34 aa, Artificial Sequence
  Description of Artificial Sequence: Synthetic polypeptide
DEEEIRTTNPVATESYGSVMGQNMEQEGGENEGI

SEQ ID NO: 113968 - protein, 34 aa, Artificial Sequence
  Description of Artificial Sequence: Synthetic polypeptide
DEEAIRTTNPVATEIWGQVATTNNGDHQRGMNDR

SEQ ID NO: 113969 - protein, 36 aa, Artificial Sequence
  Description of Artificial Sequence: Synthetic polypeptide
DEEEIRTTNPVATESYGSVMGTNDELQQGEGGENGL

SEQ ID NO: 113970 - protein, 34 aa, Artificial Sequence
  Description of Artificial Sequence: Synthetic polypeptide
DEEEIRTTNPVATESYGSVMGNVNQGQGEQGENV

SEQ ID NO: 113971 - protein, 33 aa, Artificial Sequence
  Description of Artificial Sequence: Synthetic polypeptide
DEEAIRTTNPVATEQWGCVCGSNNLQHFNSNQS

SEQ ID NO: 113972 - protein, 30 aa, Artificial Sequence
  Description of Artificial Sequence: Synthetic polypeptide
DEEEIRCTNPIATECYGATVAENWMPKGNI

SEQ ID NO: 113973 - protein, 33 aa, Artificial Sequence
  Description of Artificial Sequence: Synthetic polypeptide
DEEAIRTTNPVATEQWGCVCGTGNLQHFGSQQS

SEQ ID NO: 113974 - protein, 35 aa, Artificial Sequence
  Description of Artificial Sequence: Synthetic polypeptide
DEEEIRTTNPVATEQYGSCSLTANMDQVIISNVSG

SEQ ID NO: 113975 - protein, 36 aa, Artificial Sequence
  Description of Artificial Sequence: Synthetic polypeptide
DEEEIRTTNPVATEQYGSVTPTNGDEFTQSGQDGNQ

SEQ ID NO: 113976 - protein, 31 aa, Artificial Sequence
  Description of Artificial Sequence: Synthetic polypeptide
DEEEIRCTNPIATECWGSVAAENWMEPGNYR

SEQ ID NO: 113977 - protein, 34 aa, Artificial Sequence
  Description of Artificial Sequence: Synthetic polypeptide
DEEAIRTTNPVATEQWGCVCGTNELQHFGSNNQS

SEQ ID NO: 113978 - protein, 33 aa, Artificial Sequence
  Description of Artificial Sequence: Synthetic polypeptide
DEEAIRTTNPVATENYGKHSDTWNELQPPSNEF

SEQ ID NO: 113979 - protein, 33 aa, Artificial Sequence
  Description of Artificial Sequence: Synthetic polypeptide
DEEAIRTTNPVATEAYGKHSTWNELQPPSNEVF

SEQ ID NO: 113980 - protein, 33 aa, Artificial Sequence
  Description of Artificial Sequence: Synthetic polypeptide
DEEAIRTTNPVATEAWGQVATTDGGDHQRGSNR

SEQ ID NO: 113981 - protein, 35 aa, Artificial Sequence
  Description of Artificial Sequence: Synthetic polypeptide
DEEEIRTTNPVATESYGSVMGTNLIDEGGGGNTTT

SEQ ID NO: 113982 - protein, 35 aa, Artificial Sequence
  Description of Artificial Sequence: Synthetic polypeptide
DEEEIRTTNPVATEQYGSVTPDNGDETTQSGQDNF

SEQ ID NO: 113983 - protein, 33 aa, Artificial Sequence
  Description of Artificial Sequence: Synthetic polypeptide
DEEAIKTTNGVATEQYGSVDPTAVMLQGGSSRN

SEQ ID NO: 113984 - protein, 33 aa, Artificial Sequence
  Description of Artificial Sequence: Synthetic polypeptide
DEEEIRTTNPVATEQYGSVTPEVAGLIDTNVGT

SEQ ID NO: 113985 - protein, 32 aa, Artificial Sequence
  Description of Artificial Sequence: Synthetic polypeptide
DEAEIATTNPVATEQWGSVSGTGLQHMSAEVM

SEQ ID NO: 113986 - protein, 35 aa, Artificial Sequence
  Description of Artificial Sequence: Synthetic polypeptide
DEEEIRTTNPVATESYGSVNSDTNMNNENGNFEDE

SEQ ID NO: 113987 - protein, 31 aa, Artificial Sequence
  Description of Artificial Sequence: Synthetic polypeptide
DEEEIRCTNPIATEQYGAVSNADWMEPKGNI

SEQ ID NO: 113988 - protein, 32 aa, Artificial Sequence
  Description of Artificial Sequence: Synthetic polypeptide
DEEEIRCTNPIATEQYGATVWSADWAEPKGNR

SEQ ID NO: 113989 - protein, 34 aa, Artificial Sequence
  Description of Artificial Sequence: Synthetic polypeptide
DEEAIRTCNPVAYEQYGSTVSCTRLSARTVGQNE

SEQ ID NO: 113990 - protein, 31 aa, Artificial Sequence
  Description of Artificial Sequence: Synthetic polypeptide
DEEAIRTTNPCATEQYRYCVNSEVLQRNDGQ

SEQ ID NO: 113991 - protein, 30 aa, Artificial Sequence
  Description of Artificial Sequence: Synthetic polypeptide
DEEAIRTTNPDATEGYGSCITLDLADGQIQ

SEQ ID NO: 113992 - protein, 35 aa, Artificial Sequence
  Description of Artificial Sequence: Synthetic polypeptide
DEEEIRTTNPVATEQYGSVTPTDGSLEQTQGQDHQ

SEQ ID NO: 113993 - protein, 31 aa, Artificial Sequence
  Description of Artificial Sequence: Synthetic polypeptide
DEEAIRTTNPDATEGYGSCSTNEADSGQIHN

SEQ ID NO: 113994 - protein, 32 aa, Artificial Sequence
  Description of Artificial Sequence: Synthetic polypeptide
DEEAIRTTNPDAYEGYGSCSTNLWEFGGQNPE

SEQ ID NO: 113995 - protein, 35 aa, Artificial Sequence
  Description of Artificial Sequence: Synthetic polypeptide
DEEEIRTTNPVATEQYGSVSNTENWMVADVGLQVA

SEQ ID NO: 113996 - protein, 33 aa, Artificial Sequence
  Description of Artificial Sequence: Synthetic polypeptide
DEEEIRTTNPVATESYGSVMTGDFNGGEEGGEE

SEQ ID NO: 113997 - protein, 32 aa, Artificial Sequence
  Description of Artificial Sequence: Synthetic polypeptide
DEEAIRTTNPNATECYGSVATPNDHNGTGNNM

SEQ ID NO: 113998 - protein, 33 aa, Artificial Sequence
  Description of Artificial Sequence: Synthetic polypeptide
DEEEIRTTNPVATESYGSVMGTTNAFGNDGGGG

SEQ ID NO: 113999 - protein, 34 aa, Artificial Sequence
  Description of Artificial Sequence: Synthetic polypeptide
DEEEIRTTNPVATEQYGSVSNGNLEVPAMAVEEE

SEQ ID NO: 114000 - protein, 35 aa, Artificial Sequence
  Description of Artificial Sequence: Synthetic polypeptide
DEEEIRTTNPVATEQYGSVSNGNLEEPQPQLVEEE

SEQ ID NO: 114001 - protein, 36 aa, Artificial Sequence
  Description of Artificial Sequence: Synthetic polypeptide
DEEEIRATNPVATEQYGVVSTTNNQQLQAGNQNNQD

SEQ ID NO: 114002 - protein, 34 aa, Artificial Sequence
  Description of Artificial Sequence: Synthetic polypeptide
DEEEIRTTNPVATEQYGSVSNGNLEEPAAEVAEE

SEQ ID NO: 114003 - protein, 32 aa, Artificial Sequence
  Description of Artificial Sequence: Synthetic polypeptide
DEAEIRTTNPVATEQYGCVCSWGELFNFNSNQ

SEQ ID NO: 114004 - protein, 32 aa, Artificial Sequence
  Description of Artificial Sequence: Synthetic polypeptide
DEAEIATTNPVATEQYGCVSYTDLEDHEGEDQ

SEQ ID NO: 114005 - protein, 34 aa, Artificial Sequence
  Description of Artificial Sequence: Synthetic polypeptide
DEEEIRATNPVATEQYGSVCATNLEAPDNQDNEM

SEQ ID NO: 114006 - protein, 32 aa, Artificial Sequence
  Description of Artificial Sequence: Synthetic polypeptide
DEECIATTNPVAWEQWGVVCTIEDGQRGNGNR

SEQ ID NO: 114007 - protein, 32 aa, Artificial Sequence
  Description of Artificial Sequence: Synthetic polypeptide
DEAEIRTTNPVATEQYGCVCSWELQNFPSDQS

SEQ ID NO: 114008 - protein, 32 aa, Artificial Sequence
  Description of Artificial Sequence: Synthetic polypeptide
DEAEIRTTNPVATEQYGCVCSWELAENNSNQS

SEQ ID NO: 114009 - protein, 32 aa, Artificial Sequence
  Description of Artificial Sequence: Synthetic polypeptide
DEAEIRTTNPVATEQYGCVCSWEHQNFNSDQG

SEQ ID NO: 114010 - protein, 31 aa, Artificial Sequence
  Description of Artificial Sequence: Synthetic polypeptide
DEECIATTNPEATQQYGEVCTIDQGQREGNF

SEQ ID NO: 114011 - protein, 33 aa, Artificial Sequence
  Description of Artificial Sequence: Synthetic polypeptide
DEAEIRTTNPVATEQYGCVCSWEHQNFGSENQL

SEQ ID NO: 114012 - protein, 34 aa, Artificial Sequence
  Description of Artificial Sequence: Synthetic polypeptide
DEAEIATTNPVATEQYGSACATNNLQDDPGNADI

SEQ ID NO: 114013 - protein, 32 aa, Artificial Sequence
  Description of Artificial Sequence: Synthetic polypeptide
DEEEIRATNPVATEQYGSVCAMAPLDTMPDNQ

SEQ ID NO: 114014 - protein, 34 aa, Artificial Sequence
  Description of Artificial Sequence: Synthetic polypeptide
DEEEIRTTNPVATEQYGYVSTMNNGPEIDQNDDE

SEQ ID NO: 114015 - protein, 33 aa, Artificial Sequence
  Description of Artificial Sequence: Synthetic polypeptide
DEAEIATTNPVATEQYGSCSATPVDQNQDVNRH

SEQ ID NO: 114016 - protein, 33 aa, Artificial Sequence
  Description of Artificial Sequence: Synthetic polypeptide
DEAEIATTNPVATEQYGSICAGMNDGLTNGENR

SEQ ID NO: 114017 - protein, 33 aa, Artificial Sequence
  Description of Artificial Sequence: Synthetic polypeptide
DEEEIRATNPVATEQYGSVCAATGEEPAREQND

SEQ ID NO: 114018 - protein, 34 aa, Artificial Sequence
  Description of Artificial Sequence: Synthetic polypeptide
DEEEIRTTNPVATEQYGSVSMNLMNNTIEVDQGP

SEQ ID NO: 114019 - protein, 33 aa, Artificial Sequence
  Description of Artificial Sequence: Synthetic polypeptide
DEECIATTNPVAYECYGSVAMTNELSQSGGNMF

SEQ ID NO: 114020 - protein, 35 aa, Artificial Sequence
  Description of Artificial Sequence: Synthetic polypeptide
DEEEIRTTNPVATEQYGSVSMNLHEHPSTPPEENQ

SEQ ID NO: 114021 - protein, 34 aa, Artificial Sequence
  Description of Artificial Sequence: Synthetic polypeptide
DEAEIRTTNPVATEQYGCVFTDINDTHRSGQENG

SEQ ID NO: 114022 - protein, 29 aa, Artificial Sequence
  Description of Artificial Sequence: Synthetic peptide
DEECIACTNPVAYAQWGQVSTANVQHDNN

SEQ ID NO: 114023 - protein, 34 aa, Artificial Sequence
  Description of Artificial Sequence: Synthetic polypeptide
DEEEIRTTNPVATEQYGSVSNAGNLEEFAAVEEE

SEQ ID NO: 114024 - protein, 34 aa, Artificial Sequence
  Description of Artificial Sequence: Synthetic polypeptide
DEAEIRTTNPVATEQYGCVSTHWELQGIGIEDTP

SEQ ID NO: 114025 - protein, 35 aa, Artificial Sequence
  Description of Artificial Sequence: Synthetic polypeptide
DEEEIRTTNPVATEQYGSVSMTWPNHQPQVPEQVD

SEQ ID NO: 114026 - protein, 36 aa, Artificial Sequence
  Description of Artificial Sequence: Synthetic polypeptide
DEEEIRTTNPVATEQYGSVSMTTPAGPNMRNGMNPV

SEQ ID NO: 114027 - protein, 34 aa, Artificial Sequence
  Description of Artificial Sequence: Synthetic polypeptide
DEEEIRTTNPVATEQYGSCTPTDTNEHRIIDGGD

SEQ ID NO: 114028 - protein, 32 aa, Artificial Sequence
  Description of Artificial Sequence: Synthetic polypeptide
DEEEIRTTNPVATEQYGSCTPTGTLEGMEEDQ

SEQ ID NO: 114029 - protein, 36 aa, Artificial Sequence
  Description of Artificial Sequence: Synthetic polypeptide
DEEEIRTTNPVATEQYGSVSMTTPAGINMRNGMNPV

SEQ ID NO: 114030 - protein, 33 aa, Artificial Sequence
  Description of Artificial Sequence: Synthetic polypeptide
DEAEIATTNPVATEQYGCVCTIEGNQDQGGNEP

SEQ ID NO: 114031 - protein, 34 aa, Artificial Sequence
  Description of Artificial Sequence: Synthetic polypeptide
DEAEIRTTNPVATEQYGCVSTANYELQGTIEDTV

SEQ ID NO: 114032 - protein, 36 aa, Artificial Sequence
  Description of Artificial Sequence: Synthetic polypeptide
DEEEIRTTNPVATEQYGSVSMTNNMMNQESGEEEVN

SEQ ID NO: 114033 - protein, 33 aa, Artificial Sequence
  Description of Artificial Sequence: Synthetic polypeptide
DEAEIRTTNPVATEQYGCVSMDLEQTRTQQDEI

SEQ ID NO: 114034 - protein, 31 aa, Artificial Sequence
  Description of Artificial Sequence: Synthetic polypeptide
DEAEIRTTNPVATEQYGCVSEVDSENGSEDP

SEQ ID NO: 114035 - protein, 36 aa, Artificial Sequence
  Description of Artificial Sequence: Synthetic polypeptide
DEEEIRTTNPVATEQYGSVSMTNLLEEMDPGAEAEH

SEQ ID NO: 114036 - protein, 35 aa, Artificial Sequence
  Description of Artificial Sequence: Synthetic polypeptide
DEAEIRTTNPVATEQYGCVSCTQNVEQDRSGEEKN

SEQ ID NO: 114037 - protein, 34 aa, Artificial Sequence
  Description of Artificial Sequence: Synthetic polypeptide
DEECIACTNPVATEQYGSVSWNEGEQERQGDNQL

SEQ ID NO: 114038 - protein, 36 aa, Artificial Sequence
  Description of Artificial Sequence: Synthetic polypeptide
DEEEIRTTNPVATEQYGYVTSTTPNGPNMRNGMNPV

SEQ ID NO: 114039 - protein, 35 aa, Artificial Sequence
  Description of Artificial Sequence: Synthetic polypeptide
DEAEIRTTNPVATEQYGCVSSTNWELQGIGIEDTA

SEQ ID NO: 114040 - protein, 35 aa, Artificial Sequence
  Description of Artificial Sequence: Synthetic polypeptide
DEEEIRTTNPVATEQYGSCVVLPTNLENGSEQQEI

SEQ ID NO: 114041 - protein, 34 aa, Artificial Sequence
  Description of Artificial Sequence: Synthetic polypeptide
DEEEIRTTNPVATEQYGSCVVPPTPLENGSEQED

SEQ ID NO: 114042 - protein, 35 aa, Artificial Sequence
  Description of Artificial Sequence: Synthetic polypeptide
DEEEIRTTNPVATEQYGYVGSTGMGQEGNGGNQGG

SEQ ID NO: 114043 - protein, 36 aa, Artificial Sequence
  Description of Artificial Sequence: Synthetic polypeptide
DEAEIATTNPVATEQYGSVAATTNGNQTRSGDNNRD

SEQ ID NO: 114044 - protein, 33 aa, Artificial Sequence
  Description of Artificial Sequence: Synthetic polypeptide
DEAEIATTNPVATEQYGSVAATTNLTHPMDENN

SEQ ID NO: 114045 - protein, 31 aa, Artificial Sequence
  Description of Artificial Sequence: Synthetic polypeptide
DEEEIRATNPVATEQYGSVCAAGLDNIPEDN

SEQ ID NO: 114046 - protein, 34 aa, Artificial Sequence
  Description of Artificial Sequence: Synthetic polypeptide
DEECIATTNPVAYEQYGQSTVSVDNELAQHVGER

SEQ ID NO: 114047 - protein, 34 aa, Artificial Sequence
  Description of Artificial Sequence: Synthetic polypeptide
DEECIATTNPVAYEQYGQSVFWLNLQNTGGNNRM

SEQ ID NO: 114048 - protein, 33 aa, Artificial Sequence
  Description of Artificial Sequence: Synthetic polypeptide
DEAEIATTNPVATEQYGSVAATTNLTHPMGDEP

SEQ ID NO: 114049 - protein, 33 aa, Artificial Sequence
  Description of Artificial Sequence: Synthetic polypeptide
DEECIATTNPVAYEQYGQSVSCGNHQNGGSYRM

SEQ ID NO: 114050 - protein, 34 aa, Artificial Sequence
  Description of Artificial Sequence: Synthetic polypeptide
DEEEIRTTNPVATEQYGYTIMTNGGQQDEGENGE

SEQ ID NO: 114051 - protein, 33 aa, Artificial Sequence
  Description of Artificial Sequence: Synthetic polypeptide
DEECIATTNPVAYEQYGQSVSWGNHSQAGGSRM

SEQ ID NO: 114052 - protein, 32 aa, Artificial Sequence
  Description of Artificial Sequence: Synthetic polypeptide
DEECIATTNPVAYEQYGQTVSEGNHQNGGSRM

SEQ ID NO: 114053 - protein, 34 aa, Artificial Sequence
  Description of Artificial Sequence: Synthetic polypeptide
DEEEIRTTNPVATEQYGSFGSDETDETGGNVGNQ

SEQ ID NO: 114054 - protein, 33 aa, Artificial Sequence
  Description of Artificial Sequence: Synthetic polypeptide
DEAEIRTTNPVATEQYGCVCSTGEDEGFNSEQG

SEQ ID NO: 114055 - protein, 33 aa, Artificial Sequence
  Description of Artificial Sequence: Synthetic polypeptide
DEAEIATTNPVATEQYGSVAGTGPQNRDPQNPN

SEQ ID NO: 114056 - protein, 33 aa, Artificial Sequence
  Description of Artificial Sequence: Synthetic polypeptide
DEAEIRTTNPVATEQYGCVCSTELENFGSETQP

SEQ ID NO: 114057 - protein, 33 aa, Artificial Sequence
  Description of Artificial Sequence: Synthetic polypeptide
DEAEIRTTNPVATEQYGCVCSTEHQYFGSETQS

SEQ ID NO: 114058 - protein, 33 aa, Artificial Sequence
  Description of Artificial Sequence: Synthetic polypeptide
DEAEIATTNPVATEQYGSVAGTHGPDQGGNPED

SEQ ID NO: 114059 - protein, 33 aa, Artificial Sequence
  Description of Artificial Sequence: Synthetic polypeptide
DEECIATTNPVAYEQYGQSVVSFGNHQNGGSRM

SEQ ID NO: 114060 - protein, 33 aa, Artificial Sequence
  Description of Artificial Sequence: Synthetic polypeptide
DEAEIATTNPVATEQYGSVAATQLDQNPNNTPM

SEQ ID NO: 114061 - protein, 32 aa, Artificial Sequence
  Description of Artificial Sequence: Synthetic polypeptide
DEEEIRTTNPVATEQYGYTIPPSFEEFRGEQV

SEQ ID NO: 114062 - protein, 33 aa, Artificial Sequence
  Description of Artificial Sequence: Synthetic polypeptide
DEEEIRTTNPVATEQYGSVSMGNQVEPAAVEEE

SEQ ID NO: 114063 - protein, 36 aa, Artificial Sequence
  Description of Artificial Sequence: Synthetic polypeptide
DEEEIRTTNPVATEQYGYVGSTDNLNIMDDGEFTNI

SEQ ID NO: 114064 - protein, 34 aa, Artificial Sequence
  Description of Artificial Sequence: Synthetic polypeptide
DEAEIRTTNPVATEQYGCVCSTGNHQENFNSEQA

SEQ ID NO: 114065 - protein, 34 aa, Artificial Sequence
  Description of Artificial Sequence: Synthetic polypeptide
DEAEIRTTNPVATEQYGCVCSTGNDHQNFGSEQA

SEQ ID NO: 114066 - protein, 32 aa, Artificial Sequence
  Description of Artificial Sequence: Synthetic polypeptide
DEECIATTNPVAYEQWGQSVSWGNHQNGGSRE

SEQ ID NO: 114067 - protein, 31 aa, Artificial Sequence
  Description of Artificial Sequence: Synthetic polypeptide
DEECIATTNPVAYEQWGSVFQHEDLDRGNTP

SEQ ID NO: 114068 - protein, 31 aa, Artificial Sequence
  Description of Artificial Sequence: Synthetic polypeptide
DEECIATTNPVAYEQWGSVFQHEDLGRGENT

SEQ ID NO: 114069 - protein, 32 aa, Artificial Sequence
  Description of Artificial Sequence: Synthetic polypeptide
DEAEIATTNPVATEQYGSVAANNDLTMSPGEG

SEQ ID NO: 114070 - protein, 33 aa, Artificial Sequence
  Description of Artificial Sequence: Synthetic polypeptide
DEAEIATTNPVATEQYGSVAATNDATMNPEDRH

SEQ ID NO: 114071 - protein, 33 aa, Artificial Sequence
  Description of Artificial Sequence: Synthetic polypeptide
DEAEIATTNPVATEQYGSVAATNEQANGGVDQL

SEQ ID NO: 114072 - protein, 32 aa, Artificial Sequence
  Description of Artificial Sequence: Synthetic polypeptide
DEECIATTNPVAYEQWGSVFQHEDLGRGNEER

SEQ ID NO: 114073 - protein, 34 aa, Artificial Sequence
  Description of Artificial Sequence: Synthetic polypeptide
DEEEIRTTNPVATEQYGSVSMMDGLEHDSNQNDD

SEQ ID NO: 114074 - protein, 35 aa, Artificial Sequence
  Description of Artificial Sequence: Synthetic polypeptide
DEEEIRTTNPVATEQYGSVSMMDGLEHDSGQNDPI

SEQ ID NO: 114075 - protein, 34 aa, Artificial Sequence
  Description of Artificial Sequence: Synthetic polypeptide
DEEEIRTTNPVATEQYGSVSMLPMHQHRPFQEEH

SEQ ID NO: 114076 - protein, 34 aa, Artificial Sequence
  Description of Artificial Sequence: Synthetic polypeptide
DEEEIRTTNPVATEQYGYTISPSFTTEVRDGEVE

SEQ ID NO: 114077 - protein, 33 aa, Artificial Sequence
  Description of Artificial Sequence: Synthetic polypeptide
DEEEIRTTNPVATEQYGYTISPSFEGEGVRGEE

SEQ ID NO: 114078 - protein, 34 aa, Artificial Sequence
  Description of Artificial Sequence: Synthetic polypeptide
DEAEIATTNPVATEQYGSVAATPHLDQIDENDNR

SEQ ID NO: 114079 - protein, 33 aa, Artificial Sequence
  Description of Artificial Sequence: Synthetic polypeptide
DEAEIATTNPVATEQYGSVAATPNDQTQANPNH

SEQ ID NO: 114080 - protein, 36 aa, Artificial Sequence
  Description of Artificial Sequence: Synthetic polypeptide
DEEEIRTTNPVATEQYGSCSWVNIWPQERFNESQRS

SEQ ID NO: 114081 - protein, 34 aa, Artificial Sequence
  Description of Artificial Sequence: Synthetic polypeptide
DEEEIRTTNPVATEQYGSVTGPNNGNHGEGNGNM

SEQ ID NO: 114082 - protein, 34 aa, Artificial Sequence
  Description of Artificial Sequence: Synthetic polypeptide
DEEEIRATNPVATEQYGSVCIVNDQHDRQGSGSP

SEQ ID NO: 114083 - protein, 35 aa, Artificial Sequence
  Description of Artificial Sequence: Synthetic polypeptide
DEEEIRTTNPVATEQYGSVSNAINNLPQGQLEVIQ

SEQ ID NO: 114084 - protein, 33 aa, Artificial Sequence
  Description of Artificial Sequence: Synthetic polypeptide
DEAEIATTNPVATEQYGCVAATNLANRDGDTLI

SEQ ID NO: 114085 - protein, 33 aa, Artificial Sequence
  Description of Artificial Sequence: Synthetic polypeptide
DEEEIRATNPVATEQYGTAVMSTNHTFYQDDAG

SEQ ID NO: 114086 - protein, 32 aa, Artificial Sequence
  Description of Artificial Sequence: Synthetic polypeptide
DEAEIATTNPVATEQYGCVAATNLATMNPNTD

SEQ ID NO: 114087 - protein, 32 aa, Artificial Sequence
  Description of Artificial Sequence: Synthetic polypeptide
DEAEIRTTNPVATEQYGCVWSDHLEREDTQVD

SEQ ID NO: 114088 - protein, 34 aa, Artificial Sequence
  Description of Artificial Sequence: Synthetic polypeptide
DEEEIRTTNPVATERYGETVFCQNMLSQRGGSPV

SEQ ID NO: 114089 - protein, 34 aa, Artificial Sequence
  Description of Artificial Sequence: Synthetic polypeptide
DEEEIRATNPVATEQYGSVVTGGMDNLDEEFNDQ

SEQ ID NO: 114090 - protein, 34 aa, Artificial Sequence
  Description of Artificial Sequence: Synthetic polypeptide
DEEEIRTTNPVATERWGQSVVSYTNAESHRPGDF

SEQ ID NO: 114091 - protein, 31 aa, Artificial Sequence
  Description of Artificial Sequence: Synthetic polypeptide
DEAEIATTNPVATEQYGCVAATGDTATNNDR

SEQ ID NO: 114092 - protein, 33 aa, Artificial Sequence
  Description of Artificial Sequence: Synthetic polypeptide
DEEEIRATNPVATEQYGSVTSANNHDAPSGSFT

SEQ ID NO: 114093 - protein, 34 aa, Artificial Sequence
  Description of Artificial Sequence: Synthetic polypeptide
DEEEIRTTNPVATEQYGSVSNENDIVNEAVLESR

SEQ ID NO: 114094 - protein, 34 aa, Artificial Sequence
  Description of Artificial Sequence: Synthetic polypeptide
DEEEIRTTNPVATERWGCVPSCTRGSQYEGPNNR

SEQ ID NO: 114095 - protein, 33 aa, Artificial Sequence
  Description of Artificial Sequence: Synthetic polypeptide
DEEEIRTTNPVATERWGCVPSCTQGSQYEGNNM

SEQ ID NO: 114096 - protein, 35 aa, Artificial Sequence
  Description of Artificial Sequence: Synthetic polypeptide
DEEEIRTTNPVATERWGCVPSCTNNGPQETGLNNR

SEQ ID NO: 114097 - protein, 35 aa, Artificial Sequence
  Description of Artificial Sequence: Synthetic polypeptide
DEEEIRTTNPVATEQYGSVSNDTPLSEMSQSEVED

SEQ ID NO: 114098 - protein, 34 aa, Artificial Sequence
  Description of Artificial Sequence: Synthetic polypeptide
DEEEIRTTNPVATERWGCVPSCTNGSQYEQGNNH

SEQ ID NO: 114099 - protein, 34 aa, Artificial Sequence
  Description of Artificial Sequence: Synthetic polypeptide
DEEEIRTTNPVATERWGCVPSCTNGSPEGLNNRI

SEQ ID NO: 114100 - protein, 34 aa, Artificial Sequence
  Description of Artificial Sequence: Synthetic polypeptide
DEEEIRTTNPVATERWGCVPSCVNGSQYEGNNRL

SEQ ID NO: 114101 - protein, 34 aa, Artificial Sequence
  Description of Artificial Sequence: Synthetic polypeptide
DEEEIRTTNPVATERWGCVPSCTGIGSQYEGNNR

SEQ ID NO: 114102 - protein, 34 aa, Artificial Sequence
  Description of Artificial Sequence: Synthetic polypeptide
DEEEIRTTNPVATEQYGSVSNFLDDVIENVVVTE

SEQ ID NO: 114103 - protein, 36 aa, Artificial Sequence
  Description of Artificial Sequence: Synthetic polypeptide
DEEEIRATNPVATEQYGTVVIGTSIGTNNLQLGNIG

SEQ ID NO: 114104 - protein, 33 aa, Artificial Sequence
  Description of Artificial Sequence: Synthetic polypeptide
DEEEIRTTNPVATEQYGSVSNGMGEFTGEGESE

SEQ ID NO: 114105 - protein, 36 aa, Artificial Sequence
  Description of Artificial Sequence: Synthetic polypeptide
DEEEIRTTNPVATERYGSVVPSTLELSQVTGGNQYW

SEQ ID NO: 114106 - protein, 36 aa, Artificial Sequence
  Description of Artificial Sequence: Synthetic polypeptide
DEEEIRATNPVATEQYGVVSTTNNQQLQAGNNQQGD

SEQ ID NO: 114107 - protein, 32 aa, Artificial Sequence
  Description of Artificial Sequence: Synthetic polypeptide
DEAEIATTNPVATEQYGCVAANGNGTNMEGNR

SEQ ID NO: 114108 - protein, 36 aa, Artificial Sequence
  Description of Artificial Sequence: Synthetic polypeptide
DEEEIRTTNPVATEQYGSVSNGITTNGLGEDEFGTV

SEQ ID NO: 114109 - protein, 36 aa, Artificial Sequence
  Description of Artificial Sequence: Synthetic polypeptide
DEEEIRATNPVATEQYGVVSTTNNQLQQLGNGNQED

SEQ ID NO: 114110 - protein, 36 aa, Artificial Sequence
  Description of Artificial Sequence: Synthetic polypeptide
DEEEIRATNPVATEQYGVVSTTNNQLQQGNGNNIFD

SEQ ID NO: 114111 - protein, 36 aa, Artificial Sequence
  Description of Artificial Sequence: Synthetic polypeptide
DEEEIRTTNPVATEQYGSVTSATPAGPNMRNGMNPV

SEQ ID NO: 114112 - protein, 36 aa, Artificial Sequence
  Description of Artificial Sequence: Synthetic polypeptide
DEEEIRATNPVATEQYGVVSTTNNQLLQQGNNQQTD

SEQ ID NO: 114113 - protein, 36 aa, Artificial Sequence
  Description of Artificial Sequence: Synthetic polypeptide
DEEEIRATNPVATEQYGVVSTTNNDNLQLGNNQQQD

SEQ ID NO: 114114 - protein, 33 aa, Artificial Sequence
  Description of Artificial Sequence: Synthetic polypeptide
DEEEIRTTNPVATEQYGSVSNGELVEVAMVEEE

SEQ ID NO: 114115 - protein, 33 aa, Artificial Sequence
  Description of Artificial Sequence: Synthetic polypeptide
DEEEIRTTNPVATEQYGSVSNGDLEEYAAVEEE

SEQ ID NO: 114116 - protein, 36 aa, Artificial Sequence
  Description of Artificial Sequence: Synthetic polypeptide
DEEEIRATNPVATEQYGVSVNYTNELWQVSSGANVD

SEQ ID NO: 114117 - protein, 37 aa, Artificial Sequence
  Description of Artificial Sequence: Synthetic polypeptide
DEEEIRATNPVATEQYGTVVTIGTSISTTNLQLGNIR

SEQ ID NO: 114118 - protein, 35 aa, Artificial Sequence
  Description of Artificial Sequence: Synthetic polypeptide
DEAEIRTTNPVATEQYGCVYSTNYELQGIGIEDTS

SEQ ID NO: 114119 - protein, 32 aa, Artificial Sequence
  Description of Artificial Sequence: Synthetic polypeptide
DEAEIATTNPVATEQYGCVAANNLTNAMNPDR

SEQ ID NO: 114120 - protein, 34 aa, Artificial Sequence
  Description of Artificial Sequence: Synthetic polypeptide
DEEEIRTTNPVATEQYGSVSNGFIGEEVEGNTGN

SEQ ID NO: 114121 - protein, 34 aa, Artificial Sequence
  Description of Artificial Sequence: Synthetic polypeptide
DEEEIRTTNPVATERWGCVPSCTENGSQYEGNNG

SEQ ID NO: 114122 - protein, 34 aa, Artificial Sequence
  Description of Artificial Sequence: Synthetic polypeptide
DEEEIRATNPVATEQYGSVSVANNHDADPSGSND

SEQ ID NO: 114123 - protein, 34 aa, Artificial Sequence
  Description of Artificial Sequence: Synthetic polypeptide
DEEEIRTTNPVATERWGCVPSCGNEGSQYEGNNR

SEQ ID NO: 114124 - protein, 35 aa, Artificial Sequence
  Description of Artificial Sequence: Synthetic polypeptide
DEEEIRTTNPVATEQYGSCSTTNLADDRNFEHEDQ

SEQ ID NO: 114125 - protein, 35 aa, Artificial Sequence
  Description of Artificial Sequence: Synthetic polypeptide
DEEEIRTTNPVATEQYGSVSNDNELSESQSEVEDI

SEQ ID NO: 114126 - protein, 35 aa, Artificial Sequence
  Description of Artificial Sequence: Synthetic polypeptide
DEEEIRTTNPVATEQYGSCSTVNNLTETGISMQEM

SEQ ID NO: 114127 - protein, 33 aa, Artificial Sequence
  Description of Artificial Sequence: Synthetic polypeptide
DEAEIRTTNPVATEQYGCVSYPTEQTGPQEDRF

SEQ ID NO: 114128 - protein, 33 aa, Artificial Sequence
  Description of Artificial Sequence: Synthetic polypeptide
DEEEIRTTNPVATEQYGSVSNDMTDVTIEQLPI

SEQ ID NO: 114129 - protein, 35 aa, Artificial Sequence
  Description of Artificial Sequence: Synthetic polypeptide
DEEEIRATNPVATEQYGSVNSVTMNSNPIGGNNEG

SEQ ID NO: 114130 - protein, 34 aa, Artificial Sequence
  Description of Artificial Sequence: Synthetic polypeptide
DEEEIRATNPVATEQYGSVNDTNGDQEEEGGQGI

SEQ ID NO: 114131 - protein, 34 aa, Artificial Sequence
  Description of Artificial Sequence: Synthetic polypeptide
DEEEIRTTNPVATEQYGSCSTTMLDDRNAEQEDM

SEQ ID NO: 114132 - protein, 31 aa, Artificial Sequence
  Description of Artificial Sequence: Synthetic polypeptide
DEAEIRTTNPVATEQYGCVSVEVSEENGGDI

SEQ ID NO: 114133 - protein, 36 aa, Artificial Sequence
  Description of Artificial Sequence: Synthetic polypeptide
DEEEIRTTNPVATEQYGSVSNDDNMDGQGGGETNND

SEQ ID NO: 114134 - protein, 35 aa, Artificial Sequence
  Description of Artificial Sequence: Synthetic polypeptide
DEAEIRTTNPVATEQYGCVSTVNYELQGIGIEDTI

SEQ ID NO: 114135 - protein, 34 aa, Artificial Sequence
  Description of Artificial Sequence: Synthetic polypeptide
DEAEIRTTNPVATEQYGCVSTTYELQIGIGIEDT

SEQ ID NO: 114136 - protein, 33 aa, Artificial Sequence
  Description of Artificial Sequence: Synthetic polypeptide
DEEEIRATNPVATEQYGSVIQVNINPTEQQFLR

SEQ ID NO: 114137 - protein, 35 aa, Artificial Sequence
  Description of Artificial Sequence: Synthetic polypeptide
DEAEIRTTNPVATEQYGCVSTNYELQVGIGIEDTV

SEQ ID NO: 114138 - protein, 35 aa, Artificial Sequence
  Description of Artificial Sequence: Synthetic polypeptide
DEEEIRATNPVATEQYGSVCSTNPEPQEHDDNLAG

SEQ ID NO: 114139 - protein, 34 aa, Artificial Sequence
  Description of Artificial Sequence: Synthetic polypeptide
DEEEIRTTNPVATEQYGSVSNANNQHNEVAELDG

SEQ ID NO: 114140 - protein, 32 aa, Artificial Sequence
  Description of Artificial Sequence: Synthetic polypeptide
DEAEIRTTNPVATEQYGCVSVEEVSENGSGDP

SEQ ID NO: 114141 - protein, 33 aa, Artificial Sequence
  Description of Artificial Sequence: Synthetic polypeptide
DEEEIRATNPVATEQYGSVSANNHDEAPSGSFP

SEQ ID NO: 114142 - protein, 33 aa, Artificial Sequence
  Description of Artificial Sequence: Synthetic polypeptide
DEEEIRATNPVATEQYGSVSANNHDNADPSGSF

SEQ ID NO: 114143 - protein, 34 aa, Artificial Sequence
  Description of Artificial Sequence: Synthetic polypeptide
DEEEIRATNPVATEQYGSVSDDIGDTQNGGNGQE

SEQ ID NO: 114144 - protein, 37 aa, Artificial Sequence
  Description of Artificial Sequence: Synthetic polypeptide
DEEEIRTTNPVATEQYGSVSNDTENMDNQGGGQDNTT

SEQ ID NO: 114145 - protein, 32 aa, Artificial Sequence
  Description of Artificial Sequence: Synthetic polypeptide
DEAEIATTNPVATEQYGCVATNLAAGIGEFDD

SEQ ID NO: 114146 - protein, 36 aa, Artificial Sequence
  Description of Artificial Sequence: Synthetic polypeptide
DEEEIRATNPVATEQYGSVSTVVNQQGTEQGTNEDQ

SEQ ID NO: 114147 - protein, 34 aa, Artificial Sequence
  Description of Artificial Sequence: Synthetic polypeptide
DEEEIRTTNPVATEQYGSVSNDPSQQTIQQEEEQ

SEQ ID NO: 114148 - protein, 36 aa, Artificial Sequence
  Description of Artificial Sequence: Synthetic polypeptide
DEEEIRATNPVATEQYGSVSTVVNQQGDEQGTENDE

SEQ ID NO: 114149 - protein, 34 aa, Artificial Sequence
  Description of Artificial Sequence: Synthetic polypeptide
DEEEIRTTNPVATEQYGSCSTNNIETGAISGQEM

SEQ ID NO: 114150 - protein, 36 aa, Artificial Sequence
  Description of Artificial Sequence: Synthetic polypeptide
DEEEIRATNPVATEQYGSVSTVVNQQGDEQGSNNNE

SEQ ID NO: 114151 - protein, 36 aa, Artificial Sequence
  Description of Artificial Sequence: Synthetic polypeptide
DEEEIRATNPVATEQYGSVSTVVNQQGDEQGNNEDE

SEQ ID NO: 114152 - protein, 36 aa, Artificial Sequence
  Description of Artificial Sequence: Synthetic polypeptide
DEEEIRTTNPVATEQYGSVTSITPAGPNMRQGMNPV

SEQ ID NO: 114153 - protein, 35 aa, Artificial Sequence
  Description of Artificial Sequence: Synthetic polypeptide
DEEEIRATNPVATEQYGSVSTMGMGQEDNIQDGGE

SEQ ID NO: 114154 - protein, 35 aa, Artificial Sequence
  Description of Artificial Sequence: Synthetic polypeptide
DEEEIRATNPVATEQYGSVSTGGQSDTNGGGNQGE

SEQ ID NO: 114155 - protein, 36 aa, Artificial Sequence
  Description of Artificial Sequence: Synthetic polypeptide
DEEEIRTTNPVATEQYGSVTSNDDLFQVNEGGNGDE

SEQ ID NO: 114156 - protein, 34 aa, Artificial Sequence
  Description of Artificial Sequence: Synthetic polypeptide
DEEEIRTTNPVATEQYGSVTSNGFGEFTGGEGNS

SEQ ID NO: 114157 - protein, 35 aa, Artificial Sequence
  Description of Artificial Sequence: Synthetic polypeptide
DEEEIRTTNPVATEQYWSVEETPNPLVQDDGDEPP

SEQ ID NO: 114158 - protein, 35 aa, Artificial Sequence
  Description of Artificial Sequence: Synthetic polypeptide
DEEEIRATNPVATEQYGSVSNNDNMDQGGGEINND

SEQ ID NO: 114159 - protein, 34 aa, Artificial Sequence
  Description of Artificial Sequence: Synthetic polypeptide
DEEEIRTTNPVATEQYGSVTSNLVDEDAMEVARS

SEQ ID NO: 114160 - protein, 34 aa, Artificial Sequence
  Description of Artificial Sequence: Synthetic polypeptide
DEEEIRATNPVATEQYGSVSIENLQNTQVDPTIQ

SEQ ID NO: 114161 - protein, 36 aa, Artificial Sequence
  Description of Artificial Sequence: Synthetic polypeptide
DEEEIRATNPVATEQYGSVCSCVNDQHDERQGSDSR

SEQ ID NO: 114162 - protein, 36 aa, Artificial Sequence
  Description of Artificial Sequence: Synthetic polypeptide
DEEEIRTTNPVATEQYGSVSSTAPDGPNMRNGMNPV

SEQ ID NO: 114163 - protein, 32 aa, Artificial Sequence
  Description of Artificial Sequence: Synthetic polypeptide
DEEEIRTTNPVATEQYGSCNYMDNNETIDVNQ

SEQ ID NO: 114164 - protein, 32 aa, Artificial Sequence
  Description of Artificial Sequence: Synthetic polypeptide
DEEAEIATTNPVAYEQWGSTSTNGQGNGGEGA

SEQ ID NO: 114165 - protein, 34 aa, Artificial Sequence
  Description of Artificial Sequence: Synthetic polypeptide
DEDEIRTTNPVAYEQWGSVSGGDNHQGIGGGENR

SEQ ID NO: 114166 - protein, 33 aa, Artificial Sequence
  Description of Artificial Sequence: Synthetic polypeptide
DEDEIRTTNPVAYEQWGSVSGGENHQGQGGGNN

SEQ ID NO: 114167 - protein, 35 aa, Artificial Sequence
  Description of Artificial Sequence: Synthetic polypeptide
DEEEIRTTNPVATEQYGSASSTTPAGPNRNGMNPV

SEQ ID NO: 114168 - protein, 36 aa, Artificial Sequence
  Description of Artificial Sequence: Synthetic polypeptide
DEEEIRTTNPVATEQYGSVSWTTPAGPNMRIGMNPV

SEQ ID NO: 114169 - protein, 36 aa, Artificial Sequence
  Description of Artificial Sequence: Synthetic polypeptide
DEEEIRTTNPVATEQYGSVSWTTPAGPNMRNGMNPV

SEQ ID NO: 114170 - protein, 36 aa, Artificial Sequence
  Description of Artificial Sequence: Synthetic polypeptide
DEEEIRTTNPVATEQYGSASSTTPAGPQMRNGMNPV

SEQ ID NO: 114171 - protein, 36 aa, Artificial Sequence
  Description of Artificial Sequence: Synthetic polypeptide
DEEEIRTTNPVATEQYGSVSWTTPAGPNMRNGMNSV

SEQ ID NO: 114172 - protein, 35 aa, Artificial Sequence
  Description of Artificial Sequence: Synthetic polypeptide
DEEEIRTTNPVATEQYGSVSPSSYLEHPEGENFLL

SEQ ID NO: 114173 - protein, 36 aa, Artificial Sequence
  Description of Artificial Sequence: Synthetic polypeptide
DEEEIRTTNPVATEQYGSVSWTTPAGPNPRNGMNPV

SEQ ID NO: 114174 - protein, 32 aa, Artificial Sequence
  Description of Artificial Sequence: Synthetic polypeptide
DEDEIRTTNPVAYEQWGSVSGGGNHQGEGGHN

SEQ ID NO: 114175 - protein, 35 aa, Artificial Sequence
  Description of Artificial Sequence: Synthetic polypeptide
DEEEIRTTNPVATEQYGSVSPSLLIQAISGFPEPT

SEQ ID NO: 114176 - protein, 35 aa, Artificial Sequence
  Description of Artificial Sequence: Synthetic polypeptide
DEEEIRTTNPVATEQYGSVSPSISNSETPQVHENL

SEQ ID NO: 114177 - protein, 35 aa, Artificial Sequence
  Description of Artificial Sequence: Synthetic polypeptide
DEEEIRTTNPVATEVYGSVMGTNDQGGDEDTNEGG

SEQ ID NO: 114178 - protein, 34 aa, Artificial Sequence
  Description of Artificial Sequence: Synthetic polypeptide
DEEEIRCTNPVATEQYGEASSTEPAGQRNGMGPR

SEQ ID NO: 114179 - protein, 34 aa, Artificial Sequence
  Description of Artificial Sequence: Synthetic polypeptide
DEEEIRTTNPVATEQYGSVSPSELLLPEVMPTDR

SEQ ID NO: 114180 - protein, 35 aa, Artificial Sequence
  Description of Artificial Sequence: Synthetic polypeptide
DEEEIRTTNPVATEVYGSVMGNGNNLQGEMGNGGN

SEQ ID NO: 114181 - protein, 33 aa, Artificial Sequence
  Description of Artificial Sequence: Synthetic polypeptide
DEEEIRCTNPVATEQYGEASSTPAGPQMRGGPV

SEQ ID NO: 114182 - protein, 36 aa, Artificial Sequence
  Description of Artificial Sequence: Synthetic polypeptide
DEEEIRTTNPVATEQYGSVSWWNGLIVNSNGENNEQ

SEQ ID NO: 114183 - protein, 35 aa, Artificial Sequence
  Description of Artificial Sequence: Synthetic polypeptide
DEEEIRTTNPVATEVYGSVSSTQGFGQTTGGNGNE

SEQ ID NO: 114184 - protein, 35 aa, Artificial Sequence
  Description of Artificial Sequence: Synthetic polypeptide
DEEEIRTTNPVATEQYGSASSTTPAGNMRNGMGPR

SEQ ID NO: 114185 - protein, 35 aa, Artificial Sequence
  Description of Artificial Sequence: Synthetic polypeptide
DEEEIRTTNPVATEQYGSASPWNLPQETQIEDNSD

SEQ ID NO: 114186 - protein, 33 aa, Artificial Sequence
  Description of Artificial Sequence: Synthetic polypeptide
DEDEIRTTNPVAYEQWGSVSGDNGIQGGGNANI

SEQ ID NO: 114187 - protein, 34 aa, Artificial Sequence
  Description of Artificial Sequence: Synthetic polypeptide
DEDEIRTTNPVAYEQWGSVSGDNGNNQRGPNEDS

SEQ ID NO: 114188 - protein, 35 aa, Artificial Sequence
  Description of Artificial Sequence: Synthetic polypeptide
DEEEIRTTNPVATEVYGSVSTGQGGQNVEGGNEDD

SEQ ID NO: 114189 - protein, 34 aa, Artificial Sequence
  Description of Artificial Sequence: Synthetic polypeptide
DEEEIRTTNPVATEVYGSVSTGFGQNEEGGGGQI

SEQ ID NO: 114190 - protein, 34 aa, Artificial Sequence
  Description of Artificial Sequence: Synthetic polypeptide
DEDEIRTTNPVAYEQWGSVSGDNMNDEQRGNGDS

SEQ ID NO: 114191 - protein, 33 aa, Artificial Sequence
  Description of Artificial Sequence: Synthetic polypeptide
DEEEIRTTNPVATEQYGSASSEAGPQMHGMEPV

SEQ ID NO: 114192 - protein, 37 aa, Artificial Sequence
  Description of Artificial Sequence: Synthetic polypeptide
DEEEIRTTNPVATEQYGSVSWTPTNLGGERAVNVHEH

SEQ ID NO: 114193 - protein, 34 aa, Artificial Sequence
  Description of Artificial Sequence: Synthetic polypeptide
DEDEIRTTNPVAYEQWGSVSGDNMNDQERGNEDS

SEQ ID NO: 114194 - protein, 35 aa, Artificial Sequence
  Description of Artificial Sequence: Synthetic polypeptide
DEEEIRTTNPVATEQYGSASSTEAGPNMRNGMGPR

SEQ ID NO: 114195 - protein, 35 aa, Artificial Sequence
  Description of Artificial Sequence: Synthetic polypeptide
DEEEIRTTNPVATEQYGSASSTEAGPQMRNGMEPV

SEQ ID NO: 114196 - protein, 34 aa, Artificial Sequence
  Description of Artificial Sequence: Synthetic polypeptide
DEEEIRTTNPVATEQYGSVSWTPGGESQVLVPPV

SEQ ID NO: 114197 - protein, 36 aa, Artificial Sequence
  Description of Artificial Sequence: Synthetic polypeptide
DEEEIRTTNPVATEQYGSASSTEPACPQMRNGMNPV

SEQ ID NO: 114198 - protein, 35 aa, Artificial Sequence
  Description of Artificial Sequence: Synthetic polypeptide
DEEEIRTTNPVATEQYGSASSTEPAGPNMRGMNPV

SEQ ID NO: 114199 - protein, 36 aa, Artificial Sequence
  Description of Artificial Sequence: Synthetic polypeptide
DEEEIRTTNPVATEQYGSASSTEPAGPQMRNGMNPV

SEQ ID NO: 114200 - protein, 35 aa, Artificial Sequence
  Description of Artificial Sequence: Synthetic polypeptide
DEEEIRTTNPVATEQYGSASSTTAGPNMRNGMNPV

SEQ ID NO: 114201 - protein, 35 aa, Artificial Sequence
  Description of Artificial Sequence: Synthetic polypeptide
DEEEIRTTNPVATEQYGSASSTEACPQMRNGMEPV

SEQ ID NO: 114202 - protein, 34 aa, Artificial Sequence
  Description of Artificial Sequence: Synthetic polypeptide
DEEEIRTTNPVATEQYGSASPVTSSLSRSEVETD

SEQ ID NO: 114203 - protein, 33 aa, Artificial Sequence
  Description of Artificial Sequence: Synthetic polypeptide
DEAEIATTNPVATCQYGQCVCSTALQRFGSDQS

SEQ ID NO: 114204 - protein, 34 aa, Artificial Sequence
  Description of Artificial Sequence: Synthetic polypeptide
DEEEIRTTNPVATEQYGSVSPQSLLPERLLIEMG

SEQ ID NO: 114205 - protein, 31 aa, Artificial Sequence
  Description of Artificial Sequence: Synthetic polypeptide
DEEEIRCTNPVATEQYGCVCSWETDHGSDTQ

SEQ ID NO: 114206 - protein, 35 aa, Artificial Sequence
  Description of Artificial Sequence: Synthetic polypeptide
DEAEIRTTNPVATEQYGSFVSTTNIEQPNSPQENS

SEQ ID NO: 114207 - protein, 34 aa, Artificial Sequence
  Description of Artificial Sequence: Synthetic polypeptide
DEEEIRTTNPVATEQYGSVSYENMDIEEGSELIE

SEQ ID NO: 114208 - protein, 35 aa, Artificial Sequence
  Description of Artificial Sequence: Synthetic polypeptide
DEAEIRTTNPVATEQYGSFVSTTIHEQNSPQESND

SEQ ID NO: 114209 - protein, 36 aa, Artificial Sequence
  Description of Artificial Sequence: Synthetic polypeptide
DEEEIRTTNPVATEQYGSVSPPDFEQEQRDTGGNVY

SEQ ID NO: 114210 - protein, 35 aa, Artificial Sequence
  Description of Artificial Sequence: Synthetic polypeptide
DEEEIRTTNPVATEQYGSVSYENNTEETPLQVERY

SEQ ID NO: 114211 - protein, 36 aa, Artificial Sequence
  Description of Artificial Sequence: Synthetic polypeptide
DEEEIRTTNPVATEQYGSVSPPANLGVIRNMVANSN

SEQ ID NO: 114212 - protein, 34 aa, Artificial Sequence
  Description of Artificial Sequence: Synthetic polypeptide
DEEEIRTTNPVATEQYGSVSPPEDNLEMLVMEGQ

SEQ ID NO: 114213 - protein, 35 aa, Artificial Sequence
  Description of Artificial Sequence: Synthetic polypeptide
DEEEIRTTNPVATEQYGSVSYENSLQELMVSLEGQ

SEQ ID NO: 114214 - protein, 35 aa, Artificial Sequence
  Description of Artificial Sequence: Synthetic polypeptide
DEEEIRTTNPVATEQYGSVSPNWEEQGRQIEEEDD

SEQ ID NO: 114215 - protein, 34 aa, Artificial Sequence
  Description of Artificial Sequence: Synthetic polypeptide
DEEEIRTTNPVATEQYGSVSPNTNDTDTIEDIQD

SEQ ID NO: 114216 - protein, 35 aa, Artificial Sequence
  Description of Artificial Sequence: Synthetic polypeptide
DEEEIRTTNPVATEQYGSVSPNTNASHIRNFEVEE

SEQ ID NO: 114217 - protein, 35 aa, Artificial Sequence
  Description of Artificial Sequence: Synthetic polypeptide
DEEEIRTTNPVATEQYGSVSYEYLQQIVFEEAGGD

SEQ ID NO: 114218 - protein, 35 aa, Artificial Sequence
  Description of Artificial Sequence: Synthetic polypeptide
DEEEIRTTNPVATEQYGSVSYEYLQQIVTEEPGGE

SEQ ID NO: 114219 - protein, 36 aa, Artificial Sequence
  Description of Artificial Sequence: Synthetic polypeptide
DEEEIRTTNPVATEQYGSVSPNSNQTPGGQIEELRD

SEQ ID NO: 114220 - protein, 33 aa, Artificial Sequence
  Description of Artificial Sequence: Synthetic polypeptide
DEEEIRTTNPVATEQYGSVSPNMNSIEEDQHVD

SEQ ID NO: 114221 - protein, 36 aa, Artificial Sequence
  Description of Artificial Sequence: Synthetic polypeptide
DEEEIRTTNPVATEQYGSVSPNWPQESGGQIEELRD

SEQ ID NO: 114222 - protein, 34 aa, Artificial Sequence
  Description of Artificial Sequence: Synthetic polypeptide
DEEEIRTTNPVATEQYGSVSPQSQLVERLMEEAG

SEQ ID NO: 114223 - protein, 36 aa, Artificial Sequence
  Description of Artificial Sequence: Synthetic polypeptide
DEEEIRTTNPVATEQYGSVSPPHNLGVILNQVANLN

SEQ ID NO: 114224 - protein, 34 aa, Artificial Sequence
  Description of Artificial Sequence: Synthetic polypeptide
DEEEIRCTNPVATEQYGCVCSWGNPDRFGSDNQM

SEQ ID NO: 114225 - protein, 32 aa, Artificial Sequence
  Description of Artificial Sequence: Synthetic polypeptide
DEDEIRTTNPVAYEQWGSVSGGGNQGAMNGNQ

SEQ ID NO: 114226 - protein, 33 aa, Artificial Sequence
  Description of Artificial Sequence: Synthetic polypeptide
DEEEIRTTNPVATEQYGSVSPPVGLVETMVQTK

SEQ ID NO: 114227 - protein, 30 aa, Artificial Sequence
  Description of Artificial Sequence: Synthetic polypeptide
DEEEIRCTNPVATEQYGDVSEIEMNAAEDA

SEQ ID NO: 114228 - protein, 34 aa, Artificial Sequence
  Description of Artificial Sequence: Synthetic polypeptide
DEDEIRTTNPVAYEQWGSVSGGNLGENRGGDDND

SEQ ID NO: 114229 - protein, 33 aa, Artificial Sequence
  Description of Artificial Sequence: Synthetic polypeptide
DEAEIATTNPVATEAYGSVCMTDNQDNRGNGEM

SEQ ID NO: 114230 - protein, 33 aa, Artificial Sequence
  Description of Artificial Sequence: Synthetic polypeptide
DEAEIATTNPVATEAYGSVCMTEDLGQHGGQNS

SEQ ID NO: 114231 - protein, 34 aa, Artificial Sequence
  Description of Artificial Sequence: Synthetic polypeptide
DEDEIRTTNPVAYEQWGSVSGNNLGEDRGGDGND

SEQ ID NO: 114232 - protein, 33 aa, Artificial Sequence
  Description of Artificial Sequence: Synthetic polypeptide
DEEEIRCTNPVATEQYGCVCSWGNHDHGSNNQG

SEQ ID NO: 114233 - protein, 35 aa, Artificial Sequence
  Description of Artificial Sequence: Synthetic polypeptide
DEDEIRTTNPVAYEQWGSVSGTNGNMQDRGQNEDS

SEQ ID NO: 114234 - protein, 35 aa, Artificial Sequence
  Description of Artificial Sequence: Synthetic polypeptide
DEEEIRTTNPVATEQYGSVSPPNLGVIDIQVASLN

SEQ ID NO: 114235 - protein, 34 aa, Artificial Sequence
  Description of Artificial Sequence: Synthetic polypeptide
DEEEIRCTNPVATEQYGCVCSWNDHDRFGSNTAM

SEQ ID NO: 114236 - protein, 33 aa, Artificial Sequence
  Description of Artificial Sequence: Synthetic polypeptide
DEEEIRTTNPVATEQYGSVSWYWIMETISNEND

SEQ ID NO: 114237 - protein, 32 aa, Artificial Sequence
  Description of Artificial Sequence: Synthetic polypeptide
DEDEIRTTNPVAYEQWGSVSHPLDDRQNMNQE

SEQ ID NO: 114238 - protein, 35 aa, Artificial Sequence
  Description of Artificial Sequence: Synthetic polypeptide
DEDEIRTTNPVAYEQWGSVSHTMNDQAGHDEGNRN

SEQ ID NO: 114239 - protein, 34 aa, Artificial Sequence
  Description of Artificial Sequence: Synthetic polypeptide
DEEEIRTTNPVATEQYGSASTNNASENETEETDT

SEQ ID NO: 114240 - protein, 33 aa, Artificial Sequence
  Description of Artificial Sequence: Synthetic polypeptide
DEAEIATTNPVATECYGCVCHTNDLNQDGKGNG

SEQ ID NO: 114241 - protein, 33 aa, Artificial Sequence
  Description of Artificial Sequence: Synthetic polypeptide
DEDEIRTTNPVAYEQWGSVSHGMNDRNDGNDPR

SEQ ID NO: 114242 - protein, 35 aa, Artificial Sequence
  Description of Artificial Sequence: Synthetic polypeptide
DEEEIRTTNPVATEQYGSASPVTSSLQRSEVEEDV

SEQ ID NO: 114243 - protein, 34 aa, Artificial Sequence
  Description of Artificial Sequence: Synthetic polypeptide
DEEEIRTTNPVATEQYGSASPTTSMVQRSEVEGD

SEQ ID NO: 114244 - protein, 34 aa, Artificial Sequence
  Description of Artificial Sequence: Synthetic polypeptide
DEEEIRTTNPVATEQYGSASPTNTNQLNMEVPEF

SEQ ID NO: 114245 - protein, 36 aa, Artificial Sequence
  Description of Artificial Sequence: Synthetic polypeptide
DEEEIRCTNPVATEQYGSVSSTTPAGPNMRNGMNPR

SEQ ID NO: 114246 - protein, 33 aa, Artificial Sequence
  Description of Artificial Sequence: Synthetic polypeptide
DEDEIRTTNPVAYEQWGSVCSTNDGQHQGGDTS

SEQ ID NO: 114247 - protein, 34 aa, Artificial Sequence
  Description of Artificial Sequence: Synthetic polypeptide
DEDEIRTTNPVAYEQWGSVCSTNDHNGHQGENMR

SEQ ID NO: 114248 - protein, 34 aa, Artificial Sequence
  Description of Artificial Sequence: Synthetic polypeptide
DEDEIRTTNPVAYEQWGSVCSTNDIDQGEGNANI

SEQ ID NO: 114249 - protein, 34 aa, Artificial Sequence
  Description of Artificial Sequence: Synthetic polypeptide
DEDEIRTTNPVAYEQWGSVCSTNDLNDNHGGNTV

SEQ ID NO: 114250 - protein, 33 aa, Artificial Sequence
  Description of Artificial Sequence: Synthetic polypeptide
DEDEIRTTNPVAYEQWGSVCSTNDMGDTQNGGQ

SEQ ID NO: 114251 - protein, 34 aa, Artificial Sequence
  Description of Artificial Sequence: Synthetic polypeptide
DEEEIRTTNPVATEYYGAVSVGNGGQGNDGVENE

SEQ ID NO: 114252 - protein, 33 aa, Artificial Sequence
  Description of Artificial Sequence: Synthetic polypeptide
DEEEIRTTNPVATEYYGCVCSTEEHQNFISNQS

SEQ ID NO: 114253 - protein, 35 aa, Artificial Sequence
  Description of Artificial Sequence: Synthetic polypeptide
DEEEIRTTNPVATEYYGAVSTQNDGNQETGGGNED

SEQ ID NO: 114254 - protein, 33 aa, Artificial Sequence
  Description of Artificial Sequence: Synthetic polypeptide
DEDEIRTTNPVAYEQWGSVCSTNDQGDLMNGGA

SEQ ID NO: 114255 - protein, 34 aa, Artificial Sequence
  Description of Artificial Sequence: Synthetic polypeptide
DEDEIRTTNPVAYEQWGSVCSTNDQGEVQGGNTS

SEQ ID NO: 114256 - protein, 34 aa, Artificial Sequence
  Description of Artificial Sequence: Synthetic polypeptide
DEDEIRTTNPVAYEQWGSVCSTNDQQDTGQGNEQ

SEQ ID NO: 114257 - protein, 34 aa, Artificial Sequence
  Description of Artificial Sequence: Synthetic polypeptide
DEDEIRTTNPVAYEQWGSVCSTNDQVGDTQNGNA

SEQ ID NO: 114258 - protein, 34 aa, Artificial Sequence
  Description of Artificial Sequence: Synthetic polypeptide
DEEEIRTTNPVATEQYGSAITPTNEVMRIENELT

SEQ ID NO: 114259 - protein, 35 aa, Artificial Sequence
  Description of Artificial Sequence: Synthetic polypeptide
DEEEIRTTNPVATEQYGSVSPTDMVMQESGEEEVY

SEQ ID NO: 114260 - protein, 33 aa, Artificial Sequence
  Description of Artificial Sequence: Synthetic polypeptide
DEDEIRTTNPVAYEQWGSVCSTNEDGDNHGNTV

SEQ ID NO: 114261 - protein, 34 aa, Artificial Sequence
  Description of Artificial Sequence: Synthetic polypeptide
DEDEIRTTNPVAYEQWGSVCSTNDNDGVQGNNDR

SEQ ID NO: 114262 - protein, 33 aa, Artificial Sequence
  Description of Artificial Sequence: Synthetic polypeptide
DEEEIRTTNPVATEQYGSALPTMNQINGELSVL

SEQ ID NO: 114263 - protein, 34 aa, Artificial Sequence
  Description of Artificial Sequence: Synthetic polypeptide
DEDEIRTTNPVAYEQWGSVCSTNDGGHQQEGMRS

SEQ ID NO: 114264 - protein, 33 aa, Artificial Sequence
  Description of Artificial Sequence: Synthetic polypeptide
DEEEIRTTNPVATEYYGCVCSTEHNQNFNSEDS

SEQ ID NO: 114265 - protein, 34 aa, Artificial Sequence
  Description of Artificial Sequence: Synthetic polypeptide
DEDEIRTTNPVAYEQWGSVCSTENGDQHDQGNPD

SEQ ID NO: 114266 - protein, 33 aa, Artificial Sequence
  Description of Artificial Sequence: Synthetic polypeptide
DEEEIRTTNPVATEYYGCVCSTMEHQNFGSEQS

SEQ ID NO: 114267 - protein, 34 aa, Artificial Sequence
  Description of Artificial Sequence: Synthetic polypeptide
DEEEIRTTNPVATEYYGCVCSTGELQENFGSEDS

SEQ ID NO: 114268 - protein, 36 aa, Artificial Sequence
  Description of Artificial Sequence: Synthetic polypeptide
DEEEIRTTNPVATEQYGSVSPTENNLEEEQGEEILD

SEQ ID NO: 114269 - protein, 36 aa, Artificial Sequence
  Description of Artificial Sequence: Synthetic polypeptide
DEEEIRTTNPVATEQYGSVSPTENMEHQPANLNIHE

SEQ ID NO: 114270 - protein, 34 aa, Artificial Sequence
  Description of Artificial Sequence: Synthetic polypeptide
DEEEIRTTNPVATEYYGCVCSTENHQENFGSEQS

SEQ ID NO: 114271 - protein, 35 aa, Artificial Sequence
  Description of Artificial Sequence: Synthetic polypeptide
DEEEIRTTNPVATEQYGSAAENLDNQITNGEENDQ

SEQ ID NO: 114272 - protein, 35 aa, Artificial Sequence
  Description of Artificial Sequence: Synthetic polypeptide
DEEEIRCTNPVATEQYGSVSSTTPAGPNMRNGNPV

SEQ ID NO: 114273 - protein, 33 aa, Artificial Sequence
  Description of Artificial Sequence: Synthetic polypeptide
DEEEIRTTNPVATEYYGCVCSTEHQNFGSETDS

SEQ ID NO: 114274 - protein, 35 aa, Artificial Sequence
  Description of Artificial Sequence: Synthetic polypeptide
DEEEIRTTNPVATEQYGSACATNPELQEHDDNEAE

SEQ ID NO: 114275 - protein, 34 aa, Artificial Sequence
  Description of Artificial Sequence: Synthetic polypeptide
DEDEIRTTNPVAYEQWGSVCSTIENDGHQGGQRS

SEQ ID NO: 114276 - protein, 32 aa, Artificial Sequence
  Description of Artificial Sequence: Synthetic polypeptide
DEDEIRTTNPVAYEQWGSVCSTINQGDTNGDA

SEQ ID NO: 114277 - protein, 33 aa, Artificial Sequence
  Description of Artificial Sequence: Synthetic polypeptide
DEDEIRTTNPVAYEQWGSVCSTNDGEHSGGNTS

SEQ ID NO: 114278 - protein, 35 aa, Artificial Sequence
  Description of Artificial Sequence: Synthetic polypeptide
DEEEIRTTNPVATEQYGSACATNPLQNGAGEGDHH

SEQ ID NO: 114279 - protein, 36 aa, Artificial Sequence
  Description of Artificial Sequence: Synthetic polypeptide
DEEEIRCTNPVATEQYGSVSSTTPALPNMRNGMNPV

SEQ ID NO: 114280 - protein, 33 aa, Artificial Sequence
  Description of Artificial Sequence: Synthetic polypeptide
DEDEIRTTNPVAYEQWGSVCSTNDGGHQIEGME

SEQ ID NO: 114281 - protein, 34 aa, Artificial Sequence
  Description of Artificial Sequence: Synthetic polypeptide
DEEEIRTTNPVATEQYGSACATNPELNEHDDNAQ

SEQ ID NO: 114282 - protein, 33 aa, Artificial Sequence
  Description of Artificial Sequence: Synthetic polypeptide
DEDEIRTTNPVAYEQWGSVCSTNMQGDTHNGGA

SEQ ID NO: 114283 - protein, 34 aa, Artificial Sequence
  Description of Artificial Sequence: Synthetic polypeptide
DEAEIRTTNPVATEQYGSIVGENLDFGGSNENDQ

SEQ ID NO: 114284 - protein, 33 aa, Artificial Sequence
  Description of Artificial Sequence: Synthetic polypeptide
DEAEIRTTNPVATEQYGSITNQDLNTTEGNDTD

SEQ ID NO: 114285 - protein, 33 aa, Artificial Sequence
  Description of Artificial Sequence: Synthetic polypeptide
DEDEIRTTNPVAYEQWGSVCYTNDGDQQGENMQ

SEQ ID NO: 114286 - protein, 33 aa, Artificial Sequence
  Description of Artificial Sequence: Synthetic polypeptide
DEEEIRCTNPVATEQYGSASSTTAGNMRNGMGV

SEQ ID NO: 114287 - protein, 35 aa, Artificial Sequence
  Description of Artificial Sequence: Synthetic polypeptide
DEEEIRCTNPVATEQYGSASSTEPAGQMRNGMGPR

SEQ ID NO: 114288 - protein, 32 aa, Artificial Sequence
  Description of Artificial Sequence: Synthetic polypeptide
DEAEIATTNPVATCQYGCVCSTALQNSGSDQS

SEQ ID NO: 114289 - protein, 35 aa, Artificial Sequence
  Description of Artificial Sequence: Synthetic polypeptide
DEEEIRTTNPVATEQYGSASPCEVEIIQQTAGNAR

SEQ ID NO: 114290 - protein, 35 aa, Artificial Sequence
  Description of Artificial Sequence: Synthetic polypeptide
DEEEIRTTNPVATEQYGSASPCEVPHIQQTAGNPR

SEQ ID NO: 114291 - protein, 35 aa, Artificial Sequence
  Description of Artificial Sequence: Synthetic polypeptide
DEEEIRTTNPVATEQYGSASPCEVSHIIQTIGNAQ

SEQ ID NO: 114292 - protein, 35 aa, Artificial Sequence
  Description of Artificial Sequence: Synthetic polypeptide
DEEEIRTTNPVATEQYGSVSPTAPLLQNNLEEVHE

SEQ ID NO: 114293 - protein, 37 aa, Artificial Sequence
  Description of Artificial Sequence: Synthetic polypeptide
DEAEIRTTNPVATEQYGSHVSTNIMLEELRNGNEEVF

SEQ ID NO: 114294 - protein, 35 aa, Artificial Sequence
  Description of Artificial Sequence: Synthetic polypeptide
DEEEIRCTNPVATEQYGSASSTENGPNMRNGMGPR

SEQ ID NO: 114295 - protein, 34 aa, Artificial Sequence
  Description of Artificial Sequence: Synthetic polypeptide
DEEEIRTTNPVATEQYGSASPETSTLDREEVEGD

SEQ ID NO: 114296 - protein, 34 aa, Artificial Sequence
  Description of Artificial Sequence: Synthetic polypeptide
DEDEIRTTNPVAYEQWGSVSGDNDNNDQRGNEGS

SEQ ID NO: 114297 - protein, 34 aa, Artificial Sequence
  Description of Artificial Sequence: Synthetic polypeptide
DEEEIRTTNPVATEQYGSASPHTSSLQPSEVELD

SEQ ID NO: 114298 - protein, 35 aa, Artificial Sequence
  Description of Artificial Sequence: Synthetic polypeptide
DEEEIRTTNPVATEQYGSASPMTSSLQVRSEVEGD

SEQ ID NO: 114299 - protein, 35 aa, Artificial Sequence
  Description of Artificial Sequence: Synthetic polypeptide
DEEEIRTTNPVATEQYGSASPNTSSLWQRSEVEGD

SEQ ID NO: 114300 - protein, 34 aa, Artificial Sequence
  Description of Artificial Sequence: Synthetic polypeptide
DEDEIRTTNPVAYEQWGSVSGDNDNQQQRGNEDS

SEQ ID NO: 114301 - protein, 33 aa, Artificial Sequence
  Description of Artificial Sequence: Synthetic polypeptide
DEAEIATTNPVATCQYGCVCSTMALQNFGSNQS

SEQ ID NO: 114302 - protein, 36 aa, Artificial Sequence
  Description of Artificial Sequence: Synthetic polypeptide
DEEEIRTTNPVATEQYGSVSPTAPQLIQVQGELQSI

SEQ ID NO: 114303 - protein, 34 aa, Artificial Sequence
  Description of Artificial Sequence: Synthetic polypeptide
DEEEIRTTNPVATEQYGSVSWSLMAEVNTMINAM

SEQ ID NO: 114304 - protein, 35 aa, Artificial Sequence
  Description of Artificial Sequence: Synthetic polypeptide
DEEEIRTTNPVATEQYGSAQQVMTELQEVISLANL

SEQ ID NO: 114305 - protein, 33 aa, Artificial Sequence
  Description of Artificial Sequence: Synthetic polypeptide
DEDEIRTTNPVAYEQWGSVCSTTDQGDTQGGGR

SEQ ID NO: 114306 - protein, 33 aa, Artificial Sequence
  Description of Artificial Sequence: Synthetic polypeptide
DEEEIRTTNPVATEQYGSANSCYNDDDMSNEMM

SEQ ID NO: 114307 - protein, 32 aa, Artificial Sequence
  Description of Artificial Sequence: Synthetic polypeptide
DEDEIRTTNPVAYEQWGSVCSTVDQGDTGGGA

SEQ ID NO: 114308 - protein, 35 aa, Artificial Sequence
  Description of Artificial Sequence: Synthetic polypeptide
DEDEIRTTNPVAYEQWGSVCVTENGLTQDSGGDNR

SEQ ID NO: 114309 - protein, 34 aa, Artificial Sequence
  Description of Artificial Sequence: Synthetic polypeptide
DEEEIRTTNPVATEQYGSANSHILDDDVRSNEQM

SEQ ID NO: 114310 - protein, 32 aa, Artificial Sequence
  Description of Artificial Sequence: Synthetic polypeptide
DEEEIRTTNPVATEQYGSANSILDDDSSNEMN

SEQ ID NO: 114311 - protein, 32 aa, Artificial Sequence
  Description of Artificial Sequence: Synthetic polypeptide
DEDEIRTTNPVAYEQWGSVCYNNDGGNGHGQR

SEQ ID NO: 114312 - protein, 36 aa, Artificial Sequence
  Description of Artificial Sequence: Synthetic polypeptide
DEEEIRTTNPVATEQYGSVSWPINLGVIDNQVANTN

SEQ ID NO: 114313 - protein, 35 aa, Artificial Sequence
  Description of Artificial Sequence: Synthetic polypeptide
DEEEIRTTNPVATEQYGSVSWPNKHSSETPMGSRN

SEQ ID NO: 114314 - protein, 35 aa, Artificial Sequence
  Description of Artificial Sequence: Synthetic polypeptide
DEEEIRTTNPVATEQYGSAPPTNIGLNVFGQVNGN

SEQ ID NO: 114315 - protein, 34 aa, Artificial Sequence
  Description of Artificial Sequence: Synthetic polypeptide
DEEEIRTTNPVATEVYGSVVGFGNLEDGENVNID

SEQ ID NO: 114316 - protein, 34 aa, Artificial Sequence
  Description of Artificial Sequence: Synthetic polypeptide
DEEEIRTTNPVATEVYGSVVGFGNLEDGEEVGNI

SEQ ID NO: 114317 - protein, 32 aa, Artificial Sequence
  Description of Artificial Sequence: Synthetic polypeptide
DEAEIATTNPVAHEQYGSVSATDLEDHEGEDL

SEQ ID NO: 114318 - protein, 35 aa, Artificial Sequence
  Description of Artificial Sequence: Synthetic polypeptide
DEEEIRTTNPVATEVYGSVSVGMGNTQNGEGNGEG

SEQ ID NO: 114319 - protein, 34 aa, Artificial Sequence
  Description of Artificial Sequence: Synthetic polypeptide
DEEEIRTTNPVATEQYGSAQQVMGELQEVMLANL

SEQ ID NO: 114320 - protein, 32 aa, Artificial Sequence
  Description of Artificial Sequence: Synthetic polypeptide
DEEEIRTTNPVATEQYGSVSWPQAETTDEEMI

SEQ ID NO: 114321 - protein, 34 aa, Artificial Sequence
  Description of Artificial Sequence: Synthetic polypeptide
DEEEIRTTNPVATEQYGSVSWPVGLIETMVGQTV

SEQ ID NO: 114322 - protein, 36 aa, Artificial Sequence
  Description of Artificial Sequence: Synthetic polypeptide
DEEEIRTTNPVATEQYGSVSPNLNMMMQEEGEEEVD

SEQ ID NO: 114323 - protein, 32 aa, Artificial Sequence
  Description of Artificial Sequence: Synthetic polypeptide
DEEEIRTTNPVATEQYGSVSYLEIYVEDEMGT

SEQ ID NO: 114324 - protein, 34 aa, Artificial Sequence
  Description of Artificial Sequence: Synthetic polypeptide
DEEEIRTTNPVATEQYGSVSYMNPMNNTIEVDNG

SEQ ID NO: 114325 - protein, 34 aa, Artificial Sequence
  Description of Artificial Sequence: Synthetic polypeptide
DEEEIRTTNPVATEQYGSAVDPTPDQQMPLENED

SEQ ID NO: 114326 - protein, 35 aa, Artificial Sequence
  Description of Artificial Sequence: Synthetic polypeptide
DEEEIRTTNPVATEQYGSVSPDENHPQPTNEVDQQ

SEQ ID NO: 114327 - protein, 34 aa, Artificial Sequence
  Description of Artificial Sequence: Synthetic polypeptide
DEEEIRTTNPVATEQYGSCNAVDNANQLQPNEQQ

SEQ ID NO: 114328 - protein, 35 aa, Artificial Sequence
  Description of Artificial Sequence: Synthetic polypeptide
DEEEIRTTNPVATEQYGSVSPDEHLEQPTNEVDQQ

SEQ ID NO: 114329 - protein, 36 aa, Artificial Sequence
  Description of Artificial Sequence: Synthetic polypeptide
DEEEIRTTNPVATEQYGSVSPDDNLQQPTENEVDQQ

SEQ ID NO: 114330 - protein, 36 aa, Artificial Sequence
  Description of Artificial Sequence: Synthetic polypeptide
DEEEIRTTNPVATEQYGSVSPDCENLNQPTNEVDQQ

SEQ ID NO: 114331 - protein, 36 aa, Artificial Sequence
  Description of Artificial Sequence: Synthetic polypeptide
DEEEIRTTNPVATEQYGSVSYYTPAGPNMRNGMNPV

SEQ ID NO: 114332 - protein, 35 aa, Artificial Sequence
  Description of Artificial Sequence: Synthetic polypeptide
DEEEIRTTNPVATEQYGSVSPCLWLQQIIHEEIRE

SEQ ID NO: 114333 - protein, 35 aa, Artificial Sequence
  Description of Artificial Sequence: Synthetic polypeptide
DEEEIRTTNPVATEQYGSCNASVLDANQLQDNERF

SEQ ID NO: 114334 - protein, 36 aa, Artificial Sequence
  Description of Artificial Sequence: Synthetic polypeptide
DEEEIRTTNPVATEQYGSVSPCEENLGEQMLVMGGQ

SEQ ID NO: 114335 - protein, 36 aa, Artificial Sequence
  Description of Artificial Sequence: Synthetic polypeptide
DEEEIRTTNPVATEQYGSVSPASNLYQPTENEDDQQ

SEQ ID NO: 114336 - protein, 34 aa, Artificial Sequence
  Description of Artificial Sequence: Synthetic polypeptide
DEEEIRTTNPVATEQYGSCNAVLYANQLQPNEQF

SEQ ID NO: 114337 - protein, 34 aa, Artificial Sequence
  Description of Artificial Sequence: Synthetic polypeptide
DEEEIRTTNPVATEQYGSVSPASNAPDDQFMMDD

SEQ ID NO: 114338 - protein, 35 aa, Artificial Sequence
  Description of Artificial Sequence: Synthetic polypeptide
DEEEIRTTNPVATEQYGSVTDDNNDEQNEGGNDQE

SEQ ID NO: 114339 - protein, 35 aa, Artificial Sequence
  Description of Artificial Sequence: Synthetic polypeptide
DEEEIRTTNPVATEQYGSVTDDNNDQEDEGGNDQE

SEQ ID NO: 114340 - protein, 34 aa, Artificial Sequence
  Description of Artificial Sequence: Synthetic polypeptide
DEDEIRTTNPVAYEQYGTVSTTNAQGNAGENSMQ

SEQ ID NO: 114341 - protein, 34 aa, Artificial Sequence
  Description of Artificial Sequence: Synthetic polypeptide
DEEEIRTTNPVATEQYGSVSPAPNAPEDQIMMED

SEQ ID NO: 114342 - protein, 35 aa, Artificial Sequence
  Description of Artificial Sequence: Synthetic polypeptide
DEEEIRTTNPVATEQYGSVTAGNLQELGQDEGGGI

SEQ ID NO: 114343 - protein, 34 aa, Artificial Sequence
  Description of Artificial Sequence: Synthetic polypeptide
DEEEIRTTNPVATEQYGSVSPAPHQVTHVDMERE

SEQ ID NO: 114344 - protein, 33 aa, Artificial Sequence
  Description of Artificial Sequence: Synthetic polypeptide
DEDEIRTTNPVAYEQYGTVATVGGNLPDEGGNE

SEQ ID NO: 114345 - protein, 33 aa, Artificial Sequence
  Description of Artificial Sequence: Synthetic polypeptide
DEDEIRTTNPVAYEQYGTVATGNGQQQDAGNQS

SEQ ID NO: 114346 - protein, 33 aa, Artificial Sequence
  Description of Artificial Sequence: Synthetic polypeptide
DEDEIRTTNPVAYEQWGVVVPTDNGDQAEGGNR

SEQ ID NO: 114347 - protein, 34 aa, Artificial Sequence
  Description of Artificial Sequence: Synthetic polypeptide
DEEEIRCTNPVATEQYGCVCSMSNDFQGFGSNQL

SEQ ID NO: 114348 - protein, 35 aa, Artificial Sequence
  Description of Artificial Sequence: Synthetic polypeptide
DEEEIRTTNPVATEQYGSCFSTTVYLEDPGNENEF

SEQ ID NO: 114349 - protein, 36 aa, Artificial Sequence
  Description of Artificial Sequence: Synthetic polypeptide
DEEEIRTTNPVATEQYGSVSYTTPAGPNMRNGMNPV

SEQ ID NO: 114350 - protein, 35 aa, Artificial Sequence
  Description of Artificial Sequence: Synthetic polypeptide
DEEEIRTTNPVATEQYGSVSPEMNELTVRESVEME

SEQ ID NO: 114351 - protein, 33 aa, Artificial Sequence
  Description of Artificial Sequence: Synthetic polypeptide
DEEEIRTTNPVATEQYGSCGVSFKENQELVVVV

SEQ ID NO: 114352 - protein, 34 aa, Artificial Sequence
  Description of Artificial Sequence: Synthetic polypeptide
DEEEIRTTNPVATEQYGSVSPEILEVTQMLPSTE

SEQ ID NO: 114353 - protein, 34 aa, Artificial Sequence
  Description of Artificial Sequence: Synthetic polypeptide
DEDEIRTTNPVAYEQYGTVATNLNGQQDAGGNQS

SEQ ID NO: 114354 - protein, 34 aa, Artificial Sequence
  Description of Artificial Sequence: Synthetic polypeptide
DEEEIRTTNPVATEQYGSVSPEGENLEMLVMEGQ

SEQ ID NO: 114355 - protein, 37 aa, Artificial Sequence
  Description of Artificial Sequence: Synthetic polypeptide
DEEEIRTTNPVATEQYGSVSPDTSNLYQPTENEVDQH

SEQ ID NO: 114356 - protein, 36 aa, Artificial Sequence
  Description of Artificial Sequence: Synthetic polypeptide
DEEEIRTTNPVATEQYGSVSPDSNLPQPTENEVDQN

SEQ ID NO: 114357 - protein, 34 aa, Artificial Sequence
  Description of Artificial Sequence: Synthetic polypeptide
DEEEIRTTNPVATEQYGSCIQSPNEQPRLTEMQD

SEQ ID NO: 114358 - protein, 36 aa, Artificial Sequence
  Description of Artificial Sequence: Synthetic polypeptide
DEEEIRTTNPVATEQYGSVSPDSNLMQPTMNEVDSQ

SEQ ID NO: 114359 - protein, 36 aa, Artificial Sequence
  Description of Artificial Sequence: Synthetic polypeptide
DEEEIRTTNPVATEQYGSVSPDSNLEQPTLNEVDQQ

SEQ ID NO: 114360 - protein, 35 aa, Artificial Sequence
  Description of Artificial Sequence: Synthetic polypeptide
DEEEIRTTNPVATEQYGSVSPDNMMMQESGEEEDE

SEQ ID NO: 114361 - protein, 33 aa, Artificial Sequence
  Description of Artificial Sequence: Synthetic polypeptide
DEDEIRTTNPVAYEQYGTVATGLNGQQDAGNQY

SEQ ID NO: 114362 - protein, 35 aa, Artificial Sequence
  Description of Artificial Sequence: Synthetic polypeptide
DEEEIRTTNPVATEQYGSVSPDVNLWPPTNEVDQQ

SEQ ID NO: 114363 - protein, 34 aa, Artificial Sequence
  Description of Artificial Sequence: Synthetic polypeptide
DEEEIRTTNPVATEQYGSVSPANMVVTIEVENDS

SEQ ID NO: 114364 - protein, 33 aa, Artificial Sequence
  Description of Artificial Sequence: Synthetic polypeptide
DEDEIRTTNPVAYEQYGTVVSGDNNQEHGNTTA

SEQ ID NO: 114365 - protein, 34 aa, Artificial Sequence
  Description of Artificial Sequence: Synthetic polypeptide
DEDEIRTTNPVAYEQYGTVVSGDNNQNEHGNTRN

SEQ ID NO: 114366 - protein, 36 aa, Artificial Sequence
  Description of Artificial Sequence: Synthetic polypeptide
DEEEIRTTNPVATEQYGSVSNTTPLGPNMGNGNNPV

SEQ ID NO: 114367 - protein, 36 aa, Artificial Sequence
  Description of Artificial Sequence: Synthetic polypeptide
DEEEIRTTNPVATEQYGSVSNTTPDGPNMGNGMNFV

SEQ ID NO: 114368 - protein, 36 aa, Artificial Sequence
  Description of Artificial Sequence: Synthetic polypeptide
DEEEIRTTNPVATEQYGSVSNTTPDGPNMGNGDNDD

SEQ ID NO: 114369 - protein, 36 aa, Artificial Sequence
  Description of Artificial Sequence: Synthetic polypeptide
DEEEIRTTNPVATEQYGSVSNTTPAGPNRRNGMNPV

SEQ ID NO: 114370 - protein, 36 aa, Artificial Sequence
  Description of Artificial Sequence: Synthetic polypeptide
DEEEIRTTNPVATEQYGSVSNTTPAGPNMRNGMNPV

SEQ ID NO: 114371 - protein, 35 aa, Artificial Sequence
  Description of Artificial Sequence: Synthetic polypeptide
DEEEIRCTNPVATEPYGSTVSTTGNEHSQMVGNMN

SEQ ID NO: 114372 - protein, 36 aa, Artificial Sequence
  Description of Artificial Sequence: Synthetic polypeptide
DEEEIRTTNPVATEQYGSVSNTSMDMLEPQSTQNHI

SEQ ID NO: 114373 - protein, 33 aa, Artificial Sequence
  Description of Artificial Sequence: Synthetic polypeptide
DEEEIRTTNPVATEQYGSCNNSNDSEGNDEIQG

SEQ ID NO: 114374 - protein, 33 aa, Artificial Sequence
  Description of Artificial Sequence: Synthetic polypeptide
DEDEIVTTNPVATEQYGTVCSATDGQVEFEGND

SEQ ID NO: 114375 - protein, 36 aa, Artificial Sequence
  Description of Artificial Sequence: Synthetic polypeptide
DEAEIRTTNPVATEQYGKVVSCTNMLSHRTSFNNRD

SEQ ID NO: 114376 - protein, 32 aa, Artificial Sequence
  Description of Artificial Sequence: Synthetic polypeptide
DEDTIRTTNPVATEQYGQVVNIMNGQGGDNDT

SEQ ID NO: 114377 - protein, 32 aa, Artificial Sequence
  Description of Artificial Sequence: Synthetic polypeptide
DEDVIHTTNPVATEQYGCVELTNNEQGGGCNN

SEQ ID NO: 114378 - protein, 32 aa, Artificial Sequence
  Description of Artificial Sequence: Synthetic polypeptide
DEDVINTTNPVATEQYGCVELTNNGWQGGCNN

SEQ ID NO: 114379 - protein, 32 aa, Artificial Sequence
  Description of Artificial Sequence: Synthetic polypeptide
DEDVINTTNPVATEQYGCVELTNVEQWGGCNN

SEQ ID NO: 114380 - protein, 33 aa, Artificial Sequence
  Description of Artificial Sequence: Synthetic polypeptide
DEDVIRTTNPVATEQYNGLCVELTNNPQGGTNN

SEQ ID NO: 114381 - protein, 34 aa, Artificial Sequence
  Description of Artificial Sequence: Synthetic polypeptide
DEEEIRTTNPVATEQYGSVTGDGENQNEGNGNTT

SEQ ID NO: 114382 - protein, 33 aa, Artificial Sequence
  Description of Artificial Sequence: Synthetic polypeptide
DEEEIRTTNPVATEQYGSCNTEPTMLDQEQEIN

SEQ ID NO: 114383 - protein, 34 aa, Artificial Sequence
  Description of Artificial Sequence: Synthetic polypeptide
DEEEIRTTNPVATEQYGSVSNTVHWLELFTSQQE

SEQ ID NO: 114384 - protein, 34 aa, Artificial Sequence
  Description of Artificial Sequence: Synthetic polypeptide
DEEEIRTTNPVATEQYGSVTDTVNGFGQTEEQGE

SEQ ID NO: 114385 - protein, 32 aa, Artificial Sequence
  Description of Artificial Sequence: Synthetic polypeptide
DEDEIRTTNPVAYESWGSVSTTNGPHSGGNDF

SEQ ID NO: 114386 - protein, 34 aa, Artificial Sequence
  Description of Artificial Sequence: Synthetic polypeptide
DEDEIRTTNPVAYEQYGTVVSGDNQQGEQGNGRA

SEQ ID NO: 114387 - protein, 35 aa, Artificial Sequence
  Description of Artificial Sequence: Synthetic polypeptide
DEEEIRTTNPVATEQYGSVTDGEGNLNQENGGEIA

SEQ ID NO: 114388 - protein, 36 aa, Artificial Sequence
  Description of Artificial Sequence: Synthetic polypeptide
DEEEIRTTNPVATEQYGSVTDGEGNLNQNDEGNIQE

SEQ ID NO: 114389 - protein, 36 aa, Artificial Sequence
  Description of Artificial Sequence: Synthetic polypeptide
DEEEIRTTNPVATEQYGSVTDTDNMDQGGGGETNAT

SEQ ID NO: 114390 - protein, 35 aa, Artificial Sequence
  Description of Artificial Sequence: Synthetic polypeptide
DEEEIRTTNPVATEQYGSVTDTMNNDQGEDDENED

SEQ ID NO: 114391 - protein, 35 aa, Artificial Sequence
  Description of Artificial Sequence: Synthetic polypeptide
DEEEIRTTNPVATEQYGSVSPAMLHQVTHVDMQRQ

SEQ ID NO: 114392 - protein, 36 aa, Artificial Sequence
  Description of Artificial Sequence: Synthetic polypeptide
DEEEIRTTNPVATEQYGSVTDTMNVGQQGENANDQY

SEQ ID NO: 114393 - protein, 34 aa, Artificial Sequence
  Description of Artificial Sequence: Synthetic polypeptide
DEEEIRTTNPVATEQYGSVSPAITAPDDQIMEED

SEQ ID NO: 114394 - protein, 36 aa, Artificial Sequence
  Description of Artificial Sequence: Synthetic polypeptide
DEEEIRTTNPVATEQYGSVSPAINLGVIDNQVANPN

SEQ ID NO: 114395 - protein, 33 aa, Artificial Sequence
  Description of Artificial Sequence: Synthetic polypeptide
DEEEIRTTNPVATEQYGSCNGELEDDNGSNNIQ

SEQ ID NO: 114396 - protein, 33 aa, Artificial Sequence
  Description of Artificial Sequence: Synthetic polypeptide
DEEEIRTTNPVATEQYGSCNGELEDDQGSNTDQ

SEQ ID NO: 114397 - protein, 35 aa, Artificial Sequence
  Description of Artificial Sequence: Synthetic polypeptide
DEEEIRTTNPVATEQYGSVSPAENVAQPTNEVDQQ

SEQ ID NO: 114398 - protein, 33 aa, Artificial Sequence
  Description of Artificial Sequence: Synthetic polypeptide
DEEEIRTTNPVATEQYGSVSPAADSEVEGLDDN

SEQ ID NO: 114399 - protein, 34 aa, Artificial Sequence
  Description of Artificial Sequence: Synthetic polypeptide
DEEEIRTTNPVATEQYGSVSNWGNLVEPEAVEEE

SEQ ID NO: 114400 - protein, 33 aa, Artificial Sequence
  Description of Artificial Sequence: Synthetic polypeptide
DEEEIRTTNPVATEQYGSVSNWDADQLVLEMHY

SEQ ID NO: 114401 - protein, 33 aa, Artificial Sequence
  Description of Artificial Sequence: Synthetic polypeptide
DEDEIRTTNPVAYESWGSVATNLNQGDAGQNKP

SEQ ID NO: 114402 - protein, 36 aa, Artificial Sequence
  Description of Artificial Sequence: Synthetic polypeptide
DEEEIRTTNPVATEQYGSVSNTYDPGNDVTFNGNNE

SEQ ID NO: 114403 - protein, 35 aa, Artificial Sequence
  Description of Artificial Sequence: Synthetic polypeptide
DEEEIRTTNPVATEQYGSVSYTPLMDTHTGSFSKL

SEQ ID NO: 114404 - protein, 33 aa, Artificial Sequence
  Description of Artificial Sequence: Synthetic polypeptide
DEEAEIATTNPVAYEQWGVVVITNDQHHGGNER

SEQ ID NO: 114405 - protein, 35 aa, Artificial Sequence
  Description of Artificial Sequence: Synthetic polypeptide
DEEEIRTTNPVATEQYGSCCSPTNLMERNDDTQQS

SEQ ID NO: 114406 - protein, 36 aa, Artificial Sequence
  Description of Artificial Sequence: Synthetic polypeptide
DEEEIRTTNPVATEQYGSVSPETPAGPNMRKGMNPV

SEQ ID NO: 114407 - protein, 36 aa, Artificial Sequence
  Description of Artificial Sequence: Synthetic polypeptide
DEEEIRTTNPVATEQYGSVSPMMTPINHLLNEQSGT

SEQ ID NO: 114408 - protein, 33 aa, Artificial Sequence
  Description of Artificial Sequence: Synthetic polypeptide
DEDEIRTTNPVAYEQWGSVSWGNDNNDQGGNDM

SEQ ID NO: 114409 - protein, 32 aa, Artificial Sequence
  Description of Artificial Sequence: Synthetic polypeptide
DEDEIRTTNPVAYEQWGSVTGNPNGNGMGNVR

SEQ ID NO: 114410 - protein, 33 aa, Artificial Sequence
  Description of Artificial Sequence: Synthetic polypeptide
DEDEIRTTNPVAYEQWGSVTSDNLGDNHGGNTV

SEQ ID NO: 114411 - protein, 32 aa, Artificial Sequence
  Description of Artificial Sequence: Synthetic polypeptide
DEEEIRCTNPVATEQYGCVCSSEHDYFGSNNA

SEQ ID NO: 114412 - protein, 33 aa, Artificial Sequence
  Description of Artificial Sequence: Synthetic polypeptide
DEEEIRCTNPVATEQYGCVCSNWNPDGFGSDNQ

SEQ ID NO: 114413 - protein, 33 aa, Artificial Sequence
  Description of Artificial Sequence: Synthetic polypeptide
DEEEIRTTNPVATEQYGSVSYPQGGVMTVASSN

SEQ ID NO: 114414 - protein, 35 aa, Artificial Sequence
  Description of Artificial Sequence: Synthetic polypeptide
DEEEIRTTNPVATEQYGSVSPMNNEQGDLILEERS

SEQ ID NO: 114415 - protein, 35 aa, Artificial Sequence
  Description of Artificial Sequence: Synthetic polypeptide
DEEEIRTTNPVATEQYGSVSPMINESGGAIEELRD

SEQ ID NO: 114416 - protein, 32 aa, Artificial Sequence
  Description of Artificial Sequence: Synthetic polypeptide
DEAEIATTNPVATEPYGSVAGNGLQNSGDSQY

SEQ ID NO: 114417 - protein, 35 aa, Artificial Sequence
  Description of Artificial Sequence: Synthetic polypeptide
DEEEIRTTNPVATEQYGSVSPMENLYPPINEVDQQ

SEQ ID NO: 114418 - protein, 34 aa, Artificial Sequence
  Description of Artificial Sequence: Synthetic polypeptide
DEEEIRCTNPVATEQYGCVCSNTNHQENFGSDQS

SEQ ID NO: 114419 - protein, 34 aa, Artificial Sequence
  Description of Artificial Sequence: Synthetic polypeptide
DEAEIRTTNPVATEQYGSCITVNELEVRNGDIED

SEQ ID NO: 114420 - protein, 34 aa, Artificial Sequence
  Description of Artificial Sequence: Synthetic polypeptide
DEEEIRTTNPVATEQYGSVSYTAGQDSTHFEQIM

SEQ ID NO: 114421 - protein, 32 aa, Artificial Sequence
  Description of Artificial Sequence: Synthetic polypeptide
DEAEIRTTNPVATEQYGSCFTNWLESSTLDVE

SEQ ID NO: 114422 - protein, 33 aa, Artificial Sequence
  Description of Artificial Sequence: Synthetic polypeptide
DEDEIRTTNPVAYEQWGSVVPTDNAGDQGGNNT

SEQ ID NO: 114423 - protein, 35 aa, Artificial Sequence
  Description of Artificial Sequence: Synthetic polypeptide
DEEEIRTTNPVATEQYGSVSPMINESGDQMEELRD

SEQ ID NO: 114424 - protein, 34 aa, Artificial Sequence
  Description of Artificial Sequence: Synthetic polypeptide
DEEEIRTTNPVATEQYGSVSYTDWHSPETIGVQQ

SEQ ID NO: 114425 - protein, 34 aa, Artificial Sequence
  Description of Artificial Sequence: Synthetic polypeptide
DEEEIRTTNPVATEQYGSVSPMNNQNPQQELLVQ

SEQ ID NO: 114426 - protein, 35 aa, Artificial Sequence
  Description of Artificial Sequence: Synthetic polypeptide
DEEEIRTTNPVATEQYGSAVSAHNEDQVENDETQN

SEQ ID NO: 114427 - protein, 35 aa, Artificial Sequence
  Description of Artificial Sequence: Synthetic polypeptide
DEEEIRTTNPVATEQYGSVSYNAPEMADAGSNQFS

SEQ ID NO: 114428 - protein, 33 aa, Artificial Sequence
  Description of Artificial Sequence: Synthetic polypeptide
DEAEIRTTNPVATEQYGSCVSMDWLDQETEDEI

SEQ ID NO: 114429 - protein, 32 aa, Artificial Sequence
  Description of Artificial Sequence: Synthetic polypeptide
DEAEIATTNPVATEIYGSVSATDLEDHEGEDL

SEQ ID NO: 114430 - protein, 35 aa, Artificial Sequence
  Description of Artificial Sequence: Synthetic polypeptide
DEAEIRTTNPVATEQYGSCSVPWMLEDRGGENQRE

SEQ ID NO: 114431 - protein, 34 aa, Artificial Sequence
  Description of Artificial Sequence: Synthetic polypeptide
DEAEIRTTNPVATEQYGSCSTYNLADDRNFEDED

SEQ ID NO: 114432 - protein, 34 aa, Artificial Sequence
  Description of Artificial Sequence: Synthetic polypeptide
DEAEIRTTNPVATEQYGSCSTTNLADDGLFEEED

SEQ ID NO: 114433 - protein, 34 aa, Artificial Sequence
  Description of Artificial Sequence: Synthetic polypeptide
DEDEIRTTNPVAYEQWGSVSTTNAGNQRNDMNMQ

SEQ ID NO: 114434 - protein, 34 aa, Artificial Sequence
  Description of Artificial Sequence: Synthetic polypeptide
DEEEIRTTNPVATEQYGSVSPMNNQQIEQELLSV

SEQ ID NO: 114435 - protein, 33 aa, Artificial Sequence
  Description of Artificial Sequence: Synthetic polypeptide
DEDEIRTTNPVAYEQWGSVSTTNAGTQNDQNMP

SEQ ID NO: 114436 - protein, 34 aa, Artificial Sequence
  Description of Artificial Sequence: Synthetic polypeptide
DEEEIRTTNPVATEQYGSVSPNDMQAQQTVEVGE

SEQ ID NO: 114437 - protein, 33 aa, Artificial Sequence
  Description of Artificial Sequence: Synthetic polypeptide
DEAEIRTTNPVATEQYGSCQVTYANLIRFEVQE

SEQ ID NO: 114438 - protein, 34 aa, Artificial Sequence
  Description of Artificial Sequence: Synthetic polypeptide
DEAEIRTTNPVATEQYGSCNYDSNELQQESGEER

SEQ ID NO: 114439 - protein, 35 aa, Artificial Sequence
  Description of Artificial Sequence: Synthetic polypeptide
DEEEIRTTNPVATEQYGSVSPNAVLQAQQTVETEE

SEQ ID NO: 114440 - protein, 35 aa, Artificial Sequence
  Description of Artificial Sequence: Synthetic polypeptide
DEEEIRTTNPVATEQYGSVSPNANEQGRQTEEEED

SEQ ID NO: 114441 - protein, 34 aa, Artificial Sequence
  Description of Artificial Sequence: Synthetic polypeptide
DEEEIRTTNPVATEQYGSVSPNAMVQAQQTVEGL

SEQ ID NO: 114442 - protein, 35 aa, Artificial Sequence
  Description of Artificial Sequence: Synthetic polypeptide
DEEEIRTTNPVATEQYGSVSPMVNIAGRDLVNLAY

SEQ ID NO: 114443 - protein, 35 aa, Artificial Sequence
  Description of Artificial Sequence: Synthetic polypeptide
DEEEIRTTNPVATEQYGSVSYNNHNQVQQGAILGQ

SEQ ID NO: 114444 - protein, 34 aa, Artificial Sequence
  Description of Artificial Sequence: Synthetic polypeptide
DEAEIRTTNPVATEQYGSASDTQDLNNQDGQEMI

SEQ ID NO: 114445 - protein, 36 aa, Artificial Sequence
  Description of Artificial Sequence: Synthetic polypeptide
DEEEIRTTNPVATEQYGSVSYTGDQDEGGENGNQGD

SEQ ID NO: 114446 - protein, 35 aa, Artificial Sequence
  Description of Artificial Sequence: Synthetic polypeptide
DEEEIRTTNPVATEQYGSVSPLMLNLIQIVEQLPE

SEQ ID NO: 114447 - protein, 34 aa, Artificial Sequence
  Description of Artificial Sequence: Synthetic polypeptide
DEEEIRTTNPVATEQYGSVSPIEDGTQGPNFTGN

SEQ ID NO: 114448 - protein, 34 aa, Artificial Sequence
  Description of Artificial Sequence: Synthetic polypeptide
DEEEIRCTNPVATEQYGCVCSMTNDNQGFNSNTQ

SEQ ID NO: 114449 - protein, 33 aa, Artificial Sequence
  Description of Artificial Sequence: Synthetic polypeptide
DEEEIRTTNPVATEQYGSCAATTDQDSGGSMEN

SEQ ID NO: 114450 - protein, 35 aa, Artificial Sequence
  Description of Artificial Sequence: Synthetic polypeptide
DEEEIRTTNPVATEQYGSVSPHNMMMQSSGEEEVN

SEQ ID NO: 114451 - protein, 34 aa, Artificial Sequence
  Description of Artificial Sequence: Synthetic polypeptide
DEEEIRCTNPVATEQYGCVCSMTNDFQGFGSQQP

SEQ ID NO: 114452 - protein, 32 aa, Artificial Sequence
  Description of Artificial Sequence: Synthetic polypeptide
DEDEIRTTNPVAYEQWGVVCSTDNDGKQNNNS

SEQ ID NO: 114453 - protein, 33 aa, Artificial Sequence
  Description of Artificial Sequence: Synthetic polypeptide
DEDEIRTTNPVAYEQWGVVCSTDNGQQDNGNVI

SEQ ID NO: 114454 - protein, 35 aa, Artificial Sequence
  Description of Artificial Sequence: Synthetic polypeptide
DEEEIRTTNPVATEQYGSAYSTTNEDQVENDEKQF

SEQ ID NO: 114455 - protein, 34 aa, Artificial Sequence
  Description of Artificial Sequence: Synthetic polypeptide
DEEEIRCTNPVATEQYGCVCSMTGNDFQGFISNQ

SEQ ID NO: 114456 - protein, 32 aa, Artificial Sequence
  Description of Artificial Sequence: Synthetic polypeptide
DEDEIRTTNPVAYEQWGVVSGGNLQDHPNEGP

SEQ ID NO: 114457 - protein, 35 aa, Artificial Sequence
  Description of Artificial Sequence: Synthetic polypeptide
DEEEIRTTNPVATEQYGSCASGNEPQNHQDDGNAE

SEQ ID NO: 114458 - protein, 33 aa, Artificial Sequence
  Description of Artificial Sequence: Synthetic polypeptide
DEEEIRTTNPVATEQYGSVSPEVQMLDLTPELN

SEQ ID NO: 114459 - protein, 33 aa, Artificial Sequence
  Description of Artificial Sequence: Synthetic polypeptide
DEDEIRTTNPVAYEQWGVVSTTNHPNDAGNNSR

SEQ ID NO: 114460 - protein, 34 aa, Artificial Sequence
  Description of Artificial Sequence: Synthetic polypeptide
DEEEIRTTNPVATEQYGSVSPEVGLQNQTPELLE

SEQ ID NO: 114461 - protein, 34 aa, Artificial Sequence
  Description of Artificial Sequence: Synthetic polypeptide
DEEEIRCTNPVATEQYGCVCSMTEYDFQGFGSNQ

SEQ ID NO: 114462 - protein, 34 aa, Artificial Sequence
  Description of Artificial Sequence: Synthetic polypeptide
DEEEIRTTNPVATEQYGSVSPEVGLQILDTELLE

SEQ ID NO: 114463 - protein, 34 aa, Artificial Sequence
  Description of Artificial Sequence: Synthetic polypeptide
DEEEIRTTNPVATEQYGSVSPGTAALEMDMEIVT

SEQ ID NO: 114464 - protein, 35 aa, Artificial Sequence
  Description of Artificial Sequence: Synthetic polypeptide
DEEEIRTTNPVATEQYGSAYSTCNEDQVENDEDQS

SEQ ID NO: 114465 - protein, 35 aa, Artificial Sequence
  Description of Artificial Sequence: Synthetic polypeptide
DEEEIRTTNPVATEQYGSAYSTCNEDGQVENDENQ

SEQ ID NO: 114466 - protein, 35 aa, Artificial Sequence
  Description of Artificial Sequence: Synthetic polypeptide
DEEEIRTTNPVATEQYGSVSPILNHLISVGEEYDD

SEQ ID NO: 114467 - protein, 33 aa, Artificial Sequence
  Description of Artificial Sequence: Synthetic polypeptide
DEDEIRTTNPVAYEQWGTVCSTDNGEQDNGNVS

SEQ ID NO: 114468 - protein, 35 aa, Artificial Sequence
  Description of Artificial Sequence: Synthetic polypeptide
DEEEIRTTNPVATEQYGSVSYTIDLGVAVDPAQRE

SEQ ID NO: 114469 - protein, 36 aa, Artificial Sequence
  Description of Artificial Sequence: Synthetic polypeptide
DEEEIRTTNPVATEQYGSAYGSTCNEDQVEGNDEQE

SEQ ID NO: 114470 - protein, 36 aa, Artificial Sequence
  Description of Artificial Sequence: Synthetic polypeptide
DEEEIRTTNPVATEQYGSVSYTINNTQAGDGPEEPI

SEQ ID NO: 114471 - protein, 33 aa, Artificial Sequence
  Description of Artificial Sequence: Synthetic polypeptide
DEAEIATTNPVATEPYGSVSWNENNDQRQGDHQ

SEQ ID NO: 114472 - protein, 33 aa, Artificial Sequence
  Description of Artificial Sequence: Synthetic polypeptide
DEAEIATTNPVATEQWGAVSTNLNGNAGEGMRN

SEQ ID NO: 114473 - protein, 32 aa, Artificial Sequence
  Description of Artificial Sequence: Synthetic polypeptide
DEDEIRTTNPVAYEQWGTVSTNLNGEAGDEGA

SEQ ID NO: 114474 - protein, 36 aa, Artificial Sequence
  Description of Artificial Sequence: Synthetic polypeptide
DEEEIRTTNPVATEQYGSVSPLDDVSAIHNFQEGVR

SEQ ID NO: 114475 - protein, 34 aa, Artificial Sequence
  Description of Artificial Sequence: Synthetic polypeptide
DEEEIRTTNPVATEQYGSVSPISQLPERLLHELG

SEQ ID NO: 114476 - protein, 36 aa, Artificial Sequence
  Description of Artificial Sequence: Synthetic polypeptide
DEEEIRTTNPVATEQYGSVSPISNLYQPTENEVPQQ

SEQ ID NO: 114477 - protein, 34 aa, Artificial Sequence
  Description of Artificial Sequence: Synthetic polypeptide
DEEEIRTTNPVATEQYGSVSPIPDKSQIDNDEEI

SEQ ID NO: 114478 - protein, 34 aa, Artificial Sequence
  Description of Artificial Sequence: Synthetic polypeptide
DEEEIRTTNPVATEQYGSVSPIPDHLVIDNDSVF

SEQ ID NO: 114479 - protein, 35 aa, Artificial Sequence
  Description of Artificial Sequence: Synthetic polypeptide
DEEEIRTTNPVATEQYGSAYPTMNPNQIRVFNNGD

SEQ ID NO: 114480 - protein, 35 aa, Artificial Sequence
  Description of Artificial Sequence: Synthetic polypeptide
DEEEIRTTNPVATEQYGSVSPIPDHLQIMDNDVLI

SEQ ID NO: 114481 - protein, 35 aa, Artificial Sequence
  Description of Artificial Sequence: Synthetic polypeptide
DEEEIRTTNPVATEQYGSAYSPTVNEIQQQEVERY

SEQ ID NO: 114482 - protein, 33 aa, Artificial Sequence
  Description of Artificial Sequence: Synthetic polypeptide
DEDEIRTTNPVAYEQWGTVVPTDNDGQHGQNNR

SEQ ID NO: 114483 - protein, 33 aa, Artificial Sequence
  Description of Artificial Sequence: Synthetic polypeptide
DEEEIRTTNPVATEQYGSVSPIMSDIEEINDNF

SEQ ID NO: 114484 - protein, 34 aa, Artificial Sequence
  Description of Artificial Sequence: Synthetic polypeptide
DEEEIRTTNPVATEQYGSVSPETLEVSQMLPSTN

SEQ ID NO: 114485 - protein, 34 aa, Artificial Sequence
  Description of Artificial Sequence: Synthetic polypeptide
DEEEIRTTNPVATEQYGMVNFENGEQDEGGNEQD

SEQ ID NO: 114486 - protein, 36 aa, Artificial Sequence
  Description of Artificial Sequence: Synthetic polypeptide
DEEEIRTTNPVATEQYGMVISTVENGDQGEGGNINT

SEQ ID NO: 114487 - protein, 34 aa, Artificial Sequence
  Description of Artificial Sequence: Synthetic polypeptide
DEEEIRTTNPVATEQYGMVGVITDGQGEGENDEF

SEQ ID NO: 114488 - protein, 32 aa, Artificial Sequence
  Description of Artificial Sequence: Synthetic polypeptide
DEEEIRTTNPEATEQYGSVPIWLHFSGGEKEP

SEQ ID NO: 114489 - protein, 36 aa, Artificial Sequence
  Description of Artificial Sequence: Synthetic polypeptide
DEEEIRTTNPVATEQYGSVSSTTPAPPNMREGMNPV

SEQ ID NO: 114490 - protein, 36 aa, Artificial Sequence
  Description of Artificial Sequence: Synthetic polypeptide
DEEEIRTTNPVATEQYGSVSSTTPAPPEMREGMNPV

SEQ ID NO: 114491 - protein, 33 aa, Artificial Sequence
  Description of Artificial Sequence: Synthetic polypeptide
DEEEIRTTNPVAYEQWGEVSWTEHDNRGGGNNP

SEQ ID NO: 114492 - protein, 33 aa, Artificial Sequence
  Description of Artificial Sequence: Synthetic polypeptide
DEEEIRTTNPEATEQYGQCVCPTELARFGSEQA

SEQ ID NO: 114493 - protein, 31 aa, Artificial Sequence
  Description of Artificial Sequence: Synthetic polypeptide
DEEEIRTTNPEATEQYGCVQTEHANFGSDQS

SEQ ID NO: 114494 - protein, 34 aa, Artificial Sequence
  Description of Artificial Sequence: Synthetic polypeptide
DEEEIRTTNPVATEQYGCVSTDDGDQQEEGGGEG

SEQ ID NO: 114495 - protein, 36 aa, Artificial Sequence
  Description of Artificial Sequence: Synthetic polypeptide
DEEEIRTTNPVATEQYGSVSSTTPAPPNMRNGMNPV

SEQ ID NO: 114496 - protein, 32 aa, Artificial Sequence
  Description of Artificial Sequence: Synthetic polypeptide
DEEEIRTTNPEATEQYGCVCPTGELAHFGSEQ

SEQ ID NO: 114497 - protein, 34 aa, Artificial Sequence
  Description of Artificial Sequence: Synthetic polypeptide
DEEEIRTTNPVATEQYGSVSVQPNDIQQTISVEE

SEQ ID NO: 114498 - protein, 33 aa, Artificial Sequence
  Description of Artificial Sequence: Synthetic polypeptide
DEEEIRTTNPEATEQYGCVCPTELASFGSDNQS

SEQ ID NO: 114499 - protein, 32 aa, Artificial Sequence
  Description of Artificial Sequence: Synthetic polypeptide
DEEEIRTTNPEATEQYGCVCPTEHARFGSEQN

SEQ ID NO: 114500 - protein, 31 aa, Artificial Sequence
  Description of Artificial Sequence: Synthetic polypeptide
DEEEIRTTNPEATEQYGCVCPSELASFGSEQ

SEQ ID NO: 114501 - protein, 34 aa, Artificial Sequence
  Description of Artificial Sequence: Synthetic polypeptide
DEAEIRTTNPVATEQYGSVHTPNLNTEHDEENFN

SEQ ID NO: 114502 - protein, 33 aa, Artificial Sequence
  Description of Artificial Sequence: Synthetic polypeptide
DEAEIRTTNPVATEQYGSVHTNDLNNESDEEQN

SEQ ID NO: 114503 - protein, 34 aa, Artificial Sequence
  Description of Artificial Sequence: Synthetic polypeptide
DEEEIRTTNPVATEQYGCVSTEDHNQERFMSEQS

SEQ ID NO: 114504 - protein, 34 aa, Artificial Sequence
  Description of Artificial Sequence: Synthetic polypeptide
DEEEIRTTNPVAYEQWGETVRMTNDHTQRGLDRD

SEQ ID NO: 114505 - protein, 33 aa, Artificial Sequence
  Description of Artificial Sequence: Synthetic polypeptide
DEEEIRTTNPVATEQYGCVSTEDHQEYFMSQQA

SEQ ID NO: 114506 - protein, 31 aa, Artificial Sequence
  Description of Artificial Sequence: Synthetic polypeptide
DEEEIRTTNPEATEQYGSVPIWSHFSGEKEN

SEQ ID NO: 114507 - protein, 33 aa, Artificial Sequence
  Description of Artificial Sequence: Synthetic polypeptide
DEEEIRTTNPVATEQYGSVSVPVGLIETEVQTV

SEQ ID NO: 114508 - protein, 36 aa, Artificial Sequence
  Description of Artificial Sequence: Synthetic polypeptide
DEEEIRTTNPVATEQYGSVSSTTPASPNMRNGMNPV

SEQ ID NO: 114509 - protein, 36 aa, Artificial Sequence
  Description of Artificial Sequence: Synthetic polypeptide
DEEEIRTTNPVAYEQWGHSTVSCTNALSVRPGGNVC

SEQ ID NO: 114510 - protein, 34 aa, Artificial Sequence
  Description of Artificial Sequence: Synthetic polypeptide
DEEEIRTTNPVAYEQWGHSNVSLPNEDQHRPGGF

SEQ ID NO: 114511 - protein, 34 aa, Artificial Sequence
  Description of Artificial Sequence: Synthetic polypeptide
DEEEIRTTNPEATEQYGSVSSPTEAQVEADEGDF

SEQ ID NO: 114512 - protein, 36 aa, Artificial Sequence
  Description of Artificial Sequence: Synthetic polypeptide
DEEEIRTTNPVATEQYGSVSSTTPARPNMRNGMNPV

SEQ ID NO: 114513 - protein, 37 aa, Artificial Sequence
  Description of Artificial Sequence: Synthetic polypeptide
DEEEIRTTNPVATEQYGSVSSTTPARGPNMRNGMNPV

SEQ ID NO: 114514 - protein, 33 aa, Artificial Sequence
  Description of Artificial Sequence: Synthetic polypeptide
DEEEIRTTNPEATEQYGSVPRVWQEATRFEGKE

SEQ ID NO: 114515 - protein, 34 aa, Artificial Sequence
  Description of Artificial Sequence: Synthetic polypeptide
DEEEIRTTNPVAYEQWGEYWSQRNDDLQRGERDR

SEQ ID NO: 114516 - protein, 33 aa, Artificial Sequence
  Description of Artificial Sequence: Synthetic polypeptide
DEEEIRTTNPEATEQYGSVPRTWLEATGFQGKE

SEQ ID NO: 114517 - protein, 33 aa, Artificial Sequence
  Description of Artificial Sequence: Synthetic polypeptide
DEEEIRTTNPEATEQYGSVPRTWLASRMEEKIE

SEQ ID NO: 114518 - protein, 34 aa, Artificial Sequence
  Description of Artificial Sequence: Synthetic polypeptide
DEEEIRTTNPVAYEQWGHNNVSYTNEDQHRPGGS

SEQ ID NO: 114519 - protein, 37 aa, Artificial Sequence
  Description of Artificial Sequence: Synthetic polypeptide
DEEEIRTTNPVATEQYGSVSSTTPAQGPNMRNGMNPV

SEQ ID NO: 114520 - protein, 33 aa, Artificial Sequence
  Description of Artificial Sequence: Synthetic polypeptide
DEEEIRTTNPEATEQYGSVPRTHWLATSEGKQE

SEQ ID NO: 114521 - protein, 34 aa, Artificial Sequence
  Description of Artificial Sequence: Synthetic polypeptide
DEEEIRTTNPVATEQYGSVSVPQVGVMTVAVSNE

SEQ ID NO: 114522 - protein, 32 aa, Artificial Sequence
  Description of Artificial Sequence: Synthetic polypeptide
DEEEIRTTNPEATEQYGSVPRSWLPALGEKIE

SEQ ID NO: 114523 - protein, 37 aa, Artificial Sequence
  Description of Artificial Sequence: Synthetic polypeptide
DEEEIRTTNPVATEQYGSVSSTTPAQGPNMRIGMNPV

SEQ ID NO: 114524 - protein, 36 aa, Artificial Sequence
  Description of Artificial Sequence: Synthetic polypeptide
DEEEIRTTNPVATEQYGSVSSTTPAQPNMRNHMNPV

SEQ ID NO: 114525 - protein, 32 aa, Artificial Sequence
  Description of Artificial Sequence: Synthetic polypeptide
DEEEIRTTNPEATQQYGEVCTIDQGQQGMNKK

SEQ ID NO: 114526 - protein, 34 aa, Artificial Sequence
  Description of Artificial Sequence: Synthetic polypeptide
DEEEIRTTNPEATEHYGSVPRTWNLEATRFEGKE

SEQ ID NO: 114527 - protein, 33 aa, Artificial Sequence
  Description of Artificial Sequence: Synthetic polypeptide
DEEEIRTTNPEATDQYGQVCCCDQDQKRGENDR

SEQ ID NO: 114528 - protein, 28 aa, Artificial Sequence
  Description of Artificial Sequence: Synthetic peptide
DEEEIRTTNPCAYMQYGQVPADLTHDAF

SEQ ID NO: 114529 - protein, 33 aa, Artificial Sequence
  Description of Artificial Sequence: Synthetic polypeptide
DEEEIRTTNPVAYEQWGCCVWQTNDHHQRGGIV

SEQ ID NO: 114530 - protein, 30 aa, Artificial Sequence
  Description of Artificial Sequence: Synthetic polypeptide
DEEEIRTTNPCAYMPYGQVPTADLQHDANF

SEQ ID NO: 114531 - protein, 29 aa, Artificial Sequence
  Description of Artificial Sequence: Synthetic peptide
DEEEIRTTNPCAYMPYGQTPTDLQHGAEF

SEQ ID NO: 114532 - protein, 36 aa, Artificial Sequence
  Description of Artificial Sequence: Synthetic polypeptide
DEEEIRTTNPVATEQYGSVSSTTPAIPNMANGMNPV

SEQ ID NO: 114533 - protein, 33 aa, Artificial Sequence
  Description of Artificial Sequence: Synthetic polypeptide
DEEEIRTTNPCAYESYGSVAYTNEHSGRFGGNA

SEQ ID NO: 114534 - protein, 37 aa, Artificial Sequence
  Description of Artificial Sequence: Synthetic polypeptide
DEEEIRTTNPVATEQYGSVSSTTPAIGQNMRLGMNPV

SEQ ID NO: 114535 - protein, 36 aa, Artificial Sequence
  Description of Artificial Sequence: Synthetic polypeptide
DEEEIRTTNPVATEQYGSVSSTTPAIPNMRNGMNPV

SEQ ID NO: 114536 - protein, 34 aa, Artificial Sequence
  Description of Artificial Sequence: Synthetic polypeptide
DEEEIRTTNPVAYEQFGQSVVFCTAALLRGGNNS

SEQ ID NO: 114537 - protein, 37 aa, Artificial Sequence
  Description of Artificial Sequence: Synthetic polypeptide
DEEEIRTTNPVATEQYGSVSSTTPAIGLNMRNGMNPV

SEQ ID NO: 114538 - protein, 33 aa, Artificial Sequence
  Description of Artificial Sequence: Synthetic polypeptide
DEEEIRTTNPVAYEQFGQSVVACTYALLNVGNS

SEQ ID NO: 114539 - protein, 36 aa, Artificial Sequence
  Description of Artificial Sequence: Synthetic polypeptide
DEEEIRTTNPVATEQYGSVSSTTPAHRNMRNGMNPV

SEQ ID NO: 114540 - protein, 36 aa, Artificial Sequence
  Description of Artificial Sequence: Synthetic polypeptide
DEEEIRTTNPVATEQYGSVSSTTPAHPNMRNGMNWV

SEQ ID NO: 114541 - protein, 36 aa, Artificial Sequence
  Description of Artificial Sequence: Synthetic polypeptide
DEEEIRTTNPVATEQYGSVSSTTPAHPNMRNGMNPV

SEQ ID NO: 114542 - protein, 33 aa, Artificial Sequence
  Description of Artificial Sequence: Synthetic polypeptide
DEEEIRTTNPCAYEQWGSVYCTDNDQARGGDHA

SEQ ID NO: 114543 - protein, 36 aa, Artificial Sequence
  Description of Artificial Sequence: Synthetic polypeptide
DEEEIRTTNPVATEQYGSVSSTTPAHPNMRLGMNPV

SEQ ID NO: 114544 - protein, 34 aa, Artificial Sequence
  Description of Artificial Sequence: Synthetic polypeptide
DEEEIRTTNPCAYEQWGSVYCTDNDQHREGHDRA

SEQ ID NO: 114545 - protein, 36 aa, Artificial Sequence
  Description of Artificial Sequence: Synthetic polypeptide
DEEEIRTTNPVATEQYGSVSSTTPAPGNMRNGMNPV

SEQ ID NO: 114546 - protein, 34 aa, Artificial Sequence
  Description of Artificial Sequence: Synthetic polypeptide
DEACIRTTNPVATEQYGKTVWYTNELATGEGGNR

SEQ ID NO: 114547 - protein, 36 aa, Artificial Sequence
  Description of Artificial Sequence: Synthetic polypeptide
DEEEIRTTNPVATEQYGSVSSTTPAKPNMRNGMNPV

SEQ ID NO: 114548 - protein, 37 aa, Artificial Sequence
  Description of Artificial Sequence: Synthetic polypeptide
DEEEIRTTNPVATEQYGSVSSTTPANPNMRNGMNPVE

SEQ ID NO: 114549 - protein, 35 aa, Artificial Sequence
  Description of Artificial Sequence: Synthetic polypeptide
DEEEIRTTNPVAYEQWGESVIEQRNDDLQRGHRER

SEQ ID NO: 114550 - protein, 33 aa, Artificial Sequence
  Description of Artificial Sequence: Synthetic polypeptide
DEEEIRTTNPVAYEQWGCTYSTINPLQDHENNS

SEQ ID NO: 114551 - protein, 37 aa, Artificial Sequence
  Description of Artificial Sequence: Synthetic polypeptide
DEEEIRTTNPVATEQYGSVSSTTPANGPNMRNGMNPV

SEQ ID NO: 114552 - protein, 35 aa, Artificial Sequence
  Description of Artificial Sequence: Synthetic polypeptide
DEEEIRTTNPVAYEQWGCSYNSINDLDQRGNVPTH

SEQ ID NO: 114553 - protein, 35 aa, Artificial Sequence
  Description of Artificial Sequence: Synthetic polypeptide
DEEEIRTTNPVAYEQWGCSYNSINDLDQRGHVERH

SEQ ID NO: 114554 - protein, 32 aa, Artificial Sequence
  Description of Artificial Sequence: Synthetic polypeptide
DEEEIRTTNPEATCQYGCVCPTDDQEYFGSNQ

SEQ ID NO: 114555 - protein, 36 aa, Artificial Sequence
  Description of Artificial Sequence: Synthetic polypeptide
DEEEIRTTNPVATEQYGSVSSTTPAKPNMHLGMNPV

SEQ ID NO: 114556 - protein, 36 aa, Artificial Sequence
  Description of Artificial Sequence: Synthetic polypeptide
DEEEIRTTNPVATEQYGSVSSTTPAMPNVRNGMNPV

SEQ ID NO: 114557 - protein, 36 aa, Artificial Sequence
  Description of Artificial Sequence: Synthetic polypeptide
DEEEIRTTNPVATEQYGSVSSTTPALPNMSNGMNPV

SEQ ID NO: 114558 - protein, 34 aa, Artificial Sequence
  Description of Artificial Sequence: Synthetic polypeptide
DEEEIRTTNPVAYEQWGCSYNIRNDLDQRGHTPR

SEQ ID NO: 114559 - protein, 35 aa, Artificial Sequence
  Description of Artificial Sequence: Synthetic polypeptide
DEEEIRTTNPVATEQYGSVSSTTPALPNMHNGEPV

SEQ ID NO: 114560 - protein, 36 aa, Artificial Sequence
  Description of Artificial Sequence: Synthetic polypeptide
DEEEIRTTNPVATEQYGSVSSTTPALPEDHEGMNPV

SEQ ID NO: 114561 - protein, 36 aa, Artificial Sequence
  Description of Artificial Sequence: Synthetic polypeptide
DEEEIRTTNPVATEQYGSVSSTTPALPEDHEGMNDV

SEQ ID NO: 114562 - protein, 30 aa, Artificial Sequence
  Description of Artificial Sequence: Synthetic polypeptide
DEEEIRTTNPCAYYMQYGQVPTDLQHDAEM

SEQ ID NO: 114563 - protein, 37 aa, Artificial Sequence
  Description of Artificial Sequence: Synthetic polypeptide
DEEEIRTTNPVATEQYGSVSSTTPALGPNMRNGMNPV

SEQ ID NO: 114564 - protein, 36 aa, Artificial Sequence
  Description of Artificial Sequence: Synthetic polypeptide
DEEEIRTTNPVATEQYGSVSSTTPAMPNMRNGMNPV

SEQ ID NO: 114565 - protein, 33 aa, Artificial Sequence
  Description of Artificial Sequence: Synthetic polypeptide
DEEEIRTTNPEATQQYGEVCTIDQQDQQRQGNF

SEQ ID NO: 114566 - protein, 31 aa, Artificial Sequence
  Description of Artificial Sequence: Synthetic polypeptide
DEEEIRTTNPEAYECYGSVPREWLATREGVE

SEQ ID NO: 114567 - protein, 33 aa, Artificial Sequence
  Description of Artificial Sequence: Synthetic polypeptide
DEEEIRTTNPEAYEQWGSVPCTWLSARTGGKNE

SEQ ID NO: 114568 - protein, 36 aa, Artificial Sequence
  Description of Artificial Sequence: Synthetic polypeptide
DEEEIRTTNPVATEQYGSVSSTTPKGPNMRNGMNDV

SEQ ID NO: 114569 - protein, 36 aa, Artificial Sequence
  Description of Artificial Sequence: Synthetic polypeptide
DEEEIRTTNPVATEQYGSVSSTTPIGPNMRNGMNPV

SEQ ID NO: 114570 - protein, 36 aa, Artificial Sequence
  Description of Artificial Sequence: Synthetic polypeptide
DEEEIRTTNPIATEQYGSVSSTTPALPNMRNGMNPV

SEQ ID NO: 114571 - protein, 34 aa, Artificial Sequence
  Description of Artificial Sequence: Synthetic polypeptide
DEEEIRTTNPVATEQYGCVDSNTEEHQNFGSDQA

SEQ ID NO: 114572 - protein, 36 aa, Artificial Sequence
  Description of Artificial Sequence: Synthetic polypeptide
DEEEIRTTNPVATEQYGSVSSTTPIGPNMANGMNPV

SEQ ID NO: 114573 - protein, 35 aa, Artificial Sequence
  Description of Artificial Sequence: Synthetic polypeptide
DEEEIRTTNPIATEQYGSVSATTPAGPNMRNGNPV

SEQ ID NO: 114574 - protein, 36 aa, Artificial Sequence
  Description of Artificial Sequence: Synthetic polypeptide
DEEEIRTTNPVATEQYGSVSSTTPHGSNHRNGMNPV

SEQ ID NO: 114575 - protein, 36 aa, Artificial Sequence
  Description of Artificial Sequence: Synthetic polypeptide
DEEEIRTTNPVATEQYGSVSSTTPKGPNMRNGMNPV

SEQ ID NO: 114576 - protein, 36 aa, Artificial Sequence
  Description of Artificial Sequence: Synthetic polypeptide
DEEEIRTTNPVATEQYGSVSSTTPHGPTTRNGMNPV

SEQ ID NO: 114577 - protein, 36 aa, Artificial Sequence
  Description of Artificial Sequence: Synthetic polypeptide
DEEEIRTTNPVATEQYGSVSSTTPHGPNMRNGNNPV

SEQ ID NO: 114578 - protein, 33 aa, Artificial Sequence
  Description of Artificial Sequence: Synthetic polypeptide
DEEEIRTTNPVATEQYGCVGNGNMNNAEGGNGG

SEQ ID NO: 114579 - protein, 36 aa, Artificial Sequence
  Description of Artificial Sequence: Synthetic polypeptide
DEEEIRTTNPVATEQYGSVSSTTPHGPNMRNGMNPV

SEQ ID NO: 114580 - protein, 36 aa, Artificial Sequence
  Description of Artificial Sequence: Synthetic polypeptide
DEEEIRTTNPVATEQYGSVSSTTPHGPNMRNGMNPA

SEQ ID NO: 114581 - protein, 36 aa, Artificial Sequence
  Description of Artificial Sequence: Synthetic polypeptide
DEEEIRTTNPVATEQYGSVSSTTPHGPNMRNGDNPV

SEQ ID NO: 114582 - protein, 36 aa, Artificial Sequence
  Description of Artificial Sequence: Synthetic polypeptide
DEEEIRTTNPVATEQYGSVSSTTPHGPNARNGGNPV

SEQ ID NO: 114583 - protein, 36 aa, Artificial Sequence
  Description of Artificial Sequence: Synthetic polypeptide
DEEEIRTTNPVATEQYGSVSSTTPGQPEMRNRMNYV

SEQ ID NO: 114584 - protein, 33 aa, Artificial Sequence
  Description of Artificial Sequence: Synthetic polypeptide
DEEEIRTTNPIATEQYGSVCSVDIGFHGDNQDM

SEQ ID NO: 114585 - protein, 33 aa, Artificial Sequence
  Description of Artificial Sequence: Synthetic polypeptide
DEEEIRTTNPVATEQYGCVGTGGDTGGNGNGQQ

SEQ ID NO: 114586 - protein, 33 aa, Artificial Sequence
  Description of Artificial Sequence: Synthetic polypeptide
DEEEIRTTNPIATEQYGSVSVDIGFGHGDNQDD

SEQ ID NO: 114587 - protein, 36 aa, Artificial Sequence
  Description of Artificial Sequence: Synthetic polypeptide
DEEEIRTTNPVATEQYGSVSSTTPMGPNMRNGMNPV

SEQ ID NO: 114588 - protein, 37 aa, Artificial Sequence
  Description of Artificial Sequence: Synthetic polypeptide
DEEEIRTTNPVATEQYGSVSSTTPQQGPNMRNGDGPV

SEQ ID NO: 114589 - protein, 32 aa, Artificial Sequence
  Description of Artificial Sequence: Synthetic polypeptide
DEEEIRTTNPLATEGYGCCCSTNHASFGSNQA

SEQ ID NO: 114590 - protein, 34 aa, Artificial Sequence
  Description of Artificial Sequence: Synthetic polypeptide
DEEEIRTTNPIAYEQYGSVVCTGNEHSDHGDNQR

SEQ ID NO: 114591 - protein, 32 aa, Artificial Sequence
  Description of Artificial Sequence: Synthetic polypeptide
DEEEIRTTNPIAYEQYGSVQPCTGSSARGGSE

SEQ ID NO: 114592 - protein, 35 aa, Artificial Sequence
  Description of Artificial Sequence: Synthetic polypeptide
DEEEIRTTNPIAYEQWGSVVCTGNEFSQNRGDNQR

SEQ ID NO: 114593 - protein, 36 aa, Artificial Sequence
  Description of Artificial Sequence: Synthetic polypeptide
DEEEIRTTNPVATEQYGSVSSTTPQGPNMANGMNPV

SEQ ID NO: 114594 - protein, 36 aa, Artificial Sequence
  Description of Artificial Sequence: Synthetic polypeptide
DEEEIRTTNPVATEQYGSVSSTTPPGPNMRNGPNPV

SEQ ID NO: 114595 - protein, 33 aa, Artificial Sequence
  Description of Artificial Sequence: Synthetic polypeptide
DEEEIRTTNPVATEQYGCVCSWPHQNFGSDFQL

SEQ ID NO: 114596 - protein, 36 aa, Artificial Sequence
  Description of Artificial Sequence: Synthetic polypeptide
DEEEIRTTNPVATEQYGSVSSTTPPGPNMRNGMNPV

SEQ ID NO: 114597 - protein, 32 aa, Artificial Sequence
  Description of Artificial Sequence: Synthetic polypeptide
DEEEIRTTNPIAYEAYGSVIPCTGLSARGGSE

SEQ ID NO: 114598 - protein, 32 aa, Artificial Sequence
  Description of Artificial Sequence: Synthetic polypeptide
DEEEIRTTNPIAYDQYGQVPCTDHSQRGGNNE

SEQ ID NO: 114599 - protein, 34 aa, Artificial Sequence
  Description of Artificial Sequence: Synthetic polypeptide
DEEEIRTTNPIAWEQYGKVPSCINELSTQVQNRA

SEQ ID NO: 114600 - protein, 37 aa, Artificial Sequence
  Description of Artificial Sequence: Synthetic polypeptide
DEEEIRTTNPVATEQYGSVSSTTPNGPNMRNGMNPVS

SEQ ID NO: 114601 - protein, 33 aa, Artificial Sequence
  Description of Artificial Sequence: Synthetic polypeptide
DEEEIRTTNPIATEQYGTVCSATDGPVEFEGND

SEQ ID NO: 114602 - protein, 36 aa, Artificial Sequence
  Description of Artificial Sequence: Synthetic polypeptide
DEEEIRTTNPVATEQYGSVSSTTPMGPNMRNRMNPV

SEQ ID NO: 114603 - protein, 35 aa, Artificial Sequence
  Description of Artificial Sequence: Synthetic polypeptide
DEEEIRTTNPIATEQYGSVSVTNIGFAHMGDNQDD

SEQ ID NO: 114604 - protein, 36 aa, Artificial Sequence
  Description of Artificial Sequence: Synthetic polypeptide
DEEEIRTTNPVATEQYGSVSSTTPNGPNMRNHMNPV

SEQ ID NO: 114605 - protein, 33 aa, Artificial Sequence
  Description of Artificial Sequence: Synthetic polypeptide
DEEEIRTTNPVATEQYGCVGTGGDTGGNGNNQE

SEQ ID NO: 114606 - protein, 36 aa, Artificial Sequence
  Description of Artificial Sequence: Synthetic polypeptide
DEEEIRTTNPVATEQYGSVSSTTPGGVNMRNGMNPV

SEQ ID NO: 114607 - protein, 36 aa, Artificial Sequence
  Description of Artificial Sequence: Synthetic polypeptide
DEEEIRTTNPVATEQYGSVSSTTPGGPNMRNGYNPV

SEQ ID NO: 114608 - protein, 36 aa, Artificial Sequence
  Description of Artificial Sequence: Synthetic polypeptide
DEEEIRTTNPVATEQYGSVSSTTPDGPNMREGMNDV

SEQ ID NO: 114609 - protein, 34 aa, Artificial Sequence
  Description of Artificial Sequence: Synthetic polypeptide
DEEEIRTTNPVATEQYGCVSITLVDAEGGNNEQE

SEQ ID NO: 114610 - protein, 36 aa, Artificial Sequence
  Description of Artificial Sequence: Synthetic polypeptide
DEEEIRTTNPVATEQYGSVSSTTPDGPNMGNGENQG

SEQ ID NO: 114611 - protein, 36 aa, Artificial Sequence
  Description of Artificial Sequence: Synthetic polypeptide
DEEEIRTTNPVATEQYGSVSSTTPDGPNMGNGDNPF

SEQ ID NO: 114612 - protein, 36 aa, Artificial Sequence
  Description of Artificial Sequence: Synthetic polypeptide
DEEEIRTTNPVATEQYGSVSSTTPDGPNMGEGDNDV

SEQ ID NO: 114613 - protein, 36 aa, Artificial Sequence
  Description of Artificial Sequence: Synthetic polypeptide
DEEEIRTTNPVATEQYGSVSSTTPDGPEMREGMNDV

SEQ ID NO: 114614 - protein, 36 aa, Artificial Sequence
  Description of Artificial Sequence: Synthetic polypeptide
DEEEIRTTNPVATEQYGSVSSTTPCGPNMRNGMNPV

SEQ ID NO: 114615 - protein, 36 aa, Artificial Sequence
  Description of Artificial Sequence: Synthetic polypeptide
DEEEIRTTNPVATEQYGSVSSTTPDGPNMRNGMNDV

SEQ ID NO: 114616 - protein, 36 aa, Artificial Sequence
  Description of Artificial Sequence: Synthetic polypeptide
DEEEIRTTNPVATEQYGSVSSTTPCGPNMRNGMNPL

SEQ ID NO: 114617 - protein, 36 aa, Artificial Sequence
  Description of Artificial Sequence: Synthetic polypeptide
DEEEIRTTNPVATEQYGSVSSTTPAYPNMRNGMNNV

SEQ ID NO: 114618 - protein, 36 aa, Artificial Sequence
  Description of Artificial Sequence: Synthetic polypeptide
DEEEIRTTNPVATEQYGSVSSTTPAYPNMINGMNPV

SEQ ID NO: 114619 - protein, 36 aa, Artificial Sequence
  Description of Artificial Sequence: Synthetic polypeptide
DEEEIRTTNPVATEQYGSVSSTTPAWPNMRNGMNPV

SEQ ID NO: 114620 - protein, 36 aa, Artificial Sequence
  Description of Artificial Sequence: Synthetic polypeptide
DEEEIRTTNPVATEQYGSVSSTTPAWPNKRNGMNPV

SEQ ID NO: 114621 - protein, 36 aa, Artificial Sequence
  Description of Artificial Sequence: Synthetic polypeptide
DEEEIRTTNPVATEQYGSVSSTTPAVPNMRNGMNPV

SEQ ID NO: 114622 - protein, 36 aa, Artificial Sequence
  Description of Artificial Sequence: Synthetic polypeptide
DEEEIRTTNPVATEQYGSVSSTTPATPNMRNGMNPV

SEQ ID NO: 114623 - protein, 36 aa, Artificial Sequence
  Description of Artificial Sequence: Synthetic polypeptide
DEEEIRTTNPVATEQYGSVSSTTPATPNMRNGLNPV

SEQ ID NO: 114624 - protein, 36 aa, Artificial Sequence
  Description of Artificial Sequence: Synthetic polypeptide
DEEEIRTTNPVATEQYGSVSSTTPAYPNMRNGMNPV

SEQ ID NO: 114625 - protein, 36 aa, Artificial Sequence
  Description of Artificial Sequence: Synthetic polypeptide
DEEEIRTTNPVATEQYGSVSSTTPDGPNMRNGMNPV

SEQ ID NO: 114626 - protein, 36 aa, Artificial Sequence
  Description of Artificial Sequence: Synthetic polypeptide
DEEEIRTTNPVATEQYGSVSSTTPDGPNMRNGNNPV

SEQ ID NO: 114627 - protein, 36 aa, Artificial Sequence
  Description of Artificial Sequence: Synthetic polypeptide
DEEEIRTTNPVATEQYGSVSSTTPDGPNMTFGMNPV

SEQ ID NO: 114628 - protein, 36 aa, Artificial Sequence
  Description of Artificial Sequence: Synthetic polypeptide
DEEEIRTTNPVATEQYGSVSSTTPGGPNMRNGMNPV

SEQ ID NO: 114629 - protein, 36 aa, Artificial Sequence
  Description of Artificial Sequence: Synthetic polypeptide
DEEEIRTTNPVATEQYGSVSSTTPGGPNMRNGMNEV

SEQ ID NO: 114630 - protein, 34 aa, Artificial Sequence
  Description of Artificial Sequence: Synthetic polypeptide
DEEEIRTTNPIATEQYGAVSATTPAGNMRNGNPV

SEQ ID NO: 114631 - protein, 36 aa, Artificial Sequence
  Description of Artificial Sequence: Synthetic polypeptide
DEEEIRTTNPVATEQYGSVSSTTPGGPNMFNGMNPV

SEQ ID NO: 114632 - protein, 36 aa, Artificial Sequence
  Description of Artificial Sequence: Synthetic polypeptide
DEEEIRTTNPVATEQYGSVSSTTPFGPNMRNGMNPV

SEQ ID NO: 114633 - protein, 33 aa, Artificial Sequence
  Description of Artificial Sequence: Synthetic polypeptide
DEEEIRTTNPVATEQYGCVIVNLDFGYDEEMEI

SEQ ID NO: 114634 - protein, 36 aa, Artificial Sequence
  Description of Artificial Sequence: Synthetic polypeptide
DEEEIRTTNPVATEQYGSVSSTTPFGPNDRNGMNPV

SEQ ID NO: 114635 - protein, 34 aa, Artificial Sequence
  Description of Artificial Sequence: Synthetic polypeptide
DEEEIRTTNPVATEQYGCVIWTNEQEQETQNMDN

SEQ ID NO: 114636 - protein, 36 aa, Artificial Sequence
  Description of Artificial Sequence: Synthetic polypeptide
DEEEIRTTNPVATEQYGSVSSTTPFGHNMRNGMNPV

SEQ ID NO: 114637 - protein, 33 aa, Artificial Sequence
  Description of Artificial Sequence: Synthetic polypeptide
DEEEIRTTNPVATEQYGCVNLTNNIETQENQDP

SEQ ID NO: 114638 - protein, 35 aa, Artificial Sequence
  Description of Artificial Sequence: Synthetic polypeptide
DEEEIRTTNPVATEQYGCVNSTTDFDSRNNEDERQ

SEQ ID NO: 114639 - protein, 36 aa, Artificial Sequence
  Description of Artificial Sequence: Synthetic polypeptide
DEEEIRTTNPVATEQYGSVSSTTPEGPNMRNGMNPV

SEQ ID NO: 114640 - protein, 36 aa, Artificial Sequence
  Description of Artificial Sequence: Synthetic polypeptide
DEEEIRTTNPVATEQYGSVSSTTPEGPNMRLGMNPV

SEQ ID NO: 114641 - protein, 36 aa, Artificial Sequence
  Description of Artificial Sequence: Synthetic polypeptide
DEEEIRTTNPVATEQYGSVSSTTPEGDNMRNGMNPV

SEQ ID NO: 114642 - protein, 31 aa, Artificial Sequence
  Description of Artificial Sequence: Synthetic polypeptide
DEEEIRTTNPIATECWGATWSEEDLARGNYI

SEQ ID NO: 114643 - protein, 36 aa, Artificial Sequence
  Description of Artificial Sequence: Synthetic polypeptide
DEEEIRTTNPVATEQYGSVSSTTPDLPNMREGMEPV

SEQ ID NO: 114644 - protein, 36 aa, Artificial Sequence
  Description of Artificial Sequence: Synthetic polypeptide
DEEEIRTTNPVATEQYGSVSSTTPDLPNMINGMNPV

SEQ ID NO: 114645 - protein, 32 aa, Artificial Sequence
  Description of Artificial Sequence: Synthetic polypeptide
DEEEIRTTNPCAYEQWGSVPTWENDQQIGGEG

SEQ ID NO: 114646 - protein, 32 aa, Artificial Sequence
  Description of Artificial Sequence: Synthetic polypeptide
DEEEIRTTNPCAYEQWGSVPTWENDQANGGKN

SEQ ID NO: 114647 - protein, 32 aa, Artificial Sequence
  Description of Artificial Sequence: Synthetic polypeptide
DEEEIRTTNPCAYEQWGSVPTWENDQAMGGHQ

SEQ ID NO: 114648 - protein, 36 aa, Artificial Sequence
  Description of Artificial Sequence: Synthetic polypeptide
DEEEIRTTNPVATEQYGSVSSTTPAHPNERSGSNPV

SEQ ID NO: 114649 - protein, 36 aa, Artificial Sequence
  Description of Artificial Sequence: Synthetic polypeptide
DEEEIRTTNPVATEQYGSVSSTTPAGPNNRNGMNPV

SEQ ID NO: 114650 - protein, 34 aa, Artificial Sequence
  Description of Artificial Sequence: Synthetic polypeptide
DEAEIRTTNPVATEQYGSVETTTYLTEITGENQE

SEQ ID NO: 114651 - protein, 36 aa, Artificial Sequence
  Description of Artificial Sequence: Synthetic polypeptide
DEEEIRTTNPVATEQYGSVSSTTPAGPNNRNGMNIV

SEQ ID NO: 114652 - protein, 36 aa, Artificial Sequence
  Description of Artificial Sequence: Synthetic polypeptide
DEEEIRTTNPVATEQYGSVSSTTPAGPNMYNGMNPV

SEQ ID NO: 114653 - protein, 36 aa, Artificial Sequence
  Description of Artificial Sequence: Synthetic polypeptide
DEEEIRTTNPVATEQYGSVSSTTPAGPNMWNGMNPV

SEQ ID NO: 114654 - protein, 34 aa, Artificial Sequence
  Description of Artificial Sequence: Synthetic polypeptide
DEEEIRTTNPCATEQYGVVATVVSNLQAGTDEED

SEQ ID NO: 114655 - protein, 35 aa, Artificial Sequence
  Description of Artificial Sequence: Synthetic polypeptide
DEEEIRTTNPCATEQYGVVATVVNLNLQAGNQEED

SEQ ID NO: 114656 - protein, 36 aa, Artificial Sequence
  Description of Artificial Sequence: Synthetic polypeptide
DEEEIRTTNPVATEQYGSVSSTTPAGPNPRNGMNPV

SEQ ID NO: 114657 - protein, 36 aa, Artificial Sequence
  Description of Artificial Sequence: Synthetic polypeptide
DEEEIRTTNPVATEQYGSVSSTTPAGPNMVNGMNPV

SEQ ID NO: 114658 - protein, 36 aa, Artificial Sequence
  Description of Artificial Sequence: Synthetic polypeptide
DEEEIRTTNPVATEQYGSVSSTTPAGPNMTNGNNPV

SEQ ID NO: 114659 - protein, 36 aa, Artificial Sequence
  Description of Artificial Sequence: Synthetic polypeptide
DEEEIRTTNPVATEQYGSVSSTTPAGPNMTNGMNPV

SEQ ID NO: 114660 - protein, 33 aa, Artificial Sequence
  Description of Artificial Sequence: Synthetic polypeptide
DEEEIRTTNPCATEQYGSVYPENGEQELIENVT

SEQ ID NO: 114661 - protein, 36 aa, Artificial Sequence
  Description of Artificial Sequence: Synthetic polypeptide
DEEEIRTTNPCATEQYGSVVTVTTTNNLQQGTNSAE

SEQ ID NO: 114662 - protein, 34 aa, Artificial Sequence
  Description of Artificial Sequence: Synthetic polypeptide
DEEEIRTTNPCATEQYGSVVSPVNIPLIAVVNDP

SEQ ID NO: 114663 - protein, 36 aa, Artificial Sequence
  Description of Artificial Sequence: Synthetic polypeptide
DEEEIRTTNPVATEQYGSVSSTTPAGPNMSNGMNPV

SEQ ID NO: 114664 - protein, 35 aa, Artificial Sequence
  Description of Artificial Sequence: Synthetic polypeptide
DEEEIRTTNPCATEQYGSVSVYVNNISTEQYGNTD

SEQ ID NO: 114665 - protein, 34 aa, Artificial Sequence
  Description of Artificial Sequence: Synthetic polypeptide
DEEEIRTTNPCATEQYGVVATVNLNLQAGTQDED

SEQ ID NO: 114666 - protein, 35 aa, Artificial Sequence
  Description of Artificial Sequence: Synthetic polypeptide
DEEEIRTTNPCATEQYGSVSVYTNIGTEQGNNNDN

SEQ ID NO: 114667 - protein, 35 aa, Artificial Sequence
  Description of Artificial Sequence: Synthetic polypeptide
DEEEIRTTNPVATEQYGSVSSTTPAGPNRNEMNPV

SEQ ID NO: 114668 - protein, 36 aa, Artificial Sequence
  Description of Artificial Sequence: Synthetic polypeptide
DEEEIRTTNPVATEQYGSVSSTTPAGPNRRNGMNPV

SEQ ID NO: 114669 - protein, 36 aa, Artificial Sequence
  Description of Artificial Sequence: Synthetic polypeptide
DEEEIRTTNPVATEQYGSVSSTTPAGPNYRNGMNYV

SEQ ID NO: 114670 - protein, 36 aa, Artificial Sequence
  Description of Artificial Sequence: Synthetic polypeptide
DEEEIRTTNPVATEQYGSVSSTTPAGPNYRNGMNPV

SEQ ID NO: 114671 - protein, 36 aa, Artificial Sequence
  Description of Artificial Sequence: Synthetic polypeptide
DEEEIRTTNPVATEQYGSVSSTTPAGPNWRNGMNPV

SEQ ID NO: 114672 - protein, 36 aa, Artificial Sequence
  Description of Artificial Sequence: Synthetic polypeptide
DEEEIRTTNPVATEQYGSVSSTTPAGPNVRNGMNPV

SEQ ID NO: 114673 - protein, 36 aa, Artificial Sequence
  Description of Artificial Sequence: Synthetic polypeptide
DEEEIRTTNPVATEQYGSVSSTTPAGPNVRNGMNPT

SEQ ID NO: 114674 - protein, 36 aa, Artificial Sequence
  Description of Artificial Sequence: Synthetic polypeptide
DEEEIRTTNPVATEQYGSVSSTTPAGPNVRIGMNPV

SEQ ID NO: 114675 - protein, 36 aa, Artificial Sequence
  Description of Artificial Sequence: Synthetic polypeptide
DEEEIRTTNPVATEQYGSVSSTTPAGPNVEMGMNTV

SEQ ID NO: 114676 - protein, 35 aa, Artificial Sequence
  Description of Artificial Sequence: Synthetic polypeptide
DEEEIRTTNPVATEQYGSVSSTTPAGPNRNQMNPV

SEQ ID NO: 114677 - protein, 36 aa, Artificial Sequence
  Description of Artificial Sequence: Synthetic polypeptide
DEEEIRTTNPVATEQYGSVSSTTPAGPNTTNGMNAV

SEQ ID NO: 114678 - protein, 36 aa, Artificial Sequence
  Description of Artificial Sequence: Synthetic polypeptide
DEEEIRTTNPVATEQYGSVSSTTPAGPNTRNGWNPV

SEQ ID NO: 114679 - protein, 36 aa, Artificial Sequence
  Description of Artificial Sequence: Synthetic polypeptide
DEEEIRTTNPVATEQYGSVSSTTPAGPNTRNGMNPV

SEQ ID NO: 114680 - protein, 36 aa, Artificial Sequence
  Description of Artificial Sequence: Synthetic polypeptide
DEEEIRTTNPVATEQYGSVSSTTPAGPNTRNGKNPV

SEQ ID NO: 114681 - protein, 36 aa, Artificial Sequence
  Description of Artificial Sequence: Synthetic polypeptide
DEEEIRTTNPVATEQYGSVSSTTPAGPNTPNGMNPV

SEQ ID NO: 114682 - protein, 36 aa, Artificial Sequence
  Description of Artificial Sequence: Synthetic polypeptide
DEEEIRTTNPVATEQYGSVSSTTPAGPNSRNGMNPV

SEQ ID NO: 114683 - protein, 36 aa, Artificial Sequence
  Description of Artificial Sequence: Synthetic polypeptide
DEEEIRTTNPCATEQYGVVSTVNLQAGTEQGTNQQD

SEQ ID NO: 114684 - protein, 36 aa, Artificial Sequence
  Description of Artificial Sequence: Synthetic polypeptide
DEEEIRTTNPCATEQYGVVSTVNLQAGTEQGNNQEE

SEQ ID NO: 114685 - protein, 36 aa, Artificial Sequence
  Description of Artificial Sequence: Synthetic polypeptide
DEEEIRTTNPVATEQYGSVSSTTPAGPNTRVGVNPV

SEQ ID NO: 114686 - protein, 36 aa, Artificial Sequence
  Description of Artificial Sequence: Synthetic polypeptide
DEEEIRTTNPVATEQYGSVSSTTPAGPNMRYGPNPV

SEQ ID NO: 114687 - protein, 35 aa, Artificial Sequence
  Description of Artificial Sequence: Synthetic polypeptide
DEAEIRTTNPVATEQYGSVDTWNNLETRNGQEDFN

SEQ ID NO: 114688 - protein, 34 aa, Artificial Sequence
  Description of Artificial Sequence: Synthetic polypeptide
DEEEIRTTNPVATEQYGSVSVSNNIEVSYILNID

SEQ ID NO: 114689 - protein, 33 aa, Artificial Sequence
  Description of Artificial Sequence: Synthetic polypeptide
DEEEIRTTNPCATEQYGSVPIALQAPTGPVGVN

SEQ ID NO: 114690 - protein, 36 aa, Artificial Sequence
  Description of Artificial Sequence: Synthetic polypeptide
DEEEIRTTNPVATEQYGSVSSTTPAGPNMRVGMNPV

SEQ ID NO: 114691 - protein, 34 aa, Artificial Sequence
  Description of Artificial Sequence: Synthetic polypeptide
DEAEIRTTNPVATEQYGSVCSVLQTEIGQNEDHI

SEQ ID NO: 114692 - protein, 35 aa, Artificial Sequence
  Description of Artificial Sequence: Synthetic polypeptide
DEAEIRTTNPVATEQYGSVCSVLLQSEIGQNEDHA

SEQ ID NO: 114693 - protein, 35 aa, Artificial Sequence
  Description of Artificial Sequence: Synthetic polypeptide
DEAEIRTTNPVATEQYGSVCSTSAGEQRGGEDTMF

SEQ ID NO: 114694 - protein, 36 aa, Artificial Sequence
  Description of Artificial Sequence: Synthetic polypeptide
DEEEIRTTNPVATEQYGSVSSTTPAGPNMRTGQNPV

SEQ ID NO: 114695 - protein, 36 aa, Artificial Sequence
  Description of Artificial Sequence: Synthetic polypeptide
DEEEIRTTNPVATEQYGSVSSTTPAGPNMRTGMNPV

SEQ ID NO: 114696 - protein, 34 aa, Artificial Sequence
  Description of Artificial Sequence: Synthetic polypeptide
DEEEIRTTNPCATEQYGSVPVTALQATQGLDIEE

SEQ ID NO: 114697 - protein, 36 aa, Artificial Sequence
  Description of Artificial Sequence: Synthetic polypeptide
DEEEIRTTNPVATEQYGSVSSTTPAGPNMRSGYNPV

SEQ ID NO: 114698 - protein, 36 aa, Artificial Sequence
  Description of Artificial Sequence: Synthetic polypeptide
DEEEIRTTNPVATEQYGSVSSTTPAGPNMRSGMNPV

SEQ ID NO: 114699 - protein, 34 aa, Artificial Sequence
  Description of Artificial Sequence: Synthetic polypeptide
DEEEIRTTNPCATEQYGSVPEALQAIHEGPVGNV

SEQ ID NO: 114700 - protein, 33 aa, Artificial Sequence
  Description of Artificial Sequence: Synthetic polypeptide
DEEEIRTTNPCATEQYGSVPEALQADELPVGVN

SEQ ID NO: 114701 - protein, 36 aa, Artificial Sequence
  Description of Artificial Sequence: Synthetic polypeptide
DEEEIRTTNPVATEQYGSVSSTTPAGPNMRSGMNMW

SEQ ID NO: 114702 - protein, 36 aa, Artificial Sequence
  Description of Artificial Sequence: Synthetic polypeptide
DEEEIRTTNPVATEQYGSVSSTTPAGPNMRQGMRPV

SEQ ID NO: 114703 - protein, 33 aa, Artificial Sequence
  Description of Artificial Sequence: Synthetic polypeptide
DEEEIRTTNPCATEQYGSVPEADLQAITGPVML

SEQ ID NO: 114704 - protein, 33 aa, Artificial Sequence
  Description of Artificial Sequence: Synthetic polypeptide
DEEEIRTTNPCATEQYGSVPEADLQAFGPVGQN

SEQ ID NO: 114705 - protein, 33 aa, Artificial Sequence
  Description of Artificial Sequence: Synthetic polypeptide
DEEEIRTTNPCATEQYGSVPEALQLTTGPVGQN

SEQ ID NO: 114706 - protein, 32 aa, Artificial Sequence
  Description of Artificial Sequence: Synthetic polypeptide
DEEEIRTTNPVATEQYGCVSVPSESIMPSFSF

SEQ ID NO: 114707 - protein, 33 aa, Artificial Sequence
  Description of Artificial Sequence: Synthetic polypeptide
DEEEIRTTNPVATEQYGCVSTYVNDIEDTSISD

SEQ ID NO: 114708 - protein, 33 aa, Artificial Sequence
  Description of Artificial Sequence: Synthetic polypeptide
DEEEIRTTNPCATEQYGSVSMVFPMTPMRVNEQ

SEQ ID NO: 114709 - protein, 37 aa, Artificial Sequence
  Description of Artificial Sequence: Synthetic polypeptide
DEEEIRTTNPCATEQYGSVSVTNNNLQQLQQGTNSAN

SEQ ID NO: 114710 - protein, 34 aa, Artificial Sequence
  Description of Artificial Sequence: Synthetic polypeptide
DEAEIRTTNPVATEQYGSVDESPEQDRIGSNTQE

SEQ ID NO: 114711 - protein, 36 aa, Artificial Sequence
  Description of Artificial Sequence: Synthetic polypeptide
DEEEIRTTNPVATEQYGSVSSTTPAGPNMRYGMNPV

SEQ ID NO: 114712 - protein, 34 aa, Artificial Sequence
  Description of Artificial Sequence: Synthetic polypeptide
DEAEIRTTNPVATEQYGSVCWMVPTETQSGQNEN

SEQ ID NO: 114713 - protein, 36 aa, Artificial Sequence
  Description of Artificial Sequence: Synthetic polypeptide
DEEEIRTTNPCATEQYGSVSTVNNQISTEQGTNLDQ

SEQ ID NO: 114714 - protein, 34 aa, Artificial Sequence
  Description of Artificial Sequence: Synthetic polypeptide
DEEEIRTTNPVATEQYGCVSTQTDGDQEEGGGEG

SEQ ID NO: 114715 - protein, 36 aa, Artificial Sequence
  Description of Artificial Sequence: Synthetic polypeptide
DEEEIRTTNPCATEQYGSVSTVNLNIGTEQGNNQDE

SEQ ID NO: 114716 - protein, 34 aa, Artificial Sequence
  Description of Artificial Sequence: Synthetic polypeptide
DEAEIRTTNPVATEQYGSVCTTTVALGMGNDDDN

SEQ ID NO: 114717 - protein, 32 aa, Artificial Sequence
  Description of Artificial Sequence: Synthetic polypeptide
DEEEIRTTNPCATEQYGSVSPVGNIPIVPSQD

SEQ ID NO: 114718 - protein, 34 aa, Artificial Sequence
  Description of Artificial Sequence: Synthetic polypeptide
DEEEIRTTNPCATEQYGSVSPTVEGEQPSVGQVD

SEQ ID NO: 114719 - protein, 34 aa, Artificial Sequence
  Description of Artificial Sequence: Synthetic polypeptide
DEEEIRTTNPCATEQYGSVSPENVETQELIENVE

SEQ ID NO: 114720 - protein, 36 aa, Artificial Sequence
  Description of Artificial Sequence: Synthetic polypeptide
DEEEIRTTNPVATEQYGSVSSTTPAGPNMRWGMNPV

SEQ ID NO: 114721 - protein, 36 aa, Artificial Sequence
  Description of Artificial Sequence: Synthetic polypeptide
DEEEIRTTNPVATEQYGSVSSTTPAGPNMRWGANPV

SEQ ID NO: 114722 - protein, 34 aa, Artificial Sequence
  Description of Artificial Sequence: Synthetic polypeptide
DEEEIRTTNPCATEQYGSVSPENGYQELIVENVE

SEQ ID NO: 114723 - protein, 34 aa, Artificial Sequence
  Description of Artificial Sequence: Synthetic polypeptide
DEEEIRTTNPCATEQYGSVSPENGEIPLDIENVE

SEQ ID NO: 114724 - protein, 34 aa, Artificial Sequence
  Description of Artificial Sequence: Synthetic polypeptide
DEEEIRTTNPCATEQYGSVSPANGEQPLIIENVE

SEQ ID NO: 114725 - protein, 34 aa, Artificial Sequence
  Description of Artificial Sequence: Synthetic polypeptide
DEEEIRTTNPVATEQYGCVSTVVNDIEDTSINST

SEQ ID NO: 114726 - protein, 36 aa, Artificial Sequence
  Description of Artificial Sequence: Synthetic polypeptide
DEEEIRTTNPVATEQYGSVSSTTPAGPPLRNGMNPV

SEQ ID NO: 114727 - protein, 36 aa, Artificial Sequence
  Description of Artificial Sequence: Synthetic polypeptide
DEEEIRTTNPVATEQYGSVSSTTPRGPNMNNGMNPV

SEQ ID NO: 114728 - protein, 36 aa, Artificial Sequence
  Description of Artificial Sequence: Synthetic polypeptide
DEEEIRTTNPVATEQYGSVSSTTPAGPPMRGGMNPV

SEQ ID NO: 114729 - protein, 32 aa, Artificial Sequence
  Description of Artificial Sequence: Synthetic polypeptide
DEAEIRTTNPVATEQYGSVEVPNDTNSIEHTQ

SEQ ID NO: 114730 - protein, 36 aa, Artificial Sequence
  Description of Artificial Sequence: Synthetic polypeptide
DEEEIRTTNPVATEQYGSVSSTTPAGVNMRNGINPV

SEQ ID NO: 114731 - protein, 36 aa, Artificial Sequence
  Description of Artificial Sequence: Synthetic polypeptide
DEEEIRTTNPVATEQYGSVSSTTPAGVNMENGMNPV

SEQ ID NO: 114732 - protein, 36 aa, Artificial Sequence
  Description of Artificial Sequence: Synthetic polypeptide
DEEEIRTTNPVATEQYGSVSSTTPAGTNMRQGMNPV

SEQ ID NO: 114733 - protein, 34 aa, Artificial Sequence
  Description of Artificial Sequence: Synthetic polypeptide
DEAEIRTTNPVATEQYGSVHSTIINNTQEDEEQN

SEQ ID NO: 114734 - protein, 32 aa, Artificial Sequence
  Description of Artificial Sequence: Synthetic polypeptide
DEEEIRTTNPCAYEEWGSVATGDHQGGRGNTA

SEQ ID NO: 114735 - protein, 36 aa, Artificial Sequence
  Description of Artificial Sequence: Synthetic polypeptide
DEEEIRTTNPVATEQYGSVSSTTPAGTNMRNGMNPV

SEQ ID NO: 114736 - protein, 32 aa, Artificial Sequence
  Description of Artificial Sequence: Synthetic polypeptide
DEEEIRTTNPCAYEEWGSVATDNDHEGRGNAS

SEQ ID NO: 114737 - protein, 36 aa, Artificial Sequence
  Description of Artificial Sequence: Synthetic polypeptide
DEEEIRTTNPVATEQYGSVSSTTPAGVNMRNGMNPV

SEQ ID NO: 114738 - protein, 33 aa, Artificial Sequence
  Description of Artificial Sequence: Synthetic polypeptide
DEEEIRTTNPCAYEEWGSVAPTDNDHQGGRGNA

SEQ ID NO: 114739 - protein, 33 aa, Artificial Sequence
  Description of Artificial Sequence: Synthetic polypeptide
DEEEIRTTNPCAYEAYGSVACTNNGHQGRGGDV

SEQ ID NO: 114740 - protein, 33 aa, Artificial Sequence
  Description of Artificial Sequence: Synthetic polypeptide
DEEEIRTTNPCAYEAYGSVACTNGHQGRSGDAT

SEQ ID NO: 114741 - protein, 32 aa, Artificial Sequence
  Description of Artificial Sequence: Synthetic polypeptide
DEEEIRTTNPCAYEAYGSVACTGGHQGRDGDA

SEQ ID NO: 114742 - protein, 32 aa, Artificial Sequence
  Description of Artificial Sequence: Synthetic polypeptide
DEEEIRTTNPCAYEAYGSVACQNGHGRGGNAD

SEQ ID NO: 114743 - protein, 33 aa, Artificial Sequence
  Description of Artificial Sequence: Synthetic polypeptide
DEEEIRTTNPCAYDQYGQVPCTDELSQRNGGND

SEQ ID NO: 114744 - protein, 31 aa, Artificial Sequence
  Description of Artificial Sequence: Synthetic polypeptide
DEEEIRTTNPCATTQYGTVATTQQGTTTNVT

SEQ ID NO: 114745 - protein, 36 aa, Artificial Sequence
  Description of Artificial Sequence: Synthetic polypeptide
DEEEIRTTNPVATEQYGSVSSTTPAGSWMRNGMNPV

SEQ ID NO: 114746 - protein, 36 aa, Artificial Sequence
  Description of Artificial Sequence: Synthetic polypeptide
DEEEIRTTNPVATEQYGSVSSTTPAGTNKRNGMNPV

SEQ ID NO: 114747 - protein, 31 aa, Artificial Sequence
  Description of Artificial Sequence: Synthetic polypeptide
DEEEIRTTNPCATTQYGTVATEQYGTVNVSE

SEQ ID NO: 114748 - protein, 36 aa, Artificial Sequence
  Description of Artificial Sequence: Synthetic polypeptide
DEEEIRTTNPVATEQYGSVSSTTPAGVSMRNGMNPV

SEQ ID NO: 114749 - protein, 34 aa, Artificial Sequence
  Description of Artificial Sequence: Synthetic polypeptide
DEEEIRTTNPVATEQYGCVSTMDGLEHDSGQQDM

SEQ ID NO: 114750 - protein, 32 aa, Artificial Sequence
  Description of Artificial Sequence: Synthetic polypeptide
DEEEIRTTNPCAYEQWGSVPTWENDDRKGGEQ

SEQ ID NO: 114751 - protein, 32 aa, Artificial Sequence
  Description of Artificial Sequence: Synthetic polypeptide
DEEEIRTTNPCAYEQWGSVPTWENDDRHGKEH

SEQ ID NO: 114752 - protein, 32 aa, Artificial Sequence
  Description of Artificial Sequence: Synthetic polypeptide
DEEEIRTTNPCAYEQWGSVPTWELDDRKGDEE

SEQ ID NO: 114753 - protein, 32 aa, Artificial Sequence
  Description of Artificial Sequence: Synthetic polypeptide
DEEEIRTTNPCAYEQWGSVPTWELDDRGGGKE

SEQ ID NO: 114754 - protein, 32 aa, Artificial Sequence
  Description of Artificial Sequence: Synthetic polypeptide
DEEEIRTTNPCAYEQWGSVPTWDLDLREGDEP

SEQ ID NO: 114755 - protein, 32 aa, Artificial Sequence
  Description of Artificial Sequence: Synthetic polypeptide
DEEEIRTTNPCAYEQWGSVPTWDLDDRNGKEP

SEQ ID NO: 114756 - protein, 34 aa, Artificial Sequence
  Description of Artificial Sequence: Synthetic polypeptide
DEEEIRTTNPVAYEPYRGQSVSQNELSQGPGSSD

SEQ ID NO: 114757 - protein, 34 aa, Artificial Sequence
  Description of Artificial Sequence: Synthetic polypeptide
DEEEIRTTNPVATEQYGCVSTMNDHQENFMSDQS

SEQ ID NO: 114758 - protein, 36 aa, Artificial Sequence
  Description of Artificial Sequence: Synthetic polypeptide
DEEEIRTTNPVATEQYGSVSSTTPAHENERFGMNPV

SEQ ID NO: 114759 - protein, 32 aa, Artificial Sequence
  Description of Artificial Sequence: Synthetic polypeptide
DEEEIRTTNPCAYEQWGSVCYNIEKRDGNDDP

SEQ ID NO: 114760 - protein, 36 aa, Artificial Sequence
  Description of Artificial Sequence: Synthetic polypeptide
DEEEIRTTNPVATEQYGSVSSTTPAGWNVRNGMNPV

SEQ ID NO: 114761 - protein, 36 aa, Artificial Sequence
  Description of Artificial Sequence: Synthetic polypeptide
DEEEIRTTNPVATEQYGSVSSTTPAGWNMRSGMNPV

SEQ ID NO: 114762 - protein, 32 aa, Artificial Sequence
  Description of Artificial Sequence: Synthetic polypeptide
DEEEIRTTNPCAYEQWGSVCYNIEEDQDGNDS

SEQ ID NO: 114763 - protein, 36 aa, Artificial Sequence
  Description of Artificial Sequence: Synthetic polypeptide
DEEEIRTTNPVATEQYGSVSSTTPAGWNMRNGMNPV

SEQ ID NO: 114764 - protein, 34 aa, Artificial Sequence
  Description of Artificial Sequence: Synthetic polypeptide
DEEEIRTTNPCAYEPYRGQSVSQNELSQGPGGSR

SEQ ID NO: 114765 - protein, 32 aa, Artificial Sequence
  Description of Artificial Sequence: Synthetic polypeptide
DEEEIRTTNPCAYEPYGSVAASNHGRHGDNEA

SEQ ID NO: 114766 - protein, 36 aa, Artificial Sequence
  Description of Artificial Sequence: Synthetic polypeptide
DEEEIRTTNPVATEQYGSVSSTTPAGYNMRNGMNPV

SEQ ID NO: 114767 - protein, 36 aa, Artificial Sequence
  Description of Artificial Sequence: Synthetic polypeptide
DEEEIRTTNPVATEQYGSVSSTTPAGSTNRNGGNNV

SEQ ID NO: 114768 - protein, 36 aa, Artificial Sequence
  Description of Artificial Sequence: Synthetic polypeptide
DEEEIRTTNPVATEQYGSVSSTTPAGSNMRNGMNPV

SEQ ID NO: 114769 - protein, 36 aa, Artificial Sequence
  Description of Artificial Sequence: Synthetic polypeptide
DEEEIRTTNPVATEQYGSVSSTTPAGSNMRNGMNPM

SEQ ID NO: 114770 - protein, 32 aa, Artificial Sequence
  Description of Artificial Sequence: Synthetic polypeptide
DEEEIRTTNPCATESYGSVALTENHPSQVVAP

SEQ ID NO: 114771 - protein, 32 aa, Artificial Sequence
  Description of Artificial Sequence: Synthetic polypeptide
DEEEIRTTNPCATESYGSVALTENHPAQAVIA

SEQ ID NO: 114772 - protein, 36 aa, Artificial Sequence
  Description of Artificial Sequence: Synthetic polypeptide
DEEEIRTTNPVATEQYGSVSSTTPAGPWMREGMNPV

SEQ ID NO: 114773 - protein, 36 aa, Artificial Sequence
  Description of Artificial Sequence: Synthetic polypeptide
DEEEIRTTNPVAYEPYGSVQSCTLNSLSHANGDNER

SEQ ID NO: 114774 - protein, 35 aa, Artificial Sequence
  Description of Artificial Sequence: Synthetic polypeptide
DEAEIRTTNPVATEQYGSVFSDTHSLTDRIDEINI

SEQ ID NO: 114775 - protein, 33 aa, Artificial Sequence
  Description of Artificial Sequence: Synthetic polypeptide
DEAEIRTTNPVATEQYGSVFLVTWEVDEGEERI

SEQ ID NO: 114776 - protein, 36 aa, Artificial Sequence
  Description of Artificial Sequence: Synthetic polypeptide
DEEEIRTTNPVATEQYGSVSSTTPAGPVVRNGMNPV

SEQ ID NO: 114777 - protein, 36 aa, Artificial Sequence
  Description of Artificial Sequence: Synthetic polypeptide
DEEEIRTTNPVATEQYGSVSSTTPAGPWMRNGMNPV

SEQ ID NO: 114778 - protein, 36 aa, Artificial Sequence
  Description of Artificial Sequence: Synthetic polypeptide
DEEEIRTTNPVATEQYGSVSSTTPAGPVMRNGMNPV

SEQ ID NO: 114779 - protein, 34 aa, Artificial Sequence
  Description of Artificial Sequence: Synthetic polypeptide
DEEEIRTTNPVAYEPYGSVPSCTDNMLPSTTNND

SEQ ID NO: 114780 - protein, 36 aa, Artificial Sequence
  Description of Artificial Sequence: Synthetic polypeptide
DEEEIRTTNPVATEQYGSVSSTTPAGPTMRNGMNPV

SEQ ID NO: 114781 - protein, 36 aa, Artificial Sequence
  Description of Artificial Sequence: Synthetic polypeptide
DEEEIRTTNPCATEQYGVVSVVTNNDQLQQGTNSAE

SEQ ID NO: 114782 - protein, 36 aa, Artificial Sequence
  Description of Artificial Sequence: Synthetic polypeptide
DEEEIRTTNPVATEQYGSVSSTTPAGPSMRNGMNPV

SEQ ID NO: 114783 - protein, 36 aa, Artificial Sequence
  Description of Artificial Sequence: Synthetic polypeptide
DEEEIRTTNPVATEQYGSVSSTTPAGPSMRNGGNPV

SEQ ID NO: 114784 - protein, 36 aa, Artificial Sequence
  Description of Artificial Sequence: Synthetic polypeptide
DEEEIRTTNPVATEQYGSVSSTTPAGPRMRNGMNPV

SEQ ID NO: 114785 - protein, 36 aa, Artificial Sequence
  Description of Artificial Sequence: Synthetic polypeptide
DEEEIRTTNPVATEQYGSVSSTTPAGPQMRNGMEPV

SEQ ID NO: 114786 - protein, 35 aa, Artificial Sequence
  Description of Artificial Sequence: Synthetic polypeptide
DEEEIRTTNPCATEQYGVVSVVVNDQLQQGTNSAE

SEQ ID NO: 114787 - protein, 33 aa, Artificial Sequence
  Description of Artificial Sequence: Synthetic polypeptide
DEEEIRTTNPCATESYGSVALTENHQPRQVVAK

SEQ ID NO: 114788 - protein, 36 aa, Artificial Sequence
  Description of Artificial Sequence: Synthetic polypeptide
DEEEIRTTNPVATEQYGSVSSTTPAGPYMRNGMNGV

SEQ ID NO: 114789 - protein, 36 aa, Artificial Sequence
  Description of Artificial Sequence: Synthetic polypeptide
DEEEIRTTNPVATEQYGSVSSTTPAGPYMRNGMNPV

SEQ ID NO: 114790 - protein, 36 aa, Artificial Sequence
  Description of Artificial Sequence: Synthetic polypeptide
DEEEIRTTNPVATEQYGSVSSTTPAGSNMRNGMNPL

SEQ ID NO: 114791 - protein, 36 aa, Artificial Sequence
  Description of Artificial Sequence: Synthetic polypeptide
DEEEIRTTNPVATEQYGSVSSTTPAGSNDRTGTNPV

SEQ ID NO: 114792 - protein, 31 aa, Artificial Sequence
  Description of Artificial Sequence: Synthetic polypeptide
DEEEIRTTNPCATTQYGTVATEQYGTTTTNI

SEQ ID NO: 114793 - protein, 36 aa, Artificial Sequence
  Description of Artificial Sequence: Synthetic polypeptide
DEEEIRTTNPVATEQYGSVSSTTPAGSNARNGMNNV

SEQ ID NO: 114794 - protein, 36 aa, Artificial Sequence
  Description of Artificial Sequence: Synthetic polypeptide
DEEEIRTTNPVATEQYGSVSSTTPAGSKMRNGMNPI

SEQ ID NO: 114795 - protein, 31 aa, Artificial Sequence
  Description of Artificial Sequence: Synthetic polypeptide
DEEEIRTTNPCATTQYGTVATEQYGTTSNNE

SEQ ID NO: 114796 - protein, 31 aa, Artificial Sequence
  Description of Artificial Sequence: Synthetic polypeptide
DEEEIRTTNPCATTQYGTVATEQYGTTNVEE

SEQ ID NO: 114797 - protein, 31 aa, Artificial Sequence
  Description of Artificial Sequence: Synthetic polypeptide
DEEEIRTTNPCATTQYGTVATEQYGTTNTNV

SEQ ID NO: 114798 - protein, 31 aa, Artificial Sequence
  Description of Artificial Sequence: Synthetic polypeptide
DEEEIRTTNPCATTQYGTVATEQYGTTNNDQ

SEQ ID NO: 114799 - protein, 36 aa, Artificial Sequence
  Description of Artificial Sequence: Synthetic polypeptide
DEEEIRTTNPVATEQYGSVSSTTPAGRNMRNGQNPV

SEQ ID NO: 114800 - protein, 36 aa, Artificial Sequence
  Description of Artificial Sequence: Synthetic polypeptide
DEEEIRTTNPVATEQYGSVSSTTPAGRNMRNGMNPV

SEQ ID NO: 114801 - protein, 36 aa, Artificial Sequence
  Description of Artificial Sequence: Synthetic polypeptide
DEEEIRTTNPVATEQYGSVSSTTPAGRNMRNGMNPS

SEQ ID NO: 114802 - protein, 30 aa, Artificial Sequence
  Description of Artificial Sequence: Synthetic polypeptide
DEEEIRTTNPCATTQYGTVATEAYGTTNDE

SEQ ID NO: 114803 - protein, 34 aa, Artificial Sequence
  Description of Artificial Sequence: Synthetic polypeptide
DEAEIRTTNPVATEQYGSVGENLDFGGNNENPQI

SEQ ID NO: 114804 - protein, 34 aa, Artificial Sequence
  Description of Artificial Sequence: Synthetic polypeptide
DEAEIRTTNPVATEQYGSVGENLDFFGFNEIDQD

SEQ ID NO: 114805 - protein, 32 aa, Artificial Sequence
  Description of Artificial Sequence: Synthetic polypeptide
DEEEIRTTNPCATNAYGSVSTYNIHFRLQEDP

SEQ ID NO: 114806 - protein, 36 aa, Artificial Sequence
  Description of Artificial Sequence: Synthetic polypeptide
DEEEIRTTNPVATEQYGSVSSTTPAGRNMRNGMNNV

SEQ ID NO: 114807 - protein, 36 aa, Artificial Sequence
  Description of Artificial Sequence: Synthetic polypeptide
DEEEIRTTNPVATEQYGSVSSTTPAGPPMRNGMNPV

SEQ ID NO: 114808 - protein, 36 aa, Artificial Sequence
  Description of Artificial Sequence: Synthetic polypeptide
DEEEIRTTNPVATEQYGSVSSTTPAGPNMRQGMNPV

SEQ ID NO: 114809 - protein, 36 aa, Artificial Sequence
  Description of Artificial Sequence: Synthetic polypeptide
DEEEIRTTNPVATEQYGSVSSTTPRGPNMRNGMEPV

SEQ ID NO: 114810 - protein, 34 aa, Artificial Sequence
  Description of Artificial Sequence: Synthetic polypeptide
DEEEIRTTNPLATEHYGSVVSQGTMSSQIGGSPR

SEQ ID NO: 114811 - protein, 35 aa, Artificial Sequence
  Description of Artificial Sequence: Synthetic polypeptide
DEEEIRTTNPVATEQYGCVCSTTGNHQENFGSEQA

SEQ ID NO: 114812 - protein, 36 aa, Artificial Sequence
  Description of Artificial Sequence: Synthetic polypeptide
DEEEIRTTNPVATEQYGCVCSTTGNHQENFGSNTQL

SEQ ID NO: 114813 - protein, 35 aa, Artificial Sequence
  Description of Artificial Sequence: Synthetic polypeptide
DEEEIRTTNPVATEQYGCVCSTTMEHQFFGSNNQE

SEQ ID NO: 114814 - protein, 34 aa, Artificial Sequence
  Description of Artificial Sequence: Synthetic polypeptide
DEEEIRTTNPVATEQYGCVCSTTMEHQNFGSDQT

SEQ ID NO: 114815 - protein, 34 aa, Artificial Sequence
  Description of Artificial Sequence: Synthetic polypeptide
DEEEIRTTNPLAYEQYGSVVSYTNLSDTPGGIQF

SEQ ID NO: 114816 - protein, 33 aa, Artificial Sequence
  Description of Artificial Sequence: Synthetic polypeptide
DEEEIRTTNPLAYEQYGSVVSYTNASDPGGIQV

SEQ ID NO: 114817 - protein, 35 aa, Artificial Sequence
  Description of Artificial Sequence: Synthetic polypeptide
DEEEIRTTNPVATEQYGCVCSTTNHQEGFGSETQS

SEQ ID NO: 114818 - protein, 34 aa, Artificial Sequence
  Description of Artificial Sequence: Synthetic polypeptide
DEEEIRTTNPVATEQYGCVCSTTGEPQHFGSEQS

SEQ ID NO: 114819 - protein, 33 aa, Artificial Sequence
  Description of Artificial Sequence: Synthetic polypeptide
DEEEIRTTNPLAYEQYGSVVSYTDLSGPGGIQV

SEQ ID NO: 114820 - protein, 35 aa, Artificial Sequence
  Description of Artificial Sequence: Synthetic polypeptide
DEEEIRTTNPVATEQYGSVSVDSTQQPTQEQNDEL

SEQ ID NO: 114821 - protein, 34 aa, Artificial Sequence
  Description of Artificial Sequence: Synthetic polypeptide
DEAEIRTTNPVATEQYGSVNVYESQVFNGNNEDR

SEQ ID NO: 114822 - protein, 35 aa, Artificial Sequence
  Description of Artificial Sequence: Synthetic polypeptide
DEEEIRTTNPVATEQYGCVCSTVEHQENFGSDNQS

SEQ ID NO: 114823 - protein, 34 aa, Artificial Sequence
  Description of Artificial Sequence: Synthetic polypeptide
DEEEIRTTNPVATEQYGCVCSTVEHQENFNSDQA

SEQ ID NO: 114824 - protein, 34 aa, Artificial Sequence
  Description of Artificial Sequence: Synthetic polypeptide
DEEEIRTTNPVATEQYGCVCSTVEHQNFNSNNQN

SEQ ID NO: 114825 - protein, 35 aa, Artificial Sequence
  Description of Artificial Sequence: Synthetic polypeptide
DEEEIRTTNPLAYEQYGQSVSTGNSFSQLRVGDSC

SEQ ID NO: 114826 - protein, 34 aa, Artificial Sequence
  Description of Artificial Sequence: Synthetic polypeptide
DEAEIRTTNPVATEQYGSVNTVLWEQMEDEIDNM

SEQ ID NO: 114827 - protein, 33 aa, Artificial Sequence
  Description of Artificial Sequence: Synthetic polypeptide
DEEEIRTTNPLAYEQYGSVVSYCNLSDPGGGVV

SEQ ID NO: 114828 - protein, 33 aa, Artificial Sequence
  Description of Artificial Sequence: Synthetic polypeptide
DEDEIRTTNPVATEAWGSVSVVNNNNNQEGENG

SEQ ID NO: 114829 - protein, 35 aa, Artificial Sequence
  Description of Artificial Sequence: Synthetic polypeptide
DEEEIRTTNPVATEQYGCVCSTTGELNQNFSSNQA

SEQ ID NO: 114830 - protein, 34 aa, Artificial Sequence
  Description of Artificial Sequence: Synthetic polypeptide
DEEEIRTTNPVATEQYGCVCSTTGEHQHFGSEQA

SEQ ID NO: 114831 - protein, 33 aa, Artificial Sequence
  Description of Artificial Sequence: Synthetic polypeptide
DEEEIRTTNPVATEQYGCVCSTTEHQNFTSDQA

SEQ ID NO: 114832 - protein, 34 aa, Artificial Sequence
  Description of Artificial Sequence: Synthetic polypeptide
DEEEIRTTNPVATEQYGCVCSTTEHQYFPSENQS

SEQ ID NO: 114833 - protein, 35 aa, Artificial Sequence
  Description of Artificial Sequence: Synthetic polypeptide
DEEEIRTTNPMATEPYGSVVSCATNSGQTGTNYLA

SEQ ID NO: 114834 - protein, 34 aa, Artificial Sequence
  Description of Artificial Sequence: Synthetic polypeptide
DEEEIRTTNPVATEQYGCVCSTTEPQNFNSNNQS

SEQ ID NO: 114835 - protein, 34 aa, Artificial Sequence
  Description of Artificial Sequence: Synthetic polypeptide
DEDEIRTTNPVATEAWGSVSTVVNNQQGTNDEQG

SEQ ID NO: 114836 - protein, 34 aa, Artificial Sequence
  Description of Artificial Sequence: Synthetic polypeptide
DEAEIRTTNPVATEQYGSVPTVWLQEFFEEDQRD

SEQ ID NO: 114837 - protein, 35 aa, Artificial Sequence
  Description of Artificial Sequence: Synthetic polypeptide
DEEEIRTTNPVATEQYGSVSTYPTEQAVTSDSGVM

SEQ ID NO: 114838 - protein, 34 aa, Artificial Sequence
  Description of Artificial Sequence: Synthetic polypeptide
DEEEIRTTNPVATEQYGCVCSTTGEHQHFNSDQL

SEQ ID NO: 114839 - protein, 34 aa, Artificial Sequence
  Description of Artificial Sequence: Synthetic polypeptide
DEAEIRTTNPVATEQYGSVPSTINLNTVEDEEQN

SEQ ID NO: 114840 - protein, 35 aa, Artificial Sequence
  Description of Artificial Sequence: Synthetic polypeptide
DEEEIRTTNPVATEQYGSVSVAATQAHEQMQNDEN

SEQ ID NO: 114841 - protein, 32 aa, Artificial Sequence
  Description of Artificial Sequence: Synthetic polypeptide
DEAEIRTTNPVATEQYGSVPPSALEREEEAEQ

SEQ ID NO: 114842 - protein, 34 aa, Artificial Sequence
  Description of Artificial Sequence: Synthetic polypeptide
DEEEIRTTNPVATEQYGSVSVATLGDEGGGQGFM

SEQ ID NO: 114843 - protein, 33 aa, Artificial Sequence
  Description of Artificial Sequence: Synthetic polypeptide
DEAEIRTTNPVATEQYGSVNYTTTDFDRGQEIM

SEQ ID NO: 114844 - protein, 35 aa, Artificial Sequence
  Description of Artificial Sequence: Synthetic polypeptide
DEAEIRTTNPVATEQYGSVNYDSNELEQQQSGEER

SEQ ID NO: 114845 - protein, 35 aa, Artificial Sequence
  Description of Artificial Sequence: Synthetic polypeptide
DEEEIRTTNPVATEQYGSVSVDDNMTMEFDGENGP

SEQ ID NO: 114846 - protein, 34 aa, Artificial Sequence
  Description of Artificial Sequence: Synthetic polypeptide
DEAEIRTTNPVATEQYGSVNWWLDLEQRSNQNGN

SEQ ID NO: 114847 - protein, 32 aa, Artificial Sequence
  Description of Artificial Sequence: Synthetic polypeptide
DEAEIRTTNPVATEQYGSVPRPLDEVPGDEDG

SEQ ID NO: 114848 - protein, 35 aa, Artificial Sequence
  Description of Artificial Sequence: Synthetic polypeptide
DEEEIRTTNPVATEQYGCVCSTTEHQEHFGSNFQS

SEQ ID NO: 114849 - protein, 35 aa, Artificial Sequence
  Description of Artificial Sequence: Synthetic polypeptide
DEEEIRTTNPVATEQYGSVSVENGDQARQMPEAQA

SEQ ID NO: 114850 - protein, 33 aa, Artificial Sequence
  Description of Artificial Sequence: Synthetic polypeptide
DEDEIRTTNPVATEAWGSVSVVNNNQQNEGENG

SEQ ID NO: 114851 - protein, 35 aa, Artificial Sequence
  Description of Artificial Sequence: Synthetic polypeptide
DEDEIRTTNPVATEAYGSVSTVVNNLQQQQGTDEE

SEQ ID NO: 114852 - protein, 33 aa, Artificial Sequence
  Description of Artificial Sequence: Synthetic polypeptide
DEEEIRTTNPVATEQYGCVCSWEDHQNFGSDTQ

SEQ ID NO: 114853 - protein, 33 aa, Artificial Sequence
  Description of Artificial Sequence: Synthetic polypeptide
DEEEIRTTNPVATEQYGCVCSWEDHQNFNSDQM

SEQ ID NO: 114854 - protein, 34 aa, Artificial Sequence
  Description of Artificial Sequence: Synthetic polypeptide
DEEEIRTTNPVATEQYGCVCSWEDTQNFGSENQS

SEQ ID NO: 114855 - protein, 33 aa, Artificial Sequence
  Description of Artificial Sequence: Synthetic polypeptide
DEEEIRTTNPVATEQYGCVCSWEEDQFFGSEQP

SEQ ID NO: 114856 - protein, 33 aa, Artificial Sequence
  Description of Artificial Sequence: Synthetic polypeptide
DEEEIRTTNPVATEQYGCVCSWEEDQFFNSNDY

SEQ ID NO: 114857 - protein, 33 aa, Artificial Sequence
  Description of Artificial Sequence: Synthetic polypeptide
DEEEIRTTNPVATEQYGCVCSWEEDQNFGSEQA

SEQ ID NO: 114858 - protein, 35 aa, Artificial Sequence
  Description of Artificial Sequence: Synthetic polypeptide
DEDEIRTTNPVATEAYGSVSTVNNNLGQQGSTTTE

SEQ ID NO: 114859 - protein, 34 aa, Artificial Sequence
  Description of Artificial Sequence: Synthetic polypeptide
DEAEIRTTNPVATEQYGSVNTAPDENGLEEMNEI

SEQ ID NO: 114860 - protein, 34 aa, Artificial Sequence
  Description of Artificial Sequence: Synthetic polypeptide
DEAEIRTTNPVATEQYGSVNSVPNVNALQGESQQ

SEQ ID NO: 114861 - protein, 34 aa, Artificial Sequence
  Description of Artificial Sequence: Synthetic polypeptide
DEEEIRTTNPVATEQYGSVSVGPDDEAANTQDTN

SEQ ID NO: 114862 - protein, 36 aa, Artificial Sequence
  Description of Artificial Sequence: Synthetic polypeptide
DEAEIRTTNPVATEQYGSVNSTSNELQQDSGQEEDT

SEQ ID NO: 114863 - protein, 35 aa, Artificial Sequence
  Description of Artificial Sequence: Synthetic polypeptide
DEAEIRTTNPVATEQYGSVNSTSDDQQYEGENDFA

SEQ ID NO: 114864 - protein, 33 aa, Artificial Sequence
  Description of Artificial Sequence: Synthetic polypeptide
DEEEIRTTNPVATEQYGCVCSWEEHQGFGSDQS

SEQ ID NO: 114865 - protein, 34 aa, Artificial Sequence
  Description of Artificial Sequence: Synthetic polypeptide
DEEEIRTTNPVATEQYGCVCSWEEHQRFGSDTQS

SEQ ID NO: 114866 - protein, 33 aa, Artificial Sequence
  Description of Artificial Sequence: Synthetic polypeptide
DEEEIRTTNPVATEQYGCVCSWEEHQRFISDQV

SEQ ID NO: 114867 - protein, 34 aa, Artificial Sequence
  Description of Artificial Sequence: Synthetic polypeptide
DEEEIRTTNPVATEQYGSVSVGLGLIETTPGQLE

SEQ ID NO: 114868 - protein, 35 aa, Artificial Sequence
  Description of Artificial Sequence: Synthetic polypeptide
DEEEIRTTNPVATEQYGSVSVENGLMQAQMPEAMA

SEQ ID NO: 114869 - protein, 34 aa, Artificial Sequence
  Description of Artificial Sequence: Synthetic polypeptide
DEDEIRTTNPVATEAYGSVSTNNNQGQQGDTTTE

SEQ ID NO: 114870 - protein, 33 aa, Artificial Sequence
  Description of Artificial Sequence: Synthetic polypeptide
DEEEIRTTNPVATEQYGCVCSWDDHQNFGSEQS

SEQ ID NO: 114871 - protein, 34 aa, Artificial Sequence
  Description of Artificial Sequence: Synthetic polypeptide
DEEEIRTTNPVATEQYGCVCSTWEHQHFNSDNQT

SEQ ID NO: 114872 - protein, 37 aa, Artificial Sequence
  Description of Artificial Sequence: Synthetic polypeptide
DEEEIRTTNPLAYEQYGQSVSPTGNSLSQVRVGDNFA

SEQ ID NO: 114873 - protein, 34 aa, Artificial Sequence
  Description of Artificial Sequence: Synthetic polypeptide
DEEEIRTTNPVATEQYGCVCSTWGEHQFFGSDQS

SEQ ID NO: 114874 - protein, 35 aa, Artificial Sequence
  Description of Artificial Sequence: Synthetic polypeptide
DEEEIRTTNPVATEQYGCVCSTWGEHQYFGSENQS

SEQ ID NO: 114875 - protein, 32 aa, Artificial Sequence
  Description of Artificial Sequence: Synthetic polypeptide
DEEEIRTTNPLAYEQYGKVPPCTTLSARGGKE

SEQ ID NO: 114876 - protein, 33 aa, Artificial Sequence
  Description of Artificial Sequence: Synthetic polypeptide
DEEEIRTTNPLAYEQYGCVVSYTNLSGPGGIVV

SEQ ID NO: 114877 - protein, 35 aa, Artificial Sequence
  Description of Artificial Sequence: Synthetic polypeptide
DEEEIRTTNPVATEQYGCVCSVSGEDLNQNFISNI

SEQ ID NO: 114878 - protein, 34 aa, Artificial Sequence
  Description of Artificial Sequence: Synthetic polypeptide
DEEEIRTTNPVATEQYGCVCSWEDHDQNFGSNQS

SEQ ID NO: 114879 - protein, 34 aa, Artificial Sequence
  Description of Artificial Sequence: Synthetic polypeptide
DEDEIRTTNPVATEAYGSVSNNNLNQGQQGTTTE

SEQ ID NO: 114880 - protein, 35 aa, Artificial Sequence
  Description of Artificial Sequence: Synthetic polypeptide
DEEEIRTTNPVATEQYGCVCSVSGELNQNFNSEIS

SEQ ID NO: 114881 - protein, 35 aa, Artificial Sequence
  Description of Artificial Sequence: Synthetic polypeptide
DEEEIRTTNPVATEQYGCVCSVSGELNQNFSSNAS

SEQ ID NO: 114882 - protein, 35 aa, Artificial Sequence
  Description of Artificial Sequence: Synthetic polypeptide
DEDEIRTTNPVATEAYGSVSTNNNLGQQQGTTTTE

SEQ ID NO: 114883 - protein, 35 aa, Artificial Sequence
  Description of Artificial Sequence: Synthetic polypeptide
DEDEIRTTNPVATEAYGSVSTNNNLLGQQGETTTE

SEQ ID NO: 114884 - protein, 35 aa, Artificial Sequence
  Description of Artificial Sequence: Synthetic polypeptide
DEDEIRTTNPVATEAYGSVSTNNNNLGNQLGTTTE

SEQ ID NO: 114885 - protein, 35 aa, Artificial Sequence
  Description of Artificial Sequence: Synthetic polypeptide
DEEEIRTTNPVATEQYGCVCSVSGNLNTNFNSNIS

SEQ ID NO: 114886 - protein, 34 aa, Artificial Sequence
  Description of Artificial Sequence: Synthetic polypeptide
DEEEIRTTNPLAYEPYGSVVSCATNGQTVTNYRA

SEQ ID NO: 114887 - protein, 34 aa, Artificial Sequence
  Description of Artificial Sequence: Synthetic polypeptide
DEDEIRTTNPVATEAYGSVSNNNLQQQIGTTTTE

SEQ ID NO: 114888 - protein, 34 aa, Artificial Sequence
  Description of Artificial Sequence: Synthetic polypeptide
DEEEIRTTNPVATEQYGCVCSTTEHNQNFNSNQA

SEQ ID NO: 114889 - protein, 34 aa, Artificial Sequence
  Description of Artificial Sequence: Synthetic polypeptide
DEEEIRTTNPVATEQYGCVCSTTEHNQNFNSDQM

SEQ ID NO: 114890 - protein, 34 aa, Artificial Sequence
  Description of Artificial Sequence: Synthetic polypeptide
DEEEIRTTNPVATEQYGCVCSTTEHNQNFGSDQS

SEQ ID NO: 114891 - protein, 36 aa, Artificial Sequence
  Description of Artificial Sequence: Synthetic polypeptide
DEEEIRTTNPVAFEQYGSVVDGQRNDLGQQRGERGG

SEQ ID NO: 114892 - protein, 37 aa, Artificial Sequence
  Description of Artificial Sequence: Synthetic polypeptide
DEEEIRTTNPVAFEQYGSVSTGGQTNDGDQQRGIRGG

SEQ ID NO: 114893 - protein, 33 aa, Artificial Sequence
  Description of Artificial Sequence: Synthetic polypeptide
DEAEIRTTNPVATEQYGSVSPLDEHPLGDEDGR

SEQ ID NO: 114894 - protein, 35 aa, Artificial Sequence
  Description of Artificial Sequence: Synthetic polypeptide
DEEEIRTTNPVAFEQYGQVVSTGGDLGQRGEFTGD

SEQ ID NO: 114895 - protein, 34 aa, Artificial Sequence
  Description of Artificial Sequence: Synthetic polypeptide
DEEEIRTTNPVAFEQYGQVVSTGGDLGQEMERGI

SEQ ID NO: 114896 - protein, 36 aa, Artificial Sequence
  Description of Artificial Sequence: Synthetic polypeptide
DEEEIRTTNPVAFEQYGQVVSIDTGDLGQRGARGGQ

SEQ ID NO: 114897 - protein, 34 aa, Artificial Sequence
  Description of Artificial Sequence: Synthetic polypeptide
DEEEIRTTNPVAFEQYGQVVNQGDLDQRFGDRGD

SEQ ID NO: 114898 - protein, 36 aa, Artificial Sequence
  Description of Artificial Sequence: Synthetic polypeptide
DEEEIRTTNPVAFEQYGSVVSTGGDLGQEEQGDGND

SEQ ID NO: 114899 - protein, 34 aa, Artificial Sequence
  Description of Artificial Sequence: Synthetic polypeptide
DEEEIRTTNPVAFEQYGQVVITGDLGQEEGDRGD

SEQ ID NO: 114900 - protein, 35 aa, Artificial Sequence
  Description of Artificial Sequence: Synthetic polypeptide
DEEEIRTTNPVAFEQYGQTVNGQINDGLQRGIRGQ

SEQ ID NO: 114901 - protein, 36 aa, Artificial Sequence
  Description of Artificial Sequence: Synthetic polypeptide
DEEEIRTTNPVAFEQYGQSGVSGQTDDGDQRGIRGA

SEQ ID NO: 114902 - protein, 32 aa, Artificial Sequence
  Description of Artificial Sequence: Synthetic polypeptide
DEAEIRTTNPVATEQYGSVSPLDEAPGDEDQI

SEQ ID NO: 114903 - protein, 33 aa, Artificial Sequence
  Description of Artificial Sequence: Synthetic polypeptide
DEAEIRTTNPVATEQYGSVSPDIELTERQDDQI

SEQ ID NO: 114904 - protein, 34 aa, Artificial Sequence
  Description of Artificial Sequence: Synthetic polypeptide
DEAEIRTTNPVATEQYGSVSNANDNTNTYQIERN

SEQ ID NO: 114905 - protein, 34 aa, Artificial Sequence
  Description of Artificial Sequence: Synthetic polypeptide
DEAEIRTTNPVATEQYGSVSMTSLMNNTIEVDNG

SEQ ID NO: 114906 - protein, 36 aa, Artificial Sequence
  Description of Artificial Sequence: Synthetic polypeptide
DEEEIRTTNPVACEQYGSVSSTTPALPNMRNGMNPV

SEQ ID NO: 114907 - protein, 36 aa, Artificial Sequence
  Description of Artificial Sequence: Synthetic polypeptide
DEEEIRTTNPVAFEQYGQTVSGQINDLLQVRGIRGG

SEQ ID NO: 114908 - protein, 35 aa, Artificial Sequence
  Description of Artificial Sequence: Synthetic polypeptide
DEAEIRTTNPVATEQYGSVSMTMNQMWQMSTEGVM

SEQ ID NO: 114909 - protein, 32 aa, Artificial Sequence
  Description of Artificial Sequence: Synthetic polypeptide
DEAEIRTTNPVATEQYGSVSPLDLHPSDEDGM

SEQ ID NO: 114910 - protein, 35 aa, Artificial Sequence
  Description of Artificial Sequence: Synthetic polypeptide
DEAEIRTTNPVATEQYGSVSPPWQGISTEGTENRM

SEQ ID NO: 114911 - protein, 35 aa, Artificial Sequence
  Description of Artificial Sequence: Synthetic polypeptide
DEEEIRTTNPVASEQYGSVSSTTPAGPNMRGMNPV

SEQ ID NO: 114912 - protein, 35 aa, Artificial Sequence
  Description of Artificial Sequence: Synthetic polypeptide
DEEEIRTTNPVASEQYGSVSSTTPAGNMRNGMNPV

SEQ ID NO: 114913 - protein, 34 aa, Artificial Sequence
  Description of Artificial Sequence: Synthetic polypeptide
DEEEIRTTNPVATEQYGSVSTAPDMHEGYIESMH

SEQ ID NO: 114914 - protein, 35 aa, Artificial Sequence
  Description of Artificial Sequence: Synthetic polypeptide
DEDEIRTTNPVATEAWGSVSTNNNNNLQDEEGENG

SEQ ID NO: 114915 - protein, 33 aa, Artificial Sequence
  Description of Artificial Sequence: Synthetic polypeptide
DEAEIRTTNPVATEQYGSVSPTMGETVTNEDDN

SEQ ID NO: 114916 - protein, 36 aa, Artificial Sequence
  Description of Artificial Sequence: Synthetic polypeptide
DEEEIRTTNPVAIEQYGSVSSTTPQGPNMRNGMNPV

SEQ ID NO: 114917 - protein, 34 aa, Artificial Sequence
  Description of Artificial Sequence: Synthetic polypeptide
DEEEIRTTNPVAHEQYGSVWTTNLQPVFDVSWDQ

SEQ ID NO: 114918 - protein, 33 aa, Artificial Sequence
  Description of Artificial Sequence: Synthetic polypeptide
DEAEIRTTNPVATEQYGSVSPLDNEVPGDEDGL

SEQ ID NO: 114919 - protein, 36 aa, Artificial Sequence
  Description of Artificial Sequence: Synthetic polypeptide
DEAEIRTTNPVATEQYGSVSPTITLWETRQGDNTQV

SEQ ID NO: 114920 - protein, 34 aa, Artificial Sequence
  Description of Artificial Sequence: Synthetic polypeptide
DEAEIRTTNPVATEQYGSVSPTIMSLTERQDDQQ

SEQ ID NO: 114921 - protein, 33 aa, Artificial Sequence
  Description of Artificial Sequence: Synthetic polypeptide
DEEEIRTTNPVAHEQYGSVPTTNGQPVFDVSIW

SEQ ID NO: 114922 - protein, 35 aa, Artificial Sequence
  Description of Artificial Sequence: Synthetic polypeptide
DEAEIRTTNPVATEQYGSVSPTIELTERQDEDQRN

SEQ ID NO: 114923 - protein, 34 aa, Artificial Sequence
  Description of Artificial Sequence: Synthetic polypeptide
DEDEIRTTNPVATEAWGSVSTNNNNNQDNEGNNG

SEQ ID NO: 114924 - protein, 34 aa, Artificial Sequence
  Description of Artificial Sequence: Synthetic polypeptide
DEDEIRTTNPVATEAWGSVSTNNNNNQTNNGENG

SEQ ID NO: 114925 - protein, 32 aa, Artificial Sequence
  Description of Artificial Sequence: Synthetic polypeptide
DEAEIRTTNPVATEQYGSVSPTDGMEIESLEN

SEQ ID NO: 114926 - protein, 36 aa, Artificial Sequence
  Description of Artificial Sequence: Synthetic polypeptide
DEEEIRTTNPVAFEQYGSVVTTGQNELGQRGQTDED

SEQ ID NO: 114927 - protein, 33 aa, Artificial Sequence
  Description of Artificial Sequence: Synthetic polypeptide
DEEEIRTTNPVAHEQYGSVVDDNDQGEFDSGGG

SEQ ID NO: 114928 - protein, 33 aa, Artificial Sequence
  Description of Artificial Sequence: Synthetic polypeptide
DEAEIRTTNPVATEQYGSVSMPDLYNRIESDQT

SEQ ID NO: 114929 - protein, 33 aa, Artificial Sequence
  Description of Artificial Sequence: Synthetic polypeptide
DEAEIRTTNPVATEQYGSVSMNDHNRPESDQTD

SEQ ID NO: 114930 - protein, 33 aa, Artificial Sequence
  Description of Artificial Sequence: Synthetic polypeptide
DEEEIRTTNPTATEQYGECVATNLEDNTYSNMS

SEQ ID NO: 114931 - protein, 34 aa, Artificial Sequence
  Description of Artificial Sequence: Synthetic polypeptide
DEAEIRTTNPVATEQYGSVSDWNTLVAEGSEEKT

SEQ ID NO: 114932 - protein, 34 aa, Artificial Sequence
  Description of Artificial Sequence: Synthetic polypeptide
DEAEIRTTNPVATEQYGSVSDTHSLTDMIDEINN

SEQ ID NO: 114933 - protein, 34 aa, Artificial Sequence
  Description of Artificial Sequence: Synthetic polypeptide
DEEEIRTTNPVATEQYGCVCSTSEEHQSFGSDQS

SEQ ID NO: 114934 - protein, 34 aa, Artificial Sequence
  Description of Artificial Sequence: Synthetic polypeptide
DEEEIRTTNPVATEQYGCVCSTSEHNQGFNSDQS

SEQ ID NO: 114935 - protein, 33 aa, Artificial Sequence
  Description of Artificial Sequence: Synthetic polypeptide
DEAEIRTTNPVATEQYGSVSCSPEMLQMTQEDI

SEQ ID NO: 114936 - protein, 34 aa, Artificial Sequence
  Description of Artificial Sequence: Synthetic polypeptide
DEEEIRTTNPVATEQYGCVCSTSGEHQHFGSDQG

SEQ ID NO: 114937 - protein, 36 aa, Artificial Sequence
  Description of Artificial Sequence: Synthetic polypeptide
DEEEIRTTNPMATEQYGSIVVACTNALSQRPGGPYA

SEQ ID NO: 114938 - protein, 34 aa, Artificial Sequence
  Description of Artificial Sequence: Synthetic polypeptide
DEAEIRTTNPVATEQYGSVSDYNAENQPQGEDDS

SEQ ID NO: 114939 - protein, 33 aa, Artificial Sequence
  Description of Artificial Sequence: Synthetic polypeptide
DEAEIRTTNPVATEQYGSVQTNDHTDNTSEDNL

SEQ ID NO: 114940 - protein, 34 aa, Artificial Sequence
  Description of Artificial Sequence: Synthetic polypeptide
DEEEIRTTNPVATEQYGCVCSTTEEHQHFGSDAS

SEQ ID NO: 114941 - protein, 34 aa, Artificial Sequence
  Description of Artificial Sequence: Synthetic polypeptide
DEEEIRTTNPVATEQYGCVCSTTEEHQNFGSDQA

SEQ ID NO: 114942 - protein, 35 aa, Artificial Sequence
  Description of Artificial Sequence: Synthetic polypeptide
DEEEIRTTNPVATEQYGCVCSTTEELQGFNSNNQF

SEQ ID NO: 114943 - protein, 33 aa, Artificial Sequence
  Description of Artificial Sequence: Synthetic polypeptide
DEAEIRTTNPVATEQYGSVQSWMLDSDRNEEHN

SEQ ID NO: 114944 - protein, 34 aa, Artificial Sequence
  Description of Artificial Sequence: Synthetic polypeptide
DEAEIRTTNPVATEQYGSVQSSTDVLEGMESERE

SEQ ID NO: 114945 - protein, 34 aa, Artificial Sequence
  Description of Artificial Sequence: Synthetic polypeptide
DEEEIRTTNPVATEQYGCVCSTTEHNQGFGSEQS

SEQ ID NO: 114946 - protein, 34 aa, Artificial Sequence
  Description of Artificial Sequence: Synthetic polypeptide
DEEEIRTTNPVATEQYGCVCSTTEHNQHFNSNQL

SEQ ID NO: 114947 - protein, 34 aa, Artificial Sequence
  Description of Artificial Sequence: Synthetic polypeptide
DEEEIRTTNPVATEQYGCVCSTTEEHQFFGSDQA

SEQ ID NO: 114948 - protein, 32 aa, Artificial Sequence
  Description of Artificial Sequence: Synthetic polypeptide
DEEEIRTTNPMAYEGYGKCSCTNEQSHHVGNN

SEQ ID NO: 114949 - protein, 33 aa, Artificial Sequence
  Description of Artificial Sequence: Synthetic polypeptide
DEEEIRTTNPMAYEGYGSCSCTNELSAHVGNQK

SEQ ID NO: 114950 - protein, 33 aa, Artificial Sequence
  Description of Artificial Sequence: Synthetic polypeptide
DEEEIRTTNPMAYEPYGSTCSCTNELSAKGGNW

SEQ ID NO: 114951 - protein, 34 aa, Artificial Sequence
  Description of Artificial Sequence: Synthetic polypeptide
DEEEIRTTNPTATEHYGSVVSEGTMSSQDGGSPR

SEQ ID NO: 114952 - protein, 35 aa, Artificial Sequence
  Description of Artificial Sequence: Synthetic polypeptide
DEEEIRTTNPTATECYGSVATGNLNGNDGQRNGDS

SEQ ID NO: 114953 - protein, 33 aa, Artificial Sequence
  Description of Artificial Sequence: Synthetic polypeptide
DEAEIRTTNPVATEQYGSVSMDLMNYRIESDQT

SEQ ID NO: 114954 - protein, 33 aa, Artificial Sequence
  Description of Artificial Sequence: Synthetic polypeptide
DEEEIRTTNPSAYEGYGSCPSCTNHSARGGNNW

SEQ ID NO: 114955 - protein, 34 aa, Artificial Sequence
  Description of Artificial Sequence: Synthetic polypeptide
DEAEIRTTNPVATEQYGSVSMDDLTQMGYSQQID

SEQ ID NO: 114956 - protein, 36 aa, Artificial Sequence
  Description of Artificial Sequence: Synthetic polypeptide
DEAEIRTTNPVATEQYGSVSGHTNLEETDNGQEDGN

SEQ ID NO: 114957 - protein, 35 aa, Artificial Sequence
  Description of Artificial Sequence: Synthetic polypeptide
DEEEIRTTNPSATEQYGSVSSTTPAGPNMRGMNPV

SEQ ID NO: 114958 - protein, 36 aa, Artificial Sequence
  Description of Artificial Sequence: Synthetic polypeptide
DEEEIRTTNPSATEQYGSVSGTTPAGQNMRPGMNPV

SEQ ID NO: 114959 - protein, 36 aa, Artificial Sequence
  Description of Artificial Sequence: Synthetic polypeptide
DEAEIRTTNPVATEQYGSVSEYMNMLQPFGSEVNFN

SEQ ID NO: 114960 - protein, 34 aa, Artificial Sequence
  Description of Artificial Sequence: Synthetic polypeptide
DEAEIRTTNPVATEQYGSVSESPEQDRIQSNNQE

SEQ ID NO: 114961 - protein, 35 aa, Artificial Sequence
  Description of Artificial Sequence: Synthetic polypeptide
DEAEIRTTNPVATEQYGSVSEAPNLDQEIGEDGDI

SEQ ID NO: 114962 - protein, 34 aa, Artificial Sequence
  Description of Artificial Sequence: Synthetic polypeptide
DEEEIRTTNPVATEQYGCVCSTPEHEGFNSDNQS

SEQ ID NO: 114963 - protein, 34 aa, Artificial Sequence
  Description of Artificial Sequence: Synthetic polypeptide
DEAEIRTTNPVATEQYGSVSEAPMLQERMEDTDL

SEQ ID NO: 114964 - protein, 34 aa, Artificial Sequence
  Description of Artificial Sequence: Synthetic polypeptide
DEEEIRTTNPVATEQYGCVCSTPEHQENFGSQDF

SEQ ID NO: 114965 - protein, 34 aa, Artificial Sequence
  Description of Artificial Sequence: Synthetic polypeptide
DEEEIRTTNPVATEQYGCVCSTPHQENFNSDTQS

SEQ ID NO: 114966 - protein, 34 aa, Artificial Sequence
  Description of Artificial Sequence: Synthetic polypeptide
DEAEIRTTNPVATEQYGSVSDYQLQTGEMQIEVN

SEQ ID NO: 114967 - protein, 34 aa, Artificial Sequence
  Description of Artificial Sequence: Synthetic polypeptide
DEEEIRTTNPMAYEQYGSVINTDNLPQTTENIEE

SEQ ID NO: 114968 - protein, 35 aa, Artificial Sequence
  Description of Artificial Sequence: Synthetic polypeptide
DEAEIRTTNPVATEQYGSVNSTNNEQQEGQETDDN

SEQ ID NO: 114969 - protein, 34 aa, Artificial Sequence
  Description of Artificial Sequence: Synthetic polypeptide
DEEEIRTTNPVATEQYGCVCSWEELANFGSQNQA

SEQ ID NO: 114970 - protein, 33 aa, Artificial Sequence
  Description of Artificial Sequence: Synthetic polypeptide
DEEEIRTTNPVATEQYGCVCSWEELAYFNSQQA

SEQ ID NO: 114971 - protein, 35 aa, Artificial Sequence
  Description of Artificial Sequence: Synthetic polypeptide
DEEEIRTTNPVATEQYGCVCSWEELQESFGSNNQS

SEQ ID NO: 114972 - protein, 34 aa, Artificial Sequence
  Description of Artificial Sequence: Synthetic polypeptide
DEEEIRTTNPVATEQYGCVCSWGEHQERFGSEQA

SEQ ID NO: 114973 - protein, 34 aa, Artificial Sequence
  Description of Artificial Sequence: Synthetic polypeptide
DEEEIRTTNPVATEQYGCVCSWGEHQFFGSENQY

SEQ ID NO: 114974 - protein, 34 aa, Artificial Sequence
  Description of Artificial Sequence: Synthetic polypeptide
DEEEIRTTNPVATEQYGCVCSWGEHQGFGSDNQM

SEQ ID NO: 114975 - protein, 36 aa, Artificial Sequence
  Description of Artificial Sequence: Synthetic polypeptide
DEEEIRTTNPVATEQYGSVSSTTSAGDNMENGMNPV

SEQ ID NO: 114976 - protein, 36 aa, Artificial Sequence
  Description of Artificial Sequence: Synthetic polypeptide
DEEEIRTTNPVATEQYGSVSSTTRAGPNMRNGMNPV

SEQ ID NO: 114977 - protein, 36 aa, Artificial Sequence
  Description of Artificial Sequence: Synthetic polypeptide
DEEEIRTTNPVATEQYGSVSSTTQAGTNQEQGVNPV

SEQ ID NO: 114978 - protein, 33 aa, Artificial Sequence
  Description of Artificial Sequence: Synthetic polypeptide
DEEEIRTTNPVATEQYGCVCSWGEHQHFNSNQN

SEQ ID NO: 114979 - protein, 36 aa, Artificial Sequence
  Description of Artificial Sequence: Synthetic polypeptide
DEEEIRTTNPVATEQYGSVSSTTSAGPNMRNGMNPV

SEQ ID NO: 114980 - protein, 33 aa, Artificial Sequence
  Description of Artificial Sequence: Synthetic polypeptide
DEEEIRTTNPVATEQYGCVCSWGEHQHFNSQQA

SEQ ID NO: 114981 - protein, 33 aa, Artificial Sequence
  Description of Artificial Sequence: Synthetic polypeptide
DEEEIRTTNPVATEQYGCVCSWGEHQNFNSDQN

SEQ ID NO: 114982 - protein, 36 aa, Artificial Sequence
  Description of Artificial Sequence: Synthetic polypeptide
DEEEIRTTNPVATEQYGSVSSTTQAGTNMENGVNPN

SEQ ID NO: 114983 - protein, 33 aa, Artificial Sequence
  Description of Artificial Sequence: Synthetic polypeptide
DEEEIRTTNPVATEQYGCVCSWGEHQNGSETQS

SEQ ID NO: 114984 - protein, 32 aa, Artificial Sequence
  Description of Artificial Sequence: Synthetic polypeptide
DEEEIRTTNPVATEQYGCVCSWGEHQNNSQQS

SEQ ID NO: 114985 - protein, 33 aa, Artificial Sequence
  Description of Artificial Sequence: Synthetic polypeptide
DEEEIRTTNPVATEQYGCVCSWGELINFNSDQA

SEQ ID NO: 114986 - protein, 36 aa, Artificial Sequence
  Description of Artificial Sequence: Synthetic polypeptide
DEEEIRTTNPVATEQYGSVSSTTQAGTNMENGTNNV

SEQ ID NO: 114987 - protein, 36 aa, Artificial Sequence
  Description of Artificial Sequence: Synthetic polypeptide
DEEEIRTTNPVATEQYGSVSSTTQAGTNAENGTNPQ

SEQ ID NO: 114988 - protein, 33 aa, Artificial Sequence
  Description of Artificial Sequence: Synthetic polypeptide
DEEEIRTTNPVATEQYGCVCSWGEHQNFGSDQA

SEQ ID NO: 114989 - protein, 34 aa, Artificial Sequence
  Description of Artificial Sequence: Synthetic polypeptide
DEEEIRTTNPVATEQYGCVCSWGELQENFGSDDT

SEQ ID NO: 114990 - protein, 37 aa, Artificial Sequence
  Description of Artificial Sequence: Synthetic polypeptide
DEEEIRTTNPVATEQYGSVSSTTSAGPNMRNGMNPVR

SEQ ID NO: 114991 - protein, 36 aa, Artificial Sequence
  Description of Artificial Sequence: Synthetic polypeptide
DEEEIRTTNPVATEQYGSVSSTTTAGPNMRNGMNPV

SEQ ID NO: 114992 - protein, 34 aa, Artificial Sequence
  Description of Artificial Sequence: Synthetic polypeptide
DEAEIRTTNPVATEQYGSVNNFETEDQGGGNEED

SEQ ID NO: 114993 - protein, 36 aa, Artificial Sequence
  Description of Artificial Sequence: Synthetic polypeptide
DEEEIRTTNPVATEQYGSVSSTVEAGPNMRNGMNPV

SEQ ID NO: 114994 - protein, 32 aa, Artificial Sequence
  Description of Artificial Sequence: Synthetic polypeptide
DEAEIRTTNPVATEQYGSVNGTLDDMNGEETN

SEQ ID NO: 114995 - protein, 33 aa, Artificial Sequence
  Description of Artificial Sequence: Synthetic polypeptide
DEACIRTTNPVATEQYGCVCETGNPQYFGSNQA

SEQ ID NO: 114996 - protein, 36 aa, Artificial Sequence
  Description of Artificial Sequence: Synthetic polypeptide
DEEEIRTTNPVATEQYGSVSSTTYAGPNMRNGMNPV

SEQ ID NO: 114997 - protein, 33 aa, Artificial Sequence
  Description of Artificial Sequence: Synthetic polypeptide
DEEEIRTTNPVATEQYGCVCSWGEHNQNFGSDQ

SEQ ID NO: 114998 - protein, 36 aa, Artificial Sequence
  Description of Artificial Sequence: Synthetic polypeptide
DEEEIRTTNPVATEQYGSVSSTTYAGPNMRNGMNFV

SEQ ID NO: 114999 - protein, 36 aa, Artificial Sequence
  Description of Artificial Sequence: Synthetic polypeptide
DEEEIRTTNPVATEQYGSVSSTTTAGPNMRNGFNPV

SEQ ID NO: 115000 - protein, 36 aa, Artificial Sequence
  Description of Artificial Sequence: Synthetic polypeptide
DEEEIRTTNPVATEQYGSVSSTTYAGPNMRNGMNDV

SEQ ID NO: 115001 - protein, 36 aa, Artificial Sequence
  Description of Artificial Sequence: Synthetic polypeptide
DEEEIRTTNPVATEQYGSVSSTTWAGPNMRNGMNPV

SEQ ID NO: 115002 - protein, 36 aa, Artificial Sequence
  Description of Artificial Sequence: Synthetic polypeptide
DEEEIRTTNPVATEQYGSVSSTTVAGPNMRTGMNPV

SEQ ID NO: 115003 - protein, 36 aa, Artificial Sequence
  Description of Artificial Sequence: Synthetic polypeptide
DEEEIRTTNPVATEQYGSVSSTTVAGPNMRNGSNPV

SEQ ID NO: 115004 - protein, 36 aa, Artificial Sequence
  Description of Artificial Sequence: Synthetic polypeptide
DEEEIRTTNPVATEQYGSVSSTTVAGPNMRNGMNQV

SEQ ID NO: 115005 - protein, 36 aa, Artificial Sequence
  Description of Artificial Sequence: Synthetic polypeptide
DEEEIRTTNPVATEQYGSVSSTTVAGPNMRNGMNPV

SEQ ID NO: 115006 - protein, 36 aa, Artificial Sequence
  Description of Artificial Sequence: Synthetic polypeptide
DEEEIRTTNPVATEQYGSVSSTTVAGPNMRDGMNPV

SEQ ID NO: 115007 - protein, 36 aa, Artificial Sequence
  Description of Artificial Sequence: Synthetic polypeptide
DEEEIRTTNPVATEQYGSVSSTTTAGPWMRNGMNPV

SEQ ID NO: 115008 - protein, 36 aa, Artificial Sequence
  Description of Artificial Sequence: Synthetic polypeptide
DEEEIRTTNPVATEQYGSVSSTTWAGPNMRNGMNVY

SEQ ID NO: 115009 - protein, 36 aa, Artificial Sequence
  Description of Artificial Sequence: Synthetic polypeptide
DEEEIRTTNPVATEQYGSVSSTTQAGSNNLNGTNPV

SEQ ID NO: 115010 - protein, 35 aa, Artificial Sequence
  Description of Artificial Sequence: Synthetic polypeptide
DEEEIRTTNPVATEQYGCVCSWGELQENFGSDNQS

SEQ ID NO: 115011 - protein, 35 aa, Artificial Sequence
  Description of Artificial Sequence: Synthetic polypeptide
DEEEIRTTNPVATEQYGCVCSWGELQENFGSENQA

SEQ ID NO: 115012 - protein, 36 aa, Artificial Sequence
  Description of Artificial Sequence: Synthetic polypeptide
DEEEIRTTNPVATEQYGSVSSTTPTGPNMRNGMNPV

SEQ ID NO: 115013 - protein, 34 aa, Artificial Sequence
  Description of Artificial Sequence: Synthetic polypeptide
DEEEIRTTNPVATEQYGCVCSWGETNQNFNSEQA

SEQ ID NO: 115014 - protein, 33 aa, Artificial Sequence
  Description of Artificial Sequence: Synthetic polypeptide
DEEEIRTTNPVATEQYGCVCSWGETQGFGSDQA

SEQ ID NO: 115015 - protein, 36 aa, Artificial Sequence
  Description of Artificial Sequence: Synthetic polypeptide
DEEEIRTTNPVATEQYGSVSSTTPTGPAMRNGMNPV

SEQ ID NO: 115016 - protein, 35 aa, Artificial Sequence
  Description of Artificial Sequence: Synthetic polypeptide
DEEEIRTTNPVATEQYGCVCSWGNDHQENFGSNQA

SEQ ID NO: 115017 - protein, 34 aa, Artificial Sequence
  Description of Artificial Sequence: Synthetic polypeptide
DEEEIRTTNPVATEQYGCVCSWGNHQENFGSEDT

SEQ ID NO: 115018 - protein, 37 aa, Artificial Sequence
  Description of Artificial Sequence: Synthetic polypeptide
DEEEIRTTNPVATEQYGSVSSTTPSRGPNMRNGMNPV

SEQ ID NO: 115019 - protein, 35 aa, Artificial Sequence
  Description of Artificial Sequence: Synthetic polypeptide
DEEEIRTTNPVATEQYGSVSSTTPTGPNRNGMDPV

SEQ ID NO: 115020 - protein, 34 aa, Artificial Sequence
  Description of Artificial Sequence: Synthetic polypeptide
DEEEIRTTNPVATEQYGCVCSWGNHQNFNSNNQM

SEQ ID NO: 115021 - protein, 36 aa, Artificial Sequence
  Description of Artificial Sequence: Synthetic polypeptide
DEEEIRTTNPVATEQYGSVSSTTPSGPNMRNGMNPV

SEQ ID NO: 115022 - protein, 34 aa, Artificial Sequence
  Description of Artificial Sequence: Synthetic polypeptide
DEEEIRTTNPVATEQYGCVCSWGNTQENFGSEQA

SEQ ID NO: 115023 - protein, 33 aa, Artificial Sequence
  Description of Artificial Sequence: Synthetic polypeptide
DEEEIRTTNPVATEQYGCVCSWGPHQGFGSDQA

SEQ ID NO: 115024 - protein, 36 aa, Artificial Sequence
  Description of Artificial Sequence: Synthetic polypeptide
DEEEIRTTNPVATEQYGSVSSTTPSGDNMENGMNDV

SEQ ID NO: 115025 - protein, 33 aa, Artificial Sequence
  Description of Artificial Sequence: Synthetic polypeptide
DEEEIRTTNPVATEQYGCVCSWMNHAYFGSQQG

SEQ ID NO: 115026 - protein, 35 aa, Artificial Sequence
  Description of Artificial Sequence: Synthetic polypeptide
DEEEIRTTNPLATEQWGSVSCTLNELSDNTGGERV

SEQ ID NO: 115027 - protein, 36 aa, Artificial Sequence
  Description of Artificial Sequence: Synthetic polypeptide
DEEEIRTTNPVATEQYGSVSSTTPRGPNMRNGMNPV

SEQ ID NO: 115028 - protein, 35 aa, Artificial Sequence
  Description of Artificial Sequence: Synthetic polypeptide
DEEEIRTTNPVATEQYGCVCSWGNLQENFNSNNQS

SEQ ID NO: 115029 - protein, 36 aa, Artificial Sequence
  Description of Artificial Sequence: Synthetic polypeptide
DEEEIRTTNPVATEQYGSVSSTTPTSPNMRNGMNPV

SEQ ID NO: 115030 - protein, 35 aa, Artificial Sequence
  Description of Artificial Sequence: Synthetic polypeptide
DEEEIRTTNPVATEQYGSVSSTTPVGPNMHNEMNV

SEQ ID NO: 115031 - protein, 36 aa, Artificial Sequence
  Description of Artificial Sequence: Synthetic polypeptide
DEEEIRTTNPVATEQYGSVSSTTPVGPNMRNGMNPV

SEQ ID NO: 115032 - protein, 35 aa, Artificial Sequence
  Description of Artificial Sequence: Synthetic polypeptide
DEAEIRTTNPVATEQYGSVIWSPTNLENPNTWEYQ

SEQ ID NO: 115033 - protein, 34 aa, Artificial Sequence
  Description of Artificial Sequence: Synthetic polypeptide
DEEEIRTTNPVATEQYGCVCSWGELQNFNSDNQM

SEQ ID NO: 115034 - protein, 34 aa, Artificial Sequence
  Description of Artificial Sequence: Synthetic polypeptide
DEEEIRTTNPVATEQYGCVCSWGELQNFNSETQA

SEQ ID NO: 115035 - protein, 34 aa, Artificial Sequence
  Description of Artificial Sequence: Synthetic polypeptide
DEEEIRTTNPVATEQYGCVCSWGELQSFGSETQT

SEQ ID NO: 115036 - protein, 36 aa, Artificial Sequence
  Description of Artificial Sequence: Synthetic polypeptide
DEEEIRTTNPVATEQYGSVSSTTQAGSNGANGDNPV

SEQ ID NO: 115037 - protein, 35 aa, Artificial Sequence
  Description of Artificial Sequence: Synthetic polypeptide
DEAEIRTTNPVATEQYGSVISWLDEQIMVGQNDRM

SEQ ID NO: 115038 - protein, 36 aa, Artificial Sequence
  Description of Artificial Sequence: Synthetic polypeptide
DEEEIRTTNPVATEQYGSVSSTTQAGQNMTNGNNPV

SEQ ID NO: 115039 - protein, 36 aa, Artificial Sequence
  Description of Artificial Sequence: Synthetic polypeptide
DEEEIRTTNPVATEQYGSVSSTTQAGPVMRNGMNPV

SEQ ID NO: 115040 - protein, 36 aa, Artificial Sequence
  Description of Artificial Sequence: Synthetic polypeptide
DEEEIRTTNPVATEQYGSVSSTTQAGPRMRNGMNPV

SEQ ID NO: 115041 - protein, 36 aa, Artificial Sequence
  Description of Artificial Sequence: Synthetic polypeptide
DEEEIRTTNPVATEQYGSVSSTTQAGPNMRNGMNPV

SEQ ID NO: 115042 - protein, 36 aa, Artificial Sequence
  Description of Artificial Sequence: Synthetic polypeptide
DEEEIRTTNPVATEQYGSVSSTTQAGPNDRNGMNMV

SEQ ID NO: 115043 - protein, 36 aa, Artificial Sequence
  Description of Artificial Sequence: Synthetic polypeptide
DEEEIRTTNPVATEQYGSVSSTTQAGANNENGVNPV

SEQ ID NO: 115044 - protein, 36 aa, Artificial Sequence
  Description of Artificial Sequence: Synthetic polypeptide
DEEEIRTTNPVATEQYGSVSSTTPYGPNMRNGMNPV

SEQ ID NO: 115045 - protein, 36 aa, Artificial Sequence
  Description of Artificial Sequence: Synthetic polypeptide
DEEEIRTTNPVATEQYGSVSSTTPYGPNMRNGMNPT

SEQ ID NO: 115046 - protein, 36 aa, Artificial Sequence
  Description of Artificial Sequence: Synthetic polypeptide
DEEEIRTTNPVATEQYGSVSSTTPYGPNMRNGMNPL

SEQ ID NO: 115047 - protein, 36 aa, Artificial Sequence
  Description of Artificial Sequence: Synthetic polypeptide
DEEEIRTTNPVATEQYGSVSSTTPWGPNMRNGMNPV

SEQ ID NO: 115048 - protein, 36 aa, Artificial Sequence
  Description of Artificial Sequence: Synthetic polypeptide
DEEEIRTTNPVATEQYGSVSSTTPVSPNMRNGMNPV

SEQ ID NO: 115049 - protein, 36 aa, Artificial Sequence
  Description of Artificial Sequence: Synthetic polypeptide
DEEEIRTTNPVATEQYGSVSSTVPAGPNMRNGMNPV

SEQ ID NO: 115050 - protein, 33 aa, Artificial Sequence
  Description of Artificial Sequence: Synthetic polypeptide
DEEEIRTTNPVATEQYGCVCSWNHQENFISEQD

SEQ ID NO: 115051 - protein, 34 aa, Artificial Sequence
  Description of Artificial Sequence: Synthetic polypeptide
DEEEIRTTNPVATEQYGSVSVNGNLEEPALVEEE

SEQ ID NO: 115052 - protein, 36 aa, Artificial Sequence
  Description of Artificial Sequence: Synthetic polypeptide
DEEEIRTTNPVATEQYGSVSSTWPAGPNMRNGMNPV

SEQ ID NO: 115053 - protein, 34 aa, Artificial Sequence
  Description of Artificial Sequence: Synthetic polypeptide
DEEEIRTTNPVATEQYGCVCSWEHQENFGSDNQP

SEQ ID NO: 115054 - protein, 34 aa, Artificial Sequence
  Description of Artificial Sequence: Synthetic polypeptide
DEEEIRTTNPVATEQYGCVCSWEHQENFGSNNQS

SEQ ID NO: 115055 - protein, 34 aa, Artificial Sequence
  Description of Artificial Sequence: Synthetic polypeptide
DEEEIRTTNPVATEQYGCVCSWEHQENFGSQNQG

SEQ ID NO: 115056 - protein, 33 aa, Artificial Sequence
  Description of Artificial Sequence: Synthetic polypeptide
DEEEIRTTNPVATEQYGCVCSWEHQENFGSQQN

SEQ ID NO: 115057 - protein, 33 aa, Artificial Sequence
  Description of Artificial Sequence: Synthetic polypeptide
DEEEIRTTNPVATEQYGCVCSWEHQESFGSDQA

SEQ ID NO: 115058 - protein, 33 aa, Artificial Sequence
  Description of Artificial Sequence: Synthetic polypeptide
DEEEIRTTNPVATEQYGCVCSWEHQEYFGSDQT

SEQ ID NO: 115059 - protein, 34 aa, Artificial Sequence
  Description of Artificial Sequence: Synthetic polypeptide
DEEEIRTTNPVATEQYGCVCSWEHQEYFGSENQS

SEQ ID NO: 115060 - protein, 34 aa, Artificial Sequence
  Description of Artificial Sequence: Synthetic polypeptide
DEEEIRTTNPVATEQYGCVCSWEHQEHFGSNNQE

SEQ ID NO: 115061 - protein, 33 aa, Artificial Sequence
  Description of Artificial Sequence: Synthetic polypeptide
DEEEIRTTNPVATEQYGCVCSWEHQFFNSDTQA

SEQ ID NO: 115062 - protein, 33 aa, Artificial Sequence
  Description of Artificial Sequence: Synthetic polypeptide
DEEEIRTTNPVATEQYGCVCSWEHQFFNSDTQS

SEQ ID NO: 115063 - protein, 36 aa, Artificial Sequence
  Description of Artificial Sequence: Synthetic polypeptide
DEEEIRTTNPVATEQYGSVSSYTPAGENMRNGMNPV

SEQ ID NO: 115064 - protein, 32 aa, Artificial Sequence
  Description of Artificial Sequence: Synthetic polypeptide
DEEEIRTTNPVATEQYGCVCSWEHQHFLSEQT

SEQ ID NO: 115065 - protein, 33 aa, Artificial Sequence
  Description of Artificial Sequence: Synthetic polypeptide
DEEEIRTTNPVATEQYGCVCSWEHQHFNSNNQA

SEQ ID NO: 115066 - protein, 33 aa, Artificial Sequence
  Description of Artificial Sequence: Synthetic polypeptide
DEEEIRTTNPVATEQYGCVCSWEHQHFNSNNQM

SEQ ID NO: 115067 - protein, 33 aa, Artificial Sequence
  Description of Artificial Sequence: Synthetic polypeptide
DEEEIRTTNPLAYEPYGSVPSYCNISRTGGNNG

SEQ ID NO: 115068 - protein, 35 aa, Artificial Sequence
  Description of Artificial Sequence: Synthetic polypeptide
DEEEIRTTNPVATEQYGCVCSWELHQENFGSENQQ

SEQ ID NO: 115069 - protein, 36 aa, Artificial Sequence
  Description of Artificial Sequence: Synthetic polypeptide
DEEEIRTTNPVATEQYGSVSSYTPAGPNMRNGMNPV

SEQ ID NO: 115070 - protein, 33 aa, Artificial Sequence
  Description of Artificial Sequence: Synthetic polypeptide
DEEEIRTTNPLAYEGWGSCPSCTNLSARGGNNW

SEQ ID NO: 115071 - protein, 34 aa, Artificial Sequence
  Description of Artificial Sequence: Synthetic polypeptide
DEEEIRTTNPVATEQYGCVCSWEHQEGFGSNNQS

SEQ ID NO: 115072 - protein, 33 aa, Artificial Sequence
  Description of Artificial Sequence: Synthetic polypeptide
DEDEIRTTNPVATECWGSVSCIWEPQDREGENG

SEQ ID NO: 115073 - protein, 32 aa, Artificial Sequence
  Description of Artificial Sequence: Synthetic polypeptide
DEEEIRTTNPVATEQYGCVCSWEETANFGSQQ

SEQ ID NO: 115074 - protein, 34 aa, Artificial Sequence
  Description of Artificial Sequence: Synthetic polypeptide
DEEEIRTTNPVATEQYGCVCSWEETNQNFGSEQA

SEQ ID NO: 115075 - protein, 32 aa, Artificial Sequence
  Description of Artificial Sequence: Synthetic polypeptide
DEEEIRTTNPVATEQYGCVCSWEHAHFNSEQA

SEQ ID NO: 115076 - protein, 32 aa, Artificial Sequence
  Description of Artificial Sequence: Synthetic polypeptide
DEEEIRTTNPVATEQYGCVCSWEHANFGSDQA

SEQ ID NO: 115077 - protein, 34 aa, Artificial Sequence
  Description of Artificial Sequence: Synthetic polypeptide
DEEEIRTTNPVATEQYGCVCSWEHEQYFGSENQS

SEQ ID NO: 115078 - protein, 33 aa, Artificial Sequence
  Description of Artificial Sequence: Synthetic polypeptide
DEEEIRTTNPVATEQYGCVCSWEHINFGSENQA

SEQ ID NO: 115079 - protein, 36 aa, Artificial Sequence
  Description of Artificial Sequence: Synthetic polypeptide
DEEEIRTTNPVATEQYGSVSVLMNQGQQTESNNNRN

SEQ ID NO: 115080 - protein, 34 aa, Artificial Sequence
  Description of Artificial Sequence: Synthetic polypeptide
DEEEIRTTNPVATEQYGCVCSWEHQEFFGSNNQA

SEQ ID NO: 115081 - protein, 33 aa, Artificial Sequence
  Description of Artificial Sequence: Synthetic polypeptide
DEDEIRTTNPVATECWGCVSCINEMQDREGENG

SEQ ID NO: 115082 - protein, 33 aa, Artificial Sequence
  Description of Artificial Sequence: Synthetic polypeptide
DEDEIRTTNPVATECWGSASCINEPQDREGENG

SEQ ID NO: 115083 - protein, 33 aa, Artificial Sequence
  Description of Artificial Sequence: Synthetic polypeptide
DEDEIRTTNPVATECWGSVSCINEPQDREAENG

SEQ ID NO: 115084 - protein, 33 aa, Artificial Sequence
  Description of Artificial Sequence: Synthetic polypeptide
DEEEIRTTNPVATEQYGCVCSWEHNQNFGSDQA

SEQ ID NO: 115085 - protein, 33 aa, Artificial Sequence
  Description of Artificial Sequence: Synthetic polypeptide
DEEEIRTTNPVATEQYGCVCSWEHNQNFGSDQS

SEQ ID NO: 115086 - protein, 33 aa, Artificial Sequence
  Description of Artificial Sequence: Synthetic polypeptide
DEEEIRTTNPVATEQYGCVCSWEHNQNFGSDQT

SEQ ID NO: 115087 - protein, 34 aa, Artificial Sequence
  Description of Artificial Sequence: Synthetic polypeptide
DEEEIRTTNPVATEQYGCVCSWEHNQNFGSENQS

SEQ ID NO: 115088 - protein, 34 aa, Artificial Sequence
  Description of Artificial Sequence: Synthetic polypeptide
DEEEIRTTNPVATEQYGSVSVLTLGDEGGGQGEF

SEQ ID NO: 115089 - protein, 35 aa, Artificial Sequence
  Description of Artificial Sequence: Synthetic polypeptide
DEEEIRTTNPVATEQYGSVSVLTLGDEGGGNQGFE

SEQ ID NO: 115090 - protein, 36 aa, Artificial Sequence
  Description of Artificial Sequence: Synthetic polypeptide
DEEEIRTTNPLAYEAYGQSVSPTGNSLSQLRVGDMR

SEQ ID NO: 115091 - protein, 36 aa, Artificial Sequence
  Description of Artificial Sequence: Synthetic polypeptide
DEEEIRTTNPVATEQYGSVSSWTPAGPNMRNGMNPV

SEQ ID NO: 115092 - protein, 35 aa, Artificial Sequence
  Description of Artificial Sequence: Synthetic polypeptide
DEEEIRTTNPVATEQYGCVCSWENDHQNFGSNNQG

SEQ ID NO: 115093 - protein, 36 aa, Artificial Sequence
  Description of Artificial Sequence: Synthetic polypeptide
DEEEIRTTNPVATEQYGSVSSVTPAGPNMLNGMNPV

SEQ ID NO: 115094 - protein, 35 aa, Artificial Sequence
  Description of Artificial Sequence: Synthetic polypeptide
DEAEIRTTNPVATEQYGSVNNTPDHQDEYGNEDRE

SEQ ID NO: 115095 - protein, 36 aa, Artificial Sequence
  Description of Artificial Sequence: Synthetic polypeptide
DEEEIRTTNPVATEQYGSVSSVTPAGPEMRVGMNPV

SEQ ID NO: 115096 - protein, 36 aa, Artificial Sequence
  Description of Artificial Sequence: Synthetic polypeptide
DEEEIRTTNPVATEQYGSVSSVTPAGENMRQGMNPV

SEQ ID NO: 115097 - protein, 36 aa, Artificial Sequence
  Description of Artificial Sequence: Synthetic polypeptide
DEEEIRTTNPVATEQYGSVSSVTPAAPNMRVGENPV

SEQ ID NO: 115098 - protein, 34 aa, Artificial Sequence
  Description of Artificial Sequence: Synthetic polypeptide
DEDEIRTTNPVATEGWGSVSADINEPQDREGENG

SEQ ID NO: 115099 - protein, 33 aa, Artificial Sequence
  Description of Artificial Sequence: Synthetic polypeptide
DEEEIRTTNPVATEQYGCVCSWGEDQNFGSQQS

SEQ ID NO: 115100 - protein, 35 aa, Artificial Sequence
  Description of Artificial Sequence: Synthetic polypeptide
DEAEIRTTNPVATEQYGSVNSCTMLDVQMEGQETS

SEQ ID NO: 115101 - protein, 33 aa, Artificial Sequence
  Description of Artificial Sequence: Synthetic polypeptide
DEDEIRTTNPVATEGWGSVSAINGGQDGEGGNG

SEQ ID NO: 115102 - protein, 33 aa, Artificial Sequence
  Description of Artificial Sequence: Synthetic polypeptide
DEEEIRTTNPVATEQYGSVSSTYWIDSFMEEMD

SEQ ID NO: 115103 - protein, 36 aa, Artificial Sequence
  Description of Artificial Sequence: Synthetic polypeptide
DEEEIRTTNPVATEQYGSVSSTYPVGPNMRNGMNPV

SEQ ID NO: 115104 - protein, 36 aa, Artificial Sequence
  Description of Artificial Sequence: Synthetic polypeptide
DEEEIRTTNPVATEQYGSVSSTYPAKPNMRNGMNPV

SEQ ID NO: 115105 - protein, 34 aa, Artificial Sequence
  Description of Artificial Sequence: Synthetic polypeptide
DEAEIRTTNPVATEQYGSVNNTDNPDQGSEEQND

SEQ ID NO: 115106 - protein, 36 aa, Artificial Sequence
  Description of Artificial Sequence: Synthetic polypeptide
DEEEIRTTNPVATEQYGSVSSTYPAGPNMRNGMNPV

SEQ ID NO: 115107 - protein, 36 aa, Artificial Sequence
  Description of Artificial Sequence: Synthetic polypeptide
DEEEIRTTNPVATEQYGSVSSTYPAGPNMRLGMNPP

SEQ ID NO: 115108 - protein, 36 aa, Artificial Sequence
  Description of Artificial Sequence: Synthetic polypeptide
DEEEIRTTNPVATEQYGSVSSTWPAGPNMTNGMNPV

SEQ ID NO: 115109 - protein, 34 aa, Artificial Sequence
  Description of Artificial Sequence: Synthetic polypeptide
DEEEIRTTNPVATEQYGSVSSVDILIVSNEFINA

SEQ ID NO: 115110 - protein, 34 aa, Artificial Sequence
  Description of Artificial Sequence: Synthetic polypeptide
DEEEIRTTNPVATEQYGCVCSWGAHQNFGSENQA

SEQ ID NO: 115111 - protein, 33 aa, Artificial Sequence
  Description of Artificial Sequence: Synthetic polypeptide
DEEEIRTTNPVATEQYGCVCSWGAHQNFGSDQA

SEQ ID NO: 115112 - protein, 33 aa, Artificial Sequence
  Description of Artificial Sequence: Synthetic polypeptide
DEEEIRTTNPVATEQYGCVCSWGAHQHFNSNQS

SEQ ID NO: 115113 - protein, 34 aa, Artificial Sequence
  Description of Artificial Sequence: Synthetic polypeptide
DEEEIRTTNPVATEQYGCVCSWENDLANFGSQQG

SEQ ID NO: 115114 - protein, 34 aa, Artificial Sequence
  Description of Artificial Sequence: Synthetic polypeptide
DEEEIRTTNPVATEQYGCVCSWENDQNFNSETQS

SEQ ID NO: 115115 - protein, 34 aa, Artificial Sequence
  Description of Artificial Sequence: Synthetic polypeptide
DEEEIRTTNPVATEQYGCVCSWENHQEGFGSDQV

SEQ ID NO: 115116 - protein, 35 aa, Artificial Sequence
  Description of Artificial Sequence: Synthetic polypeptide
DEEEIRTTNPVATEQYGCVCSWENHQEGFGSNNQD

SEQ ID NO: 115117 - protein, 34 aa, Artificial Sequence
  Description of Artificial Sequence: Synthetic polypeptide
DEEEIRTTNPVATEQYGCVCSWENHQNFGSDTQP

SEQ ID NO: 115118 - protein, 36 aa, Artificial Sequence
  Description of Artificial Sequence: Synthetic polypeptide
DEEEIRTTNPVATEQYGSVSSWTPAGPNMRNGMNPG

SEQ ID NO: 115119 - protein, 33 aa, Artificial Sequence
  Description of Artificial Sequence: Synthetic polypeptide
DEEEIRTTNPVATEQYGCVCSWENHQNFISDQG

SEQ ID NO: 115120 - protein, 34 aa, Artificial Sequence
  Description of Artificial Sequence: Synthetic polypeptide
DEEEIRTTNPVATEQYGCVCSWENHQNFNSDNQA

SEQ ID NO: 115121 - protein, 35 aa, Artificial Sequence
  Description of Artificial Sequence: Synthetic polypeptide
DEEEIRTTNPVATEQYGSVSSWNGVQVMEIENVTD

SEQ ID NO: 115122 - protein, 35 aa, Artificial Sequence
  Description of Artificial Sequence: Synthetic polypeptide
DEEEIRTTNPLATERWGSVSCTNELSDNRGGEERV

SEQ ID NO: 115123 - protein, 35 aa, Artificial Sequence
  Description of Artificial Sequence: Synthetic polypeptide
DEEEIRTTNPVATEQYGSVSSWNGVPQVDFINNQY

SEQ ID NO: 115124 - protein, 36 aa, Artificial Sequence
  Description of Artificial Sequence: Synthetic polypeptide
DEEEIRTTNPVATEQYGSVSSVTQAGPNSRVGMNPV

SEQ ID NO: 115125 - protein, 33 aa, Artificial Sequence
  Description of Artificial Sequence: Synthetic polypeptide
DEEEIRTTNPVATEQYGCVCSWEPLAGFGSQQA

SEQ ID NO: 115126 - protein, 33 aa, Artificial Sequence
  Description of Artificial Sequence: Synthetic polypeptide
DEEEIRTTNPVATEQYGCVCSWEPQENFNSEQA

SEQ ID NO: 115127 - protein, 34 aa, Artificial Sequence
  Description of Artificial Sequence: Synthetic polypeptide
DEEEIRTTNPVATEQYGCVCSWETQENFGSENQM

SEQ ID NO: 115128 - protein, 36 aa, Artificial Sequence
  Description of Artificial Sequence: Synthetic polypeptide
DEEEIRTTNPVATEQYGSVSSVTPAGPNMRNGMNPV

SEQ ID NO: 115129 - protein, 36 aa, Artificial Sequence
  Description of Artificial Sequence: Synthetic polypeptide
DEEEIRTTNPVATEQYGSVSSVTPAGPNMRNGMNEV

SEQ ID NO: 115130 - protein, 36 aa, Artificial Sequence
  Description of Artificial Sequence: Synthetic polypeptide
DEEEIRTTNPVATEQYGSVSSTWPAGPNMRNGLNPV

SEQ ID NO: 115131 - protein, 33 aa, Artificial Sequence
  Description of Artificial Sequence: Synthetic polypeptide
DEAEIATTNPVATEQYGSVAGTNGLQTADTDQE

SEQ ID NO: 115132 - protein, 34 aa, Artificial Sequence
  Description of Artificial Sequence: Synthetic polypeptide
DEEEIRTTNPCATEQYGSVNQENDGQQEGGGNND

SEQ ID NO: 115133 - protein, 35 aa, Artificial Sequence
  Description of Artificial Sequence: Synthetic polypeptide
DEEEIRTTNPVATEQYGCVSYEGPSTARNGGSNRI

SEQ ID NO: 115134 - protein, 36 aa, Artificial Sequence
  Description of Artificial Sequence: Synthetic polypeptide
DEEEIRTTNPVATEQYGSVSSTTPAAPNMTNGMNPV

SEQ ID NO: 115135 - protein, 36 aa, Artificial Sequence
  Description of Artificial Sequence: Synthetic polypeptide
DEEEIRTTNPVATEQYGSVSSTTPAAPNMRNGTNPV

SEQ ID NO: 115136 - protein, 36 aa, Artificial Sequence
  Description of Artificial Sequence: Synthetic polypeptide
DEEEIRTTNPVATEQYGSVSSTTPAAPNMRNGMNPV

SEQ ID NO: 115137 - protein, 36 aa, Artificial Sequence
  Description of Artificial Sequence: Synthetic polypeptide
DEEEIRTTNPVATEQYGSVSSTTPAAPNMANGMNPV

SEQ ID NO: 115138 - protein, 37 aa, Artificial Sequence
  Description of Artificial Sequence: Synthetic polypeptide
DEEEIRTTNPVATEQYGSVSSTTNLQAGTEQGTTDEQ

SEQ ID NO: 115139 - protein, 36 aa, Artificial Sequence
  Description of Artificial Sequence: Synthetic polypeptide
DEEEIRTTNPVATEQYGSVSSTTNAGTNGENGVNPV

SEQ ID NO: 115140 - protein, 32 aa, Artificial Sequence
  Description of Artificial Sequence: Synthetic polypeptide
DEEEIRTTNPCATEEYGCVCQTNHGNFGGNAS

SEQ ID NO: 115141 - protein, 37 aa, Artificial Sequence
  Description of Artificial Sequence: Synthetic polypeptide
DEEEIRTTNPVATEQYGSVSSTTPACGNNMRNGMNPV

SEQ ID NO: 115142 - protein, 31 aa, Artificial Sequence
  Description of Artificial Sequence: Synthetic polypeptide
DEEEIRTTNPCATEEYGCVCQTNHGGGSDAA

SEQ ID NO: 115143 - protein, 36 aa, Artificial Sequence
  Description of Artificial Sequence: Synthetic polypeptide
DEEEIRTTNPVATEQYGSVSSTTNAGPNMRNGMWPV

SEQ ID NO: 115144 - protein, 36 aa, Artificial Sequence
  Description of Artificial Sequence: Synthetic polypeptide
DEEEIRTTNPVATEQYGSVSSTTNAGPNMNNGMNPV

SEQ ID NO: 115145 - protein, 36 aa, Artificial Sequence
  Description of Artificial Sequence: Synthetic polypeptide
DEEEIRTTNPVATEQYGSVSSTTMAGPNMRNGMNPV

SEQ ID NO: 115146 - protein, 36 aa, Artificial Sequence
  Description of Artificial Sequence: Synthetic polypeptide
DEEEIRTTNPVATEQYGSVSSTTMAGPNMRNGINPV

SEQ ID NO: 115147 - protein, 36 aa, Artificial Sequence
  Description of Artificial Sequence: Synthetic polypeptide
DEEEIRTTNPVATEQYGSVSSTTLAGTNDENGTNPV

SEQ ID NO: 115148 - protein, 36 aa, Artificial Sequence
  Description of Artificial Sequence: Synthetic polypeptide
DEEEIRTTNPVATEQYGSVSSTTLAGGNMENGVNPV

SEQ ID NO: 115149 - protein, 36 aa, Artificial Sequence
  Description of Artificial Sequence: Synthetic polypeptide
DEEEIRTTNPVATEQYGSVSSTTKDGPNMRYGMNPV

SEQ ID NO: 115150 - protein, 36 aa, Artificial Sequence
  Description of Artificial Sequence: Synthetic polypeptide
DEEEIRTTNPVATEQYGSVSSTTNAGPNMRNMMNPV

SEQ ID NO: 115151 - protein, 36 aa, Artificial Sequence
  Description of Artificial Sequence: Synthetic polypeptide
DEEEIRTTNPVATEQYGSVSSTTKAGPNMRNGMNPV

SEQ ID NO: 115152 - protein, 36 aa, Artificial Sequence
  Description of Artificial Sequence: Synthetic polypeptide
DEEEIRTTNPVATEQYGSVSSTTPACPNMRNGMNPV

SEQ ID NO: 115153 - protein, 36 aa, Artificial Sequence
  Description of Artificial Sequence: Synthetic polypeptide
DEEEIRTTNPVATEQYGSVSSTTPADPNMGNGENPV

SEQ ID NO: 115154 - protein, 36 aa, Artificial Sequence
  Description of Artificial Sequence: Synthetic polypeptide
DEEEIRTTNPVATEQYGSVSSTTPAGEPMRNGMNPV

SEQ ID NO: 115155 - protein, 36 aa, Artificial Sequence
  Description of Artificial Sequence: Synthetic polypeptide
DEEEIRTTNPVATEQYGSVSSTTPAGENNNNGVNPV

SEQ ID NO: 115156 - protein, 36 aa, Artificial Sequence
  Description of Artificial Sequence: Synthetic polypeptide
DEEEIRTTNPVATEQYGSVSSTTPAGENMRNGMNPV

SEQ ID NO: 115157 - protein, 36 aa, Artificial Sequence
  Description of Artificial Sequence: Synthetic polypeptide
DEEEIRTTNPVATEQYGSVSSTTPAGENMRKGMNPV

SEQ ID NO: 115158 - protein, 36 aa, Artificial Sequence
  Description of Artificial Sequence: Synthetic polypeptide
DEEEIRTTNPVATEQYGSVSSTTPAGENERNGMNPV

SEQ ID NO: 115159 - protein, 36 aa, Artificial Sequence
  Description of Artificial Sequence: Synthetic polypeptide
DEEEIRTTNPVATEQYGSVSSTTPAGDNMRNGMNPV

SEQ ID NO: 115160 - protein, 36 aa, Artificial Sequence
  Description of Artificial Sequence: Synthetic polypeptide
DEEEIRTTNPVATEQYGSVSSTTPAGDNDRNGMNPV

SEQ ID NO: 115161 - protein, 36 aa, Artificial Sequence
  Description of Artificial Sequence: Synthetic polypeptide
DEEEIRTTNPVATEQYGFVSSTTPNGPNMRNGMNPV

SEQ ID NO: 115162 - protein, 36 aa, Artificial Sequence
  Description of Artificial Sequence: Synthetic polypeptide
DEEEIRTTNPVATEQYGSVSSTTPAGCNMRNGMRPV

SEQ ID NO: 115163 - protein, 36 aa, Artificial Sequence
  Description of Artificial Sequence: Synthetic polypeptide
DEEEIRTTNPVATEQYGSVSSTTPAGANMRNGMNPV

SEQ ID NO: 115164 - protein, 36 aa, Artificial Sequence
  Description of Artificial Sequence: Synthetic polypeptide
DEEEIRTTNPVATEQYGSVSSTTPAGANMRGGMNPV

SEQ ID NO: 115165 - protein, 36 aa, Artificial Sequence
  Description of Artificial Sequence: Synthetic polypeptide
DEEEIRTTNPVATEQYGSVSSTTPAGANMREGMNPV

SEQ ID NO: 115166 - protein, 36 aa, Artificial Sequence
  Description of Artificial Sequence: Synthetic polypeptide
DEEEIRTTNPVATEQYGSVSSTTPAFPNMRNGMNPV

SEQ ID NO: 115167 - protein, 36 aa, Artificial Sequence
  Description of Artificial Sequence: Synthetic polypeptide
DEEEIRTTNPVATEQYGSVSSTTPAEPNMRNGMNPV

SEQ ID NO: 115168 - protein, 36 aa, Artificial Sequence
  Description of Artificial Sequence: Synthetic polypeptide
DEEEIRTTNPVATEQYGSVSSTTPADPNMRNGMNPV

SEQ ID NO: 115169 - protein, 36 aa, Artificial Sequence
  Description of Artificial Sequence: Synthetic polypeptide
DEEEIRTTNPVATEQYGSVSSTTPADPNMRNGMNPC

SEQ ID NO: 115170 - protein, 36 aa, Artificial Sequence
  Description of Artificial Sequence: Synthetic polypeptide
DEEEIRTTNPVATEQYGSVSSTTPAGCNMRNGMNPV

SEQ ID NO: 115171 - protein, 36 aa, Artificial Sequence
  Description of Artificial Sequence: Synthetic polypeptide
DEEEIRTTNPVATEQYGSVSSTTPAGFNMRNGMNPF

SEQ ID NO: 115172 - protein, 36 aa, Artificial Sequence
  Description of Artificial Sequence: Synthetic polypeptide
DEEEIRTTNPVATEQYGSVSSTTIAGPNMRNGMNPV

SEQ ID NO: 115173 - protein, 36 aa, Artificial Sequence
  Description of Artificial Sequence: Synthetic polypeptide
DEEEIRTTNPVATEQYGSVSSTTIAGPNMRNGMNCV

SEQ ID NO: 115174 - protein, 34 aa, Artificial Sequence
  Description of Artificial Sequence: Synthetic polypeptide
DEEEIRTTNPVATEQYGGYGTIMTNEGQGGNNGN

SEQ ID NO: 115175 - protein, 36 aa, Artificial Sequence
  Description of Artificial Sequence: Synthetic polypeptide
DEEEIRTTNPVATEQYGSVSSTTEAGENMRNGMNPV

SEQ ID NO: 115176 - protein, 36 aa, Artificial Sequence
  Description of Artificial Sequence: Synthetic polypeptide
DEEEIRTTNPVATEQYGSVSSTTDGGPNMREGMNPV

SEQ ID NO: 115177 - protein, 37 aa, Artificial Sequence
  Description of Artificial Sequence: Synthetic polypeptide
DEEEIRTTNPVATEQYGSVSSTTDALGPNMRNGMNPV

SEQ ID NO: 115178 - protein, 36 aa, Artificial Sequence
  Description of Artificial Sequence: Synthetic polypeptide
DEEEIRTTNPVATEQYGSVSSTTDAGPNMRNGMNPV

SEQ ID NO: 115179 - protein, 36 aa, Artificial Sequence
  Description of Artificial Sequence: Synthetic polypeptide
DEEEIRTTNPVATEQYGSVSSTTDAGPNMREGMNPV

SEQ ID NO: 115180 - protein, 36 aa, Artificial Sequence
  Description of Artificial Sequence: Synthetic polypeptide
DEEEIRTTNPVATEQYGSVSSTTDAGPNMFNGMNPV

SEQ ID NO: 115181 - protein, 36 aa, Artificial Sequence
  Description of Artificial Sequence: Synthetic polypeptide
DEEEIRTTNPVATEQYGSVSSTTEAGPNMRNGMNPI

SEQ ID NO: 115182 - protein, 36 aa, Artificial Sequence
  Description of Artificial Sequence: Synthetic polypeptide
DEEEIRTTNPVATEQYGSVSSTTCAGPNMRNGMNPV

SEQ ID NO: 115183 - protein, 35 aa, Artificial Sequence
  Description of Artificial Sequence: Synthetic polypeptide
DEEEIRTTNPVATEQYGSVSSTTAGPEDHNGMNDV

SEQ ID NO: 115184 - protein, 36 aa, Artificial Sequence
  Description of Artificial Sequence: Synthetic polypeptide
DEEEIRTTNPVATEQYGSVSSTTAAGVNMENGNNPV

SEQ ID NO: 115185 - protein, 36 aa, Artificial Sequence
  Description of Artificial Sequence: Synthetic polypeptide
DEEEIRTTNPVATEQYGSVSSTTAAGPNMRNGMNPV

SEQ ID NO: 115186 - protein, 36 aa, Artificial Sequence
  Description of Artificial Sequence: Synthetic polypeptide
DEEEIRTTNPVATEQYGSVSSTTAAGENVRNGMNPV

SEQ ID NO: 115187 - protein, 36 aa, Artificial Sequence
  Description of Artificial Sequence: Synthetic polypeptide
DEEEIRTTNPVATEQYGSVSSTSPAGPNMRVGVNAV

SEQ ID NO: 115188 - protein, 33 aa, Artificial Sequence
  Description of Artificial Sequence: Synthetic polypeptide
DEEEIRTTNPVAYECYGQKISTNMESQDRVNND

SEQ ID NO: 115189 - protein, 33 aa, Artificial Sequence
  Description of Artificial Sequence: Synthetic polypeptide
DEEEIRTTNPCATEEWGSVATGNDHGGRGQNAA

SEQ ID NO: 115190 - protein, 35 aa, Artificial Sequence
  Description of Artificial Sequence: Synthetic polypeptide
DEEEIRTTNPVATEQYGSVSSTTAGPNMRNGMDPV

SEQ ID NO: 115191 - protein, 36 aa, Artificial Sequence
  Description of Artificial Sequence: Synthetic polypeptide
DEEEIRTTNPVATEQYGSVSSTTIAGPNMRNGMNGV

SEQ ID NO: 115192 - protein, 36 aa, Artificial Sequence
  Description of Artificial Sequence: Synthetic polypeptide
DEEEIRTTNPVATEQYGSVSSTTEAGPNMRNGMNPV

SEQ ID NO: 115193 - protein, 36 aa, Artificial Sequence
  Description of Artificial Sequence: Synthetic polypeptide
DEEEIRTTNPVATEQYGSVSSTTEAGPQQQNGMNPV

SEQ ID NO: 115194 - protein, 36 aa, Artificial Sequence
  Description of Artificial Sequence: Synthetic polypeptide
DEEEIRTTNPVATEQYGSVSSTTHAGPNMRNGMNPV

SEQ ID NO: 115195 - protein, 36 aa, Artificial Sequence
  Description of Artificial Sequence: Synthetic polypeptide
DEEEIRTTNPVATEQYGSVSSTTGAGTNNENGNNPV

SEQ ID NO: 115196 - protein, 36 aa, Artificial Sequence
  Description of Artificial Sequence: Synthetic polypeptide
DEEEIRTTNPVATEQYGSVSSTTGAGPNWRNGMNPV

SEQ ID NO: 115197 - protein, 36 aa, Artificial Sequence
  Description of Artificial Sequence: Synthetic polypeptide
DEEEIRTTNPVATEQYGSVSSTTGAGPNSRDGMNPV

SEQ ID NO: 115198 - protein, 36 aa, Artificial Sequence
  Description of Artificial Sequence: Synthetic polypeptide
DEEEIRTTNPVATEQYGSVSSTTGAGPNMRNGMNYV

SEQ ID NO: 115199 - protein, 36 aa, Artificial Sequence
  Description of Artificial Sequence: Synthetic polypeptide
DEEEIRTTNPVATEQYGSVSSTTGAGPNMRNGMNPV

SEQ ID NO: 115200 - protein, 36 aa, Artificial Sequence
  Description of Artificial Sequence: Synthetic polypeptide
DEEEIRTTNPVATEQYGSVSSTTGAGPNMRNGMNPH

SEQ ID NO: 115201 - protein, 36 aa, Artificial Sequence
  Description of Artificial Sequence: Synthetic polypeptide
DEEEIRTTNPVATEQYGSVSSTTEAGPQMQNGMNPV

SEQ ID NO: 115202 - protein, 36 aa, Artificial Sequence
  Description of Artificial Sequence: Synthetic polypeptide
DEEEIRTTNPVATEQYGSVSSTTGAGPNIRNGMNPV

SEQ ID NO: 115203 - protein, 34 aa, Artificial Sequence
  Description of Artificial Sequence: Synthetic polypeptide
DEEEIRTTNPVAYECYGSVCCTGNAISTGRGGTR

SEQ ID NO: 115204 - protein, 36 aa, Artificial Sequence
  Description of Artificial Sequence: Synthetic polypeptide
DEEEIRTTNPVATEQYGSVSSTTFAGPNMRNGWNPV

SEQ ID NO: 115205 - protein, 36 aa, Artificial Sequence
  Description of Artificial Sequence: Synthetic polypeptide
DEEEIRTTNPVATEQYGSVSSTTFAGPNMRNGMNPV

SEQ ID NO: 115206 - protein, 36 aa, Artificial Sequence
  Description of Artificial Sequence: Synthetic polypeptide
DEEEIRTTNPVATEQYGSVSSTTEAWPNMRNGMNPV

SEQ ID NO: 115207 - protein, 36 aa, Artificial Sequence
  Description of Artificial Sequence: Synthetic polypeptide
DEEEIRTTNPVATEQYGSVSSTTEAWPNMRNGMNPI

SEQ ID NO: 115208 - protein, 30 aa, Artificial Sequence
  Description of Artificial Sequence: Synthetic polypeptide
DEEEIRTTNPCATEEYGCVCGTEHGNFGDA

SEQ ID NO: 115209 - protein, 36 aa, Artificial Sequence
  Description of Artificial Sequence: Synthetic polypeptide
DEEEIRTTNPVATEQYGSVSSTTEAWPNERNGMNPV

SEQ ID NO: 115210 - protein, 36 aa, Artificial Sequence
  Description of Artificial Sequence: Synthetic polypeptide
DEEEIRTTNPVATEQYGSVSSTTFAGSNMRNGMNPV

SEQ ID NO: 115211 - protein, 36 aa, Artificial Sequence
  Description of Artificial Sequence: Synthetic polypeptide
DEEEIRTTNPVATEQYGSVSSTTPAGFNMRNGMNPV

SEQ ID NO: 115212 - protein, 36 aa, Artificial Sequence
  Description of Artificial Sequence: Synthetic polypeptide
DEEEIRTTNPVATEQYGSVSSTTPAGGDMRNGMNPV

SEQ ID NO: 115213 - protein, 36 aa, Artificial Sequence
  Description of Artificial Sequence: Synthetic polypeptide
DEEEIRTTNPVATEQYGSVSSTTPAGGNMRNGMNPV

SEQ ID NO: 115214 - protein, 36 aa, Artificial Sequence
  Description of Artificial Sequence: Synthetic polypeptide
DEEEIRTTNPVATEQYGSVSSTTPAGPNDHNGMNPV

SEQ ID NO: 115215 - protein, 33 aa, Artificial Sequence
  Description of Artificial Sequence: Synthetic polypeptide
DEEEIRTTNPVAYEPDGSTVFTVNLSQDVGGEP

SEQ ID NO: 115216 - protein, 36 aa, Artificial Sequence
  Description of Artificial Sequence: Synthetic polypeptide
DEEEIRTTNPVATEQYGSVSSTTPAGPNDHNGMNDV

SEQ ID NO: 115217 - protein, 36 aa, Artificial Sequence
  Description of Artificial Sequence: Synthetic polypeptide
DEEEIRTTNPVATEQYGSVSSTTPAGPNARNGMNPV

SEQ ID NO: 115218 - protein, 36 aa, Artificial Sequence
  Description of Artificial Sequence: Synthetic polypeptide
DEEEIRTTNPVATEQYGEVSSTNPEGPNMRNGMNPP

SEQ ID NO: 115219 - protein, 36 aa, Artificial Sequence
  Description of Artificial Sequence: Synthetic polypeptide
DEEEIRTTNPVATEQYGSVSSTTPAGPNARNGINPV

SEQ ID NO: 115220 - protein, 36 aa, Artificial Sequence
  Description of Artificial Sequence: Synthetic polypeptide
DEEEIRTTNPVATEQYGSVSSTTPAGPMMRNGMNPV

SEQ ID NO: 115221 - protein, 31 aa, Artificial Sequence
  Description of Artificial Sequence: Synthetic polypeptide
DEEEIRTTNPCATEPYGNCATTHMNRGNEAM

SEQ ID NO: 115222 - protein, 35 aa, Artificial Sequence
  Description of Artificial Sequence: Synthetic polypeptide
DEEEIRTTNPVATEQYGEVSSTPAGPQMRNGMGPV

SEQ ID NO: 115223 - protein, 36 aa, Artificial Sequence
  Description of Artificial Sequence: Synthetic polypeptide
DEEEIRTTNPVATEQYGSVSSTTPAGPLMRNMMNPV

SEQ ID NO: 115224 - protein, 36 aa, Artificial Sequence
  Description of Artificial Sequence: Synthetic polypeptide
DEEEIRTTNPVATEQYGSVSSTTPAGPKMRNGMNPV

SEQ ID NO: 115225 - protein, 36 aa, Artificial Sequence
  Description of Artificial Sequence: Synthetic polypeptide
DEEEIRTTNPVATEQYGSVSSTTPAGPKMRNGMNLV

SEQ ID NO: 115226 - protein, 35 aa, Artificial Sequence
  Description of Artificial Sequence: Synthetic polypeptide
DEEEIRTTNPVATEQYGEVSSTTPAGNMRNGMNPV

SEQ ID NO: 115227 - protein, 33 aa, Artificial Sequence
  Description of Artificial Sequence: Synthetic polypeptide
DEEEIRTTNPVAYEHYGTIACTMNSLSQRTENP

SEQ ID NO: 115228 - protein, 36 aa, Artificial Sequence
  Description of Artificial Sequence: Synthetic polypeptide
DEEEIRTTNPVATEQYGSVSSTTPAGPIMRNGMNPV

SEQ ID NO: 115229 - protein, 36 aa, Artificial Sequence
  Description of Artificial Sequence: Synthetic polypeptide
DEEEIRTTNPVATEQYGSVSSTTPAGPIERNGMNPV

SEQ ID NO: 115230 - protein, 36 aa, Artificial Sequence
  Description of Artificial Sequence: Synthetic polypeptide
DEEEIRTTNPVATEQYGSVSSTTPAGPMMRNGMNPA

SEQ ID NO: 115231 - protein, 36 aa, Artificial Sequence
  Description of Artificial Sequence: Synthetic polypeptide
DEEEIRTTNPVATEQYGSVSSTTPAGPHMRNGMNPV

SEQ ID NO: 115232 - protein, 36 aa, Artificial Sequence
  Description of Artificial Sequence: Synthetic polypeptide
DEEEIRTTNPVATEQYGSVSSTTPAGPNDRDGMNPV

SEQ ID NO: 115233 - protein, 33 aa, Artificial Sequence
  Description of Artificial Sequence: Synthetic polypeptide
DEEEIRTTNPVAYEPWGSTVSLVNLSQDVGGMP

SEQ ID NO: 115234 - protein, 35 aa, Artificial Sequence
  Description of Artificial Sequence: Synthetic polypeptide
DEEEIRTTNPVATEQYGETVPFHNMLSQQNGGNPS

SEQ ID NO: 115235 - protein, 35 aa, Artificial Sequence
  Description of Artificial Sequence: Synthetic polypeptide
DEEEIRTTNPVATEQYGETVPFHNMLSQRGGDPSH

SEQ ID NO: 115236 - protein, 36 aa, Artificial Sequence
  Description of Artificial Sequence: Synthetic polypeptide
DEEEIRTTNPVATEQYGETVPFYHNMLSQRGGNPSN

SEQ ID NO: 115237 - protein, 36 aa, Artificial Sequence
  Description of Artificial Sequence: Synthetic polypeptide
DEEEIRTTNPVATEQYGSVSSTTPAGPNGRNGMNPV

SEQ ID NO: 115238 - protein, 36 aa, Artificial Sequence
  Description of Artificial Sequence: Synthetic polypeptide
DEEEIRTTNPVATEQYGSVSSTTPAGPNGRNGFNPV

SEQ ID NO: 115239 - protein, 36 aa, Artificial Sequence
  Description of Artificial Sequence: Synthetic polypeptide
DEEEIRTTNPVATEQYGSVSSTTPAGPNGGNGENEV

SEQ ID NO: 115240 - protein, 36 aa, Artificial Sequence
  Description of Artificial Sequence: Synthetic polypeptide
DEEEIRTTNPVATEQYGSVSSTTPAGPNFRNGMNPV

SEQ ID NO: 115241 - protein, 33 aa, Artificial Sequence
  Description of Artificial Sequence: Synthetic polypeptide
DEEEIRTTNPVATEQYGEVQTGYYGQQKFDGQI

SEQ ID NO: 115242 - protein, 35 aa, Artificial Sequence
  Description of Artificial Sequence: Synthetic polypeptide
DEEEIRTTNPVATEQYGSVSSTTPAGPNFNGMNPV

SEQ ID NO: 115243 - protein, 35 aa, Artificial Sequence
  Description of Artificial Sequence: Synthetic polypeptide
DEEEIRTTNPVAYEPYGCSVSCTTLSQLVTDGNMC

SEQ ID NO: 115244 - protein, 36 aa, Artificial Sequence
  Description of Artificial Sequence: Synthetic polypeptide
DEEEIRTTNPVATEQYGSVSSTTPAGPNERNGMNPV

SEQ ID NO: 115245 - protein, 36 aa, Artificial Sequence
  Description of Artificial Sequence: Synthetic polypeptide
DEEEIRTTNPVATEQYGSVSSTTPAGPNERNGMNPD

SEQ ID NO: 115246 - protein, 33 aa, Artificial Sequence
  Description of Artificial Sequence: Synthetic polypeptide
DEEEIRTTNPVATEQYGEVFYIFSSGRTGGNNS

SEQ ID NO: 115247 - protein, 36 aa, Artificial Sequence
  Description of Artificial Sequence: Synthetic polypeptide
DEEEIRTTNPVATEQYGSVSSTTPAGPNDRPGMNPV

SEQ ID NO: 115248 - protein, 36 aa, Artificial Sequence
  Description of Artificial Sequence: Synthetic polypeptide
DEEEIRTTNPVATEQYGSVSSTTPAGPNDRNGMNPV

SEQ ID NO: 115249 - protein, 33 aa, Artificial Sequence
  Description of Artificial Sequence: Synthetic polypeptide
DEEEIRTTNPVATEQYGEVPTTPVGPQHGMEPV

SEQ ID NO: 115250 - protein, 33 aa, Artificial Sequence
  Description of Artificial Sequence: Synthetic polypeptide
DEEEIRTTNPVATEQYGEVETVLVPIEQGEEEI

SEQ ID NO: 115251 - protein, 36 aa, Artificial Sequence
  Description of Artificial Sequence: Synthetic polypeptide
DEEEIRTTNPVATEQYGSVSSTTPAGPGMRNGMNPV

SEQ ID NO: 115252 - protein, 36 aa, Artificial Sequence
  Description of Artificial Sequence: Synthetic polypeptide
DEEEIRTTNPVATEQYGSVSSTTPAGPFMRNGVNPV

SEQ ID NO: 115253 - protein, 36 aa, Artificial Sequence
  Description of Artificial Sequence: Synthetic polypeptide
DEEEIRTTNPVATEQYGSVSSTTPAGPFMRNGMNPV

SEQ ID NO: 115254 - protein, 36 aa, Artificial Sequence
  Description of Artificial Sequence: Synthetic polypeptide
DEEEIRTTNPVATEQYGSVSSTTPAGMNMRNGMNPV

SEQ ID NO: 115255 - protein, 34 aa, Artificial Sequence
  Description of Artificial Sequence: Synthetic polypeptide
DEEEIRTTNPVATEQYGFCQSCTPYEIQEQEANR

SEQ ID NO: 115256 - protein, 35 aa, Artificial Sequence
  Description of Artificial Sequence: Synthetic polypeptide
DEEEIRTTNPVATEQYGFCQSETPNEIQEQEAPNR

SEQ ID NO: 115257 - protein, 37 aa, Artificial Sequence
  Description of Artificial Sequence: Synthetic polypeptide
DEEEIRTTNPVATEQYGSVSSTTPAGLNMRNGMNPVT

SEQ ID NO: 115258 - protein, 33 aa, Artificial Sequence
  Description of Artificial Sequence: Synthetic polypeptide
DEEEIRTTNPVATEQYGFCQSGPNEIQEQEAPR

SEQ ID NO: 115259 - protein, 36 aa, Artificial Sequence
  Description of Artificial Sequence: Synthetic polypeptide
DEEEIRTTNPVATEQYGSVSSTTPAGKNMRNGMNPV

SEQ ID NO: 115260 - protein, 34 aa, Artificial Sequence
  Description of Artificial Sequence: Synthetic polypeptide
DEEEIRTTNPVATEQYGFCQSTPNEIQEQEAIRL

SEQ ID NO: 115261 - protein, 36 aa, Artificial Sequence
  Description of Artificial Sequence: Synthetic polypeptide
DEEEIRTTNPVATEQYGSVSSTTPAGMNMSNGMNPV

SEQ ID NO: 115262 - protein, 36 aa, Artificial Sequence
  Description of Artificial Sequence: Synthetic polypeptide
DEEEIRTTNPVATEQYGSVSSTTPAGINMRNGMNPV

SEQ ID NO: 115263 - protein, 36 aa, Artificial Sequence
  Description of Artificial Sequence: Synthetic polypeptide
DEEEIRTTNPVATEQYGSVSSTTPAGGNQGNGVNPV

SEQ ID NO: 115264 - protein, 36 aa, Artificial Sequence
  Description of Artificial Sequence: Synthetic polypeptide
DEEEIRTTNPVATEQYGSVSSTTPAGGNMTNGGNPV

SEQ ID NO: 115265 - protein, 36 aa, Artificial Sequence
  Description of Artificial Sequence: Synthetic polypeptide
DEEEIRTTNPVATEQYGSVSSTTPAGGNMRNSMNPV

SEQ ID NO: 115266 - protein, 36 aa, Artificial Sequence
  Description of Artificial Sequence: Synthetic polypeptide
DEEEIRTTNPVATEQYGSVSSTTPAGGNMRNPMNPV

SEQ ID NO: 115267 - protein, 36 aa, Artificial Sequence
  Description of Artificial Sequence: Synthetic polypeptide
DEEEIRTTNPVATEQYGSVSSTTPAGGNMRNIMNPV

SEQ ID NO: 115268 - protein, 36 aa, Artificial Sequence
  Description of Artificial Sequence: Synthetic polypeptide
DEEEIRTTNPVATEQYGSVSSTTPAGGNMRNGMPPV

SEQ ID NO: 115269 - protein, 36 aa, Artificial Sequence
  Description of Artificial Sequence: Synthetic polypeptide
DEEEIRTTNPVATEQYGSVSSTTPAGGNMRNGMNTV

SEQ ID NO: 115270 - protein, 36 aa, Artificial Sequence
  Description of Artificial Sequence: Synthetic polypeptide
DEEEIRTTNPVATEQYGSVSSTTPAGHNMRNGMNPV

SEQ ID NO: 115271 - protein, 34 aa, Artificial Sequence
  Description of Artificial Sequence: Synthetic polypeptide
DEEEIRTTNPVATEQYGEVVGTANMGVGGGNEGI

SEQ ID NO: 115272 - protein, 35 aa, Artificial Sequence
  Description of Artificial Sequence: Synthetic polypeptide
DEEEIRTTNPVAYEGYGQSSFSTEALLYQRNFNDR

SEQ ID NO: 115273 - protein, 36 aa, Artificial Sequence
  Description of Artificial Sequence: Synthetic polypeptide
DEEEIRTTNPVATEQYGSVSSTTPAGNNMRNFMNPV

SEQ ID NO: 115274 - protein, 36 aa, Artificial Sequence
  Description of Artificial Sequence: Synthetic polypeptide
DEEEIRTTNPVATEQYGSVSSTTPAGPFMRNGMNMV

SEQ ID NO: 115275 - protein, 36 aa, Artificial Sequence
  Description of Artificial Sequence: Synthetic polypeptide
DEEEIRTTNPVATEQYGSVSSTTPAGPFMRNGMNFV

SEQ ID NO: 115276 - protein, 36 aa, Artificial Sequence
  Description of Artificial Sequence: Synthetic polypeptide
DEEEIRTTNPVATEQYGSVSSTTPAGPEMRYGMNPV

SEQ ID NO: 115277 - protein, 36 aa, Artificial Sequence
  Description of Artificial Sequence: Synthetic polypeptide
DEEEIRTTNPVATEQYGSVSSTTPAGPEMRNGMNTV

SEQ ID NO: 115278 - protein, 35 aa, Artificial Sequence
  Description of Artificial Sequence: Synthetic polypeptide
DEEEIRTTNPVATEQYGEVSSTTPVGPNMRNGMNV

SEQ ID NO: 115279 - protein, 32 aa, Artificial Sequence
  Description of Artificial Sequence: Synthetic polypeptide
DEEEIRTTNPCATEGYGCCCSWNLAESFGSNQ

SEQ ID NO: 115280 - protein, 36 aa, Artificial Sequence
  Description of Artificial Sequence: Synthetic polypeptide
DEEEIRTTNPVATEQYGSVSSTTPAGPEMRNGMNPV

SEQ ID NO: 115281 - protein, 36 aa, Artificial Sequence
  Description of Artificial Sequence: Synthetic polypeptide
DEEEIRTTNPVATEQYGSVSSTTPAGPEMRNGMNNV

SEQ ID NO: 115282 - protein, 36 aa, Artificial Sequence
  Description of Artificial Sequence: Synthetic polypeptide
DEEEIRTTNPVATEQYGSVSSTTPAGPEMREGMNPV

SEQ ID NO: 115283 - protein, 36 aa, Artificial Sequence
  Description of Artificial Sequence: Synthetic polypeptide
DEEEIRTTNPVATEQYGSVSSTTPAGPEMREGMNPL

SEQ ID NO: 115284 - protein, 36 aa, Artificial Sequence
  Description of Artificial Sequence: Synthetic polypeptide
DEEEIRTTNPVATEQYGSVSSTTPAGPEHRNGMNPV

SEQ ID NO: 115285 - protein, 36 aa, Artificial Sequence
  Description of Artificial Sequence: Synthetic polypeptide
DEEEIRTTNPVATEQYGSVSSTTPAGPDMRNGMNPV

SEQ ID NO: 115286 - protein, 36 aa, Artificial Sequence
  Description of Artificial Sequence: Synthetic polypeptide
DEEEIRTTNPVATEQYGSVSSTTPAGPDMRNGMNDV

SEQ ID NO: 115287 - protein, 36 aa, Artificial Sequence
  Description of Artificial Sequence: Synthetic polypeptide
DEEEIRTTNPVATEQYGSVSSTTPAGPAMRNGMNPV

SEQ ID NO: 115288 - protein, 36 aa, Artificial Sequence
  Description of Artificial Sequence: Synthetic polypeptide
DEEEIRTTNPVATEQYGSVSSTTPAGPAERMGSNPV

SEQ ID NO: 115289 - protein, 31 aa, Artificial Sequence
  Description of Artificial Sequence: Synthetic polypeptide
DEEEIRTTNPCATEGYGCCCSSELAYGSNQS

SEQ ID NO: 115290 - protein, 36 aa, Artificial Sequence
  Description of Artificial Sequence: Synthetic polypeptide
DEEEIRTTNPVATEQYGSVSSTTPAGNTMFNGMNPV

SEQ ID NO: 115291 - protein, 33 aa, Artificial Sequence
  Description of Artificial Sequence: Synthetic polypeptide
DEEEIRTTNPCATEEWGSVATGNDHAGGRGNAM

SEQ ID NO: 115292 - protein, 35 aa, Artificial Sequence
  Description of Artificial Sequence: Synthetic polypeptide
DEEEIRTTNPCATECYGSVCSKTENQDDRNGGNAH

SEQ ID NO: 115293 - protein, 34 aa, Artificial Sequence
  Description of Artificial Sequence: Synthetic polypeptide
DEEEIRTTNPCATECYGSVCSKTENQDDRNGGAQ

SEQ ID NO: 115294 - protein, 36 aa, Artificial Sequence
  Description of Artificial Sequence: Synthetic polypeptide
DEEEIRTTNPVATEQYGSVSSTSPAGPNMRNGMNPV

SEQ ID NO: 115295 - protein, 36 aa, Artificial Sequence
  Description of Artificial Sequence: Synthetic polypeptide
DEEEIRTTNPVATEQYGSVSSTEPAGPQMRNGMEPK

SEQ ID NO: 115296 - protein, 33 aa, Artificial Sequence
  Description of Artificial Sequence: Synthetic polypeptide
DEEEIRTTNPVATEQYGMVGITGMGNEDEDNEG

SEQ ID NO: 115297 - protein, 32 aa, Artificial Sequence
  Description of Artificial Sequence: Synthetic polypeptide
DEEEIRTTNPVATEQYGMVGITGMGNEEDQGD

SEQ ID NO: 115298 - protein, 34 aa, Artificial Sequence
  Description of Artificial Sequence: Synthetic polypeptide
DEEEIRTTNPVATEQYGMVGITGMGNEQEDGGGG

SEQ ID NO: 115299 - protein, 35 aa, Artificial Sequence
  Description of Artificial Sequence: Synthetic polypeptide
DEEEIRTTNPVATEQYGSVSSTEPAGPNRNGMEPV

SEQ ID NO: 115300 - protein, 33 aa, Artificial Sequence
  Description of Artificial Sequence: Synthetic polypeptide
DEEEIRTTNPVATEQYGMVGITNGMGEEDNGGD

SEQ ID NO: 115301 - protein, 35 aa, Artificial Sequence
  Description of Artificial Sequence: Synthetic polypeptide
DEAEIRTTNPVATEQYGSVCSLLSQTEIGQNEDHR

SEQ ID NO: 115302 - protein, 36 aa, Artificial Sequence
  Description of Artificial Sequence: Synthetic polypeptide
DEEEIRTTNPVATEQYGSVSSTEPALPNMRNGMEPL

SEQ ID NO: 115303 - protein, 33 aa, Artificial Sequence
  Description of Artificial Sequence: Synthetic polypeptide
DEAEIRTTNPVATEQYGSVCSLLQTEIYQNEDN

SEQ ID NO: 115304 - protein, 35 aa, Artificial Sequence
  Description of Artificial Sequence: Synthetic polypeptide
DEEEIRTTNPVATEQYGMVGSEGNMDQGGGQENEE

SEQ ID NO: 115305 - protein, 36 aa, Artificial Sequence
  Description of Artificial Sequence: Synthetic polypeptide
DEEEIRTTNPVATEQYGMVGSGILNQLEEQGNGNGI

SEQ ID NO: 115306 - protein, 35 aa, Artificial Sequence
  Description of Artificial Sequence: Synthetic polypeptide
DEEEIRTTNPVATEQYGMVGSGNMNMNQEIFGFNN

SEQ ID NO: 115307 - protein, 35 aa, Artificial Sequence
  Description of Artificial Sequence: Synthetic polypeptide
DEEEIRTTNPVATEQYGMVGSGNMNMNQNIFGNNE

SEQ ID NO: 115308 - protein, 35 aa, Artificial Sequence
  Description of Artificial Sequence: Synthetic polypeptide
DEEEIRTTNPVATEQYGMVGSGNMNNQDIFGNQEI

SEQ ID NO: 115309 - protein, 34 aa, Artificial Sequence
  Description of Artificial Sequence: Synthetic polypeptide
DEEEIRTTNPVATEQYGMVGSGNMNQGEFDNNGI

SEQ ID NO: 115310 - protein, 36 aa, Artificial Sequence
  Description of Artificial Sequence: Synthetic polypeptide
DEEEIRTTNPVATEQYGSVSSTEPAGPNMSNGMNVV

SEQ ID NO: 115311 - protein, 34 aa, Artificial Sequence
  Description of Artificial Sequence: Synthetic polypeptide
DEEEIRTCNPVATEQYGSVVGNRGLQGAEGQGEI

SEQ ID NO: 115312 - protein, 36 aa, Artificial Sequence
  Description of Artificial Sequence: Synthetic polypeptide
DEEEIRTTNPVATEQYGSVSSTEPAGPNMRNGQNPV

SEQ ID NO: 115313 - protein, 33 aa, Artificial Sequence
  Description of Artificial Sequence: Synthetic polypeptide
DEEEIRTTNPVATEQYGMVGITGMGGGEDNGGD

SEQ ID NO: 115314 - protein, 33 aa, Artificial Sequence
  Description of Artificial Sequence: Synthetic polypeptide
DEEEIRTTNPVATEQYGMVENGNGGNLNGENGI

SEQ ID NO: 115315 - protein, 33 aa, Artificial Sequence
  Description of Artificial Sequence: Synthetic polypeptide
DEDEIRTTNPVATEQYGEWTMTTNLNQEGGEDS

SEQ ID NO: 115316 - protein, 32 aa, Artificial Sequence
  Description of Artificial Sequence: Synthetic polypeptide
DEDEIRTTNPVATEQYGMTSTGDGQGDGDGED

SEQ ID NO: 115317 - protein, 34 aa, Artificial Sequence
  Description of Artificial Sequence: Synthetic polypeptide
DEEEIRTTNCVATEGYGSVSNNDEMQNQEGNQGG

SEQ ID NO: 115318 - protein, 35 aa, Artificial Sequence
  Description of Artificial Sequence: Synthetic polypeptide
DEEEIRTCNPVAYEQYGSTVVSCTRLSQRTVGQPE

SEQ ID NO: 115319 - protein, 35 aa, Artificial Sequence
  Description of Artificial Sequence: Synthetic polypeptide
DEEEIRTCNPVAYEQYGSTVSCTRLSQYDTVGQNM

SEQ ID NO: 115320 - protein, 35 aa, Artificial Sequence
  Description of Artificial Sequence: Synthetic polypeptide
DEEEIRTCNPVAYEQYGSTVSCTGRCSQRTVGQNE

SEQ ID NO: 115321 - protein, 35 aa, Artificial Sequence
  Description of Artificial Sequence: Synthetic polypeptide
DEEEIRTCNPVAYEQYGCTVSCTRLSAQRTVGQNE

SEQ ID NO: 115322 - protein, 33 aa, Artificial Sequence
  Description of Artificial Sequence: Synthetic polypeptide
DEEEIRTTNPVATEQYGMVGDGNMNQGEFNNGG

SEQ ID NO: 115323 - protein, 33 aa, Artificial Sequence
  Description of Artificial Sequence: Synthetic polypeptide
DEDEIRTTNPVATEQYGMYTIMTNGGQGGENEG

SEQ ID NO: 115324 - protein, 35 aa, Artificial Sequence
  Description of Artificial Sequence: Synthetic polypeptide
DEEEIRTCNPVATEQYGSVVVGTRGLQRENEQGEI

SEQ ID NO: 115325 - protein, 34 aa, Artificial Sequence
  Description of Artificial Sequence: Synthetic polypeptide
DEEEIRTCNPVATEQYGSVVVGTRGLGEGNQGEQ

SEQ ID NO: 115326 - protein, 36 aa, Artificial Sequence
  Description of Artificial Sequence: Synthetic polypeptide
DEEEIRTTNPVATEQYGSVSSTFTAGPNMRNGMNPV

SEQ ID NO: 115327 - protein, 35 aa, Artificial Sequence
  Description of Artificial Sequence: Synthetic polypeptide
DEEEIRTTNPVATEQYGMTVWETIDPGQREGNGNG

SEQ ID NO: 115328 - protein, 36 aa, Artificial Sequence
  Description of Artificial Sequence: Synthetic polypeptide
DEEEIRTTNPVATEQYGSVSSTFPAGPNMRNGMNPV

SEQ ID NO: 115329 - protein, 33 aa, Artificial Sequence
  Description of Artificial Sequence: Synthetic polypeptide
DEEEIRTCNPVATEQYGSVVGTRGLGGENQGEQ

SEQ ID NO: 115330 - protein, 34 aa, Artificial Sequence
  Description of Artificial Sequence: Synthetic polypeptide
DEEEIRTCNPVATEQYGSVVGTRGLGDEGNQGEI

SEQ ID NO: 115331 - protein, 36 aa, Artificial Sequence
  Description of Artificial Sequence: Synthetic polypeptide
DEEEIRTTNPVATEQYGSVSSTGFGQQIGEEGNEDG

SEQ ID NO: 115332 - protein, 36 aa, Artificial Sequence
  Description of Artificial Sequence: Synthetic polypeptide
DEEEIRTTNPVATEQYGSVSSTEPAGPNMRNGMNPV

SEQ ID NO: 115333 - protein, 36 aa, Artificial Sequence
  Description of Artificial Sequence: Synthetic polypeptide
DEEEIRTTNPVATEQYGSVSSTEPAGPNMRNGMNPL

SEQ ID NO: 115334 - protein, 33 aa, Artificial Sequence
  Description of Artificial Sequence: Synthetic polypeptide
DEEEIRTTNPVATEQYGMVGSIDFLGEGGDEGD

SEQ ID NO: 115335 - protein, 33 aa, Artificial Sequence
  Description of Artificial Sequence: Synthetic polypeptide
DEDEIRTTNPVATEQYGSLSTADNVRDNSLQEE

SEQ ID NO: 115336 - protein, 37 aa, Artificial Sequence
  Description of Artificial Sequence: Synthetic polypeptide
DEEEIRTTNPVATEQYGSVSSTDNGLIGEFTGGNTIT

SEQ ID NO: 115337 - protein, 35 aa, Artificial Sequence
  Description of Artificial Sequence: Synthetic polypeptide
DEDEIRTTNPVATEQYGSVAITDNQDDHRQGGDRQ

SEQ ID NO: 115338 - protein, 35 aa, Artificial Sequence
  Description of Artificial Sequence: Synthetic polypeptide
DEDEIRTTNPVATEQYGSVATTQALQIGTTEDENE

SEQ ID NO: 115339 - protein, 34 aa, Artificial Sequence
  Description of Artificial Sequence: Synthetic polypeptide
DEDEIRTTNPVATEQYGSVATTQALQINETTNNE

SEQ ID NO: 115340 - protein, 35 aa, Artificial Sequence
  Description of Artificial Sequence: Synthetic polypeptide
DEEEIRTTNPVATEQYGSVSSTDGFGQDEEENFGA

SEQ ID NO: 115341 - protein, 31 aa, Artificial Sequence
  Description of Artificial Sequence: Synthetic polypeptide
DEEEIRSTNPVSTEPYGVVSMEDIQQQNGNH

SEQ ID NO: 115342 - protein, 35 aa, Artificial Sequence
  Description of Artificial Sequence: Synthetic polypeptide
DEEEIRTTNPVATEQYGMVGSTMEFGQSEMGNNGN

SEQ ID NO: 115343 - protein, 36 aa, Artificial Sequence
  Description of Artificial Sequence: Synthetic polypeptide
DEEEIRTTNPVATEQYGSVSSTCPAGPNMRNGSNPV

SEQ ID NO: 115344 - protein, 34 aa, Artificial Sequence
  Description of Artificial Sequence: Synthetic polypeptide
DEEEIRSTNPVCTEQYGVVSTDNLPNMSNGMNPV

SEQ ID NO: 115345 - protein, 34 aa, Artificial Sequence
  Description of Artificial Sequence: Synthetic polypeptide
DEEEIRSTNPVCTEQYGVVSTDNLPNMSNGMNPQ

SEQ ID NO: 115346 - protein, 36 aa, Artificial Sequence
  Description of Artificial Sequence: Synthetic polypeptide
DEEEIRTTNPVATEQYGSVSSTCPAGPNDRNGMNPV

SEQ ID NO: 115347 - protein, 34 aa, Artificial Sequence
  Description of Artificial Sequence: Synthetic polypeptide
DEEEIRSTNPVCTEQYGSVSSTPALPNMSGMNPV

SEQ ID NO: 115348 - protein, 35 aa, Artificial Sequence
  Description of Artificial Sequence: Synthetic polypeptide
DEDEIRTTNPVATEQYGSVATTQANLQINTTNVAE

SEQ ID NO: 115349 - protein, 30 aa, Artificial Sequence
  Description of Artificial Sequence: Synthetic polypeptide
DEEEIRSTNPVCTEQWGDVSEILMNSAGDA

SEQ ID NO: 115350 - protein, 35 aa, Artificial Sequence
  Description of Artificial Sequence: Synthetic polypeptide
DEEEIRTTNPVATEQYGMVGSVTGIGNQNQGDGDN

SEQ ID NO: 115351 - protein, 36 aa, Artificial Sequence
  Description of Artificial Sequence: Synthetic polypeptide
DEEEIRTTNPVATEQYGSVSSTCPAGPNMRNGMNPV

SEQ ID NO: 115352 - protein, 36 aa, Artificial Sequence
  Description of Artificial Sequence: Synthetic polypeptide
DEEEIRTTNPVATEQYGMVGSTGNMDQQGGGGNEDV

SEQ ID NO: 115353 - protein, 35 aa, Artificial Sequence
  Description of Artificial Sequence: Synthetic polypeptide
DEEEIRTTNPVATEQYGMVGSTGMGGQGEGGNITF

SEQ ID NO: 115354 - protein, 35 aa, Artificial Sequence
  Description of Artificial Sequence: Synthetic polypeptide
DEEEIRTTNPVATEQYGMVGSTGMGGQGEFGNGEF

SEQ ID NO: 115355 - protein, 33 aa, Artificial Sequence
  Description of Artificial Sequence: Synthetic polypeptide
DEEEIRTTNPVATEQYGMVGSIDFLGEGGGGEQ

SEQ ID NO: 115356 - protein, 35 aa, Artificial Sequence
  Description of Artificial Sequence: Synthetic polypeptide
DEEEIRTTNPVATEQYGSVSSTEPAGPNMHNEMNV

SEQ ID NO: 115357 - protein, 33 aa, Artificial Sequence
  Description of Artificial Sequence: Synthetic polypeptide
DEEEIRTTNPVATEQYGMVGSIDFLGEGGGGET

SEQ ID NO: 115358 - protein, 33 aa, Artificial Sequence
  Description of Artificial Sequence: Synthetic polypeptide
DEEEIRTTNPVATEQYGMVGSIDFLGEGGQGQD

SEQ ID NO: 115359 - protein, 34 aa, Artificial Sequence
  Description of Artificial Sequence: Synthetic polypeptide
DEEEIRTTNPVATEQYGMVGSIDFQGIGGNQEGD

SEQ ID NO: 115360 - protein, 36 aa, Artificial Sequence
  Description of Artificial Sequence: Synthetic polypeptide
DEEEIRTTNPVATEQYGSVSSTEPACPNMRNGMNPV

SEQ ID NO: 115361 - protein, 35 aa, Artificial Sequence
  Description of Artificial Sequence: Synthetic polypeptide
DEEEIRTTNPVATEQYGMVGSIDNLDETGGNGNGE

SEQ ID NO: 115362 - protein, 34 aa, Artificial Sequence
  Description of Artificial Sequence: Synthetic polypeptide
DEEEIRTTNPVATEQYGMVGSIMNDEGGQGNGDE

SEQ ID NO: 115363 - protein, 34 aa, Artificial Sequence
  Description of Artificial Sequence: Synthetic polypeptide
DEDEIRTTNPVATEQYGSCSTNNLETGGISMQEM

SEQ ID NO: 115364 - protein, 36 aa, Artificial Sequence
  Description of Artificial Sequence: Synthetic polypeptide
DEEEIRTTNPVATEQYGSVSSTDPAGPVMRNGMNPV

SEQ ID NO: 115365 - protein, 36 aa, Artificial Sequence
  Description of Artificial Sequence: Synthetic polypeptide
DEEEIRTTNPVATEQYGSVSSTDPAGPNMRNGMNPV

SEQ ID NO: 115366 - protein, 36 aa, Artificial Sequence
  Description of Artificial Sequence: Synthetic polypeptide
DEEEIRTTNPVATEQYGSVSSTDPAGPNMRNGMNPF

SEQ ID NO: 115367 - protein, 30 aa, Artificial Sequence
  Description of Artificial Sequence: Synthetic polypeptide
DEEEIRSVNPVATEQWGVVSEIEQNAAGDQ

SEQ ID NO: 115368 - protein, 32 aa, Artificial Sequence
  Description of Artificial Sequence: Synthetic polypeptide
DEEEIRSTNPVSTEQYGVVSMEDIQQQSNGNH

SEQ ID NO: 115369 - protein, 36 aa, Artificial Sequence
  Description of Artificial Sequence: Synthetic polypeptide
DEEEIRTTNPVATEQYGSVSSTDPAGPNMENGMNPV

SEQ ID NO: 115370 - protein, 36 aa, Artificial Sequence
  Description of Artificial Sequence: Synthetic polypeptide
DEEEIRTTNPVATEQYGSVSSTDPAGPGMRNGMNPV

SEQ ID NO: 115371 - protein, 32 aa, Artificial Sequence
  Description of Artificial Sequence: Synthetic polypeptide
DEEEIRSTNPVSTEQYGTVSMEDIQQQSNGNH

SEQ ID NO: 115372 - protein, 36 aa, Artificial Sequence
  Description of Artificial Sequence: Synthetic polypeptide
DEEEIRTTNPVATEQYGSVSSTGPAGPEMRNGMNPV

SEQ ID NO: 115373 - protein, 35 aa, Artificial Sequence
  Description of Artificial Sequence: Synthetic polypeptide
DEEEIRTTNPVATEQYGETVPFHNMLSQPGGNPSQ

SEQ ID NO: 115374 - protein, 36 aa, Artificial Sequence
  Description of Artificial Sequence: Synthetic polypeptide
DEEEIRTTNPVATEQYGSVSSTGPAGPNMRNGMNPV

SEQ ID NO: 115375 - protein, 36 aa, Artificial Sequence
  Description of Artificial Sequence: Synthetic polypeptide
DEEEIRTTNPVATEQYGSVSSTHPAGPNMPNGMNPV

SEQ ID NO: 115376 - protein, 35 aa, Artificial Sequence
  Description of Artificial Sequence: Synthetic polypeptide
DEEEIRTTNPCATEAYGSVTVSTTNLEAGNNNNTE

SEQ ID NO: 115377 - protein, 37 aa, Artificial Sequence
  Description of Artificial Sequence: Synthetic polypeptide
DEEEIRTTNPVATEQYGISVSSTTPAGNNMRNGMNPV

SEQ ID NO: 115378 - protein, 36 aa, Artificial Sequence
  Description of Artificial Sequence: Synthetic polypeptide
DEEEIRTTNPCATEAYGSVTVSTNNNLQAGTTNGTE

SEQ ID NO: 115379 - protein, 36 aa, Artificial Sequence
  Description of Artificial Sequence: Synthetic polypeptide
DEEEIRTTNPCATEAYGSVTVSTNNLQAGTTTNNTE

SEQ ID NO: 115380 - protein, 35 aa, Artificial Sequence
  Description of Artificial Sequence: Synthetic polypeptide
DEEEIRTTNPCATEAYGSVTVSTNNLQAGTTEETE

SEQ ID NO: 115381 - protein, 35 aa, Artificial Sequence
  Description of Artificial Sequence: Synthetic polypeptide
DEEEIRTTNPVATEQYGSVSSTPAGPNMRNGMDPV

SEQ ID NO: 115382 - protein, 33 aa, Artificial Sequence
  Description of Artificial Sequence: Synthetic polypeptide
DEEEIRTTNPCATEAYGSVLLTLEHEEVRGNEV

SEQ ID NO: 115383 - protein, 35 aa, Artificial Sequence
  Description of Artificial Sequence: Synthetic polypeptide
DEEEIRTTNPCATEAYGSVTVSTTNLEAGTNNDTG

SEQ ID NO: 115384 - protein, 35 aa, Artificial Sequence
  Description of Artificial Sequence: Synthetic polypeptide
DEDEIRTTNPVATEQWGSVCSTNDGGGHQGENNRP

SEQ ID NO: 115385 - protein, 36 aa, Artificial Sequence
  Description of Artificial Sequence: Synthetic polypeptide
DEEEIRTTNPVATEQYGSVSSTNPSGPNMRNGMGPV

SEQ ID NO: 115386 - protein, 37 aa, Artificial Sequence
  Description of Artificial Sequence: Synthetic polypeptide
DEEEIRTTNPVATEQYGSVSSTNPEGPNMRNGMNPGE

SEQ ID NO: 115387 - protein, 36 aa, Artificial Sequence
  Description of Artificial Sequence: Synthetic polypeptide
DEEEIRTTNPVATEQYGSVSSTNPAGPNMRNTMNPV

SEQ ID NO: 115388 - protein, 35 aa, Artificial Sequence
  Description of Artificial Sequence: Synthetic polypeptide
DEEEIRTTNPVATEQYGIVSSTTPNGNMSNGMNPV

SEQ ID NO: 115389 - protein, 36 aa, Artificial Sequence
  Description of Artificial Sequence: Synthetic polypeptide
DEEEIRTTNPVATEQYGSVSSTNPAGPNMRNGMGPV

SEQ ID NO: 115390 - protein, 37 aa, Artificial Sequence
  Description of Artificial Sequence: Synthetic polypeptide
DEEEIRTTNPVATEQYGSVSSTNPAFGPNMRNGMNPV

SEQ ID NO: 115391 - protein, 34 aa, Artificial Sequence
  Description of Artificial Sequence: Synthetic polypeptide
DEDEIRTTNPVATEQWGTVSTNQQAGNNNVAEDA

SEQ ID NO: 115392 - protein, 35 aa, Artificial Sequence
  Description of Artificial Sequence: Synthetic polypeptide
DEEEIRTTNPVATEQYGIVSSTPAGPNMRNGMNPV

SEQ ID NO: 115393 - protein, 34 aa, Artificial Sequence
  Description of Artificial Sequence: Synthetic polypeptide
DEEEIRTTNPCATEAYGSVATTNNDQGTQQGTNA

SEQ ID NO: 115394 - protein, 36 aa, Artificial Sequence
  Description of Artificial Sequence: Synthetic polypeptide
DEEEIRTTNPCATEAYGSVTVSTTNLQAGSTTNETE

SEQ ID NO: 115395 - protein, 32 aa, Artificial Sequence
  Description of Artificial Sequence: Synthetic polypeptide
DEDEIRTTNPVATEQWGGCCATNHQAEGPERS

SEQ ID NO: 115396 - protein, 36 aa, Artificial Sequence
  Description of Artificial Sequence: Synthetic polypeptide
DEEEIRTTNPVATEQYGSVSSTRPWGPNMRNGMNPV

SEQ ID NO: 115397 - protein, 36 aa, Artificial Sequence
  Description of Artificial Sequence: Synthetic polypeptide
DEEEIRTTNPVATEQYGSVSSTRPAGPNMRNGMNPV

SEQ ID NO: 115398 - protein, 33 aa, Artificial Sequence
  Description of Artificial Sequence: Synthetic polypeptide
DEEEIRTTNPVATEQYGICFTTNFLDQDPEEFK

SEQ ID NO: 115399 - protein, 33 aa, Artificial Sequence
  Description of Artificial Sequence: Synthetic polypeptide
DEEEIRTTNPCATEAYGSVYLTLEHEVRGNEAQ

SEQ ID NO: 115400 - protein, 34 aa, Artificial Sequence
  Description of Artificial Sequence: Synthetic polypeptide
DEEEIRTTNPVAYEAYGWVSDNNLSQQKTGGNNN

SEQ ID NO: 115401 - protein, 34 aa, Artificial Sequence
  Description of Artificial Sequence: Synthetic polypeptide
DEEEIRTTNPVAYEAYGWVSCNNLSQQKAGGNVA

SEQ ID NO: 115402 - protein, 36 aa, Artificial Sequence
  Description of Artificial Sequence: Synthetic polypeptide
DEEEIRTTNPVATEQYGSVSSTQPAGPNMRNGMNPV

SEQ ID NO: 115403 - protein, 35 aa, Artificial Sequence
  Description of Artificial Sequence: Synthetic polypeptide
DEEEIRTTNPVATEQYGSVSSTPAGPNMRNGMGPV

SEQ ID NO: 115404 - protein, 33 aa, Artificial Sequence
  Description of Artificial Sequence: Synthetic polypeptide
DEEEIRTTNPVAYEAYGTVISCNINAFDRENNR

SEQ ID NO: 115405 - protein, 36 aa, Artificial Sequence
  Description of Artificial Sequence: Synthetic polypeptide
DEEEIRTTNPVATEQYGSVSSTPPAWPNMRNGMNPV

SEQ ID NO: 115406 - protein, 35 aa, Artificial Sequence
  Description of Artificial Sequence: Synthetic polypeptide
DEEEIRTTNPVATEQYGISCSTTTLETEGNNQGED

SEQ ID NO: 115407 - protein, 33 aa, Artificial Sequence
  Description of Artificial Sequence: Synthetic polypeptide
DEEEIRTTNPVAYEAYGTTPSEAEHSQRGGNPR

SEQ ID NO: 115408 - protein, 32 aa, Artificial Sequence
  Description of Artificial Sequence: Synthetic polypeptide
DEEEIRTTNPVAYEAYGTTPCTAEHSQRGGNS

SEQ ID NO: 115409 - protein, 36 aa, Artificial Sequence
  Description of Artificial Sequence: Synthetic polypeptide
DEEEIRTTNPVATEQYGSVSSTPPAGPNMRNGMNPV

SEQ ID NO: 115410 - protein, 36 aa, Artificial Sequence
  Description of Artificial Sequence: Synthetic polypeptide
DEEEIRTTNPVATEQYGSVSSTPPAGPNMRNGMNHV

SEQ ID NO: 115411 - protein, 30 aa, Artificial Sequence
  Description of Artificial Sequence: Synthetic polypeptide
DEDEIRTTNPVATEQWGDVSEIEMNAAGDA

SEQ ID NO: 115412 - protein, 36 aa, Artificial Sequence
  Description of Artificial Sequence: Synthetic polypeptide
DEEEIRTTNPVATEQYGSVSSTPPKGPNMRNGMNPV

SEQ ID NO: 115413 - protein, 34 aa, Artificial Sequence
  Description of Artificial Sequence: Synthetic polypeptide
DEEEIRTTNPCATEAYGSVATTNNDQGQNGTNAE

SEQ ID NO: 115414 - protein, 34 aa, Artificial Sequence
  Description of Artificial Sequence: Synthetic polypeptide
DEEEIRTTNPCATEAYGSVATTNNDNGQQGTNAE

SEQ ID NO: 115415 - protein, 35 aa, Artificial Sequence
  Description of Artificial Sequence: Synthetic polypeptide
DEAEIRTTNPVATEQYGSVCSPLPLQTEIGQNEDH

SEQ ID NO: 115416 - protein, 36 aa, Artificial Sequence
  Description of Artificial Sequence: Synthetic polypeptide
DEEEIRTTNPVATEQYGSVSSTKPAGPNMRNGMNPC

SEQ ID NO: 115417 - protein, 35 aa, Artificial Sequence
  Description of Artificial Sequence: Synthetic polypeptide
DEEEIRTTNPVATEQYGMSGSTGMGGQGEGNNGEF

SEQ ID NO: 115418 - protein, 36 aa, Artificial Sequence
  Description of Artificial Sequence: Synthetic polypeptide
DEEEIRTTNPVATEQYGSVSSTIPAGPNMRNGMNPV

SEQ ID NO: 115419 - protein, 35 aa, Artificial Sequence
  Description of Artificial Sequence: Synthetic polypeptide
DEEEIRTTNPVATEQYGMSGTFDETGNLDEGGNNI

SEQ ID NO: 115420 - protein, 35 aa, Artificial Sequence
  Description of Artificial Sequence: Synthetic polypeptide
DEEEIRTTNPVATEQYGMSGTGGETGNDDQEGNNM

SEQ ID NO: 115421 - protein, 36 aa, Artificial Sequence
  Description of Artificial Sequence: Synthetic polypeptide
DEEEIRTTNPVATEQYGSVSSTIPAGPNMRNGHNPV

SEQ ID NO: 115422 - protein, 35 aa, Artificial Sequence
  Description of Artificial Sequence: Synthetic polypeptide
DEEEIRTTNPVATEQYGMSGTGMETGNLDGQGNNG

SEQ ID NO: 115423 - protein, 36 aa, Artificial Sequence
  Description of Artificial Sequence: Synthetic polypeptide
DEEEIRTTNPVATEQYGSVSSTKPAGPNMRNGMNPV

SEQ ID NO: 115424 - protein, 36 aa, Artificial Sequence
  Description of Artificial Sequence: Synthetic polypeptide
DEEEIRTTNPVATEQYGMSGTGMETGNLDQGGENNM

SEQ ID NO: 115425 - protein, 36 aa, Artificial Sequence
  Description of Artificial Sequence: Synthetic polypeptide
DEEEIRTTNPVATEQYGMSGTGMETGNLEDQGNGNG

SEQ ID NO: 115426 - protein, 34 aa, Artificial Sequence
  Description of Artificial Sequence: Synthetic polypeptide
DEDEIRTTNPVATEQYGETTSCTINAHSQRPGDS

SEQ ID NO: 115427 - protein, 33 aa, Artificial Sequence
  Description of Artificial Sequence: Synthetic polypeptide
DEDEIRTTNPVATEQYGETTSCTNAHSQLGGMS

SEQ ID NO: 115428 - protein, 32 aa, Artificial Sequence
  Description of Artificial Sequence: Synthetic polypeptide
DEDEIRTTNPVATEQYGETWTTGLNQEGGEDS

SEQ ID NO: 115429 - protein, 36 aa, Artificial Sequence
  Description of Artificial Sequence: Synthetic polypeptide
DEEEIRTTNPVATEQYGSVSSTHPAGPNMRNGMNPV

SEQ ID NO: 115430 - protein, 35 aa, Artificial Sequence
  Description of Artificial Sequence: Synthetic polypeptide
DEAEIRTTNPVATEQYGSVCSLPLQTENDGQNEDH

SEQ ID NO: 115431 - protein, 36 aa, Artificial Sequence
  Description of Artificial Sequence: Synthetic polypeptide
DEEEIRTTNPVATEQYGSVSSTHPAGPNMRNGMNCV

SEQ ID NO: 115432 - protein, 36 aa, Artificial Sequence
  Description of Artificial Sequence: Synthetic polypeptide
DEEEIRTTNPVATEQYGMSGTGMETGNLDQGGNGDD

SEQ ID NO: 115433 - protein, 36 aa, Artificial Sequence
  Description of Artificial Sequence: Synthetic polypeptide
DEEEIRTTNPVATEQYGSVSSTKPHGPNMRNGMNPV

SEQ ID NO: 115434 - protein, 35 aa, Artificial Sequence
  Description of Artificial Sequence: Synthetic polypeptide
DEAEIRTTNPVATEQYGSVCSPDNDLERNGSDMIE

SEQ ID NO: 115435 - protein, 34 aa, Artificial Sequence
  Description of Artificial Sequence: Synthetic polypeptide
DEDEIRTTNPVATEQYGETSTTDNLNQEGGEDSL

SEQ ID NO: 115436 - protein, 34 aa, Artificial Sequence
  Description of Artificial Sequence: Synthetic polypeptide
DEEEIRTTNPCATEAYGSVATTNDQGNQQGTNNE

SEQ ID NO: 115437 - protein, 34 aa, Artificial Sequence
  Description of Artificial Sequence: Synthetic polypeptide
DEEEIRTTNPCATEAYGSVATTNDQGNQQGTNDT

SEQ ID NO: 115438 - protein, 33 aa, Artificial Sequence
  Description of Artificial Sequence: Synthetic polypeptide
DEEEIRTTNPCATEAYGSVALTLTHVEVRGNEQ

SEQ ID NO: 115439 - protein, 32 aa, Artificial Sequence
  Description of Artificial Sequence: Synthetic polypeptide
DEAEIRTTNPVATEQYGSVCSPLDEVPGDEDQ

SEQ ID NO: 115440 - protein, 36 aa, Artificial Sequence
  Description of Artificial Sequence: Synthetic polypeptide
DEEEIRTTNPVATEQYGKVPSTTPAGSNQRNGGNPV

SEQ ID NO: 115441 - protein, 34 aa, Artificial Sequence
  Description of Artificial Sequence: Synthetic polypeptide
DEEEIRTTNPCAHEQYGSVINTNLQPVFDVSGRP

SEQ ID NO: 115442 - protein, 32 aa, Artificial Sequence
  Description of Artificial Sequence: Synthetic polypeptide
DEEEIRTTNPAATEQYGSVNLTIFDDGGEGDT

SEQ ID NO: 115443 - protein, 32 aa, Artificial Sequence
  Description of Artificial Sequence: Synthetic polypeptide
DEDEIRTTNPVATEQYGCTCSTAHQHFGSDQS

SEQ ID NO: 115444 - protein, 33 aa, Artificial Sequence
  Description of Artificial Sequence: Synthetic polypeptide
DEDEIRTTNPVATEQYGCTCSTNHQENSGSDQA

SEQ ID NO: 115445 - protein, 36 aa, Artificial Sequence
  Description of Artificial Sequence: Synthetic polypeptide
DEEEIRTTNPVATEQYGSVSSTMPAGPNMRNGMNPV

SEQ ID NO: 115446 - protein, 36 aa, Artificial Sequence
  Description of Artificial Sequence: Synthetic polypeptide
DEEEIRTTNPVATEQYGSVSSTLPAGTNMRNGMNPV

SEQ ID NO: 115447 - protein, 36 aa, Artificial Sequence
  Description of Artificial Sequence: Synthetic polypeptide
DEEEIRTTNPVATEQYGSVSSTLPAGPNMRNGMNPV

SEQ ID NO: 115448 - protein, 36 aa, Artificial Sequence
  Description of Artificial Sequence: Synthetic polypeptide
DEEEIRTTNPVATEQYGSVSSTLPAGPNMFNGMNPV

SEQ ID NO: 115449 - protein, 33 aa, Artificial Sequence
  Description of Artificial Sequence: Synthetic polypeptide
DEDEIRTTNPVATEQYGEMTSGNNGGQGGNDGQ

SEQ ID NO: 115450 - protein, 32 aa, Artificial Sequence
  Description of Artificial Sequence: Synthetic polypeptide
DEDEIRTTNPVATEQYGEMTSTGGQGNGDGGV

SEQ ID NO: 115451 - protein, 33 aa, Artificial Sequence
  Description of Artificial Sequence: Synthetic polypeptide
DEDEIRTTNPVATEQYGEMTSTGNGQTGGDEGG

SEQ ID NO: 115452 - protein, 34 aa, Artificial Sequence
  Description of Artificial Sequence: Synthetic polypeptide
DEEEIRTTNPVATEQYGMATIMTNGGQGGENEED

SEQ ID NO: 115453 - protein, 36 aa, Artificial Sequence
  Description of Artificial Sequence: Synthetic polypeptide
DEEEIRTTNPVATEQYGSVSSTGPEGPNMRNGMNPV

SEQ ID NO: 115454 - protein, 36 aa, Artificial Sequence
  Description of Artificial Sequence: Synthetic polypeptide
DEEEIRTTNPVATEQYGSVSSTTPAGPNMRPGMNPV

SEQ ID NO: 115455 - protein, 34 aa, Artificial Sequence
  Description of Artificial Sequence: Synthetic polypeptide
DEEEIRTTNPVATEQYGETVPFHNMHSQRGGPPS

SEQ ID NO: 115456 - protein, 36 aa, Artificial Sequence
  Description of Artificial Sequence: Synthetic polypeptide
DEEEIRTTNPVATEQYGSVSSTTPAGPNGRNGPNPV

SEQ ID NO: 115457 - protein, 36 aa, Artificial Sequence
  Description of Artificial Sequence: Synthetic polypeptide
DEEEIRTTNPVATEQYGSVSSTTPAGPNMRNGMNNV

SEQ ID NO: 115458 - protein, 32 aa, Artificial Sequence
  Description of Artificial Sequence: Synthetic polypeptide
DEEEIRTTNPVATEQYGDVSSEIGNMRAEMDV

SEQ ID NO: 115459 - protein, 33 aa, Artificial Sequence
  Description of Artificial Sequence: Synthetic polypeptide
DEEEIRTTNPVATEQYGDVSSEIGPNMRAEMNV

SEQ ID NO: 115460 - protein, 33 aa, Artificial Sequence
  Description of Artificial Sequence: Synthetic polypeptide
DEEEIRTTNPVATEQYGDVSSEPAENMAAENPV

SEQ ID NO: 115461 - protein, 34 aa, Artificial Sequence
  Description of Artificial Sequence: Synthetic polypeptide
DEEEIRTTNPVATEQYGDVSSEPALNMRNGMEPL

SEQ ID NO: 115462 - protein, 33 aa, Artificial Sequence
  Description of Artificial Sequence: Synthetic polypeptide
DEEEIRTTNPVATEQYGDVSSGIGTGGNGGEEE

SEQ ID NO: 115463 - protein, 35 aa, Artificial Sequence
  Description of Artificial Sequence: Synthetic polypeptide
DEEEIRTTNPVATEQYGDVSSTEPALNMRNGMEPL

SEQ ID NO: 115464 - protein, 34 aa, Artificial Sequence
  Description of Artificial Sequence: Synthetic polypeptide
DEEEIRTTNPCATEQYGSCAATALTQNHGDNEAM

SEQ ID NO: 115465 - protein, 37 aa, Artificial Sequence
  Description of Artificial Sequence: Synthetic polypeptide
DEEEIRTTNPVATEQYGDVSSTFNDLGQDEGGDENEI

SEQ ID NO: 115466 - protein, 35 aa, Artificial Sequence
  Description of Artificial Sequence: Synthetic polypeptide
DEEEIRTTNPVATEQYGDVSSTTAGPNMRNGMNPV

SEQ ID NO: 115467 - protein, 33 aa, Artificial Sequence
  Description of Artificial Sequence: Synthetic polypeptide
DEAEIRTTNPVATEQYGSVCSSQISLFPINFID

SEQ ID NO: 115468 - protein, 35 aa, Artificial Sequence
  Description of Artificial Sequence: Synthetic polypeptide
DEEEIRTTNPVATEQYGDVSSTTPAGPMMRNGMNV

SEQ ID NO: 115469 - protein, 36 aa, Artificial Sequence
  Description of Artificial Sequence: Synthetic polypeptide
DEEEIRTTNPVATEQYGSVSSTTPAGPNMRNGMNMV

SEQ ID NO: 115470 - protein, 36 aa, Artificial Sequence
  Description of Artificial Sequence: Synthetic polypeptide
DEEEIRTTNPVATEQYGSVSSTTPAGPNMRNGMNLV

SEQ ID NO: 115471 - protein, 36 aa, Artificial Sequence
  Description of Artificial Sequence: Synthetic polypeptide
DEEEIRTTNPVATEQYGSVSSTTPAGPNMRNGMNKV

SEQ ID NO: 115472 - protein, 33 aa, Artificial Sequence
  Description of Artificial Sequence: Synthetic polypeptide
DEAEIRTTNPVATEQYGSVCSSQISLFPHNMIN

SEQ ID NO: 115473 - protein, 34 aa, Artificial Sequence
  Description of Artificial Sequence: Synthetic polypeptide
DEEEIRTTNPCATEQYGSCAAATNLQATPGDSTA

SEQ ID NO: 115474 - protein, 36 aa, Artificial Sequence
  Description of Artificial Sequence: Synthetic polypeptide
DEEEIRTTNPVATEQYGSVSSTTPAGPNMRNGMNIV

SEQ ID NO: 115475 - protein, 36 aa, Artificial Sequence
  Description of Artificial Sequence: Synthetic polypeptide
DEEEIRTTNPVATEQYGSVSSTTPAGPNMRNGMNPA

SEQ ID NO: 115476 - protein, 36 aa, Artificial Sequence
  Description of Artificial Sequence: Synthetic polypeptide
DEEEIRTTNPVATEQYGSVSSTTPAGPNMRNGMNPC

SEQ ID NO: 115477 - protein, 36 aa, Artificial Sequence
  Description of Artificial Sequence: Synthetic polypeptide
DEAEIRTTNPVATEQYGSVCSSVDVLSQERFGGSER

SEQ ID NO: 115478 - protein, 36 aa, Artificial Sequence
  Description of Artificial Sequence: Synthetic polypeptide
DEEEIRTTNPVATEQYGSVSSTTPAGPNMRNGMNPG

SEQ ID NO: 115479 - protein, 33 aa, Artificial Sequence
  Description of Artificial Sequence: Synthetic polypeptide
DEEEIRTTNPVATEQYGDVQGNFNDEGGGENTT

SEQ ID NO: 115480 - protein, 36 aa, Artificial Sequence
  Description of Artificial Sequence: Synthetic polypeptide
DEEEIRTTNPVATEQYGSVSSTTPAGPNMRNGMNPF

SEQ ID NO: 115481 - protein, 35 aa, Artificial Sequence
  Description of Artificial Sequence: Synthetic polypeptide
DEEEIRTTNPVATEQYGDVQSTFGDEGQEGGGGNQ

SEQ ID NO: 115482 - protein, 36 aa, Artificial Sequence
  Description of Artificial Sequence: Synthetic polypeptide
DEEEIRTTNPVATEQYGSVSSTTPAGPNMRNGMNPE

SEQ ID NO: 115483 - protein, 34 aa, Artificial Sequence
  Description of Artificial Sequence: Synthetic polypeptide
DEEEIRTTNPVATEQYGDVSDGVTGLGGNEGGQG

SEQ ID NO: 115484 - protein, 34 aa, Artificial Sequence
  Description of Artificial Sequence: Synthetic polypeptide
DEEEIRTTNPVATEQYGDVSIVVNEGDTGGGNQG

SEQ ID NO: 115485 - protein, 34 aa, Artificial Sequence
  Description of Artificial Sequence: Synthetic polypeptide
DEEEIRTTNPCATEQYGSMVSPVNNIPLIDVVND

SEQ ID NO: 115486 - protein, 33 aa, Artificial Sequence
  Description of Artificial Sequence: Synthetic polypeptide
DEEEIRTTNPVATEQYGDVSDVGMGLNGEGGGG

SEQ ID NO: 115487 - protein, 36 aa, Artificial Sequence
  Description of Artificial Sequence: Synthetic polypeptide
DEEEIRTTNPVATEQYGSVSSTTPAGPNMRNGMNPD

SEQ ID NO: 115488 - protein, 33 aa, Artificial Sequence
  Description of Artificial Sequence: Synthetic polypeptide
DEEEIRTTNPCATEQYGSCAATNLQMHQDEQAD

SEQ ID NO: 115489 - protein, 31 aa, Artificial Sequence
  Description of Artificial Sequence: Synthetic polypeptide
DEEEIRTTNPVATEQYGDVSEPIEMMAAEDA

SEQ ID NO: 115490 - protein, 33 aa, Artificial Sequence
  Description of Artificial Sequence: Synthetic polypeptide
DEEEIRTTNPVATEQYGDVSGGMGEGGNNGNGD

SEQ ID NO: 115491 - protein, 33 aa, Artificial Sequence
  Description of Artificial Sequence: Synthetic polypeptide
DEEEIRTTNPCATEQYGSCAATNLQATPQDEGA

SEQ ID NO: 115492 - protein, 37 aa, Artificial Sequence
  Description of Artificial Sequence: Synthetic polypeptide
DEEEIRTTNPVATEQYGDVSGVSTQNLPDNEVGGNSN

SEQ ID NO: 115493 - protein, 33 aa, Artificial Sequence
  Description of Artificial Sequence: Synthetic polypeptide
DEEEIRTTNPCATEQYGSMVSPVNIANIAVVND

SEQ ID NO: 115494 - protein, 30 aa, Artificial Sequence
  Description of Artificial Sequence: Synthetic polypeptide
DEEEIRTTNPVATEQYGDVPEIEMNAAEDA

SEQ ID NO: 115495 - protein, 36 aa, Artificial Sequence
  Description of Artificial Sequence: Synthetic polypeptide
DEEEIRTTNPVATEQYGSVSSTTPAGPNMRNGMNHV

SEQ ID NO: 115496 - protein, 36 aa, Artificial Sequence
  Description of Artificial Sequence: Synthetic polypeptide
DEEEIRTTNPVATEQYGSVSSTTPAGPNMRNGMNHP

SEQ ID NO: 115497 - protein, 34 aa, Artificial Sequence
  Description of Artificial Sequence: Synthetic polypeptide
DEAEIRTTNPVATEQYGSVCSSQINLFPRNQIDN

SEQ ID NO: 115498 - protein, 33 aa, Artificial Sequence
  Description of Artificial Sequence: Synthetic polypeptide
DEEEIRTTNPCATEQYGCVCGTEHNQNFGSNTA

SEQ ID NO: 115499 - protein, 34 aa, Artificial Sequence
  Description of Artificial Sequence: Synthetic polypeptide
DEEEIRTTNPCATEQYGCVCGTEELQRFGSDTAS

SEQ ID NO: 115500 - protein, 36 aa, Artificial Sequence
  Description of Artificial Sequence: Synthetic polypeptide
DEEEIRTTNPVATEQYGSVSSTTPAGPNMRNGMFPR

SEQ ID NO: 115501 - protein, 34 aa, Artificial Sequence
  Description of Artificial Sequence: Synthetic polypeptide
DEEEIRTTNPVATEQYGDVSVGGMGQTTIGNGDE

SEQ ID NO: 115502 - protein, 33 aa, Artificial Sequence
  Description of Artificial Sequence: Synthetic polypeptide
DEEEIRTTNPVATEQYGDVSVWMELANRQMVSD

SEQ ID NO: 115503 - protein, 33 aa, Artificial Sequence
  Description of Artificial Sequence: Synthetic polypeptide
DEEEIRTTNPVATEQYGDVSWMELPNQEQMVVQ

SEQ ID NO: 115504 - protein, 34 aa, Artificial Sequence
  Description of Artificial Sequence: Synthetic polypeptide
DEEEIRTTNPCATEQYGCVCGTNDHQNFGSNTAS

SEQ ID NO: 115505 - protein, 33 aa, Artificial Sequence
  Description of Artificial Sequence: Synthetic polypeptide
DEEEIRTTNPVATEQYGDVSWMSFANQMQMVVP

SEQ ID NO: 115506 - protein, 33 aa, Artificial Sequence
  Description of Artificial Sequence: Synthetic polypeptide
DEEEIRTTNPVATEQYGDVTDGNLNDNMDEGGG

SEQ ID NO: 115507 - protein, 34 aa, Artificial Sequence
  Description of Artificial Sequence: Synthetic polypeptide
DEAEIRTTNPVATEQYGSVCSSQINLFPRNMTQN

SEQ ID NO: 115508 - protein, 34 aa, Artificial Sequence
  Description of Artificial Sequence: Synthetic polypeptide
DEEEIRTTNPVATEQYGDVTDTGNLNNMNGEGGE

SEQ ID NO: 115509 - protein, 33 aa, Artificial Sequence
  Description of Artificial Sequence: Synthetic polypeptide
DEEEIRTTNPCATEQYGACAASNLQATPGDNTA

SEQ ID NO: 115510 - protein, 36 aa, Artificial Sequence
  Description of Artificial Sequence: Synthetic polypeptide
DEEEIRTTNPVATEQYGSVSSTTPAGPNMRNGLNPV

SEQ ID NO: 115511 - protein, 36 aa, Artificial Sequence
  Description of Artificial Sequence: Synthetic polypeptide
DEEEIRTTNPVATEQYGSVSSTTPAGPNMRNGLNIV

SEQ ID NO: 115512 - protein, 34 aa, Artificial Sequence
  Description of Artificial Sequence: Synthetic polypeptide
DEEEIRTTNPVATEQYGDVVDGNFTDQNIGGNLN

SEQ ID NO: 115513 - protein, 33 aa, Artificial Sequence
  Description of Artificial Sequence: Synthetic polypeptide
DEEEIRTTNPVATEQYGDVSYMELANRQMVVQL

SEQ ID NO: 115514 - protein, 33 aa, Artificial Sequence
  Description of Artificial Sequence: Synthetic polypeptide
DEAEIRTTNPVATEQYGSVCSSQINWFPSNMID

SEQ ID NO: 115515 - protein, 33 aa, Artificial Sequence
  Description of Artificial Sequence: Synthetic polypeptide
DEEEIRTTNPCATEQYGCVCQSNHQNFGSNTAS

SEQ ID NO: 115516 - protein, 33 aa, Artificial Sequence
  Description of Artificial Sequence: Synthetic polypeptide
DEEEIRTTNPCATEQYGCVCSWENIAYFGSNDS

SEQ ID NO: 115517 - protein, 36 aa, Artificial Sequence
  Description of Artificial Sequence: Synthetic polypeptide
DEEEIRTTNPVATEQYGSVSSTTPAGPNMRNGMNGV

SEQ ID NO: 115518 - protein, 36 aa, Artificial Sequence
  Description of Artificial Sequence: Synthetic polypeptide
DEEEIRTTNPVATEQYGSVSSTTPAGPNMRNGMNFV

SEQ ID NO: 115519 - protein, 36 aa, Artificial Sequence
  Description of Artificial Sequence: Synthetic polypeptide
DEEEIRTTNPVATEQYGSVSSTTPAGPNMRNGMNEV

SEQ ID NO: 115520 - protein, 36 aa, Artificial Sequence
  Description of Artificial Sequence: Synthetic polypeptide
DEEEIRTTNPVATEQYGSVSSTTPAGPNMRNGMNDV

SEQ ID NO: 115521 - protein, 36 aa, Artificial Sequence
  Description of Artificial Sequence: Synthetic polypeptide
DEEEIRTTNPVATEQYGSVSSTTPAGPNMRNGMNDQ

SEQ ID NO: 115522 - protein, 36 aa, Artificial Sequence
  Description of Artificial Sequence: Synthetic polypeptide
DEEEIRTTNPVATEQYGSVSSTTPAGPNMRNGMNCV

SEQ ID NO: 115523 - protein, 36 aa, Artificial Sequence
  Description of Artificial Sequence: Synthetic polypeptide
DEEEIRTTNPVATEQYGSVSSTTPAGPNMRNGMNAV

SEQ ID NO: 115524 - protein, 33 aa, Artificial Sequence
  Description of Artificial Sequence: Synthetic polypeptide
DEEEIRTTNPCATEQYGCVCSWEHNASFGSNQS

SEQ ID NO: 115525 - protein, 36 aa, Artificial Sequence
  Description of Artificial Sequence: Synthetic polypeptide
DEEEIRTTNPVATEQYGDVSTFNDLGQDEGGDEDED

SEQ ID NO: 115526 - protein, 35 aa, Artificial Sequence
  Description of Artificial Sequence: Synthetic polypeptide
DEEEIRTTNPVATEQYGDVSTGNGGGDGEGNENQI

SEQ ID NO: 115527 - protein, 35 aa, Artificial Sequence
  Description of Artificial Sequence: Synthetic polypeptide
DEEEIRTTNPVATEQYGDVSTGNGGGDGEQGNETY

SEQ ID NO: 115528 - protein, 35 aa, Artificial Sequence
  Description of Artificial Sequence: Synthetic polypeptide
DEEEIRTTNPCATEQYGIVSSTPNGPNMRNGMNPV

SEQ ID NO: 115529 - protein, 32 aa, Artificial Sequence
  Description of Artificial Sequence: Synthetic polypeptide
DEEEIRTTNPCATEQYGCVCSYNHNANGSDQS

SEQ ID NO: 115530 - protein, 32 aa, Artificial Sequence
  Description of Artificial Sequence: Synthetic polypeptide
DEEEIRTTNPCATEQYGCVCSYNDANFGSDQA

SEQ ID NO: 115531 - protein, 32 aa, Artificial Sequence
  Description of Artificial Sequence: Synthetic polypeptide
DEEEIRTTNPCATEQYGCVCSWNHFYFGSDDA

SEQ ID NO: 115532 - protein, 32 aa, Artificial Sequence
  Description of Artificial Sequence: Synthetic polypeptide
DEEEIRTTNPCATEQYGCVCSWNHFHFGSDQS

SEQ ID NO: 115533 - protein, 35 aa, Artificial Sequence
  Description of Artificial Sequence: Synthetic polypeptide
DEEEIRTTNPVATEQYGDVSTGMGQFGQEGGENEM

SEQ ID NO: 115534 - protein, 36 aa, Artificial Sequence
  Description of Artificial Sequence: Synthetic polypeptide
DEEEIRTTNPVATEQYGSVSSTTPAGPNMRNGMNPH

SEQ ID NO: 115535 - protein, 34 aa, Artificial Sequence
  Description of Artificial Sequence: Synthetic polypeptide
DEEEIRTTNPVATEQYGDVNSITNFGMGGDEGGI

SEQ ID NO: 115536 - protein, 34 aa, Artificial Sequence
  Description of Artificial Sequence: Synthetic polypeptide
DEEEIRTTNPVATEQYGDVNSDLDGQQQEGGNQE

SEQ ID NO: 115537 - protein, 36 aa, Artificial Sequence
  Description of Artificial Sequence: Synthetic polypeptide
DEEEIRTTNPVATEQYGSVSSTTPAGPNMRNGQNFV

SEQ ID NO: 115538 - protein, 36 aa, Artificial Sequence
  Description of Artificial Sequence: Synthetic polypeptide
DEEEIRTTNPVATEQYGSVSSTTPAGPNMRNGPNPV

SEQ ID NO: 115539 - protein, 34 aa, Artificial Sequence
  Description of Artificial Sequence: Synthetic polypeptide
DEEEIRTTNPVATEQYGCVTTNDVQNYMEENIVQ

SEQ ID NO: 115540 - protein, 36 aa, Artificial Sequence
  Description of Artificial Sequence: Synthetic polypeptide
DEEEIRTTNPVATEQYGSVSSTTPAGPNMRNGPNMV

SEQ ID NO: 115541 - protein, 34 aa, Artificial Sequence
  Description of Artificial Sequence: Synthetic polypeptide
DEEEIRTTNPCATEQYGSVIEPTFHQITGVNPVY

SEQ ID NO: 115542 - protein, 36 aa, Artificial Sequence
  Description of Artificial Sequence: Synthetic polypeptide
DEEEIRTTNPVATEQYGSVSSTTPAGPNMRNGNPVF

SEQ ID NO: 115543 - protein, 36 aa, Artificial Sequence
  Description of Artificial Sequence: Synthetic polypeptide
DEEEIRTTNPVATEQYGSVSSTTPAGPNMRNGNNPV

SEQ ID NO: 115544 - protein, 34 aa, Artificial Sequence
  Description of Artificial Sequence: Synthetic polypeptide
DEAEIRTTNPVATEQYGSVCSTGNGDVNDTDNQE

SEQ ID NO: 115545 - protein, 36 aa, Artificial Sequence
  Description of Artificial Sequence: Synthetic polypeptide
DEEEIRTTNPVATEQYGSVSSTTPAGPNMRNGNEPV

SEQ ID NO: 115546 - protein, 36 aa, Artificial Sequence
  Description of Artificial Sequence: Synthetic polypeptide
DEEEIRTTNPVATEQYGSVSSTTPAGPNMRNGMRPV

SEQ ID NO: 115547 - protein, 33 aa, Artificial Sequence
  Description of Artificial Sequence: Synthetic polypeptide
DEEEIRTTNPVATEQYGCYNSSNDERGGEEEIW

SEQ ID NO: 115548 - protein, 36 aa, Artificial Sequence
  Description of Artificial Sequence: Synthetic polypeptide
DEEEIRTTNPVATEQYGSVSSTTPAGPNMRNGMRLV

SEQ ID NO: 115549 - protein, 36 aa, Artificial Sequence
  Description of Artificial Sequence: Synthetic polypeptide
DEEEIRTTNPVATEQYGSVSSTTPAGPNMRNGMNYV

SEQ ID NO: 115550 - protein, 36 aa, Artificial Sequence
  Description of Artificial Sequence: Synthetic polypeptide
DEEEIRTTNPVATEQYGSVSSTTPAGPNMRNGMNWV

SEQ ID NO: 115551 - protein, 35 aa, Artificial Sequence
  Description of Artificial Sequence: Synthetic polypeptide
DEEEIRTTNPCATEQYGSVATVVNQALQNGTQEED

SEQ ID NO: 115552 - protein, 33 aa, Artificial Sequence
  Description of Artificial Sequence: Synthetic polypeptide
DEEEIRTTNPVATEQYGCYTTSVDERNGQEESL

SEQ ID NO: 115553 - protein, 33 aa, Artificial Sequence
  Description of Artificial Sequence: Synthetic polypeptide
DEEEIRTTNPVATEQYGCWCSWGNMHQNDSNQS

SEQ ID NO: 115554 - protein, 34 aa, Artificial Sequence
  Description of Artificial Sequence: Synthetic polypeptide
DEEEIRTTNPCATEQYGSVATVTTQALQAGTQED

SEQ ID NO: 115555 - protein, 36 aa, Artificial Sequence
  Description of Artificial Sequence: Synthetic polypeptide
DEEEIRTTNPVATEQYGSVSSTTPAGPNMRNGQNPV

SEQ ID NO: 115556 - protein, 33 aa, Artificial Sequence
  Description of Artificial Sequence: Synthetic polypeptide
DEAEIRTTNPVATEQYGSVCSTPSTETIGIDDL

SEQ ID NO: 115557 - protein, 35 aa, Artificial Sequence
  Description of Artificial Sequence: Synthetic polypeptide
DEEEIRTTNPCATEQYGSVIEPTPLHQITGVNPAD

SEQ ID NO: 115558 - protein, 36 aa, Artificial Sequence
  Description of Artificial Sequence: Synthetic polypeptide
DEEEIRTTNPVATEQYGSVSSTTPAGPNMRNSGNPV

SEQ ID NO: 115559 - protein, 36 aa, Artificial Sequence
  Description of Artificial Sequence: Synthetic polypeptide
DEEEIRTTNPVATEQYGSVSSTTPAGPNMRNRMNPV

SEQ ID NO: 115560 - protein, 35 aa, Artificial Sequence
  Description of Artificial Sequence: Synthetic polypeptide
DEEEIRTTNPCATEQYGSVIEPTNHQQITGVNIAP

SEQ ID NO: 115561 - protein, 34 aa, Artificial Sequence
  Description of Artificial Sequence: Synthetic polypeptide
DEEEIRTTNPCATEQYGSVIEPTNHQITHVNEAP

SEQ ID NO: 115562 - protein, 34 aa, Artificial Sequence
  Description of Artificial Sequence: Synthetic polypeptide
DEEEIRTTNPCATEQYGSVIEPTNHQITGVVQAP

SEQ ID NO: 115563 - protein, 34 aa, Artificial Sequence
  Description of Artificial Sequence: Synthetic polypeptide
DEEEIRTTNPVAYEPYGSVCFTNAASTRTGGNPT

SEQ ID NO: 115564 - protein, 34 aa, Artificial Sequence
  Description of Artificial Sequence: Synthetic polypeptide
DEAEIRTTNPVATEQYGSVCSTPPQWEVHSGETT

SEQ ID NO: 115565 - protein, 36 aa, Artificial Sequence
  Description of Artificial Sequence: Synthetic polypeptide
DEEEIRTTNPVATEQYGSVSSTTPAGPNMRNGYNPV

SEQ ID NO: 115566 - protein, 36 aa, Artificial Sequence
  Description of Artificial Sequence: Synthetic polypeptide
DEEEIRTTNPVATEQYGSVSSTTPAGPNMRNGVNPV

SEQ ID NO: 115567 - protein, 36 aa, Artificial Sequence
  Description of Artificial Sequence: Synthetic polypeptide
DEEEIRTTNPVATEQYGSVSSTTPAGPNMRNGTNPV

SEQ ID NO: 115568 - protein, 36 aa, Artificial Sequence
  Description of Artificial Sequence: Synthetic polypeptide
DEEEIRTTNPVATEQYGSVSSTTPAGPNMRNGTNPP

SEQ ID NO: 115569 - protein, 36 aa, Artificial Sequence
  Description of Artificial Sequence: Synthetic polypeptide
DEEEIRTTNPVATEQYGSVSSTTPAGPNMRNGSNPV

SEQ ID NO: 115570 - protein, 36 aa, Artificial Sequence
  Description of Artificial Sequence: Synthetic polypeptide
DEEEIRTTNPVATEQYGSVSSTTPAGPNMRNGSNPD

SEQ ID NO: 115571 - protein, 36 aa, Artificial Sequence
  Description of Artificial Sequence: Synthetic polypeptide
DEEEIRTTNPVATEQYGSVSSTTPAGPNMRNGRNPV

SEQ ID NO: 115572 - protein, 36 aa, Artificial Sequence
  Description of Artificial Sequence: Synthetic polypeptide
DEEEIRTTNPVATEQYGSVSSTTPAGPNMRNGQNQV

SEQ ID NO: 115573 - protein, 36 aa, Artificial Sequence
  Description of Artificial Sequence: Synthetic polypeptide
DEEEIRTTNPVATEQYGSVSSTTPAGPNMRNGWNPV

SEQ ID NO: 115574 - protein, 36 aa, Artificial Sequence
  Description of Artificial Sequence: Synthetic polypeptide
DEEEIRTTNPVATEQYGSVSSTTPAGPNMRNGMNWG

SEQ ID NO: 115575 - protein, 35 aa, Artificial Sequence
  Description of Artificial Sequence: Synthetic polypeptide
DEEEIRTTNPCATEQYGSVATVNLQNLQAGTQGED

SEQ ID NO: 115576 - protein, 36 aa, Artificial Sequence
  Description of Artificial Sequence: Synthetic polypeptide
DEEEIRTTNPVATEQYGSVSSTTPAGPNMRNGMNVV

SEQ ID NO: 115577 - protein, 36 aa, Artificial Sequence
  Description of Artificial Sequence: Synthetic polypeptide
DEEEIRTTNPVATEQYGSVSSTTPAGPNMRNGMNPN

SEQ ID NO: 115578 - protein, 36 aa, Artificial Sequence
  Description of Artificial Sequence: Synthetic polypeptide
DEEEIRTTNPVATEQYGSVSSTTPAGPNMRNGMNPM

SEQ ID NO: 115579 - protein, 36 aa, Artificial Sequence
  Description of Artificial Sequence: Synthetic polypeptide
DEEEIRTTNPVATEQYGSVSSTTPAGPNMRNGMNPL

SEQ ID NO: 115580 - protein, 35 aa, Artificial Sequence
  Description of Artificial Sequence: Synthetic polypeptide
DEAEIRTTNPVATEQYGSVCSTDNGNDNGRNGSPP

SEQ ID NO: 115581 - protein, 35 aa, Artificial Sequence
  Description of Artificial Sequence: Synthetic polypeptide
DEEEIRTTNPVATEQYGDVMGSTPNEMTGDGNGGT

SEQ ID NO: 115582 - protein, 35 aa, Artificial Sequence
  Description of Artificial Sequence: Synthetic polypeptide
DEEEIRTTNPVATEQYGDVMGSTPNEMTGGNGNGQ

SEQ ID NO: 115583 - protein, 32 aa, Artificial Sequence
  Description of Artificial Sequence: Synthetic polypeptide
DEEEIRTTNPVATEQYGDVMSGIGGGNGGEEP

SEQ ID NO: 115584 - protein, 36 aa, Artificial Sequence
  Description of Artificial Sequence: Synthetic polypeptide
DEEEIRTTNPVATEQYGSVSSTTPAGPNMRNGMNPP

SEQ ID NO: 115585 - protein, 33 aa, Artificial Sequence
  Description of Artificial Sequence: Synthetic polypeptide
DEEEIRTTNPVATEQYGDVMSGIGGGNGNEEMT

SEQ ID NO: 115586 - protein, 32 aa, Artificial Sequence
  Description of Artificial Sequence: Synthetic polypeptide
DEEEIRTTNPVATEQYGDVMSGIGGNGEGEEQ

SEQ ID NO: 115587 - protein, 33 aa, Artificial Sequence
  Description of Artificial Sequence: Synthetic polypeptide
DEEEIRTTNPVATEQYGDVMSGIGGNGQGEELD

SEQ ID NO: 115588 - protein, 33 aa, Artificial Sequence
  Description of Artificial Sequence: Synthetic polypeptide
DEEEIRTTNPVATEQYGDVMSGIGGNNGDGEEA

SEQ ID NO: 115589 - protein, 34 aa, Artificial Sequence
  Description of Artificial Sequence: Synthetic polypeptide
DEEEIRTTNPVATEQYGDVMTEMNGSGQEDEGQG

SEQ ID NO: 115590 - protein, 33 aa, Artificial Sequence
  Description of Artificial Sequence: Synthetic polypeptide
DEEEIRTTNPVATEQYGDVNGQTDIQNEGGEDI

SEQ ID NO: 115591 - protein, 33 aa, Artificial Sequence
  Description of Artificial Sequence: Synthetic polypeptide
DEEEIRTTNPVATEQYGDVNGVGNMTDGGGGNG

SEQ ID NO: 115592 - protein, 36 aa, Artificial Sequence
  Description of Artificial Sequence: Synthetic polypeptide
DEEEIRTTNPVATEQYGSVSSTTPAGPNMRNGMNPI

SEQ ID NO: 115593 - protein, 36 aa, Artificial Sequence
  Description of Artificial Sequence: Synthetic polypeptide
DEEEIRTTNPVATEQYGSVSSTTPAGPNMRNGMNPK

SEQ ID NO: 115594 - protein, 36 aa, Artificial Sequence
  Description of Artificial Sequence: Synthetic polypeptide
DEEEIRTTNPVATEQYGSVSSTTPAGPNMRNGMNPQ

SEQ ID NO: 115595 - protein, 34 aa, Artificial Sequence
  Description of Artificial Sequence: Synthetic polypeptide
DEEEIRTTNPVATEQYGDVMGSDPNEMTGGGGND

SEQ ID NO: 115596 - protein, 34 aa, Artificial Sequence
  Description of Artificial Sequence: Synthetic polypeptide
DEEEIRTTNPVATEQYGDVMGSDPNDEGTTGGNQ

SEQ ID NO: 115597 - protein, 36 aa, Artificial Sequence
  Description of Artificial Sequence: Synthetic polypeptide
DEEEIRTTNPVATEQYGSVSSTTPAGPNMRNGMNTV

SEQ ID NO: 115598 - protein, 36 aa, Artificial Sequence
  Description of Artificial Sequence: Synthetic polypeptide
DEEEIRTTNPVATEQYGSVSSTTPAGPNMRNGMNSV

SEQ ID NO: 115599 - protein, 36 aa, Artificial Sequence
  Description of Artificial Sequence: Synthetic polypeptide
DEEEIRTTNPVATEQYGSVSSTTPAGPNMRNGMNQV

SEQ ID NO: 115600 - protein, 36 aa, Artificial Sequence
  Description of Artificial Sequence: Synthetic polypeptide
DEEEIRTTNPVATEQYGSVSSTTPAGPNMRNGMNPY

SEQ ID NO: 115601 - protein, 32 aa, Artificial Sequence
  Description of Artificial Sequence: Synthetic polypeptide
DEEEIRTTNPVATEQYGDVDGGQGGGNNGNGD

SEQ ID NO: 115602 - protein, 36 aa, Artificial Sequence
  Description of Artificial Sequence: Synthetic polypeptide
DEEEIRTTNPVATEQYGSVSSTTPAGPNMRNGMNPW

SEQ ID NO: 115603 - protein, 33 aa, Artificial Sequence
  Description of Artificial Sequence: Synthetic polypeptide
DEEEIRTTNPVATEQYGDVDTDNMNNGEGGEGI

SEQ ID NO: 115604 - protein, 34 aa, Artificial Sequence
  Description of Artificial Sequence: Synthetic polypeptide
DEEEIRTTNPVATEQYGDVFGNMNVGQGGGNDEV

SEQ ID NO: 115605 - protein, 36 aa, Artificial Sequence
  Description of Artificial Sequence: Synthetic polypeptide
DEEEIRTTNPVATEQYGDVGSTMNLNEGGNEDDDQD

SEQ ID NO: 115606 - protein, 34 aa, Artificial Sequence
  Description of Artificial Sequence: Synthetic polypeptide
DEEEIRTTNPCATEQYGSVATVNGNALQGTQEED

SEQ ID NO: 115607 - protein, 33 aa, Artificial Sequence
  Description of Artificial Sequence: Synthetic polypeptide
DEEEIRTTNPVATEQYGDVHWMELANRMQGVVQ

SEQ ID NO: 115608 - protein, 34 aa, Artificial Sequence
  Description of Artificial Sequence: Synthetic polypeptide
DEEEIRTTNPVATEQYGDVLPTMNQGINGELNVL

SEQ ID NO: 115609 - protein, 37 aa, Artificial Sequence
  Description of Artificial Sequence: Synthetic polypeptide
DEEEIRTTNPVATEQYGSVSSTTPAGPNMRNGMNPVR

SEQ ID NO: 115610 - protein, 32 aa, Artificial Sequence
  Description of Artificial Sequence: Synthetic polypeptide
DEEEIRTTNPVATEQYGDVMGGIGGNGNEGFG

SEQ ID NO: 115611 - protein, 36 aa, Artificial Sequence
  Description of Artificial Sequence: Synthetic polypeptide
DEEEIRTTNPVATEQYGSVSSTTPAGPNMRNGMNPT

SEQ ID NO: 115612 - protein, 36 aa, Artificial Sequence
  Description of Artificial Sequence: Synthetic polypeptide
DEEEIRTTNPVATEQYGSVSSTTPAGPNMRNGMNPS

SEQ ID NO: 115613 - protein, 33 aa, Artificial Sequence
  Description of Artificial Sequence: Synthetic polypeptide
DEEEIRTTNPVATEQYGDVMGLMQTGDGGNDGD

SEQ ID NO: 115614 - protein, 34 aa, Artificial Sequence
  Description of Artificial Sequence: Synthetic polypeptide
DEEEIRTTNPVATEQYGDVVDLMTMGQGEGENET

SEQ ID NO: 115615 - protein, 32 aa, Artificial Sequence
  Description of Artificial Sequence: Synthetic polypeptide
DEEEIRTTNPVATEQYGDVVDNENMNDGGQGD

SEQ ID NO: 115616 - protein, 35 aa, Artificial Sequence
  Description of Artificial Sequence: Synthetic polypeptide
DEEEIRTTNPVATEQYGDVVDSIVNGLEGGNGDGD

SEQ ID NO: 115617 - protein, 33 aa, Artificial Sequence
  Description of Artificial Sequence: Synthetic polypeptide
DEEEIRTTNPVATEQYGDVVDTMNAEGEGGETE

SEQ ID NO: 115618 - protein, 34 aa, Artificial Sequence
  Description of Artificial Sequence: Synthetic polypeptide
DEEEIRTTNPVATEQYGEASSTEPAGNMHNGNPV

SEQ ID NO: 115619 - protein, 36 aa, Artificial Sequence
  Description of Artificial Sequence: Synthetic polypeptide
DEEEIRTTNPVATEQYGSVSSTTPAGPNMNNGMNPV

SEQ ID NO: 115620 - protein, 34 aa, Artificial Sequence
  Description of Artificial Sequence: Synthetic polypeptide
DEEEIRTTNPVATEQYGEASSTPAGPQMRGMGPV

SEQ ID NO: 115621 - protein, 32 aa, Artificial Sequence
  Description of Artificial Sequence: Synthetic polypeptide
DEEEIRTTNPVATEQYGEASSTTPAGNMHGEV

SEQ ID NO: 115622 - protein, 36 aa, Artificial Sequence
  Description of Artificial Sequence: Synthetic polypeptide
DEEEIRTTNPVATEQYGSVSSTTPAGPNMNNGMNPC

SEQ ID NO: 115623 - protein, 36 aa, Artificial Sequence
  Description of Artificial Sequence: Synthetic polypeptide
DEEEIRTTNPVATEQYGSVSSTTPAGPNMMNGMNPV

SEQ ID NO: 115624 - protein, 33 aa, Artificial Sequence
  Description of Artificial Sequence: Synthetic polypeptide
DEEEIRTTNPVATEQYGEASSTTPAGPNMHGNV

SEQ ID NO: 115625 - protein, 33 aa, Artificial Sequence
  Description of Artificial Sequence: Synthetic polypeptide
DEEEIRTTNPVATEQYGEASSEPAGNMHNGNPV

SEQ ID NO: 115626 - protein, 32 aa, Artificial Sequence
  Description of Artificial Sequence: Synthetic polypeptide
DEEEIRTTNPVATEQYGEASSTVCNMRNEMEK

SEQ ID NO: 115627 - protein, 34 aa, Artificial Sequence
  Description of Artificial Sequence: Synthetic polypeptide
DEEEIRTTNPVAYEPYGISVVYTGNLQDMVTNNK

SEQ ID NO: 115628 - protein, 32 aa, Artificial Sequence
  Description of Artificial Sequence: Synthetic polypeptide
DEEEIRTTNPVATEQYGEASTACPNHNEMEPV

SEQ ID NO: 115629 - protein, 36 aa, Artificial Sequence
  Description of Artificial Sequence: Synthetic polypeptide
DEEEIRTTNPVATEQYGSVSSTTPAGPNMLNGMNPV

SEQ ID NO: 115630 - protein, 36 aa, Artificial Sequence
  Description of Artificial Sequence: Synthetic polypeptide
DEEEIRTTNPVATEQYGSVSSTTPAGPNMKNGMNPV

SEQ ID NO: 115631 - protein, 36 aa, Artificial Sequence
  Description of Artificial Sequence: Synthetic polypeptide
DEEEIRTTNPVATEQYGSVSSTTPAGPNMINGMNPV

SEQ ID NO: 115632 - protein, 36 aa, Artificial Sequence
  Description of Artificial Sequence: Synthetic polypeptide
DEEEIRTTNPVATEQYGSVSSTTPAGPNMHNGNNPV

SEQ ID NO: 115633 - protein, 36 aa, Artificial Sequence
  Description of Artificial Sequence: Synthetic polypeptide
DEEEIRTTNPVATEQYGSVSSTTPAGPNMHNGMNPV

SEQ ID NO: 115634 - protein, 35 aa, Artificial Sequence
  Description of Artificial Sequence: Synthetic polypeptide
DEEEIRTTNPVAYEPYGISVVYTGNLQDRVTNNLS

SEQ ID NO: 115635 - protein, 35 aa, Artificial Sequence
  Description of Artificial Sequence: Synthetic polypeptide
DEEEIRTTNPVATEQYGSVSSTTPAGPNMHGMNPV

SEQ ID NO: 115636 - protein, 33 aa, Artificial Sequence
  Description of Artificial Sequence: Synthetic polypeptide
DEEEIRTTNPVATEQYGEASPTEACQMRNEEPK

SEQ ID NO: 115637 - protein, 30 aa, Artificial Sequence
  Description of Artificial Sequence: Synthetic polypeptide
DEEEIRTTNPVATEQYGEAANEEDWQHEPK

SEQ ID NO: 115638 - protein, 35 aa, Artificial Sequence
  Description of Artificial Sequence: Synthetic polypeptide
DEEEIRTTNPVATEQYGDVVTDNGLELEAGNNGQQ

SEQ ID NO: 115639 - protein, 35 aa, Artificial Sequence
  Description of Artificial Sequence: Synthetic polypeptide
DEEEIRTTNPVATEQYGDVVTGIQNDEGQGGNNTE

SEQ ID NO: 115640 - protein, 36 aa, Artificial Sequence
  Description of Artificial Sequence: Synthetic polypeptide
DEEEIRTTNPVATEQYGSVSSTTPAGPNMRAGMNPA

SEQ ID NO: 115641 - protein, 35 aa, Artificial Sequence
  Description of Artificial Sequence: Synthetic polypeptide
DEEEIRTTNPVATEQYGDVVTGIQNDGQEGNGEET

SEQ ID NO: 115642 - protein, 35 aa, Artificial Sequence
  Description of Artificial Sequence: Synthetic polypeptide
DEEEIRTTNPVATEQYGDVVTGIQNDTGQGDGNNE

SEQ ID NO: 115643 - protein, 35 aa, Artificial Sequence
  Description of Artificial Sequence: Synthetic polypeptide
DEEEIRTTNPVATEQYGDVVTGQVNLFQNGQGGEQ

SEQ ID NO: 115644 - protein, 34 aa, Artificial Sequence
  Description of Artificial Sequence: Synthetic polypeptide
DEEEIRTTNPVATEQYGDVVTSIQSDGQGGGNEE

SEQ ID NO: 115645 - protein, 30 aa, Artificial Sequence
  Description of Artificial Sequence: Synthetic polypeptide
DEEEIRTTNPVATEQYGEASEICMNHAEDA

SEQ ID NO: 115646 - protein, 36 aa, Artificial Sequence
  Description of Artificial Sequence: Synthetic polypeptide
DEEEIRTTNPVATEQYGDVVTSIVNLFQNEGGNDQG

SEQ ID NO: 115647 - protein, 33 aa, Artificial Sequence
  Description of Artificial Sequence: Synthetic polypeptide
DEEEIRTTNPVATEQYGDVYGDDEGQTEGGNNQ

SEQ ID NO: 115648 - protein, 34 aa, Artificial Sequence
  Description of Artificial Sequence: Synthetic polypeptide
DEEEIRTTNPVATEQYGDVYGDEGLGQDNGENEQ

SEQ ID NO: 115649 - protein, 35 aa, Artificial Sequence
  Description of Artificial Sequence: Synthetic polypeptide
DEAEIRTTNPVATEQYGSVCSPTNMIEDQTEHSGN

SEQ ID NO: 115650 - protein, 34 aa, Artificial Sequence
  Description of Artificial Sequence: Synthetic polypeptide
DEEEIRTTNPVATEQYGDVYGTDEGQQNIIGGNQ

SEQ ID NO: 115651 - protein, 36 aa, Artificial Sequence
  Description of Artificial Sequence: Synthetic polypeptide
DEEEIRTTNPVATEQYGSVSSTTPAGPNMPNGMNYV

SEQ ID NO: 115652 - protein, 36 aa, Artificial Sequence
  Description of Artificial Sequence: Synthetic polypeptide
DEEEIRTTNPVATEQYGSVSSTTPAGPNMPNGMNPV

SEQ ID NO: 115653 - protein, 32 aa, Artificial Sequence
  Description of Artificial Sequence: Synthetic polypeptide
DEEEIRTTNPCATEPYGSVAASNHGPGGDNEA

SEQ ID NO: 115654 - protein, 33 aa, Artificial Sequence
  Description of Artificial Sequence: Synthetic polypeptide
DEEEIRTTNPVAYEPYGQSVSINEGSSSPGGSR

SEQ ID NO: 115655 - protein, 36 aa, Artificial Sequence
  Description of Artificial Sequence: Synthetic polypeptide
DEEEIRTTNPVATEQYGSVSSTTPAGPNMHEGMNPV

SEQ ID NO: 115656 - protein, 36 aa, Artificial Sequence
  Description of Artificial Sequence: Synthetic polypeptide
DEEEIRTTNPVATEQYGSVSSTTPAGPNMGNGNNVV

SEQ ID NO: 115657 - protein, 36 aa, Artificial Sequence
  Description of Artificial Sequence: Synthetic polypeptide
DEEEIRTTNPVATEQYGSVSSTTPAGPNMGNGMNPV

SEQ ID NO: 115658 - protein, 36 aa, Artificial Sequence
  Description of Artificial Sequence: Synthetic polypeptide
DEEEIRTTNPVATEQYGSVSSTTPAGPNIRNGVNPV

SEQ ID NO: 115659 - protein, 36 aa, Artificial Sequence
  Description of Artificial Sequence: Synthetic polypeptide
DEEEIRTTNPVATEQYGSVSSTTPAGPNIRNGMNPV

SEQ ID NO: 115660 - protein, 36 aa, Artificial Sequence
  Description of Artificial Sequence: Synthetic polypeptide
DEEEIRTTNPVATEQYGSVSSTTPAGPNIRNGMNPA

SEQ ID NO: 115661 - protein, 32 aa, Artificial Sequence
  Description of Artificial Sequence: Synthetic polypeptide
DEEEIRTTNPCATEPYGSCAATNLATAPGEQD

SEQ ID NO: 115662 - protein, 36 aa, Artificial Sequence
  Description of Artificial Sequence: Synthetic polypeptide
DEEEIRTTNPVATEQYGSVSSTTPAGPNHRNGMNPV

SEQ ID NO: 115663 - protein, 36 aa, Artificial Sequence
  Description of Artificial Sequence: Synthetic polypeptide
DEEEIRTTNPVATEQYGSVSSTTPAGPNHRNGMNPN

SEQ ID NO: 115664 - protein, 33 aa, Artificial Sequence
  Description of Artificial Sequence: Synthetic polypeptide
DEEEIRTTNPCATEPYGSCAATNLAAPGDNMAE

SEQ ID NO: 115665 - protein, 36 aa, Artificial Sequence
  Description of Artificial Sequence: Synthetic polypeptide
DEEEIRTTNPVATEQYGSVSSTTPAGPNKRNGMNIV

SEQ ID NO: 115666 - protein, 35 aa, Artificial Sequence
  Description of Artificial Sequence: Synthetic polypeptide
DEEEIRTTNPVATEQYGETVCFCHPMLSQRGGSPR

SEQ ID NO: 115667 - protein, 36 aa, Artificial Sequence
  Description of Artificial Sequence: Synthetic polypeptide
DEEEIRTTNPVATEQYGSVSSTTPAGPNHRNGMNPL

SEQ ID NO: 115668 - protein, 34 aa, Artificial Sequence
  Description of Artificial Sequence: Synthetic polypeptide
DEEEIRTTNPVAYEPYGIKVSCTTLSQVSPGNMQ

SEQ ID NO: 115669 - protein, 34 aa, Artificial Sequence
  Description of Artificial Sequence: Synthetic polypeptide
DEEEIRTTNPVATEQYGETVFCHNMLSDRGGVPP

SEQ ID NO: 115670 - protein, 36 aa, Artificial Sequence
  Description of Artificial Sequence: Synthetic polypeptide
DEEEIRTTNPVATEQYGSVSSTTPAGPNGRSGMNPV

SEQ ID NO: 115671 - protein, 36 aa, Artificial Sequence
  Description of Artificial Sequence: Synthetic polypeptide
DEEEIRTTNPVATEQYGSVSSTTPAGPNGRNGVNPV

SEQ ID NO: 115672 - protein, 36 aa, Artificial Sequence
  Description of Artificial Sequence: Synthetic polypeptide
DEEEIRTTNPVATEQYGETVFCHNMLSQERDGGSPR

SEQ ID NO: 115673 - protein, 34 aa, Artificial Sequence
  Description of Artificial Sequence: Synthetic polypeptide
DEEEIRTTNPVATEQYGETVFCHNMLSQFGGSPE

SEQ ID NO: 115674 - protein, 35 aa, Artificial Sequence
  Description of Artificial Sequence: Synthetic polypeptide
DEEEIRTTNPVATEQYGETVFCHNMLSDLEGGNPR

SEQ ID NO: 115675 - protein, 35 aa, Artificial Sequence
  Description of Artificial Sequence: Synthetic polypeptide
DEEEIRTTNPVAYEPYGISVSCTGTLSQVSDGNIP

SEQ ID NO: 115676 - protein, 36 aa, Artificial Sequence
  Description of Artificial Sequence: Synthetic polypeptide
DEEEIRTTNPVATEQYGSVSSTTPAGPNKRNGMNPV

SEQ ID NO: 115677 - protein, 33 aa, Artificial Sequence
  Description of Artificial Sequence: Synthetic polypeptide
DEEEIRTTNPCATEPYGSCAGTNLAAPGDNMAM

SEQ ID NO: 115678 - protein, 36 aa, Artificial Sequence
  Description of Artificial Sequence: Synthetic polypeptide
DEEEIRTTNPVATEQYGSVSSTTPAGPNMGNGMNPN

SEQ ID NO: 115679 - protein, 36 aa, Artificial Sequence
  Description of Artificial Sequence: Synthetic polypeptide
DEEEIRTTNPVATEQYGSVSSTTPAGPNMGMGENIV

SEQ ID NO: 115680 - protein, 32 aa, Artificial Sequence
  Description of Artificial Sequence: Synthetic polypeptide
DEEEIRTTNPCATEPYGSCATNLAAPGDGSAM

SEQ ID NO: 115681 - protein, 36 aa, Artificial Sequence
  Description of Artificial Sequence: Synthetic polypeptide
DEEEIRTTNPVATEQYGSVSSTTPAGPNMFNGMNPV

SEQ ID NO: 115682 - protein, 36 aa, Artificial Sequence
  Description of Artificial Sequence: Synthetic polypeptide
DEEEIRTTNPVATEQYGSVSSTTPAGPNMENGMNPV

SEQ ID NO: 115683 - protein, 36 aa, Artificial Sequence
  Description of Artificial Sequence: Synthetic polypeptide
DEEEIRTTNPVATEQYGSVSSTTPAGPNMDNGMNPV

SEQ ID NO: 115684 - protein, 36 aa, Artificial Sequence
  Description of Artificial Sequence: Synthetic polypeptide
DEEEIRTTNPVATEQYGSVSSTTPAGPNMANGMNPV

SEQ ID NO: 115685 - protein, 36 aa, Artificial Sequence
  Description of Artificial Sequence: Synthetic polypeptide
DEEEIRTTNPVATEQYGSVSSTTPAGPNMANGMNPE

SEQ ID NO: 115686 - protein, 35 aa, Artificial Sequence
  Description of Artificial Sequence: Synthetic polypeptide
DEEEIRTTNPVAYEPYGISVSCTTTLSQVVSGNNQ

SEQ ID NO: 115687 - protein, 35 aa, Artificial Sequence
  Description of Artificial Sequence: Synthetic polypeptide
DEEEIRTTNPVAYEPYGISVSCTTTLSQVEDGNKQ

SEQ ID NO: 115688 - protein, 34 aa, Artificial Sequence
  Description of Artificial Sequence: Synthetic polypeptide
DEAEIRTTNPVATEQYGSVCSPTFLERNDDTQES

SEQ ID NO: 115689 - protein, 34 aa, Artificial Sequence
  Description of Artificial Sequence: Synthetic polypeptide
DEEEIRTTNPVAYEPYGISVSCTTLSTVSDGNYE

SEQ ID NO: 115690 - protein, 34 aa, Artificial Sequence
  Description of Artificial Sequence: Synthetic polypeptide
DEEEIRTTNPVAYEPYGISVSCTTLSMESDGNMI

SEQ ID NO: 115691 - protein, 32 aa, Artificial Sequence
  Description of Artificial Sequence: Synthetic polypeptide
DEEEIRTTNPCATEPYGSCATNHMNRDQNAAM

SEQ ID NO: 115692 - protein, 36 aa, Artificial Sequence
  Description of Artificial Sequence: Synthetic polypeptide
DEEEIRTTNPVATEQYGSVSSTTPAGPNLRNDMNPV

SEQ ID NO: 115693 - protein, 32 aa, Artificial Sequence
  Description of Artificial Sequence: Synthetic polypeptide
DEEEIRTTNPCATEPYGSCATNHANRQMNEAM

SEQ ID NO: 115694 - protein, 32 aa, Artificial Sequence
  Description of Artificial Sequence: Synthetic polypeptide
DEEEIRTTNPCATEPYGSCASGNHMNRQGEAM

SEQ ID NO: 115695 - protein, 36 aa, Artificial Sequence
  Description of Artificial Sequence: Synthetic polypeptide
DEEEIRTTNPVATEQYGSVSSTTPAGPNMRAGMNPV

SEQ ID NO: 115696 - protein, 34 aa, Artificial Sequence
  Description of Artificial Sequence: Synthetic polypeptide
DEEEIRTTNPVATEQYGETVPFHNMGSQKGGNPQ

SEQ ID NO: 115697 - protein, 34 aa, Artificial Sequence
  Description of Artificial Sequence: Synthetic polypeptide
DEEEIRTTNPVATEQYGDVVSVGDTGQGEIGNGD

SEQ ID NO: 115698 - protein, 34 aa, Artificial Sequence
  Description of Artificial Sequence: Synthetic polypeptide
DEEEIRTTNPVATEQYGDVVSTTGMGQGNFNNEG

SEQ ID NO: 115699 - protein, 36 aa, Artificial Sequence
  Description of Artificial Sequence: Synthetic polypeptide
DEEEIRTTNPVATEQYGSVSSTTPAGPNMRNGFNPV

SEQ ID NO: 115700 - protein, 36 aa, Artificial Sequence
  Description of Artificial Sequence: Synthetic polypeptide
DEEEIRTTNPVATEQYGSVSSTTPAGPNMRNGFNPN

SEQ ID NO: 115701 - protein, 35 aa, Artificial Sequence
  Description of Artificial Sequence: Synthetic polypeptide
DEEEIRTTNPVATEQYGSVSSTTPAGPNMRNGEPV

SEQ ID NO: 115702 - protein, 36 aa, Artificial Sequence
  Description of Artificial Sequence: Synthetic polypeptide
DEEEIRTTNPVATEQYGSVSSTTPAGPNMRNGENVE

SEQ ID NO: 115703 - protein, 36 aa, Artificial Sequence
  Description of Artificial Sequence: Synthetic polypeptide
DEEEIRTTNPVATEQYGSVSSTTPAGPNMRNGENPV

SEQ ID NO: 115704 - protein, 36 aa, Artificial Sequence
  Description of Artificial Sequence: Synthetic polypeptide
DEEEIRTTNPVATEQYGSVSSTTPAGPNMRNGDNPV

SEQ ID NO: 115705 - protein, 35 aa, Artificial Sequence
  Description of Artificial Sequence: Synthetic polypeptide
DEEEIRTTNPVATEQYGDVVNGFGTNDQDGNDEQT

SEQ ID NO: 115706 - protein, 36 aa, Artificial Sequence
  Description of Artificial Sequence: Synthetic polypeptide
DEEEIRTTNPVATEQYGSVSSTTPAGPNMRNGGNPV

SEQ ID NO: 115707 - protein, 36 aa, Artificial Sequence
  Description of Artificial Sequence: Synthetic polypeptide
DEEEIRTTNPVATEQYGSVSSTTPAGPNMRNGDNPN

SEQ ID NO: 115708 - protein, 36 aa, Artificial Sequence
  Description of Artificial Sequence: Synthetic polypeptide
DEEEIRTTNPVATEQYGSVSSTTPAGPNMRNGANPV

SEQ ID NO: 115709 - protein, 35 aa, Artificial Sequence
  Description of Artificial Sequence: Synthetic polypeptide
DEEEIRTTNPVATEQYGDVVNGFGTNDQNGGGNQP

SEQ ID NO: 115710 - protein, 34 aa, Artificial Sequence
  Description of Artificial Sequence: Synthetic polypeptide
DEEEIRTTNPVATEQYGDVVNGTMNQTNGMGQND

SEQ ID NO: 115711 - protein, 35 aa, Artificial Sequence
  Description of Artificial Sequence: Synthetic polypeptide
DEEEIRTTNPVATEQYGDVVNGVGTNDQEGGNEQT

SEQ ID NO: 115712 - protein, 35 aa, Artificial Sequence
  Description of Artificial Sequence: Synthetic polypeptide
DEEEIRTTNPVATEQYGDVVNQDTNLIREGMGGGQ

SEQ ID NO: 115713 - protein, 36 aa, Artificial Sequence
  Description of Artificial Sequence: Synthetic polypeptide
DEEEIRTTNPVATEQYGSVSSTTPAGPNMRMGYNPV

SEQ ID NO: 115714 - protein, 36 aa, Artificial Sequence
  Description of Artificial Sequence: Synthetic polypeptide
DEEEIRTTNPVATEQYGSVSSTTPAGPNMRMGMNPV

SEQ ID NO: 115715 - protein, 36 aa, Artificial Sequence
  Description of Artificial Sequence: Synthetic polypeptide
DEEEIRTTNPVATEQYGSVSSTTPAGPNMRNGDNNV

SEQ ID NO: 115716 - protein, 34 aa, Artificial Sequence
  Description of Artificial Sequence: Synthetic polypeptide
DEEEIRTTNPVAYEPYGQSVVSQNELSQPGISMV

SEQ ID NO: 115717 - protein, 33 aa, Artificial Sequence
  Description of Artificial Sequence: Synthetic polypeptide
DEEEIRTTNPVATEQYGDVVGSGNQDEGEGGTT

SEQ ID NO: 115718 - protein, 36 aa, Artificial Sequence
  Description of Artificial Sequence: Synthetic polypeptide
DEEEIRTTNPVATEQYGSVSSTTPAGPNMRNGGNTV

SEQ ID NO: 115719 - protein, 33 aa, Artificial Sequence
  Description of Artificial Sequence: Synthetic polypeptide
DEEEIRTTNPVATEQYGDVVDTNEMVEDEFGQE

SEQ ID NO: 115720 - protein, 35 aa, Artificial Sequence
  Description of Artificial Sequence: Synthetic polypeptide
DEAEIRTTNPVATEQYGSVCSSQINLFPHGNMITD

SEQ ID NO: 115721 - protein, 32 aa, Artificial Sequence
  Description of Artificial Sequence: Synthetic polypeptide
DEEEIRTTNPCATEQWGTVPTDLARGGMDGEM

SEQ ID NO: 115722 - protein, 35 aa, Artificial Sequence
  Description of Artificial Sequence: Synthetic polypeptide
DEEEIRTTNPCATEQWGSVYCTDNMDGQRQGGNHA

SEQ ID NO: 115723 - protein, 34 aa, Artificial Sequence
  Description of Artificial Sequence: Synthetic polypeptide
DEEEIRTTNPVATEQYGDVVDTNNMVEDEFGNNI

SEQ ID NO: 115724 - protein, 34 aa, Artificial Sequence
  Description of Artificial Sequence: Synthetic polypeptide
DEEEIRTTNPVATEQYGDVVDTNNMVEDEGGNDQ

SEQ ID NO: 115725 - protein, 34 aa, Artificial Sequence
  Description of Artificial Sequence: Synthetic polypeptide
DEEEIRTTNPVATEQYGDVVDTNNNMVEDEGNQE

SEQ ID NO: 115726 - protein, 34 aa, Artificial Sequence
  Description of Artificial Sequence: Synthetic polypeptide
DEAEIRTTNPVATEQYGSVCSSLNSEMIGQNEDK

SEQ ID NO: 115727 - protein, 36 aa, Artificial Sequence
  Description of Artificial Sequence: Synthetic polypeptide
DEEEIRTTNPVATEQYGSVSSTTPAGPNMRNGKNPV

SEQ ID NO: 115728 - protein, 35 aa, Artificial Sequence
  Description of Artificial Sequence: Synthetic polypeptide
DEEEIRTTNPVATEQYGDVVGDTMNADQEGGANIG

SEQ ID NO: 115729 - protein, 36 aa, Artificial Sequence
  Description of Artificial Sequence: Synthetic polypeptide
DEEEIRTTNPVATEQYGSVSSTTPAGPNMRNGINPV

SEQ ID NO: 115730 - protein, 34 aa, Artificial Sequence
  Description of Artificial Sequence: Synthetic polypeptide
DEEEIRTTNPVATEQYGDVVGNMNNGQSTGGGNG

SEQ ID NO: 115731 - protein, 36 aa, Artificial Sequence
  Description of Artificial Sequence: Synthetic polypeptide
DEEEIRTTNPVATEQYGSVSSTTPAGPNMRNGHNPV

SEQ ID NO: 115732 - protein, 34 aa, Artificial Sequence
  Description of Artificial Sequence: Synthetic polypeptide
DEEEIRTTNPVATEQYGDVVGNMNSGQGGGNDDN

SEQ ID NO: 115733 - protein, 36 aa, Artificial Sequence
  Description of Artificial Sequence: Synthetic polypeptide
DEEEIRTTNPVATEQYGSVSSTTPAGPNMRNGHNPD

SEQ ID NO: 115734 - protein, 33 aa, Artificial Sequence
  Description of Artificial Sequence: Synthetic polypeptide
DEEEIRTTNPVATEQYGDVVGSGMEDQEGGGEF

SEQ ID NO: 115735 - protein, 33 aa, Artificial Sequence
  Description of Artificial Sequence: Synthetic polypeptide
DEEEIRTTNPVATEQYGDVVENFTNDGNVGGED

SEQ ID NO: 115736 - protein, 36 aa, Artificial Sequence
  Description of Artificial Sequence: Synthetic polypeptide
DEEEIRTTNPVATEQYGSVSSTTPAGPNMRLGMNPV

SEQ ID NO: 115737 - protein, 36 aa, Artificial Sequence
  Description of Artificial Sequence: Synthetic polypeptide
DEEEIRTTNPVATEQYGSVSSTTPAGPNMRLGMNLV

SEQ ID NO: 115738 - protein, 36 aa, Artificial Sequence
  Description of Artificial Sequence: Synthetic polypeptide
DEEEIRTTNPVATEQYGSVSSTTPAGPNMRKGMNPV

SEQ ID NO: 115739 - protein, 34 aa, Artificial Sequence
  Description of Artificial Sequence: Synthetic polypeptide
DEEEIRTTNPVATEQYGDVVSISNGFGQTEGGEI

SEQ ID NO: 115740 - protein, 35 aa, Artificial Sequence
  Description of Artificial Sequence: Synthetic polypeptide
DEEEIRTTNPVATEQYGDVVSISNGFGQTGDEGNQ

SEQ ID NO: 115741 - protein, 36 aa, Artificial Sequence
  Description of Artificial Sequence: Synthetic polypeptide
DEEEIRTTNPVATEQYGSVSSTTPAGPNMRDGMNPV

SEQ ID NO: 115742 - protein, 34 aa, Artificial Sequence
  Description of Artificial Sequence: Synthetic polypeptide
DEEEIRTTNPVATEQYGDVVSISNGFGQTGGEGQ

SEQ ID NO: 115743 - protein, 35 aa, Artificial Sequence
  Description of Artificial Sequence: Synthetic polypeptide
DEEEIRTTNPVATEQYGDVVSISNGFGQTGGGNNT

SEQ ID NO: 115744 - protein, 35 aa, Artificial Sequence
  Description of Artificial Sequence: Synthetic polypeptide
DEEEIRTTNPVATEQYGDVVSISNGFGQTGGGQNI

SEQ ID NO: 115745 - protein, 35 aa, Artificial Sequence
  Description of Artificial Sequence: Synthetic polypeptide
DEEEIRTTNPVATEQYGDVVSISNGFGQTGGNTGT

SEQ ID NO: 115746 - protein, 34 aa, Artificial Sequence
  Description of Artificial Sequence: Synthetic polypeptide
DEEEIRTTNPVATEQYGDVVSISNGFGGQTGGEI

SEQ ID NO: 115747 - protein, 35 aa, Artificial Sequence
  Description of Artificial Sequence: Synthetic polypeptide
DEEEIRTTNPVATEQYGDVVSISNGFGQTGNGNGI

SEQ ID NO: 115748 - protein, 34 aa, Artificial Sequence
  Description of Artificial Sequence: Synthetic polypeptide
DEEEIRTTNPVATEQYGDVVSNMFGEQNEMGNTA

SEQ ID NO: 115749 - protein, 34 aa, Artificial Sequence
  Description of Artificial Sequence: Synthetic polypeptide
DEEEIRTTNPVATEQYGDVVSNSGDQNGGGNDDE

SEQ ID NO: 115750 - protein, 35 aa, Artificial Sequence
  Description of Artificial Sequence: Synthetic polypeptide
DEEEIRTTNPVATEQYGDVVSSDNANNGQDEGGNT

SEQ ID NO: 115751 - protein, 35 aa, Artificial Sequence
  Description of Artificial Sequence: Synthetic polypeptide
DEEEIRTTNPVATEQYGDVVSTFDLINEGGQGNEQ

SEQ ID NO: 115752 - protein, 36 aa, Artificial Sequence
  Description of Artificial Sequence: Synthetic polypeptide
DEEEIRTTNPVATEQYGDVVSTFTDLGQDEGGDENE

SEQ ID NO: 115753 - protein, 35 aa, Artificial Sequence
  Description of Artificial Sequence: Synthetic polypeptide
DEEEIRTTNPVATEQYGDVVSTTGFGQGEGGGNTV

SEQ ID NO: 115754 - protein, 35 aa, Artificial Sequence
  Description of Artificial Sequence: Synthetic polypeptide
DEEEIRTTNPVATEQYGDVVSTTGFGQGNDGGNEI

SEQ ID NO: 115755 - protein, 34 aa, Artificial Sequence
  Description of Artificial Sequence: Synthetic polypeptide
DEEEIRTTNPVATEQYGDVVSISNGMGQTGGEEQ

SEQ ID NO: 115756 - protein, 36 aa, Artificial Sequence
  Description of Artificial Sequence: Synthetic polypeptide
DEEEIRTTNPVATEQYGSVSSTTPAGPNMREGENPV

SEQ ID NO: 115757 - protein, 34 aa, Artificial Sequence
  Description of Artificial Sequence: Synthetic polypeptide
DEEEIRTTNPVATEQYGDVVSISNGFGDETGGNI

SEQ ID NO: 115758 - protein, 36 aa, Artificial Sequence
  Description of Artificial Sequence: Synthetic polypeptide
DEEEIRTTNPVATEQYGSVSSTTPAGPNMREGMNPD

SEQ ID NO: 115759 - protein, 34 aa, Artificial Sequence
  Description of Artificial Sequence: Synthetic polypeptide
DEEEIRTTNPVATEQYGDVVNSGDNGQGEGGEGT

SEQ ID NO: 115760 - protein, 36 aa, Artificial Sequence
  Description of Artificial Sequence: Synthetic polypeptide
DEEEIRTTNPVATEQYGSVSSTTPAGPNMRKGMNHV

SEQ ID NO: 115761 - protein, 36 aa, Artificial Sequence
  Description of Artificial Sequence: Synthetic polypeptide
DEEEIRTTNPVATEQYGSVSSTTPAGPNMRIGMNPV

SEQ ID NO: 115762 - protein, 36 aa, Artificial Sequence
  Description of Artificial Sequence: Synthetic polypeptide
DEEEIRTTNPVATEQYGSVSSTTPAGPNMRHGMNPV

SEQ ID NO: 115763 - protein, 36 aa, Artificial Sequence
  Description of Artificial Sequence: Synthetic polypeptide
DEEEIRTTNPVATEQYGSVSSTTPAGPNMRHGMNAV

SEQ ID NO: 115764 - protein, 36 aa, Artificial Sequence
  Description of Artificial Sequence: Synthetic polypeptide
DEEEIRTTNPVATEQYGSVSSTTPAGPNMRHGKNPV

SEQ ID NO: 115765 - protein, 36 aa, Artificial Sequence
  Description of Artificial Sequence: Synthetic polypeptide
DEEEIRTTNPVATEQYGSVSSTTPAGPNMRGGMNVV

SEQ ID NO: 115766 - protein, 36 aa, Artificial Sequence
  Description of Artificial Sequence: Synthetic polypeptide
DEEEIRTTNPVATEQYGSVSSTTPAGPNMRGGMNPV

SEQ ID NO: 115767 - protein, 36 aa, Artificial Sequence
  Description of Artificial Sequence: Synthetic polypeptide
DEEEIRTTNPVATEQYGSVSSTTPAGPNMRFGNPVK

SEQ ID NO: 115768 - protein, 36 aa, Artificial Sequence
  Description of Artificial Sequence: Synthetic polypeptide
DEEEIRTTNPVATEQYGSVSSTTPAGPNMRFGMNPV

SEQ ID NO: 115769 - protein, 36 aa, Artificial Sequence
  Description of Artificial Sequence: Synthetic polypeptide
DEEEIRTTNPVATEQYGSVSSTTPAGPNMRFGMNFV

SEQ ID NO: 115770 - protein, 35 aa, Artificial Sequence
  Description of Artificial Sequence: Synthetic polypeptide
DEEEIRTTNPVATEQYGDVVSEMNNTQETGSGNGG

SEQ ID NO: 115771 - protein, 33 aa, Artificial Sequence
  Description of Artificial Sequence: Synthetic polypeptide
DEEEIRTTNPCATEQWGSVCYNIEESRDGQNDS

SEQ ID NO: 115772 - protein, 36 aa, Artificial Sequence
  Description of Artificial Sequence: Synthetic polypeptide
DEEEIRTTNPVATEQYGSVSSTTPAGPNMREGMNPV

SEQ ID NO: 115773 - protein, 34 aa, Artificial Sequence
  Description of Artificial Sequence: Synthetic polypeptide
DEEEIRTTNPVATEQYGDVVSGMGGNQTIGNFAG

SEQ ID NO: 115774 - protein, 35 aa, Artificial Sequence
  Description of Artificial Sequence: Synthetic polypeptide
DEEEIRTTNPCATEQWGSVAPTWNDHQERDMGDRM

SEQ ID NO: 115775 - protein, 36 aa, Artificial Sequence
  Description of Artificial Sequence: Synthetic polypeptide
DEEEIRTTNPVATEQYGDVVSGTIGLGQNDGGNEQE

SEQ ID NO: 115776 - protein, 35 aa, Artificial Sequence
  Description of Artificial Sequence: Synthetic polypeptide
DEEEIRTTNPVATEQYGDVVSTVNGTDQFGFEGQE

SEQ ID NO: 115777 - protein, 36 aa, Artificial Sequence
  Description of Artificial Sequence: Synthetic polypeptide
DEEEIRTTNPVASEQYGSVSSTTPALPNMRNGMNPV

SEQ ID NO: 115778 - protein, 32 aa, Artificial Sequence
  Description of Artificial Sequence: Synthetic polypeptide
DEECIATTNPVAYEQYSEEVTTGNQQDNGNNR

SEQ ID NO: 115779 - protein, 35 aa, Artificial Sequence
  Description of Artificial Sequence: Synthetic polypeptide
DEEEIRTTNPVATEQYGSFGSDTNGQGNITEDETI

SEQ ID NO: 115780 - protein, 35 aa, Artificial Sequence
  Description of Artificial Sequence: Synthetic polypeptide
DEEEIRTTNPVATEQYGSVDSPWLQELNVPIMILE

SEQ ID NO: 115781 - protein, 34 aa, Artificial Sequence
  Description of Artificial Sequence: Synthetic polypeptide
DEEEIATTNPVATEAYGITTVQSCQDALQKPGNR

SEQ ID NO: 115782 - protein, 35 aa, Artificial Sequence
  Description of Artificial Sequence: Synthetic polypeptide
DEEEIATTNPVATEAYGITTVQSCTDDALQKAGNR

SEQ ID NO: 115783 - protein, 35 aa, Artificial Sequence
  Description of Artificial Sequence: Synthetic polypeptide
DEEEIRTTNPVATEQYGSVDSQTPTSNIPELSFNN

SEQ ID NO: 115784 - protein, 36 aa, Artificial Sequence
  Description of Artificial Sequence: Synthetic polypeptide
DEEEIRTTNPVATEQYGSVDSTDGDQEEGQGENNDE

SEQ ID NO: 115785 - protein, 36 aa, Artificial Sequence
  Description of Artificial Sequence: Synthetic polypeptide
DEEEIRTTNPVATEQYGSVNNTNDDDEPRGMQENVS

SEQ ID NO: 115786 - protein, 35 aa, Artificial Sequence
  Description of Artificial Sequence: Synthetic polypeptide
DEEEIATTNPVATEAYGSTVPSCTGDNHQHEGGNP

SEQ ID NO: 115787 - protein, 35 aa, Artificial Sequence
  Description of Artificial Sequence: Synthetic polypeptide
DEEEIRTTNPVATEQYGSVDSPVNNLEAELGEELD

SEQ ID NO: 115788 - protein, 34 aa, Artificial Sequence
  Description of Artificial Sequence: Synthetic polypeptide
DEEEIRTTNPVATEQYGSVDSTMEMTDTDQGEGQ

SEQ ID NO: 115789 - protein, 34 aa, Artificial Sequence
  Description of Artificial Sequence: Synthetic polypeptide
DEEEIATTNPVATEQYGSVCAMANNAETQDGNEH

SEQ ID NO: 115790 - protein, 37 aa, Artificial Sequence
  Description of Artificial Sequence: Synthetic polypeptide
DEEEIRTTNPVATEQYGVVSTVNLQQGNQQGTNQETD

SEQ ID NO: 115791 - protein, 34 aa, Artificial Sequence
  Description of Artificial Sequence: Synthetic polypeptide
DEEEIATTNPVATEQYGSVCAGTNQEQDQGVPTE

SEQ ID NO: 115792 - protein, 34 aa, Artificial Sequence
  Description of Artificial Sequence: Synthetic polypeptide
DEEEIRTTNPVATEQYGSVNNSPENDDQVSMDLL

SEQ ID NO: 115793 - protein, 34 aa, Artificial Sequence
  Description of Artificial Sequence: Synthetic polypeptide
DEEEIATTNPVATEQYGSVCAGTNLPADNDDDDG

SEQ ID NO: 115794 - protein, 37 aa, Artificial Sequence
  Description of Artificial Sequence: Synthetic polypeptide
DEEEIRTTNPVATEQYGVVSTVNLQQGNQQGTEDEED

SEQ ID NO: 115795 - protein, 37 aa, Artificial Sequence
  Description of Artificial Sequence: Synthetic polypeptide
DEEEIRTTNPVATEQYGVVSTVNLQQGNQQGNNTDDD

SEQ ID NO: 115796 - protein, 34 aa, Artificial Sequence
  Description of Artificial Sequence: Synthetic polypeptide
DEEEIRTTNPVATEQYGSVNNSVENDDQVEMDGI

SEQ ID NO: 115797 - protein, 34 aa, Artificial Sequence
  Description of Artificial Sequence: Synthetic polypeptide
DEEEIATTNPVATEQYGSVCAGTNLAGDVGEDMD

SEQ ID NO: 115798 - protein, 35 aa, Artificial Sequence
  Description of Artificial Sequence: Synthetic polypeptide
DEEEIATTNPVATEAYGISTVQTCTTALQNAGNQR

SEQ ID NO: 115799 - protein, 36 aa, Artificial Sequence
  Description of Artificial Sequence: Synthetic polypeptide
DEEEIATTNPVATEAYGISTVQSCTQDALQDKAGNR

SEQ ID NO: 115800 - protein, 37 aa, Artificial Sequence
  Description of Artificial Sequence: Synthetic polypeptide
DEEEIRTTNPVATEQYGVVSTVNLQQLGNQGNDEEDE

SEQ ID NO: 115801 - protein, 37 aa, Artificial Sequence
  Description of Artificial Sequence: Synthetic polypeptide
DEEEIRTTNPVATEQYGVVSTVNLQQGSTNVTEEEDD

SEQ ID NO: 115802 - protein, 35 aa, Artificial Sequence
  Description of Artificial Sequence: Synthetic polypeptide
DEEEIATTNPVATEAYGCSTVQSCTDALQKAGNQD

SEQ ID NO: 115803 - protein, 35 aa, Artificial Sequence
  Description of Artificial Sequence: Synthetic polypeptide
DEEEIRTTNPVATEQYGSVDSNVLSLQEDGQVFQE

SEQ ID NO: 115804 - protein, 33 aa, Artificial Sequence
  Description of Artificial Sequence: Synthetic polypeptide
DEAEIATTNPVAYEQYGSVATNLADTGGEDQRG

SEQ ID NO: 115805 - protein, 32 aa, Artificial Sequence
  Description of Artificial Sequence: Synthetic polypeptide
DEAEIATTNPVAYEQYGSVATNGTAEGGNMIA

SEQ ID NO: 115806 - protein, 37 aa, Artificial Sequence
  Description of Artificial Sequence: Synthetic polypeptide
DEEEIRTTNPVATEQYGVVSTVNLQQGNTEQGTTEDE

SEQ ID NO: 115807 - protein, 37 aa, Artificial Sequence
  Description of Artificial Sequence: Synthetic polypeptide
DEEEIRTTNPVATEQYGVVSTVNLQQGNQQGTTDETE

SEQ ID NO: 115808 - protein, 35 aa, Artificial Sequence
  Description of Artificial Sequence: Synthetic polypeptide
DEEEIATTNPVATEAYGISTVQHCTDALQKAGNLR

SEQ ID NO: 115809 - protein, 32 aa, Artificial Sequence
  Description of Artificial Sequence: Synthetic polypeptide
DEAEIATTNPVAYEQYGSVATNDQTPAGAGFN

SEQ ID NO: 115810 - protein, 36 aa, Artificial Sequence
  Description of Artificial Sequence: Synthetic polypeptide
DEEEIRTTNPVATEQYGSVDSPTNNLEEELGEEVLD

SEQ ID NO: 115811 - protein, 35 aa, Artificial Sequence
  Description of Artificial Sequence: Synthetic polypeptide
DEEEIRTTNPVATEQYGSVDSPTNNLEEELPEEGD

SEQ ID NO: 115812 - protein, 37 aa, Artificial Sequence
  Description of Artificial Sequence: Synthetic polypeptide
DEEEIRTTNPVATEQYGVVSTVNLQQGNQQNDTEEDE

SEQ ID NO: 115813 - protein, 36 aa, Artificial Sequence
  Description of Artificial Sequence: Synthetic polypeptide
DEEEIRTTNPVATEQYGSVDSPTNNLPAEELGEELD

SEQ ID NO: 115814 - protein, 35 aa, Artificial Sequence
  Description of Artificial Sequence: Synthetic polypeptide
DEEEIATTNPVATEAYGISTVQSCTDAGQDNAGNR

SEQ ID NO: 115815 - protein, 36 aa, Artificial Sequence
  Description of Artificial Sequence: Synthetic polypeptide
DEEEIATTNPVATEAYGISTVQSCTDALAQNAGNRN

SEQ ID NO: 115816 - protein, 36 aa, Artificial Sequence
  Description of Artificial Sequence: Synthetic polypeptide
DEEEIRTTNPVATEQYGSVDSPSMNLLQQQGEEEFT

SEQ ID NO: 115817 - protein, 33 aa, Artificial Sequence
  Description of Artificial Sequence: Synthetic polypeptide
DEAEIATTNPVAYEQYGSVATNLQGTPGDETLH

SEQ ID NO: 115818 - protein, 35 aa, Artificial Sequence
  Description of Artificial Sequence: Synthetic polypeptide
DEEEIATTNPVATEQYGSVCAGTNLADAHQDGEAP

SEQ ID NO: 115819 - protein, 37 aa, Artificial Sequence
  Description of Artificial Sequence: Synthetic polypeptide
DEEEIRTTNPVATEQYGVVSTVNLQQGNQNNEEQNAE

SEQ ID NO: 115820 - protein, 33 aa, Artificial Sequence
  Description of Artificial Sequence: Synthetic polypeptide
DEEEIRTTNPVATEQYGSVNNSELDGVHEENVG

SEQ ID NO: 115821 - protein, 35 aa, Artificial Sequence
  Description of Artificial Sequence: Synthetic polypeptide
DEEEIRTTNPVATEQYGSVDTDTMGQSGEGDEGND

SEQ ID NO: 115822 - protein, 33 aa, Artificial Sequence
  Description of Artificial Sequence: Synthetic polypeptide
DEEEIRTTNPVATEQYGSVNNSEADDVHDENVG

SEQ ID NO: 115823 - protein, 35 aa, Artificial Sequence
  Description of Artificial Sequence: Synthetic polypeptide
DEEEIRTTNPVATEQYGSVDTFNMNNVGIGGNGEE

SEQ ID NO: 115824 - protein, 32 aa, Artificial Sequence
  Description of Artificial Sequence: Synthetic polypeptide
DEAEIATTNPVAYEQYGSVATAGAQGMNPNRQ

SEQ ID NO: 115825 - protein, 37 aa, Artificial Sequence
  Description of Artificial Sequence: Synthetic polypeptide
DEEEIRTTNPVATEQYGVVSTVNLQQGNNQQEEQNDE

SEQ ID NO: 115826 - protein, 36 aa, Artificial Sequence
  Description of Artificial Sequence: Synthetic polypeptide
DEEEIATTNPVATEQYGSVCADTNPLQDDPGEQTRQ

SEQ ID NO: 115827 - protein, 33 aa, Artificial Sequence
  Description of Artificial Sequence: Synthetic polypeptide
DEEEIRTTNPVATEQYGSVNNSELDSMQTEEVG

SEQ ID NO: 115828 - protein, 36 aa, Artificial Sequence
  Description of Artificial Sequence: Synthetic polypeptide
DEEEIRTTNPVATEQYGSVDTNDDNNDQNEGGNDQE

SEQ ID NO: 115829 - protein, 34 aa, Artificial Sequence
  Description of Artificial Sequence: Synthetic polypeptide
DEEEIRTTNPVATEQYGTVCSATDAPPEFEGMNV

SEQ ID NO: 115830 - protein, 35 aa, Artificial Sequence
  Description of Artificial Sequence: Synthetic polypeptide
DEEEIRTTNPVATEQYGTVCSATDAPPNMFEGMNV

SEQ ID NO: 115831 - protein, 35 aa, Artificial Sequence
  Description of Artificial Sequence: Synthetic polypeptide
DEEEIRTTNPVATEQYGTVCSATDAPPNMFNGMNV

SEQ ID NO: 115832 - protein, 34 aa, Artificial Sequence
  Description of Artificial Sequence: Synthetic polypeptide
DEEEIRTTNPVATEQYGTVCSATDGPPNFEGMNV

SEQ ID NO: 115833 - protein, 34 aa, Artificial Sequence
  Description of Artificial Sequence: Synthetic polypeptide
DEEEIRTTNPVATEQYGTVCSATPGGPNFNGMNV

SEQ ID NO: 115834 - protein, 35 aa, Artificial Sequence
  Description of Artificial Sequence: Synthetic polypeptide
DEEEIATTNPVATEQYGSVCADTNNLQEAPQNNHN

SEQ ID NO: 115835 - protein, 33 aa, Artificial Sequence
  Description of Artificial Sequence: Synthetic polypeptide
DEEEIATTNPVATEQYGSVCADINDTMGEEMNN

SEQ ID NO: 115836 - protein, 34 aa, Artificial Sequence
  Description of Artificial Sequence: Synthetic polypeptide
DEEEIRTTNPVATEQYGSVNNSAENDDQVEMDEL

SEQ ID NO: 115837 - protein, 37 aa, Artificial Sequence
  Description of Artificial Sequence: Synthetic polypeptide
DEEEIRTTNPVATEQYGVVSTVNLQQGNQQGNINTDG

SEQ ID NO: 115838 - protein, 36 aa, Artificial Sequence
  Description of Artificial Sequence: Synthetic polypeptide
DEEEIRTTNPVATEQYGSVDTDNVQNQGGEFENGDE

SEQ ID NO: 115839 - protein, 35 aa, Artificial Sequence
  Description of Artificial Sequence: Synthetic polypeptide
DEEEIRTTNPVATEQYGSVDTDMEMTNQGGEDNIT

SEQ ID NO: 115840 - protein, 37 aa, Artificial Sequence
  Description of Artificial Sequence: Synthetic polypeptide
DEEEIRTTNPVATEQYGVVSTVNLQQGNQNATEQGAE

SEQ ID NO: 115841 - protein, 34 aa, Artificial Sequence
  Description of Artificial Sequence: Synthetic polypeptide
DEEEIATTNPVATEAYGSVQSTNMHSHMNGDNNL

SEQ ID NO: 115842 - protein, 33 aa, Artificial Sequence
  Description of Artificial Sequence: Synthetic polypeptide
DEEEIRTTNPVATEQYGSVNNSELDVNEDTEVG

SEQ ID NO: 115843 - protein, 34 aa, Artificial Sequence
  Description of Artificial Sequence: Synthetic polypeptide
DEEEIATTNPVATEQYGSVCAGNGLLTMQMDNEN

SEQ ID NO: 115844 - protein, 36 aa, Artificial Sequence
  Description of Artificial Sequence: Synthetic polypeptide
DEEEIRTTNPVATEQYGSVDSTTPAGPNMRNGMNPV

SEQ ID NO: 115845 - protein, 36 aa, Artificial Sequence
  Description of Artificial Sequence: Synthetic polypeptide
DEEEIRTTNPVATEQYGSVDSTTPAGPNMRNGQNPV

SEQ ID NO: 115846 - protein, 36 aa, Artificial Sequence
  Description of Artificial Sequence: Synthetic polypeptide
DEEEIRTTNPVATEQYGSVDSTTPDGPNMGNGPNPV

SEQ ID NO: 115847 - protein, 35 aa, Artificial Sequence
  Description of Artificial Sequence: Synthetic polypeptide
DEEEIRTTNPVATEQYGSVDTDNMNEEEGGIENIQ

SEQ ID NO: 115848 - protein, 34 aa, Artificial Sequence
  Description of Artificial Sequence: Synthetic polypeptide
DEEEIATTNPVATEQYGSVCAGMNGDQDSNGNMQ

SEQ ID NO: 115849 - protein, 32 aa, Artificial Sequence
  Description of Artificial Sequence: Synthetic polypeptide
DEEEIATTNPVATEQYGSVCAGEGNGQNAPGE

SEQ ID NO: 115850 - protein, 33 aa, Artificial Sequence
  Description of Artificial Sequence: Synthetic polypeptide
DEEEIRTTNPVATEQYGSVNNSELDVGSDEEWG

SEQ ID NO: 115851 - protein, 33 aa, Artificial Sequence
  Description of Artificial Sequence: Synthetic polypeptide
DEEEIATTNPVATEQYGSVCAGEGGQNQGQSRH

SEQ ID NO: 115852 - protein, 32 aa, Artificial Sequence
  Description of Artificial Sequence: Synthetic polypeptide
DEEEIATTNPVATEQYGSVCAGEGGGQNDLGD

SEQ ID NO: 115853 - protein, 37 aa, Artificial Sequence
  Description of Artificial Sequence: Synthetic polypeptide
DEEEIRTTNPVATEQYGVVSTVNLQQGNNTEQGNGTE

SEQ ID NO: 115854 - protein, 37 aa, Artificial Sequence
  Description of Artificial Sequence: Synthetic polypeptide
DEEEIRTTNPVATEQYGVVSTVNLQQGNNQQGTDEQT

SEQ ID NO: 115855 - protein, 35 aa, Artificial Sequence
  Description of Artificial Sequence: Synthetic polypeptide
DEEEIRTTNPVATEQYGSVDTDMEMTDQGGDDGNN

SEQ ID NO: 115856 - protein, 33 aa, Artificial Sequence
  Description of Artificial Sequence: Synthetic polypeptide
DEEEIRTTNPVATEQYGSVNNSELDVIHVENQG

SEQ ID NO: 115857 - protein, 33 aa, Artificial Sequence
  Description of Artificial Sequence: Synthetic polypeptide
DEAEIATTNPVAYEQYGSVATNLQNGAGMGDDN

SEQ ID NO: 115858 - protein, 37 aa, Artificial Sequence
  Description of Artificial Sequence: Synthetic polypeptide
DEEEIRTTNPVATEQYGVVSTVNLQQQGNNNQQGTDE

SEQ ID NO: 115859 - protein, 37 aa, Artificial Sequence
  Description of Artificial Sequence: Synthetic polypeptide
DEEEIRTTNPVATEQYGVVSTVNLQSGNNNNEEQIEE

SEQ ID NO: 115860 - protein, 34 aa, Artificial Sequence
  Description of Artificial Sequence: Synthetic polypeptide
DEEEIRTTNPVATEQYGSVNSESDFERGGEEGKN

SEQ ID NO: 115861 - protein, 35 aa, Artificial Sequence
  Description of Artificial Sequence: Synthetic polypeptide
DEEEIATTNPVATEQYGSVCAMTNGLAPGEQMEGN

SEQ ID NO: 115862 - protein, 35 aa, Artificial Sequence
  Description of Artificial Sequence: Synthetic polypeptide
DEEEIRTTNPVATEQYGSVCVPYLTEVLQNVEQRI

SEQ ID NO: 115863 - protein, 36 aa, Artificial Sequence
  Description of Artificial Sequence: Synthetic polypeptide
DEEEIATTNPVATEQYGSVCAMTNGELTQDSNGNGM

SEQ ID NO: 115864 - protein, 34 aa, Artificial Sequence
  Description of Artificial Sequence: Synthetic polypeptide
DEEEIRTTNPVATEQYGSVCVTGMDVREDHGVDE

SEQ ID NO: 115865 - protein, 36 aa, Artificial Sequence
  Description of Artificial Sequence: Synthetic polypeptide
DEEEIATTNPVATEQYGSVCAMTNGELQDNNQEHRH

SEQ ID NO: 115866 - protein, 35 aa, Artificial Sequence
  Description of Artificial Sequence: Synthetic polypeptide
DEEEIATTNPMATEQYGSVPTEVLQAHRQAVNGRN

SEQ ID NO: 115867 - protein, 36 aa, Artificial Sequence
  Description of Artificial Sequence: Synthetic polypeptide
DEEEIATTNPVATEQYGSVCAMTNGVLQPDDSEGNP

SEQ ID NO: 115868 - protein, 32 aa, Artificial Sequence
  Description of Artificial Sequence: Synthetic polypeptide
DEEEIATTNPMATEQYGSVPTVQDHFQQEGRV

SEQ ID NO: 115869 - protein, 36 aa, Artificial Sequence
  Description of Artificial Sequence: Synthetic polypeptide
DEEEIRTTNPVATEQYGVVSTVNNQQGNQQGTDTED

SEQ ID NO: 115870 - protein, 36 aa, Artificial Sequence
  Description of Artificial Sequence: Synthetic polypeptide
DEEEIRTTNPVATEQYGVVSTVNNQQGNQAGTEEQD

SEQ ID NO: 115871 - protein, 36 aa, Artificial Sequence
  Description of Artificial Sequence: Synthetic polypeptide
DEEEIRTTNPVATEQYGVVSTVNNQQGNQAGTDEEE

SEQ ID NO: 115872 - protein, 36 aa, Artificial Sequence
  Description of Artificial Sequence: Synthetic polypeptide
DEEEIATTNPVATEQYGSVCAMTNGELQDAPGEHRH

SEQ ID NO: 115873 - protein, 35 aa, Artificial Sequence
  Description of Artificial Sequence: Synthetic polypeptide
DEEEIRTTNPVATEQYGSVNSDGSGDQNQEGGNDQ

SEQ ID NO: 115874 - protein, 32 aa, Artificial Sequence
  Description of Artificial Sequence: Synthetic polypeptide
DEEEIATTNPNATEQYGSVPTVQDHFQVEGAV

SEQ ID NO: 115875 - protein, 33 aa, Artificial Sequence
  Description of Artificial Sequence: Synthetic polypeptide
DEEEIRTTNPVATEQYGSVNSCTDADVTEDQQD

SEQ ID NO: 115876 - protein, 32 aa, Artificial Sequence
  Description of Artificial Sequence: Synthetic polypeptide
DEEEIATTNPMATEQYGSVPTVQDHRQVVEGR

SEQ ID NO: 115877 - protein, 35 aa, Artificial Sequence
  Description of Artificial Sequence: Synthetic polypeptide
DEEEIATTNPVATEQYGSVCAMTNALNLDMENGRQ

SEQ ID NO: 115878 - protein, 34 aa, Artificial Sequence
  Description of Artificial Sequence: Synthetic polypeptide
DEEEIRTTNPVATEQYGSVCTTMLQNVQLLEVLD

SEQ ID NO: 115879 - protein, 34 aa, Artificial Sequence
  Description of Artificial Sequence: Synthetic polypeptide
DEEEIRTTNPVATEQYGSVCTTMLQEVQLLELIE

SEQ ID NO: 115880 - protein, 34 aa, Artificial Sequence
  Description of Artificial Sequence: Synthetic polypeptide
DEEEIRTTNPVATEQYGSVNSKENEDEEGGEEID

SEQ ID NO: 115881 - protein, 34 aa, Artificial Sequence
  Description of Artificial Sequence: Synthetic polypeptide
DEEEIRTTNPVATEQYGSVNSIPDQLNEMGEGEN

SEQ ID NO: 115882 - protein, 35 aa, Artificial Sequence
  Description of Artificial Sequence: Synthetic polypeptide
DEEEIATTNPVATEQYGSVCAPTEALIQNHGNDSA

SEQ ID NO: 115883 - protein, 36 aa, Artificial Sequence
  Description of Artificial Sequence: Synthetic polypeptide
DEEEIRTTNPVATEQYGSVNSHNIDDDQRGGEEDIN

SEQ ID NO: 115884 - protein, 33 aa, Artificial Sequence
  Description of Artificial Sequence: Synthetic polypeptide
DEEEIATTNPVATEQYGSVCAPDNPQDDLGAQA

SEQ ID NO: 115885 - protein, 34 aa, Artificial Sequence
  Description of Artificial Sequence: Synthetic polypeptide
DEEEIATTNPVATEQYGSVCANPELGQEHDENGH

SEQ ID NO: 115886 - protein, 35 aa, Artificial Sequence
  Description of Artificial Sequence: Synthetic polypeptide
DEEEIATTNPVATEQYGSVCANNNLQESDENNGRN

SEQ ID NO: 115887 - protein, 34 aa, Artificial Sequence
  Description of Artificial Sequence: Synthetic polypeptide
DEEEIRTTNPVATEQYGSVCTTMLQEVQMLELMV

SEQ ID NO: 115888 - protein, 34 aa, Artificial Sequence
  Description of Artificial Sequence: Synthetic polypeptide
DEEEIRTTNPVATEQYGSVCTPLNEQSPTFLVDN

SEQ ID NO: 115889 - protein, 34 aa, Artificial Sequence
  Description of Artificial Sequence: Synthetic polypeptide
DEEEIATTNPVATEQYGSVCANNLEATPGDEDRM

SEQ ID NO: 115890 - protein, 35 aa, Artificial Sequence
  Description of Artificial Sequence: Synthetic polypeptide
DEEEIATTNPVATEQYGSVCANNGLEQTAPGGVRL

SEQ ID NO: 115891 - protein, 35 aa, Artificial Sequence
  Description of Artificial Sequence: Synthetic polypeptide
DEEEIATTNPVATEQYGSVCANMNHLQPDDQGGRP

SEQ ID NO: 115892 - protein, 35 aa, Artificial Sequence
  Description of Artificial Sequence: Synthetic polypeptide
DEEEIATTNPVATEQYGSVCANDNLQTDDLDGNQA

SEQ ID NO: 115893 - protein, 37 aa, Artificial Sequence
  Description of Artificial Sequence: Synthetic polypeptide
DEEEIRTTNPVATEQYGVVSTVNNQQQLQQGNNQNND

SEQ ID NO: 115894 - protein, 34 aa, Artificial Sequence
  Description of Artificial Sequence: Synthetic polypeptide
DEEEIATTNPLAYEQYGSVVSYTNLSDTPGGIRV

SEQ ID NO: 115895 - protein, 34 aa, Artificial Sequence
  Description of Artificial Sequence: Synthetic polypeptide
DEEEIRTTNPVATEQYGSVCTTLELPQNNEEPSE

SEQ ID NO: 115896 - protein, 33 aa, Artificial Sequence
  Description of Artificial Sequence: Synthetic polypeptide
DEEEIATTNPVATEQYGSVCANNLEATPGDEEA

SEQ ID NO: 115897 - protein, 35 aa, Artificial Sequence
  Description of Artificial Sequence: Synthetic polypeptide
DEEEIRTTNPVATEQYGSVNSCENEDEDRGGEMFS

SEQ ID NO: 115898 - protein, 34 aa, Artificial Sequence
  Description of Artificial Sequence: Synthetic polypeptide
DEEEIRTTNPVATEQYGSVNSCELEDEAGGDEIS

SEQ ID NO: 115899 - protein, 32 aa, Artificial Sequence
  Description of Artificial Sequence: Synthetic polypeptide
DEAEIATTNPVAYEQYGVSVSANDLLINDITR

SEQ ID NO: 115900 - protein, 35 aa, Artificial Sequence
  Description of Artificial Sequence: Synthetic polypeptide
DEEEIRTTNPVATEQYGSVDNDNMQSGDGEQGNND

SEQ ID NO: 115901 - protein, 34 aa, Artificial Sequence
  Description of Artificial Sequence: Synthetic polypeptide
DEEEIRTTNPVATEQYGSVDNFNQNVGEGGNGEE

SEQ ID NO: 115902 - protein, 34 aa, Artificial Sequence
  Description of Artificial Sequence: Synthetic polypeptide
DEEEIRTTNPVATEQYGSVDNFTGDEGQGGESED

SEQ ID NO: 115903 - protein, 35 aa, Artificial Sequence
  Description of Artificial Sequence: Synthetic polypeptide
DEEEIRTTNPVATEQYGSVNQDTGMNQEEGQGNIG

SEQ ID NO: 115904 - protein, 34 aa, Artificial Sequence
  Description of Artificial Sequence: Synthetic polypeptide
DEEEIRTTNPVATEQYGSVDNPNVLNNNIVLERI

SEQ ID NO: 115905 - protein, 34 aa, Artificial Sequence
  Description of Artificial Sequence: Synthetic polypeptide
DEEEIRTTNPVATEQYGSVDNPQNLNLNFVLERI

SEQ ID NO: 115906 - protein, 34 aa, Artificial Sequence
  Description of Artificial Sequence: Synthetic polypeptide
DEEEIRTTNPVATEQYGSVNPPPLLEQSMGLLMQ

SEQ ID NO: 115907 - protein, 36 aa, Artificial Sequence
  Description of Artificial Sequence: Synthetic polypeptide
DEEEIRTTNPVATEQYGSVNQTSGLGQQEEFGNGNT

SEQ ID NO: 115908 - protein, 34 aa, Artificial Sequence
  Description of Artificial Sequence: Synthetic polypeptide
DEEEIRTTNPVATEQYGSVDNPRLLNENFVEERI

SEQ ID NO: 115909 - protein, 34 aa, Artificial Sequence
  Description of Artificial Sequence: Synthetic polypeptide
DEEEIRTTNPVATEQYGSVDNPRNQLNNFVNEEI

SEQ ID NO: 115910 - protein, 35 aa, Artificial Sequence
  Description of Artificial Sequence: Synthetic polypeptide
DEEEIRTTNPVATEQYGSVNNVAGNMTQTGGGNIG

SEQ ID NO: 115911 - protein, 37 aa, Artificial Sequence
  Description of Artificial Sequence: Synthetic polypeptide
DEEEIRTTNPVATEQYGVVSTVNNLQQGTTNEETEED

SEQ ID NO: 115912 - protein, 37 aa, Artificial Sequence
  Description of Artificial Sequence: Synthetic polypeptide
DEEEIRTTNPVATEQYGVVSTVNNLQQGNQQGTNEEE

SEQ ID NO: 115913 - protein, 36 aa, Artificial Sequence
  Description of Artificial Sequence: Synthetic polypeptide
DEEEIRTTNPVATEQYGSVDSDFNMNIQEGEGNGQT

SEQ ID NO: 115914 - protein, 35 aa, Artificial Sequence
  Description of Artificial Sequence: Synthetic polypeptide
DEEEIRTTNPVATEQYGSVDSGMNDQNQIGGGEEG

SEQ ID NO: 115915 - protein, 35 aa, Artificial Sequence
  Description of Artificial Sequence: Synthetic polypeptide
DEEEIRTTNPVATEQYGSVDSGMNEQNQGGGGETG

SEQ ID NO: 115916 - protein, 34 aa, Artificial Sequence
  Description of Artificial Sequence: Synthetic polypeptide
DEEEIRTTNPVATEQYGSVDNPRNLNNNFVEERQ

SEQ ID NO: 115917 - protein, 33 aa, Artificial Sequence
  Description of Artificial Sequence: Synthetic polypeptide
DEAEIATTNPVAYEQYGSVCTNLQEHGGDLEAM

SEQ ID NO: 115918 - protein, 34 aa, Artificial Sequence
  Description of Artificial Sequence: Synthetic polypeptide
DEEEIRTTNPVATEQYGSVDHTTEDHNDENGEEQ

SEQ ID NO: 115919 - protein, 34 aa, Artificial Sequence
  Description of Artificial Sequence: Synthetic polypeptide
DEEEIRTTNPVATEQYGSVDGQTTDDENQGGEFD

SEQ ID NO: 115920 - protein, 37 aa, Artificial Sequence
  Description of Artificial Sequence: Synthetic polypeptide
DEEEIRTTNPVATEQYGVVSTVNNQLQAGNNQQGNVD

SEQ ID NO: 115921 - protein, 32 aa, Artificial Sequence
  Description of Artificial Sequence: Synthetic polypeptide
DEAEIATTNPVAYEQYGSVTSAANQLQSNDPT

SEQ ID NO: 115922 - protein, 32 aa, Artificial Sequence
  Description of Artificial Sequence: Synthetic polypeptide
DEAEIATTNPVAYEQYGSVTSAANQLQNPPTN

SEQ ID NO: 115923 - protein, 32 aa, Artificial Sequence
  Description of Artificial Sequence: Synthetic polypeptide
DEAEIATTNPVAYEQYGSVTSAANQLQNDPPN

SEQ ID NO: 115924 - protein, 33 aa, Artificial Sequence
  Description of Artificial Sequence: Synthetic polypeptide
DEAEIATTNPVAYEQYGSVSVANLGVDGDNTEM

SEQ ID NO: 115925 - protein, 33 aa, Artificial Sequence
  Description of Artificial Sequence: Synthetic polypeptide
DEEEIATTNPTATEQYGSVNVNDLWVDNAGYRF

SEQ ID NO: 115926 - protein, 33 aa, Artificial Sequence
  Description of Artificial Sequence: Synthetic polypeptide
DEEEIRTTNPVATEQYGTCVCSTEHENFGSDDS

SEQ ID NO: 115927 - protein, 34 aa, Artificial Sequence
  Description of Artificial Sequence: Synthetic polypeptide
DEAEIATTNPVAYEQYGSVSVAGNLGQDGGNTES

SEQ ID NO: 115928 - protein, 36 aa, Artificial Sequence
  Description of Artificial Sequence: Synthetic polypeptide
DEEEIRTTNPVATEQYGSVDDSDLDNGQGEGGNNTQ

SEQ ID NO: 115929 - protein, 35 aa, Artificial Sequence
  Description of Artificial Sequence: Synthetic polypeptide
DEEEIRTTNPVATEQYGSVDDTDLQNNIGEGEDGG

SEQ ID NO: 115930 - protein, 34 aa, Artificial Sequence
  Description of Artificial Sequence: Synthetic polypeptide
DEAEIATTNPVAYEQYGSVSTNNLPQEHQGDGEA

SEQ ID NO: 115931 - protein, 36 aa, Artificial Sequence
  Description of Artificial Sequence: Synthetic polypeptide
DEEEIRTTNPVATEQYGSVDDTDLQNNIGEGENNGQ

SEQ ID NO: 115932 - protein, 35 aa, Artificial Sequence
  Description of Artificial Sequence: Synthetic polypeptide
DEEEIATTNPVATEQYGSVCAMTGLTAPGNQMEGR

SEQ ID NO: 115933 - protein, 34 aa, Artificial Sequence
  Description of Artificial Sequence: Synthetic polypeptide
DEEEIATTNPVATEQYGSVCAMTGLNQDMMNMES

SEQ ID NO: 115934 - protein, 34 aa, Artificial Sequence
  Description of Artificial Sequence: Synthetic polypeptide
DEEEIATTNPVATEQYGSVCAMTGHNQDAGNMEN

SEQ ID NO: 115935 - protein, 35 aa, Artificial Sequence
  Description of Artificial Sequence: Synthetic polypeptide
DEEEIATTNPVATEQYGSVCAMTGELQDSGGEHNH

SEQ ID NO: 115936 - protein, 34 aa, Artificial Sequence
  Description of Artificial Sequence: Synthetic polypeptide
DEEEIRTTNPVATEQYGSVDGNNDGQNETGGDGE

SEQ ID NO: 115937 - protein, 35 aa, Artificial Sequence
  Description of Artificial Sequence: Synthetic polypeptide
DEEEIRTTNPVATEQYGTVCSATPGGPNMFNGMNV

SEQ ID NO: 115938 - protein, 34 aa, Artificial Sequence
  Description of Artificial Sequence: Synthetic polypeptide
DEEEIATTNPVATEQYGSVCAPTNPEAGAQTEDR

SEQ ID NO: 115939 - protein, 33 aa, Artificial Sequence
  Description of Artificial Sequence: Synthetic polypeptide
DEEEIATTNPVATEQYGSVCAATQLQAAEASGQ

SEQ ID NO: 115940 - protein, 34 aa, Artificial Sequence
  Description of Artificial Sequence: Synthetic polypeptide
DEEEIATTNPVATEQYGSVCAATQLAATAEGGRE

SEQ ID NO: 115941 - protein, 33 aa, Artificial Sequence
  Description of Artificial Sequence: Synthetic polypeptide
DEEEIATTNPVATECYGDVSSTPALPQMREEPV

SEQ ID NO: 115942 - protein, 28 aa, Artificial Sequence
  Description of Artificial Sequence: Synthetic peptide
DEEEIATTNPVATECYGETAEDCQHEEI

SEQ ID NO: 115943 - protein, 31 aa, Artificial Sequence
  Description of Artificial Sequence: Synthetic polypeptide
DEEEIATTNPVATECYGEVSEIVCQREEEEK

SEQ ID NO: 115944 - protein, 36 aa, Artificial Sequence
  Description of Artificial Sequence: Synthetic polypeptide
DEEEIATTNPVATECYGSTVSCTNMESNSRGGNYRC

SEQ ID NO: 115945 - protein, 37 aa, Artificial Sequence
  Description of Artificial Sequence: Synthetic polypeptide
DEEEIRTTNPVATEQYGSVESTPLNELEQHQGDETQI

SEQ ID NO: 115946 - protein, 31 aa, Artificial Sequence
  Description of Artificial Sequence: Synthetic polypeptide
DEEEIATTNPVATECYGSVSSECGPQHEEPV

SEQ ID NO: 115947 - protein, 34 aa, Artificial Sequence
  Description of Artificial Sequence: Synthetic polypeptide
DEEEIRTTNPVATEQYGSVNGTGTDFDERGQEIM

SEQ ID NO: 115948 - protein, 33 aa, Artificial Sequence
  Description of Artificial Sequence: Synthetic polypeptide
DEEEIATTNPVATECWGSVSTTNGDNDNGKNAD

SEQ ID NO: 115949 - protein, 34 aa, Artificial Sequence
  Description of Artificial Sequence: Synthetic polypeptide
DEEEIRTTNPVATEQYGSVNGTGSGQTEGEDGED

SEQ ID NO: 115950 - protein, 36 aa, Artificial Sequence
  Description of Artificial Sequence: Synthetic polypeptide
DEEEIRTTNPVATEQYGSVESTTPAGPNMRNGMNPL

SEQ ID NO: 115951 - protein, 36 aa, Artificial Sequence
  Description of Artificial Sequence: Synthetic polypeptide
DEEEIRTTNPVATEQYGSVESTTPAGPNMRNGMNPV

SEQ ID NO: 115952 - protein, 36 aa, Artificial Sequence
  Description of Artificial Sequence: Synthetic polypeptide
DEEEIRTTNPVATEQYGSVESTTPAGPNVRNGMNPV

SEQ ID NO: 115953 - protein, 34 aa, Artificial Sequence
  Description of Artificial Sequence: Synthetic polypeptide
DEEEIRTTNPVATEQYGSVNGQSLEDDQGSNNIQ

SEQ ID NO: 115954 - protein, 36 aa, Artificial Sequence
  Description of Artificial Sequence: Synthetic polypeptide
DEEEIRTTNPVATEQYGSVESTTPAYPNMRNGMNPV

SEQ ID NO: 115955 - protein, 36 aa, Artificial Sequence
  Description of Artificial Sequence: Synthetic polypeptide
DEEEIRTTNPVATEQYGSVESTTPDGPNMRNGMNPV

SEQ ID NO: 115956 - protein, 35 aa, Artificial Sequence
  Description of Artificial Sequence: Synthetic polypeptide
DEEEIRTTNPVATEQYGSVNGQMNTLTGGNENFEW

SEQ ID NO: 115957 - protein, 33 aa, Artificial Sequence
  Description of Artificial Sequence: Synthetic polypeptide
DEEEIATTNPVATEQYGSVCAANNGDQDPDNNH

SEQ ID NO: 115958 - protein, 35 aa, Artificial Sequence
  Description of Artificial Sequence: Synthetic polypeptide
DEEEIATTNPVATEQYGSVCAANMHLEQTIDGERH

SEQ ID NO: 115959 - protein, 32 aa, Artificial Sequence
  Description of Artificial Sequence: Synthetic polypeptide
DEEEIATTNPVATECWGSVSEINEPQREEEEK

SEQ ID NO: 115960 - protein, 34 aa, Artificial Sequence
  Description of Artificial Sequence: Synthetic polypeptide
DEEEIATTNPVATEQYGSVCAANNLDEAPGNNVH

SEQ ID NO: 115961 - protein, 34 aa, Artificial Sequence
  Description of Artificial Sequence: Synthetic polypeptide
DEEEIRTTNPVATEQYGSVEPTPIILEPTIEVAR

SEQ ID NO: 115962 - protein, 32 aa, Artificial Sequence
  Description of Artificial Sequence: Synthetic polypeptide
DEAEIATTNPVAYEQYGSTTAGNGLQDSGNDM

SEQ ID NO: 115963 - protein, 35 aa, Artificial Sequence
  Description of Artificial Sequence: Synthetic polypeptide
DEEEIRTTNPVATEQYGSVNMPNGIGQEDDGENEG

SEQ ID NO: 115964 - protein, 35 aa, Artificial Sequence
  Description of Artificial Sequence: Synthetic polypeptide
DEEEIRTTNPVATEQYGSVNMLGLTGEPGQEEGNI

SEQ ID NO: 115965 - protein, 34 aa, Artificial Sequence
  Description of Artificial Sequence: Synthetic polypeptide
DEEEIRTTNPVATEQYGSVNMGLTGPGGEEGNIL

SEQ ID NO: 115966 - protein, 35 aa, Artificial Sequence
  Description of Artificial Sequence: Synthetic polypeptide
DEEEIRTTNPVATEQYGSVNILANMLEVERGPIQD

SEQ ID NO: 115967 - protein, 33 aa, Artificial Sequence
  Description of Artificial Sequence: Synthetic polypeptide
DEEEIRTTNPVATEQYGSVEQPMLGEAQPELET

SEQ ID NO: 115968 - protein, 34 aa, Artificial Sequence
  Description of Artificial Sequence: Synthetic polypeptide
DEEEIATTNPVATEQYGSVCAANNLDEAENGARS

SEQ ID NO: 115969 - protein, 33 aa, Artificial Sequence
  Description of Artificial Sequence: Synthetic polypeptide
DEEEIRTTNPVATEQYGSVNICEVEDERGGEES

SEQ ID NO: 115970 - protein, 35 aa, Artificial Sequence
  Description of Artificial Sequence: Synthetic polypeptide
DEEEIRTTNPVATEQYGSVESPTITLPQEESEVPL

SEQ ID NO: 115971 - protein, 35 aa, Artificial Sequence
  Description of Artificial Sequence: Synthetic polypeptide
DEEEIRTTNPVATEQYGSVESPTITLPQENSEVGV

SEQ ID NO: 115972 - protein, 34 aa, Artificial Sequence
  Description of Artificial Sequence: Synthetic polypeptide
DEEEIRTTNPVATEQYGSVNGTTPDDDYRGQEIS

SEQ ID NO: 115973 - protein, 36 aa, Artificial Sequence
  Description of Artificial Sequence: Synthetic polypeptide
DEEEIRTTNPVATEQYGSVESPTNTNQGLNMEVNEF

SEQ ID NO: 115974 - protein, 30 aa, Artificial Sequence
  Description of Artificial Sequence: Synthetic polypeptide
DEEEIATTNPVATECWGSVPCNCPQHEEEG

SEQ ID NO: 115975 - protein, 31 aa, Artificial Sequence
  Description of Artificial Sequence: Synthetic polypeptide
DEEEIATTNPVATECWGSVPCNCPQHEGEEG

SEQ ID NO: 115976 - protein, 33 aa, Artificial Sequence
  Description of Artificial Sequence: Synthetic polypeptide
DEEEIATTNPVATEQYGSVCAANNLDEAPNGVN

SEQ ID NO: 115977 - protein, 37 aa, Artificial Sequence
  Description of Artificial Sequence: Synthetic polypeptide
DEEEIRTTNPVATEQYGVVSTVNLGNNQQGTNEEDED

SEQ ID NO: 115978 - protein, 34 aa, Artificial Sequence
  Description of Artificial Sequence: Synthetic polypeptide
DEEEIATTNPVATEQYGSVCAANPLQEADGYQMQ

SEQ ID NO: 115979 - protein, 33 aa, Artificial Sequence
  Description of Artificial Sequence: Synthetic polypeptide
DEEEIATTNPVATEQYGSVCAANMGEQPDSQNT

SEQ ID NO: 115980 - protein, 34 aa, Artificial Sequence
  Description of Artificial Sequence: Synthetic polypeptide
DEEEIRTTNPVATEQYGSVNGQMNEFGGNEGFED

SEQ ID NO: 115981 - protein, 34 aa, Artificial Sequence
  Description of Artificial Sequence: Synthetic polypeptide
DEEEIRTTNPVATEQYGSVNGELYDDQGSSQINT

SEQ ID NO: 115982 - protein, 34 aa, Artificial Sequence
  Description of Artificial Sequence: Synthetic polypeptide
DEEEIRTTNPVATEQYGSVNGELEDDQESEQINV

SEQ ID NO: 115983 - protein, 34 aa, Artificial Sequence
  Description of Artificial Sequence: Synthetic polypeptide
DEEEIATTNPVATECYGSVSSTPCGPQHNGMNPV

SEQ ID NO: 115984 - protein, 35 aa, Artificial Sequence
  Description of Artificial Sequence: Synthetic polypeptide
DEEEIRTTNPVATEQYGSVNGELDDQVGDNQNGQD

SEQ ID NO: 115985 - protein, 33 aa, Artificial Sequence
  Description of Artificial Sequence: Synthetic polypeptide
DEEEIATTNPVATEQYGSVCAANAGEADDPGNN

SEQ ID NO: 115986 - protein, 34 aa, Artificial Sequence
  Description of Artificial Sequence: Synthetic polypeptide
DEEEIRTTNPVATEQYGSVNGELDDQGSNQNQQD

SEQ ID NO: 115987 - protein, 33 aa, Artificial Sequence
  Description of Artificial Sequence: Synthetic polypeptide
DEEEIRTTNPVATEQYGSVNGDNMNEEGGGDGN

SEQ ID NO: 115988 - protein, 35 aa, Artificial Sequence
  Description of Artificial Sequence: Synthetic polypeptide
DEEEIRTTNPVATEQYGSVNGETNMTNGGGGENGT

SEQ ID NO: 115989 - protein, 36 aa, Artificial Sequence
  Description of Artificial Sequence: Synthetic polypeptide
DEEEIRTTNPVATEQYGSVNGATTNDESQRNGDADI

SEQ ID NO: 115990 - protein, 35 aa, Artificial Sequence
  Description of Artificial Sequence: Synthetic polypeptide
DEEEIRTTNPVATEQYGSVNFTTDLQGGEGGEEEE

SEQ ID NO: 115991 - protein, 34 aa, Artificial Sequence
  Description of Artificial Sequence: Synthetic polypeptide
DEEEIRTTNPVATEQYGSVNFNTMVSEQEVNPLF

SEQ ID NO: 115992 - protein, 35 aa, Artificial Sequence
  Description of Artificial Sequence: Synthetic polypeptide
DEEEIRTTNPVATEQYGSVNFNNGIQEGGGNEQDG

SEQ ID NO: 115993 - protein, 34 aa, Artificial Sequence
  Description of Artificial Sequence: Synthetic polypeptide
DEEEIRTTNPVATEQYGSVNFNDNNVDIGGNGEE

SEQ ID NO: 115994 - protein, 35 aa, Artificial Sequence
  Description of Artificial Sequence: Synthetic polypeptide
DEEEIRTTNPVATEQYGSVNEPTNNMGIEPRDNKQ

SEQ ID NO: 115995 - protein, 34 aa, Artificial Sequence
  Description of Artificial Sequence: Synthetic polypeptide
DEEEIRTTNPVATEQYGSVNEPTLHMRNVNVVND

SEQ ID NO: 115996 - protein, 36 aa, Artificial Sequence
  Description of Artificial Sequence: Synthetic polypeptide
DEEEIRTTNPVATEQYGSVNDITGNFNDQDEGGNEI

SEQ ID NO: 115997 - protein, 34 aa, Artificial Sequence
  Description of Artificial Sequence: Synthetic polypeptide
DEEEIRTTNPVATEQYGSVNGALEDDQGSNNIQN

SEQ ID NO: 115998 - protein, 33 aa, Artificial Sequence
  Description of Artificial Sequence: Synthetic polypeptide
DEEEIATTNPVATEQYGSVCAANMGEQPDQNEH

SEQ ID NO: 115999 - protein, 34 aa, Artificial Sequence
  Description of Artificial Sequence: Synthetic polypeptide
DEEEIRTTNPVATEQYGSVNGFGGQEDGGQNEGD

SEQ ID NO: 116000 - protein, 34 aa, Artificial Sequence
  Description of Artificial Sequence: Synthetic polypeptide
DEEEIRTTNPVATEQYGSVNGFVSDDERMEQNRT

SEQ ID NO: 116001 - protein, 34 aa, Artificial Sequence
  Description of Artificial Sequence: Synthetic polypeptide
DEEEIATTNPVATEQYGSVCAANMGEQPDMGNMS

SEQ ID NO: 116002 - protein, 33 aa, Artificial Sequence
  Description of Artificial Sequence: Synthetic polypeptide
DEEEIATTNPVATEQYGSVCAANMGEQPDMANH

SEQ ID NO: 116003 - protein, 34 aa, Artificial Sequence
  Description of Artificial Sequence: Synthetic polypeptide
DEEEIRTTNPVATEQYGVVSTVGDTGEGGGNEEG

SEQ ID NO: 116004 - protein, 35 aa, Artificial Sequence
  Description of Artificial Sequence: Synthetic polypeptide
DEEEIRTTNPVATEQYGSVNGMNIDDDQRGGEEIN

SEQ ID NO: 116005 - protein, 34 aa, Artificial Sequence
  Description of Artificial Sequence: Synthetic polypeptide
DEEEIATTNPVATEQYGSVCAANMGEQIDVGENS

SEQ ID NO: 116006 - protein, 34 aa, Artificial Sequence
  Description of Artificial Sequence: Synthetic polypeptide
DEEEIATTNPVATEQYGSVCAANMGEQIDMGNEH

SEQ ID NO: 116007 - protein, 34 aa, Artificial Sequence
  Description of Artificial Sequence: Synthetic polypeptide
DEEEIATTNPVATEQYGSVCAANMGEEQPDGNES

SEQ ID NO: 116008 - protein, 36 aa, Artificial Sequence
  Description of Artificial Sequence: Synthetic polypeptide
DEEEIRTTNPVATEQYGSVNGFVSDDDQRDMEDNRD

SEQ ID NO: 116009 - protein, 33 aa, Artificial Sequence
  Description of Artificial Sequence: Synthetic polypeptide
DEEEIATTNPVATECYGSVSSEPCGPQHNGNPV

SEQ ID NO: 116010 - protein, 34 aa, Artificial Sequence
  Description of Artificial Sequence: Synthetic polypeptide
DEEEIRTTNPVATEQYGSVNGIDNMTNGGGNDGV

SEQ ID NO: 116011 - protein, 35 aa, Artificial Sequence
  Description of Artificial Sequence: Synthetic polypeptide
DEEEIRTTNPVATEQYGSVNGFVSNDDQRMEDNND

SEQ ID NO: 116012 - protein, 34 aa, Artificial Sequence
  Description of Artificial Sequence: Synthetic polypeptide
DEEEIRTTNPVATEQYGSVNGFVSDDQSMENERG

SEQ ID NO: 116013 - protein, 34 aa, Artificial Sequence
  Description of Artificial Sequence: Synthetic polypeptide
DEEEIRTTNPVATEQYGSVNGFVSDDQRMETNVG

SEQ ID NO: 116014 - protein, 34 aa, Artificial Sequence
  Description of Artificial Sequence: Synthetic polypeptide
DEEEIRTTNPVATEQYGSVNGFVSDDQRMEFNED

SEQ ID NO: 116015 - protein, 34 aa, Artificial Sequence
  Description of Artificial Sequence: Synthetic polypeptide
DEEEIRTTNPVATEQYGSVNGFVSDDQQMEDNVN

SEQ ID NO: 116016 - protein, 34 aa, Artificial Sequence
  Description of Artificial Sequence: Synthetic polypeptide
DEEEIRTTNPVATEQYGSVNGFVSDDQFMEDNRD

SEQ ID NO: 116017 - protein, 34 aa, Artificial Sequence
  Description of Artificial Sequence: Synthetic polypeptide
DEEEIRTTNPVATEQYGSVNGIMNDIGGNEGFED

SEQ ID NO: 116018 - protein, 33 aa, Artificial Sequence
  Description of Artificial Sequence: Synthetic polypeptide
DEEEIATTNPVATEQYGSVCAAPLQDHHGDQQH

SEQ ID NO: 116019 - protein, 35 aa, Artificial Sequence
  Description of Artificial Sequence: Synthetic polypeptide
DEEEIATTNPVATEQYGSVCAATAELQDMLGGEND

SEQ ID NO: 116020 - protein, 31 aa, Artificial Sequence
  Description of Artificial Sequence: Synthetic polypeptide
DEAEIATTNPVAYEQYGSTTAGNNDQDSGNP

SEQ ID NO: 116021 - protein, 37 aa, Artificial Sequence
  Description of Artificial Sequence: Synthetic polypeptide
DEEEIRTTNPVATEQYGVVSTVNLQQGNNQNQNDEED

SEQ ID NO: 116022 - protein, 37 aa, Artificial Sequence
  Description of Artificial Sequence: Synthetic polypeptide
DEEEIRTTNPVATEQYGVVSTVNLQQGNNQNQEEEDT

SEQ ID NO: 116023 - protein, 37 aa, Artificial Sequence
  Description of Artificial Sequence: Synthetic polypeptide
DEEEIRTTNPVATEQYGVVSTVNLQQGNNQNEEENEE

SEQ ID NO: 116024 - protein, 37 aa, Artificial Sequence
  Description of Artificial Sequence: Synthetic polypeptide
DEEEIRTTNPVATEQYGVVSTVNLQQGNNQINEEEDD

SEQ ID NO: 116025 - protein, 37 aa, Artificial Sequence
  Description of Artificial Sequence: Synthetic polypeptide
DEEEIRTTNPVATEQYGVVSTVNLQQGNNQEQGTEDE

SEQ ID NO: 116026 - protein, 34 aa, Artificial Sequence
  Description of Artificial Sequence: Synthetic polypeptide
DEEEIRTTNPVATEQYGTVDTDNVGQGNGQTGEQ

SEQ ID NO: 116027 - protein, 32 aa, Artificial Sequence
  Description of Artificial Sequence: Synthetic polypeptide
DEAEIATTNPVAYEQYGSVAANGDQGTPPDNR

SEQ ID NO: 116028 - protein, 33 aa, Artificial Sequence
  Description of Artificial Sequence: Synthetic polypeptide
DEEEIRTTNPVATEQYGSVELPNIPTAVEELRY

SEQ ID NO: 116029 - protein, 36 aa, Artificial Sequence
  Description of Artificial Sequence: Synthetic polypeptide
DEEEIRTTNPVATEQYGSVENLNMNFLQPGSQVENG

SEQ ID NO: 116030 - protein, 37 aa, Artificial Sequence
  Description of Artificial Sequence: Synthetic polypeptide
DEEEIRTTNPVATEQYGVVSTVNLQQGNNNQEEEDDE

SEQ ID NO: 116031 - protein, 37 aa, Artificial Sequence
  Description of Artificial Sequence: Synthetic polypeptide
DEEEIRTTNPVATEQYGVVSTVNLQQGNNNNENQQAE

SEQ ID NO: 116032 - protein, 37 aa, Artificial Sequence
  Description of Artificial Sequence: Synthetic polypeptide
DEEEIRTTNPVATEQYGVVSTVNLQQGNNNNEEQEDE

SEQ ID NO: 116033 - protein, 37 aa, Artificial Sequence
  Description of Artificial Sequence: Synthetic polypeptide
DEEEIRTTNPVATEQYGVVSTVNLQQGNNNNEEEGAE

SEQ ID NO: 116034 - protein, 33 aa, Artificial Sequence
  Description of Artificial Sequence: Synthetic polypeptide
DEEEIRTTNPVATEQYGSVENQPQQGEAQPEPN

SEQ ID NO: 116035 - protein, 34 aa, Artificial Sequence
  Description of Artificial Sequence: Synthetic polypeptide
DEEEIATTNPVATEQYGSVCAATMDGANQADNRH

SEQ ID NO: 116036 - protein, 31 aa, Artificial Sequence
  Description of Artificial Sequence: Synthetic polypeptide
DEAEIATTNPVAYEQYGSVAAAGGQDQGGNY

SEQ ID NO: 116037 - protein, 37 aa, Artificial Sequence
  Description of Artificial Sequence: Synthetic polypeptide
DEEEIRTTNPVATEQYGVVSTVNLQQGNNNQEEQQTE

SEQ ID NO: 116038 - protein, 37 aa, Artificial Sequence
  Description of Artificial Sequence: Synthetic polypeptide
DEEEIRTTNPVATEQYGVVSTVNLQQGNNNNDEQTAE

SEQ ID NO: 116039 - protein, 33 aa, Artificial Sequence
  Description of Artificial Sequence: Synthetic polypeptide
DEEEIRTTNPVATEQYGSVNNNIWEESDSNDSL

SEQ ID NO: 116040 - protein, 34 aa, Artificial Sequence
  Description of Artificial Sequence: Synthetic polypeptide
DEEEIRTTNPVATEQYGSVNNNTCEDNGEEQNNP

SEQ ID NO: 116041 - protein, 34 aa, Artificial Sequence
  Description of Artificial Sequence: Synthetic polypeptide
DEEEIRTTNPVATEQYGTVCSATPGPPNFEGMNV

SEQ ID NO: 116042 - protein, 34 aa, Artificial Sequence
  Description of Artificial Sequence: Synthetic polypeptide
DEEEIRTTNPVATEQYGTVCSATPGPPNFNGMNV

SEQ ID NO: 116043 - protein, 34 aa, Artificial Sequence
  Description of Artificial Sequence: Synthetic polypeptide
DEEEIATTNPVATEQYGSVCAATNGEEQADEENN

SEQ ID NO: 116044 - protein, 36 aa, Artificial Sequence
  Description of Artificial Sequence: Synthetic polypeptide
DEEEIRTTNPVATEQYGTVCSNTEEDLQEGFNSEQS

SEQ ID NO: 116045 - protein, 36 aa, Artificial Sequence
  Description of Artificial Sequence: Synthetic polypeptide
DEEEIRTTNPVATEQYGSVDTNNMQNQEMGVNGEQN

SEQ ID NO: 116046 - protein, 35 aa, Artificial Sequence
  Description of Artificial Sequence: Synthetic polypeptide
DEEEIATTNPVATEQYGSVCAATNEEAGDGGENRD

SEQ ID NO: 116047 - protein, 34 aa, Artificial Sequence
  Description of Artificial Sequence: Synthetic polypeptide
DEEEIRTTNPVATEQYGSVDTPSNMEEIQENVVW

SEQ ID NO: 116048 - protein, 32 aa, Artificial Sequence
  Description of Artificial Sequence: Synthetic polypeptide
DEEEIRTTNPVATEQYGSVELNIIPTVVEETV

SEQ ID NO: 116049 - protein, 34 aa, Artificial Sequence
  Description of Artificial Sequence: Synthetic polypeptide
DEEEIRTTNPVATEQYGSVDTPSNMEPQENAHDQ

SEQ ID NO: 116050 - protein, 32 aa, Artificial Sequence
  Description of Artificial Sequence: Synthetic polypeptide
DEAEIATTNPVAYEQYGSVATADQRENPNTDD

SEQ ID NO: 116051 - protein, 32 aa, Artificial Sequence
  Description of Artificial Sequence: Synthetic polypeptide
DEAEIATTNPVAYEQYGSVASAANGLQNNPPT

SEQ ID NO: 116052 - protein, 33 aa, Artificial Sequence
  Description of Artificial Sequence: Synthetic polypeptide
DEAEIATTNPVAYEQYGSVANTNNDEQNGNNDQ

SEQ ID NO: 116053 - protein, 36 aa, Artificial Sequence
  Description of Artificial Sequence: Synthetic polypeptide
DEEEIATTNPVATEQYGSVCAATMNPLEATEDGNRH

SEQ ID NO: 116054 - protein, 34 aa, Artificial Sequence
  Description of Artificial Sequence: Synthetic polypeptide
DEEEIRTTNPVATEQYGSVEAVNIMVQDGEQEDV

SEQ ID NO: 116055 - protein, 32 aa, Artificial Sequence
  Description of Artificial Sequence: Synthetic polypeptide
DEAEIATTNPVAYEQYGSVANNNLQDPAEGRH

SEQ ID NO: 116056 - protein, 33 aa, Artificial Sequence
  Description of Artificial Sequence: Synthetic polypeptide
DEAEIATTNPVAYEQYGSVAITDGDQDQGNDRL

SEQ ID NO: 116057 - protein, 35 aa, Artificial Sequence
  Description of Artificial Sequence: Synthetic polypeptide
DEEEIRTTNPVATEQYGSVDTVMIGNGGDEGENEQ

SEQ ID NO: 116058 - protein, 37 aa, Artificial Sequence
  Description of Artificial Sequence: Synthetic polypeptide
DEEEIRTTNPVATEQYGVVSTVNLQQGNNDEEATTDT

SEQ ID NO: 116059 - protein, 34 aa, Artificial Sequence
  Description of Artificial Sequence: Synthetic polypeptide
DEEEIATTNPVATEQYGSVCAATGLEARSGMEKA

SEQ ID NO: 116060 - protein, 37 aa, Artificial Sequence
  Description of Artificial Sequence: Synthetic polypeptide
DEEEIRTTNPVATEQYGVVSTVNLQNQQQGTNATTDD

SEQ ID NO: 116061 - protein, 36 aa, Artificial Sequence
  Description of Artificial Sequence: Synthetic polypeptide
DEEEIRTTNPVATEQYGSVNNLTNHFDEIGNMEVRP

SEQ ID NO: 116062 - protein, 34 aa, Artificial Sequence
  Description of Artificial Sequence: Synthetic polypeptide
DEEEIRTTNPVATEQYGSVNNETEDNNGSEQNNP

SEQ ID NO: 116063 - protein, 34 aa, Artificial Sequence
  Description of Artificial Sequence: Synthetic polypeptide
DEEEIRTTNPVATEQYGSVNNETEDNGSEEENFP

SEQ ID NO: 116064 - protein, 35 aa, Artificial Sequence
  Description of Artificial Sequence: Synthetic polypeptide
DEEEIATTNPVATEQYGSVCAATANDQDLPGENNH

SEQ ID NO: 116065 - protein, 35 aa, Artificial Sequence
  Description of Artificial Sequence: Synthetic polypeptide
DEEEIRTTNPVATEQYGSVNNEDNPDQGREEQNDE

SEQ ID NO: 116066 - protein, 35 aa, Artificial Sequence
  Description of Artificial Sequence: Synthetic polypeptide
DEEEIATTNPVATEQYGSVCAATANDEQDMPGENN

SEQ ID NO: 116067 - protein, 35 aa, Artificial Sequence
  Description of Artificial Sequence: Synthetic polypeptide
DEEEIRTTNPVATEQYGSVNNDTGDENQEGEGNQI

SEQ ID NO: 116068 - protein, 33 aa, Artificial Sequence
  Description of Artificial Sequence: Synthetic polypeptide
DEEEIRTTNPVATEQYGSVEPMNVSVISNVPTI

SEQ ID NO: 116069 - protein, 33 aa, Artificial Sequence
  Description of Artificial Sequence: Synthetic polypeptide
DEEEIRTTNPVATEQYGSVNNATTPTERISIEM

SEQ ID NO: 116070 - protein, 33 aa, Artificial Sequence
  Description of Artificial Sequence: Synthetic polypeptide
DEEEIRTTNPVATEQYGSVNNACEDNGEEENNP

SEQ ID NO: 116071 - protein, 35 aa, Artificial Sequence
  Description of Artificial Sequence: Synthetic polypeptide
DEEEIRTTNPVATEQYGSVNMTVGIQEDNGQNNGD

SEQ ID NO: 116072 - protein, 34 aa, Artificial Sequence
  Description of Artificial Sequence: Synthetic polypeptide
DEEEIRTTNPVATEQYGSVEPTLIIGELTIEEAR

SEQ ID NO: 116073 - protein, 34 aa, Artificial Sequence
  Description of Artificial Sequence: Synthetic polypeptide
DEEEIATTNPVATEQYGSVCAATANDADMPGNEN

SEQ ID NO: 116074 - protein, 35 aa, Artificial Sequence
  Description of Artificial Sequence: Synthetic polypeptide
DEEEIATTNPVATEQYGSVCAATANADQDLPDGNN

SEQ ID NO: 116075 - protein, 34 aa, Artificial Sequence
  Description of Artificial Sequence: Synthetic polypeptide
DEEEIRTTNPVATEQYGSVEPTMNMEQENMQTTI

SEQ ID NO: 116076 - protein, 35 aa, Artificial Sequence
  Description of Artificial Sequence: Synthetic polypeptide
DEEEIRTTNPVATEQYGSVEPTMNMLNENIQGVIE

SEQ ID NO: 116077 - protein, 35 aa, Artificial Sequence
  Description of Artificial Sequence: Synthetic polypeptide
DEEEIRTTNPVATEQYGSVEPTLAIGELNGAVQRA

SEQ ID NO: 116078 - protein, 36 aa, Artificial Sequence
  Description of Artificial Sequence: Synthetic polypeptide
DEEEIRTTNPVATEQYGSVNNLTNHWDEEGNNEIRT

SEQ ID NO: 116079 - protein, 36 aa, Artificial Sequence
  Description of Artificial Sequence: Synthetic polypeptide
DEEEIRTTNPVATEQYGSVNNLTNMHNDEEGNTEIR

SEQ ID NO: 116080 - protein, 33 aa, Artificial Sequence
  Description of Artificial Sequence: Synthetic polypeptide
DEEEIATTNPVATEQYGSVCAATAQLDAAEIGN

SEQ ID NO: 116081 - protein, 33 aa, Artificial Sequence
  Description of Artificial Sequence: Synthetic polypeptide
DEEEIATTNPVATEQYGSVCAATGEEQADDPNN

SEQ ID NO: 116082 - protein, 37 aa, Artificial Sequence
  Description of Artificial Sequence: Synthetic polypeptide
DEEEIRTTNPVATEQYGVVSTVNLQLGNQQGNGTTDD

SEQ ID NO: 116083 - protein, 36 aa, Artificial Sequence
  Description of Artificial Sequence: Synthetic polypeptide
DEEEIRTTNPVATEQYGVVSTVNLQAGTEQGTEDED

SEQ ID NO: 116084 - protein, 32 aa, Artificial Sequence
  Description of Artificial Sequence: Synthetic polypeptide
DEEEIRTTNPVATEQYGTVNNFDTDQEGGGEI

SEQ ID NO: 116085 - protein, 32 aa, Artificial Sequence
  Description of Artificial Sequence: Synthetic polypeptide
DEAEIATTNPVAYEQYGSTTAGNNLQDSGNFP

SEQ ID NO: 116086 - protein, 35 aa, Artificial Sequence
  Description of Artificial Sequence: Synthetic polypeptide
DEEEIRTTNPVATEQYGSVNNMQLDQVGENNGQDT

SEQ ID NO: 116087 - protein, 33 aa, Artificial Sequence
  Description of Artificial Sequence: Synthetic polypeptide
DEEEIATTNPVATEQYGSVCAATGEEPDREQNN

SEQ ID NO: 116088 - protein, 34 aa, Artificial Sequence
  Description of Artificial Sequence: Synthetic polypeptide
DEEEIRTTNPVATEQYGSVNNLTVELNEVLDNNQ

SEQ ID NO: 116089 - protein, 37 aa, Artificial Sequence
  Description of Artificial Sequence: Synthetic polypeptide
DEEEIRTTNPVATEQYGVVSTVNLQAGNQQGNTQEED

SEQ ID NO: 116090 - protein, 37 aa, Artificial Sequence
  Description of Artificial Sequence: Synthetic polypeptide
DEEEIRTTNPVATEQYGVVSTVNLQAGNQQGNIQEDT

SEQ ID NO: 116091 - protein, 37 aa, Artificial Sequence
  Description of Artificial Sequence: Synthetic polypeptide
DEEEIRTTNPVATEQYGVVSTVNLQAGNQQGNGNTED

SEQ ID NO: 116092 - protein, 37 aa, Artificial Sequence
  Description of Artificial Sequence: Synthetic polypeptide
DEEEIRTTNPVATEQYGVVSTVNLQAGNQQGNDTDTD

SEQ ID NO: 116093 - protein, 34 aa, Artificial Sequence
  Description of Artificial Sequence: Synthetic polypeptide
DEEEIRTTNPVATEQYGSVEPCNFEQPIMPNAIL

SEQ ID NO: 116094 - protein, 35 aa, Artificial Sequence
  Description of Artificial Sequence: Synthetic polypeptide
DEEEIRTTNPVATEQYGSVNNLTNTHDEEGNTEIN

SEQ ID NO: 116095 - protein, 33 aa, Artificial Sequence
  Description of Artificial Sequence: Synthetic polypeptide
DEEEIATTNPVATEQYGSVCAATAQLQMAEEGQ

SEQ ID NO: 116096 - protein, 33 aa, Artificial Sequence
  Description of Artificial Sequence: Synthetic polypeptide
DEEEIRTTNPVATEQYGSVEPFMGLDEVTNVVG

SEQ ID NO: 116097 - protein, 33 aa, Artificial Sequence
  Description of Artificial Sequence: Synthetic polypeptide
DEEEIATTNPVATEQYGSVCAATAQLQAAEMDQ

SEQ ID NO: 116098 - protein, 33 aa, Artificial Sequence
  Description of Artificial Sequence: Synthetic polypeptide
DEEEIATTNPVATEQYGSVCAATQLDAAENTGQ

SEQ ID NO: 116099 - protein, 33 aa, Artificial Sequence
  Description of Artificial Sequence: Synthetic polypeptide
DEEEIATTNPFATEQYGSVPTVQADHRQVVNGR

SEQ ID NO: 116100 - protein, 35 aa, Artificial Sequence
  Description of Artificial Sequence: Synthetic polypeptide
DEEEIRTTNPVATEQYGSVNSNELSQEENASEQDI

SEQ ID NO: 116101 - protein, 35 aa, Artificial Sequence
  Description of Artificial Sequence: Synthetic polypeptide
DEEEIATTNPVATEQYGSVCAPTNPEQQRDQIDDR

SEQ ID NO: 116102 - protein, 34 aa, Artificial Sequence
  Description of Artificial Sequence: Synthetic polypeptide
DEEEIRTTNPVATEQYGSVPEPPLLIQQIGEEIV

SEQ ID NO: 116103 - protein, 37 aa, Artificial Sequence
  Description of Artificial Sequence: Synthetic polypeptide
DEEEIRTTNPVATEQYGVVSTVTNLQQGNNIGTEDED

SEQ ID NO: 116104 - protein, 37 aa, Artificial Sequence
  Description of Artificial Sequence: Synthetic polypeptide
DEEEIRTTNPVATEQYGVVSTVTNLQQGNNEEEEEEE

SEQ ID NO: 116105 - protein, 33 aa, Artificial Sequence
  Description of Artificial Sequence: Synthetic polypeptide
DEEEIRTTNPVATEQYGSVPELMMPEQENNEGQ

SEQ ID NO: 116106 - protein, 35 aa, Artificial Sequence
  Description of Artificial Sequence: Synthetic polypeptide
DEEEIATTNPVATEQYGSVICSVGNLDNNDGDSRM

SEQ ID NO: 116107 - protein, 35 aa, Artificial Sequence
  Description of Artificial Sequence: Synthetic polypeptide
DEEEIRTTNPVATEQYGSVPCWDNHGQDRQGDKGH

SEQ ID NO: 116108 - protein, 37 aa, Artificial Sequence
  Description of Artificial Sequence: Synthetic polypeptide
DEEEIRTTNPVATEQYGVVSTVTNLQNGNQQNQNDED

SEQ ID NO: 116109 - protein, 37 aa, Artificial Sequence
  Description of Artificial Sequence: Synthetic polypeptide
DEEEIRTTNPVATEQYGVVSTVTNLQQGNNNEEDEEE

SEQ ID NO: 116110 - protein, 37 aa, Artificial Sequence
  Description of Artificial Sequence: Synthetic polypeptide
DEEEIRTTNPVATEQYGVVSTVTNLQNAGNQQGTNQE

SEQ ID NO: 116111 - protein, 34 aa, Artificial Sequence
  Description of Artificial Sequence: Synthetic polypeptide
DEEEIRTTNPVATEQYGSVPATPNDEQQTISVEE

SEQ ID NO: 116112 - protein, 33 aa, Artificial Sequence
  Description of Artificial Sequence: Synthetic polypeptide
DEEEIRTTNPVATEQYGSVNYCELEDEGGGEES

SEQ ID NO: 116113 - protein, 34 aa, Artificial Sequence
  Description of Artificial Sequence: Synthetic polypeptide
DEEEIRTTNPVATEQYGSVNVGNFTGQEELNGGG

SEQ ID NO: 116114 - protein, 34 aa, Artificial Sequence
  Description of Artificial Sequence: Synthetic polypeptide
DEEEIRTTNPVATEQYGSVNVGNFEGQGENENGG

SEQ ID NO: 116115 - protein, 37 aa, Artificial Sequence
  Description of Artificial Sequence: Synthetic polypeptide
DEEEIRTTNPVATEQYGSVCSTTGADNNERFGMNPVA

SEQ ID NO: 116116 - protein, 34 aa, Artificial Sequence
  Description of Artificial Sequence: Synthetic polypeptide
DEEEIRTTNPVATEQYGSVNTVYVMETTGNDVEE

SEQ ID NO: 116117 - protein, 34 aa, Artificial Sequence
  Description of Artificial Sequence: Synthetic polypeptide
DEEEIRTTNPVATEQYGSVNTQGFGQDEGEDGDQ

SEQ ID NO: 116118 - protein, 37 aa, Artificial Sequence
  Description of Artificial Sequence: Synthetic polypeptide
DEEEIRTTNPVATEQYGVVSTVTNLQAGTNTEEEEDE

SEQ ID NO: 116119 - protein, 34 aa, Artificial Sequence
  Description of Artificial Sequence: Synthetic polypeptide
DEEEIACTNPVATEQYGSVCATGLAPGEQMEGNN

SEQ ID NO: 116120 - protein, 37 aa, Artificial Sequence
  Description of Artificial Sequence: Synthetic polypeptide
DEEEIRTTNPVATEQYGVVSTVTNLQQGNNNEEQQED

SEQ ID NO: 116121 - protein, 37 aa, Artificial Sequence
  Description of Artificial Sequence: Synthetic polypeptide
DEEEIRTTNPVATEQYGVVSTVTNLQQGNNQEGTEDE

SEQ ID NO: 116122 - protein, 35 aa, Artificial Sequence
  Description of Artificial Sequence: Synthetic polypeptide
DEEEIRTTNPVATEQYGSVPITPNMPLVRQFEMVT

SEQ ID NO: 116123 - protein, 34 aa, Artificial Sequence
  Description of Artificial Sequence: Synthetic polypeptide
DEEEIATTNPVATEQYGSVPCWDNHGQRQGGGAA

SEQ ID NO: 116124 - protein, 34 aa, Artificial Sequence
  Description of Artificial Sequence: Synthetic polypeptide
DEEEIRTTNPVATEQYGSVPITITQMINPMDNNE

SEQ ID NO: 116125 - protein, 33 aa, Artificial Sequence
  Description of Artificial Sequence: Synthetic polypeptide
DEEEIACTNPVATEQYGSVCAANPLQEADNQMQ

SEQ ID NO: 116126 - protein, 34 aa, Artificial Sequence
  Description of Artificial Sequence: Synthetic polypeptide
DEEEIATTNPVATEQYGSVPCWDNHGQRQGGDHE

SEQ ID NO: 116127 - protein, 36 aa, Artificial Sequence
  Description of Artificial Sequence: Synthetic polypeptide
DEEEIRTTNPVATEQYGSVCSTPEVLDLQENVEENA

SEQ ID NO: 116128 - protein, 37 aa, Artificial Sequence
  Description of Artificial Sequence: Synthetic polypeptide
DEEEIRTTNPVATEQYGVVSTVTNLQSGNNNEEEEED

SEQ ID NO: 116129 - protein, 37 aa, Artificial Sequence
  Description of Artificial Sequence: Synthetic polypeptide
DEEEIRTTNPVATEQYGVVSTVTNLQQGNNQEEDEDT

SEQ ID NO: 116130 - protein, 34 aa, Artificial Sequence
  Description of Artificial Sequence: Synthetic polypeptide
DEEEIATTNPVATEQYGSVPCWDNHGQQRQGKGS

SEQ ID NO: 116131 - protein, 31 aa, Artificial Sequence
  Description of Artificial Sequence: Synthetic polypeptide
DEEEIATTNPVATEQYGSVPATVCEHEEEDL

SEQ ID NO: 116132 - protein, 31 aa, Artificial Sequence
  Description of Artificial Sequence: Synthetic polypeptide
DEEEIATTNPVATEQYGSVPATDCEHEEEDL

SEQ ID NO: 116133 - protein, 34 aa, Artificial Sequence
  Description of Artificial Sequence: Synthetic polypeptide
DEEEIATTNPVATEQYGSVPAITGNGEYGDEGGR

SEQ ID NO: 116134 - protein, 35 aa, Artificial Sequence
  Description of Artificial Sequence: Synthetic polypeptide
DEEEIRTTNPVATEQYGSVPETPLLEQTMGLLMQN

SEQ ID NO: 116135 - protein, 37 aa, Artificial Sequence
  Description of Artificial Sequence: Synthetic polypeptide
DEEEIRTTNPVATEQYGVVSTVTNLQQGNQQGNQTDE

SEQ ID NO: 116136 - protein, 37 aa, Artificial Sequence
  Description of Artificial Sequence: Synthetic polypeptide
DEEEIRTTNPVATEQYGVVSTVTNLQQGNQQEEENDT

SEQ ID NO: 116137 - protein, 37 aa, Artificial Sequence
  Description of Artificial Sequence: Synthetic polypeptide
DEEEIRTTNPVATEQYGVVSTVTNLQQGNNQNEEDED

SEQ ID NO: 116138 - protein, 35 aa, Artificial Sequence
  Description of Artificial Sequence: Synthetic polypeptide
DEEEIRTTNPVATEQYGSVPHPPVGLQRNGFGETI

SEQ ID NO: 116139 - protein, 37 aa, Artificial Sequence
  Description of Artificial Sequence: Synthetic polypeptide
DEEEIRTTNPVATEQYGVVSTVTNLQYGNNEEEEEDE

SEQ ID NO: 116140 - protein, 34 aa, Artificial Sequence
  Description of Artificial Sequence: Synthetic polypeptide
DEEEIACTNPVATEQYGSVCATNLAGTPGAEDND

SEQ ID NO: 116141 - protein, 34 aa, Artificial Sequence
  Description of Artificial Sequence: Synthetic polypeptide
DEEEIACTNPVATEQYGSVCATNLAPDSMDGERL

SEQ ID NO: 116142 - protein, 35 aa, Artificial Sequence
  Description of Artificial Sequence: Synthetic polypeptide
DEEEIRTTNPVATEQYGSVNTETVTLESGGMLNLE

SEQ ID NO: 116143 - protein, 37 aa, Artificial Sequence
  Description of Artificial Sequence: Synthetic polypeptide
DEEEIRTTNPVATEQYGVVSTVSNLQQGNQNNEEQED

SEQ ID NO: 116144 - protein, 36 aa, Artificial Sequence
  Description of Artificial Sequence: Synthetic polypeptide
DEEEIRTTNPVATEQYGSVCSTTPADNAESSGSNPV

SEQ ID NO: 116145 - protein, 37 aa, Artificial Sequence
  Description of Artificial Sequence: Synthetic polypeptide
DEEEIRTTNPVATEQYGSVCSTTPADNIERSGSNPVS

SEQ ID NO: 116146 - protein, 37 aa, Artificial Sequence
  Description of Artificial Sequence: Synthetic polypeptide
DEEEIRTTNPVATEQYGVVSTVQNLQAGNQAGTNQDE

SEQ ID NO: 116147 - protein, 36 aa, Artificial Sequence
  Description of Artificial Sequence: Synthetic polypeptide
DEEEIRTTNPVATEQYGSVCSTTPADNNERFGGDPQ

SEQ ID NO: 116148 - protein, 37 aa, Artificial Sequence
  Description of Artificial Sequence: Synthetic polypeptide
DEEEIRTTNPVATEQYGSVCSTTPADNNERFGGNPVM

SEQ ID NO: 116149 - protein, 34 aa, Artificial Sequence
  Description of Artificial Sequence: Synthetic polypeptide
DEEEIACTNPVATEQYGSVSPTNNHQENDMIERM

SEQ ID NO: 116150 - protein, 37 aa, Artificial Sequence
  Description of Artificial Sequence: Synthetic polypeptide
DEEEIRTTNPVATEQYGVVSTVNVNNLQAGTTNEEED

SEQ ID NO: 116151 - protein, 36 aa, Artificial Sequence
  Description of Artificial Sequence: Synthetic polypeptide
DEEEIRTTNPVATEQYGSVCSTTPADNNERSNSNPV

SEQ ID NO: 116152 - protein, 36 aa, Artificial Sequence
  Description of Artificial Sequence: Synthetic polypeptide
DEEEIRTTNPVATEQYGSVNTDTGNMGQEFGQGNIE

SEQ ID NO: 116153 - protein, 36 aa, Artificial Sequence
  Description of Artificial Sequence: Synthetic polypeptide
DEEEIRTTNPVATEQYGSVCSTTPADPAERFGNNPV

SEQ ID NO: 116154 - protein, 36 aa, Artificial Sequence
  Description of Artificial Sequence: Synthetic polypeptide
DEEEIRTTNPVATEQYGSVCSTTPADPNNRFGSNPV

SEQ ID NO: 116155 - protein, 36 aa, Artificial Sequence
  Description of Artificial Sequence: Synthetic polypeptide
DEEEIRTTNPVATEQYGSVCSTTPADPTERSGMNPV

SEQ ID NO: 116156 - protein, 36 aa, Artificial Sequence
  Description of Artificial Sequence: Synthetic polypeptide
DEEEIRTTNPVATEQYGVVSTVNTNQQAGNNQEQDE

SEQ ID NO: 116157 - protein, 33 aa, Artificial Sequence
  Description of Artificial Sequence: Synthetic polypeptide
DEEEIRTTNPVATEQYGSVNTDMEQPQSTQIMH

SEQ ID NO: 116158 - protein, 35 aa, Artificial Sequence
  Description of Artificial Sequence: Synthetic polypeptide
DEEEIRTTNPVATEQYGSVNTDTMNLIDDEGEGGN

SEQ ID NO: 116159 - protein, 36 aa, Artificial Sequence
  Description of Artificial Sequence: Synthetic polypeptide
DEEEIRTTNPVATEQYGSVCSTTMADPNERFGMNPV

SEQ ID NO: 116160 - protein, 36 aa, Artificial Sequence
  Description of Artificial Sequence: Synthetic polypeptide
DEEEIRTTNPVATEQYGSVCSTTPADEIERFGMNPV

SEQ ID NO: 116161 - protein, 37 aa, Artificial Sequence
  Description of Artificial Sequence: Synthetic polypeptide
DEEEIRTTNPVATEQYGVVSTVSTVNLQQGTTTEEED

SEQ ID NO: 116162 - protein, 33 aa, Artificial Sequence
  Description of Artificial Sequence: Synthetic polypeptide
DEEEIACTNPVATEQYGSVCATNLAPDSMDGHQ

SEQ ID NO: 116163 - protein, 34 aa, Artificial Sequence
  Description of Artificial Sequence: Synthetic polypeptide
DEEEIACTNPVATEQYGSVCATNLQPDDGMGSQV

SEQ ID NO: 116164 - protein, 37 aa, Artificial Sequence
  Description of Artificial Sequence: Synthetic polypeptide
DEEEIRTTNPVATEQYGVVSTVTNLQAGNQQGTDTQE

SEQ ID NO: 116165 - protein, 35 aa, Artificial Sequence
  Description of Artificial Sequence: Synthetic polypeptide
DEEEIACTNPVATEQYGSVCATNPLAEAEMGNGRF

SEQ ID NO: 116166 - protein, 35 aa, Artificial Sequence
  Description of Artificial Sequence: Synthetic polypeptide
DEEEIACTNPVATEQYGSVCATNPLQDDPGEQTNQ

SEQ ID NO: 116167 - protein, 34 aa, Artificial Sequence
  Description of Artificial Sequence: Synthetic polypeptide
DEEEIACTNPVATEQYGSVCSTDQNDAGIGNADD

SEQ ID NO: 116168 - protein, 37 aa, Artificial Sequence
  Description of Artificial Sequence: Synthetic polypeptide
DEEEIRTTNPVATEQYGVVSTVTNLQAGNQAGNQEDE

SEQ ID NO: 116169 - protein, 37 aa, Artificial Sequence
  Description of Artificial Sequence: Synthetic polypeptide
DEEEIRTTNPVATEQYGVVSTVSTNQQGNTEQGTNTE

SEQ ID NO: 116170 - protein, 37 aa, Artificial Sequence
  Description of Artificial Sequence: Synthetic polypeptide
DEEEIRTTNPVATEQYGVVSTVTNLQAGNNAEEEDED

SEQ ID NO: 116171 - protein, 35 aa, Artificial Sequence
  Description of Artificial Sequence: Synthetic polypeptide
DEEEIACTNPVATEQYGSVCSTNPLQEDAGEGDHE

SEQ ID NO: 116172 - protein, 37 aa, Artificial Sequence
  Description of Artificial Sequence: Synthetic polypeptide
DEEEIRTTNPVATEQYGVVSTVTNLQAGNEQGTNQDQ

SEQ ID NO: 116173 - protein, 34 aa, Artificial Sequence
  Description of Artificial Sequence: Synthetic polypeptide
DEEEIATTNPVATEQYGSVCSVDNLPQGDDLDQD

SEQ ID NO: 116174 - protein, 36 aa, Artificial Sequence
  Description of Artificial Sequence: Synthetic polypeptide
DEEEIATTNPVATEQYGSVCSVANHLNEAGEENTRD

SEQ ID NO: 116175 - protein, 34 aa, Artificial Sequence
  Description of Artificial Sequence: Synthetic polypeptide
DEEEIATTNPVATEQYGSVCSVADNDNDGGENED

SEQ ID NO: 116176 - protein, 34 aa, Artificial Sequence
  Description of Artificial Sequence: Synthetic polypeptide
DEEEIATTNPVATEQYGSVCSVADNDNDGGENAD

SEQ ID NO: 116177 - protein, 37 aa, Artificial Sequence
  Description of Artificial Sequence: Synthetic polypeptide
DEEEIRTTNPVATEQYGVVSTVTGNNLQQGTEEGGND

SEQ ID NO: 116178 - protein, 34 aa, Artificial Sequence
  Description of Artificial Sequence: Synthetic polypeptide
DEEEIACTNPVATEQYGSVCSTNDQNGAGDGTDN

SEQ ID NO: 116179 - protein, 34 aa, Artificial Sequence
  Description of Artificial Sequence: Synthetic polypeptide
DEEEIRTTNPVATEQYGSVPLVVQTNQADNELLY

SEQ ID NO: 116180 - protein, 35 aa, Artificial Sequence
  Description of Artificial Sequence: Synthetic polypeptide
DEEEIRTTNPVATEQYGSVPLWINPLDVQAMGLDE

SEQ ID NO: 116181 - protein, 34 aa, Artificial Sequence
  Description of Artificial Sequence: Synthetic polypeptide
DEEEIRTTNPVATEQYGSVPMLSVGTEPGQVEIT

SEQ ID NO: 116182 - protein, 35 aa, Artificial Sequence
  Description of Artificial Sequence: Synthetic polypeptide
DEEEIATTNPVATEQYGSVSSTTPALNMRNGMTPV

SEQ ID NO: 116183 - protein, 35 aa, Artificial Sequence
  Description of Artificial Sequence: Synthetic polypeptide
DEEEIATTNPVATEQYGSVSSTTPALEMHNGMNDV

SEQ ID NO: 116184 - protein, 35 aa, Artificial Sequence
  Description of Artificial Sequence: Synthetic polypeptide
DEEEIATTNPVATEQYGSVSSTTPALEDHNGMNDV

SEQ ID NO: 116185 - protein, 36 aa, Artificial Sequence
  Description of Artificial Sequence: Synthetic polypeptide
DEEEIATTNPVATEQYGSVSSTTPAIPNMQNGGNPV

SEQ ID NO: 116186 - protein, 33 aa, Artificial Sequence
  Description of Artificial Sequence: Synthetic polypeptide
DEAEICTTNPVATECYGSVSTGGNAGADGGMDR

SEQ ID NO: 116187 - protein, 34 aa, Artificial Sequence
  Description of Artificial Sequence: Synthetic polypeptide
DEAEICTTNPVATECYGSVSTGGLAQGDTGGNTS

SEQ ID NO: 116188 - protein, 33 aa, Artificial Sequence
  Description of Artificial Sequence: Synthetic polypeptide
DEAEICTTNPVATECYGSVSGGNGNQGGHGNND

SEQ ID NO: 116189 - protein, 35 aa, Artificial Sequence
  Description of Artificial Sequence: Synthetic polypeptide
DEEEIATTNPVATEQYGSVSSTTPALNMSNGMTPR

SEQ ID NO: 116190 - protein, 35 aa, Artificial Sequence
  Description of Artificial Sequence: Synthetic polypeptide
DEEEIATTNPVATEQYGSVSSTTPAGPNRNGMNPV

SEQ ID NO: 116191 - protein, 35 aa, Artificial Sequence
  Description of Artificial Sequence: Synthetic polypeptide
DEEEIATTNPVATEQYGSVSSTTPAGPNMRNGNPV

SEQ ID NO: 116192 - protein, 34 aa, Artificial Sequence
  Description of Artificial Sequence: Synthetic polypeptide
DEEEIRTTNPVATEQYGSVPPPLLQETMNLLEQV

SEQ ID NO: 116193 - protein, 35 aa, Artificial Sequence
  Description of Artificial Sequence: Synthetic polypeptide
DEEEIATTNPVATEQYGSVSSTTPAGPNMRGMNPL

SEQ ID NO: 116194 - protein, 35 aa, Artificial Sequence
  Description of Artificial Sequence: Synthetic polypeptide
DEEEIATTNPVATEQYGSVSSTTPAGPNMREGNPV

SEQ ID NO: 116195 - protein, 34 aa, Artificial Sequence
  Description of Artificial Sequence: Synthetic polypeptide
DEAEICTTNPVATECYGEVSTGNQLQGDTGGNEV

SEQ ID NO: 116196 - protein, 33 aa, Artificial Sequence
  Description of Artificial Sequence: Synthetic polypeptide
DEEEIRTTNPVATEQYGSVPPPLLEVTMGLLEQ

SEQ ID NO: 116197 - protein, 34 aa, Artificial Sequence
  Description of Artificial Sequence: Synthetic polypeptide
DEAEICTTNPVATECYGEVSTGNGLLQDVGQNET

SEQ ID NO: 116198 - protein, 33 aa, Artificial Sequence
  Description of Artificial Sequence: Synthetic polypeptide
DEAEICTTNPVATECYGSVATGNPQGDTGGNEK

SEQ ID NO: 116199 - protein, 34 aa, Artificial Sequence
  Description of Artificial Sequence: Synthetic polypeptide
DEAEICTTNPVATECYGEVSTGNGLLDDRGQNEN

SEQ ID NO: 116200 - protein, 36 aa, Artificial Sequence
  Description of Artificial Sequence: Synthetic polypeptide
DEEEIATTNPVATEQYGSVSSTTPALPNMRNGMNPV

SEQ ID NO: 116201 - protein, 34 aa, Artificial Sequence
  Description of Artificial Sequence: Synthetic polypeptide
DEAEICTTNPVATECYGSVSTGNGIQGGHGGNND

SEQ ID NO: 116202 - protein, 36 aa, Artificial Sequence
  Description of Artificial Sequence: Synthetic polypeptide
DEEEIRTTNPVATEQYGVVSTVTNQAGNQAGTNEDT

SEQ ID NO: 116203 - protein, 30 aa, Artificial Sequence
  Description of Artificial Sequence: Synthetic polypeptide
DEEEIATTNPVATEQYGTISEVCQQQHEEK

SEQ ID NO: 116204 - protein, 29 aa, Artificial Sequence
  Description of Artificial Sequence: Synthetic peptide
DEEEIATTNPVATEQYGTAPEVCQQHEEK

SEQ ID NO: 116205 - protein, 35 aa, Artificial Sequence
  Description of Artificial Sequence: Synthetic polypeptide
DEAEICTTNPVATECYGSVSTGNGLLQDQGQNNEN

SEQ ID NO: 116206 - protein, 36 aa, Artificial Sequence
  Description of Artificial Sequence: Synthetic polypeptide
DEAEICTTNPVATECYGSVSTGNGLLQDDRGQNGTA

SEQ ID NO: 116207 - protein, 36 aa, Artificial Sequence
  Description of Artificial Sequence: Synthetic polypeptide
DEAEICTTNPVATECYGSVSTGNGLLQDDRGGNGKN

SEQ ID NO: 116208 - protein, 33 aa, Artificial Sequence
  Description of Artificial Sequence: Synthetic polypeptide
DEEEIATTNPVATEQYGSVTGPNNGNTSGENEA

SEQ ID NO: 116209 - protein, 34 aa, Artificial Sequence
  Description of Artificial Sequence: Synthetic polypeptide
DEAEICTTNPVATECYGSVSTGNEGNQGTHGNND

SEQ ID NO: 116210 - protein, 36 aa, Artificial Sequence
  Description of Artificial Sequence: Synthetic polypeptide
DEAEICTTNPVATECYGSVSTGNGLLQDDRGDNEEN

SEQ ID NO: 116211 - protein, 35 aa, Artificial Sequence
  Description of Artificial Sequence: Synthetic polypeptide
DEAEICTTNPVATECYGSVSTGNGLLQDDRGDHEE

SEQ ID NO: 116212 - protein, 34 aa, Artificial Sequence
  Description of Artificial Sequence: Synthetic polypeptide
DEEEIATTNPVATEQYGSVSTTPALNDHEGMEPL

SEQ ID NO: 116213 - protein, 35 aa, Artificial Sequence
  Description of Artificial Sequence: Synthetic polypeptide
DEEEIATTNPVATEQYGSVSTTPAGPNMHNGMNPL

SEQ ID NO: 116214 - protein, 34 aa, Artificial Sequence
  Description of Artificial Sequence: Synthetic polypeptide
DEEEIATTNPVATEQYGSVSTTPAGNDHEGMEPV

SEQ ID NO: 116215 - protein, 34 aa, Artificial Sequence
  Description of Artificial Sequence: Synthetic polypeptide
DEEEIATTNPVATEQYGSVSTTPAGNDHEGMEPL

SEQ ID NO: 116216 - protein, 36 aa, Artificial Sequence
  Description of Artificial Sequence: Synthetic polypeptide
DEEEIATTNPVATEQYGSVSSTWPAGPNNQHGGNPV

SEQ ID NO: 116217 - protein, 34 aa, Artificial Sequence
  Description of Artificial Sequence: Synthetic polypeptide
DEAEICTTNPVATECYGSVSTGNGLGQDDGKEEN

SEQ ID NO: 116218 - protein, 34 aa, Artificial Sequence
  Description of Artificial Sequence: Synthetic polypeptide
DEEEIATTNPVATEQYGSVSTTPDLNDHEGMEPL

SEQ ID NO: 116219 - protein, 35 aa, Artificial Sequence
  Description of Artificial Sequence: Synthetic polypeptide
DEEEIATTNPVATEQYGSVSSTTPAGNMRNGMNPV

SEQ ID NO: 116220 - protein, 36 aa, Artificial Sequence
  Description of Artificial Sequence: Synthetic polypeptide
DEEEIATTNPVATEQYGSVSSTTPAGLNMRDGMNPV

SEQ ID NO: 116221 - protein, 34 aa, Artificial Sequence
  Description of Artificial Sequence: Synthetic polypeptide
DEEEIRTTNPVATEQYGSVPPPLLEQTTGELEQV

SEQ ID NO: 116222 - protein, 34 aa, Artificial Sequence
  Description of Artificial Sequence: Synthetic polypeptide
DEEEIATTNPVATEQYGSVSGNGVPQEADGTAPN

SEQ ID NO: 116223 - protein, 35 aa, Artificial Sequence
  Description of Artificial Sequence: Synthetic polypeptide
DEEEIATTNPVATEQYGSVSGGNNGNQGNGGNGMD

SEQ ID NO: 116224 - protein, 34 aa, Artificial Sequence
  Description of Artificial Sequence: Synthetic polypeptide
DEEEIATTNPVATEQYGSVSGEGPPQNTGGNPVN

SEQ ID NO: 116225 - protein, 36 aa, Artificial Sequence
  Description of Artificial Sequence: Synthetic polypeptide
DEEEIRTTNPVATEQYGSVCSTNNELQEHQDDTDAG

SEQ ID NO: 116226 - protein, 34 aa, Artificial Sequence
  Description of Artificial Sequence: Synthetic polypeptide
DEEEIRTTNPVATEQYGSYTTTNIDPVRQGEDGQ

SEQ ID NO: 116227 - protein, 33 aa, Artificial Sequence
  Description of Artificial Sequence: Synthetic polypeptide
DEEEIRTTNPVATEQYGSYTTYQHNNRTEDDED

SEQ ID NO: 116228 - protein, 35 aa, Artificial Sequence
  Description of Artificial Sequence: Synthetic polypeptide
DEEEIRTTNPVATEQYGSVCSTNPELNEHDDTVAG

SEQ ID NO: 116229 - protein, 33 aa, Artificial Sequence
  Description of Artificial Sequence: Synthetic polypeptide
DEEEIRTTNPVATEQYGSYTSWGPSLFGGEEQM

SEQ ID NO: 116230 - protein, 34 aa, Artificial Sequence
  Description of Artificial Sequence: Synthetic polypeptide
DEEEIRTTNPVATEQYGSYVEPTPQEHVGVNEPA

SEQ ID NO: 116231 - protein, 34 aa, Artificial Sequence
  Description of Artificial Sequence: Synthetic polypeptide
DEEEIATTNPVATEQYGSVSANTGPGEYGAEGGR

SEQ ID NO: 116232 - protein, 35 aa, Artificial Sequence
  Description of Artificial Sequence: Synthetic polypeptide
DEEEIATTNPVATEQYGSVSANGVPPQDDDGNNSN

SEQ ID NO: 116233 - protein, 36 aa, Artificial Sequence
  Description of Artificial Sequence: Synthetic polypeptide
DEEEIATTNPVATEQYGSVSAMTPAGLNMRAGMNPV

SEQ ID NO: 116234 - protein, 36 aa, Artificial Sequence
  Description of Artificial Sequence: Synthetic polypeptide
DEEEIRTTNPVATEQYGSYVEPVVSELQPRMGNILL

SEQ ID NO: 116235 - protein, 34 aa, Artificial Sequence
  Description of Artificial Sequence: Synthetic polypeptide
DEAEICTTNPVATECWGSVSTNLNQGNAGENGGS

SEQ ID NO: 116236 - protein, 35 aa, Artificial Sequence
  Description of Artificial Sequence: Synthetic polypeptide
DEEEIRTTNPVATEQYGSYVPQTNQTNLQNEAEDL

SEQ ID NO: 116237 - protein, 34 aa, Artificial Sequence
  Description of Artificial Sequence: Synthetic polypeptide
DEEEIRTTNPVATEQYGSVPMNDGLEHDITQNDD

SEQ ID NO: 116238 - protein, 34 aa, Artificial Sequence
  Description of Artificial Sequence: Synthetic polypeptide
DEEEIATTNPVATEQYGSVSATPAGPNDRNGEPL

SEQ ID NO: 116239 - protein, 35 aa, Artificial Sequence
  Description of Artificial Sequence: Synthetic polypeptide
DEEEIATTNPVATEQYGSVSGTGPPQNNPDEEGNN

SEQ ID NO: 116240 - protein, 36 aa, Artificial Sequence
  Description of Artificial Sequence: Synthetic polypeptide
DEEEIATTNPVATEQYGSVSGTNPEGPNMRNGMNPV

SEQ ID NO: 116241 - protein, 36 aa, Artificial Sequence
  Description of Artificial Sequence: Synthetic polypeptide
DEEEIATTNPVATEQYGSVSGTTNGGPNMRNGMNPV

SEQ ID NO: 116242 - protein, 35 aa, Artificial Sequence
  Description of Artificial Sequence: Synthetic polypeptide
DEEEIATTNPVATEQYGSVSSTTAGPNMRNGMNPV

SEQ ID NO: 116243 - protein, 35 aa, Artificial Sequence
  Description of Artificial Sequence: Synthetic polypeptide
DEEEIATTNPVATEQYGSVSSTTAGPNMRNGMNDV

SEQ ID NO: 116244 - protein, 34 aa, Artificial Sequence
  Description of Artificial Sequence: Synthetic polypeptide
DEEEIATTNPVATEQYGSVSSTTAGPNMRNGEPV

SEQ ID NO: 116245 - protein, 34 aa, Artificial Sequence
  Description of Artificial Sequence: Synthetic polypeptide
DEEEIATTNPVATEQYGSVSSTTAGPNMREGEPV

SEQ ID NO: 116246 - protein, 34 aa, Artificial Sequence
  Description of Artificial Sequence: Synthetic polypeptide
DEEEIATTNPVATEQYGSVSSTTAGPNDREGEPV

SEQ ID NO: 116247 - protein, 34 aa, Artificial Sequence
  Description of Artificial Sequence: Synthetic polypeptide
DEEEIATTNPVATEQYGSVSSTTAGPNDREGEPL

SEQ ID NO: 116248 - protein, 34 aa, Artificial Sequence
  Description of Artificial Sequence: Synthetic polypeptide
DEEEIATTNPVATEQYGSVSSTTAGEMHNGMNDV

SEQ ID NO: 116249 - protein, 34 aa, Artificial Sequence
  Description of Artificial Sequence: Synthetic polypeptide
DEEEIATTNPVATEQYGSVSSTTAGEDHNGMNDV

SEQ ID NO: 116250 - protein, 36 aa, Artificial Sequence
  Description of Artificial Sequence: Synthetic polypeptide
DEEEIRTTNPVATEQYGVVSTVTNNNQQGNQDEEQD

SEQ ID NO: 116251 - protein, 33 aa, Artificial Sequence
  Description of Artificial Sequence: Synthetic polypeptide
DEAEICTTNPVATECYGEVSTGNGLDAGGMNVD

SEQ ID NO: 116252 - protein, 35 aa, Artificial Sequence
  Description of Artificial Sequence: Synthetic polypeptide
DEEEIATTNPVATEQYGSVSSTPAGPNMRNGMNPV

SEQ ID NO: 116253 - protein, 36 aa, Artificial Sequence
  Description of Artificial Sequence: Synthetic polypeptide
DEEEIATTNPVATEQYGSVSSTNPAGPNMRVGMQPR

SEQ ID NO: 116254 - protein, 36 aa, Artificial Sequence
  Description of Artificial Sequence: Synthetic polypeptide
DEEEIATTNPVATEQYGSVSSTNPAGPNMRVGMNPV

SEQ ID NO: 116255 - protein, 34 aa, Artificial Sequence
  Description of Artificial Sequence: Synthetic polypeptide
DEEEIRTTNPVATEQYGSVPPPLLEETMGILENV

SEQ ID NO: 116256 - protein, 32 aa, Artificial Sequence
  Description of Artificial Sequence: Synthetic polypeptide
DEEEIACTNPVATEQYGSVATTGPLPAEPEGN

SEQ ID NO: 116257 - protein, 36 aa, Artificial Sequence
  Description of Artificial Sequence: Synthetic polypeptide
DEEEIRTTNPVATEQYGSVPPATTLQPTTQGENEEL

SEQ ID NO: 116258 - protein, 34 aa, Artificial Sequence
  Description of Artificial Sequence: Synthetic polypeptide
DEEEIRTTNPVATEQYGSVPPALLEQTMGLLEQV

SEQ ID NO: 116259 - protein, 35 aa, Artificial Sequence
  Description of Artificial Sequence: Synthetic polypeptide
DEEEIRTTNPVATEQYGSVNTDGDGQNEEEGNGDG

SEQ ID NO: 116260 - protein, 37 aa, Artificial Sequence
  Description of Artificial Sequence: Synthetic polypeptide
DEEEIRTTNPVATEQYGSVCSTTPAGNIERFGNNPVI

SEQ ID NO: 116261 - protein, 37 aa, Artificial Sequence
  Description of Artificial Sequence: Synthetic polypeptide
DEEEIRTTNPVATEQYGVVSTVNTNLQQGTEAGTVNQ

SEQ ID NO: 116262 - protein, 37 aa, Artificial Sequence
  Description of Artificial Sequence: Synthetic polypeptide
DEEEIRTTNPVATEQYGVVSTVNTNLQQGNNEETEDE

SEQ ID NO: 116263 - protein, 31 aa, Artificial Sequence
  Description of Artificial Sequence: Synthetic polypeptide
DEEEIASTNPVCTEQYGVVSATDLEHEGEDL

SEQ ID NO: 116264 - protein, 34 aa, Artificial Sequence
  Description of Artificial Sequence: Synthetic polypeptide
DEEEIATTNPVATEQYGSVCSMNNQNEAMDDGDN

SEQ ID NO: 116265 - protein, 34 aa, Artificial Sequence
  Description of Artificial Sequence: Synthetic polypeptide
DEEEIATTNPVATEQYGSVCSMNNLNEAMPDGEN

SEQ ID NO: 116266 - protein, 33 aa, Artificial Sequence
  Description of Artificial Sequence: Synthetic polypeptide
DEEEIATTNPVATEQYGSVCSMNGNESENNNDQ

SEQ ID NO: 116267 - protein, 35 aa, Artificial Sequence
  Description of Artificial Sequence: Synthetic polypeptide
DEEEIATTNPVATEQYGSVCSMNDLGDQGQQPNID

SEQ ID NO: 116268 - protein, 35 aa, Artificial Sequence
  Description of Artificial Sequence: Synthetic polypeptide
DEEEIATTNPVATEQYGSVCSATNTLSNSNDKEHY

SEQ ID NO: 116269 - protein, 35 aa, Artificial Sequence
  Description of Artificial Sequence: Synthetic polypeptide
DEEEIRTTNPVATEQYGSVCSYGVLDTQLNVEENA

SEQ ID NO: 116270 - protein, 36 aa, Artificial Sequence
  Description of Artificial Sequence: Synthetic polypeptide
DEEEIRTTNPVATEQYGVVSTVNQQAGNNNEEETDE

SEQ ID NO: 116271 - protein, 35 aa, Artificial Sequence
  Description of Artificial Sequence: Synthetic polypeptide
DEEEIATTNPVATEQYGSVCSADNHGPLDSEGNNG

SEQ ID NO: 116272 - protein, 30 aa, Artificial Sequence
  Description of Artificial Sequence: Synthetic polypeptide
DEEEIASVNPIATEQYGAVSDENLAESGPQ

SEQ ID NO: 116273 - protein, 36 aa, Artificial Sequence
  Description of Artificial Sequence: Synthetic polypeptide
DEEEIRTTNPVATEQYGSYVYPVSTNHELQVDEDIE

SEQ ID NO: 116274 - protein, 30 aa, Artificial Sequence
  Description of Artificial Sequence: Synthetic polypeptide
DEEEIASVNPVATEQYGDVSEIEQNAAGDQ

SEQ ID NO: 116275 - protein, 33 aa, Artificial Sequence
  Description of Artificial Sequence: Synthetic polypeptide
DEEEIATTNPVATEQYGSVCAVDHNDNSMGNNQ

SEQ ID NO: 116276 - protein, 29 aa, Artificial Sequence
  Description of Artificial Sequence: Synthetic peptide
DEEEIASVNPVCTEQWGVVSENEQNSGDQ

SEQ ID NO: 116277 - protein, 35 aa, Artificial Sequence
  Description of Artificial Sequence: Synthetic polypeptide
DEEEIATTNPVATEQYGSVCATPNPLPQGSDDNGN

SEQ ID NO: 116278 - protein, 35 aa, Artificial Sequence
  Description of Artificial Sequence: Synthetic polypeptide
DEEEIATTNPVATEQYGSVCATPGLADRPGDNMAM

SEQ ID NO: 116279 - protein, 33 aa, Artificial Sequence
  Description of Artificial Sequence: Synthetic polypeptide
DEEEIASTNPVGTEQYGSVSSTTTLPQHNGMDV

SEQ ID NO: 116280 - protein, 35 aa, Artificial Sequence
  Description of Artificial Sequence: Synthetic polypeptide
DEEEIATTNPVATEQYGSVCATNTVDQDSDENARQ

SEQ ID NO: 116281 - protein, 36 aa, Artificial Sequence
  Description of Artificial Sequence: Synthetic polypeptide
DEEEIRTTNPVATEQYGVVSTVNQQAGNNQNTEENE

SEQ ID NO: 116282 - protein, 34 aa, Artificial Sequence
  Description of Artificial Sequence: Synthetic polypeptide
DEEEIASTNPVCTEQYGSVSSTTNGQMSNGMNPV

SEQ ID NO: 116283 - protein, 30 aa, Artificial Sequence
  Description of Artificial Sequence: Synthetic polypeptide
DEEEIASTNPVATEQWGDVSEIEQNAAGDQ

SEQ ID NO: 116284 - protein, 33 aa, Artificial Sequence
  Description of Artificial Sequence: Synthetic polypeptide
DEEEIASTNPVATEQYGNVSSTTAINSRNGNPV

SEQ ID NO: 116285 - protein, 34 aa, Artificial Sequence
  Description of Artificial Sequence: Synthetic polypeptide
DEEEIASTNPVATEQYGSVSSTTNGNMSNGMNPV

SEQ ID NO: 116286 - protein, 35 aa, Artificial Sequence
  Description of Artificial Sequence: Synthetic polypeptide
DEEEIATTNPVATEQYGSVCSPDGTGNEAGGNEHN

SEQ ID NO: 116287 - protein, 34 aa, Artificial Sequence
  Description of Artificial Sequence: Synthetic polypeptide
DEEEIASTNPVATEQYGSVSTTPAGPNRNGMNPV

SEQ ID NO: 116288 - protein, 35 aa, Artificial Sequence
  Description of Artificial Sequence: Synthetic polypeptide
DEEEIATTNPVATEQYGSVCSNNEGDQDQHGMNNE

SEQ ID NO: 116289 - protein, 36 aa, Artificial Sequence
  Description of Artificial Sequence: Synthetic polypeptide
DEEEIATTNPVATEQYGSVCSNNEGDLDQHQGGNNN

SEQ ID NO: 116290 - protein, 34 aa, Artificial Sequence
  Description of Artificial Sequence: Synthetic polypeptide
DEEEIATTNPVATEQYGSVCSMNNQNEAVPDGRN

SEQ ID NO: 116291 - protein, 37 aa, Artificial Sequence
  Description of Artificial Sequence: Synthetic polypeptide
DEEEIATTNPVATEQYGSVCSMTNTLPQDHQDGNENN

SEQ ID NO: 116292 - protein, 32 aa, Artificial Sequence
  Description of Artificial Sequence: Synthetic polypeptide
DEEEIASTNPVATEQYGVVSTTPAGPNSGMNQ

SEQ ID NO: 116293 - protein, 32 aa, Artificial Sequence
  Description of Artificial Sequence: Synthetic polypeptide
DEEEIASTNPVATEQYGVVSTTPAGPNSGMNV

SEQ ID NO: 116294 - protein, 34 aa, Artificial Sequence
  Description of Artificial Sequence: Synthetic polypeptide
DEEEIATTNPVATEQYGSVCSMTNGGEAEAPGDH

SEQ ID NO: 116295 - protein, 31 aa, Artificial Sequence
  Description of Artificial Sequence: Synthetic polypeptide
DEEEIASTNPVCTECWGSVSCNEPQSEGENQ

SEQ ID NO: 116296 - protein, 36 aa, Artificial Sequence
  Description of Artificial Sequence: Synthetic polypeptide
DEEEIRTTNPVATEQYGVVSTVNQQAGNQQGTDEED

SEQ ID NO: 116297 - protein, 30 aa, Artificial Sequence
  Description of Artificial Sequence: Synthetic polypeptide
DEEEIASTNPVCTEQWGDVSDILMNSAGNQ

SEQ ID NO: 116298 - protein, 32 aa, Artificial Sequence
  Description of Artificial Sequence: Synthetic polypeptide
DEEEIASTNPVCTEQYGSVSATDLEDHEGEDL

SEQ ID NO: 116299 - protein, 33 aa, Artificial Sequence
  Description of Artificial Sequence: Synthetic polypeptide
DEEEIASTNPVATEQYGSVSTTPAGPNSGMNPV

SEQ ID NO: 116300 - protein, 34 aa, Artificial Sequence
  Description of Artificial Sequence: Synthetic polypeptide
DEEEIATTNPVATEQYGSVCATNTQDQDSDNAEQ

SEQ ID NO: 116301 - protein, 31 aa, Artificial Sequence
  Description of Artificial Sequence: Synthetic polypeptide
DEEEIASVNPVCTEQYGSVSATDLEDHEGEQ

SEQ ID NO: 116302 - protein, 32 aa, Artificial Sequence
  Description of Artificial Sequence: Synthetic polypeptide
DEEEIASVNPVCTEQYGSVSSDPALQMSNGNQ

SEQ ID NO: 116303 - protein, 35 aa, Artificial Sequence
  Description of Artificial Sequence: Synthetic polypeptide
DEEEIATTNPVATEQYGSVCATNEEAGDPGENDRH

SEQ ID NO: 116304 - protein, 34 aa, Artificial Sequence
  Description of Artificial Sequence: Synthetic polypeptide
DEEEIATTNPVATEQYGSVCATNEEAGDGGENAM

SEQ ID NO: 116305 - protein, 34 aa, Artificial Sequence
  Description of Artificial Sequence: Synthetic polypeptide
DEEEIATTNPVATEQYGSVCATNEEADAGENNDD

SEQ ID NO: 116306 - protein, 33 aa, Artificial Sequence
  Description of Artificial Sequence: Synthetic polypeptide
DEEEIATTNPVATEQYGSVCATGPLPEDDENFP

SEQ ID NO: 116307 - protein, 32 aa, Artificial Sequence
  Description of Artificial Sequence: Synthetic polypeptide
DEEEIATTNPVATEQYGSVCATDPVTDDGGQM

SEQ ID NO: 116308 - protein, 32 aa, Artificial Sequence
  Description of Artificial Sequence: Synthetic polypeptide
DEEEIATTNPVATEQYGSVCATDPPTDDQGDI

SEQ ID NO: 116309 - protein, 32 aa, Artificial Sequence
  Description of Artificial Sequence: Synthetic polypeptide
DEEEIATTNPVATEQYGSVCATDPPTDDMNDD

SEQ ID NO: 116310 - protein, 34 aa, Artificial Sequence
  Description of Artificial Sequence: Synthetic polypeptide
DEEEIATTNPVATEQYGSVCATNLEAPDSMDGRE

SEQ ID NO: 116311 - protein, 33 aa, Artificial Sequence
  Description of Artificial Sequence: Synthetic polypeptide
DEEEIATTNPVATEQYGSVCATDPPTDDGNDDN

SEQ ID NO: 116312 - protein, 31 aa, Artificial Sequence
  Description of Artificial Sequence: Synthetic polypeptide
DEEEIATTNPCAYEQWGSVPTWDLDLRGTKE

SEQ ID NO: 116313 - protein, 37 aa, Artificial Sequence
  Description of Artificial Sequence: Synthetic polypeptide
DEEEIRTTNPVATEQYGVVSTVNQLQQGNQQSTTEDE

SEQ ID NO: 116314 - protein, 36 aa, Artificial Sequence
  Description of Artificial Sequence: Synthetic polypeptide
DEEEIRTTNPVATEQYGSVNSNTMNGTNEFGQNGGE

SEQ ID NO: 116315 - protein, 32 aa, Artificial Sequence
  Description of Artificial Sequence: Synthetic polypeptide
DEEEIATTNPCVTEQYGEVGSHNDLHSEQTNR

SEQ ID NO: 116316 - protein, 37 aa, Artificial Sequence
  Description of Artificial Sequence: Synthetic polypeptide
DEEEIRTTNPVATEQYGVVSTVNQLQAGNQQNTEEAE

SEQ ID NO: 116317 - protein, 36 aa, Artificial Sequence
  Description of Artificial Sequence: Synthetic polypeptide
DEEEIATTNPVATEQYGSVCAPTNQLQEAAAENMRQ

SEQ ID NO: 116318 - protein, 34 aa, Artificial Sequence
  Description of Artificial Sequence: Synthetic polypeptide
DEEEIRTTNPVATEQYGSVNSNGFGEQDGEGEIT

SEQ ID NO: 116319 - protein, 32 aa, Artificial Sequence
  Description of Artificial Sequence: Synthetic polypeptide
DEEEIATTNPVATEQYGSVCATDPPTDDGHDH

SEQ ID NO: 116320 - protein, 34 aa, Artificial Sequence
  Description of Artificial Sequence: Synthetic polypeptide
DEEEIATTNPCATEQYGSVSSTTAGPNRNGMNPV

SEQ ID NO: 116321 - protein, 34 aa, Artificial Sequence
  Description of Artificial Sequence: Synthetic polypeptide
DEEEIATTNPCATEQWGSVYCTDNMDQRMGGNHA

SEQ ID NO: 116322 - protein, 35 aa, Artificial Sequence
  Description of Artificial Sequence: Synthetic polypeptide
DEEEIATTNPVATEQYGSVCATNNPMQQGNQNQTM

SEQ ID NO: 116323 - protein, 36 aa, Artificial Sequence
  Description of Artificial Sequence: Synthetic polypeptide
DEEEIATTNPVATEQYGSVCATNPQLNPDDQMGQRE

SEQ ID NO: 116324 - protein, 35 aa, Artificial Sequence
  Description of Artificial Sequence: Synthetic polypeptide
DEEEIATTNPVATEQYGSVCATNPQLNPDDQMGQD

SEQ ID NO: 116325 - protein, 36 aa, Artificial Sequence
  Description of Artificial Sequence: Synthetic polypeptide
DEEEIATTNPVATEQYGSVCATNPQLNPDDQMGGNA

SEQ ID NO: 116326 - protein, 35 aa, Artificial Sequence
  Description of Artificial Sequence: Synthetic polypeptide
DEEEIATTNPVATEQYGSVCATNPQENPDDQGTRD

SEQ ID NO: 116327 - protein, 31 aa, Artificial Sequence
  Description of Artificial Sequence: Synthetic polypeptide
DEEEIASVNPVCTEQYGVVSSDPALQMSGNQ

SEQ ID NO: 116328 - protein, 35 aa, Artificial Sequence
  Description of Artificial Sequence: Synthetic polypeptide
DEEEIATTNPVATEQYGSVCATNPQDNPDDQGQNA

SEQ ID NO: 116329 - protein, 35 aa, Artificial Sequence
  Description of Artificial Sequence: Synthetic polypeptide
DEEEIATTNPVATEQYGSVCATNPMQQRNQMQGTD

SEQ ID NO: 116330 - protein, 35 aa, Artificial Sequence
  Description of Artificial Sequence: Synthetic polypeptide
DEEEIATTNPVATEQYGSVCATNPMQQGNQTQGDD

SEQ ID NO: 116331 - protein, 35 aa, Artificial Sequence
  Description of Artificial Sequence: Synthetic polypeptide
DEEEIATTNPVATEQYGSVCATNPMQQGNQTEGNN

SEQ ID NO: 116332 - protein, 37 aa, Artificial Sequence
  Description of Artificial Sequence: Synthetic polypeptide
DEEEIRTTNPVATEQYGVVSTVNQNLQQGNNDEDEDE

SEQ ID NO: 116333 - protein, 37 aa, Artificial Sequence
  Description of Artificial Sequence: Synthetic polypeptide
DEEEIRTTNPVATEQYGVVSTVNQNLQAGNNQEEEDE

SEQ ID NO: 116334 - protein, 36 aa, Artificial Sequence
  Description of Artificial Sequence: Synthetic polypeptide
DEEEIATTNPVATEQYGSVCATNPLPIEHQDGNVHQ

SEQ ID NO: 116335 - protein, 34 aa, Artificial Sequence
  Description of Artificial Sequence: Synthetic polypeptide
DEEEIATTNPCATECYGSVCYKTNDAQRQGGNQP

SEQ ID NO: 116336 - protein, 32 aa, Artificial Sequence
  Description of Artificial Sequence: Synthetic polypeptide
DEEEIATTNPCATEEWGSVATGNDHGGRGNEA

SEQ ID NO: 116337 - protein, 34 aa, Artificial Sequence
  Description of Artificial Sequence: Synthetic polypeptide
DEEEIATTNPVATEQYGSVCATNPEEAGDLDNAD

SEQ ID NO: 116338 - protein, 35 aa, Artificial Sequence
  Description of Artificial Sequence: Synthetic polypeptide
DEEEIRTTNPVATEQYGSVNSSNDDGQNDEGEDDP

SEQ ID NO: 116339 - protein, 32 aa, Artificial Sequence
  Description of Artificial Sequence: Synthetic polypeptide
DEEEIATTNPCATEPYGSCAATNLATAPGNMW

SEQ ID NO: 116340 - protein, 37 aa, Artificial Sequence
  Description of Artificial Sequence: Synthetic polypeptide
DEEEIRTTNPVATEQYGVVSTVNQQLLQQGTEQGNEE

SEQ ID NO: 116341 - protein, 34 aa, Artificial Sequence
  Description of Artificial Sequence: Synthetic polypeptide
DEEEIRTTNPVATEQYGSVNDFNEFDQEIGGGEF

SEQ ID NO: 116342 - protein, 34 aa, Artificial Sequence
  Description of Artificial Sequence: Synthetic polypeptide
DEEEIATTNPVATEQYGSVCSPTGTLVETMGQEA

SEQ ID NO: 116343 - protein, 36 aa, Artificial Sequence
  Description of Artificial Sequence: Synthetic polypeptide
DEEEIATTNPVATEQYGSVCSPTNHGPLDSEGNDGM

SEQ ID NO: 116344 - protein, 36 aa, Artificial Sequence
  Description of Artificial Sequence: Synthetic polypeptide
DEEEIRTTNPVATEQYGSVNSTTPEEPNMSNGMNPV

SEQ ID NO: 116345 - protein, 36 aa, Artificial Sequence
  Description of Artificial Sequence: Synthetic polypeptide
DEEEIRTTNPVATEQYGSVNSTTPDGPNMGNGNNEV

SEQ ID NO: 116346 - protein, 37 aa, Artificial Sequence
  Description of Artificial Sequence: Synthetic polypeptide
DEEEIRTTNPVATEQYGVVSTVNQQQLQQGNNNEEEE

SEQ ID NO: 116347 - protein, 36 aa, Artificial Sequence
  Description of Artificial Sequence: Synthetic polypeptide
DEEEIRTTNPVATEQYGSVNSTTPAMPNMRNGMNVY

SEQ ID NO: 116348 - protein, 36 aa, Artificial Sequence
  Description of Artificial Sequence: Synthetic polypeptide
DEEEIRTTNPVATEQYGSVNSTTPAIPNMRNGMNPV

SEQ ID NO: 116349 - protein, 36 aa, Artificial Sequence
  Description of Artificial Sequence: Synthetic polypeptide
DEEEIRTTNPVATEQYGSVNSTTPAGPNMRPGMNPV

SEQ ID NO: 116350 - protein, 36 aa, Artificial Sequence
  Description of Artificial Sequence: Synthetic polypeptide
DEEEIRTTNPVATEQYGSVCSTTPAGVNMRNGMNPV

SEQ ID NO: 116351 - protein, 35 aa, Artificial Sequence
  Description of Artificial Sequence: Synthetic polypeptide
DEEEIRTTNPVATEQYGVVSTVNQQQNQNEEETED

SEQ ID NO: 116352 - protein, 37 aa, Artificial Sequence
  Description of Artificial Sequence: Synthetic polypeptide
DEEEIRTTNPVATEQYGSVCSTTPAHNDERFGMNPVI

SEQ ID NO: 116353 - protein, 36 aa, Artificial Sequence
  Description of Artificial Sequence: Synthetic polypeptide
DEEEIRTTNPVATEQYGSVNSTTPAGPNMRNGMNPV

SEQ ID NO: 116354 - protein, 36 aa, Artificial Sequence
  Description of Artificial Sequence: Synthetic polypeptide
DEEEIRTTNPVATEQYGVVSTVNQQQGNQQSTEEED

SEQ ID NO: 116355 - protein, 36 aa, Artificial Sequence
  Description of Artificial Sequence: Synthetic polypeptide
DEEEIRTTNPVATEQYGSVCSTTPAHPIMRSGMNPV

SEQ ID NO: 116356 - protein, 36 aa, Artificial Sequence
  Description of Artificial Sequence: Synthetic polypeptide
DEEEIRTTNPVATEQYGVVSTVNQQQGNQQNTEETE

SEQ ID NO: 116357 - protein, 36 aa, Artificial Sequence
  Description of Artificial Sequence: Synthetic polypeptide
DEEEIRTTNPVATEQYGVVSTVNQQQGNQQNTEAGS

SEQ ID NO: 116358 - protein, 33 aa, Artificial Sequence
  Description of Artificial Sequence: Synthetic polypeptide
DEEEIACTNPVAYEQYGCVATNLQGTPGEDQRN

SEQ ID NO: 116359 - protein, 36 aa, Artificial Sequence
  Description of Artificial Sequence: Synthetic polypeptide
DEEEIRTTNPVATEQYGSVCSTTPDGPNMRNGMNPN

SEQ ID NO: 116360 - protein, 36 aa, Artificial Sequence
  Description of Artificial Sequence: Synthetic polypeptide
DEEEIRTTNPVATEQYGSVCSTTPAHNIERSGMDPV

SEQ ID NO: 116361 - protein, 35 aa, Artificial Sequence
  Description of Artificial Sequence: Synthetic polypeptide
DEEEIRTTNPVATEQYGSVNSTTNDSENSGQEEIS

SEQ ID NO: 116362 - protein, 36 aa, Artificial Sequence
  Description of Artificial Sequence: Synthetic polypeptide
DEEEIRTTNPVATEQYGSVCSTTPAGVNMFNGMNPV

SEQ ID NO: 116363 - protein, 32 aa, Artificial Sequence
  Description of Artificial Sequence: Synthetic polypeptide
DEEEIACTNPVAYEQWGSVATNLQGAPAEGKP

SEQ ID NO: 116364 - protein, 37 aa, Artificial Sequence
  Description of Artificial Sequence: Synthetic polypeptide
DEEEIRTTNPVATEQYGVVSTVNTNLQQGNNDEQEDT

SEQ ID NO: 116365 - protein, 37 aa, Artificial Sequence
  Description of Artificial Sequence: Synthetic polypeptide
DEEEIRTTNPVATEQYGVVSTVNTNLQAGNQEDTEDE

SEQ ID NO: 116366 - protein, 37 aa, Artificial Sequence
  Description of Artificial Sequence: Synthetic polypeptide
DEEEIRTTNPVATEQYGVVSTVNTNLQAGNNDEDEED

SEQ ID NO: 116367 - protein, 37 aa, Artificial Sequence
  Description of Artificial Sequence: Synthetic polypeptide
DEEEIRTTNPVATEQYGVVSTVNSTNLQAGTTTEQED

SEQ ID NO: 116368 - protein, 37 aa, Artificial Sequence
  Description of Artificial Sequence: Synthetic polypeptide
DEEEIRTTNPVATEQYGVVSTVNSTNLQAGTTEQGTE

SEQ ID NO: 116369 - protein, 36 aa, Artificial Sequence
  Description of Artificial Sequence: Synthetic polypeptide
DEEEIRTTNPVATEQYGSVCSTTPAGNTERMGSDPV

SEQ ID NO: 116370 - protein, 37 aa, Artificial Sequence
  Description of Artificial Sequence: Synthetic polypeptide
DEEEIRTTNPVATEQYGVVSTVNSNLQQGTNQEDEST

SEQ ID NO: 116371 - protein, 35 aa, Artificial Sequence
  Description of Artificial Sequence: Synthetic polypeptide
DEEEIRTTNPVATEQYGSVCSTTPAGVNFNGMNPV

SEQ ID NO: 116372 - protein, 36 aa, Artificial Sequence
  Description of Artificial Sequence: Synthetic polypeptide
DEEEIRTTNPVATEQYGVVSTVNQQSGNNNNEDEDD

SEQ ID NO: 116373 - protein, 35 aa, Artificial Sequence
  Description of Artificial Sequence: Synthetic polypeptide
DEEEIRTTNPVATEQYGVVSTVNQQQQQNNEEEED

SEQ ID NO: 116374 - protein, 36 aa, Artificial Sequence
  Description of Artificial Sequence: Synthetic polypeptide
DEEEIRTTNPVATEQYGSVCSTTPAGPNMRNGMNPD

SEQ ID NO: 116375 - protein, 36 aa, Artificial Sequence
  Description of Artificial Sequence: Synthetic polypeptide
DEEEIRTTNPVATEQYGSVCSTTPAGPNMRNGMNPV

SEQ ID NO: 116376 - protein, 35 aa, Artificial Sequence
  Description of Artificial Sequence: Synthetic polypeptide
DEEEIRTTNPVATEQYGSVNSVNDDELNSGQEEDS

SEQ ID NO: 116377 - protein, 35 aa, Artificial Sequence
  Description of Artificial Sequence: Synthetic polypeptide
DEEEIRTTNPVATEQYGSVNSVGNFTGQELEGQGG

SEQ ID NO: 116378 - protein, 36 aa, Artificial Sequence
  Description of Artificial Sequence: Synthetic polypeptide
DEEEIRTTNPVATEQYGSVCSTTPAGPNNRFGMNPQ

SEQ ID NO: 116379 - protein, 36 aa, Artificial Sequence
  Description of Artificial Sequence: Synthetic polypeptide
DEEEIRTTNPVATEQYGSVCSTTPAGPNTRNGMNNV

SEQ ID NO: 116380 - protein, 36 aa, Artificial Sequence
  Description of Artificial Sequence: Synthetic polypeptide
DEEEIRTTNPVATEQYGSVCSTTPAGPIMRMGSNPV

SEQ ID NO: 116381 - protein, 35 aa, Artificial Sequence
  Description of Artificial Sequence: Synthetic polypeptide
DEEEIRTTNPVATEQYGSVNSTTNDDSNSGQEEIS

SEQ ID NO: 116382 - protein, 33 aa, Artificial Sequence
  Description of Artificial Sequence: Synthetic polypeptide
DEEEIACTNPVAYEQYGSVAATNLQAAPDGSHN

SEQ ID NO: 116383 - protein, 35 aa, Artificial Sequence
  Description of Artificial Sequence: Synthetic polypeptide
DEEEIRTTNPVATEQYGSVCSTTPGPVNFNGMNPV

SEQ ID NO: 116384 - protein, 33 aa, Artificial Sequence
  Description of Artificial Sequence: Synthetic polypeptide
DEEEIACTNPVAYEQYGSVATNLADTGGGDQNG

SEQ ID NO: 116385 - protein, 33 aa, Artificial Sequence
  Description of Artificial Sequence: Synthetic polypeptide
DEEEIACTNPVAYEQYGSVATNLQGTPGEDQAL

SEQ ID NO: 116386 - protein, 36 aa, Artificial Sequence
  Description of Artificial Sequence: Synthetic polypeptide
DEEEIRTTNPVATEQYGVVSTVNQQQGNNDEETTNM

SEQ ID NO: 116387 - protein, 33 aa, Artificial Sequence
  Description of Artificial Sequence: Synthetic polypeptide
DEEEIACTNPVAYEQYGSVATNLQNGAPAEPKN

SEQ ID NO: 116388 - protein, 33 aa, Artificial Sequence
  Description of Artificial Sequence: Synthetic polypeptide
DEEEIACTNPVAYEQYGSVATNLQPAGEPGGDD

SEQ ID NO: 116389 - protein, 35 aa, Artificial Sequence
  Description of Artificial Sequence: Synthetic polypeptide
DEEEIRTTNPVATEQYGSVNSTNPDDEGSHEEEIS

SEQ ID NO: 116390 - protein, 36 aa, Artificial Sequence
  Description of Artificial Sequence: Synthetic polypeptide
DEEEIRTTNPVATEQYGVVSTVNQQQGNNAEEETED

SEQ ID NO: 116391 - protein, 32 aa, Artificial Sequence
  Description of Artificial Sequence: Synthetic polypeptide
DEEEIACTNPVAYEQYGSVATNGTEAEGGNPA

SEQ ID NO: 116392 - protein, 35 aa, Artificial Sequence
  Description of Artificial Sequence: Synthetic polypeptide
DEEEIRTTNPVATEQYGSVNSTNNDDHNSGQEEDS

SEQ ID NO: 116393 - protein, 34 aa, Artificial Sequence
  Description of Artificial Sequence: Synthetic polypeptide
DEEEIATTNPVATEQYGSVCSTNDDEAGMPMSEN

SEQ ID NO: 116394 - protein, 36 aa, Artificial Sequence
  Description of Artificial Sequence: Synthetic polypeptide
DEEEIATTNPVATEQYGSVCSTNAELQEHQDDNDAG

SEQ ID NO: 116395 - protein, 37 aa, Artificial Sequence
  Description of Artificial Sequence: Synthetic polypeptide
DEEEIRTTNPVATEQYGVVSTVNQQLQQGNNNNQEEE

SEQ ID NO: 116396 - protein, 31 aa, Artificial Sequence
  Description of Artificial Sequence: Synthetic polypeptide
DEEEIAPTNPCSSEQYGIVSTTALPNRGNPV

SEQ ID NO: 116397 - protein, 31 aa, Artificial Sequence
  Description of Artificial Sequence: Synthetic polypeptide
DEEEIAPTNPCSSEQYGIVSTTNLPQSGTPV

SEQ ID NO: 116398 - protein, 35 aa, Artificial Sequence
  Description of Artificial Sequence: Synthetic polypeptide
DEEEIATTNPVATEQYGSVCSPTNQGLPAEAENHN

SEQ ID NO: 116399 - protein, 36 aa, Artificial Sequence
  Description of Artificial Sequence: Synthetic polypeptide
DEEEIATTNPVATEQYGSVCSPTNNTLNTMIGEERI

SEQ ID NO: 116400 - protein, 36 aa, Artificial Sequence
  Description of Artificial Sequence: Synthetic polypeptide
DEEEIRTTNPVATEQYGVVSTVNQQNQQQGTNTTTD

SEQ ID NO: 116401 - protein, 35 aa, Artificial Sequence
  Description of Artificial Sequence: Synthetic polypeptide
DEEEIRTTNPVATEQYGSVCSVDNLHNIDMDMNDG

SEQ ID NO: 116402 - protein, 36 aa, Artificial Sequence
  Description of Artificial Sequence: Synthetic polypeptide
DEEEIRTTNPVATEQYGVVSTVNQQQGNNNQTDETE

SEQ ID NO: 116403 - protein, 36 aa, Artificial Sequence
  Description of Artificial Sequence: Synthetic polypeptide
DEEEIRTTNPVATEQYGVVSTVNQQQGNNQEEDTTG

SEQ ID NO: 116404 - protein, 35 aa, Artificial Sequence
  Description of Artificial Sequence: Synthetic polypeptide
DEEEIATTNPVATEQYGSVCSTNPVGAEAEMNGRF

SEQ ID NO: 116405 - protein, 36 aa, Artificial Sequence
  Description of Artificial Sequence: Synthetic polypeptide
DEEEIRTTNPVATEQYGVVSTVNQQQGNQQGNQEDD

SEQ ID NO: 116406 - protein, 34 aa, Artificial Sequence
  Description of Artificial Sequence: Synthetic polypeptide
DEEEIACTNPVAYEQYGSVASGNLQEAPGEIMNN

SEQ ID NO: 116407 - protein, 36 aa, Artificial Sequence
  Description of Artificial Sequence: Synthetic polypeptide
DEEEIRTTNPVATEQYGSVNSTSIDDIQRVSENAQA

SEQ ID NO: 116408 - protein, 37 aa, Artificial Sequence
  Description of Artificial Sequence: Synthetic polypeptide
DEEEIRTTNPVATEQYGSVCSTWPADNAERFGSNPVI

SEQ ID NO: 116409 - protein, 36 aa, Artificial Sequence
  Description of Artificial Sequence: Synthetic polypeptide
DEEEIRTTNPVATEQYGSVCSTWPADNNENSGSNPV

SEQ ID NO: 116410 - protein, 33 aa, Artificial Sequence
  Description of Artificial Sequence: Synthetic polypeptide
DEEEIACTNPVAYEQYGSVATAGTQTRNNEERF

SEQ ID NO: 116411 - protein, 36 aa, Artificial Sequence
  Description of Artificial Sequence: Synthetic polypeptide
DEEEIATTNPVATEQYGSVCSTNNQPQDAGEGNHDD

SEQ ID NO: 116412 - protein, 36 aa, Artificial Sequence
  Description of Artificial Sequence: Synthetic polypeptide
DEEEIRTTNPVATEQYGVVSTVNQQQGNQAGTDEQQ

SEQ ID NO: 116413 - protein, 35 aa, Artificial Sequence
  Description of Artificial Sequence: Synthetic polypeptide
DEEEIATTNPVATEQYGSVCSTNDQTEHQDGTAQK

SEQ ID NO: 116414 - protein, 33 aa, Artificial Sequence
  Description of Artificial Sequence: Synthetic polypeptide
DEEEIACTNPVAYEQYGSVATHLQDTPDGNDNN

SEQ ID NO: 116415 - protein, 35 aa, Artificial Sequence
  Description of Artificial Sequence: Synthetic polypeptide
DEEEIATTNPVATEQYGSVCSTNDQQEHQDGTAGQ

SEQ ID NO: 116416 - protein, 36 aa, Artificial Sequence
  Description of Artificial Sequence: Synthetic polypeptide
DEEEIRTTNPVATEQYGVVSTVNQQQGNNQQNTEDE

SEQ ID NO: 116417 - protein, 36 aa, Artificial Sequence
  Description of Artificial Sequence: Synthetic polypeptide
DEEEIRTTNPVATEQYGSYVSSTTPAGPNMRNGNPV

SEQ ID NO: 116418 - protein, 35 aa, Artificial Sequence
  Description of Artificial Sequence: Synthetic polypeptide
DEEEIRTTNPVATEQYGSVNSTSDFDQNGGEEPIS

SEQ ID NO: 116419 - protein, 35 aa, Artificial Sequence
  Description of Artificial Sequence: Synthetic polypeptide
DEEEIRTTNPVATEQYGSVNSTSDDQQYEMENIYI

SEQ ID NO: 116420 - protein, 32 aa, Artificial Sequence
  Description of Artificial Sequence: Synthetic polypeptide
DEEEIACTNPVAYEQYGSVATNGTAEGGNEIA

SEQ ID NO: 116421 - protein, 35 aa, Artificial Sequence
  Description of Artificial Sequence: Synthetic polypeptide
DEEEIATTNPVATEQYGSVCSPTNGHVPDDGGERN

SEQ ID NO: 116422 - protein, 34 aa, Artificial Sequence
  Description of Artificial Sequence: Synthetic polypeptide
DEEEIRTTNPVATEQYGSVNDDTMNQDGGMEDEG

SEQ ID NO: 116423 - protein, 35 aa, Artificial Sequence
  Description of Artificial Sequence: Synthetic polypeptide
DEEEIRTTNPVATEQYGSVNDDTDNATDQNGQGEQ

SEQ ID NO: 116424 - protein, 33 aa, Artificial Sequence
  Description of Artificial Sequence: Synthetic polypeptide
DEEEIATTNPVATEQYGSVCAAMNNDQDLPGEN

SEQ ID NO: 116425 - protein, 34 aa, Artificial Sequence
  Description of Artificial Sequence: Synthetic polypeptide
DEEEIATTNPVATEQWGNTTTSMTNHQGQGNGNR

SEQ ID NO: 116426 - protein, 34 aa, Artificial Sequence
  Description of Artificial Sequence: Synthetic polypeptide
DEEEIATTNPVATEQWGNTTTSTNELAGMPGNRE

SEQ ID NO: 116427 - protein, 34 aa, Artificial Sequence
  Description of Artificial Sequence: Synthetic polypeptide
DEEEIRTTNPVATEQYGSVIEPTLHDRNNNLVND

SEQ ID NO: 116428 - protein, 34 aa, Artificial Sequence
  Description of Artificial Sequence: Synthetic polypeptide
DEEEIATTNPVATEQWGNTTTSTNELTQGNGNDA

SEQ ID NO: 116429 - protein, 37 aa, Artificial Sequence
  Description of Artificial Sequence: Synthetic polypeptide
DEEEIRTTNPVATEQYGVVSTNLQAGNQAGNTAETEE

SEQ ID NO: 116430 - protein, 37 aa, Artificial Sequence
  Description of Artificial Sequence: Synthetic polypeptide
DEEEIRTTNPVATEQYGVVSTNLQAGNNQGNQDEEEQ

SEQ ID NO: 116431 - protein, 37 aa, Artificial Sequence
  Description of Artificial Sequence: Synthetic polypeptide
DEEEIRTTNPVATEQYGVVSTNLQAGNNNQQQNEEQA

SEQ ID NO: 116432 - protein, 34 aa, Artificial Sequence
  Description of Artificial Sequence: Synthetic polypeptide
DEEEIRTTNPVATEQYGSVITTNFDNLGGEEEHD

SEQ ID NO: 116433 - protein, 35 aa, Artificial Sequence
  Description of Artificial Sequence: Synthetic polypeptide
DEEEIRTTNPVATEQYGSVITTLALGAEGSNEDGQ

SEQ ID NO: 116434 - protein, 35 aa, Artificial Sequence
  Description of Artificial Sequence: Synthetic polypeptide
DEEEIRTTNPVATEQYGSVIEPTNNGQPRMTMLEM

SEQ ID NO: 116435 - protein, 36 aa, Artificial Sequence
  Description of Artificial Sequence: Synthetic polypeptide
DEEEIRTTNPVATEQYGSVIEPTNNGSQPRMQLENL

SEQ ID NO: 116436 - protein, 33 aa, Artificial Sequence
  Description of Artificial Sequence: Synthetic polypeptide
DEEEIRTTNPVATEQYGSVIEPWDEMERVNNEL

SEQ ID NO: 116437 - protein, 30 aa, Artificial Sequence
  Description of Artificial Sequence: Synthetic polypeptide
DEEEIATTNPVATEQYGEVPEVEQNHAEEK

SEQ ID NO: 116438 - protein, 30 aa, Artificial Sequence
  Description of Artificial Sequence: Synthetic polypeptide
DEEEIATTNPVATEQYGEVPEIVCQHEEEK

SEQ ID NO: 116439 - protein, 34 aa, Artificial Sequence
  Description of Artificial Sequence: Synthetic polypeptide
DEEEIRTTNPVATEQYGSVIETTILGTPIEEPNI

SEQ ID NO: 116440 - protein, 29 aa, Artificial Sequence
  Description of Artificial Sequence: Synthetic peptide
DEEEIATTNPVATEQYGEVPAEVCEHEEK

SEQ ID NO: 116441 - protein, 36 aa, Artificial Sequence
  Description of Artificial Sequence: Synthetic polypeptide
DEEEIRTTNPVATEQYGSVIEPTNLMHMRNNNIVND

SEQ ID NO: 116442 - protein, 31 aa, Artificial Sequence
  Description of Artificial Sequence: Synthetic polypeptide
DEEEIATTNPVATEQYGEVCPATVCVQHEEK

SEQ ID NO: 116443 - protein, 35 aa, Artificial Sequence
  Description of Artificial Sequence: Synthetic polypeptide
DEEEIRTTNPVATEQYGSVIEPAENLQPRLPLEGY

SEQ ID NO: 116444 - protein, 35 aa, Artificial Sequence
  Description of Artificial Sequence: Synthetic polypeptide
DEEEIRTTNPVATEQYGSVIENSALIQETLENEDL

SEQ ID NO: 116445 - protein, 35 aa, Artificial Sequence
  Description of Artificial Sequence: Synthetic polypeptide
DEEEIRTTNPVATEQYGSVIDTDNNMTGTGGNGGT

SEQ ID NO: 116446 - protein, 34 aa, Artificial Sequence
  Description of Artificial Sequence: Synthetic polypeptide
DEEEIATTNPVATEQWGHSNVSYTNVLQDDDPGF

SEQ ID NO: 116447 - protein, 37 aa, Artificial Sequence
  Description of Artificial Sequence: Synthetic polypeptide
DEEEIRTTNPVATEQYGVVSTNLQQLGNQAGNQEEDE

SEQ ID NO: 116448 - protein, 37 aa, Artificial Sequence
  Description of Artificial Sequence: Synthetic polypeptide
DEEEIRTTNPVATEQYGVVSTNLQQGNNQQSEEEEED

SEQ ID NO: 116449 - protein, 37 aa, Artificial Sequence
  Description of Artificial Sequence: Synthetic polypeptide
DEEEIRTTNPVATEQYGVVSTNLQQGNNQNQDEEEED

SEQ ID NO: 116450 - protein, 37 aa, Artificial Sequence
  Description of Artificial Sequence: Synthetic polypeptide
DEEEIRTTNPVATEQYGVVSTNLQQGNNNQQNEEEED

SEQ ID NO: 116451 - protein, 37 aa, Artificial Sequence
  Description of Artificial Sequence: Synthetic polypeptide
DEEEIRTTNPVATEQYGVVSTNLQQGNNNNEQGEEDT

SEQ ID NO: 116452 - protein, 33 aa, Artificial Sequence
  Description of Artificial Sequence: Synthetic polypeptide
DEAEIATTNPVATEQYGSVCAGNGLLTMGMGMR

SEQ ID NO: 116453 - protein, 37 aa, Artificial Sequence
  Description of Artificial Sequence: Synthetic polypeptide
DEEEIRTTNPVATEQYGVVSTNLQQGNNNDEQGTTED

SEQ ID NO: 116454 - protein, 34 aa, Artificial Sequence
  Description of Artificial Sequence: Synthetic polypeptide
DEEEIRTTNPVATEQYGSVIEESTLAETEFNVSS

SEQ ID NO: 116455 - protein, 37 aa, Artificial Sequence
  Description of Artificial Sequence: Synthetic polypeptide
DEEEIRTTNPVATEQYGVVSTNLQQGNEQGTTEQGEQ

SEQ ID NO: 116456 - protein, 37 aa, Artificial Sequence
  Description of Artificial Sequence: Synthetic polypeptide
DEEEIRTTNPVATEQYGVVSTNLQQAGNTEEGTTEDQ

SEQ ID NO: 116457 - protein, 35 aa, Artificial Sequence
  Description of Artificial Sequence: Synthetic polypeptide
DEEEIRTTNPVATEQYGSVIEFNMLPERQGEQDIL

SEQ ID NO: 116458 - protein, 37 aa, Artificial Sequence
  Description of Artificial Sequence: Synthetic polypeptide
DEEEIRTTNPVATEQYGVVSTNLQNGGNQAGNQEGEQ

SEQ ID NO: 116459 - protein, 33 aa, Artificial Sequence
  Description of Artificial Sequence: Synthetic polypeptide
DEEEIRTTNPVATEQYGSVIEISVLAPTENVDS

SEQ ID NO: 116460 - protein, 36 aa, Artificial Sequence
  Description of Artificial Sequence: Synthetic polypeptide
DEEEIRTTNPVATEQYGSVIELTNNLQVQIEENVET

SEQ ID NO: 116461 - protein, 37 aa, Artificial Sequence
  Description of Artificial Sequence: Synthetic polypeptide
DEEEIRTTNPVATEQYGVVSTNLQQGNNNDEQGTDTE

SEQ ID NO: 116462 - protein, 34 aa, Artificial Sequence
  Description of Artificial Sequence: Synthetic polypeptide
DEEEIRTTNPVATEQYGSVIDPVSGVQVRVGVEN

SEQ ID NO: 116463 - protein, 31 aa, Artificial Sequence
  Description of Artificial Sequence: Synthetic polypeptide
DEEEIATTNPVATEQYGEVCPATVCVQFEEK

SEQ ID NO: 116464 - protein, 36 aa, Artificial Sequence
  Description of Artificial Sequence: Synthetic polypeptide
DEEEIRTTNPVATEQYGSVIFESNLVIQQQGPLSNM

SEQ ID NO: 116465 - protein, 35 aa, Artificial Sequence
  Description of Artificial Sequence: Synthetic polypeptide
DEAEIATTNPVATEQYGSVCSPTGNNNDQTAAGNL

SEQ ID NO: 116466 - protein, 36 aa, Artificial Sequence
  Description of Artificial Sequence: Synthetic polypeptide
DEAEIATTNPVATEQYGSVCSPTNGLFPQREEEGDD

SEQ ID NO: 116467 - protein, 35 aa, Artificial Sequence
  Description of Artificial Sequence: Synthetic polypeptide
DEEEIRTTNPVATEQYGVVSTGNGGNLNIGEDGQE

SEQ ID NO: 116468 - protein, 34 aa, Artificial Sequence
  Description of Artificial Sequence: Synthetic polypeptide
DEEEIRTTNPVATEQYGVVSTGDGEGQGNENEEQ

SEQ ID NO: 116469 - protein, 34 aa, Artificial Sequence
  Description of Artificial Sequence: Synthetic polypeptide
DEEEIATTNPVATEQWGSVSGEGPPDNQGGNPRV

SEQ ID NO: 116470 - protein, 33 aa, Artificial Sequence
  Description of Artificial Sequence: Synthetic polypeptide
DEEEIATTNPVATEQWGSVSGQGPPQEADGSRN

SEQ ID NO: 116471 - protein, 34 aa, Artificial Sequence
  Description of Artificial Sequence: Synthetic polypeptide
DEAEIATTNPVATEQYGSVCSTPQQEHQDGNAMK

SEQ ID NO: 116472 - protein, 33 aa, Artificial Sequence
  Description of Artificial Sequence: Synthetic polypeptide
DEAEIATTNPVATEQYGSVCSPMNDGNTDSDNR

SEQ ID NO: 116473 - protein, 31 aa, Artificial Sequence
  Description of Artificial Sequence: Synthetic polypeptide
DEAEIATTNPVAYEQWGSVAGENGQNAGNSD

SEQ ID NO: 116474 - protein, 35 aa, Artificial Sequence
  Description of Artificial Sequence: Synthetic polypeptide
DEEEIRTTNPVATEQYGSVITLVGMNEEGGGNDGN

SEQ ID NO: 116475 - protein, 33 aa, Artificial Sequence
  Description of Artificial Sequence: Synthetic polypeptide
DEAEIATTNPVATEQYGSVCTIEQQAQGDNNHD

SEQ ID NO: 116476 - protein, 35 aa, Artificial Sequence
  Description of Artificial Sequence: Synthetic polypeptide
DEAEIATTNPVATEQYGSVCYMNDLQDRNDGNAET

SEQ ID NO: 116477 - protein, 35 aa, Artificial Sequence
  Description of Artificial Sequence: Synthetic polypeptide
DEAEIATTNPVATEQYGSVCYMNDLQDRNDGNNAT

SEQ ID NO: 116478 - protein, 34 aa, Artificial Sequence
  Description of Artificial Sequence: Synthetic polypeptide
DEEEIRTTNPVATEQYGSVITLVGMGNGEGQDGE

SEQ ID NO: 116479 - protein, 32 aa, Artificial Sequence
  Description of Artificial Sequence: Synthetic polypeptide
DEAEIATTNPVATEQYGSVSAAAIDEQDNGTE

SEQ ID NO: 116480 - protein, 35 aa, Artificial Sequence
  Description of Artificial Sequence: Synthetic polypeptide
DEAEIATTNPVATEQYGSVSAATNHMGETDDGNRM

SEQ ID NO: 116481 - protein, 34 aa, Artificial Sequence
  Description of Artificial Sequence: Synthetic polypeptide
DEEEIRTTNPVATEQYGSVITLVGMNGEGGGEDG

SEQ ID NO: 116482 - protein, 35 aa, Artificial Sequence
  Description of Artificial Sequence: Synthetic polypeptide
DEEEIRTTNPVATEQYGSVIEVSTVMQPEDHAADR

SEQ ID NO: 116483 - protein, 33 aa, Artificial Sequence
  Description of Artificial Sequence: Synthetic polypeptide
DEEEIRTTNPVATEQYGVVSTMDGTTGGGGEGE

SEQ ID NO: 116484 - protein, 35 aa, Artificial Sequence
  Description of Artificial Sequence: Synthetic polypeptide
DEAEIATTNPVATEQYGSVCSMTNDLPQHQDDNNN

SEQ ID NO: 116485 - protein, 31 aa, Artificial Sequence
  Description of Artificial Sequence: Synthetic polypeptide
DEEEIATTNPVATEQYGEVCPATGCVQFEEK

SEQ ID NO: 116486 - protein, 34 aa, Artificial Sequence
  Description of Artificial Sequence: Synthetic polypeptide
DEEEIRTTNPVATEQYGSVITNTGIQEPEFTEEE

SEQ ID NO: 116487 - protein, 35 aa, Artificial Sequence
  Description of Artificial Sequence: Synthetic polypeptide
DEEEIRTTNPVATEQYGSVIFSNLVIQQNTELSNM

SEQ ID NO: 116488 - protein, 32 aa, Artificial Sequence
  Description of Artificial Sequence: Synthetic polypeptide
DEEEIATTNPVATEQWGSVAMHGQDSDGNPTA

SEQ ID NO: 116489 - protein, 34 aa, Artificial Sequence
  Description of Artificial Sequence: Synthetic polypeptide
DEAEIATTNPVATEQYGSVCANANQLQAAENARQ

SEQ ID NO: 116490 - protein, 34 aa, Artificial Sequence
  Description of Artificial Sequence: Synthetic polypeptide
DEEEIATTNPVATEQWGSVSAEGPLGTHQGGNHG

SEQ ID NO: 116491 - protein, 34 aa, Artificial Sequence
  Description of Artificial Sequence: Synthetic polypeptide
DEAEIATTNPVATEQYGSVCAQNGLEQDDGGVRL

SEQ ID NO: 116492 - protein, 35 aa, Artificial Sequence
  Description of Artificial Sequence: Synthetic polypeptide
DEEEIRTTNPVATEQYGSVIGPTNNLSIRVEIEDE

SEQ ID NO: 116493 - protein, 35 aa, Artificial Sequence
  Description of Artificial Sequence: Synthetic polypeptide
DEEEIATTNPVATEQWGSVSATANGNQPDGIDNQM

SEQ ID NO: 116494 - protein, 33 aa, Artificial Sequence
  Description of Artificial Sequence: Synthetic polypeptide
DEAEIATTNPVATEQYGSVCATNLAPDSMDGRV

SEQ ID NO: 116495 - protein, 34 aa, Artificial Sequence
  Description of Artificial Sequence: Synthetic polypeptide
DEAEIATTNPVATEQYGSVCATNPMQQGNQTQGT

SEQ ID NO: 116496 - protein, 35 aa, Artificial Sequence
  Description of Artificial Sequence: Synthetic polypeptide
DEEEIRTTNPVATEQYGVVSTMNLLIGEEGEEGGD

SEQ ID NO: 116497 - protein, 35 aa, Artificial Sequence
  Description of Artificial Sequence: Synthetic polypeptide
DEEEIRTTNPVATEQYGSVIGPTNNLISRIEIEDY

SEQ ID NO: 116498 - protein, 33 aa, Artificial Sequence
  Description of Artificial Sequence: Synthetic polypeptide
DEAEIATTNPVATEQYGSVCSAPPQQEHAGENH

SEQ ID NO: 116499 - protein, 36 aa, Artificial Sequence
  Description of Artificial Sequence: Synthetic polypeptide
DEEEIRTTNPVATEQYGTVTSCGENELSQGTGGNQP

SEQ ID NO: 116500 - protein, 34 aa, Artificial Sequence
  Description of Artificial Sequence: Synthetic polypeptide
DEAEIATTNPVATEQYGSVCSDNANNSERDGNEH

SEQ ID NO: 116501 - protein, 35 aa, Artificial Sequence
  Description of Artificial Sequence: Synthetic polypeptide
DEAEIATTNPVATEQYGSVCATNGLADRPGDNSAM

SEQ ID NO: 116502 - protein, 34 aa, Artificial Sequence
  Description of Artificial Sequence: Synthetic polypeptide
DEEEIRTTNPVATEQYGSVIDPTTDANNIIPNEI

SEQ ID NO: 116503 - protein, 34 aa, Artificial Sequence
  Description of Artificial Sequence: Synthetic polypeptide
DEAEIATTNPVATEQYGSVCAAQNGDEQDRSINR

SEQ ID NO: 116504 - protein, 32 aa, Artificial Sequence
  Description of Artificial Sequence: Synthetic polypeptide
DEAEIATTNPVATEQYGSVCAAPLQDHGDQQY

SEQ ID NO: 116505 - protein, 34 aa, Artificial Sequence
  Description of Artificial Sequence: Synthetic polypeptide
DEEEIRTTNPVATEQYGSVLPTMTQINGEELSQL

SEQ ID NO: 116506 - protein, 33 aa, Artificial Sequence
  Description of Artificial Sequence: Synthetic polypeptide
DEEEIRTTNPVATEQYGSVLPTMNQINWELEVL

SEQ ID NO: 116507 - protein, 34 aa, Artificial Sequence
  Description of Artificial Sequence: Synthetic polypeptide
DEEEIRTTNPVATEQYGSVLPTMNQIHNGELSEL

SEQ ID NO: 116508 - protein, 34 aa, Artificial Sequence
  Description of Artificial Sequence: Synthetic polypeptide
DEEEIRTTNPVATEQYGSVLPTMNQGINGELVEL

SEQ ID NO: 116509 - protein, 34 aa, Artificial Sequence
  Description of Artificial Sequence: Synthetic polypeptide
DEAEIATTNPVATEQYGSVATNNDLDQTDGTTDD

SEQ ID NO: 116510 - protein, 34 aa, Artificial Sequence
  Description of Artificial Sequence: Synthetic polypeptide
DEEEIRTTNPVATEQYGSVHMNDGLEHDSDQNDE

SEQ ID NO: 116511 - protein, 34 aa, Artificial Sequence
  Description of Artificial Sequence: Synthetic polypeptide
DEEEIRTTNPVATEQYGSVHNNGLLAIQQEIEEG

SEQ ID NO: 116512 - protein, 36 aa, Artificial Sequence
  Description of Artificial Sequence: Synthetic polypeptide
DEEEIRTTNPVATEQYGSVLSATINGIQQTISVENE

SEQ ID NO: 116513 - protein, 34 aa, Artificial Sequence
  Description of Artificial Sequence: Synthetic polypeptide
DEEEIRTTNPVATEQYGVVSTQGDEGEGGGENNE

SEQ ID NO: 116514 - protein, 34 aa, Artificial Sequence
  Description of Artificial Sequence: Synthetic polypeptide
DEEEIRTTNPVATEQYGSVLIENENGLENGQQDM

SEQ ID NO: 116515 - protein, 36 aa, Artificial Sequence
  Description of Artificial Sequence: Synthetic polypeptide
DEEEIRTTNPVATEQYGSVKSTTPAGPNMRNGPNPV

SEQ ID NO: 116516 - protein, 36 aa, Artificial Sequence
  Description of Artificial Sequence: Synthetic polypeptide
DEEEIRTTNPVATEQYGSVKSTTPAGPNMRNGMNPV

SEQ ID NO: 116517 - protein, 36 aa, Artificial Sequence
  Description of Artificial Sequence: Synthetic polypeptide
DEEEIRTTNPVATEQYGSVHSENSLEGVQPLVPENQ

SEQ ID NO: 116518 - protein, 36 aa, Artificial Sequence
  Description of Artificial Sequence: Synthetic polypeptide
DEEEIRTTNPVATEQYGSVHSTTPAGPNMRNGMNPV

SEQ ID NO: 116519 - protein, 36 aa, Artificial Sequence
  Description of Artificial Sequence: Synthetic polypeptide
DEEEIRTTNPVATEQYGSVHSTTPAGPRMRNGMNPV

SEQ ID NO: 116520 - protein, 37 aa, Artificial Sequence
  Description of Artificial Sequence: Synthetic polypeptide
DEEEIRTTNPVATEQYGSVHTCENVSEQQRFNVEVRY

SEQ ID NO: 116521 - protein, 33 aa, Artificial Sequence
  Description of Artificial Sequence: Synthetic polypeptide
DEEEIRTTNPVATEQYGSVLPAENQINGELLVL

SEQ ID NO: 116522 - protein, 34 aa, Artificial Sequence
  Description of Artificial Sequence: Synthetic polypeptide
DEEEIRTTNPVATEQYGSVHTDDLTNPEETQNDD

SEQ ID NO: 116523 - protein, 33 aa, Artificial Sequence
  Description of Artificial Sequence: Synthetic polypeptide
DEEEIATTNPVATEQWGCVSGTNQGEHQGEGMS

SEQ ID NO: 116524 - protein, 33 aa, Artificial Sequence
  Description of Artificial Sequence: Synthetic polypeptide
DEEEIATTNPVATEQWGCVAMTNLNRDGMGDAH

SEQ ID NO: 116525 - protein, 36 aa, Artificial Sequence
  Description of Artificial Sequence: Synthetic polypeptide
DEEEIRTTNPVATEQYGVVSTTNNNNQQQGNNQQED

SEQ ID NO: 116526 - protein, 33 aa, Artificial Sequence
  Description of Artificial Sequence: Synthetic polypeptide
DEEEIRTTNPVATEQYGSVGVSFKENQIVEVVD

SEQ ID NO: 116527 - protein, 34 aa, Artificial Sequence
  Description of Artificial Sequence: Synthetic polypeptide
DEEEIRTTNPVATEQYGSVGVSFKENQSEQVVVV

SEQ ID NO: 116528 - protein, 33 aa, Artificial Sequence
  Description of Artificial Sequence: Synthetic polypeptide
DEEEIATTNPVATEQWGCVAGNGQLQNRMENGL

SEQ ID NO: 116529 - protein, 34 aa, Artificial Sequence
  Description of Artificial Sequence: Synthetic polypeptide
DEEEIRTTNPVATEQYGSVLSPVTLDQVEIEELL

SEQ ID NO: 116530 - protein, 34 aa, Artificial Sequence
  Description of Artificial Sequence: Synthetic polypeptide
DEEEIRTTNPVATEQYGSVLSPTTLDELHEIEEL

SEQ ID NO: 116531 - protein, 33 aa, Artificial Sequence
  Description of Artificial Sequence: Synthetic polypeptide
DEAEIATTNPVAYEQWGSVATTNNLQHDAGNAD

SEQ ID NO: 116532 - protein, 31 aa, Artificial Sequence
  Description of Artificial Sequence: Synthetic polypeptide
DEEEIATTNPVATEQWGCVATNGGEAVAGEF

SEQ ID NO: 116533 - protein, 37 aa, Artificial Sequence
  Description of Artificial Sequence: Synthetic polypeptide
DEEEIRTTNPVATEQYGVVSTTNLQQLQQGTEEGNTE

SEQ ID NO: 116534 - protein, 35 aa, Artificial Sequence
  Description of Artificial Sequence: Synthetic polypeptide
DEEEIRTTNPVATEQYGSVLSPTGTLDQVFVIEEL

SEQ ID NO: 116535 - protein, 37 aa, Artificial Sequence
  Description of Artificial Sequence: Synthetic polypeptide
DEEEIRTTNPVATEQYGVVSTTNLQQGNQQGTTENDE

SEQ ID NO: 116536 - protein, 37 aa, Artificial Sequence
  Description of Artificial Sequence: Synthetic polypeptide
DEEEIRTTNPVATEQYGVVSTTNLQQGNQQGNNDEED

SEQ ID NO: 116537 - protein, 37 aa, Artificial Sequence
  Description of Artificial Sequence: Synthetic polypeptide
DEEEIRTTNPVATEQYGVVSTTNLQQGNNNNQQGIDT

SEQ ID NO: 116538 - protein, 37 aa, Artificial Sequence
  Description of Artificial Sequence: Synthetic polypeptide
DEEEIRTTNPVATEQYGVVSTTNLQAGTEQGSTQNEE

SEQ ID NO: 116539 - protein, 37 aa, Artificial Sequence
  Description of Artificial Sequence: Synthetic polypeptide
DEEEIRTTNPVATEQYGVVSTTNLQAGNQQGTNEEND

SEQ ID NO: 116540 - protein, 34 aa, Artificial Sequence
  Description of Artificial Sequence: Synthetic polypeptide
DEEEIATTNPVATEQWGCVAMTNLNDRDGMNDDH

SEQ ID NO: 116541 - protein, 37 aa, Artificial Sequence
  Description of Artificial Sequence: Synthetic polypeptide
DEEEIRTTNPVATEQYGVVSTTNLQQGNTEQGTNQTD

SEQ ID NO: 116542 - protein, 36 aa, Artificial Sequence
  Description of Artificial Sequence: Synthetic polypeptide
DEEEIRTTNPVATEQYGVVSTNTNQQGNQAGTNNNM

SEQ ID NO: 116543 - protein, 36 aa, Artificial Sequence
  Description of Artificial Sequence: Synthetic polypeptide
DEEEIRTTNPVATEQYGSVIYTTLWLTAEGINEMRD

SEQ ID NO: 116544 - protein, 36 aa, Artificial Sequence
  Description of Artificial Sequence: Synthetic polypeptide
DEEEIRTTNPVATEQYGVVSTNTNNNNNQAGTNQTE

SEQ ID NO: 116545 - protein, 35 aa, Artificial Sequence
  Description of Artificial Sequence: Synthetic polypeptide
DEEEIRTTNPVATEQYGSVIYMTPNQTPRENVELG

SEQ ID NO: 116546 - protein, 34 aa, Artificial Sequence
  Description of Artificial Sequence: Synthetic polypeptide
DEEEIATTNPVATEQYGNVSSTTAGPNSRNGNPV

SEQ ID NO: 116547 - protein, 37 aa, Artificial Sequence
  Description of Artificial Sequence: Synthetic polypeptide
DEEEIRTTNPVATEQYGVVSTNLQSGNNNQEQNEQQD

SEQ ID NO: 116548 - protein, 35 aa, Artificial Sequence
  Description of Artificial Sequence: Synthetic polypeptide
DEEEIATTNPVATEQWGHSNVAATANGLQARPGEF

SEQ ID NO: 116549 - protein, 37 aa, Artificial Sequence
  Description of Artificial Sequence: Synthetic polypeptide
DEEEIRTTNPVATEQYGVVSTNLQSGNNNQEQGTEDE

SEQ ID NO: 116550 - protein, 33 aa, Artificial Sequence
  Description of Artificial Sequence: Synthetic polypeptide
DEEEIRTTNPVATEQYGSVIAVDLVHSGFQEEG

SEQ ID NO: 116551 - protein, 37 aa, Artificial Sequence
  Description of Artificial Sequence: Synthetic polypeptide
DEEEIRTTNPVATEQYGVVSTNLQSGNNNQEQDEETA

SEQ ID NO: 116552 - protein, 35 aa, Artificial Sequence
  Description of Artificial Sequence: Synthetic polypeptide
DEEEIRTTNPVATEQYGSVIYPTFNEIQHPENLQT

SEQ ID NO: 116553 - protein, 36 aa, Artificial Sequence
  Description of Artificial Sequence: Synthetic polypeptide
DEEEIATTNPVATEQWGHSNVLSYTDNPLQERPGEF

SEQ ID NO: 116554 - protein, 34 aa, Artificial Sequence
  Description of Artificial Sequence: Synthetic polypeptide
DEEEIRTTNPVATEQYGSVIDPENLQQNTVPVTL

SEQ ID NO: 116555 - protein, 37 aa, Artificial Sequence
  Description of Artificial Sequence: Synthetic polypeptide
DEEEIRTTNPVATEQYGVVSTNLQSGNNNNQQGEEQA

SEQ ID NO: 116556 - protein, 37 aa, Artificial Sequence
  Description of Artificial Sequence: Synthetic polypeptide
DEEEIRTTNPVATEQYGVVSTNLQSGNNNGEQGEEQE

SEQ ID NO: 116557 - protein, 37 aa, Artificial Sequence
  Description of Artificial Sequence: Synthetic polypeptide
DEEEIRTTNPVATEQYGVVSTNLQSGNNNGEQEEEEA

SEQ ID NO: 116558 - protein, 37 aa, Artificial Sequence
  Description of Artificial Sequence: Synthetic polypeptide
DEEEIRTTNPVATEQYGVVSTNLQSGNNNEQQNEETA

SEQ ID NO: 116559 - protein, 37 aa, Artificial Sequence
  Description of Artificial Sequence: Synthetic polypeptide
DEEEIRTTNPVATEQYGVVSTNLQSGNNNDEDEEETA

SEQ ID NO: 116560 - protein, 37 aa, Artificial Sequence
  Description of Artificial Sequence: Synthetic polypeptide
DEEEIRTTNPVATEQYGVVSTNLQSGNNNAEQNEEQA

SEQ ID NO: 116561 - protein, 37 aa, Artificial Sequence
  Description of Artificial Sequence: Synthetic polypeptide
DEEEIRTTNPVATEQYGVVSTNLQSGNNNQEEEEEQD

SEQ ID NO: 116562 - protein, 37 aa, Artificial Sequence
  Description of Artificial Sequence: Synthetic polypeptide
DEEEIRTTNPVATEQYGVVSTNLQSGNNNQNQDEEQD

SEQ ID NO: 116563 - protein, 37 aa, Artificial Sequence
  Description of Artificial Sequence: Synthetic polypeptide
DEEEIRTTNPVATEQYGVVSTNLQSGNNNQQQGEENQ

SEQ ID NO: 116564 - protein, 37 aa, Artificial Sequence
  Description of Artificial Sequence: Synthetic polypeptide
DEEEIRTTNPVATEQYGVVSTNLQSGNNNQQQNEEED

SEQ ID NO: 116565 - protein, 37 aa, Artificial Sequence
  Description of Artificial Sequence: Synthetic polypeptide
DEEEIRTTNPVATEQYGSVHTNEGVLEQQRVNVEVMI

SEQ ID NO: 116566 - protein, 37 aa, Artificial Sequence
  Description of Artificial Sequence: Synthetic polypeptide
DEEEIRTTNPVATEQYGSVHTNENNLEQNRVNVEVNY

SEQ ID NO: 116567 - protein, 37 aa, Artificial Sequence
  Description of Artificial Sequence: Synthetic polypeptide
DEEEIRTTNPVATEQYGVVSTNTNLQQGNNQEEQEED

SEQ ID NO: 116568 - protein, 36 aa, Artificial Sequence
  Description of Artificial Sequence: Synthetic polypeptide
DEEEIRTTNPVATEQYGSVIYTPNTQQVRENVEPNA

SEQ ID NO: 116569 - protein, 36 aa, Artificial Sequence
  Description of Artificial Sequence: Synthetic polypeptide
DEEEIRTTNPVATEQYGSVIYTPNTMQVRENVENGA

SEQ ID NO: 116570 - protein, 37 aa, Artificial Sequence
  Description of Artificial Sequence: Synthetic polypeptide
DEEEIRTTNPVATEQYGSVHTNENVLEQQAANVEVRY

SEQ ID NO: 116571 - protein, 36 aa, Artificial Sequence
  Description of Artificial Sequence: Synthetic polypeptide
DEEEIRTTNPVATEQYGVVSTNQQAGTEEGTTEEND

SEQ ID NO: 116572 - protein, 33 aa, Artificial Sequence
  Description of Artificial Sequence: Synthetic polypeptide
DEEEIATTNPVATEQYGSACAADLQNHDENGNH

SEQ ID NO: 116573 - protein, 34 aa, Artificial Sequence
  Description of Artificial Sequence: Synthetic polypeptide
DEEEIRTTNPVATEQYGSVHTTMLQEVQVLEELV

SEQ ID NO: 116574 - protein, 33 aa, Artificial Sequence
  Description of Artificial Sequence: Synthetic polypeptide
DEAEIATTNPVATEQYGSVCAAMNHGLTMMENR

SEQ ID NO: 116575 - protein, 36 aa, Artificial Sequence
  Description of Artificial Sequence: Synthetic polypeptide
DEEEIRTTNPVATEQYGSVIYPTWNGNEQSRTGELV

SEQ ID NO: 116576 - protein, 35 aa, Artificial Sequence
  Description of Artificial Sequence: Synthetic polypeptide
DEEEIRTTNPVATEQYGSVHVENSLEQIPIVPERQ

SEQ ID NO: 116577 - protein, 34 aa, Artificial Sequence
  Description of Artificial Sequence: Synthetic polypeptide
DEEEIRTTNPVATEQYGSVIYPTTLINEIFNHEQ

SEQ ID NO: 116578 - protein, 36 aa, Artificial Sequence
  Description of Artificial Sequence: Synthetic polypeptide
DEEEIRTTNPVATEQYGSVHVENSLETIQPGVPERD

SEQ ID NO: 116579 - protein, 36 aa, Artificial Sequence
  Description of Artificial Sequence: Synthetic polypeptide
DEEEIRTTNPVATEQYGVVSTNNNQQGNQQGTDEQQ

SEQ ID NO: 116580 - protein, 35 aa, Artificial Sequence
  Description of Artificial Sequence: Synthetic polypeptide
DEEEIRTTNPVATEQYGSVHYTIDPNPYVEVENRI

SEQ ID NO: 116581 - protein, 34 aa, Artificial Sequence
  Description of Artificial Sequence: Synthetic polypeptide
DEAEIATTNPVATEQYGSVCAANPLIEHDGNQRQ

SEQ ID NO: 116582 - protein, 36 aa, Artificial Sequence
  Description of Artificial Sequence: Synthetic polypeptide
DEEEIRTTNPVATEQYGVVSSTTPNGPQMSNGMNPQ

SEQ ID NO: 116583 - protein, 33 aa, Artificial Sequence
  Description of Artificial Sequence: Synthetic polypeptide
DEEEIATTNPVATEQWGSVSGQGPPQNTDGNPY

SEQ ID NO: 116584 - protein, 34 aa, Artificial Sequence
  Description of Artificial Sequence: Synthetic polypeptide
DEEEIATTNPVATEQWGSVSGSGNPDNRPEGANE

SEQ ID NO: 116585 - protein, 31 aa, Artificial Sequence
  Description of Artificial Sequence: Synthetic polypeptide
DEAEIATTNPVAYEQWGSTISKNLEDHQNGR

SEQ ID NO: 116586 - protein, 34 aa, Artificial Sequence
  Description of Artificial Sequence: Synthetic polypeptide
DEAEIATTNPVATESYGSVCSGNEDHQGDTGNAR

SEQ ID NO: 116587 - protein, 34 aa, Artificial Sequence
  Description of Artificial Sequence: Synthetic polypeptide
DEEEIRTTNPVATEQYGSVIQPTTLINEHINHEI

SEQ ID NO: 116588 - protein, 35 aa, Artificial Sequence
  Description of Artificial Sequence: Synthetic polypeptide
DEEEIATTNPVATEQWGSVSVSGNLENTRGVENEI

SEQ ID NO: 116589 - protein, 34 aa, Artificial Sequence
  Description of Artificial Sequence: Synthetic polypeptide
DEEEIRTTNPVATEQYGSVISCGVAVSQGTLGSD

SEQ ID NO: 116590 - protein, 35 aa, Artificial Sequence
  Description of Artificial Sequence: Synthetic polypeptide
DEEEIRTTNPVATEQYGSVISCVVPLNQPNSQISR

SEQ ID NO: 116591 - protein, 36 aa, Artificial Sequence
  Description of Artificial Sequence: Synthetic polypeptide
DEEEIRTTNPVATEQYGSVISDTDGGEQDEIGGNGG

SEQ ID NO: 116592 - protein, 35 aa, Artificial Sequence
  Description of Artificial Sequence: Synthetic polypeptide
DEEEIRTTNPVATEQYGSVISDTPNFNGEFEAGGN

SEQ ID NO: 116593 - protein, 35 aa, Artificial Sequence
  Description of Artificial Sequence: Synthetic polypeptide
DEEEIATTNPVATEQWGSVSTPNPQQDHQDGQDNH

SEQ ID NO: 116594 - protein, 29 aa, Artificial Sequence
  Description of Artificial Sequence: Synthetic peptide
DEEEIATTNPVATEQYGEAPEACQHNEEK

SEQ ID NO: 116595 - protein, 31 aa, Artificial Sequence
  Description of Artificial Sequence: Synthetic polypeptide
DEEEIATTNPVATEQWGTNCSAAEMRGSNDS

SEQ ID NO: 116596 - protein, 34 aa, Artificial Sequence
  Description of Artificial Sequence: Synthetic polypeptide
DEEEIRTTNPVATEQYGVVCSTGEHQNFNSNNQI

SEQ ID NO: 116597 - protein, 31 aa, Artificial Sequence
  Description of Artificial Sequence: Synthetic polypeptide
DEEEIATTNPVATEQWGTNCSAALLANGNEN

SEQ ID NO: 116598 - protein, 32 aa, Artificial Sequence
  Description of Artificial Sequence: Synthetic polypeptide
DEEEIATTNPVATEQWGTNCSAALLDRGPNDS

SEQ ID NO: 116599 - protein, 33 aa, Artificial Sequence
  Description of Artificial Sequence: Synthetic polypeptide
DEAEIATTNPVAYDQYGSTVNCTGQLQRTGGND

SEQ ID NO: 116600 - protein, 34 aa, Artificial Sequence
  Description of Artificial Sequence: Synthetic polypeptide
DEEEIRTTNPVATEQYGSVISGNNMDEGEGGGEG

SEQ ID NO: 116601 - protein, 32 aa, Artificial Sequence
  Description of Artificial Sequence: Synthetic polypeptide
DEEEIATTNPVATEQWGTSSTGAPLNARENEN

SEQ ID NO: 116602 - protein, 30 aa, Artificial Sequence
  Description of Artificial Sequence: Synthetic polypeptide
DEEEIATTNPVATEQYGEAPCVCQDREEEK

SEQ ID NO: 116603 - protein, 35 aa, Artificial Sequence
  Description of Artificial Sequence: Synthetic polypeptide
DEEEIRTTNPVATEQYGSVISGNNMDNGEGGNQTG

SEQ ID NO: 116604 - protein, 33 aa, Artificial Sequence
  Description of Artificial Sequence: Synthetic polypeptide
DEEEIATTNPVATEQWGSVSPPEPQENGDNSDA

SEQ ID NO: 116605 - protein, 34 aa, Artificial Sequence
  Description of Artificial Sequence: Synthetic polypeptide
DEEEIRTTNPVATEQYGVVDDTTNGQGGGETTGS

SEQ ID NO: 116606 - protein, 30 aa, Artificial Sequence
  Description of Artificial Sequence: Synthetic polypeptide
DEEEIATTNPVATEQYGEAPEVCQDREEEK

SEQ ID NO: 116607 - protein, 33 aa, Artificial Sequence
  Description of Artificial Sequence: Synthetic polypeptide
DEEEIRTTNPVATEQYGVVDTTGDTGEGGGENN

SEQ ID NO: 116608 - protein, 29 aa, Artificial Sequence
  Description of Artificial Sequence: Synthetic peptide
DEEEIATTNPVATEQYGEAPEVCNHGMEK

SEQ ID NO: 116609 - protein, 28 aa, Artificial Sequence
  Description of Artificial Sequence: Synthetic peptide
DEEEIATTNPVATEQYGEAPEVCAHEEK

SEQ ID NO: 116610 - protein, 35 aa, Artificial Sequence
  Description of Artificial Sequence: Synthetic polypeptide
DEEEIRTTNPVATEQYGSVISTVDYDNQETQNLEQ

SEQ ID NO: 116611 - protein, 35 aa, Artificial Sequence
  Description of Artificial Sequence: Synthetic polypeptide
DEEEIRTTNPVATEQYGVVDTDNGLEDQGENEEAE

SEQ ID NO: 116612 - protein, 30 aa, Artificial Sequence
  Description of Artificial Sequence: Synthetic polypeptide
DEEEIATTNPVATEQYGEAPEEVIQHNGEK

SEQ ID NO: 116613 - protein, 34 aa, Artificial Sequence
  Description of Artificial Sequence: Synthetic polypeptide
DEEEIRTTNPVATEQYGVVCSWGELQENFNSEQA

SEQ ID NO: 116614 - protein, 36 aa, Artificial Sequence
  Description of Artificial Sequence: Synthetic polypeptide
DEEEIRTTNPVATEQYGSVISTTPDGPNMGNGENGV

SEQ ID NO: 116615 - protein, 32 aa, Artificial Sequence
  Description of Artificial Sequence: Synthetic polypeptide
DEAEIATTNPVAYEQWGAVSTNLQGNAGPDAG

SEQ ID NO: 116616 - protein, 36 aa, Artificial Sequence
  Description of Artificial Sequence: Synthetic polypeptide
DEEEIRTTNPVATEQYGSVISTTPAGPNMRNGMNPV

SEQ ID NO: 116617 - protein, 35 aa, Artificial Sequence
  Description of Artificial Sequence: Synthetic polypeptide
DEEEIRTTNPVATEQYGSVISTSNMGNSEGGEFTD

SEQ ID NO: 116618 - protein, 32 aa, Artificial Sequence
  Description of Artificial Sequence: Synthetic polypeptide
DEAEIATTNPVAYEQWGAVSTNLNGNAGPDRH

SEQ ID NO: 116619 - protein, 35 aa, Artificial Sequence
  Description of Artificial Sequence: Synthetic polypeptide
DEEEIRTTNPVATEQYGVVDMETTNLVNNFGGNII

SEQ ID NO: 116620 - protein, 34 aa, Artificial Sequence
  Description of Artificial Sequence: Synthetic polypeptide
DEEEIRTTNPVATEQYGVVDGDTGTNGEGGGGNQ

SEQ ID NO: 116621 - protein, 35 aa, Artificial Sequence
  Description of Artificial Sequence: Synthetic polypeptide
DEEEIRTTNPVATEQYGVVDETNDNLVNEFGQNII

SEQ ID NO: 116622 - protein, 35 aa, Artificial Sequence
  Description of Artificial Sequence: Synthetic polypeptide
DEEEIRTTNPVATEQYGVVDSDMNENEQAEGNTIA

SEQ ID NO: 116623 - protein, 37 aa, Artificial Sequence
  Description of Artificial Sequence: Synthetic polypeptide
DEEEIRTTNPVATEQYGSVISGTGNDLNQDEGGGGEE

SEQ ID NO: 116624 - protein, 33 aa, Artificial Sequence
  Description of Artificial Sequence: Synthetic polypeptide
DEEEIATTNPVATEQYGCVYVWENGIQKTGNGE

SEQ ID NO: 116625 - protein, 35 aa, Artificial Sequence
  Description of Artificial Sequence: Synthetic polypeptide
DEEEIRTTNPVATEQYGSVISGTSNMSNSTGGGGT

SEQ ID NO: 116626 - protein, 35 aa, Artificial Sequence
  Description of Artificial Sequence: Synthetic polypeptide
DEEEIRTTNPVATEQYGSVISPDNNPQMILENLVS

SEQ ID NO: 116627 - protein, 34 aa, Artificial Sequence
  Description of Artificial Sequence: Synthetic polypeptide
DEEEIRTTNPVATEQYGSVISPYMNQPDDQNEED

SEQ ID NO: 116628 - protein, 32 aa, Artificial Sequence
  Description of Artificial Sequence: Synthetic polypeptide
DEEEIATTNPVATEQYGCVADTWHAQANSDNN

SEQ ID NO: 116629 - protein, 29 aa, Artificial Sequence
  Description of Artificial Sequence: Synthetic peptide
DEAEIATTNPVAYEPYGNIAATNLAAPNN

SEQ ID NO: 116630 - protein, 35 aa, Artificial Sequence
  Description of Artificial Sequence: Synthetic polypeptide
DEEEIRTTNPVATEQYGSVISPPILLQVIEDNQML

SEQ ID NO: 116631 - protein, 35 aa, Artificial Sequence
  Description of Artificial Sequence: Synthetic polypeptide
DEEEIRTTNPVATEQYGSVISPTTYQHGPQIVFEN

SEQ ID NO: 116632 - protein, 36 aa, Artificial Sequence
  Description of Artificial Sequence: Synthetic polypeptide
DEEEIRTTNPVATEQYGSVISPPNLGVIGNMVANLN

SEQ ID NO: 116633 - protein, 34 aa, Artificial Sequence
  Description of Artificial Sequence: Synthetic polypeptide
DEEEIRTTNPVATEQYGVMTGNDQGIQGGGTNGT

SEQ ID NO: 116634 - protein, 35 aa, Artificial Sequence
  Description of Artificial Sequence: Synthetic polypeptide
DEEEIRTTNPVATEQYGSVISPSMVLMQHDNVLEM

SEQ ID NO: 116635 - protein, 33 aa, Artificial Sequence
  Description of Artificial Sequence: Synthetic polypeptide
DEAEIATTNPVAYEGWGSVSTSNGAQQNDGNNR

SEQ ID NO: 116636 - protein, 35 aa, Artificial Sequence
  Description of Artificial Sequence: Synthetic polypeptide
DEEEIRTTNPVATEQYGSVISPTTNEIQSPEILQD

SEQ ID NO: 116637 - protein, 36 aa, Artificial Sequence
  Description of Artificial Sequence: Synthetic polypeptide
DEEEIRTTNPVATEQYGSVISPTNNTGIQAVAEQNM

SEQ ID NO: 116638 - protein, 34 aa, Artificial Sequence
  Description of Artificial Sequence: Synthetic polypeptide
DEEEIATTNPVATEQYGCVAGTGQLQNRMGGTLH

SEQ ID NO: 116639 - protein, 36 aa, Artificial Sequence
  Description of Artificial Sequence: Synthetic polypeptide
DEEEIRTTNPVATEQYGSVISPTFNDMIQSPENEQT

SEQ ID NO: 116640 - protein, 36 aa, Artificial Sequence
  Description of Artificial Sequence: Synthetic polypeptide
DEEEIRTTNPVATEQYGSVISPTILLQVLEDVNQTE

SEQ ID NO: 116641 - protein, 33 aa, Artificial Sequence
  Description of Artificial Sequence: Synthetic polypeptide
DEEEIATTNPVATEQYGCVAITNGLEATAGGEF

SEQ ID NO: 116642 - protein, 36 aa, Artificial Sequence
  Description of Artificial Sequence: Synthetic polypeptide
DEEEIRTTNPVATEQYGSVISPTTYLNVPQIVFENN

SEQ ID NO: 116643 - protein, 34 aa, Artificial Sequence
  Description of Artificial Sequence: Synthetic polypeptide
DEEEIRTTNPVATEQYGVMTGNDQGIQGGGGNTG

SEQ ID NO: 116644 - protein, 33 aa, Artificial Sequence
  Description of Artificial Sequence: Synthetic polypeptide
DEEEIATTNPVATEQYGCVAATNGAAEIGNGLD

SEQ ID NO: 116645 - protein, 34 aa, Artificial Sequence
  Description of Artificial Sequence: Synthetic polypeptide
DEEEIATTNPVATEQYGCVAATMDGANQADGNRN

SEQ ID NO: 116646 - protein, 32 aa, Artificial Sequence
  Description of Artificial Sequence: Synthetic polypeptide
DEEEIATTNPVATEQYGCNANNEPLQAPMENN

SEQ ID NO: 116647 - protein, 33 aa, Artificial Sequence
  Description of Artificial Sequence: Synthetic polypeptide
DEEEIATTNPVATEQYGCVSGGLNGEAQGEGMS

SEQ ID NO: 116648 - protein, 33 aa, Artificial Sequence
  Description of Artificial Sequence: Synthetic polypeptide
DEEEIATTNPVATEQYGCTAGNEPLEATRDGDR

SEQ ID NO: 116649 - protein, 34 aa, Artificial Sequence
  Description of Artificial Sequence: Synthetic polypeptide
DEEEIRTTNPVATEQYGVVCSTEHNQNFNSENQI

SEQ ID NO: 116650 - protein, 36 aa, Artificial Sequence
  Description of Artificial Sequence: Synthetic polypeptide
DEEEIRTTNPVATEQYGSVISLTPNMGEERNENQQY

SEQ ID NO: 116651 - protein, 35 aa, Artificial Sequence
  Description of Artificial Sequence: Synthetic polypeptide
DEEEIRTTNPVATEQYGSVISTMNSDNGEGGEFDD

SEQ ID NO: 116652 - protein, 35 aa, Artificial Sequence
  Description of Artificial Sequence: Synthetic polypeptide
DEEEIATTNPVATEQYGCVCSVSGNLNQNFNSNQS

SEQ ID NO: 116653 - protein, 35 aa, Artificial Sequence
  Description of Artificial Sequence: Synthetic polypeptide
DEEEIRTTNPVATEQYGSVISTMNNSDNGEGGEFT

SEQ ID NO: 116654 - protein, 33 aa, Artificial Sequence
  Description of Artificial Sequence: Synthetic polypeptide
DEEEIATTNPVATEQYGCVCSTEHQNFGSDTQL

SEQ ID NO: 116655 - protein, 36 aa, Artificial Sequence
  Description of Artificial Sequence: Synthetic polypeptide
DEEEIRTTNPVATEQYGSVISNSGNNGQGEFGNQGE

SEQ ID NO: 116656 - protein, 34 aa, Artificial Sequence
  Description of Artificial Sequence: Synthetic polypeptide
DEEEIRTTNPVATEQYGSVISNSVNMEVNRFQQD

SEQ ID NO: 116657 - protein, 33 aa, Artificial Sequence
  Description of Artificial Sequence: Synthetic polypeptide
DEEEIRTTNPVATEQYGVISGTDNGGDEDGGEG

SEQ ID NO: 116658 - protein, 36 aa, Artificial Sequence
  Description of Artificial Sequence: Synthetic polypeptide
DEEEIRTTNPVATEQYGSVISNTDNMNIQGEGAGQE

SEQ ID NO: 116659 - protein, 35 aa, Artificial Sequence
  Description of Artificial Sequence: Synthetic polypeptide
DEEEIRTTNPVATEQYGSVISTDNVGFGEFGQITI

SEQ ID NO: 116660 - protein, 34 aa, Artificial Sequence
  Description of Artificial Sequence: Synthetic polypeptide
DEEEIATTNPVATEQYGCVAATANLQDDPGVDTA

SEQ ID NO: 116661 - protein, 35 aa, Artificial Sequence
  Description of Artificial Sequence: Synthetic polypeptide
DEEEIRTTNPVATEQYGSVISPALWLQPRLELEGL

SEQ ID NO: 116662 - protein, 34 aa, Artificial Sequence
  Description of Artificial Sequence: Synthetic polypeptide
DEEEIATTNPVATEQYGCVAATHNDQTAGENDEN

SEQ ID NO: 116663 - protein, 34 aa, Artificial Sequence
  Description of Artificial Sequence: Synthetic polypeptide
DEEEIRTTNPVATEQYGVVDTTNFGQGGGETTDG

SEQ ID NO: 116664 - protein, 33 aa, Artificial Sequence
  Description of Artificial Sequence: Synthetic polypeptide
DEEEIATTNPVATEQWGCVADTWLAQNDSGNHA

SEQ ID NO: 116665 - protein, 34 aa, Artificial Sequence
  Description of Artificial Sequence: Synthetic polypeptide
DEEEIRTTNPVATEQYGSVIPPTMNQINGELSVL

SEQ ID NO: 116666 - protein, 34 aa, Artificial Sequence
  Description of Artificial Sequence: Synthetic polypeptide
DEEEIRTTNPVATEQYGVVFGDENIQGEDGGNGD

SEQ ID NO: 116667 - protein, 35 aa, Artificial Sequence
  Description of Artificial Sequence: Synthetic polypeptide
DEEEIRTTNPVATEQYGTVTVTTNNNLLQNTEENN

SEQ ID NO: 116668 - protein, 36 aa, Artificial Sequence
  Description of Artificial Sequence: Synthetic polypeptide
DEEEIRTTNPVATEQYGTVTVVTNNNLQQGEETNTD

SEQ ID NO: 116669 - protein, 36 aa, Artificial Sequence
  Description of Artificial Sequence: Synthetic polypeptide
DEEEIRTTNPVATEQYGTVTVVTNNNLQQGESEENN

SEQ ID NO: 116670 - protein, 33 aa, Artificial Sequence
  Description of Artificial Sequence: Synthetic polypeptide
DEAEIATTNPVATEQYGSVSVTDLEDHEGEDLG

SEQ ID NO: 116671 - protein, 33 aa, Artificial Sequence
  Description of Artificial Sequence: Synthetic polypeptide
DEAEIATTNPVATEQYGSVSYTDLEEHEGEDLS

SEQ ID NO: 116672 - protein, 35 aa, Artificial Sequence
  Description of Artificial Sequence: Synthetic polypeptide
DEAEIATTNPVATEQYGSVTAATANLQPRDMNPQN

SEQ ID NO: 116673 - protein, 36 aa, Artificial Sequence
  Description of Artificial Sequence: Synthetic polypeptide
DEEEIRTTNPVATEQYGTVTVVTTNNNLQQGEVENN

SEQ ID NO: 116674 - protein, 33 aa, Artificial Sequence
  Description of Artificial Sequence: Synthetic polypeptide
DEAEIATTNPVATEQYGSVSMTELNEDHEGEDL

SEQ ID NO: 116675 - protein, 34 aa, Artificial Sequence
  Description of Artificial Sequence: Synthetic polypeptide
DEAEIATTNPVATEQYGSVVAAAANLPQEADGND

SEQ ID NO: 116676 - protein, 33 aa, Artificial Sequence
  Description of Artificial Sequence: Synthetic polypeptide
DEEEIATTNPVATEQWGSVSGTGPPQEAVDMRN

SEQ ID NO: 116677 - protein, 34 aa, Artificial Sequence
  Description of Artificial Sequence: Synthetic polypeptide
DEEEIRTTNPVATEQYGSVIHTIVAENEMQMVEG

SEQ ID NO: 116678 - protein, 33 aa, Artificial Sequence
  Description of Artificial Sequence: Synthetic polypeptide
DEAEIATTNPVATEQYGSVVATNLAPDTNNPED

SEQ ID NO: 116679 - protein, 37 aa, Artificial Sequence
  Description of Artificial Sequence: Synthetic polypeptide
DEEEIRTTNPVATEQYGSVIHTNENLEQSPSNVEVRY

SEQ ID NO: 116680 - protein, 34 aa, Artificial Sequence
  Description of Artificial Sequence: Synthetic polypeptide
DEAEIATTNPVATEQYGSVVSGAAGLGQEDTGNL

SEQ ID NO: 116681 - protein, 35 aa, Artificial Sequence
  Description of Artificial Sequence: Synthetic polypeptide
DEAEIATTNPVATEQYGSVVSGEANLGQEDTGNDL

SEQ ID NO: 116682 - protein, 31 aa, Artificial Sequence
  Description of Artificial Sequence: Synthetic polypeptide
DEEEIATTNPVATEQYGEISEEVCQQQHGEK

SEQ ID NO: 116683 - protein, 36 aa, Artificial Sequence
  Description of Artificial Sequence: Synthetic polypeptide
DEEEIRTTNPVATEQYGTVTVVVTNNNLQQGEETNN

SEQ ID NO: 116684 - protein, 31 aa, Artificial Sequence
  Description of Artificial Sequence: Synthetic polypeptide
DEEEIATTNPVATEQYGEASTDCQDHEEEDL

SEQ ID NO: 116685 - protein, 33 aa, Artificial Sequence
  Description of Artificial Sequence: Synthetic polypeptide
DEAEIATTNPVATEQYGSVSMTDLEDHFGEDLS

SEQ ID NO: 116686 - protein, 34 aa, Artificial Sequence
  Description of Artificial Sequence: Synthetic polypeptide
DEAEIATTNPVATEQYGSVSGGNNDDRQTGNDDA

SEQ ID NO: 116687 - protein, 31 aa, Artificial Sequence
  Description of Artificial Sequence: Synthetic polypeptide
DEAEIATTNPVAYEQWGSTISKNLEDHNNGR

SEQ ID NO: 116688 - protein, 36 aa, Artificial Sequence
  Description of Artificial Sequence: Synthetic polypeptide
DEEEIRTTNPVATEQYGVVSSTTNAGPNMRNGMNPV

SEQ ID NO: 116689 - protein, 31 aa, Artificial Sequence
  Description of Artificial Sequence: Synthetic polypeptide
DEAEIATTNPVAYEQWGSISKNLEDRQNTSE

SEQ ID NO: 116690 - protein, 31 aa, Artificial Sequence
  Description of Artificial Sequence: Synthetic polypeptide
DEAEIATTNPVAYEQWGSISKNLEDRQEQMR

SEQ ID NO: 116691 - protein, 34 aa, Artificial Sequence
  Description of Artificial Sequence: Synthetic polypeptide
DEEEIATTNPVATEQWGSVSGTGNPPDAAAGENG

SEQ ID NO: 116692 - protein, 33 aa, Artificial Sequence
  Description of Artificial Sequence: Synthetic polypeptide
DEAEIATTNPVAYEQWGQSVAQNDLDQTRGITR

SEQ ID NO: 116693 - protein, 34 aa, Artificial Sequence
  Description of Artificial Sequence: Synthetic polypeptide
DEEEIRTTNPVATEQYGSVIGPWVSLSQIGMVEQ

SEQ ID NO: 116694 - protein, 32 aa, Artificial Sequence
  Description of Artificial Sequence: Synthetic polypeptide
DEEEIRTTNPVATEQYGVVSNGFGEFTGEGEF

SEQ ID NO: 116695 - protein, 33 aa, Artificial Sequence
  Description of Artificial Sequence: Synthetic polypeptide
DEAEIATTNPVATEQYGSVSATDLEDHEGWEDL

SEQ ID NO: 116696 - protein, 35 aa, Artificial Sequence
  Description of Artificial Sequence: Synthetic polypeptide
DEEEIRTTNPVATEQYGVVSSTDNGPNMSNGMNPV

SEQ ID NO: 116697 - protein, 35 aa, Artificial Sequence
  Description of Artificial Sequence: Synthetic polypeptide
DEEEIRTTNPVATEQYGVVSSTDAGPNMSNGMNPV

SEQ ID NO: 116698 - protein, 34 aa, Artificial Sequence
  Description of Artificial Sequence: Synthetic polypeptide
DEEEIRTTNPVATEQYGVVSSSPAGPNMRNGMNV

SEQ ID NO: 116699 - protein, 31 aa, Artificial Sequence
  Description of Artificial Sequence: Synthetic polypeptide
DEEEIATTNPVATEQYGEISEEVIQQQHGEK

SEQ ID NO: 116700 - protein, 33 aa, Artificial Sequence
  Description of Artificial Sequence: Synthetic polypeptide
DEAEIATTNPVATEQYGSVSDTGDLEDHEGEDL

SEQ ID NO: 116701 - protein, 34 aa, Artificial Sequence
  Description of Artificial Sequence: Synthetic polypeptide
DEAEIATTNPVATEQYGSVSGGNMGNQGNGNGGD

SEQ ID NO: 116702 - protein, 34 aa, Artificial Sequence
  Description of Artificial Sequence: Synthetic polypeptide
DEAEIATTNPVATEQYGSVSGGNNDDRQDSGNDM

SEQ ID NO: 116703 - protein, 32 aa, Artificial Sequence
  Description of Artificial Sequence: Synthetic polypeptide
DEAEIATTNPVATEQYGSVSATDLTDHETEDL

SEQ ID NO: 116704 - protein, 31 aa, Artificial Sequence
  Description of Artificial Sequence: Synthetic polypeptide
DEEEIATTNPVATEQYGEASTDCQDHEEEDK

SEQ ID NO: 116705 - protein, 34 aa, Artificial Sequence
  Description of Artificial Sequence: Synthetic polypeptide
DEEEIRTTNPVATEQYGSVILALMLEQERVPSQD

SEQ ID NO: 116706 - protein, 36 aa, Artificial Sequence
  Description of Artificial Sequence: Synthetic polypeptide
DEEEIRTTNPVATEQYGTVVSCTNALSVIEGGNLEG

SEQ ID NO: 116707 - protein, 30 aa, Artificial Sequence
  Description of Artificial Sequence: Synthetic polypeptide
DEAEIATTNPVAYEQWGETYTNLQLGEDDS

SEQ ID NO: 116708 - protein, 32 aa, Artificial Sequence
  Description of Artificial Sequence: Synthetic polypeptide
DEAEIATTNPVATEQYGSVWATDLHDHEGEDL

SEQ ID NO: 116709 - protein, 30 aa, Artificial Sequence
  Description of Artificial Sequence: Synthetic polypeptide
DEEEIATTNPVATEQYGEAPTVCNMRNEEK

SEQ ID NO: 116710 - protein, 34 aa, Artificial Sequence
  Description of Artificial Sequence: Synthetic polypeptide
DEEEIRTTNPVATEQYGSVINPLSQQENPIVNNG

SEQ ID NO: 116711 - protein, 36 aa, Artificial Sequence
  Description of Artificial Sequence: Synthetic polypeptide
DEEEIRTTNPVATEQYGSVINSDEMNLQGTIGGQGN

SEQ ID NO: 116712 - protein, 28 aa, Artificial Sequence
  Description of Artificial Sequence: Synthetic peptide
DEEEIATTNPVATEQYGEAPEVWAHEEK

SEQ ID NO: 116713 - protein, 34 aa, Artificial Sequence
  Description of Artificial Sequence: Synthetic polypeptide
DEEEIRTTNPVATEQYGVVGSGNDGQGEQGGETQ

SEQ ID NO: 116714 - protein, 35 aa, Artificial Sequence
  Description of Artificial Sequence: Synthetic polypeptide
DEEEIRTTNPVATEQYGSVINIVNDLMQTIDENFQ

SEQ ID NO: 116715 - protein, 34 aa, Artificial Sequence
  Description of Artificial Sequence: Synthetic polypeptide
DEEEIATTNPVATEQWGSVSMSGNGEQPAGVNML

SEQ ID NO: 116716 - protein, 34 aa, Artificial Sequence
  Description of Artificial Sequence: Synthetic polypeptide
DEEEIRTTNPVATEQYGVVGGMGDNNLQEEGMEF

SEQ ID NO: 116717 - protein, 30 aa, Artificial Sequence
  Description of Artificial Sequence: Synthetic polypeptide
DEEEIATTNPVATEQYGEAPEVCQMRNEEK

SEQ ID NO: 116718 - protein, 30 aa, Artificial Sequence
  Description of Artificial Sequence: Synthetic polypeptide
DEEEIATTNPVATEQYGEAPEVCQMHNEEK

SEQ ID NO: 116719 - protein, 34 aa, Artificial Sequence
  Description of Artificial Sequence: Synthetic polypeptide
DEEEIRTTNPVATEQYGSVIPGTLEIFKPENERF

SEQ ID NO: 116720 - protein, 29 aa, Artificial Sequence
  Description of Artificial Sequence: Synthetic peptide
DEEEIATTNPVATEQYGEAPEVCQHEIEK

SEQ ID NO: 116721 - protein, 32 aa, Artificial Sequence
  Description of Artificial Sequence: Synthetic polypeptide
DEEEIATTNPVATEQWGSVSMSGNGGDHGPQF

SEQ ID NO: 116722 - protein, 29 aa, Artificial Sequence
  Description of Artificial Sequence: Synthetic peptide
DEEEIATTNPVATEQYGEAPEVCQHEEEK

SEQ ID NO: 116723 - protein, 34 aa, Artificial Sequence
  Description of Artificial Sequence: Synthetic polypeptide
DEEEIRTTNPVATEQYGVVGGMGDNNQGEGNEFT

SEQ ID NO: 116724 - protein, 35 aa, Artificial Sequence
  Description of Artificial Sequence: Synthetic polypeptide
DEEEIRTTNPVATEQYGSVINDTGDDENQEGEGNQ

SEQ ID NO: 116725 - protein, 29 aa, Artificial Sequence
  Description of Artificial Sequence: Synthetic peptide
DEEEIATTNPVATEQYGEASEICMHAEDK

SEQ ID NO: 116726 - protein, 31 aa, Artificial Sequence
  Description of Artificial Sequence: Synthetic polypeptide
DEEEIATTNPVATEQYGEASEIVCQREEEEK

SEQ ID NO: 116727 - protein, 35 aa, Artificial Sequence
  Description of Artificial Sequence: Synthetic polypeptide
DEEEIRTTNPVATEQYGSVILANDGEQERQDNPDE

SEQ ID NO: 116728 - protein, 36 aa, Artificial Sequence
  Description of Artificial Sequence: Synthetic polypeptide
DEEEIRTTNPVATEQYGTVVSCTNNSLSVIGGNLEG

SEQ ID NO: 116729 - protein, 34 aa, Artificial Sequence
  Description of Artificial Sequence: Synthetic polypeptide
DEEEIRTTNPVATEQYGTVVSDNMGMGGEGNQTP

SEQ ID NO: 116730 - protein, 33 aa, Artificial Sequence
  Description of Artificial Sequence: Synthetic polypeptide
DEEEIRTTNPVATEQYGVVMGTDQTTEGQGNEG

SEQ ID NO: 116731 - protein, 31 aa, Artificial Sequence
  Description of Artificial Sequence: Synthetic polypeptide
DEEEIATTNPVATEQYGEASSTVCNMRNEEK

SEQ ID NO: 116732 - protein, 33 aa, Artificial Sequence
  Description of Artificial Sequence: Synthetic polypeptide
DEEEIATTNPVATEQYGEASSTPVGNMRNGMNV

SEQ ID NO: 116733 - protein, 34 aa, Artificial Sequence
  Description of Artificial Sequence: Synthetic polypeptide
DEEEIATTNPVATEQWGSVSGTGVPQNNGENNQD

SEQ ID NO: 116734 - protein, 30 aa, Artificial Sequence
  Description of Artificial Sequence: Synthetic polypeptide
DEEEIATTNPVATEQYGEASSEVCNHGMEK

SEQ ID NO: 116735 - protein, 32 aa, Artificial Sequence
  Description of Artificial Sequence: Synthetic polypeptide
DEEEIATTNPVATEQYGEASSEPAGPQRNGEK

SEQ ID NO: 116736 - protein, 31 aa, Artificial Sequence
  Description of Artificial Sequence: Synthetic polypeptide
DEEEIATTNPVATEQYGEASPTVCNMRNEEK

SEQ ID NO: 116737 - protein, 35 aa, Artificial Sequence
  Description of Artificial Sequence: Synthetic polypeptide
DEEEIRTTNPVATEQYGSVILTNMLDYVAQEVEFE

SEQ ID NO: 116738 - protein, 35 aa, Artificial Sequence
  Description of Artificial Sequence: Synthetic polypeptide
DEEEIRTTNPVATEQYGTVWETIDPGQGREGNGND

SEQ ID NO: 116739 - protein, 33 aa, Artificial Sequence
  Description of Artificial Sequence: Synthetic polypeptide
DEEEIATTNPVATEQYGEASPTPAGPNRNGMNV

SEQ ID NO: 116740 - protein, 33 aa, Artificial Sequence
  Description of Artificial Sequence: Synthetic polypeptide
DEEEIATTNPVATEQWGSVSGTNPDNHQGAEAP

SEQ ID NO: 116741 - protein, 35 aa, Artificial Sequence
  Description of Artificial Sequence: Synthetic polypeptide
DEEEIRTTNPVATEQYGSVILTNMLVEVAQEVEFE

SEQ ID NO: 116742 - protein, 30 aa, Artificial Sequence
  Description of Artificial Sequence: Synthetic polypeptide
DEEEIATTNPVATEQYGEASEVCQHEMEPV

SEQ ID NO: 116743 - protein, 35 aa, Artificial Sequence
  Description of Artificial Sequence: Synthetic polypeptide
DEEEIRTTNPVATEQYGSVILTPNMLAVAQEVEFE

SEQ ID NO: 116744 - protein, 34 aa, Artificial Sequence
  Description of Artificial Sequence: Synthetic polypeptide
DEEEIATTNPVATEQWGSVSMSGNGGQHGDPQFR

SEQ ID NO: 116745 - protein, 35 aa, Artificial Sequence
  Description of Artificial Sequence: Synthetic polypeptide
DEAEICTTNPVATECYGSVSTGNGLLQNDVGQNEN

SEQ ID NO: 116746 - protein, 34 aa, Artificial Sequence
  Description of Artificial Sequence: Synthetic polypeptide
DEEEIATTNPVATEQYGSACAATGEANDNQGNRM

SEQ ID NO: 116747 - protein, 36 aa, Artificial Sequence
  Description of Artificial Sequence: Synthetic polypeptide
DEEEIRTTNPVATEQYGSVGTTNFEQQERPEVNEDF

SEQ ID NO: 116748 - protein, 34 aa, Artificial Sequence
  Description of Artificial Sequence: Synthetic polypeptide
DEEEIATTNPVATEQYGSVCAAAINLDEAGGNVN

SEQ ID NO: 116749 - protein, 35 aa, Artificial Sequence
  Description of Artificial Sequence: Synthetic polypeptide
DEEEIRTTNPVATEQYGSVMGTNNNMDEGGENTIQ

SEQ ID NO: 116750 - protein, 36 aa, Artificial Sequence
  Description of Artificial Sequence: Synthetic polypeptide
DEEEIRTTNPVATEQYGSVFSTTPAGPNMRNGMNPV

SEQ ID NO: 116751 - protein, 36 aa, Artificial Sequence
  Description of Artificial Sequence: Synthetic polypeptide
DEEEIRTTNPVATEQYGSVFSTTPAGPNMRNGMNVV

SEQ ID NO: 116752 - protein, 36 aa, Artificial Sequence
  Description of Artificial Sequence: Synthetic polypeptide
DEEEIRTTNPVATEQYGSVFSTTPAMPNMRNGMNPV

SEQ ID NO: 116753 - protein, 36 aa, Artificial Sequence
  Description of Artificial Sequence: Synthetic polypeptide
DEEEIRTTNPVATEQYGSVFSTTPAVPNMRNGMNPV

SEQ ID NO: 116754 - protein, 36 aa, Artificial Sequence
  Description of Artificial Sequence: Synthetic polypeptide
DEEEIRTTNPVATEQYGSVFSTTPSGPNPENGMNDK

SEQ ID NO: 116755 - protein, 35 aa, Artificial Sequence
  Description of Artificial Sequence: Synthetic polypeptide
DEEEIRTTNPVATEQYGSVMGTPNNIVQTEFTGEQ

SEQ ID NO: 116756 - protein, 36 aa, Artificial Sequence
  Description of Artificial Sequence: Synthetic polypeptide
DEEEIRTTNPVATEQYGSVFSTTYAGPNMRNGMNPV

SEQ ID NO: 116757 - protein, 36 aa, Artificial Sequence
  Description of Artificial Sequence: Synthetic polypeptide
DEEEIRTTNPVATEQYGSVMGTNNIDTQENGGNQTI

SEQ ID NO: 116758 - protein, 36 aa, Artificial Sequence
  Description of Artificial Sequence: Synthetic polypeptide
DEEEIRTTNPVATEQYGSVMGTNMNLGGGGQENDDE

SEQ ID NO: 116759 - protein, 35 aa, Artificial Sequence
  Description of Artificial Sequence: Synthetic polypeptide
DEEEIRTTNPVATEQYGSVFSVTPNVQTQMVQEAD

SEQ ID NO: 116760 - protein, 36 aa, Artificial Sequence
  Description of Artificial Sequence: Synthetic polypeptide
DEEEIRTTNPVATEQYGSVMGTMNTQDQGENGGGQG

SEQ ID NO: 116761 - protein, 34 aa, Artificial Sequence
  Description of Artificial Sequence: Synthetic polypeptide
DEEEIRTTNPVATEQYGSVFTAEQDMQNETQNDN

SEQ ID NO: 116762 - protein, 35 aa, Artificial Sequence
  Description of Artificial Sequence: Synthetic polypeptide
DEEEIRTTNPVATEQYGSVMGTLNAFTQGGGGEGT

SEQ ID NO: 116763 - protein, 34 aa, Artificial Sequence
  Description of Artificial Sequence: Synthetic polypeptide
DEEEIRTTNPVATEQYGSVMGTLNAFTGGGGEGG

SEQ ID NO: 116764 - protein, 35 aa, Artificial Sequence
  Description of Artificial Sequence: Synthetic polypeptide
DEEEIRTTNPVATEQYGSVMGTNNMTQQEEGFGET

SEQ ID NO: 116765 - protein, 35 aa, Artificial Sequence
  Description of Artificial Sequence: Synthetic polypeptide
DEEEIRTTNPVATEQYGSVFTDMNQNIGQGNNEGN

SEQ ID NO: 116766 - protein, 36 aa, Artificial Sequence
  Description of Artificial Sequence: Synthetic polypeptide
DEEEIRTTNPVATEQYGSVFSSTPAGPNMRNGMNPV

SEQ ID NO: 116767 - protein, 33 aa, Artificial Sequence
  Description of Artificial Sequence: Synthetic polypeptide
DEEEIATTNPVATEQYGSVCAAANGLNMEGGEH

SEQ ID NO: 116768 - protein, 35 aa, Artificial Sequence
  Description of Artificial Sequence: Synthetic polypeptide
DEEEIRTTNPVATEQYGSVFGSTDDEGGNETTDGE

SEQ ID NO: 116769 - protein, 35 aa, Artificial Sequence
  Description of Artificial Sequence: Synthetic polypeptide
DEEEIRTTNPVATEQYGSVMGVTANDQEEGGEFTE

SEQ ID NO: 116770 - protein, 34 aa, Artificial Sequence
  Description of Artificial Sequence: Synthetic polypeptide
DEEEIRTTNPVATEQYGSVMGVGNGTAQELNNGG

SEQ ID NO: 116771 - protein, 35 aa, Artificial Sequence
  Description of Artificial Sequence: Synthetic polypeptide
DEEEIRTTNPVATEQYGSVMGTVNMNQITEGQGGA

SEQ ID NO: 116772 - protein, 36 aa, Artificial Sequence
  Description of Artificial Sequence: Synthetic polypeptide
DEEEIRTTNPVATEQYGSVMGTVNIGEQDQGGNEQQ

SEQ ID NO: 116773 - protein, 34 aa, Artificial Sequence
  Description of Artificial Sequence: Synthetic polypeptide
DEEEIRTTNPVATEQYGSVMGTVMVEGGQGEGGQ

SEQ ID NO: 116774 - protein, 35 aa, Artificial Sequence
  Description of Artificial Sequence: Synthetic polypeptide
DEEEIATTNPVATEQYGSVCAADNGLADSDGNDRH

SEQ ID NO: 116775 - protein, 36 aa, Artificial Sequence
  Description of Artificial Sequence: Synthetic polypeptide
DEEEIRTTNPVATEQYGSVFSPVTTLQQPPQVGECW

SEQ ID NO: 116776 - protein, 35 aa, Artificial Sequence
  Description of Artificial Sequence: Synthetic polypeptide
DEEEIRTTNPVATEQYGSVMGTVAGNDGQTTNDDT

SEQ ID NO: 116777 - protein, 35 aa, Artificial Sequence
  Description of Artificial Sequence: Synthetic polypeptide
DEEEIRTTNPVATEQYGSVMGTTVGQENGGGNQGQ

SEQ ID NO: 116778 - protein, 37 aa, Artificial Sequence
  Description of Artificial Sequence: Synthetic polypeptide
DEEEIRTTNPVATEQYGVVSTTVNLQQGNQQGNQTDD

SEQ ID NO: 116779 - protein, 35 aa, Artificial Sequence
  Description of Artificial Sequence: Synthetic polypeptide
DEEEIRTTNPVATEQYGSVMGTQNVEMNNNGNGQG

SEQ ID NO: 116780 - protein, 34 aa, Artificial Sequence
  Description of Artificial Sequence: Synthetic polypeptide
DEEEIATTNPVATEQYGSVCAAANGLNMEGGNHK

SEQ ID NO: 116781 - protein, 33 aa, Artificial Sequence
  Description of Artificial Sequence: Synthetic polypeptide
DEEEIRTTNPVATEQYGSVFPTLTIQPQEAELD

SEQ ID NO: 116782 - protein, 35 aa, Artificial Sequence
  Description of Artificial Sequence: Synthetic polypeptide
DEEEIRTTNPVATEQYGSVMGTQNDQGGGEDDEGG

SEQ ID NO: 116783 - protein, 34 aa, Artificial Sequence
  Description of Artificial Sequence: Synthetic polypeptide
DEEEIRTTNPVATEQYGSVMGTQNAMTEEGGGEE

SEQ ID NO: 116784 - protein, 34 aa, Artificial Sequence
  Description of Artificial Sequence: Synthetic polypeptide
DEEEIRTTNPVATEQYGSVFMYENDMQNETQNDN

SEQ ID NO: 116785 - protein, 34 aa, Artificial Sequence
  Description of Artificial Sequence: Synthetic polypeptide
DEEEIRTTNPVATEQYGSVMGVTDIDQEQGGEGQ

SEQ ID NO: 116786 - protein, 35 aa, Artificial Sequence
  Description of Artificial Sequence: Synthetic polypeptide
DEEEIRTTNPVATEQYGSVMGTINMGSNGQGEGGQ

SEQ ID NO: 116787 - protein, 35 aa, Artificial Sequence
  Description of Artificial Sequence: Synthetic polypeptide
DEEEIRTTNPVATEQYGSVFTTNMMWQESGEEEVE

SEQ ID NO: 116788 - protein, 34 aa, Artificial Sequence
  Description of Artificial Sequence: Synthetic polypeptide
DEEEIRTTNPVATEQYGSVGDFGNNGQENDDGGG

SEQ ID NO: 116789 - protein, 34 aa, Artificial Sequence
  Description of Artificial Sequence: Synthetic polypeptide
DEEEIRTTNPVATEQYGSVGDFGQGNDDEAGNAG

SEQ ID NO: 116790 - protein, 33 aa, Artificial Sequence
  Description of Artificial Sequence: Synthetic polypeptide
DEEEIRTTNPVATEQYGSVGDFGQGNDDEIGAG

SEQ ID NO: 116791 - protein, 33 aa, Artificial Sequence
  Description of Artificial Sequence: Synthetic polypeptide
DEAEIATTNPVAYEQWGSVSTNLNQGAMGGDTH

SEQ ID NO: 116792 - protein, 33 aa, Artificial Sequence
  Description of Artificial Sequence: Synthetic polypeptide
DEEEIRTTNPVATEQYGSVGDFGQGNQDEGGTG

SEQ ID NO: 116793 - protein, 35 aa, Artificial Sequence
  Description of Artificial Sequence: Synthetic polypeptide
DEEEIRTTNPVATEQYGSVGDNNDGQNETGGDNGE

SEQ ID NO: 116794 - protein, 31 aa, Artificial Sequence
  Description of Artificial Sequence: Synthetic polypeptide
DEAEIATTNPVAYEQWGSVSPDGQNAGNSDD

SEQ ID NO: 116795 - protein, 35 aa, Artificial Sequence
  Description of Artificial Sequence: Synthetic polypeptide
DEEEIRTTNPVATEQYGSVGDFGNEDGQENDDGND

SEQ ID NO: 116796 - protein, 33 aa, Artificial Sequence
  Description of Artificial Sequence: Synthetic polypeptide
DEEEIRTTNPVATEQYGSVGDVGQANDGEGGDG

SEQ ID NO: 116797 - protein, 33 aa, Artificial Sequence
  Description of Artificial Sequence: Synthetic polypeptide
DEAEIATTNPVAYEQWGSVSNPNLQQGGMNGGH

SEQ ID NO: 116798 - protein, 36 aa, Artificial Sequence
  Description of Artificial Sequence: Synthetic polypeptide
DEEEIRTTNPVATEQYGSVMGQTNVGQEEGGGNQDD

SEQ ID NO: 116799 - protein, 32 aa, Artificial Sequence
  Description of Artificial Sequence: Synthetic polypeptide
DEAEIATTNPVAYEQWGSVSNNDRQGGMNGGH

SEQ ID NO: 116800 - protein, 34 aa, Artificial Sequence
  Description of Artificial Sequence: Synthetic polypeptide
DEEEIRTTNPVATEQYGSVGEPLENLQLIQEIQI

SEQ ID NO: 116801 - protein, 35 aa, Artificial Sequence
  Description of Artificial Sequence: Synthetic polypeptide
DEEEIRTTNPVATEQYGSVGETNVGMIEVVNTNQR

SEQ ID NO: 116802 - protein, 33 aa, Artificial Sequence
  Description of Artificial Sequence: Synthetic polypeptide
DEAEIATTNPVAYEQWGSVSKMNDLQQQRTGEK

SEQ ID NO: 116803 - protein, 35 aa, Artificial Sequence
  Description of Artificial Sequence: Synthetic polypeptide
DEEEIRTTNPVATEQYGSVMGQSNQNMDEGGEGNI

SEQ ID NO: 116804 - protein, 36 aa, Artificial Sequence
  Description of Artificial Sequence: Synthetic polypeptide
DEEEIRTTNPVATEQYGSVMGQTVNNLDIFGDNEFG

SEQ ID NO: 116805 - protein, 35 aa, Artificial Sequence
  Description of Artificial Sequence: Synthetic polypeptide
DEEEIRTTNPVATEQYGTVSTMTNGFEGGGENDGT

SEQ ID NO: 116806 - protein, 35 aa, Artificial Sequence
  Description of Artificial Sequence: Synthetic polypeptide
DEEEIRTTNPVATEQYGSVGDFGNDGQTNDDGNEG

SEQ ID NO: 116807 - protein, 35 aa, Artificial Sequence
  Description of Artificial Sequence: Synthetic polypeptide
DEEEIRTTNPVATEQYGSVGDDTTGNDGQGEGGQG

SEQ ID NO: 116808 - protein, 35 aa, Artificial Sequence
  Description of Artificial Sequence: Synthetic polypeptide
DEEEIRTTNPVATEQYGSVFVWINGEQERKKNDNH

SEQ ID NO: 116809 - protein, 35 aa, Artificial Sequence
  Description of Artificial Sequence: Synthetic polypeptide
DEEEIRTTNPVATEQYGSVFVWINGEQERKTNDDD

SEQ ID NO: 116810 - protein, 35 aa, Artificial Sequence
  Description of Artificial Sequence: Synthetic polypeptide
DEEEIRTTNPVATEQYGSVFVWINGQDRKNGGGDS

SEQ ID NO: 116811 - protein, 35 aa, Artificial Sequence
  Description of Artificial Sequence: Synthetic polypeptide
DEEEIRTTNPVATEQYGSVFVWINQEQDRQMNGSA

SEQ ID NO: 116812 - protein, 37 aa, Artificial Sequence
  Description of Artificial Sequence: Synthetic polypeptide
DEEEIRTTNPVATEQYGVVSTTVNGNLQQGTNEEDED

SEQ ID NO: 116813 - protein, 34 aa, Artificial Sequence
  Description of Artificial Sequence: Synthetic polypeptide
DEEEIRTTNPVATEQYGSVGCNTPLLEQQLVTEH

SEQ ID NO: 116814 - protein, 34 aa, Artificial Sequence
  Description of Artificial Sequence: Synthetic polypeptide
DEEEIRTTNPVATEQYGSVGCPTPELEQMLVTEH

SEQ ID NO: 116815 - protein, 33 aa, Artificial Sequence
  Description of Artificial Sequence: Synthetic polypeptide
DEAEIATTNPVAYEQWGSVVSTNNILGEDGGNS

SEQ ID NO: 116816 - protein, 35 aa, Artificial Sequence
  Description of Artificial Sequence: Synthetic polypeptide
DEEEIRTTNPVATEQYGSVMGTGQNGQNIGGEDVE

SEQ ID NO: 116817 - protein, 34 aa, Artificial Sequence
  Description of Artificial Sequence: Synthetic polypeptide
DEEEIRTTNPVATEQYGSVGCPTPLLEQQLVDEY

SEQ ID NO: 116818 - protein, 35 aa, Artificial Sequence
  Description of Artificial Sequence: Synthetic polypeptide
DEEEIRTTNPVATEQYGSVMGTEMGSNGQGEGGTL

SEQ ID NO: 116819 - protein, 36 aa, Artificial Sequence
  Description of Artificial Sequence: Synthetic polypeptide
DEEEIRTTNPVATEQYGSVMGTDNMEQNIGGGFNET

SEQ ID NO: 116820 - protein, 34 aa, Artificial Sequence
  Description of Artificial Sequence: Synthetic polypeptide
DEEEIRTTNPVATEQYGSVGCPTSLLETQLVTEH

SEQ ID NO: 116821 - protein, 34 aa, Artificial Sequence
  Description of Artificial Sequence: Synthetic polypeptide
DEEEIRTTNPVATEQYGSVMGTDEMQTGEGGEDG

SEQ ID NO: 116822 - protein, 34 aa, Artificial Sequence
  Description of Artificial Sequence: Synthetic polypeptide
DEEEIRTTNPVATEQYGSVGDDGQGNDGEQGGQS

SEQ ID NO: 116823 - protein, 33 aa, Artificial Sequence
  Description of Artificial Sequence: Synthetic polypeptide
DEEEIRTTNPVATEQYGSVGDDGQGNDTEGGQG

SEQ ID NO: 116824 - protein, 35 aa, Artificial Sequence
  Description of Artificial Sequence: Synthetic polypeptide
DEEEIRTTNPVATEQYGSVMGTGMGSNGQEEGGQA

SEQ ID NO: 116825 - protein, 35 aa, Artificial Sequence
  Description of Artificial Sequence: Synthetic polypeptide
DEEEIRTTNPVATEQYGSVMGVTDNQDQEQGEQGI

SEQ ID NO: 116826 - protein, 34 aa, Artificial Sequence
  Description of Artificial Sequence: Synthetic polypeptide
DEEEIRTTNPVATEQYGSVFGSSDDEGGNTETNI

SEQ ID NO: 116827 - protein, 32 aa, Artificial Sequence
  Description of Artificial Sequence: Synthetic polypeptide
DEEEIRTTNPVATEQYGSVMNGFIGGGFGDTD

SEQ ID NO: 116828 - protein, 35 aa, Artificial Sequence
  Description of Artificial Sequence: Synthetic polypeptide
DEEEIATTNPVATEQYGSVCAAMHLQAMEPGNDRH

SEQ ID NO: 116829 - protein, 35 aa, Artificial Sequence
  Description of Artificial Sequence: Synthetic polypeptide
DEEEIRTTNPVATEQYGSVMTGIEIQNNGQGEGGT

SEQ ID NO: 116830 - protein, 34 aa, Artificial Sequence
  Description of Artificial Sequence: Synthetic polypeptide
DEEEIRTTNPVATEQYGSVMTGDFNGGEEGGEST

SEQ ID NO: 116831 - protein, 36 aa, Artificial Sequence
  Description of Artificial Sequence: Synthetic polypeptide
DEEEIRTTNPVATEQYGSVMSTTPDGPNMGNGDNIV

SEQ ID NO: 116832 - protein, 36 aa, Artificial Sequence
  Description of Artificial Sequence: Synthetic polypeptide
DEEEIRTTNPVATEQYGSVMSTTPAGPNMRNGMNPV

SEQ ID NO: 116833 - protein, 36 aa, Artificial Sequence
  Description of Artificial Sequence: Synthetic polypeptide
DEEEIRTTNPVATEQYGSVMSTTPAGPNMRNGMNIV

SEQ ID NO: 116834 - protein, 36 aa, Artificial Sequence
  Description of Artificial Sequence: Synthetic polypeptide
DEEEIRTTNPVATEQYGSVMSTTPAGPNMNNGMNPV

SEQ ID NO: 116835 - protein, 34 aa, Artificial Sequence
  Description of Artificial Sequence: Synthetic polypeptide
DEEEIATTNPVATEQYGSVCAAMHLQAMPDNDRQ

SEQ ID NO: 116836 - protein, 34 aa, Artificial Sequence
  Description of Artificial Sequence: Synthetic polypeptide
DEEEIATTNPVATEQYGSVCAAMANDQSPDGSRH

SEQ ID NO: 116837 - protein, 35 aa, Artificial Sequence
  Description of Artificial Sequence: Synthetic polypeptide
DEEEIRTTNPVATEQYGSVETTPAGPVMRNGMNPV

SEQ ID NO: 116838 - protein, 35 aa, Artificial Sequence
  Description of Artificial Sequence: Synthetic polypeptide
DEEEIRTTNPVATEQYGSVETTTQEQPRTLTNVDN

SEQ ID NO: 116839 - protein, 33 aa, Artificial Sequence
  Description of Artificial Sequence: Synthetic polypeptide
DEEEIATTNPVATEQYGSVCAAGNGPGIDGENG

SEQ ID NO: 116840 - protein, 33 aa, Artificial Sequence
  Description of Artificial Sequence: Synthetic polypeptide
DEEEIATTNPVATEQYGSVCAAEGGTRDVQNMR

SEQ ID NO: 116841 - protein, 33 aa, Artificial Sequence
  Description of Artificial Sequence: Synthetic polypeptide
DEEEIRTTNPVATEQYGSVEVLMPLGREEVVEF

SEQ ID NO: 116842 - protein, 34 aa, Artificial Sequence
  Description of Artificial Sequence: Synthetic polypeptide
DEEEIRTTNPVATEQYGSVEVTEVLPAVGDGEEN

SEQ ID NO: 116843 - protein, 33 aa, Artificial Sequence
  Description of Artificial Sequence: Synthetic polypeptide
DEEEIRTTNPVATEQYGSVEVTGQYSVSNVGDI

SEQ ID NO: 116844 - protein, 35 aa, Artificial Sequence
  Description of Artificial Sequence: Synthetic polypeptide
DEEEIRTTNPVATEQYGSVETTNQQQVLTLTNVDN

SEQ ID NO: 116845 - protein, 34 aa, Artificial Sequence
  Description of Artificial Sequence: Synthetic polypeptide
DEEEIRTTNPVATEQYGSVEVTMNPFGQMNEDTD

SEQ ID NO: 116846 - protein, 35 aa, Artificial Sequence
  Description of Artificial Sequence: Synthetic polypeptide
DEEEIRTTNPVATEQYGSVMTGNMGPGQDEGGQIM

SEQ ID NO: 116847 - protein, 34 aa, Artificial Sequence
  Description of Artificial Sequence: Synthetic polypeptide
DEEEIATTNPVATENYGSVVTGPGLGQPNGNTEV

SEQ ID NO: 116848 - protein, 34 aa, Artificial Sequence
  Description of Artificial Sequence: Synthetic polypeptide
DEEEIATTNPVATEQYGSVCAAMNNDEQEAGNVT

SEQ ID NO: 116849 - protein, 33 aa, Artificial Sequence
  Description of Artificial Sequence: Synthetic polypeptide
DEEEIRTTNPVATEQYGSVNDDNMTDEFDTENG

SEQ ID NO: 116850 - protein, 35 aa, Artificial Sequence
  Description of Artificial Sequence: Synthetic polypeptide
DEEEIRTTNPVATEQYGSVNDDNGDQNEEGQNENN

SEQ ID NO: 116851 - protein, 34 aa, Artificial Sequence
  Description of Artificial Sequence: Synthetic polypeptide
DEEEIRTTNPVATEQYGSVNDDGDENQEGEGNIQ

SEQ ID NO: 116852 - protein, 30 aa, Artificial Sequence
  Description of Artificial Sequence: Synthetic polypeptide
DEEEIATTNPVATEGYGEAAAEVIQSREQR

SEQ ID NO: 116853 - protein, 32 aa, Artificial Sequence
  Description of Artificial Sequence: Synthetic polypeptide
DEAEIATTNPVAYEQYGSTANNNLQTPGDNPY

SEQ ID NO: 116854 - protein, 33 aa, Artificial Sequence
  Description of Artificial Sequence: Synthetic polypeptide
DEEEIRTTNPVATEQYGSVMWEPLQPTLVAVVT

SEQ ID NO: 116855 - protein, 35 aa, Artificial Sequence
  Description of Artificial Sequence: Synthetic polypeptide
DEEEIRTTNPVATEQYGSVMTGVNAFNSGQEGEQD

SEQ ID NO: 116856 - protein, 31 aa, Artificial Sequence
  Description of Artificial Sequence: Synthetic polypeptide
DEAEIATTNPVAYEQYGCVATEGLQDNPDNQ

SEQ ID NO: 116857 - protein, 34 aa, Artificial Sequence
  Description of Artificial Sequence: Synthetic polypeptide
DEEEIRTTNPVATEQYGTVSSTTDGGVNFEGMNV

SEQ ID NO: 116858 - protein, 35 aa, Artificial Sequence
  Description of Artificial Sequence: Synthetic polypeptide
DEEEIRTTNPVATEQYGTVSSTTDGGVNMREGMNV

SEQ ID NO: 116859 - protein, 35 aa, Artificial Sequence
  Description of Artificial Sequence: Synthetic polypeptide
DEEEIRTTNPVATEQYGTVSSTTPAGPNMREGNPV

SEQ ID NO: 116860 - protein, 34 aa, Artificial Sequence
  Description of Artificial Sequence: Synthetic polypeptide
DEEEIRTTNPVATEQYGSVMTTGQQTEGEGGQEG

SEQ ID NO: 116861 - protein, 34 aa, Artificial Sequence
  Description of Artificial Sequence: Synthetic polypeptide
DEEEIRTTNPVATEQYGSVMTQENGSGEEDEGQG

SEQ ID NO: 116862 - protein, 36 aa, Artificial Sequence
  Description of Artificial Sequence: Synthetic polypeptide
DEEEIRTTNPVATEQYGTVSSTTPAGQNMRNGMNPV

SEQ ID NO: 116863 - protein, 35 aa, Artificial Sequence
  Description of Artificial Sequence: Synthetic polypeptide
DEEEIRTTNPVATEQYGTVSSTTPGPVEMRNGNPD

SEQ ID NO: 116864 - protein, 33 aa, Artificial Sequence
  Description of Artificial Sequence: Synthetic polypeptide
DEEEIRTTNPVATEQYGSVMTYGATDDGQFQEG

SEQ ID NO: 116865 - protein, 34 aa, Artificial Sequence
  Description of Artificial Sequence: Synthetic polypeptide
DEEEIATTNPVATEQYGSVCAADSGLQDSDGNNH

SEQ ID NO: 116866 - protein, 34 aa, Artificial Sequence
  Description of Artificial Sequence: Synthetic polypeptide
DEEEIATTNPVATEQYGSVCAADNPLNDMDPGNN

SEQ ID NO: 116867 - protein, 32 aa, Artificial Sequence
  Description of Artificial Sequence: Synthetic polypeptide
DEEEIRTTNPVATEQYGSVEWMIPVTVVEERV

SEQ ID NO: 116868 - protein, 35 aa, Artificial Sequence
  Description of Artificial Sequence: Synthetic polypeptide
DEEEIRTTNPVATEQYGSVMSGMFGNGGEGENVNE

SEQ ID NO: 116869 - protein, 36 aa, Artificial Sequence
  Description of Artificial Sequence: Synthetic polypeptide
DEEEIRTTNPVATEQYGSVMSGITQNDNNGEGEGND

SEQ ID NO: 116870 - protein, 35 aa, Artificial Sequence
  Description of Artificial Sequence: Synthetic polypeptide
DEEEIRTTNPVATEQYGSVMSGINNDLGEGEDTGD

SEQ ID NO: 116871 - protein, 34 aa, Artificial Sequence
  Description of Artificial Sequence: Synthetic polypeptide
DEEEIRTTNPVATEQYGSVFGGTDDEFGAETGNI

SEQ ID NO: 116872 - protein, 36 aa, Artificial Sequence
  Description of Artificial Sequence: Synthetic polypeptide
DEEEIRTTNPVATEQYGSVMSGINIDLDEGEGNGDE

SEQ ID NO: 116873 - protein, 35 aa, Artificial Sequence
  Description of Artificial Sequence: Synthetic polypeptide
DEEEIRTTNPVATEQYGSVMSDTIMGGQEDDDGDT

SEQ ID NO: 116874 - protein, 35 aa, Artificial Sequence
  Description of Artificial Sequence: Synthetic polypeptide
DEEEIRTTNPVATEQYGSVMSDMFNSGDEGENVNT

SEQ ID NO: 116875 - protein, 34 aa, Artificial Sequence
  Description of Artificial Sequence: Synthetic polypeptide
DEEEIATTNPVATEPYGSVCSGENLDRNDGGQGL

SEQ ID NO: 116876 - protein, 35 aa, Artificial Sequence
  Description of Artificial Sequence: Synthetic polypeptide
DEEEIRTTNPVATEQYGSVMSDGTEGGQEDDNIED

SEQ ID NO: 116877 - protein, 30 aa, Artificial Sequence
  Description of Artificial Sequence: Synthetic polypeptide
DEEEIATTNPVATEPYGTISEDCQQQNEEH

SEQ ID NO: 116878 - protein, 36 aa, Artificial Sequence
  Description of Artificial Sequence: Synthetic polypeptide
DEEEIRTTNPVATEQYGSVFGSIGQNVGQIEGDNNG

SEQ ID NO: 116879 - protein, 33 aa, Artificial Sequence
  Description of Artificial Sequence: Synthetic polypeptide
DEEEIRTTNPVATEQYGSVMNGFNGNGGFGGTT

SEQ ID NO: 116880 - protein, 33 aa, Artificial Sequence
  Description of Artificial Sequence: Synthetic polypeptide
DEEEIRTTNPVATEQYGSVMNGFNGGGFGDTIG

SEQ ID NO: 116881 - protein, 36 aa, Artificial Sequence
  Description of Artificial Sequence: Synthetic polypeptide
DEEEIRTTNPVATEQYGSVFGSIGVNVGQGEGDGNG

SEQ ID NO: 116882 - protein, 33 aa, Artificial Sequence
  Description of Artificial Sequence: Synthetic polypeptide
DEEEIRTTNPVATEQYGSVMNGFNGEGGFEGTT

SEQ ID NO: 116883 - protein, 34 aa, Artificial Sequence
  Description of Artificial Sequence: Synthetic polypeptide
DEEEIRTTNPVATEQYGSVFGSMDDEGGNETTNI

SEQ ID NO: 116884 - protein, 35 aa, Artificial Sequence
  Description of Artificial Sequence: Synthetic polypeptide
DEEEIRTTNPVATEQYGSVMPTMNNLVHLGELVDA

SEQ ID NO: 116885 - protein, 35 aa, Artificial Sequence
  Description of Artificial Sequence: Synthetic polypeptide
DEEEIRTTNPVATEQYGSVMSGMFNNDQEEIVNIE

SEQ ID NO: 116886 - protein, 35 aa, Artificial Sequence
  Description of Artificial Sequence: Synthetic polypeptide
DEEEIRTTNPVATEQYGSVMSGMFNNDQEEVGDIG

SEQ ID NO: 116887 - protein, 33 aa, Artificial Sequence
  Description of Artificial Sequence: Synthetic polypeptide
DEEEIATTNPVATEPYGSVCSGDNQRNDGGQGL

SEQ ID NO: 116888 - protein, 29 aa, Artificial Sequence
  Description of Artificial Sequence: Synthetic peptide
DEEEIATTNPVATEPYGEASMEVCQQEEK

SEQ ID NO: 116889 - protein, 33 aa, Artificial Sequence
  Description of Artificial Sequence: Synthetic polypeptide
DEEEIRTTNPVATEQYGSVEYPMLEHDIQNIEQ

SEQ ID NO: 116890 - protein, 37 aa, Artificial Sequence
  Description of Artificial Sequence: Synthetic polypeptide
DEEEIRTTNPVATEQYGSVMSTGINMDLGEGEGNGDD

SEQ ID NO: 116891 - protein, 35 aa, Artificial Sequence
  Description of Artificial Sequence: Synthetic polypeptide
DEEEIRTTNPVATEQYGSVFETSLLEIQVGELEVP

SEQ ID NO: 116892 - protein, 35 aa, Artificial Sequence
  Description of Artificial Sequence: Synthetic polypeptide
DEEEIRTTNPVATEQYGSVFETSLLPIQVGEQEVD

SEQ ID NO: 116893 - protein, 36 aa, Artificial Sequence
  Description of Artificial Sequence: Synthetic polypeptide
DEEEIRTTNPVATEQYGSVMSTGGNGELEEGEGGEQ

SEQ ID NO: 116894 - protein, 36 aa, Artificial Sequence
  Description of Artificial Sequence: Synthetic polypeptide
DEEEIRTTNPVATEQYGSVMSTDNEGGQEEDNNIEG

SEQ ID NO: 116895 - protein, 36 aa, Artificial Sequence
  Description of Artificial Sequence: Synthetic polypeptide
DEEEIRTTNPVATEQYGSVMSTDGNGEEEEGEGGNG

SEQ ID NO: 116896 - protein, 37 aa, Artificial Sequence
  Description of Artificial Sequence: Synthetic polypeptide
DEEEIRTTNPVATEQYGSVMSQDTNFGQGGNTNDEDT

SEQ ID NO: 116897 - protein, 35 aa, Artificial Sequence
  Description of Artificial Sequence: Synthetic polypeptide
DEEEIRTTNPVATEQYGSVMSQDMNEGGQEDDNID

SEQ ID NO: 116898 - protein, 35 aa, Artificial Sequence
  Description of Artificial Sequence: Synthetic polypeptide
DEEEIRTTNPVATEQYGSVFGDDDDLEQGEGGNNE

SEQ ID NO: 116899 - protein, 35 aa, Artificial Sequence
  Description of Artificial Sequence: Synthetic polypeptide
DEEEIATTNPVATEPYGSVCFTNEDHNRGGQNQRE

SEQ ID NO: 116900 - protein, 36 aa, Artificial Sequence
  Description of Artificial Sequence: Synthetic polypeptide
DEEEIRTTNPVATEQYGSVMSGTNMDNGEGESINGD

SEQ ID NO: 116901 - protein, 36 aa, Artificial Sequence
  Description of Artificial Sequence: Synthetic polypeptide
DEEEIRTTNPVATEQYGSVMSGSNNMDLGEGESNGD

SEQ ID NO: 116902 - protein, 36 aa, Artificial Sequence
  Description of Artificial Sequence: Synthetic polypeptide
DEEEIRTTNPVATEQYGSVMSGMTDNGGETGEGNNE

SEQ ID NO: 116903 - protein, 34 aa, Artificial Sequence
  Description of Artificial Sequence: Synthetic polypeptide
DEEEIRTTNPVATEQYGSVFGDINVNNGEGGGNI

SEQ ID NO: 116904 - protein, 36 aa, Artificial Sequence
  Description of Artificial Sequence: Synthetic polypeptide
DEEEIRTTNPVATEQYGSVMSGMNVDLGEGESINGD

SEQ ID NO: 116905 - protein, 36 aa, Artificial Sequence
  Description of Artificial Sequence: Synthetic polypeptide
DEEEIRTTNPVATEQYGSVGGLSNNVQTRENVVDQL

SEQ ID NO: 116906 - protein, 36 aa, Artificial Sequence
  Description of Artificial Sequence: Synthetic polypeptide
DEEEIRTTNPVATEQYGSVGGPSGNVQSRENVVDQL

SEQ ID NO: 116907 - protein, 37 aa, Artificial Sequence
  Description of Artificial Sequence: Synthetic polypeptide
DEEEIRTTNPVATEQYGVVSTTTTNLQAGNQAGTTVE

SEQ ID NO: 116908 - protein, 36 aa, Artificial Sequence
  Description of Artificial Sequence: Synthetic polypeptide
DEEEIRTTNPVATEQYGVVSTTTNTNQQGNQAGIGD

SEQ ID NO: 116909 - protein, 34 aa, Artificial Sequence
  Description of Artificial Sequence: Synthetic polypeptide
DEEEIRTTNPVATEQYGSVMGLGDQNDNEGGNGG

SEQ ID NO: 116910 - protein, 31 aa, Artificial Sequence
  Description of Artificial Sequence: Synthetic polypeptide
DEEEIATTNPVATEQYGSAPEVGPQMHGEPV

SEQ ID NO: 116911 - protein, 30 aa, Artificial Sequence
  Description of Artificial Sequence: Synthetic polypeptide
DEEEIATTNPVATEQYGSAPEDLEDHEEEK

SEQ ID NO: 116912 - protein, 36 aa, Artificial Sequence
  Description of Artificial Sequence: Synthetic polypeptide
DEEEIRTTNPVATEQYGVVSTTNQQQNNQQGNTEDE

SEQ ID NO: 116913 - protein, 35 aa, Artificial Sequence
  Description of Artificial Sequence: Synthetic polypeptide
DEEEIRTTNPVATEQYGSVMGLFQTTNDDEGGNGQ

SEQ ID NO: 116914 - protein, 36 aa, Artificial Sequence
  Description of Artificial Sequence: Synthetic polypeptide
DEEEIRTTNPVATEQYGSVGSTTPAGPNMRFGMNPV

SEQ ID NO: 116915 - protein, 36 aa, Artificial Sequence
  Description of Artificial Sequence: Synthetic polypeptide
DEEEIRTTNPVATEQYGSVGSTTPAGPNMRHGMNPV

SEQ ID NO: 116916 - protein, 32 aa, Artificial Sequence
  Description of Artificial Sequence: Synthetic polypeptide
DEEEIATTNPVATEQYGSASEAGPQMHGMEPV

SEQ ID NO: 116917 - protein, 36 aa, Artificial Sequence
  Description of Artificial Sequence: Synthetic polypeptide
DEEEIRTTNPVATEQYGSVGSTTPAGPNMRNGMNPV

SEQ ID NO: 116918 - protein, 34 aa, Artificial Sequence
  Description of Artificial Sequence: Synthetic polypeptide
DEEEIATTNPVATEQYGSACSGNNDIPQDNSNNR

SEQ ID NO: 116919 - protein, 35 aa, Artificial Sequence
  Description of Artificial Sequence: Synthetic polypeptide
DEEEIRTTNPVATEQYGSVMGIGNDEQEGGGQNEI

SEQ ID NO: 116920 - protein, 35 aa, Artificial Sequence
  Description of Artificial Sequence: Synthetic polypeptide
DEEEIRTTNPVATEQYGSVMGIDNEQDQGGGEENV

SEQ ID NO: 116921 - protein, 35 aa, Artificial Sequence
  Description of Artificial Sequence: Synthetic polypeptide
DEEEIATTNPVATEQYGSACSATNNNQEAEIGNDD

SEQ ID NO: 116922 - protein, 34 aa, Artificial Sequence
  Description of Artificial Sequence: Synthetic polypeptide
DEEEIRTTNPVATEQYGSVMGIDNEGQGEVGTTS

SEQ ID NO: 116923 - protein, 36 aa, Artificial Sequence
  Description of Artificial Sequence: Synthetic polypeptide
DEEEIRTTNPVATEQYGSVMGGTNDQGEEEGGDNEQ

SEQ ID NO: 116924 - protein, 36 aa, Artificial Sequence
  Description of Artificial Sequence: Synthetic polypeptide
DEEEIRTTNPVATEQYGSVMGGTNDQFNEEGGDNIN

SEQ ID NO: 116925 - protein, 35 aa, Artificial Sequence
  Description of Artificial Sequence: Synthetic polypeptide
DEEEIRTTNPVATEQYGSVMGLFNNNNEFTQEGNT

SEQ ID NO: 116926 - protein, 36 aa, Artificial Sequence
  Description of Artificial Sequence: Synthetic polypeptide
DEEEIRTTNPVATEQYGSVMGGTNDQEEEEGGDNNA

SEQ ID NO: 116927 - protein, 33 aa, Artificial Sequence
  Description of Artificial Sequence: Synthetic polypeptide
DEEEIATTNPVATEQYGSASSEPAGPQRNGMEK

SEQ ID NO: 116928 - protein, 33 aa, Artificial Sequence
  Description of Artificial Sequence: Synthetic polypeptide
DEEEIATTNPVATEQYGSCAAAGNLPQDDLGTP

SEQ ID NO: 116929 - protein, 32 aa, Artificial Sequence
  Description of Artificial Sequence: Synthetic polypeptide
DEEEIATTNPVATEQYGSVAAAAIDEQDNGTH

SEQ ID NO: 116930 - protein, 35 aa, Artificial Sequence
  Description of Artificial Sequence: Synthetic polypeptide
DEEEIRTTNPVATEQYGSVMGMDNELDEDEGNGNE

SEQ ID NO: 116931 - protein, 34 aa, Artificial Sequence
  Description of Artificial Sequence: Synthetic polypeptide
DEEEIATTNPVATEQYGSTCAMTENGLEARDIDR

SEQ ID NO: 116932 - protein, 35 aa, Artificial Sequence
  Description of Artificial Sequence: Synthetic polypeptide
DEEEIRTTNPVATEQYGSVMGLQTIQNQDEGGNGQ

SEQ ID NO: 116933 - protein, 33 aa, Artificial Sequence
  Description of Artificial Sequence: Synthetic polypeptide
DEEEIATTNPVATEQYGSTCAMTEHLEARDGDF

SEQ ID NO: 116934 - protein, 34 aa, Artificial Sequence
  Description of Artificial Sequence: Synthetic polypeptide
DEEEIATTNPVATEQYGSTCAMTEHLEADDGDNR

SEQ ID NO: 116935 - protein, 35 aa, Artificial Sequence
  Description of Artificial Sequence: Synthetic polypeptide
DEEEIRTTNPVATEQYGSVMGLQNIQNDEGGENGV

SEQ ID NO: 116936 - protein, 34 aa, Artificial Sequence
  Description of Artificial Sequence: Synthetic polypeptide
DEEEIATTNPVATEQYGSASSTPAGPNMRNGMNV

SEQ ID NO: 116937 - protein, 35 aa, Artificial Sequence
  Description of Artificial Sequence: Synthetic polypeptide
DEEEIRTTNPVATEQYGSVGSPNNMVIQRTPEEDE

SEQ ID NO: 116938 - protein, 36 aa, Artificial Sequence
  Description of Artificial Sequence: Synthetic polypeptide
DEEEIRTTNPVATEQYGSVGSPTSLLEMQQLVLERD

SEQ ID NO: 116939 - protein, 36 aa, Artificial Sequence
  Description of Artificial Sequence: Synthetic polypeptide
DEEEIRTTNPVATEQYGSVGSPTSLLSEQQLVLERN

SEQ ID NO: 116940 - protein, 34 aa, Artificial Sequence
  Description of Artificial Sequence: Synthetic polypeptide
DEEEIATTNPVATEQYGSIVSCCGSNVGGPGGSR

SEQ ID NO: 116941 - protein, 35 aa, Artificial Sequence
  Description of Artificial Sequence: Synthetic polypeptide
DEEEIRTTNPVATEQYGSVMGLLNGGNGQTGNNGN

SEQ ID NO: 116942 - protein, 32 aa, Artificial Sequence
  Description of Artificial Sequence: Synthetic polypeptide
DEEEIATTNPVATEQYGSCSAGPPQEHDGAHN

SEQ ID NO: 116943 - protein, 34 aa, Artificial Sequence
  Description of Artificial Sequence: Synthetic polypeptide
DEEEIATTNPVATEQYGSCATGNQPDDHQDGNDE

SEQ ID NO: 116944 - protein, 34 aa, Artificial Sequence
  Description of Artificial Sequence: Synthetic polypeptide
DEEEIATTNPVATEQYGSCAATGNLPQDDPGGTP

SEQ ID NO: 116945 - protein, 35 aa, Artificial Sequence
  Description of Artificial Sequence: Synthetic polypeptide
DEEEIRTTNPVATEQYGSVMGLPNDQSEGGGQNET

SEQ ID NO: 116946 - protein, 37 aa, Artificial Sequence
  Description of Artificial Sequence: Synthetic polypeptide
DEEEIRTTNPVATEQYGVVSTTNQQQLQQNTEQGNTE

SEQ ID NO: 116947 - protein, 34 aa, Artificial Sequence
  Description of Artificial Sequence: Synthetic polypeptide
DEEEIRTTNPVATEQYGSVMGFEMNGEGGENGGD

SEQ ID NO: 116948 - protein, 34 aa, Artificial Sequence
  Description of Artificial Sequence: Synthetic polypeptide
DEEEIRTTNPVATEQYGSVMGENNTDQEEGGGQT

SEQ ID NO: 116949 - protein, 37 aa, Artificial Sequence
  Description of Artificial Sequence: Synthetic polypeptide
DEEEIRTTNPVATEQYGVVSTTNNQQQLQQGTTNNTT

SEQ ID NO: 116950 - protein, 34 aa, Artificial Sequence
  Description of Artificial Sequence: Synthetic polypeptide
DEEEIATTNPVATEQYGSACSANNDIPNDNGNQR

SEQ ID NO: 116951 - protein, 33 aa, Artificial Sequence
  Description of Artificial Sequence: Synthetic polypeptide
DEEEIATTNPVATEQYGSACSADLQAEMPNDNE

SEQ ID NO: 116952 - protein, 35 aa, Artificial Sequence
  Description of Artificial Sequence: Synthetic polypeptide
DEEEIATTNPVATEQYGSACSAANGLDNRMGEDNN

SEQ ID NO: 116953 - protein, 33 aa, Artificial Sequence
  Description of Artificial Sequence: Synthetic polypeptide
DEEEIATTNPVATEQWGCCAMTNLNRDGMNDLH

SEQ ID NO: 116954 - protein, 35 aa, Artificial Sequence
  Description of Artificial Sequence: Synthetic polypeptide
DEEEIRTTNPVATEQYGSVLTMEENSDAAMNELRQ

SEQ ID NO: 116955 - protein, 35 aa, Artificial Sequence
  Description of Artificial Sequence: Synthetic polypeptide
DEEEIATTNPVATEQYGSACATNPLQPDMQMGDNH

SEQ ID NO: 116956 - protein, 36 aa, Artificial Sequence
  Description of Artificial Sequence: Synthetic polypeptide
DEEEIRTTNPVATEQYGSVGSWTPNVQLTQMVQEED

SEQ ID NO: 116957 - protein, 34 aa, Artificial Sequence
  Description of Artificial Sequence: Synthetic polypeptide
DEEEIATTNPVATEQYGSACATNPLQDDTGDGDP

SEQ ID NO: 116958 - protein, 34 aa, Artificial Sequence
  Description of Artificial Sequence: Synthetic polypeptide
DEEEIATTNPVATEQYGSACATNPLQDDPGGEDW

SEQ ID NO: 116959 - protein, 35 aa, Artificial Sequence
  Description of Artificial Sequence: Synthetic polypeptide
DEEEIATTNPVATEQYGSACATNPLQDDPGEETNQ

SEQ ID NO: 116960 - protein, 36 aa, Artificial Sequence
  Description of Artificial Sequence: Synthetic polypeptide
DEEEIRTTNPVATEQYGSVLSYTVEQLQDMSGGEID

SEQ ID NO: 116961 - protein, 34 aa, Artificial Sequence
  Description of Artificial Sequence: Synthetic polypeptide
DEEEIATTNPVATEQYGSACATNNLQDDPGDEDI

SEQ ID NO: 116962 - protein, 36 aa, Artificial Sequence
  Description of Artificial Sequence: Synthetic polypeptide
DEEEIRTTNPVATEQYGSVLSTTPAGPNMRNGMNPV

SEQ ID NO: 116963 - protein, 34 aa, Artificial Sequence
  Description of Artificial Sequence: Synthetic polypeptide
DEEEIATTNPVATEQYGSACAATNNHQEPGENDD

SEQ ID NO: 116964 - protein, 36 aa, Artificial Sequence
  Description of Artificial Sequence: Synthetic polypeptide
DEEEIRTTNPVATEQYGVVSTTNNNQQQGNIGTNPE

SEQ ID NO: 116965 - protein, 34 aa, Artificial Sequence
  Description of Artificial Sequence: Synthetic polypeptide
DEEEIATTNPVATEQYGSACATNPLQDDSGTGDI

SEQ ID NO: 116966 - protein, 34 aa, Artificial Sequence
  Description of Artificial Sequence: Synthetic polypeptide
DEEEIRTTNPVATEQYGSVMCPTPLLEQQMVLEI

SEQ ID NO: 116967 - protein, 35 aa, Artificial Sequence
  Description of Artificial Sequence: Synthetic polypeptide
DEEEIRTTNPVATEQYGSVMENEWLDQETLENLDS

SEQ ID NO: 116968 - protein, 36 aa, Artificial Sequence
  Description of Artificial Sequence: Synthetic polypeptide
DEEEIRTTNPVATEQYGSVGSWTINVQPLQMVQEHD

SEQ ID NO: 116969 - protein, 36 aa, Artificial Sequence
  Description of Artificial Sequence: Synthetic polypeptide
DEEEIRTTNPVATEQYGSVMGDTMNLDGSGNGEQVG

SEQ ID NO: 116970 - protein, 36 aa, Artificial Sequence
  Description of Artificial Sequence: Synthetic polypeptide
DEEEIRTTNPVATEQYGSVMGDTMNLDGSGNFIGDQ

SEQ ID NO: 116971 - protein, 36 aa, Artificial Sequence
  Description of Artificial Sequence: Synthetic polypeptide
DEEEIRTTNPVATEQYGSVMGDTMNLDGSGNFEGTA

SEQ ID NO: 116972 - protein, 36 aa, Artificial Sequence
  Description of Artificial Sequence: Synthetic polypeptide
DEEEIRTTNPVATEQYGSVMGDTMNLDGSGNEEIEN

SEQ ID NO: 116973 - protein, 36 aa, Artificial Sequence
  Description of Artificial Sequence: Synthetic polypeptide
DEEEIRTTNPVATEQYGSVMGDTMNLDGSGNDEGDN

SEQ ID NO: 116974 - protein, 36 aa, Artificial Sequence
  Description of Artificial Sequence: Synthetic polypeptide
DEEEIRTTNPVATEQYGSVMGDTMNELDGSGNDGDD

SEQ ID NO: 116975 - protein, 35 aa, Artificial Sequence
  Description of Artificial Sequence: Synthetic polypeptide
DEEEIRTTNPVATEQYGSVMGDTMNEDGSGNENGP

SEQ ID NO: 116976 - protein, 35 aa, Artificial Sequence
  Description of Artificial Sequence: Synthetic polypeptide
DEEEIRTTNPVATEQYGSVMGDTMNEDGSGNDGDT

SEQ ID NO: 116977 - protein, 35 aa, Artificial Sequence
  Description of Artificial Sequence: Synthetic polypeptide
DEEEIRTTNPVATEQYGSVMGDTDQDQEQGNEQEE

SEQ ID NO: 116978 - protein, 37 aa, Artificial Sequence
  Description of Artificial Sequence: Synthetic polypeptide
DEEEIRTTNPVATEQYGVVSTTNQQLQQGNNQQGTTE

SEQ ID NO: 116979 - protein, 34 aa, Artificial Sequence
  Description of Artificial Sequence: Synthetic polypeptide
DEEEIRTTNPVATEQYGSVMGDNDLGGGEDEFEG

SEQ ID NO: 116980 - protein, 34 aa, Artificial Sequence
  Description of Artificial Sequence: Synthetic polypeptide
DEEEIRTTNPVATEQYGSVMGDNDLGEGEDEIGG

SEQ ID NO: 116981 - protein, 35 aa, Artificial Sequence
  Description of Artificial Sequence: Synthetic polypeptide
DEEEIRTTNPVATEQYGSVMGDFNNNNGQTDQGNT

SEQ ID NO: 116982 - protein, 33 aa, Artificial Sequence
  Description of Artificial Sequence: Synthetic polypeptide
DEEEIATTNPVATEPYGVVCAGNNLAERGGNEQ

SEQ ID NO: 116983 - protein, 34 aa, Artificial Sequence
  Description of Artificial Sequence: Synthetic polypeptide
DEEEIRTTNPVATEQYGSVMFMGLNQQTGVELIW

SEQ ID NO: 116984 - protein, 35 aa, Artificial Sequence
  Description of Artificial Sequence: Synthetic polypeptide
DEEEIRTTNPVATEQYGSVMEVTQVGLQPLVGEIE

SEQ ID NO: 116985 - protein, 35 aa, Artificial Sequence
  Description of Artificial Sequence: Synthetic polypeptide
DEEEIRTTNPVATEQYGSVMEPQGNLEQQDVSERG

SEQ ID NO: 116986 - protein, 34 aa, Artificial Sequence
  Description of Artificial Sequence: Synthetic polypeptide
DEEEIRTTNPVATEQYGSVMGMENGENDTGGNGD

SEQ ID NO: 116987 - protein, 34 aa, Artificial Sequence
  Description of Artificial Sequence: Synthetic polypeptide
DEEEIRTTNPVATEQYGSVGTTNVGAEVVNPNQN

SEQ ID NO: 116988 - protein, 33 aa, Artificial Sequence
  Description of Artificial Sequence: Synthetic polypeptide
DEEEIATTNPVATEQYGSVAAGNPDNSEHNTRV

SEQ ID NO: 116989 - protein, 34 aa, Artificial Sequence
  Description of Artificial Sequence: Synthetic polypeptide
DEEEIATTNPVATEQYGSVAATANLDEANNNNEP

SEQ ID NO: 116990 - protein, 34 aa, Artificial Sequence
  Description of Artificial Sequence: Synthetic polypeptide
DEEEIRTTNPVATEQYGSVMGPEMNGEDGEQGNT

SEQ ID NO: 116991 - protein, 34 aa, Artificial Sequence
  Description of Artificial Sequence: Synthetic polypeptide
DEEEIRTTNPVATEQYGSVMGPEMGNGETGENSN

SEQ ID NO: 116992 - protein, 37 aa, Artificial Sequence
  Description of Artificial Sequence: Synthetic polypeptide
DEEEIRTTNPVATEQYGVVSTTTNLQAGNQQGSNQDE

SEQ ID NO: 116993 - protein, 37 aa, Artificial Sequence
  Description of Artificial Sequence: Synthetic polypeptide
DEEEIRTTNPVATEQYGVVSTTTNLQAGNQANGTEDE

SEQ ID NO: 116994 - protein, 37 aa, Artificial Sequence
  Description of Artificial Sequence: Synthetic polypeptide
DEEEIRTTNPVATEQYGVVSTTTNLQAGNQAIGTNVE

SEQ ID NO: 116995 - protein, 37 aa, Artificial Sequence
  Description of Artificial Sequence: Synthetic polypeptide
DEEEIRTTNPVATEQYGVVSTTTNLQAGNQAGSTVEE

SEQ ID NO: 116996 - protein, 34 aa, Artificial Sequence
  Description of Artificial Sequence: Synthetic polypeptide
DEEEIATTNPVATEQYGSVASANNISEDLAMGQH

SEQ ID NO: 116997 - protein, 34 aa, Artificial Sequence
  Description of Artificial Sequence: Synthetic polypeptide
DEEEIRTTNPVATEQYGSVMGPEMNGELGENGGG

SEQ ID NO: 116998 - protein, 33 aa, Artificial Sequence
  Description of Artificial Sequence: Synthetic polypeptide
DEEEIATTNPVATEQYGSVANTGNGEYGMEGGN

SEQ ID NO: 116999 - protein, 34 aa, Artificial Sequence
  Description of Artificial Sequence: Synthetic polypeptide
DEEEIRTTNPVATEQYGSVGNQDNGIEEDTGENI

SEQ ID NO: 117000 - protein, 34 aa, Artificial Sequence
  Description of Artificial Sequence: Synthetic polypeptide
DEEEIRTTNPVATEQYGSVMGNVDSGQDEFNEME

SEQ ID NO: 117001 - protein, 32 aa, Artificial Sequence
  Description of Artificial Sequence: Synthetic polypeptide
DEEEIATTNPVATEQYGSVANPNDPAEANPGD

SEQ ID NO: 117002 - protein, 35 aa, Artificial Sequence
  Description of Artificial Sequence: Synthetic polypeptide
DEEEIRTTNPVATEQYGSVMGNTTDQGQEEGGGNG

SEQ ID NO: 117003 - protein, 34 aa, Artificial Sequence
  Description of Artificial Sequence: Synthetic polypeptide
DEEEIATTNPVATEQYGSVANAGNLQANASIGDE

SEQ ID NO: 117004 - protein, 36 aa, Artificial Sequence
  Description of Artificial Sequence: Synthetic polypeptide
DEEEIRTTNPVATEQYGSVMGNTNTGGNGQTGNQPS

SEQ ID NO: 117005 - protein, 35 aa, Artificial Sequence
  Description of Artificial Sequence: Synthetic polypeptide
DEEEIRTTNPVATEQYGSVGPDSNLAQPTNEVDQQ

SEQ ID NO: 117006 - protein, 34 aa, Artificial Sequence
  Description of Artificial Sequence: Synthetic polypeptide
DEEEIRTTNPVATEQYGSVGNLNELYERPEEDEN

SEQ ID NO: 117007 - protein, 33 aa, Artificial Sequence
  Description of Artificial Sequence: Synthetic polypeptide
DEEEIRTTNPVATEQYGSVGPPNQQPALLVEFD

SEQ ID NO: 117008 - protein, 35 aa, Artificial Sequence
  Description of Artificial Sequence: Synthetic polypeptide
DEEEIRTTNPVATEQYGSVMGPEMTNVETGENGGT

SEQ ID NO: 117009 - protein, 35 aa, Artificial Sequence
  Description of Artificial Sequence: Synthetic polypeptide
DEEEIRTTNPVATEQYGSVGGTTNIDGQGGQGGEE

SEQ ID NO: 117010 - protein, 34 aa, Artificial Sequence
  Description of Artificial Sequence: Synthetic polypeptide
DEEEIRTTNPVATEQYGSVMGQNMGDEGGENEGV

SEQ ID NO: 117011 - protein, 34 aa, Artificial Sequence
  Description of Artificial Sequence: Synthetic polypeptide
DEEEIRTTNPVATEQYGSVMGQNMEEGGNGDGEV

SEQ ID NO: 117012 - protein, 33 aa, Artificial Sequence
  Description of Artificial Sequence: Synthetic polypeptide
DEEEIRTTNPVATEQYGSVMGQNMEDEGGEEQA

SEQ ID NO: 117013 - protein, 36 aa, Artificial Sequence
  Description of Artificial Sequence: Synthetic polypeptide
DEEEIRTTNPVATEQYGSVGGPSNNDQPRTNVVDQL

SEQ ID NO: 117014 - protein, 36 aa, Artificial Sequence
  Description of Artificial Sequence: Synthetic polypeptide
DEEEIRTTNPVATEQYGSVGGPSNNNQERENVVDQL

SEQ ID NO: 117015 - protein, 36 aa, Artificial Sequence
  Description of Artificial Sequence: Synthetic polypeptide
DEEEIRTTNPVATEQYGSVGGPSNNVQPRENVVDQW

SEQ ID NO: 117016 - protein, 36 aa, Artificial Sequence
  Description of Artificial Sequence: Synthetic polypeptide
DEEEIRTTNPVATEQYGSVGGPSNNVQVRENEVDQL

SEQ ID NO: 117017 - protein, 33 aa, Artificial Sequence
  Description of Artificial Sequence: Synthetic polypeptide
DEAEIATTNPVAYEQWGSVSGNNNLQGGMNGGH

SEQ ID NO: 117018 - protein, 37 aa, Artificial Sequence
  Description of Artificial Sequence: Synthetic polypeptide
DEEEIRTTNPVATEQYGSVGGPSNTNVQMGENNVDQY

SEQ ID NO: 117019 - protein, 34 aa, Artificial Sequence
  Description of Artificial Sequence: Synthetic polypeptide
DEEEIRTTNPVATEQYGSVMGQLMEDEGGENQGV

SEQ ID NO: 117020 - protein, 33 aa, Artificial Sequence
  Description of Artificial Sequence: Synthetic polypeptide
DEEEIRTTNPVATEQYGSVMGQGNEGGNNGEDG

SEQ ID NO: 117021 - protein, 34 aa, Artificial Sequence
  Description of Artificial Sequence: Synthetic polypeptide
DEEEIRTTNPVATEQYGSVGGPTPLLEQQLVTET

SEQ ID NO: 117022 - protein, 37 aa, Artificial Sequence
  Description of Artificial Sequence: Synthetic polypeptide
DEEEIRTTNPVATEQYGSVGGQSCNLDQHRENVQDQE

SEQ ID NO: 117023 - protein, 36 aa, Artificial Sequence
  Description of Artificial Sequence: Synthetic polypeptide
DEEEIRTTNPVATEQYGSVMGQDINLQEVEGQNDEI

SEQ ID NO: 117024 - protein, 33 aa, Artificial Sequence
  Description of Artificial Sequence: Synthetic polypeptide
DEEEIATTNPVATEQYGSVATGPGENAPGGEFN

SEQ ID NO: 117025 - protein, 33 aa, Artificial Sequence
  Description of Artificial Sequence: Synthetic polypeptide
DEEEIATTNPVATEQYGSVATGNPDNSEHNTME

SEQ ID NO: 117026 - protein, 36 aa, Artificial Sequence
  Description of Artificial Sequence: Synthetic polypeptide
DEEEIRTTNPVATEQYGSVGGPSTNVQHNENVVDQL

SEQ ID NO: 117027 - protein, 32 aa, Artificial Sequence
  Description of Artificial Sequence: Synthetic polypeptide
DEEEIATTNPVATEQYGSVAMNDNNENPTVAQ

SEQ ID NO: 117028 - protein, 35 aa, Artificial Sequence
  Description of Artificial Sequence: Synthetic polypeptide
DEEEIATTNPVATEQYGSVAMANNDQDRNGQNPHN

SEQ ID NO: 117029 - protein, 33 aa, Artificial Sequence
  Description of Artificial Sequence: Synthetic polypeptide
DEEEIATTNPVATEQYGSVAIVANDGQTAEDNN

SEQ ID NO: 117030 - protein, 35 aa, Artificial Sequence
  Description of Artificial Sequence: Synthetic polypeptide
DEEEIRTTNPVATEQYGSVMGNLNGGNGQTENQGD

SEQ ID NO: 117031 - protein, 34 aa, Artificial Sequence
  Description of Artificial Sequence: Synthetic polypeptide
DEEEIATTNPVATEQYGSVAGAGNPQEAEGGNDD

SEQ ID NO: 117032 - protein, 34 aa, Artificial Sequence
  Description of Artificial Sequence: Synthetic polypeptide
DEEEIRTTNPVATEQYGSVMGNFMGSNGQGEGGQ

SEQ ID NO: 117033 - protein, 35 aa, Artificial Sequence
  Description of Artificial Sequence: Synthetic polypeptide
DEEEIRTTNPVATEQYGSVGSLDTTLIEDENMNLQ

SEQ ID NO: 117034 - protein, 35 aa, Artificial Sequence
  Description of Artificial Sequence: Synthetic polypeptide
DEEEIATTNPVATEQYGSVACGGNNDIPQDNGNHR

SEQ ID NO: 117035 - protein, 35 aa, Artificial Sequence
  Description of Artificial Sequence: Synthetic polypeptide
DEEEIRTTNPVATEQYGSVMGNENDQGQEEGGNGD

SEQ ID NO: 117036 - protein, 34 aa, Artificial Sequence
  Description of Artificial Sequence: Synthetic polypeptide
DEEEIRTTNPVATEQYGSVMGNDFEGNGNDTGDI

SEQ ID NO: 117037 - protein, 35 aa, Artificial Sequence
  Description of Artificial Sequence: Synthetic polypeptide
DEEEIRTTNPVATEQYGSVMGNNDQEGGEDTNEGG

SEQ ID NO: 117038 - protein, 35 aa, Artificial Sequence
  Description of Artificial Sequence: Synthetic polypeptide
DEEEIRTTNPVATEQYGSVGSNNDEMQGENEQEED

SEQ ID NO: 117039 - protein, 35 aa, Artificial Sequence
  Description of Artificial Sequence: Synthetic polypeptide
DEEEIATTNPVATEQYGSVAATPHLDQIDPNANMR

SEQ ID NO: 117040 - protein, 32 aa, Artificial Sequence
  Description of Artificial Sequence: Synthetic polypeptide
DEEEIATTNPVATEQYGSVAATGTDNDNGTHV

SEQ ID NO: 117041 - protein, 35 aa, Artificial Sequence
  Description of Artificial Sequence: Synthetic polypeptide
DEEEIATTNPVATEQYGSVAATENLAGPPGETARN

SEQ ID NO: 117042 - protein, 34 aa, Artificial Sequence
  Description of Artificial Sequence: Synthetic polypeptide
DEEEIRTTNPVATEQYGSVMGMNNINEDDGEGNI

SEQ ID NO: 117043 - protein, 36 aa, Artificial Sequence
  Description of Artificial Sequence: Synthetic polypeptide
DEEEIRTTNPVATEQYGSVGSNTMGLVQQNGPEEVL

SEQ ID NO: 117044 - protein, 36 aa, Artificial Sequence
  Description of Artificial Sequence: Synthetic polypeptide
DEEEIRTTNPVATEQYGSVGSNTMNDIFNGGDNEGT

SEQ ID NO: 117045 - protein, 34 aa, Artificial Sequence
  Description of Artificial Sequence: Synthetic polypeptide
DEEEIATTNPVATEQYGSVAATANLDEANNNPEE

SEQ ID NO: 117046 - protein, 35 aa, Artificial Sequence
  Description of Artificial Sequence: Synthetic polypeptide
DEEEIRTTNPVATEQYGSVGSNNQDEMQGEGQEED

SEQ ID NO: 117047 - protein, 35 aa, Artificial Sequence
  Description of Artificial Sequence: Synthetic polypeptide
DEEEIRTTNPVATEQYGSVGSGNNGTGQTEGGGQT

SEQ ID NO: 117048 - protein, 35 aa, Artificial Sequence
  Description of Artificial Sequence: Synthetic polypeptide
DEEEIRTTNPVATEQYGSVGSGNNDGQNDGGEDPG

SEQ ID NO: 117049 - protein, 35 aa, Artificial Sequence
  Description of Artificial Sequence: Synthetic polypeptide
DEEEIRTTNPVATEQYGSVMGNNDQGGGEDDNEQG

SEQ ID NO: 117050 - protein, 34 aa, Artificial Sequence
  Description of Artificial Sequence: Synthetic polypeptide
DEEEIATTNPVATEQYGSVAITNPPEQGQDNSDA

SEQ ID NO: 117051 - protein, 34 aa, Artificial Sequence
  Description of Artificial Sequence: Synthetic polypeptide
DEEEIATTNPVATEQYGSVAITNPEQGSQDGSDA

SEQ ID NO: 117052 - protein, 36 aa, Artificial Sequence
  Description of Artificial Sequence: Synthetic polypeptide
DEEEIRTTNPVATEQYGSVGPTTNLDMEINGEHERF

SEQ ID NO: 117053 - protein, 36 aa, Artificial Sequence
  Description of Artificial Sequence: Synthetic polypeptide
DEEEIRTTNPVATEQYGSVMGNTDGNNQEENGNNAN

SEQ ID NO: 117054 - protein, 34 aa, Artificial Sequence
  Description of Artificial Sequence: Synthetic polypeptide
DEEEIRTTNPVATEQYGSVGQPTDIPHNQMVNET

SEQ ID NO: 117055 - protein, 35 aa, Artificial Sequence
  Description of Artificial Sequence: Synthetic polypeptide
DEEEIRTTNPVATEQYGSVGQPTNLQPEMMPMSWD

SEQ ID NO: 117056 - protein, 35 aa, Artificial Sequence
  Description of Artificial Sequence: Synthetic polypeptide
DEEEIRTTNPVATEQYGSVMGNNTGDDQLEEQGNT

SEQ ID NO: 117057 - protein, 32 aa, Artificial Sequence
  Description of Artificial Sequence: Synthetic polypeptide
DEEEIATTNPVATEQYGSVAGTTPAPDNENDT

SEQ ID NO: 117058 - protein, 33 aa, Artificial Sequence
  Description of Artificial Sequence: Synthetic polypeptide
DEEEIRTTNPVATEQYGSVGQVTDIPVNQMVDT

SEQ ID NO: 117059 - protein, 35 aa, Artificial Sequence
  Description of Artificial Sequence: Synthetic polypeptide
DEEEIRTTNPVATEQYGSVGSDDNGGEEDGGGNIQ

SEQ ID NO: 117060 - protein, 35 aa, Artificial Sequence
  Description of Artificial Sequence: Synthetic polypeptide
DEEEIRTTNPVATEQYGSVGSDDNGIEEDGGGNEI

SEQ ID NO: 117061 - protein, 37 aa, Artificial Sequence
  Description of Artificial Sequence: Synthetic polypeptide
DEEEIRTTNPVATEQYGVVSTTNTNLQQGNTEQGSTQ

SEQ ID NO: 117062 - protein, 35 aa, Artificial Sequence
  Description of Artificial Sequence: Synthetic polypeptide
DEEEIRTTNPVATEQYGSVGSGMGGQGDEGNGETQ

SEQ ID NO: 117063 - protein, 33 aa, Artificial Sequence
  Description of Artificial Sequence: Synthetic polypeptide
DEEEIRTTNPVATEQYGSVGSGMGGQNDETEGD

SEQ ID NO: 117064 - protein, 34 aa, Artificial Sequence
  Description of Artificial Sequence: Synthetic polypeptide
DEEEIRTTNPVATEQYGSVGSGMGGQNGGEEEGD

SEQ ID NO: 117065 - protein, 34 aa, Artificial Sequence
  Description of Artificial Sequence: Synthetic polypeptide
DEEEIRTTNPVATEQYGSVGSGMGGQNNEEQEGD

SEQ ID NO: 117066 - protein, 34 aa, Artificial Sequence
  Description of Artificial Sequence: Synthetic polypeptide
DEEEIRTTNPVATEQYGSVGSGMGGQNSGGEGTS

SEQ ID NO: 117067 - protein, 34 aa, Artificial Sequence
  Description of Artificial Sequence: Synthetic polypeptide
DEEEIRTTNPVATEQYGSVMGMNNINDIGEGNDI

SEQ ID NO: 117068 - protein, 30 aa, Artificial Sequence
  Description of Artificial Sequence: Synthetic polypeptide
DEEEIATTNPVATEQYGTISEVCQQQQEEH

SEQ ID NO: 117069 - protein, 30 aa, Artificial Sequence
  Description of Artificial Sequence: Synthetic polypeptide
DEEEIATTNPVATEQYGTISEVCQQQQEEK

SEQ ID NO: 117070 - protein, 34 aa, Artificial Sequence
  Description of Artificial Sequence: Synthetic polypeptide
DEAEICTTNPVATECYGSVSTGNGLQDDDGKGES

SEQ ID NO: 117071 - protein, 35 aa, Artificial Sequence
  Description of Artificial Sequence: Synthetic polypeptide
DEEEIRTTNPVATEQYGSIVNSANDDENSGNEEIS

SEQ ID NO: 117072 - protein, 35 aa, Artificial Sequence
  Description of Artificial Sequence: Synthetic polypeptide
DEEEIRTTNPVATEQYGSVVSTVPDDDEQDEFNDD

SEQ ID NO: 117073 - protein, 36 aa, Artificial Sequence
  Description of Artificial Sequence: Synthetic polypeptide
DEEEIRTTNPVATEQYGSVVSTVPDDNDELDETNDD

SEQ ID NO: 117074 - protein, 35 aa, Artificial Sequence
  Description of Artificial Sequence: Synthetic polypeptide
DEEEIRTTNPVATEQYGSVSENGQAQESQQMNTIG

SEQ ID NO: 117075 - protein, 33 aa, Artificial Sequence
  Description of Artificial Sequence: Synthetic polypeptide
DEEEIRTTNPVATEQYGSIVNSGEVEDESEQRD

SEQ ID NO: 117076 - protein, 36 aa, Artificial Sequence
  Description of Artificial Sequence: Synthetic polypeptide
DEEEIRTTNPVATEQYGSVVSTWNMMWQEEMGVEEL

SEQ ID NO: 117077 - protein, 36 aa, Artificial Sequence
  Description of Artificial Sequence: Synthetic polypeptide
DEEEINTTNPVATEQYGETVVSYTNELSQESNPGNL

SEQ ID NO: 117078 - protein, 36 aa, Artificial Sequence
  Description of Artificial Sequence: Synthetic polypeptide
DEEEIRTTNPVATEQYGSVVSTTPDGPNMGNGENIT

SEQ ID NO: 117079 - protein, 35 aa, Artificial Sequence
  Description of Artificial Sequence: Synthetic polypeptide
DEEEIRTTNPVATEQYGSIVSCCGSNVSQGPGSYE

SEQ ID NO: 117080 - protein, 34 aa, Artificial Sequence
  Description of Artificial Sequence: Synthetic polypeptide
DEEEIRTTNPVATEQYGSVVSVLNALENETTEQN

SEQ ID NO: 117081 - protein, 33 aa, Artificial Sequence
  Description of Artificial Sequence: Synthetic polypeptide
DEAEIRTTNPVATEAWGSVSWMNENQDHEGSNQ

SEQ ID NO: 117082 - protein, 33 aa, Artificial Sequence
  Description of Artificial Sequence: Synthetic polypeptide
DEEEINTTNPVATEAYGSVCSTNSEFTVTGEFY

SEQ ID NO: 117083 - protein, 32 aa, Artificial Sequence
  Description of Artificial Sequence: Synthetic polypeptide
DEEEINTTNPMATETYGSVPTPDPQHAGENFQ

SEQ ID NO: 117084 - protein, 31 aa, Artificial Sequence
  Description of Artificial Sequence: Synthetic polypeptide
DEEEINPTNPVAYEQWGSASCSNLQGKNNAW

SEQ ID NO: 117085 - protein, 35 aa, Artificial Sequence
  Description of Artificial Sequence: Synthetic polypeptide
DEEEIRTTNPVATEQYGSVSEMWNLHQPEVVEFQT

SEQ ID NO: 117086 - protein, 35 aa, Artificial Sequence
  Description of Artificial Sequence: Synthetic polypeptide
DEEEIRTTNPVATEQYGSVVTDTMTGLQGEGQEGI

SEQ ID NO: 117087 - protein, 36 aa, Artificial Sequence
  Description of Artificial Sequence: Synthetic polypeptide
DEEEINTTNPVATEQYGETVVSTNELSQESTGGNPL

SEQ ID NO: 117088 - protein, 32 aa, Artificial Sequence
  Description of Artificial Sequence: Synthetic polypeptide
DEAEIRTTNPVATDAWGVVSCTNLSIEPVPNR

SEQ ID NO: 117089 - protein, 36 aa, Artificial Sequence
  Description of Artificial Sequence: Synthetic polypeptide
DEEEIRTTNPVATEQYGSVVSTTPAGPTNRNGGNPV

SEQ ID NO: 117090 - protein, 36 aa, Artificial Sequence
  Description of Artificial Sequence: Synthetic polypeptide
DEEEIRTTNPVATEQYGSVVSTTPAGPNMRNGMNPV

SEQ ID NO: 117091 - protein, 32 aa, Artificial Sequence
  Description of Artificial Sequence: Synthetic polypeptide
DEEEIRTTNPVATEQYGSITTIENNYGESDQE

SEQ ID NO: 117092 - protein, 34 aa, Artificial Sequence
  Description of Artificial Sequence: Synthetic polypeptide
DEAEIRTTNPVATECWGSVSCINEPQDRDGENKG

SEQ ID NO: 117093 - protein, 34 aa, Artificial Sequence
  Description of Artificial Sequence: Synthetic polypeptide
DEEEIRTTNPVATEQYGSIVCITTDDCGNEQPQD

SEQ ID NO: 117094 - protein, 33 aa, Artificial Sequence
  Description of Artificial Sequence: Synthetic polypeptide
DEAEIRTTNPVATECWGSVSCINEPNDREGEND

SEQ ID NO: 117095 - protein, 36 aa, Artificial Sequence
  Description of Artificial Sequence: Synthetic polypeptide
DEEEINTTNPVATEQYGIAVVPSTNLSDEQVGSPER

SEQ ID NO: 117096 - protein, 38 aa, Artificial Sequence
  Description of Artificial Sequence: Synthetic polypeptide
DEEEIRTTNPVATEQYGVVSTVVTSTTNLQAGNTEQGS

SEQ ID NO: 117097 - protein, 34 aa, Artificial Sequence
  Description of Artificial Sequence: Synthetic polypeptide
DEAEIRTTNPVATECWGSVPSCINEPQAREGENG

SEQ ID NO: 117098 - protein, 36 aa, Artificial Sequence
  Description of Artificial Sequence: Synthetic polypeptide
DEEEIRTTNPVATEQYGSVVSTTPAGPTMRNGMNPV

SEQ ID NO: 117099 - protein, 33 aa, Artificial Sequence
  Description of Artificial Sequence: Synthetic polypeptide
DEAEIRTTNPVATECWGSVNCQNEPQDRYGENG

SEQ ID NO: 117100 - protein, 33 aa, Artificial Sequence
  Description of Artificial Sequence: Synthetic polypeptide
DEAEIRTTNPVATECWGSISCINEPQVRDGENE

SEQ ID NO: 117101 - protein, 33 aa, Artificial Sequence
  Description of Artificial Sequence: Synthetic polypeptide
DEAEIRTTNPVATECWGSISCINEPQDREGENG

SEQ ID NO: 117102 - protein, 36 aa, Artificial Sequence
  Description of Artificial Sequence: Synthetic polypeptide
DEEEIRTTNPVATEQYGSVVSTTPAGPNARNGTNPV

SEQ ID NO: 117103 - protein, 36 aa, Artificial Sequence
  Description of Artificial Sequence: Synthetic polypeptide
DEEEIRTTNPVATEQYGSVVSTTPAGPNERTGMNPV

SEQ ID NO: 117104 - protein, 36 aa, Artificial Sequence
  Description of Artificial Sequence: Synthetic polypeptide
DEEEIRTTNPVATEQYGSVVSTTPAGPNMGNGTNGQ

SEQ ID NO: 117105 - protein, 36 aa, Artificial Sequence
  Description of Artificial Sequence: Synthetic polypeptide
DEEEIRTTNPVATEQYGSVVSTTPAGPNMQQPMNPV

SEQ ID NO: 117106 - protein, 36 aa, Artificial Sequence
  Description of Artificial Sequence: Synthetic polypeptide
DEEEIRTTNPVATEQYGSVVSTTPAGPNMRNGMNPK

SEQ ID NO: 117107 - protein, 37 aa, Artificial Sequence
  Description of Artificial Sequence: Synthetic polypeptide
DEEEIRTTNPVATEQYGVVSTVVTNTNLQQGTEETND

SEQ ID NO: 117108 - protein, 32 aa, Artificial Sequence
  Description of Artificial Sequence: Synthetic polypeptide
DEEEIRTTNPVATEQYGSITIQLNTGEEDQEE

SEQ ID NO: 117109 - protein, 33 aa, Artificial Sequence
  Description of Artificial Sequence: Synthetic polypeptide
DEAEIRTTNPVATDAWGSVSCTNLSDNEPVPNR

SEQ ID NO: 117110 - protein, 33 aa, Artificial Sequence
  Description of Artificial Sequence: Synthetic polypeptide
DEAEIRTTNPVATDAWGSVSCTNDSQEPVPNRV

SEQ ID NO: 117111 - protein, 36 aa, Artificial Sequence
  Description of Artificial Sequence: Synthetic polypeptide
DEEEIRTTNPVATEQYGSVSECTLLEQNEDGQELES

SEQ ID NO: 117112 - protein, 37 aa, Artificial Sequence
  Description of Artificial Sequence: Synthetic polypeptide
DEEEIRTTNPVATEQYGVVSTVVTNLQSGTNQEEEND

SEQ ID NO: 117113 - protein, 37 aa, Artificial Sequence
  Description of Artificial Sequence: Synthetic polypeptide
DEEEIRTTNPVATEQYGVVSTVVTNLQSGTNEDEEEE

SEQ ID NO: 117114 - protein, 37 aa, Artificial Sequence
  Description of Artificial Sequence: Synthetic polypeptide
DEEEIRTTNPVATEQYGVVSTVVTNLQSGTENQGNNQ

SEQ ID NO: 117115 - protein, 37 aa, Artificial Sequence
  Description of Artificial Sequence: Synthetic polypeptide
DEEEIRTTNPVATEQYGVVSTVVTNLQSGNQQGTTED

SEQ ID NO: 117116 - protein, 37 aa, Artificial Sequence
  Description of Artificial Sequence: Synthetic polypeptide
DEEEIRTTNPVATEQYGVVSTVVTNLQSGNQQGTEDD

SEQ ID NO: 117117 - protein, 35 aa, Artificial Sequence
  Description of Artificial Sequence: Synthetic polypeptide
DEEEIRTTNPVATEQYGSVVTTNGMGNLDEEFNQT

SEQ ID NO: 117118 - protein, 37 aa, Artificial Sequence
  Description of Artificial Sequence: Synthetic polypeptide
DEEEIRTTNPVATEQYGVVSTVVTNLQYGNNNEDEDE

SEQ ID NO: 117119 - protein, 36 aa, Artificial Sequence
  Description of Artificial Sequence: Synthetic polypeptide
DEEEIRTTNPVATEQYGSVSDYTPAGPNMRNGMNPV

SEQ ID NO: 117120 - protein, 35 aa, Artificial Sequence
  Description of Artificial Sequence: Synthetic polypeptide
DEEEIRTTNPVATEQYGSMSATTPAGPQRNGMDPI

SEQ ID NO: 117121 - protein, 35 aa, Artificial Sequence
  Description of Artificial Sequence: Synthetic polypeptide
DEEEIRTTNPVATEQYGSVSDTVPELQTQQVLEVA

SEQ ID NO: 117122 - protein, 36 aa, Artificial Sequence
  Description of Artificial Sequence: Synthetic polypeptide
DEEEIRTTNPVATEQYGSVSDTTPAGPNNRNGMNPV

SEQ ID NO: 117123 - protein, 36 aa, Artificial Sequence
  Description of Artificial Sequence: Synthetic polypeptide
DEEEIRTTNPVATEQYGSVSDTTPAGPNMRSGMNPV

SEQ ID NO: 117124 - protein, 36 aa, Artificial Sequence
  Description of Artificial Sequence: Synthetic polypeptide
DEEEIRTTNPVATEQYGSVSDTTPAGPNMRNGMNPV

SEQ ID NO: 117125 - protein, 36 aa, Artificial Sequence
  Description of Artificial Sequence: Synthetic polypeptide
DEEEIRTTNPVATEQYGSMSSTTPAGPQMRNGMNPV

SEQ ID NO: 117126 - protein, 36 aa, Artificial Sequence
  Description of Artificial Sequence: Synthetic polypeptide
DEEEIRTTNPVATEQYGSVSDTTPAGANMRNGMNPV

SEQ ID NO: 117127 - protein, 33 aa, Artificial Sequence
  Description of Artificial Sequence: Synthetic polypeptide
DEEEIRTTNPVATEQYGSVVTVQSHFENSEEKY

SEQ ID NO: 117128 - protein, 34 aa, Artificial Sequence
  Description of Artificial Sequence: Synthetic polypeptide
DEEEIKTTNPVAYEYYGQSVPSYTGEPQSVGNDR

SEQ ID NO: 117129 - protein, 35 aa, Artificial Sequence
  Description of Artificial Sequence: Synthetic polypeptide
DEEEIRTTNPVATEQYGSVVTTGMNNEGGEQGGET

SEQ ID NO: 117130 - protein, 36 aa, Artificial Sequence
  Description of Artificial Sequence: Synthetic polypeptide
DEEEIRTTNPVATEQYGSVVTTGDNNQTGETGGNED

SEQ ID NO: 117131 - protein, 33 aa, Artificial Sequence
  Description of Artificial Sequence: Synthetic polypeptide
DEAEIRTTNPVATDAWGSVSCNNLSQEPVPNRI

SEQ ID NO: 117132 - protein, 35 aa, Artificial Sequence
  Description of Artificial Sequence: Synthetic polypeptide
DEEEIRTTNPVATEQYGSIYPTMNPLQIHVVQNGD

SEQ ID NO: 117133 - protein, 33 aa, Artificial Sequence
  Description of Artificial Sequence: Synthetic polypeptide
DEAEIRTTNPVATDAWGSVCSCTSLSQEPGPNP

SEQ ID NO: 117134 - protein, 34 aa, Artificial Sequence
  Description of Artificial Sequence: Synthetic polypeptide
DEAEIRTTNPVATDAWGSSVSCTMNLSQEPVPNR

SEQ ID NO: 117135 - protein, 34 aa, Artificial Sequence
  Description of Artificial Sequence: Synthetic polypeptide
DEAEIRTTNPVATDAWGEVSCTNLSQQEPGPNRF

SEQ ID NO: 117136 - protein, 32 aa, Artificial Sequence
  Description of Artificial Sequence: Synthetic polypeptide
DEAEIRTTNPVATDAWGDVSCTNLSQEPVPNA

SEQ ID NO: 117137 - protein, 34 aa, Artificial Sequence
  Description of Artificial Sequence: Synthetic polypeptide
DEEEIRTTNPVATEQYGSVVTLVQSHFENWSEEK

SEQ ID NO: 117138 - protein, 36 aa, Artificial Sequence
  Description of Artificial Sequence: Synthetic polypeptide
DEEEIRTTNPVATEQYGSVSEEEAVLQSVVGVNSEN

SEQ ID NO: 117139 - protein, 37 aa, Artificial Sequence
  Description of Artificial Sequence: Synthetic polypeptide
DEEEIRTTNPVATEQYGVVSTVVTNQNLQQGNTETGS

SEQ ID NO: 117140 - protein, 33 aa, Artificial Sequence
  Description of Artificial Sequence: Synthetic polypeptide
DEAEIRTTNPVATCHYGCVCSTNHNQERFTSNQ

SEQ ID NO: 117141 - protein, 34 aa, Artificial Sequence
  Description of Artificial Sequence: Synthetic polypeptide
DEEEIKTTNPVAYEQYGQAVPSYTGEPQPVGNDR

SEQ ID NO: 117142 - protein, 34 aa, Artificial Sequence
  Description of Artificial Sequence: Synthetic polypeptide
DEEEIRTTNPVATEQYGSVSEMDGDEHDSGQNDM

SEQ ID NO: 117143 - protein, 35 aa, Artificial Sequence
  Description of Artificial Sequence: Synthetic polypeptide
DEEEIRTTNPVATEQYGSVSELNGLEQADFVEQAQ

SEQ ID NO: 117144 - protein, 35 aa, Artificial Sequence
  Description of Artificial Sequence: Synthetic polypeptide
DEEEIRTTNPVATEQYGSLSPTNIGLNVFGQVTEN

SEQ ID NO: 117145 - protein, 34 aa, Artificial Sequence
  Description of Artificial Sequence: Synthetic polypeptide
DEEEIKTTNPVAVDQYGQVNVSTVNDLQRPGVKD

SEQ ID NO: 117146 - protein, 35 aa, Artificial Sequence
  Description of Artificial Sequence: Synthetic polypeptide
DEEEIRTTNPVATEQYGSLSPTNWIGERFGQLQFE

SEQ ID NO: 117147 - protein, 33 aa, Artificial Sequence
  Description of Artificial Sequence: Synthetic polypeptide
DEAEIRTTNPVATCHYGCVCSTNLQYFTSNNQG

SEQ ID NO: 117148 - protein, 33 aa, Artificial Sequence
  Description of Artificial Sequence: Synthetic polypeptide
DEAEIRTTNPVATECWGSVSCINEPQMSDGENF

SEQ ID NO: 117149 - protein, 34 aa, Artificial Sequence
  Description of Artificial Sequence: Synthetic polypeptide
DEAEIRTTNPVATECWGSVSCINEPQVRDGENIM

SEQ ID NO: 117150 - protein, 33 aa, Artificial Sequence
  Description of Artificial Sequence: Synthetic polypeptide
DEAEIRTTNPVATECWGSVSCINEPRDREGENG

SEQ ID NO: 117151 - protein, 36 aa, Artificial Sequence
  Description of Artificial Sequence: Synthetic polypeptide
DEEEIRTTNPVATEQYGSVSETTPAGPNMRNGMNPV

SEQ ID NO: 117152 - protein, 36 aa, Artificial Sequence
  Description of Artificial Sequence: Synthetic polypeptide
DEEEIRTTNPVATEQYGSVSETTPAGPNMDNGMNPV

SEQ ID NO: 117153 - protein, 33 aa, Artificial Sequence
  Description of Artificial Sequence: Synthetic polypeptide
DEECIRTTNPVAYEQYGCVSTINWVETMIGENQ

SEQ ID NO: 117154 - protein, 34 aa, Artificial Sequence
  Description of Artificial Sequence: Synthetic polypeptide
DEEEIRTTNPVATEQYGSVSETPQIVNSGLLEQE

SEQ ID NO: 117155 - protein, 36 aa, Artificial Sequence
  Description of Artificial Sequence: Synthetic polypeptide
DEEEIRTTNPVATEQYGSVSETPPLQEEAQSSEVRE

SEQ ID NO: 117156 - protein, 35 aa, Artificial Sequence
  Description of Artificial Sequence: Synthetic polypeptide
DEEEIRTTNPVATEQYGSVSETPGERATLTIVNEA

SEQ ID NO: 117157 - protein, 35 aa, Artificial Sequence
  Description of Artificial Sequence: Synthetic polypeptide
DEECIRTTNPVAYEQYGSTVPATLNEQSGRNGEER

SEQ ID NO: 117158 - protein, 34 aa, Artificial Sequence
  Description of Artificial Sequence: Synthetic polypeptide
DEECIRTTNPVAYEQYGCVSTINVETTRIGENIQ

SEQ ID NO: 117159 - protein, 33 aa, Artificial Sequence
  Description of Artificial Sequence: Synthetic polypeptide
DEECIRTTNPVAYEQYGVTVQSYFGELSTGGNR

SEQ ID NO: 117160 - protein, 30 aa, Artificial Sequence
  Description of Artificial Sequence: Synthetic polypeptide
DEECIRTTNPVAYEQYSEEVTTGDNHGNAS

SEQ ID NO: 117161 - protein, 31 aa, Artificial Sequence
  Description of Artificial Sequence: Synthetic polypeptide
DEECIRTTNPVAYEQYSEEVTTGDNHNGGER

SEQ ID NO: 117162 - protein, 31 aa, Artificial Sequence
  Description of Artificial Sequence: Synthetic polypeptide
DEECIRTTNPVAYEQYSEEVTTGDNHNGNHR

SEQ ID NO: 117163 - protein, 36 aa, Artificial Sequence
  Description of Artificial Sequence: Synthetic polypeptide
DEEEIRTTNPVATEQYGSISLTPNLDQQNAGVQLQY

SEQ ID NO: 117164 - protein, 31 aa, Artificial Sequence
  Description of Artificial Sequence: Synthetic polypeptide
DEECIRTTNPVAYEQYSEEVTTTGDNHGNQR

SEQ ID NO: 117165 - protein, 35 aa, Artificial Sequence
  Description of Artificial Sequence: Synthetic polypeptide
DEEEIRTTNPVATEQYGSISLTPNNDQPNAGMQLQ

SEQ ID NO: 117166 - protein, 33 aa, Artificial Sequence
  Description of Artificial Sequence: Synthetic polypeptide
DEECIRTTNPVSTEQYGSVYIIDNLQDGHGQTD

SEQ ID NO: 117167 - protein, 31 aa, Artificial Sequence
  Description of Artificial Sequence: Synthetic polypeptide
DEECIRTTNPVAYEQYSEEVATGDNHNGGSR

SEQ ID NO: 117168 - protein, 36 aa, Artificial Sequence
  Description of Artificial Sequence: Synthetic polypeptide
DEEEIRTTNPVATEQYGSVSETMNNILGRDMVDLDY

SEQ ID NO: 117169 - protein, 33 aa, Artificial Sequence
  Description of Artificial Sequence: Synthetic polypeptide
DEECIRTTNPVAYEQYGCVSTINVETRTGEGPQ

SEQ ID NO: 117170 - protein, 33 aa, Artificial Sequence
  Description of Artificial Sequence: Synthetic polypeptide
DEECIRTTNPVAYEQYGCVSTINVESRIGEGQD

SEQ ID NO: 117171 - protein, 32 aa, Artificial Sequence
  Description of Artificial Sequence: Synthetic polypeptide
DEECIRTTNPVAYEQYGCVCSTGEDQHFGSQQ

SEQ ID NO: 117172 - protein, 34 aa, Artificial Sequence
  Description of Artificial Sequence: Synthetic polypeptide
DEAEIRTTNPVATEPFGCASNQLTPNLKAERGNR

SEQ ID NO: 117173 - protein, 33 aa, Artificial Sequence
  Description of Artificial Sequence: Synthetic polypeptide
DEECIRTTNPVAYEQYGCVCSTGEDQYFGSNQF

SEQ ID NO: 117174 - protein, 34 aa, Artificial Sequence
  Description of Artificial Sequence: Synthetic polypeptide
DEAEIRTTNPVATEMYGSVCFTQMLLTQGGGQNE

SEQ ID NO: 117175 - protein, 37 aa, Artificial Sequence
  Description of Artificial Sequence: Synthetic polypeptide
DEEEIRTTNPVATEQYGSVVSPNTNLHEMGFGETNHM

SEQ ID NO: 117176 - protein, 34 aa, Artificial Sequence
  Description of Artificial Sequence: Synthetic polypeptide
DEAEIRTTNPVATEMYGSVCFTGQMLLTRGNQNE

SEQ ID NO: 117177 - protein, 34 aa, Artificial Sequence
  Description of Artificial Sequence: Synthetic polypeptide
DEECIRTTNPVAYEQYGCVCSTGNHQEYFGSNQI

SEQ ID NO: 117178 - protein, 32 aa, Artificial Sequence
  Description of Artificial Sequence: Synthetic polypeptide
DEECIRTTNPVAYEQYGCVSTINVETRIFEMQ

SEQ ID NO: 117179 - protein, 33 aa, Artificial Sequence
  Description of Artificial Sequence: Synthetic polypeptide
DEECIRTTNPVAYEQYGCVCSTGNHQHFGSQQG

SEQ ID NO: 117180 - protein, 33 aa, Artificial Sequence
  Description of Artificial Sequence: Synthetic polypeptide
DEECIRTTNPVAYEQYGCVCSTGNHQYSGSDQS

SEQ ID NO: 117181 - protein, 36 aa, Artificial Sequence
  Description of Artificial Sequence: Synthetic polypeptide
DEEEIRTTNPVATEQYGSVVSPSPNLNLRQGQEATL

SEQ ID NO: 117182 - protein, 36 aa, Artificial Sequence
  Description of Artificial Sequence: Synthetic polypeptide
DEEEIRTTNPVATEQYGSVVSPTPAGPNERQGMNPV

SEQ ID NO: 117183 - protein, 34 aa, Artificial Sequence
  Description of Artificial Sequence: Synthetic polypeptide
DEEEIRTTNPVATEQYGSVSFANSQHNEVVELDG

SEQ ID NO: 117184 - protein, 37 aa, Artificial Sequence
  Description of Artificial Sequence: Synthetic polypeptide
DEEEIRTTNPVATEQYGVVSTVVVTNLQAGNTETGSE

SEQ ID NO: 117185 - protein, 35 aa, Artificial Sequence
  Description of Artificial Sequence: Synthetic polypeptide
DEEEIRTTNPVATEQYGSVVSTFGEQQLEMMENAF

SEQ ID NO: 117186 - protein, 37 aa, Artificial Sequence
  Description of Artificial Sequence: Synthetic polypeptide
DEEEIRTTNPVATEQYGVVSTVVVTNLQAGNQETTDG

SEQ ID NO: 117187 - protein, 37 aa, Artificial Sequence
  Description of Artificial Sequence: Synthetic polypeptide
DEEEIRTTNPVATEQYGVVSTVVVTNLQQGTNQEEED

SEQ ID NO: 117188 - protein, 36 aa, Artificial Sequence
  Description of Artificial Sequence: Synthetic polypeptide
DEEEIRTTNPVATEQYGSVSETGVSLDVAEIMNMRD

SEQ ID NO: 117189 - protein, 36 aa, Artificial Sequence
  Description of Artificial Sequence: Synthetic polypeptide
DEEEIRTTNPVATEQYGSVSETGNGLDQASFVEPAQ

SEQ ID NO: 117190 - protein, 36 aa, Artificial Sequence
  Description of Artificial Sequence: Synthetic polypeptide
DEEEIRTTNPVATEQYGSVSETGNGAIMELGQENMI

SEQ ID NO: 117191 - protein, 34 aa, Artificial Sequence
  Description of Artificial Sequence: Synthetic polypeptide
DEEEIRTTNPVATEQYGSVSENNNDVSVGVEEPA

SEQ ID NO: 117192 - protein, 34 aa, Artificial Sequence
  Description of Artificial Sequence: Synthetic polypeptide
DEEEIRTTNPVATEQYGSITHTNLEDNNDEGEEQ

SEQ ID NO: 117193 - protein, 34 aa, Artificial Sequence
  Description of Artificial Sequence: Synthetic polypeptide
DEAEIRTTNPVATECWGSVSCINREPQDREGENG

SEQ ID NO: 117194 - protein, 34 aa, Artificial Sequence
  Description of Artificial Sequence: Synthetic polypeptide
DEAEIRTTNPVATECWGSVSCINLEPQVSDGENG

SEQ ID NO: 117195 - protein, 35 aa, Artificial Sequence
  Description of Artificial Sequence: Synthetic polypeptide
DEEEIRTTNPVATEQYGSVSENNIVNDTQQNDGQL

SEQ ID NO: 117196 - protein, 33 aa, Artificial Sequence
  Description of Artificial Sequence: Synthetic polypeptide
DEAEIRTTNPVATECWGSVSCINGPDVRDGENE

SEQ ID NO: 117197 - protein, 34 aa, Artificial Sequence
  Description of Artificial Sequence: Synthetic polypeptide
DEEEIRTTNPVATEQYGSVSENNESDMSGVEEPA

SEQ ID NO: 117198 - protein, 34 aa, Artificial Sequence
  Description of Artificial Sequence: Synthetic polypeptide
DEEEIRTTNPVATEQYGSVSENNPYMSQGVEPPA

SEQ ID NO: 117199 - protein, 33 aa, Artificial Sequence
  Description of Artificial Sequence: Synthetic polypeptide
DEEEIRTTNPVATEQYGSVSENNEDDIEMVVVV

SEQ ID NO: 117200 - protein, 34 aa, Artificial Sequence
  Description of Artificial Sequence: Synthetic polypeptide
DEEEIRTTNPVATEQYGSVSENMEGLDEALEAGE

SEQ ID NO: 117201 - protein, 33 aa, Artificial Sequence
  Description of Artificial Sequence: Synthetic polypeptide
DEAEIRTTNPVATECWGSVSCINETQHEGMENM

SEQ ID NO: 117202 - protein, 33 aa, Artificial Sequence
  Description of Artificial Sequence: Synthetic polypeptide
DEECISTTNPVATEGYGCVCNTNALQRSGSEQA

SEQ ID NO: 117203 - protein, 32 aa, Artificial Sequence
  Description of Artificial Sequence: Synthetic polypeptide
DEECISTTNPVATEGYGCVCNTNGPQRFGSDQ

SEQ ID NO: 117204 - protein, 32 aa, Artificial Sequence
  Description of Artificial Sequence: Synthetic polypeptide
DEECISTTNPVATEGYGCVCNTNPLANFGSNQ

SEQ ID NO: 117205 - protein, 34 aa, Artificial Sequence
  Description of Artificial Sequence: Synthetic polypeptide
DEECISTTNPVATEGYGCVCNTNPLQERFGSNQA

SEQ ID NO: 117206 - protein, 32 aa, Artificial Sequence
  Description of Artificial Sequence: Synthetic polypeptide
DEECISTTNPVATEGYGCVCQTNGLQYFGSDQ

SEQ ID NO: 117207 - protein, 34 aa, Artificial Sequence
  Description of Artificial Sequence: Synthetic polypeptide
DEEEIRTTNPVATEQYGSVSENMNNDQIILTEEE

SEQ ID NO: 117208 - protein, 34 aa, Artificial Sequence
  Description of Artificial Sequence: Synthetic polypeptide
DEEEIRTTNPVATEQYGSISTTPLQVVAQMQEQL

SEQ ID NO: 117209 - protein, 35 aa, Artificial Sequence
  Description of Artificial Sequence: Synthetic polypeptide
DEEEIRTTNPVATEQYGSISTTPDGPNMRNGMNPV

SEQ ID NO: 117210 - protein, 35 aa, Artificial Sequence
  Description of Artificial Sequence: Synthetic polypeptide
DEEEIRTTNPVATEQYGSISTTLNLVQENVELTFD

SEQ ID NO: 117211 - protein, 35 aa, Artificial Sequence
  Description of Artificial Sequence: Synthetic polypeptide
DEEEIRTTNPVATEQYGSVSETGIEVQEDEGELMT

SEQ ID NO: 117212 - protein, 32 aa, Artificial Sequence
  Description of Artificial Sequence: Synthetic polypeptide
DEECISCTNPVATEQYGCVCSWNHQRFGSDQS

SEQ ID NO: 117213 - protein, 34 aa, Artificial Sequence
  Description of Artificial Sequence: Synthetic polypeptide
DEEEIRTTNPVATEQYGSVSETAGVIIREEQSVE

SEQ ID NO: 117214 - protein, 35 aa, Artificial Sequence
  Description of Artificial Sequence: Synthetic polypeptide
DEEEIRTTNPVATEQYGSVSESVSDSQARGEQLEM

SEQ ID NO: 117215 - protein, 36 aa, Artificial Sequence
  Description of Artificial Sequence: Synthetic polypeptide
DEEEIRTTNPVATEQYGSISSTMPAIPQMRNGMNPH

SEQ ID NO: 117216 - protein, 37 aa, Artificial Sequence
  Description of Artificial Sequence: Synthetic polypeptide
DEEEIRTTNPVATEQYGVVSTVVVNLQQGNNNEEDED

SEQ ID NO: 117217 - protein, 37 aa, Artificial Sequence
  Description of Artificial Sequence: Synthetic polypeptide
DEEEIRTTNPVATEQYGVVSTVVVNLQGNQAGNNEGE

SEQ ID NO: 117218 - protein, 33 aa, Artificial Sequence
  Description of Artificial Sequence: Synthetic polypeptide
DEEEIRTTNPVATEQYGSVSEQNNMMIVVAEPQ

SEQ ID NO: 117219 - protein, 36 aa, Artificial Sequence
  Description of Artificial Sequence: Synthetic polypeptide
DEEEIRTTNPVATEQYGSISSTTPAGPQMRNGMNPV

SEQ ID NO: 117220 - protein, 33 aa, Artificial Sequence
  Description of Artificial Sequence: Synthetic polypeptide
DEEEIRTTNPVATEQYGSVSEPVGMERNMQVHI

SEQ ID NO: 117221 - protein, 35 aa, Artificial Sequence
  Description of Artificial Sequence: Synthetic polypeptide
DEEEIRTTNPVATEQYGSVSEPNSGQQERQIMLTE

SEQ ID NO: 117222 - protein, 34 aa, Artificial Sequence
  Description of Artificial Sequence: Synthetic polypeptide
DEEEIRTTNPVATEQYGSVSEPIVGMERNGLVHI

SEQ ID NO: 117223 - protein, 34 aa, Artificial Sequence
  Description of Artificial Sequence: Synthetic polypeptide
DEEEIQTTNPVATEAYGITTVQSCTDALQKAGNE

SEQ ID NO: 117224 - protein, 34 aa, Artificial Sequence
  Description of Artificial Sequence: Synthetic polypeptide
DEEEIRTTNPVATEQYGSISTNPGHQIQIPEQVD

SEQ ID NO: 117225 - protein, 34 aa, Artificial Sequence
  Description of Artificial Sequence: Synthetic polypeptide
DEAEIRTTNPVATECWGSVSPCINEPQDREGENG

SEQ ID NO: 117226 - protein, 35 aa, Artificial Sequence
  Description of Artificial Sequence: Synthetic polypeptide
DEEEINTTNPVATEQYGSTVSTNEFSQESNVGPEL

SEQ ID NO: 117227 - protein, 34 aa, Artificial Sequence
  Description of Artificial Sequence: Synthetic polypeptide
DEAEIRTTNPVATECWGSVSCQNEPQDRYGENQQ

SEQ ID NO: 117228 - protein, 34 aa, Artificial Sequence
  Description of Artificial Sequence: Synthetic polypeptide
DEEEIKTTNPVATEQYGNVSGTDQGNGQGGTGGQ

SEQ ID NO: 117229 - protein, 35 aa, Artificial Sequence
  Description of Artificial Sequence: Synthetic polypeptide
DEEEIRTTNPVATEQYGSMTTIMTNGGQGGENEGN

SEQ ID NO: 117230 - protein, 35 aa, Artificial Sequence
  Description of Artificial Sequence: Synthetic polypeptide
DEEEIRTTNPVATEQYGSVSDTPNDIQQNISVEEW

SEQ ID NO: 117231 - protein, 35 aa, Artificial Sequence
  Description of Artificial Sequence: Synthetic polypeptide
DEEEIRTTNPVATEQYGSVSDTNQMDNGGGEDQGE

SEQ ID NO: 117232 - protein, 34 aa, Artificial Sequence
  Description of Artificial Sequence: Synthetic polypeptide
DEEEIGTTNPVATEQYGCVCSTGELQEFFGSDQS

SEQ ID NO: 117233 - protein, 37 aa, Artificial Sequence
  Description of Artificial Sequence: Synthetic polypeptide
DEEEIRTTNPVATEQYGVVSTVVTNLGNQIGTNEQGQ

SEQ ID NO: 117234 - protein, 35 aa, Artificial Sequence
  Description of Artificial Sequence: Synthetic polypeptide
DEEEIRTTNPVATEQYGSTCSMTEEPNQNIGSNQS

SEQ ID NO: 117235 - protein, 34 aa, Artificial Sequence
  Description of Artificial Sequence: Synthetic polypeptide
DEEEIRTTNPVATEQYGSTCSMTEETNQNIGSDQ

SEQ ID NO: 117236 - protein, 37 aa, Artificial Sequence
  Description of Artificial Sequence: Synthetic polypeptide
DEEEIRTTNPVATEQYGVVSTVVTNLGGNQAGNEEGS

SEQ ID NO: 117237 - protein, 35 aa, Artificial Sequence
  Description of Artificial Sequence: Synthetic polypeptide
DEEEIRTTNPVATEQYGSVVWPTGTLEGMNMEIRD

SEQ ID NO: 117238 - protein, 36 aa, Artificial Sequence
  Description of Artificial Sequence: Synthetic polypeptide
DEEEIRTTNPVATEQYGSVSCTMPDMAADVGSNDRF

SEQ ID NO: 117239 - protein, 35 aa, Artificial Sequence
  Description of Artificial Sequence: Synthetic polypeptide
DEEEIGTTNPVATEQYGCVCSTGNDLQEHMGSDQS

SEQ ID NO: 117240 - protein, 36 aa, Artificial Sequence
  Description of Artificial Sequence: Synthetic polypeptide
DEECISTTNPVAYEQYGQSTVSVTNELAQRTGGERV

SEQ ID NO: 117241 - protein, 31 aa, Artificial Sequence
  Description of Artificial Sequence: Synthetic polypeptide
DEECISTVNPVATEEYGCVCSWNHERGSNQA

SEQ ID NO: 117242 - protein, 30 aa, Artificial Sequence
  Description of Artificial Sequence: Synthetic polypeptide
DEECISTVNPVATEEYGCVCSWNLENGSDQ

SEQ ID NO: 117243 - protein, 34 aa, Artificial Sequence
  Description of Artificial Sequence: Synthetic polypeptide
DEEEIRTTNPVATEQYGSTMYEPDTEEQRTENLI

SEQ ID NO: 117244 - protein, 34 aa, Artificial Sequence
  Description of Artificial Sequence: Synthetic polypeptide
DEEEIGTTNPVATEQYGCVCSTEELNQNFNSDQS

SEQ ID NO: 117245 - protein, 33 aa, Artificial Sequence
  Description of Artificial Sequence: Synthetic polypeptide
DEEEIGTTNPVATEQYGCVCSTEELINFGSDDS

SEQ ID NO: 117246 - protein, 32 aa, Artificial Sequence
  Description of Artificial Sequence: Synthetic polypeptide
DEECISTVNPVATEGYGCVCSWNLARFGSNQS

SEQ ID NO: 117247 - protein, 34 aa, Artificial Sequence
  Description of Artificial Sequence: Synthetic polypeptide
DEEEIRTTNPVATEQYGSVVYENMTQEIGSELIE

SEQ ID NO: 117248 - protein, 32 aa, Artificial Sequence
  Description of Artificial Sequence: Synthetic polypeptide
DEECISTVNPVATEAYGCVCSWNLEERFGSNQ

SEQ ID NO: 117249 - protein, 33 aa, Artificial Sequence
  Description of Artificial Sequence: Synthetic polypeptide
DEEEIGTTNPVATEQYGCVCSTEDHQNSGSEQQ

SEQ ID NO: 117250 - protein, 33 aa, Artificial Sequence
  Description of Artificial Sequence: Synthetic polypeptide
DEEEIRTTNPVATEQYGSVVWPGVHQRMVEEQE

SEQ ID NO: 117251 - protein, 31 aa, Artificial Sequence
  Description of Artificial Sequence: Synthetic polypeptide
DEAEIRTTNPIATEAWGSCSKNEDAQGGGNM

SEQ ID NO: 117252 - protein, 36 aa, Artificial Sequence
  Description of Artificial Sequence: Synthetic polypeptide
DEEEIRTTNPVATEQYGSVSCTTPAGPNPRNGMNPV

SEQ ID NO: 117253 - protein, 37 aa, Artificial Sequence
  Description of Artificial Sequence: Synthetic polypeptide
DEEEIRTTNPVATEQYGVVSTVVTNLQAGNEQGEEDE

SEQ ID NO: 117254 - protein, 37 aa, Artificial Sequence
  Description of Artificial Sequence: Synthetic polypeptide
DEEEIRTTNPVATEQYGVVSTVVTNLQAGNEEEDEEE

SEQ ID NO: 117255 - protein, 37 aa, Artificial Sequence
  Description of Artificial Sequence: Synthetic polypeptide
DEEEIRTTNPVATEQYGVVSTVVTNLQAGNDEEAEDE

SEQ ID NO: 117256 - protein, 36 aa, Artificial Sequence
  Description of Artificial Sequence: Synthetic polypeptide
DEEEIRTTNPVATEQYGSVSCTTPAGPNMRNGMNPV

SEQ ID NO: 117257 - protein, 36 aa, Artificial Sequence
  Description of Artificial Sequence: Synthetic polypeptide
DEEEIRTTNPVATEQYGSVSCTTPAGPNMRNGMNEV

SEQ ID NO: 117258 - protein, 37 aa, Artificial Sequence
  Description of Artificial Sequence: Synthetic polypeptide
DEEEIRTTNPVATEQYGVVSTVVTNLQAGGNNQEEDD

SEQ ID NO: 117259 - protein, 32 aa, Artificial Sequence
  Description of Artificial Sequence: Synthetic polypeptide
DEEEIRTTNPVATEQYGSVVWLVSHFENSEEK

SEQ ID NO: 117260 - protein, 37 aa, Artificial Sequence
  Description of Artificial Sequence: Synthetic polypeptide
DEEEIRTTNPVATEQYGVVSTVVTNLNQQQGNNEQGE

SEQ ID NO: 117261 - protein, 33 aa, Artificial Sequence
  Description of Artificial Sequence: Synthetic polypeptide
DEEEIRTTNPVATEQYGSSSVIIDPQYQGEDGQ

SEQ ID NO: 117262 - protein, 35 aa, Artificial Sequence
  Description of Artificial Sequence: Synthetic polypeptide
DEEEIRTTNPVATEQYGSSSVTDYLTNLESTQNDD

SEQ ID NO: 117263 - protein, 35 aa, Artificial Sequence
  Description of Artificial Sequence: Synthetic polypeptide
DEEEIRTTNPVATEQYGSVVVTTNTLENPELQNFN

SEQ ID NO: 117264 - protein, 37 aa, Artificial Sequence
  Description of Artificial Sequence: Synthetic polypeptide
DEEEIRTTNPVATEQYGVVSTVVTNLNGNQQGNDEES

SEQ ID NO: 117265 - protein, 36 aa, Artificial Sequence
  Description of Artificial Sequence: Synthetic polypeptide
DEEEIRTTNPVATEQYGVVSTVVTNLNEQYGTDEED

SEQ ID NO: 117266 - protein, 34 aa, Artificial Sequence
  Description of Artificial Sequence: Synthetic polypeptide
DEEEIGTTNPVATEQYGCVCSTNEHNQNFGSEQP

SEQ ID NO: 117267 - protein, 35 aa, Artificial Sequence
  Description of Artificial Sequence: Synthetic polypeptide
DEEEIGTTNPVATEQYGCVCSTNDHQEYMGSNNQA

SEQ ID NO: 117268 - protein, 34 aa, Artificial Sequence
  Description of Artificial Sequence: Synthetic polypeptide
DEEEIGTTNPVATEQYGCVCSWNDLQENFGSQLS

SEQ ID NO: 117269 - protein, 34 aa, Artificial Sequence
  Description of Artificial Sequence: Synthetic polypeptide
DEEEIRTTNPVATEQYGSTPSVTGVLQVVVQEDP

SEQ ID NO: 117270 - protein, 35 aa, Artificial Sequence
  Description of Artificial Sequence: Synthetic polypeptide
DEEEIRTTNPVATEQYGSTSATAPAGNERNGMNPI

SEQ ID NO: 117271 - protein, 33 aa, Artificial Sequence
  Description of Artificial Sequence: Synthetic polypeptide
DEEEIRTTNPVATEQYGSVVYPTMESQDVTVQQ

SEQ ID NO: 117272 - protein, 33 aa, Artificial Sequence
  Description of Artificial Sequence: Synthetic polypeptide
DEEEICTTNPVAYESWGVVSTNLQGNAGENDGM

SEQ ID NO: 117273 - protein, 36 aa, Artificial Sequence
  Description of Artificial Sequence: Synthetic polypeptide
DEEEIRTTNPVATEQYGSVSAYFNYMQIRENPQIDT

SEQ ID NO: 117274 - protein, 35 aa, Artificial Sequence
  Description of Artificial Sequence: Synthetic polypeptide
DEEEIRTTNPVATEQYGSTTSSTAPAWNMRKGNPI

SEQ ID NO: 117275 - protein, 35 aa, Artificial Sequence
  Description of Artificial Sequence: Synthetic polypeptide
DEEEIRTTNPVATEQYGSVWLTPNQHQERDQVIDD

SEQ ID NO: 117276 - protein, 33 aa, Artificial Sequence
  Description of Artificial Sequence: Synthetic polypeptide
DEEEICTTNPVAYEQYGSVPVTATSQPVGKTRP

SEQ ID NO: 117277 - protein, 36 aa, Artificial Sequence
  Description of Artificial Sequence: Synthetic polypeptide
DEEEIRTTNPVATEQYGSVSATWPAGPNMLNGMNPV

SEQ ID NO: 117278 - protein, 36 aa, Artificial Sequence
  Description of Artificial Sequence: Synthetic polypeptide
DEEEIRTTNPVATEQYGSVSATWGAGVEMRNGMNPV

SEQ ID NO: 117279 - protein, 34 aa, Artificial Sequence
  Description of Artificial Sequence: Synthetic polypeptide
DEEEIRTTNPVATEQYGSVSAYNDLASEEMIEVQ

SEQ ID NO: 117280 - protein, 36 aa, Artificial Sequence
  Description of Artificial Sequence: Synthetic polypeptide
DEEEIRTTNPVATEQYGSVSATWGAGPEARNGGNPV

SEQ ID NO: 117281 - protein, 36 aa, Artificial Sequence
  Description of Artificial Sequence: Synthetic polypeptide
DEEEIRTTNPVATEQYGSVSATTPHGPNPRNGMNPV

SEQ ID NO: 117282 - protein, 36 aa, Artificial Sequence
  Description of Artificial Sequence: Synthetic polypeptide
DEEEIRTTNPVATEQYGSVSATTPAGPNMWNGMNPV

SEQ ID NO: 117283 - protein, 35 aa, Artificial Sequence
  Description of Artificial Sequence: Synthetic polypeptide
DEEEIRTTNPVATEQYGSTVNSTNDDENSGQEEID

SEQ ID NO: 117284 - protein, 34 aa, Artificial Sequence
  Description of Artificial Sequence: Synthetic polypeptide
DEEEICTTNPVAYEQYGSVGSCLNSLSQVSGGEG

SEQ ID NO: 117285 - protein, 36 aa, Artificial Sequence
  Description of Artificial Sequence: Synthetic polypeptide
DEEEIRTTNPVATEQYGSVSATTPAGPNMRNGWNPV

SEQ ID NO: 117286 - protein, 36 aa, Artificial Sequence
  Description of Artificial Sequence: Synthetic polypeptide
DEEEIRTTNPVATEQYGSVSATTPAGPNMRNGMNPV

SEQ ID NO: 117287 - protein, 35 aa, Artificial Sequence
  Description of Artificial Sequence: Synthetic polypeptide
DEEEIRTTNPVATEQYGSVWNTPDDMGQKIIGNQE

SEQ ID NO: 117288 - protein, 35 aa, Artificial Sequence
  Description of Artificial Sequence: Synthetic polypeptide
DEEEIRTTNPVATEQYGSVSATTPTGPNRNGMDPV

SEQ ID NO: 117289 - protein, 34 aa, Artificial Sequence
  Description of Artificial Sequence: Synthetic polypeptide
DEEEIRTTNPVATEQYGSVSAYNDLASIEDSEVQ

SEQ ID NO: 117290 - protein, 31 aa, Artificial Sequence
  Description of Artificial Sequence: Synthetic polypeptide
DEECIVTVNPVATEWYGCSYVSDNNMERVTR

SEQ ID NO: 117291 - protein, 36 aa, Artificial Sequence
  Description of Artificial Sequence: Synthetic polypeptide
DEEEIRTTNPVATEQYGSVSCCTPAGPNMRNGMNPV

SEQ ID NO: 117292 - protein, 34 aa, Artificial Sequence
  Description of Artificial Sequence: Synthetic polypeptide
DEEEIRTTNPVATEQYGSTSATPNDAQQTISVEE

SEQ ID NO: 117293 - protein, 35 aa, Artificial Sequence
  Description of Artificial Sequence: Synthetic polypeptide
DEEEIRTTNPVATEQYGSTSATTPAWPNMRNGNPV

SEQ ID NO: 117294 - protein, 34 aa, Artificial Sequence
  Description of Artificial Sequence: Synthetic polypeptide
DEEEIGTTNPVATEQYGCVCSTEDHQENMGSNLM

SEQ ID NO: 117295 - protein, 34 aa, Artificial Sequence
  Description of Artificial Sequence: Synthetic polypeptide
DEEEIGTTNPVATEQYGCVCSTEDHNQENMGSNQ

SEQ ID NO: 117296 - protein, 32 aa, Artificial Sequence
  Description of Artificial Sequence: Synthetic polypeptide
DEEEIGTTNPVATEQYGCVCSSEHQFFGSDQA

SEQ ID NO: 117297 - protein, 35 aa, Artificial Sequence
  Description of Artificial Sequence: Synthetic polypeptide
DEEEIRTTNPVATEQYGSVSCIVDLNQPNSQIDNQ

SEQ ID NO: 117298 - protein, 30 aa, Artificial Sequence
  Description of Artificial Sequence: Synthetic polypeptide
DEECISTVNPVATEGYGCVSWELEHFGSNQ

SEQ ID NO: 117299 - protein, 34 aa, Artificial Sequence
  Description of Artificial Sequence: Synthetic polypeptide
DEEEIRTTNPVATEQYGSVWAVPDPMQQLGSNEE

SEQ ID NO: 117300 - protein, 36 aa, Artificial Sequence
  Description of Artificial Sequence: Synthetic polypeptide
DEEEIRTTNPVATEQYGSVSCGTPAGPNMRNGMNVV

SEQ ID NO: 117301 - protein, 34 aa, Artificial Sequence
  Description of Artificial Sequence: Synthetic polypeptide
DEEEIGTTNPVATEQYGCVCSMTELQNFNSDTQA

SEQ ID NO: 117302 - protein, 34 aa, Artificial Sequence
  Description of Artificial Sequence: Synthetic polypeptide
DEEEIGTTNPVATEQYGCVCSDTELNQNFSSNQA

SEQ ID NO: 117303 - protein, 34 aa, Artificial Sequence
  Description of Artificial Sequence: Synthetic polypeptide
DEEEIRTTNPVATEQYGSVWELPQMDQRFINGED

SEQ ID NO: 117304 - protein, 34 aa, Artificial Sequence
  Description of Artificial Sequence: Synthetic polypeptide
DEEEIGTTNPCATEQYGTQVSTNVLFTREGIDSP

SEQ ID NO: 117305 - protein, 35 aa, Artificial Sequence
  Description of Artificial Sequence: Synthetic polypeptide
DEEEIRTTNPVATEQYGSTSSTTPAWPNMRNGNPV

SEQ ID NO: 117306 - protein, 34 aa, Artificial Sequence
  Description of Artificial Sequence: Synthetic polypeptide
DEEEIGTTNPCATEQYGCVCPTNLQEHFGSNTQS

SEQ ID NO: 117307 - protein, 34 aa, Artificial Sequence
  Description of Artificial Sequence: Synthetic polypeptide
DEEEIRTTNPVATEQYGSVWELPQMLQRDIQEEG

SEQ ID NO: 117308 - protein, 35 aa, Artificial Sequence
  Description of Artificial Sequence: Synthetic polypeptide
DEEEIRTTNPVATEQYGSVWEMMNTVQINTQPGMQ

SEQ ID NO: 117309 - protein, 34 aa, Artificial Sequence
  Description of Artificial Sequence: Synthetic polypeptide
DEEEIGTTNPVATEQYGQCVCSTGELQNSGSEQQ

SEQ ID NO: 117310 - protein, 33 aa, Artificial Sequence
  Description of Artificial Sequence: Synthetic polypeptide
DEECIRTTNPVAYEQYGCTVSTNQSQFGGQQQS

SEQ ID NO: 117311 - protein, 34 aa, Artificial Sequence
  Description of Artificial Sequence: Synthetic polypeptide
DEEEIRTTNPVATEQYGSSSDVQDLNNQDGQEMI

SEQ ID NO: 117312 - protein, 32 aa, Artificial Sequence
  Description of Artificial Sequence: Synthetic polypeptide
DEEEIRTTNPVATEQYGSSCTENDPDAVSSSS

SEQ ID NO: 117313 - protein, 37 aa, Artificial Sequence
  Description of Artificial Sequence: Synthetic polypeptide
DEEEIRTTNPVATEQYGVVSTVVTNLQQGNNQEDEDD

SEQ ID NO: 117314 - protein, 34 aa, Artificial Sequence
  Description of Artificial Sequence: Synthetic polypeptide
DEEEIRTTNPVATEQYGSVSDPVGLIETMMQGVD

SEQ ID NO: 117315 - protein, 34 aa, Artificial Sequence
  Description of Artificial Sequence: Synthetic polypeptide
DEEEIRTTNPVATEQYGSVSDPVGLIETHGQLVQ

SEQ ID NO: 117316 - protein, 37 aa, Artificial Sequence
  Description of Artificial Sequence: Synthetic polypeptide
DEEEIRTTNPVATEQYGVVSTVVTNLQQGNNEEEEED

SEQ ID NO: 117317 - protein, 37 aa, Artificial Sequence
  Description of Artificial Sequence: Synthetic polypeptide
DEEEIRTTNPVATEQYGVVSTVVTNLQQGNNEDEEDE

SEQ ID NO: 117318 - protein, 33 aa, Artificial Sequence
  Description of Artificial Sequence: Synthetic polypeptide
DEEEIRTTNPVATEQYGSVSDPVGLIEPMVVTG

SEQ ID NO: 117319 - protein, 37 aa, Artificial Sequence
  Description of Artificial Sequence: Synthetic polypeptide
DEEEIRTTNPVATEQYGVVSTVVTNLQQGNNDEDEEE

SEQ ID NO: 117320 - protein, 33 aa, Artificial Sequence
  Description of Artificial Sequence: Synthetic polypeptide
DEEEIRTTNPVATEQYGSVSDPVGLIETMVQPP

SEQ ID NO: 117321 - protein, 37 aa, Artificial Sequence
  Description of Artificial Sequence: Synthetic polypeptide
DEEEIRTTNPVATEQYGVVSTVVTNLQQGNNAEQEDE

SEQ ID NO: 117322 - protein, 37 aa, Artificial Sequence
  Description of Artificial Sequence: Synthetic polypeptide
DEEEIRTTNPVATEQYGVVSTVVTNLQQGNEDEEETE

SEQ ID NO: 117323 - protein, 33 aa, Artificial Sequence
  Description of Artificial Sequence: Synthetic polypeptide
DEEEIRTTNPVATEQYGSVSDPVGLIEHMVQTV

SEQ ID NO: 117324 - protein, 33 aa, Artificial Sequence
  Description of Artificial Sequence: Synthetic polypeptide
DEEEIRTTNPVATEQYGSVSDPVGIYETMGQTV

SEQ ID NO: 117325 - protein, 37 aa, Artificial Sequence
  Description of Artificial Sequence: Synthetic polypeptide
DEEEIRTTNPVATEQYGVVSTVVTNLQQAGTNTEEED

SEQ ID NO: 117326 - protein, 33 aa, Artificial Sequence
  Description of Artificial Sequence: Synthetic polypeptide
DEEEIRTTNPVATEQYGSVSDPVGHIETPGQTV

SEQ ID NO: 117327 - protein, 37 aa, Artificial Sequence
  Description of Artificial Sequence: Synthetic polypeptide
DEEEIRTTNPVATEQYGVVSTVVTNLQNQQGNNQNQD

SEQ ID NO: 117328 - protein, 33 aa, Artificial Sequence
  Description of Artificial Sequence: Synthetic polypeptide
DEEEIRTTNPVATEQYGSVSDPTGGIETMVQTK

SEQ ID NO: 117329 - protein, 37 aa, Artificial Sequence
  Description of Artificial Sequence: Synthetic polypeptide
DEEEIRTTNPVATEQYGVVSTVVTNLQQGNETEEGEE

SEQ ID NO: 117330 - protein, 33 aa, Artificial Sequence
  Description of Artificial Sequence: Synthetic polypeptide
DEEEIRTTNPVATEQYGSVSDPSGSIETMVQTG

SEQ ID NO: 117331 - protein, 37 aa, Artificial Sequence
  Description of Artificial Sequence: Synthetic polypeptide
DEEEIRTTNPVATEQYGVVSTVVTNLQQGNQEEDETE

SEQ ID NO: 117332 - protein, 34 aa, Artificial Sequence
  Description of Artificial Sequence: Synthetic polypeptide
DEEEIRTTNPVATEQYGSVSDPVGLIETNVQQVD

SEQ ID NO: 117333 - protein, 32 aa, Artificial Sequence
  Description of Artificial Sequence: Synthetic polypeptide
DEEEIKTTNPVATEQYGCVCSWEHQNFNSEQA

SEQ ID NO: 117334 - protein, 37 aa, Artificial Sequence
  Description of Artificial Sequence: Synthetic polypeptide
DEEEIRTTNPVATEQYGVVSTVVTNLQQGTEQGSNQE

SEQ ID NO: 117335 - protein, 36 aa, Artificial Sequence
  Description of Artificial Sequence: Synthetic polypeptide
DEEEIRTTNPVATEQYGSVSDTKPAGPNMRNGMNPV

SEQ ID NO: 117336 - protein, 34 aa, Artificial Sequence
  Description of Artificial Sequence: Synthetic polypeptide
DEEEIKTTNPVATEQYGCVCSTEHQENFGSNNQL

SEQ ID NO: 117337 - protein, 36 aa, Artificial Sequence
  Description of Artificial Sequence: Synthetic polypeptide
DEEEIRTTNPVATEQYGSVSDTDNNDTNEMGSNAGL

SEQ ID NO: 117338 - protein, 36 aa, Artificial Sequence
  Description of Artificial Sequence: Synthetic polypeptide
DEEEIRTTNPVATEQYGSVSDTDGMNGQNEGGGAEI

SEQ ID NO: 117339 - protein, 32 aa, Artificial Sequence
  Description of Artificial Sequence: Synthetic polypeptide
DEEEIRTTNPVATEQYGSVSDSASPEYTQEDQ

SEQ ID NO: 117340 - protein, 37 aa, Artificial Sequence
  Description of Artificial Sequence: Synthetic polypeptide
DEEEIRTTNPVATEQYGVVSTVVTNLQQGNQEEEEDE

SEQ ID NO: 117341 - protein, 34 aa, Artificial Sequence
  Description of Artificial Sequence: Synthetic polypeptide
DEEEIRTTNPVATEQYGSNNNLTNHDEEGNTEIH

SEQ ID NO: 117342 - protein, 33 aa, Artificial Sequence
  Description of Artificial Sequence: Synthetic polypeptide
DEEEIRTTNPVATEQYGSVSDPVGLNETMVQTG

SEQ ID NO: 117343 - protein, 37 aa, Artificial Sequence
  Description of Artificial Sequence: Synthetic polypeptide
DEEEIRTTNPVATEQYGVVSTVVTNLQQGTEQGEQNQ

SEQ ID NO: 117344 - protein, 37 aa, Artificial Sequence
  Description of Artificial Sequence: Synthetic polypeptide
DEEEIRTTNPVATEQYGVVSTVVTNLQQGTENAGNNE

SEQ ID NO: 117345 - protein, 37 aa, Artificial Sequence
  Description of Artificial Sequence: Synthetic polypeptide
DEEEIRTTNPVATEQYGVVSTVVTNLQQGTEAGEINT

SEQ ID NO: 117346 - protein, 34 aa, Artificial Sequence
  Description of Artificial Sequence: Synthetic polypeptide
DEEEIRTTNPVATEQYGSVSDPVGLIETTPMQNV

SEQ ID NO: 117347 - protein, 33 aa, Artificial Sequence
  Description of Artificial Sequence: Synthetic polypeptide
DEEEIRTTNPVATEQYGSVSDPVGLIETPAELV

SEQ ID NO: 117348 - protein, 37 aa, Artificial Sequence
  Description of Artificial Sequence: Synthetic polypeptide
DEEEIRTTNPVATEQYGVVSTVVTNLQQGNQEEETTD

SEQ ID NO: 117349 - protein, 35 aa, Artificial Sequence
  Description of Artificial Sequence: Synthetic polypeptide
DEEEIRTTNPVATEQYGSVSDQNDPQELEIGEGGQ

SEQ ID NO: 117350 - protein, 34 aa, Artificial Sequence
  Description of Artificial Sequence: Synthetic polypeptide
DEEEIRTTNPVATEQYGSVSDPPGLIETPGQLTP

SEQ ID NO: 117351 - protein, 33 aa, Artificial Sequence
  Description of Artificial Sequence: Synthetic polypeptide
DEEEIRTTNPVATEQYGSVSDPDYWIEHAINNQ

SEQ ID NO: 117352 - protein, 34 aa, Artificial Sequence
  Description of Artificial Sequence: Synthetic polypeptide
DEEEIRTTNPVATEQYGSVSDNNCDERTSIDQSK

SEQ ID NO: 117353 - protein, 37 aa, Artificial Sequence
  Description of Artificial Sequence: Synthetic polypeptide
DEEEIRTTNPVATEQYGVVSTVVTNLQAGNQTEEEDE

SEQ ID NO: 117354 - protein, 37 aa, Artificial Sequence
  Description of Artificial Sequence: Synthetic polypeptide
DEEEIRTTNPVATEQYGVVSTVVTNLQAGNQQNTEDT

SEQ ID NO: 117355 - protein, 34 aa, Artificial Sequence
  Description of Artificial Sequence: Synthetic polypeptide
DEEEIRTTNPVATEQYGSVSCVVDLNQPMSQIPQ

SEQ ID NO: 117356 - protein, 37 aa, Artificial Sequence
  Description of Artificial Sequence: Synthetic polypeptide
DEEEIRTTNPVATEQYGVVSTVVTNLQAGNQQGNDTE

SEQ ID NO: 117357 - protein, 37 aa, Artificial Sequence
  Description of Artificial Sequence: Synthetic polypeptide
DEEEIRTTNPVATEQYGVVSTVVTNLQAGNQQGEQEE

SEQ ID NO: 117358 - protein, 35 aa, Artificial Sequence
  Description of Artificial Sequence: Synthetic polypeptide
DEEEIRTTNPVATEQYGSVSCVPDLNQPNSQITRQ

SEQ ID NO: 117359 - protein, 31 aa, Artificial Sequence
  Description of Artificial Sequence: Synthetic polypeptide
DEAEIRTTNPIATECWGSCSKNEDDQGGGNY

SEQ ID NO: 117360 - protein, 34 aa, Artificial Sequence
  Description of Artificial Sequence: Synthetic polypeptide
DEEEIRTTNPVATEQYGSVSCWDALQATESDQQD

SEQ ID NO: 117361 - protein, 37 aa, Artificial Sequence
  Description of Artificial Sequence: Synthetic polypeptide
DEEEIRTTNPVATEQYGVVSTVVTNLQAGNQEEEEDE

SEQ ID NO: 117362 - protein, 37 aa, Artificial Sequence
  Description of Artificial Sequence: Synthetic polypeptide
DEEEIRTTNPVATEQYGVVSTVVTNLQAGNQEDEEEE

SEQ ID NO: 117363 - protein, 37 aa, Artificial Sequence
  Description of Artificial Sequence: Synthetic polypeptide
DEEEIRTTNPVATEQYGVVSTVVTNLQAGNQEATEET

SEQ ID NO: 117364 - protein, 37 aa, Artificial Sequence
  Description of Artificial Sequence: Synthetic polypeptide
DEEEIRTTNPVATEQYGSQVVSYTVNLEQERNDTQQI

SEQ ID NO: 117365 - protein, 35 aa, Artificial Sequence
  Description of Artificial Sequence: Synthetic polypeptide
DEEEIRTTNPVATEQYGSQVWMTNDEVREETQNAG

SEQ ID NO: 117366 - protein, 37 aa, Artificial Sequence
  Description of Artificial Sequence: Synthetic polypeptide
DEEEIRTTNPVATEQYGVVSTVVTNLQAGNNTEQGTE

SEQ ID NO: 117367 - protein, 35 aa, Artificial Sequence
  Description of Artificial Sequence: Synthetic polypeptide
DEEEIRTTNPVATEQYGSSCSPTNLLERNDDTQES

SEQ ID NO: 117368 - protein, 37 aa, Artificial Sequence
  Description of Artificial Sequence: Synthetic polypeptide
DEEEIRTTNPVATEQYGVVSTVVTNLQAGNNEEDEDT

SEQ ID NO: 117369 - protein, 37 aa, Artificial Sequence
  Description of Artificial Sequence: Synthetic polypeptide
DEEEIRTTNPVATEQYGVVSTVVTNLQAGNQEEDEDT

SEQ ID NO: 117370 - protein, 34 aa, Artificial Sequence
  Description of Artificial Sequence: Synthetic polypeptide
DEEEIRTTNPVATEQYGSVSDAVEHGVRLVNENG

SEQ ID NO: 117371 - protein, 37 aa, Artificial Sequence
  Description of Artificial Sequence: Synthetic polypeptide
DEEEIRTTNPVATEQYGVVSTVVTNLQAGNQTEEETE

SEQ ID NO: 117372 - protein, 37 aa, Artificial Sequence
  Description of Artificial Sequence: Synthetic polypeptide
DEEEIRTTNPVATEQYGVVSTVVTNLQAGNTDEEEDT

SEQ ID NO: 117373 - protein, 37 aa, Artificial Sequence
  Description of Artificial Sequence: Synthetic polypeptide
DEEEIRTTNPVATEQYGVVSTVVTNLQGNGNNQEEDT

SEQ ID NO: 117374 - protein, 37 aa, Artificial Sequence
  Description of Artificial Sequence: Synthetic polypeptide
DEEEIRTTNPVATEQYGVVSTVVTNLQGNEAGNDEGS

SEQ ID NO: 117375 - protein, 36 aa, Artificial Sequence
  Description of Artificial Sequence: Synthetic polypeptide
DEEEIRTTNPVATEQYGSVSDMTPAGPNMRNGMNPV

SEQ ID NO: 117376 - protein, 36 aa, Artificial Sequence
  Description of Artificial Sequence: Synthetic polypeptide
DEEEIRTTNPVATEQYGSVSDLMPENGQGEGQNTEE

SEQ ID NO: 117377 - protein, 36 aa, Artificial Sequence
  Description of Artificial Sequence: Synthetic polypeptide
DEEEIRTTNPVATEQYGSVSDGVTGLGGQEGGGQGF

SEQ ID NO: 117378 - protein, 35 aa, Artificial Sequence
  Description of Artificial Sequence: Synthetic polypeptide
DEEEIRTTNPVATEQYGSVSDGVTGLGGNGGGEGA

SEQ ID NO: 117379 - protein, 35 aa, Artificial Sequence
  Description of Artificial Sequence: Synthetic polypeptide
DEEEIRTTNPVATEQYGSVSDGVTGLGGDGEDIGG

SEQ ID NO: 117380 - protein, 34 aa, Artificial Sequence
  Description of Artificial Sequence: Synthetic polypeptide
DEEEIRTTNPVATEQYGSVSDGTINVAEMSEIEI

SEQ ID NO: 117381 - protein, 34 aa, Artificial Sequence
  Description of Artificial Sequence: Synthetic polypeptide
DEEEIRTTNPVATEQYGSVSDGMMNEEEGGDGEL

SEQ ID NO: 117382 - protein, 33 aa, Artificial Sequence
  Description of Artificial Sequence: Synthetic polypeptide
DEEEIRTTNPVATEQYGSVSDEVGLIETMVQDV

SEQ ID NO: 117383 - protein, 35 aa, Artificial Sequence
  Description of Artificial Sequence: Synthetic polypeptide
DEEEIRTTNPVATEQYGSVSDDVTEGLGNGGQTGG

SEQ ID NO: 117384 - protein, 35 aa, Artificial Sequence
  Description of Artificial Sequence: Synthetic polypeptide
DEEEIRTTNPVATEQYGSVSDDVTEGLGNGGQGQI

SEQ ID NO: 117385 - protein, 35 aa, Artificial Sequence
  Description of Artificial Sequence: Synthetic polypeptide
DEEEIRTTNPVATEQYGSVSDDVTEGLGNGGQEGQ

SEQ ID NO: 117386 - protein, 34 aa, Artificial Sequence
  Description of Artificial Sequence: Synthetic polypeptide
DEEEIRTTNPVATEQYGSVSDDNMTMEIGGGQGE

SEQ ID NO: 117387 - protein, 35 aa, Artificial Sequence
  Description of Artificial Sequence: Synthetic polypeptide
DEEEIRTTNPVATEQYGSVSDDGMNDQNEGGGAEI

SEQ ID NO: 117388 - protein, 37 aa, Artificial Sequence
  Description of Artificial Sequence: Synthetic polypeptide
DEEEIRTTNPVATEQYGVVSTVVTNLQAGTEENEEDE

SEQ ID NO: 117389 - protein, 34 aa, Artificial Sequence
  Description of Artificial Sequence: Synthetic polypeptide
DEEEIRTTNPVATEQYGSVSDDGLGPEGGGQTED

SEQ ID NO: 117390 - protein, 37 aa, Artificial Sequence
  Description of Artificial Sequence: Synthetic polypeptide
DEEEIRTTNPVATEQYGVVSTVVTNLQAGNIDEEGTE

SEQ ID NO: 117391 - protein, 34 aa, Artificial Sequence
  Description of Artificial Sequence: Synthetic polypeptide
DEEEIRTTNPVATEQYGSVWPENLPKDEVGEEQN

SEQ ID NO: 117392 - protein, 33 aa, Artificial Sequence
  Description of Artificial Sequence: Synthetic polypeptide
DEAEIRTTNPVATEPWGSVSLTNDINDHGNGTD

SEQ ID NO: 117393 - protein, 36 aa, Artificial Sequence
  Description of Artificial Sequence: Synthetic polypeptide
DEAEIRTTNPVATEPYGHVPSCWTNELSNRTGGNRW

SEQ ID NO: 117394 - protein, 36 aa, Artificial Sequence
  Description of Artificial Sequence: Synthetic polypeptide
DEEEIRTTNPVATEQYGVVTVVVTNLQQLGGNDEEQ

SEQ ID NO: 117395 - protein, 36 aa, Artificial Sequence
  Description of Artificial Sequence: Synthetic polypeptide
DEEEIRTTNPVATEQYGVVTVVVTNLQNQQGTNEEQ

SEQ ID NO: 117396 - protein, 32 aa, Artificial Sequence
  Description of Artificial Sequence: Synthetic polypeptide
DEECIRTTNPEATQQYGEVCTIDQGQREGNQS

SEQ ID NO: 117397 - protein, 34 aa, Artificial Sequence
  Description of Artificial Sequence: Synthetic polypeptide
DEECIRTTNPLAYEQYGQSVSTGNSFSQLKVGDR

SEQ ID NO: 117398 - protein, 31 aa, Artificial Sequence
  Description of Artificial Sequence: Synthetic polypeptide
DEECIRTTNPMATECYGSVNTNIVDMPQGRV

SEQ ID NO: 117399 - protein, 33 aa, Artificial Sequence
  Description of Artificial Sequence: Synthetic polypeptide
DEECIRTTNPVACEQYGVVCTIEDGQRGTNGNT

SEQ ID NO: 117400 - protein, 33 aa, Artificial Sequence
  Description of Artificial Sequence: Synthetic polypeptide
DEECIRTTNPVACEQYGVVCTIEDGQRQGMGNT

SEQ ID NO: 117401 - protein, 33 aa, Artificial Sequence
  Description of Artificial Sequence: Synthetic polypeptide
DEEEIRTTNPVATEQYGSGSLAMTNDESSEIEI

SEQ ID NO: 117402 - protein, 37 aa, Artificial Sequence
  Description of Artificial Sequence: Synthetic polypeptide
DEEEIRTTNPVATEQYGSVSITNNGLGQQEGQGGGQT

SEQ ID NO: 117403 - protein, 34 aa, Artificial Sequence
  Description of Artificial Sequence: Synthetic polypeptide
DEECIRTTNPVATEAYGETVSCTASLSGRGGDRV

SEQ ID NO: 117404 - protein, 34 aa, Artificial Sequence
  Description of Artificial Sequence: Synthetic polypeptide
DEECIRTTNPVATEAYGETVSSTSSLSQTGGDRV

SEQ ID NO: 117405 - protein, 34 aa, Artificial Sequence
  Description of Artificial Sequence: Synthetic polypeptide
DEECIRTTNPVATEAYGETVSTAEHSQYRGGDRF

SEQ ID NO: 117406 - protein, 34 aa, Artificial Sequence
  Description of Artificial Sequence: Synthetic polypeptide
DEECIRTTNPVATEAYGETVSTASLSQNGGDYRV

SEQ ID NO: 117407 - protein, 34 aa, Artificial Sequence
  Description of Artificial Sequence: Synthetic polypeptide
DEECIRTTNPVATEAYGETVSTASLSQPTGGKRA

SEQ ID NO: 117408 - protein, 34 aa, Artificial Sequence
  Description of Artificial Sequence: Synthetic polypeptide
DEECIRTTNPVATEAYGETVSYTASLSQRGGMVA

SEQ ID NO: 117409 - protein, 36 aa, Artificial Sequence
  Description of Artificial Sequence: Synthetic polypeptide
DEEEIRTTNPVATEQYGVVTVVVTNLLEQQGNNEES

SEQ ID NO: 117410 - protein, 33 aa, Artificial Sequence
  Description of Artificial Sequence: Synthetic polypeptide
DEECIRTTNPVACEQYGVVCTIEDVGQRGGNHN

SEQ ID NO: 117411 - protein, 36 aa, Artificial Sequence
  Description of Artificial Sequence: Synthetic polypeptide
DEEEIRTTNPVATEQYGVVTVVVTNLELQSGNNEES

SEQ ID NO: 117412 - protein, 31 aa, Artificial Sequence
  Description of Artificial Sequence: Synthetic polypeptide
DEECIRTTNPDAWEQYGQCCQTINVQGGNNV

SEQ ID NO: 117413 - protein, 34 aa, Artificial Sequence
  Description of Artificial Sequence: Synthetic polypeptide
DEEEIRTTNPVATEQYGSGLSPTTLDQVEIEELN

SEQ ID NO: 117414 - protein, 33 aa, Artificial Sequence
  Description of Artificial Sequence: Synthetic polypeptide
DEAEIRTTNPVATEQYGCVCSMTEHQENFGSQQ

SEQ ID NO: 117415 - protein, 36 aa, Artificial Sequence
  Description of Artificial Sequence: Synthetic polypeptide
DEEEIRTTNPVATEQYGSVSKTWPAGPNMRNGMNPV

SEQ ID NO: 117416 - protein, 36 aa, Artificial Sequence
  Description of Artificial Sequence: Synthetic polypeptide
DEEEIRTTNPVATEQYGSVSKTTPAGPNMRNGMNPV

SEQ ID NO: 117417 - protein, 34 aa, Artificial Sequence
  Description of Artificial Sequence: Synthetic polypeptide
DEECIRCTNPVAYEQYGISVVSVNEFSQRGGNLM

SEQ ID NO: 117418 - protein, 34 aa, Artificial Sequence
  Description of Artificial Sequence: Synthetic polypeptide
DEECIRCTNPVAYEQYGSVVSCWNGFSQRTGGNL

SEQ ID NO: 117419 - protein, 33 aa, Artificial Sequence
  Description of Artificial Sequence: Synthetic polypeptide
DEECIRCTNPVAYEQYGSVVSNNEGSQAGGNLM

SEQ ID NO: 117420 - protein, 33 aa, Artificial Sequence
  Description of Artificial Sequence: Synthetic polypeptide
DEEEIRTTNPVATEQYGSVSIVMDDTTQESQTD

SEQ ID NO: 117421 - protein, 33 aa, Artificial Sequence
  Description of Artificial Sequence: Synthetic polypeptide
DEEEIRATNPVATEQYGCVFYCGNAMTRGMKRE

SEQ ID NO: 117422 - protein, 34 aa, Artificial Sequence
  Description of Artificial Sequence: Synthetic polypeptide
DEEEIRTTNPVATEQYGSVSITVDHTNAVGSEIF

SEQ ID NO: 117423 - protein, 35 aa, Artificial Sequence
  Description of Artificial Sequence: Synthetic polypeptide
DEEEIRTTNPVATEQYGVVVGTNDDNEQTGGENDQ

SEQ ID NO: 117424 - protein, 31 aa, Artificial Sequence
  Description of Artificial Sequence: Synthetic polypeptide
DEAEIRTTNPVATEQYGCVCQTAHIENMSNQ

SEQ ID NO: 117425 - protein, 33 aa, Artificial Sequence
  Description of Artificial Sequence: Synthetic polypeptide
DEECIRTTNPCATEQYGCVCQTELQNFGSNTAS

SEQ ID NO: 117426 - protein, 32 aa, Artificial Sequence
  Description of Artificial Sequence: Synthetic polypeptide
DEAEIRTTNPVATEQYGCVCQTADHIRMSNQS

SEQ ID NO: 117427 - protein, 32 aa, Artificial Sequence
  Description of Artificial Sequence: Synthetic polypeptide
DEECIRTTNPCAYEQWGSVCYNIEQRDGNQDF

SEQ ID NO: 117428 - protein, 32 aa, Artificial Sequence
  Description of Artificial Sequence: Synthetic polypeptide
DEECIRTTNPCAYEQWGSVSTTNGDNDNNGNQ

SEQ ID NO: 117429 - protein, 35 aa, Artificial Sequence
  Description of Artificial Sequence: Synthetic polypeptide
DEEEIRTTNPVATEQYGVVVDSGDLEQGEGQQENI

SEQ ID NO: 117430 - protein, 36 aa, Artificial Sequence
  Description of Artificial Sequence: Synthetic polypeptide
DEEEIRTTNPVATEQYGSVSITTPAGPNMRNGMNPV

SEQ ID NO: 117431 - protein, 34 aa, Artificial Sequence
  Description of Artificial Sequence: Synthetic polypeptide
DEAEIRTTNPVATEQYGCVCSMTELQENFNSDQA

SEQ ID NO: 117432 - protein, 31 aa, Artificial Sequence
  Description of Artificial Sequence: Synthetic polypeptide
DEAEIRTTNPVATEQYGCLWSDHWLEREDTD

SEQ ID NO: 117433 - protein, 36 aa, Artificial Sequence
  Description of Artificial Sequence: Synthetic polypeptide
DEEEIRTTNPVATEQYGVVTVTVTENNLLQGIGNTD

SEQ ID NO: 117434 - protein, 34 aa, Artificial Sequence
  Description of Artificial Sequence: Synthetic polypeptide
DEECIRTTNPVATEPWGESVRTWNDDQGRQKNAR

SEQ ID NO: 117435 - protein, 34 aa, Artificial Sequence
  Description of Artificial Sequence: Synthetic polypeptide
DEEEIRTTNPVATEQYGSGSTGNGLEMAALEQLI

SEQ ID NO: 117436 - protein, 34 aa, Artificial Sequence
  Description of Artificial Sequence: Synthetic polypeptide
DEEEIRATNPVATEQYGCVAITNHADEQAGMGGR

SEQ ID NO: 117437 - protein, 37 aa, Artificial Sequence
  Description of Artificial Sequence: Synthetic polypeptide
DEEEIRTTNPVATEQYGVVSVVVVTNLQQGNTEQGSE

SEQ ID NO: 117438 - protein, 35 aa, Artificial Sequence
  Description of Artificial Sequence: Synthetic polypeptide
DEEEIRTTNPVATEQYGSGVSIAGHLQELIVEGLA

SEQ ID NO: 117439 - protein, 36 aa, Artificial Sequence
  Description of Artificial Sequence: Synthetic polypeptide
DEEEIRTTNPVATEQYGVVSVVVVTNLQAGTTTEDD

SEQ ID NO: 117440 - protein, 37 aa, Artificial Sequence
  Description of Artificial Sequence: Synthetic polypeptide
DEEEIRTTNPVATEQYGVVSVVVVTNLQAGTNQDEDE

SEQ ID NO: 117441 - protein, 34 aa, Artificial Sequence
  Description of Artificial Sequence: Synthetic polypeptide
DEECIRTTNPVATEIYGQVWTTANLEYRFGSDQR

SEQ ID NO: 117442 - protein, 37 aa, Artificial Sequence
  Description of Artificial Sequence: Synthetic polypeptide
DEEEIRTTNPVATEQYGVVSVVVVTNLQAGNTETGED

SEQ ID NO: 117443 - protein, 35 aa, Artificial Sequence
  Description of Artificial Sequence: Synthetic polypeptide
DEEEIRTTNPVATEQYGSVVENSNQLIQETLENDS

SEQ ID NO: 117444 - protein, 37 aa, Artificial Sequence
  Description of Artificial Sequence: Synthetic polypeptide
DEEEIRTTNPVATEQYGVVSVVVVTNLQAGNNEQGAE

SEQ ID NO: 117445 - protein, 34 aa, Artificial Sequence
  Description of Artificial Sequence: Synthetic polypeptide
DEEEIRTTNPVATEQYGSVVEPTNESQNVTVQQT

SEQ ID NO: 117446 - protein, 34 aa, Artificial Sequence
  Description of Artificial Sequence: Synthetic polypeptide
DEEEIRTTNPVATEQYGSVVFENQEHMGNNSNIE

SEQ ID NO: 117447 - protein, 35 aa, Artificial Sequence
  Description of Artificial Sequence: Synthetic polypeptide
DEEEIRTTNPVATEQYGSVVGDNMNQGEGFGNGGD

SEQ ID NO: 117448 - protein, 34 aa, Artificial Sequence
  Description of Artificial Sequence: Synthetic polypeptide
DEEEIRTTNPVATEQYGSVVGDNMSQGEGIGDGG

SEQ ID NO: 117449 - protein, 35 aa, Artificial Sequence
  Description of Artificial Sequence: Synthetic polypeptide
DEEEIRTTNPVATEQYGSVVGDNMSQGEGMGNGED

SEQ ID NO: 117450 - protein, 34 aa, Artificial Sequence
  Description of Artificial Sequence: Synthetic polypeptide
DEEEIRTTNPVATEQYGSVVENQEWMGNNSIIEK

SEQ ID NO: 117451 - protein, 35 aa, Artificial Sequence
  Description of Artificial Sequence: Synthetic polypeptide
DEEEIRTTNPVATEQYGVVTVVTNNQLQDEETNNT

SEQ ID NO: 117452 - protein, 32 aa, Artificial Sequence
  Description of Artificial Sequence: Synthetic polypeptide
DEECIRTTNPVATEIYGCVCTTGEHQNGSNQA

SEQ ID NO: 117453 - protein, 31 aa, Artificial Sequence
  Description of Artificial Sequence: Synthetic polypeptide
DEECIRTTNPVATEIYGCVCQWELQNGSDQS

SEQ ID NO: 117454 - protein, 33 aa, Artificial Sequence
  Description of Artificial Sequence: Synthetic polypeptide
DEECIRTTNPVATEIYGCVCGSETNQNFGSNQS

SEQ ID NO: 117455 - protein, 37 aa, Artificial Sequence
  Description of Artificial Sequence: Synthetic polypeptide
DEEEIRTTNPVATEQYGVVTVSVTNNLLQGIGNNTTN

SEQ ID NO: 117456 - protein, 37 aa, Artificial Sequence
  Description of Artificial Sequence: Synthetic polypeptide
DEEEIRTTNPVATEQYGVVTVSVTNLQLNQQGTNNET

SEQ ID NO: 117457 - protein, 37 aa, Artificial Sequence
  Description of Artificial Sequence: Synthetic polypeptide
DEEEIRTTNPVATEQYGVVTVSVTENLLQGIGNNDTG

SEQ ID NO: 117458 - protein, 33 aa, Artificial Sequence
  Description of Artificial Sequence: Synthetic polypeptide
DEAEIATTNPVATEQYGSVAMNDGQVRNPDTRM

SEQ ID NO: 117459 - protein, 37 aa, Artificial Sequence
  Description of Artificial Sequence: Synthetic polypeptide
DEEEIRTTNPVATEQYGSVTVTVTENLQQGIGTNDTE

SEQ ID NO: 117460 - protein, 32 aa, Artificial Sequence
  Description of Artificial Sequence: Synthetic polypeptide
DEEEIRTTNPVATEQYGVVTGDGQGGQEDEGF

SEQ ID NO: 117461 - protein, 32 aa, Artificial Sequence
  Description of Artificial Sequence: Synthetic polypeptide
DEECIRTTNPVATEIYGCVCQWNLQYFGSEQA

SEQ ID NO: 117462 - protein, 32 aa, Artificial Sequence
  Description of Artificial Sequence: Synthetic polypeptide
DEECIRTTNPVATEIYGCVCGTNDQYFGSEQA

SEQ ID NO: 117463 - protein, 32 aa, Artificial Sequence
  Description of Artificial Sequence: Synthetic polypeptide
DEAEIATTNPVATEQYGSVANTAPQADPPGME

SEQ ID NO: 117464 - protein, 33 aa, Artificial Sequence
  Description of Artificial Sequence: Synthetic polypeptide
DEAEIATTNPVATEQYGSVANTEALAGPGETRH

SEQ ID NO: 117465 - protein, 34 aa, Artificial Sequence
  Description of Artificial Sequence: Synthetic polypeptide
DEECIRTTNPVATEIYGCVCQNTNLQEYFGSNQS

SEQ ID NO: 117466 - protein, 36 aa, Artificial Sequence
  Description of Artificial Sequence: Synthetic polypeptide
DEEEIRTTNPVATEQYGSVTWPNNSLEQQPGVPERQ

SEQ ID NO: 117467 - protein, 33 aa, Artificial Sequence
  Description of Artificial Sequence: Synthetic polypeptide
DEEEIRTTNPVATEQYGSVTWSGDMEYPGSQEQ

SEQ ID NO: 117468 - protein, 34 aa, Artificial Sequence
  Description of Artificial Sequence: Synthetic polypeptide
DEEEIRTTNPVATEQYGSVTWVMMDLERPNFNQE

SEQ ID NO: 117469 - protein, 35 aa, Artificial Sequence
  Description of Artificial Sequence: Synthetic polypeptide
DEEEIRTTNPVATEQYGSVTYTMGDETTQSGQDNQ

SEQ ID NO: 117470 - protein, 33 aa, Artificial Sequence
  Description of Artificial Sequence: Synthetic polypeptide
DEEEIRTTNPVATEQYGVVTDGNMVEEGGNDEG

SEQ ID NO: 117471 - protein, 34 aa, Artificial Sequence
  Description of Artificial Sequence: Synthetic polypeptide
DEEEIRTTNPVATEQYGSVSLEEVGMQAELGEQN

SEQ ID NO: 117472 - protein, 36 aa, Artificial Sequence
  Description of Artificial Sequence: Synthetic polypeptide
DEEEIRTTNPVATEQYGSVTTNEVELEVLGNNETQD

SEQ ID NO: 117473 - protein, 34 aa, Artificial Sequence
  Description of Artificial Sequence: Synthetic polypeptide
DEEEIRTTNPVATEQYGSVSLENIQAETSDEVVL

SEQ ID NO: 117474 - protein, 32 aa, Artificial Sequence
  Description of Artificial Sequence: Synthetic polypeptide
DEECIATVNPVATECYGSVVCIDNDDERDGNR

SEQ ID NO: 117475 - protein, 31 aa, Artificial Sequence
  Description of Artificial Sequence: Synthetic polypeptide
DEECIATVNPVATECYGSVVCIDNDERSGNA

SEQ ID NO: 117476 - protein, 36 aa, Artificial Sequence
  Description of Artificial Sequence: Synthetic polypeptide
DEEEIRATNPVATEQYGSVAGTPNPQYDNQGGENPR

SEQ ID NO: 117477 - protein, 36 aa, Artificial Sequence
  Description of Artificial Sequence: Synthetic polypeptide
DEEEIRTTNPVATEQYGSVSLTPLSSQPVEGEGPLA

SEQ ID NO: 117478 - protein, 36 aa, Artificial Sequence
  Description of Artificial Sequence: Synthetic polypeptide
DEEEIRTTNPVATEQYGSVSLTPLQMQPDELENPLA

SEQ ID NO: 117479 - protein, 36 aa, Artificial Sequence
  Description of Artificial Sequence: Synthetic polypeptide
DEEEIRTTNPVATEQYGSVSLTPLLSQPVELQNPLF

SEQ ID NO: 117480 - protein, 36 aa, Artificial Sequence
  Description of Artificial Sequence: Synthetic polypeptide
DEEEIRTTNPVATEQYGSVSLTPLLMQPPELENPLF

SEQ ID NO: 117481 - protein, 35 aa, Artificial Sequence
  Description of Artificial Sequence: Synthetic polypeptide
DEEEIRTTNPVATEQYGSVSLTPPLHSETVAVDRL

SEQ ID NO: 117482 - protein, 33 aa, Artificial Sequence
  Description of Artificial Sequence: Synthetic polypeptide
DEEEIRTTNPVATEQYGYCWTNNLETGMSMQEM

SEQ ID NO: 117483 - protein, 35 aa, Artificial Sequence
  Description of Artificial Sequence: Synthetic polypeptide
DEEEIRTTNPVATEQYGSVSLTNVIVPVTNVQLNT

SEQ ID NO: 117484 - protein, 35 aa, Artificial Sequence
  Description of Artificial Sequence: Synthetic polypeptide
DEEEIRTTNPVATEQYGSVSLTNVGQPVMIVEEPI

SEQ ID NO: 117485 - protein, 32 aa, Artificial Sequence
  Description of Artificial Sequence: Synthetic polypeptide
DEECIATVNPVATECYGSVVCIDNGDERGTNR

SEQ ID NO: 117486 - protein, 32 aa, Artificial Sequence
  Description of Artificial Sequence: Synthetic polypeptide
DEECIATVNPVATEHYGSVVCIDNMDERGNDR

SEQ ID NO: 117487 - protein, 32 aa, Artificial Sequence
  Description of Artificial Sequence: Synthetic polypeptide
DEECIATVNPVAYEAYGSVSCDNELSEHGGNR

SEQ ID NO: 117488 - protein, 32 aa, Artificial Sequence
  Description of Artificial Sequence: Synthetic polypeptide
DEECIATVNPVAYEAYGSVSCDNLSERGGNNQ

SEQ ID NO: 117489 - protein, 32 aa, Artificial Sequence
  Description of Artificial Sequence: Synthetic polypeptide
DEECIATVNPVAYEPYGSVSCDNLEATGGNNR

SEQ ID NO: 117490 - protein, 33 aa, Artificial Sequence
  Description of Artificial Sequence: Synthetic polypeptide
DEECIATVNPVATECYGSVVCIDNDQEHRGNER

SEQ ID NO: 117491 - protein, 33 aa, Artificial Sequence
  Description of Artificial Sequence: Synthetic polypeptide
DEECIATVNPVAYERYGSVSCDVNLSERGGNNR

SEQ ID NO: 117492 - protein, 34 aa, Artificial Sequence
  Description of Artificial Sequence: Synthetic polypeptide
DEECIATVNPVATEAYGSVPSCQNLSERGGNNRK

SEQ ID NO: 117493 - protein, 34 aa, Artificial Sequence
  Description of Artificial Sequence: Synthetic polypeptide
DEECIATVNPVATEAYGSVPSCMNLSDRGGPNRR

SEQ ID NO: 117494 - protein, 33 aa, Artificial Sequence
  Description of Artificial Sequence: Synthetic polypeptide
DEAEIRTTNPVATEQYGCVCSTEHIGFGSENQA

SEQ ID NO: 117495 - protein, 33 aa, Artificial Sequence
  Description of Artificial Sequence: Synthetic polypeptide
DEAEIRTTNPVATEQYGCVCSTEHDQNFGSDQS

SEQ ID NO: 117496 - protein, 33 aa, Artificial Sequence
  Description of Artificial Sequence: Synthetic polypeptide
DEAEIRTTNPVATEQYGCVCSTEEHQSFGSDQL

SEQ ID NO: 117497 - protein, 35 aa, Artificial Sequence
  Description of Artificial Sequence: Synthetic polypeptide
DEEEIRTTNPVATEQYGSFGSDTNVGNGNIEDNTQ

SEQ ID NO: 117498 - protein, 36 aa, Artificial Sequence
  Description of Artificial Sequence: Synthetic polypeptide
DEEEIRTTNPVATEQYGSFMSVPDTNEEQRTEENLI

SEQ ID NO: 117499 - protein, 35 aa, Artificial Sequence
  Description of Artificial Sequence: Synthetic polypeptide
DEEEIRTTNPVATEQYGSVSLWPNGTQEFVGPEFT

SEQ ID NO: 117500 - protein, 35 aa, Artificial Sequence
  Description of Artificial Sequence: Synthetic polypeptide
DEEEIRTTNPVATEQYGSFPSTPNLPQFVVVFDQD

SEQ ID NO: 117501 - protein, 36 aa, Artificial Sequence
  Description of Artificial Sequence: Synthetic polypeptide
DEEEIRTTNPVATEQYGSVSLTPSLIQPVELENPLF

SEQ ID NO: 117502 - protein, 36 aa, Artificial Sequence
  Description of Artificial Sequence: Synthetic polypeptide
DEEEIRTTNPVATEQYGSVSLVPNLKPGTNVEQTNT

SEQ ID NO: 117503 - protein, 35 aa, Artificial Sequence
  Description of Artificial Sequence: Synthetic polypeptide
DEEEIRTTNPVATEQYGSVSLTVNPAIETSTQNQT

SEQ ID NO: 117504 - protein, 36 aa, Artificial Sequence
  Description of Artificial Sequence: Synthetic polypeptide
DEEEIRTTNPVATEQYGSVSLTTPAGPNMRNGMNPV

SEQ ID NO: 117505 - protein, 36 aa, Artificial Sequence
  Description of Artificial Sequence: Synthetic polypeptide
DEEEIRTTNPVATEQYGSVSLTTPAGPNMRNGMNHV

SEQ ID NO: 117506 - protein, 36 aa, Artificial Sequence
  Description of Artificial Sequence: Synthetic polypeptide
DEEEIRTTNPVATEQYGSVSLTTPAGPNMLNGMNPV

SEQ ID NO: 117507 - protein, 34 aa, Artificial Sequence
  Description of Artificial Sequence: Synthetic polypeptide
DEAEIATTNPVATEQYGSVAISNNLPQHQDPNES

SEQ ID NO: 117508 - protein, 35 aa, Artificial Sequence
  Description of Artificial Sequence: Synthetic polypeptide
DEEEIRTTNPVATEQYGSVSLTSSMVARENLLIAD

SEQ ID NO: 117509 - protein, 34 aa, Artificial Sequence
  Description of Artificial Sequence: Synthetic polypeptide
DEECIATVNPVATEAYGSVPSCFNLSERGGVNAR

SEQ ID NO: 117510 - protein, 34 aa, Artificial Sequence
  Description of Artificial Sequence: Synthetic polypeptide
DEAEIRTTNPVATEQYGCVCSTEDHQNFGSNTQL

SEQ ID NO: 117511 - protein, 33 aa, Artificial Sequence
  Description of Artificial Sequence: Synthetic polypeptide
DEECINTTNPVAYEQYGCTVSTNQSQFGGNPQS

SEQ ID NO: 117512 - protein, 33 aa, Artificial Sequence
  Description of Artificial Sequence: Synthetic polypeptide
DEECIQCTNPVAYEQYGSVVQSANEQDRGGNNE

SEQ ID NO: 117513 - protein, 36 aa, Artificial Sequence
  Description of Artificial Sequence: Synthetic polypeptide
DEEEIRTTNPVATEQYGSVTSTSPAGPNMRNGMNPV

SEQ ID NO: 117514 - protein, 35 aa, Artificial Sequence
  Description of Artificial Sequence: Synthetic polypeptide
DEEEIRTTNPVATEQYGSVSLMMLEVFREAENLED

SEQ ID NO: 117515 - protein, 35 aa, Artificial Sequence
  Description of Artificial Sequence: Synthetic polypeptide
DEEEIRTTNPVATEQYGSVSLMMLEQPIDNENLEE

SEQ ID NO: 117516 - protein, 33 aa, Artificial Sequence
  Description of Artificial Sequence: Synthetic polypeptide
DEAEIATTNPVATEQYGSVAITNLEANGDGPDS

SEQ ID NO: 117517 - protein, 35 aa, Artificial Sequence
  Description of Artificial Sequence: Synthetic polypeptide
DEEEIRTTNPVATEQYGSVSLLMLLPQSVPEIERL

SEQ ID NO: 117518 - protein, 34 aa, Artificial Sequence
  Description of Artificial Sequence: Synthetic polypeptide
DEECIRCTNPVATEQYGSVSWNEGEQEQQGHGER

SEQ ID NO: 117519 - protein, 34 aa, Artificial Sequence
  Description of Artificial Sequence: Synthetic polypeptide
DEECIRCTNPVATEQYGSVSWNEGEQERQGGTQG

SEQ ID NO: 117520 - protein, 35 aa, Artificial Sequence
  Description of Artificial Sequence: Synthetic polypeptide
DEECIRCTNPVATEQYGSVSWNEGEQERQGHGGNA

SEQ ID NO: 117521 - protein, 31 aa, Artificial Sequence
  Description of Artificial Sequence: Synthetic polypeptide
DEECIRCTNPVATEQYGCVSWEHQNFGSDQS

SEQ ID NO: 117522 - protein, 35 aa, Artificial Sequence
  Description of Artificial Sequence: Synthetic polypeptide
DEECIRCTNPVATEQYGSVSWNEGEQERQRGGGSR

SEQ ID NO: 117523 - protein, 35 aa, Artificial Sequence
  Description of Artificial Sequence: Synthetic polypeptide
DEECIRCTNPVATEQYGSVSWNEGEQERQRHNMDR

SEQ ID NO: 117524 - protein, 33 aa, Artificial Sequence
  Description of Artificial Sequence: Synthetic polypeptide
DEEEIRATNPVATEQYGDVVMGNGFQGGGGNTE

SEQ ID NO: 117525 - protein, 34 aa, Artificial Sequence
  Description of Artificial Sequence: Synthetic polypeptide
DEEEIRATNPVATEQYGDVSTFGLIGEGGQGNEQ

SEQ ID NO: 117526 - protein, 36 aa, Artificial Sequence
  Description of Artificial Sequence: Synthetic polypeptide
DEEEIRTTNPVATEQYGSFVSTWNMMWQEEMGEELI

SEQ ID NO: 117527 - protein, 35 aa, Artificial Sequence
  Description of Artificial Sequence: Synthetic polypeptide
DEEEIRATNPVATEQYGDVSNMTNNIFQGGGNDGD

SEQ ID NO: 117528 - protein, 34 aa, Artificial Sequence
  Description of Artificial Sequence: Synthetic polypeptide
DEEEIRTTNPVATEQYGSVSLENIQNTQVDPLIY

SEQ ID NO: 117529 - protein, 34 aa, Artificial Sequence
  Description of Artificial Sequence: Synthetic polypeptide
DEEEIRTTNPVATEQYGSVTTMTTDQERPVPVTS

SEQ ID NO: 117530 - protein, 34 aa, Artificial Sequence
  Description of Artificial Sequence: Synthetic polypeptide
DEAEIATTNPVATEQYGSVAITNPLQNGAGEPSE

SEQ ID NO: 117531 - protein, 32 aa, Artificial Sequence
  Description of Artificial Sequence: Synthetic polypeptide
DEECIRCTNPVATEQYGCVSNWNHQNFGSELS

SEQ ID NO: 117532 - protein, 32 aa, Artificial Sequence
  Description of Artificial Sequence: Synthetic polypeptide
DEECIRCTNPVATEQYGCVCSWNHQHFNSDQS

SEQ ID NO: 117533 - protein, 33 aa, Artificial Sequence
  Description of Artificial Sequence: Synthetic polypeptide
DEECIRCTNPVATEQYGCVCSWNHQHFGSNNQS

SEQ ID NO: 117534 - protein, 32 aa, Artificial Sequence
  Description of Artificial Sequence: Synthetic polypeptide
DEEEIRATNPVATEQYGSCATTPQPDDQEGDD

SEQ ID NO: 117535 - protein, 36 aa, Artificial Sequence
  Description of Artificial Sequence: Synthetic polypeptide
DEEEIRTTNPVATEQYGSVSLTLNMMMQEENEEEVN

SEQ ID NO: 117536 - protein, 36 aa, Artificial Sequence
  Description of Artificial Sequence: Synthetic polypeptide
DEEEIRTTNPVATEQYGSVSLTHPAGPNMRNGMNPV

SEQ ID NO: 117537 - protein, 34 aa, Artificial Sequence
  Description of Artificial Sequence: Synthetic polypeptide
DEECIRCTNPVATEPYGSVSWNEGEQERQGNTQA

SEQ ID NO: 117538 - protein, 32 aa, Artificial Sequence
  Description of Artificial Sequence: Synthetic polypeptide
DEAEIRTTNPVATEQYGCVCSSELAHFNSNQS

SEQ ID NO: 117539 - protein, 33 aa, Artificial Sequence
  Description of Artificial Sequence: Synthetic polypeptide
DEAEIRTTNPVATEQYGCVCSNWNHQNFGSEQA

SEQ ID NO: 117540 - protein, 36 aa, Artificial Sequence
  Description of Artificial Sequence: Synthetic polypeptide
DEEEIRTTNPVATEQYGSVTSTTPADDNERIGMNPV

SEQ ID NO: 117541 - protein, 36 aa, Artificial Sequence
  Description of Artificial Sequence: Synthetic polypeptide
DEEEIRTTNPVATEQYGSVTSTTPADPNERFGMNPQ

SEQ ID NO: 117542 - protein, 36 aa, Artificial Sequence
  Description of Artificial Sequence: Synthetic polypeptide
DEEEIRTTNPVATEQYGSVTSTTPAGEIERFGGNPV

SEQ ID NO: 117543 - protein, 36 aa, Artificial Sequence
  Description of Artificial Sequence: Synthetic polypeptide
DEEEIRTTNPVATEQYGSVTSTTPAGPNMRNGMNPV

SEQ ID NO: 117544 - protein, 36 aa, Artificial Sequence
  Description of Artificial Sequence: Synthetic polypeptide
DEEEIRTTNPVATEQYGSVTSTTPAHNAEHFGNNPV

SEQ ID NO: 117545 - protein, 34 aa, Artificial Sequence
  Description of Artificial Sequence: Synthetic polypeptide
DEEEIRTTNPVATEQYGSVSLSMVGMNVPVEERN

SEQ ID NO: 117546 - protein, 35 aa, Artificial Sequence
  Description of Artificial Sequence: Synthetic polypeptide
DEEEIRTTNPVATEQYGSFVIELNLEVAEELTNRQ

SEQ ID NO: 117547 - protein, 36 aa, Artificial Sequence
  Description of Artificial Sequence: Synthetic polypeptide
DEEEIRTTNPVATEQYGSVTSVTTNLEEAQGVVTLT

SEQ ID NO: 117548 - protein, 36 aa, Artificial Sequence
  Description of Artificial Sequence: Synthetic polypeptide
DEEEIRTTNPVATEQYGSFVNSTNQDDDQEGGEEIN

SEQ ID NO: 117549 - protein, 35 aa, Artificial Sequence
  Description of Artificial Sequence: Synthetic polypeptide
DEEEIRTTNPVATEQYGSVSLNWINEELVDMLGDQ

SEQ ID NO: 117550 - protein, 33 aa, Artificial Sequence
  Description of Artificial Sequence: Synthetic polypeptide
DEECIRCTNPVATEQYGCVCSWGNNQNFGSNQS

SEQ ID NO: 117551 - protein, 35 aa, Artificial Sequence
  Description of Artificial Sequence: Synthetic polypeptide
DEEEIRTTNPVATEQYGSVVGDNNMSQDEFGNGGT

SEQ ID NO: 117552 - protein, 34 aa, Artificial Sequence
  Description of Artificial Sequence: Synthetic polypeptide
DEEEIRTTNPVATEQYGSVVGFTNFEGGGEGGES

SEQ ID NO: 117553 - protein, 37 aa, Artificial Sequence
  Description of Artificial Sequence: Synthetic polypeptide
DEEEIRTTNPVATEQYGVVSVVVTNLQQGTEAGNNTE

SEQ ID NO: 117554 - protein, 35 aa, Artificial Sequence
  Description of Artificial Sequence: Synthetic polypeptide
DEEEIRTTNPVATEQYGSVVGFTNFNGEGGNGENS

SEQ ID NO: 117555 - protein, 36 aa, Artificial Sequence
  Description of Artificial Sequence: Synthetic polypeptide
DEECIRTTNPVATEQYGSVSSTNPEGPNMRNGMNPT

SEQ ID NO: 117556 - protein, 33 aa, Artificial Sequence
  Description of Artificial Sequence: Synthetic polypeptide
DEEEIRATNPVATEQWGSVSMSGNGGQHGPQFH

SEQ ID NO: 117557 - protein, 33 aa, Artificial Sequence
  Description of Artificial Sequence: Synthetic polypeptide
DEECIRTTNPVATEQYSACVCSTELAIFGSNQS

SEQ ID NO: 117558 - protein, 34 aa, Artificial Sequence
  Description of Artificial Sequence: Synthetic polypeptide
DEECIRTTNPVATEQYSACVCSTGNLQYFGSDQS

SEQ ID NO: 117559 - protein, 34 aa, Artificial Sequence
  Description of Artificial Sequence: Synthetic polypeptide
DEECIRTTNPVATEQYSACVCSTMNLQIFGSEQS

SEQ ID NO: 117560 - protein, 35 aa, Artificial Sequence
  Description of Artificial Sequence: Synthetic polypeptide
DEECIRTTNPVATEQYSACVCSTNLNQNFGSNNQS

SEQ ID NO: 117561 - protein, 34 aa, Artificial Sequence
  Description of Artificial Sequence: Synthetic polypeptide
DEECIRTTNPVATEQYSACVCSWNLQNFGSDNQA

SEQ ID NO: 117562 - protein, 36 aa, Artificial Sequence
  Description of Artificial Sequence: Synthetic polypeptide
DEECIRTTNPVATEQYGSVSGTNPEGPNMRNGMNDV

SEQ ID NO: 117563 - protein, 33 aa, Artificial Sequence
  Description of Artificial Sequence: Synthetic polypeptide
DEECIRTTNPVAWEQYGVVCTIEGDGQRGMNDA

SEQ ID NO: 117564 - protein, 33 aa, Artificial Sequence
  Description of Artificial Sequence: Synthetic polypeptide
DEECIRTTNPVAYEAYGIKTVSQTNASQDGNVH

SEQ ID NO: 117565 - protein, 32 aa, Artificial Sequence
  Description of Artificial Sequence: Synthetic polypeptide
DEECIRTTNPVAYEAYGKTVSTANASQDGSTF

SEQ ID NO: 117566 - protein, 33 aa, Artificial Sequence
  Description of Artificial Sequence: Synthetic polypeptide
DEECIRTTNPVAYEAYGKTVVSYLNASQDGNNR

SEQ ID NO: 117567 - protein, 33 aa, Artificial Sequence
  Description of Artificial Sequence: Synthetic polypeptide
DEECIRTTNPVAYEPYGSTVQSYFGELSTIGNR

SEQ ID NO: 117568 - protein, 34 aa, Artificial Sequence
  Description of Artificial Sequence: Synthetic polypeptide
DEEEIRTTNPVATEQYGSVSGTMQDVEQGFTEDF

SEQ ID NO: 117569 - protein, 35 aa, Artificial Sequence
  Description of Artificial Sequence: Synthetic polypeptide
DEEEIRTTNPVATEQYGSVSGTGNMEDDDEMQNTI

SEQ ID NO: 117570 - protein, 31 aa, Artificial Sequence
  Description of Artificial Sequence: Synthetic polypeptide
DEECIRTTNPVAYEQWGCVYIQNDNQDHGNH

SEQ ID NO: 117571 - protein, 33 aa, Artificial Sequence
  Description of Artificial Sequence: Synthetic polypeptide
DEECIRTTNPVAWEQYGVVCTIEQDGQRGNNEH

SEQ ID NO: 117572 - protein, 31 aa, Artificial Sequence
  Description of Artificial Sequence: Synthetic polypeptide
DEECIRTTNPVAYEQWGCVYNQNDWQDHGNV

SEQ ID NO: 117573 - protein, 36 aa, Artificial Sequence
  Description of Artificial Sequence: Synthetic polypeptide
DEEEIRTTNPVATEQYGSVSGTNNDQQQDEGGQGEE

SEQ ID NO: 117574 - protein, 34 aa, Artificial Sequence
  Description of Artificial Sequence: Synthetic polypeptide
DEEEIRTTNPVATEQYGVVSVTDGFGENDGGNQQ

SEQ ID NO: 117575 - protein, 35 aa, Artificial Sequence
  Description of Artificial Sequence: Synthetic polypeptide
DEEEIRTTNPVATEQYGSVSHNSNLTESQNVAEDL

SEQ ID NO: 117576 - protein, 35 aa, Artificial Sequence
  Description of Artificial Sequence: Synthetic polypeptide
DEEEIRTTNPVATEQYGSVSHNMMSQITPQDVNES

SEQ ID NO: 117577 - protein, 33 aa, Artificial Sequence
  Description of Artificial Sequence: Synthetic polypeptide
DEEEIRATNPVATEQWGSVSMSGNGGQPQGGQF

SEQ ID NO: 117578 - protein, 35 aa, Artificial Sequence
  Description of Artificial Sequence: Synthetic polypeptide
DEEEIRTTNPVATEQYGSVSGVGNMTAGELNNEGG

SEQ ID NO: 117579 - protein, 33 aa, Artificial Sequence
  Description of Artificial Sequence: Synthetic polypeptide
DEECIRTTNPVATEQYGCVYVWENGIQKTGNAN

SEQ ID NO: 117580 - protein, 36 aa, Artificial Sequence
  Description of Artificial Sequence: Synthetic polypeptide
DEEEIRTTNPVATEQYGSVSGTTPAGPNMRNGMNPV

SEQ ID NO: 117581 - protein, 35 aa, Artificial Sequence
  Description of Artificial Sequence: Synthetic polypeptide
DEECIRTTNPVATEQYGHAVSTTDVRPQRKGNEEM

SEQ ID NO: 117582 - protein, 34 aa, Artificial Sequence
  Description of Artificial Sequence: Synthetic polypeptide
DEECIRTTNPVATEQYGSVRCTEESSNNGGGNED

SEQ ID NO: 117583 - protein, 33 aa, Artificial Sequence
  Description of Artificial Sequence: Synthetic polypeptide
DEEEIRTTNPVATEQYGSVVMNGFNGGGFEFFG

SEQ ID NO: 117584 - protein, 34 aa, Artificial Sequence
  Description of Artificial Sequence: Synthetic polypeptide
DEEEIRTTNPVATEQYGSVVMNGFNTGGGNGGTG

SEQ ID NO: 117585 - protein, 35 aa, Artificial Sequence
  Description of Artificial Sequence: Synthetic polypeptide
DEEEIRTTNPVATEQYGSVVMSDTDEGGQEDDNID

SEQ ID NO: 117586 - protein, 34 aa, Artificial Sequence
  Description of Artificial Sequence: Synthetic polypeptide
DEEEIRTTNPVATEQYGSVVMTGFNDGGGFEGTG

SEQ ID NO: 117587 - protein, 30 aa, Artificial Sequence
  Description of Artificial Sequence: Synthetic polypeptide
DEAEIRTTNPVATEQWGDVSWIEMRAIEDA

SEQ ID NO: 117588 - protein, 34 aa, Artificial Sequence
  Description of Artificial Sequence: Synthetic polypeptide
DEECIRTTNPVATEQYGSVFVWINEQDRKMGGDH

SEQ ID NO: 117589 - protein, 34 aa, Artificial Sequence
  Description of Artificial Sequence: Synthetic polypeptide
DEEEIRTTNPVATEQYGVVSVTTGFGEDEGGNGG

SEQ ID NO: 117590 - protein, 35 aa, Artificial Sequence
  Description of Artificial Sequence: Synthetic polypeptide
DEEEIRTTNPVATEQYGVVSVTPAGPNMRNGMNPV

SEQ ID NO: 117591 - protein, 33 aa, Artificial Sequence
  Description of Artificial Sequence: Synthetic polypeptide
DEEEIRTTNPVATEQYGSVVMNGFNGGGFETIG

SEQ ID NO: 117592 - protein, 30 aa, Artificial Sequence
  Description of Artificial Sequence: Synthetic polypeptide
DEECIRTTNPVAYEQWGCVYQMDMQDHGNH

SEQ ID NO: 117593 - protein, 31 aa, Artificial Sequence
  Description of Artificial Sequence: Synthetic polypeptide
DEECIRTTNPVAYEQWGCVYQMNDGQDHGNH

SEQ ID NO: 117594 - protein, 31 aa, Artificial Sequence
  Description of Artificial Sequence: Synthetic polypeptide
DEECIRTTNPVAYEQWGCVYQNDGQDHAGNA

SEQ ID NO: 117595 - protein, 32 aa, Artificial Sequence
  Description of Artificial Sequence: Synthetic polypeptide
DEECIRTTNPVAYEQWGSVFQIEDLGRGGNET

SEQ ID NO: 117596 - protein, 32 aa, Artificial Sequence
  Description of Artificial Sequence: Synthetic polypeptide
DEECIRTTNPVAYEQWGSYISLDNDLDRPDDR

SEQ ID NO: 117597 - protein, 35 aa, Artificial Sequence
  Description of Artificial Sequence: Synthetic polypeptide
DEECIRTTNPVAYEQWGTVCSTNDLHDQNPGQNNR

SEQ ID NO: 117598 - protein, 33 aa, Artificial Sequence
  Description of Artificial Sequence: Synthetic polypeptide
DEAEIRTTNPVATEQFGTVCASTLYNLRGQDDS

SEQ ID NO: 117599 - protein, 35 aa, Artificial Sequence
  Description of Artificial Sequence: Synthetic polypeptide
DEEEIRTTNPVATEQYGSVSGDGNFNQGEGGEFIE

SEQ ID NO: 117600 - protein, 34 aa, Artificial Sequence
  Description of Artificial Sequence: Synthetic polypeptide
DEEEIRTTNPVATEQYGSVSGDGFGGQNTGEEEG

SEQ ID NO: 117601 - protein, 35 aa, Artificial Sequence
  Description of Artificial Sequence: Synthetic polypeptide
DEEEIRTTNPVATEQYGSVSFWYDPMNLQSMEDFY

SEQ ID NO: 117602 - protein, 34 aa, Artificial Sequence
  Description of Artificial Sequence: Synthetic polypeptide
DEEEIRTTNPVATEQYGSVSGGMGGEDGGENEQA

SEQ ID NO: 117603 - protein, 32 aa, Artificial Sequence
  Description of Artificial Sequence: Synthetic polypeptide
DEECIRTTNPVAYEQWGTYVYTPDDDLDRGNS

SEQ ID NO: 117604 - protein, 36 aa, Artificial Sequence
  Description of Artificial Sequence: Synthetic polypeptide
DEEEIRTTNPVATEQYGSVSFTTPAGPNMRNGMNPV

SEQ ID NO: 117605 - protein, 33 aa, Artificial Sequence
  Description of Artificial Sequence: Synthetic polypeptide
DEECIRTTNPVAYEQWGVVCTIEDGQRGQNGNR

SEQ ID NO: 117606 - protein, 33 aa, Artificial Sequence
  Description of Artificial Sequence: Synthetic polypeptide
DEECIRTTNPVAYEQWGVVCTIEDGQRMGMNDR

SEQ ID NO: 117607 - protein, 34 aa, Artificial Sequence
  Description of Artificial Sequence: Synthetic polypeptide
DEEEIRTTNPVATEQYGSVVSAQGEQQLEMENAF

SEQ ID NO: 117608 - protein, 34 aa, Artificial Sequence
  Description of Artificial Sequence: Synthetic polypeptide
DEAEIRTTNPVATEPYGSVCFTEQGLLTRGGQNE

SEQ ID NO: 117609 - protein, 33 aa, Artificial Sequence
  Description of Artificial Sequence: Synthetic polypeptide
DEECIRTTNPVAYEQWGVVCTIEHGQRQGNGNR

SEQ ID NO: 117610 - protein, 33 aa, Artificial Sequence
  Description of Artificial Sequence: Synthetic polypeptide
DEAEIRTTNPVATEPYGISVSWVVLEQDRIKDV

SEQ ID NO: 117611 - protein, 33 aa, Artificial Sequence
  Description of Artificial Sequence: Synthetic polypeptide
DEECIRTTNPVAYEQWGTYVYTQDNDLDRGENI

SEQ ID NO: 117612 - protein, 30 aa, Artificial Sequence
  Description of Artificial Sequence: Synthetic polypeptide
DEECIRTTNPVAYEQWGSVFQHEDLRQGMT

SEQ ID NO: 117613 - protein, 32 aa, Artificial Sequence
  Description of Artificial Sequence: Synthetic polypeptide
DEECIRTTNPVAYEQWGSVFQHEDLGRGNNDF

SEQ ID NO: 117614 - protein, 32 aa, Artificial Sequence
  Description of Artificial Sequence: Synthetic polypeptide
DEECIRTTNPVAYEQWGSVFQHEDLGRGNDEK

SEQ ID NO: 117615 - protein, 36 aa, Artificial Sequence
  Description of Artificial Sequence: Synthetic polypeptide
DEEEIRTTNPVATEQYGSVSGTDLDLGQGEGGEQDG

SEQ ID NO: 117616 - protein, 36 aa, Artificial Sequence
  Description of Artificial Sequence: Synthetic polypeptide
DEEEIRTTNPVATEQYGSVSGTDGEGQNEEEGNDGG

SEQ ID NO: 117617 - protein, 33 aa, Artificial Sequence
  Description of Artificial Sequence: Synthetic polypeptide
DEECIRTTNPVAYEQWGESYNVDNRNDQPGDNR

SEQ ID NO: 117618 - protein, 34 aa, Artificial Sequence
  Description of Artificial Sequence: Synthetic polypeptide
DEEEIRATNPVATEQWGNTNTSANNELTQGNGNR

SEQ ID NO: 117619 - protein, 33 aa, Artificial Sequence
  Description of Artificial Sequence: Synthetic polypeptide
DEECIRTTNPVAYEQWGESYSVDNEMQGGGDNR

SEQ ID NO: 117620 - protein, 32 aa, Artificial Sequence
  Description of Artificial Sequence: Synthetic polypeptide
DEECIRTTNPVAYEQWGESYSVDNEQKGDNIP

SEQ ID NO: 117621 - protein, 32 aa, Artificial Sequence
  Description of Artificial Sequence: Synthetic polypeptide
DEECIRTTNPVAYEQWGESYSVDNVDQKGDNN

SEQ ID NO: 117622 - protein, 35 aa, Artificial Sequence
  Description of Artificial Sequence: Synthetic polypeptide
DEEEIRTTNPVATEQYGSVSGNNDGQNDTGEDGTN

SEQ ID NO: 117623 - protein, 34 aa, Artificial Sequence
  Description of Artificial Sequence: Synthetic polypeptide
DEEEIRTTNPVATEQYGSVSGNNDGENDTGGDGE

SEQ ID NO: 117624 - protein, 34 aa, Artificial Sequence
  Description of Artificial Sequence: Synthetic polypeptide
DEECIRTTNPVAYEQWGSVACTNNGLQDDHGDDR

SEQ ID NO: 117625 - protein, 33 aa, Artificial Sequence
  Description of Artificial Sequence: Synthetic polypeptide
DEECIRTTNPVAYEQWGSVACTNNGLQDHEDNT

SEQ ID NO: 117626 - protein, 34 aa, Artificial Sequence
  Description of Artificial Sequence: Synthetic polypeptide
DEECIRTTNPVAYEQWGSVACTNNGLQDHGDQRT

SEQ ID NO: 117627 - protein, 36 aa, Artificial Sequence
  Description of Artificial Sequence: Synthetic polypeptide
DEEEIRTTNPVATEQYGSVVPGENLQEHRVTENDLL

SEQ ID NO: 117628 - protein, 35 aa, Artificial Sequence
  Description of Artificial Sequence: Synthetic polypeptide
DEEEIRTTNPVATEQYGSIACGSNESQGPGGSNRY

SEQ ID NO: 117629 - protein, 35 aa, Artificial Sequence
  Description of Artificial Sequence: Synthetic polypeptide
DEEEIRTTNPVATEQYGSVVPPNPPVVHQREGVFE

SEQ ID NO: 117630 - protein, 34 aa, Artificial Sequence
  Description of Artificial Sequence: Synthetic polypeptide
DEECIRTTNPVAYEQWGSVACTNNGLQDLGDDMR

SEQ ID NO: 117631 - protein, 31 aa, Artificial Sequence
  Description of Artificial Sequence: Synthetic polypeptide
DEECIRTTNPVAYEQWGSVFQHEDIGRGNEE

SEQ ID NO: 117632 - protein, 33 aa, Artificial Sequence
  Description of Artificial Sequence: Synthetic polypeptide
DEECIRTTNPVATEQYGCVCSWEHQNFGSENQA

SEQ ID NO: 117633 - protein, 36 aa, Artificial Sequence
  Description of Artificial Sequence: Synthetic polypeptide
DEEEIRTTNPVATEQYGSVSFTDVPLPQETISQQRP

SEQ ID NO: 117634 - protein, 32 aa, Artificial Sequence
  Description of Artificial Sequence: Synthetic polypeptide
DEECIRTTNPVATEQYGCVCSWEHQHFNSEQT

SEQ ID NO: 117635 - protein, 36 aa, Artificial Sequence
  Description of Artificial Sequence: Synthetic polypeptide
DEEEIRTTNPVATEQYGSVSHTITEPNELMINPERN

SEQ ID NO: 117636 - protein, 36 aa, Artificial Sequence
  Description of Artificial Sequence: Synthetic polypeptide
DEEEIRTTNPVATEQYGSVVGSGQNDEEQNQEGENT

SEQ ID NO: 117637 - protein, 36 aa, Artificial Sequence
  Description of Artificial Sequence: Synthetic polypeptide
DEEEIRTTNPVATEQYGSVVGSGQNDEEQSGEGNNM

SEQ ID NO: 117638 - protein, 36 aa, Artificial Sequence
  Description of Artificial Sequence: Synthetic polypeptide
DEEEIRTTNPVATEQYGSVVGSGQNDEEQSIEGGNA

SEQ ID NO: 117639 - protein, 35 aa, Artificial Sequence
  Description of Artificial Sequence: Synthetic polypeptide
DEEEIRTTNPVATEQYGSVSITLELINFQNETELD

SEQ ID NO: 117640 - protein, 36 aa, Artificial Sequence
  Description of Artificial Sequence: Synthetic polypeptide
DEEEIRTTNPVATEQYGSVVGSGQNDEEQSNEGENI

SEQ ID NO: 117641 - protein, 36 aa, Artificial Sequence
  Description of Artificial Sequence: Synthetic polypeptide
DEEEIRTTNPVATEQYGSVVGSGQNDEEQTDEGENG

SEQ ID NO: 117642 - protein, 36 aa, Artificial Sequence
  Description of Artificial Sequence: Synthetic polypeptide
DEEEIRTTNPVATEQYGSVVGSGQNDEEQVIEGNNG

SEQ ID NO: 117643 - protein, 36 aa, Artificial Sequence
  Description of Artificial Sequence: Synthetic polypeptide
DEEEIRTTNPVATEQYGSVVGSGQNDEEQGDEGNNI

SEQ ID NO: 117644 - protein, 36 aa, Artificial Sequence
  Description of Artificial Sequence: Synthetic polypeptide
DEEEIRTTNPVATEQYGSVVGSGQNDEGQGNEGNEN

SEQ ID NO: 117645 - protein, 35 aa, Artificial Sequence
  Description of Artificial Sequence: Synthetic polypeptide
DEEEIRTTNPVATEQYGSVVGSTGTIGQGNDQNEG

SEQ ID NO: 117646 - protein, 35 aa, Artificial Sequence
  Description of Artificial Sequence: Synthetic polypeptide
DEEEIRTTNPVATEQYGSVVGTGDGGQNNGGNVTN

SEQ ID NO: 117647 - protein, 35 aa, Artificial Sequence
  Description of Artificial Sequence: Synthetic polypeptide
DEEEIRTTNPVATEQYGSVVGTNMSQDEFQNEGGI

SEQ ID NO: 117648 - protein, 35 aa, Artificial Sequence
  Description of Artificial Sequence: Synthetic polypeptide
DEEEIRTTNPVATEQYGSVVGTNMSQQEEFDNGGN

SEQ ID NO: 117649 - protein, 34 aa, Artificial Sequence
  Description of Artificial Sequence: Synthetic polypeptide
DEEEIRTTNPVATEQYGSVVGVNFQGEQGEGEQG

SEQ ID NO: 117650 - protein, 35 aa, Artificial Sequence
  Description of Artificial Sequence: Synthetic polypeptide
DEEEIRTTNPVATEQYGSVVIAMNDGLNRQGPALN

SEQ ID NO: 117651 - protein, 34 aa, Artificial Sequence
  Description of Artificial Sequence: Synthetic polypeptide
DEEEIRTTNPVATEQYGSVVIAMNMQNEQNPPLN

SEQ ID NO: 117652 - protein, 35 aa, Artificial Sequence
  Description of Artificial Sequence: Synthetic polypeptide
DEEEIRTTNPVATEQYGSVVGSNMGQNDEGGNEEI

SEQ ID NO: 117653 - protein, 34 aa, Artificial Sequence
  Description of Artificial Sequence: Synthetic polypeptide
DEEEIRTTNPVATEQYGSVVITMNGQITQVPTLN

SEQ ID NO: 117654 - protein, 36 aa, Artificial Sequence
  Description of Artificial Sequence: Synthetic polypeptide
DEEEIRTTNPVATEQYGSVVGSGQNDEEQDGGGNNV

SEQ ID NO: 117655 - protein, 36 aa, Artificial Sequence
  Description of Artificial Sequence: Synthetic polypeptide
DEEEIRTTNPVATEQYGSVVGSGQNDEEQDGEGDNN

SEQ ID NO: 117656 - protein, 35 aa, Artificial Sequence
  Description of Artificial Sequence: Synthetic polypeptide
DEEEIRTTNPVATEQYGSVVGFTNMTQDEFDNEGT

SEQ ID NO: 117657 - protein, 37 aa, Artificial Sequence
  Description of Artificial Sequence: Synthetic polypeptide
DEEEIRTTNPVATEQYGVVSVVVTNLQLQQIGNNEED

SEQ ID NO: 117658 - protein, 37 aa, Artificial Sequence
  Description of Artificial Sequence: Synthetic polypeptide
DEEEIRTTNPVATEQYGVVSVVVTNLQLGGNNQEQDT

SEQ ID NO: 117659 - protein, 35 aa, Artificial Sequence
  Description of Artificial Sequence: Synthetic polypeptide
DEEEIRTTNPVATEQYGSVSITLVGMGTGGGNDGN

SEQ ID NO: 117660 - protein, 36 aa, Artificial Sequence
  Description of Artificial Sequence: Synthetic polypeptide
DEEEIRTTNPVATEQYGSVVGLTNMSDQDEFGNGGT

SEQ ID NO: 117661 - protein, 35 aa, Artificial Sequence
  Description of Artificial Sequence: Synthetic polypeptide
DEEEIRTTNPVATEQYGSVVGNDDDEEQEEGGGNS

SEQ ID NO: 117662 - protein, 36 aa, Artificial Sequence
  Description of Artificial Sequence: Synthetic polypeptide
DEEEIRTTNPVATEQYGSVVGNGTMNLEDPEGQGNI

SEQ ID NO: 117663 - protein, 38 aa, Artificial Sequence
  Description of Artificial Sequence: Synthetic polypeptide
DEEEIRTTNPVATEQYGVVSVVVSNNNTNLQQGTNEEE

SEQ ID NO: 117664 - protein, 37 aa, Artificial Sequence
  Description of Artificial Sequence: Synthetic polypeptide
DEEEIRTTNPVATEQYGVVSVVVTNLQAGNQQGTEDE

SEQ ID NO: 117665 - protein, 37 aa, Artificial Sequence
  Description of Artificial Sequence: Synthetic polypeptide
DEEEIRTTNPVATEQYGVVSVVVSTVNLQAGTTEESD

SEQ ID NO: 117666 - protein, 37 aa, Artificial Sequence
  Description of Artificial Sequence: Synthetic polypeptide
DEEEIRTTNPVATEQYGVVSVVVSTNQQSGNTETGSE

SEQ ID NO: 117667 - protein, 37 aa, Artificial Sequence
  Description of Artificial Sequence: Synthetic polypeptide
DEEEIRTTNPVATEQYGVVSVVVSTNQQAGNSEEGSE

SEQ ID NO: 117668 - protein, 38 aa, Artificial Sequence
  Description of Artificial Sequence: Synthetic polypeptide
DEEEIRTTNPVATEQYGVVSVVVSTNNNNLQQGTNSED

SEQ ID NO: 117669 - protein, 37 aa, Artificial Sequence
  Description of Artificial Sequence: Synthetic polypeptide
DEEEIRTTNPVATEQYGVVSVVVSTNLQAGTTEQGQD

SEQ ID NO: 117670 - protein, 38 aa, Artificial Sequence
  Description of Artificial Sequence: Synthetic polypeptide
DEEEIRTTNPVATEQYGVVSVVVSTNLQAGNTEQGVAE

SEQ ID NO: 117671 - protein, 37 aa, Artificial Sequence
  Description of Artificial Sequence: Synthetic polypeptide
DEEEIRTTNPVATEQYGVVSVVVSTNLEQGNNTEDTE

SEQ ID NO: 117672 - protein, 35 aa, Artificial Sequence
  Description of Artificial Sequence: Synthetic polypeptide
DEAEIRTTNPVATEQWGTVISCTINPLSQQRVNNN

SEQ ID NO: 117673 - protein, 36 aa, Artificial Sequence
  Description of Artificial Sequence: Synthetic polypeptide
DEEEIRTTNPVATEQYGVVSVVTNNNQAGNNDEQQD

SEQ ID NO: 117674 - protein, 35 aa, Artificial Sequence
  Description of Artificial Sequence: Synthetic polypeptide
DEECIRTTNPVATEQWGHSNVSYTNELQHIGGGFE

SEQ ID NO: 117675 - protein, 37 aa, Artificial Sequence
  Description of Artificial Sequence: Synthetic polypeptide
DEEEIRTTNPVATEQYGVVSVTVVTNLQQGTNQTTTE

SEQ ID NO: 117676 - protein, 35 aa, Artificial Sequence
  Description of Artificial Sequence: Synthetic polypeptide
DEEEIRTTNPVATEQYGSVSIENLVQNTQVDPDIQ

SEQ ID NO: 117677 - protein, 34 aa, Artificial Sequence
  Description of Artificial Sequence: Synthetic polypeptide
DEECIRTTNPVATEQYGCVCSTGNDQEFFNSEQS

SEQ ID NO: 117678 - protein, 35 aa, Artificial Sequence
  Description of Artificial Sequence: Synthetic polypeptide
DEEEIRTTNPVATEQYGSVSIENLLTNTQVDPLIY

SEQ ID NO: 117679 - protein, 35 aa, Artificial Sequence
  Description of Artificial Sequence: Synthetic polypeptide
DEEEIRTTNPVATEQYGSVSIENDLQNTQVDPQQY

SEQ ID NO: 117680 - protein, 34 aa, Artificial Sequence
  Description of Artificial Sequence: Synthetic polypeptide
DEEEIRTTNPVATEQYGSVSIENAQNTQVDPFIA

SEQ ID NO: 117681 - protein, 35 aa, Artificial Sequence
  Description of Artificial Sequence: Synthetic polypeptide
DEEEIRTTNPVATEQYGSVSIEMNLQNTQVFPLIY

SEQ ID NO: 117682 - protein, 34 aa, Artificial Sequence
  Description of Artificial Sequence: Synthetic polypeptide
DEECIRTTNPVATEQYGCVCSTNLNDNFGSDTQS

SEQ ID NO: 117683 - protein, 33 aa, Artificial Sequence
  Description of Artificial Sequence: Synthetic polypeptide
DEECIRTTNPVATEQYGCVCSTGEHQNFGSDQA

SEQ ID NO: 117684 - protein, 34 aa, Artificial Sequence
  Description of Artificial Sequence: Synthetic polypeptide
DEECIRTTNPVATEQYGCVCSTTGEELNFGSNQS

SEQ ID NO: 117685 - protein, 36 aa, Artificial Sequence
  Description of Artificial Sequence: Synthetic polypeptide
DEEEIRTTNPVATEQYGSVSIDNGLGQQEGQTGGDT

SEQ ID NO: 117686 - protein, 35 aa, Artificial Sequence
  Description of Artificial Sequence: Synthetic polypeptide
DEEEIRTTNPVATEQYGSVSIAPNLLQIQSEEPAL

SEQ ID NO: 117687 - protein, 34 aa, Artificial Sequence
  Description of Artificial Sequence: Synthetic polypeptide
DEEEIRTTNPVATEQYGSVSIAGTINVATMQEEI

SEQ ID NO: 117688 - protein, 36 aa, Artificial Sequence
  Description of Artificial Sequence: Synthetic polypeptide
DEEEIRTTNPVATEQYGSVSHTTPAGPNMRNGMNPV

SEQ ID NO: 117689 - protein, 34 aa, Artificial Sequence
  Description of Artificial Sequence: Synthetic polypeptide
DEEEIRATNPVATEQYGCNVAITNHDEQAGMGSR

SEQ ID NO: 117690 - protein, 35 aa, Artificial Sequence
  Description of Artificial Sequence: Synthetic polypeptide
DEEEIRTTNPVATEQYGSVSHTTEPQILMTQQETN

SEQ ID NO: 117691 - protein, 35 aa, Artificial Sequence
  Description of Artificial Sequence: Synthetic polypeptide
DEEEIRTTNPVATEQYGSVSHTTEPLIVMTNPETN

SEQ ID NO: 117692 - protein, 35 aa, Artificial Sequence
  Description of Artificial Sequence: Synthetic polypeptide
DEEEIRTTNPVATEQYGSVSIDQNDQMNEMGEGEN

SEQ ID NO: 117693 - protein, 34 aa, Artificial Sequence
  Description of Artificial Sequence: Synthetic polypeptide
DEECIRTTNPVATEQYGCVCSTGEHQENFGSNQE

SEQ ID NO: 117694 - protein, 34 aa, Artificial Sequence
  Description of Artificial Sequence: Synthetic polypeptide
DEECIRTTNPVATEQYGCVCSTGEENLNFGSEQS

SEQ ID NO: 117695 - protein, 35 aa, Artificial Sequence
  Description of Artificial Sequence: Synthetic polypeptide
DEEEIRTTNPVATEQYGSVSIMMDDELGQLPEQRE

SEQ ID NO: 117696 - protein, 35 aa, Artificial Sequence
  Description of Artificial Sequence: Synthetic polypeptide
DEAEIRTTNPVATEQWGHSNVSYTNMLQHTGGEGF

SEQ ID NO: 117697 - protein, 34 aa, Artificial Sequence
  Description of Artificial Sequence: Synthetic polypeptide
DEEEIRTTNPVATEQYGSVVLVNQTNPSDGELLD

SEQ ID NO: 117698 - protein, 31 aa, Artificial Sequence
  Description of Artificial Sequence: Synthetic polypeptide
DEECIRTTNPVATEQWGSCVEISVLYNANHL

SEQ ID NO: 117699 - protein, 35 aa, Artificial Sequence
  Description of Artificial Sequence: Synthetic polypeptide
DEEEIRTTNPVATEQYGSVSITDNDIQQTISVEEA

SEQ ID NO: 117700 - protein, 35 aa, Artificial Sequence
  Description of Artificial Sequence: Synthetic polypeptide
DEECIRTTNPVATEQYGCTVPFHNMLSQRGGNPSM

SEQ ID NO: 117701 - protein, 34 aa, Artificial Sequence
  Description of Artificial Sequence: Synthetic polypeptide
DEECIRTTNPVATEQYGCVCSNTEPQEFFGSNQS

SEQ ID NO: 117702 - protein, 33 aa, Artificial Sequence
  Description of Artificial Sequence: Synthetic polypeptide
DEECIRTTNPVATEQYGCVCSNWNDQFFGSEQS

SEQ ID NO: 117703 - protein, 37 aa, Artificial Sequence
  Description of Artificial Sequence: Synthetic polypeptide
DEEEIRTTNPVATEQYGVVSVTVVTNLQAGNTEEGTE

SEQ ID NO: 117704 - protein, 32 aa, Artificial Sequence
  Description of Artificial Sequence: Synthetic polypeptide
DEECIRTTNPVATEQYGCVCSSEHQNFGSEQE

SEQ ID NO: 117705 - protein, 34 aa, Artificial Sequence
  Description of Artificial Sequence: Synthetic polypeptide
DEECIRTTNPVATEQYGCVCSTEDHQNFGSNNQE

SEQ ID NO: 117706 - protein, 33 aa, Artificial Sequence
  Description of Artificial Sequence: Synthetic polypeptide
DEECIRTTNPVATEQYGCVCSTEEAENFGSNQS

SEQ ID NO: 117707 - protein, 33 aa, Artificial Sequence
  Description of Artificial Sequence: Synthetic polypeptide
DEECIRTTNPVATEQYGCVCSTEENANFNSNQS

SEQ ID NO: 117708 - protein, 33 aa, Artificial Sequence
  Description of Artificial Sequence: Synthetic polypeptide
DEECIRTTNPVATEQYGCVCSTEENARFGSQQS

SEQ ID NO: 117709 - protein, 33 aa, Artificial Sequence
  Description of Artificial Sequence: Synthetic polypeptide
DEECIRTTNPVATEQYGCVCSTEPQEFFGSDQG

SEQ ID NO: 117710 - protein, 34 aa, Artificial Sequence
  Description of Artificial Sequence: Synthetic polypeptide
DEECIRTTNPVATEQYGCVCSTEPQEFFGSNNQA

SEQ ID NO: 117711 - protein, 35 aa, Artificial Sequence
  Description of Artificial Sequence: Synthetic polypeptide
DEEEIRTTNPVATEQYGSVSIMMHDMLHQLPEQRE

SEQ ID NO: 117712 - protein, 35 aa, Artificial Sequence
  Description of Artificial Sequence: Synthetic polypeptide
DEEEIRTTNPVATEQYGSVSIMMDDMLEQLPEQRG

SEQ ID NO: 117713 - protein, 33 aa, Artificial Sequence
  Description of Artificial Sequence: Synthetic polypeptide
DEEEIRATNPVATEQWGSVSVANNHDADPSGSR

SEQ ID NO: 117714 - protein, 34 aa, Artificial Sequence
  Description of Artificial Sequence: Synthetic polypeptide
DEEEIRTTNPVATEQYGSFGSDTNGGNIEEDENI

SEQ ID NO: 117715 - protein, 35 aa, Artificial Sequence
  Description of Artificial Sequence: Synthetic polypeptide
DEEEIRTTNPVATEQYGSVWPENNPLDERGEDEDN

SEQ ID NO: 117716 - protein, 36 aa, Artificial Sequence
  Description of Artificial Sequence: Synthetic polypeptide
DEEEIRTTNPVATEQYGSVSATTFAGPNMRNGMNPV

SEQ ID NO: 117717 - protein, 33 aa, Artificial Sequence
  Description of Artificial Sequence: Synthetic polypeptide
DEEEIRTTNPVATEQYGSVYTGGDGEQGEEEGV

SEQ ID NO: 117718 - protein, 34 aa, Artificial Sequence
  Description of Artificial Sequence: Synthetic polypeptide
DEEEIRTTNPVATEQYGSVQINNQEQSHETNQEE

SEQ ID NO: 117719 - protein, 36 aa, Artificial Sequence
  Description of Artificial Sequence: Synthetic polypeptide
DEEEIRTTNPVATEQYGSVQGSGNDDEEQDGEGNNG

SEQ ID NO: 117720 - protein, 33 aa, Artificial Sequence
  Description of Artificial Sequence: Synthetic polypeptide
DEEEIATTNPVAYEQWGVSWSLDNMEQREDTNR

SEQ ID NO: 117721 - protein, 36 aa, Artificial Sequence
  Description of Artificial Sequence: Synthetic polypeptide
DEEEIRTTNPVATEQYGSVQGPTTNLNARGHEIEDT

SEQ ID NO: 117722 - protein, 32 aa, Artificial Sequence
  Description of Artificial Sequence: Synthetic polypeptide
DEEEIATTNPVAYEQWGTYSTINPLQDHENNH

SEQ ID NO: 117723 - protein, 32 aa, Artificial Sequence
  Description of Artificial Sequence: Synthetic polypeptide
DEEEIATTNPVAYEQWGTVSWTEHDNRGGGMR

SEQ ID NO: 117724 - protein, 34 aa, Artificial Sequence
  Description of Artificial Sequence: Synthetic polypeptide
DEEEIRTTNPVATEQYGSVYTGEEVERMGLVPQD

SEQ ID NO: 117725 - protein, 35 aa, Artificial Sequence
  Description of Artificial Sequence: Synthetic polypeptide
DEEEIRTTNPVATEQYGSVQFPITNLQTVIQLEIP

SEQ ID NO: 117726 - protein, 33 aa, Artificial Sequence
  Description of Artificial Sequence: Synthetic polypeptide
DEEEIATTNPVAYEQWGSVYKTDEQIQERMGNM

SEQ ID NO: 117727 - protein, 35 aa, Artificial Sequence
  Description of Artificial Sequence: Synthetic polypeptide
DEEEIATTNPVAYEQWGSVVSTENTLGEERGNDNG

SEQ ID NO: 117728 - protein, 32 aa, Artificial Sequence
  Description of Artificial Sequence: Synthetic polypeptide
DEEEIATTNPVAYEQWGSVTTTNHGEDNGNVG

SEQ ID NO: 117729 - protein, 33 aa, Artificial Sequence
  Description of Artificial Sequence: Synthetic polypeptide
DEEEIATTNPVAYEQWGSVTGNGNQQGNMGDQR

SEQ ID NO: 117730 - protein, 33 aa, Artificial Sequence
  Description of Artificial Sequence: Synthetic polypeptide
DEEEIATTNPVAYEQWGSVTGDNVGNQRGGDNP

SEQ ID NO: 117731 - protein, 32 aa, Artificial Sequence
  Description of Artificial Sequence: Synthetic polypeptide
DEEEIATTNPVAYEQWGSVSYSNGDNHGGHDR

SEQ ID NO: 117732 - protein, 33 aa, Artificial Sequence
  Description of Artificial Sequence: Synthetic polypeptide
DEEEIATTNPVAYEQWGSVSTTNGDNHGGRNDE

SEQ ID NO: 117733 - protein, 34 aa, Artificial Sequence
  Description of Artificial Sequence: Synthetic polypeptide
DEEEIATTNPVAYEQWGTSNVSYPNELQHRPGGF

SEQ ID NO: 117734 - protein, 36 aa, Artificial Sequence
  Description of Artificial Sequence: Synthetic polypeptide
DEEEIRTTNPVATEQYGSVQEPTNNIGFERMDNVRV

SEQ ID NO: 117735 - protein, 35 aa, Artificial Sequence
  Description of Artificial Sequence: Synthetic polypeptide
DEEEIRTTNPVATEQYGSVYTDYLTNLESTQNDDT

SEQ ID NO: 117736 - protein, 33 aa, Artificial Sequence
  Description of Artificial Sequence: Synthetic polypeptide
DEEEIRTTNPVATEQYGSVQIVTEEVDEGEESI

SEQ ID NO: 117737 - protein, 34 aa, Artificial Sequence
  Description of Artificial Sequence: Synthetic polypeptide
DEEEIRTTNPVATEQYGSVYTDDQFDEELEGGGG

SEQ ID NO: 117738 - protein, 34 aa, Artificial Sequence
  Description of Artificial Sequence: Synthetic polypeptide
DEEEIRTTNPVATEQYGSVQNTMNQAQTESEIEM

SEQ ID NO: 117739 - protein, 34 aa, Artificial Sequence
  Description of Artificial Sequence: Synthetic polypeptide
DEEEIRTTNPVATEQYGSVQNGNLEAAAENVEQE

SEQ ID NO: 117740 - protein, 35 aa, Artificial Sequence
  Description of Artificial Sequence: Synthetic polypeptide
DEEEIRTTNPVATEQYGSVCSGTEGLDTRVFVEEN

SEQ ID NO: 117741 - protein, 36 aa, Artificial Sequence
  Description of Artificial Sequence: Synthetic polypeptide
DEEEIRTTNPVATEQYGVVSTVVNNQAGNQEEEEDE

SEQ ID NO: 117742 - protein, 34 aa, Artificial Sequence
  Description of Artificial Sequence: Synthetic polypeptide
DEEEIRTTNPVATEQYGSVCSIGVHDTRNVEENA

SEQ ID NO: 117743 - protein, 35 aa, Artificial Sequence
  Description of Artificial Sequence: Synthetic polypeptide
DEEEIATTNPVAYEQYGKVVSCWTNEWSNRGTNVR

SEQ ID NO: 117744 - protein, 34 aa, Artificial Sequence
  Description of Artificial Sequence: Synthetic polypeptide
DEEEIRTTNPVATEQYGSVQIVNIHDTRPENQTD

SEQ ID NO: 117745 - protein, 36 aa, Artificial Sequence
  Description of Artificial Sequence: Synthetic polypeptide
DEEEIRTTNPVATEQYGSVQLTWNGLEMVSDGNEVV

SEQ ID NO: 117746 - protein, 34 aa, Artificial Sequence
  Description of Artificial Sequence: Synthetic polypeptide
DEEEIRTTNPVATEQYGSVQLTPNGLVPLIMEMP

SEQ ID NO: 117747 - protein, 35 aa, Artificial Sequence
  Description of Artificial Sequence: Synthetic polypeptide
DEEEIRTTNPVATEQYGSVQLTPNEFPRDIELANM

SEQ ID NO: 117748 - protein, 34 aa, Artificial Sequence
  Description of Artificial Sequence: Synthetic polypeptide
DEEEIRTTNPVATEQYGSVQLTPGIINRGIMEEE

SEQ ID NO: 117749 - protein, 35 aa, Artificial Sequence
  Description of Artificial Sequence: Synthetic polypeptide
DEEEIRTTNPVATEQYGSVQLTNINEENLALEPLR

SEQ ID NO: 117750 - protein, 35 aa, Artificial Sequence
  Description of Artificial Sequence: Synthetic polypeptide
DEEEIRTTNPVATEQYGSVYTDNLAPNSAMEYQRM

SEQ ID NO: 117751 - protein, 35 aa, Artificial Sequence
  Description of Artificial Sequence: Synthetic polypeptide
DEEEIRTTNPVATEQYGSVYTDNMVEGQTGDGEEM

SEQ ID NO: 117752 - protein, 34 aa, Artificial Sequence
  Description of Artificial Sequence: Synthetic polypeptide
DEEEIRTTNPVATEQYGSVYTDQLTILESTQNDD

SEQ ID NO: 117753 - protein, 36 aa, Artificial Sequence
  Description of Artificial Sequence: Synthetic polypeptide
DEEEIRTTNPVATEQYGSVQLTPNSQYQAQDQEGNV

SEQ ID NO: 117754 - protein, 35 aa, Artificial Sequence
  Description of Artificial Sequence: Synthetic polypeptide
DEEEIRTTNPVATEQYGSVCSENLDEHLVGEEEEY

SEQ ID NO: 117755 - protein, 33 aa, Artificial Sequence
  Description of Artificial Sequence: Synthetic polypeptide
DEEEIATTNPVAYEQWGSVSTTNGDNAGGGNQL

SEQ ID NO: 117756 - protein, 34 aa, Artificial Sequence
  Description of Artificial Sequence: Synthetic polypeptide
DEEEIRTTNPVATEQYGSVCSPEPEDNIGNQNID

SEQ ID NO: 117757 - protein, 36 aa, Artificial Sequence
  Description of Artificial Sequence: Synthetic polypeptide
DEEEIRTTNPVATEQYGSVCSPTELPQNISNEEPSE

SEQ ID NO: 117758 - protein, 35 aa, Artificial Sequence
  Description of Artificial Sequence: Synthetic polypeptide
DEEEIRTTNPVATEQYGSVYTTGDDENQEGEGNQS

SEQ ID NO: 117759 - protein, 35 aa, Artificial Sequence
  Description of Artificial Sequence: Synthetic polypeptide
DEEEIRTTNPVATEQYGSVCSPTFSDIELYEDNME

SEQ ID NO: 117760 - protein, 36 aa, Artificial Sequence
  Description of Artificial Sequence: Synthetic polypeptide
DEEEIRTTNPVATEQYGSVCSPTGNNLERNDDTQEI

SEQ ID NO: 117761 - protein, 36 aa, Artificial Sequence
  Description of Artificial Sequence: Synthetic polypeptide
DEEEIRTTNPVATEQYGSVCSPTIALSEARIEGQDT

SEQ ID NO: 117762 - protein, 35 aa, Artificial Sequence
  Description of Artificial Sequence: Synthetic polypeptide
DEEEIRTTNPVATEQYGSVCSPTLELPPRNEEPQE

SEQ ID NO: 117763 - protein, 35 aa, Artificial Sequence
  Description of Artificial Sequence: Synthetic polypeptide
DEEEIRTTNPVATEQYGSVCSPTLNMERNDDTQES

SEQ ID NO: 117764 - protein, 34 aa, Artificial Sequence
  Description of Artificial Sequence: Synthetic polypeptide
DEEEIRTTNPVATEQYGSVCSPTCSDIELYEDME

SEQ ID NO: 117765 - protein, 34 aa, Artificial Sequence
  Description of Artificial Sequence: Synthetic polypeptide
DEEEIRTTNPVATEQYGSVQCTELEQFQTLMQLE

SEQ ID NO: 117766 - protein, 36 aa, Artificial Sequence
  Description of Artificial Sequence: Synthetic polypeptide
DEEEIRTTNPVATEQYGSVCSPTNGHEVNDDPGQRN

SEQ ID NO: 117767 - protein, 35 aa, Artificial Sequence
  Description of Artificial Sequence: Synthetic polypeptide
DEEEIRTTNPVATEQYGSVCSPTNNIEDSTEIMRS

SEQ ID NO: 117768 - protein, 36 aa, Artificial Sequence
  Description of Artificial Sequence: Synthetic polypeptide
DEEEIRTTNPVATEQYGSVCSPTNNLTERNDDTQQS

SEQ ID NO: 117769 - protein, 35 aa, Artificial Sequence
  Description of Artificial Sequence: Synthetic polypeptide
DEEEIRTTNPVATEQYGSVCSPTNNYDTTRVEDTD

SEQ ID NO: 117770 - protein, 35 aa, Artificial Sequence
  Description of Artificial Sequence: Synthetic polypeptide
DEEEIRTTNPVATEQYGSVCSPTTNLENNDDTQES

SEQ ID NO: 117771 - protein, 36 aa, Artificial Sequence
  Description of Artificial Sequence: Synthetic polypeptide
DEEEIRTTNPVATEQYGSVCSPTYNQLERNDDTQES

SEQ ID NO: 117772 - protein, 33 aa, Artificial Sequence
  Description of Artificial Sequence: Synthetic polypeptide
DEAEICTTNPVATEQWGAVSTNLNAGNAGENSS

SEQ ID NO: 117773 - protein, 36 aa, Artificial Sequence
  Description of Artificial Sequence: Synthetic polypeptide
DEEEIRTTNPVATEQYGSVCSPTLPAAEQHGMQNQV

SEQ ID NO: 117774 - protein, 35 aa, Artificial Sequence
  Description of Artificial Sequence: Synthetic polypeptide
DEEEIRTTNPVATEQYGSVCSPENLIEDMTEIMGN

SEQ ID NO: 117775 - protein, 36 aa, Artificial Sequence
  Description of Artificial Sequence: Synthetic polypeptide
DEEEIRTTNPVATEQYGSVYTNTQNGNQEIGTNNET

SEQ ID NO: 117776 - protein, 35 aa, Artificial Sequence
  Description of Artificial Sequence: Synthetic polypeptide
DEEEIRTTNPVATEQYGSVCSPNKLQHFSQEESHD

SEQ ID NO: 117777 - protein, 36 aa, Artificial Sequence
  Description of Artificial Sequence: Synthetic polypeptide
DEEEIRTTNPVATEQYGSVQEPSNTGPEPRDMNDRH

SEQ ID NO: 117778 - protein, 34 aa, Artificial Sequence
  Description of Artificial Sequence: Synthetic polypeptide
DEEEIRTTNPVATEQYGSVYTMNIIEPMIFNENL

SEQ ID NO: 117779 - protein, 34 aa, Artificial Sequence
  Description of Artificial Sequence: Synthetic polypeptide
DEEEIRTTNPVATEQYGSVQDVTEEVDQEDEERI

SEQ ID NO: 117780 - protein, 34 aa, Artificial Sequence
  Description of Artificial Sequence: Synthetic polypeptide
DEEEIRTTNPVATEQYGSVCSPLHDLIRFPEEQI

SEQ ID NO: 117781 - protein, 35 aa, Artificial Sequence
  Description of Artificial Sequence: Synthetic polypeptide
DEEEIRTTNPVATEQYGSVCSPLLLPQARNEEPSL

SEQ ID NO: 117782 - protein, 33 aa, Artificial Sequence
  Description of Artificial Sequence: Synthetic polypeptide
DEAEICTTNPVAYEQWGSVCSTNDTQGEGMNNE

SEQ ID NO: 117783 - protein, 36 aa, Artificial Sequence
  Description of Artificial Sequence: Synthetic polypeptide
DEEEIRTTNPVATEQYGSVQCWTSNNLEQPIDQERI

SEQ ID NO: 117784 - protein, 35 aa, Artificial Sequence
  Description of Artificial Sequence: Synthetic polypeptide
DEAEICTTNPVATEQYGSVSWTDNGEQDGQGGNHE

SEQ ID NO: 117785 - protein, 36 aa, Artificial Sequence
  Description of Artificial Sequence: Synthetic polypeptide
DEEEIRTTNPVATEQYGSVCSPLMLPQARLNEEPSE

SEQ ID NO: 117786 - protein, 35 aa, Artificial Sequence
  Description of Artificial Sequence: Synthetic polypeptide
DEEEIRTTNPVATEQYGSVCSPLTLPQSINEETFE

SEQ ID NO: 117787 - protein, 34 aa, Artificial Sequence
  Description of Artificial Sequence: Synthetic polypeptide
DEEEIRTTNPVATEQYGSVQCTSSLLPRLQVQGS

SEQ ID NO: 117788 - protein, 34 aa, Artificial Sequence
  Description of Artificial Sequence: Synthetic polypeptide
DEEEIRTTNPVATEQYGSVQCTPNLMPNLLEAIN

SEQ ID NO: 117789 - protein, 33 aa, Artificial Sequence
  Description of Artificial Sequence: Synthetic polypeptide
DEAEICTTNPVATEYYGEVSTGNMQDAGGMNTE

SEQ ID NO: 117790 - protein, 33 aa, Artificial Sequence
  Description of Artificial Sequence: Synthetic polypeptide
DEAEICTTNPVATEQYGTVSSVTQGPVEQEGND

SEQ ID NO: 117791 - protein, 33 aa, Artificial Sequence
  Description of Artificial Sequence: Synthetic polypeptide
DEAEICTTNPVATEQYGTVSSVTDGPNEFEGND

SEQ ID NO: 117792 - protein, 35 aa, Artificial Sequence
  Description of Artificial Sequence: Synthetic polypeptide
DEEEIRTTNPVATEQYGSVCSPMLQNLQNNEEKEL

SEQ ID NO: 117793 - protein, 35 aa, Artificial Sequence
  Description of Artificial Sequence: Synthetic polypeptide
DEEEIRTTNPVATEQYGSVQCVRASSNNNGGNNET

SEQ ID NO: 117794 - protein, 35 aa, Artificial Sequence
  Description of Artificial Sequence: Synthetic polypeptide
DEEEIRTTNPVATEQYGSVYTDDELNQQQEENEGI

SEQ ID NO: 117795 - protein, 35 aa, Artificial Sequence
  Description of Artificial Sequence: Synthetic polypeptide
DEEEIRTTNPVATEQYGSVYTCVYLEPPGNMGDEM

SEQ ID NO: 117796 - protein, 31 aa, Artificial Sequence
  Description of Artificial Sequence: Synthetic polypeptide
DEAEIGTTNPVATEQYGCVSTDDSYAYENQT

SEQ ID NO: 117797 - protein, 35 aa, Artificial Sequence
  Description of Artificial Sequence: Synthetic polypeptide
DEEEIRTTNPVATEQYGSVQPTNINEENRAIEFNT

SEQ ID NO: 117798 - protein, 35 aa, Artificial Sequence
  Description of Artificial Sequence: Synthetic polypeptide
DEEEIRTTNPVATEQYGSVCPDTYDLQEIEGSFPE

SEQ ID NO: 117799 - protein, 35 aa, Artificial Sequence
  Description of Artificial Sequence: Synthetic polypeptide
DEEEIRTTNPVATEQYGSVCPDTYDLQEIGGVQIE

SEQ ID NO: 117800 - protein, 36 aa, Artificial Sequence
  Description of Artificial Sequence: Synthetic polypeptide
DEEEIRTTNPVATEQYGSVYSNPPLPQARNGVGVLI

SEQ ID NO: 117801 - protein, 35 aa, Artificial Sequence
  Description of Artificial Sequence: Synthetic polypeptide
DEEEIRTTNPVATEQYGSVQPTLNLDEMIEPNDIS

SEQ ID NO: 117802 - protein, 33 aa, Artificial Sequence
  Description of Artificial Sequence: Synthetic polypeptide
DEEEIRTTNPVATEQYGSVCPPLMLPQTTFEEE

SEQ ID NO: 117803 - protein, 35 aa, Artificial Sequence
  Description of Artificial Sequence: Synthetic polypeptide
DEEEIRTTNPVATEQYGSVYSPAVNEIQTQEVENY

SEQ ID NO: 117804 - protein, 37 aa, Artificial Sequence
  Description of Artificial Sequence: Synthetic polypeptide
DEEEIRTTNPVATEQYGSVYSNAPNLEIQVNGQGNVN

SEQ ID NO: 117805 - protein, 36 aa, Artificial Sequence
  Description of Artificial Sequence: Synthetic polypeptide
DEEEIRTTNPVATEQYGSVQPTLEVLDQEGFENEND

SEQ ID NO: 117806 - protein, 34 aa, Artificial Sequence
  Description of Artificial Sequence: Synthetic polypeptide
DEEEIRTTNPVATEQYGSVYSPPQEQAEAFNLIE

SEQ ID NO: 117807 - protein, 33 aa, Artificial Sequence
  Description of Artificial Sequence: Synthetic polypeptide
DEEEIRTTNPVATEQYGSVQPPPVVQAQGEPVL

SEQ ID NO: 117808 - protein, 35 aa, Artificial Sequence
  Description of Artificial Sequence: Synthetic polypeptide
DEEEIRTTNPVATEQYGSVYSPVVNEIQIQEVENL

SEQ ID NO: 117809 - protein, 34 aa, Artificial Sequence
  Description of Artificial Sequence: Synthetic polypeptide
DEEEIRTTNPVATEQYGSVCPQALPEERELNTVF

SEQ ID NO: 117810 - protein, 33 aa, Artificial Sequence
  Description of Artificial Sequence: Synthetic polypeptide
DEAEIRATNPVATDCYGFVSMTNWLFQGGENQI

SEQ ID NO: 117811 - protein, 36 aa, Artificial Sequence
  Description of Artificial Sequence: Synthetic polypeptide
DEEEIRTTNPVATEQYGSVCPTNDSDFDSFGENPRE

SEQ ID NO: 117812 - protein, 31 aa, Artificial Sequence
  Description of Artificial Sequence: Synthetic polypeptide
DEAEIQTTNPVAYEPYGVVSVTVPSTRPGND

SEQ ID NO: 117813 - protein, 34 aa, Artificial Sequence
  Description of Artificial Sequence: Synthetic polypeptide
DEEEIRTTNPVATEQYGSVYSPPDEQAENFAQGE

SEQ ID NO: 117814 - protein, 37 aa, Artificial Sequence
  Description of Artificial Sequence: Synthetic polypeptide
DEEEIRTTNPVATEQYGVVSTVVNNQNLQQGNQEEED

SEQ ID NO: 117815 - protein, 35 aa, Artificial Sequence
  Description of Artificial Sequence: Synthetic polypeptide
DEEEIRTTNPVATEQYGSVYSIENLQNTQVDPLMY

SEQ ID NO: 117816 - protein, 32 aa, Artificial Sequence
  Description of Artificial Sequence: Synthetic polypeptide
DEEEIATTNPVAYEQYGSVAATNDADTGGTEM

SEQ ID NO: 117817 - protein, 32 aa, Artificial Sequence
  Description of Artificial Sequence: Synthetic polypeptide
DEEEIACTNPVATEQYGCVATNPEPGQGDNEL

SEQ ID NO: 117818 - protein, 32 aa, Artificial Sequence
  Description of Artificial Sequence: Synthetic polypeptide
DEEEIACTNPVATEQYGCVATNSLFAVDGEFA

SEQ ID NO: 117819 - protein, 34 aa, Artificial Sequence
  Description of Artificial Sequence: Synthetic polypeptide
DEEEIRTTNPVATEQYGSVCNTFGCLYGRESTQD

SEQ ID NO: 117820 - protein, 35 aa, Artificial Sequence
  Description of Artificial Sequence: Synthetic polypeptide
DEEEIRTTNPVATEQYGSVQQTNDNEENEALEFLR

SEQ ID NO: 117821 - protein, 33 aa, Artificial Sequence
  Description of Artificial Sequence: Synthetic polypeptide
DEEEIATTNPVAYEQYGSVANNLQDAPGGEGEH

SEQ ID NO: 117822 - protein, 35 aa, Artificial Sequence
  Description of Artificial Sequence: Synthetic polypeptide
DEEEIRTTNPVATEQYGSVCNTFNCLDYGRYESED

SEQ ID NO: 117823 - protein, 34 aa, Artificial Sequence
  Description of Artificial Sequence: Synthetic polypeptide
DEEEIRTTNPVATEQYGSVQQQTMGEQPEGEVSI

SEQ ID NO: 117824 - protein, 35 aa, Artificial Sequence
  Description of Artificial Sequence: Synthetic polypeptide
DEEEIRTTNPVATEQYGSVYSENNNLEHRLTEELV

SEQ ID NO: 117825 - protein, 36 aa, Artificial Sequence
  Description of Artificial Sequence: Synthetic polypeptide
DEEEIRTTNPVATEQYGSVQQPVVSENQPRMGNILL

SEQ ID NO: 117826 - protein, 34 aa, Artificial Sequence
  Description of Artificial Sequence: Synthetic polypeptide
DEEEIATTNPVAYEQYGSVANMNDQTDTDGNDRE

SEQ ID NO: 117827 - protein, 33 aa, Artificial Sequence
  Description of Artificial Sequence: Synthetic polypeptide
DEEEIACTNPVATEQYGCVSTNNHQENDMDITR

SEQ ID NO: 117828 - protein, 33 aa, Artificial Sequence
  Description of Artificial Sequence: Synthetic polypeptide
DEEEIATTNPVAYEQYGSVAMNDTQTGNGNDEH

SEQ ID NO: 117829 - protein, 33 aa, Artificial Sequence
  Description of Artificial Sequence: Synthetic polypeptide
DEEEIATTNPVAYEQYGSVAMNDTQTGNGDVHQ

SEQ ID NO: 117830 - protein, 36 aa, Artificial Sequence
  Description of Artificial Sequence: Synthetic polypeptide
DEEEIRTTNPVATEQYGSVYSEAPNEIQRNGFGDDN

SEQ ID NO: 117831 - protein, 35 aa, Artificial Sequence
  Description of Artificial Sequence: Synthetic polypeptide
DEEEIRTTNPVATEQYGSVYSEAPNEIQTVNGVVN

SEQ ID NO: 117832 - protein, 35 aa, Artificial Sequence
  Description of Artificial Sequence: Synthetic polypeptide
DEEEIRTTNPVATEQYGSVYSEAPNEIQVVSEGVN

SEQ ID NO: 117833 - protein, 35 aa, Artificial Sequence
  Description of Artificial Sequence: Synthetic polypeptide
DEEEIRTTNPVATEQYGSVCNTFNCLYGRYEESDD

SEQ ID NO: 117834 - protein, 33 aa, Artificial Sequence
  Description of Artificial Sequence: Synthetic polypeptide
DEEEIRTTNPVATEQYGSVCPWGQQIRQTQEED

SEQ ID NO: 117835 - protein, 33 aa, Artificial Sequence
  Description of Artificial Sequence: Synthetic polypeptide
DEAEIQCTNPVAYEQYGSVVQSCNEQDMGGNNR

SEQ ID NO: 117836 - protein, 34 aa, Artificial Sequence
  Description of Artificial Sequence: Synthetic polypeptide
DEAEIQCTNPVAYEQYGSVVQSANEQADRGGSNR

SEQ ID NO: 117837 - protein, 36 aa, Artificial Sequence
  Description of Artificial Sequence: Synthetic polypeptide
DEEEIRTTNPVATEQYGSVCSATPGGPNMFNGMNPV

SEQ ID NO: 117838 - protein, 33 aa, Artificial Sequence
  Description of Artificial Sequence: Synthetic polypeptide
DEAEIKTTNPVATDAWGSVSCHNLSQEPGGENR

SEQ ID NO: 117839 - protein, 32 aa, Artificial Sequence
  Description of Artificial Sequence: Synthetic polypeptide
DEAEIKTTNPVATDAWGSVSCENHSQEPGPNR

SEQ ID NO: 117840 - protein, 32 aa, Artificial Sequence
  Description of Artificial Sequence: Synthetic polypeptide
DEAEIKTTNPVATDAWGSVACTGLSQEPGPNR

SEQ ID NO: 117841 - protein, 33 aa, Artificial Sequence
  Description of Artificial Sequence: Synthetic polypeptide
DEAEIKTTNPVATDAWGSISCTNMLSQEPGPNR

SEQ ID NO: 117842 - protein, 33 aa, Artificial Sequence
  Description of Artificial Sequence: Synthetic polypeptide
DEAEIKTTNPVATDAWGSISCTNLSQEYGGPNR

SEQ ID NO: 117843 - protein, 33 aa, Artificial Sequence
  Description of Artificial Sequence: Synthetic polypeptide
DEAEIKTTNPVATDAWGQSVSCTNASQEPGPNR

SEQ ID NO: 117844 - protein, 34 aa, Artificial Sequence
  Description of Artificial Sequence: Synthetic polypeptide
DEAEIKTTNPVATDAWGSVSCTNELSQEPGPNRR

SEQ ID NO: 117845 - protein, 33 aa, Artificial Sequence
  Description of Artificial Sequence: Synthetic polypeptide
DEAEIKTTNPCATDAWGSVSCTNLSQVPGGPNR

SEQ ID NO: 117846 - protein, 32 aa, Artificial Sequence
  Description of Artificial Sequence: Synthetic polypeptide
DEAEIGTTNPVATEQYGSVNTDDLYMYIENQT

SEQ ID NO: 117847 - protein, 35 aa, Artificial Sequence
  Description of Artificial Sequence: Synthetic polypeptide
DEEEIRTTNPVATEQYGSVQPHNLDQEMIEPNDIL

SEQ ID NO: 117848 - protein, 32 aa, Artificial Sequence
  Description of Artificial Sequence: Synthetic polypeptide
DEAEIGTTNPVATEQYGCVSTEDDLYMYENQT

SEQ ID NO: 117849 - protein, 36 aa, Artificial Sequence
  Description of Artificial Sequence: Synthetic polypeptide
DEEEIRTTNPVATEQYGSVYSTTPAGPEMRNGMNPV

SEQ ID NO: 117850 - protein, 36 aa, Artificial Sequence
  Description of Artificial Sequence: Synthetic polypeptide
DEEEIRTTNPVATEQYGSVYSTTPAGPNMRNGMNPV

SEQ ID NO: 117851 - protein, 36 aa, Artificial Sequence
  Description of Artificial Sequence: Synthetic polypeptide
DEEEIRTTNPVATEQYGSVYSTTPAGWNMRNGMNPV

SEQ ID NO: 117852 - protein, 36 aa, Artificial Sequence
  Description of Artificial Sequence: Synthetic polypeptide
DEEEIRTTNPVATEQYGSVYSTTPMGPNMRNGMNPV

SEQ ID NO: 117853 - protein, 31 aa, Artificial Sequence
  Description of Artificial Sequence: Synthetic polypeptide
DEAEIGTTNPVATEQYGSVSDDDPYMYENQT

SEQ ID NO: 117854 - protein, 33 aa, Artificial Sequence
  Description of Artificial Sequence: Synthetic polypeptide
DEAEIKTTNPVATDAWGSVSCTNFSQEPGPNRM

SEQ ID NO: 117855 - protein, 32 aa, Artificial Sequence
  Description of Artificial Sequence: Synthetic polypeptide
DEAEIKTTNPVATDAWGSVSCTNGSQEPGPNQ

SEQ ID NO: 117856 - protein, 33 aa, Artificial Sequence
  Description of Artificial Sequence: Synthetic polypeptide
DEAEIKTTNPVATDAWGSVSCTNLSQEPEPNRI

SEQ ID NO: 117857 - protein, 33 aa, Artificial Sequence
  Description of Artificial Sequence: Synthetic polypeptide
DEAEIMTTNPVATDAWGSVHCTNLSQEPGGPNR

SEQ ID NO: 117858 - protein, 34 aa, Artificial Sequence
  Description of Artificial Sequence: Synthetic polypeptide
DEEEIATTNPVAYEQYGSACSTNPLQNHADGDHH

SEQ ID NO: 117859 - protein, 33 aa, Artificial Sequence
  Description of Artificial Sequence: Synthetic polypeptide
DEAEIKTVNPVATDAWGSVSCTNLSQEPGGPNR

SEQ ID NO: 117860 - protein, 33 aa, Artificial Sequence
  Description of Artificial Sequence: Synthetic polypeptide
DEAEIKTTNPVATYAWGCVSCTNLSQEPGGPNR

SEQ ID NO: 117861 - protein, 34 aa, Artificial Sequence
  Description of Artificial Sequence: Synthetic polypeptide
DEAEIKTTNPVATSAWGSVSCTVNLSQEPGGSNR

SEQ ID NO: 117862 - protein, 35 aa, Artificial Sequence
  Description of Artificial Sequence: Synthetic polypeptide
DEEEIRTTNPVATEQYGSVCSAADNLQNTTPPDLE

SEQ ID NO: 117863 - protein, 33 aa, Artificial Sequence
  Description of Artificial Sequence: Synthetic polypeptide
DEAEIKTTNPVATSAWGSVSCTNSSQFPGGPNR

SEQ ID NO: 117864 - protein, 34 aa, Artificial Sequence
  Description of Artificial Sequence: Synthetic polypeptide
DEAEIKTTNPVATSAWGSVSCTNLSQEAGGPNRS

SEQ ID NO: 117865 - protein, 34 aa, Artificial Sequence
  Description of Artificial Sequence: Synthetic polypeptide
DEAEIKTTNPVATSAWGSVSCTNLSQDEPGGPNR

SEQ ID NO: 117866 - protein, 34 aa, Artificial Sequence
  Description of Artificial Sequence: Synthetic polypeptide
DEAEIKTTNPVATLAWGSVSCTNLSQEPGGPNRT

SEQ ID NO: 117867 - protein, 34 aa, Artificial Sequence
  Description of Artificial Sequence: Synthetic polypeptide
DEAEIKTTNPVATEQYGETVPFHNMLSQRGGNPS

SEQ ID NO: 117868 - protein, 32 aa, Artificial Sequence
  Description of Artificial Sequence: Synthetic polypeptide
DEAEIKTTNPVATDAWGTVFCTNLSQEPGPNR

SEQ ID NO: 117869 - protein, 35 aa, Artificial Sequence
  Description of Artificial Sequence: Synthetic polypeptide
DEEEIRTTNPVATEQYGSVCSAPDGPQDHGGNDQH

SEQ ID NO: 117870 - protein, 35 aa, Artificial Sequence
  Description of Artificial Sequence: Synthetic polypeptide
DEEEIRTTNPVATEQYGSVCSAPNALVMIVGVEEY

SEQ ID NO: 117871 - protein, 34 aa, Artificial Sequence
  Description of Artificial Sequence: Synthetic polypeptide
DEAEIKTTNPVATDAWGSVSCTNLSQSEPGGVNR

SEQ ID NO: 117872 - protein, 32 aa, Artificial Sequence
  Description of Artificial Sequence: Synthetic polypeptide
DEAEIKTTNPVATDAWGSVSCTNLSQEPQPND

SEQ ID NO: 117873 - protein, 34 aa, Artificial Sequence
  Description of Artificial Sequence: Synthetic polypeptide
DEAEIKTTNPVATDAWGSVSCTNLSQEPGGTNRP

SEQ ID NO: 117874 - protein, 36 aa, Artificial Sequence
  Description of Artificial Sequence: Synthetic polypeptide
DEEEIRTTNPVATEQYGSVYTTQNGNNQEIGTNNES

SEQ ID NO: 117875 - protein, 35 aa, Artificial Sequence
  Description of Artificial Sequence: Synthetic polypeptide
DEEEIRTTNPVATEQYGSVYTTVYLEDPGNENFEF

SEQ ID NO: 117876 - protein, 33 aa, Artificial Sequence
  Description of Artificial Sequence: Synthetic polypeptide
DEEEIRTTNPVATEQYGSVCSQDDEQQEVMSVE

SEQ ID NO: 117877 - protein, 34 aa, Artificial Sequence
  Description of Artificial Sequence: Synthetic polypeptide
DEEEIRTTNPVATEQYGSVQCPPDTLINIVDQNE

SEQ ID NO: 117878 - protein, 35 aa, Artificial Sequence
  Description of Artificial Sequence: Synthetic polypeptide
DEEEIRTTNPVATEQYGSVPSPPPGLPIRVNVNEP

SEQ ID NO: 117879 - protein, 35 aa, Artificial Sequence
  Description of Artificial Sequence: Synthetic polypeptide
DEEEIRTTNPVATEQYGSVPSLQVNEQRAMVEQMN

SEQ ID NO: 117880 - protein, 36 aa, Artificial Sequence
  Description of Artificial Sequence: Synthetic polypeptide
DEEEIRTTNPVATEQYGSYASPTENMIHRIGNNISN

SEQ ID NO: 117881 - protein, 35 aa, Artificial Sequence
  Description of Artificial Sequence: Synthetic polypeptide
DEAEICTTNPVATECYGSVSTGNLQQGDTGGNDEN

SEQ ID NO: 117882 - protein, 34 aa, Artificial Sequence
  Description of Artificial Sequence: Synthetic polypeptide
DEEEIRTTNPVATEQYGSYCISPTSDIQMDLNEF

SEQ ID NO: 117883 - protein, 34 aa, Artificial Sequence
  Description of Artificial Sequence: Synthetic polypeptide
DEAEICTTNPVATECYGSVSTGNLQGDTGGGKES

SEQ ID NO: 117884 - protein, 35 aa, Artificial Sequence
  Description of Artificial Sequence: Synthetic polypeptide
DEEEIRTTNPVATEQYGSVPSETPLIELSGLITVQ

SEQ ID NO: 117885 - protein, 35 aa, Artificial Sequence
  Description of Artificial Sequence: Synthetic polypeptide
DEEEIRTTNPVATEQYGSVPSPPPGSPIIRVGVNP

SEQ ID NO: 117886 - protein, 36 aa, Artificial Sequence
  Description of Artificial Sequence: Synthetic polypeptide
DEEEIRTTNPVATEQYGSVPSEPPSGLEIRVGVNDP

SEQ ID NO: 117887 - protein, 36 aa, Artificial Sequence
  Description of Artificial Sequence: Synthetic polypeptide
DEEEIRTTNPVATEQYGSVPSCTPAGPTTRNGGNPV

SEQ ID NO: 117888 - protein, 35 aa, Artificial Sequence
  Description of Artificial Sequence: Synthetic polypeptide
DEEEIRTTNPVATEQYGSYEVANSEIQRMGEEVRN

SEQ ID NO: 117889 - protein, 35 aa, Artificial Sequence
  Description of Artificial Sequence: Synthetic polypeptide
DEEEIRTTNPVATEQYGSYFVNLGIEQRDLVNENQ

SEQ ID NO: 117890 - protein, 34 aa, Artificial Sequence
  Description of Artificial Sequence: Synthetic polypeptide
DEEEIATTNPVAYEGWGTVSTTNPLQGDVGDNER

SEQ ID NO: 117891 - protein, 33 aa, Artificial Sequence
  Description of Artificial Sequence: Synthetic polypeptide
DEEEIATTNPVAYEEWGVVSTNLNQLGEDNGSN

SEQ ID NO: 117892 - protein, 34 aa, Artificial Sequence
  Description of Artificial Sequence: Synthetic polypeptide
DEEEIRTTNPVATEQYGSVPQNALTMEELQLELM

SEQ ID NO: 117893 - protein, 32 aa, Artificial Sequence
  Description of Artificial Sequence: Synthetic polypeptide
DEEEIRTTNPVATEQYGSYGANGIEQATQLVL

SEQ ID NO: 117894 - protein, 36 aa, Artificial Sequence
  Description of Artificial Sequence: Synthetic polypeptide
DEEEIRTTNPVATEQYGSVPSDTLSDLEQEEGFEWN

SEQ ID NO: 117895 - protein, 36 aa, Artificial Sequence
  Description of Artificial Sequence: Synthetic polypeptide
DEEEIRTTNPVATEQYGSVPPYTSTSQINVQVDPNM

SEQ ID NO: 117896 - protein, 36 aa, Artificial Sequence
  Description of Artificial Sequence: Synthetic polypeptide
DEEEIRTTNPVATEQYGSVPSPTPAGPNMRQAMNPV

SEQ ID NO: 117897 - protein, 35 aa, Artificial Sequence
  Description of Artificial Sequence: Synthetic polypeptide
DEEEIRTTNPVATEQYGSVPSPWATLQQSMGDEEL

SEQ ID NO: 117898 - protein, 36 aa, Artificial Sequence
  Description of Artificial Sequence: Synthetic polypeptide
DEEEIRTTNPVATEQYGSVPSVHPGDSQVVGVNARE

SEQ ID NO: 117899 - protein, 36 aa, Artificial Sequence
  Description of Artificial Sequence: Synthetic polypeptide
DEEEIRTTNPVATEQYGSVPSTWNMMWQEEMGEELL

SEQ ID NO: 117900 - protein, 35 aa, Artificial Sequence
  Description of Artificial Sequence: Synthetic polypeptide
DEEEIRTTNPVATEQYGSVPSTTTEVEITPEVNRA

SEQ ID NO: 117901 - protein, 36 aa, Artificial Sequence
  Description of Artificial Sequence: Synthetic polypeptide
DEEEIRTTNPVATEQYGSVPSTTPAGSNHRNGGNNV

SEQ ID NO: 117902 - protein, 36 aa, Artificial Sequence
  Description of Artificial Sequence: Synthetic polypeptide
DEEEIRTTNPVATEQYGSVPSTTPAGPTNRNEGNNV

SEQ ID NO: 117903 - protein, 36 aa, Artificial Sequence
  Description of Artificial Sequence: Synthetic polypeptide
DEEEIRTTNPVATEQYGSVPSTTPAGPNMRNRMNPV

SEQ ID NO: 117904 - protein, 36 aa, Artificial Sequence
  Description of Artificial Sequence: Synthetic polypeptide
DEEEIRTTNPVATEQYGSVPSTTPAGPNMRNGMNPV

SEQ ID NO: 117905 - protein, 33 aa, Artificial Sequence
  Description of Artificial Sequence: Synthetic polypeptide
DEEEIATTNPVAYEPYGSTVSLVNLSQDVGGEP

SEQ ID NO: 117906 - protein, 36 aa, Artificial Sequence
  Description of Artificial Sequence: Synthetic polypeptide
DEEEIRTTNPVATEQYGSVPSTTPAGPNMPNGMNPV

SEQ ID NO: 117907 - protein, 35 aa, Artificial Sequence
  Description of Artificial Sequence: Synthetic polypeptide
DEEEIRTTNPVATEQYGSVPSTPPIEPQNRIEIEL

SEQ ID NO: 117908 - protein, 33 aa, Artificial Sequence
  Description of Artificial Sequence: Synthetic polypeptide
DEEEIATTNPVAYEQWGEVSTTNHNNDAGNQDR

SEQ ID NO: 117909 - protein, 33 aa, Artificial Sequence
  Description of Artificial Sequence: Synthetic polypeptide
DEEEIACTNPVATEQYGSVASNLQEADITNDDN

SEQ ID NO: 117910 - protein, 36 aa, Artificial Sequence
  Description of Artificial Sequence: Synthetic polypeptide
DEEEIRTTNPVATEQYGVVSTVTNVNQAGNNDEQED

SEQ ID NO: 117911 - protein, 33 aa, Artificial Sequence
  Description of Artificial Sequence: Synthetic polypeptide
DEEEIACTNPVATEQYGSVATNDDTDAPGEERH

SEQ ID NO: 117912 - protein, 33 aa, Artificial Sequence
  Description of Artificial Sequence: Synthetic polypeptide
DEEEIACTNPVATEQYGSVATNLEDTPDENDNN

SEQ ID NO: 117913 - protein, 36 aa, Artificial Sequence
  Description of Artificial Sequence: Synthetic polypeptide
DEEEIRTTNPVATEQYGSVPSPWQNLQMTEEENLFQ

SEQ ID NO: 117914 - protein, 34 aa, Artificial Sequence
  Description of Artificial Sequence: Synthetic polypeptide
DEEEIRTTNPVATEQYGSVPSTPTQDDDVIIPML

SEQ ID NO: 117915 - protein, 35 aa, Artificial Sequence
  Description of Artificial Sequence: Synthetic polypeptide
DEEEIRTTNPVATEQYGSYGSSSTQLIERLVAQNV

SEQ ID NO: 117916 - protein, 31 aa, Artificial Sequence
  Description of Artificial Sequence: Synthetic polypeptide
DEEEIATTNPVAYEEWGVVSTNLNGEMNGEN

SEQ ID NO: 117917 - protein, 33 aa, Artificial Sequence
  Description of Artificial Sequence: Synthetic polypeptide
DEEEIRTTNPVATEQYGSVPPVVQIRQTQEHED

SEQ ID NO: 117918 - protein, 35 aa, Artificial Sequence
  Description of Artificial Sequence: Synthetic polypeptide
DEEEIRTTNPVATEQYGSVPPTAHEQPVDNMFERD

SEQ ID NO: 117919 - protein, 35 aa, Artificial Sequence
  Description of Artificial Sequence: Synthetic polypeptide
DEEEIRTTNPVATEQYGSYSPTNIGLNPFGQVQFN

SEQ ID NO: 117920 - protein, 34 aa, Artificial Sequence
  Description of Artificial Sequence: Synthetic polypeptide
DEAEICTTNPVATECYGSVSTGNINQGDTGGNEM

SEQ ID NO: 117921 - protein, 36 aa, Artificial Sequence
  Description of Artificial Sequence: Synthetic polypeptide
DEEEIRTTNPVATEQYGSVCSTMNSLDQHHVVVPEL

SEQ ID NO: 117922 - protein, 34 aa, Artificial Sequence
  Description of Artificial Sequence: Synthetic polypeptide
DEEEIRTTNPVATEQYGSVPPPTIEEQAIGPEQE

SEQ ID NO: 117923 - protein, 35 aa, Artificial Sequence
  Description of Artificial Sequence: Synthetic polypeptide
DEEEIRTTNPVATEQYGSVPPPNPQQQPALGVERD

SEQ ID NO: 117924 - protein, 33 aa, Artificial Sequence
  Description of Artificial Sequence: Synthetic polypeptide
DEEEIATTNPVATETYGCVSTGGAGLTNGGNSQ

SEQ ID NO: 117925 - protein, 32 aa, Artificial Sequence
  Description of Artificial Sequence: Synthetic polypeptide
DEEEIRTTNPVATEQYGSYSLIIDPNQGEDGQ

SEQ ID NO: 117926 - protein, 34 aa, Artificial Sequence
  Description of Artificial Sequence: Synthetic polypeptide
DEAEICTTNPVATECYGSVSTGNGNQGGHGNGND

SEQ ID NO: 117927 - protein, 34 aa, Artificial Sequence
  Description of Artificial Sequence: Synthetic polypeptide
DEAEICTTNPVATECYGSVSTGNGLQQPDDGKEN

SEQ ID NO: 117928 - protein, 35 aa, Artificial Sequence
  Description of Artificial Sequence: Synthetic polypeptide
DEAEICTTNPVATECYGSVSTGNGLQQGDTGGNEP

SEQ ID NO: 117929 - protein, 36 aa, Artificial Sequence
  Description of Artificial Sequence: Synthetic polypeptide
DEAEICTTNPVATECYGSVSTGNGLQQDDRGQNDEQ

SEQ ID NO: 117930 - protein, 32 aa, Artificial Sequence
  Description of Artificial Sequence: Synthetic polypeptide
DEEEIATTNPVATEQYGTVCSTDVPVEHEGED

SEQ ID NO: 117931 - protein, 35 aa, Artificial Sequence
  Description of Artificial Sequence: Synthetic polypeptide
DEAEICTTNPVATECYGSVSTGNGLQGDTGGNGKS

SEQ ID NO: 117932 - protein, 35 aa, Artificial Sequence
  Description of Artificial Sequence: Synthetic polypeptide
DEAEICTTNPVATECYGSVSTGNGLQGDTGGNDED

SEQ ID NO: 117933 - protein, 35 aa, Artificial Sequence
  Description of Artificial Sequence: Synthetic polypeptide
DEAEICTTNPVATECYGSVSTGNGLQDDRQMNGDH

SEQ ID NO: 117934 - protein, 35 aa, Artificial Sequence
  Description of Artificial Sequence: Synthetic polypeptide
DEEEIRTTNPVATEQYGSYSTFLQQLELAFVNEEV

SEQ ID NO: 117935 - protein, 34 aa, Artificial Sequence
  Description of Artificial Sequence: Synthetic polypeptide
DEEEIRTTNPVATEQYGSYSITETLQIQDELIVE

SEQ ID NO: 117936 - protein, 33 aa, Artificial Sequence
  Description of Artificial Sequence: Synthetic polypeptide
DEEEIRTTNPVATEQYGSYSHMTFQEGTQEQEE

SEQ ID NO: 117937 - protein, 34 aa, Artificial Sequence
  Description of Artificial Sequence: Synthetic polypeptide
DEAEICTTNPVATECYGSVSTGNLPEGDTGGNEN

SEQ ID NO: 117938 - protein, 32 aa, Artificial Sequence
  Description of Artificial Sequence: Synthetic polypeptide
DEEEIATTNPVAYECYGKISTNMESQRVNNFT

SEQ ID NO: 117939 - protein, 33 aa, Artificial Sequence
  Description of Artificial Sequence: Synthetic polypeptide
DEEEIRTTNPVATEQYGSVPPVGQERQTPEPED

SEQ ID NO: 117940 - protein, 31 aa, Artificial Sequence
  Description of Artificial Sequence: Synthetic polypeptide
DEEEIATTNPVAYECWGSVATNLNGEDNNEQ

SEQ ID NO: 117941 - protein, 33 aa, Artificial Sequence
  Description of Artificial Sequence: Synthetic polypeptide
DEEEIRTTNPVATEQYGSVPPTTVEPNRNAEEI

SEQ ID NO: 117942 - protein, 34 aa, Artificial Sequence
  Description of Artificial Sequence: Synthetic polypeptide
DEEEIATTNPVAYEAYGISTVQSCTDALQNAGIR

SEQ ID NO: 117943 - protein, 34 aa, Artificial Sequence
  Description of Artificial Sequence: Synthetic polypeptide
DEEEIRTTNPVATEQYGSVPPTTGQERDFQVLVE

SEQ ID NO: 117944 - protein, 34 aa, Artificial Sequence
  Description of Artificial Sequence: Synthetic polypeptide
DEEEIRTTNPVATEQYGSVPPTPVESQVFEIQRN

SEQ ID NO: 117945 - protein, 36 aa, Artificial Sequence
  Description of Artificial Sequence: Synthetic polypeptide
DEEEIRTTNPVATEQYGSVPPTPLLSQPVEGENPLA

SEQ ID NO: 117946 - protein, 33 aa, Artificial Sequence
  Description of Artificial Sequence: Synthetic polypeptide
DEEEIACTNPVATEQYGSVATNLTDAPAEATNG

SEQ ID NO: 117947 - protein, 35 aa, Artificial Sequence
  Description of Artificial Sequence: Synthetic polypeptide
DEEEIRTTNPVATEQYGSVPPTNRLFPTQGEEEEL

SEQ ID NO: 117948 - protein, 32 aa, Artificial Sequence
  Description of Artificial Sequence: Synthetic polypeptide
DEEEIRTTNPVATEQYGSYQANGNEEATQLVN

SEQ ID NO: 117949 - protein, 34 aa, Artificial Sequence
  Description of Artificial Sequence: Synthetic polypeptide
DEEEIRTTNPVATEQYGSVCSTLIEPQENEEPQE

SEQ ID NO: 117950 - protein, 34 aa, Artificial Sequence
  Description of Artificial Sequence: Synthetic polypeptide
DEEEIRTTNPVATEQYGSVPPTNIHPDGREDIID

SEQ ID NO: 117951 - protein, 35 aa, Artificial Sequence
  Description of Artificial Sequence: Synthetic polypeptide
DEEEIRTTNPVATEQYGSVPPTLVFLQQQGEQELM

SEQ ID NO: 117952 - protein, 32 aa, Artificial Sequence
  Description of Artificial Sequence: Synthetic polypeptide
DEEEIRTTNPVATEQYGSYQANGNEQATLLVE

SEQ ID NO: 117953 - protein, 35 aa, Artificial Sequence
  Description of Artificial Sequence: Synthetic polypeptide
DEAEICTTNPVATECYGSVSTGNLPQDDRQMNGEN

SEQ ID NO: 117954 - protein, 36 aa, Artificial Sequence
  Description of Artificial Sequence: Synthetic polypeptide
DEEEIRTTNPVATEQYGVVSTVTNQLGNQNGTDETA

SEQ ID NO: 117955 - protein, 34 aa, Artificial Sequence
  Description of Artificial Sequence: Synthetic polypeptide
DEEEIRTTNPVATEQYGSVPSVPTMLPDLIFDED

SEQ ID NO: 117956 - protein, 34 aa, Artificial Sequence
  Description of Artificial Sequence: Synthetic polypeptide
DEEEIRTTNPVATEQYGSVQQWTTLIPEGQSFQN

SEQ ID NO: 117957 - protein, 32 aa, Artificial Sequence
  Description of Artificial Sequence: Synthetic polypeptide
DEEEIACTNPVATEQYGSVAITNDNSNETVNS

SEQ ID NO: 117958 - protein, 32 aa, Artificial Sequence
  Description of Artificial Sequence: Synthetic polypeptide
DEEEIACTNPVATEQYGSVAITNDNSENTDES

SEQ ID NO: 117959 - protein, 34 aa, Artificial Sequence
  Description of Artificial Sequence: Synthetic polypeptide
DEAEICTTNPVATECYGVVSTGNMQQLDRGGNES

SEQ ID NO: 117960 - protein, 34 aa, Artificial Sequence
  Description of Artificial Sequence: Synthetic polypeptide
DEAEICTTNPVATECYGVVSTGNMNQGDRGGNKS

SEQ ID NO: 117961 - protein, 34 aa, Artificial Sequence
  Description of Artificial Sequence: Synthetic polypeptide
DEAEICTTNPVATECYGVVSTGNLQQGDTGGNEK

SEQ ID NO: 117962 - protein, 33 aa, Artificial Sequence
  Description of Artificial Sequence: Synthetic polypeptide
DEAEICTTNPVATECYGVVSGGNMQGDRGGNES

SEQ ID NO: 117963 - protein, 34 aa, Artificial Sequence
  Description of Artificial Sequence: Synthetic polypeptide
DEEEIRTTNPVATEQYGSVPTTPVGPNHNGMNPV

SEQ ID NO: 117964 - protein, 33 aa, Artificial Sequence
  Description of Artificial Sequence: Synthetic polypeptide
DEEEIRTTNPVATEQYGSVPTTPVGPNHGMEPV

SEQ ID NO: 117965 - protein, 32 aa, Artificial Sequence
  Description of Artificial Sequence: Synthetic polypeptide
DEEEIATTNPVAYEQWGSVSGGNGNSGPGNTD

SEQ ID NO: 117966 - protein, 35 aa, Artificial Sequence
  Description of Artificial Sequence: Synthetic polypeptide
DEEEIRTTNPVATEQYGSVPVANQLGNEDGILNES

SEQ ID NO: 117967 - protein, 37 aa, Artificial Sequence
  Description of Artificial Sequence: Synthetic polypeptide
DEEEIRTTNPVATEQYGVVSTVVNLQQGNQQGNNVTD

SEQ ID NO: 117968 - protein, 34 aa, Artificial Sequence
  Description of Artificial Sequence: Synthetic polypeptide
DEEEIRTTNPVATEQYGSVPTPLNPQSPVFLQDN

SEQ ID NO: 117969 - protein, 37 aa, Artificial Sequence
  Description of Artificial Sequence: Synthetic polypeptide
DEEEIRTTNPVATEQYGVVSTVVNLQQGNNNQEDENN

SEQ ID NO: 117970 - protein, 37 aa, Artificial Sequence
  Description of Artificial Sequence: Synthetic polypeptide
DEEEIRTTNPVATEQYGVVSTVVNLQQGNNNDEDEED

SEQ ID NO: 117971 - protein, 33 aa, Artificial Sequence
  Description of Artificial Sequence: Synthetic polypeptide
DEAEICTTNPVATECYGSVTTGNGLQGDDGKEN

SEQ ID NO: 117972 - protein, 37 aa, Artificial Sequence
  Description of Artificial Sequence: Synthetic polypeptide
DEEEIRTTNPVATEQYGVVSTVVNLQAGNQQGTEAGE

SEQ ID NO: 117973 - protein, 37 aa, Artificial Sequence
  Description of Artificial Sequence: Synthetic polypeptide
DEEEIRTTNPVATEQYGVVSTVVNLQAGNQQGNQEDD

SEQ ID NO: 117974 - protein, 37 aa, Artificial Sequence
  Description of Artificial Sequence: Synthetic polypeptide
DEEEIRTTNPVATEQYGVVSTVVNLQAGNQEQNEETD

SEQ ID NO: 117975 - protein, 34 aa, Artificial Sequence
  Description of Artificial Sequence: Synthetic polypeptide
DEAEICTTNPVATECYGSVTTGNQLQGDTGGNEM

SEQ ID NO: 117976 - protein, 34 aa, Artificial Sequence
  Description of Artificial Sequence: Synthetic polypeptide
DEAEICTTNPVATECYGSVSTVGGGQNRGGGNEQ

SEQ ID NO: 117977 - protein, 35 aa, Artificial Sequence
  Description of Artificial Sequence: Synthetic polypeptide
DEEEIATTNPVAYEQWGSVSKTDEQLQERQGGNMD

SEQ ID NO: 117978 - protein, 35 aa, Artificial Sequence
  Description of Artificial Sequence: Synthetic polypeptide
DEEEIRTTNPVATEQYGSVPVTGNDLPLPSLENLA

SEQ ID NO: 117979 - protein, 35 aa, Artificial Sequence
  Description of Artificial Sequence: Synthetic polypeptide
DEEEIRTTNPVATEQYGSVCSQSPLNENQQGLILM

SEQ ID NO: 117980 - protein, 34 aa, Artificial Sequence
  Description of Artificial Sequence: Synthetic polypeptide
DEEEIRTTNPVATEQYGSVYTVHMYHEADGDQRD

SEQ ID NO: 117981 - protein, 34 aa, Artificial Sequence
  Description of Artificial Sequence: Synthetic polypeptide
DEEEIRTTNPVATEQYGSVYTVYMETTGWNDVDE

SEQ ID NO: 117982 - protein, 34 aa, Artificial Sequence
  Description of Artificial Sequence: Synthetic polypeptide
DEEEIACTNPVATEQYGSACSAANPLQDADGNEN

SEQ ID NO: 117983 - protein, 34 aa, Artificial Sequence
  Description of Artificial Sequence: Synthetic polypeptide
DEEEIRTTNPVATEQYGSVQCMNNLGQEPIDTEF

SEQ ID NO: 117984 - protein, 33 aa, Artificial Sequence
  Description of Artificial Sequence: Synthetic polypeptide
DEEEIRTTNPVATEQYGSVQCIEEGFRMIDNQV

SEQ ID NO: 117985 - protein, 34 aa, Artificial Sequence
  Description of Artificial Sequence: Synthetic polypeptide
DEEEIRTTNPVATEQYGSVQCEPNSTINSTEVRD

SEQ ID NO: 117986 - protein, 35 aa, Artificial Sequence
  Description of Artificial Sequence: Synthetic polypeptide
DEEEIATTNPVAYEQWGSVSKTMNDLQQQRTGDEK

SEQ ID NO: 117987 - protein, 34 aa, Artificial Sequence
  Description of Artificial Sequence: Synthetic polypeptide
DEEEIRTTNPVATEQYGSVQCAPGLVTRQLEGYE

SEQ ID NO: 117988 - protein, 34 aa, Artificial Sequence
  Description of Artificial Sequence: Synthetic polypeptide
DEEEIATTNPVAYEQWGSVSKTNDTQQQRQGQEK

SEQ ID NO: 117989 - protein, 34 aa, Artificial Sequence
  Description of Artificial Sequence: Synthetic polypeptide
DEEEIRTTNPVATEQYGSVPYTPVFEQQVMENQE

SEQ ID NO: 117990 - protein, 33 aa, Artificial Sequence
  Description of Artificial Sequence: Synthetic polypeptide
DEEEIRTTNPVATEQYGSVYVAKHSQETPMGST

SEQ ID NO: 117991 - protein, 35 aa, Artificial Sequence
  Description of Artificial Sequence: Synthetic polypeptide
DEEEIATTNPVAYEQWGSVSKTNDLQQQRSGQEPK

SEQ ID NO: 117992 - protein, 33 aa, Artificial Sequence
  Description of Artificial Sequence: Synthetic polypeptide
DEEEIRTTNPVATEQYGSVPWPGDGLPRLEPSL

SEQ ID NO: 117993 - protein, 36 aa, Artificial Sequence
  Description of Artificial Sequence: Synthetic polypeptide
DEEEIRTTNPVATEQYGSVCSSTNNGQDNTGTELEV

SEQ ID NO: 117994 - protein, 33 aa, Artificial Sequence
  Description of Artificial Sequence: Synthetic polypeptide
DEAEICTTNPVATECYGVVSTGNVQGDTGGNES

SEQ ID NO: 117995 - protein, 37 aa, Artificial Sequence
  Description of Artificial Sequence: Synthetic polypeptide
DEEEIRTTNPVATEQYGVVSTVVNNLQQLGNQDEEED

SEQ ID NO: 117996 - protein, 32 aa, Artificial Sequence
  Description of Artificial Sequence: Synthetic polypeptide
DEEEIATTNPVAYEQWGSVSGGNGNSGEGRNS

SEQ ID NO: 117997 - protein, 32 aa, Artificial Sequence
  Description of Artificial Sequence: Synthetic polypeptide
DEEEIATTNPVAYEQWGSVSGGNGNMGEGNTL

SEQ ID NO: 117998 - protein, 37 aa, Artificial Sequence
  Description of Artificial Sequence: Synthetic polypeptide
DEEEIRTTNPVATEQYGSVCSTDNEAPQVRIMENDQE

SEQ ID NO: 117999 - protein, 34 aa, Artificial Sequence
  Description of Artificial Sequence: Synthetic polypeptide
DEEEIRTTNPVATEQYGSWVTNGIFGAAAQDSND

SEQ ID NO: 118000 - protein, 33 aa, Artificial Sequence
  Description of Artificial Sequence: Synthetic polypeptide
DEEEIATTNPVAYEQWGSVCNTFNREGRGNTDN

SEQ ID NO: 118001 - protein, 32 aa, Artificial Sequence
  Description of Artificial Sequence: Synthetic polypeptide
DEEEIACTNPVATEQYGSCSTNNHVENDMLIN

SEQ ID NO: 118002 - protein, 34 aa, Artificial Sequence
  Description of Artificial Sequence: Synthetic polypeptide
DEEEIRTTNPVATEQYGSVPTGVMQMQSTQMERQ

SEQ ID NO: 118003 - protein, 33 aa, Artificial Sequence
  Description of Artificial Sequence: Synthetic polypeptide
DEEEIATTNPVAYEQWGSVATTNHPGEDGNNDR

SEQ ID NO: 118004 - protein, 34 aa, Artificial Sequence
  Description of Artificial Sequence: Synthetic polypeptide
DEEEIACTNPVATEQYGSVAATNNHQAEDPGENT

SEQ ID NO: 118005 - protein, 34 aa, Artificial Sequence
  Description of Artificial Sequence: Synthetic polypeptide
DEEEIACTNPVATEQYGSVACSGNNDIPQDNGNQ

SEQ ID NO: 118006 - protein, 34 aa, Artificial Sequence
  Description of Artificial Sequence: Synthetic polypeptide
DEEEIACTNPVATEQYGSCATNQLQEQMGNNSLH

SEQ ID NO: 118007 - protein, 32 aa, Artificial Sequence
  Description of Artificial Sequence: Synthetic polypeptide
DEEEIACTNPVATEQYGSVAITNDNAGETVES

SEQ ID NO: 118008 - protein, 34 aa, Artificial Sequence
  Description of Artificial Sequence: Synthetic polypeptide
DEEEIATTNPVAYEQWGSVAKTNDLQEQRLGQEP

SEQ ID NO: 118009 - protein, 32 aa, Artificial Sequence
  Description of Artificial Sequence: Synthetic polypeptide
DEEEIACTNPVATEQYGSVAITNDNDSETNES

SEQ ID NO: 118010 - protein, 34 aa, Artificial Sequence
  Description of Artificial Sequence: Synthetic polypeptide
DEEEIATTNPVAYEQWGSVAKTNDLQEQREGQID

SEQ ID NO: 118011 - protein, 33 aa, Artificial Sequence
  Description of Artificial Sequence: Synthetic polypeptide
DEEEIATTNPVAYEQWGSTVTNLQGNDAGNNEE

SEQ ID NO: 118012 - protein, 32 aa, Artificial Sequence
  Description of Artificial Sequence: Synthetic polypeptide
DEEEIACTNPVATEQYGSVAITNDNNSMTVRS

SEQ ID NO: 118013 - protein, 35 aa, Artificial Sequence
  Description of Artificial Sequence: Synthetic polypeptide
DEEEIRTTNPVATEQYGSVPSVTTMLPDNLITIED

SEQ ID NO: 118014 - protein, 35 aa, Artificial Sequence
  Description of Artificial Sequence: Synthetic polypeptide
DEEEIRTTNPVATEQYGSVPSVTPNLEDSLMEITI

SEQ ID NO: 118015 - protein, 33 aa, Artificial Sequence
  Description of Artificial Sequence: Synthetic polypeptide
DEEEIRTTNPVATEQYGSVPTDEQIPQTEMVVQ

SEQ ID NO: 118016 - protein, 35 aa, Artificial Sequence
  Description of Artificial Sequence: Synthetic polypeptide
DEAEICTTNPVATECYGSVSTGNPLQGDTGGNNEV

SEQ ID NO: 118017 - protein, 33 aa, Artificial Sequence
  Description of Artificial Sequence: Synthetic polypeptide
DEEEIACTNPVATEQYGSCATNLTDNPEGNDQE

SEQ ID NO: 118018 - protein, 33 aa, Artificial Sequence
  Description of Artificial Sequence: Synthetic polypeptide
DEEEIATTNPVAYEQWGSVCQTFEDFQRQGGER

SEQ ID NO: 118019 - protein, 34 aa, Artificial Sequence
  Description of Artificial Sequence: Synthetic polypeptide
DEAEICTTNPVATECYGSVSTGNVNQGDTGGNTP

SEQ ID NO: 118020 - protein, 37 aa, Artificial Sequence
  Description of Artificial Sequence: Synthetic polypeptide
DEEEIRTTNPVATEQYGVVSTVVNLQAGNNENQNETD

SEQ ID NO: 118021 - protein, 34 aa, Artificial Sequence
  Description of Artificial Sequence: Synthetic polypeptide
DEEEIRTTNPVATEQYGSVPTPLNEQPVFLVDYE

SEQ ID NO: 118022 - protein, 34 aa, Artificial Sequence
  Description of Artificial Sequence: Synthetic polypeptide
DEAEICTTNPVATECYGSVSTGNTGEQGGHGNND

SEQ ID NO: 118023 - protein, 34 aa, Artificial Sequence
  Description of Artificial Sequence: Synthetic polypeptide
DEAEICTTNPVATECYGSVSTGNQQQGDTGGNET

SEQ ID NO: 118024 - protein, 31 aa, Artificial Sequence
  Description of Artificial Sequence: Synthetic polypeptide
DEEEIACTNPVATEQYGSCAAATNLTADSEN

SEQ ID NO: 118025 - protein, 33 aa, Artificial Sequence
  Description of Artificial Sequence: Synthetic polypeptide
DEEEIATTNPVAYEQWGSVSGGNGNEQGEGNTD

SEQ ID NO: 118026 - protein, 36 aa, Artificial Sequence
  Description of Artificial Sequence: Synthetic polypeptide
DEEEIRTTNPVATEQYGSWSSTTPLGPNMRNGMNPV

SEQ ID NO: 118027 - protein, 34 aa, Artificial Sequence
  Description of Artificial Sequence: Synthetic polypeptide
DEAEICTTNPVATECYGSVSTGNQQQGDTGGNES

SEQ ID NO: 118028 - protein, 35 aa, Artificial Sequence
  Description of Artificial Sequence: Synthetic polypeptide
DEAEICTTNPVATECYGSVSTGNQMNQGDRKGNES

SEQ ID NO: 118029 - protein, 34 aa, Artificial Sequence
  Description of Artificial Sequence: Synthetic polypeptide
DEEEIRTTNPVATEQYGSVCSTEEHQENFISDQA

SEQ ID NO: 118030 - protein, 32 aa, Artificial Sequence
  Description of Artificial Sequence: Synthetic polypeptide
DEEEIATTNPVAYEQWGSVSCNTQQGDTGDHQ

SEQ ID NO: 118031 - protein, 33 aa, Artificial Sequence
  Description of Artificial Sequence: Synthetic polypeptide
DEEEIATTNPVAYEQWGSVCSTNDQQSGGMGEP

SEQ ID NO: 118032 - protein, 34 aa, Artificial Sequence
  Description of Artificial Sequence: Synthetic polypeptide
DEEEIATTNPVAYEQWGSVCSTNDQDQMEGNNDN

SEQ ID NO: 118033 - protein, 34 aa, Artificial Sequence
  Description of Artificial Sequence: Synthetic polypeptide
DEAEICTTNPVATECYGSVSTGNPPQGDTGGNEY

SEQ ID NO: 118034 - protein, 34 aa, Artificial Sequence
  Description of Artificial Sequence: Synthetic polypeptide
DEEEIATTNPVAYEQWGSVCSTMDQDHRNGDDNH

SEQ ID NO: 118035 - protein, 33 aa, Artificial Sequence
  Description of Artificial Sequence: Synthetic polypeptide
DEEEIACTNPVATEQYGSCATNLQPDAQAEGAP

SEQ ID NO: 118036 - protein, 37 aa, Artificial Sequence
  Description of Artificial Sequence: Synthetic polypeptide
DEEEIRTTNPVATEQYGVVSTVTTTNLQAGNNDEQQD

SEQ ID NO: 118037 - protein, 36 aa, Artificial Sequence
  Description of Artificial Sequence: Synthetic polypeptide
DEEEIRTTNPVATEQYGSVSATTPAGDNMRNGMNPV

SEQ ID NO: 118038 - protein, 33 aa, Artificial Sequence
  Description of Artificial Sequence: Synthetic polypeptide
DEEEIATTNPVAYEQYGSVANTGNLERPMQDSQ

SEQ ID NO: 118039 - protein, 34 aa, Artificial Sequence
  Description of Artificial Sequence: Synthetic polypeptide
DEEEIRTTNPVATEQYGSVYQGEPVERMGLVPRD

SEQ ID NO: 118040 - protein, 35 aa, Artificial Sequence
  Description of Artificial Sequence: Synthetic polypeptide
DEEEICTTNPVATECYGSVSTGNPGNQGGHGNGNM

SEQ ID NO: 118041 - protein, 35 aa, Artificial Sequence
  Description of Artificial Sequence: Synthetic polypeptide
DEEEICTTNPVATECYGSVSTGNPGNQGGHGGGNT

SEQ ID NO: 118042 - protein, 35 aa, Artificial Sequence
  Description of Artificial Sequence: Synthetic polypeptide
DEEEICTTNPVATECYGSVSTGNNGQGGHGGNHND

SEQ ID NO: 118043 - protein, 32 aa, Artificial Sequence
  Description of Artificial Sequence: Synthetic polypeptide
DEAEIRTTNPCATDAWGSVSCTNLSQEPVPNE

SEQ ID NO: 118044 - protein, 34 aa, Artificial Sequence
  Description of Artificial Sequence: Synthetic polypeptide
DEEEICTTNPVATECYGSVSTGNGNTGGHGGNNS

SEQ ID NO: 118045 - protein, 35 aa, Artificial Sequence
  Description of Artificial Sequence: Synthetic polypeptide
DEEEICTTNPVATECYGSVSTGNGNQGGHGGNMNT

SEQ ID NO: 118046 - protein, 34 aa, Artificial Sequence
  Description of Artificial Sequence: Synthetic polypeptide
DEAEIRTTNGVAYCQYGSVSSNTWALQRGIDDRP

SEQ ID NO: 118047 - protein, 35 aa, Artificial Sequence
  Description of Artificial Sequence: Synthetic polypeptide
DEEEICTTNPVATECYGSVSTGNQGAQGGHGNNED

SEQ ID NO: 118048 - protein, 31 aa, Artificial Sequence
  Description of Artificial Sequence: Synthetic polypeptide
DEAEIRTTNGVAYCQYGSVSLTNNYVTAGEQ

SEQ ID NO: 118049 - protein, 35 aa, Artificial Sequence
  Description of Artificial Sequence: Synthetic polypeptide
DEEEIRTTNPVATEQYGSVQVTFMNEENRALEPLR

SEQ ID NO: 118050 - protein, 35 aa, Artificial Sequence
  Description of Artificial Sequence: Synthetic polypeptide
DEEEICTTNPVATECYGSVSTGNGGQQGGHGGNND

SEQ ID NO: 118051 - protein, 36 aa, Artificial Sequence
  Description of Artificial Sequence: Synthetic polypeptide
DEEEICTTNPVATECYGSVSTGNGGNQGGDGRNGND

SEQ ID NO: 118052 - protein, 35 aa, Artificial Sequence
  Description of Artificial Sequence: Synthetic polypeptide
DEEEICTTNPVATECYGSVSTGNEGNQGNHGNGNS

SEQ ID NO: 118053 - protein, 35 aa, Artificial Sequence
  Description of Artificial Sequence: Synthetic polypeptide
DEEEICTTNPVATECYGSVSTGNEGNQGGTGRNND

SEQ ID NO: 118054 - protein, 36 aa, Artificial Sequence
  Description of Artificial Sequence: Synthetic polypeptide
DEEEICTTNPVATECYGSVSTGNEGNQGGHGQNDNR

SEQ ID NO: 118055 - protein, 32 aa, Artificial Sequence
  Description of Artificial Sequence: Synthetic polypeptide
DEAEIRTTNGVAYCQYGCVSTELQERFGSDQA

SEQ ID NO: 118056 - protein, 35 aa, Artificial Sequence
  Description of Artificial Sequence: Synthetic polypeptide
DEEEICTTNPVATECYGSVSTGNGIQQGGQGQNQD

SEQ ID NO: 118057 - protein, 35 aa, Artificial Sequence
  Description of Artificial Sequence: Synthetic polypeptide
DEEEICTTNPVATECYGSVSTGNEGNQGGHGNNGD

SEQ ID NO: 118058 - protein, 34 aa, Artificial Sequence
  Description of Artificial Sequence: Synthetic polypeptide
DEEEICTTNPVATECYGSVSTGNQGNAGGGGNND

SEQ ID NO: 118059 - protein, 35 aa, Artificial Sequence
  Description of Artificial Sequence: Synthetic polypeptide
DEEEICTTNPVATECYGSVSTGNQGNQGGHGGDND

SEQ ID NO: 118060 - protein, 37 aa, Artificial Sequence
  Description of Artificial Sequence: Synthetic polypeptide
DEEEIRTTNPVATEQYGSVRSDTDVDGQERFGSNEIP

SEQ ID NO: 118061 - protein, 35 aa, Artificial Sequence
  Description of Artificial Sequence: Synthetic polypeptide
DEEEIRTTNPVATEQYGSVAEPQGNELQQDVAERG

SEQ ID NO: 118062 - protein, 35 aa, Artificial Sequence
  Description of Artificial Sequence: Synthetic polypeptide
DEEEIRTTNPVATEQYGSVRPVSSVNLTGVVNVDN

SEQ ID NO: 118063 - protein, 33 aa, Artificial Sequence
  Description of Artificial Sequence: Synthetic polypeptide
DEEEIRTTNPVATEQYGSVRPVSFVVNTRFVEP

SEQ ID NO: 118064 - protein, 34 aa, Artificial Sequence
  Description of Artificial Sequence: Synthetic polypeptide
DEEEIRTTNPVATEQYGSVQYNTMELERASLAEI

SEQ ID NO: 118065 - protein, 33 aa, Artificial Sequence
  Description of Artificial Sequence: Synthetic polypeptide
DEAEIRTTNPCATECYGSVSTGNLGNAGEDGQS

SEQ ID NO: 118066 - protein, 36 aa, Artificial Sequence
  Description of Artificial Sequence: Synthetic polypeptide
DEEEIRTTNPVATEQYGSVQWTTMNDAQDGSNENFE

SEQ ID NO: 118067 - protein, 34 aa, Artificial Sequence
  Description of Artificial Sequence: Synthetic polypeptide
DEAEIRTTNPCATECYGSVCSKTENQDDRNGNAS

SEQ ID NO: 118068 - protein, 34 aa, Artificial Sequence
  Description of Artificial Sequence: Synthetic polypeptide
DEEEIRTTNPVATEQYGSVAESETTEVPMIDNDV

SEQ ID NO: 118069 - protein, 34 aa, Artificial Sequence
  Description of Artificial Sequence: Synthetic polypeptide
DEEEIRTTNPVATEQYGSVQVTNNEWNRQLEMLP

SEQ ID NO: 118070 - protein, 35 aa, Artificial Sequence
  Description of Artificial Sequence: Synthetic polypeptide
DEEEIRTTNPVATEQYGSVQVTNINEENRNLELLQ

SEQ ID NO: 118071 - protein, 35 aa, Artificial Sequence
  Description of Artificial Sequence: Synthetic polypeptide
DEEEIRTTNPVATEQYGSVQVTNINEENRALSPLF

SEQ ID NO: 118072 - protein, 35 aa, Artificial Sequence
  Description of Artificial Sequence: Synthetic polypeptide
DEEEICTTNPVATECYGSVSTGQNGNQGGHGNGND

SEQ ID NO: 118073 - protein, 34 aa, Artificial Sequence
  Description of Artificial Sequence: Synthetic polypeptide
DEEEIRTTNPVATEQYGSVWTDYLTNWEETQNDG

SEQ ID NO: 118074 - protein, 35 aa, Artificial Sequence
  Description of Artificial Sequence: Synthetic polypeptide
DEEEICTTNPVATECYGSVSTGNTGNQGGTGGNNQ

SEQ ID NO: 118075 - protein, 35 aa, Artificial Sequence
  Description of Artificial Sequence: Synthetic polypeptide
DEEEICTTNPVATECYGSVSTGNQGNQGGQGNTND

SEQ ID NO: 118076 - protein, 36 aa, Artificial Sequence
  Description of Artificial Sequence: Synthetic polypeptide
DEEEIRTTNPVATEQYGSVQVTVWINEQNRALEPLR

SEQ ID NO: 118077 - protein, 34 aa, Artificial Sequence
  Description of Artificial Sequence: Synthetic polypeptide
DEEEIRTTNPVATEQYGSVRSEWHLHQNTMMSSI

SEQ ID NO: 118078 - protein, 33 aa, Artificial Sequence
  Description of Artificial Sequence: Synthetic polypeptide
DEEEIRTTNPVATEQYGSVQVPTMGEIQPEQVV

SEQ ID NO: 118079 - protein, 34 aa, Artificial Sequence
  Description of Artificial Sequence: Synthetic polypeptide
DEEEIRTTNPVATEQYGSVAQAGLQEQTGVGLAD

SEQ ID NO: 118080 - protein, 36 aa, Artificial Sequence
  Description of Artificial Sequence: Synthetic polypeptide
DEEEIRTTNPVATEQYGSVASQWMNMIEVRIGNVDE

SEQ ID NO: 118081 - protein, 35 aa, Artificial Sequence
  Description of Artificial Sequence: Synthetic polypeptide
DEEEIRTTNPVATEQYGSVASTDGQTGEDGEEGGQ

SEQ ID NO: 118082 - protein, 35 aa, Artificial Sequence
  Description of Artificial Sequence: Synthetic polypeptide
DEEEIRTTNPVATEQYGSVYEPEVNEEIQRGQQQT

SEQ ID NO: 118083 - protein, 34 aa, Artificial Sequence
  Description of Artificial Sequence: Synthetic polypeptide
DEEEICTTNPMAYEHYGSVPTNAPSQHRTGGSNR

SEQ ID NO: 118084 - protein, 33 aa, Artificial Sequence
  Description of Artificial Sequence: Synthetic polypeptide
DEAEIRTTNGVAYCQYGCVCSTENLQERGSDQA

SEQ ID NO: 118085 - protein, 33 aa, Artificial Sequence
  Description of Artificial Sequence: Synthetic polypeptide
DEEEICTTNPMATETYGSVVTPDPQHAMGENFR

SEQ ID NO: 118086 - protein, 31 aa, Artificial Sequence
  Description of Artificial Sequence: Synthetic polypeptide
DEAEIRTTNGVAYCQYGCVCSTELQGGSDQG

SEQ ID NO: 118087 - protein, 33 aa, Artificial Sequence
  Description of Artificial Sequence: Synthetic polypeptide
DEEEIRTTNPVATEQYGSVYEPESEIQRIQQLT

SEQ ID NO: 118088 - protein, 30 aa, Artificial Sequence
  Description of Artificial Sequence: Synthetic polypeptide
DEAEIRTTNGVAYCQYGCVCSTEHQNSGDQ

SEQ ID NO: 118089 - protein, 36 aa, Artificial Sequence
  Description of Artificial Sequence: Synthetic polypeptide
DEEEIRTTNPVATEQYGSVASTTDAGPNARNGMNPV

SEQ ID NO: 118090 - protein, 37 aa, Artificial Sequence
  Description of Artificial Sequence: Synthetic polypeptide
DEEEIRTTNPVATEQYGVVSTVVNTNLQNQGTNQQNE

SEQ ID NO: 118091 - protein, 36 aa, Artificial Sequence
  Description of Artificial Sequence: Synthetic polypeptide
DEEEIRTTNPVATEQYGSVASTTPAGKNMRNGMNPV

SEQ ID NO: 118092 - protein, 35 aa, Artificial Sequence
  Description of Artificial Sequence: Synthetic polypeptide
DEEEIRTTNPVATEQYGSVYGDDETLQGGEGGNGE

SEQ ID NO: 118093 - protein, 37 aa, Artificial Sequence
  Description of Artificial Sequence: Synthetic polypeptide
DEEEIRTTNPVATEQYGVVSTVVNTNLQAGTNEEQED

SEQ ID NO: 118094 - protein, 36 aa, Artificial Sequence
  Description of Artificial Sequence: Synthetic polypeptide
DEEEIRTTNPVATEQYGSVASTTPAGPNMRNGMNHV

SEQ ID NO: 118095 - protein, 35 aa, Artificial Sequence
  Description of Artificial Sequence: Synthetic polypeptide
DEEEIRTTNPVATEQYGSVYGDDNTDQGEGGNDQE

SEQ ID NO: 118096 - protein, 32 aa, Artificial Sequence
  Description of Artificial Sequence: Synthetic polypeptide
DEEEICTTNPMATETYGSVCTPDPQHAGEDFR

SEQ ID NO: 118097 - protein, 35 aa, Artificial Sequence
  Description of Artificial Sequence: Synthetic polypeptide
DEEEICTTNPVATECYGSVSTGNAGNQGGHDGNND

SEQ ID NO: 118098 - protein, 36 aa, Artificial Sequence
  Description of Artificial Sequence: Synthetic polypeptide
DEEEIRTTNPVATEQYGSVASPTQYLELQIVEVNVE

SEQ ID NO: 118099 - protein, 34 aa, Artificial Sequence
  Description of Artificial Sequence: Synthetic polypeptide
DEEEICTTNPVATEAWGEVSTGGNLQDHQGGNTA

SEQ ID NO: 118100 - protein, 34 aa, Artificial Sequence
  Description of Artificial Sequence: Synthetic polypeptide
DEEEICTTNPVATECYGSVSTGGNAGGADGGMGR

SEQ ID NO: 118101 - protein, 34 aa, Artificial Sequence
  Description of Artificial Sequence: Synthetic polypeptide
DEEEIRTTNPVATEQYGSVAQMSGLQQTGVELFL

SEQ ID NO: 118102 - protein, 34 aa, Artificial Sequence
  Description of Artificial Sequence: Synthetic polypeptide
DEEEIRTTNPVATEQYGSVAQNNLTEGVLGLMVT

SEQ ID NO: 118103 - protein, 34 aa, Artificial Sequence
  Description of Artificial Sequence: Synthetic polypeptide
DEEEIRTTNPVATEQYGSVYATDNDIQVTISVEE

SEQ ID NO: 118104 - protein, 34 aa, Artificial Sequence
  Description of Artificial Sequence: Synthetic polypeptide
DEEEICTTNPVATECYGSVATGNGQQGGHGNNND

SEQ ID NO: 118105 - protein, 35 aa, Artificial Sequence
  Description of Artificial Sequence: Synthetic polypeptide
DEEEIRTTNPVATEQYGSVASMMNMIEVRIANVEE

SEQ ID NO: 118106 - protein, 34 aa, Artificial Sequence
  Description of Artificial Sequence: Synthetic polypeptide
DEEEIRTTNPVATEQYGSVASMPMLEQEPLEQFQ

SEQ ID NO: 118107 - protein, 35 aa, Artificial Sequence
  Description of Artificial Sequence: Synthetic polypeptide
DEEEIRTTNPVATEQYGSVYEPENFEIQRGQQDQT

SEQ ID NO: 118108 - protein, 34 aa, Artificial Sequence
  Description of Artificial Sequence: Synthetic polypeptide
DEEEIRTTNPVATEQYGSVYCPSTVEQNTLVTVI

SEQ ID NO: 118109 - protein, 36 aa, Artificial Sequence
  Description of Artificial Sequence: Synthetic polypeptide
DEEEIRTTNPVATEQYGSVASPTFNLDELQIVEVAE

SEQ ID NO: 118110 - protein, 36 aa, Artificial Sequence
  Description of Artificial Sequence: Synthetic polypeptide
DEEEIRTTNPVATEQYGSVASPTFSLELQIVESNVN

SEQ ID NO: 118111 - protein, 32 aa, Artificial Sequence
  Description of Artificial Sequence: Synthetic polypeptide
DEAEIRTTNGVAYCQYGCVCSTNLQNSGSDAG

SEQ ID NO: 118112 - protein, 35 aa, Artificial Sequence
  Description of Artificial Sequence: Synthetic polypeptide
DEEEIRTTNPVATEQYGSVYDTGLGNEQEEEQGEI

SEQ ID NO: 118113 - protein, 33 aa, Artificial Sequence
  Description of Artificial Sequence: Synthetic polypeptide
DEAEIRTTNGVAYCQYGCVCSTNLQGFGSDNQA

SEQ ID NO: 118114 - protein, 33 aa, Artificial Sequence
  Description of Artificial Sequence: Synthetic polypeptide
DEEEIRTTNPVATEQYGSVYELWGLQVEAEAHI

SEQ ID NO: 118115 - protein, 34 aa, Artificial Sequence
  Description of Artificial Sequence: Synthetic polypeptide
DEEEICTTNPVATEAYGEVSTGNTNQQQGGNDMT

SEQ ID NO: 118116 - protein, 34 aa, Artificial Sequence
  Description of Artificial Sequence: Synthetic polypeptide
DEEEICTTNPVATECYGEVSTGNGQGGHGGNTND

SEQ ID NO: 118117 - protein, 34 aa, Artificial Sequence
  Description of Artificial Sequence: Synthetic polypeptide
DEEEIRTTNPVATEQYGSVAENTLNASINNEENE

SEQ ID NO: 118118 - protein, 35 aa, Artificial Sequence
  Description of Artificial Sequence: Synthetic polypeptide
DEEEIRTTNPVATEQYGSVAENTENPLINNEENEV

SEQ ID NO: 118119 - protein, 34 aa, Artificial Sequence
  Description of Artificial Sequence: Synthetic polypeptide
DEEEIRTTNPVATEQYGSVAENTCPGLINNEENE

SEQ ID NO: 118120 - protein, 31 aa, Artificial Sequence
  Description of Artificial Sequence: Synthetic polypeptide
DEECNATTNPIAYEQWGEVCSTNLDHDGNER

SEQ ID NO: 118121 - protein, 33 aa, Artificial Sequence
  Description of Artificial Sequence: Synthetic polypeptide
DEEEICTTNPVATESWGSVSTPDLGNHGGQNQN

SEQ ID NO: 118122 - protein, 32 aa, Artificial Sequence
  Description of Artificial Sequence: Synthetic polypeptide
DEECNATTNPIAYEQWGEVCSTNLQHDGGNDR

SEQ ID NO: 118123 - protein, 32 aa, Artificial Sequence
  Description of Artificial Sequence: Synthetic polypeptide
DEECTCTTNPVAVEQYGVVSTVNNVQDGNNNT

SEQ ID NO: 118124 - protein, 36 aa, Artificial Sequence
  Description of Artificial Sequence: Synthetic polypeptide
DEEEICTTNPVATEQYGSVCATNGLEADRPGDNTAM

SEQ ID NO: 118125 - protein, 32 aa, Artificial Sequence
  Description of Artificial Sequence: Synthetic polypeptide
DEECTRTTNPCAYEQYGCVCSTNLQNFGSDQS

SEQ ID NO: 118126 - protein, 33 aa, Artificial Sequence
  Description of Artificial Sequence: Synthetic polypeptide
DEECVRTTNPIAYEAYGEVVSCTNLSQRGGNYI

SEQ ID NO: 118127 - protein, 32 aa, Artificial Sequence
  Description of Artificial Sequence: Synthetic polypeptide
DEECNATTNPIAYEQWGEVCSTNELDQHDGNR

SEQ ID NO: 118128 - protein, 37 aa, Artificial Sequence
  Description of Artificial Sequence: Synthetic polypeptide
DEEEIRTTNPVATEQYGVVSTVVSTNQQAGNNDEQDT

SEQ ID NO: 118129 - protein, 35 aa, Artificial Sequence
  Description of Artificial Sequence: Synthetic polypeptide
DEEEIRTTNPVATEQYGSVSALNTDNGIFQEEPLI

SEQ ID NO: 118130 - protein, 35 aa, Artificial Sequence
  Description of Artificial Sequence: Synthetic polypeptide
DEEEICTTNPVATEQYGEVSTGGPLQDHQQGNMGH

SEQ ID NO: 118131 - protein, 35 aa, Artificial Sequence
  Description of Artificial Sequence: Synthetic polypeptide
DEEEICTTNPVATEQYGEVSTGGPLQDHQGGNNTS

SEQ ID NO: 118132 - protein, 38 aa, Artificial Sequence
  Description of Artificial Sequence: Synthetic polypeptide
DEEEIRTTNPVATEQYGVVSTVVSTNLQSGNNQEDEDE

SEQ ID NO: 118133 - protein, 34 aa, Artificial Sequence
  Description of Artificial Sequence: Synthetic polypeptide
DEEEIRTTNPVATEQYGSVWPTVYTLNETNDVSD

SEQ ID NO: 118134 - protein, 34 aa, Artificial Sequence
  Description of Artificial Sequence: Synthetic polypeptide
DEEEICTTNPVATEQYGEVSTGGPLQDHQGGGGP

SEQ ID NO: 118135 - protein, 35 aa, Artificial Sequence
  Description of Artificial Sequence: Synthetic polypeptide
DEEEICTTNPVATEQYGEVSTGGPLGQDHQGGNNG

SEQ ID NO: 118136 - protein, 36 aa, Artificial Sequence
  Description of Artificial Sequence: Synthetic polypeptide
DEEEIRTTNPVATEQYGSVSAMTPAEPNMRMGMNPV

SEQ ID NO: 118137 - protein, 35 aa, Artificial Sequence
  Description of Artificial Sequence: Synthetic polypeptide
DEEEICTTNPVATEQYGEVSTGGLPGDHQGGNTGS

SEQ ID NO: 118138 - protein, 32 aa, Artificial Sequence
  Description of Artificial Sequence: Synthetic polypeptide
DEECNATTNPIAYEQWGEVCSTNDLQHDGNNR

SEQ ID NO: 118139 - protein, 33 aa, Artificial Sequence
  Description of Artificial Sequence: Synthetic polypeptide
DEEEICTTNPVAYECWGSVTTNLQGNAGENGGM

SEQ ID NO: 118140 - protein, 34 aa, Artificial Sequence
  Description of Artificial Sequence: Synthetic polypeptide
DEEEIRTTNPVATEQYGSVSATPQGMAHRQEAEP

SEQ ID NO: 118141 - protein, 35 aa, Artificial Sequence
  Description of Artificial Sequence: Synthetic polypeptide
DEEEIRTTNPVATEQYGSVSATPNSIQQTISVEED

SEQ ID NO: 118142 - protein, 35 aa, Artificial Sequence
  Description of Artificial Sequence: Synthetic polypeptide
DEEEIRTTNPVATEQYGSVSATPNFIQQYISVEEN

SEQ ID NO: 118143 - protein, 33 aa, Artificial Sequence
  Description of Artificial Sequence: Synthetic polypeptide
DEEEICTTNPVAYEQWGSVTGNNGEQGNMGNNR

SEQ ID NO: 118144 - protein, 31 aa, Artificial Sequence
  Description of Artificial Sequence: Synthetic polypeptide
DEECLRTTNPCAYEQYGCVCSWNHQHFGSNQ

SEQ ID NO: 118145 - protein, 31 aa, Artificial Sequence
  Description of Artificial Sequence: Synthetic polypeptide
DEECLRTTNPCAYEQYGCVCSWNLQNFGSQQ

SEQ ID NO: 118146 - protein, 36 aa, Artificial Sequence
  Description of Artificial Sequence: Synthetic polypeptide
DEEEIRTTNPVATEQYGSVSATNNMMMQEEGEQEVN

SEQ ID NO: 118147 - protein, 33 aa, Artificial Sequence
  Description of Artificial Sequence: Synthetic polypeptide
DEEEICTTNPVAYECWGSVSTNQQGNAGENHGM

SEQ ID NO: 118148 - protein, 38 aa, Artificial Sequence
  Description of Artificial Sequence: Synthetic polypeptide
DEEEIRTTNPVATEQYGVVSTVVSTTNLQGIGNTEQGS

SEQ ID NO: 118149 - protein, 34 aa, Artificial Sequence
  Description of Artificial Sequence: Synthetic polypeptide
DEECLRTTNPIAYEQWGIEVVSTNLSQRTGGNNR

SEQ ID NO: 118150 - protein, 32 aa, Artificial Sequence
  Description of Artificial Sequence: Synthetic polypeptide
DEECLRTTNPIAYEQYGCVCSTNPQNFGSNQG

SEQ ID NO: 118151 - protein, 32 aa, Artificial Sequence
  Description of Artificial Sequence: Synthetic polypeptide
DEECLRTTNPIAYEQYGCVCSTPLQNFGSNQS

SEQ ID NO: 118152 - protein, 35 aa, Artificial Sequence
  Description of Artificial Sequence: Synthetic polypeptide
DEEEIRTTNPVATEQYGSVSATLNDIQQTISVEES

SEQ ID NO: 118153 - protein, 36 aa, Artificial Sequence
  Description of Artificial Sequence: Synthetic polypeptide
DEEEIRTTNPVATEQYGSVSATDNDLQMMTISQEED

SEQ ID NO: 118154 - protein, 34 aa, Artificial Sequence
  Description of Artificial Sequence: Synthetic polypeptide
DEEEIRTTNPVATEQYGSVSAPVGLIETTPGQLV

SEQ ID NO: 118155 - protein, 34 aa, Artificial Sequence
  Description of Artificial Sequence: Synthetic polypeptide
DEEEIRTTNPVATEQYGSVSAPSNDIQMTISVEE

SEQ ID NO: 118156 - protein, 33 aa, Artificial Sequence
  Description of Artificial Sequence: Synthetic polypeptide
DEEEICTTNPVAYEQWGSVCNTFNREDRTGTDR

SEQ ID NO: 118157 - protein, 32 aa, Artificial Sequence
  Description of Artificial Sequence: Synthetic polypeptide
DEEEICTTNPVATEQYGEVSTGGGDHGGGEQE

SEQ ID NO: 118158 - protein, 33 aa, Artificial Sequence
  Description of Artificial Sequence: Synthetic polypeptide
DEEEICTTNPVATEQYGEVSTGDGDHGGQGERE

SEQ ID NO: 118159 - protein, 36 aa, Artificial Sequence
  Description of Artificial Sequence: Synthetic polypeptide
DEEEIRTTNPVATEQYGSVSAITPAGPDMRNGMNPV

SEQ ID NO: 118160 - protein, 36 aa, Artificial Sequence
  Description of Artificial Sequence: Synthetic polypeptide
DEEEIRTTNPVATEQYGSVWSTTPAGPNMRNGMNYV

SEQ ID NO: 118161 - protein, 35 aa, Artificial Sequence
  Description of Artificial Sequence: Synthetic polypeptide
DEEEIRTTNPVATEQYGSVSAEFNYMQMINPEDIQ

SEQ ID NO: 118162 - protein, 36 aa, Artificial Sequence
  Description of Artificial Sequence: Synthetic polypeptide
DEEEIRTTNPVATEQYGSVSAEDNYMQERENPQIDT

SEQ ID NO: 118163 - protein, 37 aa, Artificial Sequence
  Description of Artificial Sequence: Synthetic polypeptide
DEEEIRTTNPVATEQYGVVSTVVSNLQSGNNEEDEDE

SEQ ID NO: 118164 - protein, 32 aa, Artificial Sequence
  Description of Artificial Sequence: Synthetic polypeptide
DEEEIAATNPTATEQYGGVSEMNEQDQEGDNF

SEQ ID NO: 118165 - protein, 34 aa, Artificial Sequence
  Description of Artificial Sequence: Synthetic polypeptide
DEEEIRTTNPVATEQYGSVSADYLTTTEETQNDP

SEQ ID NO: 118166 - protein, 37 aa, Artificial Sequence
  Description of Artificial Sequence: Synthetic polypeptide
DEEEIRTTNPVATEQYGVVSTVVSNLQQGSEEGSVND

SEQ ID NO: 118167 - protein, 36 aa, Artificial Sequence
  Description of Artificial Sequence: Synthetic polypeptide
DEEEIRTTNPVATEQYGVVSTVVSNNNQQGNNQQED

SEQ ID NO: 118168 - protein, 37 aa, Artificial Sequence
  Description of Artificial Sequence: Synthetic polypeptide
DEEEIRTTNPVATEQYGVVSTVVSNLQQGNNDEEEDE

SEQ ID NO: 118169 - protein, 37 aa, Artificial Sequence
  Description of Artificial Sequence: Synthetic polypeptide
DEEEIRTTNPVATEQYGVVSTVVSNLQAGSEGGTVNE

SEQ ID NO: 118170 - protein, 37 aa, Artificial Sequence
  Description of Artificial Sequence: Synthetic polypeptide
DEEEIRTTNPVATEQYGVVSTVVSNLQAGNQQNEEDE

SEQ ID NO: 118171 - protein, 35 aa, Artificial Sequence
  Description of Artificial Sequence: Synthetic polypeptide
DEEEIRTTNPVATEQYGSVSADEGLYQPTNEVDQQ

SEQ ID NO: 118172 - protein, 36 aa, Artificial Sequence
  Description of Artificial Sequence: Synthetic polypeptide
DEEEIRTTNPVATEQYGSVRSTTPAGPNMRNGMNPV

SEQ ID NO: 118173 - protein, 36 aa, Artificial Sequence
  Description of Artificial Sequence: Synthetic polypeptide
DEEEIRTTNPVATEQYGSVWSTTPAGPNTRNGMNPV

SEQ ID NO: 118174 - protein, 36 aa, Artificial Sequence
  Description of Artificial Sequence: Synthetic polypeptide
DEEEIRTTNPVATEQYGSVWSTTPAMPNMRNGMNPV

SEQ ID NO: 118175 - protein, 35 aa, Artificial Sequence
  Description of Artificial Sequence: Synthetic polypeptide
DEEEIRTTNPVATEQYGSVAENTANDQINGEQEED

SEQ ID NO: 118176 - protein, 37 aa, Artificial Sequence
  Description of Artificial Sequence: Synthetic polypeptide
DEEEIRTTNPVATEQYGVVSTVVSNLQAGSESGVVNQ

SEQ ID NO: 118177 - protein, 36 aa, Artificial Sequence
  Description of Artificial Sequence: Synthetic polypeptide
DEEEIRTTNPVATEQYGSVWSTTPAGPNMRNGMNPV

SEQ ID NO: 118178 - protein, 35 aa, Artificial Sequence
  Description of Artificial Sequence: Synthetic polypeptide
DEEEIRTTNPVATEQYGSVSAEPNGQQENMGPEEV

SEQ ID NO: 118179 - protein, 32 aa, Artificial Sequence
  Description of Artificial Sequence: Synthetic polypeptide
DEEEICTTNPVATEHYGEVSTGGDHGGQGGRE

SEQ ID NO: 118180 - protein, 38 aa, Artificial Sequence
  Description of Artificial Sequence: Synthetic polypeptide
DEEEIRTTNPVATEQYGVVSTVVSTNLQQLGNQDEEED

SEQ ID NO: 118181 - protein, 33 aa, Artificial Sequence
  Description of Artificial Sequence: Synthetic polypeptide
DEEEICTTNPVATEQYGCVCSTEEHQYFNSEQS

SEQ ID NO: 118182 - protein, 34 aa, Artificial Sequence
  Description of Artificial Sequence: Synthetic polypeptide
DEAEIRTTNPCATEQWGSVTNGNGGDLQGGGNPR

SEQ ID NO: 118183 - protein, 34 aa, Artificial Sequence
  Description of Artificial Sequence: Synthetic polypeptide
DEAEIRTTNPCATEQWGSVTNGNGGDLQGGGNGR

SEQ ID NO: 118184 - protein, 34 aa, Artificial Sequence
  Description of Artificial Sequence: Synthetic polypeptide
DEEEICTTNPVATEQWGEVSTNGLGDHGGQGGRE

SEQ ID NO: 118185 - protein, 38 aa, Artificial Sequence
  Description of Artificial Sequence: Synthetic polypeptide
DEEEIRTTNPVATEQYGVVSTVVSTNLQALGTTEQGND

SEQ ID NO: 118186 - protein, 38 aa, Artificial Sequence
  Description of Artificial Sequence: Synthetic polypeptide
DEEEIRTTNPVATEQYGVVSTVVSTNLQAGNQQGEETE

SEQ ID NO: 118187 - protein, 37 aa, Artificial Sequence
  Description of Artificial Sequence: Synthetic polypeptide
DEEEIRTTNPVATEQYGVVSTVVSTNLEQGNNTEEQE

SEQ ID NO: 118188 - protein, 34 aa, Artificial Sequence
  Description of Artificial Sequence: Synthetic polypeptide
DEEEIRTTNPVATEQYGSVSAGMGGNQNENDDEG

SEQ ID NO: 118189 - protein, 34 aa, Artificial Sequence
  Description of Artificial Sequence: Synthetic polypeptide
DEEEIRTTNPVATEQYGSVSAGDNDIQMTIVVEE

SEQ ID NO: 118190 - protein, 33 aa, Artificial Sequence
  Description of Artificial Sequence: Synthetic polypeptide
DEEEICTTNPVATEQWGEVSTEGGNDHGGGRRE

SEQ ID NO: 118191 - protein, 34 aa, Artificial Sequence
  Description of Artificial Sequence: Synthetic polypeptide
DEEEICTTNPVATEPYGEVSTGGPLQDHQGGNKG

SEQ ID NO: 118192 - protein, 32 aa, Artificial Sequence
  Description of Artificial Sequence: Synthetic polypeptide
DEEEICTTNPVATEMWGVVSTNNGNDDRNNDS

SEQ ID NO: 118193 - protein, 35 aa, Artificial Sequence
  Description of Artificial Sequence: Synthetic polypeptide
DEEEIRTTNPVATEQYGSVACTENQPQNVGPEQQE

SEQ ID NO: 118194 - protein, 34 aa, Artificial Sequence
  Description of Artificial Sequence: Synthetic polypeptide
DEEEICTTNPVATEHYGSVTTGNQGNQGGHGNND

SEQ ID NO: 118195 - protein, 34 aa, Artificial Sequence
  Description of Artificial Sequence: Synthetic polypeptide
DEEEIRTTNPVATEQYGSVACTNPQAMTIVQDEE

SEQ ID NO: 118196 - protein, 34 aa, Artificial Sequence
  Description of Artificial Sequence: Synthetic polypeptide
DEEEICTTNPVATEHYGSVISCLPNMLSFHDGNH

SEQ ID NO: 118197 - protein, 36 aa, Artificial Sequence
  Description of Artificial Sequence: Synthetic polypeptide
DEEEIRTTNPVATEQYGSVASTTPAGPNMRNGMNPK

SEQ ID NO: 118198 - protein, 36 aa, Artificial Sequence
  Description of Artificial Sequence: Synthetic polypeptide
DEEEIRTTNPVATEQYGSVASTTPAGPNMRNGMNPV

SEQ ID NO: 118199 - protein, 36 aa, Artificial Sequence
  Description of Artificial Sequence: Synthetic polypeptide
DEEEIRTTNPVATEQYGSVASTTSAGPNMRNGMNPV

SEQ ID NO: 118200 - protein, 34 aa, Artificial Sequence
  Description of Artificial Sequence: Synthetic polypeptide
DEEEIRTTNPVATEQYGSVASVPLLETGQIVDDL

SEQ ID NO: 118201 - protein, 35 aa, Artificial Sequence
  Description of Artificial Sequence: Synthetic polypeptide
DEEEIRTTNPVATEQYGSVYPTNLINIVDQMVELN

SEQ ID NO: 118202 - protein, 34 aa, Artificial Sequence
  Description of Artificial Sequence: Synthetic polypeptide
DEEEIRTTNPVATEQYGSVCAGTDPVTDDGGTRM

SEQ ID NO: 118203 - protein, 34 aa, Artificial Sequence
  Description of Artificial Sequence: Synthetic polypeptide
DEEEIRTTNPVATEQYGSVCAMAGLNPAVGNPES

SEQ ID NO: 118204 - protein, 36 aa, Artificial Sequence
  Description of Artificial Sequence: Synthetic polypeptide
DEEEIRTTNPVATEQYGSVQSTTPAGPNMRNGMNPV

SEQ ID NO: 118205 - protein, 33 aa, Artificial Sequence
  Description of Artificial Sequence: Synthetic polypeptide
DEEEIACTNPVATEQYGCVAATNLQAEAGGSEN

SEQ ID NO: 118206 - protein, 34 aa, Artificial Sequence
  Description of Artificial Sequence: Synthetic polypeptide
DEEEIRTTNPVATEQYGSVCAMNGNLEPADIDNE

SEQ ID NO: 118207 - protein, 33 aa, Artificial Sequence
  Description of Artificial Sequence: Synthetic polypeptide
DEEEIACTNPVATEQYGCVAGTNQLQNDMGGLH

SEQ ID NO: 118208 - protein, 35 aa, Artificial Sequence
  Description of Artificial Sequence: Synthetic polypeptide
DEEEIRTTNPVATEQYGSVCADNANLANAGGNNHN

SEQ ID NO: 118209 - protein, 33 aa, Artificial Sequence
  Description of Artificial Sequence: Synthetic polypeptide
DEEEIRTTNPVATEQYGSVCAPEILLPQITVVG

SEQ ID NO: 118210 - protein, 32 aa, Artificial Sequence
  Description of Artificial Sequence: Synthetic polypeptide
DEEEIACTNPVATEQYGCVATNLADAPQGEIQ

SEQ ID NO: 118211 - protein, 32 aa, Artificial Sequence
  Description of Artificial Sequence: Synthetic polypeptide
DEEEIACTNPVATEQYGCVATNLAPDNQMNEN

SEQ ID NO: 118212 - protein, 32 aa, Artificial Sequence
  Description of Artificial Sequence: Synthetic polypeptide
DEEEIACTNPVATEQYGCVATNLAPDQIEAQM

SEQ ID NO: 118213 - protein, 35 aa, Artificial Sequence
  Description of Artificial Sequence: Synthetic polypeptide
DEEEIRTTNPVATEQYGSVCATNGEPTGGDLENGM

SEQ ID NO: 118214 - protein, 33 aa, Artificial Sequence
  Description of Artificial Sequence: Synthetic polypeptide
DEEEIACTNPVATEQYGCVATNLQAAEDDTERN

SEQ ID NO: 118215 - protein, 32 aa, Artificial Sequence
  Description of Artificial Sequence: Synthetic polypeptide
DEEEIACTNPVATEQYGCVATNLQAEDDTEDV

SEQ ID NO: 118216 - protein, 36 aa, Artificial Sequence
  Description of Artificial Sequence: Synthetic polypeptide
DEEEIRTTNPVATEQYGSVQSTNFLEQELMDPPELV

SEQ ID NO: 118217 - protein, 32 aa, Artificial Sequence
  Description of Artificial Sequence: Synthetic polypeptide
DEEEIACTNPVATEQYGCVATNEAEDNGNNDV

SEQ ID NO: 118218 - protein, 33 aa, Artificial Sequence
  Description of Artificial Sequence: Synthetic polypeptide
DEEEIACTNPVATEQYGCVATNLQDMPGEEGIH

SEQ ID NO: 118219 - protein, 35 aa, Artificial Sequence
  Description of Artificial Sequence: Synthetic polypeptide
DEEEIRTTNPVATEQYGSVCAATQLASATAEGDRE

SEQ ID NO: 118220 - protein, 35 aa, Artificial Sequence
  Description of Artificial Sequence: Synthetic polypeptide
DEEEIRTTNPVATEQYGSVCAATNNQEQDTTNGLE

SEQ ID NO: 118221 - protein, 36 aa, Artificial Sequence
  Description of Artificial Sequence: Synthetic polypeptide
DEEEIRTTNPVATEQYGVVSTVVNNQQQGDEETNDE

SEQ ID NO: 118222 - protein, 35 aa, Artificial Sequence
  Description of Artificial Sequence: Synthetic polypeptide
DEEEIRTTNPVATEQYGSVYPLDDVSIGFQEGVRL

SEQ ID NO: 118223 - protein, 35 aa, Artificial Sequence
  Description of Artificial Sequence: Synthetic polypeptide
DEEEIRTTNPVATEQYGSVQSWTNLGIEPVIMAIG

SEQ ID NO: 118224 - protein, 36 aa, Artificial Sequence
  Description of Artificial Sequence: Synthetic polypeptide
DEEEIRTTNPVATEQYGSVCAANIILQDRAIENGME

SEQ ID NO: 118225 - protein, 35 aa, Artificial Sequence
  Description of Artificial Sequence: Synthetic polypeptide
DEEEIRTTNPVATEQYGSVCAANNDLQGDVQNDDE

SEQ ID NO: 118226 - protein, 34 aa, Artificial Sequence
  Description of Artificial Sequence: Synthetic polypeptide
DEEEIRTTNPVATEQYGSVYPMTTVQQPPQVGEC

SEQ ID NO: 118227 - protein, 35 aa, Artificial Sequence
  Description of Artificial Sequence: Synthetic polypeptide
DEEEIRTTNPVATEQYGSVCAATAQLAATAEGARE

SEQ ID NO: 118228 - protein, 34 aa, Artificial Sequence
  Description of Artificial Sequence: Synthetic polypeptide
DEEEIRTTNPVATEQYGSVYPTNEPEIRPQIVHT

SEQ ID NO: 118229 - protein, 34 aa, Artificial Sequence
  Description of Artificial Sequence: Synthetic polypeptide
DEEEIRTTNPVATEQYGSVCAATGEEPAREMNNA

SEQ ID NO: 118230 - protein, 33 aa, Artificial Sequence
  Description of Artificial Sequence: Synthetic polypeptide
DEEEIRTTNPVATEQYGSVCAATNEEADMPDEG

SEQ ID NO: 118231 - protein, 33 aa, Artificial Sequence
  Description of Artificial Sequence: Synthetic polypeptide
DEEEIRTTNPVATEQYGSVCAATNEEGMMPDEW

SEQ ID NO: 118232 - protein, 34 aa, Artificial Sequence
  Description of Artificial Sequence: Synthetic polypeptide
DEEEIRTTNPVATEQYGSVCAATNEEVMNMPDEK

SEQ ID NO: 118233 - protein, 34 aa, Artificial Sequence
  Description of Artificial Sequence: Synthetic polypeptide
DEEEIACTNPVATEQWGSVSVSGNPLNTRGVNES

SEQ ID NO: 118234 - protein, 36 aa, Artificial Sequence
  Description of Artificial Sequence: Synthetic polypeptide
DEEEIRTTNPVATEQYGSVQSVTMTMLQDVHENAMV

SEQ ID NO: 118235 - protein, 34 aa, Artificial Sequence
  Description of Artificial Sequence: Synthetic polypeptide
DEEEIRTTNPVATEQYGSVYPTMLPETRPVSVEQ

SEQ ID NO: 118236 - protein, 36 aa, Artificial Sequence
  Description of Artificial Sequence: Synthetic polypeptide
DEEEIRTTNPVATEQYGSVQSTTTVTLAPRNIVFER

SEQ ID NO: 118237 - protein, 34 aa, Artificial Sequence
  Description of Artificial Sequence: Synthetic polypeptide
DEEEIRTTNPVATEQYGSVCAATGEEQAIEMMNM

SEQ ID NO: 118238 - protein, 32 aa, Artificial Sequence
  Description of Artificial Sequence: Synthetic polypeptide
DEEEIACTNPVATEQYGCVATNLQEADTTPEQ

SEQ ID NO: 118239 - protein, 33 aa, Artificial Sequence
  Description of Artificial Sequence: Synthetic polypeptide
DEEEIACTNPVATEQYGCVATNLQENPGEDPHN

SEQ ID NO: 118240 - protein, 34 aa, Artificial Sequence
  Description of Artificial Sequence: Synthetic polypeptide
DEEEIATTNPVAYEQYGSVATPHLPQDPLGNAAE

SEQ ID NO: 118241 - protein, 34 aa, Artificial Sequence
  Description of Artificial Sequence: Synthetic polypeptide
DEEEIRTTNPVATEQYGSVYPTNVPETDTQSVET

SEQ ID NO: 118242 - protein, 33 aa, Artificial Sequence
  Description of Artificial Sequence: Synthetic polypeptide
DEEEIATTNPVAYEQYGSVATNLADTGGGDESM

SEQ ID NO: 118243 - protein, 35 aa, Artificial Sequence
  Description of Artificial Sequence: Synthetic polypeptide
DEEEIRTTNPVATEQYGSVYPTPGLPETRGVSVET

SEQ ID NO: 118244 - protein, 35 aa, Artificial Sequence
  Description of Artificial Sequence: Synthetic polypeptide
DEEEIRTTNPVATEQYGSVYPTPNLPETRPVSVEA

SEQ ID NO: 118245 - protein, 35 aa, Artificial Sequence
  Description of Artificial Sequence: Synthetic polypeptide
DEEEIRTTNPVATEQYGSVQSPESLVQTPRSMIVD

SEQ ID NO: 118246 - protein, 33 aa, Artificial Sequence
  Description of Artificial Sequence: Synthetic polypeptide
DEEEIACTNPVATEQYGCVATNLQTAPDGEAGN

SEQ ID NO: 118247 - protein, 33 aa, Artificial Sequence
  Description of Artificial Sequence: Synthetic polypeptide
DEEEIATTNPVAYEQYGSVATAGTQTRNGPDEY

SEQ ID NO: 118248 - protein, 34 aa, Artificial Sequence
  Description of Artificial Sequence: Synthetic polypeptide
DEEEIRTTNPVATEQYGSVQSPIMSLEEIEDSRI

SEQ ID NO: 118249 - protein, 34 aa, Artificial Sequence
  Description of Artificial Sequence: Synthetic polypeptide
DEEEIATTNPVAYEQYGSVATAGTQTRNGIDERL

SEQ ID NO: 118250 - protein, 32 aa, Artificial Sequence
  Description of Artificial Sequence: Synthetic polypeptide
DEEEIATTNPVAYEQYGSVATAGTQTLNNDEV

SEQ ID NO: 118251 - protein, 33 aa, Artificial Sequence
  Description of Artificial Sequence: Synthetic polypeptide
DEEEIATTNPVAYEQYGSVATAGTQTGNGDEAL

SEQ ID NO: 118252 - protein, 33 aa, Artificial Sequence
  Description of Artificial Sequence: Synthetic polypeptide
DEEEIATTNPVAYEQYGSVATAGTQTANGDERN

SEQ ID NO: 118253 - protein, 32 aa, Artificial Sequence
  Description of Artificial Sequence: Synthetic polypeptide
DEEEIATTNPVAYEQYGSVATAGTPTRNGDEE

SEQ ID NO: 118254 - protein, 35 aa, Artificial Sequence
  Description of Artificial Sequence: Synthetic polypeptide
DEEEIRTTNPVATEQYGSVYPTVNWLQQDEVTVQI

SEQ ID NO: 118255 - protein, 35 aa, Artificial Sequence
  Description of Artificial Sequence: Synthetic polypeptide
DEEEIRTTNPVATEQYGSVQSFNTMVSMEQSVNPE

SEQ ID NO: 118256 - protein, 35 aa, Artificial Sequence
  Description of Artificial Sequence: Synthetic polypeptide
DEEEIRTTNPVATEQYGSVQSETTMEEQRMVVEVN

SEQ ID NO: 118257 - protein, 35 aa, Artificial Sequence
  Description of Artificial Sequence: Synthetic polypeptide
DEEEIRTTNPVATEQYGSVQSLTTMEQNMVVEVNL

SEQ ID NO: 118258 - protein, 35 aa, Artificial Sequence
  Description of Artificial Sequence: Synthetic polypeptide
DEEEIRTTNPVATEQYGSVCEPTNNMPQAQGPQGL

SEQ ID NO: 118259 - protein, 35 aa, Artificial Sequence
  Description of Artificial Sequence: Synthetic polypeptide
DEEEIRTTNPVATEQYGSVQSPNSLESEVGMVVPD

SEQ ID NO: 118260 - protein, 30 aa, Artificial Sequence
  Description of Artificial Sequence: Synthetic polypeptide
DEAEIRCTNGVAYCQYGSSVSLTNNVAGEQ

SEQ ID NO: 118261 - protein, 36 aa, Artificial Sequence
  Description of Artificial Sequence: Synthetic polypeptide
DEEEIRTTNPVATEQYGSVQSTDNMQEMLEVVEGED

SEQ ID NO: 118262 - protein, 36 aa, Artificial Sequence
  Description of Artificial Sequence: Synthetic polypeptide
DEEEIRTTNPVATEQYGVVSTVVNNQQGNDEETEDE

SEQ ID NO: 118263 - protein, 36 aa, Artificial Sequence
  Description of Artificial Sequence: Synthetic polypeptide
DEEEIRTTNPVATEQYGSVQSTAYLQPDLEGVEGED

SEQ ID NO: 118264 - protein, 35 aa, Artificial Sequence
  Description of Artificial Sequence: Synthetic polypeptide
DEEEIRTTNPVATEQYGSVQSSTYDVLEGMEINGS

SEQ ID NO: 118265 - protein, 35 aa, Artificial Sequence
  Description of Artificial Sequence: Synthetic polypeptide
DEEEIRTTNPVATEQYGSVCATNNEPTGDLENDGM

SEQ ID NO: 118266 - protein, 35 aa, Artificial Sequence
  Description of Artificial Sequence: Synthetic polypeptide
DEEEIRTTNPVATEQYGSVQSSAYDVLQGMEINMV

SEQ ID NO: 118267 - protein, 35 aa, Artificial Sequence
  Description of Artificial Sequence: Synthetic polypeptide
DEEEIRTTNPVATEQYGSVCATNPELNEHDDNVAN

SEQ ID NO: 118268 - protein, 36 aa, Artificial Sequence
  Description of Artificial Sequence: Synthetic polypeptide
DEEEIRTTNPVATEQYGSVCATNPELPQEHDDNEAG

SEQ ID NO: 118269 - protein, 33 aa, Artificial Sequence
  Description of Artificial Sequence: Synthetic polypeptide
DEEEIACTNPVATEQYGCVATNLQPAGQDMSDM

SEQ ID NO: 118270 - protein, 36 aa, Artificial Sequence
  Description of Artificial Sequence: Synthetic polypeptide
DEEEIRTTNPVATEQYGSVCATNPQLNPDDGMGENA

SEQ ID NO: 118271 - protein, 35 aa, Artificial Sequence
  Description of Artificial Sequence: Synthetic polypeptide
DEEEIRTTNPVATEQYGSVCAWNPLLQLDAEGDHH

SEQ ID NO: 118272 - protein, 37 aa, Artificial Sequence
  Description of Artificial Sequence: Synthetic polypeptide
DEEEIRTTNPVATEQYGSVQSPTYYLQPMLEGVENED

SEQ ID NO: 118273 - protein, 33 aa, Artificial Sequence
  Description of Artificial Sequence: Synthetic polypeptide
DEEEIACTNPVATEQYGCVATNLQPDDQMNDEM

SEQ ID NO: 118274 - protein, 33 aa, Artificial Sequence
  Description of Artificial Sequence: Synthetic polypeptide
DEEEIATTNPVAYEQYGSVATNLQPADSMISDM

SEQ ID NO: 118275 - protein, 33 aa, Artificial Sequence
  Description of Artificial Sequence: Synthetic polypeptide
DEEEIACTNPVATEQYGCVATNLQPDNQGEGDA

SEQ ID NO: 118276 - protein, 34 aa, Artificial Sequence
  Description of Artificial Sequence: Synthetic polypeptide
DEEEIRTTNPVATEQYGSVQSPSVNYEMTVDNDL

SEQ ID NO: 118277 - protein, 34 aa, Artificial Sequence
  Description of Artificial Sequence: Synthetic polypeptide
DEEEIRTTNPVATEQYGSVQSPSINMEHVVDNDL

SEQ ID NO: 118278 - protein, 33 aa, Artificial Sequence
  Description of Artificial Sequence: Synthetic polypeptide
DEEEIATTNPVAYEQYGSVCQAANVLQAEDGDS

SEQ ID NO: 118279 - protein, 35 aa, Artificial Sequence
  Description of Artificial Sequence: Synthetic polypeptide
DEEEIRTTNPVATEQYGSVCNTELLDTQENVEENA

SEQ ID NO: 118280 - protein, 34 aa, Artificial Sequence
  Description of Artificial Sequence: Synthetic polypeptide
DEEEIRTTNPVATEQYGSVYPFNLPETRTQAVET

SEQ ID NO: 118281 - protein, 34 aa, Artificial Sequence
  Description of Artificial Sequence: Synthetic polypeptide
DEEEIATTNPVAYEQYGSVCQATNVLNQAEDNDS

SEQ ID NO: 118282 - protein, 32 aa, Artificial Sequence
  Description of Artificial Sequence: Synthetic polypeptide
DEEEIATTNPVGTEQYGVVSSSAGPQRNGMDI

SEQ ID NO: 118283 - protein, 31 aa, Artificial Sequence
  Description of Artificial Sequence: Synthetic polypeptide
DEEEIATTNPVGTEGYGVVSSTAGPNHGMNV

SEQ ID NO: 118284 - protein, 32 aa, Artificial Sequence
  Description of Artificial Sequence: Synthetic polypeptide
DEEEIATTNPVCTETYGSVANPNLQDEGGSLH

SEQ ID NO: 118285 - protein, 32 aa, Artificial Sequence
  Description of Artificial Sequence: Synthetic polypeptide
DEEEIATTNPVCTETYGSVAGNPNLQNDMGGL

SEQ ID NO: 118286 - protein, 34 aa, Artificial Sequence
  Description of Artificial Sequence: Synthetic polypeptide
DEEEIATTNPVCTEQYGSVSSTTALPNSNGMNPQ

SEQ ID NO: 118287 - protein, 34 aa, Artificial Sequence
  Description of Artificial Sequence: Synthetic polypeptide
DEEEIATTNPVCTEQYGSVSSTTAGPNRNGMNPV

SEQ ID NO: 118288 - protein, 33 aa, Artificial Sequence
  Description of Artificial Sequence: Synthetic polypeptide
DEEEIATTNPVCTEQYGCVAFNNLQEGMENQFT

SEQ ID NO: 118289 - protein, 32 aa, Artificial Sequence
  Description of Artificial Sequence: Synthetic polypeptide
DEEEIATTNPVSTEQWGSVYTFDNHQNGGKQT

SEQ ID NO: 118290 - protein, 31 aa, Artificial Sequence
  Description of Artificial Sequence: Synthetic polypeptide
DEEEIATTNPVCTECWGVVSNDEDLQESGNI

SEQ ID NO: 118291 - protein, 33 aa, Artificial Sequence
  Description of Artificial Sequence: Synthetic polypeptide
DEEEIATTNPVAYERWGVVSTNQQMGGPNGNHR

SEQ ID NO: 118292 - protein, 33 aa, Artificial Sequence
  Description of Artificial Sequence: Synthetic polypeptide
DEEEIATTNPVAYERWGSVSTMNQGMGPNGNTR

SEQ ID NO: 118293 - protein, 34 aa, Artificial Sequence
  Description of Artificial Sequence: Synthetic polypeptide
DEEEIRTTNPVATEQYGSVYGMGNMDTGGNGQEI

SEQ ID NO: 118294 - protein, 31 aa, Artificial Sequence
  Description of Artificial Sequence: Synthetic polypeptide
DEEEIATTNPVAYEQYGTVSYEGGQNHGGDL

SEQ ID NO: 118295 - protein, 35 aa, Artificial Sequence
  Description of Artificial Sequence: Synthetic polypeptide
DEEEIRTTNPVATEQYGSVYGQGTDDLGQGNEETG

SEQ ID NO: 118296 - protein, 35 aa, Artificial Sequence
  Description of Artificial Sequence: Synthetic polypeptide
DEEEIATTNPVAYEQYGSVSWTDNSLFTVRNNEDF

SEQ ID NO: 118297 - protein, 35 aa, Artificial Sequence
  Description of Artificial Sequence: Synthetic polypeptide
DEEEIATTNPVAYEQYGSVSHDNSLFTVRVGNEFT

SEQ ID NO: 118298 - protein, 34 aa, Artificial Sequence
  Description of Artificial Sequence: Synthetic polypeptide
DEEEIRTTNPVATEQYGSVYGEGNMDDGGNQQEI

SEQ ID NO: 118299 - protein, 35 aa, Artificial Sequence
  Description of Artificial Sequence: Synthetic polypeptide
DEEEIATTNPVAYEQYGSVSHDNSLFTVRSGNEIF

SEQ ID NO: 118300 - protein, 35 aa, Artificial Sequence
  Description of Artificial Sequence: Synthetic polypeptide
DEEEIRTTNPVATEQYGVVSTVVNQQQQNNEETEE

SEQ ID NO: 118301 - protein, 35 aa, Artificial Sequence
  Description of Artificial Sequence: Synthetic polypeptide
DEEEIATTNPVSTEQYGSVSSTTPAGPNMRNGNPR

SEQ ID NO: 118302 - protein, 35 aa, Artificial Sequence
  Description of Artificial Sequence: Synthetic polypeptide
DEEEICTTNPCAYEEYGSVPTQNALSQHRTGGSNR

SEQ ID NO: 118303 - protein, 34 aa, Artificial Sequence
  Description of Artificial Sequence: Synthetic polypeptide
DEEEICTTNPAATEQYGSVVPGNNLQEGGGNGDD

SEQ ID NO: 118304 - protein, 32 aa, Artificial Sequence
  Description of Artificial Sequence: Synthetic polypeptide
DEEEICSTNPTAYEQYGSVATNLQHAGGTDMW

SEQ ID NO: 118305 - protein, 31 aa, Artificial Sequence
  Description of Artificial Sequence: Synthetic polypeptide
DEEEIATVNPVSTEPYGTVSMEDLQQQNGNQ

SEQ ID NO: 118306 - protein, 32 aa, Artificial Sequence
  Description of Artificial Sequence: Synthetic polypeptide
DEEEIATVNPVCTEQYGVVSATDGLVEFEGND

SEQ ID NO: 118307 - protein, 34 aa, Artificial Sequence
  Description of Artificial Sequence: Synthetic polypeptide
DEEEIATVNPVCTEQYGSVSSTTALPQSNGMNPQ

SEQ ID NO: 118308 - protein, 33 aa, Artificial Sequence
  Description of Artificial Sequence: Synthetic polypeptide
DEEEIATVNPVCTEQYGSVSSDPNGQSNGMNPV

SEQ ID NO: 118309 - protein, 29 aa, Artificial Sequence
  Description of Artificial Sequence: Synthetic peptide
DEEEIATTNPVSTEQYGEAPEVCQRVEEK

SEQ ID NO: 118310 - protein, 32 aa, Artificial Sequence
  Description of Artificial Sequence: Synthetic polypeptide
DEEEIATVNPVCTEQYGSVSATDLEDHEGEDQ

SEQ ID NO: 118311 - protein, 33 aa, Artificial Sequence
  Description of Artificial Sequence: Synthetic polypeptide
DEEEIATVNPVATEQYGSVAGTGLQSNMNHQGE

SEQ ID NO: 118312 - protein, 33 aa, Artificial Sequence
  Description of Artificial Sequence: Synthetic polypeptide
DEEEIATVNPVATEQYGSVAGTGLQNPMNNQEN

SEQ ID NO: 118313 - protein, 32 aa, Artificial Sequence
  Description of Artificial Sequence: Synthetic polypeptide
DEEEIATVNPVATEQYGSVAGAGLQSNNNHQE

SEQ ID NO: 118314 - protein, 33 aa, Artificial Sequence
  Description of Artificial Sequence: Synthetic polypeptide
DEEEIRTTNPVATEQYGSVQTTDTTVTLMQNDT

SEQ ID NO: 118315 - protein, 32 aa, Artificial Sequence
  Description of Artificial Sequence: Synthetic polypeptide
DEEEIATVNPVATEQYGCVAGNGLQSADNQAE

SEQ ID NO: 118316 - protein, 32 aa, Artificial Sequence
  Description of Artificial Sequence: Synthetic polypeptide
DEEEIATTNPYATEQYGSVPTVQGEHQQMNEP

SEQ ID NO: 118317 - protein, 33 aa, Artificial Sequence
  Description of Artificial Sequence: Synthetic polypeptide
DEEEIATTNPVVTEQYGSVSWNEGENRQGGDAP

SEQ ID NO: 118318 - protein, 33 aa, Artificial Sequence
  Description of Artificial Sequence: Synthetic polypeptide
DEEEIATVNPVATEQYGSVATGLQSNNNHQAEE

SEQ ID NO: 118319 - protein, 34 aa, Artificial Sequence
  Description of Artificial Sequence: Synthetic polypeptide
DEEEIATTNPVAYEQYGSVSHDNSLFTVRIGDEF

SEQ ID NO: 118320 - protein, 34 aa, Artificial Sequence
  Description of Artificial Sequence: Synthetic polypeptide
DEEEIATTNPVAYEQYGSVSCTDHMLPSGTNNDL

SEQ ID NO: 118321 - protein, 34 aa, Artificial Sequence
  Description of Artificial Sequence: Synthetic polypeptide
DEEEIATTNPVAYEQYGSVSANGLQENPNGALPN

SEQ ID NO: 118322 - protein, 32 aa, Artificial Sequence
  Description of Artificial Sequence: Synthetic polypeptide
DEEEIACTNPVATEQWGSVAIENLQPPGGTES

SEQ ID NO: 118323 - protein, 37 aa, Artificial Sequence
  Description of Artificial Sequence: Synthetic polypeptide
DEEEIRTTNPVATEQYGSVATVNQNNLQQGNDEEDEE

SEQ ID NO: 118324 - protein, 33 aa, Artificial Sequence
  Description of Artificial Sequence: Synthetic polypeptide
DEAEIRTTNCVAYCAYGSTVSCTHLSQNGGDNR

SEQ ID NO: 118325 - protein, 37 aa, Artificial Sequence
  Description of Artificial Sequence: Synthetic polypeptide
DEEEIRTTNPVATEQYGSVYMNSPLLPQARNGVGVRI

SEQ ID NO: 118326 - protein, 34 aa, Artificial Sequence
  Description of Artificial Sequence: Synthetic polypeptide
DEEEIRTTNPVATEQYGSVAVSMDIQVGISEQEA

SEQ ID NO: 118327 - protein, 33 aa, Artificial Sequence
  Description of Artificial Sequence: Synthetic polypeptide
DEEEIRTTNPVATEQYGSVQTDTTVPTGEEEWG

SEQ ID NO: 118328 - protein, 32 aa, Artificial Sequence
  Description of Artificial Sequence: Synthetic polypeptide
DEAEIRTCNPVATDQYGSVSMTRTLQENDQSE

SEQ ID NO: 118329 - protein, 35 aa, Artificial Sequence
  Description of Artificial Sequence: Synthetic polypeptide
DEEEIRTTNPVATEQYGSVQTMSGLQGEFEQMVRE

SEQ ID NO: 118330 - protein, 33 aa, Artificial Sequence
  Description of Artificial Sequence: Synthetic polypeptide
DEEEIRTTNPVATEQYGSVAVTTDEGASSDNQQ

SEQ ID NO: 118331 - protein, 35 aa, Artificial Sequence
  Description of Artificial Sequence: Synthetic polypeptide
DEEEIATTNPVAYEQYGSVCSATNNLAEPPGGERE

SEQ ID NO: 118332 - protein, 33 aa, Artificial Sequence
  Description of Artificial Sequence: Synthetic polypeptide
DEEEIRTTNPVATEQYGSVQTDTSVPTGEEELY

SEQ ID NO: 118333 - protein, 32 aa, Artificial Sequence
  Description of Artificial Sequence: Synthetic polypeptide
DEAEIRTCNPVATDQYGSVSMTRTLEQENQEY

SEQ ID NO: 118334 - protein, 33 aa, Artificial Sequence
  Description of Artificial Sequence: Synthetic polypeptide
DEAEIRTCNPVATDQYGSVSMTHLVQHPNQEEP

SEQ ID NO: 118335 - protein, 29 aa, Artificial Sequence
  Description of Artificial Sequence: Synthetic peptide
DEAEIRQTNGVAYCSYGSVSLTNNVAGEQ

SEQ ID NO: 118336 - protein, 35 aa, Artificial Sequence
  Description of Artificial Sequence: Synthetic polypeptide
DEEEIRTTNPVATEQYGSVAYENAPEETPGFQNER

SEQ ID NO: 118337 - protein, 34 aa, Artificial Sequence
  Description of Artificial Sequence: Synthetic polypeptide
DEEEIRTTNPVATEQYGSVAYMGLAIRDLIENEL

SEQ ID NO: 118338 - protein, 34 aa, Artificial Sequence
  Description of Artificial Sequence: Synthetic polypeptide
DEEEIRTTNPVATEQYGSVAVTYVPLDSLYEENQ

SEQ ID NO: 118339 - protein, 35 aa, Artificial Sequence
  Description of Artificial Sequence: Synthetic polypeptide
DEEEIRTTNPVATEQYGSVYLTENQHQTADQIGDG

SEQ ID NO: 118340 - protein, 35 aa, Artificial Sequence
  Description of Artificial Sequence: Synthetic polypeptide
DEEEIRTTNPVATEQYGSVYLTENQHQSRDQIEDG

SEQ ID NO: 118341 - protein, 35 aa, Artificial Sequence
  Description of Artificial Sequence: Synthetic polypeptide
DEEEIRTTNPVATEQYGSVYLTENQHQERDQEIDQ

SEQ ID NO: 118342 - protein, 33 aa, Artificial Sequence
  Description of Artificial Sequence: Synthetic polypeptide
DEEEIRTTNPVATEQYGSVYGVGQGLEENGGGI

SEQ ID NO: 118343 - protein, 33 aa, Artificial Sequence
  Description of Artificial Sequence: Synthetic polypeptide
DEEEIATTNPVAYEQYGSVMHDNSLFTVRQNEF

SEQ ID NO: 118344 - protein, 35 aa, Artificial Sequence
  Description of Artificial Sequence: Synthetic polypeptide
DEEEIRTTNPVATEQYGSVATTGNLAGTESGTTES

SEQ ID NO: 118345 - protein, 35 aa, Artificial Sequence
  Description of Artificial Sequence: Synthetic polypeptide
DEEEIRTTNPVATEQYGSVATTGNNLAGTETGTTE

SEQ ID NO: 118346 - protein, 34 aa, Artificial Sequence
  Description of Artificial Sequence: Synthetic polypeptide
DEEEIRTTNPVATEQYGSVATTGNQAGTEGTTET

SEQ ID NO: 118347 - protein, 34 aa, Artificial Sequence
  Description of Artificial Sequence: Synthetic polypeptide
DEEEIRTTNPVATEQYGSVYIENDTPQQGVIPQP

SEQ ID NO: 118348 - protein, 35 aa, Artificial Sequence
  Description of Artificial Sequence: Synthetic polypeptide
DEEEIRTTNPVATEQYGSVATTGNQLAGTEENTTE

SEQ ID NO: 118349 - protein, 33 aa, Artificial Sequence
  Description of Artificial Sequence: Synthetic polypeptide
DEEEIATTNPVAYEQYGSVGANNNLQENPDGAP

SEQ ID NO: 118350 - protein, 32 aa, Artificial Sequence
  Description of Artificial Sequence: Synthetic polypeptide
DEEEIACTNPVATEQWGCVATNLQEEGDGEQP

SEQ ID NO: 118351 - protein, 32 aa, Artificial Sequence
  Description of Artificial Sequence: Synthetic polypeptide
DEEEIACTNPVATEQWGCVATNLQTEEGIGEQ

SEQ ID NO: 118352 - protein, 35 aa, Artificial Sequence
  Description of Artificial Sequence: Synthetic polypeptide
DEEEIRTTNPVATEQYGSVATTNNNQLLQEDEDED

SEQ ID NO: 118353 - protein, 36 aa, Artificial Sequence
  Description of Artificial Sequence: Synthetic polypeptide
DEEEIRTTNPVATEQYGSVATTNNNQLQQGEDEAEE

SEQ ID NO: 118354 - protein, 34 aa, Artificial Sequence
  Description of Artificial Sequence: Synthetic polypeptide
DEEEIRTTNPVATEQYGSVATTNPNQNQEQDEEQ

SEQ ID NO: 118355 - protein, 35 aa, Artificial Sequence
  Description of Artificial Sequence: Synthetic polypeptide
DEEEIRTTNPVATEQYGSVATTNQNQLLQEDEEDE

SEQ ID NO: 118356 - protein, 35 aa, Artificial Sequence
  Description of Artificial Sequence: Synthetic polypeptide
DEEEIRTTNPVATEQYGSVATTVNQLAGTEGTTTE

SEQ ID NO: 118357 - protein, 34 aa, Artificial Sequence
  Description of Artificial Sequence: Synthetic polypeptide
DEEEIATTNPVAYEQYGSVCSTIDNLPLSDEGEN

SEQ ID NO: 118358 - protein, 34 aa, Artificial Sequence
  Description of Artificial Sequence: Synthetic polypeptide
DEEEIATTNPVAYEQYGSVCSTDTGQNHGDNEQV

SEQ ID NO: 118359 - protein, 33 aa, Artificial Sequence
  Description of Artificial Sequence: Synthetic polypeptide
DEEEIRTTNPVATEQYGSVQTDDTTVTGEEELL

SEQ ID NO: 118360 - protein, 35 aa, Artificial Sequence
  Description of Artificial Sequence: Synthetic polypeptide
DEEEIRTTNPVATEQYGSVSTYGMGNDTGQENEEF

SEQ ID NO: 118361 - protein, 33 aa, Artificial Sequence
  Description of Artificial Sequence: Synthetic polypeptide
DEEEIATTNPVATEQYGCVATADLQPDNENNNL

SEQ ID NO: 118362 - protein, 35 aa, Artificial Sequence
  Description of Artificial Sequence: Synthetic polypeptide
DEEEIRTTNPVATEQYGCVCSTNEDNQENFNSEQA

SEQ ID NO: 118363 - protein, 38 aa, Artificial Sequence
  Description of Artificial Sequence: Synthetic polypeptide
DEEEIRTTNPVATEQYGSVSTVNLQQGNTEQGTNQQED

SEQ ID NO: 118364 - protein, 33 aa, Artificial Sequence
  Description of Artificial Sequence: Synthetic polypeptide
DEDEIATTNPVAYEQYGSVATPNLENNRGGEPE

SEQ ID NO: 118365 - protein, 33 aa, Artificial Sequence
  Description of Artificial Sequence: Synthetic polypeptide
DEEEIRTTNPVATEQYGAYSTSIDDPRQGEDGQ

SEQ ID NO: 118366 - protein, 33 aa, Artificial Sequence
  Description of Artificial Sequence: Synthetic polypeptide
DEEEIRTTNPVATEQYGAYSTNIDPWEQGEDGQ

SEQ ID NO: 118367 - protein, 33 aa, Artificial Sequence
  Description of Artificial Sequence: Synthetic polypeptide
DEEEIRTTNPVATEQYGAYSANIDDLEQGEDGQ

SEQ ID NO: 118368 - protein, 32 aa, Artificial Sequence
  Description of Artificial Sequence: Synthetic polypeptide
DEEEIRTTNPVATEQYGAVYTPGIVGVGGEGT

SEQ ID NO: 118369 - protein, 38 aa, Artificial Sequence
  Description of Artificial Sequence: Synthetic polypeptide
DEEEIRTTNPVATEQYGSVSTVNLQQGNTEAGTNNEED

SEQ ID NO: 118370 - protein, 38 aa, Artificial Sequence
  Description of Artificial Sequence: Synthetic polypeptide
DEEEIRTTNPVATEQYGSVSTVNLQQGNQEQGTNEDEE

SEQ ID NO: 118371 - protein, 32 aa, Artificial Sequence
  Description of Artificial Sequence: Synthetic polypeptide
DEDEIATTNPVAYEQYGSVATNNQDQGDGAEE

SEQ ID NO: 118372 - protein, 32 aa, Artificial Sequence
  Description of Artificial Sequence: Synthetic polypeptide
DEDEIATTNPVAYEQYGSVATNLQVPDDSAEN

SEQ ID NO: 118373 - protein, 33 aa, Artificial Sequence
  Description of Artificial Sequence: Synthetic polypeptide
DEEEIRTTNPVATEQYGAVYTDNNFGEGGEGQT

SEQ ID NO: 118374 - protein, 38 aa, Artificial Sequence
  Description of Artificial Sequence: Synthetic polypeptide
DEEEIRTTNPVATEQYGSVSTVNLQQGNNVTEQGNETG

SEQ ID NO: 118375 - protein, 34 aa, Artificial Sequence
  Description of Artificial Sequence: Synthetic polypeptide
DEEEIRTTNPVATEQYGSVSTPACPNMRNEMEPV

SEQ ID NO: 118376 - protein, 36 aa, Artificial Sequence
  Description of Artificial Sequence: Synthetic polypeptide
DEEEIRTTNPVATEQYGSVSTEMMGLEENMGNNPQQ

SEQ ID NO: 118377 - protein, 37 aa, Artificial Sequence
  Description of Artificial Sequence: Synthetic polypeptide
DEEEIRTTNPVATEQYGSVSTSTNQQISTEQGTNNGN

SEQ ID NO: 118378 - protein, 34 aa, Artificial Sequence
  Description of Artificial Sequence: Synthetic polypeptide
DEEEIRTTNPVATEQYGSVSTEMVPNTRAEDLQF

SEQ ID NO: 118379 - protein, 35 aa, Artificial Sequence
  Description of Artificial Sequence: Synthetic polypeptide
DEEEIRTTNPVATEQYGSVSTENADMADELEIQYM

SEQ ID NO: 118380 - protein, 34 aa, Artificial Sequence
  Description of Artificial Sequence: Synthetic polypeptide
DEEEIRTTNPVATEQYGSVSTPAGPNMRNEMEPV

SEQ ID NO: 118381 - protein, 38 aa, Artificial Sequence
  Description of Artificial Sequence: Synthetic polypeptide
DEEEIRTTNPVATEQYGSVSTVNLQQGNTEQGTNTDTD

SEQ ID NO: 118382 - protein, 38 aa, Artificial Sequence
  Description of Artificial Sequence: Synthetic polypeptide
DEEEIRTTNPVATEQYGSVSTVNLQQGNTEQGTTTDEE

SEQ ID NO: 118383 - protein, 37 aa, Artificial Sequence
  Description of Artificial Sequence: Synthetic polypeptide
DEEEIRTTNPVATEQYGSVSTVNLQQLNENNEENQED

SEQ ID NO: 118384 - protein, 34 aa, Artificial Sequence
  Description of Artificial Sequence: Synthetic polypeptide
DEEEIRTTNPVATEQYGCVCSSGEHQNFGSDNQS

SEQ ID NO: 118385 - protein, 34 aa, Artificial Sequence
  Description of Artificial Sequence: Synthetic polypeptide
DEAEIRTTNPVATEQYGSVSTVLWWGQPELEEQA

SEQ ID NO: 118386 - protein, 35 aa, Artificial Sequence
  Description of Artificial Sequence: Synthetic polypeptide
DEAEIRTTNPVATEQYGSVSTWGSLQEFGEFEQQV

SEQ ID NO: 118387 - protein, 33 aa, Artificial Sequence
  Description of Artificial Sequence: Synthetic polypeptide
DEAEIRTTNPVATEQYGSVSTWPSDLVPFTQIE

SEQ ID NO: 118388 - protein, 34 aa, Artificial Sequence
  Description of Artificial Sequence: Synthetic polypeptide
DEEEIRTTNPVATEQYGSVSTMTTIQELIVPVTS

SEQ ID NO: 118389 - protein, 33 aa, Artificial Sequence
  Description of Artificial Sequence: Synthetic polypeptide
DEEEIRTTNPVATEQFGQCVCSTYDLEHFGSDQ

SEQ ID NO: 118390 - protein, 37 aa, Artificial Sequence
  Description of Artificial Sequence: Synthetic polypeptide
DEEEIRTTNPVATEQYGSVSTVNLQQQNQNNEEQEDG

SEQ ID NO: 118391 - protein, 32 aa, Artificial Sequence
  Description of Artificial Sequence: Synthetic polypeptide
DECEISTTNPVAYEGWGSVATENEGQNDGNNR

SEQ ID NO: 118392 - protein, 38 aa, Artificial Sequence
  Description of Artificial Sequence: Synthetic polypeptide
DEEEIRTTNPVATEQYGSVSTSVNTNLQQGTNDEDEED

SEQ ID NO: 118393 - protein, 33 aa, Artificial Sequence
  Description of Artificial Sequence: Synthetic polypeptide
DEAEIRTTNPVAYEQWGSVATSNQLQGDVDNGQ

SEQ ID NO: 118394 - protein, 33 aa, Artificial Sequence
  Description of Artificial Sequence: Synthetic polypeptide
DEAEIRTTNPVAYEQWGSVAITGNDHGQMGGNH

SEQ ID NO: 118395 - protein, 33 aa, Artificial Sequence
  Description of Artificial Sequence: Synthetic polypeptide
DECEIRTTNPVSTEQWGSSSTDNMNQITGNNVI

SEQ ID NO: 118396 - protein, 32 aa, Artificial Sequence
  Description of Artificial Sequence: Synthetic polypeptide
DECEIRTTNPVSTEPYGTISVEDITQQQNGNH

SEQ ID NO: 118397 - protein, 34 aa, Artificial Sequence
  Description of Artificial Sequence: Synthetic polypeptide
DEEEIRTTNPVATEQYGSVSTMTGHQEQVPEQVD

SEQ ID NO: 118398 - protein, 32 aa, Artificial Sequence
  Description of Artificial Sequence: Synthetic polypeptide
DEDEIATTNPVATAQWGGCVSTAALQDRGDID

SEQ ID NO: 118399 - protein, 36 aa, Artificial Sequence
  Description of Artificial Sequence: Synthetic polypeptide
DEEEIRTTNPVATEQYGSVSTSSNIGVQLTQLEVLL

SEQ ID NO: 118400 - protein, 35 aa, Artificial Sequence
  Description of Artificial Sequence: Synthetic polypeptide
DEEEIRTTNPVATEQYGCVCSMWGELQFFGSNNQS

SEQ ID NO: 118401 - protein, 38 aa, Artificial Sequence
  Description of Artificial Sequence: Synthetic polypeptide
DEEEIRTTNPVATEQYGSVSTVNLQQLQAGNNEQGEDD

SEQ ID NO: 118402 - protein, 37 aa, Artificial Sequence
  Description of Artificial Sequence: Synthetic polypeptide
DEEEIRTTNPVATEQYGSVSTVNLQQQNQNATEQGTE

SEQ ID NO: 118403 - protein, 31 aa, Artificial Sequence
  Description of Artificial Sequence: Synthetic polypeptide
DECEIATTNPVAYEQYGVCSTIEDQGGPNDN

SEQ ID NO: 118404 - protein, 35 aa, Artificial Sequence
  Description of Artificial Sequence: Synthetic polypeptide
DEEEIRTTNPVATEQYGSVSTENDDHPDEASDNEH

SEQ ID NO: 118405 - protein, 38 aa, Artificial Sequence
  Description of Artificial Sequence: Synthetic polypeptide
DEEEIRTTNPVATEQYGSVSTSVNTTNLQAGTTNNTTD

SEQ ID NO: 118406 - protein, 32 aa, Artificial Sequence
  Description of Artificial Sequence: Synthetic polypeptide
DEDEIATTNPVAYEQYGSVATAGTQTRNGDEA

SEQ ID NO: 118407 - protein, 35 aa, Artificial Sequence
  Description of Artificial Sequence: Synthetic polypeptide
DEEEIRTTNPVATEQYGSVSTNKHSSETPMGSIWN

SEQ ID NO: 118408 - protein, 34 aa, Artificial Sequence
  Description of Artificial Sequence: Synthetic polypeptide
DECEIATVNPVATEQYGSVSWTEDLDEGGRNDHR

SEQ ID NO: 118409 - protein, 34 aa, Artificial Sequence
  Description of Artificial Sequence: Synthetic polypeptide
DEDEIATTNPVAYEQYGSVANTNLEDRGSNQDEQ

SEQ ID NO: 118410 - protein, 32 aa, Artificial Sequence
  Description of Artificial Sequence: Synthetic polypeptide
DEDEIATTNPVAYEQYGSVANTALPQNHDDNQ

SEQ ID NO: 118411 - protein, 33 aa, Artificial Sequence
  Description of Artificial Sequence: Synthetic polypeptide
DECEIATVNPVATEQYGSVSWTEGLDEGGGKHR

SEQ ID NO: 118412 - protein, 35 aa, Artificial Sequence
  Description of Artificial Sequence: Synthetic polypeptide
DEAEIRTTNPVAYEQWGSCVYSDEVNDGQRNGNAR

SEQ ID NO: 118413 - protein, 33 aa, Artificial Sequence
  Description of Artificial Sequence: Synthetic polypeptide
DEEEIRTTNPVATEQYGCVCSSEPQEFFNSDQA

SEQ ID NO: 118414 - protein, 38 aa, Artificial Sequence
  Description of Artificial Sequence: Synthetic polypeptide
DEEEIRTTNPVATEQYGSVSTVNLQQGNNGTQQGEETE

SEQ ID NO: 118415 - protein, 30 aa, Artificial Sequence
  Description of Artificial Sequence: Synthetic polypeptide
DEDEIATTNPVAYEQYGSVAMNGTAENPNE

SEQ ID NO: 118416 - protein, 34 aa, Artificial Sequence
  Description of Artificial Sequence: Synthetic polypeptide
DEEEIRTTNPVATEQYGCVCSSENHQENFGSDQA

SEQ ID NO: 118417 - protein, 34 aa, Artificial Sequence
  Description of Artificial Sequence: Synthetic polypeptide
DECEICTTNPMATEQWGSVAPTDNDQHREGGNGR

SEQ ID NO: 118418 - protein, 32 aa, Artificial Sequence
  Description of Artificial Sequence: Synthetic polypeptide
DEDEIATTNPVAYEQYGSVAMNDQATGNGDEH

SEQ ID NO: 118419 - protein, 38 aa, Artificial Sequence
  Description of Artificial Sequence: Synthetic polypeptide
DEEEIRTTNPVATEQYGSVSTVNLQQGNNGTEQGTSTE

SEQ ID NO: 118420 - protein, 38 aa, Artificial Sequence
  Description of Artificial Sequence: Synthetic polypeptide
DEEEIRTTNPVATEQYGSVSTVNLQQGNNEQGTNADEN

SEQ ID NO: 118421 - protein, 38 aa, Artificial Sequence
  Description of Artificial Sequence: Synthetic polypeptide
DEEEIRTTNPVATEQYGSVSTVNLQQGNNANQQGNGTE

SEQ ID NO: 118422 - protein, 33 aa, Artificial Sequence
  Description of Artificial Sequence: Synthetic polypeptide
DECEICTTNPMATEQWGSVAPTDNHQHRGNGDQ

SEQ ID NO: 118423 - protein, 33 aa, Artificial Sequence
  Description of Artificial Sequence: Synthetic polypeptide
DEDEIATTNPVAYEQYGSVATAGTQTRNNEERN

SEQ ID NO: 118424 - protein, 32 aa, Artificial Sequence
  Description of Artificial Sequence: Synthetic polypeptide
DECEIATTNPVAYERWGSVSTNQGMGPNGNNR

SEQ ID NO: 118425 - protein, 32 aa, Artificial Sequence
  Description of Artificial Sequence: Synthetic polypeptide
DEDEIATTNPVAYEQYGSVATGNLENNAGEPE

SEQ ID NO: 118426 - protein, 31 aa, Artificial Sequence
  Description of Artificial Sequence: Synthetic polypeptide
DEDEIATTNPVAYEQYGSVATHGQDSDGSEH

SEQ ID NO: 118427 - protein, 38 aa, Artificial Sequence
  Description of Artificial Sequence: Synthetic polypeptide
DEEEIRTTNPVATEQYGSVSTSVSTTNLQAGTTNEESD

SEQ ID NO: 118428 - protein, 38 aa, Artificial Sequence
  Description of Artificial Sequence: Synthetic polypeptide
DEEEIRTTNPVATEQYGSVSTSVTNLQAGNNQGTEDED

SEQ ID NO: 118429 - protein, 34 aa, Artificial Sequence
  Description of Artificial Sequence: Synthetic polypeptide
DEAEIRTTNPVAYEQWGSCVYSIEVNDTQRNQNR

SEQ ID NO: 118430 - protein, 35 aa, Artificial Sequence
  Description of Artificial Sequence: Synthetic polypeptide
DEEEIRTTNPVATEQYGSVSTENDNGQADEASDLE

SEQ ID NO: 118431 - protein, 35 aa, Artificial Sequence
  Description of Artificial Sequence: Synthetic polypeptide
DEEEIRTTNPVATEQYGSVSTENFDDNLGGEEEHD

SEQ ID NO: 118432 - protein, 34 aa, Artificial Sequence
  Description of Artificial Sequence: Synthetic polypeptide
DEEEIRTTNPVATEFYGSVMGMTNEGEGGEGNNV

SEQ ID NO: 118433 - protein, 31 aa, Artificial Sequence
  Description of Artificial Sequence: Synthetic polypeptide
DEDEIATTNPVAYEQYGSVATNGTAENPNVN

SEQ ID NO: 118434 - protein, 31 aa, Artificial Sequence
  Description of Artificial Sequence: Synthetic polypeptide
DEDEIATTNPVAYEQYGSVATNGTAENPNKY

SEQ ID NO: 118435 - protein, 35 aa, Artificial Sequence
  Description of Artificial Sequence: Synthetic polypeptide
DEEEIRTTNPVATEFYGSVMGMTNMGDQGGEENET

SEQ ID NO: 118436 - protein, 32 aa, Artificial Sequence
  Description of Artificial Sequence: Synthetic polypeptide
DEDEIATTNPVAYEQYGSVATNGTAEGGNEHA

SEQ ID NO: 118437 - protein, 38 aa, Artificial Sequence
  Description of Artificial Sequence: Synthetic polypeptide
DEEEIRTTNPVATEQYGSVSTVNLQQGNNQQGNGNDET

SEQ ID NO: 118438 - protein, 33 aa, Artificial Sequence
  Description of Artificial Sequence: Synthetic polypeptide
DEEEIRTTNPVATEQYGCVCSSGEHANFGSNQY

SEQ ID NO: 118439 - protein, 38 aa, Artificial Sequence
  Description of Artificial Sequence: Synthetic polypeptide
DEEEIRTTNPVATEQYGSVSTVNLQQGNNNTEQGIGTE

SEQ ID NO: 118440 - protein, 32 aa, Artificial Sequence
  Description of Artificial Sequence: Synthetic polypeptide
DEDEIATTNPVAYEQYGSVATHLQDQGGDQEN

SEQ ID NO: 118441 - protein, 34 aa, Artificial Sequence
  Description of Artificial Sequence: Synthetic polypeptide
DEAEIRTTNPVAYEQWGSCVYSDEVNDTQRDLNR

SEQ ID NO: 118442 - protein, 34 aa, Artificial Sequence
  Description of Artificial Sequence: Synthetic polypeptide
DEEEIRTTNPVATEFYGSVMGFTNQGEGGEENTG

SEQ ID NO: 118443 - protein, 34 aa, Artificial Sequence
  Description of Artificial Sequence: Synthetic polypeptide
DEEEIRTTNPVATEFYGSVMGFTNEGEGGEENGV

SEQ ID NO: 118444 - protein, 32 aa, Artificial Sequence
  Description of Artificial Sequence: Synthetic polypeptide
DEDEIATTNPVAYEQYGSVATHLPQDSGSDEM

SEQ ID NO: 118445 - protein, 38 aa, Artificial Sequence
  Description of Artificial Sequence: Synthetic polypeptide
DEEEIRTTNPVATEQYGSVSTVNLQQGNNQQGTNQDED

SEQ ID NO: 118446 - protein, 33 aa, Artificial Sequence
  Description of Artificial Sequence: Synthetic polypeptide
DEEEIRTTNPVATEFYGSVMGDVGQTGGGENEG

SEQ ID NO: 118447 - protein, 33 aa, Artificial Sequence
  Description of Artificial Sequence: Synthetic polypeptide
DEEEIRTTNPVATEQYGCVCSSGEHQNFGSDQA

SEQ ID NO: 118448 - protein, 34 aa, Artificial Sequence
  Description of Artificial Sequence: Synthetic polypeptide
DEEEIRTTNPVATEQYGCVCSSGEHQNFGSQNQL

SEQ ID NO: 118449 - protein, 33 aa, Artificial Sequence
  Description of Artificial Sequence: Synthetic polypeptide
DEEEIRTTNPVATEQYGCVCSSYHQNFNSDTQY

SEQ ID NO: 118450 - protein, 33 aa, Artificial Sequence
  Description of Artificial Sequence: Synthetic polypeptide
DEEEIRTTNPVATEQYGCVCSSPHQENFNSDQT

SEQ ID NO: 118451 - protein, 35 aa, Artificial Sequence
  Description of Artificial Sequence: Synthetic polypeptide
DEEEIRTTNPVATEQYGSVSTDYLTTTEHTQNTDG

SEQ ID NO: 118452 - protein, 35 aa, Artificial Sequence
  Description of Artificial Sequence: Synthetic polypeptide
DEEEIRTTNPVATEQYGSVSTDYPTNTRSTQNDTN

SEQ ID NO: 118453 - protein, 34 aa, Artificial Sequence
  Description of Artificial Sequence: Synthetic polypeptide
DEEEIRTTNPVATEFYGSVSNDNGQGQEFNNEGG

SEQ ID NO: 118454 - protein, 35 aa, Artificial Sequence
  Description of Artificial Sequence: Synthetic polypeptide
DEEEIRTTNPVATEFYGSVSGTVNGQSEGGGGQTG

SEQ ID NO: 118455 - protein, 34 aa, Artificial Sequence
  Description of Artificial Sequence: Synthetic polypeptide
DEEEIRTTNPVATEQYGCVCSSPEHQEHFGSNQT

SEQ ID NO: 118456 - protein, 35 aa, Artificial Sequence
  Description of Artificial Sequence: Synthetic polypeptide
DEEEIRTTNPVATEFYGSVSGTNQGQSEGGGGQTN

SEQ ID NO: 118457 - protein, 32 aa, Artificial Sequence
  Description of Artificial Sequence: Synthetic polypeptide
DEDEIATTNPVAYEQYGSVSANDAQGNDNNSD

SEQ ID NO: 118458 - protein, 33 aa, Artificial Sequence
  Description of Artificial Sequence: Synthetic polypeptide
DEDEIATTNPVAYEQYGSVSAGNPPQRPGDSEN

SEQ ID NO: 118459 - protein, 33 aa, Artificial Sequence
  Description of Artificial Sequence: Synthetic polypeptide
DEDEIATTNPVAYEQYGSVSAANQADAQAENRH

SEQ ID NO: 118460 - protein, 34 aa, Artificial Sequence
  Description of Artificial Sequence: Synthetic polypeptide
DEEEIRTTNPVATEFYGSVSDNDNDQNDEGFGEE

SEQ ID NO: 118461 - protein, 32 aa, Artificial Sequence
  Description of Artificial Sequence: Synthetic polypeptide
DECEIATTNPVAYEQYGTVATGGNGQAGQNDV

SEQ ID NO: 118462 - protein, 32 aa, Artificial Sequence
  Description of Artificial Sequence: Synthetic polypeptide
DECEIATTNPVAYEQYGTVATGGNSGQAGNTV

SEQ ID NO: 118463 - protein, 34 aa, Artificial Sequence
  Description of Artificial Sequence: Synthetic polypeptide
DEAEIRTTNPVAYEQWGSVCSTDNGIQDEGENNS

SEQ ID NO: 118464 - protein, 34 aa, Artificial Sequence
  Description of Artificial Sequence: Synthetic polypeptide
DEEEIRTTNPVATEQYGSVSTNMVSTEHFLEDEI

SEQ ID NO: 118465 - protein, 32 aa, Artificial Sequence
  Description of Artificial Sequence: Synthetic polypeptide
DEDEIATTNPVAYEQYGSVSAAGGQDSDGNGY

SEQ ID NO: 118466 - protein, 35 aa, Artificial Sequence
  Description of Artificial Sequence: Synthetic polypeptide
DEEEIRTTNPVATEQYGSVSTDVLTTMPVVENFET

SEQ ID NO: 118467 - protein, 33 aa, Artificial Sequence
  Description of Artificial Sequence: Synthetic polypeptide
DEAEIRTTNPVAYEQWGSVCSTDNMTQGDVNEN

SEQ ID NO: 118468 - protein, 31 aa, Artificial Sequence
  Description of Artificial Sequence: Synthetic polypeptide
DEDEIATTNPVAYEQYGSVSANNDANTTPRE

SEQ ID NO: 118469 - protein, 38 aa, Artificial Sequence
  Description of Artificial Sequence: Synthetic polypeptide
DEEEIRTTNPVATEQYGSVSTNLQQQGNNNNEQGEEQD

SEQ ID NO: 118470 - protein, 33 aa, Artificial Sequence
  Description of Artificial Sequence: Synthetic polypeptide
DEEEIRTTNPVATEPYGTVSSMEDIQQQQNGNH

SEQ ID NO: 118471 - protein, 34 aa, Artificial Sequence
  Description of Artificial Sequence: Synthetic polypeptide
DEEEIRTTNPVATEQYGSVSTDVIQTSLMVSQQF

SEQ ID NO: 118472 - protein, 35 aa, Artificial Sequence
  Description of Artificial Sequence: Synthetic polypeptide
DEEEIRTTNPVATEQYGCVCSTEDDQENFGSDNQA

SEQ ID NO: 118473 - protein, 32 aa, Artificial Sequence
  Description of Artificial Sequence: Synthetic polypeptide
DECEIYTTNPVATEQYGITVSGSNLSYPGEIT

SEQ ID NO: 118474 - protein, 33 aa, Artificial Sequence
  Description of Artificial Sequence: Synthetic polypeptide
DEDEIATTNPVAYEQYGSVSANSQDNQGPNEDT

SEQ ID NO: 118475 - protein, 34 aa, Artificial Sequence
  Description of Artificial Sequence: Synthetic polypeptide
DEEEIRTTNPVATEQYGCVCSTEDDQEGFGSDQS

SEQ ID NO: 118476 - protein, 33 aa, Artificial Sequence
  Description of Artificial Sequence: Synthetic polypeptide
DEEEIRTTNPVATEQYGCVCSTEDDENFNSEQA

SEQ ID NO: 118477 - protein, 34 aa, Artificial Sequence
  Description of Artificial Sequence: Synthetic polypeptide
DEEEIRTTNPVATEPYGTVSSTTEAGPNMRNGNV

SEQ ID NO: 118478 - protein, 33 aa, Artificial Sequence
  Description of Artificial Sequence: Synthetic polypeptide
DEAEIRTTNPVAYEQWGSVCSTDNDQGDVNGMQ

SEQ ID NO: 118479 - protein, 33 aa, Artificial Sequence
  Description of Artificial Sequence: Synthetic polypeptide
DEAEIRTTNPVAYEQWGSVCSTDNVQGDVQNMN

SEQ ID NO: 118480 - protein, 33 aa, Artificial Sequence
  Description of Artificial Sequence: Synthetic polypeptide
DEEEIRTTNPVATEAYGSVYSVSDCIQKCLDKR

SEQ ID NO: 118481 - protein, 34 aa, Artificial Sequence
  Description of Artificial Sequence: Synthetic polypeptide
DEEEIRTTNPVATEQYGCVCSTDDHQENFGSDQS

SEQ ID NO: 118482 - protein, 33 aa, Artificial Sequence
  Description of Artificial Sequence: Synthetic polypeptide
DEAEIRTTNPVAYEQWGSVCSTDNTDQGDMNMN

SEQ ID NO: 118483 - protein, 34 aa, Artificial Sequence
  Description of Artificial Sequence: Synthetic polypeptide
DEAEIRTTNPVAYEQWGSVCSTDNQHQQHGGNTT

SEQ ID NO: 118484 - protein, 36 aa, Artificial Sequence
  Description of Artificial Sequence: Synthetic polypeptide
DEEEIRTTNPVATEAYGVVSTTTNLQQGNAATEQGQ

SEQ ID NO: 118485 - protein, 33 aa, Artificial Sequence
  Description of Artificial Sequence: Synthetic polypeptide
DEAEIRTTNPVAYEQWGSVCSTDNNDQGDVNMN

SEQ ID NO: 118486 - protein, 34 aa, Artificial Sequence
  Description of Artificial Sequence: Synthetic polypeptide
DEEEIRTTNPVATEQYGCIVCSNTEHQYFGSEQS

SEQ ID NO: 118487 - protein, 32 aa, Artificial Sequence
  Description of Artificial Sequence: Synthetic polypeptide
DEDEIATTNPVAYEQYGSVSANSDDTGPNEDT

SEQ ID NO: 118488 - protein, 37 aa, Artificial Sequence
  Description of Artificial Sequence: Synthetic polypeptide
DEEEIRTTNPVATEQYGSVSTVNNNQQGNNDEEDETE

SEQ ID NO: 118489 - protein, 33 aa, Artificial Sequence
  Description of Artificial Sequence: Synthetic polypeptide
DEEEIRTTNPVATEQYGCVCSSGEHQNFGSETQ

SEQ ID NO: 118490 - protein, 31 aa, Artificial Sequence
  Description of Artificial Sequence: Synthetic polypeptide
DEDEIATTNPVAYEQYGSVSAAGDEQDNNTE

SEQ ID NO: 118491 - protein, 32 aa, Artificial Sequence
  Description of Artificial Sequence: Synthetic polypeptide
DEAEIRTTNPVAYEQWGSVCSTDNDQGDQQMN

SEQ ID NO: 118492 - protein, 32 aa, Artificial Sequence
  Description of Artificial Sequence: Synthetic polypeptide
DEAEIRTTNPVAYEQWGSVCSGDNTQGDVNMN

SEQ ID NO: 118493 - protein, 34 aa, Artificial Sequence
  Description of Artificial Sequence: Synthetic polypeptide
DEAEIRTTNPVAYEQWGSVCSGDHNLQDQGDQNP

SEQ ID NO: 118494 - protein, 30 aa, Artificial Sequence
  Description of Artificial Sequence: Synthetic polypeptide
DECEIATTNPVAYEQYGVCSTIDQGPNGDN

SEQ ID NO: 118495 - protein, 31 aa, Artificial Sequence
  Description of Artificial Sequence: Synthetic polypeptide
DEDEIATTNPVAYEQYGSVCATNEQDATVTD

SEQ ID NO: 118496 - protein, 31 aa, Artificial Sequence
  Description of Artificial Sequence: Synthetic polypeptide
DECEIATTNPVAYEQYGVCSTIDQNTGPNDN

SEQ ID NO: 118497 - protein, 34 aa, Artificial Sequence
  Description of Artificial Sequence: Synthetic polypeptide
DEEEIRTTNPVATEQYGCVCSSGNTQEFFGSEQS

SEQ ID NO: 118498 - protein, 34 aa, Artificial Sequence
  Description of Artificial Sequence: Synthetic polypeptide
DEEEIRTTNPVATEQYGCVCSSGNHQEHFNSNQL

SEQ ID NO: 118499 - protein, 34 aa, Artificial Sequence
  Description of Artificial Sequence: Synthetic polypeptide
DEEEIRTTNPVATEQYGCVCSSGNHQEGFGSDQS

SEQ ID NO: 118500 - protein, 38 aa, Artificial Sequence
  Description of Artificial Sequence: Synthetic polypeptide
DEEEIRTTNPVATEQYGSVSTVNNNNLQEGTEQGTNVE

SEQ ID NO: 118501 - protein, 35 aa, Artificial Sequence
  Description of Artificial Sequence: Synthetic polypeptide
DEEEIRTTNPVATEQYGCVCSSGNDHQNFGSDNQL

SEQ ID NO: 118502 - protein, 33 aa, Artificial Sequence
  Description of Artificial Sequence: Synthetic polypeptide
DEEEIRTTNPVATEQYGCVCSSGETQNFGSEQG

SEQ ID NO: 118503 - protein, 33 aa, Artificial Sequence
  Description of Artificial Sequence: Synthetic polypeptide
DEEEIRTTNPVATEQYGCVCSSGETQHFNSNQL

SEQ ID NO: 118504 - protein, 38 aa, Artificial Sequence
  Description of Artificial Sequence: Synthetic polypeptide
DEEEIRTTNPVATEQYGSVSTVNNNLQEGQEQGTNNEA

SEQ ID NO: 118505 - protein, 34 aa, Artificial Sequence
  Description of Artificial Sequence: Synthetic polypeptide
DEEEIRTTNPVATEQYGCVCSSGELNQNFGSEQA

SEQ ID NO: 118506 - protein, 34 aa, Artificial Sequence
  Description of Artificial Sequence: Synthetic polypeptide
DEEEIRTTNPVATEQYGCVCSSGELNQNFGSDQS

SEQ ID NO: 118507 - protein, 38 aa, Artificial Sequence
  Description of Artificial Sequence: Synthetic polypeptide
DEEEIRTTNPVATEQYGSVSTVNNLQQGNNQQSTTEES

SEQ ID NO: 118508 - protein, 38 aa, Artificial Sequence
  Description of Artificial Sequence: Synthetic polypeptide
DEEEIRTTNPVATEQYGSVSTVNNLQQGNNQQGTDEED

SEQ ID NO: 118509 - protein, 34 aa, Artificial Sequence
  Description of Artificial Sequence: Synthetic polypeptide
DEAEIRTTNPVAYEQWGSVCSNDNDNGERQGNER

SEQ ID NO: 118510 - protein, 34 aa, Artificial Sequence
  Description of Artificial Sequence: Synthetic polypeptide
DEEEIRTTNPVAYEQYGQCVCSWEEDLNQRGSQA

SEQ ID NO: 118511 - protein, 33 aa, Artificial Sequence
  Description of Artificial Sequence: Synthetic polypeptide
DEAEIRTTNPVAYEQWGSVCSNNDGMQNMGNTD

SEQ ID NO: 118512 - protein, 28 aa, Artificial Sequence
  Description of Artificial Sequence: Synthetic peptide
DDSEVATTNPVSTEGYGNVANTIQRGQR

SEQ ID NO: 118513 - protein, 32 aa, Artificial Sequence
  Description of Artificial Sequence: Synthetic polypeptide
DEDEIATTNPVAYEQYGSVCTNLAEPGIDQDM

SEQ ID NO: 118514 - protein, 33 aa, Artificial Sequence
  Description of Artificial Sequence: Synthetic polypeptide
DECEIVTTNPVATEQYGTVCSATDGQVEFEGND

SEQ ID NO: 118515 - protein, 34 aa, Artificial Sequence
  Description of Artificial Sequence: Synthetic polypeptide
DEAEIRTTNPVAYEQWGSVCSTDNDNQNNGDNNM

SEQ ID NO: 118516 - protein, 34 aa, Artificial Sequence
  Description of Artificial Sequence: Synthetic polypeptide
DEAEIRTTNPVAYEQWGSVCSTDNDKEQNGQNNM

SEQ ID NO: 118517 - protein, 38 aa, Artificial Sequence
  Description of Artificial Sequence: Synthetic polypeptide
DEEEIRTTNPVATEQYGSVSTNLQQIGNNNNQQGEEQQ

SEQ ID NO: 118518 - protein, 35 aa, Artificial Sequence
  Description of Artificial Sequence: Synthetic polypeptide
DEAEIRTTNPVAYEQWGSVCSTDNDDQPRDGEGMR

SEQ ID NO: 118519 - protein, 34 aa, Artificial Sequence
  Description of Artificial Sequence: Synthetic polypeptide
DEEEIRTTNPVATEFYGSVNSGFEIQEDGQGGNE

SEQ ID NO: 118520 - protein, 32 aa, Artificial Sequence
  Description of Artificial Sequence: Synthetic polypeptide
DEAEISTTNPVAYEQWGTVSTNLQGDAGGDDA

SEQ ID NO: 118521 - protein, 35 aa, Artificial Sequence
  Description of Artificial Sequence: Synthetic polypeptide
DEEEIRTTNPVATEQYGSVSTSNMNWEESGEEEVE

SEQ ID NO: 118522 - protein, 33 aa, Artificial Sequence
  Description of Artificial Sequence: Synthetic polypeptide
DEEEIRTTNPVATEFYGSVNDQNEMGQGNTNIT

SEQ ID NO: 118523 - protein, 30 aa, Artificial Sequence
  Description of Artificial Sequence: Synthetic polypeptide
DECEIATTNPVAYEQYGVCSIIDQRDQNDN

SEQ ID NO: 118524 - protein, 34 aa, Artificial Sequence
  Description of Artificial Sequence: Synthetic polypeptide
DEEEIRTTNPVATEFYGSVMSGMFNNIQGENVGI

SEQ ID NO: 118525 - protein, 34 aa, Artificial Sequence
  Description of Artificial Sequence: Synthetic polypeptide
DEEEIRTTNPVATEFYGSVMSGMFNNDQEEVGDG

SEQ ID NO: 118526 - protein, 33 aa, Artificial Sequence
  Description of Artificial Sequence: Synthetic polypeptide
DEAEIRTTNPVAYEQWGSVCSNNDGQNHGNTDM

SEQ ID NO: 118527 - protein, 33 aa, Artificial Sequence
  Description of Artificial Sequence: Synthetic polypeptide
DECEIVTTNPVATECWGSVSCINEPQDREGENG

SEQ ID NO: 118528 - protein, 33 aa, Artificial Sequence
  Description of Artificial Sequence: Synthetic polypeptide
DEEEIRTTNPVATEQYGCVCSSNHQENFFSEQS

SEQ ID NO: 118529 - protein, 30 aa, Artificial Sequence
  Description of Artificial Sequence: Synthetic polypeptide
DECEIATTNPVAYEQYGVCSITIDQHPNDN

SEQ ID NO: 118530 - protein, 30 aa, Artificial Sequence
  Description of Artificial Sequence: Synthetic polypeptide
DECEIATTNPVAYEQYGVCSTIDNRPNDDN

SEQ ID NO: 118531 - protein, 37 aa, Artificial Sequence
  Description of Artificial Sequence: Synthetic polypeptide
DEEEIRTTNPVATEQYGSVSTELANIMEQRSLAEGGE

SEQ ID NO: 118532 - protein, 31 aa, Artificial Sequence
  Description of Artificial Sequence: Synthetic polypeptide
DEDEIATTNPVAYEQYGSVAMHEPQQGGNTE

SEQ ID NO: 118533 - protein, 34 aa, Artificial Sequence
  Description of Artificial Sequence: Synthetic polypeptide
DECEICTTNPMATEQWGSVAPTDNQQEREGQNGR

SEQ ID NO: 118534 - protein, 33 aa, Artificial Sequence
  Description of Artificial Sequence: Synthetic polypeptide
DEDEIATTNPVAYEQYGSVAITNLEPNRNQERH

SEQ ID NO: 118535 - protein, 36 aa, Artificial Sequence
  Description of Artificial Sequence: Synthetic polypeptide
DECEICTTNPVATEQYGSVSTTNLLNQNNNGNEEEE

SEQ ID NO: 118536 - protein, 35 aa, Artificial Sequence
  Description of Artificial Sequence: Synthetic polypeptide
DECEICTTNPVATEQYGSVSTTNLLNQNNNNETEE

SEQ ID NO: 118537 - protein, 35 aa, Artificial Sequence
  Description of Artificial Sequence: Synthetic polypeptide
DEAEIRTTNPVATEQYGSVSVTATLETGNGDNIDH

SEQ ID NO: 118538 - protein, 34 aa, Artificial Sequence
  Description of Artificial Sequence: Synthetic polypeptide
DEEEIRTTNPVATEQYGCVCSNSEPQFFGSDNQS

SEQ ID NO: 118539 - protein, 35 aa, Artificial Sequence
  Description of Artificial Sequence: Synthetic polypeptide
DECEICTTNPVATEQYGSVSTTNLLQQQNGTEEEE

SEQ ID NO: 118540 - protein, 34 aa, Artificial Sequence
  Description of Artificial Sequence: Synthetic polypeptide
DEDEIATTNPVAYEQYGSCSTNLPQDSMGDNDEH

SEQ ID NO: 118541 - protein, 36 aa, Artificial Sequence
  Description of Artificial Sequence: Synthetic polypeptide
DECEICTTNPVATEQYGSVSTTNLQAGNQQGNNQGD

SEQ ID NO: 118542 - protein, 36 aa, Artificial Sequence
  Description of Artificial Sequence: Synthetic polypeptide
DECEICTTNPVATEQYGSVSTTNLQQGNQQGNDEED

SEQ ID NO: 118543 - protein, 35 aa, Artificial Sequence
  Description of Artificial Sequence: Synthetic polypeptide
DEEEIRTTNPVATEQWGCFNVSNTNVDTQNGANWI

SEQ ID NO: 118544 - protein, 32 aa, Artificial Sequence
  Description of Artificial Sequence: Synthetic polypeptide
DEAEIRTTNPVAYEQWGEVCSTDNGGIGGNEM

SEQ ID NO: 118545 - protein, 33 aa, Artificial Sequence
  Description of Artificial Sequence: Synthetic polypeptide
DECEIRTTNPVATEQYGCVSTPYWELDTGDEKV

SEQ ID NO: 118546 - protein, 38 aa, Artificial Sequence
  Description of Artificial Sequence: Synthetic polypeptide
DEEEIRTTNPVATEQYGSVSTVNGNLQEGTEQGTNSEN

SEQ ID NO: 118547 - protein, 38 aa, Artificial Sequence
  Description of Artificial Sequence: Synthetic polypeptide
DEEEIRTTNPVATEQYGSVSTVNGNLQEGTEQGNNVEG

SEQ ID NO: 118548 - protein, 38 aa, Artificial Sequence
  Description of Artificial Sequence: Synthetic polypeptide
DEEEIRTTNPVATEQYGSVSTVNGNLQEGTEQGATNVE

SEQ ID NO: 118549 - protein, 38 aa, Artificial Sequence
  Description of Artificial Sequence: Synthetic polypeptide
DEEEIRTTNPVATEQYGSVSTVNGNLQEGTEAGTNVEI

SEQ ID NO: 118550 - protein, 38 aa, Artificial Sequence
  Description of Artificial Sequence: Synthetic polypeptide
DEEEIRTTNPVATEQYGSVSTVNGNLQEGNEQGTNNEV

SEQ ID NO: 118551 - protein, 35 aa, Artificial Sequence
  Description of Artificial Sequence: Synthetic polypeptide
DEEEIRTTNPVATEQYGAVVGNSGDLEQGEGQENL

SEQ ID NO: 118552 - protein, 38 aa, Artificial Sequence
  Description of Artificial Sequence: Synthetic polypeptide
DEEEIRTTNPVATEQYGSVSTVNLEQGNTEQGTNMTED

SEQ ID NO: 118553 - protein, 34 aa, Artificial Sequence
  Description of Artificial Sequence: Synthetic polypeptide
DECEICTTNPVATEQYGSVSTTNALQNDTEEEDD

SEQ ID NO: 118554 - protein, 36 aa, Artificial Sequence
  Description of Artificial Sequence: Synthetic polypeptide
DEEEIRTTNPVATEQYGSVSTTGPAGPNMRNGMNPV

SEQ ID NO: 118555 - protein, 34 aa, Artificial Sequence
  Description of Artificial Sequence: Synthetic polypeptide
DECEICTTNPVATEQYGSVSTTNALNEDTEGEQD

SEQ ID NO: 118556 - protein, 34 aa, Artificial Sequence
  Description of Artificial Sequence: Synthetic polypeptide
DEAEIRTTNPVATEQYGSVSVTALLETMNGDEIQ

SEQ ID NO: 118557 - protein, 33 aa, Artificial Sequence
  Description of Artificial Sequence: Synthetic polypeptide
DEAEIRTTNPVAYEQWGEVCSTNLNGDHGNNEQ

SEQ ID NO: 118558 - protein, 33 aa, Artificial Sequence
  Description of Artificial Sequence: Synthetic polypeptide
DEEEIRTTNPVATEQYGCVCSSEDQEGFGSDQS

SEQ ID NO: 118559 - protein, 33 aa, Artificial Sequence
  Description of Artificial Sequence: Synthetic polypeptide
DEEEIRTTNPVATEQYGCVCSSEDQEFFNSDQA

SEQ ID NO: 118560 - protein, 34 aa, Artificial Sequence
  Description of Artificial Sequence: Synthetic polypeptide
DEEEIRTTNPVATEQYGCVCSSEDLQSFGSETQS

SEQ ID NO: 118561 - protein, 34 aa, Artificial Sequence
  Description of Artificial Sequence: Synthetic polypeptide
DEEEIRTTNPVATEQYGCVCSNSEHQNFGSNFQP

SEQ ID NO: 118562 - protein, 33 aa, Artificial Sequence
  Description of Artificial Sequence: Synthetic polypeptide
DEEEIRTTNPVATEQYGCVCSSEDHQNFGSEQS

SEQ ID NO: 118563 - protein, 33 aa, Artificial Sequence
  Description of Artificial Sequence: Synthetic polypeptide
DEAEIRTTNPVAYEQWGEVCSTDNGQQDGGNEI

SEQ ID NO: 118564 - protein, 38 aa, Artificial Sequence
  Description of Artificial Sequence: Synthetic polypeptide
DEEEIRTTNPVATEQYGSVSTVNGNLQAGTEQGTNVEE

SEQ ID NO: 118565 - protein, 34 aa, Artificial Sequence
  Description of Artificial Sequence: Synthetic polypeptide
DEEEIRTTNPVATEQYGCVCSSEDHQFFGSNTQY

SEQ ID NO: 118566 - protein, 34 aa, Artificial Sequence
  Description of Artificial Sequence: Synthetic polypeptide
DECEICTTNPVATEQYGSVSTTLQGNEDTEEEDD

SEQ ID NO: 118567 - protein, 34 aa, Artificial Sequence
  Description of Artificial Sequence: Synthetic polypeptide
DEEEIRTTNPVATEQYGCVCSNWNHQNFGSDTQE

SEQ ID NO: 118568 - protein, 32 aa, Artificial Sequence
  Description of Artificial Sequence: Synthetic polypeptide
DEAEIRTTNPVAYEQWGEVCSTDNGQDGGQEM

SEQ ID NO: 118569 - protein, 35 aa, Artificial Sequence
  Description of Artificial Sequence: Synthetic polypeptide
DEAEIRTTNPVATEQYGSVSVTANNTQDGQEEVES

SEQ ID NO: 118570 - protein, 30 aa, Artificial Sequence
  Description of Artificial Sequence: Synthetic polypeptide
DEDEIATTNPVATASWGCVATNLERDDNPM

SEQ ID NO: 118571 - protein, 34 aa, Artificial Sequence
  Description of Artificial Sequence: Synthetic polypeptide
DEEEIRTTNPVATEQYGCVCSNWNHQENFGSDQP

SEQ ID NO: 118572 - protein, 32 aa, Artificial Sequence
  Description of Artificial Sequence: Synthetic polypeptide
DEDEIATTNPVAYEQYGSTTATNLQDDSNGSD

SEQ ID NO: 118573 - protein, 34 aa, Artificial Sequence
  Description of Artificial Sequence: Synthetic polypeptide
DEAEIRTTNPVATEQYGSVSVTAPLHTGEGDDIQ

SEQ ID NO: 118574 - protein, 33 aa, Artificial Sequence
  Description of Artificial Sequence: Synthetic polypeptide
DEAEIRTTNPVAYEQWGEVCSTDNGQDGQGNNE

SEQ ID NO: 118575 - protein, 33 aa, Artificial Sequence
  Description of Artificial Sequence: Synthetic polypeptide
DEEEIRTTNPVATEQYGCVCSNSEHQHFGSQQG

SEQ ID NO: 118576 - protein, 35 aa, Artificial Sequence
  Description of Artificial Sequence: Synthetic polypeptide
DEEEIRTTNPVATEQYGAVVGNSGDLEQGEEQGNI

SEQ ID NO: 118577 - protein, 37 aa, Artificial Sequence
  Description of Artificial Sequence: Synthetic polypeptide
DEEEIRTTNPVATEQWGCVVQSYTGLDQARNVGNNRI

SEQ ID NO: 118578 - protein, 31 aa, Artificial Sequence
  Description of Artificial Sequence: Synthetic polypeptide
DEEEIRTTNPVATEQWGDVSEIEMNANENPV

SEQ ID NO: 118579 - protein, 33 aa, Artificial Sequence
  Description of Artificial Sequence: Synthetic polypeptide
DECEIKTTNPVATEQYGTVSSVTDGQAEEEGND

SEQ ID NO: 118580 - protein, 33 aa, Artificial Sequence
  Description of Artificial Sequence: Synthetic polypeptide
DEDEIATTNPVAYEQYGQSVSAWDLLQRAEMGR

SEQ ID NO: 118581 - protein, 31 aa, Artificial Sequence
  Description of Artificial Sequence: Synthetic polypeptide
DEEEIRTTNPVATEQWGDVSEPAEMNAAGDA

SEQ ID NO: 118582 - protein, 31 aa, Artificial Sequence
  Description of Artificial Sequence: Synthetic polypeptide
DEEEIRTTNPVATEQWGDVSEPAEMNAAGDV

SEQ ID NO: 118583 - protein, 36 aa, Artificial Sequence
  Description of Artificial Sequence: Synthetic polypeptide
DECEICTTNPVATEQYGSVSTTNNQLNENQQGTNTD

SEQ ID NO: 118584 - protein, 32 aa, Artificial Sequence
  Description of Artificial Sequence: Synthetic polypeptide
DEEEIRTTNPVATEQWGDVSSEIEMNAAGNPA

SEQ ID NO: 118585 - protein, 33 aa, Artificial Sequence
  Description of Artificial Sequence: Synthetic polypeptide
DEEEIRTTNPVATEQWGDVSSTEIEMNAAGNPA

SEQ ID NO: 118586 - protein, 34 aa, Artificial Sequence
  Description of Artificial Sequence: Synthetic polypeptide
DEDEIATTNPVAYEQYGQSVPAANDLLQRAGMGR

SEQ ID NO: 118587 - protein, 33 aa, Artificial Sequence
  Description of Artificial Sequence: Synthetic polypeptide
DEEEIRTTNPVATEQYGAVVGDTNDGTEQGQGG

SEQ ID NO: 118588 - protein, 34 aa, Artificial Sequence
  Description of Artificial Sequence: Synthetic polypeptide
DEDEIATTNPVATEAYGISTVQSCSDALQRPGNK

SEQ ID NO: 118589 - protein, 35 aa, Artificial Sequence
  Description of Artificial Sequence: Synthetic polypeptide
DEDEIATTNPVATEAYGISTVQSCTDALQRDGNYT

SEQ ID NO: 118590 - protein, 34 aa, Artificial Sequence
  Description of Artificial Sequence: Synthetic polypeptide
DEDEIATTNPVAYEQYGQSVAANWDLLQRAGMGR

SEQ ID NO: 118591 - protein, 34 aa, Artificial Sequence
  Description of Artificial Sequence: Synthetic polypeptide
DEDEIATTNPVATEAYGISTVQSCTIALARDGNK

SEQ ID NO: 118592 - protein, 34 aa, Artificial Sequence
  Description of Artificial Sequence: Synthetic polypeptide
DEEEIRTTNPVATEQYGAVVGDTNDGTEQGGEGI

SEQ ID NO: 118593 - protein, 34 aa, Artificial Sequence
  Description of Artificial Sequence: Synthetic polypeptide
DEDEIATTNPVATEAYGISTVQSCTTALQHAGNK

SEQ ID NO: 118594 - protein, 35 aa, Artificial Sequence
  Description of Artificial Sequence: Synthetic polypeptide
DEDEIATTNPVATEAYGISTVQSCTVALQREDGNK

SEQ ID NO: 118595 - protein, 31 aa, Artificial Sequence
  Description of Artificial Sequence: Synthetic polypeptide
DEEEIRTTNPVATEQWGDVSEIEMNANEDPV

SEQ ID NO: 118596 - protein, 38 aa, Artificial Sequence
  Description of Artificial Sequence: Synthetic polypeptide
DEEEIRTTNPVATEQYGSVSTVNANNLQQGENDEEDET

SEQ ID NO: 118597 - protein, 33 aa, Artificial Sequence
  Description of Artificial Sequence: Synthetic polypeptide
DECEIRTCNPVATEGYGSVSETARLVRGSEQEE

SEQ ID NO: 118598 - protein, 32 aa, Artificial Sequence
  Description of Artificial Sequence: Synthetic polypeptide
DEDEIATTNPVATDQYGVVSTDEGQGGQGNDT

SEQ ID NO: 118599 - protein, 36 aa, Artificial Sequence
  Description of Artificial Sequence: Synthetic polypeptide
DECEICTTNPVATEQYGSVSTTNNLNQNNQGNETEE

SEQ ID NO: 118600 - protein, 30 aa, Artificial Sequence
  Description of Artificial Sequence: Synthetic polypeptide
DEEEIRTTNPVATEQWGDVSDIEMNAAEDQ

SEQ ID NO: 118601 - protein, 33 aa, Artificial Sequence
  Description of Artificial Sequence: Synthetic polypeptide
DEDEIATTNPVAYEQYGSCAAAGNLQRTGDQRQ

SEQ ID NO: 118602 - protein, 36 aa, Artificial Sequence
  Description of Artificial Sequence: Synthetic polypeptide
DEEEIRTTNPVATEQYGSVSTVNGFGQENEQGEIEE

SEQ ID NO: 118603 - protein, 33 aa, Artificial Sequence
  Description of Artificial Sequence: Synthetic polypeptide
DEAEIRTTNPVATEQYGSVSVTFESETRVEDEY

SEQ ID NO: 118604 - protein, 35 aa, Artificial Sequence
  Description of Artificial Sequence: Synthetic polypeptide
DEEEIRTTNPVATEQYGSVSTGDGEGFGQEENEEM

SEQ ID NO: 118605 - protein, 34 aa, Artificial Sequence
  Description of Artificial Sequence: Synthetic polypeptide
DEEEIRTTNPVATEQYGCVCSNWGPLQNFNSNQS

SEQ ID NO: 118606 - protein, 33 aa, Artificial Sequence
  Description of Artificial Sequence: Synthetic polypeptide
DECEIRTTNPVATEQFGTVVSTLYLLEGQNDSL

SEQ ID NO: 118607 - protein, 34 aa, Artificial Sequence
  Description of Artificial Sequence: Synthetic polypeptide
DEEEIRTTNPVATEEYGCVCSTEHNQNFGSENQT

SEQ ID NO: 118608 - protein, 34 aa, Artificial Sequence
  Description of Artificial Sequence: Synthetic polypeptide
DECEIRTTNPVATECWGSVSCINEPQDREGENGG

SEQ ID NO: 118609 - protein, 33 aa, Artificial Sequence
  Description of Artificial Sequence: Synthetic polypeptide
DECEIRTTNPVATECWGSVSCIEEPQSREGENE

SEQ ID NO: 118610 - protein, 30 aa, Artificial Sequence
  Description of Artificial Sequence: Synthetic polypeptide
DEEEIRTTNPVATEQWGDVSEIEMIAAEDA

SEQ ID NO: 118611 - protein, 33 aa, Artificial Sequence
  Description of Artificial Sequence: Synthetic polypeptide
DECEIRTTNPVATECWGSKSCINEPQDREGENG

SEQ ID NO: 118612 - protein, 35 aa, Artificial Sequence
  Description of Artificial Sequence: Synthetic polypeptide
DEEEIRTTNPVAYEQYGQCVCSWGNDLDQRFGSQQ

SEQ ID NO: 118613 - protein, 30 aa, Artificial Sequence
  Description of Artificial Sequence: Synthetic polypeptide
DEEEIRTTNPVATEQWGDVSEIEMNAAEDA

SEQ ID NO: 118614 - protein, 31 aa, Artificial Sequence
  Description of Artificial Sequence: Synthetic polypeptide
DEEEIRTTNPVATEQWGDVSEIEMNAAEKDA

SEQ ID NO: 118615 - protein, 35 aa, Artificial Sequence
  Description of Artificial Sequence: Synthetic polypeptide
DEEEIRTTNPVATEQYGCVCSNWGNLQNFNSDNQS

SEQ ID NO: 118616 - protein, 35 aa, Artificial Sequence
  Description of Artificial Sequence: Synthetic polypeptide
DEEEIRTTNPVATEQYGSVSTTILGVAVDPEQSRE

SEQ ID NO: 118617 - protein, 30 aa, Artificial Sequence
  Description of Artificial Sequence: Synthetic polypeptide
DEEEIRTTNPVATEQWGDVSEAEMNAAEDA

SEQ ID NO: 118618 - protein, 30 aa, Artificial Sequence
  Description of Artificial Sequence: Synthetic polypeptide
DEDEIATTNPVATASWGCVATGALQMVGNQ

SEQ ID NO: 118619 - protein, 34 aa, Artificial Sequence
  Description of Artificial Sequence: Synthetic polypeptide
DEEEIRTTNPVATEQYGCVCSNSEHQERFGSEQF

SEQ ID NO: 118620 - protein, 30 aa, Artificial Sequence
  Description of Artificial Sequence: Synthetic polypeptide
DEDEIATTNPVATASWGCVATANLDRSNDS

SEQ ID NO: 118621 - protein, 32 aa, Artificial Sequence
  Description of Artificial Sequence: Synthetic polypeptide
DEAAIGTTNPVAAEQYGSVSTPNVHGTNGNHA

SEQ ID NO: 118622 - protein, 33 aa, Artificial Sequence
  Description of Artificial Sequence: Synthetic polypeptide
DEEEIRTTNPVATEFYGNVVDTMNGEGQGTNDD

SEQ ID NO: 118623 - protein, 32 aa, Artificial Sequence
  Description of Artificial Sequence: Synthetic polypeptide
DEEEIRTTNPVATEFYGNVVDGNENGQGNNGD

SEQ ID NO: 118624 - protein, 32 aa, Artificial Sequence
  Description of Artificial Sequence: Synthetic polypeptide
DEDEIATTNPVAYEQYGSVAGANGGTDSGNDR

SEQ ID NO: 118625 - protein, 34 aa, Artificial Sequence
  Description of Artificial Sequence: Synthetic polypeptide
DEEEIRTTNPVATEQYGCVCSSEHNQEGFGSNQS

SEQ ID NO: 118626 - protein, 33 aa, Artificial Sequence
  Description of Artificial Sequence: Synthetic polypeptide
DEDEIATTNPVAYEQYGSVAATNGEATRNGERQ

SEQ ID NO: 118627 - protein, 33 aa, Artificial Sequence
  Description of Artificial Sequence: Synthetic polypeptide
DEEEIRTTNPVATEQYGCVCSSEETQHFGSDQD

SEQ ID NO: 118628 - protein, 33 aa, Artificial Sequence
  Description of Artificial Sequence: Synthetic polypeptide
DEEEIRTTNPVATEQYGCVCSSEEPQFFNSNQA

SEQ ID NO: 118629 - protein, 34 aa, Artificial Sequence
  Description of Artificial Sequence: Synthetic polypeptide
DEAEIRTTNPVATEQYGSVSVLDTNEDEMQNNQI

SEQ ID NO: 118630 - protein, 34 aa, Artificial Sequence
  Description of Artificial Sequence: Synthetic polypeptide
DEEEIRTTNPVATEQYGCVCSSEEPQFFGSDNQA

SEQ ID NO: 118631 - protein, 32 aa, Artificial Sequence
  Description of Artificial Sequence: Synthetic polypeptide
DECEICTTNPVATEQYGSVSTTALEDTEDEDS

SEQ ID NO: 118632 - protein, 33 aa, Artificial Sequence
  Description of Artificial Sequence: Synthetic polypeptide
DEEEIRTTNPVATEFYGMVSNENFTDDGGNNDD

SEQ ID NO: 118633 - protein, 34 aa, Artificial Sequence
  Description of Artificial Sequence: Synthetic polypeptide
DEAEIRTTNPVAYEQWGEVVSTNNILGEDGGNER

SEQ ID NO: 118634 - protein, 33 aa, Artificial Sequence
  Description of Artificial Sequence: Synthetic polypeptide
DEAEIRTTNPVATEQYGSVSVPANVDLSGQEFD

SEQ ID NO: 118635 - protein, 33 aa, Artificial Sequence
  Description of Artificial Sequence: Synthetic polypeptide
DEEEIRTTNPVATEFYGMVSIMTVGQFTNGGQN

SEQ ID NO: 118636 - protein, 34 aa, Artificial Sequence
  Description of Artificial Sequence: Synthetic polypeptide
DEEEIRTTNPVATEQYGCVCSSEELQYFGSETQS

SEQ ID NO: 118637 - protein, 33 aa, Artificial Sequence
  Description of Artificial Sequence: Synthetic polypeptide
DEAEIRTTNPVATEQYGSVSVPAVLDLSGEVFD

SEQ ID NO: 118638 - protein, 34 aa, Artificial Sequence
  Description of Artificial Sequence: Synthetic polypeptide
DEEEIRTTNPVATEQYGCVCSSEHNQNFGSDNQS

SEQ ID NO: 118639 - protein, 36 aa, Artificial Sequence
  Description of Artificial Sequence: Synthetic polypeptide
DEEEIRTTNPVATEQYGSVSTTDQAGSNNTNGTNPV

SEQ ID NO: 118640 - protein, 32 aa, Artificial Sequence
  Description of Artificial Sequence: Synthetic polypeptide
DECEICTTNPVATEQYGSVSTTAGEDTEGEDT

SEQ ID NO: 118641 - protein, 33 aa, Artificial Sequence
  Description of Artificial Sequence: Synthetic polypeptide
DEEEIRTTNPVATEQYGCVCSSEHNQNFGSEQS

SEQ ID NO: 118642 - protein, 34 aa, Artificial Sequence
  Description of Artificial Sequence: Synthetic polypeptide
DEEEIRTTNPVATEFYGSVDSTMGFGGDEGNIQT

SEQ ID NO: 118643 - protein, 34 aa, Artificial Sequence
  Description of Artificial Sequence: Synthetic polypeptide
DEEEIRTTNPVATEFYGSVDSNNDEMTNEGNQGG

SEQ ID NO: 118644 - protein, 33 aa, Artificial Sequence
  Description of Artificial Sequence: Synthetic polypeptide
DECEICTTNPMATEQWGSVAPTDNQQHAGGNGR

SEQ ID NO: 118645 - protein, 33 aa, Artificial Sequence
  Description of Artificial Sequence: Synthetic polypeptide
DEEEIRTTNPVATEQFGTCVCSTYLTHFGSDQA

SEQ ID NO: 118646 - protein, 34 aa, Artificial Sequence
  Description of Artificial Sequence: Synthetic polypeptide
DEEEIRTTNPVATEQYGCVCSSELDQENFNSEQP

SEQ ID NO: 118647 - protein, 34 aa, Artificial Sequence
  Description of Artificial Sequence: Synthetic polypeptide
DECEICTTNPTATEQWGSVAPTDNKQQEREGNGR

SEQ ID NO: 118648 - protein, 33 aa, Artificial Sequence
  Description of Artificial Sequence: Synthetic polypeptide
DEEEIRTTNPVATEQYGCVCSSEHTEGFGSNQA

SEQ ID NO: 118649 - protein, 33 aa, Artificial Sequence
  Description of Artificial Sequence: Synthetic polypeptide
DEEEIRTTNPVATEQYGCVCSSEHQYFNSDTQS

SEQ ID NO: 118650 - protein, 36 aa, Artificial Sequence
  Description of Artificial Sequence: Synthetic polypeptide
DEEEIRTTNPVATEQYGSVSTEYDTEQAVTGNSPVN

SEQ ID NO: 118651 - protein, 37 aa, Artificial Sequence
  Description of Artificial Sequence: Synthetic polypeptide
DEEEIRTTNPVATEQYGSVSTTDNGLGLEINGANEQG

SEQ ID NO: 118652 - protein, 33 aa, Artificial Sequence
  Description of Artificial Sequence: Synthetic polypeptide
DECEIRTTNPVAYEQWGTVCSTWENDQNGAGNH

SEQ ID NO: 118653 - protein, 34 aa, Artificial Sequence
  Description of Artificial Sequence: Synthetic polypeptide
DEEEIRTTNPVATEQYGCVCSSEHQEHFGSDNQG

SEQ ID NO: 118654 - protein, 37 aa, Artificial Sequence
  Description of Artificial Sequence: Synthetic polypeptide
DEEEIRTTNPVATEQYGSVSTTDNGLGLEINGGNEDF

SEQ ID NO: 118655 - protein, 34 aa, Artificial Sequence
  Description of Artificial Sequence: Synthetic polypeptide
DEDEIATTNPVAYEQYGSVAGTNLQATPDGQARN

SEQ ID NO: 118656 - protein, 32 aa, Artificial Sequence
  Description of Artificial Sequence: Synthetic polypeptide
DEDEIATTNPVAYEQYGSVAGTGLADTPGERH

SEQ ID NO: 118657 - protein, 33 aa, Artificial Sequence
  Description of Artificial Sequence: Synthetic polypeptide
DEEEIRTTNPVATEQYGCVCSSEHNQSFNSNQG

SEQ ID NO: 118658 - protein, 36 aa, Artificial Sequence
  Description of Artificial Sequence: Synthetic polypeptide
DEEEIRTTNPVATEQYGSVSTTDQAGNTEQGTTNQE

SEQ ID NO: 118659 - protein, 33 aa, Artificial Sequence
  Description of Artificial Sequence: Synthetic polypeptide
DEEEIRTTNPVATEQYGCVCSSEHNQNFISNQE

SEQ ID NO: 118660 - protein, 33 aa, Artificial Sequence
  Description of Artificial Sequence: Synthetic polypeptide
DEEEIRTTNPVATEFYGNVVDTVNMFDRIISNG

SEQ ID NO: 118661 - protein, 33 aa, Artificial Sequence
  Description of Artificial Sequence: Synthetic polypeptide
DEEEIRTTNPVATEFYGMVSIFTGVGQTNNGEN

SEQ ID NO: 118662 - protein, 33 aa, Artificial Sequence
  Description of Artificial Sequence: Synthetic polypeptide
DEEEIRTTNPVATEFYGMVSIFTGVGQGTNEQN

SEQ ID NO: 118663 - protein, 35 aa, Artificial Sequence
  Description of Artificial Sequence: Synthetic polypeptide
DEEEIRTTNPVATEFYGMVGSTGNEGQGQGNEGND

SEQ ID NO: 118664 - protein, 33 aa, Artificial Sequence
  Description of Artificial Sequence: Synthetic polypeptide
DEAEIRTTNPVAYEQWGEVSTNMNAGNAGEDSR

SEQ ID NO: 118665 - protein, 30 aa, Artificial Sequence
  Description of Artificial Sequence: Synthetic polypeptide
DEDEIATTNPVAYEQYGSVAAANDTDNNDS

SEQ ID NO: 118666 - protein, 30 aa, Artificial Sequence
  Description of Artificial Sequence: Synthetic polypeptide
DEDEIATTNPVAYEQYGSVAAANDDMGDHQ

SEQ ID NO: 118667 - protein, 36 aa, Artificial Sequence
  Description of Artificial Sequence: Synthetic polypeptide
DEEEIRTTNPVATEQYGSVSTTEQAGNTEQGTNNEE

SEQ ID NO: 118668 - protein, 30 aa, Artificial Sequence
  Description of Artificial Sequence: Synthetic polypeptide
DEDEIATTNPVAYEQYGSVAAAGDDGGNVD

SEQ ID NO: 118669 - protein, 35 aa, Artificial Sequence
  Description of Artificial Sequence: Synthetic polypeptide
DEEEIRTTNPVATEQYGSVSTTGLEVTILAQNIGE

SEQ ID NO: 118670 - protein, 31 aa, Artificial Sequence
  Description of Artificial Sequence: Synthetic polypeptide
DDSEVATTNPVSTEGYGSVAANDLQSRVGQR

SEQ ID NO: 118671 - protein, 34 aa, Artificial Sequence
  Description of Artificial Sequence: Synthetic polypeptide
DECEICTTNPVATEQYGSVSTTAQLQEDTEGEDE

SEQ ID NO: 118672 - protein, 34 aa, Artificial Sequence
  Description of Artificial Sequence: Synthetic polypeptide
DEEEIRTTNPVATEQYGAVVSTDTGMGQGNFNQG

SEQ ID NO: 118673 - protein, 31 aa, Artificial Sequence
  Description of Artificial Sequence: Synthetic polypeptide
DDSEVATTNPVSTEGYGSVAANTLQSRVGQR

SEQ ID NO: 118674 - protein, 37 aa, Artificial Sequence
  Description of Artificial Sequence: Synthetic polypeptide
DEEEIRTTNPVATEQYGSVSTVNLQAGTEQGSTQTED

SEQ ID NO: 118675 - protein, 38 aa, Artificial Sequence
  Description of Artificial Sequence: Synthetic polypeptide
DEEEIRTTNPVATEQYGSVSTVNLQAGNTEQGTTEEQE

SEQ ID NO: 118676 - protein, 38 aa, Artificial Sequence
  Description of Artificial Sequence: Synthetic polypeptide
DEEEIRTTNPVATEQYGSVSTVNLQAGNQETTTNVATE

SEQ ID NO: 118677 - protein, 31 aa, Artificial Sequence
  Description of Artificial Sequence: Synthetic polypeptide
DEDEIATTNPVATASWGCVAGTNNLERDGNP

SEQ ID NO: 118678 - protein, 35 aa, Artificial Sequence
  Description of Artificial Sequence: Synthetic polypeptide
DEAEIRTTNPVATEQYGSVSVTADNTQTGGGEVES

SEQ ID NO: 118679 - protein, 37 aa, Artificial Sequence
  Description of Artificial Sequence: Synthetic polypeptide
DEEEIRTTNPVATEQYGSVSTVNLNQLQQGEADEEDE

SEQ ID NO: 118680 - protein, 28 aa, Artificial Sequence
  Description of Artificial Sequence: Synthetic peptide
DEDEIATTNPVATASWGCVATADDPGND

SEQ ID NO: 118681 - protein, 33 aa, Artificial Sequence
  Description of Artificial Sequence: Synthetic polypeptide
DECEICTTNPVATEQYGSVSTTDGLEGTEGEDD

SEQ ID NO: 118682 - protein, 34 aa, Artificial Sequence
  Description of Artificial Sequence: Synthetic polypeptide
DEEEIRTTNPVATEFYGAVSITNGDEFNGGGGND

SEQ ID NO: 118683 - protein, 34 aa, Artificial Sequence
  Description of Artificial Sequence: Synthetic polypeptide
DEEEIRTTNPVATEQYGSVSTDVGVDTSLMNQQF

SEQ ID NO: 118684 - protein, 31 aa, Artificial Sequence
  Description of Artificial Sequence: Synthetic polypeptide
DEDEIATTNPVAYEQYGSVAASLPRENPNTE

SEQ ID NO: 118685 - protein, 34 aa, Artificial Sequence
  Description of Artificial Sequence: Synthetic polypeptide
DECEICTTNPVATEQYGSVSTTANLEDTEGEDEN

SEQ ID NO: 118686 - protein, 34 aa, Artificial Sequence
  Description of Artificial Sequence: Synthetic polypeptide
DEEEIRTTNPVATEFYGMVGSGNMNQIEFGNNGQ

SEQ ID NO: 118687 - protein, 34 aa, Artificial Sequence
  Description of Artificial Sequence: Synthetic polypeptide
DEEEIRTTNPVATEFYGMVGSGNMNQDEIGGNDG

SEQ ID NO: 118688 - protein, 33 aa, Artificial Sequence
  Description of Artificial Sequence: Synthetic polypeptide
DEEEIRTTNPVATEQYGCVCSSEEHQNFGSEQS

SEQ ID NO: 118689 - protein, 34 aa, Artificial Sequence
  Description of Artificial Sequence: Synthetic polypeptide
DEEEIRTTNPVATEQYGSVSTFLNVEDEEEDSSP

SEQ ID NO: 118690 - protein, 31 aa, Artificial Sequence
  Description of Artificial Sequence: Synthetic polypeptide
DEDEIATTNPVAYEQYGSVAATGDTSGNPTV

SEQ ID NO: 118691 - protein, 32 aa, Artificial Sequence
  Description of Artificial Sequence: Synthetic polypeptide
DEDEIATTNPVAYEQYGSVAATGDQNSGNPVV

SEQ ID NO: 118692 - protein, 34 aa, Artificial Sequence
  Description of Artificial Sequence: Synthetic polypeptide
DEEEIRTTNPVATEQYGCVCSSEEHQNFGSDNQV

SEQ ID NO: 118693 - protein, 33 aa, Artificial Sequence
  Description of Artificial Sequence: Synthetic polypeptide
DECEIRTTNPVAYEQWGSVSTGIGLNAGEDNGS

SEQ ID NO: 118694 - protein, 30 aa, Artificial Sequence
  Description of Artificial Sequence: Synthetic polypeptide
DEDEIATTNPVATASWGCVAGNGLERDGNN

SEQ ID NO: 118695 - protein, 34 aa, Artificial Sequence
  Description of Artificial Sequence: Synthetic polypeptide
DEEEIRTTNPVATEQYGAVVTDGNMVTEGGENEG

SEQ ID NO: 118696 - protein, 33 aa, Artificial Sequence
  Description of Artificial Sequence: Synthetic polypeptide
DECEICTTNPVATEQYGSVSTTALNDTEGEDES

SEQ ID NO: 118697 - protein, 33 aa, Artificial Sequence
  Description of Artificial Sequence: Synthetic polypeptide
DECEICTTNPVATEQYGSVSTTALQEDTEEEDD

SEQ ID NO: 118698 - protein, 33 aa, Artificial Sequence
  Description of Artificial Sequence: Synthetic polypeptide
DEDEIATTNPVAYEQYGSVAATANGQAAPPGNN

SEQ ID NO: 118699 - protein, 33 aa, Artificial Sequence
  Description of Artificial Sequence: Synthetic polypeptide
DEEEIRTTNPVATEQYGCVCSSEEHQAFNSQQL

SEQ ID NO: 118700 - protein, 33 aa, Artificial Sequence
  Description of Artificial Sequence: Synthetic polypeptide
DEDEIATTNPVAYEQYGSVAATANGQAAPGNNS

SEQ ID NO: 118701 - protein, 34 aa, Artificial Sequence
  Description of Artificial Sequence: Synthetic polypeptide
DEDEIATTNPVAYEQYGSVAATANGQAAPGNMRS

SEQ ID NO: 118702 - protein, 34 aa, Artificial Sequence
  Description of Artificial Sequence: Synthetic polypeptide
DEEEIRTTNPVATEFYGDVDNTDNGGQEEGGGNT

SEQ ID NO: 118703 - protein, 34 aa, Artificial Sequence
  Description of Artificial Sequence: Synthetic polypeptide
DEEEIRTTNPVATEQYGSVSTTEMYDPRLEVEEQ

SEQ ID NO: 118704 - protein, 33 aa, Artificial Sequence
  Description of Artificial Sequence: Synthetic polypeptide
DEEEIRTTNPVATEQYGCVCSSEEHQGFGSDQS

SEQ ID NO: 118705 - protein, 34 aa, Artificial Sequence
  Description of Artificial Sequence: Synthetic polypeptide
DEDEIATTNPVAYEQYGSVSTNPLQAQANGDVQS

SEQ ID NO: 118706 - protein, 34 aa, Artificial Sequence
  Description of Artificial Sequence: Synthetic polypeptide
DECEIATTNPVAYEQWGSVSTTNGWGQNSGENDR

SEQ ID NO: 118707 - protein, 33 aa, Artificial Sequence
  Description of Artificial Sequence: Synthetic polypeptide
DEEEIRTTNPVATEPYGTVSSMEAIQQQQNGNH

SEQ ID NO: 118708 - protein, 34 aa, Artificial Sequence
  Description of Artificial Sequence: Synthetic polypeptide
DEEEIRTTNPVATEQYGCVCSTEHNQNFISNTQS

SEQ ID NO: 118709 - protein, 35 aa, Artificial Sequence
  Description of Artificial Sequence: Synthetic polypeptide
DEEEIRTTNPVAYEQYGCVCSCTDNMLPSGTNNDL

SEQ ID NO: 118710 - protein, 34 aa, Artificial Sequence
  Description of Artificial Sequence: Synthetic polypeptide
DECTICTTNPVATEQYGSVTVTTNLQIGIGNNLE

SEQ ID NO: 118711 - protein, 35 aa, Artificial Sequence
  Description of Artificial Sequence: Synthetic polypeptide
DEEEIRTTNPVATEQYGCVCSTEHNQENFGSNTQA

SEQ ID NO: 118712 - protein, 35 aa, Artificial Sequence
  Description of Artificial Sequence: Synthetic polypeptide
DEEEIRTTNPVATEQYGCVCSTEHNQENFGSNNQS

SEQ ID NO: 118713 - protein, 34 aa, Artificial Sequence
  Description of Artificial Sequence: Synthetic polypeptide
DEEEIRTTNPVATEPYGSVCFTNAPSPRTGGGPE

SEQ ID NO: 118714 - protein, 34 aa, Artificial Sequence
  Description of Artificial Sequence: Synthetic polypeptide
DEEEIRTTNPVATEQYGCVCSTEHNQENFGSDQS

SEQ ID NO: 118715 - protein, 34 aa, Artificial Sequence
  Description of Artificial Sequence: Synthetic polypeptide
DEEEIRTTNPVATEQYGCVCSTEHNQENFGSDQF

SEQ ID NO: 118716 - protein, 35 aa, Artificial Sequence
  Description of Artificial Sequence: Synthetic polypeptide
DEEEIRTTNPVATEPYGSVCFTNAPSTRTDGNPEN

SEQ ID NO: 118717 - protein, 35 aa, Artificial Sequence
  Description of Artificial Sequence: Synthetic polypeptide
DEEEIRTTNPVATEPYGSVCFTNEDHHNHGGQNQR

SEQ ID NO: 118718 - protein, 34 aa, Artificial Sequence
  Description of Artificial Sequence: Synthetic polypeptide
DEEEIRTTNPVATEQYGCVCSTEHNQEGFGSEQS

SEQ ID NO: 118719 - protein, 35 aa, Artificial Sequence
  Description of Artificial Sequence: Synthetic polypeptide
DEEEIRTTNPVATEPYGSVCFTNEDHTDQGGQNHT

SEQ ID NO: 118720 - protein, 35 aa, Artificial Sequence
  Description of Artificial Sequence: Synthetic polypeptide
DEEEIRTTNPVATEPYGSVCFTNEDHTDQQGDNHI

SEQ ID NO: 118721 - protein, 33 aa, Artificial Sequence
  Description of Artificial Sequence: Synthetic polypeptide
DEEEIRTTNPVATEGYGCICSTNEQRFSSDTFA

SEQ ID NO: 118722 - protein, 35 aa, Artificial Sequence
  Description of Artificial Sequence: Synthetic polypeptide
DEEEIRTTNPVATEQYGCVCSTEHNQEFFGSQNQS

SEQ ID NO: 118723 - protein, 34 aa, Artificial Sequence
  Description of Artificial Sequence: Synthetic polypeptide
DEEEIRTTNPVATEQYGCVCSTEHNQEFFGSDQS

SEQ ID NO: 118724 - protein, 34 aa, Artificial Sequence
  Description of Artificial Sequence: Synthetic polypeptide
DEEEIRTTNPVAYEQYGCVCSMTEHQYFGSENQS

SEQ ID NO: 118725 - protein, 33 aa, Artificial Sequence
  Description of Artificial Sequence: Synthetic polypeptide
DEEEIRTTNPVATEQYGCVCSTEHNQNFISQQA

SEQ ID NO: 118726 - protein, 34 aa, Artificial Sequence
  Description of Artificial Sequence: Synthetic polypeptide
DEEEIRTTNPVATEQYGCVCSTEHNQNFNSNNQM

SEQ ID NO: 118727 - protein, 33 aa, Artificial Sequence
  Description of Artificial Sequence: Synthetic polypeptide
DEEEIRTTNPVATEGYGCSCSTEEQEHFNSQFA

SEQ ID NO: 118728 - protein, 34 aa, Artificial Sequence
  Description of Artificial Sequence: Synthetic polypeptide
DEEEIRTTNPVATEQYGCVCSTEHNQNFTSENQS

SEQ ID NO: 118729 - protein, 34 aa, Artificial Sequence
  Description of Artificial Sequence: Synthetic polypeptide
DEAEIRTTNPVATEQYGSVSTMWGDSQQEGPEEY

SEQ ID NO: 118730 - protein, 33 aa, Artificial Sequence
  Description of Artificial Sequence: Synthetic polypeptide
DECEIATTNPVATEPYGSVCYNNDNQDQGSNDR

SEQ ID NO: 118731 - protein, 32 aa, Artificial Sequence
  Description of Artificial Sequence: Synthetic polypeptide
DECEIATTNPVATEPYGSVCYNNDSQDQGGDR

SEQ ID NO: 118732 - protein, 32 aa, Artificial Sequence
  Description of Artificial Sequence: Synthetic polypeptide
DECEIATTNPVATEQAGVVSITGKLQQRTPTD

SEQ ID NO: 118733 - protein, 34 aa, Artificial Sequence
  Description of Artificial Sequence: Synthetic polypeptide
DEEEIRTTNPVATEQYGCVCSTEHQEGFFSDTQG

SEQ ID NO: 118734 - protein, 34 aa, Artificial Sequence
  Description of Artificial Sequence: Synthetic polypeptide
DEEEIRTTNPVATEQYGCVCSTEHQEFFSSNNQY

SEQ ID NO: 118735 - protein, 35 aa, Artificial Sequence
  Description of Artificial Sequence: Synthetic polypeptide
DEEEIRTTNPVATEPYGSVCFNNNPLTYRGGQNFM

SEQ ID NO: 118736 - protein, 34 aa, Artificial Sequence
  Description of Artificial Sequence: Synthetic polypeptide
DECEIATTNPVATEQYGCVCTIEGNQDQGGGNPR

SEQ ID NO: 118737 - protein, 32 aa, Artificial Sequence
  Description of Artificial Sequence: Synthetic polypeptide
DEEEIRTTNPVATEGYGCICSTGNEQHFSSDF

SEQ ID NO: 118738 - protein, 34 aa, Artificial Sequence
  Description of Artificial Sequence: Synthetic polypeptide
DEEEIRTTNPVATEQYGCVCSTEHQEFFNSNTQE

SEQ ID NO: 118739 - protein, 36 aa, Artificial Sequence
  Description of Artificial Sequence: Synthetic polypeptide
DECEIATTNPVATEQYGSVSWNEGDLQEGGGQRGDR

SEQ ID NO: 118740 - protein, 34 aa, Artificial Sequence
  Description of Artificial Sequence: Synthetic polypeptide
DEEEIRTTNPVATEGYGCSCSTNEQEYFNSDNQA

SEQ ID NO: 118741 - protein, 32 aa, Artificial Sequence
  Description of Artificial Sequence: Synthetic polypeptide
DECEIATTNPVATEQYGSVSWNEGDMDGKGTQ

SEQ ID NO: 118742 - protein, 31 aa, Artificial Sequence
  Description of Artificial Sequence: Synthetic polypeptide
DEDEIATTNPVATAQWGCVAGTNGLEADGNN

SEQ ID NO: 118743 - protein, 34 aa, Artificial Sequence
  Description of Artificial Sequence: Synthetic polypeptide
DECEIATTNPVATEQYGSVSWNEGDQQQDRQGQA

SEQ ID NO: 118744 - protein, 34 aa, Artificial Sequence
  Description of Artificial Sequence: Synthetic polypeptide
DEEEIRTTNPVATEQYGCVCSTEHNTEGFNSDQS

SEQ ID NO: 118745 - protein, 34 aa, Artificial Sequence
  Description of Artificial Sequence: Synthetic polypeptide
DEEEIRTTNPVATEQYGCVCSTEHNQSFPSENQS

SEQ ID NO: 118746 - protein, 34 aa, Artificial Sequence
  Description of Artificial Sequence: Synthetic polypeptide
DECEIATTNPVATEQYGSVSWTEGDLTGQGGGGE

SEQ ID NO: 118747 - protein, 34 aa, Artificial Sequence
  Description of Artificial Sequence: Synthetic polypeptide
DEEEIRTTNPVATEQYGCVCSTEHNTENFGSDQP

SEQ ID NO: 118748 - protein, 35 aa, Artificial Sequence
  Description of Artificial Sequence: Synthetic polypeptide
DEEEIRTTNPVATEPYGSVCFFTEYLGTQEGGQNE

SEQ ID NO: 118749 - protein, 34 aa, Artificial Sequence
  Description of Artificial Sequence: Synthetic polypeptide
DECTICTTNPVATEQWGSVSTTVNLGQQGTNQNT

SEQ ID NO: 118750 - protein, 35 aa, Artificial Sequence
  Description of Artificial Sequence: Synthetic polypeptide
DEEEIRTTNPVAYEQYGCVCSMTGNHQENFGSNQG

SEQ ID NO: 118751 - protein, 35 aa, Artificial Sequence
  Description of Artificial Sequence: Synthetic polypeptide
DEEEIRTTNPVATEPYGSVCFTVNAPSTRTGGNPP

SEQ ID NO: 118752 - protein, 33 aa, Artificial Sequence
  Description of Artificial Sequence: Synthetic polypeptide
DEEEIRTTNPVATEQYGCVCSTEHANFGSQTQS

SEQ ID NO: 118753 - protein, 38 aa, Artificial Sequence
  Description of Artificial Sequence: Synthetic polypeptide
DEEEIRTTNPVATEQYGSVSTVNTNLQQGTEQGTNTTE

SEQ ID NO: 118754 - protein, 32 aa, Artificial Sequence
  Description of Artificial Sequence: Synthetic polypeptide
DEEEIRTTNPVATEQYGCVCSTEHAFFMSDQP

SEQ ID NO: 118755 - protein, 33 aa, Artificial Sequence
  Description of Artificial Sequence: Synthetic polypeptide
DEEEIRTTNPVATEQYGCVCSTEHAFFGSDTQA

SEQ ID NO: 118756 - protein, 38 aa, Artificial Sequence
  Description of Artificial Sequence: Synthetic polypeptide
DEEEIRTTNPVATEQYGSVSTVNTNLNGNQQNGNTNND

SEQ ID NO: 118757 - protein, 38 aa, Artificial Sequence
  Description of Artificial Sequence: Synthetic polypeptide
DEEEIRTTNPVATEQYGSVSTVNTNLNGNQIGNTNNTD

SEQ ID NO: 118758 - protein, 37 aa, Artificial Sequence
  Description of Artificial Sequence: Synthetic polypeptide
DEEEIRTTNPVATEQYGSVSTVNQQQQNATNEQGTND

SEQ ID NO: 118759 - protein, 30 aa, Artificial Sequence
  Description of Artificial Sequence: Synthetic polypeptide
DEDEIATTNPVATAQWGCVATTGLEPDGNH

SEQ ID NO: 118760 - protein, 37 aa, Artificial Sequence
  Description of Artificial Sequence: Synthetic polypeptide
DEEEIRTTNPVATEQYGSVSTVNQQQNNAEQGTNQET

SEQ ID NO: 118761 - protein, 34 aa, Artificial Sequence
  Description of Artificial Sequence: Synthetic polypeptide
DEEEIRTTNPVATEQYGCVCSTEHAEHFGSENQA

SEQ ID NO: 118762 - protein, 34 aa, Artificial Sequence
  Description of Artificial Sequence: Synthetic polypeptide
DECEIATTNPVATEVWGSVCYTNDLQDQGGDNGR

SEQ ID NO: 118763 - protein, 33 aa, Artificial Sequence
  Description of Artificial Sequence: Synthetic polypeptide
DEEEIRTTNPVATEQYGCVCSTEHAEFSGSEQP

SEQ ID NO: 118764 - protein, 37 aa, Artificial Sequence
  Description of Artificial Sequence: Synthetic polypeptide
DEEEIRTTNPVATEQYGSVSTVNQQQLNGNQQGTTED

SEQ ID NO: 118765 - protein, 34 aa, Artificial Sequence
  Description of Artificial Sequence: Synthetic polypeptide
DEEEIRTTNPVAYEQYGCVCSNTENHQNFGSDQS

SEQ ID NO: 118766 - protein, 35 aa, Artificial Sequence
  Description of Artificial Sequence: Synthetic polypeptide
DEEEIRTTNPVATEQYGCVCSTEGHQEFFGSNTQS

SEQ ID NO: 118767 - protein, 35 aa, Artificial Sequence
  Description of Artificial Sequence: Synthetic polypeptide
DEEEIRTTNPVATEQYGCSCSTGYPLNQNFNSDQA

SEQ ID NO: 118768 - protein, 34 aa, Artificial Sequence
  Description of Artificial Sequence: Synthetic polypeptide
DEEEIRTTNPVATEQYGCVCSTEHDQENFISNQP

SEQ ID NO: 118769 - protein, 37 aa, Artificial Sequence
  Description of Artificial Sequence: Synthetic polypeptide
DEEEIRTTNPVATEQYGSVSTVNTNNQQGNNDEDEDD

SEQ ID NO: 118770 - protein, 38 aa, Artificial Sequence
  Description of Artificial Sequence: Synthetic polypeptide
DEEEIRTTNPVATEQYGSVSTVNTNQNLNQQGTNEDEE

SEQ ID NO: 118771 - protein, 33 aa, Artificial Sequence
  Description of Artificial Sequence: Synthetic polypeptide
DEEEIRTTNPVAYEQYGCVCSNSEHQHFGSNQS

SEQ ID NO: 118772 - protein, 35 aa, Artificial Sequence
  Description of Artificial Sequence: Synthetic polypeptide
DEEEIRTTNPVATEGYGAVSGTGNDQQDEGGNGEE

SEQ ID NO: 118773 - protein, 34 aa, Artificial Sequence
  Description of Artificial Sequence: Synthetic polypeptide
DEEEIRTTNPVATEQYGCVCSTEHNINFGSETQA

SEQ ID NO: 118774 - protein, 32 aa, Artificial Sequence
  Description of Artificial Sequence: Synthetic polypeptide
DECEIATTNPVATESWGSVSGGNGNAGNDNDR

SEQ ID NO: 118775 - protein, 34 aa, Artificial Sequence
  Description of Artificial Sequence: Synthetic polypeptide
DEEEIRTTNPVATEGWGETVPFHNMLSQRGGNPQ

SEQ ID NO: 118776 - protein, 36 aa, Artificial Sequence
  Description of Artificial Sequence: Synthetic polypeptide
DEEEIRTTNPVATEGWGESRVFSYTDNYLQERPGEF

SEQ ID NO: 118777 - protein, 33 aa, Artificial Sequence
  Description of Artificial Sequence: Synthetic polypeptide
DEEEIRTTNPVATEQYGCVCSTEHNANFNSEQS

SEQ ID NO: 118778 - protein, 35 aa, Artificial Sequence
  Description of Artificial Sequence: Synthetic polypeptide
DEEEIRTTNPVATEFYGYVSTNNMEQGIEGQNIGE

SEQ ID NO: 118779 - protein, 35 aa, Artificial Sequence
  Description of Artificial Sequence: Synthetic polypeptide
DEAEIRTTNPVATEQYGSVSTMWNDSQQEIGEFEH

SEQ ID NO: 118780 - protein, 34 aa, Artificial Sequence
  Description of Artificial Sequence: Synthetic polypeptide
DEEEIRTTNPVATEQYGCVCSTEHNINFNSDNQL

SEQ ID NO: 118781 - protein, 34 aa, Artificial Sequence
  Description of Artificial Sequence: Synthetic polypeptide
DEEEIRTTNPVATEFYGYVSTDLDIGDEGENTVA

SEQ ID NO: 118782 - protein, 33 aa, Artificial Sequence
  Description of Artificial Sequence: Synthetic polypeptide
DEEEIRTTNPVATEFYGYVSGNMDDGIGQGEGN

SEQ ID NO: 118783 - protein, 34 aa, Artificial Sequence
  Description of Artificial Sequence: Synthetic polypeptide
DECTICTTNPVATEQWGSVSTTTTNLQQGTNQME

SEQ ID NO: 118784 - protein, 34 aa, Artificial Sequence
  Description of Artificial Sequence: Synthetic polypeptide
DECTICTTNPVATEQWGSVSTTTNLLQQGNNQVE

SEQ ID NO: 118785 - protein, 33 aa, Artificial Sequence
  Description of Artificial Sequence: Synthetic polypeptide
DEEEIRTTNPVATEQYGCVCSTEHIGFPSNNQS

SEQ ID NO: 118786 - protein, 34 aa, Artificial Sequence
  Description of Artificial Sequence: Synthetic polypeptide
DEEEIRTTNPVATEFYGYVSGDTMDLNEIGENED

SEQ ID NO: 118787 - protein, 34 aa, Artificial Sequence
  Description of Artificial Sequence: Synthetic polypeptide
DEEEIRTTNPVATEQYGCVCSTEHFEGFGSENQA

SEQ ID NO: 118788 - protein, 33 aa, Artificial Sequence
  Description of Artificial Sequence: Synthetic polypeptide
DECEIATTNPVATESYGSVCYNNDHQDVGNNDR

SEQ ID NO: 118789 - protein, 34 aa, Artificial Sequence
  Description of Artificial Sequence: Synthetic polypeptide
DEEEIRTTNPVATEFYGYVSGDTMDLNEGGENDQ

SEQ ID NO: 118790 - protein, 33 aa, Artificial Sequence
  Description of Artificial Sequence: Synthetic polypeptide
DEEEIRTTNPVATEQYGCVCSTEHIYFNSDNQV

SEQ ID NO: 118791 - protein, 34 aa, Artificial Sequence
  Description of Artificial Sequence: Synthetic polypeptide
DEAEIRTTNPVATEQYGSVSTMWGDSQIEGGEEK

SEQ ID NO: 118792 - protein, 35 aa, Artificial Sequence
  Description of Artificial Sequence: Synthetic polypeptide
DEAEIRTTNPVATEQYGSVSTMWGDSGQEGGNEHF

SEQ ID NO: 118793 - protein, 34 aa, Artificial Sequence
  Description of Artificial Sequence: Synthetic polypeptide
DEAEIRTTNPVATEQYGSVSTMVNNLEFSEEDFD

SEQ ID NO: 118794 - protein, 32 aa, Artificial Sequence
  Description of Artificial Sequence: Synthetic polypeptide
DECEIATTNPVATEPYGSVCYNNDHDGNNDRT

SEQ ID NO: 118795 - protein, 38 aa, Artificial Sequence
  Description of Artificial Sequence: Synthetic polypeptide
DEEEIRTTNPVATEQYGSVSTVTNLQQGNQNNEENAED

SEQ ID NO: 118796 - protein, 32 aa, Artificial Sequence
  Description of Artificial Sequence: Synthetic polypeptide
DEEEIRTTNPVAYEQYGCVCGTNHQYFDSDQA

SEQ ID NO: 118797 - protein, 38 aa, Artificial Sequence
  Description of Artificial Sequence: Synthetic polypeptide
DEEEIRTTNPVATEQYGSVSTVTNLQQGNNNEEEDTEE

SEQ ID NO: 118798 - protein, 33 aa, Artificial Sequence
  Description of Artificial Sequence: Synthetic polypeptide
DEAEIRTTNPVAYEQWGSVCVTDNHDQGMGQIR

SEQ ID NO: 118799 - protein, 38 aa, Artificial Sequence
  Description of Artificial Sequence: Synthetic polypeptide
DEEEIRTTNPVATEQYGSVSTVTNLQQGNNDEETEDEM

SEQ ID NO: 118800 - protein, 33 aa, Artificial Sequence
  Description of Artificial Sequence: Synthetic polypeptide
DEAEIRTVNPVAYEQWGSTVSCTRLSQRTNGQE

SEQ ID NO: 118801 - protein, 31 aa, Artificial Sequence
  Description of Artificial Sequence: Synthetic polypeptide
DECEIATTNPVATEPYGSVCYNNDHDGVGDR

SEQ ID NO: 118802 - protein, 32 aa, Artificial Sequence
  Description of Artificial Sequence: Synthetic polypeptide
DECEIATTNPVATEPYGSVCYNNDHDTGNEDR

SEQ ID NO: 118803 - protein, 33 aa, Artificial Sequence
  Description of Artificial Sequence: Synthetic polypeptide
DECTICTTNPVATEQYGTVSTTLNNQTGTNDED

SEQ ID NO: 118804 - protein, 34 aa, Artificial Sequence
  Description of Artificial Sequence: Synthetic polypeptide
DEEEIRTTNPVATEQYGCVCSMTEHQYFNSEQQS

SEQ ID NO: 118805 - protein, 37 aa, Artificial Sequence
  Description of Artificial Sequence: Synthetic polypeptide
DEEEIRTTNPVATEQYGSVSTVTNLQNQNQATNVATE

SEQ ID NO: 118806 - protein, 38 aa, Artificial Sequence
  Description of Artificial Sequence: Synthetic polypeptide
DEEEIRTTNPVATEQYGSVSTVTNLQNNQQGTTNDEQN

SEQ ID NO: 118807 - protein, 35 aa, Artificial Sequence
  Description of Artificial Sequence: Synthetic polypeptide
DEEEIRTTNPVATEQYGCVCSTELHNQENFNSDQS

SEQ ID NO: 118808 - protein, 38 aa, Artificial Sequence
  Description of Artificial Sequence: Synthetic polypeptide
DEEEIRTTNPVATEQYGSVSTVTNLQNNQQGTNNVATE

SEQ ID NO: 118809 - protein, 37 aa, Artificial Sequence
  Description of Artificial Sequence: Synthetic polypeptide
DEEEIRTTNPVATEAYGSVSTVNTNLQAGNEEDEEDE

SEQ ID NO: 118810 - protein, 37 aa, Artificial Sequence
  Description of Artificial Sequence: Synthetic polypeptide
DEEEIRTTNPVATEAYGSVSTVQNLGNQQGNNNAETE

SEQ ID NO: 118811 - protein, 37 aa, Artificial Sequence
  Description of Artificial Sequence: Synthetic polypeptide
DEEEIRTTNPVATEAYGSVSTVNQNNLTQLGNNNNNQ

SEQ ID NO: 118812 - protein, 38 aa, Artificial Sequence
  Description of Artificial Sequence: Synthetic polypeptide
DEEEIRTTNPVATEQYGSVSTVTNLQQGNQQGTEEGTD

SEQ ID NO: 118813 - protein, 38 aa, Artificial Sequence
  Description of Artificial Sequence: Synthetic polypeptide
DEEEIRTTNPVATEQYGSVSTVTNLQQGNQQGTEQGEQ

SEQ ID NO: 118814 - protein, 34 aa, Artificial Sequence
  Description of Artificial Sequence: Synthetic polypeptide
DEEEIRTTNPVATEPYGKVCFTNAPSTRTGGNPI

SEQ ID NO: 118815 - protein, 33 aa, Artificial Sequence
  Description of Artificial Sequence: Synthetic polypeptide
DEEEIRTTNPVAYEQYGCTVNYTCELSARGSYS

SEQ ID NO: 118816 - protein, 37 aa, Artificial Sequence
  Description of Artificial Sequence: Synthetic polypeptide
DEEEIRTTNPVATEQYGSVSTVTNQQAGNQAGNQTDE

SEQ ID NO: 118817 - protein, 35 aa, Artificial Sequence
  Description of Artificial Sequence: Synthetic polypeptide
DEEEIRTTNPVATEQYGSVSTPMTLDQIHAVVEEL

SEQ ID NO: 118818 - protein, 34 aa, Artificial Sequence
  Description of Artificial Sequence: Synthetic polypeptide
DEEEIRTTNPVAYEQYGCTVQACQHLSQRLPGVR

SEQ ID NO: 118819 - protein, 34 aa, Artificial Sequence
  Description of Artificial Sequence: Synthetic polypeptide
DECTICTTNPVATEQYGVVSTTTNLDQQGNGNVD

SEQ ID NO: 118820 - protein, 35 aa, Artificial Sequence
  Description of Artificial Sequence: Synthetic polypeptide
DEEEIRTTNPVAYEQYGCTVQACTHLSQSRLSGDR

SEQ ID NO: 118821 - protein, 34 aa, Artificial Sequence
  Description of Artificial Sequence: Synthetic polypeptide
DEEEIRTTNPVAYEQYGCTVQGCTHLSTRLSGVR

SEQ ID NO: 118822 - protein, 32 aa, Artificial Sequence
  Description of Artificial Sequence: Synthetic polypeptide
DEAEISTVNPVATEQYGCVCSTNLFHFGGDQA

SEQ ID NO: 118823 - protein, 37 aa, Artificial Sequence
  Description of Artificial Sequence: Synthetic polypeptide
DEEEIRTTNPVATEAYGSVSTVQNLNQQGNTNNNTTE

SEQ ID NO: 118824 - protein, 33 aa, Artificial Sequence
  Description of Artificial Sequence: Synthetic polypeptide
DEEEIRTTNPVATEGYGCVCSNTELENFGSDQS

SEQ ID NO: 118825 - protein, 33 aa, Artificial Sequence
  Description of Artificial Sequence: Synthetic polypeptide
DECTICTTNPVATEQYGVVSTTNQMQTGTNDED

SEQ ID NO: 118826 - protein, 33 aa, Artificial Sequence
  Description of Artificial Sequence: Synthetic polypeptide
DEEEIRTTNPVATEPYGISVSWVVLADTIENHS

SEQ ID NO: 118827 - protein, 33 aa, Artificial Sequence
  Description of Artificial Sequence: Synthetic polypeptide
DEEEIRTTNPVATEGYGCVCSNTEHQNFGSDQS

SEQ ID NO: 118828 - protein, 33 aa, Artificial Sequence
  Description of Artificial Sequence: Synthetic polypeptide
DEEEIRTTNPVATEGYGCVCSNTEHQGFGSQQS

SEQ ID NO: 118829 - protein, 34 aa, Artificial Sequence
  Description of Artificial Sequence: Synthetic polypeptide
DEEEIRTTNPVATEGYGCVCSNTEELQNFGSDQG

SEQ ID NO: 118830 - protein, 32 aa, Artificial Sequence
  Description of Artificial Sequence: Synthetic polypeptide
DECEIATTNPVATEPYGSVCYNNDHDEGNNDR

SEQ ID NO: 118831 - protein, 33 aa, Artificial Sequence
  Description of Artificial Sequence: Synthetic polypeptide
DECTICTTNPVATEQYGVVSTTNGGQTGTNDED

SEQ ID NO: 118832 - protein, 38 aa, Artificial Sequence
  Description of Artificial Sequence: Synthetic polypeptide
DEEEIRTTNPVATEQYGSVSTVTNLQYGNQQGTEQGND

SEQ ID NO: 118833 - protein, 37 aa, Artificial Sequence
  Description of Artificial Sequence: Synthetic polypeptide
DEEEIRTTNPVATEQYGSVSTVTNNNQNQQGTNQNGD

SEQ ID NO: 118834 - protein, 37 aa, Artificial Sequence
  Description of Artificial Sequence: Synthetic polypeptide
DEEEIRTTNPVATEAYGSVSTVQNLQQQGNGNNAETE

SEQ ID NO: 118835 - protein, 38 aa, Artificial Sequence
  Description of Artificial Sequence: Synthetic polypeptide
DEEEIRTTNPVATEQYGSVSTVTNLQGGNQAGTTNQET

SEQ ID NO: 118836 - protein, 33 aa, Artificial Sequence
  Description of Artificial Sequence: Synthetic polypeptide
DEEEIRTTNPVATEQYGCVCSTEHTFFNSDTQE

SEQ ID NO: 118837 - protein, 37 aa, Artificial Sequence
  Description of Artificial Sequence: Synthetic polypeptide
DEEEIRTTNPVATEQYGSVSTVTNDQNQQGNNNNEEE

SEQ ID NO: 118838 - protein, 33 aa, Artificial Sequence
  Description of Artificial Sequence: Synthetic polypeptide
DECEIATTNPVATEPYGSVCYNNDHQDGPNDRD

SEQ ID NO: 118839 - protein, 37 aa, Artificial Sequence
  Description of Artificial Sequence: Synthetic polypeptide
DEEEIRTTNPVATEQYGSVSTVTNAQAGNQQGTNVDT

SEQ ID NO: 118840 - protein, 37 aa, Artificial Sequence
  Description of Artificial Sequence: Synthetic polypeptide
DEEEIRTTNPVATEQYGSVSTVTNAEAGNQQGTNTDE

SEQ ID NO: 118841 - protein, 33 aa, Artificial Sequence
  Description of Artificial Sequence: Synthetic polypeptide
DEEEIRTTNPVATEQYGCVCSMTEPQNFSSEQA

SEQ ID NO: 118842 - protein, 32 aa, Artificial Sequence
  Description of Artificial Sequence: Synthetic polypeptide
DEEEIRTTNPVATEGYGCVCFTELTYGGSEQA

SEQ ID NO: 118843 - protein, 35 aa, Artificial Sequence
  Description of Artificial Sequence: Synthetic polypeptide
DEEEIRTTNPVATEQYGSVSTVSEEQLLATVANQT

SEQ ID NO: 118844 - protein, 34 aa, Artificial Sequence
  Description of Artificial Sequence: Synthetic polypeptide
DEAEIRTTNPVAYEQWGSVCVNENLGQDGQDNTR

SEQ ID NO: 118845 - protein, 32 aa, Artificial Sequence
  Description of Artificial Sequence: Synthetic polypeptide
DECEIATTNPVATEPYGSVCYNNDHQDGNDTT

SEQ ID NO: 118846 - protein, 32 aa, Artificial Sequence
  Description of Artificial Sequence: Synthetic polypeptide
DEEEIRTTNPVATEGYGCVCFSEHTYGGSNQA

SEQ ID NO: 118847 - protein, 34 aa, Artificial Sequence
  Description of Artificial Sequence: Synthetic polypeptide
DEEEIRTTNPVATEQYGCVCSTEHQEYFSSENQS

SEQ ID NO: 118848 - protein, 34 aa, Artificial Sequence
  Description of Artificial Sequence: Synthetic polypeptide
DEEEIRTTNPVATEQYGCVCSTEHQEYFNSENQT

SEQ ID NO: 118849 - protein, 33 aa, Artificial Sequence
  Description of Artificial Sequence: Synthetic polypeptide
DEEEIRTTNPVATEQYGCVCSTEHQEYFISDQS

SEQ ID NO: 118850 - protein, 34 aa, Artificial Sequence
  Description of Artificial Sequence: Synthetic polypeptide
DEEEIRTTNPVATEQYGCVCSTEHQENFPSENQS

SEQ ID NO: 118851 - protein, 33 aa, Artificial Sequence
  Description of Artificial Sequence: Synthetic polypeptide
DECEIATTNPVATEPYGSVCYNNDNQDDGNDRT

SEQ ID NO: 118852 - protein, 36 aa, Artificial Sequence
  Description of Artificial Sequence: Synthetic polypeptide
DEEEIRTTNPVATEPYGSVCFFTAGLDIQRGGQNEG

SEQ ID NO: 118853 - protein, 33 aa, Artificial Sequence
  Description of Artificial Sequence: Synthetic polypeptide
DEEEIRTTNPVATEQYGCVCSTEHQENFISQQA

SEQ ID NO: 118854 - protein, 38 aa, Artificial Sequence
  Description of Artificial Sequence: Synthetic polypeptide
DEEEIRTTNPVATEQYGSVSTVQNLQISTTEQGTNQDN

SEQ ID NO: 118855 - protein, 37 aa, Artificial Sequence
  Description of Artificial Sequence: Synthetic polypeptide
DEEEIRTTNPVATEAYGSVSTVVNTNLQLGNNDEQEE

SEQ ID NO: 118856 - protein, 34 aa, Artificial Sequence
  Description of Artificial Sequence: Synthetic polypeptide
DEEEIRTTNPVATEQYGCSCSTGNPPQNFISDQA

SEQ ID NO: 118857 - protein, 37 aa, Artificial Sequence
  Description of Artificial Sequence: Synthetic polypeptide
DEEEIRTTNPVATEQYGSVSTVTNGGNQQGNNNNQEE

SEQ ID NO: 118858 - protein, 33 aa, Artificial Sequence
  Description of Artificial Sequence: Synthetic polypeptide
DECEIATTNPVATEPYGSVCYNNDHQDGGQNMR

SEQ ID NO: 118859 - protein, 38 aa, Artificial Sequence
  Description of Artificial Sequence: Synthetic polypeptide
DEEEIRTTNPVATEQYGSVSTVTNLQGGNQAGTEEGED

SEQ ID NO: 118860 - protein, 38 aa, Artificial Sequence
  Description of Artificial Sequence: Synthetic polypeptide
DEEEIRTTNPVATEQYGSVSTVTNLQEGNQAGTTNNEA

SEQ ID NO: 118861 - protein, 38 aa, Artificial Sequence
  Description of Artificial Sequence: Synthetic polypeptide
DEEEIRTTNPVATEQYGSVSTVTNLQAGTEQGTNEEND

SEQ ID NO: 118862 - protein, 34 aa, Artificial Sequence
  Description of Artificial Sequence: Synthetic polypeptide
DEEEIRTTNPVATEQYGCVCSTEHTEFFGSNNQP

SEQ ID NO: 118863 - protein, 37 aa, Artificial Sequence
  Description of Artificial Sequence: Synthetic polypeptide
DEEEIRTTNPVATEAYGSVSTVTNNLGNQLGNNNNNQ

SEQ ID NO: 118864 - protein, 38 aa, Artificial Sequence
  Description of Artificial Sequence: Synthetic polypeptide
DEEEIRTTNPVATEQYGSVSTVTNLQAGNQQGTEENED

SEQ ID NO: 118865 - protein, 33 aa, Artificial Sequence
  Description of Artificial Sequence: Synthetic polypeptide
DECEIATTNPVATEPYGSVCYNNDHQDDGRNDR

SEQ ID NO: 118866 - protein, 35 aa, Artificial Sequence
  Description of Artificial Sequence: Synthetic polypeptide
DEEEIRTTNPVATEQYGCVCSMTENHQENFGSQQP

SEQ ID NO: 118867 - protein, 34 aa, Artificial Sequence
  Description of Artificial Sequence: Synthetic polypeptide
DEEEIRTTNPVATEGYGCVCFTGELTERGGSNQS

SEQ ID NO: 118868 - protein, 38 aa, Artificial Sequence
  Description of Artificial Sequence: Synthetic polypeptide
DEEEIRTTNPVATEQYGSVSTVTNLQAGNQNATEQGTD

SEQ ID NO: 118869 - protein, 38 aa, Artificial Sequence
  Description of Artificial Sequence: Synthetic polypeptide
DEEEIRTTNPVATEQYGSVSTVTNLQAGNQAGNNNEED

SEQ ID NO: 118870 - protein, 31 aa, Artificial Sequence
  Description of Artificial Sequence: Synthetic polypeptide
DEEEIRTTNPVAYEQYGCVCQSELQYFDSDQ

SEQ ID NO: 118871 - protein, 35 aa, Artificial Sequence
  Description of Artificial Sequence: Synthetic polypeptide
DEEEIRTTNPVATEPYGSNVCFFTYLATQRGGQDE

SEQ ID NO: 118872 - protein, 34 aa, Artificial Sequence
  Description of Artificial Sequence: Synthetic polypeptide
DEEEIRTTNPVATEPYGSTCATNAPSTRTGGNPE

SEQ ID NO: 118873 - protein, 32 aa, Artificial Sequence
  Description of Artificial Sequence: Synthetic polypeptide
DECEIATTNPVATEPYGSVCYNNDHQDGDNDK

SEQ ID NO: 118874 - protein, 38 aa, Artificial Sequence
  Description of Artificial Sequence: Synthetic polypeptide
DEEEIRTTNPVATEQYGSVSTVTNLNQAGNQQGTTEDE

SEQ ID NO: 118875 - protein, 33 aa, Artificial Sequence
  Description of Artificial Sequence: Synthetic polypeptide
DEEEIRTTNPVAYEQYGCVCQTNLQEYFDSDQA

SEQ ID NO: 118876 - protein, 33 aa, Artificial Sequence
  Description of Artificial Sequence: Synthetic polypeptide
DEEEIRTTNPVAYEQYGCVCQTNLQNFDSDTQA

SEQ ID NO: 118877 - protein, 38 aa, Artificial Sequence
  Description of Artificial Sequence: Synthetic polypeptide
DEEEIRTTNPVATEQYGSVSTVTNLQAGNQAGTDEEED

SEQ ID NO: 118878 - protein, 34 aa, Artificial Sequence
  Description of Artificial Sequence: Synthetic polypeptide
DEDEIATTNPVAYEQYGQSTVATNDLTQDGMGRI

SEQ ID NO: 118879 - protein, 34 aa, Artificial Sequence
  Description of Artificial Sequence: Synthetic polypeptide
DEEEIRTTNPVATEQYGCVCSTEETQNFGSETQS

SEQ ID NO: 118880 - protein, 35 aa, Artificial Sequence
  Description of Artificial Sequence: Synthetic polypeptide
DEEEIRTTNPVATEQYGCSCSTGNPLQENFISDQS

SEQ ID NO: 118881 - protein, 34 aa, Artificial Sequence
  Description of Artificial Sequence: Synthetic polypeptide
DEEEIRTTNPVAYEQYGCVCSTGNHQNFGSDTQL

SEQ ID NO: 118882 - protein, 35 aa, Artificial Sequence
  Description of Artificial Sequence: Synthetic polypeptide
DEEEIRTTNPVATEPYGSVSTTPAGPNMRNGMNPV

SEQ ID NO: 118883 - protein, 33 aa, Artificial Sequence
  Description of Artificial Sequence: Synthetic polypeptide
DEEEIRTTNPVAYEQYGCVCSTGPHQNFISNQS

SEQ ID NO: 118884 - protein, 34 aa, Artificial Sequence
  Description of Artificial Sequence: Synthetic polypeptide
DEEEIRTTNPVATEQYGCVCSTEDTNQNFGSDQS

SEQ ID NO: 118885 - protein, 31 aa, Artificial Sequence
  Description of Artificial Sequence: Synthetic polypeptide
DEDEICTTNPTAYAQYGSVATNGQGAGGNDM

SEQ ID NO: 118886 - protein, 34 aa, Artificial Sequence
  Description of Artificial Sequence: Synthetic polypeptide
DEEEIRTTNPVATEQYGCQVCSTGEHQNFGSEQG

SEQ ID NO: 118887 - protein, 34 aa, Artificial Sequence
  Description of Artificial Sequence: Synthetic polypeptide
DEEEIRTTNPVATEQYGCVCSTEDPNQNFNSNQS

SEQ ID NO: 118888 - protein, 34 aa, Artificial Sequence
  Description of Artificial Sequence: Synthetic polypeptide
DEEEIRTTNPVATEQYGCVCSTEDPNQGFGSEQS

SEQ ID NO: 118889 - protein, 36 aa, Artificial Sequence
  Description of Artificial Sequence: Synthetic polypeptide
DEEEIRTTNPVATEQYGCVCSMTGELNQFFGSENQA

SEQ ID NO: 118890 - protein, 34 aa, Artificial Sequence
  Description of Artificial Sequence: Synthetic polypeptide
DEEEIRTTNPVATEQYGCQVCSTGEHQNFGSDQQ

SEQ ID NO: 118891 - protein, 34 aa, Artificial Sequence
  Description of Artificial Sequence: Synthetic polypeptide
DEEEIRTTNPVATEPYGSVVDFENELTGGGENEE

SEQ ID NO: 118892 - protein, 32 aa, Artificial Sequence
  Description of Artificial Sequence: Synthetic polypeptide
DECEIATTNPVAYEQWGSTSTNLGMEDGNGAQ

SEQ ID NO: 118893 - protein, 35 aa, Artificial Sequence
  Description of Artificial Sequence: Synthetic polypeptide
DEEEIRTTNPVATEPYGSVVGFGNLNNQGGGNQGE

SEQ ID NO: 118894 - protein, 32 aa, Artificial Sequence
  Description of Artificial Sequence: Synthetic polypeptide
DEDEIATVNPVATEQYGCVAATNLATMTGGNH

SEQ ID NO: 118895 - protein, 32 aa, Artificial Sequence
  Description of Artificial Sequence: Synthetic polypeptide
DEDEIATVNPVATEQYGCVAATNLATAPAGNH

SEQ ID NO: 118896 - protein, 34 aa, Artificial Sequence
  Description of Artificial Sequence: Synthetic polypeptide
DEEEIRTTNPVATEQYGCVCSTEDLQNFTSETQS

SEQ ID NO: 118897 - protein, 35 aa, Artificial Sequence
  Description of Artificial Sequence: Synthetic polypeptide
DEEEIRTTNPVATEQYGCVCSTEDLQEGFGSDTQS

SEQ ID NO: 118898 - protein, 34 aa, Artificial Sequence
  Description of Artificial Sequence: Synthetic polypeptide
DEEEIRTTNPVAYEQYGCVCSTGNHQFFNSDFQS

SEQ ID NO: 118899 - protein, 35 aa, Artificial Sequence
  Description of Artificial Sequence: Synthetic polypeptide
DEEEIRTTNPVATEQYGCVCSTEEAHQEFFGSNQA

SEQ ID NO: 118900 - protein, 36 aa, Artificial Sequence
  Description of Artificial Sequence: Synthetic polypeptide
DEEEIRTTNPVATEQYGCQVCSTGELQENFGSENQA

SEQ ID NO: 118901 - protein, 37 aa, Artificial Sequence
  Description of Artificial Sequence: Synthetic polypeptide
DEEEIRTTNPVATEQYGSVSTVNNNQQGNNQQQNTEE

SEQ ID NO: 118902 - protein, 35 aa, Artificial Sequence
  Description of Artificial Sequence: Synthetic polypeptide
DEEEIRTTNPVATEQYGCVCSTEEDLQEHFGSDQA

SEQ ID NO: 118903 - protein, 37 aa, Artificial Sequence
  Description of Artificial Sequence: Synthetic polypeptide
DEEEIRTTNPVATEQYGSVSTVNNNQQQQGNNNDETN

SEQ ID NO: 118904 - protein, 33 aa, Artificial Sequence
  Description of Artificial Sequence: Synthetic polypeptide
DEEEIRTTNPVAYEQYGCVCSTEEHQSFGSDQM

SEQ ID NO: 118905 - protein, 34 aa, Artificial Sequence
  Description of Artificial Sequence: Synthetic polypeptide
DEEEIRTTNPVAYEQYGCVCSTEEPHQNFGSNQL

SEQ ID NO: 118906 - protein, 33 aa, Artificial Sequence
  Description of Artificial Sequence: Synthetic polypeptide
DECEIATTNPVAYEQWGCVSTTNMLGNSGENDR

SEQ ID NO: 118907 - protein, 33 aa, Artificial Sequence
  Description of Artificial Sequence: Synthetic polypeptide
DEEEIRTTNPVAYEQYGCVCSTEEPQNFGSDDS

SEQ ID NO: 118908 - protein, 34 aa, Artificial Sequence
  Description of Artificial Sequence: Synthetic polypeptide
DEEEIRTTNPVAYEQYGCVCSTEHNQNFGSNFQS

SEQ ID NO: 118909 - protein, 37 aa, Artificial Sequence
  Description of Artificial Sequence: Synthetic polypeptide
DEEEIRTTNPVATEQYGSVSTVNNNQQQLGTETGTNG

SEQ ID NO: 118910 - protein, 33 aa, Artificial Sequence
  Description of Artificial Sequence: Synthetic polypeptide
DEEEIRTTNPVATEQYGCVCSTEDLANFISEQS

SEQ ID NO: 118911 - protein, 35 aa, Artificial Sequence
  Description of Artificial Sequence: Synthetic polypeptide
DEEEIRTTNPVATEQYGCVCSTEEDLNQFFGSDQT

SEQ ID NO: 118912 - protein, 36 aa, Artificial Sequence
  Description of Artificial Sequence: Synthetic polypeptide
DEEEIRTTNPVATEAYGVVSTTNQQLQLQQGTTNED

SEQ ID NO: 118913 - protein, 37 aa, Artificial Sequence
  Description of Artificial Sequence: Synthetic polypeptide
DEEEIRTTNPVATEQYGSVSTVNNNQQGTTNQETEED

SEQ ID NO: 118914 - protein, 33 aa, Artificial Sequence
  Description of Artificial Sequence: Synthetic polypeptide
DEDEICTTNPVATEQYGTVSVVTDGPVEQEGND

SEQ ID NO: 118915 - protein, 33 aa, Artificial Sequence
  Description of Artificial Sequence: Synthetic polypeptide
DEEEIRTTNPVAYEQYGCVCSTGEDQFFGSDQS

SEQ ID NO: 118916 - protein, 34 aa, Artificial Sequence
  Description of Artificial Sequence: Synthetic polypeptide
DEAEIRTTNPVAYEQWGSVCSTNDNQSNDGDNNM

SEQ ID NO: 118917 - protein, 37 aa, Artificial Sequence
  Description of Artificial Sequence: Synthetic polypeptide
DEEEIRTTNPVATEQYGSVSTVNNNQQGTNAEETEED

SEQ ID NO: 118918 - protein, 33 aa, Artificial Sequence
  Description of Artificial Sequence: Synthetic polypeptide
DEAEIRTTNPVAYEQWGSVCSTNDNHEDIGDNS

SEQ ID NO: 118919 - protein, 34 aa, Artificial Sequence
  Description of Artificial Sequence: Synthetic polypeptide
DEEEIRTTNPVATEQYGCQVCSTGEPQNFNSEQA

SEQ ID NO: 118920 - protein, 33 aa, Artificial Sequence
  Description of Artificial Sequence: Synthetic polypeptide
DEEEIRTTNPVAYEQYGCVCSTEPQENFGSEQS

SEQ ID NO: 118921 - protein, 34 aa, Artificial Sequence
  Description of Artificial Sequence: Synthetic polypeptide
DEEEIRTTNPVAYEQYGCVCSTEEHNQGFGSNQS

SEQ ID NO: 118922 - protein, 34 aa, Artificial Sequence
  Description of Artificial Sequence: Synthetic polypeptide
DEEEIRTTNPVATEQYGCVCSTEDHQNSISNNQS

SEQ ID NO: 118923 - protein, 34 aa, Artificial Sequence
  Description of Artificial Sequence: Synthetic polypeptide
DEEEIRTTNPVATEQYGCVCSTEDHQNFGSDFQS

SEQ ID NO: 118924 - protein, 34 aa, Artificial Sequence
  Description of Artificial Sequence: Synthetic polypeptide
DEDEIATTNPVAYEQYGVSVPAANGDLDQAGNQR

SEQ ID NO: 118925 - protein, 32 aa, Artificial Sequence
  Description of Artificial Sequence: Synthetic polypeptide
DECSIMTTNPVATECYGSVNENTLWERIGNNM

SEQ ID NO: 118926 - protein, 35 aa, Artificial Sequence
  Description of Artificial Sequence: Synthetic polypeptide
DEEEIRTTNPVATEFYGSVSNTNNMDEFNGGNDEQ

SEQ ID NO: 118927 - protein, 35 aa, Artificial Sequence
  Description of Artificial Sequence: Synthetic polypeptide
DEEEIRTTNPVATEPYGTVPSCTGNESSQDVGDER

SEQ ID NO: 118928 - protein, 35 aa, Artificial Sequence
  Description of Artificial Sequence: Synthetic polypeptide
DEEEIRTTNPVATEFYGSVSNTDNMDNGGGQTNLE

SEQ ID NO: 118929 - protein, 35 aa, Artificial Sequence
  Description of Artificial Sequence: Synthetic polypeptide
DEEEIRTTNPVATEQYGCVCSTEDHNQEFFGSNQT

SEQ ID NO: 118930 - protein, 34 aa, Artificial Sequence
  Description of Artificial Sequence: Synthetic polypeptide
DEEEIRTTNPVAYEQYGCVCSTTEDHQNFGSNQA

SEQ ID NO: 118931 - protein, 35 aa, Artificial Sequence
  Description of Artificial Sequence: Synthetic polypeptide
DEEEIRTTNPVATEQYGCVCSTEDHNQEFFGSENQ

SEQ ID NO: 118932 - protein, 34 aa, Artificial Sequence
  Description of Artificial Sequence: Synthetic polypeptide
DEEEIRTTNPVATEQYGCVCSTEDHIEGFGSNQS

SEQ ID NO: 118933 - protein, 35 aa, Artificial Sequence
  Description of Artificial Sequence: Synthetic polypeptide
DEEEIRTTNPVATEQYGCVCSMTMEHQHFGSENQS

SEQ ID NO: 118934 - protein, 33 aa, Artificial Sequence
  Description of Artificial Sequence: Synthetic polypeptide
DEEEIRTTNPVATEQYGCVCSTEDHAHFGSEQA

SEQ ID NO: 118935 - protein, 33 aa, Artificial Sequence
  Description of Artificial Sequence: Synthetic polypeptide
DEEEIRTTNPVATEQYGCVCSTEDENFGSDTDG

SEQ ID NO: 118936 - protein, 34 aa, Artificial Sequence
  Description of Artificial Sequence: Synthetic polypeptide
DEEEIRTTNPVATEQYGCVCSTEDDQGFGSETQA

SEQ ID NO: 118937 - protein, 34 aa, Artificial Sequence
  Description of Artificial Sequence: Synthetic polypeptide
DEEEIRTTNPVATEQYGCVCSTEDDQENFGSDQP

SEQ ID NO: 118938 - protein, 35 aa, Artificial Sequence
  Description of Artificial Sequence: Synthetic polypeptide
DEEEIRTTNPVATEQYGSVSTDSTGQETQEQNDEL

SEQ ID NO: 118939 - protein, 32 aa, Artificial Sequence
  Description of Artificial Sequence: Synthetic polypeptide
DECPIRTTNPVATEQYSEEVSTENLEQETQEK

SEQ ID NO: 118940 - protein, 32 aa, Artificial Sequence
  Description of Artificial Sequence: Synthetic polypeptide
DECFIATTNPVATEQYGSVSATDLEDHEGEDL

SEQ ID NO: 118941 - protein, 35 aa, Artificial Sequence
  Description of Artificial Sequence: Synthetic polypeptide
DEDEIATTNPVAYEQYGVSVPAIATGDLDQRGNQR

SEQ ID NO: 118942 - protein, 36 aa, Artificial Sequence
  Description of Artificial Sequence: Synthetic polypeptide
DEEEIRTTNPVATEQYGSVSTDPMPLAIRTENEIEQ

SEQ ID NO: 118943 - protein, 32 aa, Artificial Sequence
  Description of Artificial Sequence: Synthetic polypeptide
DECSIMTTNPVATECYGSVNETTLERIGNNME

SEQ ID NO: 118944 - protein, 35 aa, Artificial Sequence
  Description of Artificial Sequence: Synthetic polypeptide
DEEEIRTTNPVATEQYGSVSTNMMSPEPQNFMDQV

SEQ ID NO: 118945 - protein, 33 aa, Artificial Sequence
  Description of Artificial Sequence: Synthetic polypeptide
DEAEIRTTNPVAYEQWGSVCSTGDGDRQDGDRR

SEQ ID NO: 118946 - protein, 34 aa, Artificial Sequence
  Description of Artificial Sequence: Synthetic polypeptide
DEEEIRTTNPVATEAYGSVYGTTGMGQGGNNQEI

SEQ ID NO: 118947 - protein, 35 aa, Artificial Sequence
  Description of Artificial Sequence: Synthetic polypeptide
DEEEIRTTNPVATEQYGCVCSMTGNLQEFFPSEQS

SEQ ID NO: 118948 - protein, 34 aa, Artificial Sequence
  Description of Artificial Sequence: Synthetic polypeptide
DEEEIRTTNPVATEQYGCVCSTEDHQEHFGSDQA

SEQ ID NO: 118949 - protein, 34 aa, Artificial Sequence
  Description of Artificial Sequence: Synthetic polypeptide
DEEEIRTTNPVATEPYGSVVGFGNLNNQGGGQDG

SEQ ID NO: 118950 - protein, 35 aa, Artificial Sequence
  Description of Artificial Sequence: Synthetic polypeptide
DEEEIRTTNPVATEQYGCVCSTEDHQEGFGSDNQD

SEQ ID NO: 118951 - protein, 32 aa, Artificial Sequence
  Description of Artificial Sequence: Synthetic polypeptide
DECEIATTNPVAYEQWGSVSCNGLMMEDGNTQ

SEQ ID NO: 118952 - protein, 35 aa, Artificial Sequence
  Description of Artificial Sequence: Synthetic polypeptide
DEEEIRTTNPVATEQYGCVCSTEDHQEFSGSDNQT

SEQ ID NO: 118953 - protein, 33 aa, Artificial Sequence
  Description of Artificial Sequence: Synthetic polypeptide
DEEEIRTTNPVATEQYGCVCSTEDHQNFSSQQE

SEQ ID NO: 118954 - protein, 29 aa, Artificial Sequence
  Description of Artificial Sequence: Synthetic peptide
DEDEIATTNPVAYERWGVTSTNDQHNGDA

SEQ ID NO: 118955 - protein, 33 aa, Artificial Sequence
  Description of Artificial Sequence: Synthetic polypeptide
DEAEIRTTNPVAYEQWGSVCSTGDDGTRQDGDR

SEQ ID NO: 118956 - protein, 33 aa, Artificial Sequence
  Description of Artificial Sequence: Synthetic polypeptide
DEAEIRTTNPVAYEQWGSVCSTGDDGRQDGDRN

SEQ ID NO: 118957 - protein, 35 aa, Artificial Sequence
  Description of Artificial Sequence: Synthetic polypeptide
DEEEIRTTNPVATEQYGCVCSTEDHNQNFGSDNQA

SEQ ID NO: 118958 - protein, 34 aa, Artificial Sequence
  Description of Artificial Sequence: Synthetic polypeptide
DECEIATTNPVAYEQWGSVSCTDNLQDGGHNGAQ

SEQ ID NO: 118959 - protein, 33 aa, Artificial Sequence
  Description of Artificial Sequence: Synthetic polypeptide
DECSIMTTNPVATECYGSVNTNTLERIGVNNME

SEQ ID NO: 118960 - protein, 32 aa, Artificial Sequence
  Description of Artificial Sequence: Synthetic polypeptide
DECSIMTTNPVATECYGSVNTDNTLETGNNME

SEQ ID NO: 118961 - protein, 32 aa, Artificial Sequence
  Description of Artificial Sequence: Synthetic polypeptide
DECEIATTNPVAYEQWGSVSHNLNMGEDGNTQ

SEQ ID NO: 118962 - protein, 34 aa, Artificial Sequence
  Description of Artificial Sequence: Synthetic polypeptide
DEEEIRTTNPVATEQYGCQVCSTEDHQNFGSEQS

SEQ ID NO: 118963 - protein, 35 aa, Artificial Sequence
  Description of Artificial Sequence: Synthetic polypeptide
DEEEIRTTNPVATEQYGCVCSTEDHNQYFGSENQS

SEQ ID NO: 118964 - protein, 31 aa, Artificial Sequence
  Description of Artificial Sequence: Synthetic polypeptide
DECSIRTTNPLATEFFGSVSFELTQEGQNKN

SEQ ID NO: 118965 - protein, 35 aa, Artificial Sequence
  Description of Artificial Sequence: Synthetic polypeptide
DEEEIRTTNPVATEQYGCSCSMTENDNQNIGSDQA

SEQ ID NO: 118966 - protein, 34 aa, Artificial Sequence
  Description of Artificial Sequence: Synthetic polypeptide
DEEEIRTTNPVATEQYGCVCSTEEDQNFQSNFQS

SEQ ID NO: 118967 - protein, 34 aa, Artificial Sequence
  Description of Artificial Sequence: Synthetic polypeptide
DEEEIRTTNPVATEFYGVVPACTNEGSTEEGNNR

SEQ ID NO: 118968 - protein, 33 aa, Artificial Sequence
  Description of Artificial Sequence: Synthetic polypeptide
DEEEIRTTNPVATEQYGCVCSTEEHQSFISDTQ

SEQ ID NO: 118969 - protein, 37 aa, Artificial Sequence
  Description of Artificial Sequence: Synthetic polypeptide
DEEEIRTTNPVATEQYGSVSTVNQQAGNQQGTNEEED

SEQ ID NO: 118970 - protein, 34 aa, Artificial Sequence
  Description of Artificial Sequence: Synthetic polypeptide
DEEEIRTTNPVATEQYGCVCSTEEHQSFGSQTQM

SEQ ID NO: 118971 - protein, 37 aa, Artificial Sequence
  Description of Artificial Sequence: Synthetic polypeptide
DEEEIRTTNPVATEQYGSVSTVNQQAGNQNATEQGNE

SEQ ID NO: 118972 - protein, 32 aa, Artificial Sequence
  Description of Artificial Sequence: Synthetic polypeptide
DECEIATTNPVAYEGWGSVATNLQGDAGNNGQ

SEQ ID NO: 118973 - protein, 32 aa, Artificial Sequence
  Description of Artificial Sequence: Synthetic polypeptide
DECEIATTNPVAYEGWGSVATNLQGDAGNNMH

SEQ ID NO: 118974 - protein, 32 aa, Artificial Sequence
  Description of Artificial Sequence: Synthetic polypeptide
DECEIATTNPVAYEGWGSVATNLQGDHGNGSQ

SEQ ID NO: 118975 - protein, 35 aa, Artificial Sequence
  Description of Artificial Sequence: Synthetic polypeptide
DEEEIRTTNPVATEFYGVATSMTGNGLGQDEGNEQ

SEQ ID NO: 118976 - protein, 38 aa, Artificial Sequence
  Description of Artificial Sequence: Synthetic polypeptide
DEEEIRTTNPVATEQYGSVSTVNQNQLQQGTNQQGTTE

SEQ ID NO: 118977 - protein, 36 aa, Artificial Sequence
  Description of Artificial Sequence: Synthetic polypeptide
DEEEIRTTNPVATEQYGSVSTDNGLIGEFTGGETVN

SEQ ID NO: 118978 - protein, 33 aa, Artificial Sequence
  Description of Artificial Sequence: Synthetic polypeptide
DEEEIRTTNPVATEQYGCVCSTEEHQHFTSETQ

SEQ ID NO: 118979 - protein, 33 aa, Artificial Sequence
  Description of Artificial Sequence: Synthetic polypeptide
DEEEIRTTNPVATEQYGCVCSTEEHQHFTSDQG

SEQ ID NO: 118980 - protein, 32 aa, Artificial Sequence
  Description of Artificial Sequence: Synthetic polypeptide
DEDEIRATNPVAYEQWGVVSGWNDHQQGGVNR

SEQ ID NO: 118981 - protein, 34 aa, Artificial Sequence
  Description of Artificial Sequence: Synthetic polypeptide
DEEEIRTTNPVATEQYGCVCSTEEHQESFGSQQS

SEQ ID NO: 118982 - protein, 34 aa, Artificial Sequence
  Description of Artificial Sequence: Synthetic polypeptide
DEEEIRTTNPVATEQYGCVCSMTGEHIYFGSNQA

SEQ ID NO: 118983 - protein, 35 aa, Artificial Sequence
  Description of Artificial Sequence: Synthetic polypeptide
DEEEIRTTNPVATEPYGSVSSTPAGPNMRNGMNPV

SEQ ID NO: 118984 - protein, 34 aa, Artificial Sequence
  Description of Artificial Sequence: Synthetic polypeptide
DECTICTTNPVATEQWGSVSTTNQQLQQGNNTEN

SEQ ID NO: 118985 - protein, 34 aa, Artificial Sequence
  Description of Artificial Sequence: Synthetic polypeptide
DEEEIRTTNPVATEFYGVVSNMTDEMQEGGTNDN

SEQ ID NO: 118986 - protein, 36 aa, Artificial Sequence
  Description of Artificial Sequence: Synthetic polypeptide
DEEEIRTTNPVATEQYGCVCSTEELDQENFGSENQP

SEQ ID NO: 118987 - protein, 36 aa, Artificial Sequence
  Description of Artificial Sequence: Synthetic polypeptide
DEEEIRTTNPVATEQYGSVSTVNQQAGTEQGTTDTE

SEQ ID NO: 118988 - protein, 34 aa, Artificial Sequence
  Description of Artificial Sequence: Synthetic polypeptide
DEEEIRTTNPVATEQYGCVCSMTGEHEQNFGSVQ

SEQ ID NO: 118989 - protein, 34 aa, Artificial Sequence
  Description of Artificial Sequence: Synthetic polypeptide
DEEEIRTTNPVAYEQYGCVCSNTGELQNFGSQQG

SEQ ID NO: 118990 - protein, 37 aa, Artificial Sequence
  Description of Artificial Sequence: Synthetic polypeptide
DEEEIRTTNPVATEQYGSVSTVNQQQGNNQQGTEEDE

SEQ ID NO: 118991 - protein, 37 aa, Artificial Sequence
  Description of Artificial Sequence: Synthetic polypeptide
DEEEIRTTNPVATEQYGSVSTVNQQQGNNQQGNDDET

SEQ ID NO: 118992 - protein, 37 aa, Artificial Sequence
  Description of Artificial Sequence: Synthetic polypeptide
DEEEIRTTNPVATEQYGSVSTVNQQQGNNNQQGNTEG

SEQ ID NO: 118993 - protein, 37 aa, Artificial Sequence
  Description of Artificial Sequence: Synthetic polypeptide
DEEEIRTTNPVATEQYGSVSTVNQQQGNNNNDEEDED

SEQ ID NO: 118994 - protein, 34 aa, Artificial Sequence
  Description of Artificial Sequence: Synthetic polypeptide
DEEEIRTTNPVATEQYGCVCSTEEPHQYFGSEQL

SEQ ID NO: 118995 - protein, 37 aa, Artificial Sequence
  Description of Artificial Sequence: Synthetic polypeptide
DEEEIRTTNPVATEQYGSVSTVNQQQGNGNQNEEDED

SEQ ID NO: 118996 - protein, 34 aa, Artificial Sequence
  Description of Artificial Sequence: Synthetic polypeptide
DEEEIRTTNPVATEQYGCVCSTEEHQEHFNSDQA

SEQ ID NO: 118997 - protein, 36 aa, Artificial Sequence
  Description of Artificial Sequence: Synthetic polypeptide
DEEEIRTTNPVATEQYGSVSTVNQQLQQNEEETTTT

SEQ ID NO: 118998 - protein, 34 aa, Artificial Sequence
  Description of Artificial Sequence: Synthetic polypeptide
DEAEIRTTNPVAYEQWGSVCSTWNGDDHDGGNRS

SEQ ID NO: 118999 - protein, 32 aa, Artificial Sequence
  Description of Artificial Sequence: Synthetic polypeptide
DECEIATTNPVAYEGWGSVATNEGNQNDGNTR

SEQ ID NO: 119000 - protein, 33 aa, Artificial Sequence
  Description of Artificial Sequence: Synthetic polypeptide
DECEIATTNPVAYEGWGSVATNLQGDAGNGRQD

SEQ ID NO: 119001 - protein, 34 aa, Artificial Sequence
  Description of Artificial Sequence: Synthetic polypeptide
DEEEIRTTNPVATEAYGSVTGTINELSVIIPAKR

SEQ ID NO: 119002 - protein, 35 aa, Artificial Sequence
  Description of Artificial Sequence: Synthetic polypeptide
DEAEIRTTNPVAYEQWGSVCSTWGGNMQDQGGNDR

SEQ ID NO: 119003 - protein, 35 aa, Artificial Sequence
  Description of Artificial Sequence: Synthetic polypeptide
DEEEIRTTNPVATEQYGCVCSTEELQENFQSNNQS

SEQ ID NO: 119004 - protein, 37 aa, Artificial Sequence
  Description of Artificial Sequence: Synthetic polypeptide
DEEEIRTTNPVATEQYGSVSTVNQQGNNNQQGNDEDE

SEQ ID NO: 119005 - protein, 37 aa, Artificial Sequence
  Description of Artificial Sequence: Synthetic polypeptide
DEEEIRTTNPVATEQYGSVSTVNQQAGTNEQGTSTND

SEQ ID NO: 119006 - protein, 34 aa, Artificial Sequence
  Description of Artificial Sequence: Synthetic polypeptide
DEEEIRTTNPVATEQYGCSCSTGEPPQYFNSNQS

SEQ ID NO: 119007 - protein, 34 aa, Artificial Sequence
  Description of Artificial Sequence: Synthetic polypeptide
DEEEIRTTNPVATEQYGCVCSTEEHQEGFQSEQA

SEQ ID NO: 119008 - protein, 35 aa, Artificial Sequence
  Description of Artificial Sequence: Synthetic polypeptide
DEEEIRTTNPVATEQYGCVCSTEEHQEFSGSNNQT

SEQ ID NO: 119009 - protein, 34 aa, Artificial Sequence
  Description of Artificial Sequence: Synthetic polypeptide
DEEEIRTTNPVATEQYGCVCSTEEHNTNFGSDQA

SEQ ID NO: 119010 - protein, 33 aa, Artificial Sequence
  Description of Artificial Sequence: Synthetic polypeptide
DEEEIRTTNPVATEQYGCVCSTEEHEHFGSDQL

SEQ ID NO: 119011 - protein, 33 aa, Artificial Sequence
  Description of Artificial Sequence: Synthetic polypeptide
DECTICTTNPVATEQWGSVSTTNQGNQQGNNTQ

SEQ ID NO: 119012 - protein, 34 aa, Artificial Sequence
  Description of Artificial Sequence: Synthetic polypeptide
DEEEIRTTNPVATEFYGSVVTGGVNQGQQTGEGQ

SEQ ID NO: 119013 - protein, 33 aa, Artificial Sequence
  Description of Artificial Sequence: Synthetic polypeptide
DEEEIRTTNPVATEQYGCVCSTEEHAYFNSDQY

SEQ ID NO: 119014 - protein, 34 aa, Artificial Sequence
  Description of Artificial Sequence: Synthetic polypeptide
DEAEISCTNPVAYEQYGSVVQSANEQDRGGNNRN

SEQ ID NO: 119015 - protein, 32 aa, Artificial Sequence
  Description of Artificial Sequence: Synthetic polypeptide
DEEEIRTTNPVAYEQYGCVCSSEHQNFGSQQG

SEQ ID NO: 119016 - protein, 33 aa, Artificial Sequence
  Description of Artificial Sequence: Synthetic polypeptide
DECEIATTNPVAYEPWGSVSTTNLGGNAGENAR

SEQ ID NO: 119017 - protein, 34 aa, Artificial Sequence
  Description of Artificial Sequence: Synthetic polypeptide
DEEEIRTTNPVATEQYGCVCSTEEGHQSFGSDQN

SEQ ID NO: 119018 - protein, 33 aa, Artificial Sequence
  Description of Artificial Sequence: Synthetic polypeptide
DEEEIRTTNPVATEQYGCVCSTEEHENFGSDQS

SEQ ID NO: 119019 - protein, 33 aa, Artificial Sequence
  Description of Artificial Sequence: Synthetic polypeptide
DEEEIRTTNPVATEQYGCVCSTEEETGFGSEQS

SEQ ID NO: 119020 - protein, 33 aa, Artificial Sequence
  Description of Artificial Sequence: Synthetic polypeptide
DECTICTTNPVATEQWGSVSTTDGLQQGNNDEE

SEQ ID NO: 119021 - protein, 34 aa, Artificial Sequence
  Description of Artificial Sequence: Synthetic polypeptide
DEAEIRTTNPVAYEQWGSVCSTNDSGGHQGENMR

SEQ ID NO: 119022 - protein, 33 aa, Artificial Sequence
  Description of Artificial Sequence: Synthetic polypeptide
DECTEIATTNPCAYEQWGSVSTNLQGDHGNDAD

SEQ ID NO: 119023 - protein, 32 aa, Artificial Sequence
  Description of Artificial Sequence: Synthetic polypeptide
DEEEIRTTNPVAYEQYGCVCSTEDEGFNSEQA

SEQ ID NO: 119024 - protein, 33 aa, Artificial Sequence
  Description of Artificial Sequence: Synthetic polypeptide
DEAEIRTTNPVAYEQWGSVCSTNDQGDTQNGGT

SEQ ID NO: 119025 - protein, 35 aa, Artificial Sequence
  Description of Artificial Sequence: Synthetic polypeptide
DEEEIRTTNPVATEQYGCVCSMTGEHQRFGSETQA

SEQ ID NO: 119026 - protein, 37 aa, Artificial Sequence
  Description of Artificial Sequence: Synthetic polypeptide
DEEEIRTTNPVATEQYGSVSTVNNQISTTEQGTNNGN

SEQ ID NO: 119027 - protein, 34 aa, Artificial Sequence
  Description of Artificial Sequence: Synthetic polypeptide
DEAEIRTTNPVATEQYGSVSTTGMTAENGSGNQE

SEQ ID NO: 119028 - protein, 35 aa, Artificial Sequence
  Description of Artificial Sequence: Synthetic polypeptide
DEEEIRTTNPVATEQYGCVCSTEEDTQNFGSNFQP

SEQ ID NO: 119029 - protein, 33 aa, Artificial Sequence
  Description of Artificial Sequence: Synthetic polypeptide
DEEEIRTTNPVATEQYGCVCSTEETAGFGSDQT

SEQ ID NO: 119030 - protein, 34 aa, Artificial Sequence
  Description of Artificial Sequence: Synthetic polypeptide
DEEEIRTTNPVATEQYGCVCSTEEHEQYFGSDQN

SEQ ID NO: 119031 - protein, 33 aa, Artificial Sequence
  Description of Artificial Sequence: Synthetic polypeptide
DEEEIRTTNPVAYEQYGCVCSSEHQNFGSNNQS

SEQ ID NO: 119032 - protein, 33 aa, Artificial Sequence
  Description of Artificial Sequence: Synthetic polypeptide
DEAEIRTTNPVAYEQWGSVCSTTDQGDYQNGNA

SEQ ID NO: 119033 - protein, 34 aa, Artificial Sequence
  Description of Artificial Sequence: Synthetic polypeptide
DEEEIRTTNPVATEQYGCVCSMTGEHNQFFGSQQ

SEQ ID NO: 119034 - protein, 36 aa, Artificial Sequence
  Description of Artificial Sequence: Synthetic polypeptide
DEEEIRTTNPVATEPYGSVSSTTPAGPQQRNGMNPV

SEQ ID NO: 119035 - protein, 34 aa, Artificial Sequence
  Description of Artificial Sequence: Synthetic polypeptide
DEEEIRTTNPVATEQYGCVCSTEEHNQHFNSDQS

SEQ ID NO: 119036 - protein, 34 aa, Artificial Sequence
  Description of Artificial Sequence: Synthetic polypeptide
DEEEIRTTNPVAYEQYGQCVCSTEHQEYFGSNQS

SEQ ID NO: 119037 - protein, 35 aa, Artificial Sequence
  Description of Artificial Sequence: Synthetic polypeptide
DEAEIRTTNPVATEQYGSVSTNNTNQTQEGQEDTM

SEQ ID NO: 119038 - protein, 35 aa, Artificial Sequence
  Description of Artificial Sequence: Synthetic polypeptide
DEAEIRTTNPVATEQYGSVSTPWGDSQQEGGNEHI

SEQ ID NO: 119039 - protein, 33 aa, Artificial Sequence
  Description of Artificial Sequence: Synthetic polypeptide
DEDEIETTNPVATECWGSVSCINEPQDREGENG

SEQ ID NO: 119040 - protein, 34 aa, Artificial Sequence
  Description of Artificial Sequence: Synthetic polypeptide
DEAEIRTTNPVAYEQWGSVCSTNDTQGEGQNGND

SEQ ID NO: 119041 - protein, 32 aa, Artificial Sequence
  Description of Artificial Sequence: Synthetic polypeptide
DECEIATTNPVAYEGWGSVSCNNLQDGGHNQQ

SEQ ID NO: 119042 - protein, 34 aa, Artificial Sequence
  Description of Artificial Sequence: Synthetic polypeptide
DEEEIRTTNPVATEQYGCVCSTEEHNINFGSDQA

SEQ ID NO: 119043 - protein, 33 aa, Artificial Sequence
  Description of Artificial Sequence: Synthetic polypeptide
DEAEIRTTNPVATEQYGSVSTPYADIEGLEEPQ

SEQ ID NO: 119044 - protein, 35 aa, Artificial Sequence
  Description of Artificial Sequence: Synthetic polypeptide
DEEEIRTTNPVAYEQYGQCVCSTENDHNQRGSDQQ

SEQ ID NO: 119045 - protein, 33 aa, Artificial Sequence
  Description of Artificial Sequence: Synthetic polypeptide
DEEEIRTTNPVATEQYGCVCSTEEHINFGSQQV

SEQ ID NO: 119046 - protein, 36 aa, Artificial Sequence
  Description of Artificial Sequence: Synthetic polypeptide
DEEEIRTTNPVATEQYGSVSTVNNQQQQNDEETTTE

SEQ ID NO: 119047 - protein, 32 aa, Artificial Sequence
  Description of Artificial Sequence: Synthetic polypeptide
DECEIATTNPVAYEHWGTVSTNLQGDAGNNQH

SEQ ID NO: 119048 - protein, 34 aa, Artificial Sequence
  Description of Artificial Sequence: Synthetic polypeptide
DEAEIRTTNPVAYEQWGSVCSTQDLQINDGDGNM

SEQ ID NO: 119049 - protein, 33 aa, Artificial Sequence
  Description of Artificial Sequence: Synthetic polypeptide
DEAEIRTTNPVAYEQWGSVCSTPNGDTMGNNEV

SEQ ID NO: 119050 - protein, 33 aa, Artificial Sequence
  Description of Artificial Sequence: Synthetic polypeptide
DECEIATTNPVAYEGWGSVSTSNQGNQNNGNNR

SEQ ID NO: 119051 - protein, 33 aa, Artificial Sequence
  Description of Artificial Sequence: Synthetic polypeptide
DECTICTTNPVATEQYGVVSTTTNPQTGTNDED

SEQ ID NO: 119052 - protein, 34 aa, Artificial Sequence
  Description of Artificial Sequence: Synthetic polypeptide
DEAEIRTTNPVATEQYGSVSVTPTHQETFNTNGE

SEQ ID NO: 119053 - protein, 33 aa, Artificial Sequence
  Description of Artificial Sequence: Synthetic polypeptide
DEDEIATTNPVATEAYGVVCSTNDGQDQGTNNQ

SEQ ID NO: 119054 - protein, 35 aa, Artificial Sequence
  Description of Artificial Sequence: Synthetic polypeptide
DEEEIRTTNPVATEQYGSVSTTNMMMQESLEEEVN

SEQ ID NO: 119055 - protein, 36 aa, Artificial Sequence
  Description of Artificial Sequence: Synthetic polypeptide
DEEEIRTTNPVATEQYGSVSTTTNAGANAENGTNPV

SEQ ID NO: 119056 - protein, 36 aa, Artificial Sequence
  Description of Artificial Sequence: Synthetic polypeptide
DEEEIRTTNPVATEQYGSVSTTNMMQQESNGEEEVE

SEQ ID NO: 119057 - protein, 33 aa, Artificial Sequence
  Description of Artificial Sequence: Synthetic polypeptide
DEEEIRTTNPVATECWGMHCWTMNEQEQRGNFD

SEQ ID NO: 119058 - protein, 31 aa, Artificial Sequence
  Description of Artificial Sequence: Synthetic polypeptide
DDSEVRTTNPVATEQYGNVSANTEMSRVEDR

SEQ ID NO: 119059 - protein, 33 aa, Artificial Sequence
  Description of Artificial Sequence: Synthetic polypeptide
DEEEIRTTNPVATEQWGSVSTEPIENNAAEMDA

SEQ ID NO: 119060 - protein, 31 aa, Artificial Sequence
  Description of Artificial Sequence: Synthetic polypeptide
DEEEIRTTNPVATECWGMHCWTMNEQDRNMQ

SEQ ID NO: 119061 - protein, 34 aa, Artificial Sequence
  Description of Artificial Sequence: Synthetic polypeptide
DEEEIRTTNPVATEAYGTVSTSQTNTEQGSNNNF

SEQ ID NO: 119062 - protein, 36 aa, Artificial Sequence
  Description of Artificial Sequence: Synthetic polypeptide
DEEEIRTTNPVATEQYGCVCSNTNEHQEFFGSNTQV

SEQ ID NO: 119063 - protein, 36 aa, Artificial Sequence
  Description of Artificial Sequence: Synthetic polypeptide
DEEEIRTTNPVAYEQYGQSVSPEFNDALITTGIENR

SEQ ID NO: 119064 - protein, 35 aa, Artificial Sequence
  Description of Artificial Sequence: Synthetic polypeptide
DEEEIRTTNPVATEQYGCVCSNTNDHQESFGSDQS

SEQ ID NO: 119065 - protein, 35 aa, Artificial Sequence
  Description of Artificial Sequence: Synthetic polypeptide
DEEEIRTTNPVATEQYGCVCSNTMELQEFFNSDQT

SEQ ID NO: 119066 - protein, 35 aa, Artificial Sequence
  Description of Artificial Sequence: Synthetic polypeptide
DEEEIRTTNPVATEQYGSVSTTTMNQEVALLELAV

SEQ ID NO: 119067 - protein, 34 aa, Artificial Sequence
  Description of Artificial Sequence: Synthetic polypeptide
DEEEIRTTNPVATEQYGCVCSNTEHQENMGSEQS

SEQ ID NO: 119068 - protein, 35 aa, Artificial Sequence
  Description of Artificial Sequence: Synthetic polypeptide
DEEEIRTTNPVAYEQYGQSVSNTVGLLQITTEQRQ

SEQ ID NO: 119069 - protein, 35 aa, Artificial Sequence
  Description of Artificial Sequence: Synthetic polypeptide
DEEEIRTTNPVAYEQYGQSVSNTVGLLQIEVGQFQ

SEQ ID NO: 119070 - protein, 34 aa, Artificial Sequence
  Description of Artificial Sequence: Synthetic polypeptide
DEAEIRTTNPVATEQYGSVWVTVALDERGSEHDM

SEQ ID NO: 119071 - protein, 36 aa, Artificial Sequence
  Description of Artificial Sequence: Synthetic polypeptide
DEEEIRTTNPVATEQYGSVSTTTNAGVNMENGTNNV

SEQ ID NO: 119072 - protein, 35 aa, Artificial Sequence
  Description of Artificial Sequence: Synthetic polypeptide
DEEEIRTTNPVATEQYGCVCSNTNHNQNFNSNNQL

SEQ ID NO: 119073 - protein, 31 aa, Artificial Sequence
  Description of Artificial Sequence: Synthetic polypeptide
DEEEIRTTNPVATECWGMHCWTMNEQHTNDE

SEQ ID NO: 119074 - protein, 35 aa, Artificial Sequence
  Description of Artificial Sequence: Synthetic polypeptide
DEEEIRTTNPVATEQYGCVCSNTNHQEYFGSETQS

SEQ ID NO: 119075 - protein, 36 aa, Artificial Sequence
  Description of Artificial Sequence: Synthetic polypeptide
DEEEIRTTNPVATEQWGSVSSTTPNGPNMREGMNPV

SEQ ID NO: 119076 - protein, 34 aa, Artificial Sequence
  Description of Artificial Sequence: Synthetic polypeptide
DEEEIRTTNPVATEQYGCVCSNTEHNQNFGSDDP

SEQ ID NO: 119077 - protein, 34 aa, Artificial Sequence
  Description of Artificial Sequence: Synthetic polypeptide
DEEEIRTTNPVATEQYGCVCSNTEHNQNFISNQS

SEQ ID NO: 119078 - protein, 36 aa, Artificial Sequence
  Description of Artificial Sequence: Synthetic polypeptide
DEEEIRTTNPVATEQYGSVSTTNMMEQESDGEEEVF

SEQ ID NO: 119079 - protein, 34 aa, Artificial Sequence
  Description of Artificial Sequence: Synthetic polypeptide
DEEEIRTTNPVATEQYGCVCSNTEHNQNFNSQQT

SEQ ID NO: 119080 - protein, 35 aa, Artificial Sequence
  Description of Artificial Sequence: Synthetic polypeptide
DEEEIRTTNPVATEQYGCVCSNTEHQEFFGSNTQE

SEQ ID NO: 119081 - protein, 35 aa, Artificial Sequence
  Description of Artificial Sequence: Synthetic polypeptide
DEEEIRTTNPVAYEQYGQSVCSSGNDLNQNGSQQS

SEQ ID NO: 119082 - protein, 38 aa, Artificial Sequence
  Description of Artificial Sequence: Synthetic polypeptide
DEEEIRTTNPVATEQYGSVSTTTNLQAGNQAGTNQEED

SEQ ID NO: 119083 - protein, 36 aa, Artificial Sequence
  Description of Artificial Sequence: Synthetic polypeptide
DEEEIRTTNPVAYEQYGQSVSNTVGLLQIEGVDQNE

SEQ ID NO: 119084 - protein, 35 aa, Artificial Sequence
  Description of Artificial Sequence: Synthetic polypeptide
DEEEIRTTNPVATEAYGTVSTSGTNLEQGNNNNQE

SEQ ID NO: 119085 - protein, 35 aa, Artificial Sequence
  Description of Artificial Sequence: Synthetic polypeptide
DEEEIRTTNPVAYEQYGQSVCSSNDHNQERFGSQQ

SEQ ID NO: 119086 - protein, 35 aa, Artificial Sequence
  Description of Artificial Sequence: Synthetic polypeptide
DEEEIRTTNPVATEQYGCVCSNTEHQEFGNSDTQE

SEQ ID NO: 119087 - protein, 35 aa, Artificial Sequence
  Description of Artificial Sequence: Synthetic polypeptide
DEEEIRTTNPVATEQYGCVCSNTEHQEGFGSQNQD

SEQ ID NO: 119088 - protein, 31 aa, Artificial Sequence
  Description of Artificial Sequence: Synthetic polypeptide
DEEEIRTTNPVATECWGMHCWTMNEQQDTNF

SEQ ID NO: 119089 - protein, 31 aa, Artificial Sequence
  Description of Artificial Sequence: Synthetic polypeptide
DDSEVRTTNPVATEQYGNVSANTEMNRVEDR

SEQ ID NO: 119090 - protein, 33 aa, Artificial Sequence
  Description of Artificial Sequence: Synthetic polypeptide
DEAEIRTTNPVATEQYGSVWVTPVEMEHGNEIE

SEQ ID NO: 119091 - protein, 34 aa, Artificial Sequence
  Description of Artificial Sequence: Synthetic polypeptide
DEAEIRTTNPVATEQYGSVWVTTVEMELGGNERE

SEQ ID NO: 119092 - protein, 37 aa, Artificial Sequence
  Description of Artificial Sequence: Synthetic polypeptide
DEEEIRTTNPVATEQYGSVSTNVATEQYGSVTNNTQE

SEQ ID NO: 119093 - protein, 38 aa, Artificial Sequence
  Description of Artificial Sequence: Synthetic polypeptide
DEEEIRTTNPVATEQYGSVSTTTNLNQANNQNGTNPVE

SEQ ID NO: 119094 - protein, 36 aa, Artificial Sequence
  Description of Artificial Sequence: Synthetic polypeptide
DEEEIRTTNPVATEQYGSVSTTTNPNQLQGEEDEEE

SEQ ID NO: 119095 - protein, 33 aa, Artificial Sequence
  Description of Artificial Sequence: Synthetic polypeptide
DEAEIRTTNPVATEQYGSVWVTVEMEEGGNEGE

SEQ ID NO: 119096 - protein, 34 aa, Artificial Sequence
  Description of Artificial Sequence: Synthetic polypeptide
DEEEIRTTNPVATEQYGCVCSNTMEHQNSGSDQP

SEQ ID NO: 119097 - protein, 34 aa, Artificial Sequence
  Description of Artificial Sequence: Synthetic polypeptide
DEEEIRTTNPVATEQWGSVTMTMLEQFMNSNDHQ

SEQ ID NO: 119098 - protein, 34 aa, Artificial Sequence
  Description of Artificial Sequence: Synthetic polypeptide
DEEEIRTTNPVATEQYGCVCSNTEHQYFNSDTQS

SEQ ID NO: 119099 - protein, 35 aa, Artificial Sequence
  Description of Artificial Sequence: Synthetic polypeptide
DEEEIRTTNPVATEQYGSVSTTNMMWTESGVEEVE

SEQ ID NO: 119100 - protein, 36 aa, Artificial Sequence
  Description of Artificial Sequence: Synthetic polypeptide
DEEEIRTTNPVATEQYGSVSTTTEAGTNTENGTNPV

SEQ ID NO: 119101 - protein, 36 aa, Artificial Sequence
  Description of Artificial Sequence: Synthetic polypeptide
DEEEIRTTNPVATEQYGSVSTTTDTLVQIPPLMNEM

SEQ ID NO: 119102 - protein, 34 aa, Artificial Sequence
  Description of Artificial Sequence: Synthetic polypeptide
DEEEIRTTNPVATEQYGAVNNLTVELEVQDNNQD

SEQ ID NO: 119103 - protein, 36 aa, Artificial Sequence
  Description of Artificial Sequence: Synthetic polypeptide
DEEEIRTTNPVATEQYGSVSTTTAAGVNGENGTNPV

SEQ ID NO: 119104 - protein, 31 aa, Artificial Sequence
  Description of Artificial Sequence: Synthetic polypeptide
DEAAIRTTNPVATEQYGCFCSTELINGSDQS

SEQ ID NO: 119105 - protein, 35 aa, Artificial Sequence
  Description of Artificial Sequence: Synthetic polypeptide
DEEEIRTTNPVATEQWGSVVNCTNSLSVIGGNLEG

SEQ ID NO: 119106 - protein, 35 aa, Artificial Sequence
  Description of Artificial Sequence: Synthetic polypeptide
DEEEIRTTNPVATEQYGCVCSNTELNQENFGSDQE

SEQ ID NO: 119107 - protein, 34 aa, Artificial Sequence
  Description of Artificial Sequence: Synthetic polypeptide
DEEEIRTTNPVATEQYGAVNDTNIQQDIGGQTEN

SEQ ID NO: 119108 - protein, 34 aa, Artificial Sequence
  Description of Artificial Sequence: Synthetic polypeptide
DECEICTTNPVATEQYGTVSTVTNGQQVEGEGND

SEQ ID NO: 119109 - protein, 32 aa, Artificial Sequence
  Description of Artificial Sequence: Synthetic polypeptide
DEEEIRTTNPVATEQYGAVNDDNFNGEMTNGQ

SEQ ID NO: 119110 - protein, 35 aa, Artificial Sequence
  Description of Artificial Sequence: Synthetic polypeptide
DEEEIRTTNPVATEQYGCVCSNTENHNQGFGSDQE

SEQ ID NO: 119111 - protein, 34 aa, Artificial Sequence
  Description of Artificial Sequence: Synthetic polypeptide
DEEEIRTTNPVATEQYGAVMTNDQFDEELEGEGG

SEQ ID NO: 119112 - protein, 37 aa, Artificial Sequence
  Description of Artificial Sequence: Synthetic polypeptide
DEEEIRTTNPVATEQYGSVSTTSQAGNNNQNGTNPEE

SEQ ID NO: 119113 - protein, 33 aa, Artificial Sequence
  Description of Artificial Sequence: Synthetic polypeptide
DEAEIRTTNPVATEQYGSVWVTVSLDERMEHDM

SEQ ID NO: 119114 - protein, 35 aa, Artificial Sequence
  Description of Artificial Sequence: Synthetic polypeptide
DEEEIRTTNPVATEQYGSVSTTNMMWSEEQEEELF

SEQ ID NO: 119115 - protein, 34 aa, Artificial Sequence
  Description of Artificial Sequence: Synthetic polypeptide
DEEEIRTTNPVATEAYGVVVVTTVNLQDETENNS

SEQ ID NO: 119116 - protein, 33 aa, Artificial Sequence
  Description of Artificial Sequence: Synthetic polypeptide
DEEEIRTTNPVATEQWGSVSTTPIENNAAEMDA

SEQ ID NO: 119117 - protein, 34 aa, Artificial Sequence
  Description of Artificial Sequence: Synthetic polypeptide
DEEEIRTTNPVATEQWGSVSTTPAEPNMRAGDPV

SEQ ID NO: 119118 - protein, 33 aa, Artificial Sequence
  Description of Artificial Sequence: Synthetic polypeptide
DEEEIRTTNPVATECWGMHCWTMNEGQRQDNHR

SEQ ID NO: 119119 - protein, 33 aa, Artificial Sequence
  Description of Artificial Sequence: Synthetic polypeptide
DEEEIRTTNPVAYEQYGITVNYTTELSGRGSYS

SEQ ID NO: 119120 - protein, 34 aa, Artificial Sequence
  Description of Artificial Sequence: Synthetic polypeptide
DEEEIRTTNPVATEQYGCVCSNTMEHQNFLSNQS

SEQ ID NO: 119121 - protein, 34 aa, Artificial Sequence
  Description of Artificial Sequence: Synthetic polypeptide
DEEEIRTTNPVATEQYGCVCSNTEHQEYFNSDQA

SEQ ID NO: 119122 - protein, 34 aa, Artificial Sequence
  Description of Artificial Sequence: Synthetic polypeptide
DEEEIRTTNPVATEQYGCVCSNTEHQFFGSETQY

SEQ ID NO: 119123 - protein, 34 aa, Artificial Sequence
  Description of Artificial Sequence: Synthetic polypeptide
DEEEIRTTNPVATEQYGCVCSNTEHQGFGSDTQT

SEQ ID NO: 119124 - protein, 33 aa, Artificial Sequence
  Description of Artificial Sequence: Synthetic polypeptide
DEEEIRTTNPVATEQYGCVCSNTEHQHSISDQP

SEQ ID NO: 119125 - protein, 36 aa, Artificial Sequence
  Description of Artificial Sequence: Synthetic polypeptide
DEEEIRTTNPVATEQYGSVSTTNMMWQEFWGEEEVF

SEQ ID NO: 119126 - protein, 34 aa, Artificial Sequence
  Description of Artificial Sequence: Synthetic polypeptide
DEEEIRTTNPVATEQYGCVCSNTEHQEYFGSDQA

SEQ ID NO: 119127 - protein, 35 aa, Artificial Sequence
  Description of Artificial Sequence: Synthetic polypeptide
DEEEIRTTNPVATEQYGSVSTTNMMWQESAEEEVP

SEQ ID NO: 119128 - protein, 33 aa, Artificial Sequence
  Description of Artificial Sequence: Synthetic polypeptide
DEAEIRTTNPVATEQYGSVWVTVEMEGPGNSIE

SEQ ID NO: 119129 - protein, 33 aa, Artificial Sequence
  Description of Artificial Sequence: Synthetic polypeptide
DEAEIRTTNPVATEQYGSVWVTVEMHEGGNLIE

SEQ ID NO: 119130 - protein, 34 aa, Artificial Sequence
  Description of Artificial Sequence: Synthetic polypeptide
DEEEIRTTNPVATEQYGCVCSNTEHQNSPSNNQS

SEQ ID NO: 119131 - protein, 34 aa, Artificial Sequence
  Description of Artificial Sequence: Synthetic polypeptide
DEAEIRTTNPVATEQYGSVWVTVLMEEGGNEFIE

SEQ ID NO: 119132 - protein, 35 aa, Artificial Sequence
  Description of Artificial Sequence: Synthetic polypeptide
DEEEIRTTNPVATEQYGSVSTTNMMWQESDEEEIF

SEQ ID NO: 119133 - protein, 33 aa, Artificial Sequence
  Description of Artificial Sequence: Synthetic polypeptide
DECEICTTNPVATEQYGTVSTVTDGNDEDEGND

SEQ ID NO: 119134 - protein, 36 aa, Artificial Sequence
  Description of Artificial Sequence: Synthetic polypeptide
DEEEIRTTNPVATEQYGSVSTTTGAGTNMENGNNNV

SEQ ID NO: 119135 - protein, 30 aa, Artificial Sequence
  Description of Artificial Sequence: Synthetic polypeptide
DEEEIRTTNPVATECWGEAPCVCQDRGEEK

SEQ ID NO: 119136 - protein, 32 aa, Artificial Sequence
  Description of Artificial Sequence: Synthetic polypeptide
DEEEIRTTNPVATECWGEVPCINEPQDREGEG

SEQ ID NO: 119137 - protein, 35 aa, Artificial Sequence
  Description of Artificial Sequence: Synthetic polypeptide
DEEEIRTTNPVATEQYGSVSTTSMQWQESGEEEVE

SEQ ID NO: 119138 - protein, 35 aa, Artificial Sequence
  Description of Artificial Sequence: Synthetic polypeptide
DEEEIRTTNPVATEQYGCVCSNTPELQENFNSEQA

SEQ ID NO: 119139 - protein, 34 aa, Artificial Sequence
  Description of Artificial Sequence: Synthetic polypeptide
DEEEIRTTNPVATEQYGCVCSNTEHNQHFNSDQF

SEQ ID NO: 119140 - protein, 35 aa, Artificial Sequence
  Description of Artificial Sequence: Synthetic polypeptide
DEEEIRTTNPVATEQWGSVSSNTPAGPNMRNGNPV

SEQ ID NO: 119141 - protein, 35 aa, Artificial Sequence
  Description of Artificial Sequence: Synthetic polypeptide
DEEEIRTTNPVATEQWGSVSSTCIAGPNMRNGMNV

SEQ ID NO: 119142 - protein, 36 aa, Artificial Sequence
  Description of Artificial Sequence: Synthetic polypeptide
DEEEIRTTNPVATEQYGSVSTTTQAGTNQLNGSNNV

SEQ ID NO: 119143 - protein, 35 aa, Artificial Sequence
  Description of Artificial Sequence: Synthetic polypeptide
DEEEIRTTNPVATEQYGAVSGGNGGQGGNDDGEED

SEQ ID NO: 119144 - protein, 36 aa, Artificial Sequence
  Description of Artificial Sequence: Synthetic polypeptide
DEEEIRTTNPVATEQYGSVSTTTQAGSTNANGNNPV

SEQ ID NO: 119145 - protein, 32 aa, Artificial Sequence
  Description of Artificial Sequence: Synthetic polypeptide
DEDEIATTNPVATEQYGSVCAATNEEADMPNG

SEQ ID NO: 119146 - protein, 35 aa, Artificial Sequence
  Description of Artificial Sequence: Synthetic polypeptide
DEEEIRTTNPVATEQWGSVSSTCPAGPNMRNGENV

SEQ ID NO: 119147 - protein, 34 aa, Artificial Sequence
  Description of Artificial Sequence: Synthetic polypeptide
DEEEIRTTNPVATEQYGCVCSNTEHFEGFNSDQS

SEQ ID NO: 119148 - protein, 34 aa, Artificial Sequence
  Description of Artificial Sequence: Synthetic polypeptide
DEEEIRTTNPVATEQYGCVCSNTEHIEFSGSNQP

SEQ ID NO: 119149 - protein, 35 aa, Artificial Sequence
  Description of Artificial Sequence: Synthetic polypeptide
DEEEIRTTNPVATEQWGSVSSTEPAGNMRNGMNPA

SEQ ID NO: 119150 - protein, 34 aa, Artificial Sequence
  Description of Artificial Sequence: Synthetic polypeptide
DEEEIRTTNPVATEQWGSVSSTEPIEMNAAGNPA

SEQ ID NO: 119151 - protein, 34 aa, Artificial Sequence
  Description of Artificial Sequence: Synthetic polypeptide
DEEEIRTTNPVATEQWGSVSSTEPIEMNANGNPA

SEQ ID NO: 119152 - protein, 36 aa, Artificial Sequence
  Description of Artificial Sequence: Synthetic polypeptide
DEEEIRTTNPVATEQYGSVSTTTQAGSNNANNNNTV

SEQ ID NO: 119153 - protein, 33 aa, Artificial Sequence
  Description of Artificial Sequence: Synthetic polypeptide
DEEEIRTTNPVATEQYGCVCSNWEDQNFNSDQS

SEQ ID NO: 119154 - protein, 35 aa, Artificial Sequence
  Description of Artificial Sequence: Synthetic polypeptide
DEEEIRTTNPVAYEQYGQSVSQGNDLLQPRSQIMG

SEQ ID NO: 119155 - protein, 34 aa, Artificial Sequence
  Description of Artificial Sequence: Synthetic polypeptide
DEEEIRTTNPVATEQWGSVSSTPAGPMMRAGMDV

SEQ ID NO: 119156 - protein, 35 aa, Artificial Sequence
  Description of Artificial Sequence: Synthetic polypeptide
DEEEIRTTNPVATEQWGSVSSTPAGPNDRNGENPG

SEQ ID NO: 119157 - protein, 33 aa, Artificial Sequence
  Description of Artificial Sequence: Synthetic polypeptide
DECEICTTNPVATTQYGVVSTTNANQQGTEGND

SEQ ID NO: 119158 - protein, 36 aa, Artificial Sequence
  Description of Artificial Sequence: Synthetic polypeptide
DEEEIRTTNPVATEQYGSVSTTTQAGTNSEQGTNPV

SEQ ID NO: 119159 - protein, 34 aa, Artificial Sequence
  Description of Artificial Sequence: Synthetic polypeptide
DEEEIRTTNPVATEQYGCVCSNTEHDQNFGSQQA

SEQ ID NO: 119160 - protein, 33 aa, Artificial Sequence
  Description of Artificial Sequence: Synthetic polypeptide
DEEEIRTTNPVATEQWGSVSSEAGPMNRAEMDA

SEQ ID NO: 119161 - protein, 36 aa, Artificial Sequence
  Description of Artificial Sequence: Synthetic polypeptide
DEEEIRTTNPVAYEQYGQSVSQLNVLLQPRGQISMG

SEQ ID NO: 119162 - protein, 35 aa, Artificial Sequence
  Description of Artificial Sequence: Synthetic polypeptide
DEEEIRTTNPVATEQYGCVCSNTEELNQNFNSEQF

SEQ ID NO: 119163 - protein, 34 aa, Artificial Sequence
  Description of Artificial Sequence: Synthetic polypeptide
DEEEIRTTNPVATEQWGSVSMSGNGGQPHGMPQF

SEQ ID NO: 119164 - protein, 35 aa, Artificial Sequence
  Description of Artificial Sequence: Synthetic polypeptide
DEEEIRTTNPVATEQYGCVCSNTEELQEFFGSEQE

SEQ ID NO: 119165 - protein, 35 aa, Artificial Sequence
  Description of Artificial Sequence: Synthetic polypeptide
DEEEIRTTNPVATEQYGSVSTMDTIEHDSGQNVDD

SEQ ID NO: 119166 - protein, 32 aa, Artificial Sequence
  Description of Artificial Sequence: Synthetic polypeptide
DEEEIRTTNPVATECWGMHCWTMNEQRTDNEA

SEQ ID NO: 119167 - protein, 36 aa, Artificial Sequence
  Description of Artificial Sequence: Synthetic polypeptide
DEEEIRTTNPVAYEQYGQSVSQGNDTLQPRGQISMG

SEQ ID NO: 119168 - protein, 32 aa, Artificial Sequence
  Description of Artificial Sequence: Synthetic polypeptide
DEDEIATTNPVAYEGWGTVSTNLQGDVGDNEH

SEQ ID NO: 119169 - protein, 34 aa, Artificial Sequence
  Description of Artificial Sequence: Synthetic polypeptide
DEEEIRTTNPVATEQYGCVCSNWEDQEFFGSNQS

SEQ ID NO: 119170 - protein, 34 aa, Artificial Sequence
  Description of Artificial Sequence: Synthetic polypeptide
DEEEIRTTNPVATEQYGCVCSNTEGHQYFGSDQS

SEQ ID NO: 119171 - protein, 33 aa, Artificial Sequence
  Description of Artificial Sequence: Synthetic polypeptide
DEAEIRTTNPVATESYGSVCFTQMLLTRGGQKE

SEQ ID NO: 119172 - protein, 32 aa, Artificial Sequence
  Description of Artificial Sequence: Synthetic polypeptide
DEDEIATTNPVAYEGWGSVSTSNESGNDGNNR

SEQ ID NO: 119173 - protein, 33 aa, Artificial Sequence
  Description of Artificial Sequence: Synthetic polypeptide
DEEEIRTTNPVATEQYGCVCSNTEHAFSNSNQP

SEQ ID NO: 119174 - protein, 34 aa, Artificial Sequence
  Description of Artificial Sequence: Synthetic polypeptide
DEEEIRTTNPVATEQWGSVSSCIAEPNMRNGMNV

SEQ ID NO: 119175 - protein, 34 aa, Artificial Sequence
  Description of Artificial Sequence: Synthetic polypeptide
DEEEIRTTNPVATEQWGSVSSCPAGPNDRNGENG

SEQ ID NO: 119176 - protein, 33 aa, Artificial Sequence
  Description of Artificial Sequence: Synthetic polypeptide
DEEEIRTTNPVATEQYGCVCSNTEHAYFNSDQP

SEQ ID NO: 119177 - protein, 33 aa, Artificial Sequence
  Description of Artificial Sequence: Synthetic polypeptide
DEEEIRTTNPVATEQWGSVSSEAGPMMRAGMDV

SEQ ID NO: 119178 - protein, 35 aa, Artificial Sequence
  Description of Artificial Sequence: Synthetic polypeptide
DEEEIRTTNPVATEQYGAVSGLGNIQDEGGQNDDF

SEQ ID NO: 119179 - protein, 34 aa, Artificial Sequence
  Description of Artificial Sequence: Synthetic polypeptide
DEEEIRTTNPVATEQWGSVSSCIAEPNDRNGMNV

SEQ ID NO: 119180 - protein, 33 aa, Artificial Sequence
  Description of Artificial Sequence: Synthetic polypeptide
DEEEIRTTNPVATEQYGCVCSNTPHEHFGSEQY

SEQ ID NO: 119181 - protein, 36 aa, Artificial Sequence
  Description of Artificial Sequence: Synthetic polypeptide
DEEEIRTTNPVATEQYGSVSTTTQAGSNNANGTNPD

SEQ ID NO: 119182 - protein, 36 aa, Artificial Sequence
  Description of Artificial Sequence: Synthetic polypeptide
DEEEIRTTNPVATEQYGSVSTTTQAGSNGANGTNEV

SEQ ID NO: 119183 - protein, 34 aa, Artificial Sequence
  Description of Artificial Sequence: Synthetic polypeptide
DEEEIRTTNPVATEQYGCVCSNTYDQENFNSNQA

SEQ ID NO: 119184 - protein, 34 aa, Artificial Sequence
  Description of Artificial Sequence: Synthetic polypeptide
DEEEIRTTNPVATEQYGCVCSNTYDQENFNSDQT

SEQ ID NO: 119185 - protein, 35 aa, Artificial Sequence
  Description of Artificial Sequence: Synthetic polypeptide
DEEEIRTTNPVATEQYGCVCSNTYDHQENFGSNQI

SEQ ID NO: 119186 - protein, 32 aa, Artificial Sequence
  Description of Artificial Sequence: Synthetic polypeptide
DEAEIRTTNPVATEQYGVVCSTEHNQNFPSEQ

SEQ ID NO: 119187 - protein, 35 aa, Artificial Sequence
  Description of Artificial Sequence: Synthetic polypeptide
DEEEIRTTNPVATEQYGSVSTMDGLEHDSSQNDDD

SEQ ID NO: 119188 - protein, 34 aa, Artificial Sequence
  Description of Artificial Sequence: Synthetic polypeptide
DEAEIRTTNPVATEQYGVVCSTEEHQENFGSNQS

SEQ ID NO: 119189 - protein, 33 aa, Artificial Sequence
  Description of Artificial Sequence: Synthetic polypeptide
DECEICTTNPVATEQYGTVSSVTDGTQEGEGND

SEQ ID NO: 119190 - protein, 35 aa, Artificial Sequence
  Description of Artificial Sequence: Synthetic polypeptide
DEEEIRTTNPVATEQWGSVSSTTPAGPNMRNGNPV

SEQ ID NO: 119191 - protein, 35 aa, Artificial Sequence
  Description of Artificial Sequence: Synthetic polypeptide
DEEEIRTTNPVAYEQYGQSVSPVENGLLQRTVETE

SEQ ID NO: 119192 - protein, 33 aa, Artificial Sequence
  Description of Artificial Sequence: Synthetic polypeptide
DEEEIRTTNPVATEQYGSVSTLDYPMPTVVQDD

SEQ ID NO: 119193 - protein, 34 aa, Artificial Sequence
  Description of Artificial Sequence: Synthetic polypeptide
DEEEIRTTNPVATEQYGSVSTMDGLEHDSEQFDD

SEQ ID NO: 119194 - protein, 36 aa, Artificial Sequence
  Description of Artificial Sequence: Synthetic polypeptide
DEEEIRTTNPVATEQYGSVSTTTPAGPNMRNGMNPV

SEQ ID NO: 119195 - protein, 36 aa, Artificial Sequence
  Description of Artificial Sequence: Synthetic polypeptide
DEEEIRTTNPVATEQYGSVSTTTPAGPNMRLGMNPV

SEQ ID NO: 119196 - protein, 36 aa, Artificial Sequence
  Description of Artificial Sequence: Synthetic polypeptide
DEEEIRTTNPVATEQYGSVSTTTPAGHNMRNGMNPV

SEQ ID NO: 119197 - protein, 37 aa, Artificial Sequence
  Description of Artificial Sequence: Synthetic polypeptide
DEEEIRTTNPVATEQYGSVSTTTNQQQANNQNGTNPV

SEQ ID NO: 119198 - protein, 37 aa, Artificial Sequence
  Description of Artificial Sequence: Synthetic polypeptide
DEEEIRTTNPVATEQYGSVSTTTNQQGQEQIGTTNNE

SEQ ID NO: 119199 - protein, 33 aa, Artificial Sequence
  Description of Artificial Sequence: Synthetic polypeptide
DECEICTTNPVATEQYGTVSSVTNGAVEGEGND

SEQ ID NO: 119200 - protein, 33 aa, Artificial Sequence
  Description of Artificial Sequence: Synthetic polypeptide
DEAEIRTTNPVATEQYGVVCSTEHQEHFPSNDS

SEQ ID NO: 119201 - protein, 36 aa, Artificial Sequence
  Description of Artificial Sequence: Synthetic polypeptide
DEEEIRTTNPVATEQYGSVSTTTQAGNNMENGTNPT

SEQ ID NO: 119202 - protein, 33 aa, Artificial Sequence
  Description of Artificial Sequence: Synthetic polypeptide
DEAEIRTTNPVATEQYGVVCSTEHQERFPSDQS

SEQ ID NO: 119203 - protein, 36 aa, Artificial Sequence
  Description of Artificial Sequence: Synthetic polypeptide
DEEEIRTTNPVATEQYGSVSTTTQAGNNNANGVNPV

SEQ ID NO: 119204 - protein, 38 aa, Artificial Sequence
  Description of Artificial Sequence: Synthetic polypeptide
DEEEIRTTNPVATEQYGSVSTTNLQSGNNNQNGTNPVD

SEQ ID NO: 119205 - protein, 34 aa, Artificial Sequence
  Description of Artificial Sequence: Synthetic polypeptide
DEEEIRTTNPVATEQYGAVSDLNNVDELGFNGQG

SEQ ID NO: 119206 - protein, 34 aa, Artificial Sequence
  Description of Artificial Sequence: Synthetic polypeptide
DEEEIRTTNPVATEQYGSVSTMDGPEHDSGQIDM

SEQ ID NO: 119207 - protein, 35 aa, Artificial Sequence
  Description of Artificial Sequence: Synthetic polypeptide
DEEEIRTTNPVATEQYGAVSATTPAWAERNGMNYI

SEQ ID NO: 119208 - protein, 35 aa, Artificial Sequence
  Description of Artificial Sequence: Synthetic polypeptide
DEEEIRTTNPVATEQYGCVCSNTEHNQERFNSNQT

SEQ ID NO: 119209 - protein, 36 aa, Artificial Sequence
  Description of Artificial Sequence: Synthetic polypeptide
DEEEIRTTNPVATEQYGSVSTTTQAGNNTENGTNTV

SEQ ID NO: 119210 - protein, 33 aa, Artificial Sequence
  Description of Artificial Sequence: Synthetic polypeptide
DECEICTTNPVATTQYGVVSTTALQQGTEGGND

SEQ ID NO: 119211 - protein, 37 aa, Artificial Sequence
  Description of Artificial Sequence: Synthetic polypeptide
DEEEIRTTNPVATEQYGSVSTTTQAGNNNQNGTNVDE

SEQ ID NO: 119212 - protein, 35 aa, Artificial Sequence
  Description of Artificial Sequence: Synthetic polypeptide
DEEEIRTTNPVATEQWGSVSSTTIAGPNMRNGMNV

SEQ ID NO: 119213 - protein, 33 aa, Artificial Sequence
  Description of Artificial Sequence: Synthetic polypeptide
DECEICTTNPVATTQYGVVSTNANLQAGTTEDG

SEQ ID NO: 119214 - protein, 35 aa, Artificial Sequence
  Description of Artificial Sequence: Synthetic polypeptide
DEEEIRTTNPVATEQWGSVSSTTPAGPMMRNGNPA

SEQ ID NO: 119215 - protein, 35 aa, Artificial Sequence
  Description of Artificial Sequence: Synthetic polypeptide
DEEEIRTTNPVAYEQYGQSVSQDDLLQPRGQIDMG

SEQ ID NO: 119216 - protein, 34 aa, Artificial Sequence
  Description of Artificial Sequence: Synthetic polypeptide
DEAEIRTTNPVATEQYGVVCSTGELQENFPSNQS

SEQ ID NO: 119217 - protein, 32 aa, Artificial Sequence
  Description of Artificial Sequence: Synthetic polypeptide
DDSEVRTTNPVATECWGSVSCNEPQDREGENG

SEQ ID NO: 119218 - protein, 37 aa, Artificial Sequence
  Description of Artificial Sequence: Synthetic polypeptide
DEEEIRTTNPVATEQYGSVSTTTQAGNNNQAGTNNVA

SEQ ID NO: 119219 - protein, 34 aa, Artificial Sequence
  Description of Artificial Sequence: Synthetic polypeptide
DEEEIRTTNPVATEQYGCVCSNTYHQESFGSDQE

SEQ ID NO: 119220 - protein, 34 aa, Artificial Sequence
  Description of Artificial Sequence: Synthetic polypeptide
DEEEIRTTNPVATEQYGCVCSNTYHQESFGSDQA

SEQ ID NO: 119221 - protein, 33 aa, Artificial Sequence
  Description of Artificial Sequence: Synthetic polypeptide
DECEICTTNPVATTQYGVVSTEQLNQIGTNTDE

SEQ ID NO: 119222 - protein, 35 aa, Artificial Sequence
  Description of Artificial Sequence: Synthetic polypeptide
DEEEIRTTNPVATEQYGAVSATAPAWAERNGMNYI

SEQ ID NO: 119223 - protein, 35 aa, Artificial Sequence
  Description of Artificial Sequence: Synthetic polypeptide
DEEEIRTTNPVATEQYGSVSTTNNGGNEQGTQEVN

SEQ ID NO: 119224 - protein, 32 aa, Artificial Sequence
  Description of Artificial Sequence: Synthetic polypeptide
DEEEIRTTNPVATEQWGTNCAGTADLNHGNES

SEQ ID NO: 119225 - protein, 32 aa, Artificial Sequence
  Description of Artificial Sequence: Synthetic polypeptide
DEAEIRTTNPVATEQYGSVWVYVEMEGMNEIE

SEQ ID NO: 119226 - protein, 34 aa, Artificial Sequence
  Description of Artificial Sequence: Synthetic polypeptide
DEEEIRTTNPVATEQYGCVCSNTGEHQNFTSNQA

SEQ ID NO: 119227 - protein, 34 aa, Artificial Sequence
  Description of Artificial Sequence: Synthetic polypeptide
DEEEIRTTNPVATEQYGAVFEDTNMNDTGEGGNI

SEQ ID NO: 119228 - protein, 34 aa, Artificial Sequence
  Description of Artificial Sequence: Synthetic polypeptide
DEDEIATTNPVATEQYGSVCFTENQGQGQGQGNH

SEQ ID NO: 119229 - protein, 34 aa, Artificial Sequence
  Description of Artificial Sequence: Synthetic polypeptide
DEEEIRTTNPVATEQYGAVDTNNFNGEDGQENGN

SEQ ID NO: 119230 - protein, 35 aa, Artificial Sequence
  Description of Artificial Sequence: Synthetic polypeptide
DEEEIRTTNPVATEQYGCVCSNTGEDQEFFGSNQV

SEQ ID NO: 119231 - protein, 35 aa, Artificial Sequence
  Description of Artificial Sequence: Synthetic polypeptide
DEEEIRTTNPVAYEQYGQSVSETVGLLGIGIEQRT

SEQ ID NO: 119232 - protein, 34 aa, Artificial Sequence
  Description of Artificial Sequence: Synthetic polypeptide
DEEEIRTTNPVATEQYGAVDTDTMQEGDGEEGND

SEQ ID NO: 119233 - protein, 34 aa, Artificial Sequence
  Description of Artificial Sequence: Synthetic polypeptide
DEEEIRTTNPVATEQYGAVDTDINELTGGGQGGT

SEQ ID NO: 119234 - protein, 35 aa, Artificial Sequence
  Description of Artificial Sequence: Synthetic polypeptide
DEEEIRTTNPVATEQYGCVCSNTGEHQNFGSQNQV

SEQ ID NO: 119235 - protein, 37 aa, Artificial Sequence
  Description of Artificial Sequence: Synthetic polypeptide
DEEEIRTTNPVATEQYGSVSTTNQQNNEQGNNNTNQT

SEQ ID NO: 119236 - protein, 33 aa, Artificial Sequence
  Description of Artificial Sequence: Synthetic polypeptide
DEEEIRTTNPVATEQYGCVCSNTGEHQHFTSDQ

SEQ ID NO: 119237 - protein, 35 aa, Artificial Sequence
  Description of Artificial Sequence: Synthetic polypeptide
DEEEIRTTNPVATEQYGCVCSNTGEDQEGFGSNQN

SEQ ID NO: 119238 - protein, 35 aa, Artificial Sequence
  Description of Artificial Sequence: Synthetic polypeptide
DEEEIRTTNPVATEQYGAVDTDINELQTGGGQGGI

SEQ ID NO: 119239 - protein, 33 aa, Artificial Sequence
  Description of Artificial Sequence: Synthetic polypeptide
DEEEIRTTNPVATEQYGAVDTDIDEDGQEGGQG

SEQ ID NO: 119240 - protein, 35 aa, Artificial Sequence
  Description of Artificial Sequence: Synthetic polypeptide
DEEEIRTTNPVATEQYGAVDTDDNNDQNEGGNDQG

SEQ ID NO: 119241 - protein, 34 aa, Artificial Sequence
  Description of Artificial Sequence: Synthetic polypeptide
DEEEIRTTNPVATEQYGCVCSNTGEHQHFNSQQS

SEQ ID NO: 119242 - protein, 37 aa, Artificial Sequence
  Description of Artificial Sequence: Synthetic polypeptide
DEEEIRTTNPVATEQYGSVSTTNNQQAGNQAGQTEDE

SEQ ID NO: 119243 - protein, 33 aa, Artificial Sequence
  Description of Artificial Sequence: Synthetic polypeptide
DEEEIRTTNPVATEQYGAVFGDEQEGGNQGQGT

SEQ ID NO: 119244 - protein, 33 aa, Artificial Sequence
  Description of Artificial Sequence: Synthetic polypeptide
DECEICTTNPVATEQYGVVSTVAQLQGNNNNDQ

SEQ ID NO: 119245 - protein, 35 aa, Artificial Sequence
  Description of Artificial Sequence: Synthetic polypeptide
DEEEIRTTNPVATEQYGCVCSNTGEHQNGGSNNQS

SEQ ID NO: 119246 - protein, 35 aa, Artificial Sequence
  Description of Artificial Sequence: Synthetic polypeptide
DECEICTTNPVATEQYGVVSTVANLQQGNNENNDE

SEQ ID NO: 119247 - protein, 33 aa, Artificial Sequence
  Description of Artificial Sequence: Synthetic polypeptide
DEAEIRTTNPVATEQYGSYSWTWNESQGEEVFE

SEQ ID NO: 119248 - protein, 34 aa, Artificial Sequence
  Description of Artificial Sequence: Synthetic polypeptide
DEEEIRTTNPVAYEQYGQSVSEVQDAAQTGVELR

SEQ ID NO: 119249 - protein, 35 aa, Artificial Sequence
  Description of Artificial Sequence: Synthetic polypeptide
DEEEIRTTNPVATEQYGCVCSNTGELQEHFNSDQA

SEQ ID NO: 119250 - protein, 34 aa, Artificial Sequence
  Description of Artificial Sequence: Synthetic polypeptide
DEEEIRTTNPVATEQYGAVFGVDNLEQDEGGGQG

SEQ ID NO: 119251 - protein, 37 aa, Artificial Sequence
  Description of Artificial Sequence: Synthetic polypeptide
DEEEIRTTNPVATEQYGSVSTNQQQAGNQQGTNEENQ

SEQ ID NO: 119252 - protein, 37 aa, Artificial Sequence
  Description of Artificial Sequence: Synthetic polypeptide
DEEEIRTTNPVATEQYGSVSTNQQQGNNNDEQGTTTE

SEQ ID NO: 119253 - protein, 35 aa, Artificial Sequence
  Description of Artificial Sequence: Synthetic polypeptide
DEEEIRTTNPVATEQYGCVCSNTGELNQNFGSDQS

SEQ ID NO: 119254 - protein, 35 aa, Artificial Sequence
  Description of Artificial Sequence: Synthetic polypeptide
DEEEIRTTNPVAYEQYGQSVSEVNDALQVRTVEEN

SEQ ID NO: 119255 - protein, 33 aa, Artificial Sequence
  Description of Artificial Sequence: Synthetic polypeptide
DEEEIRTTNPVAYEQYGQSVSEQDALQTVVELE

SEQ ID NO: 119256 - protein, 34 aa, Artificial Sequence
  Description of Artificial Sequence: Synthetic polypeptide
DEEEIRTTNPVATEQYGCVCSNTGELINFGSDQE

SEQ ID NO: 119257 - protein, 36 aa, Artificial Sequence
  Description of Artificial Sequence: Synthetic polypeptide
DEEEIRTTNPVATEQYGCVCSNTGELDQEGFNSDQG

SEQ ID NO: 119258 - protein, 34 aa, Artificial Sequence
  Description of Artificial Sequence: Synthetic polypeptide
DEEEIRTTNPVATEQYGCVCSNTGEHQYSGSDQS

SEQ ID NO: 119259 - protein, 33 aa, Artificial Sequence
  Description of Artificial Sequence: Synthetic polypeptide
DEEEIRTTNPVATEQYGAVFGDMEQGNQGDNVG

SEQ ID NO: 119260 - protein, 34 aa, Artificial Sequence
  Description of Artificial Sequence: Synthetic polypeptide
DECEICTTNPVATEQYGVVSTVANLLQGNPNNDD

SEQ ID NO: 119261 - protein, 33 aa, Artificial Sequence
  Description of Artificial Sequence: Synthetic polypeptide
DEEEIRTTNPVATEQYGAVFGDLEEQDEGGGQG

SEQ ID NO: 119262 - protein, 35 aa, Artificial Sequence
  Description of Artificial Sequence: Synthetic polypeptide
DECEICTTNPVATEQYGVVSTVTNGNLEQGEGNDD

SEQ ID NO: 119263 - protein, 32 aa, Artificial Sequence
  Description of Artificial Sequence: Synthetic polypeptide
DEEEIRTTNPVATEQYGAVFGDGENDEGGGQI

SEQ ID NO: 119264 - protein, 29 aa, Artificial Sequence
  Description of Artificial Sequence: Synthetic peptide
DEDEIATTNPVATESYGCIAGAEDQRDNF

SEQ ID NO: 119265 - protein, 35 aa, Artificial Sequence
  Description of Artificial Sequence: Synthetic polypeptide
DEEEIRTTNPVATEQYGCVCSNTGELEQYFNSDQS

SEQ ID NO: 119266 - protein, 34 aa, Artificial Sequence
  Description of Artificial Sequence: Synthetic polypeptide
DEEEIRTTNPVATEQYGCVCSNTGEDENFGSNQS

SEQ ID NO: 119267 - protein, 34 aa, Artificial Sequence
  Description of Artificial Sequence: Synthetic polypeptide
DEEEIRTTNPVATEQYGCVCSNTGEHQHFGSVQG

SEQ ID NO: 119268 - protein, 36 aa, Artificial Sequence
  Description of Artificial Sequence: Synthetic polypeptide
DEEEIRTTNPVATEQYGSVSTTNNQQGEEQGTTTVE

SEQ ID NO: 119269 - protein, 33 aa, Artificial Sequence
  Description of Artificial Sequence: Synthetic polypeptide
DEAEISTTNPVATEQYGCVCSTEHQGFGSNNQS

SEQ ID NO: 119270 - protein, 32 aa, Artificial Sequence
  Description of Artificial Sequence: Synthetic polypeptide
DEAEISTTNPVATEQYGCVCSTEHQEFGSDQS

SEQ ID NO: 119271 - protein, 35 aa, Artificial Sequence
  Description of Artificial Sequence: Synthetic polypeptide
DEEEIRTTNPVATEQYGASCCSPTNNDIELYEDNE

SEQ ID NO: 119272 - protein, 35 aa, Artificial Sequence
  Description of Artificial Sequence: Synthetic polypeptide
DEEEIRTTNPVATEQYGCVCSNTGEHNQGFGSNQS

SEQ ID NO: 119273 - protein, 33 aa, Artificial Sequence
  Description of Artificial Sequence: Synthetic polypeptide
DEEEIRTTNPVATEQYGAVDSDGQDQEGEGEDT

SEQ ID NO: 119274 - protein, 34 aa, Artificial Sequence
  Description of Artificial Sequence: Synthetic polypeptide
DEEEIRTTNPVATEQYGASVPCNTQNDFGRIATE

SEQ ID NO: 119275 - protein, 34 aa, Artificial Sequence
  Description of Artificial Sequence: Synthetic polypeptide
DEEEIRTTNPVATEQYGAVDSDDNMNEGGGENDS

SEQ ID NO: 119276 - protein, 33 aa, Artificial Sequence
  Description of Artificial Sequence: Synthetic polypeptide
DEDEIATTNPVATEQYGSVPCWDNHGQRQGGDA

SEQ ID NO: 119277 - protein, 33 aa, Artificial Sequence
  Description of Artificial Sequence: Synthetic polypeptide
DEAEISTTNPVATEQYGCVCSTEEPQHFGSNQS

SEQ ID NO: 119278 - protein, 37 aa, Artificial Sequence
  Description of Artificial Sequence: Synthetic polypeptide
DEEEIRTTNPVATEQYGSVSTTNQNLLQGNNNQNEQE

SEQ ID NO: 119279 - protein, 37 aa, Artificial Sequence
  Description of Artificial Sequence: Synthetic polypeptide
DEEEIRTTNPVATEQYGSVSTTNQAGNNNQQGTTNDE

SEQ ID NO: 119280 - protein, 36 aa, Artificial Sequence
  Description of Artificial Sequence: Synthetic polypeptide
DEEEIRTTNPVATEQYGASVSSTTPAGPNMRGMNPV

SEQ ID NO: 119281 - protein, 34 aa, Artificial Sequence
  Description of Artificial Sequence: Synthetic polypeptide
DEEEIRTTNPVATEQYGCVCSNTGEHEQYFGSDQ

SEQ ID NO: 119282 - protein, 38 aa, Artificial Sequence
  Description of Artificial Sequence: Synthetic polypeptide
DEEEIRTTNPVATEQYGSVSTTNQLQGNNNQQGTNVDE

SEQ ID NO: 119283 - protein, 32 aa, Artificial Sequence
  Description of Artificial Sequence: Synthetic polypeptide
DEDEIATTNPVATEQYGSVSATDTEDHEGEDL

SEQ ID NO: 119284 - protein, 34 aa, Artificial Sequence
  Description of Artificial Sequence: Synthetic polypeptide
DEEEIRTTNPVATEQYGATNMTDNGLSQRIIDGD

SEQ ID NO: 119285 - protein, 32 aa, Artificial Sequence
  Description of Artificial Sequence: Synthetic polypeptide
DEDEIATTNPVATEQYGSVSAPPANDNPDGQP

SEQ ID NO: 119286 - protein, 35 aa, Artificial Sequence
  Description of Artificial Sequence: Synthetic polypeptide
DEEEIRTTNPVATEQYGSVSTTNNTHQIVEEFQDE

SEQ ID NO: 119287 - protein, 33 aa, Artificial Sequence
  Description of Artificial Sequence: Synthetic polypeptide
DEAEISTTNPVATEQYGCVCSTELQNFNSNFQS

SEQ ID NO: 119288 - protein, 35 aa, Artificial Sequence
  Description of Artificial Sequence: Synthetic polypeptide
DEEEIRTTNPVATEQYGAIWSLTINHGQGEEGNEN

SEQ ID NO: 119289 - protein, 34 aa, Artificial Sequence
  Description of Artificial Sequence: Synthetic polypeptide
DEEEIRTTNPVATEQYGAIWSLHINMGQGEGNIN

SEQ ID NO: 119290 - protein, 33 aa, Artificial Sequence
  Description of Artificial Sequence: Synthetic polypeptide
DEAEISTTNPVATEQYGCVCSTGNHINFGSNQS

SEQ ID NO: 119291 - protein, 35 aa, Artificial Sequence
  Description of Artificial Sequence: Synthetic polypeptide
DEEEIRTTNPVATEQYGCVCSNTGEDQGFGSDNQV

SEQ ID NO: 119292 - protein, 38 aa, Artificial Sequence
  Description of Artificial Sequence: Synthetic polypeptide
DEEEIRTTNPVATEQYGSVSTTNQQLQNGTEQGNNQEN

SEQ ID NO: 119293 - protein, 38 aa, Artificial Sequence
  Description of Artificial Sequence: Synthetic polypeptide
DEEEIRTTNPVATEQYGSVSTTNQQLQNATEQGNTQEE

SEQ ID NO: 119294 - protein, 36 aa, Artificial Sequence
  Description of Artificial Sequence: Synthetic polypeptide
DEEEIRTTNPVATEQYGSVSTTNNQQGTEQGTTDEA

SEQ ID NO: 119295 - protein, 34 aa, Artificial Sequence
  Description of Artificial Sequence: Synthetic polypeptide
DEEEIRTTNPVATEQYGCVCSNTGEDQNFGSEQA

SEQ ID NO: 119296 - protein, 34 aa, Artificial Sequence
  Description of Artificial Sequence: Synthetic polypeptide
DEEEIRTTNPVATEQYGAVDSGMGDNEQQGDEGE

SEQ ID NO: 119297 - protein, 36 aa, Artificial Sequence
  Description of Artificial Sequence: Synthetic polypeptide
DEEEIRTTNPVATEQYGSVSTTNQQLLQNNEEQEQE

SEQ ID NO: 119298 - protein, 38 aa, Artificial Sequence
  Description of Artificial Sequence: Synthetic polypeptide
DEEEIRTTNPVATEQYGSVSTTNQQLQQGTEQGNNEEE

SEQ ID NO: 119299 - protein, 37 aa, Artificial Sequence
  Description of Artificial Sequence: Synthetic polypeptide
DEEEIRTTNPVATEQYGSVSTTNQQGNGSEQGTNNQE

SEQ ID NO: 119300 - protein, 36 aa, Artificial Sequence
  Description of Artificial Sequence: Synthetic polypeptide
DEEEIRTTNPVATEQYGSVSTTNQQAGTEQGTQEDT

SEQ ID NO: 119301 - protein, 34 aa, Artificial Sequence
  Description of Artificial Sequence: Synthetic polypeptide
DEEEIRTTNPVATEQYGAVDSDTNMQGDEFTSTE

SEQ ID NO: 119302 - protein, 33 aa, Artificial Sequence
  Description of Artificial Sequence: Synthetic polypeptide
DEDEIATTNPVATEQYGSVLSATDLEDHEGEDL

SEQ ID NO: 119303 - protein, 36 aa, Artificial Sequence
  Description of Artificial Sequence: Synthetic polypeptide
DEEEIRTTNPVATEQYGSVSTTNQQAGTEQGTDEEE

SEQ ID NO: 119304 - protein, 34 aa, Artificial Sequence
  Description of Artificial Sequence: Synthetic polypeptide
DEEEIRTTNPVATEQYGAVDSDTNMNGDEFTNTN

SEQ ID NO: 119305 - protein, 34 aa, Artificial Sequence
  Description of Artificial Sequence: Synthetic polypeptide
DEEEIRTTNPVATEQYGAVDSDTNMGEGGETDDG

SEQ ID NO: 119306 - protein, 34 aa, Artificial Sequence
  Description of Artificial Sequence: Synthetic polypeptide
DEEEIRTTNPVATEQYGAVDSDTNMGDEFTNITD

SEQ ID NO: 119307 - protein, 37 aa, Artificial Sequence
  Description of Artificial Sequence: Synthetic polypeptide
DEEEIRTTNPVATEQYGSVSTTNQNNQQGNNQQGTNE

SEQ ID NO: 119308 - protein, 36 aa, Artificial Sequence
  Description of Artificial Sequence: Synthetic polypeptide
DEEEIRTTNPVATEQYGSVSTTNQQAGTEQGTQTEQ

SEQ ID NO: 119309 - protein, 33 aa, Artificial Sequence
  Description of Artificial Sequence: Synthetic polypeptide
DEEEIRTTNPVATEQYGAVISNGFGNGQDIQEE

SEQ ID NO: 119310 - protein, 37 aa, Artificial Sequence
  Description of Artificial Sequence: Synthetic polypeptide
DEEEIRTTNPVATEQWGYSNVSATNELQHRPGQGQFQ

SEQ ID NO: 119311 - protein, 38 aa, Artificial Sequence
  Description of Artificial Sequence: Synthetic polypeptide
DEEEIRTTNPVATEQWGYSNVSATNELQHQRPGQGNDA

SEQ ID NO: 119312 - protein, 34 aa, Artificial Sequence
  Description of Artificial Sequence: Synthetic polypeptide
DEDEIATTNPVATQQYGCVVSCTNLSERGGNNPG

SEQ ID NO: 119313 - protein, 38 aa, Artificial Sequence
  Description of Artificial Sequence: Synthetic polypeptide
DEEEIRTTNPVATEQYGSVSTTQNLQAGTEQGTEQGNE

SEQ ID NO: 119314 - protein, 35 aa, Artificial Sequence
  Description of Artificial Sequence: Synthetic polypeptide
DEEEIRTTNPVATEQWGTVIPCTINPLSQRTVNNN

SEQ ID NO: 119315 - protein, 34 aa, Artificial Sequence
  Description of Artificial Sequence: Synthetic polypeptide
DEAEISTTNPVATEQYGCVCSNTELQNFGSENQA

SEQ ID NO: 119316 - protein, 34 aa, Artificial Sequence
  Description of Artificial Sequence: Synthetic polypeptide
DEAEISTTNPVATEQYGCVCSNTNLNAYFGSNQA

SEQ ID NO: 119317 - protein, 36 aa, Artificial Sequence
  Description of Artificial Sequence: Synthetic polypeptide
DEEEIRTTNPVATEAYGTVSTTNLQQGNNDEDEEDT

SEQ ID NO: 119318 - protein, 33 aa, Artificial Sequence
  Description of Artificial Sequence: Synthetic polypeptide
DEAEISTTNPVATEQYGCVCSWNLAEYFGSNQS

SEQ ID NO: 119319 - protein, 34 aa, Artificial Sequence
  Description of Artificial Sequence: Synthetic polypeptide
DEAEIRTTNPVATEQYGSVYDVSVNPQDEGLESD

SEQ ID NO: 119320 - protein, 32 aa, Artificial Sequence
  Description of Artificial Sequence: Synthetic polypeptide
DEAEISTTNPVATEQYGCVCSWNHQNFGSDQS

SEQ ID NO: 119321 - protein, 31 aa, Artificial Sequence
  Description of Artificial Sequence: Synthetic polypeptide
DEAEISTTNPVATEQYGCVCSWNHAYFGSDQ

SEQ ID NO: 119322 - protein, 34 aa, Artificial Sequence
  Description of Artificial Sequence: Synthetic polypeptide
DEDEIATTNPVATEQYGSVCATNPLQEHDENQHQ

SEQ ID NO: 119323 - protein, 34 aa, Artificial Sequence
  Description of Artificial Sequence: Synthetic polypeptide
DEEEIRTTNPVATEQYGAVMSDENMTNEGEGEEV

SEQ ID NO: 119324 - protein, 37 aa, Artificial Sequence
  Description of Artificial Sequence: Synthetic polypeptide
DEEEIRTTNPVATEAYGVVSTVVSTNLQSGNNDEEDE

SEQ ID NO: 119325 - protein, 35 aa, Artificial Sequence
  Description of Artificial Sequence: Synthetic polypeptide
DEEEIRTTNPVATEQYGCVCSNTENPNQYFGSDFA

SEQ ID NO: 119326 - protein, 35 aa, Artificial Sequence
  Description of Artificial Sequence: Synthetic polypeptide
DEAEIRTTNPVATEQYGSVYETNKLDDGRSGQEDG

SEQ ID NO: 119327 - protein, 35 aa, Artificial Sequence
  Description of Artificial Sequence: Synthetic polypeptide
DEEEIRTTNPVAYEQYGQSVSLTVGLLQIGIEQQQ

SEQ ID NO: 119328 - protein, 36 aa, Artificial Sequence
  Description of Artificial Sequence: Synthetic polypeptide
DEEEIRTTNPVATEQYGSVSTTNNMMWQESGEFEVE

SEQ ID NO: 119329 - protein, 35 aa, Artificial Sequence
  Description of Artificial Sequence: Synthetic polypeptide
DEEEIRTTNPVATEQYGCVCSNTENHQHFGSDTQA

SEQ ID NO: 119330 - protein, 34 aa, Artificial Sequence
  Description of Artificial Sequence: Synthetic polypeptide
DEEEIRTTNPVATEQYGAVMSDMQQEEEGGGNEQ

SEQ ID NO: 119331 - protein, 33 aa, Artificial Sequence
  Description of Artificial Sequence: Synthetic polypeptide
DEEEIRTTNPVATEQYGAVMSDNIFGEDGEGTT

SEQ ID NO: 119332 - protein, 37 aa, Artificial Sequence
  Description of Artificial Sequence: Synthetic polypeptide
DEEEIRTTNPVATEQYGSVSTTQNNQISTEQGTNNGN

SEQ ID NO: 119333 - protein, 34 aa, Artificial Sequence
  Description of Artificial Sequence: Synthetic polypeptide
DEEEIRTTNPVATEQYGSVSTNPPMADFFSDQTY

SEQ ID NO: 119334 - protein, 37 aa, Artificial Sequence
  Description of Artificial Sequence: Synthetic polypeptide
DEEEIRTTNPVATEQYGSVSTTQQQGNNNQQGTNPNE

SEQ ID NO: 119335 - protein, 36 aa, Artificial Sequence
  Description of Artificial Sequence: Synthetic polypeptide
DEEEIRTTNPVATEQYGCVCSNTENHQEHFGSDNQT

SEQ ID NO: 119336 - protein, 34 aa, Artificial Sequence
  Description of Artificial Sequence: Synthetic polypeptide
DEEEIRTTNPVATEQYGCVCSNTGPHQYFGSDQS

SEQ ID NO: 119337 - protein, 34 aa, Artificial Sequence
  Description of Artificial Sequence: Synthetic polypeptide
DEEEIRTTNPVAYEQYGQSVCSWEEDLNQNGSQQ

SEQ ID NO: 119338 - protein, 32 aa, Artificial Sequence
  Description of Artificial Sequence: Synthetic polypeptide
DEEEIRTTNPVATEQWGTNCSAALMNRGTDSW

SEQ ID NO: 119339 - protein, 32 aa, Artificial Sequence
  Description of Artificial Sequence: Synthetic polypeptide
DEEEIRTTNPVATEQWGTNCSGAMNLLHMNEQ

SEQ ID NO: 119340 - protein, 34 aa, Artificial Sequence
  Description of Artificial Sequence: Synthetic polypeptide
DEAEIRTTNPVATEQYGSVWWFTDLEQESNQNDN

SEQ ID NO: 119341 - protein, 35 aa, Artificial Sequence
  Description of Artificial Sequence: Synthetic polypeptide
DEEEIRTTNPVATEQYGCVCSNTGNHQSFGSDTQS

SEQ ID NO: 119342 - protein, 33 aa, Artificial Sequence
  Description of Artificial Sequence: Synthetic polypeptide
DECEICTTNPVATEQYGTVSTVTQGMVEGEGND

SEQ ID NO: 119343 - protein, 33 aa, Artificial Sequence
  Description of Artificial Sequence: Synthetic polypeptide
DEAEIRTTNPVATEQYGSYWSLDPMLERISQRD

SEQ ID NO: 119344 - protein, 34 aa, Artificial Sequence
  Description of Artificial Sequence: Synthetic polypeptide
DEEEIRTTNPVATEQWGTSSDINPLQENGENNNN

SEQ ID NO: 119345 - protein, 34 aa, Artificial Sequence
  Description of Artificial Sequence: Synthetic polypeptide
DEEEIRTTNPVAYEQYGQSVCTNDELVPRQQPVG

SEQ ID NO: 119346 - protein, 34 aa, Artificial Sequence
  Description of Artificial Sequence: Synthetic polypeptide
DEAEIRTTNPVATEQYGSYWSLDNMLEEIENQRE

SEQ ID NO: 119347 - protein, 35 aa, Artificial Sequence
  Description of Artificial Sequence: Synthetic polypeptide
DEEEIRTTNPVAYEQYGQSVCTNDELVPRVGQPVY

SEQ ID NO: 119348 - protein, 36 aa, Artificial Sequence
  Description of Artificial Sequence: Synthetic polypeptide
DEEEIRTTNPVATEQYGSVSTTQQAGNTEQGTNQTT

SEQ ID NO: 119349 - protein, 34 aa, Artificial Sequence
  Description of Artificial Sequence: Synthetic polypeptide
DEEEIRTTNPVAYEQYGQSVSMNDELVPWGQVSV

SEQ ID NO: 119350 - protein, 37 aa, Artificial Sequence
  Description of Artificial Sequence: Synthetic polypeptide
DEEEIRTTNPVATEQYGSVSTTQNNQISTEQGTNNTN

SEQ ID NO: 119351 - protein, 33 aa, Artificial Sequence
  Description of Artificial Sequence: Synthetic polypeptide
DECEICTTNPVATEQYGTVSVATQGNVEEEGND

SEQ ID NO: 119352 - protein, 36 aa, Artificial Sequence
  Description of Artificial Sequence: Synthetic polypeptide
DEEEIRTTNPVATEQYGSVSTTNNNGGQEQGTQGGG

SEQ ID NO: 119353 - protein, 34 aa, Artificial Sequence
  Description of Artificial Sequence: Synthetic polypeptide
DEEEIRTTNPVATEQYGCVCSNTGNHQNFFSDQQ

SEQ ID NO: 119354 - protein, 34 aa, Artificial Sequence
  Description of Artificial Sequence: Synthetic polypeptide
DEEEIRTTNPVATEQYGAVMGTGNQGEDGQGNID

SEQ ID NO: 119355 - protein, 35 aa, Artificial Sequence
  Description of Artificial Sequence: Synthetic polypeptide
DEEEIRTTNPVATEQYGSVSTTPIGPNMANEMNPA

SEQ ID NO: 119356 - protein, 35 aa, Artificial Sequence
  Description of Artificial Sequence: Synthetic polypeptide
DEEEIRTTNPVATEQYGSVSTTPAGPNMRNEMNPV

SEQ ID NO: 119357 - protein, 35 aa, Artificial Sequence
  Description of Artificial Sequence: Synthetic polypeptide
DEEEIRTTNPVATEQYGSVSTTPAGPNDRNGMEDV

SEQ ID NO: 119358 - protein, 35 aa, Artificial Sequence
  Description of Artificial Sequence: Synthetic polypeptide
DEAEIRTTNPVATEQYGSVYTATANELQGQIEDRN

SEQ ID NO: 119359 - protein, 33 aa, Artificial Sequence
  Description of Artificial Sequence: Synthetic polypeptide
DEDEIATTNPVATETWGTVCSTDLQGDTGDNER

SEQ ID NO: 119360 - protein, 33 aa, Artificial Sequence
  Description of Artificial Sequence: Synthetic polypeptide
DEAEIRTTNPVATEQYGSVYTNPMDEIEQNEEN

SEQ ID NO: 119361 - protein, 36 aa, Artificial Sequence
  Description of Artificial Sequence: Synthetic polypeptide
DEEEIRTTNPVATEQYGAVMGDTNLGQGNNGNNEGT

SEQ ID NO: 119362 - protein, 37 aa, Artificial Sequence
  Description of Artificial Sequence: Synthetic polypeptide
DEEEIRTTNPVATEQYGSVSTTNNNNNQLQQNEETNE

SEQ ID NO: 119363 - protein, 38 aa, Artificial Sequence
  Description of Artificial Sequence: Synthetic polypeptide
DEEEIRTTNPVATEQYGSVSTTNNNNNNLQQGTTNQES

SEQ ID NO: 119364 - protein, 33 aa, Artificial Sequence
  Description of Artificial Sequence: Synthetic polypeptide
DEEEIRTTNPVATEQYGAVMGDLMNENGGNDGI

SEQ ID NO: 119365 - protein, 36 aa, Artificial Sequence
  Description of Artificial Sequence: Synthetic polypeptide
DEEEIRTTNPVATEQWGYSNVSATNELQHAPGQGFI

SEQ ID NO: 119366 - protein, 34 aa, Artificial Sequence
  Description of Artificial Sequence: Synthetic polypeptide
DEEEIRTTNPVATEQYGAVITDTNIMTGNQGNIG

SEQ ID NO: 119367 - protein, 34 aa, Artificial Sequence
  Description of Artificial Sequence: Synthetic polypeptide
DEEEIRTTNPVATEQYGCVCSNTETQEFFGSDQE

SEQ ID NO: 119368 - protein, 38 aa, Artificial Sequence
  Description of Artificial Sequence: Synthetic polypeptide
DEEEIRTTNPVATEQYGSVSTTNNNNNQLQQNEQGTNE

SEQ ID NO: 119369 - protein, 35 aa, Artificial Sequence
  Description of Artificial Sequence: Synthetic polypeptide
DEEEIRTTNPVATEQYGCVCSNTGAHQNFGSNTQS

SEQ ID NO: 119370 - protein, 34 aa, Artificial Sequence
  Description of Artificial Sequence: Synthetic polypeptide
DEEEIRTTNPVATEQYGCVCSNTGAHQNGGSEQS

SEQ ID NO: 119371 - protein, 30 aa, Artificial Sequence
  Description of Artificial Sequence: Synthetic polypeptide
DEDEIATTNPVATESYGCIAGTNDVQADNF

SEQ ID NO: 119372 - protein, 35 aa, Artificial Sequence
  Description of Artificial Sequence: Synthetic polypeptide
DEEEIRTTNPVATEQYGCVCSNTGELQHFGSETQA

SEQ ID NO: 119373 - protein, 36 aa, Artificial Sequence
  Description of Artificial Sequence: Synthetic polypeptide
DEEEIRTTNPVATEQWGYSNVSATDELQHRPGQGFP

SEQ ID NO: 119374 - protein, 33 aa, Artificial Sequence
  Description of Artificial Sequence: Synthetic polypeptide
DEEEIRTTNPVATEQWGSVSMSGEGGQTPGPQF

SEQ ID NO: 119375 - protein, 34 aa, Artificial Sequence
  Description of Artificial Sequence: Synthetic polypeptide
DEEEIRTTNPVATEQYGCVCSNTETDQNFNSEQP

SEQ ID NO: 119376 - protein, 34 aa, Artificial Sequence
  Description of Artificial Sequence: Synthetic polypeptide
DEEEIRTTNPVATEQYGCVCSNTEPNQYFGSDFS

SEQ ID NO: 119377 - protein, 35 aa, Artificial Sequence
  Description of Artificial Sequence: Synthetic polypeptide
DEEEIRTTNPVATEQYGAVMGNLVGGNGQDGNQTN

SEQ ID NO: 119378 - protein, 35 aa, Artificial Sequence
  Description of Artificial Sequence: Synthetic polypeptide
DEEEIRTTNPVATEQYGCVCSNTGNHQFFNSNFAS

SEQ ID NO: 119379 - protein, 35 aa, Artificial Sequence
  Description of Artificial Sequence: Synthetic polypeptide
DEEEIRTTNPVATEQWGTVVVVTTTNLQLGGNNSD

SEQ ID NO: 119380 - protein, 34 aa, Artificial Sequence
  Description of Artificial Sequence: Synthetic polypeptide
DECEICTTNPVATEQYGVVSTTALLQQGNPNNDE

SEQ ID NO: 119381 - protein, 33 aa, Artificial Sequence
  Description of Artificial Sequence: Synthetic polypeptide
DECEICTTNPVATEQYGVVSTTAQLEQGNPNDE

SEQ ID NO: 119382 - protein, 34 aa, Artificial Sequence
  Description of Artificial Sequence: Synthetic polypeptide
DEEEIRTTNPVATEQWGVVNVVTTNLQQSTTGGN

SEQ ID NO: 119383 - protein, 35 aa, Artificial Sequence
  Description of Artificial Sequence: Synthetic polypeptide
DEEEIRTTNPVATEQYGCVCSNTGNHNQNFGSEQS

SEQ ID NO: 119384 - protein, 35 aa, Artificial Sequence
  Description of Artificial Sequence: Synthetic polypeptide
DEEEIRTTNPVATEQYGCVCSNTGNHNQGFGSEQS

SEQ ID NO: 119385 - protein, 34 aa, Artificial Sequence
  Description of Artificial Sequence: Synthetic polypeptide
DEEEIRTTNPVATEQYGCVCSNTEPQHFNSDTQS

SEQ ID NO: 119386 - protein, 35 aa, Artificial Sequence
  Description of Artificial Sequence: Synthetic polypeptide
DEEEIRTTNPVATEQYGCVCSNTGNHNQGFGSDQS

SEQ ID NO: 119387 - protein, 32 aa, Artificial Sequence
  Description of Artificial Sequence: Synthetic polypeptide
DEEEIRTTNPVATEQYGAVMGGNGGNGGEEAD

SEQ ID NO: 119388 - protein, 35 aa, Artificial Sequence
  Description of Artificial Sequence: Synthetic polypeptide
DEEEIRTTNPVATEQWGVVVVSTTNLQQSATTGGF

SEQ ID NO: 119389 - protein, 38 aa, Artificial Sequence
  Description of Artificial Sequence: Synthetic polypeptide
DEEEIRTTNPVATEQYGSVSTTNNNNLQQGNNQQNTDG

SEQ ID NO: 119390 - protein, 35 aa, Artificial Sequence
  Description of Artificial Sequence: Synthetic polypeptide
DEEEIRTTNPVATEQYGCVCSNTGETQNFGSNTQG

SEQ ID NO: 119391 - protein, 35 aa, Artificial Sequence
  Description of Artificial Sequence: Synthetic polypeptide
DEEEIRTTNPVATEQYGCVCSNTGETQNFGSNNQD

SEQ ID NO: 119392 - protein, 34 aa, Artificial Sequence
  Description of Artificial Sequence: Synthetic polypeptide
DEEEIRTTNPVATEQYGCVCSNTGETQFFGSEQS

SEQ ID NO: 119393 - protein, 35 aa, Artificial Sequence
  Description of Artificial Sequence: Synthetic polypeptide
DEEEIRTTNPVATEQYGCVCSNTEPDQENFGSNQS

SEQ ID NO: 119394 - protein, 32 aa, Artificial Sequence
  Description of Artificial Sequence: Synthetic polypeptide
DEEEIRTTNPVATEQYGAVMGGIGGNGNEEFV

SEQ ID NO: 119395 - protein, 34 aa, Artificial Sequence
  Description of Artificial Sequence: Synthetic polypeptide
DEEEIRTTNPVATEQYGAVMGLNIEQQNIGGNGG

SEQ ID NO: 119396 - protein, 35 aa, Artificial Sequence
  Description of Artificial Sequence: Synthetic polypeptide
DEEEIRTTNPVATEQYGCVCSNTEELNQFFGSEQG

SEQ ID NO: 119397 - protein, 34 aa, Artificial Sequence
  Description of Artificial Sequence: Synthetic polypeptide
DEEEIRTTNPVATEQYGCVCSNTEEHQYSNSDQA

SEQ ID NO: 119398 - protein, 35 aa, Artificial Sequence
  Description of Artificial Sequence: Synthetic polypeptide
DEEEIRTTNPVATEQYGCVCSNTEEHQYFGSDNQS

SEQ ID NO: 119399 - protein, 34 aa, Artificial Sequence
  Description of Artificial Sequence: Synthetic polypeptide
DEEEIRTTNPVATEQYGSVSTVGPCNASGETEIF

SEQ ID NO: 119400 - protein, 32 aa, Artificial Sequence
  Description of Artificial Sequence: Synthetic polypeptide
DEDEIATTNPVATEQYGCTAATENLTADIGND

SEQ ID NO: 119401 - protein, 36 aa, Artificial Sequence
  Description of Artificial Sequence: Synthetic polypeptide
DECEICTTNPVATEQYGSVSTTTNLQGNQQGTNVTD

SEQ ID NO: 119402 - protein, 36 aa, Artificial Sequence
  Description of Artificial Sequence: Synthetic polypeptide
DEEEIRTTNPVATEQYGSVSTTMNMMMQEFGEEEVF

SEQ ID NO: 119403 - protein, 36 aa, Artificial Sequence
  Description of Artificial Sequence: Synthetic polypeptide
DEEEIRTTNPVATEQYGSVSTTMNMMWQENGEEEVE

SEQ ID NO: 119404 - protein, 36 aa, Artificial Sequence
  Description of Artificial Sequence: Synthetic polypeptide
DEEEIRTTNPVATEQYGSVSTVGNFTGQEELNNGGG

SEQ ID NO: 119405 - protein, 33 aa, Artificial Sequence
  Description of Artificial Sequence: Synthetic polypeptide
DEAEIRTTNPVATEQYGSVVPWDWQQRFGSDQF

SEQ ID NO: 119406 - protein, 33 aa, Artificial Sequence
  Description of Artificial Sequence: Synthetic polypeptide
DEAEIRTTNPVAYEEWGSVCSGLNDDLQDTGNV

SEQ ID NO: 119407 - protein, 36 aa, Artificial Sequence
  Description of Artificial Sequence: Synthetic polypeptide
DEEEIRTTNPVAYEQYGQSVSQTNDLLQPRSIIEHI

SEQ ID NO: 119408 - protein, 36 aa, Artificial Sequence
  Description of Artificial Sequence: Synthetic polypeptide
DEEEIRTTNPVATEQYGSVSTTNDAGVNNENGTNPV

SEQ ID NO: 119409 - protein, 34 aa, Artificial Sequence
  Description of Artificial Sequence: Synthetic polypeptide
DEEEIRTTNPVATEQYGCVCSNSGELQGFGSDQA

SEQ ID NO: 119410 - protein, 34 aa, Artificial Sequence
  Description of Artificial Sequence: Synthetic polypeptide
DEEEIRTTNPVATEQYGCVCSNSGELQNFGSEQV

SEQ ID NO: 119411 - protein, 34 aa, Artificial Sequence
  Description of Artificial Sequence: Synthetic polypeptide
DEEEIRTTNPVATEQWGHVNVSIPNEDQHRPGGF

SEQ ID NO: 119412 - protein, 35 aa, Artificial Sequence
  Description of Artificial Sequence: Synthetic polypeptide
DEEEIRTTNPVATEQWGHVNVSYTNYNQHRPGDGF

SEQ ID NO: 119413 - protein, 36 aa, Artificial Sequence
  Description of Artificial Sequence: Synthetic polypeptide
DEAEIRTTNPVATEQYGSVVSGDANGLGNEQTGGNL

SEQ ID NO: 119414 - protein, 34 aa, Artificial Sequence
  Description of Artificial Sequence: Synthetic polypeptide
DEEEIRTTNPVATEQYGAVTDGGNLVTEGGNDQG

SEQ ID NO: 119415 - protein, 32 aa, Artificial Sequence
  Description of Artificial Sequence: Synthetic polypeptide
DEEEIRTTNPVAYEQYGCVCWTENHQGFDSDQ

SEQ ID NO: 119416 - protein, 35 aa, Artificial Sequence
  Description of Artificial Sequence: Synthetic polypeptide
DEAEIRTTNPVATEQYGSVVITNDNHQDNGGNNAQ

SEQ ID NO: 119417 - protein, 34 aa, Artificial Sequence
  Description of Artificial Sequence: Synthetic polypeptide
DECEICTTNPVATEQYGSVSTTTGNLEDTEGEDD

SEQ ID NO: 119418 - protein, 33 aa, Artificial Sequence
  Description of Artificial Sequence: Synthetic polypeptide
DECEICTTNPVATEQYGSVSTTTANEDTEGEDA

SEQ ID NO: 119419 - protein, 33 aa, Artificial Sequence
  Description of Artificial Sequence: Synthetic polypeptide
DEEEIRTTNPVAYEQYGCVCSWEELQNFNSNQA

SEQ ID NO: 119420 - protein, 32 aa, Artificial Sequence
  Description of Artificial Sequence: Synthetic polypeptide
DEAEIRTTNPVAYEHWGEVATNLQGNDGQNAN

SEQ ID NO: 119421 - protein, 36 aa, Artificial Sequence
  Description of Artificial Sequence: Synthetic polypeptide
DEEEIRTTNPVATEQWGHSNVSYTANELQHIIGEGF

SEQ ID NO: 119422 - protein, 33 aa, Artificial Sequence
  Description of Artificial Sequence: Synthetic polypeptide
DEDEIATTNPVAYEQWGSVTTNLQGNAGEDGAR

SEQ ID NO: 119423 - protein, 33 aa, Artificial Sequence
  Description of Artificial Sequence: Synthetic polypeptide
DECEICTTNPVATEQYGSVSTTSNQEDTEGEDL

SEQ ID NO: 119424 - protein, 36 aa, Artificial Sequence
  Description of Artificial Sequence: Synthetic polypeptide
DEEEIRTTNPVATEQWGHSNVSYTDAYLQENRPGEF

SEQ ID NO: 119425 - protein, 33 aa, Artificial Sequence
  Description of Artificial Sequence: Synthetic polypeptide
DEDEIATTNPVAYEQWGSVSTNLNAGDTGGNTA

SEQ ID NO: 119426 - protein, 32 aa, Artificial Sequence
  Description of Artificial Sequence: Synthetic polypeptide
DEDEIATTNPVATEQWGSVSATDLEDHEGEDE

SEQ ID NO: 119427 - protein, 34 aa, Artificial Sequence
  Description of Artificial Sequence: Synthetic polypeptide
DEDEIATTNPVATEQWGSVSATENLQDTGMGEDA

SEQ ID NO: 119428 - protein, 36 aa, Artificial Sequence
  Description of Artificial Sequence: Synthetic polypeptide
DEEEIRTTNPVATEQYGSVSTMNDPLNPPSVQNDFY

SEQ ID NO: 119429 - protein, 32 aa, Artificial Sequence
  Description of Artificial Sequence: Synthetic polypeptide
DEDEIATTNPVATEQWGSVSPNPPEAGGNDQT

SEQ ID NO: 119430 - protein, 36 aa, Artificial Sequence
  Description of Artificial Sequence: Synthetic polypeptide
DEEEIRTTNPVATEQWGHSNVSYTDNELQHGPGDGF

SEQ ID NO: 119431 - protein, 34 aa, Artificial Sequence
  Description of Artificial Sequence: Synthetic polypeptide
DECEICTVNPVATEQYGSVSTTNAQLQQQNQEED

SEQ ID NO: 119432 - protein, 34 aa, Artificial Sequence
  Description of Artificial Sequence: Synthetic polypeptide
DEEEIRTTNPVATEQYGAVVDDQNEEQDGGGNQG

SEQ ID NO: 119433 - protein, 34 aa, Artificial Sequence
  Description of Artificial Sequence: Synthetic polypeptide
DECEICTVNPVATEQYGSVSTTAQNNQQGNQDED

SEQ ID NO: 119434 - protein, 34 aa, Artificial Sequence
  Description of Artificial Sequence: Synthetic polypeptide
DECEICTVNPVATEQYGSVSTTAQLQQQGNQQEE

SEQ ID NO: 119435 - protein, 33 aa, Artificial Sequence
  Description of Artificial Sequence: Synthetic polypeptide
DEEEIRTTNPVATEQYGAVVDDNMTMGFGENGQ

SEQ ID NO: 119436 - protein, 33 aa, Artificial Sequence
  Description of Artificial Sequence: Synthetic polypeptide
DEEEIRTTNPVAYEQYGCVCSWEELQNFGSEQS

SEQ ID NO: 119437 - protein, 33 aa, Artificial Sequence
  Description of Artificial Sequence: Synthetic polypeptide
DEAEIRTTNPVAYEEWGSVCSGLNDLQDSGNVP

SEQ ID NO: 119438 - protein, 32 aa, Artificial Sequence
  Description of Artificial Sequence: Synthetic polypeptide
DEDEIATTNPVAYEQWGSVSSTADGGNHGQNR

SEQ ID NO: 119439 - protein, 33 aa, Artificial Sequence
  Description of Artificial Sequence: Synthetic polypeptide
DEDEIATTNPVATEQWGSVAITNDEQNNNGNPV

SEQ ID NO: 119440 - protein, 33 aa, Artificial Sequence
  Description of Artificial Sequence: Synthetic polypeptide
DEDEIATTNPVATEQYGCVAANNLQDMGPNESN

SEQ ID NO: 119441 - protein, 35 aa, Artificial Sequence
  Description of Artificial Sequence: Synthetic polypeptide
DECEICTTNPVATEQYGSVSTTVNQLNMEQGTNTQ

SEQ ID NO: 119442 - protein, 37 aa, Artificial Sequence
  Description of Artificial Sequence: Synthetic polypeptide
DEEEIRTTNPVATEQYGSVSTTNDQGNNNQNGTNPVV

SEQ ID NO: 119443 - protein, 33 aa, Artificial Sequence
  Description of Artificial Sequence: Synthetic polypeptide
DEDEIATTNPVATEQYGCVAATNLATMNPNERE

SEQ ID NO: 119444 - protein, 35 aa, Artificial Sequence
  Description of Artificial Sequence: Synthetic polypeptide
DEEEIRTTNPVATECYGSVSTDGDGQNEEEGNDGG

SEQ ID NO: 119445 - protein, 34 aa, Artificial Sequence
  Description of Artificial Sequence: Synthetic polypeptide
DEEEIRTTNPVATEQYGCVCSNSNHNQNFNSNQS

SEQ ID NO: 119446 - protein, 36 aa, Artificial Sequence
  Description of Artificial Sequence: Synthetic polypeptide
DEEEIRTTNPVATECYGSVSSTTPNGPNMRNGMNPV

SEQ ID NO: 119447 - protein, 33 aa, Artificial Sequence
  Description of Artificial Sequence: Synthetic polypeptide
DEDEIATTNPVATEQYGCVAATNLQNADGPTLA

SEQ ID NO: 119448 - protein, 35 aa, Artificial Sequence
  Description of Artificial Sequence: Synthetic polypeptide
DEEEIRTTNPVATECYGSVSSTTPAGPQRNEMNPV

SEQ ID NO: 119449 - protein, 36 aa, Artificial Sequence
  Description of Artificial Sequence: Synthetic polypeptide
DEEEIRTTNPVATEQWGQCIVCSYTNDLQARFGGFS

SEQ ID NO: 119450 - protein, 34 aa, Artificial Sequence
  Description of Artificial Sequence: Synthetic polypeptide
DEEEIRTTNPVATEQYGCVCSNSNHQNFGSDTQA

SEQ ID NO: 119451 - protein, 38 aa, Artificial Sequence
  Description of Artificial Sequence: Synthetic polypeptide
DEEEIRTTNPVATEQYGSVSTNNQNLQEGTEQGTNVEQ

SEQ ID NO: 119452 - protein, 32 aa, Artificial Sequence
  Description of Artificial Sequence: Synthetic polypeptide
DEDEIATTNPVATEQYGCVAATNPQAEMGTEH

SEQ ID NO: 119453 - protein, 33 aa, Artificial Sequence
  Description of Artificial Sequence: Synthetic polypeptide
DEAEIRTTNPVATEQYGSVWDMNLENRSEDQEG

SEQ ID NO: 119454 - protein, 36 aa, Artificial Sequence
  Description of Artificial Sequence: Synthetic polypeptide
DEEEIRTTNPVATEQWGQSNVCSYTNDLNHRFGSGQ

SEQ ID NO: 119455 - protein, 37 aa, Artificial Sequence
  Description of Artificial Sequence: Synthetic polypeptide
DEEEIRTTNPVATEQWGQSNVCSYTNDLQARFGSGFG

SEQ ID NO: 119456 - protein, 32 aa, Artificial Sequence
  Description of Artificial Sequence: Synthetic polypeptide
DEDEIATTNPVATEQYGCVAATPDQAENPQER

SEQ ID NO: 119457 - protein, 32 aa, Artificial Sequence
  Description of Artificial Sequence: Synthetic polypeptide
DEAAIRTTNPVATEQYGCFCSTNLIHFGSDQF

SEQ ID NO: 119458 - protein, 34 aa, Artificial Sequence
  Description of Artificial Sequence: Synthetic polypeptide
DEAEIRTTNPVATEQYGSVWDVPTEYFQSGQNED

SEQ ID NO: 119459 - protein, 34 aa, Artificial Sequence
  Description of Artificial Sequence: Synthetic polypeptide
DEEEIRTTNPVATECYGSVSTMEMEDNDGQGEGQ

SEQ ID NO: 119460 - protein, 35 aa, Artificial Sequence
  Description of Artificial Sequence: Synthetic polypeptide
DEEEIRTTNPVATECYGSVSTMNGFGQENIGGVGG

SEQ ID NO: 119461 - protein, 33 aa, Artificial Sequence
  Description of Artificial Sequence: Synthetic polypeptide
DEDEIATTNPVATEQYGCVAATANLQDGVDGAV

SEQ ID NO: 119462 - protein, 32 aa, Artificial Sequence
  Description of Artificial Sequence: Synthetic polypeptide
DEDEIATTNPVATEQYGCVAATANLNMPNDTN

SEQ ID NO: 119463 - protein, 34 aa, Artificial Sequence
  Description of Artificial Sequence: Synthetic polypeptide
DEAEIRTTNPVAYECWGVVSNDNLGEEQRGENGR

SEQ ID NO: 119464 - protein, 31 aa, Artificial Sequence
  Description of Artificial Sequence: Synthetic polypeptide
DEDEIATTNPVATEQYGCVAATANLMMPEGT

SEQ ID NO: 119465 - protein, 35 aa, Artificial Sequence
  Description of Artificial Sequence: Synthetic polypeptide
DEEEIRTTNPVATEQYGSVSTVEDLTDDGQGEFGQ

SEQ ID NO: 119466 - protein, 34 aa, Artificial Sequence
  Description of Artificial Sequence: Synthetic polypeptide
DEEEIRTTNPVAYEQYGCVSCTGSMLNVSGTNND

SEQ ID NO: 119467 - protein, 36 aa, Artificial Sequence
  Description of Artificial Sequence: Synthetic polypeptide
DEEEIRTTNPVATEQYGSVSTVDQAGNTEGGTNNQE

SEQ ID NO: 119468 - protein, 35 aa, Artificial Sequence
  Description of Artificial Sequence: Synthetic polypeptide
DEEEIRTTNPVATEQYGSVSTVDPVNQASGQTDID

SEQ ID NO: 119469 - protein, 32 aa, Artificial Sequence
  Description of Artificial Sequence: Synthetic polypeptide
DEDEIATTNPVATEQYGCVAATANLMMPSNTN

SEQ ID NO: 119470 - protein, 34 aa, Artificial Sequence
  Description of Artificial Sequence: Synthetic polypeptide
DEEEIRTTNPVATEQYGCVCSNSGNHQHFNSDQL

SEQ ID NO: 119471 - protein, 31 aa, Artificial Sequence
  Description of Artificial Sequence: Synthetic polypeptide
DEDEIATTNPVATEQYGCVAATANGATMPNT

SEQ ID NO: 119472 - protein, 35 aa, Artificial Sequence
  Description of Artificial Sequence: Synthetic polypeptide
DEEEIRTTNPVATEQWGISTVSYTNAHSIRPGTGF

SEQ ID NO: 119473 - protein, 32 aa, Artificial Sequence
  Description of Artificial Sequence: Synthetic polypeptide
DDSEVATTNPVSTEQYGSVSANDLQSREGQDL

SEQ ID NO: 119474 - protein, 36 aa, Artificial Sequence
  Description of Artificial Sequence: Synthetic polypeptide
DEEEIRTTNPVATEQWGISVVSYTNALSHRPGTGTF

SEQ ID NO: 119475 - protein, 35 aa, Artificial Sequence
  Description of Artificial Sequence: Synthetic polypeptide
DEEEIRTTNPVATEQWGISVVSYTNELSHAPGGGF

SEQ ID NO: 119476 - protein, 35 aa, Artificial Sequence
  Description of Artificial Sequence: Synthetic polypeptide
DEEEIRTTNPVATEQWGISVYSPINELYRMDNMEP

SEQ ID NO: 119477 - protein, 34 aa, Artificial Sequence
  Description of Artificial Sequence: Synthetic polypeptide
DEEEIRTTNPVATEQYGSVSTVDMTDVTIEQGSQ

SEQ ID NO: 119478 - protein, 32 aa, Artificial Sequence
  Description of Artificial Sequence: Synthetic polypeptide
DEDEIATTNPVATEQYGCVAATANLMTMPNQT

SEQ ID NO: 119479 - protein, 32 aa, Artificial Sequence
  Description of Artificial Sequence: Synthetic polypeptide
DDSEVATTNPVSTEQYGSVSANDLQSRVGQDL

SEQ ID NO: 119480 - protein, 33 aa, Artificial Sequence
  Description of Artificial Sequence: Synthetic polypeptide
DECEICTTNPVATEQYGSVSTTVTLEDTEGEDE

SEQ ID NO: 119481 - protein, 33 aa, Artificial Sequence
  Description of Artificial Sequence: Synthetic polypeptide
DEEEIRTTNPVATEQYGSVSTVDPAHPEVEDDI

SEQ ID NO: 119482 - protein, 35 aa, Artificial Sequence
  Description of Artificial Sequence: Synthetic polypeptide
DECEICTVNPVATEQYGSVSTTNLQNSEEGNNQET

SEQ ID NO: 119483 - protein, 34 aa, Artificial Sequence
  Description of Artificial Sequence: Synthetic polypeptide
DEEEIRTTNPVATEDYGCVSGAFNSEQGRPGPSP

SEQ ID NO: 119484 - protein, 35 aa, Artificial Sequence
  Description of Artificial Sequence: Synthetic polypeptide
DEEEIRTTNPVAYEQYGQCVSWNDLDQERFGSDQS

SEQ ID NO: 119485 - protein, 37 aa, Artificial Sequence
  Description of Artificial Sequence: Synthetic polypeptide
DEEEIRTTNPVATEQYGSVSTTLQAGNATEQGTNQQT

SEQ ID NO: 119486 - protein, 37 aa, Artificial Sequence
  Description of Artificial Sequence: Synthetic polypeptide
DEEEIRTTNPVATEQYGSVSTTLQAGNNNQQGTNQDE

SEQ ID NO: 119487 - protein, 37 aa, Artificial Sequence
  Description of Artificial Sequence: Synthetic polypeptide
DEEEIRTTNPVATEQYGSVSTTLQAGNNNQQGTNTVT

SEQ ID NO: 119488 - protein, 37 aa, Artificial Sequence
  Description of Artificial Sequence: Synthetic polypeptide
DEEEIRTTNPVATEQYGSVSTTLQAGNNTEQGVTNQE

SEQ ID NO: 119489 - protein, 37 aa, Artificial Sequence
  Description of Artificial Sequence: Synthetic polypeptide
DEEEIRTTNPVATEQYGSVSTTLQAGNTTEQGTNNQE

SEQ ID NO: 119490 - protein, 35 aa, Artificial Sequence
  Description of Artificial Sequence: Synthetic polypeptide
DECEICTTNPVATEQYGSVSTTNQQQGEQQGNNNQ

SEQ ID NO: 119491 - protein, 34 aa, Artificial Sequence
  Description of Artificial Sequence: Synthetic polypeptide
DEEEIRTTNPVATEQYGCVCSNWGEHQRFGSQQP

SEQ ID NO: 119492 - protein, 32 aa, Artificial Sequence
  Description of Artificial Sequence: Synthetic polypeptide
DEEEIRTTNPVATEQYGAVVGDGEQDEGGGGG

SEQ ID NO: 119493 - protein, 31 aa, Artificial Sequence
  Description of Artificial Sequence: Synthetic polypeptide
DEDEIATTNPVAYEQWGTVSTNLNGEHNNDT

SEQ ID NO: 119494 - protein, 35 aa, Artificial Sequence
  Description of Artificial Sequence: Synthetic polypeptide
DECEICTTNPVATEQYGSVSTTNQQQGEQQGTNIL

SEQ ID NO: 119495 - protein, 32 aa, Artificial Sequence
  Description of Artificial Sequence: Synthetic polypeptide
DEEEIRTTNPVATEQWGDVSTPAEMMAAGDPV

SEQ ID NO: 119496 - protein, 34 aa, Artificial Sequence
  Description of Artificial Sequence: Synthetic polypeptide
DEEEIRTTNPVATEQYGAVVDTDINEQGQEGGQG

SEQ ID NO: 119497 - protein, 32 aa, Artificial Sequence
  Description of Artificial Sequence: Synthetic polypeptide
DEDEIATTNPVAYEQWGTVSTNLNGEAGNEGD

SEQ ID NO: 119498 - protein, 34 aa, Artificial Sequence
  Description of Artificial Sequence: Synthetic polypeptide
DEAEIRTTNPVAYEQWGCCVWQTNDHHQRGIGNR

SEQ ID NO: 119499 - protein, 35 aa, Artificial Sequence
  Description of Artificial Sequence: Synthetic polypeptide
DEEEIRTTNPVATEQYGAVVDTDINELQGQGGQGG

SEQ ID NO: 119500 - protein, 36 aa, Artificial Sequence
  Description of Artificial Sequence: Synthetic polypeptide
DEEEIRTTNPVATEQYGAVVDSDTNDLTGQGEQGET

SEQ ID NO: 119501 - protein, 34 aa, Artificial Sequence
  Description of Artificial Sequence: Synthetic polypeptide
DECEICTVNPVATEQYGSVSTTTNQLEEGTNNTD

SEQ ID NO: 119502 - protein, 33 aa, Artificial Sequence
  Description of Artificial Sequence: Synthetic polypeptide
DECEICTVNPVATEQYGSVSTTTQLQQQNQDEE

SEQ ID NO: 119503 - protein, 33 aa, Artificial Sequence
  Description of Artificial Sequence: Synthetic polypeptide
DEEEIRTTNPVATEQYGAVVGDTDDGTEQGGEE

SEQ ID NO: 119504 - protein, 31 aa, Artificial Sequence
  Description of Artificial Sequence: Synthetic polypeptide
DEDEIATTNPVAYEQWGTVSTNLNMGDDGSS

SEQ ID NO: 119505 - protein, 34 aa, Artificial Sequence
  Description of Artificial Sequence: Synthetic polypeptide
DEEEIRTTNPVAYEQYGQCVCSWMEDLDQRGSQQ

SEQ ID NO: 119506 - protein, 34 aa, Artificial Sequence
  Description of Artificial Sequence: Synthetic polypeptide
DEDEIATTNPVATEAYGVVCSTNDGQDRAGTNNM

SEQ ID NO: 119507 - protein, 34 aa, Artificial Sequence
  Description of Artificial Sequence: Synthetic polypeptide
DEEEIRTTNPVATEQYGCVCSNWGETNQNFNSEQ

SEQ ID NO: 119508 - protein, 33 aa, Artificial Sequence
  Description of Artificial Sequence: Synthetic polypeptide
DEDEIATTNPVATEGWGSVCSTNDGGQHGGNEE

SEQ ID NO: 119509 - protein, 35 aa, Artificial Sequence
  Description of Artificial Sequence: Synthetic polypeptide
DECEICTTNPVATEQYGSVSTTNNQQQQEQQGNLG

SEQ ID NO: 119510 - protein, 32 aa, Artificial Sequence
  Description of Artificial Sequence: Synthetic polypeptide
DEDEIATTNPVAYEQYGCVATNLQGPGDEALH

SEQ ID NO: 119511 - protein, 32 aa, Artificial Sequence
  Description of Artificial Sequence: Synthetic polypeptide
DEDEIATTNPVATEMWGSVATNLETEGGNEHT

SEQ ID NO: 119512 - protein, 33 aa, Artificial Sequence
  Description of Artificial Sequence: Synthetic polypeptide
DEDEIATTNPVATENYGSVATGNNLQMDPNNGI

SEQ ID NO: 119513 - protein, 33 aa, Artificial Sequence
  Description of Artificial Sequence: Synthetic polypeptide
DEDEIATTNPVATENYGSVATGNNLQMDPNNGK

SEQ ID NO: 119514 - protein, 35 aa, Artificial Sequence
  Description of Artificial Sequence: Synthetic polypeptide
DEAEIRTTNPVATEQYGSVTNSEDHTQRDTNDERQ

SEQ ID NO: 119515 - protein, 33 aa, Artificial Sequence
  Description of Artificial Sequence: Synthetic polypeptide
DEDEIATTNPVATEPYGSVCAGNNLADRGGNDQ

SEQ ID NO: 119516 - protein, 34 aa, Artificial Sequence
  Description of Artificial Sequence: Synthetic polypeptide
DEEEIRTTNPVATEQYGCVCSNWGELQYFGSEQS

SEQ ID NO: 119517 - protein, 31 aa, Artificial Sequence
  Description of Artificial Sequence: Synthetic polypeptide
DEDEIATTNPVATEPYGSVSANNDRNDTEEN

SEQ ID NO: 119518 - protein, 34 aa, Artificial Sequence
  Description of Artificial Sequence: Synthetic polypeptide
DEEEIRTTNPVATEQYGCVCSNWGELQSFGSDQT

SEQ ID NO: 119519 - protein, 35 aa, Artificial Sequence
  Description of Artificial Sequence: Synthetic polypeptide
DEEEIRTTNPVATEQYGCVCSNWGELQNFGSNTQS

SEQ ID NO: 119520 - protein, 34 aa, Artificial Sequence
  Description of Artificial Sequence: Synthetic polypeptide
DEEEIRTTNPVATEQYGCVCSNWGELQHFNSDQL

SEQ ID NO: 119521 - protein, 33 aa, Artificial Sequence
  Description of Artificial Sequence: Synthetic polypeptide
DEEEIRTTNPVATEQWGDVSTEIEPMNRNENPV

SEQ ID NO: 119522 - protein, 34 aa, Artificial Sequence
  Description of Artificial Sequence: Synthetic polypeptide
DEAEIRTTNPVATEQYGSVSVYVLQSMIGQTDDM

SEQ ID NO: 119523 - protein, 35 aa, Artificial Sequence
  Description of Artificial Sequence: Synthetic polypeptide
DECEICTTNPVATEQYGSVSTTNQQQEQQGNNEEN

SEQ ID NO: 119524 - protein, 34 aa, Artificial Sequence
  Description of Artificial Sequence: Synthetic polypeptide
DECEICTVNPVATEQYGSVSTVTNLEEQGTNNTD

SEQ ID NO: 119525 - protein, 34 aa, Artificial Sequence
  Description of Artificial Sequence: Synthetic polypeptide
DEAEIRTTNPVATEQYGSVTPPNVQTTEEGENEP

SEQ ID NO: 119526 - protein, 33 aa, Artificial Sequence
  Description of Artificial Sequence: Synthetic polypeptide
DEAEIRTTNPVAYEQWGAVSTNLNGNAGENSDP

SEQ ID NO: 119527 - protein, 33 aa, Artificial Sequence
  Description of Artificial Sequence: Synthetic polypeptide
DEAEIRTTNPVAYEQWGAVSTNLNGNAGEEGRD

SEQ ID NO: 119528 - protein, 34 aa, Artificial Sequence
  Description of Artificial Sequence: Synthetic polypeptide
DEEEIRTTNPVAYEQYGQCVCSWNDHDQRGSDQS

SEQ ID NO: 119529 - protein, 33 aa, Artificial Sequence
  Description of Artificial Sequence: Synthetic polypeptide
DEAEIRTTNPVAYEHWGTVSTNLGAGNAGENSR

SEQ ID NO: 119530 - protein, 35 aa, Artificial Sequence
  Description of Artificial Sequence: Synthetic polypeptide
DECEICTVNPVATEQYGSVSTTNQQLQQGNQEDEE

SEQ ID NO: 119531 - protein, 34 aa, Artificial Sequence
  Description of Artificial Sequence: Synthetic polypeptide
DEEEIRTTNPVAYEQYGQCVSNSNDLNQHFGSQQ

SEQ ID NO: 119532 - protein, 35 aa, Artificial Sequence
  Description of Artificial Sequence: Synthetic polypeptide
DECEICTVNPVATEQYGSVSTTNQQLQQGNNQQSE

SEQ ID NO: 119533 - protein, 33 aa, Artificial Sequence
  Description of Artificial Sequence: Synthetic polypeptide
DEEEIRTTNPVAYEQYGQCVSSNDHNQNFGSQA

SEQ ID NO: 119534 - protein, 33 aa, Artificial Sequence
  Description of Artificial Sequence: Synthetic polypeptide
DEAEIRTTNPVAYEHWGSVATNLQGDLGGNNGS

SEQ ID NO: 119535 - protein, 35 aa, Artificial Sequence
  Description of Artificial Sequence: Synthetic polypeptide
DEEEIRTTNPVATEQWGHCNVSYTNGLQATDPGGF

SEQ ID NO: 119536 - protein, 33 aa, Artificial Sequence
  Description of Artificial Sequence: Synthetic polypeptide
DECEICTTNPVATEQYGSVSTTQNLEDEEEEDD

SEQ ID NO: 119537 - protein, 33 aa, Artificial Sequence
  Description of Artificial Sequence: Synthetic polypeptide
DEEEIRTTNPVATEQYGCVCSNWGEHQHFGSDQ

SEQ ID NO: 119538 - protein, 34 aa, Artificial Sequence
  Description of Artificial Sequence: Synthetic polypeptide
DEEEIRTTNPVAYEQYGQCVSTEEDLNQYFGSEQ

SEQ ID NO: 119539 - protein, 35 aa, Artificial Sequence
  Description of Artificial Sequence: Synthetic polypeptide
DEEEIRTTNPVAYEQYGQCVSTENDLNQNFGSEQA

SEQ ID NO: 119540 - protein, 34 aa, Artificial Sequence
  Description of Artificial Sequence: Synthetic polypeptide
DEAEIRTTNPVATEQYGSVTWIDVLDQIAEGNIQ

SEQ ID NO: 119541 - protein, 34 aa, Artificial Sequence
  Description of Artificial Sequence: Synthetic polypeptide
DEEEIRTTNPVATEQWGHNNVSIMNFLQHLPGGE

SEQ ID NO: 119542 - protein, 35 aa, Artificial Sequence
  Description of Artificial Sequence: Synthetic polypeptide
DEEEIRTTNPVAYEQYGQCVSTGEDLNQRFGSEQG

SEQ ID NO: 119543 - protein, 35 aa, Artificial Sequence
  Description of Artificial Sequence: Synthetic polypeptide
DEEEIRTTNPVATEQWGHSNVAYTNYLQHDPGTGF

SEQ ID NO: 119544 - protein, 33 aa, Artificial Sequence
  Description of Artificial Sequence: Synthetic polypeptide
DECEICTTNPVATEQYGSVSTTQQLEDTEGEDL

SEQ ID NO: 119545 - protein, 34 aa, Artificial Sequence
  Description of Artificial Sequence: Synthetic polypeptide
DEEEIRTTNPVATEEWGCVPSCTNNGSQEGLNNI

SEQ ID NO: 119546 - protein, 36 aa, Artificial Sequence
  Description of Artificial Sequence: Synthetic polypeptide
DEEEIRTTNPVATEQYGSVSTTMELLNEQQETNLVQ

SEQ ID NO: 119547 - protein, 35 aa, Artificial Sequence
  Description of Artificial Sequence: Synthetic polypeptide
DEEEIRTTNPVATEQYGSVSTNLGASEVPFFVTVA

SEQ ID NO: 119548 - protein, 36 aa, Artificial Sequence
  Description of Artificial Sequence: Synthetic polypeptide
DEEEIRTTNPVATEQWGHCNVSATNHLQHRPPGQFN

SEQ ID NO: 119549 - protein, 36 aa, Artificial Sequence
  Description of Artificial Sequence: Synthetic polypeptide
DEEEIRTTNPVATEQWGHCNVSATNHLQHGRPPGDF

SEQ ID NO: 119550 - protein, 33 aa, Artificial Sequence
  Description of Artificial Sequence: Synthetic polypeptide
DEAEIRTTNPVATEQYGSVTPTNGESLNNDEDN

SEQ ID NO: 119551 - protein, 35 aa, Artificial Sequence
  Description of Artificial Sequence: Synthetic polypeptide
DECEICTVNPVATEQYGSVSTTTNLQLEQGTNNTD

SEQ ID NO: 119552 - protein, 35 aa, Artificial Sequence
  Description of Artificial Sequence: Synthetic polypeptide
DECEICTVNPVATEQYGSVSTTTANLNQQGNQDED

SEQ ID NO: 119553 - protein, 34 aa, Artificial Sequence
  Description of Artificial Sequence: Synthetic polypeptide
DECEICTVNPVATEQYGSVSTTQNNLEEGTNATD

SEQ ID NO: 119554 - protein, 32 aa, Artificial Sequence
  Description of Artificial Sequence: Synthetic polypeptide
DEEEIRTTNPVATEQWGDVSTPAEMNAAGDPV

SEQ ID NO: 119555 - protein, 32 aa, Artificial Sequence
  Description of Artificial Sequence: Synthetic polypeptide
DEEEIRTTNPVATEQWGDVSTTAEMMANEMNA

SEQ ID NO: 119556 - protein, 35 aa, Artificial Sequence
  Description of Artificial Sequence: Synthetic polypeptide
DECEICTTNPVATEQYGSVSTTNQQQQEQQGNNDG

SEQ ID NO: 119557 - protein, 35 aa, Artificial Sequence
  Description of Artificial Sequence: Synthetic polypeptide
DECEICTTNPVATEQYGSVSTTNQQQQEQQGNNQN

SEQ ID NO: 119558 - protein, 34 aa, Artificial Sequence
  Description of Artificial Sequence: Synthetic polypeptide
DEEEIRTTNPVATEQYGCVCSNWGEHQNFGSNDG

SEQ ID NO: 119559 - protein, 28 aa, Artificial Sequence
  Description of Artificial Sequence: Synthetic peptide
DEEEIRTTNPVATEQWGEAPEICMHEDK

SEQ ID NO: 119560 - protein, 34 aa, Artificial Sequence
  Description of Artificial Sequence: Synthetic polypeptide
DECEICTVNPVATEQYGSVSTTQNLDEEGNNNTD

SEQ ID NO: 119561 - protein, 33 aa, Artificial Sequence
  Description of Artificial Sequence: Synthetic polypeptide
DECEICTTNPVATEQYGSVSTTQLEDTEEGEDD

SEQ ID NO: 119562 - protein, 30 aa, Artificial Sequence
  Description of Artificial Sequence: Synthetic polypeptide
DEEEIRTTNPVATEQWGEASEVEMNAAEDA

SEQ ID NO: 119563 - protein, 30 aa, Artificial Sequence
  Description of Artificial Sequence: Synthetic polypeptide
DEEEIRTTNPVATEQWGEASEVEQNAAEEA

SEQ ID NO: 119564 - protein, 35 aa, Artificial Sequence
  Description of Artificial Sequence: Synthetic polypeptide
DEEEIRTTNPVATEQYGAVVDGNGNLQSGTEGGNG

SEQ ID NO: 119565 - protein, 30 aa, Artificial Sequence
  Description of Artificial Sequence: Synthetic polypeptide
DEDEIATTNPVAYEQWGTISATNLAAPNNN

SEQ ID NO: 119566 - protein, 35 aa, Artificial Sequence
  Description of Artificial Sequence: Synthetic polypeptide
DEEEIRTTNPVATEQYGAVVDGNGNLQGEEGGNDG

SEQ ID NO: 119567 - protein, 35 aa, Artificial Sequence
  Description of Artificial Sequence: Synthetic polypeptide
DECEICTVNPVATEQYGSVSTTNQQLQQGTNQDED

SEQ ID NO: 119568 - protein, 33 aa, Artificial Sequence
  Description of Artificial Sequence: Synthetic polypeptide
DEAEIRTTNPVAYEPYGVVSVTTVLSTRPGNDL

SEQ ID NO: 119569 - protein, 34 aa, Artificial Sequence
  Description of Artificial Sequence: Synthetic polypeptide
DEDEIATTNPVATEAYGVVCSTNDDGQDRGGTNN

SEQ ID NO: 119570 - protein, 35 aa, Artificial Sequence
  Description of Artificial Sequence: Synthetic polypeptide
DEEEIRTTNPVATEQYGCVCSNTAHQENFGSNTQL

SEQ ID NO: 119571 - protein, 34 aa, Artificial Sequence
  Description of Artificial Sequence: Synthetic polypeptide
DEEEIRTTNPVAYEQYGQSVSQNDLLTPEGIETN

SEQ ID NO: 119572 - protein, 37 aa, Artificial Sequence
  Description of Artificial Sequence: Synthetic polypeptide
DEEEIRTTNPVATEQYGSVSTTNLQAGTEQGVTTDEQ

SEQ ID NO: 119573 - protein, 36 aa, Artificial Sequence
  Description of Artificial Sequence: Synthetic polypeptide
DEEEIRTTNPVAYEQYGESVSPSTNDEQSRVGEPVD

SEQ ID NO: 119574 - protein, 35 aa, Artificial Sequence
  Description of Artificial Sequence: Synthetic polypeptide
DEEEIRTTNPVATEQYGAVSTGTGGQGGNDDNDGG

SEQ ID NO: 119575 - protein, 31 aa, Artificial Sequence
  Description of Artificial Sequence: Synthetic polypeptide
DEDEIATTNPVATEQYGSVASNPANPNPEQP

SEQ ID NO: 119576 - protein, 36 aa, Artificial Sequence
  Description of Artificial Sequence: Synthetic polypeptide
DECEICTTNPVATEQYGSVSTVNLQQLGNTEEGEDD

SEQ ID NO: 119577 - protein, 33 aa, Artificial Sequence
  Description of Artificial Sequence: Synthetic polypeptide
DEEEIRTTNPVATECYGDVSTEPAGPNHNEMNL

SEQ ID NO: 119578 - protein, 31 aa, Artificial Sequence
  Description of Artificial Sequence: Synthetic polypeptide
DEAEIRTTNPVAVEQYGCISVELEGRENNQH

SEQ ID NO: 119579 - protein, 32 aa, Artificial Sequence
  Description of Artificial Sequence: Synthetic polypeptide
DEEEIRTTNPVATECYGDVSSECLNMHNEEPL

SEQ ID NO: 119580 - protein, 32 aa, Artificial Sequence
  Description of Artificial Sequence: Synthetic polypeptide
DEAEIRTTNPVAVEQYGCISTFLEGRIENNQH

SEQ ID NO: 119581 - protein, 29 aa, Artificial Sequence
  Description of Artificial Sequence: Synthetic peptide
DEDEIATTNPVAYEPWGSTANNNLQDGDT

SEQ ID NO: 119582 - protein, 32 aa, Artificial Sequence
  Description of Artificial Sequence: Synthetic polypeptide
DEDEIATTNPVATEQYGSVATAPQANDPTGRE

SEQ ID NO: 119583 - protein, 35 aa, Artificial Sequence
  Description of Artificial Sequence: Synthetic polypeptide
DEEEIRTTNPVATEQYGSVSTMHDHQPMEVNDDNF

SEQ ID NO: 119584 - protein, 34 aa, Artificial Sequence
  Description of Artificial Sequence: Synthetic polypeptide
DEAEIRTTNPVATEQYGSVWSTIRTNTQEDEEQN

SEQ ID NO: 119585 - protein, 33 aa, Artificial Sequence
  Description of Artificial Sequence: Synthetic polypeptide
DECEICTTNPVAVEQYGSVSTSTNTEQGTNQGE

SEQ ID NO: 119586 - protein, 34 aa, Artificial Sequence
  Description of Artificial Sequence: Synthetic polypeptide
DECEICTTNPVAVEQYGSVSTSTNNLEQGTNNGE

SEQ ID NO: 119587 - protein, 34 aa, Artificial Sequence
  Description of Artificial Sequence: Synthetic polypeptide
DECEICTTNPVAVEQYGSVSTSTNNLEQGTNNEG

SEQ ID NO: 119588 - protein, 34 aa, Artificial Sequence
  Description of Artificial Sequence: Synthetic polypeptide
DECEICTTNPVAVEQYGSVSTSNNNLEQGTNQGT

SEQ ID NO: 119589 - protein, 32 aa, Artificial Sequence
  Description of Artificial Sequence: Synthetic polypeptide
DEEEIRTTNPVATECYGETSAENMEQRMTVAF

SEQ ID NO: 119590 - protein, 35 aa, Artificial Sequence
  Description of Artificial Sequence: Synthetic polypeptide
DEEEIRTTNPVAYEQYGESVSLVNDELERVGVPVD

SEQ ID NO: 119591 - protein, 37 aa, Artificial Sequence
  Description of Artificial Sequence: Synthetic polypeptide
DEEEIRTTNPVATEQYGSVSTTNLQAGTEEGSTQDEE

SEQ ID NO: 119592 - protein, 34 aa, Artificial Sequence
  Description of Artificial Sequence: Synthetic polypeptide
DEAEIRTTNPVATEQYGSVWSTINDNTQEDQEQN

SEQ ID NO: 119593 - protein, 34 aa, Artificial Sequence
  Description of Artificial Sequence: Synthetic polypeptide
DEEEIRTTNPVATEQYGCVCSNWELQENFNSDQQ

SEQ ID NO: 119594 - protein, 33 aa, Artificial Sequence
  Description of Artificial Sequence: Synthetic polypeptide
DEAEIRTTNPVAYEAWGEVCSTNDGQHDGDDNR

SEQ ID NO: 119595 - protein, 35 aa, Artificial Sequence
  Description of Artificial Sequence: Synthetic polypeptide
DEEEIRTTNPVATEQYGCVCSNWELQENFGSNFQP

SEQ ID NO: 119596 - protein, 35 aa, Artificial Sequence
  Description of Artificial Sequence: Synthetic polypeptide
DEEEIRTTNPVATECYGKTVSCTDAESHSRGGNRC

SEQ ID NO: 119597 - protein, 34 aa, Artificial Sequence
  Description of Artificial Sequence: Synthetic polypeptide
DEEEIRTTNPVATEQYGCVCSNWEHQYFGSDNQS

SEQ ID NO: 119598 - protein, 33 aa, Artificial Sequence
  Description of Artificial Sequence: Synthetic polypeptide
DEEEIRTTNPVATECYGKHSYTWNEQPPISNEF

SEQ ID NO: 119599 - protein, 34 aa, Artificial Sequence
  Description of Artificial Sequence: Synthetic polypeptide
DEEEIRTTNPVATEQYGCVCSNTEEDQNFISNQG

SEQ ID NO: 119600 - protein, 34 aa, Artificial Sequence
  Description of Artificial Sequence: Synthetic polypeptide
DEEEIRTTNPVATEQYGCVCSNTEEDQYFGSDQS

SEQ ID NO: 119601 - protein, 34 aa, Artificial Sequence
  Description of Artificial Sequence: Synthetic polypeptide
DEEEIRTTNPVATECYGAMSTGNGQGGDTDNFFD

SEQ ID NO: 119602 - protein, 31 aa, Artificial Sequence
  Description of Artificial Sequence: Synthetic polypeptide
DEAEIRTTNPVAYEAWGCVSTNLNGDTNGTG

SEQ ID NO: 119603 - protein, 34 aa, Artificial Sequence
  Description of Artificial Sequence: Synthetic polypeptide
DECEICTTNPVAVEQYGSVSTSVTTNLEQGTNNG

SEQ ID NO: 119604 - protein, 34 aa, Artificial Sequence
  Description of Artificial Sequence: Synthetic polypeptide
DEEEIRTTNPVATEQYGCVCSNWEHQNFGSDNQS

SEQ ID NO: 119605 - protein, 38 aa, Artificial Sequence
  Description of Artificial Sequence: Synthetic polypeptide
DEEEIRTTNPVATEQYGSVSTTNLQAGNTEQGTTEQGS

SEQ ID NO: 119606 - protein, 33 aa, Artificial Sequence
  Description of Artificial Sequence: Synthetic polypeptide
DEEEIRTTNPVATEQYGCVCSNWEHQHFNSQQT

SEQ ID NO: 119607 - protein, 33 aa, Artificial Sequence
  Description of Artificial Sequence: Synthetic polypeptide
DEEEIRTTNPVATEQYGCVCSNWEHQHFGSQQA

SEQ ID NO: 119608 - protein, 33 aa, Artificial Sequence
  Description of Artificial Sequence: Synthetic polypeptide
DEEEIRTTNPVATEQYGCVCSNWEHQGFGSDQA

SEQ ID NO: 119609 - protein, 33 aa, Artificial Sequence
  Description of Artificial Sequence: Synthetic polypeptide
DEEEIRTTNPVATEQYGCVCSNWEHQFFGSEVA

SEQ ID NO: 119610 - protein, 34 aa, Artificial Sequence
  Description of Artificial Sequence: Synthetic polypeptide
DEEEIRTTNPVATECYGKHSTNEESGNRTVGNNF

SEQ ID NO: 119611 - protein, 31 aa, Artificial Sequence
  Description of Artificial Sequence: Synthetic polypeptide
DEEEIRTTNPVATECYGKHSTWVEMPPSNEF

SEQ ID NO: 119612 - protein, 33 aa, Artificial Sequence
  Description of Artificial Sequence: Synthetic polypeptide
DEAEIRTTNPVAYEAWGSVSTNLNLGDTQNDTS

SEQ ID NO: 119613 - protein, 34 aa, Artificial Sequence
  Description of Artificial Sequence: Synthetic polypeptide
DEDEIATTNPVATEQYGSVCAANNLQDQGGNESN

SEQ ID NO: 119614 - protein, 35 aa, Artificial Sequence
  Description of Artificial Sequence: Synthetic polypeptide
DEEEIRTTNPVATEQYGAVSSTAPDGPNMPNGNPV

SEQ ID NO: 119615 - protein, 35 aa, Artificial Sequence
  Description of Artificial Sequence: Synthetic polypeptide
DEEEIRTTNPVATEQYGAVSITNGDEFNGGGNQGD

SEQ ID NO: 119616 - protein, 34 aa, Artificial Sequence
  Description of Artificial Sequence: Synthetic polypeptide
DEAEIRTTNPVATEQYGSVWVTHVEMEGTGNERF

SEQ ID NO: 119617 - protein, 33 aa, Artificial Sequence
  Description of Artificial Sequence: Synthetic polypeptide
DECEICTTNPVATEQYGSVSTVTLQEDTEEEDD

SEQ ID NO: 119618 - protein, 35 aa, Artificial Sequence
  Description of Artificial Sequence: Synthetic polypeptide
DEEEIRTTNPVATEQYGSVSTMELTDFDNQGEFGQ

SEQ ID NO: 119619 - protein, 33 aa, Artificial Sequence
  Description of Artificial Sequence: Synthetic polypeptide
DEEEIRTTNPVATECWGSVSCPAGPNDRNGENG

SEQ ID NO: 119620 - protein, 35 aa, Artificial Sequence
  Description of Artificial Sequence: Synthetic polypeptide
DEEEIRTTNPVATEQYGAVSITNGDEFNGGGDGND

SEQ ID NO: 119621 - protein, 35 aa, Artificial Sequence
  Description of Artificial Sequence: Synthetic polypeptide
DEAEIRTTNPVATEQYGSVWVTIVEMNEGIGNERE

SEQ ID NO: 119622 - protein, 34 aa, Artificial Sequence
  Description of Artificial Sequence: Synthetic polypeptide
DEEEIRTTNPVATECWGSVSCIAEPQDREGMNPG

SEQ ID NO: 119623 - protein, 33 aa, Artificial Sequence
  Description of Artificial Sequence: Synthetic polypeptide
DEEEIRTTNPVATECWGSVMCINEPQDREGEPG

SEQ ID NO: 119624 - protein, 34 aa, Artificial Sequence
  Description of Artificial Sequence: Synthetic polypeptide
DEAEIRTTNPVATETYGCVSTGGAGLTNGGNQSR

SEQ ID NO: 119625 - protein, 32 aa, Artificial Sequence
  Description of Artificial Sequence: Synthetic polypeptide
DEEEIRTTNPVATEQWGSVSEPIEMNAAEMDA

SEQ ID NO: 119626 - protein, 32 aa, Artificial Sequence
  Description of Artificial Sequence: Synthetic polypeptide
DEEEIRTTNPVATEQWGSVSEPIENNAAEMDA

SEQ ID NO: 119627 - protein, 33 aa, Artificial Sequence
  Description of Artificial Sequence: Synthetic polypeptide
DEAEIRTTNPVATETYGCVSTGGAGLTNGGNAI

SEQ ID NO: 119628 - protein, 35 aa, Artificial Sequence
  Description of Artificial Sequence: Synthetic polypeptide
DEEEIRTTNPVATEQYGCVCSNTEEHQRFGSDTQG

SEQ ID NO: 119629 - protein, 38 aa, Artificial Sequence
  Description of Artificial Sequence: Synthetic polypeptide
DEEEIRTTNPVATEQYGSVSTTTTNLQAGNQAGNTNAE

SEQ ID NO: 119630 - protein, 35 aa, Artificial Sequence
  Description of Artificial Sequence: Synthetic polypeptide
DEEEIRTTNPVATEQYGSVSTIWPQTQEENGPQFE

SEQ ID NO: 119631 - protein, 36 aa, Artificial Sequence
  Description of Artificial Sequence: Synthetic polypeptide
DEEEIRTTNPVATEQYGSVSTTTQQGNSEQGTNNEE

SEQ ID NO: 119632 - protein, 34 aa, Artificial Sequence
  Description of Artificial Sequence: Synthetic polypeptide
DEEEIRTTNPVATECWGSVSSCPNGPNDREGENV

SEQ ID NO: 119633 - protein, 34 aa, Artificial Sequence
  Description of Artificial Sequence: Synthetic polypeptide
DEEEIRTTNPVATECWGSVSSCPNGPNMRNGENG

SEQ ID NO: 119634 - protein, 34 aa, Artificial Sequence
  Description of Artificial Sequence: Synthetic polypeptide
DECEICTTNPVAVEQYGSVSTNTNNLEQGTNTGN

SEQ ID NO: 119635 - protein, 35 aa, Artificial Sequence
  Description of Artificial Sequence: Synthetic polypeptide
DEEEIRTTNPVATECWGSVSSTCPNGPNDREGENV

SEQ ID NO: 119636 - protein, 33 aa, Artificial Sequence
  Description of Artificial Sequence: Synthetic polypeptide
DECEICTTNPVAVEQYGSVSTNTTNVEQGTNTG

SEQ ID NO: 119637 - protein, 34 aa, Artificial Sequence
  Description of Artificial Sequence: Synthetic polypeptide
DEDEIATTNPVATEQYGSVCAANNLQDSDGNDQH

SEQ ID NO: 119638 - protein, 33 aa, Artificial Sequence
  Description of Artificial Sequence: Synthetic polypeptide
DECEICTTNPVAVEQYGSVSTNTTNTEQGTNGQ

SEQ ID NO: 119639 - protein, 35 aa, Artificial Sequence
  Description of Artificial Sequence: Synthetic polypeptide
DEEEIRTTNPVATEQYGCVCSNTEEHNQRFNSDQG

SEQ ID NO: 119640 - protein, 36 aa, Artificial Sequence
  Description of Artificial Sequence: Synthetic polypeptide
DEAEIRTTNPVATEQYGSVWTHTNLEEQDNGQEDRN

SEQ ID NO: 119641 - protein, 33 aa, Artificial Sequence
  Description of Artificial Sequence: Synthetic polypeptide
DECEICTTNPVATEQYGSVSTVQQGDTEENEDD

SEQ ID NO: 119642 - protein, 33 aa, Artificial Sequence
  Description of Artificial Sequence: Synthetic polypeptide
DEEEIRTTNPVATECYGAMSTGNGEEDGDTNNF

SEQ ID NO: 119643 - protein, 33 aa, Artificial Sequence
  Description of Artificial Sequence: Synthetic polypeptide
DEEEIRTTNPVATECYGAMSTGNGEDGDEENFN

SEQ ID NO: 119644 - protein, 33 aa, Artificial Sequence
  Description of Artificial Sequence: Synthetic polypeptide
DEDEIATTNPVATEQYGSVCAANNLQDSDDNHN

SEQ ID NO: 119645 - protein, 33 aa, Artificial Sequence
  Description of Artificial Sequence: Synthetic polypeptide
DEEEIRTTNPVAYEQYGQSVSQNDLLTESIEFF

SEQ ID NO: 119646 - protein, 34 aa, Artificial Sequence
  Description of Artificial Sequence: Synthetic polypeptide
DECEICTTNPVAVEQYGSVSTNTNNLEQGTNTGT

SEQ ID NO: 119647 - protein, 34 aa, Artificial Sequence
  Description of Artificial Sequence: Synthetic polypeptide
DEEEIRTTNPVATEQYGAVSIVNGDEFNGGNQND

SEQ ID NO: 119648 - protein, 38 aa, Artificial Sequence
  Description of Artificial Sequence: Synthetic polypeptide
DEEEIRTTNPVATEQYGSVSTTNLQNGNNNQQGTNPVE

SEQ ID NO: 119649 - protein, 34 aa, Artificial Sequence
  Description of Artificial Sequence: Synthetic polypeptide
DECEICTTNPVATEQYGSVSTVTALQEGTEEEDD

SEQ ID NO: 119650 - protein, 35 aa, Artificial Sequence
  Description of Artificial Sequence: Synthetic polypeptide
DEEEIRTTNPVATECWGSVSTTPAEPQDREGMNPG

SEQ ID NO: 119651 - protein, 34 aa, Artificial Sequence
  Description of Artificial Sequence: Synthetic polypeptide
DEDEIATTNPVATEQYGSVCAANNLQEAGGTDNV

SEQ ID NO: 119652 - protein, 35 aa, Artificial Sequence
  Description of Artificial Sequence: Synthetic polypeptide
DEEEIRTTNPVATEQYGCVCSNTEEHNQYFGSNQS

SEQ ID NO: 119653 - protein, 33 aa, Artificial Sequence
  Description of Artificial Sequence: Synthetic polypeptide
DEDEIATTNPVATEQYGSVCAANNLQEAGTDES

SEQ ID NO: 119654 - protein, 34 aa, Artificial Sequence
  Description of Artificial Sequence: Synthetic polypeptide
DEDEIATTNPVATEQYGSVCAANNLQEAGENSNQ

SEQ ID NO: 119655 - protein, 34 aa, Artificial Sequence
  Description of Artificial Sequence: Synthetic polypeptide
DEEEIRTTNPVATEQYGCVCSNWENHQSFGSEQA

SEQ ID NO: 119656 - protein, 31 aa, Artificial Sequence
  Description of Artificial Sequence: Synthetic polypeptide
DEAEIRTTNPVAYEAWGSVSTNVNGDTNDTS

SEQ ID NO: 119657 - protein, 31 aa, Artificial Sequence
  Description of Artificial Sequence: Synthetic polypeptide
DEAEIRTTNPVAYEAWGSVVIENDQGGGNME

SEQ ID NO: 119658 - protein, 33 aa, Artificial Sequence
  Description of Artificial Sequence: Synthetic polypeptide
DEAEIRTTNPVAYECWGSVSNDNLGEERGENSP

SEQ ID NO: 119659 - protein, 31 aa, Artificial Sequence
  Description of Artificial Sequence: Synthetic polypeptide
DEDEIATTNPVATEQYGCVAGTGLARPDQDW

SEQ ID NO: 119660 - protein, 34 aa, Artificial Sequence
  Description of Artificial Sequence: Synthetic polypeptide
DECEICTTNPVATEQYGSVSTVAQNGTTEENEDD

SEQ ID NO: 119661 - protein, 37 aa, Artificial Sequence
  Description of Artificial Sequence: Synthetic polypeptide
DEEEIRTTNPVATEQYGSVSTTVTNLLQGNNQQNEQE

SEQ ID NO: 119662 - protein, 36 aa, Artificial Sequence
  Description of Artificial Sequence: Synthetic polypeptide
DEEEIRTTNPVATEQYGSVSTTVQAGNTEQGTNNQQ

SEQ ID NO: 119663 - protein, 32 aa, Artificial Sequence
  Description of Artificial Sequence: Synthetic polypeptide
DEDEIATTNPVAYEQWGSTSTNDGGNHGGGNR

SEQ ID NO: 119664 - protein, 38 aa, Artificial Sequence
  Description of Artificial Sequence: Synthetic polypeptide
DEEEIRTTNPVATEQYGSVSTTVNTNLQQGNNEEDEDE

SEQ ID NO: 119665 - protein, 38 aa, Artificial Sequence
  Description of Artificial Sequence: Synthetic polypeptide
DEEEIRTTNPVATEQYGSVSTTVNTNLQQGNNDEDEED

SEQ ID NO: 119666 - protein, 38 aa, Artificial Sequence
  Description of Artificial Sequence: Synthetic polypeptide
DEEEIRTTNPVATEQYGSVSTTVNTNLQQGNNDEDEDT

SEQ ID NO: 119667 - protein, 34 aa, Artificial Sequence
  Description of Artificial Sequence: Synthetic polypeptide
DEAEIRTTNPVAYECWGSVSGENLGEQRGGDNSH

SEQ ID NO: 119668 - protein, 38 aa, Artificial Sequence
  Description of Artificial Sequence: Synthetic polypeptide
DEEEIRTTNPVATEQYGSVSTTVNQNLQQGNNNNDEDD

SEQ ID NO: 119669 - protein, 31 aa, Artificial Sequence
  Description of Artificial Sequence: Synthetic polypeptide
DEDEIATTNPVATEQYGCVAGTGLQAAAPSD

SEQ ID NO: 119670 - protein, 31 aa, Artificial Sequence
  Description of Artificial Sequence: Synthetic polypeptide
DEDEIATTNPVATEQYGCVATHLEAMNPDQD

SEQ ID NO: 119671 - protein, 34 aa, Artificial Sequence
  Description of Artificial Sequence: Synthetic polypeptide
DEAEIRTTNPVAYECWGSVSGENLGEERQGDNRN

SEQ ID NO: 119672 - protein, 33 aa, Artificial Sequence
  Description of Artificial Sequence: Synthetic polypeptide
DEDEIATTNPVATEQYGCVATNGLVDDGNDTTP

SEQ ID NO: 119673 - protein, 33 aa, Artificial Sequence
  Description of Artificial Sequence: Synthetic polypeptide
DEDEIATTNPVAYEQWGSITSAAGNLQDRGQRQ

SEQ ID NO: 119674 - protein, 32 aa, Artificial Sequence
  Description of Artificial Sequence: Synthetic polypeptide
DEAEIRTTNPVAYECWGSVSGENHQETGNDGI

SEQ ID NO: 119675 - protein, 33 aa, Artificial Sequence
  Description of Artificial Sequence: Synthetic polypeptide
DEDEIATTNPVAYEQWGSVAITNPTQTGNGEER

SEQ ID NO: 119676 - protein, 33 aa, Artificial Sequence
  Description of Artificial Sequence: Synthetic polypeptide
DEDEIATTNPVAYEQWGSVATNPTQTGNGDVRG

SEQ ID NO: 119677 - protein, 34 aa, Artificial Sequence
  Description of Artificial Sequence: Synthetic polypeptide
DEAEIRTTNPVAYECWGSVSNDNLGEERNGENDR

SEQ ID NO: 119678 - protein, 33 aa, Artificial Sequence
  Description of Artificial Sequence: Synthetic polypeptide
DEDEIATTNPVAYEQWGSVATTNHPNERGGNDR

SEQ ID NO: 119679 - protein, 32 aa, Artificial Sequence
  Description of Artificial Sequence: Synthetic polypeptide
DEDEIATTNPVAYEQWGSVCSTNDNGMQNGGA

SEQ ID NO: 119680 - protein, 34 aa, Artificial Sequence
  Description of Artificial Sequence: Synthetic polypeptide
DEEEIRTTNPVATEQYGCVCSNTAHQEYFNSDQT

SEQ ID NO: 119681 - protein, 32 aa, Artificial Sequence
  Description of Artificial Sequence: Synthetic polypeptide
DEDEIATTNPVATEQYGCVAATPNDQTAGPQE

SEQ ID NO: 119682 - protein, 31 aa, Artificial Sequence
  Description of Artificial Sequence: Synthetic polypeptide
DEAEIRTTNPVATEQYGSVWEEELTTEVEKE

SEQ ID NO: 119683 - protein, 36 aa, Artificial Sequence
  Description of Artificial Sequence: Synthetic polypeptide
DEEEIRTTNPVATEQYGSVSTTWLEYHGSTPPEENQ

SEQ ID NO: 119684 - protein, 31 aa, Artificial Sequence
  Description of Artificial Sequence: Synthetic polypeptide
DEDEIATTNPVATEQYGCVAGNGLAAPDNQD

SEQ ID NO: 119685 - protein, 32 aa, Artificial Sequence
  Description of Artificial Sequence: Synthetic polypeptide
DECEICTTNPVAYEGWGSVATDNMNQNDGNDR

SEQ ID NO: 119686 - protein, 36 aa, Artificial Sequence
  Description of Artificial Sequence: Synthetic polypeptide
DEEEIRTTNPVATECYGSVSSTNPEGPNMRNGMNAV

SEQ ID NO: 119687 - protein, 38 aa, Artificial Sequence
  Description of Artificial Sequence: Synthetic polypeptide
DEEEIRTTNPVATEQYGSVSTTVNQNLQQGNNNEDEDT

SEQ ID NO: 119688 - protein, 34 aa, Artificial Sequence
  Description of Artificial Sequence: Synthetic polypeptide
DEAEIRTTNPVAYECWGSVSWTNDDDQQGQNDRD

SEQ ID NO: 119689 - protein, 36 aa, Artificial Sequence
  Description of Artificial Sequence: Synthetic polypeptide
DEEEIRTTNPVATEAYGVVSTVTNLNLQQGGNNNTD

SEQ ID NO: 119690 - protein, 35 aa, Artificial Sequence
  Description of Artificial Sequence: Synthetic polypeptide
DEEEIRTTNPVATEQYGCVCSNTEDDQNFGSENQS

SEQ ID NO: 119691 - protein, 36 aa, Artificial Sequence
  Description of Artificial Sequence: Synthetic polypeptide
DEEEIRTTNPVATECYGSVSSTCPNGPNMRNGMNPG

SEQ ID NO: 119692 - protein, 34 aa, Artificial Sequence
  Description of Artificial Sequence: Synthetic polypeptide
DEEEIRTTNPVATEQYGCVCSNTEDDQNFGSQQA

SEQ ID NO: 119693 - protein, 33 aa, Artificial Sequence
  Description of Artificial Sequence: Synthetic polypeptide
DEAEIRTTNPVAYECWGSVSWINENQDREGTND

SEQ ID NO: 119694 - protein, 34 aa, Artificial Sequence
  Description of Artificial Sequence: Synthetic polypeptide
DEEEIRTTNPVATEQYGCVCSNTEDDQNFNSEQS

SEQ ID NO: 119695 - protein, 33 aa, Artificial Sequence
  Description of Artificial Sequence: Synthetic polypeptide
DEAEIRTTNPVAYECWGSVSNTNLGEERGEGSE

SEQ ID NO: 119696 - protein, 33 aa, Artificial Sequence
  Description of Artificial Sequence: Synthetic polypeptide
DEEEIRTTNPVATEQYGCVCSNTEDENFGSEQA

SEQ ID NO: 119697 - protein, 36 aa, Artificial Sequence
  Description of Artificial Sequence: Synthetic polypeptide
DEEEIRTTNPVATECYGSVSSTCPNGPNMRNGMNPV

SEQ ID NO: 119698 - protein, 33 aa, Artificial Sequence
  Description of Artificial Sequence: Synthetic polypeptide
DEDEIATTNPVATEQYGCVATNLADDPTGDNFV

SEQ ID NO: 119699 - protein, 32 aa, Artificial Sequence
  Description of Artificial Sequence: Synthetic polypeptide
DEDEIATTNPVATEQYGCVATNPQEADGMVQN

SEQ ID NO: 119700 - protein, 38 aa, Artificial Sequence
  Description of Artificial Sequence: Synthetic polypeptide
DEEEIRTTNPVATEQYGSVSTTVNQNLQQGNNEEEEDT

SEQ ID NO: 119701 - protein, 34 aa, Artificial Sequence
  Description of Artificial Sequence: Synthetic polypeptide
DEEEIRTTNPVATEQYGCVCSNTEDNQNFGSEQS

SEQ ID NO: 119702 - protein, 33 aa, Artificial Sequence
  Description of Artificial Sequence: Synthetic polypeptide
DECEICTTNPVATEQYGSVSTVNAQEDTEEEDD

SEQ ID NO: 119703 - protein, 32 aa, Artificial Sequence
  Description of Artificial Sequence: Synthetic polypeptide
DEDEIATTNPVATEQYGSVAATAPQADPTGAH

SEQ ID NO: 119704 - protein, 33 aa, Artificial Sequence
  Description of Artificial Sequence: Synthetic polypeptide
DEDEIATTNPVATEQYGSVAGTNPANGMDNLAE

SEQ ID NO: 119705 - protein, 35 aa, Artificial Sequence
  Description of Artificial Sequence: Synthetic polypeptide
DEEEIRTTNPVATEQYGCVCSNTEDQENFGSNNQA

SEQ ID NO: 119706 - protein, 34 aa, Artificial Sequence
  Description of Artificial Sequence: Synthetic polypeptide
DEEEIRTTNPVATEQYGCVCSNTEDQENFGSQQS

SEQ ID NO: 119707 - protein, 36 aa, Artificial Sequence
  Description of Artificial Sequence: Synthetic polypeptide
DEEEIRTTNPVATEQYGSVSTNLGLSENVPFEVLVA

SEQ ID NO: 119708 - protein, 38 aa, Artificial Sequence
  Description of Artificial Sequence: Synthetic polypeptide
DEEEIRTTNPVATEQYGSVSTTNLGLGNNNQNGTNPVG

SEQ ID NO: 119709 - protein, 34 aa, Artificial Sequence
  Description of Artificial Sequence: Synthetic polypeptide
DEEEIRTTNPVATEQYGCVCSNTEDNQNFGSEQP

SEQ ID NO: 119710 - protein, 34 aa, Artificial Sequence
  Description of Artificial Sequence: Synthetic polypeptide
DEEEIRTTNPVATEQYGCVCSNTEDQFFNSDNQE

SEQ ID NO: 119711 - protein, 34 aa, Artificial Sequence
  Description of Artificial Sequence: Synthetic polypeptide
DEDEIATTNPVATEQYGSVAITNLPTNPGENTEG

SEQ ID NO: 119712 - protein, 35 aa, Artificial Sequence
  Description of Artificial Sequence: Synthetic polypeptide
DEEEIRTTNPVATECYGSVCFTNEDHTDQGGDNHS

SEQ ID NO: 119713 - protein, 33 aa, Artificial Sequence
  Description of Artificial Sequence: Synthetic polypeptide
DEEEIRTTNPVATECYGQVAWFPDLTQFGDNHY

SEQ ID NO: 119714 - protein, 35 aa, Artificial Sequence
  Description of Artificial Sequence: Synthetic polypeptide
DEEEIRTTNPVATEQYGSVSTIENTMVIPNQNQLD

SEQ ID NO: 119715 - protein, 34 aa, Artificial Sequence
  Description of Artificial Sequence: Synthetic polypeptide
DEEEIRTTNPVATEQYGCVCSNWETNQYFGSDFG

SEQ ID NO: 119716 - protein, 34 aa, Artificial Sequence
  Description of Artificial Sequence: Synthetic polypeptide
DEEEIRTTNPVATEQYGCVCSNWEPQNFGSNFQS

SEQ ID NO: 119717 - protein, 36 aa, Artificial Sequence
  Description of Artificial Sequence: Synthetic polypeptide
DEEEIRTTNPVATECYGKTVSCTNMSSNSRGGNQRC

SEQ ID NO: 119718 - protein, 33 aa, Artificial Sequence
  Description of Artificial Sequence: Synthetic polypeptide
DEEEIRTTNPVATEQYGCVCSNWEPQNFGSDQD

SEQ ID NO: 119719 - protein, 33 aa, Artificial Sequence
  Description of Artificial Sequence: Synthetic polypeptide
DEEEIRTTNPVATEQYGCVCSNTEDQGFQSEQS

SEQ ID NO: 119720 - protein, 32 aa, Artificial Sequence
  Description of Artificial Sequence: Synthetic polypeptide
DEAAIRTTNPVATEQYGCFCSTNHIEYFGSNQ

SEQ ID NO: 119721 - protein, 34 aa, Artificial Sequence
  Description of Artificial Sequence: Synthetic polypeptide
DECEICTTNPVATEQYGSVSTVATQTGDTEEEND

SEQ ID NO: 119722 - protein, 32 aa, Artificial Sequence
  Description of Artificial Sequence: Synthetic polypeptide
DEDEIATTNPVAYEPYGSVSANDNDRGDTGRN

SEQ ID NO: 119723 - protein, 34 aa, Artificial Sequence
  Description of Artificial Sequence: Synthetic polypeptide
DEEEIRTTNPVATEQYGCVCSNTEDHQFFGSDAA

SEQ ID NO: 119724 - protein, 35 aa, Artificial Sequence
  Description of Artificial Sequence: Synthetic polypeptide
DEEEIRTTNPVATEQYGSVSTTNIPHNQSLVVEFM

SEQ ID NO: 119725 - protein, 38 aa, Artificial Sequence
  Description of Artificial Sequence: Synthetic polypeptide
DEEEIRTTNPVATEQYGSVSTTNLANGNNNQNGTNPNS

SEQ ID NO: 119726 - protein, 38 aa, Artificial Sequence
  Description of Artificial Sequence: Synthetic polypeptide
DEEEIRTTNPVATEQYGSVSTTNLDNGNNNQQGTNEDE

SEQ ID NO: 119727 - protein, 31 aa, Artificial Sequence
  Description of Artificial Sequence: Synthetic polypeptide
DEDEIATTNPVAYEQWGMTSTNLQGNAGDDS

SEQ ID NO: 119728 - protein, 37 aa, Artificial Sequence
  Description of Artificial Sequence: Synthetic polypeptide
DEEEIRTTNPVATEQYGSVSTTVNNNNLQQNENNEEE

SEQ ID NO: 119729 - protein, 36 aa, Artificial Sequence
  Description of Artificial Sequence: Synthetic polypeptide
DEEEIRTTNPVATEQWGSTVCNTGNELSTNRGLTNQ

SEQ ID NO: 119730 - protein, 33 aa, Artificial Sequence
  Description of Artificial Sequence: Synthetic polypeptide
DEDEIATTNPVATEQYGSVAANNQDAGGPNEDT

SEQ ID NO: 119731 - protein, 33 aa, Artificial Sequence
  Description of Artificial Sequence: Synthetic polypeptide
DEEEIRTTNPVATECYGSVNCTICMPERSGGIV

SEQ ID NO: 119732 - protein, 35 aa, Artificial Sequence
  Description of Artificial Sequence: Synthetic polypeptide
DEEEIRTTNPVATEQYGCVCSNTEDLQEFFGSQQA

SEQ ID NO: 119733 - protein, 38 aa, Artificial Sequence
  Description of Artificial Sequence: Synthetic polypeptide
DEEEIRTTNPVATEQYGSVSTTVNGNLQQGTNQEEEED

SEQ ID NO: 119734 - protein, 34 aa, Artificial Sequence
  Description of Artificial Sequence: Synthetic polypeptide
DEAEIRTTNPVATEQYGSVWPTDYELEHDGQNEG

SEQ ID NO: 119735 - protein, 34 aa, Artificial Sequence
  Description of Artificial Sequence: Synthetic polypeptide
DEEEIRTTNPVAYEQYGCVVSTMDELVPRGQPVG

SEQ ID NO: 119736 - protein, 33 aa, Artificial Sequence
  Description of Artificial Sequence: Synthetic polypeptide
DEAEIRTTNPVAYECWGSVATNLNQGDVGQNAG

SEQ ID NO: 119737 - protein, 33 aa, Artificial Sequence
  Description of Artificial Sequence: Synthetic polypeptide
DEDEIATTNPVATEQYGSVAATANLEAIGPMEE

SEQ ID NO: 119738 - protein, 38 aa, Artificial Sequence
  Description of Artificial Sequence: Synthetic polypeptide
DEEEIRTTNPVATEQYGSVSTTNLENGNNNQNGTNPVQ

SEQ ID NO: 119739 - protein, 35 aa, Artificial Sequence
  Description of Artificial Sequence: Synthetic polypeptide
DEEEIRTTNPVATEQYGSVSTHHTMEPQQEQNDEL

SEQ ID NO: 119740 - protein, 33 aa, Artificial Sequence
  Description of Artificial Sequence: Synthetic polypeptide
DECEICTTNPVATEQYGSVSTVAQSGDTEEEDD

SEQ ID NO: 119741 - protein, 38 aa, Artificial Sequence
  Description of Artificial Sequence: Synthetic polypeptide
DEEEIRTTNPVATEQYGSVSTTVNLNLQQGNNNEEEED

SEQ ID NO: 119742 - protein, 32 aa, Artificial Sequence
  Description of Artificial Sequence: Synthetic polypeptide
DEAEIRTTNPVSTEPYGTISVEDINQPQSGNH

SEQ ID NO: 119743 - protein, 33 aa, Artificial Sequence
  Description of Artificial Sequence: Synthetic polypeptide
DEDEIATTNPVATEQYGSVSANPNDVRNGTPEE

SEQ ID NO: 119744 - protein, 36 aa, Artificial Sequence
  Description of Artificial Sequence: Synthetic polypeptide
DEEEIRTTNPVATEAYGVVSTNLQQGNNQQETEEED

SEQ ID NO: 119745 - protein, 37 aa, Artificial Sequence
  Description of Artificial Sequence: Synthetic polypeptide
DEEEIRTTNPVATEQYGSVSTVVNNQQGTNAEEEEEN

SEQ ID NO: 119746 - protein, 33 aa, Artificial Sequence
  Description of Artificial Sequence: Synthetic polypeptide
DEAEIRTTNPVAYEQWGSVSGGGNHQGEGGVER

SEQ ID NO: 119747 - protein, 35 aa, Artificial Sequence
  Description of Artificial Sequence: Synthetic polypeptide
DEEEIRTTNPVATEQYGCVCSTGNPQENFNSNFQS

SEQ ID NO: 119748 - protein, 36 aa, Artificial Sequence
  Description of Artificial Sequence: Synthetic polypeptide
DEEEIRTTNPVATEAYGCSVPSCTGDNDQHEGGNPK

SEQ ID NO: 119749 - protein, 36 aa, Artificial Sequence
  Description of Artificial Sequence: Synthetic polypeptide
DEEEIRTTNPVATEAYGCTVPSCTGDNLQAHEGGNP

SEQ ID NO: 119750 - protein, 36 aa, Artificial Sequence
  Description of Artificial Sequence: Synthetic polypeptide
DEEEIRTTNPVATEQYGSVSTCVYLEPPGMNMGQEM

SEQ ID NO: 119751 - protein, 34 aa, Artificial Sequence
  Description of Artificial Sequence: Synthetic polypeptide
DEEEIRTTNPVATEQYGCVCQTEDLQENFGSEQT

SEQ ID NO: 119752 - protein, 34 aa, Artificial Sequence
  Description of Artificial Sequence: Synthetic polypeptide
DEAEIRTTNPVAYEQWGSVVPTDNPDDGQQGQNR

SEQ ID NO: 119753 - protein, 36 aa, Artificial Sequence
  Description of Artificial Sequence: Synthetic polypeptide
DEEEIRTTNPVATEAYGVVSTNQNQQQLQQGTTNTD

SEQ ID NO: 119754 - protein, 31 aa, Artificial Sequence
  Description of Artificial Sequence: Synthetic polypeptide
DEAVIRTTNPVATEQYGCVETDWPQTFSGQF

SEQ ID NO: 119755 - protein, 35 aa, Artificial Sequence
  Description of Artificial Sequence: Synthetic polypeptide
DEEEIRTTNPVATEAYGEVPSCTGDNDPQSEGGNE

SEQ ID NO: 119756 - protein, 31 aa, Artificial Sequence
  Description of Artificial Sequence: Synthetic polypeptide
DEDEIACTNPVATEQWGCVATNLQEEGGEEF

SEQ ID NO: 119757 - protein, 34 aa, Artificial Sequence
  Description of Artificial Sequence: Synthetic polypeptide
DEEEIRTTNPVATEQYGCVCQTEHQENFGSENQA

SEQ ID NO: 119758 - protein, 35 aa, Artificial Sequence
  Description of Artificial Sequence: Synthetic polypeptide
DEEEIRTTNPVATEAYGEVPSCTGDNDQHEGGNML

SEQ ID NO: 119759 - protein, 35 aa, Artificial Sequence
  Description of Artificial Sequence: Synthetic polypeptide
DEEEIRTTNPVATEAYGEVPSCTGDNDRQPTGGNE

SEQ ID NO: 119760 - protein, 34 aa, Artificial Sequence
  Description of Artificial Sequence: Synthetic polypeptide
DEEEIRTTNPVATEAYGKTSCNNLSQQKAGGNEG

SEQ ID NO: 119761 - protein, 34 aa, Artificial Sequence
  Description of Artificial Sequence: Synthetic polypeptide
DEEEIRTTNPVATEQYGCTCSTGEHNQYFGSNQS

SEQ ID NO: 119762 - protein, 34 aa, Artificial Sequence
  Description of Artificial Sequence: Synthetic polypeptide
DEEEIRTTNPVATEQYGCTCSTGELQENFGSQQS

SEQ ID NO: 119763 - protein, 31 aa, Artificial Sequence
  Description of Artificial Sequence: Synthetic polypeptide
DDSEVATTNPVATEQYGNVSANTEQSRVEDR

SEQ ID NO: 119764 - protein, 32 aa, Artificial Sequence
  Description of Artificial Sequence: Synthetic polypeptide
DEAEIRTTNPVAYEQWGSVVIENDQGHQGNAE

SEQ ID NO: 119765 - protein, 36 aa, Artificial Sequence
  Description of Artificial Sequence: Synthetic polypeptide
DEEEIRTTNPVATEQYGSVSTVVNNQQQGDEETIEE

SEQ ID NO: 119766 - protein, 38 aa, Artificial Sequence
  Description of Artificial Sequence: Synthetic polypeptide
DEEEIRTTNPVATEQYGSVSTVVVNNLQQGNNQDEEEQ

SEQ ID NO: 119767 - protein, 33 aa, Artificial Sequence
  Description of Artificial Sequence: Synthetic polypeptide
DEDEIRTTNPCATECYGSVATGNTGNAGENHDR

SEQ ID NO: 119768 - protein, 36 aa, Artificial Sequence
  Description of Artificial Sequence: Synthetic polypeptide
DEEEIRTTNPVATEAYGKTVPSCTGDNLQHEGGNFP

SEQ ID NO: 119769 - protein, 35 aa, Artificial Sequence
  Description of Artificial Sequence: Synthetic polypeptide
DEDEIACTNPVATEQYGSVCATNPLQEHGDENQRQ

SEQ ID NO: 119770 - protein, 31 aa, Artificial Sequence
  Description of Artificial Sequence: Synthetic polypeptide
DEDEIACTNPVAYEQYGSVATNLQANPPMEN

SEQ ID NO: 119771 - protein, 33 aa, Artificial Sequence
  Description of Artificial Sequence: Synthetic polypeptide
DEEEIRTTNPVATEQYGCVCQTEDHQNFGSEQA

SEQ ID NO: 119772 - protein, 32 aa, Artificial Sequence
  Description of Artificial Sequence: Synthetic polypeptide
DEAVIRTTNPVATEQYGCVCETNPIYFGSNQA

SEQ ID NO: 119773 - protein, 33 aa, Artificial Sequence
  Description of Artificial Sequence: Synthetic polypeptide
DEEEIRTTNPVATEQYGCVCSTGEDAHFNSEQA

SEQ ID NO: 119774 - protein, 34 aa, Artificial Sequence
  Description of Artificial Sequence: Synthetic polypeptide
DEEEIRTTNPVATEGYGVVDDTGNEGQTGGNGGE

SEQ ID NO: 119775 - protein, 32 aa, Artificial Sequence
  Description of Artificial Sequence: Synthetic polypeptide
DEAEIRTTNPVAYEQWGSVSGDNTQGDVNNTN

SEQ ID NO: 119776 - protein, 29 aa, Artificial Sequence
  Description of Artificial Sequence: Synthetic peptide
DEDCIACTNPVAYEQYGSVAMNDQDHNDL

SEQ ID NO: 119777 - protein, 31 aa, Artificial Sequence
  Description of Artificial Sequence: Synthetic polypeptide
DDSEVATTNPVATEQYGNVSANTIQSRVEDR

SEQ ID NO: 119778 - protein, 34 aa, Artificial Sequence
  Description of Artificial Sequence: Synthetic polypeptide
DEEEIRTTNPVATEQYGCVCSETEHQENFNSNQP

SEQ ID NO: 119779 - protein, 37 aa, Artificial Sequence
  Description of Artificial Sequence: Synthetic polypeptide
DEEEIRTTNPVATEQYGSVSTVVNNQQGNNQQEDEEE

SEQ ID NO: 119780 - protein, 34 aa, Artificial Sequence
  Description of Artificial Sequence: Synthetic polypeptide
DEEEIRTTNPVATEQYGCVCSTGEDDQNFGSEQS

SEQ ID NO: 119781 - protein, 34 aa, Artificial Sequence
  Description of Artificial Sequence: Synthetic polypeptide
DEEEIRTTNPVATEGYGVVNGQGTNDQEGGGNGQ

SEQ ID NO: 119782 - protein, 33 aa, Artificial Sequence
  Description of Artificial Sequence: Synthetic polypeptide
DEEEIRTTNPVATEQYGCVCSTGPHEFFGSDQY

SEQ ID NO: 119783 - protein, 34 aa, Artificial Sequence
  Description of Artificial Sequence: Synthetic polypeptide
DEEEIRTTNPVATEQYGCVCSTGPHEEGFGSNQY

SEQ ID NO: 119784 - protein, 34 aa, Artificial Sequence
  Description of Artificial Sequence: Synthetic polypeptide
DEEEIRTTNPVATEGYGVVSDTGDLGEGGENVGT

SEQ ID NO: 119785 - protein, 33 aa, Artificial Sequence
  Description of Artificial Sequence: Synthetic polypeptide
DEAEIRTTNPVAYEQWGSVSGGDNLGQGGDQGE

SEQ ID NO: 119786 - protein, 34 aa, Artificial Sequence
  Description of Artificial Sequence: Synthetic polypeptide
DEEEIRTTNPVATEQYGCVCSTGEDENFNSENQA

SEQ ID NO: 119787 - protein, 34 aa, Artificial Sequence
  Description of Artificial Sequence: Synthetic polypeptide
DEEEIRTTNPVATEGYGVVSGTLNGQAEGGGEQT

SEQ ID NO: 119788 - protein, 34 aa, Artificial Sequence
  Description of Artificial Sequence: Synthetic polypeptide
DEEEIRTTNPVATEGYGVVVSGFNVGQGEGNGDT

SEQ ID NO: 119789 - protein, 34 aa, Artificial Sequence
  Description of Artificial Sequence: Synthetic polypeptide
DEEEIRTTNPVATEGYGVVVSGTNVGMEEGNGNT

SEQ ID NO: 119790 - protein, 35 aa, Artificial Sequence
  Description of Artificial Sequence: Synthetic polypeptide
DEEEIRTTNPVATEQYGCTCSMTENHSQHFGSNTQ

SEQ ID NO: 119791 - protein, 35 aa, Artificial Sequence
  Description of Artificial Sequence: Synthetic polypeptide
DEEEIRTTNPVATEAWGSTVPSCCGDNLQHKGGNP

SEQ ID NO: 119792 - protein, 35 aa, Artificial Sequence
  Description of Artificial Sequence: Synthetic polypeptide
DEEEIRTTNPVATEHWGISTVSYTNALSHQPGTGF

SEQ ID NO: 119793 - protein, 36 aa, Artificial Sequence
  Description of Artificial Sequence: Synthetic polypeptide
DEEEIRTTNPVATEAWGSTVPSCTGDNLFQHEGGNP

SEQ ID NO: 119794 - protein, 29 aa, Artificial Sequence
  Description of Artificial Sequence: Synthetic peptide
DEDCIATTNPVAYEQWGQVSAINVQNDNN

SEQ ID NO: 119795 - protein, 34 aa, Artificial Sequence
  Description of Artificial Sequence: Synthetic polypeptide
DEAEIRTTNPVAYEQWGSVVTTNNILGEDGGGNR

SEQ ID NO: 119796 - protein, 37 aa, Artificial Sequence
  Description of Artificial Sequence: Synthetic polypeptide
DEEEIRTTNPVATEQYGSVSTVVNNQQGNQETNNNTD

SEQ ID NO: 119797 - protein, 31 aa, Artificial Sequence
  Description of Artificial Sequence: Synthetic polypeptide
DEDCIATTNPVAYEQWGQVSTIAVQTRDGNN

SEQ ID NO: 119798 - protein, 31 aa, Artificial Sequence
  Description of Artificial Sequence: Synthetic polypeptide
DEAVIRTTNPVATEQYGCVETEPQTVGTDEQ

SEQ ID NO: 119799 - protein, 35 aa, Artificial Sequence
  Description of Artificial Sequence: Synthetic polypeptide
DEEEIRTTNPVATEQYGCTCSMTENHNQSIGSNNQ

SEQ ID NO: 119800 - protein, 31 aa, Artificial Sequence
  Description of Artificial Sequence: Synthetic polypeptide
DEAEIRTTNPVAYEQWGSVVIENDQDGGGME

SEQ ID NO: 119801 - protein, 36 aa, Artificial Sequence
  Description of Artificial Sequence: Synthetic polypeptide
DEEEIRTTNPVATEQYGSVSTVVNNQQQNEEETNDT

SEQ ID NO: 119802 - protein, 33 aa, Artificial Sequence
  Description of Artificial Sequence: Synthetic polypeptide
DEAEIRTTNPVAYEQWGSVSGGNGGNQGEGANE

SEQ ID NO: 119803 - protein, 31 aa, Artificial Sequence
  Description of Artificial Sequence: Synthetic polypeptide
DDSEVATTNPVATEGYGNVSANTLQDRVGQL

SEQ ID NO: 119804 - protein, 33 aa, Artificial Sequence
  Description of Artificial Sequence: Synthetic polypeptide
DEAVIRTTNPVATEQYGSVSPELMFPNYSQNRL

SEQ ID NO: 119805 - protein, 32 aa, Artificial Sequence
  Description of Artificial Sequence: Synthetic polypeptide
DEAVIRTTNPVATEQYGSVSPEMEFPNYSQTR

SEQ ID NO: 119806 - protein, 35 aa, Artificial Sequence
  Description of Artificial Sequence: Synthetic polypeptide
DEEEIRTTNPVATEQYGCVCSTGNHQEHFNSNNQT

SEQ ID NO: 119807 - protein, 34 aa, Artificial Sequence
  Description of Artificial Sequence: Synthetic polypeptide
DEEEIRTTNPVATEQYGCVCSTGNHQEHFFSEQS

SEQ ID NO: 119808 - protein, 33 aa, Artificial Sequence
  Description of Artificial Sequence: Synthetic polypeptide
DEDEIRTTNPCATECYGSVSTGNLGNAGETDGE

SEQ ID NO: 119809 - protein, 34 aa, Artificial Sequence
  Description of Artificial Sequence: Synthetic polypeptide
DEEEIRTTNPVATEQYGCTCSTNEHNQENFNSDQ

SEQ ID NO: 119810 - protein, 35 aa, Artificial Sequence
  Description of Artificial Sequence: Synthetic polypeptide
DEEEIRTTNPVATEQYGCTCSTNEHNQYFGSENQS

SEQ ID NO: 119811 - protein, 35 aa, Artificial Sequence
  Description of Artificial Sequence: Synthetic polypeptide
DEEEIRTTNPVATEQYGCVCSTGEDHQEHGSENQS

SEQ ID NO: 119812 - protein, 37 aa, Artificial Sequence
  Description of Artificial Sequence: Synthetic polypeptide
DEEEIRTTNPVATEQYGSVSTVVNTQAGNEQGNTTVQ

SEQ ID NO: 119813 - protein, 35 aa, Artificial Sequence
  Description of Artificial Sequence: Synthetic polypeptide
DEEEIRTTNPVATEGYGICVCSTVNLQENFISNQI

SEQ ID NO: 119814 - protein, 37 aa, Artificial Sequence
  Description of Artificial Sequence: Synthetic polypeptide
DEEEIRTTNPVATEQYGSVSTVVNTQEQQGNNNNQEE

SEQ ID NO: 119815 - protein, 34 aa, Artificial Sequence
  Description of Artificial Sequence: Synthetic polypeptide
DEEEIRTTNPVATEQYGCVCSTGEDIENFGSNQP

SEQ ID NO: 119816 - protein, 36 aa, Artificial Sequence
  Description of Artificial Sequence: Synthetic polypeptide
DEEEIRTTNPVATEQYGCVCSTGEDLQESFGSDNQS

SEQ ID NO: 119817 - protein, 31 aa, Artificial Sequence
  Description of Artificial Sequence: Synthetic polypeptide
DDSEVATTNPVATEGYGNVSANTLQSRVGQL

SEQ ID NO: 119818 - protein, 34 aa, Artificial Sequence
  Description of Artificial Sequence: Synthetic polypeptide
DEEEIRTTNPVATEQYGCVCSTGEDNENFGSEQG

SEQ ID NO: 119819 - protein, 33 aa, Artificial Sequence
  Description of Artificial Sequence: Synthetic polypeptide
DEDEIRTTNPCATECYGSVSTGNLNGNAGEDHE

SEQ ID NO: 119820 - protein, 37 aa, Artificial Sequence
  Description of Artificial Sequence: Synthetic polypeptide
DEEEIRTTNPVATEQYGSVSTVVNTQQGNNDEEDTEE

SEQ ID NO: 119821 - protein, 37 aa, Artificial Sequence
  Description of Artificial Sequence: Synthetic polypeptide
DEEEIRTTNPVATEQYGSVSTVVNTQQGNNQDEQETD

SEQ ID NO: 119822 - protein, 35 aa, Artificial Sequence
  Description of Artificial Sequence: Synthetic polypeptide
DEEEIRTTNPVATEQYGCVCSTGEDPQNFGSNTQA

SEQ ID NO: 119823 - protein, 33 aa, Artificial Sequence
  Description of Artificial Sequence: Synthetic polypeptide
DEAEIRTTNPVAYEQWGSVTSGNDNGERQGTNS

SEQ ID NO: 119824 - protein, 35 aa, Artificial Sequence
  Description of Artificial Sequence: Synthetic polypeptide
DEEEIRTTNPVATEGYGICVCSTVNLQENISNTQM

SEQ ID NO: 119825 - protein, 31 aa, Artificial Sequence
  Description of Artificial Sequence: Synthetic polypeptide
DEAEIRTTNPVAYEQWGSVSGGNGNSGEGKA

SEQ ID NO: 119826 - protein, 34 aa, Artificial Sequence
  Description of Artificial Sequence: Synthetic polypeptide
DEEEIRTTNPVATEQYGCVCSTGEDHQSFGSDQP

SEQ ID NO: 119827 - protein, 38 aa, Artificial Sequence
  Description of Artificial Sequence: Synthetic polypeptide
DEEEIRTTNPVATEQYGSVSTVVNTNLQAGNNDEDEDD

SEQ ID NO: 119828 - protein, 34 aa, Artificial Sequence
  Description of Artificial Sequence: Synthetic polypeptide
DEDEIRTTNPCATECYGSVSTGNLGGNAGENTTE

SEQ ID NO: 119829 - protein, 32 aa, Artificial Sequence
  Description of Artificial Sequence: Synthetic polypeptide
DEAEVRTTNPVATEQWGVSVWVDNLGQRPDTK

SEQ ID NO: 119830 - protein, 33 aa, Artificial Sequence
  Description of Artificial Sequence: Synthetic polypeptide
DEEEIRTTNPVATEQYGCVCQTEHQENFISNQS

SEQ ID NO: 119831 - protein, 30 aa, Artificial Sequence
  Description of Artificial Sequence: Synthetic polypeptide
DDSEVATTNPVATEGYGNVAANTIQRVGQR

SEQ ID NO: 119832 - protein, 38 aa, Artificial Sequence
  Description of Artificial Sequence: Synthetic polypeptide
DEEEIRTTNPVATEQYGSVSTVVNQLQAGNQQGTEGES

SEQ ID NO: 119833 - protein, 34 aa, Artificial Sequence
  Description of Artificial Sequence: Synthetic polypeptide
DEEEIRTTNPVATEQYGCVCSTGNHQENFISDQG

SEQ ID NO: 119834 - protein, 34 aa, Artificial Sequence
  Description of Artificial Sequence: Synthetic polypeptide
DEEEIRTTNPVATEGYGICVCSTVEDQERFISNQ

SEQ ID NO: 119835 - protein, 38 aa, Artificial Sequence
  Description of Artificial Sequence: Synthetic polypeptide
DEEEIRTTNPVATEQYGSVSTVVNQNLQAGNNTEDEDT

SEQ ID NO: 119836 - protein, 34 aa, Artificial Sequence
  Description of Artificial Sequence: Synthetic polypeptide
DEAEIRTTNPVAYEQWGSVTSTNDNGERQDSNER

SEQ ID NO: 119837 - protein, 34 aa, Artificial Sequence
  Description of Artificial Sequence: Synthetic polypeptide
DEDEIRTTNPVATEAWGSVSTNNNENQNQEGTNG

SEQ ID NO: 119838 - protein, 36 aa, Artificial Sequence
  Description of Artificial Sequence: Synthetic polypeptide
DEEEIRTTNPVATEAYGVVSTTNNLQQGNNQLDEEE

SEQ ID NO: 119839 - protein, 36 aa, Artificial Sequence
  Description of Artificial Sequence: Synthetic polypeptide
DEEEIRTTNPVATEQYGSVSTVVNQQLQNDEEDEDG

SEQ ID NO: 119840 - protein, 30 aa, Artificial Sequence
  Description of Artificial Sequence: Synthetic polypeptide
DDSEVATTNPVATEQYGNVAANTPQREGQD

SEQ ID NO: 119841 - protein, 34 aa, Artificial Sequence
  Description of Artificial Sequence: Synthetic polypeptide
DEATEIATTNPVAYEQWGSVSTTNPLQSGPNEAE

SEQ ID NO: 119842 - protein, 34 aa, Artificial Sequence
  Description of Artificial Sequence: Synthetic polypeptide
DEEEIRTTNPVATENYGQTVSADSDLGQEPGNHT

SEQ ID NO: 119843 - protein, 31 aa, Artificial Sequence
  Description of Artificial Sequence: Synthetic polypeptide
DEAVIRTTNPVATEQYGCVYTDPQTFINNQQ

SEQ ID NO: 119844 - protein, 36 aa, Artificial Sequence
  Description of Artificial Sequence: Synthetic polypeptide
DEEEIRTTNPVAYEQYGNSVTSNTDDLLQPRSIEKR

SEQ ID NO: 119845 - protein, 33 aa, Artificial Sequence
  Description of Artificial Sequence: Synthetic polypeptide
DEDEIRTTNPCATECYGSVSTGNAGNAGEDNAE

SEQ ID NO: 119846 - protein, 33 aa, Artificial Sequence
  Description of Artificial Sequence: Synthetic polypeptide
DEDEIRTTNPCATECYGSVSTGNAQGNAGEDSE

SEQ ID NO: 119847 - protein, 32 aa, Artificial Sequence
  Description of Artificial Sequence: Synthetic polypeptide
DEDEIACTNPVAYEQYGSTVATNLQAEPPGEN

SEQ ID NO: 119848 - protein, 35 aa, Artificial Sequence
  Description of Artificial Sequence: Synthetic polypeptide
DEEEIRTTNPVATEGYGICVCSTVNDQERISNNQA

SEQ ID NO: 119849 - protein, 34 aa, Artificial Sequence
  Description of Artificial Sequence: Synthetic polypeptide
DEAVIRTTNPVATEQYGNVVACTNEPSQRGGNGK

SEQ ID NO: 119850 - protein, 33 aa, Artificial Sequence
  Description of Artificial Sequence: Synthetic polypeptide
DEDEIRTTNPCATECYGSVSTGNEAGNAGENHE

SEQ ID NO: 119851 - protein, 35 aa, Artificial Sequence
  Description of Artificial Sequence: Synthetic polypeptide
DEEEIRTTNPVATEGYGICVCSTVNDQERSISNQS

SEQ ID NO: 119852 - protein, 32 aa, Artificial Sequence
  Description of Artificial Sequence: Synthetic polypeptide
DEAENSTTNPVAYEQWGTVSTNLQGDAGNGDA

SEQ ID NO: 119853 - protein, 34 aa, Artificial Sequence
  Description of Artificial Sequence: Synthetic polypeptide
DEAEIRTTNPVAYEQWGSVTSNNGLEQGGMNGGH

SEQ ID NO: 119854 - protein, 34 aa, Artificial Sequence
  Description of Artificial Sequence: Synthetic polypeptide
DEDEIRTTNPCATECYGSVSTGNGLGNAGEGNTE

SEQ ID NO: 119855 - protein, 31 aa, Artificial Sequence
  Description of Artificial Sequence: Synthetic polypeptide
DEATIATTNPVATEQYGSVSFTVVYDRPVPM

SEQ ID NO: 119856 - protein, 34 aa, Artificial Sequence
  Description of Artificial Sequence: Synthetic polypeptide
DEEEIRTTNPVATEQYGCVCSTGPHENFGSNNQY

SEQ ID NO: 119857 - protein, 34 aa, Artificial Sequence
  Description of Artificial Sequence: Synthetic polypeptide
DEEEIRTTNPVAYEQYGQSVTSVQDALQTGAEQN

SEQ ID NO: 119858 - protein, 33 aa, Artificial Sequence
  Description of Artificial Sequence: Synthetic polypeptide
DEEEIRTTNPVATEQYGCVCSTGEDAHFGSEQS

SEQ ID NO: 119859 - protein, 36 aa, Artificial Sequence
  Description of Artificial Sequence: Synthetic polypeptide
DEAEIRTTNPVATEQYGSVSTHTNLEEFRNTQEDRN

SEQ ID NO: 119860 - protein, 29 aa, Artificial Sequence
  Description of Artificial Sequence: Synthetic peptide
DEDEIACTNPVATEQYGCVATHLAPPDQD

SEQ ID NO: 119861 - protein, 34 aa, Artificial Sequence
  Description of Artificial Sequence: Synthetic polypeptide
DEEEIRTTNPVATEQYGCVCSTMEHQENFTSNQS

SEQ ID NO: 119862 - protein, 37 aa, Artificial Sequence
  Description of Artificial Sequence: Synthetic polypeptide
DEEEIRTTNPVATEQYGSVSTVVNNLQAGTDEEEEED

SEQ ID NO: 119863 - protein, 38 aa, Artificial Sequence
  Description of Artificial Sequence: Synthetic polypeptide
DEEEIRTTNPVATEQYGSVSTVVNNLQAGTEGNNVTED

SEQ ID NO: 119864 - protein, 35 aa, Artificial Sequence
  Description of Artificial Sequence: Synthetic polypeptide
DEEEIRTTNPVAYEQWGSVSTTNGDNQAGGGNNDL

SEQ ID NO: 119865 - protein, 31 aa, Artificial Sequence
  Description of Artificial Sequence: Synthetic polypeptide
DEDEIACTNPVATEQYGCTATNLQQGGDESL

SEQ ID NO: 119866 - protein, 31 aa, Artificial Sequence
  Description of Artificial Sequence: Synthetic polypeptide
DEDEIATTNPVATAQWGCVAGTGLEMQDGNN

SEQ ID NO: 119867 - protein, 31 aa, Artificial Sequence
  Description of Artificial Sequence: Synthetic polypeptide
DEDEIACTNPVATEQYGCNATNHQEAEGPRS

SEQ ID NO: 119868 - protein, 36 aa, Artificial Sequence
  Description of Artificial Sequence: Synthetic polypeptide
DEAEIRTTNPVATEQYGSVSTHTNLEEKDNSQEDRN

SEQ ID NO: 119869 - protein, 38 aa, Artificial Sequence
  Description of Artificial Sequence: Synthetic polypeptide
DEEEIRTTNPVATEQYGSVSTVVNNLQSGTEENNVEDT

SEQ ID NO: 119870 - protein, 35 aa, Artificial Sequence
  Description of Artificial Sequence: Synthetic polypeptide
DEEEIRTTNPVATEGYGSVMDNLEDGGGQGTGNIE

SEQ ID NO: 119871 - protein, 34 aa, Artificial Sequence
  Description of Artificial Sequence: Synthetic polypeptide
DEEEIRTTNPVATEQYGSVSTWISVEQFNMSQEE

SEQ ID NO: 119872 - protein, 35 aa, Artificial Sequence
  Description of Artificial Sequence: Synthetic polypeptide
DEEEIRTTNPVATEAYGSVSNWVNLGTTGNDQIID

SEQ ID NO: 119873 - protein, 36 aa, Artificial Sequence
  Description of Artificial Sequence: Synthetic polypeptide
DEAEIRTTNPVATEQYGSVSTHTNLEEPGNGQEDHN

SEQ ID NO: 119874 - protein, 34 aa, Artificial Sequence
  Description of Artificial Sequence: Synthetic polypeptide
DEEEIRTTNPVATEQYGCVCSMTEAHQNFGSEQS

SEQ ID NO: 119875 - protein, 36 aa, Artificial Sequence
  Description of Artificial Sequence: Synthetic polypeptide
DEAEIRTTNPVATEQYGSVSTHTNLEETDMGQEDNN

SEQ ID NO: 119876 - protein, 34 aa, Artificial Sequence
  Description of Artificial Sequence: Synthetic polypeptide
DEEEIRTTNPVATEAYGSVSNWVNDSMTGNQQID

SEQ ID NO: 119877 - protein, 38 aa, Artificial Sequence
  Description of Artificial Sequence: Synthetic polypeptide
DEEEIRTTNPVATEQYGSVSTVVNNNLNQQGNNNEEND

SEQ ID NO: 119878 - protein, 33 aa, Artificial Sequence
  Description of Artificial Sequence: Synthetic polypeptide
DEDEIACTNPVATEQYGSVCATNLAPDNGDNDL

SEQ ID NO: 119879 - protein, 32 aa, Artificial Sequence
  Description of Artificial Sequence: Synthetic polypeptide
DECEIATTNPVATEIYGTVATTNQGQDAGNEW

SEQ ID NO: 119880 - protein, 33 aa, Artificial Sequence
  Description of Artificial Sequence: Synthetic polypeptide
DEEEIRTTNPVATEAYGSVILCGSAVSQGTGSE

SEQ ID NO: 119881 - protein, 31 aa, Artificial Sequence
  Description of Artificial Sequence: Synthetic polypeptide
DEAEIRTTNPVAYEQYGCICSTNHENFPSNV

SEQ ID NO: 119882 - protein, 34 aa, Artificial Sequence
  Description of Artificial Sequence: Synthetic polypeptide
DEEEIRTTNPVAYEQWGSVSTGNGNEGNQGQNNM

SEQ ID NO: 119883 - protein, 34 aa, Artificial Sequence
  Description of Artificial Sequence: Synthetic polypeptide
DEEEIRTTNPVATEQYGSVSTWIHVEENYMSQGE

SEQ ID NO: 119884 - protein, 33 aa, Artificial Sequence
  Description of Artificial Sequence: Synthetic polypeptide
DEAEIRTTNPVAYEQWGVVCSTNLNGDHGNEQY

SEQ ID NO: 119885 - protein, 34 aa, Artificial Sequence
  Description of Artificial Sequence: Synthetic polypeptide
DEEEIRTTNPVATEGYGSVMETNAFGNEGGQGGN

SEQ ID NO: 119886 - protein, 34 aa, Artificial Sequence
  Description of Artificial Sequence: Synthetic polypeptide
DEEEIRTTNPVATEQYGCVCSTMEHQFFGSDTQA

SEQ ID NO: 119887 - protein, 34 aa, Artificial Sequence
  Description of Artificial Sequence: Synthetic polypeptide
DEAEIRTTNPVQTECWGSVSCINEPQDREGENRG

SEQ ID NO: 119888 - protein, 38 aa, Artificial Sequence
  Description of Artificial Sequence: Synthetic polypeptide
DEEEIRTTNPVATEQYGSVSTVVNNLNGNQQGNLNEEN

SEQ ID NO: 119889 - protein, 33 aa, Artificial Sequence
  Description of Artificial Sequence: Synthetic polypeptide
DEEEIRTTNPVAYEQWGSVCYTTEDVDRGDTTR

SEQ ID NO: 119890 - protein, 33 aa, Artificial Sequence
  Description of Artificial Sequence: Synthetic polypeptide
DEAEIRTTNPVAYEQWGSVCYNDLQDAMGEGNP

SEQ ID NO: 119891 - protein, 32 aa, Artificial Sequence
  Description of Artificial Sequence: Synthetic polypeptide
DEDEIACTNPVATEQYGCVATNLQAEDDTPRV

SEQ ID NO: 119892 - protein, 34 aa, Artificial Sequence
  Description of Artificial Sequence: Synthetic polypeptide
DEEEIRTTNPVATEAYGTVVVTVNLNQDEEEENE

SEQ ID NO: 119893 - protein, 35 aa, Artificial Sequence
  Description of Artificial Sequence: Synthetic polypeptide
DEEEIRTTNPVATEAWGESVRTWNDDDHDRREGNR

SEQ ID NO: 119894 - protein, 31 aa, Artificial Sequence
  Description of Artificial Sequence: Synthetic polypeptide
DEDEIACTNPVATEQYGCVATNLQAEAHHDV

SEQ ID NO: 119895 - protein, 30 aa, Artificial Sequence
  Description of Artificial Sequence: Synthetic polypeptide
DEDEIATTNPVATAQWGCVAGTGLERDGPN

SEQ ID NO: 119896 - protein, 38 aa, Artificial Sequence
  Description of Artificial Sequence: Synthetic polypeptide
DEEEIRTTNPVATEQYGSVSTVVNNLNNQQGNNNEQQG

SEQ ID NO: 119897 - protein, 34 aa, Artificial Sequence
  Description of Artificial Sequence: Synthetic polypeptide
DEEEIRTTNPVATEAYGTVVVTVNNLNQDEEEND

SEQ ID NO: 119898 - protein, 34 aa, Artificial Sequence
  Description of Artificial Sequence: Synthetic polypeptide
DEEEIRTTNPVATEAYGTVVVTVNNLQDETENTD

SEQ ID NO: 119899 - protein, 37 aa, Artificial Sequence
  Description of Artificial Sequence: Synthetic polypeptide
DEEEIRTTNPVATEAYGSVSTNLQQGTNNQEAEEEDT

SEQ ID NO: 119900 - protein, 36 aa, Artificial Sequence
  Description of Artificial Sequence: Synthetic polypeptide
DEAEIRTTNPVATEQYGSVSTATNLESPMNVQEDRN

SEQ ID NO: 119901 - protein, 33 aa, Artificial Sequence
  Description of Artificial Sequence: Synthetic polypeptide
DEDEIACTNPVATEQYGCVATNLQAALTGEGRE

SEQ ID NO: 119902 - protein, 33 aa, Artificial Sequence
  Description of Artificial Sequence: Synthetic polypeptide
DEEEIRTTNPVATEQYGCVCQMTGEHQNFGSDQ

SEQ ID NO: 119903 - protein, 33 aa, Artificial Sequence
  Description of Artificial Sequence: Synthetic polypeptide
DEEEIRTTNPVATEQYGCVCSTMEHQNFTSEQA

SEQ ID NO: 119904 - protein, 37 aa, Artificial Sequence
  Description of Artificial Sequence: Synthetic polypeptide
DEEEIRTTNPVATEAYGSVSTNLQQGNNNQEATEEDE

SEQ ID NO: 119905 - protein, 35 aa, Artificial Sequence
  Description of Artificial Sequence: Synthetic polypeptide
DEAEIRTTNPVATEQYGSVSTDVEDEHFRGGNQDM

SEQ ID NO: 119906 - protein, 35 aa, Artificial Sequence
  Description of Artificial Sequence: Synthetic polypeptide
DEAEIRTTNPVATEQYGSVSTDVEDEQERGGDLQD

SEQ ID NO: 119907 - protein, 34 aa, Artificial Sequence
  Description of Artificial Sequence: Synthetic polypeptide
DEEEIRTTNPVATEQYGCTCSMTEELNQSINSDQ

SEQ ID NO: 119908 - protein, 34 aa, Artificial Sequence
  Description of Artificial Sequence: Synthetic polypeptide
DEEEIRTTNPVATEQYGCVCQNTENLIEHFGSDQ

SEQ ID NO: 119909 - protein, 34 aa, Artificial Sequence
  Description of Artificial Sequence: Synthetic polypeptide
DEEEIRTTNPVATEQYGCVCSTMEHQNFNSNTQP

SEQ ID NO: 119910 - protein, 37 aa, Artificial Sequence
  Description of Artificial Sequence: Synthetic polypeptide
DEEEIRTTNPVATEAYGSVSTNLNNNQQGNNNNATND

SEQ ID NO: 119911 - protein, 34 aa, Artificial Sequence
  Description of Artificial Sequence: Synthetic polypeptide
DEAEIRTTNPVATEQYGSVSTEGDLSQQSVSQEI

SEQ ID NO: 119912 - protein, 35 aa, Artificial Sequence
  Description of Artificial Sequence: Synthetic polypeptide
DEEEIRTTNPVATEQYGSVSTVYSGTDVSYFGNNG

SEQ ID NO: 119913 - protein, 34 aa, Artificial Sequence
  Description of Artificial Sequence: Synthetic polypeptide
DEEEIRTTNPVATEQYGCVCSTMEHFQSFNSEQG

SEQ ID NO: 119914 - protein, 34 aa, Artificial Sequence
  Description of Artificial Sequence: Synthetic polypeptide
DEDEIACTNPVATEQYGSVCATNLQPDNQTEGNV

SEQ ID NO: 119915 - protein, 38 aa, Artificial Sequence
  Description of Artificial Sequence: Synthetic polypeptide
DEEEIRTTNPVATEQYGSVSTVVNNNLQQLGTETGTNQ

SEQ ID NO: 119916 - protein, 34 aa, Artificial Sequence
  Description of Artificial Sequence: Synthetic polypeptide
DEEEIRTTNPVATEGYGSVVTGDGDQEDEGNGNV

SEQ ID NO: 119917 - protein, 33 aa, Artificial Sequence
  Description of Artificial Sequence: Synthetic polypeptide
DECEIATTNPVATEHYGSVSGGNGNAGNDNGRE

SEQ ID NO: 119918 - protein, 36 aa, Artificial Sequence
  Description of Artificial Sequence: Synthetic polypeptide
DEEEIRTTNPVATEAYGSTVPSCCGSNLQHEGGNMS

SEQ ID NO: 119919 - protein, 34 aa, Artificial Sequence
  Description of Artificial Sequence: Synthetic polypeptide
DEEEIRTTNPVATEAYGSTSMTEDWFSQTIGSRE

SEQ ID NO: 119920 - protein, 34 aa, Artificial Sequence
  Description of Artificial Sequence: Synthetic polypeptide
DEEEIRTTNPVATEQYGCVCSTEWHQEYFGSEQG

SEQ ID NO: 119921 - protein, 35 aa, Artificial Sequence
  Description of Artificial Sequence: Synthetic polypeptide
DEEEIRTTNPVAYEQYGQSVVSPEQDALQTGVELR

SEQ ID NO: 119922 - protein, 37 aa, Artificial Sequence
  Description of Artificial Sequence: Synthetic polypeptide
DEEEIRTTNPVATEQYGSVSTVVNNNQQGNNNNEDEE

SEQ ID NO: 119923 - protein, 34 aa, Artificial Sequence
  Description of Artificial Sequence: Synthetic polypeptide
DEEEIRTTNPVATEQYGCVCSTGAHNQNFNSDQA

SEQ ID NO: 119924 - protein, 33 aa, Artificial Sequence
  Description of Artificial Sequence: Synthetic polypeptide
DEEEIRTTNPVATEQYGCVCSMSEHQSFGSETQ

SEQ ID NO: 119925 - protein, 37 aa, Artificial Sequence
  Description of Artificial Sequence: Synthetic polypeptide
DEEEIRTTNPVATEQYGSVSTVVNNQNGNNQQETEEA

SEQ ID NO: 119926 - protein, 33 aa, Artificial Sequence
  Description of Artificial Sequence: Synthetic polypeptide
DEEEIRTTNPVATEQYGCVCSTGYHINSGSEQA

SEQ ID NO: 119927 - protein, 33 aa, Artificial Sequence
  Description of Artificial Sequence: Synthetic polypeptide
DEAEIRTTNPVAYEQWGTVSWTEHDNRGGGNIR

SEQ ID NO: 119928 - protein, 33 aa, Artificial Sequence
  Description of Artificial Sequence: Synthetic polypeptide
DEAEIRTTNPVAYEQWGTVSTNANGQADNGNGS

SEQ ID NO: 119929 - protein, 38 aa, Artificial Sequence
  Description of Artificial Sequence: Synthetic polypeptide
DEEEIRTTNPVATEQYGSVSTVVVTNLQQGNQEEEEEE

SEQ ID NO: 119930 - protein, 34 aa, Artificial Sequence
  Description of Artificial Sequence: Synthetic polypeptide
DEEEIRTTNPVATEGYGSVYSTSNCINKCLENFD

SEQ ID NO: 119931 - protein, 38 aa, Artificial Sequence
  Description of Artificial Sequence: Synthetic polypeptide
DEEEIRTTNPVATEQYGSVSTVVVTNLQQGNNDEDEED

SEQ ID NO: 119932 - protein, 34 aa, Artificial Sequence
  Description of Artificial Sequence: Synthetic polypeptide
DEEEIRTTNPVATEQYGCVCSTGAHQENFGSEIS

SEQ ID NO: 119933 - protein, 34 aa, Artificial Sequence
  Description of Artificial Sequence: Synthetic polypeptide
DEEEIRTTNPVATEQYGCVCSTGAHQNFISDNQS

SEQ ID NO: 119934 - protein, 34 aa, Artificial Sequence
  Description of Artificial Sequence: Synthetic polypeptide
DEEEIRTTNPVATEQYGCVCSMSEHQENFGSNQA

SEQ ID NO: 119935 - protein, 34 aa, Artificial Sequence
  Description of Artificial Sequence: Synthetic polypeptide
DEEEIRTTNPVATEAYGSIVSEMKDNTGEGINHL

SEQ ID NO: 119936 - protein, 34 aa, Artificial Sequence
  Description of Artificial Sequence: Synthetic polypeptide
DEEEIRTTNPVATEAYGSIVSCGSNVSQGPGGSM

SEQ ID NO: 119937 - protein, 34 aa, Artificial Sequence
  Description of Artificial Sequence: Synthetic polypeptide
DEEEIRTTNPVATEQYGCVCSTGPHQFFNSDFAS

SEQ ID NO: 119938 - protein, 35 aa, Artificial Sequence
  Description of Artificial Sequence: Synthetic polypeptide
DEEEIRTTNPVATEQYGCVCSTGEAHQNFGSNTQL

SEQ ID NO: 119939 - protein, 37 aa, Artificial Sequence
  Description of Artificial Sequence: Synthetic polypeptide
DEEEIRTTNPVATEQYGSVSTVVNNQQGNNQDETEEV

SEQ ID NO: 119940 - protein, 34 aa, Artificial Sequence
  Description of Artificial Sequence: Synthetic polypeptide
DEEEIRTTNPVATEQYGCVCSTGPHQENFGSEQS

SEQ ID NO: 119941 - protein, 35 aa, Artificial Sequence
  Description of Artificial Sequence: Synthetic polypeptide
DEEEIRTTNPVATEAYGSTVPSCIGINFQHEGGNP

SEQ ID NO: 119942 - protein, 35 aa, Artificial Sequence
  Description of Artificial Sequence: Synthetic polypeptide
DEEEIRTTNPVATEQYGCVCSTGNHNQNFNSQNQS

SEQ ID NO: 119943 - protein, 35 aa, Artificial Sequence
  Description of Artificial Sequence: Synthetic polypeptide
DEEEIRTTNPVATEGYGSVVMTDEFLQQRIINGDD

SEQ ID NO: 119944 - protein, 31 aa, Artificial Sequence
  Description of Artificial Sequence: Synthetic polypeptide
DEDEIATTNPVATAQWGCCAGTALQDRGGNQ

SEQ ID NO: 119945 - protein, 32 aa, Artificial Sequence
  Description of Artificial Sequence: Synthetic polypeptide
DECEIATTNPVATEIYGTVATTNMGQDAGGNW

SEQ ID NO: 119946 - protein, 34 aa, Artificial Sequence
  Description of Artificial Sequence: Synthetic polypeptide
DEEEIRTTNPVATEQYGCVCSTMEHDQNFGSDQG

SEQ ID NO: 119947 - protein, 34 aa, Artificial Sequence
  Description of Artificial Sequence: Synthetic polypeptide
DEEEIRTTNPVAYEQWGSVSTGNGNEGNQGNDSM

SEQ ID NO: 119948 - protein, 32 aa, Artificial Sequence
  Description of Artificial Sequence: Synthetic polypeptide
DEAEIRTTNPVAYEQYGCICSTNLENFISNQA

SEQ ID NO: 119949 - protein, 34 aa, Artificial Sequence
  Description of Artificial Sequence: Synthetic polypeptide
DEEEIRTTNPVATEAYGSVCNTFNLYGRAQSTQI

SEQ ID NO: 119950 - protein, 33 aa, Artificial Sequence
  Description of Artificial Sequence: Synthetic polypeptide
DECEIATTNPVATEIYGTVATTNLGQNDAGDNW

SEQ ID NO: 119951 - protein, 32 aa, Artificial Sequence
  Description of Artificial Sequence: Synthetic polypeptide
DEEEIRTTNPVATEGYGCVCSWEHQNFNSQQS

SEQ ID NO: 119952 - protein, 37 aa, Artificial Sequence
  Description of Artificial Sequence: Synthetic polypeptide
DEEEIRTTNPVATEQYGSVSTVVNNNNLLGTETGTNG

SEQ ID NO: 119953 - protein, 35 aa, Artificial Sequence
  Description of Artificial Sequence: Synthetic polypeptide
DEEEIRTTNPVATEQYGCVCSTMEDLQENFGSDQT

SEQ ID NO: 119954 - protein, 34 aa, Artificial Sequence
  Description of Artificial Sequence: Synthetic polypeptide
DEEEIRTTNPVATEQYGCVCSTMEDHQNFGSQQV

SEQ ID NO: 119955 - protein, 32 aa, Artificial Sequence
  Description of Artificial Sequence: Synthetic polypeptide
DEEEIRTTNPVATEGYGCVCSWETQNFGSEQS

SEQ ID NO: 119956 - protein, 35 aa, Artificial Sequence
  Description of Artificial Sequence: Synthetic polypeptide
DEEEIRTTNPVATEQYGCVCSTMEDHQFFGSDNQY

SEQ ID NO: 119957 - protein, 32 aa, Artificial Sequence
  Description of Artificial Sequence: Synthetic polypeptide
DECEIATTNPVATEIYGTVATTGNSGQDAGNS

SEQ ID NO: 119958 - protein, 32 aa, Artificial Sequence
  Description of Artificial Sequence: Synthetic polypeptide
DEAEIRTTNPVAYEQYGCICSTNLENFPSDRS

SEQ ID NO: 119959 - protein, 32 aa, Artificial Sequence
  Description of Artificial Sequence: Synthetic polypeptide
DEAEIRTTNPVAYEQYGCICSTNLENFPSNPQ

SEQ ID NO: 119960 - protein, 34 aa, Artificial Sequence
  Description of Artificial Sequence: Synthetic polypeptide
DEEEIRTTNPVATEQYGCVCSTETQEHFGSDFQS

SEQ ID NO: 119961 - protein, 34 aa, Artificial Sequence
  Description of Artificial Sequence: Synthetic polypeptide
DEEEIRTTNPVATEPWGESVRTWNDDQDQQKNAR

SEQ ID NO: 119962 - protein, 31 aa, Artificial Sequence
  Description of Artificial Sequence: Synthetic polypeptide
DEDCIACTNPVAYEPWDYSVSNNLQRGDNMR

SEQ ID NO: 119963 - protein, 33 aa, Artificial Sequence
  Description of Artificial Sequence: Synthetic polypeptide
DEEEIRTTNPVATEGYGDVFGNMNGQGGGNDDD

SEQ ID NO: 119964 - protein, 35 aa, Artificial Sequence
  Description of Artificial Sequence: Synthetic polypeptide
DEEEIRTTNPVATEAWGISVRTWNDDDQQRRESNR

SEQ ID NO: 119965 - protein, 34 aa, Artificial Sequence
  Description of Artificial Sequence: Synthetic polypeptide
DEEEIRTTNPVATEGYGSVVDQTVNMFDRISNGV

SEQ ID NO: 119966 - protein, 34 aa, Artificial Sequence
  Description of Artificial Sequence: Synthetic polypeptide
DEEEIRTTNPVATEGYGSVDNTNDEMNQEQENGD

SEQ ID NO: 119967 - protein, 32 aa, Artificial Sequence
  Description of Artificial Sequence: Synthetic polypeptide
DEAEIRTTNPVAYEQYGCICSTNLENSPSNQG

SEQ ID NO: 119968 - protein, 35 aa, Artificial Sequence
  Description of Artificial Sequence: Synthetic polypeptide
DEDEIRTTNPVATEAWGSVCSTMNNDHEREGDGNR

SEQ ID NO: 119969 - protein, 32 aa, Artificial Sequence
  Description of Artificial Sequence: Synthetic polypeptide
DECEIATTNPVATEHYGTVAITGGNQQDAGNW

SEQ ID NO: 119970 - protein, 34 aa, Artificial Sequence
  Description of Artificial Sequence: Synthetic polypeptide
DEEEIRTTNPVAYEQYGQTTSTENDLLQFSIEKR

SEQ ID NO: 119971 - protein, 34 aa, Artificial Sequence
  Description of Artificial Sequence: Synthetic polypeptide
DEDEIRTTNPCATECYGSVSTGNNLGGNAGENAE

SEQ ID NO: 119972 - protein, 36 aa, Artificial Sequence
  Description of Artificial Sequence: Synthetic polypeptide
DEEEIRTTNPVATEMYGSVSSTTPAGPNMRRGMNPV

SEQ ID NO: 119973 - protein, 34 aa, Artificial Sequence
  Description of Artificial Sequence: Synthetic polypeptide
DEEEIRTTNPVATEQYGCVCSTGEDQHFGSETQS

SEQ ID NO: 119974 - protein, 35 aa, Artificial Sequence
  Description of Artificial Sequence: Synthetic polypeptide
DEEEIRTTNPVAYEQYGQSVSVTNDALQVPTVEFN

SEQ ID NO: 119975 - protein, 35 aa, Artificial Sequence
  Description of Artificial Sequence: Synthetic polypeptide
DEEEIRTTNPVATEQYGCVCSTGELNQFFGSETQS

SEQ ID NO: 119976 - protein, 34 aa, Artificial Sequence
  Description of Artificial Sequence: Synthetic polypeptide
DEEEIRTTNPVATEQYGCVCSTGELNENFGSDQS

SEQ ID NO: 119977 - protein, 32 aa, Artificial Sequence
  Description of Artificial Sequence: Synthetic polypeptide
DEDEIACTNPVATEPYGSVSANLQDQGGGDPF

SEQ ID NO: 119978 - protein, 32 aa, Artificial Sequence
  Description of Artificial Sequence: Synthetic polypeptide
DEEEIRTTNPVATEKYGEVVTADQQAIKDNNE

SEQ ID NO: 119979 - protein, 38 aa, Artificial Sequence
  Description of Artificial Sequence: Synthetic polypeptide
DEEEIRTTNPVATEQYGSVSTVVTNLQGNQNIGNNEGS

SEQ ID NO: 119980 - protein, 38 aa, Artificial Sequence
  Description of Artificial Sequence: Synthetic polypeptide
DEEEIRTTNPVATEQYGSVSTVVTNLQGNQQIGNNENN

SEQ ID NO: 119981 - protein, 34 aa, Artificial Sequence
  Description of Artificial Sequence: Synthetic polypeptide
DEAEIRTTNPVAYEQWGSVSNNPLDQGGGMNGGH

SEQ ID NO: 119982 - protein, 34 aa, Artificial Sequence
  Description of Artificial Sequence: Synthetic polypeptide
DEEEIRTTNPVATEQYGCVCSTGEHNQNFGSDQY

SEQ ID NO: 119983 - protein, 38 aa, Artificial Sequence
  Description of Artificial Sequence: Synthetic polypeptide
DEEEIRTTNPVATEQYGSVSTVVTNLQGNQQIGNNNEG

SEQ ID NO: 119984 - protein, 35 aa, Artificial Sequence
  Description of Artificial Sequence: Synthetic polypeptide
DEEEIRTTNPVATEQYGCVCSTGEHNQNFGSNTQA

SEQ ID NO: 119985 - protein, 38 aa, Artificial Sequence
  Description of Artificial Sequence: Synthetic polypeptide
DEEEIRTTNPVATEQYGSVSTVVTNLQGNQAGNNEEGS

SEQ ID NO: 119986 - protein, 33 aa, Artificial Sequence
  Description of Artificial Sequence: Synthetic polypeptide
DEAEIRTTNPVAYEQWGSVSNNPSQGGGMNGGH

SEQ ID NO: 119987 - protein, 33 aa, Artificial Sequence
  Description of Artificial Sequence: Synthetic polypeptide
DEAEIRTTNPVAYEQWGSVSNPNGNQGGMNGGH

SEQ ID NO: 119988 - protein, 32 aa, Artificial Sequence
  Description of Artificial Sequence: Synthetic polypeptide
DECEIATTNPCAYEQWGSVSTNLQGEHPNDAD

SEQ ID NO: 119989 - protein, 34 aa, Artificial Sequence
  Description of Artificial Sequence: Synthetic polypeptide
DEEEIRTTNPVATEGYGMVNNNGTGNLEGNGGNQ

SEQ ID NO: 119990 - protein, 33 aa, Artificial Sequence
  Description of Artificial Sequence: Synthetic polypeptide
DECEIATTNPCAYEQWGSVSTNLQGDHGGNDAI

SEQ ID NO: 119991 - protein, 33 aa, Artificial Sequence
  Description of Artificial Sequence: Synthetic polypeptide
DEEEIRTTNPVATEQYGCVAGTNNHQEPDMIFD

SEQ ID NO: 119992 - protein, 32 aa, Artificial Sequence
  Description of Artificial Sequence: Synthetic polypeptide
DECEIATTNPCAYEQWGSVSTNLQGDHGGDAS

SEQ ID NO: 119993 - protein, 34 aa, Artificial Sequence
  Description of Artificial Sequence: Synthetic polypeptide
DEEEIRTTNPVATEQYGCVCSTGELDTNFGSEQP

SEQ ID NO: 119994 - protein, 33 aa, Artificial Sequence
  Description of Artificial Sequence: Synthetic polypeptide
DEEEIRTTNPVATEQYGCVAGTNGHAEPDMGRD

SEQ ID NO: 119995 - protein, 34 aa, Artificial Sequence
  Description of Artificial Sequence: Synthetic polypeptide
DEDCIRTTNPVATEQWGSMVATGNMLSQNGGNND

SEQ ID NO: 119996 - protein, 33 aa, Artificial Sequence
  Description of Artificial Sequence: Synthetic polypeptide
DEAEIRTTNPVAYEQWGSVSNPNGQDMQGNNEV

SEQ ID NO: 119997 - protein, 35 aa, Artificial Sequence
  Description of Artificial Sequence: Synthetic polypeptide
DEEEIRTTNPVATEQYGCVCSTGEHNQNFGSNTQS

SEQ ID NO: 119998 - protein, 34 aa, Artificial Sequence
  Description of Artificial Sequence: Synthetic polypeptide
DEEEIRTTNPVATEQYGCVCSTGELINFGSDTQA

SEQ ID NO: 119999 - protein, 33 aa, Artificial Sequence
  Description of Artificial Sequence: Synthetic polypeptide
DEAVIRTTNPVATEQYGSVYSLSEIPNGSQNER

SEQ ID NO: 120000 - protein, 35 aa, Artificial Sequence
  Description of Artificial Sequence: Synthetic polypeptide
DEEEIRTTNPVATEQYGCVCSTGELNQFFNSDNQS

SEQ ID NO: 120001 - protein, 34 aa, Artificial Sequence
  Description of Artificial Sequence: Synthetic polypeptide
DEAEIRTTNPVAYEQWGSVSNENGLQGGGMNGGH

SEQ ID NO: 120002 - protein, 35 aa, Artificial Sequence
  Description of Artificial Sequence: Synthetic polypeptide
DEEEIRTTNPVATEQYGCVCSTGEHNQGFGSNTQS

SEQ ID NO: 120003 - protein, 34 aa, Artificial Sequence
  Description of Artificial Sequence: Synthetic polypeptide
DEEEIRTTNPVATEQYGCVCQTGELQENFGSEDS

SEQ ID NO: 120004 - protein, 35 aa, Artificial Sequence
  Description of Artificial Sequence: Synthetic polypeptide
DEEEIRTTNPVATEQYGCVCSTGEPHQYFGSENQS

SEQ ID NO: 120005 - protein, 35 aa, Artificial Sequence
  Description of Artificial Sequence: Synthetic polypeptide
DEEEIRTTNPVATEQYGCVCSTGEHNQHFGSNTQS

SEQ ID NO: 120006 - protein, 33 aa, Artificial Sequence
  Description of Artificial Sequence: Synthetic polypeptide
DEAEIRTTNPVAYEQWGSVSTTNGDNHGGRNTL

SEQ ID NO: 120007 - protein, 35 aa, Artificial Sequence
  Description of Artificial Sequence: Synthetic polypeptide
DEAEIRTTNPVAYEQWGSVSTTNAGNQGEGAGNHR

SEQ ID NO: 120008 - protein, 34 aa, Artificial Sequence
  Description of Artificial Sequence: Synthetic polypeptide
DEAEIRTTNPVAYEQYGSICACTNLTDPTPGNRN

SEQ ID NO: 120009 - protein, 33 aa, Artificial Sequence
  Description of Artificial Sequence: Synthetic polypeptide
DEEEIRTTNPVATEQYGCVCSTGEPEGFGSDQS

SEQ ID NO: 120010 - protein, 35 aa, Artificial Sequence
  Description of Artificial Sequence: Synthetic polypeptide
DEEEIRTTNPVATEQYGCVCSTGEHNQNFGSDNQM

SEQ ID NO: 120011 - protein, 34 aa, Artificial Sequence
  Description of Artificial Sequence: Synthetic polypeptide
DEEEIRTTNPVATEQYGCVCSTGEPDQFFGSEQS

SEQ ID NO: 120012 - protein, 33 aa, Artificial Sequence
  Description of Artificial Sequence: Synthetic polypeptide
DEEEIRTTNPVATEQYGCVCSTGEPAHFGSEQA

SEQ ID NO: 120013 - protein, 33 aa, Artificial Sequence
  Description of Artificial Sequence: Synthetic polypeptide
DEEEIRTTNPVATEQYGCVCSTGEPAFFGSDQS

SEQ ID NO: 120014 - protein, 32 aa, Artificial Sequence
  Description of Artificial Sequence: Synthetic polypeptide
DEAEIRTTNPVAYEQWGSVSTPQGNTMGNNEV

SEQ ID NO: 120015 - protein, 34 aa, Artificial Sequence
  Description of Artificial Sequence: Synthetic polypeptide
DEEEIRTTNPVATEAYGKVSCNNLSQQKAGGMEP

SEQ ID NO: 120016 - protein, 32 aa, Artificial Sequence
  Description of Artificial Sequence: Synthetic polypeptide
DEEEIRTTNPVATEAYGMVSNVEDQDGQGEEQ

SEQ ID NO: 120017 - protein, 33 aa, Artificial Sequence
  Description of Artificial Sequence: Synthetic polypeptide
DEDEIRTTNPCATEQYGETTSCTNAHSQRGGDG

SEQ ID NO: 120018 - protein, 35 aa, Artificial Sequence
  Description of Artificial Sequence: Synthetic polypeptide
DEEEIRTTNPVATEQYGCVCSTGELQEYFISENQS

SEQ ID NO: 120019 - protein, 33 aa, Artificial Sequence
  Description of Artificial Sequence: Synthetic polypeptide
DECEIATTNPCAYEQWGSVSTNLQNGDHGNDAD

SEQ ID NO: 120020 - protein, 32 aa, Artificial Sequence
  Description of Artificial Sequence: Synthetic polypeptide
DEAEIRTTNPVAYEQWGSVSNDGQGGGMNGGH

SEQ ID NO: 120021 - protein, 35 aa, Artificial Sequence
  Description of Artificial Sequence: Synthetic polypeptide
DEEEIRTTNPVATEQYGCVCSTGELQESFNSDNQA

SEQ ID NO: 120022 - protein, 38 aa, Artificial Sequence
  Description of Artificial Sequence: Synthetic polypeptide
DEEEIRTTNPVATEQYGSVSTVVTNLQGNNQAGNGNEG

SEQ ID NO: 120023 - protein, 35 aa, Artificial Sequence
  Description of Artificial Sequence: Synthetic polypeptide
DEEEIRTTNPVATEQYGCVCSTGELQEHFNSDNQL

SEQ ID NO: 120024 - protein, 35 aa, Artificial Sequence
  Description of Artificial Sequence: Synthetic polypeptide
DEEEIRTTNPVATEQYGCVCSTGELQEHFGSDTQE

SEQ ID NO: 120025 - protein, 34 aa, Artificial Sequence
  Description of Artificial Sequence: Synthetic polypeptide
DEEEIRTTNPVATEAYGNVPSCNNLSQQKAGGDE

SEQ ID NO: 120026 - protein, 38 aa, Artificial Sequence
  Description of Artificial Sequence: Synthetic polypeptide
DEEEIRTTNPVATEQYGSVSTVVTNLQGNNQIGNNEGI

SEQ ID NO: 120027 - protein, 32 aa, Artificial Sequence
  Description of Artificial Sequence: Synthetic polypeptide
DEAVISTTNPVATEQYGCVCETNPQYSGSNQA

SEQ ID NO: 120028 - protein, 34 aa, Artificial Sequence
  Description of Artificial Sequence: Synthetic polypeptide
DEEEIRTTNPVATEQYGCVCSTGELDQNFISDQS

SEQ ID NO: 120029 - protein, 38 aa, Artificial Sequence
  Description of Artificial Sequence: Synthetic polypeptide
DEEEIRTTNPVATEQYGSVSTVVTNLQQGNQQGTTEES

SEQ ID NO: 120030 - protein, 34 aa, Artificial Sequence
  Description of Artificial Sequence: Synthetic polypeptide
DEEEIRTTNPVATEQYGCVAGTGEHQDEMSDNRW

SEQ ID NO: 120031 - protein, 32 aa, Artificial Sequence
  Description of Artificial Sequence: Synthetic polypeptide
DECEIATTNPCAYEKWGSVSTNLQGDAGNDTD

SEQ ID NO: 120032 - protein, 33 aa, Artificial Sequence
  Description of Artificial Sequence: Synthetic polypeptide
DEEEIRTTNPVATEQYGCVCSTGEHQENFISEQ

SEQ ID NO: 120033 - protein, 34 aa, Artificial Sequence
  Description of Artificial Sequence: Synthetic polypeptide
DEDEIRTTNPCATESYGSVSTGNLNGNAGENHGE

SEQ ID NO: 120034 - protein, 36 aa, Artificial Sequence
  Description of Artificial Sequence: Synthetic polypeptide
DEEEIRTTNPVATEIYGSVSSTTLAGPNMRNGMNPV

SEQ ID NO: 120035 - protein, 34 aa, Artificial Sequence
  Description of Artificial Sequence: Synthetic polypeptide
DEEEIRTTNPVATEGYGMVNNSGTNIDENNGGNQ

SEQ ID NO: 120036 - protein, 34 aa, Artificial Sequence
  Description of Artificial Sequence: Synthetic polypeptide
DEDEIACTNPVATEQYGSVSTNLTQNGQDEDTAM

SEQ ID NO: 120037 - protein, 35 aa, Artificial Sequence
  Description of Artificial Sequence: Synthetic polypeptide
DEEEIRTTNPVATEQYGSVSTDEMLNSNMNTNEGD

SEQ ID NO: 120038 - protein, 34 aa, Artificial Sequence
  Description of Artificial Sequence: Synthetic polypeptide
DEEEIRTTNPVATEGYGMVNNSNTNDENNGGNNQ

SEQ ID NO: 120039 - protein, 34 aa, Artificial Sequence
  Description of Artificial Sequence: Synthetic polypeptide
DEAEIRTTNPVAYEQWGSVSNPNLNQGGGMNGGH

SEQ ID NO: 120040 - protein, 32 aa, Artificial Sequence
  Description of Artificial Sequence: Synthetic polypeptide
DEAEIRTTNPVAYEQWGSVSNQGQGGGMNGGH

SEQ ID NO: 120041 - protein, 31 aa, Artificial Sequence
  Description of Artificial Sequence: Synthetic polypeptide
DDSEVATTNPVATEGYGNVSATDLQDRVGEL

SEQ ID NO: 120042 - protein, 34 aa, Artificial Sequence
  Description of Artificial Sequence: Synthetic polypeptide
DEEEIRTTNPVATEGYGMVNSVNIGQFTGENGEN

SEQ ID NO: 120043 - protein, 35 aa, Artificial Sequence
  Description of Artificial Sequence: Synthetic polypeptide
DEEEIRTTNPVATEQYGCVCSTGEHQEYFGSNNQF

SEQ ID NO: 120044 - protein, 34 aa, Artificial Sequence
  Description of Artificial Sequence: Synthetic polypeptide
DEEEIRTTNPVATEQYGCVCSTGEHQGFGSDTDS

SEQ ID NO: 120045 - protein, 34 aa, Artificial Sequence
  Description of Artificial Sequence: Synthetic polypeptide
DEEEIRTTNPVATEQYGCVCSTGEHQGFQSENQS

SEQ ID NO: 120046 - protein, 31 aa, Artificial Sequence
  Description of Artificial Sequence: Synthetic polypeptide
DEDDCIACTNPVAYEQYGSVAAMNDQRGNDL

SEQ ID NO: 120047 - protein, 35 aa, Artificial Sequence
  Description of Artificial Sequence: Synthetic polypeptide
DEEEIRTTNPVATEAYGQTVQSTNMHSHMNGDNNR

SEQ ID NO: 120048 - protein, 34 aa, Artificial Sequence
  Description of Artificial Sequence: Synthetic polypeptide
DEEEIRTTNPVATEQYGCVCSTGEHQNFFSDNAS

SEQ ID NO: 120049 - protein, 34 aa, Artificial Sequence
  Description of Artificial Sequence: Synthetic polypeptide
DEEEIRTTNPVATEQYGCVCSTGEHQNFGSQFAP

SEQ ID NO: 120050 - protein, 34 aa, Artificial Sequence
  Description of Artificial Sequence: Synthetic polypeptide
DEEEIRTTNPVATEQYGCVCSTGEHQNFISNFQP

SEQ ID NO: 120051 - protein, 33 aa, Artificial Sequence
  Description of Artificial Sequence: Synthetic polypeptide
DEEEIRTTNPVATEQYGCVCSDTEDEGFGSEQG

SEQ ID NO: 120052 - protein, 33 aa, Artificial Sequence
  Description of Artificial Sequence: Synthetic polypeptide
DEEEIRTTNPVATEQYGCVCSDTEDENFNSEQN

SEQ ID NO: 120053 - protein, 34 aa, Artificial Sequence
  Description of Artificial Sequence: Synthetic polypeptide
DEEEIRTTNPVATEQYGCVCSTGEHQNSPSDNQS

SEQ ID NO: 120054 - protein, 32 aa, Artificial Sequence
  Description of Artificial Sequence: Synthetic polypeptide
DEDEIRTTNPCAYEQWGSVCSTIDNKDQGGEL

SEQ ID NO: 120055 - protein, 33 aa, Artificial Sequence
  Description of Artificial Sequence: Synthetic polypeptide
DEEEIRTTNPVATEQYGCVADTWHAQANSDNAH

SEQ ID NO: 120056 - protein, 34 aa, Artificial Sequence
  Description of Artificial Sequence: Synthetic polypeptide
DEEEIRTTNPVATEQYGCVCSDSELQNFNSNNQS

SEQ ID NO: 120057 - protein, 34 aa, Artificial Sequence
  Description of Artificial Sequence: Synthetic polypeptide
DEEEIRTTNPVATEQYGCVCSDTELNQSFSSDQL

SEQ ID NO: 120058 - protein, 33 aa, Artificial Sequence
  Description of Artificial Sequence: Synthetic polypeptide
DEEEIRTTNPVATEIYGCVCSTEPHQNFGSDQS

SEQ ID NO: 120059 - protein, 34 aa, Artificial Sequence
  Description of Artificial Sequence: Synthetic polypeptide
DEDEIRTTNPCATEQYGSVSTVNGNGNAGENHGE

SEQ ID NO: 120060 - protein, 38 aa, Artificial Sequence
  Description of Artificial Sequence: Synthetic polypeptide
DEEEIRTTNPVATEQYGSVSTVVTNLQQLGNQDEEEED

SEQ ID NO: 120061 - protein, 35 aa, Artificial Sequence
  Description of Artificial Sequence: Synthetic polypeptide
DEDCIRTTNPVATEQWGSVATGNMLSQYEGGNNRC

SEQ ID NO: 120062 - protein, 34 aa, Artificial Sequence
  Description of Artificial Sequence: Synthetic polypeptide
DEDCIRTTNPVATEQWGSVATGNMLSQYNGTNNP

SEQ ID NO: 120063 - protein, 32 aa, Artificial Sequence
  Description of Artificial Sequence: Synthetic polypeptide
DEAEIRTTNPVAYEQWGSVSSGNNTQGDVNMN

SEQ ID NO: 120064 - protein, 34 aa, Artificial Sequence
  Description of Artificial Sequence: Synthetic polypeptide
DEEEIRTTNPVATEQYGCVCSTGEHNQNFNSDIA

SEQ ID NO: 120065 - protein, 35 aa, Artificial Sequence
  Description of Artificial Sequence: Synthetic polypeptide
DEEEIRTTNPVATEGYGMVSTTDNDGQGEGGNQGT

SEQ ID NO: 120066 - protein, 38 aa, Artificial Sequence
  Description of Artificial Sequence: Synthetic polypeptide
DEEEIRTTNPVATEQYGSVSTVVTNLQQLGNQEEEDTD

SEQ ID NO: 120067 - protein, 34 aa, Artificial Sequence
  Description of Artificial Sequence: Synthetic polypeptide
DEEEIRTTNPVATEQYGCVCSDTEEHNQRFSSDQ

SEQ ID NO: 120068 - protein, 34 aa, Artificial Sequence
  Description of Artificial Sequence: Synthetic polypeptide
DEEEIRTTNPVATEQYGCVCSTGEHNQNFNSDQS

SEQ ID NO: 120069 - protein, 34 aa, Artificial Sequence
  Description of Artificial Sequence: Synthetic polypeptide
DEEEIRTTNPVATEQYGCVCSTGEHNQNFNSNQE

SEQ ID NO: 120070 - protein, 34 aa, Artificial Sequence
  Description of Artificial Sequence: Synthetic polypeptide
DEEEIRTTNPVATEQYGCVCSTGEHNQNFNSQQA

SEQ ID NO: 120071 - protein, 33 aa, Artificial Sequence
  Description of Artificial Sequence: Synthetic polypeptide
DEEEIRTTNPVATEIYGCVCSTEDHQNFGSDQS

SEQ ID NO: 120072 - protein, 33 aa, Artificial Sequence
  Description of Artificial Sequence: Synthetic polypeptide
DEEEIRTTNPVATEQYGCVCSTGEHTNFTSDQN

SEQ ID NO: 120073 - protein, 34 aa, Artificial Sequence
  Description of Artificial Sequence: Synthetic polypeptide
DEEEIRTTNPVATEQYGCVCSDTEEHNQNSNSEQ

SEQ ID NO: 120074 - protein, 34 aa, Artificial Sequence
  Description of Artificial Sequence: Synthetic polypeptide
DEEEIRTTNPVATEQYGCVCSTGEHTHSGSENQS

SEQ ID NO: 120075 - protein, 35 aa, Artificial Sequence
  Description of Artificial Sequence: Synthetic polypeptide
DEEEIRTTNPVATEQYGSVSTDIVQQSGQGEEIVD

SEQ ID NO: 120076 - protein, 32 aa, Artificial Sequence
  Description of Artificial Sequence: Synthetic polypeptide
DEDEIRTTNPCAYEQWGSVPTWENDQRNGSEQ

SEQ ID NO: 120077 - protein, 33 aa, Artificial Sequence
  Description of Artificial Sequence: Synthetic polypeptide
DEEEIRTTNPVATEQYGCVAANNELIIGEEDTN

SEQ ID NO: 120078 - protein, 34 aa, Artificial Sequence
  Description of Artificial Sequence: Synthetic polypeptide
DEEEIRTTNPVATEQYGCVCSTGEHQEFFGSDQA

SEQ ID NO: 120079 - protein, 35 aa, Artificial Sequence
  Description of Artificial Sequence: Synthetic polypeptide
DEEEIRTTNPVATEQYGCVCSTGEHQEFFGSQNQY

SEQ ID NO: 120080 - protein, 32 aa, Artificial Sequence
  Description of Artificial Sequence: Synthetic polypeptide
DEDCIRTTNPVAYEAYGKTVSTNASQDGNNTF

SEQ ID NO: 120081 - protein, 34 aa, Artificial Sequence
  Description of Artificial Sequence: Synthetic polypeptide
DEEEIRTTNPVATEQYGCVCSTGEHQYFGSDTQV

SEQ ID NO: 120082 - protein, 32 aa, Artificial Sequence
  Description of Artificial Sequence: Synthetic polypeptide
DEDEIRTTNPCATEQYGEVSTGPGDHGGKGRE

SEQ ID NO: 120083 - protein, 34 aa, Artificial Sequence
  Description of Artificial Sequence: Synthetic polypeptide
DEDEIRTTNPCATEQYGSVSTVNGNGNAGEHGRE

SEQ ID NO: 120084 - protein, 33 aa, Artificial Sequence
  Description of Artificial Sequence: Synthetic polypeptide
DEAEIRTTNPVAYEQWGSVSNTNDNGNTGGTER

SEQ ID NO: 120085 - protein, 34 aa, Artificial Sequence
  Description of Artificial Sequence: Synthetic polypeptide
DEEEIRTTNPVATEQYGCVCSTGEHQYFGSDTQA

SEQ ID NO: 120086 - protein, 33 aa, Artificial Sequence
  Description of Artificial Sequence: Synthetic polypeptide
DEEEIRTTNPVATEGYGCVCSTGEHQFFNSDQE

SEQ ID NO: 120087 - protein, 37 aa, Artificial Sequence
  Description of Artificial Sequence: Synthetic polypeptide
DEEEIRTTNPVATEQYGSVSTVVTNLQGIGTEDEEED

SEQ ID NO: 120088 - protein, 34 aa, Artificial Sequence
  Description of Artificial Sequence: Synthetic polypeptide
DEEEIRTTNPVATEAYGSCSMTEALLYQTIGSQE

SEQ ID NO: 120089 - protein, 34 aa, Artificial Sequence
  Description of Artificial Sequence: Synthetic polypeptide
DEAEIRTTNPVAYEQWGSVSGNLNDLQGGMNGGH

SEQ ID NO: 120090 - protein, 35 aa, Artificial Sequence
  Description of Artificial Sequence: Synthetic polypeptide
DEEEIRTTNPVATEQYGCVCSTGEGTQNFGSNNQS

SEQ ID NO: 120091 - protein, 36 aa, Artificial Sequence
  Description of Artificial Sequence: Synthetic polypeptide
DEEEIRTTNPVATEAYGVVSTTNNLQQGNNATEQGQ

SEQ ID NO: 120092 - protein, 34 aa, Artificial Sequence
  Description of Artificial Sequence: Synthetic polypeptide
DEEEIRTTNPVATEAYGKVPSCNNLSQPKPGGIG

SEQ ID NO: 120093 - protein, 35 aa, Artificial Sequence
  Description of Artificial Sequence: Synthetic polypeptide
DEEEIRTTNPVATEQYGCVCSDTGEHNQRFSSNQS

SEQ ID NO: 120094 - protein, 34 aa, Artificial Sequence
  Description of Artificial Sequence: Synthetic polypeptide
DEEEIRTTNPVATEQYGCVCSTGEHAENFGSNQP

SEQ ID NO: 120095 - protein, 34 aa, Artificial Sequence
  Description of Artificial Sequence: Synthetic polypeptide
DEEEIRTTNPVATEAYGKVPSCNNLSQQDAGGID

SEQ ID NO: 120096 - protein, 33 aa, Artificial Sequence
  Description of Artificial Sequence: Synthetic polypeptide
DEEEIRTTNPVATEQYGCVCSTGEHAHFGSDQP

SEQ ID NO: 120097 - protein, 35 aa, Artificial Sequence
  Description of Artificial Sequence: Synthetic polypeptide
DEEEIRTTNPVATEQYGCVCSTGNDIQENFGSDQL

SEQ ID NO: 120098 - protein, 33 aa, Artificial Sequence
  Description of Artificial Sequence: Synthetic polypeptide
DEEEIRTTNPVATEQYGCVCSTGEHANFGSDQE

SEQ ID NO: 120099 - protein, 35 aa, Artificial Sequence
  Description of Artificial Sequence: Synthetic polypeptide
DEEEIRTTNPVATEAYGKVSCNNALSQQKAGGNKP

SEQ ID NO: 120100 - protein, 36 aa, Artificial Sequence
  Description of Artificial Sequence: Synthetic polypeptide
DEEEIRTTNPVATEQYGCVCSTGNDNNQENFGSNQS

SEQ ID NO: 120101 - protein, 35 aa, Artificial Sequence
  Description of Artificial Sequence: Synthetic polypeptide
DEEEIRTTNPVATEQYGCVCSTGNDHQEGFGSDDS

SEQ ID NO: 120102 - protein, 38 aa, Artificial Sequence
  Description of Artificial Sequence: Synthetic polypeptide
DEEEIRTTNPVATEQYGSVSTVVSNNLQQGTNQDESEV

SEQ ID NO: 120103 - protein, 38 aa, Artificial Sequence
  Description of Artificial Sequence: Synthetic polypeptide
DEEEIRTTNPVATEQYGSVSTVVSNNNLQLGNQDEEEE

SEQ ID NO: 120104 - protein, 33 aa, Artificial Sequence
  Description of Artificial Sequence: Synthetic polypeptide
DEEEIRTTNPVATEQYGCVCSTGEHANFTSNQS

SEQ ID NO: 120105 - protein, 33 aa, Artificial Sequence
  Description of Artificial Sequence: Synthetic polypeptide
DEAEIRTTNPVAYEQWGSVTGMNGDIQGGGNER

SEQ ID NO: 120106 - protein, 32 aa, Artificial Sequence
  Description of Artificial Sequence: Synthetic polypeptide
DEAGIRTTNPVATDAWGSVSCTNLSQEPVPNG

SEQ ID NO: 120107 - protein, 35 aa, Artificial Sequence
  Description of Artificial Sequence: Synthetic polypeptide
DEAEIRTTNPVAYEQYGSTVSCTNMLHRTSFNNQD

SEQ ID NO: 120108 - protein, 33 aa, Artificial Sequence
  Description of Artificial Sequence: Synthetic polypeptide
DEEEIRTTNPVATELYGSVYHVSDCIQKCLDER

SEQ ID NO: 120109 - protein, 35 aa, Artificial Sequence
  Description of Artificial Sequence: Synthetic polypeptide
DEEEIRTTNPVATEAYGKVSCNNLSQEKAGGNNKP

SEQ ID NO: 120110 - protein, 34 aa, Artificial Sequence
  Description of Artificial Sequence: Synthetic polypeptide
DEDEIRTTNPCATECYGSVSTGNQLGNAGENDTE

SEQ ID NO: 120111 - protein, 33 aa, Artificial Sequence
  Description of Artificial Sequence: Synthetic polypeptide
DECEIATTNPVATECYGSVATGDLQDRQGDGED

SEQ ID NO: 120112 - protein, 34 aa, Artificial Sequence
  Description of Artificial Sequence: Synthetic polypeptide
DEEEIRTTNPVATEQYGCVCSTGEHDQFFGSDQI

SEQ ID NO: 120113 - protein, 33 aa, Artificial Sequence
  Description of Artificial Sequence: Synthetic polypeptide
DEAEIRTTNPVAYEQWGSVSHAMNDQNHGGNDS

SEQ ID NO: 120114 - protein, 33 aa, Artificial Sequence
  Description of Artificial Sequence: Synthetic polypeptide
DEAVIRTTNPVATEQYGSVSPPELEFPNYSQER

SEQ ID NO: 120115 - protein, 33 aa, Artificial Sequence
  Description of Artificial Sequence: Synthetic polypeptide
DEEEIRTTNPVATEQYGCTCSWGELQNFGSEQS

SEQ ID NO: 120116 - protein, 32 aa, Artificial Sequence
  Description of Artificial Sequence: Synthetic polypeptide
DEEEIRTTNPVATEQYGCTCSWGEHQNFGSDQ

SEQ ID NO: 120117 - protein, 34 aa, Artificial Sequence
  Description of Artificial Sequence: Synthetic polypeptide
DEEEIRTTNPVATEQYGCVCSTGEDQHSNSENQS

SEQ ID NO: 120118 - protein, 35 aa, Artificial Sequence
  Description of Artificial Sequence: Synthetic polypeptide
DEEEIRTTNPVATEQYGCVCSTGNHNQNFNSDNQS

SEQ ID NO: 120119 - protein, 38 aa, Artificial Sequence
  Description of Artificial Sequence: Synthetic polypeptide
DEEEIRTTNPVATEQYGSVSTVVNTTNLQAGTTGENTD

SEQ ID NO: 120120 - protein, 35 aa, Artificial Sequence
  Description of Artificial Sequence: Synthetic polypeptide
DEEEIRTTNPVATEQYGCVCSTGNHNQENFNSNQS

SEQ ID NO: 120121 - protein, 36 aa, Artificial Sequence
  Description of Artificial Sequence: Synthetic polypeptide
DEEEIRTTNPVATEAYGVVSTTNNLQQGNNQEDETD

SEQ ID NO: 120122 - protein, 35 aa, Artificial Sequence
  Description of Artificial Sequence: Synthetic polypeptide
DEEEIRTTNPVATEQYGCVCSTGNHNQENFNSDQA

SEQ ID NO: 120123 - protein, 34 aa, Artificial Sequence
  Description of Artificial Sequence: Synthetic polypeptide
DEEEIRTTNPVATEQYGCVCSTGEDQNFNSENQA

SEQ ID NO: 120124 - protein, 32 aa, Artificial Sequence
  Description of Artificial Sequence: Synthetic polypeptide
DEAEIRTTNPVAYEQWGSVSGGNGNSGNGNGA

SEQ ID NO: 120125 - protein, 36 aa, Artificial Sequence
  Description of Artificial Sequence: Synthetic polypeptide
DEEEIRTTNPVATEAYGVVSTTNNLQQGNNDEDTED

SEQ ID NO: 120126 - protein, 34 aa, Artificial Sequence
  Description of Artificial Sequence: Synthetic polypeptide
DEAEIRTTNPVATEQYGSVSTLNDHTDNSDEDNL

SEQ ID NO: 120127 - protein, 33 aa, Artificial Sequence
  Description of Artificial Sequence: Synthetic polypeptide
DEAEIRTTNPVAYEQWGSVSGGNGNSQGEGNAI

SEQ ID NO: 120128 - protein, 34 aa, Artificial Sequence
  Description of Artificial Sequence: Synthetic polypeptide
DEEEIRTTNPVATEAYGKVACCNLSQQKAGGNVP

SEQ ID NO: 120129 - protein, 37 aa, Artificial Sequence
  Description of Artificial Sequence: Synthetic polypeptide
DEEEIRTTNPVATEQYGSVSTVVSNGNQNENNNDGNE

SEQ ID NO: 120130 - protein, 34 aa, Artificial Sequence
  Description of Artificial Sequence: Synthetic polypeptide
DEEEIRTTNPVATEAYGKVPSCDNLSQQKAGGIL

SEQ ID NO: 120131 - protein, 35 aa, Artificial Sequence
  Description of Artificial Sequence: Synthetic polypeptide
DEEEIRTTNPVATEQYGCVCSTGEDTQHFGSENQS

SEQ ID NO: 120132 - protein, 32 aa, Artificial Sequence
  Description of Artificial Sequence: Synthetic polypeptide
DECEIATTNPVATECYGVVSGGNGNAGNDNQR

SEQ ID NO: 120133 - protein, 33 aa, Artificial Sequence
  Description of Artificial Sequence: Synthetic polypeptide
DEEEIRTTNPVATEQYGCVASHAKPTLEGTNNE

SEQ ID NO: 120134 - protein, 38 aa, Artificial Sequence
  Description of Artificial Sequence: Synthetic polypeptide
DEEEIRTTNPVATEQYGSVSTVVSNNLQQGNNQDESTE

SEQ ID NO: 120135 - protein, 35 aa, Artificial Sequence
  Description of Artificial Sequence: Synthetic polypeptide
DEEEIRTTNPVATEQYGSVSTDALTNFRSTQIDGF

SEQ ID NO: 120136 - protein, 34 aa, Artificial Sequence
  Description of Artificial Sequence: Synthetic polypeptide
DEEEIRTTNPVATEQYGCVCSDTNHQENFISDQA

SEQ ID NO: 120137 - protein, 34 aa, Artificial Sequence
  Description of Artificial Sequence: Synthetic polypeptide
DEAEIRTTNPVAYEQYGTVATGNLGNQPSPGNTQ

SEQ ID NO: 120138 - protein, 38 aa, Artificial Sequence
  Description of Artificial Sequence: Synthetic polypeptide
DEEEIRTTNPVATEQYGSVSTVVSNNLQQGNNQDETET

SEQ ID NO: 120139 - protein, 35 aa, Artificial Sequence
  Description of Artificial Sequence: Synthetic polypeptide
DEAEIRTTNPVAYEQYGSVVSCTDNMLNPSGTNND

SEQ ID NO: 120140 - protein, 34 aa, Artificial Sequence
  Description of Artificial Sequence: Synthetic polypeptide
DEAEIRTTNPVAYEQYGSVSCTDNMFPSGTNNDL

SEQ ID NO: 120141 - protein, 35 aa, Artificial Sequence
  Description of Artificial Sequence: Synthetic polypeptide
DEEEIRTTNPVATEQYGCVCSDTGLHQENFNSDQS

SEQ ID NO: 120142 - protein, 38 aa, Artificial Sequence
  Description of Artificial Sequence: Synthetic polypeptide
DEEEIRTTNPVATEQYGSVSTVVSNNNLQNGNQDESET

SEQ ID NO: 120143 - protein, 34 aa, Artificial Sequence
  Description of Artificial Sequence: Synthetic polypeptide
DEEEIRTTNPVATEQYGCVCSTGEHDQNFGSQQM

SEQ ID NO: 120144 - protein, 34 aa, Artificial Sequence
  Description of Artificial Sequence: Synthetic polypeptide
DEEEIRTTNPVATEQYGCVCSTGETQNFGSDFQS

SEQ ID NO: 120145 - protein, 32 aa, Artificial Sequence
  Description of Artificial Sequence: Synthetic polypeptide
DEAEIRTTNPVAYEQWGSVSHPLDDRNNMNAE

SEQ ID NO: 120146 - protein, 33 aa, Artificial Sequence
  Description of Artificial Sequence: Synthetic polypeptide
DEDEIRTTNPCSTECYGSVSTGNLGNAGENNTE

SEQ ID NO: 120147 - protein, 34 aa, Artificial Sequence
  Description of Artificial Sequence: Synthetic polypeptide
DEEEIRTTNPVATEQYGCVCSTGEPNQNFGSDQA

SEQ ID NO: 120148 - protein, 38 aa, Artificial Sequence
  Description of Artificial Sequence: Synthetic polypeptide
DEEEIRTTNPVATEQYGSVSTVVTNLNGNQAIGNEEGT

SEQ ID NO: 120149 - protein, 38 aa, Artificial Sequence
  Description of Artificial Sequence: Synthetic polypeptide
DEEEIRTTNPVATEQYGSVSTVVTNLNGNQGIGNDEGN

SEQ ID NO: 120150 - protein, 38 aa, Artificial Sequence
  Description of Artificial Sequence: Synthetic polypeptide
DEEEIRTTNPVATEQYGSVSTVVTNLNGNQIGNNNEGN

SEQ ID NO: 120151 - protein, 33 aa, Artificial Sequence
  Description of Artificial Sequence: Synthetic polypeptide
DECEIATTNPVATEAYGSVSGGNGNANGNDNQR

SEQ ID NO: 120152 - protein, 34 aa, Artificial Sequence
  Description of Artificial Sequence: Synthetic polypeptide
DEDEIRTTNPCATEGYGSVSTGNLNGNAGEHGRE

SEQ ID NO: 120153 - protein, 33 aa, Artificial Sequence
  Description of Artificial Sequence: Synthetic polypeptide
DEEEIRTTNPVATEQYGCVCQTGEHQENFGSEQ

SEQ ID NO: 120154 - protein, 35 aa, Artificial Sequence
  Description of Artificial Sequence: Synthetic polypeptide
DEDEIRTTNPCATEHYGSVSTVNNLQGNAGENGAE

SEQ ID NO: 120155 - protein, 34 aa, Artificial Sequence
  Description of Artificial Sequence: Synthetic polypeptide
DEAVIRTTNPVATEQYGSVYSDLLQFPNGSQNTQ

SEQ ID NO: 120156 - protein, 38 aa, Artificial Sequence
  Description of Artificial Sequence: Synthetic polypeptide
DEEEIRTTNPVATEQYGSVSTVVTNLNGNQNGNSNEEN

SEQ ID NO: 120157 - protein, 38 aa, Artificial Sequence
  Description of Artificial Sequence: Synthetic polypeptide
DEEEIRTTNPVATEQYGSVSTVVTNLNGNQNTGNNEGN

SEQ ID NO: 120158 - protein, 38 aa, Artificial Sequence
  Description of Artificial Sequence: Synthetic polypeptide
DEEEIRTTNPVATEQYGSVSTVVTNLNGNQQGNGNNEN

SEQ ID NO: 120159 - protein, 32 aa, Artificial Sequence
  Description of Artificial Sequence: Synthetic polypeptide
DECEIATTNPVATEAWGSVSGGNGNAGNDDQR

SEQ ID NO: 120160 - protein, 35 aa, Artificial Sequence
  Description of Artificial Sequence: Synthetic polypeptide
DEEEIRTTNPVATEQYGCVCSTGEHNQENFGSENQ

SEQ ID NO: 120161 - protein, 35 aa, Artificial Sequence
  Description of Artificial Sequence: Synthetic polypeptide
DEEEIRTTNPVATEGYGNVSAATPAGPQMRNGNPV

SEQ ID NO: 120162 - protein, 38 aa, Artificial Sequence
  Description of Artificial Sequence: Synthetic polypeptide
DEEEIRTTNPVATEQYGSVSTVVTNLNGNQQGNNVEEN

SEQ ID NO: 120163 - protein, 38 aa, Artificial Sequence
  Description of Artificial Sequence: Synthetic polypeptide
DEEEIRTTNPVATEQYGSVSTVVTNLNGNQQGNTNEES

SEQ ID NO: 120164 - protein, 38 aa, Artificial Sequence
  Description of Artificial Sequence: Synthetic polypeptide
DEEEIRTTNPVATEQYGSVSTVVTNLNGNQQIGNNEGE

SEQ ID NO: 120165 - protein, 38 aa, Artificial Sequence
  Description of Artificial Sequence: Synthetic polypeptide
DEEEIRTTNPVATEQYGSVSTVVTNLNGNQQIGNTEEG

SEQ ID NO: 120166 - protein, 38 aa, Artificial Sequence
  Description of Artificial Sequence: Synthetic polypeptide
DEEEIRTTNPVATEQYGSVSTVVTNLQAGTEENNSEDT

SEQ ID NO: 120167 - protein, 38 aa, Artificial Sequence
  Description of Artificial Sequence: Synthetic polypeptide
DEEEIRTTNPVATEQYGSVSTVVTNLQAGTEENNVEEE

SEQ ID NO: 120168 - protein, 36 aa, Artificial Sequence
  Description of Artificial Sequence: Synthetic polypeptide
DEAEIRTTNPVAYEQYGSSVHNTGNLPQEFGLNLRD

SEQ ID NO: 120169 - protein, 38 aa, Artificial Sequence
  Description of Artificial Sequence: Synthetic polypeptide
DEEEIRTTNPVATEQYGSVSTVVTNLQGEQQGTTEENE

SEQ ID NO: 120170 - protein, 35 aa, Artificial Sequence
  Description of Artificial Sequence: Synthetic polypeptide
DEEEIRTTNPVATEQYGCVCSTGEHNQGFGSENQA

SEQ ID NO: 120171 - protein, 34 aa, Artificial Sequence
  Description of Artificial Sequence: Synthetic polypeptide
DEEEIRTTNPVATEGYGMVNGQGTNEQNEGGGNG

SEQ ID NO: 120172 - protein, 34 aa, Artificial Sequence
  Description of Artificial Sequence: Synthetic polypeptide
DEEEIRTTNPVATEQYGCVCQTGEHQHFGSENQS

SEQ ID NO: 120173 - protein, 35 aa, Artificial Sequence
  Description of Artificial Sequence: Synthetic polypeptide
DEEEIRTTNPVATEQYGCVCSTGEHNQEGFGSNQS

SEQ ID NO: 120174 - protein, 33 aa, Artificial Sequence
  Description of Artificial Sequence: Synthetic polypeptide
DECEIATTNPVATEAYGSVSGMNPGDQDRQGQP

SEQ ID NO: 120175 - protein, 34 aa, Artificial Sequence
  Description of Artificial Sequence: Synthetic polypeptide
DEEEIRTTNPVATEQYGCVCSTGEHEEGFGSNLS

SEQ ID NO: 120176 - protein, 33 aa, Artificial Sequence
  Description of Artificial Sequence: Synthetic polypeptide
DEDEIRTTNPVADECWGSVSCINEPQDREGENG

SEQ ID NO: 120177 - protein, 34 aa, Artificial Sequence
  Description of Artificial Sequence: Synthetic polypeptide
DEDEIRTTNPLAYERYGQSVSTGNSFSQLRVGDR

SEQ ID NO: 120178 - protein, 34 aa, Artificial Sequence
  Description of Artificial Sequence: Synthetic polypeptide
DEEEIRTTNPVATEQYGCVCSTGETQEHFGSEQM

SEQ ID NO: 120179 - protein, 32 aa, Artificial Sequence
  Description of Artificial Sequence: Synthetic polypeptide
DEDEIACTNPVAYEQWGSVATNLQANPPGERP

SEQ ID NO: 120180 - protein, 34 aa, Artificial Sequence
  Description of Artificial Sequence: Synthetic polypeptide
DEEEIRTTNPVATEGYGMVNDQNTNIQEEITGNG

SEQ ID NO: 120181 - protein, 33 aa, Artificial Sequence
  Description of Artificial Sequence: Synthetic polypeptide
DEAEIRTTNPVAYEQWGSVSHTMNDMNGGGNMP

SEQ ID NO: 120182 - protein, 34 aa, Artificial Sequence
  Description of Artificial Sequence: Synthetic polypeptide
DEAEIRTTNPVAYEQWGSVSHTMNDQNGGGGTDR

SEQ ID NO: 120183 - protein, 33 aa, Artificial Sequence
  Description of Artificial Sequence: Synthetic polypeptide
DEEEIRTTNPVATEQYGCVCSTGETAFFGSEQA

SEQ ID NO: 120184 - protein, 34 aa, Artificial Sequence
  Description of Artificial Sequence: Synthetic polypeptide
DEAEIRTTNPVAYEQWGSVSVTNLGEMGDRNGHA

SEQ ID NO: 120185 - protein, 33 aa, Artificial Sequence
  Description of Artificial Sequence: Synthetic polypeptide
DEDEIRTTNPCATECYGSVSTGNTGNAGEMNTE

SEQ ID NO: 120186 - protein, 34 aa, Artificial Sequence
  Description of Artificial Sequence: Synthetic polypeptide
DEEEIRTTNPVATEQYGCVCSTGEHFEGFNSNQS

SEQ ID NO: 120187 - protein, 34 aa, Artificial Sequence
  Description of Artificial Sequence: Synthetic polypeptide
DEEEIRTTNPVATEQYGCTCSWNEDHQNFGSNQA

SEQ ID NO: 120188 - protein, 33 aa, Artificial Sequence
  Description of Artificial Sequence: Synthetic polypeptide
DEDEIRTTNPCATECYGSVSTGNTGNAGENNSM

SEQ ID NO: 120189 - protein, 32 aa, Artificial Sequence
  Description of Artificial Sequence: Synthetic polypeptide
DEDEIRTTNPCATECYGSVSTGNTGNAGETDE

SEQ ID NO: 120190 - protein, 33 aa, Artificial Sequence
  Description of Artificial Sequence: Synthetic polypeptide
DEDEIRTTNPCATECYGSVSTGNTGNAGGNDSE

SEQ ID NO: 120191 - protein, 34 aa, Artificial Sequence
  Description of Artificial Sequence: Synthetic polypeptide
DEEEIRTTNPVATEAYGSCSMTEATLSQTMGSQE

SEQ ID NO: 120192 - protein, 33 aa, Artificial Sequence
  Description of Artificial Sequence: Synthetic polypeptide
DEAVIRTTNPVATEQYGSVSWPLLEEPNYSQNR

SEQ ID NO: 120193 - protein, 34 aa, Artificial Sequence
  Description of Artificial Sequence: Synthetic polypeptide
DEEEIRTTNPVATEQYGCVCSTGEPQSFGSDFQP

SEQ ID NO: 120194 - protein, 33 aa, Artificial Sequence
  Description of Artificial Sequence: Synthetic polypeptide
DEDEIRTTNPCATECYGSVSTGNTNGNAGENSE

SEQ ID NO: 120195 - protein, 35 aa, Artificial Sequence
  Description of Artificial Sequence: Synthetic polypeptide
DEEEIRTTNPVATEQYGCVCSTGEPQESFGSDNQA

SEQ ID NO: 120196 - protein, 32 aa, Artificial Sequence
  Description of Artificial Sequence: Synthetic polypeptide
DECEIATTNPVATECYGCVSGGNGNAGNDNSR

SEQ ID NO: 120197 - protein, 33 aa, Artificial Sequence
  Description of Artificial Sequence: Synthetic polypeptide
DEDEIRTTNPCATECYGSVSTVNGGNAGENHEE

SEQ ID NO: 120198 - protein, 35 aa, Artificial Sequence
  Description of Artificial Sequence: Synthetic polypeptide
DEDEIRTTNPCATECYGSVSTVNNLQGNAGENNDE

SEQ ID NO: 120199 - protein, 34 aa, Artificial Sequence
  Description of Artificial Sequence: Synthetic polypeptide
DEEEIRTTNPVATELYGSVSSNVSDCIEQKCLDR

SEQ ID NO: 120200 - protein, 38 aa, Artificial Sequence
  Description of Artificial Sequence: Synthetic polypeptide
DEEEIRTTNPVATEQYGSVSTVVTNLGGNQQGNINEEN

SEQ ID NO: 120201 - protein, 35 aa, Artificial Sequence
  Description of Artificial Sequence: Synthetic polypeptide
DEEEIRTTNPVATEQYGCVCSMTEDLQNFISENQA

SEQ ID NO: 120202 - protein, 34 aa, Artificial Sequence
  Description of Artificial Sequence: Synthetic polypeptide
DEEEIRTTNPVATEIYGETVACQNMPSQRGGTPR

SEQ ID NO: 120203 - protein, 34 aa, Artificial Sequence
  Description of Artificial Sequence: Synthetic polypeptide
DEEEIRTTNPVATEQYGCVCSMTEHQNFSSDNQG

SEQ ID NO: 120204 - protein, 34 aa, Artificial Sequence
  Description of Artificial Sequence: Synthetic polypeptide
DEEEIRTTNPVATEQYGCVCSTMEPQENFGSEQA

SEQ ID NO: 120205 - protein, 35 aa, Artificial Sequence
  Description of Artificial Sequence: Synthetic polypeptide
DEEEIRTTNPVATEQYGCVCGNSGNLAENFGSDNQ

SEQ ID NO: 120206 - protein, 33 aa, Artificial Sequence
  Description of Artificial Sequence: Synthetic polypeptide
DECEIATTNPVATEPYGSVCYNNDDQDGGDNDR

SEQ ID NO: 120207 - protein, 33 aa, Artificial Sequence
  Description of Artificial Sequence: Synthetic polypeptide
DEEEIRTTNPVAYEQWGVSWSLDNMEDRRDNNR

SEQ ID NO: 120208 - protein, 34 aa, Artificial Sequence
  Description of Artificial Sequence: Synthetic polypeptide
DEEEIRTTNPVAYEQWGSYWSTINPNQNVEGNND

SEQ ID NO: 120209 - protein, 34 aa, Artificial Sequence
  Description of Artificial Sequence: Synthetic polypeptide
DEAEIRTTNPVATEQYGSVSSTDTLDTGSSFDEN

SEQ ID NO: 120210 - protein, 35 aa, Artificial Sequence
  Description of Artificial Sequence: Synthetic polypeptide
DEEEIRTTNPVATEQYGCVCGNTENLIERFGSQQS

SEQ ID NO: 120211 - protein, 33 aa, Artificial Sequence
  Description of Artificial Sequence: Synthetic polypeptide
DECEIATTNPVATEPYGSVCYNLDHMDQGGDDR

SEQ ID NO: 120212 - protein, 35 aa, Artificial Sequence
  Description of Artificial Sequence: Synthetic polypeptide
DEEEIRTTNPVATEQYGCVCSTNDHQEYFGSDTQS

SEQ ID NO: 120213 - protein, 33 aa, Artificial Sequence
  Description of Artificial Sequence: Synthetic polypeptide
DEEEIRTTNPVAYEQWGVSVWWQQDDDQRGIRR

SEQ ID NO: 120214 - protein, 34 aa, Artificial Sequence
  Description of Artificial Sequence: Synthetic polypeptide
DEEEIRTTNPVATEQYGCVCSTMEPQENFNSEQM

SEQ ID NO: 120215 - protein, 34 aa, Artificial Sequence
  Description of Artificial Sequence: Synthetic polypeptide
DEEEIRTTNPVATEGYGSVMGTMEQDQGNGGGQG

SEQ ID NO: 120216 - protein, 35 aa, Artificial Sequence
  Description of Artificial Sequence: Synthetic polypeptide
DEEEIRTTNPVATEQYGCVCSTENHNQNFNSDTQA

SEQ ID NO: 120217 - protein, 35 aa, Artificial Sequence
  Description of Artificial Sequence: Synthetic polypeptide
DEAEIRTTNPVATEQYGSVSSTDTGLDTGSSNDSS

SEQ ID NO: 120218 - protein, 37 aa, Artificial Sequence
  Description of Artificial Sequence: Synthetic polypeptide
DEEEIRTTNPVATEAYGSVSTTQNQLNLQQGGNNNTD

SEQ ID NO: 120219 - protein, 33 aa, Artificial Sequence
  Description of Artificial Sequence: Synthetic polypeptide
DEEEIRTTNPVAYEQWGSVCSTWDHQDQDMLNE

SEQ ID NO: 120220 - protein, 34 aa, Artificial Sequence
  Description of Artificial Sequence: Synthetic polypeptide
DEEEIRTTNPVATEQYGSVSTAVWDMQNETQIDE

SEQ ID NO: 120221 - protein, 34 aa, Artificial Sequence
  Description of Artificial Sequence: Synthetic polypeptide
DEEEIRTTNPVATEGYGSVMGTNLIDEGGGGTTT

SEQ ID NO: 120222 - protein, 34 aa, Artificial Sequence
  Description of Artificial Sequence: Synthetic polypeptide
DEEEIRTTNPVATEGYGSVNTGQELGQGEGGGGQ

SEQ ID NO: 120223 - protein, 33 aa, Artificial Sequence
  Description of Artificial Sequence: Synthetic polypeptide
DEEEIRTTNPVATEQYGCVCGTPHQNFNSETQS

SEQ ID NO: 120224 - protein, 33 aa, Artificial Sequence
  Description of Artificial Sequence: Synthetic polypeptide
DEAEIRTTNPVAYEQWGVVSTNLGAGNAGEDSD

SEQ ID NO: 120225 - protein, 35 aa, Artificial Sequence
  Description of Artificial Sequence: Synthetic polypeptide
DEEEIRTTNPVATEQYGSVSTNDPDMTDLGGTQFQ

SEQ ID NO: 120226 - protein, 33 aa, Artificial Sequence
  Description of Artificial Sequence: Synthetic polypeptide
DEDEIACTNPVATEQYGSVCAANPLQEADNMRN

SEQ ID NO: 120227 - protein, 34 aa, Artificial Sequence
  Description of Artificial Sequence: Synthetic polypeptide
DEEEIRTTNPVATEQYGCVCGNTMNLIENGSDQM

SEQ ID NO: 120228 - protein, 35 aa, Artificial Sequence
  Description of Artificial Sequence: Synthetic polypeptide
DEAEIRTTNPVATEQYGSVSSFDTWLDTGSSNDEY

SEQ ID NO: 120229 - protein, 36 aa, Artificial Sequence
  Description of Artificial Sequence: Synthetic polypeptide
DEEEIRTTNPVATEQYGSVSTVTQNGNDEQGTNNTQ

SEQ ID NO: 120230 - protein, 32 aa, Artificial Sequence
  Description of Artificial Sequence: Synthetic polypeptide
DEDEIACTNPVATEQYGCVATNLQDAGDQTAQ

SEQ ID NO: 120231 - protein, 33 aa, Artificial Sequence
  Description of Artificial Sequence: Synthetic polypeptide
DEAEIRTTNPVAYEQWGSVCVTDNNDQMDGNMN

SEQ ID NO: 120232 - protein, 33 aa, Artificial Sequence
  Description of Artificial Sequence: Synthetic polypeptide
DEDEIACTNPVATEQYGCVATNLQDADGNNVNN

SEQ ID NO: 120233 - protein, 38 aa, Artificial Sequence
  Description of Artificial Sequence: Synthetic polypeptide
DEEEIRTTNPVATEQYGSVSTVVNLQAGNQQGTEEGSD

SEQ ID NO: 120234 - protein, 33 aa, Artificial Sequence
  Description of Artificial Sequence: Synthetic polypeptide
DEEEIRTTNPVAYEQWGSVAPTWNDHQERDMDQ

SEQ ID NO: 120235 - protein, 38 aa, Artificial Sequence
  Description of Artificial Sequence: Synthetic polypeptide
DEEEIRTTNPVATEQYGSVSTVVNLQAGNQAGTEQGED

SEQ ID NO: 120236 - protein, 35 aa, Artificial Sequence
  Description of Artificial Sequence: Synthetic polypeptide
DEEEIRTTNPVATEQYGCVCSMTEHQERFGSETQS

SEQ ID NO: 120237 - protein, 32 aa, Artificial Sequence
  Description of Artificial Sequence: Synthetic polypeptide
DEAVIGTTNPVATEQWGCVCSTDPLQRGSDQS

SEQ ID NO: 120238 - protein, 38 aa, Artificial Sequence
  Description of Artificial Sequence: Synthetic polypeptide
DEEEIRTTNPVATEQYGSVSTVVNGNLQQGNQDEEEED

SEQ ID NO: 120239 - protein, 37 aa, Artificial Sequence
  Description of Artificial Sequence: Synthetic polypeptide
DEEEIRTTNPVATEQYGSVSTVTQAGNNQEQGTNNQE

SEQ ID NO: 120240 - protein, 36 aa, Artificial Sequence
  Description of Artificial Sequence: Synthetic polypeptide
DEEEIRTTNPVATEQYGCVCSTENHEQENFGSDNQQ

SEQ ID NO: 120241 - protein, 33 aa, Artificial Sequence
  Description of Artificial Sequence: Synthetic polypeptide
DEEEIRTTNPVAYEQWGSYWSTINPNGQDENNN

SEQ ID NO: 120242 - protein, 35 aa, Artificial Sequence
  Description of Artificial Sequence: Synthetic polypeptide
DEEEIRTTNPVATEQYGSVSTDNDVQSFQHMEMVI

SEQ ID NO: 120243 - protein, 34 aa, Artificial Sequence
  Description of Artificial Sequence: Synthetic polypeptide
DEAEIRTTNPVATEQYGSVSTMGHDSQQEGGEEF

SEQ ID NO: 120244 - protein, 32 aa, Artificial Sequence
  Description of Artificial Sequence: Synthetic polypeptide
DEEEIRTTNPVAYEQWGSYWSTINPNMDENNP

SEQ ID NO: 120245 - protein, 33 aa, Artificial Sequence
  Description of Artificial Sequence: Synthetic polypeptide
DECEIATTNPVATENYGSVSGNNTGNAGNDGQR

SEQ ID NO: 120246 - protein, 33 aa, Artificial Sequence
  Description of Artificial Sequence: Synthetic polypeptide
DEEEIRTTNPVAYEQWGSVAWMENDQRDFDGSM

SEQ ID NO: 120247 - protein, 31 aa, Artificial Sequence
  Description of Artificial Sequence: Synthetic polypeptide
DEDEIACTNPVATEQYGCVATNLQMPMDQMD

SEQ ID NO: 120248 - protein, 34 aa, Artificial Sequence
  Description of Artificial Sequence: Synthetic polypeptide
DEEEIRTTNPVAYEQWGSYWSTINPNQDEKGNND

SEQ ID NO: 120249 - protein, 35 aa, Artificial Sequence
  Description of Artificial Sequence: Synthetic polypeptide
DEEEIRTTNPVATEAWGCVPSCTGDNLQEHEGGNP

SEQ ID NO: 120250 - protein, 32 aa, Artificial Sequence
  Description of Artificial Sequence: Synthetic polypeptide
DEAVIGTTNPVATEQWGCVCSTEGLQYFGSNQ

SEQ ID NO: 120251 - protein, 36 aa, Artificial Sequence
  Description of Artificial Sequence: Synthetic polypeptide
DEEEIRTTNPVATEQYGSVSTVTNQQGTNVTEEEET

SEQ ID NO: 120252 - protein, 35 aa, Artificial Sequence
  Description of Artificial Sequence: Synthetic polypeptide
DEEEIRTTNPVATEGYGSVSDVDNGQQTGEGEGNQ

SEQ ID NO: 120253 - protein, 33 aa, Artificial Sequence
  Description of Artificial Sequence: Synthetic polypeptide
DEEEIRTTNPVAYEQWGSYWSTINPNQDENDNG

SEQ ID NO: 120254 - protein, 31 aa, Artificial Sequence
  Description of Artificial Sequence: Synthetic polypeptide
DEDAEIATTNPVAYEPYGSVSAANDDRHNES

SEQ ID NO: 120255 - protein, 33 aa, Artificial Sequence
  Description of Artificial Sequence: Synthetic polypeptide
DECEIATTNPVATEPYGSVCYNNDDQDGRNDRQ

SEQ ID NO: 120256 - protein, 37 aa, Artificial Sequence
  Description of Artificial Sequence: Synthetic polypeptide
DEEEIRTTNPVATEQYGSVSTVTNTQAGNQQGTNADE

SEQ ID NO: 120257 - protein, 36 aa, Artificial Sequence
  Description of Artificial Sequence: Synthetic polypeptide
DEEEIRTTNPVATEAYGVVSTTNNQLQLQQGTTNTE

SEQ ID NO: 120258 - protein, 34 aa, Artificial Sequence
  Description of Artificial Sequence: Synthetic polypeptide
DEEEIRTTNPVATEQYGCVCGNTGNLIESGSDQS

SEQ ID NO: 120259 - protein, 35 aa, Artificial Sequence
  Description of Artificial Sequence: Synthetic polypeptide
DEEEIRTTNPVAYEQWGSCVYSDTWGDGQRSQNER

SEQ ID NO: 120260 - protein, 34 aa, Artificial Sequence
  Description of Artificial Sequence: Synthetic polypeptide
DEEEIRTTNPVAYEQYGQVCACTNAISQNKGSPR

SEQ ID NO: 120261 - protein, 34 aa, Artificial Sequence
  Description of Artificial Sequence: Synthetic polypeptide
DEEEIRTTNPVATDQYGDVVTGIQNDGQGGNQEP

SEQ ID NO: 120262 - protein, 33 aa, Artificial Sequence
  Description of Artificial Sequence: Synthetic polypeptide
DEEEIRTTNPVAYEQWGSVAWTEQLQGVDDMGR

SEQ ID NO: 120263 - protein, 37 aa, Artificial Sequence
  Description of Artificial Sequence: Synthetic polypeptide
DEEEIRTTNPVATEQYGSVSTVTNQQANNQQGTNNQE

SEQ ID NO: 120264 - protein, 33 aa, Artificial Sequence
  Description of Artificial Sequence: Synthetic polypeptide
DEDEIRTTNPVATEAWGSVSAINEGQQDEGENG

SEQ ID NO: 120265 - protein, 33 aa, Artificial Sequence
  Description of Artificial Sequence: Synthetic polypeptide
DEDEIACTNPVATEQYGCVATNLQEAPGGNGVE

SEQ ID NO: 120266 - protein, 32 aa, Artificial Sequence
  Description of Artificial Sequence: Synthetic polypeptide
DEEEIRTTNPVAYEQWGTYYYTDLLDRGQNSG

SEQ ID NO: 120267 - protein, 31 aa, Artificial Sequence
  Description of Artificial Sequence: Synthetic polypeptide
DEDEIACTNPVATEQYGCVATNLQMHPEEAH

SEQ ID NO: 120268 - protein, 34 aa, Artificial Sequence
  Description of Artificial Sequence: Synthetic polypeptide
DECEIATTNPVATENYGSVSGTNQGNAGNDNQRN

SEQ ID NO: 120269 - protein, 33 aa, Artificial Sequence
  Description of Artificial Sequence: Synthetic polypeptide
DEEEIRTTNPVAYEQWGSSYSDGWGDGQRSQNR

SEQ ID NO: 120270 - protein, 32 aa, Artificial Sequence
  Description of Artificial Sequence: Synthetic polypeptide
DEDEIACTNPVATEQYGCVATNLQGEMNPTDD

SEQ ID NO: 120271 - protein, 35 aa, Artificial Sequence
  Description of Artificial Sequence: Synthetic polypeptide
DEEEIRTTNPVAYEQWGSCVYSDTWNDGQRSQNDT

SEQ ID NO: 120272 - protein, 33 aa, Artificial Sequence
  Description of Artificial Sequence: Synthetic polypeptide
DEEEIRTTNPVAYEQWGTYVYTDQLLDRGNGSN

SEQ ID NO: 120273 - protein, 35 aa, Artificial Sequence
  Description of Artificial Sequence: Synthetic polypeptide
DEEEIRTTNPVATEQYGCVCSTENHQEYFNSDNQV

SEQ ID NO: 120274 - protein, 33 aa, Artificial Sequence
  Description of Artificial Sequence: Synthetic polypeptide
DEEEIRTTNPVAYEQWGSVAWTEQLQQVDDSGR

SEQ ID NO: 120275 - protein, 31 aa, Artificial Sequence
  Description of Artificial Sequence: Synthetic polypeptide
DEDEIACTNPVATEQYGSCATNLQAEDDTDV

SEQ ID NO: 120276 - protein, 32 aa, Artificial Sequence
  Description of Artificial Sequence: Synthetic polypeptide
DECTICTTNPVATEQYGVVTTNPQQGGNNQAN

SEQ ID NO: 120277 - protein, 33 aa, Artificial Sequence
  Description of Artificial Sequence: Synthetic polypeptide
DEEEIRTTNPVATEGYGCVCSTEEHQGFGSDQV

SEQ ID NO: 120278 - protein, 35 aa, Artificial Sequence
  Description of Artificial Sequence: Synthetic polypeptide
DEAEIRTTNPVATEQYGSVSSTDTGLDPGSSNDEM

SEQ ID NO: 120279 - protein, 33 aa, Artificial Sequence
  Description of Artificial Sequence: Synthetic polypeptide
DEEEIRTTNPVATEQYGCVCGTGEHQNFGSDQT

SEQ ID NO: 120280 - protein, 34 aa, Artificial Sequence
  Description of Artificial Sequence: Synthetic polypeptide
DEEEIRTTNPVATEGYGCVCSTEEHQFFGSNTQY

SEQ ID NO: 120281 - protein, 33 aa, Artificial Sequence
  Description of Artificial Sequence: Synthetic polypeptide
DEEEIRTTNPVATEGYGCVCSTEEHNQNFGSEQ

SEQ ID NO: 120282 - protein, 34 aa, Artificial Sequence
  Description of Artificial Sequence: Synthetic polypeptide
DEEEIRTTNPVAYEQYGCSTVNYTFELSGRGTYS

SEQ ID NO: 120283 - protein, 31 aa, Artificial Sequence
  Description of Artificial Sequence: Synthetic polypeptide
DEDEIACTNPVATEQYGSVATIHQAEPPGEN

SEQ ID NO: 120284 - protein, 33 aa, Artificial Sequence
  Description of Artificial Sequence: Synthetic polypeptide
DEDEIACTNPVATEQYGCVATNLQEAMDGDTNY

SEQ ID NO: 120285 - protein, 37 aa, Artificial Sequence
  Description of Artificial Sequence: Synthetic polypeptide
DEEEIRTTNPVATEQYGSVSTVTQNGNQQEIGTNNDE

SEQ ID NO: 120286 - protein, 35 aa, Artificial Sequence
  Description of Artificial Sequence: Synthetic polypeptide
DEEEIRTTNPVATEQYGCVCSMTEHNENFGSNTQS

SEQ ID NO: 120287 - protein, 31 aa, Artificial Sequence
  Description of Artificial Sequence: Synthetic polypeptide
DEAVIATTNPVAYEQWGTCSTWDFMQRGDNR

SEQ ID NO: 120288 - protein, 33 aa, Artificial Sequence
  Description of Artificial Sequence: Synthetic polypeptide
DEDEIRTTNPVATEAWGSVSAINEGQGGEDENG

SEQ ID NO: 120289 - protein, 31 aa, Artificial Sequence
  Description of Artificial Sequence: Synthetic polypeptide
DEDEIACTNPVATEQYGSVATPAIQDMPGDE

SEQ ID NO: 120290 - protein, 33 aa, Artificial Sequence
  Description of Artificial Sequence: Synthetic polypeptide
DEDEIACTNPVATEQYGSVATNLQGAPGPEGAV

SEQ ID NO: 120291 - protein, 33 aa, Artificial Sequence
  Description of Artificial Sequence: Synthetic polypeptide
DEDEIACTNPVATEQYGCVATNLQEADGNTDNF

SEQ ID NO: 120292 - protein, 34 aa, Artificial Sequence
  Description of Artificial Sequence: Synthetic polypeptide
DEAEIRTTNPVATEQYGSVSSQINLTFPRNMITD

SEQ ID NO: 120293 - protein, 33 aa, Artificial Sequence
  Description of Artificial Sequence: Synthetic polypeptide
DEDEIACTNPVATEQYGSVATNLQDGPGGEGAE

SEQ ID NO: 120294 - protein, 35 aa, Artificial Sequence
  Description of Artificial Sequence: Synthetic polypeptide
DEAEIRTTNPVATEQYGSVSPWINLETRNGQEDEN

SEQ ID NO: 120295 - protein, 34 aa, Artificial Sequence
  Description of Artificial Sequence: Synthetic polypeptide
DEEEIRTTNPVAYEQYGCIAVCTNLSGKGGDSRY

SEQ ID NO: 120296 - protein, 36 aa, Artificial Sequence
  Description of Artificial Sequence: Synthetic polypeptide
DEEEIRTTNPVATEAYGVVSTTNNNLQQGSNEEGSE

SEQ ID NO: 120297 - protein, 36 aa, Artificial Sequence
  Description of Artificial Sequence: Synthetic polypeptide
DEEEIRTTNPVATEAYGSVSTTNNGQQGNNQEDEVD

SEQ ID NO: 120298 - protein, 34 aa, Artificial Sequence
  Description of Artificial Sequence: Synthetic polypeptide
DEEEIRTTNPVAYEQWGSCVYSDELNDGQRQQNP

SEQ ID NO: 120299 - protein, 33 aa, Artificial Sequence
  Description of Artificial Sequence: Synthetic polypeptide
DEAEIRTTNPVAYEQWGSVCVTELQQGQGGNAN

SEQ ID NO: 120300 - protein, 32 aa, Artificial Sequence
  Description of Artificial Sequence: Synthetic polypeptide
DECTICTTNPVATEQYGVVVTTNPNQQGNGNA

SEQ ID NO: 120301 - protein, 34 aa, Artificial Sequence
  Description of Artificial Sequence: Synthetic polypeptide
DEEEIRTTNPVAYEQWGSCVYSDEWNDGQRSNNN

SEQ ID NO: 120302 - protein, 34 aa, Artificial Sequence
  Description of Artificial Sequence: Synthetic polypeptide
DEAEIRTTNPVATEQYGSVSSQINSLFPENMIDV

SEQ ID NO: 120303 - protein, 34 aa, Artificial Sequence
  Description of Artificial Sequence: Synthetic polypeptide
DEEEIRTTNPVATEQYGCVCSTELQENFISDTQG

SEQ ID NO: 120304 - protein, 32 aa, Artificial Sequence
  Description of Artificial Sequence: Synthetic polypeptide
DECTICTTNPVATEQYGVVVTNPQQGNGNNTD

SEQ ID NO: 120305 - protein, 35 aa, Artificial Sequence
  Description of Artificial Sequence: Synthetic polypeptide
DEAVIRTTNPVATEQYGCCVACTNEPSQRNGGNRA

SEQ ID NO: 120306 - protein, 35 aa, Artificial Sequence
  Description of Artificial Sequence: Synthetic polypeptide
DEEEIRTTNPVATEGYGSVNSVTMNIGEGEQGNDT

SEQ ID NO: 120307 - protein, 35 aa, Artificial Sequence
  Description of Artificial Sequence: Synthetic polypeptide
DEEEIRTTNPVATEQYGCVCSTMNHQEFFNSNNQE

SEQ ID NO: 120308 - protein, 35 aa, Artificial Sequence
  Description of Artificial Sequence: Synthetic polypeptide
DEEEIRTTNPVATEGYGSVMGTNLISNGGGGNNTT

SEQ ID NO: 120309 - protein, 33 aa, Artificial Sequence
  Description of Artificial Sequence: Synthetic polypeptide
DEEEIRTTNPVATEQYGCVCSMTEHANFGSQQP

SEQ ID NO: 120310 - protein, 33 aa, Artificial Sequence
  Description of Artificial Sequence: Synthetic polypeptide
DEEEIRTTNPVAYEQWGSVCNTFNREGTGGTDR

SEQ ID NO: 120311 - protein, 32 aa, Artificial Sequence
  Description of Artificial Sequence: Synthetic polypeptide
DEAVIRTTNPVATEQYGCVCETENPQYGSDQA

SEQ ID NO: 120312 - protein, 33 aa, Artificial Sequence
  Description of Artificial Sequence: Synthetic polypeptide
DEEEIRTTNPVATEGYGCVCSTEEHINFGSNQS

SEQ ID NO: 120313 - protein, 35 aa, Artificial Sequence
  Description of Artificial Sequence: Synthetic polypeptide
DEEEIRTTNPVATEGYGCVCSNTGELQNFGSENQG

SEQ ID NO: 120314 - protein, 32 aa, Artificial Sequence
  Description of Artificial Sequence: Synthetic polypeptide
DEDEIACTNPVATEQYGCVATNLQAEDINANE

SEQ ID NO: 120315 - protein, 37 aa, Artificial Sequence
  Description of Artificial Sequence: Synthetic polypeptide
DEEEIRTTNPVATEAYGSVSTTNNLGQQGNNQEDEED

SEQ ID NO: 120316 - protein, 33 aa, Artificial Sequence
  Description of Artificial Sequence: Synthetic polypeptide
DEDEIACTNPVATEQYGCVATNLTQENNITERP

SEQ ID NO: 120317 - protein, 32 aa, Artificial Sequence
  Description of Artificial Sequence: Synthetic polypeptide
DEAVIRCTNPVATEQYGSVSPNLEFPNYSQNG

SEQ ID NO: 120318 - protein, 36 aa, Artificial Sequence
  Description of Artificial Sequence: Synthetic polypeptide
DEEEIRTTNPVATDQYGSVSSTTPAGQNMRNGMNPV

SEQ ID NO: 120319 - protein, 33 aa, Artificial Sequence
  Description of Artificial Sequence: Synthetic polypeptide
DEEEIRTTNPVATEGYGSVSNNDEMQNETFTGG

SEQ ID NO: 120320 - protein, 36 aa, Artificial Sequence
  Description of Artificial Sequence: Synthetic polypeptide
DEEEIRTTNPVATEAYGSVSTSNNGQQGTNQEDEED

SEQ ID NO: 120321 - protein, 37 aa, Artificial Sequence
  Description of Artificial Sequence: Synthetic polypeptide
DEEEIRTTNPVATEQYGSVSTVTNQQQGNNQEEETEQ

SEQ ID NO: 120322 - protein, 37 aa, Artificial Sequence
  Description of Artificial Sequence: Synthetic polypeptide
DEEEIRTTNPVATEQYGSVSTVTNQQQGNNNEEDTED

SEQ ID NO: 120323 - protein, 36 aa, Artificial Sequence
  Description of Artificial Sequence: Synthetic polypeptide
DEEEIRTTNPVATEAYGSVSTTNNLNLLQGNNNNTD

SEQ ID NO: 120324 - protein, 38 aa, Artificial Sequence
  Description of Artificial Sequence: Synthetic polypeptide
DEEEIRTTNPVATEQYGSVSTVVNLQEGNQAGTTNVET

SEQ ID NO: 120325 - protein, 33 aa, Artificial Sequence
  Description of Artificial Sequence: Synthetic polypeptide
DEAEIVTTNPVATEQYGTVCSATDGPVLFEGND

SEQ ID NO: 120326 - protein, 38 aa, Artificial Sequence
  Description of Artificial Sequence: Synthetic polypeptide
DEEEIRTTNPVATEQYGSVSTVVNLQQGNNQQGTTEQG

SEQ ID NO: 120327 - protein, 34 aa, Artificial Sequence
  Description of Artificial Sequence: Synthetic polypeptide
DEEEIRTTNPVATEQYGCVCSMTEEDQNFGSDQP

SEQ ID NO: 120328 - protein, 34 aa, Artificial Sequence
  Description of Artificial Sequence: Synthetic polypeptide
DEEEIRTTNPVATEQYGCVCNTGNLIEGFGSEQA

SEQ ID NO: 120329 - protein, 32 aa, Artificial Sequence
  Description of Artificial Sequence: Synthetic polypeptide
DECEIATTNPVATENWGSVSGGNPAGLNDGQR

SEQ ID NO: 120330 - protein, 35 aa, Artificial Sequence
  Description of Artificial Sequence: Synthetic polypeptide
DEEEIRTTNPVATEPYGETVPFHNMLSQRGGNYSM

SEQ ID NO: 120331 - protein, 32 aa, Artificial Sequence
  Description of Artificial Sequence: Synthetic polypeptide
DEDEIACTNPVATEQYGCVATNLQPASDNSDM

SEQ ID NO: 120332 - protein, 31 aa, Artificial Sequence
  Description of Artificial Sequence: Synthetic polypeptide
DEDEIACTNPVATEQYGCVATNLQPDQHTDD

SEQ ID NO: 120333 - protein, 36 aa, Artificial Sequence
  Description of Artificial Sequence: Synthetic polypeptide
DEEEIRTTNPVATEAYGVVSTTNNNLQLQQGTNQTE

SEQ ID NO: 120334 - protein, 34 aa, Artificial Sequence
  Description of Artificial Sequence: Synthetic polypeptide
DEEEIRTTNPVATDQYGSVMGMVNGQEDGIGNIE

SEQ ID NO: 120335 - protein, 35 aa, Artificial Sequence
  Description of Artificial Sequence: Synthetic polypeptide
DEEEIRTTNPVATEQYGCVCSTNDHNQENFGSEQS

SEQ ID NO: 120336 - protein, 33 aa, Artificial Sequence
  Description of Artificial Sequence: Synthetic polypeptide
DECEIATTNPVATENYGEVSGGNPQNAGNDNQR

SEQ ID NO: 120337 - protein, 32 aa, Artificial Sequence
  Description of Artificial Sequence: Synthetic polypeptide
DEDEIACTNPVATEQYGCVATNLQSNDNHNTE

SEQ ID NO: 120338 - protein, 37 aa, Artificial Sequence
  Description of Artificial Sequence: Synthetic polypeptide
DEEEIRTTNPVATEQYGSVSTVVNNLGNNQNDEQGSE

SEQ ID NO: 120339 - protein, 34 aa, Artificial Sequence
  Description of Artificial Sequence: Synthetic polypeptide
DEEEIRTTNPVATEGYGSVSNNDEMQNLEFNQGG

SEQ ID NO: 120340 - protein, 34 aa, Artificial Sequence
  Description of Artificial Sequence: Synthetic polypeptide
DEEEIRTTNPVATEQYGCVCSMTEHQNFTSNTQA

SEQ ID NO: 120341 - protein, 34 aa, Artificial Sequence
  Description of Artificial Sequence: Synthetic polypeptide
DEAEIRTTNPVATEQYGSVSPTWQGIETEGTNPM

SEQ ID NO: 120342 - protein, 38 aa, Artificial Sequence
  Description of Artificial Sequence: Synthetic polypeptide
DEEEIRTTNPVATEQYGSVSTVVNLQQGNNEQGTTEES

SEQ ID NO: 120343 - protein, 38 aa, Artificial Sequence
  Description of Artificial Sequence: Synthetic polypeptide
DEEEIRTTNPVATEQYGSVSTVVNLQAGTEQGTEETND

SEQ ID NO: 120344 - protein, 32 aa, Artificial Sequence
  Description of Artificial Sequence: Synthetic polypeptide
DEAEIRTTNPVATEQYGSVSSLDYAEEPQEDR

SEQ ID NO: 120345 - protein, 38 aa, Artificial Sequence
  Description of Artificial Sequence: Synthetic polypeptide
DEEEIRTTNPVATEQYGSVSTVVNNLNGNQEIGNNEGD

SEQ ID NO: 120346 - protein, 35 aa, Artificial Sequence
  Description of Artificial Sequence: Synthetic polypeptide
DEEEIRTTNPVATEGYGSVSSTTAGPNMRNGMNPV

SEQ ID NO: 120347 - protein, 33 aa, Artificial Sequence
  Description of Artificial Sequence: Synthetic polypeptide
DEDEIRTTNPVATEAWGSVSAGNEGQSGEGENG

SEQ ID NO: 120348 - protein, 32 aa, Artificial Sequence
  Description of Artificial Sequence: Synthetic polypeptide
DEDEIACTNPVATEQYGCVATNLQVADINDEQ

SEQ ID NO: 120349 - protein, 37 aa, Artificial Sequence
  Description of Artificial Sequence: Synthetic polypeptide
DEEEIRTTNPVATEAYGSVSTTNNLQQGNNNEDEEDA

SEQ ID NO: 120350 - protein, 37 aa, Artificial Sequence
  Description of Artificial Sequence: Synthetic polypeptide
DEEEIRTTNPVATEQYGSVSTVTNQQQNNQQGTNVDE

SEQ ID NO: 120351 - protein, 33 aa, Artificial Sequence
  Description of Artificial Sequence: Synthetic polypeptide
DEDEIRTTNPVATEAWGSVSNINEPQDNEGENG

SEQ ID NO: 120352 - protein, 35 aa, Artificial Sequence
  Description of Artificial Sequence: Synthetic polypeptide
DEEEIRTTNPVATEQYGCVCSMTEHQANFGSNTQS

SEQ ID NO: 120353 - protein, 32 aa, Artificial Sequence
  Description of Artificial Sequence: Synthetic polypeptide
DEDEIACTNPVATEQYGCVATNLQAPDENDNE

SEQ ID NO: 120354 - protein, 33 aa, Artificial Sequence
  Description of Artificial Sequence: Synthetic polypeptide
DEAEIRTTNPVAYEQWGVVSGDNGNHQNGAGNR

SEQ ID NO: 120355 - protein, 31 aa, Artificial Sequence
  Description of Artificial Sequence: Synthetic polypeptide
DEAVIRTTNPVATEQYGCVCETEPQYGSQQG

SEQ ID NO: 120356 - protein, 36 aa, Artificial Sequence
  Description of Artificial Sequence: Synthetic polypeptide
DEAEIRTTNPVATEQYGSVSSTTPQGPNMRNGNNPV

SEQ ID NO: 120357 - protein, 37 aa, Artificial Sequence
  Description of Artificial Sequence: Synthetic polypeptide
DEEEIRTTNPVATEAYGSVSTTNLQQGNQQGTNEENE

SEQ ID NO: 120358 - protein, 35 aa, Artificial Sequence
  Description of Artificial Sequence: Synthetic polypeptide
DEEEIRTTNPVATEQYGSVSTAVNDMQQNETQTDE

SEQ ID NO: 120359 - protein, 38 aa, Artificial Sequence
  Description of Artificial Sequence: Synthetic polypeptide
DEEEIRTTNPVATEQYGSVSTVVNLQQGNNQQGTEENS

SEQ ID NO: 120360 - protein, 34 aa, Artificial Sequence
  Description of Artificial Sequence: Synthetic polypeptide
DEEEIRTTNPVATEQYGSYLPTMNQGINGELSVQ

SEQ ID NO: 120361 - protein, 30 aa, Artificial Sequence
  Description of Artificial Sequence: Synthetic polypeptide
DENEIATTNPVATEQWGDVSEGEANQAEDA

SEQ ID NO: 120362 - protein, 36 aa, Artificial Sequence
  Description of Artificial Sequence: Synthetic polypeptide
AEEEIRTTNPVATEQYGSVVVVVTQGGNNQLGGNDD

SEQ ID NO: 120363 - protein, 33 aa, Artificial Sequence
  Description of Artificial Sequence: Synthetic polypeptide
DENEIRTTNPVATEAWGVVSVVNNNQQGEGENG

SEQ ID NO: 120364 - protein, 31 aa, Artificial Sequence
  Description of Artificial Sequence: Synthetic polypeptide
DENEIATTNPVATEQWGDVSEGEMNAAEDNK

SEQ ID NO: 120365 - protein, 33 aa, Artificial Sequence
  Description of Artificial Sequence: Synthetic polypeptide
ENEEIATTNPVAYEQWGVVCSTNLIGDHGQNQR

SEQ ID NO: 120366 - protein, 33 aa, Artificial Sequence
  Description of Artificial Sequence: Synthetic polypeptide
DESEIRTTNPVASECWGSASCINEPQDREGENG

SEQ ID NO: 120367 - protein, 31 aa, Artificial Sequence
  Description of Artificial Sequence: Synthetic polypeptide
NEEEIATTNPVAYEQWGSLSCFEHDDRQGER

SEQ ID NO: 120368 - protein, 36 aa, Artificial Sequence
  Description of Artificial Sequence: Synthetic polypeptide
DECEICTTNPVATEQYGVVSTVTNLQQGNNNEQNDE

SEQ ID NO: 120369 - protein, 31 aa, Artificial Sequence
  Description of Artificial Sequence: Synthetic polypeptide
DENEIATTNPVATEQWGDVSEGEMNAAEGRA

SEQ ID NO: 120370 - protein, 28 aa, Artificial Sequence
  Description of Artificial Sequence: Synthetic peptide
DENEIAPTNPVATEQWGDVSEIEMAETA

SEQ ID NO: 120371 - protein, 28 aa, Artificial Sequence
  Description of Artificial Sequence: Synthetic peptide
DENEIAPTNPVATEQWGDVSCIEMAETA

SEQ ID NO: 120372 - protein, 34 aa, Artificial Sequence
  Description of Artificial Sequence: Synthetic polypeptide
DEAEIRTTNPVATECWGSVWCINEPQVRDGENFE

SEQ ID NO: 120373 - protein, 34 aa, Artificial Sequence
  Description of Artificial Sequence: Synthetic polypeptide
CEEQIRTTNPVGYERYGEKVSTNAPSQRGGDNRR

SEQ ID NO: 120374 - protein, 32 aa, Artificial Sequence
  Description of Artificial Sequence: Synthetic polypeptide
NEMEIRTTNPVATEQYGSVSVPDMQHSSQVDG

SEQ ID NO: 120375 - protein, 30 aa, Artificial Sequence
  Description of Artificial Sequence: Synthetic polypeptide
DENEIATTNPVATEQWGDMSEILQNHAEDA

SEQ ID NO: 120376 - protein, 34 aa, Artificial Sequence
  Description of Artificial Sequence: Synthetic polypeptide
CEEPIRTTNPVGYERYGQSVWTNAVSQRGGDNRM

SEQ ID NO: 120377 - protein, 29 aa, Artificial Sequence
  Description of Artificial Sequence: Synthetic peptide
DENEIATTNPVATEQWGDVSECEMAAEDA

SEQ ID NO: 120378 - protein, 35 aa, Artificial Sequence
  Description of Artificial Sequence: Synthetic polypeptide
DEEEIRTTNPVATEQYGSVYTMFTETEVQESENIL

SEQ ID NO: 120379 - protein, 30 aa, Artificial Sequence
  Description of Artificial Sequence: Synthetic polypeptide
DENEIATTNPVATEQWGDVSECEQNAAEDL

SEQ ID NO: 120380 - protein, 36 aa, Artificial Sequence
  Description of Artificial Sequence: Synthetic polypeptide
DEEEIRTTNPVATEQYGSVQEVITTDQITELQANNT

SEQ ID NO: 120381 - protein, 32 aa, Artificial Sequence
  Description of Artificial Sequence: Synthetic polypeptide
DEDEIACTNPVATEQYGCVATNSLFQVDDSEF

SEQ ID NO: 120382 - protein, 34 aa, Artificial Sequence
  Description of Artificial Sequence: Synthetic polypeptide
FEEEIRTTNPVATEQYGSVNQGNNMDETGGNGDD

SEQ ID NO: 120383 - protein, 33 aa, Artificial Sequence
  Description of Artificial Sequence: Synthetic polypeptide
DEEEIRTTNPVATEQYGSYQANGNEQATQLVLN

SEQ ID NO: 120384 - protein, 33 aa, Artificial Sequence
  Description of Artificial Sequence: Synthetic polypeptide
FEEEIRTTNPVATEQYGSVNSIDNGNENIQDQQ

SEQ ID NO: 120385 - protein, 30 aa, Artificial Sequence
  Description of Artificial Sequence: Synthetic polypeptide
DENEIATTNPVATEQWGDVSEDEENHAGDA

SEQ ID NO: 120386 - protein, 33 aa, Artificial Sequence
  Description of Artificial Sequence: Synthetic polypeptide
CENEIRTTNPVATEQYGSISLTFNETIRETLQG

SEQ ID NO: 120387 - protein, 30 aa, Artificial Sequence
  Description of Artificial Sequence: Synthetic polypeptide
DENEIATTNPVATEQWGDMSEILQNAAEDA

SEQ ID NO: 120388 - protein, 30 aa, Artificial Sequence
  Description of Artificial Sequence: Synthetic polypeptide
DENEIATTNPVATEQWGDVSEDEENHAGEA

SEQ ID NO: 120389 - protein, 33 aa, Artificial Sequence
  Description of Artificial Sequence: Synthetic polypeptide
ENEEISTTNPVATTQWGSVSKTDNPMERGGGKR

SEQ ID NO: 120390 - protein, 36 aa, Artificial Sequence
  Description of Artificial Sequence: Synthetic polypeptide
FEEEIRTTNPVATEQYGSVNTDEGNNDPEERGNIGN

SEQ ID NO: 120391 - protein, 34 aa, Artificial Sequence
  Description of Artificial Sequence: Synthetic polypeptide
DEQEIATTNPVAYEQWGSVSTGIGLNAGEDNNRD

SEQ ID NO: 120392 - protein, 31 aa, Artificial Sequence
  Description of Artificial Sequence: Synthetic polypeptide
NEGEIRTTNPVATGHYGSVSDVLNETEGTDM

SEQ ID NO: 120393 - protein, 34 aa, Artificial Sequence
  Description of Artificial Sequence: Synthetic polypeptide
DESEIRTCNPVATECWGGSVSCINEPQDREGENG

SEQ ID NO: 120394 - protein, 29 aa, Artificial Sequence
  Description of Artificial Sequence: Synthetic peptide
DENEIATTNPVATEQWGDVSEIEMAAEDL

SEQ ID NO: 120395 - protein, 33 aa, Artificial Sequence
  Description of Artificial Sequence: Synthetic polypeptide
DESEIRTTNPVATECWGSVGCINEPQDRETENG

SEQ ID NO: 120396 - protein, 34 aa, Artificial Sequence
  Description of Artificial Sequence: Synthetic polypeptide
DENEIRTTNPVATEAWGSVSNNNNNNQNDEGENG

SEQ ID NO: 120397 - protein, 30 aa, Artificial Sequence
  Description of Artificial Sequence: Synthetic polypeptide
DESEIRSTNPVSTEQWGNVSNTEMSAAEDR

SEQ ID NO: 120398 - protein, 33 aa, Artificial Sequence
  Description of Artificial Sequence: Synthetic polypeptide
NEMEIRTTNPVATEQYGSVWDHNLDEFMSSQRP

SEQ ID NO: 120399 - protein, 32 aa, Artificial Sequence
  Description of Artificial Sequence: Synthetic polypeptide
DENEIRTTNPVATEIYGCVCSWNHQNFISDQM

SEQ ID NO: 120400 - protein, 32 aa, Artificial Sequence
  Description of Artificial Sequence: Synthetic polypeptide
DENEIATTNPVATEPYGTISTEDIQQQQNGNH

SEQ ID NO: 120401 - protein, 35 aa, Artificial Sequence
  Description of Artificial Sequence: Synthetic polypeptide
DEEEIRTTNPVATEQYGSYSITETLQIQPDELVEE

SEQ ID NO: 120402 - protein, 34 aa, Artificial Sequence
  Description of Artificial Sequence: Synthetic polypeptide
DEEEIRTTNPVATEQYGSVQGTMVAEQVDEILVE

SEQ ID NO: 120403 - protein, 34 aa, Artificial Sequence
  Description of Artificial Sequence: Synthetic polypeptide
ENEEISTTNPVATTQWGSVSKTDNQPMERGENDR

SEQ ID NO: 120404 - protein, 33 aa, Artificial Sequence
  Description of Artificial Sequence: Synthetic polypeptide
NEMEIRTTNPVATEQYGSVWAPNLDEFMSSQRM

SEQ ID NO: 120405 - protein, 37 aa, Artificial Sequence
  Description of Artificial Sequence: Synthetic polypeptide
AEEEIRTTNPVATEQYGSVVVVVTTNNLQAGDENGEQ

SEQ ID NO: 120406 - protein, 30 aa, Artificial Sequence
  Description of Artificial Sequence: Synthetic polypeptide
DENEIATTNPVATEQWGDVSEIEMNAAEDR

SEQ ID NO: 120407 - protein, 34 aa, Artificial Sequence
  Description of Artificial Sequence: Synthetic polypeptide
ENEEISTTNPVATTQWGSVSKTDNQPNMERGNHR

SEQ ID NO: 120408 - protein, 32 aa, Artificial Sequence
  Description of Artificial Sequence: Synthetic polypeptide
ENEEIATTNPVAYEQWGVCSTNLQGDHGNNDS

SEQ ID NO: 120409 - protein, 32 aa, Artificial Sequence
  Description of Artificial Sequence: Synthetic polypeptide
DENEIATTNPVATEPYGTISMEVIQQQQNGNK

SEQ ID NO: 120410 - protein, 35 aa, Artificial Sequence
  Description of Artificial Sequence: Synthetic polypeptide
DEEEIRTTNPVATEQYGSVSEQNNDGMTIGVAEPQ

SEQ ID NO: 120411 - protein, 33 aa, Artificial Sequence
  Description of Artificial Sequence: Synthetic polypeptide
DEEEIRTTNPVATEQYGSVPPTAMETVAMPEFD

SEQ ID NO: 120412 - protein, 33 aa, Artificial Sequence
  Description of Artificial Sequence: Synthetic polypeptide
DEDEIACTNPVATEQYGSCATGNTNRDGMENQM

SEQ ID NO: 120413 - protein, 34 aa, Artificial Sequence
  Description of Artificial Sequence: Synthetic polypeptide
FEEEIRTTNPVATEQYGSVQTTMDHGENGVPMVL

SEQ ID NO: 120414 - protein, 34 aa, Artificial Sequence
  Description of Artificial Sequence: Synthetic polypeptide
FEEEIRTTNPVATEQYGSVMSGMFEDEGNEGEGF

SEQ ID NO: 120415 - protein, 32 aa, Artificial Sequence
  Description of Artificial Sequence: Synthetic polypeptide
DENEIATTNPVATEPYGTISMENIQQQRNGGH

SEQ ID NO: 120416 - protein, 37 aa, Artificial Sequence
  Description of Artificial Sequence: Synthetic polypeptide
AEEEIRTTNPVATEQYGSVVVTVTNNGNLQQGTENIG

SEQ ID NO: 120417 - protein, 37 aa, Artificial Sequence
  Description of Artificial Sequence: Synthetic polypeptide
AEEEIRTTNPVATEQYGSVVVVVTQGGNLQAGTTNMD

SEQ ID NO: 120418 - protein, 29 aa, Artificial Sequence
  Description of Artificial Sequence: Synthetic peptide
DENEIATTNPVATEQWGDVSEIEMAAEDA

SEQ ID NO: 120419 - protein, 29 aa, Artificial Sequence
  Description of Artificial Sequence: Synthetic peptide
DENEIASTNPVATEGWGVVSSTEMAAGDA

SEQ ID NO: 120420 - protein, 35 aa, Artificial Sequence
  Description of Artificial Sequence: Synthetic polypeptide
DEEEIRTTNPVATEQYGSYHYTNDPYGVEPEEFND

SEQ ID NO: 120421 - protein, 32 aa, Artificial Sequence
  Description of Artificial Sequence: Synthetic polypeptide
DEQEIATTNPVAYEQWGSVSATDLEDHEGEDL

SEQ ID NO: 120422 - protein, 35 aa, Artificial Sequence
  Description of Artificial Sequence: Synthetic polypeptide
FEEEIRTTNPVATEQYGSVMTEMNFEGGGEGGENT

SEQ ID NO: 120423 - protein, 33 aa, Artificial Sequence
  Description of Artificial Sequence: Synthetic polypeptide
DESEIRTTNPVATECWGSVHFINEPQDREGEQG

SEQ ID NO: 120424 - protein, 31 aa, Artificial Sequence
  Description of Artificial Sequence: Synthetic polypeptide
DENEIRTTNPVATEAWGTVSEIEMNAAEGDA

SEQ ID NO: 120425 - protein, 28 aa, Artificial Sequence
  Description of Artificial Sequence: Synthetic peptide
NEEEIATTNPVATTQYGEAPEVCQHEEK

SEQ ID NO: 120426 - protein, 36 aa, Artificial Sequence
  Description of Artificial Sequence: Synthetic polypeptide
AEEEIRTTNPVATEQYGSVVVVVTNQNQDQGNNEGG

SEQ ID NO: 120427 - protein, 34 aa, Artificial Sequence
  Description of Artificial Sequence: Synthetic polypeptide
DESEIRTTNPVANECWGSVSCINMEPQDREGENG

SEQ ID NO: 120428 - protein, 34 aa, Artificial Sequence
  Description of Artificial Sequence: Synthetic polypeptide
DESEIRTTNPVATECWGSVGSCINEPQCREQENG

SEQ ID NO: 120429 - protein, 37 aa, Artificial Sequence
  Description of Artificial Sequence: Synthetic polypeptide
AEEEIRTTNPVATEQYGSVVVTVTNNGNLQAGTNQQI

SEQ ID NO: 120430 - protein, 36 aa, Artificial Sequence
  Description of Artificial Sequence: Synthetic polypeptide
FEEEIRTTNPVATEQYGSVQTTDTGLGQEQGGGGNE

SEQ ID NO: 120431 - protein, 33 aa, Artificial Sequence
  Description of Artificial Sequence: Synthetic polypeptide
DESEIRTTNPVATECWGSVGCMNEPQAMEGENG

SEQ ID NO: 120432 - protein, 32 aa, Artificial Sequence
  Description of Artificial Sequence: Synthetic polypeptide
DENEIATTNPVATEPYGTVSMEDLQQQHNEEH

SEQ ID NO: 120433 - protein, 34 aa, Artificial Sequence
  Description of Artificial Sequence: Synthetic polypeptide
DENEIRTTNPVATEAWGSVSVVNNNNQNDEGENG

SEQ ID NO: 120434 - protein, 32 aa, Artificial Sequence
  Description of Artificial Sequence: Synthetic polypeptide
DENEIATTNPVATEPYGTVSATDIQQDQEGEL

SEQ ID NO: 120435 - protein, 34 aa, Artificial Sequence
  Description of Artificial Sequence: Synthetic polypeptide
DENEIRTTNPVATEIYGCVCSWNHQEYFGSDNQS

SEQ ID NO: 120436 - protein, 32 aa, Artificial Sequence
  Description of Artificial Sequence: Synthetic polypeptide
NEMEIRTTNPVATEQYGSVVVPMLDEYPDDNQ

SEQ ID NO: 120437 - protein, 35 aa, Artificial Sequence
  Description of Artificial Sequence: Synthetic polypeptide
FEEEIRTTNPVATEQYGSVQGDTGQNTTEGGGNEG

SEQ ID NO: 120438 - protein, 35 aa, Artificial Sequence
  Description of Artificial Sequence: Synthetic polypeptide
FEEEIRTTNPVATEQYGSVQSNTEGMQTEEVLENV

SEQ ID NO: 120439 - protein, 34 aa, Artificial Sequence
  Description of Artificial Sequence: Synthetic polypeptide
DENEIRTTNPVATEAWGSVSTVVNNNNGDEGNNG

SEQ ID NO: 120440 - protein, 30 aa, Artificial Sequence
  Description of Artificial Sequence: Synthetic polypeptide
DENEIATTNPVATEQWGDVSEIEENAEGDA

SEQ ID NO: 120441 - protein, 33 aa, Artificial Sequence
  Description of Artificial Sequence: Synthetic polypeptide
NEMEIRTTNPVATEQYGSVWANNLDEFLSSQRP

SEQ ID NO: 120442 - protein, 38 aa, Artificial Sequence
  Description of Artificial Sequence: Synthetic polypeptide
DEEEIRTTNPVATEQYGSVVTVVTNLNGNQIGNTEEGN

SEQ ID NO: 120443 - protein, 36 aa, Artificial Sequence
  Description of Artificial Sequence: Synthetic polypeptide
DECEICTTNPVATEQYGVVSTVTNLQQGNNTEDEDE

SEQ ID NO: 120444 - protein, 36 aa, Artificial Sequence
  Description of Artificial Sequence: Synthetic polypeptide
AEEEIRTTNPVATEQYGSVVVVVTTDNGQIGTNNLE

SEQ ID NO: 120445 - protein, 33 aa, Artificial Sequence
  Description of Artificial Sequence: Synthetic polypeptide
NEMEIRTTNPVATEQYGSVSVPDLLDEYGDDAQ

SEQ ID NO: 120446 - protein, 30 aa, Artificial Sequence
  Description of Artificial Sequence: Synthetic polypeptide
DENEIAPTNPCATEQWGIVSCNEMNAAGDR

SEQ ID NO: 120447 - protein, 36 aa, Artificial Sequence
  Description of Artificial Sequence: Synthetic polypeptide
AEEEIRTTNPVATEQYGSVVVTVTNGNLQQGTEQIS

SEQ ID NO: 120448 - protein, 37 aa, Artificial Sequence
  Description of Artificial Sequence: Synthetic polypeptide
AEEEIRTTNPVATEQYGSVVVVVTTNLQNNEGQNTED

SEQ ID NO: 120449 - protein, 32 aa, Artificial Sequence
  Description of Artificial Sequence: Synthetic polypeptide
DEQEIATTNPVAYEQWGSVSGNPNGNGMGNEP

SEQ ID NO: 120450 - protein, 33 aa, Artificial Sequence
  Description of Artificial Sequence: Synthetic polypeptide
FEEEIRTTNPVATEQYGSVNMGVDQNEMGEGEN

SEQ ID NO: 120451 - protein, 36 aa, Artificial Sequence
  Description of Artificial Sequence: Synthetic polypeptide
FEEEIRTTNPVATEQYGSVNIGTMNLDEGGGQNGTT

SEQ ID NO: 120452 - protein, 35 aa, Artificial Sequence
  Description of Artificial Sequence: Synthetic polypeptide
NEEEICTTNPVAYEQYGQSVSCTNSSSQVRGGEEH

SEQ ID NO: 120453 - protein, 33 aa, Artificial Sequence
  Description of Artificial Sequence: Synthetic polypeptide
DENEIRTTNPVATECWGATAWSNANLQRKGGYI

SEQ ID NO: 120454 - protein, 37 aa, Artificial Sequence
  Description of Artificial Sequence: Synthetic polypeptide
AEEEIRTTNPVATEQYGSVVVVVTTNLQNNEQGQNGE

SEQ ID NO: 120455 - protein, 32 aa, Artificial Sequence
  Description of Artificial Sequence: Synthetic polypeptide
DEQEIATTNPVAYEQWGSVSGGNGNVGEGNAS

SEQ ID NO: 120456 - protein, 37 aa, Artificial Sequence
  Description of Artificial Sequence: Synthetic polypeptide
AEEEIRTTNPVATEQYGSVVVVVTTNLQNNEQGSNEN

SEQ ID NO: 120457 - protein, 32 aa, Artificial Sequence
  Description of Artificial Sequence: Synthetic polypeptide
NEHEIRTTNPVATGHYGSVSDVVNLTEGTIDM

SEQ ID NO: 120458 - protein, 35 aa, Artificial Sequence
  Description of Artificial Sequence: Synthetic polypeptide
DEEEIRTTNPVATEQYGSVSEAPGERAMDTIVNEY

SEQ ID NO: 120459 - protein, 35 aa, Artificial Sequence
  Description of Artificial Sequence: Synthetic polypeptide
DEEEIRTTNPVATEQYGSVQFINMGDEQPEGEVEI

SEQ ID NO: 120460 - protein, 31 aa, Artificial Sequence
  Description of Artificial Sequence: Synthetic polypeptide
DENEIATTNPVATEQWGCVSEGEMNAAMDNE

SEQ ID NO: 120461 - protein, 37 aa, Artificial Sequence
  Description of Artificial Sequence: Synthetic polypeptide
AEEEIRTTNPVATEQYGSVVVVVTTNLQQGEGGNEDE

SEQ ID NO: 120462 - protein, 37 aa, Artificial Sequence
  Description of Artificial Sequence: Synthetic polypeptide
AEEEIRTTNPVATEQYGSVVVVVTTNLQQGEGNNNTE

SEQ ID NO: 120463 - protein, 36 aa, Artificial Sequence
  Description of Artificial Sequence: Synthetic polypeptide
AEEEIRTTNPVATEQYGSVVVVVTTNLENNEGGNED

SEQ ID NO: 120464 - protein, 32 aa, Artificial Sequence
  Description of Artificial Sequence: Synthetic polypeptide
DEQEIATTNPVAYEQWGSVSGGNGETGEGNAE

SEQ ID NO: 120465 - protein, 31 aa, Artificial Sequence
  Description of Artificial Sequence: Synthetic polypeptide
DENEIRTTNPVATECWGAISAEDIQQQKGNI

SEQ ID NO: 120466 - protein, 37 aa, Artificial Sequence
  Description of Artificial Sequence: Synthetic polypeptide
AEEEIRTTNPVATEQYGSVVVVVTTNLQQGNGDEDTE

SEQ ID NO: 120467 - protein, 29 aa, Artificial Sequence
  Description of Artificial Sequence: Synthetic peptide
DENEIATTNPVATEQWGDVSEIEMNAEDI

SEQ ID NO: 120468 - protein, 36 aa, Artificial Sequence
  Description of Artificial Sequence: Synthetic polypeptide
CEEEVRTTNPVATEQYGSVSCAGNGLSARTVGNNTC

SEQ ID NO: 120469 - protein, 30 aa, Artificial Sequence
  Description of Artificial Sequence: Synthetic polypeptide
DENEIACTNPVSTEPYGTASENIQQQQGGR

SEQ ID NO: 120470 - protein, 35 aa, Artificial Sequence
  Description of Artificial Sequence: Synthetic polypeptide
DEEEIRTTNPVATEQYGSVQFITWGEEQPEGEVEI

SEQ ID NO: 120471 - protein, 31 aa, Artificial Sequence
  Description of Artificial Sequence: Synthetic polypeptide
DENEIATTNPVATEQWGCVSEGEMNAADANA

SEQ ID NO: 120472 - protein, 34 aa, Artificial Sequence
  Description of Artificial Sequence: Synthetic polypeptide
DESEIRTTNPVAQECWGSVSCINEPQDREGENWG

SEQ ID NO: 120473 - protein, 37 aa, Artificial Sequence
  Description of Artificial Sequence: Synthetic polypeptide
AEEEIRTTNPVATEQYGSVVVVVTTNLNQDEGNNVDE

SEQ ID NO: 120474 - protein, 37 aa, Artificial Sequence
  Description of Artificial Sequence: Synthetic polypeptide
AEEEIRTTNPVATEQYGSVVVVVTTNLNQGENGNVDE

SEQ ID NO: 120475 - protein, 33 aa, Artificial Sequence
  Description of Artificial Sequence: Synthetic polypeptide
DESEIRTTNPVAQECWGSVHCINEPQDREGENG

SEQ ID NO: 120476 - protein, 37 aa, Artificial Sequence
  Description of Artificial Sequence: Synthetic polypeptide
AEEEIRTTNPVATEQYGSVVVVVTTNLNQDEGNGNDE

SEQ ID NO: 120477 - protein, 37 aa, Artificial Sequence
  Description of Artificial Sequence: Synthetic polypeptide
AEEEIRTTNPVATEQYGSVVVVVTTNLGQNTGEENDE

SEQ ID NO: 120478 - protein, 34 aa, Artificial Sequence
  Description of Artificial Sequence: Synthetic polypeptide
DEEEIRTTNPVATEQYGSVPPTVVVNTYGPLEVT

SEQ ID NO: 120479 - protein, 37 aa, Artificial Sequence
  Description of Artificial Sequence: Synthetic polypeptide
AEEEIRTTNPVATEQYGSVVVVVTTNLQDENGTNDGG

SEQ ID NO: 120480 - protein, 34 aa, Artificial Sequence
  Description of Artificial Sequence: Synthetic polypeptide
DEQEIATTNPVAYEQYGVSVSANDLLIDRDITGR

SEQ ID NO: 120481 - protein, 33 aa, Artificial Sequence
  Description of Artificial Sequence: Synthetic polypeptide
DEQEIATTNPVAYEQWGSVSGPNGNQGGMNGDD

SEQ ID NO: 120482 - protein, 34 aa, Artificial Sequence
  Description of Artificial Sequence: Synthetic polypeptide
DESEIRTTNAVATECWGSVSECINEPQDREGENG

SEQ ID NO: 120483 - protein, 35 aa, Artificial Sequence
  Description of Artificial Sequence: Synthetic polypeptide
DEEEIRTTNPVATEQYGSVQFITMGEEQPEGEMII

SEQ ID NO: 120484 - protein, 33 aa, Artificial Sequence
  Description of Artificial Sequence: Synthetic polypeptide
DESEIRTTNPVANECWGSVSCIQEPQDREGENG

SEQ ID NO: 120485 - protein, 37 aa, Artificial Sequence
  Description of Artificial Sequence: Synthetic polypeptide
AEEEIRTTNPVATEQYGSVVVVVTTNLGQEQGNVEDE

SEQ ID NO: 120486 - protein, 37 aa, Artificial Sequence
  Description of Artificial Sequence: Synthetic polypeptide
AEEEIRTTNPVATEQYGSVVVVVTTNLQNNEAGQNET

SEQ ID NO: 120487 - protein, 31 aa, Artificial Sequence
  Description of Artificial Sequence: Synthetic polypeptide
NEGEIRTTNPVATGHWGSVSDVLNLTEGTDH

SEQ ID NO: 120488 - protein, 32 aa, Artificial Sequence
  Description of Artificial Sequence: Synthetic polypeptide
NEEEICTTNPVAYEQWGSVRAWNNDEKDGGNR

SEQ ID NO: 120489 - protein, 31 aa, Artificial Sequence
  Description of Artificial Sequence: Synthetic polypeptide
DENEIACTNPVSTEPYGTASENLQQQQNGNH

SEQ ID NO: 120490 - protein, 35 aa, Artificial Sequence
  Description of Artificial Sequence: Synthetic polypeptide
DEEEIRTTNPVATEQYGSVPPTTGQNQADFQHETE

SEQ ID NO: 120491 - protein, 36 aa, Artificial Sequence
  Description of Artificial Sequence: Synthetic polypeptide
AEEEIRTTNPVATEQYGSVVVVVTTNLQNNEEQNES

SEQ ID NO: 120492 - protein, 34 aa, Artificial Sequence
  Description of Artificial Sequence: Synthetic polypeptide
FEEEIRTTNPVATEQYGSVNLPWEHQQRVVENNL

SEQ ID NO: 120493 - protein, 31 aa, Artificial Sequence
  Description of Artificial Sequence: Synthetic polypeptide
DENEIATTNPVATEQWGCVSEGEANAAEDND

SEQ ID NO: 120494 - protein, 33 aa, Artificial Sequence
  Description of Artificial Sequence: Synthetic polypeptide
DESEIRTTNAVATECWGSVSCINEPQDREGESG

SEQ ID NO: 120495 - protein, 36 aa, Artificial Sequence
  Description of Artificial Sequence: Synthetic polypeptide
DEEEIRTTNPVATEQYGSVSEANQLQEQIHPEVPET

SEQ ID NO: 120496 - protein, 33 aa, Artificial Sequence
  Description of Artificial Sequence: Synthetic polypeptide
DEAEIRTTNPVAYEQWGVVTGGNGNQPEGNQDR

SEQ ID NO: 120497 - protein, 37 aa, Artificial Sequence
  Description of Artificial Sequence: Synthetic polypeptide
AEEEIRTTNPVATEQYGSVVVVVTTNGNLQQGTNGED

SEQ ID NO: 120498 - protein, 33 aa, Artificial Sequence
  Description of Artificial Sequence: Synthetic polypeptide
DESEIRTTNPVAQECWGSVSCINEPQDREGEVG

SEQ ID NO: 120499 - protein, 34 aa, Artificial Sequence
  Description of Artificial Sequence: Synthetic polypeptide
DESEIRTTNPVATECWGSVHCINEEPQDREGENG

SEQ ID NO: 120500 - protein, 35 aa, Artificial Sequence
  Description of Artificial Sequence: Synthetic polypeptide
DEEEIRTTNPVATEQYGSVSEATLAEATPEVDDNN

SEQ ID NO: 120501 - protein, 36 aa, Artificial Sequence
  Description of Artificial Sequence: Synthetic polypeptide
DEEEIRTTNPVATEQYGSVQGPLTNVGAEVVNTQGR

SEQ ID NO: 120502 - protein, 29 aa, Artificial Sequence
  Description of Artificial Sequence: Synthetic peptide
DENEIAPTNPVASEQWGDVSCNEMSAGTA

SEQ ID NO: 120503 - protein, 33 aa, Artificial Sequence
  Description of Artificial Sequence: Synthetic polypeptide
DENEIRTTNPVATEIYGCVCSNWNHQNFGSDTQ

SEQ ID NO: 120504 - protein, 36 aa, Artificial Sequence
  Description of Artificial Sequence: Synthetic polypeptide
DEEEIRTTNPVATEQYGSVSEQGVELDQAEIMMNND

SEQ ID NO: 120505 - protein, 33 aa, Artificial Sequence
  Description of Artificial Sequence: Synthetic polypeptide
ENEEIATTNPVAYEQWGVVCSTNLQGDHGQNEE

SEQ ID NO: 120506 - protein, 32 aa, Artificial Sequence
  Description of Artificial Sequence: Synthetic polypeptide
DENEIACTNPVATEQYGTVCSEDNPVQFEGGD

SEQ ID NO: 120507 - protein, 31 aa, Artificial Sequence
  Description of Artificial Sequence: Synthetic polypeptide
NEEEIATTNPVAYEQWGSVRAWDLDEKGDGR

SEQ ID NO: 120508 - protein, 31 aa, Artificial Sequence
  Description of Artificial Sequence: Synthetic polypeptide
DENEIATTNPVATEQWGCVAANGLQNSDIED

SEQ ID NO: 120509 - protein, 33 aa, Artificial Sequence
  Description of Artificial Sequence: Synthetic polypeptide
DENEIACTNPVATEQYGTVCSATDNPVQFEGGD

SEQ ID NO: 120510 - protein, 36 aa, Artificial Sequence
  Description of Artificial Sequence: Synthetic polypeptide
DEEEIRTTNPVATEQYGSVPPVTMEMLQEVHENVMV

SEQ ID NO: 120511 - protein, 33 aa, Artificial Sequence
  Description of Artificial Sequence: Synthetic polypeptide
DENEIRTTNPVATEIYGCVCSWGEHQRFGSDQS

SEQ ID NO: 120512 - protein, 35 aa, Artificial Sequence
  Description of Artificial Sequence: Synthetic polypeptide
DEEEIRTTNPVATEQYGSVYTMNGIEIMISNEEWL

SEQ ID NO: 120513 - protein, 33 aa, Artificial Sequence
  Description of Artificial Sequence: Synthetic polypeptide
DEEEIRTTNPVATEQYGSYQANGNEQAQTQTVL

SEQ ID NO: 120514 - protein, 34 aa, Artificial Sequence
  Description of Artificial Sequence: Synthetic polypeptide
ENEEISTTNPVATTQWGSVSKTDNPIMERNGGNR

SEQ ID NO: 120515 - protein, 34 aa, Artificial Sequence
  Description of Artificial Sequence: Synthetic polypeptide
DEQEIATTNPVATEQYGSVSSTTPDLEMHEGEDL

SEQ ID NO: 120516 - protein, 35 aa, Artificial Sequence
  Description of Artificial Sequence: Synthetic polypeptide
DESEIRTTNPVATECWGSVGSCINEPQDREGENGV

SEQ ID NO: 120517 - protein, 33 aa, Artificial Sequence
  Description of Artificial Sequence: Synthetic polypeptide
CEEIIATTNPVAYEQYGSVSSRSNTQSQQTGNS

SEQ ID NO: 120518 - protein, 34 aa, Artificial Sequence
  Description of Artificial Sequence: Synthetic polypeptide
NEEEIRTTNPVATEPYGKVSCPGELSTENGGNNR

SEQ ID NO: 120519 - protein, 35 aa, Artificial Sequence
  Description of Artificial Sequence: Synthetic polypeptide
FEEEIRTTNPVATEQYGSVNGNTMDGQTGGGNEGE

SEQ ID NO: 120520 - protein, 36 aa, Artificial Sequence
  Description of Artificial Sequence: Synthetic polypeptide
FEEEIRTTNPVATEQYGSVNMTSDQNEQTGEGENTE

SEQ ID NO: 120521 - protein, 31 aa, Artificial Sequence
  Description of Artificial Sequence: Synthetic polypeptide
NEEEIATTNPVAYEQWGSVAKTLEQANGDES

SEQ ID NO: 120522 - protein, 33 aa, Artificial Sequence
  Description of Artificial Sequence: Synthetic polypeptide
NEMEIRTTNPVATEQYGSVSTPDQEQEQQDSEG

SEQ ID NO: 120523 - protein, 32 aa, Artificial Sequence
  Description of Artificial Sequence: Synthetic polypeptide
NEEEIATTNPVAYEQWGSVRWENDDDQTGDNH

SEQ ID NO: 120524 - protein, 36 aa, Artificial Sequence
  Description of Artificial Sequence: Synthetic polypeptide
AEEEIRTTNPVATEQYGSVVVVVTTDNGQQIGTNAT

SEQ ID NO: 120525 - protein, 31 aa, Artificial Sequence
  Description of Artificial Sequence: Synthetic polypeptide
NEEEIATTNPVAYEQWGSVRWWNDDEQTGEM

SEQ ID NO: 120526 - protein, 36 aa, Artificial Sequence
  Description of Artificial Sequence: Synthetic polypeptide
AEEEIRTTNPVATEQYGSVVVVVTTDNNNQIGTNLD

SEQ ID NO: 120527 - protein, 34 aa, Artificial Sequence
  Description of Artificial Sequence: Synthetic polypeptide
ENEEIRTTNPVAYEQWGCVSTTNLGADSGQGDNR

SEQ ID NO: 120528 - protein, 36 aa, Artificial Sequence
  Description of Artificial Sequence: Synthetic polypeptide
DECEICTTNPVATEQYGVVSTVTNLQQGNNNEQEND

SEQ ID NO: 120529 - protein, 33 aa, Artificial Sequence
  Description of Artificial Sequence: Synthetic polypeptide
DESEIRTTNCVATECWGSVSCINEPQDCEGENG

SEQ ID NO: 120530 - protein, 35 aa, Artificial Sequence
  Description of Artificial Sequence: Synthetic polypeptide
NEEEIRATNPVATEQYGSVCIVNDQHDMRQGSGSR

SEQ ID NO: 120531 - protein, 36 aa, Artificial Sequence
  Description of Artificial Sequence: Synthetic polypeptide
AEEEIRTTNPVATEQYGSVVVTVTNLGGTEQGTNGN

SEQ ID NO: 120532 - protein, 33 aa, Artificial Sequence
  Description of Artificial Sequence: Synthetic polypeptide
NEEEIATTNPVAYEQYGCVATNLADTPGEDERG

SEQ ID NO: 120533 - protein, 36 aa, Artificial Sequence
  Description of Artificial Sequence: Synthetic polypeptide
DEEEIRTTNPVATEQYGSVVTTGTDNNNETGEGGNI

SEQ ID NO: 120534 - protein, 37 aa, Artificial Sequence
  Description of Artificial Sequence: Synthetic polypeptide
AEEEIRTTNPVATEQYGSVVVVVTTGGNLQAGSTNME

SEQ ID NO: 120535 - protein, 35 aa, Artificial Sequence
  Description of Artificial Sequence: Synthetic polypeptide
DEQEIATTNPVATEQYGSVSSTTPAGPNMREGNPV

SEQ ID NO: 120536 - protein, 34 aa, Artificial Sequence
  Description of Artificial Sequence: Synthetic polypeptide
DEEEIRTTNPVATEQYGSYNVTLDPQRQLVTSDN

SEQ ID NO: 120537 - protein, 33 aa, Artificial Sequence
  Description of Artificial Sequence: Synthetic polypeptide
DESEIRTTNAVATECWGSVSCINEPQDIEGENG

SEQ ID NO: 120538 - protein, 33 aa, Artificial Sequence
  Description of Artificial Sequence: Synthetic polypeptide
DESEIRTCNPVATECWGSVSCINEPQDREGEQG

SEQ ID NO: 120539 - protein, 32 aa, Artificial Sequence
  Description of Artificial Sequence: Synthetic polypeptide
DENEIRTTNPVATEIYGCVCSWEHQHFGSQQA

SEQ ID NO: 120540 - protein, 33 aa, Artificial Sequence
  Description of Artificial Sequence: Synthetic polypeptide
NEMEIRTTNPVATEQYGSLSVSHHNPESYQGQG

SEQ ID NO: 120541 - protein, 36 aa, Artificial Sequence
  Description of Artificial Sequence: Synthetic polypeptide
AEEEIRTTNPVATEQYGSVVVVVTTDQNGQQIGTNT

SEQ ID NO: 120542 - protein, 35 aa, Artificial Sequence
  Description of Artificial Sequence: Synthetic polypeptide
DEQEIATTNPVATEQYGSVSSTTPALEDHNGMNDV

SEQ ID NO: 120543 - protein, 30 aa, Artificial Sequence
  Description of Artificial Sequence: Synthetic polypeptide
DENEIAPTNPCSSEQWGIVSCNLQNSAGTR

SEQ ID NO: 120544 - protein, 29 aa, Artificial Sequence
  Description of Artificial Sequence: Synthetic peptide
DENEIAPTNPCSSEQYGIISCNIQQQGTR

SEQ ID NO: 120545 - protein, 28 aa, Artificial Sequence
  Description of Artificial Sequence: Synthetic peptide
DENEIAPTNPVASEQWGDVSCIEMAGTA

SEQ ID NO: 120546 - protein, 32 aa, Artificial Sequence
  Description of Artificial Sequence: Synthetic polypeptide
NEEEIATTNPVAYEQWGSVRWWNQDEQGGNMQ

SEQ ID NO: 120547 - protein, 35 aa, Artificial Sequence
  Description of Artificial Sequence: Synthetic polypeptide
DESEIRTTNPVATECWGSVGSWCINEPQDREGENG

SEQ ID NO: 120548 - protein, 32 aa, Artificial Sequence
  Description of Artificial Sequence: Synthetic polypeptide
NEEEIATTNPVAYEQWGSVRWWNGDDEQQGNH

SEQ ID NO: 120549 - protein, 34 aa, Artificial Sequence
  Description of Artificial Sequence: Synthetic polypeptide
DESEIRTTNAVATECWGASVSCINEPQDREGENG

SEQ ID NO: 120550 - protein, 32 aa, Artificial Sequence
  Description of Artificial Sequence: Synthetic polypeptide
NEMEIRTTNPVATEQYGSLSVSHNNESYQSQG

SEQ ID NO: 120551 - protein, 33 aa, Artificial Sequence
  Description of Artificial Sequence: Synthetic polypeptide
DEQEIATTNPVAYEQYGWSVSATDLEDHEGEDL

SEQ ID NO: 120552 - protein, 32 aa, Artificial Sequence
  Description of Artificial Sequence: Synthetic polypeptide
NEMEIATTNPVATEQYGSFSATDLEDHEGEDL

SEQ ID NO: 120553 - protein, 33 aa, Artificial Sequence
  Description of Artificial Sequence: Synthetic polypeptide
DESEIRTTNPCATECWGIVSCINEPQDREGENG

SEQ ID NO: 120554 - protein, 34 aa, Artificial Sequence
  Description of Artificial Sequence: Synthetic polypeptide
NEEEIATTNPVATEQYGSVPCWDNHGQQRQGGKD

SEQ ID NO: 120555 - protein, 34 aa, Artificial Sequence
  Description of Artificial Sequence: Synthetic polypeptide
EEQEIATTNPVATEQYGSVSATDLPEDQEGWEFL

SEQ ID NO: 120556 - protein, 35 aa, Artificial Sequence
  Description of Artificial Sequence: Synthetic polypeptide
FEEEIRTTNPVATEQYGSVSITGMGGQNDEMNTTS

SEQ ID NO: 120557 - protein, 36 aa, Artificial Sequence
  Description of Artificial Sequence: Synthetic polypeptide
DECEICTVNPVATEQYGSVSTTNANLQQIGNNQDED

SEQ ID NO: 120558 - protein, 33 aa, Artificial Sequence
  Description of Artificial Sequence: Synthetic polypeptide
AEEEISTTNPVATEQYGCVCSTNHANFNSQFQA

SEQ ID NO: 120559 - protein, 34 aa, Artificial Sequence
  Description of Artificial Sequence: Synthetic polypeptide
DECEICTTNPVATEQYGVVSTVTDGNVEGEGNND

SEQ ID NO: 120560 - protein, 35 aa, Artificial Sequence
  Description of Artificial Sequence: Synthetic polypeptide
AEEEISTTNPVATEQYGCVCSTGNHNQNFGSENQS

SEQ ID NO: 120561 - protein, 34 aa, Artificial Sequence
  Description of Artificial Sequence: Synthetic polypeptide
AEEEISTTNPVATEQYGCVCSTGELQENFNSDQS

SEQ ID NO: 120562 - protein, 32 aa, Artificial Sequence
  Description of Artificial Sequence: Synthetic polypeptide
DESEIRSTNPVSTEGYGNVAANPTIQSRVGQR

SEQ ID NO: 120563 - protein, 35 aa, Artificial Sequence
  Description of Artificial Sequence: Synthetic polypeptide
DESEIRTTNPVATECWGSVDSCYNAEPQDREGENG

SEQ ID NO: 120564 - protein, 35 aa, Artificial Sequence
  Description of Artificial Sequence: Synthetic polypeptide
FEEEIRTTNPVATEQYGSVSMVNADQGENGVPETL

SEQ ID NO: 120565 - protein, 36 aa, Artificial Sequence
  Description of Artificial Sequence: Synthetic polypeptide
AEEEIRTTNPVATEQYGVVSTNGNNENQETGTNQTE

SEQ ID NO: 120566 - protein, 36 aa, Artificial Sequence
  Description of Artificial Sequence: Synthetic polypeptide
DECEICTVNPVATEQYGSVSTTNLQLQQLGNNQDED

SEQ ID NO: 120567 - protein, 34 aa, Artificial Sequence
  Description of Artificial Sequence: Synthetic polypeptide
EEPEIRTTNPVATECWGSVSCINGEPQDREGENG

SEQ ID NO: 120568 - protein, 36 aa, Artificial Sequence
  Description of Artificial Sequence: Synthetic polypeptide
AEEEIRTTNPVATEQYGVVSTNLNNENSETGTNVEQ

SEQ ID NO: 120569 - protein, 33 aa, Artificial Sequence
  Description of Artificial Sequence: Synthetic polypeptide
NEQEIATTNPVATEQYGSVGSATDLEDHEGEDL

SEQ ID NO: 120570 - protein, 34 aa, Artificial Sequence
  Description of Artificial Sequence: Synthetic polypeptide
FEEEIRTTNPVATEQYGSVSNTDDEQGQTFELDN

SEQ ID NO: 120571 - protein, 32 aa, Artificial Sequence
  Description of Artificial Sequence: Synthetic polypeptide
DESEIRSTNPVSTEGYGNVAANPTIQMRVGQR

SEQ ID NO: 120572 - protein, 28 aa, Artificial Sequence
  Description of Artificial Sequence: Synthetic peptide
EENEIATTNPVAYERWGCVSECLQHMES

SEQ ID NO: 120573 - protein, 33 aa, Artificial Sequence
  Description of Artificial Sequence: Synthetic polypeptide
DEQEIATTNPVCTEQYGSVWSATDLEDHEGEDL

SEQ ID NO: 120574 - protein, 32 aa, Artificial Sequence
  Description of Artificial Sequence: Synthetic polypeptide
DEQEIATTNPVCTEQYGSVYATDLEDHEGEDL

SEQ ID NO: 120575 - protein, 31 aa, Artificial Sequence
  Description of Artificial Sequence: Synthetic polypeptide
DESEIRSTNPVSTEGYGNIAANTIQSRVGQR

SEQ ID NO: 120576 - protein, 30 aa, Artificial Sequence
  Description of Artificial Sequence: Synthetic polypeptide
DENEIATTNPVATEQYGDMAEILQNHAEDA

SEQ ID NO: 120577 - protein, 33 aa, Artificial Sequence
  Description of Artificial Sequence: Synthetic polypeptide
DENEIRTTNPVATDQYGSTNTGLEHPRQAVNED

SEQ ID NO: 120578 - protein, 33 aa, Artificial Sequence
  Description of Artificial Sequence: Synthetic polypeptide
NEQEIATTNPVATEQYGSVSATDTLEDHEGEDL

SEQ ID NO: 120579 - protein, 30 aa, Artificial Sequence
  Description of Artificial Sequence: Synthetic polypeptide
DESEIRSTNPVSTEGWGNVANIEQNRAGDR

SEQ ID NO: 120580 - protein, 30 aa, Artificial Sequence
  Description of Artificial Sequence: Synthetic polypeptide
CEDEIRTTNPVATEQYGELCPFNWQETDSA

SEQ ID NO: 120581 - protein, 37 aa, Artificial Sequence
  Description of Artificial Sequence: Synthetic polypeptide
AEEEIRTTNPVATEQYGVVSTNLNQLGNTEQGTNENQ

SEQ ID NO: 120582 - protein, 34 aa, Artificial Sequence
  Description of Artificial Sequence: Synthetic polypeptide
FEEEIRTTNPVATEQYGSVSNTDDEQGQTFEMTE

SEQ ID NO: 120583 - protein, 32 aa, Artificial Sequence
  Description of Artificial Sequence: Synthetic polypeptide
DEAEIGTTNPVATEQYGSVNTDDPYMYENQTA

SEQ ID NO: 120584 - protein, 35 aa, Artificial Sequence
  Description of Artificial Sequence: Synthetic polypeptide
FEEEIRTTNPVATEQYGSVSITGEANVAPQAEEEI

SEQ ID NO: 120585 - protein, 33 aa, Artificial Sequence
  Description of Artificial Sequence: Synthetic polypeptide
CEDEIRTTNPVATEQYGDVVTGQNEGQGNDGEQ

SEQ ID NO: 120586 - protein, 33 aa, Artificial Sequence
  Description of Artificial Sequence: Synthetic polypeptide
DEAEIGTTNPVATEQYGCVSTDDLYMYMENQTA

SEQ ID NO: 120587 - protein, 32 aa, Artificial Sequence
  Description of Artificial Sequence: Synthetic polypeptide
DESEIRTTNPVATCHYGCVCSTPHQYFTSNQS

SEQ ID NO: 120588 - protein, 35 aa, Artificial Sequence
  Description of Artificial Sequence: Synthetic polypeptide
DECEICTTNPVATEQYGVVSTVTDGNVELGEGNDT

SEQ ID NO: 120589 - protein, 34 aa, Artificial Sequence
  Description of Artificial Sequence: Synthetic polypeptide
FEEEIRTTNPVATEQYGSVSILDSVGMGGGNEGD

SEQ ID NO: 120590 - protein, 36 aa, Artificial Sequence
  Description of Artificial Sequence: Synthetic polypeptide
DEEEIRTTNPVATEQYGSVVVCTRASSNSNGGNNED

SEQ ID NO: 120591 - protein, 31 aa, Artificial Sequence
  Description of Artificial Sequence: Synthetic polypeptide
DEQEIATTNPVAYEQWGSISKTLEDRQSNDI

SEQ ID NO: 120592 - protein, 28 aa, Artificial Sequence
  Description of Artificial Sequence: Synthetic peptide
EESEIASTNPVGTEGYGVMASTLQKGDI

SEQ ID NO: 120593 - protein, 34 aa, Artificial Sequence
  Description of Artificial Sequence: Synthetic polypeptide
DEEEIRTTNPVATEQYGSVQNGNLEEPAPAVEEE

SEQ ID NO: 120594 - protein, 33 aa, Artificial Sequence
  Description of Artificial Sequence: Synthetic polypeptide
DENEIRTTNPVATDQYGSVNTGLEHPRQAQADF

SEQ ID NO: 120595 - protein, 30 aa, Artificial Sequence
  Description of Artificial Sequence: Synthetic polypeptide
NEEEIASVNPVCTEQYGCVVCSDNGDSGNQ

SEQ ID NO: 120596 - protein, 32 aa, Artificial Sequence
  Description of Artificial Sequence: Synthetic polypeptide
DESEIRSTNPVSTEGYGNVSCNIPQSRVGEQG

SEQ ID NO: 120597 - protein, 31 aa, Artificial Sequence
  Description of Artificial Sequence: Synthetic polypeptide
NEEEIASVNPVCTEQYGCVCCSDNGDQSGNQ

SEQ ID NO: 120598 - protein, 37 aa, Artificial Sequence
  Description of Artificial Sequence: Synthetic polypeptide
AEEEIRTTNPVATEQYGSVVVTVTDNGNLQQGTNQIA

SEQ ID NO: 120599 - protein, 28 aa, Artificial Sequence
  Description of Artificial Sequence: Synthetic peptide
EESEIASTNPVGTEGYGVMASTLQHGRI

SEQ ID NO: 120600 - protein, 28 aa, Artificial Sequence
  Description of Artificial Sequence: Synthetic peptide
EESEIASTNPVGTEGYGVMASTLQHGDI

SEQ ID NO: 120601 - protein, 34 aa, Artificial Sequence
  Description of Artificial Sequence: Synthetic polypeptide
DENEIRTTNPVATDQYGSVNQTQTEHPRQGQNAD

SEQ ID NO: 120602 - protein, 33 aa, Artificial Sequence
  Description of Artificial Sequence: Synthetic polypeptide
DEQEIATTNPVCTEQYGSVSATDLEDHEGWEDL

SEQ ID NO: 120603 - protein, 32 aa, Artificial Sequence
  Description of Artificial Sequence: Synthetic polypeptide
DECEICTTNPVAYEQWGSVGWNIEDLQPMDMR

SEQ ID NO: 120604 - protein, 35 aa, Artificial Sequence
  Description of Artificial Sequence: Synthetic polypeptide
FEEEIRTTNPVATEQYGSVSINNGMGQNDEFTEEG

SEQ ID NO: 120605 - protein, 32 aa, Artificial Sequence
  Description of Artificial Sequence: Synthetic polypeptide
DEAEIGTTNPVATEQYGCVETDDLYMYENQTS

SEQ ID NO: 120606 - protein, 33 aa, Artificial Sequence
  Description of Artificial Sequence: Synthetic polypeptide
DESEIRTTNPVATCHYGCVCSTGELQHFTSNQG

SEQ ID NO: 120607 - protein, 33 aa, Artificial Sequence
  Description of Artificial Sequence: Synthetic polypeptide
DEQEIATTNPVATEQYGSVSDTDPEDHEGSEDL

SEQ ID NO: 120608 - protein, 31 aa, Artificial Sequence
  Description of Artificial Sequence: Synthetic polypeptide
NENEIRTTNPVAYEAWGQVVWTNLSGIGGSR

SEQ ID NO: 120609 - protein, 33 aa, Artificial Sequence
  Description of Artificial Sequence: Synthetic polypeptide
AEEEIRTTNPVATEQYGVVCSWEHQENFGSEQS

SEQ ID NO: 120610 - protein, 34 aa, Artificial Sequence
  Description of Artificial Sequence: Synthetic polypeptide
DEEEIRTTNPVATEQYGSVYTDDPKVASLLSNFE

SEQ ID NO: 120611 - protein, 33 aa, Artificial Sequence
  Description of Artificial Sequence: Synthetic polypeptide
DEQEIATTNPVCTEQYGSVSATDLEDHEGYEDL

SEQ ID NO: 120612 - protein, 35 aa, Artificial Sequence
  Description of Artificial Sequence: Synthetic polypeptide
FEEEIRTTNPVATEQYGSVSINNMDINGEGGGNGE

SEQ ID NO: 120613 - protein, 34 aa, Artificial Sequence
  Description of Artificial Sequence: Synthetic polypeptide
DEEEIRTTNPVATEQYGSVYTDDPKHASSVSNFE

SEQ ID NO: 120614 - protein, 36 aa, Artificial Sequence
  Description of Artificial Sequence: Synthetic polypeptide
DEAEICTTNPVATECYGSVSTGNGLLQDDRNGDGEE

SEQ ID NO: 120615 - protein, 33 aa, Artificial Sequence
  Description of Artificial Sequence: Synthetic polypeptide
DESEIRTTNPVATCHYGCVCSTNHQERFTSDQM

SEQ ID NO: 120616 - protein, 33 aa, Artificial Sequence
  Description of Artificial Sequence: Synthetic polypeptide
EEQEIATTNPVATEQYGSVSATDYEDHEGNEDL

SEQ ID NO: 120617 - protein, 33 aa, Artificial Sequence
  Description of Artificial Sequence: Synthetic polypeptide
EEQEIATTNPVATEQYGSVSATDWLEDHEGEDL

SEQ ID NO: 120618 - protein, 31 aa, Artificial Sequence
  Description of Artificial Sequence: Synthetic polypeptide
NEEEIATTNPVATAQWGSVSAGGPDEAGGRT

SEQ ID NO: 120619 - protein, 33 aa, Artificial Sequence
  Description of Artificial Sequence: Synthetic polypeptide
DEAEIGTTNPVATEQYGSVSTDDPYMYMEENQT

SEQ ID NO: 120620 - protein, 36 aa, Artificial Sequence
  Description of Artificial Sequence: Synthetic polypeptide
DECEICTVNPVATEQYGSVSTTNNLQENEQGTNNTD

SEQ ID NO: 120621 - protein, 36 aa, Artificial Sequence
  Description of Artificial Sequence: Synthetic polypeptide
DECEICTTNPVATEQYGVVSTVTDGNLEQGEGNNGV

SEQ ID NO: 120622 - protein, 35 aa, Artificial Sequence
  Description of Artificial Sequence: Synthetic polypeptide
DESEIRTTNPVATDQYGSVNFTMGLQGLEGGNGDA

SEQ ID NO: 120623 - protein, 35 aa, Artificial Sequence
  Description of Artificial Sequence: Synthetic polypeptide
FEEEIRTTNPVATEQYGSVSPTNNEMGLFPLTVVD

SEQ ID NO: 120624 - protein, 35 aa, Artificial Sequence
  Description of Artificial Sequence: Synthetic polypeptide
FEEEIRTTNPVATEQYGSVSPTVSMAEIESQNGRQ

SEQ ID NO: 120625 - protein, 36 aa, Artificial Sequence
  Description of Artificial Sequence: Synthetic polypeptide
FEEEIRTTNPVATEQYGSVSSGDDENGQSEDGENGD

SEQ ID NO: 120626 - protein, 35 aa, Artificial Sequence
  Description of Artificial Sequence: Synthetic polypeptide
DESEIRTTNPVATDQYGSVNGTVGLQQEDGGNEDT

SEQ ID NO: 120627 - protein, 34 aa, Artificial Sequence
  Description of Artificial Sequence: Synthetic polypeptide
NEQEIRTTNPVATEQYGSVSWGPLQEDFAENDID

SEQ ID NO: 120628 - protein, 28 aa, Artificial Sequence
  Description of Artificial Sequence: Synthetic peptide
CESEIACTNPVGTEGYGVMASTLQHGDI

SEQ ID NO: 120629 - protein, 28 aa, Artificial Sequence
  Description of Artificial Sequence: Synthetic peptide
CESEIASTNPVGTECYGVMASTLQHGDI

SEQ ID NO: 120630 - protein, 35 aa, Artificial Sequence
  Description of Artificial Sequence: Synthetic polypeptide
DESEIRTTNPVATDQYGSVNLTRGLQGLEGVNGDT

SEQ ID NO: 120631 - protein, 35 aa, Artificial Sequence
  Description of Artificial Sequence: Synthetic polypeptide
DESEIRSTNPVGTEGYGSVSSTSPTLQMRNGMNPV

SEQ ID NO: 120632 - protein, 36 aa, Artificial Sequence
  Description of Artificial Sequence: Synthetic polypeptide
FEEEIRTTNPVATEQYGSVSSGDQLEGGQEGGNEGD

SEQ ID NO: 120633 - protein, 33 aa, Artificial Sequence
  Description of Artificial Sequence: Synthetic polypeptide
DESEIRTTNPVATECWGSVDCINEPQDRERENG

SEQ ID NO: 120634 - protein, 37 aa, Artificial Sequence
  Description of Artificial Sequence: Synthetic polypeptide
FEEEIRTTNPVATEQYGSVSSTQGVNEGQNVEGQNGI

SEQ ID NO: 120635 - protein, 30 aa, Artificial Sequence
  Description of Artificial Sequence: Synthetic polypeptide
DENEIRTTNPVASEQWGDVSTIEMNAAEDA

SEQ ID NO: 120636 - protein, 36 aa, Artificial Sequence
  Description of Artificial Sequence: Synthetic polypeptide
FEEEIRTTNPVATEQYGSVSSTTPAGPNMRNGMNNV

SEQ ID NO: 120637 - protein, 36 aa, Artificial Sequence
  Description of Artificial Sequence: Synthetic polypeptide
FEEEIRTTNPVATEQYGSVSSTTPAGPNMRNGMNPV

SEQ ID NO: 120638 - protein, 33 aa, Artificial Sequence
  Description of Artificial Sequence: Synthetic polypeptide
DEQEIATTNPVGTEQYGSVTSATDLEDHEGEDL

SEQ ID NO: 120639 - protein, 34 aa, Artificial Sequence
  Description of Artificial Sequence: Synthetic polypeptide
DESEIRTTNPVATECWGSVCWCINEPQDREGENG

SEQ ID NO: 120640 - protein, 36 aa, Artificial Sequence
  Description of Artificial Sequence: Synthetic polypeptide
FEEEIRTTNPVATEQYGSVSSTTPAVPNMRNGMNPV

SEQ ID NO: 120641 - protein, 32 aa, Artificial Sequence
  Description of Artificial Sequence: Synthetic polypeptide
DEQEIATTNPVAYEQWGSCSATDNNDHHGENL

SEQ ID NO: 120642 - protein, 34 aa, Artificial Sequence
  Description of Artificial Sequence: Synthetic polypeptide
DESEIRSTNPVGTEGYGSVSATSPTLQMHNGNPV

SEQ ID NO: 120643 - protein, 36 aa, Artificial Sequence
  Description of Artificial Sequence: Synthetic polypeptide
AEEEIRTTNPVATEQYGVVSTNNNQLGQEQGTEQSE

SEQ ID NO: 120644 - protein, 35 aa, Artificial Sequence
  Description of Artificial Sequence: Synthetic polypeptide
DEEEIRTTNPVATEQYGSVSDTETDIQADEASDLE

SEQ ID NO: 120645 - protein, 30 aa, Artificial Sequence
  Description of Artificial Sequence: Synthetic polypeptide
DENEIATTNPVATEQYGDVSEIEMNAAEDL

SEQ ID NO: 120646 - protein, 37 aa, Artificial Sequence
  Description of Artificial Sequence: Synthetic polypeptide
FEEEIRTTNPVATEQYGSVSTEGVNEGQNVEGQNQII

SEQ ID NO: 120647 - protein, 37 aa, Artificial Sequence
  Description of Artificial Sequence: Synthetic polypeptide
AEEEIRTTNPVATEQYGSVVVTVNTNLEQGSEGGNTG

SEQ ID NO: 120648 - protein, 30 aa, Artificial Sequence
  Description of Artificial Sequence: Synthetic polypeptide
DENEIRTTNPVAHEQWGDVSSIEMQAAEDH

SEQ ID NO: 120649 - protein, 35 aa, Artificial Sequence
  Description of Artificial Sequence: Synthetic polypeptide
FEEEIRTTNPVATEQYGSVSTGMGDQGNGQGDEAN

SEQ ID NO: 120650 - protein, 28 aa, Artificial Sequence
  Description of Artificial Sequence: Synthetic peptide
CESEIACTNPVGTEGWGVSASTLQHGDD

SEQ ID NO: 120651 - protein, 36 aa, Artificial Sequence
  Description of Artificial Sequence: Synthetic polypeptide
AEEEIRTTNPVATEQYGVVSTNLNQQGQEQGTEEAT

SEQ ID NO: 120652 - protein, 35 aa, Artificial Sequence
  Description of Artificial Sequence: Synthetic polypeptide
FEEEIRTTNPVATEQYGSVSPTILVQEHEAEIDMD

SEQ ID NO: 120653 - protein, 30 aa, Artificial Sequence
  Description of Artificial Sequence: Synthetic polypeptide
DENEIATTNPVATEQYGDVSECEMNAAEDA

SEQ ID NO: 120654 - protein, 36 aa, Artificial Sequence
  Description of Artificial Sequence: Synthetic polypeptide
DEEEIRTTNPVATEQYGSVQPNAVNLDIMIEPGNEL

SEQ ID NO: 120655 - protein, 32 aa, Artificial Sequence
  Description of Artificial Sequence: Synthetic polypeptide
DEQEIATTNPVGTEQYGKVSATDLEDHEGEDL

SEQ ID NO: 120656 - protein, 36 aa, Artificial Sequence
  Description of Artificial Sequence: Synthetic polypeptide
DECEICTVNPVATEQYGSVSTTNNLQFSEQGNNEEE

SEQ ID NO: 120657 - protein, 35 aa, Artificial Sequence
  Description of Artificial Sequence: Synthetic polypeptide
FEEEIRTTNPVATEQYGSVSNTMEPQAENGVPEST

SEQ ID NO: 120658 - protein, 28 aa, Artificial Sequence
  Description of Artificial Sequence: Synthetic peptide
EENEIATTNPVAYEPWGTVSECLQHEEQ

SEQ ID NO: 120659 - protein, 34 aa, Artificial Sequence
  Description of Artificial Sequence: Synthetic polypeptide
DESEIRTTNPVATDCWGSTVSCINEPQDRFGENG

SEQ ID NO: 120660 - protein, 33 aa, Artificial Sequence
  Description of Artificial Sequence: Synthetic polypeptide
DESEIRTTNPVATDCWGSVSCINEPEDREGENG

SEQ ID NO: 120661 - protein, 34 aa, Artificial Sequence
  Description of Artificial Sequence: Synthetic polypeptide
DESEIRTTNPVATDCWGSVSCINEPQDREGENGH

SEQ ID NO: 120662 - protein, 33 aa, Artificial Sequence
  Description of Artificial Sequence: Synthetic polypeptide
DESEIRTTNPVATDCWGSVSCINEPQDREGEVG

SEQ ID NO: 120663 - protein, 35 aa, Artificial Sequence
  Description of Artificial Sequence: Synthetic polypeptide
FEEEIRTTNPVATEQYGSVSNVNLIPETNVLQTQT

SEQ ID NO: 120664 - protein, 36 aa, Artificial Sequence
  Description of Artificial Sequence: Synthetic polypeptide
DECEICTVNPVATEQYGSVSTTNQQLQEQGNNQQGD

SEQ ID NO: 120665 - protein, 31 aa, Artificial Sequence
  Description of Artificial Sequence: Synthetic polypeptide
DENEIATTNPVATEQYGDVSAEILMNAEEDA

SEQ ID NO: 120666 - protein, 35 aa, Artificial Sequence
  Description of Artificial Sequence: Synthetic polypeptide
DEAEICTTNPVATECYGSVSTGNGLLDDRQMNGEN

SEQ ID NO: 120667 - protein, 32 aa, Artificial Sequence
  Description of Artificial Sequence: Synthetic polypeptide
DESEIRSTNPVGTEGYGVVSSSPTLQRNGDPV

SEQ ID NO: 120668 - protein, 35 aa, Artificial Sequence
  Description of Artificial Sequence: Synthetic polypeptide
FEEEIRTTNPVATEQYGSVSNWNLEPETNVEQTNT

SEQ ID NO: 120669 - protein, 36 aa, Artificial Sequence
  Description of Artificial Sequence: Synthetic polypeptide
DECEICTVNPVATEQYGSVSTTNQQLQGNGNNQDEE

SEQ ID NO: 120670 - protein, 36 aa, Artificial Sequence
  Description of Artificial Sequence: Synthetic polypeptide
FEEEIRTTNPVATEQYGSVSPLVVTNLQMNPLTLQT

SEQ ID NO: 120671 - protein, 28 aa, Artificial Sequence
  Description of Artificial Sequence: Synthetic peptide
EENEIATTNPVAYEPWGDVSECLQHNEA

SEQ ID NO: 120672 - protein, 35 aa, Artificial Sequence
  Description of Artificial Sequence: Synthetic polypeptide
FEEEIRTTNPVATEQYGSVSPTAEMAEIESQNGRQ

SEQ ID NO: 120673 - protein, 36 aa, Artificial Sequence
  Description of Artificial Sequence: Synthetic polypeptide
DEAEICTTNPVATECYGSVSTGNGLLDDDRGQNAEN

SEQ ID NO: 120674 - protein, 32 aa, Artificial Sequence
  Description of Artificial Sequence: Synthetic polypeptide
DENEIACTNPVATEQYGEASEPNGPQMRGGPV

SEQ ID NO: 120675 - protein, 35 aa, Artificial Sequence
  Description of Artificial Sequence: Synthetic polypeptide
DESEIRTTNPVATDQYGSVNDTRGLQDLEGENGDT

SEQ ID NO: 120676 - protein, 34 aa, Artificial Sequence
  Description of Artificial Sequence: Synthetic polypeptide
DEEEIRTTNPVATEQYGSVPPPLTEQTMPLLEQV

SEQ ID NO: 120677 - protein, 35 aa, Artificial Sequence
  Description of Artificial Sequence: Synthetic polypeptide
DEEEIRTTNPVATEQYGSVPPPLSLEETMGLQEQV

SEQ ID NO: 120678 - protein, 36 aa, Artificial Sequence
  Description of Artificial Sequence: Synthetic polypeptide
DECEICTTNPVATEQYGVVSTVTDGNLEQGENGNDD

SEQ ID NO: 120679 - protein, 36 aa, Artificial Sequence
  Description of Artificial Sequence: Synthetic polypeptide
DECEICTTNPVATEQYGVVSTVTDGNLEQGEGTNTD

SEQ ID NO: 120680 - protein, 35 aa, Artificial Sequence
  Description of Artificial Sequence: Synthetic polypeptide
DESEIRTTNPVATECWGSVDSCINEPQDREGFNGG

SEQ ID NO: 120681 - protein, 35 aa, Artificial Sequence
  Description of Artificial Sequence: Synthetic polypeptide
DESEIRTTNPVATDQYGSVNDTRGLQGLQGGNGDA

SEQ ID NO: 120682 - protein, 35 aa, Artificial Sequence
  Description of Artificial Sequence: Synthetic polypeptide
DESEIRTTNPVATDQYGSVNDTRGLQQLEGGNIDT

SEQ ID NO: 120683 - protein, 36 aa, Artificial Sequence
  Description of Artificial Sequence: Synthetic polypeptide
FEEEIRTTNPVATEQYGSVSPTGPMAEIGITQNPRQ

SEQ ID NO: 120684 - protein, 31 aa, Artificial Sequence
  Description of Artificial Sequence: Synthetic polypeptide
NEEEIATTNPVATAQWGSVSAGGPDEAGNVN

SEQ ID NO: 120685 - protein, 35 aa, Artificial Sequence
  Description of Artificial Sequence: Synthetic polypeptide
CEDEIRTTNPVATEQYGVVSTVDNTGDQGGGNEDE

SEQ ID NO: 120686 - protein, 34 aa, Artificial Sequence
  Description of Artificial Sequence: Synthetic polypeptide
DESEIRTTNPVATCCWGSVSCINYEPQDREGENG

SEQ ID NO: 120687 - protein, 36 aa, Artificial Sequence
  Description of Artificial Sequence: Synthetic polypeptide
AEEEIRTTNPVATEQYGSVVVVVTTNQQGEQGTNVD

SEQ ID NO: 120688 - protein, 36 aa, Artificial Sequence
  Description of Artificial Sequence: Synthetic polypeptide
DEEEIRTTNPVATEQYGSYSSTTPAGPNMRNGANPV

SEQ ID NO: 120689 - protein, 35 aa, Artificial Sequence
  Description of Artificial Sequence: Synthetic polypeptide
FEEEIRTTNPVATEQYGSVSDGEGQGGNDEGNVGE

SEQ ID NO: 120690 - protein, 36 aa, Artificial Sequence
  Description of Artificial Sequence: Synthetic polypeptide
DEEEIRTTNPVATEQYGSYSSTTPAGPNMRNGMNPV

SEQ ID NO: 120691 - protein, 36 aa, Artificial Sequence
  Description of Artificial Sequence: Synthetic polypeptide
DEEEIRTTNPVATEQYGSYSSTTPAGPNMRNGNNPV

SEQ ID NO: 120692 - protein, 28 aa, Artificial Sequence
  Description of Artificial Sequence: Synthetic peptide
NENEIATTNPVAYERWGVVSECLQHEET

SEQ ID NO: 120693 - protein, 28 aa, Artificial Sequence
  Description of Artificial Sequence: Synthetic peptide
EEVEIATTNPVAYEPWGDVSECLQHMEG

SEQ ID NO: 120694 - protein, 35 aa, Artificial Sequence
  Description of Artificial Sequence: Synthetic polypeptide
FEEEIRTTNPVATEQYGSVSDGLIGDDEQGEENQD

SEQ ID NO: 120695 - protein, 36 aa, Artificial Sequence
  Description of Artificial Sequence: Synthetic polypeptide
FEEEIRTTNPVATEQYGSVSDTDNGGQGNEDGGDTV

SEQ ID NO: 120696 - protein, 35 aa, Artificial Sequence
  Description of Artificial Sequence: Synthetic polypeptide
DEAEICTTNPVATECYGSVSTGNGNQGGHGQNGND

SEQ ID NO: 120697 - protein, 30 aa, Artificial Sequence
  Description of Artificial Sequence: Synthetic polypeptide
DESEIRSTNPVSTEQWGNVANTIQNAAGDR

SEQ ID NO: 120698 - protein, 28 aa, Artificial Sequence
  Description of Artificial Sequence: Synthetic peptide
EEVEIATTNPVAYECWGCVSECLQHESA

SEQ ID NO: 120699 - protein, 33 aa, Artificial Sequence
  Description of Artificial Sequence: Synthetic polypeptide
DEECISTTNPVATEQYGCVCSTEDQNFNSNTQS

SEQ ID NO: 120700 - protein, 32 aa, Artificial Sequence
  Description of Artificial Sequence: Synthetic polypeptide
EEVEIATTNPVATTQWGTVRTWDHQQRNGNER

SEQ ID NO: 120701 - protein, 35 aa, Artificial Sequence
  Description of Artificial Sequence: Synthetic polypeptide
EETEIATTNPVATENYGCVSTSNGLNDQERQGNEN

SEQ ID NO: 120702 - protein, 34 aa, Artificial Sequence
  Description of Artificial Sequence: Synthetic polypeptide
DENEIRTTNPVATEIYGSVDNNNDLDQDGQTGQT

SEQ ID NO: 120703 - protein, 36 aa, Artificial Sequence
  Description of Artificial Sequence: Synthetic polypeptide
AEEEIRTTNPVATEQYGSVVVVVTTNQQNDEGNNDD

SEQ ID NO: 120704 - protein, 32 aa, Artificial Sequence
  Description of Artificial Sequence: Synthetic polypeptide
DENEIATTNPVATEQWGSVAAANNDDTEAGNF

SEQ ID NO: 120705 - protein, 34 aa, Artificial Sequence
  Description of Artificial Sequence: Synthetic polypeptide
DENEIATTNPVATEQWGSVAAANNLDERPGGVNQ

SEQ ID NO: 120706 - protein, 36 aa, Artificial Sequence
  Description of Artificial Sequence: Synthetic polypeptide
FEEEIRTTNPVATEQYGSVSDTGMQGQGEGGGNNEE

SEQ ID NO: 120707 - protein, 30 aa, Artificial Sequence
  Description of Artificial Sequence: Synthetic polypeptide
DESEIRSTNPVSTEQWGNVANTEMSAAGDR

SEQ ID NO: 120708 - protein, 36 aa, Artificial Sequence
  Description of Artificial Sequence: Synthetic polypeptide
AEEEIRTTNPVATEQYGSVVVVVTTNQQQDEGNNQD

SEQ ID NO: 120709 - protein, 36 aa, Artificial Sequence
  Description of Artificial Sequence: Synthetic polypeptide
DEAEICTTNPVATECYGSVSTGNGLTQGDRGGDKES

SEQ ID NO: 120710 - protein, 33 aa, Artificial Sequence
  Description of Artificial Sequence: Synthetic polypeptide
DECEICTTNPVAYEGWGSVATSNGNQGDGNNRD

SEQ ID NO: 120711 - protein, 36 aa, Artificial Sequence
  Description of Artificial Sequence: Synthetic polypeptide
AEEEIRTTNPVATEQYGSVVVVVTTNQQQGEQGNND

SEQ ID NO: 120712 - protein, 35 aa, Artificial Sequence
  Description of Artificial Sequence: Synthetic polypeptide
EETEIATTNPVATENYGCVSTPNGLNDQERQGGER

SEQ ID NO: 120713 - protein, 33 aa, Artificial Sequence
  Description of Artificial Sequence: Synthetic polypeptide
DEECISTTNPVATEQYGCVCSTEHNQNFNSDQS

SEQ ID NO: 120714 - protein, 32 aa, Artificial Sequence
  Description of Artificial Sequence: Synthetic polypeptide
DENEIACTNPVATEQYGSASATDLEDHEGEDL

SEQ ID NO: 120715 - protein, 36 aa, Artificial Sequence
  Description of Artificial Sequence: Synthetic polypeptide
AEEEIRTTNPVATEQYGSVVVVVTTNQQQQEGTNGT

SEQ ID NO: 120716 - protein, 36 aa, Artificial Sequence
  Description of Artificial Sequence: Synthetic polypeptide
DEEEIRTTNPVATEQYGSYSSTTPAGPNMRFGMNPV

SEQ ID NO: 120717 - protein, 36 aa, Artificial Sequence
  Description of Artificial Sequence: Synthetic polypeptide
AEEEIRTTNPVATEQYGSVYTNNNNQNGTEAGNTQS

SEQ ID NO: 120718 - protein, 30 aa, Artificial Sequence
  Description of Artificial Sequence: Synthetic polypeptide
DENEIATTNPVATEQWGQVSWIEMRDAEDA

SEQ ID NO: 120719 - protein, 36 aa, Artificial Sequence
  Description of Artificial Sequence: Synthetic polypeptide
DEEEIRTTNPVATEQYGSYSSTRPAGPNMRNGMNPV

SEQ ID NO: 120720 - protein, 29 aa, Artificial Sequence
  Description of Artificial Sequence: Synthetic peptide
EMNEIATTNPVATECYGQVSEWLQHEEEL

SEQ ID NO: 120721 - protein, 30 aa, Artificial Sequence
  Description of Artificial Sequence: Synthetic polypeptide
DENEIATTNPVATEQWGDVSEIEQNAAETA

SEQ ID NO: 120722 - protein, 35 aa, Artificial Sequence
  Description of Artificial Sequence: Synthetic polypeptide
NEEEIATTNPVATEQYGSVCATNPQQEHQDGNQHQ

SEQ ID NO: 120723 - protein, 30 aa, Artificial Sequence
  Description of Artificial Sequence: Synthetic polypeptide
DENEIATTNPVATEQWGDVSEILMNAAEDA

SEQ ID NO: 120724 - protein, 32 aa, Artificial Sequence
  Description of Artificial Sequence: Synthetic polypeptide
EGEEIATTNPVSTEQYGSVSWNEMDRQGMDSQ

SEQ ID NO: 120725 - protein, 30 aa, Artificial Sequence
  Description of Artificial Sequence: Synthetic polypeptide
DENEIATTNPVATEQWGDVSEILMNAAEEA

SEQ ID NO: 120726 - protein, 34 aa, Artificial Sequence
  Description of Artificial Sequence: Synthetic polypeptide
DEEEIRTTNPVATEQYGSVPPSAYEDTVMMVEED

SEQ ID NO: 120727 - protein, 29 aa, Artificial Sequence
  Description of Artificial Sequence: Synthetic peptide
NENEIATTNPVATECWGDVSEGLQHESEE

SEQ ID NO: 120728 - protein, 32 aa, Artificial Sequence
  Description of Artificial Sequence: Synthetic polypeptide
EGEEIATTNPVAYEQWGVVCSTELQGDHGQNE

SEQ ID NO: 120729 - protein, 36 aa, Artificial Sequence
  Description of Artificial Sequence: Synthetic polypeptide
FEEEIRTTNPVATEQYGSVRSTTPAGPNMRNGMNPV

SEQ ID NO: 120730 - protein, 34 aa, Artificial Sequence
  Description of Artificial Sequence: Synthetic polypeptide
DESEIRTTNPVASECWGSVSCINMEPQDREGENG

SEQ ID NO: 120731 - protein, 32 aa, Artificial Sequence
  Description of Artificial Sequence: Synthetic polypeptide
DECEICTTNPVAYEGWGSVATENGNQNDFNNR

SEQ ID NO: 120732 - protein, 35 aa, Artificial Sequence
  Description of Artificial Sequence: Synthetic polypeptide
DEEEIRTTNPVATEQYGSVSESDTTQVRDVEELYT

SEQ ID NO: 120733 - protein, 32 aa, Artificial Sequence
  Description of Artificial Sequence: Synthetic polypeptide
DEQEIATTNPVAYEQWGSTVTNPNGNGMGNDR

SEQ ID NO: 120734 - protein, 34 aa, Artificial Sequence
  Description of Artificial Sequence: Synthetic polypeptide
DEEEIRTTNPVATEQYGSVPPRPVEQQVMEIQRL

SEQ ID NO: 120735 - protein, 34 aa, Artificial Sequence
  Description of Artificial Sequence: Synthetic polypeptide
NEEEIATTNPVATEQYGSVCAANNGLEYMDGDNP

SEQ ID NO: 120736 - protein, 32 aa, Artificial Sequence
  Description of Artificial Sequence: Synthetic polypeptide
EGEEIATTNPVAYEQWGSVTHGLDDHQRGTDR

SEQ ID NO: 120737 - protein, 35 aa, Artificial Sequence
  Description of Artificial Sequence: Synthetic polypeptide
AEEEIRTTNPVATEQYGSVVVVVTTNNQQQQNNVE

SEQ ID NO: 120738 - protein, 35 aa, Artificial Sequence
  Description of Artificial Sequence: Synthetic polypeptide
FEEEIRTTNPVATEQYGSVSCPLISLERSGEEQWQ

SEQ ID NO: 120739 - protein, 30 aa, Artificial Sequence
  Description of Artificial Sequence: Synthetic polypeptide
DENEIRTTNPVATEAWGDVSEIEMNGAEDA

SEQ ID NO: 120740 - protein, 32 aa, Artificial Sequence
  Description of Artificial Sequence: Synthetic polypeptide
DEQEIATTNPVAYERWGTVATNNSQGDQGMNR

SEQ ID NO: 120741 - protein, 37 aa, Artificial Sequence
  Description of Artificial Sequence: Synthetic polypeptide
AEEEIRTTNPVATEQYGSVVVVVTTNQGNLQQGTNIN

SEQ ID NO: 120742 - protein, 30 aa, Artificial Sequence
  Description of Artificial Sequence: Synthetic polypeptide
DESEIRSTNPVSTEQWGNVANTIQSAVGQR

SEQ ID NO: 120743 - protein, 30 aa, Artificial Sequence
  Description of Artificial Sequence: Synthetic polypeptide
DENEIATTNPVATEQWGKVSEGEMNAAEGE

SEQ ID NO: 120744 - protein, 30 aa, Artificial Sequence
  Description of Artificial Sequence: Synthetic polypeptide
DESEIRSTNPVSTEQWGNVANTIQSAAGQR

SEQ ID NO: 120745 - protein, 36 aa, Artificial Sequence
  Description of Artificial Sequence: Synthetic polypeptide
FEEEIRTTNPVATEQYGSVSDEMNVNQNGGGDNGGG

SEQ ID NO: 120746 - protein, 31 aa, Artificial Sequence
  Description of Artificial Sequence: Synthetic polypeptide
DENEIATTNPVATEQWGKVSEIHMNAAEGDA

SEQ ID NO: 120747 - protein, 37 aa, Artificial Sequence
  Description of Artificial Sequence: Synthetic polypeptide
AEEEIRTTNPVATEQYGSVVVVVTTNQLNEQQGNNQA

SEQ ID NO: 120748 - protein, 36 aa, Artificial Sequence
  Description of Artificial Sequence: Synthetic polypeptide
AEEEIRTTNPVATEQYGSVVVVVTTNQLQTNTEEND

SEQ ID NO: 120749 - protein, 36 aa, Artificial Sequence
  Description of Artificial Sequence: Synthetic polypeptide
NEGEIRTTNPVATEQYGSTVWCTVNLSQPIGFSKRE

SEQ ID NO: 120750 - protein, 34 aa, Artificial Sequence
  Description of Artificial Sequence: Synthetic polypeptide
DESEIRTTNPVATACWGSVSCINVEPQDREGENG

SEQ ID NO: 120751 - protein, 32 aa, Artificial Sequence
  Description of Artificial Sequence: Synthetic polypeptide
DENEIATTNPVATEQWGSVASNPANPNPNGQP

SEQ ID NO: 120752 - protein, 33 aa, Artificial Sequence
  Description of Artificial Sequence: Synthetic polypeptide
DEECISTTNPVATEQYGCVCSTEHQNFNSDNQS

SEQ ID NO: 120753 - protein, 35 aa, Artificial Sequence
  Description of Artificial Sequence: Synthetic polypeptide
FEEEIRTTNPVATEQYGSVSGTDNGGDTNEENEGQ

SEQ ID NO: 120754 - protein, 29 aa, Artificial Sequence
  Description of Artificial Sequence: Synthetic peptide
NEEEIATTNPVATEQYGCACPWEDQHEEQ

SEQ ID NO: 120755 - protein, 31 aa, Artificial Sequence
  Description of Artificial Sequence: Synthetic polypeptide
DESEIRTTNPVATAHWGSVCTWEDRNTNGMD

SEQ ID NO: 120756 - protein, 36 aa, Artificial Sequence
  Description of Artificial Sequence: Synthetic polypeptide
FEEEIRTTNPVATEQYGSVSGTDNGGQTNDEENEGE

SEQ ID NO: 120757 - protein, 30 aa, Artificial Sequence
  Description of Artificial Sequence: Synthetic polypeptide
DESEIRSTNPVSTEGYGTMSMDIQQHNGNI

SEQ ID NO: 120758 - protein, 36 aa, Artificial Sequence
  Description of Artificial Sequence: Synthetic polypeptide
DEEEIRTTNPVATEQYGSVQLTPNTLVPNLQEVMPQ

SEQ ID NO: 120759 - protein, 34 aa, Artificial Sequence
  Description of Artificial Sequence: Synthetic polypeptide
DENEIRTTNPVATDQYGSVNTQLEHPRQAQNQDE

SEQ ID NO: 120760 - protein, 32 aa, Artificial Sequence
  Description of Artificial Sequence: Synthetic polypeptide
DEQEIATTNPVAYRQYGSVSATDLEDHEGEDL

SEQ ID NO: 120761 - protein, 31 aa, Artificial Sequence
  Description of Artificial Sequence: Synthetic polypeptide
DECEICTTNPVAYEQWGSVCWIEDLQAMDAR

SEQ ID NO: 120762 - protein, 34 aa, Artificial Sequence
  Description of Artificial Sequence: Synthetic polypeptide
DESEIRTTNPVATCCWGSRVSCQNEPQDREGENG

SEQ ID NO: 120763 - protein, 32 aa, Artificial Sequence
  Description of Artificial Sequence: Synthetic polypeptide
DENEIATTNPVATEQYGCVAANGGLAMNPENN

SEQ ID NO: 120764 - protein, 37 aa, Artificial Sequence
  Description of Artificial Sequence: Synthetic polypeptide
AEEEIRTTNPVATEQYGTVSTTNNNLQNGNQEGNNAE

SEQ ID NO: 120765 - protein, 35 aa, Artificial Sequence
  Description of Artificial Sequence: Synthetic polypeptide
DECEICTTNPVATEQYGVVSTVTDGNVEQGEGNND

SEQ ID NO: 120766 - protein, 36 aa, Artificial Sequence
  Description of Artificial Sequence: Synthetic polypeptide
AEEEIRTTNPVATEQYGTVSTVTNNQNGDEAGNEDI

SEQ ID NO: 120767 - protein, 32 aa, Artificial Sequence
  Description of Artificial Sequence: Synthetic polypeptide
NEEEIATTNPVATEQWGCVAGTMLQHTDDNPE

SEQ ID NO: 120768 - protein, 33 aa, Artificial Sequence
  Description of Artificial Sequence: Synthetic polypeptide
DENEIRTTNPVATDQYGSVNTQHEHPRQAQNED

SEQ ID NO: 120769 - protein, 34 aa, Artificial Sequence
  Description of Artificial Sequence: Synthetic polypeptide
DENEIATTNPVATEQYGCVAANNLQQENQGNEQL

SEQ ID NO: 120770 - protein, 36 aa, Artificial Sequence
  Description of Artificial Sequence: Synthetic polypeptide
AEEEIRTTNPVATEQYGTVSTVVNNLQQQNAEGTTE

SEQ ID NO: 120771 - protein, 32 aa, Artificial Sequence
  Description of Artificial Sequence: Synthetic polypeptide
DENEIATTNPVATEQYGCVAANPNDIQNQPNP

SEQ ID NO: 120772 - protein, 32 aa, Artificial Sequence
  Description of Artificial Sequence: Synthetic polypeptide
NEEEIATTNPVATAQWGSVSAGNPDEAGNNHK

SEQ ID NO: 120773 - protein, 34 aa, Artificial Sequence
  Description of Artificial Sequence: Synthetic polypeptide
FEEEIRTTNPVATEQYGSVSIDNDGGNENIDQGT

SEQ ID NO: 120774 - protein, 33 aa, Artificial Sequence
  Description of Artificial Sequence: Synthetic polypeptide
DENEIATTNPVATEQYGCVAATNDATMNPGERN

SEQ ID NO: 120775 - protein, 32 aa, Artificial Sequence
  Description of Artificial Sequence: Synthetic polypeptide
DENEIATTNPVATEQYGCVAATNDATMPGEGP

SEQ ID NO: 120776 - protein, 34 aa, Artificial Sequence
  Description of Artificial Sequence: Synthetic polypeptide
DEQEIATTNPVAYTIEQYGSVSATDLEDHEGEDL

SEQ ID NO: 120777 - protein, 32 aa, Artificial Sequence
  Description of Artificial Sequence: Synthetic polypeptide
NEEEIATTNPVATAQWGSVSAGNPDEAGNMEN

SEQ ID NO: 120778 - protein, 34 aa, Artificial Sequence
  Description of Artificial Sequence: Synthetic polypeptide
DESEIRTTNPVATECWGSVECINEPQDREGENWG

SEQ ID NO: 120779 - protein, 32 aa, Artificial Sequence
  Description of Artificial Sequence: Synthetic polypeptide
NEEEIATTNPVATAQWGSVSAGNGDEANNMRN

SEQ ID NO: 120780 - protein, 33 aa, Artificial Sequence
  Description of Artificial Sequence: Synthetic polypeptide
DESEIRTTNPVATCCWGSVSCINEPQDREGEFG

SEQ ID NO: 120781 - protein, 33 aa, Artificial Sequence
  Description of Artificial Sequence: Synthetic polypeptide
FEEEIRTTNPVATEQYGSVSIDNGGNEEIEDQQ

SEQ ID NO: 120782 - protein, 33 aa, Artificial Sequence
  Description of Artificial Sequence: Synthetic polypeptide
CEQEIATTNPVATEQYGSVSATDLLEDHNGEDL

SEQ ID NO: 120783 - protein, 33 aa, Artificial Sequence
  Description of Artificial Sequence: Synthetic polypeptide
DESEIRTTNPVATAHWGSVCTWEDQQRQEHGNK

SEQ ID NO: 120784 - protein, 33 aa, Artificial Sequence
  Description of Artificial Sequence: Synthetic polypeptide
DESEIRTTNPVATAHWGSVCTWEDQQRDQHGNA

SEQ ID NO: 120785 - protein, 35 aa, Artificial Sequence
  Description of Artificial Sequence: Synthetic polypeptide
FEEEIRTTNPVATEQYGSVSGDQNEMQGNGGEGDE

SEQ ID NO: 120786 - protein, 33 aa, Artificial Sequence
  Description of Artificial Sequence: Synthetic polypeptide
DESEIRTTNPVATACWGTVSAGNEPQDRGGENG

SEQ ID NO: 120787 - protein, 32 aa, Artificial Sequence
  Description of Artificial Sequence: Synthetic polypeptide
DESEIRSTNPVSTEPYGTISANEDIQQQVGNR

SEQ ID NO: 120788 - protein, 34 aa, Artificial Sequence
  Description of Artificial Sequence: Synthetic polypeptide
DENEIATTNPVATEQWGSVSANDPGAPANQEGNN

SEQ ID NO: 120789 - protein, 36 aa, Artificial Sequence
  Description of Artificial Sequence: Synthetic polypeptide
AEEEIRTTNPVATEQYGSVYTNNNQNGTEAGNTNSN

SEQ ID NO: 120790 - protein, 37 aa, Artificial Sequence
  Description of Artificial Sequence: Synthetic polypeptide
DEEEIRTTNPVATEQYGSVVTVVVTNLQQGTDEEEDE

SEQ ID NO: 120791 - protein, 33 aa, Artificial Sequence
  Description of Artificial Sequence: Synthetic polypeptide
DESEIRTTNPVATAHWGSVCSTWEDQQRDTNNM

SEQ ID NO: 120792 - protein, 34 aa, Artificial Sequence
  Description of Artificial Sequence: Synthetic polypeptide
DEECISTTNPVATEQYGCVCSTGEDQEFFGSNQS

SEQ ID NO: 120793 - protein, 32 aa, Artificial Sequence
  Description of Artificial Sequence: Synthetic polypeptide
DESEIRSTNPVSTEPYGNISANEDIQSRVGQR

SEQ ID NO: 120794 - protein, 31 aa, Artificial Sequence
  Description of Artificial Sequence: Synthetic polypeptide
DENEIATTNPVATEQWGSVSEIEMDAAGEDL

SEQ ID NO: 120795 - protein, 32 aa, Artificial Sequence
  Description of Artificial Sequence: Synthetic polypeptide
DESEIRTTNPVATAHWGSVCTWEDHQRTNNGM

SEQ ID NO: 120796 - protein, 32 aa, Artificial Sequence
  Description of Artificial Sequence: Synthetic polypeptide
DESEIRTTNPVATAHWGSVCTWEDQERNTNNM

SEQ ID NO: 120797 - protein, 33 aa, Artificial Sequence
  Description of Artificial Sequence: Synthetic polypeptide
DESEIRTTNPVATECWGSVGCINEPETREGENP

SEQ ID NO: 120798 - protein, 35 aa, Artificial Sequence
  Description of Artificial Sequence: Synthetic polypeptide
AEEEIRTTNPVATEQYGSVYTNNNQNGTEAGTTEE

SEQ ID NO: 120799 - protein, 35 aa, Artificial Sequence
  Description of Artificial Sequence: Synthetic polypeptide
AEEEIRTTNPVATEQYGSVYTNQNQNGTEAGTTQS

SEQ ID NO: 120800 - protein, 30 aa, Artificial Sequence
  Description of Artificial Sequence: Synthetic polypeptide
DENEIATTNPVATEQWGDVSEIEQNAAEDA

SEQ ID NO: 120801 - protein, 33 aa, Artificial Sequence
  Description of Artificial Sequence: Synthetic polypeptide
DEDEIACTNPVATEPYGSVAANLQDQGGGNDPH

SEQ ID NO: 120802 - protein, 33 aa, Artificial Sequence
  Description of Artificial Sequence: Synthetic polypeptide
EESEIRTTNPVAYEQWGYTISPNEGDQHRGNAR

SEQ ID NO: 120803 - protein, 35 aa, Artificial Sequence
  Description of Artificial Sequence: Synthetic polypeptide
DESEIRTTNPVATECWGSVFSCINEPQDREGENHG

SEQ ID NO: 120804 - protein, 35 aa, Artificial Sequence
  Description of Artificial Sequence: Synthetic polypeptide
DESEIRTTNPVATECWGSVESIINDEPQDREGENG

SEQ ID NO: 120805 - protein, 35 aa, Artificial Sequence
  Description of Artificial Sequence: Synthetic polypeptide
AEEEIRTTNPVATEQYGSVYTTNNQNGDEAGTEDE

SEQ ID NO: 120806 - protein, 35 aa, Artificial Sequence
  Description of Artificial Sequence: Synthetic polypeptide
AEEEIRTTNPVATEQYGSVYTTNNQQNNNDEANED

SEQ ID NO: 120807 - protein, 34 aa, Artificial Sequence
  Description of Artificial Sequence: Synthetic polypeptide
DENEIATTNPVATEQWGSVSMTGNDGNPQGDGPE

SEQ ID NO: 120808 - protein, 35 aa, Artificial Sequence
  Description of Artificial Sequence: Synthetic polypeptide
AEEEIRTTNPVATEQYGSVYTTNQQGNDEAGTEDT

SEQ ID NO: 120809 - protein, 35 aa, Artificial Sequence
  Description of Artificial Sequence: Synthetic polypeptide
AEEEIRTTNPVATEQYGSVYTVNNNQNGTEAGTTS

SEQ ID NO: 120810 - protein, 34 aa, Artificial Sequence
  Description of Artificial Sequence: Synthetic polypeptide
NEEEIATTNPVATEQYGSCPATHLEQPDDQGGRA

SEQ ID NO: 120811 - protein, 34 aa, Artificial Sequence
  Description of Artificial Sequence: Synthetic polypeptide
EESEIRTTNPVATECWGSVSCINEPQDREGENGN

SEQ ID NO: 120812 - protein, 31 aa, Artificial Sequence
  Description of Artificial Sequence: Synthetic polypeptide
DEDEIACTNPVATAQWGSVAAGNLFAATNNR

SEQ ID NO: 120813 - protein, 32 aa, Artificial Sequence
  Description of Artificial Sequence: Synthetic polypeptide
DESEIRTTNPVATAHWGSVCTWEDQHRTNGMS

SEQ ID NO: 120814 - protein, 29 aa, Artificial Sequence
  Description of Artificial Sequence: Synthetic peptide
NEEEIATTNPVATEQYGEYCPWVDQHEEQ

SEQ ID NO: 120815 - protein, 35 aa, Artificial Sequence
  Description of Artificial Sequence: Synthetic polypeptide
NEEEIATTNPVATEQYGCVANANNLPQEAPGENMR

SEQ ID NO: 120816 - protein, 35 aa, Artificial Sequence
  Description of Artificial Sequence: Synthetic polypeptide
DEAEICTTNPVATECYGSVSTGNGLQPDDGKKGEN

SEQ ID NO: 120817 - protein, 32 aa, Artificial Sequence
  Description of Artificial Sequence: Synthetic polypeptide
DENEIATTNPVATEPYGTISMEDIQQQRNGNH

SEQ ID NO: 120818 - protein, 35 aa, Artificial Sequence
  Description of Artificial Sequence: Synthetic polypeptide
DEEEIRTTNPVATEQYGSYEMVPNLPTMQEVSVRI

SEQ ID NO: 120819 - protein, 34 aa, Artificial Sequence
  Description of Artificial Sequence: Synthetic polypeptide
ENEEISTTNPVATTQWGSVSKTPNEPMERGGNTR

SEQ ID NO: 120820 - protein, 33 aa, Artificial Sequence
  Description of Artificial Sequence: Synthetic polypeptide
DESEIRTTNPAATECWGSVSCINEPQDREGEPG

SEQ ID NO: 120821 - protein, 35 aa, Artificial Sequence
  Description of Artificial Sequence: Synthetic polypeptide
DEAEICTTNPVATECYGSVSTGNVQNQGDTGGNEP

SEQ ID NO: 120822 - protein, 35 aa, Artificial Sequence
  Description of Artificial Sequence: Synthetic polypeptide
CEEEIATTNPVATEQYGSVCAANPLIEHPDGNQRQ

SEQ ID NO: 120823 - protein, 32 aa, Artificial Sequence
  Description of Artificial Sequence: Synthetic polypeptide
DESEIRTTNPIATECWGSCSKNEDAQGGGNTT

SEQ ID NO: 120824 - protein, 33 aa, Artificial Sequence
  Description of Artificial Sequence: Synthetic polypeptide
DESEIRTTNPVATECWGSVQCIHEPQDREGENG

SEQ ID NO: 120825 - protein, 35 aa, Artificial Sequence
  Description of Artificial Sequence: Synthetic polypeptide
DEAEICTTNPVATECYGSVSTGNVQQGDTGGNKES

SEQ ID NO: 120826 - protein, 30 aa, Artificial Sequence
  Description of Artificial Sequence: Synthetic polypeptide
DENEIATTNPVATECYGDVSAECLEDHEEL

SEQ ID NO: 120827 - protein, 30 aa, Artificial Sequence
  Description of Artificial Sequence: Synthetic polypeptide
DENEIRTTNPVATEGWGDVSEIIQNAAEDA

SEQ ID NO: 120828 - protein, 35 aa, Artificial Sequence
  Description of Artificial Sequence: Synthetic polypeptide
FEEEIRTTNPVATEQYGCVCSTGEHNQHFGSNTQS

SEQ ID NO: 120829 - protein, 29 aa, Artificial Sequence
  Description of Artificial Sequence: Synthetic peptide
FEEEIATTNPVATEQYGEAPEVCQHSEEK

SEQ ID NO: 120830 - protein, 32 aa, Artificial Sequence
  Description of Artificial Sequence: Synthetic polypeptide
DESEIRTTNPIATECWGSCSKNEDDQGGGNSP

SEQ ID NO: 120831 - protein, 34 aa, Artificial Sequence
  Description of Artificial Sequence: Synthetic polypeptide
DEQEIATTNPVATEQYGSVSSATDLEDHEGMEDV

SEQ ID NO: 120832 - protein, 37 aa, Artificial Sequence
  Description of Artificial Sequence: Synthetic polypeptide
AEEEIRTTNPVATEQYGSVVVTVTTNGNLQQGTNQIT

SEQ ID NO: 120833 - protein, 34 aa, Artificial Sequence
  Description of Artificial Sequence: Synthetic polypeptide
DEAEICTTNPVATECYGSVSTGVGGGQNRGGGEV

SEQ ID NO: 120834 - protein, 33 aa, Artificial Sequence
  Description of Artificial Sequence: Synthetic polypeptide
DESEIRTTNPIATECWGSVACINEPQDREGENG

SEQ ID NO: 120835 - protein, 37 aa, Artificial Sequence
  Description of Artificial Sequence: Synthetic polypeptide
DEEEIRTTNPVATEQYGSVPSTTPAEGSNTRNGGNPV

SEQ ID NO: 120836 - protein, 35 aa, Artificial Sequence
  Description of Artificial Sequence: Synthetic polypeptide
FEEEIRTTNPVATEQYGCVCSTGNDNQNFGSETQA

SEQ ID NO: 120837 - protein, 32 aa, Artificial Sequence
  Description of Artificial Sequence: Synthetic polypeptide
DENEIATTNPVATECYGDVSATDLEDHEGEDL

SEQ ID NO: 120838 - protein, 37 aa, Artificial Sequence
  Description of Artificial Sequence: Synthetic polypeptide
DEEEIRTTNPVATEQYGSVPSTTGAEGPNNRNGGNPV

SEQ ID NO: 120839 - protein, 34 aa, Artificial Sequence
  Description of Artificial Sequence: Synthetic polypeptide
DESEIRTTNPVATECWGSVSCCINEPQDREFENG

SEQ ID NO: 120840 - protein, 33 aa, Artificial Sequence
  Description of Artificial Sequence: Synthetic polypeptide
DESEIRTTNPIATECWGSVSCIDEPQDREGENG

SEQ ID NO: 120841 - protein, 35 aa, Artificial Sequence
  Description of Artificial Sequence: Synthetic polypeptide
DESEIRTTNPVATECWGSVPSCCPNHSQNREGENG

SEQ ID NO: 120842 - protein, 33 aa, Artificial Sequence
  Description of Artificial Sequence: Synthetic polypeptide
DECEICTTNPVATTQYGVVSTLAGNQIGTNTDE

SEQ ID NO: 120843 - protein, 30 aa, Artificial Sequence
  Description of Artificial Sequence: Synthetic polypeptide
DENEIATTNPVATECYGDVSCCEPQHEEEL

SEQ ID NO: 120844 - protein, 33 aa, Artificial Sequence
  Description of Artificial Sequence: Synthetic polypeptide
DEQEIATTNPVATEQYGSVSSATDLEDHEVEDL

SEQ ID NO: 120845 - protein, 35 aa, Artificial Sequence
  Description of Artificial Sequence: Synthetic polypeptide
DEEEIRTTNPVATEQYGSVPTPLNEQSPEFLVDDN

SEQ ID NO: 120846 - protein, 32 aa, Artificial Sequence
  Description of Artificial Sequence: Synthetic polypeptide
DESEIRTTNPVATECWGSVPCINEPQHEGEEG

SEQ ID NO: 120847 - protein, 34 aa, Artificial Sequence
  Description of Artificial Sequence: Synthetic polypeptide
DESEIRTTNPIATECWGSVSCINEPQDREGENGA

SEQ ID NO: 120848 - protein, 35 aa, Artificial Sequence
  Description of Artificial Sequence: Synthetic polypeptide
FEEEIRTTNPVATEQYGCVCSTGNHNQNFGSDTQM

SEQ ID NO: 120849 - protein, 34 aa, Artificial Sequence
  Description of Artificial Sequence: Synthetic polypeptide
DESEIRTTNPVATECWGSVQSCINEPQDRENENG

SEQ ID NO: 120850 - protein, 33 aa, Artificial Sequence
  Description of Artificial Sequence: Synthetic polypeptide
DESEIRTTNPIATECWGSVSCINWPAEREGENG

SEQ ID NO: 120851 - protein, 33 aa, Artificial Sequence
  Description of Artificial Sequence: Synthetic polypeptide
DEQEIATTNPVATEQYGSVSSATDGEDHEGEDV

SEQ ID NO: 120852 - protein, 31 aa, Artificial Sequence
  Description of Artificial Sequence: Synthetic polypeptide
DEAEIRTTNPVAYEQYGCICSTNTENFPSEQ

SEQ ID NO: 120853 - protein, 36 aa, Artificial Sequence
  Description of Artificial Sequence: Synthetic polypeptide
DEEEIRTTNPVATEQYGSWSSTTPAGPVMRNGMNPV

SEQ ID NO: 120854 - protein, 33 aa, Artificial Sequence
  Description of Artificial Sequence: Synthetic polypeptide
DENEIRTTNPVATECWGTVSMIDEQQDREGENG

SEQ ID NO: 120855 - protein, 34 aa, Artificial Sequence
  Description of Artificial Sequence: Synthetic polypeptide
DESEIRTTNPFATECWGSVSCINEPQDREGENIG

SEQ ID NO: 120856 - protein, 35 aa, Artificial Sequence
  Description of Artificial Sequence: Synthetic polypeptide
NEEEIRTTNPVATEQYGSVYTTDGLEFRIGDPQSH

SEQ ID NO: 120857 - protein, 36 aa, Artificial Sequence
  Description of Artificial Sequence: Synthetic polypeptide
DEEEIRTTNPVATEQYGSWSSTTPAGPNMRNGMNPV

SEQ ID NO: 120858 - protein, 36 aa, Artificial Sequence
  Description of Artificial Sequence: Synthetic polypeptide
AEEEIRTTNPVATEQYGSVVVVTNNQLGNEQGNEDE

SEQ ID NO: 120859 - protein, 33 aa, Artificial Sequence
  Description of Artificial Sequence: Synthetic polypeptide
DENEIRTTNPVATECWGTVSCINIPQDQEGENG

SEQ ID NO: 120860 - protein, 29 aa, Artificial Sequence
  Description of Artificial Sequence: Synthetic peptide
FEEEIATTNPVATEQYGEAPEVCQTHEEK

SEQ ID NO: 120861 - protein, 36 aa, Artificial Sequence
  Description of Artificial Sequence: Synthetic polypeptide
AEEEIRTTNPVATEQYGSVVVVTNNQLGNEQGNNVS

SEQ ID NO: 120862 - protein, 33 aa, Artificial Sequence
  Description of Artificial Sequence: Synthetic polypeptide
DESEIRTTNPGATECWGSMSCINEPQDREGENG

SEQ ID NO: 120863 - protein, 37 aa, Artificial Sequence
  Description of Artificial Sequence: Synthetic polypeptide
AEEEIRTTNPVATEQYGSVVVTVTTNNGNLQQGTNED

SEQ ID NO: 120864 - protein, 36 aa, Artificial Sequence
  Description of Artificial Sequence: Synthetic polypeptide
DEEEIRTTNPVATEQYGSWSSTTPAGHNMRNGMNPV

SEQ ID NO: 120865 - protein, 33 aa, Artificial Sequence
  Description of Artificial Sequence: Synthetic polypeptide
DEQEIATTNPVAYEQYGSVSATCDLEDHEGEDL

SEQ ID NO: 120866 - protein, 33 aa, Artificial Sequence
  Description of Artificial Sequence: Synthetic polypeptide
DESEIRTTNPGATECWGSVSCINEPQDREGEMG

SEQ ID NO: 120867 - protein, 30 aa, Artificial Sequence
  Description of Artificial Sequence: Synthetic polypeptide
DENEIRTTNPVATEGWGDVSEIEQNAAEDA

SEQ ID NO: 120868 - protein, 29 aa, Artificial Sequence
  Description of Artificial Sequence: Synthetic peptide
DENEIATTNPVATECYGDISECIQHNEEL

SEQ ID NO: 120869 - protein, 29 aa, Artificial Sequence
  Description of Artificial Sequence: Synthetic peptide
DENEIATTNPVATECYGDVAACLAHEEYL

SEQ ID NO: 120870 - protein, 35 aa, Artificial Sequence
  Description of Artificial Sequence: Synthetic polypeptide
DEAEICTTNPVATECYGSVSTGNQQQGDTGGNTTS

SEQ ID NO: 120871 - protein, 36 aa, Artificial Sequence
  Description of Artificial Sequence: Synthetic polypeptide
DEEEIRTTNPVATEQYGSWSSHTPAGPNMRNGMNPV

SEQ ID NO: 120872 - protein, 33 aa, Artificial Sequence
  Description of Artificial Sequence: Synthetic polypeptide
DESEIRTTNPAATECWGSVSCINEPQDRENENG

SEQ ID NO: 120873 - protein, 33 aa, Artificial Sequence
  Description of Artificial Sequence: Synthetic polypeptide
DENEIRTTNPVATECWGTVSCENIPQDQEGENG

SEQ ID NO: 120874 - protein, 34 aa, Artificial Sequence
  Description of Artificial Sequence: Synthetic polypeptide
FEEEIRTTNPVATEQYGAVVDNNNEEQEGGGNQG

SEQ ID NO: 120875 - protein, 36 aa, Artificial Sequence
  Description of Artificial Sequence: Synthetic polypeptide
AEEEIRTTNPVATEQYGSVVVVTTDNNNQQIGTNVD

SEQ ID NO: 120876 - protein, 35 aa, Artificial Sequence
  Description of Artificial Sequence: Synthetic polypeptide
FEEEIRTTNPVATEQYGAVVSGNIMNLDQEGQQDE

SEQ ID NO: 120877 - protein, 33 aa, Artificial Sequence
  Description of Artificial Sequence: Synthetic polypeptide
CEEEIATTNPVATEQYGSVCAAMNPLNDMDINN

SEQ ID NO: 120878 - protein, 33 aa, Artificial Sequence
  Description of Artificial Sequence: Synthetic polypeptide
DESEIRTTNPHATECWGSVICINEPQDREGENG

SEQ ID NO: 120879 - protein, 34 aa, Artificial Sequence
  Description of Artificial Sequence: Synthetic polypeptide
DECEICTTNPVATTQYGVVSTALQAGTEGGNDDN

SEQ ID NO: 120880 - protein, 36 aa, Artificial Sequence
  Description of Artificial Sequence: Synthetic polypeptide
AEEEIRTTNPVATEQYGSVVVTVTTNLNGTEQGNNQ

SEQ ID NO: 120881 - protein, 34 aa, Artificial Sequence
  Description of Artificial Sequence: Synthetic polypeptide
FEEEIRTTNPVATEQYGAVVTGGMDNLDEEFNEE

SEQ ID NO: 120882 - protein, 31 aa, Artificial Sequence
  Description of Artificial Sequence: Synthetic polypeptide
DENEIATTNPVATECYGDVCSECLVQFEEEL

SEQ ID NO: 120883 - protein, 36 aa, Artificial Sequence
  Description of Artificial Sequence: Synthetic polypeptide
DEEEIRTTNPVATEQYGSWSSTTPCGPNMRNGMNPV

SEQ ID NO: 120884 - protein, 32 aa, Artificial Sequence
  Description of Artificial Sequence: Synthetic polypeptide
DEQEIATTNPVAYEQYGSVSAVDLEDHEGEDL

SEQ ID NO: 120885 - protein, 35 aa, Artificial Sequence
  Description of Artificial Sequence: Synthetic polypeptide
DEAEIRTTNPVATEAYGCVVCTDNQQDQHEGDGNR

SEQ ID NO: 120886 - protein, 34 aa, Artificial Sequence
  Description of Artificial Sequence: Synthetic polypeptide
DEAEIRTTNPVATEAWGSVCSTWNDIDNNGNTDG

SEQ ID NO: 120887 - protein, 36 aa, Artificial Sequence
  Description of Artificial Sequence: Synthetic polypeptide
DEEEIRTTNPVATEQYGSVSENNIVDDTQQDINIQD

SEQ ID NO: 120888 - protein, 33 aa, Artificial Sequence
  Description of Artificial Sequence: Synthetic polypeptide
DESEIRTTNPAATECWGSVSCIFEPQDREGENG

SEQ ID NO: 120889 - protein, 36 aa, Artificial Sequence
  Description of Artificial Sequence: Synthetic polypeptide
DEEEIRTTNPVATEQYGSVVSWTNNVPPTQMVQEPD

SEQ ID NO: 120890 - protein, 34 aa, Artificial Sequence
  Description of Artificial Sequence: Synthetic polypeptide
DESEIRTTNPMATECWGSVSCINGEPQDREGENG

SEQ ID NO: 120891 - protein, 35 aa, Artificial Sequence
  Description of Artificial Sequence: Synthetic polypeptide
DEEEIRTTNPVATEQYGSVSENGNLEAPAELVEQE

SEQ ID NO: 120892 - protein, 33 aa, Artificial Sequence
  Description of Artificial Sequence: Synthetic polypeptide
DEEEIACTNPVATEQYGSVATGNPDNSEHNTID

SEQ ID NO: 120893 - protein, 33 aa, Artificial Sequence
  Description of Artificial Sequence: Synthetic polypeptide
DESEIRTTNPNATECWGSVPCINEPQDREGENG

SEQ ID NO: 120894 - protein, 37 aa, Artificial Sequence
  Description of Artificial Sequence: Synthetic polypeptide
AEEEIRTTNPVATEQYGSVVVVTTNLLGNQAGTNNDG

SEQ ID NO: 120895 - protein, 36 aa, Artificial Sequence
  Description of Artificial Sequence: Synthetic polypeptide
DEAEIRTTNPVATEAWGSVCSTMNNDHHERNGDQNR

SEQ ID NO: 120896 - protein, 33 aa, Artificial Sequence
  Description of Artificial Sequence: Synthetic polypeptide
DEEEIACTNPVATEQYGSVATGNPPNSEHNTMV

SEQ ID NO: 120897 - protein, 33 aa, Artificial Sequence
  Description of Artificial Sequence: Synthetic polypeptide
DEEEIRTTNPVATEQYGSVPVTEVGPEVLMQEL

SEQ ID NO: 120898 - protein, 33 aa, Artificial Sequence
  Description of Artificial Sequence: Synthetic polypeptide
DEQEIATTNPVAYEQYGCVAANGLDNRGENLHW

SEQ ID NO: 120899 - protein, 34 aa, Artificial Sequence
  Description of Artificial Sequence: Synthetic polypeptide
DEQEIATTNPVATEQYGSVSSATDLNMHEGMEPL

SEQ ID NO: 120900 - protein, 35 aa, Artificial Sequence
  Description of Artificial Sequence: Synthetic polypeptide
DEAEICTTNPVATECYGVVSTGNQMTQGDRGGNES

SEQ ID NO: 120901 - protein, 33 aa, Artificial Sequence
  Description of Artificial Sequence: Synthetic polypeptide
DESEIRTTNPVATECWGSVPCINEPQDNEGENG

SEQ ID NO: 120902 - protein, 35 aa, Artificial Sequence
  Description of Artificial Sequence: Synthetic polypeptide
DEEEIACTNPVATEQYGSACSATNPQQEAEIGNDF

SEQ ID NO: 120903 - protein, 33 aa, Artificial Sequence
  Description of Artificial Sequence: Synthetic polypeptide
DESEIRTTNPVATECWGSVPCINEPQDAEGENG

SEQ ID NO: 120904 - protein, 38 aa, Artificial Sequence
  Description of Artificial Sequence: Synthetic polypeptide
DEEEIRTTNPVATEQYGSVPSTNLNNVGVETAEMMLRL

SEQ ID NO: 120905 - protein, 34 aa, Artificial Sequence
  Description of Artificial Sequence: Synthetic polypeptide
FEEEIRTTNPVATEQYGDVSIDIMNGEDEGGNGP

SEQ ID NO: 120906 - protein, 36 aa, Artificial Sequence
  Description of Artificial Sequence: Synthetic polypeptide
DEAEIRTTNPVATEAWGSVCSTMNNDHERNGDSNRG

SEQ ID NO: 120907 - protein, 34 aa, Artificial Sequence
  Description of Artificial Sequence: Synthetic polypeptide
DEAEICTTNPVATECYGVVSTGNQPQGDTGGNEN

SEQ ID NO: 120908 - protein, 34 aa, Artificial Sequence
  Description of Artificial Sequence: Synthetic polypeptide
FEDEIRTTNPVATEQYGSVVGNVNDQAGEGGNGD

SEQ ID NO: 120909 - protein, 34 aa, Artificial Sequence
  Description of Artificial Sequence: Synthetic polypeptide
DESEIRTTNNVATECWGSVYSCINEPQDREGENV

SEQ ID NO: 120910 - protein, 34 aa, Artificial Sequence
  Description of Artificial Sequence: Synthetic polypeptide
FEEEIRTTNPVATEQYGDVSIDIMNGEDGGGNVG

SEQ ID NO: 120911 - protein, 34 aa, Artificial Sequence
  Description of Artificial Sequence: Synthetic polypeptide
FEEEIRTTNPVATEQYGDVSITGDEGQGGEGEII

SEQ ID NO: 120912 - protein, 35 aa, Artificial Sequence
  Description of Artificial Sequence: Synthetic polypeptide
FEEEIRTTNPVATEQYGDVSSILNGLGEGGQEGGG

SEQ ID NO: 120913 - protein, 34 aa, Artificial Sequence
  Description of Artificial Sequence: Synthetic polypeptide
FEEEIRTTNPVATEQYGDVVIGGLGQNEGGGNGG

SEQ ID NO: 120914 - protein, 35 aa, Artificial Sequence
  Description of Artificial Sequence: Synthetic polypeptide
DEEEIRTTNPVATEQYGSVYWTATNQGELVVVVED

SEQ ID NO: 120915 - protein, 32 aa, Artificial Sequence
  Description of Artificial Sequence: Synthetic polypeptide
DEEEIACTNPVATEQYGSVATGGLTDPDQEAQ

SEQ ID NO: 120916 - protein, 30 aa, Artificial Sequence
  Description of Artificial Sequence: Synthetic polypeptide
DENEIATTNPCSTEQWGDVSEIEQNAAGTR

SEQ ID NO: 120917 - protein, 35 aa, Artificial Sequence
  Description of Artificial Sequence: Synthetic polypeptide
DEAEICTTNPVATECYGVVSTGNQMNQGDRNGNEH

SEQ ID NO: 120918 - protein, 34 aa, Artificial Sequence
  Description of Artificial Sequence: Synthetic polypeptide
DECEICTTNPVATTQYGVVSTTALQQGTEQGNDT

SEQ ID NO: 120919 - protein, 30 aa, Artificial Sequence
  Description of Artificial Sequence: Synthetic polypeptide
DENEIATTNPCSTEQWGDVSCIEQNAAGTR

SEQ ID NO: 120920 - protein, 37 aa, Artificial Sequence
  Description of Artificial Sequence: Synthetic polypeptide
DEEEIRTTNPVATEQYGSVPSTNSNNLGVETQEMMEL

SEQ ID NO: 120921 - protein, 34 aa, Artificial Sequence
  Description of Artificial Sequence: Synthetic polypeptide
DEAEICTTNPVATECYGTVATGNGLQGDTGGNET

SEQ ID NO: 120922 - protein, 37 aa, Artificial Sequence
  Description of Artificial Sequence: Synthetic polypeptide
AEEEIRTTNPVATEQYGSVVVTVTQNGNLQAGTNIIN

SEQ ID NO: 120923 - protein, 30 aa, Artificial Sequence
  Description of Artificial Sequence: Synthetic polypeptide
DENEIATTNPCSSEPYGTISMNIQQQQGNR

SEQ ID NO: 120924 - protein, 34 aa, Artificial Sequence
  Description of Artificial Sequence: Synthetic polypeptide
DESEIRTTNPVATECWGSVPCINEPQDREGENDG

SEQ ID NO: 120925 - protein, 32 aa, Artificial Sequence
  Description of Artificial Sequence: Synthetic polypeptide
DEQEIATTNPVAYEQYGSTANNNLQTPADNPN

SEQ ID NO: 120926 - protein, 29 aa, Artificial Sequence
  Description of Artificial Sequence: Synthetic peptide
DENEIATTNPVATECYGDVSECEMNAEEA

SEQ ID NO: 120927 - protein, 34 aa, Artificial Sequence
  Description of Artificial Sequence: Synthetic polypeptide
DEEEIRTTNPVATEQYGSVPTTPGGEYSIASINP

SEQ ID NO: 120928 - protein, 33 aa, Artificial Sequence
  Description of Artificial Sequence: Synthetic polypeptide
DEEEIRTTNPVATEQYGSWSCDIPEQNNEVEPS

SEQ ID NO: 120929 - protein, 30 aa, Artificial Sequence
  Description of Artificial Sequence: Synthetic polypeptide
DENEIATTNPVATECYGDVSECIQQQHEEH

SEQ ID NO: 120930 - protein, 35 aa, Artificial Sequence
  Description of Artificial Sequence: Synthetic polypeptide
DEAEICTTNPVATECYGTVSTGNGLQGDTGGNTEP

SEQ ID NO: 120931 - protein, 34 aa, Artificial Sequence
  Description of Artificial Sequence: Synthetic polypeptide
DEQEIATTNPVATEQYGSVSSATDLNDHEGMEPL

SEQ ID NO: 120932 - protein, 34 aa, Artificial Sequence
  Description of Artificial Sequence: Synthetic polypeptide
DESEIRTTNPIATECWGSVWSCENEPQDREGNYG

SEQ ID NO: 120933 - protein, 34 aa, Artificial Sequence
  Description of Artificial Sequence: Synthetic polypeptide
DESEIRTTNPIATECWGSVWSCENEPQEREGNYG

SEQ ID NO: 120934 - protein, 36 aa, Artificial Sequence
  Description of Artificial Sequence: Synthetic polypeptide
AEEEIRTTNPVATEQYGSVVVVTTNGNLQAGTDEED

SEQ ID NO: 120935 - protein, 30 aa, Artificial Sequence
  Description of Artificial Sequence: Synthetic polypeptide
DENEIATTNPVATECYGDVSECLMNAAEDA

SEQ ID NO: 120936 - protein, 34 aa, Artificial Sequence
  Description of Artificial Sequence: Synthetic polypeptide
DESEIRTTNPIATECWGSVWSCINEPQDREGNYG

SEQ ID NO: 120937 - protein, 34 aa, Artificial Sequence
  Description of Artificial Sequence: Synthetic polypeptide
DEQEIATTNPVAYEQYGSVSCTDALSEDHEGENL

SEQ ID NO: 120938 - protein, 34 aa, Artificial Sequence
  Description of Artificial Sequence: Synthetic polypeptide
DEEEIRTTNPVATEQYGSWHHTTLEDHNDETYEQ

SEQ ID NO: 120939 - protein, 36 aa, Artificial Sequence
  Description of Artificial Sequence: Synthetic polypeptide
DEEEIRTTNPVATEQYGSWGSTTPAGPNMRNGMNPV

SEQ ID NO: 120940 - protein, 32 aa, Artificial Sequence
  Description of Artificial Sequence: Synthetic polypeptide
DENEIRTTNPVATECWGSVSEINEPMNAAENA

SEQ ID NO: 120941 - protein, 34 aa, Artificial Sequence
  Description of Artificial Sequence: Synthetic polypeptide
DEAEICTTNPVATECYGVVSTGGPLQGDTGGNTS

SEQ ID NO: 120942 - protein, 33 aa, Artificial Sequence
  Description of Artificial Sequence: Synthetic polypeptide
DESEIRTTNPAATECWGSVSCINEPQDFEGENG

SEQ ID NO: 120943 - protein, 35 aa, Artificial Sequence
  Description of Artificial Sequence: Synthetic polypeptide
DEAEICTTNPVATECYGVVSTGNGLLDDDRGQNSN

SEQ ID NO: 120944 - protein, 34 aa, Artificial Sequence
  Description of Artificial Sequence: Synthetic polypeptide
DEEEIACTNPVATEQYGSVATALTQNRMDEDTGM

SEQ ID NO: 120945 - protein, 36 aa, Artificial Sequence
  Description of Artificial Sequence: Synthetic polypeptide
DEEEIRTTNPVATEQYGSVSENNIVDDTQQDDVGQH

SEQ ID NO: 120946 - protein, 35 aa, Artificial Sequence
  Description of Artificial Sequence: Synthetic polypeptide
DEEEIRTTNPVATEQYGSVVSWNNGEHLVGEEVEY

SEQ ID NO: 120947 - protein, 34 aa, Artificial Sequence
  Description of Artificial Sequence: Synthetic polypeptide
DESEIRTTNPIATECWGSYVSCINEPQDREGENG

SEQ ID NO: 120948 - protein, 34 aa, Artificial Sequence
  Description of Artificial Sequence: Synthetic polypeptide
DECEICTTNPVATTQYGVVSTTANLQQGTEGGSD

SEQ ID NO: 120949 - protein, 34 aa, Artificial Sequence
  Description of Artificial Sequence: Synthetic polypeptide
FEEEIRTTNPVATEQYGDVVSIDIMNGEDEIGNE

SEQ ID NO: 120950 - protein, 37 aa, Artificial Sequence
  Description of Artificial Sequence: Synthetic polypeptide
DEEEIRTTNPVATEQYGSVVSTTPQGPNMGNGTNFVD

SEQ ID NO: 120951 - protein, 35 aa, Artificial Sequence
  Description of Artificial Sequence: Synthetic polypeptide
FEEEIRTTNPVATEQYGAVTSTGDNDQDEGGQTEG

SEQ ID NO: 120952 - protein, 35 aa, Artificial Sequence
  Description of Artificial Sequence: Synthetic polypeptide
DENEIRTTNPVATECYGSVSTEPALPQMRNEMEPV

SEQ ID NO: 120953 - protein, 33 aa, Artificial Sequence
  Description of Artificial Sequence: Synthetic polypeptide
FEEEIRTTNPVATEGYGSVSIDDMGENEGQGED

SEQ ID NO: 120954 - protein, 34 aa, Artificial Sequence
  Description of Artificial Sequence: Synthetic polypeptide
DEQEIATTNPVAYEQYGSVCAATNPLQEREVPDS

SEQ ID NO: 120955 - protein, 31 aa, Artificial Sequence
  Description of Artificial Sequence: Synthetic polypeptide
DEDEIACTNPVATEQYGCVATNLAIDDTDDV

SEQ ID NO: 120956 - protein, 33 aa, Artificial Sequence
  Description of Artificial Sequence: Synthetic polypeptide
DEDEIACTNPVATEQYGCVATNGLFQVRNEEFH

SEQ ID NO: 120957 - protein, 35 aa, Artificial Sequence
  Description of Artificial Sequence: Synthetic polypeptide
NEEEIRTTNPVATEQYGSVSTDTGVEEGGEGNQGV

SEQ ID NO: 120958 - protein, 35 aa, Artificial Sequence
  Description of Artificial Sequence: Synthetic polypeptide
AEEEIRTTNPVATEQYGSVVVVNTNDESGVTNQTV

SEQ ID NO: 120959 - protein, 35 aa, Artificial Sequence
  Description of Artificial Sequence: Synthetic polypeptide
FEEEIRSTNPVATEQYGSVSDDTENQNGQGEGGEG

SEQ ID NO: 120960 - protein, 33 aa, Artificial Sequence
  Description of Artificial Sequence: Synthetic polypeptide
FEEEIRTTNPVATEGYGSVSIDDMGQNDGQEED

SEQ ID NO: 120961 - protein, 35 aa, Artificial Sequence
  Description of Artificial Sequence: Synthetic polypeptide
DENEIRTTNPVATEFYGSVVDNNGLDQQRGQTGQG

SEQ ID NO: 120962 - protein, 33 aa, Artificial Sequence
  Description of Artificial Sequence: Synthetic polypeptide
FEEEIRTTNPVATEGYGSVSIDDMGQNEGGGEI

SEQ ID NO: 120963 - protein, 35 aa, Artificial Sequence
  Description of Artificial Sequence: Synthetic polypeptide
AEEEIRTTNPVATEQYGSVVVVNTNDESGVNNATE

SEQ ID NO: 120964 - protein, 36 aa, Artificial Sequence
  Description of Artificial Sequence: Synthetic polypeptide
AEEEIRTTNPVATEQYGSVVVVSTNNNTEQGNNTDD

SEQ ID NO: 120965 - protein, 34 aa, Artificial Sequence
  Description of Artificial Sequence: Synthetic polypeptide
FEEEIRTTNPVATEGYGSVSINDDPGQIEGQGED

SEQ ID NO: 120966 - protein, 34 aa, Artificial Sequence
  Description of Artificial Sequence: Synthetic polypeptide
FEEEIRTTNPVATEGYGSVSTGVGDDEGGEGNEA

SEQ ID NO: 120967 - protein, 36 aa, Artificial Sequence
  Description of Artificial Sequence: Synthetic polypeptide
FEEEIRTTNPVATEGYGSVSTMGVNEGQNVEGQNGI

SEQ ID NO: 120968 - protein, 35 aa, Artificial Sequence
  Description of Artificial Sequence: Synthetic polypeptide
FEEEIRTTNPVATEGYGSVSTMNGDDQLEGGGDEN

SEQ ID NO: 120969 - protein, 32 aa, Artificial Sequence
  Description of Artificial Sequence: Synthetic polypeptide
FEEEIRCTNPAATEQYGSVVSEGGMGGENDNG

SEQ ID NO: 120970 - protein, 33 aa, Artificial Sequence
  Description of Artificial Sequence: Synthetic polypeptide
DESEIRTTNPEATECWGSVKCINEPQDREGENG

SEQ ID NO: 120971 - protein, 38 aa, Artificial Sequence
  Description of Artificial Sequence: Synthetic polypeptide
AEEEIRTTNPVATEQYGSVVVVSTTNLNGNQAGTNNDE

SEQ ID NO: 120972 - protein, 35 aa, Artificial Sequence
  Description of Artificial Sequence: Synthetic polypeptide
DEEEIACTNPVATEQYGSVAAATNLTGAPDGSDRN

SEQ ID NO: 120973 - protein, 37 aa, Artificial Sequence
  Description of Artificial Sequence: Synthetic polypeptide
DEEEIRTTNPVATEQYGSVSTNVATEQYGSTDEQGQD

SEQ ID NO: 120974 - protein, 35 aa, Artificial Sequence
  Description of Artificial Sequence: Synthetic polypeptide
AEEEIRTTNPVATEQYGSVVVVNTNDESGTVNNTT

SEQ ID NO: 120975 - protein, 35 aa, Artificial Sequence
  Description of Artificial Sequence: Synthetic polypeptide
AEEEIRTTNPVATEQYGSVVVVTNDESGTVNNTTT

SEQ ID NO: 120976 - protein, 35 aa, Artificial Sequence
  Description of Artificial Sequence: Synthetic polypeptide
FEEEIRTTNPVATEGYGSVVNFDTNNDQEGGGNED

SEQ ID NO: 120977 - protein, 34 aa, Artificial Sequence
  Description of Artificial Sequence: Synthetic polypeptide
DESEIRTTNPCATCECWGSVSCINEPQDREGENG

SEQ ID NO: 120978 - protein, 37 aa, Artificial Sequence
  Description of Artificial Sequence: Synthetic polypeptide
DEEEIRTTNPVATEQYGSVSTNVATEQYGSTTDQQQD

SEQ ID NO: 120979 - protein, 33 aa, Artificial Sequence
  Description of Artificial Sequence: Synthetic polypeptide
DEECISTTNPVATEGYGCVCNTNPLQYFNSNQA

SEQ ID NO: 120980 - protein, 34 aa, Artificial Sequence
  Description of Artificial Sequence: Synthetic polypeptide
DESEIRTTNPVATECWGSVSANITEPQDREGEQG

SEQ ID NO: 120981 - protein, 34 aa, Artificial Sequence
  Description of Artificial Sequence: Synthetic polypeptide
FEEEIRTTNPVATEGYGDVSVDNLQNEMGEQDGE

SEQ ID NO: 120982 - protein, 34 aa, Artificial Sequence
  Description of Artificial Sequence: Synthetic polypeptide
DEQEIATTNPVAYEQYGSVCSTPNEQDAALTGDM

SEQ ID NO: 120983 - protein, 34 aa, Artificial Sequence
  Description of Artificial Sequence: Synthetic polypeptide
FEEEIRSTNPVATEQYGSVSINNDINGEGQENGE

SEQ ID NO: 120984 - protein, 36 aa, Artificial Sequence
  Description of Artificial Sequence: Synthetic polypeptide
DEEEIRTTNPVATEQYGSVPTDPSTMEPQQPQNDEL

SEQ ID NO: 120985 - protein, 37 aa, Artificial Sequence
  Description of Artificial Sequence: Synthetic polypeptide
DEEEIRTTNPVATEQYGSVPSYDNLMVAQSEMVEENV

SEQ ID NO: 120986 - protein, 32 aa, Artificial Sequence
  Description of Artificial Sequence: Synthetic polypeptide
DEEEIACTNPVATEQYGSVAITNDNNSETPTS

SEQ ID NO: 120987 - protein, 36 aa, Artificial Sequence
  Description of Artificial Sequence: Synthetic polypeptide
DEEEIRTTNPVATEQYGSVPTALNIEQNLEGEEIQD

SEQ ID NO: 120988 - protein, 34 aa, Artificial Sequence
  Description of Artificial Sequence: Synthetic polypeptide
DESEIRTTNPCATECWGSVPSCINEPQDREGENG

SEQ ID NO: 120989 - protein, 33 aa, Artificial Sequence
  Description of Artificial Sequence: Synthetic polypeptide
DENEIRTTNPVATECYGTISMEDIQQQRNGENG

SEQ ID NO: 120990 - protein, 36 aa, Artificial Sequence
  Description of Artificial Sequence: Synthetic polypeptide
DEEEIRTTNPVATEQYGSVPSWWPNVTLTQMVQEAD

SEQ ID NO: 120991 - protein, 34 aa, Artificial Sequence
  Description of Artificial Sequence: Synthetic polypeptide
DEAEIRTTNPVAYEQWGVVYTGGNGNQGEGNADR

SEQ ID NO: 120992 - protein, 38 aa, Artificial Sequence
  Description of Artificial Sequence: Synthetic polypeptide
AEEEIRTTNPVATEQYGSVVVVSNTNLEQGSEGGNTTS

SEQ ID NO: 120993 - protein, 33 aa, Artificial Sequence
  Description of Artificial Sequence: Synthetic polypeptide
DESEIRTTNPCATECWGSVSCIQEPQDREGENG

SEQ ID NO: 120994 - protein, 36 aa, Artificial Sequence
  Description of Artificial Sequence: Synthetic polypeptide
NEEEIRTTNPVATEQYGSVSPTSNMEMQEEGEEEVN

SEQ ID NO: 120995 - protein, 34 aa, Artificial Sequence
  Description of Artificial Sequence: Synthetic polypeptide
DEAEIRTTNPVATECWGSVSCINEPQSSDGENLG

SEQ ID NO: 120996 - protein, 36 aa, Artificial Sequence
  Description of Artificial Sequence: Synthetic polypeptide
NEEEIRTTNPVATEQYGSVSSTEPAGPNMRNGMNPV

SEQ ID NO: 120997 - protein, 33 aa, Artificial Sequence
  Description of Artificial Sequence: Synthetic polypeptide
DENEIATTNPVATAQYGSVCAPPNGLQTDDGGN

SEQ ID NO: 120998 - protein, 36 aa, Artificial Sequence
  Description of Artificial Sequence: Synthetic polypeptide
NEEEIRTTNPVATEQYGSVSSTTPAGPNMRNGMNPV

SEQ ID NO: 120999 - protein, 36 aa, Artificial Sequence
  Description of Artificial Sequence: Synthetic polypeptide
FEEEIRTTNPVATDQYGSVNSGTVNIEGQTGGQGNI

SEQ ID NO: 121000 - protein, 35 aa, Artificial Sequence
  Description of Artificial Sequence: Synthetic polypeptide
DECEICTTNPVATEQYGVVSVTVEQLQQGNNNQDD

SEQ ID NO: 121001 - protein, 35 aa, Artificial Sequence
  Description of Artificial Sequence: Synthetic polypeptide
AEEEIRTTNPVATEQYGSVVVVNTNNDESGVNNTV

SEQ ID NO: 121002 - protein, 30 aa, Artificial Sequence
  Description of Artificial Sequence: Synthetic polypeptide
DEAEIRTTNPVAYEQWGWVSWIEMRALEDA

SEQ ID NO: 121003 - protein, 34 aa, Artificial Sequence
  Description of Artificial Sequence: Synthetic polypeptide
FEEEIRTTNPVATEFYGSVSTGMDGQGGQEEEIS

SEQ ID NO: 121004 - protein, 33 aa, Artificial Sequence
  Description of Artificial Sequence: Synthetic polypeptide
DEEEIRTTNPVATEQYGSVPSVWEGWTDIIEVE

SEQ ID NO: 121005 - protein, 31 aa, Artificial Sequence
  Description of Artificial Sequence: Synthetic polypeptide
DENEIRTTNPVATECYGTISEEDIQQQNGEH

SEQ ID NO: 121006 - protein, 34 aa, Artificial Sequence
  Description of Artificial Sequence: Synthetic polypeptide
DEAEIRTTNPVATECWGSVSCINEPQDGYGENEN

SEQ ID NO: 121007 - protein, 36 aa, Artificial Sequence
  Description of Artificial Sequence: Synthetic polypeptide
AEEEIRTTNPVATEQYGSVVVVNTNDQSGTVNNSTM

SEQ ID NO: 121008 - protein, 33 aa, Artificial Sequence
  Description of Artificial Sequence: Synthetic polypeptide
DEEEIACTNPVATEQYGSVAITGNDNGAEGVDS

SEQ ID NO: 121009 - protein, 37 aa, Artificial Sequence
  Description of Artificial Sequence: Synthetic polypeptide
DEEEIRTTNPVATEQYGSVSTNVATEQYGATTQQAQD

SEQ ID NO: 121010 - protein, 33 aa, Artificial Sequence
  Description of Artificial Sequence: Synthetic polypeptide
DEDEIACTNPVATEQYGCVATNLQAAGGGEGAE

SEQ ID NO: 121011 - protein, 36 aa, Artificial Sequence
  Description of Artificial Sequence: Synthetic polypeptide
DEEEIACTNPVATEQYGSVACSGNNDIPQDNGENDR

SEQ ID NO: 121012 - protein, 34 aa, Artificial Sequence
  Description of Artificial Sequence: Synthetic polypeptide
DEAEIRTTNPVATECWGSVSCINEEPTVRDGENE

SEQ ID NO: 121013 - protein, 35 aa, Artificial Sequence
  Description of Artificial Sequence: Synthetic polypeptide
DENEIRTTNPVATEFYGSVGSTYGMGNQGGQENED

SEQ ID NO: 121014 - protein, 33 aa, Artificial Sequence
  Description of Artificial Sequence: Synthetic polypeptide
FEEEIRTTNPVATEGYGCTSIMNIGQGGQGGNE

SEQ ID NO: 121015 - protein, 33 aa, Artificial Sequence
  Description of Artificial Sequence: Synthetic polypeptide
DECEICTTNPVATTQYGVVATTQLQQGTEAGND

SEQ ID NO: 121016 - protein, 34 aa, Artificial Sequence
  Description of Artificial Sequence: Synthetic polypeptide
DEAEIRTTNPVATECWGSVCSTMDQDQHGQNGKQ

SEQ ID NO: 121017 - protein, 37 aa, Artificial Sequence
  Description of Artificial Sequence: Synthetic polypeptide
DEEEIRTTNPVATEQYGSVSTNVATEQYGSTTQETDE

SEQ ID NO: 121018 - protein, 35 aa, Artificial Sequence
  Description of Artificial Sequence: Synthetic polypeptide
DEAEICTTNPVATECYGSVSTGNQGNQGGHGNGNT

SEQ ID NO: 121019 - protein, 34 aa, Artificial Sequence
  Description of Artificial Sequence: Synthetic polypeptide
DESEIRTTNPEATECWGSVSCINEPQDREGENWG

SEQ ID NO: 121020 - protein, 36 aa, Artificial Sequence
  Description of Artificial Sequence: Synthetic polypeptide
AEEEIRTTNPVATEQYGSVVVTVTTNTNQQQGTNGQ

SEQ ID NO: 121021 - protein, 31 aa, Artificial Sequence
  Description of Artificial Sequence: Synthetic polypeptide
FEEEIGSVNPVSTEQYGVVSVNTQQQDGENQ

SEQ ID NO: 121022 - protein, 29 aa, Artificial Sequence
  Description of Artificial Sequence: Synthetic peptide
DENEIATTNPVATECWGDVSECLMAAEEL

SEQ ID NO: 121023 - protein, 33 aa, Artificial Sequence
  Description of Artificial Sequence: Synthetic polypeptide
DEEEIACTNPVATEQYGSVAITNPEPGQGMDEL

SEQ ID NO: 121024 - protein, 37 aa, Artificial Sequence
  Description of Artificial Sequence: Synthetic polypeptide
AEEEIRTTNPVATEQYGSVVVTVTTNNNNLQQGTNIQ

SEQ ID NO: 121025 - protein, 35 aa, Artificial Sequence
  Description of Artificial Sequence: Synthetic polypeptide
NEEEIRTTNPVATEQYGSVVCTRASSNNHGGNNED

SEQ ID NO: 121026 - protein, 34 aa, Artificial Sequence
  Description of Artificial Sequence: Synthetic polypeptide
DEECISTTNPVATEGYGCVCNTGNGLQHFGSNQS

SEQ ID NO: 121027 - protein, 37 aa, Artificial Sequence
  Description of Artificial Sequence: Synthetic polypeptide
DEEEIRTTNPVATEQYGSVSTNVATEQYGSVTQSGQE

SEQ ID NO: 121028 - protein, 34 aa, Artificial Sequence
  Description of Artificial Sequence: Synthetic polypeptide
DEQEIATTNPVATEQYGSVSITDDLEDEEGEDLD

SEQ ID NO: 121029 - protein, 35 aa, Artificial Sequence
  Description of Artificial Sequence: Synthetic polypeptide
NEEEIRTTNPVATEQYGSVSAGNEGEDEFGGNTTT

SEQ ID NO: 121030 - protein, 29 aa, Artificial Sequence
  Description of Artificial Sequence: Synthetic peptide
DENEIATTNPVATECWGDVSEILMAAEEL

SEQ ID NO: 121031 - protein, 33 aa, Artificial Sequence
  Description of Artificial Sequence: Synthetic polypeptide
DESEIRTTNPEATECWGSVSCINEPRDREGENG

SEQ ID NO: 121032 - protein, 31 aa, Artificial Sequence
  Description of Artificial Sequence: Synthetic polypeptide
DENEIATTNPVATECWGEASENEPQDRGEGG

SEQ ID NO: 121033 - protein, 32 aa, Artificial Sequence
  Description of Artificial Sequence: Synthetic polypeptide
DENEIRTTNPVATECYGDISMEDIQQQQNGNH

SEQ ID NO: 121034 - protein, 33 aa, Artificial Sequence
  Description of Artificial Sequence: Synthetic polypeptide
DEQEIATTNPVAYEQYGSVSAAEALQNNVAGPM

SEQ ID NO: 121035 - protein, 35 aa, Artificial Sequence
  Description of Artificial Sequence: Synthetic polypeptide
CEEEIATTNPVATEQYGSVANANNLPQEAPGENDV

SEQ ID NO: 121036 - protein, 36 aa, Artificial Sequence
  Description of Artificial Sequence: Synthetic polypeptide
DEEEIRTTNPVATEQYGSVPSTWMNLIPEVLEAIDI

SEQ ID NO: 121037 - protein, 35 aa, Artificial Sequence
  Description of Artificial Sequence: Synthetic polypeptide
DEAEICTTNPVATECYGSVSTGNQLQGDTGGGQEN

SEQ ID NO: 121038 - protein, 36 aa, Artificial Sequence
  Description of Artificial Sequence: Synthetic polypeptide
AEEEIRTTNPVATEQYGSVVVVTNNQLGNEAGVNNV

SEQ ID NO: 121039 - protein, 33 aa, Artificial Sequence
  Description of Artificial Sequence: Synthetic polypeptide
DESEIRTTNPFATECWGSASCINEPQDREGENG

SEQ ID NO: 121040 - protein, 36 aa, Artificial Sequence
  Description of Artificial Sequence: Synthetic polypeptide
DEAEICTTNPVATECYGSVSTGNQPLQGDTGGNTEN

SEQ ID NO: 121041 - protein, 34 aa, Artificial Sequence
  Description of Artificial Sequence: Synthetic polypeptide
DEECISTTNPVATEGYGQCVCNTNGLQRFGSDQS

SEQ ID NO: 121042 - protein, 34 aa, Artificial Sequence
  Description of Artificial Sequence: Synthetic polypeptide
FEEEIRTTNPVATEQYGAVSTGDDQQDEGGQSEF

SEQ ID NO: 121043 - protein, 35 aa, Artificial Sequence
  Description of Artificial Sequence: Synthetic polypeptide
DEAEICTTNPVATECYGSVSTGNQPNQGDTGGNEM

SEQ ID NO: 121044 - protein, 33 aa, Artificial Sequence
  Description of Artificial Sequence: Synthetic polypeptide
DEAEIRTTNPVATECWGSCSSINEQQVSDGENE

SEQ ID NO: 121045 - protein, 33 aa, Artificial Sequence
  Description of Artificial Sequence: Synthetic polypeptide
DESEIRTTNPFATECWGSVSCINEPQDREGECG

SEQ ID NO: 121046 - protein, 37 aa, Artificial Sequence
  Description of Artificial Sequence: Synthetic polypeptide
AEEEIRTTNPVATEQYGSVVVTVTTNNGNLQQGTNEI

SEQ ID NO: 121047 - protein, 37 aa, Artificial Sequence
  Description of Artificial Sequence: Synthetic polypeptide
DEEEIRTTNPVATEQYGSVSTNVATEQYGSVTQQMGD

SEQ ID NO: 121048 - protein, 35 aa, Artificial Sequence
  Description of Artificial Sequence: Synthetic polypeptide
FEEEIRTTNPVATEPYGSVVGFGNLQGTGGEGNQD

SEQ ID NO: 121049 - protein, 35 aa, Artificial Sequence
  Description of Artificial Sequence: Synthetic polypeptide
DEAEICTTNPVATECYGSVSTGNPVQGDTGGNKED

SEQ ID NO: 121050 - protein, 33 aa, Artificial Sequence
  Description of Artificial Sequence: Synthetic polypeptide
DEAEIRTTNPVAYEQYGCICSTNLEGFPSNTQS

SEQ ID NO: 121051 - protein, 37 aa, Artificial Sequence
  Description of Artificial Sequence: Synthetic polypeptide
DEEEIRTTNPVATEQYGSVSTNVATEQYGSTTQLDQD

SEQ ID NO: 121052 - protein, 37 aa, Artificial Sequence
  Description of Artificial Sequence: Synthetic polypeptide
DEEEIRTTNPVATEQYGSVSTNVATEQYGSTTQQPED

SEQ ID NO: 121053 - protein, 32 aa, Artificial Sequence
  Description of Artificial Sequence: Synthetic polypeptide
DEQEIATTNPVAYEQYGSVATNDTGTPDGSEN

SEQ ID NO: 121054 - protein, 33 aa, Artificial Sequence
  Description of Artificial Sequence: Synthetic polypeptide
FEEEIRCTNPAATEQYGSVPTDLQNIEGQGEGE

SEQ ID NO: 121055 - protein, 34 aa, Artificial Sequence
  Description of Artificial Sequence: Synthetic polypeptide
DESEIRTTNPVATECWGSVSACINEPQDREGESG

SEQ ID NO: 121056 - protein, 35 aa, Artificial Sequence
  Description of Artificial Sequence: Synthetic polypeptide
AEEEIRTTNPVATEQYGSVVVVATNLETGTTEAGT

SEQ ID NO: 121057 - protein, 35 aa, Artificial Sequence
  Description of Artificial Sequence: Synthetic polypeptide
FEEEIRATNPVATEQYGSVVTNTDGEQVGEGGNID

SEQ ID NO: 121058 - protein, 33 aa, Artificial Sequence
  Description of Artificial Sequence: Synthetic polypeptide
DESEIRTTNPVATECWGSVSACIDEQDHEGENG

SEQ ID NO: 121059 - protein, 33 aa, Artificial Sequence
  Description of Artificial Sequence: Synthetic polypeptide
FEEEIRTTNPVATEPYGSVVGFGNLTGEGEGED

SEQ ID NO: 121060 - protein, 33 aa, Artificial Sequence
  Description of Artificial Sequence: Synthetic polypeptide
DENEIRTTNPVATEGWGAVSPINEPQDREEENG

SEQ ID NO: 121061 - protein, 35 aa, Artificial Sequence
  Description of Artificial Sequence: Synthetic polypeptide
FEEEIRTTNPVATEPYGSVVGFGNNLQGEGEGNED

SEQ ID NO: 121062 - protein, 35 aa, Artificial Sequence
  Description of Artificial Sequence: Synthetic polypeptide
FEEEIRTTNPVATEPYGSVVGFGNNLQGGEEGNDD

SEQ ID NO: 121063 - protein, 34 aa, Artificial Sequence
  Description of Artificial Sequence: Synthetic polypeptide
FEEEIRTTNPVATEPYGSVVGFGNNLQGGGDGQD

SEQ ID NO: 121064 - protein, 35 aa, Artificial Sequence
  Description of Artificial Sequence: Synthetic polypeptide
FEEEIRTTNPVATEQYGAVDEDGEGNLDQGEGTNQ

SEQ ID NO: 121065 - protein, 34 aa, Artificial Sequence
  Description of Artificial Sequence: Synthetic polypeptide
DESEIRTTNPEATECWGSVSCINEPQDREGENEG

SEQ ID NO: 121066 - protein, 37 aa, Artificial Sequence
  Description of Artificial Sequence: Synthetic polypeptide
AEEEIRTTNPVATEQYGSVVVTVVTNGNLQQGTNQMD

SEQ ID NO: 121067 - protein, 33 aa, Artificial Sequence
  Description of Artificial Sequence: Synthetic polypeptide
DEECISTTNPVATEGYGCVCNTNPHQNFGSNQA

SEQ ID NO: 121068 - protein, 34 aa, Artificial Sequence
  Description of Artificial Sequence: Synthetic polypeptide
DESEIRTTNPEATECWGSVSCINEPQDREGENGY

SEQ ID NO: 121069 - protein, 35 aa, Artificial Sequence
  Description of Artificial Sequence: Synthetic polypeptide
FEEEIRTTNPVATEQYGAVISGTGQIGGQGGENGI

SEQ ID NO: 121070 - protein, 34 aa, Artificial Sequence
  Description of Artificial Sequence: Synthetic polypeptide
DEEEIACTNPVATEQYGSCAGTGNPDNRDGDNQM

SEQ ID NO: 121071 - protein, 34 aa, Artificial Sequence
  Description of Artificial Sequence: Synthetic polypeptide
FEEEIRTTNPVATEQYGAVISTGDDQDEGGEQEG

SEQ ID NO: 121072 - protein, 37 aa, Artificial Sequence
  Description of Artificial Sequence: Synthetic polypeptide
AEEEIRTTNPVATEQYGSVVVTVTTQQGNLQQGTNNI

SEQ ID NO: 121073 - protein, 32 aa, Artificial Sequence
  Description of Artificial Sequence: Synthetic polypeptide
DEAEIRTTNPVAYEQYGCICSTGELENSPSNQ

SEQ ID NO: 121074 - protein, 34 aa, Artificial Sequence
  Description of Artificial Sequence: Synthetic polypeptide
DEQEIATTNPVATEQYGSVSNTTDGEDQEGEDGD

SEQ ID NO: 121075 - protein, 35 aa, Artificial Sequence
  Description of Artificial Sequence: Synthetic polypeptide
DEEEIACTNPVATEQYGSCAATPTGLQDHPGENQR

SEQ ID NO: 121076 - protein, 34 aa, Artificial Sequence
  Description of Artificial Sequence: Synthetic polypeptide
DESEIRTTNPVATECWGSVSACDNEPQDFEGENG

SEQ ID NO: 121077 - protein, 33 aa, Artificial Sequence
  Description of Artificial Sequence: Synthetic polypeptide
DEECISTTNPVATEGYGCVCNTNGLQYFGSEQA

SEQ ID NO: 121078 - protein, 32 aa, Artificial Sequence
  Description of Artificial Sequence: Synthetic polypeptide
DEAEIRTTNPVAYEQYGCICSTNHENPSNTQA

SEQ ID NO: 121079 - protein, 37 aa, Artificial Sequence
  Description of Artificial Sequence: Synthetic polypeptide
AEEEIRTTNPVATEQYGSVVVTVTTQNGNLQQGTNIA

SEQ ID NO: 121080 - protein, 37 aa, Artificial Sequence
  Description of Artificial Sequence: Synthetic polypeptide
DEEEIRTTNPVATEQYGSVVSTTPAGPNMRNGMNPVW

SEQ ID NO: 121081 - protein, 35 aa, Artificial Sequence
  Description of Artificial Sequence: Synthetic polypeptide
DEAEICTTNPVATEEYGTVSTGNGLLDDDRGQNEN

SEQ ID NO: 121082 - protein, 36 aa, Artificial Sequence
  Description of Artificial Sequence: Synthetic polypeptide
DEAEICTTNPVATEFWGSVSTGNGLLQDDRGQNGEN

SEQ ID NO: 121083 - protein, 35 aa, Artificial Sequence
  Description of Artificial Sequence: Synthetic polypeptide
FEEEIRTTNPVATEQYGDVVSTGFGQTQGGQGNEF

SEQ ID NO: 121084 - protein, 34 aa, Artificial Sequence
  Description of Artificial Sequence: Synthetic polypeptide
FEEEIRTTNPVATEQYGSVGVTTMDNNGGGGGEG

SEQ ID NO: 121085 - protein, 30 aa, Artificial Sequence
  Description of Artificial Sequence: Synthetic polypeptide
DENEIATTNPVATEPYGEASMVIQQHNENH

SEQ ID NO: 121086 - protein, 31 aa, Artificial Sequence
  Description of Artificial Sequence: Synthetic polypeptide
DENEIATTNPVATEPYGEASMVIQQQHNGNH

SEQ ID NO: 121087 - protein, 34 aa, Artificial Sequence
  Description of Artificial Sequence: Synthetic polypeptide
FEEEIRTTNPVATEQYGSVINMGDGDQEEGGNIQ

SEQ ID NO: 121088 - protein, 32 aa, Artificial Sequence
  Description of Artificial Sequence: Synthetic polypeptide
DENEIATTNPVATEPYGSISATDIQEQQNGEL

SEQ ID NO: 121089 - protein, 37 aa, Artificial Sequence
  Description of Artificial Sequence: Synthetic polypeptide
DEEEIRTTNPVATEQYGSVVTNVATEQYGSVTQNGQD

SEQ ID NO: 121090 - protein, 34 aa, Artificial Sequence
  Description of Artificial Sequence: Synthetic polypeptide
DEEEIRTTNPVATEQYGSVSEEVYDIRAIEEEGY

SEQ ID NO: 121091 - protein, 29 aa, Artificial Sequence
  Description of Artificial Sequence: Synthetic peptide
DENEIRTTNPVATECWGDVSECEMAAEEL

SEQ ID NO: 121092 - protein, 35 aa, Artificial Sequence
  Description of Artificial Sequence: Synthetic polypeptide
DEEEIRTTNPVATEQYGSVSEEVVDSNNRNASNVS

SEQ ID NO: 121093 - protein, 33 aa, Artificial Sequence
  Description of Artificial Sequence: Synthetic polypeptide
NEEEIRTTNPVATEQYGCVCSSMELDEFFGSDQ

SEQ ID NO: 121094 - protein, 35 aa, Artificial Sequence
  Description of Artificial Sequence: Synthetic polypeptide
FEDEIRTTNPVATEQYGSVGGLTNVGQEGGGNDGG

SEQ ID NO: 121095 - protein, 36 aa, Artificial Sequence
  Description of Artificial Sequence: Synthetic polypeptide
AEEEIRTTNPVATEQYGSVVVVVTNNGNQAGNDEGQ

SEQ ID NO: 121096 - protein, 33 aa, Artificial Sequence
  Description of Artificial Sequence: Synthetic polypeptide
DEAEIRTTNPVATECWGSVSCIWEPQVSDGENE

SEQ ID NO: 121097 - protein, 37 aa, Artificial Sequence
  Description of Artificial Sequence: Synthetic polypeptide
AEEEIRTTNPVATEQYGSVVVTVTNNNNLQQGTNLIG

SEQ ID NO: 121098 - protein, 32 aa, Artificial Sequence
  Description of Artificial Sequence: Synthetic polypeptide
DENEIATTNPVATEPYGSISTEDIQQQQNGEL

SEQ ID NO: 121099 - protein, 32 aa, Artificial Sequence
  Description of Artificial Sequence: Synthetic polypeptide
DENEIRTTNPVATECWGDVSCIEPQDREGEDG

SEQ ID NO: 121100 - protein, 36 aa, Artificial Sequence
  Description of Artificial Sequence: Synthetic polypeptide
DEEEIRTTNPVATEQYGSVQCWISNNLGEPIPDERF

SEQ ID NO: 121101 - protein, 32 aa, Artificial Sequence
  Description of Artificial Sequence: Synthetic polypeptide
DENEIRTTNPVATECWGDVSCIEPQDRAGEDG

SEQ ID NO: 121102 - protein, 33 aa, Artificial Sequence
  Description of Artificial Sequence: Synthetic polypeptide
DEAEICTTNPVAYEQWGEVSTNDGNQGQAGNAT

SEQ ID NO: 121103 - protein, 35 aa, Artificial Sequence
  Description of Artificial Sequence: Synthetic polypeptide
DEEEIRTTNPVATEQYGSVPSEPPPGLIEVGVADP

SEQ ID NO: 121104 - protein, 33 aa, Artificial Sequence
  Description of Artificial Sequence: Synthetic polypeptide
DEAEIRTTNPVAYEQWGVVTGMNGDQRGGMNEQ

SEQ ID NO: 121105 - protein, 35 aa, Artificial Sequence
  Description of Artificial Sequence: Synthetic polypeptide
DEEEIRTTNPVATEQYGSVSEEPPEDEAMRIVNEH

SEQ ID NO: 121106 - protein, 30 aa, Artificial Sequence
  Description of Artificial Sequence: Synthetic polypeptide
DENEIRTTNPVATECWGDVSCIEMNAAENG

SEQ ID NO: 121107 - protein, 33 aa, Artificial Sequence
  Description of Artificial Sequence: Synthetic polypeptide
DESEIRTTNPVATECWGSVKCIEEPQDREGENG

SEQ ID NO: 121108 - protein, 33 aa, Artificial Sequence
  Description of Artificial Sequence: Synthetic polypeptide
DESEIRTTNPVAGECWGSVSCIQEPQDREGENG

SEQ ID NO: 121109 - protein, 33 aa, Artificial Sequence
  Description of Artificial Sequence: Synthetic polypeptide
NEEEIRTTNPVATEQYGCVCSAGNHTEFGSDQA

SEQ ID NO: 121110 - protein, 34 aa, Artificial Sequence
  Description of Artificial Sequence: Synthetic polypeptide
DESEIRTTNPVATECWGSVICCINEPQDREGENG

SEQ ID NO: 121111 - protein, 31 aa, Artificial Sequence
  Description of Artificial Sequence: Synthetic polypeptide
DENEIRTTNPVATECWGAVWSEDLQEHKEEL

SEQ ID NO: 121112 - protein, 29 aa, Artificial Sequence
  Description of Artificial Sequence: Synthetic peptide
DENEIASTNPVSTEPYGTMASTLQHNGDI

SEQ ID NO: 121113 - protein, 36 aa, Artificial Sequence
  Description of Artificial Sequence: Synthetic polypeptide
FEEEIRTTNPVATEQYGSVGNTGVNEGQNVEGQNGE

SEQ ID NO: 121114 - protein, 34 aa, Artificial Sequence
  Description of Artificial Sequence: Synthetic polypeptide
DESEIRTTNPVAGECWGSVSSCINEPQDREGENG

SEQ ID NO: 121115 - protein, 34 aa, Artificial Sequence
  Description of Artificial Sequence: Synthetic polypeptide
FEEEIRTTNPVATEQYGSVGGNNDGQNQTGGDGE

SEQ ID NO: 121116 - protein, 30 aa, Artificial Sequence
  Description of Artificial Sequence: Synthetic polypeptide
DENEIRTTNPVATECWGDVSEIEMNAAENG

SEQ ID NO: 121117 - protein, 31 aa, Artificial Sequence
  Description of Artificial Sequence: Synthetic polypeptide
DENEIRTTNPVATECWGDVSEIIEQNRAEDA

SEQ ID NO: 121118 - protein, 33 aa, Artificial Sequence
  Description of Artificial Sequence: Synthetic polypeptide
NEEEIRTTNPVATEQYGCVSWGNHDEFFGSDQA

SEQ ID NO: 121119 - protein, 37 aa, Artificial Sequence
  Description of Artificial Sequence: Synthetic polypeptide
AEEEIRTTNPVATEQYGSVVVVVTNLQQGTEGNNNGN

SEQ ID NO: 121120 - protein, 35 aa, Artificial Sequence
  Description of Artificial Sequence: Synthetic polypeptide
FEEEIRTTNPVATEQYGSVDNTDNINQNEGEGGET

SEQ ID NO: 121121 - protein, 33 aa, Artificial Sequence
  Description of Artificial Sequence: Synthetic polypeptide
DESEIRTTNPVAGECWGSVSCINEPQDRENENG

SEQ ID NO: 121122 - protein, 30 aa, Artificial Sequence
  Description of Artificial Sequence: Synthetic polypeptide
DENEIRTTNPVATECWGDVSEIEQNHAEDL

SEQ ID NO: 121123 - protein, 34 aa, Artificial Sequence
  Description of Artificial Sequence: Synthetic polypeptide
DECEICTTNPVATEQYGVVSTVTTGNPVEGEGND

SEQ ID NO: 121124 - protein, 34 aa, Artificial Sequence
  Description of Artificial Sequence: Synthetic polypeptide
DEEEIACTNPVATEQYGSACATNPLQQDSGGEAM

SEQ ID NO: 121125 - protein, 35 aa, Artificial Sequence
  Description of Artificial Sequence: Synthetic polypeptide
DENEIATTNPVATEIYGSVCSNWNDGQDRQGGGSR

SEQ ID NO: 121126 - protein, 30 aa, Artificial Sequence
  Description of Artificial Sequence: Synthetic polypeptide
DENEIRTTNPVATECWGDVSEIEQNHAEDA

SEQ ID NO: 121127 - protein, 33 aa, Artificial Sequence
  Description of Artificial Sequence: Synthetic polypeptide
NEEEIRTTNPVATEQYGCVSAEELDEFFGSDQS

SEQ ID NO: 121128 - protein, 33 aa, Artificial Sequence
  Description of Artificial Sequence: Synthetic polypeptide
DENEIATTNPVATEMWGSVAATANLENNANSRV

SEQ ID NO: 121129 - protein, 30 aa, Artificial Sequence
  Description of Artificial Sequence: Synthetic polypeptide
DENEIRTTNPVATECWGDVSEIEQNAAEDL

SEQ ID NO: 121130 - protein, 32 aa, Artificial Sequence
  Description of Artificial Sequence: Synthetic polypeptide
DEAEIRTTNPVAYEQYGQCICSTALENFPSNQ

SEQ ID NO: 121131 - protein, 35 aa, Artificial Sequence
  Description of Artificial Sequence: Synthetic polypeptide
FEEEIRTTNPVATEQYGSVDNTQDINQNEGQGNEN

SEQ ID NO: 121132 - protein, 30 aa, Artificial Sequence
  Description of Artificial Sequence: Synthetic polypeptide
DENEIATTNPVATEMWGSVAPPLDNNGEPA

SEQ ID NO: 121133 - protein, 30 aa, Artificial Sequence
  Description of Artificial Sequence: Synthetic polypeptide
DENEIRTTNPVATECWGDVSEIEMRAPEDA

SEQ ID NO: 121134 - protein, 35 aa, Artificial Sequence
  Description of Artificial Sequence: Synthetic polypeptide
FEEEIRTTNPVATEQYGSVDSDGDDEGEQGGGNGQ

SEQ ID NO: 121135 - protein, 29 aa, Artificial Sequence
  Description of Artificial Sequence: Synthetic peptide
DENEIRTTNPVATECWGDVSEIEMNHEEA

SEQ ID NO: 121136 - protein, 29 aa, Artificial Sequence
  Description of Artificial Sequence: Synthetic peptide
DENEIRTTNPVATECWGDVSEIEMNHEDA

SEQ ID NO: 121137 - protein, 29 aa, Artificial Sequence
  Description of Artificial Sequence: Synthetic peptide
DENEIRTTNPVATECWGDVSEIEMNAEDA

SEQ ID NO: 121138 - protein, 34 aa, Artificial Sequence
  Description of Artificial Sequence: Synthetic polypeptide
DESEIRTTNGVATECWGSVSCINEEPQDREGENG

SEQ ID NO: 121139 - protein, 30 aa, Artificial Sequence
  Description of Artificial Sequence: Synthetic polypeptide
DENEIATTNPVATEPYGDVSMECIQQHEEL

SEQ ID NO: 121140 - protein, 34 aa, Artificial Sequence
  Description of Artificial Sequence: Synthetic polypeptide
NEEEIRTTNPVATEQYGCVCSWGELDEFIGSNQA

SEQ ID NO: 121141 - protein, 36 aa, Artificial Sequence
  Description of Artificial Sequence: Synthetic polypeptide
DEEEIRTTNPVATEQYGSVPSEPPPLLIRVAVNDPQ

SEQ ID NO: 121142 - protein, 33 aa, Artificial Sequence
  Description of Artificial Sequence: Synthetic polypeptide
DESEIRTTNPVAGECWGSVSCINEPQDRESENG

SEQ ID NO: 121143 - protein, 36 aa, Artificial Sequence
  Description of Artificial Sequence: Synthetic polypeptide
AEEEIRTTNPVATEQYGSVVVTVTNNNNQQQGTNGQ

SEQ ID NO: 121144 - protein, 35 aa, Artificial Sequence
  Description of Artificial Sequence: Synthetic polypeptide
FEEEIRTTNPVATEQYGSVDTTQNADVGEGGNEEI

SEQ ID NO: 121145 - protein, 30 aa, Artificial Sequence
  Description of Artificial Sequence: Synthetic polypeptide
DENEIATTNPVATEPYGEASMVCQQHNEEH

SEQ ID NO: 121146 - protein, 30 aa, Artificial Sequence
  Description of Artificial Sequence: Synthetic polypeptide
DENEIRTTNPVATECWGDVSEIEMNAAENA

SEQ ID NO: 121147 - protein, 35 aa, Artificial Sequence
  Description of Artificial Sequence: Synthetic polypeptide
FEDEIRTTNPVATEQYGSVNITNGMEQNNIGGGNF

SEQ ID NO: 121148 - protein, 36 aa, Artificial Sequence
  Description of Artificial Sequence: Synthetic polypeptide
FEEEIRTTNPVATEQYGSVISTVNGFGQENQGEIGG

SEQ ID NO: 121149 - protein, 32 aa, Artificial Sequence
  Description of Artificial Sequence: Synthetic polypeptide
DENEIATTNPVATEPYGSVSAPPANDNPNGQP

SEQ ID NO: 121150 - protein, 34 aa, Artificial Sequence
  Description of Artificial Sequence: Synthetic polypeptide
DESEIRTTNGVATECWGMSVSCINEPQDREGENG

SEQ ID NO: 121151 - protein, 35 aa, Artificial Sequence
  Description of Artificial Sequence: Synthetic polypeptide
DEEEIRTTNPVATEQYGSVQENSAALIQETLEMDS

SEQ ID NO: 121152 - protein, 34 aa, Artificial Sequence
  Description of Artificial Sequence: Synthetic polypeptide
NEEEIRTTNPVATEQYGCSCSTEDHNQNFQSDQS

SEQ ID NO: 121153 - protein, 35 aa, Artificial Sequence
  Description of Artificial Sequence: Synthetic polypeptide
DEEEIRTTNPVATEQYGSVQEPEETGFEPQDNDRH

SEQ ID NO: 121154 - protein, 37 aa, Artificial Sequence
  Description of Artificial Sequence: Synthetic polypeptide
AEEEIRTTNPVATEQYGSVVVTVTNNGNLQQGTNEEG

SEQ ID NO: 121155 - protein, 33 aa, Artificial Sequence
  Description of Artificial Sequence: Synthetic polypeptide
ETEEIRTTNPVGTEQWGMTVSTNELVPIVGQVR

SEQ ID NO: 121156 - protein, 33 aa, Artificial Sequence
  Description of Artificial Sequence: Synthetic polypeptide
DEDEIACTNPVATEQYGCVATNLQQATEEPGAE

SEQ ID NO: 121157 - protein, 30 aa, Artificial Sequence
  Description of Artificial Sequence: Synthetic polypeptide
NEGEIAPTNPCSSEQYGEVSCNLQSGGDTR

SEQ ID NO: 121158 - protein, 36 aa, Artificial Sequence
  Description of Artificial Sequence: Synthetic polypeptide
FEEEIRTTNPVATEQYGSVMGTNIDQGGGEQQNGGG

SEQ ID NO: 121159 - protein, 34 aa, Artificial Sequence
  Description of Artificial Sequence: Synthetic polypeptide
DESEIRTTNGVATECWGCSVSCINEIQDREGENG

SEQ ID NO: 121160 - protein, 31 aa, Artificial Sequence
  Description of Artificial Sequence: Synthetic polypeptide
ETEEIATTNPCAYEPWGSVYFVELDQREGNR

SEQ ID NO: 121161 - protein, 33 aa, Artificial Sequence
  Description of Artificial Sequence: Synthetic polypeptide
DESEIRTTNGVAIECWGSVSCINEPQDREGENG

SEQ ID NO: 121162 - protein, 34 aa, Artificial Sequence
  Description of Artificial Sequence: Synthetic polypeptide
ETAEIATTNPVATEQYGSVSWNEGDLQDGQGNHM

SEQ ID NO: 121163 - protein, 30 aa, Artificial Sequence
  Description of Artificial Sequence: Synthetic polypeptide
DENEIATTNPVATEPYGTISEEVCQQQGEH

SEQ ID NO: 121164 - protein, 33 aa, Artificial Sequence
  Description of Artificial Sequence: Synthetic polypeptide
FEEEIRTTNPVATEQYGSVMNGMNGGGFNDTGA

SEQ ID NO: 121165 - protein, 31 aa, Artificial Sequence
  Description of Artificial Sequence: Synthetic polypeptide
DENEIATTNPVATEPYGTISEEVCQQQNGNH

SEQ ID NO: 121166 - protein, 33 aa, Artificial Sequence
  Description of Artificial Sequence: Synthetic polypeptide
ESETEIRTTNPVAYEQWGSVTTNLNHEDGNNGS

SEQ ID NO: 121167 - protein, 34 aa, Artificial Sequence
  Description of Artificial Sequence: Synthetic polypeptide
ENTEIATTNPVATENYGCVSTANGLNDTERGNER

SEQ ID NO: 121168 - protein, 32 aa, Artificial Sequence
  Description of Artificial Sequence: Synthetic polypeptide
ENETEIATTNPVAYEQWGSVSTNLNGEANDAS

SEQ ID NO: 121169 - protein, 33 aa, Artificial Sequence
  Description of Artificial Sequence: Synthetic polypeptide
DESEIRTTNPVAIECWGSVSCIREPQDREGENG

SEQ ID NO: 121170 - protein, 34 aa, Artificial Sequence
  Description of Artificial Sequence: Synthetic polypeptide
DESEIRTTNPVALECWGSVSCINAEPQDREGENG

SEQ ID NO: 121171 - protein, 36 aa, Artificial Sequence
  Description of Artificial Sequence: Synthetic polypeptide
DEEEIRTTNPVATEQYGSVYTMNGIEQMEMNAEEEL

SEQ ID NO: 121172 - protein, 33 aa, Artificial Sequence
  Description of Artificial Sequence: Synthetic polypeptide
DESEIRTTNGVAHECWGSVSCDNEPQGREGENG

SEQ ID NO: 121173 - protein, 33 aa, Artificial Sequence
  Description of Artificial Sequence: Synthetic polypeptide
DESEIRTTNPVANACWGSVSCINEPQDREGENG

SEQ ID NO: 121174 - protein, 28 aa, Artificial Sequence
  Description of Artificial Sequence: Synthetic peptide
DENEIASTNPVATEQWGDVSEIEMHEDI

SEQ ID NO: 121175 - protein, 31 aa, Artificial Sequence
  Description of Artificial Sequence: Synthetic polypeptide
DENEIATTNPVATEPYGTISMDLQQQQNGGH

SEQ ID NO: 121176 - protein, 35 aa, Artificial Sequence
  Description of Artificial Sequence: Synthetic polypeptide
DEEEIRTTNPVATEQYGSVQEPSNYGFERDVNDVH

SEQ ID NO: 121177 - protein, 33 aa, Artificial Sequence
  Description of Artificial Sequence: Synthetic polypeptide
ENEEISTTNPVATTQWGSVSKTWNPMEQQGGDR

SEQ ID NO: 121178 - protein, 33 aa, Artificial Sequence
  Description of Artificial Sequence: Synthetic polypeptide
DESEIRTTNPVANECWGSVSCINEPQDLEGENG

SEQ ID NO: 121179 - protein, 33 aa, Artificial Sequence
  Description of Artificial Sequence: Synthetic polypeptide
NEEEIRTTNPVATEQYGCSCSTEHQEYFQSDQS

SEQ ID NO: 121180 - protein, 34 aa, Artificial Sequence
  Description of Artificial Sequence: Synthetic polypeptide
FEEEIRTTNPVATEQYGSVITTDGGQDEEGGEGE

SEQ ID NO: 121181 - protein, 33 aa, Artificial Sequence
  Description of Artificial Sequence: Synthetic polypeptide
ETEEIRYTNPVATEQYGSNVCSANQAQNTGMTD

SEQ ID NO: 121182 - protein, 33 aa, Artificial Sequence
  Description of Artificial Sequence: Synthetic polypeptide
DESEIRTTNGVATECWGSVMCINEPQDREGENG

SEQ ID NO: 121183 - protein, 37 aa, Artificial Sequence
  Description of Artificial Sequence: Synthetic polypeptide
AEEEIRTTNPVATEQYGSVVVVVTNNLLQGNDEGNDT

SEQ ID NO: 121184 - protein, 32 aa, Artificial Sequence
  Description of Artificial Sequence: Synthetic polypeptide
ETTEIACTNPVATEQYGSVSWNEGERNGKQER

SEQ ID NO: 121185 - protein, 36 aa, Artificial Sequence
  Description of Artificial Sequence: Synthetic polypeptide
FEEEIRTTNPVATEQYGSVLWPFDLEEEQPGLNVRD

SEQ ID NO: 121186 - protein, 32 aa, Artificial Sequence
  Description of Artificial Sequence: Synthetic polypeptide
DEAEICTTNPVAYEQWGSVSGGGNHQGEGGDE

SEQ ID NO: 121187 - protein, 37 aa, Artificial Sequence
  Description of Artificial Sequence: Synthetic polypeptide
AEEEIRTTNPVATEQYGSVVVVVTNNLQNNEGGNDED

SEQ ID NO: 121188 - protein, 33 aa, Artificial Sequence
  Description of Artificial Sequence: Synthetic polypeptide
DESEIRTTNGVATECWGSVSCIGEPQDREGENG

SEQ ID NO: 121189 - protein, 37 aa, Artificial Sequence
  Description of Artificial Sequence: Synthetic polypeptide
AEEEIRTTNPVATEQYGSVVVTVTNNNGNLQQGTNIG

SEQ ID NO: 121190 - protein, 35 aa, Artificial Sequence
  Description of Artificial Sequence: Synthetic polypeptide
FEEEIRTTNPVATEQYGSVMGMDNDLQGEDNNGQG

SEQ ID NO: 121191 - protein, 37 aa, Artificial Sequence
  Description of Artificial Sequence: Synthetic polypeptide
AEEEIRTTNPVATEQYGSVVVVVTNNLQNNEGQNEEN

SEQ ID NO: 121192 - protein, 33 aa, Artificial Sequence
  Description of Artificial Sequence: Synthetic polypeptide
DENEIATTNPVATEPYGSVSATEDIQDHEGEDL

SEQ ID NO: 121193 - protein, 33 aa, Artificial Sequence
  Description of Artificial Sequence: Synthetic polypeptide
NEEEIRTTNPVATEQYGCSCSTGEDQHFQSDQA

SEQ ID NO: 121194 - protein, 33 aa, Artificial Sequence
  Description of Artificial Sequence: Synthetic polypeptide
DESEIRTTNPVAHECWGSVICINEPQDREGENG

SEQ ID NO: 121195 - protein, 33 aa, Artificial Sequence
  Description of Artificial Sequence: Synthetic polypeptide
DESEIRTTNPVAIECWGSVSCINEPQDGEGENG

SEQ ID NO: 121196 - protein, 29 aa, Artificial Sequence
  Description of Artificial Sequence: Synthetic peptide
DENEIASTNPVSTEGYGTMASTLQQQGDI

SEQ ID NO: 121197 - protein, 29 aa, Artificial Sequence
  Description of Artificial Sequence: Synthetic peptide
DENEIASTNPVSTEGYGTMASTLQHNGDI

SEQ ID NO: 121198 - protein, 36 aa, Artificial Sequence
  Description of Artificial Sequence: Synthetic polypeptide
AEEEIRTTNPVATEQYGSVVVVVTNNNGQTGEENDE

SEQ ID NO: 121199 - protein, 35 aa, Artificial Sequence
  Description of Artificial Sequence: Synthetic polypeptide
DEEEIRTTNPVATEQYGSVPSALQVNEDAMVEQRN

SEQ ID NO: 121200 - protein, 37 aa, Artificial Sequence
  Description of Artificial Sequence: Synthetic polypeptide
AEEEIRTTNPVATEQYGSVVVTVTNNGNLQQGTNIIA

SEQ ID NO: 121201 - protein, 34 aa, Artificial Sequence
  Description of Artificial Sequence: Synthetic polypeptide
FEEEIRTTNPVATEQYGSVMGMNNINVGGGNGQG

SEQ ID NO: 121202 - protein, 34 aa, Artificial Sequence
  Description of Artificial Sequence: Synthetic polypeptide
DESEIRTTNPVATECWGSVHSCINEFQDVEGENG

SEQ ID NO: 121203 - protein, 35 aa, Artificial Sequence
  Description of Artificial Sequence: Synthetic polypeptide
DEEEIRTTNPVATEQYGSVQDVTEEVDAEVGEERI

SEQ ID NO: 121204 - protein, 36 aa, Artificial Sequence
  Description of Artificial Sequence: Synthetic polypeptide
DEEEIRTTNPVATEQYGSVVTTGMNVETGETGGNET

SEQ ID NO: 121205 - protein, 33 aa, Artificial Sequence
  Description of Artificial Sequence: Synthetic polypeptide
DEEEIRTTNPVATEQYGSVQDVTEEVDESEEMI

SEQ ID NO: 121206 - protein, 31 aa, Artificial Sequence
  Description of Artificial Sequence: Synthetic polypeptide
DENEIATTNPVATEPYGTASMDIQQQHNGNH

SEQ ID NO: 121207 - protein, 30 aa, Artificial Sequence
  Description of Artificial Sequence: Synthetic polypeptide
DENEIASTNPVSTEGYGNAANTLQSRVGQR

SEQ ID NO: 121208 - protein, 31 aa, Artificial Sequence
  Description of Artificial Sequence: Synthetic polypeptide
DENEIATTNPVATEPYGTASMEDIQQQQGNK

SEQ ID NO: 121209 - protein, 35 aa, Artificial Sequence
  Description of Artificial Sequence: Synthetic polypeptide
FEEEIRTTNPVATEFYGSVSTGGGQGQGDGENGDA

SEQ ID NO: 121210 - protein, 31 aa, Artificial Sequence
  Description of Artificial Sequence: Synthetic polypeptide
DENEIATTNPVATEPYGTASMVIQQQHNGNH

SEQ ID NO: 121211 - protein, 35 aa, Artificial Sequence
  Description of Artificial Sequence: Synthetic polypeptide
FEEEIRTTNPVATEQYGSVMGTDNFGGQTTGEGEF

SEQ ID NO: 121212 - protein, 30 aa, Artificial Sequence
  Description of Artificial Sequence: Synthetic polypeptide
DENEIATTNPVATEPYGTISEDCQQQNEEH

SEQ ID NO: 121213 - protein, 33 aa, Artificial Sequence
  Description of Artificial Sequence: Synthetic polypeptide
DESEIRTTNPVAGECWGSVSCINEPQDREGEPG

SEQ ID NO: 121214 - protein, 37 aa, Artificial Sequence
  Description of Artificial Sequence: Synthetic polypeptide
AEEEIRTTNPVATEQYGSVVVVVTNLNQNEQGNVEDE

SEQ ID NO: 121215 - protein, 34 aa, Artificial Sequence
  Description of Artificial Sequence: Synthetic polypeptide
DESEIRTTNGVATECWGSVTSCINEPQDREGENG

SEQ ID NO: 121216 - protein, 32 aa, Artificial Sequence
  Description of Artificial Sequence: Synthetic polypeptide
DENEIRTTNPVATECWGSVSCIIEQDAAEENA

SEQ ID NO: 121217 - protein, 33 aa, Artificial Sequence
  Description of Artificial Sequence: Synthetic polypeptide
DESEIRTTNPQATECWGSVSCINEPQDREGELG

SEQ ID NO: 121218 - protein, 30 aa, Artificial Sequence
  Description of Artificial Sequence: Synthetic polypeptide
DENEIATTNPVATECYGETWSNEDWARGPI

SEQ ID NO: 121219 - protein, 34 aa, Artificial Sequence
  Description of Artificial Sequence: Synthetic polypeptide
DEQEIATTNPVAYEQWGTVSTNLNQGDAGGNSTG

SEQ ID NO: 121220 - protein, 35 aa, Artificial Sequence
  Description of Artificial Sequence: Synthetic polypeptide
DECEICTTNPVAVEQYGSVSTNNNNQLEQGTNQGQ

SEQ ID NO: 121221 - protein, 33 aa, Artificial Sequence
  Description of Artificial Sequence: Synthetic polypeptide
DESEIRTTNPVATECWGSVNCIFEPQDREGENG

SEQ ID NO: 121222 - protein, 35 aa, Artificial Sequence
  Description of Artificial Sequence: Synthetic polypeptide
DEEEIRTTNPVATEQYGSVQCILRASSNVGGNNET

SEQ ID NO: 121223 - protein, 35 aa, Artificial Sequence
  Description of Artificial Sequence: Synthetic polypeptide
DECEICTTNPVAVEQYGSVSTNNTNLEQGTTNTGT

SEQ ID NO: 121224 - protein, 31 aa, Artificial Sequence
  Description of Artificial Sequence: Synthetic polypeptide
DENEIRTTNPVATECWGSVSCIIEMNAAENA

SEQ ID NO: 121225 - protein, 35 aa, Artificial Sequence
  Description of Artificial Sequence: Synthetic polypeptide
DEEEIRTTNPVATEQYGSVYTWLPMAENEMNEVLL

SEQ ID NO: 121226 - protein, 35 aa, Artificial Sequence
  Description of Artificial Sequence: Synthetic polypeptide
FEEEIRTTNPVATEQYGDVYGTSNGEGQTGGGGNE

SEQ ID NO: 121227 - protein, 36 aa, Artificial Sequence
  Description of Artificial Sequence: Synthetic polypeptide
DECEICTTNPVATEQYGVVSTVTVGNLEQGEGNNDE

SEQ ID NO: 121228 - protein, 34 aa, Artificial Sequence
  Description of Artificial Sequence: Synthetic polypeptide
DEQEIATTNPVATEQYGSVSSATQDLEDMEGEDL

SEQ ID NO: 121229 - protein, 37 aa, Artificial Sequence
  Description of Artificial Sequence: Synthetic polypeptide
AEEEIRTTNPVATEQYGSVVVTVTNQGNLQQGTNQIN

SEQ ID NO: 121230 - protein, 34 aa, Artificial Sequence
  Description of Artificial Sequence: Synthetic polypeptide
DEEEIRTTNPVATEQYGSVQCNTMGEQPEEEVSI

SEQ ID NO: 121231 - protein, 35 aa, Artificial Sequence
  Description of Artificial Sequence: Synthetic polypeptide
DEEEIRTTNPVATEQYGSVYTWLPDALNTMNVVLE

SEQ ID NO: 121232 - protein, 33 aa, Artificial Sequence
  Description of Artificial Sequence: Synthetic polypeptide
DEQEIATTNPVATEQYGSVSSAWDLEDHEGEFL

SEQ ID NO: 121233 - protein, 35 aa, Artificial Sequence
  Description of Artificial Sequence: Synthetic polypeptide
DEEEIRTTNPVATEQYGSVYTWLPDALETMNIVTL

SEQ ID NO: 121234 - protein, 35 aa, Artificial Sequence
  Description of Artificial Sequence: Synthetic polypeptide
DECEICTTNPVAVEQYGSVSTNNTNNLEQGTNEGS

SEQ ID NO: 121235 - protein, 35 aa, Artificial Sequence
  Description of Artificial Sequence: Synthetic polypeptide
DEEEIRTTNPVATEQYGSVYTWLPDAENMMIPVLL

SEQ ID NO: 121236 - protein, 34 aa, Artificial Sequence
  Description of Artificial Sequence: Synthetic polypeptide
DESEIRTTNPTATECWGSTVSCINEPQDREGENG

SEQ ID NO: 121237 - protein, 32 aa, Artificial Sequence
  Description of Artificial Sequence: Synthetic polypeptide
DEQEIATTNPVAYEQWGSVVPTDNDIQDGEHG

SEQ ID NO: 121238 - protein, 31 aa, Artificial Sequence
  Description of Artificial Sequence: Synthetic polypeptide
DENEIRTTNPVATECWGSVSCIEMDAAEENG

SEQ ID NO: 121239 - protein, 34 aa, Artificial Sequence
  Description of Artificial Sequence: Synthetic polypeptide
DESEIRTTNPVATECWGSVMSCIREPQDREGENG

SEQ ID NO: 121240 - protein, 34 aa, Artificial Sequence
  Description of Artificial Sequence: Synthetic polypeptide
DESEIRTTNPVATECWGSVMSCINEPSDREGENG

SEQ ID NO: 121241 - protein, 35 aa, Artificial Sequence
  Description of Artificial Sequence: Synthetic polypeptide
FEEEIRTTNPVATEQYGMVSNMNLVGITGGFNGDG

SEQ ID NO: 121242 - protein, 35 aa, Artificial Sequence
  Description of Artificial Sequence: Synthetic polypeptide
DECEICTTNPVAVEQYGSVSTNNTTNLEQGTNTGE

SEQ ID NO: 121243 - protein, 37 aa, Artificial Sequence
  Description of Artificial Sequence: Synthetic polypeptide
AEEEIRTTNPVATEQYGSVVVVTTQNGNLQQGTNQIE

SEQ ID NO: 121244 - protein, 37 aa, Artificial Sequence
  Description of Artificial Sequence: Synthetic polypeptide
AEEEIRTTNPVATEQYGSVVVVTTTNLAGNQAGNNDT

SEQ ID NO: 121245 - protein, 34 aa, Artificial Sequence
  Description of Artificial Sequence: Synthetic polypeptide
DEQEIATTNPVATEQYGSVSSATPDLEDHEGEDV

SEQ ID NO: 121246 - protein, 36 aa, Artificial Sequence
  Description of Artificial Sequence: Synthetic polypeptide
DEEEIRTTNPVATEQYGSVPSPMTNGNTTQQEVLDQ

SEQ ID NO: 121247 - protein, 37 aa, Artificial Sequence
  Description of Artificial Sequence: Synthetic polypeptide
AEEEIRTTNPVATEQYGSVVVVTTNNLQQGNGNNATE

SEQ ID NO: 121248 - protein, 35 aa, Artificial Sequence
  Description of Artificial Sequence: Synthetic polypeptide
DEEEIRTTNPVATEQYGSVQATTMMLQITQEVEMT

SEQ ID NO: 121249 - protein, 32 aa, Artificial Sequence
  Description of Artificial Sequence: Synthetic polypeptide
DESEIRTTNPVATECWGSVPCINCPQHEGEEG

SEQ ID NO: 121250 - protein, 33 aa, Artificial Sequence
  Description of Artificial Sequence: Synthetic polypeptide
DENEIRTTNPVATEGYGCVCSWNHNQNFGSDQS

SEQ ID NO: 121251 - protein, 35 aa, Artificial Sequence
  Description of Artificial Sequence: Synthetic polypeptide
DEEEIRTTNPVATEQYGSVSEMVSNQNLLVELSEQ

SEQ ID NO: 121252 - protein, 35 aa, Artificial Sequence
  Description of Artificial Sequence: Synthetic polypeptide
DEQEIATTNPVATEQYGSVSSATPALEDHNGMNDV

SEQ ID NO: 121253 - protein, 34 aa, Artificial Sequence
  Description of Artificial Sequence: Synthetic polypeptide
DESEIRTTNPNATECWGSVSCINEPQDREGENPG

SEQ ID NO: 121254 - protein, 34 aa, Artificial Sequence
  Description of Artificial Sequence: Synthetic polypeptide
FEDEIRTTNPVATEQYGSVSTGMDGQGEEDNGGE

SEQ ID NO: 121255 - protein, 33 aa, Artificial Sequence
  Description of Artificial Sequence: Synthetic polypeptide
DESEIRTTNPNATECWGSVSCINEPRDREGENG

SEQ ID NO: 121256 - protein, 29 aa, Artificial Sequence
  Description of Artificial Sequence: Synthetic peptide
DENEIATTNPVATECYGDVSEIEMNAEEA

SEQ ID NO: 121257 - protein, 35 aa, Artificial Sequence
  Description of Artificial Sequence: Synthetic polypeptide
NEEEIRTTNPVATEQYGSTLSPTVVELEVERQGRT

SEQ ID NO: 121258 - protein, 32 aa, Artificial Sequence
  Description of Artificial Sequence: Synthetic polypeptide
DEAEICTTNPVATEMWGEVSTNNGDDRNNGDH

SEQ ID NO: 121259 - protein, 36 aa, Artificial Sequence
  Description of Artificial Sequence: Synthetic polypeptide
DECEICTTNPVAVEQYGSVSTNLNQNSEQGTTNVTE

SEQ ID NO: 121260 - protein, 36 aa, Artificial Sequence
  Description of Artificial Sequence: Synthetic polypeptide
AEEEIRTTNPVATEQYGSVVVTVTNQLGGNEQGNND

SEQ ID NO: 121261 - protein, 36 aa, Artificial Sequence
  Description of Artificial Sequence: Synthetic polypeptide
DEEEIRTTNPVATEQYGSVPWSSNIGGQLTQLVLLE

SEQ ID NO: 121262 - protein, 34 aa, Artificial Sequence
  Description of Artificial Sequence: Synthetic polypeptide
DESEIRTTNPPATECWGSVSCINEPQDREGENSG

SEQ ID NO: 121263 - protein, 33 aa, Artificial Sequence
  Description of Artificial Sequence: Synthetic polypeptide
DESEIRTTNPQAIECWGSVSCINEPQDREGENG

SEQ ID NO: 121264 - protein, 31 aa, Artificial Sequence
  Description of Artificial Sequence: Synthetic polypeptide
NEEEIRTTNPVAYEQWGSLSCFEHNQRQDIP

SEQ ID NO: 121265 - protein, 34 aa, Artificial Sequence
  Description of Artificial Sequence: Synthetic polypeptide
DEAEIRTTNPVAYEQWGVVVQITPNDQHHGGNER

SEQ ID NO: 121266 - protein, 34 aa, Artificial Sequence
  Description of Artificial Sequence: Synthetic polypeptide
DESEIRTTNNVATECWGSVSCINEPQDREGENGL

SEQ ID NO: 121267 - protein, 30 aa, Artificial Sequence
  Description of Artificial Sequence: Synthetic polypeptide
DENEIATTNPVATECYGDVSMECIQQHEEL

SEQ ID NO: 121268 - protein, 34 aa, Artificial Sequence
  Description of Artificial Sequence: Synthetic polypeptide
DEAEIRTTNPVATDCWGSVSVCINETQHRGGENM

SEQ ID NO: 121269 - protein, 33 aa, Artificial Sequence
  Description of Artificial Sequence: Synthetic polypeptide
DESEIRTTNPQATECWGSVSCINEPMDREGENG

SEQ ID NO: 121270 - protein, 34 aa, Artificial Sequence
  Description of Artificial Sequence: Synthetic polypeptide
DESEIRTTNMVATECWGSVSCINWEPQDREGENG

SEQ ID NO: 121271 - protein, 34 aa, Artificial Sequence
  Description of Artificial Sequence: Synthetic polypeptide
DEQEIATTNPVATEQYGSVSSATPDGNDHEGEDV

SEQ ID NO: 121272 - protein, 35 aa, Artificial Sequence
  Description of Artificial Sequence: Synthetic polypeptide
DEEEIRTTNPVATEQYGSVQAANEMVPVRGEQADE

SEQ ID NO: 121273 - protein, 35 aa, Artificial Sequence
  Description of Artificial Sequence: Synthetic polypeptide
DESEIRTTNPVATECWGSVNSCINEPQDREGENGK

SEQ ID NO: 121274 - protein, 34 aa, Artificial Sequence
  Description of Artificial Sequence: Synthetic polypeptide
DESEIRTTNPVATECWGSVNGCINEIQAREGENG

SEQ ID NO: 121275 - protein, 33 aa, Artificial Sequence
  Description of Artificial Sequence: Synthetic polypeptide
DESEIRTTNPVATECWGSVSCDNEPEDFEGENG

SEQ ID NO: 121276 - protein, 34 aa, Artificial Sequence
  Description of Artificial Sequence: Synthetic polypeptide
DESEIRTTNMVATECWGSVSCINGEPQDREGENG

SEQ ID NO: 121277 - protein, 35 aa, Artificial Sequence
  Description of Artificial Sequence: Synthetic polypeptide
DESEIRTTNPVATDQYGSVVNTQGLQQEEGGNEDI

SEQ ID NO: 121278 - protein, 34 aa, Artificial Sequence
  Description of Artificial Sequence: Synthetic polypeptide
DEQEIATTNPVATEQYGSVSSATPDLADHEGEDL

SEQ ID NO: 121279 - protein, 35 aa, Artificial Sequence
  Description of Artificial Sequence: Synthetic polypeptide
FEDEIRTTNPVATEQYGSVSNMQTDNNDEFGGNNE

SEQ ID NO: 121280 - protein, 37 aa, Artificial Sequence
  Description of Artificial Sequence: Synthetic polypeptide
AEEEIRTTNPVATEQYGSVVVTVTNQGNLQQGTNAIN

SEQ ID NO: 121281 - protein, 31 aa, Artificial Sequence
  Description of Artificial Sequence: Synthetic polypeptide
DENEIRTTNPVATEGYGDVAAEIIQSAAGDA

SEQ ID NO: 121282 - protein, 37 aa, Artificial Sequence
  Description of Artificial Sequence: Synthetic polypeptide
DEEEIRTTNPVATEQYGSVPSFDNLELDQSEMVEERL

SEQ ID NO: 121283 - protein, 35 aa, Artificial Sequence
  Description of Artificial Sequence: Synthetic polypeptide
FEEEIRTTNPVATEQYGSVDGGTNNMDEGGGGNNP

SEQ ID NO: 121284 - protein, 34 aa, Artificial Sequence
  Description of Artificial Sequence: Synthetic polypeptide
DESEIRTTNIVATECWGSVSCINEPQDREGENGC

SEQ ID NO: 121285 - protein, 32 aa, Artificial Sequence
  Description of Artificial Sequence: Synthetic polypeptide
DENEIRTTNPVATECWGDVSEINEQDRAEEDG

SEQ ID NO: 121286 - protein, 33 aa, Artificial Sequence
  Description of Artificial Sequence: Synthetic polypeptide
DESEIRTTNPVADECWGSVSCINEPQDRENENN

SEQ ID NO: 121287 - protein, 33 aa, Artificial Sequence
  Description of Artificial Sequence: Synthetic polypeptide
DESEIRTTNPVAEECWGSVHCINEPQDREGENG

SEQ ID NO: 121288 - protein, 34 aa, Artificial Sequence
  Description of Artificial Sequence: Synthetic polypeptide
DEQEIATTNPVATEQYGSVSSTTAGPEDHEGNPL

SEQ ID NO: 121289 - protein, 34 aa, Artificial Sequence
  Description of Artificial Sequence: Synthetic polypeptide
FEEEIRTTNPVATEQYGSVDGTNMDINGGEGQET

SEQ ID NO: 121290 - protein, 34 aa, Artificial Sequence
  Description of Artificial Sequence: Synthetic polypeptide
FEDEIRTTNPVATEQYGSVSINNDINGEGGENEP

SEQ ID NO: 121291 - protein, 33 aa, Artificial Sequence
  Description of Artificial Sequence: Synthetic polypeptide
FEDEIRTTNPVATEQYGSVNTQGMEQNIGGGEG

SEQ ID NO: 121292 - protein, 34 aa, Artificial Sequence
  Description of Artificial Sequence: Synthetic polypeptide
DESEIRTTNPVAEECWGSVSCINEPQDREGENNG

SEQ ID NO: 121293 - protein, 34 aa, Artificial Sequence
  Description of Artificial Sequence: Synthetic polypeptide
DESEIRTTNPVAEECWGSVSCINEPQDREGENYG

SEQ ID NO: 121294 - protein, 35 aa, Artificial Sequence
  Description of Artificial Sequence: Synthetic polypeptide
DEEEIRTTNPVATEQYGSVYTTDQFDEEELEGGGQ

SEQ ID NO: 121295 - protein, 36 aa, Artificial Sequence
  Description of Artificial Sequence: Synthetic polypeptide
DEEEIRTTNPVATEQYGSVYTPTDGDETTQSGQDNQ

SEQ ID NO: 121296 - protein, 30 aa, Artificial Sequence
  Description of Artificial Sequence: Synthetic polypeptide
DENEIRTTNPVATECWGDVSEILMNAAEDA

SEQ ID NO: 121297 - protein, 34 aa, Artificial Sequence
  Description of Artificial Sequence: Synthetic polypeptide
FEEEIRTTNPVATEQYGSVDINNGEGQNDEGGGI

SEQ ID NO: 121298 - protein, 35 aa, Artificial Sequence
  Description of Artificial Sequence: Synthetic polypeptide
FEDEIRTTNPVATEQYGSVNITNGMEQNNIGGGNG

SEQ ID NO: 121299 - protein, 34 aa, Artificial Sequence
  Description of Artificial Sequence: Synthetic polypeptide
DEQEIATTNPVATEQYGSVSSTTALEDHNGMEDL

SEQ ID NO: 121300 - protein, 34 aa, Artificial Sequence
  Description of Artificial Sequence: Synthetic polypeptide
DESEIRTTNPVAFECWGSVSCINEPQDREGENGC

SEQ ID NO: 121301 - protein, 33 aa, Artificial Sequence
  Description of Artificial Sequence: Synthetic polypeptide
DEAEICTTNPVATEQYGTVCSTTDGGVEFEGND

SEQ ID NO: 121302 - protein, 34 aa, Artificial Sequence
  Description of Artificial Sequence: Synthetic polypeptide
DESEIRTTNPVAFECWGSVSDCINEPQDREGENG

SEQ ID NO: 121303 - protein, 33 aa, Artificial Sequence
  Description of Artificial Sequence: Synthetic polypeptide
DEAEICTTNPVATEQYGTVSSATDGPVEEEGND

SEQ ID NO: 121304 - protein, 33 aa, Artificial Sequence
  Description of Artificial Sequence: Synthetic polypeptide
CEEEIATTNPVATEQYGSVCATGGLDNDNANDN

SEQ ID NO: 121305 - protein, 36 aa, Artificial Sequence
  Description of Artificial Sequence: Synthetic polypeptide
AEEEIRTTNPVATEQYGSVVVTVTNNQNQQQGTNGQ

SEQ ID NO: 121306 - protein, 35 aa, Artificial Sequence
  Description of Artificial Sequence: Synthetic polypeptide
NEEEIRTTNPVAYEQYGSVVSCAQNALSDEFGTNS

SEQ ID NO: 121307 - protein, 34 aa, Artificial Sequence
  Description of Artificial Sequence: Synthetic polypeptide
DESEIRTTNPVAGECWGSVSCINEPQDREGENQG

SEQ ID NO: 121308 - protein, 37 aa, Artificial Sequence
  Description of Artificial Sequence: Synthetic polypeptide
AEEEIRTTNPVATEQYGSVVVVVNTNLEQGSEGGTNY

SEQ ID NO: 121309 - protein, 38 aa, Artificial Sequence
  Description of Artificial Sequence: Synthetic polypeptide
AEEEIRTTNPVATEQYGSVVVVVSTNLGQQGNNQNTTE

SEQ ID NO: 121310 - protein, 36 aa, Artificial Sequence
  Description of Artificial Sequence: Synthetic polypeptide
AEEEIRTTNPVATEQYGSVVVVVTDQNNQQIGTNLE

SEQ ID NO: 121311 - protein, 33 aa, Artificial Sequence
  Description of Artificial Sequence: Synthetic polypeptide
DENEIATTNPVATECYGSVSTPAGNMHNEMNPL

SEQ ID NO: 121312 - protein, 33 aa, Artificial Sequence
  Description of Artificial Sequence: Synthetic polypeptide
DESEIRTTNPVADECWGSVSCINEPQDAEGENG

SEQ ID NO: 121313 - protein, 33 aa, Artificial Sequence
  Description of Artificial Sequence: Synthetic polypeptide
DESEIRTTNPVACECWGSVSCINEPQDLEGENG

SEQ ID NO: 121314 - protein, 34 aa, Artificial Sequence
  Description of Artificial Sequence: Synthetic polypeptide
DESEIRTTNPVACECWGSEVSCINEPQDREGENG

SEQ ID NO: 121315 - protein, 37 aa, Artificial Sequence
  Description of Artificial Sequence: Synthetic polypeptide
DEEEIRTTNPVATEQYGSVPSNNMDNQIGCTQNVPEN

SEQ ID NO: 121316 - protein, 37 aa, Artificial Sequence
  Description of Artificial Sequence: Synthetic polypeptide
AEEEIRTTNPVATEQYGSVVVVTTTNLQQGNGTNNTD

SEQ ID NO: 121317 - protein, 36 aa, Artificial Sequence
  Description of Artificial Sequence: Synthetic polypeptide
AEEEIRTTNPVATEQYGSVVVVTTTNNNQTGEENDE

SEQ ID NO: 121318 - protein, 35 aa, Artificial Sequence
  Description of Artificial Sequence: Synthetic polypeptide
FEEEIRTTNPVATEQYGMVSVGNFTGQGEGEENGN

SEQ ID NO: 121319 - protein, 34 aa, Artificial Sequence
  Description of Artificial Sequence: Synthetic polypeptide
DESEIRTTNPTATECWGSYVSCINEPQDREGENG

SEQ ID NO: 121320 - protein, 34 aa, Artificial Sequence
  Description of Artificial Sequence: Synthetic polypeptide
DECEICTTNPVAVEQYGSVSTNTNNAEQGTTNGQ

SEQ ID NO: 121321 - protein, 34 aa, Artificial Sequence
  Description of Artificial Sequence: Synthetic polypeptide
DESEIRTTNPVATECWGSVMSCINEPMDREGENG

SEQ ID NO: 121322 - protein, 31 aa, Artificial Sequence
  Description of Artificial Sequence: Synthetic polypeptide
DENEIASVNPVSTEPYGVVSDENLQQSNGNH

SEQ ID NO: 121323 - protein, 33 aa, Artificial Sequence
  Description of Artificial Sequence: Synthetic polypeptide
DESEIRTTNPVAAECWGSVSCINEPQDREGEFG

SEQ ID NO: 121324 - protein, 30 aa, Artificial Sequence
  Description of Artificial Sequence: Synthetic polypeptide
DENEIRTTNPVATEGYGDVAEIIQSAAEDA

SEQ ID NO: 121325 - protein, 33 aa, Artificial Sequence
  Description of Artificial Sequence: Synthetic polypeptide
DEAEIRTTNPVAYEQWGVVVITNDDQHHGGNEQ

SEQ ID NO: 121326 - protein, 35 aa, Artificial Sequence
  Description of Artificial Sequence: Synthetic polypeptide
FEEEIRTTNPVATEQYGNVMTGDDNTDQAEGGGNI

SEQ ID NO: 121327 - protein, 31 aa, Artificial Sequence
  Description of Artificial Sequence: Synthetic polypeptide
DENEIRTTNPVATECWGETTANENLAPKGPR

SEQ ID NO: 121328 - protein, 35 aa, Artificial Sequence
  Description of Artificial Sequence: Synthetic polypeptide
FEEEIRTTNPVATEQYGNVMTNGDEDQGNEGGNIG

SEQ ID NO: 121329 - protein, 34 aa, Artificial Sequence
  Description of Artificial Sequence: Synthetic polypeptide
DESEIRTTNPVANECWGSVSCINEPQDREGENGN

SEQ ID NO: 121330 - protein, 34 aa, Artificial Sequence
  Description of Artificial Sequence: Synthetic polypeptide
DEAEICTTNPVATEQYGCVATTNQGNQGEEQNDR

SEQ ID NO: 121331 - protein, 32 aa, Artificial Sequence
  Description of Artificial Sequence: Synthetic polypeptide
DENEIATTNPVATECYGSVSEPAGNMHNEMNL

SEQ ID NO: 121332 - protein, 37 aa, Artificial Sequence
  Description of Artificial Sequence: Synthetic polypeptide
AEEEIRTTNPVATEQYGSVVVVTVNNLGNQQGTNNDT

SEQ ID NO: 121333 - protein, 35 aa, Artificial Sequence
  Description of Artificial Sequence: Synthetic polypeptide
DEAEICTTNPVATEQYGSTVSCTLLSEDHEGGENH

SEQ ID NO: 121334 - protein, 34 aa, Artificial Sequence
  Description of Artificial Sequence: Synthetic polypeptide
DESEIRTTNPVATECWGSVLSCIHEPQDREGENG

SEQ ID NO: 121335 - protein, 34 aa, Artificial Sequence
  Description of Artificial Sequence: Synthetic polypeptide
DESEIRTTNPVATECWGSVLPCINEPQDREGENG

SEQ ID NO: 121336 - protein, 35 aa, Artificial Sequence
  Description of Artificial Sequence: Synthetic polypeptide
NEEEIRTTNPVATEQYGSGWSPTVVELEVELQQGR

SEQ ID NO: 121337 - protein, 34 aa, Artificial Sequence
  Description of Artificial Sequence: Synthetic polypeptide
DENEIATTNPVATECYGSVSTEPALPQMREMEPV

SEQ ID NO: 121338 - protein, 34 aa, Artificial Sequence
  Description of Artificial Sequence: Synthetic polypeptide
DESEIRTTNIVATECWGSVSFCINEPQDREGENG

SEQ ID NO: 121339 - protein, 34 aa, Artificial Sequence
  Description of Artificial Sequence: Synthetic polypeptide
DEQEIATTNPVATEQYGSVSSTTAGEDHNGMNDV

SEQ ID NO: 121340 - protein, 35 aa, Artificial Sequence
  Description of Artificial Sequence: Synthetic polypeptide
FEEEIRTTNPVATEQYGSCGSVTGDNGQGGEQGQI

SEQ ID NO: 121341 - protein, 35 aa, Artificial Sequence
  Description of Artificial Sequence: Synthetic polypeptide
DECEICTTNPVAVEQYGSVSTNTNNLEQGTTNIGE

SEQ ID NO: 121342 - protein, 35 aa, Artificial Sequence
  Description of Artificial Sequence: Synthetic polypeptide
FEEEIRTTNPVATEQYGSTTCTTLVQEMPQGTNPD

SEQ ID NO: 121343 - protein, 34 aa, Artificial Sequence
  Description of Artificial Sequence: Synthetic polypeptide
FEEEIRTTNPVATEQYGSVAPTWGMQIESQAGEQ

SEQ ID NO: 121344 - protein, 33 aa, Artificial Sequence
  Description of Artificial Sequence: Synthetic polypeptide
DESEIRTTNPVACECWGSCSCINEPQDREGENG

SEQ ID NO: 121345 - protein, 34 aa, Artificial Sequence
  Description of Artificial Sequence: Synthetic polypeptide
FEEEIRTTNPVATEQYGNVVDTMNGGQGGQEEIQ

SEQ ID NO: 121346 - protein, 34 aa, Artificial Sequence
  Description of Artificial Sequence: Synthetic polypeptide
DESEIRTTNPVATECWGSKSCINSEPQDREGEND

SEQ ID NO: 121347 - protein, 34 aa, Artificial Sequence
  Description of Artificial Sequence: Synthetic polypeptide
DENEIATTNPVATEQYGSVAMNGLTNPDNGDPRM

SEQ ID NO: 121348 - protein, 35 aa, Artificial Sequence
  Description of Artificial Sequence: Synthetic polypeptide
FEEEIRTTNPVATEQYGSVSTGVGDDEGGEGNINA

SEQ ID NO: 121349 - protein, 33 aa, Artificial Sequence
  Description of Artificial Sequence: Synthetic polypeptide
DESEIRTTNPVATECWGQVSCINEPQDRETENG

SEQ ID NO: 121350 - protein, 33 aa, Artificial Sequence
  Description of Artificial Sequence: Synthetic polypeptide
DESEIRTTNPVATECWGQVSCINEPQDREGEQG

SEQ ID NO: 121351 - protein, 30 aa, Artificial Sequence
  Description of Artificial Sequence: Synthetic polypeptide
DEDCIACTNPVAYEPWDYNVASNLQRGDNR

SEQ ID NO: 121352 - protein, 30 aa, Artificial Sequence
  Description of Artificial Sequence: Synthetic polypeptide
DEDCIACTNPVAYEPWDYSNANNLQRGDNR

SEQ ID NO: 121353 - protein, 34 aa, Artificial Sequence
  Description of Artificial Sequence: Synthetic polypeptide
DEEEIRTTNPVATEQYGSVRPFSSVVETGVVVVP

SEQ ID NO: 121354 - protein, 36 aa, Artificial Sequence
  Description of Artificial Sequence: Synthetic polypeptide
AEEEIRTTNPVATEQYGVVSTVNNDQQGEAEENEEG

SEQ ID NO: 121355 - protein, 32 aa, Artificial Sequence
  Description of Artificial Sequence: Synthetic polypeptide
DENEIATTNPVSTEPYGSVSTEDIQQDHNGEL

SEQ ID NO: 121356 - protein, 31 aa, Artificial Sequence
  Description of Artificial Sequence: Synthetic polypeptide
DENEIATTNPVSTEPYGSISTDIQEQQNGEL

SEQ ID NO: 121357 - protein, 30 aa, Artificial Sequence
  Description of Artificial Sequence: Synthetic polypeptide
DENEIRPTNPVATEQWGDVSEIEMNAAGDA

SEQ ID NO: 121358 - protein, 34 aa, Artificial Sequence
  Description of Artificial Sequence: Synthetic polypeptide
DESEIRTTNPVATECWGQVSCINEPQDREGENGG

SEQ ID NO: 121359 - protein, 38 aa, Artificial Sequence
  Description of Artificial Sequence: Synthetic polypeptide
DEEEIRTTNPVATEQYGSVVVVVTNLQGNQGIGNNEGT

SEQ ID NO: 121360 - protein, 35 aa, Artificial Sequence
  Description of Artificial Sequence: Synthetic polypeptide
DESEIRTTNPVATECWGQSVSCINEPQDREGLNEG

SEQ ID NO: 121361 - protein, 31 aa, Artificial Sequence
  Description of Artificial Sequence: Synthetic polypeptide
DENEIATTNPVSTEPYGNISMTIQQQQVGNH

SEQ ID NO: 121362 - protein, 34 aa, Artificial Sequence
  Description of Artificial Sequence: Synthetic polypeptide
DESEIRTTNPVATECWGQSVQCINEPQDREGENG

SEQ ID NO: 121363 - protein, 36 aa, Artificial Sequence
  Description of Artificial Sequence: Synthetic polypeptide
DEEEIRTTNPVATEQYGSVVVVGFGTENDQDEDGGT

SEQ ID NO: 121364 - protein, 30 aa, Artificial Sequence
  Description of Artificial Sequence: Synthetic polypeptide
DENEIATTNPVSTEPYGTASMNIQQQQGGH

SEQ ID NO: 121365 - protein, 32 aa, Artificial Sequence
  Description of Artificial Sequence: Synthetic polypeptide
CEEVIACTNPVATEQYGCVAATNLATMNPNRM

SEQ ID NO: 121366 - protein, 33 aa, Artificial Sequence
  Description of Artificial Sequence: Synthetic polypeptide
DESEIRTTNPVATECWGRASCINEPQDREGENG

SEQ ID NO: 121367 - protein, 33 aa, Artificial Sequence
  Description of Artificial Sequence: Synthetic polypeptide
DEQEIATTNPVATEQYGTVSATEDLEDHEGEDL

SEQ ID NO: 121368 - protein, 32 aa, Artificial Sequence
  Description of Artificial Sequence: Synthetic polypeptide
DENEIATTNPVSTEPYGTISCENLQQQSNGNH

SEQ ID NO: 121369 - protein, 33 aa, Artificial Sequence
  Description of Artificial Sequence: Synthetic polypeptide
HEQEIATTNPVATEQYGSVSATDLEDHEGEDLK

SEQ ID NO: 121370 - protein, 34 aa, Artificial Sequence
  Description of Artificial Sequence: Synthetic polypeptide
MEEEIRTTNPVATEQYGVVGSGNNDGQGEGGEQT

SEQ ID NO: 121371 - protein, 33 aa, Artificial Sequence
  Description of Artificial Sequence: Synthetic polypeptide
MEEEIRTTNPVATEQYGVVMDDEQGGGENGGTG

SEQ ID NO: 121372 - protein, 35 aa, Artificial Sequence
  Description of Artificial Sequence: Synthetic polypeptide
DEQEIATTNPVATEQYGSVSVTDLQEDYMGQEDES

SEQ ID NO: 121373 - protein, 35 aa, Artificial Sequence
  Description of Artificial Sequence: Synthetic polypeptide
MEEEIRTTNPVATEQYGVVNMGDNNGLQEGQGNIL

SEQ ID NO: 121374 - protein, 33 aa, Artificial Sequence
  Description of Artificial Sequence: Synthetic polypeptide
DESEIRTTNPVATECWGSQSCIPEPQDREGENG

SEQ ID NO: 121375 - protein, 37 aa, Artificial Sequence
  Description of Artificial Sequence: Synthetic polypeptide
AEEEIRTTNPVATEQYGVVSTVNLQLQQGQTNGNNAT

SEQ ID NO: 121376 - protein, 37 aa, Artificial Sequence
  Description of Artificial Sequence: Synthetic polypeptide
DEEEIRTTNPVATEQYGSVRSPMMTVINHRLNEQSGT

SEQ ID NO: 121377 - protein, 35 aa, Artificial Sequence
  Description of Artificial Sequence: Synthetic polypeptide
MEEEIRTTNPVATEQYGYVSNMNLGQTGEGQEGGD

SEQ ID NO: 121378 - protein, 33 aa, Artificial Sequence
  Description of Artificial Sequence: Synthetic polypeptide
HENEIRTTNPVATETYGSVSGNSLQQVHDTVPG

SEQ ID NO: 121379 - protein, 34 aa, Artificial Sequence
  Description of Artificial Sequence: Synthetic polypeptide
DESEIRTTNPVATECWGRVFSCINEPQDREGENG

SEQ ID NO: 121380 - protein, 29 aa, Artificial Sequence
  Description of Artificial Sequence: Synthetic peptide
DEDCIACTNPVAYEPPWGSIAQNDQRGNL

SEQ ID NO: 121381 - protein, 34 aa, Artificial Sequence
  Description of Artificial Sequence: Synthetic polypeptide
DESEIRTTNPVATECWGRSVSCINEPQDEEGENG

SEQ ID NO: 121382 - protein, 35 aa, Artificial Sequence
  Description of Artificial Sequence: Synthetic polypeptide
DESEIRTTNPVATECWGRSNVSCINEPQDREGENG

SEQ ID NO: 121383 - protein, 36 aa, Artificial Sequence
  Description of Artificial Sequence: Synthetic polypeptide
AEEEIRTTNPVATEQYGVVSTVNNNDEQSEGTNVAE

SEQ ID NO: 121384 - protein, 33 aa, Artificial Sequence
  Description of Artificial Sequence: Synthetic polypeptide
DESEIRTTNPVATECWGRVSCIGEPQDREGENG

SEQ ID NO: 121385 - protein, 35 aa, Artificial Sequence
  Description of Artificial Sequence: Synthetic polypeptide
DEEEIRTTNPVATEQYGSVQWMIENDDQAMNELMQ

SEQ ID NO: 121386 - protein, 37 aa, Artificial Sequence
  Description of Artificial Sequence: Synthetic polypeptide
AEEEIRTTNPVATEQYGVVSTVNLQLQQGNTNNNIAT

SEQ ID NO: 121387 - protein, 34 aa, Artificial Sequence
  Description of Artificial Sequence: Synthetic polypeptide
DESEIRTTNPVATECWGQHVSCINEPQDREGENG

SEQ ID NO: 121388 - protein, 36 aa, Artificial Sequence
  Description of Artificial Sequence: Synthetic polypeptide
DEEEIRTTNPVATEQYGSVQVTNENEENRALEFLRG

SEQ ID NO: 121389 - protein, 34 aa, Artificial Sequence
  Description of Artificial Sequence: Synthetic polypeptide
HEGEIRTTNPVATEQYGSVSTTLEDLTNENQVFY

SEQ ID NO: 121390 - protein, 33 aa, Artificial Sequence
  Description of Artificial Sequence: Synthetic polypeptide
DESEIRTTNPVATECWGSRSCINEPQDREDENG

SEQ ID NO: 121391 - protein, 34 aa, Artificial Sequence
  Description of Artificial Sequence: Synthetic polypeptide
HEGEIRTTNPVATEQYGSVSTLEDLTDFANQVFS

SEQ ID NO: 121392 - protein, 34 aa, Artificial Sequence
  Description of Artificial Sequence: Synthetic polypeptide
DECTICTTNPVATEQWGSVSTTNQGNNQQGTNTD

SEQ ID NO: 121393 - protein, 33 aa, Artificial Sequence
  Description of Artificial Sequence: Synthetic polypeptide
DEAEIRTTNPCATECYGSVATGNTGNAGETDNE

SEQ ID NO: 121394 - protein, 33 aa, Artificial Sequence
  Description of Artificial Sequence: Synthetic polypeptide
DESEIRTTNPVATECWGNVSCINEPQSRVGEQG

SEQ ID NO: 121395 - protein, 33 aa, Artificial Sequence
  Description of Artificial Sequence: Synthetic polypeptide
DEQEIATTNPVATEQYGVVQSATDLEDHEGEDL

SEQ ID NO: 121396 - protein, 33 aa, Artificial Sequence
  Description of Artificial Sequence: Synthetic polypeptide
DESEIRTTNPVATECWGNVSCINEPQSREGEQG

SEQ ID NO: 121397 - protein, 33 aa, Artificial Sequence
  Description of Artificial Sequence: Synthetic polypeptide
HEGEIRTTNPVATEQYGSVSDLEDLTFANQEFY

SEQ ID NO: 121398 - protein, 34 aa, Artificial Sequence
  Description of Artificial Sequence: Synthetic polypeptide
HEGEIRTTNPVATEQYGSVFSTTLEDLTFNQVFH

SEQ ID NO: 121399 - protein, 31 aa, Artificial Sequence
  Description of Artificial Sequence: Synthetic polypeptide
HEEEIRTTNPVATSMYGCVYATVASDQGGQG

SEQ ID NO: 121400 - protein, 36 aa, Artificial Sequence
  Description of Artificial Sequence: Synthetic polypeptide
AEEEIRTTNPVATEQYGVVSTVNDQAGNQQGNETAE

SEQ ID NO: 121401 - protein, 33 aa, Artificial Sequence
  Description of Artificial Sequence: Synthetic polypeptide
DEECISTTNPVAYEQWGESYSIDNEMQQPGDNR

SEQ ID NO: 121402 - protein, 34 aa, Artificial Sequence
  Description of Artificial Sequence: Synthetic polypeptide
DESEIRTTNPVATECWGNSVSCINEPQDREGEMG

SEQ ID NO: 121403 - protein, 36 aa, Artificial Sequence
  Description of Artificial Sequence: Synthetic polypeptide
AEEEIRTTNPVATESYGSVSTVNNSNGNQQGNGNNE

SEQ ID NO: 121404 - protein, 34 aa, Artificial Sequence
  Description of Artificial Sequence: Synthetic polypeptide
DESEIRTTNPVATECWGNVSCINEPQDREGENGW

SEQ ID NO: 121405 - protein, 30 aa, Artificial Sequence
  Description of Artificial Sequence: Synthetic polypeptide
DENEIRHTNPVATEQWGDVSEITMNAAEDA

SEQ ID NO: 121406 - protein, 35 aa, Artificial Sequence
  Description of Artificial Sequence: Synthetic polypeptide
AEEEIRTTNPVATEQYGVVSTVNGNQQNDTNNNDQ

SEQ ID NO: 121407 - protein, 35 aa, Artificial Sequence
  Description of Artificial Sequence: Synthetic polypeptide
DEEEIRTTNPVATEQYGSVQVTNINEENEAIEFNV

SEQ ID NO: 121408 - protein, 35 aa, Artificial Sequence
  Description of Artificial Sequence: Synthetic polypeptide
MEEEIRTTNPVGTEQYGSVSTTMGLMGEQGGFGET

SEQ ID NO: 121409 - protein, 31 aa, Artificial Sequence
  Description of Artificial Sequence: Synthetic polypeptide
DENEIATTNPVSTEPYGEISMENIQQQNGNH

SEQ ID NO: 121410 - protein, 33 aa, Artificial Sequence
  Description of Artificial Sequence: Synthetic polypeptide
DESEIRTTNPVATECWGPVSCINEPQDREHENG

SEQ ID NO: 121411 - protein, 36 aa, Artificial Sequence
  Description of Artificial Sequence: Synthetic polypeptide
AEEEIRTTNPVATEQYGVVVVVSTTTNLQQGTEQGV

SEQ ID NO: 121412 - protein, 34 aa, Artificial Sequence
  Description of Artificial Sequence: Synthetic polypeptide
DESEIRTTNPVATECWGPVSCINEPQDREGENGA

SEQ ID NO: 121413 - protein, 30 aa, Artificial Sequence
  Description of Artificial Sequence: Synthetic polypeptide
DENEIRPTNPVSSEPYGTISCDLQQQQGTR

SEQ ID NO: 121414 - protein, 33 aa, Artificial Sequence
  Description of Artificial Sequence: Synthetic polypeptide
HEMEIVTTNPVATEQYGTVCSATDGPNEFEGND

SEQ ID NO: 121415 - protein, 34 aa, Artificial Sequence
  Description of Artificial Sequence: Synthetic polypeptide
DECTICTTNPVATEQWGSVSTTNQGNQQGNNDEN

SEQ ID NO: 121416 - protein, 34 aa, Artificial Sequence
  Description of Artificial Sequence: Synthetic polypeptide
DESEIRTTNPVATECWGPSVSCINEPQDREGEWG

SEQ ID NO: 121417 - protein, 34 aa, Artificial Sequence
  Description of Artificial Sequence: Synthetic polypeptide
DEQEIATTNPVATEQYGVSVSATDLEDHEGEDLQ

SEQ ID NO: 121418 - protein, 32 aa, Artificial Sequence
  Description of Artificial Sequence: Synthetic polypeptide
HEGQIRCTNPVATEQYGSVWSKLEELRGQNNT

SEQ ID NO: 121419 - protein, 35 aa, Artificial Sequence
  Description of Artificial Sequence: Synthetic polypeptide
DESEIRTTNPVATECWGPSVSCINEPQDREGENGY

SEQ ID NO: 121420 - protein, 30 aa, Artificial Sequence
  Description of Artificial Sequence: Synthetic polypeptide
DENEIRPTNPVSTEQYGDVSCIEMNAAGDA

SEQ ID NO: 121421 - protein, 29 aa, Artificial Sequence
  Description of Artificial Sequence: Synthetic peptide
DENEIRPTNPVSTEQYGDVSCIEMNAETA

SEQ ID NO: 121422 - protein, 29 aa, Artificial Sequence
  Description of Artificial Sequence: Synthetic peptide
DENEIATTNPVSTEPYGDISECIQQNGEL

SEQ ID NO: 121423 - protein, 36 aa, Artificial Sequence
  Description of Artificial Sequence: Synthetic polypeptide
AEEEIRTTNPVATEQYGVVSTVNLLQQNNNVEQGTE

SEQ ID NO: 121424 - protein, 33 aa, Artificial Sequence
  Description of Artificial Sequence: Synthetic polypeptide
HEMEIRTTNPVATEPYGSVCHNQMLLTRGGQEE

SEQ ID NO: 121425 - protein, 35 aa, Artificial Sequence
  Description of Artificial Sequence: Synthetic polypeptide
AEEEIRTTNPVATESYGSVSTVQSNNNSEEGTNNQ

SEQ ID NO: 121426 - protein, 35 aa, Artificial Sequence
  Description of Artificial Sequence: Synthetic polypeptide
DEEEIRTTNPVATEQYGSVWSYASLEAQSTQLEEN

SEQ ID NO: 121427 - protein, 32 aa, Artificial Sequence
  Description of Artificial Sequence: Synthetic polypeptide
CEEVIACTNPVATEQYGCVAGTNLATMLGENN

SEQ ID NO: 121428 - protein, 29 aa, Artificial Sequence
  Description of Artificial Sequence: Synthetic peptide
IEEEIATTNPVATEQYGEAPEVCQHEEKK

SEQ ID NO: 121429 - protein, 32 aa, Artificial Sequence
  Description of Artificial Sequence: Synthetic polypeptide
DENEIATTNPVSTEPYGTVSMENIQQQQNGNH

SEQ ID NO: 121430 - protein, 34 aa, Artificial Sequence
  Description of Artificial Sequence: Synthetic polypeptide
DEQEIATTNPVATEQYGTVCSATDGLVEFEGNDD

SEQ ID NO: 121431 - protein, 32 aa, Artificial Sequence
  Description of Artificial Sequence: Synthetic polypeptide
DENEIATTNPVSTEPYGTVSMEDLQQDQNGNH

SEQ ID NO: 121432 - protein, 32 aa, Artificial Sequence
  Description of Artificial Sequence: Synthetic polypeptide
DENEIATTNPVSTEPYGTVSMEDLQQDHNGNH

SEQ ID NO: 121433 - protein, 37 aa, Artificial Sequence
  Description of Artificial Sequence: Synthetic polypeptide
AEEEIRTTNPVATEQYGVVSTVNQQLQQGTEAGNTDD

SEQ ID NO: 121434 - protein, 31 aa, Artificial Sequence
  Description of Artificial Sequence: Synthetic polypeptide
DENEIATTNPVSTEPYGTVSMDLQQQQNENH

SEQ ID NO: 121435 - protein, 37 aa, Artificial Sequence
  Description of Artificial Sequence: Synthetic polypeptide
AEEEIRTTNPVATEQYGVVSTVNQNLNQLQIGTNTEQ

SEQ ID NO: 121436 - protein, 36 aa, Artificial Sequence
  Description of Artificial Sequence: Synthetic polypeptide
AEEEIRTTNPVATEQYGVVSTVNQNGGNQQGNNVAE

SEQ ID NO: 121437 - protein, 36 aa, Artificial Sequence
  Description of Artificial Sequence: Synthetic polypeptide
AEEEIRTTNPVATEQYGVVSTVNQLQQQGTEEEEED

SEQ ID NO: 121438 - protein, 36 aa, Artificial Sequence
  Description of Artificial Sequence: Synthetic polypeptide
DEEEIRTTNPVATEQYGSVSAEFNYMQGVENPIDDT

SEQ ID NO: 121439 - protein, 33 aa, Artificial Sequence
  Description of Artificial Sequence: Synthetic polypeptide
DEQEIATTNPVATEQYGTVCSATDGPDEFEGND

SEQ ID NO: 121440 - protein, 36 aa, Artificial Sequence
  Description of Artificial Sequence: Synthetic polypeptide
DEEDIRTTNPVATEQYGSVSSTTPAGPNMRNGMNPV

SEQ ID NO: 121441 - protein, 34 aa, Artificial Sequence
  Description of Artificial Sequence: Synthetic polypeptide
DECTICTTNPVATEQWGSVSTTNQQNQQGNNNDN

SEQ ID NO: 121442 - protein, 29 aa, Artificial Sequence
  Description of Artificial Sequence: Synthetic peptide
IEEEIATTNPVATEQYGEAPEVCQGEEHK

SEQ ID NO: 121443 - protein, 29 aa, Artificial Sequence
  Description of Artificial Sequence: Synthetic peptide
IEEEIATTNPVATEQYGEAPEVCQHEKEK

SEQ ID NO: 121444 - protein, 36 aa, Artificial Sequence
  Description of Artificial Sequence: Synthetic polypeptide
DEEEIRTTNPVATEQYGSVWSTPYLTTTEITQTDDY

SEQ ID NO: 121445 - protein, 32 aa, Artificial Sequence
  Description of Artificial Sequence: Synthetic polypeptide
DENEIATTNPVSTEPYGTVSTDIQEDQNGNDL

SEQ ID NO: 121446 - protein, 35 aa, Artificial Sequence
  Description of Artificial Sequence: Synthetic polypeptide
AEEEIRTTNPVATEQYGVVSTVNTNQQANTNQEQD

SEQ ID NO: 121447 - protein, 34 aa, Artificial Sequence
  Description of Artificial Sequence: Synthetic polypeptide
DEQEIATTNPVATEQYGTVCSATDGLVEDFEGND

SEQ ID NO: 121448 - protein, 36 aa, Artificial Sequence
  Description of Artificial Sequence: Synthetic polypeptide
DEEDIRTTNPVATEQYGSVSSTTDAGPNMRNGMNPV

SEQ ID NO: 121449 - protein, 35 aa, Artificial Sequence
  Description of Artificial Sequence: Synthetic polypeptide
MEEEIRTTNPVATEQYGSVSTLMNVEQENELTTEN

SEQ ID NO: 121450 - protein, 35 aa, Artificial Sequence
  Description of Artificial Sequence: Synthetic polypeptide
DESEIRTTNPVATECWGSPVSCINGEPQDREGENG

SEQ ID NO: 121451 - protein, 28 aa, Artificial Sequence
  Description of Artificial Sequence: Synthetic peptide
IEEEIATTNPVATESYGEAPEVCQHEEK

SEQ ID NO: 121452 - protein, 36 aa, Artificial Sequence
  Description of Artificial Sequence: Synthetic polypeptide
DEEDIRTTNPVATEQYGSVSSTTPAGPNMINGMNPV

SEQ ID NO: 121453 - protein, 37 aa, Artificial Sequence
  Description of Artificial Sequence: Synthetic polypeptide
AEEEIRTTNPVATEQYGVVSTVTNLQQQGEQGTNVAE

SEQ ID NO: 121454 - protein, 36 aa, Artificial Sequence
  Description of Artificial Sequence: Synthetic polypeptide
AEEEIRTTNPVATEQYGVVSTVNQEQGNQQGTNQGT

SEQ ID NO: 121455 - protein, 36 aa, Artificial Sequence
  Description of Artificial Sequence: Synthetic polypeptide
AEEEIRTTNPVATEQYGVVSTVTNGNQLQIGTEQGQ

SEQ ID NO: 121456 - protein, 37 aa, Artificial Sequence
  Description of Artificial Sequence: Synthetic polypeptide
AEEEIRTTNPVATEQYGVVSTVTANLQNGNEQGNNVE

SEQ ID NO: 121457 - protein, 37 aa, Artificial Sequence
  Description of Artificial Sequence: Synthetic polypeptide
AEEEIRTTNPVATEQYGVVSTVSNNLNQQQIGTNTES

SEQ ID NO: 121458 - protein, 36 aa, Artificial Sequence
  Description of Artificial Sequence: Synthetic polypeptide
AEEEIRTTNPVATEQYGVVSTVSNNDQQGTNTTNQD

SEQ ID NO: 121459 - protein, 36 aa, Artificial Sequence
  Description of Artificial Sequence: Synthetic polypeptide
DEEEIRTTNPVATEQYGSVSAEIPGTQEREAPQNDM

SEQ ID NO: 121460 - protein, 29 aa, Artificial Sequence
  Description of Artificial Sequence: Synthetic peptide
IEEEIATTNPVATEQYGEAPEVCQHEVEK

SEQ ID NO: 121461 - protein, 36 aa, Artificial Sequence
  Description of Artificial Sequence: Synthetic polypeptide
AEEEIRTTNPVATEQYGVVSTVQNQQASEEGTNVEM

SEQ ID NO: 121462 - protein, 36 aa, Artificial Sequence
  Description of Artificial Sequence: Synthetic polypeptide
AEEEIRTTNPVATEQYGVVSTVNTNQQGEGEENEEG

SEQ ID NO: 121463 - protein, 35 aa, Artificial Sequence
  Description of Artificial Sequence: Synthetic polypeptide
AEEEIRTTNPVATEQYGVVSTVTATNLTQGDEQIQ

SEQ ID NO: 121464 - protein, 30 aa, Artificial Sequence
  Description of Artificial Sequence: Synthetic polypeptide
IEEEIATTNPVATEQYGEAGTEVCQHEECK

SEQ ID NO: 121465 - protein, 36 aa, Artificial Sequence
  Description of Artificial Sequence: Synthetic polypeptide
AEEEIRTTNPVATEQYGVVSTVNNQQQNDEGGNGNE

SEQ ID NO: 121466 - protein, 33 aa, Artificial Sequence
  Description of Artificial Sequence: Synthetic polypeptide
DESEIRTTNPVATECWGSASCINEPWDREGENG

SEQ ID NO: 121467 - protein, 34 aa, Artificial Sequence
  Description of Artificial Sequence: Synthetic polypeptide
DECTICTTNPVATEQWGSVSTTNQNQQQGNNTDQ

SEQ ID NO: 121468 - protein, 36 aa, Artificial Sequence
  Description of Artificial Sequence: Synthetic polypeptide
AEEEIRTTNPVATEQYGVVVVVSTTNLQQGTEEGVQ

SEQ ID NO: 121469 - protein, 34 aa, Artificial Sequence
  Description of Artificial Sequence: Synthetic polypeptide
DEEEIRTTNPVATEQYGSVRYTEISIDESQQSPQ

SEQ ID NO: 121470 - protein, 34 aa, Artificial Sequence
  Description of Artificial Sequence: Synthetic polypeptide
MEEEIRTTNPVATEQYGSVYGEGNMTDGGNGQEI

SEQ ID NO: 121471 - protein, 37 aa, Artificial Sequence
  Description of Artificial Sequence: Synthetic polypeptide
AEEEIRTTNPVATEQYGVVVVVSTTNLQQGTELGNVD

SEQ ID NO: 121472 - protein, 33 aa, Artificial Sequence
  Description of Artificial Sequence: Synthetic polypeptide
HESEIRTTNPVATECWGSVSCINEPCDREGENG

SEQ ID NO: 121473 - protein, 33 aa, Artificial Sequence
  Description of Artificial Sequence: Synthetic polypeptide
HESEIRTTNPVATECWGSVMCINEPQAREGENG

SEQ ID NO: 121474 - protein, 30 aa, Artificial Sequence
  Description of Artificial Sequence: Synthetic polypeptide
DENEIATTNPVSTEPYGTISMEDIQQQGNH

SEQ ID NO: 121475 - protein, 33 aa, Artificial Sequence
  Description of Artificial Sequence: Synthetic polypeptide
DESEIRTTNPVATECWGSASCINCPQDREGEEK

SEQ ID NO: 121476 - protein, 34 aa, Artificial Sequence
  Description of Artificial Sequence: Synthetic polypeptide
DEQEIATTNPVATEQYGSVSVTDYQEDYEGEDEV

SEQ ID NO: 121477 - protein, 31 aa, Artificial Sequence
  Description of Artificial Sequence: Synthetic polypeptide
DESEIRTTNPVATECWGSAPEINEQDHEGEG

SEQ ID NO: 121478 - protein, 30 aa, Artificial Sequence
  Description of Artificial Sequence: Synthetic polypeptide
DENEIATTNPVSTEPYGTISMCIQQQNGNH

SEQ ID NO: 121479 - protein, 33 aa, Artificial Sequence
  Description of Artificial Sequence: Synthetic polypeptide
HESEIRTTNPVANECWGSVSCINEPQDREGENG

SEQ ID NO: 121480 - protein, 37 aa, Artificial Sequence
  Description of Artificial Sequence: Synthetic polypeptide
AEEEIRTTNPVATEQYGVVSTVNNNLQQGDEQGNNEE

SEQ ID NO: 121481 - protein, 28 aa, Artificial Sequence
  Description of Artificial Sequence: Synthetic peptide
HESEIASTNPVGTEGYGVMASTLQHGDI

SEQ ID NO: 121482 - protein, 33 aa, Artificial Sequence
  Description of Artificial Sequence: Synthetic polypeptide
DESEIRTTNPVATECWGRVSCINEPQDRECENG

SEQ ID NO: 121483 - protein, 35 aa, Artificial Sequence
  Description of Artificial Sequence: Synthetic polypeptide
MEEEIRTTNPVATEQYGSYGNDTNGNDQGQGEEND

SEQ ID NO: 121484 - protein, 36 aa, Artificial Sequence
  Description of Artificial Sequence: Synthetic polypeptide
AEEEIRTTNPVATEQYGVVVVVSTTNLQSGSEQGVQ

SEQ ID NO: 121485 - protein, 35 aa, Artificial Sequence
  Description of Artificial Sequence: Synthetic polypeptide
MEEEIRTTNPVATEQYGSVVGNTMDQVEGGGNEGN

SEQ ID NO: 121486 - protein, 34 aa, Artificial Sequence
  Description of Artificial Sequence: Synthetic polypeptide
IEAEIACTNPVATEQYGSVATNNQPQDAGPNSRA

SEQ ID NO: 121487 - protein, 36 aa, Artificial Sequence
  Description of Artificial Sequence: Synthetic polypeptide
AEEEIRTTNPVATEQYGVVSTVNNQQQGNQAGNDTD

SEQ ID NO: 121488 - protein, 33 aa, Artificial Sequence
  Description of Artificial Sequence: Synthetic polypeptide
DESEIRTTNPVATECWGSASCINEPTDREGENG

SEQ ID NO: 121489 - protein, 35 aa, Artificial Sequence
  Description of Artificial Sequence: Synthetic polypeptide
DEEEIRTTNPVATEQYGSVSADPSTQQEIQQEEEQ

SEQ ID NO: 121490 - protein, 34 aa, Artificial Sequence
  Description of Artificial Sequence: Synthetic polypeptide
DEQEIATTNPVATEQYGTVCSATLGNPVEFEGND

SEQ ID NO: 121491 - protein, 36 aa, Artificial Sequence
  Description of Artificial Sequence: Synthetic polypeptide
AEEEIRTTNPVATEQYGVVVVVSTTNLQAGTEQGQV

SEQ ID NO: 121492 - protein, 35 aa, Artificial Sequence
  Description of Artificial Sequence: Synthetic polypeptide
MEEEIRTTNPVATEQYGSVSVLYTADEELGQSVDQ

SEQ ID NO: 121493 - protein, 36 aa, Artificial Sequence
  Description of Artificial Sequence: Synthetic polypeptide
AEEEIRTTNPVATEQYGVVSTVNNQLENSEEGNTNG

SEQ ID NO: 121494 - protein, 35 aa, Artificial Sequence
  Description of Artificial Sequence: Synthetic polypeptide
DEEEIAATNPVATEQYGSVCAMTNNDQDQGGNSNG

SEQ ID NO: 121495 - protein, 31 aa, Artificial Sequence
  Description of Artificial Sequence: Synthetic polypeptide
DENEIATTNPVSTEPYGTISMETIQQQQGNH

SEQ ID NO: 121496 - protein, 34 aa, Artificial Sequence
  Description of Artificial Sequence: Synthetic polypeptide
IEEAIRTTNPVATEQYGSVSPTMNEHTGHEPLDE

SEQ ID NO: 121497 - protein, 33 aa, Artificial Sequence
  Description of Artificial Sequence: Synthetic polypeptide
DEDAIRTTNPVATEQYGSFSTLELIEGGQISDV

SEQ ID NO: 121498 - protein, 33 aa, Artificial Sequence
  Description of Artificial Sequence: Synthetic polypeptide
DEQEIATTNPVATEQYGTVSAMDLQQDHNGEDL

SEQ ID NO: 121499 - protein, 35 aa, Artificial Sequence
  Description of Artificial Sequence: Synthetic polypeptide
DESEIRTTNPVATECWGSPVSRCINEPQDREGENG

SEQ ID NO: 121500 - protein, 35 aa, Artificial Sequence
  Description of Artificial Sequence: Synthetic polypeptide
MEEEIRTTNPVATEQYGSVSVVTADESLEAQSDTT

SEQ ID NO: 121501 - protein, 35 aa, Artificial Sequence
  Description of Artificial Sequence: Synthetic polypeptide
AEEEIRTTNPVATEQYGVVSTVNNNQQQNEENEED

SEQ ID NO: 121502 - protein, 34 aa, Artificial Sequence
  Description of Artificial Sequence: Synthetic polypeptide
DESEIRTTNPVATECWGSQLSCINEPQDREGENG

SEQ ID NO: 121503 - protein, 33 aa, Artificial Sequence
  Description of Artificial Sequence: Synthetic polypeptide
DEQEIATTNPVATEQYGTVSAMDLQQDHNGEDH

SEQ ID NO: 121504 - protein, 30 aa, Artificial Sequence
  Description of Artificial Sequence: Synthetic polypeptide
DENEIATTNPVSTEPYGVIAMETLQQQGNI

SEQ ID NO: 121505 - protein, 32 aa, Artificial Sequence
  Description of Artificial Sequence: Synthetic polypeptide
DENEIATTNPVSTEGYGTISNETIQQQQNGNR

SEQ ID NO: 121506 - protein, 34 aa, Artificial Sequence
  Description of Artificial Sequence: Synthetic polypeptide
DESEIRTTNPVATECWGNPVSCINEPQDREGENG

SEQ ID NO: 121507 - protein, 33 aa, Artificial Sequence
  Description of Artificial Sequence: Synthetic polypeptide
DENEIATTNPVAYEQYGSVATNPQQNASPGSKM

SEQ ID NO: 121508 - protein, 34 aa, Artificial Sequence
  Description of Artificial Sequence: Synthetic polypeptide
DESEIRTTNPVATECWGLVSCINEPQDREGENGI

SEQ ID NO: 121509 - protein, 29 aa, Artificial Sequence
  Description of Artificial Sequence: Synthetic peptide
DENEIRSTNPVSTEPYGTIAMEDIQQGNI

SEQ ID NO: 121510 - protein, 34 aa, Artificial Sequence
  Description of Artificial Sequence: Synthetic polypeptide
DESEIRTTNPVATECWGLVPSCINEPQDREGENG

SEQ ID NO: 121511 - protein, 32 aa, Artificial Sequence
  Description of Artificial Sequence: Synthetic polypeptide
DEAEIRTTNGVAYCQYGCVCSTNHQEGFGSDQ

SEQ ID NO: 121512 - protein, 31 aa, Artificial Sequence
  Description of Artificial Sequence: Synthetic polypeptide
CEGEIAPTNPCSYEQYGKVSINLSQSVGTNR

SEQ ID NO: 121513 - protein, 35 aa, Artificial Sequence
  Description of Artificial Sequence: Synthetic polypeptide
DEEEIRTTNPVATEQYGSVSCTPNMVPPYTLELLE

SEQ ID NO: 121514 - protein, 36 aa, Artificial Sequence
  Description of Artificial Sequence: Synthetic polypeptide
DEEEIRTTNPVATEQYGSVYENNSQLGLTRQQNPQE

SEQ ID NO: 121515 - protein, 33 aa, Artificial Sequence
  Description of Artificial Sequence: Synthetic polypeptide
DENEIATTNPVAYEQYGSVATNGQEHQGDQAEE

SEQ ID NO: 121516 - protein, 35 aa, Artificial Sequence
  Description of Artificial Sequence: Synthetic polypeptide
AEEEIRTTNPVATESYGSVSTVTSNNNTEEGTNQT

SEQ ID NO: 121517 - protein, 34 aa, Artificial Sequence
  Description of Artificial Sequence: Synthetic polypeptide
DEEEIRTTNPVATEQYGSVYEPENEIQETIQEQT

SEQ ID NO: 121518 - protein, 35 aa, Artificial Sequence
  Description of Artificial Sequence: Synthetic polypeptide
AEEEIRTTNPVATESYGSVSTVTSNNNVEEGTNQQ

SEQ ID NO: 121519 - protein, 35 aa, Artificial Sequence
  Description of Artificial Sequence: Synthetic polypeptide
CEEEIATTNPVATEQYGSVCSATLALQNHQDANDN

SEQ ID NO: 121520 - protein, 35 aa, Artificial Sequence
  Description of Artificial Sequence: Synthetic polypeptide
AEEEIRTTNPVATESYGSVSTVTSNNNVEEGTNTQ

SEQ ID NO: 121521 - protein, 30 aa, Artificial Sequence
  Description of Artificial Sequence: Synthetic polypeptide
DENEIRSTNPVSTEPYGTISMEDIQQNGNI

SEQ ID NO: 121522 - protein, 33 aa, Artificial Sequence
  Description of Artificial Sequence: Synthetic polypeptide
MEGEIRTTNPVATEQYGSCSPDIPLQEGEEDQG

SEQ ID NO: 121523 - protein, 36 aa, Artificial Sequence
  Description of Artificial Sequence: Synthetic polypeptide
DEEEIRTTNPVATEQYGSVYDQNIADLNQGPEFGTF

SEQ ID NO: 121524 - protein, 35 aa, Artificial Sequence
  Description of Artificial Sequence: Synthetic polypeptide
AEEEIRTTNPVATESYGSVSTVTSNNNTEEGTNQE

SEQ ID NO: 121525 - protein, 35 aa, Artificial Sequence
  Description of Artificial Sequence: Synthetic polypeptide
AEEEIRTTNPVATESYGSVSTVTQNNNVEEGTNQM

SEQ ID NO: 121526 - protein, 29 aa, Artificial Sequence
  Description of Artificial Sequence: Synthetic peptide
MEGEIATTNPVATECYGQVSEWSQHEEEK

SEQ ID NO: 121527 - protein, 29 aa, Artificial Sequence
  Description of Artificial Sequence: Synthetic peptide
DENEIRSTNPVGTEPYGTIAMEDIQHGNI

SEQ ID NO: 121528 - protein, 29 aa, Artificial Sequence
  Description of Artificial Sequence: Synthetic peptide
DENEIRSTNPVGTEPYGTIAMEDIQQGNI

SEQ ID NO: 121529 - protein, 29 aa, Artificial Sequence
  Description of Artificial Sequence: Synthetic peptide
DENEIRSTNPVGTEQWGDVSSIEQAAEDA

SEQ ID NO: 121530 - protein, 29 aa, Artificial Sequence
  Description of Artificial Sequence: Synthetic peptide
DENEIRSTNPVGTEQWGVMASTEMNAGDI

SEQ ID NO: 121531 - protein, 29 aa, Artificial Sequence
  Description of Artificial Sequence: Synthetic peptide
DENEIRSTNPVGTEQWGVMASTLMNAGDI

SEQ ID NO: 121532 - protein, 33 aa, Artificial Sequence
  Description of Artificial Sequence: Synthetic polypeptide
DESEIRTTNPVATECWGLVYCINEPQDREGENG

SEQ ID NO: 121533 - protein, 36 aa, Artificial Sequence
  Description of Artificial Sequence: Synthetic polypeptide
GSEEIRTTNPVAYEQYGSVSCTINSHSQTQGGNNRA

SEQ ID NO: 121534 - protein, 31 aa, Artificial Sequence
  Description of Artificial Sequence: Synthetic polypeptide
DEDCIACTNPVAYEPWPYSTVASNLQRGDNR

SEQ ID NO: 121535 - protein, 31 aa, Artificial Sequence
  Description of Artificial Sequence: Synthetic polypeptide
DENEIRSTNPVSTEGYGTISMETIQQQNGNH

SEQ ID NO: 121536 - protein, 37 aa, Artificial Sequence
  Description of Artificial Sequence: Synthetic polypeptide
AEEEIRTTNPVATESYGSVSTVTNNQLGNQQGNDEGT

SEQ ID NO: 121537 - protein, 37 aa, Artificial Sequence
  Description of Artificial Sequence: Synthetic polypeptide
AEEEIRTTNPVATEQYGVVSTTTNNLQQGNNGGNQEG

SEQ ID NO: 121538 - protein, 34 aa, Artificial Sequence
  Description of Artificial Sequence: Synthetic polypeptide
DESEIRTTNPVATECWGLVSCINREPQDREGENG

SEQ ID NO: 121539 - protein, 35 aa, Artificial Sequence
  Description of Artificial Sequence: Synthetic polypeptide
DENEIATTNPVAYEQYGSVCSPANALQEAEIGNNE

SEQ ID NO: 121540 - protein, 35 aa, Artificial Sequence
  Description of Artificial Sequence: Synthetic polypeptide
DENEIATTNPVAYEQYGSVCSATNNLAETPGGERH

SEQ ID NO: 121541 - protein, 33 aa, Artificial Sequence
  Description of Artificial Sequence: Synthetic polypeptide
MEGEIRTTNPVATEQYGCVSTLTMEEQEGIDEV

SEQ ID NO: 121542 - protein, 35 aa, Artificial Sequence
  Description of Artificial Sequence: Synthetic polypeptide
DESEIRTTNPVATECWGSRVSQCKNEPQDREGENG

SEQ ID NO: 121543 - protein, 35 aa, Artificial Sequence
  Description of Artificial Sequence: Synthetic polypeptide
DESEIRTTNPVATECWGLSVSCINEPQDREGENTG

SEQ ID NO: 121544 - protein, 35 aa, Artificial Sequence
  Description of Artificial Sequence: Synthetic polypeptide
DEQEIATTNPVATESYGISVPTTMNLQDQMIGNVD

SEQ ID NO: 121545 - protein, 33 aa, Artificial Sequence
  Description of Artificial Sequence: Synthetic polypeptide
DECSIMTTNPVATECYGSVNETNTLEGIGNNME

SEQ ID NO: 121546 - protein, 34 aa, Artificial Sequence
  Description of Artificial Sequence: Synthetic polypeptide
DESEIRTTNPVATECWGKSVECINEPQDREGENG

SEQ ID NO: 121547 - protein, 36 aa, Artificial Sequence
  Description of Artificial Sequence: Synthetic polypeptide
DECEICTTNPVATEQYGVVSTVSNLQQGNNNTNQDD

SEQ ID NO: 121548 - protein, 34 aa, Artificial Sequence
  Description of Artificial Sequence: Synthetic polypeptide
MEGEIRTTNPVATEQYGSVCSTTLSEEGGDIIID

SEQ ID NO: 121549 - protein, 33 aa, Artificial Sequence
  Description of Artificial Sequence: Synthetic polypeptide
DESEIRTTNPVATECWGIVSCIPEPQDREGENG

SEQ ID NO: 121550 - protein, 34 aa, Artificial Sequence
  Description of Artificial Sequence: Synthetic polypeptide
DESEIRTTNPVATECWGSSSCINEPQDREGENMG

SEQ ID NO: 121551 - protein, 34 aa, Artificial Sequence
  Description of Artificial Sequence: Synthetic polypeptide
DECNEIATTNPVAYEQWGSVCSTNDNQGEGNNNG

SEQ ID NO: 121552 - protein, 33 aa, Artificial Sequence
  Description of Artificial Sequence: Synthetic polypeptide
CEEEIATTNPVATEQYGSVCSANPPGQEHITEM

SEQ ID NO: 121553 - protein, 34 aa, Artificial Sequence
  Description of Artificial Sequence: Synthetic polypeptide
MEGEIRTTNPVATEQYGSVAPDNIQEGEYNDEDI

SEQ ID NO: 121554 - protein, 34 aa, Artificial Sequence
  Description of Artificial Sequence: Synthetic polypeptide
DEQEIATTNPVATEVWGSVCYTNDHQDQHRQGDR

SEQ ID NO: 121555 - protein, 33 aa, Artificial Sequence
  Description of Artificial Sequence: Synthetic polypeptide
DENEIATTNPVAYEQYGSVAATNLATPSGGEDD

SEQ ID NO: 121556 - protein, 30 aa, Artificial Sequence
  Description of Artificial Sequence: Synthetic polypeptide
DENEIRSTNPVSTEPYGVISDDIQQQQGNH

SEQ ID NO: 121557 - protein, 34 aa, Artificial Sequence
  Description of Artificial Sequence: Synthetic polypeptide
GESEIRTTNPVATECWGSVSFCINEPQDREGENG

SEQ ID NO: 121558 - protein, 37 aa, Artificial Sequence
  Description of Artificial Sequence: Synthetic polypeptide
DEEEIRTTNPVATEQYGSVSCTTPAGPNMRNGMNPVE

SEQ ID NO: 121559 - protein, 36 aa, Artificial Sequence
  Description of Artificial Sequence: Synthetic polypeptide
DEEEIRTTNPVATEQYGSVYGDDNTLQDTGQEEGEV

SEQ ID NO: 121560 - protein, 33 aa, Artificial Sequence
  Description of Artificial Sequence: Synthetic polypeptide
DENEIATTNPVAYEQYGSVAATNDADTGGNEMK

SEQ ID NO: 121561 - protein, 34 aa, Artificial Sequence
  Description of Artificial Sequence: Synthetic polypeptide
DENEIATTNPVAYEQYGSTVCAANNLQDADGNND

SEQ ID NO: 121562 - protein, 36 aa, Artificial Sequence
  Description of Artificial Sequence: Synthetic polypeptide
DEEEIRTTNPVATEQYGSVYGDDITLQDNGGEEGNV

SEQ ID NO: 121563 - protein, 37 aa, Artificial Sequence
  Description of Artificial Sequence: Synthetic polypeptide
AEEEIRTTNPVATEQYGVVSTTTNNNLQQGNNDENLY

SEQ ID NO: 121564 - protein, 34 aa, Artificial Sequence
  Description of Artificial Sequence: Synthetic polypeptide
GESEIRTTNPVATECWGSVSWCINEPQDREGENG

SEQ ID NO: 121565 - protein, 32 aa, Artificial Sequence
  Description of Artificial Sequence: Synthetic polypeptide
DECSIMTTNPVATECYGCVNTNTLEFIGNNMP

SEQ ID NO: 121566 - protein, 34 aa, Artificial Sequence
  Description of Artificial Sequence: Synthetic polypeptide
DESEIRTTNPVATECWGLSVSCINEPQDREGEGG

SEQ ID NO: 121567 - protein, 33 aa, Artificial Sequence
  Description of Artificial Sequence: Synthetic polypeptide
DEQEIATTNPVATESYGSVSATDMLEDHEGEDL

SEQ ID NO: 121568 - protein, 35 aa, Artificial Sequence
  Description of Artificial Sequence: Synthetic polypeptide
DESEIRTTNPVATECWGSSMVSCINEPQDREGENG

SEQ ID NO: 121569 - protein, 32 aa, Artificial Sequence
  Description of Artificial Sequence: Synthetic polypeptide
DEAEIRTTNGVAYCQYGCVCSTGNPQGFGSDQ

SEQ ID NO: 121570 - protein, 33 aa, Artificial Sequence
  Description of Artificial Sequence: Synthetic polypeptide
GESEIRTVNPVATECWGSVSEINEPQDREGENG

SEQ ID NO: 121571 - protein, 33 aa, Artificial Sequence
  Description of Artificial Sequence: Synthetic polypeptide
DESEIRTTNPVATECWGKVSCINEPQDREGEQG

SEQ ID NO: 121572 - protein, 33 aa, Artificial Sequence
  Description of Artificial Sequence: Synthetic polypeptide
DESEIRTTNPVATECWGSSSCINEPQDREAENG

SEQ ID NO: 121573 - protein, 29 aa, Artificial Sequence
  Description of Artificial Sequence: Synthetic peptide
DENEIRSTNPVSTEPYGTMASDLQHNGDI

SEQ ID NO: 121574 - protein, 33 aa, Artificial Sequence
  Description of Artificial Sequence: Synthetic polypeptide
DEQEIATTNPVATESYWGSVSATDLLDHEGEDL

SEQ ID NO: 121575 - protein, 31 aa, Artificial Sequence
  Description of Artificial Sequence: Synthetic polypeptide
DENEIATTNPVAYEQYGSVASNEADTPQERH

SEQ ID NO: 121576 - protein, 34 aa, Artificial Sequence
  Description of Artificial Sequence: Synthetic polypeptide
DESEIRTTNPVATECWGKVRSCINEPQDREGENG

SEQ ID NO: 121577 - protein, 32 aa, Artificial Sequence
  Description of Artificial Sequence: Synthetic polypeptide
DEDCIACTNPVAYEPYDYNTVTSANLQRGDNR

SEQ ID NO: 121578 - protein, 33 aa, Artificial Sequence
  Description of Artificial Sequence: Synthetic polypeptide
DECSIMTTNPVATECYGQVNTENTLERIGVNNM

SEQ ID NO: 121579 - protein, 36 aa, Artificial Sequence
  Description of Artificial Sequence: Synthetic polypeptide
MEGEIRTTNPVATEQYGSLVFSPDNDIQERDGDNQE

SEQ ID NO: 121580 - protein, 34 aa, Artificial Sequence
  Description of Artificial Sequence: Synthetic polypeptide
MEGEIRTTNPVATEQYGSNCSPDNLEQEGEEDQG

SEQ ID NO: 121581 - protein, 33 aa, Artificial Sequence
  Description of Artificial Sequence: Synthetic polypeptide
DENEIATTNPVAYEQYGSVAMNGDTQTGNGDEH

SEQ ID NO: 121582 - protein, 33 aa, Artificial Sequence
  Description of Artificial Sequence: Synthetic polypeptide
MEGEIRTTNPVATEQYGSCWTDVASLEMGNDDQ

SEQ ID NO: 121583 - protein, 34 aa, Artificial Sequence
  Description of Artificial Sequence: Synthetic polypeptide
DEEEIRTTNPVATEQYGSVWTMDPMTGLGGTQFQ

SEQ ID NO: 121584 - protein, 37 aa, Artificial Sequence
  Description of Artificial Sequence: Synthetic polypeptide
AEEEIRTTNPVATEQYGVVSTTTNNNLQQGNNGGNTE

SEQ ID NO: 121585 - protein, 38 aa, Artificial Sequence
  Description of Artificial Sequence: Synthetic polypeptide
DEEEIRTTNPVATEQYGSVVVSTNLQAGTEQGSTQQQE

SEQ ID NO: 121586 - protein, 33 aa, Artificial Sequence
  Description of Artificial Sequence: Synthetic polypeptide
DESEIRTTNPVATECWGMVGCINEYQAREGENG

SEQ ID NO: 121587 - protein, 36 aa, Artificial Sequence
  Description of Artificial Sequence: Synthetic polypeptide
AEEEIRTTNPVATEQYGVVSTVGSNNNQQGSTNAGV

SEQ ID NO: 121588 - protein, 36 aa, Artificial Sequence
  Description of Artificial Sequence: Synthetic polypeptide
HEEEIRTTNPVATEQYGSVSSTTPAGPAMRNGMNPV

SEQ ID NO: 121589 - protein, 30 aa, Artificial Sequence
  Description of Artificial Sequence: Synthetic polypeptide
DENEIRSTNPVATEQWGDVSEIIQNAAEQA

SEQ ID NO: 121590 - protein, 37 aa, Artificial Sequence
  Description of Artificial Sequence: Synthetic polypeptide
DEEEIRTTNPVATEQYGSVQVPTMNLNVPQAGEPVTQ

SEQ ID NO: 121591 - protein, 37 aa, Artificial Sequence
  Description of Artificial Sequence: Synthetic polypeptide
AEEEIRTTNPVATEQYGVVSTVGNNLQQGENGNTEEE

SEQ ID NO: 121592 - protein, 34 aa, Artificial Sequence
  Description of Artificial Sequence: Synthetic polypeptide
DEEEIRTTNPVATEQYGSVWVTLVSHFENSQEDK

SEQ ID NO: 121593 - protein, 33 aa, Artificial Sequence
  Description of Artificial Sequence: Synthetic polypeptide
DEQEIATTNPVATEQYGWVSATDELEDHEGEDL

SEQ ID NO: 121594 - protein, 33 aa, Artificial Sequence
  Description of Artificial Sequence: Synthetic polypeptide
DEQEIATTNPVATEQYGWVSATDLEDHEGEEDL

SEQ ID NO: 121595 - protein, 34 aa, Artificial Sequence
  Description of Artificial Sequence: Synthetic polypeptide
DESEIRTTNPVATECWGSRVDCINEPQDREGENG

SEQ ID NO: 121596 - protein, 35 aa, Artificial Sequence
  Description of Artificial Sequence: Synthetic polypeptide
DEEEIRTTNPVATEQYGSVQVLTLGDEGGINQGFM

SEQ ID NO: 121597 - protein, 32 aa, Artificial Sequence
  Description of Artificial Sequence: Synthetic polypeptide
DEQEIATTNPVATEQYGWVSATDTEDHEGEDL

SEQ ID NO: 121598 - protein, 30 aa, Artificial Sequence
  Description of Artificial Sequence: Synthetic polypeptide
DENEIRSTNPVATEQWGDVSEILMNAAEDA

SEQ ID NO: 121599 - protein, 35 aa, Artificial Sequence
  Description of Artificial Sequence: Synthetic polypeptide
DESEIRTTNPVATECWGMSVGSCINEPQDREGENG

SEQ ID NO: 121600 - protein, 31 aa, Artificial Sequence
  Description of Artificial Sequence: Synthetic polypeptide
DENEIATTNPVSSEPYGTISMENIQQQQGNR

SEQ ID NO: 121601 - protein, 34 aa, Artificial Sequence
  Description of Artificial Sequence: Synthetic polypeptide
DEQEIATTNPVATEQYGWSVSATDLVEDHEGEDL

SEQ ID NO: 121602 - protein, 33 aa, Artificial Sequence
  Description of Artificial Sequence: Synthetic polypeptide
DEQEIATTNPVATEQYGWSVSATDLEDHEIEDA

SEQ ID NO: 121603 - protein, 31 aa, Artificial Sequence
  Description of Artificial Sequence: Synthetic polypeptide
DENEIATTNPVSTECYGTVSMDLQQQQNENH

SEQ ID NO: 121604 - protein, 36 aa, Artificial Sequence
  Description of Artificial Sequence: Synthetic polypeptide
HEEEIRTTNPVATEQYGSVSSTTPAGPNMRNGMNPV

SEQ ID NO: 121605 - protein, 29 aa, Artificial Sequence
  Description of Artificial Sequence: Synthetic peptide
DENEIRSTNPVATEGWGDVAEILQAAEDA

SEQ ID NO: 121606 - protein, 34 aa, Artificial Sequence
  Description of Artificial Sequence: Synthetic polypeptide
DESEIRTTNPVATECWGNFVSCINEPQDREGENG

SEQ ID NO: 121607 - protein, 35 aa, Artificial Sequence
  Description of Artificial Sequence: Synthetic polypeptide
AEEEIRTTNPVATEQYGVVSTVNANDEQSEETNNA

SEQ ID NO: 121608 - protein, 32 aa, Artificial Sequence
  Description of Artificial Sequence: Synthetic polypeptide
MEEEISTTNPVATEQYGCVCSTEHESFNSNQQ

SEQ ID NO: 121609 - protein, 33 aa, Artificial Sequence
  Description of Artificial Sequence: Synthetic polypeptide
MEEEISTTNPVATEQYGCVCSVTEDQGFGSQQL

SEQ ID NO: 121610 - protein, 35 aa, Artificial Sequence
  Description of Artificial Sequence: Synthetic polypeptide
AEEEIRTTNPVATESYGSVSTVSNNNVAEEGTNQD

SEQ ID NO: 121611 - protein, 35 aa, Artificial Sequence
  Description of Artificial Sequence: Synthetic polypeptide
AEEEIRTTNPVATESYGSVSTVSNNNVEEGTNEQT

SEQ ID NO: 121612 - protein, 34 aa, Artificial Sequence
  Description of Artificial Sequence: Synthetic polypeptide
DEQEIATTNPVATEQYGYSVSATDLYEDHEGEDL

SEQ ID NO: 121613 - protein, 35 aa, Artificial Sequence
  Description of Artificial Sequence: Synthetic polypeptide
AEEEIRTTNPVATESYGSVSTVSNNNVTEEGTNEQ

SEQ ID NO: 121614 - protein, 34 aa, Artificial Sequence
  Description of Artificial Sequence: Synthetic polypeptide
MEEEISTTNPVATEQYGCVCSVTGELNQGNSDQM

SEQ ID NO: 121615 - protein, 36 aa, Artificial Sequence
  Description of Artificial Sequence: Synthetic polypeptide
HEEEIRTTNPVATEQYGSVSSTTRAGPNMRNGMNPV

SEQ ID NO: 121616 - protein, 36 aa, Artificial Sequence
  Description of Artificial Sequence: Synthetic polypeptide
DEQEIATTNPVATEQYGVVVHTDNGLDQREGQNGNH

SEQ ID NO: 121617 - protein, 31 aa, Artificial Sequence
  Description of Artificial Sequence: Synthetic polypeptide
DENEIRSTNPVATEQWGDVSAEIIQNAAEQR

SEQ ID NO: 121618 - protein, 33 aa, Artificial Sequence
  Description of Artificial Sequence: Synthetic polypeptide
DEQEIATTNPVATEQYGWSVKATDLEDHEGEDL

SEQ ID NO: 121619 - protein, 33 aa, Artificial Sequence
  Description of Artificial Sequence: Synthetic polypeptide
DESEIRTTNPVATECWGMVSCINEPVDREGENG

SEQ ID NO: 121620 - protein, 33 aa, Artificial Sequence
  Description of Artificial Sequence: Synthetic polypeptide
DECSIMTTNPVATECYGTVVNTNTLERIGNNME

SEQ ID NO: 121621 - protein, 35 aa, Artificial Sequence
  Description of Artificial Sequence: Synthetic polypeptide
MEEEISTTNPVATEQYGCVCSVTELNQEGFGSNQL

SEQ ID NO: 121622 - protein, 36 aa, Artificial Sequence
  Description of Artificial Sequence: Synthetic polypeptide
AEEEIRTTNPVATEQYGVVSTVDNGNQQQGNNNTQE

SEQ ID NO: 121623 - protein, 31 aa, Artificial Sequence
  Description of Artificial Sequence: Synthetic polypeptide
DENEIATTNPVGTEPYGVMSSDLQQQHNGNI

SEQ ID NO: 121624 - protein, 37 aa, Artificial Sequence
  Description of Artificial Sequence: Synthetic polypeptide
AEEEIRTTNPVATEQYGVVSTTVTNLQQGNQAGNDTD

SEQ ID NO: 121625 - protein, 30 aa, Artificial Sequence
  Description of Artificial Sequence: Synthetic polypeptide
DENEIRSTNPVATEQWGNVANTEQNAAEDR

SEQ ID NO: 121626 - protein, 35 aa, Artificial Sequence
  Description of Artificial Sequence: Synthetic polypeptide
HEEEIRTTNPVATEQYGSVSPWENPTEINLAGPYP

SEQ ID NO: 121627 - protein, 34 aa, Artificial Sequence
  Description of Artificial Sequence: Synthetic polypeptide
DENEIATTNPVAYEQYGSVSANDPGAPDNQEGNN

SEQ ID NO: 121628 - protein, 36 aa, Artificial Sequence
  Description of Artificial Sequence: Synthetic polypeptide
AEEEIRTTNPVATEQYGVVSTTTNQQQQGNVTNNVD

SEQ ID NO: 121629 - protein, 33 aa, Artificial Sequence
  Description of Artificial Sequence: Synthetic polypeptide
DENEIATTNPVAYEQYGSVSAGPPQQARPGDSE

SEQ ID NO: 121630 - protein, 36 aa, Artificial Sequence
  Description of Artificial Sequence: Synthetic polypeptide
AEEEIRTTNPVATESYGSVSTVTNLTNNQQGTTGGN

SEQ ID NO: 121631 - protein, 34 aa, Artificial Sequence
  Description of Artificial Sequence: Synthetic polypeptide
DEQEIATTNPVATEQYGYSYVSATDLEDHEGEDL

SEQ ID NO: 121632 - protein, 36 aa, Artificial Sequence
  Description of Artificial Sequence: Synthetic polypeptide
AEEEIRTTNPVATEQYGVVSTTTNQQQQQNGTNQQG

SEQ ID NO: 121633 - protein, 34 aa, Artificial Sequence
  Description of Artificial Sequence: Synthetic polypeptide
DESEIRTTNPVATECWGMSLSCINEPQDREGKNG

SEQ ID NO: 121634 - protein, 36 aa, Artificial Sequence
  Description of Artificial Sequence: Synthetic polypeptide
HEEEIRTTNPVATEQYGSVSLTVNTHEHRMLAGPYP

SEQ ID NO: 121635 - protein, 36 aa, Artificial Sequence
  Description of Artificial Sequence: Synthetic polypeptide
AEEEIRTTNPVATESYGSVSTVTNNLNGNQQGEDGG

SEQ ID NO: 121636 - protein, 36 aa, Artificial Sequence
  Description of Artificial Sequence: Synthetic polypeptide
AEEEIRTTNPVATESYGSVSTVTNNLNNQIGTDGGV

SEQ ID NO: 121637 - protein, 36 aa, Artificial Sequence
  Description of Artificial Sequence: Synthetic polypeptide
AEEEIRTTNPVATESYGSVSTVTNNNLNQQGTEGGT

SEQ ID NO: 121638 - protein, 37 aa, Artificial Sequence
  Description of Artificial Sequence: Synthetic polypeptide
AEEEIRTTNPVATEQYGVVSTTTNQLQAGNNENNNAD

SEQ ID NO: 121639 - protein, 37 aa, Artificial Sequence
  Description of Artificial Sequence: Synthetic polypeptide
AEEEIRTTNPVATEQYGVVSTTTNNQLQNQNGTNGQE

SEQ ID NO: 121640 - protein, 35 aa, Artificial Sequence
  Description of Artificial Sequence: Synthetic polypeptide
AEEEIRTTNPVATESYGSVSTVTNNNNNNQQGDGG

SEQ ID NO: 121641 - protein, 33 aa, Artificial Sequence
  Description of Artificial Sequence: Synthetic polypeptide
DEQEIATTNPVATEQYGYVSATDLEDHEGEDLD

SEQ ID NO: 121642 - protein, 36 aa, Artificial Sequence
  Description of Artificial Sequence: Synthetic polypeptide
AEEEIRTTNPVATEQYGVVSTTTNNNQQQIGTNEGG

SEQ ID NO: 121643 - protein, 30 aa, Artificial Sequence
  Description of Artificial Sequence: Synthetic polypeptide
DENEIRSTNPVATEQWGDVSNTEMNAAEDA

SEQ ID NO: 121644 - protein, 34 aa, Artificial Sequence
  Description of Artificial Sequence: Synthetic polypeptide
DENEIATTNPVAYEQYGSVSGPNPQDNGTLLNVN

SEQ ID NO: 121645 - protein, 30 aa, Artificial Sequence
  Description of Artificial Sequence: Synthetic polypeptide
DENEIATTNPVGTEGYGTIASETIQQHGDI

SEQ ID NO: 121646 - protein, 33 aa, Artificial Sequence
  Description of Artificial Sequence: Synthetic polypeptide
DENEIATTNPVAYGAHYGSVSTNLQNHDEMNVH

SEQ ID NO: 121647 - protein, 37 aa, Artificial Sequence
  Description of Artificial Sequence: Synthetic polypeptide
AEEEIRTTNPVATEQYGVVSTTVNLQNQQGTEENTED

SEQ ID NO: 121648 - protein, 35 aa, Artificial Sequence
  Description of Artificial Sequence: Synthetic polypeptide
AEEEIRTTNPVATEQYGVVSTTVGNNNNQQDENGV

SEQ ID NO: 121649 - protein, 32 aa, Artificial Sequence
  Description of Artificial Sequence: Synthetic polypeptide
DEAEIRTTNPVAYESWGSVCPEDGQGQGNNDR

SEQ ID NO: 121650 - protein, 34 aa, Artificial Sequence
  Description of Artificial Sequence: Synthetic polypeptide
MEEEITTTNPVATEQYGNVSVTGGGQGDGGNEEI

SEQ ID NO: 121651 - protein, 37 aa, Artificial Sequence
  Description of Artificial Sequence: Synthetic polypeptide
AEEEIRTTNPVATEQYGVVSTTTVNLQAGTEAGNEED

SEQ ID NO: 121652 - protein, 36 aa, Artificial Sequence
  Description of Artificial Sequence: Synthetic polypeptide
HEEEIRTTNPVATEQYGSVSSTTPAEPNMRNGMNPV

SEQ ID NO: 121653 - protein, 30 aa, Artificial Sequence
  Description of Artificial Sequence: Synthetic polypeptide
DENEIRSTNPVATEQWGDVSEILMNHAEDA

SEQ ID NO: 121654 - protein, 33 aa, Artificial Sequence
  Description of Artificial Sequence: Synthetic polypeptide
MEEEITTTNPVATEQYGQVSVTQGGGQGDGGEE

SEQ ID NO: 121655 - protein, 34 aa, Artificial Sequence
  Description of Artificial Sequence: Synthetic polypeptide
DENEIATTNPVAYEQYGSVSTNNLIEHPGDMQAE

SEQ ID NO: 121656 - protein, 37 aa, Artificial Sequence
  Description of Artificial Sequence: Synthetic polypeptide
AEEEIRTTNPVATEQYGVVSTTTSNLQAGTEQGNEEG

SEQ ID NO: 121657 - protein, 36 aa, Artificial Sequence
  Description of Artificial Sequence: Synthetic polypeptide
AEEEIRTTNPVATEQYGVVSTTTQQLQQGNNNNNEY

SEQ ID NO: 121658 - protein, 33 aa, Artificial Sequence
  Description of Artificial Sequence: Synthetic polypeptide
DEAEIRTTNPVAYESWGSVATNLNNGDVGQNQP

SEQ ID NO: 121659 - protein, 36 aa, Artificial Sequence
  Description of Artificial Sequence: Synthetic polypeptide
DENEIATTNPVAYEQYGSVSITNTLDNDRPGMNLHN

SEQ ID NO: 121660 - protein, 30 aa, Artificial Sequence
  Description of Artificial Sequence: Synthetic polypeptide
DENEIRSTNPVATEQWGDVSEILMNSAEDA

SEQ ID NO: 121661 - protein, 33 aa, Artificial Sequence
  Description of Artificial Sequence: Synthetic polypeptide
MEEEITTTNPVATEQYGNVSVTQGGGQGDGDGE

SEQ ID NO: 121662 - protein, 34 aa, Artificial Sequence
  Description of Artificial Sequence: Synthetic polypeptide
MEGEIRTTNPVATEQYGSVSIMDHLDGTEGGDRQ

SEQ ID NO: 121663 - protein, 33 aa, Artificial Sequence
  Description of Artificial Sequence: Synthetic polypeptide
DEAEIRTTNPCATEEWGSVSTGNGAQLEGDHMQ

SEQ ID NO: 121664 - protein, 34 aa, Artificial Sequence
  Description of Artificial Sequence: Synthetic polypeptide
DENEIRGTNPVATEQYGSVVMTGMLIRGMGFDSE

SEQ ID NO: 121665 - protein, 36 aa, Artificial Sequence
  Description of Artificial Sequence: Synthetic polypeptide
AEEEIRTTNPVATEQYGVVSVTNNQNGSEQGTNDEQ

SEQ ID NO: 121666 - protein, 34 aa, Artificial Sequence
  Description of Artificial Sequence: Synthetic polypeptide
DEEEIRTTNPVATEQYGSVSATMTIVPVSTEELF

SEQ ID NO: 121667 - protein, 33 aa, Artificial Sequence
  Description of Artificial Sequence: Synthetic polypeptide
DESEIRTTNPVATECWGSGSCINEPQDREGEWG

SEQ ID NO: 121668 - protein, 33 aa, Artificial Sequence
  Description of Artificial Sequence: Synthetic polypeptide
DESEIRTTNPVATECWGSGSCIDEPQDREGENG

SEQ ID NO: 121669 - protein, 35 aa, Artificial Sequence
  Description of Artificial Sequence: Synthetic polypeptide
LEEEIRTTNPVAYEQYGTVSDTINEPHTRIGNLMT

SEQ ID NO: 121670 - protein, 36 aa, Artificial Sequence
  Description of Artificial Sequence: Synthetic polypeptide
DEEEIRTTNPVATEQYGSVSATDNDLAMMTISPEAE

SEQ ID NO: 121671 - protein, 33 aa, Artificial Sequence
  Description of Artificial Sequence: Synthetic polypeptide
DESEIRTTNPVATECWGSMSCINFPQDREGESG

SEQ ID NO: 121672 - protein, 34 aa, Artificial Sequence
  Description of Artificial Sequence: Synthetic polypeptide
DESEIRTTNPVATECWGSGMSFINTPQDREGENG

SEQ ID NO: 121673 - protein, 34 aa, Artificial Sequence
  Description of Artificial Sequence: Synthetic polypeptide
DESEIRTTNPVATECWGSFVSCINEPQDREGEIG

SEQ ID NO: 121674 - protein, 34 aa, Artificial Sequence
  Description of Artificial Sequence: Synthetic polypeptide
DEQEIATTNPVATEQYGSVSWTELQEDHQQHEDL

SEQ ID NO: 121675 - protein, 36 aa, Artificial Sequence
  Description of Artificial Sequence: Synthetic polypeptide
AEEEIRTTNPVATEQYGVVSTVVSNGNQAGQTNQTD

SEQ ID NO: 121676 - protein, 36 aa, Artificial Sequence
  Description of Artificial Sequence: Synthetic polypeptide
LEEEIRTTNPVATEQYGSVSSTTPAGPNMRNGMNPV

SEQ ID NO: 121677 - protein, 33 aa, Artificial Sequence
  Description of Artificial Sequence: Synthetic polypeptide
DEQEIATTNPVATEQYGSVWSATDWAEHEGEDI

SEQ ID NO: 121678 - protein, 36 aa, Artificial Sequence
  Description of Artificial Sequence: Synthetic polypeptide
LEEEIRTTNPVATEQYGSVSSTTPAAPNMRNGMNPV

SEQ ID NO: 121679 - protein, 36 aa, Artificial Sequence
  Description of Artificial Sequence: Synthetic polypeptide
LEEEIRTTNPVATEQYGSVSSQTPAGPNMRNGMNPV

SEQ ID NO: 121680 - protein, 36 aa, Artificial Sequence
  Description of Artificial Sequence: Synthetic polypeptide
AEEEIRTTNPVATEQYGVVVTVTTNNGNLQQGTNIN

SEQ ID NO: 121681 - protein, 33 aa, Artificial Sequence
  Description of Artificial Sequence: Synthetic polypeptide
DEECISTVNPVATEGYGQCVCSWNLERFGSNQA

SEQ ID NO: 121682 - protein, 33 aa, Artificial Sequence
  Description of Artificial Sequence: Synthetic polypeptide
DESEIRTTNPVATECWGSGTCINEPQDREGENG

SEQ ID NO: 121683 - protein, 33 aa, Artificial Sequence
  Description of Artificial Sequence: Synthetic polypeptide
DEECLRTTNPIAYEQYGCVCSTNHQNFGSDNQS

SEQ ID NO: 121684 - protein, 35 aa, Artificial Sequence
  Description of Artificial Sequence: Synthetic polypeptide
LENEIRTTNPVATEQYGSVSVTYNSLENRFESQSI

SEQ ID NO: 121685 - protein, 36 aa, Artificial Sequence
  Description of Artificial Sequence: Synthetic polypeptide
DEEEIRTTNPVATEQYGSVWCTEQNEDEQMQPQSNS

SEQ ID NO: 121686 - protein, 32 aa, Artificial Sequence
  Description of Artificial Sequence: Synthetic polypeptide
DENEIRCTNPVATEQYGCFSWASLTRIQENEQ

SEQ ID NO: 121687 - protein, 33 aa, Artificial Sequence
  Description of Artificial Sequence: Synthetic polypeptide
DESEIRTTNPVATECWGSMSCINEPQDREGEWG

SEQ ID NO: 121688 - protein, 36 aa, Artificial Sequence
  Description of Artificial Sequence: Synthetic polypeptide
AEEEIRTTNPVATEQYGVVVTVNTNLQSGSTDNGTQ

SEQ ID NO: 121689 - protein, 37 aa, Artificial Sequence
  Description of Artificial Sequence: Synthetic polypeptide
AEEEIRTTNPVATEQYGVVSVTVTNLQQQQEGTNVEQ

SEQ ID NO: 121690 - protein, 36 aa, Artificial Sequence
  Description of Artificial Sequence: Synthetic polypeptide
AEEEIRTTNPVATEQYGVVSVTVTNLQQGSTDGDTD

SEQ ID NO: 121691 - protein, 31 aa, Artificial Sequence
  Description of Artificial Sequence: Synthetic polypeptide
DEECISTVNPVATEGYGCVCSWNLENGSEQA

SEQ ID NO: 121692 - protein, 33 aa, Artificial Sequence
  Description of Artificial Sequence: Synthetic polypeptide
DEQEIATTNPVATEQYGSVWAATDLEDHEGEDL

SEQ ID NO: 121693 - protein, 35 aa, Artificial Sequence
  Description of Artificial Sequence: Synthetic polypeptide
AEEEIRTTNPVATEQYGVVSVTTNQQGNEQGSTAT

SEQ ID NO: 121694 - protein, 33 aa, Artificial Sequence
  Description of Artificial Sequence: Synthetic polypeptide
DEQEIATTNPVATEQYGSVWANTDLEDHEGEDL

SEQ ID NO: 121695 - protein, 33 aa, Artificial Sequence
  Description of Artificial Sequence: Synthetic polypeptide
DEECLRTTNPIAYEQYGCVCSNTELNQNFGSNQ

SEQ ID NO: 121696 - protein, 33 aa, Artificial Sequence
  Description of Artificial Sequence: Synthetic polypeptide
DENEIRATNPVATEQYGCVSWPFLTFRIQEGEQ

SEQ ID NO: 121697 - protein, 37 aa, Artificial Sequence
  Description of Artificial Sequence: Synthetic polypeptide
AEEEIRTTNPVATEQYGVVSVTTNNLQAGTEQGNQTN

SEQ ID NO: 121698 - protein, 32 aa, Artificial Sequence
  Description of Artificial Sequence: Synthetic polypeptide
DEECLRTTNPIAYEQYGCVCSSNLQNFGSEQS

SEQ ID NO: 121699 - protein, 33 aa, Artificial Sequence
  Description of Artificial Sequence: Synthetic polypeptide
DEECLRTTNPIAYEQYGCVCSTELQNFGSNNQA

SEQ ID NO: 121700 - protein, 37 aa, Artificial Sequence
  Description of Artificial Sequence: Synthetic polypeptide
AEEEIRTTNPVATEQYGVVSVTTTNLQAGTEAGNEEG

SEQ ID NO: 121701 - protein, 33 aa, Artificial Sequence
  Description of Artificial Sequence: Synthetic polypeptide
DEQEIATTNPVATEQYGSVWSATDWAEHEGPDI

SEQ ID NO: 121702 - protein, 32 aa, Artificial Sequence
  Description of Artificial Sequence: Synthetic polypeptide
DENEIRCTNPVATEQYGCVSWPFTTRIQENEQ

SEQ ID NO: 121703 - protein, 34 aa, Artificial Sequence
  Description of Artificial Sequence: Synthetic polypeptide
AEEEIRTTNPVATEQYGVVSTVVNQQAQTETEDE

SEQ ID NO: 121704 - protein, 31 aa, Artificial Sequence
  Description of Artificial Sequence: Synthetic polypeptide
CEEVIACTNPVATEQYGCVATNLATMNPEAE

SEQ ID NO: 121705 - protein, 33 aa, Artificial Sequence
  Description of Artificial Sequence: Synthetic polypeptide
DENEIRCTNPVATEQYGEASSTPAGPQMRGGPV

SEQ ID NO: 121706 - protein, 31 aa, Artificial Sequence
  Description of Artificial Sequence: Synthetic polypeptide
CEEVIACTNPVATEQYGCVATNLATMNPDEE

SEQ ID NO: 121707 - protein, 35 aa, Artificial Sequence
  Description of Artificial Sequence: Synthetic polypeptide
DESEIRTTNPVATECWGSNVSCINGEPQDREGYNG

SEQ ID NO: 121708 - protein, 31 aa, Artificial Sequence
  Description of Artificial Sequence: Synthetic polypeptide
CEEVIACTNPVATEQYGCVATNLAMNPNMHW

SEQ ID NO: 121709 - protein, 28 aa, Artificial Sequence
  Description of Artificial Sequence: Synthetic peptide
LEEEIATTNPVATEQYGEAYEVCKHEGK

SEQ ID NO: 121710 - protein, 33 aa, Artificial Sequence
  Description of Artificial Sequence: Synthetic polypeptide
DENEIKTTNPAATEQYGSVPTGLIMGGGGNGDT

SEQ ID NO: 121711 - protein, 35 aa, Artificial Sequence
  Description of Artificial Sequence: Synthetic polypeptide
DEEEIRTTNPVATEQYGSVVYNGFGQEGDQEEDDG

SEQ ID NO: 121712 - protein, 33 aa, Artificial Sequence
  Description of Artificial Sequence: Synthetic polypeptide
DENEIKTTNPAATEQYGSVPTGLIEGGGNNGDA

SEQ ID NO: 121713 - protein, 32 aa, Artificial Sequence
  Description of Artificial Sequence: Synthetic polypeptide
DEECNATTNPIAYEQWGEVCSTDNDGQHQGNR

SEQ ID NO: 121714 - protein, 35 aa, Artificial Sequence
  Description of Artificial Sequence: Synthetic polypeptide
DEEEIRTTNPVATEQYGSVSAPDNDIQMTIPVEEN

SEQ ID NO: 121715 - protein, 28 aa, Artificial Sequence
  Description of Artificial Sequence: Synthetic peptide
LEEEIATTNPVATEQYGEAPEVCIHEEK

SEQ ID NO: 121716 - protein, 34 aa, Artificial Sequence
  Description of Artificial Sequence: Synthetic polypeptide
MEEEIRSTNPVATEQYGSVSDGDFNEGGDEGENG

SEQ ID NO: 121717 - protein, 36 aa, Artificial Sequence
  Description of Artificial Sequence: Synthetic polypeptide
AEEEIRTTNPVATEQYGVVSTVVGSNNNQQGNNQSD

SEQ ID NO: 121718 - protein, 31 aa, Artificial Sequence
  Description of Artificial Sequence: Synthetic polypeptide
MEEEIRTTNPCATSRYGCVYATVALDQGGQG

SEQ ID NO: 121719 - protein, 32 aa, Artificial Sequence
  Description of Artificial Sequence: Synthetic polypeptide
DEECNATTNPIAYEQWGEVCSTDNDQHGGGNR

SEQ ID NO: 121720 - protein, 35 aa, Artificial Sequence
  Description of Artificial Sequence: Synthetic polypeptide
MEEEIRGTNPVATEQYGSVVMGDSNQNNQDIGGNG

SEQ ID NO: 121721 - protein, 35 aa, Artificial Sequence
  Description of Artificial Sequence: Synthetic polypeptide
DESEIRTTNPVATECWGSGVESCINEPQDREGENG

SEQ ID NO: 121722 - protein, 34 aa, Artificial Sequence
  Description of Artificial Sequence: Synthetic polypeptide
DECYIYTTNPVATEQYGCVSTNELMMGTFESNNT

SEQ ID NO: 121723 - protein, 35 aa, Artificial Sequence
  Description of Artificial Sequence: Synthetic polypeptide
DESEIRTTNPVATECWGSNVISCINEPQDREGENG

SEQ ID NO: 121724 - protein, 33 aa, Artificial Sequence
  Description of Artificial Sequence: Synthetic polypeptide
MEEEIRCTNPAATEQYGSVVSEGGLGGGENGLG

SEQ ID NO: 121725 - protein, 31 aa, Artificial Sequence
  Description of Artificial Sequence: Synthetic polypeptide
MEEEIRCTNPAATEQYGVVVSEGGMGGENGF

SEQ ID NO: 121726 - protein, 36 aa, Artificial Sequence
  Description of Artificial Sequence: Synthetic polypeptide
AEEEIRTTNPVATEQYGVVSTVVNNQQQNDEAGNNE

SEQ ID NO: 121727 - protein, 32 aa, Artificial Sequence
  Description of Artificial Sequence: Synthetic polypeptide
DEAEIRTTNPEATDQYGQVCCCDQDQKREGNH

SEQ ID NO: 121728 - protein, 31 aa, Artificial Sequence
  Description of Artificial Sequence: Synthetic polypeptide
DENEIRCTNPVATEQYGCVVWAPMTRQENQN

SEQ ID NO: 121729 - protein, 33 aa, Artificial Sequence
  Description of Artificial Sequence: Synthetic polypeptide
DECTICTTNPVATEQYGVVTVTNQQQQGNGNVD

SEQ ID NO: 121730 - protein, 37 aa, Artificial Sequence
  Description of Artificial Sequence: Synthetic polypeptide
AEEEIRTTNPVATEQYGVVSTVVNNLQQQETGTNNVA

SEQ ID NO: 121731 - protein, 33 aa, Artificial Sequence
  Description of Artificial Sequence: Synthetic polypeptide
DENEIKTTNPAATEQYGSVPTGLIMGGGNGGDP

SEQ ID NO: 121732 - protein, 33 aa, Artificial Sequence
  Description of Artificial Sequence: Synthetic polypeptide
DESEIRTTNPVATECWGSNSCINEPQDREIENG

SEQ ID NO: 121733 - protein, 34 aa, Artificial Sequence
  Description of Artificial Sequence: Synthetic polypeptide
DEQEIATTNPVATEQYGSVSWTDQLEDHQQKEDL

SEQ ID NO: 121734 - protein, 34 aa, Artificial Sequence
  Description of Artificial Sequence: Synthetic polypeptide
DEQEIATTNPVATEQYGSVSWTDLQEDHQQEEDP

SEQ ID NO: 121735 - protein, 37 aa, Artificial Sequence
  Description of Artificial Sequence: Synthetic polypeptide
AEEEIRTTNPVATEQYGVVSTVVNNLQNGNQEGNNAE

SEQ ID NO: 121736 - protein, 32 aa, Artificial Sequence
  Description of Artificial Sequence: Synthetic polypeptide
DECWIATTNPVATEQYGSVSATDLEDHEKEDL

SEQ ID NO: 121737 - protein, 32 aa, Artificial Sequence
  Description of Artificial Sequence: Synthetic polypeptide
CEEVIACTNPVATEQYGCVATNLATMNPTNSR

SEQ ID NO: 121738 - protein, 36 aa, Artificial Sequence
  Description of Artificial Sequence: Synthetic polypeptide
DEEEIRTTNPVATEQYGSVVYPTETMLQEVASLGPQ

SEQ ID NO: 121739 - protein, 37 aa, Artificial Sequence
  Description of Artificial Sequence: Synthetic polypeptide
AEEEIRTTNPVATEQYGVVSTVVNNLNQQQIGTNDEM

SEQ ID NO: 121740 - protein, 34 aa, Artificial Sequence
  Description of Artificial Sequence: Synthetic polypeptide
LEEEIRTTNPVATEQYGSVSDAELTTEGGMEDFQ

SEQ ID NO: 121741 - protein, 32 aa, Artificial Sequence
  Description of Artificial Sequence: Synthetic polypeptide
DEECNATTNPIAYEQWGEVCSTDNQDQHMGNR

SEQ ID NO: 121742 - protein, 35 aa, Artificial Sequence
  Description of Artificial Sequence: Synthetic polypeptide
DEQEIATTNPVATEQYGSVVSCTLLSEDHEGGKNL

SEQ ID NO: 121743 - protein, 37 aa, Artificial Sequence
  Description of Artificial Sequence: Synthetic polypeptide
AEEEIRTTNPVATEQYGVVSVVSSTTNLQQGTEAGSV

SEQ ID NO: 121744 - protein, 35 aa, Artificial Sequence
  Description of Artificial Sequence: Synthetic polypeptide
DEEEIRTTNPVATEQYGSVSAVPNDIQQTISVEEP

SEQ ID NO: 121745 - protein, 28 aa, Artificial Sequence
  Description of Artificial Sequence: Synthetic peptide
LESEIASTNPVGTEGYGVMASTLQHGDI

SEQ ID NO: 121746 - protein, 34 aa, Artificial Sequence
  Description of Artificial Sequence: Synthetic polypeptide
DECTICTTNPVATEQYGVVSTTNQQQSGNGTNVD

SEQ ID NO: 121747 - protein, 30 aa, Artificial Sequence
  Description of Artificial Sequence: Synthetic polypeptide
DENEIRCTNPVATEQWGDVSEILMNAAEDA

SEQ ID NO: 121748 - protein, 33 aa, Artificial Sequence
  Description of Artificial Sequence: Synthetic polypeptide
DESEIRTTNPVATECWGSMHCINEPQDREGENG

SEQ ID NO: 121749 - protein, 35 aa, Artificial Sequence
  Description of Artificial Sequence: Synthetic polypeptide
DEEEIRTTNPVATEQYGSVWNAVPDPMVQMGSNEE

SEQ ID NO: 121750 - protein, 34 aa, Artificial Sequence
  Description of Artificial Sequence: Synthetic polypeptide
DEEEIRTTNPVATEQYGSVWNMNVEDVEVIENED

SEQ ID NO: 121751 - protein, 34 aa, Artificial Sequence
  Description of Artificial Sequence: Synthetic polypeptide
DECTICTTNPVATEQYGVVSTTNQPQTTGTNDED

SEQ ID NO: 121752 - protein, 31 aa, Artificial Sequence
  Description of Artificial Sequence: Synthetic polypeptide
DENEIRCTNPISTEQYGTISMENIQQQNGNH

SEQ ID NO: 121753 - protein, 31 aa, Artificial Sequence
  Description of Artificial Sequence: Synthetic polypeptide
DENEIRCTNPISTEQYGTISEENIQQQNGNH

SEQ ID NO: 121754 - protein, 32 aa, Artificial Sequence
  Description of Artificial Sequence: Synthetic polypeptide
DENEIRCTNPISTEPYGTVSEENLQQQQNGNH

SEQ ID NO: 121755 - protein, 33 aa, Artificial Sequence
  Description of Artificial Sequence: Synthetic polypeptide
DEECLRTTNPCAYEQYGCVCSTELQENFGSNQA

SEQ ID NO: 121756 - protein, 33 aa, Artificial Sequence
  Description of Artificial Sequence: Synthetic polypeptide
DESEIRTTNPVATECWGSMSCINEPEDREGENG

SEQ ID NO: 121757 - protein, 32 aa, Artificial Sequence
  Description of Artificial Sequence: Synthetic polypeptide
DENEIRCTNPIATEQYGTISMEDIQQQRNGNH

SEQ ID NO: 121758 - protein, 34 aa, Artificial Sequence
  Description of Artificial Sequence: Synthetic polypeptide
DEECLRTTNPCAYEQYGCVCSTGNLQEYFGSNQS

SEQ ID NO: 121759 - protein, 28 aa, Artificial Sequence
  Description of Artificial Sequence: Synthetic peptide
LESEIASTNPVGTESYGVMASTLQHGDI

SEQ ID NO: 121760 - protein, 35 aa, Artificial Sequence
  Description of Artificial Sequence: Synthetic polypeptide
DEEEIRTTNPVATEQYGSVSAWPAGEQEMMSPEFR

SEQ ID NO: 121761 - protein, 33 aa, Artificial Sequence
  Description of Artificial Sequence: Synthetic polypeptide
MDCEIRTTNPVATEQYGSVPDTFWNETESQNMR

SEQ ID NO: 121762 - protein, 36 aa, Artificial Sequence
  Description of Artificial Sequence: Synthetic polypeptide
DEEEIRTTNPVATEQYGSVSAYFNYMHQTENPEDIQ

SEQ ID NO: 121763 - protein, 33 aa, Artificial Sequence
  Description of Artificial Sequence: Synthetic polypeptide
DESEIRTTNPVATECWGSMACINEPQDREGENG

SEQ ID NO: 121764 - protein, 34 aa, Artificial Sequence
  Description of Artificial Sequence: Synthetic polypeptide
LESEIRTTNPVATECWGSEVSCINEPQDREGENG

SEQ ID NO: 121765 - protein, 30 aa, Artificial Sequence
  Description of Artificial Sequence: Synthetic polypeptide
DENEIRCTNPVATEQWGDASEIEQNAAGGA

SEQ ID NO: 121766 - protein, 33 aa, Artificial Sequence
  Description of Artificial Sequence: Synthetic polypeptide
LESEIRTTNPVATECWGSVSCINEPQDRECENG

SEQ ID NO: 121767 - protein, 35 aa, Artificial Sequence
  Description of Artificial Sequence: Synthetic polypeptide
DESEIRTTNPVATECWGSIVSSCINEPQDREGENG

SEQ ID NO: 121768 - protein, 33 aa, Artificial Sequence
  Description of Artificial Sequence: Synthetic polypeptide
LESEIRTTNPVAVECWGSVSCINEPQDREGENG

SEQ ID NO: 121769 - protein, 33 aa, Artificial Sequence
  Description of Artificial Sequence: Synthetic polypeptide
LESEITTTNPVATECWGSVSCINEPQDREGENG

SEQ ID NO: 121770 - protein, 33 aa, Artificial Sequence
  Description of Artificial Sequence: Synthetic polypeptide
DEQEIATTNPVATEQYGSVTLTDLEDGEGEDLQ

SEQ ID NO: 121771 - protein, 34 aa, Artificial Sequence
  Description of Artificial Sequence: Synthetic polypeptide
LNDEIRTTNPVATEQYGVVGITPNLNEDFGPNLR

SEQ ID NO: 121772 - protein, 33 aa, Artificial Sequence
  Description of Artificial Sequence: Synthetic polypeptide
LNDEIRTTNPVATEQYGVVGSTNLNEDFGPHLW

SEQ ID NO: 121773 - protein, 34 aa, Artificial Sequence
  Description of Artificial Sequence: Synthetic polypeptide
DESEIRTTNPVATECWGSIVSNINEPQDGEGENG

SEQ ID NO: 121774 - protein, 31 aa, Artificial Sequence
  Description of Artificial Sequence: Synthetic polypeptide
DENEIRCTNPVATEPYGTISEEDIQQRNGGH

SEQ ID NO: 121775 - protein, 33 aa, Artificial Sequence
  Description of Artificial Sequence: Synthetic polypeptide
LESEIRTTNPVAMECWGSVSCINEPQDREGENG

SEQ ID NO: 121776 - protein, 34 aa, Artificial Sequence
  Description of Artificial Sequence: Synthetic polypeptide
DESEIRTTNPVATECWGSIVSCINEPQDWEGENG

SEQ ID NO: 121777 - protein, 35 aa, Artificial Sequence
  Description of Artificial Sequence: Synthetic polypeptide
DESEIRTTNPVATECWGSISVINFLPQDREGENCG

SEQ ID NO: 121778 - protein, 33 aa, Artificial Sequence
  Description of Artificial Sequence: Synthetic polypeptide
LESEIRPTNPVATECWGSVSCINEPQDREGENG

SEQ ID NO: 121779 - protein, 29 aa, Artificial Sequence
  Description of Artificial Sequence: Synthetic peptide
DENEIRCTNPVATEQWGDVSEIEMAAEDA

SEQ ID NO: 121780 - protein, 35 aa, Artificial Sequence
  Description of Artificial Sequence: Synthetic polypeptide
DEEEIRTTNPVATEQYGSVWELMQMTMQRDINDGD

SEQ ID NO: 121781 - protein, 29 aa, Artificial Sequence
  Description of Artificial Sequence: Synthetic peptide
LESEIASTNPVGTEGYGVMASTFLQHGDI

SEQ ID NO: 121782 - protein, 33 aa, Artificial Sequence
  Description of Artificial Sequence: Synthetic polypeptide
DESEIRTTNPVATECWGSISCINEPEDREGENG

SEQ ID NO: 121783 - protein, 35 aa, Artificial Sequence
  Description of Artificial Sequence: Synthetic polypeptide
DESEIRTTNPVATECWGSGVSVCINEPQDREGENG

SEQ ID NO: 121784 - protein, 37 aa, Artificial Sequence
  Description of Artificial Sequence: Synthetic polypeptide
AEEEIRTTNPVATEQYGVVSVVTTNQQGNLQQGTNND

SEQ ID NO: 121785 - protein, 34 aa, Artificial Sequence
  Description of Artificial Sequence: Synthetic polypeptide
DEAEIRTTNPVTTEHYGSVYCMPNQDQNRQGNDL

SEQ ID NO: 121786 - protein, 36 aa, Artificial Sequence
  Description of Artificial Sequence: Synthetic polypeptide
DEEEIRTTNPVATEQYGSVSATPNDIQQTISVEVEW

SEQ ID NO: 121787 - protein, 34 aa, Artificial Sequence
  Description of Artificial Sequence: Synthetic polypeptide
MEEEIATTNPVATEQYGCVCSTTGELQGFGSDQM

SEQ ID NO: 121788 - protein, 33 aa, Artificial Sequence
  Description of Artificial Sequence: Synthetic polypeptide
LEQEIATTNPVATEQYGSVMSATDLEDHEGEDL

SEQ ID NO: 121789 - protein, 32 aa, Artificial Sequence
  Description of Artificial Sequence: Synthetic polypeptide
CEEVIACTNPVATEQYGCVATNLPDNTEGNMQ

SEQ ID NO: 121790 - protein, 33 aa, Artificial Sequence
  Description of Artificial Sequence: Synthetic polypeptide
LEQEIATTNPVATEQYGSVSATDLEDHEGHEDL

SEQ ID NO: 121791 - protein, 36 aa, Artificial Sequence
  Description of Artificial Sequence: Synthetic polypeptide
AEEEIRTTNPVATEQYGVVSVVTNNNNAQQGNNGNQ

SEQ ID NO: 121792 - protein, 33 aa, Artificial Sequence
  Description of Artificial Sequence: Synthetic polypeptide
AEEEIRTTNPVATEQYGVVSVVTATTTQDEQIQ

SEQ ID NO: 121793 - protein, 35 aa, Artificial Sequence
  Description of Artificial Sequence: Synthetic polypeptide
DEEEIRTTNPVATEQYGSVSATPMPIQQTISVEEW

SEQ ID NO: 121794 - protein, 34 aa, Artificial Sequence
  Description of Artificial Sequence: Synthetic polypeptide
DESEIRTTNPVATECWGSGVSCIIEPQDREGENG

SEQ ID NO: 121795 - protein, 32 aa, Artificial Sequence
  Description of Artificial Sequence: Synthetic polypeptide
LEQEIATTNPVATEFYGSVSATDLEDHEGEDL

SEQ ID NO: 121796 - protein, 29 aa, Artificial Sequence
  Description of Artificial Sequence: Synthetic peptide
MEEEIATTNPVATEQYGEAPEVCQMHEEK

SEQ ID NO: 121797 - protein, 32 aa, Artificial Sequence
  Description of Artificial Sequence: Synthetic polypeptide
DENEIRCTNPVATEQYGAAANADWQERKGGYR

SEQ ID NO: 121798 - protein, 34 aa, Artificial Sequence
  Description of Artificial Sequence: Synthetic polypeptide
DEQEIATTNPVATEQYGSVVSCTDALENHEGEDL

SEQ ID NO: 121799 - protein, 33 aa, Artificial Sequence
  Description of Artificial Sequence: Synthetic polypeptide
LEQEIATTNPVATEQYGQSVSATDLEDHEGEDL

SEQ ID NO: 121800 - protein, 36 aa, Artificial Sequence
  Description of Artificial Sequence: Synthetic polypeptide
AEEEIRTTNPVATEQYGVVSVVSNNQQGTNGNNNQD

SEQ ID NO: 121801 - protein, 34 aa, Artificial Sequence
  Description of Artificial Sequence: Synthetic polypeptide
DEQEIATTNPVATEQYGSVVSATDLEDHEGKEDL

SEQ ID NO: 121802 - protein, 34 aa, Artificial Sequence
  Description of Artificial Sequence: Synthetic polypeptide
DESEIRTTNPVATECWGSMSCINEPQDREGENIF

SEQ ID NO: 121803 - protein, 32 aa, Artificial Sequence
  Description of Artificial Sequence: Synthetic polypeptide
CEEVIACTNPVATEQYGCVATNLPDTNEQNPR

SEQ ID NO: 121804 - protein, 33 aa, Artificial Sequence
  Description of Artificial Sequence: Synthetic polypeptide
DEQEIATTNPVATEQYGSVTSATDLEDHESEDL

SEQ ID NO: 121805 - protein, 33 aa, Artificial Sequence
  Description of Artificial Sequence: Synthetic polypeptide
DESEIRTTNPVATECWGSISCIFEPQDREGENG

SEQ ID NO: 121806 - protein, 28 aa, Artificial Sequence
  Description of Artificial Sequence: Synthetic peptide
LESEIASTNPVGTEGYGVIASTLQHGDI

SEQ ID NO: 121807 - protein, 33 aa, Artificial Sequence
  Description of Artificial Sequence: Synthetic polypeptide
DESEIRTTNPVATECWGSMSCINEPQDREGEDG

SEQ ID NO: 121808 - protein, 33 aa, Artificial Sequence
  Description of Artificial Sequence: Synthetic polypeptide
DEQEIATTNPVATEQYGSVVAATHLADHEGEDL

SEQ ID NO: 121809 - protein, 34 aa, Artificial Sequence
  Description of Artificial Sequence: Synthetic polypeptide
DECTICTTNPVATEQYGVVSTTNPQTTNGTNDED

SEQ ID NO: 121810 - protein, 34 aa, Artificial Sequence
  Description of Artificial Sequence: Synthetic polypeptide
DESEIRTTNPVATECWGSHCSCINEPQDREGENG

SEQ ID NO: 121811 - protein, 33 aa, Artificial Sequence
  Description of Artificial Sequence: Synthetic polypeptide
DEQEIATTNPVATEQYGSVVATDLREDHEGQDL

SEQ ID NO: 121812 - protein, 37 aa, Artificial Sequence
  Description of Artificial Sequence: Synthetic polypeptide
AEEEIRTTNPVATEQYGVVSVVVTTTTNLQSGVTNQQ

SEQ ID NO: 121813 - protein, 34 aa, Artificial Sequence
  Description of Artificial Sequence: Synthetic polypeptide
DECTICTTNPVATEQYGVVSTTNNPVQTGTNDED

SEQ ID NO: 121814 - protein, 36 aa, Artificial Sequence
  Description of Artificial Sequence: Synthetic polypeptide
DEEEIRTTNPVATEQYGSVSATTPAGENMNNGMEPV

SEQ ID NO: 121815 - protein, 33 aa, Artificial Sequence
  Description of Artificial Sequence: Synthetic polypeptide
DEQEIATTNPVATEQYGSVVSADDLEDHEGEDL

SEQ ID NO: 121816 - protein, 32 aa, Artificial Sequence
  Description of Artificial Sequence: Synthetic polypeptide
LEQEIATTNPVATEQYGSVSATDMEDHEGEDL

SEQ ID NO: 121817 - protein, 34 aa, Artificial Sequence
  Description of Artificial Sequence: Synthetic polypeptide
DESEIRTTNPVATECWGSHSMCINEPQDREGENG

SEQ ID NO: 121818 - protein, 34 aa, Artificial Sequence
  Description of Artificial Sequence: Synthetic polypeptide
DEQEIATTNPVATEQYGSVVSATDLDEDHEGEDL

SEQ ID NO: 121819 - protein, 34 aa, Artificial Sequence
  Description of Artificial Sequence: Synthetic polypeptide
DESEIRTTNPVATECWGSIASCINEPQDREGENG

SEQ ID NO: 121820 - protein, 35 aa, Artificial Sequence
  Description of Artificial Sequence: Synthetic polypeptide
DESEIRTTNPVATECWGSAVLSCINEPQDREGENG

SEQ ID NO: 121821 - protein, 35 aa, Artificial Sequence
  Description of Artificial Sequence: Synthetic polypeptide
DEEEIRTTNPVATEQYGSVSANVGNLVEVAAVEEE

SEQ ID NO: 121822 - protein, 36 aa, Artificial Sequence
  Description of Artificial Sequence: Synthetic polypeptide
AEEEIRTTNPVATEQYGVVSTVTQNSNQQGNNNNNQ

SEQ ID NO: 121823 - protein, 34 aa, Artificial Sequence
  Description of Artificial Sequence: Synthetic polypeptide
DEQEIATTNPVATEQYGTSVSATDLMEDHEGEDL

SEQ ID NO: 121824 - protein, 33 aa, Artificial Sequence
  Description of Artificial Sequence: Synthetic polypeptide
DEQEIATTNPVATEQYGTSWSATDLEDHEGEDL

SEQ ID NO: 121825 - protein, 32 aa, Artificial Sequence
  Description of Artificial Sequence: Synthetic polypeptide
DEECISTVNPVATEAYGCVCSWNLENFGSNTQ

SEQ ID NO: 121826 - protein, 35 aa, Artificial Sequence
  Description of Artificial Sequence: Synthetic polypeptide
DESEIRTTNPVATECWGSCVSCINEPQDREGENGI

SEQ ID NO: 121827 - protein, 35 aa, Artificial Sequence
  Description of Artificial Sequence: Synthetic polypeptide
MEEEIRTTNPVATEQYGSVSINNGMGQNDEFTGEL

SEQ ID NO: 121828 - protein, 35 aa, Artificial Sequence
  Description of Artificial Sequence: Synthetic polypeptide
DEQEIATTNPVATEQYGSVSWNEQNGQRQNDGDQE

SEQ ID NO: 121829 - protein, 36 aa, Artificial Sequence
  Description of Artificial Sequence: Synthetic polypeptide
MEEEIRTTNPVATEQYGSVSNLPTQNYQPVNLEELA

SEQ ID NO: 121830 - protein, 36 aa, Artificial Sequence
  Description of Artificial Sequence: Synthetic polypeptide
MEEEIRTTNPVATEQYGSVSPTLNMMMQEEGEEEVN

SEQ ID NO: 121831 - protein, 28 aa, Artificial Sequence
  Description of Artificial Sequence: Synthetic peptide
KEAEIATTNPVATEQYGEAPEVCQHEEK

SEQ ID NO: 121832 - protein, 34 aa, Artificial Sequence
  Description of Artificial Sequence: Synthetic polypeptide
ITEEIRTTNPVATDQYGSVSTQGMGQTRGQTEGQ

SEQ ID NO: 121833 - protein, 33 aa, Artificial Sequence
  Description of Artificial Sequence: Synthetic polypeptide
DESEIRTTNPVATECWGSCSCPNEPWDREGENG

SEQ ID NO: 121834 - protein, 32 aa, Artificial Sequence
  Description of Artificial Sequence: Synthetic polypeptide
INEEIRTTNPVATEQWGCVSLLDTYQEGVQNP

SEQ ID NO: 121835 - protein, 37 aa, Artificial Sequence
  Description of Artificial Sequence: Synthetic polypeptide
AEEEIRTTNPVATEQYGVVSTVTNNLQNGNDEGNVAE

SEQ ID NO: 121836 - protein, 33 aa, Artificial Sequence
  Description of Artificial Sequence: Synthetic polypeptide
IESEIRTTNPEATECWGSVSCINEPQDREGENG

SEQ ID NO: 121837 - protein, 28 aa, Artificial Sequence
  Description of Artificial Sequence: Synthetic peptide
IESEIASTNPVGTEGYGVMASTLQHGDI

SEQ ID NO: 121838 - protein, 33 aa, Artificial Sequence
  Description of Artificial Sequence: Synthetic polypeptide
DEQEIATTNPVATEQYGTISATEDIEQQEGNDL

SEQ ID NO: 121839 - protein, 31 aa, Artificial Sequence
  Description of Artificial Sequence: Synthetic polypeptide
DEECISTVNPVATEEYGCVCSWELENGSNQA

SEQ ID NO: 121840 - protein, 34 aa, Artificial Sequence
  Description of Artificial Sequence: Synthetic polypeptide
DEQEIATTNPVATEQYGSVSWNEQNNQNNGGGDT

SEQ ID NO: 121841 - protein, 37 aa, Artificial Sequence
  Description of Artificial Sequence: Synthetic polypeptide
MEEEIRTTNPVATEQYGSVSGSTDNGLGQEGQGGQGE

SEQ ID NO: 121842 - protein, 36 aa, Artificial Sequence
  Description of Artificial Sequence: Synthetic polypeptide
DEEEIRTTNPVATEQYGSVWPVPNVLMARDGVVQEI

SEQ ID NO: 121843 - protein, 36 aa, Artificial Sequence
  Description of Artificial Sequence: Synthetic polypeptide
DECTICTTNPVATEQYGSVTVVSTNLQIGIGNNQDD

SEQ ID NO: 121844 - protein, 31 aa, Artificial Sequence
  Description of Artificial Sequence: Synthetic polypeptide
DENEIRCTNPVSTEPYGTVSMEDIMQQNGNH

SEQ ID NO: 121845 - protein, 36 aa, Artificial Sequence
  Description of Artificial Sequence: Synthetic polypeptide
KEEEIRTTNPVATEQYGSVSRTTPAGPNMRNGMNPV

SEQ ID NO: 121846 - protein, 34 aa, Artificial Sequence
  Description of Artificial Sequence: Synthetic polypeptide
DEQEIATTNPVATEQYGSYVSATDFLEDHEGEDL

SEQ ID NO: 121847 - protein, 31 aa, Artificial Sequence
  Description of Artificial Sequence: Synthetic polypeptide
DENEIATVNPVSTEPYGVVSMENIQQQQGNH

SEQ ID NO: 121848 - protein, 35 aa, Artificial Sequence
  Description of Artificial Sequence: Synthetic polypeptide
DECTICTTNPVATEQYGSVTVVNTNLQIGIGNNVD

SEQ ID NO: 121849 - protein, 33 aa, Artificial Sequence
  Description of Artificial Sequence: Synthetic polypeptide
IEQEIATTNPVATEQYGSVSATSDLEDHEGEDL

SEQ ID NO: 121850 - protein, 36 aa, Artificial Sequence
  Description of Artificial Sequence: Synthetic polypeptide
MEEEIRTTNPVATEQYGSVSDSNGGGQGENDGNGGV

SEQ ID NO: 121851 - protein, 35 aa, Artificial Sequence
  Description of Artificial Sequence: Synthetic polypeptide
DEAEIRTTNPCATEQWGSVYCTDNGDQQRSGDNHA

SEQ ID NO: 121852 - protein, 34 aa, Artificial Sequence
  Description of Artificial Sequence: Synthetic polypeptide
DESEIRTTNPVATECWGSDSCINEPQDREGENGV

SEQ ID NO: 121853 - protein, 36 aa, Artificial Sequence
  Description of Artificial Sequence: Synthetic polypeptide
AEEEIRTTNPVATEQYGVVVVTTIGTNLQQGTTNME

SEQ ID NO: 121854 - protein, 36 aa, Artificial Sequence
  Description of Artificial Sequence: Synthetic polypeptide
AEEEIRTTNPVATEQYGVVVVTTNLQQQQQGTNDEE

SEQ ID NO: 121855 - protein, 34 aa, Artificial Sequence
  Description of Artificial Sequence: Synthetic polypeptide
DESEIRTTNPVATECWGSPVSCINEPQDREGEHG

SEQ ID NO: 121856 - protein, 33 aa, Artificial Sequence
  Description of Artificial Sequence: Synthetic polypeptide
DEQEIATTNPVATEQYGTISATEDIEDQEGNDL

SEQ ID NO: 121857 - protein, 36 aa, Artificial Sequence
  Description of Artificial Sequence: Synthetic polypeptide
MEEEIRTTNPVATEQYGSVSGGNGTGQGENDGNGGS

SEQ ID NO: 121858 - protein, 34 aa, Artificial Sequence
  Description of Artificial Sequence: Synthetic polypeptide
DEQEIATTNPVATEQYGSYVSATSDLEDHEGEDL

SEQ ID NO: 121859 - protein, 29 aa, Artificial Sequence
  Description of Artificial Sequence: Synthetic peptide
DENEIRGTNPVATEQWGDVSEIEMNAEDA

SEQ ID NO: 121860 - protein, 33 aa, Artificial Sequence
  Description of Artificial Sequence: Synthetic polypeptide
IEQEIATTNPVATEQYGSVSATPDLEDHEGEDL

SEQ ID NO: 121861 - protein, 33 aa, Artificial Sequence
  Description of Artificial Sequence: Synthetic polypeptide
IEQEIATTNPVATEQYGSVSATDLEVHENEMLD

SEQ ID NO: 121862 - protein, 36 aa, Artificial Sequence
  Description of Artificial Sequence: Synthetic polypeptide
MEEEIRTTNPVATEQYGSVSSTTPAGPNMRNGMNPV

SEQ ID NO: 121863 - protein, 35 aa, Artificial Sequence
  Description of Artificial Sequence: Synthetic polypeptide
DESEIRTTNPVATECWGSAVSSCINEPQDREGENG

SEQ ID NO: 121864 - protein, 36 aa, Artificial Sequence
  Description of Artificial Sequence: Synthetic polypeptide
MEEEIRTTNPVATEQYGSVSSTTPAYPNMRNGMNPL

SEQ ID NO: 121865 - protein, 31 aa, Artificial Sequence
  Description of Artificial Sequence: Synthetic polypeptide
DENEIATTNPVSTEQYGEISMDIQQQQNGNH

SEQ ID NO: 121866 - protein, 36 aa, Artificial Sequence
  Description of Artificial Sequence: Synthetic polypeptide
IEEEIRTTNPVATEQYGSVSSTTPAGPNMRNGMNPV

SEQ ID NO: 121867 - protein, 36 aa, Artificial Sequence
  Description of Artificial Sequence: Synthetic polypeptide
IEEEIRTTNPVATEQYGSVQSTTPAGPNMRNGMNPV

SEQ ID NO: 121868 - protein, 36 aa, Artificial Sequence
  Description of Artificial Sequence: Synthetic polypeptide
IEEEIRTTNPVATEQYGSVISTTPAGPNMRNGMNPV

SEQ ID NO: 121869 - protein, 36 aa, Artificial Sequence
  Description of Artificial Sequence: Synthetic polypeptide
IEEEIRTTNPVATEQYGSVSSTTPAGPNMRVGMNPV

SEQ ID NO: 121870 - protein, 36 aa, Artificial Sequence
  Description of Artificial Sequence: Synthetic polypeptide
IEEEIRTTNPVATEQYGSVGSLTVNTEEHRLAGPLS

SEQ ID NO: 121871 - protein, 37 aa, Artificial Sequence
  Description of Artificial Sequence: Synthetic polypeptide
AEEEIRTTNPVATEQYGVVSTVTNNLNQQQIGNNTEL

SEQ ID NO: 121872 - protein, 35 aa, Artificial Sequence
  Description of Artificial Sequence: Synthetic polypeptide
MEEEIRTTNPVATEQYGSVSTENGPQADELEIQEM

SEQ ID NO: 121873 - protein, 34 aa, Artificial Sequence
  Description of Artificial Sequence: Synthetic polypeptide
DECTICTTNPVATEQWGSVSTTNQQNQQQGNNTD

SEQ ID NO: 121874 - protein, 35 aa, Artificial Sequence
  Description of Artificial Sequence: Synthetic polypeptide
IEEEIRTTNPVATEQYGSVCSPTNNLETVDDTQES

SEQ ID NO: 121875 - protein, 33 aa, Artificial Sequence
  Description of Artificial Sequence: Synthetic polypeptide
DEQEIATTNPVATEQYGTVCSATDGGVDPEGND

SEQ ID NO: 121876 - protein, 33 aa, Artificial Sequence
  Description of Artificial Sequence: Synthetic polypeptide
DEQEIATTNPVATEQYGTVCSATDGGVEDGGND

SEQ ID NO: 121877 - protein, 33 aa, Artificial Sequence
  Description of Artificial Sequence: Synthetic polypeptide
IEEEIRTTNPVATEGYGSVVCIVPPLDLAGSNS

SEQ ID NO: 121878 - protein, 36 aa, Artificial Sequence
  Description of Artificial Sequence: Synthetic polypeptide
MEEEIRTTNPVATEQYGSVSSTTRAGPNMRNGMNPV

SEQ ID NO: 121879 - protein, 36 aa, Artificial Sequence
  Description of Artificial Sequence: Synthetic polypeptide
KEEEIRTTNPVATEQYGSVSSTTPAGPNMRNGMNPV

SEQ ID NO: 121880 - protein, 35 aa, Artificial Sequence
  Description of Artificial Sequence: Synthetic polypeptide
IEEEIRTTNPVATEQYGSVTPTNGDETTQSGQDGQ

SEQ ID NO: 121881 - protein, 35 aa, Artificial Sequence
  Description of Artificial Sequence: Synthetic polypeptide
DEEEIRTTNPVATEQYGSVWSPSYGPLEQLFDEVE

SEQ ID NO: 121882 - protein, 33 aa, Artificial Sequence
  Description of Artificial Sequence: Synthetic polypeptide
IEQEIATTNPVATEQYGSVSATDLEEDHEGEDT

SEQ ID NO: 121883 - protein, 36 aa, Artificial Sequence
  Description of Artificial Sequence: Synthetic polypeptide
AEEEIRTTNPVATEQYGVVSTVTNNLNSNNGTNDTD

SEQ ID NO: 121884 - protein, 30 aa, Artificial Sequence
  Description of Artificial Sequence: Synthetic polypeptide
IENEIATTNPVATECYGQVSEWLEQHEEEL

SEQ ID NO: 121885 - protein, 31 aa, Artificial Sequence
  Description of Artificial Sequence: Synthetic polypeptide
DENEIRGTNPVATEQYGSVMDGMIEMDGGGF

SEQ ID NO: 121886 - protein, 37 aa, Artificial Sequence
  Description of Artificial Sequence: Synthetic polypeptide
AEEEIRTTNPVATEQYGVVSTVTNNLNQQQIGTNTDE

SEQ ID NO: 121887 - protein, 32 aa, Artificial Sequence
  Description of Artificial Sequence: Synthetic polypeptide
DENEIATTNPVSTEQYGTVSMEDLQQDHNGEH

SEQ ID NO: 121888 - protein, 31 aa, Artificial Sequence
  Description of Artificial Sequence: Synthetic polypeptide
IENEIATTNPVATECYGHVSEVLEQHGQEDL

SEQ ID NO: 121889 - protein, 36 aa, Artificial Sequence
  Description of Artificial Sequence: Synthetic polypeptide
MEEEIRTTNPVATEQYGSVSSTTPAGPNMRNGMNPE

SEQ ID NO: 121890 - protein, 33 aa, Artificial Sequence
  Description of Artificial Sequence: Synthetic polypeptide
DENEIATTNPVSTEQYGTVSATDIQEDQEGNDL

SEQ ID NO: 121891 - protein, 37 aa, Artificial Sequence
  Description of Artificial Sequence: Synthetic polypeptide
AEEEIRTTNPVATEQYGVVSTVTNNLNQQQIGTNQEQ

SEQ ID NO: 121892 - protein, 35 aa, Artificial Sequence
  Description of Artificial Sequence: Synthetic polypeptide
AEEEIRTTNPVATEQYGVVVVTVTNLGGTEQGNNQ

SEQ ID NO: 121893 - protein, 34 aa, Artificial Sequence
  Description of Artificial Sequence: Synthetic polypeptide
IEEEISPTNPVATEQYGSVSVQNGLSATGGNGME

SEQ ID NO: 121894 - protein, 32 aa, Artificial Sequence
  Description of Artificial Sequence: Synthetic polypeptide
DENEIATTNPVSTEQYGTVSAMDLQQDHNGEH

SEQ ID NO: 121895 - protein, 30 aa, Artificial Sequence
  Description of Artificial Sequence: Synthetic polypeptide
DENEIATTNPVSTEQYGTIPEEVIQQHGNH

SEQ ID NO: 121896 - protein, 30 aa, Artificial Sequence
  Description of Artificial Sequence: Synthetic polypeptide
DENEIATTNPVSTEQYGTIPEEDIQQQGNH

SEQ ID NO: 121897 - protein, 33 aa, Artificial Sequence
  Description of Artificial Sequence: Synthetic polypeptide
DESEIRTTNPVATECWGSCSCIFEPQDREGENG

SEQ ID NO: 121898 - protein, 34 aa, Artificial Sequence
  Description of Artificial Sequence: Synthetic polypeptide
DESEIRTTNPVATECWGSPVSCINEPYDREGENG

SEQ ID NO: 121899 - protein, 35 aa, Artificial Sequence
  Description of Artificial Sequence: Synthetic polypeptide
MEEEIRTTNPVATEGYGSVSINMDDGGQGEGGNTN

SEQ ID NO: 121900 - protein, 35 aa, Artificial Sequence
  Description of Artificial Sequence: Synthetic polypeptide
DEAEIRTTNPCATEQYGCVTNGNGGDLQNGGGDNR

SEQ ID NO: 121901 - protein, 35 aa, Artificial Sequence
  Description of Artificial Sequence: Synthetic polypeptide
DESEIRTTNPVATECWGSDVSMCINEPQDREGENG

SEQ ID NO: 121902 - protein, 33 aa, Artificial Sequence
  Description of Artificial Sequence: Synthetic polypeptide
DEECTCTTNPVANEQYGVVSTVNNNQTGSNNNN

SEQ ID NO: 121903 - protein, 35 aa, Artificial Sequence
  Description of Artificial Sequence: Synthetic polypeptide
MEEEIRTTNPVATEQYGDVVSISNGFGQTGDGENE

SEQ ID NO: 121904 - protein, 28 aa, Artificial Sequence
  Description of Artificial Sequence: Synthetic peptide
LEAEIASTNPVGTEGYGVMASTLQHGDI

SEQ ID NO: 121905 - protein, 32 aa, Artificial Sequence
  Description of Artificial Sequence: Synthetic polypeptide
DENEIRCTNPVSTEPYGEASMEDLQQQQNGNR

SEQ ID NO: 121906 - protein, 36 aa, Artificial Sequence
  Description of Artificial Sequence: Synthetic polypeptide
MEEEIRTTNPVATEQYGDVVSTYVNLVQTDGMEGIG

SEQ ID NO: 121907 - protein, 30 aa, Artificial Sequence
  Description of Artificial Sequence: Synthetic polypeptide
DENEIETTNPVATEQWGDVSTIEMNAAEDA

SEQ ID NO: 121908 - protein, 33 aa, Artificial Sequence
  Description of Artificial Sequence: Synthetic polypeptide
DEQEIATTNPVATEQYGSVYATDLEDHEGEDLM

SEQ ID NO: 121909 - protein, 34 aa, Artificial Sequence
  Description of Artificial Sequence: Synthetic polypeptide
MEEEIRTTNPVATEQYGMATIMTNGGQGGENEGE

SEQ ID NO: 121910 - protein, 31 aa, Artificial Sequence
  Description of Artificial Sequence: Synthetic polypeptide
DENEIRCTNPVSTEPYGEISMEDIQQQNGNR

SEQ ID NO: 121911 - protein, 34 aa, Artificial Sequence
  Description of Artificial Sequence: Synthetic polypeptide
DESEIRTTNPVATECWGSPVSCICEPQDREGENG

SEQ ID NO: 121912 - protein, 31 aa, Artificial Sequence
  Description of Artificial Sequence: Synthetic polypeptide
DENEIRCTNPVSTEPYGSISEEDIQMQNGNH

SEQ ID NO: 121913 - protein, 34 aa, Artificial Sequence
  Description of Artificial Sequence: Synthetic polypeptide
MEEEIRTTNPVATEQYGMVGSGNMDQGGGQEIQA

SEQ ID NO: 121914 - protein, 34 aa, Artificial Sequence
  Description of Artificial Sequence: Synthetic polypeptide
MEEEIRTTNPVATEQYGMVGSIDNSEGEGNGNGD

SEQ ID NO: 121915 - protein, 34 aa, Artificial Sequence
  Description of Artificial Sequence: Synthetic polypeptide
DESEIRTTNPVATECWGSEVSCINEPQDREGESG

SEQ ID NO: 121916 - protein, 33 aa, Artificial Sequence
  Description of Artificial Sequence: Synthetic polypeptide
DEECTCTTNPVAVEQYGVVSTVNVQDNGTNNND

SEQ ID NO: 121917 - protein, 37 aa, Artificial Sequence
  Description of Artificial Sequence: Synthetic polypeptide
AEEEIRTTNPVATEQYGVVVVSVSTNQNQEQGEQNDE

SEQ ID NO: 121918 - protein, 33 aa, Artificial Sequence
  Description of Artificial Sequence: Synthetic polypeptide
MEEEIRTTNPVATEQYGCVCSTEEHQNFSSDQS

SEQ ID NO: 121919 - protein, 33 aa, Artificial Sequence
  Description of Artificial Sequence: Synthetic polypeptide
LEDEIRTTNPVATEQYGELCSTNLEPENGDDSA

SEQ ID NO: 121920 - protein, 35 aa, Artificial Sequence
  Description of Artificial Sequence: Synthetic polypeptide
MEEEIRTTNPVATEQYGCVCSTEEDHQNFGSDNQS

SEQ ID NO: 121921 - protein, 30 aa, Artificial Sequence
  Description of Artificial Sequence: Synthetic polypeptide
DENEIHTTNPVATEQWGDVSEIEMNGAEDA

SEQ ID NO: 121922 - protein, 36 aa, Artificial Sequence
  Description of Artificial Sequence: Synthetic polypeptide
AEEEIRTTNPVATEQYGVVSTVTQNNQNGDEAGNED

SEQ ID NO: 121923 - protein, 33 aa, Artificial Sequence
  Description of Artificial Sequence: Synthetic polypeptide
DEECNATTNPIAYEQWGEVCSTNDLQDHDGNSR

SEQ ID NO: 121924 - protein, 32 aa, Artificial Sequence
  Description of Artificial Sequence: Synthetic polypeptide
CEEVIACTNPVATEQYGCVATNGLPDNTEGNH

SEQ ID NO: 121925 - protein, 35 aa, Artificial Sequence
  Description of Artificial Sequence: Synthetic polypeptide
MEEEIRTTNPVATEQYGAVSITVNGDEFNGGNDND

SEQ ID NO: 121926 - protein, 33 aa, Artificial Sequence
  Description of Artificial Sequence: Synthetic polypeptide
DEQEIATTNPVATEQYGSVWSATDWAEHEGPYI

SEQ ID NO: 121927 - protein, 32 aa, Artificial Sequence
  Description of Artificial Sequence: Synthetic polypeptide
DEECNATTNPIAYEQWGEVCSTNDQGHDGGNR

SEQ ID NO: 121928 - protein, 34 aa, Artificial Sequence
  Description of Artificial Sequence: Synthetic polypeptide
MEEEIRTTNPVATEQYGMVSIANGMETGGGNGED

SEQ ID NO: 121929 - protein, 33 aa, Artificial Sequence
  Description of Artificial Sequence: Synthetic polypeptide
DEQEIATTNPVATEQYGSVWSATDWAEPEGPYI

SEQ ID NO: 121930 - protein, 34 aa, Artificial Sequence
  Description of Artificial Sequence: Synthetic polypeptide
DESEIRTTNPVATECWGSPVSCIAEPQDREGENG

SEQ ID NO: 121931 - protein, 29 aa, Artificial Sequence
  Description of Artificial Sequence: Synthetic peptide
LEEEIATTNPVATEQYGEAPEAVCQHEEK

SEQ ID NO: 121932 - protein, 33 aa, Artificial Sequence
  Description of Artificial Sequence: Synthetic polypeptide
DESEIRTTNPVATECWGSFSCIFEPQDREGENG

SEQ ID NO: 121933 - protein, 32 aa, Artificial Sequence
  Description of Artificial Sequence: Synthetic polypeptide
CEEVIACTNPVATEQYGCVAITNLPDNTEGNT

SEQ ID NO: 121934 - protein, 34 aa, Artificial Sequence
  Description of Artificial Sequence: Synthetic polypeptide
DESEIRTTNPVATECWGSFLSCINEPQDREGENG

SEQ ID NO: 121935 - protein, 34 aa, Artificial Sequence
  Description of Artificial Sequence: Synthetic polypeptide
MEEEIRTTNPVATEQYGCVCSNWEHQNFGSENQI

SEQ ID NO: 121936 - protein, 34 aa, Artificial Sequence
  Description of Artificial Sequence: Synthetic polypeptide
MEEEIRTTNPVATEQYGCVCSSEHQENFGSNNQS

SEQ ID NO: 121937 - protein, 33 aa, Artificial Sequence
  Description of Artificial Sequence: Synthetic polypeptide
DEQEIATTNPVATEQYGSVWSATDWEDHEGEDL

SEQ ID NO: 121938 - protein, 31 aa, Artificial Sequence
  Description of Artificial Sequence: Synthetic polypeptide
DENEIRCTNPVSTEPYGSISMDIQQQQNGNH

SEQ ID NO: 121939 - protein, 34 aa, Artificial Sequence
  Description of Artificial Sequence: Synthetic polypeptide
MEEEIRTTNPVATEQYGMVSIFGMGQGGNQDEDN

SEQ ID NO: 121940 - protein, 35 aa, Artificial Sequence
  Description of Artificial Sequence: Synthetic polypeptide
MEEEIRTTNPVATEQYGQVSTMTNGFEGGGENNIF

SEQ ID NO: 121941 - protein, 36 aa, Artificial Sequence
  Description of Artificial Sequence: Synthetic polypeptide
MEEEIRTTNPVATEQYGSVMSGINMDLGEGESTNGD

SEQ ID NO: 121942 - protein, 35 aa, Artificial Sequence
  Description of Artificial Sequence: Synthetic polypeptide
MEEEIRTTNPVATEQYGSVMSGMFNNGEEENGTND

SEQ ID NO: 121943 - protein, 35 aa, Artificial Sequence
  Description of Artificial Sequence: Synthetic polypeptide
AEEEIRTTNPVATEQYGVVVVSVTNNNQEQDEEND

SEQ ID NO: 121944 - protein, 34 aa, Artificial Sequence
  Description of Artificial Sequence: Synthetic polypeptide
DESEIRTTNPVATECWGSESCINEPQDREGENGT

SEQ ID NO: 121945 - protein, 34 aa, Artificial Sequence
  Description of Artificial Sequence: Synthetic polypeptide
CEEVIRTTNPMATEQWGSVVACTNALSQQGGNYA

SEQ ID NO: 121946 - protein, 32 aa, Artificial Sequence
  Description of Artificial Sequence: Synthetic polypeptide
DENEIRCTNPVSTEPYGTASMEDLQQQQNGNR

SEQ ID NO: 121947 - protein, 35 aa, Artificial Sequence
  Description of Artificial Sequence: Synthetic polypeptide
MEEEIRTTNPVATEQYGSVNMTGSTQGQQGGQGEG

SEQ ID NO: 121948 - protein, 30 aa, Artificial Sequence
  Description of Artificial Sequence: Synthetic polypeptide
DENEICTTNPVATEQWGDVSEIEMQANEDA

SEQ ID NO: 121949 - protein, 33 aa, Artificial Sequence
  Description of Artificial Sequence: Synthetic polypeptide
KESECRTTNPVATECWGSVSCINEPQDREGENG

SEQ ID NO: 121950 - protein, 35 aa, Artificial Sequence
  Description of Artificial Sequence: Synthetic polypeptide
DECTICTTNPVATEQYGSVTVVTNNLQIGIGTNLQ

SEQ ID NO: 121951 - protein, 33 aa, Artificial Sequence
  Description of Artificial Sequence: Synthetic polypeptide
DESEIRTTNPVATECWGSESCINEPQDREAENG

SEQ ID NO: 121952 - protein, 35 aa, Artificial Sequence
  Description of Artificial Sequence: Synthetic polypeptide
MEEEIRTTNPVATEQYGSVNTLGLNLINGGGGQGQ

SEQ ID NO: 121953 - protein, 34 aa, Artificial Sequence
  Description of Artificial Sequence: Synthetic polypeptide
DEEEIRTTNPVATEQYGSVSCPPSIQDNVEQLAM

SEQ ID NO: 121954 - protein, 33 aa, Artificial Sequence
  Description of Artificial Sequence: Synthetic polypeptide
DESEIRTTNPVATECWGSESCINEPHDREGENG

SEQ ID NO: 121955 - protein, 36 aa, Artificial Sequence
  Description of Artificial Sequence: Synthetic polypeptide
AEEEIRTTNPVATEQYGVVSTVTNNNQTDEGNNNVE

SEQ ID NO: 121956 - protein, 34 aa, Artificial Sequence
  Description of Artificial Sequence: Synthetic polypeptide
DEQEIATTNPVATEQYGSWVSATKDLEDHEGEDL

SEQ ID NO: 121957 - protein, 32 aa, Artificial Sequence
  Description of Artificial Sequence: Synthetic polypeptide
DEQEIATTNPVATEQYGSWSATDEEDHEGEWL

SEQ ID NO: 121958 - protein, 33 aa, Artificial Sequence
  Description of Artificial Sequence: Synthetic polypeptide
DEQEIATTNPVATEQYGSYSATDLEDHEGEDLT

SEQ ID NO: 121959 - protein, 36 aa, Artificial Sequence
  Description of Artificial Sequence: Synthetic polypeptide
MEEEIRTTNPVATEQYGSVMGSTMNGGDQENDNGGN

SEQ ID NO: 121960 - protein, 30 aa, Artificial Sequence
  Description of Artificial Sequence: Synthetic polypeptide
DENEIRCTNPVSTEPYGTASMDIQQQQGNH

SEQ ID NO: 121961 - protein, 36 aa, Artificial Sequence
  Description of Artificial Sequence: Synthetic polypeptide
AEEEIRTTNPVATEQYGVVSTVTNQQQQGNDENEQD

SEQ ID NO: 121962 - protein, 35 aa, Artificial Sequence
  Description of Artificial Sequence: Synthetic polypeptide
DESEIRTTNPVATECWGSEVSCINEPQDREGENGW

SEQ ID NO: 121963 - protein, 35 aa, Artificial Sequence
  Description of Artificial Sequence: Synthetic polypeptide
DECTICTTNPVATEQYGSVTVVTNNNLQIGIGNNL

SEQ ID NO: 121964 - protein, 33 aa, Artificial Sequence
  Description of Artificial Sequence: Synthetic polypeptide
KESEIRTTNPVATECWGSVSCINEPQDRERENG

SEQ ID NO: 121965 - protein, 36 aa, Artificial Sequence
  Description of Artificial Sequence: Synthetic polypeptide
AEEEIRTTNPVATEQYGVVSTVTNQQQGNNDENSEL

SEQ ID NO: 121966 - protein, 37 aa, Artificial Sequence
  Description of Artificial Sequence: Synthetic polypeptide
AEEEIRTTNPVATEQYGVVSTVTNQNLQNQEQGTNVD

SEQ ID NO: 121967 - protein, 36 aa, Artificial Sequence
  Description of Artificial Sequence: Synthetic polypeptide
AEEEIRTTNPVATEQYGVVSTVTNQLTQGNNDEESE

SEQ ID NO: 121968 - protein, 28 aa, Artificial Sequence
  Description of Artificial Sequence: Synthetic peptide
KESEIASTNPVGTEGYGVMASTLQHGDH

SEQ ID NO: 121969 - protein, 36 aa, Artificial Sequence
  Description of Artificial Sequence: Synthetic polypeptide
AEEEIRTTNPVATEQYGVVSTVTNQLNQNQAIGTTE

SEQ ID NO: 121970 - protein, 34 aa, Artificial Sequence
  Description of Artificial Sequence: Synthetic polypeptide
DEQEIATTNPVATEQYGSVYSATDLLEDHEGEDL

SEQ ID NO: 121971 - protein, 34 aa, Artificial Sequence
  Description of Artificial Sequence: Synthetic polypeptide
DEQEIATTNPVATEQYGSVYSATWDLEDHEGEDL

SEQ ID NO: 121972 - protein, 34 aa, Artificial Sequence
  Description of Artificial Sequence: Synthetic polypeptide
KESEIRTTNPVATECWGSVSCINEPQDREGENGW

SEQ ID NO: 121973 - protein, 32 aa, Artificial Sequence
  Description of Artificial Sequence: Synthetic polypeptide
DENEICTTNPVATEQYGSCPTYLNLILSDDFQ

SEQ ID NO: 121974 - protein, 30 aa, Artificial Sequence
  Description of Artificial Sequence: Synthetic polypeptide
DEECISTVNPVATEGYGCVCSWEHEYGSNQ

SEQ ID NO: 121975 - protein, 35 aa, Artificial Sequence
  Description of Artificial Sequence: Synthetic polypeptide
DEEEIRTTNPVATEQYGSVSALNVDNGIFPEEMQI

SEQ ID NO: 121976 - protein, 35 aa, Artificial Sequence
  Description of Artificial Sequence: Synthetic polypeptide
MEEEIRTTNPVATEQYGSVMGQNIGQTLNGGGENG

SEQ ID NO: 121977 - protein, 34 aa, Artificial Sequence
  Description of Artificial Sequence: Synthetic polypeptide
DENEICTTNPVATEQYGSVFTWPNPETQQDNQIM

SEQ ID NO: 121978 - protein, 34 aa, Artificial Sequence
  Description of Artificial Sequence: Synthetic polypeptide
DEAEIQCTNPVAYEGYGSVVQSANEQSDRVGNNR

SEQ ID NO: 121979 - protein, 33 aa, Artificial Sequence
  Description of Artificial Sequence: Synthetic polypeptide
DESEIRTTNPVATECWGHVSCINEPQDREVENG

SEQ ID NO: 121980 - protein, 35 aa, Artificial Sequence
  Description of Artificial Sequence: Synthetic polypeptide
DESEIRTTNPVATECWGSSVSCINEPQDREGENWG

SEQ ID NO: 121981 - protein, 33 aa, Artificial Sequence
  Description of Artificial Sequence: Synthetic polypeptide
DEQEIATTNPVAYEGWGSVATNLQGDAGNNNQD

SEQ ID NO: 121982 - protein, 34 aa, Artificial Sequence
  Description of Artificial Sequence: Synthetic polypeptide
DESEIRTTNPVATECWGCVSWMNENQERIGSNQS

SEQ ID NO: 121983 - protein, 33 aa, Artificial Sequence
  Description of Artificial Sequence: Synthetic polypeptide
DESEIRTTNPVATECWGCVSWMNENQDRFGSEQ

SEQ ID NO: 121984 - protein, 35 aa, Artificial Sequence
  Description of Artificial Sequence: Synthetic polypeptide
FEEEIRTTNPVATEQYGSVVGFDNNLQGGGGGETN

SEQ ID NO: 121985 - protein, 32 aa, Artificial Sequence
  Description of Artificial Sequence: Synthetic polypeptide
NEAEIRTTNPVAYEQWGSATTNQQGNTGDAGR

SEQ ID NO: 121986 - protein, 36 aa, Artificial Sequence
  Description of Artificial Sequence: Synthetic polypeptide
DECEIRTTNPVATEQYGSVSSTTPAGPNMRNGMNPV

SEQ ID NO: 121987 - protein, 36 aa, Artificial Sequence
  Description of Artificial Sequence: Synthetic polypeptide
FEEEIRTTNPVATEQYGSVVGDTNMEMGQEGGNNNP

SEQ ID NO: 121988 - protein, 36 aa, Artificial Sequence
  Description of Artificial Sequence: Synthetic polypeptide
NEAEIRTTNPVAYEQWGSVCSTDNGGNLGQQGNGRN

SEQ ID NO: 121989 - protein, 34 aa, Artificial Sequence
  Description of Artificial Sequence: Synthetic polypeptide
DESEIRTTNPVATECWGCVSCINEPQDREGENGN

SEQ ID NO: 121990 - protein, 36 aa, Artificial Sequence
  Description of Artificial Sequence: Synthetic polypeptide
DECEIRTTNPVATEQYGSVSNNNLLLDTRIIENQQE

SEQ ID NO: 121991 - protein, 35 aa, Artificial Sequence
  Description of Artificial Sequence: Synthetic polypeptide
DEEEIRTTNPVATEQYGSVSDPPNGVQQQYTVEED

SEQ ID NO: 121992 - protein, 32 aa, Artificial Sequence
  Description of Artificial Sequence: Synthetic polypeptide
NEAEIRTTNPVAYEQWGSVCYTEGQGEGMNET

SEQ ID NO: 121993 - protein, 33 aa, Artificial Sequence
  Description of Artificial Sequence: Synthetic polypeptide
DESEIRTTNPVATECWGCVSCINEPADREGENG

SEQ ID NO: 121994 - protein, 34 aa, Artificial Sequence
  Description of Artificial Sequence: Synthetic polypeptide
NEAEIRTTNPVAYEQWGSVSGGINDQHQQGGNSR

SEQ ID NO: 121995 - protein, 32 aa, Artificial Sequence
  Description of Artificial Sequence: Synthetic polypeptide
DEQEIATTNPVAYEGWGSVATNNQGDAGNGDQ

SEQ ID NO: 121996 - protein, 34 aa, Artificial Sequence
  Description of Artificial Sequence: Synthetic polypeptide
DENEIATTNPVATEQYGSVCAADNTDQDMSIDNR

SEQ ID NO: 121997 - protein, 33 aa, Artificial Sequence
  Description of Artificial Sequence: Synthetic polypeptide
DEQEIATTNPVAYEGWGSVATNLQGDAGNNGNM

SEQ ID NO: 121998 - protein, 33 aa, Artificial Sequence
  Description of Artificial Sequence: Synthetic polypeptide
DECEIRTTNPVATEQYGSVSWDSLEYDIDAMQE

SEQ ID NO: 121999 - protein, 35 aa, Artificial Sequence
  Description of Artificial Sequence: Synthetic polypeptide
DESEIRTTNPVATECWGDSVSCINEPQDREGENVG

SEQ ID NO: 122000 - protein, 32 aa, Artificial Sequence
  Description of Artificial Sequence: Synthetic polypeptide
DEQEIATTNPVAYEGWGSVATNEQGNDQGGHR

SEQ ID NO: 122001 - protein, 33 aa, Artificial Sequence
  Description of Artificial Sequence: Synthetic polypeptide
DEEEIACTNPVATEQYGCVATHLQESMNNDDAY

SEQ ID NO: 122002 - protein, 34 aa, Artificial Sequence
  Description of Artificial Sequence: Synthetic polypeptide
NEAEIRTTNPVATEQYGSVWVTVEMEGIGNSFRE

SEQ ID NO: 122003 - protein, 36 aa, Artificial Sequence
  Description of Artificial Sequence: Synthetic polypeptide
AEEEIRTTNPVATEQYGVVSTTNNLNGTELGNNELV

SEQ ID NO: 122004 - protein, 32 aa, Artificial Sequence
  Description of Artificial Sequence: Synthetic polypeptide
DEQEIATTNPVAYEGWGSVATNIQGDLGNGSN

SEQ ID NO: 122005 - protein, 33 aa, Artificial Sequence
  Description of Artificial Sequence: Synthetic polypeptide
DENEIATTNPVATEQYGSVCAAMNHGQDSDIER

SEQ ID NO: 122006 - protein, 33 aa, Artificial Sequence
  Description of Artificial Sequence: Synthetic polypeptide
DEEEIACTNPVATEQYGCVATNGQESEHNTDQV

SEQ ID NO: 122007 - protein, 36 aa, Artificial Sequence
  Description of Artificial Sequence: Synthetic polypeptide
AEEEIRTTNPVATEQYGVVSTTNLQQLQQNATEEGQ

SEQ ID NO: 122008 - protein, 33 aa, Artificial Sequence
  Description of Artificial Sequence: Synthetic polypeptide
DEQEIATTNPVAYEGWGSVATNLNQGDAGNGQE

SEQ ID NO: 122009 - protein, 30 aa, Artificial Sequence
  Description of Artificial Sequence: Synthetic polypeptide
DENEIRTTNPIATEQWGSVSEIEMNAAEDA

SEQ ID NO: 122010 - protein, 34 aa, Artificial Sequence
  Description of Artificial Sequence: Synthetic polypeptide
FEEEIRTTNPVATEQYGSVVGGVNQNGQGENGEG

SEQ ID NO: 122011 - protein, 32 aa, Artificial Sequence
  Description of Artificial Sequence: Synthetic polypeptide
DESEIRTTNPVATECWGDVSCCLPQDHEGEEL

SEQ ID NO: 122012 - protein, 35 aa, Artificial Sequence
  Description of Artificial Sequence: Synthetic polypeptide
DESEIRTTNPVATECWGDSVSCINSEPQDREGENG

SEQ ID NO: 122013 - protein, 32 aa, Artificial Sequence
  Description of Artificial Sequence: Synthetic polypeptide
DEQEIATTNPVAYEGWGSVATNLQGDAGGQSQ

SEQ ID NO: 122014 - protein, 33 aa, Artificial Sequence
  Description of Artificial Sequence: Synthetic polypeptide
DENEIATTNPVATEQYGSVCAAMHLQAMPEDRP

SEQ ID NO: 122015 - protein, 33 aa, Artificial Sequence
  Description of Artificial Sequence: Synthetic polypeptide
DEQEIATTNPVAYEGWGSVATNLQGDAGNGAQK

SEQ ID NO: 122016 - protein, 33 aa, Artificial Sequence
  Description of Artificial Sequence: Synthetic polypeptide
NEAEIRTTNPVAYECWGVVSNDNLGEERGENSR

SEQ ID NO: 122017 - protein, 35 aa, Artificial Sequence
  Description of Artificial Sequence: Synthetic polypeptide
FEEEIRTTNPVATEQYGSVVGDGNLNDDEEGNGGQ

SEQ ID NO: 122018 - protein, 33 aa, Artificial Sequence
  Description of Artificial Sequence: Synthetic polypeptide
DEQEIATTNPVAYEGWGSVATNQQGDAGNGNQR

SEQ ID NO: 122019 - protein, 36 aa, Artificial Sequence
  Description of Artificial Sequence: Synthetic polypeptide
DEEEIRTTNPVATEQYGSVQSSAYDVLHGNMEINRS

SEQ ID NO: 122020 - protein, 35 aa, Artificial Sequence
  Description of Artificial Sequence: Synthetic polypeptide
CEEEIATTNPVATEQYGSVCSADNPLAEAMIGDRQ

SEQ ID NO: 122021 - protein, 34 aa, Artificial Sequence
  Description of Artificial Sequence: Synthetic polypeptide
DESEIRTTNPVATECWGAPVSCINEPQDREGENG

SEQ ID NO: 122022 - protein, 35 aa, Artificial Sequence
  Description of Artificial Sequence: Synthetic polypeptide
DEEEIRTTNPVATEQYGSVQSPIQFLEEITGDSDL

SEQ ID NO: 122023 - protein, 34 aa, Artificial Sequence
  Description of Artificial Sequence: Synthetic polypeptide
DESEIRTTNPVATECWFGTVSCINEPQDREGENG

SEQ ID NO: 122024 - protein, 34 aa, Artificial Sequence
  Description of Artificial Sequence: Synthetic polypeptide
DESEIRTTNPVATECWDGSASCINEPQDREGENG

SEQ ID NO: 122025 - protein, 35 aa, Artificial Sequence
  Description of Artificial Sequence: Synthetic polypeptide
DEEEIRTTNPVATEQYGSVQSPIMFLEEITMDSGN

SEQ ID NO: 122026 - protein, 35 aa, Artificial Sequence
  Description of Artificial Sequence: Synthetic polypeptide
DEEEIRTTNPVATEQYGSVQSPIMFLEEITGDMML

SEQ ID NO: 122027 - protein, 36 aa, Artificial Sequence
  Description of Artificial Sequence: Synthetic polypeptide
DEEEIRTTNPVATEQYGSVQSPSINGCEQTHVDNDL

SEQ ID NO: 122028 - protein, 34 aa, Artificial Sequence
  Description of Artificial Sequence: Synthetic polypeptide
DENEIATTNPVATEQYGSVASNDTANDNPMGAQE

SEQ ID NO: 122029 - protein, 34 aa, Artificial Sequence
  Description of Artificial Sequence: Synthetic polypeptide
DEEEIRTTNPVATEQYGSVSDPVGHIETPAQLVP

SEQ ID NO: 122030 - protein, 33 aa, Artificial Sequence
  Description of Artificial Sequence: Synthetic polypeptide
DEEEIRTTNPVATEQYGSVSDPVGHIETPDVLV

SEQ ID NO: 122031 - protein, 31 aa, Artificial Sequence
  Description of Artificial Sequence: Synthetic polypeptide
DECEIRTTNPVATEQWGDVSNEIEMNAAEDA

SEQ ID NO: 122032 - protein, 36 aa, Artificial Sequence
  Description of Artificial Sequence: Synthetic polypeptide
DEEEIRTTNPVATEQYGSVYPTNYLPETEFPQSVQT

SEQ ID NO: 122033 - protein, 32 aa, Artificial Sequence
  Description of Artificial Sequence: Synthetic polypeptide
DENEIATTNPVATEQYGSVASDDANTNPDAQP

SEQ ID NO: 122034 - protein, 35 aa, Artificial Sequence
  Description of Artificial Sequence: Synthetic polypeptide
DENEIATTNPVATEQYGSVAPTGGLDQPSGDEFRV

SEQ ID NO: 122035 - protein, 32 aa, Artificial Sequence
  Description of Artificial Sequence: Synthetic polypeptide
NEDEIACTNPVATEQYGCASANLQEAHPGQRN

SEQ ID NO: 122036 - protein, 29 aa, Artificial Sequence
  Description of Artificial Sequence: Synthetic peptide
NEDEIAATNPCSYEQWGIVSCNLQSGDTR

SEQ ID NO: 122037 - protein, 36 aa, Artificial Sequence
  Description of Artificial Sequence: Synthetic polypeptide
AEEEIRTTNPVATEQYGVVSTTNNLQQQANEQGEDE

SEQ ID NO: 122038 - protein, 34 aa, Artificial Sequence
  Description of Artificial Sequence: Synthetic polypeptide
DESEIRTTNPVATECWGATVSAINEQDRKGENYG

SEQ ID NO: 122039 - protein, 35 aa, Artificial Sequence
  Description of Artificial Sequence: Synthetic polypeptide
FEEEIRTTNPVATEQYGSVVAGVNDNNGQGEGNEI

SEQ ID NO: 122040 - protein, 35 aa, Artificial Sequence
  Description of Artificial Sequence: Synthetic polypeptide
DESEIRTTNPVATECWGCSVSICINEPQDREGENG

SEQ ID NO: 122041 - protein, 36 aa, Artificial Sequence
  Description of Artificial Sequence: Synthetic polypeptide
DECEIRTTNPVATEQYGSVSATTPAGPNMRNGMNPV

SEQ ID NO: 122042 - protein, 33 aa, Artificial Sequence
  Description of Artificial Sequence: Synthetic polypeptide
DEQEIATTNPVAYEGWGTVATNLQGDAGNGRQI

SEQ ID NO: 122043 - protein, 33 aa, Artificial Sequence
  Description of Artificial Sequence: Synthetic polypeptide
DESEIRTTNPVATECWGAVWACINEPQDRKGNG

SEQ ID NO: 122044 - protein, 34 aa, Artificial Sequence
  Description of Artificial Sequence: Synthetic polypeptide
FEEEIRTTNPVATEQYGSVVDTFGEMDQEEGGEF

SEQ ID NO: 122045 - protein, 33 aa, Artificial Sequence
  Description of Artificial Sequence: Synthetic polypeptide
DESEIRTTNPVATECWGAVSCINWPQDREGEPG

SEQ ID NO: 122046 - protein, 33 aa, Artificial Sequence
  Description of Artificial Sequence: Synthetic polypeptide
NEAEIRTTNPVAYEQWGSVTTGNNQMQDNDGAR

SEQ ID NO: 122047 - protein, 34 aa, Artificial Sequence
  Description of Artificial Sequence: Synthetic polypeptide
DECEIRTTNPVATEQYGCVSTNNREHMFPENPQE

SEQ ID NO: 122048 - protein, 34 aa, Artificial Sequence
  Description of Artificial Sequence: Synthetic polypeptide
DENEIATTNPVATEQYGSVCAAAANDQDMPGENN

SEQ ID NO: 122049 - protein, 34 aa, Artificial Sequence
  Description of Artificial Sequence: Synthetic polypeptide
DESEIRTTNPVATECWGSVAACINEPQDREGENG

SEQ ID NO: 122050 - protein, 32 aa, Artificial Sequence
  Description of Artificial Sequence: Synthetic polypeptide
DEQEIATTNPVAYEMYGSVSATDLEDHEGEDL

SEQ ID NO: 122051 - protein, 37 aa, Artificial Sequence
  Description of Artificial Sequence: Synthetic polypeptide
DEEEIRTTNPVATEQYGSVQSPTQYLQPMLEGVEFVD

SEQ ID NO: 122052 - protein, 37 aa, Artificial Sequence
  Description of Artificial Sequence: Synthetic polypeptide
DEEEIRTTNPVATEQYGSVQSPTQYLQPMAEGVEEED

SEQ ID NO: 122053 - protein, 37 aa, Artificial Sequence
  Description of Artificial Sequence: Synthetic polypeptide
AEEEIRTTNPVATEQYGVVSTTNLQQIGTEQGTNQDD

SEQ ID NO: 122054 - protein, 33 aa, Artificial Sequence
  Description of Artificial Sequence: Synthetic polypeptide
DESEIRTTNPVATECWGAVSCINEPQDDEGENG

SEQ ID NO: 122055 - protein, 32 aa, Artificial Sequence
  Description of Artificial Sequence: Synthetic polypeptide
DESEIRTTNPVATECWGAVSAINEADREGPYG

SEQ ID NO: 122056 - protein, 33 aa, Artificial Sequence
  Description of Artificial Sequence: Synthetic polypeptide
DEAEIRTTNPVAYEQYGQSVSQPDLLTEQIERF

SEQ ID NO: 122057 - protein, 33 aa, Artificial Sequence
  Description of Artificial Sequence: Synthetic polypeptide
DENEIATTNPVATEQYGSVANPNDPAEANPERG

SEQ ID NO: 122058 - protein, 36 aa, Artificial Sequence
  Description of Artificial Sequence: Synthetic polypeptide
AEEEIRTTNPVATEQYGVVSTTNNLTNEEQGNNTNE

SEQ ID NO: 122059 - protein, 36 aa, Artificial Sequence
  Description of Artificial Sequence: Synthetic polypeptide
AEEEIRTTNPVATEQYGVVSTTNNNLNQNEGETDED

SEQ ID NO: 122060 - protein, 34 aa, Artificial Sequence
  Description of Artificial Sequence: Synthetic polypeptide
FEEEIRTTNPVATEQYGVVGGDENGQSEGGENET

SEQ ID NO: 122061 - protein, 35 aa, Artificial Sequence
  Description of Artificial Sequence: Synthetic polypeptide
FEEEIRTTNPVATEQYGVVDTDNGLENQGENEEGE

SEQ ID NO: 122062 - protein, 34 aa, Artificial Sequence
  Description of Artificial Sequence: Synthetic polypeptide
FEEEIRTTNPVATEQYGTVVNNFDDEDQEGGGNQ

SEQ ID NO: 122063 - protein, 31 aa, Artificial Sequence
  Description of Artificial Sequence: Synthetic polypeptide
NEAEIATTNPVAYEQWGAVSTNQQHNDQNDA

SEQ ID NO: 122064 - protein, 31 aa, Artificial Sequence
  Description of Artificial Sequence: Synthetic polypeptide
NEAEIATTNPVAYEQWGSATTNQQGNEGDAR

SEQ ID NO: 122065 - protein, 31 aa, Artificial Sequence
  Description of Artificial Sequence: Synthetic polypeptide
DENEIRTTNPIATEPYGTISMEDWAQQNGNH

SEQ ID NO: 122066 - protein, 31 aa, Artificial Sequence
  Description of Artificial Sequence: Synthetic polypeptide
DENEIRTTNPIATEPYGTISMEDWAQQNGNI

SEQ ID NO: 122067 - protein, 34 aa, Artificial Sequence
  Description of Artificial Sequence: Synthetic polypeptide
DECEIRTTNPVAYEQWGSVVTGIGLNAGEEDNNR

SEQ ID NO: 122068 - protein, 34 aa, Artificial Sequence
  Description of Artificial Sequence: Synthetic polypeptide
DECEIRTTNPVAYEQWGSVSTGIGLNAGEDNNTN

SEQ ID NO: 122069 - protein, 31 aa, Artificial Sequence
  Description of Artificial Sequence: Synthetic polypeptide
DENEIRTTNPIATEPYGTTSMEDWAQQNGNI

SEQ ID NO: 122070 - protein, 36 aa, Artificial Sequence
  Description of Artificial Sequence: Synthetic polypeptide
DEEEIRTTNPVATEQYGSVSDPDNGVQMQAGVELED

SEQ ID NO: 122071 - protein, 35 aa, Artificial Sequence
  Description of Artificial Sequence: Synthetic polypeptide
FEEEIRTTNPVATEQYGSVYQLPHLEERENIINRI

SEQ ID NO: 122072 - protein, 32 aa, Artificial Sequence
  Description of Artificial Sequence: Synthetic polypeptide
DESEIRTTNPVATECWGDVSCNEPQDHEGEEG

SEQ ID NO: 122073 - protein, 35 aa, Artificial Sequence
  Description of Artificial Sequence: Synthetic polypeptide
DEEEIRTTNPVATEQYGSVSDPENGVEPQETVEED

SEQ ID NO: 122074 - protein, 35 aa, Artificial Sequence
  Description of Artificial Sequence: Synthetic polypeptide
DEEEIRTTNPVATEQYGSVSDPENGVIMQLTVEED

SEQ ID NO: 122075 - protein, 34 aa, Artificial Sequence
  Description of Artificial Sequence: Synthetic polypeptide
FEEEIRTTNPVATEQYGVVINDTTNGQGQGGEQG

SEQ ID NO: 122076 - protein, 33 aa, Artificial Sequence
  Description of Artificial Sequence: Synthetic polypeptide
FEEEIRTTNPVATEQYGVVNDVGQGQEGGNQNG

SEQ ID NO: 122077 - protein, 32 aa, Artificial Sequence
  Description of Artificial Sequence: Synthetic polypeptide
DENEIATTNPVATEQYGSVCDTPGPDDSGDMN

SEQ ID NO: 122078 - protein, 35 aa, Artificial Sequence
  Description of Artificial Sequence: Synthetic polypeptide
DENEIATTNPVATEQYGSVCSAANNLPLDSEGTNQ

SEQ ID NO: 122079 - protein, 34 aa, Artificial Sequence
  Description of Artificial Sequence: Synthetic polypeptide
AEEEIRTTNPVAYEQWGSYWSTINPNQPDVGNND

SEQ ID NO: 122080 - protein, 32 aa, Artificial Sequence
  Description of Artificial Sequence: Synthetic polypeptide
DEQEIATTNPVAYECWGSVSGGNGNSGNDNQR

SEQ ID NO: 122081 - protein, 35 aa, Artificial Sequence
  Description of Artificial Sequence: Synthetic polypeptide
DENEIATTNPVATEQYGSVCSAANNLPLDSGETNN

SEQ ID NO: 122082 - protein, 34 aa, Artificial Sequence
  Description of Artificial Sequence: Synthetic polypeptide
FEEEIRTTNPVATEQYGVVSNTGGQGQEDGEGFT

SEQ ID NO: 122083 - protein, 37 aa, Artificial Sequence
  Description of Artificial Sequence: Synthetic polypeptide
AEEEIRTTNPVATEQYGVVSTTNNQLQQGNQNNNEND

SEQ ID NO: 122084 - protein, 36 aa, Artificial Sequence
  Description of Artificial Sequence: Synthetic polypeptide
DEEEIRTTNPVATEQYGSVQSVTEMVQHADNFMVDP

SEQ ID NO: 122085 - protein, 35 aa, Artificial Sequence
  Description of Artificial Sequence: Synthetic polypeptide
FEEEIRTTNPVATEQYGVVSIDDLGQGENGNNDEE

SEQ ID NO: 122086 - protein, 36 aa, Artificial Sequence
  Description of Artificial Sequence: Synthetic polypeptide
DEEEIRTTNPVATEQYGSVQSTTTSLLEIGMESSEQ

SEQ ID NO: 122087 - protein, 33 aa, Artificial Sequence
  Description of Artificial Sequence: Synthetic polypeptide
FEEEIRTTNPVATEQYGVVNVVGGQGQEGGNNG

SEQ ID NO: 122088 - protein, 29 aa, Artificial Sequence
  Description of Artificial Sequence: Synthetic peptide
CEEEIATTNPVATEQYGVAPEVGQQHEEK

SEQ ID NO: 122089 - protein, 36 aa, Artificial Sequence
  Description of Artificial Sequence: Synthetic polypeptide
DEEEIRTTNPVATEQYGSVQSVTEGLEEAPQGQETP

SEQ ID NO: 122090 - protein, 29 aa, Artificial Sequence
  Description of Artificial Sequence: Synthetic peptide
CEEEIATTNPVATEQYGVAPEVGQSEEHK

SEQ ID NO: 122091 - protein, 36 aa, Artificial Sequence
  Description of Artificial Sequence: Synthetic polypeptide
DEEEIRTTNPVATEQYGSVQSVSTYQNLPPDIDEVI

SEQ ID NO: 122092 - protein, 34 aa, Artificial Sequence
  Description of Artificial Sequence: Synthetic polypeptide
AEEEIRTTNPVAYEQWGSYWSTIPPNGEEGRQNR

SEQ ID NO: 122093 - protein, 34 aa, Artificial Sequence
  Description of Artificial Sequence: Synthetic polypeptide
FEEEIRTTNPVATEQYGVVNFTIGLGQNDEGEET

SEQ ID NO: 122094 - protein, 36 aa, Artificial Sequence
  Description of Artificial Sequence: Synthetic polypeptide
AEEEIRTTNPVATEQYGVVSTTNNQLQGNPNENQNE

SEQ ID NO: 122095 - protein, 36 aa, Artificial Sequence
  Description of Artificial Sequence: Synthetic polypeptide
DEEEIRTTNPVATEQYGSVSDNMDTGGQVGEGGEQG

SEQ ID NO: 122096 - protein, 36 aa, Artificial Sequence
  Description of Artificial Sequence: Synthetic polypeptide
FEEEIRTTNPVATEQYGSVVSDTQGLPGEQGEGGDE

SEQ ID NO: 122097 - protein, 33 aa, Artificial Sequence
  Description of Artificial Sequence: Synthetic polypeptide
DECEIRTTNPVAYEQWGCVSTGIGLNAGEDNNG

SEQ ID NO: 122098 - protein, 36 aa, Artificial Sequence
  Description of Artificial Sequence: Synthetic polypeptide
DEEEIRTTNPVATEQYGSVSDPENGVQMQDGVEVED

SEQ ID NO: 122099 - protein, 37 aa, Artificial Sequence
  Description of Artificial Sequence: Synthetic polypeptide
DEEEIRTTNPVATEQYGSVQSTTPAGGPNMRNGMNPV

SEQ ID NO: 122100 - protein, 29 aa, Artificial Sequence
  Description of Artificial Sequence: Synthetic peptide
DENEIRTTNPIATEQWGDVSEIEMNAEDA

SEQ ID NO: 122101 - protein, 32 aa, Artificial Sequence
  Description of Artificial Sequence: Synthetic polypeptide
DESEIRTTNPVATECWGDVSCINEMNRAEENG

SEQ ID NO: 122102 - protein, 36 aa, Artificial Sequence
  Description of Artificial Sequence: Synthetic polypeptide
AEEEIRTTNPVATEQYGVVSTTNNNQQLQIGTEEGS

SEQ ID NO: 122103 - protein, 37 aa, Artificial Sequence
  Description of Artificial Sequence: Synthetic polypeptide
AEEEIRTTNPVATEQYGVVSTTNNNLQYGNNGNNQTE

SEQ ID NO: 122104 - protein, 37 aa, Artificial Sequence
  Description of Artificial Sequence: Synthetic polypeptide
AEEEIRTTNPVATEQYGVVSTTNNNLQQGTEEGNQED

SEQ ID NO: 122105 - protein, 30 aa, Artificial Sequence
  Description of Artificial Sequence: Synthetic polypeptide
DENEIRTTNPIATEQWGDVSEIEMNRAEDA

SEQ ID NO: 122106 - protein, 35 aa, Artificial Sequence
  Description of Artificial Sequence: Synthetic polypeptide
FEEEIRTTNPVATEQYGSVVNFDNNDQQGGGNEET

SEQ ID NO: 122107 - protein, 33 aa, Artificial Sequence
  Description of Artificial Sequence: Synthetic polypeptide
FEEEIRTTNPVATEQYGSVVMNGFNGGGFGTGF

SEQ ID NO: 122108 - protein, 34 aa, Artificial Sequence
  Description of Artificial Sequence: Synthetic polypeptide
DEEEIACTNPVATEQYGCVAGTGQLQNRMGGELP

SEQ ID NO: 122109 - protein, 30 aa, Artificial Sequence
  Description of Artificial Sequence: Synthetic polypeptide
DENEIRTTNPIATEQWGDVSEIWMNAAGDA

SEQ ID NO: 122110 - protein, 32 aa, Artificial Sequence
  Description of Artificial Sequence: Synthetic polypeptide
DEQEIATTNPVAYEGWGSVATELQGDAGNGGQ

SEQ ID NO: 122111 - protein, 35 aa, Artificial Sequence
  Description of Artificial Sequence: Synthetic polypeptide
DENEIATTNPVATEQYGSVCAANNGDEQDRSINER

SEQ ID NO: 122112 - protein, 35 aa, Artificial Sequence
  Description of Artificial Sequence: Synthetic polypeptide
NEAEIRTTNPVATEQYGSVSNLTNMHNTGPEVNDT

SEQ ID NO: 122113 - protein, 37 aa, Artificial Sequence
  Description of Artificial Sequence: Synthetic polypeptide
AEEEIRTTNPVATEQYGVVSTTNNNLQGSEEGTNTNG

SEQ ID NO: 122114 - protein, 34 aa, Artificial Sequence
  Description of Artificial Sequence: Synthetic polypeptide
FEEEIRTTNPVATEQYGSVVGTDQGGQTNEENEG

SEQ ID NO: 122115 - protein, 32 aa, Artificial Sequence
  Description of Artificial Sequence: Synthetic polypeptide
DEQEIATTNPVAYEGWGEVATNLQGDAGNNSQ

SEQ ID NO: 122116 - protein, 37 aa, Artificial Sequence
  Description of Artificial Sequence: Synthetic polypeptide
AEEEIRTTNPVATEQYGVVSTTNNNLEQGTEEGNTTE

SEQ ID NO: 122117 - protein, 32 aa, Artificial Sequence
  Description of Artificial Sequence: Synthetic polypeptide
DESEIRTTNPVATECWGDVSCINEPMDREENG

SEQ ID NO: 122118 - protein, 35 aa, Artificial Sequence
  Description of Artificial Sequence: Synthetic polypeptide
AEEEIRTTNPVATEQYGVVSTTNNNQQQQTNGTVQ

SEQ ID NO: 122119 - protein, 30 aa, Artificial Sequence
  Description of Artificial Sequence: Synthetic polypeptide
NEAEIATTNPVAYEQWGSVTGGGQDQNGAR

SEQ ID NO: 122120 - protein, 33 aa, Artificial Sequence
  Description of Artificial Sequence: Synthetic polypeptide
NEAEICTTNPVAYEQWGSVCSTWDQNGQDHGNF

SEQ ID NO: 122121 - protein, 33 aa, Artificial Sequence
  Description of Artificial Sequence: Synthetic polypeptide
DESEIRTTNPVATECWGDVSCINEPQDREGEEL

SEQ ID NO: 122122 - protein, 35 aa, Artificial Sequence
  Description of Artificial Sequence: Synthetic polypeptide
DENEIATTNPVATEQYGSVCAMTNHGEQTLDGERF

SEQ ID NO: 122123 - protein, 35 aa, Artificial Sequence
  Description of Artificial Sequence: Synthetic polypeptide
DENEIATTNPVATEQYGSVCAMTHGEQTLDGNPRE

SEQ ID NO: 122124 - protein, 36 aa, Artificial Sequence
  Description of Artificial Sequence: Synthetic polypeptide
FEEEIRTTNPVATEQYGSVVQGTVNGLEQENGGGQG

SEQ ID NO: 122125 - protein, 34 aa, Artificial Sequence
  Description of Artificial Sequence: Synthetic polypeptide
DENEIATTNPVATEQYGSVCAMTHGEQTEDGARI

SEQ ID NO: 122126 - protein, 37 aa, Artificial Sequence
  Description of Artificial Sequence: Synthetic polypeptide
DEEEIRTTNPVATEQYGSVQSTTPAGPNMRNGMNPVI

SEQ ID NO: 122127 - protein, 36 aa, Artificial Sequence
  Description of Artificial Sequence: Synthetic polypeptide
DEEEIRTTNPVATEQYGSVSDPENGVQMQQTMEGED

SEQ ID NO: 122128 - protein, 36 aa, Artificial Sequence
  Description of Artificial Sequence: Synthetic polypeptide
AEEEIRTTNPVATEQYGVVSTTNNQAGSETGTNEEQ

SEQ ID NO: 122129 - protein, 37 aa, Artificial Sequence
  Description of Artificial Sequence: Synthetic polypeptide
DEEEIRTTNPVATEQYGSVQSTTPAVGPSMRNGMNPV

SEQ ID NO: 122130 - protein, 36 aa, Artificial Sequence
  Description of Artificial Sequence: Synthetic polypeptide
DEEEIRTTNPVATEQYGSVQSTTPAGPNMRNSMNPV

SEQ ID NO: 122131 - protein, 33 aa, Artificial Sequence
  Description of Artificial Sequence: Synthetic polypeptide
DESEIRTTNPVATECWGDVSCINEPQDAEGENG

SEQ ID NO: 122132 - protein, 30 aa, Artificial Sequence
  Description of Artificial Sequence: Synthetic polypeptide
DENEIRTTNPIATEQWGDVSEDWMNAAGDA

SEQ ID NO: 122133 - protein, 36 aa, Artificial Sequence
  Description of Artificial Sequence: Synthetic polypeptide
FEEEIRTTNPVATEQYGSVVNGTVNGLEQENEGGQE

SEQ ID NO: 122134 - protein, 30 aa, Artificial Sequence
  Description of Artificial Sequence: Synthetic polypeptide
DENEIRTTNPIATEQWGDVSEIEMNAAEDR

SEQ ID NO: 122135 - protein, 36 aa, Artificial Sequence
  Description of Artificial Sequence: Synthetic polypeptide
FEEEIRTTNPVATEQYGSVVPTALYMEQADGQTNED

SEQ ID NO: 122136 - protein, 35 aa, Artificial Sequence
  Description of Artificial Sequence: Synthetic polypeptide
AEEEIRTTNPVAYEQWGSYWSTINPNQDREGNQNA

SEQ ID NO: 122137 - protein, 34 aa, Artificial Sequence
  Description of Artificial Sequence: Synthetic polypeptide
DESEIRTTNPVATECWASVSCLNESQDREGENVG

SEQ ID NO: 122138 - protein, 35 aa, Artificial Sequence
  Description of Artificial Sequence: Synthetic polypeptide
DEEEIRTTNPVATEQYGSVQSPFGLIQQNMVETDQ

SEQ ID NO: 122139 - protein, 32 aa, Artificial Sequence
  Description of Artificial Sequence: Synthetic polypeptide
DENEIATTNPVATEQYGEISMEVIQQQHNGNK

SEQ ID NO: 122140 - protein, 31 aa, Artificial Sequence
  Description of Artificial Sequence: Synthetic polypeptide
DENEIATTNPVATEQYGEISMEVIQQQHGEK

SEQ ID NO: 122141 - protein, 34 aa, Artificial Sequence
  Description of Artificial Sequence: Synthetic polypeptide
DESEIRTTNPVATECWGSVCSWGEENQDREGSNA

SEQ ID NO: 122142 - protein, 31 aa, Artificial Sequence
  Description of Artificial Sequence: Synthetic polypeptide
DENEIATTNPVATEQYGEISEEVIQQQHGEK

SEQ ID NO: 122143 - protein, 31 aa, Artificial Sequence
  Description of Artificial Sequence: Synthetic polypeptide
CEEEIATTNPVAYEQWGSLSCDEHDQRQGEN

SEQ ID NO: 122144 - protein, 33 aa, Artificial Sequence
  Description of Artificial Sequence: Synthetic polypeptide
DENEIATTNPVATEQYGEASTTPALNMRGMGPV

SEQ ID NO: 122145 - protein, 33 aa, Artificial Sequence
  Description of Artificial Sequence: Synthetic polypeptide
DENEIATTNPVATEQYGEASTEPALNMRGMGPV

SEQ ID NO: 122146 - protein, 33 aa, Artificial Sequence
  Description of Artificial Sequence: Synthetic polypeptide
DESEIRTTNPVATEAWGCVSWMNENQDNFGSNQ

SEQ ID NO: 122147 - protein, 33 aa, Artificial Sequence
  Description of Artificial Sequence: Synthetic polypeptide
DEAEIRATNPVATEQYGSIFDTTSDEQEGNEVN

SEQ ID NO: 122148 - protein, 32 aa, Artificial Sequence
  Description of Artificial Sequence: Synthetic polypeptide
DENEIATTNPVATEQYGEASSEPAGPNRGNPV

SEQ ID NO: 122149 - protein, 33 aa, Artificial Sequence
  Description of Artificial Sequence: Synthetic polypeptide
DESEIRTTNPVATEAWGCVSWINENQDHSGSNQ

SEQ ID NO: 122150 - protein, 33 aa, Artificial Sequence
  Description of Artificial Sequence: Synthetic polypeptide
DESEIRTTNPVATEAWGCVSWGNENQEHEGSNQ

SEQ ID NO: 122151 - protein, 34 aa, Artificial Sequence
  Description of Artificial Sequence: Synthetic polypeptide
DEEEIRTTNPVATEQYGSVSDPVILIETMVQTDD

SEQ ID NO: 122152 - protein, 33 aa, Artificial Sequence
  Description of Artificial Sequence: Synthetic polypeptide
DEEEIRTTNPVATEQYGSVYSNPDEDPEAFSIE

SEQ ID NO: 122153 - protein, 34 aa, Artificial Sequence
  Description of Artificial Sequence: Synthetic polypeptide
DEEEIACTNPVATEQYGSACAANDLQEAMGMENE

SEQ ID NO: 122154 - protein, 37 aa, Artificial Sequence
  Description of Artificial Sequence: Synthetic polypeptide
DEEEIRTTNPVATEQYGSVYSEAPNLEIQVVNGQEPN

SEQ ID NO: 122155 - protein, 34 aa, Artificial Sequence
  Description of Artificial Sequence: Synthetic polypeptide
DECEICTVNPVATEQYGSVSTTTQLQQQQNQEED

SEQ ID NO: 122156 - protein, 36 aa, Artificial Sequence
  Description of Artificial Sequence: Synthetic polypeptide
DECEICTVNPVATEQYGSVSTVNNLQNSEEGNNQEE

SEQ ID NO: 122157 - protein, 36 aa, Artificial Sequence
  Description of Artificial Sequence: Synthetic polypeptide
DECEICTVNPVATEQYGSVSTVNQLQGNEEGTNNET

SEQ ID NO: 122158 - protein, 35 aa, Artificial Sequence
  Description of Artificial Sequence: Synthetic polypeptide
DEEEIRTTNPVATEQYGSVYSEAPNEIIPVNGGPN

SEQ ID NO: 122159 - protein, 35 aa, Artificial Sequence
  Description of Artificial Sequence: Synthetic polypeptide
DEEEIRTTNPVATEQYGSVSDPVGLIETQGQQLVF

SEQ ID NO: 122160 - protein, 35 aa, Artificial Sequence
  Description of Artificial Sequence: Synthetic polypeptide
DECEICTVNPVATEQYGVVSTTNQQLQQGNNQDTD

SEQ ID NO: 122161 - protein, 34 aa, Artificial Sequence
  Description of Artificial Sequence: Synthetic polypeptide
DESEIRTTNPVATEAWGSVSTNNNENQNDEGETG

SEQ ID NO: 122162 - protein, 35 aa, Artificial Sequence
  Description of Artificial Sequence: Synthetic polypeptide
AEEEIRTTNPVATEQYGVVSTSQNNDEQGNNNEDD

SEQ ID NO: 122163 - protein, 35 aa, Artificial Sequence
  Description of Artificial Sequence: Synthetic polypeptide
AEEEIRTTNPVATEQYGVVSTSQNGDEQGNNNNDD

SEQ ID NO: 122164 - protein, 33 aa, Artificial Sequence
  Description of Artificial Sequence: Synthetic polypeptide
DENEIATTNPVATEQYGSACSADTSQDDSDGNP

SEQ ID NO: 122165 - protein, 30 aa, Artificial Sequence
  Description of Artificial Sequence: Synthetic polypeptide
DENEIATTNPVATEQYGEAPMEDIQQNGEH

SEQ ID NO: 122166 - protein, 35 aa, Artificial Sequence
  Description of Artificial Sequence: Synthetic polypeptide
AEEEIRTTNPVATEQYGVVSTSQNGDEQGNNNDES

SEQ ID NO: 122167 - protein, 33 aa, Artificial Sequence
  Description of Artificial Sequence: Synthetic polypeptide
DESEIRTTNPVATEAWGSVSNNNNNNDEEGENG

SEQ ID NO: 122168 - protein, 35 aa, Artificial Sequence
  Description of Artificial Sequence: Synthetic polypeptide
FEEEIRTTNPVATEQYGSVSTVIADQIENNEPETK

SEQ ID NO: 122169 - protein, 34 aa, Artificial Sequence
  Description of Artificial Sequence: Synthetic polypeptide
NEEAEIATTNPVAYEQWGSVSTGGLNDERNMNQR

SEQ ID NO: 122170 - protein, 34 aa, Artificial Sequence
  Description of Artificial Sequence: Synthetic polypeptide
NEEAEICTTNPVAYECWGSVSTNLQGNAGENDGM

SEQ ID NO: 122171 - protein, 35 aa, Artificial Sequence
  Description of Artificial Sequence: Synthetic polypeptide
FEEEIRTTNPVATEQYGSVSTVELDPIENNVPETK

SEQ ID NO: 122172 - protein, 30 aa, Artificial Sequence
  Description of Artificial Sequence: Synthetic polypeptide
DEDDCIACTNPVAYEQWGCVSAINVQRDNN

SEQ ID NO: 122173 - protein, 35 aa, Artificial Sequence
  Description of Artificial Sequence: Synthetic polypeptide
FEEEIRTTNPVATEQYGSVSTVADDQGENGVPETV

SEQ ID NO: 122174 - protein, 33 aa, Artificial Sequence
  Description of Artificial Sequence: Synthetic polypeptide
NEDEIRTTNPVAYEQWGSVSGGGNHQGEGGGRN

SEQ ID NO: 122175 - protein, 30 aa, Artificial Sequence
  Description of Artificial Sequence: Synthetic polypeptide
DENEIATTNPVATEQYGEAPEEVIQQNGEK

SEQ ID NO: 122176 - protein, 32 aa, Artificial Sequence
  Description of Artificial Sequence: Synthetic polypeptide
CEDEIATTNPVAYEQYGSVAITNLENNGGEEQ

SEQ ID NO: 122177 - protein, 36 aa, Artificial Sequence
  Description of Artificial Sequence: Synthetic polypeptide
FEEEIRTTNPVATEQYGSVSTTMPDQQGENGVPESN

SEQ ID NO: 122178 - protein, 31 aa, Artificial Sequence
  Description of Artificial Sequence: Synthetic polypeptide
CEDEIATTNPVAYEQYGSVSAGNTDNDNNAS

SEQ ID NO: 122179 - protein, 35 aa, Artificial Sequence
  Description of Artificial Sequence: Synthetic polypeptide
AEEEIRTTNPVATEQYGVVSTNQNNQNQEQGTEQL

SEQ ID NO: 122180 - protein, 36 aa, Artificial Sequence
  Description of Artificial Sequence: Synthetic polypeptide
AEEEIRTTNPVATEQYGVVSTNQNNQNQEQGTENAG

SEQ ID NO: 122181 - protein, 36 aa, Artificial Sequence
  Description of Artificial Sequence: Synthetic polypeptide
FEEEIRTTNPVATEQYGSVSTMGVNEGQNVEGQSGG

SEQ ID NO: 122182 - protein, 34 aa, Artificial Sequence
  Description of Artificial Sequence: Synthetic polypeptide
DECEICTVNPVATEQYGSVSTTQNNADEEGTNTD

SEQ ID NO: 122183 - protein, 34 aa, Artificial Sequence
  Description of Artificial Sequence: Synthetic polypeptide
DESEIRTTNPVATDRCWGSVSCINEPQDREGENG

SEQ ID NO: 122184 - protein, 31 aa, Artificial Sequence
  Description of Artificial Sequence: Synthetic polypeptide
CEDEIATTNPVAYEQYGSVSAGNTDNDNNNF

SEQ ID NO: 122185 - protein, 34 aa, Artificial Sequence
  Description of Artificial Sequence: Synthetic polypeptide
DECEICTVNPVATEQYGSVSTTQNQNDEEGNNTD

SEQ ID NO: 122186 - protein, 35 aa, Artificial Sequence
  Description of Artificial Sequence: Synthetic polypeptide
AEEEIRTTNPVATEQYGVVSTNQNNGDEQGTNQEE

SEQ ID NO: 122187 - protein, 33 aa, Artificial Sequence
  Description of Artificial Sequence: Synthetic polypeptide
CEEEIATTNPVAYEQYGAVATNLADTPGEDDRW

SEQ ID NO: 122188 - protein, 35 aa, Artificial Sequence
  Description of Artificial Sequence: Synthetic polypeptide
AEEEIRTTNPVATEQYGVVSTNNNQNQDEEGTEAL

SEQ ID NO: 122189 - protein, 35 aa, Artificial Sequence
  Description of Artificial Sequence: Synthetic polypeptide
FEEEIRTTNPVATEQYGSVSTMAPDQGENGVPETL

SEQ ID NO: 122190 - protein, 34 aa, Artificial Sequence
  Description of Artificial Sequence: Synthetic polypeptide
AEEEISTTNPVATEQYGCVCSNTELNQNFGSEQA

SEQ ID NO: 122191 - protein, 36 aa, Artificial Sequence
  Description of Artificial Sequence: Synthetic polypeptide
AEEEIRTTNPVATEQYGVVSTNNNQLGSETGTNNAE

SEQ ID NO: 122192 - protein, 34 aa, Artificial Sequence
  Description of Artificial Sequence: Synthetic polypeptide
DEAEIQCTNPVAYEGYGSVVQSWNEQDRTGGNNR

SEQ ID NO: 122193 - protein, 34 aa, Artificial Sequence
  Description of Artificial Sequence: Synthetic polypeptide
FEEEIRTTNPVATEQYGSVSTGVGDDEGGEGTID

SEQ ID NO: 122194 - protein, 33 aa, Artificial Sequence
  Description of Artificial Sequence: Synthetic polypeptide
DEAEIQCTNPVAYEQYGKVVQSANEQDDGGNNR

SEQ ID NO: 122195 - protein, 32 aa, Artificial Sequence
  Description of Artificial Sequence: Synthetic polypeptide
DENEIATTNPVATEQYGSASAPPANDNPGGFP

SEQ ID NO: 122196 - protein, 32 aa, Artificial Sequence
  Description of Artificial Sequence: Synthetic polypeptide
DENEIATTNPVATEQYGDVSSTTPAGNMHGEL

SEQ ID NO: 122197 - protein, 33 aa, Artificial Sequence
  Description of Artificial Sequence: Synthetic polypeptide
DECEICTVNPVATEQYGSVSTTQQLQQNQQDED

SEQ ID NO: 122198 - protein, 30 aa, Artificial Sequence
  Description of Artificial Sequence: Synthetic polypeptide
DENEIATTNPVATEQYGEAPEEDIQQNGEK

SEQ ID NO: 122199 - protein, 35 aa, Artificial Sequence
  Description of Artificial Sequence: Synthetic polypeptide
FEEEIRTTNPVATEQYGSVSTTMMDQGENGVPEQN

SEQ ID NO: 122200 - protein, 35 aa, Artificial Sequence
  Description of Artificial Sequence: Synthetic polypeptide
FEEEIRTTNPVATEQYGSVSTTMDNQGENGVPMSL

SEQ ID NO: 122201 - protein, 33 aa, Artificial Sequence
  Description of Artificial Sequence: Synthetic polypeptide
DEEEIRTTNPVATEQYGSVYSPADEYAEMDLIE

SEQ ID NO: 122202 - protein, 34 aa, Artificial Sequence
  Description of Artificial Sequence: Synthetic polypeptide
DESEIRTTNPVATECWGSVCSWGNENQDNEGSNV

SEQ ID NO: 122203 - protein, 33 aa, Artificial Sequence
  Description of Artificial Sequence: Synthetic polypeptide
DESEIRTTNPVATDSYGSVVANGLGQIFTEGDQ

SEQ ID NO: 122204 - protein, 36 aa, Artificial Sequence
  Description of Artificial Sequence: Synthetic polypeptide
FEEEIRTTNPVATEQYGSVSTTGVNQGQNVEGQSGD

SEQ ID NO: 122205 - protein, 32 aa, Artificial Sequence
  Description of Artificial Sequence: Synthetic polypeptide
DENEIATTNPVATEQYGDVSSTTPCGNMHGEL

SEQ ID NO: 122206 - protein, 37 aa, Artificial Sequence
  Description of Artificial Sequence: Synthetic polypeptide
DEEEIRTTNPVATEQYGSVYSPANNLEIQVNGQGQPD

SEQ ID NO: 122207 - protein, 33 aa, Artificial Sequence
  Description of Artificial Sequence: Synthetic polypeptide
CEDEIATTNPVAYEQYGSVATNLQATPGDETLH

SEQ ID NO: 122208 - protein, 36 aa, Artificial Sequence
  Description of Artificial Sequence: Synthetic polypeptide
DEEEIRTTNPVATEQYGSVQPTDSTLQQNVQVIMDL

SEQ ID NO: 122209 - protein, 32 aa, Artificial Sequence
  Description of Artificial Sequence: Synthetic polypeptide
DEQEIATTNPVAYEQWGSCSATDNLDHEGTDQ

SEQ ID NO: 122210 - protein, 35 aa, Artificial Sequence
  Description of Artificial Sequence: Synthetic polypeptide
DESEIRTTNPVATECWGSVCSWMNENQDRSGSNQS

SEQ ID NO: 122211 - protein, 35 aa, Artificial Sequence
  Description of Artificial Sequence: Synthetic polypeptide
FEEEIRTTNPVATEQYGSVSTPWEHQQSTVVENNF

SEQ ID NO: 122212 - protein, 32 aa, Artificial Sequence
  Description of Artificial Sequence: Synthetic polypeptide
AEEEISTTNPVATEEYGCSCSWNHQYFGSDQS

SEQ ID NO: 122213 - protein, 35 aa, Artificial Sequence
  Description of Artificial Sequence: Synthetic polypeptide
DEEEIRTTNPVATEQYGSVSDSVGLIETMVGQTKI

SEQ ID NO: 122214 - protein, 34 aa, Artificial Sequence
  Description of Artificial Sequence: Synthetic polypeptide
DEEEIRTTNPVATEQYGSVSDSAGLIETMVEQVK

SEQ ID NO: 122215 - protein, 36 aa, Artificial Sequence
  Description of Artificial Sequence: Synthetic polypeptide
DEEEIRTTNPVATEQYGSVQSPFNQIQPQNMVLTDQ

SEQ ID NO: 122216 - protein, 34 aa, Artificial Sequence
  Description of Artificial Sequence: Synthetic polypeptide
DESEIRTTNPVATECWGSVCSCINEPQDRSGEHG

SEQ ID NO: 122217 - protein, 34 aa, Artificial Sequence
  Description of Artificial Sequence: Synthetic polypeptide
DESEIRTTNPVATEAWGSVSTVNNNNQQNETENG

SEQ ID NO: 122218 - protein, 31 aa, Artificial Sequence
  Description of Artificial Sequence: Synthetic polypeptide
NEDEIATTNPVAYEQWGSVRWWNDDQQTGNH

SEQ ID NO: 122219 - protein, 33 aa, Artificial Sequence
  Description of Artificial Sequence: Synthetic polypeptide
DESEIRTTNPVATECWGSVACINEPEDREGENG

SEQ ID NO: 122220 - protein, 35 aa, Artificial Sequence
  Description of Artificial Sequence: Synthetic polypeptide
DENEIATTNPVATEQYGSVAMNGLTQPDNQMDTRM

SEQ ID NO: 122221 - protein, 35 aa, Artificial Sequence
  Description of Artificial Sequence: Synthetic polypeptide
FEEEIRTTNPVATEQYGSVTDTGLGIGQGGTEDDD

SEQ ID NO: 122222 - protein, 32 aa, Artificial Sequence
  Description of Artificial Sequence: Synthetic polypeptide
DENEIRTTNPISTEPYGSISMEDLQQQQNGNH

SEQ ID NO: 122223 - protein, 34 aa, Artificial Sequence
  Description of Artificial Sequence: Synthetic polypeptide
DESEIRTTNPVATECWGSLVSCINEPQDREIENG

SEQ ID NO: 122224 - protein, 37 aa, Artificial Sequence
  Description of Artificial Sequence: Synthetic polypeptide
DEEEIRTTNPVATEQYGSVQSITQYLQPMLENVELED

SEQ ID NO: 122225 - protein, 35 aa, Artificial Sequence
  Description of Artificial Sequence: Synthetic polypeptide
DEEEIRTTNPVATEQYGSVQSFPDMLEEERQESIY

SEQ ID NO: 122226 - protein, 34 aa, Artificial Sequence
  Description of Artificial Sequence: Synthetic polypeptide
DESEIRTTNPVATECFGSVSHCINEPWDREGENG

SEQ ID NO: 122227 - protein, 36 aa, Artificial Sequence
  Description of Artificial Sequence: Synthetic polypeptide
FEEEIRTTNPVATEQYGSVTDTGLGIGQGGGTNGDD

SEQ ID NO: 122228 - protein, 34 aa, Artificial Sequence
  Description of Artificial Sequence: Synthetic polypeptide
DENEIATTNPVATEQYGSVAIANNLTEAPGNTHQ

SEQ ID NO: 122229 - protein, 32 aa, Artificial Sequence
  Description of Artificial Sequence: Synthetic polypeptide
DECEIRTTNPCAYEQWGSVPTWENDQQKGSEQ

SEQ ID NO: 122230 - protein, 37 aa, Artificial Sequence
  Description of Artificial Sequence: Synthetic polypeptide
DEEEIRTTNPVATEQYGSVQSEGSMVSTTGTGGNYRL

SEQ ID NO: 122231 - protein, 33 aa, Artificial Sequence
  Description of Artificial Sequence: Synthetic polypeptide
DESEIRTTNPVATECWGSVACINEPWDREGENG

SEQ ID NO: 122232 - protein, 33 aa, Artificial Sequence
  Description of Artificial Sequence: Synthetic polypeptide
DENEIATTNPVATEQYGSVAATNPLEAPDQHMS

SEQ ID NO: 122233 - protein, 36 aa, Artificial Sequence
  Description of Artificial Sequence: Synthetic polypeptide
DEEEIRTTNPVATEQYGSVQSLMPMLEQIANENLIE

SEQ ID NO: 122234 - protein, 35 aa, Artificial Sequence
  Description of Artificial Sequence: Synthetic polypeptide
DEEEIRTTNPVATEQYGSVQSLSNGEAHELAQVDV

SEQ ID NO: 122235 - protein, 35 aa, Artificial Sequence
  Description of Artificial Sequence: Synthetic polypeptide
FEEEIRTTNPVATEQYGSVTGDNIGQGEDGGNTQA

SEQ ID NO: 122236 - protein, 33 aa, Artificial Sequence
  Description of Artificial Sequence: Synthetic polypeptide
DESEIRTTNPVATECWGSVACIDEPQDREGENG

SEQ ID NO: 122237 - protein, 30 aa, Artificial Sequence
  Description of Artificial Sequence: Synthetic polypeptide
DECEIRTTNPVATEQWGDVSEIRMNAAEDA

SEQ ID NO: 122238 - protein, 32 aa, Artificial Sequence
  Description of Artificial Sequence: Synthetic polypeptide
DENEIATTNPVATEQYGSVANMNNDNAIGEGA

SEQ ID NO: 122239 - protein, 34 aa, Artificial Sequence
  Description of Artificial Sequence: Synthetic polypeptide
DEDCIRTTNPVATEEWGSVATGNMGSQANGGNNR

SEQ ID NO: 122240 - protein, 36 aa, Artificial Sequence
  Description of Artificial Sequence: Synthetic polypeptide
DEEEIRTTNPVATEQYGSVQSPANQTQEQNMVNTTQ

SEQ ID NO: 122241 - protein, 34 aa, Artificial Sequence
  Description of Artificial Sequence: Synthetic polypeptide
DEAEIRTTNPVAYEQYGQSVSQNELLTEQIEYQF

SEQ ID NO: 122242 - protein, 35 aa, Artificial Sequence
  Description of Artificial Sequence: Synthetic polypeptide
DEEEIRTTNPVATEQYGSVQSNTTVIVDASALQNE

SEQ ID NO: 122243 - protein, 36 aa, Artificial Sequence
  Description of Artificial Sequence: Synthetic polypeptide
DEEEIRTTNPVATEQYGSVQSNDNFLDEISQSVVED

SEQ ID NO: 122244 - protein, 36 aa, Artificial Sequence
  Description of Artificial Sequence: Synthetic polypeptide
DEEEIRTTNPVATEQYGSVQSEGESVSTGTSGNYRL

SEQ ID NO: 122245 - protein, 30 aa, Artificial Sequence
  Description of Artificial Sequence: Synthetic polypeptide
DECEIRTTNPVATEQWGDVSEIEMNAAEDA

SEQ ID NO: 122246 - protein, 34 aa, Artificial Sequence
  Description of Artificial Sequence: Synthetic polypeptide
DEAEIRTTNPVAYEQYGQSVSQNELLTEDQIEFF

SEQ ID NO: 122247 - protein, 33 aa, Artificial Sequence
  Description of Artificial Sequence: Synthetic polypeptide
DESEIRTTNPVATECWASCSCINEPQDREGENG

SEQ ID NO: 122248 - protein, 35 aa, Artificial Sequence
  Description of Artificial Sequence: Synthetic polypeptide
DEEEIRTTNPVATEQYGSVSDPVGLIEDQGPQLVT

SEQ ID NO: 122249 - protein, 33 aa, Artificial Sequence
  Description of Artificial Sequence: Synthetic polypeptide
DEAEIRTTNPVAYEQYGQSVSQNALLTELIEQF

SEQ ID NO: 122250 - protein, 33 aa, Artificial Sequence
  Description of Artificial Sequence: Synthetic polypeptide
DEAEIRTTNPVAYEQYGQSVSQLEDLTELIERF

SEQ ID NO: 122251 - protein, 33 aa, Artificial Sequence
  Description of Artificial Sequence: Synthetic polypeptide
NEDEIATTNPVATEQYGCVAGTGLAASGDENRH

SEQ ID NO: 122252 - protein, 34 aa, Artificial Sequence
  Description of Artificial Sequence: Synthetic polypeptide
DECEIRTTNPVATECWGSVSCINEPEDREGENTG

SEQ ID NO: 122253 - protein, 33 aa, Artificial Sequence
  Description of Artificial Sequence: Synthetic polypeptide
DESEIRTTNPVATECWASVSCINEPQDREGEDG

SEQ ID NO: 122254 - protein, 35 aa, Artificial Sequence
  Description of Artificial Sequence: Synthetic polypeptide
DEEEIRTTNPVATEQYGSVSDPVGLIESTPGQLVG

SEQ ID NO: 122255 - protein, 34 aa, Artificial Sequence
  Description of Artificial Sequence: Synthetic polypeptide
DESEIRTTNPVATECWGSVADCINEPQDREGENG

SEQ ID NO: 122256 - protein, 32 aa, Artificial Sequence
  Description of Artificial Sequence: Synthetic polypeptide
DESEIRTTNPVATECWGSVANCINWADPEGNG

SEQ ID NO: 122257 - protein, 35 aa, Artificial Sequence
  Description of Artificial Sequence: Synthetic polypeptide
DEEEIRTTNPVATEQYGSVYSAPIPDEQAENFLIE

SEQ ID NO: 122258 - protein, 33 aa, Artificial Sequence
  Description of Artificial Sequence: Synthetic polypeptide
NEDEIRTTNPVATEQYGSVDPANGQGINGGQGQ

SEQ ID NO: 122259 - protein, 33 aa, Artificial Sequence
  Description of Artificial Sequence: Synthetic polypeptide
DESEIRTTNPVATECWGSVCCINEPVDREGENG

SEQ ID NO: 122260 - protein, 33 aa, Artificial Sequence
  Description of Artificial Sequence: Synthetic polypeptide
DEAEIRTTNPVAYEQYGQSCSQNDLLTEGIEFF

SEQ ID NO: 122261 - protein, 33 aa, Artificial Sequence
  Description of Artificial Sequence: Synthetic polypeptide
DESEIRTTNPVATEAWGSVSWGNENQDHEGSQQ

SEQ ID NO: 122262 - protein, 34 aa, Artificial Sequence
  Description of Artificial Sequence: Synthetic polypeptide
DESEIRTTNPVATECWGSVCSCINEPCDREGENG

SEQ ID NO: 122263 - protein, 33 aa, Artificial Sequence
  Description of Artificial Sequence: Synthetic polypeptide
DESEIRTTNPVATEAWGSVSVVNNNQGNEEENG

SEQ ID NO: 122264 - protein, 35 aa, Artificial Sequence
  Description of Artificial Sequence: Synthetic polypeptide
DESEIRTTNPVATECWGSVASPCINEPQDREGENG

SEQ ID NO: 122265 - protein, 33 aa, Artificial Sequence
  Description of Artificial Sequence: Synthetic polypeptide
DESEIRTTNPVATEAWGSVSVNNNNQQDEGEQG

SEQ ID NO: 122266 - protein, 32 aa, Artificial Sequence
  Description of Artificial Sequence: Synthetic polypeptide
DENEIATTNPVATEQYGSISATDIEDHEGEDL

SEQ ID NO: 122267 - protein, 34 aa, Artificial Sequence
  Description of Artificial Sequence: Synthetic polypeptide
DESEIRTTNPVATEAWGSVSVNNNENQEDEGENG

SEQ ID NO: 122268 - protein, 34 aa, Artificial Sequence
  Description of Artificial Sequence: Synthetic polypeptide
DESEIRTTNPVATEAWGSVSTVVNNNTNDEGENG

SEQ ID NO: 122269 - protein, 35 aa, Artificial Sequence
  Description of Artificial Sequence: Synthetic polypeptide
DENEIATTNPVATEQYGSCSTGAIPNPRMQMEGNN

SEQ ID NO: 122270 - protein, 32 aa, Artificial Sequence
  Description of Artificial Sequence: Synthetic polypeptide
DENEIATTNPVATEQYGSCSTGAIGPNDMGTM

SEQ ID NO: 122271 - protein, 34 aa, Artificial Sequence
  Description of Artificial Sequence: Synthetic polypeptide
DENEIATTNPVATEQYGSCSGTGNPQNDDLGAQV

SEQ ID NO: 122272 - protein, 36 aa, Artificial Sequence
  Description of Artificial Sequence: Synthetic polypeptide
AEEEIRTTNPVATEQYGVVSTTLQLNGNEEGTTVDD

SEQ ID NO: 122273 - protein, 34 aa, Artificial Sequence
  Description of Artificial Sequence: Synthetic polypeptide
DESEIRTTNPVATECWGSVCSCINEPQDFEGENG

SEQ ID NO: 122274 - protein, 36 aa, Artificial Sequence
  Description of Artificial Sequence: Synthetic polypeptide
DEEEIRTTNPVATEQYGSVYSEAPLLEIQVNGGDPN

SEQ ID NO: 122275 - protein, 33 aa, Artificial Sequence
  Description of Artificial Sequence: Synthetic polypeptide
DECEIKTTNPVATEQYGSVMTPVFLIAETSNAQ

SEQ ID NO: 122276 - protein, 34 aa, Artificial Sequence
  Description of Artificial Sequence: Synthetic polypeptide
DESEIRTTNPVATECWGSVASCINEPQDRELENG

SEQ ID NO: 122277 - protein, 35 aa, Artificial Sequence
  Description of Artificial Sequence: Synthetic polypeptide
NEDEIRTTNPVATEPYGSVCFTNEDHTDQGGDNHR

SEQ ID NO: 122278 - protein, 35 aa, Artificial Sequence
  Description of Artificial Sequence: Synthetic polypeptide
DEEEIRTTNPVATEQYGSVYQNSYALIQETLEMDS

SEQ ID NO: 122279 - protein, 36 aa, Artificial Sequence
  Description of Artificial Sequence: Synthetic polypeptide
DEEEIRTTNPVATEQYGSVYQPFNLVISPEQQLSNL

SEQ ID NO: 122280 - protein, 33 aa, Artificial Sequence
  Description of Artificial Sequence: Synthetic polypeptide
DECEIKTTNPVATEQYGTVSSVTDGPEENEGND

SEQ ID NO: 122281 - protein, 34 aa, Artificial Sequence
  Description of Artificial Sequence: Synthetic polypeptide
NEDEIRTTNPVATEQWGSVAWTDNMQQQDRGSDK

SEQ ID NO: 122282 - protein, 32 aa, Artificial Sequence
  Description of Artificial Sequence: Synthetic polypeptide
NEDEIRTTNPVATEQYGELCSTNLEPEPDDSA

SEQ ID NO: 122283 - protein, 35 aa, Artificial Sequence
  Description of Artificial Sequence: Synthetic polypeptide
DENEIATTNPVATEQYGSVAAATNNQENTDDGNQM

SEQ ID NO: 122284 - protein, 33 aa, Artificial Sequence
  Description of Artificial Sequence: Synthetic polypeptide
DEEEIACTNPVATEQYGCVATNNHQENDMLIRD

SEQ ID NO: 122285 - protein, 30 aa, Artificial Sequence
  Description of Artificial Sequence: Synthetic polypeptide
CEDEIATTNPVAYEQYGSVAANNDADNNNN

SEQ ID NO: 122286 - protein, 37 aa, Artificial Sequence
  Description of Artificial Sequence: Synthetic polypeptide
AEEEIRTTNPVATEQYGVVSTTNGTLQNGNQEGNNAE

SEQ ID NO: 122287 - protein, 37 aa, Artificial Sequence
  Description of Artificial Sequence: Synthetic polypeptide
FEEEIRTTNPVATEQYGSVSWPFNDLGEEQPVFNVRN

SEQ ID NO: 122288 - protein, 36 aa, Artificial Sequence
  Description of Artificial Sequence: Synthetic polypeptide
FEEEIRTTNPVATEQYGSVSVLPTGLEPANGNPANL

SEQ ID NO: 122289 - protein, 33 aa, Artificial Sequence
  Description of Artificial Sequence: Synthetic polypeptide
NEDEIRTTNPVATEQYGSVDDANGQGIQGGQTG

SEQ ID NO: 122290 - protein, 35 aa, Artificial Sequence
  Description of Artificial Sequence: Synthetic polypeptide
FEEEIRTTNPVATEQYGSVSVDQNEQQENGGEGQE

SEQ ID NO: 122291 - protein, 35 aa, Artificial Sequence
  Description of Artificial Sequence: Synthetic polypeptide
FEEEIRTTNPVATEQYGSVSVDQNEMDENGNEGQE

SEQ ID NO: 122292 - protein, 35 aa, Artificial Sequence
  Description of Artificial Sequence: Synthetic polypeptide
DENEIATTNPVATEQYGSTCAMNNHLEADRDGDNR

SEQ ID NO: 122293 - protein, 35 aa, Artificial Sequence
  Description of Artificial Sequence: Synthetic polypeptide
DEEEIRTTNPVATEQYGSVQQTSEQEQQEVAENDT

SEQ ID NO: 122294 - protein, 30 aa, Artificial Sequence
  Description of Artificial Sequence: Synthetic polypeptide
DENEIRSTNPVSTEQYGNVANTIMSRAEDA

SEQ ID NO: 122295 - protein, 37 aa, Artificial Sequence
  Description of Artificial Sequence: Synthetic polypeptide
AEEEIRTTNPVATEQYGVVSTTNNQLQQGTETGTNTA

SEQ ID NO: 122296 - protein, 33 aa, Artificial Sequence
  Description of Artificial Sequence: Synthetic polypeptide
DEQEIATTNPVAYECWGSVATNLQGNAGENDGH

SEQ ID NO: 122297 - protein, 35 aa, Artificial Sequence
  Description of Artificial Sequence: Synthetic polypeptide
DEEEIRTTNPVATEQYGSVSCVVDDLNQPNSQHQQ

SEQ ID NO: 122298 - protein, 35 aa, Artificial Sequence
  Description of Artificial Sequence: Synthetic polypeptide
DEEEIRTTNPVATEQYGSVSCVVDLFQPNDQIDEQ

SEQ ID NO: 122299 - protein, 33 aa, Artificial Sequence
  Description of Artificial Sequence: Synthetic polypeptide
DESEIRTTNPVATECWGGVSCINEPIDREGENG

SEQ ID NO: 122300 - protein, 33 aa, Artificial Sequence
  Description of Artificial Sequence: Synthetic polypeptide
DEQEIATTNPVATKQYGSVSATDLKEDHEGEDL

SEQ ID NO: 122301 - protein, 28 aa, Artificial Sequence
  Description of Artificial Sequence: Synthetic peptide
GEEEIATTNPVAYEQYGEAPEVCQHEEW

SEQ ID NO: 122302 - protein, 31 aa, Artificial Sequence
  Description of Artificial Sequence: Synthetic polypeptide
DENEIATTNPVATYDPHYGSVASNDQTDNES

SEQ ID NO: 122303 - protein, 31 aa, Artificial Sequence
  Description of Artificial Sequence: Synthetic polypeptide
DENEIRTTNPCSSEQYGTISMENIQQQNGNH

SEQ ID NO: 122304 - protein, 34 aa, Artificial Sequence
  Description of Artificial Sequence: Synthetic polypeptide
MENEIRTTNPVATEQYGSVTFLAMQQEMGNEEEN

SEQ ID NO: 122305 - protein, 32 aa, Artificial Sequence
  Description of Artificial Sequence: Synthetic polypeptide
MENEIRTTNPVATEQYGVTVSAELIRPQIQDG

SEQ ID NO: 122306 - protein, 33 aa, Artificial Sequence
  Description of Artificial Sequence: Synthetic polypeptide
MENEIRTTNPVATEQYGVVSAELTINRPQNQDG

SEQ ID NO: 122307 - protein, 35 aa, Artificial Sequence
  Description of Artificial Sequence: Synthetic polypeptide
DESEIRTTNPVATECWGSTVSAINEPQEREGENYG

SEQ ID NO: 122308 - protein, 33 aa, Artificial Sequence
  Description of Artificial Sequence: Synthetic polypeptide
MENEIRTTNPVATETYGSVSNNILTEVGDTVPC

SEQ ID NO: 122309 - protein, 31 aa, Artificial Sequence
  Description of Artificial Sequence: Synthetic polypeptide
DENEIRTTNPCSSEQYGTISMENIQQQNGTR

SEQ ID NO: 122310 - protein, 36 aa, Artificial Sequence
  Description of Artificial Sequence: Synthetic polypeptide
DEEEIRTTNPVATEQYGSVYGDGNLNMDEEGINNGQ

SEQ ID NO: 122311 - protein, 35 aa, Artificial Sequence
  Description of Artificial Sequence: Synthetic polypeptide
DEEEIRTTNPVATEQYGSVYGEGGNMVDGGNGQEI

SEQ ID NO: 122312 - protein, 34 aa, Artificial Sequence
  Description of Artificial Sequence: Synthetic polypeptide
AEEEIRTTNPVATESYGVVSTVSNNNVEEGTNSQ

SEQ ID NO: 122313 - protein, 36 aa, Artificial Sequence
  Description of Artificial Sequence: Synthetic polypeptide
DEEEIRTTNPVATEQYGSVVVDGSGQENDQEEDGTY

SEQ ID NO: 122314 - protein, 35 aa, Artificial Sequence
  Description of Artificial Sequence: Synthetic polypeptide
DEEEIRTTNPVATEQYGSVSCVVDDLLQPNSQFEQ

SEQ ID NO: 122315 - protein, 32 aa, Artificial Sequence
  Description of Artificial Sequence: Synthetic polypeptide
DEQEIATTNPVATKQYGSVSATDHEDHEGEDL

SEQ ID NO: 122316 - protein, 30 aa, Artificial Sequence
  Description of Artificial Sequence: Synthetic polypeptide
DENEIRTTNPCATEQWGDVSENEMNAAEDA

SEQ ID NO: 122317 - protein, 37 aa, Artificial Sequence
  Description of Artificial Sequence: Synthetic polypeptide
AEEEIRTTNPVATEQYGVVSTTQNNLQNGNQEGNNVE

SEQ ID NO: 122318 - protein, 33 aa, Artificial Sequence
  Description of Artificial Sequence: Synthetic polypeptide
DECEIVTTNPVATEQYGTVCSITDHPVEFEGND

SEQ ID NO: 122319 - protein, 32 aa, Artificial Sequence
  Description of Artificial Sequence: Synthetic polypeptide
MENEIRTTNPVATEQYGCVVPWLNMQESNDTQ

SEQ ID NO: 122320 - protein, 30 aa, Artificial Sequence
  Description of Artificial Sequence: Synthetic polypeptide
DENEIRTTNPCATEQWGDVSENEMNSAEDA

SEQ ID NO: 122321 - protein, 36 aa, Artificial Sequence
  Description of Artificial Sequence: Synthetic polypeptide
DEEEIRTTNPVATEQYGSVYGDDNTLQDTIGEEGEG

SEQ ID NO: 122322 - protein, 33 aa, Artificial Sequence
  Description of Artificial Sequence: Synthetic polypeptide
DEQEIATTNPVATHQYGVSVSATDLEDHEGEDL

SEQ ID NO: 122323 - protein, 33 aa, Artificial Sequence
  Description of Artificial Sequence: Synthetic polypeptide
DECEIVTTNPVATEQYGTVCSATDGPVEFEGNW

SEQ ID NO: 122324 - protein, 35 aa, Artificial Sequence
  Description of Artificial Sequence: Synthetic polypeptide
MENEIRTTNPVATEQYGEVVTSATEGLQRPQNTDG

SEQ ID NO: 122325 - protein, 33 aa, Artificial Sequence
  Description of Artificial Sequence: Synthetic polypeptide
DECEIVTTNPVATEQYGTVCSATDGPWEFEGND

SEQ ID NO: 122326 - protein, 33 aa, Artificial Sequence
  Description of Artificial Sequence: Synthetic polypeptide
DEQEIATTNPVATIQYGSVSATDLLEDHEGEDL

SEQ ID NO: 122327 - protein, 33 aa, Artificial Sequence
  Description of Artificial Sequence: Synthetic polypeptide
DESEIRTTNPVATECWGGVSCINEPQDIEGENG

SEQ ID NO: 122328 - protein, 34 aa, Artificial Sequence
  Description of Artificial Sequence: Synthetic polypeptide
DEQEIATTNPVATEQYGSVSTTDLEDHEGSEDLV

SEQ ID NO: 122329 - protein, 31 aa, Artificial Sequence
  Description of Artificial Sequence: Synthetic polypeptide
DENEIATTNPVAYDPHYGSVASNDQRDNESH

SEQ ID NO: 122330 - protein, 37 aa, Artificial Sequence
  Description of Artificial Sequence: Synthetic polypeptide
AEEEIRTTNPVATEQYGVVSTTPNNLQNGNQEGTNAE

SEQ ID NO: 122331 - protein, 35 aa, Artificial Sequence
  Description of Artificial Sequence: Synthetic polypeptide
MENEIRTTNPVATEQYGSVSTAGSLESTENNEDRQ

SEQ ID NO: 122332 - protein, 30 aa, Artificial Sequence
  Description of Artificial Sequence: Synthetic polypeptide
DENEIRTTNPCATEQWGIVSEIEMNAAGDA

SEQ ID NO: 122333 - protein, 33 aa, Artificial Sequence
  Description of Artificial Sequence: Synthetic polypeptide
DECEIVTTNPVATEQYGTVCSATDGPVEFEGND

SEQ ID NO: 122334 - protein, 34 aa, Artificial Sequence
  Description of Artificial Sequence: Synthetic polypeptide
DESEIRTTNPVATECWGGSVSCINEPQDKEGENG

SEQ ID NO: 122335 - protein, 30 aa, Artificial Sequence
  Description of Artificial Sequence: Synthetic polypeptide
MENQIACTNPVATEQYGEASEVLQRGDGQQ

SEQ ID NO: 122336 - protein, 33 aa, Artificial Sequence
  Description of Artificial Sequence: Synthetic polypeptide
DENEIATTNPVATEQYGTVCSATDGGVGDEGND

SEQ ID NO: 122337 - protein, 32 aa, Artificial Sequence
  Description of Artificial Sequence: Synthetic polypeptide
DEQEIATTNPVATNQYGSVSATDLEDHEWEDN

SEQ ID NO: 122338 - protein, 31 aa, Artificial Sequence
  Description of Artificial Sequence: Synthetic polypeptide
DENEIRTTNPCSTEPYGIVSCDIQQQQNGNH

SEQ ID NO: 122339 - protein, 33 aa, Artificial Sequence
  Description of Artificial Sequence: Synthetic polypeptide
DEQEIATTNPVATNQYGSVSATDLIEDHEGEDL

SEQ ID NO: 122340 - protein, 33 aa, Artificial Sequence
  Description of Artificial Sequence: Synthetic polypeptide
DENEIATTNPVATEQYGTVCSATDGEVNAEGND

SEQ ID NO: 122341 - protein, 35 aa, Artificial Sequence
  Description of Artificial Sequence: Synthetic polypeptide
MEQEIRTTNPVATEQYGVVSTTDGDLGQRNQGDGG

SEQ ID NO: 122342 - protein, 31 aa, Artificial Sequence
  Description of Artificial Sequence: Synthetic polypeptide
DENEIATTNPVATEQYGTISMVIQQQHNENH

SEQ ID NO: 122343 - protein, 33 aa, Artificial Sequence
  Description of Artificial Sequence: Synthetic polypeptide
DEQEIATTNPVATNQYGSVSATDLEDHEGTEDL

SEQ ID NO: 122344 - protein, 32 aa, Artificial Sequence
  Description of Artificial Sequence: Synthetic polypeptide
DEQEIATTNPVATQCYGSVSATDLEDHEGEDL

SEQ ID NO: 122345 - protein, 32 aa, Artificial Sequence
  Description of Artificial Sequence: Synthetic polypeptide
DENEIATTNPVATEQYGTISMEVIQQQHNGNK

SEQ ID NO: 122346 - protein, 33 aa, Artificial Sequence
  Description of Artificial Sequence: Synthetic polypeptide
DEQEIATTNPVATQQYGSVSATDCLEDHEGEDL

SEQ ID NO: 122347 - protein, 34 aa, Artificial Sequence
  Description of Artificial Sequence: Synthetic polypeptide
DESEIRTTNPVATECWGFVSCINGEPQDREGENG

SEQ ID NO: 122348 - protein, 33 aa, Artificial Sequence
  Description of Artificial Sequence: Synthetic polypeptide
DESEIRTTNPVATECWGFVSCINEPQDREYENG

SEQ ID NO: 122349 - protein, 34 aa, Artificial Sequence
  Description of Artificial Sequence: Synthetic polypeptide
DESEIRTTNPVATECWGFVSCINEPQDREGENGT

SEQ ID NO: 122350 - protein, 35 aa, Artificial Sequence
  Description of Artificial Sequence: Synthetic polypeptide
DEEEIRTTNPVATEQYGSVSCVVDTLNQPNSQIYQ

SEQ ID NO: 122351 - protein, 36 aa, Artificial Sequence
  Description of Artificial Sequence: Synthetic polypeptide
DEEEIRTTNPVATEQYGSVYHTTEDHNDQENGEEGE

SEQ ID NO: 122352 - protein, 28 aa, Artificial Sequence
  Description of Artificial Sequence: Synthetic peptide
MESEIASTNPVGTEGYGVMASTLQHGDI

SEQ ID NO: 122353 - protein, 34 aa, Artificial Sequence
  Description of Artificial Sequence: Synthetic polypeptide
GEEEIRTTNPVATEQYGSVSISNTEEREVVELQT

SEQ ID NO: 122354 - protein, 35 aa, Artificial Sequence
  Description of Artificial Sequence: Synthetic polypeptide
AEEEIRTTNPVATEQYGVVSTTNSNTNGEEGTNND

SEQ ID NO: 122355 - protein, 35 aa, Artificial Sequence
  Description of Artificial Sequence: Synthetic polypeptide
DEEEIRTTNPVATEQYGSVYGQTTDDSGQGNEFED

SEQ ID NO: 122356 - protein, 32 aa, Artificial Sequence
  Description of Artificial Sequence: Synthetic polypeptide
DEAEIRTTNGVAYCQYGCVCSTALQGFGSDQS

SEQ ID NO: 122357 - protein, 35 aa, Artificial Sequence
  Description of Artificial Sequence: Synthetic polypeptide
MEPEICTTNPVATEQYGSVCTTDGNLQEEMGNGEE

SEQ ID NO: 122358 - protein, 35 aa, Artificial Sequence
  Description of Artificial Sequence: Synthetic polypeptide
DESEIRTTNPVATECWGGSAVSCINEPQDREGENG

SEQ ID NO: 122359 - protein, 34 aa, Artificial Sequence
  Description of Artificial Sequence: Synthetic polypeptide
MEPEIRTTNPVATEQYGSVILMPALEARNVNERM

SEQ ID NO: 122360 - protein, 33 aa, Artificial Sequence
  Description of Artificial Sequence: Synthetic polypeptide
MEQEIATTNPVATEQYGSVSATCDLEDHEGEDL

SEQ ID NO: 122361 - protein, 32 aa, Artificial Sequence
  Description of Artificial Sequence: Synthetic polypeptide
DEQEIATTNPVATNIYGSVSATDLEDHEGEDL

SEQ ID NO: 122362 - protein, 35 aa, Artificial Sequence
  Description of Artificial Sequence: Synthetic polypeptide
DEEEIRTTNPVATEQYGSVYGQGTDDLNQGPEFVG

SEQ ID NO: 122363 - protein, 35 aa, Artificial Sequence
  Description of Artificial Sequence: Synthetic polypeptide
MEQEIRTTNPVATEQYGSVSVTNEIDINDGEPNMM

SEQ ID NO: 122364 - protein, 35 aa, Artificial Sequence
  Description of Artificial Sequence: Synthetic polypeptide
AEEEIRTTNPVATEQYGVVSTTNSTTNSEEGNTNA

SEQ ID NO: 122365 - protein, 33 aa, Artificial Sequence
  Description of Artificial Sequence: Synthetic polypeptide
DENEIATTNPVATEQYGTVSATDIQEQHNGEDH

SEQ ID NO: 122366 - protein, 35 aa, Artificial Sequence
  Description of Artificial Sequence: Synthetic polypeptide
DEEEIRTTNPVATEQYGSVYGQTTDDLNQGEEFDV

SEQ ID NO: 122367 - protein, 34 aa, Artificial Sequence
  Description of Artificial Sequence: Synthetic polypeptide
MEQEIRTTNPVATEQYGSCSVTNILHIEEIGEEQ

SEQ ID NO: 122368 - protein, 35 aa, Artificial Sequence
  Description of Artificial Sequence: Synthetic polypeptide
DEEEIRTTNPVATEQYGSVSCVVDLNQPNSQCEEQ

SEQ ID NO: 122369 - protein, 33 aa, Artificial Sequence
  Description of Artificial Sequence: Synthetic polypeptide
DENEIATTNPVATEQYGTVCSATWGPVEFEGND

SEQ ID NO: 122370 - protein, 34 aa, Artificial Sequence
  Description of Artificial Sequence: Synthetic polypeptide
DESEIRTTNPVATECWGGNVSCINEPQDREGENG

SEQ ID NO: 122371 - protein, 33 aa, Artificial Sequence
  Description of Artificial Sequence: Synthetic polypeptide
DENEIATTNPVATEQYGTVCSATQGGVEDDGND

SEQ ID NO: 122372 - protein, 35 aa, Artificial Sequence
  Description of Artificial Sequence: Synthetic polypeptide
DEEEIRTTNPVATEQYGSVYGQTTDDLGQGEEFQD

SEQ ID NO: 122373 - protein, 33 aa, Artificial Sequence
  Description of Artificial Sequence: Synthetic polypeptide
DECEISTTNPVAYEQWGTTSHTDNHAQREGTGR

SEQ ID NO: 122374 - protein, 34 aa, Artificial Sequence
  Description of Artificial Sequence: Synthetic polypeptide
DESEIRTTNPVATECWGGVSYCINEPQDREGENG

SEQ ID NO: 122375 - protein, 33 aa, Artificial Sequence
  Description of Artificial Sequence: Synthetic polypeptide
DEQEIATTNPVATHQYGSVSATDDLEDHEGEDL

SEQ ID NO: 122376 - protein, 28 aa, Artificial Sequence
  Description of Artificial Sequence: Synthetic peptide
GESEIASTNPVGTEGYGVMASTLQHGDI

SEQ ID NO: 122377 - protein, 34 aa, Artificial Sequence
  Description of Artificial Sequence: Synthetic polypeptide
DESEIRTTNPVATECWGSSVSCINEPQDSEGENG

SEQ ID NO: 122378 - protein, 33 aa, Artificial Sequence
  Description of Artificial Sequence: Synthetic polypeptide
DEQEIATTNPVATEWYGSVSATDLEDHEGYEDL

SEQ ID NO: 122379 - protein, 32 aa, Artificial Sequence
  Description of Artificial Sequence: Synthetic polypeptide
GEQEIATTNPVACEQYGSVSATDLEDHEGEDL

SEQ ID NO: 122380 - protein, 34 aa, Artificial Sequence
  Description of Artificial Sequence: Synthetic polypeptide
MEGEIRTTNPVATEQYGSVSVSFNYDQRVQEDIV

SEQ ID NO: 122381 - protein, 31 aa, Artificial Sequence
  Description of Artificial Sequence: Synthetic polypeptide
DENEIRSVNPVSTEPYGVVSDENIQQSNGNH

SEQ ID NO: 122382 - protein, 37 aa, Artificial Sequence
  Description of Artificial Sequence: Synthetic polypeptide
AEEEIRTTNPVATEQYGVVSTTTANLQAGTEAGNEDG

SEQ ID NO: 122383 - protein, 32 aa, Artificial Sequence
  Description of Artificial Sequence: Synthetic polypeptide
DEQEIATTNPVATEWYGSVSATDLEDHEWEDL

SEQ ID NO: 122384 - protein, 33 aa, Artificial Sequence
  Description of Artificial Sequence: Synthetic polypeptide
MEHEIATVNPVATEQYGSVITNGLGGGETGGNT

SEQ ID NO: 122385 - protein, 35 aa, Artificial Sequence
  Description of Artificial Sequence: Synthetic polypeptide
DESEIRTTNPVATECWGSSYVSCINEPQDREGANG

SEQ ID NO: 122386 - protein, 33 aa, Artificial Sequence
  Description of Artificial Sequence: Synthetic polypeptide
MEHEIATVNPVATEQYGSVITNGLGGGQGENIT

SEQ ID NO: 122387 - protein, 33 aa, Artificial Sequence
  Description of Artificial Sequence: Synthetic polypeptide
DEQEIATTNPVATEWYGSVSATDLEEDHEGEDL

SEQ ID NO: 122388 - protein, 33 aa, Artificial Sequence
  Description of Artificial Sequence: Synthetic polypeptide
MEHEIATVNPVATEQYGSVITNGLGGGQGQNTQ

SEQ ID NO: 122389 - protein, 33 aa, Artificial Sequence
  Description of Artificial Sequence: Synthetic polypeptide
MEHEIATVNPVATEQYGSVITNGLGGGQQGGET

SEQ ID NO: 122390 - protein, 34 aa, Artificial Sequence
  Description of Artificial Sequence: Synthetic polypeptide
MEHEIATVNPVATEQYGSVITNNGLGGGQGGNNT

SEQ ID NO: 122391 - protein, 34 aa, Artificial Sequence
  Description of Artificial Sequence: Synthetic polypeptide
DEEEIRTTNPVATEQYGSVVVLTLGDEGGGQGFA

SEQ ID NO: 122392 - protein, 33 aa, Artificial Sequence
  Description of Artificial Sequence: Synthetic polypeptide
GESEIRTTNPVATECWGSVSCINEPQDREGECG

SEQ ID NO: 122393 - protein, 34 aa, Artificial Sequence
  Description of Artificial Sequence: Synthetic polypeptide
MEGEIRTTNPVATEQYGSVSVNEDVERGHDGDQE

SEQ ID NO: 122394 - protein, 33 aa, Artificial Sequence
  Description of Artificial Sequence: Synthetic polypeptide
DESEIRTTNPVATECWGHVNCINEPQDREGENG

SEQ ID NO: 122395 - protein, 32 aa, Artificial Sequence
  Description of Artificial Sequence: Synthetic polypeptide
DENEIATTNPVAYEQYGSCATNLADTPGDEAA

SEQ ID NO: 122396 - protein, 33 aa, Artificial Sequence
  Description of Artificial Sequence: Synthetic polypeptide
DEQEIATTNPVATEWWYGSVSATDLEDHEGEDL

SEQ ID NO: 122397 - protein, 33 aa, Artificial Sequence
  Description of Artificial Sequence: Synthetic polypeptide
DESEIRTTNPVATECWGHVSCIIEPQDREGENC

SEQ ID NO: 122398 - protein, 34 aa, Artificial Sequence
  Description of Artificial Sequence: Synthetic polypeptide
DESEIRTTNPVATECWGSSVSCINEPQDRERENG

SEQ ID NO: 122399 - protein, 33 aa, Artificial Sequence
  Description of Artificial Sequence: Synthetic polypeptide
DENEIATTNPVAYEQYGSCATNLADDPMDNMRH

SEQ ID NO: 122400 - protein, 36 aa, Artificial Sequence
  Description of Artificial Sequence: Synthetic polypeptide
MEGEIRTTNPVATEQYGSVSPTDNELDEKTNGDNDE

SEQ ID NO: 122401 - protein, 34 aa, Artificial Sequence
  Description of Artificial Sequence: Synthetic polypeptide
MEGEIRTTNPVATEQYGSVSPVDMDLNQEVNFHE

SEQ ID NO: 122402 - protein, 35 aa, Artificial Sequence
  Description of Artificial Sequence: Synthetic polypeptide
AEEEIRTTNPVATEQYGVVSTTQQNGDEQGTNEEQ

SEQ ID NO: 122403 - protein, 34 aa, Artificial Sequence
  Description of Artificial Sequence: Synthetic polypeptide
MEGEIRTTNPVATEQYGSVSTDTLSDPNYGQTHE

SEQ ID NO: 122404 - protein, 33 aa, Artificial Sequence
  Description of Artificial Sequence: Synthetic polypeptide
DEEEIACTNPVATEAYGSVAATNDTATPDGNEH

SEQ ID NO: 122405 - protein, 33 aa, Artificial Sequence
  Description of Artificial Sequence: Synthetic polypeptide
DEEEIACTNPVATELYGIVSCDGDLQCYANGNI

SEQ ID NO: 122406 - protein, 32 aa, Artificial Sequence
  Description of Artificial Sequence: Synthetic polypeptide
DENEIATTNPVAYEQYGCVATNLADDPGEDAH

SEQ ID NO: 122407 - protein, 35 aa, Artificial Sequence
  Description of Artificial Sequence: Synthetic polypeptide
MEGEIRTTNPVATEQYGSVSTPMNDLNNRDMFDHQ

SEQ ID NO: 122408 - protein, 36 aa, Artificial Sequence
  Description of Artificial Sequence: Synthetic polypeptide
MEGEIRTTNPVATEQYGSVSTPMNILNNTRGGDDSQ

SEQ ID NO: 122409 - protein, 35 aa, Artificial Sequence
  Description of Artificial Sequence: Synthetic polypeptide
MEGEIRTTNPVATEQYGSVSTVVASLDEQIPGSQL

SEQ ID NO: 122410 - protein, 35 aa, Artificial Sequence
  Description of Artificial Sequence: Synthetic polypeptide
MEGEIRTTNPVATEQYGSVSVAFNLQPRELQDDIV

SEQ ID NO: 122411 - protein, 37 aa, Artificial Sequence
  Description of Artificial Sequence: Synthetic polypeptide
AEEEIRTTNPVATEQYGVVSTTTNLQQAATEAGNEEG

SEQ ID NO: 122412 - protein, 33 aa, Artificial Sequence
  Description of Artificial Sequence: Synthetic polypeptide
DEQEIATTNPVATEYYGSLVSATDLEDHEGEDL

SEQ ID NO: 122413 - protein, 32 aa, Artificial Sequence
  Description of Artificial Sequence: Synthetic polypeptide
DEQEIATTNPVATEYYGSVDATDLEDHEGEDL

SEQ ID NO: 122414 - protein, 32 aa, Artificial Sequence
  Description of Artificial Sequence: Synthetic polypeptide
GEQEIATTNPAATEQYGSVSATDLEDHEGEDL

SEQ ID NO: 122415 - protein, 34 aa, Artificial Sequence
  Description of Artificial Sequence: Synthetic polypeptide
DESEIRTTNPVATECWGSTVAAINEQEREGENYG

SEQ ID NO: 122416 - protein, 35 aa, Artificial Sequence
  Description of Artificial Sequence: Synthetic polypeptide
AEEEIRTTNPVATESYGSVSTVVSNNNVEQGTNQE

SEQ ID NO: 122417 - protein, 30 aa, Artificial Sequence
  Description of Artificial Sequence: Synthetic polypeptide
MENEIATTNPVATECYGNVRSECLQHEEHL

SEQ ID NO: 122418 - protein, 34 aa, Artificial Sequence
  Description of Artificial Sequence: Synthetic polypeptide
DESEIRTTNPVATECWGSTVSAENEPQEREGEPG

SEQ ID NO: 122419 - protein, 30 aa, Artificial Sequence
  Description of Artificial Sequence: Synthetic polypeptide
MENEIATTNPVATECYGQVSEWLQHEEELN

SEQ ID NO: 122420 - protein, 34 aa, Artificial Sequence
  Description of Artificial Sequence: Synthetic polypeptide
MENEICTTNPVATEQYGSVTTGGQLQEEMGNGLE

SEQ ID NO: 122421 - protein, 30 aa, Artificial Sequence
  Description of Artificial Sequence: Synthetic polypeptide
DENEIRTTNPCATEQWGDVSCIEMNSAGDA

SEQ ID NO: 122422 - protein, 34 aa, Artificial Sequence
  Description of Artificial Sequence: Synthetic polypeptide
DESEIRTTNPVATECWGHSVPCINKPQDREGENG

SEQ ID NO: 122423 - protein, 35 aa, Artificial Sequence
  Description of Artificial Sequence: Synthetic polypeptide
AEEEIRTTNPVATEQYGVVSTTQNQQQANNNNTTD

SEQ ID NO: 122424 - protein, 33 aa, Artificial Sequence
  Description of Artificial Sequence: Synthetic polypeptide
DEQEIATTNPVATGQYGSVSATDLEDHEGEDLS

SEQ ID NO: 122425 - protein, 35 aa, Artificial Sequence
  Description of Artificial Sequence: Synthetic polypeptide
DESEIRTTNPVATECWGHSAVSCINEPQDREGENG

SEQ ID NO: 122426 - protein, 35 aa, Artificial Sequence
  Description of Artificial Sequence: Synthetic polypeptide
AEEEIRTTNPVATEQYGVVSTTQNNNVEQGTNQEE

SEQ ID NO: 122427 - protein, 36 aa, Artificial Sequence
  Description of Artificial Sequence: Synthetic polypeptide
AEEEIRTTNPVATEQYGVVSTTQNNNDEQIGTNNET

SEQ ID NO: 122428 - protein, 35 aa, Artificial Sequence
  Description of Artificial Sequence: Synthetic polypeptide
AEEEIRTTNPVATESYGSVSTVVSTNNVEQGNNQQ

SEQ ID NO: 122429 - protein, 34 aa, Artificial Sequence
  Description of Artificial Sequence: Synthetic polypeptide
DESEIRTTNPVATECWGHCVSCINEPQDREGENG

SEQ ID NO: 122430 - protein, 30 aa, Artificial Sequence
  Description of Artificial Sequence: Synthetic polypeptide
MENEIRTTNPVATEQWGDVSEIEMRAAEDA

SEQ ID NO: 122431 - protein, 34 aa, Artificial Sequence
  Description of Artificial Sequence: Synthetic polypeptide
MENEIRTTNPVATEFYGSVNSVNGFGDEQGGNED

SEQ ID NO: 122432 - protein, 36 aa, Artificial Sequence
  Description of Artificial Sequence: Synthetic polypeptide
GEEEIRTTNPVATEQYGSVSSTTPAGPNMRNGMNPV

SEQ ID NO: 122433 - protein, 32 aa, Artificial Sequence
  Description of Artificial Sequence: Synthetic polypeptide
MENEIACTNPVATEQYGEAVSHEVLQRGDGQQ

SEQ ID NO: 122434 - protein, 34 aa, Artificial Sequence
  Description of Artificial Sequence: Synthetic polypeptide
DESEIRTTNPVATECWGSTSNCINEPQERKGENG

SEQ ID NO: 122435 - protein, 35 aa, Artificial Sequence
  Description of Artificial Sequence: Synthetic polypeptide
DEEEIRTTNPVATEQYGSVSTPGHQQEQIVPEQVD

SEQ ID NO: 122436 - protein, 30 aa, Artificial Sequence
  Description of Artificial Sequence: Synthetic polypeptide
DENEIRTTNCVATEQWGDVSEINMNAAEDA

SEQ ID NO: 122437 - protein, 35 aa, Artificial Sequence
  Description of Artificial Sequence: Synthetic polypeptide
AEEEIRTTNPVATESYGSVSTVVSNNNVEEGTNSD

SEQ ID NO: 122438 - protein, 33 aa, Artificial Sequence
  Description of Artificial Sequence: Synthetic polypeptide
DEQEIATTNPVATEYYGSVSATDLEDHEGEDLG

SEQ ID NO: 122439 - protein, 35 aa, Artificial Sequence
  Description of Artificial Sequence: Synthetic polypeptide
DESEIRTTNPVATECWGHSVSRCINEPQDREGENG

SEQ ID NO: 122440 - protein, 35 aa, Artificial Sequence
  Description of Artificial Sequence: Synthetic polypeptide
AEEEIRTTNPVATESYGSVSTVVSNNNVEEGTNVM

SEQ ID NO: 122441 - protein, 35 aa, Artificial Sequence
  Description of Artificial Sequence: Synthetic polypeptide
DEQEIATTNPVATEQYGSVSTTGDLQEDQEGGEDT

SEQ ID NO: 122442 - protein, 34 aa, Artificial Sequence
  Description of Artificial Sequence: Synthetic polypeptide
DESEIRTTNPVATECWGSTSNCINEPQERKGENI

SEQ ID NO: 122443 - protein, 34 aa, Artificial Sequence
  Description of Artificial Sequence: Synthetic polypeptide
CEEEIATTNPVATEQYGSVCSANPPAQEHKGTEM

SEQ ID NO: 122444 - protein, 34 aa, Artificial Sequence
  Description of Artificial Sequence: Synthetic polypeptide
DEQEIATTNPVATEQYGSVSTTGDGEDQEGEGDG

SEQ ID NO: 122445 - protein, 30 aa, Artificial Sequence
  Description of Artificial Sequence: Synthetic polypeptide
MENEIACTNPVATEQFGEASEVLQRGDGQM

SEQ ID NO: 122446 - protein, 36 aa, Artificial Sequence
  Description of Artificial Sequence: Synthetic polypeptide
AEEEIRTTNPVATEQYGVVSTTQQLQQEISTENGNE

SEQ ID NO: 122447 - protein, 34 aa, Artificial Sequence
  Description of Artificial Sequence: Synthetic polypeptide
AEEEIRTTNPVATESYGSVSTVVSNNNVEEGTVQ

SEQ ID NO: 122448 - protein, 35 aa, Artificial Sequence
  Description of Artificial Sequence: Synthetic polypeptide
DESEIRTTNPVATECWGHSVSCINEPQDREGENGM

SEQ ID NO: 122449 - protein, 34 aa, Artificial Sequence
  Description of Artificial Sequence: Synthetic polypeptide
DESEIRTTNPVATECWGSTSCINREPQDREGENG

SEQ ID NO: 122450 - protein, 31 aa, Artificial Sequence
  Description of Artificial Sequence: Synthetic polypeptide
MENEIACTNPVATEQYGEASSEVLQRGDGQD

SEQ ID NO: 122451 - protein, 34 aa, Artificial Sequence
  Description of Artificial Sequence: Synthetic polypeptide
GEEEIRTTNPVAYEAYGSVVPSTNSHQELTEGKD

SEQ ID NO: 122452 - protein, 34 aa, Artificial Sequence
  Description of Artificial Sequence: Synthetic polypeptide
AEEEIRTTNPVAYEQWGSYWSTINPNQDEGNNNP

SEQ ID NO: 122453 - protein, 32 aa, Artificial Sequence
  Description of Artificial Sequence: Synthetic polypeptide
DEQEIATTNPVATQQYGSVSATDPEDHEGEDL

SEQ ID NO: 122454 - protein, 29 aa, Artificial Sequence
  Description of Artificial Sequence: Synthetic peptide
GEEEIATTNPVATEQYGEAPEVCPQHEEK

SEQ ID NO: 122455 - protein, 34 aa, Artificial Sequence
  Description of Artificial Sequence: Synthetic polypeptide
DESEIRTTNPVATECWGSTVSCINEPQDREGEIG

SEQ ID NO: 122456 - protein, 33 aa, Artificial Sequence
  Description of Artificial Sequence: Synthetic polypeptide
NDEEIRTTNPVATEQYGVVCSWELNQHFNSEQA

SEQ ID NO: 122457 - protein, 33 aa, Artificial Sequence
  Description of Artificial Sequence: Synthetic polypeptide
DEEEIACTNPVATEQWGSVSMSGNGQPAGVGPL

SEQ ID NO: 122458 - protein, 34 aa, Artificial Sequence
  Description of Artificial Sequence: Synthetic polypeptide
DEAEIRTTNPVAYEQYGTVATGNNLGNQPSMDNT

SEQ ID NO: 122459 - protein, 32 aa, Artificial Sequence
  Description of Artificial Sequence: Synthetic polypeptide
DEQEIATTNPVAWEQYGSVSATDLEHHEDEDL

SEQ ID NO: 122460 - protein, 35 aa, Artificial Sequence
  Description of Artificial Sequence: Synthetic polypeptide
DENEIATTNPVATEQYGSVCSPVNLPLDSGEENHH

SEQ ID NO: 122461 - protein, 34 aa, Artificial Sequence
  Description of Artificial Sequence: Synthetic polypeptide
FEETIRTTNPVATEQWGAVCETVGNQLVIGVNRE

SEQ ID NO: 122462 - protein, 33 aa, Artificial Sequence
  Description of Artificial Sequence: Synthetic polypeptide
NDEEIRTTNPVATEQYGVVCSWNHQENFGSQQA

SEQ ID NO: 122463 - protein, 34 aa, Artificial Sequence
  Description of Artificial Sequence: Synthetic polypeptide
DEEEIRTTNPVATEQYGSVQTAGVSVQAFDSDIV

SEQ ID NO: 122464 - protein, 35 aa, Artificial Sequence
  Description of Artificial Sequence: Synthetic polypeptide
DENEIATTNPVATEQYGSVCSPTNGHVEDDGGQRN

SEQ ID NO: 122465 - protein, 32 aa, Artificial Sequence
  Description of Artificial Sequence: Synthetic polypeptide
DEQEIATTNPVAWEQYKSVSATDLEDHEGEDL

SEQ ID NO: 122466 - protein, 32 aa, Artificial Sequence
  Description of Artificial Sequence: Synthetic polypeptide
DEQEIATTNPVAWEWYGSVSATDLEDHEGEDL

SEQ ID NO: 122467 - protein, 30 aa, Artificial Sequence
  Description of Artificial Sequence: Synthetic polypeptide
AEEEIRTTNPVAYEHWGCFCINDDQRGDAH

SEQ ID NO: 122468 - protein, 31 aa, Artificial Sequence
  Description of Artificial Sequence: Synthetic polypeptide
AEEEIRTTNPVAYEHWGCFCINDDQRGQNAQ

SEQ ID NO: 122469 - protein, 32 aa, Artificial Sequence
  Description of Artificial Sequence: Synthetic polypeptide
AEEEIRTTNPVAYEHWGCFCINDLGQRDGNTA

SEQ ID NO: 122470 - protein, 34 aa, Artificial Sequence
  Description of Artificial Sequence: Synthetic polypeptide
DEEEIRTTNPVATEQYGSVQTCTGTIVPISVNEF

SEQ ID NO: 122471 - protein, 32 aa, Artificial Sequence
  Description of Artificial Sequence: Synthetic polypeptide
DEEEIACTNPVATEQWGSVSMSGEGGQPGPQF

SEQ ID NO: 122472 - protein, 33 aa, Artificial Sequence
  Description of Artificial Sequence: Synthetic polypeptide
NDEEIRTTNPVATEQYGVVCSSGEDQNFGSNQS

SEQ ID NO: 122473 - protein, 34 aa, Artificial Sequence
  Description of Artificial Sequence: Synthetic polypeptide
DENEIATTNPVATEQYGSVPCWDNHGQQRQGGDG

SEQ ID NO: 122474 - protein, 32 aa, Artificial Sequence
  Description of Artificial Sequence: Synthetic polypeptide
DEQEIATTNPVATYQYGTVSATDLEDHEGEDL

SEQ ID NO: 122475 - protein, 32 aa, Artificial Sequence
  Description of Artificial Sequence: Synthetic polypeptide
DEAEIRTTNPVAYEQYGTVYCEDLHQENGDSN

SEQ ID NO: 122476 - protein, 36 aa, Artificial Sequence
  Description of Artificial Sequence: Synthetic polypeptide
AEEEIRTTNPVATEQYGVVSTTNNQQQQQNGNNDET

SEQ ID NO: 122477 - protein, 33 aa, Artificial Sequence
  Description of Artificial Sequence: Synthetic polypeptide
FENEIRTTNPVATEQYGSVSPWNLNELFEDTQI

SEQ ID NO: 122478 - protein, 34 aa, Artificial Sequence
  Description of Artificial Sequence: Synthetic polypeptide
NDEEIRTTNPVATEQYGCVCSWEELNQHFGSNQA

SEQ ID NO: 122479 - protein, 34 aa, Artificial Sequence
  Description of Artificial Sequence: Synthetic polypeptide
DEQEIATTNPVATEQYGSVSTTDHNEDHFGSEDL

SEQ ID NO: 122480 - protein, 32 aa, Artificial Sequence
  Description of Artificial Sequence: Synthetic polypeptide
DEQEIATTNPVAWEQYGAVSATDLEDHEGEDL

SEQ ID NO: 122481 - protein, 34 aa, Artificial Sequence
  Description of Artificial Sequence: Synthetic polypeptide
DENEIATTNPVATEQYGSVCSPTNGHVDDPGQQN

SEQ ID NO: 122482 - protein, 32 aa, Artificial Sequence
  Description of Artificial Sequence: Synthetic polypeptide
FENEIRCTNPVATEQYGCVSWPFLTRIQENDQ

SEQ ID NO: 122483 - protein, 34 aa, Artificial Sequence
  Description of Artificial Sequence: Synthetic polypeptide
DESEIRTTNPVATECWGSTVSCIDEPQDRKGENG

SEQ ID NO: 122484 - protein, 32 aa, Artificial Sequence
  Description of Artificial Sequence: Synthetic polypeptide
DESEIRTTNPVATECWGEVPCINEPQDREGEG

SEQ ID NO: 122485 - protein, 35 aa, Artificial Sequence
  Description of Artificial Sequence: Synthetic polypeptide
FEHEIRTTNPVAYEQYGQSIVSDYNDLEQPGIERS

SEQ ID NO: 122486 - protein, 34 aa, Artificial Sequence
  Description of Artificial Sequence: Synthetic polypeptide
FEGEIRTTNPVATEQYGSVSWTWPLHQIDTTESQ

SEQ ID NO: 122487 - protein, 35 aa, Artificial Sequence
  Description of Artificial Sequence: Synthetic polypeptide
DESEIRTTNPVATECWGESVSCINEPQDREGENGG

SEQ ID NO: 122488 - protein, 33 aa, Artificial Sequence
  Description of Artificial Sequence: Synthetic polypeptide
NDEEIRTTNPVATEQYGVVCSNWNHQNFGSQQS

SEQ ID NO: 122489 - protein, 34 aa, Artificial Sequence
  Description of Artificial Sequence: Synthetic polypeptide
NDEEIRTTNPVATEQYGVVCSSELNQENFGSNQS

SEQ ID NO: 122490 - protein, 36 aa, Artificial Sequence
  Description of Artificial Sequence: Synthetic polypeptide
AEEEIRTTNPVATEQYGVVSTTNNQQQLNGGNQDEE

SEQ ID NO: 122491 - protein, 34 aa, Artificial Sequence
  Description of Artificial Sequence: Synthetic polypeptide
DESEIRTTNPVATECWGENVSCINEPQDREGENG

SEQ ID NO: 122492 - protein, 35 aa, Artificial Sequence
  Description of Artificial Sequence: Synthetic polypeptide
DENEIATTNPVATEQYGSVCSPTGNNNDQTAGGMD

SEQ ID NO: 122493 - protein, 34 aa, Artificial Sequence
  Description of Artificial Sequence: Synthetic polypeptide
DEAEIRTTNPVAYEQYGTVATGNLGNQPQMDNET

SEQ ID NO: 122494 - protein, 35 aa, Artificial Sequence
  Description of Artificial Sequence: Synthetic polypeptide
DEEEIRTTNPVATEQYGSVYPNLGLSQEVPFMVVA

SEQ ID NO: 122495 - protein, 32 aa, Artificial Sequence
  Description of Artificial Sequence: Synthetic polypeptide
FEEEIRTTNPVATSRYGCVGATVALDQGGEQG

SEQ ID NO: 122496 - protein, 36 aa, Artificial Sequence
  Description of Artificial Sequence: Synthetic polypeptide
AEEEIRTTNPVATEQYGVVSTTNNQNQQGNGNNQQD

SEQ ID NO: 122497 - protein, 34 aa, Artificial Sequence
  Description of Artificial Sequence: Synthetic polypeptide
DEQEIATTNPVAYECWGSVATGNMLGDQQGTNPR

SEQ ID NO: 122498 - protein, 34 aa, Artificial Sequence
  Description of Artificial Sequence: Synthetic polypeptide
DENEIATTNPVATEQYGSVCSMPTGDNQMPDSRM

SEQ ID NO: 122499 - protein, 36 aa, Artificial Sequence
  Description of Artificial Sequence: Synthetic polypeptide
AEEEIRTTNPVATEQYGVVSTTNNQLTNSEEGTTNY

SEQ ID NO: 122500 - protein, 35 aa, Artificial Sequence
  Description of Artificial Sequence: Synthetic polypeptide
FEEEIRTTNPVATEVYGSVVGFDGNNLQGGGEGND

SEQ ID NO: 122501 - protein, 36 aa, Artificial Sequence
  Description of Artificial Sequence: Synthetic polypeptide
FEEEIRTTNPVAYEQYGQSIVSNQYNDLEQPGIERW

SEQ ID NO: 122502 - protein, 33 aa, Artificial Sequence
  Description of Artificial Sequence: Synthetic polypeptide
DEQEIATTNPVAYECWGSVATNLQGDAGNGSEN

SEQ ID NO: 122503 - protein, 33 aa, Artificial Sequence
  Description of Artificial Sequence: Synthetic polypeptide
AEEEIRTTNPVAYEQWGSYWSTINPNNDSGNND

SEQ ID NO: 122504 - protein, 36 aa, Artificial Sequence
  Description of Artificial Sequence: Synthetic polypeptide
DEEEIRTTNPVATEQYGSVSDNLGLSQAQPFVVQVN

SEQ ID NO: 122505 - protein, 32 aa, Artificial Sequence
  Description of Artificial Sequence: Synthetic polypeptide
NDENEIATTNPVAYEQWGSVAWTDNHQEQGSV

SEQ ID NO: 122506 - protein, 36 aa, Artificial Sequence
  Description of Artificial Sequence: Synthetic polypeptide
DENEIATTNPVATEQYGSVCSATLALQNHSDDDNRH

SEQ ID NO: 122507 - protein, 37 aa, Artificial Sequence
  Description of Artificial Sequence: Synthetic polypeptide
AEEEIRTTNPVATEQYGVVSTTNNQLQQGTNNQGNDE

SEQ ID NO: 122508 - protein, 31 aa, Artificial Sequence
  Description of Artificial Sequence: Synthetic polypeptide
DENEIRTTNPIATECYGATVSNACLAPGEYI

SEQ ID NO: 122509 - protein, 31 aa, Artificial Sequence
  Description of Artificial Sequence: Synthetic polypeptide
DENEIRTTNPIATECYGATVSNECLAPGEYI

SEQ ID NO: 122510 - protein, 37 aa, Artificial Sequence
  Description of Artificial Sequence: Synthetic polypeptide
DEEEIRTTNPVATEQYGSVQSVTQYLQPMLEGVEGED

SEQ ID NO: 122511 - protein, 33 aa, Artificial Sequence
  Description of Artificial Sequence: Synthetic polypeptide
DEQEIATTNPVATYQYGSVSATDLGEDHEGEDL

SEQ ID NO: 122512 - protein, 36 aa, Artificial Sequence
  Description of Artificial Sequence: Synthetic polypeptide
FEEEIRTTNPVAYEQYGQSVSPVTNGYLQQRTVEQT

SEQ ID NO: 122513 - protein, 35 aa, Artificial Sequence
  Description of Artificial Sequence: Synthetic polypeptide
DEEEIRTTNPVATEQYGSVQSWSLNMIEVEQVDRD

SEQ ID NO: 122514 - protein, 30 aa, Artificial Sequence
  Description of Artificial Sequence: Synthetic polypeptide
DESEIRTTNPVATECWGEASCIVCQHEGEK

SEQ ID NO: 122515 - protein, 35 aa, Artificial Sequence
  Description of Artificial Sequence: Synthetic polypeptide
DEEEIRTTNPVATEQYGSVSDGNGDEDTEEGGEGV

SEQ ID NO: 122516 - protein, 36 aa, Artificial Sequence
  Description of Artificial Sequence: Synthetic polypeptide
DENEIATTNPVATEQYGSVCSPTGNNNDQTAAGNEE

SEQ ID NO: 122517 - protein, 35 aa, Artificial Sequence
  Description of Artificial Sequence: Synthetic polypeptide
DESEIRTTNPVATECWGSTVSNCENEPQDREGENG

SEQ ID NO: 122518 - protein, 36 aa, Artificial Sequence
  Description of Artificial Sequence: Synthetic polypeptide
DENEIATTNPVATEQYGSVCSPTGNNNDQTAAGNED

SEQ ID NO: 122519 - protein, 31 aa, Artificial Sequence
  Description of Artificial Sequence: Synthetic polypeptide
DESEIRTTNPVATECWGEASCINCQDHEGEK

SEQ ID NO: 122520 - protein, 36 aa, Artificial Sequence
  Description of Artificial Sequence: Synthetic polypeptide
AEEEIRTTNPVATEQYGVVSTTNNQQNQQGNGNNQE

SEQ ID NO: 122521 - protein, 34 aa, Artificial Sequence
  Description of Artificial Sequence: Synthetic polypeptide
DESEIRTTNPVATECWGDVSWCINEPQDREGENG

SEQ ID NO: 122522 - protein, 33 aa, Artificial Sequence
  Description of Artificial Sequence: Synthetic polypeptide
DESEIRTTNPVATECWGEASCINCPQDREGENK

SEQ ID NO: 122523 - protein, 32 aa, Artificial Sequence
  Description of Artificial Sequence: Synthetic polypeptide
DEEEIACTNPVATEQWGSVSQGPPQEHPMGMH

SEQ ID NO: 122524 - protein, 32 aa, Artificial Sequence
  Description of Artificial Sequence: Synthetic polypeptide
DESEIRTTNPVATECWGEAPCNCPQDREGENK

SEQ ID NO: 122525 - protein, 32 aa, Artificial Sequence
  Description of Artificial Sequence: Synthetic polypeptide
AEEEIRTTNPVAYEHWGCFSWINDLQQNGVGR

SEQ ID NO: 122526 - protein, 33 aa, Artificial Sequence
  Description of Artificial Sequence: Synthetic polypeptide
AEEEIRTTNPVAYEHWGCFSWINDLTQHRGNAN

SEQ ID NO: 122527 - protein, 31 aa, Artificial Sequence
  Description of Artificial Sequence: Synthetic polypeptide
DENEIRTTNPIATECWGAVWSEDLQEHKGPL

SEQ ID NO: 122528 - protein, 35 aa, Artificial Sequence
  Description of Artificial Sequence: Synthetic polypeptide
FEEEIRTTNPVFTDEQYGNAVSQDMNLTQYGNPGP

SEQ ID NO: 122529 - protein, 35 aa, Artificial Sequence
  Description of Artificial Sequence: Synthetic polypeptide
DEEEIRTTNPVATEQYGSVYPNANIVHQSINPINN

SEQ ID NO: 122530 - protein, 33 aa, Artificial Sequence
  Description of Artificial Sequence: Synthetic polypeptide
DESEIRTTNPVATECWGEASCINCPQDREGENG

SEQ ID NO: 122531 - protein, 32 aa, Artificial Sequence
  Description of Artificial Sequence: Synthetic polypeptide
DEQEIATTNPVATRQYGSVSATDIEDHEGEDL

SEQ ID NO: 122532 - protein, 36 aa, Artificial Sequence
  Description of Artificial Sequence: Synthetic polypeptide
DEEEIRTTNPVATEQYGSVSDCPNGVQMQETVEGED

SEQ ID NO: 122533 - protein, 33 aa, Artificial Sequence
  Description of Artificial Sequence: Synthetic polypeptide
DEEEIRTTNPVATEQYGSVQTDTTVPTFSEEEW

SEQ ID NO: 122534 - protein, 34 aa, Artificial Sequence
  Description of Artificial Sequence: Synthetic polypeptide
DENEIATTNPVATEQYGSVSTAIPGPDENNGNPM

SEQ ID NO: 122535 - protein, 35 aa, Artificial Sequence
  Description of Artificial Sequence: Synthetic polypeptide
DESEIRTTNPVATECWGFSVSCINQEPQDREGENG

SEQ ID NO: 122536 - protein, 33 aa, Artificial Sequence
  Description of Artificial Sequence: Synthetic polypeptide
DEQEIATTNPVATRQYGSVSATIDLEDHEGEDS

SEQ ID NO: 122537 - protein, 34 aa, Artificial Sequence
  Description of Artificial Sequence: Synthetic polypeptide
DEEEIACTNPVATEQWGCVVAMTNLNRDGMEDRH

SEQ ID NO: 122538 - protein, 35 aa, Artificial Sequence
  Description of Artificial Sequence: Synthetic polypeptide
MESEIRTTNPVATEQYGSVSPTSYLDLSIGENYQE

SEQ ID NO: 122539 - protein, 32 aa, Artificial Sequence
  Description of Artificial Sequence: Synthetic polypeptide
DECEISTTNPVAYEQWGTISHTDNHQREGADN

SEQ ID NO: 122540 - protein, 34 aa, Artificial Sequence
  Description of Artificial Sequence: Synthetic polypeptide
DESEIRTTNPVATECWGSTVSCENEPQEREGEPG

SEQ ID NO: 122541 - protein, 35 aa, Artificial Sequence
  Description of Artificial Sequence: Synthetic polypeptide
DEEEIRTTNPVATEQYGSVSCWVDLNQPNSQFDEQ

SEQ ID NO: 122542 - protein, 35 aa, Artificial Sequence
  Description of Artificial Sequence: Synthetic polypeptide
MESEIRTTNPVATEQYGSVSWPVGLDQFDNNQERG

SEQ ID NO: 122543 - protein, 34 aa, Artificial Sequence
  Description of Artificial Sequence: Synthetic polypeptide
DESEIRTTNPVATECWGFSVECINEPQDREGENG

SEQ ID NO: 122544 - protein, 36 aa, Artificial Sequence
  Description of Artificial Sequence: Synthetic polypeptide
DENEIATTNPVATEQYGSVSPTPAGLQARAPDPGRE

SEQ ID NO: 122545 - protein, 33 aa, Artificial Sequence
  Description of Artificial Sequence: Synthetic polypeptide
DEQEIATTNPVATSQYGSVSATDLEDHEGQEDL

SEQ ID NO: 122546 - protein, 33 aa, Artificial Sequence
  Description of Artificial Sequence: Synthetic polypeptide
DEQEIATTNPVATSQYGSVSATDTLEDHEGEDL

SEQ ID NO: 122547 - protein, 33 aa, Artificial Sequence
  Description of Artificial Sequence: Synthetic polypeptide
FVEELIGTTNNEVATEVKYGSASTRNSIMRGNR

SEQ ID NO: 122548 - protein, 33 aa, Artificial Sequence
  Description of Artificial Sequence: Synthetic polypeptide
DENEIATTNPVATEQYGSVSNWDLEEHEGSEDL

SEQ ID NO: 122549 - protein, 35 aa, Artificial Sequence
  Description of Artificial Sequence: Synthetic polypeptide
DESEIRTTNPVATECWGSTVSCCPNHSQNREGENT

SEQ ID NO: 122550 - protein, 34 aa, Artificial Sequence
  Description of Artificial Sequence: Synthetic polypeptide
MESEIRTTNPVATEQYGSVSPDSNLDFSITENYQ

SEQ ID NO: 122551 - protein, 35 aa, Artificial Sequence
  Description of Artificial Sequence: Synthetic polypeptide
GEEEIATTNPVATEAWGSVCSKTNDDLDQRNNNDG

SEQ ID NO: 122552 - protein, 35 aa, Artificial Sequence
  Description of Artificial Sequence: Synthetic polypeptide
MESEIRTTNPVATEQYGSVSPASNLDLSIGENYQG

SEQ ID NO: 122553 - protein, 29 aa, Artificial Sequence
  Description of Artificial Sequence: Synthetic peptide
MESEICSTNPVCTEIYGVVNNSTLQNGDI

SEQ ID NO: 122554 - protein, 33 aa, Artificial Sequence
  Description of Artificial Sequence: Synthetic polypeptide
MESEILTTNPVATECWGSVSCINEPQKREGENG

SEQ ID NO: 122555 - protein, 32 aa, Artificial Sequence
  Description of Artificial Sequence: Synthetic polypeptide
DEAEIRTTNGVAYCQYGCVCSNTELQHGSDQA

SEQ ID NO: 122556 - protein, 30 aa, Artificial Sequence
  Description of Artificial Sequence: Synthetic polypeptide
DENEIATTNPVATEQYGTAPMEDIQQNGEH

SEQ ID NO: 122557 - protein, 33 aa, Artificial Sequence
  Description of Artificial Sequence: Synthetic polypeptide
MESEIRTTNPVATECWGDVSCINEPQDREGENG

SEQ ID NO: 122558 - protein, 35 aa, Artificial Sequence
  Description of Artificial Sequence: Synthetic polypeptide
DENEIATTNPVATEQYGSVVCSVGNLDNNAGDSRM

SEQ ID NO: 122559 - protein, 34 aa, Artificial Sequence
  Description of Artificial Sequence: Synthetic polypeptide
DEAEIRTTNGVAYCGYGSVSTLNLEQQRGGEDKY

SEQ ID NO: 122560 - protein, 33 aa, Artificial Sequence
  Description of Artificial Sequence: Synthetic polypeptide
MESEIRTTNPVATETWGSVDCINDPQDREGNNG

SEQ ID NO: 122561 - protein, 28 aa, Artificial Sequence
  Description of Artificial Sequence: Synthetic peptide
GEEEIATTNPVATEQYGEAPEVCLHEEK

SEQ ID NO: 122562 - protein, 32 aa, Artificial Sequence
  Description of Artificial Sequence: Synthetic polypeptide
DECEISTTNPVAYEQWGTISHTDNHQREGTQG

SEQ ID NO: 122563 - protein, 33 aa, Artificial Sequence
  Description of Artificial Sequence: Synthetic polypeptide
DEAEIRTTNGVAYCGYGSCSTLNELEQRGEDKY

SEQ ID NO: 122564 - protein, 33 aa, Artificial Sequence
  Description of Artificial Sequence: Synthetic polypeptide
MESEIRTTNPVATECWGSVSCINEPQSSDGENE

SEQ ID NO: 122565 - protein, 33 aa, Artificial Sequence
  Description of Artificial Sequence: Synthetic polypeptide
MESEIRTTNPVATEQYGCVQTEVPNDSRGTQME

SEQ ID NO: 122566 - protein, 34 aa, Artificial Sequence
  Description of Artificial Sequence: Synthetic polypeptide
MESEIRTTNPVATEQYGSSSTDPLVMSFQELNQS

SEQ ID NO: 122567 - protein, 35 aa, Artificial Sequence
  Description of Artificial Sequence: Synthetic polypeptide
MESEIRTTNPVATEQYGSVFSPTNLLETNEENIQG

SEQ ID NO: 122568 - protein, 35 aa, Artificial Sequence
  Description of Artificial Sequence: Synthetic polypeptide
MESEIRTTNPVATEQYGSVSNTTNLPHFIPENDQG

SEQ ID NO: 122569 - protein, 33 aa, Artificial Sequence
  Description of Artificial Sequence: Synthetic polypeptide
DEAEIRTTNGVAYCGYGSVSTLMLEQRGLEDKY

SEQ ID NO: 122570 - protein, 33 aa, Artificial Sequence
  Description of Artificial Sequence: Synthetic polypeptide
MESEIRTTNPVATETWGSVVCINEPQDREGENG

SEQ ID NO: 122571 - protein, 33 aa, Artificial Sequence
  Description of Artificial Sequence: Synthetic polypeptide
AEEEIRTTNPVAWEEYGCISCINLSTRGGNNYH

SEQ ID NO: 122572 - protein, 33 aa, Artificial Sequence
  Description of Artificial Sequence: Synthetic polypeptide
MESEIRTTNPVATRCWGSVSCINEPQDREGENG

SEQ ID NO: 122573 - protein, 33 aa, Artificial Sequence
  Description of Artificial Sequence: Synthetic polypeptide
DEQEIATTNPVATWFQYGSVSATDLEDHEGEDL

SEQ ID NO: 122574 - protein, 34 aa, Artificial Sequence
  Description of Artificial Sequence: Synthetic polypeptide
DECEISTTNPVATEIYGSVCSNWNDGQDREGDTE

SEQ ID NO: 122575 - protein, 36 aa, Artificial Sequence
  Description of Artificial Sequence: Synthetic polypeptide
DEEEIRTTNPVATEQYGSVQTLDTVLEGARGQMLLP

SEQ ID NO: 122576 - protein, 35 aa, Artificial Sequence
  Description of Artificial Sequence: Synthetic polypeptide
AEEEIRTTNPVATEQYGVVSTTNQLGNNNEENNAD

SEQ ID NO: 122577 - protein, 32 aa, Artificial Sequence
  Description of Artificial Sequence: Synthetic polypeptide
DEQEIATTNPVATWQYGSVKATDLEDHEGEDL

SEQ ID NO: 122578 - protein, 33 aa, Artificial Sequence
  Description of Artificial Sequence: Synthetic polypeptide
DEEEIACTNPVATEQWGSVATNLPETEPGGETK

SEQ ID NO: 122579 - protein, 33 aa, Artificial Sequence
  Description of Artificial Sequence: Synthetic polypeptide
DEQEIATTNPVATWQYGSVSATDHLEDHEGEDL

SEQ ID NO: 122580 - protein, 33 aa, Artificial Sequence
  Description of Artificial Sequence: Synthetic polypeptide
DECEISTTNPVAYEGWGSVATDNGNQMNDGNNR

SEQ ID NO: 122581 - protein, 36 aa, Artificial Sequence
  Description of Artificial Sequence: Synthetic polypeptide
DEEEIRTTNPVATEQYGSVYLVQNNDEQRINPVLEV

SEQ ID NO: 122582 - protein, 34 aa, Artificial Sequence
  Description of Artificial Sequence: Synthetic polypeptide
DEAEIRTTNCVAYCAYGSTVPSTNELSQRTGGDD

SEQ ID NO: 122583 - protein, 34 aa, Artificial Sequence
  Description of Artificial Sequence: Synthetic polypeptide
FEQEIRTTNPVATEQYGSVNMTGDENDEGGNQEA

SEQ ID NO: 122584 - protein, 33 aa, Artificial Sequence
  Description of Artificial Sequence: Synthetic polypeptide
DENEIATTNPVATEQYGSVSAPPQANDNPGGQP

SEQ ID NO: 122585 - protein, 33 aa, Artificial Sequence
  Description of Artificial Sequence: Synthetic polypeptide
DESEIRTTNPVATECWGEVSCINEPQDREGECG

SEQ ID NO: 122586 - protein, 34 aa, Artificial Sequence
  Description of Artificial Sequence: Synthetic polypeptide
DEEEIRTTNPVATEQYGSVSDAVNSGEMIDLSQE

SEQ ID NO: 122587 - protein, 36 aa, Artificial Sequence
  Description of Artificial Sequence: Synthetic polypeptide
DEEEIRTTNPVATEQYGSVYNTCMNSQAETVNMQQA

SEQ ID NO: 122588 - protein, 35 aa, Artificial Sequence
  Description of Artificial Sequence: Synthetic polypeptide
FEQEIRTTNPVATDQYGSVSTTDGDLGQRNQGTGG

SEQ ID NO: 122589 - protein, 35 aa, Artificial Sequence
  Description of Artificial Sequence: Synthetic polypeptide
DEEEIRTTNPVATEQYGSVQTESYVSMSEGVSERE

SEQ ID NO: 122590 - protein, 32 aa, Artificial Sequence
  Description of Artificial Sequence: Synthetic polypeptide
FEQEIAVTNPVATEQYGSVSATDLEDHEGEDL

SEQ ID NO: 122591 - protein, 34 aa, Artificial Sequence
  Description of Artificial Sequence: Synthetic polypeptide
FESEIRTTNPVATECWGSVSCINEPQDREGENHG

SEQ ID NO: 122592 - protein, 36 aa, Artificial Sequence
  Description of Artificial Sequence: Synthetic polypeptide
DEEEIRTTNPVATEQYGSVYLTENQHQPQIQTINDD

SEQ ID NO: 122593 - protein, 33 aa, Artificial Sequence
  Description of Artificial Sequence: Synthetic polypeptide
MESEIRTTNPVMTECWGSVSCINEPQDRKGENG

SEQ ID NO: 122594 - protein, 33 aa, Artificial Sequence
  Description of Artificial Sequence: Synthetic polypeptide
MESEMRTTNPVATECWGSVSCINEPQDREGENG

SEQ ID NO: 122595 - protein, 33 aa, Artificial Sequence
  Description of Artificial Sequence: Synthetic polypeptide
FETEIKTTNPVATEQYGSVSTDGEDEGENVEEI

SEQ ID NO: 122596 - protein, 33 aa, Artificial Sequence
  Description of Artificial Sequence: Synthetic polypeptide
MNEEIRTTNPVATEQYGVCVWTQDLDQDGGEEM

SEQ ID NO: 122597 - protein, 33 aa, Artificial Sequence
  Description of Artificial Sequence: Synthetic polypeptide
DEQEIATTNPVATTQYGSVPSATDLEDHEGEDL

SEQ ID NO: 122598 - protein, 34 aa, Artificial Sequence
  Description of Artificial Sequence: Synthetic polypeptide
MNEEIRTTNPVATEQYGVVWVTQNLQQDGGPESI

SEQ ID NO: 122599 - protein, 36 aa, Artificial Sequence
  Description of Artificial Sequence: Synthetic polypeptide
AEEEIRTTNPVATEQYGVVSTTNQQTNSEQGNNTND

SEQ ID NO: 122600 - protein, 33 aa, Artificial Sequence
  Description of Artificial Sequence: Synthetic polypeptide
DEAEIRTTNPVAYEQYGTVYCTDLDNDNGNGGA

SEQ ID NO: 122601 - protein, 36 aa, Artificial Sequence
  Description of Artificial Sequence: Synthetic polypeptide
AEEEIRTTNPVATEQYGVVSTTNQQQQQQGNNVATE

SEQ ID NO: 122602 - protein, 35 aa, Artificial Sequence
  Description of Artificial Sequence: Synthetic polypeptide
DESEIRTTNPVATECWGFSQVSCINEPQDREGENI

SEQ ID NO: 122603 - protein, 35 aa, Artificial Sequence
  Description of Artificial Sequence: Synthetic polypeptide
DENEIATTNPVATEQYGSVSATLDLVEQHEGIEDT

SEQ ID NO: 122604 - protein, 35 aa, Artificial Sequence
  Description of Artificial Sequence: Synthetic polypeptide
DEAEIRTTNCVAYCQYGSTVPSCNELSQRTVGDNE

SEQ ID NO: 122605 - protein, 36 aa, Artificial Sequence
  Description of Artificial Sequence: Synthetic polypeptide
AEEEIRTTNPVATEQYGVVSTTNQQLQQGDEDETEV

SEQ ID NO: 122606 - protein, 35 aa, Artificial Sequence
  Description of Artificial Sequence: Synthetic polypeptide
DENEIATTNPVATEQYGSVSATGDGNEDQEGEGDG

SEQ ID NO: 122607 - protein, 36 aa, Artificial Sequence
  Description of Artificial Sequence: Synthetic polypeptide
AEEEIRTTNPVATEQYGVVSTTNQQGNNQAGNNNQE

SEQ ID NO: 122608 - protein, 32 aa, Artificial Sequence
  Description of Artificial Sequence: Synthetic polypeptide
DEQEIATTNPVATTQYGSVSATDLEDHETEWL

SEQ ID NO: 122609 - protein, 33 aa, Artificial Sequence
  Description of Artificial Sequence: Synthetic polypeptide
DEQEIATTNPVATTQYGSVSATDFLEDHEGEDL

SEQ ID NO: 122610 - protein, 34 aa, Artificial Sequence
  Description of Artificial Sequence: Synthetic polypeptide
MEGEIRTTNPVATEQYGSVCSPTLSEEGGDVVRD

SEQ ID NO: 122611 - protein, 28 aa, Artificial Sequence
  Description of Artificial Sequence: Synthetic peptide
QAEEIATTNPVATEQYGEAPEVCQHEEK

SEQ ID NO: 122612 - protein, 35 aa, Artificial Sequence
  Description of Artificial Sequence: Synthetic polypeptide
DECEICTTNPVATEQYGVVSTVQQLQQGNQNNTDD

SEQ ID NO: 122613 - protein, 32 aa, Artificial Sequence
  Description of Artificial Sequence: Synthetic polypeptide
DEMEIVTTNPVATELYGTVSATDGPVEFEGND

SEQ ID NO: 122614 - protein, 33 aa, Artificial Sequence
  Description of Artificial Sequence: Synthetic polypeptide
DEAEISTVNPVATEQYGCVCSTNDAYFGSENQS

SEQ ID NO: 122615 - protein, 34 aa, Artificial Sequence
  Description of Artificial Sequence: Synthetic polypeptide
DECEIATTNPVATEPYGSVCYNNDDQDQGHNQRN

SEQ ID NO: 122616 - protein, 36 aa, Artificial Sequence
  Description of Artificial Sequence: Synthetic polypeptide
DEEEIRTTNPVATEQYGSVMGIDNENEQDEGGTGNE

SEQ ID NO: 122617 - protein, 36 aa, Artificial Sequence
  Description of Artificial Sequence: Synthetic polypeptide
AEEEIRTTNPVATEQYGSVVTVNTNLQSGSVDEGTQ

SEQ ID NO: 122618 - protein, 33 aa, Artificial Sequence
  Description of Artificial Sequence: Synthetic polypeptide
DEAEISTVNPVATEQYGCVCSTNHFYFGSNNQS

SEQ ID NO: 122619 - protein, 34 aa, Artificial Sequence
  Description of Artificial Sequence: Synthetic polypeptide
QEEEIATTNPVATEQYGCVAATNLTDDNQNNSRM

SEQ ID NO: 122620 - protein, 35 aa, Artificial Sequence
  Description of Artificial Sequence: Synthetic polypeptide
DEEEIRTTNPVATEQYGSVMGIDEQEGDEGGNGNE

SEQ ID NO: 122621 - protein, 35 aa, Artificial Sequence
  Description of Artificial Sequence: Synthetic polypeptide
DEEEIRTTNPVATEQYGSVMGIMEGNLEDNGGQSI

SEQ ID NO: 122622 - protein, 33 aa, Artificial Sequence
  Description of Artificial Sequence: Synthetic polypeptide
DECEIATTNPVATEPYGSVCYNNDDQDQGHNDQ

SEQ ID NO: 122623 - protein, 33 aa, Artificial Sequence
  Description of Artificial Sequence: Synthetic polypeptide
DEMEIVTTNPVATEGYGTVCSATDGPVQFVGND

SEQ ID NO: 122624 - protein, 33 aa, Artificial Sequence
  Description of Artificial Sequence: Synthetic polypeptide
DEMEIVTTNPVATEGYGTVCSATDGPVQFEGND

SEQ ID NO: 122625 - protein, 29 aa, Artificial Sequence
  Description of Artificial Sequence: Synthetic peptide
DESEIASTNPVSTEGYGTMASETIQHGNI

SEQ ID NO: 122626 - protein, 35 aa, Artificial Sequence
  Description of Artificial Sequence: Synthetic polypeptide
DEEEIRTTNPVATEQYGSVMGGLEGDQNEGGGETE

SEQ ID NO: 122627 - protein, 30 aa, Artificial Sequence
  Description of Artificial Sequence: Synthetic polypeptide
QEEEIATTNPVATEQYGCVAPEGGQSEEED

SEQ ID NO: 122628 - protein, 32 aa, Artificial Sequence
  Description of Artificial Sequence: Synthetic polypeptide
DEMEIVTTNPVATEGYGTVCSATDGLVEFGDI

SEQ ID NO: 122629 - protein, 35 aa, Artificial Sequence
  Description of Artificial Sequence: Synthetic polypeptide
AEEEIRTTNPVATEQYGSVVTVNTDGNNNLGGNDD

SEQ ID NO: 122630 - protein, 33 aa, Artificial Sequence
  Description of Artificial Sequence: Synthetic polypeptide
DEMEIVTTNPVATEGYGTVCSATDGEQEFEGND

SEQ ID NO: 122631 - protein, 30 aa, Artificial Sequence
  Description of Artificial Sequence: Synthetic polypeptide
DESEIASTNPVSTEGYGTMASTIQQHNGNI

SEQ ID NO: 122632 - protein, 36 aa, Artificial Sequence
  Description of Artificial Sequence: Synthetic polypeptide
DEEEIRTTNPVATEQYGSVMGIMNEQDGDEGGNGEE

SEQ ID NO: 122633 - protein, 36 aa, Artificial Sequence
  Description of Artificial Sequence: Synthetic polypeptide
DEEEIRTTNPVATEQYGSVMGIMVNNTQDEGGQNDI

SEQ ID NO: 122634 - protein, 33 aa, Artificial Sequence
  Description of Artificial Sequence: Synthetic polypeptide
QEEEIATTNPVATEQYGCVAATNLAVTGPGDVQ

SEQ ID NO: 122635 - protein, 30 aa, Artificial Sequence
  Description of Artificial Sequence: Synthetic polypeptide
QEEEIATTNPVATEQYGCAPMHGQDSPGQK

SEQ ID NO: 122636 - protein, 30 aa, Artificial Sequence
  Description of Artificial Sequence: Synthetic polypeptide
QEEEIATTNPVATEQYGCAPMHGQESEGEK

SEQ ID NO: 122637 - protein, 32 aa, Artificial Sequence
  Description of Artificial Sequence: Synthetic polypeptide
QEEEIATTNPVATEQYGCAPMNHGQDSEGENN

SEQ ID NO: 122638 - protein, 33 aa, Artificial Sequence
  Description of Artificial Sequence: Synthetic polypeptide
DEMEIVTTNPVATEPYGTVCSATDGPVEQEGND

SEQ ID NO: 122639 - protein, 33 aa, Artificial Sequence
  Description of Artificial Sequence: Synthetic polypeptide
DEAEISTVNPVATEQYGCVCSSNLANFGSNNQS

SEQ ID NO: 122640 - protein, 36 aa, Artificial Sequence
  Description of Artificial Sequence: Synthetic polypeptide
DEEEIRTTNPVATEQYGSVMGLLIDDQEGGGGNEQT

SEQ ID NO: 122641 - protein, 35 aa, Artificial Sequence
  Description of Artificial Sequence: Synthetic polypeptide
DEQEIRTTNPVATEQYGSVWVVTANETQFEGVEDQ

SEQ ID NO: 122642 - protein, 29 aa, Artificial Sequence
  Description of Artificial Sequence: Synthetic peptide
QEEEIATTNPVATEQYGCAPWEDQHNSEA

SEQ ID NO: 122643 - protein, 29 aa, Artificial Sequence
  Description of Artificial Sequence: Synthetic peptide
QEEEIATTNPVATEQYGCAPWVEQHESEA

SEQ ID NO: 122644 - protein, 29 aa, Artificial Sequence
  Description of Artificial Sequence: Synthetic peptide
QEEEIATTNPVATEQYGCFCPWVDQHEEV

SEQ ID NO: 122645 - protein, 31 aa, Artificial Sequence
  Description of Artificial Sequence: Synthetic polypeptide
DESEIASTNPVSTEQYGDVAANTIQNRVEQR

SEQ ID NO: 122646 - protein, 29 aa, Artificial Sequence
  Description of Artificial Sequence: Synthetic peptide
QEEEIATTNPVATEQYGCIAPEVCQHEEK

SEQ ID NO: 122647 - protein, 33 aa, Artificial Sequence
  Description of Artificial Sequence: Synthetic polypeptide
DEQEIRTTNPVATEQYGTISAMEDIQQDQNGNH

SEQ ID NO: 122648 - protein, 29 aa, Artificial Sequence
  Description of Artificial Sequence: Synthetic peptide
QEEEIATTNPVATEQYGCSCNEVCEPHEK

SEQ ID NO: 122649 - protein, 33 aa, Artificial Sequence
  Description of Artificial Sequence: Synthetic polypeptide
DECEIATTNPVATEPYGSVCYNNDHADHGNNDR

SEQ ID NO: 122650 - protein, 32 aa, Artificial Sequence
  Description of Artificial Sequence: Synthetic polypeptide
DESEIASTNPVSTEGYGTVANETIQQQRNGNR

SEQ ID NO: 122651 - protein, 29 aa, Artificial Sequence
  Description of Artificial Sequence: Synthetic peptide
DESEIASTNPVSTEGYGTMSMETIQHGNI

SEQ ID NO: 122652 - protein, 32 aa, Artificial Sequence
  Description of Artificial Sequence: Synthetic polypeptide
DEMEIVTTNPVATEPYGTISATDDPQEQEGNH

SEQ ID NO: 122653 - protein, 34 aa, Artificial Sequence
  Description of Artificial Sequence: Synthetic polypeptide
QEEEIATTNPVATEQYGCVAANPNDIQNQEGNPR

SEQ ID NO: 122654 - protein, 36 aa, Artificial Sequence
  Description of Artificial Sequence: Synthetic polypeptide
AEEEIRTTNPVATEQYGSVVTVNTDGGNNQLGNNDD

SEQ ID NO: 122655 - protein, 30 aa, Artificial Sequence
  Description of Artificial Sequence: Synthetic polypeptide
QEEEIATTNPVATEQYGCAPMHGQDSNGEP

SEQ ID NO: 122656 - protein, 36 aa, Artificial Sequence
  Description of Artificial Sequence: Synthetic polypeptide
DEEEIRTTNPVATEQYGSVMGFTGDNGQNIQGEFGV

SEQ ID NO: 122657 - protein, 35 aa, Artificial Sequence
  Description of Artificial Sequence: Synthetic polypeptide
DEEEIRTTNPVATEQYGSVMGFNMNSEGGNTDGEE

SEQ ID NO: 122658 - protein, 36 aa, Artificial Sequence
  Description of Artificial Sequence: Synthetic polypeptide
DEEEIRTTNPVATEQYGSVMGDPMNLDNSGQEEGGN

SEQ ID NO: 122659 - protein, 35 aa, Artificial Sequence
  Description of Artificial Sequence: Synthetic polypeptide
DEEEIRTTNPVATEQYGSVMGDNMNSEGGNGDGDE

SEQ ID NO: 122660 - protein, 33 aa, Artificial Sequence
  Description of Artificial Sequence: Synthetic polypeptide
CEEEIACTNPVATEQYGSVATGNGPAQGENDQT

SEQ ID NO: 122661 - protein, 31 aa, Artificial Sequence
  Description of Artificial Sequence: Synthetic polypeptide
DESEIASTNPVSTEGYGNVAANTIQSRVGQR

SEQ ID NO: 122662 - protein, 29 aa, Artificial Sequence
  Description of Artificial Sequence: Synthetic peptide
QEEEIATTNPVATEQYGEAAEEVCQHEEK

SEQ ID NO: 122663 - protein, 36 aa, Artificial Sequence
  Description of Artificial Sequence: Synthetic polypeptide
DEEEIRTTNPVATEQYGSVMGDIMNLDNEGQDEGEN

SEQ ID NO: 122664 - protein, 31 aa, Artificial Sequence
  Description of Artificial Sequence: Synthetic polypeptide
DESEIASTNPVSTEGYGNVAANTIQSRVGNH

SEQ ID NO: 122665 - protein, 35 aa, Artificial Sequence
  Description of Artificial Sequence: Synthetic polypeptide
DEEEIRTTNPVATEQYGSVMGDFNNNNEQEGQGET

SEQ ID NO: 122666 - protein, 36 aa, Artificial Sequence
  Description of Artificial Sequence: Synthetic polypeptide
DEEEIRTTNPVATEQYGSVMGDPMNLENSGQSEGEN

SEQ ID NO: 122667 - protein, 34 aa, Artificial Sequence
  Description of Artificial Sequence: Synthetic polypeptide
DEEEIRTTNPVATEQYGSVMGDFNNNNEFTQGET

SEQ ID NO: 122668 - protein, 28 aa, Artificial Sequence
  Description of Artificial Sequence: Synthetic peptide
QEEEIATTNPVATEQYGEAAEVCWHEEK

SEQ ID NO: 122669 - protein, 29 aa, Artificial Sequence
  Description of Artificial Sequence: Synthetic peptide
QEEEIATTNPVATEQYGEAAEVPCQHEEK

SEQ ID NO: 122670 - protein, 36 aa, Artificial Sequence
  Description of Artificial Sequence: Synthetic polypeptide
DEEEIRTTNPVATEQYGSVMGDFNNDNEFTQGGNIT

SEQ ID NO: 122671 - protein, 29 aa, Artificial Sequence
  Description of Artificial Sequence: Synthetic peptide
QEEEIATTNPVATEQYGEAANEDWQHEPK

SEQ ID NO: 122672 - protein, 29 aa, Artificial Sequence
  Description of Artificial Sequence: Synthetic peptide
QEEEIATTNPVATEQYGEAANEVCQHEEK

SEQ ID NO: 122673 - protein, 29 aa, Artificial Sequence
  Description of Artificial Sequence: Synthetic peptide
QEEEIATTNPVATEQYGEAAPEVCQHEEK

SEQ ID NO: 122674 - protein, 29 aa, Artificial Sequence
  Description of Artificial Sequence: Synthetic peptide
QEEEIATTNPVATEQYGEAAPEVMQHEEK

SEQ ID NO: 122675 - protein, 29 aa, Artificial Sequence
  Description of Artificial Sequence: Synthetic peptide
QEEEIATTNPVATEQYGEAAPMVCQHEEK

SEQ ID NO: 122676 - protein, 30 aa, Artificial Sequence
  Description of Artificial Sequence: Synthetic polypeptide
QEEEIATTNPVATEQYGEAAEVCQSRVEEK

SEQ ID NO: 122677 - protein, 30 aa, Artificial Sequence
  Description of Artificial Sequence: Synthetic polypeptide
DESEIASTNPVSTEGYGNVAETIQSRVGQR

SEQ ID NO: 122678 - protein, 32 aa, Artificial Sequence
  Description of Artificial Sequence: Synthetic polypeptide
DEMEIVTTNPVATECYGTVSATDGPVEFEGND

SEQ ID NO: 122679 - protein, 32 aa, Artificial Sequence
  Description of Artificial Sequence: Synthetic polypeptide
DEMEIVTTNPVATECYGTVSATDGPVEFEGNG

SEQ ID NO: 122680 - protein, 37 aa, Artificial Sequence
  Description of Artificial Sequence: Synthetic polypeptide
DEEEIRTTNPVATEQYGSVMGFNGSNTQNIQGGEFGV

SEQ ID NO: 122681 - protein, 31 aa, Artificial Sequence
  Description of Artificial Sequence: Synthetic polypeptide
DEMEIVTTNPVATEGYGTVCAATGLVEFGDI

SEQ ID NO: 122682 - protein, 32 aa, Artificial Sequence
  Description of Artificial Sequence: Synthetic polypeptide
DEMEIVTTNPVATEGYGTMCSATDGPQFEGNI

SEQ ID NO: 122683 - protein, 36 aa, Artificial Sequence
  Description of Artificial Sequence: Synthetic polypeptide
DEEEIRTTNPVATEQYGSVMGFMNDLGGGEDEINGG

SEQ ID NO: 122684 - protein, 30 aa, Artificial Sequence
  Description of Artificial Sequence: Synthetic polypeptide
DEMEIVTTNPVATEGYGTMCATDTPQFGDD

SEQ ID NO: 122685 - protein, 29 aa, Artificial Sequence
  Description of Artificial Sequence: Synthetic peptide
DESEIASTNPVSTEGYGTISMETIQHGNI

SEQ ID NO: 122686 - protein, 35 aa, Artificial Sequence
  Description of Artificial Sequence: Synthetic polypeptide
DEEEIRTTNPVATEQYGSVMGEQNFGDEGGGDNEQ

SEQ ID NO: 122687 - protein, 30 aa, Artificial Sequence
  Description of Artificial Sequence: Synthetic polypeptide
QEEEIATTNPVATEQYGCYPWGVDQHFNEQ

SEQ ID NO: 122688 - protein, 29 aa, Artificial Sequence
  Description of Artificial Sequence: Synthetic peptide
QEEEIATTNPVATEQYGCYPWVDQHNEQM

SEQ ID NO: 122689 - protein, 29 aa, Artificial Sequence
  Description of Artificial Sequence: Synthetic peptide
QEEEIATTNPVATEQYGCYPWVDQHSEEQ

SEQ ID NO: 122690 - protein, 32 aa, Artificial Sequence
  Description of Artificial Sequence: Synthetic polypeptide
DESEIASTNPVSTEGYGSVSANTLEDREGQDL

SEQ ID NO: 122691 - protein, 35 aa, Artificial Sequence
  Description of Artificial Sequence: Synthetic polypeptide
DEEEIRTTNPVATEQYGSVMGDTNMTDEFTGGMGE

SEQ ID NO: 122692 - protein, 31 aa, Artificial Sequence
  Description of Artificial Sequence: Synthetic polypeptide
DESEIASTNPVSTEGYGSVAANTIQSRVGQL

SEQ ID NO: 122693 - protein, 31 aa, Artificial Sequence
  Description of Artificial Sequence: Synthetic polypeptide
DESEIASTNPVSTEGYGNVSANDIQSHEGER

SEQ ID NO: 122694 - protein, 33 aa, Artificial Sequence
  Description of Artificial Sequence: Synthetic polypeptide
DESEIASTNPVSTEGYGNVCSANDGPQSRVGNR

SEQ ID NO: 122695 - protein, 33 aa, Artificial Sequence
  Description of Artificial Sequence: Synthetic polypeptide
DESEIASTNPVSTEGYGNVCSANDGIQSRVGNR

SEQ ID NO: 122696 - protein, 34 aa, Artificial Sequence
  Description of Artificial Sequence: Synthetic polypeptide
DECEIATTNPVATEPYGSVCYNNDDQDHGQNDRK

SEQ ID NO: 122697 - protein, 33 aa, Artificial Sequence
  Description of Artificial Sequence: Synthetic polypeptide
DECEIATTNPVATEPYGSVCYNNDDQDHGHDDR

SEQ ID NO: 122698 - protein, 32 aa, Artificial Sequence
  Description of Artificial Sequence: Synthetic polypeptide
DEMEIVTTNPVATECYGTVWSATDDPEFEGND

SEQ ID NO: 122699 - protein, 35 aa, Artificial Sequence
  Description of Artificial Sequence: Synthetic polypeptide
DEEEIRTTNPVATEQYGSVMGFPEMNGEGGERGGT

SEQ ID NO: 122700 - protein, 30 aa, Artificial Sequence
  Description of Artificial Sequence: Synthetic polypeptide
QEEEIATTNPVATEQYGCAPMHGQDSNEGN

SEQ ID NO: 122701 - protein, 31 aa, Artificial Sequence
  Description of Artificial Sequence: Synthetic polypeptide
QEEEIATTNPVATEQYGCAPMHGQDSEGENE

SEQ ID NO: 122702 - protein, 32 aa, Artificial Sequence
  Description of Artificial Sequence: Synthetic polypeptide
DEMEIVTTNPVATEPYGTVSMEGIQQQFNGND

SEQ ID NO: 122703 - protein, 28 aa, Artificial Sequence
  Description of Artificial Sequence: Synthetic peptide
QEEEIATTNPVATEQWGEAPEVCQHEEK

SEQ ID NO: 122704 - protein, 35 aa, Artificial Sequence
  Description of Artificial Sequence: Synthetic polypeptide
DEQEIRTTNPVATEQYGSVSWTTWNEEIPNNNNDN

SEQ ID NO: 122705 - protein, 33 aa, Artificial Sequence
  Description of Artificial Sequence: Synthetic polypeptide
DEMEIVTTNPVATEQYGAVYSATDGPVEFEGND

SEQ ID NO: 122706 - protein, 32 aa, Artificial Sequence
  Description of Artificial Sequence: Synthetic polypeptide
DESEIATTNPVASYDPHYGSVSANLQDDTGDM

SEQ ID NO: 122707 - protein, 29 aa, Artificial Sequence
  Description of Artificial Sequence: Synthetic peptide
QEEEIATTNPVATEQWGEAWPEVWQHGEK

SEQ ID NO: 122708 - protein, 30 aa, Artificial Sequence
  Description of Artificial Sequence: Synthetic polypeptide
QEEEIATTNPVATEQWGETWANEVWQHGEK

SEQ ID NO: 122709 - protein, 33 aa, Artificial Sequence
  Description of Artificial Sequence: Synthetic polypeptide
DEMEIVTTNPVATEQYGAVCSDTDGPVEFEGNY

SEQ ID NO: 122710 - protein, 33 aa, Artificial Sequence
  Description of Artificial Sequence: Synthetic polypeptide
DECEIATTNPVATEPYGSVCYNNDHQDMGGDDR

SEQ ID NO: 122711 - protein, 28 aa, Artificial Sequence
  Description of Artificial Sequence: Synthetic peptide
QEEEIATTNPVATEQWGEAPEVCQHEEC

SEQ ID NO: 122712 - protein, 33 aa, Artificial Sequence
  Description of Artificial Sequence: Synthetic polypeptide
DESEIATTNPVASECWGSVSCINEPQDREGENG

SEQ ID NO: 122713 - protein, 33 aa, Artificial Sequence
  Description of Artificial Sequence: Synthetic polypeptide
DEMEIVTTNPVATEQYGAVCSATDVIVEFEGND

SEQ ID NO: 122714 - protein, 33 aa, Artificial Sequence
  Description of Artificial Sequence: Synthetic polypeptide
DEMEIVTTNPVATEQYGAVCSATDGRVEFEGND

SEQ ID NO: 122715 - protein, 29 aa, Artificial Sequence
  Description of Artificial Sequence: Synthetic peptide
QEEEIATTNPVATEQWGEVSEICMNHEEA

SEQ ID NO: 122716 - protein, 30 aa, Artificial Sequence
  Description of Artificial Sequence: Synthetic polypeptide
QEEEIATTNPVATEQWGSAPEIVCPQHENG

SEQ ID NO: 122717 - protein, 33 aa, Artificial Sequence
  Description of Artificial Sequence: Synthetic polypeptide
DECEIATTNPVATEPYGSVCYNNDHQDGQGDRN

SEQ ID NO: 122718 - protein, 30 aa, Artificial Sequence
  Description of Artificial Sequence: Synthetic polypeptide
QEEEIATTNPVATEQWGSAPEIVCPQHENK

SEQ ID NO: 122719 - protein, 33 aa, Artificial Sequence
  Description of Artificial Sequence: Synthetic polypeptide
DEMEIVTTNPVATEQYGAVCSATDGPVEFEGND

SEQ ID NO: 122720 - protein, 30 aa, Artificial Sequence
  Description of Artificial Sequence: Synthetic polypeptide
QEEEIATTNPVATEQWGSAPEIVEPQHENG

SEQ ID NO: 122721 - protein, 29 aa, Artificial Sequence
  Description of Artificial Sequence: Synthetic peptide
QEEEIATTNPVATEQWGETWPEVWQHGEK

SEQ ID NO: 122722 - protein, 33 aa, Artificial Sequence
  Description of Artificial Sequence: Synthetic polypeptide
CEEEIACTNPVATEQYGCVSTNNHQENDMLIRE

SEQ ID NO: 122723 - protein, 33 aa, Artificial Sequence
  Description of Artificial Sequence: Synthetic polypeptide
DECEIATTNPVATEPYGSVCYNNDNQDDGDHDR

SEQ ID NO: 122724 - protein, 33 aa, Artificial Sequence
  Description of Artificial Sequence: Synthetic polypeptide
DEMEIVTTNPVATEQYGCVCSATDGPVEFEGND

SEQ ID NO: 122725 - protein, 29 aa, Artificial Sequence
  Description of Artificial Sequence: Synthetic peptide
QEEEIATTNPVATEPYGEASMEVCQHEEK

SEQ ID NO: 122726 - protein, 28 aa, Artificial Sequence
  Description of Artificial Sequence: Synthetic peptide
QEEEIATTNPVATEPYGESPEVCQHEEK

SEQ ID NO: 122727 - protein, 33 aa, Artificial Sequence
  Description of Artificial Sequence: Synthetic polypeptide
DECEIATTNPVATEPYGSVCYNNDNQDDHNQDR

SEQ ID NO: 122728 - protein, 36 aa, Artificial Sequence
  Description of Artificial Sequence: Synthetic polypeptide
DEEEIRTTNPVATEQYGSVMGNNDLQSENGGEFTTA

SEQ ID NO: 122729 - protein, 34 aa, Artificial Sequence
  Description of Artificial Sequence: Synthetic polypeptide
DEQEIRTTNPVATEQYGSVSVPMNHDEHPFNSEG

SEQ ID NO: 122730 - protein, 34 aa, Artificial Sequence
  Description of Artificial Sequence: Synthetic polypeptide
DEQEIRTTNPVATEQYGSVSVPMNHDEHPMNSQH

SEQ ID NO: 122731 - protein, 34 aa, Artificial Sequence
  Description of Artificial Sequence: Synthetic polypeptide
QEEEIATTNPVATEPYGSVCAGNNLTDAGGNERF

SEQ ID NO: 122732 - protein, 37 aa, Artificial Sequence
  Description of Artificial Sequence: Synthetic polypeptide
AEEEIRTTNPVATEQYGSVVTVNTTNLQSGTVTNNTD

SEQ ID NO: 122733 - protein, 30 aa, Artificial Sequence
  Description of Artificial Sequence: Synthetic polypeptide
QEEEIATTNPVATEPYGTISEDCQQQNEEH

SEQ ID NO: 122734 - protein, 32 aa, Artificial Sequence
  Description of Artificial Sequence: Synthetic polypeptide
CEEEIACTNPVATEQYGCVATNLQTEDSDAQD

SEQ ID NO: 122735 - protein, 34 aa, Artificial Sequence
  Description of Artificial Sequence: Synthetic polypeptide
DEMEIVTTNPVATEQYGCVCSNTEEPNEFEGNDA

SEQ ID NO: 122736 - protein, 28 aa, Artificial Sequence
  Description of Artificial Sequence: Synthetic peptide
QEEEIATTNPVATEQFGEAPEVCQHDEK

SEQ ID NO: 122737 - protein, 33 aa, Artificial Sequence
  Description of Artificial Sequence: Synthetic polypeptide
DEMEIVTTNPVATEQYGCVCSNTDPPDEFEGND

SEQ ID NO: 122738 - protein, 28 aa, Artificial Sequence
  Description of Artificial Sequence: Synthetic peptide
QEEEIATTNPVATEQFGEAPEVCQHEEE

SEQ ID NO: 122739 - protein, 28 aa, Artificial Sequence
  Description of Artificial Sequence: Synthetic peptide
QEEEIATTNPVATEQFGEAPEVCQHEEK

SEQ ID NO: 122740 - protein, 33 aa, Artificial Sequence
  Description of Artificial Sequence: Synthetic polypeptide
DESEIATTNPVATEAYGSVSCTDELEDHEGEDL

SEQ ID NO: 122741 - protein, 33 aa, Artificial Sequence
  Description of Artificial Sequence: Synthetic polypeptide
DEMEIVTTNPVATEQYGCVCSATGEPVEFEGND

SEQ ID NO: 122742 - protein, 35 aa, Artificial Sequence
  Description of Artificial Sequence: Synthetic polypeptide
DESEIATTNPVATEAYGSTVQSGTNMLSAYGGNHF

SEQ ID NO: 122743 - protein, 36 aa, Artificial Sequence
  Description of Artificial Sequence: Synthetic polypeptide
DEEEIRTTNPVATEQYGSVMGMNVNGQGGEGQENQQ

SEQ ID NO: 122744 - protein, 34 aa, Artificial Sequence
  Description of Artificial Sequence: Synthetic polypeptide
DESEIATTNPLATEQYGSTVAHCTNGLSAYGGNT

SEQ ID NO: 122745 - protein, 32 aa, Artificial Sequence
  Description of Artificial Sequence: Synthetic polypeptide
DEMEIVTTNPVATEQYGAVCSATDGPEFEGPD

SEQ ID NO: 122746 - protein, 36 aa, Artificial Sequence
  Description of Artificial Sequence: Synthetic polypeptide
DEEEIRTTNPVATEQYGSVMGMNNAQGQGEQGENVE

SEQ ID NO: 122747 - protein, 32 aa, Artificial Sequence
  Description of Artificial Sequence: Synthetic polypeptide
QEEEIATTNPVATEQWGSVSGEGDQNTDDNAH

SEQ ID NO: 122748 - protein, 32 aa, Artificial Sequence
  Description of Artificial Sequence: Synthetic polypeptide
DEMEIVTTNPVATEQWGTVCSATDIEEFEGND

SEQ ID NO: 122749 - protein, 32 aa, Artificial Sequence
  Description of Artificial Sequence: Synthetic polypeptide
DECEIATTNPVATEPYGSVCYNNDHLDGHNDS

SEQ ID NO: 122750 - protein, 31 aa, Artificial Sequence
  Description of Artificial Sequence: Synthetic polypeptide
QEEEIATTNPVATEQYGAVAPEVDQHGEEGQ

SEQ ID NO: 122751 - protein, 32 aa, Artificial Sequence
  Description of Artificial Sequence: Synthetic polypeptide
DEMEIVTTNPVATEQWGTVCSATDGPEFEGND

SEQ ID NO: 122752 - protein, 30 aa, Artificial Sequence
  Description of Artificial Sequence: Synthetic polypeptide
QEEEIATTNPVATEQYGCAPEHGQDSDGEG

SEQ ID NO: 122753 - protein, 30 aa, Artificial Sequence
  Description of Artificial Sequence: Synthetic polypeptide
QEEEIATTNPVATEQYGCAPEHGQDSNEQK

SEQ ID NO: 122754 - protein, 30 aa, Artificial Sequence
  Description of Artificial Sequence: Synthetic polypeptide
QEEEIATTNPVATEQYGCAPEHGTDSEEGN

SEQ ID NO: 122755 - protein, 29 aa, Artificial Sequence
  Description of Artificial Sequence: Synthetic peptide
QEEEIATTNPVATEQYGCAPEVCQHEEEK

SEQ ID NO: 122756 - protein, 30 aa, Artificial Sequence
  Description of Artificial Sequence: Synthetic polypeptide
DESEIASVNPVCTEGYGVVSDTIQSRVGNQ

SEQ ID NO: 122757 - protein, 33 aa, Artificial Sequence
  Description of Artificial Sequence: Synthetic polypeptide
DEMEIVTTNPVATEQWGSVSACIGPVEDREGNG

SEQ ID NO: 122758 - protein, 31 aa, Artificial Sequence
  Description of Artificial Sequence: Synthetic polypeptide
DESEIASTNPVSTEQYGNVAANTIQSSVGTR

SEQ ID NO: 122759 - protein, 29 aa, Artificial Sequence
  Description of Artificial Sequence: Synthetic peptide
QEEEIATTNPVATEQYGCAPEVCQHEVEK

SEQ ID NO: 122760 - protein, 33 aa, Artificial Sequence
  Description of Artificial Sequence: Synthetic polypeptide
DEMEIVTTNPVATEQWGSVSACDGPVEDREGND

SEQ ID NO: 122761 - protein, 29 aa, Artificial Sequence
  Description of Artificial Sequence: Synthetic peptide
QEEEIATTNPVATEQYGCAPEVCQMHEEK

SEQ ID NO: 122762 - protein, 29 aa, Artificial Sequence
  Description of Artificial Sequence: Synthetic peptide
QEEEIATTNPVATEQYGCAPEVCSQHEEK

SEQ ID NO: 122763 - protein, 31 aa, Artificial Sequence
  Description of Artificial Sequence: Synthetic polypeptide
DEMEIVTTNPVATEQWGDVCSEDIEEAEGND

SEQ ID NO: 122764 - protein, 32 aa, Artificial Sequence
  Description of Artificial Sequence: Synthetic polypeptide
DEMEIVTTNPVATEQWGDVCSATDIEEFEGND

SEQ ID NO: 122765 - protein, 29 aa, Artificial Sequence
  Description of Artificial Sequence: Synthetic peptide
QEEEIATTNPVATEQYGCAPMHGLDSEEK

SEQ ID NO: 122766 - protein, 32 aa, Artificial Sequence
  Description of Artificial Sequence: Synthetic polypeptide
DEMEIVTTNPVATEQFGTVCSATGPVEFEGND

SEQ ID NO: 122767 - protein, 32 aa, Artificial Sequence
  Description of Artificial Sequence: Synthetic polypeptide
DEMEIVTTNPVATEQWGTVCSATDIPEFEGND

SEQ ID NO: 122768 - protein, 31 aa, Artificial Sequence
  Description of Artificial Sequence: Synthetic polypeptide
DESEIASTNPVSTEGYGNVAANTIQNRVGQR

SEQ ID NO: 122769 - protein, 30 aa, Artificial Sequence
  Description of Artificial Sequence: Synthetic polypeptide
QEEEIATTNPVATEQYGAVAGPEVGQGEEG

SEQ ID NO: 122770 - protein, 34 aa, Artificial Sequence
  Description of Artificial Sequence: Synthetic polypeptide
DEMEIVTTNPVATEQWGTVCSCDNPPQDREGEND

SEQ ID NO: 122771 - protein, 33 aa, Artificial Sequence
  Description of Artificial Sequence: Synthetic polypeptide
QEEEIATTNPVATEQWGSVSGTGPPIDNSGNPL

SEQ ID NO: 122772 - protein, 33 aa, Artificial Sequence
  Description of Artificial Sequence: Synthetic polypeptide
DESEIATTNPCASECWGSVSCINEPQDREGENR

SEQ ID NO: 122773 - protein, 29 aa, Artificial Sequence
  Description of Artificial Sequence: Synthetic peptide
QEEEIATTNPVATEQYGAAGPEVCQHEEK

SEQ ID NO: 122774 - protein, 29 aa, Artificial Sequence
  Description of Artificial Sequence: Synthetic peptide
QEEEIATTNPVATEQYGAAPEVCQEHEEI

SEQ ID NO: 122775 - protein, 32 aa, Artificial Sequence
  Description of Artificial Sequence: Synthetic polypeptide
DEMEIVTTNPVATEQWGTVSCDNEVEDFEGNG

SEQ ID NO: 122776 - protein, 32 aa, Artificial Sequence
  Description of Artificial Sequence: Synthetic polypeptide
DEMEIVTTNPVATEQWGTVSCDNEPEDFEGNG

SEQ ID NO: 122777 - protein, 31 aa, Artificial Sequence
  Description of Artificial Sequence: Synthetic polypeptide
DEMEIVTTNPVATEQWGTVSCDGEVEFEGNG

SEQ ID NO: 122778 - protein, 29 aa, Artificial Sequence
  Description of Artificial Sequence: Synthetic peptide
DESEIASVNPVSTEGYGNVANNLQSVGQQ

SEQ ID NO: 122779 - protein, 33 aa, Artificial Sequence
  Description of Artificial Sequence: Synthetic polypeptide
DECEIATTNPVATEPYGSVCYNNDHMDTGHNDR

SEQ ID NO: 122780 - protein, 29 aa, Artificial Sequence
  Description of Artificial Sequence: Synthetic peptide
QEEEIATTNPVATEQYGAAPEVCQHEEKF

SEQ ID NO: 122781 - protein, 37 aa, Artificial Sequence
  Description of Artificial Sequence: Synthetic polypeptide
DEEEIRTTNPVATEQYGTVSTTTNNNLQQGTEEGSTD

SEQ ID NO: 122782 - protein, 34 aa, Artificial Sequence
  Description of Artificial Sequence: Synthetic polypeptide
DECEIATTNPVATEPYGSVCYNNDHLDLGQNDRK

SEQ ID NO: 122783 - protein, 32 aa, Artificial Sequence
  Description of Artificial Sequence: Synthetic polypeptide
DECEIATTNPVATEPYGSVCYNNDHLDGSDDR

SEQ ID NO: 122784 - protein, 34 aa, Artificial Sequence
  Description of Artificial Sequence: Synthetic polypeptide
DEAEIATTNPVAYEQWGSVSGENLGEPGNPNDNR

SEQ ID NO: 122785 - protein, 38 aa, Artificial Sequence
  Description of Artificial Sequence: Synthetic polypeptide
DEEEIRTTNPVATEQYGTVSTTVTGNNLQQGTTEGGND

SEQ ID NO: 122786 - protein, 32 aa, Artificial Sequence
  Description of Artificial Sequence: Synthetic polypeptide
DEMEIVTTNPVATEQWGTVSATDGPVEFEGND

SEQ ID NO: 122787 - protein, 29 aa, Artificial Sequence
  Description of Artificial Sequence: Synthetic peptide
QEEEIATTNPVATEQYGAAPEVVCQHEEK

SEQ ID NO: 122788 - protein, 33 aa, Artificial Sequence
  Description of Artificial Sequence: Synthetic polypeptide
DEMEIVTTNPVATEQWGTVCSTDGPVQFEGEND

SEQ ID NO: 122789 - protein, 29 aa, Artificial Sequence
  Description of Artificial Sequence: Synthetic peptide
QEEEIATTNPVATEQYGAAWPAVCQHEPK

SEQ ID NO: 122790 - protein, 29 aa, Artificial Sequence
  Description of Artificial Sequence: Synthetic peptide
QEEEIATTNPVATEQYGAAWPEVCQHEPK

SEQ ID NO: 122791 - protein, 33 aa, Artificial Sequence
  Description of Artificial Sequence: Synthetic polypeptide
DECEIATTNPVATEPYGSVCYNNDSQDQHQNDR

SEQ ID NO: 122792 - protein, 33 aa, Artificial Sequence
  Description of Artificial Sequence: Synthetic polypeptide
DEAEIVTTNPVATEQYGTVCSATDGISEFEGND

SEQ ID NO: 122793 - protein, 30 aa, Artificial Sequence
  Description of Artificial Sequence: Synthetic polypeptide
DESEIASTNPVSTEGYGNVAANTIQHVGQR

SEQ ID NO: 122794 - protein, 32 aa, Artificial Sequence
  Description of Artificial Sequence: Synthetic polypeptide
DEMEIVSTNPVATEQYGVVCSADDGPQFEGNQ

SEQ ID NO: 122795 - protein, 38 aa, Artificial Sequence
  Description of Artificial Sequence: Synthetic polypeptide
DEEEIRTTNPVATEQYGTVSTVTNLQAGNQAGTNQEEE

SEQ ID NO: 122796 - protein, 32 aa, Artificial Sequence
  Description of Artificial Sequence: Synthetic polypeptide
DEMEIVSTNPVATEQYGVVCAASDTLVQHGDI

SEQ ID NO: 122797 - protein, 29 aa, Artificial Sequence
  Description of Artificial Sequence: Synthetic peptide
QEEEIATTNPVATEQYGEAPEIRCQHEEK

SEQ ID NO: 122798 - protein, 33 aa, Artificial Sequence
  Description of Artificial Sequence: Synthetic polypeptide
DECEIATTNPVATENWGSVSGGNAGNAGNDDSR

SEQ ID NO: 122799 - protein, 37 aa, Artificial Sequence
  Description of Artificial Sequence: Synthetic polypeptide
DEEEIRTTNPVATEQYGTVSTVVNQQLQQGTEEGSTD

SEQ ID NO: 122800 - protein, 32 aa, Artificial Sequence
  Description of Artificial Sequence: Synthetic polypeptide
DEMEIVSTNPVATEQYGTVCSTDGPVEFEGND

SEQ ID NO: 122801 - protein, 29 aa, Artificial Sequence
  Description of Artificial Sequence: Synthetic peptide
QEEEIATTNPVATEQYGEAPEIVCQHEEK

SEQ ID NO: 122802 - protein, 30 aa, Artificial Sequence
  Description of Artificial Sequence: Synthetic polypeptide
QEEEIATTNPVATEQYGEAPEINCQHEEEK

SEQ ID NO: 122803 - protein, 32 aa, Artificial Sequence
  Description of Artificial Sequence: Synthetic polypeptide
DEMEIVSTNPVATEQYGTVCSATGPVEFEGND

SEQ ID NO: 122804 - protein, 31 aa, Artificial Sequence
  Description of Artificial Sequence: Synthetic polypeptide
DESEIASTNPVGTEGYGVVSSSALPQRGMDI

SEQ ID NO: 122805 - protein, 33 aa, Artificial Sequence
  Description of Artificial Sequence: Synthetic polypeptide
DEQEIRTTNPVAYEQWGSVATNPNGNGMGDNVA

SEQ ID NO: 122806 - protein, 30 aa, Artificial Sequence
  Description of Artificial Sequence: Synthetic polypeptide
QEEEIATTNPVATEQYGEAPEIVEQDHGEK

SEQ ID NO: 122807 - protein, 29 aa, Artificial Sequence
  Description of Artificial Sequence: Synthetic peptide
QEEEIATTNPVATEQYGEAPEIVEQHEEK

SEQ ID NO: 122808 - protein, 30 aa, Artificial Sequence
  Description of Artificial Sequence: Synthetic polypeptide
QEEEIATTNPVATEQYGEAPEIVEQHEGEG

SEQ ID NO: 122809 - protein, 34 aa, Artificial Sequence
  Description of Artificial Sequence: Synthetic polypeptide
DEEEIATTNPVATEQWGCVAGNGELAQNNSGNEH

SEQ ID NO: 122810 - protein, 33 aa, Artificial Sequence
  Description of Artificial Sequence: Synthetic polypeptide
DEAEIYTTNPVATEQYGCVCSTEDHAYFGSNQS

SEQ ID NO: 122811 - protein, 32 aa, Artificial Sequence
  Description of Artificial Sequence: Synthetic polypeptide
DEMEIVSTNPVATEQYGTVCSATDGPEFVGND

SEQ ID NO: 122812 - protein, 29 aa, Artificial Sequence
  Description of Artificial Sequence: Synthetic peptide
QEEEIATTNPVATEQYGEAPEIVCQHEIK

SEQ ID NO: 122813 - protein, 29 aa, Artificial Sequence
  Description of Artificial Sequence: Synthetic peptide
QEEEIATTNPVATEQYGEAPEICQKHEEK

SEQ ID NO: 122814 - protein, 33 aa, Artificial Sequence
  Description of Artificial Sequence: Synthetic polypeptide
DEMEIVSTNPVATEQYGVVCSATDGPVQFEGNQ

SEQ ID NO: 122815 - protein, 31 aa, Artificial Sequence
  Description of Artificial Sequence: Synthetic polypeptide
DEMEIVTTNPCASEQYGTVCSTDGPVQFGTD

SEQ ID NO: 122816 - protein, 30 aa, Artificial Sequence
  Description of Artificial Sequence: Synthetic polypeptide
QEEEIATTNPVATEQYGEAPEEVCQHENEK

SEQ ID NO: 122817 - protein, 30 aa, Artificial Sequence
  Description of Artificial Sequence: Synthetic polypeptide
QEEEIATTNPVATEQYGEAPEEVCQQQGEH

SEQ ID NO: 122818 - protein, 30 aa, Artificial Sequence
  Description of Artificial Sequence: Synthetic polypeptide
QEEEIATTNPVATEQYGEAPEEVIQQQGEH

SEQ ID NO: 122819 - protein, 29 aa, Artificial Sequence
  Description of Artificial Sequence: Synthetic peptide
QEEEIATTNPVATEQYGEAPEFCQGHEEK

SEQ ID NO: 122820 - protein, 29 aa, Artificial Sequence
  Description of Artificial Sequence: Synthetic peptide
QEEEIATTNPVATEQYGEAPEFCQHAEEK

SEQ ID NO: 122821 - protein, 29 aa, Artificial Sequence
  Description of Artificial Sequence: Synthetic peptide
QEEEIATTNPVATEQYGEAPEFVCQHEEK

SEQ ID NO: 122822 - protein, 29 aa, Artificial Sequence
  Description of Artificial Sequence: Synthetic peptide
QEEEIATTNPVATEQYGEAPEGCQHEEEK

SEQ ID NO: 122823 - protein, 29 aa, Artificial Sequence
  Description of Artificial Sequence: Synthetic peptide
QEEEIATTNPVATEQYGEAPEGDCQHEEK

SEQ ID NO: 122824 - protein, 29 aa, Artificial Sequence
  Description of Artificial Sequence: Synthetic peptide
QEEEIATTNPVATEQYGEAPEGISQHEEK

SEQ ID NO: 122825 - protein, 29 aa, Artificial Sequence
  Description of Artificial Sequence: Synthetic peptide
QEEEIATTNPVATEQYGEAPEGVCQHEEK

SEQ ID NO: 122826 - protein, 29 aa, Artificial Sequence
  Description of Artificial Sequence: Synthetic peptide
QEEEIATTNPVATEQYGEAPEGVCQTEEK

SEQ ID NO: 122827 - protein, 29 aa, Artificial Sequence
  Description of Artificial Sequence: Synthetic peptide
QEEEIATTNPVATEQYGEAPEHGQHEEKM

SEQ ID NO: 122828 - protein, 33 aa, Artificial Sequence
  Description of Artificial Sequence: Synthetic polypeptide
DECEIATTNPVATENYGEVSGGNGNAGGNDNQR

SEQ ID NO: 122829 - protein, 32 aa, Artificial Sequence
  Description of Artificial Sequence: Synthetic polypeptide
DEMEIVTTNPCATEQYGTVCSTDGPVQFEGTD

SEQ ID NO: 122830 - protein, 33 aa, Artificial Sequence
  Description of Artificial Sequence: Synthetic polypeptide
DEMEIVTTNPCATEQYGTVCSATDNPVEFEGND

SEQ ID NO: 122831 - protein, 32 aa, Artificial Sequence
  Description of Artificial Sequence: Synthetic polypeptide
DEMEIVTTNPCATEQYGTVCSATDNPEFEGTD

SEQ ID NO: 122832 - protein, 31 aa, Artificial Sequence
  Description of Artificial Sequence: Synthetic polypeptide
DEAEIATTNPVAYEQWGSVGWIEDLQLMDAR

SEQ ID NO: 122833 - protein, 29 aa, Artificial Sequence
  Description of Artificial Sequence: Synthetic peptide
QEEEIATTNPVATEQYGEAPEHVCQHEEK

SEQ ID NO: 122834 - protein, 28 aa, Artificial Sequence
  Description of Artificial Sequence: Synthetic peptide
QEEEIATTNPVATEQYGEAPEICMHEDK

SEQ ID NO: 122835 - protein, 33 aa, Artificial Sequence
  Description of Artificial Sequence: Synthetic polypeptide
DEMEIVSTNPVATEQYGTVCSATDGIVEFVGNR

SEQ ID NO: 122836 - protein, 29 aa, Artificial Sequence
  Description of Artificial Sequence: Synthetic peptide
QEEEIATTNPVATEQYGEAPEECQQHEEK

SEQ ID NO: 122837 - protein, 35 aa, Artificial Sequence
  Description of Artificial Sequence: Synthetic polypeptide
DEEEIRTTNPVATEQYGSVLSTFGAGENETLEEQL

SEQ ID NO: 122838 - protein, 29 aa, Artificial Sequence
  Description of Artificial Sequence: Synthetic peptide
QEEEIATTNPVATEQYGEAPEKVTQHEEQ

SEQ ID NO: 122839 - protein, 33 aa, Artificial Sequence
  Description of Artificial Sequence: Synthetic polypeptide
DECEIATTNPVATEHYGTVAITGNQQDAGQNNW

SEQ ID NO: 122840 - protein, 36 aa, Artificial Sequence
  Description of Artificial Sequence: Synthetic polypeptide
DEEEIRTTNPVATEQYGSVLSPTGTLDQDVEIEELI

SEQ ID NO: 122841 - protein, 34 aa, Artificial Sequence
  Description of Artificial Sequence: Synthetic polypeptide
DEEEIATTNPVATEQWGCVAMTHLNPRDQMGDRH

SEQ ID NO: 122842 - protein, 35 aa, Artificial Sequence
  Description of Artificial Sequence: Synthetic polypeptide
DEEEIATTNPVATEQWGCVAMTNLENTRDGMGDRH

SEQ ID NO: 122843 - protein, 29 aa, Artificial Sequence
  Description of Artificial Sequence: Synthetic peptide
DESEIASTNPVGTEGYGVTMASTLQHGDI

SEQ ID NO: 122844 - protein, 33 aa, Artificial Sequence
  Description of Artificial Sequence: Synthetic polypeptide
DEMEIVCTNPVATEQYGTVCSATDGPVEREGND

SEQ ID NO: 122845 - protein, 32 aa, Artificial Sequence
  Description of Artificial Sequence: Synthetic polypeptide
DEMEIVCTNPVATEQYGTVCSATDGPVEFGND

SEQ ID NO: 122846 - protein, 33 aa, Artificial Sequence
  Description of Artificial Sequence: Synthetic polypeptide
DEMEIVCTNPVATEQYGTVCSATDGPVEFEGNR

SEQ ID NO: 122847 - protein, 34 aa, Artificial Sequence
  Description of Artificial Sequence: Synthetic polypeptide
DEAEIATTNPVAYEQWGSVAKTNDLQEQRNGPPK

SEQ ID NO: 122848 - protein, 29 aa, Artificial Sequence
  Description of Artificial Sequence: Synthetic peptide
DESEIASTNPVGTEGYGVMSSDLQHEGDI

SEQ ID NO: 122849 - protein, 30 aa, Artificial Sequence
  Description of Artificial Sequence: Synthetic polypeptide
QEEEIATTNPVATEQYGEAPENVCQHEEAK

SEQ ID NO: 122850 - protein, 33 aa, Artificial Sequence
  Description of Artificial Sequence: Synthetic polypeptide
DEMEIVCTNPVATEQYGTVCSAEDGPVEREGNR

SEQ ID NO: 122851 - protein, 30 aa, Artificial Sequence
  Description of Artificial Sequence: Synthetic polypeptide
QEEEIATTNPVATEQYGEAPENVFCQHEEK

SEQ ID NO: 122852 - protein, 37 aa, Artificial Sequence
  Description of Artificial Sequence: Synthetic polypeptide
DEEEIRTTNPVATEQYGSVLSIITVNEEQVEGAASQV

SEQ ID NO: 122853 - protein, 30 aa, Artificial Sequence
  Description of Artificial Sequence: Synthetic polypeptide
DESEIASTNPVGTEGYGVMSASTLPQHGDI

SEQ ID NO: 122854 - protein, 33 aa, Artificial Sequence
  Description of Artificial Sequence: Synthetic polypeptide
DEEEIATTNPVATEQWGCVATNGLEAVAPGEFM

SEQ ID NO: 122855 - protein, 29 aa, Artificial Sequence
  Description of Artificial Sequence: Synthetic peptide
QEEEIATTNPVATEQYGEAPEPGQHEEEK

SEQ ID NO: 122856 - protein, 34 aa, Artificial Sequence
  Description of Artificial Sequence: Synthetic polypeptide
DECEIATTNPVATEHYGSVSGGNAGNANGNDNER

SEQ ID NO: 122857 - protein, 32 aa, Artificial Sequence
  Description of Artificial Sequence: Synthetic polypeptide
DEMEIVCTNPVATEQYGTVCSAEDGPVMFGNR

SEQ ID NO: 122858 - protein, 36 aa, Artificial Sequence
  Description of Artificial Sequence: Synthetic polypeptide
DEEEIRTTNPVATEQYGSVLSPTITLPQEEESEVGV

SEQ ID NO: 122859 - protein, 32 aa, Artificial Sequence
  Description of Artificial Sequence: Synthetic polypeptide
DEMEIVCTNPVATEQYGTVSAEDGPVEFEGNR

SEQ ID NO: 122860 - protein, 32 aa, Artificial Sequence
  Description of Artificial Sequence: Synthetic polypeptide
DEMEIVCTNPVATEQYGTVSAEDNPVEFEGND

SEQ ID NO: 122861 - protein, 33 aa, Artificial Sequence
  Description of Artificial Sequence: Synthetic polypeptide
DEMEIVSTNPVATEQYGTVCAASDTLVQHEGNI

SEQ ID NO: 122862 - protein, 36 aa, Artificial Sequence
  Description of Artificial Sequence: Synthetic polypeptide
DEEEIRTTNPVATEQYGSVLSTDYLTELESTQNDDP

SEQ ID NO: 122863 - protein, 29 aa, Artificial Sequence
  Description of Artificial Sequence: Synthetic peptide
QEEEIATTNPVATEQYGEAPELCMQHEEK

SEQ ID NO: 122864 - protein, 29 aa, Artificial Sequence
  Description of Artificial Sequence: Synthetic peptide
QEEEIATTNPVATEQYGEAPELCQCECEK

SEQ ID NO: 122865 - protein, 33 aa, Artificial Sequence
  Description of Artificial Sequence: Synthetic polypeptide
DEEEIATTNPVATEQWGCVAGTGELAQNNSMNH

SEQ ID NO: 122866 - protein, 29 aa, Artificial Sequence
  Description of Artificial Sequence: Synthetic peptide
QEEEIATTNPVATEQYGEAPELCQHEEKF

SEQ ID NO: 122867 - protein, 33 aa, Artificial Sequence
  Description of Artificial Sequence: Synthetic polypeptide
DEMEIVSTNPVATEGYGTVCSANDGPQSRVGND

SEQ ID NO: 122868 - protein, 33 aa, Artificial Sequence
  Description of Artificial Sequence: Synthetic polypeptide
DEAEIYTTNPVATEQYGCVCSTEHAEYFGSNQA

SEQ ID NO: 122869 - protein, 34 aa, Artificial Sequence
  Description of Artificial Sequence: Synthetic polypeptide
DEAEIATTNPVAYEQWGSVCSNENLDQGGMNGGH

SEQ ID NO: 122870 - protein, 32 aa, Artificial Sequence
  Description of Artificial Sequence: Synthetic polypeptide
DEMEIVSTNPVATEGYGNVSATDGIESREGND

SEQ ID NO: 122871 - protein, 33 aa, Artificial Sequence
  Description of Artificial Sequence: Synthetic polypeptide
DEMEIVSTNPVATEGYGNVCSANDGPQSRVGND

SEQ ID NO: 122872 - protein, 36 aa, Artificial Sequence
  Description of Artificial Sequence: Synthetic polypeptide
DEEEIRTTNPVATEQYGSVLSPTTNVQEMIISHEQN

SEQ ID NO: 122873 - protein, 29 aa, Artificial Sequence
  Description of Artificial Sequence: Synthetic peptide
QEEEIATTNPVATEQYGEAPELVCQHEEK

SEQ ID NO: 122874 - protein, 29 aa, Artificial Sequence
  Description of Artificial Sequence: Synthetic peptide
QEEEIATTNPVATEQYGEAPELVWQHEEK

SEQ ID NO: 122875 - protein, 29 aa, Artificial Sequence
  Description of Artificial Sequence: Synthetic peptide
QEEEIATTNPVATEQYGEAPEMCQHEEKG

SEQ ID NO: 122876 - protein, 34 aa, Artificial Sequence
  Description of Artificial Sequence: Synthetic polypeptide
DEEEIATTNPVATEQWGCVAGTGQLPQNRMGGEL

SEQ ID NO: 122877 - protein, 29 aa, Artificial Sequence
  Description of Artificial Sequence: Synthetic peptide
QEEEIATTNPVATEQYGEAPEMMCQHEEK

SEQ ID NO: 122878 - protein, 29 aa, Artificial Sequence
  Description of Artificial Sequence: Synthetic peptide
QEEEIATTNPVATEQYGEAPEMVCQHEAK

SEQ ID NO: 122879 - protein, 29 aa, Artificial Sequence
  Description of Artificial Sequence: Synthetic peptide
QEEEIATTNPVATEQYGEAPEMVCQHEEK

SEQ ID NO: 122880 - protein, 29 aa, Artificial Sequence
  Description of Artificial Sequence: Synthetic peptide
QEEEIATTNPVATEQYGEAPEKVCQHEEK

SEQ ID NO: 122881 - protein, 29 aa, Artificial Sequence
  Description of Artificial Sequence: Synthetic peptide
QEEEIATTNPVATEQYGEAPEECQHSEEK

SEQ ID NO: 122882 - protein, 30 aa, Artificial Sequence
  Description of Artificial Sequence: Synthetic polypeptide
DESEIASTNPVGTEQYGVMCSTGPQHEGDI

SEQ ID NO: 122883 - protein, 29 aa, Artificial Sequence
  Description of Artificial Sequence: Synthetic peptide
QEEEIATTNPVATEQYGEAPEECQFHEEK

SEQ ID NO: 122884 - protein, 29 aa, Artificial Sequence
  Description of Artificial Sequence: Synthetic peptide
QEEEIATTNPVATEQYGEAFEVCQSHEEK

SEQ ID NO: 122885 - protein, 29 aa, Artificial Sequence
  Description of Artificial Sequence: Synthetic peptide
QEEEIATTNPVATEQYGEAFPEVCQHEEK

SEQ ID NO: 122886 - protein, 36 aa, Artificial Sequence
  Description of Artificial Sequence: Synthetic polypeptide
DEEEIRTTNPVATEQYGSVMENTNVQGILVNEDLGP

SEQ ID NO: 122887 - protein, 32 aa, Artificial Sequence
  Description of Artificial Sequence: Synthetic polypeptide
DEMEIVTTNPVATECWGSVSCDNEPEDFEGNG

SEQ ID NO: 122888 - protein, 36 aa, Artificial Sequence
  Description of Artificial Sequence: Synthetic polypeptide
DEEEIRTTNPVATEQYGSVMDNTNGDEENQGEGEGT

SEQ ID NO: 122889 - protein, 32 aa, Artificial Sequence
  Description of Artificial Sequence: Synthetic polypeptide
CEEEIACTNPVATEQYGSVAITNDNNGEGVQS

SEQ ID NO: 122890 - protein, 30 aa, Artificial Sequence
  Description of Artificial Sequence: Synthetic polypeptide
QEEEIATTNPVATEQYGEAGSEPVEQMSEQ

SEQ ID NO: 122891 - protein, 29 aa, Artificial Sequence
  Description of Artificial Sequence: Synthetic peptide
QEEEIATTNPVATEQYGEAHEVCQHEEQK

SEQ ID NO: 122892 - protein, 29 aa, Artificial Sequence
  Description of Artificial Sequence: Synthetic peptide
QEEEIATTNPVATEQYGEAFEVCQHEEIK

SEQ ID NO: 122893 - protein, 28 aa, Artificial Sequence
  Description of Artificial Sequence: Synthetic peptide
QEEEIATTNPVATEQYGEAIEVCNHEEK

SEQ ID NO: 122894 - protein, 33 aa, Artificial Sequence
  Description of Artificial Sequence: Synthetic polypeptide
CEEEIACTNPVATEQYGSVAITNDNNGAEGPRS

SEQ ID NO: 122895 - protein, 29 aa, Artificial Sequence
  Description of Artificial Sequence: Synthetic peptide
QEEEIATTNPVATEQYGEALEVGQHEEKH

SEQ ID NO: 122896 - protein, 29 aa, Artificial Sequence
  Description of Artificial Sequence: Synthetic peptide
QEEEIATTNPVATEQYGEAMEVCQHPEEK

SEQ ID NO: 122897 - protein, 30 aa, Artificial Sequence
  Description of Artificial Sequence: Synthetic polypeptide
QEEEIATTNPVATEQYGEAMSEVEQMSEVQ

SEQ ID NO: 122898 - protein, 36 aa, Artificial Sequence
  Description of Artificial Sequence: Synthetic polypeptide
DEEEIRTTNPVATEQYGSVLVESTMVEPNMLLVEVA

SEQ ID NO: 122899 - protein, 29 aa, Artificial Sequence
  Description of Artificial Sequence: Synthetic peptide
QEEEIATTNPVATEQYGEANKEVCQHEEK

SEQ ID NO: 122900 - protein, 36 aa, Artificial Sequence
  Description of Artificial Sequence: Synthetic polypeptide
DEEEIRTTNPVATEQYGSVLTTSTAVEIEGLVEVRS

SEQ ID NO: 122901 - protein, 29 aa, Artificial Sequence
  Description of Artificial Sequence: Synthetic peptide
QEEEIATTNPVATEQYGEAPAEMCQHEEK

SEQ ID NO: 122902 - protein, 29 aa, Artificial Sequence
  Description of Artificial Sequence: Synthetic peptide
QEEEIATTNPVATEQYGEAIEVCQEHEEK

SEQ ID NO: 122903 - protein, 29 aa, Artificial Sequence
  Description of Artificial Sequence: Synthetic peptide
QEEEIATTNPVATEQYGEAFEVCQHEEEK

SEQ ID NO: 122904 - protein, 32 aa, Artificial Sequence
  Description of Artificial Sequence: Synthetic polypeptide
DEMEIVTTNPVATECWGTVCSTDGPPQFEGNG

SEQ ID NO: 122905 - protein, 33 aa, Artificial Sequence
  Description of Artificial Sequence: Synthetic polypeptide
DEMEIVTTNPVATECWGTVCSTDNPVQFEGEND

SEQ ID NO: 122906 - protein, 29 aa, Artificial Sequence
  Description of Artificial Sequence: Synthetic peptide
QEEEIATTNPVATEQYGEACEVCQHEEEK

SEQ ID NO: 122907 - protein, 33 aa, Artificial Sequence
  Description of Artificial Sequence: Synthetic polypeptide
DEAEIVTTNPVATEQYGTVCSATDGPVEFEGND

SEQ ID NO: 122908 - protein, 32 aa, Artificial Sequence
  Description of Artificial Sequence: Synthetic polypeptide
DEMEIVTTNPVATECYGDVCSATDGPVEFGND

SEQ ID NO: 122909 - protein, 36 aa, Artificial Sequence
  Description of Artificial Sequence: Synthetic polypeptide
DEEEIRTTNPVATEQYGSVMENTNVQMILVNENLGM

SEQ ID NO: 122910 - protein, 32 aa, Artificial Sequence
  Description of Artificial Sequence: Synthetic polypeptide
DEMEIVTTNPVATECYGDVCSATDCPVEFGND

SEQ ID NO: 122911 - protein, 29 aa, Artificial Sequence
  Description of Artificial Sequence: Synthetic peptide
QEEEIATTNPVATEQYGEACPEVCEHGEK

SEQ ID NO: 122912 - protein, 29 aa, Artificial Sequence
  Description of Artificial Sequence: Synthetic peptide
QEEEIATTNPVATEQYGEACPEVCQFEEK

SEQ ID NO: 122913 - protein, 29 aa, Artificial Sequence
  Description of Artificial Sequence: Synthetic peptide
QEEEIATTNPVATEQYGEACPEVCQHEEK

SEQ ID NO: 122914 - protein, 29 aa, Artificial Sequence
  Description of Artificial Sequence: Synthetic peptide
QEEEIATTNPVATEQYGEACPEVCQHEEQ

SEQ ID NO: 122915 - protein, 36 aa, Artificial Sequence
  Description of Artificial Sequence: Synthetic polypeptide
DEEEIRTTNPVATEQYGSVMENTNVQGITVHENLNE

SEQ ID NO: 122916 - protein, 29 aa, Artificial Sequence
  Description of Artificial Sequence: Synthetic peptide
QEEEIATTNPVATEQYGEACPEVCQHWEK

SEQ ID NO: 122917 - protein, 30 aa, Artificial Sequence
  Description of Artificial Sequence: Synthetic polypeptide
QEEEIATTNPVATEQYGEACPTEVMQHEEK

SEQ ID NO: 122918 - protein, 29 aa, Artificial Sequence
  Description of Artificial Sequence: Synthetic peptide
QEEEIATTNPVATEQYGEAFEVCCQHEEK

SEQ ID NO: 122919 - protein, 33 aa, Artificial Sequence
  Description of Artificial Sequence: Synthetic polypeptide
DEMEIVTTNPVATECWGTVSATINPVQFEGENG

SEQ ID NO: 122920 - protein, 28 aa, Artificial Sequence
  Description of Artificial Sequence: Synthetic peptide
QEEEIATTNPVATEQYGEAFEVCMHEEK

SEQ ID NO: 122921 - protein, 33 aa, Artificial Sequence
  Description of Artificial Sequence: Synthetic polypeptide
DEMEIVTTNPVATECWGTVCSTINPVQFEGEND

SEQ ID NO: 122922 - protein, 33 aa, Artificial Sequence
  Description of Artificial Sequence: Synthetic polypeptide
DEMEIVTTNPVATECWGTVCSTINPPQFEGENG

SEQ ID NO: 122923 - protein, 33 aa, Artificial Sequence
  Description of Artificial Sequence: Synthetic polypeptide
DEMEIVTTNPVATECWGTVCSTINPPQFEGEND

SEQ ID NO: 122924 - protein, 33 aa, Artificial Sequence
  Description of Artificial Sequence: Synthetic polypeptide
DEAEIVTTNPVATEQYGTVCSATDGPVEMEGND

SEQ ID NO: 122925 - protein, 33 aa, Artificial Sequence
  Description of Artificial Sequence: Synthetic polypeptide
DEMEIVTTNPVASEQYGTVCSATDNPVESEGND

SEQ ID NO: 122926 - protein, 29 aa, Artificial Sequence
  Description of Artificial Sequence: Synthetic peptide
QEEEIATTNPVATEQYGEAPAEVCQHEEK

SEQ ID NO: 122927 - protein, 32 aa, Artificial Sequence
  Description of Artificial Sequence: Synthetic polypeptide
DEMEIVTTNPVASEQYGTVCSATDGPVEFGTR

SEQ ID NO: 122928 - protein, 29 aa, Artificial Sequence
  Description of Artificial Sequence: Synthetic peptide
QEEEIATTNPVATEQYGEAPAEVCQHEEN

SEQ ID NO: 122929 - protein, 33 aa, Artificial Sequence
  Description of Artificial Sequence: Synthetic polypeptide
DEAEIVTTNPVATEQYGTVCSATDGYVEFEGND

SEQ ID NO: 122930 - protein, 33 aa, Artificial Sequence
  Description of Artificial Sequence: Synthetic polypeptide
DECEIATTNPVATEPWGSVCYNNDDQDAGHNDR

SEQ ID NO: 122931 - protein, 29 aa, Artificial Sequence
  Description of Artificial Sequence: Synthetic peptide
QEEEIATTNPVATEQYGEAPEAVCQHEEK

SEQ ID NO: 122932 - protein, 33 aa, Artificial Sequence
  Description of Artificial Sequence: Synthetic polypeptide
DEMEIVTTNPSATEQYGTVCSATDGNVEFEGND

SEQ ID NO: 122933 - protein, 29 aa, Artificial Sequence
  Description of Artificial Sequence: Synthetic peptide
QEEEIATTNPVATEQYGEAPECCQHEHEK

SEQ ID NO: 122934 - protein, 29 aa, Artificial Sequence
  Description of Artificial Sequence: Synthetic peptide
QEEEIATTNPVATEQYGEAPECCQNHEEK

SEQ ID NO: 122935 - protein, 28 aa, Artificial Sequence
  Description of Artificial Sequence: Synthetic peptide
QEEEIATTNPVATEQYGEAPECCSHEEK

SEQ ID NO: 122936 - protein, 29 aa, Artificial Sequence
  Description of Artificial Sequence: Synthetic peptide
QEEEIATTNPVATEQYGEAPECVCQAEEK

SEQ ID NO: 122937 - protein, 29 aa, Artificial Sequence
  Description of Artificial Sequence: Synthetic peptide
QEEEIATTNPVATEQYGEAPECVCQHEEK

SEQ ID NO: 122938 - protein, 29 aa, Artificial Sequence
  Description of Artificial Sequence: Synthetic peptide
QEEEIATTNPVATEQYGEAPECVCQHKEK

SEQ ID NO: 122939 - protein, 28 aa, Artificial Sequence
  Description of Artificial Sequence: Synthetic peptide
QEEEIATTNPVATEQYGEAPEDCEHEEK

SEQ ID NO: 122940 - protein, 36 aa, Artificial Sequence
  Description of Artificial Sequence: Synthetic polypeptide
DEEEIRTTNPVATEQYGSVLSVTTGQPQEREESSLL

SEQ ID NO: 122941 - protein, 33 aa, Artificial Sequence
  Description of Artificial Sequence: Synthetic polypeptide
DEMEIVTTNPIATEQYGTVCSATDGPVEREGND

SEQ ID NO: 122942 - protein, 29 aa, Artificial Sequence
  Description of Artificial Sequence: Synthetic peptide
QEEEIATTNPVATEQYGEAPEDCQHEEDK

SEQ ID NO: 122943 - protein, 29 aa, Artificial Sequence
  Description of Artificial Sequence: Synthetic peptide
QEEEIATTNPVATEQYGEAPEDCQHEEKL

SEQ ID NO: 122944 - protein, 29 aa, Artificial Sequence
  Description of Artificial Sequence: Synthetic peptide
QEEEIATTNPVATEQYGEAPEDCQHEWEK

SEQ ID NO: 122945 - protein, 30 aa, Artificial Sequence
  Description of Artificial Sequence: Synthetic polypeptide
QEEEIATTNPVATEQYGEAPEDIQQQHGEH

SEQ ID NO: 122946 - protein, 29 aa, Artificial Sequence
  Description of Artificial Sequence: Synthetic peptide
QEEEIATTNPVATEQYGEAPEDVCQHEEK

SEQ ID NO: 122947 - protein, 29 aa, Artificial Sequence
  Description of Artificial Sequence: Synthetic peptide
QEEEIATTNPVATEQYGEAPEECKQHEEK

SEQ ID NO: 122948 - protein, 29 aa, Artificial Sequence
  Description of Artificial Sequence: Synthetic peptide
QEEEIATTNPVATEQYGEAPEAQCQHEEK

SEQ ID NO: 122949 - protein, 28 aa, Artificial Sequence
  Description of Artificial Sequence: Synthetic peptide
QEEEIATTNPVATEQYGEACEHCAHEEK

SEQ ID NO: 122950 - protein, 29 aa, Artificial Sequence
  Description of Artificial Sequence: Synthetic peptide
QEEEIATTNPVATEQYGEAPEACQHNEEK

SEQ ID NO: 122951 - protein, 36 aa, Artificial Sequence
  Description of Artificial Sequence: Synthetic polypeptide
DEEEIRTTNPVATEQYGSVLTESLAVEPNAILVEVR

SEQ ID NO: 122952 - protein, 33 aa, Artificial Sequence
  Description of Artificial Sequence: Synthetic polypeptide
DEMEIVTTNPVASEQYGTVCSATDGPVEFEGNR

SEQ ID NO: 122953 - protein, 32 aa, Artificial Sequence
  Description of Artificial Sequence: Synthetic polypeptide
DECEIATTNPVATEPYGSVCYNLDHDTGGDDH

SEQ ID NO: 122954 - protein, 30 aa, Artificial Sequence
  Description of Artificial Sequence: Synthetic polypeptide
DESEIASTNPVSTEGYGNAANTLQSRVGQR

SEQ ID NO: 122955 - protein, 29 aa, Artificial Sequence
  Description of Artificial Sequence: Synthetic peptide
QEEEIATTNPVATEQYGEAPAFVCQHEEK

SEQ ID NO: 122956 - protein, 29 aa, Artificial Sequence
  Description of Artificial Sequence: Synthetic peptide
QEEEIATTNPVATEQYGEAPAKVCQHEEK

SEQ ID NO: 122957 - protein, 28 aa, Artificial Sequence
  Description of Artificial Sequence: Synthetic peptide
QEEEIATTNPVATEQYGEAPAVCKHEEK

SEQ ID NO: 122958 - protein, 33 aa, Artificial Sequence
  Description of Artificial Sequence: Synthetic polypeptide
DEMEIVTTNPVASEQYGTVCSATDGLVEFEGND

SEQ ID NO: 122959 - protein, 32 aa, Artificial Sequence
  Description of Artificial Sequence: Synthetic polypeptide
DEMEIVTTNPVAMEQYGTVCSTDGPVEFEGND

SEQ ID NO: 122960 - protein, 29 aa, Artificial Sequence
  Description of Artificial Sequence: Synthetic peptide
QEEEIATTNPVATEQYGEAPAVCQLHEEK

SEQ ID NO: 122961 - protein, 29 aa, Artificial Sequence
  Description of Artificial Sequence: Synthetic peptide
QEEEIATTNPVATEQYGEAPCEVCQHEEK

SEQ ID NO: 122962 - protein, 29 aa, Artificial Sequence
  Description of Artificial Sequence: Synthetic peptide
QEEEIATTNPVATEQYGEAPCEVCQHEEV

SEQ ID NO: 122963 - protein, 30 aa, Artificial Sequence
  Description of Artificial Sequence: Synthetic polypeptide
DESEIASTNPVSTEGYGIVACTIQSRVGQR

SEQ ID NO: 122964 - protein, 29 aa, Artificial Sequence
  Description of Artificial Sequence: Synthetic peptide
QEEEIATTNPVATEQYGEAPCEVCQHHEK

SEQ ID NO: 122965 - protein, 32 aa, Artificial Sequence
  Description of Artificial Sequence: Synthetic polypeptide
DEMEIVTTNPVAHEQYGTVCSTDGPVEFEGND

SEQ ID NO: 122966 - protein, 29 aa, Artificial Sequence
  Description of Artificial Sequence: Synthetic peptide
QEEEIATTNPVATEQYGEAPCEVCQTEEK

SEQ ID NO: 122967 - protein, 29 aa, Artificial Sequence
  Description of Artificial Sequence: Synthetic peptide
QEEEIATTNPVATEQYGEAPCIVCQHEEK

SEQ ID NO: 122968 - protein, 28 aa, Artificial Sequence
  Description of Artificial Sequence: Synthetic peptide
DESEIASTNPVGYEGYGVMASTLQHGDI

SEQ ID NO: 122969 - protein, 29 aa, Artificial Sequence
  Description of Artificial Sequence: Synthetic peptide
QEEEIATTNPVATEQYGEAPDEVCQHEEK

SEQ ID NO: 122970 - protein, 28 aa, Artificial Sequence
  Description of Artificial Sequence: Synthetic peptide
DESEIASTNPVGTSGYGVMASTLQHGDI

SEQ ID NO: 122971 - protein, 29 aa, Artificial Sequence
  Description of Artificial Sequence: Synthetic peptide
QEEEIATTNPVATEQYGEAPEACQHEMEK

SEQ ID NO: 122972 - protein, 29 aa, Artificial Sequence
  Description of Artificial Sequence: Synthetic peptide
QEEEIATTNPVATEQYGEAPEQGCQHEEK

SEQ ID NO: 122973 - protein, 29 aa, Artificial Sequence
  Description of Artificial Sequence: Synthetic peptide
QEEEIATTNPVATEPYGEASEEVCQHEEK

SEQ ID NO: 122974 - protein, 31 aa, Artificial Sequence
  Description of Artificial Sequence: Synthetic polypeptide
DESEIATTNPVATECWGEASENEPQDRGEGG

SEQ ID NO: 122975 - protein, 28 aa, Artificial Sequence
  Description of Artificial Sequence: Synthetic peptide
QEEEIATTNPIATEQYGEAPEVCQIEKK

SEQ ID NO: 122976 - protein, 32 aa, Artificial Sequence
  Description of Artificial Sequence: Synthetic polypeptide
DEMEIVTTNPVATEQYGTMCSATDGPEFEGNI

SEQ ID NO: 122977 - protein, 37 aa, Artificial Sequence
  Description of Artificial Sequence: Synthetic polypeptide
DEEEIRTTNPVATEQYGSVMGTINQYDQQGENGGGQG

SEQ ID NO: 122978 - protein, 31 aa, Artificial Sequence
  Description of Artificial Sequence: Synthetic polypeptide
DECEIATTNPVAYEQWGSCWTDLIDREMNNG

SEQ ID NO: 122979 - protein, 36 aa, Artificial Sequence
  Description of Artificial Sequence: Synthetic polypeptide
DEEEIRTTNPVATEQYGSVMGTIAGNNDGQTENDDT

SEQ ID NO: 122980 - protein, 28 aa, Artificial Sequence
  Description of Artificial Sequence: Synthetic peptide
QEEEIATTNPIATEQYGETAAVWQHEEK

SEQ ID NO: 122981 - protein, 28 aa, Artificial Sequence
  Description of Artificial Sequence: Synthetic peptide
QEEEIATTNPIATEQYGETPAVWQHEEK

SEQ ID NO: 122982 - protein, 28 aa, Artificial Sequence
  Description of Artificial Sequence: Synthetic peptide
QEEEIATTNPIATEQYGETPEVCQHEEK

SEQ ID NO: 122983 - protein, 36 aa, Artificial Sequence
  Description of Artificial Sequence: Synthetic polypeptide
DEEEIRTTNPVATEQYGSVMGTLGLQGQEGGGDIGD

SEQ ID NO: 122984 - protein, 33 aa, Artificial Sequence
  Description of Artificial Sequence: Synthetic polypeptide
CEEEIACTNPVATEQYGCVATNLQENPGEDQHQ

SEQ ID NO: 122985 - protein, 32 aa, Artificial Sequence
  Description of Artificial Sequence: Synthetic polypeptide
DEAEIATTNPVAYEQWGTVCSTENDEHDGNAA

SEQ ID NO: 122986 - protein, 32 aa, Artificial Sequence
  Description of Artificial Sequence: Synthetic polypeptide
DESEIATTNPVATEGYGSVAATDLEDHVGEDL

SEQ ID NO: 122987 - protein, 28 aa, Artificial Sequence
  Description of Artificial Sequence: Synthetic peptide
QEEEIATTNPLATEQYGEAPEVCQHEEK

SEQ ID NO: 122988 - protein, 32 aa, Artificial Sequence
  Description of Artificial Sequence: Synthetic polypeptide
DEMEIVTTNPVATEQYGTISAMDGIVQFNGND

SEQ ID NO: 122989 - protein, 32 aa, Artificial Sequence
  Description of Artificial Sequence: Synthetic polypeptide
DEMEIVTTNPVATEQYGTISAMDGIVQFEGND

SEQ ID NO: 122990 - protein, 33 aa, Artificial Sequence
  Description of Artificial Sequence: Synthetic polypeptide
DECEIATTNPVAYEQWGSACSTNMLMMEDGNTQ

SEQ ID NO: 122991 - protein, 32 aa, Artificial Sequence
  Description of Artificial Sequence: Synthetic polypeptide
DEAEIATTNPVAYEQWGTVCSTENDEHDGANQ

SEQ ID NO: 122992 - protein, 33 aa, Artificial Sequence
  Description of Artificial Sequence: Synthetic polypeptide
DEMEIVTTNPVATEQYGTICSTEGIQQQQEGNH

SEQ ID NO: 122993 - protein, 32 aa, Artificial Sequence
  Description of Artificial Sequence: Synthetic polypeptide
DEMEIVTTNPVATEQYGTISMEDIQQQQEGNH

SEQ ID NO: 122994 - protein, 28 aa, Artificial Sequence
  Description of Artificial Sequence: Synthetic peptide
QEEEIATTNPIATEQYGEAPEVCQHEEK

SEQ ID NO: 122995 - protein, 28 aa, Artificial Sequence
  Description of Artificial Sequence: Synthetic peptide
QEEEIATTNPIATEQYGEAPEVCMHENK

SEQ ID NO: 122996 - protein, 28 aa, Artificial Sequence
  Description of Artificial Sequence: Synthetic peptide
QEEEIATTNPIATEQYGEAPEDCQHEEK

SEQ ID NO: 122997 - protein, 28 aa, Artificial Sequence
  Description of Artificial Sequence: Synthetic peptide
QEEEIATTNPCATEQYGEAPEVCQHEEK

SEQ ID NO: 122998 - protein, 29 aa, Artificial Sequence
  Description of Artificial Sequence: Synthetic peptide
QEEEIATTNPCATEQYGEAPEVCQHENEK

SEQ ID NO: 122999 - protein, 28 aa, Artificial Sequence
  Description of Artificial Sequence: Synthetic peptide
QEEEIATTNPCATEQYGEAPEVCQHREK

SEQ ID NO: 123000 - protein, 36 aa, Artificial Sequence
  Description of Artificial Sequence: Synthetic polypeptide
AEEEIRTTNPVATEQYGSVVTVTNNNLQQNDENNNS

SEQ ID NO: 123001 - protein, 34 aa, Artificial Sequence
  Description of Artificial Sequence: Synthetic polypeptide
QEEEIATTNPCATEQYGSVSSTPALNMSNGMTPR

SEQ ID NO: 123002 - protein, 37 aa, Artificial Sequence
  Description of Artificial Sequence: Synthetic polypeptide
DEEEIRTTNPVATEQYGSVMGTMNQVDQFGENGGGQG

SEQ ID NO: 123003 - protein, 36 aa, Artificial Sequence
  Description of Artificial Sequence: Synthetic polypeptide
DEEEIRTTNPVATEQYGSVMGTMNQQDVGETGGGQG

SEQ ID NO: 123004 - protein, 36 aa, Artificial Sequence
  Description of Artificial Sequence: Synthetic polypeptide
DEEEIRTTNPVATEQYGSVMGTMNQQDDQENGGGQG

SEQ ID NO: 123005 - protein, 34 aa, Artificial Sequence
  Description of Artificial Sequence: Synthetic polypeptide
DEMEIVTTNPVATEQYGTSVCSATDGPVEFEGND

SEQ ID NO: 123006 - protein, 28 aa, Artificial Sequence
  Description of Artificial Sequence: Synthetic peptide
QEEEIATTNPCSTEQYGEASCVCQSEEK

SEQ ID NO: 123007 - protein, 33 aa, Artificial Sequence
  Description of Artificial Sequence: Synthetic polypeptide
DEMEIVTTNPVATEQYGTSCSATDGPVEFEGND

SEQ ID NO: 123008 - protein, 37 aa, Artificial Sequence
  Description of Artificial Sequence: Synthetic polypeptide
DEEEIRTTNPVATEQYGSVMGTMNQADQGGENNGGQG

SEQ ID NO: 123009 - protein, 36 aa, Artificial Sequence
  Description of Artificial Sequence: Synthetic polypeptide
DEEEIRTTNPVATEQYGSVMGTMNDQGGGEDQEVGG

SEQ ID NO: 123010 - protein, 34 aa, Artificial Sequence
  Description of Artificial Sequence: Synthetic polypeptide
QEEEIATTNPCSTEQYGSVSSTPALQMSNGMTPR

SEQ ID NO: 123011 - protein, 28 aa, Artificial Sequence
  Description of Artificial Sequence: Synthetic peptide
QEEEIATTNPHATEQYGEAPEVCQHEEK

SEQ ID NO: 123012 - protein, 37 aa, Artificial Sequence
  Description of Artificial Sequence: Synthetic polypeptide
AEEEIRTTNPVATEQYGSVVTVTNNNGNLQQGTNGTG

SEQ ID NO: 123013 - protein, 31 aa, Artificial Sequence
  Description of Artificial Sequence: Synthetic polypeptide
DECEIATTNPVAYEQWGSTSKTLEDRQNPQG

SEQ ID NO: 123014 - protein, 33 aa, Artificial Sequence
  Description of Artificial Sequence: Synthetic polypeptide
CEEEIACTNPVAYEQYGCVATNLQDRPGEETAN

SEQ ID NO: 123015 - protein, 36 aa, Artificial Sequence
  Description of Artificial Sequence: Synthetic polypeptide
DEEEIRTTNPVATEQYGSVMGTLNADQTQGGGGEGI

SEQ ID NO: 123016 - protein, 33 aa, Artificial Sequence
  Description of Artificial Sequence: Synthetic polypeptide
DEMEIVTTNPVATEQYGTICSTDGIVEQQEGNH

SEQ ID NO: 123017 - protein, 37 aa, Artificial Sequence
  Description of Artificial Sequence: Synthetic polypeptide
DEEEIRTTNPVATEQYGSVMGTNMDTTGQGEVGNGQT

SEQ ID NO: 123018 - protein, 32 aa, Artificial Sequence
  Description of Artificial Sequence: Synthetic polypeptide
DEMEIVTTNPVATEQYGTICSTDGIVEFEGNH

SEQ ID NO: 123019 - protein, 33 aa, Artificial Sequence
  Description of Artificial Sequence: Synthetic polypeptide
DEMEIVTTNPVATEQYGTICSTDGIQEQQEGNH

SEQ ID NO: 123020 - protein, 28 aa, Artificial Sequence
  Description of Artificial Sequence: Synthetic peptide
QEEEIATTNPVASEQYGEAPECCQHEEK

SEQ ID NO: 123021 - protein, 30 aa, Artificial Sequence
  Description of Artificial Sequence: Synthetic polypeptide
DESEIATTNPVATEGWGDVSSTLMNAAGDA

SEQ ID NO: 123022 - protein, 33 aa, Artificial Sequence
  Description of Artificial Sequence: Synthetic polypeptide
DESEIATTNPVATECYGSVSTNEPEDHEGEEDG

SEQ ID NO: 123023 - protein, 32 aa, Artificial Sequence
  Description of Artificial Sequence: Synthetic polypeptide
DEMEIVTTNPVATEQYGTASATDGPVQFEEND

SEQ ID NO: 123024 - protein, 32 aa, Artificial Sequence
  Description of Artificial Sequence: Synthetic polypeptide
DEMEIVTTNPVATEQYGTASATDGPVEHEGND

SEQ ID NO: 123025 - protein, 31 aa, Artificial Sequence
  Description of Artificial Sequence: Synthetic polypeptide
DECEIATTNPVAYEQWGCACTNLMMEDGNTQ

SEQ ID NO: 123026 - protein, 32 aa, Artificial Sequence
  Description of Artificial Sequence: Synthetic polypeptide
DEMEIVTTNPVATEQYGTASATDGPVEFEGND

SEQ ID NO: 123027 - protein, 31 aa, Artificial Sequence
  Description of Artificial Sequence: Synthetic polypeptide
DEMEIVTTNPVATEQYGTAPATDGPQFEEND

SEQ ID NO: 123028 - protein, 28 aa, Artificial Sequence
  Description of Artificial Sequence: Synthetic peptide
QEEEIATTNPVAIEQYGEAPLVCQHEEK

SEQ ID NO: 123029 - protein, 32 aa, Artificial Sequence
  Description of Artificial Sequence: Synthetic polypeptide
DECEIATTNPVAYEPWGSATTNLQGNAGENED

SEQ ID NO: 123030 - protein, 36 aa, Artificial Sequence
  Description of Artificial Sequence: Synthetic polypeptide
DEEEIRTTNPVATEQYGSVMGTDNMEQNEGGGFSEA

SEQ ID NO: 123031 - protein, 32 aa, Artificial Sequence
  Description of Artificial Sequence: Synthetic polypeptide
DECEIATTNPVAYEPWGEVCSTNDQHGQGNQL

SEQ ID NO: 123032 - protein, 36 aa, Artificial Sequence
  Description of Artificial Sequence: Synthetic polypeptide
DEEEIRTTNPVATEQYGSVMGTDEMNQENDGGNGQD

SEQ ID NO: 123033 - protein, 28 aa, Artificial Sequence
  Description of Artificial Sequence: Synthetic peptide
QEEEIATTNPVATAQYGEAPEVCQHEEH

SEQ ID NO: 123034 - protein, 33 aa, Artificial Sequence
  Description of Artificial Sequence: Synthetic polypeptide
DEMEIVTTNPVATEQYGTACSATDNPVEFEGND

SEQ ID NO: 123035 - protein, 28 aa, Artificial Sequence
  Description of Artificial Sequence: Synthetic peptide
QEEEIATTNPVATAQYGEAPEVCQHEEK

SEQ ID NO: 123036 - protein, 28 aa, Artificial Sequence
  Description of Artificial Sequence: Synthetic peptide
QEEEIATTNPVATAQYGEAPEVNQHEEK

SEQ ID NO: 123037 - protein, 33 aa, Artificial Sequence
  Description of Artificial Sequence: Synthetic polypeptide
DEMEIVTTNPVATEQYGTACSATDGPVQFEGND

SEQ ID NO: 123038 - protein, 32 aa, Artificial Sequence
  Description of Artificial Sequence: Synthetic polypeptide
DEMEIVTTNPVATEQYGTACSEDGPVQFEGND

SEQ ID NO: 123039 - protein, 32 aa, Artificial Sequence
  Description of Artificial Sequence: Synthetic polypeptide
DESEIATTNPVATEGWGNVSNITEQDREGENG

SEQ ID NO: 123040 - protein, 28 aa, Artificial Sequence
  Description of Artificial Sequence: Synthetic peptide
QEEEIATTNPVAHEQYGEAPEVCQHEEK

SEQ ID NO: 123041 - protein, 34 aa, Artificial Sequence
  Description of Artificial Sequence: Synthetic polypeptide
DEMEIVTTNPVATEQYGTCVCSATDGNVVFEGND

SEQ ID NO: 123042 - protein, 32 aa, Artificial Sequence
  Description of Artificial Sequence: Synthetic polypeptide
DEMEIVTTNPVATEQYGTICSMEGIVEQEGND

SEQ ID NO: 123043 - protein, 28 aa, Artificial Sequence
  Description of Artificial Sequence: Synthetic peptide
QEEEIATTNPLATEQYGEAPEVCQHVEK

SEQ ID NO: 123044 - protein, 28 aa, Artificial Sequence
  Description of Artificial Sequence: Synthetic peptide
QEEEIATTNPMATEQYGEAPEVCQHEEK

SEQ ID NO: 123045 - protein, 32 aa, Artificial Sequence
  Description of Artificial Sequence: Synthetic polypeptide
DESEIATTNPVATEGYGNVAATDLQSHVGEDL

SEQ ID NO: 123046 - protein, 29 aa, Artificial Sequence
  Description of Artificial Sequence: Synthetic peptide
DESEIATTNPVATEGYGEAAEVIQHVGEK

SEQ ID NO: 123047 - protein, 28 aa, Artificial Sequence
  Description of Artificial Sequence: Synthetic peptide
QEEEIATTNPMATEQYGEAPEVCQHLEK

SEQ ID NO: 123048 - protein, 28 aa, Artificial Sequence
  Description of Artificial Sequence: Synthetic peptide
QEEEIATTNPNATEQYGEAPESVQHEEK

SEQ ID NO: 123049 - protein, 28 aa, Artificial Sequence
  Description of Artificial Sequence: Synthetic peptide
QEEEIATTNPNATEQYGEAPEVCQHEEK

SEQ ID NO: 123050 - protein, 28 aa, Artificial Sequence
  Description of Artificial Sequence: Synthetic peptide
QEEEIATTNPTATEQYGEAPEVCQHEEK

SEQ ID NO: 123051 - protein, 29 aa, Artificial Sequence
  Description of Artificial Sequence: Synthetic peptide
DESEIATTNPVATEGWGVVSEIEMNAGDA

SEQ ID NO: 123052 - protein, 33 aa, Artificial Sequence
  Description of Artificial Sequence: Synthetic polypeptide
DEMEIVTTNPVATEQYGTHCSATDFPQEHEGND

SEQ ID NO: 123053 - protein, 28 aa, Artificial Sequence
  Description of Artificial Sequence: Synthetic peptide
QEEEIATTNPTATEQYGEAPEVCQHLEK

SEQ ID NO: 123054 - protein, 29 aa, Artificial Sequence
  Description of Artificial Sequence: Synthetic peptide
DESEIATTNPVATEGWGVVAETLMNAGDA

SEQ ID NO: 123055 - protein, 28 aa, Artificial Sequence
  Description of Artificial Sequence: Synthetic peptide
QEEEIATTNPVACEQYGEAPEVCQHEEK

SEQ ID NO: 123056 - protein, 28 aa, Artificial Sequence
  Description of Artificial Sequence: Synthetic peptide
QEEEIATTNPVAFEQYGEAPEVCQHEEK

SEQ ID NO: 123057 - protein, 28 aa, Artificial Sequence
  Description of Artificial Sequence: Synthetic peptide
QEEEIATTNPVAFEQYGEAPEVCQHEEV

SEQ ID NO: 123058 - protein, 28 aa, Artificial Sequence
  Description of Artificial Sequence: Synthetic peptide
QEEEIATTNPVAFEQYGEAPYVCQHEEK

SEQ ID NO: 123059 - protein, 28 aa, Artificial Sequence
  Description of Artificial Sequence: Synthetic peptide
QEEEIATTNPVAFEQYGEAQEVCQHEEK

SEQ ID NO: 123060 - protein, 28 aa, Artificial Sequence
  Description of Artificial Sequence: Synthetic peptide
QEEEIATTNPVAGEQYGEIPEVCQHEEK

SEQ ID NO: 123061 - protein, 33 aa, Artificial Sequence
  Description of Artificial Sequence: Synthetic polypeptide
DEMEIVTTNPVATEQYGTICSTDGIQQQQEGNH

SEQ ID NO: 123062 - protein, 29 aa, Artificial Sequence
  Description of Artificial Sequence: Synthetic peptide
DESEIATTNPVATEGYGVMASDLAEPGDI

SEQ ID NO: 123063 - protein, 29 aa, Artificial Sequence
  Description of Artificial Sequence: Synthetic peptide
DESEIATTNPVATEGYGVTASDLAEPGPI

SEQ ID NO: 123064 - protein, 34 aa, Artificial Sequence
  Description of Artificial Sequence: Synthetic polypeptide
DECEIATTNPVAYEQWGSVCSGVNWQGDAGNGER

SEQ ID NO: 123065 - protein, 32 aa, Artificial Sequence
  Description of Artificial Sequence: Synthetic polypeptide
DEMEIVTTNPVATEQYGTVCPATGPVEFEGND

SEQ ID NO: 123066 - protein, 28 aa, Artificial Sequence
  Description of Artificial Sequence: Synthetic peptide
QEEEIASVNPVATEQYGEVPEVCQSEEK

SEQ ID NO: 123067 - protein, 32 aa, Artificial Sequence
  Description of Artificial Sequence: Synthetic polypeptide
DEMEIVTTNPVATEQYGTVCPATDGPEFEGND

SEQ ID NO: 123068 - protein, 36 aa, Artificial Sequence
  Description of Artificial Sequence: Synthetic polypeptide
DEQEIRTTNPVATEQYGSVSSATPDLPNMREGMEPV

SEQ ID NO: 123069 - protein, 31 aa, Artificial Sequence
  Description of Artificial Sequence: Synthetic polypeptide
DEEEIATTNPVATEPYGTASMEVIQQQQGEK

SEQ ID NO: 123070 - protein, 34 aa, Artificial Sequence
  Description of Artificial Sequence: Synthetic polypeptide
DEEEIRTTNPVATEQYGSVMPCEENLEMLVMEGD

SEQ ID NO: 123071 - protein, 28 aa, Artificial Sequence
  Description of Artificial Sequence: Synthetic peptide
QEEEIASVNPVCTECYGVVSDCLQSEEQ

SEQ ID NO: 123072 - protein, 28 aa, Artificial Sequence
  Description of Artificial Sequence: Synthetic peptide
QEEEIASVNPVCTECYGVVSECLQHEEQ

SEQ ID NO: 123073 - protein, 30 aa, Artificial Sequence
  Description of Artificial Sequence: Synthetic polypeptide
DEEEIATTNPVATEPYGTASMEVCQQQEEK

SEQ ID NO: 123074 - protein, 33 aa, Artificial Sequence
  Description of Artificial Sequence: Synthetic polypeptide
DEMEIVTTNPVATEQYGTVCMATDGPQEFEGND

SEQ ID NO: 123075 - protein, 30 aa, Artificial Sequence
  Description of Artificial Sequence: Synthetic polypeptide
CEEEIASVNPVCTEQYGVVCSWEDQSGSNQ

SEQ ID NO: 123076 - protein, 33 aa, Artificial Sequence
  Description of Artificial Sequence: Synthetic polypeptide
DESEIATTNPVATEQWGSVSATIDEPQDHEGEG

SEQ ID NO: 123077 - protein, 31 aa, Artificial Sequence
  Description of Artificial Sequence: Synthetic polypeptide
CEEEIASVNPVCTEAYGVVSCINLSQSGGNQ

SEQ ID NO: 123078 - protein, 34 aa, Artificial Sequence
  Description of Artificial Sequence: Synthetic polypeptide
DECEIATTNPVAYEQWGSVSTGIGLNAGEEDSNR

SEQ ID NO: 123079 - protein, 28 aa, Artificial Sequence
  Description of Artificial Sequence: Synthetic peptide
QEEEIASVNPVCTEQYGEVPDVLQSEEQ

SEQ ID NO: 123080 - protein, 34 aa, Artificial Sequence
  Description of Artificial Sequence: Synthetic polypeptide
DESEIATTNPVATEQWGSVSATDLPQDHEGEEDL

SEQ ID NO: 123081 - protein, 33 aa, Artificial Sequence
  Description of Artificial Sequence: Synthetic polypeptide
DEMEIVTTNPVATEQYGTVCIATDGPREFEGND

SEQ ID NO: 123082 - protein, 36 aa, Artificial Sequence
  Description of Artificial Sequence: Synthetic polypeptide
AEEEIRTTNPVATEQYGSVVTVTNQLGNEQGNNIGD

SEQ ID NO: 123083 - protein, 28 aa, Artificial Sequence
  Description of Artificial Sequence: Synthetic peptide
QEEEIASVNPVCTECYGVVSECLQSEEQ

SEQ ID NO: 123084 - protein, 35 aa, Artificial Sequence
  Description of Artificial Sequence: Synthetic polypeptide
DEEEIRTTNPVATEQYGSVMSDFAEFGVGEEENGQ

SEQ ID NO: 123085 - protein, 33 aa, Artificial Sequence
  Description of Artificial Sequence: Synthetic polypeptide
DESEIATTNPVATEQWGSVSATIDLEDHEGEDL

SEQ ID NO: 123086 - protein, 36 aa, Artificial Sequence
  Description of Artificial Sequence: Synthetic polypeptide
DEEEIRTTNPVATEQYGSVMSDMFNQNDEFGNIGGS

SEQ ID NO: 123087 - protein, 32 aa, Artificial Sequence
  Description of Artificial Sequence: Synthetic polypeptide
DEMEIVTTNPVATEQYGTVCSAEDGPEFEGND

SEQ ID NO: 123088 - protein, 36 aa, Artificial Sequence
  Description of Artificial Sequence: Synthetic polypeptide
DEEEIRTTNPVATEQYGSVMSGINMDLGEGEDIEGD

SEQ ID NO: 123089 - protein, 33 aa, Artificial Sequence
  Description of Artificial Sequence: Synthetic polypeptide
DEMEIVTTNPVATEQYGTVCSADDGPVQFEGND

SEQ ID NO: 123090 - protein, 35 aa, Artificial Sequence
  Description of Artificial Sequence: Synthetic polypeptide
DEQEIRTTNPVATEQYGSVSSATPDLNMHEGMEPL

SEQ ID NO: 123091 - protein, 36 aa, Artificial Sequence
  Description of Artificial Sequence: Synthetic polypeptide
DEEEIRTTNPVATEQYGSVMSGINEDLGEGESTEGD

SEQ ID NO: 123092 - protein, 28 aa, Artificial Sequence
  Description of Artificial Sequence: Synthetic peptide
QEEEIASTNPVGTEQYGEAPEVLQHEEK

SEQ ID NO: 123093 - protein, 33 aa, Artificial Sequence
  Description of Artificial Sequence: Synthetic polypeptide
DEMEIVTTNPVATEQYGTVCSACDGPVEREGND

SEQ ID NO: 123094 - protein, 33 aa, Artificial Sequence
  Description of Artificial Sequence: Synthetic polypeptide
QEEEIASTNPVGTEQYGSVSSTTTLPQHNGMDV

SEQ ID NO: 123095 - protein, 28 aa, Artificial Sequence
  Description of Artificial Sequence: Synthetic peptide
QEEEIASTNPVGTEQYGVAAEVLQHEEI

SEQ ID NO: 123096 - protein, 28 aa, Artificial Sequence
  Description of Artificial Sequence: Synthetic peptide
QEEEIASTNPVGTEQYGVAAEVLQHEEK

SEQ ID NO: 123097 - protein, 36 aa, Artificial Sequence
  Description of Artificial Sequence: Synthetic polypeptide
DEEEIRTTNPVATEQYGSVMSGIDINDLGEGEGFGI

SEQ ID NO: 123098 - protein, 28 aa, Artificial Sequence
  Description of Artificial Sequence: Synthetic peptide
QEEEIASTNPVGTEQYGVMASTCQHEDI

SEQ ID NO: 123099 - protein, 36 aa, Artificial Sequence
  Description of Artificial Sequence: Synthetic polypeptide
DEEEIRTTNPVATEQYGSVMSDTQIQGGQEDDDDGT

SEQ ID NO: 123100 - protein, 33 aa, Artificial Sequence
  Description of Artificial Sequence: Synthetic polypeptide
DECEIATTNPVAYEQWGSVYTNLMMEDGNNGTQ

SEQ ID NO: 123101 - protein, 36 aa, Artificial Sequence
  Description of Artificial Sequence: Synthetic polypeptide
DEEEIRTTNPVATEQYGSVMSDTIMGGQEDDDDNGA

SEQ ID NO: 123102 - protein, 35 aa, Artificial Sequence
  Description of Artificial Sequence: Synthetic polypeptide
DEEEIRTTNPVATEQYGSVMSDTIEGDQEDDDIFG

SEQ ID NO: 123103 - protein, 37 aa, Artificial Sequence
  Description of Artificial Sequence: Synthetic polypeptide
AEEEIRTTNPVATEQYGSVVTVTNQQLGNQQGNNTGD

SEQ ID NO: 123104 - protein, 28 aa, Artificial Sequence
  Description of Artificial Sequence: Synthetic peptide
QEEEIASTNPVSTEQYGEVPEVIQHEQK

SEQ ID NO: 123105 - protein, 28 aa, Artificial Sequence
  Description of Artificial Sequence: Synthetic peptide
QEEEIASTNPVSTEQYGNVPEVIQHEQK

SEQ ID NO: 123106 - protein, 30 aa, Artificial Sequence
  Description of Artificial Sequence: Synthetic polypeptide
DEEEIATTNPVATEPYGTISEEVCQQQEEH

SEQ ID NO: 123107 - protein, 36 aa, Artificial Sequence
  Description of Artificial Sequence: Synthetic polypeptide
DEEEIRTTNPVATEQYGSVMIHTIVAENEQQLGEEG

SEQ ID NO: 123108 - protein, 34 aa, Artificial Sequence
  Description of Artificial Sequence: Synthetic polypeptide
DEQEIRTTNPVATEQYGSVSSTTAGPEDHEGEPL

SEQ ID NO: 123109 - protein, 33 aa, Artificial Sequence
  Description of Artificial Sequence: Synthetic polypeptide
DESEIATTNPVATEQWGSVSATDLPEDHEGEDL

SEQ ID NO: 123110 - protein, 28 aa, Artificial Sequence
  Description of Artificial Sequence: Synthetic peptide
QEEEIATTNPAATEQYGEAPRVCQHEEK

SEQ ID NO: 123111 - protein, 33 aa, Artificial Sequence
  Description of Artificial Sequence: Synthetic polypeptide
DEMEIVTTNPVATEQYGTVASATDGPVEFEGNI

SEQ ID NO: 123112 - protein, 33 aa, Artificial Sequence
  Description of Artificial Sequence: Synthetic polypeptide
DECEIATTNPVAYEQWGSVSCTNLDGDGGHSQQ

SEQ ID NO: 123113 - protein, 33 aa, Artificial Sequence
  Description of Artificial Sequence: Synthetic polypeptide
DEMEIVTTNPVATEQYGTVASATDGPVEFEGND

SEQ ID NO: 123114 - protein, 29 aa, Artificial Sequence
  Description of Artificial Sequence: Synthetic peptide
QEEEIATTNPAATEQYGEAPTEVCQHEEK

SEQ ID NO: 123115 - protein, 28 aa, Artificial Sequence
  Description of Artificial Sequence: Synthetic peptide
QEEEIATTNPAATEQYGEAPWVCQHEEK

SEQ ID NO: 123116 - protein, 36 aa, Artificial Sequence
  Description of Artificial Sequence: Synthetic polypeptide
DEQEIRTTNPVATEQYGSVSSTTPWMPNMENGMNPV

SEQ ID NO: 123117 - protein, 30 aa, Artificial Sequence
  Description of Artificial Sequence: Synthetic polypeptide
DESEIATTNPVATEQWGDVSETIMNAAEDA

SEQ ID NO: 123118 - protein, 35 aa, Artificial Sequence
  Description of Artificial Sequence: Synthetic polypeptide
DEEEIRTTNPVATEQYGSVMGTQNAMTEEGGEEEM

SEQ ID NO: 123119 - protein, 35 aa, Artificial Sequence
  Description of Artificial Sequence: Synthetic polypeptide
DEQEIRTTNPVATEQYGSVSSVDNNTQEEGSEEGI

SEQ ID NO: 123120 - protein, 36 aa, Artificial Sequence
  Description of Artificial Sequence: Synthetic polypeptide
DEQEIRTTNPVATEQYGSVSTCLDAIEIEGMQNGQI

SEQ ID NO: 123121 - protein, 30 aa, Artificial Sequence
  Description of Artificial Sequence: Synthetic polypeptide
DESEIATTNPVATEQWGDVSEIEQNAAEDI

SEQ ID NO: 123122 - protein, 33 aa, Artificial Sequence
  Description of Artificial Sequence: Synthetic polypeptide
DESEIATTNPVATEPYGSVCYNNDNQDGGQNDG

SEQ ID NO: 123123 - protein, 33 aa, Artificial Sequence
  Description of Artificial Sequence: Synthetic polypeptide
DECEIATTNPVAYEQWGSVSCNLMMLEDGDNTQ

SEQ ID NO: 123124 - protein, 32 aa, Artificial Sequence
  Description of Artificial Sequence: Synthetic polypeptide
DESEIATTNPVATEMWGSVSAAADAQHGNDSP

SEQ ID NO: 123125 - protein, 33 aa, Artificial Sequence
  Description of Artificial Sequence: Synthetic polypeptide
CEEEIACTNPVAYEQYGSVATNLADTPGEDQRE

SEQ ID NO: 123126 - protein, 36 aa, Artificial Sequence
  Description of Artificial Sequence: Synthetic polypeptide
AEEEIRTTNPVATEQYGSVVTVTNNQAGNEQGNQDE

SEQ ID NO: 123127 - protein, 34 aa, Artificial Sequence
  Description of Artificial Sequence: Synthetic polypeptide
DECEIATTNPVAYEQWGSVCSTQNPDQGEGNNNG

SEQ ID NO: 123128 - protein, 33 aa, Artificial Sequence
  Description of Artificial Sequence: Synthetic polypeptide
DECEIATTNPVAYEQWGSVCSTNDHDHPNGDER

SEQ ID NO: 123129 - protein, 28 aa, Artificial Sequence
  Description of Artificial Sequence: Synthetic peptide
QEEEIATCNPVATEQYGEAPEVCQHEEK

SEQ ID NO: 123130 - protein, 34 aa, Artificial Sequence
  Description of Artificial Sequence: Synthetic polypeptide
DESEIATTNPVATECYGSVSATNLPEDHEGEEDL

SEQ ID NO: 123131 - protein, 36 aa, Artificial Sequence
  Description of Artificial Sequence: Synthetic polypeptide
DEEEIRTTNPVATEQYGSVMGTQNDQGGGEDTETGG

SEQ ID NO: 123132 - protein, 36 aa, Artificial Sequence
  Description of Artificial Sequence: Synthetic polypeptide
DEEEIRTTNPVATEQYGSVMGTTNMEGQIGQGGEGQ

SEQ ID NO: 123133 - protein, 34 aa, Artificial Sequence
  Description of Artificial Sequence: Synthetic polypeptide
DECEIATTNPVAYEQWGSVSTGIGLNAGEDNQRN

SEQ ID NO: 123134 - protein, 35 aa, Artificial Sequence
  Description of Artificial Sequence: Synthetic polypeptide
DEQEIRTTNPVATEQYGSVSSTTAGPEDREGMEPL

SEQ ID NO: 123135 - protein, 35 aa, Artificial Sequence
  Description of Artificial Sequence: Synthetic polypeptide
DEQEIRTTNPVATEQYGSVSSTTAGPEMREGMEPL

SEQ ID NO: 123136 - protein, 33 aa, Artificial Sequence
  Description of Artificial Sequence: Synthetic polypeptide
DEMEIVTTNPVATEQYGTVCDATDNPVEFEGND

SEQ ID NO: 123137 - protein, 36 aa, Artificial Sequence
  Description of Artificial Sequence: Synthetic polypeptide
DEEEIRTTNPVATEQYGSVMGVTANDDQEEGEEVIE

SEQ ID NO: 123138 - protein, 33 aa, Artificial Sequence
  Description of Artificial Sequence: Synthetic polypeptide
DEEEIRTTNPVATEQYGSVMGVMVEGGGGQTTF

SEQ ID NO: 123139 - protein, 33 aa, Artificial Sequence
  Description of Artificial Sequence: Synthetic polypeptide
DEEEIRTTNPVATEQYGSVMGVMVEGGGDTGTE

SEQ ID NO: 123140 - protein, 33 aa, Artificial Sequence
  Description of Artificial Sequence: Synthetic polypeptide
DESEIATTNPVATEQWGSVSATDEPEDHEGNDL

SEQ ID NO: 123141 - protein, 35 aa, Artificial Sequence
  Description of Artificial Sequence: Synthetic polypeptide
DEEEIRTTNPVATEQYGSVMGVGGNDQEEGGEEIV

SEQ ID NO: 123142 - protein, 35 aa, Artificial Sequence
  Description of Artificial Sequence: Synthetic polypeptide
DEEEIRTTNPVATEQYGSVMGVFEQDQGNEGGVQE

SEQ ID NO: 123143 - protein, 33 aa, Artificial Sequence
  Description of Artificial Sequence: Synthetic polypeptide
DESEIATTNPVATEQWGSVSACIDEPQDREGEG

SEQ ID NO: 123144 - protein, 36 aa, Artificial Sequence
  Description of Artificial Sequence: Synthetic polypeptide
AEEEIRTTNPVATEQYGSVVTVTNNQLGGNEQGNNN

SEQ ID NO: 123145 - protein, 37 aa, Artificial Sequence
  Description of Artificial Sequence: Synthetic polypeptide
AEEEIRTTNPVATEQYGSVVTVTNNQGNLQQGTNNIN

SEQ ID NO: 123146 - protein, 33 aa, Artificial Sequence
  Description of Artificial Sequence: Synthetic polypeptide
DECEIATTNPVAYEQWGSVSTGIGLNAGEDGMR

SEQ ID NO: 123147 - protein, 36 aa, Artificial Sequence
  Description of Artificial Sequence: Synthetic polypeptide
DEQEIRTTNPVATEQYGSVSSTTPAGPNMHNGMNDV

SEQ ID NO: 123148 - protein, 36 aa, Artificial Sequence
  Description of Artificial Sequence: Synthetic polypeptide
DEQEIRTTNPVATEQYGSVSSTTPAGPNMRNGMNPV

SEQ ID NO: 123149 - protein, 35 aa, Artificial Sequence
  Description of Artificial Sequence: Synthetic polypeptide
DEEEIRTTNPVATEQYGSVMGTTQNAFTGGGGETG

SEQ ID NO: 123150 - protein, 36 aa, Artificial Sequence
  Description of Artificial Sequence: Synthetic polypeptide
DEEEIRTTNPVATEQYGSVMGTTNMEQNIGGGFQEE

SEQ ID NO: 123151 - protein, 31 aa, Artificial Sequence
  Description of Artificial Sequence: Synthetic polypeptide
DESEIATTNPVATEQWGSASCIVCPQREEEG

SEQ ID NO: 123152 - protein, 36 aa, Artificial Sequence
  Description of Artificial Sequence: Synthetic polypeptide
DEEEIRTTNPVATEQYGSVMGTQNNDQGTFNFGQGD

SEQ ID NO: 123153 - protein, 30 aa, Artificial Sequence
  Description of Artificial Sequence: Synthetic polypeptide
DESEIATTNPVATECWGEASCIVCQREENK

SEQ ID NO: 123154 - protein, 28 aa, Artificial Sequence
  Description of Artificial Sequence: Synthetic peptide
QEEEIATTNPVATDQYGEAPEVCQHEEK

SEQ ID NO: 123155 - protein, 36 aa, Artificial Sequence
  Description of Artificial Sequence: Synthetic polypeptide
AEEEIRTTNPVATEQYGSVVTVTNNLLGNEQGNNVE

SEQ ID NO: 123156 - protein, 33 aa, Artificial Sequence
  Description of Artificial Sequence: Synthetic polypeptide
DEMEIVTTNPVATEQYGHVCSATDGPVEFEGND

SEQ ID NO: 123157 - protein, 34 aa, Artificial Sequence
  Description of Artificial Sequence: Synthetic polypeptide
DEEEIRTTNPVATEQYGSVMGPEMNGEMGEIGGT

SEQ ID NO: 123158 - protein, 34 aa, Artificial Sequence
  Description of Artificial Sequence: Synthetic polypeptide
DECEIATTNPVATESYGSVSGGNQGNAQGNDNQR

SEQ ID NO: 123159 - protein, 33 aa, Artificial Sequence
  Description of Artificial Sequence: Synthetic polypeptide
DECEIATTNPVATESYGSVCYNNDHRDTGGDDR

SEQ ID NO: 123160 - protein, 33 aa, Artificial Sequence
  Description of Artificial Sequence: Synthetic polypeptide
DEMEIVTTNPVATEQYGGVCSATIGPVEFEGND

SEQ ID NO: 123161 - protein, 33 aa, Artificial Sequence
  Description of Artificial Sequence: Synthetic polypeptide
DEMEIVTTNPVATEQYGGVCSATDGPVEFEGNV

SEQ ID NO: 123162 - protein, 33 aa, Artificial Sequence
  Description of Artificial Sequence: Synthetic polypeptide
DEMEIVTTNPVATEQYGGVCSATDGPVEFEGND

SEQ ID NO: 123163 - protein, 33 aa, Artificial Sequence
  Description of Artificial Sequence: Synthetic polypeptide
DEMEIVTTNPVATEQYGFVCSATGGPVEFEGND

SEQ ID NO: 123164 - protein, 28 aa, Artificial Sequence
  Description of Artificial Sequence: Synthetic peptide
QEEEIATTNPVATEHYGEAPEVCQHEEK

SEQ ID NO: 123165 - protein, 33 aa, Artificial Sequence
  Description of Artificial Sequence: Synthetic polypeptide
DEMEIVTTNPVATEQYGFVCSATDGPVEFMGND

SEQ ID NO: 123166 - protein, 32 aa, Artificial Sequence
  Description of Artificial Sequence: Synthetic polypeptide
DESEIATTNPVATECWGSMACINEPQDREGNI

SEQ ID NO: 123167 - protein, 32 aa, Artificial Sequence
  Description of Artificial Sequence: Synthetic polypeptide
DESEIATTNPVATECWGSMACINEPQDREGNG

SEQ ID NO: 123168 - protein, 33 aa, Artificial Sequence
  Description of Artificial Sequence: Synthetic polypeptide
DEMEIVTTNPVATEQYGFVCSATDGPVEFEGNN

SEQ ID NO: 123169 - protein, 33 aa, Artificial Sequence
  Description of Artificial Sequence: Synthetic polypeptide
DEMEIVTTNPVATEQYGFVCSATDGPVEFEGND

SEQ ID NO: 123170 - protein, 34 aa, Artificial Sequence
  Description of Artificial Sequence: Synthetic polypeptide
DEEEIRTTNPVATEQYGSVMGNVMVNGGGQTETA

SEQ ID NO: 123171 - protein, 28 aa, Artificial Sequence
  Description of Artificial Sequence: Synthetic peptide
QEEEIATTNPVATEIYGEAPEVCQHEEK

SEQ ID NO: 123172 - protein, 29 aa, Artificial Sequence
  Description of Artificial Sequence: Synthetic peptide
DEMEIVTTNPVATEQYGEVPAEVCEHEEK

SEQ ID NO: 123173 - protein, 32 aa, Artificial Sequence
  Description of Artificial Sequence: Synthetic polypeptide
DECEIATTNPVATEQYMTVSATDLEDHEGEDL

SEQ ID NO: 123174 - protein, 33 aa, Artificial Sequence
  Description of Artificial Sequence: Synthetic polypeptide
DEMEIVTTNPVATEQYGFVCSATDGPVEFEGNT

SEQ ID NO: 123175 - protein, 33 aa, Artificial Sequence
  Description of Artificial Sequence: Synthetic polypeptide
DEMEIVTTNPVATEQYGHVQSATDGPVEFEGND

SEQ ID NO: 123176 - protein, 33 aa, Artificial Sequence
  Description of Artificial Sequence: Synthetic polypeptide
DEMEIVTTNPVATEQYGIVCSATDGGVEFEGND

SEQ ID NO: 123177 - protein, 33 aa, Artificial Sequence
  Description of Artificial Sequence: Synthetic polypeptide
DEMEIVTTNPVATEQYGIVCSATDGPEEFEGND

SEQ ID NO: 123178 - protein, 33 aa, Artificial Sequence
  Description of Artificial Sequence: Synthetic polypeptide
DEMEIVTTNPVATEQYGLVCSATWGPVEFEGND

SEQ ID NO: 123179 - protein, 33 aa, Artificial Sequence
  Description of Artificial Sequence: Synthetic polypeptide
DEMEIVTTNPVATEQYGLVCSATDGPVEFEGND

SEQ ID NO: 123180 - protein, 33 aa, Artificial Sequence
  Description of Artificial Sequence: Synthetic polypeptide
DESEIATTNPVATECWGSVSCIDEPQDREGENG

SEQ ID NO: 123181 - protein, 32 aa, Artificial Sequence
  Description of Artificial Sequence: Synthetic polypeptide
DESEIATTNPVATECWGSVSCICEPQREGEEL

SEQ ID NO: 123182 - protein, 37 aa, Artificial Sequence
  Description of Artificial Sequence: Synthetic polypeptide
AEEEIRTTNPVATEQYGSVVTVTNLQLGNEQGTNDED

SEQ ID NO: 123183 - protein, 33 aa, Artificial Sequence
  Description of Artificial Sequence: Synthetic polypeptide
DESEIATTNPVATECWGSVSCICEPQDREGENL

SEQ ID NO: 123184 - protein, 33 aa, Artificial Sequence
  Description of Artificial Sequence: Synthetic polypeptide
DEMEIVTTNPVATEQYGKVCSATDGPVEFEGND

SEQ ID NO: 123185 - protein, 34 aa, Artificial Sequence
  Description of Artificial Sequence: Synthetic polypeptide
DEAEIATTNPVAYEQWGSVSGNPNGQTDRGNNEY

SEQ ID NO: 123186 - protein, 33 aa, Artificial Sequence
  Description of Artificial Sequence: Synthetic polypeptide
DEMEIVTTNPVATEQYGKVCSATDGPDEFEGND

SEQ ID NO: 123187 - protein, 33 aa, Artificial Sequence
  Description of Artificial Sequence: Synthetic polypeptide
DEMEIVTTNPVATEQYGKVCSATDGEVEFEGNT

SEQ ID NO: 123188 - protein, 35 aa, Artificial Sequence
  Description of Artificial Sequence: Synthetic polypeptide
DEEEIRTTNPVATEQYGSVMGQDDEGGNDQDDANN

SEQ ID NO: 123189 - protein, 35 aa, Artificial Sequence
  Description of Artificial Sequence: Synthetic polypeptide
DEEEIRTTNPVATEQYGSVMGQAMNSEGGNGGEEE

SEQ ID NO: 123190 - protein, 35 aa, Artificial Sequence
  Description of Artificial Sequence: Synthetic polypeptide
DEEEIRTTNPVATEQYGSVMGPNNIVQTGEFTGGG

SEQ ID NO: 123191 - protein, 37 aa, Artificial Sequence
  Description of Artificial Sequence: Synthetic polypeptide
DEEEIRTTNPVATEQYGTVSTTDQAGNTEQLGVTNQE

SEQ ID NO: 123192 - protein, 30 aa, Artificial Sequence
  Description of Artificial Sequence: Synthetic polypeptide
DESEIATTNPVATECWGSVPEVEQDREEEK

SEQ ID NO: 123193 - protein, 30 aa, Artificial Sequence
  Description of Artificial Sequence: Synthetic polypeptide
DESEIATTNPVATECWGSVPCVEQDREEEK

SEQ ID NO: 123194 - protein, 33 aa, Artificial Sequence
  Description of Artificial Sequence: Synthetic polypeptide
DEAEIATTNPVAYEQWGSVSGNNNEQGGMNGGH

SEQ ID NO: 123195 - protein, 36 aa, Artificial Sequence
  Description of Artificial Sequence: Synthetic polypeptide
AEEEIRTTNPVATEQYGSVVTVTNLLGGTEQGTTNQ

SEQ ID NO: 123196 - protein, 33 aa, Artificial Sequence
  Description of Artificial Sequence: Synthetic polypeptide
DEMEIVTTNPVATEQYGIVCSATDGPVEFEGND

SEQ ID NO: 123197 - protein, 28 aa, Artificial Sequence
  Description of Artificial Sequence: Synthetic peptide
QEEEIATTNPVATEKYGEAPEVCQHEEK

SEQ ID NO: 123198 - protein, 33 aa, Artificial Sequence
  Description of Artificial Sequence: Synthetic polypeptide
DECEIATTNPVATEWWGSVCYNNDLQDHGGQDR

SEQ ID NO: 123199 - protein, 30 aa, Artificial Sequence
  Description of Artificial Sequence: Synthetic polypeptide
DEMEIVTTNPVATEQYGEVPAEDVPEFEND

SEQ ID NO: 123200 - protein, 31 aa, Artificial Sequence
  Description of Artificial Sequence: Synthetic polypeptide
DEMEIVTTNPVATEQYGEVCSTDVCEFEEEK

SEQ ID NO: 123201 - protein, 28 aa, Artificial Sequence
  Description of Artificial Sequence: Synthetic peptide
QEEEIATTNPVATENYGEAPEVCQHHEK

SEQ ID NO: 123202 - protein, 28 aa, Artificial Sequence
  Description of Artificial Sequence: Synthetic peptide
QEEEIATTNPVATENYGEAPKVCQHEEK

SEQ ID NO: 123203 - protein, 33 aa, Artificial Sequence
  Description of Artificial Sequence: Synthetic polypeptide
DEMEIVTTNPVATEQYGDVCSATDGPVEFEGND

SEQ ID NO: 123204 - protein, 33 aa, Artificial Sequence
  Description of Artificial Sequence: Synthetic polypeptide
DEMEIVTTNPVATEQYGDVCSATDGPVEFAGND

SEQ ID NO: 123205 - protein, 31 aa, Artificial Sequence
  Description of Artificial Sequence: Synthetic polypeptide
DEMEIVTTNPVATEQYGDVCSAEIPMAEENA

SEQ ID NO: 123206 - protein, 34 aa, Artificial Sequence
  Description of Artificial Sequence: Synthetic polypeptide
DECEIATTNPVATEQYGSVCSATCDLEDHEGEDL

SEQ ID NO: 123207 - protein, 35 aa, Artificial Sequence
  Description of Artificial Sequence: Synthetic polypeptide
DEEEIRTTNPVATEQYGSVMGNNMNSEGGNNDTEE

SEQ ID NO: 123208 - protein, 31 aa, Artificial Sequence
  Description of Artificial Sequence: Synthetic polypeptide
DEMEIVTTNPVATEQYGDVCSAEGPMAEEND

SEQ ID NO: 123209 - protein, 28 aa, Artificial Sequence
  Description of Artificial Sequence: Synthetic peptide
QEEEIATTNPVATENYGEAPEVCQHEEK

SEQ ID NO: 123210 - protein, 28 aa, Artificial Sequence
  Description of Artificial Sequence: Synthetic peptide
QEEEIATTNPVATEPYGEAPEDCQQEEK

SEQ ID NO: 123211 - protein, 28 aa, Artificial Sequence
  Description of Artificial Sequence: Synthetic peptide
QEEEIATTNPVATEPYGEAPEVCQHEEK

SEQ ID NO: 123212 - protein, 29 aa, Artificial Sequence
  Description of Artificial Sequence: Synthetic peptide
QEEEIATTNPVATEPYGEAPEVCQHNGEK

SEQ ID NO: 123213 - protein, 33 aa, Artificial Sequence
  Description of Artificial Sequence: Synthetic polypeptide
DEMEIVTTNPVATEQYGCVCSTTMPPVEFEGND

SEQ ID NO: 123214 - protein, 28 aa, Artificial Sequence
  Description of Artificial Sequence: Synthetic peptide
QEEEIATTNPVATEPYGEAPEVCQHTEK

SEQ ID NO: 123215 - protein, 33 aa, Artificial Sequence
  Description of Artificial Sequence: Synthetic polypeptide
DEMEIVTTNPVATEQYGCVCSTTDEPNEFFGDQ

SEQ ID NO: 123216 - protein, 28 aa, Artificial Sequence
  Description of Artificial Sequence: Synthetic peptide
QEEEIATTNPVATEPYGEAPEVCQQEEK

SEQ ID NO: 123217 - protein, 29 aa, Artificial Sequence
  Description of Artificial Sequence: Synthetic peptide
QEEEIATTNPVATEPYGEAPEVIQHNGEK

SEQ ID NO: 123218 - protein, 35 aa, Artificial Sequence
  Description of Artificial Sequence: Synthetic polypeptide
DEQEIRTTNPVATEQYGSVSVDVNTNIAEGGEEHT

SEQ ID NO: 123219 - protein, 33 aa, Artificial Sequence
  Description of Artificial Sequence: Synthetic polypeptide
DEMEIVTTNPVATEQYGCVCSYTDEPVEFSGND

SEQ ID NO: 123220 - protein, 35 aa, Artificial Sequence
  Description of Artificial Sequence: Synthetic polypeptide
AEEEIRTTNPVATEQYGSVVTVTDGQNNNLGGNDD

SEQ ID NO: 123221 - protein, 34 aa, Artificial Sequence
  Description of Artificial Sequence: Synthetic polypeptide
DEEEIRTTNPVATEQYGSVMGNNMNSEPGGGGGN

SEQ ID NO: 123222 - protein, 36 aa, Artificial Sequence
  Description of Artificial Sequence: Synthetic polypeptide
AEEEIRTTNPVATEQYGSVVTVTNDQLGNEQGTEDE

SEQ ID NO: 123223 - protein, 32 aa, Artificial Sequence
  Description of Artificial Sequence: Synthetic polypeptide
DEMEIVTTNPVATEQYGEVCSATVCVEFEENK

SEQ ID NO: 123224 - protein, 33 aa, Artificial Sequence
  Description of Artificial Sequence: Synthetic polypeptide
DEMEIVTTNPVATEQYGEVCSATDVPVEFEGNK

SEQ ID NO: 123225 - protein, 33 aa, Artificial Sequence
  Description of Artificial Sequence: Synthetic polypeptide
DEMEIVTTNPVATEQYGEVCSATDVPVEFEGND

SEQ ID NO: 123226 - protein, 33 aa, Artificial Sequence
  Description of Artificial Sequence: Synthetic polypeptide
DEMEIVTTNPVATEQYGEVCSATDVCVEFEGNK

SEQ ID NO: 123227 - protein, 28 aa, Artificial Sequence
  Description of Artificial Sequence: Synthetic peptide
QEEEIATTNPVATEKYGEAPEVCQHPEK

SEQ ID NO: 123228 - protein, 33 aa, Artificial Sequence
  Description of Artificial Sequence: Synthetic polypeptide
DEMEIVTTNPVATEQYGEVCSATDGPVEFLGND

SEQ ID NO: 123229 - protein, 33 aa, Artificial Sequence
  Description of Artificial Sequence: Synthetic polypeptide
DEMEIVTTNPVATEQYGEVCSATDGPVEFEGNN

SEQ ID NO: 123230 - protein, 36 aa, Artificial Sequence
  Description of Artificial Sequence: Synthetic polypeptide
DEQEIRTTNPVATEQYGSVSTVLDANEDEGMQKGQI

SEQ ID NO: 123231 - protein, 33 aa, Artificial Sequence
  Description of Artificial Sequence: Synthetic polypeptide
DEMEIVTTNPVATEQYGEVCSATDGPVEFEGND

SEQ ID NO: 123232 - protein, 33 aa, Artificial Sequence
  Description of Artificial Sequence: Synthetic polypeptide
DEMEIVTTNPVATEQYGEVCSATDGCVEFEGNK

SEQ ID NO: 123233 - protein, 28 aa, Artificial Sequence
  Description of Artificial Sequence: Synthetic peptide
QEEEIATTNPVATEKYGEAPEVGQHEEK

SEQ ID NO: 123234 - protein, 32 aa, Artificial Sequence
  Description of Artificial Sequence: Synthetic polypeptide
DESEIATTNPVATECWGSASCINEPQDRGEGG

SEQ ID NO: 123235 - protein, 33 aa, Artificial Sequence
  Description of Artificial Sequence: Synthetic polypeptide
DEAEIATTNPVAYEQWGSVSGNNDQQGGMNGGH

SEQ ID NO: 123236 - protein, 30 aa, Artificial Sequence
  Description of Artificial Sequence: Synthetic polypeptide
DEMEIVTTNPVATEQYGEACSEVPVEHGEK

SEQ ID NO: 123237 - protein, 28 aa, Artificial Sequence
  Description of Artificial Sequence: Synthetic peptide
QEEEIATTNPVATEMYGEAPEVCQHEEK

SEQ ID NO: 123238 - protein, 33 aa, Artificial Sequence
  Description of Artificial Sequence: Synthetic polypeptide
DEAEIATTNPVAYEQWGSVSGNDLGNTNGGNTK

SEQ ID NO: 123239 - protein, 28 aa, Artificial Sequence
  Description of Artificial Sequence: Synthetic peptide
QEEEIATTNPVATEMYGEAPEVNQHEEK

SEQ ID NO: 123240 - protein, 28 aa, Artificial Sequence
  Description of Artificial Sequence: Synthetic peptide
QEEEIATTNPVATEMYGETPEVCQHEEK

SEQ ID NO: 123241 - protein, 32 aa, Artificial Sequence
  Description of Artificial Sequence: Synthetic polypeptide
DEMEIVTTNPVATEQYGDVSATDGPVEAAENA

SEQ ID NO: 123242 - protein, 30 aa, Artificial Sequence
  Description of Artificial Sequence: Synthetic polypeptide
DEMEIVTTNPVATEQYGEVPAEDGPEFEND

SEQ ID NO: 123243 - protein, 33 aa, Artificial Sequence
  Description of Artificial Sequence: Synthetic polypeptide
DEMEIVTTNPVATEQYGLVCSKTDGPVEFEGND

SEQ ID NO: 123244 - protein, 33 aa, Artificial Sequence
  Description of Artificial Sequence: Synthetic polypeptide
DESEIATTNPVATECWGSVSCINEPQDHEGENG

SEQ ID NO: 123245 - protein, 31 aa, Artificial Sequence
  Description of Artificial Sequence: Synthetic polypeptide
QEEEIATTNPVATEGYGNAAANTCQSRVGQK

SEQ ID NO: 123246 - protein, 35 aa, Artificial Sequence
  Description of Artificial Sequence: Synthetic polypeptide
DEMEIVTTNPVATEQYGSVCSATPAGPEMREGNPV

SEQ ID NO: 123247 - protein, 32 aa, Artificial Sequence
  Description of Artificial Sequence: Synthetic polypeptide
DESEIATTNPVATECYGEVSCIVEPQHEGENG

SEQ ID NO: 123248 - protein, 34 aa, Artificial Sequence
  Description of Artificial Sequence: Synthetic polypeptide
DEAEIATTNPVAYEQWGSVSTNLNQGAMGGDGSM

SEQ ID NO: 123249 - protein, 28 aa, Artificial Sequence
  Description of Artificial Sequence: Synthetic peptide
QEEEIATTNPVATECYGEAPEVCQHEEL

SEQ ID NO: 123250 - protein, 29 aa, Artificial Sequence
  Description of Artificial Sequence: Synthetic peptide
QEEEIATTNPVATECYGEAPEVCQHGEYK

SEQ ID NO: 123251 - protein, 33 aa, Artificial Sequence
  Description of Artificial Sequence: Synthetic polypeptide
DEMEIVTTNPVATEQYGSVCSATDPVEFEGEDL

SEQ ID NO: 123252 - protein, 38 aa, Artificial Sequence
  Description of Artificial Sequence: Synthetic polypeptide
DEEEIRTTNPVATEQYGTVSTNLQYGNNNQNGNNNANT

SEQ ID NO: 123253 - protein, 34 aa, Artificial Sequence
  Description of Artificial Sequence: Synthetic polypeptide
DEEEIRTTNPVATEQYGSVMGQVMNEGGNGDGEQ

SEQ ID NO: 123254 - protein, 34 aa, Artificial Sequence
  Description of Artificial Sequence: Synthetic polypeptide
DEMEIVTTNPVATEQYGSVCSATPAPPEFEGNPV

SEQ ID NO: 123255 - protein, 33 aa, Artificial Sequence
  Description of Artificial Sequence: Synthetic polypeptide
QEEEIATTNPVATECYGEVSCINEPQDHEGENG

SEQ ID NO: 123256 - protein, 32 aa, Artificial Sequence
  Description of Artificial Sequence: Synthetic polypeptide
DESEIATTNPVATECWGVVSCNEPQDSEGENG

SEQ ID NO: 123257 - protein, 34 aa, Artificial Sequence
  Description of Artificial Sequence: Synthetic polypeptide
DEMEIVTTNPVATEQYGSVCSATDLVEDFEGEDL

SEQ ID NO: 123258 - protein, 33 aa, Artificial Sequence
  Description of Artificial Sequence: Synthetic polypeptide
CEEEIACTNPVATEQYGSVCSTNPQQEHADTMK

SEQ ID NO: 123259 - protein, 33 aa, Artificial Sequence
  Description of Artificial Sequence: Synthetic polypeptide
DESEIATTNPVATECWGVVSCINEPQDREGENG

SEQ ID NO: 123260 - protein, 34 aa, Artificial Sequence
  Description of Artificial Sequence: Synthetic polypeptide
DEMEIVTTNPVATEQYGSVCSATDGPVEFFEGND

SEQ ID NO: 123261 - protein, 33 aa, Artificial Sequence
  Description of Artificial Sequence: Synthetic polypeptide
DESEIATTNPVATECWGSVWCINEPQDREGENG

SEQ ID NO: 123262 - protein, 30 aa, Artificial Sequence
  Description of Artificial Sequence: Synthetic polypeptide
QEEEIATTNPVATECYGEVSEIVEQHEEEK

SEQ ID NO: 123263 - protein, 34 aa, Artificial Sequence
  Description of Artificial Sequence: Synthetic polypeptide
DEMEIVTTNPVATEQYGSVCSATDGPVEDFEGND

SEQ ID NO: 123264 - protein, 33 aa, Artificial Sequence
  Description of Artificial Sequence: Synthetic polypeptide
DESEIATTNPVATECYGEVSCIVEPQDREGENG

SEQ ID NO: 123265 - protein, 34 aa, Artificial Sequence
  Description of Artificial Sequence: Synthetic polypeptide
DEMEIVTTNPVATEQYGSVCSATPGPPEFEGNPD

SEQ ID NO: 123266 - protein, 34 aa, Artificial Sequence
  Description of Artificial Sequence: Synthetic polypeptide
DEMEIVTTNPVATEQYGSVCSATPGPPEFEGNPV

SEQ ID NO: 123267 - protein, 34 aa, Artificial Sequence
  Description of Artificial Sequence: Synthetic polypeptide
DEAEIATTNPVAYEQWGSVSTNLNQGAMGGDMTN

SEQ ID NO: 123268 - protein, 33 aa, Artificial Sequence
  Description of Artificial Sequence: Synthetic polypeptide
DECEIATTNPVAYEKWGSVATNLNRGEGQNGGS

SEQ ID NO: 123269 - protein, 36 aa, Artificial Sequence
  Description of Artificial Sequence: Synthetic polypeptide
AEEEIRTTNPVATEQYGSVVTVTNNLGGTEQGTVNQ

SEQ ID NO: 123270 - protein, 35 aa, Artificial Sequence
  Description of Artificial Sequence: Synthetic polypeptide
DEAEIATTNPVAYEQWGSVVSTNNTLGEDIGGNAR

SEQ ID NO: 123271 - protein, 34 aa, Artificial Sequence
  Description of Artificial Sequence: Synthetic polypeptide
DEMEIVTTNPVATEQYGSVSSTTPAGVNFEGMNV

SEQ ID NO: 123272 - protein, 34 aa, Artificial Sequence
  Description of Artificial Sequence: Synthetic polypeptide
DESEIATTNPVATECYGSVSACINEPQDREGEEG

SEQ ID NO: 123273 - protein, 34 aa, Artificial Sequence
  Description of Artificial Sequence: Synthetic polypeptide
DEMEIVTTNPVATEQYGSVSSTTDGGVNFEGMNV

SEQ ID NO: 123274 - protein, 34 aa, Artificial Sequence
  Description of Artificial Sequence: Synthetic polypeptide
DEMEIVTTNPVATEQYGSVSSTTDGGVNFEGMND

SEQ ID NO: 123275 - protein, 34 aa, Artificial Sequence
  Description of Artificial Sequence: Synthetic polypeptide
DEMEIVTTNPVATEQYGSVSSTTDAGVEFEGMNV

SEQ ID NO: 123276 - protein, 33 aa, Artificial Sequence
  Description of Artificial Sequence: Synthetic polypeptide
DESEIATTNPVATECYGSVPCINEPQDHEGENG

SEQ ID NO: 123277 - protein, 33 aa, Artificial Sequence
  Description of Artificial Sequence: Synthetic polypeptide
DECEIATTNPVAYEHWGSVATNLQGDAGNNNQH

SEQ ID NO: 123278 - protein, 33 aa, Artificial Sequence
  Description of Artificial Sequence: Synthetic polypeptide
DEMEIVTTNPVATEQYGSVSATDPVEDHEGEDD

SEQ ID NO: 123279 - protein, 32 aa, Artificial Sequence
  Description of Artificial Sequence: Synthetic polypeptide
DESEIATTNPVATECYGSAPCINEPQDHEGNG

SEQ ID NO: 123280 - protein, 33 aa, Artificial Sequence
  Description of Artificial Sequence: Synthetic polypeptide
DEMEIVTTNPVATEQYGSVSATDGPVEFEGEDD

SEQ ID NO: 123281 - protein, 32 aa, Artificial Sequence
  Description of Artificial Sequence: Synthetic polypeptide
QEEEIATTNPVATECYGDVSTTCLPQHNEMEV

SEQ ID NO: 123282 - protein, 34 aa, Artificial Sequence
  Description of Artificial Sequence: Synthetic polypeptide
DEAEIATTNPVAYEQWGSVSWGNGNLQDSGGNDS

SEQ ID NO: 123283 - protein, 28 aa, Artificial Sequence
  Description of Artificial Sequence: Synthetic peptide
QEEEIATTNPVATECYGEAPECCQHEEK

SEQ ID NO: 123284 - protein, 28 aa, Artificial Sequence
  Description of Artificial Sequence: Synthetic peptide
QEEEIATTNPVATECYGEAPEVCQHEEK

SEQ ID NO: 123285 - protein, 34 aa, Artificial Sequence
  Description of Artificial Sequence: Synthetic polypeptide
DEMEIVTTNPVATEQYGSVSATDDLVEDHEGEDL

SEQ ID NO: 123286 - protein, 33 aa, Artificial Sequence
  Description of Artificial Sequence: Synthetic polypeptide
DESEIATTNPVATECYGNVSACITEQDRVGENG

SEQ ID NO: 123287 - protein, 34 aa, Artificial Sequence
  Description of Artificial Sequence: Synthetic polypeptide
DEMEIVTTNPVATEQYGSVCSATDGPPEFEGNPD

SEQ ID NO: 123288 - protein, 33 aa, Artificial Sequence
  Description of Artificial Sequence: Synthetic polypeptide
CEEEIACTNPVATEQYGSVCSANPPQEHGTEMK

SEQ ID NO: 123289 - protein, 33 aa, Artificial Sequence
  Description of Artificial Sequence: Synthetic polypeptide
DEMEIVTTNPVATEQYGSVCSATDDPVEFEGEL

SEQ ID NO: 123290 - protein, 36 aa, Artificial Sequence
  Description of Artificial Sequence: Synthetic polypeptide
DEEEIRTTNPVATEQYGSVMGQSEGNLDEDEGGQSI

SEQ ID NO: 123291 - protein, 34 aa, Artificial Sequence
  Description of Artificial Sequence: Synthetic polypeptide
CEEEIACTNPVATEQYGSVCATNLAPDEQMGDLH

SEQ ID NO: 123292 - protein, 33 aa, Artificial Sequence
  Description of Artificial Sequence: Synthetic polypeptide
DESEIATTNPVATECWGSVSCINEPVDREGENG

SEQ ID NO: 123293 - protein, 33 aa, Artificial Sequence
  Description of Artificial Sequence: Synthetic polypeptide
DESEIATTNPVATECWGSVSCINEPQDSEGETR

SEQ ID NO: 123294 - protein, 35 aa, Artificial Sequence
  Description of Artificial Sequence: Synthetic polypeptide
DEEEIRTTNPVATEQYGSVMGQNMEDEGGEDNVTQ

SEQ ID NO: 123295 - protein, 30 aa, Artificial Sequence
  Description of Artificial Sequence: Synthetic polypeptide
QEEEIATTNPVATEGYGEAPETCQSRVGEK

SEQ ID NO: 123296 - protein, 33 aa, Artificial Sequence
  Description of Artificial Sequence: Synthetic polypeptide
DESEIATTNPVATECWGSVSCINEPQDSEGENG

SEQ ID NO: 123297 - protein, 28 aa, Artificial Sequence
  Description of Artificial Sequence: Synthetic peptide
QEEEIATTNPVATEGYGEAPEVCQHEEK

SEQ ID NO: 123298 - protein, 33 aa, Artificial Sequence
  Description of Artificial Sequence: Synthetic polypeptide
DESEIATTNPVATECWGSVSCINEPQDREGEQG

SEQ ID NO: 123299 - protein, 28 aa, Artificial Sequence
  Description of Artificial Sequence: Synthetic peptide
QEEEIATTNPVATEGYGEAPEVCQHEEL

SEQ ID NO: 123300 - protein, 34 aa, Artificial Sequence
  Description of Artificial Sequence: Synthetic polypeptide
DEEEIRTTNPVATEQYGSVMGQNMEDEGGEDIAV

SEQ ID NO: 123301 - protein, 32 aa, Artificial Sequence
  Description of Artificial Sequence: Synthetic polypeptide
DECEIATTNPVAVEQYGTVSATDLEDHEGEDL

SEQ ID NO: 123302 - protein, 28 aa, Artificial Sequence
  Description of Artificial Sequence: Synthetic peptide
QEEEIATTNPVATEGYGEAPEVIQHEEK

SEQ ID NO: 123303 - protein, 33 aa, Artificial Sequence
  Description of Artificial Sequence: Synthetic polypeptide
DEMEIVTTNPVATEQYGMVCSATDGPVEFEGND

SEQ ID NO: 123304 - protein, 33 aa, Artificial Sequence
  Description of Artificial Sequence: Synthetic polypeptide
DEMEIVTTNPVATEQYGMVCSATDGEVEFEGND

SEQ ID NO: 123305 - protein, 28 aa, Artificial Sequence
  Description of Artificial Sequence: Synthetic peptide
QEEEIATTNPVATEGYGEAPEVIQHEQK

SEQ ID NO: 123306 - protein, 28 aa, Artificial Sequence
  Description of Artificial Sequence: Synthetic peptide
QEEEIATTNPVATEGYGEAPLVCQHEEK

SEQ ID NO: 123307 - protein, 28 aa, Artificial Sequence
  Description of Artificial Sequence: Synthetic peptide
QEEEIATTNPVATEGYGEMAETCQHEEK

SEQ ID NO: 123308 - protein, 33 aa, Artificial Sequence
  Description of Artificial Sequence: Synthetic polypeptide
DESEIATTNPVATECWGSVSCINEPQDREGEEL

SEQ ID NO: 123309 - protein, 30 aa, Artificial Sequence
  Description of Artificial Sequence: Synthetic polypeptide
QEEEIATTNPVATEGYGNAAAETCQSRGQK

SEQ ID NO: 123310 - protein, 33 aa, Artificial Sequence
  Description of Artificial Sequence: Synthetic polypeptide
DEMEIVTTNPVATEQYGNVCSATDGPVEFEGND

SEQ ID NO: 123311 - protein, 28 aa, Artificial Sequence
  Description of Artificial Sequence: Synthetic peptide
QEEEIATTNPVATEAYGEAPEVCQHEEK

SEQ ID NO: 123312 - protein, 28 aa, Artificial Sequence
  Description of Artificial Sequence: Synthetic peptide
QEEEIATTNPVATEGYGEAPETCQHEEK

SEQ ID NO: 123313 - protein, 33 aa, Artificial Sequence
  Description of Artificial Sequence: Synthetic polypeptide
DEMEIVTTNPVATEQYGNVCSATDHPVEFEGND

SEQ ID NO: 123314 - protein, 33 aa, Artificial Sequence
  Description of Artificial Sequence: Synthetic polypeptide
DEMEIVTTNPVATEQYGSVCSACIGPVEFEGND

SEQ ID NO: 123315 - protein, 35 aa, Artificial Sequence
  Description of Artificial Sequence: Synthetic polypeptide
DEEEIRTTNPVATEQYGSVMGQPGEDGQGEGENTQ

SEQ ID NO: 123316 - protein, 34 aa, Artificial Sequence
  Description of Artificial Sequence: Synthetic polypeptide
DEMEIVTTNPVATEQYGSTVCSKTDGPVEFEGND

SEQ ID NO: 123317 - protein, 34 aa, Artificial Sequence
  Description of Artificial Sequence: Synthetic polypeptide
DEMEIVTTNPVATEQYGSTVCSATDGPVEFEGND

SEQ ID NO: 123318 - protein, 33 aa, Artificial Sequence
  Description of Artificial Sequence: Synthetic polypeptide
DEMEIVTTNPVATEQYGRVCSATDGPVEFEGND

SEQ ID NO: 123319 - protein, 33 aa, Artificial Sequence
  Description of Artificial Sequence: Synthetic polypeptide
DEMEIVTTNPVATEQYGQVCSITDGPDEFEGND

SEQ ID NO: 123320 - protein, 34 aa, Artificial Sequence
  Description of Artificial Sequence: Synthetic polypeptide
CEEEIACTNPVATEQYGSVCATNPMQQGNQTEGD

SEQ ID NO: 123321 - protein, 33 aa, Artificial Sequence
  Description of Artificial Sequence: Synthetic polypeptide
DEMEIVTTNPVATEQYGQVCSATDSPVEFEGND

SEQ ID NO: 123322 - protein, 33 aa, Artificial Sequence
  Description of Artificial Sequence: Synthetic polypeptide
DEMEIVTTNPVATEQYGQVCSATDGPVEFEGND

SEQ ID NO: 123323 - protein, 34 aa, Artificial Sequence
  Description of Artificial Sequence: Synthetic polypeptide
DEMEIVTTNPVATEQYGQTVCSATDGPVQFEGND

SEQ ID NO: 123324 - protein, 35 aa, Artificial Sequence
  Description of Artificial Sequence: Synthetic polypeptide
DEEEIRTTNPVATEQYGSVMGQNMNEEGGNGDDED

SEQ ID NO: 123325 - protein, 37 aa, Artificial Sequence
  Description of Artificial Sequence: Synthetic polypeptide
AEEEIRTTNPVATEQYGSVVTVTNLQQGNDEQGTNDE

SEQ ID NO: 123326 - protein, 35 aa, Artificial Sequence
  Description of Artificial Sequence: Synthetic polypeptide
DEEEIRTTNPVATEQYGSVMGQNMEDEGGENNQNV

SEQ ID NO: 123327 - protein, 33 aa, Artificial Sequence
  Description of Artificial Sequence: Synthetic polypeptide
DECEIATTNPVAYEGWGSVATENGGNQNDGNNR

SEQ ID NO: 123328 - protein, 28 aa, Artificial Sequence
  Description of Artificial Sequence: Synthetic peptide
QEEEIATTNPVATEEYGEAPEVCQHEEQ

SEQ ID NO: 123329 - protein, 28 aa, Artificial Sequence
  Description of Artificial Sequence: Synthetic peptide
QEEEIATTNPVATEEYGEAPEVCQSEEK

SEQ ID NO: 123330 - protein, 32 aa, Artificial Sequence
  Description of Artificial Sequence: Synthetic polypeptide
DECEIATTNPVAYEGWGSVATDNGNQNDGNNA

SEQ ID NO: 123331 - protein, 28 aa, Artificial Sequence
  Description of Artificial Sequence: Synthetic peptide
QEEEIATTNPVATEGYGEAAETCQHEEK

SEQ ID NO: 123332 - protein, 33 aa, Artificial Sequence
  Description of Artificial Sequence: Synthetic polypeptide
DEAEIATTNPVAYEQWGSVSGPNLGGQTNGGEM

SEQ ID NO: 123333 - protein, 29 aa, Artificial Sequence
  Description of Artificial Sequence: Synthetic peptide
QEEEIATTNPVATEGYGEAPAEVCQREEK

SEQ ID NO: 123334 - protein, 28 aa, Artificial Sequence
  Description of Artificial Sequence: Synthetic peptide
QEEEIATTNPVATEQYGEAPEQPRHEEK

SEQ ID NO: 123335 - protein, 29 aa, Artificial Sequence
  Description of Artificial Sequence: Synthetic peptide
QEEEIATTNPVATEQYGEAPEQVCQHEEK

SEQ ID NO: 123336 - protein, 29 aa, Artificial Sequence
  Description of Artificial Sequence: Synthetic peptide
QEEEIATTNPVATEQYGEAPEQVCQHETK

SEQ ID NO: 123337 - protein, 33 aa, Artificial Sequence
  Description of Artificial Sequence: Synthetic polypeptide
DEQNEIATTNPVAYEQWGSVTTALNQGDGMEGR

SEQ ID NO: 123338 - protein, 32 aa, Artificial Sequence
  Description of Artificial Sequence: Synthetic polypeptide
DEQNIATTNPVAGEQYGSVSATGLEDHEGEDM

SEQ ID NO: 123339 - protein, 35 aa, Artificial Sequence
  Description of Artificial Sequence: Synthetic polypeptide
CSEEIRTTNPVGYERYGESVSTNAPSQRNGGDNRS

SEQ ID NO: 123340 - protein, 33 aa, Artificial Sequence
  Description of Artificial Sequence: Synthetic polypeptide
DEQNIATTNPVATEQYGSVMSATDLEDHEGEDL

SEQ ID NO: 123341 - protein, 29 aa, Artificial Sequence
  Description of Artificial Sequence: Synthetic peptide
QEEEIATTNPVATEQYGEAPEVSCQHEEK

SEQ ID NO: 123342 - protein, 34 aa, Artificial Sequence
  Description of Artificial Sequence: Synthetic polypeptide
DEMEIRTTNPVATEQYGTVCSATPGPVEFEGNPD

SEQ ID NO: 123343 - protein, 31 aa, Artificial Sequence
  Description of Artificial Sequence: Synthetic polypeptide
QEEEIATTNPVATEQYGEAPEVSCRQQHEEK

SEQ ID NO: 123344 - protein, 36 aa, Artificial Sequence
  Description of Artificial Sequence: Synthetic polypeptide
DEEEIRTTNPVATEQYGSVISVGNNMDLGEGGDSEG

SEQ ID NO: 123345 - protein, 34 aa, Artificial Sequence
  Description of Artificial Sequence: Synthetic polypeptide
DESEAIRTTNPVATECWGSVSCINEPQDLEGENG

SEQ ID NO: 123346 - protein, 29 aa, Artificial Sequence
  Description of Artificial Sequence: Synthetic peptide
QEEEIATTNPVATEQYGEAPEVTCQCEEK

SEQ ID NO: 123347 - protein, 32 aa, Artificial Sequence
  Description of Artificial Sequence: Synthetic polypeptide
DEQNIATTNPVATEQYGSVSAKDLEDHEGEDL

SEQ ID NO: 123348 - protein, 29 aa, Artificial Sequence
  Description of Artificial Sequence: Synthetic peptide
QEEEIATTNPVATEQYGEAPEVTCQHEEK

SEQ ID NO: 123349 - protein, 29 aa, Artificial Sequence
  Description of Artificial Sequence: Synthetic peptide
QEEEIATTNPVATEQYGEAPEVTQHCEEK

SEQ ID NO: 123350 - protein, 34 aa, Artificial Sequence
  Description of Artificial Sequence: Synthetic polypeptide
DESEAIRTTNPVATECWGFVSCINEPQDREGENG

SEQ ID NO: 123351 - protein, 32 aa, Artificial Sequence
  Description of Artificial Sequence: Synthetic polypeptide
DEQNIATTNPVATEQYGSVSATDLEDHEYEDL

SEQ ID NO: 123352 - protein, 32 aa, Artificial Sequence
  Description of Artificial Sequence: Synthetic polypeptide
DEQNIATTNPVATFQYGSVSATDLEDHEGEDL

SEQ ID NO: 123353 - protein, 34 aa, Artificial Sequence
  Description of Artificial Sequence: Synthetic polypeptide
DESEAINTTNPVATECWGSVSCINEPQDREGENG

SEQ ID NO: 123354 - protein, 36 aa, Artificial Sequence
  Description of Artificial Sequence: Synthetic polypeptide
DEEEIRTTNPVATEQYGTVYEICPTLELQPRENHES

SEQ ID NO: 123355 - protein, 35 aa, Artificial Sequence
  Description of Artificial Sequence: Synthetic polypeptide
DEEEIRTTNPVATEQYGTVVSTTGDTGEGGGENNE

SEQ ID NO: 123356 - protein, 33 aa, Artificial Sequence
  Description of Artificial Sequence: Synthetic polypeptide
DEAEIATTNPVAYEQWGHSISATANLPTAPNSR

SEQ ID NO: 123357 - protein, 33 aa, Artificial Sequence
  Description of Artificial Sequence: Synthetic polypeptide
DEAVIRTTNPVATEQYGCVCETNPQEYFNSNQA

SEQ ID NO: 123358 - protein, 33 aa, Artificial Sequence
  Description of Artificial Sequence: Synthetic polypeptide
DEQMIATTNPVATEQYGSVSATDLEDHEGEEDL

SEQ ID NO: 123359 - protein, 35 aa, Artificial Sequence
  Description of Artificial Sequence: Synthetic polypeptide
DEEEIRTTNPVATEQYGSVISVTEVGPEVGMQEHP

SEQ ID NO: 123360 - protein, 35 aa, Artificial Sequence
  Description of Artificial Sequence: Synthetic polypeptide
DEEEIRTTNPVATEQYGTVVDGMTNQGNGDENEQE

SEQ ID NO: 123361 - protein, 29 aa, Artificial Sequence
  Description of Artificial Sequence: Synthetic peptide
QEEEIATTNPVATEQYGEAPEVRCQHEEK

SEQ ID NO: 123362 - protein, 35 aa, Artificial Sequence
  Description of Artificial Sequence: Synthetic polypeptide
DEEEIATTNPVATEQWGSVSGTGQDGDTGNNTPRD

SEQ ID NO: 123363 - protein, 33 aa, Artificial Sequence
  Description of Artificial Sequence: Synthetic polypeptide
DEMEIRTTNPVATEQYGTVCVATDGPVEFEGND

SEQ ID NO: 123364 - protein, 33 aa, Artificial Sequence
  Description of Artificial Sequence: Synthetic polypeptide
DEQLIATTNPVATEQYGSVSATDLEDHEGEDLL

SEQ ID NO: 123365 - protein, 35 aa, Artificial Sequence
  Description of Artificial Sequence: Synthetic polypeptide
DEEEIRTTNPVATEQYGTVVDGMTNQGNQDEENEQ

SEQ ID NO: 123366 - protein, 34 aa, Artificial Sequence
  Description of Artificial Sequence: Synthetic polypeptide
DEMEIRTTNPVATEQYGTVCSTTDGPVEFEGMNV

SEQ ID NO: 123367 - protein, 34 aa, Artificial Sequence
  Description of Artificial Sequence: Synthetic polypeptide
DEEEIRTTNPVATEQYGTVVDGMTNQGNQDNDEQ

SEQ ID NO: 123368 - protein, 35 aa, Artificial Sequence
  Description of Artificial Sequence: Synthetic polypeptide
DEEEIRTTNPVATEQYGTVVDGMTNQGNQIDDNEQ

SEQ ID NO: 123369 - protein, 34 aa, Artificial Sequence
  Description of Artificial Sequence: Synthetic polypeptide
DEMEIRTTNPVATEQYGTVCSTTDGGVEFEGMNV

SEQ ID NO: 123370 - protein, 33 aa, Artificial Sequence
  Description of Artificial Sequence: Synthetic polypeptide
DESEARTTNPVATECWGNVSCINEPQDREGENG

SEQ ID NO: 123371 - protein, 34 aa, Artificial Sequence
  Description of Artificial Sequence: Synthetic polypeptide
DEMEIRTTNPVATEQYGTVCSTTDGGVEFEGMND

SEQ ID NO: 123372 - protein, 34 aa, Artificial Sequence
  Description of Artificial Sequence: Synthetic polypeptide
DEMEIRTTNPVATEQYGTVCSTTDAPVEFEGMNV

SEQ ID NO: 123373 - protein, 29 aa, Artificial Sequence
  Description of Artificial Sequence: Synthetic peptide
QEEEIATTNPVATEQYGEAPEVRQHSEEK

SEQ ID NO: 123374 - protein, 32 aa, Artificial Sequence
  Description of Artificial Sequence: Synthetic polypeptide
DEQMIATTNPVATEQYGCVSATDLEDHEGEDL

SEQ ID NO: 123375 - protein, 34 aa, Artificial Sequence
  Description of Artificial Sequence: Synthetic polypeptide
DESEAIRTTNPVATECWGSVSCINEPQDTEGENG

SEQ ID NO: 123376 - protein, 34 aa, Artificial Sequence
  Description of Artificial Sequence: Synthetic polypeptide
DEEEIRTTNPVATEQYGTVVNGFDTDQEGGGGNI

SEQ ID NO: 123377 - protein, 33 aa, Artificial Sequence
  Description of Artificial Sequence: Synthetic polypeptide
DEQMIATTNPVATEQYGSVSATDLEDHEGEDLV

SEQ ID NO: 123378 - protein, 34 aa, Artificial Sequence
  Description of Artificial Sequence: Synthetic polypeptide
DESDIRTTNPVATECWQGSVSCINEPQDREGENG

SEQ ID NO: 123379 - protein, 34 aa, Artificial Sequence
  Description of Artificial Sequence: Synthetic polypeptide
DESEARTTNPVATECWGSVSCINEPQDREGENGQ

SEQ ID NO: 123380 - protein, 34 aa, Artificial Sequence
  Description of Artificial Sequence: Synthetic polypeptide
DEMEIRTTNPVATEQYGTVCSATDGPVEFEGNPD

SEQ ID NO: 123381 - protein, 29 aa, Artificial Sequence
  Description of Artificial Sequence: Synthetic peptide
QEEEIATTNPVATEQYGEAPEVVCQHEEK

SEQ ID NO: 123382 - protein, 29 aa, Artificial Sequence
  Description of Artificial Sequence: Synthetic peptide
QEEEIATTNPVATEQYGEAPEVYCQHEEK

SEQ ID NO: 123383 - protein, 34 aa, Artificial Sequence
  Description of Artificial Sequence: Synthetic polypeptide
DEAEIATTNPVAYEQWGCVSTNLNAGNAGEESRS

SEQ ID NO: 123384 - protein, 32 aa, Artificial Sequence
  Description of Artificial Sequence: Synthetic polypeptide
DEQQIATTNPVCTEQYGSVSATDLEDHEGEDL

SEQ ID NO: 123385 - protein, 29 aa, Artificial Sequence
  Description of Artificial Sequence: Synthetic peptide
QEEEIATTNPVATEQYGEAPEVYCQHEPK

SEQ ID NO: 123386 - protein, 34 aa, Artificial Sequence
  Description of Artificial Sequence: Synthetic polypeptide
DESDEIRTTNPVAYECWGSVSCINEPQDREGENG

SEQ ID NO: 123387 - protein, 34 aa, Artificial Sequence
  Description of Artificial Sequence: Synthetic polypeptide
DESDEIKTTNPVATECWGSVSCINEPQDREGENG

SEQ ID NO: 123388 - protein, 33 aa, Artificial Sequence
  Description of Artificial Sequence: Synthetic polypeptide
DEMEIRTTNPVATEQYGTISAMEDPQQQQNGNH

SEQ ID NO: 123389 - protein, 30 aa, Artificial Sequence
  Description of Artificial Sequence: Synthetic polypeptide
DEAEIATTNPVAYEQWGCVCDNDQGQGDEH

SEQ ID NO: 123390 - protein, 32 aa, Artificial Sequence
  Description of Artificial Sequence: Synthetic polypeptide
DEQQIATTNPVATNQYGSVSATDLEDHEGEDL

SEQ ID NO: 123391 - protein, 34 aa, Artificial Sequence
  Description of Artificial Sequence: Synthetic polypeptide
DESDEICTTNPVAYEHWGSVSTGELGDHQGGNER

SEQ ID NO: 123392 - protein, 34 aa, Artificial Sequence
  Description of Artificial Sequence: Synthetic polypeptide
DEEEIATTNPVATEQWGSVSMSGNGGQHGGPQFH

SEQ ID NO: 123393 - protein, 33 aa, Artificial Sequence
  Description of Artificial Sequence: Synthetic polypeptide
DEMEIRTTNPVATEQYGTISAMDDIQQQFNGNH

SEQ ID NO: 123394 - protein, 29 aa, Artificial Sequence
  Description of Artificial Sequence: Synthetic peptide
QEEEIATTNPVATEQYGEAPEWVCQHEEK

SEQ ID NO: 123395 - protein, 32 aa, Artificial Sequence
  Description of Artificial Sequence: Synthetic polypeptide
DEQRIATTNPVATSQYGSVSATDLEDHEGEDL

SEQ ID NO: 123396 - protein, 33 aa, Artificial Sequence
  Description of Artificial Sequence: Synthetic polypeptide
DESDEIATTNPVAYEQWGCVSTNLNGDADGSNG

SEQ ID NO: 123397 - protein, 29 aa, Artificial Sequence
  Description of Artificial Sequence: Synthetic peptide
QEEEIATTNPVATEQYGEAPEWVCQHETK

SEQ ID NO: 123398 - protein, 34 aa, Artificial Sequence
  Description of Artificial Sequence: Synthetic polypeptide
DEEEIATTNPVATEQWGSVSMSGNGNPAGVNEML

SEQ ID NO: 123399 - protein, 33 aa, Artificial Sequence
  Description of Artificial Sequence: Synthetic polypeptide
DESCIRTTNPVAYEQYGCVSHTINVETRIGEGQ

SEQ ID NO: 123400 - protein, 33 aa, Artificial Sequence
  Description of Artificial Sequence: Synthetic polypeptide
DEQRIATTNPVATEQYGSVSATKDLEDHEGEDL

SEQ ID NO: 123401 - protein, 32 aa, Artificial Sequence
  Description of Artificial Sequence: Synthetic polypeptide
DEQQIATTNPVATEQYGSVSAYDLEDHEGEDL

SEQ ID NO: 123402 - protein, 29 aa, Artificial Sequence
  Description of Artificial Sequence: Synthetic peptide
QEEEIATTNPVATEQYGEAPEVWVQHEEE

SEQ ID NO: 123403 - protein, 29 aa, Artificial Sequence
  Description of Artificial Sequence: Synthetic peptide
QEEEIATTNPVATEQYGEAPEVWQQHEEK

SEQ ID NO: 123404 - protein, 34 aa, Artificial Sequence
  Description of Artificial Sequence: Synthetic polypeptide
DEMEIRTTNPVATEQYGTVCSATDGPPNFEGMNV

SEQ ID NO: 123405 - protein, 29 aa, Artificial Sequence
  Description of Artificial Sequence: Synthetic peptide
QEEEIATTNPVATEQYGEAPEVVDQHEEK

SEQ ID NO: 123406 - protein, 37 aa, Artificial Sequence
  Description of Artificial Sequence: Synthetic polypeptide
DEEEIRTTNPVATEQYGSVISTYEVLWDQYLNVEENA

SEQ ID NO: 123407 - protein, 32 aa, Artificial Sequence
  Description of Artificial Sequence: Synthetic polypeptide
DEQPIAGTNPVATEQYGSVSATDLEDHEGEDL

SEQ ID NO: 123408 - protein, 33 aa, Artificial Sequence
  Description of Artificial Sequence: Synthetic polypeptide
DESDIRTTNPVATECWGSVSCINEPQDREPENG

SEQ ID NO: 123409 - protein, 34 aa, Artificial Sequence
  Description of Artificial Sequence: Synthetic polypeptide
DEMEIRTTNPVATEQYGTVCSAMEDPVEQFNGNH

SEQ ID NO: 123410 - protein, 33 aa, Artificial Sequence
  Description of Artificial Sequence: Synthetic polypeptide
DEMEIRTTNPVATEQYGTVCSAEDGPVEFEGND

SEQ ID NO: 123411 - protein, 33 aa, Artificial Sequence
  Description of Artificial Sequence: Synthetic polypeptide
DEMEIRTTNPVATEQYGTVCSAADGPVEPEGND

SEQ ID NO: 123412 - protein, 33 aa, Artificial Sequence
  Description of Artificial Sequence: Synthetic polypeptide
DEMEIRTTNPVATEQYGTVCSAADGPVEFKGND

SEQ ID NO: 123413 - protein, 33 aa, Artificial Sequence
  Description of Artificial Sequence: Synthetic polypeptide
DEAVIRTTNPVATEQYGCVCETGNPQYSGSDQS

SEQ ID NO: 123414 - protein, 29 aa, Artificial Sequence
  Description of Artificial Sequence: Synthetic peptide
QEEEIATTNPVATEQYGEAPEVVQHEEKE

SEQ ID NO: 123415 - protein, 29 aa, Artificial Sequence
  Description of Artificial Sequence: Synthetic peptide
QEEEIATTNPVATEQYGEAPEVWCQHEEK

SEQ ID NO: 123416 - protein, 33 aa, Artificial Sequence
  Description of Artificial Sequence: Synthetic polypeptide
DEAVIRTTNPVATEQYGCVCETGEPQYSGSNQA

SEQ ID NO: 123417 - protein, 32 aa, Artificial Sequence
  Description of Artificial Sequence: Synthetic polypeptide
DEQPIATTNPVATMQYGSVSATDLEDHEGEDL

SEQ ID NO: 123418 - protein, 37 aa, Artificial Sequence
  Description of Artificial Sequence: Synthetic polypeptide
DEEEIRTTNPVATEQYGSVISTVNGFGQENFQGEFGI

SEQ ID NO: 123419 - protein, 32 aa, Artificial Sequence
  Description of Artificial Sequence: Synthetic polypeptide
DEQQIATTNPVATEQWGSVSATDLEDHEGEDL

SEQ ID NO: 123420 - protein, 29 aa, Artificial Sequence
  Description of Artificial Sequence: Synthetic peptide
QEEEIATTNPVATEQYGEAPEVWQHEEVE

SEQ ID NO: 123421 - protein, 30 aa, Artificial Sequence
  Description of Artificial Sequence: Synthetic polypeptide
QEEEIATTNPVATEQYGEAPEVWQHEGEQK

SEQ ID NO: 123422 - protein, 33 aa, Artificial Sequence
  Description of Artificial Sequence: Synthetic polypeptide
DESDIRTTNPVATECWGFVSCINEPQDREGENG

SEQ ID NO: 123423 - protein, 33 aa, Artificial Sequence
  Description of Artificial Sequence: Synthetic polypeptide
DESDIRTTNPVATECWGSVSCIPEPQDREGENG

SEQ ID NO: 123424 - protein, 34 aa, Artificial Sequence
  Description of Artificial Sequence: Synthetic polypeptide
DESEARTTNPVATECWGSVSCINEPQDREGENSG

SEQ ID NO: 123425 - protein, 33 aa, Artificial Sequence
  Description of Artificial Sequence: Synthetic polypeptide
DEQLIATTNPVATEQYGSVCSATDLEDHEGEDL

SEQ ID NO: 123426 - protein, 33 aa, Artificial Sequence
  Description of Artificial Sequence: Synthetic polypeptide
DESEARTTNPVATECWGSVSCINEPQDREKENG

SEQ ID NO: 123427 - protein, 29 aa, Artificial Sequence
  Description of Artificial Sequence: Synthetic peptide
QEEEIATTNPVATEQYGEAPEVITQHEEK

SEQ ID NO: 123428 - protein, 32 aa, Artificial Sequence
  Description of Artificial Sequence: Synthetic polypeptide
DEQEVASTNPVATEGYGSVSATDLEDHVGEDR

SEQ ID NO: 123429 - protein, 29 aa, Artificial Sequence
  Description of Artificial Sequence: Synthetic peptide
QEEEIATTNPVATEQYGEAPEVKCQHEEK

SEQ ID NO: 123430 - protein, 29 aa, Artificial Sequence
  Description of Artificial Sequence: Synthetic peptide
QEEEIATTNPVATEQYGEAPEVKCQHEKK

SEQ ID NO: 123431 - protein, 30 aa, Artificial Sequence
  Description of Artificial Sequence: Synthetic polypeptide
DESEIAPTNPCSSEQWGIVSCNLPQSGETR

SEQ ID NO: 123432 - protein, 29 aa, Artificial Sequence
  Description of Artificial Sequence: Synthetic peptide
QEEEIATTNPVATEQYGEAPEVKNQHEEK

SEQ ID NO: 123433 - protein, 29 aa, Artificial Sequence
  Description of Artificial Sequence: Synthetic peptide
QEEEIATTNPVATEQYGEAPEVKQAKEKT

SEQ ID NO: 123434 - protein, 34 aa, Artificial Sequence
  Description of Artificial Sequence: Synthetic polypeptide
DEEEIRTTNPVATEQYGSVITIVEEGEQQPLVEG

SEQ ID NO: 123435 - protein, 34 aa, Artificial Sequence
  Description of Artificial Sequence: Synthetic polypeptide
DEEEIATTNPVATEQWGSVSGQGPPQETGDGMRN

SEQ ID NO: 123436 - protein, 32 aa, Artificial Sequence
  Description of Artificial Sequence: Synthetic polypeptide
CQEEIRTTNPIAYEQYGSVPCTGALSARGGSP

SEQ ID NO: 123437 - protein, 33 aa, Artificial Sequence
  Description of Artificial Sequence: Synthetic polypeptide
DEAEIATTNPVAYEQWGSTSTNNNGDEGGGNTR

SEQ ID NO: 123438 - protein, 31 aa, Artificial Sequence
  Description of Artificial Sequence: Synthetic polypeptide
DEAEIATTNPVAYEQWGSTSKTLEDRQNAQH

SEQ ID NO: 123439 - protein, 32 aa, Artificial Sequence
  Description of Artificial Sequence: Synthetic polypeptide
DEAVIRTTNPVATEQYGSVSPLDEFPNYSQNE

SEQ ID NO: 123440 - protein, 31 aa, Artificial Sequence
  Description of Artificial Sequence: Synthetic polypeptide
DEQEVASTNPVATEQYGNVSATTLESHEGEL

SEQ ID NO: 123441 - protein, 31 aa, Artificial Sequence
  Description of Artificial Sequence: Synthetic polypeptide
DEQEVASTNPVATEQYGNVSATTLESHVGEL

SEQ ID NO: 123442 - protein, 33 aa, Artificial Sequence
  Description of Artificial Sequence: Synthetic polypeptide
DEATEIATTNPCAYEQWGSVSTNLQGDHGGDAD

SEQ ID NO: 123443 - protein, 33 aa, Artificial Sequence
  Description of Artificial Sequence: Synthetic polypeptide
DEMEIRTTNPVATQQYGCVCSTELEEHFGSDQA

SEQ ID NO: 123444 - protein, 31 aa, Artificial Sequence
  Description of Artificial Sequence: Synthetic polypeptide
DEAEIATTNPVAYEQWGSISKTLEDEQHNGR

SEQ ID NO: 123445 - protein, 29 aa, Artificial Sequence
  Description of Artificial Sequence: Synthetic peptide
QEEEIATTNPVATEQYGEAPEVKQHEQEK

SEQ ID NO: 123446 - protein, 35 aa, Artificial Sequence
  Description of Artificial Sequence: Synthetic polypeptide
DEAVIRTTNPVATEQYGSVSPTLDLEFPNYSQNTR

SEQ ID NO: 123447 - protein, 31 aa, Artificial Sequence
  Description of Artificial Sequence: Synthetic polypeptide
DEQEVASTNPVATEGYGNVSATDIQDHVGQR

SEQ ID NO: 123448 - protein, 31 aa, Artificial Sequence
  Description of Artificial Sequence: Synthetic polypeptide
DEQEVASTNPVATEGYGNVAATDIQSRVGQR

SEQ ID NO: 123449 - protein, 29 aa, Artificial Sequence
  Description of Artificial Sequence: Synthetic peptide
QEEEIATTNPVATEQYGEAPEVGCQHEEK

SEQ ID NO: 123450 - protein, 29 aa, Artificial Sequence
  Description of Artificial Sequence: Synthetic peptide
QEEEIATTNPVATEQYGEAPEVGCQWEEK

SEQ ID NO: 123451 - protein, 29 aa, Artificial Sequence
  Description of Artificial Sequence: Synthetic peptide
QEEEIATTNPVATEQYGEAPEVGQHEEEK

SEQ ID NO: 123452 - protein, 33 aa, Artificial Sequence
  Description of Artificial Sequence: Synthetic polypeptide
DEAVIRTTNPVATEQYGSVSYLLEFPVYSQNTD

SEQ ID NO: 123453 - protein, 32 aa, Artificial Sequence
  Description of Artificial Sequence: Synthetic polypeptide
DEQETATTNPVATEQYGNVSATDLEDHEGEDL

SEQ ID NO: 123454 - protein, 29 aa, Artificial Sequence
  Description of Artificial Sequence: Synthetic peptide
QEEEIATTNPVATEQYGEAPEVGQHEEKW

SEQ ID NO: 123455 - protein, 29 aa, Artificial Sequence
  Description of Artificial Sequence: Synthetic peptide
QEEEIATTNPVATEQYGEAPEVGQHEVEK

SEQ ID NO: 123456 - protein, 32 aa, Artificial Sequence
  Description of Artificial Sequence: Synthetic polypeptide
DEEEIATTNPVATEQWGSVSGQGPPQEADMPE

SEQ ID NO: 123457 - protein, 34 aa, Artificial Sequence
  Description of Artificial Sequence: Synthetic polypeptide
DEASIQCTNPVAYEQYGSVVQSANEQSDRGGNNR

SEQ ID NO: 123458 - protein, 34 aa, Artificial Sequence
  Description of Artificial Sequence: Synthetic polypeptide
CETEIATTNPVATENYGCVSTSNGLNDTGGGNER

SEQ ID NO: 123459 - protein, 36 aa, Artificial Sequence
  Description of Artificial Sequence: Synthetic polypeptide
DEEEIRTTNPVATEQYGSVITLVGMSGEGQGGNDGE

SEQ ID NO: 123460 - protein, 29 aa, Artificial Sequence
  Description of Artificial Sequence: Synthetic peptide
QEEEIATTNPVATEQYGEAPEVGQVHEEK

SEQ ID NO: 123461 - protein, 29 aa, Artificial Sequence
  Description of Artificial Sequence: Synthetic peptide
QEEEIATTNPVATEQYGEAPEVGRQHEEK

SEQ ID NO: 123462 - protein, 29 aa, Artificial Sequence
  Description of Artificial Sequence: Synthetic peptide
QEEEIATTNPVATEQYGEAPEVGSQHEED

SEQ ID NO: 123463 - protein, 29 aa, Artificial Sequence
  Description of Artificial Sequence: Synthetic peptide
QEEEIATTNPVATEQYGEAPEVHCQHEEK

SEQ ID NO: 123464 - protein, 31 aa, Artificial Sequence
  Description of Artificial Sequence: Synthetic polypeptide
DEQEVASTNPVATEGYGNVAANDIQSRVGQR

SEQ ID NO: 123465 - protein, 29 aa, Artificial Sequence
  Description of Artificial Sequence: Synthetic peptide
QEEEIATTNPVATEQYGEAPEVICQHEEK

SEQ ID NO: 123466 - protein, 29 aa, Artificial Sequence
  Description of Artificial Sequence: Synthetic peptide
QEEEIATTNPVATEQYGEAPEVICQHEEP

SEQ ID NO: 123467 - protein, 31 aa, Artificial Sequence
  Description of Artificial Sequence: Synthetic polypeptide
DEQEVASTNPVATEGYGNVAATDIQDRVGQR

SEQ ID NO: 123468 - protein, 33 aa, Artificial Sequence
  Description of Artificial Sequence: Synthetic polypeptide
DEAVIRTTNPVATEQYGSVSDPELEFPNYSQNA

SEQ ID NO: 123469 - protein, 30 aa, Artificial Sequence
  Description of Artificial Sequence: Synthetic polypeptide
DESEIACTNPVSTEGYGNVAETIQSRVGQR

SEQ ID NO: 123470 - protein, 37 aa, Artificial Sequence
  Description of Artificial Sequence: Synthetic polypeptide
AEEEIRTTNPVATEQYGSVVTVANLQNNQGEQGTNVE

SEQ ID NO: 123471 - protein, 35 aa, Artificial Sequence
  Description of Artificial Sequence: Synthetic polypeptide
DEEEIATTNPVATEQWGSVSGTGNPPQNNSENGQD

SEQ ID NO: 123472 - protein, 33 aa, Artificial Sequence
  Description of Artificial Sequence: Synthetic polypeptide
DEQHIATTNPVATEQYGSVSATFDLEDHEGEDL

SEQ ID NO: 123473 - protein, 34 aa, Artificial Sequence
  Description of Artificial Sequence: Synthetic polypeptide
DEEEIRTTNPVATEQYGSVISWDADQHASQTHDI

SEQ ID NO: 123474 - protein, 33 aa, Artificial Sequence
  Description of Artificial Sequence: Synthetic polypeptide
DEMEIRTTNPVATEQYGTVWSAADGPVAFKGND

SEQ ID NO: 123475 - protein, 32 aa, Artificial Sequence
  Description of Artificial Sequence: Synthetic polypeptide
DEQIIAATNPVATEQYGSVSATDLEDHEGEDL

SEQ ID NO: 123476 - protein, 33 aa, Artificial Sequence
  Description of Artificial Sequence: Synthetic polypeptide
DEQIIATTNPVATEQYGSRVSATDLEDHEGEDL

SEQ ID NO: 123477 - protein, 29 aa, Artificial Sequence
  Description of Artificial Sequence: Synthetic peptide
QEEEIATTNPVATEQYGEAPEVPQHEEKA

SEQ ID NO: 123478 - protein, 29 aa, Artificial Sequence
  Description of Artificial Sequence: Synthetic peptide
QEEEIATTNPVATEQYGEAPEVPQKHEEK

SEQ ID NO: 123479 - protein, 37 aa, Artificial Sequence
  Description of Artificial Sequence: Synthetic polypeptide
DEEEIRTTNPVATEQYGTVTVVTNNNLQQGEEGNGNG

SEQ ID NO: 123480 - protein, 33 aa, Artificial Sequence
  Description of Artificial Sequence: Synthetic polypeptide
DESECQTTNPVATECWGSVSCILEPQDREGENG

SEQ ID NO: 123481 - protein, 37 aa, Artificial Sequence
  Description of Artificial Sequence: Synthetic polypeptide
DEEEIRTTNPVATEQYGTVTVVTNNNLQQGETETNNQ

SEQ ID NO: 123482 - protein, 33 aa, Artificial Sequence
  Description of Artificial Sequence: Synthetic polypeptide
DEMEIRTTNPVATEQYGTVSATDGEVMNFAGDD

SEQ ID NO: 123483 - protein, 34 aa, Artificial Sequence
  Description of Artificial Sequence: Synthetic polypeptide
DEATEIRTTNPVAYEHWGSVATGMNGDHQGGNAR

SEQ ID NO: 123484 - protein, 37 aa, Artificial Sequence
  Description of Artificial Sequence: Synthetic polypeptide
DEEEIRTTNPVATEQYGTVTVVTTNNNLQQGEEENEN

SEQ ID NO: 123485 - protein, 34 aa, Artificial Sequence
  Description of Artificial Sequence: Synthetic polypeptide
DESECIRTTNPVATECWGSVSCINEPQDGEGENG

SEQ ID NO: 123486 - protein, 29 aa, Artificial Sequence
  Description of Artificial Sequence: Synthetic peptide
QEEEIATTNPVATEQYGEAPEVQCQHEEK

SEQ ID NO: 123487 - protein, 29 aa, Artificial Sequence
  Description of Artificial Sequence: Synthetic peptide
QEEEIATTNPVATEQYGEAPEVQCQHETK

SEQ ID NO: 123488 - protein, 37 aa, Artificial Sequence
  Description of Artificial Sequence: Synthetic polypeptide
DEEEIRTTNPVATEQYGTVTVVVTNNNLQQGEENEND

SEQ ID NO: 123489 - protein, 34 aa, Artificial Sequence
  Description of Artificial Sequence: Synthetic polypeptide
DESEARTTNPVATECWGSVSGCINEPQDREGENG

SEQ ID NO: 123490 - protein, 32 aa, Artificial Sequence
  Description of Artificial Sequence: Synthetic polypeptide
DEQLIATTNPVATEQYGCVSATDLEDHEGEDL

SEQ ID NO: 123491 - protein, 28 aa, Artificial Sequence
  Description of Artificial Sequence: Synthetic peptide
QEEEIATTNPVATEQYGEAPEVPPHEEK

SEQ ID NO: 123492 - protein, 33 aa, Artificial Sequence
  Description of Artificial Sequence: Synthetic polypeptide
DESCIRTTNPVAYEQWGSAYNVDAHGQRGDNGR

SEQ ID NO: 123493 - protein, 29 aa, Artificial Sequence
  Description of Artificial Sequence: Synthetic peptide
QEEEIATTNPVATEQYGEAPEVPCQHEEK

SEQ ID NO: 123494 - protein, 36 aa, Artificial Sequence
  Description of Artificial Sequence: Synthetic polypeptide
DEEEIATTNPVATEQWGSVSGTGPPPQDAHQGENRN

SEQ ID NO: 123495 - protein, 29 aa, Artificial Sequence
  Description of Artificial Sequence: Synthetic peptide
QEEEIATTNPVATEQYGEAPEVMCQHEEK

SEQ ID NO: 123496 - protein, 29 aa, Artificial Sequence
  Description of Artificial Sequence: Synthetic peptide
QEEEIATTNPVATEQYGEAPEVMCQPTEK

SEQ ID NO: 123497 - protein, 29 aa, Artificial Sequence
  Description of Artificial Sequence: Synthetic peptide
QEEEIATTNPVATEQYGEAPEVMMQHEEK

SEQ ID NO: 123498 - protein, 31 aa, Artificial Sequence
  Description of Artificial Sequence: Synthetic polypeptide
DEQEVATTNPVSTEQYGNVSANTLEDHEGEL

SEQ ID NO: 123499 - protein, 31 aa, Artificial Sequence
  Description of Artificial Sequence: Synthetic polypeptide
DEQEVATTNPVSTEQYGNVSATTLEDHEGEL

SEQ ID NO: 123500 - protein, 32 aa, Artificial Sequence
  Description of Artificial Sequence: Synthetic polypeptide
DEQFIAPTNPVATEQYGSVSATDLEDHEGEDL

SEQ ID NO: 123501 - protein, 31 aa, Artificial Sequence
  Description of Artificial Sequence: Synthetic polypeptide
DESEIACTNPVATEQWGEASENEPQDREGGG

SEQ ID NO: 123502 - protein, 29 aa, Artificial Sequence
  Description of Artificial Sequence: Synthetic peptide
QEEEIATTNPVATEQYGEAPEVMPQHEEK

SEQ ID NO: 123503 - protein, 29 aa, Artificial Sequence
  Description of Artificial Sequence: Synthetic peptide
QEEEIATTNPVATEQYGEAPEVMQHDEEK

SEQ ID NO: 123504 - protein, 34 aa, Artificial Sequence
  Description of Artificial Sequence: Synthetic polypeptide
DESEGIRTTNPVATECWGVVSCINEPQDREGENG

SEQ ID NO: 123505 - protein, 32 aa, Artificial Sequence
  Description of Artificial Sequence: Synthetic polypeptide
DEAVIRTTNPVATEQYGCVWYTVPQWTEINNQ

SEQ ID NO: 123506 - protein, 31 aa, Artificial Sequence
  Description of Artificial Sequence: Synthetic polypeptide
CSEEIATTNPVGTEQWGGMCSITNEQGGDER

SEQ ID NO: 123507 - protein, 35 aa, Artificial Sequence
  Description of Artificial Sequence: Synthetic polypeptide
DEEEIATTNPVATEQWGSVSGTGPPPDAAGGENRE

SEQ ID NO: 123508 - protein, 33 aa, Artificial Sequence
  Description of Artificial Sequence: Synthetic polypeptide
DESECRTTNPVATFCWGSVSCINEPQDREGENG

SEQ ID NO: 123509 - protein, 33 aa, Artificial Sequence
  Description of Artificial Sequence: Synthetic polypeptide
CSEEIATTNPVGTEQWGGMVSITHNLAQGGGER

SEQ ID NO: 123510 - protein, 30 aa, Artificial Sequence
  Description of Artificial Sequence: Synthetic polypeptide
QEEEIATTNPVATEQYGEAPEVMVQHENEK

SEQ ID NO: 123511 - protein, 34 aa, Artificial Sequence
  Description of Artificial Sequence: Synthetic polypeptide
DESECRTTNPVATECWGSVSCINPEPQDREGENG

SEQ ID NO: 123512 - protein, 34 aa, Artificial Sequence
  Description of Artificial Sequence: Synthetic polypeptide
DEEEIATTNPVATEQWGSVSGTGPPPETANGERN

SEQ ID NO: 123513 - protein, 29 aa, Artificial Sequence
  Description of Artificial Sequence: Synthetic peptide
QEEEIATTNPVATEQYGEAPEVNQFHEEK

SEQ ID NO: 123514 - protein, 29 aa, Artificial Sequence
  Description of Artificial Sequence: Synthetic peptide
QEEEIATTNPVATEQYGEAPEVPCQGEEK

SEQ ID NO: 123515 - protein, 29 aa, Artificial Sequence
  Description of Artificial Sequence: Synthetic peptide
QEEEIATTNPVATEQYGEAPEVFCQHEEK

SEQ ID NO: 123516 - protein, 33 aa, Artificial Sequence
  Description of Artificial Sequence: Synthetic polypeptide
DESCIRTTNPVAYEQWGESYSVDLHGQRGDNTN

SEQ ID NO: 123517 - protein, 36 aa, Artificial Sequence
  Description of Artificial Sequence: Synthetic polypeptide
DEMEIRTTNPVATEQYGSYFCSVTDWNDERPGDNSW

SEQ ID NO: 123518 - protein, 28 aa, Artificial Sequence
  Description of Artificial Sequence: Synthetic peptide
QEEEIATTNPVATEQYGEAPVVCAHEEK

SEQ ID NO: 123519 - protein, 34 aa, Artificial Sequence
  Description of Artificial Sequence: Synthetic polypeptide
DESAEIRTTNPVATECWGSVSCINEPQDGEGENG

SEQ ID NO: 123520 - protein, 29 aa, Artificial Sequence
  Description of Artificial Sequence: Synthetic peptide
QEEEIATTNPVATEQYGEAPWADQHNEQF

SEQ ID NO: 123521 - protein, 29 aa, Artificial Sequence
  Description of Artificial Sequence: Synthetic peptide
QEEEIATTNPVATEQYGEAPWEVCQHEEK

SEQ ID NO: 123522 - protein, 33 aa, Artificial Sequence
  Description of Artificial Sequence: Synthetic polypeptide
DESAEIATTNPVAYEQWGSTTTNLQGDAGGNEE

SEQ ID NO: 123523 - protein, 33 aa, Artificial Sequence
  Description of Artificial Sequence: Synthetic polypeptide
DEMEIRTTNPVATEQYGSVSYSAIATENVVPLL

SEQ ID NO: 123524 - protein, 29 aa, Artificial Sequence
  Description of Artificial Sequence: Synthetic peptide
QEEEIATTNPVATEQYGEAPYECCQHEEK

SEQ ID NO: 123525 - protein, 29 aa, Artificial Sequence
  Description of Artificial Sequence: Synthetic peptide
QEEEIATTNPVATEQYGEAPYEVCQHEEK

SEQ ID NO: 123526 - protein, 31 aa, Artificial Sequence
  Description of Artificial Sequence: Synthetic polypeptide
QEEEIATTNPVATEQYGEAPVEWVCQPTNEK

SEQ ID NO: 123527 - protein, 34 aa, Artificial Sequence
  Description of Artificial Sequence: Synthetic polypeptide
DEEEIATTNPVATEQYGCTAMTEGLTAGIGMNRM

SEQ ID NO: 123528 - protein, 34 aa, Artificial Sequence
  Description of Artificial Sequence: Synthetic polypeptide
DEEEIATTNPVATEQYGCTATINPLQAPMEMNNN

SEQ ID NO: 123529 - protein, 33 aa, Artificial Sequence
  Description of Artificial Sequence: Synthetic polypeptide
DEEEIATTNPVATEQYGCVAAAAQPTEAGTNIE

SEQ ID NO: 123530 - protein, 29 aa, Artificial Sequence
  Description of Artificial Sequence: Synthetic peptide
QEEEIATTNPVATEQYGEAPYVVCQHEEK

SEQ ID NO: 123531 - protein, 29 aa, Artificial Sequence
  Description of Artificial Sequence: Synthetic peptide
QEEEIATTNPVATEQYGEAQYEVCQHEEK

SEQ ID NO: 123532 - protein, 33 aa, Artificial Sequence
  Description of Artificial Sequence: Synthetic polypeptide
DEREIVTTNPVATEQYGTVNSATDGPVEFEGND

SEQ ID NO: 123533 - protein, 30 aa, Artificial Sequence
  Description of Artificial Sequence: Synthetic polypeptide
QEEEIATTNPVATEQYGEASATVCEHEEDK

SEQ ID NO: 123534 - protein, 33 aa, Artificial Sequence
  Description of Artificial Sequence: Synthetic polypeptide
DEREIVTTNPVATEQYGTVCSPTDGPVEFEGND

SEQ ID NO: 123535 - protein, 33 aa, Artificial Sequence
  Description of Artificial Sequence: Synthetic polypeptide
DEREIVTTNPVATEQYGTVCSATDGPVEFEGND

SEQ ID NO: 123536 - protein, 32 aa, Artificial Sequence
  Description of Artificial Sequence: Synthetic polypeptide
DEEEIATTNPVATEQYGCTANINPLQAPMEEN

SEQ ID NO: 123537 - protein, 29 aa, Artificial Sequence
  Description of Artificial Sequence: Synthetic peptide
QEEEIATTNPVATEQYGEAPVEVCQHYEK

SEQ ID NO: 123538 - protein, 29 aa, Artificial Sequence
  Description of Artificial Sequence: Synthetic peptide
QEEEIATTNPVATEQYGEAPVEVCQHEEK

SEQ ID NO: 123539 - protein, 34 aa, Artificial Sequence
  Description of Artificial Sequence: Synthetic polypeptide
DEMEIRTTNPVATEQYGSVTDNTLLELSFESDQR

SEQ ID NO: 123540 - protein, 34 aa, Artificial Sequence
  Description of Artificial Sequence: Synthetic polypeptide
CEEEIACTNPVATEQYGSCAAATNLQDGAGTNDQ

SEQ ID NO: 123541 - protein, 29 aa, Artificial Sequence
  Description of Artificial Sequence: Synthetic peptide
QEEEIATTNPVATEQYGEAPSVCQYHEEK

SEQ ID NO: 123542 - protein, 30 aa, Artificial Sequence
  Description of Artificial Sequence: Synthetic polypeptide
QEEEIATTNPVATEQYGEAPSVEQMQSVEQ

SEQ ID NO: 123543 - protein, 34 aa, Artificial Sequence
  Description of Artificial Sequence: Synthetic polypeptide
DESAILRTTNPVATECWGSVSCINEPQDREGENG

SEQ ID NO: 123544 - protein, 33 aa, Artificial Sequence
  Description of Artificial Sequence: Synthetic polypeptide
DEQVIATTNPVATEQYGSVSATDDLEDHEGEDL

SEQ ID NO: 123545 - protein, 35 aa, Artificial Sequence
  Description of Artificial Sequence: Synthetic polypeptide
DESAEIRTTNPVATECWGSVSCINEPQDREGENGD

SEQ ID NO: 123546 - protein, 29 aa, Artificial Sequence
  Description of Artificial Sequence: Synthetic peptide
QEEEIATTNPVATEQYGEAPTEHCCHEEK

SEQ ID NO: 123547 - protein, 33 aa, Artificial Sequence
  Description of Artificial Sequence: Synthetic polypeptide
DEQVIATTNPVATEQYGYSVSATDLEDSEGEDL

SEQ ID NO: 123548 - protein, 34 aa, Artificial Sequence
  Description of Artificial Sequence: Synthetic polypeptide
DEMEIRTTNPVATEQYGSVTPYVDLQERDTDQMG

SEQ ID NO: 123549 - protein, 31 aa, Artificial Sequence
  Description of Artificial Sequence: Synthetic polypeptide
QEEEIATTNPVATEQYGEAPTEVCPNREMNK

SEQ ID NO: 123550 - protein, 35 aa, Artificial Sequence
  Description of Artificial Sequence: Synthetic polypeptide
DEMEIRTTNPVATEQYGSVTPWTNPLESFGIDVFA

SEQ ID NO: 123551 - protein, 35 aa, Artificial Sequence
  Description of Artificial Sequence: Synthetic polypeptide
DEMEIRTTNPVATEQYGSVTPWTNLEVFEGDVFAQ

SEQ ID NO: 123552 - protein, 34 aa, Artificial Sequence
  Description of Artificial Sequence: Synthetic polypeptide
DEMEIRTTNPVATEQYGSVTPWTNLESFDIDVFV

SEQ ID NO: 123553 - protein, 34 aa, Artificial Sequence
  Description of Artificial Sequence: Synthetic polypeptide
DEMEIRTTNPVATEQYGSVTPWTNALESFVDVFQ

SEQ ID NO: 123554 - protein, 32 aa, Artificial Sequence
  Description of Artificial Sequence: Synthetic polypeptide
DEQVIATTNTVATEQYGSVSATDLEDHEGEDL

SEQ ID NO: 123555 - protein, 30 aa, Artificial Sequence
  Description of Artificial Sequence: Synthetic polypeptide
QEEEIATTNPVATEQYGEAPTEVHCQHEEK

SEQ ID NO: 123556 - protein, 30 aa, Artificial Sequence
  Description of Artificial Sequence: Synthetic polypeptide
QEEEIATTNPVATEQYGEAPTVCQHEEEDL

SEQ ID NO: 123557 - protein, 35 aa, Artificial Sequence
  Description of Artificial Sequence: Synthetic polypeptide
DEAVIRTTNPVATECYGCCVVACTNEPSQRTGGNR

SEQ ID NO: 123558 - protein, 29 aa, Artificial Sequence
  Description of Artificial Sequence: Synthetic peptide
QEEEIATTNPVATEQYGEAPTVCVEHEEK

SEQ ID NO: 123559 - protein, 33 aa, Artificial Sequence
  Description of Artificial Sequence: Synthetic polypeptide
DEMEIRTTNPVATEQYGSVSWLWWQPELLEDQL

SEQ ID NO: 123560 - protein, 29 aa, Artificial Sequence
  Description of Artificial Sequence: Synthetic peptide
QEEEIATTNPVATEQYGEAPSVCQHEEPK

SEQ ID NO: 123561 - protein, 37 aa, Artificial Sequence
  Description of Artificial Sequence: Synthetic polypeptide
AEEEIRTTNPVATEQYGSVVTVANLQNGQEEGTNNVD

SEQ ID NO: 123562 - protein, 32 aa, Artificial Sequence
  Description of Artificial Sequence: Synthetic polypeptide
DEEEIATTNPVATEQYGCVAANNGDPTMDNNP

SEQ ID NO: 123563 - protein, 36 aa, Artificial Sequence
  Description of Artificial Sequence: Synthetic polypeptide
DEMEIRTTNPVATEQYGSVSVTPNIHEETFNGTIRE

SEQ ID NO: 123564 - protein, 37 aa, Artificial Sequence
  Description of Artificial Sequence: Synthetic polypeptide
DEEEIRTTNPVATEQYGVSVSSTTPAGPNMRNGMNPV

SEQ ID NO: 123565 - protein, 37 aa, Artificial Sequence
  Description of Artificial Sequence: Synthetic polypeptide
DEEEIRTTNPVATEQYGVSVSSTTPAGPNMRNGQNPV

SEQ ID NO: 123566 - protein, 34 aa, Artificial Sequence
  Description of Artificial Sequence: Synthetic polypeptide
DEMEIRTTNPVATEQYGSVSVTPDLLLESEFEQP

SEQ ID NO: 123567 - protein, 33 aa, Artificial Sequence
  Description of Artificial Sequence: Synthetic polypeptide
DEREIRTTNPVATEQYGCVCSSGEHQHFNSDQS

SEQ ID NO: 123568 - protein, 35 aa, Artificial Sequence
  Description of Artificial Sequence: Synthetic polypeptide
DEEEIRTTNPVATEQYGSVISPTVEYAEVGTPDEL

SEQ ID NO: 123569 - protein, 32 aa, Artificial Sequence
  Description of Artificial Sequence: Synthetic polypeptide
DEAEIATTNPVAYEPWGTATTNLQGNAGENSR

SEQ ID NO: 123570 - protein, 35 aa, Artificial Sequence
  Description of Artificial Sequence: Synthetic polypeptide
DEREIRTTNPVATEQYGCVCSMTEEHQENFGSNQA

SEQ ID NO: 123571 - protein, 37 aa, Artificial Sequence
  Description of Artificial Sequence: Synthetic polypeptide
DEEEIRTTNPVATEQYGVSVSSTTPAGPEMRNGMNPV

SEQ ID NO: 123572 - protein, 30 aa, Artificial Sequence
  Description of Artificial Sequence: Synthetic polypeptide
DEREIRTTNPVATEQWGDVSFIEMNAAEDA

SEQ ID NO: 123573 - protein, 36 aa, Artificial Sequence
  Description of Artificial Sequence: Synthetic polypeptide
DEEEIRTTNPVATEQYGSVISPTTTTMPPRPGMVEM

SEQ ID NO: 123574 - protein, 30 aa, Artificial Sequence
  Description of Artificial Sequence: Synthetic polypeptide
DEREIRTTNPVATEQWGDVSEIEMNAAEDA

SEQ ID NO: 123575 - protein, 34 aa, Artificial Sequence
  Description of Artificial Sequence: Synthetic polypeptide
DEREIRTTNPVATECWGSVSMCINEPQDVEGENG

SEQ ID NO: 123576 - protein, 37 aa, Artificial Sequence
  Description of Artificial Sequence: Synthetic polypeptide
DEEEIRTTNPVATEQYGSVISPTQNDEIIQIPENVQT

SEQ ID NO: 123577 - protein, 37 aa, Artificial Sequence
  Description of Artificial Sequence: Synthetic polypeptide
AEEEIRTTNPVATEQYGSVVTVANLNNQQDEIGTNVT

SEQ ID NO: 123578 - protein, 32 aa, Artificial Sequence
  Description of Artificial Sequence: Synthetic polypeptide
DEAVIGTTNPVATEQWGCVCSTADDQYFGSNQ

SEQ ID NO: 123579 - protein, 36 aa, Artificial Sequence
  Description of Artificial Sequence: Synthetic polypeptide
AEEEIRTTNPVATEQYGSVVTVANLNGDEQGTNVVT

SEQ ID NO: 123580 - protein, 32 aa, Artificial Sequence
  Description of Artificial Sequence: Synthetic polypeptide
QEEEIATTNPVATEQYGEASSEPVCQMHNGNV

SEQ ID NO: 123581 - protein, 30 aa, Artificial Sequence
  Description of Artificial Sequence: Synthetic polypeptide
DEAEIATTNPVAYEPVWGSIAATNLAAPNN

SEQ ID NO: 123582 - protein, 37 aa, Artificial Sequence
  Description of Artificial Sequence: Synthetic polypeptide
DEEEIRTTNPVATEQYGVSVSSTTPAGENMRNGMNPV

SEQ ID NO: 123583 - protein, 37 aa, Artificial Sequence
  Description of Artificial Sequence: Synthetic polypeptide
DEEEIRTTNPVATEQYGVSVSSATPHGPNMRNGMNPV

SEQ ID NO: 123584 - protein, 37 aa, Artificial Sequence
  Description of Artificial Sequence: Synthetic polypeptide
DEEEIRTTNPVATEQYGVSVHSTTPAGPNMRNGMNPV

SEQ ID NO: 123585 - protein, 34 aa, Artificial Sequence
  Description of Artificial Sequence: Synthetic polypeptide
DEREISTTNPVATEQYGCVCSTENHQGFNSDTQS

SEQ ID NO: 123586 - protein, 37 aa, Artificial Sequence
  Description of Artificial Sequence: Synthetic polypeptide
AEEEIRTTNPVATEQYGSVVTVANLNQQGEAGTNNVD

SEQ ID NO: 123587 - protein, 34 aa, Artificial Sequence
  Description of Artificial Sequence: Synthetic polypeptide
DEEEIATTNPVATEQYGCVAATAGLADTPGDERW

SEQ ID NO: 123588 - protein, 34 aa, Artificial Sequence
  Description of Artificial Sequence: Synthetic polypeptide
DEMEIRTTNPVATEQYGSVSWCDEDQSLYDNIMQ

SEQ ID NO: 123589 - protein, 29 aa, Artificial Sequence
  Description of Artificial Sequence: Synthetic peptide
QEEEIATTNPVATEQYGEASEVCEHEEDK

SEQ ID NO: 123590 - protein, 32 aa, Artificial Sequence
  Description of Artificial Sequence: Synthetic polypeptide
DEQYIATTNPVATEQYGSVVATDLEDHEGEDL

SEQ ID NO: 123591 - protein, 32 aa, Artificial Sequence
  Description of Artificial Sequence: Synthetic polypeptide
DEREISTTNPVATEGYGCVCSTEHQNFGSEQA

SEQ ID NO: 123592 - protein, 34 aa, Artificial Sequence
  Description of Artificial Sequence: Synthetic polypeptide
DEMEIRTTNPVATEQYGSVSVWYEPEVTFVQNNM

SEQ ID NO: 123593 - protein, 33 aa, Artificial Sequence
  Description of Artificial Sequence: Synthetic polypeptide
DEREIRTTNPVCYEHYGSVSMPNALTETLGNHK

SEQ ID NO: 123594 - protein, 33 aa, Artificial Sequence
  Description of Artificial Sequence: Synthetic polypeptide
CEEEIACTNPVATEQYGSACSADLQAEQPGDNA

SEQ ID NO: 123595 - protein, 36 aa, Artificial Sequence
  Description of Artificial Sequence: Synthetic polypeptide
DEREIRTTNPVATEQYGSVSSTTPAGPNMRNGMNPV

SEQ ID NO: 123596 - protein, 36 aa, Artificial Sequence
  Description of Artificial Sequence: Synthetic polypeptide
DEREIRTTNPVATEQYGSVQSTTPAGPNMRNGMNPV

SEQ ID NO: 123597 - protein, 30 aa, Artificial Sequence
  Description of Artificial Sequence: Synthetic polypeptide
QEEEIATTNPVATEQYGEASEVCQHEEEEK

SEQ ID NO: 123598 - protein, 34 aa, Artificial Sequence
  Description of Artificial Sequence: Synthetic polypeptide
DEREIRTTNPVATEQYGCVCSTMEHQENFNSDQA

SEQ ID NO: 123599 - protein, 32 aa, Artificial Sequence
  Description of Artificial Sequence: Synthetic polypeptide
DEREEATTNPVAYEQWGEVSTNLNGDHGDNEQ

SEQ ID NO: 123600 - protein, 34 aa, Artificial Sequence
  Description of Artificial Sequence: Synthetic polypeptide
DEEEIATTNPVATEQYGCVAATNLADAGIGEADD

SEQ ID NO: 123601 - protein, 34 aa, Artificial Sequence
  Description of Artificial Sequence: Synthetic polypeptide
DEREIRTTNPVATEQYGCVCSTGEHQNFNSDTQA

SEQ ID NO: 123602 - protein, 37 aa, Artificial Sequence
  Description of Artificial Sequence: Synthetic polypeptide
DEEEIRTTNPVATEQYGSVISPTYNMETERSDEQNSV

SEQ ID NO: 123603 - protein, 34 aa, Artificial Sequence
  Description of Artificial Sequence: Synthetic polypeptide
DEREIRTTNPVATEQYGCVCSTEEHQENFNSDQS

SEQ ID NO: 123604 - protein, 34 aa, Artificial Sequence
  Description of Artificial Sequence: Synthetic polypeptide
DEEEIATTNPVATEQYGCVAANGELIDNPGGENH

SEQ ID NO: 123605 - protein, 30 aa, Artificial Sequence
  Description of Artificial Sequence: Synthetic polypeptide
DEEEIATTNPVATEQWGTNCSAAPMRSPDS

SEQ ID NO: 123606 - protein, 35 aa, Artificial Sequence
  Description of Artificial Sequence: Synthetic polypeptide
DEAVIRTTNPVATEQYGCCVACTNEPSERTGGNRR

SEQ ID NO: 123607 - protein, 34 aa, Artificial Sequence
  Description of Artificial Sequence: Synthetic polypeptide
DESAIRTTNPVATECWGSVCSCINEPQDREGENG

SEQ ID NO: 123608 - protein, 29 aa, Artificial Sequence
  Description of Artificial Sequence: Synthetic peptide
QEEEIATTNPVATEQYGEAPHVCQMHEEK

SEQ ID NO: 123609 - protein, 35 aa, Artificial Sequence
  Description of Artificial Sequence: Synthetic polypeptide
DEMEIRTTNPVATEQYGSVWVSPNDLESFTQSFID

SEQ ID NO: 123610 - protein, 29 aa, Artificial Sequence
  Description of Artificial Sequence: Synthetic peptide
QEEEIATTNPVATEQYGEAPIEVCQHDEK

SEQ ID NO: 123611 - protein, 33 aa, Artificial Sequence
  Description of Artificial Sequence: Synthetic polypeptide
DEMEIRTTNPVATEQYGSVWVSNQQEVSSDSDI

SEQ ID NO: 123612 - protein, 34 aa, Artificial Sequence
  Description of Artificial Sequence: Synthetic polypeptide
DESCIRTTNPVATEQYGSVLCTGNQSTWTGTKNE

SEQ ID NO: 123613 - protein, 33 aa, Artificial Sequence
  Description of Artificial Sequence: Synthetic polypeptide
DEMEIRTTNPVATEQYGSVWVSNHQLEVSSDDI

SEQ ID NO: 123614 - protein, 29 aa, Artificial Sequence
  Description of Artificial Sequence: Synthetic peptide
QEEEIATTNPVATEQYGEAPIEVCQHEEK

SEQ ID NO: 123615 - protein, 33 aa, Artificial Sequence
  Description of Artificial Sequence: Synthetic polypeptide
DEMEIRTTNPVATEQYGSVWVPNWDEYGGDDFQ

SEQ ID NO: 123616 - protein, 31 aa, Artificial Sequence
  Description of Artificial Sequence: Synthetic polypeptide
DEAVIRTTNPVATEQYGCVCETEPQYNSDQA

SEQ ID NO: 123617 - protein, 33 aa, Artificial Sequence
  Description of Artificial Sequence: Synthetic polypeptide
DEMEIRTTNPVATEQYGSVWTTYVDLEAEDVQM

SEQ ID NO: 123618 - protein, 29 aa, Artificial Sequence
  Description of Artificial Sequence: Synthetic peptide
QEEEIATTNPVATEQYGEAPIEVGQAEEH

SEQ ID NO: 123619 - protein, 32 aa, Artificial Sequence
  Description of Artificial Sequence: Synthetic polypeptide
DEQTIATTNPGATEQYGSVSATDLEDHEGEDL

SEQ ID NO: 123620 - protein, 34 aa, Artificial Sequence
  Description of Artificial Sequence: Synthetic polypeptide
DEMEIRTTNPVATEQYGSVWTAATLENSTENMQQ

SEQ ID NO: 123621 - protein, 29 aa, Artificial Sequence
  Description of Artificial Sequence: Synthetic peptide
QEEEIATTNPVATEQYGEAPIVCQHEEKH

SEQ ID NO: 123622 - protein, 29 aa, Artificial Sequence
  Description of Artificial Sequence: Synthetic peptide
QEEEIATTNPVATEQYGEAPIVCQHEEWK

SEQ ID NO: 123623 - protein, 33 aa, Artificial Sequence
  Description of Artificial Sequence: Synthetic polypeptide
DEQTIATTNPVATEQYGRSVSATDLEDHEGEDL

SEQ ID NO: 123624 - protein, 29 aa, Artificial Sequence
  Description of Artificial Sequence: Synthetic peptide
QEEEIATTNPVATEQYGEAPKEVCQHEEK

SEQ ID NO: 123625 - protein, 29 aa, Artificial Sequence
  Description of Artificial Sequence: Synthetic peptide
QEEEIATTNPVATEQYGEAPKEVSQHEEK

SEQ ID NO: 123626 - protein, 33 aa, Artificial Sequence
  Description of Artificial Sequence: Synthetic polypeptide
DEQTEIATTNPVAYEGWGSVATNLQGDHGNGSP

SEQ ID NO: 123627 - protein, 32 aa, Artificial Sequence
  Description of Artificial Sequence: Synthetic polypeptide
DEQSIATTNPVATSQYGSVSATDLEDHEGEDL

SEQ ID NO: 123628 - protein, 33 aa, Artificial Sequence
  Description of Artificial Sequence: Synthetic polypeptide
DEQSIATTNPVATEQYGSVSATVDLEDHEGEDL

SEQ ID NO: 123629 - protein, 29 aa, Artificial Sequence
  Description of Artificial Sequence: Synthetic peptide
QEEEIATTNPVATEQYGEAPHEVCQHEEK

SEQ ID NO: 123630 - protein, 29 aa, Artificial Sequence
  Description of Artificial Sequence: Synthetic peptide
QEEEIATTNPVATEQYGEAPFEVCQHEEK

SEQ ID NO: 123631 - protein, 33 aa, Artificial Sequence
  Description of Artificial Sequence: Synthetic polypeptide
DEQSIATTNPVATEQYGESVSATDLEDHEGEDL

SEQ ID NO: 123632 - protein, 32 aa, Artificial Sequence
  Description of Artificial Sequence: Synthetic polypeptide
DEQSIATTNPVATEQYGSMSATDLEDHEGEDL

SEQ ID NO: 123633 - protein, 29 aa, Artificial Sequence
  Description of Artificial Sequence: Synthetic peptide
QEEEIATTNPVATEQYGEAPFVCQHEEDK

SEQ ID NO: 123634 - protein, 37 aa, Artificial Sequence
  Description of Artificial Sequence: Synthetic polypeptide
DEEEIRTTNPVATEQYGSVISTTPDGPNMGNGENDDG

SEQ ID NO: 123635 - protein, 36 aa, Artificial Sequence
  Description of Artificial Sequence: Synthetic polypeptide
DEEEIRTTNPVATEQYGSVISTTPDGPNMGNGEFDG

SEQ ID NO: 123636 - protein, 29 aa, Artificial Sequence
  Description of Artificial Sequence: Synthetic peptide
QEEEIATTNPVATEQYGEAPGEVCQHEEK

SEQ ID NO: 123637 - protein, 35 aa, Artificial Sequence
  Description of Artificial Sequence: Synthetic polypeptide
DEMEIRTTNPVATEQYGSWASPTDLHLERNDENVM

SEQ ID NO: 123638 - protein, 29 aa, Artificial Sequence
  Description of Artificial Sequence: Synthetic peptide
QEEEIATTNPVATEQYGEAPGEVCQHLEK

SEQ ID NO: 123639 - protein, 30 aa, Artificial Sequence
  Description of Artificial Sequence: Synthetic polypeptide
QEEEIATTNPVATEQYGEAPGVCLQHEDDK

SEQ ID NO: 123640 - protein, 29 aa, Artificial Sequence
  Description of Artificial Sequence: Synthetic peptide
QEEEIATTNPVATEQYGEAPGVCQHDEEK

SEQ ID NO: 123641 - protein, 33 aa, Artificial Sequence
  Description of Artificial Sequence: Synthetic polypeptide
DEAEIATTNPVAYEQWGAVSTNMNAGNAGENSR

SEQ ID NO: 123642 - protein, 35 aa, Artificial Sequence
  Description of Artificial Sequence: Synthetic polypeptide
DEEEIRTTNPVATEQYGTYEIPTTLPLQREENLNQ

SEQ ID NO: 123643 - protein, 32 aa, Artificial Sequence
  Description of Artificial Sequence: Synthetic polypeptide
DEQSIATTNPVATEQYGSVSATDFEDHEGEDL

SEQ ID NO: 123644 - protein, 35 aa, Artificial Sequence
  Description of Artificial Sequence: Synthetic polypeptide
DEMEIRTTNPVATEQYGSVYTGNDDNQQLEGEEDK

SEQ ID NO: 123645 - protein, 32 aa, Artificial Sequence
  Description of Artificial Sequence: Synthetic polypeptide
DEQSIATTNPVATEQYGSVSATDLEDHEEEDL

SEQ ID NO: 123646 - protein, 33 aa, Artificial Sequence
  Description of Artificial Sequence: Synthetic polypeptide
DEQSIATTNPVATEQYGSVSATDLEDHEGEDLL

SEQ ID NO: 123647 - protein, 29 aa, Artificial Sequence
  Description of Artificial Sequence: Synthetic peptide
QEEEIATTNPVATEQYGEAPGVCRQHEEK

SEQ ID NO: 123648 - protein, 34 aa, Artificial Sequence
  Description of Artificial Sequence: Synthetic polypeptide
DEEEIATTNPVATEQWGSVSMSGNGQPAGVPVMN

SEQ ID NO: 123649 - protein, 34 aa, Artificial Sequence
  Description of Artificial Sequence: Synthetic polypeptide
DEEEIATTNPVATEQWGSVSTTEPLNIHQGDEDA

SEQ ID NO: 123650 - protein, 29 aa, Artificial Sequence
  Description of Artificial Sequence: Synthetic peptide
QEEEIATTNPVATEQYGEAPKVCQHNEEK

SEQ ID NO: 123651 - protein, 33 aa, Artificial Sequence
  Description of Artificial Sequence: Synthetic polypeptide
DEMEIRTTNPVATEQYGSVWPMTEENRSEDYEN

SEQ ID NO: 123652 - protein, 32 aa, Artificial Sequence
  Description of Artificial Sequence: Synthetic polypeptide
DEQTIATTNPVATEQYGSVLATDLEDHEGEDL

SEQ ID NO: 123653 - protein, 34 aa, Artificial Sequence
  Description of Artificial Sequence: Synthetic polypeptide
DEMEIRTTNPVATEQYGSVTVTLIDTRPGSDGTG

SEQ ID NO: 123654 - protein, 29 aa, Artificial Sequence
  Description of Artificial Sequence: Synthetic peptide
QEEEIATTNPVATEQYGEAPQEVCQHEEK

SEQ ID NO: 123655 - protein, 34 aa, Artificial Sequence
  Description of Artificial Sequence: Synthetic polypeptide
DEMEIRTTNPVATEQYGSVTTYVDLQEYADDVQM

SEQ ID NO: 123656 - protein, 29 aa, Artificial Sequence
  Description of Artificial Sequence: Synthetic peptide
QEEEIATTNPVATEQYGEAPQVCQHEVEK

SEQ ID NO: 123657 - protein, 33 aa, Artificial Sequence
  Description of Artificial Sequence: Synthetic polypeptide
DEAVEIATTNPVAYEPWGEVSTNLGGNAGENAR

SEQ ID NO: 123658 - protein, 29 aa, Artificial Sequence
  Description of Artificial Sequence: Synthetic peptide
QEEEIATTNPVATEQYGEAPQVCQPHEEK

SEQ ID NO: 123659 - protein, 29 aa, Artificial Sequence
  Description of Artificial Sequence: Synthetic peptide
QEEEIATTNPVATEQYGEAPRAVCQHEEK

SEQ ID NO: 123660 - protein, 29 aa, Artificial Sequence
  Description of Artificial Sequence: Synthetic peptide
QEEEIATTNPVATEQYGEAPREVCQHEEK

SEQ ID NO: 123661 - protein, 29 aa, Artificial Sequence
  Description of Artificial Sequence: Synthetic peptide
QEEEIATTNPVATEQYGEAPREVCQHERK

SEQ ID NO: 123662 - protein, 29 aa, Artificial Sequence
  Description of Artificial Sequence: Synthetic peptide
QEEEIATTNPVATEQYGEAPRKVCQTEYK

SEQ ID NO: 123663 - protein, 32 aa, Artificial Sequence
  Description of Artificial Sequence: Synthetic polypeptide
DEAVIRTTNPVATEQYGCVCETAPQYFGSDQG

SEQ ID NO: 123664 - protein, 34 aa, Artificial Sequence
  Description of Artificial Sequence: Synthetic polypeptide
DESCIRTTNPVATECWGSVSCINEPQDREGENAG

SEQ ID NO: 123665 - protein, 33 aa, Artificial Sequence
  Description of Artificial Sequence: Synthetic polypeptide
DEEEIATTNPVATEQWGTNCSAAANLMRESNDS

SEQ ID NO: 123666 - protein, 34 aa, Artificial Sequence
  Description of Artificial Sequence: Synthetic polypeptide
DESCIRTTNPVATECWGHSVSCINEPQDREGENG

SEQ ID NO: 123667 - protein, 34 aa, Artificial Sequence
  Description of Artificial Sequence: Synthetic polypeptide
CSSEIRTTNPVATEQYGSVSMSLDTQEGSIENFG

SEQ ID NO: 123668 - protein, 34 aa, Artificial Sequence
  Description of Artificial Sequence: Synthetic polypeptide
DESAVIRTTNPVATECWGSVSCINEPQDREGENG

SEQ ID NO: 123669 - protein, 29 aa, Artificial Sequence
  Description of Artificial Sequence: Synthetic peptide
QEEEIATTNPVATEQYGEAPRVMCQHEEK

SEQ ID NO: 123670 - protein, 34 aa, Artificial Sequence
  Description of Artificial Sequence: Synthetic polypeptide
DESAIRTTNPVAYEQWGCSVIETNMDQRDQGGDR

SEQ ID NO: 123671 - protein, 33 aa, Artificial Sequence
  Description of Artificial Sequence: Synthetic polypeptide
DESAIRTTNPVATECWGSVSCINEPQDREWENG

SEQ ID NO: 123672 - protein, 34 aa, Artificial Sequence
  Description of Artificial Sequence: Synthetic polypeptide
DEMEIRTTNPVATEQYGSVTVTLIDTRPQSDGEM

SEQ ID NO: 123673 - protein, 29 aa, Artificial Sequence
  Description of Artificial Sequence: Synthetic peptide
QEEEIATTNPVATEQYGEAPEYVCQHEEK

SEQ ID NO: 123674 - protein, 29 aa, Artificial Sequence
  Description of Artificial Sequence: Synthetic peptide
QEEEIATTNPVATEQYGEAPPEVCQHEHK

SEQ ID NO: 123675 - protein, 29 aa, Artificial Sequence
  Description of Artificial Sequence: Synthetic peptide
QEEEIATTNPVATEQYGEAPPEVCQHEDK

SEQ ID NO: 123676 - protein, 29 aa, Artificial Sequence
  Description of Artificial Sequence: Synthetic peptide
QEEEIATTNPVATEQYGEAPLEVCQHEEK

SEQ ID NO: 123677 - protein, 36 aa, Artificial Sequence
  Description of Artificial Sequence: Synthetic polypeptide
DEEEIRTTNPVATEQYGSVISTPDVNQEFEAGGQGE

SEQ ID NO: 123678 - protein, 34 aa, Artificial Sequence
  Description of Artificial Sequence: Synthetic polypeptide
DEMEIRTTNPVATEQYGSVWPMFNLENRSEDQEM

SEQ ID NO: 123679 - protein, 35 aa, Artificial Sequence
  Description of Artificial Sequence: Synthetic polypeptide
DESCIRTTNPVATEQYGSVCSCTGNQSVLTGTKNF

SEQ ID NO: 123680 - protein, 34 aa, Artificial Sequence
  Description of Artificial Sequence: Synthetic polypeptide
DEMEIRTTNPVATEQYGSVWPMENLENRSEEDYE

SEQ ID NO: 123681 - protein, 29 aa, Artificial Sequence
  Description of Artificial Sequence: Synthetic peptide
QEEEIATTNPVATEQYGEAPMEVCQHEEK

SEQ ID NO: 123682 - protein, 33 aa, Artificial Sequence
  Description of Artificial Sequence: Synthetic polypeptide
DEMEIRTTNPVATEQYGSVVVTYNPEFIDVQQQ

SEQ ID NO: 123683 - protein, 33 aa, Artificial Sequence
  Description of Artificial Sequence: Synthetic polypeptide
DEMEIRTTNPVATEQYGSVVTTFVDSEREDVQM

SEQ ID NO: 123684 - protein, 30 aa, Artificial Sequence
  Description of Artificial Sequence: Synthetic polypeptide
QEEEIATTNPVATEQYGEAPMEVCQQHENH

SEQ ID NO: 123685 - protein, 33 aa, Artificial Sequence
  Description of Artificial Sequence: Synthetic polypeptide
DEMEIRTTNPVATEQYGSVVTLVASHFENSEEK

SEQ ID NO: 123686 - protein, 33 aa, Artificial Sequence
  Description of Artificial Sequence: Synthetic polypeptide
DEMEIRTTNPVATEQYGSVVSVLNEMVFESEQA

SEQ ID NO: 123687 - protein, 28 aa, Artificial Sequence
  Description of Artificial Sequence: Synthetic peptide
QEEEIATTNPVATEQYGEAPMVCGHEEK

SEQ ID NO: 123688 - protein, 33 aa, Artificial Sequence
  Description of Artificial Sequence: Synthetic polypeptide
DEEEIATTNPVATEQWGSVSVGDPTDNDGGEQG

SEQ ID NO: 123689 - protein, 33 aa, Artificial Sequence
  Description of Artificial Sequence: Synthetic polypeptide
DEMEIRTTNPVATEQYGSVTWYDHTERDLESDN

SEQ ID NO: 123690 - protein, 34 aa, Artificial Sequence
  Description of Artificial Sequence: Synthetic polypeptide
DEMEIRTTNPVATEQYGSVTWTYVDSQEDDNDQM

SEQ ID NO: 123691 - protein, 29 aa, Artificial Sequence
  Description of Artificial Sequence: Synthetic peptide
QEEEIATTNPVATEQYGEAPNEVCQHEEK

SEQ ID NO: 123692 - protein, 36 aa, Artificial Sequence
  Description of Artificial Sequence: Synthetic polypeptide
DEEEIATTNPVATEQWGSVSVTGDPNDQTAMGNADD

SEQ ID NO: 123693 - protein, 35 aa, Artificial Sequence
  Description of Artificial Sequence: Synthetic polypeptide
DEMEIRTTNPVATEQYGSVTWTYVDLQENDNTQMW

SEQ ID NO: 123694 - protein, 29 aa, Artificial Sequence
  Description of Artificial Sequence: Synthetic peptide
QEEEIATTNPVATEQYGEAPNVSCQHEEK

SEQ ID NO: 123695 - protein, 29 aa, Artificial Sequence
  Description of Artificial Sequence: Synthetic peptide
QEEEIATTNPVATEQYGEAPPEVCQHEEK

SEQ ID NO: 123696 - protein, 29 aa, Artificial Sequence
  Description of Artificial Sequence: Synthetic peptide
QEEEIATTNPVATEQYGEAPEVETAHEEG

SEQ ID NO: 123697 - protein, 29 aa, Artificial Sequence
  Description of Artificial Sequence: Synthetic peptide
QEEEIATTNPVATEQYGEAPEVEQHLEEG

SEQ ID NO: 123698 - protein, 29 aa, Artificial Sequence
  Description of Artificial Sequence: Synthetic peptide
QEEEIATTNPVATEQYGEAPEVEQHEEKK

SEQ ID NO: 123699 - protein, 34 aa, Artificial Sequence
  Description of Artificial Sequence: Synthetic polypeptide
DEMEISTTNPVATEQYGTVCSYTDGPNEHEGEND

SEQ ID NO: 123700 - protein, 34 aa, Artificial Sequence
  Description of Artificial Sequence: Synthetic polypeptide
DEMEISTTNPVATEQYGTVCSYTDGPNEGEGNND

SEQ ID NO: 123701 - protein, 28 aa, Artificial Sequence
  Description of Artificial Sequence: Synthetic peptide
DESEIASTNPVGTEGYGVMACTLQHGDI

SEQ ID NO: 123702 - protein, 29 aa, Artificial Sequence
  Description of Artificial Sequence: Synthetic peptide
QEEEIATTNPVATEQYGEAPEVCQHEEGK

SEQ ID NO: 123703 - protein, 32 aa, Artificial Sequence
  Description of Artificial Sequence: Synthetic polypeptide
DESEIASTNPVGTEGYGSMSCINEQDREGENG

SEQ ID NO: 123704 - protein, 29 aa, Artificial Sequence
  Description of Artificial Sequence: Synthetic peptide
QEEEIATTNPVATEQYGEAPEVCQHEEHK

SEQ ID NO: 123705 - protein, 29 aa, Artificial Sequence
  Description of Artificial Sequence: Synthetic peptide
QEEEIATTNPVATEQYGEAPEVCQHEEIK

SEQ ID NO: 123706 - protein, 29 aa, Artificial Sequence
  Description of Artificial Sequence: Synthetic peptide
QEEEIATTNPVATEQYGEAPEVCQHEEKA

SEQ ID NO: 123707 - protein, 35 aa, Artificial Sequence
  Description of Artificial Sequence: Synthetic polypeptide
DEEEIRTTNPVATEQYGSVIYPTVILQTMEVTTLI

SEQ ID NO: 123708 - protein, 29 aa, Artificial Sequence
  Description of Artificial Sequence: Synthetic peptide
QEEEIATTNPVATEQYGEAPEVCQHEEKC

SEQ ID NO: 123709 - protein, 29 aa, Artificial Sequence
  Description of Artificial Sequence: Synthetic peptide
QEEEIATTNPVATEQYGEAPEVCQHEEKE

SEQ ID NO: 123710 - protein, 34 aa, Artificial Sequence
  Description of Artificial Sequence: Synthetic polypeptide
DEMEISTTNPVATEQYGTVCSNTGEPNEFFGNDA

SEQ ID NO: 123711 - protein, 31 aa, Artificial Sequence
  Description of Artificial Sequence: Synthetic polypeptide
DEQEIRTTNPVSTEQYGTISMDIQQQHNGEL

SEQ ID NO: 123712 - protein, 29 aa, Artificial Sequence
  Description of Artificial Sequence: Synthetic peptide
QEEEIATTNPVATEQYGEAPEVCQHEEKF

SEQ ID NO: 123713 - protein, 29 aa, Artificial Sequence
  Description of Artificial Sequence: Synthetic peptide
QEEEIATTNPVATEQYGEAPEVCQHEEKG

SEQ ID NO: 123714 - protein, 33 aa, Artificial Sequence
  Description of Artificial Sequence: Synthetic polypeptide
DEMEISTTNPVATEQYGTVCSKTDGPMENEGND

SEQ ID NO: 123715 - protein, 33 aa, Artificial Sequence
  Description of Artificial Sequence: Synthetic polypeptide
DEMEISTTNPVATEQYGTVCSDTDEPVEFEGND

SEQ ID NO: 123716 - protein, 29 aa, Artificial Sequence
  Description of Artificial Sequence: Synthetic peptide
QEEEIATTNPVATEQYGEAPEVCQHEEKH

SEQ ID NO: 123717 - protein, 29 aa, Artificial Sequence
  Description of Artificial Sequence: Synthetic peptide
QEEEIATTNPVATEQYGEAPEVCQHEEKD

SEQ ID NO: 123718 - protein, 29 aa, Artificial Sequence
  Description of Artificial Sequence: Synthetic peptide
QEEEIATTNPVATEQYGEAPEVCQHEEFK

SEQ ID NO: 123719 - protein, 29 aa, Artificial Sequence
  Description of Artificial Sequence: Synthetic peptide
QEEEIATTNPVATEQYGEAPEVCQHEEEL

SEQ ID NO: 123720 - protein, 28 aa, Artificial Sequence
  Description of Artificial Sequence: Synthetic peptide
DESEIASTNPVGTEGYGVMASDLQHGDI

SEQ ID NO: 123721 - protein, 29 aa, Artificial Sequence
  Description of Artificial Sequence: Synthetic peptide
QEEEIATTNPVATEQYGEAPEVCQHEAEK

SEQ ID NO: 123722 - protein, 28 aa, Artificial Sequence
  Description of Artificial Sequence: Synthetic peptide
DESEIASTNPVGTEGYGVMASTEQHGDI

SEQ ID NO: 123723 - protein, 28 aa, Artificial Sequence
  Description of Artificial Sequence: Synthetic peptide
DESEIASTNPVGTEGYGVMASTEQAGDI

SEQ ID NO: 123724 - protein, 33 aa, Artificial Sequence
  Description of Artificial Sequence: Synthetic polypeptide
DEAENATTNPVAYEQWGVVCSTNLQGDAGNGEY

SEQ ID NO: 123725 - protein, 29 aa, Artificial Sequence
  Description of Artificial Sequence: Synthetic peptide
QEEEIATTNPVATEQYGEAPEVCQHECEK

SEQ ID NO: 123726 - protein, 29 aa, Artificial Sequence
  Description of Artificial Sequence: Synthetic peptide
QEEEIATTNPVATEQYGEAPEVCQHEDEK

SEQ ID NO: 123727 - protein, 34 aa, Artificial Sequence
  Description of Artificial Sequence: Synthetic polypeptide
DEAGEIATTNPVAYECWGSVSTNLQGNAGENDGM

SEQ ID NO: 123728 - protein, 36 aa, Artificial Sequence
  Description of Artificial Sequence: Synthetic polypeptide
DEEEIRTTNPVATEQYGSVIYTPNSQQVREMVELGA

SEQ ID NO: 123729 - protein, 29 aa, Artificial Sequence
  Description of Artificial Sequence: Synthetic peptide
QEEEIATTNPVATEQYGEAPEVCQHEEAE

SEQ ID NO: 123730 - protein, 28 aa, Artificial Sequence
  Description of Artificial Sequence: Synthetic peptide
DESEIASTNPVGTEGYGVMASILQHGDI

SEQ ID NO: 123731 - protein, 29 aa, Artificial Sequence
  Description of Artificial Sequence: Synthetic peptide
QEEEIATTNPVATEQYGEAPEVCQHEEAK

SEQ ID NO: 123732 - protein, 29 aa, Artificial Sequence
  Description of Artificial Sequence: Synthetic peptide
QEEEIATTNPVATEQYGEAPEVCQHEEAM

SEQ ID NO: 123733 - protein, 29 aa, Artificial Sequence
  Description of Artificial Sequence: Synthetic peptide
QEEEIATTNPVATEQYGEAPEVCQHEECK

SEQ ID NO: 123734 - protein, 37 aa, Artificial Sequence
  Description of Artificial Sequence: Synthetic polypeptide
DEEEIRTTNPVATEQYGSVIYTANFQNQVRENVELGA

SEQ ID NO: 123735 - protein, 29 aa, Artificial Sequence
  Description of Artificial Sequence: Synthetic peptide
QEEEIATTNPVATEQYGEAPEVCQHEEDK

SEQ ID NO: 123736 - protein, 29 aa, Artificial Sequence
  Description of Artificial Sequence: Synthetic peptide
QEEEIATTNPVATEQYGEAPEVCQHEEDV

SEQ ID NO: 123737 - protein, 35 aa, Artificial Sequence
  Description of Artificial Sequence: Synthetic polypeptide
DEEEIRTTNPVATEQYGSVIYPWANTEQDREMEHN

SEQ ID NO: 123738 - protein, 29 aa, Artificial Sequence
  Description of Artificial Sequence: Synthetic peptide
QEEEIATTNPVATEQYGEAPEVCQHEEEK

SEQ ID NO: 123739 - protein, 29 aa, Artificial Sequence
  Description of Artificial Sequence: Synthetic peptide
DESEIASTNPVGTEGYGVMASETLQHGDI

SEQ ID NO: 123740 - protein, 33 aa, Artificial Sequence
  Description of Artificial Sequence: Synthetic polypeptide
DEMEISTTNPVATEQYGTVCSCTDGPSEFTGND

SEQ ID NO: 123741 - protein, 29 aa, Artificial Sequence
  Description of Artificial Sequence: Synthetic peptide
QEEEIATTNPVATEQYGEAPEVCQHDEKK

SEQ ID NO: 123742 - protein, 34 aa, Artificial Sequence
  Description of Artificial Sequence: Synthetic polypeptide
DEMEISTTNPVATEQYGTVCSATSGVQVEFQGND

SEQ ID NO: 123743 - protein, 33 aa, Artificial Sequence
  Description of Artificial Sequence: Synthetic polypeptide
DEMEISTTNPVATEQYGTVCSATPIPVEFQGND

SEQ ID NO: 123744 - protein, 35 aa, Artificial Sequence
  Description of Artificial Sequence: Synthetic polypeptide
DEEEIRTTNPVATEQYGSVIYPTAETPDLNVNPRL

SEQ ID NO: 123745 - protein, 29 aa, Artificial Sequence
  Description of Artificial Sequence: Synthetic peptide
QEEEIATTNPVATEQYGEAPEVCQHEEPK

SEQ ID NO: 123746 - protein, 29 aa, Artificial Sequence
  Description of Artificial Sequence: Synthetic peptide
QEEEIATTNPVATEQYGEAPEVCQHEEQK

SEQ ID NO: 123747 - protein, 35 aa, Artificial Sequence
  Description of Artificial Sequence: Synthetic polypeptide
DEEEIRTTNPVATEQYGSVIYLPPTHQVRENVELG

SEQ ID NO: 123748 - protein, 29 aa, Artificial Sequence
  Description of Artificial Sequence: Synthetic peptide
DESEIASTNPVGTEGYGATASEDLQHGDI

SEQ ID NO: 123749 - protein, 29 aa, Artificial Sequence
  Description of Artificial Sequence: Synthetic peptide
DESEIASTNPVGTEGYGAMASETLQHGDI

SEQ ID NO: 123750 - protein, 29 aa, Artificial Sequence
  Description of Artificial Sequence: Synthetic peptide
QEEEIATTNPVATEQYGEAPEVCQHEESK

SEQ ID NO: 123751 - protein, 29 aa, Artificial Sequence
  Description of Artificial Sequence: Synthetic peptide
QEEEIATTNPVATEQYGEAPEVCQHEETK

SEQ ID NO: 123752 - protein, 30 aa, Artificial Sequence
  Description of Artificial Sequence: Synthetic polypeptide
QEEEIATTNPVATEQYGEAPEVCQHEEMKR

SEQ ID NO: 123753 - protein, 29 aa, Artificial Sequence
  Description of Artificial Sequence: Synthetic peptide
DESEIASTNPVGTEGYGAMASEDLQHGDI

SEQ ID NO: 123754 - protein, 34 aa, Artificial Sequence
  Description of Artificial Sequence: Synthetic polypeptide
DEANEIATTNPVAYEQWGSVCSTNDQGEGNNTNT

SEQ ID NO: 123755 - protein, 29 aa, Artificial Sequence
  Description of Artificial Sequence: Synthetic peptide
QEEEIATTNPVATEQYGEAPEVCQHEEVN

SEQ ID NO: 123756 - protein, 36 aa, Artificial Sequence
  Description of Artificial Sequence: Synthetic polypeptide
DEEEIRTTNPVATEQYGSVIYILPNTQQVRENVELG

SEQ ID NO: 123757 - protein, 29 aa, Artificial Sequence
  Description of Artificial Sequence: Synthetic peptide
QEEEIATTNPVATEQYGEAPEVCQHEEWK

SEQ ID NO: 123758 - protein, 29 aa, Artificial Sequence
  Description of Artificial Sequence: Synthetic peptide
DESEIASTNPVGTEGYGAMANSTLQHGPI

SEQ ID NO: 123759 - protein, 29 aa, Artificial Sequence
  Description of Artificial Sequence: Synthetic peptide
QEEEIATTNPVATEQYGEAPEVCQHEEYK

SEQ ID NO: 123760 - protein, 29 aa, Artificial Sequence
  Description of Artificial Sequence: Synthetic peptide
QEEEIATTNPVATEQYGEAPEVCQHEFEK

SEQ ID NO: 123761 - protein, 35 aa, Artificial Sequence
  Description of Artificial Sequence: Synthetic polypeptide
DEEEIRTTNPVATEQYGSVIYCTPYLQQMEVTTLI

SEQ ID NO: 123762 - protein, 29 aa, Artificial Sequence
  Description of Artificial Sequence: Synthetic peptide
QEEEIATTNPVATEQYGEAPEVCQHEEVK

SEQ ID NO: 123763 - protein, 29 aa, Artificial Sequence
  Description of Artificial Sequence: Synthetic peptide
QEEEIATTNPVATEQYGEAPEVCQHEEMK

SEQ ID NO: 123764 - protein, 36 aa, Artificial Sequence
  Description of Artificial Sequence: Synthetic polypeptide
DEEEIRTTNPVATEQYGSVIYPTEPLLERLNPDNNE

SEQ ID NO: 123765 - protein, 29 aa, Artificial Sequence
  Description of Artificial Sequence: Synthetic peptide
QEEEIATTNPVATEQYGEAPEVCQHEELK

SEQ ID NO: 123766 - protein, 35 aa, Artificial Sequence
  Description of Artificial Sequence: Synthetic polypeptide
DEMEISTTNPVATEQYGTVCSATPGNPVEQQGQND

SEQ ID NO: 123767 - protein, 29 aa, Artificial Sequence
  Description of Artificial Sequence: Synthetic peptide
QEEEIATTNPVATEQYGEAPEVCQHEEKK

SEQ ID NO: 123768 - protein, 29 aa, Artificial Sequence
  Description of Artificial Sequence: Synthetic peptide
QEEEIATTNPVATEQYGEAPEVCQHEEKL

SEQ ID NO: 123769 - protein, 34 aa, Artificial Sequence
  Description of Artificial Sequence: Synthetic polypeptide
DEMEISTTNPVATEQYGTVCSATMAQVEFQGMND

SEQ ID NO: 123770 - protein, 29 aa, Artificial Sequence
  Description of Artificial Sequence: Synthetic peptide
QEEEIATTNPVATEQYGEAPEVCQHEEKM

SEQ ID NO: 123771 - protein, 29 aa, Artificial Sequence
  Description of Artificial Sequence: Synthetic peptide
QEEEIATTNPVATEQYGEAPEVCQHEEKN

SEQ ID NO: 123772 - protein, 29 aa, Artificial Sequence
  Description of Artificial Sequence: Synthetic peptide
QEEEIATTNPVATEQYGEAPEVCQHEEKP

SEQ ID NO: 123773 - protein, 30 aa, Artificial Sequence
  Description of Artificial Sequence: Synthetic polypeptide
DESEIASTNPVGTEGYGSMASTLQHEGEDI

SEQ ID NO: 123774 - protein, 29 aa, Artificial Sequence
  Description of Artificial Sequence: Synthetic peptide
QEEEIATTNPVATEQYGEAPEVCQHEEKQ

SEQ ID NO: 123775 - protein, 33 aa, Artificial Sequence
  Description of Artificial Sequence: Synthetic polypeptide
DEMEISTTNPVATEQYGTVCSATDGPVEFEGND

SEQ ID NO: 123776 - protein, 29 aa, Artificial Sequence
  Description of Artificial Sequence: Synthetic peptide
DESEIASTNPVGTEGYGSMACTLQHGEDI

SEQ ID NO: 123777 - protein, 33 aa, Artificial Sequence
  Description of Artificial Sequence: Synthetic polypeptide
DEMEISTTNPVATEQYGTVCSATDGPSHFEGND

SEQ ID NO: 123778 - protein, 29 aa, Artificial Sequence
  Description of Artificial Sequence: Synthetic peptide
QEEEIATTNPVATEQYGEAPEVCQHEEKS

SEQ ID NO: 123779 - protein, 32 aa, Artificial Sequence
  Description of Artificial Sequence: Synthetic polypeptide
DESEIASTNPVGTEGYGSMACINLQDREGENG

SEQ ID NO: 123780 - protein, 29 aa, Artificial Sequence
  Description of Artificial Sequence: Synthetic peptide
QEEEIATTNPVATEQYGEAPEVCQHEEKT

SEQ ID NO: 123781 - protein, 29 aa, Artificial Sequence
  Description of Artificial Sequence: Synthetic peptide
QEEEIATTNPVATEQYGEAPEVCQHEEKV

SEQ ID NO: 123782 - protein, 29 aa, Artificial Sequence
  Description of Artificial Sequence: Synthetic peptide
QEEEIATTNPVATEQYGEAPEVCQHEEKW

SEQ ID NO: 123783 - protein, 33 aa, Artificial Sequence
  Description of Artificial Sequence: Synthetic polypeptide
CEEEIACTNPVATEQYGSCATGHLQPDDQGGRM

SEQ ID NO: 123784 - protein, 29 aa, Artificial Sequence
  Description of Artificial Sequence: Synthetic peptide
QEEEIATTNPVATEQYGEAPEVCQHEEKY

SEQ ID NO: 123785 - protein, 29 aa, Artificial Sequence
  Description of Artificial Sequence: Synthetic peptide
QEEEIATTNPVATEQYGEAPEVCQHEEKI

SEQ ID NO: 123786 - protein, 29 aa, Artificial Sequence
  Description of Artificial Sequence: Synthetic peptide
QEEEIATTNPVATEQYGEAPEVCQHDEEK

SEQ ID NO: 123787 - protein, 33 aa, Artificial Sequence
  Description of Artificial Sequence: Synthetic polypeptide
DEQEIRTTNPVSTEPYGSVSAMEDIQEDQEGNL

SEQ ID NO: 123788 - protein, 36 aa, Artificial Sequence
  Description of Artificial Sequence: Synthetic polypeptide
DEEEIRTTNPVATEQYGSVKLTAPAGPNMRNGMNPV

SEQ ID NO: 123789 - protein, 29 aa, Artificial Sequence
  Description of Artificial Sequence: Synthetic peptide
QEEEIATTNPVATEQYGEAPEVCAQHEEK

SEQ ID NO: 123790 - protein, 28 aa, Artificial Sequence
  Description of Artificial Sequence: Synthetic peptide
QEEEIATTNPVATEQYGEAPEVCCHEEK

SEQ ID NO: 123791 - protein, 28 aa, Artificial Sequence
  Description of Artificial Sequence: Synthetic peptide
QEEEIATTNPVATEQYGEAPEVCCHQEK

SEQ ID NO: 123792 - protein, 34 aa, Artificial Sequence
  Description of Artificial Sequence: Synthetic polypeptide
DEMEISTVNPVATEQYGCVCSTNLAENFGSNNQS

SEQ ID NO: 123793 - protein, 33 aa, Artificial Sequence
  Description of Artificial Sequence: Synthetic polypeptide
DEMEISTVNPVATEQYGCVCSTNHAHFGSDNQS

SEQ ID NO: 123794 - protein, 29 aa, Artificial Sequence
  Description of Artificial Sequence: Synthetic peptide
QEEEIATTNPVATEQYGEAPEVCCQEEEK

SEQ ID NO: 123795 - protein, 29 aa, Artificial Sequence
  Description of Artificial Sequence: Synthetic peptide
QEEEIATTNPVATEQYGEAPEVCCQHEEK

SEQ ID NO: 123796 - protein, 33 aa, Artificial Sequence
  Description of Artificial Sequence: Synthetic polypeptide
DECEIATTNPVATEHYGSVCYNNDDQDHGDDSR

SEQ ID NO: 123797 - protein, 28 aa, Artificial Sequence
  Description of Artificial Sequence: Synthetic peptide
QEEEIATTNPVATEQYGEAPEVCAHEEK

SEQ ID NO: 123798 - protein, 33 aa, Artificial Sequence
  Description of Artificial Sequence: Synthetic polypeptide
DEMEISTVNPVATEQYGCVCSTELANFGSQNQS

SEQ ID NO: 123799 - protein, 28 aa, Artificial Sequence
  Description of Artificial Sequence: Synthetic peptide
QEEEIATTNPVATEQYGEAPEVCDHEEK

SEQ ID NO: 123800 - protein, 29 aa, Artificial Sequence
  Description of Artificial Sequence: Synthetic peptide
QEEEIATTNPVATEQYGEAPEVCDQHEEK

SEQ ID NO: 123801 - protein, 28 aa, Artificial Sequence
  Description of Artificial Sequence: Synthetic peptide
QEEEIATTNPVATEQYGEAPEVCEHEEK

SEQ ID NO: 123802 - protein, 29 aa, Artificial Sequence
  Description of Artificial Sequence: Synthetic peptide
QEEEIATTNPVATEQYGEAPEVCEQFEEK

SEQ ID NO: 123803 - protein, 33 aa, Artificial Sequence
  Description of Artificial Sequence: Synthetic polypeptide
DEMEISTTNPVAYEQYGTVCSATDGPNEFEGND

SEQ ID NO: 123804 - protein, 29 aa, Artificial Sequence
  Description of Artificial Sequence: Synthetic peptide
QEEEIATTNPVATEQYGEAPEVCEQHEEK

SEQ ID NO: 123805 - protein, 29 aa, Artificial Sequence
  Description of Artificial Sequence: Synthetic peptide
QEEEIATTNPVATEQYGEAPEVCEQHQEK

SEQ ID NO: 123806 - protein, 28 aa, Artificial Sequence
  Description of Artificial Sequence: Synthetic peptide
QEEEIATTNPVATEQYGEAPEVCFGEEK

SEQ ID NO: 123807 - protein, 33 aa, Artificial Sequence
  Description of Artificial Sequence: Synthetic polypeptide
DECEIATTNPVATEHYGEVSGGNGNAGNDNQRG

SEQ ID NO: 123808 - protein, 35 aa, Artificial Sequence
  Description of Artificial Sequence: Synthetic polypeptide
DEEEIRTTNPVATEQYGSVLPATNQFINTGELSVI

SEQ ID NO: 123809 - protein, 33 aa, Artificial Sequence
  Description of Artificial Sequence: Synthetic polypeptide
DEMEITTTNPVATEQYGTVCSATDGPVEFEGND

SEQ ID NO: 123810 - protein, 33 aa, Artificial Sequence
  Description of Artificial Sequence: Synthetic polypeptide
DEMEITTTNPVATEQYGTVCSATLGPVEFFGND

SEQ ID NO: 123811 - protein, 37 aa, Artificial Sequence
  Description of Artificial Sequence: Synthetic polypeptide
DEEEIRTTNPVATEQYGSVLQTTPATGPNLRQGMNPV

SEQ ID NO: 123812 - protein, 29 aa, Artificial Sequence
  Description of Artificial Sequence: Synthetic peptide
QEEEIATTNPVATEQYGEAPERVCQHEEK

SEQ ID NO: 123813 - protein, 29 aa, Artificial Sequence
  Description of Artificial Sequence: Synthetic peptide
DESEIASTNPVGTEGYGVMIASTLQHGDI

SEQ ID NO: 123814 - protein, 29 aa, Artificial Sequence
  Description of Artificial Sequence: Synthetic peptide
QEEEIATTNPVATEQYGEAPESVCQHEEK

SEQ ID NO: 123815 - protein, 29 aa, Artificial Sequence
  Description of Artificial Sequence: Synthetic peptide
QEEEIATTNPVATEQYGEAPESVCQHWEK

SEQ ID NO: 123816 - protein, 33 aa, Artificial Sequence
  Description of Artificial Sequence: Synthetic polypeptide
DEMEIVATNPVATEQYGTVCSVTDGPVLFEGND

SEQ ID NO: 123817 - protein, 29 aa, Artificial Sequence
  Description of Artificial Sequence: Synthetic peptide
QEEEIATTNPVATEQYGEAPESVCRHEEK

SEQ ID NO: 123818 - protein, 33 aa, Artificial Sequence
  Description of Artificial Sequence: Synthetic polypeptide
DEMEITTTNPVATEQYGTVQSATLGPVESEGNF

SEQ ID NO: 123819 - protein, 34 aa, Artificial Sequence
  Description of Artificial Sequence: Synthetic polypeptide
DECEIATTNPVATEHYGSVSGGNAGNAGNDGQRE

SEQ ID NO: 123820 - protein, 29 aa, Artificial Sequence
  Description of Artificial Sequence: Synthetic peptide
DESEIASTNPVGTEGYGVMASTLQSHGDI

SEQ ID NO: 123821 - protein, 33 aa, Artificial Sequence
  Description of Artificial Sequence: Synthetic polypeptide
DEMEITTTNPVATEQYGTVCSATSGPVHFEGND

SEQ ID NO: 123822 - protein, 32 aa, Artificial Sequence
  Description of Artificial Sequence: Synthetic polypeptide
CEEEIACTNPVATEQYGSCATHLQPDDQTGRM

SEQ ID NO: 123823 - protein, 29 aa, Artificial Sequence
  Description of Artificial Sequence: Synthetic peptide
QEEEIATTNPVATEQYGEAPETCQHHEEK

SEQ ID NO: 123824 - protein, 29 aa, Artificial Sequence
  Description of Artificial Sequence: Synthetic peptide
QEEEIATTNPVATEQYGEAPETCQHVEEK

SEQ ID NO: 123825 - protein, 34 aa, Artificial Sequence
  Description of Artificial Sequence: Synthetic polypeptide
DEEEIRTTNPVATEQYGSVLPAYNQGINGELSQL

SEQ ID NO: 123826 - protein, 29 aa, Artificial Sequence
  Description of Artificial Sequence: Synthetic peptide
QEEEIATTNPVATEQYGEAPEVACQHEEK

SEQ ID NO: 123827 - protein, 29 aa, Artificial Sequence
  Description of Artificial Sequence: Synthetic peptide
QEEEIATTNPVATEQYGEAPEVACQHEEW

SEQ ID NO: 123828 - protein, 29 aa, Artificial Sequence
  Description of Artificial Sequence: Synthetic peptide
QEEEIATTNPVATEQYGEAPEVAIQHEES

SEQ ID NO: 123829 - protein, 29 aa, Artificial Sequence
  Description of Artificial Sequence: Synthetic peptide
QEEEIATTNPVATEQYGEAPEVAQDSEEK

SEQ ID NO: 123830 - protein, 28 aa, Artificial Sequence
  Description of Artificial Sequence: Synthetic peptide
QEEEIATTNPVATEQYGEAPEVCFHEEK

SEQ ID NO: 123831 - protein, 29 aa, Artificial Sequence
  Description of Artificial Sequence: Synthetic peptide
QEEEIATTNPVATEQYGEAPEVCFQHEEK

SEQ ID NO: 123832 - protein, 28 aa, Artificial Sequence
  Description of Artificial Sequence: Synthetic peptide
QEEEIATTNPVATEQYGEAPEVCGHEEK

SEQ ID NO: 123833 - protein, 29 aa, Artificial Sequence
  Description of Artificial Sequence: Synthetic peptide
QEEEIATTNPVATEQYGEAPEVCGQHEEK

SEQ ID NO: 123834 - protein, 29 aa, Artificial Sequence
  Description of Artificial Sequence: Synthetic peptide
QEEEIATTNPVATEQYGEAPEVCQAAEEA

SEQ ID NO: 123835 - protein, 29 aa, Artificial Sequence
  Description of Artificial Sequence: Synthetic peptide
QEEEIATTNPVATEQYGEAPEVCQAHEEK

SEQ ID NO: 123836 - protein, 29 aa, Artificial Sequence
  Description of Artificial Sequence: Synthetic peptide
QEEEIATTNPVATEQYGEAPEVCQAHEFK

SEQ ID NO: 123837 - protein, 31 aa, Artificial Sequence
  Description of Artificial Sequence: Synthetic polypeptide
DEEEIATTNPVATEQWGETTANADWQHGPYK

SEQ ID NO: 123838 - protein, 29 aa, Artificial Sequence
  Description of Artificial Sequence: Synthetic peptide
QEEEIATTNPVATEQYGEAPEVCQCHEEK

SEQ ID NO: 123839 - protein, 31 aa, Artificial Sequence
  Description of Artificial Sequence: Synthetic polypeptide
DEEEIATTNPVATEQWGETTPNADWQHGPYK

SEQ ID NO: 123840 - protein, 29 aa, Artificial Sequence
  Description of Artificial Sequence: Synthetic peptide
QEEEIATTNPVATEQYGEAPEVCQDHEEK

SEQ ID NO: 123841 - protein, 37 aa, Artificial Sequence
  Description of Artificial Sequence: Synthetic polypeptide
DEEEIRTTNPVATEQYGSVLDNTNIQEEMGERGSGEG

SEQ ID NO: 123842 - protein, 29 aa, Artificial Sequence
  Description of Artificial Sequence: Synthetic peptide
QEEEIATTNPVATEQYGEAPEVCQEEEKQ

SEQ ID NO: 123843 - protein, 29 aa, Artificial Sequence
  Description of Artificial Sequence: Synthetic peptide
QEEEIATTNPVATEQYGEAPEVCQEHEEI

SEQ ID NO: 123844 - protein, 29 aa, Artificial Sequence
  Description of Artificial Sequence: Synthetic peptide
QEEEIATTNPVATEQYGEAPEVCQEHEEK

SEQ ID NO: 123845 - protein, 30 aa, Artificial Sequence
  Description of Artificial Sequence: Synthetic polypeptide
QEEEIATTNPVATEQYGEAPEVCQEPENEK

SEQ ID NO: 123846 - protein, 29 aa, Artificial Sequence
  Description of Artificial Sequence: Synthetic peptide
QEEEIATTNPVATEQYGEAPEVCQFHEEK

SEQ ID NO: 123847 - protein, 32 aa, Artificial Sequence
  Description of Artificial Sequence: Synthetic polypeptide
DEQEIRTTNPVSTEPYGSVSAMDLEDHEGEDL

SEQ ID NO: 123848 - protein, 29 aa, Artificial Sequence
  Description of Artificial Sequence: Synthetic peptide
QEEEIATTNPVATEQYGEAPEVCQGHEEK

SEQ ID NO: 123849 - protein, 29 aa, Artificial Sequence
  Description of Artificial Sequence: Synthetic peptide
QEEEIATTNPVATEQYGEAPEVCQHAEEC

SEQ ID NO: 123850 - protein, 29 aa, Artificial Sequence
  Description of Artificial Sequence: Synthetic peptide
QEEEIATTNPVATEQYGEAPEVCQHAEEK

SEQ ID NO: 123851 - protein, 33 aa, Artificial Sequence
  Description of Artificial Sequence: Synthetic polypeptide
DEQEIRTTNPVSTEPYGSVSAMDLQEDQEGEDL

SEQ ID NO: 123852 - protein, 29 aa, Artificial Sequence
  Description of Artificial Sequence: Synthetic peptide
QEEEIATTNPVATEQYGEAPEVCQHCEEK

SEQ ID NO: 123853 - protein, 29 aa, Artificial Sequence
  Description of Artificial Sequence: Synthetic peptide
QEEEIATTNPVATEQYGEAPEVCQAAEDA

SEQ ID NO: 123854 - protein, 29 aa, Artificial Sequence
  Description of Artificial Sequence: Synthetic peptide
DESEIASTNPVGTEGYGAMANSTLQHGDI

SEQ ID NO: 123855 - protein, 29 aa, Artificial Sequence
  Description of Artificial Sequence: Synthetic peptide
QEEEIATTNPVATEQYGEAPEVCPQHEEK

SEQ ID NO: 123856 - protein, 28 aa, Artificial Sequence
  Description of Artificial Sequence: Synthetic peptide
DESEIASTNPVGTEGYGVMASTLNHGDV

SEQ ID NO: 123857 - protein, 28 aa, Artificial Sequence
  Description of Artificial Sequence: Synthetic peptide
QEEEIATTNPVATEQYGEAPEVCHHEEK

SEQ ID NO: 123858 - protein, 28 aa, Artificial Sequence
  Description of Artificial Sequence: Synthetic peptide
QEEEIATTNPVATEQYGEAPEVCHHETK

SEQ ID NO: 123859 - protein, 29 aa, Artificial Sequence
  Description of Artificial Sequence: Synthetic peptide
QEEEIATTNPVATEQYGEAPEVCHQHEEK

SEQ ID NO: 123860 - protein, 28 aa, Artificial Sequence
  Description of Artificial Sequence: Synthetic peptide
QEEEIATTNPVATEQYGEAPEVCIHEEK

SEQ ID NO: 123861 - protein, 28 aa, Artificial Sequence
  Description of Artificial Sequence: Synthetic peptide
QEEEIATTNPVATEQYGEAPEVCIHKEK

SEQ ID NO: 123862 - protein, 29 aa, Artificial Sequence
  Description of Artificial Sequence: Synthetic peptide
QEEEIATTNPVATEQYGEAPEVCIQHEEK

SEQ ID NO: 123863 - protein, 28 aa, Artificial Sequence
  Description of Artificial Sequence: Synthetic peptide
QEEEIATTNPVATEQYGEAPEVCKHEEK

SEQ ID NO: 123864 - protein, 29 aa, Artificial Sequence
  Description of Artificial Sequence: Synthetic peptide
QEEEIATTNPVATEQYGEAPEVCKQHEEK

SEQ ID NO: 123865 - protein, 33 aa, Artificial Sequence
  Description of Artificial Sequence: Synthetic polypeptide
DECEIATTNPVATEHWGSVSGGNGNHGNDNQRI

SEQ ID NO: 123866 - protein, 28 aa, Artificial Sequence
  Description of Artificial Sequence: Synthetic peptide
QEEEIATTNPVATEQYGEAPEVCLHEEK

SEQ ID NO: 123867 - protein, 28 aa, Artificial Sequence
  Description of Artificial Sequence: Synthetic peptide
QEEEIATTNPVATEQYGEAPEVCLHKEK

SEQ ID NO: 123868 - protein, 33 aa, Artificial Sequence
  Description of Artificial Sequence: Synthetic polypeptide
DECEIATTNPVATEHWGSVSGGNGNADGNDNQR

SEQ ID NO: 123869 - protein, 28 aa, Artificial Sequence
  Description of Artificial Sequence: Synthetic peptide
QEEEIATTNPVATEQYGEAPEVCMHEDK

SEQ ID NO: 123870 - protein, 28 aa, Artificial Sequence
  Description of Artificial Sequence: Synthetic peptide
QEEEIATTNPVATEQYGEAPEVCMHEEK

SEQ ID NO: 123871 - protein, 29 aa, Artificial Sequence
  Description of Artificial Sequence: Synthetic peptide
QEEEIATTNPVATEQYGEAPEVCMQHEEK

SEQ ID NO: 123872 - protein, 30 aa, Artificial Sequence
  Description of Artificial Sequence: Synthetic polypeptide
QEEEIATTNPVATEQYGEAPEVCMQHENEK

SEQ ID NO: 123873 - protein, 28 aa, Artificial Sequence
  Description of Artificial Sequence: Synthetic peptide
QEEEIATTNPVATEQYGEAPEVCNHEEK

SEQ ID NO: 123874 - protein, 29 aa, Artificial Sequence
  Description of Artificial Sequence: Synthetic peptide
QEEEIATTNPVATEQYGEAPEVCNHGMEK

SEQ ID NO: 123875 - protein, 29 aa, Artificial Sequence
  Description of Artificial Sequence: Synthetic peptide
QEEEIATTNPVATEQYGEAPEVCNQHEEK

SEQ ID NO: 123876 - protein, 28 aa, Artificial Sequence
  Description of Artificial Sequence: Synthetic peptide
QEEEIATTNPVATEQYGEAPEVCPHEEK

SEQ ID NO: 123877 - protein, 36 aa, Artificial Sequence
  Description of Artificial Sequence: Synthetic polypeptide
DEEEIRTTNPVATEQYGSVIYCTENNENALNNVNES

SEQ ID NO: 123878 - protein, 29 aa, Artificial Sequence
  Description of Artificial Sequence: Synthetic peptide
QEEEIATTNPVATEQYGEAPEVCQHEHEK

SEQ ID NO: 123879 - protein, 28 aa, Artificial Sequence
  Description of Artificial Sequence: Synthetic peptide
DESEIASTNPVGTEGWGVMASTLQHGDI

SEQ ID NO: 123880 - protein, 33 aa, Artificial Sequence
  Description of Artificial Sequence: Synthetic polypeptide
DEQEIVTTNPVATEQYGTVSATDGPVEHEGNDL

SEQ ID NO: 123881 - protein, 30 aa, Artificial Sequence
  Description of Artificial Sequence: Synthetic polypeptide
QEEEIATTNPVATEQYGEAPEVCQRHEDEK

SEQ ID NO: 123882 - protein, 29 aa, Artificial Sequence
  Description of Artificial Sequence: Synthetic peptide
QEEEIATTNPVATEQYGEAPEVCQSHEEK

SEQ ID NO: 123883 - protein, 29 aa, Artificial Sequence
  Description of Artificial Sequence: Synthetic peptide
QEEEIATTNPVATEQYGEAPEVCQSHEQK

SEQ ID NO: 123884 - protein, 30 aa, Artificial Sequence
  Description of Artificial Sequence: Synthetic polypeptide
QEEEIATTNPVATEQYGEAPEVCQSHVEER

SEQ ID NO: 123885 - protein, 30 aa, Artificial Sequence
  Description of Artificial Sequence: Synthetic polypeptide
QEEEIATTNPVATEQYGEAPEVCQSHVGQK

SEQ ID NO: 123886 - protein, 30 aa, Artificial Sequence
  Description of Artificial Sequence: Synthetic polypeptide
QEEEIATTNPVATEQYGEAPEVCQSRVEEK

SEQ ID NO: 123887 - protein, 35 aa, Artificial Sequence
  Description of Artificial Sequence: Synthetic polypeptide
DEEEIATTNPVATEQWGSVSGEGALPDQGGGNPVS

SEQ ID NO: 123888 - protein, 35 aa, Artificial Sequence
  Description of Artificial Sequence: Synthetic polypeptide
DEEEIATTNPVATEQWGSVSANDPGAPTNQDEGNN

SEQ ID NO: 123889 - protein, 32 aa, Artificial Sequence
  Description of Artificial Sequence: Synthetic polypeptide
DESEIASTNPVATEGYGSVSANTLEDHEGQDL

SEQ ID NO: 123890 - protein, 32 aa, Artificial Sequence
  Description of Artificial Sequence: Synthetic polypeptide
DESEIASTNPVATEGYGNVAATDLQSHVGEDR

SEQ ID NO: 123891 - protein, 29 aa, Artificial Sequence
  Description of Artificial Sequence: Synthetic peptide
QEEEIATTNPVATEQYGEAPEVCQTHEEK

SEQ ID NO: 123892 - protein, 29 aa, Artificial Sequence
  Description of Artificial Sequence: Synthetic peptide
QEEEIATTNPVATEQYGEAPEVCQVHEEK

SEQ ID NO: 123893 - protein, 29 aa, Artificial Sequence
  Description of Artificial Sequence: Synthetic peptide
QEEEIATTNPVATEQYGEAPEVCQWEEFK

SEQ ID NO: 123894 - protein, 29 aa, Artificial Sequence
  Description of Artificial Sequence: Synthetic peptide
QEEEIATTNPVATEQYGEAPEVCQWHEEK

SEQ ID NO: 123895 - protein, 29 aa, Artificial Sequence
  Description of Artificial Sequence: Synthetic peptide
QEEEIATTNPVATEQYGEAPEVCQYDEEK

SEQ ID NO: 123896 - protein, 29 aa, Artificial Sequence
  Description of Artificial Sequence: Synthetic peptide
QEEEIATTNPVATEQYGEAPEVCQYHEEK

SEQ ID NO: 123897 - protein, 28 aa, Artificial Sequence
  Description of Artificial Sequence: Synthetic peptide
QEEEIATTNPVATEQYGEAPEVCRHEEK

SEQ ID NO: 123898 - protein, 29 aa, Artificial Sequence
  Description of Artificial Sequence: Synthetic peptide
QEEEIATTNPVATEQYGEAPEVCQSYEEK

SEQ ID NO: 123899 - protein, 31 aa, Artificial Sequence
  Description of Artificial Sequence: Synthetic polypeptide
DESEIASTNPVATEGYGVMASITEPQHEGNI

SEQ ID NO: 123900 - protein, 29 aa, Artificial Sequence
  Description of Artificial Sequence: Synthetic peptide
QEEEIATTNPVATEQYGEAPEVCQQHEET

SEQ ID NO: 123901 - protein, 29 aa, Artificial Sequence
  Description of Artificial Sequence: Synthetic peptide
DESEIASTNPVATEGYGVMATTLVEHGDD

SEQ ID NO: 123902 - protein, 32 aa, Artificial Sequence
  Description of Artificial Sequence: Synthetic polypeptide
DEAEIATTNPVAYEQWGSVAINNGQNAGNSDA

SEQ ID NO: 123903 - protein, 32 aa, Artificial Sequence
  Description of Artificial Sequence: Synthetic polypeptide
DEMEISTTNPVATEQYGCICSWETQRFGSDQS

SEQ ID NO: 123904 - protein, 29 aa, Artificial Sequence
  Description of Artificial Sequence: Synthetic peptide
QEEEIATTNPVATEQYGEAPEVCQKHEEK

SEQ ID NO: 123905 - protein, 29 aa, Artificial Sequence
  Description of Artificial Sequence: Synthetic peptide
QEEEIATTNPVATEQYGEAPEVCQKHHEK

SEQ ID NO: 123906 - protein, 29 aa, Artificial Sequence
  Description of Artificial Sequence: Synthetic peptide
QEEEIATTNPVATEQYGEAPEVCQLEEWK

SEQ ID NO: 123907 - protein, 29 aa, Artificial Sequence
  Description of Artificial Sequence: Synthetic peptide
QEEEIATTNPVATEQYGEAPEVCQLHEEK

SEQ ID NO: 123908 - protein, 33 aa, Artificial Sequence
  Description of Artificial Sequence: Synthetic polypeptide
DEMEISTTNPVATEQYGAVCSATYGPVEFEGND

SEQ ID NO: 123909 - protein, 33 aa, Artificial Sequence
  Description of Artificial Sequence: Synthetic polypeptide
DECEIATTNPCATEHYGSVCYNNDDQDHGDNGR

SEQ ID NO: 123910 - protein, 29 aa, Artificial Sequence
  Description of Artificial Sequence: Synthetic peptide
QEEEIATTNPVATEQYGEAPEVCQMHEEK

SEQ ID NO: 123911 - protein, 30 aa, Artificial Sequence
  Description of Artificial Sequence: Synthetic polypeptide
QEEEIATTNPVATEQYGEAPEVCQMHEENK

SEQ ID NO: 123912 - protein, 30 aa, Artificial Sequence
  Description of Artificial Sequence: Synthetic polypeptide
QEEEIATTNPVATEQYGEAPEVCQMHNEEK

SEQ ID NO: 123913 - protein, 34 aa, Artificial Sequence
  Description of Artificial Sequence: Synthetic polypeptide
DEEEIATTNPVATEQWGSVAPGNEPQENGDNSDA

SEQ ID NO: 123914 - protein, 29 aa, Artificial Sequence
  Description of Artificial Sequence: Synthetic peptide
QEEEIATTNPVATEQYGEAPEVCQNHEEK

SEQ ID NO: 123915 - protein, 30 aa, Artificial Sequence
  Description of Artificial Sequence: Synthetic polypeptide
QEEEIATTNPVATEQYGEAPEVCQNHEERK

SEQ ID NO: 123916 - protein, 33 aa, Artificial Sequence
  Description of Artificial Sequence: Synthetic polypeptide
DEEEIATTNPVATEQWGSVAPPNPEEADDHNRS

SEQ ID NO: 123917 - protein, 29 aa, Artificial Sequence
  Description of Artificial Sequence: Synthetic peptide
QEEEIATTNPVATEQYGEAPEVCQPHEEK

SEQ ID NO: 123918 - protein, 29 aa, Artificial Sequence
  Description of Artificial Sequence: Synthetic peptide
QEEEIATTNPVATEQYGEAPEVCQPIQEK

SEQ ID NO: 123919 - protein, 34 aa, Artificial Sequence
  Description of Artificial Sequence: Synthetic polypeptide
DEEEIATTNPVATEQWGSVCSGENDQHDTNGDSP

SEQ ID NO: 123920 - protein, 29 aa, Artificial Sequence
  Description of Artificial Sequence: Synthetic peptide
QEEEIATTNPVATEQYGEAPEVCQQHEEK

SEQ ID NO: 123921 - protein, 29 aa, Artificial Sequence
  Description of Artificial Sequence: Synthetic peptide
QEEEIATTNPVATEQYGEAPEVCRQHCEK

SEQ ID NO: 123922 - protein, 29 aa, Artificial Sequence
  Description of Artificial Sequence: Synthetic peptide
QEEEIATTNPVATEQYGEAPEVCRQHEEK

SEQ ID NO: 123923 - protein, 29 aa, Artificial Sequence
  Description of Artificial Sequence: Synthetic peptide
QEEEIATTNPVATEQYGEAPEVCRQHELK

SEQ ID NO: 123924 - protein, 28 aa, Artificial Sequence
  Description of Artificial Sequence: Synthetic peptide
QEEEIATTNPVATEQYGEAPEVCSHEEK

SEQ ID NO: 123925 - protein, 29 aa, Artificial Sequence
  Description of Artificial Sequence: Synthetic peptide
QEEEIATTNPVATEQYGEAPEVDCQHEIK

SEQ ID NO: 123926 - protein, 33 aa, Artificial Sequence
  Description of Artificial Sequence: Synthetic polypeptide
DESEIASTNPVATECWGSVSCINEPQDREGENG

SEQ ID NO: 123927 - protein, 29 aa, Artificial Sequence
  Description of Artificial Sequence: Synthetic peptide
QEEEIATTNPVATEQYGEAPEVDCQHEVK

SEQ ID NO: 123928 - protein, 34 aa, Artificial Sequence
  Description of Artificial Sequence: Synthetic polypeptide
DEAVIRTTNPVATEQYGSVYSLLLESPNGSQNTQ

SEQ ID NO: 123929 - protein, 32 aa, Artificial Sequence
  Description of Artificial Sequence: Synthetic polypeptide
DEMEIRTTNPVSTEPYGTISTEGIQQQQNGNH

SEQ ID NO: 123930 - protein, 32 aa, Artificial Sequence
  Description of Artificial Sequence: Synthetic polypeptide
DEMEIRTTNPVSTEPYGTISTEDIQQQQNGNH

SEQ ID NO: 123931 - protein, 31 aa, Artificial Sequence
  Description of Artificial Sequence: Synthetic polypeptide
DEMEIRTTNPVSTEPYGTISMEDIQQFNGND

SEQ ID NO: 123932 - protein, 29 aa, Artificial Sequence
  Description of Artificial Sequence: Synthetic peptide
QEEEIATTNPVATEQYGEAPEVDQHEEKG

SEQ ID NO: 123933 - protein, 36 aa, Artificial Sequence
  Description of Artificial Sequence: Synthetic polypeptide
DEEEIATTNPVATEQWGSVSGEGNLPDPQGNGNPVS

SEQ ID NO: 123934 - protein, 34 aa, Artificial Sequence
  Description of Artificial Sequence: Synthetic polypeptide
DEAVIRTTNPVATEQYGSVYSLHSEFPNGSQNLR

SEQ ID NO: 123935 - protein, 29 aa, Artificial Sequence
  Description of Artificial Sequence: Synthetic peptide
QEEEIATTNPVATEQYGEAPEVDQIHEEK

SEQ ID NO: 123936 - protein, 29 aa, Artificial Sequence
  Description of Artificial Sequence: Synthetic peptide
QEEEIATTNPVATEQYGEAPEVEAQHESK

SEQ ID NO: 123937 - protein, 29 aa, Artificial Sequence
  Description of Artificial Sequence: Synthetic peptide
QEEEIATTNPVATEQYGEAPEVECQHEIK

SEQ ID NO: 123938 - protein, 33 aa, Artificial Sequence
  Description of Artificial Sequence: Synthetic polypeptide
DEQEIYTTNPVATEQYGTVCSATDGPVEFEGND

SEQ ID NO: 123939 - protein, 30 aa, Artificial Sequence
  Description of Artificial Sequence: Synthetic polypeptide
QEEEIATTNPVATEQYGEAPEVECQHVENK

SEQ ID NO: 123940 - protein, 29 aa, Artificial Sequence
  Description of Artificial Sequence: Synthetic peptide
QEEEIATTNPVATEQYGEAPEVEQHEEEG

SEQ ID NO: 123941 - protein, 36 aa, Artificial Sequence
  Description of Artificial Sequence: Synthetic polypeptide
DEEEIATTNPVATEQWGSVSGEGNLPDTQAGGNPVS

SEQ ID NO: 123942 - protein, 32 aa, Artificial Sequence
  Description of Artificial Sequence: Synthetic polypeptide
DEQELATTNPVATEQYGSLSATDLEDHEGEDL

SEQ ID NO: 123943 - protein, 33 aa, Artificial Sequence
  Description of Artificial Sequence: Synthetic polypeptide
DEEEIATTNPVATEQWGSVSGEGPPDNAPEGAH

SEQ ID NO: 123944 - protein, 29 aa, Artificial Sequence
  Description of Artificial Sequence: Synthetic peptide
QEEEIATTNPVATEQYGEAPEVDCQHEEK

SEQ ID NO: 123945 - protein, 29 aa, Artificial Sequence
  Description of Artificial Sequence: Synthetic peptide
QEEEIATTNPVATEQYGEAPEVCQIHEEK

SEQ ID NO: 123946 - protein, 29 aa, Artificial Sequence
  Description of Artificial Sequence: Synthetic peptide
QEEEIATTNPVATEQYGEAPEVCYQHEEK

SEQ ID NO: 123947 - protein, 32 aa, Artificial Sequence
  Description of Artificial Sequence: Synthetic polypeptide
DEMEIRTTNPVSTEQYGTISMDDIQQQFNGNH

SEQ ID NO: 123948 - protein, 29 aa, Artificial Sequence
  Description of Artificial Sequence: Synthetic peptide
QEEEIATTNPVATEQYGEAPEVCSQHEEK

SEQ ID NO: 123949 - protein, 31 aa, Artificial Sequence
  Description of Artificial Sequence: Synthetic polypeptide
QEEEIATTNPVATEQYGEAPEVCSQHEGENE

SEQ ID NO: 123950 - protein, 29 aa, Artificial Sequence
  Description of Artificial Sequence: Synthetic peptide
QEEEIATTNPVATEQYGEAPEVCSQHKEK

SEQ ID NO: 123951 - protein, 28 aa, Artificial Sequence
  Description of Artificial Sequence: Synthetic peptide
QEEEIATTNPVATEQYGEAPEVCTHEEK

SEQ ID NO: 123952 - protein, 28 aa, Artificial Sequence
  Description of Artificial Sequence: Synthetic peptide
QEEEIATTNPVATEQYGEAPEVCTQEEK

SEQ ID NO: 123953 - protein, 29 aa, Artificial Sequence
  Description of Artificial Sequence: Synthetic peptide
QEEEIATTNPVATEQYGEAPEVCTQHEEK

SEQ ID NO: 123954 - protein, 28 aa, Artificial Sequence
  Description of Artificial Sequence: Synthetic peptide
QEEEIATTNPVATEQYGEAPEVCVHEEK

SEQ ID NO: 123955 - protein, 29 aa, Artificial Sequence
  Description of Artificial Sequence: Synthetic peptide
QEEEIATTNPVATEQYGEAPEVCVQHEEA

SEQ ID NO: 123956 - protein, 29 aa, Artificial Sequence
  Description of Artificial Sequence: Synthetic peptide
QEEEIATTNPVATEQYGEAPEVCVQHEEK

SEQ ID NO: 123957 - protein, 30 aa, Artificial Sequence
  Description of Artificial Sequence: Synthetic polypeptide
DESEIASTNPVATEGYGDVSSTLMNAAGDA

SEQ ID NO: 123958 - protein, 29 aa, Artificial Sequence
  Description of Artificial Sequence: Synthetic peptide
DESEIASTNPVATEGWGVTASTLQEHGDI

SEQ ID NO: 123959 - protein, 28 aa, Artificial Sequence
  Description of Artificial Sequence: Synthetic peptide
QEEEIATTNPVATEQYGEAPEVCWHEEK

SEQ ID NO: 123960 - protein, 29 aa, Artificial Sequence
  Description of Artificial Sequence: Synthetic peptide
QEEEIATTNPVATEQYGEAPEVCWQDEEK

SEQ ID NO: 123961 - protein, 29 aa, Artificial Sequence
  Description of Artificial Sequence: Synthetic peptide
QEEEIATTNPVATEQYGEAPEVCWQHEEK

SEQ ID NO: 123962 - protein, 30 aa, Artificial Sequence
  Description of Artificial Sequence: Synthetic polypeptide
QEEEIATTNPVATEQYGEAPEVCWQHREEK

SEQ ID NO: 123963 - protein, 32 aa, Artificial Sequence
  Description of Artificial Sequence: Synthetic polypeptide
DEMEIRTTNPVSTEQYGTISMEDIQQQQNGNH

SEQ ID NO: 123964 - protein, 28 aa, Artificial Sequence
  Description of Artificial Sequence: Synthetic peptide
QEEEIATTNPVATEQYGEAPEVCYHEEK

SEQ ID NO: 123965 - protein, 33 aa, Artificial Sequence
  Description of Artificial Sequence: Synthetic polypeptide
DESEIASTNPVATECWGSVSDINEPQDREGENG

SEQ ID NO: 123966 - protein, 32 aa, Artificial Sequence
  Description of Artificial Sequence: Synthetic polypeptide
DEMEIRTTNPVSTEQYGTISMDDIQQQQNGNH

SEQ ID NO: 123967 - protein, 33 aa, Artificial Sequence
  Description of Artificial Sequence: Synthetic polypeptide
DEMEIRTTNPVSTEQYGTICSTEGIQQQQNGNH

SEQ ID NO: 123968 - protein, 31 aa, Artificial Sequence
  Description of Artificial Sequence: Synthetic polypeptide
QEEEIASTNPVGTEGYGVVSATTTGQHGMNI

SEQ ID NO: 123969 - protein, 35 aa, Artificial Sequence
  Description of Artificial Sequence: Synthetic polypeptide
DEEEIRTTNPVATEQYGSVITNSQSEFVELFPMIN

SEQ ID NO: 123970 - protein, 29 aa, Artificial Sequence
  Description of Artificial Sequence: Synthetic peptide
QEEEIATTNPVATEQYGEAPEVCQHYEEP

SEQ ID NO: 123971 - protein, 34 aa, Artificial Sequence
  Description of Artificial Sequence: Synthetic polypeptide
DEQEIVTTNPVATEQYGSVCSATDLVEDHEGEDD

SEQ ID NO: 123972 - protein, 29 aa, Artificial Sequence
  Description of Artificial Sequence: Synthetic peptide
QEEEIATTNPVATEQYGEAPEVCQHEQEK

SEQ ID NO: 123973 - protein, 29 aa, Artificial Sequence
  Description of Artificial Sequence: Synthetic peptide
QEEEIATTNPVATEQYGEAPEVCQHEQSK

SEQ ID NO: 123974 - protein, 33 aa, Artificial Sequence
  Description of Artificial Sequence: Synthetic polypeptide
DEANISTTNPVATVQYGSVSNWGPMIDQYAGNR

SEQ ID NO: 123975 - protein, 29 aa, Artificial Sequence
  Description of Artificial Sequence: Synthetic peptide
QEEEIATTNPVATEQYGEAPEVCQHEREK

SEQ ID NO: 123976 - protein, 29 aa, Artificial Sequence
  Description of Artificial Sequence: Synthetic peptide
QEEEIATTNPVATEQYGEAPEVCQHESEK

SEQ ID NO: 123977 - protein, 36 aa, Artificial Sequence
  Description of Artificial Sequence: Synthetic polypeptide
DEEEIRTTNPVATEQYGSVITVWYELEPQSTQNGQI

SEQ ID NO: 123978 - protein, 29 aa, Artificial Sequence
  Description of Artificial Sequence: Synthetic peptide
QEEEIATTNPVATEQYGEAPEVCQHETEK

SEQ ID NO: 123979 - protein, 29 aa, Artificial Sequence
  Description of Artificial Sequence: Synthetic peptide
QEEEIATTNPVATEQYGEAPEVCQHEPEK

SEQ ID NO: 123980 - protein, 30 aa, Artificial Sequence
  Description of Artificial Sequence: Synthetic polypeptide
DESEIASTNPVATEQYGDVSETIMNAAEDA

SEQ ID NO: 123981 - protein, 29 aa, Artificial Sequence
  Description of Artificial Sequence: Synthetic peptide
QEEEIATTNPVATEQYGEAPEVCQHEVEK

SEQ ID NO: 123982 - protein, 33 aa, Artificial Sequence
  Description of Artificial Sequence: Synthetic polypeptide
DEEEIATTNPVATEQWGNTTTAATNELAGMGGR

SEQ ID NO: 123983 - protein, 29 aa, Artificial Sequence
  Description of Artificial Sequence: Synthetic peptide
QEEEIATTNPVATEQYGEAPEVCQHEWEK

SEQ ID NO: 123984 - protein, 29 aa, Artificial Sequence
  Description of Artificial Sequence: Synthetic peptide
QEEEIATTNPVATEQYGEAPEVCQHEWKN

SEQ ID NO: 123985 - protein, 29 aa, Artificial Sequence
  Description of Artificial Sequence: Synthetic peptide
QEEEIATTNPVATEQYGEAPEVCQHEYEK

SEQ ID NO: 123986 - protein, 29 aa, Artificial Sequence
  Description of Artificial Sequence: Synthetic peptide
QEEEIATTNPVATEQYGEAPEVCQHFEEK

SEQ ID NO: 123987 - protein, 32 aa, Artificial Sequence
  Description of Artificial Sequence: Synthetic polypeptide
DEMEISTTNPVATEQYGCVCSWEHQNFNSDQS

SEQ ID NO: 123988 - protein, 34 aa, Artificial Sequence
  Description of Artificial Sequence: Synthetic polypeptide
DECEIATTNPCAYEQWGSVSGTNLGQGDHGNDAD

SEQ ID NO: 123989 - protein, 31 aa, Artificial Sequence
  Description of Artificial Sequence: Synthetic polypeptide
DESEIASTNPVATEQYGDVAAETIQNRAEQR

SEQ ID NO: 123990 - protein, 34 aa, Artificial Sequence
  Description of Artificial Sequence: Synthetic polypeptide
DEQEIVTTNPVATEQYGDVVSATDGQGEFEGNDQ

SEQ ID NO: 123991 - protein, 32 aa, Artificial Sequence
  Description of Artificial Sequence: Synthetic polypeptide
DESEIASTNPVATEQYGNVSATDLEDHEGEDL

SEQ ID NO: 123992 - protein, 33 aa, Artificial Sequence
  Description of Artificial Sequence: Synthetic polypeptide
DECEIATTNPCAYEQWGVVSTNLNQGDHGNDAD

SEQ ID NO: 123993 - protein, 28 aa, Artificial Sequence
  Description of Artificial Sequence: Synthetic peptide
DESEIASTNPVGTEGWGDMASTLQHGDI

SEQ ID NO: 123994 - protein, 31 aa, Artificial Sequence
  Description of Artificial Sequence: Synthetic polypeptide
DESEIASTNPVGTECYGVVSCNEPQDHEGNG

SEQ ID NO: 123995 - protein, 34 aa, Artificial Sequence
  Description of Artificial Sequence: Synthetic polypeptide
DECEIATTNPVATEAYGSVSGGNGPNAQGNDNQR

SEQ ID NO: 123996 - protein, 31 aa, Artificial Sequence
  Description of Artificial Sequence: Synthetic polypeptide
DESEIASTNPVCTECWGSVSCNEPQSEGENQ

SEQ ID NO: 123997 - protein, 31 aa, Artificial Sequence
  Description of Artificial Sequence: Synthetic polypeptide
DESEIASTNPVCTECWGSVSCNEPQSEGENG

SEQ ID NO: 123998 - protein, 29 aa, Artificial Sequence
  Description of Artificial Sequence: Synthetic peptide
QEEEIATTNPVATEQYGEAPEVCQHEIEK

SEQ ID NO: 123999 - protein, 36 aa, Artificial Sequence
  Description of Artificial Sequence: Synthetic polypeptide
DEEEIRTTNPVATEQYGSVIYCPNTQQVRENVEQGA

SEQ ID NO: 124000 - protein, 29 aa, Artificial Sequence
  Description of Artificial Sequence: Synthetic peptide
QEEEIATTNPVATEQYGEAPEVCQHEKEK

SEQ ID NO: 124001 - protein, 32 aa, Artificial Sequence
  Description of Artificial Sequence: Synthetic polypeptide
DEQEISTVNPVATEQYGSVSDDQAFQGAVNEY

SEQ ID NO: 124002 - protein, 31 aa, Artificial Sequence
  Description of Artificial Sequence: Synthetic polypeptide
DESEIASTNPVATEQYGVVAATDGLVEFGDD

SEQ ID NO: 124003 - protein, 33 aa, Artificial Sequence
  Description of Artificial Sequence: Synthetic polypeptide
DEQEITTTNPVATEQYGSVSATDGGEAGEGEDL

SEQ ID NO: 124004 - protein, 34 aa, Artificial Sequence
  Description of Artificial Sequence: Synthetic polypeptide
DEQEITTTNPVATEQYGSVSATDGGEDQEGEGGE

SEQ ID NO: 124005 - protein, 28 aa, Artificial Sequence
  Description of Artificial Sequence: Synthetic peptide
DESEIASTNPVATEQYGVMASIEMHGDI

SEQ ID NO: 124006 - protein, 29 aa, Artificial Sequence
  Description of Artificial Sequence: Synthetic peptide
QEEEIATTNPVATEQYGEAPEVCQHELEK

SEQ ID NO: 124007 - protein, 29 aa, Artificial Sequence
  Description of Artificial Sequence: Synthetic peptide
QEEEIATTNPVATEQYGEAPEVCQHELIK

SEQ ID NO: 124008 - protein, 34 aa, Artificial Sequence
  Description of Artificial Sequence: Synthetic polypeptide
DEQEITTTNPVATEQYGSVSATGDGEDQENEGDG

SEQ ID NO: 124009 - protein, 29 aa, Artificial Sequence
  Description of Artificial Sequence: Synthetic peptide
QEEEIATTNPVATEQYGEAPEVCQHEMEK

SEQ ID NO: 124010 - protein, 36 aa, Artificial Sequence
  Description of Artificial Sequence: Synthetic polypeptide
DEEEIRTTNPVATEQYGSVIVIPMNGLQRQTVDPDN

SEQ ID NO: 124011 - protein, 33 aa, Artificial Sequence
  Description of Artificial Sequence: Synthetic polypeptide
DESEIASTNPVATEQYGTVCSATDGIVEFVGNR

SEQ ID NO: 124012 - protein, 38 aa, Artificial Sequence
  Description of Artificial Sequence: Synthetic polypeptide
DEEEIRTTNPVATEQYGSVITTNENVEEQQRMNVEVRY

SEQ ID NO: 124013 - protein, 35 aa, Artificial Sequence
  Description of Artificial Sequence: Synthetic polypeptide
DEQEIVTTNPVATEQYGSVSTTGDLNEDQEGGEDG

SEQ ID NO: 124014 - protein, 30 aa, Artificial Sequence
  Description of Artificial Sequence: Synthetic polypeptide
DESEIASTNPVATEQWGDVSEILQNAAEDI

SEQ ID NO: 124015 - protein, 29 aa, Artificial Sequence
  Description of Artificial Sequence: Synthetic peptide
QEEEIATTNPVATEQYGEAPEVCQHHEEK

SEQ ID NO: 124016 - protein, 33 aa, Artificial Sequence
  Description of Artificial Sequence: Synthetic polypeptide
DEQEIVTTNPVATEQYGTVCSATDGPVEFEGND

SEQ ID NO: 124017 - protein, 29 aa, Artificial Sequence
  Description of Artificial Sequence: Synthetic peptide
QEEEIATTNPVATEQYGEAPEVCQHPEKA

SEQ ID NO: 124018 - protein, 29 aa, Artificial Sequence
  Description of Artificial Sequence: Synthetic peptide
QEEEIATTNPVATEQYGEAPEVCQHQEAK

SEQ ID NO: 124019 - protein, 32 aa, Artificial Sequence
  Description of Artificial Sequence: Synthetic polypeptide
DECEIATTNPCAYEQWGAVSTNLQGDHGQDAD

SEQ ID NO: 124020 - protein, 34 aa, Artificial Sequence
  Description of Artificial Sequence: Synthetic polypeptide
DEQEIVTTNPVATEQYGTVCSATDLVEDHEGNDD

SEQ ID NO: 124021 - protein, 29 aa, Artificial Sequence
  Description of Artificial Sequence: Synthetic peptide
QEEEIATTNPVATEQYGEAPEVCQHQEEK

SEQ ID NO: 124022 - protein, 34 aa, Artificial Sequence
  Description of Artificial Sequence: Synthetic polypeptide
DEQEIVTTNPVATEQYGTVCSATGLVEDHEGNDD

SEQ ID NO: 124023 - protein, 30 aa, Artificial Sequence
  Description of Artificial Sequence: Synthetic polypeptide
QEEEIATTNPVATEQYGEAPEVCQHREEKQ

SEQ ID NO: 124024 - protein, 33 aa, Artificial Sequence
  Description of Artificial Sequence: Synthetic polypeptide
DEEEIATTNPVATEQWGSVAITAPEQGDGDSDM

SEQ ID NO: 124025 - protein, 29 aa, Artificial Sequence
  Description of Artificial Sequence: Synthetic peptide
QEEEIATTNPVATEQYGEAPEVCQHSEEK

SEQ ID NO: 124026 - protein, 29 aa, Artificial Sequence
  Description of Artificial Sequence: Synthetic peptide
QEEEIATTNPVATEQYGEAPEVCQHSEKF

SEQ ID NO: 124027 - protein, 29 aa, Artificial Sequence
  Description of Artificial Sequence: Synthetic peptide
QEEEIATTNPVATEQYGEAPEVCQHSEVK

SEQ ID NO: 124028 - protein, 29 aa, Artificial Sequence
  Description of Artificial Sequence: Synthetic peptide
QEEEIATTNPVATEQYGEAPEVCQHTEEK

SEQ ID NO: 124029 - protein, 29 aa, Artificial Sequence
  Description of Artificial Sequence: Synthetic peptide
QEEEIATTNPVATEQYGEAPEVCQHVEEK

SEQ ID NO: 124030 - protein, 29 aa, Artificial Sequence
  Description of Artificial Sequence: Synthetic peptide
QEEEIATTNPVATEQYGEAPEVCQHVEES

SEQ ID NO: 124031 - protein, 29 aa, Artificial Sequence
  Description of Artificial Sequence: Synthetic peptide
QEEEIATTNPVATEQYGEAPEVCQHVTEK

SEQ ID NO: 124032 - protein, 29 aa, Artificial Sequence
  Description of Artificial Sequence: Synthetic peptide
QEEEIATTNPVATEQYGEAPEVCQHWEEK

SEQ ID NO: 124033 - protein, 29 aa, Artificial Sequence
  Description of Artificial Sequence: Synthetic peptide
QEEEIATTNPVATEQYGEAPEVCQHYEEK

SEQ ID NO: 124034 - protein, 29 aa, Artificial Sequence
  Description of Artificial Sequence: Synthetic peptide
QEEEIATTNPVATEQYGEAPEVCQHYEEL

SEQ ID NO: 124035 - protein, 35 aa, Artificial Sequence
  Description of Artificial Sequence: Synthetic polypeptide
DEEEIRTTNPVATEQYGSVITPTNGDETTQGQDEQ

SEQ ID NO: 124036 - protein, 30 aa, Artificial Sequence
  Description of Artificial Sequence: Synthetic polypeptide
DESEIASTNPVATEGYGVVACTLQDHGEDG

SEQ ID NO: 124037 - protein, 34 aa, Artificial Sequence
  Description of Artificial Sequence: Synthetic polypeptide
DEQEIVTTNPVATEQYGTVCSATDGLVEFEGNDD

SEQ ID NO: 124038 - protein, 33 aa, Artificial Sequence
  Description of Artificial Sequence: Synthetic polypeptide
DEEEIATTNPVATEQWGSVAGEGELQNHQDDNV

SEQ ID NO: 124039 - protein, 29 aa, Artificial Sequence
  Description of Artificial Sequence: Synthetic peptide
QEEEIATTNPVATEQYGEAPEVCQHHEGK

SEQ ID NO: 124040 - protein, 29 aa, Artificial Sequence
  Description of Artificial Sequence: Synthetic peptide
QEEEIATTNPVATEQYGEAPEVCQHIEEK

SEQ ID NO: 124041 - protein, 30 aa, Artificial Sequence
  Description of Artificial Sequence: Synthetic polypeptide
DESEIASTNPVATEQWGDVAETLQNAAGDI

SEQ ID NO: 124042 - protein, 30 aa, Artificial Sequence
  Description of Artificial Sequence: Synthetic polypeptide
DESEIASTNPVATEQWGDVAEILQNAAGDI

SEQ ID NO: 124043 - protein, 30 aa, Artificial Sequence
  Description of Artificial Sequence: Synthetic polypeptide
DESEIASTNPVATEQWGDMASTLQNHAGDI

SEQ ID NO: 124044 - protein, 33 aa, Artificial Sequence
  Description of Artificial Sequence: Synthetic polypeptide
DEQEIVTTNPVATEQYGTVCSATDGLEFEGEDD

SEQ ID NO: 124045 - protein, 31 aa, Artificial Sequence
  Description of Artificial Sequence: Synthetic polypeptide
DEEEIATTNPVATEQWGSICAMNNNDDGEMD

SEQ ID NO: 124046 - protein, 29 aa, Artificial Sequence
  Description of Artificial Sequence: Synthetic peptide
QEEEIATTNPVATEQYGEAPEVCQHKEEK

SEQ ID NO: 124047 - protein, 34 aa, Artificial Sequence
  Description of Artificial Sequence: Synthetic polypeptide
DEEEIATTNPVATEQWGSTAGNENLEATPDGDNR

SEQ ID NO: 124048 - protein, 29 aa, Artificial Sequence
  Description of Artificial Sequence: Synthetic peptide
QEEEIATTNPVATEQYGEAPEVCQHLEEK

SEQ ID NO: 124049 - protein, 31 aa, Artificial Sequence
  Description of Artificial Sequence: Synthetic polypeptide
DEASIATTNPLTTAQWGSVSIANGLQSGDSR

SEQ ID NO: 124050 - protein, 30 aa, Artificial Sequence
  Description of Artificial Sequence: Synthetic polypeptide
DESEIASTNPVATEQWGDMASTLQNAAGDI

SEQ ID NO: 124051 - protein, 32 aa, Artificial Sequence
  Description of Artificial Sequence: Synthetic polypeptide
DECEIATTNPCAYEQWGCVTTNLQGDHGNDAD

SEQ ID NO: 124052 - protein, 30 aa, Artificial Sequence
  Description of Artificial Sequence: Synthetic polypeptide
QEEEIATTNPVATEQYGEAPEVCQHLEEKN

SEQ ID NO: 124053 - protein, 29 aa, Artificial Sequence
  Description of Artificial Sequence: Synthetic peptide
QEEEIATTNPVATEQYGEAPEVCQHLEEP

SEQ ID NO: 124054 - protein, 29 aa, Artificial Sequence
  Description of Artificial Sequence: Synthetic peptide
QEEEIATTNPVATEQYGEAPEVCQHMEEK

SEQ ID NO: 124055 - protein, 30 aa, Artificial Sequence
  Description of Artificial Sequence: Synthetic polypeptide
QEEEIATTNPVATEQYGEAPEVCQHMEGEK

SEQ ID NO: 124056 - protein, 29 aa, Artificial Sequence
  Description of Artificial Sequence: Synthetic peptide
QEEEIATTNPVATEQYGEAPEVCQHMELK

SEQ ID NO: 124057 - protein, 29 aa, Artificial Sequence
  Description of Artificial Sequence: Synthetic peptide
QEEEIATTNPVATEQYGEAPEVCQHNEEK

SEQ ID NO: 124058 - protein, 29 aa, Artificial Sequence
  Description of Artificial Sequence: Synthetic peptide
QEEEIATTNPVATEQYGEAPEVCQHPEEK

SEQ ID NO: 124059 - protein, 30 aa, Artificial Sequence
  Description of Artificial Sequence: Synthetic polypeptide
DEQEIATTNPVGTEQYGVMATDLEDHEGDI

SEQ ID NO: 124060 - protein, 32 aa, Artificial Sequence
  Description of Artificial Sequence: Synthetic polypeptide
DEMEIVTTNPVATEQYGTVCSAEDGPQFEGED

SEQ ID NO: 124061 - protein, 37 aa, Artificial Sequence
  Description of Artificial Sequence: Synthetic polypeptide
DEEEIRTTNPVATEQYGSVMSGINMGLEGEGAGNGDD

SEQ ID NO: 124062 - protein, 33 aa, Artificial Sequence
  Description of Artificial Sequence: Synthetic polypeptide
DEMEIVTTNPVATHQYGTVCSATDNPVEFEGND

SEQ ID NO: 124063 - protein, 34 aa, Artificial Sequence
  Description of Artificial Sequence: Synthetic polypeptide
DEEEIATTNPFATEQYGDVSATTDGQQLVNGEND

SEQ ID NO: 124064 - protein, 32 aa, Artificial Sequence
  Description of Artificial Sequence: Synthetic polypeptide
DEQEIRTTNPVATECYGSTAATDLADHKGPDI

SEQ ID NO: 124065 - protein, 32 aa, Artificial Sequence
  Description of Artificial Sequence: Synthetic polypeptide
DEQEIRTTNPVATECYGSTAATDLADHKGPDL

SEQ ID NO: 124066 - protein, 33 aa, Artificial Sequence
  Description of Artificial Sequence: Synthetic polypeptide
DESEICTTNPVATEQYGTVSSVTDGGVEEEGND

SEQ ID NO: 124067 - protein, 36 aa, Artificial Sequence
  Description of Artificial Sequence: Synthetic polypeptide
DEEEIRTTNPVATEQYGSVNSITMGAEQVMLMADNL

SEQ ID NO: 124068 - protein, 33 aa, Artificial Sequence
  Description of Artificial Sequence: Synthetic polypeptide
QAEEIATTNPVAYEQYGSVAANLQDAGGPNDNN

SEQ ID NO: 124069 - protein, 32 aa, Artificial Sequence
  Description of Artificial Sequence: Synthetic polypeptide
QAEEIATTNPVAYEQYGSVAATALQNPGTDMQ

SEQ ID NO: 124070 - protein, 35 aa, Artificial Sequence
  Description of Artificial Sequence: Synthetic polypeptide
AEEEIRTTNPVATEQYGSVVVSVTNNQEQTETTED

SEQ ID NO: 124071 - protein, 34 aa, Artificial Sequence
  Description of Artificial Sequence: Synthetic polypeptide
QAEEIATTNPVAYEQYGSVAATNLQATPDGNAGN

SEQ ID NO: 124072 - protein, 32 aa, Artificial Sequence
  Description of Artificial Sequence: Synthetic polypeptide
QAEEIATTNPVAYEQYGSVAGTGDQDSGNDVH

SEQ ID NO: 124073 - protein, 35 aa, Artificial Sequence
  Description of Artificial Sequence: Synthetic polypeptide
DEEEIRTTNPVATEQYGSVNSHIIDQVGGMQDQEQ

SEQ ID NO: 124074 - protein, 36 aa, Artificial Sequence
  Description of Artificial Sequence: Synthetic polypeptide
AEEEIRTTNPVATEQYGSVVVSVTNNNQEQNEQTED

SEQ ID NO: 124075 - protein, 36 aa, Artificial Sequence
  Description of Artificial Sequence: Synthetic polypeptide
AEEEIRTTNPVATEQYGSVVVSVTNNNQEQGETEDE

SEQ ID NO: 124076 - protein, 36 aa, Artificial Sequence
  Description of Artificial Sequence: Synthetic polypeptide
AEEEIRTTNPVATEQYGSVVVSVTNNNQEQGEGTED

SEQ ID NO: 124077 - protein, 28 aa, Artificial Sequence
  Description of Artificial Sequence: Synthetic peptide
DEEEIATTNPIATEQYGEAPEVWAHEEK

SEQ ID NO: 124078 - protein, 33 aa, Artificial Sequence
  Description of Artificial Sequence: Synthetic polypeptide
DEMEIVTTNPVATEQYGYVCSATDWPVEPEGND

SEQ ID NO: 124079 - protein, 33 aa, Artificial Sequence
  Description of Artificial Sequence: Synthetic polypeptide
DEMEIVTTNPVATEQYGYVCSATDGPVEFEGNN

SEQ ID NO: 124080 - protein, 33 aa, Artificial Sequence
  Description of Artificial Sequence: Synthetic polypeptide
DESEICTTNPVATEQYGTVSSATEGGVEFEGND

SEQ ID NO: 124081 - protein, 33 aa, Artificial Sequence
  Description of Artificial Sequence: Synthetic polypeptide
DEMEIVTTNPVATHQYGTVYSATDGPLEFEGND

SEQ ID NO: 124082 - protein, 33 aa, Artificial Sequence
  Description of Artificial Sequence: Synthetic polypeptide
DESEICTTNPVATEQYGTVSSVTDGPVEFNGND

SEQ ID NO: 124083 - protein, 36 aa, Artificial Sequence
  Description of Artificial Sequence: Synthetic polypeptide
DEEEIRTTNPVATEQYGSVNSNTMDGIDVTFEGNNN

SEQ ID NO: 124084 - protein, 33 aa, Artificial Sequence
  Description of Artificial Sequence: Synthetic polypeptide
DESEIECTNPVATECWGSVSCINEPQDREGENG

SEQ ID NO: 124085 - protein, 33 aa, Artificial Sequence
  Description of Artificial Sequence: Synthetic polypeptide
DEMEIVTTNPVATQQYGTVCSATNGPVEFEGND

SEQ ID NO: 124086 - protein, 34 aa, Artificial Sequence
  Description of Artificial Sequence: Synthetic polypeptide
DEEEIATTNPCATTQWGSVSTTGNDNHGGGNHRT

SEQ ID NO: 124087 - protein, 33 aa, Artificial Sequence
  Description of Artificial Sequence: Synthetic polypeptide
DESEIDTVNPVATECWGSVSCINEPQDREGENG

SEQ ID NO: 124088 - protein, 34 aa, Artificial Sequence
  Description of Artificial Sequence: Synthetic polypeptide
DESEIDTTNPVATECWGSVSYCINEPQDREGENG

SEQ ID NO: 124089 - protein, 35 aa, Artificial Sequence
  Description of Artificial Sequence: Synthetic polypeptide
AEEEIRTTNPVATEQYGSVVVSVTNNTQEQQETED

SEQ ID NO: 124090 - protein, 32 aa, Artificial Sequence
  Description of Artificial Sequence: Synthetic polypeptide
DEEEIATTNPCAYEQWGSSPTWENDQNRGGEQ

SEQ ID NO: 124091 - protein, 34 aa, Artificial Sequence
  Description of Artificial Sequence: Synthetic polypeptide
DESEIDTTNPVATECWGSVSKCINEPQDREGENG

SEQ ID NO: 124092 - protein, 33 aa, Artificial Sequence
  Description of Artificial Sequence: Synthetic polypeptide
DESEICTTNTVATECWGSVSCINEPQDREGENG

SEQ ID NO: 124093 - protein, 34 aa, Artificial Sequence
  Description of Artificial Sequence: Synthetic polypeptide
DECEICTTNPVATEQYGSVSTVTQQTGDTEEEDD

SEQ ID NO: 124094 - protein, 36 aa, Artificial Sequence
  Description of Artificial Sequence: Synthetic polypeptide
DEEEIRTTNPVATEQYGSVNSPNENEWQEVPNIPNI

SEQ ID NO: 124095 - protein, 32 aa, Artificial Sequence
  Description of Artificial Sequence: Synthetic polypeptide
DEEEIATTNPCAYEQWGSVWTWENDQNIGGEQ

SEQ ID NO: 124096 - protein, 28 aa, Artificial Sequence
  Description of Artificial Sequence: Synthetic peptide
QAEEIATTNPVATEQYGEAHEVCQHEEK

SEQ ID NO: 124097 - protein, 28 aa, Artificial Sequence
  Description of Artificial Sequence: Synthetic peptide
EENEIATTNPVAYEPWGDVSECLQHESI

SEQ ID NO: 124098 - protein, 28 aa, Artificial Sequence
  Description of Artificial Sequence: Synthetic peptide
QAEEIATTNPVATEQYGEAPEVCQHTEK

SEQ ID NO: 124099 - protein, 33 aa, Artificial Sequence
  Description of Artificial Sequence: Synthetic polypeptide
DESEICTTNPVAYEAWGSVSCINESQDREPGNG

SEQ ID NO: 124100 - protein, 28 aa, Artificial Sequence
  Description of Artificial Sequence: Synthetic peptide
QAEEIATTNPVATEQYGFAPECSQHEEQ

SEQ ID NO: 124101 - protein, 37 aa, Artificial Sequence
  Description of Artificial Sequence: Synthetic polypeptide
DECEICTTNPVATEQYGSVSTVTNLQQGNQQGTTQDD

SEQ ID NO: 124102 - protein, 35 aa, Artificial Sequence
  Description of Artificial Sequence: Synthetic polypeptide
DECEICTTNPVATEQYGSVSTVTLQSGDTEEEEDD

SEQ ID NO: 124103 - protein, 35 aa, Artificial Sequence
  Description of Artificial Sequence: Synthetic polypeptide
DECEICTTNPVATEQYGSVSTVTAQQGNTEEAEND

SEQ ID NO: 124104 - protein, 35 aa, Artificial Sequence
  Description of Artificial Sequence: Synthetic polypeptide
DEEEIATTNPCATEQYGSVPPTVTQDHIQGQNVRM

SEQ ID NO: 124105 - protein, 33 aa, Artificial Sequence
  Description of Artificial Sequence: Synthetic polypeptide
DEMEIVTTNPVATEQYGYVCSATDGPVEFEGND

SEQ ID NO: 124106 - protein, 33 aa, Artificial Sequence
  Description of Artificial Sequence: Synthetic polypeptide
DEQEIRTTNPVATECYGSTVSNTDWEDHKGEYI

SEQ ID NO: 124107 - protein, 35 aa, Artificial Sequence
  Description of Artificial Sequence: Synthetic polypeptide
AEEEIRTTNPVATEQYGSVVVSVTNNNQEQAEETD

SEQ ID NO: 124108 - protein, 34 aa, Artificial Sequence
  Description of Artificial Sequence: Synthetic polypeptide
DEMEIVTTNPVATEQYGVTVCSATDGLVEFEGND

SEQ ID NO: 124109 - protein, 30 aa, Artificial Sequence
  Description of Artificial Sequence: Synthetic polypeptide
DEMEIVTTNPVATEQYGVMCATGPVEHGDD

SEQ ID NO: 124110 - protein, 31 aa, Artificial Sequence
  Description of Artificial Sequence: Synthetic polypeptide
DEMEIVTTNPVATEQYGVMAATDGPVEHGND

SEQ ID NO: 124111 - protein, 34 aa, Artificial Sequence
  Description of Artificial Sequence: Synthetic polypeptide
DECEICTTNPVATEQYGSVSTVQANGDTEENEDD

SEQ ID NO: 124112 - protein, 28 aa, Artificial Sequence
  Description of Artificial Sequence: Synthetic peptide
QASEIASTNPVATEGYGVMASTLQHGDI

SEQ ID NO: 124113 - protein, 34 aa, Artificial Sequence
  Description of Artificial Sequence: Synthetic polypeptide
DEMEIVTTNPVATEQYGTYVCSATNGPVEFEGND

SEQ ID NO: 124114 - protein, 28 aa, Artificial Sequence
  Description of Artificial Sequence: Synthetic peptide
QASEIASTNPVGTEGYGVSASTLQHGDI

SEQ ID NO: 124115 - protein, 28 aa, Artificial Sequence
  Description of Artificial Sequence: Synthetic peptide
QAGELAPTNPCSSEQYGIVSCNLQSGTR

SEQ ID NO: 124116 - protein, 28 aa, Artificial Sequence
  Description of Artificial Sequence: Synthetic peptide
QCEEIATTNPVATEQYGEAPEVCQHEEK

SEQ ID NO: 124117 - protein, 33 aa, Artificial Sequence
  Description of Artificial Sequence: Synthetic polypeptide
DEMEIVTTNPVATEQYGTVYSATDGPVEFEGND

SEQ ID NO: 124118 - protein, 36 aa, Artificial Sequence
  Description of Artificial Sequence: Synthetic polypeptide
DEEEIATTNPMATEQYGSVPETVTQNDHRQGQNGRG

SEQ ID NO: 124119 - protein, 28 aa, Artificial Sequence
  Description of Artificial Sequence: Synthetic peptide
QCNEIAATNPVATECYGDVSECLQHEEL

SEQ ID NO: 124120 - protein, 33 aa, Artificial Sequence
  Description of Artificial Sequence: Synthetic polypeptide
DEMEIVTTNPVATEQYGTVWSATDGPVEFEGND

SEQ ID NO: 124121 - protein, 35 aa, Artificial Sequence
  Description of Artificial Sequence: Synthetic polypeptide
DECEICTTNPVATEQYGSVSTVNQQQGTTTEEEDD

SEQ ID NO: 124122 - protein, 28 aa, Artificial Sequence
  Description of Artificial Sequence: Synthetic peptide
QDEEIASTNPVSTEQYGEAAEVCQREER

SEQ ID NO: 124123 - protein, 35 aa, Artificial Sequence
  Description of Artificial Sequence: Synthetic polypeptide
DECEICTTNPVATEQYGSVSTVNQQQGSTQEDEDD

SEQ ID NO: 124124 - protein, 33 aa, Artificial Sequence
  Description of Artificial Sequence: Synthetic polypeptide
DEMEIVTTNPVATEQYGTVVSTTDGPEEFEGND

SEQ ID NO: 124125 - protein, 36 aa, Artificial Sequence
  Description of Artificial Sequence: Synthetic polypeptide
DECEICTTNPVATEQYGSVSTVNTLQQGTTEEEEDD

SEQ ID NO: 124126 - protein, 32 aa, Artificial Sequence
  Description of Artificial Sequence: Synthetic polypeptide
DEMEIVTTNPVATEQYGVVAATDGPVEHEGND

SEQ ID NO: 124127 - protein, 28 aa, Artificial Sequence
  Description of Artificial Sequence: Synthetic peptide
QAGEIAPTNPCSSEQYGIVSCNLQSGTL

SEQ ID NO: 124128 - protein, 32 aa, Artificial Sequence
  Description of Artificial Sequence: Synthetic polypeptide
DEMEIVTTNPVATEQYGVVCAATDGPVEFGND

SEQ ID NO: 124129 - protein, 32 aa, Artificial Sequence
  Description of Artificial Sequence: Synthetic polypeptide
QAEEIATTNPVAYEQYGSVSANDAQGSGDMQN

SEQ ID NO: 124130 - protein, 35 aa, Artificial Sequence
  Description of Artificial Sequence: Synthetic polypeptide
AEEEIRTTNPVATEQYGSVVVSVTNNNQEQETEDE

SEQ ID NO: 124131 - protein, 33 aa, Artificial Sequence
  Description of Artificial Sequence: Synthetic polypeptide
QAEEIATTNPVAYEQYGSVSTNNNIENGENDEH

SEQ ID NO: 124132 - protein, 34 aa, Artificial Sequence
  Description of Artificial Sequence: Synthetic polypeptide
DECEICTTNPVATEQYGSVSTVSAQTGTTEEEDD

SEQ ID NO: 124133 - protein, 33 aa, Artificial Sequence
  Description of Artificial Sequence: Synthetic polypeptide
DEEEIATTNPIATEQYGSVSVGDIGFHGGDNQD

SEQ ID NO: 124134 - protein, 33 aa, Artificial Sequence
  Description of Artificial Sequence: Synthetic polypeptide
DEQEIRTTNPVATECYGSVSACIDEPQDHEGEG

SEQ ID NO: 124135 - protein, 33 aa, Artificial Sequence
  Description of Artificial Sequence: Synthetic polypeptide
DEMEIVTTNPVATEQYGWVSSMTDGPGEFEGND

SEQ ID NO: 124136 - protein, 34 aa, Artificial Sequence
  Description of Artificial Sequence: Synthetic polypeptide
DEEEIATTNPLAYEPYGSVSCATQAGQTGTNYRA

SEQ ID NO: 124137 - protein, 33 aa, Artificial Sequence
  Description of Artificial Sequence: Synthetic polypeptide
DEQEIRTTNPVATECYGSVSACIDEPQDHEGEL

SEQ ID NO: 124138 - protein, 33 aa, Artificial Sequence
  Description of Artificial Sequence: Synthetic polypeptide
DEMEIVTTNPVATEQYGWVCSATDGPVEFEGND

SEQ ID NO: 124139 - protein, 33 aa, Artificial Sequence
  Description of Artificial Sequence: Synthetic polypeptide
DEMEIVTTNPVATEQYGWVCSATDCPVEFEGND

SEQ ID NO: 124140 - protein, 31 aa, Artificial Sequence
  Description of Artificial Sequence: Synthetic polypeptide
QAEEIATTNPVGTEQWGGCCATNLQDRADRW

SEQ ID NO: 124141 - protein, 30 aa, Artificial Sequence
  Description of Artificial Sequence: Synthetic polypeptide
QAEEIATTNPVGTEQWGGCCATNLQMPGEV

SEQ ID NO: 124142 - protein, 33 aa, Artificial Sequence
  Description of Artificial Sequence: Synthetic polypeptide
DEMEIVTTNPVATEQYGVVCSATDGPVEHEGND

SEQ ID NO: 124143 - protein, 33 aa, Artificial Sequence
  Description of Artificial Sequence: Synthetic polypeptide
DEMEIVTTNPVATEQYGVVCSATDGPVEFEGND

SEQ ID NO: 124144 - protein, 35 aa, Artificial Sequence
  Description of Artificial Sequence: Synthetic polypeptide
DEEEIRTTNPVATEQYGSYWQPVMPNNDEEGENVE

SEQ ID NO: 124145 - protein, 31 aa, Artificial Sequence
  Description of Artificial Sequence: Synthetic polypeptide
DEMEIVTTNPVATEQYGVVCAATGPVEHGDD

SEQ ID NO: 124146 - protein, 32 aa, Artificial Sequence
  Description of Artificial Sequence: Synthetic polypeptide
QAEEIATTNPVGTEQWGGCVAGTNLQDMNPDR

SEQ ID NO: 124147 - protein, 35 aa, Artificial Sequence
  Description of Artificial Sequence: Synthetic polypeptide
DEEEIATTNPMATEPYGSVSCATMHSGQTGTNYRG

SEQ ID NO: 124148 - protein, 33 aa, Artificial Sequence
  Description of Artificial Sequence: Synthetic polypeptide
CEEEIACTNPVATEMYGSVATNLQDATGTPGQE

SEQ ID NO: 124149 - protein, 33 aa, Artificial Sequence
  Description of Artificial Sequence: Synthetic polypeptide
QAEEIATTNPVATEQYGCVAGTNLQTADNPNVN

SEQ ID NO: 124150 - protein, 36 aa, Artificial Sequence
  Description of Artificial Sequence: Synthetic polypeptide
DEEEIRTTNPVATEQYGSVNSPTVTPYQLVEGVTDQ

SEQ ID NO: 124151 - protein, 32 aa, Artificial Sequence
  Description of Artificial Sequence: Synthetic polypeptide
QAEEIATTNPVATEQYGCVAGTNLLTADGPGN

SEQ ID NO: 124152 - protein, 34 aa, Artificial Sequence
  Description of Artificial Sequence: Synthetic polypeptide
DESEIKTTNPVATECWGSVSCINEPQTREGENGP

SEQ ID NO: 124153 - protein, 33 aa, Artificial Sequence
  Description of Artificial Sequence: Synthetic polypeptide
DESEIKTTNPAATEQYGSVMTGLIMGGGNNGDI

SEQ ID NO: 124154 - protein, 33 aa, Artificial Sequence
  Description of Artificial Sequence: Synthetic polypeptide
CESEIRTTNPVGTECWGSVSCINEPQDREGENG

SEQ ID NO: 124155 - protein, 34 aa, Artificial Sequence
  Description of Artificial Sequence: Synthetic polypeptide
DESEIKTTNCVATEQYGSVSINGDLGEDGQGGEE

SEQ ID NO: 124156 - protein, 34 aa, Artificial Sequence
  Description of Artificial Sequence: Synthetic polypeptide
DESEIIRTTNPVATECWGSVSCINEPQDRELENG

SEQ ID NO: 124157 - protein, 33 aa, Artificial Sequence
  Description of Artificial Sequence: Synthetic polypeptide
DEQEIRTTNPIATEQYGSVSATEDWADHEGEDL

SEQ ID NO: 124158 - protein, 32 aa, Artificial Sequence
  Description of Artificial Sequence: Synthetic polypeptide
DEMEIVTTNPVSTEQYGTVSAMDDIQEQNGND

SEQ ID NO: 124159 - protein, 33 aa, Artificial Sequence
  Description of Artificial Sequence: Synthetic polypeptide
DEMEIVTTNPVSTEQYGTVCSATEDPQQFEGND

SEQ ID NO: 124160 - protein, 34 aa, Artificial Sequence
  Description of Artificial Sequence: Synthetic polypeptide
DEEEIASTNPVCTEQYGVVSTDNLPNMSNGMNPQ

SEQ ID NO: 124161 - protein, 31 aa, Artificial Sequence
  Description of Artificial Sequence: Synthetic polypeptide
DEEEIASTNPVSTEGYGNVAANTIQSRVGQK

SEQ ID NO: 124162 - protein, 32 aa, Artificial Sequence
  Description of Artificial Sequence: Synthetic polypeptide
NTEHEIATTNPVAYEQWGSVSTNLNDDHGGEE

SEQ ID NO: 124163 - protein, 32 aa, Artificial Sequence
  Description of Artificial Sequence: Synthetic polypeptide
NTEHEIATTNPVAYEQWGSVSTNLNDNGGEQT

SEQ ID NO: 124164 - protein, 32 aa, Artificial Sequence
  Description of Artificial Sequence: Synthetic polypeptide
NTEHEIATTNPVAYEQWGSVSTNLNGDEGGTT

SEQ ID NO: 124165 - protein, 32 aa, Artificial Sequence
  Description of Artificial Sequence: Synthetic polypeptide
NTEHEIATTNPVAYEQWGSVSTNLNGDGGETN

SEQ ID NO: 124166 - protein, 32 aa, Artificial Sequence
  Description of Artificial Sequence: Synthetic polypeptide
NTEHEIATTNPVAYEQWGSVSTNLNGDHGETS

SEQ ID NO: 124167 - protein, 32 aa, Artificial Sequence
  Description of Artificial Sequence: Synthetic polypeptide
DEMEIVTTNPVSTEQYGNVAATDGIVQFEGQR

SEQ ID NO: 124168 - protein, 33 aa, Artificial Sequence
  Description of Artificial Sequence: Synthetic polypeptide
DESEIHTTNPVATECWGSVSCINEPQDREGEGG

SEQ ID NO: 124169 - protein, 32 aa, Artificial Sequence
  Description of Artificial Sequence: Synthetic polypeptide
NTEHEIATTNPVAYEQWGSVSTNLNGGGEGTM

SEQ ID NO: 124170 - protein, 31 aa, Artificial Sequence
  Description of Artificial Sequence: Synthetic polypeptide
NTEHEIATTNPVAYEQWGSVATNLNGGGEVT

SEQ ID NO: 124171 - protein, 33 aa, Artificial Sequence
  Description of Artificial Sequence: Synthetic polypeptide
DEMEIVTVNPVATEQYGTVCSATDGLVEFEGND

SEQ ID NO: 124172 - protein, 33 aa, Artificial Sequence
  Description of Artificial Sequence: Synthetic polypeptide
DEQEIRTTNPIATEQYGAVSNTEDLEEHEGEDL

SEQ ID NO: 124173 - protein, 34 aa, Artificial Sequence
  Description of Artificial Sequence: Synthetic polypeptide
DESEIKTTNPVATEGYGSVSINGLPGEDGQGGEE

SEQ ID NO: 124174 - protein, 30 aa, Artificial Sequence
  Description of Artificial Sequence: Synthetic polypeptide
DEEEIASTNPVCTEQWGDVSDILMNSAGDQ

SEQ ID NO: 124175 - protein, 34 aa, Artificial Sequence
  Description of Artificial Sequence: Synthetic polypeptide
DESEIKTTNPVATEQYGSVSIGGVNGEDGQGGEE

SEQ ID NO: 124176 - protein, 30 aa, Artificial Sequence
  Description of Artificial Sequence: Synthetic polypeptide
DEEEIASTNPVCTEQWGDVSEILMNSAGDQ

SEQ ID NO: 124177 - protein, 33 aa, Artificial Sequence
  Description of Artificial Sequence: Synthetic polypeptide
DECEICTTNPVATEQYGTVNSVTDGGVEGEGNA

SEQ ID NO: 124178 - protein, 34 aa, Artificial Sequence
  Description of Artificial Sequence: Synthetic polypeptide
DEEEIASTNPVCTEQYGSVSSTTNGNMSNGMNPV

SEQ ID NO: 124179 - protein, 33 aa, Artificial Sequence
  Description of Artificial Sequence: Synthetic polypeptide
DECEICTTNPVATEQYGTVCSATDGGVEVEGND

SEQ ID NO: 124180 - protein, 33 aa, Artificial Sequence
  Description of Artificial Sequence: Synthetic polypeptide
DEMEIYTTNPVATEQYGTVCSATDGPVEFEGND

SEQ ID NO: 124181 - protein, 33 aa, Artificial Sequence
  Description of Artificial Sequence: Synthetic polypeptide
DEMEIYTTNPVATEQYGTVCSATDGEVEFEGND

SEQ ID NO: 124182 - protein, 32 aa, Artificial Sequence
  Description of Artificial Sequence: Synthetic polypeptide
DEEEIASTNPVCTEQYGVVSATDLEDHEGEDL

SEQ ID NO: 124183 - protein, 34 aa, Artificial Sequence
  Description of Artificial Sequence: Synthetic polypeptide
CESEIRTTNPVATEQYGSVFTAENDMQEETQNDN

SEQ ID NO: 124184 - protein, 31 aa, Artificial Sequence
  Description of Artificial Sequence: Synthetic polypeptide
NSREIRTTNPVAYEAWGQVVTTNLSQNGGSR

SEQ ID NO: 124185 - protein, 32 aa, Artificial Sequence
  Description of Artificial Sequence: Synthetic polypeptide
NSTEIRTTNPVAYEQWGSVSTNLNHEDNNNGS

SEQ ID NO: 124186 - protein, 32 aa, Artificial Sequence
  Description of Artificial Sequence: Synthetic polypeptide
DEQEIRTTNPIATEQYGATSATDLEEHKGEDL

SEQ ID NO: 124187 - protein, 33 aa, Artificial Sequence
  Description of Artificial Sequence: Synthetic polypeptide
DEMEIWTTNPVATEQYGTVCSATDGPVEFEGND

SEQ ID NO: 124188 - protein, 33 aa, Artificial Sequence
  Description of Artificial Sequence: Synthetic polypeptide
DEMEIWTTNPVATEQYGTVCSATDGPVEFAGND

SEQ ID NO: 124189 - protein, 35 aa, Artificial Sequence
  Description of Artificial Sequence: Synthetic polypeptide
DEAEIATTNPVGTEQYGSVPSCTTELSTRTGTNFV

SEQ ID NO: 124190 - protein, 33 aa, Artificial Sequence
  Description of Artificial Sequence: Synthetic polypeptide
DEMEIWTTNPVATEQYGTVCSATDGPPEFEGND

SEQ ID NO: 124191 - protein, 33 aa, Artificial Sequence
  Description of Artificial Sequence: Synthetic polypeptide
DEMEIVTVNPVATEQYGTVCSATDNPVEFEGND

SEQ ID NO: 124192 - protein, 33 aa, Artificial Sequence
  Description of Artificial Sequence: Synthetic polypeptide
DEQEIRTTNPIATEQYGAVSATEDLEEHEGEDL

SEQ ID NO: 124193 - protein, 32 aa, Artificial Sequence
  Description of Artificial Sequence: Synthetic polypeptide
NTEHEIATTNPVAYEQWGSVSTNLNMEGGEDT

SEQ ID NO: 124194 - protein, 32 aa, Artificial Sequence
  Description of Artificial Sequence: Synthetic polypeptide
DEMEIVTTNPVGTEQYGVVSASDGPVQHEGND

SEQ ID NO: 124195 - protein, 31 aa, Artificial Sequence
  Description of Artificial Sequence: Synthetic polypeptide
DEMEIVTTNPVGTEQYGVVCASGPVEFEGNI

SEQ ID NO: 124196 - protein, 33 aa, Artificial Sequence
  Description of Artificial Sequence: Synthetic polypeptide
PASEIRTTNPVATECWGSVSCINEPQDREGENG

SEQ ID NO: 124197 - protein, 32 aa, Artificial Sequence
  Description of Artificial Sequence: Synthetic polypeptide
QAEEIATTNPVATEQWGCVAGTGLQDQGPQNH

SEQ ID NO: 124198 - protein, 30 aa, Artificial Sequence
  Description of Artificial Sequence: Synthetic polypeptide
QAEEIATTNPVATEQWGCVAGTMLETDDNP

SEQ ID NO: 124199 - protein, 33 aa, Artificial Sequence
  Description of Artificial Sequence: Synthetic polypeptide
DEMEIVTTNPVAWEQYGTVCSATDGPNEFEGND

SEQ ID NO: 124200 - protein, 33 aa, Artificial Sequence
  Description of Artificial Sequence: Synthetic polypeptide
QAEEIATTNPVATEQWGCVAGTMNLQHQDDGNP

SEQ ID NO: 124201 - protein, 34 aa, Artificial Sequence
  Description of Artificial Sequence: Synthetic polypeptide
DESEIGTTNPVATECFWGSVSCINEPQDREGENG

SEQ ID NO: 124202 - protein, 33 aa, Artificial Sequence
  Description of Artificial Sequence: Synthetic polypeptide
DESEIGPTNPVATECWGSVSCINEPQDREGENG

SEQ ID NO: 124203 - protein, 33 aa, Artificial Sequence
  Description of Artificial Sequence: Synthetic polypeptide
QAEEIATTNPVATEQWGCVAGTNLQDQGPNENQ

SEQ ID NO: 124204 - protein, 33 aa, Artificial Sequence
  Description of Artificial Sequence: Synthetic polypeptide
DESEIFTTNPVATEQYGTVCSATDGPVEFEGND

SEQ ID NO: 124205 - protein, 36 aa, Artificial Sequence
  Description of Artificial Sequence: Synthetic polypeptide
DECEICTTNPVATEQYGSVSVTTNNQQQQQGTNTTE

SEQ ID NO: 124206 - protein, 32 aa, Artificial Sequence
  Description of Artificial Sequence: Synthetic polypeptide
DEEEIASVNPVCTEQYGVVSSDPALQMSNGNQ

SEQ ID NO: 124207 - protein, 33 aa, Artificial Sequence
  Description of Artificial Sequence: Synthetic polypeptide
DEEEIASVNPVCTEQYGVVSSTDPALPQMSGNQ

SEQ ID NO: 124208 - protein, 33 aa, Artificial Sequence
  Description of Artificial Sequence: Synthetic polypeptide
DEEEIASVNPVCTEQYGVVSSTTPALPQMSGNQ

SEQ ID NO: 124209 - protein, 33 aa, Artificial Sequence
  Description of Artificial Sequence: Synthetic polypeptide
DESEIFTTNPVATECWGSVSCINEPDDREGENG

SEQ ID NO: 124210 - protein, 34 aa, Artificial Sequence
  Description of Artificial Sequence: Synthetic polypeptide
DESEIFTTNPVATECWGSVCSCINEPQDREGENG

SEQ ID NO: 124211 - protein, 34 aa, Artificial Sequence
  Description of Artificial Sequence: Synthetic polypeptide
DESEIETTNPVATECWGSVVSCINEPQDREGENG

SEQ ID NO: 124212 - protein, 37 aa, Artificial Sequence
  Description of Artificial Sequence: Synthetic polypeptide
DECEICTTNPVATEQYGSVSVTTNLQAGNQQGTTEDE

SEQ ID NO: 124213 - protein, 33 aa, Artificial Sequence
  Description of Artificial Sequence: Synthetic polypeptide
QAEEIATTNPVATEQYGCVAGTGLQDQGPGENM

SEQ ID NO: 124214 - protein, 33 aa, Artificial Sequence
  Description of Artificial Sequence: Synthetic polypeptide
DECEICTTNPVATEQYGSVSTVVQEEDTEEEDD

SEQ ID NO: 124215 - protein, 34 aa, Artificial Sequence
  Description of Artificial Sequence: Synthetic polypeptide
QAEEIATTNPVATEQYGCVAGTNGLQPADGPNNS

SEQ ID NO: 124216 - protein, 36 aa, Artificial Sequence
  Description of Artificial Sequence: Synthetic polypeptide
DEEEIRTTNPVATEQYGSVNSTINMDDENSGMEEIP

SEQ ID NO: 124217 - protein, 33 aa, Artificial Sequence
  Description of Artificial Sequence: Synthetic polypeptide
DEMEIVTTNPVATEQYGTVVSATDGPVEFEGND

SEQ ID NO: 124218 - protein, 36 aa, Artificial Sequence
  Description of Artificial Sequence: Synthetic polypeptide
DEEEIRTTNPVATEQYGSVNSTLNPDDHNSGQEEIP

SEQ ID NO: 124219 - protein, 34 aa, Artificial Sequence
  Description of Artificial Sequence: Synthetic polypeptide
DEEEIASVNPVCTEQYGSVSSTTNGQMSNGMNPV

SEQ ID NO: 124220 - protein, 31 aa, Artificial Sequence
  Description of Artificial Sequence: Synthetic polypeptide
DEEEIASVNPIATEQYGAVSNDENLAEPGPQ

SEQ ID NO: 124221 - protein, 31 aa, Artificial Sequence
  Description of Artificial Sequence: Synthetic polypeptide
DEMEIVTTNPVGTEQYGVVAASDGPVEFGND

SEQ ID NO: 124222 - protein, 32 aa, Artificial Sequence
  Description of Artificial Sequence: Synthetic polypeptide
DEMEIVTTNPVGTEQYGTVSATDGPVEHEGND

SEQ ID NO: 124223 - protein, 32 aa, Artificial Sequence
  Description of Artificial Sequence: Synthetic polypeptide
DEMEIVTTNPVGTEQYGTVCSATDGPVEFGND

SEQ ID NO: 124224 - protein, 33 aa, Artificial Sequence
  Description of Artificial Sequence: Synthetic polypeptide
DESEIHTTNPVAHECWGSVSCINEPQDREGENG

SEQ ID NO: 124225 - protein, 36 aa, Artificial Sequence
  Description of Artificial Sequence: Synthetic polypeptide
AEEEIRTTNPVATEQYGSVVVSVTNQNQEQGETEDT

SEQ ID NO: 124226 - protein, 32 aa, Artificial Sequence
  Description of Artificial Sequence: Synthetic polypeptide
DEEEIASVNPVATEQYGVVANDENLQEPGPYQ

SEQ ID NO: 124227 - protein, 32 aa, Artificial Sequence
  Description of Artificial Sequence: Synthetic polypeptide
DEMEIVTTNPVCTEQYGTVSATDGPVEFEGND

SEQ ID NO: 124228 - protein, 32 aa, Artificial Sequence
  Description of Artificial Sequence: Synthetic polypeptide
DEMEIVTTNPVCTEQYGTVCSATGPVESEGND

SEQ ID NO: 124229 - protein, 32 aa, Artificial Sequence
  Description of Artificial Sequence: Synthetic polypeptide
DEMEIVTTNPVCTEQYGTVCSATGPVEFEGNQ

SEQ ID NO: 124230 - protein, 30 aa, Artificial Sequence
  Description of Artificial Sequence: Synthetic polypeptide
DEEEIASVNPVCTEQWGVVSENEQNSAGDQ

SEQ ID NO: 124231 - protein, 33 aa, Artificial Sequence
  Description of Artificial Sequence: Synthetic polypeptide
DESEIGTTNPVNTECWGSVSCINEPQDREGENG

SEQ ID NO: 124232 - protein, 31 aa, Artificial Sequence
  Description of Artificial Sequence: Synthetic polypeptide
QAEEIATTNPVATAQWGCVAGNGLQNGDNAT

SEQ ID NO: 124233 - protein, 33 aa, Artificial Sequence
  Description of Artificial Sequence: Synthetic polypeptide
DECEICTTNPVATEQYGTVASVTAGGVEGEGND

SEQ ID NO: 124234 - protein, 33 aa, Artificial Sequence
  Description of Artificial Sequence: Synthetic polypeptide
QAEEIATTNPVATAQWGSVSGTGNPDNADGNRH

SEQ ID NO: 124235 - protein, 33 aa, Artificial Sequence
  Description of Artificial Sequence: Synthetic polypeptide
DESEIGTTNPVATECWGVVSCINEPQDREGENG

SEQ ID NO: 124236 - protein, 32 aa, Artificial Sequence
  Description of Artificial Sequence: Synthetic polypeptide
DEEEIASVNPVCTEQYGSVSATDLEDHEGEDQ

SEQ ID NO: 124237 - protein, 33 aa, Artificial Sequence
  Description of Artificial Sequence: Synthetic polypeptide
DESEIGTTNPVATECWGSVSCINEPMDREGENG

SEQ ID NO: 124238 - protein, 33 aa, Artificial Sequence
  Description of Artificial Sequence: Synthetic polypeptide
DESEIGTTNPVATECWGHVSCINEPQDREGENG

SEQ ID NO: 124239 - protein, 34 aa, Artificial Sequence
  Description of Artificial Sequence: Synthetic polypeptide
DEEEIASVNPVCTEQYGSVSSTTPALPQMSGNPQ

SEQ ID NO: 124240 - protein, 34 aa, Artificial Sequence
  Description of Artificial Sequence: Synthetic polypeptide
DESEIKTTNPVATEQYGSVSINGMNGEDGQGGEV

SEQ ID NO: 124241 - protein, 28 aa, Artificial Sequence
  Description of Artificial Sequence: Synthetic peptide
QDEEIATTNPVATEQYGEAAEVCQHEEK

SEQ ID NO: 124242 - protein, 28 aa, Artificial Sequence
  Description of Artificial Sequence: Synthetic peptide
QDEEIATTNPVATEQYGEAPEVCQHEEK

SEQ ID NO: 124243 - protein, 33 aa, Artificial Sequence
  Description of Artificial Sequence: Synthetic polypeptide
DEMEIVTTNPVATEQYGTVMSATDGPVEFEGND

SEQ ID NO: 124244 - protein, 32 aa, Artificial Sequence
  Description of Artificial Sequence: Synthetic polypeptide
DEQEIRTTNPVATEQWGDVSATDLEDHEEDDA

SEQ ID NO: 124245 - protein, 31 aa, Artificial Sequence
  Description of Artificial Sequence: Synthetic polypeptide
QEAEIACTNPVAYEQYGEASCENLSQRVGGS

SEQ ID NO: 124246 - protein, 33 aa, Artificial Sequence
  Description of Artificial Sequence: Synthetic polypeptide
DEMEIVTTNPVATEQYGTVLSATDGPVEFEGND

SEQ ID NO: 124247 - protein, 28 aa, Artificial Sequence
  Description of Artificial Sequence: Synthetic peptide
QEAEIACTNPVGTEGWGVSASTLQDGDQ

SEQ ID NO: 124248 - protein, 29 aa, Artificial Sequence
  Description of Artificial Sequence: Synthetic peptide
QEAEIACTNPVGTEGWGVSASTLQGGDNI

SEQ ID NO: 124249 - protein, 33 aa, Artificial Sequence
  Description of Artificial Sequence: Synthetic polypeptide
DEMEIVTTNPVATEQYGTVKSATDGPVEFEGND

SEQ ID NO: 124250 - protein, 30 aa, Artificial Sequence
  Description of Artificial Sequence: Synthetic polypeptide
QEAEIACTNPVGTEGWGVSASTNLQHGDDI

SEQ ID NO: 124251 - protein, 33 aa, Artificial Sequence
  Description of Artificial Sequence: Synthetic polypeptide
DEMEIVTTNPVATEQYGTVMSATDGPVEFEGNF

SEQ ID NO: 124252 - protein, 33 aa, Artificial Sequence
  Description of Artificial Sequence: Synthetic polypeptide
DEMEIVTTNPVATEQYGTVISATDGPVEFEGNE

SEQ ID NO: 124253 - protein, 33 aa, Artificial Sequence
  Description of Artificial Sequence: Synthetic polypeptide
DEMEIVTTNPVATEQYGTVHSATDIPVEFEGND

SEQ ID NO: 124254 - protein, 33 aa, Artificial Sequence
  Description of Artificial Sequence: Synthetic polypeptide
DEMEIVTTNPVATEQYGTVHSATDGPVEFEGND

SEQ ID NO: 124255 - protein, 36 aa, Artificial Sequence
  Description of Artificial Sequence: Synthetic polypeptide
DEEEIRTTNPVATEQYGSVNPTTNDDEQNSGQEEIS

SEQ ID NO: 124256 - protein, 31 aa, Artificial Sequence
  Description of Artificial Sequence: Synthetic polypeptide
DEQEIRTTNPVATEQWGDVSATIEMNHEEEA

SEQ ID NO: 124257 - protein, 31 aa, Artificial Sequence
  Description of Artificial Sequence: Synthetic polypeptide
DEQEIRTTNPVATEQWGDVSEDLMNHAEDDL

SEQ ID NO: 124258 - protein, 33 aa, Artificial Sequence
  Description of Artificial Sequence: Synthetic polypeptide
DEMEIVTTNPVATEQYGTVGSATDGPVEFEGND

SEQ ID NO: 124259 - protein, 33 aa, Artificial Sequence
  Description of Artificial Sequence: Synthetic polypeptide
DEMEIVTTNPVATEQYGTVFSATDGPVEFEGND

SEQ ID NO: 124260 - protein, 33 aa, Artificial Sequence
  Description of Artificial Sequence: Synthetic polypeptide
DEMEIVTTNPVATEQYGTVDSATKGPVEFEGND

SEQ ID NO: 124261 - protein, 33 aa, Artificial Sequence
  Description of Artificial Sequence: Synthetic polypeptide
DEMEIVTTNPVATEQYGTVISATDGPVEFEGND

SEQ ID NO: 124262 - protein, 33 aa, Artificial Sequence
  Description of Artificial Sequence: Synthetic polypeptide
DEMEIVTTNPVATEQYGTVNSATDGPVEFEGND

SEQ ID NO: 124263 - protein, 33 aa, Artificial Sequence
  Description of Artificial Sequence: Synthetic polypeptide
DEMEIVTTNPVATEQYGTVNSATDGPVEFLGND

SEQ ID NO: 124264 - protein, 30 aa, Artificial Sequence
  Description of Artificial Sequence: Synthetic polypeptide
QEAEIACTNPCSYEQYGCVSWNLQSGGERA

SEQ ID NO: 124265 - protein, 32 aa, Artificial Sequence
  Description of Artificial Sequence: Synthetic polypeptide
DEMEIVTTNPVATEQYGTVSACDGEVEFEGNG

SEQ ID NO: 124266 - protein, 33 aa, Artificial Sequence
  Description of Artificial Sequence: Synthetic polypeptide
DEMEIVTTNPVATEQYGTVRSLTDGEVEFEGND

SEQ ID NO: 124267 - protein, 33 aa, Artificial Sequence
  Description of Artificial Sequence: Synthetic polypeptide
DEMEIVTTNPVATEQYGTVRSATDGPVEFEGNT

SEQ ID NO: 124268 - protein, 33 aa, Artificial Sequence
  Description of Artificial Sequence: Synthetic polypeptide
DEMEIVTTNPVATEQYGTVRSATDGPVEFEGND

SEQ ID NO: 124269 - protein, 33 aa, Artificial Sequence
  Description of Artificial Sequence: Synthetic polypeptide
DEMEIVTTNPVATEQYGTVRSATDGMVEFEGND

SEQ ID NO: 124270 - protein, 33 aa, Artificial Sequence
  Description of Artificial Sequence: Synthetic polypeptide
DEMEIVTTNPVATEQYGTVQSVTLGPVEFEGND

SEQ ID NO: 124271 - protein, 33 aa, Artificial Sequence
  Description of Artificial Sequence: Synthetic polypeptide
DEMEIVTTNPVATEQYGTVQSATDGPVEFEGND

SEQ ID NO: 124272 - protein, 32 aa, Artificial Sequence
  Description of Artificial Sequence: Synthetic polypeptide
DEQEIRTTNPVATEQWGDVSAEDLMNHAGEDL

SEQ ID NO: 124273 - protein, 32 aa, Artificial Sequence
  Description of Artificial Sequence: Synthetic polypeptide
DEQEIRTTNPVATEQWGDVSATDLEDAAEDDA

SEQ ID NO: 124274 - protein, 33 aa, Artificial Sequence
  Description of Artificial Sequence: Synthetic polypeptide
DEMEIVTTNPVATEQYGTVPSATKGPVEFEGND

SEQ ID NO: 124275 - protein, 33 aa, Artificial Sequence
  Description of Artificial Sequence: Synthetic polypeptide
DEMEIVTTNPVATEQYGTVPSATDMPVEFEGND

SEQ ID NO: 124276 - protein, 33 aa, Artificial Sequence
  Description of Artificial Sequence: Synthetic polypeptide
DEMEIVTTNPVATEQYGTVPSATDGPVGFEGND

SEQ ID NO: 124277 - protein, 33 aa, Artificial Sequence
  Description of Artificial Sequence: Synthetic polypeptide
DEMEIVTTNPVATEQYGTVPSATDGPVEFEGND

SEQ ID NO: 124278 - protein, 32 aa, Artificial Sequence
  Description of Artificial Sequence: Synthetic polypeptide
DEQEIRTTNPVATEQWGDVSATDLEDAEEDDA

SEQ ID NO: 124279 - protein, 33 aa, Artificial Sequence
  Description of Artificial Sequence: Synthetic polypeptide
DEMEIVTTNPVATEQYGTVPSATDGPSEAEGND

SEQ ID NO: 124280 - protein, 31 aa, Artificial Sequence
  Description of Artificial Sequence: Synthetic polypeptide
DEMEIVTTNPVATEQYGTVPATDGPVEFEND

SEQ ID NO: 124281 - protein, 32 aa, Artificial Sequence
  Description of Artificial Sequence: Synthetic polypeptide
DEMEIVTTNPVATEQYGTVPATDGPVEFEGND

SEQ ID NO: 124282 - protein, 29 aa, Artificial Sequence
  Description of Artificial Sequence: Synthetic peptide
QDSEVATTNPVATEGYGNVAANVIQRGQK

SEQ ID NO: 124283 - protein, 30 aa, Artificial Sequence
  Description of Artificial Sequence: Synthetic polypeptide
QEAEIACTNPCSYEQYGCVSWNLQESGDRA

SEQ ID NO: 124284 - protein, 31 aa, Artificial Sequence
  Description of Artificial Sequence: Synthetic polypeptide
QEAEIAPTNPVAYEQYGCASCINLSQRVGDS

SEQ ID NO: 124285 - protein, 32 aa, Artificial Sequence
  Description of Artificial Sequence: Synthetic polypeptide
DEMEIVTTNPVATEQYGTVSACDGLVEFEGTD

SEQ ID NO: 124286 - protein, 31 aa, Artificial Sequence
  Description of Artificial Sequence: Synthetic polypeptide
QEAEIAPTNPVAYEQYGEASCANLSQRVGDH

SEQ ID NO: 124287 - protein, 28 aa, Artificial Sequence
  Description of Artificial Sequence: Synthetic peptide
QEAEIASTNPVGTEGYGVMFSTLQHGDI

SEQ ID NO: 124288 - protein, 34 aa, Artificial Sequence
  Description of Artificial Sequence: Synthetic polypeptide
DEMEIVTTNPVATEQYGTVCSTTGEPNEFFGNNQ

SEQ ID NO: 124289 - protein, 33 aa, Artificial Sequence
  Description of Artificial Sequence: Synthetic polypeptide
QEAEICTVNPVATEGYGSVITNGLGGGQGGNTT

SEQ ID NO: 124290 - protein, 33 aa, Artificial Sequence
  Description of Artificial Sequence: Synthetic polypeptide
DEMEIVTTNPVATEQYGTVCSTTEEPNEFFGVD

SEQ ID NO: 124291 - protein, 33 aa, Artificial Sequence
  Description of Artificial Sequence: Synthetic polypeptide
DEMEIVTTNPVATEQYGTVCSTTDPPEEFEGND

SEQ ID NO: 124292 - protein, 33 aa, Artificial Sequence
  Description of Artificial Sequence: Synthetic polypeptide
DEMEIVTTNPVATEQYGTVCSTTDGPVEFEGNV

SEQ ID NO: 124293 - protein, 30 aa, Artificial Sequence
  Description of Artificial Sequence: Synthetic polypeptide
DESEIATTNPVSTEQYGNVANTEMNRAEQA

SEQ ID NO: 124294 - protein, 33 aa, Artificial Sequence
  Description of Artificial Sequence: Synthetic polypeptide
DEMEIVTTNPVATEQYGTVCSTTDGPVEFEGND

SEQ ID NO: 124295 - protein, 33 aa, Artificial Sequence
  Description of Artificial Sequence: Synthetic polypeptide
DEMEIVTTNPVATEQYGTVCSTTDGPMEFEGND

SEQ ID NO: 124296 - protein, 28 aa, Artificial Sequence
  Description of Artificial Sequence: Synthetic peptide
QEAEIATTNPVATEQYGVAPEVGQHMMK

SEQ ID NO: 124297 - protein, 33 aa, Artificial Sequence
  Description of Artificial Sequence: Synthetic polypeptide
DEMEIVTTNPVATEQYGTVCSTTDGGVEFEGND

SEQ ID NO: 124298 - protein, 34 aa, Artificial Sequence
  Description of Artificial Sequence: Synthetic polypeptide
DEMEIVTTNPVATEQYGTVCSTTDEPNENFGSND

SEQ ID NO: 124299 - protein, 35 aa, Artificial Sequence
  Description of Artificial Sequence: Synthetic polypeptide
QEAVIRTTNPVATEQYGCCVACTNEPSQRTGGNRN

SEQ ID NO: 124300 - protein, 33 aa, Artificial Sequence
  Description of Artificial Sequence: Synthetic polypeptide
DEMEIVTTNPVATEQYGTVCSTTDAPVEFEGND

SEQ ID NO: 124301 - protein, 29 aa, Artificial Sequence
  Description of Artificial Sequence: Synthetic peptide
QECEIAPTNPCSYEQWGIVSCNLQSGDGR

SEQ ID NO: 124302 - protein, 29 aa, Artificial Sequence
  Description of Artificial Sequence: Synthetic peptide
QECEIASTNPVGTEGYGVMASTKLQHGDI

SEQ ID NO: 124303 - protein, 28 aa, Artificial Sequence
  Description of Artificial Sequence: Synthetic peptide
QECEIASTNPVGTEGYGVMASTLQHGDI

SEQ ID NO: 124304 - protein, 28 aa, Artificial Sequence
  Description of Artificial Sequence: Synthetic peptide
QECEIASTNPVGTEGYGVMASTLQHGDY

SEQ ID NO: 124305 - protein, 28 aa, Artificial Sequence
  Description of Artificial Sequence: Synthetic peptide
QECEIASTNPVGTEGYGVMASTLQHGII

SEQ ID NO: 124306 - protein, 33 aa, Artificial Sequence
  Description of Artificial Sequence: Synthetic polypeptide
DEMEIVTTNPVATEQYGTVCSTTDEPVIFEGND

SEQ ID NO: 124307 - protein, 28 aa, Artificial Sequence
  Description of Artificial Sequence: Synthetic peptide
QEAEIATTNPVATEQYGEAPEVQQHEEK

SEQ ID NO: 124308 - protein, 28 aa, Artificial Sequence
  Description of Artificial Sequence: Synthetic peptide
QEAEIATTNPVATEQYGEAPEVCQHEMK

SEQ ID NO: 124309 - protein, 34 aa, Artificial Sequence
  Description of Artificial Sequence: Synthetic polypeptide
DEMEIVTTNPVATEQYGTVCSTTMEPNEFFGNQG

SEQ ID NO: 124310 - protein, 33 aa, Artificial Sequence
  Description of Artificial Sequence: Synthetic polypeptide
DEMEIVTTNPVATEQYGTVCVATDGPVEREGND

SEQ ID NO: 124311 - protein, 31 aa, Artificial Sequence
  Description of Artificial Sequence: Synthetic polypeptide
DEQEIRTTNPVATEQWGDVSEDLMNHAEEDL

SEQ ID NO: 124312 - protein, 34 aa, Artificial Sequence
  Description of Artificial Sequence: Synthetic polypeptide
DEEEIRTTNPVATEQYGSVNNYSEYLDVTDTEVF

SEQ ID NO: 124313 - protein, 33 aa, Artificial Sequence
  Description of Artificial Sequence: Synthetic polypeptide
DEMEIVTTNPVATEQYGTVCSYTDGPVEFEGND

SEQ ID NO: 124314 - protein, 34 aa, Artificial Sequence
  Description of Artificial Sequence: Synthetic polypeptide
DEEEIRTTNPVATEQYGSVNNYSELYDVQTEEGG

SEQ ID NO: 124315 - protein, 33 aa, Artificial Sequence
  Description of Artificial Sequence: Synthetic polypeptide
DEMEIVTTNPVATEQYGTVCSYTDAPVEFEGND

SEQ ID NO: 124316 - protein, 35 aa, Artificial Sequence
  Description of Artificial Sequence: Synthetic polypeptide
DEEEIRTTNPVATEQYGSVNNYSEHLEDVQTEEVG

SEQ ID NO: 124317 - protein, 33 aa, Artificial Sequence
  Description of Artificial Sequence: Synthetic polypeptide
DEMEIVTTNPVATEQYGTVCSWTDGPVEFEGND

SEQ ID NO: 124318 - protein, 33 aa, Artificial Sequence
  Description of Artificial Sequence: Synthetic polypeptide
DEMEIVTTNPVATEQYGTVCSVTMEPVEFEGNQ

SEQ ID NO: 124319 - protein, 34 aa, Artificial Sequence
  Description of Artificial Sequence: Synthetic polypeptide
DECEICTTNPVATEQYGSVSTVAQQGSTDEEEDD

SEQ ID NO: 124320 - protein, 33 aa, Artificial Sequence
  Description of Artificial Sequence: Synthetic polypeptide
DEMEIVTTNPVATEQYGTVCSVTGAPVEFEGND

SEQ ID NO: 124321 - protein, 33 aa, Artificial Sequence
  Description of Artificial Sequence: Synthetic polypeptide
DEMEIVTTNPVATEQYGTVCSVTDPPVEFSGND

SEQ ID NO: 124322 - protein, 30 aa, Artificial Sequence
  Description of Artificial Sequence: Synthetic polypeptide
DEQEIRTTNPVATEQWGDVSEIEMNAAEDA

SEQ ID NO: 124323 - protein, 34 aa, Artificial Sequence
  Description of Artificial Sequence: Synthetic polypeptide
DEEEIRTTNPVATEQYGSVNNYSEADVVQTEEVG

SEQ ID NO: 124324 - protein, 34 aa, Artificial Sequence
  Description of Artificial Sequence: Synthetic polypeptide
DEEEIRTTNPVATEQYGSVNNVPVQDEQGGHEFT

SEQ ID NO: 124325 - protein, 33 aa, Artificial Sequence
  Description of Artificial Sequence: Synthetic polypeptide
DEMEIVTTNPVATEQYGTVCSVTDGPVEFEGND

SEQ ID NO: 124326 - protein, 31 aa, Artificial Sequence
  Description of Artificial Sequence: Synthetic polypeptide
DEQEIRTTNPVATEQWGDVSEIEMNAAEDEA

SEQ ID NO: 124327 - protein, 28 aa, Artificial Sequence
  Description of Artificial Sequence: Synthetic peptide
QEAEIATTNPVATEQYGEAPEVCQHEEK

SEQ ID NO: 124328 - protein, 33 aa, Artificial Sequence
  Description of Artificial Sequence: Synthetic polypeptide
DEMEIVTTNPVATEQYGTVCSTTVGPVEFEGND

SEQ ID NO: 124329 - protein, 28 aa, Artificial Sequence
  Description of Artificial Sequence: Synthetic peptide
QEAEIASTNPVGTEGYGVMASTLQHGDI

SEQ ID NO: 124330 - protein, 32 aa, Artificial Sequence
  Description of Artificial Sequence: Synthetic polypeptide
DESEIATVNPVATECWGSVSDINEPQDSEGNG

SEQ ID NO: 124331 - protein, 30 aa, Artificial Sequence
  Description of Artificial Sequence: Synthetic polypeptide
QDSEIATTNPVSTEGYGDVAANCIQRVGQR

SEQ ID NO: 124332 - protein, 35 aa, Artificial Sequence
  Description of Artificial Sequence: Synthetic polypeptide
DEEEIRTTNPVATEQYGTISTMPAIPQMQNGMNPH

SEQ ID NO: 124333 - protein, 33 aa, Artificial Sequence
  Description of Artificial Sequence: Synthetic polypeptide
DEMEIVTTNPVATEQYGTVSSATPGPVNFEGND

SEQ ID NO: 124334 - protein, 33 aa, Artificial Sequence
  Description of Artificial Sequence: Synthetic polypeptide
DEMEIVTTNPVATEQYGTVSSATPAPVEFEGND

SEQ ID NO: 124335 - protein, 29 aa, Artificial Sequence
  Description of Artificial Sequence: Synthetic peptide
QDNEIATTNPVSTECYGDVAANCIQREER

SEQ ID NO: 124336 - protein, 33 aa, Artificial Sequence
  Description of Artificial Sequence: Synthetic polypeptide
DEMEIVTTNPVATEQYGTVSSATPAPPEFEGND

SEQ ID NO: 124337 - protein, 34 aa, Artificial Sequence
  Description of Artificial Sequence: Synthetic polypeptide
DEMEIVTTNPVATEQYGTVSSATPAGPEMRNGND

SEQ ID NO: 124338 - protein, 32 aa, Artificial Sequence
  Description of Artificial Sequence: Synthetic polypeptide
DEEEIATTNPSATEQYGSVPTVQDHFQVELYV

SEQ ID NO: 124339 - protein, 33 aa, Artificial Sequence
  Description of Artificial Sequence: Synthetic polypeptide
DEMEIVTTNPVATEQYGTVSSATDGPVIFEGND

SEQ ID NO: 124340 - protein, 33 aa, Artificial Sequence
  Description of Artificial Sequence: Synthetic polypeptide
DEMEIVTTNPVATEQYGTVSSATDGPVEFEGNV

SEQ ID NO: 124341 - protein, 33 aa, Artificial Sequence
  Description of Artificial Sequence: Synthetic polypeptide
DEMEIVTTNPVATEQYGTVSSATWGPAEFEGND

SEQ ID NO: 124342 - protein, 33 aa, Artificial Sequence
  Description of Artificial Sequence: Synthetic polypeptide
DEMEIVTTNPVATEQYGTVSSATDGPVEFEGND

SEQ ID NO: 124343 - protein, 37 aa, Artificial Sequence
  Description of Artificial Sequence: Synthetic polypeptide
DEEEIRTTNPVATEQYGSVNSATPAMPNMENGMNPVN

SEQ ID NO: 124344 - protein, 33 aa, Artificial Sequence
  Description of Artificial Sequence: Synthetic polypeptide
DEMEIVTTNPVATEQYGTVSSATDGGVNFEGND

SEQ ID NO: 124345 - protein, 33 aa, Artificial Sequence
  Description of Artificial Sequence: Synthetic polypeptide
DEMEIVTTNPVATEQYGTVSSATDGGVEFEGND

SEQ ID NO: 124346 - protein, 35 aa, Artificial Sequence
  Description of Artificial Sequence: Synthetic polypeptide
DEAEIATTNPVAYEQYGVSVSATNDLGQMHGIAHH

SEQ ID NO: 124347 - protein, 29 aa, Artificial Sequence
  Description of Artificial Sequence: Synthetic peptide
QDSEIASTNPVGTEGYGNVAANTLQRGQI

SEQ ID NO: 124348 - protein, 34 aa, Artificial Sequence
  Description of Artificial Sequence: Synthetic polypeptide
DESEICTTNPVATECWGSVSCINEPQDRKGENTG

SEQ ID NO: 124349 - protein, 30 aa, Artificial Sequence
  Description of Artificial Sequence: Synthetic polypeptide
QDSEIASTNPVGTEGYGNVAANTLQSRGQR

SEQ ID NO: 124350 - protein, 28 aa, Artificial Sequence
  Description of Artificial Sequence: Synthetic peptide
QDSEIASTNPVGTEGYGNVANTLQRGQI

SEQ ID NO: 124351 - protein, 34 aa, Artificial Sequence
  Description of Artificial Sequence: Synthetic polypeptide
DEEEIATTNPTATEQYGCVATTNGNDPREGGNTE

SEQ ID NO: 124352 - protein, 34 aa, Artificial Sequence
  Description of Artificial Sequence: Synthetic polypeptide
DEEEIATTNPSATEQYGSVPPCVTQDQTQGQNVD

SEQ ID NO: 124353 - protein, 34 aa, Artificial Sequence
  Description of Artificial Sequence: Synthetic polypeptide
DEMEIVTTNPVATEQYGTVSSTTDGGPEREGNPD

SEQ ID NO: 124354 - protein, 34 aa, Artificial Sequence
  Description of Artificial Sequence: Synthetic polypeptide
DEMEIVTTNPVATEQYGTVSSTTDGGPEREGNPV

SEQ ID NO: 124355 - protein, 35 aa, Artificial Sequence
  Description of Artificial Sequence: Synthetic polypeptide
DECEICTTNPVATEQYGSVSTVNNQQQQNNTEDEE

SEQ ID NO: 124356 - protein, 28 aa, Artificial Sequence
  Description of Artificial Sequence: Synthetic peptide
QDEEIATTNPVATEQYGEIPEVCQHEEI

SEQ ID NO: 124357 - protein, 33 aa, Artificial Sequence
  Description of Artificial Sequence: Synthetic polypeptide
DEMEIVTTNPVATEQYGTVTSATDGPVEFEGND

SEQ ID NO: 124358 - protein, 33 aa, Artificial Sequence
  Description of Artificial Sequence: Synthetic polypeptide
DEMEIVTTNPVATEQYGTVTSATDGPVEAEGND

SEQ ID NO: 124359 - protein, 34 aa, Artificial Sequence
  Description of Artificial Sequence: Synthetic polypeptide
DEEEIATTNPMATEQYGSVPPTVTQDHQQGANND

SEQ ID NO: 124360 - protein, 36 aa, Artificial Sequence
  Description of Artificial Sequence: Synthetic polypeptide
DECEICTTNPVATEQYGSVSTVNLQQQNNTATEESE

SEQ ID NO: 124361 - protein, 28 aa, Artificial Sequence
  Description of Artificial Sequence: Synthetic peptide
QDEEIATTNPVSTEQYGEVAEVCQHEQK

SEQ ID NO: 124362 - protein, 36 aa, Artificial Sequence
  Description of Artificial Sequence: Synthetic polypeptide
DECEICTTNPVATEQYGSVSTVNDQQGSTEENEEED

SEQ ID NO: 124363 - protein, 34 aa, Artificial Sequence
  Description of Artificial Sequence: Synthetic polypeptide
DEEEIATTNPMATEQYGSVTPTVTQDHFQGQNND

SEQ ID NO: 124364 - protein, 35 aa, Artificial Sequence
  Description of Artificial Sequence: Synthetic polypeptide
DESEICTTNPVATEHYGVVSTGGLQGDTGGGNTQR

SEQ ID NO: 124365 - protein, 33 aa, Artificial Sequence
  Description of Artificial Sequence: Synthetic polypeptide
DESEICTTNPVATEHYGVVSTGGLGDTGGGDQR

SEQ ID NO: 124366 - protein, 36 aa, Artificial Sequence
  Description of Artificial Sequence: Synthetic polypeptide
DEEEIRTTNPVATEQYGSVNSDNNMNQPEMGTGGQT

SEQ ID NO: 124367 - protein, 36 aa, Artificial Sequence
  Description of Artificial Sequence: Synthetic polypeptide
DECEICTTNPVATEQYGSVSTVNAQQQGNTEEAEED

SEQ ID NO: 124368 - protein, 28 aa, Artificial Sequence
  Description of Artificial Sequence: Synthetic peptide
QDGEIASTNPCSSEQYGNVSCNIQSGTR

SEQ ID NO: 124369 - protein, 36 aa, Artificial Sequence
  Description of Artificial Sequence: Synthetic polypeptide
DEEEIRTTNPVATEQYGSVNSDGNNQGQEQGEGVEI

SEQ ID NO: 124370 - protein, 30 aa, Artificial Sequence
  Description of Artificial Sequence: Synthetic polypeptide
QDGEIASTNPVSTEGYGIVACNLQSRVGTR

SEQ ID NO: 124371 - protein, 28 aa, Artificial Sequence
  Description of Artificial Sequence: Synthetic peptide
QDNEIATTNPVATECYGDVAETLQHEQL

SEQ ID NO: 124372 - protein, 33 aa, Artificial Sequence
  Description of Artificial Sequence: Synthetic polypeptide
DESEICTTNPVATECWGSVSCINEPQGRENENG

SEQ ID NO: 124373 - protein, 34 aa, Artificial Sequence
  Description of Artificial Sequence: Synthetic polypeptide
DEMEIVTTNPVATEQYGTVSSTTDGPPEREGNPD

SEQ ID NO: 124374 - protein, 35 aa, Artificial Sequence
  Description of Artificial Sequence: Synthetic polypeptide
DECEICTTNPVATEQYGSVSTVNAQQGSTEEAEDD

SEQ ID NO: 124375 - protein, 28 aa, Artificial Sequence
  Description of Artificial Sequence: Synthetic peptide
QDSEIASTNPVGTEGYGNVASTLQHGDI

SEQ ID NO: 124376 - protein, 36 aa, Artificial Sequence
  Description of Artificial Sequence: Synthetic polypeptide
DECEICTTNPVATEQYGSVSTVNAQQGNTEENEQDE

SEQ ID NO: 124377 - protein, 32 aa, Artificial Sequence
  Description of Artificial Sequence: Synthetic polypeptide
DEMEIVTTNPVATEQYGTVSATDPVEFEGEDD

SEQ ID NO: 124378 - protein, 34 aa, Artificial Sequence
  Description of Artificial Sequence: Synthetic polypeptide
DEAEIATTNPVAYEQYGSVSIANNDTQDQGNDQL

SEQ ID NO: 124379 - protein, 29 aa, Artificial Sequence
  Description of Artificial Sequence: Synthetic peptide
QDSEIATTNPVSTECYGDVAANCIQREQR

SEQ ID NO: 124380 - protein, 36 aa, Artificial Sequence
  Description of Artificial Sequence: Synthetic polypeptide
DEEEIRTTNPVATEQYGTISSTMPAIPQMRNGMNPH

SEQ ID NO: 124381 - protein, 34 aa, Artificial Sequence
  Description of Artificial Sequence: Synthetic polypeptide
DEAEIATTNPVAYEQYGSVSGTNPQAHPMGMVQW

SEQ ID NO: 124382 - protein, 31 aa, Artificial Sequence
  Description of Artificial Sequence: Synthetic polypeptide
DESEIATVNPVCTECWGVVSCINEQDREGNQ

SEQ ID NO: 124383 - protein, 32 aa, Artificial Sequence
  Description of Artificial Sequence: Synthetic polypeptide
DEMEIVTTNPVATEQYGTVSASDGPVEFEGND

SEQ ID NO: 124384 - protein, 32 aa, Artificial Sequence
  Description of Artificial Sequence: Synthetic polypeptide
DEMEIVTTNPVATEQYGTVSAPDGPVEFEGND

SEQ ID NO: 124385 - protein, 29 aa, Artificial Sequence
  Description of Artificial Sequence: Synthetic peptide
QDSEIATTNPVSTEGYGDVAANCIQREQR

SEQ ID NO: 124386 - protein, 32 aa, Artificial Sequence
  Description of Artificial Sequence: Synthetic polypeptide
DEMEIVTTNPVATEQYGTVSAMEGIVEFNGND

SEQ ID NO: 124387 - protein, 32 aa, Artificial Sequence
  Description of Artificial Sequence: Synthetic polypeptide
DEMEIVTTNPVATEQYGTVSAMEDIVEFNGNH

SEQ ID NO: 124388 - protein, 32 aa, Artificial Sequence
  Description of Artificial Sequence: Synthetic polypeptide
DEMEIVTTNPVATEQYGTVSAMDGPVEFNGND

SEQ ID NO: 124389 - protein, 35 aa, Artificial Sequence
  Description of Artificial Sequence: Synthetic polypeptide
DECEICTTNPVATEQYGSVSTVATLQEGDTEEEDD

SEQ ID NO: 124390 - protein, 32 aa, Artificial Sequence
  Description of Artificial Sequence: Synthetic polypeptide
DEMEIVTTNPVATEQYGTVSAMDDIVEFNGNH

SEQ ID NO: 124391 - protein, 32 aa, Artificial Sequence
  Description of Artificial Sequence: Synthetic polypeptide
DEMEIVTTNPVATEQYGTVSAMDDIVEFNGND

SEQ ID NO: 124392 - protein, 35 aa, Artificial Sequence
  Description of Artificial Sequence: Synthetic polypeptide
DECEICTTNPVATEQYGSVSTVAQQSGNTEEAEDD

SEQ ID NO: 124393 - protein, 32 aa, Artificial Sequence
  Description of Artificial Sequence: Synthetic polypeptide
DESEIATVNPVATECWGVVSCINEPQDREGNG

SEQ ID NO: 124394 - protein, 34 aa, Artificial Sequence
  Description of Artificial Sequence: Synthetic polypeptide
DEAEIATTNPVAYEQYGSVSANNNPQNHQAGNMN

SEQ ID NO: 124395 - protein, 32 aa, Artificial Sequence
  Description of Artificial Sequence: Synthetic polypeptide
DEMEIVTTNPVATEQYGTVSAEDGPVEFEGND

SEQ ID NO: 124396 - protein, 32 aa, Artificial Sequence
  Description of Artificial Sequence: Synthetic polypeptide
DEMEIVTTNPVATEQYGTVSAEDCPVQFEGED

SEQ ID NO: 124397 - protein, 33 aa, Artificial Sequence
  Description of Artificial Sequence: Synthetic polypeptide
DEAEIATTNPVAYEQYGSVSTHGQEHQGDQAEE

SEQ ID NO: 124398 - protein, 28 aa, Artificial Sequence
  Description of Artificial Sequence: Synthetic peptide
QDEEIATTNPVATEQYGEAPEVCQDEEK

SEQ ID NO: 124399 - protein, 29 aa, Artificial Sequence
  Description of Artificial Sequence: Synthetic peptide
QDSEIATTNPVSTECYGDVAANCIQREER

SEQ ID NO: 124400 - protein, 33 aa, Artificial Sequence
  Description of Artificial Sequence: Synthetic polypeptide
DEQEIRTTNPVATEPYGSISAMEDLQDQNGEDL

SEQ ID NO: 124401 - protein, 31 aa, Artificial Sequence
  Description of Artificial Sequence: Synthetic polypeptide
DEQEIRTTNPVATEHWGSVNLLNDEDYRSYE

SEQ ID NO: 124402 - protein, 33 aa, Artificial Sequence
  Description of Artificial Sequence: Synthetic polypeptide
DESEICTTNPVATECWGSVSCINEPQDHVGENG

SEQ ID NO: 124403 - protein, 33 aa, Artificial Sequence
  Description of Artificial Sequence: Synthetic polypeptide
DESEICTTNPVATECWGSVSCIAEPQDRWGENG

SEQ ID NO: 124404 - protein, 33 aa, Artificial Sequence
  Description of Artificial Sequence: Synthetic polypeptide
DEMEIVTTNPVATEQYGTVSATDGPVMNFEGND

SEQ ID NO: 124405 - protein, 33 aa, Artificial Sequence
  Description of Artificial Sequence: Synthetic polypeptide
DEMEIVTTNPVATEQYGTVSATDGPVEHEGNDL

SEQ ID NO: 124406 - protein, 33 aa, Artificial Sequence
  Description of Artificial Sequence: Synthetic polypeptide
DEAEIATTNPVAYEQYGSVSTVADGQDSNDNAE

SEQ ID NO: 124407 - protein, 33 aa, Artificial Sequence
  Description of Artificial Sequence: Synthetic polypeptide
DEMEIVTTNPVATEQYGTVSATDGPVEFEGNDD

SEQ ID NO: 124408 - protein, 36 aa, Artificial Sequence
  Description of Artificial Sequence: Synthetic polypeptide
DECEICTTNPVATEQYGSVSTVNAQQGNTEENEDED

SEQ ID NO: 124409 - protein, 32 aa, Artificial Sequence
  Description of Artificial Sequence: Synthetic polypeptide
DEMEIVTTNPVATEQYGTVSATDGPVEFEGEL

SEQ ID NO: 124410 - protein, 34 aa, Artificial Sequence
  Description of Artificial Sequence: Synthetic polypeptide
DEEEIRTTNPVATEQYGSVNQVIEPGFRGVDEQG

SEQ ID NO: 124411 - protein, 32 aa, Artificial Sequence
  Description of Artificial Sequence: Synthetic polypeptide
DEMEIVTTNPVATEQYGTVSATDGPVEFAGDD

SEQ ID NO: 124412 - protein, 32 aa, Artificial Sequence
  Description of Artificial Sequence: Synthetic polypeptide
DEMEIVTTNPVATEQYGTVSATDGPVEFAEND

SEQ ID NO: 124413 - protein, 28 aa, Artificial Sequence
  Description of Artificial Sequence: Synthetic peptide
QDSEIATTNPVATEGYGNVANVIQHGQK

SEQ ID NO: 124414 - protein, 32 aa, Artificial Sequence
  Description of Artificial Sequence: Synthetic polypeptide
DEMEIVTTNPVATEQYGTVSATDGPVEAAEND

SEQ ID NO: 124415 - protein, 35 aa, Artificial Sequence
  Description of Artificial Sequence: Synthetic polypeptide
DECEICTTNPVATEQYGSVSTVNAQQGDTEEQEDD

SEQ ID NO: 124416 - protein, 32 aa, Artificial Sequence
  Description of Artificial Sequence: Synthetic polypeptide
DEMEIVTTNPVATEQYGTVSATDGPVEAAENA

SEQ ID NO: 124417 - protein, 28 aa, Artificial Sequence
  Description of Artificial Sequence: Synthetic peptide
QDSEIATTNPVATEQYGNAAEVCQHGEK

SEQ ID NO: 124418 - protein, 33 aa, Artificial Sequence
  Description of Artificial Sequence: Synthetic polypeptide
DEMEIVTTNPVATEQYGTVSATDGPEDFEGNDD

SEQ ID NO: 124419 - protein, 30 aa, Artificial Sequence
  Description of Artificial Sequence: Synthetic polypeptide
QDSEIATTNPVATEQYGNVPANTCQRVEQK

SEQ ID NO: 124420 - protein, 30 aa, Artificial Sequence
  Description of Artificial Sequence: Synthetic polypeptide
QDSEIATTNPVATEQYGNVPANVCQRVEQK

SEQ ID NO: 124421 - protein, 33 aa, Artificial Sequence
  Description of Artificial Sequence: Synthetic polypeptide
DEAEIATTNPVAYEQYGSVCTANPAWIPRDNEE

SEQ ID NO: 124422 - protein, 35 aa, Artificial Sequence
  Description of Artificial Sequence: Synthetic polypeptide
DESEIKTTNPVATEQYGSVSINGQRGEDLGQGGEI

SEQ ID NO: 124423 - protein, 35 aa, Artificial Sequence
  Description of Artificial Sequence: Synthetic polypeptide
AEEEIRTTNPVATEQYGSVVVSVTTNNNQEQETED

SEQ ID NO: 124424 - protein, 33 aa, Artificial Sequence
  Description of Artificial Sequence: Synthetic polypeptide
NESEIRTTNPVAYEQWGSVAWTDNGGQQDGESR

SEQ ID NO: 124425 - protein, 35 aa, Artificial Sequence
  Description of Artificial Sequence: Synthetic polypeptide
DEEEIRTTNPVATEQYGSVPHPTAEWQAIMGPEQE

SEQ ID NO: 124426 - protein, 29 aa, Artificial Sequence
  Description of Artificial Sequence: Synthetic peptide
CEEEIATTNPVATEQYGEAPEVPPQHEEK

SEQ ID NO: 124427 - protein, 31 aa, Artificial Sequence
  Description of Artificial Sequence: Synthetic polypeptide
NESEIRTTNPVAYEQWGSVAWTDNSQQDHSS

SEQ ID NO: 124428 - protein, 33 aa, Artificial Sequence
  Description of Artificial Sequence: Synthetic polypeptide
DESEIRSTNPVATECYGVMSCITEPQDREGENG

SEQ ID NO: 124429 - protein, 36 aa, Artificial Sequence
  Description of Artificial Sequence: Synthetic polypeptide
DECEICTTNPVATEQYGVVSTTVANLQQGNNNNEDD

SEQ ID NO: 124430 - protein, 33 aa, Artificial Sequence
  Description of Artificial Sequence: Synthetic polypeptide
DESEIRSTNPVATECWGSVSCINEPQDREQENG

SEQ ID NO: 124431 - protein, 32 aa, Artificial Sequence
  Description of Artificial Sequence: Synthetic polypeptide
NESEIRTTNPVAYEQWGSVAWTDNSQQQDGSP

SEQ ID NO: 124432 - protein, 29 aa, Artificial Sequence
  Description of Artificial Sequence: Synthetic peptide
CEEEIATTNPVATEQYGEFPEVDQAEEKH

SEQ ID NO: 124433 - protein, 33 aa, Artificial Sequence
  Description of Artificial Sequence: Synthetic polypeptide
NETEDEIRTTNPVAYEQWGTVATNLQGEHNGKG

SEQ ID NO: 124434 - protein, 35 aa, Artificial Sequence
  Description of Artificial Sequence: Synthetic polypeptide
DEEEIRTTNPVATEQYGSVPFTDAAEKAGIDIQRQ

SEQ ID NO: 124435 - protein, 34 aa, Artificial Sequence
  Description of Artificial Sequence: Synthetic polypeptide
DEQEICTTNPVATEQYGSVSATDSLCEDHEGEDL

SEQ ID NO: 124436 - protein, 36 aa, Artificial Sequence
  Description of Artificial Sequence: Synthetic polypeptide
DEEEIRTTNPVATEQYGSVPETNSLIAPFNVSVFSD

SEQ ID NO: 124437 - protein, 36 aa, Artificial Sequence
  Description of Artificial Sequence: Synthetic polypeptide
DECEICTTNPVATEQYGVVSTTSNLQQGNNNQNQQD

SEQ ID NO: 124438 - protein, 32 aa, Artificial Sequence
  Description of Artificial Sequence: Synthetic polypeptide
NETEIATTNPVATEMWGCVSTNLQGNEGGDDS

SEQ ID NO: 124439 - protein, 35 aa, Artificial Sequence
  Description of Artificial Sequence: Synthetic polypeptide
DECEICTTNPVATEQYGVVSTTQQLQQGNNPTNDE

SEQ ID NO: 124440 - protein, 35 aa, Artificial Sequence
  Description of Artificial Sequence: Synthetic polypeptide
DEEEIRTTNPVATEQYGSVPETESLIGQTNVVFSD

SEQ ID NO: 124441 - protein, 34 aa, Artificial Sequence
  Description of Artificial Sequence: Synthetic polypeptide
DEEEIRTTNPVATEQYGSVPEPTIVEGVQMMVVS

SEQ ID NO: 124442 - protein, 32 aa, Artificial Sequence
  Description of Artificial Sequence: Synthetic polypeptide
NETEIATTNPTAYEPWGSVSTNLQGNDGMNTD

SEQ ID NO: 124443 - protein, 35 aa, Artificial Sequence
  Description of Artificial Sequence: Synthetic polypeptide
DEEEIRTTNPVATEQYGSVPIANPTQPEDEGLIQN

SEQ ID NO: 124444 - protein, 33 aa, Artificial Sequence
  Description of Artificial Sequence: Synthetic polypeptide
NESEIRTTNPVAYECWGSVATNLGQGNEGGDSR

SEQ ID NO: 124445 - protein, 33 aa, Artificial Sequence
  Description of Artificial Sequence: Synthetic polypeptide
NESEIRTTNPVATRCWGSVSCINEPQDREGENG

SEQ ID NO: 124446 - protein, 37 aa, Artificial Sequence
  Description of Artificial Sequence: Synthetic polypeptide
DEEEIRTTNPVATEQYGSYVITPLWSPQGENINRVND

SEQ ID NO: 124447 - protein, 34 aa, Artificial Sequence
  Description of Artificial Sequence: Synthetic polypeptide
DEEEIRTTNPVATEQYGSVPMPLDEETMGLLEQV

SEQ ID NO: 124448 - protein, 34 aa, Artificial Sequence
  Description of Artificial Sequence: Synthetic polypeptide
NESEIRTTNPVATECWGSVSCINEPQDREGENFG

SEQ ID NO: 124449 - protein, 37 aa, Artificial Sequence
  Description of Artificial Sequence: Synthetic polypeptide
DEEEIRTTNPVATEQYGSYVPPTAPNSEVREGAENIL

SEQ ID NO: 124450 - protein, 34 aa, Artificial Sequence
  Description of Artificial Sequence: Synthetic polypeptide
DECEICTTNPVATEQYGVVSTVAQLQGNNTTNDD

SEQ ID NO: 124451 - protein, 35 aa, Artificial Sequence
  Description of Artificial Sequence: Synthetic polypeptide
DEEEIRTTNPVATEQYGSYVPVMNLISTDVVENFQ

SEQ ID NO: 124452 - protein, 34 aa, Artificial Sequence
  Description of Artificial Sequence: Synthetic polypeptide
DECEICTTNPVATEQYGVVSTVAQLNQGNQNEDE

SEQ ID NO: 124453 - protein, 33 aa, Artificial Sequence
  Description of Artificial Sequence: Synthetic polypeptide
NESEIRTTNPVATECWGSVSCIPEPQDREGENG

SEQ ID NO: 124454 - protein, 33 aa, Artificial Sequence
  Description of Artificial Sequence: Synthetic polypeptide
DESEIRSTNPVATEGYGNVSCINIPQSRVGEQG

SEQ ID NO: 124455 - protein, 37 aa, Artificial Sequence
  Description of Artificial Sequence: Synthetic polypeptide
AEEEIRTTNPVATEQYGSVVVTTTQNGNLQQGTNNVA

SEQ ID NO: 124456 - protein, 34 aa, Artificial Sequence
  Description of Artificial Sequence: Synthetic polypeptide
DEEEIACTNPVATEQYGSVCAANNLDEAGNNVNE

SEQ ID NO: 124457 - protein, 30 aa, Artificial Sequence
  Description of Artificial Sequence: Synthetic polypeptide
DENDIRTTNPVATEQWGDVSEIELNAAEDA

SEQ ID NO: 124458 - protein, 35 aa, Artificial Sequence
  Description of Artificial Sequence: Synthetic polypeptide
DEEEIRTTNPVATEQYGSVPITWPNLAATTEVEEN

SEQ ID NO: 124459 - protein, 32 aa, Artificial Sequence
  Description of Artificial Sequence: Synthetic polypeptide
DEQEIATVNPVCTEQYGSVSATDLEDHEGEDQ

SEQ ID NO: 124460 - protein, 32 aa, Artificial Sequence
  Description of Artificial Sequence: Synthetic polypeptide
DEQEIAVTNPVATEQWGSVSFTDLEDHEGEDL

SEQ ID NO: 124461 - protein, 35 aa, Artificial Sequence
  Description of Artificial Sequence: Synthetic polypeptide
DEEEIRTTNPVATEQYGSVPITITQMINPMPNNLT

SEQ ID NO: 124462 - protein, 37 aa, Artificial Sequence
  Description of Artificial Sequence: Synthetic polypeptide
AEEEIRTTNPVATEQYGSVVVTTTNNLEQGTEGGNTT

SEQ ID NO: 124463 - protein, 32 aa, Artificial Sequence
  Description of Artificial Sequence: Synthetic polypeptide
DEQEIAVTNPVATEQYGSVSATDLEDHEMEDL

SEQ ID NO: 124464 - protein, 29 aa, Artificial Sequence
  Description of Artificial Sequence: Synthetic peptide
DESEIRSTNPVATEGWGDVASTEQAAEDA

SEQ ID NO: 124465 - protein, 34 aa, Artificial Sequence
  Description of Artificial Sequence: Synthetic polypeptide
DEEEIRTTNPVATEQYGSVPEPQYEVLRGLEEEL

SEQ ID NO: 124466 - protein, 34 aa, Artificial Sequence
  Description of Artificial Sequence: Synthetic polypeptide
NESEIRCTNPVATEQYGSVYCTWNDQHHQGKNED

SEQ ID NO: 124467 - protein, 34 aa, Artificial Sequence
  Description of Artificial Sequence: Synthetic polypeptide
NETEIATTNPVATEMWGSVCSTNLQGNDGQNTDS

SEQ ID NO: 124468 - protein, 34 aa, Artificial Sequence
  Description of Artificial Sequence: Synthetic polypeptide
DESEIRSTNPVATECWGCSVSCINEPQDREGENG

SEQ ID NO: 124469 - protein, 36 aa, Artificial Sequence
  Description of Artificial Sequence: Synthetic polypeptide
DEEEIRTTNPVATEQYGSVPCVMNSSVVTQGQNGAE

SEQ ID NO: 124470 - protein, 34 aa, Artificial Sequence
  Description of Artificial Sequence: Synthetic polypeptide
DEQEICTTNPVATEQYGSVWSATDLEPHEGEDTQ

SEQ ID NO: 124471 - protein, 34 aa, Artificial Sequence
  Description of Artificial Sequence: Synthetic polypeptide
DEEEIACTNPVATEQYGSVCAATGLAPDEQMEGN

SEQ ID NO: 124472 - protein, 32 aa, Artificial Sequence
  Description of Artificial Sequence: Synthetic polypeptide
NETEIATTNPVAYEHWGNVSTNLQGNEGNNES

SEQ ID NO: 124473 - protein, 32 aa, Artificial Sequence
  Description of Artificial Sequence: Synthetic polypeptide
NETEIATTNPVAYEKWGSVATNLQGNMGNTDK

SEQ ID NO: 124474 - protein, 33 aa, Artificial Sequence
  Description of Artificial Sequence: Synthetic polypeptide
DESEIRRTNPVATECWGSVFCINEPQDREGENG

SEQ ID NO: 124475 - protein, 35 aa, Artificial Sequence
  Description of Artificial Sequence: Synthetic polypeptide
DEEEIRTTNPVATEQYGSVPCTEMLGQVQLLEVLV

SEQ ID NO: 124476 - protein, 33 aa, Artificial Sequence
  Description of Artificial Sequence: Synthetic polypeptide
NETEIATTNPVAYEQWGSVNKTDNLDQQGENIF

SEQ ID NO: 124477 - protein, 33 aa, Artificial Sequence
  Description of Artificial Sequence: Synthetic polypeptide
DESEIRRTNPVATECWGSVSCINEPQDAEGENG

SEQ ID NO: 124478 - protein, 37 aa, Artificial Sequence
  Description of Artificial Sequence: Synthetic polypeptide
DEEEIRTTNPVATEQYGSVPCPALGQHETRTVVNVRN

SEQ ID NO: 124479 - protein, 32 aa, Artificial Sequence
  Description of Artificial Sequence: Synthetic polypeptide
NETEIATTNPVAYERWGEVSTNLQGQMGDGDR

SEQ ID NO: 124480 - protein, 32 aa, Artificial Sequence
  Description of Artificial Sequence: Synthetic polypeptide
NETEIATTNPVAYERWGNVSTNLQGNSGGNTS

SEQ ID NO: 124481 - protein, 32 aa, Artificial Sequence
  Description of Artificial Sequence: Synthetic polypeptide
NETEIATTNPVAYERWGNVSTNLQGNSGNDDS

SEQ ID NO: 124482 - protein, 35 aa, Artificial Sequence
  Description of Artificial Sequence: Synthetic polypeptide
DEEEIRTTNPVATEQYGSVPCGPNLQPALIVVEVD

SEQ ID NO: 124483 - protein, 33 aa, Artificial Sequence
  Description of Artificial Sequence: Synthetic polypeptide
DESEIRQTNPVATECWGSVSCINEPQDREPENG

SEQ ID NO: 124484 - protein, 34 aa, Artificial Sequence
  Description of Artificial Sequence: Synthetic polypeptide
DEEEIRTTNPVATEQYGSVPAENYMIEREILILD

SEQ ID NO: 124485 - protein, 36 aa, Artificial Sequence
  Description of Artificial Sequence: Synthetic polypeptide
AEEEIRTTNPVATEQYGSVVVTTNQLGGNEQGSNNE

SEQ ID NO: 124486 - protein, 33 aa, Artificial Sequence
  Description of Artificial Sequence: Synthetic polypeptide
DESEIRQTNPVATECWGSVSCINEPQDREIENG

SEQ ID NO: 124487 - protein, 31 aa, Artificial Sequence
  Description of Artificial Sequence: Synthetic polypeptide
NETEIATTNPVAYERWGEVSTNAQGNSGNDS

SEQ ID NO: 124488 - protein, 32 aa, Artificial Sequence
  Description of Artificial Sequence: Synthetic polypeptide
NETEIATTNPVAYEEWGTVSTNLQGNDGNTDP

SEQ ID NO: 124489 - protein, 33 aa, Artificial Sequence
  Description of Artificial Sequence: Synthetic polypeptide
DEEEIACTNPVATEQYGSVCAATGEEQADEQNN

SEQ ID NO: 124490 - protein, 32 aa, Artificial Sequence
  Description of Artificial Sequence: Synthetic polypeptide
NETEIATTNPVAYEEWGSVSTNLQGNDGGTDG

SEQ ID NO: 124491 - protein, 36 aa, Artificial Sequence
  Description of Artificial Sequence: Synthetic polypeptide
DEEEIRTTNPVATEQYGSVPEPPNLGVIRNQVANLN

SEQ ID NO: 124492 - protein, 33 aa, Artificial Sequence
  Description of Artificial Sequence: Synthetic polypeptide
NETEIATTNPVATEMWGSVSTNLNQGNEGGDAD

SEQ ID NO: 124493 - protein, 33 aa, Artificial Sequence
  Description of Artificial Sequence: Synthetic polypeptide
DESEIRSTNPVATDAYGSVSIANGQGQTGNGDG

SEQ ID NO: 124494 - protein, 33 aa, Artificial Sequence
  Description of Artificial Sequence: Synthetic polypeptide
DESEIRRTNPVATECWGSVWCINEPQDREGENG

SEQ ID NO: 124495 - protein, 36 aa, Artificial Sequence
  Description of Artificial Sequence: Synthetic polypeptide
DEEEIRTTNPVATEQYGSVPENVSNLPQFQEGELWV

SEQ ID NO: 124496 - protein, 36 aa, Artificial Sequence
  Description of Artificial Sequence: Synthetic polypeptide
DEEEIRTTNPVATEQYGSVPENVSHLPQFQEVEGEV

SEQ ID NO: 124497 - protein, 34 aa, Artificial Sequence
  Description of Artificial Sequence: Synthetic polypeptide
DESEIRRTNPVATECWGSVSCINHEPQDREGENG

SEQ ID NO: 124498 - protein, 36 aa, Artificial Sequence
  Description of Artificial Sequence: Synthetic polypeptide
DEEEIRTTNPVATEQYGSVPELVSNLPQFQNVELEV

SEQ ID NO: 124499 - protein, 37 aa, Artificial Sequence
  Description of Artificial Sequence: Synthetic polypeptide
DEEEIRTTNPVATEQYGSVSTNQNANNNNEEGNNNTE

SEQ ID NO: 124500 - protein, 36 aa, Artificial Sequence
  Description of Artificial Sequence: Synthetic polypeptide
DEEEIRTTNPVATEQYGSVPEDTSTLQINVQVNETA

SEQ ID NO: 124501 - protein, 36 aa, Artificial Sequence
  Description of Artificial Sequence: Synthetic polypeptide
DEEEIRTTNPVATEQYGSVPDTYDTVQDRFEVNQTD

SEQ ID NO: 124502 - protein, 35 aa, Artificial Sequence
  Description of Artificial Sequence: Synthetic polypeptide
DEEEIRTTNPVATEQYGSVPDTPLNEQSPVILVQN

SEQ ID NO: 124503 - protein, 35 aa, Artificial Sequence
  Description of Artificial Sequence: Synthetic polypeptide
DEEEIRTTNPVATEQYGSVPDLTPNQHDEGDQVID

SEQ ID NO: 124504 - protein, 32 aa, Artificial Sequence
  Description of Artificial Sequence: Synthetic polypeptide
NETEIATTNPVAYECWGEVSTNLQGNSGNNDS

SEQ ID NO: 124505 - protein, 32 aa, Artificial Sequence
  Description of Artificial Sequence: Synthetic polypeptide
NETEIATTNPVAYEEWGSTSTNLQGNDGGNTD

SEQ ID NO: 124506 - protein, 32 aa, Artificial Sequence
  Description of Artificial Sequence: Synthetic polypeptide
NETEIATTNPVAYEEWGSTVTTNLQGNDGNTD

SEQ ID NO: 124507 - protein, 31 aa, Artificial Sequence
  Description of Artificial Sequence: Synthetic polypeptide
NETEIATTNPVAYEEWGSVATNSQGNDGNTD

SEQ ID NO: 124508 - protein, 33 aa, Artificial Sequence
  Description of Artificial Sequence: Synthetic polypeptide
NETEIATTNPVAYEEWGSVCSTNLEQGNDGNTD

SEQ ID NO: 124509 - protein, 32 aa, Artificial Sequence
  Description of Artificial Sequence: Synthetic polypeptide
NETEIATTNPVAYEEWGSVSTNIQGNDGNNTD

SEQ ID NO: 124510 - protein, 33 aa, Artificial Sequence
  Description of Artificial Sequence: Synthetic polypeptide
DESEIRSTNPVATECWGSMSCINEPQDREGENG

SEQ ID NO: 124511 - protein, 32 aa, Artificial Sequence
  Description of Artificial Sequence: Synthetic polypeptide
NESEIATTNPVAYEQWGSVSGGDNHQEGGNME

SEQ ID NO: 124512 - protein, 36 aa, Artificial Sequence
  Description of Artificial Sequence: Synthetic polypeptide
DENEAEIRTTNPVAYECWGSVSTGNGMEQRGENGQS

SEQ ID NO: 124513 - protein, 35 aa, Artificial Sequence
  Description of Artificial Sequence: Synthetic polypeptide
DECEICTTNPVATEQYGVVSTVEQLQQGNNANNDD

SEQ ID NO: 124514 - protein, 34 aa, Artificial Sequence
  Description of Artificial Sequence: Synthetic polypeptide
DEEEIRTTNPVATEQYGSVPPPLLGETMGSLEQV

SEQ ID NO: 124515 - protein, 32 aa, Artificial Sequence
  Description of Artificial Sequence: Synthetic polypeptide
DENEIACTNPVATEPYGTISMENLQQQRNGGH

SEQ ID NO: 124516 - protein, 34 aa, Artificial Sequence
  Description of Artificial Sequence: Synthetic polypeptide
NEREIRTTNPVATEQYGCVCGTNLNQEIFGSDAA

SEQ ID NO: 124517 - protein, 31 aa, Artificial Sequence
  Description of Artificial Sequence: Synthetic polypeptide
DEQEIATTNPVSTEGYGSVSATDIESHEGEL

SEQ ID NO: 124518 - protein, 33 aa, Artificial Sequence
  Description of Artificial Sequence: Synthetic polypeptide
NEREIRTTNPVATEQYGCVCQTNHNQIFGSDAS

SEQ ID NO: 124519 - protein, 31 aa, Artificial Sequence
  Description of Artificial Sequence: Synthetic polypeptide
DESEIRSTNPVATEQYGVMATSTGQHNGDPI

SEQ ID NO: 124520 - protein, 34 aa, Artificial Sequence
  Description of Artificial Sequence: Synthetic polypeptide
NEREIRTTNPVATEQYGCVCWNTNLNQNFGSDAA

SEQ ID NO: 124521 - protein, 32 aa, Artificial Sequence
  Description of Artificial Sequence: Synthetic polypeptide
DEQEIATTNPVSTEPYGSISATDLEQHEGEDH

SEQ ID NO: 124522 - protein, 35 aa, Artificial Sequence
  Description of Artificial Sequence: Synthetic polypeptide
DEEEIRTTNPVATEQYGSVPPPLLLEQTMGLLEYV

SEQ ID NO: 124523 - protein, 32 aa, Artificial Sequence
  Description of Artificial Sequence: Synthetic polypeptide
DEQEIATTNPVSTEPYGSISATDLEQHEGEDL

SEQ ID NO: 124524 - protein, 32 aa, Artificial Sequence
  Description of Artificial Sequence: Synthetic polypeptide
DEQEIATTNPVSTEPYGSVSATDLEDHEGEDL

SEQ ID NO: 124525 - protein, 36 aa, Artificial Sequence
  Description of Artificial Sequence: Synthetic polypeptide
DECEICTTNPVATEQYGVVSTVNLQQQGNNATEEGE

SEQ ID NO: 124526 - protein, 36 aa, Artificial Sequence
  Description of Artificial Sequence: Synthetic polypeptide
DECEICTTNPVATEQYGVVSTVNLQQNQNEGTEENE

SEQ ID NO: 124527 - protein, 36 aa, Artificial Sequence
  Description of Artificial Sequence: Synthetic polypeptide
DESEIRSTNPVATEQYGSVSSTSPAGPQMRNGMNPI

SEQ ID NO: 124528 - protein, 34 aa, Artificial Sequence
  Description of Artificial Sequence: Synthetic polypeptide
NEREIRTTNPVATEQYGCVCWTELNQNFGSQNQA

SEQ ID NO: 124529 - protein, 36 aa, Artificial Sequence
  Description of Artificial Sequence: Synthetic polypeptide
DECEICTTNPVATEQYGVVSTVNLQAGNTEENEDED

SEQ ID NO: 124530 - protein, 35 aa, Artificial Sequence
  Description of Artificial Sequence: Synthetic polypeptide
DEEEIRTTNPVATEQYGSVPPPLLEQMTMGVLEQV

SEQ ID NO: 124531 - protein, 30 aa, Artificial Sequence
  Description of Artificial Sequence: Synthetic polypeptide
DENEIACTNPVATECYGETSNEEDWARGPR

SEQ ID NO: 124532 - protein, 35 aa, Artificial Sequence
  Description of Artificial Sequence: Synthetic polypeptide
DECEICTTNPVATEQYGVVSTVNLQQQQNNTEEEE

SEQ ID NO: 124533 - protein, 30 aa, Artificial Sequence
  Description of Artificial Sequence: Synthetic polypeptide
DENEIACTNPVATEQWGDVSENEQNAAEGA

SEQ ID NO: 124534 - protein, 34 aa, Artificial Sequence
  Description of Artificial Sequence: Synthetic polypeptide
DEAEISTTNPVATEQYGCVCSTEELQEHFGSDQS

SEQ ID NO: 124535 - protein, 33 aa, Artificial Sequence
  Description of Artificial Sequence: Synthetic polypeptide
DEAEISTTNPVATEQYGCVCSTAHQENFGSDQS

SEQ ID NO: 124536 - protein, 29 aa, Artificial Sequence
  Description of Artificial Sequence: Synthetic peptide
DESEIRSTNPVGTEGYGDVASTEQAAEDA

SEQ ID NO: 124537 - protein, 34 aa, Artificial Sequence
  Description of Artificial Sequence: Synthetic polypeptide
DEEEIRTTNPVATEQYGSYSVLTLGDEGGGQGFT

SEQ ID NO: 124538 - protein, 31 aa, Artificial Sequence
  Description of Artificial Sequence: Synthetic polypeptide
DEQEIATTNPVGTEQYGVVATDLEDHEGDDL

SEQ ID NO: 124539 - protein, 30 aa, Artificial Sequence
  Description of Artificial Sequence: Synthetic polypeptide
DESEIRSTNPVGTEGYGATASEDLQEHGDI

SEQ ID NO: 124540 - protein, 28 aa, Artificial Sequence
  Description of Artificial Sequence: Synthetic peptide
CESEIASTNPVGTEGYGVMASTLQHGDI

SEQ ID NO: 124541 - protein, 33 aa, Artificial Sequence
  Description of Artificial Sequence: Synthetic polypeptide
DEQEIATTNPVNTEQYGSVSATDLEDHEGFEDL

SEQ ID NO: 124542 - protein, 35 aa, Artificial Sequence
  Description of Artificial Sequence: Synthetic polypeptide
DEAEICTTNPVATECYGSVATGNLNQGDLGGNTED

SEQ ID NO: 124543 - protein, 36 aa, Artificial Sequence
  Description of Artificial Sequence: Synthetic polypeptide
DECEICTTNPVATEQYGVVSTVQNLQQGNNNQNQND

SEQ ID NO: 124544 - protein, 36 aa, Artificial Sequence
  Description of Artificial Sequence: Synthetic polypeptide
DEAEICTTNPVATECYGSVATGNGLQQGDRGGNKES

SEQ ID NO: 124545 - protein, 34 aa, Artificial Sequence
  Description of Artificial Sequence: Synthetic polypeptide
DEEEIRTTNPVATEQYGSVPPPLLVETMGLLEGV

SEQ ID NO: 124546 - protein, 29 aa, Artificial Sequence
  Description of Artificial Sequence: Synthetic peptide
NEREIACTNPCSYEQYGCVSWNLQSGSQQ

SEQ ID NO: 124547 - protein, 30 aa, Artificial Sequence
  Description of Artificial Sequence: Synthetic polypeptide
DENEIACTNPVATEQYGDASEIEQNAAGGA

SEQ ID NO: 124548 - protein, 31 aa, Artificial Sequence
  Description of Artificial Sequence: Synthetic polypeptide
DESEIRSTNPVGTEGWGVMSCTLPQDRGENG

SEQ ID NO: 124549 - protein, 32 aa, Artificial Sequence
  Description of Artificial Sequence: Synthetic polypeptide
NEREIATTNPVAYEQWGQVVCCTNLSQWPGSR

SEQ ID NO: 124550 - protein, 35 aa, Artificial Sequence
  Description of Artificial Sequence: Synthetic polypeptide
DEAEICTTNPVATECYGNVSTGNGLLDDDRGGNEN

SEQ ID NO: 124551 - protein, 30 aa, Artificial Sequence
  Description of Artificial Sequence: Synthetic polypeptide
DENEIACTNPVATEQWGEVSEILMNRAEGA

SEQ ID NO: 124552 - protein, 34 aa, Artificial Sequence
  Description of Artificial Sequence: Synthetic polypeptide
DEEEIRTTNPVATEQYGSVPPPLLPEEMGLLEQV

SEQ ID NO: 124553 - protein, 35 aa, Artificial Sequence
  Description of Artificial Sequence: Synthetic polypeptide
DEAEICTTNPVATECYGEVSTGNQPTQGDTGGNER

SEQ ID NO: 124554 - protein, 30 aa, Artificial Sequence
  Description of Artificial Sequence: Synthetic polypeptide
DENEIACTNPVATEQWGEASENEQNAAGGA

SEQ ID NO: 124555 - protein, 32 aa, Artificial Sequence
  Description of Artificial Sequence: Synthetic polypeptide
DENEIACTNPVATECYGETSNAENLQEPKGPR

SEQ ID NO: 124556 - protein, 32 aa, Artificial Sequence
  Description of Artificial Sequence: Synthetic polypeptide
DEQEIATTNPVSTEQYGNVSATTLEDHEGEDL

SEQ ID NO: 124557 - protein, 34 aa, Artificial Sequence
  Description of Artificial Sequence: Synthetic polypeptide
DEEEIRTTNPVATEQYGSVPPPLLEETMGMLFQV

SEQ ID NO: 124558 - protein, 34 aa, Artificial Sequence
  Description of Artificial Sequence: Synthetic polypeptide
DEEEIRTTNPVATEQYGSVPPPLLEETMGLDEQI

SEQ ID NO: 124559 - protein, 35 aa, Artificial Sequence
  Description of Artificial Sequence: Synthetic polypeptide
DEAEISTTNPVATEQYGCVCSTNLNAEYFGSDNQS

SEQ ID NO: 124560 - protein, 33 aa, Artificial Sequence
  Description of Artificial Sequence: Synthetic polypeptide
DESEIRSTNPVATEGYGVVSATSPTLPQHGDPI

SEQ ID NO: 124561 - protein, 37 aa, Artificial Sequence
  Description of Artificial Sequence: Synthetic polypeptide
AEEEIRTTNPVATEQYGSVVVTVANLQNQGENGTNVE

SEQ ID NO: 124562 - protein, 36 aa, Artificial Sequence
  Description of Artificial Sequence: Synthetic polypeptide
DEEEIRTTNPVATEQYGSVPNPTNVLPIGQQQPEVS

SEQ ID NO: 124563 - protein, 35 aa, Artificial Sequence
  Description of Artificial Sequence: Synthetic polypeptide
DEEEIRTTNPVATEQYGSVPNPPLLEQTMGLLEQE

SEQ ID NO: 124564 - protein, 32 aa, Artificial Sequence
  Description of Artificial Sequence: Synthetic polypeptide
NEREIRTTNPVAYEAWGCVVGTNLSQNDGGSR

SEQ ID NO: 124565 - protein, 35 aa, Artificial Sequence
  Description of Artificial Sequence: Synthetic polypeptide
DECEICTTNPVATEQYGVVSTVNAQAGNTEENEDD

SEQ ID NO: 124566 - protein, 32 aa, Artificial Sequence
  Description of Artificial Sequence: Synthetic polypeptide
NEREIRTTNPVAYEAWGQCVVWTNLSQNEGER

SEQ ID NO: 124567 - protein, 32 aa, Artificial Sequence
  Description of Artificial Sequence: Synthetic polypeptide
NERTIATTNPVATEQYGSVWTNVEVEIGQSRV

SEQ ID NO: 124568 - protein, 37 aa, Artificial Sequence
  Description of Artificial Sequence: Synthetic polypeptide
AEEEIRTTNPVATEQYGSVVVTVANLNLQDEEGTNVT

SEQ ID NO: 124569 - protein, 28 aa, Artificial Sequence
  Description of Artificial Sequence: Synthetic peptide
NESEIASTNPVGTEGYGVMASTLQHGDI

SEQ ID NO: 124570 - protein, 34 aa, Artificial Sequence
  Description of Artificial Sequence: Synthetic polypeptide
DESEIRSTNPVATEGYGSVSATSPAGPQMRGDPI

SEQ ID NO: 124571 - protein, 34 aa, Artificial Sequence
  Description of Artificial Sequence: Synthetic polypeptide
DEEEIRTTNPVATEQYGSYVEPTTQERVHVMEEK

SEQ ID NO: 124572 - protein, 31 aa, Artificial Sequence
  Description of Artificial Sequence: Synthetic polypeptide
DEQEIATVNPVATEQYGVVSADDLEDHEGEL

SEQ ID NO: 124573 - protein, 37 aa, Artificial Sequence
  Description of Artificial Sequence: Synthetic polypeptide
AEEEIRTTNPVATEQYGSVVVTVANLLNNQEQGTNVE

SEQ ID NO: 124574 - protein, 31 aa, Artificial Sequence
  Description of Artificial Sequence: Synthetic polypeptide
NESEIATTNPVAYEQWGSVAWTDQSQQDGSR

SEQ ID NO: 124575 - protein, 31 aa, Artificial Sequence
  Description of Artificial Sequence: Synthetic polypeptide
DEQEIATVNPVATEQYGVVSADDLEDSEGEL

SEQ ID NO: 124576 - protein, 29 aa, Artificial Sequence
  Description of Artificial Sequence: Synthetic peptide
CEEEIATTNPVATEQYGEFPEVGQDSEEK

SEQ ID NO: 124577 - protein, 32 aa, Artificial Sequence
  Description of Artificial Sequence: Synthetic polypeptide
DEQEIATVNPVATEQYGVVSATDLEDHEGEDL

SEQ ID NO: 124578 - protein, 32 aa, Artificial Sequence
  Description of Artificial Sequence: Synthetic polypeptide
DEQEIATTNSVATEQWGSVSATDLEDHEGEDL

SEQ ID NO: 124579 - protein, 34 aa, Artificial Sequence
  Description of Artificial Sequence: Synthetic polypeptide
DEEEIRTTNPVATEQYGSVNYAVYMETTGNDVEE

SEQ ID NO: 124580 - protein, 34 aa, Artificial Sequence
  Description of Artificial Sequence: Synthetic polypeptide
DEAEISTTNPVATEQYGCVCSTNHQENFNSNTQS

SEQ ID NO: 124581 - protein, 29 aa, Artificial Sequence
  Description of Artificial Sequence: Synthetic peptide
DESEIRSTNPVATEQWGDVAETEQAAEDA

SEQ ID NO: 124582 - protein, 34 aa, Artificial Sequence
  Description of Artificial Sequence: Synthetic polypeptide
DESEIRSTNPVATEQYGDMSTMNTGQGGNGQDGD

SEQ ID NO: 124583 - protein, 36 aa, Artificial Sequence
  Description of Artificial Sequence: Synthetic polypeptide
AEEEIRTTNPVATEQYGSVVVTVNQAGNQAGNNNDG

SEQ ID NO: 124584 - protein, 36 aa, Artificial Sequence
  Description of Artificial Sequence: Synthetic polypeptide
AEEEIRTTNPVATEQYGSVVVTVNNNNNQAGNNEQS

SEQ ID NO: 124585 - protein, 35 aa, Artificial Sequence
  Description of Artificial Sequence: Synthetic polypeptide
DEEEIRTTNPVATEQYGSVPPPILEQDTMGLLEQV

SEQ ID NO: 124586 - protein, 36 aa, Artificial Sequence
  Description of Artificial Sequence: Synthetic polypeptide
AEEEIRTTNPVATEQYGSVVVTVNNNDEQLGNNNAT

SEQ ID NO: 124587 - protein, 34 aa, Artificial Sequence
  Description of Artificial Sequence: Synthetic polypeptide
DEQEIATTNPVSTEQYGSVSATEDLQQQHEGEDH

SEQ ID NO: 124588 - protein, 37 aa, Artificial Sequence
  Description of Artificial Sequence: Synthetic polypeptide
AEEEIRTTNPVATEQYGSVVVTVNNLQGNEQGTNTND

SEQ ID NO: 124589 - protein, 37 aa, Artificial Sequence
  Description of Artificial Sequence: Synthetic polypeptide
AEEEIRTTNPVATEQYGSVVVTVNNLQANEQGTNNND

SEQ ID NO: 124590 - protein, 34 aa, Artificial Sequence
  Description of Artificial Sequence: Synthetic polypeptide
DEEEIRTTNPVATEQYGSVPPMDGLEHDSTQNDD

SEQ ID NO: 124591 - protein, 34 aa, Artificial Sequence
  Description of Artificial Sequence: Synthetic polypeptide
DEEEIRTTNPVATEQYGSVPPDPVGLIETPGQLV

SEQ ID NO: 124592 - protein, 33 aa, Artificial Sequence
  Description of Artificial Sequence: Synthetic polypeptide
DEEEIACTNPVATEQYGSVCAADNHGQDSDINH

SEQ ID NO: 124593 - protein, 34 aa, Artificial Sequence
  Description of Artificial Sequence: Synthetic polypeptide
DEQEIATTNPVSTEQYGSVSATEDLQQQHNGEDH

SEQ ID NO: 124594 - protein, 36 aa, Artificial Sequence
  Description of Artificial Sequence: Synthetic polypeptide
DEEEIRTTNPVATEQYGSVPPAMSMQTNVTTQVSDL

SEQ ID NO: 124595 - protein, 31 aa, Artificial Sequence
  Description of Artificial Sequence: Synthetic polypeptide
DESEIRSTNPVATEQWGDVSAEIIQNAAEQR

SEQ ID NO: 124596 - protein, 37 aa, Artificial Sequence
  Description of Artificial Sequence: Synthetic polypeptide
AEEEIRTTNPVATEQYGSVVVTVNLLQSNEQGNNNNE

SEQ ID NO: 124597 - protein, 35 aa, Artificial Sequence
  Description of Artificial Sequence: Synthetic polypeptide
DEEEIACTNPVATEQYGSVCAADNNLADRDGNDDH

SEQ ID NO: 124598 - protein, 32 aa, Artificial Sequence
  Description of Artificial Sequence: Synthetic polypeptide
DEQEIATTNPVSTEQYGTVSAMDLQQDHNGEH

SEQ ID NO: 124599 - protein, 34 aa, Artificial Sequence
  Description of Artificial Sequence: Synthetic polypeptide
DEAEISTTNPVATEQYGCVCSTGNHQEHFGSEQS

SEQ ID NO: 124600 - protein, 36 aa, Artificial Sequence
  Description of Artificial Sequence: Synthetic polypeptide
AEEEIRTTNPVATEQYGSVVVTVNGNNEQQGTNNAS

SEQ ID NO: 124601 - protein, 33 aa, Artificial Sequence
  Description of Artificial Sequence: Synthetic polypeptide
DEAEISTTNPVATEQYGCVCSTNDAYFGSDTQS

SEQ ID NO: 124602 - protein, 33 aa, Artificial Sequence
  Description of Artificial Sequence: Synthetic polypeptide
DEMELVTTNPVATEQYGTVCSATDGNVEFEGND

SEQ ID NO: 124603 - protein, 36 aa, Artificial Sequence
  Description of Artificial Sequence: Synthetic polypeptide
AEEEIRTTNPVATEQYGSVVVTTNNQLGNEAGNNVD

SEQ ID NO: 124604 - protein, 33 aa, Artificial Sequence
  Description of Artificial Sequence: Synthetic polypeptide
DESEIRQTNPVATECWGSVGWINEPQAREGENG

SEQ ID NO: 124605 - protein, 37 aa, Artificial Sequence
  Description of Artificial Sequence: Synthetic polypeptide
DEEEIRTTNPVATEQYGSYVSPVVSELQPVVGPNNLV

SEQ ID NO: 124606 - protein, 33 aa, Artificial Sequence
  Description of Artificial Sequence: Synthetic polypeptide
DESEIRCTNPIATECYGSVSEINEPMDREGENG

SEQ ID NO: 124607 - protein, 37 aa, Artificial Sequence
  Description of Artificial Sequence: Synthetic polypeptide
DEEEIRTTNPVATEQYGSYVSSTTPAGPGMRNGMNPV

SEQ ID NO: 124608 - protein, 37 aa, Artificial Sequence
  Description of Artificial Sequence: Synthetic polypeptide
DEEEIRTTNPVATEQYGSYVSSTTPAGPNMRNGMNPV

SEQ ID NO: 124609 - protein, 34 aa, Artificial Sequence
  Description of Artificial Sequence: Synthetic polypeptide
DECEICTTNPVATEQYGTVSTVTDGGVEQGEGND

SEQ ID NO: 124610 - protein, 34 aa, Artificial Sequence
  Description of Artificial Sequence: Synthetic polypeptide
DESEIRATNPVATECWGSVSCINEPQDREGENHG

SEQ ID NO: 124611 - protein, 33 aa, Artificial Sequence
  Description of Artificial Sequence: Synthetic polypeptide
DECEICTTNPVATEQYGTVSTVTDGGVEIIGND

SEQ ID NO: 124612 - protein, 33 aa, Artificial Sequence
  Description of Artificial Sequence: Synthetic polypeptide
DESEIRATNPVATECWGSVSCINEPQDPEGENG

SEQ ID NO: 124613 - protein, 34 aa, Artificial Sequence
  Description of Artificial Sequence: Synthetic polypeptide
DECEICTTNPVATEQYGTVSTVTDGNPVEGEQND

SEQ ID NO: 124614 - protein, 33 aa, Artificial Sequence
  Description of Artificial Sequence: Synthetic polypeptide
DESEIRATNPVATECWGSVSCINEGQDREGQKG

SEQ ID NO: 124615 - protein, 33 aa, Artificial Sequence
  Description of Artificial Sequence: Synthetic polypeptide
DESEIQTTNPVATHCWGSVSCINEPQDREGENG

SEQ ID NO: 124616 - protein, 37 aa, Artificial Sequence
  Description of Artificial Sequence: Synthetic polypeptide
DEEEIRTTNPVATEQYGSYVSSTTPGGPNMRNGMNPV

SEQ ID NO: 124617 - protein, 33 aa, Artificial Sequence
  Description of Artificial Sequence: Synthetic polypeptide
DESEIQTCNPVATECWGSVSCINEPQDREGENG

SEQ ID NO: 124618 - protein, 33 aa, Artificial Sequence
  Description of Artificial Sequence: Synthetic polypeptide
DESEINTTNPVATFCWGSVSCINEPQDREGENG

SEQ ID NO: 124619 - protein, 32 aa, Artificial Sequence
  Description of Artificial Sequence: Synthetic polypeptide
DEEEIACTNPVAYEQYGSVATNGTAENPNPES

SEQ ID NO: 124620 - protein, 33 aa, Artificial Sequence
  Description of Artificial Sequence: Synthetic polypeptide
DESEINTTNPVATECWGSVSCINEPQDRECENG

SEQ ID NO: 124621 - protein, 33 aa, Artificial Sequence
  Description of Artificial Sequence: Synthetic polypeptide
DESEINTTNPVATECWGSVSCINEPQDIEGENG

SEQ ID NO: 124622 - protein, 33 aa, Artificial Sequence
  Description of Artificial Sequence: Synthetic polypeptide
DEEEIACTNPVAYEQYGSVATNGTGAEGGNEED

SEQ ID NO: 124623 - protein, 32 aa, Artificial Sequence
  Description of Artificial Sequence: Synthetic polypeptide
CEECIRTTNPVAYEQWGSVFQHEDLGRGGNTT

SEQ ID NO: 124624 - protein, 33 aa, Artificial Sequence
  Description of Artificial Sequence: Synthetic polypeptide
DECEICTTNPVATEQYGTVSTVTDGNVEGEGDD

SEQ ID NO: 124625 - protein, 34 aa, Artificial Sequence
  Description of Artificial Sequence: Synthetic polypeptide
DECEICTTNPVATEQYGTVSTVTDGQVEGEGNND

SEQ ID NO: 124626 - protein, 34 aa, Artificial Sequence
  Description of Artificial Sequence: Synthetic polypeptide
DECEICTTNPVATEQYGTVSTVTDQPGENGEGND

SEQ ID NO: 124627 - protein, 36 aa, Artificial Sequence
  Description of Artificial Sequence: Synthetic polypeptide
DEEEIRTTNPVATEQYGSVNSTTPTGPEMGQGENPG

SEQ ID NO: 124628 - protein, 33 aa, Artificial Sequence
  Description of Artificial Sequence: Synthetic polypeptide
DEQEIQTTNPVATEQYGSVSAGDLEDHEGEEDL

SEQ ID NO: 124629 - protein, 34 aa, Artificial Sequence
  Description of Artificial Sequence: Synthetic polypeptide
DESEIRETNPVATECWGSVSCINEPQDREGENCG

SEQ ID NO: 124630 - protein, 33 aa, Artificial Sequence
  Description of Artificial Sequence: Synthetic polypeptide
DESEIRCTNPVATMCWGSVSCINEPQDREGENG

SEQ ID NO: 124631 - protein, 34 aa, Artificial Sequence
  Description of Artificial Sequence: Synthetic polypeptide
DECEICTTNPVATEQYGTVSTVTNGSVEGEGNQD

SEQ ID NO: 124632 - protein, 36 aa, Artificial Sequence
  Description of Artificial Sequence: Synthetic polypeptide
AEEEIRTTNPVATEQYGSVVVTNNQLGNEAGSNNVS

SEQ ID NO: 124633 - protein, 35 aa, Artificial Sequence
  Description of Artificial Sequence: Synthetic polypeptide
DECEICTTNPVATEQYGTVSTVTNGQVENGEGNDD

SEQ ID NO: 124634 - protein, 35 aa, Artificial Sequence
  Description of Artificial Sequence: Synthetic polypeptide
DECEICTTNPVATEQYGTVSTVTNGQVEGEGNNGD

SEQ ID NO: 124635 - protein, 34 aa, Artificial Sequence
  Description of Artificial Sequence: Synthetic polypeptide
DECEICTTNPVATEQYGTVSTVTNGNVEEGEGND

SEQ ID NO: 124636 - protein, 37 aa, Artificial Sequence
  Description of Artificial Sequence: Synthetic polypeptide
DEEEIRTTNPVATEQYGSVNSTTPAGPNMRNGMNPVP

SEQ ID NO: 124637 - protein, 33 aa, Artificial Sequence
  Description of Artificial Sequence: Synthetic polypeptide
DESEIRCTNPVATECWGSVSEINEPMDREGENG

SEQ ID NO: 124638 - protein, 36 aa, Artificial Sequence
  Description of Artificial Sequence: Synthetic polypeptide
DECEICTTNPVATEQYGTVSTVTNGNLEQGEGNNED

SEQ ID NO: 124639 - protein, 33 aa, Artificial Sequence
  Description of Artificial Sequence: Synthetic polypeptide
DESEIRCTNPVATECWGSVSCINEPQDREGEGG

SEQ ID NO: 124640 - protein, 36 aa, Artificial Sequence
  Description of Artificial Sequence: Synthetic polypeptide
AEEEIRTTNPVATEQYGSVVVTNNNNQNQQGTNTDD

SEQ ID NO: 124641 - protein, 30 aa, Artificial Sequence
  Description of Artificial Sequence: Synthetic polypeptide
CEEEIATTNPVATEQYGCAPMHGQDSEGEH

SEQ ID NO: 124642 - protein, 34 aa, Artificial Sequence
  Description of Artificial Sequence: Synthetic polypeptide
DECEICTTNPVATEQYGTVSTVTDQPGNGEGNTD

SEQ ID NO: 124643 - protein, 37 aa, Artificial Sequence
  Description of Artificial Sequence: Synthetic polypeptide
DEEEIRTTNPVATEQYGSVNSTTPAGPNMENGMNEKQ

SEQ ID NO: 124644 - protein, 34 aa, Artificial Sequence
  Description of Artificial Sequence: Synthetic polypeptide
DENAEIATTNPVAYEQWGSVACTNLQIDDGNGEQ

SEQ ID NO: 124645 - protein, 36 aa, Artificial Sequence
  Description of Artificial Sequence: Synthetic polypeptide
DEEEIRTTNPVATEQYGSVNSTTPAGPEMGNGENGV

SEQ ID NO: 124646 - protein, 33 aa, Artificial Sequence
  Description of Artificial Sequence: Synthetic polypeptide
DESEINTTNPVATECWGSVGCINTPQDREGENG

SEQ ID NO: 124647 - protein, 36 aa, Artificial Sequence
  Description of Artificial Sequence: Synthetic polypeptide
AEEEIRTTNPVATEQYGSVVVTNNQLGNEQGVNNVE

SEQ ID NO: 124648 - protein, 36 aa, Artificial Sequence
  Description of Artificial Sequence: Synthetic polypeptide
DEEEIRTTNPVATEQYGSVNSTPPAGPNMENGMTPV

SEQ ID NO: 124649 - protein, 33 aa, Artificial Sequence
  Description of Artificial Sequence: Synthetic polypeptide
DESEIMTTNPVATMCWGSVSCINEPQHREGENG

SEQ ID NO: 124650 - protein, 31 aa, Artificial Sequence
  Description of Artificial Sequence: Synthetic polypeptide
DEEEIASTNPVATEGYGNAAANTIQSRVGQK

SEQ ID NO: 124651 - protein, 32 aa, Artificial Sequence
  Description of Artificial Sequence: Synthetic polypeptide
NQQEIATTNPVATEQYGSVSATDLEDHIGEDH

SEQ ID NO: 124652 - protein, 30 aa, Artificial Sequence
  Description of Artificial Sequence: Synthetic polypeptide
DEEEIASTNPVATEQWGDVSEIEMNAAGDQ

SEQ ID NO: 124653 - protein, 34 aa, Artificial Sequence
  Description of Artificial Sequence: Synthetic polypeptide
DESEILTTNPVATECWGSVSCINEPQDREGENGN

SEQ ID NO: 124654 - protein, 37 aa, Artificial Sequence
  Description of Artificial Sequence: Synthetic polypeptide
AEEEIRTTNPVATEQYGSVVVSVTTNQNQEQGENTED

SEQ ID NO: 124655 - protein, 33 aa, Artificial Sequence
  Description of Artificial Sequence: Synthetic polypeptide
DESEILTTNPVATECWGSVGCINEPQAREGMNG

SEQ ID NO: 124656 - protein, 35 aa, Artificial Sequence
  Description of Artificial Sequence: Synthetic polypeptide
DEEEIASTNPVATEQYGSVSSTTPTGPNMRNGMNV

SEQ ID NO: 124657 - protein, 35 aa, Artificial Sequence
  Description of Artificial Sequence: Synthetic polypeptide
DEEEIASTNPVATEQYGSVSSTTPTGPQMRNGMDV

SEQ ID NO: 124658 - protein, 33 aa, Artificial Sequence
  Description of Artificial Sequence: Synthetic polypeptide
DESEIMCTNPVATECWGSVSCINEPQDREGENG

SEQ ID NO: 124659 - protein, 34 aa, Artificial Sequence
  Description of Artificial Sequence: Synthetic polypeptide
DESEILRTTNPVATECWGSVSCINEPNDREGENG

SEQ ID NO: 124660 - protein, 32 aa, Artificial Sequence
  Description of Artificial Sequence: Synthetic polypeptide
DEMEVATTNPVATEQYGNVCAATGPVQREGQD

SEQ ID NO: 124661 - protein, 34 aa, Artificial Sequence
  Description of Artificial Sequence: Synthetic polypeptide
DEAEIATTNPVGYEQYGSTVSCTTMLSPRGTNFV

SEQ ID NO: 124662 - protein, 34 aa, Artificial Sequence
  Description of Artificial Sequence: Synthetic polypeptide
DEAEIATTNPVGYEQYGSTVPSCTTLSPRGTNWG

SEQ ID NO: 124663 - protein, 34 aa, Artificial Sequence
  Description of Artificial Sequence: Synthetic polypeptide
DEAEIATTNPVGYEQYGSTVPSCTALSPRGTNFY

SEQ ID NO: 124664 - protein, 34 aa, Artificial Sequence
  Description of Artificial Sequence: Synthetic polypeptide
DESEIKTTNPVATEQYGTVVSATDGNEEGEGNDN

SEQ ID NO: 124665 - protein, 33 aa, Artificial Sequence
  Description of Artificial Sequence: Synthetic polypeptide
DECEICTTNPVATEQYGTVSSVTDQPVEGEGND

SEQ ID NO: 124666 - protein, 35 aa, Artificial Sequence
  Description of Artificial Sequence: Synthetic polypeptide
DESEIKTTNPVATEQYGSVSINNTLNGEDGQGGEE

SEQ ID NO: 124667 - protein, 34 aa, Artificial Sequence
  Description of Artificial Sequence: Synthetic polypeptide
DESEIKTTNPVATEQYGSVSINGQSGEDGQGGEE

SEQ ID NO: 124668 - protein, 33 aa, Artificial Sequence
  Description of Artificial Sequence: Synthetic polypeptide
DESEIKTTNPVATEVYGETTSCTNAHSQRGGDH

SEQ ID NO: 124669 - protein, 35 aa, Artificial Sequence
  Description of Artificial Sequence: Synthetic polypeptide
AEEEIRTTNPVATEQYGSVVVSVTVNQNQEQETED

SEQ ID NO: 124670 - protein, 33 aa, Artificial Sequence
  Description of Artificial Sequence: Synthetic polypeptide
DESEIMTTNPAATECWGSVSCINEPQDREGENG

SEQ ID NO: 124671 - protein, 30 aa, Artificial Sequence
  Description of Artificial Sequence: Synthetic polypeptide
DEEEIASTNPISTEGYGNVAAETIQRVGQR

SEQ ID NO: 124672 - protein, 33 aa, Artificial Sequence
  Description of Artificial Sequence: Synthetic polypeptide
DEEEIACTNPVAYEQYGSVATNLTGTPDGSDMN

SEQ ID NO: 124673 - protein, 36 aa, Artificial Sequence
  Description of Artificial Sequence: Synthetic polypeptide
DEEEIRTTNPVATEQYGSVNSTNPDDETGSEQEEIP

SEQ ID NO: 124674 - protein, 32 aa, Artificial Sequence
  Description of Artificial Sequence: Synthetic polypeptide
DEMVIGTTNPVATEQWGCVCSTDLLQYFGSEQ

SEQ ID NO: 124675 - protein, 32 aa, Artificial Sequence
  Description of Artificial Sequence: Synthetic polypeptide
DEMVIGTTNPVATEQWGCVCSTDDLQYGSEQA

SEQ ID NO: 124676 - protein, 34 aa, Artificial Sequence
  Description of Artificial Sequence: Synthetic polypeptide
NNEEIRTTNPVATEQYGVVWVTQNYLQDGGPEMI

SEQ ID NO: 124677 - protein, 34 aa, Artificial Sequence
  Description of Artificial Sequence: Synthetic polypeptide
NNEEIRTTNPVATEQYGVVWVTYNLQQDGGPEHI

SEQ ID NO: 124678 - protein, 33 aa, Artificial Sequence
  Description of Artificial Sequence: Synthetic polypeptide
DESEIMTTNPVATECWGSVSCIREPQDREGENG

SEQ ID NO: 124679 - protein, 33 aa, Artificial Sequence
  Description of Artificial Sequence: Synthetic polypeptide
DESEIMTTNPVATECWGSVSCINEPQDREQENG

SEQ ID NO: 124680 - protein, 33 aa, Artificial Sequence
  Description of Artificial Sequence: Synthetic polypeptide
DEMSIVTTNPVATEQYGTVCSATDGPVEFEGNR

SEQ ID NO: 124681 - protein, 31 aa, Artificial Sequence
  Description of Artificial Sequence: Synthetic polypeptide
DEEEIAPTNPCSSEQYGIVSTTALPNRGTPV

SEQ ID NO: 124682 - protein, 31 aa, Artificial Sequence
  Description of Artificial Sequence: Synthetic polypeptide
DEEEIAPTNPCSSEQYGIVSTTNLPNSGTPV

SEQ ID NO: 124683 - protein, 34 aa, Artificial Sequence
  Description of Artificial Sequence: Synthetic polypeptide
NNEEITTTNPVATEQYGVIVSPNTQNQAQGPANR

SEQ ID NO: 124684 - protein, 33 aa, Artificial Sequence
  Description of Artificial Sequence: Synthetic polypeptide
DEMQIVTTNPVATEQYGTVCSATDGPREFEGND

SEQ ID NO: 124685 - protein, 34 aa, Artificial Sequence
  Description of Artificial Sequence: Synthetic polypeptide
DESEIMTTNPVATECWGSVSCINEPQDREGENSG

SEQ ID NO: 124686 - protein, 35 aa, Artificial Sequence
  Description of Artificial Sequence: Synthetic polypeptide
DEEEIAQTNPVATEQYGSVSATTGLVELVEGDNDD

SEQ ID NO: 124687 - protein, 35 aa, Artificial Sequence
  Description of Artificial Sequence: Synthetic polypeptide
DEEEIAQTNPVATEQYGSVSITGDQVEENNGDNDS

SEQ ID NO: 124688 - protein, 33 aa, Artificial Sequence
  Description of Artificial Sequence: Synthetic polypeptide
DESEIMTTNPVATECWGSVPCINEPQDREGENG

SEQ ID NO: 124689 - protein, 34 aa, Artificial Sequence
  Description of Artificial Sequence: Synthetic polypeptide
DESEIMTTNPVATECWGSVFSCINEPQDREGENG

SEQ ID NO: 124690 - protein, 33 aa, Artificial Sequence
  Description of Artificial Sequence: Synthetic polypeptide
DESEIMTTNPVATECWGSCSCINEPQDREGENG

SEQ ID NO: 124691 - protein, 33 aa, Artificial Sequence
  Description of Artificial Sequence: Synthetic polypeptide
DESEINSTNPVATECWGSVSCENEPQDREGENG

SEQ ID NO: 124692 - protein, 33 aa, Artificial Sequence
  Description of Artificial Sequence: Synthetic polypeptide
DESEIRFTNPVATECWGIVSCINEPQDREGENG

SEQ ID NO: 124693 - protein, 36 aa, Artificial Sequence
  Description of Artificial Sequence: Synthetic polypeptide
AEEEIRTTNPVATEQYGSVVVTNNQNGTQAGNNEQS

SEQ ID NO: 124694 - protein, 34 aa, Artificial Sequence
  Description of Artificial Sequence: Synthetic polypeptide
DECEICTTNPVATEQYGTVSTVTNGTVEGEGNDG

SEQ ID NO: 124695 - protein, 33 aa, Artificial Sequence
  Description of Artificial Sequence: Synthetic polypeptide
DEQEICTTNPVAYEQWGSVTGNDNQQGNMGNQR

SEQ ID NO: 124696 - protein, 33 aa, Artificial Sequence
  Description of Artificial Sequence: Synthetic polypeptide
DEQEICTTNPVAYEQWGSVTGNNGDQGNMGNQR

SEQ ID NO: 124697 - protein, 33 aa, Artificial Sequence
  Description of Artificial Sequence: Synthetic polypeptide
DEQEICTVNPVATEGYGSVITNGLGGGEGNQEQ

SEQ ID NO: 124698 - protein, 31 aa, Artificial Sequence
  Description of Artificial Sequence: Synthetic polypeptide
DESEIRPTNPCASEQWGIVSCNLPQSEGETG

SEQ ID NO: 124699 - protein, 35 aa, Artificial Sequence
  Description of Artificial Sequence: Synthetic polypeptide
DEEEIACTNPVATEQYGSVCSTNPQQEHQDGTADK

SEQ ID NO: 124700 - protein, 34 aa, Artificial Sequence
  Description of Artificial Sequence: Synthetic polypeptide
NETEIRTTNPVATEYWGNVATGNLEQGQDGGNER

SEQ ID NO: 124701 - protein, 33 aa, Artificial Sequence
  Description of Artificial Sequence: Synthetic polypeptide
DEAEISTTNPVATEQYGCVCSWGNLAYFGSDQA

SEQ ID NO: 124702 - protein, 33 aa, Artificial Sequence
  Description of Artificial Sequence: Synthetic polypeptide
DENAIRTTNPVATEQYGSFSTLTVIEGGQISRQ

SEQ ID NO: 124703 - protein, 32 aa, Artificial Sequence
  Description of Artificial Sequence: Synthetic polypeptide
DESEIRPTNPVASECWGIVSCINLPQREGETG

SEQ ID NO: 124704 - protein, 32 aa, Artificial Sequence
  Description of Artificial Sequence: Synthetic polypeptide
DENAIRTTNPVATEQYGSFSTLTNIEGPQISP

SEQ ID NO: 124705 - protein, 33 aa, Artificial Sequence
  Description of Artificial Sequence: Synthetic polypeptide
DEEEIACTNPVATEQYGSVCSVADNDNDGGEME

SEQ ID NO: 124706 - protein, 34 aa, Artificial Sequence
  Description of Artificial Sequence: Synthetic polypeptide
DEQEICTVNPVATEQYGSVITNGLGGQEGGQEEA

SEQ ID NO: 124707 - protein, 34 aa, Artificial Sequence
  Description of Artificial Sequence: Synthetic polypeptide
DESEIRNTNPVATECWGSVVSCINEPQDREGENG

SEQ ID NO: 124708 - protein, 34 aa, Artificial Sequence
  Description of Artificial Sequence: Synthetic polypeptide
DEEEIACTNPVATEQYGSVSANPGNGEYGAEGER

SEQ ID NO: 124709 - protein, 34 aa, Artificial Sequence
  Description of Artificial Sequence: Synthetic polypeptide
DESEIRNTNPVATECWGSVSCINSPQDREGDNGH

SEQ ID NO: 124710 - protein, 33 aa, Artificial Sequence
  Description of Artificial Sequence: Synthetic polypeptide
DESEIRMTNPVATECWGSVSCINEPQDREGEWG

SEQ ID NO: 124711 - protein, 36 aa, Artificial Sequence
  Description of Artificial Sequence: Synthetic polypeptide
DEEEIRTTNPVATEQYGSVNTFGLTGQEDEGQGQVQ

SEQ ID NO: 124712 - protein, 35 aa, Artificial Sequence
  Description of Artificial Sequence: Synthetic polypeptide
DEEEIRTTNPVATEQYGSVNTFGDTGQDEGQGQES

SEQ ID NO: 124713 - protein, 33 aa, Artificial Sequence
  Description of Artificial Sequence: Synthetic polypeptide
DENAIRTTNPVATEQYGSFSTLTLWIEGPQESP

SEQ ID NO: 124714 - protein, 33 aa, Artificial Sequence
  Description of Artificial Sequence: Synthetic polypeptide
DEQEICTTNPVAYEQWGSVTGENNGQGNMGNQR

SEQ ID NO: 124715 - protein, 36 aa, Artificial Sequence
  Description of Artificial Sequence: Synthetic polypeptide
DEEEIACTNPVATEQYGSVCSPTENHIQEAEIGNDD

SEQ ID NO: 124716 - protein, 36 aa, Artificial Sequence
  Description of Artificial Sequence: Synthetic polypeptide
DEEEIACTNPVATEQYGSVCATNPQLNPDDQTGGRY

SEQ ID NO: 124717 - protein, 34 aa, Artificial Sequence
  Description of Artificial Sequence: Synthetic polypeptide
DESEIRQTNPVATECWGSHVSCINEPQDREGENG

SEQ ID NO: 124718 - protein, 35 aa, Artificial Sequence
  Description of Artificial Sequence: Synthetic polypeptide
DEEEIRTTNPVATEQYGSVNVGLGQLEGQSEGGGT

SEQ ID NO: 124719 - protein, 36 aa, Artificial Sequence
  Description of Artificial Sequence: Synthetic polypeptide
DEEEIRTTNPVATEQYGSVNVDTNFNIGQGNNDNGD

SEQ ID NO: 124720 - protein, 35 aa, Artificial Sequence
  Description of Artificial Sequence: Synthetic polypeptide
DEEEIRTTNPVATEQYGSVNVDGNGNLTNEMNSDN

SEQ ID NO: 124721 - protein, 33 aa, Artificial Sequence
  Description of Artificial Sequence: Synthetic polypeptide
DEQEICTTNPVAYEQWGSVATSNGNQGEHGNAE

SEQ ID NO: 124722 - protein, 35 aa, Artificial Sequence
  Description of Artificial Sequence: Synthetic polypeptide
AEEEIRTTNPVATEQYGSVVVTTNNLNLAGTDEED

SEQ ID NO: 124723 - protein, 34 aa, Artificial Sequence
  Description of Artificial Sequence: Synthetic polypeptide
DESEIRPTNPVATECWGSVSCINEPQDREGENIG

SEQ ID NO: 124724 - protein, 35 aa, Artificial Sequence
  Description of Artificial Sequence: Synthetic polypeptide
NETEIRTTNPVATEMWGSVCSTNDLHQGNEGGNDS

SEQ ID NO: 124725 - protein, 36 aa, Artificial Sequence
  Description of Artificial Sequence: Synthetic polypeptide
AEEEIRTTNPVATEQYGSVVVTTNNLGGTEQGVNNQ

SEQ ID NO: 124726 - protein, 33 aa, Artificial Sequence
  Description of Artificial Sequence: Synthetic polypeptide
DEEEIACTNPVATEQYGSVCAPGNLNDDLGAQA

SEQ ID NO: 124727 - protein, 34 aa, Artificial Sequence
  Description of Artificial Sequence: Synthetic polypeptide
DEQEICTTNPVAYEQWGSVCSTIDNHGQMGGNAQ

SEQ ID NO: 124728 - protein, 34 aa, Artificial Sequence
  Description of Artificial Sequence: Synthetic polypeptide
DEEEIACTNPVATEQYGSVCATNLADAHLDGEAD

SEQ ID NO: 124729 - protein, 33 aa, Artificial Sequence
  Description of Artificial Sequence: Synthetic polypeptide
DESEIRPTNPVATECWGSVSCINEPQDREGEDG

SEQ ID NO: 124730 - protein, 32 aa, Artificial Sequence
  Description of Artificial Sequence: Synthetic polypeptide
DEQEICTTNPVAYEQWGSVSGGNPNDHQMNNM

SEQ ID NO: 124731 - protein, 33 aa, Artificial Sequence
  Description of Artificial Sequence: Synthetic polypeptide
DESEIRPTNPVATECWGSVSCINEPQDPEGDNG

SEQ ID NO: 124732 - protein, 34 aa, Artificial Sequence
  Description of Artificial Sequence: Synthetic polypeptide
DEEEIACTNPVATEQYGSVCATNLPAGTGAEDGH

SEQ ID NO: 124733 - protein, 34 aa, Artificial Sequence
  Description of Artificial Sequence: Synthetic polypeptide
DEEEIACTNPVATEQYGSVCATNPEEAGDGENAD

SEQ ID NO: 124734 - protein, 33 aa, Artificial Sequence
  Description of Artificial Sequence: Synthetic polypeptide
DESEIRPTNPVATECWGIVSCINEPQDREGENG

SEQ ID NO: 124735 - protein, 36 aa, Artificial Sequence
  Description of Artificial Sequence: Synthetic polypeptide
DEEEIACTNPVATEQYGSVCATNPQLNPDDQMGTRD

SEQ ID NO: 124736 - protein, 33 aa, Artificial Sequence
  Description of Artificial Sequence: Synthetic polypeptide
DEAEISTTNPVATEQYGCVCSWNLFNFNSNTQS

SEQ ID NO: 124737 - protein, 34 aa, Artificial Sequence
  Description of Artificial Sequence: Synthetic polypeptide
NETEIRTTNPVAYEAWGNVSTTNNLQGQEGNTDR

SEQ ID NO: 124738 - protein, 33 aa, Artificial Sequence
  Description of Artificial Sequence: Synthetic polypeptide
DESEIRMTNPVATECWGSVSCINEPQDREGEQG

SEQ ID NO: 124739 - protein, 33 aa, Artificial Sequence
  Description of Artificial Sequence: Synthetic polypeptide
DENAIRTTNPVATECYGKHGSTWNELQPPSNEF

SEQ ID NO: 124740 - protein, 33 aa, Artificial Sequence
  Description of Artificial Sequence: Synthetic polypeptide
DEQEIKTTNPVATEQYGSVSAGKDLEDHLGEDL

SEQ ID NO: 124741 - protein, 33 aa, Artificial Sequence
  Description of Artificial Sequence: Synthetic polypeptide
DESEIRGTNPVATECWGSVSCINEPMDREGENG

SEQ ID NO: 124742 - protein, 33 aa, Artificial Sequence
  Description of Artificial Sequence: Synthetic polypeptide
DEQEIKTTNPVATEQYGSVSATDGGEDNEGEDL

SEQ ID NO: 124743 - protein, 33 aa, Artificial Sequence
  Description of Artificial Sequence: Synthetic polypeptide
DESEIRGTNPVATECWGSVSCIKEPQDREGENG

SEQ ID NO: 124744 - protein, 34 aa, Artificial Sequence
  Description of Artificial Sequence: Synthetic polypeptide
DEQEIKTTNPVATEQYGSVSATDLEVHEGPELLF

SEQ ID NO: 124745 - protein, 33 aa, Artificial Sequence
  Description of Artificial Sequence: Synthetic polypeptide
DECEICTTNPVATEQYGTVSVVTDGSVEEEGND

SEQ ID NO: 124746 - protein, 36 aa, Artificial Sequence
  Description of Artificial Sequence: Synthetic polypeptide
DECEICTTNPVATEQYGTVSTVTNLQVATEEGNNDD

SEQ ID NO: 124747 - protein, 36 aa, Artificial Sequence
  Description of Artificial Sequence: Synthetic polypeptide
DEEEIRTTNPVATEQYGSVNSWPPNVQLTQMVQEAD

SEQ ID NO: 124748 - protein, 33 aa, Artificial Sequence
  Description of Artificial Sequence: Synthetic polypeptide
DESEIRGTNPVATDAYGSVSIANGQQGTGNGDG

SEQ ID NO: 124749 - protein, 35 aa, Artificial Sequence
  Description of Artificial Sequence: Synthetic polypeptide
AEEEIRTTNPVATEQYGSVVVTTNDESGTVNNATT

SEQ ID NO: 124750 - protein, 36 aa, Artificial Sequence
  Description of Artificial Sequence: Synthetic polypeptide
DEEEIRTTNPVATEQYGSVNSWNNNVQLMQMVQEAD

SEQ ID NO: 124751 - protein, 34 aa, Artificial Sequence
  Description of Artificial Sequence: Synthetic polypeptide
CESEIATTNPVATEQFGSTVASCTNGLSAYGGNT

SEQ ID NO: 124752 - protein, 35 aa, Artificial Sequence
  Description of Artificial Sequence: Synthetic polypeptide
DECEICTTNPVATEQYGTVSTVTNLNPVEGEGNTD

SEQ ID NO: 124753 - protein, 37 aa, Artificial Sequence
  Description of Artificial Sequence: Synthetic polypeptide
AEEEIRTTNPVATEQYGSVVVTNTNLQQGSEGGNNID

SEQ ID NO: 124754 - protein, 33 aa, Artificial Sequence
  Description of Artificial Sequence: Synthetic polypeptide
DESEIRGTNPNATECWGSVSCINEPQDREGENG

SEQ ID NO: 124755 - protein, 36 aa, Artificial Sequence
  Description of Artificial Sequence: Synthetic polypeptide
DECEICTTNPVATEQYGTVSTVTNLNGVEQGEGNDE

SEQ ID NO: 124756 - protein, 34 aa, Artificial Sequence
  Description of Artificial Sequence: Synthetic polypeptide
NNEEIRTTNPVATEQYGVCVWTQNLDQDGGEETH

SEQ ID NO: 124757 - protein, 34 aa, Artificial Sequence
  Description of Artificial Sequence: Synthetic polypeptide
DESEIRFTNPVATECWGSVSCINEPQDREGENGE

SEQ ID NO: 124758 - protein, 37 aa, Artificial Sequence
  Description of Artificial Sequence: Synthetic polypeptide
DEEEIRTTNPVATEQYGSVNSTVPAGPNMENGMNDDN

SEQ ID NO: 124759 - protein, 34 aa, Artificial Sequence
  Description of Artificial Sequence: Synthetic polypeptide
DESEIRGTNPVATECWGSVSCINKEPQDREGENG

SEQ ID NO: 124760 - protein, 35 aa, Artificial Sequence
  Description of Artificial Sequence: Synthetic polypeptide
DEEEIRTTNPVATEQYGSVNVGQVNGLGEMNNSDN

SEQ ID NO: 124761 - protein, 35 aa, Artificial Sequence
  Description of Artificial Sequence: Synthetic polypeptide
DEEEIRTTNPVATEQYGSVNSWYPPMDLQSLEDFY

SEQ ID NO: 124762 - protein, 36 aa, Artificial Sequence
  Description of Artificial Sequence: Synthetic polypeptide
DEEEIRTTNPVATEQYGSVNSYTNPDDENSGQEEIS

SEQ ID NO: 124763 - protein, 34 aa, Artificial Sequence
  Description of Artificial Sequence: Synthetic polypeptide
NETEIRTTNPVAYEQWGSVCSTDNNDHHRGDDDR

SEQ ID NO: 124764 - protein, 34 aa, Artificial Sequence
  Description of Artificial Sequence: Synthetic polypeptide
DEEEIACTNPVATEQYGSVSTGNPPNSEHNTDDV

SEQ ID NO: 124765 - protein, 33 aa, Artificial Sequence
  Description of Artificial Sequence: Synthetic polypeptide
DESEIRMTNPVATECWGSKSCINEPQDREGENG

SEQ ID NO: 124766 - protein, 33 aa, Artificial Sequence
  Description of Artificial Sequence: Synthetic polypeptide
DESEIRMTNPSATECWGSVSCINEPQDREGENG

SEQ ID NO: 124767 - protein, 33 aa, Artificial Sequence
  Description of Artificial Sequence: Synthetic polypeptide
DESEIRHTNPVATECWGSVSCINEPQDRERENG

SEQ ID NO: 124768 - protein, 33 aa, Artificial Sequence
  Description of Artificial Sequence: Synthetic polypeptide
DESEIRHTNPVATECWGSVSCINEPQDREIENG

SEQ ID NO: 124769 - protein, 31 aa, Artificial Sequence
  Description of Artificial Sequence: Synthetic polypeptide
NEVEIRTTNPVAYEAWGQVVWNNLSQNGGSR

SEQ ID NO: 124770 - protein, 35 aa, Artificial Sequence
  Description of Artificial Sequence: Synthetic polypeptide
DEEEIACTNPVATEQYGTTPSCTNEELSQYGGNDD

SEQ ID NO: 124771 - protein, 32 aa, Artificial Sequence
  Description of Artificial Sequence: Synthetic polypeptide
DEQEIGTTNPVATEQYGSFSATDMEDHEGEDL

SEQ ID NO: 124772 - protein, 35 aa, Artificial Sequence
  Description of Artificial Sequence: Synthetic polypeptide
DESEIRGTNPVATEQYGVVSTSVGDLGQRGFGEEG

SEQ ID NO: 124773 - protein, 33 aa, Artificial Sequence
  Description of Artificial Sequence: Synthetic polypeptide
DEQEIGTTNPVATEQYGTVCSATDGPVEFEGND

SEQ ID NO: 124774 - protein, 35 aa, Artificial Sequence
  Description of Artificial Sequence: Synthetic polypeptide
DEEEIRTTNPVATEQYGSVNTDTFTGIQNVGIEGG

SEQ ID NO: 124775 - protein, 32 aa, Artificial Sequence
  Description of Artificial Sequence: Synthetic polypeptide
NEYEIRTTNPVATGHYGSVSDVLNLTEGTEDM

SEQ ID NO: 124776 - protein, 34 aa, Artificial Sequence
  Description of Artificial Sequence: Synthetic polypeptide
DEQEIHTTNPVATEQYGSVSATDDGEDQEGEDGE

SEQ ID NO: 124777 - protein, 32 aa, Artificial Sequence
  Description of Artificial Sequence: Synthetic polypeptide
DESEIRGTNPVATEQYGSVMQGLMEGMGQDET

SEQ ID NO: 124778 - protein, 35 aa, Artificial Sequence
  Description of Artificial Sequence: Synthetic polypeptide
DESEIRGTNPVATEQYGSVITSVGDLGQRGLGIEG

SEQ ID NO: 124779 - protein, 36 aa, Artificial Sequence
  Description of Artificial Sequence: Synthetic polypeptide
DEEEIRTTNPVATEQYGSVNTDTFGMGQETGQGNIQ

SEQ ID NO: 124780 - protein, 34 aa, Artificial Sequence
  Description of Artificial Sequence: Synthetic polypeptide
DESEIRGTNPVATEIYGSVVSTGDLGQIGEGEEG

SEQ ID NO: 124781 - protein, 33 aa, Artificial Sequence
  Description of Artificial Sequence: Synthetic polypeptide
DESEIRGTNPVATECWGSVYCINEPQDREGENG

SEQ ID NO: 124782 - protein, 34 aa, Artificial Sequence
  Description of Artificial Sequence: Synthetic polypeptide
DESEIRGTNPVATECWGSVSVCINEPQDREGENG

SEQ ID NO: 124783 - protein, 28 aa, Artificial Sequence
  Description of Artificial Sequence: Synthetic peptide
QECEIASTNPVGTEPYGVMASTLQHGDI

SEQ ID NO: 124784 - protein, 30 aa, Artificial Sequence
  Description of Artificial Sequence: Synthetic polypeptide
DESEIATTNPVSTEQYGNVANTEMNRAEDA

SEQ ID NO: 124785 - protein, 33 aa, Artificial Sequence
  Description of Artificial Sequence: Synthetic polypeptide
DECEICTTNPVATEQYGSVSTVAQEQTEEDEDD

SEQ ID NO: 124786 - protein, 33 aa, Artificial Sequence
  Description of Artificial Sequence: Synthetic polypeptide
DEMEIVTTNPVATEQYGTVCSATDGPVEFEGNE

SEQ ID NO: 124787 - protein, 33 aa, Artificial Sequence
  Description of Artificial Sequence: Synthetic polypeptide
CEEEIATTNPMATEQYGSVPTVQDHRQVVNGRD

SEQ ID NO: 124788 - protein, 32 aa, Artificial Sequence
  Description of Artificial Sequence: Synthetic polypeptide
CEEEIACTNPVATEQWGCVATNLQPAENAGMN

SEQ ID NO: 124789 - protein, 34 aa, Artificial Sequence
  Description of Artificial Sequence: Synthetic polypeptide
DEMEIVTTNPVATEQYGTVCSATDGPVEFEGNDR

SEQ ID NO: 124790 - protein, 28 aa, Artificial Sequence
  Description of Artificial Sequence: Synthetic peptide
QEEEIACTNPVATEQYGEAPEVCMHGEK

SEQ ID NO: 124791 - protein, 28 aa, Artificial Sequence
  Description of Artificial Sequence: Synthetic peptide
QEEEIACTNPVATEQYGEAPEVCQHEEK

SEQ ID NO: 124792 - protein, 35 aa, Artificial Sequence
  Description of Artificial Sequence: Synthetic polypeptide
DECEICTTNPMATEQWGSVAPTDNQKQERNGDNGR

SEQ ID NO: 124793 - protein, 34 aa, Artificial Sequence
  Description of Artificial Sequence: Synthetic polypeptide
DECEICTTNPMATEQWGSVAPTDNQEQHQGNGRD

SEQ ID NO: 124794 - protein, 34 aa, Artificial Sequence
  Description of Artificial Sequence: Synthetic polypeptide
DECEICTTNPTATEQWGSVAPTDNQEHRAGTNGR

SEQ ID NO: 124795 - protein, 35 aa, Artificial Sequence
  Description of Artificial Sequence: Synthetic polypeptide
DESEIATTNPVATEQYGSVSSTSPTGPNMRNGMNV

SEQ ID NO: 124796 - protein, 34 aa, Artificial Sequence
  Description of Artificial Sequence: Synthetic polypeptide
DESEIATTNPVATEQYGSVSCTDALSENHEGEDL

SEQ ID NO: 124797 - protein, 33 aa, Artificial Sequence
  Description of Artificial Sequence: Synthetic polypeptide
DEMEIVTTNPVATEQYGTVCSATDGPVEFEGNC

SEQ ID NO: 124798 - protein, 34 aa, Artificial Sequence
  Description of Artificial Sequence: Synthetic polypeptide
DESEIATTNPVATEQYGSVSCINEPEDREGEEDL

SEQ ID NO: 124799 - protein, 34 aa, Artificial Sequence
  Description of Artificial Sequence: Synthetic polypeptide
DECEICTTNPMATEQWGSVAPTDNDQHHQGTNGR

SEQ ID NO: 124800 - protein, 33 aa, Artificial Sequence
  Description of Artificial Sequence: Synthetic polypeptide
DEMEIVTTNPVATEQYGTVCSATDGPVEFEGNA

SEQ ID NO: 124801 - protein, 35 aa, Artificial Sequence
  Description of Artificial Sequence: Synthetic polypeptide
DEEEIRTTNPVATEQYGSVNGEEEDDQTGSEQINV

SEQ ID NO: 124802 - protein, 37 aa, Artificial Sequence
  Description of Artificial Sequence: Synthetic polypeptide
DEEEIRTTNPVATEQYGSVNGDTGENVLTGGEGENEG

SEQ ID NO: 124803 - protein, 34 aa, Artificial Sequence
  Description of Artificial Sequence: Synthetic polypeptide
DESEIATTNPVATEQYGSVSATHELEDHEGGEDL

SEQ ID NO: 124804 - protein, 35 aa, Artificial Sequence
  Description of Artificial Sequence: Synthetic polypeptide
DECEICTTNPMATEQWGSVAPTDNLQEQERGQDGR

SEQ ID NO: 124805 - protein, 35 aa, Artificial Sequence
  Description of Artificial Sequence: Synthetic polypeptide
DESEIATTNPVATEQYGTTVSCTLLSEQHEGGENF

SEQ ID NO: 124806 - protein, 33 aa, Artificial Sequence
  Description of Artificial Sequence: Synthetic polypeptide
DESEIATTNPVATEQYGTVCSATDGPEEAEGND

SEQ ID NO: 124807 - protein, 33 aa, Artificial Sequence
  Description of Artificial Sequence: Synthetic polypeptide
DEMEIVTTNPVATEQYGTVCSATDGPVEFEGNF

SEQ ID NO: 124808 - protein, 33 aa, Artificial Sequence
  Description of Artificial Sequence: Synthetic polypeptide
DEEEIATTNPVATECYGSVSSEPCGPQHNGEPV

SEQ ID NO: 124809 - protein, 34 aa, Artificial Sequence
  Description of Artificial Sequence: Synthetic polypeptide
DEEEIATTNPVATECYGSVSSEPCGPQHNGMNPV

SEQ ID NO: 124810 - protein, 33 aa, Artificial Sequence
  Description of Artificial Sequence: Synthetic polypeptide
DECEICTTNPVATEQYGSVSTTALEDTEEEEDE

SEQ ID NO: 124811 - protein, 33 aa, Artificial Sequence
  Description of Artificial Sequence: Synthetic polypeptide
DEMEIVTTNPVATEQYGTVCSATDGPVEFEGNQ

SEQ ID NO: 124812 - protein, 33 aa, Artificial Sequence
  Description of Artificial Sequence: Synthetic polypeptide
DEMEIVTTNPVATEQYGTVCSATDGPVEFEGNP

SEQ ID NO: 124813 - protein, 36 aa, Artificial Sequence
  Description of Artificial Sequence: Synthetic polypeptide
DEEEIRTTNPVATEQYGSVNGQMNSLELGGNEGFED

SEQ ID NO: 124814 - protein, 33 aa, Artificial Sequence
  Description of Artificial Sequence: Synthetic polypeptide
DEMEIVTTNPVATEQYGTVCSATDGPVEFEGNN

SEQ ID NO: 124815 - protein, 36 aa, Artificial Sequence
  Description of Artificial Sequence: Synthetic polypeptide
DEEEIRTTNPVATEQYGSVNGQMNLDTEGGNEGFED

SEQ ID NO: 124816 - protein, 33 aa, Artificial Sequence
  Description of Artificial Sequence: Synthetic polypeptide
DEMEIVTTNPVATEQYGTVCSATDGPVEFEGNM

SEQ ID NO: 124817 - protein, 33 aa, Artificial Sequence
  Description of Artificial Sequence: Synthetic polypeptide
DECEICTTNPVATEQYGSVSTTAGQEDTEEEDD

SEQ ID NO: 124818 - protein, 36 aa, Artificial Sequence
  Description of Artificial Sequence: Synthetic polypeptide
DEQEIRTTNPVATEQYGSVNISVTSLNEQEDVTEGN

SEQ ID NO: 124819 - protein, 33 aa, Artificial Sequence
  Description of Artificial Sequence: Synthetic polypeptide
DEMEIVTTNPVATEQYGTVCSATDGPVEFEGNL

SEQ ID NO: 124820 - protein, 33 aa, Artificial Sequence
  Description of Artificial Sequence: Synthetic polypeptide
DEMEIVTTNPVATEQYGTVCSATDGPVEFEGNK

SEQ ID NO: 124821 - protein, 35 aa, Artificial Sequence
  Description of Artificial Sequence: Synthetic polypeptide
DEEEIRTTNPVATEQYGSVNGPTLDDQTGSGEGDD

SEQ ID NO: 124822 - protein, 33 aa, Artificial Sequence
  Description of Artificial Sequence: Synthetic polypeptide
DEMEIVTTNPVATEQYGTVCSATDGPVEFEGNI

SEQ ID NO: 124823 - protein, 33 aa, Artificial Sequence
  Description of Artificial Sequence: Synthetic polypeptide
DEMEIVTTNPVATEQYGTVCSATDGPVEFEGNH

SEQ ID NO: 124824 - protein, 35 aa, Artificial Sequence
  Description of Artificial Sequence: Synthetic polypeptide
DEEEIRTTNPVATEQYGSVNGNFEDDEGGNQEETV

SEQ ID NO: 124825 - protein, 33 aa, Artificial Sequence
  Description of Artificial Sequence: Synthetic polypeptide
DEMEIVTTNPVATEQYGTVCSATDGPVEFEGNG

SEQ ID NO: 124826 - protein, 30 aa, Artificial Sequence
  Description of Artificial Sequence: Synthetic polypeptide
CEEEIACTNPVATEQWGCVAGTGELQNMPF

SEQ ID NO: 124827 - protein, 35 aa, Artificial Sequence
  Description of Artificial Sequence: Synthetic polypeptide
DEEEIRTTNPVATEQYGSVNGDGDGQNEEEGNDGG

SEQ ID NO: 124828 - protein, 33 aa, Artificial Sequence
  Description of Artificial Sequence: Synthetic polypeptide
DECEICTTNPVATEQYGSVSTTALEGTEESEDD

SEQ ID NO: 124829 - protein, 34 aa, Artificial Sequence
  Description of Artificial Sequence: Synthetic polypeptide
DESEIATTNPVATEQYGSVSATGDLEDHEGGEYL

SEQ ID NO: 124830 - protein, 35 aa, Artificial Sequence
  Description of Artificial Sequence: Synthetic polypeptide
DEEEIRTTNPVATEQYGSVNFTEDEQGGGGGEEEE

SEQ ID NO: 124831 - protein, 33 aa, Artificial Sequence
  Description of Artificial Sequence: Synthetic polypeptide
DEMEIVTTNPVATEQYGTVCSATDGPVEFAGND

SEQ ID NO: 124832 - protein, 36 aa, Artificial Sequence
  Description of Artificial Sequence: Synthetic polypeptide
AEEEIRTTNPVATEQYGSVVTVVTNQNTNQQGNEGD

SEQ ID NO: 124833 - protein, 37 aa, Artificial Sequence
  Description of Artificial Sequence: Synthetic polypeptide
AEEEIRTTNPVATEQYGSVVTVVTNNLQGNEEGNNND

SEQ ID NO: 124834 - protein, 33 aa, Artificial Sequence
  Description of Artificial Sequence: Synthetic polypeptide
DEMEIVTTNPVATEQYGTVCSATDGPVEEEGND

SEQ ID NO: 124835 - protein, 33 aa, Artificial Sequence
  Description of Artificial Sequence: Synthetic polypeptide
DEMEIVTTNPVATEQYGTVCSATDGPVEDIGND

SEQ ID NO: 124836 - protein, 36 aa, Artificial Sequence
  Description of Artificial Sequence: Synthetic polypeptide
AEEEIRTTNPVATEQYGSVVTVVTNLQQNDENGTTS

SEQ ID NO: 124837 - protein, 37 aa, Artificial Sequence
  Description of Artificial Sequence: Synthetic polypeptide
AEEEIRTTNPVATEQYGSVVTVVTNLQQNDENGNNST

SEQ ID NO: 124838 - protein, 37 aa, Artificial Sequence
  Description of Artificial Sequence: Synthetic polypeptide
AEEEIRTTNPVATEQYGSVVTVVTNLQQGNNQQGNTD

SEQ ID NO: 124839 - protein, 33 aa, Artificial Sequence
  Description of Artificial Sequence: Synthetic polypeptide
DEMEIVTTNPVATEQYGTVCSATDGPVEFCGND

SEQ ID NO: 124840 - protein, 33 aa, Artificial Sequence
  Description of Artificial Sequence: Synthetic polypeptide
DEMEIVTTNPVATEQYGTVCSATDGPVEDEGND

SEQ ID NO: 124841 - protein, 33 aa, Artificial Sequence
  Description of Artificial Sequence: Synthetic polypeptide
DEMEIVTTNPVATEQYGTVCSATDGPVECEGND

SEQ ID NO: 124842 - protein, 34 aa, Artificial Sequence
  Description of Artificial Sequence: Synthetic polypeptide
DEEEIATTNPVATEGYGNVSATTAIPQSRNGMQV

SEQ ID NO: 124843 - protein, 33 aa, Artificial Sequence
  Description of Artificial Sequence: Synthetic polypeptide
DEMEIVTTNPVATEQYGTVCSATDGPVEAEGND

SEQ ID NO: 124844 - protein, 33 aa, Artificial Sequence
  Description of Artificial Sequence: Synthetic polypeptide
DEMEIVTTNPVATEQYGTVCSATDGPVDSEGND

SEQ ID NO: 124845 - protein, 28 aa, Artificial Sequence
  Description of Artificial Sequence: Synthetic peptide
QEEEIAGTNPVATEQYGEAPEVCQCEEK

SEQ ID NO: 124846 - protein, 28 aa, Artificial Sequence
  Description of Artificial Sequence: Synthetic peptide
QEEEIAGTNPVATEQYGEAPEVCQHEEK

SEQ ID NO: 124847 - protein, 33 aa, Artificial Sequence
  Description of Artificial Sequence: Synthetic polypeptide
DEMEIVTTNPVATEQYGTVCSATDGPVDFEGND

SEQ ID NO: 124848 - protein, 33 aa, Artificial Sequence
  Description of Artificial Sequence: Synthetic polypeptide
DEMEIVTTNPVATEQYGTVCSATDGPVCFEGNG

SEQ ID NO: 124849 - protein, 28 aa, Artificial Sequence
  Description of Artificial Sequence: Synthetic peptide
QEEEIACTNPVATEQYGVAPEVCQHETK

SEQ ID NO: 124850 - protein, 33 aa, Artificial Sequence
  Description of Artificial Sequence: Synthetic polypeptide
DEMEIVTTNPVATEQYGTVCSATDGPVEFDGND

SEQ ID NO: 124851 - protein, 33 aa, Artificial Sequence
  Description of Artificial Sequence: Synthetic polypeptide
DEMEIVTTNPVATEQYGTVCSATDGPVEFDGNV

SEQ ID NO: 124852 - protein, 36 aa, Artificial Sequence
  Description of Artificial Sequence: Synthetic polypeptide
AEEEIRTTNPVATEQYGSVVTVVTTNQNNQQGENEG

SEQ ID NO: 124853 - protein, 33 aa, Artificial Sequence
  Description of Artificial Sequence: Synthetic polypeptide
DECEIATVNPVATEQYGSVSWTEDPDEGGGGHR

SEQ ID NO: 124854 - protein, 32 aa, Artificial Sequence
  Description of Artificial Sequence: Synthetic polypeptide
DECEIATTNPVAYERWGTTVTNLQGDVGGNNR

SEQ ID NO: 124855 - protein, 35 aa, Artificial Sequence
  Description of Artificial Sequence: Synthetic polypeptide
DEEEIATTNPVATECYGSVSSTTPCGPQHNGMNPV

SEQ ID NO: 124856 - protein, 34 aa, Artificial Sequence
  Description of Artificial Sequence: Synthetic polypeptide
DESEIATTNPVATEQYGSVPCWDNHGQQRQGGKE

SEQ ID NO: 124857 - protein, 35 aa, Artificial Sequence
  Description of Artificial Sequence: Synthetic polypeptide
DEEEIRTTNPVATEQYGSVNDNNMNVDITGGNGEE

SEQ ID NO: 124858 - protein, 33 aa, Artificial Sequence
  Description of Artificial Sequence: Synthetic polypeptide
DESEIATTNPVATEQYGSVCTIEMDGGHGGGDR

SEQ ID NO: 124859 - protein, 36 aa, Artificial Sequence
  Description of Artificial Sequence: Synthetic polypeptide
DESEIATTNPVATEQYGSVCSTNDNQQEHQDGTARK

SEQ ID NO: 124860 - protein, 34 aa, Artificial Sequence
  Description of Artificial Sequence: Synthetic polypeptide
DEEEIRTTNPVATEQYGSVNDDNMTMEFDTENDP

SEQ ID NO: 124861 - protein, 34 aa, Artificial Sequence
  Description of Artificial Sequence: Synthetic polypeptide
DEEEIRTTNPVATEQYGSVNDDNMTMEFDNENVE

SEQ ID NO: 124862 - protein, 35 aa, Artificial Sequence
  Description of Artificial Sequence: Synthetic polypeptide
AEEEIRTTNPVATEQYGSVVVNTNDESGSVNNNTE

SEQ ID NO: 124863 - protein, 35 aa, Artificial Sequence
  Description of Artificial Sequence: Synthetic polypeptide
DESEIATTNPVATEQYGSVCATNPMQQGNQTAGTM

SEQ ID NO: 124864 - protein, 35 aa, Artificial Sequence
  Description of Artificial Sequence: Synthetic polypeptide
AEEEIRTTNPVATEQYGSVVVNTNDEAGTVNNNTQ

SEQ ID NO: 124865 - protein, 34 aa, Artificial Sequence
  Description of Artificial Sequence: Synthetic polypeptide
DESEIATTNPVATEQYGSVCATNLTAPDQMNEAM

SEQ ID NO: 124866 - protein, 34 aa, Artificial Sequence
  Description of Artificial Sequence: Synthetic polypeptide
DEEEIRTTNPVATEQYGSVNDDNMTMEFDGEGGF

SEQ ID NO: 124867 - protein, 34 aa, Artificial Sequence
  Description of Artificial Sequence: Synthetic polypeptide
DESEIATTNPVATEQYGSVCATNGLTQPDQAEGA

SEQ ID NO: 124868 - protein, 32 aa, Artificial Sequence
  Description of Artificial Sequence: Synthetic polypeptide
DECEIATTNPVAYERWGSVMTNLMMEDGNDTQ

SEQ ID NO: 124869 - protein, 36 aa, Artificial Sequence
  Description of Artificial Sequence: Synthetic polypeptide
DEEEIRTTNPVATEQYGSVNCWTEHVMVQRQNEPDE

SEQ ID NO: 124870 - protein, 35 aa, Artificial Sequence
  Description of Artificial Sequence: Synthetic polypeptide
AEEEIRTTNPVATEQYGSVVVATNLGEQGTTEAGT

SEQ ID NO: 124871 - protein, 35 aa, Artificial Sequence
  Description of Artificial Sequence: Synthetic polypeptide
DEEEIRTTNPVATEQYGSVNCPSTVEQETLVTVDW

SEQ ID NO: 124872 - protein, 35 aa, Artificial Sequence
  Description of Artificial Sequence: Synthetic polypeptide
DECEICTTNPCATEQWGSVAPTDNQQERMGQNGRP

SEQ ID NO: 124873 - protein, 34 aa, Artificial Sequence
  Description of Artificial Sequence: Synthetic polypeptide
DEMEIVTTNPVATEQYGTVCSATDGPVEFEGNRD

SEQ ID NO: 124874 - protein, 33 aa, Artificial Sequence
  Description of Artificial Sequence: Synthetic polypeptide
DEMEIVTTNPVATEQYGTVCSATDGPVEFEGNS

SEQ ID NO: 124875 - protein, 33 aa, Artificial Sequence
  Description of Artificial Sequence: Synthetic polypeptide
DEMEIVTTNPVATEQYGTVCSATDGPVEFEGNT

SEQ ID NO: 124876 - protein, 33 aa, Artificial Sequence
  Description of Artificial Sequence: Synthetic polypeptide
DEMEIVTTNPVATEQYGTVCSATDGPVEFMGND

SEQ ID NO: 124877 - protein, 33 aa, Artificial Sequence
  Description of Artificial Sequence: Synthetic polypeptide
DEMEIVTTNPVATEQYGTVCSATDGPVEFLGND

SEQ ID NO: 124878 - protein, 33 aa, Artificial Sequence
  Description of Artificial Sequence: Synthetic polypeptide
DEMEIVTTNPVATEQYGTVCSATDGPVEFKGND

SEQ ID NO: 124879 - protein, 34 aa, Artificial Sequence
  Description of Artificial Sequence: Synthetic polypeptide
DECEICTTNPVATEQYGSVSTTNALNDTEEEDEA

SEQ ID NO: 124880 - protein, 34 aa, Artificial Sequence
  Description of Artificial Sequence: Synthetic polypeptide
DECEICTTNPVATEQYGSVSTTNALMEETEEEDE

SEQ ID NO: 124881 - protein, 34 aa, Artificial Sequence
  Description of Artificial Sequence: Synthetic polypeptide
QEEEIACTNPVATEQYGCVAAATNLTGAEIGNRE

SEQ ID NO: 124882 - protein, 33 aa, Artificial Sequence
  Description of Artificial Sequence: Synthetic polypeptide
DEMEIVTTNPVATEQYGTVCSATDGPVEFIGND

SEQ ID NO: 124883 - protein, 35 aa, Artificial Sequence
  Description of Artificial Sequence: Synthetic polypeptide
DECEICTTNPVATEQYGSVSTTLQQLNDEEEEEDD

SEQ ID NO: 124884 - protein, 35 aa, Artificial Sequence
  Description of Artificial Sequence: Synthetic polypeptide
DEQEIRTTNPVATEQYGSVCPYTVSVLQTADGSQQ

SEQ ID NO: 124885 - protein, 36 aa, Artificial Sequence
  Description of Artificial Sequence: Synthetic polypeptide
DEEEIRTTNPVATEQYGSVNMSDNDGDQTGQGEGEI

SEQ ID NO: 124886 - protein, 32 aa, Artificial Sequence
  Description of Artificial Sequence: Synthetic polypeptide
QEEEIACTNPVATEQYGCVAGTGLQDEGDIEQ

SEQ ID NO: 124887 - protein, 33 aa, Artificial Sequence
  Description of Artificial Sequence: Synthetic polypeptide
DEMEIVTTNPVATEQYGTVCSATDGPVEFGGND

SEQ ID NO: 124888 - protein, 32 aa, Artificial Sequence
  Description of Artificial Sequence: Synthetic polypeptide
QEEEIACTNPVATEQYGCVAGTNLQAEEDTTW

SEQ ID NO: 124889 - protein, 36 aa, Artificial Sequence
  Description of Artificial Sequence: Synthetic polypeptide
DEQEIRTTNPVATEQYGSVCSTMVPSNEQQMENLND

SEQ ID NO: 124890 - protein, 33 aa, Artificial Sequence
  Description of Artificial Sequence: Synthetic polypeptide
DEMEIVTTNPVATEQYGTVCSATDGPVEFFGND

SEQ ID NO: 124891 - protein, 37 aa, Artificial Sequence
  Description of Artificial Sequence: Synthetic polypeptide
DEEEIRTTNPVATEQYGSVNMNLIGDDQDQEDGDGNV

SEQ ID NO: 124892 - protein, 36 aa, Artificial Sequence
  Description of Artificial Sequence: Synthetic polypeptide
DEEEIRTTNPVATEQYGSVNMLTNGIQEDEGEGEGQ

SEQ ID NO: 124893 - protein, 33 aa, Artificial Sequence
  Description of Artificial Sequence: Synthetic polypeptide
DECEICTTNPVATEQYGSVSTTEQLEDTTEEDD

SEQ ID NO: 124894 - protein, 33 aa, Artificial Sequence
  Description of Artificial Sequence: Synthetic polypeptide
DEMEIVTTNPVATEQYGTVCSATDGPVEFHGND

SEQ ID NO: 124895 - protein, 33 aa, Artificial Sequence
  Description of Artificial Sequence: Synthetic polypeptide
DEMEIVTTNPVATEQYGTVCSATDGPVEFNGND

SEQ ID NO: 124896 - protein, 33 aa, Artificial Sequence
  Description of Artificial Sequence: Synthetic polypeptide
DEMEIVTTNPVATEQYGTVCSATDGPVEFNGNH

SEQ ID NO: 124897 - protein, 33 aa, Artificial Sequence
  Description of Artificial Sequence: Synthetic polypeptide
DEMEIVTTNPVATEQYGTVCSATDGPVEFPGND

SEQ ID NO: 124898 - protein, 33 aa, Artificial Sequence
  Description of Artificial Sequence: Synthetic polypeptide
DEMEIVTTNPVATEQYGTVCSATDGPVEHEGNL

SEQ ID NO: 124899 - protein, 33 aa, Artificial Sequence
  Description of Artificial Sequence: Synthetic polypeptide
DEMEIVTTNPVATEQYGTVCSATDGPVEHEGND

SEQ ID NO: 124900 - protein, 35 aa, Artificial Sequence
  Description of Artificial Sequence: Synthetic polypeptide
DEEEIRTTNPVATEQYGSVNNAENKDHLGNMEDEG

SEQ ID NO: 124901 - protein, 36 aa, Artificial Sequence
  Description of Artificial Sequence: Synthetic polypeptide
DECEICTTNPVATEQYGSVSTTNLLNQQNENNEEEN

SEQ ID NO: 124902 - protein, 33 aa, Artificial Sequence
  Description of Artificial Sequence: Synthetic polypeptide
DEMEIVTTNPVATEQYGTVCSATDGPVEGSGND

SEQ ID NO: 124903 - protein, 33 aa, Artificial Sequence
  Description of Artificial Sequence: Synthetic polypeptide
DEMEIVTTNPVATEQYGTVCSATDGPVEGEGND

SEQ ID NO: 124904 - protein, 33 aa, Artificial Sequence
  Description of Artificial Sequence: Synthetic polypeptide
DEMEIVTTNPVATEQYGTVCSATDGPVEGECND

SEQ ID NO: 124905 - protein, 35 aa, Artificial Sequence
  Description of Artificial Sequence: Synthetic polypeptide
DEEEIRTTNPVATEQYGSVNMTTNDDENSGQEEII

SEQ ID NO: 124906 - protein, 33 aa, Artificial Sequence
  Description of Artificial Sequence: Synthetic polypeptide
DEMEIVTTNPVATEQYGTVCSATDGPVEFYGND

SEQ ID NO: 124907 - protein, 36 aa, Artificial Sequence
  Description of Artificial Sequence: Synthetic polypeptide
DECEICTTNPVATEQYGSVSTTNLLEQGNNNEEEEE

SEQ ID NO: 124908 - protein, 33 aa, Artificial Sequence
  Description of Artificial Sequence: Synthetic polypeptide
DEMEIVTTNPVATEQYGTVCSATDGPVEFWGND

SEQ ID NO: 124909 - protein, 35 aa, Artificial Sequence
  Description of Artificial Sequence: Synthetic polypeptide
DECEICTTNPVATEQYGSVSTTNALNNDTEGTEDE

SEQ ID NO: 124910 - protein, 33 aa, Artificial Sequence
  Description of Artificial Sequence: Synthetic polypeptide
DEMEIVTTNPVATEQYGTVCSATDGPVEFVGND

SEQ ID NO: 124911 - protein, 36 aa, Artificial Sequence
  Description of Artificial Sequence: Synthetic polypeptide
DEEEIRTTNPVATEQYGSVNMTSGMNDQLIFGEGIG

SEQ ID NO: 124912 - protein, 33 aa, Artificial Sequence
  Description of Artificial Sequence: Synthetic polypeptide
DEMEIVTTNPVATEQYGTVCSATDGPVEFTGND

SEQ ID NO: 124913 - protein, 33 aa, Artificial Sequence
  Description of Artificial Sequence: Synthetic polypeptide
DEMEIVTTNPVATEQYGTVCSATDGPVEFSGND

SEQ ID NO: 124914 - protein, 35 aa, Artificial Sequence
  Description of Artificial Sequence: Synthetic polypeptide
DEQEIRTTNPVATEQYGSVCATVSVLTQTSDGSQQ

SEQ ID NO: 124915 - protein, 32 aa, Artificial Sequence
  Description of Artificial Sequence: Synthetic polypeptide
DESEIATTNPVAYEQYGSVAATNDEQDATLTD

SEQ ID NO: 124916 - protein, 33 aa, Artificial Sequence
  Description of Artificial Sequence: Synthetic polypeptide
DEMEIVTTNPVATEQYGTVCSATDGPVEFQGND

SEQ ID NO: 124917 - protein, 37 aa, Artificial Sequence
  Description of Artificial Sequence: Synthetic polypeptide
DEEEIRTTNPVATEQYGSVNMGTNNDQGGGEDTNEGG

SEQ ID NO: 124918 - protein, 36 aa, Artificial Sequence
  Description of Artificial Sequence: Synthetic polypeptide
DEEEIRTTNPVATEQYGSVNMGTMNGQVDEGGGGET

SEQ ID NO: 124919 - protein, 36 aa, Artificial Sequence
  Description of Artificial Sequence: Synthetic polypeptide
DEEEIRTTNPVATEQYGSVNMGLTGPGQGEQGTNIQ

SEQ ID NO: 124920 - protein, 36 aa, Artificial Sequence
  Description of Artificial Sequence: Synthetic polypeptide
DEEEIRTTNPVATEQYGSVNMGLTGPGQGEQGNQIF

SEQ ID NO: 124921 - protein, 34 aa, Artificial Sequence
  Description of Artificial Sequence: Synthetic polypeptide
DEQEIRTTNPVATEQYGSVHTLNDYEQFEDQDEM

SEQ ID NO: 124922 - protein, 33 aa, Artificial Sequence
  Description of Artificial Sequence: Synthetic polypeptide
DESEIATTNPVAYEQWGSVCPTDHLQVQDDGNS

SEQ ID NO: 124923 - protein, 33 aa, Artificial Sequence
  Description of Artificial Sequence: Synthetic polypeptide
DESEIATTNPVAYEQWGSVAFTDDLDGQGGDDR

SEQ ID NO: 124924 - protein, 33 aa, Artificial Sequence
  Description of Artificial Sequence: Synthetic polypeptide
DESEIATTNPVAYEQWGSTSTNPNQGDAGGNPE

SEQ ID NO: 124925 - protein, 32 aa, Artificial Sequence
  Description of Artificial Sequence: Synthetic polypeptide
DESEIATTNPVAYEQWGMTSTNLQNGDGDDSS

SEQ ID NO: 124926 - protein, 35 aa, Artificial Sequence
  Description of Artificial Sequence: Synthetic polypeptide
DEQEIRTTNPVATEQYGSVMPTTNIHVIEGSNEDV

SEQ ID NO: 124927 - protein, 30 aa, Artificial Sequence
  Description of Artificial Sequence: Synthetic polypeptide
DEEEIATTNPVATECYGAAPEVCQHKGEYK

SEQ ID NO: 124928 - protein, 31 aa, Artificial Sequence
  Description of Artificial Sequence: Synthetic polypeptide
DEEEIATTNPVATECYGDVSEPCLNHNEMEL

SEQ ID NO: 124929 - protein, 33 aa, Artificial Sequence
  Description of Artificial Sequence: Synthetic polypeptide
DECEICTTNPVATEQYGSVSTTAQGDTEEEEDD

SEQ ID NO: 124930 - protein, 32 aa, Artificial Sequence
  Description of Artificial Sequence: Synthetic polypeptide
DEEEIATTNPVATECYGDVSTEPAGNHNEMEL

SEQ ID NO: 124931 - protein, 32 aa, Artificial Sequence
  Description of Artificial Sequence: Synthetic polypeptide
DEEEIATTNPVATECYGDVSTEPCGNHNEMEL

SEQ ID NO: 124932 - protein, 33 aa, Artificial Sequence
  Description of Artificial Sequence: Synthetic polypeptide
DECEICTTNPVATEQYGSVSTTAQEDTEEAEED

SEQ ID NO: 124933 - protein, 33 aa, Artificial Sequence
  Description of Artificial Sequence: Synthetic polypeptide
DESEIATTNPVAYEQWGCVSTNLNGDAQGSNDG

SEQ ID NO: 124934 - protein, 35 aa, Artificial Sequence
  Description of Artificial Sequence: Synthetic polypeptide
DEEEIRTTNPVATEQYGSVNGTLDDQTGSGGGDDL

SEQ ID NO: 124935 - protein, 33 aa, Artificial Sequence
  Description of Artificial Sequence: Synthetic polypeptide
DEMEIVTTNPVATEQYGTVCSATDGPVEFEGNY

SEQ ID NO: 124936 - protein, 34 aa, Artificial Sequence
  Description of Artificial Sequence: Synthetic polypeptide
DECEICTTNPVATEQYGSVSTTANLEDTEEEEDD

SEQ ID NO: 124937 - protein, 33 aa, Artificial Sequence
  Description of Artificial Sequence: Synthetic polypeptide
DEMEIVTTNPVATEQYGTVCSATDGPVEFEGNW

SEQ ID NO: 124938 - protein, 32 aa, Artificial Sequence
  Description of Artificial Sequence: Synthetic polypeptide
DEEEIATTNPVATECYGSVSSECGPQHNEEPV

SEQ ID NO: 124939 - protein, 33 aa, Artificial Sequence
  Description of Artificial Sequence: Synthetic polypeptide
DEMEIVTTNPVATEQYGTVCSATDGPVEFEGNV

SEQ ID NO: 124940 - protein, 31 aa, Artificial Sequence
  Description of Artificial Sequence: Synthetic polypeptide
DEEEIATTNPVATECWGSVPCNCPQHEEEEG

SEQ ID NO: 124941 - protein, 33 aa, Artificial Sequence
  Description of Artificial Sequence: Synthetic polypeptide
DEMEIVTTNPVATEQYGTVCSATDGPVCFEGND

SEQ ID NO: 124942 - protein, 33 aa, Artificial Sequence
  Description of Artificial Sequence: Synthetic polypeptide
DESEIATTNPVAYEQWGSVCSTDNDDQGQGTVD

SEQ ID NO: 124943 - protein, 32 aa, Artificial Sequence
  Description of Artificial Sequence: Synthetic polypeptide
QEEEIACTNPVATEQYGCVATNLQDPEEDTAW

SEQ ID NO: 124944 - protein, 35 aa, Artificial Sequence
  Description of Artificial Sequence: Synthetic polypeptide
DESEIATTNPVAYEQYGSIACAATNNLQDSDGNRD

SEQ ID NO: 124945 - protein, 33 aa, Artificial Sequence
  Description of Artificial Sequence: Synthetic polypeptide
QEEEIACTNPVATEQYGCVATNLQAHPGGEQPH

SEQ ID NO: 124946 - protein, 36 aa, Artificial Sequence
  Description of Artificial Sequence: Synthetic polypeptide
DEEEIRTTNPVATEQYGSVNMDTNGIQGDEGQDEGQ

SEQ ID NO: 124947 - protein, 34 aa, Artificial Sequence
  Description of Artificial Sequence: Synthetic polypeptide
DEEEIATTNPVATECWGEVSCTNLQLNDHDNSGA

SEQ ID NO: 124948 - protein, 32 aa, Artificial Sequence
  Description of Artificial Sequence: Synthetic polypeptide
DEEEIATTNPVATECWGEVSEINCPQREEEEK

SEQ ID NO: 124949 - protein, 35 aa, Artificial Sequence
  Description of Artificial Sequence: Synthetic polypeptide
DEEEIRTTNPVATEQYGSVNLFENGPEEGFEGEER

SEQ ID NO: 124950 - protein, 37 aa, Artificial Sequence
  Description of Artificial Sequence: Synthetic polypeptide
DEEEIRTTNPVATEQYGSVNITFNGLGQQEGQGGGDT

SEQ ID NO: 124951 - protein, 36 aa, Artificial Sequence
  Description of Artificial Sequence: Synthetic polypeptide
DEEEIRTTNPVATEQYGSVNITFGLEDQNEGQGDVG

SEQ ID NO: 124952 - protein, 35 aa, Artificial Sequence
  Description of Artificial Sequence: Synthetic polypeptide
DEEEIRTTNPVATEQYGSVNIPWALQPEFLNEDQA

SEQ ID NO: 124953 - protein, 35 aa, Artificial Sequence
  Description of Artificial Sequence: Synthetic polypeptide
DEQEIRTTNPVATEQYGSVCTTVSVLQGTADGSQQ

SEQ ID NO: 124954 - protein, 36 aa, Artificial Sequence
  Description of Artificial Sequence: Synthetic polypeptide
DEEEIRTTNPVATEQYGSVNILANMLEQERAPSQDQ

SEQ ID NO: 124955 - protein, 31 aa, Artificial Sequence
  Description of Artificial Sequence: Synthetic polypeptide
DEEEIATTNPVATECWGEVSEIVCQREEEEK

SEQ ID NO: 124956 - protein, 33 aa, Artificial Sequence
  Description of Artificial Sequence: Synthetic polypeptide
QEEEIACTNPVATEQYGCVATNLQDAGGDEAEH

SEQ ID NO: 124957 - protein, 32 aa, Artificial Sequence
  Description of Artificial Sequence: Synthetic polypeptide
DESEIATTNPVAYEQWGSVSGGNGNSGEGNED

SEQ ID NO: 124958 - protein, 31 aa, Artificial Sequence
  Description of Artificial Sequence: Synthetic polypeptide
DEEEIATTNPVATECWGMHCWTMNEQDRNFV

SEQ ID NO: 124959 - protein, 35 aa, Artificial Sequence
  Description of Artificial Sequence: Synthetic polypeptide
DEEEIRTTNPVATEQYGSVNGTTTDFDYRGQESIM

SEQ ID NO: 124960 - protein, 33 aa, Artificial Sequence
  Description of Artificial Sequence: Synthetic polypeptide
DECEICTTNPVATEQYGSVSTTAQVNDTEEEDD

SEQ ID NO: 124961 - protein, 35 aa, Artificial Sequence
  Description of Artificial Sequence: Synthetic polypeptide
DEEEIRTTNPVATEQYGSVNGTTTDFDRYGQEGIM

SEQ ID NO: 124962 - protein, 35 aa, Artificial Sequence
  Description of Artificial Sequence: Synthetic polypeptide
DEEEIRTTNPVATEQYGSVNGTTPDFDLRIQEEIF

SEQ ID NO: 124963 - protein, 35 aa, Artificial Sequence
  Description of Artificial Sequence: Synthetic polypeptide
DEEEIRTTNPVATEQYGSVNGTTPDFDGRGGQEIF

SEQ ID NO: 124964 - protein, 33 aa, Artificial Sequence
  Description of Artificial Sequence: Synthetic polypeptide
DEMEIVTTNPVATEQYGTVCSATDGPVEHFGNG

SEQ ID NO: 124965 - protein, 29 aa, Artificial Sequence
  Description of Artificial Sequence: Synthetic peptide
QEEEIAGTNPVATEQYGEAPEVCQHEENK

SEQ ID NO: 124966 - protein, 29 aa, Artificial Sequence
  Description of Artificial Sequence: Synthetic peptide
QEEEIAGTNPVATEQYGEAPEVCQHENEK

SEQ ID NO: 124967 - protein, 33 aa, Artificial Sequence
  Description of Artificial Sequence: Synthetic polypeptide
DEMEIVTTNPVATEQYGTVCSATDFPVEFEGND

SEQ ID NO: 124968 - protein, 33 aa, Artificial Sequence
  Description of Artificial Sequence: Synthetic polypeptide
DEMEIVTTNPVATEQYGTVCSATDFPCEFEGND

SEQ ID NO: 124969 - protein, 33 aa, Artificial Sequence
  Description of Artificial Sequence: Synthetic polypeptide
DEMEIVTTNPVATEQYGTVCSATDESVEFEGND

SEQ ID NO: 124970 - protein, 33 aa, Artificial Sequence
  Description of Artificial Sequence: Synthetic polypeptide
DEMEIVTTNPVATEQYGTVCSATDEPVFFEGND

SEQ ID NO: 124971 - protein, 28 aa, Artificial Sequence
  Description of Artificial Sequence: Synthetic peptide
QEEEIASTNPVATEQYGEAWEVCQHEEK

SEQ ID NO: 124972 - protein, 33 aa, Artificial Sequence
  Description of Artificial Sequence: Synthetic polypeptide
DEMEIVTTNPVATEQYGTVCSATDEPVEFEGND

SEQ ID NO: 124973 - protein, 30 aa, Artificial Sequence
  Description of Artificial Sequence: Synthetic polypeptide
DEEEIATTNPVATEPYGEAPEDIQQQHGEH

SEQ ID NO: 124974 - protein, 33 aa, Artificial Sequence
  Description of Artificial Sequence: Synthetic polypeptide
DEMEIVTTNPVATEQYGTVCSATDDPVEFKGND

SEQ ID NO: 124975 - protein, 33 aa, Artificial Sequence
  Description of Artificial Sequence: Synthetic polypeptide
DEMEIVTTNPVATEQYGTVCSATDFPVEGEGND

SEQ ID NO: 124976 - protein, 32 aa, Artificial Sequence
  Description of Artificial Sequence: Synthetic polypeptide
DESEIATTNPVATEQYGNVSANTIEDHEGQDL

SEQ ID NO: 124977 - protein, 33 aa, Artificial Sequence
  Description of Artificial Sequence: Synthetic polypeptide
DEMEIVTTNPVATEQYGTVCSATDDPVEFEGNL

SEQ ID NO: 124978 - protein, 32 aa, Artificial Sequence
  Description of Artificial Sequence: Synthetic polypeptide
DESEIATTNPVATEQYGNVSANDIEDHEGEDL

SEQ ID NO: 124979 - protein, 34 aa, Artificial Sequence
  Description of Artificial Sequence: Synthetic polypeptide
DEQEIRTTNPVATEQYGSVSFTWPHLGDESEDGP

SEQ ID NO: 124980 - protein, 31 aa, Artificial Sequence
  Description of Artificial Sequence: Synthetic polypeptide
DEEEIATTNPVATEPYGEAPEEDIQQQHGNH

SEQ ID NO: 124981 - protein, 33 aa, Artificial Sequence
  Description of Artificial Sequence: Synthetic polypeptide
DEMEIVTTNPVATEQYGTVCSATDDPVEFEGND

SEQ ID NO: 124982 - protein, 29 aa, Artificial Sequence
  Description of Artificial Sequence: Synthetic peptide
QEEEIASTNPVATEQYGNAPETCQHVGEK

SEQ ID NO: 124983 - protein, 33 aa, Artificial Sequence
  Description of Artificial Sequence: Synthetic polypeptide
DEMEIVTTNPVATEQYGTVCSATDCPVEFEGND

SEQ ID NO: 124984 - protein, 33 aa, Artificial Sequence
  Description of Artificial Sequence: Synthetic polypeptide
DEMEIVTTNPVATEQYGTVCSATDCPVEAEGND

SEQ ID NO: 124985 - protein, 32 aa, Artificial Sequence
  Description of Artificial Sequence: Synthetic polypeptide
DESEIATTNPVATEQYGNVSANTIEDHEGEDL

SEQ ID NO: 124986 - protein, 28 aa, Artificial Sequence
  Description of Artificial Sequence: Synthetic peptide
QEEEIASTNPVATEQYGEAPEVIQHEEK

SEQ ID NO: 124987 - protein, 28 aa, Artificial Sequence
  Description of Artificial Sequence: Synthetic peptide
QEEEIASTNPVATEQYGEAPEVCQTEEK

SEQ ID NO: 124988 - protein, 28 aa, Artificial Sequence
  Description of Artificial Sequence: Synthetic peptide
QEEEIASTNPVATEQYGEAPEVCQSEEK

SEQ ID NO: 124989 - protein, 33 aa, Artificial Sequence
  Description of Artificial Sequence: Synthetic polypeptide
DEMEIVTTNPVATEQYGTVCSATDGEVELEGNP

SEQ ID NO: 124990 - protein, 33 aa, Artificial Sequence
  Description of Artificial Sequence: Synthetic polypeptide
DEMEIVTTNPVATEQYGTVCSATDGEVEFEGND

SEQ ID NO: 124991 - protein, 34 aa, Artificial Sequence
  Description of Artificial Sequence: Synthetic polypeptide
DESEIATTNPVATEQYGSMSATTPTGNMRGMNPV

SEQ ID NO: 124992 - protein, 33 aa, Artificial Sequence
  Description of Artificial Sequence: Synthetic polypeptide
DEMEIVTTNPVATEQYGTVCSATDGDVYFEGND

SEQ ID NO: 124993 - protein, 33 aa, Artificial Sequence
  Description of Artificial Sequence: Synthetic polypeptide
DEMEIVTTNPVATEQYGTVCSATDGDVPFEGND

SEQ ID NO: 124994 - protein, 37 aa, Artificial Sequence
  Description of Artificial Sequence: Synthetic polypeptide
DEEEIRTTNPVATEQYGSVMSTTPAGPNMRNGMNPVC

SEQ ID NO: 124995 - protein, 33 aa, Artificial Sequence
  Description of Artificial Sequence: Synthetic polypeptide
DEMEIVTTNPVATEQYGTVCSATDGDVEFEGNF

SEQ ID NO: 124996 - protein, 33 aa, Artificial Sequence
  Description of Artificial Sequence: Synthetic polypeptide
DEMEIVTTNPVATEQYGTVCSATDGDVEFEGND

SEQ ID NO: 124997 - protein, 34 aa, Artificial Sequence
  Description of Artificial Sequence: Synthetic polypeptide
DESEIATTNPVATEQYGSMSATTPTGNMRGMNPI

SEQ ID NO: 124998 - protein, 33 aa, Artificial Sequence
  Description of Artificial Sequence: Synthetic polypeptide
DEMEIVTTNPVATEQYGTVCSATDGCVEFYGND

SEQ ID NO: 124999 - protein, 33 aa, Artificial Sequence
  Description of Artificial Sequence: Synthetic polypeptide
DEMEIVTTNPVATEQYGTVCSATDGCVEFEGNK

SEQ ID NO: 125000 - protein, 33 aa, Artificial Sequence
  Description of Artificial Sequence: Synthetic polypeptide
DEAEISTTNPVAYEKWGVVSTNLNQGDAGQNDA

SEQ ID NO: 125001 - protein, 33 aa, Artificial Sequence
  Description of Artificial Sequence: Synthetic polypeptide
DEMEIVTTNPVATEQYGTVCSATDGCVEFEGND

SEQ ID NO: 125002 - protein, 28 aa, Artificial Sequence
  Description of Artificial Sequence: Synthetic peptide
QEEEIASTNPVATEQYGEAAEVCQHEEK

SEQ ID NO: 125003 - protein, 28 aa, Artificial Sequence
  Description of Artificial Sequence: Synthetic peptide
QEEEIASTNPVATEQYGEAPELHQHEEK

SEQ ID NO: 125004 - protein, 28 aa, Artificial Sequence
  Description of Artificial Sequence: Synthetic peptide
QEEEIASTNPVATEQYGEAPEPCQHEEK

SEQ ID NO: 125005 - protein, 33 aa, Artificial Sequence
  Description of Artificial Sequence: Synthetic polypeptide
DEMEIVTTNPVATEQYGTVCSATDGAVEFEGND

SEQ ID NO: 125006 - protein, 29 aa, Artificial Sequence
  Description of Artificial Sequence: Synthetic peptide
QEEEIASTNPVATEQYGEAPETCQHVGEK

SEQ ID NO: 125007 - protein, 28 aa, Artificial Sequence
  Description of Artificial Sequence: Synthetic peptide
QEEEIASTNPVATEQYGEAPEVCQHEEK

SEQ ID NO: 125008 - protein, 33 aa, Artificial Sequence
  Description of Artificial Sequence: Synthetic polypeptide
DEMEIVTTNPVATEQYGTVCSATDAVVEEEGND

SEQ ID NO: 125009 - protein, 37 aa, Artificial Sequence
  Description of Artificial Sequence: Synthetic polypeptide
AEEEIRTTNPVATEQYGSVVTVTTTNGNLQQGTNNID

SEQ ID NO: 125010 - protein, 33 aa, Artificial Sequence
  Description of Artificial Sequence: Synthetic polypeptide
DEMEIVTTNPVATEQYGTVCSATDAPVEFIGND

SEQ ID NO: 125011 - protein, 33 aa, Artificial Sequence
  Description of Artificial Sequence: Synthetic polypeptide
DEMEIVTTNPVATEQYGTVCSATDAPVEFEGND

SEQ ID NO: 125012 - protein, 35 aa, Artificial Sequence
  Description of Artificial Sequence: Synthetic polypeptide
DEQEIRTTNPVATEQYGSVSPTPTNMGHEVSDNEI

SEQ ID NO: 125013 - protein, 33 aa, Artificial Sequence
  Description of Artificial Sequence: Synthetic polypeptide
CEEEIACTNPVATEQYGCVAATNPDQTAGNTEE

SEQ ID NO: 125014 - protein, 31 aa, Artificial Sequence
  Description of Artificial Sequence: Synthetic polypeptide
CEEEIASVNPVCTEQYGVVCSWNLNQSGSDQ

SEQ ID NO: 125015 - protein, 33 aa, Artificial Sequence
  Description of Artificial Sequence: Synthetic polypeptide
DEMEIVTTNPVATEQYGTVCSAMDDPVEQEGND

SEQ ID NO: 125016 - protein, 37 aa, Artificial Sequence
  Description of Artificial Sequence: Synthetic polypeptide
DEEEIRTTNPVATEQYGSVMSGMMTNNGGETGEGNND

SEQ ID NO: 125017 - protein, 32 aa, Artificial Sequence
  Description of Artificial Sequence: Synthetic polypeptide
CEEEIACTNPVATEQYGCVAGNGLQAEPAGMN

SEQ ID NO: 125018 - protein, 36 aa, Artificial Sequence
  Description of Artificial Sequence: Synthetic polypeptide
DEEEIRTTNPVATEQYGSVMSGMFNNDQEEVENDIP

SEQ ID NO: 125019 - protein, 35 aa, Artificial Sequence
  Description of Artificial Sequence: Synthetic polypeptide
DEQEIRTTNPVATEQYGSVSSATPAGEDHEGMNPV

SEQ ID NO: 125020 - protein, 33 aa, Artificial Sequence
  Description of Artificial Sequence: Synthetic polypeptide
DESEIATTNPVATEQWGSVSTIDEPQDHEGEEL

SEQ ID NO: 125021 - protein, 28 aa, Artificial Sequence
  Description of Artificial Sequence: Synthetic peptide
QEEEIASTNPVGTEGYGEAASTCQHGDK

SEQ ID NO: 125022 - protein, 28 aa, Artificial Sequence
  Description of Artificial Sequence: Synthetic peptide
QEEEIASTNPVGTEGYGVMASTCQHGDI

SEQ ID NO: 125023 - protein, 29 aa, Artificial Sequence
  Description of Artificial Sequence: Synthetic peptide
QEEEIASTNPVGTEGYGVMASTLDQHGDI

SEQ ID NO: 125024 - protein, 36 aa, Artificial Sequence
  Description of Artificial Sequence: Synthetic polypeptide
DEEEIRTTNPVATEQYGSVMSGITQNDSGEGEGFDG

SEQ ID NO: 125025 - protein, 28 aa, Artificial Sequence
  Description of Artificial Sequence: Synthetic peptide
QEEEIASTNPVGTEGYGVMASVLQHGEI

SEQ ID NO: 125026 - protein, 28 aa, Artificial Sequence
  Description of Artificial Sequence: Synthetic peptide
QEEEIASTNPVGTEGYGVMASVLQHGEK

SEQ ID NO: 125027 - protein, 36 aa, Artificial Sequence
  Description of Artificial Sequence: Synthetic polypeptide
DEEEIRTTNPVATEQYGSVMSGIQIGDLGEGEGNIQ

SEQ ID NO: 125028 - protein, 30 aa, Artificial Sequence
  Description of Artificial Sequence: Synthetic polypeptide
QEEEIASTNPVGTEGYGVVATTTGQHGMNI

SEQ ID NO: 125029 - protein, 35 aa, Artificial Sequence
  Description of Artificial Sequence: Synthetic polypeptide
DEQEIRTTNPVATEQYGSVSSATPALEDHEGMEDV

SEQ ID NO: 125030 - protein, 28 aa, Artificial Sequence
  Description of Artificial Sequence: Synthetic peptide
QEEEIASTNPVGTEGYGVMASCLQHGDI

SEQ ID NO: 125031 - protein, 34 aa, Artificial Sequence
  Description of Artificial Sequence: Synthetic polypeptide
DEEEIATTNPVATEPYGSVCFTNEDHNHGGQNQN

SEQ ID NO: 125032 - protein, 35 aa, Artificial Sequence
  Description of Artificial Sequence: Synthetic polypeptide
DECEIATTNPVAYEQYGTVCSYTDGLNEEQRGNEA

SEQ ID NO: 125033 - protein, 33 aa, Artificial Sequence
  Description of Artificial Sequence: Synthetic polypeptide
DEMEIVTTNPVATEQYGTVCSANDGPVEFEGND

SEQ ID NO: 125034 - protein, 33 aa, Artificial Sequence
  Description of Artificial Sequence: Synthetic polypeptide
DEMEIVTTNPVATEQYGTVCSATCGPVEMEGND

SEQ ID NO: 125035 - protein, 33 aa, Artificial Sequence
  Description of Artificial Sequence: Synthetic polypeptide
DEMEIVTTNPVATEQYGTVCSATCGPVEFEGND

SEQ ID NO: 125036 - protein, 33 aa, Artificial Sequence
  Description of Artificial Sequence: Synthetic polypeptide
DEMEIVTTNPVATEQYGTVCSATAGPVEFEGNQ

SEQ ID NO: 125037 - protein, 33 aa, Artificial Sequence
  Description of Artificial Sequence: Synthetic polypeptide
DEMEIVTTNPVATEQYGTVCSATAGPVEFEGND

SEQ ID NO: 125038 - protein, 33 aa, Artificial Sequence
  Description of Artificial Sequence: Synthetic polypeptide
DEMEIVTTNPVATEQYGTVCSASTGPVEFEGND

SEQ ID NO: 125039 - protein, 35 aa, Artificial Sequence
  Description of Artificial Sequence: Synthetic polypeptide
DEQEIRTTNPVATEQYGSVSLPNEEEVTEEDNLRL

SEQ ID NO: 125040 - protein, 33 aa, Artificial Sequence
  Description of Artificial Sequence: Synthetic polypeptide
DEMEIVTTNPVATEQYGTVCSARDGPVEFRGND

SEQ ID NO: 125041 - protein, 33 aa, Artificial Sequence
  Description of Artificial Sequence: Synthetic polypeptide
DESEIATTNPVATEQYGEVPCINEPQDREGEEG

SEQ ID NO: 125042 - protein, 28 aa, Artificial Sequence
  Description of Artificial Sequence: Synthetic peptide
QEEEIASTNPVATEQYGVAPEVCQHEEK

SEQ ID NO: 125043 - protein, 33 aa, Artificial Sequence
  Description of Artificial Sequence: Synthetic polypeptide
DEMEIVTTNPVATEQYGTVCSAQDTPVEFEGND

SEQ ID NO: 125044 - protein, 28 aa, Artificial Sequence
  Description of Artificial Sequence: Synthetic peptide
QEEEIASTNPVATEQYGVAPSVCQHEEK

SEQ ID NO: 125045 - protein, 33 aa, Artificial Sequence
  Description of Artificial Sequence: Synthetic polypeptide
DEEEIATTNPVATEPYGSTACATNGTDAGGNEQ

SEQ ID NO: 125046 - protein, 29 aa, Artificial Sequence
  Description of Artificial Sequence: Synthetic peptide
DESEIATTNPVATEQYGEAPEVCQHEEEK

SEQ ID NO: 125047 - protein, 34 aa, Artificial Sequence
  Description of Artificial Sequence: Synthetic polypeptide
DESEIATTNPVATEQYGCVYVWENGIQKTGDNRA

SEQ ID NO: 125048 - protein, 35 aa, Artificial Sequence
  Description of Artificial Sequence: Synthetic polypeptide
DEQEIRTTNPVATEQYGSVSNTLWDYEQFGGQDEM

SEQ ID NO: 125049 - protein, 36 aa, Artificial Sequence
  Description of Artificial Sequence: Synthetic polypeptide
DEQEIRTTNPVATEQYGSVSPDATDQSPQSGNLDKG

SEQ ID NO: 125050 - protein, 32 aa, Artificial Sequence
  Description of Artificial Sequence: Synthetic polypeptide
DESEIATTNPVATEQYGCVAANGPAVADGNNN

SEQ ID NO: 125051 - protein, 37 aa, Artificial Sequence
  Description of Artificial Sequence: Synthetic polypeptide
AEEEIRTTNPVATEQYGSVVTVTTNNGNLQQGTNIGN

SEQ ID NO: 125052 - protein, 34 aa, Artificial Sequence
  Description of Artificial Sequence: Synthetic polypeptide
DEQEIRTTNPVATEQYGSVSPSDTDQTYASNQQM

SEQ ID NO: 125053 - protein, 31 aa, Artificial Sequence
  Description of Artificial Sequence: Synthetic polypeptide
DESEIATTNPVATEQYGEVPEIVCQHEGEEK

SEQ ID NO: 125054 - protein, 37 aa, Artificial Sequence
  Description of Artificial Sequence: Synthetic polypeptide
AEEEIRTTNPVATEQYGSVVTVTTTNLEQGTEGGNTG

SEQ ID NO: 125055 - protein, 34 aa, Artificial Sequence
  Description of Artificial Sequence: Synthetic polypeptide
DEMEIVTTNPVATEQYGTVCSATDGFPVEQEGND

SEQ ID NO: 125056 - protein, 33 aa, Artificial Sequence
  Description of Artificial Sequence: Synthetic polypeptide
DEMEIVTTNPVATEQYGTVCSATDGFVEDEGND

SEQ ID NO: 125057 - protein, 33 aa, Artificial Sequence
  Description of Artificial Sequence: Synthetic polypeptide
DEMEIVTTNPVATEQYGTVCSATDGPIEFEGND

SEQ ID NO: 125058 - protein, 37 aa, Artificial Sequence
  Description of Artificial Sequence: Synthetic polypeptide
DEEEIRTTNPVATEQYGSVMVPGENLQEHGVMENDEL

SEQ ID NO: 125059 - protein, 33 aa, Artificial Sequence
  Description of Artificial Sequence: Synthetic polypeptide
DEMEIVTTNPVATEQYGTVCSATDGPHEFEGND

SEQ ID NO: 125060 - protein, 36 aa, Artificial Sequence
  Description of Artificial Sequence: Synthetic polypeptide
DESEIATTNPVATEQYGSVCAADNGLEARDQMGNRH

SEQ ID NO: 125061 - protein, 28 aa, Artificial Sequence
  Description of Artificial Sequence: Synthetic peptide
QEEEIAPTNPCSSEQYGEASCNLQSEEK

SEQ ID NO: 125062 - protein, 33 aa, Artificial Sequence
  Description of Artificial Sequence: Synthetic polypeptide
DEMEIVTTNPVATEQYGTVCSATDGPGEFEGND

SEQ ID NO: 125063 - protein, 33 aa, Artificial Sequence
  Description of Artificial Sequence: Synthetic polypeptide
DEMEIVTTNPVATEQYGTVCSATDGPFEFEGND

SEQ ID NO: 125064 - protein, 32 aa, Artificial Sequence
  Description of Artificial Sequence: Synthetic polypeptide
CEEEIACTNPVATEQWGSVSMSGNGQPAGVPM

SEQ ID NO: 125065 - protein, 33 aa, Artificial Sequence
  Description of Artificial Sequence: Synthetic polypeptide
DEMEIVTTNPVATEQYGTVCSATDGPKEFEGND

SEQ ID NO: 125066 - protein, 33 aa, Artificial Sequence
  Description of Artificial Sequence: Synthetic polypeptide
DEMEIVTTNPVATEQYGTVCSATDGPEFEGQND

SEQ ID NO: 125067 - protein, 33 aa, Artificial Sequence
  Description of Artificial Sequence: Synthetic polypeptide
CEEEIACTNPVATEQWGSVSPNEPQENGDNSDA

SEQ ID NO: 125068 - protein, 28 aa, Artificial Sequence
  Description of Artificial Sequence: Synthetic peptide
QEEEIAPTNPCSSEQYGEVPCNLQHEEK

SEQ ID NO: 125069 - protein, 32 aa, Artificial Sequence
  Description of Artificial Sequence: Synthetic polypeptide
DEMEIVTTNPVATEQYGTVCSATDGPEFEGGD

SEQ ID NO: 125070 - protein, 32 aa, Artificial Sequence
  Description of Artificial Sequence: Synthetic polypeptide
DEMEIVTTNPVATEQYGTVCSATDGPEFEEND

SEQ ID NO: 125071 - protein, 32 aa, Artificial Sequence
  Description of Artificial Sequence: Synthetic polypeptide
DEMEIVTTNPVATEQYGTVCSATDGPEFAGDD

SEQ ID NO: 125072 - protein, 33 aa, Artificial Sequence
  Description of Artificial Sequence: Synthetic polypeptide
DEMEIVTTNPVATEQYGTVCSATDGPEEFEGNW

SEQ ID NO: 125073 - protein, 33 aa, Artificial Sequence
  Description of Artificial Sequence: Synthetic polypeptide
DEMEIVTTNPVATEQYGTVCSATDGPEEFEGND

SEQ ID NO: 125074 - protein, 32 aa, Artificial Sequence
  Description of Artificial Sequence: Synthetic polypeptide
DESEIATTNPVATEQYGSVAMHGQDSNENTNE

SEQ ID NO: 125075 - protein, 33 aa, Artificial Sequence
  Description of Artificial Sequence: Synthetic polypeptide
DEMEIVTTNPVATEQYGTVCSATDGPEFEGNYD

SEQ ID NO: 125076 - protein, 33 aa, Artificial Sequence
  Description of Artificial Sequence: Synthetic polypeptide
DEMEIVTTNPVATEQYGTVCSATDGPMEFEGND

SEQ ID NO: 125077 - protein, 33 aa, Artificial Sequence
  Description of Artificial Sequence: Synthetic polypeptide
QEEEIAPTNPCATEQYGIVSCNGPQMSNGMNPR

SEQ ID NO: 125078 - protein, 33 aa, Artificial Sequence
  Description of Artificial Sequence: Synthetic polypeptide
DEMEIVTTNPVATEQYGTVCSATDGPPEFEGNA

SEQ ID NO: 125079 - protein, 33 aa, Artificial Sequence
  Description of Artificial Sequence: Synthetic polypeptide
DEMEIVTTNPVATEQYGTVCSATDGPVAFEGND

SEQ ID NO: 125080 - protein, 28 aa, Artificial Sequence
  Description of Artificial Sequence: Synthetic peptide
QEEEIAGTNPVATEQYGEAPEVVQHEEK

SEQ ID NO: 125081 - protein, 33 aa, Artificial Sequence
  Description of Artificial Sequence: Synthetic polypeptide
DEMEIVTTNPVATEQYGTVCSATDGPTEFEGND

SEQ ID NO: 125082 - protein, 33 aa, Artificial Sequence
  Description of Artificial Sequence: Synthetic polypeptide
DEMEIVTTNPVATEQYGTVCSATDGPTEAEGND

SEQ ID NO: 125083 - protein, 33 aa, Artificial Sequence
  Description of Artificial Sequence: Synthetic polypeptide
DEMEIVTTNPVATEQYGTVCSATDGPSTPEGND

SEQ ID NO: 125084 - protein, 33 aa, Artificial Sequence
  Description of Artificial Sequence: Synthetic polypeptide
DEMEIVTTNPVATEQYGTVCSATDGPSEFEGND

SEQ ID NO: 125085 - protein, 28 aa, Artificial Sequence
  Description of Artificial Sequence: Synthetic peptide
QEEEIAPTNPCATEQYGEAPCNCQHEEK

SEQ ID NO: 125086 - protein, 28 aa, Artificial Sequence
  Description of Artificial Sequence: Synthetic peptide
QEEEIAPTNPCATEQYGEAPCNCQSEEK

SEQ ID NO: 125087 - protein, 34 aa, Artificial Sequence
  Description of Artificial Sequence: Synthetic polypeptide
DEMEIVTTNPVATEQYGTVCSATDGPREFEGDND

SEQ ID NO: 125088 - protein, 34 aa, Artificial Sequence
  Description of Artificial Sequence: Synthetic polypeptide
DEMEIVTTNPVATEQYGTVCSATDGPQEQFNGND

SEQ ID NO: 125089 - protein, 34 aa, Artificial Sequence
  Description of Artificial Sequence: Synthetic polypeptide
DESEIATTNPVATEQYGSVCADTNLTQPDQMEAV

SEQ ID NO: 125090 - protein, 33 aa, Artificial Sequence
  Description of Artificial Sequence: Synthetic polypeptide
DEAEIATTNPVAYEQYGSCSTNGDQGTPPDNQM

SEQ ID NO: 125091 - protein, 34 aa, Artificial Sequence
  Description of Artificial Sequence: Synthetic polypeptide
DEMEIVTTNPVATEQYGTVCSATDGPQEFEGAND

SEQ ID NO: 125092 - protein, 28 aa, Artificial Sequence
  Description of Artificial Sequence: Synthetic peptide
QEEEIAPTNPCATEQYGEAPEVCQHEER

SEQ ID NO: 125093 - protein, 36 aa, Artificial Sequence
  Description of Artificial Sequence: Synthetic polypeptide
DEEEIRTTNPVATEQYGTVSSATDAGPNMFNGMNPV

SEQ ID NO: 125094 - protein, 34 aa, Artificial Sequence
  Description of Artificial Sequence: Synthetic polypeptide
DEMEIVTTNPVATEQYGTVCSATDGPPQEFEGND

SEQ ID NO: 125095 - protein, 36 aa, Artificial Sequence
  Description of Artificial Sequence: Synthetic polypeptide
DEEEIATTNPVATEGYGSVSSTNPAGPNMRVGMQPR

SEQ ID NO: 125096 - protein, 35 aa, Artificial Sequence
  Description of Artificial Sequence: Synthetic polypeptide
DESEIATTNPVATEQYGSVCAANNGDEQDRSINRA

SEQ ID NO: 125097 - protein, 33 aa, Artificial Sequence
  Description of Artificial Sequence: Synthetic polypeptide
DEMEIVTTNPVATEQYGTVCSATDGPPEFEGND

SEQ ID NO: 125098 - protein, 33 aa, Artificial Sequence
  Description of Artificial Sequence: Synthetic polypeptide
DEMEIVTTNPVATEQYGTVCSATDGPDEFEGND

SEQ ID NO: 125099 - protein, 33 aa, Artificial Sequence
  Description of Artificial Sequence: Synthetic polypeptide
DEMEIVTTNPVATEQYGTVCSATDGPCEFEGND

SEQ ID NO: 125100 - protein, 33 aa, Artificial Sequence
  Description of Artificial Sequence: Synthetic polypeptide
DEMEIVTTNPVATEQYGTVCSATDGPCEFDGND

SEQ ID NO: 125101 - protein, 33 aa, Artificial Sequence
  Description of Artificial Sequence: Synthetic polypeptide
DEMEIVTTNPVATEQYGTVCSATDGPAEFEGND

SEQ ID NO: 125102 - protein, 33 aa, Artificial Sequence
  Description of Artificial Sequence: Synthetic polypeptide
DEMEIVTTNPVATEQYGTVCSATDGIVEFNGNH

SEQ ID NO: 125103 - protein, 33 aa, Artificial Sequence
  Description of Artificial Sequence: Synthetic polypeptide
DEMEIVTTNPVATEQYGTVCSATDGIVEFNGND

SEQ ID NO: 125104 - protein, 34 aa, Artificial Sequence
  Description of Artificial Sequence: Synthetic polypeptide
DESEIATTNPVATEQYGSTVSATDELEDHTGEDL

SEQ ID NO: 125105 - protein, 33 aa, Artificial Sequence
  Description of Artificial Sequence: Synthetic polypeptide
DEMEIVTTNPVATEQYGTVCSATDGIVEFEGND

SEQ ID NO: 125106 - protein, 28 aa, Artificial Sequence
  Description of Artificial Sequence: Synthetic peptide
QEEEIAPTNPVATEQYGEAPCVCQHEEK

SEQ ID NO: 125107 - protein, 28 aa, Artificial Sequence
  Description of Artificial Sequence: Synthetic peptide
QEEEIAPTNPVATEQYGEAPEVCQHEEK

SEQ ID NO: 125108 - protein, 33 aa, Artificial Sequence
  Description of Artificial Sequence: Synthetic polypeptide
DEMEIVTTNPVATEQYGTVCSATDGHVEFEGND

SEQ ID NO: 125109 - protein, 36 aa, Artificial Sequence
  Description of Artificial Sequence: Synthetic polypeptide
DEEEIRTTNPVATEQYGSVMTGNNNNVQTEEFTGEG

SEQ ID NO: 125110 - protein, 36 aa, Artificial Sequence
  Description of Artificial Sequence: Synthetic polypeptide
DESEIATTNPVATEQYGSTVASCTNGLSAYNGGNTN

SEQ ID NO: 125111 - protein, 33 aa, Artificial Sequence
  Description of Artificial Sequence: Synthetic polypeptide
DEMEIVTTNPVATEQYGTVCSATDGGVNFEGND

SEQ ID NO: 125112 - protein, 31 aa, Artificial Sequence
  Description of Artificial Sequence: Synthetic polypeptide
DECEIATTNPVAYEQYGVCSTIDQGHPNQSN

SEQ ID NO: 125113 - protein, 28 aa, Artificial Sequence
  Description of Artificial Sequence: Synthetic peptide
QEEEIAPTNPVATEQYGEAPEVMQHEEK

SEQ ID NO: 125114 - protein, 33 aa, Artificial Sequence
  Description of Artificial Sequence: Synthetic polypeptide
DEMEIVTTNPVATEQYGTVCSATDGGVEFNGND

SEQ ID NO: 125115 - protein, 33 aa, Artificial Sequence
  Description of Artificial Sequence: Synthetic polypeptide
DEMEIVTTNPVATEQYGTVCSATDGGVEFEGND

SEQ ID NO: 125116 - protein, 31 aa, Artificial Sequence
  Description of Artificial Sequence: Synthetic polypeptide
DECEIATTNPVAYEQYGVCSTIDQGHPNNDN

SEQ ID NO: 125117 - protein, 33 aa, Artificial Sequence
  Description of Artificial Sequence: Synthetic polypeptide
DEMEIVTTNPVATEQYGTVCSATDGGVEAEGND

SEQ ID NO: 125118 - protein, 28 aa, Artificial Sequence
  Description of Artificial Sequence: Synthetic peptide
QEEEIAPTNPVSTEQYGEAPCVLQHEEK

SEQ ID NO: 125119 - protein, 32 aa, Artificial Sequence
  Description of Artificial Sequence: Synthetic polypeptide
DECEIATTNPVAYEQYGVCSTIDQDRQPNDDN

SEQ ID NO: 125120 - protein, 33 aa, Artificial Sequence
  Description of Artificial Sequence: Synthetic polypeptide
DEMEIVTTNPVATEQYGTVCSATDGFVEFEGND

SEQ ID NO: 125121 - protein, 36 aa, Artificial Sequence
  Description of Artificial Sequence: Synthetic polypeptide
AEEEIRTTNPVATEQYGSVVTVVTDGGNNLQGNNDD

SEQ ID NO: 125122 - protein, 28 aa, Artificial Sequence
  Description of Artificial Sequence: Synthetic peptide
QEEEIAGTNPVATEQYGEAPEVCQHEGK

SEQ ID NO: 125123 - protein, 35 aa, Artificial Sequence
  Description of Artificial Sequence: Synthetic polypeptide
DESEIATTNPVATEQYGSTVSATGLSEDTEGGENL

SEQ ID NO: 125124 - protein, 28 aa, Artificial Sequence
  Description of Artificial Sequence: Synthetic peptide
QEEEIAPTNPCSTEQYGEAPCVCQSGER

SEQ ID NO: 125125 - protein, 38 aa, Artificial Sequence
  Description of Artificial Sequence: Synthetic polypeptide
DEEEIRTTNPVATEQYGSVMTSDNNNLVQGGGGDNDGD

SEQ ID NO: 125126 - protein, 36 aa, Artificial Sequence
  Description of Artificial Sequence: Synthetic polypeptide
DEEEIRTTNPVATEQYGTVSSTTPAGPNMRNGMNPI

SEQ ID NO: 125127 - protein, 34 aa, Artificial Sequence
  Description of Artificial Sequence: Synthetic polypeptide
DEMEIVTTNPVATEQYGTVCSATDGNPVEFEGND

SEQ ID NO: 125128 - protein, 33 aa, Artificial Sequence
  Description of Artificial Sequence: Synthetic polypeptide
DEMEIVTTNPVATEQYGTVCSATDGMVEFYGND

SEQ ID NO: 125129 - protein, 33 aa, Artificial Sequence
  Description of Artificial Sequence: Synthetic polypeptide
DEMEIVTTNPVATEQYGTVCSATDGMVEFEGND

SEQ ID NO: 125130 - protein, 31 aa, Artificial Sequence
  Description of Artificial Sequence: Synthetic polypeptide
DECEIATTNPVAYEQYGVCSTIDQQHQHGMN

SEQ ID NO: 125131 - protein, 35 aa, Artificial Sequence
  Description of Artificial Sequence: Synthetic polypeptide
AEEEIRTTNPVATEQYGSVVTVVTDGNENLGGNTD

SEQ ID NO: 125132 - protein, 34 aa, Artificial Sequence
  Description of Artificial Sequence: Synthetic polypeptide
DEMEIVTTNPVATEQYGTVCSATDGMPVEFEGNR

SEQ ID NO: 125133 - protein, 36 aa, Artificial Sequence
  Description of Artificial Sequence: Synthetic polypeptide
DEEEIRTTNPVATEQYGTVSSTTPAGPNMRNGMNPM

SEQ ID NO: 125134 - protein, 36 aa, Artificial Sequence
  Description of Artificial Sequence: Synthetic polypeptide
DEEEIRTTNPVATEQYGTVSSTTPAGPNMRNGMNPV

SEQ ID NO: 125135 - protein, 36 aa, Artificial Sequence
  Description of Artificial Sequence: Synthetic polypeptide
DEEEIRTTNPVATEQYGTVSSTTPAPVEMREGMNPD

SEQ ID NO: 125136 - protein, 33 aa, Artificial Sequence
  Description of Artificial Sequence: Synthetic polypeptide
DEMEIVTTNPVATEQYGTVCSATDGLVEFEEND

SEQ ID NO: 125137 - protein, 34 aa, Artificial Sequence
  Description of Artificial Sequence: Synthetic polypeptide
DEMEIVTTNPVATEQYGTVCSATDGLVEDHEGND

SEQ ID NO: 125138 - protein, 34 aa, Artificial Sequence
  Description of Artificial Sequence: Synthetic polypeptide
DEMEIVTTNPVATEQYGTVCSATDGLPVEFEGND

SEQ ID NO: 125139 - protein, 34 aa, Artificial Sequence
  Description of Artificial Sequence: Synthetic polypeptide
DEMEIVTTNPVATEQYGTVCSATDGLPVEFEGNC

SEQ ID NO: 125140 - protein, 36 aa, Artificial Sequence
  Description of Artificial Sequence: Synthetic polypeptide
DEEEIRTTNPVATEQYGTVSSTTPGGVEMRNGMNPD

SEQ ID NO: 125141 - protein, 36 aa, Artificial Sequence
  Description of Artificial Sequence: Synthetic polypeptide
DEEEIRTTNPVATEQYGTVSSTTPGGVEMRNGMNPV

SEQ ID NO: 125142 - protein, 36 aa, Artificial Sequence
  Description of Artificial Sequence: Synthetic polypeptide
DEEEIRTTNPVATEQYGTVSSTTPGGVNMRNGMNPV

SEQ ID NO: 125143 - protein, 36 aa, Artificial Sequence
  Description of Artificial Sequence: Synthetic polypeptide
DEEEIRTTNPVATEQYGTVSSTTPGPVEMRNGMNPD

SEQ ID NO: 125144 - protein, 33 aa, Artificial Sequence
  Description of Artificial Sequence: Synthetic polypeptide
DEMEIVTTNPVATEQYGTVCSATDGKVEFEGND

SEQ ID NO: 125145 - protein, 37 aa, Artificial Sequence
  Description of Artificial Sequence: Synthetic polypeptide
DECEICTTNPVATEQYGSVSTTNLQQQNNQQGTNVTD

SEQ ID NO: 125146 - protein, 33 aa, Artificial Sequence
  Description of Artificial Sequence: Synthetic polypeptide
DEMEIVTTNPVATEQYGTVCSATDGPVEHGGND

SEQ ID NO: 125147 - protein, 33 aa, Artificial Sequence
  Description of Artificial Sequence: Synthetic polypeptide
DEMEIVTTNPVATEQYGTVCSATDGPVEIEGND

SEQ ID NO: 125148 - protein, 33 aa, Artificial Sequence
  Description of Artificial Sequence: Synthetic polypeptide
DEMEIVTTNPVATEQYGTVCSATWGPVEFEGND

SEQ ID NO: 125149 - protein, 33 aa, Artificial Sequence
  Description of Artificial Sequence: Synthetic polypeptide
DEMEIVTTNPVATEQYGTVCSATVWPVEFEGND

SEQ ID NO: 125150 - protein, 33 aa, Artificial Sequence
  Description of Artificial Sequence: Synthetic polypeptide
DEMEIVTTNPVATEQYGTVCSATVGPVEFEGND

SEQ ID NO: 125151 - protein, 33 aa, Artificial Sequence
  Description of Artificial Sequence: Synthetic polypeptide
DEMEIVTTNPVATEQYGTVCSATVGEVEFEGND

SEQ ID NO: 125152 - protein, 33 aa, Artificial Sequence
  Description of Artificial Sequence: Synthetic polypeptide
DEMEIVTTNPVATEQYGTVCSATTGPVEFEGND

SEQ ID NO: 125153 - protein, 33 aa, Artificial Sequence
  Description of Artificial Sequence: Synthetic polypeptide
DEMEIVTTNPVATEQYGTVCSATSGPVEQELND

SEQ ID NO: 125154 - protein, 33 aa, Artificial Sequence
  Description of Artificial Sequence: Synthetic polypeptide
DEMEIVTTNPVATEQYGTVCSATSGPVEFEGND

SEQ ID NO: 125155 - protein, 33 aa, Artificial Sequence
  Description of Artificial Sequence: Synthetic polypeptide
DEMEIVTTNPVATEQYGTVCSATSGPVAFIGND

SEQ ID NO: 125156 - protein, 33 aa, Artificial Sequence
  Description of Artificial Sequence: Synthetic polypeptide
DEMEIVTTNPVATEQYGTVCSATYGPVEFEGND

SEQ ID NO: 125157 - protein, 33 aa, Artificial Sequence
  Description of Artificial Sequence: Synthetic polypeptide
DEMEIVTTNPVATEQYGTVCSATRGPVEIEGND

SEQ ID NO: 125158 - protein, 33 aa, Artificial Sequence
  Description of Artificial Sequence: Synthetic polypeptide
DEMEIVTTNPVATEQYGTVCSATRGPVEFEGND

SEQ ID NO: 125159 - protein, 34 aa, Artificial Sequence
  Description of Artificial Sequence: Synthetic polypeptide
DECEICTTNPVATEQYGSVSTTSQNLNDTEEEDD

SEQ ID NO: 125160 - protein, 33 aa, Artificial Sequence
  Description of Artificial Sequence: Synthetic polypeptide
DEMEIVTTNPVATEQYGTVCSATQSPVEFEGND

SEQ ID NO: 125161 - protein, 33 aa, Artificial Sequence
  Description of Artificial Sequence: Synthetic polypeptide
DECEICTTNPVATEQYGSVSTTSQLEDTEEEDT

SEQ ID NO: 125162 - protein, 34 aa, Artificial Sequence
  Description of Artificial Sequence: Synthetic polypeptide
DEMEIVTTNPVATEQYGTVCSATQGPVEQFEGND

SEQ ID NO: 125163 - protein, 33 aa, Artificial Sequence
  Description of Artificial Sequence: Synthetic polypeptide
DEMEIVTTNPVATEQYGTVCSATQGPVEMEGND

SEQ ID NO: 125164 - protein, 33 aa, Artificial Sequence
  Description of Artificial Sequence: Synthetic polypeptide
DEMEIVTTNPVATEQYGTVCSATQGPVEFEGND

SEQ ID NO: 125165 - protein, 33 aa, Artificial Sequence
  Description of Artificial Sequence: Synthetic polypeptide
DEMEIVTTNPVATEQYGTVCSATQGPFEFEGND

SEQ ID NO: 125166 - protein, 33 aa, Artificial Sequence
  Description of Artificial Sequence: Synthetic polypeptide
DEMEIVTTNPVATEQYGTVCSATRGPVEFSGND

SEQ ID NO: 125167 - protein, 32 aa, Artificial Sequence
  Description of Artificial Sequence: Synthetic polypeptide
QECEICTTNPVATEAYGVVSTELQLQPGTEEL

SEQ ID NO: 125168 - protein, 32 aa, Artificial Sequence
  Description of Artificial Sequence: Synthetic polypeptide
QECEICTTNPVATEAYGVVSTELQLQGTEETQ

SEQ ID NO: 125169 - protein, 32 aa, Artificial Sequence
  Description of Artificial Sequence: Synthetic polypeptide
QECEICTTNPVATEAYGVVSTELQLQGQEEEL

SEQ ID NO: 125170 - protein, 33 aa, Artificial Sequence
  Description of Artificial Sequence: Synthetic polypeptide
DEMEIVTTNPVATEQYGTVCSDTDGPVYFEGND

SEQ ID NO: 125171 - protein, 34 aa, Artificial Sequence
  Description of Artificial Sequence: Synthetic polypeptide
DEMEIVTTNPVATEQYGTVCSDTDGPVEFEGNRD

SEQ ID NO: 125172 - protein, 33 aa, Artificial Sequence
  Description of Artificial Sequence: Synthetic polypeptide
DEMEIVTTNPVATEQYGTVCSDTDGPVEFEGND

SEQ ID NO: 125173 - protein, 31 aa, Artificial Sequence
  Description of Artificial Sequence: Synthetic polypeptide
QECEICTTNPVATEAYGVVSTELQLQDDEEE

SEQ ID NO: 125174 - protein, 33 aa, Artificial Sequence
  Description of Artificial Sequence: Synthetic polypeptide
DEMEIVTTNPVATEQYGTVCSDTDAPVEFFGND

SEQ ID NO: 125175 - protein, 32 aa, Artificial Sequence
  Description of Artificial Sequence: Synthetic polypeptide
DEMEIVTTNPVATEQYGTVCSDDGPVEFEGND

SEQ ID NO: 125176 - protein, 33 aa, Artificial Sequence
  Description of Artificial Sequence: Synthetic polypeptide
DEMEIVTTNPVATEQYGTVCSCTDGPVETEGND

SEQ ID NO: 125177 - protein, 33 aa, Artificial Sequence
  Description of Artificial Sequence: Synthetic polypeptide
DEMEIVTTNPVATEQYGTVCSCTDGPVEFEGNF

SEQ ID NO: 125178 - protein, 32 aa, Artificial Sequence
  Description of Artificial Sequence: Synthetic polypeptide
DESEIATTNPVGTEQYGVVSSSAGPQRNGMDI

SEQ ID NO: 125179 - protein, 33 aa, Artificial Sequence
  Description of Artificial Sequence: Synthetic polypeptide
DEMEIVTTNPVATEQYGTVCSCTDGPVEFEGND

SEQ ID NO: 125180 - protein, 33 aa, Artificial Sequence
  Description of Artificial Sequence: Synthetic polypeptide
DEMEIVTTNPVATEQYGTVCSCTDGGVEFEGND

SEQ ID NO: 125181 - protein, 34 aa, Artificial Sequence
  Description of Artificial Sequence: Synthetic polypeptide
DEMEIVTTNPVATEQYGTVCSCDGPVQDREGEND

SEQ ID NO: 125182 - protein, 31 aa, Artificial Sequence
  Description of Artificial Sequence: Synthetic polypeptide
QECEICTTNPVATEAYGVVSTELQLQDEELQ

SEQ ID NO: 125183 - protein, 33 aa, Artificial Sequence
  Description of Artificial Sequence: Synthetic polypeptide
DEMEIVTTNPVATEQYGTVCSAYTGPVEFEGND

SEQ ID NO: 125184 - protein, 32 aa, Artificial Sequence
  Description of Artificial Sequence: Synthetic polypeptide
QECEICTTNPVATEAYGVVSTELQLQGAEELG

SEQ ID NO: 125185 - protein, 30 aa, Artificial Sequence
  Description of Artificial Sequence: Synthetic polypeptide
DESEIATTNPVGTEQYGVMATDLEDHEGDI

SEQ ID NO: 125186 - protein, 28 aa, Artificial Sequence
  Description of Artificial Sequence: Synthetic peptide
DESEIATTNPVGTEQYGVMASIEQAEDA

SEQ ID NO: 125187 - protein, 34 aa, Artificial Sequence
  Description of Artificial Sequence: Synthetic polypeptide
CEEEIATTNPVATEQWGCVAATNLDQATPDGNEN

SEQ ID NO: 125188 - protein, 32 aa, Artificial Sequence
  Description of Artificial Sequence: Synthetic polypeptide
QECEICTTNPVATEAYGVVSTELQLQGEEEEL

SEQ ID NO: 125189 - protein, 33 aa, Artificial Sequence
  Description of Artificial Sequence: Synthetic polypeptide
DEMEIVTTNPVATEQYGTVCSATPWPVEFEGND

SEQ ID NO: 125190 - protein, 33 aa, Artificial Sequence
  Description of Artificial Sequence: Synthetic polypeptide
DESEIATTNPVGYEQYGSVPSCTTHSGRGTNFV

SEQ ID NO: 125191 - protein, 34 aa, Artificial Sequence
  Description of Artificial Sequence: Synthetic polypeptide
DEMEIVTTNPVATEQYGTVCSATPGPVNMFEGND

SEQ ID NO: 125192 - protein, 33 aa, Artificial Sequence
  Description of Artificial Sequence: Synthetic polypeptide
DEMEIVTTNPVATEQYGTVCSATPGPVEFEGND

SEQ ID NO: 125193 - protein, 30 aa, Artificial Sequence
  Description of Artificial Sequence: Synthetic polypeptide
DESEIATTNPVGTEGYGVMSSDLQQHNGDI

SEQ ID NO: 125194 - protein, 32 aa, Artificial Sequence
  Description of Artificial Sequence: Synthetic polypeptide
QECEICTTNPVATEAYGVVSTEQLQGGEEEQL

SEQ ID NO: 125195 - protein, 33 aa, Artificial Sequence
  Description of Artificial Sequence: Synthetic polypeptide
DEMEIVTTNPVATEQYGTVCSATIGPVEFEGND

SEQ ID NO: 125196 - protein, 33 aa, Artificial Sequence
  Description of Artificial Sequence: Synthetic polypeptide
DEMEIVTTNPVATEQYGTVCSATIGPVEFEGNC

SEQ ID NO: 125197 - protein, 33 aa, Artificial Sequence
  Description of Artificial Sequence: Synthetic polypeptide
DEMEIVTTNPVATEQYGTVCSATHGPVEFEGND

SEQ ID NO: 125198 - protein, 32 aa, Artificial Sequence
  Description of Artificial Sequence: Synthetic polypeptide
QECEICTTNPVATEAYGVVSTEQLQGQENEQL

SEQ ID NO: 125199 - protein, 32 aa, Artificial Sequence
  Description of Artificial Sequence: Synthetic polypeptide
QECEICTTNPVATEAYGVVSTEQLQQEGEELQ

SEQ ID NO: 125200 - protein, 33 aa, Artificial Sequence
  Description of Artificial Sequence: Synthetic polypeptide
QECEICTTNPVATEAYGVVSTEQLQQGNEEQEQ

SEQ ID NO: 125201 - protein, 31 aa, Artificial Sequence
  Description of Artificial Sequence: Synthetic polypeptide
DESEIATTNPVGTEGYGVMSSDLQQQHNGNI

SEQ ID NO: 125202 - protein, 33 aa, Artificial Sequence
  Description of Artificial Sequence: Synthetic polypeptide
DEMEIVTTNPVATEQYGTVCSATGPVEFEGNID

SEQ ID NO: 125203 - protein, 33 aa, Artificial Sequence
  Description of Artificial Sequence: Synthetic polypeptide
DECEICTTNPVATEQYGSVSTTQQLEDTEEEDD

SEQ ID NO: 125204 - protein, 35 aa, Artificial Sequence
  Description of Artificial Sequence: Synthetic polypeptide
DEEEIRTTNPVATEQYGTVCSATDAPPEMFEGMNV

SEQ ID NO: 125205 - protein, 32 aa, Artificial Sequence
  Description of Artificial Sequence: Synthetic polypeptide
DESEIATTNPVGTEGYGVMSATPTLNRGMNPI

SEQ ID NO: 125206 - protein, 36 aa, Artificial Sequence
  Description of Artificial Sequence: Synthetic polypeptide
DEEEIRTTNPVATEQYGTVCSATDAPPNMFNGMNPV

SEQ ID NO: 125207 - protein, 33 aa, Artificial Sequence
  Description of Artificial Sequence: Synthetic polypeptide
DECEICTTNPVATEQYGSVSTTQLNNDEEEEDD

SEQ ID NO: 125208 - protein, 36 aa, Artificial Sequence
  Description of Artificial Sequence: Synthetic polypeptide
DEEEIRTTNPVATEQYGTVCSATPGGPNMFNGMNPV

SEQ ID NO: 125209 - protein, 33 aa, Artificial Sequence
  Description of Artificial Sequence: Synthetic polypeptide
DEMEIVTTNPVATEQYGTVCSATGHPVEFEGND

SEQ ID NO: 125210 - protein, 33 aa, Artificial Sequence
  Description of Artificial Sequence: Synthetic polypeptide
DEMEIVTTNPVATEQYGTVCSATGGPVEFEGNH

SEQ ID NO: 125211 - protein, 36 aa, Artificial Sequence
  Description of Artificial Sequence: Synthetic polypeptide
DEEEIRTTNPVATEQYGTVCSATDAGPNMFNGMNPV

SEQ ID NO: 125212 - protein, 36 aa, Artificial Sequence
  Description of Artificial Sequence: Synthetic polypeptide
DEEEIRTTNPVATEQYGSVNNSAENDDQVETMTDRI

SEQ ID NO: 125213 - protein, 32 aa, Artificial Sequence
  Description of Artificial Sequence: Synthetic polypeptide
DEAEIATTNPVAYEQYGSVATAGAQGMNPGHN

SEQ ID NO: 125214 - protein, 33 aa, Artificial Sequence
  Description of Artificial Sequence: Synthetic polypeptide
DEMEIVTTNPVATEQYGTVCSATKGPCEFEGND

SEQ ID NO: 125215 - protein, 33 aa, Artificial Sequence
  Description of Artificial Sequence: Synthetic polypeptide
DEMEIVTTNPVATEQYGTVCSATPGPVECEGND

SEQ ID NO: 125216 - protein, 33 aa, Artificial Sequence
  Description of Artificial Sequence: Synthetic polypeptide
DEMEIVTTNPVATEQYGTVCSATPGGVNFEGND

SEQ ID NO: 125217 - protein, 33 aa, Artificial Sequence
  Description of Artificial Sequence: Synthetic polypeptide
DECEICTTNPVATEQYGSVSTTSALEDTEEETD

SEQ ID NO: 125218 - protein, 33 aa, Artificial Sequence
  Description of Artificial Sequence: Synthetic polypeptide
DEMEIVTTNPVATEQYGTVCSATPAPVEFEGND

SEQ ID NO: 125219 - protein, 32 aa, Artificial Sequence
  Description of Artificial Sequence: Synthetic polypeptide
QECEICTTNPVATEAYGVVSTENLQLEQDEEL

SEQ ID NO: 125220 - protein, 28 aa, Artificial Sequence
  Description of Artificial Sequence: Synthetic peptide
DESEIATTNPVGTEQWGVMSSIEQAEDA

SEQ ID NO: 125221 - protein, 34 aa, Artificial Sequence
  Description of Artificial Sequence: Synthetic polypeptide
DEMEIVTTNPVATEQYGTVCSATPAGPEMRNGND

SEQ ID NO: 125222 - protein, 31 aa, Artificial Sequence
  Description of Artificial Sequence: Synthetic polypeptide
DESEIATTNPVGTEPYGVMSSDLQQQHNGNI

SEQ ID NO: 125223 - protein, 33 aa, Artificial Sequence
  Description of Artificial Sequence: Synthetic polypeptide
QECEICTTNPVATEAYGVVSTENQLQQGEEQLS

SEQ ID NO: 125224 - protein, 31 aa, Artificial Sequence
  Description of Artificial Sequence: Synthetic polypeptide
QECEICTTNPVATEAYGVVSTEQLLQHEEDD

SEQ ID NO: 125225 - protein, 31 aa, Artificial Sequence
  Description of Artificial Sequence: Synthetic polypeptide
QECEICTTNPVATEAYGVVSTEQLLQNEDEL

SEQ ID NO: 125226 - protein, 33 aa, Artificial Sequence
  Description of Artificial Sequence: Synthetic polypeptide
DEMEIVTTNPVATEQYGTVCSATMGPVEFEGND

SEQ ID NO: 125227 - protein, 33 aa, Artificial Sequence
  Description of Artificial Sequence: Synthetic polypeptide
DEMEIVTTNPVATEQYGTVCSATLGPVEVEGNE

SEQ ID NO: 125228 - protein, 33 aa, Artificial Sequence
  Description of Artificial Sequence: Synthetic polypeptide
QECEICTTNPVATEAYGVVSTEQLNQQGNEEQL

SEQ ID NO: 125229 - protein, 33 aa, Artificial Sequence
  Description of Artificial Sequence: Synthetic polypeptide
DEMEIVTTNPVATEQYGTVCSATLGPVEFEGND

SEQ ID NO: 125230 - protein, 33 aa, Artificial Sequence
  Description of Artificial Sequence: Synthetic polypeptide
DEMEIVTTNPVATEQYGTVCSATLGPSEDEGND

SEQ ID NO: 125231 - protein, 34 aa, Artificial Sequence
  Description of Artificial Sequence: Synthetic polypeptide
DEQEIRTTNPVATEQYGCYSTNPNQDESTFEGRD

SEQ ID NO: 125232 - protein, 30 aa, Artificial Sequence
  Description of Artificial Sequence: Synthetic polypeptide
DESEIATTNPVGTEGYGVVSSSAGNHGMNV

SEQ ID NO: 125233 - protein, 33 aa, Artificial Sequence
  Description of Artificial Sequence: Synthetic polypeptide
DEMEIVTTNPVATEQYGTVCSATKGPVEFEGND

SEQ ID NO: 125234 - protein, 33 aa, Artificial Sequence
  Description of Artificial Sequence: Synthetic polypeptide
DEMEIVTTNPVATEQYGTVCSATPGPVNFEGND

SEQ ID NO: 125235 - protein, 33 aa, Artificial Sequence
  Description of Artificial Sequence: Synthetic polypeptide
DEMEIVTTNPVATEQYGTVCSETDGCVEFEGND

SEQ ID NO: 125236 - protein, 33 aa, Artificial Sequence
  Description of Artificial Sequence: Synthetic polypeptide
DEMEIVTTNPVATEQYGTVCSETDGPVEFEGND

SEQ ID NO: 125237 - protein, 32 aa, Artificial Sequence
  Description of Artificial Sequence: Synthetic polypeptide
DESEIATTNPVSSEQWGSVSCINEPQREGETG

SEQ ID NO: 125238 - protein, 33 aa, Artificial Sequence
  Description of Artificial Sequence: Synthetic polypeptide
DEMEIVTTNPVATEQYGTVCSRTYGPVEFEGND

SEQ ID NO: 125239 - protein, 30 aa, Artificial Sequence
  Description of Artificial Sequence: Synthetic polypeptide
QECEICATNPCTTEIYGVVSTNSTLQNGEF

SEQ ID NO: 125240 - protein, 33 aa, Artificial Sequence
  Description of Artificial Sequence: Synthetic polypeptide
DEMEIVTTNPVATEQYGTVCSRTDGPVEFEGND

SEQ ID NO: 125241 - protein, 33 aa, Artificial Sequence
  Description of Artificial Sequence: Synthetic polypeptide
DEMEIVTTNPVATEQYGTVCSQTDGPVEFEGND

SEQ ID NO: 125242 - protein, 31 aa, Artificial Sequence
  Description of Artificial Sequence: Synthetic polypeptide
DESEIATTNPVSTEPYGTIAAMTIQQRNGNH

SEQ ID NO: 125243 - protein, 33 aa, Artificial Sequence
  Description of Artificial Sequence: Synthetic polypeptide
DEMEIVTTNPVATEQYGTVCSQTDGPAEFEGND

SEQ ID NO: 125244 - protein, 29 aa, Artificial Sequence
  Description of Artificial Sequence: Synthetic peptide
QECEICATNPCTTEIYGVVSTSQLQNGDA

SEQ ID NO: 125245 - protein, 31 aa, Artificial Sequence
  Description of Artificial Sequence: Synthetic polypeptide
DESEIATTNPVSTEPYGNVAAMTIQSRVGNH

SEQ ID NO: 125246 - protein, 30 aa, Artificial Sequence
  Description of Artificial Sequence: Synthetic polypeptide
DESEIATTNPVSTEPYGVIAMETLQQQGNI

SEQ ID NO: 125247 - protein, 30 aa, Artificial Sequence
  Description of Artificial Sequence: Synthetic polypeptide
DESEIATTNPVSTEGYGVIAMETLQQQGNI

SEQ ID NO: 125248 - protein, 31 aa, Artificial Sequence
  Description of Artificial Sequence: Synthetic polypeptide
DESEIATTNPVSTEGYGTMSSTIQQQHNGNH

SEQ ID NO: 125249 - protein, 33 aa, Artificial Sequence
  Description of Artificial Sequence: Synthetic polypeptide
DEMEIVTTNPVATEQYGTVCSPTDGPVEFEGND

SEQ ID NO: 125250 - protein, 33 aa, Artificial Sequence
  Description of Artificial Sequence: Synthetic polypeptide
DEMEIVTTNPVATEQYGTVCSPTDGEVEFEGND

SEQ ID NO: 125251 - protein, 30 aa, Artificial Sequence
  Description of Artificial Sequence: Synthetic polypeptide
QECEICTTNPVATEAYGVVSELQLQGDEEL

SEQ ID NO: 125252 - protein, 30 aa, Artificial Sequence
  Description of Artificial Sequence: Synthetic polypeptide
QECEICTTNPVATEAYGVVSELQLQNDEEL

SEQ ID NO: 125253 - protein, 30 aa, Artificial Sequence
  Description of Artificial Sequence: Synthetic polypeptide
QECEICTTNPVATEAYGVVSEQLEQGEEAL

SEQ ID NO: 125254 - protein, 33 aa, Artificial Sequence
  Description of Artificial Sequence: Synthetic polypeptide
DEMEIVTTNPVATEQYGTVCSNTGEPVEYFGND

SEQ ID NO: 125255 - protein, 35 aa, Artificial Sequence
  Description of Artificial Sequence: Synthetic polypeptide
DECEICTTNPVATEQYGSVSTTVQNGNEDEEEEDD

SEQ ID NO: 125256 - protein, 29 aa, Artificial Sequence
  Description of Artificial Sequence: Synthetic peptide
QECEICSTNPCTTEIYGVVSTSTLQNGDE

SEQ ID NO: 125257 - protein, 33 aa, Artificial Sequence
  Description of Artificial Sequence: Synthetic polypeptide
DEMEIVTTNPVATEQYGTVCSSTDGPVEFEGND

SEQ ID NO: 125258 - protein, 34 aa, Artificial Sequence
  Description of Artificial Sequence: Synthetic polypeptide
DECEICTTNPVATEQYGSVSTVAAQEGETEEEDD

SEQ ID NO: 125259 - protein, 34 aa, Artificial Sequence
  Description of Artificial Sequence: Synthetic polypeptide
DECEICTTNPVATEQYGSVSTVAAQNENTEEEDD

SEQ ID NO: 125260 - protein, 31 aa, Artificial Sequence
  Description of Artificial Sequence: Synthetic polypeptide
DEAEIATTNPVAYEQYGSVCATTEQDATLTD

SEQ ID NO: 125261 - protein, 34 aa, Artificial Sequence
  Description of Artificial Sequence: Synthetic polypeptide
DEEEIATTNPVATAQYGSVCALANGLQESNDDAQ

SEQ ID NO: 125262 - protein, 31 aa, Artificial Sequence
  Description of Artificial Sequence: Synthetic polypeptide
DEMEIVTTNPVATEQYGTVCSTDVCEFEEED

SEQ ID NO: 125263 - protein, 33 aa, Artificial Sequence
  Description of Artificial Sequence: Synthetic polypeptide
DEMEIVTTNPVATEQYGTVCSTDIPVMNFEGNA

SEQ ID NO: 125264 - protein, 28 aa, Artificial Sequence
  Description of Artificial Sequence: Synthetic peptide
QECEIATTNPVATEQYGEAPEVCQHEEK

SEQ ID NO: 125265 - protein, 32 aa, Artificial Sequence
  Description of Artificial Sequence: Synthetic polypeptide
DEQEIRTTNPVATEQWGSDVSEIQENNGMEEA

SEQ ID NO: 125266 - protein, 32 aa, Artificial Sequence
  Description of Artificial Sequence: Synthetic polypeptide
DEMEIVTTNPVATEQYGTVCSTDGPVEFEGTD

SEQ ID NO: 125267 - protein, 37 aa, Artificial Sequence
  Description of Artificial Sequence: Synthetic polypeptide
DEEEIRTTNPVATEQYGTSVSSTTPAGPNMRMGMNPV

SEQ ID NO: 125268 - protein, 37 aa, Artificial Sequence
  Description of Artificial Sequence: Synthetic polypeptide
DEEEIRTTNPVATEQYGTSVSSTTPAGPNMRNGMNPV

SEQ ID NO: 125269 - protein, 32 aa, Artificial Sequence
  Description of Artificial Sequence: Synthetic polypeptide
DEMEIVTTNPVATEQYGTVCSTDGPVEFEGGD

SEQ ID NO: 125270 - protein, 33 aa, Artificial Sequence
  Description of Artificial Sequence: Synthetic polypeptide
DEMEIVTTNPVATEQYGTVCSTDGPVEFEGENG

SEQ ID NO: 125271 - protein, 33 aa, Artificial Sequence
  Description of Artificial Sequence: Synthetic polypeptide
DEMEIVTTNPVATEQYGTVCSTDGPVEFEGEND

SEQ ID NO: 125272 - protein, 37 aa, Artificial Sequence
  Description of Artificial Sequence: Synthetic polypeptide
DEEEIRTTNPVATEQYGTSVSSTTPASPNMRNGMNPV

SEQ ID NO: 125273 - protein, 32 aa, Artificial Sequence
  Description of Artificial Sequence: Synthetic polypeptide
DEQEIRTTNPVATEQWGSVSACDEEDHEGEEG

SEQ ID NO: 125274 - protein, 28 aa, Artificial Sequence
  Description of Artificial Sequence: Synthetic peptide
QECEIATTNPVATEQYGEAYEVCQHERK

SEQ ID NO: 125275 - protein, 33 aa, Artificial Sequence
  Description of Artificial Sequence: Synthetic polypeptide
DECEICTTNPVATEQYGSVSTVANTEDTEEEDD

SEQ ID NO: 125276 - protein, 33 aa, Artificial Sequence
  Description of Artificial Sequence: Synthetic polypeptide
DECEICTTNPVATEQYGSVSTVAELEDTEEEDD

SEQ ID NO: 125277 - protein, 35 aa, Artificial Sequence
  Description of Artificial Sequence: Synthetic polypeptide
DEEEIATTNPVATEAWGISVRTWNDDDQDRREGSR

SEQ ID NO: 125278 - protein, 28 aa, Artificial Sequence
  Description of Artificial Sequence: Synthetic peptide
QECEIATTNPVAYESWGVVSECLQHEES

SEQ ID NO: 125279 - protein, 33 aa, Artificial Sequence
  Description of Artificial Sequence: Synthetic polypeptide
DEAEIATTNPVAYEQYGSVATHGQPRQGMGAEE

SEQ ID NO: 125280 - protein, 30 aa, Artificial Sequence
  Description of Artificial Sequence: Synthetic polypeptide
QECEICTTNPVATEAYGVVSEQQLQGEELQ

SEQ ID NO: 125281 - protein, 30 aa, Artificial Sequence
  Description of Artificial Sequence: Synthetic polypeptide
QECEICTTNPVATEAYGVVSNELLQQDEEL

SEQ ID NO: 125282 - protein, 31 aa, Artificial Sequence
  Description of Artificial Sequence: Synthetic polypeptide
DESEIATTNPVSTEGYGTMSMTIQQQHNGNH

SEQ ID NO: 125283 - protein, 33 aa, Artificial Sequence
  Description of Artificial Sequence: Synthetic polypeptide
DEMEIVTTNPVATEQYGTVCSITDGPVEFEGND

SEQ ID NO: 125284 - protein, 36 aa, Artificial Sequence
  Description of Artificial Sequence: Synthetic polypeptide
DECEICTTNPVATEQYGSVSTTVNNLQNQNGTEEEE

SEQ ID NO: 125285 - protein, 32 aa, Artificial Sequence
  Description of Artificial Sequence: Synthetic polypeptide
DESEIATTNPVSTEGYGSVAATDIQDHEGQDR

SEQ ID NO: 125286 - protein, 37 aa, Artificial Sequence
  Description of Artificial Sequence: Synthetic polypeptide
DECEICTTNPVATEQYGSVSTTVNLQQGNQQGNQEED

SEQ ID NO: 125287 - protein, 34 aa, Artificial Sequence
  Description of Artificial Sequence: Synthetic polypeptide
DEMEIVTTNPVATEQYGTVCSITDGLPVEFEGND

SEQ ID NO: 125288 - protein, 31 aa, Artificial Sequence
  Description of Artificial Sequence: Synthetic polypeptide
DESEIATTNPVSTEGYGNVAAMTIQSRVGNH

SEQ ID NO: 125289 - protein, 33 aa, Artificial Sequence
  Description of Artificial Sequence: Synthetic polypeptide
DEMEIVTTNPVATEQYGTVCSHTDGPVEFEGND

SEQ ID NO: 125290 - protein, 33 aa, Artificial Sequence
  Description of Artificial Sequence: Synthetic polypeptide
CEEEIATTNPVATEQWGCVAGTGELAQNNSGNN

SEQ ID NO: 125291 - protein, 33 aa, Artificial Sequence
  Description of Artificial Sequence: Synthetic polypeptide
DEMEIVTTNPVATEQYGTVCSGTDGPVEFFGND

SEQ ID NO: 125292 - protein, 33 aa, Artificial Sequence
  Description of Artificial Sequence: Synthetic polypeptide
DEMEIVTTNPVATEQYGTVCSGTDGPVEFEGND

SEQ ID NO: 125293 - protein, 33 aa, Artificial Sequence
  Description of Artificial Sequence: Synthetic polypeptide
DEMEIVTTNPVATEQYGTVCSFTDGPVEMEGND

SEQ ID NO: 125294 - protein, 33 aa, Artificial Sequence
  Description of Artificial Sequence: Synthetic polypeptide
DECEICTTNPVATEQYGSVSTTVADEDTEGEDD

SEQ ID NO: 125295 - protein, 33 aa, Artificial Sequence
  Description of Artificial Sequence: Synthetic polypeptide
DEMEIVTTNPVATEQYGTVCSFTDGPVEFEGND

SEQ ID NO: 125296 - protein, 33 aa, Artificial Sequence
  Description of Artificial Sequence: Synthetic polypeptide
DEMEIVTTNPVATEQYGTVCSFTDEPFEFEGND

SEQ ID NO: 125297 - protein, 35 aa, Artificial Sequence
  Description of Artificial Sequence: Synthetic polypeptide
DEEEIRTTNPVATEQYGSVNNSPEEDDQVEMDARL

SEQ ID NO: 125298 - protein, 31 aa, Artificial Sequence
  Description of Artificial Sequence: Synthetic polypeptide
QECEICTTNPVATEAYGVVSTELLQPEEQLN

SEQ ID NO: 125299 - protein, 33 aa, Artificial Sequence
  Description of Artificial Sequence: Synthetic polypeptide
DEMEIVTTNPVATEQYGTVCSETDGPVEYEGND

SEQ ID NO: 125300 - protein, 33 aa, Artificial Sequence
  Description of Artificial Sequence: Synthetic polypeptide
DEMEIVTTNPVATEQYGTVCSETDGPVEKEGND

SEQ ID NO: 125301 - protein, 32 aa, Artificial Sequence
  Description of Artificial Sequence: Synthetic polypeptide
DESEIATTNPVSSEQWGSVSCINEPQSEGETR

SEQ ID NO: 125302 - protein, 33 aa, Artificial Sequence
  Description of Artificial Sequence: Synthetic polypeptide
DEMEIVTTNPVATEQYGTVCSKTDEPVEFEGND

SEQ ID NO: 125303 - protein, 33 aa, Artificial Sequence
  Description of Artificial Sequence: Synthetic polypeptide
DEMEIVTTNPVATEQYGTVCSATGGPVEFEGND

SEQ ID NO: 125304 - protein, 33 aa, Artificial Sequence
  Description of Artificial Sequence: Synthetic polypeptide
DEMEIVTTNPVATEQYGTVCSKTDGPVEFEGND

SEQ ID NO: 125305 - protein, 33 aa, Artificial Sequence
  Description of Artificial Sequence: Synthetic polypeptide
DEMEIVTTNPVATEQYGTVCSLTDGPVAFEGND

SEQ ID NO: 125306 - protein, 31 aa, Artificial Sequence
  Description of Artificial Sequence: Synthetic polypeptide
QECEICTTNPVATEAYGVVSTELLLQHEEEL

SEQ ID NO: 125307 - protein, 33 aa, Artificial Sequence
  Description of Artificial Sequence: Synthetic polypeptide
DEMEIVTTNPVATEQYGTVCSNTDGPVEFEGNS

SEQ ID NO: 125308 - protein, 33 aa, Artificial Sequence
  Description of Artificial Sequence: Synthetic polypeptide
DEMEIVTTNPVATEQYGTVCSNTDGPVEFEGND

SEQ ID NO: 125309 - protein, 33 aa, Artificial Sequence
  Description of Artificial Sequence: Synthetic polypeptide
DEMEIVTTNPVATEQYGTVCSNTDGPVEAEGND

SEQ ID NO: 125310 - protein, 31 aa, Artificial Sequence
  Description of Artificial Sequence: Synthetic polypeptide
QECEICTTNPVATEAYGVVSTELLLQHEELE

SEQ ID NO: 125311 - protein, 33 aa, Artificial Sequence
  Description of Artificial Sequence: Synthetic polypeptide
DEMEIVTTNPVATEQYGTVCSNTDEPVENEGNQ

SEQ ID NO: 125312 - protein, 33 aa, Artificial Sequence
  Description of Artificial Sequence: Synthetic polypeptide
DEMEIVTTNPVATEQYGTVCSNTDEPSAFEGND

SEQ ID NO: 125313 - protein, 34 aa, Artificial Sequence
  Description of Artificial Sequence: Synthetic polypeptide
DEMEIVTTNPVATEQYGTVCSNTDEPNENFGNDA

SEQ ID NO: 125314 - protein, 34 aa, Artificial Sequence
  Description of Artificial Sequence: Synthetic polypeptide
DEMEIVTTNPVATEQYGTVCSNTDEPNEFSGNQA

SEQ ID NO: 125315 - protein, 31 aa, Artificial Sequence
  Description of Artificial Sequence: Synthetic polypeptide
QECEICTTNPVATEAYGVVSTELLNQHETEL

SEQ ID NO: 125316 - protein, 34 aa, Artificial Sequence
  Description of Artificial Sequence: Synthetic polypeptide
DEMEIVTTNPVATEQYGTVCSMTGEPNEFEGNDG

SEQ ID NO: 125317 - protein, 34 aa, Artificial Sequence
  Description of Artificial Sequence: Synthetic polypeptide
DECEICTTNPVATEQYGSVSTTVQLQEDTEEEDD

SEQ ID NO: 125318 - protein, 33 aa, Artificial Sequence
  Description of Artificial Sequence: Synthetic polypeptide
DECEICTTNPVATEQYGSVSTTVQLEEEEEEDD

SEQ ID NO: 125319 - protein, 33 aa, Artificial Sequence
  Description of Artificial Sequence: Synthetic polypeptide
DEMEIVTTNPVATEQYGTVCSMTDGPVEFEGND

SEQ ID NO: 125320 - protein, 35 aa, Artificial Sequence
  Description of Artificial Sequence: Synthetic polypeptide
DEEEIRTTNPVATEQYGSVNNSQEPDEGREDQDRD

SEQ ID NO: 125321 - protein, 32 aa, Artificial Sequence
  Description of Artificial Sequence: Synthetic polypeptide
DEQEIRTTNPVATEQYGAVAATDWEDHEGEDL

SEQ ID NO: 125322 - protein, 32 aa, Artificial Sequence
  Description of Artificial Sequence: Synthetic polypeptide
DEAEIATTNPVAYEQYGSVATHGQASPGDSVD

SEQ ID NO: 125323 - protein, 33 aa, Artificial Sequence
  Description of Artificial Sequence: Synthetic polypeptide
DEMEIVTTNPVATEQYGTVCSLTDGPVIFEGND

SEQ ID NO: 125324 - protein, 33 aa, Artificial Sequence
  Description of Artificial Sequence: Synthetic polypeptide
DEMEIVTTNPVATEQYGTVCSLTDGPVEFEGND

SEQ ID NO: 125325 - protein, 33 aa, Artificial Sequence
  Description of Artificial Sequence: Synthetic polypeptide
DEMEIVTTNPVATEQYGTVCSLTDGPSEFEGND

SEQ ID NO: 125326 - protein, 30 aa, Artificial Sequence
  Description of Artificial Sequence: Synthetic polypeptide
DESEIATTNPVGTEGYGVMATDLQDHEGDI

SEQ ID NO: 125327 - protein, 29 aa, Artificial Sequence
  Description of Artificial Sequence: Synthetic peptide
DESEIATTNPVGTEGYGVMASDLQDHGDI

SEQ ID NO: 125328 - protein, 33 aa, Artificial Sequence
  Description of Artificial Sequence: Synthetic polypeptide
DEMEIVTTNPVATEQYGTVCSATFGPVEFEGND

SEQ ID NO: 125329 - protein, 33 aa, Artificial Sequence
  Description of Artificial Sequence: Synthetic polypeptide
DEMEIVTTNPVATEQYGTVCSATDGPVNFEGND

SEQ ID NO: 125330 - protein, 36 aa, Artificial Sequence
  Description of Artificial Sequence: Synthetic polypeptide
DECEICTTNPVATEQYGSVSTTNNQLNDEQGNNLTE

SEQ ID NO: 125331 - protein, 33 aa, Artificial Sequence
  Description of Artificial Sequence: Synthetic polypeptide
DEMEIVTTNPVATEQYGTVCSATDGPVMFEGND

SEQ ID NO: 125332 - protein, 37 aa, Artificial Sequence
  Description of Artificial Sequence: Synthetic polypeptide
DECEICTTNPVATEQYGSVSTTNNNLNGNQQGNNDTD

SEQ ID NO: 125333 - protein, 33 aa, Artificial Sequence
  Description of Artificial Sequence: Synthetic polypeptide
DEMEIVTTNPVATEQYGTVCSATDGPVKFEGND

SEQ ID NO: 125334 - protein, 33 aa, Artificial Sequence
  Description of Artificial Sequence: Synthetic polypeptide
DEMEIVTTNPVATEQYGTVCSATDGPVIGEGND

SEQ ID NO: 125335 - protein, 28 aa, Artificial Sequence
  Description of Artificial Sequence: Synthetic peptide
QEEAIATTNPVATEQYGEAPEVCQHEEK

SEQ ID NO: 125336 - protein, 33 aa, Artificial Sequence
  Description of Artificial Sequence: Synthetic polypeptide
DEMEIVTTNPVATEQYGTVCSATDGPVIFEGND

SEQ ID NO: 125337 - protein, 34 aa, Artificial Sequence
  Description of Artificial Sequence: Synthetic polypeptide
DEMEIVTTNPVATEQYGTVCSATDGPVNMFEGND

SEQ ID NO: 125338 - protein, 33 aa, Artificial Sequence
  Description of Artificial Sequence: Synthetic polypeptide
DEMEIVTTNPVATEQYGTVCSATDGPVHFEGND

SEQ ID NO: 125339 - protein, 33 aa, Artificial Sequence
  Description of Artificial Sequence: Synthetic polypeptide
DEMEIVTTNPVATEQYGTVCSATDGPVGKEGND

SEQ ID NO: 125340 - protein, 33 aa, Artificial Sequence
  Description of Artificial Sequence: Synthetic polypeptide
DEMEIVTTNPVATEQYGTVCSATDGPVGFEGND

SEQ ID NO: 125341 - protein, 34 aa, Artificial Sequence
  Description of Artificial Sequence: Synthetic polypeptide
DEMEIVTTNPVATEQYGTVCSATDGPVFLFEGND

SEQ ID NO: 125342 - protein, 33 aa, Artificial Sequence
  Description of Artificial Sequence: Synthetic polypeptide
DEMEIVTTNPVATEQYGTVCSATDGPVFFEGND

SEQ ID NO: 125343 - protein, 28 aa, Artificial Sequence
  Description of Artificial Sequence: Synthetic peptide
QEEAIATTNPVATEQYGFAPEVCQHEEK

SEQ ID NO: 125344 - protein, 33 aa, Artificial Sequence
  Description of Artificial Sequence: Synthetic polypeptide
DEMEIVTTNPVATEQYGTVCSATDGPVEYEGND

SEQ ID NO: 125345 - protein, 33 aa, Artificial Sequence
  Description of Artificial Sequence: Synthetic polypeptide
DEMEIVTTNPVATEQYGTVCSATDGPVEWPGND

SEQ ID NO: 125346 - protein, 36 aa, Artificial Sequence
  Description of Artificial Sequence: Synthetic polypeptide
DEEEIRTTNPVATEQYGSVNNLTVHNDEEGNFEIEP

SEQ ID NO: 125347 - protein, 33 aa, Artificial Sequence
  Description of Artificial Sequence: Synthetic polypeptide
DEMEIVTTNPVATEQYGTVCSATDGPVGSEGND

SEQ ID NO: 125348 - protein, 33 aa, Artificial Sequence
  Description of Artificial Sequence: Synthetic polypeptide
DEQEIRTTNPVATEQYGSITTEDLNYGEGTDEQ

SEQ ID NO: 125349 - protein, 35 aa, Artificial Sequence
  Description of Artificial Sequence: Synthetic polypeptide
DEEEIRTTNPVATEQYGTVMSGMFNNDQEEVEGDI

SEQ ID NO: 125350 - protein, 33 aa, Artificial Sequence
  Description of Artificial Sequence: Synthetic polypeptide
DEMEIVTTNPVATEQYGTVCSATDGPVPFEGND

SEQ ID NO: 125351 - protein, 28 aa, Artificial Sequence
  Description of Artificial Sequence: Synthetic peptide
QEDEIASTNPVGTEGYGVMASTLQHGDI

SEQ ID NO: 125352 - protein, 33 aa, Artificial Sequence
  Description of Artificial Sequence: Synthetic polypeptide
DEMEIVTTNPVATEQYGTVCSATDGPVYFEGND

SEQ ID NO: 125353 - protein, 33 aa, Artificial Sequence
  Description of Artificial Sequence: Synthetic polypeptide
DESEIATTNPVAYEQYGSVATNHTQTRNPDEAE

SEQ ID NO: 125354 - protein, 33 aa, Artificial Sequence
  Description of Artificial Sequence: Synthetic polypeptide
DEMEIVTTNPVATEQYGTVCSATDGPVWFEGND

SEQ ID NO: 125355 - protein, 33 aa, Artificial Sequence
  Description of Artificial Sequence: Synthetic polypeptide
DEMEIVTTNPVATEQYGTVCSATDGPVVYEGND

SEQ ID NO: 125356 - protein, 37 aa, Artificial Sequence
  Description of Artificial Sequence: Synthetic polypeptide
DECEICTTNPVATEQYGSVSTTNNQLQGNEQGTNTTD

SEQ ID NO: 125357 - protein, 33 aa, Artificial Sequence
  Description of Artificial Sequence: Synthetic polypeptide
DEMEIVTTNPVATEQYGTVCSATDGPVVFEGND

SEQ ID NO: 125358 - protein, 33 aa, Artificial Sequence
  Description of Artificial Sequence: Synthetic polypeptide
DEMEIVTTNPVATEQYGTVCSATDGPVTFEGND

SEQ ID NO: 125359 - protein, 28 aa, Artificial Sequence
  Description of Artificial Sequence: Synthetic peptide
QEDEIATTNPVATEQYGEAMEVCQHEEK

SEQ ID NO: 125360 - protein, 33 aa, Artificial Sequence
  Description of Artificial Sequence: Synthetic polypeptide
DEMEIVTTNPVATEQYGTVCSATDGPVSFEGND

SEQ ID NO: 125361 - protein, 28 aa, Artificial Sequence
  Description of Artificial Sequence: Synthetic peptide
QEDEIATTNPVATEQYGEAPEVCQHEEK

SEQ ID NO: 125362 - protein, 36 aa, Artificial Sequence
  Description of Artificial Sequence: Synthetic polypeptide
DECEICTTNPVATEQYGSVSTTNNQLNSEQGNNEEE

SEQ ID NO: 125363 - protein, 28 aa, Artificial Sequence
  Description of Artificial Sequence: Synthetic peptide
QEDEIATTNPVATEQYGELPEVCQPEEK

SEQ ID NO: 125364 - protein, 34 aa, Artificial Sequence
  Description of Artificial Sequence: Synthetic polypeptide
DEMEIVTTNPVATEQYGTVCSATDGPVQFEGNID

SEQ ID NO: 125365 - protein, 36 aa, Artificial Sequence
  Description of Artificial Sequence: Synthetic polypeptide
DECEICTTNPVATEQYGSVSTTNNQLNMEQGNNETT

SEQ ID NO: 125366 - protein, 33 aa, Artificial Sequence
  Description of Artificial Sequence: Synthetic polypeptide
QEDEIRTTNPVATEGFGSVSAINEGQDGEGENG

SEQ ID NO: 125367 - protein, 32 aa, Artificial Sequence
  Description of Artificial Sequence: Synthetic polypeptide
DEAEIATTNPVAYEQYGSTTAGNNLTDSGNDQ

SEQ ID NO: 125368 - protein, 33 aa, Artificial Sequence
  Description of Artificial Sequence: Synthetic polypeptide
DEMEIVTTNPVATEQYGTVCSATDGPVQFEGED

SEQ ID NO: 125369 - protein, 33 aa, Artificial Sequence
  Description of Artificial Sequence: Synthetic polypeptide
DEMEIVTTNPVATEQYGTVCSATDGPVPFQGND

SEQ ID NO: 125370 - protein, 37 aa, Artificial Sequence
  Description of Artificial Sequence: Synthetic polypeptide
DECEICTTNPVATEQYGSVSTTNNNLNDNQQGTNATD

SEQ ID NO: 125371 - protein, 33 aa, Artificial Sequence
  Description of Artificial Sequence: Synthetic polypeptide
DEMEIVTTNPVATEQYGTVCSATDGPVEWEGND

SEQ ID NO: 125372 - protein, 35 aa, Artificial Sequence
  Description of Artificial Sequence: Synthetic polypeptide
DEEEIRTTNPVATEQYGSVNNLTVELEVLDNNAQG

SEQ ID NO: 125373 - protein, 35 aa, Artificial Sequence
  Description of Artificial Sequence: Synthetic polypeptide
AEEEIRTTNPVATEQYGSVVVSVTNANQQEQETED

SEQ ID NO: 125374 - protein, 36 aa, Artificial Sequence
  Description of Artificial Sequence: Synthetic polypeptide
DEEEIRTTNPVATEQYGSVNNLTNHPDEIGNMEPTP

SEQ ID NO: 125375 - protein, 36 aa, Artificial Sequence
  Description of Artificial Sequence: Synthetic polypeptide
DEEEIRTTNPVATEQYGSVNNLTNHPDEEGNMEILP

SEQ ID NO: 125376 - protein, 36 aa, Artificial Sequence
  Description of Artificial Sequence: Synthetic polypeptide
DEEEIRTTNPVATEQYGSVNNLTNHNDEEGNSEITP

SEQ ID NO: 125377 - protein, 34 aa, Artificial Sequence
  Description of Artificial Sequence: Synthetic polypeptide
DEQEIRTTNPVATEQYGSSSTGHTSQQHEGEMTN

SEQ ID NO: 125378 - protein, 34 aa, Artificial Sequence
  Description of Artificial Sequence: Synthetic polypeptide
DEQEIRTTNPVATEQYGSSSTGTSQQEEGFEETN

SEQ ID NO: 125379 - protein, 33 aa, Artificial Sequence
  Description of Artificial Sequence: Synthetic polypeptide
DEMEIVTTNPVATEQYGTVCSATDGPVEPEGND

SEQ ID NO: 125380 - protein, 33 aa, Artificial Sequence
  Description of Artificial Sequence: Synthetic polypeptide
DEMEIVTTNPVATEQYGTVCSATDGPVEPEGNA

SEQ ID NO: 125381 - protein, 35 aa, Artificial Sequence
  Description of Artificial Sequence: Synthetic polypeptide
DEEEIRTTNPVATEQYGSVNNLTNHDEEGIMEIGV

SEQ ID NO: 125382 - protein, 33 aa, Artificial Sequence
  Description of Artificial Sequence: Synthetic polypeptide
DEMEIVTTNPVATEQYGTVCSATDGPVENEGND

SEQ ID NO: 125383 - protein, 36 aa, Artificial Sequence
  Description of Artificial Sequence: Synthetic polypeptide
DEEEIRTTNPVATEQYGSVNNLTLNHDEEGNMEIPV

SEQ ID NO: 125384 - protein, 33 aa, Artificial Sequence
  Description of Artificial Sequence: Synthetic polypeptide
DEMEIVTTNPVATEQYGTVCSATDGPVEMEGND

SEQ ID NO: 125385 - protein, 34 aa, Artificial Sequence
  Description of Artificial Sequence: Synthetic polypeptide
DEMEIVTTNPVATEQYGTVCSATDGPVELFEGND

SEQ ID NO: 125386 - protein, 33 aa, Artificial Sequence
  Description of Artificial Sequence: Synthetic polypeptide
DEMEIVTTNPVATEQYGTVCSATDGPVELEGND

SEQ ID NO: 125387 - protein, 34 aa, Artificial Sequence
  Description of Artificial Sequence: Synthetic polypeptide
DEEEIRTTNPVATEQYGSVNNEWEDNPGEEQNNP

SEQ ID NO: 125388 - protein, 34 aa, Artificial Sequence
  Description of Artificial Sequence: Synthetic polypeptide
DEQEIRTTNPVATEQYGSSSTGTSQQHEGIEGTN

SEQ ID NO: 125389 - protein, 31 aa, Artificial Sequence
  Description of Artificial Sequence: Synthetic polypeptide
DESEIATTNPVAYEQYGSVASSDPRENPNEE

SEQ ID NO: 125390 - protein, 34 aa, Artificial Sequence
  Description of Artificial Sequence: Synthetic polypeptide
DEEEIRTTNPVATEQYGSVNNEIEDNMGEEENNL

SEQ ID NO: 125391 - protein, 33 aa, Artificial Sequence
  Description of Artificial Sequence: Synthetic polypeptide
DEMEIVTTNPVATEQYGTVCSATDGPVEKEGND

SEQ ID NO: 125392 - protein, 33 aa, Artificial Sequence
  Description of Artificial Sequence: Synthetic polypeptide
DEMEIVTTNPVATEQYGTVCSATDGPVEIEGNQ

SEQ ID NO: 125393 - protein, 28 aa, Artificial Sequence
  Description of Artificial Sequence: Synthetic peptide
QEEEIAATNPVATEQYGEAPEVRQHEEK

SEQ ID NO: 125394 - protein, 33 aa, Artificial Sequence
  Description of Artificial Sequence: Synthetic polypeptide
DEMEIVTTNPVATEQYGTVCSATDGPWEFEGND

SEQ ID NO: 125395 - protein, 28 aa, Artificial Sequence
  Description of Artificial Sequence: Synthetic peptide
QEEEIAATNPVATEQYGEAPEVCQHEEK

SEQ ID NO: 125396 - protein, 28 aa, Artificial Sequence
  Description of Artificial Sequence: Synthetic peptide
QEEDIATTNPVATEQYGEAPEVCQHEEK

SEQ ID NO: 125397 - protein, 33 aa, Artificial Sequence
  Description of Artificial Sequence: Synthetic polypeptide
DEMEIVTTNPVATEQYGTVCSATDGPVEVEGND

SEQ ID NO: 125398 - protein, 33 aa, Artificial Sequence
  Description of Artificial Sequence: Synthetic polypeptide
DEMEIVTTNPVATEQYGTVCSATDGPVETEGND

SEQ ID NO: 125399 - protein, 34 aa, Artificial Sequence
  Description of Artificial Sequence: Synthetic polypeptide
DEMEIVTTNPVATEQYGTVCSATDGPVESRVGND

SEQ ID NO: 125400 - protein, 33 aa, Artificial Sequence
  Description of Artificial Sequence: Synthetic polypeptide
DEMEIVTTNPVATEQYGTVCSATDGPVESEGND

SEQ ID NO: 125401 - protein, 32 aa, Artificial Sequence
  Description of Artificial Sequence: Synthetic polypeptide
DEAEIATTNPVAYEQYGSTTAGNNDQNRQNDN

SEQ ID NO: 125402 - protein, 28 aa, Artificial Sequence
  Description of Artificial Sequence: Synthetic peptide
QEECIATTNPVATEQYGEAPEVCQHEEK

SEQ ID NO: 125403 - protein, 28 aa, Artificial Sequence
  Description of Artificial Sequence: Synthetic peptide
QEECIATTNPVATEQYGEAPEVCQHEEM

SEQ ID NO: 125404 - protein, 34 aa, Artificial Sequence
  Description of Artificial Sequence: Synthetic polypeptide
DEMEIVTTNPVATEQYGTVCSATDGPVERFEGND

SEQ ID NO: 125405 - protein, 28 aa, Artificial Sequence
  Description of Artificial Sequence: Synthetic peptide
QEECIATTNPVATEQYGEAPEVCQHEQK

SEQ ID NO: 125406 - protein, 28 aa, Artificial Sequence
  Description of Artificial Sequence: Synthetic peptide
QEECIATTNPVATEQYGEAPEVCQHYEK

SEQ ID NO: 125407 - protein, 34 aa, Artificial Sequence
  Description of Artificial Sequence: Synthetic polypeptide
DEMEIVTTNPVATEQYGTVCSATDGPVEREGFND

SEQ ID NO: 125408 - protein, 34 aa, Artificial Sequence
  Description of Artificial Sequence: Synthetic polypeptide
DEMEIVTTNPVATEQYGTVCSATDGPVEQFFGND

SEQ ID NO: 125409 - protein, 28 aa, Artificial Sequence
  Description of Artificial Sequence: Synthetic peptide
QEECIATTNPVATEQYGEAPEVWQHEEK

SEQ ID NO: 125410 - protein, 33 aa, Artificial Sequence
  Description of Artificial Sequence: Synthetic polypeptide
DEQEIRTTNPVATEQYGSSCHTETSQQHEGETN

SEQ ID NO: 125411 - protein, 32 aa, Artificial Sequence
  Description of Artificial Sequence: Synthetic polypeptide
DEAEISTTNPVATEQYGVVCSSELQNFPSDQS

SEQ ID NO: 125412 - protein, 32 aa, Artificial Sequence
  Description of Artificial Sequence: Synthetic polypeptide
DESEIATTNPVAYEQYGSVASSDQRENPNTEK

SEQ ID NO: 125413 - protein, 34 aa, Artificial Sequence
  Description of Artificial Sequence: Synthetic polypeptide
DEMEIVTTNPVATEQYGTVCSATDGPVEQFEGND

SEQ ID NO: 125414 - protein, 36 aa, Artificial Sequence
  Description of Artificial Sequence: Synthetic polypeptide
DEEEIRTTNPVATEQYGSVNNLTNHWDEEYNMEIRV

SEQ ID NO: 125415 - protein, 37 aa, Artificial Sequence
  Description of Artificial Sequence: Synthetic polypeptide
DECEICTTNPVATEQYGSVSTTNNLLNQNNQGNEEEE

SEQ ID NO: 125416 - protein, 29 aa, Artificial Sequence
  Description of Artificial Sequence: Synthetic peptide
QEEEIAATNPVATEQYGEAPETVCQHEEK

SEQ ID NO: 125417 - protein, 32 aa, Artificial Sequence
  Description of Artificial Sequence: Synthetic polypeptide
DECEIATTNPVAYEQWGVTSTNLNGGEHNNGQ

SEQ ID NO: 125418 - protein, 33 aa, Artificial Sequence
  Description of Artificial Sequence: Synthetic polypeptide
DEMEIVTTNPVATEQYGTVCSATDGPYEFEGND

SEQ ID NO: 125419 - protein, 36 aa, Artificial Sequence
  Description of Artificial Sequence: Synthetic polypeptide
DECEICTTNPVATEQYGSVSTTNNQNNMEQGNNQTE

SEQ ID NO: 125420 - protein, 33 aa, Artificial Sequence
  Description of Artificial Sequence: Synthetic polypeptide
DEMEIVTTNPVATEQYGTVCSATDRPVEFGGND

SEQ ID NO: 125421 - protein, 32 aa, Artificial Sequence
  Description of Artificial Sequence: Synthetic polypeptide
QECEICTTNPVATEAYGVVSTEQQLQQGSEEL

SEQ ID NO: 125422 - protein, 33 aa, Artificial Sequence
  Description of Artificial Sequence: Synthetic polypeptide
DEMEIVTTNPVATEQYGTVCSATDRPVEFEGND

SEQ ID NO: 125423 - protein, 33 aa, Artificial Sequence
  Description of Artificial Sequence: Synthetic polypeptide
DEMEIVTTNPVATEQYGTVCSATDQPVEFEGND

SEQ ID NO: 125424 - protein, 33 aa, Artificial Sequence
  Description of Artificial Sequence: Synthetic polypeptide
DEMEIVTTNPVATEQYGTVCSATDPPVFFEGND

SEQ ID NO: 125425 - protein, 33 aa, Artificial Sequence
  Description of Artificial Sequence: Synthetic polypeptide
DEMEIVTTNPVATEQYGTVCSATDPPVEFEGND

SEQ ID NO: 125426 - protein, 36 aa, Artificial Sequence
  Description of Artificial Sequence: Synthetic polypeptide
DECEICTTNPVATEQYGSVSTTNQQQGNQQGNNQTQ

SEQ ID NO: 125427 - protein, 36 aa, Artificial Sequence
  Description of Artificial Sequence: Synthetic polypeptide
DECEICTTNPVATEQYGSVSTTNQQQGNQQGNNEGD

SEQ ID NO: 125428 - protein, 33 aa, Artificial Sequence
  Description of Artificial Sequence: Synthetic polypeptide
DEMEIVTTNPVATEQYGTVCSATDSPVEAEGND

SEQ ID NO: 125429 - protein, 32 aa, Artificial Sequence
  Description of Artificial Sequence: Synthetic polypeptide
DESEIATTNPVGTECYGVVSCINEPQDHEGNG

SEQ ID NO: 125430 - protein, 33 aa, Artificial Sequence
  Description of Artificial Sequence: Synthetic polypeptide
DEAEIATTNPVAYEQYGSVAITHGEQTGELNEQ

SEQ ID NO: 125431 - protein, 33 aa, Artificial Sequence
  Description of Artificial Sequence: Synthetic polypeptide
DEAEIATTNPVAYEQYGSVAIANNDTQQDGNDN

SEQ ID NO: 125432 - protein, 35 aa, Artificial Sequence
  Description of Artificial Sequence: Synthetic polypeptide
DEEEIRTTNPVATEQYGSVNNPAENLDDQVESMDD

SEQ ID NO: 125433 - protein, 33 aa, Artificial Sequence
  Description of Artificial Sequence: Synthetic polypeptide
DEAEIATTNPVAYEQYGSVAIANNDTQGTGNDM

SEQ ID NO: 125434 - protein, 33 aa, Artificial Sequence
  Description of Artificial Sequence: Synthetic polypeptide
DEMEIVTTNPVATEQYGTVCSATDMPVEFEGND

SEQ ID NO: 125435 - protein, 36 aa, Artificial Sequence
  Description of Artificial Sequence: Synthetic polypeptide
DEEEIRTTNPVATEQYGTVCSTTPAGPEMRNGMNPD

SEQ ID NO: 125436 - protein, 36 aa, Artificial Sequence
  Description of Artificial Sequence: Synthetic polypeptide
DEEEIRTTNPVATEQYGTVCSTTPAGPNMRNGMNPD

SEQ ID NO: 125437 - protein, 33 aa, Artificial Sequence
  Description of Artificial Sequence: Synthetic polypeptide
DEMEIVTTNPVATEQYGTVCSATDKPVEMEGND

SEQ ID NO: 125438 - protein, 33 aa, Artificial Sequence
  Description of Artificial Sequence: Synthetic polypeptide
QECEICTTNPVATEAYGVVSTEQQNLQGNEEQL

SEQ ID NO: 125439 - protein, 33 aa, Artificial Sequence
  Description of Artificial Sequence: Synthetic polypeptide
DEMEIVTTNPVATEQYGTVCSATDSPVEFEGNA

SEQ ID NO: 125440 - protein, 33 aa, Artificial Sequence
  Description of Artificial Sequence: Synthetic polypeptide
DEMEIVTTNPVATEQYGTVCSATDSPVEFEGND

SEQ ID NO: 125441 - protein, 36 aa, Artificial Sequence
  Description of Artificial Sequence: Synthetic polypeptide
DECEICTTNPVATEQYGSVSTTNQQQGNQQGNQEEE

SEQ ID NO: 125442 - protein, 31 aa, Artificial Sequence
  Description of Artificial Sequence: Synthetic polypeptide
QECEICTTNPVATEAYGVVSTEQLSQGEEGQ

SEQ ID NO: 125443 - protein, 33 aa, Artificial Sequence
  Description of Artificial Sequence: Synthetic polypeptide
DEMEIVTTNPVATEQYGTVCSATEGPVEFEGND

SEQ ID NO: 125444 - protein, 36 aa, Artificial Sequence
  Description of Artificial Sequence: Synthetic polypeptide
DECEICTTNPVATEQYGSVSTTNQQQQEQQGNNNNE

SEQ ID NO: 125445 - protein, 33 aa, Artificial Sequence
  Description of Artificial Sequence: Synthetic polypeptide
DEMEIVTTNPVATEQYGTVCSATEDPVEFEGND

SEQ ID NO: 125446 - protein, 34 aa, Artificial Sequence
  Description of Artificial Sequence: Synthetic polypeptide
QECEICTTNPVATEAYGVVSTEQNLQAGNEEQDE

SEQ ID NO: 125447 - protein, 29 aa, Artificial Sequence
  Description of Artificial Sequence: Synthetic peptide
DESEIATTNPVGTEGWGVMASTLQDHGDI

SEQ ID NO: 125448 - protein, 36 aa, Artificial Sequence
  Description of Artificial Sequence: Synthetic polypeptide
DECEICTTNPVATEQYGSVSTTNQQQNNQQGNNQDE

SEQ ID NO: 125449 - protein, 33 aa, Artificial Sequence
  Description of Artificial Sequence: Synthetic polypeptide
QECEICTTNPVATEAYGVVSTEQQLQEGNEELQ

SEQ ID NO: 125450 - protein, 33 aa, Artificial Sequence
  Description of Artificial Sequence: Synthetic polypeptide
DEMEIVTTNPVATEQYGTVCSATDYPVEFEGND

SEQ ID NO: 125451 - protein, 33 aa, Artificial Sequence
  Description of Artificial Sequence: Synthetic polypeptide
DEMEIVTTNPVATEQYGTVCSATDWPVRFEGKD

SEQ ID NO: 125452 - protein, 33 aa, Artificial Sequence
  Description of Artificial Sequence: Synthetic polypeptide
DEMEIVTTNPVATEQYGTVCSATDWPVEFEGND

SEQ ID NO: 125453 - protein, 34 aa, Artificial Sequence
  Description of Artificial Sequence: Synthetic polypeptide
DEMEIVTTNPVATEQYGTVCSATDVQPVEFEGND

SEQ ID NO: 125454 - protein, 36 aa, Artificial Sequence
  Description of Artificial Sequence: Synthetic polypeptide
DECEICTTNPVATEQYGSVSTTNQQQGNQQGTEEDE

SEQ ID NO: 125455 - protein, 33 aa, Artificial Sequence
  Description of Artificial Sequence: Synthetic polypeptide
DEMEIVTTNPVATEQYGTVCSATDVPVEFEGNK

SEQ ID NO: 125456 - protein, 33 aa, Artificial Sequence
  Description of Artificial Sequence: Synthetic polypeptide
DEMEIVTTNPVATEQYGTVCSATDVPVEFEGND

SEQ ID NO: 125457 - protein, 34 aa, Artificial Sequence
  Description of Artificial Sequence: Synthetic polypeptide
DEMEIVTTNPVATEQYGTVCSATDTPVESFEGNR

SEQ ID NO: 125458 - protein, 33 aa, Artificial Sequence
  Description of Artificial Sequence: Synthetic polypeptide
DEMEIVTTNPVATEQYGTVCSATDTPVEKEGND

SEQ ID NO: 125459 - protein, 33 aa, Artificial Sequence
  Description of Artificial Sequence: Synthetic polypeptide
DEMEIVTTNPVATEQYGTVCSATDTPVEIEGND

SEQ ID NO: 125460 - protein, 33 aa, Artificial Sequence
  Description of Artificial Sequence: Synthetic polypeptide
DEMEIVTTNPVATEQYGTVCSATDTPVEFEGND

SEQ ID NO: 125461 - protein, 33 aa, Artificial Sequence
  Description of Artificial Sequence: Synthetic polypeptide
DEMEIVTTNPVATEQYGTVCSATDKPVEFEGND

SEQ ID NO: 125462 - protein, 36 aa, Artificial Sequence
  Description of Artificial Sequence: Synthetic polypeptide
DEEEIRTTNPVATEQYGTVCSTTPAGPNMRNGMNPV

SEQ ID NO: 125463 - protein, 30 aa, Artificial Sequence
  Description of Artificial Sequence: Synthetic polypeptide
QECEICTTNPVATEAYGVVSVELLQHEEDE

SEQ ID NO: 125464 - protein, 33 aa, Artificial Sequence
  Description of Artificial Sequence: Synthetic polypeptide
DEMEIVTTNPVATEQYGTVCSATDIPVEYEGND

SEQ ID NO: 125465 - protein, 33 aa, Artificial Sequence
  Description of Artificial Sequence: Synthetic polypeptide
DEMEIVTTNPVATEQYGTVCSATDGRVEFVGND

SEQ ID NO: 125466 - protein, 35 aa, Artificial Sequence
  Description of Artificial Sequence: Synthetic polypeptide
DECEICTTNPVATEQYGSVSTTNQLQEDTEETEDD

SEQ ID NO: 125467 - protein, 33 aa, Artificial Sequence
  Description of Artificial Sequence: Synthetic polypeptide
DEMEIVTTNPVATEQYGTVCSATDGRVEFEGND

SEQ ID NO: 125468 - protein, 34 aa, Artificial Sequence
  Description of Artificial Sequence: Synthetic polypeptide
DECEICTTNPVATEQYGSVSTTNQLMEDTEEEED

SEQ ID NO: 125469 - protein, 33 aa, Artificial Sequence
  Description of Artificial Sequence: Synthetic polypeptide
DEMEIVTTNPVATEQYGTVCSATDGRVEFAGND

SEQ ID NO: 125470 - protein, 36 aa, Artificial Sequence
  Description of Artificial Sequence: Synthetic polypeptide
DEEEIRTTNPVATEQYGSVNNNEVELEVLGNNNTQM

SEQ ID NO: 125471 - protein, 35 aa, Artificial Sequence
  Description of Artificial Sequence: Synthetic polypeptide
DEQEIRTTNPVATEQYGSCWWVPPTVYTQIGNEFD

SEQ ID NO: 125472 - protein, 34 aa, Artificial Sequence
  Description of Artificial Sequence: Synthetic polypeptide
DECEICTTNPVATEQYGSVSTTNQLLEDEEEEDD

SEQ ID NO: 125473 - protein, 34 aa, Artificial Sequence
  Description of Artificial Sequence: Synthetic polypeptide
DECEICTTNPVATEQYGSVSTTNQLEDTEEDETD

SEQ ID NO: 125474 - protein, 36 aa, Artificial Sequence
  Description of Artificial Sequence: Synthetic polypeptide
DEEEIRTTNPVATEQYGSVNNNEVELEVAGNKIPQD

SEQ ID NO: 125475 - protein, 34 aa, Artificial Sequence
  Description of Artificial Sequence: Synthetic polypeptide
DEMEIVTTNPVATEQYGTVCSATDGQVEFEGYND

SEQ ID NO: 125476 - protein, 33 aa, Artificial Sequence
  Description of Artificial Sequence: Synthetic polypeptide
DEAEIATTNPVAYEQYGSVAATADQRENPNTEK

SEQ ID NO: 125477 - protein, 36 aa, Artificial Sequence
  Description of Artificial Sequence: Synthetic polypeptide
DECEICTTNPVATEQYGSVSTTNNQNQQQQGTNTTD

SEQ ID NO: 125478 - protein, 34 aa, Artificial Sequence
  Description of Artificial Sequence: Synthetic polypeptide
DEMEIVTTNPVATEQYGTVCSATDGQPVEFEGND

SEQ ID NO: 125479 - protein, 33 aa, Artificial Sequence
  Description of Artificial Sequence: Synthetic polypeptide
DESEIATTNPVCTECWGSVSCINLPQDSEGENQ

SEQ ID NO: 125480 - protein, 32 aa, Artificial Sequence
  Description of Artificial Sequence: Synthetic polypeptide
DESEIATTNPVCTECWGSVSCINEPQSEGENG

SEQ ID NO: 125481 - protein, 33 aa, Artificial Sequence
  Description of Artificial Sequence: Synthetic polypeptide
DESEIATTNPVAYEQYGSVSCTDELTDHEGEDL

SEQ ID NO: 125482 - protein, 33 aa, Artificial Sequence
  Description of Artificial Sequence: Synthetic polypeptide
DESEIATTNPVAYEQYGSVSATDELEDHEGEDE

SEQ ID NO: 125483 - protein, 34 aa, Artificial Sequence
  Description of Artificial Sequence: Synthetic polypeptide
DEMEIVTTNPVATEQYGTVCSATDGPYEFEGNRD

SEQ ID NO: 125484 - protein, 28 aa, Artificial Sequence
  Description of Artificial Sequence: Synthetic peptide
QEDEIACTNPVGTEGYGVTASTLQHGDQ

SEQ ID NO: 125485 - protein, 36 aa, Artificial Sequence
  Description of Artificial Sequence: Synthetic polypeptide
DECEICTTNPVATEQYGSVSTTNNQNDNQQGTNVTD

SEQ ID NO: 125486 - protein, 33 aa, Artificial Sequence
  Description of Artificial Sequence: Synthetic polypeptide
DEMEIVTTNPVATEQYGTVCSATDGSVEFEGND

SEQ ID NO: 125487 - protein, 33 aa, Artificial Sequence
  Description of Artificial Sequence: Synthetic polypeptide
DEMEIVTTNPVATEQYGTVCSATDGVVEFEGND

SEQ ID NO: 125488 - protein, 34 aa, Artificial Sequence
  Description of Artificial Sequence: Synthetic polypeptide
DEQEIRTTNPVATEQYGSCSTLNDYEQFETQDEM

SEQ ID NO: 125489 - protein, 31 aa, Artificial Sequence
  Description of Artificial Sequence: Synthetic polypeptide
QECEICTTNPVATEAYGVVSVENQLLQGEEL

SEQ ID NO: 125490 - protein, 33 aa, Artificial Sequence
  Description of Artificial Sequence: Synthetic polypeptide
DEMEIVTTNPVATEQYGTVCSATDIPVEFEGND

SEQ ID NO: 125491 - protein, 30 aa, Artificial Sequence
  Description of Artificial Sequence: Synthetic polypeptide
QECEICTTNPVATEAYGVVSVEQLQGQEEL

SEQ ID NO: 125492 - protein, 31 aa, Artificial Sequence
  Description of Artificial Sequence: Synthetic polypeptide
QECEICTTNPVATEAYGVVSVEQLQQGEEQL

SEQ ID NO: 125493 - protein, 31 aa, Artificial Sequence
  Description of Artificial Sequence: Synthetic polypeptide
QECEICTTNPVATEAYGVVSVEQQLQGENEL

SEQ ID NO: 125494 - protein, 33 aa, Artificial Sequence
  Description of Artificial Sequence: Synthetic polypeptide
DEMEIVTTNPVATEQYGTVCSATDIPDEFEGND

SEQ ID NO: 125495 - protein, 33 aa, Artificial Sequence
  Description of Artificial Sequence: Synthetic polypeptide
DEMEIVTTNPVATEQYGTVCSATDICVEFEGND

SEQ ID NO: 125496 - protein, 33 aa, Artificial Sequence
  Description of Artificial Sequence: Synthetic polypeptide
DEMEIVTTNPVATEQYGTVCSATDHPVEFYGND

SEQ ID NO: 125497 - protein, 33 aa, Artificial Sequence
  Description of Artificial Sequence: Synthetic polypeptide
DEMEIVTTNPVATEQYGTVCSATDHPVEFEGND

SEQ ID NO: 125498 - protein, 31 aa, Artificial Sequence
  Description of Artificial Sequence: Synthetic polypeptide
DEAEIATTNPVAYEQYGSVAGAANQLDNPPT

SEQ ID NO: 125499 - protein, 33 aa, Artificial Sequence
  Description of Artificial Sequence: Synthetic polypeptide
DEMEIVTTNPVATEQYGTVCSATDGYVEFEGND

SEQ ID NO: 125500 - protein, 35 aa, Artificial Sequence
  Description of Artificial Sequence: Synthetic polypeptide
DECEICTTNPVATEQYGSVSTTNQQGNEEEEEEDD

SEQ ID NO: 125501 - protein, 34 aa, Artificial Sequence
  Description of Artificial Sequence: Synthetic polypeptide
DEEEIRTTNPVATEQYGSVNNNIVEDEVLDNVQD

SEQ ID NO: 125502 - protein, 33 aa, Artificial Sequence
  Description of Artificial Sequence: Synthetic polypeptide
DEMEIVTTNPVATEQYGTVCSATDGWVEFEGND

SEQ ID NO: 125503 - protein, 36 aa, Artificial Sequence
  Description of Artificial Sequence: Synthetic polypeptide
DEEEIRTTNPVATEQYGSVNNNEVPLEVLGNDETQD

SEQ ID NO: 125504 - protein, 33 aa, Artificial Sequence
  Description of Artificial Sequence: Synthetic polypeptide
DEMEIVTTNPVATEQYGTVCSATDGVVMFEGND

SEQ ID NO: 125505 - protein, 33 aa, Artificial Sequence
  Description of Artificial Sequence: Synthetic polypeptide
DEMEIVTTNPVATEQYGTVCSATDGVVHFEGND

SEQ ID NO: 125506 - protein, 34 aa, Artificial Sequence
  Description of Artificial Sequence: Synthetic polypeptide
DEMEIVTTNPVATEQYGTVCSATDGVVEFEGNDR

SEQ ID NO: 125507 - protein, 33 aa, Artificial Sequence
  Description of Artificial Sequence: Synthetic polypeptide
DEMEIVTTNPVATEQYGTVCSATDGTVEFEGND

SEQ ID NO: 125508 - protein, 28 aa, Artificial Sequence
  Description of Artificial Sequence: Synthetic peptide
EENEIATTNPVAYEKWGNVSECLQHEEE

SEQ ID NO: 125509 - protein, 31 aa, Artificial Sequence
  Description of Artificial Sequence: Synthetic polypeptide
DENEIRTTNPVATEQWGDVQEIEMNAAEDAR

SEQ ID NO: 125510 - protein, 34 aa, Artificial Sequence
  Description of Artificial Sequence: Synthetic polypeptide
DESEIRTTNPVATECWGSVSCIAAEPQDREGENG

SEQ ID NO: 125511 - protein, 35 aa, Artificial Sequence
  Description of Artificial Sequence: Synthetic polypeptide
DEAEIRTTNPVATEQYGSVCSLILQTEIGQMEDHN

SEQ ID NO: 125512 - protein, 35 aa, Artificial Sequence
  Description of Artificial Sequence: Synthetic polypeptide
DEAEIRTTNPVATEQYGSVCSLFDWQTEIGQNEDH

SEQ ID NO: 125513 - protein, 34 aa, Artificial Sequence
  Description of Artificial Sequence: Synthetic polypeptide
DEEEIRTTNPVATEQYGSVSTEVDPAHHEVESFI

SEQ ID NO: 125514 - protein, 35 aa, Artificial Sequence
  Description of Artificial Sequence: Synthetic polypeptide
DEEEIRTTNPVATEQYGSVSTEVGPSNASGETDIF

SEQ ID NO: 125515 - protein, 30 aa, Artificial Sequence
  Description of Artificial Sequence: Synthetic polypeptide
DESEIRTTNPVATEQWGVVSEIEMNAAEDI

SEQ ID NO: 125516 - protein, 35 aa, Artificial Sequence
  Description of Artificial Sequence: Synthetic polypeptide
DEEEIRTTNPVATEQYGSVSTEYDTEQAVSLQSVD

SEQ ID NO: 125517 - protein, 34 aa, Artificial Sequence
  Description of Artificial Sequence: Synthetic polypeptide
CEEEIGTTNPVGYERYGQNVSTNATSQRGGDNRM

SEQ ID NO: 125518 - protein, 37 aa, Artificial Sequence
  Description of Artificial Sequence: Synthetic polypeptide
DEEEIRTTNPVATEQYGSVSSNTPAGPNMRNGINPVV

SEQ ID NO: 125519 - protein, 37 aa, Artificial Sequence
  Description of Artificial Sequence: Synthetic polypeptide
DEEEIRTTNPVATEQYGSVSSNVPAEGPNMRNGMNPD

SEQ ID NO: 125520 - protein, 32 aa, Artificial Sequence
  Description of Artificial Sequence: Synthetic polypeptide
DENEIRTTNPVSTEPYGTHSVEDIQQQQNGNH

SEQ ID NO: 125521 - protein, 33 aa, Artificial Sequence
  Description of Artificial Sequence: Synthetic polypeptide
DEQEIATTNPVATEQYGCVATNPQEANDGTVQV

SEQ ID NO: 125522 - protein, 37 aa, Artificial Sequence
  Description of Artificial Sequence: Synthetic polypeptide
DEEEIRTTNPVATEQYGSVSSNTPAGGPNMRPGMNPV

SEQ ID NO: 125523 - protein, 30 aa, Artificial Sequence
  Description of Artificial Sequence: Synthetic polypeptide
DESEIRTTNPVATEQWGTVSEIEMNAAVDA

SEQ ID NO: 125524 - protein, 35 aa, Artificial Sequence
  Description of Artificial Sequence: Synthetic polypeptide
DEDEIRTTNPVATEQYGSVCATNPPMGQGNQTEGT

SEQ ID NO: 125525 - protein, 33 aa, Artificial Sequence
  Description of Artificial Sequence: Synthetic polypeptide
DEQEIATTNPVATEQYGCVATTNPQEAIGTVQN

SEQ ID NO: 125526 - protein, 32 aa, Artificial Sequence
  Description of Artificial Sequence: Synthetic polypeptide
DEVEIATTNPVATDQYGVVSTDEGQGGQGQQT

SEQ ID NO: 125527 - protein, 35 aa, Artificial Sequence
  Description of Artificial Sequence: Synthetic polypeptide
DEDEIRTTNPVATEQYGSVCSPTNNEERNDDTQES

SEQ ID NO: 125528 - protein, 34 aa, Artificial Sequence
  Description of Artificial Sequence: Synthetic polypeptide
DEDEIRTTNPVATEQYGSVCSVDGPGNHGPNEAM

SEQ ID NO: 125529 - protein, 31 aa, Artificial Sequence
  Description of Artificial Sequence: Synthetic polypeptide
DENEIRTTNPVSTEPYGTHSMEDIQQQNGNH

SEQ ID NO: 125530 - protein, 37 aa, Artificial Sequence
  Description of Artificial Sequence: Synthetic polypeptide
DESEIRTTNPVATEQYGAVVVGSTTGDLGQRGEGNID

SEQ ID NO: 125531 - protein, 34 aa, Artificial Sequence
  Description of Artificial Sequence: Synthetic polypeptide
DEDEIRTTNPVATEQYGSVCAATQLAAPAEPDNH

SEQ ID NO: 125532 - protein, 36 aa, Artificial Sequence
  Description of Artificial Sequence: Synthetic polypeptide
DEEEIRTTNPVATEQYGSVSSPHPAGPNMVNGMNPV

SEQ ID NO: 125533 - protein, 31 aa, Artificial Sequence
  Description of Artificial Sequence: Synthetic polypeptide
CEDEIACTNPVATEQYGCVAGTNLAMGDEQH

SEQ ID NO: 125534 - protein, 32 aa, Artificial Sequence
  Description of Artificial Sequence: Synthetic polypeptide
CEDEIACTNPVATEQYGCVAGTNLQMQDEARA

SEQ ID NO: 125535 - protein, 33 aa, Artificial Sequence
  Description of Artificial Sequence: Synthetic polypeptide
DEQEIATTNPVATEQYGCVAATGLQNAPEGQDN

SEQ ID NO: 125536 - protein, 33 aa, Artificial Sequence
  Description of Artificial Sequence: Synthetic polypeptide
DEQEIATTNPVATEQYGCVAATNDQDPAENATM

SEQ ID NO: 125537 - protein, 34 aa, Artificial Sequence
  Description of Artificial Sequence: Synthetic polypeptide
DEQEIATTNPVATEQYGCVAATNEPTQDGGGERH

SEQ ID NO: 125538 - protein, 36 aa, Artificial Sequence
  Description of Artificial Sequence: Synthetic polypeptide
DEEEIRTTNPVATEQYGSVSSPTYAGPNMRNGMSPV

SEQ ID NO: 125539 - protein, 32 aa, Artificial Sequence
  Description of Artificial Sequence: Synthetic polypeptide
DEQEIATTNPVATEQYGCVAATNLAVAPPDPE

SEQ ID NO: 125540 - protein, 35 aa, Artificial Sequence
  Description of Artificial Sequence: Synthetic polypeptide
DEAEIRTTNPVATEQYGSVSVDDMLLTIRGVEQSS

SEQ ID NO: 125541 - protein, 32 aa, Artificial Sequence
  Description of Artificial Sequence: Synthetic polypeptide
CEDEIACTNPVATEQYGCVAGTNLQTMNMENQ

SEQ ID NO: 125542 - protein, 37 aa, Artificial Sequence
  Description of Artificial Sequence: Synthetic polypeptide
DEEEIRTTNPVATEQYGSVSSPTPAGPNMRQGMNPVW

SEQ ID NO: 125543 - protein, 35 aa, Artificial Sequence
  Description of Artificial Sequence: Synthetic polypeptide
DEDEIATTNPVAYEQYGSVAGTNNLQAAPDGSWNN

SEQ ID NO: 125544 - protein, 35 aa, Artificial Sequence
  Description of Artificial Sequence: Synthetic polypeptide
DEAEIRTTNPVATEQYGSVSVEPPMNENRDGSIIE

SEQ ID NO: 125545 - protein, 34 aa, Artificial Sequence
  Description of Artificial Sequence: Synthetic polypeptide
DEQEIATTNPVATEQYGCVAATNPTADNGMDNRD

SEQ ID NO: 125546 - protein, 31 aa, Artificial Sequence
  Description of Artificial Sequence: Synthetic polypeptide
CEDEIACTNPVATEQYGCVATNHQAENAGMN

SEQ ID NO: 125547 - protein, 35 aa, Artificial Sequence
  Description of Artificial Sequence: Synthetic polypeptide
DEEEIRTTNPVATEQYGSVSTEQDPEQADEASDLE

SEQ ID NO: 125548 - protein, 34 aa, Artificial Sequence
  Description of Artificial Sequence: Synthetic polypeptide
DEDEIRTTNPVATEQYGSVCAATAQLAAAEPDNQ

SEQ ID NO: 125549 - protein, 33 aa, Artificial Sequence
  Description of Artificial Sequence: Synthetic polypeptide
DESEIRTTNPVATEQYGCVCSNWEHQNFNSNQG

SEQ ID NO: 125550 - protein, 32 aa, Artificial Sequence
  Description of Artificial Sequence: Synthetic polypeptide
DENEIRTTNPVSTEPYGTICMSDINQQQNGNH

SEQ ID NO: 125551 - protein, 36 aa, Artificial Sequence
  Description of Artificial Sequence: Synthetic polypeptide
DEEEIRTTNPVATEQYGSVSSPITAGPDMRVGMPVV

SEQ ID NO: 125552 - protein, 36 aa, Artificial Sequence
  Description of Artificial Sequence: Synthetic polypeptide
DEDEIRTTNPVATEQYGSVCTPNCLEETGYMEDMND

SEQ ID NO: 125553 - protein, 33 aa, Artificial Sequence
  Description of Artificial Sequence: Synthetic polypeptide
DEVEIATTNPVATDQYGVVSTGDGNQEGGENND

SEQ ID NO: 125554 - protein, 32 aa, Artificial Sequence
  Description of Artificial Sequence: Synthetic polypeptide
DENEIRTTNPVSTEPYGTCSMVDIQQQPQGNQ

SEQ ID NO: 125555 - protein, 32 aa, Artificial Sequence
  Description of Artificial Sequence: Synthetic polypeptide
DENEIRTTNPVSTEPYGTCSMVDIQIQQQGNH

SEQ ID NO: 125556 - protein, 33 aa, Artificial Sequence
  Description of Artificial Sequence: Synthetic polypeptide
DESEIRTTNPVATEQWGSVSCIDEPQDHEGEEL

SEQ ID NO: 125557 - protein, 33 aa, Artificial Sequence
  Description of Artificial Sequence: Synthetic polypeptide
DESEIRTTNPVATEQWGSVSCIDEPQDHEGEEG

SEQ ID NO: 125558 - protein, 34 aa, Artificial Sequence
  Description of Artificial Sequence: Synthetic polypeptide
DESEIRTTNPVATEQWGSVSACNEPEDHEGENDG

SEQ ID NO: 125559 - protein, 32 aa, Artificial Sequence
  Description of Artificial Sequence: Synthetic polypeptide
DEQEIATTNPVATEQYGDVSATDDEDHEGEDL

SEQ ID NO: 125560 - protein, 36 aa, Artificial Sequence
  Description of Artificial Sequence: Synthetic polypeptide
DEAEIRTTNPVATEQYGSVSVTAANTQTGQSEEFES

SEQ ID NO: 125561 - protein, 31 aa, Artificial Sequence
  Description of Artificial Sequence: Synthetic polypeptide
DENEIRTTNPVSTEPYGTASMEDIQQQNGNH

SEQ ID NO: 125562 - protein, 36 aa, Artificial Sequence
  Description of Artificial Sequence: Synthetic polypeptide
DEAEIRTTNPVATEQYGSVSVTAANTQTGQVPEQES

SEQ ID NO: 125563 - protein, 33 aa, Artificial Sequence
  Description of Artificial Sequence: Synthetic polypeptide
DEQEIATTNPVATEQYGDVSATDLEDHEGWEDL

SEQ ID NO: 125564 - protein, 36 aa, Artificial Sequence
  Description of Artificial Sequence: Synthetic polypeptide
DEEEIRTTNPVATEQYGSVSSLTPAGPNMRNEMNPV

SEQ ID NO: 125565 - protein, 32 aa, Artificial Sequence
  Description of Artificial Sequence: Synthetic polypeptide
DENEIRTTNPVSTEPYGTASMEDIQQLQNGNH

SEQ ID NO: 125566 - protein, 35 aa, Artificial Sequence
  Description of Artificial Sequence: Synthetic polypeptide
DEEEIRTTNPVATEQYGSVSSLNPDNMIFQEEMLI

SEQ ID NO: 125567 - protein, 37 aa, Artificial Sequence
  Description of Artificial Sequence: Synthetic polypeptide
DEEEIRTTNPVATEQYGSVSSKTPATGPNMRNGMNPV

SEQ ID NO: 125568 - protein, 36 aa, Artificial Sequence
  Description of Artificial Sequence: Synthetic polypeptide
DEAEIRTTNPVATEQYGSVSVTAINTQTGIGEEIES

SEQ ID NO: 125569 - protein, 35 aa, Artificial Sequence
  Description of Artificial Sequence: Synthetic polypeptide
DEAEIRTTNPVATEQYGSVSVTALLETGAGDDIQI

SEQ ID NO: 125570 - protein, 35 aa, Artificial Sequence
  Description of Artificial Sequence: Synthetic polypeptide
DENEIRTTNPVSTEPYGSVSSTTPDIQNQQNGNPV

SEQ ID NO: 125571 - protein, 35 aa, Artificial Sequence
  Description of Artificial Sequence: Synthetic polypeptide
DENEIRTTNPVSTEPYGSVSSTTPAIQNQQNGNPV

SEQ ID NO: 125572 - protein, 33 aa, Artificial Sequence
  Description of Artificial Sequence: Synthetic polypeptide
DESEIRTTNPVATEQWGSVSACIDEEDHEGENG

SEQ ID NO: 125573 - protein, 35 aa, Artificial Sequence
  Description of Artificial Sequence: Synthetic polypeptide
DENEIRTTNPVSTEPYGSVSSTTPAIPNQQNGNPV

SEQ ID NO: 125574 - protein, 34 aa, Artificial Sequence
  Description of Artificial Sequence: Synthetic polypeptide
DEDEIATTNPVAYEQYGSTVCAANGLQDADGNMD

SEQ ID NO: 125575 - protein, 34 aa, Artificial Sequence
  Description of Artificial Sequence: Synthetic polypeptide
DEQEIATTNPVATEQYGCVTAATANLQPVDANNN

SEQ ID NO: 125576 - protein, 33 aa, Artificial Sequence
  Description of Artificial Sequence: Synthetic polypeptide
DEDEIATTNPVAYEQYGSVAINPNLENNGGERQ

SEQ ID NO: 125577 - protein, 36 aa, Artificial Sequence
  Description of Artificial Sequence: Synthetic polypeptide
DEDEIRTTNPVATEQYGSVSSTTPAGPNMRNGMNPV

SEQ ID NO: 125578 - protein, 32 aa, Artificial Sequence
  Description of Artificial Sequence: Synthetic polypeptide
DEDEIATTNPVAYEQYGSVAAAGLTGAPGNPE

SEQ ID NO: 125579 - protein, 32 aa, Artificial Sequence
  Description of Artificial Sequence: Synthetic polypeptide
DENEIRTTNPVSTEPYGTCSMVDIQEHQPGNH

SEQ ID NO: 125580 - protein, 35 aa, Artificial Sequence
  Description of Artificial Sequence: Synthetic polypeptide
DEDEIRTTNPVATEQYGSVIVPTVDWLENGDNLQE

SEQ ID NO: 125581 - protein, 32 aa, Artificial Sequence
  Description of Artificial Sequence: Synthetic polypeptide
DEVEIATTNPVATDQYGVVVNTGEGQGGQGNT

SEQ ID NO: 125582 - protein, 35 aa, Artificial Sequence
  Description of Artificial Sequence: Synthetic polypeptide
DEEEIRTTNPVATEQYGSVSSNGNLEEPAFEVEEE

SEQ ID NO: 125583 - protein, 32 aa, Artificial Sequence
  Description of Artificial Sequence: Synthetic polypeptide
DENEIRTTNPVSTEPYGTCSMEDNKQQQNGNH

SEQ ID NO: 125584 - protein, 36 aa, Artificial Sequence
  Description of Artificial Sequence: Synthetic polypeptide
DESEIRTTNPVATEQWGSVSSTTPAGPQMRNGMNPV

SEQ ID NO: 125585 - protein, 36 aa, Artificial Sequence
  Description of Artificial Sequence: Synthetic polypeptide
DEDEIRTTNPVATEQYGSVSDTTPAGPNMRNGMNPV

SEQ ID NO: 125586 - protein, 33 aa, Artificial Sequence
  Description of Artificial Sequence: Synthetic polypeptide
DEQEIATTNPVATEQYGCVSANGGTDHQGGEDL

SEQ ID NO: 125587 - protein, 33 aa, Artificial Sequence
  Description of Artificial Sequence: Synthetic polypeptide
DEQEIATTNPVATEQYGCVSATDILEDHEGEDL

SEQ ID NO: 125588 - protein, 34 aa, Artificial Sequence
  Description of Artificial Sequence: Synthetic polypeptide
DEDEIATTNPVAYEQYGSVAATANGQAAPDGNNY

SEQ ID NO: 125589 - protein, 34 aa, Artificial Sequence
  Description of Artificial Sequence: Synthetic polypeptide
DEVEIATTNPVATECYGCVYCTNLDQHDDERGMS

SEQ ID NO: 125590 - protein, 36 aa, Artificial Sequence
  Description of Artificial Sequence: Synthetic polypeptide
DEDEIRTTNPVATEQYGSVSSTGEAGINPRDGMNPV

SEQ ID NO: 125591 - protein, 37 aa, Artificial Sequence
  Description of Artificial Sequence: Synthetic polypeptide
DEDEIRTTNPVATEQYGSVSSTNPEGPNMRNGMNPVD

SEQ ID NO: 125592 - protein, 34 aa, Artificial Sequence
  Description of Artificial Sequence: Synthetic polypeptide
DEAEIRTTNPVATEQYGSVSVSLWDHQPELLEQA

SEQ ID NO: 125593 - protein, 32 aa, Artificial Sequence
  Description of Artificial Sequence: Synthetic polypeptide
DEDEIATTNPVAYEQYGSVAAANNDTDMGNHQ

SEQ ID NO: 125594 - protein, 36 aa, Artificial Sequence
  Description of Artificial Sequence: Synthetic polypeptide
DEEEIRTTNPVATEQYGSVSSMVPAGMNMRNGMNPV

SEQ ID NO: 125595 - protein, 34 aa, Artificial Sequence
  Description of Artificial Sequence: Synthetic polypeptide
DEVEIATTNPVATECYGSVCFTENQQDQGQQGNH

SEQ ID NO: 125596 - protein, 32 aa, Artificial Sequence
  Description of Artificial Sequence: Synthetic polypeptide
DEQEIATTNPVATEQYGCVSNTDPEDHFGETL

SEQ ID NO: 125597 - protein, 32 aa, Artificial Sequence
  Description of Artificial Sequence: Synthetic polypeptide
DEQEIATTNPVATEQYGCVSNTEPEDHEGEDL

SEQ ID NO: 125598 - protein, 31 aa, Artificial Sequence
  Description of Artificial Sequence: Synthetic polypeptide
DEDEIATTNPVAYEQYGSVAAAGDEQDNGSE

SEQ ID NO: 125599 - protein, 33 aa, Artificial Sequence
  Description of Artificial Sequence: Synthetic polypeptide
DEVEIATTNPVATCQYGCVCSTAHQENFGSNQS

SEQ ID NO: 125600 - protein, 33 aa, Artificial Sequence
  Description of Artificial Sequence: Synthetic polypeptide
DEDEIATTNPVAYEQYGSVAITHGEQTRNGDDQ

SEQ ID NO: 125601 - protein, 36 aa, Artificial Sequence
  Description of Artificial Sequence: Synthetic polypeptide
DESEIRTTNPVATEQYGDVSTTLGFGQDEGETNNGG

SEQ ID NO: 125602 - protein, 34 aa, Artificial Sequence
  Description of Artificial Sequence: Synthetic polypeptide
DEAEIRTTNPVATEQYGSVCSLLQSESGQMEDHE

SEQ ID NO: 125603 - protein, 35 aa, Artificial Sequence
  Description of Artificial Sequence: Synthetic polypeptide
DEAEIRTTNPVATEQYGSVCSLLQSEMSGQNEDKI

SEQ ID NO: 125604 - protein, 35 aa, Artificial Sequence
  Description of Artificial Sequence: Synthetic polypeptide
DESEIRTTNPVATEQYGSVCSACDNPPEDFEGEND

SEQ ID NO: 125605 - protein, 34 aa, Artificial Sequence
  Description of Artificial Sequence: Synthetic polypeptide
DESEIRTTNPVATEQYGSVCPTMLLQEIPDDQDP

SEQ ID NO: 125606 - protein, 36 aa, Artificial Sequence
  Description of Artificial Sequence: Synthetic polypeptide
DEEEIRTTNPVATEQYGSVSSTEPAGPNMRNGMEPV

SEQ ID NO: 125607 - protein, 35 aa, Artificial Sequence
  Description of Artificial Sequence: Synthetic polypeptide
DESEIRTTNPVATEQYGSVCMPTIPLENRNESDND

SEQ ID NO: 125608 - protein, 36 aa, Artificial Sequence
  Description of Artificial Sequence: Synthetic polypeptide
DESEIRTTNPVATEQYGSVAATNPDGPNMRNGMNSV

SEQ ID NO: 125609 - protein, 36 aa, Artificial Sequence
  Description of Artificial Sequence: Synthetic polypeptide
DEEEIRTTNPVATEQYGSVSSTEPAGPNMHNEMNPV

SEQ ID NO: 125610 - protein, 35 aa, Artificial Sequence
  Description of Artificial Sequence: Synthetic polypeptide
DEEEIRTTNPVATEQYGSVSTENDDAADDASDLEH

SEQ ID NO: 125611 - protein, 34 aa, Artificial Sequence
  Description of Artificial Sequence: Synthetic polypeptide
DEDEIRTTNPVATEQYGSCSAGNALGQHPDAQMN

SEQ ID NO: 125612 - protein, 36 aa, Artificial Sequence
  Description of Artificial Sequence: Synthetic polypeptide
DESEIRTTNPVATEQYGSSYSTVNMLEQSAGGSLQE

SEQ ID NO: 125613 - protein, 34 aa, Artificial Sequence
  Description of Artificial Sequence: Synthetic polypeptide
DESEIRTTNPVATEQYGSISSIGTSQQAEGEEWN

SEQ ID NO: 125614 - protein, 32 aa, Artificial Sequence
  Description of Artificial Sequence: Synthetic polypeptide
DENEIRTTNPVSTEPYGTISAMDLQQQHNGNH

SEQ ID NO: 125615 - protein, 32 aa, Artificial Sequence
  Description of Artificial Sequence: Synthetic polypeptide
DETTIATTNPVATEFYGDVDDTNGQGGQGNQG

SEQ ID NO: 125616 - protein, 34 aa, Artificial Sequence
  Description of Artificial Sequence: Synthetic polypeptide
DETTICTTNPVATEQYGDVVSIMNLDQEGGDNDD

SEQ ID NO: 125617 - protein, 31 aa, Artificial Sequence
  Description of Artificial Sequence: Synthetic polypeptide
DENEIRTTNPVSTEPYGTISAMDIQQQNGNH

SEQ ID NO: 125618 - protein, 31 aa, Artificial Sequence
  Description of Artificial Sequence: Synthetic polypeptide
DENEIRTTNPVSTEPYGTISAMDIQQQEGNH

SEQ ID NO: 125619 - protein, 31 aa, Artificial Sequence
  Description of Artificial Sequence: Synthetic polypeptide
DENEIRTTNPVSTEPYGTISAMDIQDQEGNH

SEQ ID NO: 125620 - protein, 32 aa, Artificial Sequence
  Description of Artificial Sequence: Synthetic polypeptide
DETTIGTTNPVATEQYGSVDQINGQGGGQGEQ

SEQ ID NO: 125621 - protein, 34 aa, Artificial Sequence
  Description of Artificial Sequence: Synthetic polypeptide
DEAEIRTTNPVATEQYGSVCSLLQTEATGQMEDH

SEQ ID NO: 125622 - protein, 32 aa, Artificial Sequence
  Description of Artificial Sequence: Synthetic polypeptide
DEQEIATTNPVATEQYGCVAANGDATNGDPRQ

SEQ ID NO: 125623 - protein, 39 aa, Artificial Sequence
  Description of Artificial Sequence: Synthetic polypeptide
DEEEIRTTNPVATEQYGSVSTVNLQQGNTEQGTNQQDTE

SEQ ID NO: 125624 - protein, 34 aa, Artificial Sequence
  Description of Artificial Sequence: Synthetic polypeptide
DEQEIATTNPVATEQYGCSVISATDLEDHEGEDL

SEQ ID NO: 125625 - protein, 30 aa, Artificial Sequence
  Description of Artificial Sequence: Synthetic polypeptide
AENEIRCTNPVATEPYGTISEDIQQRNGGH

SEQ ID NO: 125626 - protein, 35 aa, Artificial Sequence
  Description of Artificial Sequence: Synthetic polypeptide
DEDEIRTTNPVATEQYGQSVSCTGHMPSQGGGSGI

SEQ ID NO: 125627 - protein, 30 aa, Artificial Sequence
  Description of Artificial Sequence: Synthetic polypeptide
AENEIRCTNPVATEPYGEISEDIQQRNGGH

SEQ ID NO: 125628 - protein, 32 aa, Artificial Sequence
  Description of Artificial Sequence: Synthetic polypeptide
DENEIRTTNPVSTEPYGTISCENIQQQQNGNH

SEQ ID NO: 125629 - protein, 33 aa, Artificial Sequence
  Description of Artificial Sequence: Synthetic polypeptide
DEQEIATTNPVATEQYFSVSATKDLEDHEGEDL

SEQ ID NO: 125630 - protein, 33 aa, Artificial Sequence
  Description of Artificial Sequence: Synthetic polypeptide
DEQEIATTNPVATEQYGALVSATDLEDHEGEDL

SEQ ID NO: 125631 - protein, 32 aa, Artificial Sequence
  Description of Artificial Sequence: Synthetic polypeptide
DENEIRTTNPVSTEPYGTISCENIQQQQNGNG

SEQ ID NO: 125632 - protein, 36 aa, Artificial Sequence
  Description of Artificial Sequence: Synthetic polypeptide
DESEIRTTNPVATEQYGSVITSDGQNGQGQGGENEN

SEQ ID NO: 125633 - protein, 32 aa, Artificial Sequence
  Description of Artificial Sequence: Synthetic polypeptide
DENEIRTTNPVSTEPYGTISCENIQQDQNGNG

SEQ ID NO: 125634 - protein, 32 aa, Artificial Sequence
  Description of Artificial Sequence: Synthetic polypeptide
DENEIRTTNPVSTEPYGTISCENIPQQQNGNH

SEQ ID NO: 125635 - protein, 39 aa, Artificial Sequence
  Description of Artificial Sequence: Synthetic polypeptide
DEEEIRTTNPVATEQYGSVSTVNLQQNNTEQGTNNNTTE

SEQ ID NO: 125636 - protein, 34 aa, Artificial Sequence
  Description of Artificial Sequence: Synthetic polypeptide
DEQEIATTNPVATEQYGASVSATDLEDHEGMEDL

SEQ ID NO: 125637 - protein, 34 aa, Artificial Sequence
  Description of Artificial Sequence: Synthetic polypeptide
CECEIRTTNPVGYERWGQSVSTNAVSQRGGDNRM

SEQ ID NO: 125638 - protein, 36 aa, Artificial Sequence
  Description of Artificial Sequence: Synthetic polypeptide
DESEIRTTNPVATEQYGSVIEPWWHLQDDRDENQRD

SEQ ID NO: 125639 - protein, 39 aa, Artificial Sequence
  Description of Artificial Sequence: Synthetic polypeptide
DEEEIRTTNPVATEQYGSVSTVNLQQLQAGTEQGTNEED

SEQ ID NO: 125640 - protein, 31 aa, Artificial Sequence
  Description of Artificial Sequence: Synthetic polypeptide
DENEIRTTNPVSTEPYGTISCEDIQQQQGNH

SEQ ID NO: 125641 - protein, 35 aa, Artificial Sequence
  Description of Artificial Sequence: Synthetic polypeptide
DESEIRTTNPVATEQYGSVIDTGPNGQGEGGGQES

SEQ ID NO: 125642 - protein, 35 aa, Artificial Sequence
  Description of Artificial Sequence: Synthetic polypeptide
DEAEIRTTNPVATEQYGSVCSLLSQSEIGQNEDKV

SEQ ID NO: 125643 - protein, 33 aa, Artificial Sequence
  Description of Artificial Sequence: Synthetic polypeptide
DEDEIATTNPVAYEQYGSVATPHLQDSMGDDEM

SEQ ID NO: 125644 - protein, 35 aa, Artificial Sequence
  Description of Artificial Sequence: Synthetic polypeptide
DEAEIRTTNPVATEQYGSVCSLLQTEDLGQMEDHS

SEQ ID NO: 125645 - protein, 35 aa, Artificial Sequence
  Description of Artificial Sequence: Synthetic polypeptide
DENEIRTTNPVSTEPYGSVSSTTPAIPNMQNGNPV

SEQ ID NO: 125646 - protein, 36 aa, Artificial Sequence
  Description of Artificial Sequence: Synthetic polypeptide
DESEIRTTNPVATEQYGSCVSTIMLEELENGNEEVF

SEQ ID NO: 125647 - protein, 34 aa, Artificial Sequence
  Description of Artificial Sequence: Synthetic polypeptide
DEDEIATTNPVAYEQYGSVATNLDQATPGDETDH

SEQ ID NO: 125648 - protein, 31 aa, Artificial Sequence
  Description of Artificial Sequence: Synthetic polypeptide
CEDEIACTNPVATEQYGCASANLQEAGDGQA

SEQ ID NO: 125649 - protein, 33 aa, Artificial Sequence
  Description of Artificial Sequence: Synthetic polypeptide
DETVEIATTNPVAYEKWGSVATNLQGDLGGNGS

SEQ ID NO: 125650 - protein, 32 aa, Artificial Sequence
  Description of Artificial Sequence: Synthetic polypeptide
DETVIGTTNPVATEQHGSSYVSRDFIQGGNNA

SEQ ID NO: 125651 - protein, 33 aa, Artificial Sequence
  Description of Artificial Sequence: Synthetic polypeptide
DETVIQTTNPVAYEQWGCVVACTNPSQRNGNER

SEQ ID NO: 125652 - protein, 31 aa, Artificial Sequence
  Description of Artificial Sequence: Synthetic polypeptide
CEDEIACTNPVATEQYGCASANLQEAGGQLV

SEQ ID NO: 125653 - protein, 33 aa, Artificial Sequence
  Description of Artificial Sequence: Synthetic polypeptide
DEDEIATTNPVAYEQYGSVAMNLNPRDQTEGRN

SEQ ID NO: 125654 - protein, 36 aa, Artificial Sequence
  Description of Artificial Sequence: Synthetic polypeptide
DEDEIRTTNPVATEQYGSVATTQLGQQIGTTEEGNE

SEQ ID NO: 125655 - protein, 36 aa, Artificial Sequence
  Description of Artificial Sequence: Synthetic polypeptide
DEEEIRTTNPVATEQYGSVSSSTPAGPNMRVEMNPV

SEQ ID NO: 125656 - protein, 33 aa, Artificial Sequence
  Description of Artificial Sequence: Synthetic polypeptide
DEVEECTTNPVAYEHWGSVSTGQLGDIQGGNQR

SEQ ID NO: 125657 - protein, 36 aa, Artificial Sequence
  Description of Artificial Sequence: Synthetic polypeptide
DEEEIRTTNPVATEQYGSVSSSTPAGPNMRNIMNPV

SEQ ID NO: 125658 - protein, 36 aa, Artificial Sequence
  Description of Artificial Sequence: Synthetic polypeptide
DEDEIRTTNPVATEQYGSVATTQQQLQAGTTENSNE

SEQ ID NO: 125659 - protein, 37 aa, Artificial Sequence
  Description of Artificial Sequence: Synthetic polypeptide
DEEEIRTTNPVATEQYGSVSSSSNWNISVRVGELNET

SEQ ID NO: 125660 - protein, 37 aa, Artificial Sequence
  Description of Artificial Sequence: Synthetic polypeptide
DEEEIRTTNPVATEQYGSVSSSSNWNILMRVGEEAET

SEQ ID NO: 125661 - protein, 32 aa, Artificial Sequence
  Description of Artificial Sequence: Synthetic polypeptide
DEVEIATTNPCAYEPWGSVTTNLGGNAGENAR

SEQ ID NO: 125662 - protein, 37 aa, Artificial Sequence
  Description of Artificial Sequence: Synthetic polypeptide
DEEEIRTTNPVATEQYGSVSSSSNWNIEERVGELNPT

SEQ ID NO: 125663 - protein, 30 aa, Artificial Sequence
  Description of Artificial Sequence: Synthetic polypeptide
CEDEIACTNPVATEQYGCNATNHQAEDPRN

SEQ ID NO: 125664 - protein, 34 aa, Artificial Sequence
  Description of Artificial Sequence: Synthetic polypeptide
DEEEIRTTNPVATEQYGSVSSSEPEEIRVEEVDQ

SEQ ID NO: 125665 - protein, 37 aa, Artificial Sequence
  Description of Artificial Sequence: Synthetic polypeptide
DEEEIRTTNPVATEQYGSVSSSENWSISPRVGELNPT

SEQ ID NO: 125666 - protein, 35 aa, Artificial Sequence
  Description of Artificial Sequence: Synthetic polypeptide
DESEIRTTNPVATEQYGEIVVHATDNDLYVMGKNF

SEQ ID NO: 125667 - protein, 32 aa, Artificial Sequence
  Description of Artificial Sequence: Synthetic polypeptide
DEDEIATTNPVAYEQYGSVANMHGETQGGNTE

SEQ ID NO: 125668 - protein, 37 aa, Artificial Sequence
  Description of Artificial Sequence: Synthetic polypeptide
DEEEIRTTNPVATEQYGSVSSTDPAGPNMRNGMNPVG

SEQ ID NO: 125669 - protein, 32 aa, Artificial Sequence
  Description of Artificial Sequence: Synthetic polypeptide
CEDEIACTNPVATEQYGCASANLQDMPMGQRM

SEQ ID NO: 125670 - protein, 30 aa, Artificial Sequence
  Description of Artificial Sequence: Synthetic polypeptide
DEDEIATTNPVAYEQYGSVASSDQAEAPGD

SEQ ID NO: 125671 - protein, 33 aa, Artificial Sequence
  Description of Artificial Sequence: Synthetic polypeptide
DEDEIATTNPVAYEQYGSVATNLADTGGGDEMG

SEQ ID NO: 125672 - protein, 34 aa, Artificial Sequence
  Description of Artificial Sequence: Synthetic polypeptide
DETTIRTTNPVATEGYGSVADMTNLIGGGDNDDE

SEQ ID NO: 125673 - protein, 35 aa, Artificial Sequence
  Description of Artificial Sequence: Synthetic polypeptide
DEDEIATTNPVAYEQYGSVATNANLPQANGHMNNL

SEQ ID NO: 125674 - protein, 33 aa, Artificial Sequence
  Description of Artificial Sequence: Synthetic polypeptide
DEDEIATTNPVAYEQYGSVATNAGTPTRNNDEL

SEQ ID NO: 125675 - protein, 33 aa, Artificial Sequence
  Description of Artificial Sequence: Synthetic polypeptide
DEQEIATTNPVATEQYGCVAANGDQNTPGNPVN

SEQ ID NO: 125676 - protein, 34 aa, Artificial Sequence
  Description of Artificial Sequence: Synthetic polypeptide
DEDEIRTTNPVATEQYGSSHVGTSQQHFGSEEQQ

SEQ ID NO: 125677 - protein, 35 aa, Artificial Sequence
  Description of Artificial Sequence: Synthetic polypeptide
DEDEIRTTNPVATEQYGSVATTQAGQQIGTTENNE

SEQ ID NO: 125678 - protein, 33 aa, Artificial Sequence
  Description of Artificial Sequence: Synthetic polypeptide
DEQEIATTNPVATEQYGCVAANGDTNTMGGNPQ

SEQ ID NO: 125679 - protein, 32 aa, Artificial Sequence
  Description of Artificial Sequence: Synthetic polypeptide
DEQEIATTNPVATEQYGCVAANGDTTGGDPRW

SEQ ID NO: 125680 - protein, 33 aa, Artificial Sequence
  Description of Artificial Sequence: Synthetic polypeptide
DETTIRTTNPVATEQYGSVADFNLIGGGDIGDG

SEQ ID NO: 125681 - protein, 32 aa, Artificial Sequence
  Description of Artificial Sequence: Synthetic polypeptide
DEQEIATTNPVATEQYGCVAANGDTTGGGNPL

SEQ ID NO: 125682 - protein, 35 aa, Artificial Sequence
  Description of Artificial Sequence: Synthetic polypeptide
DEDEIRTTNPVATEQYGSVATTQALQTATTTNNNE

SEQ ID NO: 125683 - protein, 34 aa, Artificial Sequence
  Description of Artificial Sequence: Synthetic polypeptide
DEDEIATTNPVAYEQYGSVATHLPQDSMGGDLNH

SEQ ID NO: 125684 - protein, 34 aa, Artificial Sequence
  Description of Artificial Sequence: Synthetic polypeptide
DETTIRTTNPVATEQYGSVADMTNLIGGGDGGDE

SEQ ID NO: 125685 - protein, 35 aa, Artificial Sequence
  Description of Artificial Sequence: Synthetic polypeptide
DETTIRTTNPVATEQYGSVADMTNLITGGGDNGDE

SEQ ID NO: 125686 - protein, 33 aa, Artificial Sequence
  Description of Artificial Sequence: Synthetic polypeptide
DETTIRTTNPVATEQYGSVMGDGGNDNGQEGGT

SEQ ID NO: 125687 - protein, 34 aa, Artificial Sequence
  Description of Artificial Sequence: Synthetic polypeptide
DETTIRTTNPVATEQYGSVSGDGGGDNLGQEEGM

SEQ ID NO: 125688 - protein, 32 aa, Artificial Sequence
  Description of Artificial Sequence: Synthetic polypeptide
CEDEIACTNPVATEQYGCAASANNLQTMPGQR

SEQ ID NO: 125689 - protein, 32 aa, Artificial Sequence
  Description of Artificial Sequence: Synthetic polypeptide
DEDEIATTNPVAYEQYGSVATAGAQGMNPNHE

SEQ ID NO: 125690 - protein, 33 aa, Artificial Sequence
  Description of Artificial Sequence: Synthetic polypeptide
DETTIRTTNPVATEQYGSVVGDGGGDNGQEGGQ

SEQ ID NO: 125691 - protein, 32 aa, Artificial Sequence
  Description of Artificial Sequence: Synthetic polypeptide
DESEIRTTNPVATEQWGSVSACDEEDHEGEEG

SEQ ID NO: 125692 - protein, 34 aa, Artificial Sequence
  Description of Artificial Sequence: Synthetic polypeptide
DEAEIRTTNPVATEQYGSVCSLDQTEIGQNEDTN

SEQ ID NO: 125693 - protein, 35 aa, Artificial Sequence
  Description of Artificial Sequence: Synthetic polypeptide
DEAEIRTTNPVATEQYGSVCSKEGNVEGGNVQIED

SEQ ID NO: 125694 - protein, 31 aa, Artificial Sequence
  Description of Artificial Sequence: Synthetic polypeptide
AENEIATTNPVATEQYGTASEENIQQQNGGH

SEQ ID NO: 125695 - protein, 36 aa, Artificial Sequence
  Description of Artificial Sequence: Synthetic polypeptide
DEEEIRTTNPVATEQYGSVSSATPDGPNDHEGMEDV

SEQ ID NO: 125696 - protein, 36 aa, Artificial Sequence
  Description of Artificial Sequence: Synthetic polypeptide
DEEEIRTTNPVATEQYGSVSSATPDGPEMREGMEDV

SEQ ID NO: 125697 - protein, 33 aa, Artificial Sequence
  Description of Artificial Sequence: Synthetic polypeptide
DEQEIATTNPVATEQYGLVTSATDLEDHEGEDL

SEQ ID NO: 125698 - protein, 33 aa, Artificial Sequence
  Description of Artificial Sequence: Synthetic polypeptide
DEVEIATTNPVATEQYGEVCSATDGPVEAEGND

SEQ ID NO: 125699 - protein, 32 aa, Artificial Sequence
  Description of Artificial Sequence: Synthetic polypeptide
DENEIRTTNPVSTEPYGGISVEDNNQQQGGEH

SEQ ID NO: 125700 - protein, 37 aa, Artificial Sequence
  Description of Artificial Sequence: Synthetic polypeptide
DEAEIRTTNPVATEQYGSVSVTHTNLTETRNGQEDDN

SEQ ID NO: 125701 - protein, 32 aa, Artificial Sequence
  Description of Artificial Sequence: Synthetic polypeptide
DENEIRTTNPVSTEPYGGISVEDEQQQQHGNH

SEQ ID NO: 125702 - protein, 32 aa, Artificial Sequence
  Description of Artificial Sequence: Synthetic polypeptide
DENEIRTTNPVSTEPYGGISVEDENQQHNGEH

SEQ ID NO: 125703 - protein, 38 aa, Artificial Sequence
  Description of Artificial Sequence: Synthetic polypeptide
DEEEIRTTNPVATEQYGSVSTVNDQAGVTNVTEEEETD

SEQ ID NO: 125704 - protein, 33 aa, Artificial Sequence
  Description of Artificial Sequence: Synthetic polypeptide
DEQEIATTNPVATEQYGMVSATDLEDHEGYEDL

SEQ ID NO: 125705 - protein, 32 aa, Artificial Sequence
  Description of Artificial Sequence: Synthetic polypeptide
DEQEIATTNPVATEQYGMVSATDWEDHEGEDL

SEQ ID NO: 125706 - protein, 36 aa, Artificial Sequence
  Description of Artificial Sequence: Synthetic polypeptide
DEEEIRTTNPVATEQYGSVSSATPAGVEMFNGMNPV

SEQ ID NO: 125707 - protein, 36 aa, Artificial Sequence
  Description of Artificial Sequence: Synthetic polypeptide
DEEEIRTTNPVATEQYGSVSSATPAGVEMFNGMNPD

SEQ ID NO: 125708 - protein, 33 aa, Artificial Sequence
  Description of Artificial Sequence: Synthetic polypeptide
AENEIATTNPVATEQYGSASSTTAGPNRNGMNV

SEQ ID NO: 125709 - protein, 36 aa, Artificial Sequence
  Description of Artificial Sequence: Synthetic polypeptide
DEEEIRTTNPVATEQYGSVSSATPAGPNMRNGMEPV

SEQ ID NO: 125710 - protein, 32 aa, Artificial Sequence
  Description of Artificial Sequence: Synthetic polypeptide
DESEIRTTNPVATEQWGDVSCEGEMNAAEGDA

SEQ ID NO: 125711 - protein, 30 aa, Artificial Sequence
  Description of Artificial Sequence: Synthetic polypeptide
DESEIRTTNPVATEQWGDVSAIEMNAAEDA

SEQ ID NO: 125712 - protein, 30 aa, Artificial Sequence
  Description of Artificial Sequence: Synthetic polypeptide
DESEIRTTNPVATEQWGDVAETEMNAAEDA

SEQ ID NO: 125713 - protein, 36 aa, Artificial Sequence
  Description of Artificial Sequence: Synthetic polypeptide
DEEEIRTTNPVATEQYGSVSSATPDGPNDREGMEDV

SEQ ID NO: 125714 - protein, 33 aa, Artificial Sequence
  Description of Artificial Sequence: Synthetic polypeptide
DEQEIATTNPVATEQYGNSVSATDQEDHEGEDL

SEQ ID NO: 125715 - protein, 36 aa, Artificial Sequence
  Description of Artificial Sequence: Synthetic polypeptide
DEEEIRTTNPVATEQYGSVSSATPDGPNMREGMEDV

SEQ ID NO: 125716 - protein, 34 aa, Artificial Sequence
  Description of Artificial Sequence: Synthetic polypeptide
DEVEIATTNPVATEQYGCVCTIEGNQDQGGGNQK

SEQ ID NO: 125717 - protein, 33 aa, Artificial Sequence
  Description of Artificial Sequence: Synthetic polypeptide
DEVEIATTNPVATEQYGCVAATNDATMPPGERN

SEQ ID NO: 125718 - protein, 31 aa, Artificial Sequence
  Description of Artificial Sequence: Synthetic polypeptide
DESEIRTTNPVATEQWGDVSEIEMNRAEEDA

SEQ ID NO: 125719 - protein, 30 aa, Artificial Sequence
  Description of Artificial Sequence: Synthetic polypeptide
DESEIRTTNPVATEQWGDVSEIEMNPAEDA

SEQ ID NO: 125720 - protein, 30 aa, Artificial Sequence
  Description of Artificial Sequence: Synthetic polypeptide
DESEIRTTNPVATEQWGDVSEIEMNAAEDI

SEQ ID NO: 125721 - protein, 30 aa, Artificial Sequence
  Description of Artificial Sequence: Synthetic polypeptide
DESEIRTTNPVATEQWGDVSEIEMNAAEDA

SEQ ID NO: 125722 - protein, 32 aa, Artificial Sequence
  Description of Artificial Sequence: Synthetic polypeptide
DEQEIATTNPVATEQYGKVDATDLEDHEGEDL

SEQ ID NO: 125723 - protein, 32 aa, Artificial Sequence
  Description of Artificial Sequence: Synthetic polypeptide
DEQEIATTNPVATEQYGKVSATCLEDWEVEDL

SEQ ID NO: 125724 - protein, 36 aa, Artificial Sequence
  Description of Artificial Sequence: Synthetic polypeptide
DEEEIRTTNPVATEQYGSVSSCTPAGPNYRNLMNPV

SEQ ID NO: 125725 - protein, 36 aa, Artificial Sequence
  Description of Artificial Sequence: Synthetic polypeptide
DEEEIRTTNPVATEQYGSVSSCTPAGPNMRNGMVPV

SEQ ID NO: 125726 - protein, 35 aa, Artificial Sequence
  Description of Artificial Sequence: Synthetic polypeptide
DEAEIRTTNPVATEQYGSVCFTDTELDTGSSNDEY

SEQ ID NO: 125727 - protein, 33 aa, Artificial Sequence
  Description of Artificial Sequence: Synthetic polypeptide
DEQEIATTNPVATEQYGLIVSATDLEDHEGEDL

SEQ ID NO: 125728 - protein, 38 aa, Artificial Sequence
  Description of Artificial Sequence: Synthetic polypeptide
DEEEIRTTNPVATEQYGSVSTVNDQSGSTNVTEEETED

SEQ ID NO: 125729 - protein, 38 aa, Artificial Sequence
  Description of Artificial Sequence: Synthetic polypeptide
DEEEIRTTNPVATEQYGSVSTVNDQQGTTNVTTEEGQD

SEQ ID NO: 125730 - protein, 38 aa, Artificial Sequence
  Description of Artificial Sequence: Synthetic polypeptide
DEEEIRTTNPVATEQYGSVSTVNDQQGTTNVTEEETTD

SEQ ID NO: 125731 - protein, 32 aa, Artificial Sequence
  Description of Artificial Sequence: Synthetic polypeptide
DEQEIATTNPVATEQYGLVPATDLEDHEGEDL

SEQ ID NO: 125732 - protein, 38 aa, Artificial Sequence
  Description of Artificial Sequence: Synthetic polypeptide
DEEEIRTTNPVATEQYGSVSTVNDQQGTTNNTTDENQT

SEQ ID NO: 125733 - protein, 38 aa, Artificial Sequence
  Description of Artificial Sequence: Synthetic polypeptide
DEEEIRTTNPVATEQYGSVSTVNDQQGSTNVTEEEETQ

SEQ ID NO: 125734 - protein, 38 aa, Artificial Sequence
  Description of Artificial Sequence: Synthetic polypeptide
DEEEIRTTNPVATEQYGSVSTVNDQQGSTNTTTEESED

SEQ ID NO: 125735 - protein, 32 aa, Artificial Sequence
  Description of Artificial Sequence: Synthetic polypeptide
DENEIRTTNPVSTEPYGIISMNDIQQQQNGNH

SEQ ID NO: 125736 - protein, 31 aa, Artificial Sequence
  Description of Artificial Sequence: Synthetic polypeptide
DENEIRTTNPVSTEPYGIISMDIQQQQNGNH

SEQ ID NO: 125737 - protein, 37 aa, Artificial Sequence
  Description of Artificial Sequence: Synthetic polypeptide
DEDEIRTTNPVATEQYGSVSTTNNQQNGNQQGTNQNG

SEQ ID NO: 125738 - protein, 34 aa, Artificial Sequence
  Description of Artificial Sequence: Synthetic polypeptide
DEQEIATTNPVATEQYGNSVSATPDLEDHEGEDL

SEQ ID NO: 125739 - protein, 35 aa, Artificial Sequence
  Description of Artificial Sequence: Synthetic polypeptide
DEAEIRTTNPVATEQYGSVCFSVDLQEGFGGSIIV

SEQ ID NO: 125740 - protein, 35 aa, Artificial Sequence
  Description of Artificial Sequence: Synthetic polypeptide
DEEEIRTTNPVATEQYGSVSRTDMTDVTIEDQGSI

SEQ ID NO: 125741 - protein, 33 aa, Artificial Sequence
  Description of Artificial Sequence: Synthetic polypeptide
AENEIATTNPVATEQYGEASTEPALNMRGMGPR

SEQ ID NO: 125742 - protein, 34 aa, Artificial Sequence
  Description of Artificial Sequence: Synthetic polypeptide
DEAEIRTTNPVATEQYGSVSVTQETETRVEDIYE

SEQ ID NO: 125743 - protein, 36 aa, Artificial Sequence
  Description of Artificial Sequence: Synthetic polypeptide
DEAEIRTTNPVATEQYGSVSVTTVSNVTREGSEQEY

SEQ ID NO: 125744 - protein, 33 aa, Artificial Sequence
  Description of Artificial Sequence: Synthetic polypeptide
DEVEIATTNPVATEQYGSVCAANMGEAPDDGNS

SEQ ID NO: 125745 - protein, 34 aa, Artificial Sequence
  Description of Artificial Sequence: Synthetic polypeptide
DEVEIATTNPVATEQYGSVCAATNGEEAGDEMNN

SEQ ID NO: 125746 - protein, 34 aa, Artificial Sequence
  Description of Artificial Sequence: Synthetic polypeptide
DEVEIATTNPVATEQYGSVCADINDTIGEEMNRV

SEQ ID NO: 125747 - protein, 32 aa, Artificial Sequence
  Description of Artificial Sequence: Synthetic polypeptide
DENEIRTTNPVSTEPYGCISVLDEQQQQNGNH

SEQ ID NO: 125748 - protein, 33 aa, Artificial Sequence
  Description of Artificial Sequence: Synthetic polypeptide
DESEIRTTNPVATEPYGTISMENEQQDQNGENG

SEQ ID NO: 125749 - protein, 37 aa, Artificial Sequence
  Description of Artificial Sequence: Synthetic polypeptide
DEDEIRTTNPVATEQYGSVSTTNTNQQQLQEGTEETT

SEQ ID NO: 125750 - protein, 34 aa, Artificial Sequence
  Description of Artificial Sequence: Synthetic polypeptide
DEDEIATTNPVAYEQYGQSTSANNDLLQRAGMGK

SEQ ID NO: 125751 - protein, 32 aa, Artificial Sequence
  Description of Artificial Sequence: Synthetic polypeptide
DENEIRTTNPVSTEPYGCISMEVMLQPQSGNH

SEQ ID NO: 125752 - protein, 37 aa, Artificial Sequence
  Description of Artificial Sequence: Synthetic polypeptide
DEEEIRTTNPVATEQYGSVSQTTPAPGPNMRNGMNPV

SEQ ID NO: 125753 - protein, 36 aa, Artificial Sequence
  Description of Artificial Sequence: Synthetic polypeptide
DEEEIRTTNPVATEQYGSVSQTTPAGPNMRVEMTDV

SEQ ID NO: 125754 - protein, 34 aa, Artificial Sequence
  Description of Artificial Sequence: Synthetic polypeptide
DEVEIATTNPVATEQYGSVCTIEQDQGLDGNGDQ

SEQ ID NO: 125755 - protein, 34 aa, Artificial Sequence
  Description of Artificial Sequence: Synthetic polypeptide
DESEIRTTNPVATEPYGSVFVWINEQDRKNQGDH

SEQ ID NO: 125756 - protein, 36 aa, Artificial Sequence
  Description of Artificial Sequence: Synthetic polypeptide
DEEEIRTTNPVATEQYGSVSQTTPAGPNERVGMTPV

SEQ ID NO: 125757 - protein, 38 aa, Artificial Sequence
  Description of Artificial Sequence: Synthetic polypeptide
DEDEIRTTNPVATEQYGSVSTTVTNNQQQLQQGTEEND

SEQ ID NO: 125758 - protein, 34 aa, Artificial Sequence
  Description of Artificial Sequence: Synthetic polypeptide
DEVEIATTNPVATEQYGSVSATDLEDGEGQEDLT

SEQ ID NO: 125759 - protein, 33 aa, Artificial Sequence
  Description of Artificial Sequence: Synthetic polypeptide
DEQEIATTNPVATEQYGRQVSATDLEDHEGEDL

SEQ ID NO: 125760 - protein, 36 aa, Artificial Sequence
  Description of Artificial Sequence: Synthetic polypeptide
DEAEIRTTNPVATEQYGSVCFSVDLVQEEFDGSIRP

SEQ ID NO: 125761 - protein, 32 aa, Artificial Sequence
  Description of Artificial Sequence: Synthetic polypeptide
AENEIATTNPVATEQYGEVSAENLEDHEGGDL

SEQ ID NO: 125762 - protein, 37 aa, Artificial Sequence
  Description of Artificial Sequence: Synthetic polypeptide
DEDEIRTTNPVATEQYGSVSTTNNQQQGNQQGTNTND

SEQ ID NO: 125763 - protein, 32 aa, Artificial Sequence
  Description of Artificial Sequence: Synthetic polypeptide
DEQEIATTNPVATEQYGNVSANDIEDHEGEDL

SEQ ID NO: 125764 - protein, 29 aa, Artificial Sequence
  Description of Artificial Sequence: Synthetic peptide
DESEIRTTNPVATEQWGDVAEIEMAAEDA

SEQ ID NO: 125765 - protein, 35 aa, Artificial Sequence
  Description of Artificial Sequence: Synthetic polypeptide
DEAEIRTTNPVATEQYGSVCFSVDLQEEFDGSICS

SEQ ID NO: 125766 - protein, 31 aa, Artificial Sequence
  Description of Artificial Sequence: Synthetic polypeptide
DENEIRTTNPVSTEPYGEISMEDIQQQNGNH

SEQ ID NO: 125767 - protein, 35 aa, Artificial Sequence
  Description of Artificial Sequence: Synthetic polypeptide
DEDEIATTNPVAYEQYGQSVPSATNDLGQEHDIAR

SEQ ID NO: 125768 - protein, 29 aa, Artificial Sequence
  Description of Artificial Sequence: Synthetic peptide
DESEIRTTNPVATEQWGDMAETEQAAEDI

SEQ ID NO: 125769 - protein, 29 aa, Artificial Sequence
  Description of Artificial Sequence: Synthetic peptide
DESEIRTTNPVATEQWGDMAETEMAAEDI

SEQ ID NO: 125770 - protein, 36 aa, Artificial Sequence
  Description of Artificial Sequence: Synthetic polypeptide
DEAEIRTTNPVATEQYGSVCFSVDLLQEEFLGSERV

SEQ ID NO: 125771 - protein, 31 aa, Artificial Sequence
  Description of Artificial Sequence: Synthetic polypeptide
DENEIRTTNPVSTEPYGEISEEVCQQQQGNH

SEQ ID NO: 125772 - protein, 31 aa, Artificial Sequence
  Description of Artificial Sequence: Synthetic polypeptide
DENEIRTTNPVSTEPYGEISEEDCQQQQGNH

SEQ ID NO: 125773 - protein, 31 aa, Artificial Sequence
  Description of Artificial Sequence: Synthetic polypeptide
DENEIRTTNPVSTEPYGEISEEDCQQQNGNH

SEQ ID NO: 125774 - protein, 34 aa, Artificial Sequence
  Description of Artificial Sequence: Synthetic polypeptide
DEQEIATTNPVATEQYGQSHVSATDLEDHEGEDL

SEQ ID NO: 125775 - protein, 30 aa, Artificial Sequence
  Description of Artificial Sequence: Synthetic polypeptide
DENEIRTTNPVSTEPYGEISEEDCQQQENH

SEQ ID NO: 125776 - protein, 34 aa, Artificial Sequence
  Description of Artificial Sequence: Synthetic polypeptide
DEQEIATTNPVATEQYGQSVSATDLWEDHEGEDL

SEQ ID NO: 125777 - protein, 32 aa, Artificial Sequence
  Description of Artificial Sequence: Synthetic polypeptide
DENEIRTTNPVSTEPYGDVSMEDIQQQQNGNH

SEQ ID NO: 125778 - protein, 37 aa, Artificial Sequence
  Description of Artificial Sequence: Synthetic polypeptide
DEDEIRTTNPVATEQYGSVSTTNNQQQGNQQGTNQEE

SEQ ID NO: 125779 - protein, 31 aa, Artificial Sequence
  Description of Artificial Sequence: Synthetic polypeptide
DENEIRTTNPVSTEPYGDVSEEDIQNAAGDH

SEQ ID NO: 125780 - protein, 36 aa, Artificial Sequence
  Description of Artificial Sequence: Synthetic polypeptide
DEEEIRTTNPVATEQYGSVSSADPAGPNMRNGMNPV

SEQ ID NO: 125781 - protein, 32 aa, Artificial Sequence
  Description of Artificial Sequence: Synthetic polypeptide
DEQEIATTNPVATEQYGQVTATDLEDHEGEDL

SEQ ID NO: 125782 - protein, 31 aa, Artificial Sequence
  Description of Artificial Sequence: Synthetic polypeptide
DENEIRTTNPVSTEPYGDISMDIQQQQNGNH

SEQ ID NO: 125783 - protein, 32 aa, Artificial Sequence
  Description of Artificial Sequence: Synthetic polypeptide
DEQEIATTNPVATEQYFSVSATDSEDHNGEDL

SEQ ID NO: 125784 - protein, 38 aa, Artificial Sequence
  Description of Artificial Sequence: Synthetic polypeptide
DEDEIRTTNPVATEQYGSVSTTNNQQLGNQQGTNTTNS

SEQ ID NO: 125785 - protein, 38 aa, Artificial Sequence
  Description of Artificial Sequence: Synthetic polypeptide
DEDEIRTTNPVATEQYGSVSTTNNQQLGNQQGNQNTNQ

SEQ ID NO: 125786 - protein, 33 aa, Artificial Sequence
  Description of Artificial Sequence: Synthetic polypeptide
DENEIRTTNPVSTEPYGSISTMEDGQQMQNGNH

SEQ ID NO: 125787 - protein, 33 aa, Artificial Sequence
  Description of Artificial Sequence: Synthetic polypeptide
DENEIRTTNPVSTEPYGSISTMEDGPQMQNGNV

SEQ ID NO: 125788 - protein, 33 aa, Artificial Sequence
  Description of Artificial Sequence: Synthetic polypeptide
DENEIRTTNPVSTEPYGSISTMEDGPQMQNGNH

SEQ ID NO: 125789 - protein, 35 aa, Artificial Sequence
  Description of Artificial Sequence: Synthetic polypeptide
DEAEIRTTNPVATEQYGSVSVTANNTTTTQGEQHS

SEQ ID NO: 125790 - protein, 33 aa, Artificial Sequence
  Description of Artificial Sequence: Synthetic polypeptide
DENEIRTTNPVSTEPYGSISMPAGPNQRNGMNV

SEQ ID NO: 125791 - protein, 34 aa, Artificial Sequence
  Description of Artificial Sequence: Synthetic polypeptide
DEAEIRTTNPVATEQYGSVCQPWDTLERLENNQE

SEQ ID NO: 125792 - protein, 33 aa, Artificial Sequence
  Description of Artificial Sequence: Synthetic polypeptide
DENEIRTTNPVSTEPYGSISMENEQQDQEGENG

SEQ ID NO: 125793 - protein, 33 aa, Artificial Sequence
  Description of Artificial Sequence: Synthetic polypeptide
DEQEIATTNPVATEQYGEVSATDLEDHEGEDLI

SEQ ID NO: 125794 - protein, 32 aa, Artificial Sequence
  Description of Artificial Sequence: Synthetic polypeptide
DENEIRTTNPVSTEPYGSISMEDIQQQQNGNH

SEQ ID NO: 125795 - protein, 32 aa, Artificial Sequence
  Description of Artificial Sequence: Synthetic polypeptide
DEDEIATTNPVAYEQYGSTATNLTATPDGSEN

SEQ ID NO: 125796 - protein, 35 aa, Artificial Sequence
  Description of Artificial Sequence: Synthetic polypeptide
DEAEIRTTNPVATEQYGSVCNTNPDENGRAEMNEI

SEQ ID NO: 125797 - protein, 31 aa, Artificial Sequence
  Description of Artificial Sequence: Synthetic polypeptide
DENEIRTTNPVSTEPYGSISMEDIQQQNGEH

SEQ ID NO: 125798 - protein, 32 aa, Artificial Sequence
  Description of Artificial Sequence: Synthetic polypeptide
DENEIRTTNPVSTEPYGSISMEDIQQKQNGNH

SEQ ID NO: 125799 - protein, 32 aa, Artificial Sequence
  Description of Artificial Sequence: Synthetic polypeptide
DENEIRTTNPVSTEPYGSISMEDIQQCQNGNH

SEQ ID NO: 125800 - protein, 32 aa, Artificial Sequence
  Description of Artificial Sequence: Synthetic polypeptide
DENEIRTTNPVSTEPYGSISMEDIQEQQNGNL

SEQ ID NO: 125801 - protein, 32 aa, Artificial Sequence
  Description of Artificial Sequence: Synthetic polypeptide
DENEIRTTNPVSTEPYGSISMEDIQEQQNGNH

SEQ ID NO: 125802 - protein, 31 aa, Artificial Sequence
  Description of Artificial Sequence: Synthetic polypeptide
DENEIRTTNPVSTEPYGSISMEDIQDQNGEH

SEQ ID NO: 125803 - protein, 32 aa, Artificial Sequence
  Description of Artificial Sequence: Synthetic polypeptide
DENEIRTTNPVSTEPYGSISMEDIPQQQNGNH

SEQ ID NO: 125804 - protein, 32 aa, Artificial Sequence
  Description of Artificial Sequence: Synthetic polypeptide
DENEIRTTNPVSTEPYGSISMEDGQQQQNGNH

SEQ ID NO: 125805 - protein, 33 aa, Artificial Sequence
  Description of Artificial Sequence: Synthetic polypeptide
DENEIRTTNPVSTEPYGSISTMEDGQQQQNGNH

SEQ ID NO: 125806 - protein, 30 aa, Artificial Sequence
  Description of Artificial Sequence: Synthetic polypeptide
DESEIRTTNPVATEQWGNVAETEMNAAEDA

SEQ ID NO: 125807 - protein, 33 aa, Artificial Sequence
  Description of Artificial Sequence: Synthetic polypeptide
DEDEIATTNPVAYEQYGSTTATNLQGTPDGSEN

SEQ ID NO: 125808 - protein, 32 aa, Artificial Sequence
  Description of Artificial Sequence: Synthetic polypeptide
DEQEIATTNPVATEQYGEVPATDLEDHEGEDK

SEQ ID NO: 125809 - protein, 35 aa, Artificial Sequence
  Description of Artificial Sequence: Synthetic polypeptide
DEAEIRTTNPVATEQYGSVCSGWNSLEFGEFEQQM

SEQ ID NO: 125810 - protein, 35 aa, Artificial Sequence
  Description of Artificial Sequence: Synthetic polypeptide
DEDEIATTNPVAYEQYGSTVCAANGLQDADGNARK

SEQ ID NO: 125811 - protein, 32 aa, Artificial Sequence
  Description of Artificial Sequence: Synthetic polypeptide
DEQEIATTNPVATEQYGEASAEVLQDHEGEDL

SEQ ID NO: 125812 - protein, 36 aa, Artificial Sequence
  Description of Artificial Sequence: Synthetic polypeptide
DEEEIRTTNPVATEQYGSVSVTMPAGPNMINGQDGV

SEQ ID NO: 125813 - protein, 33 aa, Artificial Sequence
  Description of Artificial Sequence: Synthetic polypeptide
DENEIRTTNPVSTEPYGSVSMEDIQQQHNGNDH

SEQ ID NO: 125814 - protein, 33 aa, Artificial Sequence
  Description of Artificial Sequence: Synthetic polypeptide
DENEIRTTNPVSTEPYGSVSMEDIQQDHNGNDH

SEQ ID NO: 125815 - protein, 31 aa, Artificial Sequence
  Description of Artificial Sequence: Synthetic polypeptide
DEQEIATTNPVATEQYGEASATVCEDHGEDL

SEQ ID NO: 125816 - protein, 33 aa, Artificial Sequence
  Description of Artificial Sequence: Synthetic polypeptide
DENEIRTTNPVSTEPYGSVSMEDIQEQQNGNDH

SEQ ID NO: 125817 - protein, 39 aa, Artificial Sequence
  Description of Artificial Sequence: Synthetic polypeptide
DEEEIRTTNPVATEQYGSVSTVNLNNLQEGTEQGTNVNS

SEQ ID NO: 125818 - protein, 37 aa, Artificial Sequence
  Description of Artificial Sequence: Synthetic polypeptide
DEEEIRTTNPVATEQYGSVSSKTPAKGPNMRNGMNPV

SEQ ID NO: 125819 - protein, 36 aa, Artificial Sequence
  Description of Artificial Sequence: Synthetic polypeptide
DEEEIRTTNPVATEQYGSVSVTMTGQPQFRELVSLY

SEQ ID NO: 125820 - protein, 36 aa, Artificial Sequence
  Description of Artificial Sequence: Synthetic polypeptide
DEEEIRTTNPVATEQYGSVSSKQPAGPNMRNGMNPV

SEQ ID NO: 125821 - protein, 33 aa, Artificial Sequence
  Description of Artificial Sequence: Synthetic polypeptide
DENEIRTTNPVSTEPYGSVSAMEDIQEDQEGNL

SEQ ID NO: 125822 - protein, 34 aa, Artificial Sequence
  Description of Artificial Sequence: Synthetic polypeptide
DENEIRTTNPVSTEPYGSVCSGMEDDQRQQNGNH

SEQ ID NO: 125823 - protein, 33 aa, Artificial Sequence
  Description of Artificial Sequence: Synthetic polypeptide
DEQEIATTNPVATEQYGEIVSATDLEDHEGEDL

SEQ ID NO: 125824 - protein, 39 aa, Artificial Sequence
  Description of Artificial Sequence: Synthetic polypeptide
DEEEIRTTNPVATEQYGSVSTVNLNNLQEGTEQGTNEEN

SEQ ID NO: 125825 - protein, 34 aa, Artificial Sequence
  Description of Artificial Sequence: Synthetic polypeptide
DEQEIATTNPVATEQYGESVSATDLGEDHEGEDL

SEQ ID NO: 125826 - protein, 34 aa, Artificial Sequence
  Description of Artificial Sequence: Synthetic polypeptide
DEDEIATTNPVAYEQYGSTVAATNDQAQGPNVNQ

SEQ ID NO: 125827 - protein, 36 aa, Artificial Sequence
  Description of Artificial Sequence: Synthetic polypeptide
DEEEIRTTNPVATEQYGSVSSIGPAGPNMRNGMNPV

SEQ ID NO: 125828 - protein, 32 aa, Artificial Sequence
  Description of Artificial Sequence: Synthetic polypeptide
DESEIRTTNPVATEQWGQKVSEIEMNAAEGDA

SEQ ID NO: 125829 - protein, 31 aa, Artificial Sequence
  Description of Artificial Sequence: Synthetic polypeptide
AENEIATTNPVATEQYGTISEENIQQQNGGH

SEQ ID NO: 125830 - protein, 34 aa, Artificial Sequence
  Description of Artificial Sequence: Synthetic polypeptide
DEVEIATTNPVATEHYGSVCQTNDQQDNRGHDDE

SEQ ID NO: 125831 - protein, 35 aa, Artificial Sequence
  Description of Artificial Sequence: Synthetic polypeptide
DEAEIRTTNPVATEQYGSVCNTFNCWYGRYEESRD

SEQ ID NO: 125832 - protein, 33 aa, Artificial Sequence
  Description of Artificial Sequence: Synthetic polypeptide
DEQEIATTNPVATEQYGHQVSVTDLEDHEGEDL

SEQ ID NO: 125833 - protein, 32 aa, Artificial Sequence
  Description of Artificial Sequence: Synthetic polypeptide
DESEIRTTNPVATEQWGDVSEIESMNAAVGDA

SEQ ID NO: 125834 - protein, 30 aa, Artificial Sequence
  Description of Artificial Sequence: Synthetic polypeptide
AENEIATTNPVSTEPYGEASMNIQQQNGNH

SEQ ID NO: 125835 - protein, 31 aa, Artificial Sequence
  Description of Artificial Sequence: Synthetic polypeptide
DESEIRTTNPVATEQWGDVSEIEQNAAEEDA

SEQ ID NO: 125836 - protein, 32 aa, Artificial Sequence
  Description of Artificial Sequence: Synthetic polypeptide
DEQEIATTNPVATEQYGHVSATDGEDHEGEDL

SEQ ID NO: 125837 - protein, 35 aa, Artificial Sequence
  Description of Artificial Sequence: Synthetic polypeptide
DEEEIRTTNPVATEQYGSVSSENDPQADEISDLEH

SEQ ID NO: 125838 - protein, 39 aa, Artificial Sequence
  Description of Artificial Sequence: Synthetic polypeptide
DEEEIRTTNPVATEQYGSVSTVNGNQLQAGTESGTVVNE

SEQ ID NO: 125839 - protein, 37 aa, Artificial Sequence
  Description of Artificial Sequence: Synthetic polypeptide
DEEEIRTTNPVATEQYGSVSSEAPNLEIQVNGQDQPD

SEQ ID NO: 125840 - protein, 39 aa, Artificial Sequence
  Description of Artificial Sequence: Synthetic polypeptide
DEEEIRTTNPVATEQYGSVSTVNGNQLQAGTEQGTNQTN

SEQ ID NO: 125841 - protein, 39 aa, Artificial Sequence
  Description of Artificial Sequence: Synthetic polypeptide
DEEEIRTTNPVATEQYGSVSTVNGNNLQAGTEQGTNVNQ

SEQ ID NO: 125842 - protein, 38 aa, Artificial Sequence
  Description of Artificial Sequence: Synthetic polypeptide
DEDEIRTTNPVATEQYGSVSTTNNLQAGNQQGTNQTGQ

SEQ ID NO: 125843 - protein, 38 aa, Artificial Sequence
  Description of Artificial Sequence: Synthetic polypeptide
DEDEIRTTNPVATEQYGSVSTTNNLQLGNQQGNQNGND

SEQ ID NO: 125844 - protein, 38 aa, Artificial Sequence
  Description of Artificial Sequence: Synthetic polypeptide
DEDEIRTTNPVATEQYGSVSTTNNLQQGNQQGNGNQND

SEQ ID NO: 125845 - protein, 30 aa, Artificial Sequence
  Description of Artificial Sequence: Synthetic polypeptide
AENEIATTNPVATEYYGCVCSWELQHSEEL

SEQ ID NO: 125846 - protein, 35 aa, Artificial Sequence
  Description of Artificial Sequence: Synthetic polypeptide
DEVEIATTNPVATEPYGEVVHTDNKNDQRQGDNDR

SEQ ID NO: 125847 - protein, 33 aa, Artificial Sequence
  Description of Artificial Sequence: Synthetic polypeptide
DEVEIATTNPVATEPYGSVCYNNDDQDQDHNDR

SEQ ID NO: 125848 - protein, 33 aa, Artificial Sequence
  Description of Artificial Sequence: Synthetic polypeptide
DEVEIATTNPVATEPYGSVSWNENDQHGQGDSI

SEQ ID NO: 125849 - protein, 38 aa, Artificial Sequence
  Description of Artificial Sequence: Synthetic polypeptide
DEEEIRTTNPVATEQYGSVSTVNGNLNEGTEQGTNNET

SEQ ID NO: 125850 - protein, 38 aa, Artificial Sequence
  Description of Artificial Sequence: Synthetic polypeptide
DEDEIRTTNPVATEQYGSVSTTNNNQLGNQQGNNQTND

SEQ ID NO: 125851 - protein, 32 aa, Artificial Sequence
  Description of Artificial Sequence: Synthetic polypeptide
DESEIRTTNPVATEQWGDVSENEPQNAAEEDA

SEQ ID NO: 125852 - protein, 32 aa, Artificial Sequence
  Description of Artificial Sequence: Synthetic polypeptide
DENEIRTTNPVSTEPYGSISCEDIPQQQNGNH

SEQ ID NO: 125853 - protein, 39 aa, Artificial Sequence
  Description of Artificial Sequence: Synthetic polypeptide
DEEEIRTTNPVATEQYGSVSTVNGNQLQEGTEQGTNNED

SEQ ID NO: 125854 - protein, 36 aa, Artificial Sequence
  Description of Artificial Sequence: Synthetic polypeptide
DEEEIRTTNPVATEQYGSVSSETPAGPNMRNGMQPV

SEQ ID NO: 125855 - protein, 36 aa, Artificial Sequence
  Description of Artificial Sequence: Synthetic polypeptide
DEAEIRTTNPVATEQYGSVCLAGNLEEPRNGQEDRN

SEQ ID NO: 125856 - protein, 36 aa, Artificial Sequence
  Description of Artificial Sequence: Synthetic polypeptide
DEAEIRTTNPVATEQYGSVSVTAPNTQTGQHQEVES

SEQ ID NO: 125857 - protein, 36 aa, Artificial Sequence
  Description of Artificial Sequence: Synthetic polypeptide
DEAEIRTTNPVATEQYGSVSVTAPNTQTGTVEEVES

SEQ ID NO: 125858 - protein, 32 aa, Artificial Sequence
  Description of Artificial Sequence: Synthetic polypeptide
DESEIRTTNPVATEQWGEVSEIEEMNAAEGDA

SEQ ID NO: 125859 - protein, 36 aa, Artificial Sequence
  Description of Artificial Sequence: Synthetic polypeptide
DEAEIRTTNPVATEQYGSVSVTASNQDTGYSEEVER

SEQ ID NO: 125860 - protein, 39 aa, Artificial Sequence
  Description of Artificial Sequence: Synthetic polypeptide
DEEEIRTTNPVATEQYGSVSTVNGQQLQQGTEQGTVVNQ

SEQ ID NO: 125861 - protein, 33 aa, Artificial Sequence
  Description of Artificial Sequence: Synthetic polypeptide
DEDEIATTNPVAYEQYGSTAATANGQAAPGNNN

SEQ ID NO: 125862 - protein, 31 aa, Artificial Sequence
  Description of Artificial Sequence: Synthetic polypeptide
DENEIRTTNPVSTEPYGSISAMDIQDQEGEL

SEQ ID NO: 125863 - protein, 30 aa, Artificial Sequence
  Description of Artificial Sequence: Synthetic polypeptide
DESEIRTTNPVATEQWGDVSSIEMNAAEDA

SEQ ID NO: 125864 - protein, 31 aa, Artificial Sequence
  Description of Artificial Sequence: Synthetic polypeptide
DENEIRTTNPVSTEPYGSISAMDIQDQEGEH

SEQ ID NO: 125865 - protein, 33 aa, Artificial Sequence
  Description of Artificial Sequence: Synthetic polypeptide
DEQEIATTNPVATEQYGFVSATDLEDHEGAEDL

SEQ ID NO: 125866 - protein, 33 aa, Artificial Sequence
  Description of Artificial Sequence: Synthetic polypeptide
DEDEIATTNPVAYEQYGSCATNTQGRPGDQGAM

SEQ ID NO: 125867 - protein, 32 aa, Artificial Sequence
  Description of Artificial Sequence: Synthetic polypeptide
DEDEIATTNPVAYEQYGSCATNLADDPGMEAH

SEQ ID NO: 125868 - protein, 32 aa, Artificial Sequence
  Description of Artificial Sequence: Synthetic polypeptide
DENEIRTTNPVSTEPYGRISMEDTQQQQNGNH

SEQ ID NO: 125869 - protein, 36 aa, Artificial Sequence
  Description of Artificial Sequence: Synthetic polypeptide
DEEEIRTTNPVATEQYGSVSSFGPAGPNMYNGMNPV

SEQ ID NO: 125870 - protein, 34 aa, Artificial Sequence
  Description of Artificial Sequence: Synthetic polypeptide
DEVEIATTNPVATEIYGCVSTTNGNQLGADGDSR

SEQ ID NO: 125871 - protein, 38 aa, Artificial Sequence
  Description of Artificial Sequence: Synthetic polypeptide
DEEEIRTTNPVATEQYGSVSTVNGNQLQEGTEQGTVVE

SEQ ID NO: 125872 - protein, 32 aa, Artificial Sequence
  Description of Artificial Sequence: Synthetic polypeptide
DENEIRTTNPVSTEPYGQTSGEGNQQNQNGNH

SEQ ID NO: 125873 - protein, 36 aa, Artificial Sequence
  Description of Artificial Sequence: Synthetic polypeptide
DEEEIRTTNPVATEQYGSVSSETPAGPNSRVGMQPV

SEQ ID NO: 125874 - protein, 30 aa, Artificial Sequence
  Description of Artificial Sequence: Synthetic polypeptide
AENEIATTNPVSTEPYGEISMNIQQQNGNH

SEQ ID NO: 125875 - protein, 34 aa, Artificial Sequence
  Description of Artificial Sequence: Synthetic polypeptide
DEVEIATTNPVATEQYGSVSATDLEDGEGQGDTN

SEQ ID NO: 125876 - protein, 31 aa, Artificial Sequence
  Description of Artificial Sequence: Synthetic polypeptide
AENEIRCTNPVATEQWGATSNENLQPKGGYI

SEQ ID NO: 125877 - protein, 30 aa, Artificial Sequence
  Description of Artificial Sequence: Synthetic polypeptide
AENEIRCTNPVATEQWGDVSEIEMNRAGGA

SEQ ID NO: 125878 - protein, 34 aa, Artificial Sequence
  Description of Artificial Sequence: Synthetic polypeptide
DETEIRTTNPVATEQYGSVYSPPDEQAENFLNDE

SEQ ID NO: 125879 - protein, 33 aa, Artificial Sequence
  Description of Artificial Sequence: Synthetic polypeptide
DESEIRTTNPVATESWGSVSCINEPTDMEGENG

SEQ ID NO: 125880 - protein, 33 aa, Artificial Sequence
  Description of Artificial Sequence: Synthetic polypeptide
DEDEIATTNPVAYEQYGTVVSGDNLDEHGNTDA

SEQ ID NO: 125881 - protein, 32 aa, Artificial Sequence
  Description of Artificial Sequence: Synthetic polypeptide
DEQEIATTNPVATEQWGSCSYTDNNDHDGEDL

SEQ ID NO: 125882 - protein, 32 aa, Artificial Sequence
  Description of Artificial Sequence: Synthetic polypeptide
DEQEIATTNPVATEQWGSVAATDLEEHEGPDI

SEQ ID NO: 125883 - protein, 33 aa, Artificial Sequence
  Description of Artificial Sequence: Synthetic polypeptide
DESEIRTTNPVATESWGCVSCINEPQDIEGENG

SEQ ID NO: 125884 - protein, 31 aa, Artificial Sequence
  Description of Artificial Sequence: Synthetic polypeptide
DENEIRTTNPVSTEPYGTISMEDIQQQQGNH

SEQ ID NO: 125885 - protein, 34 aa, Artificial Sequence
  Description of Artificial Sequence: Synthetic polypeptide
DEDEIRTTNPVATEPWGVVCFTNEDQHHQGVNNR

SEQ ID NO: 125886 - protein, 36 aa, Artificial Sequence
  Description of Artificial Sequence: Synthetic polypeptide
DEEEIRTTNPVATEQYGSVSTDPSTMIPQQFQNDEL

SEQ ID NO: 125887 - protein, 34 aa, Artificial Sequence
  Description of Artificial Sequence: Synthetic polypeptide
CCEEIRTTNPVGYERYGEKVSTNEPSQRGGDNRK

SEQ ID NO: 125888 - protein, 34 aa, Artificial Sequence
  Description of Artificial Sequence: Synthetic polypeptide
DEQEIATTNPVATEQWGSVAITNPEQNHGDNSDA

SEQ ID NO: 125889 - protein, 38 aa, Artificial Sequence
  Description of Artificial Sequence: Synthetic polypeptide
DEEEIRTTNPVATEQYGSVSTVNNNQQGNNQQGETETS

SEQ ID NO: 125890 - protein, 38 aa, Artificial Sequence
  Description of Artificial Sequence: Synthetic polypeptide
DEEEIRTTNPVATEQYGSVSTVNNNQQGNNQNGQEEEE

SEQ ID NO: 125891 - protein, 34 aa, Artificial Sequence
  Description of Artificial Sequence: Synthetic polypeptide
DEDEIATTNPVAYEQYGSVVATNLAGRPGDEAAM

SEQ ID NO: 125892 - protein, 37 aa, Artificial Sequence
  Description of Artificial Sequence: Synthetic polypeptide
DEEEIRTTNPVATEQYGSVSSTTHAGPNMRNGMNPVD

SEQ ID NO: 125893 - protein, 31 aa, Artificial Sequence
  Description of Artificial Sequence: Synthetic polypeptide
DENEIRTTNPVSTEPYGTISMEDIQQQNGNQ

SEQ ID NO: 125894 - protein, 33 aa, Artificial Sequence
  Description of Artificial Sequence: Synthetic polypeptide
DEQEIATTNPVATEQWGSVISATDLEDHEGEDL

SEQ ID NO: 125895 - protein, 31 aa, Artificial Sequence
  Description of Artificial Sequence: Synthetic polypeptide
DENEIRTTNPVSTEPYGTISMEDIQQQNGNI

SEQ ID NO: 125896 - protein, 33 aa, Artificial Sequence
  Description of Artificial Sequence: Synthetic polypeptide
AENEIVTTNPVATEQYGTVCSAEDGLVQFEGND

SEQ ID NO: 125897 - protein, 37 aa, Artificial Sequence
  Description of Artificial Sequence: Synthetic polypeptide
DEEEIRTTNPVATEQYGSVSSTTPAAGPCMRNGMNPC

SEQ ID NO: 125898 - protein, 37 aa, Artificial Sequence
  Description of Artificial Sequence: Synthetic polypeptide
DEEEIRTTNPVATEQYGSVSSTTPAAGPNMRNAMNPV

SEQ ID NO: 125899 - protein, 36 aa, Artificial Sequence
  Description of Artificial Sequence: Synthetic polypeptide
DETEIRTTNPVATEQYGSVSVTMPAGPNMINGQNGD

SEQ ID NO: 125900 - protein, 33 aa, Artificial Sequence
  Description of Artificial Sequence: Synthetic polypeptide
DESEIRTTNPVATEYWGSVGCINEPQARELENG

SEQ ID NO: 125901 - protein, 34 aa, Artificial Sequence
  Description of Artificial Sequence: Synthetic polypeptide
DESEIRTTNPVATEYWGCVSWGNENQDRFGSNQS

SEQ ID NO: 125902 - protein, 37 aa, Artificial Sequence
  Description of Artificial Sequence: Synthetic polypeptide
DEEEIRTTNPVATEQYGSVSSTTPAFGPNMRNGMNPV

SEQ ID NO: 125903 - protein, 32 aa, Artificial Sequence
  Description of Artificial Sequence: Synthetic polypeptide
DEQEIATTNPVATEQWGDVSATDLEDHEGDDA

SEQ ID NO: 125904 - protein, 37 aa, Artificial Sequence
  Description of Artificial Sequence: Synthetic polypeptide
DEEEIRTTNPVATEQYGSVSSTTPAEGPNMRNGMNPV

SEQ ID NO: 125905 - protein, 37 aa, Artificial Sequence
  Description of Artificial Sequence: Synthetic polypeptide
DEEEIRTTNPVATEQYGSVSSTTPAEGPNMRNGMNPQ

SEQ ID NO: 125906 - protein, 37 aa, Artificial Sequence
  Description of Artificial Sequence: Synthetic polypeptide
DEEEIRTTNPVATEQYGSVSSTTPAEGCNMRNGMNPV

SEQ ID NO: 125907 - protein, 32 aa, Artificial Sequence
  Description of Artificial Sequence: Synthetic polypeptide
DEQEIATTNPVATEQWGDVSATDLEDHEGEDA

SEQ ID NO: 125908 - protein, 32 aa, Artificial Sequence
  Description of Artificial Sequence: Synthetic polypeptide
DEQEIATTNPVATEQWGDVSATDLEDHEGEDL

SEQ ID NO: 125909 - protein, 38 aa, Artificial Sequence
  Description of Artificial Sequence: Synthetic polypeptide
DEEEIRTTNPVATEQYGSVSTVNNNQQGNNQQGNQEEQ

SEQ ID NO: 125910 - protein, 37 aa, Artificial Sequence
  Description of Artificial Sequence: Synthetic polypeptide
DEEEIRTTNPVATEQYGSVSSTTPADGPNMRNNMNPV

SEQ ID NO: 125911 - protein, 37 aa, Artificial Sequence
  Description of Artificial Sequence: Synthetic polypeptide
DEEEIRTTNPVATEQYGSVSSTTPADGPNMRNGMNPV

SEQ ID NO: 125912 - protein, 38 aa, Artificial Sequence
  Description of Artificial Sequence: Synthetic polypeptide
DEEEIRTTNPVATEQYGSVSTVNNNQQGNNQQGNEEDE

SEQ ID NO: 125913 - protein, 37 aa, Artificial Sequence
  Description of Artificial Sequence: Synthetic polypeptide
DEEEIRTTNPVATEQYGSVSSTTPADGPNMENGSNPV

SEQ ID NO: 125914 - protein, 31 aa, Artificial Sequence
  Description of Artificial Sequence: Synthetic polypeptide
DEDEIATTNPVAYERWGSTTTNNQGDLGNGS

SEQ ID NO: 125915 - protein, 37 aa, Artificial Sequence
  Description of Artificial Sequence: Synthetic polypeptide
DEEEIRTTNPVATEQYGSVSSTTPACGPNMRNGMNPV

SEQ ID NO: 125916 - protein, 36 aa, Artificial Sequence
  Description of Artificial Sequence: Synthetic polypeptide
DEEEIRTTNPVATEQYGSVSTDPCTMEPQQAQNDEL

SEQ ID NO: 125917 - protein, 36 aa, Artificial Sequence
  Description of Artificial Sequence: Synthetic polypeptide
DEEEIRTTNPVATEQYGSVSTDPSTMEPVQEQNDEL

SEQ ID NO: 125918 - protein, 37 aa, Artificial Sequence
  Description of Artificial Sequence: Synthetic polypeptide
DEEEIRTTNPVATEQYGSVSSTTPAAGPNMRNGMNPV

SEQ ID NO: 125919 - protein, 31 aa, Artificial Sequence
  Description of Artificial Sequence: Synthetic polypeptide
DENEIRTTNPVSTEPYGTISMEDIQQQNGNH

SEQ ID NO: 125920 - protein, 32 aa, Artificial Sequence
  Description of Artificial Sequence: Synthetic polypeptide
DEQEIATTNPVATEQWGSVSAADLDDSHGEDL

SEQ ID NO: 125921 - protein, 34 aa, Artificial Sequence
  Description of Artificial Sequence: Synthetic polypeptide
DESEIRTTNPVATERWCGSVSCIMEPQDREGENG

SEQ ID NO: 125922 - protein, 36 aa, Artificial Sequence
  Description of Artificial Sequence: Synthetic polypeptide
DEEEIRTTNPVATEQYGSVSTDSTLPEPNQEQDDEL

SEQ ID NO: 125923 - protein, 33 aa, Artificial Sequence
  Description of Artificial Sequence: Synthetic polypeptide
DEQEIATTNPVATEQWGSVSATDLDDHEGEDLH

SEQ ID NO: 125924 - protein, 38 aa, Artificial Sequence
  Description of Artificial Sequence: Synthetic polypeptide
DEEEIRTTNPVATEQYGSVSTVNNNQQGNNEQGNTEES

SEQ ID NO: 125925 - protein, 38 aa, Artificial Sequence
  Description of Artificial Sequence: Synthetic polypeptide
DEEEIRTTNPVATEQYGSVSTVNNNQQGNNDEQNETEG

SEQ ID NO: 125926 - protein, 32 aa, Artificial Sequence
  Description of Artificial Sequence: Synthetic polypeptide
DETEIRTTNPVAYEAWGCVSTNLNGDTQNEGP

SEQ ID NO: 125927 - protein, 32 aa, Artificial Sequence
  Description of Artificial Sequence: Synthetic polypeptide
DENEIRTTNPVSTEPYGTISMEDIQQLQNGNK

SEQ ID NO: 125928 - protein, 32 aa, Artificial Sequence
  Description of Artificial Sequence: Synthetic polypeptide
DENEIRTTNPVSTEPYGTISMEDIQQLQNGNH

SEQ ID NO: 125929 - protein, 38 aa, Artificial Sequence
  Description of Artificial Sequence: Synthetic polypeptide
DEEEIRTTNPVATEQYGSVSTVNNNQQGNNDEENTTEA

SEQ ID NO: 125930 - protein, 38 aa, Artificial Sequence
  Description of Artificial Sequence: Synthetic polypeptide
DEEEIRTTNPVATEQYGSVSTVNNNQQGNNDEENEEET

SEQ ID NO: 125931 - protein, 34 aa, Artificial Sequence
  Description of Artificial Sequence: Synthetic polypeptide
DETEIRTTNPVAYEAWGSVSGDNMNQGERQGNQG

SEQ ID NO: 125932 - protein, 38 aa, Artificial Sequence
  Description of Artificial Sequence: Synthetic polypeptide
DEEEIRTTNPVATEQYGSVSTVNNNQQGNNDEEEEQEQ

SEQ ID NO: 125933 - protein, 33 aa, Artificial Sequence
  Description of Artificial Sequence: Synthetic polypeptide
DEQEIATTNPVATEQWGSVSATDLENHKGEDLN

SEQ ID NO: 125934 - protein, 34 aa, Artificial Sequence
  Description of Artificial Sequence: Synthetic polypeptide
DETEIRTTNPVAYECWGSVATNLNQGDVGQNQPS

SEQ ID NO: 125935 - protein, 33 aa, Artificial Sequence
  Description of Artificial Sequence: Synthetic polypeptide
DETEIRTTNPVAYECWGSVSGDNMNHQGERGGG

SEQ ID NO: 125936 - protein, 31 aa, Artificial Sequence
  Description of Artificial Sequence: Synthetic polypeptide
DENEIRTTNPVSTEPYGTISMEDIQQFNGNH

SEQ ID NO: 125937 - protein, 31 aa, Artificial Sequence
  Description of Artificial Sequence: Synthetic polypeptide
DENEIRTTNPVSTEPYGTISMEDIQQFNGND

SEQ ID NO: 125938 - protein, 38 aa, Artificial Sequence
  Description of Artificial Sequence: Synthetic polypeptide
DEEEIRTTNPVATEQYGSVSTVNNNQQGNNDEEAEDED

SEQ ID NO: 125939 - protein, 33 aa, Artificial Sequence
  Description of Artificial Sequence: Synthetic polypeptide
DETEIRTTNPVAYECWGSVSGDNMNQGDRQGQT

SEQ ID NO: 125940 - protein, 33 aa, Artificial Sequence
  Description of Artificial Sequence: Synthetic polypeptide
DEQEIATTNPVATEQWGSVSATDLPEDHEGEDH

SEQ ID NO: 125941 - protein, 33 aa, Artificial Sequence
  Description of Artificial Sequence: Synthetic polypeptide
DETEIRTTNPVAYECWGSVSGDNMNQGERNGQA

SEQ ID NO: 125942 - protein, 38 aa, Artificial Sequence
  Description of Artificial Sequence: Synthetic polypeptide
DEEEIRTTNPVATEQYGSVSTVNNNQQGNNLEEQETEM

SEQ ID NO: 125943 - protein, 34 aa, Artificial Sequence
  Description of Artificial Sequence: Synthetic polypeptide
DESEIRTTNPVATFCWGQSVSCINEPQDREGENG

SEQ ID NO: 125944 - protein, 37 aa, Artificial Sequence
  Description of Artificial Sequence: Synthetic polypeptide
DEEEIRTTNPVATEQYGSVSSTTDAGPNMRNGMNPVG

SEQ ID NO: 125945 - protein, 35 aa, Artificial Sequence
  Description of Artificial Sequence: Synthetic polypeptide
DETEIRTTNPVAVEQYGSVIITNGLGEEGGNGNEG

SEQ ID NO: 125946 - protein, 32 aa, Artificial Sequence
  Description of Artificial Sequence: Synthetic polypeptide
AENEIVTTNPVATEQYGEACSATDGLVQFGGD

SEQ ID NO: 125947 - protein, 32 aa, Artificial Sequence
  Description of Artificial Sequence: Synthetic polypeptide
DEQEIATTNPVATEQWGSVSAIGLEDHQGEDH

SEQ ID NO: 125948 - protein, 36 aa, Artificial Sequence
  Description of Artificial Sequence: Synthetic polypeptide
DEEEIRTTNPVATEQYGSVSSTTFAGPNMRNVMNPV

SEQ ID NO: 125949 - protein, 34 aa, Artificial Sequence
  Description of Artificial Sequence: Synthetic polypeptide
DEQEIATTNPVATEQWGSVSANDPGAPDNQEGNM

SEQ ID NO: 125950 - protein, 31 aa, Artificial Sequence
  Description of Artificial Sequence: Synthetic polypeptide
AENEIVCTNPVATEQYGTACSAENPVQFGGR

SEQ ID NO: 125951 - protein, 35 aa, Artificial Sequence
  Description of Artificial Sequence: Synthetic polypeptide
DEEEIRTTNPVATEQYGSVSTDTETTTEHTQKDDL

SEQ ID NO: 125952 - protein, 33 aa, Artificial Sequence
  Description of Artificial Sequence: Synthetic polypeptide
DEDEIATTNPVAYEQYGSVSTTADIGTHNNNTP

SEQ ID NO: 125953 - protein, 31 aa, Artificial Sequence
  Description of Artificial Sequence: Synthetic polypeptide
DENEIRTTNPVSTEPYGTISMEDIQQQHGNH

SEQ ID NO: 125954 - protein, 36 aa, Artificial Sequence
  Description of Artificial Sequence: Synthetic polypeptide
DEEEIRTTNPVATEQYGSVSVTFTLDQVTATEMLPQ

SEQ ID NO: 125955 - protein, 32 aa, Artificial Sequence
  Description of Artificial Sequence: Synthetic polypeptide
DENEIRTTNPVSTEPYGTISMEDIQQQGNGNR

SEQ ID NO: 125956 - protein, 36 aa, Artificial Sequence
  Description of Artificial Sequence: Synthetic polypeptide
DEEEIRTTNPVATEQYGSVSSTTEAWPNERNGMPPV

SEQ ID NO: 125957 - protein, 30 aa, Artificial Sequence
  Description of Artificial Sequence: Synthetic polypeptide
DENEIRTTNPVSTEPYGTISMEDIQQQGDH

SEQ ID NO: 125958 - protein, 32 aa, Artificial Sequence
  Description of Artificial Sequence: Synthetic polypeptide
DENEIRTTNPVSTEPYGTISMEDIQQQFNGNR

SEQ ID NO: 125959 - protein, 33 aa, Artificial Sequence
  Description of Artificial Sequence: Synthetic polypeptide
DEQEIATTNPVATEQWGSVSATADLADSHGEDT

SEQ ID NO: 125960 - protein, 33 aa, Artificial Sequence
  Description of Artificial Sequence: Synthetic polypeptide
DEQEIATTNPVATEQWGSVSATADLEDHHGEDL

SEQ ID NO: 125961 - protein, 38 aa, Artificial Sequence
  Description of Artificial Sequence: Synthetic polypeptide
DEEEIRTTNPVATEQYGSVSTVNNNQQGNNNEEGETEQ

SEQ ID NO: 125962 - protein, 31 aa, Artificial Sequence
  Description of Artificial Sequence: Synthetic polypeptide
DENEIRTTNPVSTEPYGTISMEDIQQQEGNH

SEQ ID NO: 125963 - protein, 35 aa, Artificial Sequence
  Description of Artificial Sequence: Synthetic polypeptide
DETEIRTTNPVAVEQYGSVIITNGLEEGGGNGNIG

SEQ ID NO: 125964 - protein, 33 aa, Artificial Sequence
  Description of Artificial Sequence: Synthetic polypeptide
DEQEIATTNPVATEQWGSVSATDLADHNGDEDL

SEQ ID NO: 125965 - protein, 33 aa, Artificial Sequence
  Description of Artificial Sequence: Synthetic polypeptide
DEQEIATTNPVATEQWGSVSATDLADTHGGEDT

SEQ ID NO: 125966 - protein, 36 aa, Artificial Sequence
  Description of Artificial Sequence: Synthetic polypeptide
DEEEIRTTNPVATEQYGSVSSTTPAGANMRNGMEPV

SEQ ID NO: 125967 - protein, 33 aa, Artificial Sequence
  Description of Artificial Sequence: Synthetic polypeptide
DESEIRTTNPVATFCWGSVSCIIEPQDREGENG

SEQ ID NO: 125968 - protein, 34 aa, Artificial Sequence
  Description of Artificial Sequence: Synthetic polypeptide
DESEIRTTNPVATFCWGSVSCINEPQDREGENYG

SEQ ID NO: 125969 - protein, 33 aa, Artificial Sequence
  Description of Artificial Sequence: Synthetic polypeptide
DESEIRTTNPVATTCWGSISCINEPQDREGENG

SEQ ID NO: 125970 - protein, 38 aa, Artificial Sequence
  Description of Artificial Sequence: Synthetic polypeptide
DEEEIRTTNPVATEQYGSVSTVNNNQQQGNQQGTEDEE

SEQ ID NO: 125971 - protein, 36 aa, Artificial Sequence
  Description of Artificial Sequence: Synthetic polypeptide
DEEEIRTTNPVATEQYGSVSSTTPAGPNARNGMGPV

SEQ ID NO: 125972 - protein, 33 aa, Artificial Sequence
  Description of Artificial Sequence: Synthetic polypeptide
DESEIRTTNPVATTAWGTVSWTENDDQRTSNMG

SEQ ID NO: 125973 - protein, 32 aa, Artificial Sequence
  Description of Artificial Sequence: Synthetic polypeptide
DEQEIATTNPVATEPYGSVSATDIEDHEGEDL

SEQ ID NO: 125974 - protein, 38 aa, Artificial Sequence
  Description of Artificial Sequence: Synthetic polypeptide
DEEEIRTTNPVATEQYGSVSTVNNNQQNNNLQQGEEDE

SEQ ID NO: 125975 - protein, 33 aa, Artificial Sequence
  Description of Artificial Sequence: Synthetic polypeptide
DEQEIATTNPVATEPYGSVSATEDLEDHEGEDL

SEQ ID NO: 125976 - protein, 38 aa, Artificial Sequence
  Description of Artificial Sequence: Synthetic polypeptide
DEEEIRTTNPVATEQYGSVSTVNNNQQGTNQQGTEEEE

SEQ ID NO: 125977 - protein, 33 aa, Artificial Sequence
  Description of Artificial Sequence: Synthetic polypeptide
DESEIRTTNPVATSCWGSVSCINEPQDRETENG

SEQ ID NO: 125978 - protein, 36 aa, Artificial Sequence
  Description of Artificial Sequence: Synthetic polypeptide
DETEIRTTNPVATEQYGSVSATTPAGPNMRKGMNPV

SEQ ID NO: 125979 - protein, 35 aa, Artificial Sequence
  Description of Artificial Sequence: Synthetic polypeptide
DETEIRTTNPVATEQYGSVSATTPAGPNMRKGPPV

SEQ ID NO: 125980 - protein, 33 aa, Artificial Sequence
  Description of Artificial Sequence: Synthetic polypeptide
DESEIRTTNPVATSCWGSVSCINEPQDREGEHG

SEQ ID NO: 125981 - protein, 37 aa, Artificial Sequence
  Description of Artificial Sequence: Synthetic polypeptide
DEEEIRTTNPVATEQYGSVSSTTPAGPHMRNGMNPVK

SEQ ID NO: 125982 - protein, 37 aa, Artificial Sequence
  Description of Artificial Sequence: Synthetic polypeptide
DEEEIRTTNPVATEQYGSVSTVNNNQQGTEDEETEEE

SEQ ID NO: 125983 - protein, 36 aa, Artificial Sequence
  Description of Artificial Sequence: Synthetic polypeptide
DEEEIRTTNPVATEQYGSVSSTTPAGPGMRNQMNPV

SEQ ID NO: 125984 - protein, 37 aa, Artificial Sequence
  Description of Artificial Sequence: Synthetic polypeptide
DEEEIRTTNPVATEQYGSVSSTTPAGPGMRNGMNPVK

SEQ ID NO: 125985 - protein, 32 aa, Artificial Sequence
  Description of Artificial Sequence: Synthetic polypeptide
DEQEIATTNPVATEPYGTISTEDIQQQQNGNH

SEQ ID NO: 125986 - protein, 38 aa, Artificial Sequence
  Description of Artificial Sequence: Synthetic polypeptide
DEEEIRTTNPVATEQYGSVSTVNNNQQGNQAGTTNVEA

SEQ ID NO: 125987 - protein, 36 aa, Artificial Sequence
  Description of Artificial Sequence: Synthetic polypeptide
DETEIRTTNPVATEQYGSVSITTPAGPNMRNGMNPV

SEQ ID NO: 125988 - protein, 34 aa, Artificial Sequence
  Description of Artificial Sequence: Synthetic polypeptide
DEDEICTTNPVATTAYGSVSTNLQSGSTTEQDDT

SEQ ID NO: 125989 - protein, 38 aa, Artificial Sequence
  Description of Artificial Sequence: Synthetic polypeptide
DEEEIRTTNPVATEQYGSVSTVNNNQQGNNQQNEEEEE

SEQ ID NO: 125990 - protein, 34 aa, Artificial Sequence
  Description of Artificial Sequence: Synthetic polypeptide
DEDEICTTNPVATTAYGSVSTNLQSGSTTTQEDE

SEQ ID NO: 125991 - protein, 33 aa, Artificial Sequence
  Description of Artificial Sequence: Synthetic polypeptide
DESEIRTTNPVATTCWGSVSCINEPQDREAENG

SEQ ID NO: 125992 - protein, 33 aa, Artificial Sequence
  Description of Artificial Sequence: Synthetic polypeptide
DEDEICTTNPVAYEQYGTVTTGEGNQQNQGDND

SEQ ID NO: 125993 - protein, 35 aa, Artificial Sequence
  Description of Artificial Sequence: Synthetic polypeptide
DETEIRTTNPVATEQYGSVCTPPCLETGYMEMMND

SEQ ID NO: 125994 - protein, 38 aa, Artificial Sequence
  Description of Artificial Sequence: Synthetic polypeptide
DEEEIRTTNPVATEQYGSVSTVNNQQLQAGTETGGTTG

SEQ ID NO: 125995 - protein, 38 aa, Artificial Sequence
  Description of Artificial Sequence: Synthetic polypeptide
DEEEIRTTNPVATEQYGSVSTVNNQQGNQNQGTTNQET

SEQ ID NO: 125996 - protein, 38 aa, Artificial Sequence
  Description of Artificial Sequence: Synthetic polypeptide
DEEEIRTTNPVATEQYGSVSTVNNQNLEQGNNQDEDEG

SEQ ID NO: 125997 - protein, 33 aa, Artificial Sequence
  Description of Artificial Sequence: Synthetic polypeptide
DEQEIATTNPVATEKYGSVVSATDLEDHEGEDL

SEQ ID NO: 125998 - protein, 33 aa, Artificial Sequence
  Description of Artificial Sequence: Synthetic polypeptide
DESEIRTTNPVATVCWGSVSCINDPQDLEGENG

SEQ ID NO: 125999 - protein, 33 aa, Artificial Sequence
  Description of Artificial Sequence: Synthetic polypeptide
DEQEIATTNPVATELYGSVSATDLEDHEGDEDL

SEQ ID NO: 126000 - protein, 38 aa, Artificial Sequence
  Description of Artificial Sequence: Synthetic polypeptide
DEEEIRTTNPVATEQYGSVSTVNNQNGNQQQGNNEQGQ

SEQ ID NO: 126001 - protein, 32 aa, Artificial Sequence
  Description of Artificial Sequence: Synthetic polypeptide
DEQEIATTNPVATEMYGSVSATDEEDHEGEDL

SEQ ID NO: 126002 - protein, 38 aa, Artificial Sequence
  Description of Artificial Sequence: Synthetic polypeptide
DEEEIRTTNPVATEQYGSVSTVNNQAGNQQGTNEEGTD

SEQ ID NO: 126003 - protein, 33 aa, Artificial Sequence
  Description of Artificial Sequence: Synthetic polypeptide
DEQEIATTNPVATEMYGSVSATDLKEDHEGEDL

SEQ ID NO: 126004 - protein, 34 aa, Artificial Sequence
  Description of Artificial Sequence: Synthetic polypeptide
DEQEIATTNPVATENYGSVCSATDLQEDHEGEDL

SEQ ID NO: 126005 - protein, 32 aa, Artificial Sequence
  Description of Artificial Sequence: Synthetic polypeptide
DEQEIATTNPVATENYGSVPATDLEDHEGEDL

SEQ ID NO: 126006 - protein, 33 aa, Artificial Sequence
  Description of Artificial Sequence: Synthetic polypeptide
DEQEIATTNPVATENYGSVSATADLEDHEGEDL

SEQ ID NO: 126007 - protein, 33 aa, Artificial Sequence
  Description of Artificial Sequence: Synthetic polypeptide
DEQEIATTNPVATENYGSVSATDLAEDHEGEDL

SEQ ID NO: 126008 - protein, 38 aa, Artificial Sequence
  Description of Artificial Sequence: Synthetic polypeptide
DEEEIRTTNPVATEQYGSVSTVNNQAGNQEEATNVATE

SEQ ID NO: 126009 - protein, 36 aa, Artificial Sequence
  Description of Artificial Sequence: Synthetic polypeptide
DEEEIRTTNPVATEQYGSVSSTTPAGPNERNGMDPV

SEQ ID NO: 126010 - protein, 37 aa, Artificial Sequence
  Description of Artificial Sequence: Synthetic polypeptide
DEEEIRTTNPVATEQYGSVSSTTPAGPNDRNGMNPVA

SEQ ID NO: 126011 - protein, 36 aa, Artificial Sequence
  Description of Artificial Sequence: Synthetic polypeptide
DEEEIRTTNPVATEQYGSVSSTTPAGPNDRNGMEDV

SEQ ID NO: 126012 - protein, 38 aa, Artificial Sequence
  Description of Artificial Sequence: Synthetic polypeptide
DEEEIRTTNPVATEQYGSVSTVNNNQNGNQAGTTNQET

SEQ ID NO: 126013 - protein, 38 aa, Artificial Sequence
  Description of Artificial Sequence: Synthetic polypeptide
DEEEIRTTNPVATEQYGSVSTVNNNQQGNNQQGTEEGS

SEQ ID NO: 126014 - protein, 33 aa, Artificial Sequence
  Description of Artificial Sequence: Synthetic polypeptide
DESEIRTTNPVATSCWGSVSCINEPIDREGENG

SEQ ID NO: 126015 - protein, 31 aa, Artificial Sequence
  Description of Artificial Sequence: Synthetic polypeptide
AEPEIRTTNPVATEEYGCCWNIVLQRNDNQE

SEQ ID NO: 126016 - protein, 32 aa, Artificial Sequence
  Description of Artificial Sequence: Synthetic polypeptide
AEPEIRTTNPVATEEYGCCHWDIVLQRGDNQE

SEQ ID NO: 126017 - protein, 32 aa, Artificial Sequence
  Description of Artificial Sequence: Synthetic polypeptide
DEQEIATTNPVATEQWGAVSATDLEDHEGEDL

SEQ ID NO: 126018 - protein, 33 aa, Artificial Sequence
  Description of Artificial Sequence: Synthetic polypeptide
DEDEIATVNPVATEQYGCVAGTNLFADMGDNHH

SEQ ID NO: 126019 - protein, 34 aa, Artificial Sequence
  Description of Artificial Sequence: Synthetic polypeptide
DESEIRTTNPVATMCWGSVVSCINEPQDREGENG

SEQ ID NO: 126020 - protein, 33 aa, Artificial Sequence
  Description of Artificial Sequence: Synthetic polypeptide
CAEEIATTNPVATEQYGSVCSANPPQEHGGTEM

SEQ ID NO: 126021 - protein, 37 aa, Artificial Sequence
  Description of Artificial Sequence: Synthetic polypeptide
DEEEIRTTNPVATEQYGSVSSTTPAGGPNMRNGWNPV

SEQ ID NO: 126022 - protein, 37 aa, Artificial Sequence
  Description of Artificial Sequence: Synthetic polypeptide
DEEEIRTTNPVATEQYGSVSSTTPAGGPNMRNGMYPV

SEQ ID NO: 126023 - protein, 37 aa, Artificial Sequence
  Description of Artificial Sequence: Synthetic polypeptide
DEEEIRTTNPVATEQYGSVSSTTPAGGPNMRNGMNPV

SEQ ID NO: 126024 - protein, 34 aa, Artificial Sequence
  Description of Artificial Sequence: Synthetic polypeptide
DESEIRTTNPVATLGWGSVSCINKEPQDREGENG

SEQ ID NO: 126025 - protein, 34 aa, Artificial Sequence
  Description of Artificial Sequence: Synthetic polypeptide
DESEIRTTNPVATLCWGSVSCINEEPQDREGENG

SEQ ID NO: 126026 - protein, 34 aa, Artificial Sequence
  Description of Artificial Sequence: Synthetic polypeptide
DESEIRTTNPVATLCWGSVGSCINEPQDREGENG

SEQ ID NO: 126027 - protein, 33 aa, Artificial Sequence
  Description of Artificial Sequence: Synthetic polypeptide
DESEIRTTNPVATLCWGCVSCINEPQDREGENG

SEQ ID NO: 126028 - protein, 37 aa, Artificial Sequence
  Description of Artificial Sequence: Synthetic polypeptide
DEEEIRTTNPVATEQYGSVSSTTPAGFPNMRNGMNPV

SEQ ID NO: 126029 - protein, 31 aa, Artificial Sequence
  Description of Artificial Sequence: Synthetic polypeptide
DESEIRTTNPVATKHYGTIVWTTNQNEQTNN

SEQ ID NO: 126030 - protein, 34 aa, Artificial Sequence
  Description of Artificial Sequence: Synthetic polypeptide
DESEIRTTNPVATHCWGSVSYCINEPQDREGENG

SEQ ID NO: 126031 - protein, 34 aa, Artificial Sequence
  Description of Artificial Sequence: Synthetic polypeptide
DESEIRTTNPVATHCWGLSVSCINEPQDREGENG

SEQ ID NO: 126032 - protein, 33 aa, Artificial Sequence
  Description of Artificial Sequence: Synthetic polypeptide
DESEIRTTNPVATGCWGSVSCINEPGDREGENG

SEQ ID NO: 126033 - protein, 34 aa, Artificial Sequence
  Description of Artificial Sequence: Synthetic polypeptide
DESEIRTTNPVATFSWGSVSCINQEPQDREGENQ

SEQ ID NO: 126034 - protein, 36 aa, Artificial Sequence
  Description of Artificial Sequence: Synthetic polypeptide
DEEEIRTTNPVATEQYGSVSSTTPAGMNMRNGMYPV

SEQ ID NO: 126035 - protein, 33 aa, Artificial Sequence
  Description of Artificial Sequence: Synthetic polypeptide
DEQEIATTNPVATEPYGVSVSATDLEDHEGEDL

SEQ ID NO: 126036 - protein, 32 aa, Artificial Sequence
  Description of Artificial Sequence: Synthetic polypeptide
AEPEIRTTNPVATEEYGCCWSSIVLQRGDDQE

SEQ ID NO: 126037 - protein, 33 aa, Artificial Sequence
  Description of Artificial Sequence: Synthetic polypeptide
DEDEIATVNPVATEQYGCVAGTNLFAEMGDNDT

SEQ ID NO: 126038 - protein, 38 aa, Artificial Sequence
  Description of Artificial Sequence: Synthetic polypeptide
DEEEIRTTNPVATEQYGSVSTVNNNQQGNNQQGSTENE

SEQ ID NO: 126039 - protein, 33 aa, Artificial Sequence
  Description of Artificial Sequence: Synthetic polypeptide
DEQEIATTNPVATEQLYWSVSATDLEDHEGEDL

SEQ ID NO: 126040 - protein, 38 aa, Artificial Sequence
  Description of Artificial Sequence: Synthetic polypeptide
DEEEIRTTNPVATEQYGSVSTVNNNQQGNNQQGQTTEG

SEQ ID NO: 126041 - protein, 33 aa, Artificial Sequence
  Description of Artificial Sequence: Synthetic polypeptide
DESEIRTTNPVATSCWGSRSCINEPQDREGENG

SEQ ID NO: 126042 - protein, 32 aa, Artificial Sequence
  Description of Artificial Sequence: Synthetic polypeptide
DENEIRTTNPVSTEPYGTISMEDIQQQQNGNR

SEQ ID NO: 126043 - protein, 36 aa, Artificial Sequence
  Description of Artificial Sequence: Synthetic polypeptide
DEEEIRTTNPVATEQYGSVSSTTPAGPEMHNGMNPV

SEQ ID NO: 126044 - protein, 36 aa, Artificial Sequence
  Description of Artificial Sequence: Synthetic polypeptide
DEEEIRTTNPVATEQYGSVSSTTPAGPEDHEGMNPV

SEQ ID NO: 126045 - protein, 36 aa, Artificial Sequence
  Description of Artificial Sequence: Synthetic polypeptide
DETEIRTTNPVATEQYGSVSSNTPAGPNMRNGMNPV

SEQ ID NO: 126046 - protein, 36 aa, Artificial Sequence
  Description of Artificial Sequence: Synthetic polypeptide
DETEIRTTNPVATEQYGSVSSTHPAGPNMRNGMNPV

SEQ ID NO: 126047 - protein, 36 aa, Artificial Sequence
  Description of Artificial Sequence: Synthetic polypeptide
DETEIRTTNPVATEQYGSVSSTTPAGPNMRKGMNPV

SEQ ID NO: 126048 - protein, 36 aa, Artificial Sequence
  Description of Artificial Sequence: Synthetic polypeptide
DETEIRTTNPVATEQYGSVSSTTPAGPNMRNGMNHV

SEQ ID NO: 126049 - protein, 36 aa, Artificial Sequence
  Description of Artificial Sequence: Synthetic polypeptide
DETEIRTTNPVATEQYGSVSSTTPAGPNMRNGMNPV

SEQ ID NO: 126050 - protein, 33 aa, Artificial Sequence
  Description of Artificial Sequence: Synthetic polypeptide
DESEIRTTNPVATRCWGSVSCINEPQDEEGENG

SEQ ID NO: 126051 - protein, 32 aa, Artificial Sequence
  Description of Artificial Sequence: Synthetic polypeptide
AEQEIACTNPVATEQYGCAASANLQTPGGGQR

SEQ ID NO: 126052 - protein, 33 aa, Artificial Sequence
  Description of Artificial Sequence: Synthetic polypeptide
DEDEICTTNPCAYEQWGTVSTNLNQGDTGQNDA

SEQ ID NO: 126053 - protein, 32 aa, Artificial Sequence
  Description of Artificial Sequence: Synthetic polypeptide
DESEIRTTNPVATQHWGSVCTIEDQRKTNNDM

SEQ ID NO: 126054 - protein, 35 aa, Artificial Sequence
  Description of Artificial Sequence: Synthetic polypeptide
DEDEIRTTNPVATENYGSVCSNWNDGQDRDGKTEH

SEQ ID NO: 126055 - protein, 33 aa, Artificial Sequence
  Description of Artificial Sequence: Synthetic polypeptide
DEDEIATVNPVATEQYGCVAGTNLFAEPGDNHQ

SEQ ID NO: 126056 - protein, 36 aa, Artificial Sequence
  Description of Artificial Sequence: Synthetic polypeptide
DETEIRTTNPVATEQYGSVSTNDVDEEIFMLQDHPF

SEQ ID NO: 126057 - protein, 32 aa, Artificial Sequence
  Description of Artificial Sequence: Synthetic polypeptide
AEPEIRTTNPVATEEYGCCYNCGVLQRGMNQE

SEQ ID NO: 126058 - protein, 33 aa, Artificial Sequence
  Description of Artificial Sequence: Synthetic polypeptide
DETEIRTTNPVAYECWGSVSGDNMNQGERQGMV

SEQ ID NO: 126059 - protein, 34 aa, Artificial Sequence
  Description of Artificial Sequence: Synthetic polypeptide
DETEIRTTNPVAYECWGSVSGGNGMEQQNGGNAR

SEQ ID NO: 126060 - protein, 35 aa, Artificial Sequence
  Description of Artificial Sequence: Synthetic polypeptide
DETEIRTTNPVAYECWGSVSGGNGMEQRNGDGNER

SEQ ID NO: 126061 - protein, 31 aa, Artificial Sequence
  Description of Artificial Sequence: Synthetic polypeptide
AENEIRTTNPVATECWGETTANENLQPKGGR

SEQ ID NO: 126062 - protein, 31 aa, Artificial Sequence
  Description of Artificial Sequence: Synthetic polypeptide
DETEVASTNPVATEGYGNVAANTWQERVGPR

SEQ ID NO: 126063 - protein, 32 aa, Artificial Sequence
  Description of Artificial Sequence: Synthetic polypeptide
DENEIRTTNPVSTEPYGTISMADNQQQQNGNH

SEQ ID NO: 126064 - protein, 31 aa, Artificial Sequence
  Description of Artificial Sequence: Synthetic polypeptide
DENEIRTTNPVSTEPYGTISMADIQQQNGNH

SEQ ID NO: 126065 - protein, 30 aa, Artificial Sequence
  Description of Artificial Sequence: Synthetic polypeptide
AENEIRCTNPVSTEPYGEISMDIQQQNGNR

SEQ ID NO: 126066 - protein, 34 aa, Artificial Sequence
  Description of Artificial Sequence: Synthetic polypeptide
DETNEICTTNPVAYEHWGSVSTGDLGDIQGGNTR

SEQ ID NO: 126067 - protein, 32 aa, Artificial Sequence
  Description of Artificial Sequence: Synthetic polypeptide
AENEIRCTNPVSTEPYGEASMENLQQQQNGNR

SEQ ID NO: 126068 - protein, 31 aa, Artificial Sequence
  Description of Artificial Sequence: Synthetic polypeptide
DETSIATTNPTAYECWGSVYSFENDQSGNSR

SEQ ID NO: 126069 - protein, 31 aa, Artificial Sequence
  Description of Artificial Sequence: Synthetic polypeptide
DETSIATTNPTAYEQWGSVYPFDNDHQSGNR

SEQ ID NO: 126070 - protein, 31 aa, Artificial Sequence
  Description of Artificial Sequence: Synthetic polypeptide
DETSIATTNPTAYEQWGSYSIFNDQHSDGNR

SEQ ID NO: 126071 - protein, 31 aa, Artificial Sequence
  Description of Artificial Sequence: Synthetic polypeptide
DETSIATTNPTAYEQWGSYSIFNDQSGGNNR

SEQ ID NO: 126072 - protein, 33 aa, Artificial Sequence
  Description of Artificial Sequence: Synthetic polypeptide
DEQEIATTNPVATEQWGSVSATGPLTDHQGEDF

SEQ ID NO: 126073 - protein, 31 aa, Artificial Sequence
  Description of Artificial Sequence: Synthetic polypeptide
DETSIATTNPTAYEQWGSYYSNDNDQMSGNR

SEQ ID NO: 126074 - protein, 32 aa, Artificial Sequence
  Description of Artificial Sequence: Synthetic polypeptide
DENEIRTTNPVSTEPYGTISIEDIQNQQNGNH

SEQ ID NO: 126075 - protein, 30 aa, Artificial Sequence
  Description of Artificial Sequence: Synthetic polypeptide
AENEIRCTNPVSTEPYGEASMDIQQQNGNR

SEQ ID NO: 126076 - protein, 39 aa, Artificial Sequence
  Description of Artificial Sequence: Synthetic polypeptide
DEEEIRTTNPVATEQYGSVSTVNNNNQLQAGNNQQGDDD

SEQ ID NO: 126077 - protein, 33 aa, Artificial Sequence
  Description of Artificial Sequence: Synthetic polypeptide
DEDEIRTTNPVATEQYGCTCSTNHNQNFISDQS

SEQ ID NO: 126078 - protein, 32 aa, Artificial Sequence
  Description of Artificial Sequence: Synthetic polypeptide
DEDEIRTTNPVATEQYGCWAKIHPLEREENQN

SEQ ID NO: 126079 - protein, 38 aa, Artificial Sequence
  Description of Artificial Sequence: Synthetic polypeptide
DEEEIRTTNPVATEQYGSVSTVNNNNQEQGTDEQENDT

SEQ ID NO: 126080 - protein, 33 aa, Artificial Sequence
  Description of Artificial Sequence: Synthetic polypeptide
DETEIVTTNPVATEQYGTVVSATDGPDEFEGND

SEQ ID NO: 126081 - protein, 38 aa, Artificial Sequence
  Description of Artificial Sequence: Synthetic polypeptide
DEEEIRTTNPVATEQYGSVSTVNNNNNQQQGTDENEDT

SEQ ID NO: 126082 - protein, 34 aa, Artificial Sequence
  Description of Artificial Sequence: Synthetic polypeptide
DETEIVTTNPVATEQYGTVCSATDGPVEQFEGND

SEQ ID NO: 126083 - protein, 33 aa, Artificial Sequence
  Description of Artificial Sequence: Synthetic polypeptide
DETEIVTTNPVATEQYGTVCSATDGPVEFEGND

SEQ ID NO: 126084 - protein, 36 aa, Artificial Sequence
  Description of Artificial Sequence: Synthetic polypeptide
DESEIRTTNPVATEQYGSVSSTTPAGPNMRNGCNPV

SEQ ID NO: 126085 - protein, 35 aa, Artificial Sequence
  Description of Artificial Sequence: Synthetic polypeptide
DESEIRTTNPVATEQYGSVSSTSPAGPNMRNGDPI

SEQ ID NO: 126086 - protein, 38 aa, Artificial Sequence
  Description of Artificial Sequence: Synthetic polypeptide
DEEEIRTTNPVATEQYGSVSTVNNNQAGNQNATEQGAE

SEQ ID NO: 126087 - protein, 38 aa, Artificial Sequence
  Description of Artificial Sequence: Synthetic polypeptide
DEEEIRTTNPVATEQYGSVSTVNNNQAGNQAGTESGED

SEQ ID NO: 126088 - protein, 33 aa, Artificial Sequence
  Description of Artificial Sequence: Synthetic polypeptide
DEQEIATTNPVATEQWGSVSATGLEDHQGEDLD

SEQ ID NO: 126089 - protein, 32 aa, Artificial Sequence
  Description of Artificial Sequence: Synthetic polypeptide
DETEIVTTNPVATECYGTVWSATDDPAFEGND

SEQ ID NO: 126090 - protein, 31 aa, Artificial Sequence
  Description of Artificial Sequence: Synthetic polypeptide
DENEIRTTNPVSTEPYGTISMDIQQQSNGNH

SEQ ID NO: 126091 - protein, 31 aa, Artificial Sequence
  Description of Artificial Sequence: Synthetic polypeptide
DENEIRTTNPVSTEPYGTISMDIQQQQVGNH

SEQ ID NO: 126092 - protein, 32 aa, Artificial Sequence
  Description of Artificial Sequence: Synthetic polypeptide
DETEIVTTNPVATECYGTVWSATDDPEFEGND

SEQ ID NO: 126093 - protein, 31 aa, Artificial Sequence
  Description of Artificial Sequence: Synthetic polypeptide
DENEIRTTNPVSTEPYGTISMDIQQQQNGNY

SEQ ID NO: 126094 - protein, 38 aa, Artificial Sequence
  Description of Artificial Sequence: Synthetic polypeptide
DEEEIRTTNPVATEQYGSVSTVNNNQAGNNDEETETEQ

SEQ ID NO: 126095 - protein, 34 aa, Artificial Sequence
  Description of Artificial Sequence: Synthetic polypeptide
DEQEIATTNPVATEQWGSVSATGLTDHQGGEDLH

SEQ ID NO: 126096 - protein, 31 aa, Artificial Sequence
  Description of Artificial Sequence: Synthetic polypeptide
DENEIRTTNPVSTEPYGTISMDIQQQQNGNL

SEQ ID NO: 126097 - protein, 31 aa, Artificial Sequence
  Description of Artificial Sequence: Synthetic polypeptide
DENEIRTTNPVSTEPYGTISMDIQQQQNGNH

SEQ ID NO: 126098 - protein, 30 aa, Artificial Sequence
  Description of Artificial Sequence: Synthetic polypeptide
DENEIRTTNPVSTEPYGTISMDIQQQQGTH

SEQ ID NO: 126099 - protein, 33 aa, Artificial Sequence
  Description of Artificial Sequence: Synthetic polypeptide
DETEIVTTNPVATEQYGFVCSATDGPVEFEGND

SEQ ID NO: 126100 - protein, 31 aa, Artificial Sequence
  Description of Artificial Sequence: Synthetic polypeptide
DENEIRTTNPVSTEPYGTISMDIQQNQNGNH

SEQ ID NO: 126101 - protein, 31 aa, Artificial Sequence
  Description of Artificial Sequence: Synthetic polypeptide
DENEIRTTNPVSTEPYGTISMDIQMNQNGNH

SEQ ID NO: 126102 - protein, 33 aa, Artificial Sequence
  Description of Artificial Sequence: Synthetic polypeptide
DETEIVTTNPVATEQYGTVCSATDDPVAFKGND

SEQ ID NO: 126103 - protein, 33 aa, Artificial Sequence
  Description of Artificial Sequence: Synthetic polypeptide
DETEIVTTNPVATEQYGTVCSATDGPVEFKGND

SEQ ID NO: 126104 - protein, 35 aa, Artificial Sequence
  Description of Artificial Sequence: Synthetic polypeptide
DESEIRTTNPVATEQYGSVSSTTPAGPNMRNGDPI

SEQ ID NO: 126105 - protein, 30 aa, Artificial Sequence
  Description of Artificial Sequence: Synthetic polypeptide
DEQEIATTNPVATEQWGSVSEIEMDAAEDA

SEQ ID NO: 126106 - protein, 31 aa, Artificial Sequence
  Description of Artificial Sequence: Synthetic polypeptide
DEQEIATTNPVATEQWGSVSEIEMDHEGEDL

SEQ ID NO: 126107 - protein, 35 aa, Artificial Sequence
  Description of Artificial Sequence: Synthetic polypeptide
DESEIRTTNPVATEQYGSVSCSGNQSPWTDTGNGV

SEQ ID NO: 126108 - protein, 31 aa, Artificial Sequence
  Description of Artificial Sequence: Synthetic polypeptide
DEQEIATTNPVATEQWGSVSTIEMDAEEDDA

SEQ ID NO: 126109 - protein, 30 aa, Artificial Sequence
  Description of Artificial Sequence: Synthetic polypeptide
DENEIRTTNPVSTEPYGTISEDCQQQQENK

SEQ ID NO: 126110 - protein, 31 aa, Artificial Sequence
  Description of Artificial Sequence: Synthetic polypeptide
DEQEIATTNPVATEQWGSVSTIEMDAEEEDA

SEQ ID NO: 126111 - protein, 34 aa, Artificial Sequence
  Description of Artificial Sequence: Synthetic polypeptide
DEQEIATTNPVATEQWGSVSVPAITNNDDGENDI

SEQ ID NO: 126112 - protein, 39 aa, Artificial Sequence
  Description of Artificial Sequence: Synthetic polypeptide
DEEEIRTTNPVATEQYGSVSTVNLQSGNNNQNGTNNATE

SEQ ID NO: 126113 - protein, 35 aa, Artificial Sequence
  Description of Artificial Sequence: Synthetic polypeptide
DEDEIRTTNPVATEQYGMVTIMTNGDQGGGENEGN

SEQ ID NO: 126114 - protein, 31 aa, Artificial Sequence
  Description of Artificial Sequence: Synthetic polypeptide
DETSIRTTNPLATEQFGNVCSCEKLEGPNGR

SEQ ID NO: 126115 - protein, 35 aa, Artificial Sequence
  Description of Artificial Sequence: Synthetic polypeptide
DESEIRTTNPVATEQYGSVSAVSTLNANEGQQDTL

SEQ ID NO: 126116 - protein, 35 aa, Artificial Sequence
  Description of Artificial Sequence: Synthetic polypeptide
DESEIRTTNPVATEQYGSVSATTPTGPNRNGMDPV

SEQ ID NO: 126117 - protein, 31 aa, Artificial Sequence
  Description of Artificial Sequence: Synthetic polypeptide
DETSIRTTNPLATEQFGSVMCEKLEGPNGRA

SEQ ID NO: 126118 - protein, 34 aa, Artificial Sequence
  Description of Artificial Sequence: Synthetic polypeptide
DEDEIATTNPVAYEQYGSVCAANNLQDSDGNQNH

SEQ ID NO: 126119 - protein, 33 aa, Artificial Sequence
  Description of Artificial Sequence: Synthetic polypeptide
DETSIRTTNPLATEQFGSVSCEKSQEGPSNGRI

SEQ ID NO: 126120 - protein, 34 aa, Artificial Sequence
  Description of Artificial Sequence: Synthetic polypeptide
DEDEIATTNPVAYEQYGSVCAANNLQDSDGNEHA

SEQ ID NO: 126121 - protein, 33 aa, Artificial Sequence
  Description of Artificial Sequence: Synthetic polypeptide
DEDEIATTNPVAYEQYGSVCAANDLQDSDGSVH

SEQ ID NO: 126122 - protein, 34 aa, Artificial Sequence
  Description of Artificial Sequence: Synthetic polypeptide
DEDEIATTNPVAYEQYGSVCAAANPEDQDRDLNR

SEQ ID NO: 126123 - protein, 34 aa, Artificial Sequence
  Description of Artificial Sequence: Synthetic polypeptide
DEQEIATTNPVATEQWYRGSVSATDLEDHEGEDL

SEQ ID NO: 126124 - protein, 37 aa, Artificial Sequence
  Description of Artificial Sequence: Synthetic polypeptide
DEEEIRTTNPVATEQYGSVSSTGEAGINPRNGMNPVA

SEQ ID NO: 126125 - protein, 32 aa, Artificial Sequence
  Description of Artificial Sequence: Synthetic polypeptide
DEQEIATTNPVATEQYFSVSATDQEDPEGEDL

SEQ ID NO: 126126 - protein, 36 aa, Artificial Sequence
  Description of Artificial Sequence: Synthetic polypeptide
DEAEIRTTNPVATEQYGSVCSLWLQSEMIGQNEDKL

SEQ ID NO: 126127 - protein, 34 aa, Artificial Sequence
  Description of Artificial Sequence: Synthetic polypeptide
DETSICTTNPCATEQWGSVSTNNNNLQSGTNNDE

SEQ ID NO: 126128 - protein, 35 aa, Artificial Sequence
  Description of Artificial Sequence: Synthetic polypeptide
DEEEIRTTNPVATEQYGSVSVTGSQQPAIEVVEHI

SEQ ID NO: 126129 - protein, 31 aa, Artificial Sequence
  Description of Artificial Sequence: Synthetic polypeptide
DENEIRTTNPVSTEPYGTISEEDCQQQQGNH

SEQ ID NO: 126130 - protein, 36 aa, Artificial Sequence
  Description of Artificial Sequence: Synthetic polypeptide
DESEIRTTNPVATEQYGSVSMWWNNGEFQMGEKNQE

SEQ ID NO: 126131 - protein, 35 aa, Artificial Sequence
  Description of Artificial Sequence: Synthetic polypeptide
DESEIRTTNPVATEQYGSVSCTVELTQETSAEDIQ

SEQ ID NO: 126132 - protein, 34 aa, Artificial Sequence
  Description of Artificial Sequence: Synthetic polypeptide
DEQEIATTNPVATEQWGSVSMNNPGAPDNQEGNH

SEQ ID NO: 126133 - protein, 34 aa, Artificial Sequence
  Description of Artificial Sequence: Synthetic polypeptide
DETSICTTNPCATEQWGSVSTVVTNLQSGTNAGD

SEQ ID NO: 126134 - protein, 35 aa, Artificial Sequence
  Description of Artificial Sequence: Synthetic polypeptide
DESEIRTTNPVATEQYGSVSCTGNQSPWTMTENGV

SEQ ID NO: 126135 - protein, 33 aa, Artificial Sequence
  Description of Artificial Sequence: Synthetic polypeptide
DETSICTTNPCATEQWGVVSTNNNLQAGNNENQ

SEQ ID NO: 126136 - protein, 33 aa, Artificial Sequence
  Description of Artificial Sequence: Synthetic polypeptide
DETSICTTNPCATEQWGVVSTNNNLQLGNNEGG

SEQ ID NO: 126137 - protein, 33 aa, Artificial Sequence
  Description of Artificial Sequence: Synthetic polypeptide
DETSICTTNPCATEQWGVVSTNNNLQQGNNEET

SEQ ID NO: 126138 - protein, 33 aa, Artificial Sequence
  Description of Artificial Sequence: Synthetic polypeptide
DETSICTTNPCATEQWGVVSTNNNLQSGNTEQG

SEQ ID NO: 126139 - protein, 38 aa, Artificial Sequence
  Description of Artificial Sequence: Synthetic polypeptide
DEEEIRTTNPVATEQYGSVSTVNNNNNQQGTDEEENDT

SEQ ID NO: 126140 - protein, 29 aa, Artificial Sequence
  Description of Artificial Sequence: Synthetic peptide
AENEIRCTNPVSTEPYGEASMDIQQQGGR

SEQ ID NO: 126141 - protein, 32 aa, Artificial Sequence
  Description of Artificial Sequence: Synthetic polypeptide
DENEIRTTNPVSTEPYGTISEEDLQQQQNGNH

SEQ ID NO: 126142 - protein, 36 aa, Artificial Sequence
  Description of Artificial Sequence: Synthetic polypeptide
DESEIRTTNPVATEQYGSVSCTGCQSPSSTGTKNGV

SEQ ID NO: 126143 - protein, 37 aa, Artificial Sequence
  Description of Artificial Sequence: Synthetic polypeptide
DEEEIRTTNPVATEQYGSVSSTIPADGPNMRNGMNPV

SEQ ID NO: 126144 - protein, 31 aa, Artificial Sequence
  Description of Artificial Sequence: Synthetic polypeptide
DENEIRTTNPVSTEPYGTISEEDIQQQQGNL

SEQ ID NO: 126145 - protein, 39 aa, Artificial Sequence
  Description of Artificial Sequence: Synthetic polypeptide
DEEEIRTTNPVATEQYGSVSTVNNLQQGNQNNEEGQEDT

SEQ ID NO: 126146 - protein, 31 aa, Artificial Sequence
  Description of Artificial Sequence: Synthetic polypeptide
DENEIRTTNPVSTEPYGTISEEDIQQQNGNH

SEQ ID NO: 126147 - protein, 33 aa, Artificial Sequence
  Description of Artificial Sequence: Synthetic polypeptide
DEDEIRTTNPVATEQYGETTWCTNAHSQVGGDS

SEQ ID NO: 126148 - protein, 31 aa, Artificial Sequence
  Description of Artificial Sequence: Synthetic polypeptide
DENEIRTTNPVSTEPYGTISEEDEMQANGNA

SEQ ID NO: 126149 - protein, 35 aa, Artificial Sequence
  Description of Artificial Sequence: Synthetic polypeptide
DEAEIRTTNPVATEQYGSVCSPDCLETGYMEDMNL

SEQ ID NO: 126150 - protein, 30 aa, Artificial Sequence
  Description of Artificial Sequence: Synthetic polypeptide
AENEIRCTNPVATEQWGDVSEIEMNRAGDA

SEQ ID NO: 126151 - protein, 31 aa, Artificial Sequence
  Description of Artificial Sequence: Synthetic polypeptide
DENEIRTTNPVSTEPYGTISMDLQQQQNGGH

SEQ ID NO: 126152 - protein, 32 aa, Artificial Sequence
  Description of Artificial Sequence: Synthetic polypeptide
DENEIRTTNPVSTEPYGTISMEAGPQQRNGNV

SEQ ID NO: 126153 - protein, 31 aa, Artificial Sequence
  Description of Artificial Sequence: Synthetic polypeptide
DENEIRTTNPVSTEPYGTISMEDIQDHNGNH

SEQ ID NO: 126154 - protein, 32 aa, Artificial Sequence
  Description of Artificial Sequence: Synthetic polypeptide
DEDEIRTTNPVATEQWGGCCATGHQEAEGPRD

SEQ ID NO: 126155 - protein, 32 aa, Artificial Sequence
  Description of Artificial Sequence: Synthetic polypeptide
DEDEIRTTNPVATEQWGGCCATNHPAEGPMRE

SEQ ID NO: 126156 - protein, 34 aa, Artificial Sequence
  Description of Artificial Sequence: Synthetic polypeptide
DETEIRTTNPVAYEQWGSVCPTDNQDGQMGNNEP

SEQ ID NO: 126157 - protein, 33 aa, Artificial Sequence
  Description of Artificial Sequence: Synthetic polypeptide
DEQEIATTNPVATEQWGSVSATGDLEDHEGTDH

SEQ ID NO: 126158 - protein, 32 aa, Artificial Sequence
  Description of Artificial Sequence: Synthetic polypeptide
DEDEIRTTNPVATEQWGGCCATNHQAEGPMEN

SEQ ID NO: 126159 - protein, 35 aa, Artificial Sequence
  Description of Artificial Sequence: Synthetic polypeptide
DETEIRTTNPVAYEQWGSVCSTDNNDAGHRGANDS

SEQ ID NO: 126160 - protein, 34 aa, Artificial Sequence
  Description of Artificial Sequence: Synthetic polypeptide
DETEIRTTNPVAYEQWGSVCSTENDQGHTQNGGD

SEQ ID NO: 126161 - protein, 32 aa, Artificial Sequence
  Description of Artificial Sequence: Synthetic polypeptide
DENEIRTTNPVSTEPYGTISMEDIPNQQNGNH

SEQ ID NO: 126162 - protein, 32 aa, Artificial Sequence
  Description of Artificial Sequence: Synthetic polypeptide
DENEIRTTNPVSTEPYGTISMEDINQVQFGNV

SEQ ID NO: 126163 - protein, 32 aa, Artificial Sequence
  Description of Artificial Sequence: Synthetic polypeptide
DENEIRTTNPVSTEPYGTISMEDINQQQNGNH

SEQ ID NO: 126164 - protein, 32 aa, Artificial Sequence
  Description of Artificial Sequence: Synthetic polypeptide
DENEIRTTNPVSTEPYGTISMEDINQEQLGNA

SEQ ID NO: 126165 - protein, 33 aa, Artificial Sequence
  Description of Artificial Sequence: Synthetic polypeptide
DEQEIATTNPVATEQWGSVSATGDLFDHQGEDH

SEQ ID NO: 126166 - protein, 35 aa, Artificial Sequence
  Description of Artificial Sequence: Synthetic polypeptide
DESEIRTTNPVATEQYGTVCSATDNPPEDFEGEND

SEQ ID NO: 126167 - protein, 34 aa, Artificial Sequence
  Description of Artificial Sequence: Synthetic polypeptide
DESEIRTTNPVATEQYGTVCSATDGEVEFEGEND

SEQ ID NO: 126168 - protein, 36 aa, Artificial Sequence
  Description of Artificial Sequence: Synthetic polypeptide
DETEIRTTNPVAYEQWGSVCSTENLGDQDIERGGQM

SEQ ID NO: 126169 - protein, 36 aa, Artificial Sequence
  Description of Artificial Sequence: Synthetic polypeptide
DETEIRTTNPVAYEQWGSVCSTENLGDQDIHDGGNI

SEQ ID NO: 126170 - protein, 32 aa, Artificial Sequence
  Description of Artificial Sequence: Synthetic polypeptide
DENEIRTTNPVSTEPYGTISMEDILQQQNGNH

SEQ ID NO: 126171 - protein, 36 aa, Artificial Sequence
  Description of Artificial Sequence: Synthetic polypeptide
DETEIRTTNPVAYEQWGSVCSTENLGDQDIQQRGGQ

SEQ ID NO: 126172 - protein, 30 aa, Artificial Sequence
  Description of Artificial Sequence: Synthetic polypeptide
DEDEIRTTNPVATEQWGDVSYIEMNAAEDA

SEQ ID NO: 126173 - protein, 33 aa, Artificial Sequence
  Description of Artificial Sequence: Synthetic polypeptide
DEQEIATTNPVATEQWGSVSATGDMADQEGEDL

SEQ ID NO: 126174 - protein, 35 aa, Artificial Sequence
  Description of Artificial Sequence: Synthetic polypeptide
DEDEIATTNPVAYEQYGSVSAANDLPQDAPDGNNN

SEQ ID NO: 126175 - protein, 37 aa, Artificial Sequence
  Description of Artificial Sequence: Synthetic polypeptide
DEEEIRTTNPVATEQYGSVSSTPPANPNMENGMNPIQ

SEQ ID NO: 126176 - protein, 37 aa, Artificial Sequence
  Description of Artificial Sequence: Synthetic polypeptide
DEEEIRTTNPVATEQYGSVSSTSPAGPNMRNGMNPVI

SEQ ID NO: 126177 - protein, 32 aa, Artificial Sequence
  Description of Artificial Sequence: Synthetic polypeptide
DETEIRTTNPVAYECWGSVYYGWNDQQGGGDR

SEQ ID NO: 126178 - protein, 32 aa, Artificial Sequence
  Description of Artificial Sequence: Synthetic polypeptide
DENEIRTTNPVSTEPYGTISMEDIQNQQNGNH

SEQ ID NO: 126179 - protein, 32 aa, Artificial Sequence
  Description of Artificial Sequence: Synthetic polypeptide
DETEIRTTNPVAYECWGTVSWTEHDNRGGGNK

SEQ ID NO: 126180 - protein, 32 aa, Artificial Sequence
  Description of Artificial Sequence: Synthetic polypeptide
DENEIRTTNPVSTEPYGTISMEDIQNHQNGNH

SEQ ID NO: 126181 - protein, 32 aa, Artificial Sequence
  Description of Artificial Sequence: Synthetic polypeptide
DENEIRTTNPVSTEPYGTISMEDIQNDQNGNH

SEQ ID NO: 126182 - protein, 32 aa, Artificial Sequence
  Description of Artificial Sequence: Synthetic polypeptide
DESEIRTTNPVATEQYGVMATSAGQHNGMDPI

SEQ ID NO: 126183 - protein, 37 aa, Artificial Sequence
  Description of Artificial Sequence: Synthetic polypeptide
DEEEIRTTNPVATEQYGSVSSTRPAGPNMRNGMNPVA

SEQ ID NO: 126184 - protein, 32 aa, Artificial Sequence
  Description of Artificial Sequence: Synthetic polypeptide
DENEIRTTNPVSTEPYGTISMEDIQLQQNGNH

SEQ ID NO: 126185 - protein, 32 aa, Artificial Sequence
  Description of Artificial Sequence: Synthetic polypeptide
DENEIRTTNPVSTEPYGTISMEDIQLQGNGNH

SEQ ID NO: 126186 - protein, 33 aa, Artificial Sequence
  Description of Artificial Sequence: Synthetic polypeptide
DEQEIATTNPVATEQWGSVSATGDLDDSEGEDL

SEQ ID NO: 126187 - protein, 31 aa, Artificial Sequence
  Description of Artificial Sequence: Synthetic polypeptide
DEDEIRTTNPVATEQWGCVSEGEMNAHEDEA

SEQ ID NO: 126188 - protein, 32 aa, Artificial Sequence
  Description of Artificial Sequence: Synthetic polypeptide
DEDEIRTTNPVATEQWGCVSEGVEMNAAEDGN

SEQ ID NO: 126189 - protein, 31 aa, Artificial Sequence
  Description of Artificial Sequence: Synthetic polypeptide
DEDEIRTTNPVATEQWGCVSEWEMNAALDAW

SEQ ID NO: 126190 - protein, 30 aa, Artificial Sequence
  Description of Artificial Sequence: Synthetic polypeptide
DEDEIRTTNPVATEQWGDVSEIEMNAAEDA

SEQ ID NO: 126191 - protein, 31 aa, Artificial Sequence
  Description of Artificial Sequence: Synthetic polypeptide
DEDEIRTTNPVATEQWGDVSEIEMNAAEDAQ

SEQ ID NO: 126192 - protein, 34 aa, Artificial Sequence
  Description of Artificial Sequence: Synthetic polypeptide
DEQEIATTNPVATEQWGSVSATGDLDNHQGEDNH

SEQ ID NO: 126193 - protein, 33 aa, Artificial Sequence
  Description of Artificial Sequence: Synthetic polypeptide
DEQEIATTNPVATEQWGSVSATGDLDNHQGEEA

SEQ ID NO: 126194 - protein, 36 aa, Artificial Sequence
  Description of Artificial Sequence: Synthetic polypeptide
DEEEIRTTNPVATEQYGSVSTEDELTTTEHTQTDDY

SEQ ID NO: 126195 - protein, 33 aa, Artificial Sequence
  Description of Artificial Sequence: Synthetic polypeptide
DEDEIATTNPVAYEQYGSVSAANNLTASGGDDN

SEQ ID NO: 126196 - protein, 32 aa, Artificial Sequence
  Description of Artificial Sequence: Synthetic polypeptide
DENEIRTTNPVSTEPYGTISMEAGPQQRNGNH

SEQ ID NO: 126197 - protein, 32 aa, Artificial Sequence
  Description of Artificial Sequence: Synthetic polypeptide
DEDEIATTNPVAYEQYGSVCTPLAEPGDDQDD

SEQ ID NO: 126198 - protein, 35 aa, Artificial Sequence
  Description of Artificial Sequence: Synthetic polypeptide
DETEIRTTNPVAYEQWGSVCSTENLGDQNIEDGGI

SEQ ID NO: 126199 - protein, 31 aa, Artificial Sequence
  Description of Artificial Sequence: Synthetic polypeptide
AENEIRTTNPVATEQYGTISEEDIQQQNGGH

SEQ ID NO: 126200 - protein, 33 aa, Artificial Sequence
  Description of Artificial Sequence: Synthetic polypeptide
DETEIRTTNPVAYEQWGVVCSTDNPDIDGGGQR

SEQ ID NO: 126201 - protein, 34 aa, Artificial Sequence
  Description of Artificial Sequence: Synthetic polypeptide
DEDEIRTTNPVATEQWGTVSTLQQGTNVATEDGQ

SEQ ID NO: 126202 - protein, 36 aa, Artificial Sequence
  Description of Artificial Sequence: Synthetic polypeptide
DEDEIRTTNPVATEQWGTVSTNLQRTTNVATEDGSQ

SEQ ID NO: 126203 - protein, 36 aa, Artificial Sequence
  Description of Artificial Sequence: Synthetic polypeptide
DESEIRTTNPVATEQYGSVSSTTPAGPNMRNGMNPV

SEQ ID NO: 126204 - protein, 33 aa, Artificial Sequence
  Description of Artificial Sequence: Synthetic polypeptide
DEDEIRTTNPVATEQWGTVSTVNIGTTNAEEED

SEQ ID NO: 126205 - protein, 34 aa, Artificial Sequence
  Description of Artificial Sequence: Synthetic polypeptide
DEDEIRTTNPVATEQWGTVSTVSIGTTNAEEGTD

SEQ ID NO: 126206 - protein, 33 aa, Artificial Sequence
  Description of Artificial Sequence: Synthetic polypeptide
DEDEIRTTNPVATEQWGTVSTVTISTNAGEDAE

SEQ ID NO: 126207 - protein, 31 aa, Artificial Sequence
  Description of Artificial Sequence: Synthetic polypeptide
DENEIRTTNPVSTEPYGTISMEDCQQQQGNH

SEQ ID NO: 126208 - protein, 31 aa, Artificial Sequence
  Description of Artificial Sequence: Synthetic polypeptide
DENEIRTTNPVSTEPYGTISMEDCQQQNGNH

SEQ ID NO: 126209 - protein, 29 aa, Artificial Sequence
  Description of Artificial Sequence: Synthetic peptide
AENEIRTTNPVATEQWGDVSEIEMNAEDA

SEQ ID NO: 126210 - protein, 33 aa, Artificial Sequence
  Description of Artificial Sequence: Synthetic polypeptide
DEDEIRTTNPVATEQWGTVSTVVISTNAGEDEA

SEQ ID NO: 126211 - protein, 36 aa, Artificial Sequence
  Description of Artificial Sequence: Synthetic polypeptide
DESEIRTTNPVATEQYGSVSSTTPAGPNMRNGMNPI

SEQ ID NO: 126212 - protein, 34 aa, Artificial Sequence
  Description of Artificial Sequence: Synthetic polypeptide
DETEIRTTNPVAYESWGSVATSNLNQGDAGQNQP

SEQ ID NO: 126213 - protein, 31 aa, Artificial Sequence
  Description of Artificial Sequence: Synthetic polypeptide
DENEIRTTNPVSTEPYGTISMECIQQQHGNL

SEQ ID NO: 126214 - protein, 31 aa, Artificial Sequence
  Description of Artificial Sequence: Synthetic polypeptide
DENEIRTTNPVSTEPYGTISMECIQQQHGNH

SEQ ID NO: 126215 - protein, 29 aa, Artificial Sequence
  Description of Artificial Sequence: Synthetic peptide
DETEIRTVNPIATEQWGATADDLQPKGPQ

SEQ ID NO: 126216 - protein, 34 aa, Artificial Sequence
  Description of Artificial Sequence: Synthetic polypeptide
DETEISTTNPVATEQYGSTVPFITNAPSFGGGDR

SEQ ID NO: 126217 - protein, 32 aa, Artificial Sequence
  Description of Artificial Sequence: Synthetic polypeptide
DENEIRTTNPVSTEPYGTISMEAIPNQQNGNH

SEQ ID NO: 126218 - protein, 33 aa, Artificial Sequence
  Description of Artificial Sequence: Synthetic polypeptide
DEDEIRTTNPVATEQWGTVSTEQQGTNNATEDA

SEQ ID NO: 126219 - protein, 35 aa, Artificial Sequence
  Description of Artificial Sequence: Synthetic polypeptide
DETEIRTTNPVAYEQWGSVCSTENLGDQDQEDGGE

SEQ ID NO: 126220 - protein, 31 aa, Artificial Sequence
  Description of Artificial Sequence: Synthetic polypeptide
DETEIRTTNPVAYEQWGTVSKEIENRQAEDS

SEQ ID NO: 126221 - protein, 32 aa, Artificial Sequence
  Description of Artificial Sequence: Synthetic polypeptide
DENEIRTTNPVSTEPYGTISMEDGQNQQNGNH

SEQ ID NO: 126222 - protein, 35 aa, Artificial Sequence
  Description of Artificial Sequence: Synthetic polypeptide
DETEIRTTNPVAYEQWGSVCSTENLGGQDIQDGDQ

SEQ ID NO: 126223 - protein, 33 aa, Artificial Sequence
  Description of Artificial Sequence: Synthetic polypeptide
DESEIRTTNPVATEQYGSVWPMNWIENRSEQQE

SEQ ID NO: 126224 - protein, 32 aa, Artificial Sequence
  Description of Artificial Sequence: Synthetic polypeptide
DEDEIRTTNPVATEQWGGCCATNHQAEPPDRD

SEQ ID NO: 126225 - protein, 34 aa, Artificial Sequence
  Description of Artificial Sequence: Synthetic polypeptide
DETEIRTTNPVAYEQWGSVCYTDNQQGQMGNNEE

SEQ ID NO: 126226 - protein, 36 aa, Artificial Sequence
  Description of Artificial Sequence: Synthetic polypeptide
DESEIRTTNPVATEQYGSVVSTTPDGPNMGNGENDG

SEQ ID NO: 126227 - protein, 33 aa, Artificial Sequence
  Description of Artificial Sequence: Synthetic polypeptide
DETEIRTTNPVAYEQWGSVSGGNDMGDRGGGQD

SEQ ID NO: 126228 - protein, 35 aa, Artificial Sequence
  Description of Artificial Sequence: Synthetic polypeptide
DETEIRTTNPVAYEQWGSVSNLNDDHQEGRGENEP

SEQ ID NO: 126229 - protein, 31 aa, Artificial Sequence
  Description of Artificial Sequence: Synthetic polypeptide
DEDEIRTTNPVATEQWGKVSEIEMNAAETDA

SEQ ID NO: 126230 - protein, 35 aa, Artificial Sequence
  Description of Artificial Sequence: Synthetic polypeptide
DEDEIATTNPVAYEQYGSVCSTNPELQEHDDNLAK

SEQ ID NO: 126231 - protein, 34 aa, Artificial Sequence
  Description of Artificial Sequence: Synthetic polypeptide
DEDEIATTNPVAYEQYGSVCSTNNPLNHGDLDAM

SEQ ID NO: 126232 - protein, 37 aa, Artificial Sequence
  Description of Artificial Sequence: Synthetic polypeptide
DEDEIRTTNPVATEQWGSVSATANALDQDTPGPNPQA

SEQ ID NO: 126233 - protein, 34 aa, Artificial Sequence
  Description of Artificial Sequence: Synthetic polypeptide
DEDEIRTTNPVATEQWGSVYHWTNDHQITDGHDG

SEQ ID NO: 126234 - protein, 30 aa, Artificial Sequence
  Description of Artificial Sequence: Synthetic polypeptide
DEDEIRTTNPVATEQWGTVSEWEMNAAEDA

SEQ ID NO: 126235 - protein, 28 aa, Artificial Sequence
  Description of Artificial Sequence: Synthetic peptide
CEAEIATTNPVATEQYGEAPEVCQHEEK

SEQ ID NO: 126236 - protein, 33 aa, Artificial Sequence
  Description of Artificial Sequence: Synthetic polypeptide
DEDEIATTNPVAYEQYGSVCSAPLQEHIDITRM

SEQ ID NO: 126237 - protein, 38 aa, Artificial Sequence
  Description of Artificial Sequence: Synthetic polypeptide
DESEIRTTNPVATEQYGSVSTGTVNGLGQEGGGQTTNN

SEQ ID NO: 126238 - protein, 36 aa, Artificial Sequence
  Description of Artificial Sequence: Synthetic polypeptide
DESEIRTTNPVATEQYGSVSSTTPTGPNMRNGMNPV

SEQ ID NO: 126239 - protein, 30 aa, Artificial Sequence
  Description of Artificial Sequence: Synthetic polypeptide
AENEIRTTNPVSTEPYGTASMENIQQQGGH

SEQ ID NO: 126240 - protein, 37 aa, Artificial Sequence
  Description of Artificial Sequence: Synthetic polypeptide
DESEIRTTNPVATEQYGSVSSTTPQDGPNMRNGMNPQ

SEQ ID NO: 126241 - protein, 33 aa, Artificial Sequence
  Description of Artificial Sequence: Synthetic polypeptide
DEDEIRTTNPVATEQWGTVSTEIGTNNAEEGEA

SEQ ID NO: 126242 - protein, 33 aa, Artificial Sequence
  Description of Artificial Sequence: Synthetic polypeptide
DESEIRTTNPVATEPWTCVSCINEPQDREGENG

SEQ ID NO: 126243 - protein, 33 aa, Artificial Sequence
  Description of Artificial Sequence: Synthetic polypeptide
DESEIRTTNPVATEPWGTVSMENEPQDQNGENG

SEQ ID NO: 126244 - protein, 38 aa, Artificial Sequence
  Description of Artificial Sequence: Synthetic polypeptide
DEDEIRTTNPVATEQYGSVSTVNLQQGNNQNNTNTDED

SEQ ID NO: 126245 - protein, 35 aa, Artificial Sequence
  Description of Artificial Sequence: Synthetic polypeptide
DEDEIRTTNPVATTQYGSVSTTQQQLQEATNVATD

SEQ ID NO: 126246 - protein, 34 aa, Artificial Sequence
  Description of Artificial Sequence: Synthetic polypeptide
DESEIRTTNPVATECWGYVSRCINEPQDREGENG

SEQ ID NO: 126247 - protein, 36 aa, Artificial Sequence
  Description of Artificial Sequence: Synthetic polypeptide
DEVEIRTTNPVATEQYGSVISTTPDGPNMGNGENID

SEQ ID NO: 126248 - protein, 34 aa, Artificial Sequence
  Description of Artificial Sequence: Synthetic polypeptide
DESEIRTTNPVATECWGYVSCINYEPQDREGENG

SEQ ID NO: 126249 - protein, 34 aa, Artificial Sequence
  Description of Artificial Sequence: Synthetic polypeptide
DESEIRTTNPVATECWGYVSCINEPQDREGENDG

SEQ ID NO: 126250 - protein, 34 aa, Artificial Sequence
  Description of Artificial Sequence: Synthetic polypeptide
DESEIRTTNPVATECWGYSVSCINEPYDREGENG

SEQ ID NO: 126251 - protein, 35 aa, Artificial Sequence
  Description of Artificial Sequence: Synthetic polypeptide
DEQEIATTNPVATEQYGSVCAATNTLSNSNDKERY

SEQ ID NO: 126252 - protein, 34 aa, Artificial Sequence
  Description of Artificial Sequence: Synthetic polypeptide
DEAEIRTTNPVATEQYGSVWSTINWNTSEDEEQA

SEQ ID NO: 126253 - protein, 34 aa, Artificial Sequence
  Description of Artificial Sequence: Synthetic polypeptide
CEEEIRTTNPVATEQYGQCVCSTEHQNFGSDTQQ

SEQ ID NO: 126254 - protein, 34 aa, Artificial Sequence
  Description of Artificial Sequence: Synthetic polypeptide
DESEIRTTNPVATECWGYSVSCINEPQDREDENG

SEQ ID NO: 126255 - protein, 35 aa, Artificial Sequence
  Description of Artificial Sequence: Synthetic polypeptide
DEVEIRTTNPVATEQYGSVMGNFGSNDQDGEGNGV

SEQ ID NO: 126256 - protein, 36 aa, Artificial Sequence
  Description of Artificial Sequence: Synthetic polypeptide
DEEEIRTTNPVATEQYGSVSPTNMMMAEFPGLEEVN

SEQ ID NO: 126257 - protein, 34 aa, Artificial Sequence
  Description of Artificial Sequence: Synthetic polypeptide
DEVEIRTTNPVATEQYGSVNDTNMNDEMVEQEGI

SEQ ID NO: 126258 - protein, 35 aa, Artificial Sequence
  Description of Artificial Sequence: Synthetic polypeptide
DEVEIRTTNPVATEQYGSVNGTGDEQDEGEGNNQQ

SEQ ID NO: 126259 - protein, 35 aa, Artificial Sequence
  Description of Artificial Sequence: Synthetic polypeptide
DENEIRTTNPVATESYGSVMSDNNDLDQEGQTGQT

SEQ ID NO: 126260 - protein, 34 aa, Artificial Sequence
  Description of Artificial Sequence: Synthetic polypeptide
DENEIRTTNPVATESWGSVSCWNISQTTGGLNPF

SEQ ID NO: 126261 - protein, 34 aa, Artificial Sequence
  Description of Artificial Sequence: Synthetic polypeptide
DESEIRTTNPVATECWGWVSCINEPQDREGENTG

SEQ ID NO: 126262 - protein, 34 aa, Artificial Sequence
  Description of Artificial Sequence: Synthetic polypeptide
DEVEIRTTNPVATEQYGSVQSWEDVALGEESNED

SEQ ID NO: 126263 - protein, 36 aa, Artificial Sequence
  Description of Artificial Sequence: Synthetic polypeptide
DEEEIRTTNPVATEQYGSVSPTNMMMGESMGEEEVY

SEQ ID NO: 126264 - protein, 36 aa, Artificial Sequence
  Description of Artificial Sequence: Synthetic polypeptide
DEDEIRTTNPVATTQYGSVSTTNQQLQQSTNVATEN

SEQ ID NO: 126265 - protein, 36 aa, Artificial Sequence
  Description of Artificial Sequence: Synthetic polypeptide
DEDEIRTTNPVATTQYGSVSTTNQQLQQATNVATTA

SEQ ID NO: 126266 - protein, 30 aa, Artificial Sequence
  Description of Artificial Sequence: Synthetic polypeptide
DENEIRTTNPVATEVWGMVSEIEMNRAEDA

SEQ ID NO: 126267 - protein, 36 aa, Artificial Sequence
  Description of Artificial Sequence: Synthetic polypeptide
DEEEIRTTNPVATEQYGSVSPTNNNIMDMVSLENDF

SEQ ID NO: 126268 - protein, 35 aa, Artificial Sequence
  Description of Artificial Sequence: Synthetic polypeptide
DESEIRTTNPVATECWNGSVWSCINEPQDREGENG

SEQ ID NO: 126269 - protein, 30 aa, Artificial Sequence
  Description of Artificial Sequence: Synthetic polypeptide
AENEIACTNPVATEYYGEASEVLQRGDGQE

SEQ ID NO: 126270 - protein, 37 aa, Artificial Sequence
  Description of Artificial Sequence: Synthetic polypeptide
DEEEIRTTNPVATEQYGSVSPTNNMMQQEGPGEEEVN

SEQ ID NO: 126271 - protein, 35 aa, Artificial Sequence
  Description of Artificial Sequence: Synthetic polypeptide
DESEIRTTNPVATECWNGSVSCINCPQDREGENNG

SEQ ID NO: 126272 - protein, 34 aa, Artificial Sequence
  Description of Artificial Sequence: Synthetic polypeptide
DESEIRTTNPVATECWNGSVSCIGEPQDREGENG

SEQ ID NO: 126273 - protein, 36 aa, Artificial Sequence
  Description of Artificial Sequence: Synthetic polypeptide
DEEEIRTTNPVATEQYGSVSPTNNMMMQESAEEVVN

SEQ ID NO: 126274 - protein, 37 aa, Artificial Sequence
  Description of Artificial Sequence: Synthetic polypeptide
DEEEIRTTNPVATEQYGSVSPTNNMMMQEPTGEEEVN

SEQ ID NO: 126275 - protein, 33 aa, Artificial Sequence
  Description of Artificial Sequence: Synthetic polypeptide
DEQEIATTNPVATEQYGSVCAAPLQDHGDQTQH

SEQ ID NO: 126276 - protein, 36 aa, Artificial Sequence
  Description of Artificial Sequence: Synthetic polypeptide
DEEEIRTTNPVATEQYGSVSPTNNMMMQEDLEEEVN

SEQ ID NO: 126277 - protein, 35 aa, Artificial Sequence
  Description of Artificial Sequence: Synthetic polypeptide
DEVEIRTTNPVATEQYGSVDDTDNNMTGEGGNGGT

SEQ ID NO: 126278 - protein, 33 aa, Artificial Sequence
  Description of Artificial Sequence: Synthetic polypeptide
DEQEIATTNPVATEQYGSVCAAPLQDHQGDQQM

SEQ ID NO: 126279 - protein, 34 aa, Artificial Sequence
  Description of Artificial Sequence: Synthetic polypeptide
DEVEIRTTNPVATEQYGSVDGNTNDDNEEGGQGD

SEQ ID NO: 126280 - protein, 35 aa, Artificial Sequence
  Description of Artificial Sequence: Synthetic polypeptide
DEVEIRTTNPVATEQYGSVDQTNDEGEGQEQGEDG

SEQ ID NO: 126281 - protein, 36 aa, Artificial Sequence
  Description of Artificial Sequence: Synthetic polypeptide
DEEEIRTTNPVATEQYGSVSPTNNMMHQESQEEEVM

SEQ ID NO: 126282 - protein, 34 aa, Artificial Sequence
  Description of Artificial Sequence: Synthetic polypeptide
DESEIRTTNPVATECWHGSVWCINEPQDREGENG

SEQ ID NO: 126283 - protein, 34 aa, Artificial Sequence
  Description of Artificial Sequence: Synthetic polypeptide
DESEIRTTNPVATECWHGSVSCINEPSDREGENG

SEQ ID NO: 126284 - protein, 34 aa, Artificial Sequence
  Description of Artificial Sequence: Synthetic polypeptide
CEEEIRTTNPVATEQYGQCVCSTEHEQNFGSQQM

SEQ ID NO: 126285 - protein, 34 aa, Artificial Sequence
  Description of Artificial Sequence: Synthetic polypeptide
DESEIRTTNPVATECWHGSVSCINEPQDREMENG

SEQ ID NO: 126286 - protein, 35 aa, Artificial Sequence
  Description of Artificial Sequence: Synthetic polypeptide
CEEEIRTTNPVATEQYGQCVCSTGNHNQGFGSEQS

SEQ ID NO: 126287 - protein, 34 aa, Artificial Sequence
  Description of Artificial Sequence: Synthetic polypeptide
DEDEIRTTNPVATTQYGVVSTNNATEQYGSTEDE

SEQ ID NO: 126288 - protein, 31 aa, Artificial Sequence
  Description of Artificial Sequence: Synthetic polypeptide
DENEIRTTNPVATEQYWGRVSEIEMNAAEDA

SEQ ID NO: 126289 - protein, 36 aa, Artificial Sequence
  Description of Artificial Sequence: Synthetic polypeptide
DEVEIRTTNPVATEQYGSVSGNNDEMQTGEGGNNEQ

SEQ ID NO: 126290 - protein, 36 aa, Artificial Sequence
  Description of Artificial Sequence: Synthetic polypeptide
DEVEIRTTNPVATEQYGSVSSTTPAGPNMRNGMNPV

SEQ ID NO: 126291 - protein, 34 aa, Artificial Sequence
  Description of Artificial Sequence: Synthetic polypeptide
CEDEIATTNPVATEQYGSVATAPTNPGNQTEGNN

SEQ ID NO: 126292 - protein, 33 aa, Artificial Sequence
  Description of Artificial Sequence: Synthetic polypeptide
DESEIRTTNPVATECWGTVSTINEPEDFEGENG

SEQ ID NO: 126293 - protein, 32 aa, Artificial Sequence
  Description of Artificial Sequence: Synthetic polypeptide
DEAEIRTTNPVATEQYGSTCHGTPDLIESEEQ

SEQ ID NO: 126294 - protein, 36 aa, Artificial Sequence
  Description of Artificial Sequence: Synthetic polypeptide
DEVEIRTTNPVATEQYGSVSSTTPHGPNMRNGMNPV

SEQ ID NO: 126295 - protein, 36 aa, Artificial Sequence
  Description of Artificial Sequence: Synthetic polypeptide
DEVEIRTTNPVATEQYGSVSSTTPRGPNMRNGMNPV

SEQ ID NO: 126296 - protein, 35 aa, Artificial Sequence
  Description of Artificial Sequence: Synthetic polypeptide
DEQEIATTNPVATEQYGSVCAPNGLEQTDDGGVNT

SEQ ID NO: 126297 - protein, 34 aa, Artificial Sequence
  Description of Artificial Sequence: Synthetic polypeptide
DEDEIRTTNPVAYECWGSVASGDNMNGQRGNADS

SEQ ID NO: 126298 - protein, 33 aa, Artificial Sequence
  Description of Artificial Sequence: Synthetic polypeptide
DEQEIATTNPVATEQYGSVCATALTQPDQAEGA

SEQ ID NO: 126299 - protein, 34 aa, Artificial Sequence
  Description of Artificial Sequence: Synthetic polypeptide
DEAEIRTTNPVATEQYGSVWSTIVWWTQEDEEQN

SEQ ID NO: 126300 - protein, 35 aa, Artificial Sequence
  Description of Artificial Sequence: Synthetic polypeptide
DEAEIRTTNPVATEQYGSVWSTSLWEQMEYDMIDN

SEQ ID NO: 126301 - protein, 30 aa, Artificial Sequence
  Description of Artificial Sequence: Synthetic polypeptide
AENEIACTNPVATEQYGTASEDGPQFEGGR

SEQ ID NO: 126302 - protein, 33 aa, Artificial Sequence
  Description of Artificial Sequence: Synthetic polypeptide
DEDEIRTTNPVAYECWGSVAWTDNEEQNGNGDP

SEQ ID NO: 126303 - protein, 31 aa, Artificial Sequence
  Description of Artificial Sequence: Synthetic polypeptide
DEDEIRTTNPVAYECWGSVCGDDLQEGDGDT

SEQ ID NO: 126304 - protein, 31 aa, Artificial Sequence
  Description of Artificial Sequence: Synthetic polypeptide
DEDEIRTTNPVAYECWGSVCGDDQQEGDNDT

SEQ ID NO: 126305 - protein, 32 aa, Artificial Sequence
  Description of Artificial Sequence: Synthetic polypeptide
DEDEIRTTNPVAYECWGSVCVNDHAGDRGDHR

SEQ ID NO: 126306 - protein, 33 aa, Artificial Sequence
  Description of Artificial Sequence: Synthetic polypeptide
DEQEIATTNPVATEQYGSVCATDLMEDHEGEDL

SEQ ID NO: 126307 - protein, 32 aa, Artificial Sequence
  Description of Artificial Sequence: Synthetic polypeptide
DEQEIATTNPVATEQYGSVCATDPPTDDGGDQ

SEQ ID NO: 126308 - protein, 33 aa, Artificial Sequence
  Description of Artificial Sequence: Synthetic polypeptide
DEQEIATTNPVATEQYGSVCATDRLEDHEGEDL

SEQ ID NO: 126309 - protein, 36 aa, Artificial Sequence
  Description of Artificial Sequence: Synthetic polypeptide
DEVEIRTTNPVATEQYGSVSSTTPAGPNMRNGMNPI

SEQ ID NO: 126310 - protein, 33 aa, Artificial Sequence
  Description of Artificial Sequence: Synthetic polypeptide
CEEEIRTTNPVATEQYGQCVCSSYHQNFGSEQS

SEQ ID NO: 126311 - protein, 36 aa, Artificial Sequence
  Description of Artificial Sequence: Synthetic polypeptide
DEVEIRTTNPVATEQYGSVSSTTPAGPNMRNGMNPD

SEQ ID NO: 126312 - protein, 33 aa, Artificial Sequence
  Description of Artificial Sequence: Synthetic polypeptide
DEDEIRTTNPVAYECWGCVSGDNMGNQRGEGSR

SEQ ID NO: 126313 - protein, 34 aa, Artificial Sequence
  Description of Artificial Sequence: Synthetic polypeptide
DEDEIRTTNPVATTQYGVVSTNNNNEQYGSTDDE

SEQ ID NO: 126314 - protein, 34 aa, Artificial Sequence
  Description of Artificial Sequence: Synthetic polypeptide
DEDEIRTTNPVATTQYGVVSTNNTATEQGTNQDD

SEQ ID NO: 126315 - protein, 34 aa, Artificial Sequence
  Description of Artificial Sequence: Synthetic polypeptide
DEDEIRTTNPVATTQYGVVSTNNTATEQGTTQNQ

SEQ ID NO: 126316 - protein, 33 aa, Artificial Sequence
  Description of Artificial Sequence: Synthetic polypeptide
DEDEIRTTNPVATTQYGVVSTNNTTEQGSTEDE

SEQ ID NO: 126317 - protein, 34 aa, Artificial Sequence
  Description of Artificial Sequence: Synthetic polypeptide
DESEIRTTNPVATECWGWSVSCINEPQDREGEDG

SEQ ID NO: 126318 - protein, 33 aa, Artificial Sequence
  Description of Artificial Sequence: Synthetic polypeptide
DESEIRTTNPVATECWGVVSCINEPQDSEGENG

SEQ ID NO: 126319 - protein, 33 aa, Artificial Sequence
  Description of Artificial Sequence: Synthetic polypeptide
DESEIRTTNPVATECWGVVSCINEPQDREGEVG

SEQ ID NO: 126320 - protein, 34 aa, Artificial Sequence
  Description of Artificial Sequence: Synthetic polypeptide
DEDEIRTTNPVATTQYGVVSTVNNATEEGTNNQG

SEQ ID NO: 126321 - protein, 33 aa, Artificial Sequence
  Description of Artificial Sequence: Synthetic polypeptide
DESEIRTTNPVATECWGVVSCINEPEDREGENG

SEQ ID NO: 126322 - protein, 35 aa, Artificial Sequence
  Description of Artificial Sequence: Synthetic polypeptide
DEVEIRTTNPVATEQYGSVSNDDSETGQGNGGNGN

SEQ ID NO: 126323 - protein, 33 aa, Artificial Sequence
  Description of Artificial Sequence: Synthetic polypeptide
DEDEIRTTNPVAYEAWGEVATNLNQGDVGQNQA

SEQ ID NO: 126324 - protein, 33 aa, Artificial Sequence
  Description of Artificial Sequence: Synthetic polypeptide
DENEIRTTNPVATEQYGVVVDNGFNGEGGNNDG

SEQ ID NO: 126325 - protein, 32 aa, Artificial Sequence
  Description of Artificial Sequence: Synthetic polypeptide
DEQEIATTNPVATEQYGSVCAMHGQDSPPDRH

SEQ ID NO: 126326 - protein, 34 aa, Artificial Sequence
  Description of Artificial Sequence: Synthetic polypeptide
DESEIRTTNPVATECWGVSVSQINEPQDREGFDC

SEQ ID NO: 126327 - protein, 34 aa, Artificial Sequence
  Description of Artificial Sequence: Synthetic polypeptide
DESEIRTTNPVATECWGVSVICINEPQDREGENG

SEQ ID NO: 126328 - protein, 31 aa, Artificial Sequence
  Description of Artificial Sequence: Synthetic polypeptide
DEDEIRTTNPVAYEAWGVVTGGNANDLGNER

SEQ ID NO: 126329 - protein, 35 aa, Artificial Sequence
  Description of Artificial Sequence: Synthetic polypeptide
DEVEIRTTNPVATEQYGSVSPTLPAAEWHGMNNQV

SEQ ID NO: 126330 - protein, 36 aa, Artificial Sequence
  Description of Artificial Sequence: Synthetic polypeptide
DEVEIRTTNPVATEQYGSVSSCTPAGPNMRNGMNPV

SEQ ID NO: 126331 - protein, 36 aa, Artificial Sequence
  Description of Artificial Sequence: Synthetic polypeptide
DEVEIRTTNPVATEQYGSVSSTTHDGPIMRNGMNPV

SEQ ID NO: 126332 - protein, 36 aa, Artificial Sequence
  Description of Artificial Sequence: Synthetic polypeptide
DEVEIRTTNPVATEQYGSVSSTTPAGPNMRNGMNEV

SEQ ID NO: 126333 - protein, 34 aa, Artificial Sequence
  Description of Artificial Sequence: Synthetic polypeptide
DESEIRTTNPVATECWQGVVSCINEPQDREGENG

SEQ ID NO: 126334 - protein, 34 aa, Artificial Sequence
  Description of Artificial Sequence: Synthetic polypeptide
DESEIRTTNPVATECWSGSVSCINEPQDKEGENG

SEQ ID NO: 126335 - protein, 36 aa, Artificial Sequence
  Description of Artificial Sequence: Synthetic polypeptide
DEDEIRTTNPVATTQYGSVSTTLQQLQQGTNNNTND

SEQ ID NO: 126336 - protein, 30 aa, Artificial Sequence
  Description of Artificial Sequence: Synthetic polypeptide
DEVEIRTTNPVATEQWGDVSEISMNAAEDA

SEQ ID NO: 126337 - protein, 30 aa, Artificial Sequence
  Description of Artificial Sequence: Synthetic polypeptide
DEVEIRTTNPVATEQWGDVSRIEMNAAEDA

SEQ ID NO: 126338 - protein, 30 aa, Artificial Sequence
  Description of Artificial Sequence: Synthetic polypeptide
DEVEIRTTNPVATEQWGKVSEIEMNAAEDA

SEQ ID NO: 126339 - protein, 32 aa, Artificial Sequence
  Description of Artificial Sequence: Synthetic polypeptide
DEDEIATTNPVAYEQWGMTSTNLQGMGDDGSP

SEQ ID NO: 126340 - protein, 34 aa, Artificial Sequence
  Description of Artificial Sequence: Synthetic polypeptide
CEEEICTTNPVGYERYGEKVSTNAPSQRGGENRM

SEQ ID NO: 126341 - protein, 34 aa, Artificial Sequence
  Description of Artificial Sequence: Synthetic polypeptide
DEAEIRTTNPVATEQYGSVWPTDMEEQGGITVFI

SEQ ID NO: 126342 - protein, 36 aa, Artificial Sequence
  Description of Artificial Sequence: Synthetic polypeptide
DEEEIRTTNPVATEQYGSVSTTVNGFGQENDDEFTG

SEQ ID NO: 126343 - protein, 32 aa, Artificial Sequence
  Description of Artificial Sequence: Synthetic polypeptide
AENEIACTNPVAYEPYGEISENELSQRGGGNR

SEQ ID NO: 126344 - protein, 33 aa, Artificial Sequence
  Description of Artificial Sequence: Synthetic polypeptide
DEVEIRTTNPVATEQYGCVCSNWEHQNFGSEQS

SEQ ID NO: 126345 - protein, 33 aa, Artificial Sequence
  Description of Artificial Sequence: Synthetic polypeptide
CEEEIATVNPVATEQYGCVAGTGLQSRANNQES

SEQ ID NO: 126346 - protein, 34 aa, Artificial Sequence
  Description of Artificial Sequence: Synthetic polypeptide
DEVEIRTTNPVATEQYGCVCSTEEHNQNFGSEQA

SEQ ID NO: 126347 - protein, 32 aa, Artificial Sequence
  Description of Artificial Sequence: Synthetic polypeptide
DEDEIATTNPVAYEQWGMTSTNDLQGDGDDSS

SEQ ID NO: 126348 - protein, 35 aa, Artificial Sequence
  Description of Artificial Sequence: Synthetic polypeptide
DEDEIRTTNPVATEVWGSVCYTNDLQQDDHGGNQE

SEQ ID NO: 126349 - protein, 33 aa, Artificial Sequence
  Description of Artificial Sequence: Synthetic polypeptide
DESEIRTTNPVATECYGSVSACIDLEDHEGEDG

SEQ ID NO: 126350 - protein, 35 aa, Artificial Sequence
  Description of Artificial Sequence: Synthetic polypeptide
DESEIRTTNPVATECYGSVCSACDNEPQDFEGENG

SEQ ID NO: 126351 - protein, 33 aa, Artificial Sequence
  Description of Artificial Sequence: Synthetic polypeptide
DEDEIATTNPVAYEPYGSVSGNNPQNNGDNSDT

SEQ ID NO: 126352 - protein, 35 aa, Artificial Sequence
  Description of Artificial Sequence: Synthetic polypeptide
CEEEIRTTNPVATEQYGQCVCSNTNHQNFGSETQS

SEQ ID NO: 126353 - protein, 29 aa, Artificial Sequence
  Description of Artificial Sequence: Synthetic peptide
DESEIRTTNPVATECYGEAPEVCQHEEEK

SEQ ID NO: 126354 - protein, 30 aa, Artificial Sequence
  Description of Artificial Sequence: Synthetic polypeptide
DESEIRTTNPVATECYGEAPEIVCQHEGEK

SEQ ID NO: 126355 - protein, 30 aa, Artificial Sequence
  Description of Artificial Sequence: Synthetic polypeptide
DEVEIRTTNPVATEQWGDVSEIERNAAEDA

SEQ ID NO: 126356 - protein, 33 aa, Artificial Sequence
  Description of Artificial Sequence: Synthetic polypeptide
DEQEIATTNPVATEQYGSVAVTDLGEDHEGEDL

SEQ ID NO: 126357 - protein, 31 aa, Artificial Sequence
  Description of Artificial Sequence: Synthetic polypeptide
DEVEIRTTNPVATEQWGDVSEIEMNAAESDA

SEQ ID NO: 126358 - protein, 34 aa, Artificial Sequence
  Description of Artificial Sequence: Synthetic polypeptide
DEQEIATTNPVATEQYGSVASATRDLEDHEGEDL

SEQ ID NO: 126359 - protein, 36 aa, Artificial Sequence
  Description of Artificial Sequence: Synthetic polypeptide
DEEEIRTTNPVATEQYGSVSPTSLVSQVDVHEILPD

SEQ ID NO: 126360 - protein, 34 aa, Artificial Sequence
  Description of Artificial Sequence: Synthetic polypeptide
DEQEIATTNPVATEQYGSVAMNGLTQPDNGDTAM

SEQ ID NO: 126361 - protein, 39 aa, Artificial Sequence
  Description of Artificial Sequence: Synthetic polypeptide
DEEEIRTTNPVATEQYGSVSTTVNNTNNLQAGTEQGNTD

SEQ ID NO: 126362 - protein, 32 aa, Artificial Sequence
  Description of Artificial Sequence: Synthetic polypeptide
AENEIACTNPVAYEQYGETISENALSQRGGGR

SEQ ID NO: 126363 - protein, 36 aa, Artificial Sequence
  Description of Artificial Sequence: Synthetic polypeptide
DEDEIRTTNPVATEQYGVVSTVVVNQQAGNNDEEDE

SEQ ID NO: 126364 - protein, 36 aa, Artificial Sequence
  Description of Artificial Sequence: Synthetic polypeptide
DEEEIRTTNPVATEQYGSVSPTQMMMQESTGEEEVM

SEQ ID NO: 126365 - protein, 35 aa, Artificial Sequence
  Description of Artificial Sequence: Synthetic polypeptide
DEEEIRTTNPVATEQYGSVSPTQMMHQESIEEEVM

SEQ ID NO: 126366 - protein, 32 aa, Artificial Sequence
  Description of Artificial Sequence: Synthetic polypeptide
DEDEIATTNPVAYEQWGMTSTNLQHMGQDGSN

SEQ ID NO: 126367 - protein, 34 aa, Artificial Sequence
  Description of Artificial Sequence: Synthetic polypeptide
DEVEIRTTNPVATEFYGSVYTGNGQNQNNIGGEG

SEQ ID NO: 126368 - protein, 36 aa, Artificial Sequence
  Description of Artificial Sequence: Synthetic polypeptide
DEDEIRTTNPVATEQYGVVSTVVVTTNLQAGSTEDQ

SEQ ID NO: 126369 - protein, 34 aa, Artificial Sequence
  Description of Artificial Sequence: Synthetic polypeptide
DEVEIRTTNPVATEGYGSVIDTTNNGQGEGGGQE

SEQ ID NO: 126370 - protein, 32 aa, Artificial Sequence
  Description of Artificial Sequence: Synthetic polypeptide
DEQEIATTNPVATEQYGSVANTDWEDHEGEDL

SEQ ID NO: 126371 - protein, 33 aa, Artificial Sequence
  Description of Artificial Sequence: Synthetic polypeptide
DEQEIATTNPVATEQYGSVASAGDLEDHEGEDL

SEQ ID NO: 126372 - protein, 31 aa, Artificial Sequence
  Description of Artificial Sequence: Synthetic polypeptide
AENEIACTNPVAYEQYGCYCSWNLQRFGSGQ

SEQ ID NO: 126373 - protein, 37 aa, Artificial Sequence
  Description of Artificial Sequence: Synthetic polypeptide
DEDEIRTTNPVATEQYGVVSTVVVTTNNLQAGSTNSE

SEQ ID NO: 126374 - protein, 34 aa, Artificial Sequence
  Description of Artificial Sequence: Synthetic polypeptide
DEQEIATTNPVATEQYGSVASATDLEHHQGEDLF

SEQ ID NO: 126375 - protein, 33 aa, Artificial Sequence
  Description of Artificial Sequence: Synthetic polypeptide
DEAEIRTTNPVATEQYGSVWMLPTQQISDQNEN

SEQ ID NO: 126376 - protein, 30 aa, Artificial Sequence
  Description of Artificial Sequence: Synthetic polypeptide
DEVEIRTTNPVATEQWGDVSEIEMNAAEDA

SEQ ID NO: 126377 - protein, 34 aa, Artificial Sequence
  Description of Artificial Sequence: Synthetic polypeptide
CEEEICTTNPVGYERYGQSVSTNATSQSGGDNRM

SEQ ID NO: 126378 - protein, 31 aa, Artificial Sequence
  Description of Artificial Sequence: Synthetic polypeptide
DEVEIRTTNPVATEQWGDVSEIEMNAAEDQA

SEQ ID NO: 126379 - protein, 33 aa, Artificial Sequence
  Description of Artificial Sequence: Synthetic polypeptide
DEDEIRTTNPVAYECWGSVTGGPNLQDSGNNEH

SEQ ID NO: 126380 - protein, 34 aa, Artificial Sequence
  Description of Artificial Sequence: Synthetic polypeptide
DEDEIRTTNPVATQQYGCVVSCTNVSGADGGNNP

SEQ ID NO: 126381 - protein, 33 aa, Artificial Sequence
  Description of Artificial Sequence: Synthetic polypeptide
DEQEIATTNPVATEQYGSVAWTDILEDHNGEDK

SEQ ID NO: 126382 - protein, 34 aa, Artificial Sequence
  Description of Artificial Sequence: Synthetic polypeptide
DEQEIATTNPVATEQYGSVCAAMNPLNDMDGNGN

SEQ ID NO: 126383 - protein, 34 aa, Artificial Sequence
  Description of Artificial Sequence: Synthetic polypeptide
DESEIRTTNPVATECWWGSVSCINEPQDAEGENG

SEQ ID NO: 126384 - protein, 33 aa, Artificial Sequence
  Description of Artificial Sequence: Synthetic polypeptide
DEQEIATTNPVATEQYGSVCAAMNPNNDMDGNN

SEQ ID NO: 126385 - protein, 37 aa, Artificial Sequence
  Description of Artificial Sequence: Synthetic polypeptide
DEEEIRTTNPVATEQYGSVSPTNNSIMQLESLENDFI

SEQ ID NO: 126386 - protein, 37 aa, Artificial Sequence
  Description of Artificial Sequence: Synthetic polypeptide
DEEEIRTTNPVATEQYGSVSPTNNSGLNIIMDQVDLI

SEQ ID NO: 126387 - protein, 36 aa, Artificial Sequence
  Description of Artificial Sequence: Synthetic polypeptide
DEEEIRTTNPVATEQYGSVSPTNNSGLNIIAETDTI

SEQ ID NO: 126388 - protein, 34 aa, Artificial Sequence
  Description of Artificial Sequence: Synthetic polypeptide
DESEIRTTNPVATECWWGSTSCINEPQDREGENG

SEQ ID NO: 126389 - protein, 36 aa, Artificial Sequence
  Description of Artificial Sequence: Synthetic polypeptide
DEDEIRTTNPVATTQYGSVSTNLQQLEQATNVATEF

SEQ ID NO: 126390 - protein, 36 aa, Artificial Sequence
  Description of Artificial Sequence: Synthetic polypeptide
DEDEIRTTNPVATTQYGSVSTNLQQLQNATNVATEQ

SEQ ID NO: 126391 - protein, 33 aa, Artificial Sequence
  Description of Artificial Sequence: Synthetic polypeptide
DESEIRTTNPVATECWSSVSCINEPQDNEGENG

SEQ ID NO: 126392 - protein, 36 aa, Artificial Sequence
  Description of Artificial Sequence: Synthetic polypeptide
DEDEIRTTNPVATTQYGSVSTNLQQLQQATNNATEG

SEQ ID NO: 126393 - protein, 33 aa, Artificial Sequence
  Description of Artificial Sequence: Synthetic polypeptide
DENEIRTTNPVATWHYGSVSTMNQEQVVETEDF

SEQ ID NO: 126394 - protein, 33 aa, Artificial Sequence
  Description of Artificial Sequence: Synthetic polypeptide
DENEIRTTNPVATWHYGSVSTMNQEQVEMIEDF

SEQ ID NO: 126395 - protein, 35 aa, Artificial Sequence
  Description of Artificial Sequence: Synthetic polypeptide
DESEIRTTNPVATECWSGSVSCRNEPQDREGENGM

SEQ ID NO: 126396 - protein, 34 aa, Artificial Sequence
  Description of Artificial Sequence: Synthetic polypeptide
DESEIRTTNPVATECWSGSVSCIVEPQDREGENG

SEQ ID NO: 126397 - protein, 33 aa, Artificial Sequence
  Description of Artificial Sequence: Synthetic polypeptide
DENEIRTTNPVATWHYGSVSTMGQEQVENEEDF

SEQ ID NO: 126398 - protein, 34 aa, Artificial Sequence
  Description of Artificial Sequence: Synthetic polypeptide
DEVEIRTTNPVATEQYGSCNWTNNLETGISMQEM

SEQ ID NO: 126399 - protein, 35 aa, Artificial Sequence
  Description of Artificial Sequence: Synthetic polypeptide
DESEIRTTNPVATECWSGSVSCINEPQDREGENTG

SEQ ID NO: 126400 - protein, 36 aa, Artificial Sequence
  Description of Artificial Sequence: Synthetic polypeptide
DEDEIRTTNPVATTQYGSVSTTLQLQQGTNNNNTDG

SEQ ID NO: 126401 - protein, 35 aa, Artificial Sequence
  Description of Artificial Sequence: Synthetic polypeptide
DESEIRTTNPVATECWWGSVSCINEPQDREGENGI

SEQ ID NO: 126402 - protein, 33 aa, Artificial Sequence
  Description of Artificial Sequence: Synthetic polypeptide
DEQEIATTNPVATEQYGSVAWTDILEDHERQDL

SEQ ID NO: 126403 - protein, 35 aa, Artificial Sequence
  Description of Artificial Sequence: Synthetic polypeptide
DEDEIRTTNPVATTAYGSVSTTNLQAGSTQQGEDD

SEQ ID NO: 126404 - protein, 35 aa, Artificial Sequence
  Description of Artificial Sequence: Synthetic polypeptide
DESEIRTTNPVATECWWGSVSYCINCPQDREGENG

SEQ ID NO: 126405 - protein, 34 aa, Artificial Sequence
  Description of Artificial Sequence: Synthetic polypeptide
DEDEIRTTNPVATTAYGSVATNLQSGSTTQQTDE

SEQ ID NO: 126406 - protein, 34 aa, Artificial Sequence
  Description of Artificial Sequence: Synthetic polypeptide
DEQEIATTNPVATEQYGSVAWTDILEDHTGRGDL

SEQ ID NO: 126407 - protein, 33 aa, Artificial Sequence
  Description of Artificial Sequence: Synthetic polypeptide
DEDEIATTNPVAYEPYGSVCAGNNLTDAGGNGR

SEQ ID NO: 126408 - protein, 34 aa, Artificial Sequence
  Description of Artificial Sequence: Synthetic polypeptide
DEQEIATTNPVATEQYGSVAWTDILPEQHEGDDL

SEQ ID NO: 126409 - protein, 34 aa, Artificial Sequence
  Description of Artificial Sequence: Synthetic polypeptide
DEQEIATTNPVATEQYGSVAWTDILQEDHEGDDH

SEQ ID NO: 126410 - protein, 34 aa, Artificial Sequence
  Description of Artificial Sequence: Synthetic polypeptide
DEQEIATTNPVATEQYGSVAWTDILQEDNEGQDL

SEQ ID NO: 126411 - protein, 31 aa, Artificial Sequence
  Description of Artificial Sequence: Synthetic polypeptide
DEDEIATTNPVAYEPYGSVAGNGDQNSGGSV

SEQ ID NO: 126412 - protein, 33 aa, Artificial Sequence
  Description of Artificial Sequence: Synthetic polypeptide
DESEIRTTNPVATECYGAMSTGNGEGGGQTENF

SEQ ID NO: 126413 - protein, 36 aa, Artificial Sequence
  Description of Artificial Sequence: Synthetic polypeptide
DEVEIRTTNPVATEQYGDVSTDTGNNNGQENGNAGD

SEQ ID NO: 126414 - protein, 30 aa, Artificial Sequence
  Description of Artificial Sequence: Synthetic polypeptide
DEDEIATTNPVAYEPYGSTANNNLNDGDTQ

SEQ ID NO: 126415 - protein, 36 aa, Artificial Sequence
  Description of Artificial Sequence: Synthetic polypeptide
DEQEIATTNPVATEQYGSVCAADNNLEADRDGNDRH

SEQ ID NO: 126416 - protein, 33 aa, Artificial Sequence
  Description of Artificial Sequence: Synthetic polypeptide
DEQEIATTNPVATEQYGSVCAADNPLADMDINN

SEQ ID NO: 126417 - protein, 32 aa, Artificial Sequence
  Description of Artificial Sequence: Synthetic polypeptide
DEVEIRTTNPVATEQYGDVVDQSNGEGEEGGE

SEQ ID NO: 126418 - protein, 35 aa, Artificial Sequence
  Description of Artificial Sequence: Synthetic polypeptide
DEVEIRTTNPVATEQYGDVVGSNMNLEQGENGGGD

SEQ ID NO: 126419 - protein, 31 aa, Artificial Sequence
  Description of Artificial Sequence: Synthetic polypeptide
DEDEIATTNPVAYEPYGSTAANMNLQDGGDT

SEQ ID NO: 126420 - protein, 33 aa, Artificial Sequence
  Description of Artificial Sequence: Synthetic polypeptide
DEVEIRTTNPVATEQYGDVVTGEGEGQGNDGED

SEQ ID NO: 126421 - protein, 34 aa, Artificial Sequence
  Description of Artificial Sequence: Synthetic polypeptide
DESEIRTTNPVATECWWSVSCINEPQDREGENGM

SEQ ID NO: 126422 - protein, 33 aa, Artificial Sequence
  Description of Artificial Sequence: Synthetic polypeptide
DEVEIRTTNPVATEQYGEMTTTNGGQGGEDDGD

SEQ ID NO: 126423 - protein, 33 aa, Artificial Sequence
  Description of Artificial Sequence: Synthetic polypeptide
DESEIRTTNPVATECWWSTSCINEPQDREGENG

SEQ ID NO: 126424 - protein, 35 aa, Artificial Sequence
  Description of Artificial Sequence: Synthetic polypeptide
DESEIRTTNPVATECWWGSVSCINEPQDREGENLG

SEQ ID NO: 126425 - protein, 33 aa, Artificial Sequence
  Description of Artificial Sequence: Synthetic polypeptide
DEDEIRTTNPVAYECWGSVTGNGQNLQDEGNEH

SEQ ID NO: 126426 - protein, 34 aa, Artificial Sequence
  Description of Artificial Sequence: Synthetic polypeptide
DEDEIRTTNPVAYECWGSVTGTGQNLQDSPGNEH

SEQ ID NO: 126427 - protein, 33 aa, Artificial Sequence
  Description of Artificial Sequence: Synthetic polypeptide
DEDEIRTTNPVAYECWGSVTSNQNLGEDSGNEH

SEQ ID NO: 126428 - protein, 33 aa, Artificial Sequence
  Description of Artificial Sequence: Synthetic polypeptide
DEDEIRTTNPVAYEQWGSVCSGENDQHDTNMDS

SEQ ID NO: 126429 - protein, 39 aa, Artificial Sequence
  Description of Artificial Sequence: Synthetic polypeptide
DEEEIRTTNPVATEQYGSVSVTVTNLQISTTEQGTNQGS

SEQ ID NO: 126430 - protein, 39 aa, Artificial Sequence
  Description of Artificial Sequence: Synthetic polypeptide
DEEEIRTTNPVATEQYGSVSVTVTNLQISTTEQGTNTDN

SEQ ID NO: 126431 - protein, 31 aa, Artificial Sequence
  Description of Artificial Sequence: Synthetic polypeptide
AENEIACTNPVATEQYGEMSEVLTQRGDGQQ

SEQ ID NO: 126432 - protein, 36 aa, Artificial Sequence
  Description of Artificial Sequence: Synthetic polypeptide
DEEEIRTTNPVATEQYGSVSPTLSMMMQSEGEEEVN

SEQ ID NO: 126433 - protein, 36 aa, Artificial Sequence
  Description of Artificial Sequence: Synthetic polypeptide
DENEIRTTNPVATEQYGSVYMPTDNLENRIEVNQIT

SEQ ID NO: 126434 - protein, 39 aa, Artificial Sequence
  Description of Artificial Sequence: Synthetic polypeptide
DEEEIRTTNPVATEQYGSVSVTVTNLQQGTTEQGTNQDD

SEQ ID NO: 126435 - protein, 35 aa, Artificial Sequence
  Description of Artificial Sequence: Synthetic polypeptide
DEDEIRTTNPVAYEQWGSVCSNDNHMLPGQGGNTE

SEQ ID NO: 126436 - protein, 35 aa, Artificial Sequence
  Description of Artificial Sequence: Synthetic polypeptide
DEEEIRTTNPVATEQYGSVSPTLPIIISETMNEMQ

SEQ ID NO: 126437 - protein, 37 aa, Artificial Sequence
  Description of Artificial Sequence: Synthetic polypeptide
DEEEIRTTNPVATEQYGSVSTTTQAGSNNANGTNNVE

SEQ ID NO: 126438 - protein, 36 aa, Artificial Sequence
  Description of Artificial Sequence: Synthetic polypeptide
DEEEIRTTNPVATEQYGSVSPTLPAAESHGMNNQPV

SEQ ID NO: 126439 - protein, 34 aa, Artificial Sequence
  Description of Artificial Sequence: Synthetic polypeptide
DEQEIATTNPVATEQYGSVFSATDLEDHEGEDLP

SEQ ID NO: 126440 - protein, 39 aa, Artificial Sequence
  Description of Artificial Sequence: Synthetic polypeptide
DEEEIRTTNPVATEQYGSVSVTVTNLQQSATEQGTNEGS

SEQ ID NO: 126441 - protein, 34 aa, Artificial Sequence
  Description of Artificial Sequence: Synthetic polypeptide
DENEIRTTNPVATEQYGSVYAWNSNLESGQESMM

SEQ ID NO: 126442 - protein, 35 aa, Artificial Sequence
  Description of Artificial Sequence: Synthetic polypeptide
DEEEIRTTNPVATEQYGSVSTLDYLTNWEETQFDG

SEQ ID NO: 126443 - protein, 39 aa, Artificial Sequence
  Description of Artificial Sequence: Synthetic polypeptide
DEEEIRTTNPVATEQYGSVSVTVTNLQQSATETGTNQGQ

SEQ ID NO: 126444 - protein, 37 aa, Artificial Sequence
  Description of Artificial Sequence: Synthetic polypeptide
DEEEIRTTNPVATEQYGSVSPTLNNLPSEFDGEVEIM

SEQ ID NO: 126445 - protein, 36 aa, Artificial Sequence
  Description of Artificial Sequence: Synthetic polypeptide
DEVEIRTTNPVATEQYGSVSVTTGDNEQTGGGQEID

SEQ ID NO: 126446 - protein, 33 aa, Artificial Sequence
  Description of Artificial Sequence: Synthetic polypeptide
DEQEIATTNPVATEQYGSVGATDLEDHEGKEDL

SEQ ID NO: 126447 - protein, 34 aa, Artificial Sequence
  Description of Artificial Sequence: Synthetic polypeptide
DEQEIATTNPVATEQYGSVFSATDLEDHEGCEDL

SEQ ID NO: 126448 - protein, 37 aa, Artificial Sequence
  Description of Artificial Sequence: Synthetic polypeptide
DEEEIRTTNPVATEQYGSVSPTLNNLPAEFGGEVELM

SEQ ID NO: 126449 - protein, 34 aa, Artificial Sequence
  Description of Artificial Sequence: Synthetic polypeptide
DEQEIATTNPVATEQYGSVFSATDHLEPHEGEDT

SEQ ID NO: 126450 - protein, 34 aa, Artificial Sequence
  Description of Artificial Sequence: Synthetic polypeptide
DEQEIATTNPVATEQYGSVFSATDFLEDHEGEDL

SEQ ID NO: 126451 - protein, 34 aa, Artificial Sequence
  Description of Artificial Sequence: Synthetic polypeptide
DEAEIRTTNPVATEQYGSSCPAVVHGAEREGQER

SEQ ID NO: 126452 - protein, 34 aa, Artificial Sequence
  Description of Artificial Sequence: Synthetic polypeptide
DENEIRTTNPVATEQYGSVYTWNMIGTESSEERQ

SEQ ID NO: 126453 - protein, 34 aa, Artificial Sequence
  Description of Artificial Sequence: Synthetic polypeptide
DEDEIRTTNPVAYEQWGSVATPNQLQGDQDNGAQ

SEQ ID NO: 126454 - protein, 34 aa, Artificial Sequence
  Description of Artificial Sequence: Synthetic polypeptide
DENEIRTTNPVATEQYGSVYTWNMAQTESSEEGA

SEQ ID NO: 126455 - protein, 35 aa, Artificial Sequence
  Description of Artificial Sequence: Synthetic polypeptide
DEAEIRTTNPVATEQYGSSCPAVQGNAEREGNQEM

SEQ ID NO: 126456 - protein, 32 aa, Artificial Sequence
  Description of Artificial Sequence: Synthetic polypeptide
DEDEIRTTNPVAYEQWGSVCLEDTDQGGDGNT

SEQ ID NO: 126457 - protein, 34 aa, Artificial Sequence
  Description of Artificial Sequence: Synthetic polypeptide
DENEIRTTNPVATEQYGSVYTWDMIQDESSEERV

SEQ ID NO: 126458 - protein, 32 aa, Artificial Sequence
  Description of Artificial Sequence: Synthetic polypeptide
DEDEIRTTNPVAYEQWGSVCPEDTIQGGDGNP

SEQ ID NO: 126459 - protein, 33 aa, Artificial Sequence
  Description of Artificial Sequence: Synthetic polypeptide
DEDEIRTTNPVAYEQWGSVCPEDTRQGGQDGNT

SEQ ID NO: 126460 - protein, 33 aa, Artificial Sequence
  Description of Artificial Sequence: Synthetic polypeptide
DEDEIRTTNPVAYEQWGSVCPNDINQGEGNANT

SEQ ID NO: 126461 - protein, 33 aa, Artificial Sequence
  Description of Artificial Sequence: Synthetic polypeptide
DEDEIRTTNPVAYEQWGSVCPNDTQGMGQNDHE

SEQ ID NO: 126462 - protein, 37 aa, Artificial Sequence
  Description of Artificial Sequence: Synthetic polypeptide
DEEEIRTTNPVATEQYGSVSPTMNAVNVAFDQNVERD

SEQ ID NO: 126463 - protein, 37 aa, Artificial Sequence
  Description of Artificial Sequence: Synthetic polypeptide
DEEEIRTTNPVATEQYGSVSPTMNAVNPAFDENPERD

SEQ ID NO: 126464 - protein, 37 aa, Artificial Sequence
  Description of Artificial Sequence: Synthetic polypeptide
DEEEIRTTNPVATEQYGSVSPTMNAVHVAADQLENDE

SEQ ID NO: 126465 - protein, 34 aa, Artificial Sequence
  Description of Artificial Sequence: Synthetic polypeptide
CEEEIRTTNPVATEQYGQCVCSWNHQNFNSETQS

SEQ ID NO: 126466 - protein, 37 aa, Artificial Sequence
  Description of Artificial Sequence: Synthetic polypeptide
DEEEIRTTNPVATEQYGSVSPTMNAVEFIQDQLENDD

SEQ ID NO: 126467 - protein, 37 aa, Artificial Sequence
  Description of Artificial Sequence: Synthetic polypeptide
DEEEIRTTNPVATEQYGSVSPTMNANEVIADQLENDD

SEQ ID NO: 126468 - protein, 37 aa, Artificial Sequence
  Description of Artificial Sequence: Synthetic polypeptide
DEEEIRTTNPVATEQYGSVSPTMNAGHFAADQLENED

SEQ ID NO: 126469 - protein, 35 aa, Artificial Sequence
  Description of Artificial Sequence: Synthetic polypeptide
DEDEIRTTNPVAYEQWGSVCPTDNHDRQGGDGNHR

SEQ ID NO: 126470 - protein, 34 aa, Artificial Sequence
  Description of Artificial Sequence: Synthetic polypeptide
DEDEIRTTNPVAYEQWGSVCSGDNNGDQRNGGGI

SEQ ID NO: 126471 - protein, 34 aa, Artificial Sequence
  Description of Artificial Sequence: Synthetic polypeptide
DENEIRTTNPVATEQYGSVYTWNMIQDESSEEFE

SEQ ID NO: 126472 - protein, 37 aa, Artificial Sequence
  Description of Artificial Sequence: Synthetic polypeptide
DEEEIRTTNPVATEQYGSVSTTTQAGNNTESGTNPVN

SEQ ID NO: 126473 - protein, 34 aa, Artificial Sequence
  Description of Artificial Sequence: Synthetic polypeptide
DENEIRTTNPVATEQYGSVYAANSNQESGQEDQM

SEQ ID NO: 126474 - protein, 35 aa, Artificial Sequence
  Description of Artificial Sequence: Synthetic polypeptide
DEVEIRTTNPVATEQYGSVYSDMDGNGQGEINDDE

SEQ ID NO: 126475 - protein, 36 aa, Artificial Sequence
  Description of Artificial Sequence: Synthetic polypeptide
DEVEIRTTNPVATEQYGSVYSDMDNEGGQGGEINET

SEQ ID NO: 126476 - protein, 33 aa, Artificial Sequence
  Description of Artificial Sequence: Synthetic polypeptide
DENEIRTTNPVATEQYGSVVVPVDNDESPNEHN

SEQ ID NO: 126477 - protein, 35 aa, Artificial Sequence
  Description of Artificial Sequence: Synthetic polypeptide
DEDEIRTTNPVAYEQWGSVCSTDNDQQIEGGGNEI

SEQ ID NO: 126478 - protein, 35 aa, Artificial Sequence
  Description of Artificial Sequence: Synthetic polypeptide
DEDEIRTTNPVAYEQWGSVCSTDNDQQIEGHNNEI

SEQ ID NO: 126479 - protein, 35 aa, Artificial Sequence
  Description of Artificial Sequence: Synthetic polypeptide
DENEIRTTNPVATEQYGSVVSDWNMESRFDSNQDD

SEQ ID NO: 126480 - protein, 33 aa, Artificial Sequence
  Description of Artificial Sequence: Synthetic polypeptide
DEQEIATTNPVATEQYGSVHSATDLEDHESEDL

SEQ ID NO: 126481 - protein, 34 aa, Artificial Sequence
  Description of Artificial Sequence: Synthetic polypeptide
DESEIRTTNPVATECWGSVYCINEPQAREGENGE

SEQ ID NO: 126482 - protein, 36 aa, Artificial Sequence
  Description of Artificial Sequence: Synthetic polypeptide
DEDEIRTTNPVAYEQWGSVCSTDNGGNLGDQGNGRN

SEQ ID NO: 126483 - protein, 36 aa, Artificial Sequence
  Description of Artificial Sequence: Synthetic polypeptide
DEDEIRTTNPVAYEQWGSVCSTDNGGNLGQQGNGAD

SEQ ID NO: 126484 - protein, 34 aa, Artificial Sequence
  Description of Artificial Sequence: Synthetic polypeptide
DEVEIRTTNPVATEQYGVVDTTGDTGQGGGENGE

SEQ ID NO: 126485 - protein, 36 aa, Artificial Sequence
  Description of Artificial Sequence: Synthetic polypeptide
DEDEIRTTNPVAYEQWGSVCSTDNGGNQGGQMNGRN

SEQ ID NO: 126486 - protein, 36 aa, Artificial Sequence
  Description of Artificial Sequence: Synthetic polypeptide
DENEIRTTNPVATEQYGSVVPTIMLEELRNGNEEVF

SEQ ID NO: 126487 - protein, 36 aa, Artificial Sequence
  Description of Artificial Sequence: Synthetic polypeptide
DEEEIRTTNPVATEQYGSVSPTLGSIEQIPAGVIQV

SEQ ID NO: 126488 - protein, 31 aa, Artificial Sequence
  Description of Artificial Sequence: Synthetic polypeptide
AENEIACTNPVATEQYGEFSEVLQRGDGQQY

SEQ ID NO: 126489 - protein, 37 aa, Artificial Sequence
  Description of Artificial Sequence: Synthetic polypeptide
DEEEIRTTNPVATEQYGSVSTTTQAGNNAENGTNPEG

SEQ ID NO: 126490 - protein, 31 aa, Artificial Sequence
  Description of Artificial Sequence: Synthetic polypeptide
AENEIACTNPVATEQYGEFCSWNLQYGSDQF

SEQ ID NO: 126491 - protein, 32 aa, Artificial Sequence
  Description of Artificial Sequence: Synthetic polypeptide
DEQEIATTNPVATEQYGSVIATDLEDHEHEDL

SEQ ID NO: 126492 - protein, 36 aa, Artificial Sequence
  Description of Artificial Sequence: Synthetic polypeptide
DEDEIRTTNPVAYEQWGSVCSTDNGGNQGQQGNQRN

SEQ ID NO: 126493 - protein, 38 aa, Artificial Sequence
  Description of Artificial Sequence: Synthetic polypeptide
DEEEIRTTNPVATEQYGSVSVTVVTNNNNQAGNNQQQD

SEQ ID NO: 126494 - protein, 37 aa, Artificial Sequence
  Description of Artificial Sequence: Synthetic polypeptide
DEEEIRTTNPVATEQYGSVSPTLNMMMQESEGEEEVY

SEQ ID NO: 126495 - protein, 36 aa, Artificial Sequence
  Description of Artificial Sequence: Synthetic polypeptide
DENEIRTTNPVATEQYGSVWPTLNSLHVIEGSNEDV

SEQ ID NO: 126496 - protein, 36 aa, Artificial Sequence
  Description of Artificial Sequence: Synthetic polypeptide
DEEEIRTTNPVATEQYGSVSPTLMWMMQEEGSEEVN

SEQ ID NO: 126497 - protein, 36 aa, Artificial Sequence
  Description of Artificial Sequence: Synthetic polypeptide
DEEEIRTTNPVATEQYGSVSPTLNMMMHEENEECVN

SEQ ID NO: 126498 - protein, 35 aa, Artificial Sequence
  Description of Artificial Sequence: Synthetic polypeptide
DEDEIRTTNPVAYEQWGSVCSNENDQRNDTQNGNQ

SEQ ID NO: 126499 - protein, 35 aa, Artificial Sequence
  Description of Artificial Sequence: Synthetic polypeptide
DENEIRTTNPVATEQYGSVWVTVNQNAFEGQNNDN

SEQ ID NO: 126500 - protein, 35 aa, Artificial Sequence
  Description of Artificial Sequence: Synthetic polypeptide
DENEIRTTNPVATEQYGSVWVTVNQNAFEFGQNDG

SEQ ID NO: 126501 - protein, 33 aa, Artificial Sequence
  Description of Artificial Sequence: Synthetic polypeptide
DEQEIATTNPVATEQYGSVHATDLTEDHEGEDL

SEQ ID NO: 126502 - protein, 34 aa, Artificial Sequence
  Description of Artificial Sequence: Synthetic polypeptide
DEDEIRTTNPVAYEQWGSVCSTDLQEGDTQGGGQ

SEQ ID NO: 126503 - protein, 34 aa, Artificial Sequence
  Description of Artificial Sequence: Synthetic polypeptide
DEVEIRTTNPVATEQYGSVTTGDEDQNIGGGEIE

SEQ ID NO: 126504 - protein, 35 aa, Artificial Sequence
  Description of Artificial Sequence: Synthetic polypeptide
DENEIRTTNPVATEQYGSVWVTVLLNEGGNNFSFG

SEQ ID NO: 126505 - protein, 34 aa, Artificial Sequence
  Description of Artificial Sequence: Synthetic polypeptide
DENEIRTTNPVATEQYGSVWVTPWDGNQETQNMQ

SEQ ID NO: 126506 - protein, 32 aa, Artificial Sequence
  Description of Artificial Sequence: Synthetic polypeptide
DEQEIATTNPVATEQYGSVHATDMEDHEGEDL

SEQ ID NO: 126507 - protein, 38 aa, Artificial Sequence
  Description of Artificial Sequence: Synthetic polypeptide
DEEEIRTTNPVATEQYGSVSVTVVNNLQQGTTEEEEED

SEQ ID NO: 126508 - protein, 36 aa, Artificial Sequence
  Description of Artificial Sequence: Synthetic polypeptide
DEEEIRTTNPVATEQYGSVSPTLNHMMAEENEEEVN

SEQ ID NO: 126509 - protein, 35 aa, Artificial Sequence
  Description of Artificial Sequence: Synthetic polypeptide
DEVEIRTTNPVATEQYGSVVGFGNLEDGENVQNIG

SEQ ID NO: 126510 - protein, 32 aa, Artificial Sequence
  Description of Artificial Sequence: Synthetic polypeptide
DEQEIATTNPVATEQYGSVHATDWEDHEGEDL

SEQ ID NO: 126511 - protein, 36 aa, Artificial Sequence
  Description of Artificial Sequence: Synthetic polypeptide
DENEIRTTNPVATEQYGSVWSTSDCEGQHEGEDNDI

SEQ ID NO: 126512 - protein, 38 aa, Artificial Sequence
  Description of Artificial Sequence: Synthetic polypeptide
DEEEIRTTNPVATEQYGSVSVTVVNNNNQQGNNNEQNG

SEQ ID NO: 126513 - protein, 35 aa, Artificial Sequence
  Description of Artificial Sequence: Synthetic polypeptide
DEVEIRTTNPVATEQYGSVVGFGNNLEDGENQENI

SEQ ID NO: 126514 - protein, 35 aa, Artificial Sequence
  Description of Artificial Sequence: Synthetic polypeptide
DENEIRTTNPVATEQYGSVWSFTDMINIQEVSFED

SEQ ID NO: 126515 - protein, 35 aa, Artificial Sequence
  Description of Artificial Sequence: Synthetic polypeptide
DEVEIRTTNPVATEQYGSVVNSVGNGEFTNQGQGR

SEQ ID NO: 126516 - protein, 37 aa, Artificial Sequence
  Description of Artificial Sequence: Synthetic polypeptide
DEEEIRTTNPVATEQYGSVSTTTQAGNNNENGTNPVT

SEQ ID NO: 126517 - protein, 35 aa, Artificial Sequence
  Description of Artificial Sequence: Synthetic polypeptide
DEEEIRTTNPVATEQYGSVSPTSMMMMEWGEEESN

SEQ ID NO: 126518 - protein, 34 aa, Artificial Sequence
  Description of Artificial Sequence: Synthetic polypeptide
DENEIRTTNPVATEQYGSVYTWNMIQTESSEETN

SEQ ID NO: 126519 - protein, 33 aa, Artificial Sequence
  Description of Artificial Sequence: Synthetic polypeptide
DEQEIATTNPVATEQYGSVFATDDLEDHEGEDL

SEQ ID NO: 126520 - protein, 31 aa, Artificial Sequence
  Description of Artificial Sequence: Synthetic polypeptide
DENEIRTTNPVATEQYGTVSEEIEMNAAEDH

SEQ ID NO: 126521 - protein, 38 aa, Artificial Sequence
  Description of Artificial Sequence: Synthetic polypeptide
DEEEIRTTNPVATEQYGSVSVTSTNNQISTEQGTNNNN

SEQ ID NO: 126522 - protein, 34 aa, Artificial Sequence
  Description of Artificial Sequence: Synthetic polypeptide
DESEIRTTNPVATECWGTSVSCINEPQDHEGENG

SEQ ID NO: 126523 - protein, 34 aa, Artificial Sequence
  Description of Artificial Sequence: Synthetic polypeptide
DEAEIRTTNPVATEQYGSSSSWNETNYPGTQEHN

SEQ ID NO: 126524 - protein, 35 aa, Artificial Sequence
  Description of Artificial Sequence: Synthetic polypeptide
DESEIRTTNPVATECWGTSVSCCINEPQDREGENQ

SEQ ID NO: 126525 - protein, 34 aa, Artificial Sequence
  Description of Artificial Sequence: Synthetic polypeptide
DEQEIATTNPVATEQYGSVCSATDDLEDHEGEDL

SEQ ID NO: 126526 - protein, 33 aa, Artificial Sequence
  Description of Artificial Sequence: Synthetic polypeptide
DEDEIRTTNPVAYEQWGAVCHTNDLQDNGGGVH

SEQ ID NO: 126527 - protein, 34 aa, Artificial Sequence
  Description of Artificial Sequence: Synthetic polypeptide
DESEIRTTNPVATECWGSYVSCIWEPQIREGENG

SEQ ID NO: 126528 - protein, 35 aa, Artificial Sequence
  Description of Artificial Sequence: Synthetic polypeptide
DEEEIRTTNPVATEQYGSVSVTTLDNVTATEMLSQ

SEQ ID NO: 126529 - protein, 34 aa, Artificial Sequence
  Description of Artificial Sequence: Synthetic polypeptide
DEAEIRTTNPVATEQYGSSSDVVNLEVETENNED

SEQ ID NO: 126530 - protein, 33 aa, Artificial Sequence
  Description of Artificial Sequence: Synthetic polypeptide
DEQEIATTNPVATEQYGSVCSATDGEDHHGEDL

SEQ ID NO: 126531 - protein, 37 aa, Artificial Sequence
  Description of Artificial Sequence: Synthetic polypeptide
DEEEIRTTNPVATEQYGSVSTTTVEQAGNQAGTTNNE

SEQ ID NO: 126532 - protein, 38 aa, Artificial Sequence
  Description of Artificial Sequence: Synthetic polypeptide
DEEEIRTTNPVATEQYGSVSVTTNNQISTTEQGTNAGN

SEQ ID NO: 126533 - protein, 35 aa, Artificial Sequence
  Description of Artificial Sequence: Synthetic polypeptide
DESEIRTTNPVATECWGSYVSCINYEPQDREGENG

SEQ ID NO: 126534 - protein, 34 aa, Artificial Sequence
  Description of Artificial Sequence: Synthetic polypeptide
DESEIRTTNPVATECWGSYVSCINEPQDLEGENG

SEQ ID NO: 126535 - protein, 34 aa, Artificial Sequence
  Description of Artificial Sequence: Synthetic polypeptide
DEDEIRTTNPVAYEQWGCVSGPNGNEQDRGNGDS

SEQ ID NO: 126536 - protein, 34 aa, Artificial Sequence
  Description of Artificial Sequence: Synthetic polypeptide
DEQEIATTNPVATEQYGSVCSATDLVEDHEGEDD

SEQ ID NO: 126537 - protein, 33 aa, Artificial Sequence
  Description of Artificial Sequence: Synthetic polypeptide
DENEIRTTNPVATEQYGTISMEDIQQQQEGNDL

SEQ ID NO: 126538 - protein, 33 aa, Artificial Sequence
  Description of Artificial Sequence: Synthetic polypeptide
DENEIRTTNPVATEQYGTISMEDIQQQQEGNDH

SEQ ID NO: 126539 - protein, 39 aa, Artificial Sequence
  Description of Artificial Sequence: Synthetic polypeptide
DEEEIRTTNPVATEQYGSVSVTSTNLQQGNTEQGTTTVD

SEQ ID NO: 126540 - protein, 33 aa, Artificial Sequence
  Description of Artificial Sequence: Synthetic polypeptide
DESEIRTTNPVATECWGSYMCINEPQDREGENG

SEQ ID NO: 126541 - protein, 39 aa, Artificial Sequence
  Description of Artificial Sequence: Synthetic polypeptide
DEEEIRTTNPVATEQYGSVSVTSTNLQISTTEQGTNNGN

SEQ ID NO: 126542 - protein, 34 aa, Artificial Sequence
  Description of Artificial Sequence: Synthetic polypeptide
DEQEIATTNPVATEQYGSVCATVLEAPDNQDNNE

SEQ ID NO: 126543 - protein, 33 aa, Artificial Sequence
  Description of Artificial Sequence: Synthetic polypeptide
DEDEIRTTNPVAYECWGSVYGDNQNEDRGGNDR

SEQ ID NO: 126544 - protein, 34 aa, Artificial Sequence
  Description of Artificial Sequence: Synthetic polypeptide
DEDEIRTTNPVAYECWGSVYRINENQDRRGENRG

SEQ ID NO: 126545 - protein, 33 aa, Artificial Sequence
  Description of Artificial Sequence: Synthetic polypeptide
DESEIRTTNPVATECWGTVSMIDEPQDREGENG

SEQ ID NO: 126546 - protein, 33 aa, Artificial Sequence
  Description of Artificial Sequence: Synthetic polypeptide
DESEIRTTNPVATECWGTVSCINIPQDQEGENG

SEQ ID NO: 126547 - protein, 34 aa, Artificial Sequence
  Description of Artificial Sequence: Synthetic polypeptide
DEDEIRTTNPVAYEHWGEVSTTQNLQAEGDGNTA

SEQ ID NO: 126548 - protein, 34 aa, Artificial Sequence
  Description of Artificial Sequence: Synthetic polypeptide
DEDEIRTTNPVAYEHWGSVATGMQLGDGQGGNAR

SEQ ID NO: 126549 - protein, 35 aa, Artificial Sequence
  Description of Artificial Sequence: Synthetic polypeptide
DEDEIRTTNPVAYEHWGSVCSGTDNQDLRDGDNNR

SEQ ID NO: 126550 - protein, 33 aa, Artificial Sequence
  Description of Artificial Sequence: Synthetic polypeptide
DESEIRTTNPVATECWGTVSCINEPQDQNGENG

SEQ ID NO: 126551 - protein, 33 aa, Artificial Sequence
  Description of Artificial Sequence: Synthetic polypeptide
DESEIRTTNPVATECWGTVSCIDEPQDREGENG

SEQ ID NO: 126552 - protein, 33 aa, Artificial Sequence
  Description of Artificial Sequence: Synthetic polypeptide
DESEIRTTNPVATECWGTVCSCINPPQDFEGNG

SEQ ID NO: 126553 - protein, 34 aa, Artificial Sequence
  Description of Artificial Sequence: Synthetic polypeptide
DEQEIATTNPVATEQYGSVCATNPEQQANQTEGA

SEQ ID NO: 126554 - protein, 35 aa, Artificial Sequence
  Description of Artificial Sequence: Synthetic polypeptide
DEQEIATTNPVATEQYGSVCATNPHNAQEAMGNEN

SEQ ID NO: 126555 - protein, 34 aa, Artificial Sequence
  Description of Artificial Sequence: Synthetic polypeptide
CEEEIRTTNPVATEQYGQCVCSWGNHQSFGSEQS

SEQ ID NO: 126556 - protein, 31 aa, Artificial Sequence
  Description of Artificial Sequence: Synthetic polypeptide
AENEIACTNPVATEQYGEYCSWNLQYFGSQQ

SEQ ID NO: 126557 - protein, 36 aa, Artificial Sequence
  Description of Artificial Sequence: Synthetic polypeptide
DEQEIATTNPVATEQYGSVCATNPMLQEHQDGNQHH

SEQ ID NO: 126558 - protein, 33 aa, Artificial Sequence
  Description of Artificial Sequence: Synthetic polypeptide
DEDEIRTTNPVAYEKWGSVSCTNHQQDQPEGDV

SEQ ID NO: 126559 - protein, 36 aa, Artificial Sequence
  Description of Artificial Sequence: Synthetic polypeptide
DEEEIRTTNPVATEQYGSVSVTQTGLEEARPLQFTP

SEQ ID NO: 126560 - protein, 32 aa, Artificial Sequence
  Description of Artificial Sequence: Synthetic polypeptide
AENEIACTNPVATEQYGEYCSSNLQRFGSGQA

SEQ ID NO: 126561 - protein, 35 aa, Artificial Sequence
  Description of Artificial Sequence: Synthetic polypeptide
DEQEIATTNPVATEQYGSVCATNPMQQGNQTEGDA

SEQ ID NO: 126562 - protein, 37 aa, Artificial Sequence
  Description of Artificial Sequence: Synthetic polypeptide
DEEEIRTTNPVATEQYGSVSVTSPGIGGNRQSMVPIA

SEQ ID NO: 126563 - protein, 35 aa, Artificial Sequence
  Description of Artificial Sequence: Synthetic polypeptide
DENEIRTTNPVATEQYGSVYTWNMIQTESSEETRE

SEQ ID NO: 126564 - protein, 34 aa, Artificial Sequence
  Description of Artificial Sequence: Synthetic polypeptide
DEQEIATTNPVATEQYGSVCSDNANNSEAGPNEH

SEQ ID NO: 126565 - protein, 35 aa, Artificial Sequence
  Description of Artificial Sequence: Synthetic polypeptide
DESEIRTTNPVATECWGSWVSDCINEPQDREGENG

SEQ ID NO: 126566 - protein, 34 aa, Artificial Sequence
  Description of Artificial Sequence: Synthetic polypeptide
DEDEIRTTNPVAYEQWGEVSGDNNGDQRQNGNGA

SEQ ID NO: 126567 - protein, 35 aa, Artificial Sequence
  Description of Artificial Sequence: Synthetic polypeptide
DENEIRTTNPVATEQYGSYFCSVPDWNDEYLGDNR

SEQ ID NO: 126568 - protein, 32 aa, Artificial Sequence
  Description of Artificial Sequence: Synthetic polypeptide
DEQEIATTNPVATEQYGSVDAFDLEDHEGEDL

SEQ ID NO: 126569 - protein, 33 aa, Artificial Sequence
  Description of Artificial Sequence: Synthetic polypeptide
DEDEIRTTNPVAYEQWGEVSGDNNMDQRGGEGA

SEQ ID NO: 126570 - protein, 32 aa, Artificial Sequence
  Description of Artificial Sequence: Synthetic polypeptide
DEDEIRTTNPVAYEQWGEVSGGDGNHGGGGRG

SEQ ID NO: 126571 - protein, 31 aa, Artificial Sequence
  Description of Artificial Sequence: Synthetic polypeptide
AENEIACTNPVATEQYGETTSEENLAPKGGR

SEQ ID NO: 126572 - protein, 34 aa, Artificial Sequence
  Description of Artificial Sequence: Synthetic polypeptide
DEDEIRTTNPVAYEQWGEVSGGGNHQGEGGGENR

SEQ ID NO: 126573 - protein, 32 aa, Artificial Sequence
  Description of Artificial Sequence: Synthetic polypeptide
DEQEIATTNPVATEQYGSVDATDAEDHEGEDL

SEQ ID NO: 126574 - protein, 32 aa, Artificial Sequence
  Description of Artificial Sequence: Synthetic polypeptide
DEDEIRTTNPVAYEQWGEVSGNNGDDGRGGGA

SEQ ID NO: 126575 - protein, 33 aa, Artificial Sequence
  Description of Artificial Sequence: Synthetic polypeptide
DEDEIRTTNPVAYEQWGEVSGNNGDDRAGNGGA

SEQ ID NO: 126576 - protein, 37 aa, Artificial Sequence
  Description of Artificial Sequence: Synthetic polypeptide
DEEEIRTTNPVATEQYGSVSTTTQNQNNQATTNVATE

SEQ ID NO: 126577 - protein, 34 aa, Artificial Sequence
  Description of Artificial Sequence: Synthetic polypeptide
DEDEIRTTNPVAYEQWGEVSWTEHDNRGGQRGPT

SEQ ID NO: 126578 - protein, 35 aa, Artificial Sequence
  Description of Artificial Sequence: Synthetic polypeptide
DENEIRTTNPVATEQYGSVYVPDTLDGRNGQENKM

SEQ ID NO: 126579 - protein, 34 aa, Artificial Sequence
  Description of Artificial Sequence: Synthetic polypeptide
DEQEIATTNPVATEQYGSVDSATDLEDHEGAEDL

SEQ ID NO: 126580 - protein, 37 aa, Artificial Sequence
  Description of Artificial Sequence: Synthetic polypeptide
DEEEIRTTNPVATEQYGSVSTTTQNGNNSEQGTNNQE

SEQ ID NO: 126581 - protein, 32 aa, Artificial Sequence
  Description of Artificial Sequence: Synthetic polypeptide
DEDEIRTTNPVAYEQWGSSWSLDNDLQINDAK

SEQ ID NO: 126582 - protein, 37 aa, Artificial Sequence
  Description of Artificial Sequence: Synthetic polypeptide
DEEEIRTTNPVATEQYGSVSTTTQAQGNNNEQGTNPV

SEQ ID NO: 126583 - protein, 34 aa, Artificial Sequence
  Description of Artificial Sequence: Synthetic polypeptide
DESEIRTTNPVATECWGSVYCINEPQDREGENGG

SEQ ID NO: 126584 - protein, 33 aa, Artificial Sequence
  Description of Artificial Sequence: Synthetic polypeptide
DEQEIATTNPVATEQYGSVEATDLHEDHEGEDL

SEQ ID NO: 126585 - protein, 34 aa, Artificial Sequence
  Description of Artificial Sequence: Synthetic polypeptide
DESEIRTTNPVATECWGSWGSCINEPQDREGENG

SEQ ID NO: 126586 - protein, 31 aa, Artificial Sequence
  Description of Artificial Sequence: Synthetic polypeptide
DENEIRTTNPVATEQYGTISEEIEMNAAGDA

SEQ ID NO: 126587 - protein, 35 aa, Artificial Sequence
  Description of Artificial Sequence: Synthetic polypeptide
DEQEIATTNPVATEQYGSVCSVNPHNAQEAGNMEN

SEQ ID NO: 126588 - protein, 34 aa, Artificial Sequence
  Description of Artificial Sequence: Synthetic polypeptide
DEDEIRTTNPVAYEQWGEVSGDNNGDQRGNNMGA

SEQ ID NO: 126589 - protein, 33 aa, Artificial Sequence
  Description of Artificial Sequence: Synthetic polypeptide
DEDEIATTNPVAYEHWGEVSTTQNLQAEDGNTI

SEQ ID NO: 126590 - protein, 37 aa, Artificial Sequence
  Description of Artificial Sequence: Synthetic polypeptide
DEEEIRTTNPVATEQYGSVSTTTQQGNADEQGTNNQE

SEQ ID NO: 126591 - protein, 36 aa, Artificial Sequence
  Description of Artificial Sequence: Synthetic polypeptide
DEEEIRTTNPVATEQYGSVSVTVENDMANDIGQELM

SEQ ID NO: 126592 - protein, 34 aa, Artificial Sequence
  Description of Artificial Sequence: Synthetic polypeptide
DEQEIATTNPVATEQYGSVCSNTDPEDHEGENLS

SEQ ID NO: 126593 - protein, 35 aa, Artificial Sequence
  Description of Artificial Sequence: Synthetic polypeptide
DESEIRTTNPVATECWGSWVDSCINEPQDREGENG

SEQ ID NO: 126594 - protein, 32 aa, Artificial Sequence
  Description of Artificial Sequence: Synthetic polypeptide
DEDEIRTTNPVAYEQWGCVTGPNNGDQRGGGA

SEQ ID NO: 126595 - protein, 34 aa, Artificial Sequence
  Description of Artificial Sequence: Synthetic polypeptide
DEQEIATTNPVATEQYGSVCSPTDLGEDHEGEDL

SEQ ID NO: 126596 - protein, 33 aa, Artificial Sequence
  Description of Artificial Sequence: Synthetic polypeptide
DENEIRTTNPVATEQYGTISAMEDPQQQQNGNH

SEQ ID NO: 126597 - protein, 33 aa, Artificial Sequence
  Description of Artificial Sequence: Synthetic polypeptide
DENEIRTTNPVATEQYGTISAMEDIQQQQNGNH

SEQ ID NO: 126598 - protein, 33 aa, Artificial Sequence
  Description of Artificial Sequence: Synthetic polypeptide
DENEIRTTNPVATEQYGTISAMEDIQQQEGNDL

SEQ ID NO: 126599 - protein, 33 aa, Artificial Sequence
  Description of Artificial Sequence: Synthetic polypeptide
DENEIRTTNPVATEQYGTICSMEDPVEQQNGNH

SEQ ID NO: 126600 - protein, 33 aa, Artificial Sequence
  Description of Artificial Sequence: Synthetic polypeptide
DENEIRTTNPVATEQYGTICSMEDPVEQFNGNH

SEQ ID NO: 126601 - protein, 37 aa, Artificial Sequence
  Description of Artificial Sequence: Synthetic polypeptide
DEEEIRTTNPVATEQYGSVSTTTQQGGNNNENGTNPV

SEQ ID NO: 126602 - protein, 32 aa, Artificial Sequence
  Description of Artificial Sequence: Synthetic polypeptide
DEDEIRTTNPVAYEQWGEVCSNENDEHDGNAQ

SEQ ID NO: 126603 - protein, 33 aa, Artificial Sequence
  Description of Artificial Sequence: Synthetic polypeptide
DEDEIRTTNPVAYEQWGEVCSTENDEHDGGNQI

SEQ ID NO: 126604 - protein, 35 aa, Artificial Sequence
  Description of Artificial Sequence: Synthetic polypeptide
DEQEIATTNPVATEQYGSVCSPTPQQEHQDGNADK

SEQ ID NO: 126605 - protein, 31 aa, Artificial Sequence
  Description of Artificial Sequence: Synthetic polypeptide
AENEIACTNPVATEQYGEVSAEDLEREGEDL

SEQ ID NO: 126606 - protein, 35 aa, Artificial Sequence
  Description of Artificial Sequence: Synthetic polypeptide
DEDEIRTTNPVAYEQWGEVCSTGNGNERNEGNQRD

SEQ ID NO: 126607 - protein, 33 aa, Artificial Sequence
  Description of Artificial Sequence: Synthetic polypeptide
DEDEIRTTNPVAYEQWGEVSGDNNGDQRGGEGA

SEQ ID NO: 126608 - protein, 33 aa, Artificial Sequence
  Description of Artificial Sequence: Synthetic polypeptide
DEDEIRTTNPVAYEQWGEVSGDNNGDQRQGDSA

SEQ ID NO: 126609 - protein, 32 aa, Artificial Sequence
  Description of Artificial Sequence: Synthetic polypeptide
DEQEIATTNPVATEQYGSVAMNGENPDGPTEM

SEQ ID NO: 126610 - protein, 36 aa, Artificial Sequence
  Description of Artificial Sequence: Synthetic polypeptide
DEEEIRTTNPVATEQYGSVSPTSNMEHSAFVENIAT

SEQ ID NO: 126611 - protein, 33 aa, Artificial Sequence
  Description of Artificial Sequence: Synthetic polypeptide
DEDEIATTNPVAYEQWGQSVAQNDGDQTRGIQR

SEQ ID NO: 126612 - protein, 31 aa, Artificial Sequence
  Description of Artificial Sequence: Synthetic polypeptide
CEDEIACTNPVATESYGCASANNLQMPGQRM

SEQ ID NO: 126613 - protein, 31 aa, Artificial Sequence
  Description of Artificial Sequence: Synthetic polypeptide
DEVEIATTNPVAYEGWGSVATNEQGNDDGGE

SEQ ID NO: 126614 - protein, 32 aa, Artificial Sequence
  Description of Artificial Sequence: Synthetic polypeptide
DEVEIATTNPVAYEGWGSVATNEQGNDDGNHN

SEQ ID NO: 126615 - protein, 33 aa, Artificial Sequence
  Description of Artificial Sequence: Synthetic polypeptide
DEQEIATTNPVATEQYGSGYSATDLEDHEGEDL

SEQ ID NO: 126616 - protein, 32 aa, Artificial Sequence
  Description of Artificial Sequence: Synthetic polypeptide
DEVEIATTNPVAYEGWGSVATNEQGNDDGSNM

SEQ ID NO: 126617 - protein, 32 aa, Artificial Sequence
  Description of Artificial Sequence: Synthetic polypeptide
DEQEIATTNPVATEQYGSHSATDLEDHEAEDL

SEQ ID NO: 126618 - protein, 32 aa, Artificial Sequence
  Description of Artificial Sequence: Synthetic polypeptide
DEVEIATTNPVAYEGWGSVATNEQGNDMGNAQ

SEQ ID NO: 126619 - protein, 32 aa, Artificial Sequence
  Description of Artificial Sequence: Synthetic polypeptide
DEVEIATTNPVAYEGWGSVATNEQGNDQGNHY

SEQ ID NO: 126620 - protein, 32 aa, Artificial Sequence
  Description of Artificial Sequence: Synthetic polypeptide
DEVEIATTNPVAYEGWGSVATNGQGNDMGGDR

SEQ ID NO: 126621 - protein, 32 aa, Artificial Sequence
  Description of Artificial Sequence: Synthetic polypeptide
DEVEIATTNPVAYEGWGSVATNPQGNDGGGHR

SEQ ID NO: 126622 - protein, 33 aa, Artificial Sequence
  Description of Artificial Sequence: Synthetic polypeptide
DEVEIATTNPVAYEGWGSVATTNEQGNDMGNER

SEQ ID NO: 126623 - protein, 37 aa, Artificial Sequence
  Description of Artificial Sequence: Synthetic polypeptide
DEDEIRTTNPVATEQYGVVSTTNNLQAGNQQGNQQND

SEQ ID NO: 126624 - protein, 32 aa, Artificial Sequence
  Description of Artificial Sequence: Synthetic polypeptide
DENEIRTTNPVSTEGYGTISMETIQQQQNGNH

SEQ ID NO: 126625 - protein, 32 aa, Artificial Sequence
  Description of Artificial Sequence: Synthetic polypeptide
DENEIRTTNPVSTEGYGTISMEDIQQQRNGQR

SEQ ID NO: 126626 - protein, 32 aa, Artificial Sequence
  Description of Artificial Sequence: Synthetic polypeptide
DENEIRTTNPVSTEGYGTISMEDIQQQQNGNR

SEQ ID NO: 126627 - protein, 31 aa, Artificial Sequence
  Description of Artificial Sequence: Synthetic polypeptide
DENEIRTTNPVSTEGYGTISMEDIQQQQGNH

SEQ ID NO: 126628 - protein, 32 aa, Artificial Sequence
  Description of Artificial Sequence: Synthetic polypeptide
DENEIRTTNPVSTEGYGTISMEDINQEQSGNH

SEQ ID NO: 126629 - protein, 33 aa, Artificial Sequence
  Description of Artificial Sequence: Synthetic polypeptide
DEAEIRTTNPVATEQYGSVCEWDTLENFENNQE

SEQ ID NO: 126630 - protein, 32 aa, Artificial Sequence
  Description of Artificial Sequence: Synthetic polypeptide
DENEIRTTNPVSTEGYGTISGESIQQQQNGNV

SEQ ID NO: 126631 - protein, 36 aa, Artificial Sequence
  Description of Artificial Sequence: Synthetic polypeptide
DEAEIRTTNPVATEQYGSVTWSPTNWLENPNTMEDG

SEQ ID NO: 126632 - protein, 36 aa, Artificial Sequence
  Description of Artificial Sequence: Synthetic polypeptide
DEEEIRTTNPVATEQYGSVSQLVPGTINRQDLMVAM

SEQ ID NO: 126633 - protein, 34 aa, Artificial Sequence
  Description of Artificial Sequence: Synthetic polypeptide
DESEIRTTNPVATEIWGCVSWMNENQDREGSNQS

SEQ ID NO: 126634 - protein, 34 aa, Artificial Sequence
  Description of Artificial Sequence: Synthetic polypeptide
DEVEIATTNPVAYEEWGSVSKTDEQLQERQGDNM

SEQ ID NO: 126635 - protein, 32 aa, Artificial Sequence
  Description of Artificial Sequence: Synthetic polypeptide
DENEIRTTNPVSTEIYGTISMSDIQQQQNGNA

SEQ ID NO: 126636 - protein, 35 aa, Artificial Sequence
  Description of Artificial Sequence: Synthetic polypeptide
DEAEIRTTNPVATEQYGSVTVENLDFTGFNENDMD

SEQ ID NO: 126637 - protein, 37 aa, Artificial Sequence
  Description of Artificial Sequence: Synthetic polypeptide
DEEEIRTTNPVATEQYGSVSQPTFAGPNENNGQNDVV

SEQ ID NO: 126638 - protein, 33 aa, Artificial Sequence
  Description of Artificial Sequence: Synthetic polypeptide
DENEIRTTNPVSTEIYGSVISMEDIQQQQNGNH

SEQ ID NO: 126639 - protein, 38 aa, Artificial Sequence
  Description of Artificial Sequence: Synthetic polypeptide
DEEEIRTTNPVATEQYGSVSQPTFADGPNEQNGMNDVV

SEQ ID NO: 126640 - protein, 37 aa, Artificial Sequence
  Description of Artificial Sequence: Synthetic polypeptide
DEEEIRTTNPVATEQYGSVSQPSPDGPNMQNGMNTVV

SEQ ID NO: 126641 - protein, 37 aa, Artificial Sequence
  Description of Artificial Sequence: Synthetic polypeptide
DEEEIRTTNPVATEQYGSVSQPSPAGPNMQNGMNNVS

SEQ ID NO: 126642 - protein, 37 aa, Artificial Sequence
  Description of Artificial Sequence: Synthetic polypeptide
DEEEIRTTNPVATEQYGSVSQPSPAGENMQNGMNDVV

SEQ ID NO: 126643 - protein, 30 aa, Artificial Sequence
  Description of Artificial Sequence: Synthetic polypeptide
AENEIATTNPVATECYGCVTSWELQHSSEL

SEQ ID NO: 126644 - protein, 32 aa, Artificial Sequence
  Description of Artificial Sequence: Synthetic polypeptide
DEVEIATTNPVAYEAWGEATTNLQGNAGENER

SEQ ID NO: 126645 - protein, 32 aa, Artificial Sequence
  Description of Artificial Sequence: Synthetic polypeptide
DEVEIATTNPVAYEAWGEVATNLNQGNDNDGR

SEQ ID NO: 126646 - protein, 32 aa, Artificial Sequence
  Description of Artificial Sequence: Synthetic polypeptide
DEVEIATTNPVAYEAWGEVSTNLNQGADNDGE

SEQ ID NO: 126647 - protein, 33 aa, Artificial Sequence
  Description of Artificial Sequence: Synthetic polypeptide
DEVEIATTNPVAYEAWGEVSTNLNQGEDNDGRK

SEQ ID NO: 126648 - protein, 32 aa, Artificial Sequence
  Description of Artificial Sequence: Synthetic polypeptide
DEQEIATTNPVATEQYGSGFATDLEDHEGEDL

SEQ ID NO: 126649 - protein, 37 aa, Artificial Sequence
  Description of Artificial Sequence: Synthetic polypeptide
DEEEIRTTNPVATEQYGSVSQPNPAGPNMQNGMNPVT

SEQ ID NO: 126650 - protein, 37 aa, Artificial Sequence
  Description of Artificial Sequence: Synthetic polypeptide
DEEEIRTTNPVATEQYGSVSQPIPAGSNMQNGMNPNV

SEQ ID NO: 126651 - protein, 33 aa, Artificial Sequence
  Description of Artificial Sequence: Synthetic polypeptide
DEVEIATTNPVAYEAWGTVSTNLNQGADNDGRR

SEQ ID NO: 126652 - protein, 33 aa, Artificial Sequence
  Description of Artificial Sequence: Synthetic polypeptide
DEQEIATTNPVATEQYGSGLSATDLEDHEGEDL

SEQ ID NO: 126653 - protein, 35 aa, Artificial Sequence
  Description of Artificial Sequence: Synthetic polypeptide
DEEEIRTTNPVATEQYGSVSQPDNDHEVALGSVLI

SEQ ID NO: 126654 - protein, 34 aa, Artificial Sequence
  Description of Artificial Sequence: Synthetic polypeptide
DESEIRTTNPVATEIWGSVSCINEPQDREFEGGL

SEQ ID NO: 126655 - protein, 37 aa, Artificial Sequence
  Description of Artificial Sequence: Synthetic polypeptide
DEEEIRTTNPVATEQYGSVSQPTFAGPNEQMDMNDVV

SEQ ID NO: 126656 - protein, 35 aa, Artificial Sequence
  Description of Artificial Sequence: Synthetic polypeptide
DESEIRTTNPVATEGYGSVITMTGQNGGQGGENNN

SEQ ID NO: 126657 - protein, 32 aa, Artificial Sequence
  Description of Artificial Sequence: Synthetic polypeptide
DEVEIATTNPVAYEPWGSVATNNGGNAGENAR

SEQ ID NO: 126658 - protein, 33 aa, Artificial Sequence
  Description of Artificial Sequence: Synthetic polypeptide
DEVEIATTNPVAYEQWGSVCSTNDDHPMGDHRN

SEQ ID NO: 126659 - protein, 32 aa, Artificial Sequence
  Description of Artificial Sequence: Synthetic polypeptide
DEVEIATTNPVAYEQWGSVCSTNDDHPMGHHP

SEQ ID NO: 126660 - protein, 33 aa, Artificial Sequence
  Description of Artificial Sequence: Synthetic polypeptide
DEVEIATTNPVAYEQWGSVCSTNDDHPMGQQSR

SEQ ID NO: 126661 - protein, 33 aa, Artificial Sequence
  Description of Artificial Sequence: Synthetic polypeptide
DEVEIATTNPVAYEQWGSVCSTNDDHPNGDQHR

SEQ ID NO: 126662 - protein, 34 aa, Artificial Sequence
  Description of Artificial Sequence: Synthetic polypeptide
DESEIRTTNPVATEGWGSVSIINQEPQDREGETG

SEQ ID NO: 126663 - protein, 33 aa, Artificial Sequence
  Description of Artificial Sequence: Synthetic polypeptide
DEVEIATTNPVAYEQWGSVCSTNDHDHPMGDDR

SEQ ID NO: 126664 - protein, 33 aa, Artificial Sequence
  Description of Artificial Sequence: Synthetic polypeptide
DEVEIATTNPVAYEQWGSVCSTNDHDHPNGQNT

SEQ ID NO: 126665 - protein, 30 aa, Artificial Sequence
  Description of Artificial Sequence: Synthetic polypeptide
DENEIRTTNPVSTEGWGDVANIEQNRAGDA

SEQ ID NO: 126666 - protein, 33 aa, Artificial Sequence
  Description of Artificial Sequence: Synthetic polypeptide
DEVEIATTNPVAYEQWGSVCSTNDIDHPNGDHR

SEQ ID NO: 126667 - protein, 35 aa, Artificial Sequence
  Description of Artificial Sequence: Synthetic polypeptide
DEEEIRTTNPVATEQYGSVSPYSNAPDDQIMEEID

SEQ ID NO: 126668 - protein, 33 aa, Artificial Sequence
  Description of Artificial Sequence: Synthetic polypeptide
DEQEIATTNPVATEQYGSIVAATDLEDHEGEDL

SEQ ID NO: 126669 - protein, 34 aa, Artificial Sequence
  Description of Artificial Sequence: Synthetic polypeptide
DEVEIATTNPVAYEQWGSVCSTNDQQSQGQGNES

SEQ ID NO: 126670 - protein, 36 aa, Artificial Sequence
  Description of Artificial Sequence: Synthetic polypeptide
DEEEIRTTNPVATEQYGSVSPYNPWEQTFNGQIVEV

SEQ ID NO: 126671 - protein, 32 aa, Artificial Sequence
  Description of Artificial Sequence: Synthetic polypeptide
DEVEIATTNPVAYEQWGSVCVTNPGNDGEGSR

SEQ ID NO: 126672 - protein, 33 aa, Artificial Sequence
  Description of Artificial Sequence: Synthetic polypeptide
DEVEIATTNPVAYEQWGSVSGDHNNNDRGENHQ

SEQ ID NO: 126673 - protein, 36 aa, Artificial Sequence
  Description of Artificial Sequence: Synthetic polypeptide
DEEEIRTTNPVATEQYGSVSPYNMMMQEFFGEEESN

SEQ ID NO: 126674 - protein, 32 aa, Artificial Sequence
  Description of Artificial Sequence: Synthetic polypeptide
DENEIRTTNPVSTEEYGTISWEDINQEQFGNT

SEQ ID NO: 126675 - protein, 35 aa, Artificial Sequence
  Description of Artificial Sequence: Synthetic polypeptide
DEVEIATTNPVAYEQWGSVSKTDEQLQERQGNNMT

SEQ ID NO: 126676 - protein, 33 aa, Artificial Sequence
  Description of Artificial Sequence: Synthetic polypeptide
DEVEIATTNPVAYEQWGSVSNPNGGQTTGNNEV

SEQ ID NO: 126677 - protein, 34 aa, Artificial Sequence
  Description of Artificial Sequence: Synthetic polypeptide
DESEIRTTNPVATEGWGSVSWENENQDHEGSNQG

SEQ ID NO: 126678 - protein, 35 aa, Artificial Sequence
  Description of Artificial Sequence: Synthetic polypeptide
DEEEIRTTNPVATEQYGSVSQLEMLVVVGSSEQVA

SEQ ID NO: 126679 - protein, 34 aa, Artificial Sequence
  Description of Artificial Sequence: Synthetic polypeptide
DEVEIATTNPVAYEQWGSVCSTENLGDNHGGNTV

SEQ ID NO: 126680 - protein, 34 aa, Artificial Sequence
  Description of Artificial Sequence: Synthetic polypeptide
DESEIRTTNPVATEGWGSVSWMEENQDREGSNQS

SEQ ID NO: 126681 - protein, 34 aa, Artificial Sequence
  Description of Artificial Sequence: Synthetic polypeptide
DEVEIATTNPVAYEPWGSVSNTNQLGGNAGENAR

SEQ ID NO: 126682 - protein, 33 aa, Artificial Sequence
  Description of Artificial Sequence: Synthetic polypeptide
DEVEIATTNPVAYEPWGSVSTNLGGNAGENATD

SEQ ID NO: 126683 - protein, 33 aa, Artificial Sequence
  Description of Artificial Sequence: Synthetic polypeptide
DEVEIATTNPVAYEPWGSVSTNLGGNAGEQARS

SEQ ID NO: 126684 - protein, 33 aa, Artificial Sequence
  Description of Artificial Sequence: Synthetic polypeptide
DEVEIATTNPVAYEPWGSVSTNNLGGNAGEGAR

SEQ ID NO: 126685 - protein, 32 aa, Artificial Sequence
  Description of Artificial Sequence: Synthetic polypeptide
DEVEIATTNPVAYEPWGVVSTNLGGNAGEVAR

SEQ ID NO: 126686 - protein, 32 aa, Artificial Sequence
  Description of Artificial Sequence: Synthetic polypeptide
DEQEIATTNPVATEQYGSHSATDVEDHEGEDL

SEQ ID NO: 126687 - protein, 37 aa, Artificial Sequence
  Description of Artificial Sequence: Synthetic polypeptide
DEEEIRTTNPVATEQYGSVSQFTPAGPNMQNSMNPVV

SEQ ID NO: 126688 - protein, 32 aa, Artificial Sequence
  Description of Artificial Sequence: Synthetic polypeptide
DEVEIATTNPVAYEQWGCVCDNDLGLDDRGER

SEQ ID NO: 126689 - protein, 30 aa, Artificial Sequence
  Description of Artificial Sequence: Synthetic polypeptide
DESEIRTTNPVATEGWGVVSEILMNAAEDI

SEQ ID NO: 126690 - protein, 33 aa, Artificial Sequence
  Description of Artificial Sequence: Synthetic polypeptide
DEQEIATTNPVATEQYGSHSSATDLEDHEGEDL

SEQ ID NO: 126691 - protein, 31 aa, Artificial Sequence
  Description of Artificial Sequence: Synthetic polypeptide
DEVEIATTNPVAYEQWGSTSKTLEDRQNMTP

SEQ ID NO: 126692 - protein, 31 aa, Artificial Sequence
  Description of Artificial Sequence: Synthetic polypeptide
DEVEIATTNPVAYEQWGSTVTNPGLGENDET

SEQ ID NO: 126693 - protein, 34 aa, Artificial Sequence
  Description of Artificial Sequence: Synthetic polypeptide
DEEEIRTTNPVATEQYGSVSPYVTAVMKAMPIEG

SEQ ID NO: 126694 - protein, 37 aa, Artificial Sequence
  Description of Artificial Sequence: Synthetic polypeptide
DEAEIRTTNPVATEQYGSVVCTNLMLEELRNGNEEVF

SEQ ID NO: 126695 - protein, 33 aa, Artificial Sequence
  Description of Artificial Sequence: Synthetic polypeptide
DEDEIATTNPVAYEQWGSVSIADNGGNHGGNNR

SEQ ID NO: 126696 - protein, 34 aa, Artificial Sequence
  Description of Artificial Sequence: Synthetic polypeptide
DEEEIRTTNPVATEQYGSVSPYSPAPDDQIMEED

SEQ ID NO: 126697 - protein, 35 aa, Artificial Sequence
  Description of Artificial Sequence: Synthetic polypeptide
DEEEIRTTNPVATEQYGSVSPYSNQAPDDQDELED

SEQ ID NO: 126698 - protein, 32 aa, Artificial Sequence
  Description of Artificial Sequence: Synthetic polypeptide
DEDEIATTNPVAYEQWGSVSHPPMETNGNGNM

SEQ ID NO: 126699 - protein, 36 aa, Artificial Sequence
  Description of Artificial Sequence: Synthetic polypeptide
DEAEIRTTNPVATEQYGSVVDTIMLEELRNGNEEGF

SEQ ID NO: 126700 - protein, 33 aa, Artificial Sequence
  Description of Artificial Sequence: Synthetic polypeptide
DEQEIATTNPVATEQYGSISATDLHEDHEGEDL

SEQ ID NO: 126701 - protein, 33 aa, Artificial Sequence
  Description of Artificial Sequence: Synthetic polypeptide
DEVEIATTNPVAYEQWGSVSNPNGNQTMGNNEV

SEQ ID NO: 126702 - protein, 32 aa, Artificial Sequence
  Description of Artificial Sequence: Synthetic polypeptide
DENEIRTTNPVSTEIYGTISVEDIQQIQNGNT

SEQ ID NO: 126703 - protein, 34 aa, Artificial Sequence
  Description of Artificial Sequence: Synthetic polypeptide
DEAEIRTTNPVATEQYGSVTTLWEQQMEDEIDNN

SEQ ID NO: 126704 - protein, 38 aa, Artificial Sequence
  Description of Artificial Sequence: Synthetic polypeptide
DEDEIRTTNPVATEQYGSVSTVVNTNLQAGNNNQEEDE

SEQ ID NO: 126705 - protein, 35 aa, Artificial Sequence
  Description of Artificial Sequence: Synthetic polypeptide
DEAEIRTTNPVATEQYGSVSWPVNWEQTSTQNHEI

SEQ ID NO: 126706 - protein, 38 aa, Artificial Sequence
  Description of Artificial Sequence: Synthetic polypeptide
DEDEIRTTNPVATEQYGSVSTVVVTNLQAGNNTEEEDE

SEQ ID NO: 126707 - protein, 32 aa, Artificial Sequence
  Description of Artificial Sequence: Synthetic polypeptide
DENEIRTTNPVSTEPWGTVSMIDIQQQRNGNH

SEQ ID NO: 126708 - protein, 35 aa, Artificial Sequence
  Description of Artificial Sequence: Synthetic polypeptide
DEAEIRTTNPVATEQYGSVSYANLETPNDSQDSSF

SEQ ID NO: 126709 - protein, 35 aa, Artificial Sequence
  Description of Artificial Sequence: Synthetic polypeptide
DEAEIRTTNPVATEQYGSVSYMDMLQMFGSEVYFN

SEQ ID NO: 126710 - protein, 36 aa, Artificial Sequence
  Description of Artificial Sequence: Synthetic polypeptide
DEAEIRTTNPVATEQYGSVSYMNMHFQMFGSEQNFN

SEQ ID NO: 126711 - protein, 36 aa, Artificial Sequence
  Description of Artificial Sequence: Synthetic polypeptide
DEAEIRTTNPVATEQYGSVSYMNMLLQMFGSEEPFN

SEQ ID NO: 126712 - protein, 35 aa, Artificial Sequence
  Description of Artificial Sequence: Synthetic polypeptide
DEDEIRTTNPVATEQYGSVWTDTTNTIEEQGDNQE

SEQ ID NO: 126713 - protein, 34 aa, Artificial Sequence
  Description of Artificial Sequence: Synthetic polypeptide
DEDEIRTTNPVATEQYGTVVFVTEMSSQHGGSYR

SEQ ID NO: 126714 - protein, 36 aa, Artificial Sequence
  Description of Artificial Sequence: Synthetic polypeptide
DEAEIRTTNPVATEQYGSVSYMVMLEQMFGSEVNFN

SEQ ID NO: 126715 - protein, 36 aa, Artificial Sequence
  Description of Artificial Sequence: Synthetic polypeptide
DEDEIRTTNPVATEQYGVVATTNANLQIGTTENGNE

SEQ ID NO: 126716 - protein, 36 aa, Artificial Sequence
  Description of Artificial Sequence: Synthetic polypeptide
DEDEIRTTNPVATEQYGVVATTQQNLQNGTTEQGNE

SEQ ID NO: 126717 - protein, 30 aa, Artificial Sequence
  Description of Artificial Sequence: Synthetic polypeptide
AENEIATTNPVATEPYGEISMEDIQQQGGR

SEQ ID NO: 126718 - protein, 31 aa, Artificial Sequence
  Description of Artificial Sequence: Synthetic polypeptide
DENEIRTTNPVSTEPWGTVSEEDIQQQNGNH

SEQ ID NO: 126719 - protein, 35 aa, Artificial Sequence
  Description of Artificial Sequence: Synthetic polypeptide
DEVEIATTNPVATEQYGSVSWNDNHQQNNGGGMQR

SEQ ID NO: 126720 - protein, 34 aa, Artificial Sequence
  Description of Artificial Sequence: Synthetic polypeptide
DEQEIATTNPVATEQYGSAVSATDLEDHEGKEDL

SEQ ID NO: 126721 - protein, 37 aa, Artificial Sequence
  Description of Artificial Sequence: Synthetic polypeptide
DEVEIATTNPVATEQYGSVSWNEGDLQDQERGNGGQS

SEQ ID NO: 126722 - protein, 37 aa, Artificial Sequence
  Description of Artificial Sequence: Synthetic polypeptide
DEVEIATTNPVATEQYGSVSWNEGDLQGQERGGDQGR

SEQ ID NO: 126723 - protein, 35 aa, Artificial Sequence
  Description of Artificial Sequence: Synthetic polypeptide
DEAEIRTTNPVATEQYGSVSWMNPEQDLSILEERN

SEQ ID NO: 126724 - protein, 37 aa, Artificial Sequence
  Description of Artificial Sequence: Synthetic polypeptide
DEVEIATTNPVATEQYGSVSWNEGDLQGQERGGGMER

SEQ ID NO: 126725 - protein, 32 aa, Artificial Sequence
  Description of Artificial Sequence: Synthetic polypeptide
DENEIRTTNPVSTEPYGAISMEDIQLQQNGNH

SEQ ID NO: 126726 - protein, 31 aa, Artificial Sequence
  Description of Artificial Sequence: Synthetic polypeptide
DENEIRTTNPVSTEPYGAISMEDIQQQNGNH

SEQ ID NO: 126727 - protein, 33 aa, Artificial Sequence
  Description of Artificial Sequence: Synthetic polypeptide
DESEIRTTNPVATEPWGTVSCENEPQDQNGENG

SEQ ID NO: 126728 - protein, 32 aa, Artificial Sequence
  Description of Artificial Sequence: Synthetic polypeptide
DESEIRTTNPVATEPWGTISMENIQQQQNGNG

SEQ ID NO: 126729 - protein, 34 aa, Artificial Sequence
  Description of Artificial Sequence: Synthetic polypeptide
DEQEIATTNPVATEQYGSACATNPLQDDPGGDDI

SEQ ID NO: 126730 - protein, 34 aa, Artificial Sequence
  Description of Artificial Sequence: Synthetic polypeptide
DEQEIATTNPVATEQYGSACSAANPHNAQEAGNE

SEQ ID NO: 126731 - protein, 34 aa, Artificial Sequence
  Description of Artificial Sequence: Synthetic polypeptide
DEVEIATTNPVATEQYGSVSATMDLEDGEGQEDI

SEQ ID NO: 126732 - protein, 37 aa, Artificial Sequence
  Description of Artificial Sequence: Synthetic polypeptide
DEDEIRTTNPVATEQYGSVSTVNNNTQQLQEGTEEDE

SEQ ID NO: 126733 - protein, 33 aa, Artificial Sequence
  Description of Artificial Sequence: Synthetic polypeptide
DESEIRTTNPVATEPWGTISCENEPQQREGENH

SEQ ID NO: 126734 - protein, 37 aa, Artificial Sequence
  Description of Artificial Sequence: Synthetic polypeptide
DEDEIRTTNPVATEQYGSVSTVNQNQQQLQQGTEEDT

SEQ ID NO: 126735 - protein, 33 aa, Artificial Sequence
  Description of Artificial Sequence: Synthetic polypeptide
DEDEIATTNPVAYEQWGVVCSTNLQGDAGHGEA

SEQ ID NO: 126736 - protein, 36 aa, Artificial Sequence
  Description of Artificial Sequence: Synthetic polypeptide
DEDEIRTTNPVATEQYGSVSTVTNNNQQGQEGEEQE

SEQ ID NO: 126737 - protein, 33 aa, Artificial Sequence
  Description of Artificial Sequence: Synthetic polypeptide
DEDEIATTNPVAYEQWGVVCSTNDGEHQGGNTS

SEQ ID NO: 126738 - protein, 36 aa, Artificial Sequence
  Description of Artificial Sequence: Synthetic polypeptide
DEDEIRTTNPVATEQYGSVSTVTNQQQQQIGTEEQT

SEQ ID NO: 126739 - protein, 34 aa, Artificial Sequence
  Description of Artificial Sequence: Synthetic polypeptide
DEAEIRTTNPVATEQYGSVSVWHNSDEVQPESQD

SEQ ID NO: 126740 - protein, 32 aa, Artificial Sequence
  Description of Artificial Sequence: Synthetic polypeptide
DENEIRTTNPVSTEPYGAISMVDIQQQQNGNH

SEQ ID NO: 126741 - protein, 32 aa, Artificial Sequence
  Description of Artificial Sequence: Synthetic polypeptide
DEDEIATTNPVAYEQWGVTSTNDGGNHGGNTR

SEQ ID NO: 126742 - protein, 33 aa, Artificial Sequence
  Description of Artificial Sequence: Synthetic polypeptide
DEQEIATTNPVATEQYGSASATDLEDHEGEDLG

SEQ ID NO: 126743 - protein, 37 aa, Artificial Sequence
  Description of Artificial Sequence: Synthetic polypeptide
DEAEIRTTNPVATEQYGSVSVWHTNLEFTRSGQEDDN

SEQ ID NO: 126744 - protein, 34 aa, Artificial Sequence
  Description of Artificial Sequence: Synthetic polypeptide
DEAEIRTTNPVATEQYGSVSVYVLDSMIGQIDDL

SEQ ID NO: 126745 - protein, 28 aa, Artificial Sequence
  Description of Artificial Sequence: Synthetic peptide
AENEIATTNPVATEQYGEAPEVCQHEGK

SEQ ID NO: 126746 - protein, 28 aa, Artificial Sequence
  Description of Artificial Sequence: Synthetic peptide
AENEIATTNPVATEQYGEAPEVCQHEEK

SEQ ID NO: 126747 - protein, 37 aa, Artificial Sequence
  Description of Artificial Sequence: Synthetic polypeptide
DEEEIRTTNPVATEQYGSVSQPTPAGPAMQNGMNPVI

SEQ ID NO: 126748 - protein, 37 aa, Artificial Sequence
  Description of Artificial Sequence: Synthetic polypeptide
DEVEIATTNPVATEQYGSVSWNEGDLQQDDRGGGGSR

SEQ ID NO: 126749 - protein, 35 aa, Artificial Sequence
  Description of Artificial Sequence: Synthetic polypeptide
DEVEIATTNPVATEQYGSVSWNENDQHGQGGNQDQ

SEQ ID NO: 126750 - protein, 34 aa, Artificial Sequence
  Description of Artificial Sequence: Synthetic polypeptide
DEQEIATTNPVATEQYGSCVWSATDLEMHIGEDL

SEQ ID NO: 126751 - protein, 37 aa, Artificial Sequence
  Description of Artificial Sequence: Synthetic polypeptide
DEEEIRTTNPVATEQYGSVSQPTPAGPTEQLGMNDVV

SEQ ID NO: 126752 - protein, 37 aa, Artificial Sequence
  Description of Artificial Sequence: Synthetic polypeptide
DEEEIRTTNPVATEQYGSVSQPTPAGPPMQNGMNDNV

SEQ ID NO: 126753 - protein, 37 aa, Artificial Sequence
  Description of Artificial Sequence: Synthetic polypeptide
DEEEIRTTNPVATEQYGSVSQPTPAGPNMVNGENDVV

SEQ ID NO: 126754 - protein, 37 aa, Artificial Sequence
  Description of Artificial Sequence: Synthetic polypeptide
DEEEIRTTNPVATEQYGSVSQPTPAGPNMQNVQNPVV

SEQ ID NO: 126755 - protein, 37 aa, Artificial Sequence
  Description of Artificial Sequence: Synthetic polypeptide
DEEEIRTTNPVATEQYGSVSQPTPAGPNMQNNMNDSV

SEQ ID NO: 126756 - protein, 32 aa, Artificial Sequence
  Description of Artificial Sequence: Synthetic polypeptide
DEQEIATTNPVATEQYGSFSATDLEDHEWEDL

SEQ ID NO: 126757 - protein, 32 aa, Artificial Sequence
  Description of Artificial Sequence: Synthetic polypeptide
DEVEIATTNPVATTQWGEVVRTWDQHQQGNER

SEQ ID NO: 126758 - protein, 31 aa, Artificial Sequence
  Description of Artificial Sequence: Synthetic polypeptide
DEVEIATTNPVATTQWGMVRTWDQGQQNNER

SEQ ID NO: 126759 - protein, 32 aa, Artificial Sequence
  Description of Artificial Sequence: Synthetic polypeptide
DEVEIATTNPVATTQWGMVRTWEDQQRGQGER

SEQ ID NO: 126760 - protein, 33 aa, Artificial Sequence
  Description of Artificial Sequence: Synthetic polypeptide
DEVEIATTNPVATTQWGMVYRTWDDQPRGSNER

SEQ ID NO: 126761 - protein, 32 aa, Artificial Sequence
  Description of Artificial Sequence: Synthetic polypeptide
DEVEIATTNPVATTQWGVVRTWDQHQQRQGER

SEQ ID NO: 126762 - protein, 32 aa, Artificial Sequence
  Description of Artificial Sequence: Synthetic polypeptide
DEQEIATTNPVATEQYGSFSATDLEDHEYEDL

SEQ ID NO: 126763 - protein, 37 aa, Artificial Sequence
  Description of Artificial Sequence: Synthetic polypeptide
DEEEIRTTNPVATEQYGSVSQPTPAGPNMQFGMFDVV

SEQ ID NO: 126764 - protein, 32 aa, Artificial Sequence
  Description of Artificial Sequence: Synthetic polypeptide
DENEIRTTNPVSTENYGTISMEDINQQQNGNH

SEQ ID NO: 126765 - protein, 33 aa, Artificial Sequence
  Description of Artificial Sequence: Synthetic polypeptide
DEQEIATTNPVATEQYGSFSATPDLEDHEGEDL

SEQ ID NO: 126766 - protein, 32 aa, Artificial Sequence
  Description of Artificial Sequence: Synthetic polypeptide
DENEIRTTNPVSTEMYGTISMEDSQQIQNGNA

SEQ ID NO: 126767 - protein, 33 aa, Artificial Sequence
  Description of Artificial Sequence: Synthetic polypeptide
DEQEIATTNPVATEQYGSFVGATDLEDHEGEDL

SEQ ID NO: 126768 - protein, 36 aa, Artificial Sequence
  Description of Artificial Sequence: Synthetic polypeptide
DEAEIRTTNPVATEQYGSVTTHTNLEEPFNSQEDRN

SEQ ID NO: 126769 - protein, 38 aa, Artificial Sequence
  Description of Artificial Sequence: Synthetic polypeptide
DEEEIRTTNPVATEQYGSVSQPTPANGPNMQNGMNDEV

SEQ ID NO: 126770 - protein, 34 aa, Artificial Sequence
  Description of Artificial Sequence: Synthetic polypeptide
DEQEIATTNPVATEQYGSAVSATELEKHEGEDLN

SEQ ID NO: 126771 - protein, 38 aa, Artificial Sequence
  Description of Artificial Sequence: Synthetic polypeptide
DEEEIRTTNPVATEQYGSVSQPTPASGPNMQLGMNDVV

SEQ ID NO: 126772 - protein, 34 aa, Artificial Sequence
  Description of Artificial Sequence: Synthetic polypeptide
DEQEIATTNPVATEQYGSCVSATHDLEDHEGEDL

SEQ ID NO: 126773 - protein, 36 aa, Artificial Sequence
  Description of Artificial Sequence: Synthetic polypeptide
DEDEIRTTNPVATEQYGVVATVNQQLQIGTTEQGNE

SEQ ID NO: 126774 - protein, 30 aa, Artificial Sequence
  Description of Artificial Sequence: Synthetic polypeptide
DENEIRTTNPVSTEPWGTISMIIMQQAGNH

SEQ ID NO: 126775 - protein, 34 aa, Artificial Sequence
  Description of Artificial Sequence: Synthetic polypeptide
DEVEIATTNPVATEQYGSVYCGENDQDRDGHQGP

SEQ ID NO: 126776 - protein, 33 aa, Artificial Sequence
  Description of Artificial Sequence: Synthetic polypeptide
DEVEIATTNPVATEQYGVVVHTDNHDIQDGGAA

SEQ ID NO: 126777 - protein, 30 aa, Artificial Sequence
  Description of Artificial Sequence: Synthetic polypeptide
AENEIATTNPVATEGYGCVCSWELNQHIEL

SEQ ID NO: 126778 - protein, 33 aa, Artificial Sequence
  Description of Artificial Sequence: Synthetic polypeptide
DESEIRTTNPVATEPWGSISCIDIQQDREGENG

SEQ ID NO: 126779 - protein, 33 aa, Artificial Sequence
  Description of Artificial Sequence: Synthetic polypeptide
DESEIRTTNPVATEPWGSISCIDEQQDREGENG

SEQ ID NO: 126780 - protein, 36 aa, Artificial Sequence
  Description of Artificial Sequence: Synthetic polypeptide
DEAEIRTTNPVATEQYGSVTMHTNLEEPRNGQEDDN

SEQ ID NO: 126781 - protein, 37 aa, Artificial Sequence
  Description of Artificial Sequence: Synthetic polypeptide
DEEEIRTTNPVATEQYGSVSQTGNDSGQMQQNEIPDE

SEQ ID NO: 126782 - protein, 32 aa, Artificial Sequence
  Description of Artificial Sequence: Synthetic polypeptide
DEQEIATTNPVATEQYGSCSATDLEDHETEDL

SEQ ID NO: 126783 - protein, 35 aa, Artificial Sequence
  Description of Artificial Sequence: Synthetic polypeptide
DEAEIRTTNPVATEQYGSVTPTFTTLENQGDNTQV

SEQ ID NO: 126784 - protein, 33 aa, Artificial Sequence
  Description of Artificial Sequence: Synthetic polypeptide
DEQEIATTNPVATEQYGSCSATDLGEDHDGEDL

SEQ ID NO: 126785 - protein, 33 aa, Artificial Sequence
  Description of Artificial Sequence: Synthetic polypeptide
DESEIRTTNPVATEMYGETTSCHNAHSQRGGDQ

SEQ ID NO: 126786 - protein, 35 aa, Artificial Sequence
  Description of Artificial Sequence: Synthetic polypeptide
DEEEIRTTNPVATEQYGSVSQSSPIGVQLTQLQLL

SEQ ID NO: 126787 - protein, 34 aa, Artificial Sequence
  Description of Artificial Sequence: Synthetic polypeptide
DEQEIATTNPVATEQYGSCVSATDLWEDHEGEDL

SEQ ID NO: 126788 - protein, 32 aa, Artificial Sequence
  Description of Artificial Sequence: Synthetic polypeptide
DENEIRTTNPVSTEPWGSVSMEDIQQQQNGNH

SEQ ID NO: 126789 - protein, 37 aa, Artificial Sequence
  Description of Artificial Sequence: Synthetic polypeptide
DEEEIRTTNPVATEQYGSVSQPYMAGPNMQNGMNPVV

SEQ ID NO: 126790 - protein, 31 aa, Artificial Sequence
  Description of Artificial Sequence: Synthetic polypeptide
DENEIRTTNPVSTEPWGDVSEDEQQQQAGNH

SEQ ID NO: 126791 - protein, 36 aa, Artificial Sequence
  Description of Artificial Sequence: Synthetic polypeptide
DEEEIRTTNPVATEQYGSVSQPVNTGVIDNQVANLN

SEQ ID NO: 126792 - protein, 38 aa, Artificial Sequence
  Description of Artificial Sequence: Synthetic polypeptide
DEEEIRTTNPVATEQYGSVSQPTPASGPNMQNGHNPVA

SEQ ID NO: 126793 - protein, 33 aa, Artificial Sequence
  Description of Artificial Sequence: Synthetic polypeptide
DESEIRTTNPVATWCWGSVSCINEPQDREGEEG

SEQ ID NO: 126794 - protein, 33 aa, Artificial Sequence
  Description of Artificial Sequence: Synthetic polypeptide
DEVEIATTNPVAYEQWGSVSTDNHGAAGGDNSD

SEQ ID NO: 126795 - protein, 34 aa, Artificial Sequence
  Description of Artificial Sequence: Synthetic polypeptide
DESEIRTTNPVATEGWGSVCSWENENQDHFGSNQ

SEQ ID NO: 126796 - protein, 34 aa, Artificial Sequence
  Description of Artificial Sequence: Synthetic polypeptide
DEDEIATTNPVAYEQWGSVCSTNDVQGEGNNSNL

SEQ ID NO: 126797 - protein, 33 aa, Artificial Sequence
  Description of Artificial Sequence: Synthetic polypeptide
DEDEIATTNPVAYEQWGSVCSTDNHGAAGDNES

SEQ ID NO: 126798 - protein, 31 aa, Artificial Sequence
  Description of Artificial Sequence: Synthetic polypeptide
DENEIRTTNPVGTEPYGTISMEDIQQQQGNH

SEQ ID NO: 126799 - protein, 30 aa, Artificial Sequence
  Description of Artificial Sequence: Synthetic polypeptide
DENEIRTTNPVCTEQWGVVSEIEMNSAENQ

SEQ ID NO: 126800 - protein, 30 aa, Artificial Sequence
  Description of Artificial Sequence: Synthetic polypeptide
DENEIRTTNPVCTEQWGVVSEIEMNSAENA

SEQ ID NO: 126801 - protein, 35 aa, Artificial Sequence
  Description of Artificial Sequence: Synthetic polypeptide
DEEEIRTTNPVATEQYGSVSPTVMMMQEWVEEESN

SEQ ID NO: 126802 - protein, 33 aa, Artificial Sequence
  Description of Artificial Sequence: Synthetic polypeptide
DEDEIATTNPVAYEQWGSVCSTDLQGDTQMGGQ

SEQ ID NO: 126803 - protein, 33 aa, Artificial Sequence
  Description of Artificial Sequence: Synthetic polypeptide
DEVEICTTNPVATDQYGVVSTDGEQGGQGNEEY

SEQ ID NO: 126804 - protein, 29 aa, Artificial Sequence
  Description of Artificial Sequence: Synthetic peptide
AENEIACTNPVSTEQYGTASMNIQQQGGH

SEQ ID NO: 126805 - protein, 31 aa, Artificial Sequence
  Description of Artificial Sequence: Synthetic polypeptide
DENEIRTTNPVCTEPYGVISMEDIQQQNGNQ

SEQ ID NO: 126806 - protein, 31 aa, Artificial Sequence
  Description of Artificial Sequence: Synthetic polypeptide
DENEIRTTNPVCTEPYGTISMEDIQQSNGNH

SEQ ID NO: 126807 - protein, 36 aa, Artificial Sequence
  Description of Artificial Sequence: Synthetic polypeptide
DEVEICTTNPVATECYGSVSTGNGLLDDDRGQNDDQ

SEQ ID NO: 126808 - protein, 31 aa, Artificial Sequence
  Description of Artificial Sequence: Synthetic polypeptide
DENEIRTTNPVCTEPYGTISMEDIQQQNGNQ

SEQ ID NO: 126809 - protein, 31 aa, Artificial Sequence
  Description of Artificial Sequence: Synthetic polypeptide
DENEIRTTNPVCTEPYGTISMEDIQQQNGNH

SEQ ID NO: 126810 - protein, 35 aa, Artificial Sequence
  Description of Artificial Sequence: Synthetic polypeptide
DEQEIATTNPVATEQYGSTVSATGLSADMEGGENV

SEQ ID NO: 126811 - protein, 35 aa, Artificial Sequence
  Description of Artificial Sequence: Synthetic polypeptide
DEQEIATTNPVATEQYGSTVSATGLSEDDEGGENH

SEQ ID NO: 126812 - protein, 33 aa, Artificial Sequence
  Description of Artificial Sequence: Synthetic polypeptide
DESEIRTTNPVATEFWGSVGCINEPQAREGEEG

SEQ ID NO: 126813 - protein, 35 aa, Artificial Sequence
  Description of Artificial Sequence: Synthetic polypeptide
DEQEIATTNPVATEQYGSTVSCTGLSEDMEGGENQ

SEQ ID NO: 126814 - protein, 34 aa, Artificial Sequence
  Description of Artificial Sequence: Synthetic polypeptide
DESEIRTTNPVATEEWGSVSWMNENQDNEGSNQA

SEQ ID NO: 126815 - protein, 33 aa, Artificial Sequence
  Description of Artificial Sequence: Synthetic polypeptide
DEQEIATTNPVATEQYGSTSATVDLEDHEGEDL

SEQ ID NO: 126816 - protein, 36 aa, Artificial Sequence
  Description of Artificial Sequence: Synthetic polypeptide
DEVEICTTNPVATECYGSVSTGNGNQQLDREGHDRD

SEQ ID NO: 126817 - protein, 33 aa, Artificial Sequence
  Description of Artificial Sequence: Synthetic polypeptide
DEQEIATTNPVATEQYGSTSATDYLEDHEGEDL

SEQ ID NO: 126818 - protein, 36 aa, Artificial Sequence
  Description of Artificial Sequence: Synthetic polypeptide
DEEEIRTTNPVATEQYGSVSPTVNPLLDNIESVAGL

SEQ ID NO: 126819 - protein, 33 aa, Artificial Sequence
  Description of Artificial Sequence: Synthetic polypeptide
DEQEIATTNPVATEQYGSSSATDLEDHEGIEDT

SEQ ID NO: 126820 - protein, 34 aa, Artificial Sequence
  Description of Artificial Sequence: Synthetic polypeptide
DEAEIRTTNPVATEQYGSVWADVPQSIGNGQEFM

SEQ ID NO: 126821 - protein, 34 aa, Artificial Sequence
  Description of Artificial Sequence: Synthetic polypeptide
DEQEIATTNPVATEQYGSSVSATDLEDHEGEEDL

SEQ ID NO: 126822 - protein, 33 aa, Artificial Sequence
  Description of Artificial Sequence: Synthetic polypeptide
DEVEIATTNPVAYERWGEVSTNNLGQGNDNDGR

SEQ ID NO: 126823 - protein, 32 aa, Artificial Sequence
  Description of Artificial Sequence: Synthetic polypeptide
DEVEIATTNPVAYERWGSATTNLQGNAGENDM

SEQ ID NO: 126824 - protein, 34 aa, Artificial Sequence
  Description of Artificial Sequence: Synthetic polypeptide
DEQEIATTNPVATEQYGSSVSATDLREDHEGEDL

SEQ ID NO: 126825 - protein, 32 aa, Artificial Sequence
  Description of Artificial Sequence: Synthetic polypeptide
DEVEIATTNPVAYERWGSVATNEQGNDNGNEN

SEQ ID NO: 126826 - protein, 37 aa, Artificial Sequence
  Description of Artificial Sequence: Synthetic polypeptide
DEDEIRTTNPVATEQYGVVSTVSVTTNQNNQAGNTES

SEQ ID NO: 126827 - protein, 34 aa, Artificial Sequence
  Description of Artificial Sequence: Synthetic polypeptide
DEQEIATTNPVATEQYGSSVSATTLWEDIEGEDL

SEQ ID NO: 126828 - protein, 36 aa, Artificial Sequence
  Description of Artificial Sequence: Synthetic polypeptide
DEEEIRTTNPVATEQYGSVSPTVSELEEPISNNQFD

SEQ ID NO: 126829 - protein, 33 aa, Artificial Sequence
  Description of Artificial Sequence: Synthetic polypeptide
DEVEIATTNPVAYERWGSVSTNLNQGADNDGSQ

SEQ ID NO: 126830 - protein, 32 aa, Artificial Sequence
  Description of Artificial Sequence: Synthetic polypeptide
DEQEIATTNPVATEQYGSTSAADLEDHEGEDL

SEQ ID NO: 126831 - protein, 34 aa, Artificial Sequence
  Description of Artificial Sequence: Synthetic polypeptide
DESEIRTTNPVATEGWGCVCSWENENQDRFGSNA

SEQ ID NO: 126832 - protein, 30 aa, Artificial Sequence
  Description of Artificial Sequence: Synthetic polypeptide
DENEIRTTNPVGTEQWGDVSSILMNAAEDA

SEQ ID NO: 126833 - protein, 32 aa, Artificial Sequence
  Description of Artificial Sequence: Synthetic polypeptide
DEQEIATTNPVATEQYGSTSAKDLEDHEGEDL

SEQ ID NO: 126834 - protein, 36 aa, Artificial Sequence
  Description of Artificial Sequence: Synthetic polypeptide
DEEEIRTTNPVATEQYGSVSPTVNSLIPAIPTEIIG

SEQ ID NO: 126835 - protein, 31 aa, Artificial Sequence
  Description of Artificial Sequence: Synthetic polypeptide
DEVEIATTNPVAYERWGTVSTNLNMGDDGSG

SEQ ID NO: 126836 - protein, 29 aa, Artificial Sequence
  Description of Artificial Sequence: Synthetic peptide
DENEIRTTNPVGTEQWGDVSEIEMNAEDA

SEQ ID NO: 126837 - protein, 33 aa, Artificial Sequence
  Description of Artificial Sequence: Synthetic polypeptide
DEVEIATTNPVAYERWGTVSTNVNQGDVGDNER

SEQ ID NO: 126838 - protein, 36 aa, Artificial Sequence
  Description of Artificial Sequence: Synthetic polypeptide
DEEEIRTTNPVATEQYGSVSPTVNNLHIAIPTEEIG

SEQ ID NO: 126839 - protein, 34 aa, Artificial Sequence
  Description of Artificial Sequence: Synthetic polypeptide
DESEIRTTNPVATEGWGCVSWINENQDRFGSNAS

SEQ ID NO: 126840 - protein, 36 aa, Artificial Sequence
  Description of Artificial Sequence: Synthetic polypeptide
DEVEICTTNPVATECYGSVSTGNGNQQTDREGGDRR

SEQ ID NO: 126841 - protein, 35 aa, Artificial Sequence
  Description of Artificial Sequence: Synthetic polypeptide
DEEEIRTTNPVATEQYGSVSPTTTEGPEMEGQFLN

SEQ ID NO: 126842 - protein, 31 aa, Artificial Sequence
  Description of Artificial Sequence: Synthetic polypeptide
DENEIRTTNPVAYEQWGTVSKEIEMRAGEEA

SEQ ID NO: 126843 - protein, 32 aa, Artificial Sequence
  Description of Artificial Sequence: Synthetic polypeptide
DEQEIATTNPVATEQYGSVAATDWEDHEGEDL

SEQ ID NO: 126844 - protein, 34 aa, Artificial Sequence
  Description of Artificial Sequence: Synthetic polypeptide
DEVEICTTNPVAYEQWGSVSTTNGNDNHQGDNRR

SEQ ID NO: 126845 - protein, 31 aa, Artificial Sequence
  Description of Artificial Sequence: Synthetic polypeptide
DENEIRTTNPVAYEQWGTVSKEIEERAGEDD

SEQ ID NO: 126846 - protein, 30 aa, Artificial Sequence
  Description of Artificial Sequence: Synthetic polypeptide
DENEIRTTNPVAYEQWGMVSWIEMRDLEDA

SEQ ID NO: 126847 - protein, 36 aa, Artificial Sequence
  Description of Artificial Sequence: Synthetic polypeptide
DEDEIRTTNPVATEQYGVVSTVVNNTNLQAGSTDSN

SEQ ID NO: 126848 - protein, 35 aa, Artificial Sequence
  Description of Artificial Sequence: Synthetic polypeptide
DEVEIRSTNPVATEQYGSVYTDNNQGNDEGEGGNG

SEQ ID NO: 126849 - protein, 36 aa, Artificial Sequence
  Description of Artificial Sequence: Synthetic polypeptide
DEEEIRTTNPVATEQYGSVSPTTNIIFTLNSLEDTD

SEQ ID NO: 126850 - protein, 31 aa, Artificial Sequence
  Description of Artificial Sequence: Synthetic polypeptide
DENEIRTTNPVAYEQWGEVSWIEMRALEGDA

SEQ ID NO: 126851 - protein, 33 aa, Artificial Sequence
  Description of Artificial Sequence: Synthetic polypeptide
DEQEIATTNPVATEQYGSVAATEDLADHEGEDL

SEQ ID NO: 126852 - protein, 33 aa, Artificial Sequence
  Description of Artificial Sequence: Synthetic polypeptide
DEQEIATTNPVATEQYGSVAATEDLEDHEGEDL

SEQ ID NO: 126853 - protein, 30 aa, Artificial Sequence
  Description of Artificial Sequence: Synthetic polypeptide
DENEIRTTNPVAYEQWGDVSEINMNAAEDA

SEQ ID NO: 126854 - protein, 32 aa, Artificial Sequence
  Description of Artificial Sequence: Synthetic polypeptide
DEDEIATTNPVAYEQWGSISAAGTLQQGNSEG

SEQ ID NO: 126855 - protein, 36 aa, Artificial Sequence
  Description of Artificial Sequence: Synthetic polypeptide
DEDEIRTTNPVATEQYGVVSTVVSNQQAGNNNQEDE

SEQ ID NO: 126856 - protein, 38 aa, Artificial Sequence
  Description of Artificial Sequence: Synthetic polypeptide
DEDEIRTTNPVATEQYGVVSTVVSTNLQAGNNNNDEDE

SEQ ID NO: 126857 - protein, 37 aa, Artificial Sequence
  Description of Artificial Sequence: Synthetic polypeptide
DEDEIRTTNPVATEQYGVVSTVVTNLQAGENNNQTDD

SEQ ID NO: 126858 - protein, 34 aa, Artificial Sequence
  Description of Artificial Sequence: Synthetic polypeptide
DEDEIATTNPVAYEQWGQSVATNDLTQDGMGARM

SEQ ID NO: 126859 - protein, 36 aa, Artificial Sequence
  Description of Artificial Sequence: Synthetic polypeptide
DEDEIRTTNPVATEQYGVVSTVVTNQQAGNNNQTDD

SEQ ID NO: 126860 - protein, 37 aa, Artificial Sequence
  Description of Artificial Sequence: Synthetic polypeptide
DEEEIRTTNPVATEQYGSVSPTSPGIGQNRQDMVPIN

SEQ ID NO: 126861 - protein, 33 aa, Artificial Sequence
  Description of Artificial Sequence: Synthetic polypeptide
DEQEIATTNPVATEQYGSVAATDLNEHHEGEDS

SEQ ID NO: 126862 - protein, 35 aa, Artificial Sequence
  Description of Artificial Sequence: Synthetic polypeptide
DEEEIRTTNPVATEQYGSVSPTTTMTSARQELTVL

SEQ ID NO: 126863 - protein, 37 aa, Artificial Sequence
  Description of Artificial Sequence: Synthetic polypeptide
DEDEIRTTNPVATEQYGVVSTVVNNLQAGGNNNDEDD

SEQ ID NO: 126864 - protein, 38 aa, Artificial Sequence
  Description of Artificial Sequence: Synthetic polypeptide
DEEEIRTTNPVATEQYGSVSTTVNQNQNEEQGTTNNTD

SEQ ID NO: 126865 - protein, 36 aa, Artificial Sequence
  Description of Artificial Sequence: Synthetic polypeptide
DEEEIRTTNPVATEQYGSVSPTTTEGAEVEGLQSRQ

SEQ ID NO: 126866 - protein, 35 aa, Artificial Sequence
  Description of Artificial Sequence: Synthetic polypeptide
DEQEIATTNPVATEQYGSTVSCTLLSEDAEGGENP

SEQ ID NO: 126867 - protein, 35 aa, Artificial Sequence
  Description of Artificial Sequence: Synthetic polypeptide
DEQEIATTNPVATEQYGSTVSCTLLSEDHESGDNF

SEQ ID NO: 126868 - protein, 35 aa, Artificial Sequence
  Description of Artificial Sequence: Synthetic polypeptide
DEVEICTTNPVATEGYGEVSTGNGNQQNDREGDTR

SEQ ID NO: 126869 - protein, 34 aa, Artificial Sequence
  Description of Artificial Sequence: Synthetic polypeptide
DEVEICTTNPVATEHYGEVSTGNGNQQLDEGDTR

SEQ ID NO: 126870 - protein, 36 aa, Artificial Sequence
  Description of Artificial Sequence: Synthetic polypeptide
DEDEIRTTNPVATEQYGVVSTVTVTTNLQAGTTTSA

SEQ ID NO: 126871 - protein, 35 aa, Artificial Sequence
  Description of Artificial Sequence: Synthetic polypeptide
DEQEIATTNPVATEQYGSTVSCTLLSEDHHGGENN

SEQ ID NO: 126872 - protein, 33 aa, Artificial Sequence
  Description of Artificial Sequence: Synthetic polypeptide
DEDEIATTNPVAYEQWGSVATTNQLQGDVQNTQ

SEQ ID NO: 126873 - protein, 35 aa, Artificial Sequence
  Description of Artificial Sequence: Synthetic polypeptide
DEVEICTTNPVATEPYGSVSTGNGNGGNTAGENSR

SEQ ID NO: 126874 - protein, 31 aa, Artificial Sequence
  Description of Artificial Sequence: Synthetic polypeptide
DEQEIATTNPVATEQYGSVAAAIDEQDNHTE

SEQ ID NO: 126875 - protein, 32 aa, Artificial Sequence
  Description of Artificial Sequence: Synthetic polypeptide
DEQEIATTNPVATEQYGSVAAEDLTVHEGEDI

SEQ ID NO: 126876 - protein, 32 aa, Artificial Sequence
  Description of Artificial Sequence: Synthetic polypeptide
DEQEIATTNPVATEQYGSVAASDLEDHEGEDI

SEQ ID NO: 126877 - protein, 32 aa, Artificial Sequence
  Description of Artificial Sequence: Synthetic polypeptide
DEQEIATTNPVATEQYGSVAASDLEDHEGEDL

SEQ ID NO: 126878 - protein, 34 aa, Artificial Sequence
  Description of Artificial Sequence: Synthetic polypeptide
DESEIRTTNPVATECYGTVSACINEPQDFEGENG

SEQ ID NO: 126879 - protein, 32 aa, Artificial Sequence
  Description of Artificial Sequence: Synthetic polypeptide
DEDEIATTNPVAYEQWGSTSTNNQGDSGGDGQ

SEQ ID NO: 126880 - protein, 33 aa, Artificial Sequence
  Description of Artificial Sequence: Synthetic polypeptide
CEEEIRTTNPVATEQYGDVVGVGNMTNGNGQGG

SEQ ID NO: 126881 - protein, 32 aa, Artificial Sequence
  Description of Artificial Sequence: Synthetic polypeptide
DEDEIATTNPVAYEQWGSTSTNDGGNHGGNHS

SEQ ID NO: 126882 - protein, 39 aa, Artificial Sequence
  Description of Artificial Sequence: Synthetic polypeptide
DEEEIRTTNPVATEQYGSVSTTVTNLQAGTTEQGTNQDN

SEQ ID NO: 126883 - protein, 32 aa, Artificial Sequence
  Description of Artificial Sequence: Synthetic polypeptide
DEQEIATTNPVATEQYGSVAATDLEDHELEDL

SEQ ID NO: 126884 - protein, 32 aa, Artificial Sequence
  Description of Artificial Sequence: Synthetic polypeptide
AENEIACTNPVSTEPYGEASMENLQQQRNGNR

SEQ ID NO: 126885 - protein, 31 aa, Artificial Sequence
  Description of Artificial Sequence: Synthetic polypeptide
DENEIRTTNPVSTECYGTVSEEDIQQHNENH

SEQ ID NO: 126886 - protein, 36 aa, Artificial Sequence
  Description of Artificial Sequence: Synthetic polypeptide
DEEEIRTTNPVATEQYGSVSPTWNMMMMEPGEEEVN

SEQ ID NO: 126887 - protein, 34 aa, Artificial Sequence
  Description of Artificial Sequence: Synthetic polypeptide
DEQEIATTNPVATEQYGSRVTSATDLDDHEGEDW

SEQ ID NO: 126888 - protein, 33 aa, Artificial Sequence
  Description of Artificial Sequence: Synthetic polypeptide
DEVEIATTNPVAYEQWGTVCSTNDQGEEGGNGP

SEQ ID NO: 126889 - protein, 35 aa, Artificial Sequence
  Description of Artificial Sequence: Synthetic polypeptide
DEEEIRTTNPVATEQYGSVSPWDNPPAAFEITTRE

SEQ ID NO: 126890 - protein, 32 aa, Artificial Sequence
  Description of Artificial Sequence: Synthetic polypeptide
DENEIRTTNPVSTECYGTISCENIQQDQNGNG

SEQ ID NO: 126891 - protein, 32 aa, Artificial Sequence
  Description of Artificial Sequence: Synthetic polypeptide
DEQEIATTNPVATEQYGSMAATDLEDHEGDDL

SEQ ID NO: 126892 - protein, 32 aa, Artificial Sequence
  Description of Artificial Sequence: Synthetic polypeptide
DEQEIATTNPVATEQYGSMAATDLEDHEGEDL

SEQ ID NO: 126893 - protein, 36 aa, Artificial Sequence
  Description of Artificial Sequence: Synthetic polypeptide
DEEEIRTTNPVATEQYGSVSPVWNMMMQELGEEEVN

SEQ ID NO: 126894 - protein, 36 aa, Artificial Sequence
  Description of Artificial Sequence: Synthetic polypeptide
DEAEIRTTNPVATEQYGSVVSNIMLEELRNGNEEFF

SEQ ID NO: 126895 - protein, 32 aa, Artificial Sequence
  Description of Artificial Sequence: Synthetic polypeptide
DENEIRTTNPVSTECYGSISMEDIQQQQEGNH

SEQ ID NO: 126896 - protein, 33 aa, Artificial Sequence
  Description of Artificial Sequence: Synthetic polypeptide
DEQEIATTNPVATEQYGSMLSATDLEDHEGEDL

SEQ ID NO: 126897 - protein, 33 aa, Artificial Sequence
  Description of Artificial Sequence: Synthetic polypeptide
DENEIRTTNPVSTECYGSISCIDEPQDREGENG

SEQ ID NO: 126898 - protein, 32 aa, Artificial Sequence
  Description of Artificial Sequence: Synthetic polypeptide
DEQEIATTNPVATEQYGSMSAPDLEDHEGEDL

SEQ ID NO: 126899 - protein, 35 aa, Artificial Sequence
  Description of Artificial Sequence: Synthetic polypeptide
DEEEIRTTNPVATEQYGSVSPVSLMEHAAMENIHL

SEQ ID NO: 126900 - protein, 36 aa, Artificial Sequence
  Description of Artificial Sequence: Synthetic polypeptide
DEEEIRTTNPVATEQYGSVSPVPNNLMADDGVVQEI

SEQ ID NO: 126901 - protein, 36 aa, Artificial Sequence
  Description of Artificial Sequence: Synthetic polypeptide
DEEEIRTTNPVATEQYGSVSPVPNMGMARDGVVQEI

SEQ ID NO: 126902 - protein, 34 aa, Artificial Sequence
  Description of Artificial Sequence: Synthetic polypeptide
DEVEIATTNPVAYEQWGVVCSTENDQGEGNNGRG

SEQ ID NO: 126903 - protein, 33 aa, Artificial Sequence
  Description of Artificial Sequence: Synthetic polypeptide
DENEIRTTNPVSTECWGSVSMENEPQQQEGENH

SEQ ID NO: 126904 - protein, 33 aa, Artificial Sequence
  Description of Artificial Sequence: Synthetic polypeptide
DENEIRTTNPVSTECWGSISCINEPQDREGENG

SEQ ID NO: 126905 - protein, 32 aa, Artificial Sequence
  Description of Artificial Sequence: Synthetic polypeptide
DEDEIATTNPVAYEQWGSVSGDNDQGEHNGAA

SEQ ID NO: 126906 - protein, 37 aa, Artificial Sequence
  Description of Artificial Sequence: Synthetic polypeptide
DEEEIRTTNPVATEQYGSVSPVPNALLAARDGVVVEI

SEQ ID NO: 126907 - protein, 33 aa, Artificial Sequence
  Description of Artificial Sequence: Synthetic polypeptide
DEDEIATTNPVAYEQWGSVSGDNSQQGEHNGSA

SEQ ID NO: 126908 - protein, 31 aa, Artificial Sequence
  Description of Artificial Sequence: Synthetic polypeptide
DEVEIATTNPVAYEQWGYCQEDLVRGMNQRG

SEQ ID NO: 126909 - protein, 34 aa, Artificial Sequence
  Description of Artificial Sequence: Synthetic polypeptide
DEDEIATTNPVAYEQWGSVSGENLGENRGGMDND

SEQ ID NO: 126910 - protein, 33 aa, Artificial Sequence
  Description of Artificial Sequence: Synthetic polypeptide
DEAEIRTTNPVATEQYGSVCEGTADLPEPEEEQ

SEQ ID NO: 126911 - protein, 31 aa, Artificial Sequence
  Description of Artificial Sequence: Synthetic polypeptide
DENEIRTTNPVSTECYGTVSEECIQQHNENH

SEQ ID NO: 126912 - protein, 33 aa, Artificial Sequence
  Description of Artificial Sequence: Synthetic polypeptide
DENEIRTTNPVSTECYGTVSCINIQQQQNGENG

SEQ ID NO: 126913 - protein, 33 aa, Artificial Sequence
  Description of Artificial Sequence: Synthetic polypeptide
DEAEIRTTNPVATEQYGSVCEGTLDALPEMEEQ

SEQ ID NO: 126914 - protein, 35 aa, Artificial Sequence
  Description of Artificial Sequence: Synthetic polypeptide
DEEEIRTTNPVATEQYGSVSPWWNENPQVSQSTQQ

SEQ ID NO: 126915 - protein, 33 aa, Artificial Sequence
  Description of Artificial Sequence: Synthetic polypeptide
DENEIRTTNPVSTECYGTVSCENIPQDQEGENG

SEQ ID NO: 126916 - protein, 33 aa, Artificial Sequence
  Description of Artificial Sequence: Synthetic polypeptide
DEQEIATTNPVATEQYGSLSATDLEDHEGEDTW

SEQ ID NO: 126917 - protein, 35 aa, Artificial Sequence
  Description of Artificial Sequence: Synthetic polypeptide
DEEEIRTTNPVATEQYGSVSPWTYMMEIIGDTQEI

SEQ ID NO: 126918 - protein, 36 aa, Artificial Sequence
  Description of Artificial Sequence: Synthetic polypeptide
DEEEIRTTNPVATEQYGSVSPWTSMMEEQIGDTQEI

SEQ ID NO: 126919 - protein, 33 aa, Artificial Sequence
  Description of Artificial Sequence: Synthetic polypeptide
AENEIATTNPVATECWGSVSCINEPQDREGENG

SEQ ID NO: 126920 - protein, 29 aa, Artificial Sequence
  Description of Artificial Sequence: Synthetic peptide
AENEIATTNPVATECWGDVSESLQQHEEE

SEQ ID NO: 126921 - protein, 29 aa, Artificial Sequence
  Description of Artificial Sequence: Synthetic peptide
AENEIATTNPVATECWGCVSECLQHEEAE

SEQ ID NO: 126922 - protein, 33 aa, Artificial Sequence
  Description of Artificial Sequence: Synthetic polypeptide
DEVEIATTNPVAYEQWGSVTGTNLGDNHGNTSS

SEQ ID NO: 126923 - protein, 35 aa, Artificial Sequence
  Description of Artificial Sequence: Synthetic polypeptide
DEEEIRTTNPVATEQYGSVSPWLNMDPMRVMVDLH

SEQ ID NO: 126924 - protein, 31 aa, Artificial Sequence
  Description of Artificial Sequence: Synthetic polypeptide
DENEIRTTNPVSTECYGTISMEDLQQQQGEL

SEQ ID NO: 126925 - protein, 32 aa, Artificial Sequence
  Description of Artificial Sequence: Synthetic polypeptide
DENEIRTTNPVSTECYGTISMEDIQQQRNGNG

SEQ ID NO: 126926 - protein, 34 aa, Artificial Sequence
  Description of Artificial Sequence: Synthetic polypeptide
DEQEIATTNPVATEQYGSLVMSATDLEDHEGECH

SEQ ID NO: 126927 - protein, 31 aa, Artificial Sequence
  Description of Artificial Sequence: Synthetic polypeptide
DENEIRTTNPVSTECYGTISMEDIQQQNGNL

SEQ ID NO: 126928 - protein, 31 aa, Artificial Sequence
  Description of Artificial Sequence: Synthetic polypeptide
DENEIRTTNPVSTECYGTISMEDIQQQNGNH

SEQ ID NO: 126929 - protein, 36 aa, Artificial Sequence
  Description of Artificial Sequence: Synthetic polypeptide
DEEEIRTTNPVATEQYGSVSPWFNYYQPTENEVDQQ

SEQ ID NO: 126930 - protein, 34 aa, Artificial Sequence
  Description of Artificial Sequence: Synthetic polypeptide
DEQEIATTNPVATEQYGSLVSATDFLEDHEGEDL

SEQ ID NO: 126931 - protein, 32 aa, Artificial Sequence
  Description of Artificial Sequence: Synthetic polypeptide
DEQEIATTNPVATEQYGSSSAEDLEDHEGEDL

SEQ ID NO: 126932 - protein, 32 aa, Artificial Sequence
  Description of Artificial Sequence: Synthetic polypeptide
DENEIRTTNPVSTEAYGTISWEDINQQQFGNH

SEQ ID NO: 126933 - protein, 32 aa, Artificial Sequence
  Description of Artificial Sequence: Synthetic polypeptide
DEVEIATTNPVAYEQYGSTVAANGDQNPAARM

SEQ ID NO: 126934 - protein, 37 aa, Artificial Sequence
  Description of Artificial Sequence: Synthetic polypeptide
DEAEIRTTNPVATEQYGSVVSTNIMAEELENGNEEVG

SEQ ID NO: 126935 - protein, 30 aa, Artificial Sequence
  Description of Artificial Sequence: Synthetic polypeptide
DENEIRTTNPVSSEPYGTISMDIQQQQGTR

SEQ ID NO: 126936 - protein, 37 aa, Artificial Sequence
  Description of Artificial Sequence: Synthetic polypeptide
DEAEIRTTNPVATEQYGSVVSTNIMLEELRNDNEEFF

SEQ ID NO: 126937 - protein, 32 aa, Artificial Sequence
  Description of Artificial Sequence: Synthetic polypeptide
DEQEIATTNPVATEQYGSNSATDSEDHEGEDL

SEQ ID NO: 126938 - protein, 35 aa, Artificial Sequence
  Description of Artificial Sequence: Synthetic polypeptide
DEAEIRTTNPVATEQYGSVVSTPLNFDSEGGDSEE

SEQ ID NO: 126939 - protein, 34 aa, Artificial Sequence
  Description of Artificial Sequence: Synthetic polypeptide
DEQEIATTNPVATEQYGSNVSATDLKEDHEGEDL

SEQ ID NO: 126940 - protein, 34 aa, Artificial Sequence
  Description of Artificial Sequence: Synthetic polypeptide
DEAEIRTTNPVATEQYGSVVTTPLNFDEGGDGEE

SEQ ID NO: 126941 - protein, 33 aa, Artificial Sequence
  Description of Artificial Sequence: Synthetic polypeptide
DEQEIATTNPVATEQYGSQVRATDLEDHEGEDL

SEQ ID NO: 126942 - protein, 33 aa, Artificial Sequence
  Description of Artificial Sequence: Synthetic polypeptide
DEQEIATTNPVATEQYGSRSATDLMEDHEGEDL

SEQ ID NO: 126943 - protein, 30 aa, Artificial Sequence
  Description of Artificial Sequence: Synthetic polypeptide
DENEIRTTNPVSSEPYGIISMDIQQSNGNH

SEQ ID NO: 126944 - protein, 36 aa, Artificial Sequence
  Description of Artificial Sequence: Synthetic polypeptide
DEEEIRTTNPVATEQYGSVSPVDNMMMQESGEEEVE

SEQ ID NO: 126945 - protein, 35 aa, Artificial Sequence
  Description of Artificial Sequence: Synthetic polypeptide
DEVEIATTNPVAYEQYGTVCSYTDGLHEHQRGNES

SEQ ID NO: 126946 - protein, 33 aa, Artificial Sequence
  Description of Artificial Sequence: Synthetic polypeptide
DEVEIATTNPVAYEQYGTVSSTNNLINDEHNGP

SEQ ID NO: 126947 - protein, 34 aa, Artificial Sequence
  Description of Artificial Sequence: Synthetic polypeptide
DEVEIATTNPVAYEQYGTVSSTNTGNQNGEDNGP

SEQ ID NO: 126948 - protein, 36 aa, Artificial Sequence
  Description of Artificial Sequence: Synthetic polypeptide
DEDEIRTTNPVATEQYGVVSTVNNTTNLQAGSTDDT

SEQ ID NO: 126949 - protein, 33 aa, Artificial Sequence
  Description of Artificial Sequence: Synthetic polypeptide
DEQEIATTNPVATEQYGSRVSAKDLEDHEGEDA

SEQ ID NO: 126950 - protein, 35 aa, Artificial Sequence
  Description of Artificial Sequence: Synthetic polypeptide
DEAEIRTTNPVATEQYGSVVVTADNTQTGQDEVES

SEQ ID NO: 126951 - protein, 33 aa, Artificial Sequence
  Description of Artificial Sequence: Synthetic polypeptide
DEQEIATTNPVATEQYGSRVSATDLEDHEIEDL

SEQ ID NO: 126952 - protein, 34 aa, Artificial Sequence
  Description of Artificial Sequence: Synthetic polypeptide
DEQEIATTNPVATEQYGSRVSATEDLEDHEGEDL

SEQ ID NO: 126953 - protein, 33 aa, Artificial Sequence
  Description of Artificial Sequence: Synthetic polypeptide
DEQEIATTNPVATEQYGSNSATDLEDHEGFEDL

SEQ ID NO: 126954 - protein, 37 aa, Artificial Sequence
  Description of Artificial Sequence: Synthetic polypeptide
DEEEIRTTNPVATEQYGSVSPVPNALHAARDGVDPEI

SEQ ID NO: 126955 - protein, 30 aa, Artificial Sequence
  Description of Artificial Sequence: Synthetic polypeptide
DENEIRTTNPVSSEPYGTISMDIQQSNGNH

SEQ ID NO: 126956 - protein, 34 aa, Artificial Sequence
  Description of Artificial Sequence: Synthetic polypeptide
DEQEIATTNPVATEQYGSMVSATDLEDHEGEDLP

SEQ ID NO: 126957 - protein, 36 aa, Artificial Sequence
  Description of Artificial Sequence: Synthetic polypeptide
DEEEIRTTNPVATEQYGSVSPVPNADVARDGVVPEI

SEQ ID NO: 126958 - protein, 33 aa, Artificial Sequence
  Description of Artificial Sequence: Synthetic polypeptide
DEVEIATTNPVAYEQYGSVAAANLQGTPDGSEN

SEQ ID NO: 126959 - protein, 36 aa, Artificial Sequence
  Description of Artificial Sequence: Synthetic polypeptide
DEEEIRTTNPVATEQYGSVSTVDYLTNTESTQNDDM

SEQ ID NO: 126960 - protein, 32 aa, Artificial Sequence
  Description of Artificial Sequence: Synthetic polypeptide
DENEIRTTNPVSTEAYGCISWEDINAEQFGNQ

SEQ ID NO: 126961 - protein, 36 aa, Artificial Sequence
  Description of Artificial Sequence: Synthetic polypeptide
DEEEIRTTNPVATEQYGSVSPVNAGTQEENVVPEFY

SEQ ID NO: 126962 - protein, 35 aa, Artificial Sequence
  Description of Artificial Sequence: Synthetic polypeptide
DEEEIRTTNPVATEQYGSVSPVMVDVLTAGAMSMT

SEQ ID NO: 126963 - protein, 28 aa, Artificial Sequence
  Description of Artificial Sequence: Synthetic peptide
AENEIASTNPVGTEGYGVMASTLQHGDI

SEQ ID NO: 126964 - protein, 33 aa, Artificial Sequence
  Description of Artificial Sequence: Synthetic polypeptide
DESEIRTTNPVATEGWGCVSWMNEPQENEGSNQ

SEQ ID NO: 126965 - protein, 36 aa, Artificial Sequence
  Description of Artificial Sequence: Synthetic polypeptide
DEAEIRTTNPVATEQYGSVVSTIMLEELLNGNQEVF

SEQ ID NO: 126966 - protein, 28 aa, Artificial Sequence
  Description of Artificial Sequence: Synthetic peptide
AENEIASTNPVGTEGYGEMASNLQHGDI

SEQ ID NO: 126967 - protein, 35 aa, Artificial Sequence
  Description of Artificial Sequence: Synthetic polypeptide
DEEEIRTTNPVATEQYGSVSPVMQDVLTAGGQAMT

SEQ ID NO: 126968 - protein, 35 aa, Artificial Sequence
  Description of Artificial Sequence: Synthetic polypeptide
DEEEIRTTNPVATEQYGSVSPVMQDVLSAPNMSMT

SEQ ID NO: 126969 - protein, 36 aa, Artificial Sequence
  Description of Artificial Sequence: Synthetic polypeptide
DEEEIRTTNPVATEQYGSVSPVMMDVLQTAGGQSMT

SEQ ID NO: 126970 - protein, 35 aa, Artificial Sequence
  Description of Artificial Sequence: Synthetic polypeptide
DEEEIRTTNPVATEQYGSVSPVMGDVLTAGGQSMA

SEQ ID NO: 126971 - protein, 34 aa, Artificial Sequence
  Description of Artificial Sequence: Synthetic polypeptide
DESEIRTTNPVATEGWGCVSWMNENQDRFGSNQL

SEQ ID NO: 126972 - protein, 32 aa, Artificial Sequence
  Description of Artificial Sequence: Synthetic polypeptide
DENEIRTTNPVSSEQYGTISMEDLQQQQNGNH

SEQ ID NO: 126973 - protein, 34 aa, Artificial Sequence
  Description of Artificial Sequence: Synthetic polypeptide
DEAEIRTTNPVATEQYGSTWSTILWNTQEDEEQP

SEQ ID NO: 126974 - protein, 34 aa, Artificial Sequence
  Description of Artificial Sequence: Synthetic polypeptide
DEAEIRTTNPVATEQYGSTWENLDFTGFNENDQD

SEQ ID NO: 126975 - protein, 31 aa, Artificial Sequence
  Description of Artificial Sequence: Synthetic polypeptide
DENEIRTTNPVSSEPYGTISMENIQQQQGNH

SEQ ID NO: 126976 - protein, 34 aa, Artificial Sequence
  Description of Artificial Sequence: Synthetic polypeptide
DEQEIATTNPVATEQYGSMVSATDLEDHEGFEDL

SEQ ID NO: 126977 - protein, 33 aa, Artificial Sequence
  Description of Artificial Sequence: Synthetic polypeptide
DEQEIATTNPVATEQYGSVIDATDLEDHEGEDL

SEQ ID NO: 126978 - protein, 33 aa, Artificial Sequence
  Description of Artificial Sequence: Synthetic polypeptide
DEQEIATTNPVATEKYGRSVSATDLEDHEGEDL

SEQ ID NO: 126979 - protein, 37 aa, Artificial Sequence
  Description of Artificial Sequence: Synthetic polypeptide
DEEEIRTTNPVATEQYGSVSTVNNQQNQQQATNVATE

SEQ ID NO: 126980 - protein, 33 aa, Artificial Sequence
  Description of Artificial Sequence: Synthetic polypeptide
DENEIVTTNPVATEQYGTVCSATLGPVEFEGND

SEQ ID NO: 126981 - protein, 32 aa, Artificial Sequence
  Description of Artificial Sequence: Synthetic polypeptide
DENEIVTTNPVATEQYGTVCSATGPVMFEEND

SEQ ID NO: 126982 - protein, 32 aa, Artificial Sequence
  Description of Artificial Sequence: Synthetic polypeptide
DENEIVTTNPVATEQYGTVCSATGPVEFEEND

SEQ ID NO: 126983 - protein, 33 aa, Artificial Sequence
  Description of Artificial Sequence: Synthetic polypeptide
DEAEIRTTNPVATEQYGSVNNIEPLNGGGEDSL

SEQ ID NO: 126984 - protein, 33 aa, Artificial Sequence
  Description of Artificial Sequence: Synthetic polypeptide
DESVIATTNPVAYEQWGCYVGETNLDQEDGQNR

SEQ ID NO: 126985 - protein, 31 aa, Artificial Sequence
  Description of Artificial Sequence: Synthetic polypeptide
AESEVACTNPVATEGYGNVSAETLQSRVGGR

SEQ ID NO: 126986 - protein, 33 aa, Artificial Sequence
  Description of Artificial Sequence: Synthetic polypeptide
DEDEIRTTNPVATEGYGSVVMNGQNGGGFGGGG

SEQ ID NO: 126987 - protein, 33 aa, Artificial Sequence
  Description of Artificial Sequence: Synthetic polypeptide
DESVIRTTNPVATECWGSVSCIMEPQDREGENG

SEQ ID NO: 126988 - protein, 31 aa, Artificial Sequence
  Description of Artificial Sequence: Synthetic polypeptide
DESVIATTNPVAYEQWGCVPTWDDQRMGNKH

SEQ ID NO: 126989 - protein, 33 aa, Artificial Sequence
  Description of Artificial Sequence: Synthetic polypeptide
DENEIVTTNPVATEQYGTVCSATDGPVQFEGGD

SEQ ID NO: 126990 - protein, 33 aa, Artificial Sequence
  Description of Artificial Sequence: Synthetic polypeptide
DENEIVTTNPVATEQYGTVCSATDGPVEFEGND

SEQ ID NO: 126991 - protein, 33 aa, Artificial Sequence
  Description of Artificial Sequence: Synthetic polypeptide
DESVIRTTNPVATECWGSVSCINEPFDREGENG

SEQ ID NO: 126992 - protein, 33 aa, Artificial Sequence
  Description of Artificial Sequence: Synthetic polypeptide
DESVIRTTNPVATECWGSVSCINEPPDREGENG

SEQ ID NO: 126993 - protein, 34 aa, Artificial Sequence
  Description of Artificial Sequence: Synthetic polypeptide
DEPEIRTTNPVATEQYGSVWSAADLTQEIFEDGD

SEQ ID NO: 126994 - protein, 33 aa, Artificial Sequence
  Description of Artificial Sequence: Synthetic polypeptide
DESEIRTTNPYATECWGSVSCINEPQDTEGENG

SEQ ID NO: 126995 - protein, 33 aa, Artificial Sequence
  Description of Artificial Sequence: Synthetic polypeptide
DESEIRTTNPYATECWGSVSCIGEPQDREGENG

SEQ ID NO: 126996 - protein, 33 aa, Artificial Sequence
  Description of Artificial Sequence: Synthetic polypeptide
DESEIRTTNPWATECWGSVSIINEPQDSAGENG

SEQ ID NO: 126997 - protein, 33 aa, Artificial Sequence
  Description of Artificial Sequence: Synthetic polypeptide
DENEIVTTNPVATEQYGTVCSATDGEVEFEGND

SEQ ID NO: 126998 - protein, 32 aa, Artificial Sequence
  Description of Artificial Sequence: Synthetic polypeptide
DEDEIRTTNPCAYEQWGSVPTWENDQANGGED

SEQ ID NO: 126999 - protein, 31 aa, Artificial Sequence
  Description of Artificial Sequence: Synthetic polypeptide
DENEIVTTNPVATEQYGTVCSEDGPVEFGGD

SEQ ID NO: 127000 - protein, 32 aa, Artificial Sequence
  Description of Artificial Sequence: Synthetic polypeptide
DESVIATTNPVAYEQWGCVETWNDQRMGDNEH

SEQ ID NO: 127001 - protein, 32 aa, Artificial Sequence
  Description of Artificial Sequence: Synthetic polypeptide
DESVIATTNPVAYEQWGCVETWNDQDRGGNHS

SEQ ID NO: 127002 - protein, 32 aa, Artificial Sequence
  Description of Artificial Sequence: Synthetic polypeptide
DEDEIRTTNPVATEGWYGQEEELYSLQRGISS

SEQ ID NO: 127003 - protein, 33 aa, Artificial Sequence
  Description of Artificial Sequence: Synthetic polypeptide
DENEIVTTNPVATEQYGTVVSATDGGEEFEGND

SEQ ID NO: 127004 - protein, 38 aa, Artificial Sequence
  Description of Artificial Sequence: Synthetic polypeptide
DEEEIRTTNPVATEQYGSVSTVVTNQENQQGTNNEEEE

SEQ ID NO: 127005 - protein, 30 aa, Artificial Sequence
  Description of Artificial Sequence: Synthetic polypeptide
AESEVASTNPVATEGYGNVAANTIQSRGQR

SEQ ID NO: 127006 - protein, 35 aa, Artificial Sequence
  Description of Artificial Sequence: Synthetic polypeptide
DEPEIRTTNPVATEQYGSVTPTYGDEDTQSGQDNQ

SEQ ID NO: 127007 - protein, 30 aa, Artificial Sequence
  Description of Artificial Sequence: Synthetic polypeptide
DENEIVTTNPVATEQYGTVSEIPENFEEDD

SEQ ID NO: 127008 - protein, 30 aa, Artificial Sequence
  Description of Artificial Sequence: Synthetic polypeptide
DENEIVTTNPVATEQYGTVSEIPENFEEDA

SEQ ID NO: 127009 - protein, 36 aa, Artificial Sequence
  Description of Artificial Sequence: Synthetic polypeptide
DEPEIRTTNPVATEQYGSVTSTCVSLEEPGNAGQEM

SEQ ID NO: 127010 - protein, 32 aa, Artificial Sequence
  Description of Artificial Sequence: Synthetic polypeptide
DENEIVTTNPVATEQYGTVSEDGPVENAEGND

SEQ ID NO: 127011 - protein, 32 aa, Artificial Sequence
  Description of Artificial Sequence: Synthetic polypeptide
DENEIVTTNPVATEQYGTVSEDGPVENAAGND

SEQ ID NO: 127012 - protein, 32 aa, Artificial Sequence
  Description of Artificial Sequence: Synthetic polypeptide
DENEIVTTNPVATEQYGTVSATDGEVEFAGDD

SEQ ID NO: 127013 - protein, 33 aa, Artificial Sequence
  Description of Artificial Sequence: Synthetic polypeptide
DENEIVTTNPVATEQYGTVSAMDDPQEQFEGND

SEQ ID NO: 127014 - protein, 32 aa, Artificial Sequence
  Description of Artificial Sequence: Synthetic polypeptide
DENEIVTTNPVATEQYGTVCSTIPVMNFEENA

SEQ ID NO: 127015 - protein, 35 aa, Artificial Sequence
  Description of Artificial Sequence: Synthetic polypeptide
DEAEIRTTNPVATEQYGSVNNLTNHFEEGNMEIGV

SEQ ID NO: 127016 - protein, 38 aa, Artificial Sequence
  Description of Artificial Sequence: Synthetic polypeptide
DEEEIRTTNPVATEQYGSVSTVVTNQAGNQQGTTNNNE

SEQ ID NO: 127017 - protein, 38 aa, Artificial Sequence
  Description of Artificial Sequence: Synthetic polypeptide
DEEEIRTTNPVATEQYGSVSTVVTNNQQLGNNDEEETD

SEQ ID NO: 127018 - protein, 35 aa, Artificial Sequence
  Description of Artificial Sequence: Synthetic polypeptide
DEAEIRTTNPVATEQYGSVNNIETFLQEGGSEISG

SEQ ID NO: 127019 - protein, 37 aa, Artificial Sequence
  Description of Artificial Sequence: Synthetic polypeptide
DEEEIRTTNPVATEQYGSVSSTWPACGPNMRNGMNPV

SEQ ID NO: 127020 - protein, 31 aa, Artificial Sequence
  Description of Artificial Sequence: Synthetic polypeptide
DESVIATTNPVAYEQWGCVETWNDHRNGNHP

SEQ ID NO: 127021 - protein, 33 aa, Artificial Sequence
  Description of Artificial Sequence: Synthetic polypeptide
DENEIVTTNPVATEQYGTVCSATDDPVEFEGND

SEQ ID NO: 127022 - protein, 34 aa, Artificial Sequence
  Description of Artificial Sequence: Synthetic polypeptide
DENEIVTTNPVATEQYGTVCSATDDPQEQFEGND

SEQ ID NO: 127023 - protein, 33 aa, Artificial Sequence
  Description of Artificial Sequence: Synthetic polypeptide
DESVIRTTNPVATECWGSVTCINEPQDREGENG

SEQ ID NO: 127024 - protein, 33 aa, Artificial Sequence
  Description of Artificial Sequence: Synthetic polypeptide
DENEIVTTNPVATEQYGTVCSATCGPVEFEGND

SEQ ID NO: 127025 - protein, 34 aa, Artificial Sequence
  Description of Artificial Sequence: Synthetic polypeptide
DESWIRTTNPVATECWGSVFSCINEPQDREGENG

SEQ ID NO: 127026 - protein, 32 aa, Artificial Sequence
  Description of Artificial Sequence: Synthetic polypeptide
DENEIVTTNPVATEQYGDVSATDGEVEFAGDD

SEQ ID NO: 127027 - protein, 32 aa, Artificial Sequence
  Description of Artificial Sequence: Synthetic polypeptide
DEPEIRTTNPVSTEPYGTISMEDINQQQNGNH

SEQ ID NO: 127028 - protein, 30 aa, Artificial Sequence
  Description of Artificial Sequence: Synthetic polypeptide
DESEIRTTNPVSTEQWGNVANTIQNAAGDA

SEQ ID NO: 127029 - protein, 33 aa, Artificial Sequence
  Description of Artificial Sequence: Synthetic polypeptide
DESWIRTTNPVATECWGSVSCINEPQDHEGENG

SEQ ID NO: 127030 - protein, 30 aa, Artificial Sequence
  Description of Artificial Sequence: Synthetic polypeptide
DESEIRTTNPVSTEQWGNVANTEMNAAGDA

SEQ ID NO: 127031 - protein, 33 aa, Artificial Sequence
  Description of Artificial Sequence: Synthetic polypeptide
DESYIRTTNPVATECWGSVSCINEPPDREGENG

SEQ ID NO: 127032 - protein, 34 aa, Artificial Sequence
  Description of Artificial Sequence: Synthetic polypeptide
DEAEIRTTNPVATEQYGSVKETAEVESRPQEDRF

SEQ ID NO: 127033 - protein, 33 aa, Artificial Sequence
  Description of Artificial Sequence: Synthetic polypeptide
DENEIVTTNPVATEQYGDVCSATDGPVEFEGND

SEQ ID NO: 127034 - protein, 32 aa, Artificial Sequence
  Description of Artificial Sequence: Synthetic polypeptide
DENEIVTTNPVATEQYGDVCSATDGPEFEEND

SEQ ID NO: 127035 - protein, 38 aa, Artificial Sequence
  Description of Artificial Sequence: Synthetic polypeptide
DEEEIRTTNPVATEQYGSVSTVVTNNNGQQGNNNEQNG

SEQ ID NO: 127036 - protein, 34 aa, Artificial Sequence
  Description of Artificial Sequence: Synthetic polypeptide
DESYIRTTNPVATECWGWSVSCINEPQDREGENG

SEQ ID NO: 127037 - protein, 31 aa, Artificial Sequence
  Description of Artificial Sequence: Synthetic polypeptide
DESEIRTTNPVSTEPYGTVAMDIQQQQVGNH

SEQ ID NO: 127038 - protein, 38 aa, Artificial Sequence
  Description of Artificial Sequence: Synthetic polypeptide
DEEEIRTTNPVATEQYGSVSTVVTNNGQNGTEGGTNDE

SEQ ID NO: 127039 - protein, 31 aa, Artificial Sequence
  Description of Artificial Sequence: Synthetic polypeptide
DESEIRTTNPVSTEPYGTVAMDIQQQQNGNH

SEQ ID NO: 127040 - protein, 32 aa, Artificial Sequence
  Description of Artificial Sequence: Synthetic polypeptide
DENEIVTTNPVATEQYGDVCSAEDGPEFEGND

SEQ ID NO: 127041 - protein, 32 aa, Artificial Sequence
  Description of Artificial Sequence: Synthetic polypeptide
DESEIRTTNPVSTEPYGTISMENIQQQQNGNH

SEQ ID NO: 127042 - protein, 32 aa, Artificial Sequence
  Description of Artificial Sequence: Synthetic polypeptide
DESEIRTTNPVSTEPYGTISMENEQQQQNGNG

SEQ ID NO: 127043 - protein, 32 aa, Artificial Sequence
  Description of Artificial Sequence: Synthetic polypeptide
DESEIRTTNPVSTEPYGTISMENEQQDQNGNG

SEQ ID NO: 127044 - protein, 38 aa, Artificial Sequence
  Description of Artificial Sequence: Synthetic polypeptide
DEEEIRTTNPVATEQYGSVSTVVTNNNNNQAGTEAGND

SEQ ID NO: 127045 - protein, 36 aa, Artificial Sequence
  Description of Artificial Sequence: Synthetic polypeptide
DEPEIRTTNPVATEQYGSVTPTNGDETTQSGQDENH

SEQ ID NO: 127046 - protein, 38 aa, Artificial Sequence
  Description of Artificial Sequence: Synthetic polypeptide
DEEEIRTTNPVATEQYGSVSTVVTNNNQQGNQQNEEDE

SEQ ID NO: 127047 - protein, 29 aa, Artificial Sequence
  Description of Artificial Sequence: Synthetic peptide
AETEICSTNPVTTEIYGVVNASTLQNGTI

SEQ ID NO: 127048 - protein, 38 aa, Artificial Sequence
  Description of Artificial Sequence: Synthetic polypeptide
DEEEIRTTNPVATEQYGSVSTVVTNNQQGQNSTTNVTE

SEQ ID NO: 127049 - protein, 33 aa, Artificial Sequence
  Description of Artificial Sequence: Synthetic polypeptide
DESEIRTTNPVVTECWGSVSCINEPPDREGENG

SEQ ID NO: 127050 - protein, 34 aa, Artificial Sequence
  Description of Artificial Sequence: Synthetic polypeptide
DESEIRTTNPVTTECWGSVSCINPEPQDREGENG

SEQ ID NO: 127051 - protein, 32 aa, Artificial Sequence
  Description of Artificial Sequence: Synthetic polypeptide
DESVIRTTNPVATEQYGCVETDWPQTFENQFV

SEQ ID NO: 127052 - protein, 36 aa, Artificial Sequence
  Description of Artificial Sequence: Synthetic polypeptide
DEEEIRTTNPVATEQYGSVSSTTVAMPNMRNGIDPV

SEQ ID NO: 127053 - protein, 36 aa, Artificial Sequence
  Description of Artificial Sequence: Synthetic polypeptide
DEEEIRTTNPVATEQYGSVSSTTVAGPNMRNPMNPV

SEQ ID NO: 127054 - protein, 38 aa, Artificial Sequence
  Description of Artificial Sequence: Synthetic polypeptide
DEEEIRTTNPVATEQYGSVSTVVTNNQGGNQSTTNNTE

SEQ ID NO: 127055 - protein, 33 aa, Artificial Sequence
  Description of Artificial Sequence: Synthetic polypeptide
DESEIRTTNPVTTECWGSVSCINEPQDRERENG

SEQ ID NO: 127056 - protein, 33 aa, Artificial Sequence
  Description of Artificial Sequence: Synthetic polypeptide
DENEIVTTNPVATEQYGEVCSATDGPVEFEGND

SEQ ID NO: 127057 - protein, 33 aa, Artificial Sequence
  Description of Artificial Sequence: Synthetic polypeptide
CEEEIRTTNPVATEQYGCVCSWGEDQNFGSEQA

SEQ ID NO: 127058 - protein, 36 aa, Artificial Sequence
  Description of Artificial Sequence: Synthetic polypeptide
DEEEIRTTNPVATEQYGSVSSTTTAGPNMRVGVPEV

SEQ ID NO: 127059 - protein, 34 aa, Artificial Sequence
  Description of Artificial Sequence: Synthetic polypeptide
DEAEIRTTNPVATEQYGSVMGWNSLEFGEFEQQV

SEQ ID NO: 127060 - protein, 34 aa, Artificial Sequence
  Description of Artificial Sequence: Synthetic polypeptide
DESVIRTTNPVAYEQWGVCYVGETNIDQRDGGNR

SEQ ID NO: 127061 - protein, 36 aa, Artificial Sequence
  Description of Artificial Sequence: Synthetic polypeptide
DEAEIRTTNPVATEQYGSVLSTADYLTNLESTQNDD

SEQ ID NO: 127062 - protein, 33 aa, Artificial Sequence
  Description of Artificial Sequence: Synthetic polypeptide
DEDEIRTTNPCAYEQWGSVATNWNQGDQGQNEE

SEQ ID NO: 127063 - protein, 34 aa, Artificial Sequence
  Description of Artificial Sequence: Synthetic polypeptide
DESEIRTTNPVTTECWGSAVSCINEPQDREGENG

SEQ ID NO: 127064 - protein, 38 aa, Artificial Sequence
  Description of Artificial Sequence: Synthetic polypeptide
DEEEIRTTNPVATEQYGSVSTVVTNNNQQGTTEAGNNT

SEQ ID NO: 127065 - protein, 32 aa, Artificial Sequence
  Description of Artificial Sequence: Synthetic polypeptide
DENEIVTTNPVATEQYGDVSEDGPVENAAGND

SEQ ID NO: 127066 - protein, 34 aa, Artificial Sequence
  Description of Artificial Sequence: Synthetic polypeptide
DEAEIRTTNPVATEQYGSVLGENFDFFGNEDDQD

SEQ ID NO: 127067 - protein, 33 aa, Artificial Sequence
  Description of Artificial Sequence: Synthetic polypeptide
AESEIRTTNPVATECWGSVFCINEPQDREGENG

SEQ ID NO: 127068 - protein, 33 aa, Artificial Sequence
  Description of Artificial Sequence: Synthetic polypeptide
DEDEIRTTNPVATEGWYGEESLYSLQVRGEISS

SEQ ID NO: 127069 - protein, 33 aa, Artificial Sequence
  Description of Artificial Sequence: Synthetic polypeptide
DEDEIRTTNPVATEGWGSVVAINEGQDGEGENG

SEQ ID NO: 127070 - protein, 30 aa, Artificial Sequence
  Description of Artificial Sequence: Synthetic polypeptide
AESEVASTNPVSTEGYGEASNNLQSRVGGR

SEQ ID NO: 127071 - protein, 34 aa, Artificial Sequence
  Description of Artificial Sequence: Synthetic polypeptide
DEDEIRTTNPVATEFWGSVSAINEGQDGEGENNG

SEQ ID NO: 127072 - protein, 33 aa, Artificial Sequence
  Description of Artificial Sequence: Synthetic polypeptide
DESEIRWTNPVATECWGSVVCINEPQDREGENG

SEQ ID NO: 127073 - protein, 34 aa, Artificial Sequence
  Description of Artificial Sequence: Synthetic polypeptide
DESSICTTNPCATEQWGSVSTVVNNLQSGTNMGD

SEQ ID NO: 127074 - protein, 34 aa, Artificial Sequence
  Description of Artificial Sequence: Synthetic polypeptide
CEEEIRTTNPVATEPWGESVRTWNDDQDRQKNAD

SEQ ID NO: 127075 - protein, 33 aa, Artificial Sequence
  Description of Artificial Sequence: Synthetic polypeptide
DESSIHTTNPVATELWGSVSCINEPQDREGENG

SEQ ID NO: 127076 - protein, 37 aa, Artificial Sequence
  Description of Artificial Sequence: Synthetic polypeptide
DEEEIRTTNPVATEQYGSVSSYTPAYGPNMRNGMNPV

SEQ ID NO: 127077 - protein, 36 aa, Artificial Sequence
  Description of Artificial Sequence: Synthetic polypeptide
CEEEIRTTNPVATENYGSVASTNEHSQTDTGGNNLP

SEQ ID NO: 127078 - protein, 37 aa, Artificial Sequence
  Description of Artificial Sequence: Synthetic polypeptide
DEEEIRTTNPVATEQYGSVSTVVTNSEEIGTNNEEEG

SEQ ID NO: 127079 - protein, 33 aa, Artificial Sequence
  Description of Artificial Sequence: Synthetic polypeptide
DESEIRWTNPVATECWGSCSCINEPQDREGENG

SEQ ID NO: 127080 - protein, 35 aa, Artificial Sequence
  Description of Artificial Sequence: Synthetic polypeptide
CEEEIRTTNPVATEHYGSVVSEGNMSSQHGGSPRI

SEQ ID NO: 127081 - protein, 34 aa, Artificial Sequence
  Description of Artificial Sequence: Synthetic polypeptide
DEDEIRTTNPCAYEQWGTVSTNLNQGDTGQNNEN

SEQ ID NO: 127082 - protein, 33 aa, Artificial Sequence
  Description of Artificial Sequence: Synthetic polypeptide
DESEIRVTNPVATECWGQVSCINEPQDREGENG

SEQ ID NO: 127083 - protein, 32 aa, Artificial Sequence
  Description of Artificial Sequence: Synthetic polypeptide
DESEIRTVNPVCTEQWGVVSDINEPQSEGENG

SEQ ID NO: 127084 - protein, 33 aa, Artificial Sequence
  Description of Artificial Sequence: Synthetic polypeptide
DESEIRTVNPVCTECWGSVSCINEPQDREGENG

SEQ ID NO: 127085 - protein, 33 aa, Artificial Sequence
  Description of Artificial Sequence: Synthetic polypeptide
CEEEIRTTNPVATEQYGCVCSWEHQNFNSDNQS

SEQ ID NO: 127086 - protein, 36 aa, Artificial Sequence
  Description of Artificial Sequence: Synthetic polypeptide
DEEEIRTTNPVATEQYGSVSSYHPAGPNMRNGMNPV

SEQ ID NO: 127087 - protein, 30 aa, Artificial Sequence
  Description of Artificial Sequence: Synthetic polypeptide
AETEIACTNPVATEQWGEASNAEDWQRGPR

SEQ ID NO: 127088 - protein, 34 aa, Artificial Sequence
  Description of Artificial Sequence: Synthetic polypeptide
DESEIRTVNPVATECWGYSVSCINEPQDREGENG

SEQ ID NO: 127089 - protein, 33 aa, Artificial Sequence
  Description of Artificial Sequence: Synthetic polypeptide
DESSIRTTNPLATEQFGSVSFPDLTQEGQNHKG

SEQ ID NO: 127090 - protein, 37 aa, Artificial Sequence
  Description of Artificial Sequence: Synthetic polypeptide
DEEEIRTTNPVATEQYGSVSTVVTTNNNNQQGEQEQD

SEQ ID NO: 127091 - protein, 36 aa, Artificial Sequence
  Description of Artificial Sequence: Synthetic polypeptide
DEEEIRTTNPVATEQYGSVSSYGPAVPNMRNGMNPV

SEQ ID NO: 127092 - protein, 37 aa, Artificial Sequence
  Description of Artificial Sequence: Synthetic polypeptide
DEEEIRTTNPVATEQYGSVSTVVTTNNNQETGEEEST

SEQ ID NO: 127093 - protein, 34 aa, Artificial Sequence
  Description of Artificial Sequence: Synthetic polypeptide
DESSEIRTTNPVAYECWGSVSCGNPSQDREGGNG

SEQ ID NO: 127094 - protein, 33 aa, Artificial Sequence
  Description of Artificial Sequence: Synthetic polypeptide
DESPIRTTNPVATECWGSVRCINEPQDREGENG

SEQ ID NO: 127095 - protein, 33 aa, Artificial Sequence
  Description of Artificial Sequence: Synthetic polypeptide
DESPIRTTNPVATECWGSVSCIREPQDREGENG

SEQ ID NO: 127096 - protein, 34 aa, Artificial Sequence
  Description of Artificial Sequence: Synthetic polypeptide
DESQELRTTNPVATECWGSVSCINEPQDREGENG

SEQ ID NO: 127097 - protein, 37 aa, Artificial Sequence
  Description of Artificial Sequence: Synthetic polypeptide
DEEEIRTTNPVATEQYGSVSTVVTTNNNQQGTQEETD

SEQ ID NO: 127098 - protein, 33 aa, Artificial Sequence
  Description of Artificial Sequence: Synthetic polypeptide
DESQIRTTNPGATECWGSVSCINEPQDRDGENG

SEQ ID NO: 127099 - protein, 29 aa, Artificial Sequence
  Description of Artificial Sequence: Synthetic peptide
DENEVASTNPVATECYGDVSECIQSHEQR

SEQ ID NO: 127100 - protein, 33 aa, Artificial Sequence
  Description of Artificial Sequence: Synthetic polypeptide
DEDEIRTTNPVATDAWGSVSAINEGQDGEGNNG

SEQ ID NO: 127101 - protein, 31 aa, Artificial Sequence
  Description of Artificial Sequence: Synthetic polypeptide
DENEVASTNPVATECYGDVSANCIQSRVEQR

SEQ ID NO: 127102 - protein, 30 aa, Artificial Sequence
  Description of Artificial Sequence: Synthetic polypeptide
DENEVASTNPVATECYGDVSAECIQSREQR

SEQ ID NO: 127103 - protein, 35 aa, Artificial Sequence
  Description of Artificial Sequence: Synthetic polypeptide
DEAEIRTTNPVATEQYGSVNSNENMDERGETEVHT

SEQ ID NO: 127104 - protein, 32 aa, Artificial Sequence
  Description of Artificial Sequence: Synthetic polypeptide
DESEISTTNPVATCHYGCVCSTELQERFTSDQ

SEQ ID NO: 127105 - protein, 33 aa, Artificial Sequence
  Description of Artificial Sequence: Synthetic polypeptide
DESQIRTTNPVATECWGSVSCINEPTDREGENG

SEQ ID NO: 127106 - protein, 33 aa, Artificial Sequence
  Description of Artificial Sequence: Synthetic polypeptide
DESEISSTNPVATECWGSVSCINEPQDREGENG

SEQ ID NO: 127107 - protein, 33 aa, Artificial Sequence
  Description of Artificial Sequence: Synthetic polypeptide
DESRIHTTNPVATECWGSVSCINEPQDREGENG

SEQ ID NO: 127108 - protein, 33 aa, Artificial Sequence
  Description of Artificial Sequence: Synthetic polypeptide
DESRILTTNPVATECWGSVSCINEPQDREGENG

SEQ ID NO: 127109 - protein, 36 aa, Artificial Sequence
  Description of Artificial Sequence: Synthetic polypeptide
DEDEIRTTNPVATECWGSVCSTMNNDHHERNGSQNR

SEQ ID NO: 127110 - protein, 33 aa, Artificial Sequence
  Description of Artificial Sequence: Synthetic polypeptide
DENENCTTNPVAYEHWGSVSTGQLGDIQGGNNR

SEQ ID NO: 127111 - protein, 34 aa, Artificial Sequence
  Description of Artificial Sequence: Synthetic polypeptide
DESSEIRTTNPVATECWGSVSCINEPSTREGENG

SEQ ID NO: 127112 - protein, 35 aa, Artificial Sequence
  Description of Artificial Sequence: Synthetic polypeptide
CEEEIRTTNPVATEQYGAVSVGDLGQQRFNINEQG

SEQ ID NO: 127113 - protein, 34 aa, Artificial Sequence
  Description of Artificial Sequence: Synthetic polypeptide
DESEIRYTNPVATECWGSHVSCINEPQDREGENG

SEQ ID NO: 127114 - protein, 37 aa, Artificial Sequence
  Description of Artificial Sequence: Synthetic polypeptide
DEEEIRTTNPVATEQYGSVSSTTQAGPNMRNGMNPVL

SEQ ID NO: 127115 - protein, 34 aa, Artificial Sequence
  Description of Artificial Sequence: Synthetic polypeptide
DESSIRTTNPVATECWGSVSCCINEPQDREGENG

SEQ ID NO: 127116 - protein, 33 aa, Artificial Sequence
  Description of Artificial Sequence: Synthetic polypeptide
CEEEIRTTNPVATEFYGVVNDTVGQNTGNGNGN

SEQ ID NO: 127117 - protein, 34 aa, Artificial Sequence
  Description of Artificial Sequence: Synthetic polypeptide
DESTIRTTNPVATEQYGDIVSIMNNDQGGGENDG

SEQ ID NO: 127118 - protein, 34 aa, Artificial Sequence
  Description of Artificial Sequence: Synthetic polypeptide
DESEIRTTNTVATECWGSVSCINEPQDREGENPG

SEQ ID NO: 127119 - protein, 33 aa, Artificial Sequence
  Description of Artificial Sequence: Synthetic polypeptide
DESEIRTTNSVATECWGSVSCIPEPQDREGENG

SEQ ID NO: 127120 - protein, 34 aa, Artificial Sequence
  Description of Artificial Sequence: Synthetic polypeptide
DEDEIRTTNPCAYEQWGSVSTNLNQGDTGQDDEN

SEQ ID NO: 127121 - protein, 34 aa, Artificial Sequence
  Description of Artificial Sequence: Synthetic polypeptide
DESTIRTTNPVATEQYGQYSVNVIGNGQGGGDND

SEQ ID NO: 127122 - protein, 33 aa, Artificial Sequence
  Description of Artificial Sequence: Synthetic polypeptide
DENEIVTTNPVSTEQYGTVCSATEDPQQFEGNH

SEQ ID NO: 127123 - protein, 33 aa, Artificial Sequence
  Description of Artificial Sequence: Synthetic polypeptide
DENEIVTTNPVSTEQYGTVCSATEDIQQFNGNH

SEQ ID NO: 127124 - protein, 33 aa, Artificial Sequence
  Description of Artificial Sequence: Synthetic polypeptide
DENEIVTTNPVSTEQYGTVCSATEDIQQFEGNH

SEQ ID NO: 127125 - protein, 33 aa, Artificial Sequence
  Description of Artificial Sequence: Synthetic polypeptide
DESTIRTTNPVATTCWGSVSCINEPQDREGENG

SEQ ID NO: 127126 - protein, 33 aa, Artificial Sequence
  Description of Artificial Sequence: Synthetic polypeptide
DESTIRTTNPVAVECWGSVSCINEPQDREGENG

SEQ ID NO: 127127 - protein, 33 aa, Artificial Sequence
  Description of Artificial Sequence: Synthetic polypeptide
DESTIRTTNPYATECWGSVSCINEPQDREGENG

SEQ ID NO: 127128 - protein, 34 aa, Artificial Sequence
  Description of Artificial Sequence: Synthetic polypeptide
DEDEIRTTNPVATEGWGSVSAINEGQGGEGENGD

SEQ ID NO: 127129 - protein, 31 aa, Artificial Sequence
  Description of Artificial Sequence: Synthetic polypeptide
DENEIVTTNPVSTEQYGTISMDDIQQFNGND

SEQ ID NO: 127130 - protein, 31 aa, Artificial Sequence
  Description of Artificial Sequence: Synthetic polypeptide
DENEIVTTNPVSTEQYGTISMDDIQQFEGND

SEQ ID NO: 127131 - protein, 32 aa, Artificial Sequence
  Description of Artificial Sequence: Synthetic polypeptide
DESVEIATTNPCAYEQWGTVSTTNAGDSRGNV

SEQ ID NO: 127132 - protein, 31 aa, Artificial Sequence
  Description of Artificial Sequence: Synthetic polypeptide
DENEIVTTNPVSTEPYGTISTEDPQQQEGNH

SEQ ID NO: 127133 - protein, 33 aa, Artificial Sequence
  Description of Artificial Sequence: Synthetic polypeptide
DESEIRTTNSVATECWGSVSCINEPHDREGENG

SEQ ID NO: 127134 - protein, 30 aa, Artificial Sequence
  Description of Artificial Sequence: Synthetic polypeptide
AESEVASTNPVSTEGYGNVSNNIQSRVGQR

SEQ ID NO: 127135 - protein, 36 aa, Artificial Sequence
  Description of Artificial Sequence: Synthetic polypeptide
DEEEIRTTNPVATEQYGSVSSVIPAGPNMRVGVNPV

SEQ ID NO: 127136 - protein, 32 aa, Artificial Sequence
  Description of Artificial Sequence: Synthetic polypeptide
DENEIVTTNPVSTEQYGTVSMDDIQEQQNGND

SEQ ID NO: 127137 - protein, 38 aa, Artificial Sequence
  Description of Artificial Sequence: Synthetic polypeptide
DEEEIRTTNPVATEQYGSVSTVVTNQQGNQQGTNEEQE

SEQ ID NO: 127138 - protein, 32 aa, Artificial Sequence
  Description of Artificial Sequence: Synthetic polypeptide
DENEIVTTNPVSTEQYGTVSMDDIQQQQEGNH

SEQ ID NO: 127139 - protein, 32 aa, Artificial Sequence
  Description of Artificial Sequence: Synthetic polypeptide
DENEIVTTNPVSTEQYGTVSMDDIQQQQNGNH

SEQ ID NO: 127140 - protein, 33 aa, Artificial Sequence
  Description of Artificial Sequence: Synthetic polypeptide
DESSIRTTNPVATECWGSVSCINEPFDREGENG

SEQ ID NO: 127141 - protein, 36 aa, Artificial Sequence
  Description of Artificial Sequence: Synthetic polypeptide
DEPEIRTTNPVATEQYGSVSTWVYDLEPPGNAGQEM

SEQ ID NO: 127142 - protein, 33 aa, Artificial Sequence
  Description of Artificial Sequence: Synthetic polypeptide
DESEIRTVNPVATECWGSVSCINEPQDGEGENG

SEQ ID NO: 127143 - protein, 33 aa, Artificial Sequence
  Description of Artificial Sequence: Synthetic polypeptide
DEPEIRTTNPVATEQYGSVSVIPPKLPIVDVEL

SEQ ID NO: 127144 - protein, 33 aa, Artificial Sequence
  Description of Artificial Sequence: Synthetic polypeptide
DESEIRTVNPVATECWGSVACINEPQDREGENG

SEQ ID NO: 127145 - protein, 33 aa, Artificial Sequence
  Description of Artificial Sequence: Synthetic polypeptide
DEPEIRTTNPVATEQYGSVSVIPPQLPTVYVEN

SEQ ID NO: 127146 - protein, 38 aa, Artificial Sequence
  Description of Artificial Sequence: Synthetic polypeptide
DEEEIRTTNPVATEQYGSVSTVVTNQQGNNQQGTTNET

SEQ ID NO: 127147 - protein, 35 aa, Artificial Sequence
  Description of Artificial Sequence: Synthetic polypeptide
CEEEIRTTNPVATEFYGSVTSDTGDGQTGGENNGQ

SEQ ID NO: 127148 - protein, 33 aa, Artificial Sequence
  Description of Artificial Sequence: Synthetic polypeptide
DESSIRTTNPVSTECWGSVSCINEPQDREGENG

SEQ ID NO: 127149 - protein, 33 aa, Artificial Sequence
  Description of Artificial Sequence: Synthetic polypeptide
DESEIRTTQPVATECWGSVSCINEPQDGEGENG

SEQ ID NO: 127150 - protein, 34 aa, Artificial Sequence
  Description of Artificial Sequence: Synthetic polypeptide
DESEIRTTNVVATECWGSVSCINEPQDREGENVG

SEQ ID NO: 127151 - protein, 33 aa, Artificial Sequence
  Description of Artificial Sequence: Synthetic polypeptide
DEAEIRTTNPVATEQYGSVNSESQVFNGPGEET

SEQ ID NO: 127152 - protein, 36 aa, Artificial Sequence
  Description of Artificial Sequence: Synthetic polypeptide
DEEEIRTTNPVATEQYGSVSSVTPAGPNMVNVMNPV

SEQ ID NO: 127153 - protein, 37 aa, Artificial Sequence
  Description of Artificial Sequence: Synthetic polypeptide
DEEEIRTTNPVATEQYGSVSSVTPAGPNMRNGMNPVT

SEQ ID NO: 127154 - protein, 38 aa, Artificial Sequence
  Description of Artificial Sequence: Synthetic polypeptide
DEEEIRTTNPVATEQYGSVSTVVTNQNGNQQNEGNNNE

SEQ ID NO: 127155 - protein, 36 aa, Artificial Sequence
  Description of Artificial Sequence: Synthetic polypeptide
DEEEIRTTNPVATEQYGSVSSVTPAGPNMRNAMNPV

SEQ ID NO: 127156 - protein, 29 aa, Artificial Sequence
  Description of Artificial Sequence: Synthetic peptide
AETEIACTNPIATECYGATAEENLARGGR

SEQ ID NO: 127157 - protein, 34 aa, Artificial Sequence
  Description of Artificial Sequence: Synthetic polypeptide
DEAEIRTTNPVATEQYGSVNQCWTLNEEDGSDQY

SEQ ID NO: 127158 - protein, 32 aa, Artificial Sequence
  Description of Artificial Sequence: Synthetic polypeptide
AETDEIATTNPVAYERWGVVSTTNLQDGNLGQ

SEQ ID NO: 127159 - protein, 32 aa, Artificial Sequence
  Description of Artificial Sequence: Synthetic polypeptide
DENEIVTTNPVSTEQYGTVSMDDIQQQQNGND

SEQ ID NO: 127160 - protein, 31 aa, Artificial Sequence
  Description of Artificial Sequence: Synthetic polypeptide
DENEIVTTNPVATEQWGTVCSATGPEFEEND

SEQ ID NO: 127161 - protein, 33 aa, Artificial Sequence
  Description of Artificial Sequence: Synthetic polypeptide
DEPEITTTNPVATEQYGTVCSATSGPVEFIGND

SEQ ID NO: 127162 - protein, 35 aa, Artificial Sequence
  Description of Artificial Sequence: Synthetic polypeptide
DEPEIVTTNPVATEQYGSVVTTDGQLQEEMGGNGE

SEQ ID NO: 127163 - protein, 32 aa, Artificial Sequence
  Description of Artificial Sequence: Synthetic polypeptide
DETEIACTNPVAYEPYGEVAAATNLQAMGNDS

SEQ ID NO: 127164 - protein, 32 aa, Artificial Sequence
  Description of Artificial Sequence: Synthetic polypeptide
DETEIACTNPVAYEQYGSVATNGQVIDGDDLH

SEQ ID NO: 127165 - protein, 32 aa, Artificial Sequence
  Description of Artificial Sequence: Synthetic polypeptide
DEQEIAATNPVATEQYGSVMATDLEDHEGEDL

SEQ ID NO: 127166 - protein, 32 aa, Artificial Sequence
  Description of Artificial Sequence: Synthetic polypeptide
DETEIACTNPVAYEQYGSVATNGTAEGGNMDG

SEQ ID NO: 127167 - protein, 37 aa, Artificial Sequence
  Description of Artificial Sequence: Synthetic polypeptide
DEEEIRTTNPVATEQYGSVSSTTPAVGPNMRNGMYPV

SEQ ID NO: 127168 - protein, 37 aa, Artificial Sequence
  Description of Artificial Sequence: Synthetic polypeptide
DEEEIRTTNPVATEQYGSVSSTTPAVGPNMRNGMNPV

SEQ ID NO: 127169 - protein, 37 aa, Artificial Sequence
  Description of Artificial Sequence: Synthetic polypeptide
DEEEIRTTNPVATEQYGSVSSTTPAVGPNMRDGMNPV

SEQ ID NO: 127170 - protein, 33 aa, Artificial Sequence
  Description of Artificial Sequence: Synthetic polypeptide
DETEIACTNPVAYEQYGSVATNLQNGAPMEGTN

SEQ ID NO: 127171 - protein, 36 aa, Artificial Sequence
  Description of Artificial Sequence: Synthetic polypeptide
DEEEIRTTNPVATEQYGSVSSTTPATPNMRNQMNPV

SEQ ID NO: 127172 - protein, 30 aa, Artificial Sequence
  Description of Artificial Sequence: Synthetic polypeptide
DETEIASVNPICTEQYGVVSANWQESKGNQ

SEQ ID NO: 127173 - protein, 36 aa, Artificial Sequence
  Description of Artificial Sequence: Synthetic polypeptide
DEEEIRTTNPVATEQYGSVSSTTPATPNMRNGMAPV

SEQ ID NO: 127174 - protein, 32 aa, Artificial Sequence
  Description of Artificial Sequence: Synthetic polypeptide
DEQEIAATNPVATEQYGSVSATDLEDHEMEDL

SEQ ID NO: 127175 - protein, 37 aa, Artificial Sequence
  Description of Artificial Sequence: Synthetic polypeptide
DEEEIRTTNPVATEQYGSVSSTTPATGPNMRNGMNPV

SEQ ID NO: 127176 - protein, 33 aa, Artificial Sequence
  Description of Artificial Sequence: Synthetic polypeptide
DEQEIAATNPVATEQYGSVSATDMLEDHEGEDL

SEQ ID NO: 127177 - protein, 30 aa, Artificial Sequence
  Description of Artificial Sequence: Synthetic polypeptide
DETEIATTNPCSTEQYGIVAANWAESKGTR

SEQ ID NO: 127178 - protein, 37 aa, Artificial Sequence
  Description of Artificial Sequence: Synthetic polypeptide
DEEEIRTTNPVATEQYGSVSTVVSNGNGNGGNNDTDE

SEQ ID NO: 127179 - protein, 31 aa, Artificial Sequence
  Description of Artificial Sequence: Synthetic polypeptide
DETEIATTNPIATEQWGATWSEENWQPKGGR

SEQ ID NO: 127180 - protein, 38 aa, Artificial Sequence
  Description of Artificial Sequence: Synthetic polypeptide
DEEEIRTTNPVATEQYGSVSTVVQNLNGNDEQGNNEEN

SEQ ID NO: 127181 - protein, 37 aa, Artificial Sequence
  Description of Artificial Sequence: Synthetic polypeptide
DEEEIRTTNPVATEQYGSVSSTTPASGPNMRNGMNPV

SEQ ID NO: 127182 - protein, 37 aa, Artificial Sequence
  Description of Artificial Sequence: Synthetic polypeptide
DEEEIRTTNPVATEQYGSVSSTTPAWGPNMRNGMNPM

SEQ ID NO: 127183 - protein, 37 aa, Artificial Sequence
  Description of Artificial Sequence: Synthetic polypeptide
DEEEIRTTNPVATEQYGSVSSTTPARPNMRNGMNPVM

SEQ ID NO: 127184 - protein, 33 aa, Artificial Sequence
  Description of Artificial Sequence: Synthetic polypeptide
DETEIACTNPVATEQYGSVCAANNLQEADGTDN

SEQ ID NO: 127185 - protein, 35 aa, Artificial Sequence
  Description of Artificial Sequence: Synthetic polypeptide
DEDEIRTTNPCATECYGSVSTGNQLAGNAGENGSE

SEQ ID NO: 127186 - protein, 33 aa, Artificial Sequence
  Description of Artificial Sequence: Synthetic polypeptide
DETEIACTNPVATEQYGSCATNLQDAPDENAAE

SEQ ID NO: 127187 - protein, 33 aa, Artificial Sequence
  Description of Artificial Sequence: Synthetic polypeptide
DETEIACTNPVATEQYGSCATNLQDHQWGEAAE

SEQ ID NO: 127188 - protein, 36 aa, Artificial Sequence
  Description of Artificial Sequence: Synthetic polypeptide
DEEEIRTTNPVATEQYGSVSSTTPDGPNMPNGMPPV

SEQ ID NO: 127189 - protein, 34 aa, Artificial Sequence
  Description of Artificial Sequence: Synthetic polypeptide
DETEIACTNPVATEQYGSCSTGNLPQDHQDDNAW

SEQ ID NO: 127190 - protein, 32 aa, Artificial Sequence
  Description of Artificial Sequence: Synthetic polypeptide
DESEIRTTNPVSTECWGSISCENIPQQQEGNH

SEQ ID NO: 127191 - protein, 32 aa, Artificial Sequence
  Description of Artificial Sequence: Synthetic polypeptide
DETEIACTNPVATEQYGSVAAANNLDEANNNE

SEQ ID NO: 127192 - protein, 34 aa, Artificial Sequence
  Description of Artificial Sequence: Synthetic polypeptide
DETEIACTNPVATEQYGSVAANNLQEAEGGNADD

SEQ ID NO: 127193 - protein, 32 aa, Artificial Sequence
  Description of Artificial Sequence: Synthetic polypeptide
DETEIACTNPVATEQYGSVATNDAAPINDVPM

SEQ ID NO: 127194 - protein, 34 aa, Artificial Sequence
  Description of Artificial Sequence: Synthetic polypeptide
DEQEAEIRTTNPVAYEQWGSVSWGNDIDMGGGNH

SEQ ID NO: 127195 - protein, 36 aa, Artificial Sequence
  Description of Artificial Sequence: Synthetic polypeptide
DEEEIRTTNPVATEQYGSVSSTTPDGPEMREGMEDV

SEQ ID NO: 127196 - protein, 33 aa, Artificial Sequence
  Description of Artificial Sequence: Synthetic polypeptide
DENEISTTNPVATEQYGCVCSTGEHQNFGSQQS

SEQ ID NO: 127197 - protein, 33 aa, Artificial Sequence
  Description of Artificial Sequence: Synthetic polypeptide
AESEIATTNPVATECWGSVSCINEPQDREGENG

SEQ ID NO: 127198 - protein, 37 aa, Artificial Sequence
  Description of Artificial Sequence: Synthetic polypeptide
DEEEIRTTNPVATEQYGSVSSTTPCGPNMRNGMNPVE

SEQ ID NO: 127199 - protein, 32 aa, Artificial Sequence
  Description of Artificial Sequence: Synthetic polypeptide
DESEIRTTNPVSTECWGSISCENIPQDQEGNG

SEQ ID NO: 127200 - protein, 31 aa, Artificial Sequence
  Description of Artificial Sequence: Synthetic polypeptide
DESEIRTTNPVSTECWGNVSCITIQSREGQG

SEQ ID NO: 127201 - protein, 37 aa, Artificial Sequence
  Description of Artificial Sequence: Synthetic polypeptide
DEEEIRTTNPVATEQYGSVSSTTPAYGPNMRNSMNPV

SEQ ID NO: 127202 - protein, 37 aa, Artificial Sequence
  Description of Artificial Sequence: Synthetic polypeptide
DEEEIRTTNPVATEQYGSVSSTTPAYGPNMRNGMNPV

SEQ ID NO: 127203 - protein, 37 aa, Artificial Sequence
  Description of Artificial Sequence: Synthetic polypeptide
DEEEIRTTNPVATEQYGSVSSTTPAYGPNMRNGMNPL

SEQ ID NO: 127204 - protein, 32 aa, Artificial Sequence
  Description of Artificial Sequence: Synthetic polypeptide
DETEIACTNPVATEQYGSVATNLTDAPAEATG

SEQ ID NO: 127205 - protein, 37 aa, Artificial Sequence
  Description of Artificial Sequence: Synthetic polypeptide
DEEEIRTTNPVATEQYGSVSSTTPAWGPNMRNGMNPV

SEQ ID NO: 127206 - protein, 34 aa, Artificial Sequence
  Description of Artificial Sequence: Synthetic polypeptide
DESEIRTTNPVSTECWGSVKSCINEPQDREGENG

SEQ ID NO: 127207 - protein, 31 aa, Artificial Sequence
  Description of Artificial Sequence: Synthetic polypeptide
DETEIATTNPIATEQWGETWSEENWQPKGGR

SEQ ID NO: 127208 - protein, 32 aa, Artificial Sequence
  Description of Artificial Sequence: Synthetic polypeptide
DETEIATTNPVATAQWGSVAAGNLFPNNMGRN

SEQ ID NO: 127209 - protein, 38 aa, Artificial Sequence
  Description of Artificial Sequence: Synthetic polypeptide
DEEEIRTTNPVATEQYGSVSTVVNQQNQQQGTNNDEQS

SEQ ID NO: 127210 - protein, 34 aa, Artificial Sequence
  Description of Artificial Sequence: Synthetic polypeptide
DEDEIRTTNPCATECYGSVSTGNEAGNAGENDAG

SEQ ID NO: 127211 - protein, 29 aa, Artificial Sequence
  Description of Artificial Sequence: Synthetic peptide
DENEIRTVNPVATEQWGDVSEIEMNAEDA

SEQ ID NO: 127212 - protein, 30 aa, Artificial Sequence
  Description of Artificial Sequence: Synthetic polypeptide
DENEIRTVNPVATEQWGDVSEIEMNAAGDQ

SEQ ID NO: 127213 - protein, 38 aa, Artificial Sequence
  Description of Artificial Sequence: Synthetic polypeptide
DEEEIRTTNPVATEQYGSVSTVVNQQLQQGTTTEEEDE

SEQ ID NO: 127214 - protein, 33 aa, Artificial Sequence
  Description of Artificial Sequence: Synthetic polypeptide
DEQEIACTNPVATEQYGSVGSATDLEDHEGEDL

SEQ ID NO: 127215 - protein, 32 aa, Artificial Sequence
  Description of Artificial Sequence: Synthetic polypeptide
DENEIRTTNPVTTEPYGTISMENIQQQQNGNH

SEQ ID NO: 127216 - protein, 34 aa, Artificial Sequence
  Description of Artificial Sequence: Synthetic polypeptide
DETEIATTNPVATEQWGSVAETNTPSQEHNNQRE

SEQ ID NO: 127217 - protein, 38 aa, Artificial Sequence
  Description of Artificial Sequence: Synthetic polypeptide
DEEEIRTTNPVATEQYGSVSTVVNQQLQQGTTEEEEQN

SEQ ID NO: 127218 - protein, 33 aa, Artificial Sequence
  Description of Artificial Sequence: Synthetic polypeptide
DETEIATTNPVATEQWGSVAIAGLEQSPGNSEE

SEQ ID NO: 127219 - protein, 33 aa, Artificial Sequence
  Description of Artificial Sequence: Synthetic polypeptide
DETEIATTNPVATEQWGSVAPNEPGGEHNNQRE

SEQ ID NO: 127220 - protein, 37 aa, Artificial Sequence
  Description of Artificial Sequence: Synthetic polypeptide
DEEEIRTTNPVATEQYGSVSTVVNQQGVTNVTEETQT

SEQ ID NO: 127221 - protein, 37 aa, Artificial Sequence
  Description of Artificial Sequence: Synthetic polypeptide
DEEEIRTTNPVATEQYGSVSTVVNQQAGTTTEEEEED

SEQ ID NO: 127222 - protein, 34 aa, Artificial Sequence
  Description of Artificial Sequence: Synthetic polypeptide
DETEIATTNPVATEQWGSVSAANNLTEAGHNIEE

SEQ ID NO: 127223 - protein, 34 aa, Artificial Sequence
  Description of Artificial Sequence: Synthetic polypeptide
DETEIATTNPVATEQWGSVSANDPTAPDNQEGNH

SEQ ID NO: 127224 - protein, 28 aa, Artificial Sequence
  Description of Artificial Sequence: Synthetic peptide
AESEIASTNPVGTEGYGVMASTLQHGDI

SEQ ID NO: 127225 - protein, 33 aa, Artificial Sequence
  Description of Artificial Sequence: Synthetic polypeptide
DETEIATTNPVATEQWGSVSATGDPDNHQGEDA

SEQ ID NO: 127226 - protein, 38 aa, Artificial Sequence
  Description of Artificial Sequence: Synthetic polypeptide
DEEEIRTTNPVATEQYGSVSTVVNNVNNLQQNENEEEE

SEQ ID NO: 127227 - protein, 37 aa, Artificial Sequence
  Description of Artificial Sequence: Synthetic polypeptide
DEEEIRTTNPVATEQYGSVSSTTPAMTPNMRNGMNPV

SEQ ID NO: 127228 - protein, 33 aa, Artificial Sequence
  Description of Artificial Sequence: Synthetic polypeptide
DEAEIRTTNPVATEQYGSVHVSQLNTAEDEETN

SEQ ID NO: 127229 - protein, 31 aa, Artificial Sequence
  Description of Artificial Sequence: Synthetic polypeptide
DETEIATTNPIATEQWGITWSNANWQPKGTR

SEQ ID NO: 127230 - protein, 30 aa, Artificial Sequence
  Description of Artificial Sequence: Synthetic polypeptide
DENEIRTVNPVATEQWGVVSEIEMNAAGDQ

SEQ ID NO: 127231 - protein, 33 aa, Artificial Sequence
  Description of Artificial Sequence: Synthetic polypeptide
CEEEIRTTNPVATEQYGCVCSWPEHQNFNSEQA

SEQ ID NO: 127232 - protein, 32 aa, Artificial Sequence
  Description of Artificial Sequence: Synthetic polypeptide
DETEIATTNPVATAQWGSVAAGNLFTNNMGPR

SEQ ID NO: 127233 - protein, 37 aa, Artificial Sequence
  Description of Artificial Sequence: Synthetic polypeptide
DEEEIRTTNPVATEQYGSVSSTTPARGPHMRNGMNPV

SEQ ID NO: 127234 - protein, 32 aa, Artificial Sequence
  Description of Artificial Sequence: Synthetic polypeptide
DEQEIACTNPVALEQYGSVSATDLEDHEGEDL

SEQ ID NO: 127235 - protein, 32 aa, Artificial Sequence
  Description of Artificial Sequence: Synthetic polypeptide
DETEIATTNPVATECWGSVSATDLEDHKGEDL

SEQ ID NO: 127236 - protein, 35 aa, Artificial Sequence
  Description of Artificial Sequence: Synthetic polypeptide
DETEIATTNPVATECYGSVCSTSNGDQDRPPNMDA

SEQ ID NO: 127237 - protein, 38 aa, Artificial Sequence
  Description of Artificial Sequence: Synthetic polypeptide
DEEEIRTTNPVATEQYGSVSSTTPAQGPNMRNGMNPVD

SEQ ID NO: 127238 - protein, 32 aa, Artificial Sequence
  Description of Artificial Sequence: Synthetic polypeptide
DESEIRTTNPVSSECWGSVSCINEPQDREGTG

SEQ ID NO: 127239 - protein, 34 aa, Artificial Sequence
  Description of Artificial Sequence: Synthetic polypeptide
DESEIRTTNPVQTECWGSVSCWNEPQDREGENGF

SEQ ID NO: 127240 - protein, 38 aa, Artificial Sequence
  Description of Artificial Sequence: Synthetic polypeptide
DEEEIRTTNPVATEQYGSVSTVVNTQQGNNQQNETEEE

SEQ ID NO: 127241 - protein, 36 aa, Artificial Sequence
  Description of Artificial Sequence: Synthetic polypeptide
DEEEIRTTNPVATEQYGSVSVPVYGTDVTYFGNNGK

SEQ ID NO: 127242 - protein, 31 aa, Artificial Sequence
  Description of Artificial Sequence: Synthetic polypeptide
DENEIRTVNPVSTEPYGTISMENIQQQNGNH

SEQ ID NO: 127243 - protein, 37 aa, Artificial Sequence
  Description of Artificial Sequence: Synthetic polypeptide
DEEEIRTTNPVATEQYGSVSTVVNTNVDEGTTNNATE

SEQ ID NO: 127244 - protein, 29 aa, Artificial Sequence
  Description of Artificial Sequence: Synthetic peptide
AESEIASTNPVGTEGYGVSASTLQHGDIA

SEQ ID NO: 127245 - protein, 34 aa, Artificial Sequence
  Description of Artificial Sequence: Synthetic polypeptide
DESEIRTTNPVQTECWGSVSCINEPQDREGENWG

SEQ ID NO: 127246 - protein, 34 aa, Artificial Sequence
  Description of Artificial Sequence: Synthetic polypeptide
DEDEIRTTNPCATECYGSVSTGNLGPNAGEDGQE

SEQ ID NO: 127247 - protein, 33 aa, Artificial Sequence
  Description of Artificial Sequence: Synthetic polypeptide
DEAEIRTTNPVATEQYGSVIDVTEEVDEFEERI

SEQ ID NO: 127248 - protein, 37 aa, Artificial Sequence
  Description of Artificial Sequence: Synthetic polypeptide
DEEEIRTTNPVATEQYGSVSSTTPAPGPNMRNGMNPV

SEQ ID NO: 127249 - protein, 38 aa, Artificial Sequence
  Description of Artificial Sequence: Synthetic polypeptide
DEEEIRTTNPVATEQYGSVSTVVNTNQAGNLGGTEEEA

SEQ ID NO: 127250 - protein, 34 aa, Artificial Sequence
  Description of Artificial Sequence: Synthetic polypeptide
DESEIRTTNPVNTECWGSVSCINEPQDREGENGY

SEQ ID NO: 127251 - protein, 32 aa, Artificial Sequence
  Description of Artificial Sequence: Synthetic polypeptide
DETEIATTNPVATEQWGAVAATNDQDAENGTM

SEQ ID NO: 127252 - protein, 34 aa, Artificial Sequence
  Description of Artificial Sequence: Synthetic polypeptide
DESPIRTTNPVATECWGSVCSCINEPQDREGENG

SEQ ID NO: 127253 - protein, 36 aa, Artificial Sequence
  Description of Artificial Sequence: Synthetic polypeptide
DEEEIRTTNPVATEQYGSVSSTTPDGPNMRNGMEPV

SEQ ID NO: 127254 - protein, 33 aa, Artificial Sequence
  Description of Artificial Sequence: Synthetic polypeptide
DESEIRTTNPVSTECWGSVSCINEPQDREEENG

SEQ ID NO: 127255 - protein, 31 aa, Artificial Sequence
  Description of Artificial Sequence: Synthetic polypeptide
DENEIVTTNPVATECYGDVCSEDGPVQHENL

SEQ ID NO: 127256 - protein, 39 aa, Artificial Sequence
  Description of Artificial Sequence: Synthetic polypeptide
DEEEIRTTNPVATEQYGSVSTVVTNLQGNQQLGNTEEGE

SEQ ID NO: 127257 - protein, 36 aa, Artificial Sequence
  Description of Artificial Sequence: Synthetic polypeptide
DEEEIRTTNPVATEQYGSVSSTTPVGPNMHNEMNPV

SEQ ID NO: 127258 - protein, 33 aa, Artificial Sequence
  Description of Artificial Sequence: Synthetic polypeptide
DENEIVCTNPVATEQYGTVCSATDNPVQFEGGD

SEQ ID NO: 127259 - protein, 35 aa, Artificial Sequence
  Description of Artificial Sequence: Synthetic polypeptide
CEEEIRTTNPVATEQYGCVCSWGELQENFGSENQA

SEQ ID NO: 127260 - protein, 36 aa, Artificial Sequence
  Description of Artificial Sequence: Synthetic polypeptide
DEEEIRTTNPVATEQYGSVSSTTPTGPNMRNGMDPV

SEQ ID NO: 127261 - protein, 33 aa, Artificial Sequence
  Description of Artificial Sequence: Synthetic polypeptide
AESEIRTTNPVATECWGEVSCINEPQDREGENG

SEQ ID NO: 127262 - protein, 34 aa, Artificial Sequence
  Description of Artificial Sequence: Synthetic polypeptide
DETAEIATTNPVAYEQYGSVCAETGPQDNGSNPR

SEQ ID NO: 127263 - protein, 33 aa, Artificial Sequence
  Description of Artificial Sequence: Synthetic polypeptide
DETAEISTTNPVAYEQWGTVSTTNHGEGGNNNR

SEQ ID NO: 127264 - protein, 37 aa, Artificial Sequence
  Description of Artificial Sequence: Synthetic polypeptide
DEEEIRTTNPVATEQYGSVSSTTPTGGPNMRNGMNPV

SEQ ID NO: 127265 - protein, 37 aa, Artificial Sequence
  Description of Artificial Sequence: Synthetic polypeptide
DEEEIRTTNPVATEQYGSVSSTTPSTGPNMRNGMNPV

SEQ ID NO: 127266 - protein, 39 aa, Artificial Sequence
  Description of Artificial Sequence: Synthetic polypeptide
DEEEIRTTNPVATEQYGSVSTVVTNLQGNNQIGNGTEGD

SEQ ID NO: 127267 - protein, 35 aa, Artificial Sequence
  Description of Artificial Sequence: Synthetic polypeptide
DEDEIRTTNPCATEQYGEVSTGNAQNQGNAGENSE

SEQ ID NO: 127268 - protein, 31 aa, Artificial Sequence
  Description of Artificial Sequence: Synthetic polypeptide
DESEIRTTNPVSTEPYGTISMDIQQQQNGNH

SEQ ID NO: 127269 - protein, 33 aa, Artificial Sequence
  Description of Artificial Sequence: Synthetic polypeptide
DETAIRTTNPLATECFGSVSFNLEQPEGQNDKF

SEQ ID NO: 127270 - protein, 36 aa, Artificial Sequence
  Description of Artificial Sequence: Synthetic polypeptide
DEEEIRTTNPVATEQYGSVSSTTPSGPNMENGMEPV

SEQ ID NO: 127271 - protein, 32 aa, Artificial Sequence
  Description of Artificial Sequence: Synthetic polypeptide
DETAIRTTNPLATEQFGCVCSNWELQSFGSNQ

SEQ ID NO: 127272 - protein, 32 aa, Artificial Sequence
  Description of Artificial Sequence: Synthetic polypeptide
DETAIRTTNPLATEQFGCVCSSNLQSFGSDQS

SEQ ID NO: 127273 - protein, 33 aa, Artificial Sequence
  Description of Artificial Sequence: Synthetic polypeptide
DESEIRTTNPVSTEPYGTISCENEPQQRNGENH

SEQ ID NO: 127274 - protein, 33 aa, Artificial Sequence
  Description of Artificial Sequence: Synthetic polypeptide
DETAEIATTNPVAYEQYGSVAIVNEDRNNPGRE

SEQ ID NO: 127275 - protein, 32 aa, Artificial Sequence
  Description of Artificial Sequence: Synthetic polypeptide
DESEIRTTNPVSTEPYGTISCEDEPQQRNGNH

SEQ ID NO: 127276 - protein, 33 aa, Artificial Sequence
  Description of Artificial Sequence: Synthetic polypeptide
DEPEIVTTNPVATEQYGVVVSATDGPEEFEGNG

SEQ ID NO: 127277 - protein, 33 aa, Artificial Sequence
  Description of Artificial Sequence: Synthetic polypeptide
DETAEIATTNPVAYEQYGSVAIANEDRNNPGRE

SEQ ID NO: 127278 - protein, 36 aa, Artificial Sequence
  Description of Artificial Sequence: Synthetic polypeptide
DEEEIRTTNPVATEQYGSVSSTTPYGPNMRNGMSPV

SEQ ID NO: 127279 - protein, 32 aa, Artificial Sequence
  Description of Artificial Sequence: Synthetic polypeptide
DESEIRTTNPVSTEPYGTISMEDIQQQQNGNR

SEQ ID NO: 127280 - protein, 30 aa, Artificial Sequence
  Description of Artificial Sequence: Synthetic polypeptide
DENEIVTTNPVATEQWGDVSEIEMNAREDA

SEQ ID NO: 127281 - protein, 33 aa, Artificial Sequence
  Description of Artificial Sequence: Synthetic polypeptide
DEPEIVTTNPVATEQYGTVCSATDGPVEFEGND

SEQ ID NO: 127282 - protein, 36 aa, Artificial Sequence
  Description of Artificial Sequence: Synthetic polypeptide
DEEEIRTTNPVATEQYGSVSSTTPWGPNMRNGMTPV

SEQ ID NO: 127283 - protein, 39 aa, Artificial Sequence
  Description of Artificial Sequence: Synthetic polypeptide
DEEEIRTTNPVATEQYGSVSTVVTNLQISTTEQGTNQDN

SEQ ID NO: 127284 - protein, 33 aa, Artificial Sequence
  Description of Artificial Sequence: Synthetic polypeptide
DEPEIVTTNPVATEQYGVVNSATDGPEEGEGND

SEQ ID NO: 127285 - protein, 32 aa, Artificial Sequence
  Description of Artificial Sequence: Synthetic polypeptide
DENEIVTTNPVATEPYGTVSMEDIVQQQEGNH

SEQ ID NO: 127286 - protein, 32 aa, Artificial Sequence
  Description of Artificial Sequence: Synthetic polypeptide
DENEIVTTNPVATEPYGTVSMEDIVQQQEGND

SEQ ID NO: 127287 - protein, 36 aa, Artificial Sequence
  Description of Artificial Sequence: Synthetic polypeptide
DEEEIRTTNPVATEQYGSVSSTTPVGPNMRNIMNPV

SEQ ID NO: 127288 - protein, 32 aa, Artificial Sequence
  Description of Artificial Sequence: Synthetic polypeptide
DENEIVTTNPVATEPYGTVSMEDIQQQQEGNH

SEQ ID NO: 127289 - protein, 33 aa, Artificial Sequence
  Description of Artificial Sequence: Synthetic polypeptide
DENEIVTTNPVATEPYGTVSATEDIVEQQNGND

SEQ ID NO: 127290 - protein, 32 aa, Artificial Sequence
  Description of Artificial Sequence: Synthetic polypeptide
DENEIVTTNPVATEPYGTVCSMEDPVQQEGND

SEQ ID NO: 127291 - protein, 32 aa, Artificial Sequence
  Description of Artificial Sequence: Synthetic polypeptide
DENEIVTTNPVATEPYGTVCSMEDIVQQEGND

SEQ ID NO: 127292 - protein, 32 aa, Artificial Sequence
  Description of Artificial Sequence: Synthetic polypeptide
DENEIVTTNPVATEPYGTISTDGIQQQFNGND

SEQ ID NO: 127293 - protein, 32 aa, Artificial Sequence
  Description of Artificial Sequence: Synthetic polypeptide
DETAEIATTNPVAYEQWGSVANGNPQNAGNSD

SEQ ID NO: 127294 - protein, 34 aa, Artificial Sequence
  Description of Artificial Sequence: Synthetic polypeptide
DETAEIATTNPVAYEQYGSVAANNGDQQPGENTR

SEQ ID NO: 127295 - protein, 34 aa, Artificial Sequence
  Description of Artificial Sequence: Synthetic polypeptide
DETAEIATTNPVAYEQYGSVAHGNGLQDPGEGDR

SEQ ID NO: 127296 - protein, 31 aa, Artificial Sequence
  Description of Artificial Sequence: Synthetic polypeptide
DENEIVTTNPVATECYGTVCSAEDCPQFGED

SEQ ID NO: 127297 - protein, 31 aa, Artificial Sequence
  Description of Artificial Sequence: Synthetic polypeptide
DENEIVTTNPVATECYGTVCSAEDCLQFEED

SEQ ID NO: 127298 - protein, 32 aa, Artificial Sequence
  Description of Artificial Sequence: Synthetic polypeptide
DETEIACTNPVATEQYGETTAEENLQERGPYI

SEQ ID NO: 127299 - protein, 31 aa, Artificial Sequence
  Description of Artificial Sequence: Synthetic polypeptide
DESEIRTTNPVSTEPYGTIAMDIQQQRNGNH

SEQ ID NO: 127300 - protein, 32 aa, Artificial Sequence
  Description of Artificial Sequence: Synthetic polypeptide
DEQAIATTNPVATEIYGSVSATDLEDHEGEDL

SEQ ID NO: 127301 - protein, 33 aa, Artificial Sequence
  Description of Artificial Sequence: Synthetic polypeptide
DETEIACTNPVATEQWGCVAMTNLNRDGMNDLH

SEQ ID NO: 127302 - protein, 36 aa, Artificial Sequence
  Description of Artificial Sequence: Synthetic polypeptide
DEEEIRTTNPVATEQYGSVSSTTPGGPEMGNGENPV

SEQ ID NO: 127303 - protein, 33 aa, Artificial Sequence
  Description of Artificial Sequence: Synthetic polypeptide
DEQDEIATTNPVAYEGWGSVATNLQGDAGNDSS

SEQ ID NO: 127304 - protein, 33 aa, Artificial Sequence
  Description of Artificial Sequence: Synthetic polypeptide
DESEIRTTNPVSTECWGSVSMIDIPQDREGENG

SEQ ID NO: 127305 - protein, 33 aa, Artificial Sequence
  Description of Artificial Sequence: Synthetic polypeptide
DEDEIRTTNPCATECYGSVSTGNTGNAGEHGDA

SEQ ID NO: 127306 - protein, 37 aa, Artificial Sequence
  Description of Artificial Sequence: Synthetic polypeptide
DEEEIRTTNPVATEQYGSVSSTTPEGPNMRNGMNPVP

SEQ ID NO: 127307 - protein, 33 aa, Artificial Sequence
  Description of Artificial Sequence: Synthetic polypeptide
DETEIACTNPVATEQWGSVSMSGNGQPAGEPNM

SEQ ID NO: 127308 - protein, 33 aa, Artificial Sequence
  Description of Artificial Sequence: Synthetic polypeptide
DESEIRTTNPVSTECWGSVSMENEPQQQEGENH

SEQ ID NO: 127309 - protein, 33 aa, Artificial Sequence
  Description of Artificial Sequence: Synthetic polypeptide
DEDEIRTTNPCATECYGSVSTGNTGNAGEDGSN

SEQ ID NO: 127310 - protein, 38 aa, Artificial Sequence
  Description of Artificial Sequence: Synthetic polypeptide
DEEEIRTTNPVATEQYGSVSTVVSNNQQLGNQDEEEET

SEQ ID NO: 127311 - protein, 33 aa, Artificial Sequence
  Description of Artificial Sequence: Synthetic polypeptide
DESEIRTTNPVSTECWGSVSCINIPQDQNGENG

SEQ ID NO: 127312 - protein, 33 aa, Artificial Sequence
  Description of Artificial Sequence: Synthetic polypeptide
DENEISTTNPVATEQYGVVCSTGEHQYFNSDQS

SEQ ID NO: 127313 - protein, 33 aa, Artificial Sequence
  Description of Artificial Sequence: Synthetic polypeptide
DENEISTTNPVATEQYGVVCSTGEHQNFISNQS

SEQ ID NO: 127314 - protein, 36 aa, Artificial Sequence
  Description of Artificial Sequence: Synthetic polypeptide
DEEEIRTTNPVATEQYGSVSVPNNSGLNIIEDQVRD

SEQ ID NO: 127315 - protein, 33 aa, Artificial Sequence
  Description of Artificial Sequence: Synthetic polypeptide
DETEIACTNPVATEQYGCVATNLQATPDGMVPN

SEQ ID NO: 127316 - protein, 36 aa, Artificial Sequence
  Description of Artificial Sequence: Synthetic polypeptide
DEEEIRTTNPVATEQYGSVSSTTPEEPNMRNGMSPV

SEQ ID NO: 127317 - protein, 33 aa, Artificial Sequence
  Description of Artificial Sequence: Synthetic polypeptide
DESEIRTTNPVSTECWGSVSCINIPQDQEGENG

SEQ ID NO: 127318 - protein, 34 aa, Artificial Sequence
  Description of Artificial Sequence: Synthetic polypeptide
DETEIACTNPVATEQYGCVATNQLQEQMGNNSLH

SEQ ID NO: 127319 - protein, 34 aa, Artificial Sequence
  Description of Artificial Sequence: Synthetic polypeptide
DEDEIRTTNPCATECYGSVSTGNQLGNAGEGGAE

SEQ ID NO: 127320 - protein, 34 aa, Artificial Sequence
  Description of Artificial Sequence: Synthetic polypeptide
DEDEIRTTNPCATECYGSVSTGNTGTNAGENGDE

SEQ ID NO: 127321 - protein, 32 aa, Artificial Sequence
  Description of Artificial Sequence: Synthetic polypeptide
DEQAIATTNPRATEQYGSVSATDLEDHEGEDL

SEQ ID NO: 127322 - protein, 30 aa, Artificial Sequence
  Description of Artificial Sequence: Synthetic polypeptide
DETEIACTNPIATEQWGEAWSEENWQPGGR

SEQ ID NO: 127323 - protein, 33 aa, Artificial Sequence
  Description of Artificial Sequence: Synthetic polypeptide
DESEIRTTNPVSTECYGTVSCINIQQQQNGENG

SEQ ID NO: 127324 - protein, 32 aa, Artificial Sequence
  Description of Artificial Sequence: Synthetic polypeptide
DEQAIATTNPVATEQYGSVSANDLEDHEWEDL

SEQ ID NO: 127325 - protein, 31 aa, Artificial Sequence
  Description of Artificial Sequence: Synthetic polypeptide
DESEIRTTNPVSTEPYGTIAAMDIQQRNGNH

SEQ ID NO: 127326 - protein, 39 aa, Artificial Sequence
  Description of Artificial Sequence: Synthetic polypeptide
DEEEIRTTNPVATEQYGSVSTVVTNLNGNQNIGNTNEGT

SEQ ID NO: 127327 - protein, 34 aa, Artificial Sequence
  Description of Artificial Sequence: Synthetic polypeptide
DEDEIRTTNPCATEQWGEVSTGNATQGNAGENSE

SEQ ID NO: 127328 - protein, 33 aa, Artificial Sequence
  Description of Artificial Sequence: Synthetic polypeptide
DEDEIRTTNPCATECYGVVSTGNTGNAGETDNE

SEQ ID NO: 127329 - protein, 36 aa, Artificial Sequence
  Description of Artificial Sequence: Synthetic polypeptide
DEEEIRTTNPVATEQYGSVSSTTPKGPNMRNGMTPV

SEQ ID NO: 127330 - protein, 33 aa, Artificial Sequence
  Description of Artificial Sequence: Synthetic polypeptide
DEQAIRTTNPVATEQYGSFISTLTLTEWGQISP

SEQ ID NO: 127331 - protein, 33 aa, Artificial Sequence
  Description of Artificial Sequence: Synthetic polypeptide
DESEIRTTNPVSTEPWGSVSMINEQQDQEGENG

SEQ ID NO: 127332 - protein, 32 aa, Artificial Sequence
  Description of Artificial Sequence: Synthetic polypeptide
AESEIRCTNPVATECWGSVSCINEPQDREGGG

SEQ ID NO: 127333 - protein, 33 aa, Artificial Sequence
  Description of Artificial Sequence: Synthetic polypeptide
DESEIRTTNPVSTEPWGSVSCINIQQDQEGENG

SEQ ID NO: 127334 - protein, 36 aa, Artificial Sequence
  Description of Artificial Sequence: Synthetic polypeptide
DEEEIRTTNPVATEQYGSVSSTTPIGPNMANEMNPA

SEQ ID NO: 127335 - protein, 33 aa, Artificial Sequence
  Description of Artificial Sequence: Synthetic polypeptide
DESEIRTTNPVSTEPWGSVSCINEPQDQEGENG

SEQ ID NO: 127336 - protein, 32 aa, Artificial Sequence
  Description of Artificial Sequence: Synthetic polypeptide
DETCIRTTNPLATEQWGCVCSWELQESFGSNQ

SEQ ID NO: 127337 - protein, 38 aa, Artificial Sequence
  Description of Artificial Sequence: Synthetic polypeptide
DEEEIRTTNPVATEQYGSVSTVVTNLGGNNEQGNNEEN

SEQ ID NO: 127338 - protein, 32 aa, Artificial Sequence
  Description of Artificial Sequence: Synthetic polypeptide
DESEIRTTNPVSTEPWGSISCINIQQDQNGNG

SEQ ID NO: 127339 - protein, 32 aa, Artificial Sequence
  Description of Artificial Sequence: Synthetic polypeptide
DEQCIATTNPVATEQYGSYSATDLEDHEGEDL

SEQ ID NO: 127340 - protein, 32 aa, Artificial Sequence
  Description of Artificial Sequence: Synthetic polypeptide
DESEIRTTNPVSTEGYGTISSETIQQQQNGNH

SEQ ID NO: 127341 - protein, 32 aa, Artificial Sequence
  Description of Artificial Sequence: Synthetic polypeptide
DESEIRTTNPVSTEGYGTISMETIQQQQNGNH

SEQ ID NO: 127342 - protein, 34 aa, Artificial Sequence
  Description of Artificial Sequence: Synthetic polypeptide
DEDEIRTTNPCATECYGSVSTTGNTGNAGEDRSE

SEQ ID NO: 127343 - protein, 32 aa, Artificial Sequence
  Description of Artificial Sequence: Synthetic polypeptide
DESEIRTTNPVSTECYGTISMENIQQQQNGNH

SEQ ID NO: 127344 - protein, 36 aa, Artificial Sequence
  Description of Artificial Sequence: Synthetic polypeptide
DETEIATTNPVATEQWGSVSATGELPQDQTEGNNRH

SEQ ID NO: 127345 - protein, 30 aa, Artificial Sequence
  Description of Artificial Sequence: Synthetic polypeptide
DENEVASTNPVSTEGYGNVAANTIQSRGQR

SEQ ID NO: 127346 - protein, 31 aa, Artificial Sequence
  Description of Artificial Sequence: Synthetic polypeptide
DENEVASTNPVSTEGYGNVSANTIQSRVGQR

SEQ ID NO: 127347 - protein, 36 aa, Artificial Sequence
  Description of Artificial Sequence: Synthetic polypeptide
DEAEIRTTNPVATEQYGSVSSTDTGLDTGSSNDKEN

SEQ ID NO: 127348 - protein, 30 aa, Artificial Sequence
  Description of Artificial Sequence: Synthetic polypeptide
DESEVACTNPVSTEGYGNVAAETIQRVGNR

SEQ ID NO: 127349 - protein, 30 aa, Artificial Sequence
  Description of Artificial Sequence: Synthetic polypeptide
DESEVAPTNPVSTEQYGNVAANTIQSVGQR

SEQ ID NO: 127350 - protein, 36 aa, Artificial Sequence
  Description of Artificial Sequence: Synthetic polypeptide
DEAEIRTTNPVATEQYGSVSSTTPAGPNMRNGMNPV

SEQ ID NO: 127351 - protein, 35 aa, Artificial Sequence
  Description of Artificial Sequence: Synthetic polypeptide
DEAEIRTTNPVATEQYGSVSDYQLLVTGMGQSENF

SEQ ID NO: 127352 - protein, 34 aa, Artificial Sequence
  Description of Artificial Sequence: Synthetic polypeptide
DEDEIRTTNPVATEAWGSVSTVVNNNNNDEGENN

SEQ ID NO: 127353 - protein, 31 aa, Artificial Sequence
  Description of Artificial Sequence: Synthetic polypeptide
DESEVASTNPVATEGYGNAAANTLQSRVGGR

SEQ ID NO: 127354 - protein, 31 aa, Artificial Sequence
  Description of Artificial Sequence: Synthetic polypeptide
DESEVASTNPVATEGYGNAAANTLQSRVGQR

SEQ ID NO: 127355 - protein, 36 aa, Artificial Sequence
  Description of Artificial Sequence: Synthetic polypeptide
DEAEIRTTNPVATEQYGSVSSTDTGLDTGSENDIEY

SEQ ID NO: 127356 - protein, 35 aa, Artificial Sequence
  Description of Artificial Sequence: Synthetic polypeptide
DEAEIRTTNPVATEQYGSVSDYQLEQTGEGQSEGF

SEQ ID NO: 127357 - protein, 37 aa, Artificial Sequence
  Description of Artificial Sequence: Synthetic polypeptide
DEAEIRTTNPVATEQYGSVSSTTPAQGPNMRNGMNPV

SEQ ID NO: 127358 - protein, 35 aa, Artificial Sequence
  Description of Artificial Sequence: Synthetic polypeptide
CEEEIRTTNPVATEQYGCVCSTENHNQNFNSNNQE

SEQ ID NO: 127359 - protein, 30 aa, Artificial Sequence
  Description of Artificial Sequence: Synthetic polypeptide
DESEVASTNPVATEGYGNAAETLQSRVGGR

SEQ ID NO: 127360 - protein, 35 aa, Artificial Sequence
  Description of Artificial Sequence: Synthetic polypeptide
CEEEIRTTNPVATEQYGCVCSNTELQENFGSDTQN

SEQ ID NO: 127361 - protein, 34 aa, Artificial Sequence
  Description of Artificial Sequence: Synthetic polypeptide
DEDEIRTTNPVATEAWGSVSAENEGQDGEGENGD

SEQ ID NO: 127362 - protein, 36 aa, Artificial Sequence
  Description of Artificial Sequence: Synthetic polypeptide
DEAEIRTTNPVATEQYGSVSDTHSLQTDRIDEIQIW

SEQ ID NO: 127363 - protein, 34 aa, Artificial Sequence
  Description of Artificial Sequence: Synthetic polypeptide
DEAEIRTTNPVATEQYGSVSDTHSCTDRIDQIQI

SEQ ID NO: 127364 - protein, 31 aa, Artificial Sequence
  Description of Artificial Sequence: Synthetic polypeptide
DESEVASTNPVATEGYGNVAANDIQSRVGQR

SEQ ID NO: 127365 - protein, 36 aa, Artificial Sequence
  Description of Artificial Sequence: Synthetic polypeptide
DEAEIRTTNPVATEQYGSVSSTTPAGTNMRNGMNPV

SEQ ID NO: 127366 - protein, 36 aa, Artificial Sequence
  Description of Artificial Sequence: Synthetic polypeptide
DEPEIRTTNPVATEQYGSVQTPTNGDETTQSGQDNF

SEQ ID NO: 127367 - protein, 34 aa, Artificial Sequence
  Description of Artificial Sequence: Synthetic polypeptide
DEAEIRTTNPVATEQYGSVSESPEQDDITSFGQE

SEQ ID NO: 127368 - protein, 34 aa, Artificial Sequence
  Description of Artificial Sequence: Synthetic polypeptide
DEAEIRTTNPVATEQYGSVSESPEQDEIASNGQE

SEQ ID NO: 127369 - protein, 34 aa, Artificial Sequence
  Description of Artificial Sequence: Synthetic polypeptide
DEDEIRTTNPVATEAWGSVSTVVNNNGNQEEENG

SEQ ID NO: 127370 - protein, 34 aa, Artificial Sequence
  Description of Artificial Sequence: Synthetic polypeptide
CEEEIRTTNPVATEQYGCVCSSGELNQNFNSDQS

SEQ ID NO: 127371 - protein, 34 aa, Artificial Sequence
  Description of Artificial Sequence: Synthetic polypeptide
DESESRTTNPVATECWGSHVSCINEPQDREGENG

SEQ ID NO: 127372 - protein, 34 aa, Artificial Sequence
  Description of Artificial Sequence: Synthetic polypeptide
CEEEIRTTNPVATEQYGCVCSSGNHQENFNSDQD

SEQ ID NO: 127373 - protein, 34 aa, Artificial Sequence
  Description of Artificial Sequence: Synthetic polypeptide
DEAEIRTTNPVATEQYGSVSMDPLQGLSILEEMP

SEQ ID NO: 127374 - protein, 34 aa, Artificial Sequence
  Description of Artificial Sequence: Synthetic polypeptide
DESEIVTTNPVATEQWGSVCSCIGPVQDREGENG

SEQ ID NO: 127375 - protein, 34 aa, Artificial Sequence
  Description of Artificial Sequence: Synthetic polypeptide
DEDEIRTTNPVATEAWGSVSTVVNNNGQDEGETG

SEQ ID NO: 127376 - protein, 35 aa, Artificial Sequence
  Description of Artificial Sequence: Synthetic polypeptide
DEPEIRTTNPVATEQYGSVITTANALTNVFNVENW

SEQ ID NO: 127377 - protein, 35 aa, Artificial Sequence
  Description of Artificial Sequence: Synthetic polypeptide
CEEEIRTTNPVATEQYGCVCSTEEHNQAFGSENQS

SEQ ID NO: 127378 - protein, 37 aa, Artificial Sequence
  Description of Artificial Sequence: Synthetic polypeptide
DEAEIRTTNPVATEQYGSVSITHTNLEFTRNGQEDEN

SEQ ID NO: 127379 - protein, 33 aa, Artificial Sequence
  Description of Artificial Sequence: Synthetic polypeptide
DESEIVTTNPVATECYGTVSCINEPQDFEGENG

SEQ ID NO: 127380 - protein, 35 aa, Artificial Sequence
  Description of Artificial Sequence: Synthetic polypeptide
DEAEIRTTNPVATEQYGSVSFWSQDEQMSTQGDRI

SEQ ID NO: 127381 - protein, 35 aa, Artificial Sequence
  Description of Artificial Sequence: Synthetic polypeptide
DEAEIRTTNPVATEQYGSVSFVNSDETDFFGTENP

SEQ ID NO: 127382 - protein, 34 aa, Artificial Sequence
  Description of Artificial Sequence: Synthetic polypeptide
DEDEIRTTNPVATEAWGSVSTVVNNNNDEEGENG

SEQ ID NO: 127383 - protein, 32 aa, Artificial Sequence
  Description of Artificial Sequence: Synthetic polypeptide
DESEIVTTNPVATECYGTVSCINEPEDFEGNG

SEQ ID NO: 127384 - protein, 33 aa, Artificial Sequence
  Description of Artificial Sequence: Synthetic polypeptide
CEEEIRTTNPVATEQYGCVCSTEHNQNFISEQN

SEQ ID NO: 127385 - protein, 36 aa, Artificial Sequence
  Description of Artificial Sequence: Synthetic polypeptide
DEAEIRTTNPVATEQYGSVSFTDSGLDTGSSNDQEY

SEQ ID NO: 127386 - protein, 35 aa, Artificial Sequence
  Description of Artificial Sequence: Synthetic polypeptide
DEAEIRTTNPVATEQYGSVSEYVNLEVFETEENED

SEQ ID NO: 127387 - protein, 32 aa, Artificial Sequence
  Description of Artificial Sequence: Synthetic polypeptide
DESEIVTTNPVATECYGTVSCINEPEDFEGND

SEQ ID NO: 127388 - protein, 34 aa, Artificial Sequence
  Description of Artificial Sequence: Synthetic polypeptide
DEAEIRTTNPVATEQYGSVSDPHSLTDRIDEIQS

SEQ ID NO: 127389 - protein, 31 aa, Artificial Sequence
  Description of Artificial Sequence: Synthetic polypeptide
DESEVASTNPVATEGYGNVAANTIQERVGPR

SEQ ID NO: 127390 - protein, 31 aa, Artificial Sequence
  Description of Artificial Sequence: Synthetic polypeptide
DESEVASTNPVATEGYGNVAANTIQMRVGQR

SEQ ID NO: 127391 - protein, 34 aa, Artificial Sequence
  Description of Artificial Sequence: Synthetic polypeptide
CEEEIRTTNPVATEQYGCVCSTEPQENFNSDTQD

SEQ ID NO: 127392 - protein, 36 aa, Artificial Sequence
  Description of Artificial Sequence: Synthetic polypeptide
DEPEIRTTNPVATEQYGSVSLTPTLDQQTQGLEQDT

SEQ ID NO: 127393 - protein, 32 aa, Artificial Sequence
  Description of Artificial Sequence: Synthetic polypeptide
DESEVASTNPVATEQYGTVCSANDGIQFVGND

SEQ ID NO: 127394 - protein, 33 aa, Artificial Sequence
  Description of Artificial Sequence: Synthetic polypeptide
DEPEIATTNPVATEQYGSVSVNINQAEVEFEQI

SEQ ID NO: 127395 - protein, 34 aa, Artificial Sequence
  Description of Artificial Sequence: Synthetic polypeptide
DEPEIATTNPVATEQYGSVSSNVNQAEVEFEGQI

SEQ ID NO: 127396 - protein, 32 aa, Artificial Sequence
  Description of Artificial Sequence: Synthetic polypeptide
DESEIVTTNPVATECWGTVCSCDNPPQFEGNG

SEQ ID NO: 127397 - protein, 35 aa, Artificial Sequence
  Description of Artificial Sequence: Synthetic polypeptide
DEAEIRTTNPVATEQYGSVQSSTDSLEGGMEILES

SEQ ID NO: 127398 - protein, 33 aa, Artificial Sequence
  Description of Artificial Sequence: Synthetic polypeptide
DEPEIATTNPVATEQYGSVSSNNQAQEVEVEQI

SEQ ID NO: 127399 - protein, 36 aa, Artificial Sequence
  Description of Artificial Sequence: Synthetic polypeptide
DEAEIRTTNPVATEQYGSVPYHTNLEETDNGQEDRN

SEQ ID NO: 127400 - protein, 29 aa, Artificial Sequence
  Description of Artificial Sequence: Synthetic peptide
DESEVASTNPVCTEGYGVVSDNIQSSGQQ

SEQ ID NO: 127401 - protein, 35 aa, Artificial Sequence
  Description of Artificial Sequence: Synthetic polypeptide
DEAEIRTTNPVATEQYGSVPWVTVEMQEGIGNEDE

SEQ ID NO: 127402 - protein, 35 aa, Artificial Sequence
  Description of Artificial Sequence: Synthetic polypeptide
DEAEIRTTNPVATEQYGSVSTFDLNVEREEEQSSI

SEQ ID NO: 127403 - protein, 34 aa, Artificial Sequence
  Description of Artificial Sequence: Synthetic polypeptide
DEAEIRTTNPVATEQYGSVPWVTVEMEGILNEGE

SEQ ID NO: 127404 - protein, 35 aa, Artificial Sequence
  Description of Artificial Sequence: Synthetic polypeptide
DEDEIRTTNPVATEAWGSVSTVVNNQQGTNNEEGE

SEQ ID NO: 127405 - protein, 30 aa, Artificial Sequence
  Description of Artificial Sequence: Synthetic polypeptide
DESEVASTNPVGTEGYGNVAANTIQRVGQR

SEQ ID NO: 127406 - protein, 33 aa, Artificial Sequence
  Description of Artificial Sequence: Synthetic polypeptide
CEEEIRTTNPVATEQYGCVCSTGEHQNNSDTQD

SEQ ID NO: 127407 - protein, 29 aa, Artificial Sequence
  Description of Artificial Sequence: Synthetic peptide
DESEVASTNPVGTEGYGNVASTIQSHGDR

SEQ ID NO: 127408 - protein, 33 aa, Artificial Sequence
  Description of Artificial Sequence: Synthetic polypeptide
DEPEIATTNPVATEQYGSVSSFLNQAEVEFEWI

SEQ ID NO: 127409 - protein, 33 aa, Artificial Sequence
  Description of Artificial Sequence: Synthetic polypeptide
DEPEIATTNPVATEQYGSVSSANNQAEVEQEQI

SEQ ID NO: 127410 - protein, 34 aa, Artificial Sequence
  Description of Artificial Sequence: Synthetic polypeptide
DEPEIATTNPVATEQYGSVSPTYDLEVHEGEDLF

SEQ ID NO: 127411 - protein, 33 aa, Artificial Sequence
  Description of Artificial Sequence: Synthetic polypeptide
DEPEIATTNPVATEQYGTVCSATLGPVEFEGND

SEQ ID NO: 127412 - protein, 34 aa, Artificial Sequence
  Description of Artificial Sequence: Synthetic polypeptide
DESESIRTTNPCATECWGSVSCINEPQDREGENG

SEQ ID NO: 127413 - protein, 33 aa, Artificial Sequence
  Description of Artificial Sequence: Synthetic polypeptide
DEAEIRTTNPVATEQYGSVSTDMTDVTIEQLFI

SEQ ID NO: 127414 - protein, 32 aa, Artificial Sequence
  Description of Artificial Sequence: Synthetic polypeptide
DESEVASTNPVATEQYGTVCSANDGIQFEGND

SEQ ID NO: 127415 - protein, 31 aa, Artificial Sequence
  Description of Artificial Sequence: Synthetic polypeptide
DESEVASTNPVATEGYGNVAANTIQSRVGQR

SEQ ID NO: 127416 - protein, 34 aa, Artificial Sequence
  Description of Artificial Sequence: Synthetic polypeptide
CEEEIRTTNPVATEQYGCVCSNTEHQNFNSDTQD

SEQ ID NO: 127417 - protein, 31 aa, Artificial Sequence
  Description of Artificial Sequence: Synthetic polypeptide
DESEVASTNPVATEGYGNVAANTWQERVGPR

SEQ ID NO: 127418 - protein, 33 aa, Artificial Sequence
  Description of Artificial Sequence: Synthetic polypeptide
DEAEIRTTNPVATEQYGSVRSPLDEVPEGDEDG

SEQ ID NO: 127419 - protein, 32 aa, Artificial Sequence
  Description of Artificial Sequence: Synthetic polypeptide
DESEVASTNPVATEGYGNVSAANTIQSRVGQR

SEQ ID NO: 127420 - protein, 32 aa, Artificial Sequence
  Description of Artificial Sequence: Synthetic polypeptide
DESEIVTTNPVATECYGSVSCDGPPEFEGENG

SEQ ID NO: 127421 - protein, 31 aa, Artificial Sequence
  Description of Artificial Sequence: Synthetic polypeptide
DESEVASTNPVATEGYGNVSAETIQSRVGGR

SEQ ID NO: 127422 - protein, 35 aa, Artificial Sequence
  Description of Artificial Sequence: Synthetic polypeptide
CEEEIRTTNPVATEQYGCVCSNTEHDQNFGSDNQF

SEQ ID NO: 127423 - protein, 32 aa, Artificial Sequence
  Description of Artificial Sequence: Synthetic polypeptide
DESEIVTTNPVATECYGSVSCDGPPEFEGEND

SEQ ID NO: 127424 - protein, 32 aa, Artificial Sequence
  Description of Artificial Sequence: Synthetic polypeptide
DESEIVTTNPVATECWGTVSCINEVQFEGENG

SEQ ID NO: 127425 - protein, 35 aa, Artificial Sequence
  Description of Artificial Sequence: Synthetic polypeptide
CEEEIRTTNPVATEQYGCVCSNTEDLQENFGSQQA

SEQ ID NO: 127426 - protein, 33 aa, Artificial Sequence
  Description of Artificial Sequence: Synthetic polypeptide
DEPEIATTNPVATWQYGMVSTDTLEFRQATSGR

SEQ ID NO: 127427 - protein, 34 aa, Artificial Sequence
  Description of Artificial Sequence: Synthetic polypeptide
DEPEIATTNPVATWQYGMVSTANLEFQQAFSGGN

SEQ ID NO: 127428 - protein, 33 aa, Artificial Sequence
  Description of Artificial Sequence: Synthetic polypeptide
DEPEIATTNPVATWQYGMVSTALEFQQAQWGGN

SEQ ID NO: 127429 - protein, 33 aa, Artificial Sequence
  Description of Artificial Sequence: Synthetic polypeptide
DEPEIATTNPVATWQYGMVSTALEFNQATIGRE

SEQ ID NO: 127430 - protein, 34 aa, Artificial Sequence
  Description of Artificial Sequence: Synthetic polypeptide
CEEEIRTTNPVATEQYGCVCSTGEHDQGFGSDQQ

SEQ ID NO: 127431 - protein, 33 aa, Artificial Sequence
  Description of Artificial Sequence: Synthetic polypeptide
DEPEIATTNPVATWQYGAVSTALEFQQAQTGGL

SEQ ID NO: 127432 - protein, 35 aa, Artificial Sequence
  Description of Artificial Sequence: Synthetic polypeptide
CEEEIRTTNPVATEQYGCVCSNSENHQENFGSNQS

SEQ ID NO: 127433 - protein, 30 aa, Artificial Sequence
  Description of Artificial Sequence: Synthetic polypeptide
AETEIACTNPVATEQYGEAWAENLQEPGGI

SEQ ID NO: 127434 - protein, 36 aa, Artificial Sequence
  Description of Artificial Sequence: Synthetic polypeptide
DEPEIRTTNPVATEQYGSVSLTPTLDELTQGLEVRT

SEQ ID NO: 127435 - protein, 33 aa, Artificial Sequence
  Description of Artificial Sequence: Synthetic polypeptide
DESEQRTTNPVATECWGSVSCINEPQDHEGENG

SEQ ID NO: 127436 - protein, 33 aa, Artificial Sequence
  Description of Artificial Sequence: Synthetic polypeptide
DESENRTTNPVATECWGSVSCINEPQDREGEKG

SEQ ID NO: 127437 - protein, 33 aa, Artificial Sequence
  Description of Artificial Sequence: Synthetic polypeptide
CEEEIRTTNPVATEQYGCVCSSGEDQNFNSNQD

SEQ ID NO: 127438 - protein, 34 aa, Artificial Sequence
  Description of Artificial Sequence: Synthetic polypeptide
DEDEIRTTNPVATEAWGSVSTNNNNNNSDEGEND

SEQ ID NO: 127439 - protein, 33 aa, Artificial Sequence
  Description of Artificial Sequence: Synthetic polypeptide
DEPEIRTTNPVATEQYGSVGMMPALAPNVNEFM

SEQ ID NO: 127440 - protein, 34 aa, Artificial Sequence
  Description of Artificial Sequence: Synthetic polypeptide
DEPEIRTTNPVATEQYGETSTTFPEEQFRQGDFV

SEQ ID NO: 127441 - protein, 33 aa, Artificial Sequence
  Description of Artificial Sequence: Synthetic polypeptide
DEPEIRTTNPVATEQYGETSTTEGEQFRQADSV

SEQ ID NO: 127442 - protein, 33 aa, Artificial Sequence
  Description of Artificial Sequence: Synthetic polypeptide
DESEIVTTNPVATEQYGTVCSYTDGPVEFEGND

SEQ ID NO: 127443 - protein, 33 aa, Artificial Sequence
  Description of Artificial Sequence: Synthetic polypeptide
DESEIVTTNPVATEQYGTVSACDGEPQFEGENG

SEQ ID NO: 127444 - protein, 33 aa, Artificial Sequence
  Description of Artificial Sequence: Synthetic polypeptide
DESEIVTTNPVATEQYGTVSACDGEVQFEGENG

SEQ ID NO: 127445 - protein, 35 aa, Artificial Sequence
  Description of Artificial Sequence: Synthetic polypeptide
DEDEIRTTNPVATEAWGSVSTNNNNNQNDEGENGT

SEQ ID NO: 127446 - protein, 31 aa, Artificial Sequence
  Description of Artificial Sequence: Synthetic polypeptide
DESEIVTTNPVATEQYGTVSASGPVEFEGDD

SEQ ID NO: 127447 - protein, 35 aa, Artificial Sequence
  Description of Artificial Sequence: Synthetic polypeptide
DEDEIRTTNPVATEAWGSVSTNNNNNQNNEGENND

SEQ ID NO: 127448 - protein, 34 aa, Artificial Sequence
  Description of Artificial Sequence: Synthetic polypeptide
DEPEIRTTNPVATEQYGSVIDQNTGQGEGQDEGN

SEQ ID NO: 127449 - protein, 35 aa, Artificial Sequence
  Description of Artificial Sequence: Synthetic polypeptide
DEAEIRTTNPVATEQYGSVSSDWMLEDESQSDNQQ

SEQ ID NO: 127450 - protein, 32 aa, Artificial Sequence
  Description of Artificial Sequence: Synthetic polypeptide
DESEIVTTNPVATEQYGTVSATDGPVEFEGDD

SEQ ID NO: 127451 - protein, 34 aa, Artificial Sequence
  Description of Artificial Sequence: Synthetic polypeptide
DEDEIRTTNPVATEAWGSVSTNNNTNNNDEGTNG

SEQ ID NO: 127452 - protein, 33 aa, Artificial Sequence
  Description of Artificial Sequence: Synthetic polypeptide
DESEIVTTNPVATEQYGTVVSATDGDDEGEGND

SEQ ID NO: 127453 - protein, 36 aa, Artificial Sequence
  Description of Artificial Sequence: Synthetic polypeptide
DEAEIRTTNPVATEQYGSVSSDWNLEDERQSLNQQI

SEQ ID NO: 127454 - protein, 32 aa, Artificial Sequence
  Description of Artificial Sequence: Synthetic polypeptide
DEAEIRTTNPVATEQYGSVSPLDEVYPSDEDM

SEQ ID NO: 127455 - protein, 34 aa, Artificial Sequence
  Description of Artificial Sequence: Synthetic polypeptide
DESEIVTTNPVATEQYGTVVSATDGNEEFEGNGD

SEQ ID NO: 127456 - protein, 30 aa, Artificial Sequence
  Description of Artificial Sequence: Synthetic polypeptide
DEPEIRTTNPVATEQWGVVSEIEENIAEDA

SEQ ID NO: 127457 - protein, 34 aa, Artificial Sequence
  Description of Artificial Sequence: Synthetic polypeptide
DEAEIRTTNPVATEQYGSVSPVPLWWHQPELEQA

SEQ ID NO: 127458 - protein, 34 aa, Artificial Sequence
  Description of Artificial Sequence: Synthetic polypeptide
DESEIVTTNPVATEQYGTVVSATDGQDEEGDGND

SEQ ID NO: 127459 - protein, 34 aa, Artificial Sequence
  Description of Artificial Sequence: Synthetic polypeptide
DEDEIRTTNPVATEAWGSVSAINVEGQEGEGENG

SEQ ID NO: 127460 - protein, 34 aa, Artificial Sequence
  Description of Artificial Sequence: Synthetic polypeptide
DESEIVTTNPVATEQYGTVCSCINPPQDFEGENG

SEQ ID NO: 127461 - protein, 33 aa, Artificial Sequence
  Description of Artificial Sequence: Synthetic polypeptide
DESEIVTTNPVATEQYGTVCSACDNPPEFEGND

SEQ ID NO: 127462 - protein, 34 aa, Artificial Sequence
  Description of Artificial Sequence: Synthetic polypeptide
DEPEIRTTNPVATEQYGSSHVGTSGQHSGSEETN

SEQ ID NO: 127463 - protein, 34 aa, Artificial Sequence
  Description of Artificial Sequence: Synthetic polypeptide
DESEIVTTNPVATEQYGTVCSACINPVQDFEGNG

SEQ ID NO: 127464 - protein, 34 aa, Artificial Sequence
  Description of Artificial Sequence: Synthetic polypeptide
DEPEIRTTNPVATEQYGSSHVDTSQQHEGSEFQN

SEQ ID NO: 127465 - protein, 34 aa, Artificial Sequence
  Description of Artificial Sequence: Synthetic polypeptide
DEDEIRTTNPVATEAWGSVSAVNQEGQDGEGENG

SEQ ID NO: 127466 - protein, 34 aa, Artificial Sequence
  Description of Artificial Sequence: Synthetic polypeptide
DEPEIRTTNPVATEQYGSSCVLTSQQHEGSEEQE

SEQ ID NO: 127467 - protein, 35 aa, Artificial Sequence
  Description of Artificial Sequence: Synthetic polypeptide
CEEEIRTTNPVATEQYGCVCSNWEELQENFGSNQS

SEQ ID NO: 127468 - protein, 34 aa, Artificial Sequence
  Description of Artificial Sequence: Synthetic polypeptide
DEPEIRTTNPVATEQYGSISSTGTSNMAEGEEWN

SEQ ID NO: 127469 - protein, 33 aa, Artificial Sequence
  Description of Artificial Sequence: Synthetic polypeptide
DESEIVTTNPVATEQYGTVCSATDGPVEFEGND

SEQ ID NO: 127470 - protein, 33 aa, Artificial Sequence
  Description of Artificial Sequence: Synthetic polypeptide
DESEIVTTNPVATEQYGTVCSATDGPVEFEGNT

SEQ ID NO: 127471 - protein, 34 aa, Artificial Sequence
  Description of Artificial Sequence: Synthetic polypeptide
DEDEIRTTNPVATEAWGSVSTNNNNNANNEGENG

SEQ ID NO: 127472 - protein, 35 aa, Artificial Sequence
  Description of Artificial Sequence: Synthetic polypeptide
DEPEIRTTNPVATEQYGSCVVSITVLENGSEQFEI

SEQ ID NO: 127473 - protein, 35 aa, Artificial Sequence
  Description of Artificial Sequence: Synthetic polypeptide
DEAEIRTTNPVATEQYGSVSPTNANEQFDTQFIEI

SEQ ID NO: 127474 - protein, 33 aa, Artificial Sequence
  Description of Artificial Sequence: Synthetic polypeptide
DESEIVTTNPVATEQYGTVCSATIGPVEFEGND

SEQ ID NO: 127475 - protein, 33 aa, Artificial Sequence
  Description of Artificial Sequence: Synthetic polypeptide
DESEIVTTNPVATEQYGSVCSCDGPPEFEGEND

SEQ ID NO: 127476 - protein, 35 aa, Artificial Sequence
  Description of Artificial Sequence: Synthetic polypeptide
DEAEIRTTNPVATEQYGSVSPTWQSITTEGTEWRM

SEQ ID NO: 127477 - protein, 34 aa, Artificial Sequence
  Description of Artificial Sequence: Synthetic polypeptide
DEPEIRTTNPVATEQYGETTTTTNHEQFRQGDDV

SEQ ID NO: 127478 - protein, 33 aa, Artificial Sequence
  Description of Artificial Sequence: Synthetic polypeptide
DEPEIRTTNPVATEQYGETTTTNHEQFEQGDSV

SEQ ID NO: 127479 - protein, 35 aa, Artificial Sequence
  Description of Artificial Sequence: Synthetic polypeptide
DEAEIRTTNPVATEQYGSVSPTITVAENQGDNTQV

SEQ ID NO: 127480 - protein, 33 aa, Artificial Sequence
  Description of Artificial Sequence: Synthetic polypeptide
DEDEIRTTNPVATEAWGSVSAITEGDDGEGENG

SEQ ID NO: 127481 - protein, 35 aa, Artificial Sequence
  Description of Artificial Sequence: Synthetic polypeptide
DEPEIATTNPVATEQYGSVSATGDNEDQDGGEDGG

SEQ ID NO: 127482 - protein, 30 aa, Artificial Sequence
  Description of Artificial Sequence: Synthetic polypeptide
DEPEIRTTNPVATEQWGHVSVIEMPAAEVT

SEQ ID NO: 127483 - protein, 31 aa, Artificial Sequence
  Description of Artificial Sequence: Synthetic polypeptide
DEPEIRTTNPVATEQWGDVSVIEQMNADEDT

SEQ ID NO: 127484 - protein, 34 aa, Artificial Sequence
  Description of Artificial Sequence: Synthetic polypeptide
DEDEIRTTNPVATEAWGSVSAINEGQDIEGENGE

SEQ ID NO: 127485 - protein, 30 aa, Artificial Sequence
  Description of Artificial Sequence: Synthetic polypeptide
DEPEIRTTNPVATEQWGDVSEIEMNAATDA

SEQ ID NO: 127486 - protein, 30 aa, Artificial Sequence
  Description of Artificial Sequence: Synthetic polypeptide
DEPEIRTTNPVATEQWGDVSEIEMNAAEDA

SEQ ID NO: 127487 - protein, 34 aa, Artificial Sequence
  Description of Artificial Sequence: Synthetic polypeptide
DEDEIRTTNPVATEAWGSVSTVVNNEQGTNQEQE

SEQ ID NO: 127488 - protein, 32 aa, Artificial Sequence
  Description of Artificial Sequence: Synthetic polypeptide
DESELATTNPVATEQYGSVAILTDNTDVFGVK

SEQ ID NO: 127489 - protein, 33 aa, Artificial Sequence
  Description of Artificial Sequence: Synthetic polypeptide
DESELRTTNPVATECWGSQSCINEPQDREGENG

SEQ ID NO: 127490 - protein, 30 aa, Artificial Sequence
  Description of Artificial Sequence: Synthetic polypeptide
DEPEIRTTNPVATEQWGAVSVIEIIAAEDE

SEQ ID NO: 127491 - protein, 33 aa, Artificial Sequence
  Description of Artificial Sequence: Synthetic polypeptide
DESELRTTNPVATECWGYVSCINEPQDREGENG

SEQ ID NO: 127492 - protein, 30 aa, Artificial Sequence
  Description of Artificial Sequence: Synthetic polypeptide
DEPEIRTTNPVATEQWGAVSEIEEIAAEDA

SEQ ID NO: 127493 - protein, 33 aa, Artificial Sequence
  Description of Artificial Sequence: Synthetic polypeptide
DESEMRTTNVVATECWGSVSCINEPQDREGENG

SEQ ID NO: 127494 - protein, 33 aa, Artificial Sequence
  Description of Artificial Sequence: Synthetic polypeptide
DESEMRVTNPVATECWGSVSCINEPQDREGENG

SEQ ID NO: 127495 - protein, 33 aa, Artificial Sequence
  Description of Artificial Sequence: Synthetic polypeptide
DESENATTNPVAYEHWGSVSTGQLGDIQGGNQR

SEQ ID NO: 127496 - protein, 34 aa, Artificial Sequence
  Description of Artificial Sequence: Synthetic polypeptide
DESENIQTTNPVATECWGSVSCINEPQDREGENG

SEQ ID NO: 127497 - protein, 35 aa, Artificial Sequence
  Description of Artificial Sequence: Synthetic polypeptide
CEEEIRTTNPVATEQYGCVCSNTGELAENFGSNQS

SEQ ID NO: 127498 - protein, 36 aa, Artificial Sequence
  Description of Artificial Sequence: Synthetic polypeptide
DEAEIRTTNPVATEQYGSVSNWSNDEQTMVGQQDRI

SEQ ID NO: 127499 - protein, 33 aa, Artificial Sequence
  Description of Artificial Sequence: Synthetic polypeptide
DEPEIRTTNPVATECWGVVSPINEPVEREGENG

SEQ ID NO: 127500 - protein, 37 aa, Artificial Sequence
  Description of Artificial Sequence: Synthetic polypeptide
DEAEIRTTNPVATEQYGSVSNTPNNLLQTSFQEDQRE

SEQ ID NO: 127501 - protein, 35 aa, Artificial Sequence
  Description of Artificial Sequence: Synthetic polypeptide
DEAEIRTTNPVATEQYGSVSSMDTMLDTGSSQDEY

SEQ ID NO: 127502 - protein, 33 aa, Artificial Sequence
  Description of Artificial Sequence: Synthetic polypeptide
DESENRTTNPVATECWGSVSCGNEPMDREGENG

SEQ ID NO: 127503 - protein, 30 aa, Artificial Sequence
  Description of Artificial Sequence: Synthetic polypeptide
DEPEIRTTNPVATEQWGDVSLIEMIAAEDD

SEQ ID NO: 127504 - protein, 30 aa, Artificial Sequence
  Description of Artificial Sequence: Synthetic polypeptide
DESEIVTTNPVATEQYGVMCATGPVEHGDD

SEQ ID NO: 127505 - protein, 34 aa, Artificial Sequence
  Description of Artificial Sequence: Synthetic polypeptide
CEEEIRTTNPVATEQYGCVCSNTNHAENFNSDQS

SEQ ID NO: 127506 - protein, 30 aa, Artificial Sequence
  Description of Artificial Sequence: Synthetic polypeptide
DEPEIRTTNPVATEQWGDVSVEEMPAAESA

SEQ ID NO: 127507 - protein, 31 aa, Artificial Sequence
  Description of Artificial Sequence: Synthetic polypeptide
DEPEIRTTNPVATEQWGDVSVIEQMIAIEDQ

SEQ ID NO: 127508 - protein, 30 aa, Artificial Sequence
  Description of Artificial Sequence: Synthetic polypeptide
DESEIVTTNPVATEQYGVMCATTPVEHGDD

SEQ ID NO: 127509 - protein, 32 aa, Artificial Sequence
  Description of Artificial Sequence: Synthetic polypeptide
DEPEIRTTNPVATEQWGDVSVIEQMIAAENSA

SEQ ID NO: 127510 - protein, 33 aa, Artificial Sequence
  Description of Artificial Sequence: Synthetic polypeptide
DESEIVTTNPVSTEGYGTVCSATDGPVQRVGND

SEQ ID NO: 127511 - protein, 34 aa, Artificial Sequence
  Description of Artificial Sequence: Synthetic polypeptide
DEDEIRTTNPVATEAWGSVSAINEGQNGEGENGQ

SEQ ID NO: 127512 - protein, 30 aa, Artificial Sequence
  Description of Artificial Sequence: Synthetic polypeptide
DEPEIRTTNPVATEQWGDVSVIEMPNAEQA

SEQ ID NO: 127513 - protein, 30 aa, Artificial Sequence
  Description of Artificial Sequence: Synthetic polypeptide
DEPEIRTTNPVATEQWGDVSVIEMPAAEFG

SEQ ID NO: 127514 - protein, 30 aa, Artificial Sequence
  Description of Artificial Sequence: Synthetic polypeptide
DEPEIRTTNPVATEQWGDVSVIEMITAETA

SEQ ID NO: 127515 - protein, 30 aa, Artificial Sequence
  Description of Artificial Sequence: Synthetic polypeptide
DEPEIRTTNPVATEQWGDVSVIEMIAVETV

SEQ ID NO: 127516 - protein, 31 aa, Artificial Sequence
  Description of Artificial Sequence: Synthetic polypeptide
DEPEIRTTNPVATEQWGDVSVIEMIAQEDAV

SEQ ID NO: 127517 - protein, 34 aa, Artificial Sequence
  Description of Artificial Sequence: Synthetic polypeptide
DESEIWTTNPVATECWGSVSCINEPQDREGENGN

SEQ ID NO: 127518 - protein, 34 aa, Artificial Sequence
  Description of Artificial Sequence: Synthetic polypeptide
DESEIWTTNPVATECWGSVSKCINEPQDREGENG

SEQ ID NO: 127519 - protein, 34 aa, Artificial Sequence
  Description of Artificial Sequence: Synthetic polypeptide
DESEIYTTNPVATECWGASVSCINEPQDREGENG

SEQ ID NO: 127520 - protein, 30 aa, Artificial Sequence
  Description of Artificial Sequence: Synthetic polypeptide
DEPEIRTTNPVATEQWGDVSVIEMIAADDG

SEQ ID NO: 127521 - protein, 34 aa, Artificial Sequence
  Description of Artificial Sequence: Synthetic polypeptide
DEDEIRTTNPVATEAWGSVSAINEGQEGGGENIG

SEQ ID NO: 127522 - protein, 30 aa, Artificial Sequence
  Description of Artificial Sequence: Synthetic polypeptide
DEPEIRTTNPVATEQWGDVSVIEEIAQEDE

SEQ ID NO: 127523 - protein, 36 aa, Artificial Sequence
  Description of Artificial Sequence: Synthetic polypeptide
DEAEIRTTNPVATEQYGSVSSDWNNLEDERQYDNQQ

SEQ ID NO: 127524 - protein, 33 aa, Artificial Sequence
  Description of Artificial Sequence: Synthetic polypeptide
DEAEIRTTNPVATEQYGSVSPLDEHFPGDEDGI

SEQ ID NO: 127525 - protein, 34 aa, Artificial Sequence
  Description of Artificial Sequence: Synthetic polypeptide
DESEIYTTNPVATECWGSVSCINEPQDREGENGH

SEQ ID NO: 127526 - protein, 34 aa, Artificial Sequence
  Description of Artificial Sequence: Synthetic polypeptide
DESEIYTTNPVATECWGWSVSCINEPQDREGENG

SEQ ID NO: 127527 - protein, 35 aa, Artificial Sequence
  Description of Artificial Sequence: Synthetic polypeptide
DEAEIRTTNPVATEQYGSVPSDTLASLEGEGDESI

SEQ ID NO: 127528 - protein, 33 aa, Artificial Sequence
  Description of Artificial Sequence: Synthetic polypeptide
DEAEIRTTNPVATEQYGSVPPYSAIQREEEAEQ

SEQ ID NO: 127529 - protein, 33 aa, Artificial Sequence
  Description of Artificial Sequence: Synthetic polypeptide
DEAEIRTTNPVATEQYGSVPPSALMQTEEEAEQ

SEQ ID NO: 127530 - protein, 33 aa, Artificial Sequence
  Description of Artificial Sequence: Synthetic polypeptide
DESEVRTTNPVSTECWGSVSCINEPQDREGENG

SEQ ID NO: 127531 - protein, 33 aa, Artificial Sequence
  Description of Artificial Sequence: Synthetic polypeptide
DESEVRTTNPVSTECWGSVSCITEPQDREGENG

SEQ ID NO: 127532 - protein, 32 aa, Artificial Sequence
  Description of Artificial Sequence: Synthetic polypeptide
DESEVRTTNPVSTECWGSVSCTEPQSRVGEQG

SEQ ID NO: 127533 - protein, 36 aa, Artificial Sequence
  Description of Artificial Sequence: Synthetic polypeptide
DEDEIRTTNPVATEAYGSVSTNNNNQGQQQGNTTTE

SEQ ID NO: 127534 - protein, 36 aa, Artificial Sequence
  Description of Artificial Sequence: Synthetic polypeptide
DEPEIRTTNPVATEQYGSVSSTTPWENNMENGMNDV

SEQ ID NO: 127535 - protein, 31 aa, Artificial Sequence
  Description of Artificial Sequence: Synthetic polypeptide
DESEVRTTNPVSTEGYGNVSACTIQSRVGQG

SEQ ID NO: 127536 - protein, 31 aa, Artificial Sequence
  Description of Artificial Sequence: Synthetic polypeptide
DESEVRTTNPVSTEPYGTISMEDIQQRNGNH

SEQ ID NO: 127537 - protein, 36 aa, Artificial Sequence
  Description of Artificial Sequence: Synthetic polypeptide
DEDEIRTTNPVATEAYGSVSTVVNNLQQQQGTTTTE

SEQ ID NO: 127538 - protein, 30 aa, Artificial Sequence
  Description of Artificial Sequence: Synthetic polypeptide
DESEVRTTNPVSTEPYGTVAMDIQQRNGQH

SEQ ID NO: 127539 - protein, 30 aa, Artificial Sequence
  Description of Artificial Sequence: Synthetic polypeptide
DESEVRTTNPVSTEPYGTVAMTIQSRNGQH

SEQ ID NO: 127540 - protein, 36 aa, Artificial Sequence
  Description of Artificial Sequence: Synthetic polypeptide
DEDEIRTTNPVATEAYGSVSTVVNNQQQQGNETTTE

SEQ ID NO: 127541 - protein, 33 aa, Artificial Sequence
  Description of Artificial Sequence: Synthetic polypeptide
DESEVVTTNPVATEQYGTVCSATDGIVQFEGND

SEQ ID NO: 127542 - protein, 38 aa, Artificial Sequence
  Description of Artificial Sequence: Synthetic polypeptide
DEEEIRTTNPVATEQYGSVSTVVVNNLQQGTTDEETTD

SEQ ID NO: 127543 - protein, 33 aa, Artificial Sequence
  Description of Artificial Sequence: Synthetic polypeptide
DESEVVTTNPVATEQYGTVCSATDTIESFEGNR

SEQ ID NO: 127544 - protein, 33 aa, Artificial Sequence
  Description of Artificial Sequence: Synthetic polypeptide
DESFIQTTNPVATECWGSVSCINEPQDREGENG

SEQ ID NO: 127545 - protein, 34 aa, Artificial Sequence
  Description of Artificial Sequence: Synthetic polypeptide
DESFIRTTNPVATECWGSKVSCINEPQDREGENG

SEQ ID NO: 127546 - protein, 34 aa, Artificial Sequence
  Description of Artificial Sequence: Synthetic polypeptide
DESFIRTTNPVATECWGSVSCINEPQDREGENGG

SEQ ID NO: 127547 - protein, 34 aa, Artificial Sequence
  Description of Artificial Sequence: Synthetic polypeptide
DESFIRTTNPVATECWGSVSCINYEPQDREGENG

SEQ ID NO: 127548 - protein, 33 aa, Artificial Sequence
  Description of Artificial Sequence: Synthetic polypeptide
DESFIRTTNPVATGCWGSVSCINEPQDREGENG

SEQ ID NO: 127549 - protein, 34 aa, Artificial Sequence
  Description of Artificial Sequence: Synthetic polypeptide
DESEVRTTNPVSTECWGSVSACINIPQDREGENR

SEQ ID NO: 127550 - protein, 34 aa, Artificial Sequence
  Description of Artificial Sequence: Synthetic polypeptide
DESGEINTTNPVATECWGSVSCINEPQDREGENG

SEQ ID NO: 127551 - protein, 30 aa, Artificial Sequence
  Description of Artificial Sequence: Synthetic polypeptide
DESEVRTTNPVSTECWGNVSCTIQSREGQG

SEQ ID NO: 127552 - protein, 33 aa, Artificial Sequence
  Description of Artificial Sequence: Synthetic polypeptide
DESEITTTNPVATECWGSVSCINEPQDREVENG

SEQ ID NO: 127553 - protein, 31 aa, Artificial Sequence
  Description of Artificial Sequence: Synthetic polypeptide
DESEVRSTNPVATEGWGNVSANIIMSRVGQR

SEQ ID NO: 127554 - protein, 33 aa, Artificial Sequence
  Description of Artificial Sequence: Synthetic polypeptide
DEDEIRTTNPVATEAWGWVSAINDGQDGEGENG

SEQ ID NO: 127555 - protein, 33 aa, Artificial Sequence
  Description of Artificial Sequence: Synthetic polypeptide
DEDEIRTTNPVATEAYGSVSCVHMPSQGGGSGI

SEQ ID NO: 127556 - protein, 34 aa, Artificial Sequence
  Description of Artificial Sequence: Synthetic polypeptide
DESEVRSTNPVSTECYGSVSACINIPQDREGENR

SEQ ID NO: 127557 - protein, 31 aa, Artificial Sequence
  Description of Artificial Sequence: Synthetic polypeptide
DESEIVSTNPVGTEGYGVVSSDTLVQHEGNI

SEQ ID NO: 127558 - protein, 32 aa, Artificial Sequence
  Description of Artificial Sequence: Synthetic polypeptide
DESEVRSTNPVSTEGYGTVSAMTIQQQRVGNH

SEQ ID NO: 127559 - protein, 33 aa, Artificial Sequence
  Description of Artificial Sequence: Synthetic polypeptide
DESEIVSTNPVATEQYGTVCSATDGIVEFVGNR

SEQ ID NO: 127560 - protein, 36 aa, Artificial Sequence
  Description of Artificial Sequence: Synthetic polypeptide
DEDEIRTTNPVATEAYGSVSTNLNNGNQQQIGTTTE

SEQ ID NO: 127561 - protein, 36 aa, Artificial Sequence
  Description of Artificial Sequence: Synthetic polypeptide
DEDEIRTTNPVATEAYGSVSTNLNQQNQQQGTTTTE

SEQ ID NO: 127562 - protein, 33 aa, Artificial Sequence
  Description of Artificial Sequence: Synthetic polypeptide
DESEVRTTNPVATECWGSVSCINEPQDREGEKG

SEQ ID NO: 127563 - protein, 36 aa, Artificial Sequence
  Description of Artificial Sequence: Synthetic polypeptide
DEDEIRTTNPVATEAYGSVSTNNNLGQNQTGETTTE

SEQ ID NO: 127564 - protein, 33 aa, Artificial Sequence
  Description of Artificial Sequence: Synthetic polypeptide
DESEVRTTNPVATECWGSVSCINEPQDREPENG

SEQ ID NO: 127565 - protein, 36 aa, Artificial Sequence
  Description of Artificial Sequence: Synthetic polypeptide
DEDEIRTTNPVATEAYGSVSTNNNLNNQQIGETTTE

SEQ ID NO: 127566 - protein, 36 aa, Artificial Sequence
  Description of Artificial Sequence: Synthetic polypeptide
DEDEIRTTNPVATEAYGSVSTNNNNLGGNQQGTTTE

SEQ ID NO: 127567 - protein, 36 aa, Artificial Sequence
  Description of Artificial Sequence: Synthetic polypeptide
DEPEIRTTNPVATEQYGSVSSTTPAGPNMRNGMNPV

SEQ ID NO: 127568 - protein, 36 aa, Artificial Sequence
  Description of Artificial Sequence: Synthetic polypeptide
DEPEIRTTNPVATEQYGSVSSTTPAIPNMENGMNPN

SEQ ID NO: 127569 - protein, 34 aa, Artificial Sequence
  Description of Artificial Sequence: Synthetic polypeptide
DESEVRTTNPVATECWGSVSECINEPQDREGENG

SEQ ID NO: 127570 - protein, 36 aa, Artificial Sequence
  Description of Artificial Sequence: Synthetic polypeptide
DEDEIRTTNPVATEAYGSVSTNNNNLGQQQGTTTTE

SEQ ID NO: 127571 - protein, 35 aa, Artificial Sequence
  Description of Artificial Sequence: Synthetic polypeptide
DESEVRTTNPVATEQYGNVSATNPAGPNSRNGMNV

SEQ ID NO: 127572 - protein, 33 aa, Artificial Sequence
  Description of Artificial Sequence: Synthetic polypeptide
DESEVRTTNPVNTECWGSVSCINEPQDREGENG

SEQ ID NO: 127573 - protein, 33 aa, Artificial Sequence
  Description of Artificial Sequence: Synthetic polypeptide
DEDEIRTTNPVATEAWGDVSAINEGQDGEGEND

SEQ ID NO: 127574 - protein, 35 aa, Artificial Sequence
  Description of Artificial Sequence: Synthetic polypeptide
DEDEIRTTNPVATEAYGVVSTNLQQQLQQGTTTTE

SEQ ID NO: 127575 - protein, 34 aa, Artificial Sequence
  Description of Artificial Sequence: Synthetic polypeptide
DESGIRTTNPVATECWGTSVSCINEPQDREGENG

SEQ ID NO: 127576 - protein, 34 aa, Artificial Sequence
  Description of Artificial Sequence: Synthetic polypeptide
DESLIRTTNPVATECWGASVSCINEPQDREGENG

SEQ ID NO: 127577 - protein, 34 aa, Artificial Sequence
  Description of Artificial Sequence: Synthetic polypeptide
DESLIRTTNPVATECWGSKVSCINEPQDRKGENG

SEQ ID NO: 127578 - protein, 33 aa, Artificial Sequence
  Description of Artificial Sequence: Synthetic polypeptide
DESLVRTTNPVATECWGSVSCINEPQDREGENG

SEQ ID NO: 127579 - protein, 34 aa, Artificial Sequence
  Description of Artificial Sequence: Synthetic polypeptide
DESMGIRTTNPVATECWGSVSCINEPQDREGENG

SEQ ID NO: 127580 - protein, 33 aa, Artificial Sequence
  Description of Artificial Sequence: Synthetic polypeptide
DESMICTTNPVATECWGSVSCINEPQDREGENG

SEQ ID NO: 127581 - protein, 30 aa, Artificial Sequence
  Description of Artificial Sequence: Synthetic polypeptide
DENEVRSTNPVATEQWGDVSNIIQNAAEDR

SEQ ID NO: 127582 - protein, 33 aa, Artificial Sequence
  Description of Artificial Sequence: Synthetic polypeptide
DESMIRTTNPVANECWGSVSCINEPQDREGENG

SEQ ID NO: 127583 - protein, 34 aa, Artificial Sequence
  Description of Artificial Sequence: Synthetic polypeptide
DESMIRTTNPVATECWGSVSCINEPQDREGENAG

SEQ ID NO: 127584 - protein, 31 aa, Artificial Sequence
  Description of Artificial Sequence: Synthetic polypeptide
DENEVATTNPVSTEPYGNISMTIQQQRVGNH

SEQ ID NO: 127585 - protein, 35 aa, Artificial Sequence
  Description of Artificial Sequence: Synthetic polypeptide
DEEEIRTTNPVATEQYGSVSTDAHTTTEHTQTDDY

SEQ ID NO: 127586 - protein, 35 aa, Artificial Sequence
  Description of Artificial Sequence: Synthetic polypeptide
DEPEIRTTNPVATEQYGSVSTDNTENLDYFPSQQP

SEQ ID NO: 127587 - protein, 35 aa, Artificial Sequence
  Description of Artificial Sequence: Synthetic polypeptide
DEAEIRTTNPVATEQYGSVNSVTVSIMDTQIGGTE

SEQ ID NO: 127588 - protein, 33 aa, Artificial Sequence
  Description of Artificial Sequence: Synthetic polypeptide
DESEISTTNPVATEQYGTVCSATDGPVEFTGND

SEQ ID NO: 127589 - protein, 30 aa, Artificial Sequence
  Description of Artificial Sequence: Synthetic polypeptide
AETEIATTNPIATECYGATANEENLARGGR

SEQ ID NO: 127590 - protein, 34 aa, Artificial Sequence
  Description of Artificial Sequence: Synthetic polypeptide
DEEEIRTTNPVATEQYGSVSVGVGDDEGGQEQIE

SEQ ID NO: 127591 - protein, 33 aa, Artificial Sequence
  Description of Artificial Sequence: Synthetic polypeptide
DESNIRTTNPVATECWGSVSCINEPIDREGENG

SEQ ID NO: 127592 - protein, 33 aa, Artificial Sequence
  Description of Artificial Sequence: Synthetic polypeptide
DESPIRTTNPSATECWGSVSCINEPQDREGENG

SEQ ID NO: 127593 - protein, 30 aa, Artificial Sequence
  Description of Artificial Sequence: Synthetic polypeptide
DENEVASTNPVSTEPYGNIAMTIQQRVGNR

SEQ ID NO: 127594 - protein, 33 aa, Artificial Sequence
  Description of Artificial Sequence: Synthetic polypeptide
DESPIRTTNPVAMECWGSVSCINEPQDREGENG

SEQ ID NO: 127595 - protein, 33 aa, Artificial Sequence
  Description of Artificial Sequence: Synthetic polypeptide
DESLIRTTNPQATECWGSVSCINEPQDREGENG

SEQ ID NO: 127596 - protein, 34 aa, Artificial Sequence
  Description of Artificial Sequence: Synthetic polypeptide
DESGIRTTNPVATECWGSVYSCINEPQDREGENG

SEQ ID NO: 127597 - protein, 34 aa, Artificial Sequence
  Description of Artificial Sequence: Synthetic polypeptide
DESKIRTTNPVATECWGSVSCINEPQDREGENEG

SEQ ID NO: 127598 - protein, 34 aa, Artificial Sequence
  Description of Artificial Sequence: Synthetic polypeptide
DESKIRTTNPVATECWGSVQSCINEPQDREGENG

SEQ ID NO: 127599 - protein, 33 aa, Artificial Sequence
  Description of Artificial Sequence: Synthetic polypeptide
DESHIRTTNPVAMECWGSVSCINEPQDREGENG

SEQ ID NO: 127600 - protein, 33 aa, Artificial Sequence
  Description of Artificial Sequence: Synthetic polypeptide
DESHIRTTNPVATECWGSVSCIMEPQDREGENG

SEQ ID NO: 127601 - protein, 33 aa, Artificial Sequence
  Description of Artificial Sequence: Synthetic polypeptide
DESHIRTTNPVATQCWGSVSCINEPQDREGENG

SEQ ID NO: 127602 - protein, 33 aa, Artificial Sequence
  Description of Artificial Sequence: Synthetic polypeptide
DESHSRTTNPVATEAWGSVSCINEPQDREGWNG

SEQ ID NO: 127603 - protein, 34 aa, Artificial Sequence
  Description of Artificial Sequence: Synthetic polypeptide
DEEEIRTTNPVATEQYGSVSVEYDTEQAVTLSPV

SEQ ID NO: 127604 - protein, 33 aa, Artificial Sequence
  Description of Artificial Sequence: Synthetic polypeptide
DEAEIRTTNPVATEQYGSVNTLWKQMESDEIDN

SEQ ID NO: 127605 - protein, 33 aa, Artificial Sequence
  Description of Artificial Sequence: Synthetic polypeptide
DESIIRMTNPVATECWGSVSCINEPQDREGENG

SEQ ID NO: 127606 - protein, 32 aa, Artificial Sequence
  Description of Artificial Sequence: Synthetic polypeptide
DENEVRTTNPVSTEPYGTISMETIQQQRNGNH

SEQ ID NO: 127607 - protein, 33 aa, Artificial Sequence
  Description of Artificial Sequence: Synthetic polypeptide
DESEITTTNPVATECWGHVSCINEPQDREGENG

SEQ ID NO: 127608 - protein, 37 aa, Artificial Sequence
  Description of Artificial Sequence: Synthetic polypeptide
DEEEIRTTNPVATEQYGSVSTVVVNGNQQANTTTTTE

SEQ ID NO: 127609 - protein, 33 aa, Artificial Sequence
  Description of Artificial Sequence: Synthetic polypeptide
DESIIRTTNPVATECWGSVSCINEPCDREGENG

SEQ ID NO: 127610 - protein, 31 aa, Artificial Sequence
  Description of Artificial Sequence: Synthetic polypeptide
DENEVRTTNPVSTEPYGTISMEDIQQRNGNH

SEQ ID NO: 127611 - protein, 33 aa, Artificial Sequence
  Description of Artificial Sequence: Synthetic polypeptide
DESIIRTTNPVATECWGSVSCINEPQDTEGENG

SEQ ID NO: 127612 - protein, 33 aa, Artificial Sequence
  Description of Artificial Sequence: Synthetic polypeptide
DESKIRTTNPVAFECWGSVSCINEPQDREGENG

SEQ ID NO: 127613 - protein, 33 aa, Artificial Sequence
  Description of Artificial Sequence: Synthetic polypeptide
DESKIRTTNPVATECWGSSSCINEPQDREGENG

SEQ ID NO: 127614 - protein, 33 aa, Artificial Sequence
  Description of Artificial Sequence: Synthetic polypeptide
DENEVRTTNPVSTEPYGTISANEDIQQQRNGNR

SEQ ID NO: 127615 - protein, 33 aa, Artificial Sequence
  Description of Artificial Sequence: Synthetic polypeptide
DESKIRTTNPVATECWGSVECINEPQDREGENG

SEQ ID NO: 127616 - protein, 33 aa, Artificial Sequence
  Description of Artificial Sequence: Synthetic polypeptide
DENEVRTTNPVSTEPYGNISANEDIQQQRNGNR

SEQ ID NO: 127617 - protein, 32 aa, Artificial Sequence
  Description of Artificial Sequence: Synthetic polypeptide
DENEVRTTNPVSTEPYGNISANDIQQQRNGQR

SEQ ID NO: 127618 - protein, 30 aa, Artificial Sequence
  Description of Artificial Sequence: Synthetic polypeptide
DENEVRTTNPVATEQWGDVSEIEMNRAEDA

SEQ ID NO: 127619 - protein, 35 aa, Artificial Sequence
  Description of Artificial Sequence: Synthetic polypeptide
DEEEIRTTNPVATEQYGSVSVLAHIEVSPGEQNNE

SEQ ID NO: 127620 - protein, 31 aa, Artificial Sequence
  Description of Artificial Sequence: Synthetic polypeptide
DESEVRSTNPVATEGWGDVSANIIMSRVGQR

SEQ ID NO: 127621 - protein, 30 aa, Artificial Sequence
  Description of Artificial Sequence: Synthetic polypeptide
DESEVATTNPVSTEQYGNVAAEVIQSREER

SEQ ID NO: 127622 - protein, 37 aa, Artificial Sequence
  Description of Artificial Sequence: Synthetic polypeptide
DEEEIRTTNPVATEQYGSVSTVVVTNNNQNQNQQGTV

SEQ ID NO: 127623 - protein, 29 aa, Artificial Sequence
  Description of Artificial Sequence: Synthetic peptide
DESEVASTNPVSTEGYGNVAASTIQRGQI

SEQ ID NO: 127624 - protein, 30 aa, Artificial Sequence
  Description of Artificial Sequence: Synthetic polypeptide
DESEVASTNPVSTEGYGNVAASTLQHVGDR

SEQ ID NO: 127625 - protein, 35 aa, Artificial Sequence
  Description of Artificial Sequence: Synthetic polypeptide
DEPEIRTTNPVATEQYGSVSPANNEIEPQNVNTVI

SEQ ID NO: 127626 - protein, 35 aa, Artificial Sequence
  Description of Artificial Sequence: Synthetic polypeptide
DEAEIRTTNPVATEQYGSVNWTLDLETRSDQNEGP

SEQ ID NO: 127627 - protein, 36 aa, Artificial Sequence
  Description of Artificial Sequence: Synthetic polypeptide
DEAEIRTTNPVATEQYGSVNWTLDALEQRSNQNNGN

SEQ ID NO: 127628 - protein, 29 aa, Artificial Sequence
  Description of Artificial Sequence: Synthetic peptide
DESEVASTNPVSTEGYGNVANTLQSRGQL

SEQ ID NO: 127629 - protein, 33 aa, Artificial Sequence
  Description of Artificial Sequence: Synthetic polypeptide
DESEIVTTNPVATECWGSVSCINEPQDFEGENG

SEQ ID NO: 127630 - protein, 36 aa, Artificial Sequence
  Description of Artificial Sequence: Synthetic polypeptide
DEPEIRTTNPVATEQYGSVSPAVNLEIEPGNNNEVI

SEQ ID NO: 127631 - protein, 30 aa, Artificial Sequence
  Description of Artificial Sequence: Synthetic polypeptide
DESEVASTNPVSTEGYGNVANTLQSRVGQR

SEQ ID NO: 127632 - protein, 34 aa, Artificial Sequence
  Description of Artificial Sequence: Synthetic polypeptide
DEAEIRTTNPVATEQYGSVNWTLDAEQGSNQNDN

SEQ ID NO: 127633 - protein, 29 aa, Artificial Sequence
  Description of Artificial Sequence: Synthetic peptide
DESEVASTNPVSTEGYGNVASTLQHVGQI

SEQ ID NO: 127634 - protein, 30 aa, Artificial Sequence
  Description of Artificial Sequence: Synthetic polypeptide
DESEVASTNPVSTEGYGNVASTLQSRVGQI

SEQ ID NO: 127635 - protein, 35 aa, Artificial Sequence
  Description of Artificial Sequence: Synthetic polypeptide
DEAEIRTTNPVATEQYGSVNWCTLDWEQRSNQNGN

SEQ ID NO: 127636 - protein, 36 aa, Artificial Sequence
  Description of Artificial Sequence: Synthetic polypeptide
DEPEIRTTNPVATEQYGSVSPAVNLSIEPGNVNTPI

SEQ ID NO: 127637 - protein, 35 aa, Artificial Sequence
  Description of Artificial Sequence: Synthetic polypeptide
DEEEIRTTNPVATEQYGSVSVDTTMDNGGGEDQGE

SEQ ID NO: 127638 - protein, 36 aa, Artificial Sequence
  Description of Artificial Sequence: Synthetic polypeptide
DEAEIRTTNPVATEQYGSVNWCTLDLTQRSDQNEGQ

SEQ ID NO: 127639 - protein, 32 aa, Artificial Sequence
  Description of Artificial Sequence: Synthetic polypeptide
DESEVASTNPVSTEGYGNVCSANGIQSRVGNR

SEQ ID NO: 127640 - protein, 32 aa, Artificial Sequence
  Description of Artificial Sequence: Synthetic polypeptide
DESEVASTNPVSTEGYGNVCSANTIQSRVGNR

SEQ ID NO: 127641 - protein, 33 aa, Artificial Sequence
  Description of Artificial Sequence: Synthetic polypeptide
DESEIVTTNPVATECWGSVSCINEVQDFEGENG

SEQ ID NO: 127642 - protein, 35 aa, Artificial Sequence
  Description of Artificial Sequence: Synthetic polypeptide
DEAEIRTTNPVATEQYGSVNWCSDLEQRSDQNEGN

SEQ ID NO: 127643 - protein, 31 aa, Artificial Sequence
  Description of Artificial Sequence: Synthetic polypeptide
DESEVASTNPVSTEGYGNVAANTLQSRVGQR

SEQ ID NO: 127644 - protein, 35 aa, Artificial Sequence
  Description of Artificial Sequence: Synthetic polypeptide
DEDEIRTTNPVATEAWGSVCSTMNNDHERNGDENM

SEQ ID NO: 127645 - protein, 29 aa, Artificial Sequence
  Description of Artificial Sequence: Synthetic peptide
DESEVASTNPVSTECYGNVAECIQRVGER

SEQ ID NO: 127646 - protein, 34 aa, Artificial Sequence
  Description of Artificial Sequence: Synthetic polypeptide
DEPEIATTNPVATEQYGSVSATDGGEDQEGEGGI

SEQ ID NO: 127647 - protein, 34 aa, Artificial Sequence
  Description of Artificial Sequence: Synthetic polypeptide
DEPEIATTNPVATEQYGSVSATDGEDQEGEEDGD

SEQ ID NO: 127648 - protein, 35 aa, Artificial Sequence
  Description of Artificial Sequence: Synthetic polypeptide
DEAEIRTTNPVATEQYGSVPENALDLTGFNENDED

SEQ ID NO: 127649 - protein, 33 aa, Artificial Sequence
  Description of Artificial Sequence: Synthetic polypeptide
DESEVASTNPVSTECYGSVSACNIPQDREGENR

SEQ ID NO: 127650 - protein, 33 aa, Artificial Sequence
  Description of Artificial Sequence: Synthetic polypeptide
DESEVASTNPVSTECYGSVSACNIPQSREGENR

SEQ ID NO: 127651 - protein, 32 aa, Artificial Sequence
  Description of Artificial Sequence: Synthetic polypeptide
DESEVASTNPVSTECYGSVSACNIQSREGEQR

SEQ ID NO: 127652 - protein, 34 aa, Artificial Sequence
  Description of Artificial Sequence: Synthetic polypeptide
DEPEIATTNPVATDQYGVVSTDNGEQGGQGENET

SEQ ID NO: 127653 - protein, 31 aa, Artificial Sequence
  Description of Artificial Sequence: Synthetic polypeptide
DESEVASTNPVSTEGYGNVAANDGIQRVGNR

SEQ ID NO: 127654 - protein, 36 aa, Artificial Sequence
  Description of Artificial Sequence: Synthetic polypeptide
DEAEIRTTNPVATEQYGSVSTHTWLEETANGQEDRN

SEQ ID NO: 127655 - protein, 36 aa, Artificial Sequence
  Description of Artificial Sequence: Synthetic polypeptide
DEEEIRTTNPVATEQYGSVSVCWLEEEAEQLQTNTP

SEQ ID NO: 127656 - protein, 35 aa, Artificial Sequence
  Description of Artificial Sequence: Synthetic polypeptide
DEPEIRTTNPVATEQYGSVSPAANEIEPGNVPTVI

SEQ ID NO: 127657 - protein, 32 aa, Artificial Sequence
  Description of Artificial Sequence: Synthetic polypeptide
DENVISTTNPVAYEQWGTCSTWDFMQRGDNNR

SEQ ID NO: 127658 - protein, 34 aa, Artificial Sequence
  Description of Artificial Sequence: Synthetic polypeptide
DENVIRYTNPVATEQYGSVSVPNQNDRIGSNNYM

SEQ ID NO: 127659 - protein, 29 aa, Artificial Sequence
  Description of Artificial Sequence: Synthetic peptide
DESEVASTNPVSTEGYGNVAANTIQREQR

SEQ ID NO: 127660 - protein, 34 aa, Artificial Sequence
  Description of Artificial Sequence: Synthetic polypeptide
DENVIRYTNPVATEQYGSVSVPNQNDERIGNNSI

SEQ ID NO: 127661 - protein, 36 aa, Artificial Sequence
  Description of Artificial Sequence: Synthetic polypeptide
DEAEIRTTNPVATEQYGSVNWTLDTLMQRSDQNEGN

SEQ ID NO: 127662 - protein, 30 aa, Artificial Sequence
  Description of Artificial Sequence: Synthetic polypeptide
DESEVASTNPVSTEGYGNVAANTIQRVGQR

SEQ ID NO: 127663 - protein, 35 aa, Artificial Sequence
  Description of Artificial Sequence: Synthetic polypeptide
DEDEIRTTNPVATEAWGSVCSTMNNDHERNGDKER

SEQ ID NO: 127664 - protein, 30 aa, Artificial Sequence
  Description of Artificial Sequence: Synthetic polypeptide
DESEVASTNPVSTEGYGNVAANTIQSRGQR

SEQ ID NO: 127665 - protein, 33 aa, Artificial Sequence
  Description of Artificial Sequence: Synthetic polypeptide
DESEVRSTNPVATECWGNVSANINEPQDREGNR

SEQ ID NO: 127666 - protein, 30 aa, Artificial Sequence
  Description of Artificial Sequence: Synthetic polypeptide
DESEVASTNPVSTEGYGNVSACTIQSRGQR

SEQ ID NO: 127667 - protein, 35 aa, Artificial Sequence
  Description of Artificial Sequence: Synthetic polypeptide
DEPEIRTTNPVATEQYGSVSPIWNWLETRFQDQQD

SEQ ID NO: 127668 - protein, 32 aa, Artificial Sequence
  Description of Artificial Sequence: Synthetic polypeptide
DESEVATTNPVATECYGNVSACITIQDRVGNG

SEQ ID NO: 127669 - protein, 33 aa, Artificial Sequence
  Description of Artificial Sequence: Synthetic polypeptide
DENSIATTNPLAYEQFGSVSCFGNLSQSGGNNR

SEQ ID NO: 127670 - protein, 32 aa, Artificial Sequence
  Description of Artificial Sequence: Synthetic polypeptide
DESEVATTNPVATEGWGNVAACINEQDREGNR

SEQ ID NO: 127671 - protein, 31 aa, Artificial Sequence
  Description of Artificial Sequence: Synthetic polypeptide
DESEVATTNPVATEGWGNVAACNEQDRVGQR

SEQ ID NO: 127672 - protein, 32 aa, Artificial Sequence
  Description of Artificial Sequence: Synthetic polypeptide
DESEVATTNPVATEGWGNVACINEQDREGENR

SEQ ID NO: 127673 - protein, 32 aa, Artificial Sequence
  Description of Artificial Sequence: Synthetic polypeptide
DESEVATTNPVATEGWGSVACNEPQSREGENG

SEQ ID NO: 127674 - protein, 32 aa, Artificial Sequence
  Description of Artificial Sequence: Synthetic polypeptide
DESEVATTNPVATEGWGSVACTEPQSREGENG

SEQ ID NO: 127675 - protein, 32 aa, Artificial Sequence
  Description of Artificial Sequence: Synthetic polypeptide
DESEVATTNPVATEGWGSVACTEPQSREGEQR

SEQ ID NO: 127676 - protein, 33 aa, Artificial Sequence
  Description of Artificial Sequence: Synthetic polypeptide
DESEVATTNPVATEGWGSVSCINEPQSREGENG

SEQ ID NO: 127677 - protein, 32 aa, Artificial Sequence
  Description of Artificial Sequence: Synthetic polypeptide
DESEVATTNPVATEGYGNVSCITIQSRVGEQR

SEQ ID NO: 127678 - protein, 30 aa, Artificial Sequence
  Description of Artificial Sequence: Synthetic polypeptide
DESEVATTNPVATEQYGNAAAEVIQSREER

SEQ ID NO: 127679 - protein, 30 aa, Artificial Sequence
  Description of Artificial Sequence: Synthetic polypeptide
DENQIRTTNPVATEQWGDVSEIEMLAAEDA

SEQ ID NO: 127680 - protein, 33 aa, Artificial Sequence
  Description of Artificial Sequence: Synthetic polypeptide
DENQEASCTTNPVATELYGAVSTNLQRQMHQVY

SEQ ID NO: 127681 - protein, 31 aa, Artificial Sequence
  Description of Artificial Sequence: Synthetic polypeptide
DESEVATTNPVSTEGYGNVAANDIQSRVGER

SEQ ID NO: 127682 - protein, 31 aa, Artificial Sequence
  Description of Artificial Sequence: Synthetic polypeptide
DESEVATTNPVSTEGYGNVAANTIQSRVGQR

SEQ ID NO: 127683 - protein, 30 aa, Artificial Sequence
  Description of Artificial Sequence: Synthetic polypeptide
DENPIRTTNPVATEQWGDVSEIEMNLAEDA

SEQ ID NO: 127684 - protein, 30 aa, Artificial Sequence
  Description of Artificial Sequence: Synthetic polypeptide
DESEVATTNPVSTEGYGNVANTIQSRVGQR

SEQ ID NO: 127685 - protein, 31 aa, Artificial Sequence
  Description of Artificial Sequence: Synthetic polypeptide
DESEVATTNPVSTEGYGNVSANTIQSRVGQG

SEQ ID NO: 127686 - protein, 31 aa, Artificial Sequence
  Description of Artificial Sequence: Synthetic polypeptide
DESEVATTNPVSTEGYGSVANITEQSRVGQR

SEQ ID NO: 127687 - protein, 32 aa, Artificial Sequence
  Description of Artificial Sequence: Synthetic polypeptide
DESEVATTNPVATECWGNVACINEQDREGENR

SEQ ID NO: 127688 - protein, 31 aa, Artificial Sequence
  Description of Artificial Sequence: Synthetic polypeptide
DESEVASTNPVSTEGYGNVSANTIQDRVGQR

SEQ ID NO: 127689 - protein, 31 aa, Artificial Sequence
  Description of Artificial Sequence: Synthetic polypeptide
DESEVATTNPVATECWGNVAANTIQDREGQR

SEQ ID NO: 127690 - protein, 31 aa, Artificial Sequence
  Description of Artificial Sequence: Synthetic polypeptide
DESEVASVNPVSTEQYGNVSANNLQSSVGQR

SEQ ID NO: 127691 - protein, 34 aa, Artificial Sequence
  Description of Artificial Sequence: Synthetic polypeptide
DEPEIRTTNPVATEQYGSVSPLIMEQWALGGDEL

SEQ ID NO: 127692 - protein, 34 aa, Artificial Sequence
  Description of Artificial Sequence: Synthetic polypeptide
DESEIVTTNPVATECWGSVCSCINPPQDREGEND

SEQ ID NO: 127693 - protein, 35 aa, Artificial Sequence
  Description of Artificial Sequence: Synthetic polypeptide
DEPEIRTTNPVATEQYGSVSPPNLEIEPDNVNTVI

SEQ ID NO: 127694 - protein, 31 aa, Artificial Sequence
  Description of Artificial Sequence: Synthetic polypeptide
DESEVASTNPVSTEGYGNVSANTIQSREGQR

SEQ ID NO: 127695 - protein, 35 aa, Artificial Sequence
  Description of Artificial Sequence: Synthetic polypeptide
DEAEIRTTNPVATEQYGSVNTYTNSHEGPRSFEQQ

SEQ ID NO: 127696 - protein, 31 aa, Artificial Sequence
  Description of Artificial Sequence: Synthetic polypeptide
DESEVASTNPVSTEGYGNVSANTIQSRVGQR

SEQ ID NO: 127697 - protein, 35 aa, Artificial Sequence
  Description of Artificial Sequence: Synthetic polypeptide
DEEEIRTTNPVATEQYGSVSVENDDHADEISDNEH

SEQ ID NO: 127698 - protein, 38 aa, Artificial Sequence
  Description of Artificial Sequence: Synthetic polypeptide
DEEEIRTTNPVATEQYGSVSTVVVTNLQNQIGTEEETD

SEQ ID NO: 127699 - protein, 31 aa, Artificial Sequence
  Description of Artificial Sequence: Synthetic polypeptide
DESEVASTNPVSTEGYGTVAANDGIQRVGNR

SEQ ID NO: 127700 - protein, 31 aa, Artificial Sequence
  Description of Artificial Sequence: Synthetic polypeptide
DESEVASTNPVSTEGYGTVAANTIQSRVGNR

SEQ ID NO: 127701 - protein, 31 aa, Artificial Sequence
  Description of Artificial Sequence: Synthetic polypeptide
DESEVASTNPVSTEGYGTVSAMTIQQRVGNH

SEQ ID NO: 127702 - protein, 31 aa, Artificial Sequence
  Description of Artificial Sequence: Synthetic polypeptide
DESEVASTNPVSTEGYGTVSAMTIQSRVGNR

SEQ ID NO: 127703 - protein, 29 aa, Artificial Sequence
  Description of Artificial Sequence: Synthetic peptide
DESEVASTNPVSTEGYGVMAANTIQRGQR

SEQ ID NO: 127704 - protein, 30 aa, Artificial Sequence
  Description of Artificial Sequence: Synthetic polypeptide
DESEVASTNPVSTEGYGVVAANNLQRVGQQ

SEQ ID NO: 127705 - protein, 39 aa, Artificial Sequence
  Description of Artificial Sequence: Synthetic polypeptide
DEEEIRTTNPVATEQYGSVSTVVVTNLGQQGTEGGTNDE

SEQ ID NO: 127706 - protein, 30 aa, Artificial Sequence
  Description of Artificial Sequence: Synthetic polypeptide
DESEVASTNPVSTEQYGNVAAETIQRVGQR

SEQ ID NO: 127707 - protein, 30 aa, Artificial Sequence
  Description of Artificial Sequence: Synthetic polypeptide
DESEVASTNPVSTEQYGNVANTIQSRVGQR

SEQ ID NO: 127708 - protein, 32 aa, Artificial Sequence
  Description of Artificial Sequence: Synthetic polypeptide
DESEVASTNPVSTEQYGNVCSANGIQSRVGND

SEQ ID NO: 127709 - protein, 31 aa, Artificial Sequence
  Description of Artificial Sequence: Synthetic polypeptide
DESEVASVNPVCTEQYGNVSANTIQSSVGNR

SEQ ID NO: 127710 - protein, 31 aa, Artificial Sequence
  Description of Artificial Sequence: Synthetic polypeptide
DESEVASVNPVSTEQYGVVSANNLQSSVGNQ

SEQ ID NO: 127711 - protein, 37 aa, Artificial Sequence
  Description of Artificial Sequence: Synthetic polypeptide
DEEEIRTTNPVATEQYGSVSSTTPAMGPNMRNGMNPV

SEQ ID NO: 127712 - protein, 37 aa, Artificial Sequence
  Description of Artificial Sequence: Synthetic polypeptide
DEEEIRTTNPVATEQYGSVSSTTPAMGHNMRNGMNPV

SEQ ID NO: 127713 - protein, 28 aa, Artificial Sequence
  Description of Artificial Sequence: Synthetic peptide
AESEIASTNPVGTEGYGVMASTLQHGDE

SEQ ID NO: 127714 - protein, 35 aa, Artificial Sequence
  Description of Artificial Sequence: Synthetic polypeptide
DEAEIRTTNPVATEQYGSVCSSQINLFSRNMIADN

SEQ ID NO: 127715 - protein, 35 aa, Artificial Sequence
  Description of Artificial Sequence: Synthetic polypeptide
DETEIRTTNPAATEQYGSVSSTPAGPNMDNGMNPV

SEQ ID NO: 127716 - protein, 33 aa, Artificial Sequence
  Description of Artificial Sequence: Synthetic polypeptide
DEQEIATTNPVASEQYGSVSATQDLEDHEGEDL

SEQ ID NO: 127717 - protein, 37 aa, Artificial Sequence
  Description of Artificial Sequence: Synthetic polypeptide
DEEEIRTTNPVATEQYGSVSTVNVNQQGTTGEETEED

SEQ ID NO: 127718 - protein, 36 aa, Artificial Sequence
  Description of Artificial Sequence: Synthetic polypeptide
DEEEIRTTNPVATEQYGSVSSTTPAGPNMRNGMMPV

SEQ ID NO: 127719 - protein, 36 aa, Artificial Sequence
  Description of Artificial Sequence: Synthetic polypeptide
DEEEIRTTNPVATEQYGSVSSTTPAGPNMRNGMLPV

SEQ ID NO: 127720 - protein, 33 aa, Artificial Sequence
  Description of Artificial Sequence: Synthetic polypeptide
DESEIRTTNPVAYECWGSVSWINENQDRSGEGH

SEQ ID NO: 127721 - protein, 31 aa, Artificial Sequence
  Description of Artificial Sequence: Synthetic polypeptide
DETEIRTTNPIATECWGATWAENLMERGPYR

SEQ ID NO: 127722 - protein, 35 aa, Artificial Sequence
  Description of Artificial Sequence: Synthetic polypeptide
DEAEIRTTNPVATEQYGSVCSSQINSLFPQNMIDY

SEQ ID NO: 127723 - protein, 34 aa, Artificial Sequence
  Description of Artificial Sequence: Synthetic polypeptide
DESEIRTTNPVAYECWGSVSWINENQDREGDNDQ

SEQ ID NO: 127724 - protein, 32 aa, Artificial Sequence
  Description of Artificial Sequence: Synthetic polypeptide
DENEIRTTNPVSTEPYGTISPNDIQQQQNGNH

SEQ ID NO: 127725 - protein, 32 aa, Artificial Sequence
  Description of Artificial Sequence: Synthetic polypeptide
DETEIRTTNPIATECWGSVANAEDEQERKGNI

SEQ ID NO: 127726 - protein, 32 aa, Artificial Sequence
  Description of Artificial Sequence: Synthetic polypeptide
DETEIRTTNPIATECWGSVANAEDWQERKGNI

SEQ ID NO: 127727 - protein, 33 aa, Artificial Sequence
  Description of Artificial Sequence: Synthetic polypeptide
DESEIRTTNPVAYECWGSVSWINENQDRDGEHG

SEQ ID NO: 127728 - protein, 36 aa, Artificial Sequence
  Description of Artificial Sequence: Synthetic polypeptide
DEAEIRTTNPVATEQYGSVSTMWGDSQQEIGNPEHF

SEQ ID NO: 127729 - protein, 33 aa, Artificial Sequence
  Description of Artificial Sequence: Synthetic polypeptide
DETEIRTTNPIATECWGSVSNAEDEPQERKGNI

SEQ ID NO: 127730 - protein, 33 aa, Artificial Sequence
  Description of Artificial Sequence: Synthetic polypeptide
DESEIRTTNPVAYECWGSVSWGIEPQDREGENG

SEQ ID NO: 127731 - protein, 33 aa, Artificial Sequence
  Description of Artificial Sequence: Synthetic polypeptide
DETEIRTTNPIATECWGSVWSCINEQDPKGNYI

SEQ ID NO: 127732 - protein, 31 aa, Artificial Sequence
  Description of Artificial Sequence: Synthetic polypeptide
DETEIRTTNPIATECWGAVWSEDLQEHKGPL

SEQ ID NO: 127733 - protein, 35 aa, Artificial Sequence
  Description of Artificial Sequence: Synthetic polypeptide
DEAEIRTTNPVATEQYGSVSTMWGDSQQEGGSEEF

SEQ ID NO: 127734 - protein, 32 aa, Artificial Sequence
  Description of Artificial Sequence: Synthetic polypeptide
DENEIRTTNPVSTEPYGTISSEDINQNQLGNH

SEQ ID NO: 127735 - protein, 33 aa, Artificial Sequence
  Description of Artificial Sequence: Synthetic polypeptide
DESEIRTTNPVAYECWGSVSWINEPQDREGEGQ

SEQ ID NO: 127736 - protein, 33 aa, Artificial Sequence
  Description of Artificial Sequence: Synthetic polypeptide
DESEIRTTNPVAYECWGSVSWINETQDRDGEMS

SEQ ID NO: 127737 - protein, 32 aa, Artificial Sequence
  Description of Artificial Sequence: Synthetic polypeptide
DENEIRTTNPVSTEPYGTISTEDIQQQFNGNH

SEQ ID NO: 127738 - protein, 33 aa, Artificial Sequence
  Description of Artificial Sequence: Synthetic polypeptide
DESEIRTTNPVAYECWGSVSWINEQQDREGETD

SEQ ID NO: 127739 - protein, 32 aa, Artificial Sequence
  Description of Artificial Sequence: Synthetic polypeptide
DENEIRTTNPVSTEPYGTISTDGIQQQFNGNH

SEQ ID NO: 127740 - protein, 32 aa, Artificial Sequence
  Description of Artificial Sequence: Synthetic polypeptide
DENEIRTTNPVSTEPYGTISTDGIQQQFNGND

SEQ ID NO: 127741 - protein, 32 aa, Artificial Sequence
  Description of Artificial Sequence: Synthetic polypeptide
DENEIRTTNPVSTEPYGTISTDDPQQQQEGNH

SEQ ID NO: 127742 - protein, 32 aa, Artificial Sequence
  Description of Artificial Sequence: Synthetic polypeptide
DEQEIATTNPVASEQYGIVSATDLEDHEGEDL

SEQ ID NO: 127743 - protein, 37 aa, Artificial Sequence
  Description of Artificial Sequence: Synthetic polypeptide
DEEEIRTTNPVATEQYGSVSSTTPAGPNMRNGMNMVG

SEQ ID NO: 127744 - protein, 32 aa, Artificial Sequence
  Description of Artificial Sequence: Synthetic polypeptide
DEQEIATTNPVASEQYGIVSATDLEDSEGTDL

SEQ ID NO: 127745 - protein, 30 aa, Artificial Sequence
  Description of Artificial Sequence: Synthetic polypeptide
DETEIRCTNPVATEQWGAASANWAEPGGYI

SEQ ID NO: 127746 - protein, 32 aa, Artificial Sequence
  Description of Artificial Sequence: Synthetic polypeptide
DETEIRCTNPVATEQYGAAANADWQERKGGYR

SEQ ID NO: 127747 - protein, 33 aa, Artificial Sequence
  Description of Artificial Sequence: Synthetic polypeptide
DETEIRCTNPVATEQYGAAWANADWQERKGGYR

SEQ ID NO: 127748 - protein, 37 aa, Artificial Sequence
  Description of Artificial Sequence: Synthetic polypeptide
DEEEIRTTNPVATEQYGSVSTVQQQQQNGNQQGTTTD

SEQ ID NO: 127749 - protein, 32 aa, Artificial Sequence
  Description of Artificial Sequence: Synthetic polypeptide
DEQEIATTNPVASEQYGSVIATDLEDHEGEDL

SEQ ID NO: 127750 - protein, 30 aa, Artificial Sequence
  Description of Artificial Sequence: Synthetic polypeptide
DETEIRSTNPVATECWGATTWAANWQPGNI

SEQ ID NO: 127751 - protein, 37 aa, Artificial Sequence
  Description of Artificial Sequence: Synthetic polypeptide
DEEEIRTTNPVATEQYGSVSSTTPAGPNMRNGMNIVA

SEQ ID NO: 127752 - protein, 33 aa, Artificial Sequence
  Description of Artificial Sequence: Synthetic polypeptide
DEQEIATTNPVASEQYGSVSATDLEDHEGHEDL

SEQ ID NO: 127753 - protein, 33 aa, Artificial Sequence
  Description of Artificial Sequence: Synthetic polypeptide
DEQEIATTNPVASEQYGSVSATDLEDHEGPEDL

SEQ ID NO: 127754 - protein, 33 aa, Artificial Sequence
  Description of Artificial Sequence: Synthetic polypeptide
DEQEIATTNPVASEQYGSVSATDLEDHEGQEDL

SEQ ID NO: 127755 - protein, 36 aa, Artificial Sequence
  Description of Artificial Sequence: Synthetic polypeptide
DEEEIRTTNPVATEQYGSVSSTTPAGPNMRNGMKPV

SEQ ID NO: 127756 - protein, 32 aa, Artificial Sequence
  Description of Artificial Sequence: Synthetic polypeptide
DENEIRTTNPVSTEPYGTISNEDIQQQQNGNR

SEQ ID NO: 127757 - protein, 36 aa, Artificial Sequence
  Description of Artificial Sequence: Synthetic polypeptide
DEEEIRTTNPVATEQYGSVSSTTPAGPNMRNGMIPV

SEQ ID NO: 127758 - protein, 36 aa, Artificial Sequence
  Description of Artificial Sequence: Synthetic polypeptide
DETEIRTTNPVACEQYGSVIISTDNGLEEGGNGNGN

SEQ ID NO: 127759 - protein, 32 aa, Artificial Sequence
  Description of Artificial Sequence: Synthetic polypeptide
DENEIRTTNPVSTEPYGTISMPAGPQQRNGNV

SEQ ID NO: 127760 - protein, 32 aa, Artificial Sequence
  Description of Artificial Sequence: Synthetic polypeptide
DENEIRTTNPVSTEPYGTISMNDIQQQQNGNH

SEQ ID NO: 127761 - protein, 32 aa, Artificial Sequence
  Description of Artificial Sequence: Synthetic polypeptide
DENEIRTTNPVSTEPYGTISMNDIQPQQNGNH

SEQ ID NO: 127762 - protein, 35 aa, Artificial Sequence
  Description of Artificial Sequence: Synthetic polypeptide
DETEIRTTNPVATEAWGSVCSTMNNDHERNGDSND

SEQ ID NO: 127763 - protein, 36 aa, Artificial Sequence
  Description of Artificial Sequence: Synthetic polypeptide
DEEEIRTTNPVATEQYGSVSSTTPAGPNMRNGMFEV

SEQ ID NO: 127764 - protein, 35 aa, Artificial Sequence
  Description of Artificial Sequence: Synthetic polypeptide
DETEIRTTNPVATEAWGSVSTVNNNNNQQGEGENG

SEQ ID NO: 127765 - protein, 35 aa, Artificial Sequence
  Description of Artificial Sequence: Synthetic polypeptide
DETEIRTTNPVATEAWGSVSTVNNNNQQDEGENNG

SEQ ID NO: 127766 - protein, 36 aa, Artificial Sequence
  Description of Artificial Sequence: Synthetic polypeptide
DEEEIRTTNPVATEQYGSVSSTTPAGPNMRNGMEPV

SEQ ID NO: 127767 - protein, 33 aa, Artificial Sequence
  Description of Artificial Sequence: Synthetic polypeptide
DESEIRTTNPVAYECWGSVSRINEPDDRRGENG

SEQ ID NO: 127768 - protein, 35 aa, Artificial Sequence
  Description of Artificial Sequence: Synthetic polypeptide
DETEIRTTNPVATEAYGSVSTGMGDQEEGEGENNE

SEQ ID NO: 127769 - protein, 33 aa, Artificial Sequence
  Description of Artificial Sequence: Synthetic polypeptide
DESEIRTTNPVAYECWGSVSCPNSSDDREGGNV

SEQ ID NO: 127770 - protein, 36 aa, Artificial Sequence
  Description of Artificial Sequence: Synthetic polypeptide
DEEEIRTTNPVATEQYGSVSSTTPAGPNMRNGMDPV

SEQ ID NO: 127771 - protein, 33 aa, Artificial Sequence
  Description of Artificial Sequence: Synthetic polypeptide
DESEIRTTNPVAYECWGSVSCINEPQDREQANG

SEQ ID NO: 127772 - protein, 35 aa, Artificial Sequence
  Description of Artificial Sequence: Synthetic polypeptide
DEAEIRTTNPVATEQYGSVCSSQINLFPQNMIEDD

SEQ ID NO: 127773 - protein, 31 aa, Artificial Sequence
  Description of Artificial Sequence: Synthetic polypeptide
DENEIRTTNPVSTEPYGTISMIIQQNQNGNH

SEQ ID NO: 127774 - protein, 30 aa, Artificial Sequence
  Description of Artificial Sequence: Synthetic polypeptide
DETEIRTTNPVATECWGAASANWAEPGGYI

SEQ ID NO: 127775 - protein, 31 aa, Artificial Sequence
  Description of Artificial Sequence: Synthetic polypeptide
DETEIRTTNPVATECWGAISAEDIQQPKGNI

SEQ ID NO: 127776 - protein, 31 aa, Artificial Sequence
  Description of Artificial Sequence: Synthetic polypeptide
DETEIRTTNPVATECWGAISAEDIQQQKGNI

SEQ ID NO: 127777 - protein, 33 aa, Artificial Sequence
  Description of Artificial Sequence: Synthetic polypeptide
DETEIRTTNPVATECWGATSAINEPQDREGENG

SEQ ID NO: 127778 - protein, 35 aa, Artificial Sequence
  Description of Artificial Sequence: Synthetic polypeptide
DETEIRTTNPVATDQYGSVVDTDDNDQEEGNEEGQ

SEQ ID NO: 127779 - protein, 33 aa, Artificial Sequence
  Description of Artificial Sequence: Synthetic polypeptide
DEQEIATTNPVANEQYGSVSATDLEDHEGEDLN

SEQ ID NO: 127780 - protein, 32 aa, Artificial Sequence
  Description of Artificial Sequence: Synthetic polypeptide
DENEIRTTNPVSTEPYGTISMPDIQNQQNGNH

SEQ ID NO: 127781 - protein, 35 aa, Artificial Sequence
  Description of Artificial Sequence: Synthetic polypeptide
DETEIRTTNPVATDQYGSVVDTDDNDQEEGENEGD

SEQ ID NO: 127782 - protein, 32 aa, Artificial Sequence
  Description of Artificial Sequence: Synthetic polypeptide
DENEIRTTNPVSTEPYGTISMVDIQQQQNGNV

SEQ ID NO: 127783 - protein, 32 aa, Artificial Sequence
  Description of Artificial Sequence: Synthetic polypeptide
DEQEIATTNPVATAQWGSVAAGALFRNNMGPR

SEQ ID NO: 127784 - protein, 35 aa, Artificial Sequence
  Description of Artificial Sequence: Synthetic polypeptide
DETEIRTTNPVAFEQYGSVIDGQNDLQEGGNGGGE

SEQ ID NO: 127785 - protein, 32 aa, Artificial Sequence
  Description of Artificial Sequence: Synthetic polypeptide
DENEIRTTNPVSTEPYGTISMVDIQQQQNGNH

SEQ ID NO: 127786 - protein, 32 aa, Artificial Sequence
  Description of Artificial Sequence: Synthetic polypeptide
DENEIRTTNPVSTEPYGTISMVDIQQQQAGNH

SEQ ID NO: 127787 - protein, 32 aa, Artificial Sequence
  Description of Artificial Sequence: Synthetic polypeptide
DENEIRTTNPVSTEPYGTISMVDIQQNQNGNH

SEQ ID NO: 127788 - protein, 32 aa, Artificial Sequence
  Description of Artificial Sequence: Synthetic polypeptide
DENEIRTTNPVSTEPYGTISMTDIQQWQNGNH

SEQ ID NO: 127789 - protein, 32 aa, Artificial Sequence
  Description of Artificial Sequence: Synthetic polypeptide
DENEIRTTNPVSTEPYGTISMTDIQQQQNGNH

SEQ ID NO: 127790 - protein, 34 aa, Artificial Sequence
  Description of Artificial Sequence: Synthetic polypeptide
DESEIRTTNPVAYECWGSVSVINHEPQDREGENG

SEQ ID NO: 127791 - protein, 33 aa, Artificial Sequence
  Description of Artificial Sequence: Synthetic polypeptide
DENEIRTTNPVSTEPYGTISMSDNQQQQNGSNH

SEQ ID NO: 127792 - protein, 32 aa, Artificial Sequence
  Description of Artificial Sequence: Synthetic polypeptide
DENEIRTTNPVSTEPYGTISMSDISQQQNGNH

SEQ ID NO: 127793 - protein, 36 aa, Artificial Sequence
  Description of Artificial Sequence: Synthetic polypeptide
DEEEIRTTNPVATEQYGSVSSTTPAGPNMRNGMHPV

SEQ ID NO: 127794 - protein, 32 aa, Artificial Sequence
  Description of Artificial Sequence: Synthetic polypeptide
DENEIRTTNPVSTEPYGTISMSDIQQQQNGNH

SEQ ID NO: 127795 - protein, 32 aa, Artificial Sequence
  Description of Artificial Sequence: Synthetic polypeptide
DENEIRTTNPVSTEPYGTISMSDIQQQQEGNF

SEQ ID NO: 127796 - protein, 32 aa, Artificial Sequence
  Description of Artificial Sequence: Synthetic polypeptide
DENEIRTTNPVSTEPYGTISMSDIAQQQNGNH

SEQ ID NO: 127797 - protein, 36 aa, Artificial Sequence
  Description of Artificial Sequence: Synthetic polypeptide
DEEEIRTTNPVATEQYGSVSSTTPAGPNMRNGMGPV

SEQ ID NO: 127798 - protein, 36 aa, Artificial Sequence
  Description of Artificial Sequence: Synthetic polypeptide
DEEEIRTTNPVATEQYGSVSSTTPAGPNMRNGMGEV

SEQ ID NO: 127799 - protein, 36 aa, Artificial Sequence
  Description of Artificial Sequence: Synthetic polypeptide
DEEEIRTTNPVATEQYGSVSSTTPAGPNMRNGMFPV

SEQ ID NO: 127800 - protein, 34 aa, Artificial Sequence
  Description of Artificial Sequence: Synthetic polypeptide
DETEIRTTNPVATDQYGSVNTQGLQQLEGGQGDT

SEQ ID NO: 127801 - protein, 32 aa, Artificial Sequence
  Description of Artificial Sequence: Synthetic polypeptide
DENEIRTTNPVSTEPYGTISMPDIQQLQNGNH

SEQ ID NO: 127802 - protein, 32 aa, Artificial Sequence
  Description of Artificial Sequence: Synthetic polypeptide
DENEIRTTNPVSTEPYGTISTEDIQQQHNGNH

SEQ ID NO: 127803 - protein, 32 aa, Artificial Sequence
  Description of Artificial Sequence: Synthetic polypeptide
DENEIRTTNPVSTEPYGTISTEDIQQQQGGNH

SEQ ID NO: 127804 - protein, 32 aa, Artificial Sequence
  Description of Artificial Sequence: Synthetic polypeptide
DENEIRTTNPVSTEPYGTISTEDIQQQQNGNH

SEQ ID NO: 127805 - protein, 37 aa, Artificial Sequence
  Description of Artificial Sequence: Synthetic polypeptide
DEEEIRTTNPVATEQYGSVSSTTPAGPNMRNGMNPVV

SEQ ID NO: 127806 - protein, 33 aa, Artificial Sequence
  Description of Artificial Sequence: Synthetic polypeptide
DETEICTTNPVAYEQWGSVSNTNNLNGEHDNGS

SEQ ID NO: 127807 - protein, 37 aa, Artificial Sequence
  Description of Artificial Sequence: Synthetic polypeptide
DEEEIRTTNPVATEQYGSVSSTTPAGPNMRNGMNPVT

SEQ ID NO: 127808 - protein, 37 aa, Artificial Sequence
  Description of Artificial Sequence: Synthetic polypeptide
DEEEIRTTNPVATEQYGSVSSTTPAGPNMRNGMNPVS

SEQ ID NO: 127809 - protein, 34 aa, Artificial Sequence
  Description of Artificial Sequence: Synthetic polypeptide
DETEICTTNPVAYEQWGSVSTINDLEGNHGGNDS

SEQ ID NO: 127810 - protein, 37 aa, Artificial Sequence
  Description of Artificial Sequence: Synthetic polypeptide
DEEEIRTTNPVATEQYGSVSSTTPAGPNMRNGMNPVQ

SEQ ID NO: 127811 - protein, 37 aa, Artificial Sequence
  Description of Artificial Sequence: Synthetic polypeptide
DEEEIRTTNPVATEQYGSVSSTTPAGPNMRNGMNPVP

SEQ ID NO: 127812 - protein, 37 aa, Artificial Sequence
  Description of Artificial Sequence: Synthetic polypeptide
DEEEIRTTNPVATEQYGSVSSTTPAGPNMRNGMNPVN

SEQ ID NO: 127813 - protein, 37 aa, Artificial Sequence
  Description of Artificial Sequence: Synthetic polypeptide
DEEEIRTTNPVATEQYGSVSSTTPAGPNMRNGMNPVM

SEQ ID NO: 127814 - protein, 37 aa, Artificial Sequence
  Description of Artificial Sequence: Synthetic polypeptide
DEEEIRTTNPVATEQYGSVSSTTPAGPNMRNGMNPVL

SEQ ID NO: 127815 - protein, 37 aa, Artificial Sequence
  Description of Artificial Sequence: Synthetic polypeptide
DEEEIRTTNPVATEQYGSVSSTTPAGPNMRNGMNPVK

SEQ ID NO: 127816 - protein, 37 aa, Artificial Sequence
  Description of Artificial Sequence: Synthetic polypeptide
DEEEIRTTNPVATEQYGSVSSTTPAGPNMRNGMNPVI

SEQ ID NO: 127817 - protein, 37 aa, Artificial Sequence
  Description of Artificial Sequence: Synthetic polypeptide
DEEEIRTTNPVATEQYGSVSSTTPAGPNMRNGMNPVH

SEQ ID NO: 127818 - protein, 37 aa, Artificial Sequence
  Description of Artificial Sequence: Synthetic polypeptide
DEEEIRTTNPVATEQYGSVSSTTPAGPNMRNGMNPVG

SEQ ID NO: 127819 - protein, 33 aa, Artificial Sequence
  Description of Artificial Sequence: Synthetic polypeptide
DEQEIATTNPVAAEQYGSVSATDLEDHEGADLI

SEQ ID NO: 127820 - protein, 37 aa, Artificial Sequence
  Description of Artificial Sequence: Synthetic polypeptide
DEEEIRTTNPVATEQYGSVSSTTPAGPNMRNGMNPVF

SEQ ID NO: 127821 - protein, 37 aa, Artificial Sequence
  Description of Artificial Sequence: Synthetic polypeptide
DEEEIRTTNPVATEQYGSVSSTTPAGPNMRNGMNPVE

SEQ ID NO: 127822 - protein, 37 aa, Artificial Sequence
  Description of Artificial Sequence: Synthetic polypeptide
DEEEIRTTNPVATEQYGSVSSTTPAGPNMRNGMNPVD

SEQ ID NO: 127823 - protein, 37 aa, Artificial Sequence
  Description of Artificial Sequence: Synthetic polypeptide
DEEEIRTTNPVATEQYGSVSSTTPAGPNMRNGMNPVC

SEQ ID NO: 127824 - protein, 34 aa, Artificial Sequence
  Description of Artificial Sequence: Synthetic polypeptide
DETEICTTNPVAYEQWGSVSGGDNLQEGGQRNDQ

SEQ ID NO: 127825 - protein, 32 aa, Artificial Sequence
  Description of Artificial Sequence: Synthetic polypeptide
DENEIRTTNPVSTEPYGTISWEEINAEQFGNQ

SEQ ID NO: 127826 - protein, 33 aa, Artificial Sequence
  Description of Artificial Sequence: Synthetic polypeptide
DEQEIATTNPTATEQYGSMVSATDLEDHEGEDL

SEQ ID NO: 127827 - protein, 37 aa, Artificial Sequence
  Description of Artificial Sequence: Synthetic polypeptide
DEEEIRTTNPVATEQYGSVSSTTPAGPNMRNGMNPVY

SEQ ID NO: 127828 - protein, 36 aa, Artificial Sequence
  Description of Artificial Sequence: Synthetic polypeptide
DEEEIRTTNPVATEQYGSVSSTTPAGPNMRNGMPPV

SEQ ID NO: 127829 - protein, 36 aa, Artificial Sequence
  Description of Artificial Sequence: Synthetic polypeptide
DEEEIRTTNPVATEQYGSVSSTTPAGPNMRNGMPIV

SEQ ID NO: 127830 - protein, 38 aa, Artificial Sequence
  Description of Artificial Sequence: Synthetic polypeptide
DEEEIRTTNPVATEQYGSVSTVTNNNNNQQGNNEENGN

SEQ ID NO: 127831 - protein, 38 aa, Artificial Sequence
  Description of Artificial Sequence: Synthetic polypeptide
DEEEIRTTNPVATEQYGSVSTVTNNNNNDEQGGTEENE

SEQ ID NO: 127832 - protein, 32 aa, Artificial Sequence
  Description of Artificial Sequence: Synthetic polypeptide
DEQEIATTNPMATEQYGSVSATDSEDHEGEDL

SEQ ID NO: 127833 - protein, 38 aa, Artificial Sequence
  Description of Artificial Sequence: Synthetic polypeptide
DEEEIRTTNPVATEQYGSVSTVTNNLQQGTEAGTEEQD

SEQ ID NO: 127834 - protein, 32 aa, Artificial Sequence
  Description of Artificial Sequence: Synthetic polypeptide
DEQEIATTNPNATEQWGSVSATDLEDHEGEDL

SEQ ID NO: 127835 - protein, 32 aa, Artificial Sequence
  Description of Artificial Sequence: Synthetic polypeptide
DEQEIATTNPNATEQYGSVSAQDLEDHEGEDL

SEQ ID NO: 127836 - protein, 38 aa, Artificial Sequence
  Description of Artificial Sequence: Synthetic polypeptide
DEEEIRTTNPVATEQYGSVSTVTNLQQSATENGTTEGS

SEQ ID NO: 127837 - protein, 32 aa, Artificial Sequence
  Description of Artificial Sequence: Synthetic polypeptide
DEQEIATTNPQATEQYGSVSATDGEDHEGEDL

SEQ ID NO: 127838 - protein, 38 aa, Artificial Sequence
  Description of Artificial Sequence: Synthetic polypeptide
DEEEIRTTNPVATEQYGSVSTVTNLQQQATATTNVATE

SEQ ID NO: 127839 - protein, 33 aa, Artificial Sequence
  Description of Artificial Sequence: Synthetic polypeptide
DEQEIATTNPQATEQYGSVSATDLEDHEGEDLE

SEQ ID NO: 127840 - protein, 33 aa, Artificial Sequence
  Description of Artificial Sequence: Synthetic polypeptide
DEQEIATTNPQATEQYGSVSATDLGEDHEGEDL

SEQ ID NO: 127841 - protein, 33 aa, Artificial Sequence
  Description of Artificial Sequence: Synthetic polypeptide
DETEICTTNPVAYECWGSVATNLQGNAGENDGM

SEQ ID NO: 127842 - protein, 33 aa, Artificial Sequence
  Description of Artificial Sequence: Synthetic polypeptide
DEQEIATTNPSATEQYGSVGSATDLEDHEGEDL

SEQ ID NO: 127843 - protein, 37 aa, Artificial Sequence
  Description of Artificial Sequence: Synthetic polypeptide
DEEEIRTTNPVATEQYGSVSSTTPAGPNMRNGMNPWA

SEQ ID NO: 127844 - protein, 34 aa, Artificial Sequence
  Description of Artificial Sequence: Synthetic polypeptide
DETEICTTNPVAYEHWGSVSTGPLQGDIQGGNQR

SEQ ID NO: 127845 - protein, 33 aa, Artificial Sequence
  Description of Artificial Sequence: Synthetic polypeptide
DETEICTTNPVAYEHWGSVSTGQLGDHQGGNQS

SEQ ID NO: 127846 - protein, 33 aa, Artificial Sequence
  Description of Artificial Sequence: Synthetic polypeptide
DETEICTTNPVAYEHWGSVSTGQLGDIQGGNAH

SEQ ID NO: 127847 - protein, 37 aa, Artificial Sequence
  Description of Artificial Sequence: Synthetic polypeptide
DEEEIRTTNPVATEQYGSVSSTTPAGPNMRNGMNPVW

SEQ ID NO: 127848 - protein, 33 aa, Artificial Sequence
  Description of Artificial Sequence: Synthetic polypeptide
DETEIRTTNPVATECWGATSNAINWPQEREGNG

SEQ ID NO: 127849 - protein, 37 aa, Artificial Sequence
  Description of Artificial Sequence: Synthetic polypeptide
DEEEIRTTNPVATEQYGSVSSTTPAGPNMRNGMNPVA

SEQ ID NO: 127850 - protein, 33 aa, Artificial Sequence
  Description of Artificial Sequence: Synthetic polypeptide
DEQEIATTNPVAAEQYGSVSATDYLEDHEGEDL

SEQ ID NO: 127851 - protein, 33 aa, Artificial Sequence
  Description of Artificial Sequence: Synthetic polypeptide
DENEIRTTNPVSTEPYGTISTTEDIPNQRNGNV

SEQ ID NO: 127852 - protein, 33 aa, Artificial Sequence
  Description of Artificial Sequence: Synthetic polypeptide
DEQEIATTNPVAHEQYGSVSATDLPDHEGREDL

SEQ ID NO: 127853 - protein, 33 aa, Artificial Sequence
  Description of Artificial Sequence: Synthetic polypeptide
DENEIRTTNPVSTEPYGTISTTEAIPNQRNGNV

SEQ ID NO: 127854 - protein, 32 aa, Artificial Sequence
  Description of Artificial Sequence: Synthetic polypeptide
DEQEIATTNPVAIEQYGSVSATDLEDHEQEDL

SEQ ID NO: 127855 - protein, 33 aa, Artificial Sequence
  Description of Artificial Sequence: Synthetic polypeptide
DENEIRTTNPVSTEPYGTISTMEDIQRQQNGNH

SEQ ID NO: 127856 - protein, 32 aa, Artificial Sequence
  Description of Artificial Sequence: Synthetic polypeptide
DEQEIATTNPVAIEQYGSVTATDLEDHEGEDK

SEQ ID NO: 127857 - protein, 33 aa, Artificial Sequence
  Description of Artificial Sequence: Synthetic polypeptide
DEQEIATTNPVAIEQYGSVWSATDLEDHEGEDL

SEQ ID NO: 127858 - protein, 35 aa, Artificial Sequence
  Description of Artificial Sequence: Synthetic polypeptide
DEEEIRTTNPVATEQYGSVSTVTMGFGEEGQGQFQ

SEQ ID NO: 127859 - protein, 33 aa, Artificial Sequence
  Description of Artificial Sequence: Synthetic polypeptide
DENEIRTTNPVSTEPYGTISTMEDIQQQRNGNH

SEQ ID NO: 127860 - protein, 30 aa, Artificial Sequence
  Description of Artificial Sequence: Synthetic polypeptide
DETEIRCTNPIATEQWGSTWSEDWAERGPI

SEQ ID NO: 127861 - protein, 33 aa, Artificial Sequence
  Description of Artificial Sequence: Synthetic polypeptide
DEQEIATTNPVAMEQYGSIVSATDLEDHEGEDL

SEQ ID NO: 127862 - protein, 32 aa, Artificial Sequence
  Description of Artificial Sequence: Synthetic polypeptide
DEQEIATTNPVAMEQYGSVSAGDLEDHEGEVL

SEQ ID NO: 127863 - protein, 38 aa, Artificial Sequence
  Description of Artificial Sequence: Synthetic polypeptide
DEEEIRTTNPVATEQYGSVSTVSNNQQGNQQGTTEEED

SEQ ID NO: 127864 - protein, 33 aa, Artificial Sequence
  Description of Artificial Sequence: Synthetic polypeptide
DEQEIATTNPVAMEQYGSVSATDQLEDHEGEDL

SEQ ID NO: 127865 - protein, 33 aa, Artificial Sequence
  Description of Artificial Sequence: Synthetic polypeptide
DENEIRTTNPVSTEPYGTISTMEDIPQQRNGNH

SEQ ID NO: 127866 - protein, 32 aa, Artificial Sequence
  Description of Artificial Sequence: Synthetic polypeptide
DEQEIATTNPVANEQYGSVSAHDLEDHEGEDL

SEQ ID NO: 127867 - protein, 32 aa, Artificial Sequence
  Description of Artificial Sequence: Synthetic polypeptide
DENEIRTTNPVSTEPYGTISTMDSQQQQNGNH

SEQ ID NO: 127868 - protein, 32 aa, Artificial Sequence
  Description of Artificial Sequence: Synthetic polypeptide
DEQEIATTNPVANEQYGSVSATDAEDHEGEDL

SEQ ID NO: 127869 - protein, 37 aa, Artificial Sequence
  Description of Artificial Sequence: Synthetic polypeptide
DEEEIRTTNPVATEQYGSVSSTTPAGPNMRNGMNMVY

SEQ ID NO: 127870 - protein, 31 aa, Artificial Sequence
  Description of Artificial Sequence: Synthetic polypeptide
DETEIRCTNPIATECYGSTWSEDWAEPKGNR

SEQ ID NO: 127871 - protein, 33 aa, Artificial Sequence
  Description of Artificial Sequence: Synthetic polypeptide
DEQEIATTNPVAAEQYGSVSATDLNEDHEGEDL

SEQ ID NO: 127872 - protein, 34 aa, Artificial Sequence
  Description of Artificial Sequence: Synthetic polypeptide
DESEIRTTNPVAYECWGSVSWINPEPQDREGRND

SEQ ID NO: 127873 - protein, 32 aa, Artificial Sequence
  Description of Artificial Sequence: Synthetic polypeptide
DENEIRTTNPVSTEPYGTISVEDEQQQQNGNH

SEQ ID NO: 127874 - protein, 32 aa, Artificial Sequence
  Description of Artificial Sequence: Synthetic polypeptide
DEQEIATTNPVACEQYGSVSATDCEDHEGEDL

SEQ ID NO: 127875 - protein, 31 aa, Artificial Sequence
  Description of Artificial Sequence: Synthetic polypeptide
AESEIACTNPVATEQWGEASENEPQDREGGR

SEQ ID NO: 127876 - protein, 32 aa, Artificial Sequence
  Description of Artificial Sequence: Synthetic polypeptide
DENEIRTTNPVSTEPYGTISWEDINQFQFGNA

SEQ ID NO: 127877 - protein, 38 aa, Artificial Sequence
  Description of Artificial Sequence: Synthetic polypeptide
DEEEIRTTNPVATEQYGSVSTVTNLQNQGTEQGTEGQE

SEQ ID NO: 127878 - protein, 33 aa, Artificial Sequence
  Description of Artificial Sequence: Synthetic polypeptide
DEQEIATTNPVADEQYGSVSATDLEDHEGEDLM

SEQ ID NO: 127879 - protein, 32 aa, Artificial Sequence
  Description of Artificial Sequence: Synthetic polypeptide
DENEIRTTNPVSTEPYGTISWEDINQDQSGNQ

SEQ ID NO: 127880 - protein, 33 aa, Artificial Sequence
  Description of Artificial Sequence: Synthetic polypeptide
DETEIETTNPVATEQYGTVCSATDGPVEFEGND

SEQ ID NO: 127881 - protein, 33 aa, Artificial Sequence
  Description of Artificial Sequence: Synthetic polypeptide
DETEIKTTNPAATEQYGSVPTGLIMGGGENGGT

SEQ ID NO: 127882 - protein, 33 aa, Artificial Sequence
  Description of Artificial Sequence: Synthetic polypeptide
DETEIKTTNPAATEQYGSVPTGLIMNGGNDGDT

SEQ ID NO: 127883 - protein, 35 aa, Artificial Sequence
  Description of Artificial Sequence: Synthetic polypeptide
DETEIKTTNPVATEQYGSVGSTDGEDEGENVEEIR

SEQ ID NO: 127884 - protein, 32 aa, Artificial Sequence
  Description of Artificial Sequence: Synthetic polypeptide
DENEIRTTNPVSTEPYGTISVLDIQQMQNGNH

SEQ ID NO: 127885 - protein, 32 aa, Artificial Sequence
  Description of Artificial Sequence: Synthetic polypeptide
DENEIRTTNPVSTEPYGTISVEDWQQQQNGNH

SEQ ID NO: 127886 - protein, 32 aa, Artificial Sequence
  Description of Artificial Sequence: Synthetic polypeptide
DENEIRTTNPVSTEPYGTISVEDTMQQQNGQH

SEQ ID NO: 127887 - protein, 33 aa, Artificial Sequence
  Description of Artificial Sequence: Synthetic polypeptide
DEQEIATTNPVAFEQYGSVSATDLEDHEGEDLA

SEQ ID NO: 127888 - protein, 32 aa, Artificial Sequence
  Description of Artificial Sequence: Synthetic polypeptide
DENEIRTTNPVSTEPYGTISVEDIQQQQNGNH

SEQ ID NO: 127889 - protein, 33 aa, Artificial Sequence
  Description of Artificial Sequence: Synthetic polypeptide
DEQEIATTNPVAFEQYGSVSATWDLEDHEGEDL

SEQ ID NO: 127890 - protein, 32 aa, Artificial Sequence
  Description of Artificial Sequence: Synthetic polypeptide
DENEIRTTNPVSTEPYGTISVEDIQQQANGNH

SEQ ID NO: 127891 - protein, 32 aa, Artificial Sequence
  Description of Artificial Sequence: Synthetic polypeptide
DENEIRTTNPVSTEPYGTISVEDIQQIQTGNH

SEQ ID NO: 127892 - protein, 32 aa, Artificial Sequence
  Description of Artificial Sequence: Synthetic polypeptide
DEQEIATTNPVAHEQYGHVSATDLEDHEGEDL

SEQ ID NO: 127893 - protein, 33 aa, Artificial Sequence
  Description of Artificial Sequence: Synthetic polypeptide
DESEIRTTNPVAYECWGSVVRINEQQDREGENG

SEQ ID NO: 127894 - protein, 30 aa, Artificial Sequence
  Description of Artificial Sequence: Synthetic polypeptide
DETEIRTTNPVATECWGATTWAANWQPGPI

SEQ ID NO: 127895 - protein, 30 aa, Artificial Sequence
  Description of Artificial Sequence: Synthetic polypeptide
DETEIRTTNPVATECWGATTWAEDWARGGR

SEQ ID NO: 127896 - protein, 36 aa, Artificial Sequence
  Description of Artificial Sequence: Synthetic polypeptide
DEEEIRTTNPVATEQYGSVSSTTPAGPNMRNGMAPV

SEQ ID NO: 127897 - protein, 35 aa, Artificial Sequence
  Description of Artificial Sequence: Synthetic polypeptide
DETEIRTTNPVATEQWGSVSSNTPAGPNMRNGNPV

SEQ ID NO: 127898 - protein, 36 aa, Artificial Sequence
  Description of Artificial Sequence: Synthetic polypeptide
DEEEIRTTNPVATEQYGSVSSTTPAGPNMRAEMNPA

SEQ ID NO: 127899 - protein, 33 aa, Artificial Sequence
  Description of Artificial Sequence: Synthetic polypeptide
DEQEIATTNPVATEFYGSVSATLDLEDHEGEDL

SEQ ID NO: 127900 - protein, 38 aa, Artificial Sequence
  Description of Artificial Sequence: Synthetic polypeptide
DEEEIRTTNPVATEQYGSVSTDNGNLQEGTEQGTTVEQ

SEQ ID NO: 127901 - protein, 32 aa, Artificial Sequence
  Description of Artificial Sequence: Synthetic polypeptide
DEQEIATTNPVATEGYGSMAATDLQDHEGDDI

SEQ ID NO: 127902 - protein, 32 aa, Artificial Sequence
  Description of Artificial Sequence: Synthetic polypeptide
DEQEIATTNPVATEGYGSVAATDLEDHEGEDL

SEQ ID NO: 127903 - protein, 39 aa, Artificial Sequence
  Description of Artificial Sequence: Synthetic polypeptide
DEEEIRTTNPVATEQYGSVSTVNQNQLQAGTEQGTVNEE

SEQ ID NO: 127904 - protein, 33 aa, Artificial Sequence
  Description of Artificial Sequence: Synthetic polypeptide
DESEIRTTNPVAVNCWGSVSCINIPQHRFGENG

SEQ ID NO: 127905 - protein, 32 aa, Artificial Sequence
  Description of Artificial Sequence: Synthetic polypeptide
DENEIRTTNPVSTEPYGTISMEDIWQQQNGNR

SEQ ID NO: 127906 - protein, 33 aa, Artificial Sequence
  Description of Artificial Sequence: Synthetic polypeptide
DESEIRTTNPVAVECWGSVSCINEPVDREGENG

SEQ ID NO: 127907 - protein, 33 aa, Artificial Sequence
  Description of Artificial Sequence: Synthetic polypeptide
DESEIRTTNPVAVECWGSVSCINEPQDLEGENG

SEQ ID NO: 127908 - protein, 32 aa, Artificial Sequence
  Description of Artificial Sequence: Synthetic polypeptide
DEQEIATTNPVATEGYGSVSATDIEDHEGEDL

SEQ ID NO: 127909 - protein, 37 aa, Artificial Sequence
  Description of Artificial Sequence: Synthetic polypeptide
DEEEIRTTNPVATEQYGSVSTVNQNNQQATTTNVATE

SEQ ID NO: 127910 - protein, 33 aa, Artificial Sequence
  Description of Artificial Sequence: Synthetic polypeptide
DESEIRTTNPVAVECWGSVSCINEPQDKEGENG

SEQ ID NO: 127911 - protein, 33 aa, Artificial Sequence
  Description of Artificial Sequence: Synthetic polypeptide
DEQEIATTNPVATEGYGSVSATDLEDHEGSEDL

SEQ ID NO: 127912 - protein, 32 aa, Artificial Sequence
  Description of Artificial Sequence: Synthetic polypeptide
DENEIRTTNPVSTEPYGTISMEDITQQQQGNH

SEQ ID NO: 127913 - protein, 32 aa, Artificial Sequence
  Description of Artificial Sequence: Synthetic polypeptide
DENEIRTTNPVSTEPYGTISMEDITQQQNGNK

SEQ ID NO: 127914 - protein, 32 aa, Artificial Sequence
  Description of Artificial Sequence: Synthetic polypeptide
DENEIRTTNPVSTEPYGTISMEDITQQQNGNH

SEQ ID NO: 127915 - protein, 38 aa, Artificial Sequence
  Description of Artificial Sequence: Synthetic polypeptide
DEEEIRTTNPVATEQYGSVSTVNQNGNNDEQIGTTNQQ

SEQ ID NO: 127916 - protein, 33 aa, Artificial Sequence
  Description of Artificial Sequence: Synthetic polypeptide
DEQEIATTNPVATEFQYGSNSATDLEDHEGEDL

SEQ ID NO: 127917 - protein, 37 aa, Artificial Sequence
  Description of Artificial Sequence: Synthetic polypeptide
DEEEIRTTNPVATEQYGSVSTVNQNGNNDEQGTENQE

SEQ ID NO: 127918 - protein, 38 aa, Artificial Sequence
  Description of Artificial Sequence: Synthetic polypeptide
DEEEIRTTNPVATEQYGSVSTVNQNQNQQQGNNQEGNT

SEQ ID NO: 127919 - protein, 32 aa, Artificial Sequence
  Description of Artificial Sequence: Synthetic polypeptide
DENEIRTTNPVSTEPYGTISMEDLQQQHNGNH

SEQ ID NO: 127920 - protein, 31 aa, Artificial Sequence
  Description of Artificial Sequence: Synthetic polypeptide
DENEIRTTNPVSTEPYGTISMEDPQQQEGNH

SEQ ID NO: 127921 - protein, 38 aa, Artificial Sequence
  Description of Artificial Sequence: Synthetic polypeptide
DEEEIRTTNPVATEQYGSVSTVNQQLGNNNGEQGEEED

SEQ ID NO: 127922 - protein, 30 aa, Artificial Sequence
  Description of Artificial Sequence: Synthetic polypeptide
DETEIRTTNPVATEQWGDVSEIEMNAAEDA

SEQ ID NO: 127923 - protein, 31 aa, Artificial Sequence
  Description of Artificial Sequence: Synthetic polypeptide
DETEIRTTNPVATEQWGDVSEIEMNAAEDMA

SEQ ID NO: 127924 - protein, 38 aa, Artificial Sequence
  Description of Artificial Sequence: Synthetic polypeptide
DEEEIRTTNPVATEQYGSVSTVNQQIGTTNVTEEEEQD

SEQ ID NO: 127925 - protein, 34 aa, Artificial Sequence
  Description of Artificial Sequence: Synthetic polypeptide
DESEIRTTNPVAYEAWGSVSCINESQIRNGGNTG

SEQ ID NO: 127926 - protein, 32 aa, Artificial Sequence
  Description of Artificial Sequence: Synthetic polypeptide
DENEIRTTNPVSTEPYGTISMEDNQQQQNGNH

SEQ ID NO: 127927 - protein, 31 aa, Artificial Sequence
  Description of Artificial Sequence: Synthetic polypeptide
DETEIRTTNPVATEQWGDVSEIEMNAAEEDA

SEQ ID NO: 127928 - protein, 34 aa, Artificial Sequence
  Description of Artificial Sequence: Synthetic polypeptide
DESEIRTTNPVAYEAWGSVSCINESQDREGGNQH

SEQ ID NO: 127929 - protein, 34 aa, Artificial Sequence
  Description of Artificial Sequence: Synthetic polypeptide
DESEIRTTNPVAYEAWGSTVSCINESQDREGGNG

SEQ ID NO: 127930 - protein, 33 aa, Artificial Sequence
  Description of Artificial Sequence: Synthetic polypeptide
DEQEIATTNPVATECYGSVWSNTDLEDHEGEYL

SEQ ID NO: 127931 - protein, 33 aa, Artificial Sequence
  Description of Artificial Sequence: Synthetic polypeptide
DEQEIATTNPVATECYGSVWSNTDLEEHEGEYL

SEQ ID NO: 127932 - protein, 37 aa, Artificial Sequence
  Description of Artificial Sequence: Synthetic polypeptide
DEEEIRTTNPVATEQYGSVSTVNQQAGTEQGSTQEEE

SEQ ID NO: 127933 - protein, 32 aa, Artificial Sequence
  Description of Artificial Sequence: Synthetic polypeptide
DEQEIATTNPVATEDYGSVSARDLEDHEGEDL

SEQ ID NO: 127934 - protein, 32 aa, Artificial Sequence
  Description of Artificial Sequence: Synthetic polypeptide
DENEIRTTNPVSTEPYGTISMEDLQQQQNGNH

SEQ ID NO: 127935 - protein, 36 aa, Artificial Sequence
  Description of Artificial Sequence: Synthetic polypeptide
DEEEIRTTNPVATEQYGSVSSTTPAGPNMRAGMDPV

SEQ ID NO: 127936 - protein, 36 aa, Artificial Sequence
  Description of Artificial Sequence: Synthetic polypeptide
DEEEIRTTNPVATEQYGSVSVTEMPLFMTRVDDFVQ

SEQ ID NO: 127937 - protein, 33 aa, Artificial Sequence
  Description of Artificial Sequence: Synthetic polypeptide
DEQEIATTNPVATEDYGSVSATNDWEDHEGEDL

SEQ ID NO: 127938 - protein, 32 aa, Artificial Sequence
  Description of Artificial Sequence: Synthetic polypeptide
DEQEIATTNPVATEEYGEVSATDLEDHEGFDL

SEQ ID NO: 127939 - protein, 32 aa, Artificial Sequence
  Description of Artificial Sequence: Synthetic polypeptide
DENEIRTTNPVSTEPYGTISMEDLQEQQNGNH

SEQ ID NO: 127940 - protein, 34 aa, Artificial Sequence
  Description of Artificial Sequence: Synthetic polypeptide
DESEIRTTNPVAYEAWGSVSCMNESQDREGGNTG

SEQ ID NO: 127941 - protein, 36 aa, Artificial Sequence
  Description of Artificial Sequence: Synthetic polypeptide
DEEEIRTTNPVATEQYGSVSSTTPAGPNMHNGMEPV

SEQ ID NO: 127942 - protein, 36 aa, Artificial Sequence
  Description of Artificial Sequence: Synthetic polypeptide
DEEEIRTTNPVATEQYGSVSSTTPAGPNMHNEMNPV

SEQ ID NO: 127943 - protein, 31 aa, Artificial Sequence
  Description of Artificial Sequence: Synthetic polypeptide
DENEIRTTNPVSTEPYGTISMEDIQQRNGGH

SEQ ID NO: 127944 - protein, 32 aa, Artificial Sequence
  Description of Artificial Sequence: Synthetic polypeptide
AEQEIATTNPCATEQYGSVSATDLEDHEGEDL

SEQ ID NO: 127945 - protein, 29 aa, Artificial Sequence
  Description of Artificial Sequence: Synthetic peptide
AEQEIAPTNPCSYEQWGIVSCNLQDGDTR

SEQ ID NO: 127946 - protein, 38 aa, Artificial Sequence
  Description of Artificial Sequence: Synthetic polypeptide
DEEEIRTTNPVATEQYGSVSTVNNQQQGNNQQGTEQGQ

SEQ ID NO: 127947 - protein, 33 aa, Artificial Sequence
  Description of Artificial Sequence: Synthetic polypeptide
DEQEIATTNPVATEIYGSVSATDLEDHEGEDLF

SEQ ID NO: 127948 - protein, 33 aa, Artificial Sequence
  Description of Artificial Sequence: Synthetic polypeptide
DEQEIATTNPVATEIYGSVSATDLEDHEGIEDL

SEQ ID NO: 127949 - protein, 38 aa, Artificial Sequence
  Description of Artificial Sequence: Synthetic polypeptide
DEEEIRTTNPVATEQYGSVSTVNNQQQGNNQQGTEENE

SEQ ID NO: 127950 - protein, 36 aa, Artificial Sequence
  Description of Artificial Sequence: Synthetic polypeptide
DETEIRTTNPVATEQYGSTVSANAPAGPNMRKGPPV

SEQ ID NO: 127951 - protein, 36 aa, Artificial Sequence
  Description of Artificial Sequence: Synthetic polypeptide
DETEIRTTNPVATEQYGSTVSANAPDGPNMRKGPPV

SEQ ID NO: 127952 - protein, 32 aa, Artificial Sequence
  Description of Artificial Sequence: Synthetic polypeptide
DENEIRTTNPVSTEPYGTISMEDIQQQRNGNV

SEQ ID NO: 127953 - protein, 32 aa, Artificial Sequence
  Description of Artificial Sequence: Synthetic polypeptide
DENEIRTTNPVSTEPYGTISMEDIQQQRNGNH

SEQ ID NO: 127954 - protein, 36 aa, Artificial Sequence
  Description of Artificial Sequence: Synthetic polypeptide
DETEIRTTNPVATEQYGSTVSANTPAGPNMRKGPPV

SEQ ID NO: 127955 - protein, 36 aa, Artificial Sequence
  Description of Artificial Sequence: Synthetic polypeptide
DEAEIRTTNPVATEQYGSVCSPSVDLEERQGGTENM

SEQ ID NO: 127956 - protein, 35 aa, Artificial Sequence
  Description of Artificial Sequence: Synthetic polypeptide
DETEIRTTNPVATEQYGSTWSTTEDGPNMRNGNYI

SEQ ID NO: 127957 - protein, 35 aa, Artificial Sequence
  Description of Artificial Sequence: Synthetic polypeptide
DETEIRTTNPVATEQYGSTWSTTEDWPNMPNGNYI

SEQ ID NO: 127958 - protein, 35 aa, Artificial Sequence
  Description of Artificial Sequence: Synthetic polypeptide
DETEIRTTNPVATEQYGSTWSTTEDWPNMRNGNYI

SEQ ID NO: 127959 - protein, 38 aa, Artificial Sequence
  Description of Artificial Sequence: Synthetic polypeptide
DEEEIRTTNPVATEQYGSVSTVNNQQNQQQGTNNDEEE

SEQ ID NO: 127960 - protein, 32 aa, Artificial Sequence
  Description of Artificial Sequence: Synthetic polypeptide
DENEIRTTNPVSTEPYGTISMEDIQQQQRGNH

SEQ ID NO: 127961 - protein, 36 aa, Artificial Sequence
  Description of Artificial Sequence: Synthetic polypeptide
DEEEIRTTNPVATEQYGSVSSTTPAGPNIRNGMGPV

SEQ ID NO: 127962 - protein, 33 aa, Artificial Sequence
  Description of Artificial Sequence: Synthetic polypeptide
DEQEIATTNPVATEIYGSVSATDELEDHEGEDL

SEQ ID NO: 127963 - protein, 32 aa, Artificial Sequence
  Description of Artificial Sequence: Synthetic polypeptide
AEQEIATTNPVATEQYGSVSATDLEDHEEEKL

SEQ ID NO: 127964 - protein, 32 aa, Artificial Sequence
  Description of Artificial Sequence: Synthetic polypeptide
DENEIRTTNPVSTEPYGTISMEDIQQRQNGNH

SEQ ID NO: 127965 - protein, 32 aa, Artificial Sequence
  Description of Artificial Sequence: Synthetic polypeptide
DETEIRTTNPVATEQYGSTSAADWADHEGEDI

SEQ ID NO: 127966 - protein, 33 aa, Artificial Sequence
  Description of Artificial Sequence: Synthetic polypeptide
AEQEIATTNPVATEQYGSVSATDKLEDHEGEDL

SEQ ID NO: 127967 - protein, 32 aa, Artificial Sequence
  Description of Artificial Sequence: Synthetic polypeptide
DENEIRTTNPVSTEPYGTISMEDIQWQQRGNH

SEQ ID NO: 127968 - protein, 37 aa, Artificial Sequence
  Description of Artificial Sequence: Synthetic polypeptide
DEEEIRTTNPVATEQYGSVSTVNQAGNNNQQGTEEDE

SEQ ID NO: 127969 - protein, 32 aa, Artificial Sequence
  Description of Artificial Sequence: Synthetic polypeptide
AEQEIATTNPVATEQYGSVSAEDLEDHEGGDL

SEQ ID NO: 127970 - protein, 33 aa, Artificial Sequence
  Description of Artificial Sequence: Synthetic polypeptide
DEQEIATTNPVATEHYGSNVSATDLEDHEGEDL

SEQ ID NO: 127971 - protein, 32 aa, Artificial Sequence
  Description of Artificial Sequence: Synthetic polypeptide
DEQEIATTNPVATEHYGSVAATDLEDHEGEDL

SEQ ID NO: 127972 - protein, 37 aa, Artificial Sequence
  Description of Artificial Sequence: Synthetic polypeptide
DEEEIRTTNPVATEQYGSVSSTTPAGPNMFNGMNPVS

SEQ ID NO: 127973 - protein, 37 aa, Artificial Sequence
  Description of Artificial Sequence: Synthetic polypeptide
DEEEIRTTNPVATEQYGSVSSTTPAGPNMFNGMNPVA

SEQ ID NO: 127974 - protein, 32 aa, Artificial Sequence
  Description of Artificial Sequence: Synthetic polypeptide
AEQEIATTNPVATEQYGEVSAENLEDHEGGDL

SEQ ID NO: 127975 - protein, 38 aa, Artificial Sequence
  Description of Artificial Sequence: Synthetic polypeptide
DEEEIRTTNPVATEQYGSVSTVNPNNLQQGEEDEETEQ

SEQ ID NO: 127976 - protein, 32 aa, Artificial Sequence
  Description of Artificial Sequence: Synthetic polypeptide
DENEIRTTNPVSTEPYGTISMEDIQRQQNGNH

SEQ ID NO: 127977 - protein, 36 aa, Artificial Sequence
  Description of Artificial Sequence: Synthetic polypeptide
DEEEIRTTNPVATEQYGSVSSTTPAGPNMENGMGGV

SEQ ID NO: 127978 - protein, 38 aa, Artificial Sequence
  Description of Artificial Sequence: Synthetic polypeptide
DEEEIRTTNPVATEQYGSVSTVNNTQQGNNQQGTTEET

SEQ ID NO: 127979 - protein, 33 aa, Artificial Sequence
  Description of Artificial Sequence: Synthetic polypeptide
AEQEIATTNPVATEQYGCVASTNPQEADGTVQN

SEQ ID NO: 127980 - protein, 32 aa, Artificial Sequence
  Description of Artificial Sequence: Synthetic polypeptide
DENEIRTTNPVSTEPYGTISMEDIQQVQNGNR

SEQ ID NO: 127981 - protein, 33 aa, Artificial Sequence
  Description of Artificial Sequence: Synthetic polypeptide
DESEIRTTNPVATYCWGSVSCIKEPQDREGENG

SEQ ID NO: 127982 - protein, 34 aa, Artificial Sequence
  Description of Artificial Sequence: Synthetic polypeptide
DESEIRTTNPVATWCWGSVSRCINEPQDREGENG

SEQ ID NO: 127983 - protein, 35 aa, Artificial Sequence
  Description of Artificial Sequence: Synthetic polypeptide
CEEEIRATNPVGYERYGQSVVSTNATSQRGGDNRM

SEQ ID NO: 127984 - protein, 34 aa, Artificial Sequence
  Description of Artificial Sequence: Synthetic polypeptide
DESEIRTTNPVATWCWGSVSCINPEPQDREGENG

SEQ ID NO: 127985 - protein, 32 aa, Artificial Sequence
  Description of Artificial Sequence: Synthetic polypeptide
DETEIRTTNPVATEQYGSTSAADWEDHEGEDI

SEQ ID NO: 127986 - protein, 36 aa, Artificial Sequence
  Description of Artificial Sequence: Synthetic polypeptide
DEEEIRTTNPVATEQYGSVSSTTPAGPNMRNGMQPV

SEQ ID NO: 127987 - protein, 30 aa, Artificial Sequence
  Description of Artificial Sequence: Synthetic polypeptide
DETEIRTTNPVATEQWGDVSEIEENAAEDA

SEQ ID NO: 127988 - protein, 34 aa, Artificial Sequence
  Description of Artificial Sequence: Synthetic polypeptide
DESEIRTTNPVAYEAWGSVVSCGNESQDREGENG

SEQ ID NO: 127989 - protein, 32 aa, Artificial Sequence
  Description of Artificial Sequence: Synthetic polypeptide
DEQEIATTNPVATCEYGSVSATDLEDHEGEDL

SEQ ID NO: 127990 - protein, 38 aa, Artificial Sequence
  Description of Artificial Sequence: Synthetic polypeptide
DEEEIRTTNPVATEQYGSVSTVNTNQQGNNQQGTTEGQ

SEQ ID NO: 127991 - protein, 34 aa, Artificial Sequence
  Description of Artificial Sequence: Synthetic polypeptide
DESEIRTTNPVAYECWGSVSCGNESQDREGGNDG

SEQ ID NO: 127992 - protein, 32 aa, Artificial Sequence
  Description of Artificial Sequence: Synthetic polypeptide
DENEIRTTNPVSTEPYGTISMENIQQVQNGNH

SEQ ID NO: 127993 - protein, 32 aa, Artificial Sequence
  Description of Artificial Sequence: Synthetic polypeptide
DENEIRTTNPVSTEPYGTISMENIQQQQNGNH

SEQ ID NO: 127994 - protein, 32 aa, Artificial Sequence
  Description of Artificial Sequence: Synthetic polypeptide
DEQEIATTNPVATDQYGSISATDLEDHEGEDL

SEQ ID NO: 127995 - protein, 32 aa, Artificial Sequence
  Description of Artificial Sequence: Synthetic polypeptide
DENEIRTTNPVSTEPYGTISMENIQQQQEGNG

SEQ ID NO: 127996 - protein, 35 aa, Artificial Sequence
  Description of Artificial Sequence: Synthetic polypeptide
DEEEIRTTNPVATEQYGSVSVTDYATTTEETQNDD

SEQ ID NO: 127997 - protein, 32 aa, Artificial Sequence
  Description of Artificial Sequence: Synthetic polypeptide
DENEIRTTNPVSTEPYGTISMENIPQQQNGNH

SEQ ID NO: 127998 - protein, 32 aa, Artificial Sequence
  Description of Artificial Sequence: Synthetic polypeptide
DENEIRTTNPVSTEPYGTISMENEQQQQEGNG

SEQ ID NO: 127999 - protein, 32 aa, Artificial Sequence
  Description of Artificial Sequence: Synthetic polypeptide
DENEIRTTNPVSTEPYGTISMENEQQDQEGNG

SEQ ID NO: 128000 - protein, 33 aa, Artificial Sequence
  Description of Artificial Sequence: Synthetic polypeptide
DESEIRTTNPVAYECWGSVSCANSSSDREVGNQ

SEQ ID NO: 128001 - protein, 32 aa, Artificial Sequence
  Description of Artificial Sequence: Synthetic polypeptide
DENEIRTTNPVSTEPYGTISMELIQVQQNGNH

SEQ ID NO: 128002 - protein, 32 aa, Artificial Sequence
  Description of Artificial Sequence: Synthetic polypeptide
DENEIRTTNPVSTEPYGTISMELIQQQQNGNH

SEQ ID NO: 128003 - protein, 33 aa, Artificial Sequence
  Description of Artificial Sequence: Synthetic polypeptide
DEQEIATTNPVATDQYGSVTSATDLEDHEGEDL

SEQ ID NO: 128004 - protein, 36 aa, Artificial Sequence
  Description of Artificial Sequence: Synthetic polypeptide
DEEEIRTTNPVATEQYGSVSSTTPAGPNMRNGDQPV

SEQ ID NO: 128005 - protein, 31 aa, Artificial Sequence
  Description of Artificial Sequence: Synthetic polypeptide
DENEIRTTNPVSTEPYGTISMEIIQQQNGNH

SEQ ID NO: 128006 - protein, 36 aa, Artificial Sequence
  Description of Artificial Sequence: Synthetic polypeptide
DEEEIRTTNPVATEQYGSVSSTTPAGPNMRNGDPPV

SEQ ID NO: 128007 - protein, 33 aa, Artificial Sequence
  Description of Artificial Sequence: Synthetic polypeptide
DEQEIATTNPVATEAYGSVSATDFLEDHEGEDL

SEQ ID NO: 128008 - protein, 32 aa, Artificial Sequence
  Description of Artificial Sequence: Synthetic polypeptide
DETEIRTTNPVATECWGSTANCINWQDRKGPI

SEQ ID NO: 128009 - protein, 37 aa, Artificial Sequence
  Description of Artificial Sequence: Synthetic polypeptide
DEEEIRTTNPVATEQYGSVSTVNQQQQNTNNDEEEED

SEQ ID NO: 128010 - protein, 34 aa, Artificial Sequence
  Description of Artificial Sequence: Synthetic polypeptide
DESEIRTTNPVAYECWGSVSCGNESQDRTGENEG

SEQ ID NO: 128011 - protein, 30 aa, Artificial Sequence
  Description of Artificial Sequence: Synthetic polypeptide
DETEIRTTNPVATECWGETTWAEDWARGGR

SEQ ID NO: 128012 - protein, 31 aa, Artificial Sequence
  Description of Artificial Sequence: Synthetic polypeptide
DETEIRTTNPVATECWGATWANSTLQPGPYI

SEQ ID NO: 128013 - protein, 32 aa, Artificial Sequence
  Description of Artificial Sequence: Synthetic polypeptide
DENEIRTTNPVSTEPYGTISMEWINQQQNGNH

SEQ ID NO: 128014 - protein, 32 aa, Artificial Sequence
  Description of Artificial Sequence: Synthetic polypeptide
DENEIRTTNPVSTEPYGTISMEVIQQQQVGNH

SEQ ID NO: 128015 - protein, 37 aa, Artificial Sequence
  Description of Artificial Sequence: Synthetic polypeptide
DEEEIRTTNPVATEQYGSVSSTTPAGPNMRNGKNPVD

SEQ ID NO: 128016 - protein, 32 aa, Artificial Sequence
  Description of Artificial Sequence: Synthetic polypeptide
DENEIRTTNPVSTEPYGTISMEVIQQQQNGNH

SEQ ID NO: 128017 - protein, 31 aa, Artificial Sequence
  Description of Artificial Sequence: Synthetic polypeptide
DENEIRTTNPVSTEPYGTISMEVIQQQNGNH

SEQ ID NO: 128018 - protein, 32 aa, Artificial Sequence
  Description of Artificial Sequence: Synthetic polypeptide
DENEIRTTNPVSTEPYGTISMEVCQQQQNGNH

SEQ ID NO: 128019 - protein, 32 aa, Artificial Sequence
  Description of Artificial Sequence: Synthetic polypeptide
DENEIRTTNPVSTEPYGTISMETLQQQQNGNH

SEQ ID NO: 128020 - protein, 32 aa, Artificial Sequence
  Description of Artificial Sequence: Synthetic polypeptide
DENEIRTTNPVSTEPYGTISMETIQQQQNGNP

SEQ ID NO: 128021 - protein, 32 aa, Artificial Sequence
  Description of Artificial Sequence: Synthetic polypeptide
DENEIRTTNPVSTEPYGTISMETIQQQQNGNH

SEQ ID NO: 128022 - protein, 34 aa, Artificial Sequence
  Description of Artificial Sequence: Synthetic polypeptide
DESEIRTTNPVAYECWGSVSCINEPQDREGENGF

SEQ ID NO: 128023 - protein, 33 aa, Artificial Sequence
  Description of Artificial Sequence: Synthetic polypeptide
DESEIRTTNPVAYECWGSVSCINEPDDREGEND

SEQ ID NO: 128024 - protein, 35 aa, Artificial Sequence
  Description of Artificial Sequence: Synthetic polypeptide
DEAEIRTTNPVATEQYGSVSTMWGDSYQESGEFEG

SEQ ID NO: 128025 - protein, 31 aa, Artificial Sequence
  Description of Artificial Sequence: Synthetic polypeptide
DENEIRTTNPVSTEPYGTISMETIQQQQGDH

SEQ ID NO: 128026 - protein, 32 aa, Artificial Sequence
  Description of Artificial Sequence: Synthetic polypeptide
DENEIRTTNPVSTEPYGTISMETIQQQLNGNH

SEQ ID NO: 128027 - protein, 33 aa, Artificial Sequence
  Description of Artificial Sequence: Synthetic polypeptide
DEQEIATTNPVATAQYGSVSATDMLEDHEGEDL

SEQ ID NO: 128028 - protein, 34 aa, Artificial Sequence
  Description of Artificial Sequence: Synthetic polypeptide
DESEIRTTNPVAYECWGSVSCINEESQDREGGNG

SEQ ID NO: 128029 - protein, 33 aa, Artificial Sequence
  Description of Artificial Sequence: Synthetic polypeptide
DEAEIRTTNPVATEQYGSVCSSQIIVFPHNMID

SEQ ID NO: 128030 - protein, 32 aa, Artificial Sequence
  Description of Artificial Sequence: Synthetic polypeptide
DENEIRTTNPVSTEPYGTISMESIQQQQNGNH

SEQ ID NO: 128031 - protein, 34 aa, Artificial Sequence
  Description of Artificial Sequence: Synthetic polypeptide
DEAEIRTTNPVATEQYGSVCSSQIGLFPHNMIVD

SEQ ID NO: 128032 - protein, 30 aa, Artificial Sequence
  Description of Artificial Sequence: Synthetic polypeptide
DETEIRTTNPVATEQWGDVSEIEDNAAEDA

SEQ ID NO: 128033 - protein, 32 aa, Artificial Sequence
  Description of Artificial Sequence: Synthetic polypeptide
DEQEIATTNPVATEAYGSVSATDREDHEGEDL

SEQ ID NO: 128034 - protein, 36 aa, Artificial Sequence
  Description of Artificial Sequence: Synthetic polypeptide
DEEEIRTTNPVATEQYGSVSSTTPAGPNMRNFNNPV

SEQ ID NO: 128035 - protein, 31 aa, Artificial Sequence
  Description of Artificial Sequence: Synthetic polypeptide
DEQEIATTNPVATECYGDVSAEDLQDHEEDL

SEQ ID NO: 128036 - protein, 38 aa, Artificial Sequence
  Description of Artificial Sequence: Synthetic polypeptide
DEEEIRTTNPVATEQYGSVSTVNQQQGNTEQGTNNDED

SEQ ID NO: 128037 - protein, 34 aa, Artificial Sequence
  Description of Artificial Sequence: Synthetic polypeptide
DETEIRTTNPVATEGYGSVVNNGLDQQGGQTGQG

SEQ ID NO: 128038 - protein, 38 aa, Artificial Sequence
  Description of Artificial Sequence: Synthetic polypeptide
DEEEIRTTNPVATEQYGSVSTVNQQQGNQGQGTTNQEG

SEQ ID NO: 128039 - protein, 32 aa, Artificial Sequence
  Description of Artificial Sequence: Synthetic polypeptide
DENEIRTTNPVSTEPYGTISMEDSQQQQNGNH

SEQ ID NO: 128040 - protein, 38 aa, Artificial Sequence
  Description of Artificial Sequence: Synthetic polypeptide
DEEEIRTTNPVATEQYGSVSTVNQQQGNNTTQQGTETE

SEQ ID NO: 128041 - protein, 32 aa, Artificial Sequence
  Description of Artificial Sequence: Synthetic polypeptide
AEQELATTNPVATEQYGSVSATDLEDIEGEDL

SEQ ID NO: 128042 - protein, 32 aa, Artificial Sequence
  Description of Artificial Sequence: Synthetic polypeptide
DEQEIATTNPVATECYGSVAATDLADHKGPDL

SEQ ID NO: 128043 - protein, 32 aa, Artificial Sequence
  Description of Artificial Sequence: Synthetic polypeptide
DEQEIATTNPVATECYGSVIATDLEDHEGEDL

SEQ ID NO: 128044 - protein, 38 aa, Artificial Sequence
  Description of Artificial Sequence: Synthetic polypeptide
DEEEIRTTNPVATEQYGSVSTVNQQQGNNQQGTTNQET

SEQ ID NO: 128045 - protein, 31 aa, Artificial Sequence
  Description of Artificial Sequence: Synthetic polypeptide
DEQEIATTNPVATECYGSVSAEDLEDHEEDL

SEQ ID NO: 128046 - protein, 32 aa, Artificial Sequence
  Description of Artificial Sequence: Synthetic polypeptide
DETEIRTTNPVATEPYGAISNMEDIQEPNGNI

SEQ ID NO: 128047 - protein, 32 aa, Artificial Sequence
  Description of Artificial Sequence: Synthetic polypeptide
DETEIRTTNPVATEPYGAISNMEDIQEQNGNI

SEQ ID NO: 128048 - protein, 38 aa, Artificial Sequence
  Description of Artificial Sequence: Synthetic polypeptide
DEEEIRTTNPVATEQYGSVSTVNQQQGNNNNQQGEEDE

SEQ ID NO: 128049 - protein, 38 aa, Artificial Sequence
  Description of Artificial Sequence: Synthetic polypeptide
DEEEIRTTNPVATEQYGSVSTVNQQQGNNNNEQGTTDD

SEQ ID NO: 128050 - protein, 33 aa, Artificial Sequence
  Description of Artificial Sequence: Synthetic polypeptide
DEQEIATTNPVATECYGSVSATDLPEDHEGEDL

SEQ ID NO: 128051 - protein, 38 aa, Artificial Sequence
  Description of Artificial Sequence: Synthetic polypeptide
DEEEIRTTNPVATEQYGSVSTVNQQQGNNNDEQGTTTD

SEQ ID NO: 128052 - protein, 30 aa, Artificial Sequence
  Description of Artificial Sequence: Synthetic polypeptide
DETEIRTTNPVATEQWGDVSEIEANAAEDA

SEQ ID NO: 128053 - protein, 32 aa, Artificial Sequence
  Description of Artificial Sequence: Synthetic polypeptide
DEQEIATTNPVATECYGSVSATDWEDHEGEYI

SEQ ID NO: 128054 - protein, 32 aa, Artificial Sequence
  Description of Artificial Sequence: Synthetic polypeptide
DENEIRTTNPVSTEPYGTISMEDTQQQQAGNH

SEQ ID NO: 128055 - protein, 33 aa, Artificial Sequence
  Description of Artificial Sequence: Synthetic polypeptide
DEQEIATTNPVATEAYGSVSCTDALEDHEGEYL

SEQ ID NO: 128056 - protein, 32 aa, Artificial Sequence
  Description of Artificial Sequence: Synthetic polypeptide
DENEIRTTNPVSTEPYGTISMEDTQQQQNGNH

SEQ ID NO: 128057 - protein, 38 aa, Artificial Sequence
  Description of Artificial Sequence: Synthetic polypeptide
DEEEIRTTNPVATEQYGSVSTVNQQQGNTEQGTTDEEQ

SEQ ID NO: 128058 - protein, 32 aa, Artificial Sequence
  Description of Artificial Sequence: Synthetic polypeptide
DENEIRTTNPVSTEPYGTISMEHIQQLQNGNH

SEQ ID NO: 128059 - protein, 36 aa, Artificial Sequence
  Description of Artificial Sequence: Synthetic polypeptide
DEEEIRTTNPVATEQYGSVSSTTPAGPNMRNFMNPV

SEQ ID NO: 128060 - protein, 36 aa, Artificial Sequence
  Description of Artificial Sequence: Synthetic polypeptide
DEEEIRTTNPVATEQYGSVSSTTPAGPNMRNFHNPV

SEQ ID NO: 128061 - protein, 36 aa, Artificial Sequence
  Description of Artificial Sequence: Synthetic polypeptide
DEEEIRTTNPVATEQYGSVSSTTPAGPNMRNEMNPV

SEQ ID NO: 128062 - protein, 36 aa, Artificial Sequence
  Description of Artificial Sequence: Synthetic polypeptide
DEEEIRTTNPVATEQYGSVSSTTPAGPNMRNEMNPT

SEQ ID NO: 128063 - protein, 36 aa, Artificial Sequence
  Description of Artificial Sequence: Synthetic polypeptide
DEEEIRTTNPVATEQYGSVSSTTPAGPNMRNEMNIV

SEQ ID NO: 128064 - protein, 36 aa, Artificial Sequence
  Description of Artificial Sequence: Synthetic polypeptide
CEEEIRITTNPVATEQYGCVCSNTNGSGITGGNNRG

SEQ ID NO: 128065 - protein, 36 aa, Artificial Sequence
  Description of Artificial Sequence: Synthetic polypeptide
DEEEIRTTNPVATEQYGSVSSTTPAGPNMRNDMNPV

SEQ ID NO: 128066 - protein, 34 aa, Artificial Sequence
  Description of Artificial Sequence: Synthetic polypeptide
DETEIRTTNPVATECWGVVSPINEPQEREGENGE

SEQ ID NO: 128067 - protein, 36 aa, Artificial Sequence
  Description of Artificial Sequence: Synthetic polypeptide
DEEEIRTTNPVATEQYGSVSSTTPAGPNMRNDMNPF

SEQ ID NO: 128068 - protein, 36 aa, Artificial Sequence
  Description of Artificial Sequence: Synthetic polypeptide
DEEEIRTTNPVATEQYGSVSSTTPAGPNMRNDMNMV

SEQ ID NO: 128069 - protein, 36 aa, Artificial Sequence
  Description of Artificial Sequence: Synthetic polypeptide
DEEEIRTTNPVATEQYGSVSSTTPAGPNMRNAMNPV

SEQ ID NO: 128070 - protein, 31 aa, Artificial Sequence
  Description of Artificial Sequence: Synthetic polypeptide
DETEIRTTNPVATECYGATWANEDWAPGGYR

SEQ ID NO: 128071 - protein, 33 aa, Artificial Sequence
  Description of Artificial Sequence: Synthetic polypeptide
DEQEIATTNPVATEAYGSYVSATDLEDHEGEDL

SEQ ID NO: 128072 - protein, 33 aa, Artificial Sequence
  Description of Artificial Sequence: Synthetic polypeptide
DESEIRTTNPVAYECWGSVSCANPSDTREGGNG

SEQ ID NO: 128073 - protein, 31 aa, Artificial Sequence
  Description of Artificial Sequence: Synthetic polypeptide
DETEIRTTNPVATECYGDVANACWQEHKGPI

SEQ ID NO: 128074 - protein, 34 aa, Artificial Sequence
  Description of Artificial Sequence: Synthetic polypeptide
DESEIRTTNPVAYECWGSVSCANFSQNREGGNGS

SEQ ID NO: 128075 - protein, 34 aa, Artificial Sequence
  Description of Artificial Sequence: Synthetic polypeptide
DESEIRTTNPVAYECWGSTVSWINENQDREGGND

SEQ ID NO: 128076 - protein, 34 aa, Artificial Sequence
  Description of Artificial Sequence: Synthetic polypeptide
CEEEIRCTNPVGYERYGEKVSTNAPSQRGGDNRQ

SEQ ID NO: 128077 - protein, 36 aa, Artificial Sequence
  Description of Artificial Sequence: Synthetic polypeptide
DEEEIRTTNPVATEQYGSVSSTTPAGPNMRHGMIPV

SEQ ID NO: 128078 - protein, 38 aa, Artificial Sequence
  Description of Artificial Sequence: Synthetic polypeptide
DEEEIRTTNPVATEQYGSVSTVTNNNNQNGNQNNEEDE

SEQ ID NO: 128079 - protein, 34 aa, Artificial Sequence
  Description of Artificial Sequence: Synthetic polypeptide
DESEIRTTNPVAYECWGSVVSCGNDSQDREGENT

SEQ ID NO: 128080 - protein, 38 aa, Artificial Sequence
  Description of Artificial Sequence: Synthetic polypeptide
DEEEIRTTNPVATEQYGSVSTVTNNNNQQGNNNTEDEE

SEQ ID NO: 128081 - protein, 32 aa, Artificial Sequence
  Description of Artificial Sequence: Synthetic polypeptide
DENEIRTTNPVSTEQYGTISTDIQEQHNGEDH

SEQ ID NO: 128082 - protein, 33 aa, Artificial Sequence
  Description of Artificial Sequence: Synthetic polypeptide
CEEEIRTTNPVATEQYGCVCSWPETQNFGSEQS

SEQ ID NO: 128083 - protein, 39 aa, Artificial Sequence
  Description of Artificial Sequence: Synthetic polypeptide
DEEEIRTTNPVATEQYGSVSTVVNNNLQQLGNEDEEEED

SEQ ID NO: 128084 - protein, 39 aa, Artificial Sequence
  Description of Artificial Sequence: Synthetic polypeptide
DEEEIRTTNPVATEQYGSVSTVVNNNLQQGNNQDESEET

SEQ ID NO: 128085 - protein, 32 aa, Artificial Sequence
  Description of Artificial Sequence: Synthetic polypeptide
DENEIRTTNPVSTEQYGTISMEDIQQQQNGNH

SEQ ID NO: 128086 - protein, 32 aa, Artificial Sequence
  Description of Artificial Sequence: Synthetic polypeptide
DENEIRTTNPVSTEQYGTISMEDIQQQQNGNA

SEQ ID NO: 128087 - protein, 32 aa, Artificial Sequence
  Description of Artificial Sequence: Synthetic polypeptide
DENEIRTTNPVSTEQYGTISMEDIQQQHNGNK

SEQ ID NO: 128088 - protein, 32 aa, Artificial Sequence
  Description of Artificial Sequence: Synthetic polypeptide
DENEIRTTNPVSTEQYGTISMEDIQQQHNGNH

SEQ ID NO: 128089 - protein, 32 aa, Artificial Sequence
  Description of Artificial Sequence: Synthetic polypeptide
DENEIRTTNPVSTEQYGTISMEDEQQQQNGNA

SEQ ID NO: 128090 - protein, 32 aa, Artificial Sequence
  Description of Artificial Sequence: Synthetic polypeptide
DENEIRTTNPVSTEQYGTISMEDEQQQQAGNA

SEQ ID NO: 128091 - protein, 38 aa, Artificial Sequence
  Description of Artificial Sequence: Synthetic polypeptide
DEEEIRTTNPVATEQYGSVSTVVNNNGNQQGNNNEQEG

SEQ ID NO: 128092 - protein, 31 aa, Artificial Sequence
  Description of Artificial Sequence: Synthetic polypeptide
DENEIRTTNPVSTEQYGTISMDEQQQQAENA

SEQ ID NO: 128093 - protein, 37 aa, Artificial Sequence
  Description of Artificial Sequence: Synthetic polypeptide
DEEEIRTTNPVATEQYGSVSTVVNNNDEAGTTTNTTD

SEQ ID NO: 128094 - protein, 33 aa, Artificial Sequence
  Description of Artificial Sequence: Synthetic polypeptide
DESEIRTTNPVGTECWGSVSCINEPQDREGEGG

SEQ ID NO: 128095 - protein, 32 aa, Artificial Sequence
  Description of Artificial Sequence: Synthetic polypeptide
DENEIRTTNPVSTEQYGTISMDDIQQQQNGNH

SEQ ID NO: 128096 - protein, 31 aa, Artificial Sequence
  Description of Artificial Sequence: Synthetic polypeptide
DEQEIASTNPVATEQYGVMSTTLEDHEGDDI

SEQ ID NO: 128097 - protein, 31 aa, Artificial Sequence
  Description of Artificial Sequence: Synthetic polypeptide
DEQEIASTNPVATEQYGVMSTTLEDHEGDDL

SEQ ID NO: 128098 - protein, 32 aa, Artificial Sequence
  Description of Artificial Sequence: Synthetic polypeptide
DENEIRTTNPVSTEQYGTISCEDIQQQQNGNH

SEQ ID NO: 128099 - protein, 38 aa, Artificial Sequence
  Description of Artificial Sequence: Synthetic polypeptide
DEEEIRTTNPVATEQYGSVSTVVNNLQQLENQEEEEED

SEQ ID NO: 128100 - protein, 33 aa, Artificial Sequence
  Description of Artificial Sequence: Synthetic polypeptide
DENEIRTTNPVSTEQYGTISTEDIQEQHNGNDH

SEQ ID NO: 128101 - protein, 33 aa, Artificial Sequence
  Description of Artificial Sequence: Synthetic polypeptide
DENEIRTTNPVSTEQYGTISATEDIEQQNGNDH

SEQ ID NO: 128102 - protein, 33 aa, Artificial Sequence
  Description of Artificial Sequence: Synthetic polypeptide
DENEIRTTNPVSTEQYGTISTEDIQQMQNGMNH

SEQ ID NO: 128103 - protein, 34 aa, Artificial Sequence
  Description of Artificial Sequence: Synthetic polypeptide
DENEIRTTNPVSTEQYGTISTMEDGQNQQNGMNH

SEQ ID NO: 128104 - protein, 34 aa, Artificial Sequence
  Description of Artificial Sequence: Synthetic polypeptide
DEAEIRTTNPVATEQYGSVHPTVVDNQEQGSDQV

SEQ ID NO: 128105 - protein, 34 aa, Artificial Sequence
  Description of Artificial Sequence: Synthetic polypeptide
DENEIRTTNPVSTEQYGTVSSMEAIPNQQNGNPH

SEQ ID NO: 128106 - protein, 32 aa, Artificial Sequence
  Description of Artificial Sequence: Synthetic polypeptide
DEQEIASTNPVATEQYGNVSATDLEDHEGEDL

SEQ ID NO: 128107 - protein, 32 aa, Artificial Sequence
  Description of Artificial Sequence: Synthetic polypeptide
DEQEIASTNPVATEQYGNVSATDLESHEGEDL

SEQ ID NO: 128108 - protein, 29 aa, Artificial Sequence
  Description of Artificial Sequence: Synthetic peptide
DESEIRTTNPVGTEQWGDVSEIEMNAEDA

SEQ ID NO: 128109 - protein, 33 aa, Artificial Sequence
  Description of Artificial Sequence: Synthetic polypeptide
DEAEIRTTNPVATEQYGSVHELQLNTLEDEEQN

SEQ ID NO: 128110 - protein, 34 aa, Artificial Sequence
  Description of Artificial Sequence: Synthetic polypeptide
DESEIRTTNPVGTEGYGVVSSTPTGPQRNGMNPV

SEQ ID NO: 128111 - protein, 33 aa, Artificial Sequence
  Description of Artificial Sequence: Synthetic polypeptide
DENEIRTTNPVSTEQYGTVSATDIQEQHNGEDH

SEQ ID NO: 128112 - protein, 33 aa, Artificial Sequence
  Description of Artificial Sequence: Synthetic polypeptide
DENEIRTTNPVSTEQYGTVCSMEDIQQQQNGNH

SEQ ID NO: 128113 - protein, 34 aa, Artificial Sequence
  Description of Artificial Sequence: Synthetic polypeptide
DENEIRTTNPVSTEQYGTISTTPDGQNMRNGMNH

SEQ ID NO: 128114 - protein, 34 aa, Artificial Sequence
  Description of Artificial Sequence: Synthetic polypeptide
DENEIRTTNPVSTEQYGTISTTPDGQNMQNGMNH

SEQ ID NO: 128115 - protein, 34 aa, Artificial Sequence
  Description of Artificial Sequence: Synthetic polypeptide
DENEIRTTNPVSTEQYGTISTTEDGQNQQNGMNH

SEQ ID NO: 128116 - protein, 38 aa, Artificial Sequence
  Description of Artificial Sequence: Synthetic polypeptide
DEEEIRTTNPVATEQYGSVSTVVNNNNQQGTTEQGNDE

SEQ ID NO: 128117 - protein, 35 aa, Artificial Sequence
  Description of Artificial Sequence: Synthetic polypeptide
DESEIRTTNPVGTEGYGSVSSTSPALNMRNGMNPV

SEQ ID NO: 128118 - protein, 32 aa, Artificial Sequence
  Description of Artificial Sequence: Synthetic polypeptide
DEQEIASTNPVATEQYGSVSANDIESHEGEDL

SEQ ID NO: 128119 - protein, 34 aa, Artificial Sequence
  Description of Artificial Sequence: Synthetic polypeptide
DENEIRTTNPVSTEQYGTISTTEDGQNMQNGMNH

SEQ ID NO: 128120 - protein, 37 aa, Artificial Sequence
  Description of Artificial Sequence: Synthetic polypeptide
DEEEIRTTNPVATEQYGSVSTVVNNNNLQQNETEEDE

SEQ ID NO: 128121 - protein, 34 aa, Artificial Sequence
  Description of Artificial Sequence: Synthetic polypeptide
DETEIATTNPVATEQYGSVCTTPGQPEGGDNSDV

SEQ ID NO: 128122 - protein, 38 aa, Artificial Sequence
  Description of Artificial Sequence: Synthetic polypeptide
DEEEIRTTNPVATEQYGSVSTVVNNNNDQQGNNDEQNG

SEQ ID NO: 128123 - protein, 33 aa, Artificial Sequence
  Description of Artificial Sequence: Synthetic polypeptide
DENEIRTTNPVSTEQYGTISTEDIQQQHNGNDH

SEQ ID NO: 128124 - protein, 33 aa, Artificial Sequence
  Description of Artificial Sequence: Synthetic polypeptide
DEDEIRTTNPCATECYGEVSTGNLGNAGEHGTE

SEQ ID NO: 128125 - protein, 33 aa, Artificial Sequence
  Description of Artificial Sequence: Synthetic polypeptide
DENEIRTTNPVSTEQYGTISATEDIEQHNGNDH

SEQ ID NO: 128126 - protein, 32 aa, Artificial Sequence
  Description of Artificial Sequence: Synthetic polypeptide
DENEIRTTNPVSTEQYGTASMEDIQQQQNGNH

SEQ ID NO: 128127 - protein, 30 aa, Artificial Sequence
  Description of Artificial Sequence: Synthetic polypeptide
DENEIRTTNPVSTEQWGIVSEIEMNAAGDA

SEQ ID NO: 128128 - protein, 36 aa, Artificial Sequence
  Description of Artificial Sequence: Synthetic polypeptide
DEEEIRTTNPVATEQYGSVSSTTPAGPTMRNGMPPV

SEQ ID NO: 128129 - protein, 30 aa, Artificial Sequence
  Description of Artificial Sequence: Synthetic polypeptide
AETEIRCTNPVATEQYGEAWAENLAEPGGI

SEQ ID NO: 128130 - protein, 30 aa, Artificial Sequence
  Description of Artificial Sequence: Synthetic polypeptide
DENEIRTTNPVSTEQWGDVSNIEMNRAEDA

SEQ ID NO: 128131 - protein, 37 aa, Artificial Sequence
  Description of Artificial Sequence: Synthetic polypeptide
DEEEIRTTNPVATEQYGSVSSTTPAGPTMRNGMNPVD

SEQ ID NO: 128132 - protein, 32 aa, Artificial Sequence
  Description of Artificial Sequence: Synthetic polypeptide
DEQEIATCNPVATEQYGSVSATDFEDHEGEDL

SEQ ID NO: 128133 - protein, 33 aa, Artificial Sequence
  Description of Artificial Sequence: Synthetic polypeptide
DETEIATTNPVATEQYGTVASATDGPMEMEGNA

SEQ ID NO: 128134 - protein, 30 aa, Artificial Sequence
  Description of Artificial Sequence: Synthetic polypeptide
DENEIRTTNPVSTEQWGDVSEIEQNAAEDA

SEQ ID NO: 128135 - protein, 30 aa, Artificial Sequence
  Description of Artificial Sequence: Synthetic polypeptide
DENEIRTTNPVSTEQWGDVSEIEMNANGDA

SEQ ID NO: 128136 - protein, 33 aa, Artificial Sequence
  Description of Artificial Sequence: Synthetic polypeptide
DEQEIATCNPVATEQYGSVSATDLEDHEGKEDL

SEQ ID NO: 128137 - protein, 33 aa, Artificial Sequence
  Description of Artificial Sequence: Synthetic polypeptide
DEQEIATCNPVATEQYGSVSATLDLEDHEGEDL

SEQ ID NO: 128138 - protein, 33 aa, Artificial Sequence
  Description of Artificial Sequence: Synthetic polypeptide
DEAEIRTTNPVATEQYGSVEVPEDSHDLGFERA

SEQ ID NO: 128139 - protein, 37 aa, Artificial Sequence
  Description of Artificial Sequence: Synthetic polypeptide
DEEEIRTTNPVATEQYGSVSSTTPAGPPMRNGMNPVK

SEQ ID NO: 128140 - protein, 30 aa, Artificial Sequence
  Description of Artificial Sequence: Synthetic polypeptide
DENEIRTTNPVSTEQWGDVANIEQNRAEDA

SEQ ID NO: 128141 - protein, 32 aa, Artificial Sequence
  Description of Artificial Sequence: Synthetic polypeptide
DEQEIATTNAVATEQYGSVSATDLEDHETEDL

SEQ ID NO: 128142 - protein, 34 aa, Artificial Sequence
  Description of Artificial Sequence: Synthetic polypeptide
DETEIATTNPVATEVWGSVCYTNDSQDQGGDNDR

SEQ ID NO: 128143 - protein, 33 aa, Artificial Sequence
  Description of Artificial Sequence: Synthetic polypeptide
DEQEIATTNCVATEQYGSVASATDLEDHEGEIL

SEQ ID NO: 128144 - protein, 33 aa, Artificial Sequence
  Description of Artificial Sequence: Synthetic polypeptide
DESEIRTTNPVCTECWGSVSCINEPQDSEGENG

SEQ ID NO: 128145 - protein, 38 aa, Artificial Sequence
  Description of Artificial Sequence: Synthetic polypeptide
DEEEIRTTNPVATEQYGSVSTVVNDQQGNQQGTEQGTD

SEQ ID NO: 128146 - protein, 30 aa, Artificial Sequence
  Description of Artificial Sequence: Synthetic polypeptide
DENEIRTTNPVSTEQWGNVSEIEQNAAEDA

SEQ ID NO: 128147 - protein, 38 aa, Artificial Sequence
  Description of Artificial Sequence: Synthetic polypeptide
DEEEIRTTNPVATEQYGSVSTVVNNLNQQNQNEEETTD

SEQ ID NO: 128148 - protein, 30 aa, Artificial Sequence
  Description of Artificial Sequence: Synthetic polypeptide
DENEIRTTNPVSTEQWGNVSEIIQNAAEDA

SEQ ID NO: 128149 - protein, 30 aa, Artificial Sequence
  Description of Artificial Sequence: Synthetic polypeptide
DENEIRTTNPVSTEQWGNVSEIIQNAVEQA

SEQ ID NO: 128150 - protein, 33 aa, Artificial Sequence
  Description of Artificial Sequence: Synthetic polypeptide
DESEIRTTNPVGTECWGSVSCINEPFDREGENG

SEQ ID NO: 128151 - protein, 31 aa, Artificial Sequence
  Description of Artificial Sequence: Synthetic polypeptide
DENEIRTTNPVSTEQYGTASMEDIQQQQENH

SEQ ID NO: 128152 - protein, 30 aa, Artificial Sequence
  Description of Artificial Sequence: Synthetic polypeptide
DENEIRTTNPVSTEQYGTAPMEDIQQQENH

SEQ ID NO: 128153 - protein, 30 aa, Artificial Sequence
  Description of Artificial Sequence: Synthetic polypeptide
DENEIRTTNPVSTEQYGTAPMEDIQQHENK

SEQ ID NO: 128154 - protein, 30 aa, Artificial Sequence
  Description of Artificial Sequence: Synthetic polypeptide
DENEIRTTNPVSTEQYGTAPMEDIQQHENH

SEQ ID NO: 128155 - protein, 31 aa, Artificial Sequence
  Description of Artificial Sequence: Synthetic polypeptide
DEQEIASTNPVSTEGYGNVAANDLQDREGQL

SEQ ID NO: 128156 - protein, 31 aa, Artificial Sequence
  Description of Artificial Sequence: Synthetic polypeptide
DEQEIASTNPVSTEGYGNVAANDLQDRVGQL

SEQ ID NO: 128157 - protein, 31 aa, Artificial Sequence
  Description of Artificial Sequence: Synthetic polypeptide
DEQEIASTNPVSTEGYGSVAANTLQSHVGEL

SEQ ID NO: 128158 - protein, 30 aa, Artificial Sequence
  Description of Artificial Sequence: Synthetic polypeptide
DENEIRTTNPVSTEQYGNVANTIMSAAEDA

SEQ ID NO: 128159 - protein, 36 aa, Artificial Sequence
  Description of Artificial Sequence: Synthetic polypeptide
DEAEIRTTNPVATEQYGSVFSSTDSGLDTGSSNDEY

SEQ ID NO: 128160 - protein, 33 aa, Artificial Sequence
  Description of Artificial Sequence: Synthetic polypeptide
DESEIRTTNPVGTECWGSMSCITEPQDREGENG

SEQ ID NO: 128161 - protein, 32 aa, Artificial Sequence
  Description of Artificial Sequence: Synthetic polypeptide
DENEIRTTNPVSTEQYGEISMEVCQQQHNGNH

SEQ ID NO: 128162 - protein, 32 aa, Artificial Sequence
  Description of Artificial Sequence: Synthetic polypeptide
DENEIRTTNPVSTEQYGEISMEDIQQQQNGNH

SEQ ID NO: 128163 - protein, 32 aa, Artificial Sequence
  Description of Artificial Sequence: Synthetic polypeptide
DENEIRTTNPVSTEQYGEISMEDCQQQQNGNH

SEQ ID NO: 128164 - protein, 36 aa, Artificial Sequence
  Description of Artificial Sequence: Synthetic polypeptide
DEAEIRTTNPVATEQYGSVFNPTDNVNEQTIEGNNE

SEQ ID NO: 128165 - protein, 33 aa, Artificial Sequence
  Description of Artificial Sequence: Synthetic polypeptide
DESEIRTTNPVGTECWGSMSCINEPQDREGENG

SEQ ID NO: 128166 - protein, 36 aa, Artificial Sequence
  Description of Artificial Sequence: Synthetic polypeptide
DEEEIRTTNPVATEQYGSVSSTTPAGPWMDNGMNPV

SEQ ID NO: 128167 - protein, 30 aa, Artificial Sequence
  Description of Artificial Sequence: Synthetic polypeptide
DENEIRTTNPVSTEQYGDVANTIMSAAEDA

SEQ ID NO: 128168 - protein, 31 aa, Artificial Sequence
  Description of Artificial Sequence: Synthetic polypeptide
DENEIRTTNPVSTEQWGTVSMEDIQNANGDA

SEQ ID NO: 128169 - protein, 30 aa, Artificial Sequence
  Description of Artificial Sequence: Synthetic polypeptide
DENEIRTTNPVSTEQWGNVSEIIQNAAEQA

SEQ ID NO: 128170 - protein, 32 aa, Artificial Sequence
  Description of Artificial Sequence: Synthetic polypeptide
DETEIATTNPVAYECWGSVSQSNMGNLGGGNP

SEQ ID NO: 128171 - protein, 36 aa, Artificial Sequence
  Description of Artificial Sequence: Synthetic polypeptide
DEAEIRTTNPVATEQYGSVHSKINWNTQEGDEENQN

SEQ ID NO: 128172 - protein, 32 aa, Artificial Sequence
  Description of Artificial Sequence: Synthetic polypeptide
DEQEIASTNPVATEQYGGVSATDLEDHEGEDL

SEQ ID NO: 128173 - protein, 34 aa, Artificial Sequence
  Description of Artificial Sequence: Synthetic polypeptide
DEDEIRTTNPVATEHYGSVVSEGCMSSQHGGSPR

SEQ ID NO: 128174 - protein, 33 aa, Artificial Sequence
  Description of Artificial Sequence: Synthetic polypeptide
DEQEIAGTNPVATEQYGSVSATWDLEDHEGEDL

SEQ ID NO: 128175 - protein, 33 aa, Artificial Sequence
  Description of Artificial Sequence: Synthetic polypeptide
DEQEIAGTNPVATEQYGSVSSTDLEVHEGEDLC

SEQ ID NO: 128176 - protein, 33 aa, Artificial Sequence
  Description of Artificial Sequence: Synthetic polypeptide
DEQEIAGTNPVATEQYGSVYSATDLEDHEGEDL

SEQ ID NO: 128177 - protein, 38 aa, Artificial Sequence
  Description of Artificial Sequence: Synthetic polypeptide
DEEEIRTTNPVATEQYGSVSTVVNNQQGNQQGTEAGED

SEQ ID NO: 128178 - protein, 32 aa, Artificial Sequence
  Description of Artificial Sequence: Synthetic polypeptide
DEQEIAMTNPVATSQYGSVSATDLEDHEGEDL

SEQ ID NO: 128179 - protein, 28 aa, Artificial Sequence
  Description of Artificial Sequence: Synthetic peptide
AESEIASTNPVGTEGYGEMASNLQHGDI

SEQ ID NO: 128180 - protein, 34 aa, Artificial Sequence
  Description of Artificial Sequence: Synthetic polypeptide
DETEIATTNPVATEQYGSACATNPLADDPGDNDI

SEQ ID NO: 128181 - protein, 32 aa, Artificial Sequence
  Description of Artificial Sequence: Synthetic polypeptide
DETEIATTNPVATEQYGSTSAADLADHEGEDI

SEQ ID NO: 128182 - protein, 32 aa, Artificial Sequence
  Description of Artificial Sequence: Synthetic polypeptide
DETEIATTNPVATEQYGSTSAADLADHEGEDL

SEQ ID NO: 128183 - protein, 32 aa, Artificial Sequence
  Description of Artificial Sequence: Synthetic polypeptide
DETEIATTNPVATEQYGSTSAADLADHKGEYI

SEQ ID NO: 128184 - protein, 34 aa, Artificial Sequence
  Description of Artificial Sequence: Synthetic polypeptide
DESEIRTTNPVGTEQWGSVVSCTGTPSARGGNGD

SEQ ID NO: 128185 - protein, 38 aa, Artificial Sequence
  Description of Artificial Sequence: Synthetic polypeptide
DEEEIRTTNPVATEQYGSVSTVVNNQQGNQAGTTNQES

SEQ ID NO: 128186 - protein, 33 aa, Artificial Sequence
  Description of Artificial Sequence: Synthetic polypeptide
DETEIATTNPVATEQYGSVAAANIDEQDNGTEH

SEQ ID NO: 128187 - protein, 35 aa, Artificial Sequence
  Description of Artificial Sequence: Synthetic polypeptide
DETEIATTNPVATEQYGSVAAANNLQEAPGENMTA

SEQ ID NO: 128188 - protein, 37 aa, Artificial Sequence
  Description of Artificial Sequence: Synthetic polypeptide
DEEEIRTTNPVATEQYGSVSSTTPAIGPNMRNGMNPV

SEQ ID NO: 128189 - protein, 33 aa, Artificial Sequence
  Description of Artificial Sequence: Synthetic polypeptide
DETEIATTNPVATEQYGSVAANNPDQEHNNQME

SEQ ID NO: 128190 - protein, 38 aa, Artificial Sequence
  Description of Artificial Sequence: Synthetic polypeptide
DEEEIRTTNPVATEQYGSVSTVVNNQQGNNQQTNTEEA

SEQ ID NO: 128191 - protein, 38 aa, Artificial Sequence
  Description of Artificial Sequence: Synthetic polypeptide
DEEEIRTTNPVATEQYGSVSTVVNNQQGNNQQNETTDT

SEQ ID NO: 128192 - protein, 37 aa, Artificial Sequence
  Description of Artificial Sequence: Synthetic polypeptide
DEEEIRTTNPVATEQYGSVSSTTPAKGANMRNGMNPV

SEQ ID NO: 128193 - protein, 34 aa, Artificial Sequence
  Description of Artificial Sequence: Synthetic polypeptide
DETEIATTNPVATEQYGSVAATNPPGQEHNNQAE

SEQ ID NO: 128194 - protein, 34 aa, Artificial Sequence
  Description of Artificial Sequence: Synthetic polypeptide
DETEIATTNPVATEQYGCVADTWLAQPNDSGNHE

SEQ ID NO: 128195 - protein, 34 aa, Artificial Sequence
  Description of Artificial Sequence: Synthetic polypeptide
DETEIATTNPVATEQYGCVAATANPPADDGGNGR

SEQ ID NO: 128196 - protein, 38 aa, Artificial Sequence
  Description of Artificial Sequence: Synthetic polypeptide
DEEEIRTTNPVATEQYGSVSTVVNNQQNNNQGNTNEDE

SEQ ID NO: 128197 - protein, 32 aa, Artificial Sequence
  Description of Artificial Sequence: Synthetic polypeptide
CEEEIRTTNPIATEQYGSCSVGDIGFHGDNQD

SEQ ID NO: 128198 - protein, 38 aa, Artificial Sequence
  Description of Artificial Sequence: Synthetic polypeptide
DEEEIRTTNPVATEQYGSVSTVVNNQQGTNQQNETEET

SEQ ID NO: 128199 - protein, 33 aa, Artificial Sequence
  Description of Artificial Sequence: Synthetic polypeptide
DESEIRTTNPVGTKCWGSVSCINEPQDREGENG

SEQ ID NO: 128200 - protein, 33 aa, Artificial Sequence
  Description of Artificial Sequence: Synthetic polypeptide
DETEIATTNPVATEQWGSVSGTGNPDNHGAEAP

SEQ ID NO: 128201 - protein, 34 aa, Artificial Sequence
  Description of Artificial Sequence: Synthetic polypeptide
DESEIRTTNPVGTESYGSVVSCTGSEPSARGNND

SEQ ID NO: 128202 - protein, 35 aa, Artificial Sequence
  Description of Artificial Sequence: Synthetic polypeptide
DESEIRTTNPVGTEQYGSVSSTTPAGPNRNGMNPV

SEQ ID NO: 128203 - protein, 33 aa, Artificial Sequence
  Description of Artificial Sequence: Synthetic polypeptide
DETEIATTNPVATEQWGSVSGTGPPDNNGNPPA

SEQ ID NO: 128204 - protein, 37 aa, Artificial Sequence
  Description of Artificial Sequence: Synthetic polypeptide
DEEEIRTTNPVATEQYGSVSSTTPALGPNMVNGGNPV

SEQ ID NO: 128205 - protein, 33 aa, Artificial Sequence
  Description of Artificial Sequence: Synthetic polypeptide
DEDEIRTTNPCATECYGQVSTGNTGNAGENNEE

SEQ ID NO: 128206 - protein, 36 aa, Artificial Sequence
  Description of Artificial Sequence: Synthetic polypeptide
DEEEIRTTNPVATEQYGSVSSTTPAKPNMRNNMNPV

SEQ ID NO: 128207 - protein, 35 aa, Artificial Sequence
  Description of Artificial Sequence: Synthetic polypeptide
DESEIRTTNPVGTEQYGSVSSTSPAGNMRNGMNPV

SEQ ID NO: 128208 - protein, 33 aa, Artificial Sequence
  Description of Artificial Sequence: Synthetic polypeptide
DEQEIAGTNPVATEQYGSVSATDHLEDHEGEDL

SEQ ID NO: 128209 - protein, 28 aa, Artificial Sequence
  Description of Artificial Sequence: Synthetic peptide
AESEIASTNPVGTEGYGVMASNLQHGDI

SEQ ID NO: 128210 - protein, 32 aa, Artificial Sequence
  Description of Artificial Sequence: Synthetic polypeptide
DETEIATTNPVATEQWGTVSHTDMQQNGGGSN

SEQ ID NO: 128211 - protein, 37 aa, Artificial Sequence
  Description of Artificial Sequence: Synthetic polypeptide
DEEEIRTTNPVATEQYGSVSSTTPAKGPNMRNGMNVV

SEQ ID NO: 128212 - protein, 34 aa, Artificial Sequence
  Description of Artificial Sequence: Synthetic polypeptide
DETEIATTNPVATEQYGAVCSTIEGGNRNGDNGV

SEQ ID NO: 128213 - protein, 37 aa, Artificial Sequence
  Description of Artificial Sequence: Synthetic polypeptide
DEEEIRTTNPVATEQYGSVSSTTPAKGPNMRNGMNPV

SEQ ID NO: 128214 - protein, 33 aa, Artificial Sequence
  Description of Artificial Sequence: Synthetic polypeptide
DETEIATTNPVATEQYGCVAANGGPPADMGNGR

SEQ ID NO: 128215 - protein, 37 aa, Artificial Sequence
  Description of Artificial Sequence: Synthetic polypeptide
DEEEIRTTNPVATEQYGSVSSTTPAKGPNMRNGMDPV

SEQ ID NO: 128216 - protein, 34 aa, Artificial Sequence
  Description of Artificial Sequence: Synthetic polypeptide
DEAEIRTTNPVATEQYGSVHSTIEDNTVEDEEQN

SEQ ID NO: 128217 - protein, 38 aa, Artificial Sequence
  Description of Artificial Sequence: Synthetic polypeptide
DEEEIRTTNPVATEQYGSVSTVVNNQQGNNQQEETTEE

SEQ ID NO: 128218 - protein, 36 aa, Artificial Sequence
  Description of Artificial Sequence: Synthetic polypeptide
DEEEIRTTNPVATEQYGSVSSTTPAHPNMRNGMHPV

SEQ ID NO: 128219 - protein, 34 aa, Artificial Sequence
  Description of Artificial Sequence: Synthetic polypeptide
DETEIATTNPVATEQYGSVCAADNNDQGRMIQND

SEQ ID NO: 128220 - protein, 33 aa, Artificial Sequence
  Description of Artificial Sequence: Synthetic polypeptide
DETEIATTNPVATEQYGSVCAAMHDQDSDGNDN

SEQ ID NO: 128221 - protein, 33 aa, Artificial Sequence
  Description of Artificial Sequence: Synthetic polypeptide
DETEIATTNPVATEQYGSVCAAMHDQDSDGNPE

SEQ ID NO: 128222 - protein, 38 aa, Artificial Sequence
  Description of Artificial Sequence: Synthetic polypeptide
DEEEIRTTNPVATEQYGSVSTVVNNQNGNQAGTETGED

SEQ ID NO: 128223 - protein, 32 aa, Artificial Sequence
  Description of Artificial Sequence: Synthetic polypeptide
DENEIRTTNPVSTEYYGTISTEDIQQQQNGNH

SEQ ID NO: 128224 - protein, 34 aa, Artificial Sequence
  Description of Artificial Sequence: Synthetic polypeptide
DETEIATTNPVATEQYGSVCAAMNPLNDMDGNNH

SEQ ID NO: 128225 - protein, 38 aa, Artificial Sequence
  Description of Artificial Sequence: Synthetic polypeptide
DEEEIRTTNPVATEQYGSVSTVVNNQAGNQAGTEAGEE

SEQ ID NO: 128226 - protein, 34 aa, Artificial Sequence
  Description of Artificial Sequence: Synthetic polypeptide
DETEIATTNPVATEQYGSVCAAMNPLNDMDPGNY

SEQ ID NO: 128227 - protein, 33 aa, Artificial Sequence
  Description of Artificial Sequence: Synthetic polypeptide
DETEIATTNPVATEQYGSVCAAMNPLNHMDGGN

SEQ ID NO: 128228 - protein, 34 aa, Artificial Sequence
  Description of Artificial Sequence: Synthetic polypeptide
DETEIATTNPVATEQYGSVCAANNGDEQDRKIER

SEQ ID NO: 128229 - protein, 34 aa, Artificial Sequence
  Description of Artificial Sequence: Synthetic polypeptide
DETEIATTNPVATEQYGSVCAANNGDEQDRSINL

SEQ ID NO: 128230 - protein, 35 aa, Artificial Sequence
  Description of Artificial Sequence: Synthetic polypeptide
DETEIATTNPVATEQYGSVCAANNLQEAEGGNMDD

SEQ ID NO: 128231 - protein, 34 aa, Artificial Sequence
  Description of Artificial Sequence: Synthetic polypeptide
DETEIATTNPVATEQYGSVCAAQNGDEQTADINR

SEQ ID NO: 128232 - protein, 35 aa, Artificial Sequence
  Description of Artificial Sequence: Synthetic polypeptide
DETEIATTNPVATEQYGSVCAMTNGELNNDGEHNL

SEQ ID NO: 128233 - protein, 32 aa, Artificial Sequence
  Description of Artificial Sequence: Synthetic polypeptide
DENEIRTTNPVSTEVYGTCSMVAIQQQQPGNH

SEQ ID NO: 128234 - protein, 36 aa, Artificial Sequence
  Description of Artificial Sequence: Synthetic polypeptide
DETEIATTNPVATEQYGSVCAMTNGELQDNGQEHNL

SEQ ID NO: 128235 - protein, 31 aa, Artificial Sequence
  Description of Artificial Sequence: Synthetic polypeptide
DEQEIASTNPVATEGYGVVSATDLEDHEGDL

SEQ ID NO: 128236 - protein, 39 aa, Artificial Sequence
  Description of Artificial Sequence: Synthetic polypeptide
DEEEIRTTNPVATEQYGSVSTVVNNNQLGNQQGEGNNNE

SEQ ID NO: 128237 - protein, 35 aa, Artificial Sequence
  Description of Artificial Sequence: Synthetic polypeptide
DEAEIRTTNPVATEQYGSVHSTRNWNTEEGDEEQN

SEQ ID NO: 128238 - protein, 33 aa, Artificial Sequence
  Description of Artificial Sequence: Synthetic polypeptide
DEQEIAQTNPVATEQYGSVSATDLTEDHEGEDL

SEQ ID NO: 128239 - protein, 33 aa, Artificial Sequence
  Description of Artificial Sequence: Synthetic polypeptide
DEQEIAPTNPVATEQYGNSVSATDLEDHEGEDL

SEQ ID NO: 128240 - protein, 33 aa, Artificial Sequence
  Description of Artificial Sequence: Synthetic polypeptide
DETEIATTNPVATEQYGSVCAADNNDDASINDR

SEQ ID NO: 128241 - protein, 34 aa, Artificial Sequence
  Description of Artificial Sequence: Synthetic polypeptide
DETEIATTNPVATEQYGSVCAADNGDQDMSINMR

SEQ ID NO: 128242 - protein, 33 aa, Artificial Sequence
  Description of Artificial Sequence: Synthetic polypeptide
DETEIATTNPVATEQYGSVANANNLDEANNNTE

SEQ ID NO: 128243 - protein, 34 aa, Artificial Sequence
  Description of Artificial Sequence: Synthetic polypeptide
DETEIATTNPVATEQYGSVANANNLTEAGENMNE

SEQ ID NO: 128244 - protein, 38 aa, Artificial Sequence
  Description of Artificial Sequence: Synthetic polypeptide
DEEEIRTTNPVATEQYGSVSTVVNNQQGNNQNETDETD

SEQ ID NO: 128245 - protein, 38 aa, Artificial Sequence
  Description of Artificial Sequence: Synthetic polypeptide
DEEEIRTTNPVATEQYGSVSTVVNNQQGNNQGNQNNTD

SEQ ID NO: 128246 - protein, 38 aa, Artificial Sequence
  Description of Artificial Sequence: Synthetic polypeptide
DEEEIRTTNPVATEQYGSVSTVVNNQQGNNQGNNTEET

SEQ ID NO: 128247 - protein, 32 aa, Artificial Sequence
  Description of Artificial Sequence: Synthetic polypeptide
DETEIATTNPVATEQYGSVANTDWEDHEGEDI

SEQ ID NO: 128248 - protein, 30 aa, Artificial Sequence
  Description of Artificial Sequence: Synthetic polypeptide
DESEIRTTNPVGTEQWGDVSSIEMNAAGDA

SEQ ID NO: 128249 - protein, 33 aa, Artificial Sequence
  Description of Artificial Sequence: Synthetic polypeptide
DETEIATTNPVATEQYGSVANTGNGEYGDEGGA

SEQ ID NO: 128250 - protein, 34 aa, Artificial Sequence
  Description of Artificial Sequence: Synthetic polypeptide
DETEIATTNPVATEQYGSVANTNEPGQEHNNQHE

SEQ ID NO: 128251 - protein, 38 aa, Artificial Sequence
  Description of Artificial Sequence: Synthetic polypeptide
DEEEIRTTNPVATEQYGSVSTVVNNQQGNNQEEQGTTD

SEQ ID NO: 128252 - protein, 38 aa, Artificial Sequence
  Description of Artificial Sequence: Synthetic polypeptide
DEEEIRTTNPVATEQYGSVSTVVNNQQGNNQEEATEEE

SEQ ID NO: 128253 - protein, 38 aa, Artificial Sequence
  Description of Artificial Sequence: Synthetic polypeptide
DEEEIRTTNPVATEQYGSVSTVVNNQQGNNQDETETTD

SEQ ID NO: 128254 - protein, 37 aa, Artificial Sequence
  Description of Artificial Sequence: Synthetic polypeptide
DEEEIRTTNPVATEQYGSVSSTTPAHGPPMRNGMNPV

SEQ ID NO: 128255 - protein, 37 aa, Artificial Sequence
  Description of Artificial Sequence: Synthetic polypeptide
DEEEIRTTNPVATEQYGSVSSTTPAHGPNMRNGMNPV

SEQ ID NO: 128256 - protein, 37 aa, Artificial Sequence
  Description of Artificial Sequence: Synthetic polypeptide
DEEEIRTTNPVATEQYGSVSSTTPAHGPNMRNGMNPK

SEQ ID NO: 128257 - protein, 38 aa, Artificial Sequence
  Description of Artificial Sequence: Synthetic polypeptide
DEEEIRTTNPVATEQYGSVSTVVNNQQGNNDEETEEEA

SEQ ID NO: 128258 - protein, 34 aa, Artificial Sequence
  Description of Artificial Sequence: Synthetic polypeptide
DETEIATTNPVATEQYGSVCAAANGLNMEGENEH

SEQ ID NO: 128259 - protein, 35 aa, Artificial Sequence
  Description of Artificial Sequence: Synthetic polypeptide
DETEIATTNPVATEQYGSVCAADNGDEQDRSINAR

SEQ ID NO: 128260 - protein, 34 aa, Artificial Sequence
  Description of Artificial Sequence: Synthetic polypeptide
DETEIATTNPVATEQYGSVCAADNGDEQDSMINR

SEQ ID NO: 128261 - protein, 38 aa, Artificial Sequence
  Description of Artificial Sequence: Synthetic polypeptide
DEEEIRTTNPVATEQYGSVSTVVNNQNQQQGNNQENEE

SEQ ID NO: 128262 - protein, 34 aa, Artificial Sequence
  Description of Artificial Sequence: Synthetic polypeptide
DESEIRTTNPVATWCWGSVSCINEPQDREGENTG

SEQ ID NO: 128263 - protein, 32 aa, Artificial Sequence
  Description of Artificial Sequence: Synthetic polypeptide
DETEIATTNPVAYEEWGSVSGGNGNAGNDQQR

SEQ ID NO: 128264 - protein, 34 aa, Artificial Sequence
  Description of Artificial Sequence: Synthetic polypeptide
DEDEIRGTNPVGTEQYGSVSTDNTGQGEGGQEEE

SEQ ID NO: 128265 - protein, 33 aa, Artificial Sequence
  Description of Artificial Sequence: Synthetic polypeptide
DESEIRTTNPVAYEPWGSVSCANFSDDREGGNE

SEQ ID NO: 128266 - protein, 36 aa, Artificial Sequence
  Description of Artificial Sequence: Synthetic polypeptide
DEEEIRTTNPVATEQYGSVSSTTPAGPNMRNNMYPV

SEQ ID NO: 128267 - protein, 36 aa, Artificial Sequence
  Description of Artificial Sequence: Synthetic polypeptide
DEEEIRTTNPVATEQYGSVSSTTPAGPNMRNNMNPV

SEQ ID NO: 128268 - protein, 36 aa, Artificial Sequence
  Description of Artificial Sequence: Synthetic polypeptide
DEEEIRTTNPVATEQYGSVSSTTPAGPNMRNMMNPV

SEQ ID NO: 128269 - protein, 32 aa, Artificial Sequence
  Description of Artificial Sequence: Synthetic polypeptide
DENEIRTTNPVSTEPYGTTSMEDNQAQQNGNH

SEQ ID NO: 128270 - protein, 32 aa, Artificial Sequence
  Description of Artificial Sequence: Synthetic polypeptide
DETEIATTNPVAYEQWGVVCSTENDEHDGNAQ

SEQ ID NO: 128271 - protein, 31 aa, Artificial Sequence
  Description of Artificial Sequence: Synthetic polypeptide
DENEIRTTNPVSTEPYGTTSMEDIQQQQGNH

SEQ ID NO: 128272 - protein, 33 aa, Artificial Sequence
  Description of Artificial Sequence: Synthetic polypeptide
DETEIATTNPVAYEQWGVVCSTENDQGEGNGVG

SEQ ID NO: 128273 - protein, 36 aa, Artificial Sequence
  Description of Artificial Sequence: Synthetic polypeptide
DEEEIRTTNPVATEQYGSVSSTTPAGPNMRNLMNPV

SEQ ID NO: 128274 - protein, 36 aa, Artificial Sequence
  Description of Artificial Sequence: Synthetic polypeptide
DEEEIRTTNPVATEQYGSVSSTTPAGPNMRNKMNPV

SEQ ID NO: 128275 - protein, 33 aa, Artificial Sequence
  Description of Artificial Sequence: Synthetic polypeptide
DETEIATTNPVAYEQYGSVAGEGLQNHQDGNGN

SEQ ID NO: 128276 - protein, 32 aa, Artificial Sequence
  Description of Artificial Sequence: Synthetic polypeptide
DETEIATTNPVAYEQYGSVAGTGGTAEGGNIA

SEQ ID NO: 128277 - protein, 36 aa, Artificial Sequence
  Description of Artificial Sequence: Synthetic polypeptide
DEEEIRTTNPVATEQYGSVSSTTPAGPNMRNKENPV

SEQ ID NO: 128278 - protein, 36 aa, Artificial Sequence
  Description of Artificial Sequence: Synthetic polypeptide
DEEEIRTTNPVATEQYGSVSSTTPAGPNMRNIMNPY

SEQ ID NO: 128279 - protein, 31 aa, Artificial Sequence
  Description of Artificial Sequence: Synthetic polypeptide
DETEIATTNPVAYEQYGSVATAGTAENPNDQ

SEQ ID NO: 128280 - protein, 32 aa, Artificial Sequence
  Description of Artificial Sequence: Synthetic polypeptide
DENEIRTTNPVSTEPYGTTSGEDISQNQNGNH

SEQ ID NO: 128281 - protein, 32 aa, Artificial Sequence
  Description of Artificial Sequence: Synthetic polypeptide
DETEIATTNPVAYEQYGSVATAGTQTDNGDEE

SEQ ID NO: 128282 - protein, 33 aa, Artificial Sequence
  Description of Artificial Sequence: Synthetic polypeptide
DETEIATTNPVAYEQYGSVATNDTTAENGNMDD

SEQ ID NO: 128283 - protein, 36 aa, Artificial Sequence
  Description of Artificial Sequence: Synthetic polypeptide
DEEEIRTTNPVATEQYGSVSSTTPAGPNMRNIMNPV

SEQ ID NO: 128284 - protein, 34 aa, Artificial Sequence
  Description of Artificial Sequence: Synthetic polypeptide
DESEIRTTNPVAYEPYGQSVSINEGSTSPPGNSR

SEQ ID NO: 128285 - protein, 32 aa, Artificial Sequence
  Description of Artificial Sequence: Synthetic polypeptide
DENEIRTTNPVSTEPYGTTSFEDNQQQGNGNH

SEQ ID NO: 128286 - protein, 36 aa, Artificial Sequence
  Description of Artificial Sequence: Synthetic polypeptide
DEEEIRTTNPVATEQYGSVSSTTPAGPNMRNPMNPV

SEQ ID NO: 128287 - protein, 36 aa, Artificial Sequence
  Description of Artificial Sequence: Synthetic polypeptide
DEEEIRTTNPVATEQYGSVSSTTPAGPNMRNQTNPV

SEQ ID NO: 128288 - protein, 33 aa, Artificial Sequence
  Description of Artificial Sequence: Synthetic polypeptide
DESEIRTTNPVAYEQWGSTCPTDNGDQRQSQND

SEQ ID NO: 128289 - protein, 32 aa, Artificial Sequence
  Description of Artificial Sequence: Synthetic polypeptide
DESEIRTTNPVAYEQWGSTCPTDNGDQRQDQQ

SEQ ID NO: 128290 - protein, 33 aa, Artificial Sequence
  Description of Artificial Sequence: Synthetic polypeptide
DESEIRTTNPVAYEQWGSTCPTDNGDERQGQGR

SEQ ID NO: 128291 - protein, 33 aa, Artificial Sequence
  Description of Artificial Sequence: Synthetic polypeptide
DESEIRTTNPVAYEQWGSTCPTDNGDDRQGIQR

SEQ ID NO: 128292 - protein, 37 aa, Artificial Sequence
  Description of Artificial Sequence: Synthetic polypeptide
DEEEIRTTNPVATEQYGSVSSTTPAGPNMRPGMNPVL

SEQ ID NO: 128293 - protein, 32 aa, Artificial Sequence
  Description of Artificial Sequence: Synthetic polypeptide
DESEIRTTNPVAYEQWGSTCPTDNDDQRQSQN

SEQ ID NO: 128294 - protein, 36 aa, Artificial Sequence
  Description of Artificial Sequence: Synthetic polypeptide
DEEEIRTTNPVATEQYGSVSSTTPAGPNMRNYMNPV

SEQ ID NO: 128295 - protein, 36 aa, Artificial Sequence
  Description of Artificial Sequence: Synthetic polypeptide
DEEEIRTTNPVATEQYGSVSSTTPAGPNMRNVMNYV

SEQ ID NO: 128296 - protein, 36 aa, Artificial Sequence
  Description of Artificial Sequence: Synthetic polypeptide
DEEEIRTTNPVATEQYGSVSSTTPAGPNMRNVMNPV

SEQ ID NO: 128297 - protein, 36 aa, Artificial Sequence
  Description of Artificial Sequence: Synthetic polypeptide
DEEEIRTTNPVATEQYGSVSSTTPAGPNMRNTMNPV

SEQ ID NO: 128298 - protein, 33 aa, Artificial Sequence
  Description of Artificial Sequence: Synthetic polypeptide
DESEIRTTNPVAYEQWGEVSWTEHDNRGGGNGM

SEQ ID NO: 128299 - protein, 36 aa, Artificial Sequence
  Description of Artificial Sequence: Synthetic polypeptide
DEEEIRTTNPVATEQYGSVSSTTPAGPNMRNTMAPV

SEQ ID NO: 128300 - protein, 36 aa, Artificial Sequence
  Description of Artificial Sequence: Synthetic polypeptide
DEEEIRTTNPVATEQYGSVSSTTPAGPNMRNSMNPV

SEQ ID NO: 128301 - protein, 36 aa, Artificial Sequence
  Description of Artificial Sequence: Synthetic polypeptide
DEEEIRTTNPVATEQYGSVSSTTPAGPNMRNSMNLV

SEQ ID NO: 128302 - protein, 31 aa, Artificial Sequence
  Description of Artificial Sequence: Synthetic polypeptide
DENEIRTTNPVSTEPYGTVAMEDIQQQNGNH

SEQ ID NO: 128303 - protein, 31 aa, Artificial Sequence
  Description of Artificial Sequence: Synthetic polypeptide
DENEIRTTNPVSTEPYGTVAMDIQQQQNGNH

SEQ ID NO: 128304 - protein, 34 aa, Artificial Sequence
  Description of Artificial Sequence: Synthetic polypeptide
DESEIRTTNPVAYEQWGESVQIQRNDDGQRGHRP

SEQ ID NO: 128305 - protein, 37 aa, Artificial Sequence
  Description of Artificial Sequence: Synthetic polypeptide
DEEEIRTTNPVATEQYGSVSSTTPAGPNMRNRMNPVA

SEQ ID NO: 128306 - protein, 31 aa, Artificial Sequence
  Description of Artificial Sequence: Synthetic polypeptide
ANNEIACTNPVATEQYGEAPENLQQRAGVGR

SEQ ID NO: 128307 - protein, 36 aa, Artificial Sequence
  Description of Artificial Sequence: Synthetic polypeptide
DEEEIRTTNPVATEQYGSVSSTTPAGPNMRNQMNPV

SEQ ID NO: 128308 - protein, 33 aa, Artificial Sequence
  Description of Artificial Sequence: Synthetic polypeptide
DESEIRTTNPVAYEQWGSVCQTFEDGGNKGGTR

SEQ ID NO: 128309 - protein, 36 aa, Artificial Sequence
  Description of Artificial Sequence: Synthetic polypeptide
DEEEIRTTNPVATEQYGSVSTDNEGDTVWHNDENFQ

SEQ ID NO: 128310 - protein, 33 aa, Artificial Sequence
  Description of Artificial Sequence: Synthetic polypeptide
DETEIATTNPVAYEQYGSVATNLADTGGGDQSG

SEQ ID NO: 128311 - protein, 38 aa, Artificial Sequence
  Description of Artificial Sequence: Synthetic polypeptide
DEEEIRTTNPVATEQYGSVSTVTNNQQGNNDEEETTEG

SEQ ID NO: 128312 - protein, 32 aa, Artificial Sequence
  Description of Artificial Sequence: Synthetic polypeptide
DENEIRTTNPVSTEPYGTMSMETIQQQQNGNH

SEQ ID NO: 128313 - protein, 32 aa, Artificial Sequence
  Description of Artificial Sequence: Synthetic polypeptide
DENEIRTTNPVSTEPYGTMSMETIQQQHNGNH

SEQ ID NO: 128314 - protein, 38 aa, Artificial Sequence
  Description of Artificial Sequence: Synthetic polypeptide
DEEEIRTTNPVATEQYGSVSTVTNNQNQEQGNNQEGNT

SEQ ID NO: 128315 - protein, 33 aa, Artificial Sequence
  Description of Artificial Sequence: Synthetic polypeptide
DESEIRTTNPVAYECWGSVWCINEPQDREGENG

SEQ ID NO: 128316 - protein, 33 aa, Artificial Sequence
  Description of Artificial Sequence: Synthetic polypeptide
DESEIRTTNPVAYECWGSVWAINEPQDREGENG

SEQ ID NO: 128317 - protein, 33 aa, Artificial Sequence
  Description of Artificial Sequence: Synthetic polypeptide
DEQEIATTNPIATEQYGSVSATEDLEDHEGEDL

SEQ ID NO: 128318 - protein, 33 aa, Artificial Sequence
  Description of Artificial Sequence: Synthetic polypeptide
DEQEIATTNPIATEQYGSVSATEDLEEHEGEDL

SEQ ID NO: 128319 - protein, 38 aa, Artificial Sequence
  Description of Artificial Sequence: Synthetic polypeptide
DEEEIRTTNPVATEQYGSVSTVTNNNQQQGNIGTNNDE

SEQ ID NO: 128320 - protein, 32 aa, Artificial Sequence
  Description of Artificial Sequence: Synthetic polypeptide
DEQEIATTNPLATEQYGSVSATDLEDHEWEDL

SEQ ID NO: 128321 - protein, 33 aa, Artificial Sequence
  Description of Artificial Sequence: Synthetic polypeptide
DEQEIATTNPLATEQYGSVSATDLIEDHEGEDL

SEQ ID NO: 128322 - protein, 36 aa, Artificial Sequence
  Description of Artificial Sequence: Synthetic polypeptide
DEEEIRTTNPVATEQYGSVSSTTPAGPNMRNGMYPV

SEQ ID NO: 128323 - protein, 34 aa, Artificial Sequence
  Description of Artificial Sequence: Synthetic polypeptide
DETEICTTNPVATEAWGSVSTVNNNNNQDEGENG

SEQ ID NO: 128324 - protein, 36 aa, Artificial Sequence
  Description of Artificial Sequence: Synthetic polypeptide
DEEEIRTTNPVATEQYGSVSSTTPAGPNMRNGMYMV

SEQ ID NO: 128325 - protein, 32 aa, Artificial Sequence
  Description of Artificial Sequence: Synthetic polypeptide
DEQEIATTNPMATECYGSVSATDLEDHEGEDL

SEQ ID NO: 128326 - protein, 36 aa, Artificial Sequence
  Description of Artificial Sequence: Synthetic polypeptide
DEEEIRTTNPVATEQYGSVSSTTPAGPNMRNGMWPV

SEQ ID NO: 128327 - protein, 36 aa, Artificial Sequence
  Description of Artificial Sequence: Synthetic polypeptide
DEEEIRTTNPVATEQYGSVSSTTPAGPNMRNGMVPV

SEQ ID NO: 128328 - protein, 36 aa, Artificial Sequence
  Description of Artificial Sequence: Synthetic polypeptide
DEEEIRTTNPVATEQYGSVSSTTPAGPNMRNGMTPV

SEQ ID NO: 128329 - protein, 36 aa, Artificial Sequence
  Description of Artificial Sequence: Synthetic polypeptide
DEEEIRTTNPVATEQYGSVSSTTPAGPNMRNGMSPV

SEQ ID NO: 128330 - protein, 38 aa, Artificial Sequence
  Description of Artificial Sequence: Synthetic polypeptide
DEEEIRTTNPVATEQYGSVSTVTNNQQGNNQEETEDEG

SEQ ID NO: 128331 - protein, 32 aa, Artificial Sequence
  Description of Artificial Sequence: Synthetic polypeptide
DENEIRTTNPVSTEPYGTTSAEWNQQVQNGNH

SEQ ID NO: 128332 - protein, 37 aa, Artificial Sequence
  Description of Artificial Sequence: Synthetic polypeptide
DEEEIRTTNPVATEQYGSVSSTTPAGPNMRNGQNPVI

SEQ ID NO: 128333 - protein, 37 aa, Artificial Sequence
  Description of Artificial Sequence: Synthetic polypeptide
DEEEIRTTNPVATEQYGSVSSTTPAGPNMRNGRNPVG

SEQ ID NO: 128334 - protein, 36 aa, Artificial Sequence
  Description of Artificial Sequence: Synthetic polypeptide
DEEEIRTTNPVATEQYGSVSSTTPAGPNMRNILNPV

SEQ ID NO: 128335 - protein, 36 aa, Artificial Sequence
  Description of Artificial Sequence: Synthetic polypeptide
DEEEIRTTNPVATEQYGSVSSTTPAGPNMRNHMNPV

SEQ ID NO: 128336 - protein, 36 aa, Artificial Sequence
  Description of Artificial Sequence: Synthetic polypeptide
DEEEIRTTNPVATEQYGSVSSTTPAGPNMRNHMNEV

SEQ ID NO: 128337 - protein, 32 aa, Artificial Sequence
  Description of Artificial Sequence: Synthetic polypeptide
DETEIATTNPVAYEQYGSVCTANIGERDDQAE

SEQ ID NO: 128338 - protein, 34 aa, Artificial Sequence
  Description of Artificial Sequence: Synthetic polypeptide
DESEIRTTNPVAYEKWGSVYRINENQDRRGENGR

SEQ ID NO: 128339 - protein, 33 aa, Artificial Sequence
  Description of Artificial Sequence: Synthetic polypeptide
DESEIRTTNPVAYEHWGSVSQANFSDDREGGNG

SEQ ID NO: 128340 - protein, 33 aa, Artificial Sequence
  Description of Artificial Sequence: Synthetic polypeptide
DETEIATTNPVAYEQYGSVSAANNLTASGGDDD

SEQ ID NO: 128341 - protein, 37 aa, Artificial Sequence
  Description of Artificial Sequence: Synthetic polypeptide
DEEEIRTTNPVATEQYGSVSSTTPAGPNMRNGVNPVD

SEQ ID NO: 128342 - protein, 33 aa, Artificial Sequence
  Description of Artificial Sequence: Synthetic polypeptide
DETEIATTNPVAYEQYGSVSAGNPGQPFPGDSE

SEQ ID NO: 128343 - protein, 34 aa, Artificial Sequence
  Description of Artificial Sequence: Synthetic polypeptide
DETEIATTNPVAYEQYGSVSAGNPPQDRPGDSFE

SEQ ID NO: 128344 - protein, 32 aa, Artificial Sequence
  Description of Artificial Sequence: Synthetic polypeptide
DENEIRTTNPVSTEPYGTSSMENIQQQQNGNH

SEQ ID NO: 128345 - protein, 33 aa, Artificial Sequence
  Description of Artificial Sequence: Synthetic polypeptide
DESEIRTTNPVAYECWGSVYWINENQDREGEND

SEQ ID NO: 128346 - protein, 33 aa, Artificial Sequence
  Description of Artificial Sequence: Synthetic polypeptide
DETEIATTNPVAYEQYGSVSNGNPQQTPGVDPM

SEQ ID NO: 128347 - protein, 37 aa, Artificial Sequence
  Description of Artificial Sequence: Synthetic polypeptide
DEEEIRTTNPVATEQYGSVSSTTPAGPNMRNGSNPVF

SEQ ID NO: 128348 - protein, 32 aa, Artificial Sequence
  Description of Artificial Sequence: Synthetic polypeptide
DENEIRTTNPVSTEPYGTSSLEDSQQQQNGNH

SEQ ID NO: 128349 - protein, 38 aa, Artificial Sequence
  Description of Artificial Sequence: Synthetic polypeptide
DEEEIRTTNPVATEQYGSVSTVTNQQAGNNDEEEETED

SEQ ID NO: 128350 - protein, 33 aa, Artificial Sequence
  Description of Artificial Sequence: Synthetic polypeptide
DETEIATTNPVAYEQYGVVYCTDLQQPDGGNQE

SEQ ID NO: 128351 - protein, 33 aa, Artificial Sequence
  Description of Artificial Sequence: Synthetic polypeptide
DETEIATTNPVAYERWGEVSGDNGNQGRGENDR

SEQ ID NO: 128352 - protein, 37 aa, Artificial Sequence
  Description of Artificial Sequence: Synthetic polypeptide
DEEEIRTTNPVATEQYGSVSSTTPAGPNMRNGRNPVM

SEQ ID NO: 128353 - protein, 38 aa, Artificial Sequence
  Description of Artificial Sequence: Synthetic polypeptide
DEEEIRTTNPVATEQYGSVSTVTNQNNNQQGTTEENQD

SEQ ID NO: 128354 - protein, 38 aa, Artificial Sequence
  Description of Artificial Sequence: Synthetic polypeptide
DEEEIRTTNPVATEQYGSVSTVVNDQQGNNQQGETENS

SEQ ID NO: 128355 - protein, 33 aa, Artificial Sequence
  Description of Artificial Sequence: Synthetic polypeptide
DEQEIATTNPHATEQYGSVSATDLEDHEGAEDL

SEQ ID NO: 128356 - protein, 34 aa, Artificial Sequence
  Description of Artificial Sequence: Synthetic polypeptide
DEQEIATTNPGVATEQYGSNVSATDLEDHEGEDL

SEQ ID NO: 128357 - protein, 33 aa, Artificial Sequence
  Description of Artificial Sequence: Synthetic polypeptide
DEQEIATTNPCATEQYGSVSATDLEDHEGFEDL

SEQ ID NO: 128358 - protein, 37 aa, Artificial Sequence
  Description of Artificial Sequence: Synthetic polypeptide
DEEEIRTTNPVATEQYGSVSSTTPAGPNMVNGMNPVH

SEQ ID NO: 128359 - protein, 38 aa, Artificial Sequence
  Description of Artificial Sequence: Synthetic polypeptide
DEEEIRTTNPVATEQYGSVSTVTTNNNNQQGNNEESTN

SEQ ID NO: 128360 - protein, 31 aa, Artificial Sequence
  Description of Artificial Sequence: Synthetic polypeptide
DENEIRTTNPVSTEPYGVISMDIQQQQNGNH

SEQ ID NO: 128361 - protein, 36 aa, Artificial Sequence
  Description of Artificial Sequence: Synthetic polypeptide
DEEEIRTTNPVATEQYGSVSSTTPAGPNMVNGMAPV

SEQ ID NO: 128362 - protein, 31 aa, Artificial Sequence
  Description of Artificial Sequence: Synthetic polypeptide
DENEIRTTNPVSTEPYGVISDEDIQQQNGNH

SEQ ID NO: 128363 - protein, 35 aa, Artificial Sequence
  Description of Artificial Sequence: Synthetic polypeptide
DEAEIRTTNPVATEQYGSVSTMDTLLDTGSSEDEG

SEQ ID NO: 128364 - protein, 32 aa, Artificial Sequence
  Description of Artificial Sequence: Synthetic polypeptide
DETEIATTNPVAYEQWGSISKTLEDREQSNDR

SEQ ID NO: 128365 - protein, 33 aa, Artificial Sequence
  Description of Artificial Sequence: Synthetic polypeptide
DETEIATTNPVAYEQWGSTSTNDQGGNHGQNDS

SEQ ID NO: 128366 - protein, 32 aa, Artificial Sequence
  Description of Artificial Sequence: Synthetic polypeptide
DENEIRTTNPVSTEPYGVCSMEDGQRQQNGNH

SEQ ID NO: 128367 - protein, 32 aa, Artificial Sequence
  Description of Artificial Sequence: Synthetic polypeptide
DETEIATTNPVAYEQWGSTSTNGEGNHGQNGS

SEQ ID NO: 128368 - protein, 32 aa, Artificial Sequence
  Description of Artificial Sequence: Synthetic polypeptide
DENEIRTTNPVSTEPYGTYSMTDIQQQQNGNH

SEQ ID NO: 128369 - protein, 34 aa, Artificial Sequence
  Description of Artificial Sequence: Synthetic polypeptide
DETEIATTNPVAYEQWGSVAKTNDLQEQRLGQGD

SEQ ID NO: 128370 - protein, 32 aa, Artificial Sequence
  Description of Artificial Sequence: Synthetic polypeptide
DETEIATTNPVAYEQWGSVCPENDQGEGNNNL

SEQ ID NO: 128371 - protein, 32 aa, Artificial Sequence
  Description of Artificial Sequence: Synthetic polypeptide
DEQEIATTNPCATYQYGSVSATDLEDHEGEDL

SEQ ID NO: 128372 - protein, 33 aa, Artificial Sequence
  Description of Artificial Sequence: Synthetic polypeptide
DESEIRTTNPVAYEQWGSVSGGNGNGAGEGNTD

SEQ ID NO: 128373 - protein, 32 aa, Artificial Sequence
  Description of Artificial Sequence: Synthetic polypeptide
DEQEIATTNPCSTEQYGIVSATDLEDHEGEDR

SEQ ID NO: 128374 - protein, 37 aa, Artificial Sequence
  Description of Artificial Sequence: Synthetic polypeptide
DEEEIRTTNPVATEQYGSVSTVTQNGNNEEIGTNNQE

SEQ ID NO: 128375 - protein, 34 aa, Artificial Sequence
  Description of Artificial Sequence: Synthetic polypeptide
DEAEIRTTNPVATEQYGSVDTVWPIDTTSINERQ

SEQ ID NO: 128376 - protein, 32 aa, Artificial Sequence
  Description of Artificial Sequence: Synthetic polypeptide
DETEIATTNPVAYEQWGCVCTDLQGEDGNNNS

SEQ ID NO: 128377 - protein, 34 aa, Artificial Sequence
  Description of Artificial Sequence: Synthetic polypeptide
DETEIATTNPVAYEQWGSVCSTNDDQMEKGNNDN

SEQ ID NO: 128378 - protein, 38 aa, Artificial Sequence
  Description of Artificial Sequence: Synthetic polypeptide
DEEEIRTTNPVATEQYGSVSTVTVTNNQQGNNNNEEDE

SEQ ID NO: 128379 - protein, 32 aa, Artificial Sequence
  Description of Artificial Sequence: Synthetic polypeptide
DENEIRTTNPVSTEPYGVISMEDLQQQQNGNH

SEQ ID NO: 128380 - protein, 32 aa, Artificial Sequence
  Description of Artificial Sequence: Synthetic polypeptide
DESEIRTTNPVAYHAWGSVFCTNLSQEPVPGR

SEQ ID NO: 128381 - protein, 34 aa, Artificial Sequence
  Description of Artificial Sequence: Synthetic polypeptide
DESEIRTTNPVAYGECWGSVSCINEPQDREGENG

SEQ ID NO: 128382 - protein, 31 aa, Artificial Sequence
  Description of Artificial Sequence: Synthetic polypeptide
AETEIRTTNPVATECWGETWANEDLQRKGPI

SEQ ID NO: 128383 - protein, 31 aa, Artificial Sequence
  Description of Artificial Sequence: Synthetic polypeptide
AETEIRTTNPVATEQYGEAWANENLAEPGGI

SEQ ID NO: 128384 - protein, 32 aa, Artificial Sequence
  Description of Artificial Sequence: Synthetic polypeptide
DESEIRTTNPVAYEQWGSVTGGNMGDRGGDGA

SEQ ID NO: 128385 - protein, 32 aa, Artificial Sequence
  Description of Artificial Sequence: Synthetic polypeptide
DENEIRTTNPVSTEPYGVVSMEDIQQQQNGNH

SEQ ID NO: 128386 - protein, 34 aa, Artificial Sequence
  Description of Artificial Sequence: Synthetic polypeptide
DEAEIRTTNPVATEQYGSVEVPEDSHDLEFSSRA

SEQ ID NO: 128387 - protein, 33 aa, Artificial Sequence
  Description of Artificial Sequence: Synthetic polypeptide
DEAEIRTTNPVATEQYGSVEVPEDSHDLEFNEA

SEQ ID NO: 128388 - protein, 33 aa, Artificial Sequence
  Description of Artificial Sequence: Synthetic polypeptide
DEQEIATTNPCATEQYGKSVSATDLEDHEGEDL

SEQ ID NO: 128389 - protein, 32 aa, Artificial Sequence
  Description of Artificial Sequence: Synthetic polypeptide
DENEIRTTNPVSTEPYGVVSDEDIQQQSNGNH

SEQ ID NO: 128390 - protein, 32 aa, Artificial Sequence
  Description of Artificial Sequence: Synthetic polypeptide
DETEIATTNPVAYEKWGSVSTNAQGDLGGDGS

SEQ ID NO: 128391 - protein, 33 aa, Artificial Sequence
  Description of Artificial Sequence: Synthetic polypeptide
DETEIATTNPVAYEKWGSVSTNLQGDLGGGGGS

SEQ ID NO: 128392 - protein, 36 aa, Artificial Sequence
  Description of Artificial Sequence: Synthetic polypeptide
DEEEIRTTNPVATEQYGSVSSTTPAGPNPRNDMNPV

SEQ ID NO: 128393 - protein, 34 aa, Artificial Sequence
  Description of Artificial Sequence: Synthetic polypeptide
DESEIRTTNPVAYEQWGSVSNNNDHQEGRGEGSP

SEQ ID NO: 128394 - protein, 32 aa, Artificial Sequence
  Description of Artificial Sequence: Synthetic polypeptide
DETEIATTNPVAYEPWGSVSGGNGNMGNDNQR

SEQ ID NO: 128395 - protein, 32 aa, Artificial Sequence
  Description of Artificial Sequence: Synthetic polypeptide
DEQEIATTNPCATEQYGSVSACDLEDHEGEDL

SEQ ID NO: 128396 - protein, 32 aa, Artificial Sequence
  Description of Artificial Sequence: Synthetic polypeptide
DENEIRTTNPVSTEPYGVISMENIQQQQNGNQ

SEQ ID NO: 128397 - protein, 32 aa, Artificial Sequence
  Description of Artificial Sequence: Synthetic polypeptide
DENEIRTTNPVSTEPYGVISMENIQQQQNGNH

SEQ ID NO: 128398 - protein, 32 aa, Artificial Sequence
  Description of Artificial Sequence: Synthetic polypeptide
DENEIRTTNPVSTEPYGVISMEDLQQQSNGNH

SEQ ID NO: 128399 - protein, 34 aa, Artificial Sequence
  Description of Artificial Sequence: Synthetic polypeptide
DEAEIRTTNPVATEQYGSVEPTNWNEFENIGEQN

SEQ ID NO: 128400 - protein, 32 aa, Artificial Sequence
  Description of Artificial Sequence: Synthetic polypeptide
DEQEIATTNPHATEQYGSVSAEDLEDHEGEDL

SEQ ID NO: 128401 - protein, 33 aa, Artificial Sequence
  Description of Artificial Sequence: Synthetic polypeptide
DEQEIATTNPCVATETYGSVSATDLEDHEGEDL

SEQ ID NO: 128402 - protein, 36 aa, Artificial Sequence
  Description of Artificial Sequence: Synthetic polypeptide
DEAEIRTTNPVATEQYGSVCTTIMLEELRNGNEEVF

SEQ ID NO: 128403 - protein, 32 aa, Artificial Sequence
  Description of Artificial Sequence: Synthetic polypeptide
DEQEIATTNPFATYQYGSVSATDLEDHEGEDL

SEQ ID NO: 128404 - protein, 35 aa, Artificial Sequence
  Description of Artificial Sequence: Synthetic polypeptide
DEAEIRTTNPVATEQYGSVCTPPCLETGNMIDMND

SEQ ID NO: 128405 - protein, 32 aa, Artificial Sequence
  Description of Artificial Sequence: Synthetic polypeptide
DENEIRTTNPVSTEPYGTVSMEDIQEQFNGNH

SEQ ID NO: 128406 - protein, 35 aa, Artificial Sequence
  Description of Artificial Sequence: Synthetic polypeptide
DEAEIRTTNPVATEQYGSVCTPNCLETQYMEDMED

SEQ ID NO: 128407 - protein, 33 aa, Artificial Sequence
  Description of Artificial Sequence: Synthetic polypeptide
DETEIATTNPVAYEQWGSVSGPNGNQGGMNGQT

SEQ ID NO: 128408 - protein, 34 aa, Artificial Sequence
  Description of Artificial Sequence: Synthetic polypeptide
DETEIATTNPVAYEQWGSVSGPNGNQRGGMNGDE

SEQ ID NO: 128409 - protein, 35 aa, Artificial Sequence
  Description of Artificial Sequence: Synthetic polypeptide
DEAEIRTTNPVATEQYGSVCTLPLQTEIGQMEDHS

SEQ ID NO: 128410 - protein, 31 aa, Artificial Sequence
  Description of Artificial Sequence: Synthetic polypeptide
DENEIRTTNPVSTEPYGTVSMDIQMQQAENA

SEQ ID NO: 128411 - protein, 31 aa, Artificial Sequence
  Description of Artificial Sequence: Synthetic polypeptide
DENEIRTTNPVSTEPYGTVSEEDIQNQAGDH

SEQ ID NO: 128412 - protein, 31 aa, Artificial Sequence
  Description of Artificial Sequence: Synthetic polypeptide
DENEIRTTNPVSTEPYGTVSEEDIQNAAGDH

SEQ ID NO: 128413 - protein, 32 aa, Artificial Sequence
  Description of Artificial Sequence: Synthetic polypeptide
DEQEIATTNPFAVEQYGSVSATDLEDHEGEDL

SEQ ID NO: 128414 - protein, 32 aa, Artificial Sequence
  Description of Artificial Sequence: Synthetic polypeptide
DEQEIATTNPGATEQYGSVSATDFEDHEGEDL

SEQ ID NO: 128415 - protein, 38 aa, Artificial Sequence
  Description of Artificial Sequence: Synthetic polypeptide
DEEEIRTTNPVATEQYGSVSTVTNQQGNNTNQQGTNTE

SEQ ID NO: 128416 - protein, 38 aa, Artificial Sequence
  Description of Artificial Sequence: Synthetic polypeptide
DEEEIRTTNPVATEQYGSVSTVTNQQGNNNTEQGNNTN

SEQ ID NO: 128417 - protein, 37 aa, Artificial Sequence
  Description of Artificial Sequence: Synthetic polypeptide
DEEEIRTTNPVATEQYGSVSSTTPAGPNMRVGMNPEV

SEQ ID NO: 128418 - protein, 37 aa, Artificial Sequence
  Description of Artificial Sequence: Synthetic polypeptide
DEEEIRTTNPVATEQYGSVSTVTNQQGAEQGGTTEDE

SEQ ID NO: 128419 - protein, 32 aa, Artificial Sequence
  Description of Artificial Sequence: Synthetic polypeptide
DEQEIATTNPGATEQYGSVYATDLEDHEGEDL

SEQ ID NO: 128420 - protein, 37 aa, Artificial Sequence
  Description of Artificial Sequence: Synthetic polypeptide
DEEEIRTTNPVATEQYGSVSSTTPAGPNMRSGMNPVY

SEQ ID NO: 128421 - protein, 32 aa, Artificial Sequence
  Description of Artificial Sequence: Synthetic polypeptide
AESEIACTNPVAYEQYGEASCENLSQQRVGGR

SEQ ID NO: 128422 - protein, 33 aa, Artificial Sequence
  Description of Artificial Sequence: Synthetic polypeptide
DEQEIATTNPFATEQYGSVSATDYLEDHEGEDL

SEQ ID NO: 128423 - protein, 33 aa, Artificial Sequence
  Description of Artificial Sequence: Synthetic polypeptide
DENEIRTTNPVSTEPYGTVSTEAGQQMQNGNPH

SEQ ID NO: 128424 - protein, 34 aa, Artificial Sequence
  Description of Artificial Sequence: Synthetic polypeptide
DEQEIATTNPEVATEQYGSVSATDLEDHEGEDLG

SEQ ID NO: 128425 - protein, 36 aa, Artificial Sequence
  Description of Artificial Sequence: Synthetic polypeptide
DEEEIRTTNPVATEQYGSVSSTTPAGPNMRVSMVPV

SEQ ID NO: 128426 - protein, 35 aa, Artificial Sequence
  Description of Artificial Sequence: Synthetic polypeptide
DEAEIRTTNPVATEQYGSVCTSADLQESFQGSILV

SEQ ID NO: 128427 - protein, 34 aa, Artificial Sequence
  Description of Artificial Sequence: Synthetic polypeptide
DETEIATTNPVAYEQWGSVCSTNDLGEDGRNQEG

SEQ ID NO: 128428 - protein, 32 aa, Artificial Sequence
  Description of Artificial Sequence: Synthetic polypeptide
DENEIRTTNPVSTEPYGTVSMIDIQQQQNGNH

SEQ ID NO: 128429 - protein, 32 aa, Artificial Sequence
  Description of Artificial Sequence: Synthetic polypeptide
DEQEIATTNPDATEQYGSVSAFDLEDHEGEDL

SEQ ID NO: 128430 - protein, 38 aa, Artificial Sequence
  Description of Artificial Sequence: Synthetic polypeptide
DEEEIRTTNPVATEQYGSVSTVTNQQQGNQQGTTEEND

SEQ ID NO: 128431 - protein, 32 aa, Artificial Sequence
  Description of Artificial Sequence: Synthetic polypeptide
DENEIRTTNPVSTEPYGTVSMEIIQQQQNGNH

SEQ ID NO: 128432 - protein, 33 aa, Artificial Sequence
  Description of Artificial Sequence: Synthetic polypeptide
DEQEIATTNPDATEQYGSVSATDLKEDHEGEDL

SEQ ID NO: 128433 - protein, 38 aa, Artificial Sequence
  Description of Artificial Sequence: Synthetic polypeptide
DEEEIRTTNPVATEQYGSVSTVTNQQQGNQAGTNEEED

SEQ ID NO: 128434 - protein, 32 aa, Artificial Sequence
  Description of Artificial Sequence: Synthetic polypeptide
DENEIRTTNPVSTEPYGTVSMEDLQQQQNENH

SEQ ID NO: 128435 - protein, 32 aa, Artificial Sequence
  Description of Artificial Sequence: Synthetic polypeptide
DENEIRTTNPVSTEPYGTVSMEDIQQQTNGNH

SEQ ID NO: 128436 - protein, 32 aa, Artificial Sequence
  Description of Artificial Sequence: Synthetic polypeptide
DENEIRTTNPVSTEPYGTVSMEDIQQQSNGNH

SEQ ID NO: 128437 - protein, 32 aa, Artificial Sequence
  Description of Artificial Sequence: Synthetic polypeptide
DENEIRTTNPVSTEPYGTVSMEDIQQQQNGNH

SEQ ID NO: 128438 - protein, 33 aa, Artificial Sequence
  Description of Artificial Sequence: Synthetic polypeptide
DEQEIATTNPEVATECYGSVSATDLEDHEGEDL

SEQ ID NO: 128439 - protein, 32 aa, Artificial Sequence
  Description of Artificial Sequence: Synthetic polypeptide
DENEIRTTNPVSTEPYGTVSMEDIQQQQIGNH

SEQ ID NO: 128440 - protein, 33 aa, Artificial Sequence
  Description of Artificial Sequence: Synthetic polypeptide
DESEIRTTNPVAYEQWGSVCSGENDQHDQNDHN

SEQ ID NO: 128441 - protein, 31 aa, Artificial Sequence
  Description of Artificial Sequence: Synthetic polypeptide
DENEIRTTNPVSTEPYGTVSMEDIQQQQGEH

SEQ ID NO: 128442 - protein, 32 aa, Artificial Sequence
  Description of Artificial Sequence: Synthetic polypeptide
DENEIRTTNPVSTEPYGTVSMEDIQQQQEGNH

SEQ ID NO: 128443 - protein, 38 aa, Artificial Sequence
  Description of Artificial Sequence: Synthetic polypeptide
DEEEIRTTNPVATEQYGSVSTVTNQQNNQQGTNNDETN

SEQ ID NO: 128444 - protein, 32 aa, Artificial Sequence
  Description of Artificial Sequence: Synthetic polypeptide
DENEIRTTNPVSTEPYGTVSMEDIQQQQAGNH

SEQ ID NO: 128445 - protein, 35 aa, Artificial Sequence
  Description of Artificial Sequence: Synthetic polypeptide
DEAEIRTTNPVATEQYGSVCTPPCLETGYMEDTND

SEQ ID NO: 128446 - protein, 34 aa, Artificial Sequence
  Description of Artificial Sequence: Synthetic polypeptide
DENEIRTTNPVATEQYGSVTTTWPQQDMGFEDGS

SEQ ID NO: 128447 - protein, 35 aa, Artificial Sequence
  Description of Artificial Sequence: Synthetic polypeptide
DENEIRTTNPVATEQYGSVTTPPCLETGYMEDMNS

SEQ ID NO: 128448 - protein, 34 aa, Artificial Sequence
  Description of Artificial Sequence: Synthetic polypeptide
DEVEIRTTNPVATESYGSVIDLTNNGQGEQGGQE

SEQ ID NO: 128449 - protein, 30 aa, Artificial Sequence
  Description of Artificial Sequence: Synthetic polypeptide
DENEIRTTNPVATEQWGDVSEIEMNAYEDA

SEQ ID NO: 128450 - protein, 30 aa, Artificial Sequence
  Description of Artificial Sequence: Synthetic polypeptide
DENEIRTTNPVATEQWGDVSEIEMNAWEDA

SEQ ID NO: 128451 - protein, 30 aa, Artificial Sequence
  Description of Artificial Sequence: Synthetic polypeptide
DENEIRTTNPVATEQWGDVSEIEMNAVEDA

SEQ ID NO: 128452 - protein, 36 aa, Artificial Sequence
  Description of Artificial Sequence: Synthetic polypeptide
DEEEIRTTNPVATEQYGSVVDPTIGAITQIGVNEIT

SEQ ID NO: 128453 - protein, 30 aa, Artificial Sequence
  Description of Artificial Sequence: Synthetic polypeptide
DENEIRTTNPVATEQWGDVSEIEMNATEDA

SEQ ID NO: 128454 - protein, 30 aa, Artificial Sequence
  Description of Artificial Sequence: Synthetic polypeptide
DENEIRTTNPVATEQWGDVSEIEMNASEDA

SEQ ID NO: 128455 - protein, 37 aa, Artificial Sequence
  Description of Artificial Sequence: Synthetic polypeptide
DTEEIRTTNPVATEQYGSVVVTVNNLNQQGEQGTNVD

SEQ ID NO: 128456 - protein, 37 aa, Artificial Sequence
  Description of Artificial Sequence: Synthetic polypeptide
DTEEIRTTNPVATEQYGVVSTNLQAGNNTEQGEEEQD

SEQ ID NO: 128457 - protein, 31 aa, Artificial Sequence
  Description of Artificial Sequence: Synthetic polypeptide
DENEIRTTNPVATEQWGDVSEIEMNAYEDDA

SEQ ID NO: 128458 - protein, 30 aa, Artificial Sequence
  Description of Artificial Sequence: Synthetic polypeptide
DENEIRTTNPVATEQWGDVSEIEMNAPEDA

SEQ ID NO: 128459 - protein, 37 aa, Artificial Sequence
  Description of Artificial Sequence: Synthetic polypeptide
DTEEIRTTNPVATEQYGVVSTTNLQQGNNNQQGEDED

SEQ ID NO: 128460 - protein, 37 aa, Artificial Sequence
  Description of Artificial Sequence: Synthetic polypeptide
DTEEIRTTNPVATEQYGVVSTTNLQQQGENATTNVAE

SEQ ID NO: 128461 - protein, 31 aa, Artificial Sequence
  Description of Artificial Sequence: Synthetic polypeptide
DENEIRTTNPVATEQWGDVSEIEMNANEDPV

SEQ ID NO: 128462 - protein, 31 aa, Artificial Sequence
  Description of Artificial Sequence: Synthetic polypeptide
DENEIRTTNPVATEQWGDVSEIEMNANEDPA

SEQ ID NO: 128463 - protein, 34 aa, Artificial Sequence
  Description of Artificial Sequence: Synthetic polypeptide
DEEEIRTTNPVATEQYGSVVENEMNDTGGGGGEI

SEQ ID NO: 128464 - protein, 31 aa, Artificial Sequence
  Description of Artificial Sequence: Synthetic polypeptide
DENEIRTTNPVATEQWGDVSEIEMNAMEWDA

SEQ ID NO: 128465 - protein, 30 aa, Artificial Sequence
  Description of Artificial Sequence: Synthetic polypeptide
DENEIRTTNPVATEQWGDVSEIEMNAMEEA

SEQ ID NO: 128466 - protein, 30 aa, Artificial Sequence
  Description of Artificial Sequence: Synthetic polypeptide
DENEIRTTNPVATEQWGDVSEIEMNAMEDA

SEQ ID NO: 128467 - protein, 31 aa, Artificial Sequence
  Description of Artificial Sequence: Synthetic polypeptide
DENEIRTTNPVATEQWGDVSEIEMNANEYDA

SEQ ID NO: 128468 - protein, 30 aa, Artificial Sequence
  Description of Artificial Sequence: Synthetic polypeptide
DENEIRTTNPVATEQWGDVSEIEMNCAEDA

SEQ ID NO: 128469 - protein, 30 aa, Artificial Sequence
  Description of Artificial Sequence: Synthetic polypeptide
DENEIRTTNPVATEQWGDVSEIEMNCAEDK

SEQ ID NO: 128470 - protein, 34 aa, Artificial Sequence
  Description of Artificial Sequence: Synthetic polypeptide
DEAEIRTTNPVAYEQWGSVCVNENIQDDRQGNVA

SEQ ID NO: 128471 - protein, 37 aa, Artificial Sequence
  Description of Artificial Sequence: Synthetic polypeptide
DTEEIRTTNPVATEQYGSVSTVVNNNQQGNNEEETED

SEQ ID NO: 128472 - protein, 31 aa, Artificial Sequence
  Description of Artificial Sequence: Synthetic polypeptide
DENEIRTTNPVATEQWGDVSEIEMNIAERDA

SEQ ID NO: 128473 - protein, 31 aa, Artificial Sequence
  Description of Artificial Sequence: Synthetic polypeptide
DENEIRTTNPVATEQWGDVSEIEMNIAEDWA

SEQ ID NO: 128474 - protein, 30 aa, Artificial Sequence
  Description of Artificial Sequence: Synthetic polypeptide
DENEIRTTNPVATEQWGDVSEIEMNIAEDA

SEQ ID NO: 128475 - protein, 37 aa, Artificial Sequence
  Description of Artificial Sequence: Synthetic polypeptide
DTEEIRTTNPVATEQYGSVSTVVNQQQGNDEEEEEQN

SEQ ID NO: 128476 - protein, 37 aa, Artificial Sequence
  Description of Artificial Sequence: Synthetic polypeptide
DTEEIRTTNPVATEQYGSVSTVVNQQQGNQEEEEEDQ

SEQ ID NO: 128477 - protein, 30 aa, Artificial Sequence
  Description of Artificial Sequence: Synthetic polypeptide
DENEIRTTNPVATEQWGDVSEIEMNHAEEA

SEQ ID NO: 128478 - protein, 30 aa, Artificial Sequence
  Description of Artificial Sequence: Synthetic polypeptide
DENEIRTTNPVATEQWGDVSEIEMNHAEDK

SEQ ID NO: 128479 - protein, 30 aa, Artificial Sequence
  Description of Artificial Sequence: Synthetic polypeptide
DENEIRTTNPVATEQWGDVSEIEMNHAEDA

SEQ ID NO: 128480 - protein, 35 aa, Artificial Sequence
  Description of Artificial Sequence: Synthetic polypeptide
DEEEIRTTNPVATEQYGSVVDLFNGEEDQEGGGED

SEQ ID NO: 128481 - protein, 37 aa, Artificial Sequence
  Description of Artificial Sequence: Synthetic polypeptide
DTEEIRTTNPVATEQYGSVSVTVNNNQQGNNEEETES

SEQ ID NO: 128482 - protein, 37 aa, Artificial Sequence
  Description of Artificial Sequence: Synthetic polypeptide
DTEEIRTTNPVATEQYGSVSVTVTNNQQGNNEQETTD

SEQ ID NO: 128483 - protein, 37 aa, Artificial Sequence
  Description of Artificial Sequence: Synthetic polypeptide
DTEEIRTTNPVATEQYGSVVVTVNLQQNQEQGTNNAD

SEQ ID NO: 128484 - protein, 30 aa, Artificial Sequence
  Description of Artificial Sequence: Synthetic polypeptide
DENEIRTTNPVATEQWGDVSEIEMNFAEDA

SEQ ID NO: 128485 - protein, 30 aa, Artificial Sequence
  Description of Artificial Sequence: Synthetic polypeptide
DENEIRTTNPVATEQWGDVSEIEMNEAEDT

SEQ ID NO: 128486 - protein, 30 aa, Artificial Sequence
  Description of Artificial Sequence: Synthetic polypeptide
DENEIRTTNPVATEQWGDVSEIEMNEAEDA

SEQ ID NO: 128487 - protein, 30 aa, Artificial Sequence
  Description of Artificial Sequence: Synthetic polypeptide
DENEIRTTNPVATEQWGDVSEIEMNDAEDA

SEQ ID NO: 128488 - protein, 30 aa, Artificial Sequence
  Description of Artificial Sequence: Synthetic polypeptide
DENEIRTTNPVATEQWGDVSEIEMNCHEPA

SEQ ID NO: 128489 - protein, 30 aa, Artificial Sequence
  Description of Artificial Sequence: Synthetic polypeptide
DENEIRTTNPVATEQWGDVSEIEMNCAEIA

SEQ ID NO: 128490 - protein, 30 aa, Artificial Sequence
  Description of Artificial Sequence: Synthetic polypeptide
DENEIRTTNPVATEQWGDVSEIEMNALEDA

SEQ ID NO: 128491 - protein, 34 aa, Artificial Sequence
  Description of Artificial Sequence: Synthetic polypeptide
DEAEIRTTNPVAYEQWGSVCVNENLQQGGQDNVQ

SEQ ID NO: 128492 - protein, 31 aa, Artificial Sequence
  Description of Artificial Sequence: Synthetic polypeptide
DENEIRTTNPVATEQWGDVSEIEMNAKEDYI

SEQ ID NO: 128493 - protein, 30 aa, Artificial Sequence
  Description of Artificial Sequence: Synthetic polypeptide
DENEIRTTNPVATEQWGDVSEIEMNAKEDI

SEQ ID NO: 128494 - protein, 30 aa, Artificial Sequence
  Description of Artificial Sequence: Synthetic polypeptide
DENEIRTTNPVATEQWGDVSEIEMNAAWDA

SEQ ID NO: 128495 - protein, 30 aa, Artificial Sequence
  Description of Artificial Sequence: Synthetic polypeptide
DENEIRTTNPVATEQWGDVSEIEMNAAVDA

SEQ ID NO: 128496 - protein, 30 aa, Artificial Sequence
  Description of Artificial Sequence: Synthetic polypeptide
DENEIRTTNPVATEQWGDVSEIEMNAATPA

SEQ ID NO: 128497 - protein, 30 aa, Artificial Sequence
  Description of Artificial Sequence: Synthetic polypeptide
DENEIRTTNPVATEQWGDVSEIEMNAATDK

SEQ ID NO: 128498 - protein, 30 aa, Artificial Sequence
  Description of Artificial Sequence: Synthetic polypeptide
DENEIRTTNPVATEQWGDVSEIEMNAATDA

SEQ ID NO: 128499 - protein, 30 aa, Artificial Sequence
  Description of Artificial Sequence: Synthetic polypeptide
DENEIRTTNPVATEQWGDVSEIEMNAASDA

SEQ ID NO: 128500 - protein, 30 aa, Artificial Sequence
  Description of Artificial Sequence: Synthetic polypeptide
DENEIRTTNPVATEQWGDVSEIEMNAAQDA

SEQ ID NO: 128501 - protein, 30 aa, Artificial Sequence
  Description of Artificial Sequence: Synthetic polypeptide
DENEIRTTNPVATEQWGDVSEIEMNAAPDA

SEQ ID NO: 128502 - protein, 35 aa, Artificial Sequence
  Description of Artificial Sequence: Synthetic polypeptide
DEEEIRTTNPVATEQYGSVVEPTVVEEGVRGMVVS

SEQ ID NO: 128503 - protein, 36 aa, Artificial Sequence
  Description of Artificial Sequence: Synthetic polypeptide
DTEEIRTTNPVATEQYGVVSTTNNDQAGNTEQGQTD

SEQ ID NO: 128504 - protein, 30 aa, Artificial Sequence
  Description of Artificial Sequence: Synthetic polypeptide
DENEIRTTNPVATEQWGDVSEIEMNAAMDA

SEQ ID NO: 128505 - protein, 30 aa, Artificial Sequence
  Description of Artificial Sequence: Synthetic polypeptide
DENEIRTTNPVATEQWGDVSEIEMNAALDA

SEQ ID NO: 128506 - protein, 30 aa, Artificial Sequence
  Description of Artificial Sequence: Synthetic polypeptide
DENEIRTTNPVATEQWGDVSEIEMNAAKDA

SEQ ID NO: 128507 - protein, 30 aa, Artificial Sequence
  Description of Artificial Sequence: Synthetic polypeptide
DENEIRTTNPVATEQWGDVSEIEMNAAIVA

SEQ ID NO: 128508 - protein, 30 aa, Artificial Sequence
  Description of Artificial Sequence: Synthetic polypeptide
DENEIRTTNPVATEQWGDVSEIEMNAAIHA

SEQ ID NO: 128509 - protein, 30 aa, Artificial Sequence
  Description of Artificial Sequence: Synthetic polypeptide
DENEIRTTNPVATEQWGDVSEIEMNAAIDA

SEQ ID NO: 128510 - protein, 30 aa, Artificial Sequence
  Description of Artificial Sequence: Synthetic polypeptide
DENEIRTTNPVATEQWGDVSEIEMNAAHYA

SEQ ID NO: 128511 - protein, 31 aa, Artificial Sequence
  Description of Artificial Sequence: Synthetic polypeptide
DENEIRTTNPVATEQWGDVSEIEMNAAHPDA

SEQ ID NO: 128512 - protein, 30 aa, Artificial Sequence
  Description of Artificial Sequence: Synthetic polypeptide
DENEIRTTNPVATEQWGDVSEIEMNAAHDA

SEQ ID NO: 128513 - protein, 31 aa, Artificial Sequence
  Description of Artificial Sequence: Synthetic polypeptide
DENEIRTTNPVATEQWGDVSEIEMNAAWDAQ

SEQ ID NO: 128514 - protein, 30 aa, Artificial Sequence
  Description of Artificial Sequence: Synthetic polypeptide
DENEIRTTNPVATEQWGDVSEIEMNKAEDA

SEQ ID NO: 128515 - protein, 34 aa, Artificial Sequence
  Description of Artificial Sequence: Synthetic polypeptide
DEAEIRTTNPVAYEQWGSVCVNENQQQDGQDTNR

SEQ ID NO: 128516 - protein, 36 aa, Artificial Sequence
  Description of Artificial Sequence: Synthetic polypeptide
DEEEIRTTNPVATEQYGSVVEPTETMLQEVASLGAM

SEQ ID NO: 128517 - protein, 30 aa, Artificial Sequence
  Description of Artificial Sequence: Synthetic polypeptide
DENEIRTTNPVATEQWGDVSEIEMNAKEDA

SEQ ID NO: 128518 - protein, 31 aa, Artificial Sequence
  Description of Artificial Sequence: Synthetic polypeptide
DENEIRTTNPVATEQWGDVSEIEMNAIEQDA

SEQ ID NO: 128519 - protein, 30 aa, Artificial Sequence
  Description of Artificial Sequence: Synthetic polypeptide
DENEIRTTNPVATEQWGDVSEIEMNAIEDA

SEQ ID NO: 128520 - protein, 31 aa, Artificial Sequence
  Description of Artificial Sequence: Synthetic polypeptide
DENEIRTTNPVATEQWGDVSEIEMNAHEHDA

SEQ ID NO: 128521 - protein, 30 aa, Artificial Sequence
  Description of Artificial Sequence: Synthetic polypeptide
DENEIRTTNPVATEQWGDVSEIEMNAHEDA

SEQ ID NO: 128522 - protein, 30 aa, Artificial Sequence
  Description of Artificial Sequence: Synthetic polypeptide
DENEIRTTNPVATEQWGDVSEIEMNAFVDA

SEQ ID NO: 128523 - protein, 30 aa, Artificial Sequence
  Description of Artificial Sequence: Synthetic polypeptide
DENEIRTTNPVATEQWGDVSEIEMNAFEDA

SEQ ID NO: 128524 - protein, 36 aa, Artificial Sequence
  Description of Artificial Sequence: Synthetic polypeptide
DTEEIRTTNPVATEQYGVVSTTNNDQAGNSEQGSTE

SEQ ID NO: 128525 - protein, 30 aa, Artificial Sequence
  Description of Artificial Sequence: Synthetic polypeptide
DENEIRTTNPVATEQWGDVSEIEMNAEEEA

SEQ ID NO: 128526 - protein, 30 aa, Artificial Sequence
  Description of Artificial Sequence: Synthetic polypeptide
DENEIRTTNPVATEQWGDVSEIEMNAEEDG

SEQ ID NO: 128527 - protein, 31 aa, Artificial Sequence
  Description of Artificial Sequence: Synthetic polypeptide
DENEIRTTNPVATEQWGDVSEIEMNAEEDDA

SEQ ID NO: 128528 - protein, 30 aa, Artificial Sequence
  Description of Artificial Sequence: Synthetic polypeptide
DENEIRTTNPVATEQWGDVSEIEMNAEEDD

SEQ ID NO: 128529 - protein, 31 aa, Artificial Sequence
  Description of Artificial Sequence: Synthetic polypeptide
DENEIRTTNPVATEQWGDVSEIEMNAEEDAG

SEQ ID NO: 128530 - protein, 30 aa, Artificial Sequence
  Description of Artificial Sequence: Synthetic polypeptide
DENEIRTTNPVATEQWGDVSEIEMNAEEDA

SEQ ID NO: 128531 - protein, 34 aa, Artificial Sequence
  Description of Artificial Sequence: Synthetic polypeptide
DESEIRTTNPVATECWGSVSCINEPEDREGENDG

SEQ ID NO: 128532 - protein, 30 aa, Artificial Sequence
  Description of Artificial Sequence: Synthetic polypeptide
DENEIRTTNPVATEQWGDVSEIEMNAEDAH

SEQ ID NO: 128533 - protein, 35 aa, Artificial Sequence
  Description of Artificial Sequence: Synthetic polypeptide
DEEEIRTTNPVATEQYGSVVEPTEMMLQEVASVAD

SEQ ID NO: 128534 - protein, 30 aa, Artificial Sequence
  Description of Artificial Sequence: Synthetic polypeptide
DENEIRTTNPVATEQWGDVSEIEMNADEDA

SEQ ID NO: 128535 - protein, 30 aa, Artificial Sequence
  Description of Artificial Sequence: Synthetic polypeptide
DENEIRTTNPVATEQWGDVSEIEMNACEDA

SEQ ID NO: 128536 - protein, 30 aa, Artificial Sequence
  Description of Artificial Sequence: Synthetic polypeptide
DENEIRTTNPVATEQWGDVSEIEMNAAYDA

SEQ ID NO: 128537 - protein, 30 aa, Artificial Sequence
  Description of Artificial Sequence: Synthetic polypeptide
DENEIRTTNPVATEQWGDVSEIEMNKDEDA

SEQ ID NO: 128538 - protein, 37 aa, Artificial Sequence
  Description of Artificial Sequence: Synthetic polypeptide
DTEEIRTTNPVATEQYGSVSTVVNNLQNNQEGEEEDE

SEQ ID NO: 128539 - protein, 35 aa, Artificial Sequence
  Description of Artificial Sequence: Synthetic polypeptide
DEEEIRTTNPVATEQYGSVVDEDNNFQDEGGQEEI

SEQ ID NO: 128540 - protein, 30 aa, Artificial Sequence
  Description of Artificial Sequence: Synthetic polypeptide
DENEIRTTNPVATEQWGDVSEIEPNAAEDA

SEQ ID NO: 128541 - protein, 31 aa, Artificial Sequence
  Description of Artificial Sequence: Synthetic polypeptide
DENEIRTTNPVATEQWGDVSEIEPMNREEDG

SEQ ID NO: 128542 - protein, 37 aa, Artificial Sequence
  Description of Artificial Sequence: Synthetic polypeptide
DTEEIRTTNPVATEQYGSVSTTTNLEQGTNNVTEEED

SEQ ID NO: 128543 - protein, 38 aa, Artificial Sequence
  Description of Artificial Sequence: Synthetic polypeptide
DTEEIRTTNPVATEQYGSVSTTTNLQLGNDEIGTNDET

SEQ ID NO: 128544 - protein, 38 aa, Artificial Sequence
  Description of Artificial Sequence: Synthetic polypeptide
DTEEIRTTNPVATEQYGSVSTTTNLQQGNTEQGTNDEG

SEQ ID NO: 128545 - protein, 38 aa, Artificial Sequence
  Description of Artificial Sequence: Synthetic polypeptide
DTEEIRTTNPVATEQYGSVSTTTNLQQGNTEQGTTQEE

SEQ ID NO: 128546 - protein, 38 aa, Artificial Sequence
  Description of Artificial Sequence: Synthetic polypeptide
DTEEIRTTNPVATEQYGSVSTTTNLQSGNTEQGTTDEI

SEQ ID NO: 128547 - protein, 37 aa, Artificial Sequence
  Description of Artificial Sequence: Synthetic polypeptide
DTEEIRTTNPVATEQYGSVSTTVVNNQQGTNEEETED

SEQ ID NO: 128548 - protein, 37 aa, Artificial Sequence
  Description of Artificial Sequence: Synthetic polypeptide
DTEEIRTTNPVATEQYGSVSTVNNLNQGNDEEEEEDA

SEQ ID NO: 128549 - protein, 35 aa, Artificial Sequence
  Description of Artificial Sequence: Synthetic polypeptide
DTEEIRTTNPVATEQYGSVSTVNNNNQENDEEEDE

SEQ ID NO: 128550 - protein, 34 aa, Artificial Sequence
  Description of Artificial Sequence: Synthetic polypeptide
DEEEIRTTNPVATEQYGSVVAMTQSEFVLFPQIN

SEQ ID NO: 128551 - protein, 31 aa, Artificial Sequence
  Description of Artificial Sequence: Synthetic polypeptide
DENEIRTTNPVATEQWGDVSEIENMNAAEDA

SEQ ID NO: 128552 - protein, 36 aa, Artificial Sequence
  Description of Artificial Sequence: Synthetic polypeptide
DTEEIRTTNPVATEQYGSVSTVNNNQQGTTEETEED

SEQ ID NO: 128553 - protein, 36 aa, Artificial Sequence
  Description of Artificial Sequence: Synthetic polypeptide
DTEEIRTTNPVATEQYGSVSTVNNNQQSNDEETEDE

SEQ ID NO: 128554 - protein, 31 aa, Artificial Sequence
  Description of Artificial Sequence: Synthetic polypeptide
DENEIRTTNPVATEQWGDVSEIENKNAAEDA

SEQ ID NO: 128555 - protein, 30 aa, Artificial Sequence
  Description of Artificial Sequence: Synthetic polypeptide
DENEIRTTNPVATEQWGDVSEIEMYAAEFA

SEQ ID NO: 128556 - protein, 30 aa, Artificial Sequence
  Description of Artificial Sequence: Synthetic polypeptide
DENEIRTTNPVATEQWGDVSEIEMYAAEDA

SEQ ID NO: 128557 - protein, 30 aa, Artificial Sequence
  Description of Artificial Sequence: Synthetic polypeptide
DENEIRTTNPVATEQWGDVSEIEMWAAEDA

SEQ ID NO: 128558 - protein, 30 aa, Artificial Sequence
  Description of Artificial Sequence: Synthetic polypeptide
DENEIRTTNPVATEQWGDVSEIEMVAAEDT

SEQ ID NO: 128559 - protein, 31 aa, Artificial Sequence
  Description of Artificial Sequence: Synthetic polypeptide
DENEIRTTNPVATEQWGDVSEIEQMNAAEDA

SEQ ID NO: 128560 - protein, 30 aa, Artificial Sequence
  Description of Artificial Sequence: Synthetic polypeptide
DENEIRTTNPVATEQWGDVSEIEMVAAEDA

SEQ ID NO: 128561 - protein, 31 aa, Artificial Sequence
  Description of Artificial Sequence: Synthetic polypeptide
DENEIRTTNPVATEQWGDVSEIEQMNAAQDA

SEQ ID NO: 128562 - protein, 37 aa, Artificial Sequence
  Description of Artificial Sequence: Synthetic polypeptide
DTEEIRTTNPVATEQYGSVSTTNQQQQGNNATTNVTE

SEQ ID NO: 128563 - protein, 31 aa, Artificial Sequence
  Description of Artificial Sequence: Synthetic polypeptide
DENEIRTTNPVATEQWGDVSEIETMNAAEQA

SEQ ID NO: 128564 - protein, 31 aa, Artificial Sequence
  Description of Artificial Sequence: Synthetic polypeptide
DENEIRTTNPVATEQWGDVSEIETMNAAEDA

SEQ ID NO: 128565 - protein, 30 aa, Artificial Sequence
  Description of Artificial Sequence: Synthetic polypeptide
DENEIRTTNPVATEQWGDVSEIESNAAEDA

SEQ ID NO: 128566 - protein, 32 aa, Artificial Sequence
  Description of Artificial Sequence: Synthetic polypeptide
DENEIRTTNPVATEQWGDVSEIESMNSAEGDA

SEQ ID NO: 128567 - protein, 36 aa, Artificial Sequence
  Description of Artificial Sequence: Synthetic polypeptide
DTEEIRTTNPVATEQYGSVSTDAQQQGTNNNNNEED

SEQ ID NO: 128568 - protein, 33 aa, Artificial Sequence
  Description of Artificial Sequence: Synthetic polypeptide
DEECIRTTNPVATEIYGCVCQTEHQEYFGSNQS

SEQ ID NO: 128569 - protein, 30 aa, Artificial Sequence
  Description of Artificial Sequence: Synthetic polypeptide
DENEIRTTNPVATEQWGDVSEIERNASEDA

SEQ ID NO: 128570 - protein, 30 aa, Artificial Sequence
  Description of Artificial Sequence: Synthetic polypeptide
DENEIRTTNPVATEQWGDVSEIERNAAEDH

SEQ ID NO: 128571 - protein, 30 aa, Artificial Sequence
  Description of Artificial Sequence: Synthetic polypeptide
DENEIRTTNPVATEQWGDVSEIERNAAEDA

SEQ ID NO: 128572 - protein, 31 aa, Artificial Sequence
  Description of Artificial Sequence: Synthetic polypeptide
DENEIRTTNPVATEQWGDVSEIERMNAAVDA

SEQ ID NO: 128573 - protein, 31 aa, Artificial Sequence
  Description of Artificial Sequence: Synthetic polypeptide
DENEIRTTNPVATEQWGDVSEIERMNAAEVA

SEQ ID NO: 128574 - protein, 31 aa, Artificial Sequence
  Description of Artificial Sequence: Synthetic polypeptide
DENEIRTTNPVATEQWGDVSEIERMNAAEDA

SEQ ID NO: 128575 - protein, 35 aa, Artificial Sequence
  Description of Artificial Sequence: Synthetic polypeptide
AEMEIRTTNPVATEQYGSVNTWTYVDLQERDNDQM

SEQ ID NO: 128576 - protein, 38 aa, Artificial Sequence
  Description of Artificial Sequence: Synthetic polypeptide
DTEEIRTTNPVATEQYGSVSTTNNLQLGNNEQGTNDEQ

SEQ ID NO: 128577 - protein, 38 aa, Artificial Sequence
  Description of Artificial Sequence: Synthetic polypeptide
DTEEIRTTNPVATEQYGSVSTTNNNLQQGSEEGTNQES

SEQ ID NO: 128578 - protein, 34 aa, Artificial Sequence
  Description of Artificial Sequence: Synthetic polypeptide
DESEIRTTNPVATECWGSVSCINEPIDREGENGS

SEQ ID NO: 128579 - protein, 34 aa, Artificial Sequence
  Description of Artificial Sequence: Synthetic polypeptide
DESEIRTTNPVATECWGSVSCINEPHDREGENNG

SEQ ID NO: 128580 - protein, 34 aa, Artificial Sequence
  Description of Artificial Sequence: Synthetic polypeptide
DESEIRTTNPVATECWGSVSCINEPHDREGENHG

SEQ ID NO: 128581 - protein, 35 aa, Artificial Sequence
  Description of Artificial Sequence: Synthetic polypeptide
DEEEIRTTNPVATEQYGSVTYENVPEETPFQNERD

SEQ ID NO: 128582 - protein, 33 aa, Artificial Sequence
  Description of Artificial Sequence: Synthetic polypeptide
DESEIRTTNPVATECWGSVSCINEPHDRECENG

SEQ ID NO: 128583 - protein, 36 aa, Artificial Sequence
  Description of Artificial Sequence: Synthetic polypeptide
DEEEIRTTNPVATEQYGSVVEVNALATPRQDNLLII

SEQ ID NO: 128584 - protein, 30 aa, Artificial Sequence
  Description of Artificial Sequence: Synthetic polypeptide
DENEIRTTNPVATEQWGDVSEIEMTAASDA

SEQ ID NO: 128585 - protein, 32 aa, Artificial Sequence
  Description of Artificial Sequence: Synthetic polypeptide
DEAEIRTTNPVATEQYGASVEPLDEVPGDEDG

SEQ ID NO: 128586 - protein, 35 aa, Artificial Sequence
  Description of Artificial Sequence: Synthetic polypeptide
DEEEIRTTNPVATEQYGSVVCPENGVQMQGTVEED

SEQ ID NO: 128587 - protein, 34 aa, Artificial Sequence
  Description of Artificial Sequence: Synthetic polypeptide
DEECIRTTNPVATEIYGQVWTTANLERFGSDQTE

SEQ ID NO: 128588 - protein, 37 aa, Artificial Sequence
  Description of Artificial Sequence: Synthetic polypeptide
DTEEIRTTNPVATEQYGSVSTVTNLQQGTDEEEEQDE

SEQ ID NO: 128589 - protein, 33 aa, Artificial Sequence
  Description of Artificial Sequence: Synthetic polypeptide
DESEIRTTNPVATECWGSVSCINEPFDREGEMG

SEQ ID NO: 128590 - protein, 36 aa, Artificial Sequence
  Description of Artificial Sequence: Synthetic polypeptide
DEECIRTTNPVATEIYGQVWTWTANILEERFGSNQR

SEQ ID NO: 128591 - protein, 31 aa, Artificial Sequence
  Description of Artificial Sequence: Synthetic polypeptide
DENEIRTTNPVATEQWGDVSEIEMNRAEEDA

SEQ ID NO: 128592 - protein, 34 aa, Artificial Sequence
  Description of Artificial Sequence: Synthetic polypeptide
DEEEIRTTNPVATEQYGSVVCVVSNEIERVEESF

SEQ ID NO: 128593 - protein, 33 aa, Artificial Sequence
  Description of Artificial Sequence: Synthetic polypeptide
DEEEIRTTNPVATEQYGSVVDAVSHFENTSEEK

SEQ ID NO: 128594 - protein, 31 aa, Artificial Sequence
  Description of Artificial Sequence: Synthetic polypeptide
DEDEIATTNPVATAQWGCVATALTARGDTDM

SEQ ID NO: 128595 - protein, 34 aa, Artificial Sequence
  Description of Artificial Sequence: Synthetic polypeptide
DEAEIRTTNPVAYEQWGSVCVNENGLQDGQDGVR

SEQ ID NO: 128596 - protein, 31 aa, Artificial Sequence
  Description of Artificial Sequence: Synthetic polypeptide
DENEIRTTNPVATEQWGDVSEIEMNQAELDA

SEQ ID NO: 128597 - protein, 31 aa, Artificial Sequence
  Description of Artificial Sequence: Synthetic polypeptide
DENEIRTTNPVATEQWGDVSEIEMNQAEDIA

SEQ ID NO: 128598 - protein, 35 aa, Artificial Sequence
  Description of Artificial Sequence: Synthetic polypeptide
DEEEIRTTNPVATEQYGSVVDDNMTMEQDNQEMGN

SEQ ID NO: 128599 - protein, 30 aa, Artificial Sequence
  Description of Artificial Sequence: Synthetic polypeptide
DENEIRTTNPVATEQWGDVSEIEMNPVEDA

SEQ ID NO: 128600 - protein, 33 aa, Artificial Sequence
  Description of Artificial Sequence: Synthetic polypeptide
DESEIRTTNPVATECWGSVSCINEPEDREGEWG

SEQ ID NO: 128601 - protein, 30 aa, Artificial Sequence
  Description of Artificial Sequence: Synthetic polypeptide
DENEIRTTNPVATEQWGDVSEIEMNPAEDA

SEQ ID NO: 128602 - protein, 31 aa, Artificial Sequence
  Description of Artificial Sequence: Synthetic polypeptide
DENEIRTTNPVATEQWGDVSEIEMNNAEDPA

SEQ ID NO: 128603 - protein, 30 aa, Artificial Sequence
  Description of Artificial Sequence: Synthetic polypeptide
DENEIRTTNPVATEQWGDVSEIEMNNAEDA

SEQ ID NO: 128604 - protein, 30 aa, Artificial Sequence
  Description of Artificial Sequence: Synthetic polypeptide
DENEIRTTNPVATEQWGDVSEIEMNMAEDA

SEQ ID NO: 128605 - protein, 34 aa, Artificial Sequence
  Description of Artificial Sequence: Synthetic polypeptide
DEECIRTTNPVATEIYGQVCTDTANDERFGSDQR

SEQ ID NO: 128606 - protein, 30 aa, Artificial Sequence
  Description of Artificial Sequence: Synthetic polypeptide
DENEIRTTNPVATEQWGDVSEIEMTAAEDA

SEQ ID NO: 128607 - protein, 30 aa, Artificial Sequence
  Description of Artificial Sequence: Synthetic polypeptide
DENEIRTTNPVATEQWGDVSEIEMNSAEDA

SEQ ID NO: 128608 - protein, 31 aa, Artificial Sequence
  Description of Artificial Sequence: Synthetic polypeptide
DENEIRTTNPVATEQWGDVSEIEMNSAEDKA

SEQ ID NO: 128609 - protein, 34 aa, Artificial Sequence
  Description of Artificial Sequence: Synthetic polypeptide
DEQEIATTNPVATEQYGSVSATGDNGEDNEGEDD

SEQ ID NO: 128610 - protein, 37 aa, Artificial Sequence
  Description of Artificial Sequence: Synthetic polypeptide
DTEEIRTTNPVATEQYGSVSTVNQNNQQGNNTEQGTE

SEQ ID NO: 128611 - protein, 30 aa, Artificial Sequence
  Description of Artificial Sequence: Synthetic polypeptide
DENEIRTTNPVATEQWGDVSEIEMSAAEDA

SEQ ID NO: 128612 - protein, 37 aa, Artificial Sequence
  Description of Artificial Sequence: Synthetic polypeptide
DTEEIRTTNPVATEQYGSVSTVNQQQNNNEQGNNNVD

SEQ ID NO: 128613 - protein, 37 aa, Artificial Sequence
  Description of Artificial Sequence: Synthetic polypeptide
DTEEIRTTNPVATEQYGSVSTVNTNQQQGNTTEQGVE

SEQ ID NO: 128614 - protein, 37 aa, Artificial Sequence
  Description of Artificial Sequence: Synthetic polypeptide
DTEEIRTTNPVATEQYGSVSTVTNDQQGNTNQIGTSE

SEQ ID NO: 128615 - protein, 37 aa, Artificial Sequence
  Description of Artificial Sequence: Synthetic polypeptide
DTEEIRTTNPVATEQYGSVSTVTNLEQGTNNATNEED

SEQ ID NO: 128616 - protein, 35 aa, Artificial Sequence
  Description of Artificial Sequence: Synthetic polypeptide
DEEEIRTTNPVATEQYGSVVCMPALPQVAIQNDEF

SEQ ID NO: 128617 - protein, 35 aa, Artificial Sequence
  Description of Artificial Sequence: Synthetic polypeptide
DEQEIATTNPVATEQYGSVSATGDNGEDQEGEDGL

SEQ ID NO: 128618 - protein, 30 aa, Artificial Sequence
  Description of Artificial Sequence: Synthetic polypeptide
DENEIRTTNPVATEQWGDVSEIEMPAAEDA

SEQ ID NO: 128619 - protein, 30 aa, Artificial Sequence
  Description of Artificial Sequence: Synthetic polypeptide
DENEIRTTNPVATEQWGDVSEIEMNYAEDA

SEQ ID NO: 128620 - protein, 31 aa, Artificial Sequence
  Description of Artificial Sequence: Synthetic polypeptide
DENEIRTTNPVATEQWGDVSEIEMNWAEDAS

SEQ ID NO: 128621 - protein, 30 aa, Artificial Sequence
  Description of Artificial Sequence: Synthetic polypeptide
DENEIRTTNPVATEQWGDVSEIEMNWAEDA

SEQ ID NO: 128622 - protein, 30 aa, Artificial Sequence
  Description of Artificial Sequence: Synthetic polypeptide
DENEIRTTNPVATEQWGDVSEIEMNVAEDA

SEQ ID NO: 128623 - protein, 30 aa, Artificial Sequence
  Description of Artificial Sequence: Synthetic polypeptide
DENEIRTTNPVATEQWGDVSEIEMNTAEDA

SEQ ID NO: 128624 - protein, 31 aa, Artificial Sequence
  Description of Artificial Sequence: Synthetic polypeptide
DENEIRTTNPVATEQWGDVSEIEMNSAERDA

SEQ ID NO: 128625 - protein, 37 aa, Artificial Sequence
  Description of Artificial Sequence: Synthetic polypeptide
DTEEIRTTNPVATEQYGSVSTVTNLQNSTEQGTEESE

SEQ ID NO: 128626 - protein, 30 aa, Artificial Sequence
  Description of Artificial Sequence: Synthetic polypeptide
DENEIRTTNPVATEQWGDVSEIEMNSAEDT

SEQ ID NO: 128627 - protein, 31 aa, Artificial Sequence
  Description of Artificial Sequence: Synthetic polypeptide
DENEIRTTNPVATEQWGDVSEIEMNSAEDQA

SEQ ID NO: 128628 - protein, 31 aa, Artificial Sequence
  Description of Artificial Sequence: Synthetic polypeptide
DENEIRTTNPVATEQWGDVSEIEMNSAEDAY

SEQ ID NO: 128629 - protein, 37 aa, Artificial Sequence
  Description of Artificial Sequence: Synthetic polypeptide
DTEEIRTTNPVATEQYGVVSTTNNLQAGNTEQGTEDE

SEQ ID NO: 128630 - protein, 34 aa, Artificial Sequence
  Description of Artificial Sequence: Synthetic polypeptide
DEEEIRTTNPVATEQYGSVVFLEMSSQQHGGSYE

SEQ ID NO: 128631 - protein, 31 aa, Artificial Sequence
  Description of Artificial Sequence: Synthetic polypeptide
DENEIRTTNPVATEQWGDVSEIEMNAAFDAQ

SEQ ID NO: 128632 - protein, 30 aa, Artificial Sequence
  Description of Artificial Sequence: Synthetic polypeptide
DENEIRTTNPVATEQWGDVSEIEMNAAADA

SEQ ID NO: 128633 - protein, 31 aa, Artificial Sequence
  Description of Artificial Sequence: Synthetic polypeptide
DENEIRTTNPVATEQWGDVSEIEMMNAQEDA

SEQ ID NO: 128634 - protein, 34 aa, Artificial Sequence
  Description of Artificial Sequence: Synthetic polypeptide
DEAEIRTTNPVAYEQWGSVCVTDNNDQAGDVNGN

SEQ ID NO: 128635 - protein, 35 aa, Artificial Sequence
  Description of Artificial Sequence: Synthetic polypeptide
DEEEIRTTNPVATEQYGSVVGDPGIGDQEQGNEFE

SEQ ID NO: 128636 - protein, 31 aa, Artificial Sequence
  Description of Artificial Sequence: Synthetic polypeptide
DENEIRTTNPVATEQWGDVSEIEMMAAEMNA

SEQ ID NO: 128637 - protein, 30 aa, Artificial Sequence
  Description of Artificial Sequence: Synthetic polypeptide
DENEIRTTNPVATEQWGDVSEIEMMAAEDV

SEQ ID NO: 128638 - protein, 30 aa, Artificial Sequence
  Description of Artificial Sequence: Synthetic polypeptide
DENEIRTTNPVATEQWGDVSEIEMMAAEDA

SEQ ID NO: 128639 - protein, 31 aa, Artificial Sequence
  Description of Artificial Sequence: Synthetic polypeptide
DENEIRTTNPVATEQWGDVSEIEMLAAERDA

SEQ ID NO: 128640 - protein, 35 aa, Artificial Sequence
  Description of Artificial Sequence: Synthetic polypeptide
DEEEIRTTNPVATEQYGSVVGFGNDGQTEQEDNEG

SEQ ID NO: 128641 - protein, 37 aa, Artificial Sequence
  Description of Artificial Sequence: Synthetic polypeptide
DTEEIRTTNPVATEQYGVVSTTTNLQAGNQEQIGTED

SEQ ID NO: 128642 - protein, 33 aa, Artificial Sequence
  Description of Artificial Sequence: Synthetic polypeptide
DESEIRTTNPVATECWGSVSCINEPEDPEGENG

SEQ ID NO: 128643 - protein, 31 aa, Artificial Sequence
  Description of Artificial Sequence: Synthetic polypeptide
DENEIRTTNPVATEQWGDVSEIEMKAAEDRA

SEQ ID NO: 128644 - protein, 30 aa, Artificial Sequence
  Description of Artificial Sequence: Synthetic polypeptide
DENEIRTTNPVATEQWGDVSEIEMKAAEDA

SEQ ID NO: 128645 - protein, 30 aa, Artificial Sequence
  Description of Artificial Sequence: Synthetic polypeptide
DENEIRTTNPVATEQWGDVSEIEMIAAEDA

SEQ ID NO: 128646 - protein, 35 aa, Artificial Sequence
  Description of Artificial Sequence: Synthetic polypeptide
DEAEIRTTNPVATEQWGVVSVSPNLVQDNGGGDVH

SEQ ID NO: 128647 - protein, 30 aa, Artificial Sequence
  Description of Artificial Sequence: Synthetic polypeptide
DENEIRTTNPVATEQWGDVSEIEMHAAEDA

SEQ ID NO: 128648 - protein, 30 aa, Artificial Sequence
  Description of Artificial Sequence: Synthetic polypeptide
DENEIRTTNPVATEQWGDVSEIEMHAACDA

SEQ ID NO: 128649 - protein, 37 aa, Artificial Sequence
  Description of Artificial Sequence: Synthetic polypeptide
DTEEIRTTNPVATEQYGVVSTTTNLQAGNQEQNTTDD

SEQ ID NO: 128650 - protein, 30 aa, Artificial Sequence
  Description of Artificial Sequence: Synthetic polypeptide
DENEIRTTNPVATEQWGDVSEIEMGAAEDA

SEQ ID NO: 128651 - protein, 31 aa, Artificial Sequence
  Description of Artificial Sequence: Synthetic polypeptide
DENEIRTTNPVATEQWGDVSEIEMNAAADAC

SEQ ID NO: 128652 - protein, 30 aa, Artificial Sequence
  Description of Artificial Sequence: Synthetic polypeptide
DENEIRTTNPVATEQWGDVSEIEMFAIEDA

SEQ ID NO: 128653 - protein, 30 aa, Artificial Sequence
  Description of Artificial Sequence: Synthetic polypeptide
DENEIRTTNPVATEQWGDVSEIEMNAACDA

SEQ ID NO: 128654 - protein, 31 aa, Artificial Sequence
  Description of Artificial Sequence: Synthetic polypeptide
DENEIRTTNPVATEQWGDVSEIEMNAADEQA

SEQ ID NO: 128655 - protein, 31 aa, Artificial Sequence
  Description of Artificial Sequence: Synthetic polypeptide
DENEIRTTNPVATEQWGDVSEIEMNAAEDAN

SEQ ID NO: 128656 - protein, 31 aa, Artificial Sequence
  Description of Artificial Sequence: Synthetic polypeptide
DENEIRTTNPVATEQWGDVSEIEMNAAEDAM

SEQ ID NO: 128657 - protein, 31 aa, Artificial Sequence
  Description of Artificial Sequence: Synthetic polypeptide
DENEIRTTNPVATEQWGDVSEIEMNAAEDAL

SEQ ID NO: 128658 - protein, 31 aa, Artificial Sequence
  Description of Artificial Sequence: Synthetic polypeptide
DENEIRTTNPVATEQWGDVSEIEMNAAEDAK

SEQ ID NO: 128659 - protein, 31 aa, Artificial Sequence
  Description of Artificial Sequence: Synthetic polypeptide
DENEIRTTNPVATEQWGDVSEIEMNAAEDAI

SEQ ID NO: 128660 - protein, 31 aa, Artificial Sequence
  Description of Artificial Sequence: Synthetic polypeptide
DENEIRTTNPVATEQWGDVSEIEMNAAEDAH

SEQ ID NO: 128661 - protein, 31 aa, Artificial Sequence
  Description of Artificial Sequence: Synthetic polypeptide
DENEIRTTNPVATEQWGDVSEIEMNAAEDAG

SEQ ID NO: 128662 - protein, 31 aa, Artificial Sequence
  Description of Artificial Sequence: Synthetic polypeptide
DENEIRTTNPVATEQWGDVSEIEMNAAEDAF

SEQ ID NO: 128663 - protein, 31 aa, Artificial Sequence
  Description of Artificial Sequence: Synthetic polypeptide
DENEIRTTNPVATEQWGDVSEIEMNAAEDAE

SEQ ID NO: 128664 - protein, 31 aa, Artificial Sequence
  Description of Artificial Sequence: Synthetic polypeptide
DENEIRTTNPVATEQWGDVSEIEMNAAEDAD

SEQ ID NO: 128665 - protein, 31 aa, Artificial Sequence
  Description of Artificial Sequence: Synthetic polypeptide
DENEIRTTNPVATEQWGDVSEIEMNAAEDAC

SEQ ID NO: 128666 - protein, 31 aa, Artificial Sequence
  Description of Artificial Sequence: Synthetic polypeptide
DENEIRTTNPVATEQWGDVSEIEMNAAEDAA

SEQ ID NO: 128667 - protein, 31 aa, Artificial Sequence
  Description of Artificial Sequence: Synthetic polypeptide
DENEIRTTNPVATEQWGDVSEIEMNAAECHA

SEQ ID NO: 128668 - protein, 31 aa, Artificial Sequence
  Description of Artificial Sequence: Synthetic polypeptide
DENEIRTTNPVATEQWGDVSEIEMNAAECDA

SEQ ID NO: 128669 - protein, 30 aa, Artificial Sequence
  Description of Artificial Sequence: Synthetic polypeptide
DENEIRTTNPVATEQWGDVSEIEMNAAECA

SEQ ID NO: 128670 - protein, 30 aa, Artificial Sequence
  Description of Artificial Sequence: Synthetic polypeptide
DENEIRTTNPVATEQWGDVSEIEMNAAEAH

SEQ ID NO: 128671 - protein, 31 aa, Artificial Sequence
  Description of Artificial Sequence: Synthetic polypeptide
DENEIRTTNPVATEQWGDVSEIEMNAAEADE

SEQ ID NO: 128672 - protein, 31 aa, Artificial Sequence
  Description of Artificial Sequence: Synthetic polypeptide
DENEIRTTNPVATEQWGDVSEIEMNAAEADA

SEQ ID NO: 128673 - protein, 30 aa, Artificial Sequence
  Description of Artificial Sequence: Synthetic polypeptide
DENEIRTTNPVATEQWGDVSEIEMNAAEAA

SEQ ID NO: 128674 - protein, 30 aa, Artificial Sequence
  Description of Artificial Sequence: Synthetic polypeptide
DENEIRTTNPVATEQWGDVSEIEMNAADDA

SEQ ID NO: 128675 - protein, 31 aa, Artificial Sequence
  Description of Artificial Sequence: Synthetic polypeptide
DENEIRTTNPVATEQWGDVSEIEMNAAEDAP

SEQ ID NO: 128676 - protein, 37 aa, Artificial Sequence
  Description of Artificial Sequence: Synthetic polypeptide
DTEEIRTTNPVATEQYGVVSTTTNLQAGNTEQGGTDD

SEQ ID NO: 128677 - protein, 30 aa, Artificial Sequence
  Description of Artificial Sequence: Synthetic polypeptide
DENEIRTTNPVATEQWGDVSEIEMEAAEDA

SEQ ID NO: 128678 - protein, 30 aa, Artificial Sequence
  Description of Artificial Sequence: Synthetic polypeptide
DENEIRTTNPVATEQWGDVSEIEKNAAEIA

SEQ ID NO: 128679 - protein, 30 aa, Artificial Sequence
  Description of Artificial Sequence: Synthetic polypeptide
DENEIRTTNPVATEQWGDVSEIEKNAAEDA

SEQ ID NO: 128680 - protein, 37 aa, Artificial Sequence
  Description of Artificial Sequence: Synthetic polypeptide
DTEEIRTTNPVATEQYGVVSTTTNLQQNGNTEQGTSE

SEQ ID NO: 128681 - protein, 31 aa, Artificial Sequence
  Description of Artificial Sequence: Synthetic polypeptide
DENEIRTTNPVATEQWGDVSEIEINAAESDA

SEQ ID NO: 128682 - protein, 30 aa, Artificial Sequence
  Description of Artificial Sequence: Synthetic polypeptide
DENEIRTTNPVATEQWGDVSEIEINAAEDA

SEQ ID NO: 128683 - protein, 36 aa, Artificial Sequence
  Description of Artificial Sequence: Synthetic polypeptide
DTEEIRTTNPVATEQYGVVSTTVNDQAGNQEQGNTD

SEQ ID NO: 128684 - protein, 30 aa, Artificial Sequence
  Description of Artificial Sequence: Synthetic polypeptide
DENEIRTTNPVATEQWGDVSEIEHNAAEDA

SEQ ID NO: 128685 - protein, 36 aa, Artificial Sequence
  Description of Artificial Sequence: Synthetic polypeptide
DTEEIRTTNPVATEQYGVVSTTVNDQQGNTEQGTSE

SEQ ID NO: 128686 - protein, 31 aa, Artificial Sequence
  Description of Artificial Sequence: Synthetic polypeptide
DENEIRTTNPVATEQWGDVSEIEGNAAEDDA

SEQ ID NO: 128687 - protein, 30 aa, Artificial Sequence
  Description of Artificial Sequence: Synthetic polypeptide
DENEIRTTNPVATEQWGDVSEIEGNAAEDA

SEQ ID NO: 128688 - protein, 30 aa, Artificial Sequence
  Description of Artificial Sequence: Synthetic polypeptide
DENEIRTTNPVATEQWGDVSEIEFNDAEDA

SEQ ID NO: 128689 - protein, 30 aa, Artificial Sequence
  Description of Artificial Sequence: Synthetic polypeptide
DENEIRTTNPVATEQWGDVSEIEFNAAVDS

SEQ ID NO: 128690 - protein, 30 aa, Artificial Sequence
  Description of Artificial Sequence: Synthetic polypeptide
DENEIRTTNPVATEQWGDVSEIEFNAAEDP

SEQ ID NO: 128691 - protein, 30 aa, Artificial Sequence
  Description of Artificial Sequence: Synthetic polypeptide
DENEIRTTNPVATEQWGDVSEIEFNAAEDA

SEQ ID NO: 128692 - protein, 31 aa, Artificial Sequence
  Description of Artificial Sequence: Synthetic polypeptide
DENEIRTTNPVATEQWGDVSEIEENIAEDAD

SEQ ID NO: 128693 - protein, 35 aa, Artificial Sequence
  Description of Artificial Sequence: Synthetic polypeptide
DEAEIRTTNPVAYEQWGSVCVTENNDQHDQGNADR

SEQ ID NO: 128694 - protein, 36 aa, Artificial Sequence
  Description of Artificial Sequence: Synthetic polypeptide
DEEEIRTTNPVATEQYGSVVGSGQDDEEQDGEGNEG

SEQ ID NO: 128695 - protein, 31 aa, Artificial Sequence
  Description of Artificial Sequence: Synthetic polypeptide
DENEIRTTNPVATEQWGDVSEIEENAEEDDA

SEQ ID NO: 128696 - protein, 37 aa, Artificial Sequence
  Description of Artificial Sequence: Synthetic polypeptide
DTEEIRTTNPVATEQYGVVSTVNLQQGNNNQDTEDED

SEQ ID NO: 128697 - protein, 30 aa, Artificial Sequence
  Description of Artificial Sequence: Synthetic polypeptide
DENEIRTTNPVATEQWGDVSEIEKVAAEDA

SEQ ID NO: 128698 - protein, 30 aa, Artificial Sequence
  Description of Artificial Sequence: Synthetic polypeptide
DENEIRTTNPVATEQWGDVSEIEMFAAEDA

SEQ ID NO: 128699 - protein, 31 aa, Artificial Sequence
  Description of Artificial Sequence: Synthetic polypeptide
DENEIRTTNPVATEQWGDVSEIELMKAAEDA

SEQ ID NO: 128700 - protein, 37 aa, Artificial Sequence
  Description of Artificial Sequence: Synthetic polypeptide
DTEEIRTTNPVATEQYGVVSTTTNLQQLGNTQQGTNE

SEQ ID NO: 128701 - protein, 30 aa, Artificial Sequence
  Description of Artificial Sequence: Synthetic polypeptide
DENEIRTTNPVATEQWGDVSEIEMDHAEEA

SEQ ID NO: 128702 - protein, 33 aa, Artificial Sequence
  Description of Artificial Sequence: Synthetic polypeptide
CEEEIATTNPVAYEQYGSVAINNLSNDAGNDME

SEQ ID NO: 128703 - protein, 30 aa, Artificial Sequence
  Description of Artificial Sequence: Synthetic polypeptide
DENEIRTTNPVATEQWGDVSEIEMDAEEDA

SEQ ID NO: 128704 - protein, 30 aa, Artificial Sequence
  Description of Artificial Sequence: Synthetic polypeptide
DENEIRTTNPVATEQWGDVSEIEMDAAEEA

SEQ ID NO: 128705 - protein, 30 aa, Artificial Sequence
  Description of Artificial Sequence: Synthetic polypeptide
DENEIRTTNPVATEQWGDVSEIEMDAAEDH

SEQ ID NO: 128706 - protein, 30 aa, Artificial Sequence
  Description of Artificial Sequence: Synthetic polypeptide
DENEIRTTNPVATEQWGDVSEIEMDAAEDA

SEQ ID NO: 128707 - protein, 30 aa, Artificial Sequence
  Description of Artificial Sequence: Synthetic polypeptide
DENEIRTTNPVATEQWGDVSEIEMCAASDA

SEQ ID NO: 128708 - protein, 30 aa, Artificial Sequence
  Description of Artificial Sequence: Synthetic polypeptide
DENEIRTTNPVATEQWGDVSEIEMCAAEDA

SEQ ID NO: 128709 - protein, 32 aa, Artificial Sequence
  Description of Artificial Sequence: Synthetic polypeptide
DEDEIATTNPVATAQWGCVAGTGLQDSGGNQE

SEQ ID NO: 128710 - protein, 33 aa, Artificial Sequence
  Description of Artificial Sequence: Synthetic polypeptide
DEAEIRTTNPVAYEQWGSVCVTEGHQQGTGNAN

SEQ ID NO: 128711 - protein, 37 aa, Artificial Sequence
  Description of Artificial Sequence: Synthetic polypeptide
DTEEIRTTNPVATEQYGVVSTTTNLQQGNTEQGTEDS

SEQ ID NO: 128712 - protein, 34 aa, Artificial Sequence
  Description of Artificial Sequence: Synthetic polypeptide
DEAEIRTTNPVAYEQWGSVCVTEHLQDGTGGNAN

SEQ ID NO: 128713 - protein, 37 aa, Artificial Sequence
  Description of Artificial Sequence: Synthetic polypeptide
DTEEIRTTNPVATEQYGVVSTTTNLQQLGNTEQGATE

SEQ ID NO: 128714 - protein, 34 aa, Artificial Sequence
  Description of Artificial Sequence: Synthetic polypeptide
DEQEIATTNPVATEQYGSVSATHDLGEDHEGEDL

SEQ ID NO: 128715 - protein, 34 aa, Artificial Sequence
  Description of Artificial Sequence: Synthetic polypeptide
DEQEIATTNPVATEQYGSVSATHGTDHQGGEDFH

SEQ ID NO: 128716 - protein, 30 aa, Artificial Sequence
  Description of Artificial Sequence: Synthetic polypeptide
DENEIRTTNPVATEQWGDVSEIEMAAAEDA

SEQ ID NO: 128717 - protein, 30 aa, Artificial Sequence
  Description of Artificial Sequence: Synthetic polypeptide
DENEIRTTNPVATEQWGDVSEIEMAAAADA

SEQ ID NO: 128718 - protein, 36 aa, Artificial Sequence
  Description of Artificial Sequence: Synthetic polypeptide
DEEEIRTTNPVATEQYGSVVGNMTVGQGQEGEGNEG

SEQ ID NO: 128719 - protein, 36 aa, Artificial Sequence
  Description of Artificial Sequence: Synthetic polypeptide
DEEEIRTTNPVATEQYGSVVGPTVNVMQNRFEPSIL

SEQ ID NO: 128720 - protein, 31 aa, Artificial Sequence
  Description of Artificial Sequence: Synthetic polypeptide
DENEIRTTNPVATEQWGDVSEIELMNAAEDA

SEQ ID NO: 128721 - protein, 36 aa, Artificial Sequence
  Description of Artificial Sequence: Synthetic polypeptide
DTEEIRTTNPVATEQYGSVSSTTPAGPNMRNGMNPV

SEQ ID NO: 128722 - protein, 31 aa, Artificial Sequence
  Description of Artificial Sequence: Synthetic polypeptide
DENEIRTTNPVATEQWGDVSEIEMNAAEDAQ

SEQ ID NO: 128723 - protein, 31 aa, Artificial Sequence
  Description of Artificial Sequence: Synthetic polypeptide
DENEIRTTNPVATEQWGDVSEIEMNAAEDAT

SEQ ID NO: 128724 - protein, 30 aa, Artificial Sequence
  Description of Artificial Sequence: Synthetic polypeptide
DENEIRTTNPVATEQWGDVSEIEMNAAEMA

SEQ ID NO: 128725 - protein, 31 aa, Artificial Sequence
  Description of Artificial Sequence: Synthetic polypeptide
DENEIRTTNPVATEQWGDVSEIEMNAAELDA

SEQ ID NO: 128726 - protein, 30 aa, Artificial Sequence
  Description of Artificial Sequence: Synthetic polypeptide
DENEIRTTNPVATEQWGDVSEIEMNAAELA

SEQ ID NO: 128727 - protein, 31 aa, Artificial Sequence
  Description of Artificial Sequence: Synthetic polypeptide
DENEIRTTNPVATEQWGDVSEIEMNAAEKDA

SEQ ID NO: 128728 - protein, 31 aa, Artificial Sequence
  Description of Artificial Sequence: Synthetic polypeptide
DENEIRTTNPVATEQWGDVSEIEMNAAEKAQ

SEQ ID NO: 128729 - protein, 30 aa, Artificial Sequence
  Description of Artificial Sequence: Synthetic polypeptide
DENEIRTTNPVATEQWGDVSEIEMNAAEKA

SEQ ID NO: 128730 - protein, 31 aa, Artificial Sequence
  Description of Artificial Sequence: Synthetic polypeptide
DENEIRTTNPVATEQWGDVSEIEMNAAEIRA

SEQ ID NO: 128731 - protein, 31 aa, Artificial Sequence
  Description of Artificial Sequence: Synthetic polypeptide
DENEIRTTNPVATEQWGDVSEIEMNAAEIDA

SEQ ID NO: 128732 - protein, 30 aa, Artificial Sequence
  Description of Artificial Sequence: Synthetic polypeptide
DENEIRTTNPVATEQWGDVSEIEMNAAEIA

SEQ ID NO: 128733 - protein, 31 aa, Artificial Sequence
  Description of Artificial Sequence: Synthetic polypeptide
DENEIRTTNPVATEQWGDVSEIEMNAAEHDA

SEQ ID NO: 128734 - protein, 30 aa, Artificial Sequence
  Description of Artificial Sequence: Synthetic polypeptide
DENEIRTTNPVATEQWGDVSEIEMNAAEHA

SEQ ID NO: 128735 - protein, 31 aa, Artificial Sequence
  Description of Artificial Sequence: Synthetic polypeptide
DENEIRTTNPVATEQWGDVSEIEMNAAEFWA

SEQ ID NO: 128736 - protein, 31 aa, Artificial Sequence
  Description of Artificial Sequence: Synthetic polypeptide
DENEIRTTNPVATEQWGDVSEIEMNAAEFKA

SEQ ID NO: 128737 - protein, 31 aa, Artificial Sequence
  Description of Artificial Sequence: Synthetic polypeptide
DENEIRTTNPVATEQWGDVSEIEMNAAEFDA

SEQ ID NO: 128738 - protein, 30 aa, Artificial Sequence
  Description of Artificial Sequence: Synthetic polypeptide
DENEIRTTNPVATEQWGDVSEIEMNAAEFA

SEQ ID NO: 128739 - protein, 30 aa, Artificial Sequence
  Description of Artificial Sequence: Synthetic polypeptide
DENEIRTTNPVATEQWGDVSEIEMNAAEEK

SEQ ID NO: 128740 - protein, 31 aa, Artificial Sequence
  Description of Artificial Sequence: Synthetic polypeptide
DENEIRTTNPVATEQWGDVSEIEMNAAEEDA

SEQ ID NO: 128741 - protein, 31 aa, Artificial Sequence
  Description of Artificial Sequence: Synthetic polypeptide
DENEIRTTNPVATEQWGDVSEIEMNAAEEAF

SEQ ID NO: 128742 - protein, 30 aa, Artificial Sequence
  Description of Artificial Sequence: Synthetic polypeptide
DENEIRTTNPVATEQWGDVSEIEMNAAEEA

SEQ ID NO: 128743 - protein, 31 aa, Artificial Sequence
  Description of Artificial Sequence: Synthetic polypeptide
DENEIRTTNPVATEQWGDVSEIEMNAAEMAA

SEQ ID NO: 128744 - protein, 31 aa, Artificial Sequence
  Description of Artificial Sequence: Synthetic polypeptide
DENEIRTTNPVATEQWGDVSEIEMNAAEDYW

SEQ ID NO: 128745 - protein, 31 aa, Artificial Sequence
  Description of Artificial Sequence: Synthetic polypeptide
DENEIRTTNPVATEQWGDVSEIEMNAAEMDA

SEQ ID NO: 128746 - protein, 30 aa, Artificial Sequence
  Description of Artificial Sequence: Synthetic polypeptide
DENEIRTTNPVATEQWGDVSEIEMNAAEPA

SEQ ID NO: 128747 - protein, 30 aa, Artificial Sequence
  Description of Artificial Sequence: Synthetic polypeptide
DENEIRTTNPVATEQWGDVSEIEMNAAFDA

SEQ ID NO: 128748 - protein, 31 aa, Artificial Sequence
  Description of Artificial Sequence: Synthetic polypeptide
DENEIRTTNPVATEQWGDVSEIEMNAAEYDA

SEQ ID NO: 128749 - protein, 30 aa, Artificial Sequence
  Description of Artificial Sequence: Synthetic polypeptide
DENEIRTTNPVATEQWGDVSEIEMNAAEYA

SEQ ID NO: 128750 - protein, 31 aa, Artificial Sequence
  Description of Artificial Sequence: Synthetic polypeptide
DENEIRTTNPVATEQWGDVSEIEMNAAEWDY

SEQ ID NO: 128751 - protein, 31 aa, Artificial Sequence
  Description of Artificial Sequence: Synthetic polypeptide
DENEIRTTNPVATEQWGDVSEIEMNAAEWDA

SEQ ID NO: 128752 - protein, 30 aa, Artificial Sequence
  Description of Artificial Sequence: Synthetic polypeptide
DENEIRTTNPVATEQWGDVSEIEMNAAEWA

SEQ ID NO: 128753 - protein, 31 aa, Artificial Sequence
  Description of Artificial Sequence: Synthetic polypeptide
DENEIRTTNPVATEQWGDVSEIEMNAAEVDA

SEQ ID NO: 128754 - protein, 30 aa, Artificial Sequence
  Description of Artificial Sequence: Synthetic polypeptide
DENEIRTTNPVATEQWGDVSEIEMNAAEVA

SEQ ID NO: 128755 - protein, 31 aa, Artificial Sequence
  Description of Artificial Sequence: Synthetic polypeptide
DENEIRTTNPVATEQWGDVSEIEMNAAETPA

SEQ ID NO: 128756 - protein, 31 aa, Artificial Sequence
  Description of Artificial Sequence: Synthetic polypeptide
DENEIRTTNPVATEQWGDVSEIEMNAAETDA

SEQ ID NO: 128757 - protein, 31 aa, Artificial Sequence
  Description of Artificial Sequence: Synthetic polypeptide
DENEIRTTNPVATEQWGDVSEIEMNAAETAA

SEQ ID NO: 128758 - protein, 30 aa, Artificial Sequence
  Description of Artificial Sequence: Synthetic polypeptide
DENEIRTTNPVATEQWGDVSEIEMNAAETA

SEQ ID NO: 128759 - protein, 31 aa, Artificial Sequence
  Description of Artificial Sequence: Synthetic polypeptide
DENEIRTTNPVATEQWGDVSEIEMNAAESDA

SEQ ID NO: 128760 - protein, 30 aa, Artificial Sequence
  Description of Artificial Sequence: Synthetic polypeptide
DENEIRTTNPVATEQWGDVSEIEMNAAESA

SEQ ID NO: 128761 - protein, 31 aa, Artificial Sequence
  Description of Artificial Sequence: Synthetic polypeptide
DENEIRTTNPVATEQWGDVSEIEMNAAERDA

SEQ ID NO: 128762 - protein, 34 aa, Artificial Sequence
  Description of Artificial Sequence: Synthetic polypeptide
DEEEIRTTNPVATEQYGSVVFQEMSSQHGGSYIY

SEQ ID NO: 128763 - protein, 31 aa, Artificial Sequence
  Description of Artificial Sequence: Synthetic polypeptide
DENEIRTTNPVATEQWGDVSEIEMNAAEQDA

SEQ ID NO: 128764 - protein, 30 aa, Artificial Sequence
  Description of Artificial Sequence: Synthetic polypeptide
DENEIRTTNPVATEQWGDVSEIEMNAAEQA

SEQ ID NO: 128765 - protein, 31 aa, Artificial Sequence
  Description of Artificial Sequence: Synthetic polypeptide
DENEIRTTNPVATEQWGDVSEIEMNAAEPDA

SEQ ID NO: 128766 - protein, 31 aa, Artificial Sequence
  Description of Artificial Sequence: Synthetic polypeptide
DENEIRTTNPVATEQWGDVSEIEMNAAENDA

SEQ ID NO: 128767 - protein, 31 aa, Artificial Sequence
  Description of Artificial Sequence: Synthetic polypeptide
DENEIRTTNPVATEQWGDVSEIEMNAAEDAS

SEQ ID NO: 128768 - protein, 31 aa, Artificial Sequence
  Description of Artificial Sequence: Synthetic polypeptide
DENEIRTTNPVATEQWGDVSEIEMNAAEDYA

SEQ ID NO: 128769 - protein, 31 aa, Artificial Sequence
  Description of Artificial Sequence: Synthetic polypeptide
DENEIRTTNPVATEQWGDVSEIEMNAAEDWA

SEQ ID NO: 128770 - protein, 30 aa, Artificial Sequence
  Description of Artificial Sequence: Synthetic polypeptide
DENEIRTTNPVATEQWGDVSEIEMNAAEDK

SEQ ID NO: 128771 - protein, 31 aa, Artificial Sequence
  Description of Artificial Sequence: Synthetic polypeptide
DENEIRTTNPVATEQWGDVSEIEMNAAEDIA

SEQ ID NO: 128772 - protein, 30 aa, Artificial Sequence
  Description of Artificial Sequence: Synthetic polypeptide
DENEIRTTNPVATEQWGDVSEIEMNAAEDI

SEQ ID NO: 128773 - protein, 31 aa, Artificial Sequence
  Description of Artificial Sequence: Synthetic polypeptide
DENEIRTTNPVATEQWGDVSEIEMNAAEDHA

SEQ ID NO: 128774 - protein, 30 aa, Artificial Sequence
  Description of Artificial Sequence: Synthetic polypeptide
DENEIRTTNPVATEQWGDVSEIEMNAAEDH

SEQ ID NO: 128775 - protein, 31 aa, Artificial Sequence
  Description of Artificial Sequence: Synthetic polypeptide
DENEIRTTNPVATEQWGDVSEIEMNAAEDGA

SEQ ID NO: 128776 - protein, 30 aa, Artificial Sequence
  Description of Artificial Sequence: Synthetic polypeptide
DENEIRTTNPVATEQWGDVSEIEMNAAEDG

SEQ ID NO: 128777 - protein, 31 aa, Artificial Sequence
  Description of Artificial Sequence: Synthetic polypeptide
DENEIRTTNPVATEQWGDVSEIEMNAAEDFL

SEQ ID NO: 128778 - protein, 31 aa, Artificial Sequence
  Description of Artificial Sequence: Synthetic polypeptide
DENEIRTTNPVATEQWGDVSEIEMNAAEDFA

SEQ ID NO: 128779 - protein, 30 aa, Artificial Sequence
  Description of Artificial Sequence: Synthetic polypeptide
DENEIRTTNPVATEQWGDVSEIEMNAAEDF

SEQ ID NO: 128780 - protein, 31 aa, Artificial Sequence
  Description of Artificial Sequence: Synthetic polypeptide
DENEIRTTNPVATEQWGDVSEIEMNAAEDEA

SEQ ID NO: 128781 - protein, 30 aa, Artificial Sequence
  Description of Artificial Sequence: Synthetic polypeptide
DENEIRTTNPVATEQWGDVSEIEMNAAEDE

SEQ ID NO: 128782 - protein, 31 aa, Artificial Sequence
  Description of Artificial Sequence: Synthetic polypeptide
DENEIRTTNPVATEQWGDVSEIEMNAAEDDA

SEQ ID NO: 128783 - protein, 30 aa, Artificial Sequence
  Description of Artificial Sequence: Synthetic polypeptide
DENEIRTTNPVATEQWGDVSEIEMNAAEDD

SEQ ID NO: 128784 - protein, 31 aa, Artificial Sequence
  Description of Artificial Sequence: Synthetic polypeptide
DENEIRTTNPVATEQWGDVSEIEMNAAEDCA

SEQ ID NO: 128785 - protein, 30 aa, Artificial Sequence
  Description of Artificial Sequence: Synthetic polypeptide
DENEIRTTNPVATEQWGDVSEIEMNAAEDC

SEQ ID NO: 128786 - protein, 31 aa, Artificial Sequence
  Description of Artificial Sequence: Synthetic polypeptide
DENEIRTTNPVATEQWGDVSEIEMNAAEDAY

SEQ ID NO: 128787 - protein, 31 aa, Artificial Sequence
  Description of Artificial Sequence: Synthetic polypeptide
DENEIRTTNPVATEQWGDVSEIEMNAAEDAW

SEQ ID NO: 128788 - protein, 31 aa, Artificial Sequence
  Description of Artificial Sequence: Synthetic polypeptide
DENEIRTTNPVATEQWGDVSEIEMNAAEDAV

SEQ ID NO: 128789 - protein, 31 aa, Artificial Sequence
  Description of Artificial Sequence: Synthetic polypeptide
DENEIRTTNPVATEQWGDVSEIEMNAAEDKA

SEQ ID NO: 128790 - protein, 30 aa, Artificial Sequence
  Description of Artificial Sequence: Synthetic polypeptide
DENEIRTTNPVATEQWGDVSEIEMNAAEDY

SEQ ID NO: 128791 - protein, 30 aa, Artificial Sequence
  Description of Artificial Sequence: Synthetic polypeptide
DENEIRTTNPVATEQWGDVSEIEMNAAEDL

SEQ ID NO: 128792 - protein, 30 aa, Artificial Sequence
  Description of Artificial Sequence: Synthetic polypeptide
DENEIRTTNPVATEQWGDVSEIEMNAAEDM

SEQ ID NO: 128793 - protein, 30 aa, Artificial Sequence
  Description of Artificial Sequence: Synthetic polypeptide
DENEIRTTNPVATEQWGDVSEIEMNAAEDW

SEQ ID NO: 128794 - protein, 31 aa, Artificial Sequence
  Description of Artificial Sequence: Synthetic polypeptide
DENEIRTTNPVATEQWGDVSEIEMNAAEDVG

SEQ ID NO: 128795 - protein, 31 aa, Artificial Sequence
  Description of Artificial Sequence: Synthetic polypeptide
DENEIRTTNPVATEQWGDVSEIEMNAAEDVA

SEQ ID NO: 128796 - protein, 30 aa, Artificial Sequence
  Description of Artificial Sequence: Synthetic polypeptide
DENEIRTTNPVATEQWGDVSEIEMNAAEDV

SEQ ID NO: 128797 - protein, 37 aa, Artificial Sequence
  Description of Artificial Sequence: Synthetic polypeptide
DTEEIRTTNPVATEQYGVVSTTQNLQQIGNTEQGTTE

SEQ ID NO: 128798 - protein, 31 aa, Artificial Sequence
  Description of Artificial Sequence: Synthetic polypeptide
DENEIRTTNPVATEQWGDVSEIEMNAAEDTA

SEQ ID NO: 128799 - protein, 30 aa, Artificial Sequence
  Description of Artificial Sequence: Synthetic polypeptide
DENEIRTTNPVATEQWGDVSEIEMNAAEDT

SEQ ID NO: 128800 - protein, 31 aa, Artificial Sequence
  Description of Artificial Sequence: Synthetic polypeptide
DENEIRTTNPVATEQWGDVSEIEMNAAEDSA

SEQ ID NO: 128801 - protein, 30 aa, Artificial Sequence
  Description of Artificial Sequence: Synthetic polypeptide
DENEIRTTNPVATEQWGDVSEIEMNAAEDS

SEQ ID NO: 128802 - protein, 31 aa, Artificial Sequence
  Description of Artificial Sequence: Synthetic polypeptide
DENEIRTTNPVATEQWGDVSEIEMNAAEDRA

SEQ ID NO: 128803 - protein, 36 aa, Artificial Sequence
  Description of Artificial Sequence: Synthetic polypeptide
DEEEIRTTNPVATEQYGSVVGDGNLNMNEEGGNNGQ

SEQ ID NO: 128804 - protein, 36 aa, Artificial Sequence
  Description of Artificial Sequence: Synthetic polypeptide
DTEEIRTTNPVATEQYGVVSTTTNDQQGNTEQGTTQ

SEQ ID NO: 128805 - protein, 31 aa, Artificial Sequence
  Description of Artificial Sequence: Synthetic polypeptide
DENEIRTTNPVATEQWGDVSEIEMNAAEDQA

SEQ ID NO: 128806 - protein, 30 aa, Artificial Sequence
  Description of Artificial Sequence: Synthetic polypeptide
DENEIRTTNPVATEQWGDVSEIEMNAAEDQ

SEQ ID NO: 128807 - protein, 31 aa, Artificial Sequence
  Description of Artificial Sequence: Synthetic polypeptide
DENEIRTTNPVATEQWGDVSEIEMNAAEDPA

SEQ ID NO: 128808 - protein, 30 aa, Artificial Sequence
  Description of Artificial Sequence: Synthetic polypeptide
DENEIRTTNPVATEQWGDVSEIEMNAAEDP

SEQ ID NO: 128809 - protein, 37 aa, Artificial Sequence
  Description of Artificial Sequence: Synthetic polypeptide
DTEEIRTTNPVATEQYGVVSTTTNLQAGGNTEQGTTD

SEQ ID NO: 128810 - protein, 35 aa, Artificial Sequence
  Description of Artificial Sequence: Synthetic polypeptide
DEAEIRTTNPVAYEQWGSVCVTDNNDGQRQGANNH

SEQ ID NO: 128811 - protein, 31 aa, Artificial Sequence
  Description of Artificial Sequence: Synthetic polypeptide
DENEIRTTNPVATEQWGDVSEIEMNAAEDMA

SEQ ID NO: 128812 - protein, 31 aa, Artificial Sequence
  Description of Artificial Sequence: Synthetic polypeptide
DENEIRTTNPVATEQWGDVSEIEMNAAEDLA

SEQ ID NO: 128813 - protein, 31 aa, Artificial Sequence
  Description of Artificial Sequence: Synthetic polypeptide
DENEIRTTNPVATEQWGDVSEIEENAAETAI

SEQ ID NO: 128814 - protein, 36 aa, Artificial Sequence
  Description of Artificial Sequence: Synthetic polypeptide
DTEEIRTTNPVATEQYGSVSSTTPAGPNMRNGANPV

SEQ ID NO: 128815 - protein, 36 aa, Artificial Sequence
  Description of Artificial Sequence: Synthetic polypeptide
DTEEIRTTNPVATEQYGSVSSTTPAGPNMENGMNDV

SEQ ID NO: 128816 - protein, 32 aa, Artificial Sequence
  Description of Artificial Sequence: Synthetic polypeptide
DENEIRTTNPVATEQWGDVSNEQEMNAAEGDA

SEQ ID NO: 128817 - protein, 31 aa, Artificial Sequence
  Description of Artificial Sequence: Synthetic polypeptide
DENEIRTTNPVATEQWGDVSNEIEMNAAEDI

SEQ ID NO: 128818 - protein, 31 aa, Artificial Sequence
  Description of Artificial Sequence: Synthetic polypeptide
DENEIRTTNPVATEQWGDVSNEIEMNAAEDC

SEQ ID NO: 128819 - protein, 31 aa, Artificial Sequence
  Description of Artificial Sequence: Synthetic polypeptide
DENEIRTTNPVATEQWGDVSNEIEMNAAEDA

SEQ ID NO: 128820 - protein, 35 aa, Artificial Sequence
  Description of Artificial Sequence: Synthetic polypeptide
DEAEIRTTNPVAYEQWGSVCSTDNHNQNELGNHQA

SEQ ID NO: 128821 - protein, 36 aa, Artificial Sequence
  Description of Artificial Sequence: Synthetic polypeptide
DTEEIRATNPVATEQYGSVVVTTTNLQQGNNGETDT

SEQ ID NO: 128822 - protein, 36 aa, Artificial Sequence
  Description of Artificial Sequence: Synthetic polypeptide
DTEEIRATNPVATEQYGSVVVTTTNLQQGNNGTQDE

SEQ ID NO: 128823 - protein, 34 aa, Artificial Sequence
  Description of Artificial Sequence: Synthetic polypeptide
DEAEIRTTNPVAYEQWGSVCSTDNKDQGDVNGMN

SEQ ID NO: 128824 - protein, 30 aa, Artificial Sequence
  Description of Artificial Sequence: Synthetic polypeptide
DENEIRTTNPVATEQWGDVSNIEMNAAEDA

SEQ ID NO: 128825 - protein, 32 aa, Artificial Sequence
  Description of Artificial Sequence: Synthetic polypeptide
DEQEIATTNPVATEQYGSVSATDPEDHELEDL

SEQ ID NO: 128826 - protein, 31 aa, Artificial Sequence
  Description of Artificial Sequence: Synthetic polypeptide
DENEIRTTNPVATEQWGDVSNDIEMQGAEQA

SEQ ID NO: 128827 - protein, 36 aa, Artificial Sequence
  Description of Artificial Sequence: Synthetic polypeptide
DTEEIRATNPVATEQYGSVVVTVTNLQQGNNGTTDT

SEQ ID NO: 128828 - protein, 31 aa, Artificial Sequence
  Description of Artificial Sequence: Synthetic polypeptide
DENEIRTTNPVATEQWGDVSNDIEMNAEEDA

SEQ ID NO: 128829 - protein, 30 aa, Artificial Sequence
  Description of Artificial Sequence: Synthetic polypeptide
DENEIRTTNPVATEQWGDVSMIIMNAAEDA

SEQ ID NO: 128830 - protein, 31 aa, Artificial Sequence
  Description of Artificial Sequence: Synthetic polypeptide
DENEIRTTNPVATEQWGDVSMIEMNAAEDAM

SEQ ID NO: 128831 - protein, 30 aa, Artificial Sequence
  Description of Artificial Sequence: Synthetic polypeptide
DENEIRTTNPVATEQWGDVSMIEMNAAEDA

SEQ ID NO: 128832 - protein, 36 aa, Artificial Sequence
  Description of Artificial Sequence: Synthetic polypeptide
DTEEIRATNPVATEQYGSVVVTVTNLQQGTNGTTDN

SEQ ID NO: 128833 - protein, 33 aa, Artificial Sequence
  Description of Artificial Sequence: Synthetic polypeptide
DEQEIATTNPVATEQYGSVSATDPVEDHEGEDL

SEQ ID NO: 128834 - protein, 34 aa, Artificial Sequence
  Description of Artificial Sequence: Synthetic polypeptide
DEAEIRTTNPVAYEQWGSVCSTDNMHQGDVNNMN

SEQ ID NO: 128835 - protein, 36 aa, Artificial Sequence
  Description of Artificial Sequence: Synthetic polypeptide
DEEEIRTTNPVATEQYGSVSLMDMLNQIIENENLEE

SEQ ID NO: 128836 - protein, 30 aa, Artificial Sequence
  Description of Artificial Sequence: Synthetic polypeptide
DENEIRTTNPVATEQWGDVSNIEMNKAEDA

SEQ ID NO: 128837 - protein, 30 aa, Artificial Sequence
  Description of Artificial Sequence: Synthetic polypeptide
DENEIRTTNPVATEQWGDVSNIEMSAAEDA

SEQ ID NO: 128838 - protein, 30 aa, Artificial Sequence
  Description of Artificial Sequence: Synthetic polypeptide
DENEIRTTNPVATEQWGDVSRIEMNAAEDD

SEQ ID NO: 128839 - protein, 31 aa, Artificial Sequence
  Description of Artificial Sequence: Synthetic polypeptide
DENEIRTTNPVATEQWGDVSRIEMNAAEDAS

SEQ ID NO: 128840 - protein, 30 aa, Artificial Sequence
  Description of Artificial Sequence: Synthetic polypeptide
DENEIRTTNPVATEQWGDVSRIEMNAAEDA

SEQ ID NO: 128841 - protein, 33 aa, Artificial Sequence
  Description of Artificial Sequence: Synthetic polypeptide
DEQEIATTNPVATEQYGSVSATDMLEDHEPEDL

SEQ ID NO: 128842 - protein, 31 aa, Artificial Sequence
  Description of Artificial Sequence: Synthetic polypeptide
DENEIRTTNPVATEQWGDVSQIEMNALEFIA

SEQ ID NO: 128843 - protein, 31 aa, Artificial Sequence
  Description of Artificial Sequence: Synthetic polypeptide
DENEIRTTNPVATEQWGDVSQIEMNAAEDAV

SEQ ID NO: 128844 - protein, 30 aa, Artificial Sequence
  Description of Artificial Sequence: Synthetic polypeptide
DENEIRTTNPVATEQWGDVSQIEMNAAEDA

SEQ ID NO: 128845 - protein, 36 aa, Artificial Sequence
  Description of Artificial Sequence: Synthetic polypeptide
DEEEIRTTNPVATEQYGSVSLMVQLIQDEVPELLRL

SEQ ID NO: 128846 - protein, 36 aa, Artificial Sequence
  Description of Artificial Sequence: Synthetic polypeptide
DEEEIRTTNPVATEQYGSVSLMPMLLEQIVNEDNIE

SEQ ID NO: 128847 - protein, 35 aa, Artificial Sequence
  Description of Artificial Sequence: Synthetic polypeptide
DEEEIRTTNPVATEQYGSVSLMMQEQPIEMENLIE

SEQ ID NO: 128848 - protein, 30 aa, Artificial Sequence
  Description of Artificial Sequence: Synthetic polypeptide
DENEIRTTNPVATEQWGDVSPIEMNEAEDA

SEQ ID NO: 128849 - protein, 30 aa, Artificial Sequence
  Description of Artificial Sequence: Synthetic polypeptide
DENEIRTTNPVATEQWGDVSPIEMNAAMDA

SEQ ID NO: 128850 - protein, 30 aa, Artificial Sequence
  Description of Artificial Sequence: Synthetic polypeptide
DENEIRTTNPVATEQWGDVSPIEMNAAEDA

SEQ ID NO: 128851 - protein, 31 aa, Artificial Sequence
  Description of Artificial Sequence: Synthetic polypeptide
DENEIRTTNPVATEQWGDVSNTDEMNDAEDA

SEQ ID NO: 128852 - protein, 30 aa, Artificial Sequence
  Description of Artificial Sequence: Synthetic polypeptide
DENEIRTTNPVATEQWGDVSNIVMNAAEDA

SEQ ID NO: 128853 - protein, 31 aa, Artificial Sequence
  Description of Artificial Sequence: Synthetic polypeptide
DENEIRTTNPVATEQWGDVSNIVEMNTAEDA

SEQ ID NO: 128854 - protein, 35 aa, Artificial Sequence
  Description of Artificial Sequence: Synthetic polypeptide
DEEEIRTTNPVATEQYGSVSLMIENDDAAMNELEL

SEQ ID NO: 128855 - protein, 30 aa, Artificial Sequence
  Description of Artificial Sequence: Synthetic polypeptide
DENEIRTTNPVATEQWGDVSNIIMSAAEDA

SEQ ID NO: 128856 - protein, 31 aa, Artificial Sequence
  Description of Artificial Sequence: Synthetic polypeptide
DENEIRTTNPVATEQWGDVSNIGERNAAEDA

SEQ ID NO: 128857 - protein, 31 aa, Artificial Sequence
  Description of Artificial Sequence: Synthetic polypeptide
DENEIRTTNPVATEQWGDVSLQIEMNAAEDA

SEQ ID NO: 128858 - protein, 30 aa, Artificial Sequence
  Description of Artificial Sequence: Synthetic polypeptide
DENEIRTTNPVATEQWGDVSLIEMNACEDA

SEQ ID NO: 128859 - protein, 30 aa, Artificial Sequence
  Description of Artificial Sequence: Synthetic polypeptide
DENEIRTTNPVATEQWGDVSLIEMNAAEDA

SEQ ID NO: 128860 - protein, 36 aa, Artificial Sequence
  Description of Artificial Sequence: Synthetic polypeptide
DTEEIRATNPVATEQYGVVSTTNNLQQAGNNNQQED

SEQ ID NO: 128861 - protein, 32 aa, Artificial Sequence
  Description of Artificial Sequence: Synthetic polypeptide
DTEEIRATNPVAYEQWGCSYNVIDNHQDNGTR

SEQ ID NO: 128862 - protein, 31 aa, Artificial Sequence
  Description of Artificial Sequence: Synthetic polypeptide
DTEEIRATNPVAYEQWGCSYQMDNGQQNGSR

SEQ ID NO: 128863 - protein, 30 aa, Artificial Sequence
  Description of Artificial Sequence: Synthetic polypeptide
DENEIRTTNPVATEQWGDVSEYHMNAAEDA

SEQ ID NO: 128864 - protein, 30 aa, Artificial Sequence
  Description of Artificial Sequence: Synthetic polypeptide
DENEIRTTNPVATEQWGDVSEYEMNAAEDA

SEQ ID NO: 128865 - protein, 35 aa, Artificial Sequence
  Description of Artificial Sequence: Synthetic polypeptide
DEECIRCTNPVATEQYGSVSWNEGEQERQRTNGQS

SEQ ID NO: 128866 - protein, 30 aa, Artificial Sequence
  Description of Artificial Sequence: Synthetic polypeptide
DENEIRTTNPVATEQWGDVSEWEMNATLDA

SEQ ID NO: 128867 - protein, 30 aa, Artificial Sequence
  Description of Artificial Sequence: Synthetic polypeptide
DENEIRTTNPVATEQWGDVSEWEMNAAEDA

SEQ ID NO: 128868 - protein, 34 aa, Artificial Sequence
  Description of Artificial Sequence: Synthetic polypeptide
DEAEIRTTNPVAYEQWGSVCSTDPGIQGTGQNNS

SEQ ID NO: 128869 - protein, 34 aa, Artificial Sequence
  Description of Artificial Sequence: Synthetic polypeptide
DEAEIRTTNPVAYEQWGSVCSTDTGIQDTGQNNI

SEQ ID NO: 128870 - protein, 30 aa, Artificial Sequence
  Description of Artificial Sequence: Synthetic polypeptide
DENEIRTTNPVATEQWGDVSEVEMNAFEDA

SEQ ID NO: 128871 - protein, 30 aa, Artificial Sequence
  Description of Artificial Sequence: Synthetic polypeptide
DENEIRTTNPVATEQWGDVSEVEMNAAQDA

SEQ ID NO: 128872 - protein, 30 aa, Artificial Sequence
  Description of Artificial Sequence: Synthetic polypeptide
DENEIRTTNPVATEQWGDVSEVEMNAALDA

SEQ ID NO: 128873 - protein, 30 aa, Artificial Sequence
  Description of Artificial Sequence: Synthetic polypeptide
DENEIRTTNPVATEQWGDVSEVEMNAAEDS

SEQ ID NO: 128874 - protein, 30 aa, Artificial Sequence
  Description of Artificial Sequence: Synthetic polypeptide
DENEIRTTNPVATEQWGDVSEVEMNAAEDI

SEQ ID NO: 128875 - protein, 31 aa, Artificial Sequence
  Description of Artificial Sequence: Synthetic polypeptide
DENEIRTTNPVATEQWGDVSEVEMNAAEDAG

SEQ ID NO: 128876 - protein, 30 aa, Artificial Sequence
  Description of Artificial Sequence: Synthetic polypeptide
DENEIRTTNPVATEQWGDVSEVEMNAAEDA

SEQ ID NO: 128877 - protein, 31 aa, Artificial Sequence
  Description of Artificial Sequence: Synthetic polypeptide
DENEIRTTNPVATEQWGDVSETIRMNAAEDA

SEQ ID NO: 128878 - protein, 31 aa, Artificial Sequence
  Description of Artificial Sequence: Synthetic polypeptide
DENEIRTTNPVATEQWGDVSETIEMNHAEDA

SEQ ID NO: 128879 - protein, 31 aa, Artificial Sequence
  Description of Artificial Sequence: Synthetic polypeptide
DENEIRTTNPVATEQWGDVSETIEMNATEDA

SEQ ID NO: 128880 - protein, 35 aa, Artificial Sequence
  Description of Artificial Sequence: Synthetic polypeptide
DEECIRCTNPVATEQYGSVSWNEGEQERQRTGGEE

SEQ ID NO: 128881 - protein, 32 aa, Artificial Sequence
  Description of Artificial Sequence: Synthetic polypeptide
DEECIRCTNPVATEQYGCVCSWPHQGFGSDQS

SEQ ID NO: 128882 - protein, 35 aa, Artificial Sequence
  Description of Artificial Sequence: Synthetic polypeptide
DEECIRCTNPVATEQYGSVSWNEGEQERQRHNNEG

SEQ ID NO: 128883 - protein, 30 aa, Artificial Sequence
  Description of Artificial Sequence: Synthetic polypeptide
DENEIRTTNPVATEQWGDVSFIEMNAAESA

SEQ ID NO: 128884 - protein, 36 aa, Artificial Sequence
  Description of Artificial Sequence: Synthetic polypeptide
DTEEIRATNPVATEQYGVVSTTVTNLQAGNEQQTTD

SEQ ID NO: 128885 - protein, 31 aa, Artificial Sequence
  Description of Artificial Sequence: Synthetic polypeptide
DENEIRTTNPVATEQWGDVSKIEMNAAEDAP

SEQ ID NO: 128886 - protein, 30 aa, Artificial Sequence
  Description of Artificial Sequence: Synthetic polypeptide
DENEIRTTNPVATEQWGDVSKIEMNAAEDA

SEQ ID NO: 128887 - protein, 31 aa, Artificial Sequence
  Description of Artificial Sequence: Synthetic polypeptide
DENEIRTTNPVATEQWGDVSIIERMNAAEDA

SEQ ID NO: 128888 - protein, 30 aa, Artificial Sequence
  Description of Artificial Sequence: Synthetic polypeptide
DENEIRTTNPVATEQWGDVSIIEMNAAEEA

SEQ ID NO: 128889 - protein, 31 aa, Artificial Sequence
  Description of Artificial Sequence: Synthetic polypeptide
DENEIRTTNPVATEQWGDVSIIEMNAAEDFA

SEQ ID NO: 128890 - protein, 30 aa, Artificial Sequence
  Description of Artificial Sequence: Synthetic polypeptide
DENEIRTTNPVATEQWGDVSIIEMNAAEDA

SEQ ID NO: 128891 - protein, 30 aa, Artificial Sequence
  Description of Artificial Sequence: Synthetic polypeptide
DENEIRTTNPVATEQWGDVSHIEMNAAEDA

SEQ ID NO: 128892 - protein, 36 aa, Artificial Sequence
  Description of Artificial Sequence: Synthetic polypeptide
DTEEIRATNPVATEQYGVVSTVVTNLQQGSTNQTDD

SEQ ID NO: 128893 - protein, 30 aa, Artificial Sequence
  Description of Artificial Sequence: Synthetic polypeptide
DENEIRTTNPVATEQWGDVSGREMNHAEDA

SEQ ID NO: 128894 - protein, 34 aa, Artificial Sequence
  Description of Artificial Sequence: Synthetic polypeptide
DTEEIRATNPVAYEPYGQSVVPVTNELQNVGGRC

SEQ ID NO: 128895 - protein, 30 aa, Artificial Sequence
  Description of Artificial Sequence: Synthetic polypeptide
DENEIRTTNPVATEQWGDVSGIERNAAEDA

SEQ ID NO: 128896 - protein, 30 aa, Artificial Sequence
  Description of Artificial Sequence: Synthetic polypeptide
DENEIRTTNPVATEQWGDVSGIEMNAAVDA

SEQ ID NO: 128897 - protein, 30 aa, Artificial Sequence
  Description of Artificial Sequence: Synthetic polypeptide
DENEIRTTNPVATEQWGDVSGIEMNAAEDA

SEQ ID NO: 128898 - protein, 33 aa, Artificial Sequence
  Description of Artificial Sequence: Synthetic polypeptide
DTEEIRATNPVAYEPYGSVVPCTTNELQNSGVE

SEQ ID NO: 128899 - protein, 30 aa, Artificial Sequence
  Description of Artificial Sequence: Synthetic polypeptide
DENEIRTTNPVATEQWGDVSGEEMNAAEDA

SEQ ID NO: 128900 - protein, 33 aa, Artificial Sequence
  Description of Artificial Sequence: Synthetic polypeptide
DTEEIRATNPVAYEPYGSVVPCVTNELQQGGVE

SEQ ID NO: 128901 - protein, 30 aa, Artificial Sequence
  Description of Artificial Sequence: Synthetic polypeptide
DENEIRTTNPVATEQWGDVSFIEMNWAEDA

SEQ ID NO: 128902 - protein, 30 aa, Artificial Sequence
  Description of Artificial Sequence: Synthetic polypeptide
DENEIRTTNPVATEQWGDVSFIEMNIAEDM

SEQ ID NO: 128903 - protein, 30 aa, Artificial Sequence
  Description of Artificial Sequence: Synthetic polypeptide
DENEIRTTNPVATEQWGDVSFIEMNAAEDA

SEQ ID NO: 128904 - protein, 33 aa, Artificial Sequence
  Description of Artificial Sequence: Synthetic polypeptide
DEECIRCTNPVATEQYGCVCSWNHQERFISDQS

SEQ ID NO: 128905 - protein, 30 aa, Artificial Sequence
  Description of Artificial Sequence: Synthetic polypeptide
DENEIRTTNPVATEQWGDVSSEEMNNIEDA

SEQ ID NO: 128906 - protein, 34 aa, Artificial Sequence
  Description of Artificial Sequence: Synthetic polypeptide
DEECIRCTNPVATEQYGCVCSWMNHQNFGSNTQS

SEQ ID NO: 128907 - protein, 36 aa, Artificial Sequence
  Description of Artificial Sequence: Synthetic polypeptide
DTEEIRATNPVATEQYGSVSTNTNNNNQEQGTNNNE

SEQ ID NO: 128908 - protein, 31 aa, Artificial Sequence
  Description of Artificial Sequence: Synthetic polypeptide
DENEIRTTNPVATEQWGDVSVEISMNAAEDA

SEQ ID NO: 128909 - protein, 33 aa, Artificial Sequence
  Description of Artificial Sequence: Synthetic polypeptide
DESEIRTTNPVATECWGSVSCINEPQDAEAENG

SEQ ID NO: 128910 - protein, 36 aa, Artificial Sequence
  Description of Artificial Sequence: Synthetic polypeptide
DEEEIRTTNPVATEQYGSVSTMVNEEENENTEEFYT

SEQ ID NO: 128911 - protein, 31 aa, Artificial Sequence
  Description of Artificial Sequence: Synthetic polypeptide
DENEIRTTNPVATEQWGDVSVEIEMNNAEDA

SEQ ID NO: 128912 - protein, 37 aa, Artificial Sequence
  Description of Artificial Sequence: Synthetic polypeptide
DTEEIRATNPVATEQYGSVSTNTTNNNNLQQGTNANE

SEQ ID NO: 128913 - protein, 32 aa, Artificial Sequence
  Description of Artificial Sequence: Synthetic polypeptide
DEDEIATTNPVATAQWGGCVAGTGLEQDGTNN

SEQ ID NO: 128914 - protein, 34 aa, Artificial Sequence
  Description of Artificial Sequence: Synthetic polypeptide
DEECIRCTNPVATEPYGSVSWNEGEKERQGHGSR

SEQ ID NO: 128915 - protein, 34 aa, Artificial Sequence
  Description of Artificial Sequence: Synthetic polypeptide
DESEIRTTNPVATECWGSVSCINEPQARECENDG

SEQ ID NO: 128916 - protein, 33 aa, Artificial Sequence
  Description of Artificial Sequence: Synthetic polypeptide
DENEIRTTNPVATEQWGDVSTTAEPNMANGMDV

SEQ ID NO: 128917 - protein, 30 aa, Artificial Sequence
  Description of Artificial Sequence: Synthetic polypeptide
AENEIACTNPIATEQWGEAWSENLQPKGPR

SEQ ID NO: 128918 - protein, 34 aa, Artificial Sequence
  Description of Artificial Sequence: Synthetic polypeptide
DESEIRTTNPVATECWGSVSCINEPPDREGENWG

SEQ ID NO: 128919 - protein, 36 aa, Artificial Sequence
  Description of Artificial Sequence: Synthetic polypeptide
DEEEIRTTNPVATEQYGSVSLTDGYEQALDVSVERI

SEQ ID NO: 128920 - protein, 33 aa, Artificial Sequence
  Description of Artificial Sequence: Synthetic polypeptide
DEAEIRTTNPVAYEQWGSVCSGENDQHDTNEHS

SEQ ID NO: 128921 - protein, 35 aa, Artificial Sequence
  Description of Artificial Sequence: Synthetic polypeptide
DEAEIRTTNPVAYEQWGSVCSGNEDLGDERGQDQR

SEQ ID NO: 128922 - protein, 36 aa, Artificial Sequence
  Description of Artificial Sequence: Synthetic polypeptide
DEEEIRTTNPVATEQYGSVTSTTPAGFIEHFGSNPV

SEQ ID NO: 128923 - protein, 33 aa, Artificial Sequence
  Description of Artificial Sequence: Synthetic polypeptide
DEAEIRTTNPVAYEQWGSVCSNDNDGKQGNNAG

SEQ ID NO: 128924 - protein, 37 aa, Artificial Sequence
  Description of Artificial Sequence: Synthetic polypeptide
DEEEIRTTNPVATEQYGSVTSTTPAHNNEHFGSNPVA

SEQ ID NO: 128925 - protein, 36 aa, Artificial Sequence
  Description of Artificial Sequence: Synthetic polypeptide
DEEEIRTTNPVATEQYGSVSLSVFLEPRNRDGLMDD

SEQ ID NO: 128926 - protein, 30 aa, Artificial Sequence
  Description of Artificial Sequence: Synthetic polypeptide
DENEIRTTNPVATEQWGDVSVIEMNAAEDA

SEQ ID NO: 128927 - protein, 36 aa, Artificial Sequence
  Description of Artificial Sequence: Synthetic polypeptide
DEEEIRTTNPVATEQYGSVSLSPLLLSQVEGELPIA

SEQ ID NO: 128928 - protein, 31 aa, Artificial Sequence
  Description of Artificial Sequence: Synthetic polypeptide
DENEIRTTNPVATEQWGDVSVIEMNAAEDWA

SEQ ID NO: 128929 - protein, 31 aa, Artificial Sequence
  Description of Artificial Sequence: Synthetic polypeptide
DENEIRTTNPVATEQWGDVSVLIEMNAAEDA

SEQ ID NO: 128930 - protein, 30 aa, Artificial Sequence
  Description of Artificial Sequence: Synthetic polypeptide
DENEIRTTNPVATEQWGDVSYIEMNAAQDA

SEQ ID NO: 128931 - protein, 30 aa, Artificial Sequence
  Description of Artificial Sequence: Synthetic polypeptide
DENEIRTTNPVATEQWGDVSYIEMNAAEDA

SEQ ID NO: 128932 - protein, 31 aa, Artificial Sequence
  Description of Artificial Sequence: Synthetic polypeptide
DENEIRTTNPVATEQWGDVSWIETRNAAEDA

SEQ ID NO: 128933 - protein, 31 aa, Artificial Sequence
  Description of Artificial Sequence: Synthetic polypeptide
DENEIRTTNPVATEQWGDVSWIESMNAQEDA

SEQ ID NO: 128934 - protein, 30 aa, Artificial Sequence
  Description of Artificial Sequence: Synthetic polypeptide
DENEIRTTNPVATEQWGDVSWIEPNDAEDA

SEQ ID NO: 128935 - protein, 34 aa, Artificial Sequence
  Description of Artificial Sequence: Synthetic polypeptide
DEAEIRTTNPVATEQYGCVCSTEDHNQNFGSEQL

SEQ ID NO: 128936 - protein, 34 aa, Artificial Sequence
  Description of Artificial Sequence: Synthetic polypeptide
DEAEIRTTNPVAYEQWGSVCNTFNREEDRGGTDR

SEQ ID NO: 128937 - protein, 31 aa, Artificial Sequence
  Description of Artificial Sequence: Synthetic polypeptide
DENEIRTTNPVATEQWGDVSWIEMNAAEPDA

SEQ ID NO: 128938 - protein, 30 aa, Artificial Sequence
  Description of Artificial Sequence: Synthetic polypeptide
DENEIRTTNPVATEQWGDVSWIEMNAAEDV

SEQ ID NO: 128939 - protein, 30 aa, Artificial Sequence
  Description of Artificial Sequence: Synthetic polypeptide
DENEIRTTNPVATEQWGDVSWIEMNAAEDA

SEQ ID NO: 128940 - protein, 31 aa, Artificial Sequence
  Description of Artificial Sequence: Synthetic polypeptide
DENEIRTTNPVATEQWGDVSWIEMGAAEGDA

SEQ ID NO: 128941 - protein, 30 aa, Artificial Sequence
  Description of Artificial Sequence: Synthetic polypeptide
DENEIRTTNPVATEQWGDVSWIEMEHVEDA

SEQ ID NO: 128942 - protein, 30 aa, Artificial Sequence
  Description of Artificial Sequence: Synthetic polypeptide
DENEIRTTNPVATEQWGDVSWIEENAAEIA

SEQ ID NO: 128943 - protein, 36 aa, Artificial Sequence
  Description of Artificial Sequence: Synthetic polypeptide
DTEEIRATNPVATEQYGSVSTNQNQNQGQQGTNNNE

SEQ ID NO: 128944 - protein, 37 aa, Artificial Sequence
  Description of Artificial Sequence: Synthetic polypeptide
DTEEIRATNPVATEQYGSVSTNQNQQQLNQIGTETNE

SEQ ID NO: 128945 - protein, 36 aa, Artificial Sequence
  Description of Artificial Sequence: Synthetic polypeptide
DTEEIRATNPVATEQYGSVSTNQQQNNNQQIGTNNE

SEQ ID NO: 128946 - protein, 36 aa, Artificial Sequence
  Description of Artificial Sequence: Synthetic polypeptide
DTEEIRATNPVATEQYGSVSTNQQQNQNQNQGTNNE

SEQ ID NO: 128947 - protein, 30 aa, Artificial Sequence
  Description of Artificial Sequence: Synthetic polypeptide
AENEIACTNPIATEQYGETWSNEDLQRGGI

SEQ ID NO: 128948 - protein, 30 aa, Artificial Sequence
  Description of Artificial Sequence: Synthetic polypeptide
DENEIRTTNPVATEQWGDVSWDEMNALIDA

SEQ ID NO: 128949 - protein, 35 aa, Artificial Sequence
  Description of Artificial Sequence: Synthetic polypeptide
DEEEIRTTNPVATEQYGSVSLTMTGHEQESIEQVD

SEQ ID NO: 128950 - protein, 31 aa, Artificial Sequence
  Description of Artificial Sequence: Synthetic polypeptide
DENEIRTTNPVATEQWGDVSETIEMNAAEDL

SEQ ID NO: 128951 - protein, 33 aa, Artificial Sequence
  Description of Artificial Sequence: Synthetic polypeptide
DEAEIRTTNPVAYEQWGSVCSNENDQHDRNDHS

SEQ ID NO: 128952 - protein, 33 aa, Artificial Sequence
  Description of Artificial Sequence: Synthetic polypeptide
DEAEIRTTNPVATEQYGCVCSNWELANFNSDQS

SEQ ID NO: 128953 - protein, 31 aa, Artificial Sequence
  Description of Artificial Sequence: Synthetic polypeptide
DENEIRTTNPVATEQWGDVSSIEMNEAEQDA

SEQ ID NO: 128954 - protein, 36 aa, Artificial Sequence
  Description of Artificial Sequence: Synthetic polypeptide
DTEEIRATNPVATEQYGSVSTVTTNNNEQQGTNNNE

SEQ ID NO: 128955 - protein, 34 aa, Artificial Sequence
  Description of Artificial Sequence: Synthetic polypeptide
DEAEIRTTNPVATEQYGCVCSNTEHQNFNSDFQS

SEQ ID NO: 128956 - protein, 30 aa, Artificial Sequence
  Description of Artificial Sequence: Synthetic polypeptide
DENEIRTTNPVATEQWGDVSSIEMNAAELA

SEQ ID NO: 128957 - protein, 33 aa, Artificial Sequence
  Description of Artificial Sequence: Synthetic polypeptide
DEQEIATTNPVATEQYGSVSATDLYEDHEPEDL

SEQ ID NO: 128958 - protein, 30 aa, Artificial Sequence
  Description of Artificial Sequence: Synthetic polypeptide
DENEIRTTNPVATEQWGDVSSIEMNAAEDL

SEQ ID NO: 128959 - protein, 30 aa, Artificial Sequence
  Description of Artificial Sequence: Synthetic polypeptide
DENEIRTTNPVATEQWGDVSSIEMNAAEDA

SEQ ID NO: 128960 - protein, 34 aa, Artificial Sequence
  Description of Artificial Sequence: Synthetic polypeptide
DEAEIRTTNPVATEQYGCVCSNTEEHQNFGSDQS

SEQ ID NO: 128961 - protein, 30 aa, Artificial Sequence
  Description of Artificial Sequence: Synthetic polypeptide
DENEIRTTNPVATEQWGDVSSIEENVAEDA

SEQ ID NO: 128962 - protein, 36 aa, Artificial Sequence
  Description of Artificial Sequence: Synthetic polypeptide
DEEEIRTTNPVATEQYGSVSLPPMILPQILNEDLIE

SEQ ID NO: 128963 - protein, 37 aa, Artificial Sequence
  Description of Artificial Sequence: Synthetic polypeptide
DTEEIRATNPVATEQYGSVSTVVTNLQQAGNNQQGTD

SEQ ID NO: 128964 - protein, 32 aa, Artificial Sequence
  Description of Artificial Sequence: Synthetic polypeptide
DEECIRCTNPVATEQYGCVCSWEHQHFGSQQS

SEQ ID NO: 128965 - protein, 32 aa, Artificial Sequence
  Description of Artificial Sequence: Synthetic polypeptide
DENEIRTTNPVATEQWGDVSSEIEPNNRNGDV

SEQ ID NO: 128966 - protein, 32 aa, Artificial Sequence
  Description of Artificial Sequence: Synthetic polypeptide
DENEIRTTNPVATEQWGDVSSEIEPNNANGDV

SEQ ID NO: 128967 - protein, 32 aa, Artificial Sequence
  Description of Artificial Sequence: Synthetic polypeptide
DENEIRTTNPVATEQWGDVSSEIEPNNANGDA

SEQ ID NO: 128968 - protein, 32 aa, Artificial Sequence
  Description of Artificial Sequence: Synthetic polypeptide
DENEIRTTNPVATEQWGDVSSEIEPNNAAGDA

SEQ ID NO: 128969 - protein, 36 aa, Artificial Sequence
  Description of Artificial Sequence: Synthetic polypeptide
DEEEIRTTNPVATEQYGSVSLNVLPGIETEAGQVIT

SEQ ID NO: 128970 - protein, 34 aa, Artificial Sequence
  Description of Artificial Sequence: Synthetic polypeptide
DEAEIRTTNPVAYEQWGSVCSNNEGQNAGENGDS

SEQ ID NO: 128971 - protein, 31 aa, Artificial Sequence
  Description of Artificial Sequence: Synthetic polypeptide
DENEIRTTNPVATEQWGDVSSEIEMNAAENA

SEQ ID NO: 128972 - protein, 30 aa, Artificial Sequence
  Description of Artificial Sequence: Synthetic polypeptide
DENEIRTTNPVATEQWGDVSSIEMNPAEDA

SEQ ID NO: 128973 - protein, 35 aa, Artificial Sequence
  Description of Artificial Sequence: Synthetic polypeptide
DEEEIRTTNPVATEQYGSVSLQPNGETEFLGPTLQ

SEQ ID NO: 128974 - protein, 30 aa, Artificial Sequence
  Description of Artificial Sequence: Synthetic polypeptide
DENEIRTTNPVATEQWGDVSSIEMVAAEDA

SEQ ID NO: 128975 - protein, 34 aa, Artificial Sequence
  Description of Artificial Sequence: Synthetic polypeptide
DENEIRTTNPVATEQWGDVSSTEAEPNMRNGMNA

SEQ ID NO: 128976 - protein, 31 aa, Artificial Sequence
  Description of Artificial Sequence: Synthetic polypeptide
DENEIRTTNPVATEQWGDVSTEIWMNAAEDA

SEQ ID NO: 128977 - protein, 36 aa, Artificial Sequence
  Description of Artificial Sequence: Synthetic polypeptide
DTEEIRATNPVATEQYGSVSTTNTQNNNQEQGTNNE

SEQ ID NO: 128978 - protein, 31 aa, Artificial Sequence
  Description of Artificial Sequence: Synthetic polypeptide
DENEIRTTNPVATEQWGDVSTEIEMNAAELA

SEQ ID NO: 128979 - protein, 31 aa, Artificial Sequence
  Description of Artificial Sequence: Synthetic polypeptide
DENEIRTTNPVATEQWGDVSTEIEMNAAEDM

SEQ ID NO: 128980 - protein, 35 aa, Artificial Sequence
  Description of Artificial Sequence: Synthetic polypeptide
DEAEIRTTNPVAYEQWGSVCSNIDNHQEGRGENGP

SEQ ID NO: 128981 - protein, 31 aa, Artificial Sequence
  Description of Artificial Sequence: Synthetic polypeptide
DENEIRTTNPVATEQWGDVSTEIEMNAAEDA

SEQ ID NO: 128982 - protein, 32 aa, Artificial Sequence
  Description of Artificial Sequence: Synthetic polypeptide
DENEIRTTNPVATEQWGDVSTEAEPMNAAGDA

SEQ ID NO: 128983 - protein, 32 aa, Artificial Sequence
  Description of Artificial Sequence: Synthetic polypeptide
DENEIRTTNPVATEQWGDVSTEAEPMMAAGDA

SEQ ID NO: 128984 - protein, 31 aa, Artificial Sequence
  Description of Artificial Sequence: Synthetic polypeptide
DENEIRTTNPVATEQWGDVSTEAEMNAAEDA

SEQ ID NO: 128985 - protein, 36 aa, Artificial Sequence
  Description of Artificial Sequence: Synthetic polypeptide
DTEEIRATNPVATEQYGSVSTTTNNNQAGNGNQQSD

SEQ ID NO: 128986 - protein, 36 aa, Artificial Sequence
  Description of Artificial Sequence: Synthetic polypeptide
DTEEIRATNPVATEQYGSVSTTTNNQQAGNNNQQSE

SEQ ID NO: 128987 - protein, 37 aa, Artificial Sequence
  Description of Artificial Sequence: Synthetic polypeptide
DEEEIRTTNPVATEQYGSVTSYDNLHVDQSEMVEENV

SEQ ID NO: 128988 - protein, 30 aa, Artificial Sequence
  Description of Artificial Sequence: Synthetic polypeptide
DENEIRTTNPVATEQWGDVSSYEMNAASDA

SEQ ID NO: 128989 - protein, 36 aa, Artificial Sequence
  Description of Artificial Sequence: Synthetic polypeptide
DTEEIRATNPVATEQYGSVSTVTNNNQTQQGTNNNE

SEQ ID NO: 128990 - protein, 34 aa, Artificial Sequence
  Description of Artificial Sequence: Synthetic polypeptide
DENEIRTTNPVATEQWGDVSSTTAEPNMRNGMNA

SEQ ID NO: 128991 - protein, 33 aa, Artificial Sequence
  Description of Artificial Sequence: Synthetic polypeptide
DENEIRTTNPVATEQWGDVSSTTAEPMNRAENV

SEQ ID NO: 128992 - protein, 33 aa, Artificial Sequence
  Description of Artificial Sequence: Synthetic polypeptide
DENEIRTTNPVATEQWGDVSSTTAEPMMRAENV

SEQ ID NO: 128993 - protein, 33 aa, Artificial Sequence
  Description of Artificial Sequence: Synthetic polypeptide
DENEIRTTNPVATEQWGDVSSTIEPNNRNGMDV

SEQ ID NO: 128994 - protein, 36 aa, Artificial Sequence
  Description of Artificial Sequence: Synthetic polypeptide
DTEEIRATNPVATEQYGSVSTVTNNQQAGNNNEQQD

SEQ ID NO: 128995 - protein, 30 aa, Artificial Sequence
  Description of Artificial Sequence: Synthetic polypeptide
DENEIRTTNPVATEQWGDVSSSEMNAFIDA

SEQ ID NO: 128996 - protein, 31 aa, Artificial Sequence
  Description of Artificial Sequence: Synthetic polypeptide
DENEIRTTNPVATEQWGDVSETIEMNAAEDA

SEQ ID NO: 128997 - protein, 31 aa, Artificial Sequence
  Description of Artificial Sequence: Synthetic polypeptide
DENEIRTTNPVATEQWGDVSETIEGNAAEDA

SEQ ID NO: 128998 - protein, 34 aa, Artificial Sequence
  Description of Artificial Sequence: Synthetic polypeptide
DEAEIRTTNPVATEQYGCVCSMWEEHQNFGSNQA

SEQ ID NO: 128999 - protein, 35 aa, Artificial Sequence
  Description of Artificial Sequence: Synthetic polypeptide
DEECIRTTNPVATEAWGISVRTWNDDDQDRREGQR

SEQ ID NO: 129000 - protein, 39 aa, Artificial Sequence
  Description of Artificial Sequence: Synthetic polypeptide
DEEEIRTTNPVATEQYGSVSTSNGNNLQQGTEQGTNEEQ

SEQ ID NO: 129001 - protein, 33 aa, Artificial Sequence
  Description of Artificial Sequence: Synthetic polypeptide
DEAEIRTTNPVAYEQWGSVCSTQDQGDTQNGEF

SEQ ID NO: 129002 - protein, 35 aa, Artificial Sequence
  Description of Artificial Sequence: Synthetic polypeptide
DEAEIRTTNPVAYEQWGSVCSTTDNDQINDGMDRP

SEQ ID NO: 129003 - protein, 31 aa, Artificial Sequence
  Description of Artificial Sequence: Synthetic polypeptide
DEECIRTTNPVATECWGMHCWTMNEQHRNDS

SEQ ID NO: 129004 - protein, 33 aa, Artificial Sequence
  Description of Artificial Sequence: Synthetic polypeptide
DEEEIRTTNPVATEQYGSVTVMMDVTRPLEEPE

SEQ ID NO: 129005 - protein, 31 aa, Artificial Sequence
  Description of Artificial Sequence: Synthetic polypeptide
DENEIRTTNPVATEQWGDVSEILMNAAESDA

SEQ ID NO: 129006 - protein, 36 aa, Artificial Sequence
  Description of Artificial Sequence: Synthetic polypeptide
DEEEIRTTNPVATEQYGSVTVSVTQISTEQYGSTTT

SEQ ID NO: 129007 - protein, 31 aa, Artificial Sequence
  Description of Artificial Sequence: Synthetic polypeptide
DENEIRTTNPVATEQWGDVSEILMNAAEDDA

SEQ ID NO: 129008 - protein, 33 aa, Artificial Sequence
  Description of Artificial Sequence: Synthetic polypeptide
AEMEIVTTNPVATEQYGTVCSAEDGLVQFEGND

SEQ ID NO: 129009 - protein, 33 aa, Artificial Sequence
  Description of Artificial Sequence: Synthetic polypeptide
AEMEIVTTNPVATEQYGEVCSATDNPVEFEGGR

SEQ ID NO: 129010 - protein, 33 aa, Artificial Sequence
  Description of Artificial Sequence: Synthetic polypeptide
AEMEIVTTNPVATEQYGEVCSATDGLVEREGGD

SEQ ID NO: 129011 - protein, 31 aa, Artificial Sequence
  Description of Artificial Sequence: Synthetic polypeptide
DENEIRTTNPVATEQWGDVSEILEMNAAEDA

SEQ ID NO: 129012 - protein, 30 aa, Artificial Sequence
  Description of Artificial Sequence: Synthetic polypeptide
DENEIRTTNPVATEQWGDVSEIKMNPAEDA

SEQ ID NO: 129013 - protein, 34 aa, Artificial Sequence
  Description of Artificial Sequence: Synthetic polypeptide
DEAEIRTTNPVAYEQWGSVCSTTDNQGDTQGGGF

SEQ ID NO: 129014 - protein, 33 aa, Artificial Sequence
  Description of Artificial Sequence: Synthetic polypeptide
DEAEIRTTNPVAYEQWGSVCSTTDQGDQQNGGP

SEQ ID NO: 129015 - protein, 30 aa, Artificial Sequence
  Description of Artificial Sequence: Synthetic polypeptide
DENEIRTTNPVATEQWGDVSEIKMNAAEDA

SEQ ID NO: 129016 - protein, 33 aa, Artificial Sequence
  Description of Artificial Sequence: Synthetic polypeptide
DEECIRTTNPVATEGYGCVCGTEHNQNFGSNQA

SEQ ID NO: 129017 - protein, 31 aa, Artificial Sequence
  Description of Artificial Sequence: Synthetic polypeptide
DENEIRTTNPVATEQWGDVSEIIRMNAAEDA

SEQ ID NO: 129018 - protein, 30 aa, Artificial Sequence
  Description of Artificial Sequence: Synthetic polypeptide
DENEIRTTNPVATEQWGDVSEIMMNAAEDA

SEQ ID NO: 129019 - protein, 32 aa, Artificial Sequence
  Description of Artificial Sequence: Synthetic polypeptide
AEMEIVCTNPVATEQYGTACSAENPVQREGND

SEQ ID NO: 129020 - protein, 30 aa, Artificial Sequence
  Description of Artificial Sequence: Synthetic polypeptide
DENEIRTTNPVATEQWGDVSEIMMNHAEDA

SEQ ID NO: 129021 - protein, 35 aa, Artificial Sequence
  Description of Artificial Sequence: Synthetic polypeptide
DEEEIRTTNPVATEQYGSVTTQTTLGVREVASDGI

SEQ ID NO: 129022 - protein, 30 aa, Artificial Sequence
  Description of Artificial Sequence: Synthetic polypeptide
DENEIRTTNPVATEQWGDVSEISMNAAEDA

SEQ ID NO: 129023 - protein, 30 aa, Artificial Sequence
  Description of Artificial Sequence: Synthetic polypeptide
DENEIRTTNPVATEQWGDVSEISMNAAECA

SEQ ID NO: 129024 - protein, 30 aa, Artificial Sequence
  Description of Artificial Sequence: Synthetic polypeptide
DENEIRTTNPVATEQWGDVSEISMAAAEDA

SEQ ID NO: 129025 - protein, 36 aa, Artificial Sequence
  Description of Artificial Sequence: Synthetic polypeptide
DTEEIRTTNPCATEAYGSVSTVVTNLQQGTEENEDT

SEQ ID NO: 129026 - protein, 30 aa, Artificial Sequence
  Description of Artificial Sequence: Synthetic polypeptide
DENEIRTTNPVATEQWGDVSEIRMNAAEDA

SEQ ID NO: 129027 - protein, 33 aa, Artificial Sequence
  Description of Artificial Sequence: Synthetic polypeptide
DEQEIATTNPVATEQYGSVSATDWIEDHEGEDL

SEQ ID NO: 129028 - protein, 31 aa, Artificial Sequence
  Description of Artificial Sequence: Synthetic polypeptide
DENEIRTTNPVATEQWGDVSEIQMNAANPDA

SEQ ID NO: 129029 - protein, 30 aa, Artificial Sequence
  Description of Artificial Sequence: Synthetic polypeptide
DENEIRTTNPVATEQWGDVSEIQMNAAEDA

SEQ ID NO: 129030 - protein, 31 aa, Artificial Sequence
  Description of Artificial Sequence: Synthetic polypeptide
DENEIRTTNPVATEQWGDVSEIQFMNAAEDA

SEQ ID NO: 129031 - protein, 31 aa, Artificial Sequence
  Description of Artificial Sequence: Synthetic polypeptide
DENEIRTTNPVATEQWGDVSEIQEMNAAEDA

SEQ ID NO: 129032 - protein, 30 aa, Artificial Sequence
  Description of Artificial Sequence: Synthetic polypeptide
DENEIRTTNPVATEQWGDVSEIPMNAEEDA

SEQ ID NO: 129033 - protein, 31 aa, Artificial Sequence
  Description of Artificial Sequence: Synthetic polypeptide
DENEIRTTNPVATEQWGDVSEIPMNAAEDAL

SEQ ID NO: 129034 - protein, 30 aa, Artificial Sequence
  Description of Artificial Sequence: Synthetic polypeptide
DENEIRTTNPVATEQWGDVSEIPMNAAEDA

SEQ ID NO: 129035 - protein, 30 aa, Artificial Sequence
  Description of Artificial Sequence: Synthetic polypeptide
DENEIRTTNPVATEQWGDVSEIPMHAAEDA

SEQ ID NO: 129036 - protein, 30 aa, Artificial Sequence
  Description of Artificial Sequence: Synthetic polypeptide
DENEIRTTNPVATEQWGDVSEIPMEAAEDA

SEQ ID NO: 129037 - protein, 31 aa, Artificial Sequence
  Description of Artificial Sequence: Synthetic polypeptide
DENEIRTTNPVATEQWGDVSEINMNAAEDAT

SEQ ID NO: 129038 - protein, 34 aa, Artificial Sequence
  Description of Artificial Sequence: Synthetic polypeptide
DEQEIATTNPVATEQYGSVSATDWLEDHEGEEDL

SEQ ID NO: 129039 - protein, 31 aa, Artificial Sequence
  Description of Artificial Sequence: Synthetic polypeptide
DENEIRTTNPVATEQWGDVSEINEPNAAEDA

SEQ ID NO: 129040 - protein, 31 aa, Artificial Sequence
  Description of Artificial Sequence: Synthetic polypeptide
DENEIRTTNPVATEQWGDVSEINEMNAAEDA

SEQ ID NO: 129041 - protein, 31 aa, Artificial Sequence
  Description of Artificial Sequence: Synthetic polypeptide
DENEIRTTNPVATEQWGDVSEINEMDAEEDG

SEQ ID NO: 129042 - protein, 30 aa, Artificial Sequence
  Description of Artificial Sequence: Synthetic polypeptide
DENEIRTTNPVATEQWGDVSEISMNAFEDA

SEQ ID NO: 129043 - protein, 34 aa, Artificial Sequence
  Description of Artificial Sequence: Synthetic polypeptide
DEAEIRTTNPVATEQYGCQVCSTEHQENFGSEQS

SEQ ID NO: 129044 - protein, 33 aa, Artificial Sequence
  Description of Artificial Sequence: Synthetic polypeptide
DEAEIRTTNPVAYEQWGSVCSTTDQGDTGQGGD

SEQ ID NO: 129045 - protein, 34 aa, Artificial Sequence
  Description of Artificial Sequence: Synthetic polypeptide
DESEIRTTNPVATECWGSVSCINEPIFREGENPG

SEQ ID NO: 129046 - protein, 33 aa, Artificial Sequence
  Description of Artificial Sequence: Synthetic polypeptide
DEECIRTTNPVATEIYGCVCGTELNQNFNSNQS

SEQ ID NO: 129047 - protein, 33 aa, Artificial Sequence
  Description of Artificial Sequence: Synthetic polypeptide
DEECIRTTNPVATEIYGCVCGTGEHNQNFGSNQ

SEQ ID NO: 129048 - protein, 31 aa, Artificial Sequence
  Description of Artificial Sequence: Synthetic polypeptide
DENEIRTTNPVATEQWGDVSEIFMNAAEDAM

SEQ ID NO: 129049 - protein, 30 aa, Artificial Sequence
  Description of Artificial Sequence: Synthetic polypeptide
DENEIRTTNPVATEQWGDVSEIFMNAAEDA

SEQ ID NO: 129050 - protein, 31 aa, Artificial Sequence
  Description of Artificial Sequence: Synthetic polypeptide
DENEIRTTNPVATEQWGDVSEIFEMNANEDA

SEQ ID NO: 129051 - protein, 31 aa, Artificial Sequence
  Description of Artificial Sequence: Synthetic polypeptide
DENEIRTTNPVATEQWGDVSEIEYNAAEDYA

SEQ ID NO: 129052 - protein, 30 aa, Artificial Sequence
  Description of Artificial Sequence: Synthetic polypeptide
DENEIRTTNPVATEQWGDVSEIEYNAAEDA

SEQ ID NO: 129053 - protein, 35 aa, Artificial Sequence
  Description of Artificial Sequence: Synthetic polypeptide
DTEEIRTTNPVATEQYGSVCSTTMLENSIGEFSEM

SEQ ID NO: 129054 - protein, 31 aa, Artificial Sequence
  Description of Artificial Sequence: Synthetic polypeptide
DENEIRTTNPVATEQWGDVSEIEWNAAEDAW

SEQ ID NO: 129055 - protein, 30 aa, Artificial Sequence
  Description of Artificial Sequence: Synthetic polypeptide
DENEIRTTNPVATEQWGDVSEIEWNAAEDA

SEQ ID NO: 129056 - protein, 34 aa, Artificial Sequence
  Description of Artificial Sequence: Synthetic polypeptide
DTEEIRTTNPVATEQYGSVCTTMLENSIGEFQEM

SEQ ID NO: 129057 - protein, 35 aa, Artificial Sequence
  Description of Artificial Sequence: Synthetic polypeptide
DEAEIRTTNPVAYEQWGSVCSTWNNDDHDQGDNRS

SEQ ID NO: 129058 - protein, 34 aa, Artificial Sequence
  Description of Artificial Sequence: Synthetic polypeptide
DEAEIRTTNPVAYEQWGSVCVNEGQQQDGQDNVR

SEQ ID NO: 129059 - protein, 30 aa, Artificial Sequence
  Description of Artificial Sequence: Synthetic polypeptide
DENEIRTTNPVATEQWGDVSEIEVNAAEDA

SEQ ID NO: 129060 - protein, 30 aa, Artificial Sequence
  Description of Artificial Sequence: Synthetic polypeptide
DENEIRTTNPVATEQWGDVSEIEVNAAECA

SEQ ID NO: 129061 - protein, 31 aa, Artificial Sequence
  Description of Artificial Sequence: Synthetic polypeptide
DENEIRTTNPVATEQWGDVSEIEVMNFAGDD

SEQ ID NO: 129062 - protein, 36 aa, Artificial Sequence
  Description of Artificial Sequence: Synthetic polypeptide
DTEEIRTTNPVATEQYGSVSSTTMAGPNMRNGMNPV

SEQ ID NO: 129063 - protein, 36 aa, Artificial Sequence
  Description of Artificial Sequence: Synthetic polypeptide
DTEEIRTTNPVATEQYGSVSSTTPAGPNDRNGMNPV

SEQ ID NO: 129064 - protein, 34 aa, Artificial Sequence
  Description of Artificial Sequence: Synthetic polypeptide
DTEEIRTTNPVATEQWGVVVTVTNLQLQQGTQEQ

SEQ ID NO: 129065 - protein, 31 aa, Artificial Sequence
  Description of Artificial Sequence: Synthetic polypeptide
DENEIRTTNPVATEQWGDVSEIIMNAAESDA

SEQ ID NO: 129066 - protein, 34 aa, Artificial Sequence
  Description of Artificial Sequence: Synthetic polypeptide
DEECIRTTNPVATEIYGCVCGTEELNQNFGSNQA

SEQ ID NO: 129067 - protein, 30 aa, Artificial Sequence
  Description of Artificial Sequence: Synthetic polypeptide
DENEIRTTNPVATEQWGDVSEIGMNAAEDA

SEQ ID NO: 129068 - protein, 30 aa, Artificial Sequence
  Description of Artificial Sequence: Synthetic polypeptide
DENEIRTTNPVATEQWGDVSEIIMNAAEDA

SEQ ID NO: 129069 - protein, 31 aa, Artificial Sequence
  Description of Artificial Sequence: Synthetic polypeptide
DENEIRTTNPVATEQWGDVSEIILMNAAEDA

SEQ ID NO: 129070 - protein, 31 aa, Artificial Sequence
  Description of Artificial Sequence: Synthetic polypeptide
DENEIRTTNPVATEQWGDVSEIIEMNRAEDA

SEQ ID NO: 129071 - protein, 31 aa, Artificial Sequence
  Description of Artificial Sequence: Synthetic polypeptide
AEMEIVCTNPVATEQYGEASATDGPEFEGNR

SEQ ID NO: 129072 - protein, 30 aa, Artificial Sequence
  Description of Artificial Sequence: Synthetic polypeptide
AEMEIVCTNPVATEQYGEASAEDGPEFGNR

SEQ ID NO: 129073 - protein, 33 aa, Artificial Sequence
  Description of Artificial Sequence: Synthetic polypeptide
DEAEIRTTNPVAYEQWGSVCSTTDQGDTQHGGE

SEQ ID NO: 129074 - protein, 31 aa, Artificial Sequence
  Description of Artificial Sequence: Synthetic polypeptide
DENEIRTTNPVATEQWGDVSEIIEMNAEGDG

SEQ ID NO: 129075 - protein, 31 aa, Artificial Sequence
  Description of Artificial Sequence: Synthetic polypeptide
DENEIRTTNPVATEQWGDVSEIIEMNAAENA

SEQ ID NO: 129076 - protein, 33 aa, Artificial Sequence
  Description of Artificial Sequence: Synthetic polypeptide
DEECIRTTNPVATEIYGCVCGSELQYFGSDNQS

SEQ ID NO: 129077 - protein, 34 aa, Artificial Sequence
  Description of Artificial Sequence: Synthetic polypeptide
DEQEIATTNPVATEQYGSVSATEDLFEDHEGEDL

SEQ ID NO: 129078 - protein, 33 aa, Artificial Sequence
  Description of Artificial Sequence: Synthetic polypeptide
DEAEIRTTNPVAYEQWGSVCSTTDQGDTQNNGF

SEQ ID NO: 129079 - protein, 31 aa, Artificial Sequence
  Description of Artificial Sequence: Synthetic polypeptide
DENEIRTTNPVATEQWGDVSEIHMNAAEDAA

SEQ ID NO: 129080 - protein, 31 aa, Artificial Sequence
  Description of Artificial Sequence: Synthetic polypeptide
DEDEIATTNPVATAQWGGCCATALQQRGDQM

SEQ ID NO: 129081 - protein, 30 aa, Artificial Sequence
  Description of Artificial Sequence: Synthetic polypeptide
DENEIRTTNPVATEQWGDVSEIHMNAAEDA

SEQ ID NO: 129082 - protein, 34 aa, Artificial Sequence
  Description of Artificial Sequence: Synthetic polypeptide
DTEEIRTTNPVATEQWGVVTVTTNLQLQQGTTEE

SEQ ID NO: 129083 - protein, 31 aa, Artificial Sequence
  Description of Artificial Sequence: Synthetic polypeptide
DENEIRTTNPVATEQWGDVSEIGMNANEDPV

SEQ ID NO: 129084 - protein, 31 aa, Artificial Sequence
  Description of Artificial Sequence: Synthetic polypeptide
DENEIRTTNPVATEQWGDVSEIGMNANEDPA

SEQ ID NO: 129085 - protein, 34 aa, Artificial Sequence
  Description of Artificial Sequence: Synthetic polypeptide
DEQEIATTNPVATEQYGSVSATFDLEDHEGEDLH

SEQ ID NO: 129086 - protein, 32 aa, Artificial Sequence
  Description of Artificial Sequence: Synthetic polypeptide
DEAEIRTTNPVATEQYGCLFTEDLNREEETSG

SEQ ID NO: 129087 - protein, 34 aa, Artificial Sequence
  Description of Artificial Sequence: Synthetic polypeptide
DTEEIRTTNPVATEQWGVVVTVTNLLNQQGTTEE

SEQ ID NO: 129088 - protein, 30 aa, Artificial Sequence
  Description of Artificial Sequence: Synthetic polypeptide
DENEIRTTNPVATEQWGDVSEIEVEAAEDA

SEQ ID NO: 129089 - protein, 34 aa, Artificial Sequence
  Description of Artificial Sequence: Synthetic polypeptide
DTEEIRTTNPCATEAYGSVSTVVNNNTQQSEENQ

SEQ ID NO: 129090 - protein, 32 aa, Artificial Sequence
  Description of Artificial Sequence: Synthetic polypeptide
DENEIRTTNPVATEQWGDVSEITELMNAAEDA

SEQ ID NO: 129091 - protein, 34 aa, Artificial Sequence
  Description of Artificial Sequence: Synthetic polypeptide
DEQEIATTNPVATEQYGSVSATDSLDEDHEGEDL

SEQ ID NO: 129092 - protein, 30 aa, Artificial Sequence
  Description of Artificial Sequence: Synthetic polypeptide
DENEIRTTNPVATEQWGDVSEPEMNAAEDA

SEQ ID NO: 129093 - protein, 30 aa, Artificial Sequence
  Description of Artificial Sequence: Synthetic polypeptide
DENEIRTTNPVATEQWGDVSEPEFNAAEDA

SEQ ID NO: 129094 - protein, 35 aa, Artificial Sequence
  Description of Artificial Sequence: Synthetic polypeptide
DEAEIRTTNPVAYEQWGSVCSTENNDQHDQGRNAD

SEQ ID NO: 129095 - protein, 32 aa, Artificial Sequence
  Description of Artificial Sequence: Synthetic polypeptide
DENEIRTTNPVATEQWGDVSEPAEPMNANGNA

SEQ ID NO: 129096 - protein, 34 aa, Artificial Sequence
  Description of Artificial Sequence: Synthetic polypeptide
DEQEIATTNPVATEQYGSVSATDSLEDHEGEDLP

SEQ ID NO: 129097 - protein, 33 aa, Artificial Sequence
  Description of Artificial Sequence: Synthetic polypeptide
DEECIRCTNPVAYEQYGNVVSCNEFSQAGGNLM

SEQ ID NO: 129098 - protein, 34 aa, Artificial Sequence
  Description of Artificial Sequence: Synthetic polypeptide
DEECIRCTNPVAYEQYGSVVPSWNEFSQEGGNLM

SEQ ID NO: 129099 - protein, 32 aa, Artificial Sequence
  Description of Artificial Sequence: Synthetic polypeptide
DENEIRTTNPVATEQWGDVSEPAEPMMANGNV

SEQ ID NO: 129100 - protein, 34 aa, Artificial Sequence
  Description of Artificial Sequence: Synthetic polypeptide
CEEEISTTNPVATEQYGCVCSNTEPQNFGSDNQS

SEQ ID NO: 129101 - protein, 32 aa, Artificial Sequence
  Description of Artificial Sequence: Synthetic polypeptide
DEAEIRTTNPVATEQYGCVCQTAHINFMSNQI

SEQ ID NO: 129102 - protein, 33 aa, Artificial Sequence
  Description of Artificial Sequence: Synthetic polypeptide
DEAEIRTTNPVATEQYGCVCQTAHINFMSDNQS

SEQ ID NO: 129103 - protein, 32 aa, Artificial Sequence
  Description of Artificial Sequence: Synthetic polypeptide
DENEIRTTNPVATEQWGDVSENIREMNAAEDA

SEQ ID NO: 129104 - protein, 31 aa, Artificial Sequence
  Description of Artificial Sequence: Synthetic polypeptide
DENEIRTTNPVATEQWGDVSENIEMNAAEDA

SEQ ID NO: 129105 - protein, 33 aa, Artificial Sequence
  Description of Artificial Sequence: Synthetic polypeptide
DESEIRTTNPVATECWGSVSCINEPMDIEGENG

SEQ ID NO: 129106 - protein, 32 aa, Artificial Sequence
  Description of Artificial Sequence: Synthetic polypeptide
DEAEIRTTNPVATEQYGCVCQTAHIERFMSDQ

SEQ ID NO: 129107 - protein, 31 aa, Artificial Sequence
  Description of Artificial Sequence: Synthetic polypeptide
DENEIRTTNPVATEQWGDVSENEPMNAAEDA

SEQ ID NO: 129108 - protein, 34 aa, Artificial Sequence
  Description of Artificial Sequence: Synthetic polypeptide
DEAEIRTTNPVAYEQWGSVCSTITDQGDERNGGA

SEQ ID NO: 129109 - protein, 34 aa, Artificial Sequence
  Description of Artificial Sequence: Synthetic polypeptide
DEQEIATTNPVATEQYGSVSATDTLKEDHMGEDL

SEQ ID NO: 129110 - protein, 34 aa, Artificial Sequence
  Description of Artificial Sequence: Synthetic polypeptide
DEAEIRTTNPVATEQYGCVCSDTEHQNFGSETQP

SEQ ID NO: 129111 - protein, 31 aa, Artificial Sequence
  Description of Artificial Sequence: Synthetic polypeptide
DENEIRTTNPVATEQWGDVSENEPMDAAEDG

SEQ ID NO: 129112 - protein, 35 aa, Artificial Sequence
  Description of Artificial Sequence: Synthetic polypeptide
DEEEIRTTNPVATEQYGSVSLANDGQPHMIVEEPI

SEQ ID NO: 129113 - protein, 30 aa, Artificial Sequence
  Description of Artificial Sequence: Synthetic polypeptide
DENEIRTTNPVATEQWGDVSEQEMNAAEDA

SEQ ID NO: 129114 - protein, 35 aa, Artificial Sequence
  Description of Artificial Sequence: Synthetic polypeptide
DEEEIRTTNPVATEQYGSVSLENDEQPNMIVEEPQ

SEQ ID NO: 129115 - protein, 31 aa, Artificial Sequence
  Description of Artificial Sequence: Synthetic polypeptide
DENEIRTTNPVATEQWGDVSETCEMNAAEDA

SEQ ID NO: 129116 - protein, 30 aa, Artificial Sequence
  Description of Artificial Sequence: Synthetic polypeptide
DENEIRTTNPVATEQWGDVSESWMNAAEDA

SEQ ID NO: 129117 - protein, 35 aa, Artificial Sequence
  Description of Artificial Sequence: Synthetic polypeptide
DEEEIRTTNPVATEQYGSVSLENDEQAHMTVEEPI

SEQ ID NO: 129118 - protein, 36 aa, Artificial Sequence
  Description of Artificial Sequence: Synthetic polypeptide
DEEEIRTTNPVATEQYGSVSLELLSELIIRDIHGED

SEQ ID NO: 129119 - protein, 31 aa, Artificial Sequence
  Description of Artificial Sequence: Synthetic polypeptide
DENEIRTTNPVATEQWGDVSESIEMNAAEDN

SEQ ID NO: 129120 - protein, 31 aa, Artificial Sequence
  Description of Artificial Sequence: Synthetic polypeptide
DTEEIRATNPVAYEQWGCSYQVDNLQNNGTD

SEQ ID NO: 129121 - protein, 35 aa, Artificial Sequence
  Description of Artificial Sequence: Synthetic polypeptide
DEEEIRTTNPVATEQYGSVSLEIFVPQINPPEPNS

SEQ ID NO: 129122 - protein, 33 aa, Artificial Sequence
  Description of Artificial Sequence: Synthetic polypeptide
DEAEIRTTNPVAYEQWGSVCSTEDQGDVQNGGA

SEQ ID NO: 129123 - protein, 31 aa, Artificial Sequence
  Description of Artificial Sequence: Synthetic polypeptide
DENEIRTTNPVATEQWGDVSESEMNIAEDQA

SEQ ID NO: 129124 - protein, 31 aa, Artificial Sequence
  Description of Artificial Sequence: Synthetic polypeptide
DTEEIRATNPVAYEQWGSSYHMDNDQNGTER

SEQ ID NO: 129125 - protein, 31 aa, Artificial Sequence
  Description of Artificial Sequence: Synthetic polypeptide
DENEIRTTNPVATEQWGDVSESEMNAAEDVA

SEQ ID NO: 129126 - protein, 31 aa, Artificial Sequence
  Description of Artificial Sequence: Synthetic polypeptide
DENEIRTTNPVATEQWGDVSESEMNAAEDDA

SEQ ID NO: 129127 - protein, 30 aa, Artificial Sequence
  Description of Artificial Sequence: Synthetic polypeptide
DENEIRTTNPVATEQWGDVSESEMNAAEDA

SEQ ID NO: 129128 - protein, 34 aa, Artificial Sequence
  Description of Artificial Sequence: Synthetic polypeptide
DEAEIRTTNPVAYEQWGSVCSTENDMGDTRNGGA

SEQ ID NO: 129129 - protein, 30 aa, Artificial Sequence
  Description of Artificial Sequence: Synthetic polypeptide
DENEIRTTNPVATEQWGDVSEREMNAAEDA

SEQ ID NO: 129130 - protein, 33 aa, Artificial Sequence
  Description of Artificial Sequence: Synthetic polypeptide
DEQEIATTNPVATEQYGSVSATDRLEDHEAEDL

SEQ ID NO: 129131 - protein, 34 aa, Artificial Sequence
  Description of Artificial Sequence: Synthetic polypeptide
DEAEIRTTNPVAYEQWGSVCSTENDTQGDVNGMN

SEQ ID NO: 129132 - protein, 30 aa, Artificial Sequence
  Description of Artificial Sequence: Synthetic polypeptide
DENEIRTTNPVATEQWGDVSEQEMNAAEDS

SEQ ID NO: 129133 - protein, 31 aa, Artificial Sequence
  Description of Artificial Sequence: Synthetic polypeptide
DENEIRTTNPVATEQWGDVSEPIEMNAAEGA

SEQ ID NO: 129134 - protein, 35 aa, Artificial Sequence
  Description of Artificial Sequence: Synthetic polypeptide
DTEEIRTTNPCATEAYGSVSTVVNNLQQSEENNQQ

SEQ ID NO: 129135 - protein, 31 aa, Artificial Sequence
  Description of Artificial Sequence: Synthetic polypeptide
DENEIRTTNPVATEQWGDVSENEPMDAAEDA

SEQ ID NO: 129136 - protein, 34 aa, Artificial Sequence
  Description of Artificial Sequence: Synthetic polypeptide
DEAEIRTTNPVAYEQWGSVCSTLMDQDHRNGDDN

SEQ ID NO: 129137 - protein, 34 aa, Artificial Sequence
  Description of Artificial Sequence: Synthetic polypeptide
DEAEIRTTNPVAYEQWGSVCSTNDNHEQGENNDL

SEQ ID NO: 129138 - protein, 32 aa, Artificial Sequence
  Description of Artificial Sequence: Synthetic polypeptide
DEECIRTTNPEATDQYGQVCCCDQDQKRTGNH

SEQ ID NO: 129139 - protein, 30 aa, Artificial Sequence
  Description of Artificial Sequence: Synthetic polypeptide
DENEIRTTNPVATEQWGDVSEIWMNAAEPA

SEQ ID NO: 129140 - protein, 35 aa, Artificial Sequence
  Description of Artificial Sequence: Synthetic polypeptide
DEAEIRTTNPVAYEQWGSVCSTNDNMDERQGNGQK

SEQ ID NO: 129141 - protein, 35 aa, Artificial Sequence
  Description of Artificial Sequence: Synthetic polypeptide
DEAEIRTTNPVAYEQWGSVCSTNDNMDNRQGDNTQ

SEQ ID NO: 129142 - protein, 30 aa, Artificial Sequence
  Description of Artificial Sequence: Synthetic polypeptide
DENEIRTTNPVATEQWGDVSEIWMNAAEDA

SEQ ID NO: 129143 - protein, 31 aa, Artificial Sequence
  Description of Artificial Sequence: Synthetic polypeptide
DENEIRTTNPVATEQWGDVSEIWANAAEDYA

SEQ ID NO: 129144 - protein, 31 aa, Artificial Sequence
  Description of Artificial Sequence: Synthetic polypeptide
DENEIRTTNPVATEQWGDVSEIVMNAAEDAV

SEQ ID NO: 129145 - protein, 30 aa, Artificial Sequence
  Description of Artificial Sequence: Synthetic polypeptide
DENEIRTTNPVATEQWGDVSEIVMNAAEDA

SEQ ID NO: 129146 - protein, 35 aa, Artificial Sequence
  Description of Artificial Sequence: Synthetic polypeptide
DTEEIRTTNPCATEAYGSVSTVTNQQQGTEENNDE

SEQ ID NO: 129147 - protein, 34 aa, Artificial Sequence
  Description of Artificial Sequence: Synthetic polypeptide
DTEEIRTTNPCATEAYGSVSTVTNSEQGTEENDE

SEQ ID NO: 129148 - protein, 36 aa, Artificial Sequence
  Description of Artificial Sequence: Synthetic polypeptide
DTEEIRTTNPCATEAYGSVSTVVNNLQQGTEENNDT

SEQ ID NO: 129149 - protein, 34 aa, Artificial Sequence
  Description of Artificial Sequence: Synthetic polypeptide
DTEEIRTTNPCATEAYGSVSTVVNNLQQSEEEQT

SEQ ID NO: 129150 - protein, 33 aa, Artificial Sequence
  Description of Artificial Sequence: Synthetic polypeptide
DEQEIATTNPVATEQYGSVSATDWEDHEGEDLM

SEQ ID NO: 129151 - protein, 35 aa, Artificial Sequence
  Description of Artificial Sequence: Synthetic polypeptide
DEAEIRTTNPVATEQYGCTCSTGNLNQEHFGSDQS

SEQ ID NO: 129152 - protein, 31 aa, Artificial Sequence
  Description of Artificial Sequence: Synthetic polypeptide
DENEIRTTNPVATEQWGDVSEITEMNAASDA

SEQ ID NO: 129153 - protein, 32 aa, Artificial Sequence
  Description of Artificial Sequence: Synthetic polypeptide
DENEIRTTNPVATEQWGDVSEITEMNAAEKDA

SEQ ID NO: 129154 - protein, 31 aa, Artificial Sequence
  Description of Artificial Sequence: Synthetic polypeptide
DENEIRTTNPVATEQWGDVSEITEMNAAEDK

SEQ ID NO: 129155 - protein, 31 aa, Artificial Sequence
  Description of Artificial Sequence: Synthetic polypeptide
DENEIRTTNPVATEQWGDVSEITEMNAAEDA

SEQ ID NO: 129156 - protein, 36 aa, Artificial Sequence
  Description of Artificial Sequence: Synthetic polypeptide
DEAEIRTTNPVAYEQWGSVCSTNDDLGDNRGQDQRE

SEQ ID NO: 129157 - protein, 33 aa, Artificial Sequence
  Description of Artificial Sequence: Synthetic polypeptide
DEAEIRTTNPVAYEQWGSVCSTLDIGDTQNGGA

SEQ ID NO: 129158 - protein, 35 aa, Artificial Sequence
  Description of Artificial Sequence: Synthetic polypeptide
DTEEIRTTNPCATEAYGSVSTVTNNLQQINTEEGD

SEQ ID NO: 129159 - protein, 30 aa, Artificial Sequence
  Description of Artificial Sequence: Synthetic polypeptide
DENEIRTTNPVATEQWGDVSEIYMNAAEDA

SEQ ID NO: 129160 - protein, 31 aa, Artificial Sequence
  Description of Artificial Sequence: Synthetic polypeptide
DEAEIRTTNPVATEQYGCVCQSAHINFMSDQ

SEQ ID NO: 129161 - protein, 34 aa, Artificial Sequence
  Description of Artificial Sequence: Synthetic polypeptide
DTEEIRTTNPCATEAYGSVSTVTNLAGTEENNDE

SEQ ID NO: 129162 - protein, 33 aa, Artificial Sequence
  Description of Artificial Sequence: Synthetic polypeptide
DEQEIATTNPVATEQYGSVSATDVEDHEGVEDL

SEQ ID NO: 129163 - protein, 32 aa, Artificial Sequence
  Description of Artificial Sequence: Synthetic polypeptide
DEQEIATTNPVATEQYGSVSATDVEDHEQEDL

SEQ ID NO: 129164 - protein, 34 aa, Artificial Sequence
  Description of Artificial Sequence: Synthetic polypeptide
DEECIRTTNPCAYEQWGSVSTTNGDNQNNGNTEQ

SEQ ID NO: 129165 - protein, 30 aa, Artificial Sequence
  Description of Artificial Sequence: Synthetic polypeptide
DENEIRTTNPVATEQWGDVSEMEMNAAEDA

SEQ ID NO: 129166 - protein, 31 aa, Artificial Sequence
  Description of Artificial Sequence: Synthetic polypeptide
DENEIRTTNPVATEQWGDVSELIEMQAAEDA

SEQ ID NO: 129167 - protein, 31 aa, Artificial Sequence
  Description of Artificial Sequence: Synthetic polypeptide
DENEIRTTNPVATEQWGDVSELIEMNAQEDA

SEQ ID NO: 129168 - protein, 31 aa, Artificial Sequence
  Description of Artificial Sequence: Synthetic polypeptide
DENEIRTTNPVATEQWGDVSELIEMNAATDA

SEQ ID NO: 129169 - protein, 31 aa, Artificial Sequence
  Description of Artificial Sequence: Synthetic polypeptide
DENEIRTTNPVATEQWGDVSELIEMNAAEDA

SEQ ID NO: 129170 - protein, 30 aa, Artificial Sequence
  Description of Artificial Sequence: Synthetic polypeptide
DENEIRTTNPVATEQWGDVSELEMNACEDA

SEQ ID NO: 129171 - protein, 33 aa, Artificial Sequence
  Description of Artificial Sequence: Synthetic polypeptide
DEAEIRTTNPVAYEQWGSVCSTMDLHEEHNGED

SEQ ID NO: 129172 - protein, 30 aa, Artificial Sequence
  Description of Artificial Sequence: Synthetic polypeptide
DENEIRTTNPVATEQWGDVSELEMNAAEDA

SEQ ID NO: 129173 - protein, 30 aa, Artificial Sequence
  Description of Artificial Sequence: Synthetic polypeptide
DENEIRTTNPVATEQWGDVSEKSMNAAEDA

SEQ ID NO: 129174 - protein, 36 aa, Artificial Sequence
  Description of Artificial Sequence: Synthetic polypeptide
DTEEIRTTNPCATEAYGSVSTVTNNLQQGTEENEDE

SEQ ID NO: 129175 - protein, 30 aa, Artificial Sequence
  Description of Artificial Sequence: Synthetic polypeptide
DENEIRTTNPVATEQWGDVSEKEMNAAQDA

SEQ ID NO: 129176 - protein, 30 aa, Artificial Sequence
  Description of Artificial Sequence: Synthetic polypeptide
DENEIRTTNPVATEQWGDVSEKEMNAAEDA

SEQ ID NO: 129177 - protein, 36 aa, Artificial Sequence
  Description of Artificial Sequence: Synthetic polypeptide
DTEEIRTTNPCATEAYGSVSTVTNNLQQGTEENTDE

SEQ ID NO: 129178 - protein, 30 aa, Artificial Sequence
  Description of Artificial Sequence: Synthetic polypeptide
DENEIRTTNPVATEQWGDVSEIYMNAAEVA

SEQ ID NO: 129179 - protein, 30 aa, Artificial Sequence
  Description of Artificial Sequence: Synthetic polypeptide
DENEIRTTNPVATEQWGDVSEIYKNAAEDA

SEQ ID NO: 129180 - protein, 30 aa, Artificial Sequence
  Description of Artificial Sequence: Synthetic polypeptide
DENEIRTTNPVATEQWGDVSEIEENAAEDA

SEQ ID NO: 129181 - protein, 31 aa, Artificial Sequence
  Description of Artificial Sequence: Synthetic polypeptide
DENEIRTTNPVATEQWGDVSEIEEMQAAEDA

SEQ ID NO: 129182 - protein, 32 aa, Artificial Sequence
  Description of Artificial Sequence: Synthetic polypeptide
DENEIRTTNPVATEQWGDVSEIEEMNAAEDNA

SEQ ID NO: 129183 - protein, 33 aa, Artificial Sequence
  Description of Artificial Sequence: Synthetic polypeptide
DEAEIRTTNPVAYEQWGSVVIENGDQNGHGNTE

SEQ ID NO: 129184 - protein, 35 aa, Artificial Sequence
  Description of Artificial Sequence: Synthetic polypeptide
DEEEIRTTNPVATEQYGSVVPEEVGQLQIRQVVEN

SEQ ID NO: 129185 - protein, 35 aa, Artificial Sequence
  Description of Artificial Sequence: Synthetic polypeptide
AEEQIRTTNPVATEQYGSVSTTNNLNNLNLQNTTD

SEQ ID NO: 129186 - protein, 36 aa, Artificial Sequence
  Description of Artificial Sequence: Synthetic polypeptide
DEEEIRTTNPVATEQYGSVVPGENLFEPGVMENDEL

SEQ ID NO: 129187 - protein, 32 aa, Artificial Sequence
  Description of Artificial Sequence: Synthetic polypeptide
DENEIRTTNPVATEPYGTVSEEDIQMQQAGDH

SEQ ID NO: 129188 - protein, 34 aa, Artificial Sequence
  Description of Artificial Sequence: Synthetic polypeptide
DEECIRTTNPVAYEQWGSVACTNNGLQDHPDDPR

SEQ ID NO: 129189 - protein, 34 aa, Artificial Sequence
  Description of Artificial Sequence: Synthetic polypeptide
DEECIRTTNPVAYEQWGSVACTNNGLQDHQANNH

SEQ ID NO: 129190 - protein, 33 aa, Artificial Sequence
  Description of Artificial Sequence: Synthetic polypeptide
DENEIRTTNPVATEPYGTVCSMEGPQQQQNGNH

SEQ ID NO: 129191 - protein, 35 aa, Artificial Sequence
  Description of Artificial Sequence: Synthetic polypeptide
DEEEIRTTNPVATEQYGSVVPDDDENEQNVEGEGG

SEQ ID NO: 129192 - protein, 34 aa, Artificial Sequence
  Description of Artificial Sequence: Synthetic polypeptide
DEECIRTTNPVAYEQWGSVACTNNGLQDHQDNPM

SEQ ID NO: 129193 - protein, 35 aa, Artificial Sequence
  Description of Artificial Sequence: Synthetic polypeptide
DEECIRTTNPVAYEQWGSVACTNNGLQDHQDNQRH

SEQ ID NO: 129194 - protein, 33 aa, Artificial Sequence
  Description of Artificial Sequence: Synthetic polypeptide
DESEIRTTNPVATECWGSVSCIIEPQDRAEENG

SEQ ID NO: 129195 - protein, 33 aa, Artificial Sequence
  Description of Artificial Sequence: Synthetic polypeptide
DEECIRTTNPVAYEQWGSVAWTERDQRDFDGSM

SEQ ID NO: 129196 - protein, 33 aa, Artificial Sequence
  Description of Artificial Sequence: Synthetic polypeptide
DEECIRTTNPVAYEQWGSVAWTWEQLQVDDSGR

SEQ ID NO: 129197 - protein, 35 aa, Artificial Sequence
  Description of Artificial Sequence: Synthetic polypeptide
DEEEIRTTNPVATEQYGSVSGNGEEDVNDDGGGGT

SEQ ID NO: 129198 - protein, 33 aa, Artificial Sequence
  Description of Artificial Sequence: Synthetic polypeptide
DENEIRTTNPVATEPYGTISSTEDIQQQQNGNH

SEQ ID NO: 129199 - protein, 33 aa, Artificial Sequence
  Description of Artificial Sequence: Synthetic polypeptide
DENEIRTTNPVATEPYGTISSTEDIQQMQNGNH

SEQ ID NO: 129200 - protein, 36 aa, Artificial Sequence
  Description of Artificial Sequence: Synthetic polypeptide
AEENIRTTNPVATEQYGSVSTVTNQNLNQLQQATNE

SEQ ID NO: 129201 - protein, 33 aa, Artificial Sequence
  Description of Artificial Sequence: Synthetic polypeptide
DENEIRTTNPVATEPYGTVCSMEDPQQQQNGNH

SEQ ID NO: 129202 - protein, 36 aa, Artificial Sequence
  Description of Artificial Sequence: Synthetic polypeptide
AEEQIRTTNPVATEQYGSVSTTNNQLNNQLQQNTTE

SEQ ID NO: 129203 - protein, 36 aa, Artificial Sequence
  Description of Artificial Sequence: Synthetic polypeptide
AEEQIRTTNPVATEQYGSVSTTNNQLNQGEQQNTTE

SEQ ID NO: 129204 - protein, 36 aa, Artificial Sequence
  Description of Artificial Sequence: Synthetic polypeptide
DEEEIRTTNPVATEQYGSVVNTTPDGPNMGNGENDV

SEQ ID NO: 129205 - protein, 36 aa, Artificial Sequence
  Description of Artificial Sequence: Synthetic polypeptide
AEEQIRTTNPVATEQYGSVSTTNQQLGNQLQQNTEE

SEQ ID NO: 129206 - protein, 36 aa, Artificial Sequence
  Description of Artificial Sequence: Synthetic polypeptide
EEEEIRTTNPVATEQYGSVSSTTAAGPNMRNGMNPV

SEQ ID NO: 129207 - protein, 36 aa, Artificial Sequence
  Description of Artificial Sequence: Synthetic polypeptide
EEEEIRTTNPVATEQYGSVSSTTPAGPNMRNGMNPG

SEQ ID NO: 129208 - protein, 36 aa, Artificial Sequence
  Description of Artificial Sequence: Synthetic polypeptide
EEEEIRTTNPVATEQYGSVSSTTPAGPNMRNGMNPV

SEQ ID NO: 129209 - protein, 31 aa, Artificial Sequence
  Description of Artificial Sequence: Synthetic polypeptide
DENEIRTTNPVATEQWGATTAENWARKGPYI

SEQ ID NO: 129210 - protein, 30 aa, Artificial Sequence
  Description of Artificial Sequence: Synthetic polypeptide
DEAEIRTTNPVATEQWGCVSEIEMNAAEDA

SEQ ID NO: 129211 - protein, 33 aa, Artificial Sequence
  Description of Artificial Sequence: Synthetic polypeptide
DESEIRTTNPVATECWGSVSCIIEPQNRAEENA

SEQ ID NO: 129212 - protein, 36 aa, Artificial Sequence
  Description of Artificial Sequence: Synthetic polypeptide
EEEEIRTTNPVATEQYGSVSSTTPAGPNTRNGMNPV

SEQ ID NO: 129213 - protein, 33 aa, Artificial Sequence
  Description of Artificial Sequence: Synthetic polypeptide
DEECIRTTNPVAYEQWGESYSVDNEDQKGDNNV

SEQ ID NO: 129214 - protein, 34 aa, Artificial Sequence
  Description of Artificial Sequence: Synthetic polypeptide
DESEIRTTNPVATECWGSVSCIIEPQDREGENGV

SEQ ID NO: 129215 - protein, 32 aa, Artificial Sequence
  Description of Artificial Sequence: Synthetic polypeptide
DEAEIRTTNPVAYEQWGSVVIENDMQGHQNQE

SEQ ID NO: 129216 - protein, 34 aa, Artificial Sequence
  Description of Artificial Sequence: Synthetic polypeptide
DEECIRTTNPVAYEQWGEVCTIEFDGQRQGNGNR

SEQ ID NO: 129217 - protein, 36 aa, Artificial Sequence
  Description of Artificial Sequence: Synthetic polypeptide
EEEEIRTTNPVATEQYGSVSTALQAGTEAGGTTTDD

SEQ ID NO: 129218 - protein, 33 aa, Artificial Sequence
  Description of Artificial Sequence: Synthetic polypeptide
DEQEIATTNPVATEQYGSVSATTDIEDHEGEDL

SEQ ID NO: 129219 - protein, 34 aa, Artificial Sequence
  Description of Artificial Sequence: Synthetic polypeptide
CEEEISTTNPVATEQYGCVCSNTGELQNSGSDQS

SEQ ID NO: 129220 - protein, 30 aa, Artificial Sequence
  Description of Artificial Sequence: Synthetic polypeptide
DENEIRTTNPVATEQFGDVSEIEMNAAEDA

SEQ ID NO: 129221 - protein, 36 aa, Artificial Sequence
  Description of Artificial Sequence: Synthetic polypeptide
DEECIRTTNPVAYEQWGSVACTNNGLQDDHQGNERI

SEQ ID NO: 129222 - protein, 36 aa, Artificial Sequence
  Description of Artificial Sequence: Synthetic polypeptide
DEEEIRTTNPVATEQYGSVVNTGMNNEEGEDGENET

SEQ ID NO: 129223 - protein, 34 aa, Artificial Sequence
  Description of Artificial Sequence: Synthetic polypeptide
DEEEIRTTNPVATEQYGSVVNTLTLEDPFMTEQF

SEQ ID NO: 129224 - protein, 31 aa, Artificial Sequence
  Description of Artificial Sequence: Synthetic polypeptide
DENEIRTTNPVATEPYGTISMIIQQQQNGDH

SEQ ID NO: 129225 - protein, 30 aa, Artificial Sequence
  Description of Artificial Sequence: Synthetic polypeptide
DENEIRTTNPVATEPYGTISMIIMQQNEDA

SEQ ID NO: 129226 - protein, 36 aa, Artificial Sequence
  Description of Artificial Sequence: Synthetic polypeptide
AEENIRTTNPVATEQYGSVSTVTNQLLQNNQQNTTE

SEQ ID NO: 129227 - protein, 32 aa, Artificial Sequence
  Description of Artificial Sequence: Synthetic polypeptide
DENEIRTTNPVATEPYGTISMEIIQQQQNGNA

SEQ ID NO: 129228 - protein, 35 aa, Artificial Sequence
  Description of Artificial Sequence: Synthetic polypeptide
DEEEIRTTNPVATEQYGSVSGDNGDGENDEGQDEQ

SEQ ID NO: 129229 - protein, 33 aa, Artificial Sequence
  Description of Artificial Sequence: Synthetic polypeptide
DEAEIRTTNPVAYEQWGTVCSNENEQGDGNNGS

SEQ ID NO: 129230 - protein, 31 aa, Artificial Sequence
  Description of Artificial Sequence: Synthetic polypeptide
DENEIRTTNPVATEPYGTISMEDIMQQNENA

SEQ ID NO: 129231 - protein, 37 aa, Artificial Sequence
  Description of Artificial Sequence: Synthetic polypeptide
EEEEIRTTNPVATEQYGSVSTQLNQLNDEEIGTNNNE

SEQ ID NO: 129232 - protein, 33 aa, Artificial Sequence
  Description of Artificial Sequence: Synthetic polypeptide
DESEIRTTNPVATECWGSVSCIIEPQDAAGENG

SEQ ID NO: 129233 - protein, 36 aa, Artificial Sequence
  Description of Artificial Sequence: Synthetic polypeptide
DEEEIRTTNPVATEQYGSVVPTALDMQQADLQTNES

SEQ ID NO: 129234 - protein, 31 aa, Artificial Sequence
  Description of Artificial Sequence: Synthetic polypeptide
DENEIRTTNPVATEPYGTISEEIIQQANENH

SEQ ID NO: 129235 - protein, 31 aa, Artificial Sequence
  Description of Artificial Sequence: Synthetic polypeptide
DENEIRTTNPVATEPYGTISEEIIQQANENA

SEQ ID NO: 129236 - protein, 32 aa, Artificial Sequence
  Description of Artificial Sequence: Synthetic polypeptide
DENEIRTTNPVATEPYGTISEEDIQQQQNGNH

SEQ ID NO: 129237 - protein, 32 aa, Artificial Sequence
  Description of Artificial Sequence: Synthetic polypeptide
DEECIRTTNPVAYEQWGTYVYTDSDSDRGNSP

SEQ ID NO: 129238 - protein, 36 aa, Artificial Sequence
  Description of Artificial Sequence: Synthetic polypeptide
DEEEIRTTNPVATEQYGSVVPTMNLNEPQALPQSTQ

SEQ ID NO: 129239 - protein, 32 aa, Artificial Sequence
  Description of Artificial Sequence: Synthetic polypeptide
DENEIRTTNPVATEPYGTISEEDIQQQAAGNH

SEQ ID NO: 129240 - protein, 35 aa, Artificial Sequence
  Description of Artificial Sequence: Synthetic polypeptide
DEAEIRTTNPVAYEQWGTVVSTNNILGEDAGQNDR

SEQ ID NO: 129241 - protein, 36 aa, Artificial Sequence
  Description of Artificial Sequence: Synthetic polypeptide
DEEEIRTTNPVATEQYGSVVPTNGEGALITQDEEPA

SEQ ID NO: 129242 - protein, 33 aa, Artificial Sequence
  Description of Artificial Sequence: Synthetic polypeptide
DESEIRTTNPVATECWGSVSCIIEPMDREGENA

SEQ ID NO: 129243 - protein, 36 aa, Artificial Sequence
  Description of Artificial Sequence: Synthetic polypeptide
EEEEIRTTNPVATEQYGSVSTTNNQQNQQQGEETDE

SEQ ID NO: 129244 - protein, 33 aa, Artificial Sequence
  Description of Artificial Sequence: Synthetic polypeptide
DENEIRTTNPVATEPYGTISATEDIQQQQNGNH

SEQ ID NO: 129245 - protein, 33 aa, Artificial Sequence
  Description of Artificial Sequence: Synthetic polypeptide
DENEIRTTNPVATEPYGTISATEDIQQQQEGNH

SEQ ID NO: 129246 - protein, 32 aa, Artificial Sequence
  Description of Artificial Sequence: Synthetic polypeptide
DENEIRTTNPVATEPYGTISATDIQQQQEGEH

SEQ ID NO: 129247 - protein, 32 aa, Artificial Sequence
  Description of Artificial Sequence: Synthetic polypeptide
DENEIRTTNPVATEPYGTISMEDIQQDQNGNH

SEQ ID NO: 129248 - protein, 33 aa, Artificial Sequence
  Description of Artificial Sequence: Synthetic polypeptide
DEECIRTTNPVAYEQWGESYNVPNEDQPDGDNR

SEQ ID NO: 129249 - protein, 32 aa, Artificial Sequence
  Description of Artificial Sequence: Synthetic polypeptide
DENEIRTTNPVATEPYGTISMEDIQQQAAGNH

SEQ ID NO: 129250 - protein, 34 aa, Artificial Sequence
  Description of Artificial Sequence: Synthetic polypeptide
DEAEIRTTNPVATEQFGTVCVSTLTLELRGQDDT

SEQ ID NO: 129251 - protein, 36 aa, Artificial Sequence
  Description of Artificial Sequence: Synthetic polypeptide
DEEEIRTTNPVATEQYGSVSGGTPAGPNMRNGMGPV

SEQ ID NO: 129252 - protein, 32 aa, Artificial Sequence
  Description of Artificial Sequence: Synthetic polypeptide
DENEIRTTNPVATEPYGTISMEIIQQQANGNH

SEQ ID NO: 129253 - protein, 33 aa, Artificial Sequence
  Description of Artificial Sequence: Synthetic polypeptide
DESEIRTTNPVATECWGSVSCIIEPQDRAEENA

SEQ ID NO: 129254 - protein, 33 aa, Artificial Sequence
  Description of Artificial Sequence: Synthetic polypeptide
DEECIRTTNPVAYEQWGSVFQHEDLGRKGDNQH

SEQ ID NO: 129255 - protein, 36 aa, Artificial Sequence
  Description of Artificial Sequence: Synthetic polypeptide
AEENIRTTNPVATEQYGSVSTTVNNLNQLQLQNTTD

SEQ ID NO: 129256 - protein, 36 aa, Artificial Sequence
  Description of Artificial Sequence: Synthetic polypeptide
AEENIRTTNPVATEQYGSVSTTNQQLNQLLQQNTTE

SEQ ID NO: 129257 - protein, 32 aa, Artificial Sequence
  Description of Artificial Sequence: Synthetic polypeptide
DENEIRTTNPVATEPYGTISMEDPVQQQNGNH

SEQ ID NO: 129258 - protein, 32 aa, Artificial Sequence
  Description of Artificial Sequence: Synthetic polypeptide
DENEIRTTNPVATEPYGTISMEDPVEQQNGNH

SEQ ID NO: 129259 - protein, 32 aa, Artificial Sequence
  Description of Artificial Sequence: Synthetic polypeptide
DENEIRTTNPVATEPYGTISMEDPQQQQNGNH

SEQ ID NO: 129260 - protein, 33 aa, Artificial Sequence
  Description of Artificial Sequence: Synthetic polypeptide
DEAEIRTTNPVAYEQWGSVYWTDQQDDHNGNNH

SEQ ID NO: 129261 - protein, 32 aa, Artificial Sequence
  Description of Artificial Sequence: Synthetic polypeptide
DENEIRTTNPVATEPYGTISMEDIVQQQNGNH

SEQ ID NO: 129262 - protein, 34 aa, Artificial Sequence
  Description of Artificial Sequence: Synthetic polypeptide
DEAEIRTTNPVATEQFGTVCVSTVYLIPRGQDDS

SEQ ID NO: 129263 - protein, 33 aa, Artificial Sequence
  Description of Artificial Sequence: Synthetic polypeptide
DENEIRTTNPVATEPYGTISMEDIQQQRNGENH

SEQ ID NO: 129264 - protein, 34 aa, Artificial Sequence
  Description of Artificial Sequence: Synthetic polypeptide
DEAEIRTTNPVATEQFGTVCVSTLYLLRGQDDIP

SEQ ID NO: 129265 - protein, 34 aa, Artificial Sequence
  Description of Artificial Sequence: Synthetic polypeptide
DEAEIRTTNPVATEQFGTVCVSTLYLLRGGQEDK

SEQ ID NO: 129266 - protein, 32 aa, Artificial Sequence
  Description of Artificial Sequence: Synthetic polypeptide
DENEIRTTNPVATEPYGTISMEDIQQQQNGNH

SEQ ID NO: 129267 - protein, 32 aa, Artificial Sequence
  Description of Artificial Sequence: Synthetic polypeptide
DEAEIRTTNPVAYEQWGSYWSTINETQDNSEY

SEQ ID NO: 129268 - protein, 34 aa, Artificial Sequence
  Description of Artificial Sequence: Synthetic polypeptide
DEAEIRTTNPVAYEQWGSYWSTINPNQDVEGNID

SEQ ID NO: 129269 - protein, 33 aa, Artificial Sequence
  Description of Artificial Sequence: Synthetic polypeptide
DEAEIRTTNPVAYEQWGTISHTDQNHQREGTGP

SEQ ID NO: 129270 - protein, 31 aa, Artificial Sequence
  Description of Artificial Sequence: Synthetic polypeptide
DENEIRTTNPVATEPYGTISMEDIQQQNGGH

SEQ ID NO: 129271 - protein, 32 aa, Artificial Sequence
  Description of Artificial Sequence: Synthetic polypeptide
DESEIRTTNPVATECWGSVSCIIEQDAAEENA

SEQ ID NO: 129272 - protein, 36 aa, Artificial Sequence
  Description of Artificial Sequence: Synthetic polypeptide
DEEEIRTTNPVATEQYGSVSGQNGDGQNDEGEDEQS

SEQ ID NO: 129273 - protein, 33 aa, Artificial Sequence
  Description of Artificial Sequence: Synthetic polypeptide
DEECIRTTNPVAYEQWGEAYSVDNEDQKGDNRQ

SEQ ID NO: 129274 - protein, 34 aa, Artificial Sequence
  Description of Artificial Sequence: Synthetic polypeptide
DEECIRTTNPVATEQYSACVCSWNLQEHFGSDQS

SEQ ID NO: 129275 - protein, 36 aa, Artificial Sequence
  Description of Artificial Sequence: Synthetic polypeptide
EEEEIRTTNPVATEQYGSVATTQNLQQANNNDEQGS

SEQ ID NO: 129276 - protein, 34 aa, Artificial Sequence
  Description of Artificial Sequence: Synthetic polypeptide
EEEEIRTTNPVATEQYGSVDDTAGQQNGGGQGEQ

SEQ ID NO: 129277 - protein, 32 aa, Artificial Sequence
  Description of Artificial Sequence: Synthetic polypeptide
DEECIRTTNPVAWEQYGGQCDCHINVQGGNNV

SEQ ID NO: 129278 - protein, 32 aa, Artificial Sequence
  Description of Artificial Sequence: Synthetic polypeptide
DEECIRTTNPVAWEQYGQCDCDINVQGGNNNV

SEQ ID NO: 129279 - protein, 34 aa, Artificial Sequence
  Description of Artificial Sequence: Synthetic polypeptide
DEQEIATTNPVATEQYGSVSATPDLEPHFGIEDL

SEQ ID NO: 129280 - protein, 35 aa, Artificial Sequence
  Description of Artificial Sequence: Synthetic polypeptide
DEQEIATTNPVATEQYGSVSATPDLQEDYEGEDEY

SEQ ID NO: 129281 - protein, 34 aa, Artificial Sequence
  Description of Artificial Sequence: Synthetic polypeptide
DEAEIRTTNPVAYEQWGSVSTTNGNDNHGGDNVG

SEQ ID NO: 129282 - protein, 34 aa, Artificial Sequence
  Description of Artificial Sequence: Synthetic polypeptide
DEAEIRTTNPVAYEQWGSVSTTNGNDNHQGDNAT

SEQ ID NO: 129283 - protein, 33 aa, Artificial Sequence
  Description of Artificial Sequence: Synthetic polypeptide
EEEEIRTTNPVATEQYGSVEVMVQQRPSVDPEQ

SEQ ID NO: 129284 - protein, 34 aa, Artificial Sequence
  Description of Artificial Sequence: Synthetic polypeptide
EEEEIRTTNPVATEQYGSVISPENMEERPAFEEI

SEQ ID NO: 129285 - protein, 35 aa, Artificial Sequence
  Description of Artificial Sequence: Synthetic polypeptide
EEEEIRTTNPVATEQYGSVISPTTYQAVNQDVFEN

SEQ ID NO: 129286 - protein, 34 aa, Artificial Sequence
  Description of Artificial Sequence: Synthetic polypeptide
EEEEIRTTNPVATEQYGSVISSTTTDEIQPPQLL

SEQ ID NO: 129287 - protein, 34 aa, Artificial Sequence
  Description of Artificial Sequence: Synthetic polypeptide
EEEEIRTTNPVATEQYGSVIVPNDLQNVPSESGE

SEQ ID NO: 129288 - protein, 32 aa, Artificial Sequence
  Description of Artificial Sequence: Synthetic polypeptide
DEECIRTTNPVAYEEWGQCTTGGDHQRGSNTR

SEQ ID NO: 129289 - protein, 34 aa, Artificial Sequence
  Description of Artificial Sequence: Synthetic polypeptide
EEEEIRTTNPVATEQYGSVMNSLMVEVNQMINAD

SEQ ID NO: 129290 - protein, 34 aa, Artificial Sequence
  Description of Artificial Sequence: Synthetic polypeptide
EEEEIRTTNPVATEQYGSVNATTMGQGNGEFTEG

SEQ ID NO: 129291 - protein, 37 aa, Artificial Sequence
  Description of Artificial Sequence: Synthetic polypeptide
EEEEIRTTNPVATEQYGSVQSSMNNLEQEGMNPPEGI

SEQ ID NO: 129292 - protein, 34 aa, Artificial Sequence
  Description of Artificial Sequence: Synthetic polypeptide
DEECIRTTNPVAYEHYGSTVATLNEGSGRNGEER

SEQ ID NO: 129293 - protein, 35 aa, Artificial Sequence
  Description of Artificial Sequence: Synthetic polypeptide
DEECIRTTNPVATEQYSACVCSTNLNQENFGSQQS

SEQ ID NO: 129294 - protein, 33 aa, Artificial Sequence
  Description of Artificial Sequence: Synthetic polypeptide
DEECIRTTNPVAYEMYGSVNPTNEIDADGCNPC

SEQ ID NO: 129295 - protein, 34 aa, Artificial Sequence
  Description of Artificial Sequence: Synthetic polypeptide
DEECIRTTNPVATEQYSACVCSTNDQEYFGSDQS

SEQ ID NO: 129296 - protein, 33 aa, Artificial Sequence
  Description of Artificial Sequence: Synthetic polypeptide
DENEIRTTNPVATEQWGCVCSSPETNAFNSDNA

SEQ ID NO: 129297 - protein, 30 aa, Artificial Sequence
  Description of Artificial Sequence: Synthetic polypeptide
DENEIRTTNPVATEQWGCVSELEMNHAEDA

SEQ ID NO: 129298 - protein, 30 aa, Artificial Sequence
  Description of Artificial Sequence: Synthetic polypeptide
DENEIRTTNPVATEQWGCVSEIQMNAADDA

SEQ ID NO: 129299 - protein, 30 aa, Artificial Sequence
  Description of Artificial Sequence: Synthetic polypeptide
DENEIRTTNPVATEQWGCVSEIPMNAAEDA

SEQ ID NO: 129300 - protein, 31 aa, Artificial Sequence
  Description of Artificial Sequence: Synthetic polypeptide
DENEIRTTNPVATEQWGCVSEINIENTAEDA

SEQ ID NO: 129301 - protein, 36 aa, Artificial Sequence
  Description of Artificial Sequence: Synthetic polypeptide
DEECIRTTNPVATEQYGSVSSTTPAGPNMRNGMNPV

SEQ ID NO: 129302 - protein, 30 aa, Artificial Sequence
  Description of Artificial Sequence: Synthetic polypeptide
DENEIRTTNPVATEQWGCVSEIEMNAASDA

SEQ ID NO: 129303 - protein, 30 aa, Artificial Sequence
  Description of Artificial Sequence: Synthetic polypeptide
DENEIRTTNPVATEQWGCVSEIEMNAAEDA

SEQ ID NO: 129304 - protein, 30 aa, Artificial Sequence
  Description of Artificial Sequence: Synthetic polypeptide
DENEIRTTNPVATEQWGCVSEIEMAAAEDA

SEQ ID NO: 129305 - protein, 30 aa, Artificial Sequence
  Description of Artificial Sequence: Synthetic polypeptide
DENEIRTTNPVATEQWGCVSEIEENTIEIA

SEQ ID NO: 129306 - protein, 36 aa, Artificial Sequence
  Description of Artificial Sequence: Synthetic polypeptide
DEECIRTTNPVATEQYGSVSSTTPAPPNMRNGMNPV

SEQ ID NO: 129307 - protein, 32 aa, Artificial Sequence
  Description of Artificial Sequence: Synthetic polypeptide
DENEIRTTNPVATEQWGCVSEGEMNAALDNAK

SEQ ID NO: 129308 - protein, 31 aa, Artificial Sequence
  Description of Artificial Sequence: Synthetic polypeptide
DENEIRTTNPVATEQWGCVSEGEMNAAEDSL

SEQ ID NO: 129309 - protein, 36 aa, Artificial Sequence
  Description of Artificial Sequence: Synthetic polypeptide
DEECIRTTNPVATEQYGSVSSTTTAGPNMRNGMNPV

SEQ ID NO: 129310 - protein, 30 aa, Artificial Sequence
  Description of Artificial Sequence: Synthetic polypeptide
DENEIRTTNPVATEQWGCVSEDEMNAMEDA

SEQ ID NO: 129311 - protein, 30 aa, Artificial Sequence
  Description of Artificial Sequence: Synthetic polypeptide
DENEIRTTNPVATEQWGCVSEAEENTAEDV

SEQ ID NO: 129312 - protein, 30 aa, Artificial Sequence
  Description of Artificial Sequence: Synthetic polypeptide
DENEIRTTNPVATEQWGCVSEADENTIEDA

SEQ ID NO: 129313 - protein, 34 aa, Artificial Sequence
  Description of Artificial Sequence: Synthetic polypeptide
DEECIRTTNPVATEQYGSVSTWIIEELNFMSQEE

SEQ ID NO: 129314 - protein, 36 aa, Artificial Sequence
  Description of Artificial Sequence: Synthetic polypeptide
DEECIRTTNPVATEQYGSVSYTTPAGFIMRNGMNPV

SEQ ID NO: 129315 - protein, 35 aa, Artificial Sequence
  Description of Artificial Sequence: Synthetic polypeptide
EEEEIRTTNPVATEQYGSASPMNNQQGSQIVEERD

SEQ ID NO: 129316 - protein, 34 aa, Artificial Sequence
  Description of Artificial Sequence: Synthetic polypeptide
DEECIRTTNPVATEQYSACVCSTGELNQYFGSDQ

SEQ ID NO: 129317 - protein, 32 aa, Artificial Sequence
  Description of Artificial Sequence: Synthetic polypeptide
DENEIRTTNPVATEPYGTISATDIQQDQEGEH

SEQ ID NO: 129318 - protein, 35 aa, Artificial Sequence
  Description of Artificial Sequence: Synthetic polypeptide
EEEEIRTTNPVATEQYGSVSADTAGEQNGGGFEET

SEQ ID NO: 129319 - protein, 33 aa, Artificial Sequence
  Description of Artificial Sequence: Synthetic polypeptide
DESEIRTTNPVATECWGSVSCIKEPQDFEGMNG

SEQ ID NO: 129320 - protein, 31 aa, Artificial Sequence
  Description of Artificial Sequence: Synthetic polypeptide
DEECIRTTNPVAYEQWGCVYQNEDGGDHGNH

SEQ ID NO: 129321 - protein, 32 aa, Artificial Sequence
  Description of Artificial Sequence: Synthetic polypeptide
DEECIRTTNPVAYEQWGCVYQNGDSQDHGNHQ

SEQ ID NO: 129322 - protein, 32 aa, Artificial Sequence
  Description of Artificial Sequence: Synthetic polypeptide
DEECIRTTNPVAYEQWGCVYQPNDWQDGGTNH

SEQ ID NO: 129323 - protein, 30 aa, Artificial Sequence
  Description of Artificial Sequence: Synthetic polypeptide
DENEIRTTNPVATEQWGAVSVIEMIAAETA

SEQ ID NO: 129324 - protein, 30 aa, Artificial Sequence
  Description of Artificial Sequence: Synthetic polypeptide
DENEIRTTNPVATEQWGAVSPIEMIAAEDQ

SEQ ID NO: 129325 - protein, 31 aa, Artificial Sequence
  Description of Artificial Sequence: Synthetic polypeptide
DENEIRTTNPVATEQWGAVSNEIWMNAKEPA

SEQ ID NO: 129326 - protein, 31 aa, Artificial Sequence
  Description of Artificial Sequence: Synthetic polypeptide
DENEIRTTNPVATEQWGAVSNEIWANAKGPI

SEQ ID NO: 129327 - protein, 31 aa, Artificial Sequence
  Description of Artificial Sequence: Synthetic polypeptide
DEAEIRTTNPVATEQWGCVSEWEENTIEDAG

SEQ ID NO: 129328 - protein, 30 aa, Artificial Sequence
  Description of Artificial Sequence: Synthetic polypeptide
DEAEIRTTNPVATEQWGCVSEPEMNIAEDA

SEQ ID NO: 129329 - protein, 30 aa, Artificial Sequence
  Description of Artificial Sequence: Synthetic polypeptide
DENEIRTTNPVATEQWGAVSEIEMPAAEDA

SEQ ID NO: 129330 - protein, 30 aa, Artificial Sequence
  Description of Artificial Sequence: Synthetic polypeptide
DENEIRTTNPVATEQWGAVSEIEMNAAEDI

SEQ ID NO: 129331 - protein, 30 aa, Artificial Sequence
  Description of Artificial Sequence: Synthetic polypeptide
DENEIRTTNPVATEQWGAVSEIEMNAAEDA

SEQ ID NO: 129332 - protein, 30 aa, Artificial Sequence
  Description of Artificial Sequence: Synthetic polypeptide
DENEIRTTNPVATEQWGAVSAIWMNAKEDA

SEQ ID NO: 129333 - protein, 30 aa, Artificial Sequence
  Description of Artificial Sequence: Synthetic polypeptide
DENEIRTTNPVATEQWGAVSAIEMNAKEDA

SEQ ID NO: 129334 - protein, 30 aa, Artificial Sequence
  Description of Artificial Sequence: Synthetic polypeptide
DENEIRTTNPVATEQWGAVSAIEMNAAEDA

SEQ ID NO: 129335 - protein, 36 aa, Artificial Sequence
  Description of Artificial Sequence: Synthetic polypeptide
EEEEIRTTNPVATEQYGSVSPTNNSGLNIIDQVDII

SEQ ID NO: 129336 - protein, 31 aa, Artificial Sequence
  Description of Artificial Sequence: Synthetic polypeptide
DEECIRTTNPVAYEQWGCVYQVDEQDHGDNQ

SEQ ID NO: 129337 - protein, 32 aa, Artificial Sequence
  Description of Artificial Sequence: Synthetic polypeptide
DEECIRTTNPVAYEQWGCVYSNDWQDGGNNEH

SEQ ID NO: 129338 - protein, 32 aa, Artificial Sequence
  Description of Artificial Sequence: Synthetic polypeptide
DEECIRTTNPVAYEQWGCVYSNDWQDHGNQNH

SEQ ID NO: 129339 - protein, 31 aa, Artificial Sequence
  Description of Artificial Sequence: Synthetic polypeptide
DEECIRTTNPVAYEQWGCVYQNDQQDHNNEH

SEQ ID NO: 129340 - protein, 32 aa, Artificial Sequence
  Description of Artificial Sequence: Synthetic polypeptide
AEEVIRTTNPVATEEYGCIACINLSTRGGNNY

SEQ ID NO: 129341 - protein, 32 aa, Artificial Sequence
  Description of Artificial Sequence: Synthetic polypeptide
DESEIRTTNPVATECWGSVSCIIEQDAAEENG

SEQ ID NO: 129342 - protein, 36 aa, Artificial Sequence
  Description of Artificial Sequence: Synthetic polypeptide
AEEQIRTTNPVATEQYGSVSTVTNQLNQLNQQGTTE

SEQ ID NO: 129343 - protein, 34 aa, Artificial Sequence
  Description of Artificial Sequence: Synthetic polypeptide
DEECIRTTNPVAYEQFGSTVFTPNEGSGRNGGKR

SEQ ID NO: 129344 - protein, 35 aa, Artificial Sequence
  Description of Artificial Sequence: Synthetic polypeptide
EEEEIRTTNPVATEQYGSVSETNQQHEHMITEEQV

SEQ ID NO: 129345 - protein, 32 aa, Artificial Sequence
  Description of Artificial Sequence: Synthetic polypeptide
DEECIRTTNPVAYEQWGCSFQHEDLGRGDNTP

SEQ ID NO: 129346 - protein, 34 aa, Artificial Sequence
  Description of Artificial Sequence: Synthetic polypeptide
DEQEIATTNPVATEQYGSVSATRDLEAHEGPEDL

SEQ ID NO: 129347 - protein, 32 aa, Artificial Sequence
  Description of Artificial Sequence: Synthetic polypeptide
DENEIRTTNPVATEQWGCVCSEEETNAFESDA

SEQ ID NO: 129348 - protein, 33 aa, Artificial Sequence
  Description of Artificial Sequence: Synthetic polypeptide
DEDEIACTNPVATEQYGSVCTNLAEPGIDDQDE

SEQ ID NO: 129349 - protein, 36 aa, Artificial Sequence
  Description of Artificial Sequence: Synthetic polypeptide
DEEEIRTTNPVATEQYGSVSGTGEAGINPRDLMNPV

SEQ ID NO: 129350 - protein, 33 aa, Artificial Sequence
  Description of Artificial Sequence: Synthetic polypeptide
EEEEIRTTNPVATEQYGSVSLTSGATAAAVAED

SEQ ID NO: 129351 - protein, 34 aa, Artificial Sequence
  Description of Artificial Sequence: Synthetic polypeptide
EEEEIRTTNPVATEQYGSVSNSPEVEVNQMINAM

SEQ ID NO: 129352 - protein, 35 aa, Artificial Sequence
  Description of Artificial Sequence: Synthetic polypeptide
EEEEIRTTNPVATEQYGSVSPAITPQLELDGMMLT

SEQ ID NO: 129353 - protein, 34 aa, Artificial Sequence
  Description of Artificial Sequence: Synthetic polypeptide
EEEEIRTTNPVATEQYGSVSPAPHQVTQVDMQRQ

SEQ ID NO: 129354 - protein, 34 aa, Artificial Sequence
  Description of Artificial Sequence: Synthetic polypeptide
EEEEIRTTNPVATEQYGSVSPLAVEQNVVLIPGS

SEQ ID NO: 129355 - protein, 31 aa, Artificial Sequence
  Description of Artificial Sequence: Synthetic polypeptide
DENEIRTTNPVATEQWGCCSEVEMNIAETEA

SEQ ID NO: 129356 - protein, 36 aa, Artificial Sequence
  Description of Artificial Sequence: Synthetic polypeptide
EEEEIRTTNPVATEQYGSVSPLVVTNLQMTELTLQT

SEQ ID NO: 129357 - protein, 34 aa, Artificial Sequence
  Description of Artificial Sequence: Synthetic polypeptide
EEEEIRTTNPVATEQYGSVSPMAGVEQNFVLING

SEQ ID NO: 129358 - protein, 36 aa, Artificial Sequence
  Description of Artificial Sequence: Synthetic polypeptide
AEEQIRTTNPVATEQYGSVSTVTNQLNQNNNQNTTE

SEQ ID NO: 129359 - protein, 31 aa, Artificial Sequence
  Description of Artificial Sequence: Synthetic polypeptide
DENEIRTTNPVATEQWGAVWSAIWMNAKGPI

SEQ ID NO: 129360 - protein, 31 aa, Artificial Sequence
  Description of Artificial Sequence: Synthetic polypeptide
DENEIRTTNPVATEQWGAVWSAIWMNAKGPA

SEQ ID NO: 129361 - protein, 32 aa, Artificial Sequence
  Description of Artificial Sequence: Synthetic polypeptide
DEECIRTTNPVAYEQWGCVYQGNDSQDHGNNH

SEQ ID NO: 129362 - protein, 34 aa, Artificial Sequence
  Description of Artificial Sequence: Synthetic polypeptide
DEAEIRTTNPVAYEQWGSVTSGPNPGGQTNGGER

SEQ ID NO: 129363 - protein, 36 aa, Artificial Sequence
  Description of Artificial Sequence: Synthetic polypeptide
DEEEIRTTNPVATEQYGSVSTQAMMWQESNGEEEVE

SEQ ID NO: 129364 - protein, 33 aa, Artificial Sequence
  Description of Artificial Sequence: Synthetic polypeptide
DEECIRTTNPVAYEQWGTYVYTQDNEDDRGENA

SEQ ID NO: 129365 - protein, 33 aa, Artificial Sequence
  Description of Artificial Sequence: Synthetic polypeptide
DEAEIRTTNPVAYEQWGVTTGGNGNQGNGNADR

SEQ ID NO: 129366 - protein, 31 aa, Artificial Sequence
  Description of Artificial Sequence: Synthetic polypeptide
DENEIRTTNPVATEPWGAISMEDIQQQNGNI

SEQ ID NO: 129367 - protein, 31 aa, Artificial Sequence
  Description of Artificial Sequence: Synthetic polypeptide
DENEIRTTNPVATEPWGAISAEDIQQQNGNI

SEQ ID NO: 129368 - protein, 31 aa, Artificial Sequence
  Description of Artificial Sequence: Synthetic polypeptide
DENEIRTTNPVATEPWGAISAEDIQQQKGNI

SEQ ID NO: 129369 - protein, 36 aa, Artificial Sequence
  Description of Artificial Sequence: Synthetic polypeptide
EEEEIRTTNPVATEQYGVVSTVNQQQGNQQGNDEDD

SEQ ID NO: 129370 - protein, 36 aa, Artificial Sequence
  Description of Artificial Sequence: Synthetic polypeptide
EEEEIRTTNPVATEQYGVVSTVNQQQGNQQGNNTTD

SEQ ID NO: 129371 - protein, 36 aa, Artificial Sequence
  Description of Artificial Sequence: Synthetic polypeptide
EEEEIRTTNPVATEQYGVVSTVNQQQGNQQGTTEDE

SEQ ID NO: 129372 - protein, 30 aa, Artificial Sequence
  Description of Artificial Sequence: Synthetic polypeptide
DENEIRTTNPVATEKWGDVSEIEMNAQEDA

SEQ ID NO: 129373 - protein, 31 aa, Artificial Sequence
  Description of Artificial Sequence: Synthetic polypeptide
DENEIRTTNPVATEKWGDVSEIEMNAAEDAR

SEQ ID NO: 129374 - protein, 30 aa, Artificial Sequence
  Description of Artificial Sequence: Synthetic polypeptide
DENEIRTTNPVATEKWGDVSEIEENAANDA

SEQ ID NO: 129375 - protein, 36 aa, Artificial Sequence
  Description of Artificial Sequence: Synthetic polypeptide
EEEEIRTTNPVATEQYGVVSTVVTNQQQLQQGTEEE

SEQ ID NO: 129376 - protein, 37 aa, Artificial Sequence
  Description of Artificial Sequence: Synthetic polypeptide
EEEEIRTTNPVATEQYGVVSVVVTNLQLQNGNQNGEA

SEQ ID NO: 129377 - protein, 37 aa, Artificial Sequence
  Description of Artificial Sequence: Synthetic polypeptide
EEEEIRTTNPVATEQYGVVVTVSTNLQLQEGNQNGNE

SEQ ID NO: 129378 - protein, 35 aa, Artificial Sequence
  Description of Artificial Sequence: Synthetic polypeptide
EEEEIRTTNPVATESYGSVSEAVLEEIEARNGQQR

SEQ ID NO: 129379 - protein, 35 aa, Artificial Sequence
  Description of Artificial Sequence: Synthetic polypeptide
EEEEIRTTNPVATESYGSVSIAVLEEIHARNGFQR

SEQ ID NO: 129380 - protein, 33 aa, Artificial Sequence
  Description of Artificial Sequence: Synthetic polypeptide
EEEEIRTTNPVATESYGSVSNPVLLEHAVGFQN

SEQ ID NO: 129381 - protein, 33 aa, Artificial Sequence
  Description of Artificial Sequence: Synthetic polypeptide
DEECIRTTNPVAYEQYGCVSSTINVETGIGEGQ

SEQ ID NO: 129382 - protein, 34 aa, Artificial Sequence
  Description of Artificial Sequence: Synthetic polypeptide
DENEIRTTNPVATEIYGSVVNNGLDQLEGQTGQG

SEQ ID NO: 129383 - protein, 33 aa, Artificial Sequence
  Description of Artificial Sequence: Synthetic polypeptide
DEEEIRTTNPVATEQYGSVSEVDPAHPEVESFI

SEQ ID NO: 129384 - protein, 32 aa, Artificial Sequence
  Description of Artificial Sequence: Synthetic polypeptide
DEAEIRTTNPVAYEQWGVVSGGNLNDHPNQGS

SEQ ID NO: 129385 - protein, 34 aa, Artificial Sequence
  Description of Artificial Sequence: Synthetic polypeptide
DEEEIRTTNPVATEQYGSVSEWPVGLIETMVQTG

SEQ ID NO: 129386 - protein, 34 aa, Artificial Sequence
  Description of Artificial Sequence: Synthetic polypeptide
DEQEIATTNPVATEQYGSVSCTDALEDHTGGEYL

SEQ ID NO: 129387 - protein, 35 aa, Artificial Sequence
  Description of Artificial Sequence: Synthetic polypeptide
DEEEIRTTNPVATEQYGSVSEYPPLQTEAQSSEVE

SEQ ID NO: 129388 - protein, 30 aa, Artificial Sequence
  Description of Artificial Sequence: Synthetic polypeptide
DENEIRTTNPVATEPWGDISEIIMQAAENA

SEQ ID NO: 129389 - protein, 37 aa, Artificial Sequence
  Description of Artificial Sequence: Synthetic polypeptide
DEEEIRTTNPVATEQYGSVVSSTTPDGPNMGNGENIE

SEQ ID NO: 129390 - protein, 32 aa, Artificial Sequence
  Description of Artificial Sequence: Synthetic polypeptide
DENEIRTTNPVATEPWGSISCIDIQQQQNGNG

SEQ ID NO: 129391 - protein, 32 aa, Artificial Sequence
  Description of Artificial Sequence: Synthetic polypeptide
DENEIRTTNPVATEPWGSISCEDIQQQQNGNH

SEQ ID NO: 129392 - protein, 32 aa, Artificial Sequence
  Description of Artificial Sequence: Synthetic polypeptide
DENEIRTTNPVATEPWGSISCEDIQQQQNGNG

SEQ ID NO: 129393 - protein, 34 aa, Artificial Sequence
  Description of Artificial Sequence: Synthetic polypeptide
DEAEIRTTNPVATEHWGVVCSTDNGDEQDGDIRR

SEQ ID NO: 129394 - protein, 34 aa, Artificial Sequence
  Description of Artificial Sequence: Synthetic polypeptide
DESEIRTTNPVATECWGSVSCIEDEPQDREGENG

SEQ ID NO: 129395 - protein, 33 aa, Artificial Sequence
  Description of Artificial Sequence: Synthetic polypeptide
DENEIRTTNPVATEPWGSAVDQNLSTDRNMLRE

SEQ ID NO: 129396 - protein, 30 aa, Artificial Sequence
  Description of Artificial Sequence: Synthetic polypeptide
DENEIRTTNPVATEPWGDVSMIEQQAAEDA

SEQ ID NO: 129397 - protein, 30 aa, Artificial Sequence
  Description of Artificial Sequence: Synthetic polypeptide
DENEIRTTNPVATEPWGDVSMIEQNAAEDA

SEQ ID NO: 129398 - protein, 36 aa, Artificial Sequence
  Description of Artificial Sequence: Synthetic polypeptide
EEEEIRTTNPVATEQYGVVSTTNNQQNNQQGTNQEE

SEQ ID NO: 129399 - protein, 34 aa, Artificial Sequence
  Description of Artificial Sequence: Synthetic polypeptide
DEAEIRTTNPVATEGYGSVCFTSQMLLTRGGQAE

SEQ ID NO: 129400 - protein, 30 aa, Artificial Sequence
  Description of Artificial Sequence: Synthetic polypeptide
DENEIRTTNPVATEPWGDVSEIIMNAAGDH

SEQ ID NO: 129401 - protein, 32 aa, Artificial Sequence
  Description of Artificial Sequence: Synthetic polypeptide
DEAEIRTTNPVAYEQWGVVSGGNGNHQNGSGE

SEQ ID NO: 129402 - protein, 30 aa, Artificial Sequence
  Description of Artificial Sequence: Synthetic polypeptide
DENEIRTTNPVATEPWGDVSEIEMNQNEDA

SEQ ID NO: 129403 - protein, 36 aa, Artificial Sequence
  Description of Artificial Sequence: Synthetic polypeptide
EEEEIRTTNPVATEQYGVVSTTNQQQNQQQGTENTA

SEQ ID NO: 129404 - protein, 31 aa, Artificial Sequence
  Description of Artificial Sequence: Synthetic polypeptide
DENEIRTTNPVATEPWGDVSEEDIQNAAGDH

SEQ ID NO: 129405 - protein, 35 aa, Artificial Sequence
  Description of Artificial Sequence: Synthetic polypeptide
EEEEIRTTNPVATEQYGVVSTTNQQQNQQQGTTDT

SEQ ID NO: 129406 - protein, 30 aa, Artificial Sequence
  Description of Artificial Sequence: Synthetic polypeptide
DENEIRTTNPVATEPWGDISMIIMQAAENA

SEQ ID NO: 129407 - protein, 36 aa, Artificial Sequence
  Description of Artificial Sequence: Synthetic polypeptide
EEEEIRTTNPVATEQYGVVSTTNQQQNQQQGTTNEE

SEQ ID NO: 129408 - protein, 30 aa, Artificial Sequence
  Description of Artificial Sequence: Synthetic polypeptide
DENEIRTTNPVATEPWGDISEIEMNQNENA

SEQ ID NO: 129409 - protein, 37 aa, Artificial Sequence
  Description of Artificial Sequence: Synthetic polypeptide
DEEEIRTTNPVATEQYGSVVSSTTPAGPNMRNGMNPV

SEQ ID NO: 129410 - protein, 34 aa, Artificial Sequence
  Description of Artificial Sequence: Synthetic polypeptide
DEQEIATTNPVATEQYGSVSCTDALSEDHEGEDD

SEQ ID NO: 129411 - protein, 36 aa, Artificial Sequence
  Description of Artificial Sequence: Synthetic polypeptide
DEEEIRTTNPVATEQYGSVSETTPAGPNMRNNMNPV

SEQ ID NO: 129412 - protein, 33 aa, Artificial Sequence
  Description of Artificial Sequence: Synthetic polypeptide
CEEEISTTNPVATEQYGCVCSTELQENFFSDQA

SEQ ID NO: 129413 - protein, 33 aa, Artificial Sequence
  Description of Artificial Sequence: Synthetic polypeptide
DEECIRTTNPVAYEQYSEEVTTTGDNHQGGGSR

SEQ ID NO: 129414 - protein, 33 aa, Artificial Sequence
  Description of Artificial Sequence: Synthetic polypeptide
DEECIRTTNPVAYEQYSEEVTTTGDNHQGGGTR

SEQ ID NO: 129415 - protein, 34 aa, Artificial Sequence
  Description of Artificial Sequence: Synthetic polypeptide
DESEIRTTNPVATECWGSVSCIAEPQDREGENPG

SEQ ID NO: 129416 - protein, 35 aa, Artificial Sequence
  Description of Artificial Sequence: Synthetic polypeptide
EEETICTTNPVATEQYGSVSTVNGNQQLQGNNQSD

SEQ ID NO: 129417 - protein, 35 aa, Artificial Sequence
  Description of Artificial Sequence: Synthetic polypeptide
EEETICTTNPVATEQYGSVSTVNGNQQLQGTNQDE

SEQ ID NO: 129418 - protein, 36 aa, Artificial Sequence
  Description of Artificial Sequence: Synthetic polypeptide
EEETICTTNPVATEQYGSVSTVNNQNQLQQGNNQDD

SEQ ID NO: 129419 - protein, 35 aa, Artificial Sequence
  Description of Artificial Sequence: Synthetic polypeptide
EEETICTTNPVATEQYGSVSTVNSNQQLQGTNTTD

SEQ ID NO: 129420 - protein, 36 aa, Artificial Sequence
  Description of Artificial Sequence: Synthetic polypeptide
EEETICTTNPVATEQYGSVSTVVNDQQLQQGTNQED

SEQ ID NO: 129421 - protein, 36 aa, Artificial Sequence
  Description of Artificial Sequence: Synthetic polypeptide
EEETICTTNPVATEQYGSVSTVVNGNQLQQGTNQDE

SEQ ID NO: 129422 - protein, 33 aa, Artificial Sequence
  Description of Artificial Sequence: Synthetic polypeptide
CEEEISTTNPVATEQYGCVCSTGNPANFNSEQT

SEQ ID NO: 129423 - protein, 33 aa, Artificial Sequence
  Description of Artificial Sequence: Synthetic polypeptide
CEEEISTTNPVATEQYGCVCSTGNTANFGSEQS

SEQ ID NO: 129424 - protein, 33 aa, Artificial Sequence
  Description of Artificial Sequence: Synthetic polypeptide
CEEEISTTNPVATEQYGCVCSTNHAEGFGSEQT

SEQ ID NO: 129425 - protein, 33 aa, Artificial Sequence
  Description of Artificial Sequence: Synthetic polypeptide
DESEIRTTNPVATECWGSVSCIAEPQDEGGENG

SEQ ID NO: 129426 - protein, 31 aa, Artificial Sequence
  Description of Artificial Sequence: Synthetic polypeptide
EEETIRTTNPVATSMYGCVYATVALDQGGQG

SEQ ID NO: 129427 - protein, 34 aa, Artificial Sequence
  Description of Artificial Sequence: Synthetic polypeptide
EEGEIRTTNPVATEQYGSVSWTMPDLNQNSQEIL

SEQ ID NO: 129428 - protein, 35 aa, Artificial Sequence
  Description of Artificial Sequence: Synthetic polypeptide
DEEEIRTTNPVATEQYGSVSETNATMADIMSIQQT

SEQ ID NO: 129429 - protein, 33 aa, Artificial Sequence
  Description of Artificial Sequence: Synthetic polypeptide
DESEIRTTNPVATECWGSVSCIAEPNMRNGENG

SEQ ID NO: 129430 - protein, 36 aa, Artificial Sequence
  Description of Artificial Sequence: Synthetic polypeptide
DEEEIRTTNPVATEQYGSVSETMGNIGPPDPVEGDI

SEQ ID NO: 129431 - protein, 34 aa, Artificial Sequence
  Description of Artificial Sequence: Synthetic polypeptide
DESEIRTTNPVATECWGSVSCIAEPQDREGMNPG

SEQ ID NO: 129432 - protein, 33 aa, Artificial Sequence
  Description of Artificial Sequence: Synthetic polypeptide
DESEIRTTNPVATECWGSVSCIDEPQDREGEPI

SEQ ID NO: 129433 - protein, 34 aa, Artificial Sequence
  Description of Artificial Sequence: Synthetic polypeptide
DESEIRTTNPVATECWGSVSCIAEPQDRLGENGQ

SEQ ID NO: 129434 - protein, 33 aa, Artificial Sequence
  Description of Artificial Sequence: Synthetic polypeptide
DEECIRTTNPVAYEQYSEEVTTGPDNHQGGDSR

SEQ ID NO: 129435 - protein, 34 aa, Artificial Sequence
  Description of Artificial Sequence: Synthetic polypeptide
DESEIRTTNPVATECWGSVSCIDEPQDREGENGV

SEQ ID NO: 129436 - protein, 31 aa, Artificial Sequence
  Description of Artificial Sequence: Synthetic polypeptide
DEAEIRTTNPVAYEQWGVVTGDNGNLNGSGR

SEQ ID NO: 129437 - protein, 35 aa, Artificial Sequence
  Description of Artificial Sequence: Synthetic polypeptide
DEQEIATTNPVATEQYGSVSCTGDALEDHEGGENL

SEQ ID NO: 129438 - protein, 34 aa, Artificial Sequence
  Description of Artificial Sequence: Synthetic polypeptide
EEEEIRTTNPVAVEQYGSVSTDKHSSETPMGSRN

SEQ ID NO: 129439 - protein, 33 aa, Artificial Sequence
  Description of Artificial Sequence: Synthetic polypeptide
DESEIRTTNPVATECWGSVSCIDEPQDREGEEG

SEQ ID NO: 129440 - protein, 36 aa, Artificial Sequence
  Description of Artificial Sequence: Synthetic polypeptide
DEEEIRTTNPVATEQYGSVSETPGERAMMTIVNEYF

SEQ ID NO: 129441 - protein, 33 aa, Artificial Sequence
  Description of Artificial Sequence: Synthetic polypeptide
DEECIRTTNPVAYEQYGCVWTINVETRIGEGTQ

SEQ ID NO: 129442 - protein, 33 aa, Artificial Sequence
  Description of Artificial Sequence: Synthetic polypeptide
EEEEIRTTNPVAYEQWGYATISPNEGDQRNGSR

SEQ ID NO: 129443 - protein, 33 aa, Artificial Sequence
  Description of Artificial Sequence: Synthetic polypeptide
EEEEIRTTNPVAYEQWGYTISPNEGDQNNGNAR

SEQ ID NO: 129444 - protein, 31 aa, Artificial Sequence
  Description of Artificial Sequence: Synthetic polypeptide
EEEEISTTNPVAYEQWGCVTGGGQDQGSGNR

SEQ ID NO: 129445 - protein, 33 aa, Artificial Sequence
  Description of Artificial Sequence: Synthetic polypeptide
DESEIRTTNPVATECWGSVSCIDEPQDHEGENG

SEQ ID NO: 129446 - protein, 32 aa, Artificial Sequence
  Description of Artificial Sequence: Synthetic polypeptide
DESEIRTTNPVATECWGSVSCIDEPEDHEGNG

SEQ ID NO: 129447 - protein, 33 aa, Artificial Sequence
  Description of Artificial Sequence: Synthetic polypeptide
DEAEIRTTNPVAYEQWGVVTGGNGNQGEGNTGR

SEQ ID NO: 129448 - protein, 33 aa, Artificial Sequence
  Description of Artificial Sequence: Synthetic polypeptide
CEEEISTTNPVATEQYGCVCSTEDQNFNSDTQD

SEQ ID NO: 129449 - protein, 33 aa, Artificial Sequence
  Description of Artificial Sequence: Synthetic polypeptide
DESEIRTTNPVATECWGSVSCICEPQDREGEEL

SEQ ID NO: 129450 - protein, 34 aa, Artificial Sequence
  Description of Artificial Sequence: Synthetic polypeptide
DESEIRTTNPVATECWGSVSCIAIEPQDREGENG

SEQ ID NO: 129451 - protein, 33 aa, Artificial Sequence
  Description of Artificial Sequence: Synthetic polypeptide
CEEEISTTNPVATEQYGCVCSTEHNAGFGSEQS

SEQ ID NO: 129452 - protein, 34 aa, Artificial Sequence
  Description of Artificial Sequence: Synthetic polypeptide
EEETICTTNPVATEQYGSVSTNNNSEQLGTQGSG

SEQ ID NO: 129453 - protein, 34 aa, Artificial Sequence
  Description of Artificial Sequence: Synthetic polypeptide
DEECIRTTNPVAYEQYSEEVTTGGLQHQGGGGNR

SEQ ID NO: 129454 - protein, 32 aa, Artificial Sequence
  Description of Artificial Sequence: Synthetic polypeptide
CEEEISTTNPVATEQYGCVCSTELANFISEQT

SEQ ID NO: 129455 - protein, 33 aa, Artificial Sequence
  Description of Artificial Sequence: Synthetic polypeptide
DEQEIATTNPVATEQYGSVSATPDLEDHEVEDL

SEQ ID NO: 129456 - protein, 37 aa, Artificial Sequence
  Description of Artificial Sequence: Synthetic polypeptide
DEEEIRTTNPVATEQYGSVVSSTPPAGPNMRNGMNPV

SEQ ID NO: 129457 - protein, 34 aa, Artificial Sequence
  Description of Artificial Sequence: Synthetic polypeptide
DEEEIRTTNPVATEQYGSVSFANNEHNPVFALDT

SEQ ID NO: 129458 - protein, 35 aa, Artificial Sequence
  Description of Artificial Sequence: Synthetic polypeptide
DENEIRTTNPVATEPYGSISSTTPAGQNMRNGNPV

SEQ ID NO: 129459 - protein, 34 aa, Artificial Sequence
  Description of Artificial Sequence: Synthetic polypeptide
DEECIRTTNPVAYEQYGCAVLTINVETRIQEGNQ

SEQ ID NO: 129460 - protein, 33 aa, Artificial Sequence
  Description of Artificial Sequence: Synthetic polypeptide
DEAEIRTTNPVATEPYGISSSWVVLADTIKNRS

SEQ ID NO: 129461 - protein, 35 aa, Artificial Sequence
  Description of Artificial Sequence: Synthetic polypeptide
DENEIRTTNPVATEPYGSISSTPAGPNQRNGMNPV

SEQ ID NO: 129462 - protein, 35 aa, Artificial Sequence
  Description of Artificial Sequence: Synthetic polypeptide
DENEIRTTNPVATEPYGSISSTEDIQQMRNGMNPH

SEQ ID NO: 129463 - protein, 34 aa, Artificial Sequence
  Description of Artificial Sequence: Synthetic polypeptide
DEAEIRTTNPVAYEQWGVVCSTDEHEQSRGGNDD

SEQ ID NO: 129464 - protein, 34 aa, Artificial Sequence
  Description of Artificial Sequence: Synthetic polypeptide
EEEEIRTTNPVATEQYGSVTNTGLEAPMGAEEES

SEQ ID NO: 129465 - protein, 34 aa, Artificial Sequence
  Description of Artificial Sequence: Synthetic polypeptide
DENEIRTTNPVATEPYGSISSTEDIQQMQNGMNH

SEQ ID NO: 129466 - protein, 34 aa, Artificial Sequence
  Description of Artificial Sequence: Synthetic polypeptide
DEAEIRTTNPVATEPYGCVCFCTQMLLTRGGQNE

SEQ ID NO: 129467 - protein, 35 aa, Artificial Sequence
  Description of Artificial Sequence: Synthetic polypeptide
DEAEIRTTNPVATEPWGVVCSTDNGEQERDGDNQQ

SEQ ID NO: 129468 - protein, 34 aa, Artificial Sequence
  Description of Artificial Sequence: Synthetic polypeptide
DEAEIRTTNPVATEPWGVVCFTNEDQHHQGHNSR

SEQ ID NO: 129469 - protein, 32 aa, Artificial Sequence
  Description of Artificial Sequence: Synthetic polypeptide
DENEIRTTNPVATEPYGSISMEDIQQQQNGEL

SEQ ID NO: 129470 - protein, 36 aa, Artificial Sequence
  Description of Artificial Sequence: Synthetic polypeptide
DEEEIRTTNPVATEQYGSVVSDGFGQEGDQEEDNGF

SEQ ID NO: 129471 - protein, 33 aa, Artificial Sequence
  Description of Artificial Sequence: Synthetic polypeptide
DEECIRTTNPVAYEQYGCKSTINVQQTIFDNLQ

SEQ ID NO: 129472 - protein, 37 aa, Artificial Sequence
  Description of Artificial Sequence: Synthetic polypeptide
EEEEIRTTNPVATEQYGSVTTVVTNLNLQNGNQNGNE

SEQ ID NO: 129473 - protein, 34 aa, Artificial Sequence
  Description of Artificial Sequence: Synthetic polypeptide
DESEIRTTNPVATECWGSVSCIEEPQDREGENTD

SEQ ID NO: 129474 - protein, 33 aa, Artificial Sequence
  Description of Artificial Sequence: Synthetic polypeptide
DEECIRTTNPVAYEQYGCVCSSGEDQHFGSNQA

SEQ ID NO: 129475 - protein, 36 aa, Artificial Sequence
  Description of Artificial Sequence: Synthetic polypeptide
DEEEIRTTNPVATEQYGSVVSIENELLNTQVDPFIY

SEQ ID NO: 129476 - protein, 32 aa, Artificial Sequence
  Description of Artificial Sequence: Synthetic polypeptide
DENEIRTTNPVATEPYGEISEEDIQQQQNGNH

SEQ ID NO: 129477 - protein, 35 aa, Artificial Sequence
  Description of Artificial Sequence: Synthetic polypeptide
DENEIRTTNPVATEPYGSISSTTPAGQNQRNGNPV

SEQ ID NO: 129478 - protein, 37 aa, Artificial Sequence
  Description of Artificial Sequence: Synthetic polypeptide
EEEEIRTTNPVATEQYGSVTVVVTNLQLQAGNQNGNE

SEQ ID NO: 129479 - protein, 31 aa, Artificial Sequence
  Description of Artificial Sequence: Synthetic polypeptide
DESEIRTTNPVATECWGSVSCIEMDAAEENG

SEQ ID NO: 129480 - protein, 36 aa, Artificial Sequence
  Description of Artificial Sequence: Synthetic polypeptide
EEEEIRTTNPVATEQYGSVSTVTNQQNNQQGTTEDE

SEQ ID NO: 129481 - protein, 36 aa, Artificial Sequence
  Description of Artificial Sequence: Synthetic polypeptide
DEEEIRTTNPVATEQYGSVVQNGFNTTGTGQGEGND

SEQ ID NO: 129482 - protein, 31 aa, Artificial Sequence
  Description of Artificial Sequence: Synthetic polypeptide
DENEIRTTNPVATEPYGTASEDIQQQQNGEK

SEQ ID NO: 129483 - protein, 36 aa, Artificial Sequence
  Description of Artificial Sequence: Synthetic polypeptide
EEEEIRTTNPVATEQYGSVSTTNQQNQNLQNATETG

SEQ ID NO: 129484 - protein, 29 aa, Artificial Sequence
  Description of Artificial Sequence: Synthetic peptide
DENEIRTTNPVATEPYGTAPEDIQQQEEK

SEQ ID NO: 129485 - protein, 33 aa, Artificial Sequence
  Description of Artificial Sequence: Synthetic polypeptide
DEECIRTTNPVAYEQWGTYVYTQDQDSDRGENA

SEQ ID NO: 129486 - protein, 34 aa, Artificial Sequence
  Description of Artificial Sequence: Synthetic polypeptide
DEECIRTTNPVAYEQWGVVCFSPEDGQRQQNGNR

SEQ ID NO: 129487 - protein, 36 aa, Artificial Sequence
  Description of Artificial Sequence: Synthetic polypeptide
DENEIRTTNPVATEPYGSVSSTTPAIPNMQNGMNPV

SEQ ID NO: 129488 - protein, 33 aa, Artificial Sequence
  Description of Artificial Sequence: Synthetic polypeptide
DEECIRTTNPVAYEQWGVVCMIEDGNRQGNGNR

SEQ ID NO: 129489 - protein, 36 aa, Artificial Sequence
  Description of Artificial Sequence: Synthetic polypeptide
DENEIRTTNPVATEPYGSVSSTTPAGQNMRNGMNPV

SEQ ID NO: 129490 - protein, 34 aa, Artificial Sequence
  Description of Artificial Sequence: Synthetic polypeptide
DESEIRTTNPVATECWGSVSCIGMEPQDRGGENG

SEQ ID NO: 129491 - protein, 36 aa, Artificial Sequence
  Description of Artificial Sequence: Synthetic polypeptide
EEEEIRTTNPVATEQYGSVSTTVNNNQQLQNATEEG

SEQ ID NO: 129492 - protein, 34 aa, Artificial Sequence
  Description of Artificial Sequence: Synthetic polypeptide
DEAEIRTTNPVAYEQWGVVATGGNGNQGEGNVDR

SEQ ID NO: 129493 - protein, 35 aa, Artificial Sequence
  Description of Artificial Sequence: Synthetic polypeptide
DEEEIRTTNPVATEQYGSVVSATPHDIQQTISVEE

SEQ ID NO: 129494 - protein, 37 aa, Artificial Sequence
  Description of Artificial Sequence: Synthetic polypeptide
DEEEIRTTNPVATEQYGSVVSATPLGPSQRMQPEVDY

SEQ ID NO: 129495 - protein, 33 aa, Artificial Sequence
  Description of Artificial Sequence: Synthetic polypeptide
DESEIRTTNPVATECWGSVSCIGEPQDREGEGG

SEQ ID NO: 129496 - protein, 34 aa, Artificial Sequence
  Description of Artificial Sequence: Synthetic polypeptide
DENEIRTTNPVATEPYGSVSAMEDIQEDHNGNDL

SEQ ID NO: 129497 - protein, 33 aa, Artificial Sequence
  Description of Artificial Sequence: Synthetic polypeptide
DENEIRTTNPVATEPYGSVSAMDIQEQQEGEDH

SEQ ID NO: 129498 - protein, 36 aa, Artificial Sequence
  Description of Artificial Sequence: Synthetic polypeptide
EEEEIRTTNPVATEQYGSVSTVNNNQQQLQNATETG

SEQ ID NO: 129499 - protein, 36 aa, Artificial Sequence
  Description of Artificial Sequence: Synthetic polypeptide
EEEEIRTTNPVATEQYGSVSTVNQQAGTEAGVTTDE

SEQ ID NO: 129500 - protein, 34 aa, Artificial Sequence
  Description of Artificial Sequence: Synthetic polypeptide
DEECIRTTNPVAYEQWGVVRCTDEDGQRQGNGNR

SEQ ID NO: 129501 - protein, 36 aa, Artificial Sequence
  Description of Artificial Sequence: Synthetic polypeptide
DEEEIRTTNPVATEQYGSVVSSNPNVLQPNMIEPTQ

SEQ ID NO: 129502 - protein, 33 aa, Artificial Sequence
  Description of Artificial Sequence: Synthetic polypeptide
DEQEIATTNPVATEQYGSVSAVDGLEDLEGEDL

SEQ ID NO: 129503 - protein, 32 aa, Artificial Sequence
  Description of Artificial Sequence: Synthetic polypeptide
DENEIRTTNPVATEPYGDVSMEDIQQQHNENH

SEQ ID NO: 129504 - protein, 31 aa, Artificial Sequence
  Description of Artificial Sequence: Synthetic polypeptide
DENEIRTTNPVATEPWGTVSEDEQMQQAENA

SEQ ID NO: 129505 - protein, 33 aa, Artificial Sequence
  Description of Artificial Sequence: Synthetic polypeptide
DENEIRTTNPVATEPWGTVSCINEQQQQNGENH

SEQ ID NO: 129506 - protein, 37 aa, Artificial Sequence
  Description of Artificial Sequence: Synthetic polypeptide
EEEEIRTTNPVATEQYGVVASTNLQQSATEQGTNQDD

SEQ ID NO: 129507 - protein, 31 aa, Artificial Sequence
  Description of Artificial Sequence: Synthetic polypeptide
DENEIRTTNPVATEPWGTISMIIQQNQNGNH

SEQ ID NO: 129508 - protein, 30 aa, Artificial Sequence
  Description of Artificial Sequence: Synthetic polypeptide
DENEIRTTNPVATEPWGTISMIIMQQAENH

SEQ ID NO: 129509 - protein, 30 aa, Artificial Sequence
  Description of Artificial Sequence: Synthetic polypeptide
DENEIRTTNPVATEPWGTISMIIMQQAENA

SEQ ID NO: 129510 - protein, 30 aa, Artificial Sequence
  Description of Artificial Sequence: Synthetic polypeptide
DENEIRTTNPVATEPWGTISMIIMQAAENA

SEQ ID NO: 129511 - protein, 32 aa, Artificial Sequence
  Description of Artificial Sequence: Synthetic polypeptide
DENEIRTTNPVATEPWGTISMENIPQQQNGNH

SEQ ID NO: 129512 - protein, 36 aa, Artificial Sequence
  Description of Artificial Sequence: Synthetic polypeptide
EEEEIRTTNPVATEQYGVVSTELQAGTEAGGTNTDQ

SEQ ID NO: 129513 - protein, 36 aa, Artificial Sequence
  Description of Artificial Sequence: Synthetic polypeptide
EEEEIRTTNPVATEQYGVVSTELQAGTEAGSTNTVD

SEQ ID NO: 129514 - protein, 33 aa, Artificial Sequence
  Description of Artificial Sequence: Synthetic polypeptide
DEECIRTTNPVAYEQYGCVCSWGEHQYFGSNQQ

SEQ ID NO: 129515 - protein, 32 aa, Artificial Sequence
  Description of Artificial Sequence: Synthetic polypeptide
DENEIRTTNPVATEPWGTISMEDIQQQREGNH

SEQ ID NO: 129516 - protein, 37 aa, Artificial Sequence
  Description of Artificial Sequence: Synthetic polypeptide
EEEEIRTTNPVATEQYGVVSTNLQTGGTEAGSTNTDD

SEQ ID NO: 129517 - protein, 36 aa, Artificial Sequence
  Description of Artificial Sequence: Synthetic polypeptide
EEEEIRTTNPVATEQYGVVSTSLQAGTEAGNTTTDD

SEQ ID NO: 129518 - protein, 32 aa, Artificial Sequence
  Description of Artificial Sequence: Synthetic polypeptide
DENEIRTTNPVATEPWGTISCEDIQQQREGNH

SEQ ID NO: 129519 - protein, 32 aa, Artificial Sequence
  Description of Artificial Sequence: Synthetic polypeptide
DENEIRTTNPVATEPWGTISCEDEQQQREGNH

SEQ ID NO: 129520 - protein, 36 aa, Artificial Sequence
  Description of Artificial Sequence: Synthetic polypeptide
EEEEIRTTNPVATEQYGVVSTSLQAGTEAGSTNTDE

SEQ ID NO: 129521 - protein, 33 aa, Artificial Sequence
  Description of Artificial Sequence: Synthetic polypeptide
DEQEIATTNPVATEQYGSVSAYDLEDHEGEEDL

SEQ ID NO: 129522 - protein, 33 aa, Artificial Sequence
  Description of Artificial Sequence: Synthetic polypeptide
DENEIRTTNPVATEPWGSVSMIDIQQDQNGENG

SEQ ID NO: 129523 - protein, 36 aa, Artificial Sequence
  Description of Artificial Sequence: Synthetic polypeptide
DEEEIRTTNPVATEQYGSVVSPTVGPLLDRESVAGL

SEQ ID NO: 129524 - protein, 32 aa, Artificial Sequence
  Description of Artificial Sequence: Synthetic polypeptide
DENEIRTTNPVATEPYGDVSMEDIQQQQNENH

SEQ ID NO: 129525 - protein, 32 aa, Artificial Sequence
  Description of Artificial Sequence: Synthetic polypeptide
DEAEIRTTNPVAYEQWGVVSGDNGNHQNGMGS

SEQ ID NO: 129526 - protein, 32 aa, Artificial Sequence
  Description of Artificial Sequence: Synthetic polypeptide
DEECIRTTNPVAYEQYGCVCSWGEDQYFNSNQ

SEQ ID NO: 129527 - protein, 30 aa, Artificial Sequence
  Description of Artificial Sequence: Synthetic polypeptide
DENEIRTTNPVATEPYGDISMIIMQQNEDA

SEQ ID NO: 129528 - protein, 35 aa, Artificial Sequence
  Description of Artificial Sequence: Synthetic polypeptide
DEAEIRTTNPVATENYGSVCSNWNDGQDRQGDTEE

SEQ ID NO: 129529 - protein, 33 aa, Artificial Sequence
  Description of Artificial Sequence: Synthetic polypeptide
DEQEIATTNPVATEQYGSVSAVDLEDHEGDEQL

SEQ ID NO: 129530 - protein, 34 aa, Artificial Sequence
  Description of Artificial Sequence: Synthetic polypeptide
DEECIRTTNPVAYEQYGCVCSTGNDNQYFNSNQS

SEQ ID NO: 129531 - protein, 32 aa, Artificial Sequence
  Description of Artificial Sequence: Synthetic polypeptide
DENEIRTTNPVATEPYGDISMEDIQQQQNGNH

SEQ ID NO: 129532 - protein, 33 aa, Artificial Sequence
  Description of Artificial Sequence: Synthetic polypeptide
DESEIRTTNPVATECWGSVSCIEEPNDRIGENQ

SEQ ID NO: 129533 - protein, 32 aa, Artificial Sequence
  Description of Artificial Sequence: Synthetic polypeptide
DEQEIATTNPVATEQYGSVSAVDLEDHEYEDL

SEQ ID NO: 129534 - protein, 33 aa, Artificial Sequence
  Description of Artificial Sequence: Synthetic polypeptide
DEQEIATTNPVATEQYGSVSAVDLEDIEGDEDL

SEQ ID NO: 129535 - protein, 33 aa, Artificial Sequence
  Description of Artificial Sequence: Synthetic polypeptide
DESEIRTTNPVATECWGSVSCIEEPHSREGENG

SEQ ID NO: 129536 - protein, 37 aa, Artificial Sequence
  Description of Artificial Sequence: Synthetic polypeptide
EEEEIRTTNPVATEQYGSVVTSTALQAGTEAGTNTDD

SEQ ID NO: 129537 - protein, 33 aa, Artificial Sequence
  Description of Artificial Sequence: Synthetic polypeptide
DEQEIATTNPVATEQYGSVSAWDLEDHEGEEDL

SEQ ID NO: 129538 - protein, 35 aa, Artificial Sequence
  Description of Artificial Sequence: Synthetic polypeptide
DEEEIRTTNPVATEQYGSVSFMTSAEPVIEFENNL

SEQ ID NO: 129539 - protein, 37 aa, Artificial Sequence
  Description of Artificial Sequence: Synthetic polypeptide
EEEEIRTTNPVATEQYGSVVVTVNLQQGSEQGTNQDD

SEQ ID NO: 129540 - protein, 33 aa, Artificial Sequence
  Description of Artificial Sequence: Synthetic polypeptide
DEAEIRTTNPVAYEQWGVVSGDNGNGQNDGSGR

SEQ ID NO: 129541 - protein, 32 aa, Artificial Sequence
  Description of Artificial Sequence: Synthetic polypeptide
DENEIRTTNPVATEPYGAISNMEDIQEQNGNI

SEQ ID NO: 129542 - protein, 33 aa, Artificial Sequence
  Description of Artificial Sequence: Synthetic polypeptide
DEQEIATTNPVATEQYGSVSAWDMLEDHEGEDL

SEQ ID NO: 129543 - protein, 31 aa, Artificial Sequence
  Description of Artificial Sequence: Synthetic polypeptide
DENEIRTTNPVATEPYGAIAMEDIQEQNGNH

SEQ ID NO: 129544 - protein, 34 aa, Artificial Sequence
  Description of Artificial Sequence: Synthetic polypeptide
DEECIRTTNPVAYEQYGCVCSTMNHQNFGSQTQS

SEQ ID NO: 129545 - protein, 33 aa, Artificial Sequence
  Description of Artificial Sequence: Synthetic polypeptide
DENEIRTTNPVATEPWGTVSMIDEQQDREGENH

SEQ ID NO: 129546 - protein, 37 aa, Artificial Sequence
  Description of Artificial Sequence: Synthetic polypeptide
EEEEIRTTNPVATEQYGSVYSEAPNLEIQVMGQGQND

SEQ ID NO: 129547 - protein, 31 aa, Artificial Sequence
  Description of Artificial Sequence: Synthetic polypeptide
DENEIRTTNPVATEQWGCVSEMMMNIAEDEA

SEQ ID NO: 129548 - protein, 34 aa, Artificial Sequence
  Description of Artificial Sequence: Synthetic polypeptide
DEQEIATTNPVATEQYGSVSATPDLEDHEGEDLH

SEQ ID NO: 129549 - protein, 31 aa, Artificial Sequence
  Description of Artificial Sequence: Synthetic polypeptide
DENEIRTTNPVATEQWGCVSEVEENTAEDEI

SEQ ID NO: 129550 - protein, 36 aa, Artificial Sequence
  Description of Artificial Sequence: Synthetic polypeptide
DTEEIRTTNPVATEQYGVVSTVTNTTNLQQGTTEEE

SEQ ID NO: 129551 - protein, 36 aa, Artificial Sequence
  Description of Artificial Sequence: Synthetic polypeptide
DTEEIRTTNPVATEQYGVVSTVVNLQQGTDEEEETQ

SEQ ID NO: 129552 - protein, 36 aa, Artificial Sequence
  Description of Artificial Sequence: Synthetic polypeptide
DTEEIRTTNPVATEQYGVVSTVVNLQQNNNNNDTQD

SEQ ID NO: 129553 - protein, 33 aa, Artificial Sequence
  Description of Artificial Sequence: Synthetic polypeptide
DEDEIATTNPCAYEQWGSVSTNLNQGDTGQDDV

SEQ ID NO: 129554 - protein, 36 aa, Artificial Sequence
  Description of Artificial Sequence: Synthetic polypeptide
DTEEIRTTNPVATEQYGVVSTVVNNQQGNEEEETED

SEQ ID NO: 129555 - protein, 30 aa, Artificial Sequence
  Description of Artificial Sequence: Synthetic polypeptide
DENEIRTTNPVATEQWGDVSCIEMNAATDA

SEQ ID NO: 129556 - protein, 36 aa, Artificial Sequence
  Description of Artificial Sequence: Synthetic polypeptide
DTEEIRTTNPVATEQYGVVSTVVNNQQGNIATEDED

SEQ ID NO: 129557 - protein, 30 aa, Artificial Sequence
  Description of Artificial Sequence: Synthetic polypeptide
DENEIRTTNPVATEQWGDVSCIEMNAAEDG

SEQ ID NO: 129558 - protein, 30 aa, Artificial Sequence
  Description of Artificial Sequence: Synthetic polypeptide
DENEIRTTNPVATEQWGDVSCIEMNAAEDA

SEQ ID NO: 129559 - protein, 36 aa, Artificial Sequence
  Description of Artificial Sequence: Synthetic polypeptide
DTEEIRTTNPVATEQYGVVSTVVNNQQGNNNEEQED

SEQ ID NO: 129560 - protein, 33 aa, Artificial Sequence
  Description of Artificial Sequence: Synthetic polypeptide
DEDEIACTNPVAYEQYGSVATNLQDGAPMEGTP

SEQ ID NO: 129561 - protein, 36 aa, Artificial Sequence
  Description of Artificial Sequence: Synthetic polypeptide
DTEEIRTTNPVATEQYGVVSTVVNNQQGNNNQEEED

SEQ ID NO: 129562 - protein, 36 aa, Artificial Sequence
  Description of Artificial Sequence: Synthetic polypeptide
DTEEIRTTNPVATEQYGVVSTVVNNQQGTNEEEDED

SEQ ID NO: 129563 - protein, 30 aa, Artificial Sequence
  Description of Artificial Sequence: Synthetic polypeptide
DENEIRTTNPVATEQWGDVSCDEANAAEDA

SEQ ID NO: 129564 - protein, 30 aa, Artificial Sequence
  Description of Artificial Sequence: Synthetic polypeptide
DENEIRTTNPVATEQWGDVSAVEMNAAEDA

SEQ ID NO: 129565 - protein, 36 aa, Artificial Sequence
  Description of Artificial Sequence: Synthetic polypeptide
DTEEIRTTNPVATEQYGVVSTVVNQQQGNNEEEEED

SEQ ID NO: 129566 - protein, 36 aa, Artificial Sequence
  Description of Artificial Sequence: Synthetic polypeptide
DTEEIRTTNPVATEQYGVVSTVVNTQQGNNEEEETD

SEQ ID NO: 129567 - protein, 36 aa, Artificial Sequence
  Description of Artificial Sequence: Synthetic polypeptide
DTEEIRTTNPVATEQYGVVSTVVSTNLQQNEEDTED

SEQ ID NO: 129568 - protein, 37 aa, Artificial Sequence
  Description of Artificial Sequence: Synthetic polypeptide
DTEEIRTTNPVATEQYGVVSTVVTNLQAGNNQEEEDE

SEQ ID NO: 129569 - protein, 34 aa, Artificial Sequence
  Description of Artificial Sequence: Synthetic polypeptide
DEDEIATTNPCAYEQWGSVSTNLNQGDTGQNKED

SEQ ID NO: 129570 - protein, 37 aa, Artificial Sequence
  Description of Artificial Sequence: Synthetic polypeptide
DTEEIRTTNPVATEQYGVVSTVVTNLQAGNQEGNNNE

SEQ ID NO: 129571 - protein, 32 aa, Artificial Sequence
  Description of Artificial Sequence: Synthetic polypeptide
DENEIRTTNPVATEQWGDVSCINEPMDAAGDG

SEQ ID NO: 129572 - protein, 36 aa, Artificial Sequence
  Description of Artificial Sequence: Synthetic polypeptide
DTEEIRTTNPVATEQYGVVSTVTNQQQGNNEEEEDT

SEQ ID NO: 129573 - protein, 30 aa, Artificial Sequence
  Description of Artificial Sequence: Synthetic polypeptide
DENEIRTTNPVATEQWGDVSEDEANAAEDA

SEQ ID NO: 129574 - protein, 37 aa, Artificial Sequence
  Description of Artificial Sequence: Synthetic polypeptide
DTEEIRTTNPVATEQYGVVSTVTNLQQGNNNDEDEQD

SEQ ID NO: 129575 - protein, 37 aa, Artificial Sequence
  Description of Artificial Sequence: Synthetic polypeptide
DTEEIRTTNPVATEQYGVVSTVTNLQQGNNNNNDTQD

SEQ ID NO: 129576 - protein, 31 aa, Artificial Sequence
  Description of Artificial Sequence: Synthetic polypeptide
DENEIRTTNPVATEQWGDVSECEMNAAEVAE

SEQ ID NO: 129577 - protein, 30 aa, Artificial Sequence
  Description of Artificial Sequence: Synthetic polypeptide
DENEIRTTNPVATEQWGDVSECEMNAAEDA

SEQ ID NO: 129578 - protein, 37 aa, Artificial Sequence
  Description of Artificial Sequence: Synthetic polypeptide
DTEEIRTTNPVATEQYGVVSTVTNLQQGNQEEEETDD

SEQ ID NO: 129579 - protein, 30 aa, Artificial Sequence
  Description of Artificial Sequence: Synthetic polypeptide
DENEIRTTNPVATEQWGDVSEAEMNAAEDA

SEQ ID NO: 129580 - protein, 30 aa, Artificial Sequence
  Description of Artificial Sequence: Synthetic polypeptide
DENEIRTTNPVATEQWGDVSDIRMNAAEDA

SEQ ID NO: 129581 - protein, 30 aa, Artificial Sequence
  Description of Artificial Sequence: Synthetic polypeptide
DENEIRTTNPVATEQWGDVSDIEMNKAEDA

SEQ ID NO: 129582 - protein, 30 aa, Artificial Sequence
  Description of Artificial Sequence: Synthetic polypeptide
DENEIRTTNPVATEQWGDVSDIEMNAAEDQ

SEQ ID NO: 129583 - protein, 30 aa, Artificial Sequence
  Description of Artificial Sequence: Synthetic polypeptide
DENEIRTTNPVATEQWGDVSDIEMNAAEDA

SEQ ID NO: 129584 - protein, 30 aa, Artificial Sequence
  Description of Artificial Sequence: Synthetic polypeptide
DENEIRTTNPVATEQWGDVSDIEMNAACDA

SEQ ID NO: 129585 - protein, 31 aa, Artificial Sequence
  Description of Artificial Sequence: Synthetic polypeptide
DENEIRTTNPVATEQWGDVSDEIEMNAANDA

SEQ ID NO: 129586 - protein, 37 aa, Artificial Sequence
  Description of Artificial Sequence: Synthetic polypeptide
DTEEIRTTNPVATEQYGVVSTVTNLQQGVNNNTTTDD

SEQ ID NO: 129587 - protein, 33 aa, Artificial Sequence
  Description of Artificial Sequence: Synthetic polypeptide
DEAEIRTTNPVAYEQWGSVSGAGNGNSTGEGNA

SEQ ID NO: 129588 - protein, 31 aa, Artificial Sequence
  Description of Artificial Sequence: Synthetic polypeptide
DENEIRTTNPVATEQWGDVSCNEPMNAAEDA

SEQ ID NO: 129589 - protein, 36 aa, Artificial Sequence
  Description of Artificial Sequence: Synthetic polypeptide
DEEEIRTTNPVATEQYGSVVGTPNMSDQDEFQNGGT

SEQ ID NO: 129590 - protein, 36 aa, Artificial Sequence
  Description of Artificial Sequence: Synthetic polypeptide
DEEEIRTTNPVATEQYGSVVGTVNMSQDEFFDEGGT

SEQ ID NO: 129591 - protein, 34 aa, Artificial Sequence
  Description of Artificial Sequence: Synthetic polypeptide
DEEEIRTTNPVATEQYGSVVHTTEDHNDEGEEQV

SEQ ID NO: 129592 - protein, 32 aa, Artificial Sequence
  Description of Artificial Sequence: Synthetic polypeptide
DENEIRTTNPVATEQWGDVSCINEPMDAEGDG

SEQ ID NO: 129593 - protein, 30 aa, Artificial Sequence
  Description of Artificial Sequence: Synthetic polypeptide
DENEIRTTNPVATEQWGDVSEDEANAFEDA

SEQ ID NO: 129594 - protein, 37 aa, Artificial Sequence
  Description of Artificial Sequence: Synthetic polypeptide
DTEEIRTTNPVATEQYGVVSTVVTNLQAGNQQGTNTD

SEQ ID NO: 129595 - protein, 30 aa, Artificial Sequence
  Description of Artificial Sequence: Synthetic polypeptide
DENEIRTTNPVATEQWGDVSAIHMNPAEDA

SEQ ID NO: 129596 - protein, 36 aa, Artificial Sequence
  Description of Artificial Sequence: Synthetic polypeptide
DTEEIRTTNPVATTQYGSVATQSGSTNNQQGNNEDT

SEQ ID NO: 129597 - protein, 36 aa, Artificial Sequence
  Description of Artificial Sequence: Synthetic polypeptide
DTEEIRTTNPVATTQYGSVATQSGTNNNQQGNQDDE

SEQ ID NO: 129598 - protein, 32 aa, Artificial Sequence
  Description of Artificial Sequence: Synthetic polypeptide
DENEIRTTNPVATEQWGDVPSEIEMNAAEDNA

SEQ ID NO: 129599 - protein, 35 aa, Artificial Sequence
  Description of Artificial Sequence: Synthetic polypeptide
DTEEIRTTNPVATTQYGSVATQSGTNQNNNGNNDT

SEQ ID NO: 129600 - protein, 31 aa, Artificial Sequence
  Description of Artificial Sequence: Synthetic polypeptide
DENEIRTTNPVATEQWGDVPEIEMNAAEGDA

SEQ ID NO: 129601 - protein, 29 aa, Artificial Sequence
  Description of Artificial Sequence: Synthetic peptide
DENEIRTTNPVATEQWGDVPEIEMHAEDK

SEQ ID NO: 129602 - protein, 29 aa, Artificial Sequence
  Description of Artificial Sequence: Synthetic peptide
DENEIRTTNPVATEQWGDVPEIEMHAEDA

SEQ ID NO: 129603 - protein, 34 aa, Artificial Sequence
  Description of Artificial Sequence: Synthetic polypeptide
DTEEIRTTNPVATTQYGSVSTQSGTNQNNNNTDE

SEQ ID NO: 129604 - protein, 34 aa, Artificial Sequence
  Description of Artificial Sequence: Synthetic polypeptide
DTEEIRTTNPVATTQYGSVSTQSGTNQNNTNNDT

SEQ ID NO: 129605 - protein, 34 aa, Artificial Sequence
  Description of Artificial Sequence: Synthetic polypeptide
DTEEIRTTNPVATTQYGSVSTQSGTTTENGNNDE

SEQ ID NO: 129606 - protein, 34 aa, Artificial Sequence
  Description of Artificial Sequence: Synthetic polypeptide
DEECIRTTNPVATEQYGCVCSCTEHNQYFGSDQS

SEQ ID NO: 129607 - protein, 30 aa, Artificial Sequence
  Description of Artificial Sequence: Synthetic polypeptide
DENEIRTTNPVATEQWGDVNAISMNSAEDA

SEQ ID NO: 129608 - protein, 34 aa, Artificial Sequence
  Description of Artificial Sequence: Synthetic polypeptide
DEECIRTTNPVATEQYGCVCSDTELNQNFSSEQS

SEQ ID NO: 129609 - protein, 36 aa, Artificial Sequence
  Description of Artificial Sequence: Synthetic polypeptide
DEEEIRTTNPVATEQYGSVSIPVTTNPEVQILSLQA

SEQ ID NO: 129610 - protein, 34 aa, Artificial Sequence
  Description of Artificial Sequence: Synthetic polypeptide
DEECIRTTNPVATEQYGCVCSMTEPHQNFGSEQS

SEQ ID NO: 129611 - protein, 31 aa, Artificial Sequence
  Description of Artificial Sequence: Synthetic polypeptide
AEMEIASVNPVCTEQYGVVCSDNLQSFGSNQ

SEQ ID NO: 129612 - protein, 30 aa, Artificial Sequence
  Description of Artificial Sequence: Synthetic polypeptide
AEMEIACTNPVATEQYGTASTGPVEFEGGR

SEQ ID NO: 129613 - protein, 34 aa, Artificial Sequence
  Description of Artificial Sequence: Synthetic polypeptide
DEECIRTTNPVATEQYGCVCSNWEENANFGSNQS

SEQ ID NO: 129614 - protein, 31 aa, Artificial Sequence
  Description of Artificial Sequence: Synthetic polypeptide
DENEIRTTNPVATEQWGDVKSEIEMNLAEDA

SEQ ID NO: 129615 - protein, 31 aa, Artificial Sequence
  Description of Artificial Sequence: Synthetic polypeptide
DENEIRTTNPVATEQWGDVQEVEMNANEGDA

SEQ ID NO: 129616 - protein, 31 aa, Artificial Sequence
  Description of Artificial Sequence: Synthetic polypeptide
DENEIRTTNPVATEQWGDVSAILEMNAAEDA

SEQ ID NO: 129617 - protein, 34 aa, Artificial Sequence
  Description of Artificial Sequence: Synthetic polypeptide
DTEEIRTTNPVATTQYGSVATEAGTNQNGNNNDE

SEQ ID NO: 129618 - protein, 37 aa, Artificial Sequence
  Description of Artificial Sequence: Synthetic polypeptide
DTEEIRTTNPVATEQYGVVSVTVVTNLQQGTENQGTE

SEQ ID NO: 129619 - protein, 34 aa, Artificial Sequence
  Description of Artificial Sequence: Synthetic polypeptide
DEEEIRTTNPVATEQYGSVVLLPNQHDERDQVID

SEQ ID NO: 129620 - protein, 30 aa, Artificial Sequence
  Description of Artificial Sequence: Synthetic polypeptide
DENEIRTTNPVATEQWGDVSAIEMNASEDA

SEQ ID NO: 129621 - protein, 30 aa, Artificial Sequence
  Description of Artificial Sequence: Synthetic polypeptide
DENEIRTTNPVATEQWGDVSAIEMNAAPDA

SEQ ID NO: 129622 - protein, 31 aa, Artificial Sequence
  Description of Artificial Sequence: Synthetic polypeptide
DENEIRTTNPVATEQWGDVSAIEMNAAEDDA

SEQ ID NO: 129623 - protein, 30 aa, Artificial Sequence
  Description of Artificial Sequence: Synthetic polypeptide
DENEIRTTNPVATEQWGDVSAIEMNAAEDA

SEQ ID NO: 129624 - protein, 30 aa, Artificial Sequence
  Description of Artificial Sequence: Synthetic polypeptide
DENEIRTTNPVATEQWGDVSAIEMNAADDA

SEQ ID NO: 129625 - protein, 30 aa, Artificial Sequence
  Description of Artificial Sequence: Synthetic polypeptide
DENEIRTTNPVATEQWGDVSAGEMNAAEDA

SEQ ID NO: 129626 - protein, 32 aa, Artificial Sequence
  Description of Artificial Sequence: Synthetic polypeptide
DEDEIACTNPVAYEQYGSVATNLPTANPPGEN

SEQ ID NO: 129627 - protein, 31 aa, Artificial Sequence
  Description of Artificial Sequence: Synthetic polypeptide
DENEIRTTNPVATEQWGDVSAETIQNAVEDA

SEQ ID NO: 129628 - protein, 31 aa, Artificial Sequence
  Description of Artificial Sequence: Synthetic polypeptide
DEDEIACTNPVAYEQYGSVATNGTAENPNNK

SEQ ID NO: 129629 - protein, 37 aa, Artificial Sequence
  Description of Artificial Sequence: Synthetic polypeptide
DTEEIRTTNPVATEQYGVVSTVVTNLQAGTNQEDEED

SEQ ID NO: 129630 - protein, 36 aa, Artificial Sequence
  Description of Artificial Sequence: Synthetic polypeptide
DTEEIRTTNPVATEQYGVVSTVVTNLQGNDEEEETD

SEQ ID NO: 129631 - protein, 37 aa, Artificial Sequence
  Description of Artificial Sequence: Synthetic polypeptide
DTEEIRTTNPVATEQYGVVSTVVTNLQQGNQQGTNEE

SEQ ID NO: 129632 - protein, 36 aa, Artificial Sequence
  Description of Artificial Sequence: Synthetic polypeptide
DEAEIRTTNPVATEQWGHSNVSYTDNYLQHRPESAF

SEQ ID NO: 129633 - protein, 31 aa, Artificial Sequence
  Description of Artificial Sequence: Synthetic polypeptide
DENEIRTTNPVATEQWGDVSAEGEVEFAGDD

SEQ ID NO: 129634 - protein, 37 aa, Artificial Sequence
  Description of Artificial Sequence: Synthetic polypeptide
DTEEIRTTNPVATEQYGVVSVTTNLQQGNTEQGTNQE

SEQ ID NO: 129635 - protein, 36 aa, Artificial Sequence
  Description of Artificial Sequence: Synthetic polypeptide
DTEEIRTTNPVATEQYGVVSVTVTNLQQQNNQEEED

SEQ ID NO: 129636 - protein, 36 aa, Artificial Sequence
  Description of Artificial Sequence: Synthetic polypeptide
DTEEIRTTNPVATEQYGVVSVTVTNNQQQGNNQDED

SEQ ID NO: 129637 - protein, 36 aa, Artificial Sequence
  Description of Artificial Sequence: Synthetic polypeptide
DTEEIRTTNPVATEQYGVVSVTVTNQQQGNQEDEED

SEQ ID NO: 129638 - protein, 36 aa, Artificial Sequence
  Description of Artificial Sequence: Synthetic polypeptide
DTEEIRTTNPVATEQYGVVSVTVVTNLQQNTETGTE

SEQ ID NO: 129639 - protein, 34 aa, Artificial Sequence
  Description of Artificial Sequence: Synthetic polypeptide
DTEEIRYTNPVATEQYGECKVISTNLENDSTQRE

SEQ ID NO: 129640 - protein, 31 aa, Artificial Sequence
  Description of Artificial Sequence: Synthetic polypeptide
DENEIRTTNPVATEQWGDVSEDEDMNAANDA

SEQ ID NO: 129641 - protein, 30 aa, Artificial Sequence
  Description of Artificial Sequence: Synthetic polypeptide
DENEIRTTNPVATEQWGDVSEDEMNAAEDA

SEQ ID NO: 129642 - protein, 31 aa, Artificial Sequence
  Description of Artificial Sequence: Synthetic polypeptide
DENEIRTTNPVATEQWGDVSEICMNAAEDHA

SEQ ID NO: 129643 - protein, 30 aa, Artificial Sequence
  Description of Artificial Sequence: Synthetic polypeptide
DENEIRTTNPVATEQWGDVSEICMNAAEDA

SEQ ID NO: 129644 - protein, 37 aa, Artificial Sequence
  Description of Artificial Sequence: Synthetic polypeptide
DTEEIRTTNPVATEQYGVVSTVNQLQNGNEQGNNNVD

SEQ ID NO: 129645 - protein, 31 aa, Artificial Sequence
  Description of Artificial Sequence: Synthetic polypeptide
DENEIRTTNPVATEQWGDVSEIAQMNAAEDA

SEQ ID NO: 129646 - protein, 30 aa, Artificial Sequence
  Description of Artificial Sequence: Synthetic polypeptide
DENEIRTTNPVATEQWGDVSEIAMNALEDA

SEQ ID NO: 129647 - protein, 30 aa, Artificial Sequence
  Description of Artificial Sequence: Synthetic polypeptide
DENEIRTTNPVATEQWGDVSEIAMNAAEDK

SEQ ID NO: 129648 - protein, 31 aa, Artificial Sequence
  Description of Artificial Sequence: Synthetic polypeptide
DENEIRTTNPVATEQWGDVSEIAMNAAEDHA

SEQ ID NO: 129649 - protein, 30 aa, Artificial Sequence
  Description of Artificial Sequence: Synthetic polypeptide
DENEIRTTNPVATEQWGDVSEIAMNAAEDA

SEQ ID NO: 129650 - protein, 36 aa, Artificial Sequence
  Description of Artificial Sequence: Synthetic polypeptide
DTEEIRTTNPVATEQYGVVSTVNQQAGNNNNNDTQD

SEQ ID NO: 129651 - protein, 36 aa, Artificial Sequence
  Description of Artificial Sequence: Synthetic polypeptide
DTEEIRTTNPVATEQYGVVSTVNQQQGNNNQVDETD

SEQ ID NO: 129652 - protein, 36 aa, Artificial Sequence
  Description of Artificial Sequence: Synthetic polypeptide
DTEEIRTTNPVATEQYGVVSTVNQQQGNQQGNQEEE

SEQ ID NO: 129653 - protein, 36 aa, Artificial Sequence
  Description of Artificial Sequence: Synthetic polypeptide
DTEEIRTTNPVATEQYGVVSTVNQQQNTEQGSTNDQ

SEQ ID NO: 129654 - protein, 32 aa, Artificial Sequence
  Description of Artificial Sequence: Synthetic polypeptide
DENEIRTTNPVATEQWGDVSEHHSMNAAEGDA

SEQ ID NO: 129655 - protein, 30 aa, Artificial Sequence
  Description of Artificial Sequence: Synthetic polypeptide
DENEIRTTNPVATEQWGDVSEHEMNAAVDA

SEQ ID NO: 129656 - protein, 31 aa, Artificial Sequence
  Description of Artificial Sequence: Synthetic polypeptide
DENEIRTTNPVATEQWGDVSEHEMNAAEDWA

SEQ ID NO: 129657 - protein, 30 aa, Artificial Sequence
  Description of Artificial Sequence: Synthetic polypeptide
DENEIRTTNPVATEQWGDVSEHEMNAAEDI

SEQ ID NO: 129658 - protein, 30 aa, Artificial Sequence
  Description of Artificial Sequence: Synthetic polypeptide
DENEIRTTNPVATEQWGDVSEHEMNAAEDA

SEQ ID NO: 129659 - protein, 31 aa, Artificial Sequence
  Description of Artificial Sequence: Synthetic polypeptide
DENEIRTTNPVATEQWGDVSEGEVMNFAGDD

SEQ ID NO: 129660 - protein, 30 aa, Artificial Sequence
  Description of Artificial Sequence: Synthetic polypeptide
DENEIRTTNPVATEQWGDVSEGEVMFAEDA

SEQ ID NO: 129661 - protein, 37 aa, Artificial Sequence
  Description of Artificial Sequence: Synthetic polypeptide
DEEEIRTTNPVATEQYGSVVGSGQNDEEQDGEGQNNE

SEQ ID NO: 129662 - protein, 30 aa, Artificial Sequence
  Description of Artificial Sequence: Synthetic polypeptide
DENEIRTTNPVATEQWGDVSEGEVMAAEDA

SEQ ID NO: 129663 - protein, 37 aa, Artificial Sequence
  Description of Artificial Sequence: Synthetic polypeptide
DEEEIRTTNPVATEQYGSVVGSGQNDEEQDGEGNNQV

SEQ ID NO: 129664 - protein, 33 aa, Artificial Sequence
  Description of Artificial Sequence: Synthetic polypeptide
DEAEIRTTNPVAYEQWGSVCYNELQDANHDNEG

SEQ ID NO: 129665 - protein, 36 aa, Artificial Sequence
  Description of Artificial Sequence: Synthetic polypeptide
DTEEIRTTNPVATEQYGVVSTVNLQQQNNNNNQTTE

SEQ ID NO: 129666 - protein, 31 aa, Artificial Sequence
  Description of Artificial Sequence: Synthetic polypeptide
DENEIRTTNPVATEQWGDVSEIEDRNAAEDA

SEQ ID NO: 129667 - protein, 30 aa, Artificial Sequence
  Description of Artificial Sequence: Synthetic polypeptide
DENEIRTTNPVATEQWGDVSEIEDNAAEHA

SEQ ID NO: 129668 - protein, 31 aa, Artificial Sequence
  Description of Artificial Sequence: Synthetic polypeptide
DENEIRTTNPVATEQWGDVSEIEDNAAEEDA

SEQ ID NO: 129669 - protein, 30 aa, Artificial Sequence
  Description of Artificial Sequence: Synthetic polypeptide
DENEIRTTNPVATEQWGDVSEIEDNAAEDA

SEQ ID NO: 129670 - protein, 33 aa, Artificial Sequence
  Description of Artificial Sequence: Synthetic polypeptide
DESEIRTTNPVATECWGSVSCINEPDDFEGENG

SEQ ID NO: 129671 - protein, 31 aa, Artificial Sequence
  Description of Artificial Sequence: Synthetic polypeptide
DENEIRTTNPVATEQWGDVSEIEDMNQAEDA

SEQ ID NO: 129672 - protein, 36 aa, Artificial Sequence
  Description of Artificial Sequence: Synthetic polypeptide
DEEEIRTTNPVATEQYGSVSITLVGMGEGTGGNDGG

SEQ ID NO: 129673 - protein, 31 aa, Artificial Sequence
  Description of Artificial Sequence: Synthetic polypeptide
DENEIRTTNPVATEQWGDVSEIEDLNAAEDA

SEQ ID NO: 129674 - protein, 30 aa, Artificial Sequence
  Description of Artificial Sequence: Synthetic polypeptide
DENEIRTTNPVATEQWGDVSEIECNAAEDA

SEQ ID NO: 129675 - protein, 36 aa, Artificial Sequence
  Description of Artificial Sequence: Synthetic polypeptide
DTEEIRTTNPVATEQYGVVSTVNNLQQQTNNNTTED

SEQ ID NO: 129676 - protein, 31 aa, Artificial Sequence
  Description of Artificial Sequence: Synthetic polypeptide
DENEIRTTNPVATEQWGDVSEIEANAAEDAW

SEQ ID NO: 129677 - protein, 30 aa, Artificial Sequence
  Description of Artificial Sequence: Synthetic polypeptide
DENEIRTTNPVATEQWGDVSEIEANAAEDA

SEQ ID NO: 129678 - protein, 31 aa, Artificial Sequence
  Description of Artificial Sequence: Synthetic polypeptide
DENEIRTTNPVATEQWGDVSEIDMNAAEHDA

SEQ ID NO: 129679 - protein, 30 aa, Artificial Sequence
  Description of Artificial Sequence: Synthetic polypeptide
DENEIRTTNPVATEQWGDVSEIDMNAAEDC

SEQ ID NO: 129680 - protein, 30 aa, Artificial Sequence
  Description of Artificial Sequence: Synthetic polypeptide
DENEIRTTNPVATEQWGDVSEIDMNAAEDA

SEQ ID NO: 129681 - protein, 32 aa, Artificial Sequence
  Description of Artificial Sequence: Synthetic polypeptide
DEDEIATTNPVATAQWGCVAGTGLPEQDGGNN

SEQ ID NO: 129682 - protein, 33 aa, Artificial Sequence
  Description of Artificial Sequence: Synthetic polypeptide
DESEIRTTNPVATECWGSVSCINEPCDLEGENG

SEQ ID NO: 129683 - protein, 37 aa, Artificial Sequence
  Description of Artificial Sequence: Synthetic polypeptide
DTEEIRTTNPVATEQYGVVSTVNQLQNDTEQGTTNAD

SEQ ID NO: 129684 - protein, 37 aa, Artificial Sequence
  Description of Artificial Sequence: Synthetic polypeptide
DEEEIRTTNPVATEQYGSVVGSGQNDEEQDGEGGNDN

SEQ ID NO: 129685 - protein, 37 aa, Artificial Sequence
  Description of Artificial Sequence: Synthetic polypeptide
DTEEIRTTNPVATEQYGVVSTVTNLQQGNLEEEEEDT

SEQ ID NO: 129686 - protein, 37 aa, Artificial Sequence
  Description of Artificial Sequence: Synthetic polypeptide
DTEEIRTTNPVATEQYGVVSTVQNLQAGNNNNNDTED

SEQ ID NO: 129687 - protein, 30 aa, Artificial Sequence
  Description of Artificial Sequence: Synthetic polypeptide
DENEIRTTNPVATEQWGDVSEGEMNPAEDD

SEQ ID NO: 129688 - protein, 31 aa, Artificial Sequence
  Description of Artificial Sequence: Synthetic polypeptide
DENEIRTTNPVATEQWGDVSEDLMNAAEDDL

SEQ ID NO: 129689 - protein, 31 aa, Artificial Sequence
  Description of Artificial Sequence: Synthetic polypeptide
DENEIRTTNPVATEQWGDVSEDLMNAAEDDA

SEQ ID NO: 129690 - protein, 31 aa, Artificial Sequence
  Description of Artificial Sequence: Synthetic polypeptide
DENEIRTTNPVATEQWGDVSEDIPMNAAENA

SEQ ID NO: 129691 - protein, 36 aa, Artificial Sequence
  Description of Artificial Sequence: Synthetic polypeptide
DTEEIRTTNPVATEQYGVVSTVTNLQAGTDEEEETE

SEQ ID NO: 129692 - protein, 37 aa, Artificial Sequence
  Description of Artificial Sequence: Synthetic polypeptide
DTEEIRTTNPVATEQYGVVSTVTNLQQGINNNNTNQD

SEQ ID NO: 129693 - protein, 37 aa, Artificial Sequence
  Description of Artificial Sequence: Synthetic polypeptide
DTEEIRTTNPVATEQYGVVSTVTNLQQGINNNNTTDQ

SEQ ID NO: 129694 - protein, 37 aa, Artificial Sequence
  Description of Artificial Sequence: Synthetic polypeptide
DTEEIRTTNPVATEQYGVVSTVTNLQQGNDEEEETET

SEQ ID NO: 129695 - protein, 37 aa, Artificial Sequence
  Description of Artificial Sequence: Synthetic polypeptide
DTEEIRTTNPVATEQYGVVSTVTNLQQGNDEENQEDT

SEQ ID NO: 129696 - protein, 31 aa, Artificial Sequence
  Description of Artificial Sequence: Synthetic polypeptide
DENEIRTTNPVATEQWGDVSEDIEMNAAENA

SEQ ID NO: 129697 - protein, 37 aa, Artificial Sequence
  Description of Artificial Sequence: Synthetic polypeptide
DEEEIRTTNPVATEQYGSVVGSGQNDEEQTDEGNNEG

SEQ ID NO: 129698 - protein, 33 aa, Artificial Sequence
  Description of Artificial Sequence: Synthetic polypeptide
DEDEIATTNPVATAAWGSVSGDNEPQDRGEENG

SEQ ID NO: 129699 - protein, 30 aa, Artificial Sequence
  Description of Artificial Sequence: Synthetic polypeptide
DENEIRTTNPVATEQWGDVSEDEMNKASDA

SEQ ID NO: 129700 - protein, 32 aa, Artificial Sequence
  Description of Artificial Sequence: Synthetic polypeptide
DEDEIATTNPEATEQYGSVSKTDKADHEGEDL

SEQ ID NO: 129701 - protein, 37 aa, Artificial Sequence
  Description of Artificial Sequence: Synthetic polypeptide
DEEEIRTTNPVATEQYGSVVGSGQNNDEEQDGEGNNA

SEQ ID NO: 129702 - protein, 37 aa, Artificial Sequence
  Description of Artificial Sequence: Synthetic polypeptide
DEEEIRTTNPVATEQYGSVVGSGTMNLEDPEGQGVEI

SEQ ID NO: 129703 - protein, 30 aa, Artificial Sequence
  Description of Artificial Sequence: Synthetic polypeptide
DENEIRTTNPVATEQWGDVSEDEMNAAVDT

SEQ ID NO: 129704 - protein, 34 aa, Artificial Sequence
  Description of Artificial Sequence: Synthetic polypeptide
DEAEIRTTNPVAYEQWGSVCYTQDNDQWTGGGNE

SEQ ID NO: 129705 - protein, 37 aa, Artificial Sequence
  Description of Artificial Sequence: Synthetic polypeptide
DEEEIRTTNPVATEQYGSVVGSTTPAGPNMRNGMNPV

SEQ ID NO: 129706 - protein, 30 aa, Artificial Sequence
  Description of Artificial Sequence: Synthetic polypeptide
DENEIRTTNPVATEQWGDVSEDEMNAAEDD

SEQ ID NO: 129707 - protein, 31 aa, Artificial Sequence
  Description of Artificial Sequence: Synthetic polypeptide
DENEIRTTNPVATEQWGDVSEDWANAAEDYA

SEQ ID NO: 129708 - protein, 31 aa, Artificial Sequence
  Description of Artificial Sequence: Synthetic polypeptide
DENEIRTTNPVATEQWGDVSEGEMNTAEDAK

SEQ ID NO: 129709 - protein, 36 aa, Artificial Sequence
  Description of Artificial Sequence: Synthetic polypeptide
DTEEIRTTNPVATEQYGVVSTVTNLQAGTDEEEEDD

SEQ ID NO: 129710 - protein, 30 aa, Artificial Sequence
  Description of Artificial Sequence: Synthetic polypeptide
DENEIRTTNPVATEQWGDVSEEEMHAAEDA

SEQ ID NO: 129711 - protein, 30 aa, Artificial Sequence
  Description of Artificial Sequence: Synthetic polypeptide
DENEIRTTNPVATEQWGDVSEGEMNAASDM

SEQ ID NO: 129712 - protein, 34 aa, Artificial Sequence
  Description of Artificial Sequence: Synthetic polypeptide
DEQEIATTNPVATEQYGSVSATIDELEDHEGEDL

SEQ ID NO: 129713 - protein, 30 aa, Artificial Sequence
  Description of Artificial Sequence: Synthetic polypeptide
DENEIRTTNPVATEQWGDVSEGEMNAAEDM

SEQ ID NO: 129714 - protein, 30 aa, Artificial Sequence
  Description of Artificial Sequence: Synthetic polypeptide
DENEIRTTNPVATEQWGDVSEGEMNAAEDA

SEQ ID NO: 129715 - protein, 33 aa, Artificial Sequence
  Description of Artificial Sequence: Synthetic polypeptide
DESEIRTTNPVATECWGSVSCINEPADDEGENG

SEQ ID NO: 129716 - protein, 37 aa, Artificial Sequence
  Description of Artificial Sequence: Synthetic polypeptide
DTEEIRTTNPVATEQYGVVSTVQNLQQGNNNNEDTND

SEQ ID NO: 129717 - protein, 31 aa, Artificial Sequence
  Description of Artificial Sequence: Synthetic polypeptide
DENEIRTTNPVATEQWGDVSEFIELNAAEDA

SEQ ID NO: 129718 - protein, 30 aa, Artificial Sequence
  Description of Artificial Sequence: Synthetic polypeptide
DENEIRTTNPVATEQWGDVSEFEMNAAPDA

SEQ ID NO: 129719 - protein, 30 aa, Artificial Sequence
  Description of Artificial Sequence: Synthetic polypeptide
DENEIRTTNPVATEQWGDVSEFEMNAAHDA

SEQ ID NO: 129720 - protein, 30 aa, Artificial Sequence
  Description of Artificial Sequence: Synthetic polypeptide
DENEIRTTNPVATEQWGDVSEFEMNAAEDA

SEQ ID NO: 129721 - protein, 37 aa, Artificial Sequence
  Description of Artificial Sequence: Synthetic polypeptide
DTEEIRTTNPVATEQYGVVSTVTNLQAGGNTEQGSED

SEQ ID NO: 129722 - protein, 37 aa, Artificial Sequence
  Description of Artificial Sequence: Synthetic polypeptide
DTEEIRTTNPVATEQYGVVSTVTNLQAGNDEEEEEDE

SEQ ID NO: 129723 - protein, 31 aa, Artificial Sequence
  Description of Artificial Sequence: Synthetic polypeptide
DEDEIATTNPVATAQWGCVAGTALADAGGNQ

SEQ ID NO: 129724 - protein, 32 aa, Artificial Sequence
  Description of Artificial Sequence: Synthetic polypeptide
DENEIRTTNPVATEQWGDVSEEICMNAAEDNA

SEQ ID NO: 129725 - protein, 31 aa, Artificial Sequence
  Description of Artificial Sequence: Synthetic polypeptide
DENEIRTTNPVATEQWGDVSEEEQMNAAEDA

SEQ ID NO: 129726 - protein, 37 aa, Artificial Sequence
  Description of Artificial Sequence: Synthetic polypeptide
DEEEIRTTNPVATEQYGSVVGSGQNDEEQSIEGNNED

SEQ ID NO: 129727 - protein, 32 aa, Artificial Sequence
  Description of Artificial Sequence: Synthetic polypeptide
DEDEIATTNPVATAQWGCVAGPALQDRGGNQE

SEQ ID NO: 129728 - protein, 30 aa, Artificial Sequence
  Description of Artificial Sequence: Synthetic polypeptide
DENEIRTTNPVATEQWGDVSEEEMNAAEDC

SEQ ID NO: 129729 - protein, 30 aa, Artificial Sequence
  Description of Artificial Sequence: Synthetic polypeptide
DENEIRTTNPVATEQWGDVSEEEMNAAEDA

SEQ ID NO: 129730 - protein, 37 aa, Artificial Sequence
  Description of Artificial Sequence: Synthetic polypeptide
DTEEIRTTNPVATEQYGVVSTVTNLQAGNNNNEDTTD

SEQ ID NO: 129731 - protein, 30 aa, Artificial Sequence
  Description of Artificial Sequence: Synthetic polypeptide
DENEIRTTNPVATEQWGDVSYIEWNAAEDA

SEQ ID NO: 129732 - protein, 31 aa, Artificial Sequence
  Description of Artificial Sequence: Synthetic polypeptide
AEMEIACTNPVATEQYGEVCSEDGLVEFGGR

SEQ ID NO: 129733 - protein, 30 aa, Artificial Sequence
  Description of Artificial Sequence: Synthetic polypeptide
AEMEIACTNPCSYEQYGCVSWNLQSGSERS

SEQ ID NO: 129734 - protein, 34 aa, Artificial Sequence
  Description of Artificial Sequence: Synthetic polypeptide
DEEEIRTTNPVATEQYGSVVMNGFNGGGEGGGIG

SEQ ID NO: 129735 - protein, 33 aa, Artificial Sequence
  Description of Artificial Sequence: Synthetic polypeptide
EEAEIRTTNPVAYEQWGSVSGGNNQHNEGNGSG

SEQ ID NO: 129736 - protein, 30 aa, Artificial Sequence
  Description of Artificial Sequence: Synthetic polypeptide
DENEIRTTNPVATEQWGDASEIEQNHAEEK

SEQ ID NO: 129737 - protein, 34 aa, Artificial Sequence
  Description of Artificial Sequence: Synthetic polypeptide
DESEIRTTNPVATECWGSVSCINDECQDREQENG

SEQ ID NO: 129738 - protein, 34 aa, Artificial Sequence
  Description of Artificial Sequence: Synthetic polypeptide
DEEEIRTTNPVATEQYGSVVMNGFNGGGFEHTGA

SEQ ID NO: 129739 - protein, 30 aa, Artificial Sequence
  Description of Artificial Sequence: Synthetic polypeptide
DENEIRTTNPVATEQWGDASEIEQNAAEEK

SEQ ID NO: 129740 - protein, 30 aa, Artificial Sequence
  Description of Artificial Sequence: Synthetic polypeptide
DENEIRTTNPVATEQWGDASEIEQNAAEDA

SEQ ID NO: 129741 - protein, 34 aa, Artificial Sequence
  Description of Artificial Sequence: Synthetic polypeptide
DESEIRTTNPVATECWGSVSCINAERNDREGENG

SEQ ID NO: 129742 - protein, 30 aa, Artificial Sequence
  Description of Artificial Sequence: Synthetic polypeptide
DENEIRTTNPVATEQWGDASEIEMNAAEDR

SEQ ID NO: 129743 - protein, 29 aa, Artificial Sequence
  Description of Artificial Sequence: Synthetic peptide
DENEIRTTNPVATEQWGDASEIEMAAEDA

SEQ ID NO: 129744 - protein, 33 aa, Artificial Sequence
  Description of Artificial Sequence: Synthetic polypeptide
EEAEISTTNPVAYEQWGSVSTNLNQGDAGQGDA

SEQ ID NO: 129745 - protein, 33 aa, Artificial Sequence
  Description of Artificial Sequence: Synthetic polypeptide
EECEIATTNPVATENYGCVSTGNGLNDTEGDER

SEQ ID NO: 129746 - protein, 33 aa, Artificial Sequence
  Description of Artificial Sequence: Synthetic polypeptide
EECEIATTNPVATEPYGSVCYNNDIQDHGDNDR

SEQ ID NO: 129747 - protein, 33 aa, Artificial Sequence
  Description of Artificial Sequence: Synthetic polypeptide
EECEIATTNPVAYEGWGSVATNLGQGDTGGNER

SEQ ID NO: 129748 - protein, 32 aa, Artificial Sequence
  Description of Artificial Sequence: Synthetic polypeptide
EECEIATTNPVAYEGWGSVATNLQGDTGGNDE

SEQ ID NO: 129749 - protein, 31 aa, Artificial Sequence
  Description of Artificial Sequence: Synthetic polypeptide
DENEIRTTNPVATEQWGCVTSWEEINASNDA

SEQ ID NO: 129750 - protein, 32 aa, Artificial Sequence
  Description of Artificial Sequence: Synthetic polypeptide
DENEIRTTNPVATEQWGCVTSSEETNAFIDAA

SEQ ID NO: 129751 - protein, 28 aa, Artificial Sequence
  Description of Artificial Sequence: Synthetic peptide
EEEEIAATNPVATEQYGEAPEVCQHEEK

SEQ ID NO: 129752 - protein, 31 aa, Artificial Sequence
  Description of Artificial Sequence: Synthetic polypeptide
DENEIRTTNPVATEQWGCVTSSEEAEAFNDA

SEQ ID NO: 129753 - protein, 33 aa, Artificial Sequence
  Description of Artificial Sequence: Synthetic polypeptide
EEAEIRTTNPVAYEQWGSVSGGNGNERGENGGG

SEQ ID NO: 129754 - protein, 32 aa, Artificial Sequence
  Description of Artificial Sequence: Synthetic polypeptide
DENEIRTTNPVATEQWGCVTSSEDANAFNGDA

SEQ ID NO: 129755 - protein, 34 aa, Artificial Sequence
  Description of Artificial Sequence: Synthetic polypeptide
DEEEIRTTNPVATEQYGSVVMNGFIGGGFETTGG

SEQ ID NO: 129756 - protein, 35 aa, Artificial Sequence
  Description of Artificial Sequence: Synthetic polypeptide
EEAEIRTTNPVAYEQWGSVCSTMDRDNQQGEGNRE

SEQ ID NO: 129757 - protein, 35 aa, Artificial Sequence
  Description of Artificial Sequence: Synthetic polypeptide
EDEEICTTNPVATEQYGVVSTTNNNLNQLGNNEDD

SEQ ID NO: 129758 - protein, 35 aa, Artificial Sequence
  Description of Artificial Sequence: Synthetic polypeptide
EDEEICTTNPVATEQYGVVSTTNNNLNQNDQGDNS

SEQ ID NO: 129759 - protein, 35 aa, Artificial Sequence
  Description of Artificial Sequence: Synthetic polypeptide
EDEEICTTNPVATEQYGVVSTTNNQLNQGTQGDNS

SEQ ID NO: 129760 - protein, 34 aa, Artificial Sequence
  Description of Artificial Sequence: Synthetic polypeptide
DEEEIRTTNPVATEQYGSVSGVSDGMGGEGGEIA

SEQ ID NO: 129761 - protein, 34 aa, Artificial Sequence
  Description of Artificial Sequence: Synthetic polypeptide
DEECIRTTNPVATEQYGCVCSWGEHQHFGSENQS

SEQ ID NO: 129762 - protein, 33 aa, Artificial Sequence
  Description of Artificial Sequence: Synthetic polypeptide
DEECIRTTNPVATEQYGCVCSWMEDQFFGSEQS

SEQ ID NO: 129763 - protein, 30 aa, Artificial Sequence
  Description of Artificial Sequence: Synthetic polypeptide
DENEIRTTNPVATEQWGDFSEIEMNRAEDA

SEQ ID NO: 129764 - protein, 30 aa, Artificial Sequence
  Description of Artificial Sequence: Synthetic polypeptide
DENEIRTTNPVATEQWGDFSEIEMNAAEGA

SEQ ID NO: 129765 - protein, 32 aa, Artificial Sequence
  Description of Artificial Sequence: Synthetic polypeptide
EDETICTTNPVATEQWGTVSTNLNLEQGNNEQ

SEQ ID NO: 129766 - protein, 34 aa, Artificial Sequence
  Description of Artificial Sequence: Synthetic polypeptide
EDETICTTNPVATTQYGSVSTNLQLQLLGNNQGE

SEQ ID NO: 129767 - protein, 33 aa, Artificial Sequence
  Description of Artificial Sequence: Synthetic polypeptide
EDETICTTNPVATTQYGSVSTTLQLQYGNNNDD

SEQ ID NO: 129768 - protein, 33 aa, Artificial Sequence
  Description of Artificial Sequence: Synthetic polypeptide
EDETICTTNPVATTQYGSVSTTQELQQGNNNQD

SEQ ID NO: 129769 - protein, 31 aa, Artificial Sequence
  Description of Artificial Sequence: Synthetic polypeptide
DENEIRTTNPVATEQWGDCVSEINMNAAEDA

SEQ ID NO: 129770 - protein, 31 aa, Artificial Sequence
  Description of Artificial Sequence: Synthetic polypeptide
DENEIRTTNPVATEQWGDCVSEILMNAAEDA

SEQ ID NO: 129771 - protein, 33 aa, Artificial Sequence
  Description of Artificial Sequence: Synthetic polypeptide
EDETICTTNPVATTQYGSVSTTQLLQYGNNQGD

SEQ ID NO: 129772 - protein, 30 aa, Artificial Sequence
  Description of Artificial Sequence: Synthetic polypeptide
DENEIRTTNPVATEQWGDCSWIEMNLAEDA

SEQ ID NO: 129773 - protein, 34 aa, Artificial Sequence
  Description of Artificial Sequence: Synthetic polypeptide
DESEIRTTNPVATECWGSVSCINDEPADREGENG

SEQ ID NO: 129774 - protein, 36 aa, Artificial Sequence
  Description of Artificial Sequence: Synthetic polypeptide
DEECIRTTNPVATEQYGEVSSTNPAGPNMRNGMNPV

SEQ ID NO: 129775 - protein, 31 aa, Artificial Sequence
  Description of Artificial Sequence: Synthetic polypeptide
DENEIRTTNPVATEQWGDAVSEIEMNAAEDN

SEQ ID NO: 129776 - protein, 33 aa, Artificial Sequence
  Description of Artificial Sequence: Synthetic polypeptide
EEAEIRTTNPVAYEQWGSVCYNDLNQDAGDTNH

SEQ ID NO: 129777 - protein, 34 aa, Artificial Sequence
  Description of Artificial Sequence: Synthetic polypeptide
EDEEICTTNPVATEQYGVVSTTNNLQQQLQQNTD

SEQ ID NO: 129778 - protein, 32 aa, Artificial Sequence
  Description of Artificial Sequence: Synthetic polypeptide
EEEEIASVNPVSTEQYGCVVCSDNGLQQSGNQ

SEQ ID NO: 129779 - protein, 29 aa, Artificial Sequence
  Description of Artificial Sequence: Synthetic peptide
EEEEIATTNPVATEQYGEAPEVAQHEVEY

SEQ ID NO: 129780 - protein, 31 aa, Artificial Sequence
  Description of Artificial Sequence: Synthetic polypeptide
DENEIRTTNPVATEQWGCVSSEEANAIIDAA

SEQ ID NO: 129781 - protein, 30 aa, Artificial Sequence
  Description of Artificial Sequence: Synthetic polypeptide
DEAEIRTTNPVATEQWGDVSEIEMNAAEDA

SEQ ID NO: 129782 - protein, 31 aa, Artificial Sequence
  Description of Artificial Sequence: Synthetic polypeptide
DENEIRTTNPVATEQWGCVSSAEMNNFISDA

SEQ ID NO: 129783 - protein, 34 aa, Artificial Sequence
  Description of Artificial Sequence: Synthetic polypeptide
DEQEIATTNPVATEQYGSVSATPDLEDHEGDEDL

SEQ ID NO: 129784 - protein, 36 aa, Artificial Sequence
  Description of Artificial Sequence: Synthetic polypeptide
EEEEIRTTNPVATEAYGVVSTTNNNLNGQNGNDEDE

SEQ ID NO: 129785 - protein, 35 aa, Artificial Sequence
  Description of Artificial Sequence: Synthetic polypeptide
EEEEIRTTNPVATEAYGVVSTTNNNNTQNGNDQDE

SEQ ID NO: 129786 - protein, 35 aa, Artificial Sequence
  Description of Artificial Sequence: Synthetic polypeptide
EEEEIRTTNPVATEAYGVVSTTNQAGNQNGNDQNE

SEQ ID NO: 129787 - protein, 31 aa, Artificial Sequence
  Description of Artificial Sequence: Synthetic polypeptide
DENEIRTTNPVATEQWGCVSPIEMNIAEDEA

SEQ ID NO: 129788 - protein, 30 aa, Artificial Sequence
  Description of Artificial Sequence: Synthetic polypeptide
DENEIRTTNPVATEQWGCVSLIEMNAAEDA

SEQ ID NO: 129789 - protein, 35 aa, Artificial Sequence
  Description of Artificial Sequence: Synthetic polypeptide
EEEEIRTTNPVATEAYGVVSTTNQQGNQNGNDQTN

SEQ ID NO: 129790 - protein, 30 aa, Artificial Sequence
  Description of Artificial Sequence: Synthetic polypeptide
DENEIRTTNPVATEQWGCVSKGEMNAAEDM

SEQ ID NO: 129791 - protein, 36 aa, Artificial Sequence
  Description of Artificial Sequence: Synthetic polypeptide
EEEEIRTTNPVATEAYGVVSTTSNLGGNQNGNDEDE

SEQ ID NO: 129792 - protein, 31 aa, Artificial Sequence
  Description of Artificial Sequence: Synthetic polypeptide
DENEIRTTNPVATEQWGCVSEYEENIAEDEA

SEQ ID NO: 129793 - protein, 30 aa, Artificial Sequence
  Description of Artificial Sequence: Synthetic polypeptide
DENEIRTTNPVATEQWGCVSEVIENTAEDQ

SEQ ID NO: 129794 - protein, 30 aa, Artificial Sequence
  Description of Artificial Sequence: Synthetic polypeptide
DENEIRTTNPVATEQWGCVSEVFENTHEDL

SEQ ID NO: 129795 - protein, 32 aa, Artificial Sequence
  Description of Artificial Sequence: Synthetic polypeptide
DENEIRTTNPVATEQWGCVSEVEMNILETDEA

SEQ ID NO: 129796 - protein, 31 aa, Artificial Sequence
  Description of Artificial Sequence: Synthetic polypeptide
DENEIRTTNPVATEQWGCVSEVEMNIAEDEV

SEQ ID NO: 129797 - protein, 30 aa, Artificial Sequence
  Description of Artificial Sequence: Synthetic polypeptide
DENEIRTTNPVATEQWGCVSEVEETTIEDA

SEQ ID NO: 129798 - protein, 30 aa, Artificial Sequence
  Description of Artificial Sequence: Synthetic polypeptide
DENEIRTTNPVATEQWGCVSEVEENTDEDD

SEQ ID NO: 129799 - protein, 31 aa, Artificial Sequence
  Description of Artificial Sequence: Synthetic polypeptide
DENEIRTTNPVATEQWGCVSSEEANYINSDA

SEQ ID NO: 129800 - protein, 34 aa, Artificial Sequence
  Description of Artificial Sequence: Synthetic polypeptide
EEEEIATTNPVATEQWGSVSANGPGAPDNQEGNH

SEQ ID NO: 129801 - protein, 30 aa, Artificial Sequence
  Description of Artificial Sequence: Synthetic polypeptide
DENEIRTTNPVATEQWGCVSSEEDNAIEDA

SEQ ID NO: 129802 - protein, 31 aa, Artificial Sequence
  Description of Artificial Sequence: Synthetic polypeptide
DENEIRTTNPVATEQWGCVSSEEMNAEESDA

SEQ ID NO: 129803 - protein, 29 aa, Artificial Sequence
  Description of Artificial Sequence: Synthetic peptide
EEEEIATTNPVATEQYGEAPVEVCQHEEK

SEQ ID NO: 129804 - protein, 33 aa, Artificial Sequence
  Description of Artificial Sequence: Synthetic polypeptide
EEEEIATTNPVAYEQWGCVSGTMREQRGDGGDR

SEQ ID NO: 129805 - protein, 32 aa, Artificial Sequence
  Description of Artificial Sequence: Synthetic polypeptide
EEEEIATTNPVAYEQWGNVSGGMNQDQGDGNV

SEQ ID NO: 129806 - protein, 33 aa, Artificial Sequence
  Description of Artificial Sequence: Synthetic polypeptide
DEECIRTTNPVATEQYGQCVCSWEEAYFGSNQS

SEQ ID NO: 129807 - protein, 31 aa, Artificial Sequence
  Description of Artificial Sequence: Synthetic polypeptide
DENEIRTTNPVATEQWGCVSWPEMNALSSDA

SEQ ID NO: 129808 - protein, 32 aa, Artificial Sequence
  Description of Artificial Sequence: Synthetic polypeptide
DEAEIRTTNPVATEQWGEVSEIESMNAAEGDA

SEQ ID NO: 129809 - protein, 31 aa, Artificial Sequence
  Description of Artificial Sequence: Synthetic polypeptide
DENEIRTTNPVATEQWGCVSSPHMNAFESDA

SEQ ID NO: 129810 - protein, 30 aa, Artificial Sequence
  Description of Artificial Sequence: Synthetic polypeptide
DENEIRTTNPVATEQWGCVSSPEMNAMSDA

SEQ ID NO: 129811 - protein, 31 aa, Artificial Sequence
  Description of Artificial Sequence: Synthetic polypeptide
DENEIRTTNPVATEQWGCVSSPEMNAIISDA

SEQ ID NO: 129812 - protein, 31 aa, Artificial Sequence
  Description of Artificial Sequence: Synthetic polypeptide
DENEIRTTNPVATEQWGCVSSPEMNAFIDAS

SEQ ID NO: 129813 - protein, 36 aa, Artificial Sequence
  Description of Artificial Sequence: Synthetic polypeptide
DEECIRTTNPVATEQYGSVAATNPDGPNMRNGMNPV

SEQ ID NO: 129814 - protein, 31 aa, Artificial Sequence
  Description of Artificial Sequence: Synthetic polypeptide
DENEIRTTNPVATEQWGCVSSPEANAFEDAP

SEQ ID NO: 129815 - protein, 33 aa, Artificial Sequence
  Description of Artificial Sequence: Synthetic polypeptide
CEEEIATTNPVAYEQYGSCSTTPALNNGLDNSN

SEQ ID NO: 129816 - protein, 31 aa, Artificial Sequence
  Description of Artificial Sequence: Synthetic polypeptide
DENEIRTTNPVATEQWGCVSSIEENAFESDA

SEQ ID NO: 129817 - protein, 32 aa, Artificial Sequence
  Description of Artificial Sequence: Synthetic polypeptide
DENEIRTTNPVATEQWGCVSSEETNAFESDAN

SEQ ID NO: 129818 - protein, 34 aa, Artificial Sequence
  Description of Artificial Sequence: Synthetic polypeptide
DEECIRTTNPVATEQYGSVFVWINGEQDRKKTDV

SEQ ID NO: 129819 - protein, 30 aa, Artificial Sequence
  Description of Artificial Sequence: Synthetic polypeptide
DEAEIRTTNPVATEQWGDVSEIEMYAAEDA

SEQ ID NO: 129820 - protein, 34 aa, Artificial Sequence
  Description of Artificial Sequence: Synthetic polypeptide
DESEIRTTNPVATECWGSVSCINAEPQDRECENG

SEQ ID NO: 129821 - protein, 31 aa, Artificial Sequence
  Description of Artificial Sequence: Synthetic polypeptide
DENEIRTTNPVATEQWGCVSSEEMNAINDAG

SEQ ID NO: 129822 - protein, 35 aa, Artificial Sequence
  Description of Artificial Sequence: Synthetic polypeptide
DEECIRTTNPVATEQYGSVFVWINGEQDRTKQGDM

SEQ ID NO: 129823 - protein, 32 aa, Artificial Sequence
  Description of Artificial Sequence: Synthetic polypeptide
AEMEIACTNPVATEQYGEVCSATNPVEFEGND

SEQ ID NO: 129824 - protein, 30 aa, Artificial Sequence
  Description of Artificial Sequence: Synthetic polypeptide
DENEIRTTNPVATEQWGDISEIEMNANEDA

SEQ ID NO: 129825 - protein, 30 aa, Artificial Sequence
  Description of Artificial Sequence: Synthetic polypeptide
DENEIRTTNPVATEQWGDISEIEMNQAEDA

SEQ ID NO: 129826 - protein, 31 aa, Artificial Sequence
  Description of Artificial Sequence: Synthetic polypeptide
DENEIRTTNPVATEQWGDVCSEIEMNAAENA

SEQ ID NO: 129827 - protein, 34 aa, Artificial Sequence
  Description of Artificial Sequence: Synthetic polypeptide
DESEIRTTNPVATECWGSVSCINEEPQDREGELG

SEQ ID NO: 129828 - protein, 35 aa, Artificial Sequence
  Description of Artificial Sequence: Synthetic polypeptide
DEEEIRTTNPVATEQYGSVSILPINWEIEVMGPVN

SEQ ID NO: 129829 - protein, 31 aa, Artificial Sequence
  Description of Artificial Sequence: Synthetic polypeptide
DENEIRTTNPVATEQWGDVCSEIEENAEGDD

SEQ ID NO: 129830 - protein, 31 aa, Artificial Sequence
  Description of Artificial Sequence: Synthetic polypeptide
DENEIRTTNPVATEQWGDVCSEGEVMFAGDD

SEQ ID NO: 129831 - protein, 31 aa, Artificial Sequence
  Description of Artificial Sequence: Synthetic polypeptide
DENEIRTTNPVATEQWGDVCSEGEVMFAGDA

SEQ ID NO: 129832 - protein, 34 aa, Artificial Sequence
  Description of Artificial Sequence: Synthetic polypeptide
DEEEIRTTNPVATEQYGSVSIGTLVEVAALVEEE

SEQ ID NO: 129833 - protein, 32 aa, Artificial Sequence
  Description of Artificial Sequence: Synthetic polypeptide
DENEIRTTNPVATEQWGDVCSEDGPVMFAGND

SEQ ID NO: 129834 - protein, 34 aa, Artificial Sequence
  Description of Artificial Sequence: Synthetic polypeptide
DESEIRTTNPVATECWGSVSCINEEPQDREGEKG

SEQ ID NO: 129835 - protein, 34 aa, Artificial Sequence
  Description of Artificial Sequence: Synthetic polypeptide
DEECIRTTNPVATEQYGCVCSTGEHQFFNSDNQE

SEQ ID NO: 129836 - protein, 34 aa, Artificial Sequence
  Description of Artificial Sequence: Synthetic polypeptide
DEAEIRTTNPVAYEQWGSVSHNMNDQQNGGGMDR

SEQ ID NO: 129837 - protein, 34 aa, Artificial Sequence
  Description of Artificial Sequence: Synthetic polypeptide
DEECIRTTNPVATEQYGCVCSTGEHQNFGSQTQL

SEQ ID NO: 129838 - protein, 32 aa, Artificial Sequence
  Description of Artificial Sequence: Synthetic polypeptide
DENEIRTTNPVATEQWGDVCSAEGPMNAEGNA

SEQ ID NO: 129839 - protein, 32 aa, Artificial Sequence
  Description of Artificial Sequence: Synthetic polypeptide
DENEIRTTNPVATEQWGDVCSAEGPMNAAGNA

SEQ ID NO: 129840 - protein, 36 aa, Artificial Sequence
  Description of Artificial Sequence: Synthetic polypeptide
DTTEIRTTNPVATEQYGSVSTTVNTNNQQLGNDEAE

SEQ ID NO: 129841 - protein, 35 aa, Artificial Sequence
  Description of Artificial Sequence: Synthetic polypeptide
DEEEIRTTNPVATEQYGSVSIENWMVPAVNLQIVA

SEQ ID NO: 129842 - protein, 35 aa, Artificial Sequence
  Description of Artificial Sequence: Synthetic polypeptide
DEEEIRTTNPVATEQYGSVSIENVQQNTQVDPFIY

SEQ ID NO: 129843 - protein, 34 aa, Artificial Sequence
  Description of Artificial Sequence: Synthetic polypeptide
DEECIRTTNPVATEQYGCVCSTGELNDNFGSQQS

SEQ ID NO: 129844 - protein, 33 aa, Artificial Sequence
  Description of Artificial Sequence: Synthetic polypeptide
DEAEIRTTNPVAYEQWGSVSHSMNDRGDGGNDP

SEQ ID NO: 129845 - protein, 31 aa, Artificial Sequence
  Description of Artificial Sequence: Synthetic polypeptide
DENEIRTTNPVATEQWGDVCSEIEMNAQEDA

SEQ ID NO: 129846 - protein, 33 aa, Artificial Sequence
  Description of Artificial Sequence: Synthetic polypeptide
DEDEIACTNPVAYEQYGQSVAQNDLDQTPGITR

SEQ ID NO: 129847 - protein, 34 aa, Artificial Sequence
  Description of Artificial Sequence: Synthetic polypeptide
DEAEIRTTNPVAYEQWGSVSGNPNGQTDQGNNEV

SEQ ID NO: 129848 - protein, 31 aa, Artificial Sequence
  Description of Artificial Sequence: Synthetic polypeptide
DENEIRTTNPVATEQWGDVCSEIEVNAANDA

SEQ ID NO: 129849 - protein, 31 aa, Artificial Sequence
  Description of Artificial Sequence: Synthetic polypeptide
AEMEIACTNPCSYEQYGCVCSWNLQSGSENR

SEQ ID NO: 129850 - protein, 34 aa, Artificial Sequence
  Description of Artificial Sequence: Synthetic polypeptide
DEECIRTTNPVATEQYGCVCSSEDQEFFGSDNQS

SEQ ID NO: 129851 - protein, 33 aa, Artificial Sequence
  Description of Artificial Sequence: Synthetic polypeptide
DTMEIVTTNPVATEQYGTVCSATDGPEFRGNDE

SEQ ID NO: 129852 - protein, 34 aa, Artificial Sequence
  Description of Artificial Sequence: Synthetic polypeptide
DESEIRTTNPVATECWGSVSCINEEPQDSDGENM

SEQ ID NO: 129853 - protein, 32 aa, Artificial Sequence
  Description of Artificial Sequence: Synthetic polypeptide
DTQEIATTNPVATEQYGHVSATDLEDHEGEDL

SEQ ID NO: 129854 - protein, 32 aa, Artificial Sequence
  Description of Artificial Sequence: Synthetic polypeptide
DTQEIATTNPVATEQYGSVGATDLEDHEGEDL

SEQ ID NO: 129855 - protein, 33 aa, Artificial Sequence
  Description of Artificial Sequence: Synthetic polypeptide
DTQEIATTNPVATEQYGSVSATDLEDHEGEDLT

SEQ ID NO: 129856 - protein, 34 aa, Artificial Sequence
  Description of Artificial Sequence: Synthetic polypeptide
DEECIRTTNPVATEQYGCVCSTEDNDENFGSQQS

SEQ ID NO: 129857 - protein, 32 aa, Artificial Sequence
  Description of Artificial Sequence: Synthetic polypeptide
DTQEIATTNPVATEQYGSVSAWDLEDHEGEDL

SEQ ID NO: 129858 - protein, 33 aa, Artificial Sequence
  Description of Artificial Sequence: Synthetic polypeptide
DEQEIATTNPVATEQYGSVSATKDLEDHEWEDL

SEQ ID NO: 129859 - protein, 33 aa, Artificial Sequence
  Description of Artificial Sequence: Synthetic polypeptide
DTSEIRTTNPVATECWGSVSCIFEPQDREGENG

SEQ ID NO: 129860 - protein, 33 aa, Artificial Sequence
  Description of Artificial Sequence: Synthetic polypeptide
DEAEIRTTNPVAYEQWGSVSGGPNGNTGGNNEV

SEQ ID NO: 129861 - protein, 33 aa, Artificial Sequence
  Description of Artificial Sequence: Synthetic polypeptide
DTSEISTTNPVATECWGSVSCINEPQDREGENG

SEQ ID NO: 129862 - protein, 30 aa, Artificial Sequence
  Description of Artificial Sequence: Synthetic polypeptide
DENEIRTTNPVATEQWGDVFEIENNAAEDA

SEQ ID NO: 129863 - protein, 31 aa, Artificial Sequence
  Description of Artificial Sequence: Synthetic polypeptide
DENEIRTTNPVATEQWGDVFEIEMNAAEGDA

SEQ ID NO: 129864 - protein, 36 aa, Artificial Sequence
  Description of Artificial Sequence: Synthetic polypeptide
DTTEIRTTNPVATEQYGSVSTTNLQNNQLQGEEEQE

SEQ ID NO: 129865 - protein, 34 aa, Artificial Sequence
  Description of Artificial Sequence: Synthetic polypeptide
DEECIRTTNPVATEQYGCVCSTEHEENFGSNNQP

SEQ ID NO: 129866 - protein, 35 aa, Artificial Sequence
  Description of Artificial Sequence: Synthetic polypeptide
DESEIRTTNPVATECWGSVSCINEEPQDREGENGH

SEQ ID NO: 129867 - protein, 31 aa, Artificial Sequence
  Description of Artificial Sequence: Synthetic polypeptide
DENEIRTTNPVATEQWGDVCSTIEMNAAEDA

SEQ ID NO: 129868 - protein, 35 aa, Artificial Sequence
  Description of Artificial Sequence: Synthetic polypeptide
DTTEIRTTNPVATEQYGSVSTTNNQQQLQGEEEEV

SEQ ID NO: 129869 - protein, 30 aa, Artificial Sequence
  Description of Artificial Sequence: Synthetic polypeptide
DENEIRTTNPVATEQWGDISEIEMNANEDH

SEQ ID NO: 129870 - protein, 35 aa, Artificial Sequence
  Description of Artificial Sequence: Synthetic polypeptide
DTTEIRTTNPVATEQYGVVNTVTTVNLQAGNNEQS

SEQ ID NO: 129871 - protein, 30 aa, Artificial Sequence
  Description of Artificial Sequence: Synthetic polypeptide
DENEIRTTNPVATEQWGDVAEIEMNAAEDN

SEQ ID NO: 129872 - protein, 32 aa, Artificial Sequence
  Description of Artificial Sequence: Synthetic polypeptide
EACEIATTNPVATEQYGEVSTGNLPGMQGTGP

SEQ ID NO: 129873 - protein, 36 aa, Artificial Sequence
  Description of Artificial Sequence: Synthetic polypeptide
DEEEIRTTNPVATEQYGSVSHTTPAGPNMRNGMLPV

SEQ ID NO: 129874 - protein, 33 aa, Artificial Sequence
  Description of Artificial Sequence: Synthetic polypeptide
DEAEIRTTNPVAYEQWGSVSHTMNDRNDGGGDK

SEQ ID NO: 129875 - protein, 33 aa, Artificial Sequence
  Description of Artificial Sequence: Synthetic polypeptide
DEAEIRTTNPVAYEQWGSVSINPNGNTMGNNEV

SEQ ID NO: 129876 - protein, 31 aa, Artificial Sequence
  Description of Artificial Sequence: Synthetic polypeptide
EATEIATTNPVAYEQWGSVCTENKLDDLGMR

SEQ ID NO: 129877 - protein, 33 aa, Artificial Sequence
  Description of Artificial Sequence: Synthetic polypeptide
ECNEIATTNPVATEQYGSVSTTNGGDTGGGNED

SEQ ID NO: 129878 - protein, 30 aa, Artificial Sequence
  Description of Artificial Sequence: Synthetic polypeptide
DENEIRTTNPVATEQWGDMSEIEMNAAGDA

SEQ ID NO: 129879 - protein, 32 aa, Artificial Sequence
  Description of Artificial Sequence: Synthetic polypeptide
EDCEIRTTNPVATEQYGSVPPTFWPETESQNR

SEQ ID NO: 129880 - protein, 33 aa, Artificial Sequence
  Description of Artificial Sequence: Synthetic polypeptide
DEECIRTTNPVATEQYGCVCSWEEDQFFGSDQM

SEQ ID NO: 129881 - protein, 33 aa, Artificial Sequence
  Description of Artificial Sequence: Synthetic polypeptide
EDEEICTTNPVATEQWGTVSTTNGNQEQGTNNE

SEQ ID NO: 129882 - protein, 33 aa, Artificial Sequence
  Description of Artificial Sequence: Synthetic polypeptide
DEECIRTTNPVATEQYGCVCSWEHQENFGSDQA

SEQ ID NO: 129883 - protein, 34 aa, Artificial Sequence
  Description of Artificial Sequence: Synthetic polypeptide
DEQEIATTNPVATEQYGSVSATNEPEDHEGEEDL

SEQ ID NO: 129884 - protein, 33 aa, Artificial Sequence
  Description of Artificial Sequence: Synthetic polypeptide
EDEEICTTNPVATEQWGTVSTTNLQQNEQGTTE

SEQ ID NO: 129885 - protein, 31 aa, Artificial Sequence
  Description of Artificial Sequence: Synthetic polypeptide
DENEIRTTNPVATEQWGDIVSNIELNAAEDA

SEQ ID NO: 129886 - protein, 34 aa, Artificial Sequence
  Description of Artificial Sequence: Synthetic polypeptide
DESEIRTTNPVATECWGSVSCINDEPQDGYGENE

SEQ ID NO: 129887 - protein, 33 aa, Artificial Sequence
  Description of Artificial Sequence: Synthetic polypeptide
DEECIRTTNPVATEQYGCVCSWGEEANFGSNQS

SEQ ID NO: 129888 - protein, 34 aa, Artificial Sequence
  Description of Artificial Sequence: Synthetic polypeptide
DESEIRTTNPVATECWGSVSCINDEPQDEEGENG

SEQ ID NO: 129889 - protein, 31 aa, Artificial Sequence
  Description of Artificial Sequence: Synthetic polypeptide
DENEIRTTNPVATEQWGDISMEIEMQAAENA

SEQ ID NO: 129890 - protein, 30 aa, Artificial Sequence
  Description of Artificial Sequence: Synthetic polypeptide
DENEIRTTNPVATEQWGDISEIEMNQNEDA

SEQ ID NO: 129891 - protein, 34 aa, Artificial Sequence
  Description of Artificial Sequence: Synthetic polypeptide
DEAEIRTTNPVAYEQWGSVSHTMNDRGNLDGGDP

SEQ ID NO: 129892 - protein, 30 aa, Artificial Sequence
  Description of Artificial Sequence: Synthetic polypeptide
DENEIRTTNPVATEQWGDVAEILMNAAEDA

SEQ ID NO: 129893 - protein, 31 aa, Artificial Sequence
  Description of Artificial Sequence: Synthetic polypeptide
DENEIRTTNPVATEQWGDRVSEIEMNQAEDA

SEQ ID NO: 129894 - protein, 33 aa, Artificial Sequence
  Description of Artificial Sequence: Synthetic polypeptide
DVSEIRTTNPVATECWGSVSCINFPQDREFENG

SEQ ID NO: 129895 - protein, 34 aa, Artificial Sequence
  Description of Artificial Sequence: Synthetic polypeptide
DTTEIRTTNPVATEQYGVVNVVTNVNNQAGNTQS

SEQ ID NO: 129896 - protein, 34 aa, Artificial Sequence
  Description of Artificial Sequence: Synthetic polypeptide
DEECIRTTNPVATEQYGCVCSTMEELENFGSDQS

SEQ ID NO: 129897 - protein, 34 aa, Artificial Sequence
  Description of Artificial Sequence: Synthetic polypeptide
DEQEIATTNPVATEQYGSVSATMDLEDHEGEDLA

SEQ ID NO: 129898 - protein, 35 aa, Artificial Sequence
  Description of Artificial Sequence: Synthetic polypeptide
DEECIRTTNPVATEQYGCVCSTTGEDQEFFGSNQA

SEQ ID NO: 129899 - protein, 35 aa, Artificial Sequence
  Description of Artificial Sequence: Synthetic polypeptide
DEAEIRTTNPVAYEQWGSVSHTMNDQNGGGQQGDR

SEQ ID NO: 129900 - protein, 35 aa, Artificial Sequence
  Description of Artificial Sequence: Synthetic polypeptide
DTTEIRTTNPVATEQYGVVSTTNLQQLQQNDEEDE

SEQ ID NO: 129901 - protein, 35 aa, Artificial Sequence
  Description of Artificial Sequence: Synthetic polypeptide
DTTEIRTTNPVATEQYGVVSTTNNQQQLQGEEENE

SEQ ID NO: 129902 - protein, 34 aa, Artificial Sequence
  Description of Artificial Sequence: Synthetic polypeptide
DESEIRTTNPVATECWGSVSCINDEPQDYEGENG

SEQ ID NO: 129903 - protein, 31 aa, Artificial Sequence
  Description of Artificial Sequence: Synthetic polypeptide
DENEIRTTNPVATEQWGDTVSEIEANAAGDA

SEQ ID NO: 129904 - protein, 36 aa, Artificial Sequence
  Description of Artificial Sequence: Synthetic polypeptide
DTTEIRTTNPVATEQYGVVSVVVTGVNLQAGNDEQS

SEQ ID NO: 129905 - protein, 36 aa, Artificial Sequence
  Description of Artificial Sequence: Synthetic polypeptide
DTTEIRTTNPVATEQYGVVSVVVTNDNLQAGNNEQQ

SEQ ID NO: 129906 - protein, 34 aa, Artificial Sequence
  Description of Artificial Sequence: Synthetic polypeptide
DEQEIATTNPVATEQYGSVSATMDNEDDEGEDLV

SEQ ID NO: 129907 - protein, 33 aa, Artificial Sequence
  Description of Artificial Sequence: Synthetic polypeptide
DVQEIATTNPVATEQYGSVSATDPLEDHEGEDL

SEQ ID NO: 129908 - protein, 33 aa, Artificial Sequence
  Description of Artificial Sequence: Synthetic polypeptide
DVSEIFTTNPVATECWGSVSCINEPQDREGENG

SEQ ID NO: 129909 - protein, 35 aa, Artificial Sequence
  Description of Artificial Sequence: Synthetic polypeptide
DESEIRTTNPVATECWGSVSCINDEPQDREGENFG

SEQ ID NO: 129910 - protein, 31 aa, Artificial Sequence
  Description of Artificial Sequence: Synthetic polypeptide
DENEIRTTNPVATEQWGDSVSEYEMNAAEDA

SEQ ID NO: 129911 - protein, 31 aa, Artificial Sequence
  Description of Artificial Sequence: Synthetic polypeptide
DENEIRTTNPVATEQWGDSVSEIEMNAAEDS

SEQ ID NO: 129912 - protein, 31 aa, Artificial Sequence
  Description of Artificial Sequence: Synthetic polypeptide
DENEIRTTNPVATEQWGDSVSEIEMNAAEDF

SEQ ID NO: 129913 - protein, 31 aa, Artificial Sequence
  Description of Artificial Sequence: Synthetic polypeptide
DENEIRTTNPVATEQWGDSVSEIEMNAAEDA

SEQ ID NO: 129914 - protein, 33 aa, Artificial Sequence
  Description of Artificial Sequence: Synthetic polypeptide
DYSEIRTTNPVATECWGSVSCINEPQDRESENG

SEQ ID NO: 129915 - protein, 35 aa, Artificial Sequence
  Description of Artificial Sequence: Synthetic polypeptide
DEAEIRTTNPVAYEQWGSVAWTDDENGQHGRGDRD

SEQ ID NO: 129916 - protein, 31 aa, Artificial Sequence
  Description of Artificial Sequence: Synthetic polypeptide
DEECIMTVNPVATEWYGCSAYSDNNMERVTR

SEQ ID NO: 129917 - protein, 33 aa, Artificial Sequence
  Description of Artificial Sequence: Synthetic polypeptide
DEECIMTTNPVATEQYGSVKHKPNKIDSEGHNV

SEQ ID NO: 129918 - protein, 34 aa, Artificial Sequence
  Description of Artificial Sequence: Synthetic polypeptide
DEDEIRTTNPVAYEQWGSVVPTDNHDTQAGGTNH

SEQ ID NO: 129919 - protein, 35 aa, Artificial Sequence
  Description of Artificial Sequence: Synthetic polypeptide
CEEEIRTTNPVGYERYGQGTVSTNAVSQRGGDNRM

SEQ ID NO: 129920 - protein, 34 aa, Artificial Sequence
  Description of Artificial Sequence: Synthetic polypeptide
DEDEIRTTNPVAYEQWGSVVPTDNHDTQAGNNEP

SEQ ID NO: 129921 - protein, 35 aa, Artificial Sequence
  Description of Artificial Sequence: Synthetic polypeptide
DENEIRTTNPVATEQYGSVMSQNDNFNEGNGNVGD

SEQ ID NO: 129922 - protein, 34 aa, Artificial Sequence
  Description of Artificial Sequence: Synthetic polypeptide
DEDEIATTNPVATEQYGSVCSTDTGQNHNDNMQM

SEQ ID NO: 129923 - protein, 34 aa, Artificial Sequence
  Description of Artificial Sequence: Synthetic polypeptide
DEQEIATTNPVATEQYGSVSATDGLEDHEGAEDL

SEQ ID NO: 129924 - protein, 35 aa, Artificial Sequence
  Description of Artificial Sequence: Synthetic polypeptide
DENEIRTTNPVATEQYGSVMSQNDIFNEGNGNEGQ

SEQ ID NO: 129925 - protein, 35 aa, Artificial Sequence
  Description of Artificial Sequence: Synthetic polypeptide
DEDEIATTNPVATEQYGSVCSPVGNDLNTQDGDEH

SEQ ID NO: 129926 - protein, 36 aa, Artificial Sequence
  Description of Artificial Sequence: Synthetic polypeptide
CEEEIRTTNPVGYERYGESVSTTNAPSQRPGGDNRM

SEQ ID NO: 129927 - protein, 34 aa, Artificial Sequence
  Description of Artificial Sequence: Synthetic polypeptide
DEDEIRTTNPVAYEQWGTVCSTMDLADDERGNNN

SEQ ID NO: 129928 - protein, 34 aa, Artificial Sequence
  Description of Artificial Sequence: Synthetic polypeptide
DMEEIGTTNPVATEQYGVVSWTNALEQEDPEVQQ

SEQ ID NO: 129929 - protein, 34 aa, Artificial Sequence
  Description of Artificial Sequence: Synthetic polypeptide
DMEEIGTTNPVATEQYGVVSWTPNALMERPEVQQ

SEQ ID NO: 129930 - protein, 35 aa, Artificial Sequence
  Description of Artificial Sequence: Synthetic polypeptide
DEDEIATTNPVATEQYGSVCSPPPNLQNDDLGAQA

SEQ ID NO: 129931 - protein, 38 aa, Artificial Sequence
  Description of Artificial Sequence: Synthetic polypeptide
DEEEIRTTNPVATEQYGSVSTTNNQNQNGTEQGTNQET

SEQ ID NO: 129932 - protein, 35 aa, Artificial Sequence
  Description of Artificial Sequence: Synthetic polypeptide
DESEIRTTNPVATECWGSVSMCYNEPQDREGENYG

SEQ ID NO: 129933 - protein, 38 aa, Artificial Sequence
  Description of Artificial Sequence: Synthetic polypeptide
DEEEIRTTNPVATEQYGSVSTTNNQLQQGTEAGTDEQD

SEQ ID NO: 129934 - protein, 34 aa, Artificial Sequence
  Description of Artificial Sequence: Synthetic polypeptide
DEAEIRTTNPVATEQYGQVVCSTGELQNFPSDQS

SEQ ID NO: 129935 - protein, 34 aa, Artificial Sequence
  Description of Artificial Sequence: Synthetic polypeptide
DESEIRTTNPVATECWGSVSMCINEPQDVEGENG

SEQ ID NO: 129936 - protein, 33 aa, Artificial Sequence
  Description of Artificial Sequence: Synthetic polypeptide
DMEEIGTTNPVATEQYGSVWTNAWIERPEVQQE

SEQ ID NO: 129937 - protein, 34 aa, Artificial Sequence
  Description of Artificial Sequence: Synthetic polypeptide
CEEEIRTTNPVGYERYGESVSTGAPSHRGGDNRM

SEQ ID NO: 129938 - protein, 34 aa, Artificial Sequence
  Description of Artificial Sequence: Synthetic polypeptide
CEEEIRTTNPVGYERYGESVCTNAPSQPGGDNRM

SEQ ID NO: 129939 - protein, 34 aa, Artificial Sequence
  Description of Artificial Sequence: Synthetic polypeptide
CEEEIRTTNPVGYERYGEKVSTNASSQRGGDNIK

SEQ ID NO: 129940 - protein, 34 aa, Artificial Sequence
  Description of Artificial Sequence: Synthetic polypeptide
CEEEIRTTNPVGYERDGESVSTNAPSQQGGDNRM

SEQ ID NO: 129941 - protein, 34 aa, Artificial Sequence
  Description of Artificial Sequence: Synthetic polypeptide
DESEIRTTNPVATECWGSVSNCINEPQDREGEEG

SEQ ID NO: 129942 - protein, 36 aa, Artificial Sequence
  Description of Artificial Sequence: Synthetic polypeptide
DENEIRTTNPVATEQYGSVNSVPQEQLDQHGGNEHN

SEQ ID NO: 129943 - protein, 36 aa, Artificial Sequence
  Description of Artificial Sequence: Synthetic polypeptide
DENEIRTTNPVATEQYGSVNSVPEQLDQHGQNEPHN

SEQ ID NO: 129944 - protein, 35 aa, Artificial Sequence
  Description of Artificial Sequence: Synthetic polypeptide
DENEIRTTNPVATEQYGSVNSTNPDDEGSGQEEAP

SEQ ID NO: 129945 - protein, 33 aa, Artificial Sequence
  Description of Artificial Sequence: Synthetic polypeptide
DEDEIRTTNPVAYEQWGSVVGGNDNMQNTGNSG

SEQ ID NO: 129946 - protein, 34 aa, Artificial Sequence
  Description of Artificial Sequence: Synthetic polypeptide
CEEEIRTTNPVGYERYGEEVSTNAPSQKGGDNRM

SEQ ID NO: 129947 - protein, 34 aa, Artificial Sequence
  Description of Artificial Sequence: Synthetic polypeptide
DESEIRTTNPVATECWGSVSNCIDEPQDREGENG

SEQ ID NO: 129948 - protein, 33 aa, Artificial Sequence
  Description of Artificial Sequence: Synthetic polypeptide
DENEIRTTNPVATEQYGSVNDCDTEQGGTQGEQ

SEQ ID NO: 129949 - protein, 38 aa, Artificial Sequence
  Description of Artificial Sequence: Synthetic polypeptide
DEEEIRTTNPVATEQYGSVSTTNNQQNQQQGTNNVATE

SEQ ID NO: 129950 - protein, 34 aa, Artificial Sequence
  Description of Artificial Sequence: Synthetic polypeptide
CEEEIRTTNPVGYERYGEKVCTNAPSQRGGDNRP

SEQ ID NO: 129951 - protein, 37 aa, Artificial Sequence
  Description of Artificial Sequence: Synthetic polypeptide
DEEEIRTTNPVATEQYGSVSTTNNQQNQQGTTEQGSQ

SEQ ID NO: 129952 - protein, 34 aa, Artificial Sequence
  Description of Artificial Sequence: Synthetic polypeptide
CEEEIRTTNPVGYERYGEKVSLNAPSQRGGDNRS

SEQ ID NO: 129953 - protein, 34 aa, Artificial Sequence
  Description of Artificial Sequence: Synthetic polypeptide
CEEEIRTTNPVGYERYGEKVSTNAPSNRGGDNRM

SEQ ID NO: 129954 - protein, 35 aa, Artificial Sequence
  Description of Artificial Sequence: Synthetic polypeptide
CEEEIRTTNPVGYERYGEKVSTNAPSQQRGGMNRS

SEQ ID NO: 129955 - protein, 36 aa, Artificial Sequence
  Description of Artificial Sequence: Synthetic polypeptide
DEDEIATTNPVATEQYGSVCSTNNELQEHQDDNLAG

SEQ ID NO: 129956 - protein, 33 aa, Artificial Sequence
  Description of Artificial Sequence: Synthetic polypeptide
DEQEIATTNPVATEQYGSVSATDGEDEEGQEDL

SEQ ID NO: 129957 - protein, 34 aa, Artificial Sequence
  Description of Artificial Sequence: Synthetic polypeptide
DENEIRTTNPVATEQYGSVMSQNNIFNENMNADD

SEQ ID NO: 129958 - protein, 36 aa, Artificial Sequence
  Description of Artificial Sequence: Synthetic polypeptide
DEEEIRTTNPVATEQYGSVSPLSNYYQPTENEVDDQ

SEQ ID NO: 129959 - protein, 35 aa, Artificial Sequence
  Description of Artificial Sequence: Synthetic polypeptide
CEEEIRTTNPVGYERYGQKVSTNAPSQFRGGDNRS

SEQ ID NO: 129960 - protein, 34 aa, Artificial Sequence
  Description of Artificial Sequence: Synthetic polypeptide
DEAEIRTTNPVATEQYGQVCTPDPDLNREENTQH

SEQ ID NO: 129961 - protein, 35 aa, Artificial Sequence
  Description of Artificial Sequence: Synthetic polypeptide
DEEEIRTTNPVATEQYGSVSPIWPQTEENENGPFE

SEQ ID NO: 129962 - protein, 35 aa, Artificial Sequence
  Description of Artificial Sequence: Synthetic polypeptide
CEEEIRTTNPVGYERYGQSISTNATSQTRGGDNRM

SEQ ID NO: 129963 - protein, 34 aa, Artificial Sequence
  Description of Artificial Sequence: Synthetic polypeptide
DEQEIATTNPVATEQYGSVSATDHNEDYQGLEDE

SEQ ID NO: 129964 - protein, 36 aa, Artificial Sequence
  Description of Artificial Sequence: Synthetic polypeptide
DMEEIRTTNPVATEQYGSVISTTPAGPNMRNGMNPV

SEQ ID NO: 129965 - protein, 36 aa, Artificial Sequence
  Description of Artificial Sequence: Synthetic polypeptide
CEEEIRTTNPVGYERYGQSVSCTDNAVSQRGGDNRM

SEQ ID NO: 129966 - protein, 36 aa, Artificial Sequence
  Description of Artificial Sequence: Synthetic polypeptide
CEEEIRTTNPVGYERYGQSVSITNATSQPRGGDNRM

SEQ ID NO: 129967 - protein, 36 aa, Artificial Sequence
  Description of Artificial Sequence: Synthetic polypeptide
DMEEIRTTNPVATEQYGSVSGTTPAGPNMRNGMNPV

SEQ ID NO: 129968 - protein, 36 aa, Artificial Sequence
  Description of Artificial Sequence: Synthetic polypeptide
DMEEIRTTNPVATEQYGSVSSTTPAGPNKRNGMNPV

SEQ ID NO: 129969 - protein, 36 aa, Artificial Sequence
  Description of Artificial Sequence: Synthetic polypeptide
DMEEIRTTNPVATEQYGSVSSTTPAGPNMRNGMNMV

SEQ ID NO: 129970 - protein, 36 aa, Artificial Sequence
  Description of Artificial Sequence: Synthetic polypeptide
DMEEIRTTNPVATEQYGSVSSTTPAGPNMRNGMNPV

SEQ ID NO: 129971 - protein, 36 aa, Artificial Sequence
  Description of Artificial Sequence: Synthetic polypeptide
DMEEIRTTNPVATEQYGSVSSTTPAGTNMRNGMNPV

SEQ ID NO: 129972 - protein, 34 aa, Artificial Sequence
  Description of Artificial Sequence: Synthetic polypeptide
CEEEIRTTNPVGYERYGQSVSTNATSPDGGDNRM

SEQ ID NO: 129973 - protein, 32 aa, Artificial Sequence
  Description of Artificial Sequence: Synthetic polypeptide
DMGEIGTTNPVATEQYGSSPTNNLNERPEVQQ

SEQ ID NO: 129974 - protein, 33 aa, Artificial Sequence
  Description of Artificial Sequence: Synthetic polypeptide
DENEIRTTNPVATEQYGSVFNVPLDEMISDNQE

SEQ ID NO: 129975 - protein, 34 aa, Artificial Sequence
  Description of Artificial Sequence: Synthetic polypeptide
DENEIRTTNPVATEQYGSVFDSMVLEGEGDEMTN

SEQ ID NO: 129976 - protein, 33 aa, Artificial Sequence
  Description of Artificial Sequence: Synthetic polypeptide
DENEIRTTNPVATEQYGSVFADENQEILCEERQ

SEQ ID NO: 129977 - protein, 32 aa, Artificial Sequence
  Description of Artificial Sequence: Synthetic polypeptide
DMQEIATTNPVATEQYGDVSATDLEDHEGYDL

SEQ ID NO: 129978 - protein, 33 aa, Artificial Sequence
  Description of Artificial Sequence: Synthetic polypeptide
DMQEIATTNPVATEQYGSVFSATDLEDHEGEDL

SEQ ID NO: 129979 - protein, 33 aa, Artificial Sequence
  Description of Artificial Sequence: Synthetic polypeptide
DENEIRTTNPVATEQYGSVETTYDTEITGEDQV

SEQ ID NO: 129980 - protein, 35 aa, Artificial Sequence
  Description of Artificial Sequence: Synthetic polypeptide
CEEEIRTTNPVGYERYGQSVSTNAVSQEIGGDNRM

SEQ ID NO: 129981 - protein, 34 aa, Artificial Sequence
  Description of Artificial Sequence: Synthetic polypeptide
DEDEIRTTNPVAYEQWGVTVPTDNGDQAGGGNNR

SEQ ID NO: 129982 - protein, 36 aa, Artificial Sequence
  Description of Artificial Sequence: Synthetic polypeptide
DEEEIRTTNPVATEQYGSVSPIINLGVIDNEVANLN

SEQ ID NO: 129983 - protein, 35 aa, Artificial Sequence
  Description of Artificial Sequence: Synthetic polypeptide
DENEIRTTNPVATEQYGSVNTPLWEQMEYDEIDNC

SEQ ID NO: 129984 - protein, 35 aa, Artificial Sequence
  Description of Artificial Sequence: Synthetic polypeptide
DEEEIRTTNPVATEQYGSVSPIINNEQAVVVFQSH

SEQ ID NO: 129985 - protein, 34 aa, Artificial Sequence
  Description of Artificial Sequence: Synthetic polypeptide
DEQEIATTNPVATEQYGSVSATDHLLEDNEGEDL

SEQ ID NO: 129986 - protein, 37 aa, Artificial Sequence
  Description of Artificial Sequence: Synthetic polypeptide
DEEEIRTTNPVATEQYGSVSTTNNQAGTEQGTTEDED

SEQ ID NO: 129987 - protein, 37 aa, Artificial Sequence
  Description of Artificial Sequence: Synthetic polypeptide
DEEEIRTTNPVATEQYGSVSTTNNQAGTEQGGTEDTE

SEQ ID NO: 129988 - protein, 35 aa, Artificial Sequence
  Description of Artificial Sequence: Synthetic polypeptide
DEEEIRTTNPVATEQYGSVSPISDMEHQAMMNIMT

SEQ ID NO: 129989 - protein, 35 aa, Artificial Sequence
  Description of Artificial Sequence: Synthetic polypeptide
DEEEIRTTNPVATEQYGSVSPIPDLKESGAMEEED

SEQ ID NO: 129990 - protein, 34 aa, Artificial Sequence
  Description of Artificial Sequence: Synthetic polypeptide
DEQEIATTNPVATEQYGSVSATDGQEDNEGEEDL

SEQ ID NO: 129991 - protein, 35 aa, Artificial Sequence
  Description of Artificial Sequence: Synthetic polypeptide
DESEIRTTNPVATECWGSVSLCINWEPQDREGENG

SEQ ID NO: 129992 - protein, 34 aa, Artificial Sequence
  Description of Artificial Sequence: Synthetic polypeptide
DESEIRTTNPVATECWGSVSLCINEPQFREWENG

SEQ ID NO: 129993 - protein, 36 aa, Artificial Sequence
  Description of Artificial Sequence: Synthetic polypeptide
DENEIRTTNPVATEQYGSVISVTDTDLQTGPEEQYE

SEQ ID NO: 129994 - protein, 36 aa, Artificial Sequence
  Description of Artificial Sequence: Synthetic polypeptide
CEEEIRTTNPVGYERYGQSLVSDTNATSQRGGDNRM

SEQ ID NO: 129995 - protein, 34 aa, Artificial Sequence
  Description of Artificial Sequence: Synthetic polypeptide
CEEEIRTTNPVGYERYGQSVNTNATSSRGGDNRM

SEQ ID NO: 129996 - protein, 34 aa, Artificial Sequence
  Description of Artificial Sequence: Synthetic polypeptide
DESEIRTTNPVATECWGSVSLCINEPQDREQENG

SEQ ID NO: 129997 - protein, 35 aa, Artificial Sequence
  Description of Artificial Sequence: Synthetic polypeptide
DEEEIRTTNPVATEQYGSVSPIPDHHQQIDNDYLI

SEQ ID NO: 129998 - protein, 38 aa, Artificial Sequence
  Description of Artificial Sequence: Synthetic polypeptide
DEEEIRTTNPVATEQYGSVSTTNNNQQGNNQQGNTEEE

SEQ ID NO: 129999 - protein, 38 aa, Artificial Sequence
  Description of Artificial Sequence: Synthetic polypeptide
DEEEIRTTNPVATEQYGSVSTTNNNQISTTEQGVNNGN

SEQ ID NO: 130000 - protein, 34 aa, Artificial Sequence
  Description of Artificial Sequence: Synthetic polypeptide
DENEIRTTNPVATEQYGSVISADSLEQNMVTQDD

SEQ ID NO: 130001 - protein, 34 aa, Artificial Sequence
  Description of Artificial Sequence: Synthetic polypeptide
DEDEIRTTNPVAYEQWGTVVPTDNGDSQHGGVNR

SEQ ID NO: 130002 - protein, 35 aa, Artificial Sequence
  Description of Artificial Sequence: Synthetic polypeptide
DEDEIRTTNPVAYEQWGTVVPTDNLGDQAGGNMNR

SEQ ID NO: 130003 - protein, 38 aa, Artificial Sequence
  Description of Artificial Sequence: Synthetic polypeptide
DEEEIRTTNPVATEQYGSVSTTNNNQAGTEQGTETGND

SEQ ID NO: 130004 - protein, 35 aa, Artificial Sequence
  Description of Artificial Sequence: Synthetic polypeptide
DESEIRTTNPVATECWGSVSLCINEPQDREGENFG

SEQ ID NO: 130005 - protein, 35 aa, Artificial Sequence
  Description of Artificial Sequence: Synthetic polypeptide
DEDEIATTNPVATEQYGSVCATNPMQTGNQTEGTD

SEQ ID NO: 130006 - protein, 33 aa, Artificial Sequence
  Description of Artificial Sequence: Synthetic polypeptide
DLSEIRTTNPVATQCWGSVSCINEPQDREGENG

SEQ ID NO: 130007 - protein, 33 aa, Artificial Sequence
  Description of Artificial Sequence: Synthetic polypeptide
DEQEIATTNPVATEQYGSVSATDFEDHEGYEDL

SEQ ID NO: 130008 - protein, 34 aa, Artificial Sequence
  Description of Artificial Sequence: Synthetic polypeptide
DENEIRTTNPVATEQYGSVNVPVDTLDERSNEHN

SEQ ID NO: 130009 - protein, 32 aa, Artificial Sequence
  Description of Artificial Sequence: Synthetic polypeptide
DGQEIATTNPVATEIYGSVSATDLEDHEGEDL

SEQ ID NO: 130010 - protein, 32 aa, Artificial Sequence
  Description of Artificial Sequence: Synthetic polypeptide
DGQEIATTNPVATEQYGHVSATDLEDHEGEDL

SEQ ID NO: 130011 - protein, 38 aa, Artificial Sequence
  Description of Artificial Sequence: Synthetic polypeptide
DEEEIRTTNPVATEQYGSVSTTNQLQQNATEQGTTQEE

SEQ ID NO: 130012 - protein, 33 aa, Artificial Sequence
  Description of Artificial Sequence: Synthetic polypeptide
DGQEIATTNPVATEQYGSVSATDLDEDHEGEDL

SEQ ID NO: 130013 - protein, 36 aa, Artificial Sequence
  Description of Artificial Sequence: Synthetic polypeptide
DEEEIRTTNPVATEQYGSVSPNLAMMMQEEMEEEVN

SEQ ID NO: 130014 - protein, 34 aa, Artificial Sequence
  Description of Artificial Sequence: Synthetic polypeptide
DEAEIRTTNPVATEQYGSCYVSPAHYTGSMQSDN

SEQ ID NO: 130015 - protein, 33 aa, Artificial Sequence
  Description of Artificial Sequence: Synthetic polypeptide
DGQEIATTNPVATEQYGSVSATDLEDHEGIEDL

SEQ ID NO: 130016 - protein, 33 aa, Artificial Sequence
  Description of Artificial Sequence: Synthetic polypeptide
DGQEIATTNPVATEQYGSVSATMLEDHEGCEDL

SEQ ID NO: 130017 - protein, 33 aa, Artificial Sequence
  Description of Artificial Sequence: Synthetic polypeptide
DGSEIRTTNPVATECWGSLSCINEQQREGENGK

SEQ ID NO: 130018 - protein, 33 aa, Artificial Sequence
  Description of Artificial Sequence: Synthetic polypeptide
DEAEIRTTNPVATEQYGSCYTWLIEYESINDQM

SEQ ID NO: 130019 - protein, 36 aa, Artificial Sequence
  Description of Artificial Sequence: Synthetic polypeptide
DEAEIRTTNPVATEQYGSCVWTSMLEELRNGNEEVF

SEQ ID NO: 130020 - protein, 35 aa, Artificial Sequence
  Description of Artificial Sequence: Synthetic polypeptide
DEEEIRTTNPVATEQYGSVSPNIDDQMMQQVQLQQ

SEQ ID NO: 130021 - protein, 34 aa, Artificial Sequence
  Description of Artificial Sequence: Synthetic polypeptide
DGSEIRTTNPVATECWGSVSMCINEPQDREGENG

SEQ ID NO: 130022 - protein, 33 aa, Artificial Sequence
  Description of Artificial Sequence: Synthetic polypeptide
DENEIRTTNPVATEQYGSVSADMEDMETDQNVN

SEQ ID NO: 130023 - protein, 33 aa, Artificial Sequence
  Description of Artificial Sequence: Synthetic polypeptide
DENEIRTTNPVATEQYGSVSADESQEILLEEDN

SEQ ID NO: 130024 - protein, 34 aa, Artificial Sequence
  Description of Artificial Sequence: Synthetic polypeptide
DENEIRTTNPVATEQYGSVSADENIAEILCEERN

SEQ ID NO: 130025 - protein, 35 aa, Artificial Sequence
  Description of Artificial Sequence: Synthetic polypeptide
DEDEIRTTNPVAYEQWGSVSTTNAGNQQNDHNQER

SEQ ID NO: 130026 - protein, 33 aa, Artificial Sequence
  Description of Artificial Sequence: Synthetic polypeptide
DEAEIRTTNPVATEQYGSCSVSYWEHQPELEQA

SEQ ID NO: 130027 - protein, 33 aa, Artificial Sequence
  Description of Artificial Sequence: Synthetic polypeptide
DEQEIATTNPVATEQYGSVSATDCYDDHEGEDL

SEQ ID NO: 130028 - protein, 39 aa, Artificial Sequence
  Description of Artificial Sequence: Synthetic polypeptide
DEEEIRTTNPVATEQYGSVSTTNQNLQSGTVEQGTNQEE

SEQ ID NO: 130029 - protein, 32 aa, Artificial Sequence
  Description of Artificial Sequence: Synthetic polypeptide
DEAEIRTTNPVATEQYGSCSVLWWGQPELEQA

SEQ ID NO: 130030 - protein, 34 aa, Artificial Sequence
  Description of Artificial Sequence: Synthetic polypeptide
DEDEIRTTNPVAYEQWGSVSTTNAGNQNEDHNDP

SEQ ID NO: 130031 - protein, 33 aa, Artificial Sequence
  Description of Artificial Sequence: Synthetic polypeptide
DEQEIATTNPVATEQYGSVSATDCEDHEGFEDL

SEQ ID NO: 130032 - protein, 38 aa, Artificial Sequence
  Description of Artificial Sequence: Synthetic polypeptide
DEEEIRTTNPVATEQYGSVSTTNQNNQISTEQGTTNGQ

SEQ ID NO: 130033 - protein, 35 aa, Artificial Sequence
  Description of Artificial Sequence: Synthetic polypeptide
DEEEIRTTNPVATEQYGSVSYEQNMDQEIISELIE

SEQ ID NO: 130034 - protein, 33 aa, Artificial Sequence
  Description of Artificial Sequence: Synthetic polypeptide
DEQEIATTNPVATEQYGSVSATDAGEDHEGEDL

SEQ ID NO: 130035 - protein, 33 aa, Artificial Sequence
  Description of Artificial Sequence: Synthetic polypeptide
DENEIRTTNPVATEQYGSVSCVPPIDQLFSQEH

SEQ ID NO: 130036 - protein, 33 aa, Artificial Sequence
  Description of Artificial Sequence: Synthetic polypeptide
DENEIRTTNPVATEQYGSVSCVPPDQLFSQEPT

SEQ ID NO: 130037 - protein, 36 aa, Artificial Sequence
  Description of Artificial Sequence: Synthetic polypeptide
DEEEIRTTNPVATEQYGSVSYEVYLQQDVTEEAGGE

SEQ ID NO: 130038 - protein, 35 aa, Artificial Sequence
  Description of Artificial Sequence: Synthetic polypeptide
DEEEIRTTNPVATEQYGSVSPNTHDAEAIPNSPET

SEQ ID NO: 130039 - protein, 36 aa, Artificial Sequence
  Description of Artificial Sequence: Synthetic polypeptide
DEEEIRTTNPVATEQYGSVSPNSWNQSGGAIEELTD

SEQ ID NO: 130040 - protein, 35 aa, Artificial Sequence
  Description of Artificial Sequence: Synthetic polypeptide
DENEIRTTNPVATEQYGSVSCTGLMPEFGGGSISM

SEQ ID NO: 130041 - protein, 38 aa, Artificial Sequence
  Description of Artificial Sequence: Synthetic polypeptide
DEEEIRTTNPVATEQYGSVSTTNQNNQISTEQGTNQEN

SEQ ID NO: 130042 - protein, 38 aa, Artificial Sequence
  Description of Artificial Sequence: Synthetic polypeptide
DEEEIRTTNPVATEQYGSVSTTNQNNQISTEQGTNNQE

SEQ ID NO: 130043 - protein, 34 aa, Artificial Sequence
  Description of Artificial Sequence: Synthetic polypeptide
DENEIRTTNPVATEQYGSVSCIGNMDEGGGSIIM

SEQ ID NO: 130044 - protein, 36 aa, Artificial Sequence
  Description of Artificial Sequence: Synthetic polypeptide
DENEIRTTNPVATEQYGSVSAYDNALNQPQGEDDSF

SEQ ID NO: 130045 - protein, 38 aa, Artificial Sequence
  Description of Artificial Sequence: Synthetic polypeptide
DEEEIRTTNPVATEQYGSVSTTNQNNQISTEQGNNNGN

SEQ ID NO: 130046 - protein, 35 aa, Artificial Sequence
  Description of Artificial Sequence: Synthetic polypeptide
DENEIRTTNPVATEQYGSVSATTNATEYEGMSDQS

SEQ ID NO: 130047 - protein, 36 aa, Artificial Sequence
  Description of Artificial Sequence: Synthetic polypeptide
DEEEIRTTNPVATEQYGSVSPNMWNESGGQIEENMD

SEQ ID NO: 130048 - protein, 35 aa, Artificial Sequence
  Description of Artificial Sequence: Synthetic polypeptide
DEEEIRTTNPVATEQYGSVSPNMNEVIERAMHHVD

SEQ ID NO: 130049 - protein, 34 aa, Artificial Sequence
  Description of Artificial Sequence: Synthetic polypeptide
DENEIRTTNPVATEQYGSVSATDQATEYEGSDQS

SEQ ID NO: 130050 - protein, 38 aa, Artificial Sequence
  Description of Artificial Sequence: Synthetic polypeptide
DEEEIRTTNPVATEQYGSVSTTNQNNQIGTEQGTNTGN

SEQ ID NO: 130051 - protein, 34 aa, Artificial Sequence
  Description of Artificial Sequence: Synthetic polypeptide
DEDEIRTTNPVAYEQWGSVSTTNAGNQENDHNEP

SEQ ID NO: 130052 - protein, 33 aa, Artificial Sequence
  Description of Artificial Sequence: Synthetic polypeptide
DENEIRTTNPVATEQYGSVDCANDPTQDIQQEV

SEQ ID NO: 130053 - protein, 34 aa, Artificial Sequence
  Description of Artificial Sequence: Synthetic polypeptide
DEQEIATTNPVATEQYGSVSATDDEEGQEGEDGD

SEQ ID NO: 130054 - protein, 34 aa, Artificial Sequence
  Description of Artificial Sequence: Synthetic polypeptide
DEQEIATTNPVATEQYGSVSATDDGEDQEGEEDG

SEQ ID NO: 130055 - protein, 33 aa, Artificial Sequence
  Description of Artificial Sequence: Synthetic polypeptide
DEQEIATTNPVATEQYGSVSATDEEDHEGEDLW

SEQ ID NO: 130056 - protein, 33 aa, Artificial Sequence
  Description of Artificial Sequence: Synthetic polypeptide
DEQEIATTNPVATEQYGSVSATDEEDHEGEEDL

SEQ ID NO: 130057 - protein, 33 aa, Artificial Sequence
  Description of Artificial Sequence: Synthetic polypeptide
DISDIRTTNPVATECWGSVSCINEPQDREGENG

SEQ ID NO: 130058 - protein, 33 aa, Artificial Sequence
  Description of Artificial Sequence: Synthetic polypeptide
DISEIHTTNPVATECWGSVSCINEPQDREGENG

SEQ ID NO: 130059 - protein, 33 aa, Artificial Sequence
  Description of Artificial Sequence: Synthetic polypeptide
DISEIRTTNPVATECWGSVSCICEPQDREGENG

SEQ ID NO: 130060 - protein, 34 aa, Artificial Sequence
  Description of Artificial Sequence: Synthetic polypeptide
DEDEIRTTNPVAYEQWGSVSTTNGNDNHQGDGVY

SEQ ID NO: 130061 - protein, 34 aa, Artificial Sequence
  Description of Artificial Sequence: Synthetic polypeptide
DISEIRTTNPVATECWGSVSCINEPQDREGENGQ

SEQ ID NO: 130062 - protein, 34 aa, Artificial Sequence
  Description of Artificial Sequence: Synthetic polypeptide
DISEIRTTNPVATECWGSVSSCINEPQDREGENG

SEQ ID NO: 130063 - protein, 37 aa, Artificial Sequence
  Description of Artificial Sequence: Synthetic polypeptide
DEEEIRTTNPVATEQYGSVSTTNQAGNNNEQGTNSDE

SEQ ID NO: 130064 - protein, 34 aa, Artificial Sequence
  Description of Artificial Sequence: Synthetic polypeptide
DEQEIATTNPVATEQYGSVSATDELSEEHTGEDL

SEQ ID NO: 130065 - protein, 35 aa, Artificial Sequence
  Description of Artificial Sequence: Synthetic polypeptide
CEEEIRTTNPVGYEHYGEKVSTTNAPSQRGGDNRS

SEQ ID NO: 130066 - protein, 35 aa, Artificial Sequence
  Description of Artificial Sequence: Synthetic polypeptide
CEEEIRTTNPVGYENYGQSVVSTNAVSQGGGDNRM

SEQ ID NO: 130067 - protein, 32 aa, Artificial Sequence
  Description of Artificial Sequence: Synthetic polypeptide
DLQEIATTNPVATEQYGSVSAQDLEDHEGEDL

SEQ ID NO: 130068 - protein, 32 aa, Artificial Sequence
  Description of Artificial Sequence: Synthetic polypeptide
DEQEIATTNPVATEQYGSVSATDEMDHAEEDL

SEQ ID NO: 130069 - protein, 33 aa, Artificial Sequence
  Description of Artificial Sequence: Synthetic polypeptide
DLQEIATTNPVATEQYGSVSATDLEDHEGEEDL

SEQ ID NO: 130070 - protein, 32 aa, Artificial Sequence
  Description of Artificial Sequence: Synthetic polypeptide
DLQEIATTNPVATEQYGSVSATDLEDHEMEDL

SEQ ID NO: 130071 - protein, 33 aa, Artificial Sequence
  Description of Artificial Sequence: Synthetic polypeptide
DLQEIATTNPVATEQYGSVSATRDLEDHEGEDL

SEQ ID NO: 130072 - protein, 35 aa, Artificial Sequence
  Description of Artificial Sequence: Synthetic polypeptide
DEAEIRTTNPVATEQYGSCNWTLDLTQRSLQNEGN

SEQ ID NO: 130073 - protein, 34 aa, Artificial Sequence
  Description of Artificial Sequence: Synthetic polypeptide
DESEIRTTNPVATECWGSVSNCINEPQDREGEPG

SEQ ID NO: 130074 - protein, 33 aa, Artificial Sequence
  Description of Artificial Sequence: Synthetic polypeptide
DHSEIRTTNPVATECWGYVSCINEPQDREGENG

SEQ ID NO: 130075 - protein, 35 aa, Artificial Sequence
  Description of Artificial Sequence: Synthetic polypeptide
DEDEIRTTNPVAYEQWGSVSTTNAGNQRNDMNGPD

SEQ ID NO: 130076 - protein, 38 aa, Artificial Sequence
  Description of Artificial Sequence: Synthetic polypeptide
DEEEIRTTNPVATEQYGSVSTTNQAQGNNNQQGTNNVE

SEQ ID NO: 130077 - protein, 35 aa, Artificial Sequence
  Description of Artificial Sequence: Synthetic polypeptide
DEAEIRTTNPVATEQYGSCNWVSPLLEQRTQIALG

SEQ ID NO: 130078 - protein, 34 aa, Artificial Sequence
  Description of Artificial Sequence: Synthetic polypeptide
DENEIRTTNPVATEQYGSVQTYLVIESAAQSSLI

SEQ ID NO: 130079 - protein, 35 aa, Artificial Sequence
  Description of Artificial Sequence: Synthetic polypeptide
DESEIRTTNPVATECWGSVSNGINEPQDRKGENGM

SEQ ID NO: 130080 - protein, 34 aa, Artificial Sequence
  Description of Artificial Sequence: Synthetic polypeptide
DEAEIRTTNPVATEQYGSCSTPVAWTQRTQQHEH

SEQ ID NO: 130081 - protein, 32 aa, Artificial Sequence
  Description of Artificial Sequence: Synthetic polypeptide
DENEIRTTNPVATEQYGSVQTMEVISAAQSLI

SEQ ID NO: 130082 - protein, 32 aa, Artificial Sequence
  Description of Artificial Sequence: Synthetic polypeptide
DHQEIASTNPVATEQYGSVSATDLEDHEGEDL

SEQ ID NO: 130083 - protein, 33 aa, Artificial Sequence
  Description of Artificial Sequence: Synthetic polypeptide
DHQEIATTNPVATEQYGSVSATDKLEDHEGEDL

SEQ ID NO: 130084 - protein, 35 aa, Artificial Sequence
  Description of Artificial Sequence: Synthetic polypeptide
DEEEIRTTNPVATEQYGSVSPNEVHQAQQTVETGE

SEQ ID NO: 130085 - protein, 36 aa, Artificial Sequence
  Description of Artificial Sequence: Synthetic polypeptide
DEEEIRTTNPVATEQYGSVSPNENQMVEERLLMPQT

SEQ ID NO: 130086 - protein, 35 aa, Artificial Sequence
  Description of Artificial Sequence: Synthetic polypeptide
DEAEIRTTNPVATEQYGSCSESWEQYDRIGSNNGE

SEQ ID NO: 130087 - protein, 34 aa, Artificial Sequence
  Description of Artificial Sequence: Synthetic polypeptide
DEAEIRTTNPVATEQYGSCSDYQLQTGEGQSEDN

SEQ ID NO: 130088 - protein, 33 aa, Artificial Sequence
  Description of Artificial Sequence: Synthetic polypeptide
DHSEIRFTNPVATECWGSVSCINEPQDREGENG

SEQ ID NO: 130089 - protein, 33 aa, Artificial Sequence
  Description of Artificial Sequence: Synthetic polypeptide
DHSEIRTTNPVAMECWGSVSCINEPQDREGENG

SEQ ID NO: 130090 - protein, 36 aa, Artificial Sequence
  Description of Artificial Sequence: Synthetic polypeptide
CEEEIRTTNPVGTERYGESVASCTNAPSQAGGDNRM

SEQ ID NO: 130091 - protein, 34 aa, Artificial Sequence
  Description of Artificial Sequence: Synthetic polypeptide
DEQEIATTNPVATEQYGSVSATDDLKEDHEGEDL

SEQ ID NO: 130092 - protein, 34 aa, Artificial Sequence
  Description of Artificial Sequence: Synthetic polypeptide
DEQEIATTNPVATEQYGSVSATDDNEEDEEGEDL

SEQ ID NO: 130093 - protein, 33 aa, Artificial Sequence
  Description of Artificial Sequence: Synthetic polypeptide
DHSEIRTTNPVATECWGSVSCINEPCDREGENG

SEQ ID NO: 130094 - protein, 33 aa, Artificial Sequence
  Description of Artificial Sequence: Synthetic polypeptide
DHSEIRTTNPVATECWGSVSCINEPQDEEGENG

SEQ ID NO: 130095 - protein, 33 aa, Artificial Sequence
  Description of Artificial Sequence: Synthetic polypeptide
DEQEIATTNPVATEQYGSVSATDDYEDHEGEDL

SEQ ID NO: 130096 - protein, 35 aa, Artificial Sequence
  Description of Artificial Sequence: Synthetic polypeptide
CEEEIRTTNPVGTERYGEVVSCTNAPSDRGGDNRM

SEQ ID NO: 130097 - protein, 34 aa, Artificial Sequence
  Description of Artificial Sequence: Synthetic polypeptide
DESEIRTTNPVATECWGSVSNCINEPQEREGEPG

SEQ ID NO: 130098 - protein, 33 aa, Artificial Sequence
  Description of Artificial Sequence: Synthetic polypeptide
DEDEIRTTNPVAYEQWGVVAGDNNGDQRNGNGG

SEQ ID NO: 130099 - protein, 35 aa, Artificial Sequence
  Description of Artificial Sequence: Synthetic polypeptide
DENEIRTTNPVATEQYGSVCYVTWPLNEDIGNQEM

SEQ ID NO: 130100 - protein, 35 aa, Artificial Sequence
  Description of Artificial Sequence: Synthetic polypeptide
DEDEIATTNPVATEQYGSVCATNPMQQRNQDQGTV

SEQ ID NO: 130101 - protein, 35 aa, Artificial Sequence
  Description of Artificial Sequence: Synthetic polypeptide
DPEEIGTTNPVATEQYGSVSWPVHQINEEQQGNPL

SEQ ID NO: 130102 - protein, 35 aa, Artificial Sequence
  Description of Artificial Sequence: Synthetic polypeptide
DEEEIRTTNPVATEQYGSVSPDAYTLEVNGVEESD

SEQ ID NO: 130103 - protein, 36 aa, Artificial Sequence
  Description of Artificial Sequence: Synthetic polypeptide
DPEEIRTTNPVATEQYGSVMSTTPAGPNMRNGMNPV

SEQ ID NO: 130104 - protein, 36 aa, Artificial Sequence
  Description of Artificial Sequence: Synthetic polypeptide
DPEEIRTTNPVATEQYGSVSQTTPAGHNMRNGMNPV

SEQ ID NO: 130105 - protein, 36 aa, Artificial Sequence
  Description of Artificial Sequence: Synthetic polypeptide
DENEIRTTNPVATEQYGSIVSVDALEQTGGSQEPNF

SEQ ID NO: 130106 - protein, 32 aa, Artificial Sequence
  Description of Artificial Sequence: Synthetic polypeptide
DEAEIRTTNPVATEQYGQCVCQTAHIHMSNQS

SEQ ID NO: 130107 - protein, 35 aa, Artificial Sequence
  Description of Artificial Sequence: Synthetic polypeptide
DENEIRTTNPVATEQYGSISTTPDGPNMRNGMNPV

SEQ ID NO: 130108 - protein, 36 aa, Artificial Sequence
  Description of Artificial Sequence: Synthetic polypeptide
DPEEIRTTNPVATEQYGSVSSTLPAGPNMRNGMNPV

SEQ ID NO: 130109 - protein, 36 aa, Artificial Sequence
  Description of Artificial Sequence: Synthetic polypeptide
DPEEIRTTNPVATEQYGSVSSTTPAGPNMRNGMNPV

SEQ ID NO: 130110 - protein, 36 aa, Artificial Sequence
  Description of Artificial Sequence: Synthetic polypeptide
DEEEIRTTNPVATEQYGSVSPDAVSSIINEASGNHL

SEQ ID NO: 130111 - protein, 34 aa, Artificial Sequence
  Description of Artificial Sequence: Synthetic polypeptide
DEEEIRTTNPVATEQYGSVSPASQAPDDQIMMID

SEQ ID NO: 130112 - protein, 35 aa, Artificial Sequence
  Description of Artificial Sequence: Synthetic polypeptide
DEEEIRTTNPVATEQYGSVSPASNSYPDDQIMEED

SEQ ID NO: 130113 - protein, 33 aa, Artificial Sequence
  Description of Artificial Sequence: Synthetic polypeptide
DPSEIRTTNPVATECWGSVSCINEPRDREGENG

SEQ ID NO: 130114 - protein, 35 aa, Artificial Sequence
  Description of Artificial Sequence: Synthetic polypeptide
DEEEIRTTNPVATEQYGSVSPASNAPDDQMMEIED

SEQ ID NO: 130115 - protein, 35 aa, Artificial Sequence
  Description of Artificial Sequence: Synthetic polypeptide
DEEEIRTTNPVATEQYGSVSPASLVAPDDQIMMED

SEQ ID NO: 130116 - protein, 30 aa, Artificial Sequence
  Description of Artificial Sequence: Synthetic polypeptide
DQAEIATTNPVAYEQWGCCVTWDQGHEGNR

SEQ ID NO: 130117 - protein, 36 aa, Artificial Sequence
  Description of Artificial Sequence: Synthetic polypeptide
DEEEIRTTNPVATEQYGSVSTTNMMWMESNGEEEVC

SEQ ID NO: 130118 - protein, 33 aa, Artificial Sequence
  Description of Artificial Sequence: Synthetic polypeptide
DQAEIRTTNPVATEPYGCTCSTVLSTHGGNNRP

SEQ ID NO: 130119 - protein, 35 aa, Artificial Sequence
  Description of Artificial Sequence: Synthetic polypeptide
DEEEIRTTNPVATEQYGSVTDGEGNLNAEFQGEIQ

SEQ ID NO: 130120 - protein, 35 aa, Artificial Sequence
  Description of Artificial Sequence: Synthetic polypeptide
DEDEIATTNPVATEQYGSVCATNNPEQPGNQTEGD

SEQ ID NO: 130121 - protein, 36 aa, Artificial Sequence
  Description of Artificial Sequence: Synthetic polypeptide
DEEEIRTTNPVATEQYGSVTDGEGNLNMEEIGGNIQ

SEQ ID NO: 130122 - protein, 38 aa, Artificial Sequence
  Description of Artificial Sequence: Synthetic polypeptide
DEEEIRTTNPVATEQYGSVSTTNNANGNNNQQGTNQDE

SEQ ID NO: 130123 - protein, 34 aa, Artificial Sequence
  Description of Artificial Sequence: Synthetic polypeptide
DNSEIRTTNPVATECWGFSVSCINEPQDREGENG

SEQ ID NO: 130124 - protein, 34 aa, Artificial Sequence
  Description of Artificial Sequence: Synthetic polypeptide
DENEIRTTNPVATEQYGSSSGTGTSQQHEGEETN

SEQ ID NO: 130125 - protein, 38 aa, Artificial Sequence
  Description of Artificial Sequence: Synthetic polypeptide
DEEEIRTTNPVATEQYGSVSTTNNGQAGTEQGTEETND

SEQ ID NO: 130126 - protein, 32 aa, Artificial Sequence
  Description of Artificial Sequence: Synthetic polypeptide
DENEIRTTNPVATEQYGSSSAHDTIEGSEEHE

SEQ ID NO: 130127 - protein, 34 aa, Artificial Sequence
  Description of Artificial Sequence: Synthetic polypeptide
DEAEIRTTNPVATEQYGSYWSLDTMNEEIHNQDA

SEQ ID NO: 130128 - protein, 34 aa, Artificial Sequence
  Description of Artificial Sequence: Synthetic polypeptide
DEDEIRTTNPVAYEQYGTVATGNIGQQDAGGNQY

SEQ ID NO: 130129 - protein, 36 aa, Artificial Sequence
  Description of Artificial Sequence: Synthetic polypeptide
DENEIRTTNPVATEQYGSSCVSTCALDEQMNQNIEV

SEQ ID NO: 130130 - protein, 33 aa, Artificial Sequence
  Description of Artificial Sequence: Synthetic polypeptide
DEDEIRTTNPVAYEQYGTVATNEGNGNGQTGEA

SEQ ID NO: 130131 - protein, 33 aa, Artificial Sequence
  Description of Artificial Sequence: Synthetic polypeptide
DNEEIVTTNPVATEQYGTVCSATDGPVEFEGND

SEQ ID NO: 130132 - protein, 32 aa, Artificial Sequence
  Description of Artificial Sequence: Synthetic polypeptide
DNEGIATTNPVATEQYGECVKTPELITHEVNR

SEQ ID NO: 130133 - protein, 36 aa, Artificial Sequence
  Description of Artificial Sequence: Synthetic polypeptide
DEEEIRTTNPVATEQYGSVSPDMENLYPPTNEVDQQ

SEQ ID NO: 130134 - protein, 35 aa, Artificial Sequence
  Description of Artificial Sequence: Synthetic polypeptide
DEEEIRTTNPVATEQYGSVSPDIPLLQMNLEEMIE

SEQ ID NO: 130135 - protein, 32 aa, Artificial Sequence
  Description of Artificial Sequence: Synthetic polypeptide
DNQEIASTNPVATEQYGSVSATDLEDHEGEDL

SEQ ID NO: 130136 - protein, 33 aa, Artificial Sequence
  Description of Artificial Sequence: Synthetic polypeptide
DNQEIATTNPVATEQYGSSVSATDLEDHEGEDL

SEQ ID NO: 130137 - protein, 36 aa, Artificial Sequence
  Description of Artificial Sequence: Synthetic polypeptide
DEEEIRTTNPVATEQYGSVSPDENLIEPTMNEVDQQ

SEQ ID NO: 130138 - protein, 35 aa, Artificial Sequence
  Description of Artificial Sequence: Synthetic polypeptide
DEEEIRTTNPVATEQYGSVSTTNNEIIVVEEFQDW

SEQ ID NO: 130139 - protein, 36 aa, Artificial Sequence
  Description of Artificial Sequence: Synthetic polypeptide
DEAEIRTTNPVATEQYGSYWVTLDNMLERMIENQRD

SEQ ID NO: 130140 - protein, 35 aa, Artificial Sequence
  Description of Artificial Sequence: Synthetic polypeptide
DESEIRTTNPVATECWGSVSICINEPQDREGENGV

SEQ ID NO: 130141 - protein, 33 aa, Artificial Sequence
  Description of Artificial Sequence: Synthetic polypeptide
DNQEIATTNPVATEQYGSVSATMDLEDHEGEDL

SEQ ID NO: 130142 - protein, 32 aa, Artificial Sequence
  Description of Artificial Sequence: Synthetic polypeptide
DNQEIAVTNPVATEQYGSVSATDLEDHEGEDL

SEQ ID NO: 130143 - protein, 34 aa, Artificial Sequence
  Description of Artificial Sequence: Synthetic polypeptide
DNSEIRTTNPVATECWGSVSCINDEPQDREGENG

SEQ ID NO: 130144 - protein, 34 aa, Artificial Sequence
  Description of Artificial Sequence: Synthetic polypeptide
DEEEIRTTNPVATEQYGSVSPDPVGVIETQGQLV

SEQ ID NO: 130145 - protein, 36 aa, Artificial Sequence
  Description of Artificial Sequence: Synthetic polypeptide
DEEEIRTTNPVATEQYGSVTDGEGNLNQEFNGGETQ

SEQ ID NO: 130146 - protein, 32 aa, Artificial Sequence
  Description of Artificial Sequence: Synthetic polypeptide
DENEIRTTNPVATEQYGSCYPNNGMEIMNNEM

SEQ ID NO: 130147 - protein, 34 aa, Artificial Sequence
  Description of Artificial Sequence: Synthetic polypeptide
DESEIRTTNPVATECWGSVSHCIAEPQDREGENG

SEQ ID NO: 130148 - protein, 36 aa, Artificial Sequence
  Description of Artificial Sequence: Synthetic polypeptide
DEEEIRTTNPVATEQYGSVSNVLNDMQEESNPVNNE

SEQ ID NO: 130149 - protein, 36 aa, Artificial Sequence
  Description of Artificial Sequence: Synthetic polypeptide
DEEEIRTTNPVATEQYGSVSNVDNGMQEEANPVNNE

SEQ ID NO: 130150 - protein, 33 aa, Artificial Sequence
  Description of Artificial Sequence: Synthetic polypeptide
DEDEIRTTNPVAYESWGSVATNPNQGDVGQNTM

SEQ ID NO: 130151 - protein, 34 aa, Artificial Sequence
  Description of Artificial Sequence: Synthetic polypeptide
DEDEIRTTNPVAYESWGSVSGDNLLGDRQGDNGE

SEQ ID NO: 130152 - protein, 36 aa, Artificial Sequence
  Description of Artificial Sequence: Synthetic polypeptide
DEEEIRTTNPVATEQYGSVSTMDDHETPEIVNTDRF

SEQ ID NO: 130153 - protein, 37 aa, Artificial Sequence
  Description of Artificial Sequence: Synthetic polypeptide
DEEEIRTTNPVATEQYGSVSNTWAIGPDSRIGENNQS

SEQ ID NO: 130154 - protein, 33 aa, Artificial Sequence
  Description of Artificial Sequence: Synthetic polypeptide
DEAEIRTTNPVATEQYGVVCSSEHNQNFPSNQS

SEQ ID NO: 130155 - protein, 36 aa, Artificial Sequence
  Description of Artificial Sequence: Synthetic polypeptide
DEEEIRTTNPVATEQYGSVSNTVMDMPQPQSTQNKI

SEQ ID NO: 130156 - protein, 39 aa, Artificial Sequence
  Description of Artificial Sequence: Synthetic polypeptide
DEEEIRTTNPVATEQYGSVSTTNLQYGNNQNGNNNNQNT

SEQ ID NO: 130157 - protein, 39 aa, Artificial Sequence
  Description of Artificial Sequence: Synthetic polypeptide
DEEEIRTTNPVATEQYGSVSTTNLQYGNNLQNGNNNQNT

SEQ ID NO: 130158 - protein, 35 aa, Artificial Sequence
  Description of Artificial Sequence: Synthetic polypeptide
DESEIRTTNPVATECWGSVSFCINQEPQDREGENG

SEQ ID NO: 130159 - protein, 37 aa, Artificial Sequence
  Description of Artificial Sequence: Synthetic polypeptide
DEEEIRTTNPVATEQYGSVSNTTPDGPNMGNGGNPVT

SEQ ID NO: 130160 - protein, 35 aa, Artificial Sequence
  Description of Artificial Sequence: Synthetic polypeptide
DENEIRTTNPVATEQYGSCISVNHDLQTGMEEQQH

SEQ ID NO: 130161 - protein, 33 aa, Artificial Sequence
  Description of Artificial Sequence: Synthetic polypeptide
DQAEIRTTNPVATEQYGSVWANEHQLEQQNESQ

SEQ ID NO: 130162 - protein, 36 aa, Artificial Sequence
  Description of Artificial Sequence: Synthetic polypeptide
DEEEIRTTNPVATEQYGSVTDTVNGQDEGEDGQQET

SEQ ID NO: 130163 - protein, 34 aa, Artificial Sequence
  Description of Artificial Sequence: Synthetic polypeptide
DESEIRTTNPVATECWGSVSFCINEPQDQEGENG

SEQ ID NO: 130164 - protein, 32 aa, Artificial Sequence
  Description of Artificial Sequence: Synthetic polypeptide
DQAEIRTTNPVAYEQWGCCSTVHSQHPGGNRH

SEQ ID NO: 130165 - protein, 35 aa, Artificial Sequence
  Description of Artificial Sequence: Synthetic polypeptide
DENEIRTTNPVATEQYGSCASVTHDLQTGEVEQQN

SEQ ID NO: 130166 - protein, 36 aa, Artificial Sequence
  Description of Artificial Sequence: Synthetic polypeptide
DEEEIRTTNPVATEQYGSVSNVPNDMQEEHVLVNNP

SEQ ID NO: 130167 - protein, 32 aa, Artificial Sequence
  Description of Artificial Sequence: Synthetic polypeptide
DENEIRTTNPVATEQYGSCYPNNGMESEANEM

SEQ ID NO: 130168 - protein, 33 aa, Artificial Sequence
  Description of Artificial Sequence: Synthetic polypeptide
DENEIRTTNPVATEQYGSCPTYLNAILSDDQQY

SEQ ID NO: 130169 - protein, 34 aa, Artificial Sequence
  Description of Artificial Sequence: Synthetic polypeptide
DENEIRTTNPVATEQYGSCSCTMNMPEGGGSIED

SEQ ID NO: 130170 - protein, 32 aa, Artificial Sequence
  Description of Artificial Sequence: Synthetic polypeptide
DENEIRTTNPVATEQYGSCYPNNDMEIEENEV

SEQ ID NO: 130171 - protein, 32 aa, Artificial Sequence
  Description of Artificial Sequence: Synthetic polypeptide
DENEIRTTNPVATEQYGSCYPENGMESENNEQ

SEQ ID NO: 130172 - protein, 33 aa, Artificial Sequence
  Description of Artificial Sequence: Synthetic polypeptide
DQAEIRTTNPVATEQYGCCCSTGPPQHFGSNQS

SEQ ID NO: 130173 - protein, 32 aa, Artificial Sequence
  Description of Artificial Sequence: Synthetic polypeptide
DQAEIRTTNPVATEQYGCCCSTPDQHFGSQQS

SEQ ID NO: 130174 - protein, 33 aa, Artificial Sequence
  Description of Artificial Sequence: Synthetic polypeptide
DQAEIRTTNPVATEQYGCCCSTTALQHFGSDQS

SEQ ID NO: 130175 - protein, 36 aa, Artificial Sequence
  Description of Artificial Sequence: Synthetic polypeptide
DEEEIRTTNPVATEQYGSVSPAMSMQTNVVTQVSDT

SEQ ID NO: 130176 - protein, 34 aa, Artificial Sequence
  Description of Artificial Sequence: Synthetic polypeptide
DEEEIRTTNPVATEQYGSVSPAMQQPDDQISMMD

SEQ ID NO: 130177 - protein, 33 aa, Artificial Sequence
  Description of Artificial Sequence: Synthetic polypeptide
DQAEIRTTNPVATEQYGCCSNTEHNQHFGSNQA

SEQ ID NO: 130178 - protein, 33 aa, Artificial Sequence
  Description of Artificial Sequence: Synthetic polypeptide
DQAEIRTTNPVATEQYGCCSNTGELQHFGSDQS

SEQ ID NO: 130179 - protein, 36 aa, Artificial Sequence
  Description of Artificial Sequence: Synthetic polypeptide
DEEEIRTTNPVATEQYGSVSPAMNQLMERQMPETYI

SEQ ID NO: 130180 - protein, 35 aa, Artificial Sequence
  Description of Artificial Sequence: Synthetic polypeptide
DEEEIRTTNPVATEQYGSVSPAIPFQQPVGVVQDQ

SEQ ID NO: 130181 - protein, 32 aa, Artificial Sequence
  Description of Artificial Sequence: Synthetic polypeptide
DEDEIATTNPVATEQYGSVCATGPGDNMPDNN

SEQ ID NO: 130182 - protein, 35 aa, Artificial Sequence
  Description of Artificial Sequence: Synthetic polypeptide
DEDEIATTNPVATEQYGSVCATENPEQQGNQTEGT

SEQ ID NO: 130183 - protein, 35 aa, Artificial Sequence
  Description of Artificial Sequence: Synthetic polypeptide
DEEEIRTTNPVATEQYGSVSPAIHQQDPVGLMQEV

SEQ ID NO: 130184 - protein, 35 aa, Artificial Sequence
  Description of Artificial Sequence: Synthetic polypeptide
DESEIRTTNPVATECWGSVSHCINNEPQDREGENG

SEQ ID NO: 130185 - protein, 33 aa, Artificial Sequence
  Description of Artificial Sequence: Synthetic polypeptide
DEDEIRTTNPVAYESWGCVATGMLGDVQGGNAR

SEQ ID NO: 130186 - protein, 35 aa, Artificial Sequence
  Description of Artificial Sequence: Synthetic polypeptide
DEEEIRTTNPVATEQYGSVSNWNQLIEVLEFVSEE

SEQ ID NO: 130187 - protein, 33 aa, Artificial Sequence
  Description of Artificial Sequence: Synthetic polypeptide
DEAEIRTTNPVATEQYGVASDCQLNNQDGQEMI

SEQ ID NO: 130188 - protein, 33 aa, Artificial Sequence
  Description of Artificial Sequence: Synthetic polypeptide
DENEIRTTNPVATEQYGSCSDWNMESRFDEQDD

SEQ ID NO: 130189 - protein, 36 aa, Artificial Sequence
  Description of Artificial Sequence: Synthetic polypeptide
DEEEIRTTNPVATEQYGSVSNVYNNMQEEHVPVNNE

SEQ ID NO: 130190 - protein, 32 aa, Artificial Sequence
  Description of Artificial Sequence: Synthetic polypeptide
DEQEIATTNPVATEQYGSVSATCVEDHEHEQL

SEQ ID NO: 130191 - protein, 36 aa, Artificial Sequence
  Description of Artificial Sequence: Synthetic polypeptide
DEEEIRTTNPVATEQYGSVSPDSFLYQPTENEVDQF

SEQ ID NO: 130192 - protein, 34 aa, Artificial Sequence
  Description of Artificial Sequence: Synthetic polypeptide
DEQEIATTNPVATEQYGSVSATDLCEDHEGCEDL

SEQ ID NO: 130193 - protein, 33 aa, Artificial Sequence
  Description of Artificial Sequence: Synthetic polypeptide
DEDEIRTTNPVAYEQWGVVSGPNGLQDHPNMGS

SEQ ID NO: 130194 - protein, 33 aa, Artificial Sequence
  Description of Artificial Sequence: Synthetic polypeptide
DEDEIRTTNPVAYEQWGVVSGPNLQDNHPNDGS

SEQ ID NO: 130195 - protein, 35 aa, Artificial Sequence
  Description of Artificial Sequence: Synthetic polypeptide
DEDEIRTTNPVAYEQWGVVSGTNGNMQDRPGNEDS

SEQ ID NO: 130196 - protein, 34 aa, Artificial Sequence
  Description of Artificial Sequence: Synthetic polypeptide
DEEEIRTTNPVATEQYGSVSPEVGMWQLMTPELN

SEQ ID NO: 130197 - protein, 35 aa, Artificial Sequence
  Description of Artificial Sequence: Synthetic polypeptide
DENEIRTTNPVATEQYGSVCSVTWPILEDDGEIEM

SEQ ID NO: 130198 - protein, 35 aa, Artificial Sequence
  Description of Artificial Sequence: Synthetic polypeptide
DESEIRTTNPVATECWGSVSKCINEPQDREGENEG

SEQ ID NO: 130199 - protein, 34 aa, Artificial Sequence
  Description of Artificial Sequence: Synthetic polypeptide
DENEIRTTNPVATEQYGSVCSVAAPLEQIHEFQD

SEQ ID NO: 130200 - protein, 35 aa, Artificial Sequence
  Description of Artificial Sequence: Synthetic polypeptide
DENEIRTTNPVATEQYGSVCSTYVVLPSLDDDNFG

SEQ ID NO: 130201 - protein, 34 aa, Artificial Sequence
  Description of Artificial Sequence: Synthetic polypeptide
CEEEIRTTNPVGYERYGQSVSTYAVSERGGDNRM

SEQ ID NO: 130202 - protein, 34 aa, Artificial Sequence
  Description of Artificial Sequence: Synthetic polypeptide
CEEEIRTTNPVGYERYGQSVSVNATSQQGGDNRM

SEQ ID NO: 130203 - protein, 36 aa, Artificial Sequence
  Description of Artificial Sequence: Synthetic polypeptide
CEEEIRTTNPVGYERYGQSVVSTNAVSQRTGGDNRM

SEQ ID NO: 130204 - protein, 32 aa, Artificial Sequence
  Description of Artificial Sequence: Synthetic polypeptide
DEDEIRTTNPVAYEQWGVVTGDNNRDQRGGGA

SEQ ID NO: 130205 - protein, 32 aa, Artificial Sequence
  Description of Artificial Sequence: Synthetic polypeptide
DEDEIRTTNPVAYEQWGVVTGGNLQDTPNMDE

SEQ ID NO: 130206 - protein, 34 aa, Artificial Sequence
  Description of Artificial Sequence: Synthetic polypeptide
DEDEIRTTNPVAYEQWGVVVHTDNGDDQSGNMNR

SEQ ID NO: 130207 - protein, 38 aa, Artificial Sequence
  Description of Artificial Sequence: Synthetic polypeptide
DEEEIRTTNPVATEQYGSVSTTNNNNDEQGNIGTNVTD

SEQ ID NO: 130208 - protein, 34 aa, Artificial Sequence
  Description of Artificial Sequence: Synthetic polypeptide
DEDEIRTTNPVAYEQWGVVVPTDNDGDQAGNNRP

SEQ ID NO: 130209 - protein, 36 aa, Artificial Sequence
  Description of Artificial Sequence: Synthetic polypeptide
DENEIRTTNPVATEQYGSVCSTHLVIYNEIPGNNET

SEQ ID NO: 130210 - protein, 35 aa, Artificial Sequence
  Description of Artificial Sequence: Synthetic polypeptide
DESEIRTTNPVATECWGSVSKCINEPQDREGENAG

SEQ ID NO: 130211 - protein, 36 aa, Artificial Sequence
  Description of Artificial Sequence: Synthetic polypeptide
DENEIRTTNPVATEQYGSVCSTHLVEYNGEIGMNNE

SEQ ID NO: 130212 - protein, 39 aa, Artificial Sequence
  Description of Artificial Sequence: Synthetic polypeptide
DEEEIRTTNPVATEQYGSVSTTNNNNNNLQQGTEQGNTD

SEQ ID NO: 130213 - protein, 35 aa, Artificial Sequence
  Description of Artificial Sequence: Synthetic polypeptide
DNEEIRTTNPVATEQYGSVCSPDLLEDRIGDFEDG

SEQ ID NO: 130214 - protein, 34 aa, Artificial Sequence
  Description of Artificial Sequence: Synthetic polypeptide
DEEEIRTTNPVATEQYGSVSPGIANIEMDMEIVA

SEQ ID NO: 130215 - protein, 34 aa, Artificial Sequence
  Description of Artificial Sequence: Synthetic polypeptide
DENEIRTTNPVATEQYGSVCSVTWPLEDHFDIEM

SEQ ID NO: 130216 - protein, 33 aa, Artificial Sequence
  Description of Artificial Sequence: Synthetic polypeptide
DMQEIATTNPVATEQYGSVSATDLVEDHEGEDL

SEQ ID NO: 130217 - protein, 34 aa, Artificial Sequence
  Description of Artificial Sequence: Synthetic polypeptide
DEDEIRTTNPVAYEQWGVVCSGDNNGDQRNGNGA

SEQ ID NO: 130218 - protein, 34 aa, Artificial Sequence
  Description of Artificial Sequence: Synthetic polypeptide
DEEEIRTTNPVATEQYGSVSPHQELEVPIMQTLT

SEQ ID NO: 130219 - protein, 33 aa, Artificial Sequence
  Description of Artificial Sequence: Synthetic polypeptide
DMSEIRTTNPVATLCWGSVSCINEPQDREGENG

SEQ ID NO: 130220 - protein, 35 aa, Artificial Sequence
  Description of Artificial Sequence: Synthetic polypeptide
DEDEIATTNPVATEQYGSVCATNPMQPDNQAEGNM

SEQ ID NO: 130221 - protein, 33 aa, Artificial Sequence
  Description of Artificial Sequence: Synthetic polypeptide
DMSEIRTTNPVTTECWGSVSCINEPQDREGENG

SEQ ID NO: 130222 - protein, 37 aa, Artificial Sequence
  Description of Artificial Sequence: Synthetic polypeptide
DEEEIRTTNPVATEQYGSVSTTNNNNNQNNQQSTNVE

SEQ ID NO: 130223 - protein, 35 aa, Artificial Sequence
  Description of Artificial Sequence: Synthetic polypeptide
DENEIRTTNPVATEQYGSVCTPPWLETGYMEDMNG

SEQ ID NO: 130224 - protein, 32 aa, Artificial Sequence
  Description of Artificial Sequence: Synthetic polypeptide
DNEEIATTNPCAYEEWGSVYFVDLQRQEGNDR

SEQ ID NO: 130225 - protein, 34 aa, Artificial Sequence
  Description of Artificial Sequence: Synthetic polypeptide
DEEEIRTTNPVATEQYGSVSPGVLEEPAAVVEES

SEQ ID NO: 130226 - protein, 33 aa, Artificial Sequence
  Description of Artificial Sequence: Synthetic polypeptide
DEDEIRTTNPVAYEQWGVVCSTDQGIQDGGTQR

SEQ ID NO: 130227 - protein, 35 aa, Artificial Sequence
  Description of Artificial Sequence: Synthetic polypeptide
DEDEIRTTNPVAYEQWGVVCSTENGNQVGEGNNRN

SEQ ID NO: 130228 - protein, 35 aa, Artificial Sequence
  Description of Artificial Sequence: Synthetic polypeptide
DENEIRTTNPVATEQYGSVCTPFCLETGYMEDIND

SEQ ID NO: 130229 - protein, 34 aa, Artificial Sequence
  Description of Artificial Sequence: Synthetic polypeptide
DEAEIRTTNPVATEQYGQCVCSTGEHEGFGSENQ

SEQ ID NO: 130230 - protein, 34 aa, Artificial Sequence
  Description of Artificial Sequence: Synthetic polypeptide
DEAEIRTTNPVATEQYGQCVCSTEDQENFGSEQL

SEQ ID NO: 130231 - protein, 32 aa, Artificial Sequence
  Description of Artificial Sequence: Synthetic polypeptide
DEDEIRTTNPVAYEQWGVVSGGDLQDHPNMGD

SEQ ID NO: 130232 - protein, 33 aa, Artificial Sequence
  Description of Artificial Sequence: Synthetic polypeptide
DEDEIRTTNPVAYEQWGVVSGGGNHQGERGGEN

SEQ ID NO: 130233 - protein, 35 aa, Artificial Sequence
  Description of Artificial Sequence: Synthetic polypeptide
DEEEIRTTNPVATEQYGSVSPGINALIMDEMEIVT

SEQ ID NO: 130234 - protein, 34 aa, Artificial Sequence
  Description of Artificial Sequence: Synthetic polypeptide
DEEEIRTTNPVATEQYGSVSPGILILEMDMEIVD

SEQ ID NO: 130235 - protein, 35 aa, Artificial Sequence
  Description of Artificial Sequence: Synthetic polypeptide
DENEIRTTNPVATEQYGSVCSVTWPLEDDNGYIEM

SEQ ID NO: 130236 - protein, 36 aa, Artificial Sequence
  Description of Artificial Sequence: Synthetic polypeptide
DEEEIRTTNPVATEQYGSVSPDSNDYQPTENEVDQL

SEQ ID NO: 130237 - protein, 34 aa, Artificial Sequence
  Description of Artificial Sequence: Synthetic polypeptide
DNEEIRTTNPVATEQYGSVCSPDNLEDSIMDFDY

SEQ ID NO: 130238 - protein, 36 aa, Artificial Sequence
  Description of Artificial Sequence: Synthetic polypeptide
DEEEIRTTNPVATEQYGSVSPESNYYQPTENEVDQF

SEQ ID NO: 130239 - protein, 33 aa, Artificial Sequence
  Description of Artificial Sequence: Synthetic polypeptide
DEDEIRTTNPVAYEQWGVVVPTDNGDQKGGMNL

SEQ ID NO: 130240 - protein, 34 aa, Artificial Sequence
  Description of Artificial Sequence: Synthetic polypeptide
DEDEIRTTNPVAYEQWGVVVPTDNGGQAGGNMQR

SEQ ID NO: 130241 - protein, 36 aa, Artificial Sequence
  Description of Artificial Sequence: Synthetic polypeptide
DEEEIRTTNPVATEQYGSVSPELISSTVLMQIVEPE

SEQ ID NO: 130242 - protein, 35 aa, Artificial Sequence
  Description of Artificial Sequence: Synthetic polypeptide
DENEIRTTNPVATEQYGSVAPTLNDLTTMMNQEKE

SEQ ID NO: 130243 - protein, 34 aa, Artificial Sequence
  Description of Artificial Sequence: Synthetic polypeptide
DEDEIRTTNPVAYEQWGVVVPTDNGNDQHGGTNR

SEQ ID NO: 130244 - protein, 35 aa, Artificial Sequence
  Description of Artificial Sequence: Synthetic polypeptide
DEEEIRTTNPVATEQYGSVSPELAVLMEESVPGGE

SEQ ID NO: 130245 - protein, 37 aa, Artificial Sequence
  Description of Artificial Sequence: Synthetic polypeptide
DEEEIRTTNPVATEQYGSVSPELANLMEMRSLSEGGN

SEQ ID NO: 130246 - protein, 37 aa, Artificial Sequence
  Description of Artificial Sequence: Synthetic polypeptide
DEEEIRTTNPVATEQYGSVSPELANLMEMQMIQEGGE

SEQ ID NO: 130247 - protein, 35 aa, Artificial Sequence
  Description of Artificial Sequence: Synthetic polypeptide
DEDEIRTTNPVAYEQWGVVVPTDNLGDQQGGNMTR

SEQ ID NO: 130248 - protein, 38 aa, Artificial Sequence
  Description of Artificial Sequence: Synthetic polypeptide
DEEEIRTTNPVATEQYGSVSTTNNLQAGTEQGTEEGTE

SEQ ID NO: 130249 - protein, 34 aa, Artificial Sequence
  Description of Artificial Sequence: Synthetic polypeptide
DEEEIRTTNPVATEQYGSVSPEEGQQESVFPPTL

SEQ ID NO: 130250 - protein, 33 aa, Artificial Sequence
  Description of Artificial Sequence: Synthetic polypeptide
DENEIRTTNPVATEQYGSTQVTNAEGILEIQDF

SEQ ID NO: 130251 - protein, 35 aa, Artificial Sequence
  Description of Artificial Sequence: Synthetic polypeptide
DEEEIRTTNPVATEQYGSVSPDVYVLEVNGVEQSD

SEQ ID NO: 130252 - protein, 38 aa, Artificial Sequence
  Description of Artificial Sequence: Synthetic polypeptide
DEEEIRTTNPVATEQYGSVSTTNNLNQQGTEAGTEEED

SEQ ID NO: 130253 - protein, 34 aa, Artificial Sequence
  Description of Artificial Sequence: Synthetic polypeptide
DEAEIRTTNPVATEQYGSYWSLDNMLEASINQID

SEQ ID NO: 130254 - protein, 36 aa, Artificial Sequence
  Description of Artificial Sequence: Synthetic polypeptide
DEEEIRTTNPVATEQYGSVSPDSNYHQPTENEVEQQ

SEQ ID NO: 130255 - protein, 36 aa, Artificial Sequence
  Description of Artificial Sequence: Synthetic polypeptide
DEEEIRTTNPVATEQYGSVSPDSNLYLPTMNEVDQQ

SEQ ID NO: 130256 - protein, 34 aa, Artificial Sequence
  Description of Artificial Sequence: Synthetic polypeptide
DEDEIATTNPVATEQYGSVCATNPENDGNQTEGN

SEQ ID NO: 130257 - protein, 38 aa, Artificial Sequence
  Description of Artificial Sequence: Synthetic polypeptide
DEEEIRTTNPVATEQYGSVSTTNNLEQGNTEEGVTTEE

SEQ ID NO: 130258 - protein, 33 aa, Artificial Sequence
  Description of Artificial Sequence: Synthetic polypeptide
DEDEIRTTNPVAYEQWGVVVPTDNGDQAGSNNT

SEQ ID NO: 130259 - protein, 35 aa, Artificial Sequence
  Description of Artificial Sequence: Synthetic polypeptide
DENEIRTTNPVATEQYGSVCSPTNSDIETYEDNVE

SEQ ID NO: 130260 - protein, 36 aa, Artificial Sequence
  Description of Artificial Sequence: Synthetic polypeptide
DENEIRTTNPVATEQYGSVAVTPWDSNQLETQNGMQ

SEQ ID NO: 130261 - protein, 36 aa, Artificial Sequence
  Description of Artificial Sequence: Synthetic polypeptide
DEEEIRTTNPVATEQYGSVSYTVDTLADTTLGEDTV

SEQ ID NO: 130262 - protein, 33 aa, Artificial Sequence
  Description of Artificial Sequence: Synthetic polypeptide
DEDEIRTTNPVAYEQWGVVVPTDNEMQEGGNNM

SEQ ID NO: 130263 - protein, 36 aa, Artificial Sequence
  Description of Artificial Sequence: Synthetic polypeptide
DEEEIRTTNPVATEQYGSVSPEPNALAAVDGVVPEI

SEQ ID NO: 130264 - protein, 38 aa, Artificial Sequence
  Description of Artificial Sequence: Synthetic polypeptide
DEEEIRTTNPVATEQYGSVSTTNNNLQQGTEAGTEEQN

SEQ ID NO: 130265 - protein, 36 aa, Artificial Sequence
  Description of Artificial Sequence: Synthetic polypeptide
DNEEIRTTNPVATEQYGSVSSTTPAGPNMRNGMNPV

SEQ ID NO: 130266 - protein, 35 aa, Artificial Sequence
  Description of Artificial Sequence: Synthetic polypeptide
DEEEIRTTNPVATEQYGSVSPENMMMPEFGEEESN

SEQ ID NO: 130267 - protein, 33 aa, Artificial Sequence
  Description of Artificial Sequence: Synthetic polypeptide
DEDEIRTTNPVAYEQWGVVVPTDNGDDQAGNNF

SEQ ID NO: 130268 - protein, 33 aa, Artificial Sequence
  Description of Artificial Sequence: Synthetic polypeptide
DEDEIRTTNPVAYEQWGVVVPTDNGDQADGNNH

SEQ ID NO: 130269 - protein, 35 aa, Artificial Sequence
  Description of Artificial Sequence: Synthetic polypeptide
DNEEIRTTNPVATEQYGSVSVTAAGIDHIGENLQD

SEQ ID NO: 130270 - protein, 37 aa, Artificial Sequence
  Description of Artificial Sequence: Synthetic polypeptide
DNEEIRTTNPVATEQYGSVSVTASGLGDPRIGENNQV

SEQ ID NO: 130271 - protein, 34 aa, Artificial Sequence
  Description of Artificial Sequence: Synthetic polypeptide
DENEIRTTNPVATEQYGSVCSELYAEQRVQDSDV

SEQ ID NO: 130272 - protein, 34 aa, Artificial Sequence
  Description of Artificial Sequence: Synthetic polypeptide
DENEIRTTNPVATEQYGSVCSEGYAEQRVQDKDQ

SEQ ID NO: 130273 - protein, 34 aa, Artificial Sequence
  Description of Artificial Sequence: Synthetic polypeptide
DENEIRTTNPVATEQYGSVCSEGYAEIRGVQDDQ

SEQ ID NO: 130274 - protein, 33 aa, Artificial Sequence
  Description of Artificial Sequence: Synthetic polypeptide
DENEIRTTNPVATEQYGSVCSEGEAEQPVQDDV

SEQ ID NO: 130275 - protein, 35 aa, Artificial Sequence
  Description of Artificial Sequence: Synthetic polypeptide
DEDEIATTNPVATEQYGSVCATNPEQQRDQTEGTP

SEQ ID NO: 130276 - protein, 33 aa, Artificial Sequence
  Description of Artificial Sequence: Synthetic polypeptide
DENEIRTTNPVATEQYGSVCPTEPWEEFGEKHD

SEQ ID NO: 130277 - protein, 37 aa, Artificial Sequence
  Description of Artificial Sequence: Synthetic polypeptide
DEEEIRTTNPVATEQYGSVSPEMNAVHFAAQQLENRD

SEQ ID NO: 130278 - protein, 37 aa, Artificial Sequence
  Description of Artificial Sequence: Synthetic polypeptide
DEEEIRTTNPVATEQYGSVSPELVNLMEMRSLAEGLE

SEQ ID NO: 130279 - protein, 36 aa, Artificial Sequence
  Description of Artificial Sequence: Synthetic polypeptide
DENEIRTTNPVATEQYGSVCMPTINILENRNESDND

SEQ ID NO: 130280 - protein, 35 aa, Artificial Sequence
  Description of Artificial Sequence: Synthetic polypeptide
DENEIRTTNPVATEQYGSVCMPPINLENRNESDNQ

SEQ ID NO: 130281 - protein, 35 aa, Artificial Sequence
  Description of Artificial Sequence: Synthetic polypeptide
DEDEIATTNPVATEQYGSVCATNPEQQGNQDEGTM

SEQ ID NO: 130282 - protein, 36 aa, Artificial Sequence
  Description of Artificial Sequence: Synthetic polypeptide
DEEEIRTTNPVATEQYGSVSPNWNNEGGRQTEEERD

SEQ ID NO: 130283 - protein, 33 aa, Artificial Sequence
  Description of Artificial Sequence: Synthetic polypeptide
DEDEIATTNPVATEQYGTVASATDGPMAMEGNH

SEQ ID NO: 130284 - protein, 39 aa, Artificial Sequence
  Description of Artificial Sequence: Synthetic polypeptide
DEEEIRTTNPVATEQYGSVSTTNQNQLQQGTEQGTNVEE

SEQ ID NO: 130285 - protein, 35 aa, Artificial Sequence
  Description of Artificial Sequence: Synthetic polypeptide
DEAEIRTTNPVATEQYGSVWVTYVMQQIGNGQEFE

SEQ ID NO: 130286 - protein, 32 aa, Artificial Sequence
  Description of Artificial Sequence: Synthetic polypeptide
DEQEIATTNPVATEQYGSVSAADLEDHEVEDL

SEQ ID NO: 130287 - protein, 35 aa, Artificial Sequence
  Description of Artificial Sequence: Synthetic polypeptide
DESEIRTTNPVATECWGSVVSCINGEPQDREGENG

SEQ ID NO: 130288 - protein, 32 aa, Artificial Sequence
  Description of Artificial Sequence: Synthetic polypeptide
DEQEIATTNPVATEQYGSVSACDLEDHEFEDL

SEQ ID NO: 130289 - protein, 34 aa, Artificial Sequence
  Description of Artificial Sequence: Synthetic polypeptide
DESEIRTTNPVATECWGSVVSCINEPQDREPENG

SEQ ID NO: 130290 - protein, 34 aa, Artificial Sequence
  Description of Artificial Sequence: Synthetic polypeptide
DESEIRTTNPVATECWGSVVSCINEPQDREGEIG

SEQ ID NO: 130291 - protein, 35 aa, Artificial Sequence
  Description of Artificial Sequence: Synthetic polypeptide
DEEEIRTTNPVATEQYGSVSPTDTDSTATAGVIVN

SEQ ID NO: 130292 - protein, 32 aa, Artificial Sequence
  Description of Artificial Sequence: Synthetic polypeptide
DEQEIATTNPVATEQYGSVSACDLEDHEIEDL

SEQ ID NO: 130293 - protein, 35 aa, Artificial Sequence
  Description of Artificial Sequence: Synthetic polypeptide
DEYEIGTTNPVATEQYGSVSVTANAGMEGGENTTV

SEQ ID NO: 130294 - protein, 34 aa, Artificial Sequence
  Description of Artificial Sequence: Synthetic polypeptide
DEYEIGTTNPVATEQYGSVSVTDNAGMEGGEEGT

SEQ ID NO: 130295 - protein, 35 aa, Artificial Sequence
  Description of Artificial Sequence: Synthetic polypeptide
DEYEIGTTNPVATEQYGSVSVTGGQNQEEMGDNGT

SEQ ID NO: 130296 - protein, 35 aa, Artificial Sequence
  Description of Artificial Sequence: Synthetic polypeptide
DEAEIRTTNPVATEQYGSVWWTDLTQPETNQDDDN

SEQ ID NO: 130297 - protein, 35 aa, Artificial Sequence
  Description of Artificial Sequence: Synthetic polypeptide
CEEEIRTTNPVATEQYGSVTVGSGTDGQGEGGEQT

SEQ ID NO: 130298 - protein, 32 aa, Artificial Sequence
  Description of Artificial Sequence: Synthetic polypeptide
DEDEIATTNPVAYEAWGTVSTNLAGEHGGNSD

SEQ ID NO: 130299 - protein, 35 aa, Artificial Sequence
  Description of Artificial Sequence: Synthetic polypeptide
DEYEIGTTNPVATEQYGSVTVVTGGQLQEEMGNGQ

SEQ ID NO: 130300 - protein, 34 aa, Artificial Sequence
  Description of Artificial Sequence: Synthetic polypeptide
DESEIRTTNPVATECWGSVTSCINEPQDREHENG

SEQ ID NO: 130301 - protein, 38 aa, Artificial Sequence
  Description of Artificial Sequence: Synthetic polypeptide
DEEEIRTTNPVATEQYGSVSTTQQAYGNNNQQGTTNVE

SEQ ID NO: 130302 - protein, 35 aa, Artificial Sequence
  Description of Artificial Sequence: Synthetic polypeptide
DESEIRTTNPVATECWGSVTSCINEPQDREGENGL

SEQ ID NO: 130303 - protein, 33 aa, Artificial Sequence
  Description of Artificial Sequence: Synthetic polypeptide
DEYEIGTTNPVATEQYGVVAATNAGMEGGNGGT

SEQ ID NO: 130304 - protein, 36 aa, Artificial Sequence
  Description of Artificial Sequence: Synthetic polypeptide
DEEEIRTTNPVATEQYGSVSPTEIMMMQESGEEEVM

SEQ ID NO: 130305 - protein, 36 aa, Artificial Sequence
  Description of Artificial Sequence: Synthetic polypeptide
DENEIRTTNPVATEQYGSVSTNDVHEEIFMLQDHPI

SEQ ID NO: 130306 - protein, 35 aa, Artificial Sequence
  Description of Artificial Sequence: Synthetic polypeptide
DEDEIRTTNPVAYEQWGSVCSTNDGGGHQGENMRG

SEQ ID NO: 130307 - protein, 33 aa, Artificial Sequence
  Description of Artificial Sequence: Synthetic polypeptide
DEQEIATTNPVATEQYGSVRIATDLEDHEGEDL

SEQ ID NO: 130308 - protein, 35 aa, Artificial Sequence
  Description of Artificial Sequence: Synthetic polypeptide
CEEEIRTTNPVATEQYGSVSNVGDEGQRFNNNEQI

SEQ ID NO: 130309 - protein, 34 aa, Artificial Sequence
  Description of Artificial Sequence: Synthetic polypeptide
DEQEIATTNPVATEQYGSVQSATDLMEDHEGEDL

SEQ ID NO: 130310 - protein, 33 aa, Artificial Sequence
  Description of Artificial Sequence: Synthetic polypeptide
DEQEIATTNPVATEQYGSVQSATDVEDHEGEDL

SEQ ID NO: 130311 - protein, 36 aa, Artificial Sequence
  Description of Artificial Sequence: Synthetic polypeptide
DENEIRTTNPVATEQYGSVSTNPVDEEIFGLQDHPI

SEQ ID NO: 130312 - protein, 35 aa, Artificial Sequence
  Description of Artificial Sequence: Synthetic polypeptide
DEDEIRTTNPVAYEQWGSVCSTENLGDQDIHDGGQ

SEQ ID NO: 130313 - protein, 33 aa, Artificial Sequence
  Description of Artificial Sequence: Synthetic polypeptide
DESEIRTTNPVATECWGSVWCIKEPQDREGENG

SEQ ID NO: 130314 - protein, 33 aa, Artificial Sequence
  Description of Artificial Sequence: Synthetic polypeptide
DEQEIATTNPVATEQYGSVQTATDLEDHEGEDL

SEQ ID NO: 130315 - protein, 33 aa, Artificial Sequence
  Description of Artificial Sequence: Synthetic polypeptide
DEYEICTTNPVATEQYGSVVAANAGMEGGGNGG

SEQ ID NO: 130316 - protein, 35 aa, Artificial Sequence
  Description of Artificial Sequence: Synthetic polypeptide
DEYEIGTTNPVATEQYGSVDSTVNAGMEGGENDTT

SEQ ID NO: 130317 - protein, 34 aa, Artificial Sequence
  Description of Artificial Sequence: Synthetic polypeptide
DEYEIGTTNPVATEQYGSVIVTGGQLQEEGGQGT

SEQ ID NO: 130318 - protein, 34 aa, Artificial Sequence
  Description of Artificial Sequence: Synthetic polypeptide
DEYEIGTTNPVATEQYGSVNMTNAGMEGGQNGTQ

SEQ ID NO: 130319 - protein, 34 aa, Artificial Sequence
  Description of Artificial Sequence: Synthetic polypeptide
DEYEIGTTNPVATEQYGSVNSANAGMGEGGQNGN

SEQ ID NO: 130320 - protein, 34 aa, Artificial Sequence
  Description of Artificial Sequence: Synthetic polypeptide
DEDEIRTTNPVAYEQWGSVCSTETDQNDQQNGGA

SEQ ID NO: 130321 - protein, 36 aa, Artificial Sequence
  Description of Artificial Sequence: Synthetic polypeptide
CEEEIRTTNPVATEQYGSVSSTTPAGCNMRNGMNPV

SEQ ID NO: 130322 - protein, 36 aa, Artificial Sequence
  Description of Artificial Sequence: Synthetic polypeptide
CEEEIRTTNPVATEQYGSVSSTTPAGENMRNGMNPV

SEQ ID NO: 130323 - protein, 36 aa, Artificial Sequence
  Description of Artificial Sequence: Synthetic polypeptide
CEEEIRTTNPVATEQYGSVSSTTPAGPNARNGMNPV

SEQ ID NO: 130324 - protein, 35 aa, Artificial Sequence
  Description of Artificial Sequence: Synthetic polypeptide
DEDEIRTTNPVAYEQWGSVCSTGNNDMQPDGDNND

SEQ ID NO: 130325 - protein, 36 aa, Artificial Sequence
  Description of Artificial Sequence: Synthetic polypeptide
CEEEIRTTNPVATEQYGSVSSTTPAGPNMRNGMNPV

SEQ ID NO: 130326 - protein, 36 aa, Artificial Sequence
  Description of Artificial Sequence: Synthetic polypeptide
CEEEIRTTNPVATEQYGSVSSTTPDDPNVGNGDNDD

SEQ ID NO: 130327 - protein, 34 aa, Artificial Sequence
  Description of Artificial Sequence: Synthetic polypeptide
DEQEIATTNPVATEQYGSVRSATADLEDHEGEDL

SEQ ID NO: 130328 - protein, 33 aa, Artificial Sequence
  Description of Artificial Sequence: Synthetic polypeptide
DEQEIATTNPVATEQYGSVQSATDLEDHEPEDL

SEQ ID NO: 130329 - protein, 34 aa, Artificial Sequence
  Description of Artificial Sequence: Synthetic polypeptide
DEDEIRTTNPVAYEQWGSVCSTNDNGHQGMNQSE

SEQ ID NO: 130330 - protein, 34 aa, Artificial Sequence
  Description of Artificial Sequence: Synthetic polypeptide
DESEIRTTNPVATECWGSVSYCINEPQDQEGENG

SEQ ID NO: 130331 - protein, 36 aa, Artificial Sequence
  Description of Artificial Sequence: Synthetic polypeptide
DEYEIRTTNPVATEQYGSSSTLIMLEELRNGNEEVF

SEQ ID NO: 130332 - protein, 33 aa, Artificial Sequence
  Description of Artificial Sequence: Synthetic polypeptide
DEDEIRTTNPVAYEQWGSVCSTTDQGDTQNGHA

SEQ ID NO: 130333 - protein, 36 aa, Artificial Sequence
  Description of Artificial Sequence: Synthetic polypeptide
DEYEIRTTNPVATEQYGSVCSTAMMEELRNGNEEVF

SEQ ID NO: 130334 - protein, 36 aa, Artificial Sequence
  Description of Artificial Sequence: Synthetic polypeptide
DEYEIRTTNPVATEQYGSVCSTGMLEELDNGNEEVF

SEQ ID NO: 130335 - protein, 38 aa, Artificial Sequence
  Description of Artificial Sequence: Synthetic polypeptide
DEEEIRTTNPVATEQYGSVSTTQNLQAGTEQGGTTTDD

SEQ ID NO: 130336 - protein, 34 aa, Artificial Sequence
  Description of Artificial Sequence: Synthetic polypeptide
DEDEIRTTNPVAYEQWGSVCSTTDQVGDTQNGGG

SEQ ID NO: 130337 - protein, 36 aa, Artificial Sequence
  Description of Artificial Sequence: Synthetic polypeptide
DEYEIRTTNPVATEQYGSVCSTIMLEELFNGNEEGF

SEQ ID NO: 130338 - protein, 35 aa, Artificial Sequence
  Description of Artificial Sequence: Synthetic polypeptide
DEDEIRTTNPVAYEQWGSVCSTTENIQGEDQNDSR

SEQ ID NO: 130339 - protein, 34 aa, Artificial Sequence
  Description of Artificial Sequence: Synthetic polypeptide
DEDEIRTTNPVAYEQWGSVCSTVNDQGDTQNGGK

SEQ ID NO: 130340 - protein, 33 aa, Artificial Sequence
  Description of Artificial Sequence: Synthetic polypeptide
DEDEIRTTNPVAYEQWGSVCTIENHDSGGGDSR

SEQ ID NO: 130341 - protein, 36 aa, Artificial Sequence
  Description of Artificial Sequence: Synthetic polypeptide
DEYEIRTTNPVATEQYGSVMPTNGDETTQSGQDTNM

SEQ ID NO: 130342 - protein, 35 aa, Artificial Sequence
  Description of Artificial Sequence: Synthetic polypeptide
DENEIRTTNPVATEQYGSVSTDPHEGERASQFSES

SEQ ID NO: 130343 - protein, 33 aa, Artificial Sequence
  Description of Artificial Sequence: Synthetic polypeptide
DEDEIRTTNPVAYEQWGSVCVTDLQGDTQNGGQ

SEQ ID NO: 130344 - protein, 34 aa, Artificial Sequence
  Description of Artificial Sequence: Synthetic polypeptide
DEDEIRTTNPVAYEQWGSVCVTDNGQQREDNSDP

SEQ ID NO: 130345 - protein, 34 aa, Artificial Sequence
  Description of Artificial Sequence: Synthetic polypeptide
DEDEIATTNPVATEVWGSVCYTNIDDQDHGGNNR

SEQ ID NO: 130346 - protein, 34 aa, Artificial Sequence
  Description of Artificial Sequence: Synthetic polypeptide
DEYEIRTTNPVATEQYGSVSCVVDLNSPNSQIEQ

SEQ ID NO: 130347 - protein, 35 aa, Artificial Sequence
  Description of Artificial Sequence: Synthetic polypeptide
DEYEIRTTNPVATEQYGSVSDTYDVTVQDRESQED

SEQ ID NO: 130348 - protein, 33 aa, Artificial Sequence
  Description of Artificial Sequence: Synthetic polypeptide
DEDEIRTTNPVAYEQWGSVCYNDNDGHQGNGQR

SEQ ID NO: 130349 - protein, 35 aa, Artificial Sequence
  Description of Artificial Sequence: Synthetic polypeptide
DEDEIATTNPVATEVWGSVCYTNEDLQDQGGQNDR

SEQ ID NO: 130350 - protein, 33 aa, Artificial Sequence
  Description of Artificial Sequence: Synthetic polypeptide
DEDEIRTTNPVAYEQWGSVCSTTDQGDTQNDGN

SEQ ID NO: 130351 - protein, 34 aa, Artificial Sequence
  Description of Artificial Sequence: Synthetic polypeptide
DEDEIRTTNPVAYEQWGSVCSTNDNQGDTQNGGA

SEQ ID NO: 130352 - protein, 33 aa, Artificial Sequence
  Description of Artificial Sequence: Synthetic polypeptide
AENEIACTNPVATEQYGEASSTEALPQRNGMNV

SEQ ID NO: 130353 - protein, 34 aa, Artificial Sequence
  Description of Artificial Sequence: Synthetic polypeptide
DEYEIRTTNPVATEQYGSCINVMHDLQTGEEQQE

SEQ ID NO: 130354 - protein, 33 aa, Artificial Sequence
  Description of Artificial Sequence: Synthetic polypeptide
AENEIACTNPVATEQYGEASSTTALPQRNGMNV

SEQ ID NO: 130355 - protein, 34 aa, Artificial Sequence
  Description of Artificial Sequence: Synthetic polypeptide
DESEIRTTNPVATECWGSVSYCINEPEDREGENG

SEQ ID NO: 130356 - protein, 34 aa, Artificial Sequence
  Description of Artificial Sequence: Synthetic polypeptide
DESEIRTTNPVATECWGSVSWCINEPQDTEGENG

SEQ ID NO: 130357 - protein, 33 aa, Artificial Sequence
  Description of Artificial Sequence: Synthetic polypeptide
DEAEIRTTNPVATEQYGSLCWLDQTEDGQNEDH

SEQ ID NO: 130358 - protein, 34 aa, Artificial Sequence
  Description of Artificial Sequence: Synthetic polypeptide
DEAEIRTTNPVATEQYGSLCSPLDQTENGQNEDH

SEQ ID NO: 130359 - protein, 34 aa, Artificial Sequence
  Description of Artificial Sequence: Synthetic polypeptide
DEQEIATTNPVATEQYGSVSACIDLPQDHEGEDG

SEQ ID NO: 130360 - protein, 34 aa, Artificial Sequence
  Description of Artificial Sequence: Synthetic polypeptide
DESEIRTTNPVATECWGSVSWCINEPQDHEGENG

SEQ ID NO: 130361 - protein, 30 aa, Artificial Sequence
  Description of Artificial Sequence: Synthetic polypeptide
DEYEIRTTNPVATEQWGDVSEIEMNAAEDA

SEQ ID NO: 130362 - protein, 31 aa, Artificial Sequence
  Description of Artificial Sequence: Synthetic polypeptide
DEYEIRTTNPVATEQWGDVSEIEMNAAEDAS

SEQ ID NO: 130363 - protein, 30 aa, Artificial Sequence
  Description of Artificial Sequence: Synthetic polypeptide
DEYEIRTTNPVATEQWGDVSEIEMNCAEDA

SEQ ID NO: 130364 - protein, 30 aa, Artificial Sequence
  Description of Artificial Sequence: Synthetic polypeptide
DEYEIRTTNPVATEQWGDVSEIIMNAAEDA

SEQ ID NO: 130365 - protein, 30 aa, Artificial Sequence
  Description of Artificial Sequence: Synthetic polypeptide
DEYEIRTTNPVATEQWGDVSEWEMNAAEDA

SEQ ID NO: 130366 - protein, 30 aa, Artificial Sequence
  Description of Artificial Sequence: Synthetic polypeptide
DEYEIRTTNPVATEQWGDVSYIEMNAAEDA

SEQ ID NO: 130367 - protein, 35 aa, Artificial Sequence
  Description of Artificial Sequence: Synthetic polypeptide
DEDEIRTTNPVAYEQWGSVCSTNELDQQEGHGGQE

SEQ ID NO: 130368 - protein, 31 aa, Artificial Sequence
  Description of Artificial Sequence: Synthetic polypeptide
QEEEIATTNPVATEQYGEASTDCEDHEGEDL

SEQ ID NO: 130369 - protein, 33 aa, Artificial Sequence
  Description of Artificial Sequence: Synthetic polypeptide
DEDEIRTTNPVAYEQWGSVCSTQDQGDTQNGGS

SEQ ID NO: 130370 - protein, 33 aa, Artificial Sequence
  Description of Artificial Sequence: Synthetic polypeptide
DEAEIRTTNPVATEQYGSITTTHLLDEYMEGQQ

SEQ ID NO: 130371 - protein, 34 aa, Artificial Sequence
  Description of Artificial Sequence: Synthetic polypeptide
DEDEIRTTNPVAYEQWGSVCSTQNDQNDTQNGDA

SEQ ID NO: 130372 - protein, 33 aa, Artificial Sequence
  Description of Artificial Sequence: Synthetic polypeptide
DEQEIATTNPVATEQYGSVSADDLIEDTEGEDL

SEQ ID NO: 130373 - protein, 33 aa, Artificial Sequence
  Description of Artificial Sequence: Synthetic polypeptide
DEDEIRTTNPVAYEQWGSVCSTTDQGDHQQGGA

SEQ ID NO: 130374 - protein, 36 aa, Artificial Sequence
  Description of Artificial Sequence: Synthetic polypeptide
DEYEIRTTNPVATEQYGSVSNTTKAGPNMRNGMNPV

SEQ ID NO: 130375 - protein, 35 aa, Artificial Sequence
  Description of Artificial Sequence: Synthetic polypeptide
DEEEIRTTNPVATEQYGSVSWMVENDGAAMNELTQ

SEQ ID NO: 130376 - protein, 35 aa, Artificial Sequence
  Description of Artificial Sequence: Synthetic polypeptide
CEEEIRTTNPVATEQYGSVSILQSNGEDEQGENET

SEQ ID NO: 130377 - protein, 34 aa, Artificial Sequence
  Description of Artificial Sequence: Synthetic polypeptide
DENEIRTTNPVATEQYGSVSWCDTEQGGTQGSEQ

SEQ ID NO: 130378 - protein, 38 aa, Artificial Sequence
  Description of Artificial Sequence: Synthetic polypeptide
DEEEIRTTNPVATEQYGSVSTTTNLQAGTEQGTTEEEE

SEQ ID NO: 130379 - protein, 34 aa, Artificial Sequence
  Description of Artificial Sequence: Synthetic polypeptide
DEQEIATTNPVATEQYGSVLSATDLEDHEGEDLS

SEQ ID NO: 130380 - protein, 38 aa, Artificial Sequence
  Description of Artificial Sequence: Synthetic polypeptide
DEEEIRTTNPVATEQYGSVSTTTNLQAGTEAGTEETTE

SEQ ID NO: 130381 - protein, 33 aa, Artificial Sequence
  Description of Artificial Sequence: Synthetic polypeptide
DEVEITTTNPVATDQYGVVSTDGEQGGQGENGT

SEQ ID NO: 130382 - protein, 33 aa, Artificial Sequence
  Description of Artificial Sequence: Synthetic polypeptide
DEQEIATTNPVATEQYGSVMATQDLEDHEGEDL

SEQ ID NO: 130383 - protein, 35 aa, Artificial Sequence
  Description of Artificial Sequence: Synthetic polypeptide
DENEIRTTNPVATEQYGSVSVVPVDLDERPNENHN

SEQ ID NO: 130384 - protein, 36 aa, Artificial Sequence
  Description of Artificial Sequence: Synthetic polypeptide
DEEEIRTTNPVATEQYGSVSVYPNLFDSRIMQEDIK

SEQ ID NO: 130385 - protein, 35 aa, Artificial Sequence
  Description of Artificial Sequence: Synthetic polypeptide
DEEEIRTTNPVATEQYGSVSVYPNMFDSLIMQEIH

SEQ ID NO: 130386 - protein, 38 aa, Artificial Sequence
  Description of Artificial Sequence: Synthetic polypeptide
DEEEIRTTNPVATEQYGSVSTTTNLNNNQQGTTEQGTE

SEQ ID NO: 130387 - protein, 35 aa, Artificial Sequence
  Description of Artificial Sequence: Synthetic polypeptide
DEEEIRTTNPVATEQYGSVSVYPNQFDSRIMQEIQ

SEQ ID NO: 130388 - protein, 36 aa, Artificial Sequence
  Description of Artificial Sequence: Synthetic polypeptide
DENEIRTTNPVATEQYGSVSVTVYAEQPGENNGVEL

SEQ ID NO: 130389 - protein, 35 aa, Artificial Sequence
  Description of Artificial Sequence: Synthetic polypeptide
DENEIRTTNPVATEQYGSVSVTVYAEMPGNNGVES

SEQ ID NO: 130390 - protein, 33 aa, Artificial Sequence
  Description of Artificial Sequence: Synthetic polypeptide
DEVEIVTTNPVATDQYGVVSTDGEQGGQGNEED

SEQ ID NO: 130391 - protein, 36 aa, Artificial Sequence
  Description of Artificial Sequence: Synthetic polypeptide
DENEIRTTNPVATEQYGSVSVTTVLLNEGGNEFSFG

SEQ ID NO: 130392 - protein, 34 aa, Artificial Sequence
  Description of Artificial Sequence: Synthetic polypeptide
CEEEIRTTNPVATEQYGSVNAGTMGQGNGEFTGG

SEQ ID NO: 130393 - protein, 34 aa, Artificial Sequence
  Description of Artificial Sequence: Synthetic polypeptide
CEEEIRTTNPVATEQYGSVNDDTDDNNEFENDDE

SEQ ID NO: 130394 - protein, 35 aa, Artificial Sequence
  Description of Artificial Sequence: Synthetic polypeptide
DENEIRTTNPVATEQYGSVSVTLEMTENFGNNNQY

SEQ ID NO: 130395 - protein, 36 aa, Artificial Sequence
  Description of Artificial Sequence: Synthetic polypeptide
DENEIRTTNPVATEQYGSVSVTHNNLEDTRQEMEDY

SEQ ID NO: 130396 - protein, 32 aa, Artificial Sequence
  Description of Artificial Sequence: Synthetic polypeptide
DEVEIRTTNPVSTEPYGTISMEDSQQQQNGNH

SEQ ID NO: 130397 - protein, 33 aa, Artificial Sequence
  Description of Artificial Sequence: Synthetic polypeptide
DEVEIVTTNPVATEQYGTVCSATDGPVEFEGND

SEQ ID NO: 130398 - protein, 32 aa, Artificial Sequence
  Description of Artificial Sequence: Synthetic polypeptide
DEVEIRTTNPVSTEAYGSVTFTHLTQTEQQTK

SEQ ID NO: 130399 - protein, 35 aa, Artificial Sequence
  Description of Artificial Sequence: Synthetic polypeptide
CEEEIRTTNPVATEQYGSVIDQTNEGQEGGGEGGG

SEQ ID NO: 130400 - protein, 36 aa, Artificial Sequence
  Description of Artificial Sequence: Synthetic polypeptide
DEDEIRTTNPVAYEQWGSVCSTDNGGNTGQQGNGRI

SEQ ID NO: 130401 - protein, 36 aa, Artificial Sequence
  Description of Artificial Sequence: Synthetic polypeptide
DEDEIRTTNPVAYEQWGSVCSTDNGINAGQQGNDRN

SEQ ID NO: 130402 - protein, 36 aa, Artificial Sequence
  Description of Artificial Sequence: Synthetic polypeptide
DEEEIRTTNPVATEQYGSVSPTLAMMMQEENPEETN

SEQ ID NO: 130403 - protein, 34 aa, Artificial Sequence
  Description of Artificial Sequence: Synthetic polypeptide
DENEIRTTNPVATEQYGSVTATNATEYEGSKDMS

SEQ ID NO: 130404 - protein, 34 aa, Artificial Sequence
  Description of Artificial Sequence: Synthetic polypeptide
DEQEIATTNPVATEQYGSVISATDLWEDHEGEDL

SEQ ID NO: 130405 - protein, 38 aa, Artificial Sequence
  Description of Artificial Sequence: Synthetic polypeptide
DEEEIRTTNPVATEQYGSVSTTTNQQGNNNDEQGTNTD

SEQ ID NO: 130406 - protein, 38 aa, Artificial Sequence
  Description of Artificial Sequence: Synthetic polypeptide
DEEEIRTTNPVATEQYGSVSTTTNQQGGNQQGTEQGED

SEQ ID NO: 130407 - protein, 34 aa, Artificial Sequence
  Description of Artificial Sequence: Synthetic polypeptide
DEQEIATTNPVATEQYGSVKSATDLEDHEGLEDL

SEQ ID NO: 130408 - protein, 35 aa, Artificial Sequence
  Description of Artificial Sequence: Synthetic polypeptide
DENEIRTTNPVATEQYGSVSWPNWNEEIPNDQDRN

SEQ ID NO: 130409 - protein, 32 aa, Artificial Sequence
  Description of Artificial Sequence: Synthetic polypeptide
DEAEIRTTNPVATEQYGSSCEGTPYLPESEEQ

SEQ ID NO: 130410 - protein, 35 aa, Artificial Sequence
  Description of Artificial Sequence: Synthetic polypeptide
CEEEIRTTNPVATEQYGSVDTDGGNNDPEEDGNQD

SEQ ID NO: 130411 - protein, 33 aa, Artificial Sequence
  Description of Artificial Sequence: Synthetic polypeptide
DEQEIATTNPVATEQYGSVKSATDQEDHEGEDL

SEQ ID NO: 130412 - protein, 33 aa, Artificial Sequence
  Description of Artificial Sequence: Synthetic polypeptide
DEQEIATTNPVATEQYGSVLATDLEDHEGAEDL

SEQ ID NO: 130413 - protein, 36 aa, Artificial Sequence
  Description of Artificial Sequence: Synthetic polypeptide
DEEEIRTTNPVATEQYGSVSPTIGLLQENLEPEAVE

SEQ ID NO: 130414 - protein, 35 aa, Artificial Sequence
  Description of Artificial Sequence: Synthetic polypeptide
DEEEIRTTNPVATEQYGSVSVYAEPMADAGSNQFS

SEQ ID NO: 130415 - protein, 38 aa, Artificial Sequence
  Description of Artificial Sequence: Synthetic polypeptide
DEEEIRTTNPVATEQYGSVSTTTNNQQGTEQGTEETNV

SEQ ID NO: 130416 - protein, 35 aa, Artificial Sequence
  Description of Artificial Sequence: Synthetic polypeptide
DEDEIRTTNPVAYEQWGSVCSTDNLLDQDHENNDQ

SEQ ID NO: 130417 - protein, 34 aa, Artificial Sequence
  Description of Artificial Sequence: Synthetic polypeptide
DEQEIATTNPVATEQYGSVLSATDHLEDHEGEDL

SEQ ID NO: 130418 - protein, 36 aa, Artificial Sequence
  Description of Artificial Sequence: Synthetic polypeptide
CEEEIRTTNPVATEQYGSVGSNSDNGDQNDGGENGQ

SEQ ID NO: 130419 - protein, 33 aa, Artificial Sequence
  Description of Artificial Sequence: Synthetic polypeptide
DEVEIRTTNPVGYEQYGSVVCCDNELSGRVGSP

SEQ ID NO: 130420 - protein, 37 aa, Artificial Sequence
  Description of Artificial Sequence: Synthetic polypeptide
DEEEIRTTNPVATEQYGSVSTTTDAGVNTENGTNPVN

SEQ ID NO: 130421 - protein, 33 aa, Artificial Sequence
  Description of Artificial Sequence: Synthetic polypeptide
DEVEIVTTNPVATEQYGTVCSATDGPVIFEGND

SEQ ID NO: 130422 - protein, 33 aa, Artificial Sequence
  Description of Artificial Sequence: Synthetic polypeptide
DEQEIATTNPVATEQYGSVNATDLEDHEGTEDD

SEQ ID NO: 130423 - protein, 36 aa, Artificial Sequence
  Description of Artificial Sequence: Synthetic polypeptide
DEWEIRTTNPVATEQYGSVSSTTPAGPNMRNGMNPV

SEQ ID NO: 130424 - protein, 36 aa, Artificial Sequence
  Description of Artificial Sequence: Synthetic polypeptide
DEWEIRTTNPVATEQYGSVSSTTPAGPNMRNGMRPV

SEQ ID NO: 130425 - protein, 34 aa, Artificial Sequence
  Description of Artificial Sequence: Synthetic polypeptide
DEDEIRTTNPVAYEQWGSVCSTENDQGDAQNDGA

SEQ ID NO: 130426 - protein, 34 aa, Artificial Sequence
  Description of Artificial Sequence: Synthetic polypeptide
DEDEIRTTNPVAYEQWGSVCSTENDQGDTQAGGT

SEQ ID NO: 130427 - protein, 34 aa, Artificial Sequence
  Description of Artificial Sequence: Synthetic polypeptide
DEQEIATTNPVATEQYGSVPSCTDALEDHTGEDL

SEQ ID NO: 130428 - protein, 34 aa, Artificial Sequence
  Description of Artificial Sequence: Synthetic polypeptide
DEDEIRTTNPVAYEQWGSVCSTENDQNDDQHGGA

SEQ ID NO: 130429 - protein, 34 aa, Artificial Sequence
  Description of Artificial Sequence: Synthetic polypeptide
DEDEIRTTNPVAYEQWGSVCSTENDQNDTQNEGT

SEQ ID NO: 130430 - protein, 35 aa, Artificial Sequence
  Description of Artificial Sequence: Synthetic polypeptide
DEDEIRTTNPVAYEQWGSVCSTENDQQGDTQNGGE

SEQ ID NO: 130431 - protein, 35 aa, Artificial Sequence
  Description of Artificial Sequence: Synthetic polypeptide
DEDEIRTTNPVAYEQWGSVCSTENDQRNDAQNGSN

SEQ ID NO: 130432 - protein, 33 aa, Artificial Sequence
  Description of Artificial Sequence: Synthetic polypeptide
DEAEIRTTNPVATEQYGSLSVLDLNDRVQDDDL

SEQ ID NO: 130433 - protein, 36 aa, Artificial Sequence
  Description of Artificial Sequence: Synthetic polypeptide
DEEEIRTTNPVATEQYGSVSWLMELRQERDELELVQ

SEQ ID NO: 130434 - protein, 35 aa, Artificial Sequence
  Description of Artificial Sequence: Synthetic polypeptide
DEDEIRTTNPVAYEQWGSVCSTENDQRNDERNGQQ

SEQ ID NO: 130435 - protein, 35 aa, Artificial Sequence
  Description of Artificial Sequence: Synthetic polypeptide
DEDEIRTTNPVAYEQWGSVCSTENDQRNDQQNGDQ

SEQ ID NO: 130436 - protein, 35 aa, Artificial Sequence
  Description of Artificial Sequence: Synthetic polypeptide
DEDEIRTTNPVAYEQWGSVCSTENDQRNDTQNGQT

SEQ ID NO: 130437 - protein, 35 aa, Artificial Sequence
  Description of Artificial Sequence: Synthetic polypeptide
DEEEIRTTNPVATEQYGSVSWMLESDDAAMNELMQ

SEQ ID NO: 130438 - protein, 32 aa, Artificial Sequence
  Description of Artificial Sequence: Synthetic polypeptide
DEQEIATTNPVATEQYGSVQATDKEDHEGEDL

SEQ ID NO: 130439 - protein, 33 aa, Artificial Sequence
  Description of Artificial Sequence: Synthetic polypeptide
DESEIRTTNPVATECWGSVWCINEPMDREGENG

SEQ ID NO: 130440 - protein, 33 aa, Artificial Sequence
  Description of Artificial Sequence: Synthetic polypeptide
DEWEIVTTNPVATEQYGTVCSATDGPVEFEGND

SEQ ID NO: 130441 - protein, 35 aa, Artificial Sequence
  Description of Artificial Sequence: Synthetic polypeptide
CEEEIRTTNPVATEQYGSVSILQSNGEDEGENQNG

SEQ ID NO: 130442 - protein, 36 aa, Artificial Sequence
  Description of Artificial Sequence: Synthetic polypeptide
DEWEIRTTNPVATEQYGSVSSTEPAGPNMRNGMNPV

SEQ ID NO: 130443 - protein, 33 aa, Artificial Sequence
  Description of Artificial Sequence: Synthetic polypeptide
DEVEIVTTNPVATEQYGTVNSATDGPVEEEGND

SEQ ID NO: 130444 - protein, 33 aa, Artificial Sequence
  Description of Artificial Sequence: Synthetic polypeptide
DEQEIATTNPVATEQYGSVPATPDLEDHEGEDA

SEQ ID NO: 130445 - protein, 34 aa, Artificial Sequence
  Description of Artificial Sequence: Synthetic polypeptide
DEEEIRTTNPVATEQYGSVSWEVNIDEPMVIEQV

SEQ ID NO: 130446 - protein, 34 aa, Artificial Sequence
  Description of Artificial Sequence: Synthetic polypeptide
DENEIRTTNPVATEQYGSVSVTDMENGIEVSFED

SEQ ID NO: 130447 - protein, 35 aa, Artificial Sequence
  Description of Artificial Sequence: Synthetic polypeptide
DENEIRTTNPVATEQYGSVSVTDMENDRQEVSFEH

SEQ ID NO: 130448 - protein, 35 aa, Artificial Sequence
  Description of Artificial Sequence: Synthetic polypeptide
DENEIRTTNPVATEQYGSVSVTDFMENRQEVSFEE

SEQ ID NO: 130449 - protein, 34 aa, Artificial Sequence
  Description of Artificial Sequence: Synthetic polypeptide
DEVEIVTTNPVATESYGSVIDTNLNGQGEQGGQE

SEQ ID NO: 130450 - protein, 35 aa, Artificial Sequence
  Description of Artificial Sequence: Synthetic polypeptide
DEQEIATTNPVATEQYGSVNSATDGLETQEGEILN

SEQ ID NO: 130451 - protein, 35 aa, Artificial Sequence
  Description of Artificial Sequence: Synthetic polypeptide
DEDEIRTTNPVAYEQWGSVCSTDNMDGGHQHEGMR

SEQ ID NO: 130452 - protein, 37 aa, Artificial Sequence
  Description of Artificial Sequence: Synthetic polypeptide
DEEEIRTTNPVATEQYGSVSWEGNAENQEPNGENNEN

SEQ ID NO: 130453 - protein, 36 aa, Artificial Sequence
  Description of Artificial Sequence: Synthetic polypeptide
DEEEIRTTNPVATEQYGSVSPTGNGMEFEQLPEAEL

SEQ ID NO: 130454 - protein, 34 aa, Artificial Sequence
  Description of Artificial Sequence: Synthetic polypeptide
DEQEIATTNPVATEQYGSVNSATDLEDHEGEDLV

SEQ ID NO: 130455 - protein, 34 aa, Artificial Sequence
  Description of Artificial Sequence: Synthetic polypeptide
DEQEIATTNPVATEQYGSVNSATSDLEDHEGEDL

SEQ ID NO: 130456 - protein, 31 aa, Artificial Sequence
  Description of Artificial Sequence: Synthetic polypeptide
DEQEIATTNPVATEQYGSVPATDCEHEEEDL

SEQ ID NO: 130457 - protein, 34 aa, Artificial Sequence
  Description of Artificial Sequence: Synthetic polypeptide
DENEIRTTNPVATEQYGSVSVMDENQAEAFAGFT

SEQ ID NO: 130458 - protein, 34 aa, Artificial Sequence
  Description of Artificial Sequence: Synthetic polypeptide
DENEIRTTNPVATEQYGSVSVMDENQAEAFADRD

SEQ ID NO: 130459 - protein, 34 aa, Artificial Sequence
  Description of Artificial Sequence: Synthetic polypeptide
DEDEIRTTNPVAYEQWGSVCSTEEGLGDTQNGGA

SEQ ID NO: 130460 - protein, 34 aa, Artificial Sequence
  Description of Artificial Sequence: Synthetic polypeptide
DENEIRTTNPVATEQYGSVSVDDENQEILCEERN

SEQ ID NO: 130461 - protein, 34 aa, Artificial Sequence
  Description of Artificial Sequence: Synthetic polypeptide
DENEIRTTNPVATEQYGSVSTWPYEGEGTSQFSE

SEQ ID NO: 130462 - protein, 30 aa, Artificial Sequence
  Description of Artificial Sequence: Synthetic polypeptide
DEWEIRTTNPVATEQWGDVSEIEMNAAEDA

SEQ ID NO: 130463 - protein, 35 aa, Artificial Sequence
  Description of Artificial Sequence: Synthetic polypeptide
DEDEIRTTNPVAYEQWGSVCSTENDLQNDTQNGGA

SEQ ID NO: 130464 - protein, 37 aa, Artificial Sequence
  Description of Artificial Sequence: Synthetic polypeptide
DEEEIRTTNPVATEQYGSVSWESYNTEQARIEMSGSD

SEQ ID NO: 130465 - protein, 36 aa, Artificial Sequence
  Description of Artificial Sequence: Synthetic polypeptide
DEWEIRTTNPVATEQYGSVPSTTPAGPNMRNGMNPV

SEQ ID NO: 130466 - protein, 34 aa, Artificial Sequence
  Description of Artificial Sequence: Synthetic polypeptide
DENEIRTTNPVATEQYGSCASPTHDLFTGEEQQY

SEQ ID NO: 130467 - protein, 30 aa, Artificial Sequence
  Description of Artificial Sequence: Synthetic polypeptide
AENEIACTNPVATEQYGEASSEPAGQRGGV

SEQ ID NO: 130468 - protein, 36 aa, Artificial Sequence
  Description of Artificial Sequence: Synthetic polypeptide
DEYEIRTTNPVATEQYGSVSSWTPAGPNARNGMNPV

SEQ ID NO: 130469 - protein, 33 aa, Artificial Sequence
  Description of Artificial Sequence: Synthetic polypeptide
DEDEIRTTNPVAYEQWGSVSGGGNHGGQGDGKN

SEQ ID NO: 130470 - protein, 32 aa, Artificial Sequence
  Description of Artificial Sequence: Synthetic polypeptide
DEYVIRVTNPVATEQYGAVSTNGQQFQEEPPY

SEQ ID NO: 130471 - protein, 32 aa, Artificial Sequence
  Description of Artificial Sequence: Synthetic polypeptide
DEYVIRVTNPVATEQYGAVSTNGQQFTEEPDV

SEQ ID NO: 130472 - protein, 33 aa, Artificial Sequence
  Description of Artificial Sequence: Synthetic polypeptide
DEQEIATTNPVATEQYGSVSAPDLEDHEGPEDL

SEQ ID NO: 130473 - protein, 34 aa, Artificial Sequence
  Description of Artificial Sequence: Synthetic polypeptide
DEDEIRTTNPVAYEQWGSVSGGGNHQGAGGGAND

SEQ ID NO: 130474 - protein, 33 aa, Artificial Sequence
  Description of Artificial Sequence: Synthetic polypeptide
DEQEIATTNPVATEQYGSVSAPDWLEDHEGEDL

SEQ ID NO: 130475 - protein, 35 aa, Artificial Sequence
  Description of Artificial Sequence: Synthetic polypeptide
DEEEIRTTNPVATEQYGSVSPSISNSEVTDVHENL

SEQ ID NO: 130476 - protein, 36 aa, Artificial Sequence
  Description of Artificial Sequence: Synthetic polypeptide
DEEEIRTTNPVATEQYGSVSWVMELLNEQTENNLVI

SEQ ID NO: 130477 - protein, 35 aa, Artificial Sequence
  Description of Artificial Sequence: Synthetic polypeptide
DESEIRTTNPVATECWGSVSRCRNPEPQDREGENG

SEQ ID NO: 130478 - protein, 34 aa, Artificial Sequence
  Description of Artificial Sequence: Synthetic polypeptide
DEDEIRTTNPVAYEQWGSVSGGGNHQGIAGGENM

SEQ ID NO: 130479 - protein, 33 aa, Artificial Sequence
  Description of Artificial Sequence: Synthetic polypeptide
DEDEIRTTNPVAYEQWGSVSGGGNHQGPGGGEQ

SEQ ID NO: 130480 - protein, 34 aa, Artificial Sequence
  Description of Artificial Sequence: Synthetic polypeptide
DEDEIRTTNPVAYEQWGSVSGGGNHQGQGGGENA

SEQ ID NO: 130481 - protein, 33 aa, Artificial Sequence
  Description of Artificial Sequence: Synthetic polypeptide
DEQEIATTNPVATEQYGSVSARDLEDHEGFEDL

SEQ ID NO: 130482 - protein, 35 aa, Artificial Sequence
  Description of Artificial Sequence: Synthetic polypeptide
DEEEIRTTNPVATEQYGSVSPSELTLPQVMTTDVD

SEQ ID NO: 130483 - protein, 33 aa, Artificial Sequence
  Description of Artificial Sequence: Synthetic polypeptide
DEQEIATTNPVATEQYGSVSARDLWEDHEGEDL

SEQ ID NO: 130484 - protein, 35 aa, Artificial Sequence
  Description of Artificial Sequence: Synthetic polypeptide
DGEEIATTNPVATTQWGSVAWTENGDQDQRGQNDR

SEQ ID NO: 130485 - protein, 35 aa, Artificial Sequence
  Description of Artificial Sequence: Synthetic polypeptide
DENEIRTTNPVATEQYGSVSITSMFQTESNQESGI

SEQ ID NO: 130486 - protein, 36 aa, Artificial Sequence
  Description of Artificial Sequence: Synthetic polypeptide
DENEIRTTNPVATEQYGSVSITSENFQTESGQESGP

SEQ ID NO: 130487 - protein, 33 aa, Artificial Sequence
  Description of Artificial Sequence: Synthetic polypeptide
DEQEIATTNPVATEQYGSVSARGDLEDHEGEDL

SEQ ID NO: 130488 - protein, 36 aa, Artificial Sequence
  Description of Artificial Sequence: Synthetic polypeptide
DENEIRTTNPVATEQYGSVSNTLNVLMEMFGSEQIF

SEQ ID NO: 130489 - protein, 35 aa, Artificial Sequence
  Description of Artificial Sequence: Synthetic polypeptide
DEDEIRTTNPVAYEQWGSVSGGGNHQVGEGGGMNR

SEQ ID NO: 130490 - protein, 33 aa, Artificial Sequence
  Description of Artificial Sequence: Synthetic polypeptide
DEDEIRTTNPVAYEQWGSVSGGGNHAGQGGGEM

SEQ ID NO: 130491 - protein, 30 aa, Artificial Sequence
  Description of Artificial Sequence: Synthetic polypeptide
DEDEIATTNPVATESYGCIAGANDQANDNF

SEQ ID NO: 130492 - protein, 34 aa, Artificial Sequence
  Description of Artificial Sequence: Synthetic polypeptide
DESEIRTTNPVATECWGSVSSCINEPEDREGENG

SEQ ID NO: 130493 - protein, 35 aa, Artificial Sequence
  Description of Artificial Sequence: Synthetic polypeptide
DENEIRTTNPVATEQYGSVSPTMDMENRQEVSLED

SEQ ID NO: 130494 - protein, 34 aa, Artificial Sequence
  Description of Artificial Sequence: Synthetic polypeptide
DESEIRTTNPVATECWGSVSSCIAEPQDRNGMNG

SEQ ID NO: 130495 - protein, 38 aa, Artificial Sequence
  Description of Artificial Sequence: Synthetic polypeptide
DEEEIRTTNPVATEQYGSVSTTNQQSGNNNQQGTNQDE

SEQ ID NO: 130496 - protein, 33 aa, Artificial Sequence
  Description of Artificial Sequence: Synthetic polypeptide
DEYEIVTTNPVATEQYGTVCSATDGPVEFEGND

SEQ ID NO: 130497 - protein, 33 aa, Artificial Sequence
  Description of Artificial Sequence: Synthetic polypeptide
DEYEIVTTNPVATEQYGTVCSATDGPVEFEGNL

SEQ ID NO: 130498 - protein, 35 aa, Artificial Sequence
  Description of Artificial Sequence: Synthetic polypeptide
DENEIRTTNPVATEQYGSVSPTFNMHEEQQNVEDN

SEQ ID NO: 130499 - protein, 34 aa, Artificial Sequence
  Description of Artificial Sequence: Synthetic polypeptide
DEQEIATTNPVATEQYGSVSANHPLEDHGGGEDN

SEQ ID NO: 130500 - protein, 34 aa, Artificial Sequence
  Description of Artificial Sequence: Synthetic polypeptide
DEYEIVTTNPVATEQYGTVVSATDGNEEGEGNDD

SEQ ID NO: 130501 - protein, 33 aa, Artificial Sequence
  Description of Artificial Sequence: Synthetic polypeptide
DEYEIVTTNPVATEQYGTVYSATDGPVEFEGND

SEQ ID NO: 130502 - protein, 38 aa, Artificial Sequence
  Description of Artificial Sequence: Synthetic polypeptide
DEEEIRTTNPVATEQYGSVSTTNQQSGNNNDEQGSEQG

SEQ ID NO: 130503 - protein, 33 aa, Artificial Sequence
  Description of Artificial Sequence: Synthetic polypeptide
DEAEIRTTNPVATEQYGSFYTWLMESESINDQN

SEQ ID NO: 130504 - protein, 36 aa, Artificial Sequence
  Description of Artificial Sequence: Synthetic polypeptide
DEEEIRTTNPVATEQYGSVSPSSNIGGQLTQLVDLG

SEQ ID NO: 130505 - protein, 34 aa, Artificial Sequence
  Description of Artificial Sequence: Synthetic polypeptide
DEDEIRTTNPVAYEQWGSVSGDNQNNHGEDGNTR

SEQ ID NO: 130506 - protein, 38 aa, Artificial Sequence
  Description of Artificial Sequence: Synthetic polypeptide
DEEEIRTTNPVATEQYGSVSTTNQQQQSATEEGTTNQQ

SEQ ID NO: 130507 - protein, 31 aa, Artificial Sequence
  Description of Artificial Sequence: Synthetic polypeptide
DEYVIAVTNPVATEQYGAVSTNQQFQEPPDH

SEQ ID NO: 130508 - protein, 32 aa, Artificial Sequence
  Description of Artificial Sequence: Synthetic polypeptide
DEYVIAVTNPVATEQYGAVSTNQQLFQEEPDY

SEQ ID NO: 130509 - protein, 30 aa, Artificial Sequence
  Description of Artificial Sequence: Synthetic polypeptide
DEDEIATTNPVATESYGCIAGANDQTDDNF

SEQ ID NO: 130510 - protein, 31 aa, Artificial Sequence
  Description of Artificial Sequence: Synthetic polypeptide
DEDEIATTNPVATESYGCIAGANDQMADGNF

SEQ ID NO: 130511 - protein, 35 aa, Artificial Sequence
  Description of Artificial Sequence: Synthetic polypeptide
DENEIRTTNPVATEQYGSVSNTPNATLEETFEEMH

SEQ ID NO: 130512 - protein, 34 aa, Artificial Sequence
  Description of Artificial Sequence: Synthetic polypeptide
DESEIRTTNPVATECWGSVSSCINEPNDREGENG

SEQ ID NO: 130513 - protein, 35 aa, Artificial Sequence
  Description of Artificial Sequence: Synthetic polypeptide
DESEIRTTNPVATECWGSVSRCINEPQDREGENGG

SEQ ID NO: 130514 - protein, 34 aa, Artificial Sequence
  Description of Artificial Sequence: Synthetic polypeptide
DEQEIATTNPVATEQYGSVSASDLETQEGVEILN

SEQ ID NO: 130515 - protein, 34 aa, Artificial Sequence
  Description of Artificial Sequence: Synthetic polypeptide
DEDEIRTTNPVAYEQWGSVSMTQPGNDRQDTGEQ

SEQ ID NO: 130516 - protein, 36 aa, Artificial Sequence
  Description of Artificial Sequence: Synthetic polypeptide
DEEEIRTTNPVATEQYGSVSPPIQTGVIDNQVANLL

SEQ ID NO: 130517 - protein, 34 aa, Artificial Sequence
  Description of Artificial Sequence: Synthetic polypeptide
DENEIRTTNPVATEQYGSVSEADMINRQEVSFED

SEQ ID NO: 130518 - protein, 36 aa, Artificial Sequence
  Description of Artificial Sequence: Synthetic polypeptide
DEEEIRTTNPVATEQYGSVSPPINTGVIDDQVANVN

SEQ ID NO: 130519 - protein, 36 aa, Artificial Sequence
  Description of Artificial Sequence: Synthetic polypeptide
DENEIRTTNPVATEQYGSVSDYDNALNQPQGEDDYI

SEQ ID NO: 130520 - protein, 39 aa, Artificial Sequence
  Description of Artificial Sequence: Synthetic polypeptide
DEEEIRTTNPVATEQYGSVSTTNQQLQNGTTEQGNNAEE

SEQ ID NO: 130521 - protein, 36 aa, Artificial Sequence
  Description of Artificial Sequence: Synthetic polypeptide
DEEEIRTTNPVATEQYGSVSPPINLGVIDNQVAILN

SEQ ID NO: 130522 - protein, 36 aa, Artificial Sequence
  Description of Artificial Sequence: Synthetic polypeptide
DEEEIRTTNPVATEQYGSVSPPIMTGVIDNQVANMN

SEQ ID NO: 130523 - protein, 39 aa, Artificial Sequence
  Description of Artificial Sequence: Synthetic polypeptide
DEEEIRTTNPVATEQYGSVSTTNQQLQISTNEQGTNNGN

SEQ ID NO: 130524 - protein, 35 aa, Artificial Sequence
  Description of Artificial Sequence: Synthetic polypeptide
DEEEIRTTNPVATEQYGSVSYDSQMEPQQEQNDTL

SEQ ID NO: 130525 - protein, 36 aa, Artificial Sequence
  Description of Artificial Sequence: Synthetic polypeptide
DEEEIRTTNPVATEQYGSVSYEANMNQEPMGSELIE

SEQ ID NO: 130526 - protein, 37 aa, Artificial Sequence
  Description of Artificial Sequence: Synthetic polypeptide
DEEEIRTTNPVATEQYGSVSTTNQQGNNNQQGTQEDE

SEQ ID NO: 130527 - protein, 34 aa, Artificial Sequence
  Description of Artificial Sequence: Synthetic polypeptide
DEQEIATTNPVATEQYGSVSATCDTLEDHEGEDL

SEQ ID NO: 130528 - protein, 35 aa, Artificial Sequence
  Description of Artificial Sequence: Synthetic polypeptide
DEAEIRTTNPVATEQYGSFVNSENLDSYIGEEMID

SEQ ID NO: 130529 - protein, 35 aa, Artificial Sequence
  Description of Artificial Sequence: Synthetic polypeptide
DEEEIRTTNPVATEQYGSVSYENNMPEETPFQNEQ

SEQ ID NO: 130530 - protein, 34 aa, Artificial Sequence
  Description of Artificial Sequence: Synthetic polypeptide
DENEIRTTNPVATEQYGSVSDVDMVNRQEVSFFD

SEQ ID NO: 130531 - protein, 36 aa, Artificial Sequence
  Description of Artificial Sequence: Synthetic polypeptide
DEEEIRTTNPVATEQYGSVSPPDFEQEQRDTNGEVN

SEQ ID NO: 130532 - protein, 34 aa, Artificial Sequence
  Description of Artificial Sequence: Synthetic polypeptide
DESEIRTTNPVATECWGSVSPMINEPHDREGENG

SEQ ID NO: 130533 - protein, 36 aa, Artificial Sequence
  Description of Artificial Sequence: Synthetic polypeptide
DGEEIRTTNPVATEQYGSVSSTTPADPNMRNGMNPV

SEQ ID NO: 130534 - protein, 34 aa, Artificial Sequence
  Description of Artificial Sequence: Synthetic polypeptide
DEDEIRTTNPVAYEQWGSVSHTMNDRGNDGNNDP

SEQ ID NO: 130535 - protein, 33 aa, Artificial Sequence
  Description of Artificial Sequence: Synthetic polypeptide
CEEEIRTTNPVAYEQWGYTINPNEGDQRRGNAR

SEQ ID NO: 130536 - protein, 34 aa, Artificial Sequence
  Description of Artificial Sequence: Synthetic polypeptide
DESEIRTTNPVATECWGSVSQCINEPEDREGENG

SEQ ID NO: 130537 - protein, 39 aa, Artificial Sequence
  Description of Artificial Sequence: Synthetic polypeptide
DEEEIRTTNPVATEQYGSVSTTNQQLQQGTNEQGNNQEQ

SEQ ID NO: 130538 - protein, 39 aa, Artificial Sequence
  Description of Artificial Sequence: Synthetic polypeptide
DEEEIRTTNPVATEQYGSVSTTNQQQLQQGTEQGTNEEQ

SEQ ID NO: 130539 - protein, 36 aa, Artificial Sequence
  Description of Artificial Sequence: Synthetic polypeptide
DENEIRTTNPVATEQYGSVSFVTNHNTQEYNQFDHN

SEQ ID NO: 130540 - protein, 33 aa, Artificial Sequence
  Description of Artificial Sequence: Synthetic polypeptide
DEQEIATTNPVATEQYGSVSASDLMEDHEGEDL

SEQ ID NO: 130541 - protein, 35 aa, Artificial Sequence
  Description of Artificial Sequence: Synthetic polypeptide
DEEEIRTTNPVATEQYGSVSWWVALLETPEDNQEM

SEQ ID NO: 130542 - protein, 36 aa, Artificial Sequence
  Description of Artificial Sequence: Synthetic polypeptide
DEEEIRTTNPVATEQYGSVSPPYNTGVMDNQVANLN

SEQ ID NO: 130543 - protein, 33 aa, Artificial Sequence
  Description of Artificial Sequence: Synthetic polypeptide
DEDEIATTNPVATEQYGTVCSVTDGPVEFEGND

SEQ ID NO: 130544 - protein, 35 aa, Artificial Sequence
  Description of Artificial Sequence: Synthetic polypeptide
DENEIRTTNPVATEQYGSVSFTDMTNNRQEESFFD

SEQ ID NO: 130545 - protein, 35 aa, Artificial Sequence
  Description of Artificial Sequence: Synthetic polypeptide
DENEIRTTNPVATEQYGSVSFTDMINSRQEVSFQE

SEQ ID NO: 130546 - protein, 33 aa, Artificial Sequence
  Description of Artificial Sequence: Synthetic polypeptide
DEQEIATTNPVATEQYGSVSASDVLEDHQGEDL

SEQ ID NO: 130547 - protein, 35 aa, Artificial Sequence
  Description of Artificial Sequence: Synthetic polypeptide
DENEIRTTNPVATEQYGSVSFTDMINERQEVSFED

SEQ ID NO: 130548 - protein, 35 aa, Artificial Sequence
  Description of Artificial Sequence: Synthetic polypeptide
DENEIRTTNPVATEQYGSVSFTDEMENRQEVSFED

SEQ ID NO: 130549 - protein, 37 aa, Artificial Sequence
  Description of Artificial Sequence: Synthetic polypeptide
DEEEIRTTNPVATEQYGSVSPPPNLGVIADNQVANLN

SEQ ID NO: 130550 - protein, 38 aa, Artificial Sequence
  Description of Artificial Sequence: Synthetic polypeptide
DEEEIRTTNPVATEQYGSVSTTNQQNGNQQGTTEQGQE

SEQ ID NO: 130551 - protein, 35 aa, Artificial Sequence
  Description of Artificial Sequence: Synthetic polypeptide
DEDEIRTTNPVAYEQWGSVSGPNNGNEQDRGNGDL

SEQ ID NO: 130552 - protein, 34 aa, Artificial Sequence
  Description of Artificial Sequence: Synthetic polypeptide
DESEIRTTNPVATECWGSVSQCINEPQDWEGENG

SEQ ID NO: 130553 - protein, 35 aa, Artificial Sequence
  Description of Artificial Sequence: Synthetic polypeptide
DENEIRTTNPVATEQYGSVSETFTMMEERQNVEDN

SEQ ID NO: 130554 - protein, 32 aa, Artificial Sequence
  Description of Artificial Sequence: Synthetic polypeptide
DEDEIRTTNPVAYEQWGSVSHGMNDRNDGDDG

SEQ ID NO: 130555 - protein, 36 aa, Artificial Sequence
  Description of Artificial Sequence: Synthetic polypeptide
DEEEIRTTNPVATEQYGSVSPPNLGVIIDNNVANLN

SEQ ID NO: 130556 - protein, 39 aa, Artificial Sequence
  Description of Artificial Sequence: Synthetic polypeptide
DEEEIRTTNPVATEQYGSVSTTNQQLQQGTNEQGTNQDE

SEQ ID NO: 130557 - protein, 35 aa, Artificial Sequence
  Description of Artificial Sequence: Synthetic polypeptide
DEEEIRTTNPVATEQYGSVSWYPPKDLQSMEDFYW

SEQ ID NO: 130558 - protein, 36 aa, Artificial Sequence
  Description of Artificial Sequence: Synthetic polypeptide
DEYEIRTTNPVATEQYGSVSSTTPAGPNMRNGMNPV

SEQ ID NO: 130559 - protein, 36 aa, Artificial Sequence
  Description of Artificial Sequence: Synthetic polypeptide
DENEIRTTNPVATEQYGSVSPTMNMMEELVQNVEDN

SEQ ID NO: 130560 - protein, 33 aa, Artificial Sequence
  Description of Artificial Sequence: Synthetic polypeptide
DEYEIVTTNPVATEQYGAVVSATDGEEEGEGND

SEQ ID NO: 130561 - protein, 35 aa, Artificial Sequence
  Description of Artificial Sequence: Synthetic polypeptide
DENEIRTTNPVATEQYGSVSSTTPAGPNMANENPA

SEQ ID NO: 130562 - protein, 35 aa, Artificial Sequence
  Description of Artificial Sequence: Synthetic polypeptide
DEAEIRTTNPVATEQYGSVYPTDYELETRNGQEIE

SEQ ID NO: 130563 - protein, 35 aa, Artificial Sequence
  Description of Artificial Sequence: Synthetic polypeptide
DENEIRTTNPVATEQYGSVSSTTPAGNMRNGMDPA

SEQ ID NO: 130564 - protein, 32 aa, Artificial Sequence
  Description of Artificial Sequence: Synthetic polypeptide
DEQEIATTNPVATEQYGSVSAEDEMDHEGEDL

SEQ ID NO: 130565 - protein, 35 aa, Artificial Sequence
  Description of Artificial Sequence: Synthetic polypeptide
DESEIRTTNPVATECWGSVSTTIAGPQDRNGMNPV

SEQ ID NO: 130566 - protein, 35 aa, Artificial Sequence
  Description of Artificial Sequence: Synthetic polypeptide
DESEIRTTNPVATECWGSVSTTIAGPQDRNGMNPG

SEQ ID NO: 130567 - protein, 35 aa, Artificial Sequence
  Description of Artificial Sequence: Synthetic polypeptide
DEEEIRTTNPVATEQYGSVSWSIENDDTAMNELTQ

SEQ ID NO: 130568 - protein, 34 aa, Artificial Sequence
  Description of Artificial Sequence: Synthetic polypeptide
DENEIRTTNPVATEQYGSVSSTPAGPNMANEDPA

SEQ ID NO: 130569 - protein, 34 aa, Artificial Sequence
  Description of Artificial Sequence: Synthetic polypeptide
DENEIRTTNPVATEQYGSVSSTIGPMMANGMDPV

SEQ ID NO: 130570 - protein, 35 aa, Artificial Sequence
  Description of Artificial Sequence: Synthetic polypeptide
DESEIRTTNPVATECWGSVSTTIAEPQDRNGMNPG

SEQ ID NO: 130571 - protein, 33 aa, Artificial Sequence
  Description of Artificial Sequence: Synthetic polypeptide
DEDEIRTTNPVAYEQWGSVCYTNDGGHQGENHT

SEQ ID NO: 130572 - protein, 36 aa, Artificial Sequence
  Description of Artificial Sequence: Synthetic polypeptide
DEDEIRTTNPVAYEQWGSVCYTNEQDRMGGGGNDER

SEQ ID NO: 130573 - protein, 35 aa, Artificial Sequence
  Description of Artificial Sequence: Synthetic polypeptide
DEYEIRTTNPVATEQYGSVSWSYNDLEQNSQEDGI

SEQ ID NO: 130574 - protein, 34 aa, Artificial Sequence
  Description of Artificial Sequence: Synthetic polypeptide
DEDEIRTTNPVAYEQWGSVCYTTDNDGKQGNDRG

SEQ ID NO: 130575 - protein, 35 aa, Artificial Sequence
  Description of Artificial Sequence: Synthetic polypeptide
DESEIRTTNPVATECWGSVSTTIAEPQDRNGENPG

SEQ ID NO: 130576 - protein, 35 aa, Artificial Sequence
  Description of Artificial Sequence: Synthetic polypeptide
DESEIRTTNPVATECWGSVSTTIAEPQDREGENPG

SEQ ID NO: 130577 - protein, 34 aa, Artificial Sequence
  Description of Artificial Sequence: Synthetic polypeptide
DEYEIRTTNPVATEQYGSVTDAQWDAQLGQEDGN

SEQ ID NO: 130578 - protein, 36 aa, Artificial Sequence
  Description of Artificial Sequence: Synthetic polypeptide
DENEIRTTNPVATEQYGSVSSTEPAGPNMRNGMNPV

SEQ ID NO: 130579 - protein, 35 aa, Artificial Sequence
  Description of Artificial Sequence: Synthetic polypeptide
DENEIRTTNPVATEQYGSVSSTEPAGPNMHNEMNV

SEQ ID NO: 130580 - protein, 35 aa, Artificial Sequence
  Description of Artificial Sequence: Synthetic polypeptide
DENEIRTTNPVATEQYGSVSSTTPAGPNMANENPV

SEQ ID NO: 130581 - protein, 34 aa, Artificial Sequence
  Description of Artificial Sequence: Synthetic polypeptide
DEDEIATTNPVATEVWGSVCYTNDLQDQGGQNTK

SEQ ID NO: 130582 - protein, 36 aa, Artificial Sequence
  Description of Artificial Sequence: Synthetic polypeptide
DENEIRTTNPVATEQYGSVSSTTPAGPNMANGMNPV

SEQ ID NO: 130583 - protein, 34 aa, Artificial Sequence
  Description of Artificial Sequence: Synthetic polypeptide
DENEIRTTNPVATEQYGSVSSTTPAGPNMHGMEL

SEQ ID NO: 130584 - protein, 36 aa, Artificial Sequence
  Description of Artificial Sequence: Synthetic polypeptide
DEYEIRTTNPVATEQYGSVSSWTPAGPNMRNGMNPV

SEQ ID NO: 130585 - protein, 35 aa, Artificial Sequence
  Description of Artificial Sequence: Synthetic polypeptide
CEEEIRTTNPVATEQYGVVTEQDGDNGQRFNGNGQ

SEQ ID NO: 130586 - protein, 32 aa, Artificial Sequence
  Description of Artificial Sequence: Synthetic polypeptide
DEDEIRTTNPVAYEQWGSVCYNNDGHTDNGQR

SEQ ID NO: 130587 - protein, 35 aa, Artificial Sequence
  Description of Artificial Sequence: Synthetic polypeptide
CEEEIRTTNPVATEQYGVVTMSDGDNGQRFDDNGQ

SEQ ID NO: 130588 - protein, 35 aa, Artificial Sequence
  Description of Artificial Sequence: Synthetic polypeptide
CEEEIRTTNPVATEQYGVVTNTDGDNGQRFNDNGM

SEQ ID NO: 130589 - protein, 35 aa, Artificial Sequence
  Description of Artificial Sequence: Synthetic polypeptide
DEYEIRTTNPVATEQYGSVSTEDYLTTTEETQNDD

SEQ ID NO: 130590 - protein, 35 aa, Artificial Sequence
  Description of Artificial Sequence: Synthetic polypeptide
DEYEIRTTNPVATEQYGSVSTEYFMNTPSTQENPA

SEQ ID NO: 130591 - protein, 36 aa, Artificial Sequence
  Description of Artificial Sequence: Synthetic polypeptide
DENEIRTTNPVATEQYGSVSSTTPAYPNMRNGMNPV

SEQ ID NO: 130592 - protein, 36 aa, Artificial Sequence
  Description of Artificial Sequence: Synthetic polypeptide
DENEIRTTNPVATEQYGSVSSTTPAIPNMRNGMNPV

SEQ ID NO: 130593 - protein, 34 aa, Artificial Sequence
  Description of Artificial Sequence: Synthetic polypeptide
DESEIRTTNPVATECWGSVSVCINEPQDREGEEM

SEQ ID NO: 130594 - protein, 34 aa, Artificial Sequence
  Description of Artificial Sequence: Synthetic polypeptide
DEDEIRTTNPVAYEQWGSVCYNQDQDGGGGGDNR

SEQ ID NO: 130595 - protein, 36 aa, Artificial Sequence
  Description of Artificial Sequence: Synthetic polypeptide
DENEIRTTNPVATEQYGSVSSTTPAGPQMRNGMEPV

SEQ ID NO: 130596 - protein, 36 aa, Artificial Sequence
  Description of Artificial Sequence: Synthetic polypeptide
DENEIRTTNPVATEQYGSVSSTTPAGPNMRNGMNPV

SEQ ID NO: 130597 - protein, 36 aa, Artificial Sequence
  Description of Artificial Sequence: Synthetic polypeptide
DENEIRTTNPVATEQYGSVSSTTPAGPNMRNGMNPA

SEQ ID NO: 130598 - protein, 32 aa, Artificial Sequence
  Description of Artificial Sequence: Synthetic polypeptide
DEQEIATTNPVATEQYGSVSAEDCEDHEGEDL

SEQ ID NO: 130599 - protein, 34 aa, Artificial Sequence
  Description of Artificial Sequence: Synthetic polypeptide
DEDEIRTTNPVAYEQWGSVCYNQDQMGGQGNQNR

SEQ ID NO: 130600 - protein, 35 aa, Artificial Sequence
  Description of Artificial Sequence: Synthetic polypeptide
DENEIRTTNPVATEQYGSVSSTTPAGPNMHGMNPV

SEQ ID NO: 130601 - protein, 34 aa, Artificial Sequence
  Description of Artificial Sequence: Synthetic polypeptide
DEDEIRTTNPVAYEQWGSVCYNQDQMGHGGNDNR

SEQ ID NO: 130602 - protein, 34 aa, Artificial Sequence
  Description of Artificial Sequence: Synthetic polypeptide
DEDEIRTTNPVAYEQWGSVCYNQDQMGQGGNEGR

SEQ ID NO: 130603 - protein, 31 aa, Artificial Sequence
  Description of Artificial Sequence: Synthetic polypeptide
AENEIACTNPVATEQYGEASNENLQPKGGYI

SEQ ID NO: 130604 - protein, 35 aa, Artificial Sequence
  Description of Artificial Sequence: Synthetic polypeptide
DENEIRTTNPVATEQYGSVSPTMYLLEVSRDMVET

SEQ ID NO: 130605 - protein, 35 aa, Artificial Sequence
  Description of Artificial Sequence: Synthetic polypeptide
DEYEIRTTNPVATEQYGSVTPENYDETTQSGQDNQ

SEQ ID NO: 130606 - protein, 34 aa, Artificial Sequence
  Description of Artificial Sequence: Synthetic polypeptide
DEDEIATTNPVATEVWGSVCYTNDLQDQGGQGGR

SEQ ID NO: 130607 - protein, 33 aa, Artificial Sequence
  Description of Artificial Sequence: Synthetic polypeptide
DEQEIATTNPVATEQYGSVSAIDLEDHEGQEDL

SEQ ID NO: 130608 - protein, 38 aa, Artificial Sequence
  Description of Artificial Sequence: Synthetic polypeptide
DEEEIRTTNPVATEQYGSVSTTNTQNGNQAGTEQGNVN

SEQ ID NO: 130609 - protein, 34 aa, Artificial Sequence
  Description of Artificial Sequence: Synthetic polypeptide
DESEIRTTNPVATECWGSVSSCINEPQDREGEYG

SEQ ID NO: 130610 - protein, 33 aa, Artificial Sequence
  Description of Artificial Sequence: Synthetic polypeptide
DEQEIATTNPVATEQYGSVSALDLEDHEGEDLT

SEQ ID NO: 130611 - protein, 38 aa, Artificial Sequence
  Description of Artificial Sequence: Synthetic polypeptide
DEEEIRTTNPVATEQYGSVSTTNTNNQISTEQGTVNGN

SEQ ID NO: 130612 - protein, 35 aa, Artificial Sequence
  Description of Artificial Sequence: Synthetic polypeptide
DENEIRTTNPVATEQYGSVSPWVPHEQRTSSNQQH

SEQ ID NO: 130613 - protein, 39 aa, Artificial Sequence
  Description of Artificial Sequence: Synthetic polypeptide
DEEEIRTTNPVATEQYGSVSTTNTNLQQSTTEQGTNQDQ

SEQ ID NO: 130614 - protein, 35 aa, Artificial Sequence
  Description of Artificial Sequence: Synthetic polypeptide
DESEIRTTNPVATECWGSVSSCINEPQDREGENPV

SEQ ID NO: 130615 - protein, 34 aa, Artificial Sequence
  Description of Artificial Sequence: Synthetic polypeptide
DENEIRTTNPVATEQYGSVSPWDMQELDGDGLQK

SEQ ID NO: 130616 - protein, 33 aa, Artificial Sequence
  Description of Artificial Sequence: Synthetic polypeptide
DENEIRTTNPVATEQYGSVSPWDMPEEGDLLQK

SEQ ID NO: 130617 - protein, 36 aa, Artificial Sequence
  Description of Artificial Sequence: Synthetic polypeptide
DEEEIRTTNPVATEQYGSVSPTAAMMMQEENEEEVN

SEQ ID NO: 130618 - protein, 35 aa, Artificial Sequence
  Description of Artificial Sequence: Synthetic polypeptide
DESEIRTTNPVATECWGSVSSCINEPQDREGENPG

SEQ ID NO: 130619 - protein, 35 aa, Artificial Sequence
  Description of Artificial Sequence: Synthetic polypeptide
DENEIRTTNPVATEQYGSVSPTVYAENPGNNSVED

SEQ ID NO: 130620 - protein, 33 aa, Artificial Sequence
  Description of Artificial Sequence: Synthetic polypeptide
DEAEIRTTNPVATEQYGSFYTYLMEYESINDQY

SEQ ID NO: 130621 - protein, 30 aa, Artificial Sequence
  Description of Artificial Sequence: Synthetic polypeptide
DEDEIATTNPVATESYGCIAGTGDQAEDNF

SEQ ID NO: 130622 - protein, 35 aa, Artificial Sequence
  Description of Artificial Sequence: Synthetic polypeptide
DENEIRTTNPVATEQYGSVSPTSWDEQNSSQIDRS

SEQ ID NO: 130623 - protein, 35 aa, Artificial Sequence
  Description of Artificial Sequence: Synthetic polypeptide
DENEIRTTNPVATEQYGSVSPTPWLDGRPESPQFP

SEQ ID NO: 130624 - protein, 35 aa, Artificial Sequence
  Description of Artificial Sequence: Synthetic polypeptide
DENEIRTTNPVATEQYGSVSPTPAAEQHISNNPQV

SEQ ID NO: 130625 - protein, 34 aa, Artificial Sequence
  Description of Artificial Sequence: Synthetic polypeptide
DESEIRTTNPVATECWGSVSSCINEPQDRCGEIG

SEQ ID NO: 130626 - protein, 31 aa, Artificial Sequence
  Description of Artificial Sequence: Synthetic polypeptide
CEEEIRTTNPVATSRYGTVYATVALDTGGQG

SEQ ID NO: 130627 - protein, 36 aa, Artificial Sequence
  Description of Artificial Sequence: Synthetic polypeptide
DEYEIRTTNPVATEQYGSVTPTNEVDETTQSGQDNQ

SEQ ID NO: 130628 - protein, 34 aa, Artificial Sequence
  Description of Artificial Sequence: Synthetic polypeptide
DEAEIRTTNPVATEQYGSWLTPDPDLNREENNQH

SEQ ID NO: 130629 - protein, 33 aa, Artificial Sequence
  Description of Artificial Sequence: Synthetic polypeptide
DEQEIATTNPVATEQYGSVSAHDTLEDHEGEDL

SEQ ID NO: 130630 - protein, 34 aa, Artificial Sequence
  Description of Artificial Sequence: Synthetic polypeptide
DENEIRTTNPVATEQYGSVSSTEPAGNMHNEMEV

SEQ ID NO: 130631 - protein, 35 aa, Artificial Sequence
  Description of Artificial Sequence: Synthetic polypeptide
DEYEIRTTNPVATEQYGSVTWTTNDGEQNSNEDGW

SEQ ID NO: 130632 - protein, 34 aa, Artificial Sequence
  Description of Artificial Sequence: Synthetic polypeptide
DEDEIATTNPVATEVWGSVCYTNDLQDQGGNNMD

SEQ ID NO: 130633 - protein, 35 aa, Artificial Sequence
  Description of Artificial Sequence: Synthetic polypeptide
DEEEIRTTNPVATEQYGSVSPTAMMMYESGEEEVN

SEQ ID NO: 130634 - protein, 37 aa, Artificial Sequence
  Description of Artificial Sequence: Synthetic polypeptide
DEYEIRTTNPVATEQYGSVVSETIMLEELRNGNEEQF

SEQ ID NO: 130635 - protein, 35 aa, Artificial Sequence
  Description of Artificial Sequence: Synthetic polypeptide
DEDEIRTTNPVAYEQWGSVSGDNDNNGQRGGNGDS

SEQ ID NO: 130636 - protein, 34 aa, Artificial Sequence
  Description of Artificial Sequence: Synthetic polypeptide
DESEIRTTNPVATECWGSVSSGEENQDREGSNQA

SEQ ID NO: 130637 - protein, 34 aa, Artificial Sequence
  Description of Artificial Sequence: Synthetic polypeptide
DEDEIRTTNPVAYEQWGSVSGDNDNNGQRGHEDG

SEQ ID NO: 130638 - protein, 35 aa, Artificial Sequence
  Description of Artificial Sequence: Synthetic polypeptide
DESEIRTTNPVATECWGSVSSCPNGPQDRNGMNPG

SEQ ID NO: 130639 - protein, 34 aa, Artificial Sequence
  Description of Artificial Sequence: Synthetic polypeptide
DEAEIRTTNPVATEQYGSVYVWNMQDDFRSLEDN

SEQ ID NO: 130640 - protein, 35 aa, Artificial Sequence
  Description of Artificial Sequence: Synthetic polypeptide
DEDEIRTTNPVAYEQWGSVSGDNDNNGQRGRNEDQ

SEQ ID NO: 130641 - protein, 34 aa, Artificial Sequence
  Description of Artificial Sequence: Synthetic polypeptide
DEAEIRTTNPVATEQYGSHSESPEQDRIGSSGQE

SEQ ID NO: 130642 - protein, 34 aa, Artificial Sequence
  Description of Artificial Sequence: Synthetic polypeptide
DEDEIRTTNPVAYEQWGSVSGDNDNNGQRQNEDS

SEQ ID NO: 130643 - protein, 35 aa, Artificial Sequence
  Description of Artificial Sequence: Synthetic polypeptide
DEAEIRTTNPVATEQYGSHMSTPNLLFGGLEEDFD

SEQ ID NO: 130644 - protein, 34 aa, Artificial Sequence
  Description of Artificial Sequence: Synthetic polypeptide
DESEIRTTNPVATECWGSVSSCPNEPNDREGENV

SEQ ID NO: 130645 - protein, 36 aa, Artificial Sequence
  Description of Artificial Sequence: Synthetic polypeptide
CEEEIRTTNPVATEWYGSVASTNEISQTDTGGNNLM

SEQ ID NO: 130646 - protein, 33 aa, Artificial Sequence
  Description of Artificial Sequence: Synthetic polypeptide
DEQEIATTNPVATEQYGSVSAGPPANDNPGGQP

SEQ ID NO: 130647 - protein, 32 aa, Artificial Sequence
  Description of Artificial Sequence: Synthetic polypeptide
CEEEIRTTNPVATMRYGCVYATMALDQIGGQG

SEQ ID NO: 130648 - protein, 32 aa, Artificial Sequence
  Description of Artificial Sequence: Synthetic polypeptide
CEEEIRTTNPVATSKYGCVMYATVALDQGGQG

SEQ ID NO: 130649 - protein, 31 aa, Artificial Sequence
  Description of Artificial Sequence: Synthetic polypeptide
CEEEIRTTNPVATSRYGCVVATVAVDQGGQG

SEQ ID NO: 130650 - protein, 36 aa, Artificial Sequence
  Description of Artificial Sequence: Synthetic polypeptide
DEEEIRTTNPVATEQYGSVSETGVSEDQAEILMIRD

SEQ ID NO: 130651 - protein, 33 aa, Artificial Sequence
  Description of Artificial Sequence: Synthetic polypeptide
DEDEIRTTNPVSTEPYGTVSMEDIQNQQNGLNC

SEQ ID NO: 130652 - protein, 32 aa, Artificial Sequence
  Description of Artificial Sequence: Synthetic polypeptide
DQEEIATTNPVATTQWGCVVCTEGDHQNGNHR

SEQ ID NO: 130653 - protein, 35 aa, Artificial Sequence
  Description of Artificial Sequence: Synthetic polypeptide
DEEEIRTTNPVATEQYGSVSMTMVWTVSPQMAEEQ

SEQ ID NO: 130654 - protein, 36 aa, Artificial Sequence
  Description of Artificial Sequence: Synthetic polypeptide
DEEEIRTTNPVATEQYGSVSMTGNTNETTPLPEERI

SEQ ID NO: 130655 - protein, 33 aa, Artificial Sequence
  Description of Artificial Sequence: Synthetic polypeptide
DEECIACTNPVAYEQYGWVVSWNEFSQRGGNEG

SEQ ID NO: 130656 - protein, 34 aa, Artificial Sequence
  Description of Artificial Sequence: Synthetic polypeptide
DEAEIRTTNPVATEQYGCVGENLDFGGSNENDQD

SEQ ID NO: 130657 - protein, 32 aa, Artificial Sequence
  Description of Artificial Sequence: Synthetic polypeptide
DENEIRTTNPVATEQWGSVSEIEPMNREEEDG

SEQ ID NO: 130658 - protein, 32 aa, Artificial Sequence
  Description of Artificial Sequence: Synthetic polypeptide
DENEIRTTNPVATEQWGSVSEIEPMDREEEDG

SEQ ID NO: 130659 - protein, 33 aa, Artificial Sequence
  Description of Artificial Sequence: Synthetic polypeptide
DEAEIRTTNPVATEQYGCVCSWNPANFNSNTQS

SEQ ID NO: 130660 - protein, 33 aa, Artificial Sequence
  Description of Artificial Sequence: Synthetic polypeptide
DEAEIRTTNPVATEQYGCVCSWNHFNFNSNTQA

SEQ ID NO: 130661 - protein, 32 aa, Artificial Sequence
  Description of Artificial Sequence: Synthetic polypeptide
DENEIRTTNPVATEQWGSVSEIIEPMNAAENA

SEQ ID NO: 130662 - protein, 35 aa, Artificial Sequence
  Description of Artificial Sequence: Synthetic polypeptide
DEEEIRTTNPVATEQYGSVSMTDADQQASVEEKDP

SEQ ID NO: 130663 - protein, 34 aa, Artificial Sequence
  Description of Artificial Sequence: Synthetic polypeptide
DEDEIATTNPVATEAWGVVCSTNDGQDRSGTNNQ

SEQ ID NO: 130664 - protein, 34 aa, Artificial Sequence
  Description of Artificial Sequence: Synthetic polypeptide
DEAEIRTTNPVATEQYGCVCSWGEHQSFGSENQS

SEQ ID NO: 130665 - protein, 34 aa, Artificial Sequence
  Description of Artificial Sequence: Synthetic polypeptide
DEDEIATTNPVATEAWGVVCSTNDGQDRPGTNSN

SEQ ID NO: 130666 - protein, 34 aa, Artificial Sequence
  Description of Artificial Sequence: Synthetic polypeptide
DEECIATTNPVATEQYGSVFVWINGEQDRKMNDV

SEQ ID NO: 130667 - protein, 36 aa, Artificial Sequence
  Description of Artificial Sequence: Synthetic polypeptide
DEEEIRTTNPVATEQYGSVSTTIVTTVIPNGQNQLD

SEQ ID NO: 130668 - protein, 29 aa, Artificial Sequence
  Description of Artificial Sequence: Synthetic peptide
AENEIACTNPVATEQWGEASEIEQNREGR

SEQ ID NO: 130669 - protein, 33 aa, Artificial Sequence
  Description of Artificial Sequence: Synthetic polypeptide
DEECIATTNPVAYEAYRGSVAVENELSQSGGNM

SEQ ID NO: 130670 - protein, 31 aa, Artificial Sequence
  Description of Artificial Sequence: Synthetic polypeptide
AENEIACTNPVATEQWGEACSENLQGGGGAR

SEQ ID NO: 130671 - protein, 35 aa, Artificial Sequence
  Description of Artificial Sequence: Synthetic polypeptide
DESEIRTTNPVATECWGSVSCINEPQDREGENNGA

SEQ ID NO: 130672 - protein, 34 aa, Artificial Sequence
  Description of Artificial Sequence: Synthetic polypeptide
DEAEIRTTNPVATEQYGCVNTNPDENGYEEMNEI

SEQ ID NO: 130673 - protein, 34 aa, Artificial Sequence
  Description of Artificial Sequence: Synthetic polypeptide
DEAEIRTTNPVATEQYGCVSANYELAGIGIEDTA

SEQ ID NO: 130674 - protein, 34 aa, Artificial Sequence
  Description of Artificial Sequence: Synthetic polypeptide
DEECEIATTNPVATEPWGSVCYNNDSQDQGDNDR

SEQ ID NO: 130675 - protein, 35 aa, Artificial Sequence
  Description of Artificial Sequence: Synthetic polypeptide
DEEEIRTTNPVATEQYGSVSMWYPAMQLQSMEDFY

SEQ ID NO: 130676 - protein, 37 aa, Artificial Sequence
  Description of Artificial Sequence: Synthetic polypeptide
DEEEIRTTNPVATEQYGSVSMWDNPLPTMRLGLDEDP

SEQ ID NO: 130677 - protein, 34 aa, Artificial Sequence
  Description of Artificial Sequence: Synthetic polypeptide
CEEEISTTNPVATEQYGCVCSNTEETQNFGSNQS

SEQ ID NO: 130678 - protein, 34 aa, Artificial Sequence
  Description of Artificial Sequence: Synthetic polypeptide
DSEEIRTTNPVGTEQWGEVPACTGTLSQREGGVR

SEQ ID NO: 130679 - protein, 33 aa, Artificial Sequence
  Description of Artificial Sequence: Synthetic polypeptide
DEQEIATTNPVATEQYGSVSATDLENHEEQEDL

SEQ ID NO: 130680 - protein, 31 aa, Artificial Sequence
  Description of Artificial Sequence: Synthetic polypeptide
AENEIACTNPVATEQYGCASANLQNEGGGQL

SEQ ID NO: 130681 - protein, 34 aa, Artificial Sequence
  Description of Artificial Sequence: Synthetic polypeptide
DEAEIRTTNPVATEQYGCVSTEYELSGIGIEDTA

SEQ ID NO: 130682 - protein, 35 aa, Artificial Sequence
  Description of Artificial Sequence: Synthetic polypeptide
DEAEIRTTNPVATEQYGCVSTENYELDGIGIEDTE

SEQ ID NO: 130683 - protein, 35 aa, Artificial Sequence
  Description of Artificial Sequence: Synthetic polypeptide
DEAEIRTTNPVATEQYGCVSTENDLGAREETSPEM

SEQ ID NO: 130684 - protein, 34 aa, Artificial Sequence
  Description of Artificial Sequence: Synthetic polypeptide
DESEIRTTNPVATECWGSVSCINEPQDREGEWGG

SEQ ID NO: 130685 - protein, 33 aa, Artificial Sequence
  Description of Artificial Sequence: Synthetic polypeptide
DEDEIATTNPVATEHYGSVCYNNDDQDHGDTDR

SEQ ID NO: 130686 - protein, 34 aa, Artificial Sequence
  Description of Artificial Sequence: Synthetic polypeptide
DESEIRTTNPVATECWGSVSCINEPQDREGETWG

SEQ ID NO: 130687 - protein, 31 aa, Artificial Sequence
  Description of Artificial Sequence: Synthetic polypeptide
AENEIACTNPVATEQYGAASNENLQPKGGYI

SEQ ID NO: 130688 - protein, 32 aa, Artificial Sequence
  Description of Artificial Sequence: Synthetic polypeptide
DENEIRTTNPVATEQWGSVSEPIEMNAAEMDA

SEQ ID NO: 130689 - protein, 31 aa, Artificial Sequence
  Description of Artificial Sequence: Synthetic polypeptide
DENEIRTTNPVATEQWGSVSEPIEMNAAEDA

SEQ ID NO: 130690 - protein, 33 aa, Artificial Sequence
  Description of Artificial Sequence: Synthetic polypeptide
DEAEIRTTNPVATEQYGCVSMDDEQPRTQQDMI

SEQ ID NO: 130691 - protein, 35 aa, Artificial Sequence
  Description of Artificial Sequence: Synthetic polypeptide
DEAEIRTTNPVATEQYGCVSHTNDEQQEIGIEDQA

SEQ ID NO: 130692 - protein, 34 aa, Artificial Sequence
  Description of Artificial Sequence: Synthetic polypeptide
CEEEISTTNPVATEQYGCVCSNTEHQENIGSNQS

SEQ ID NO: 130693 - protein, 34 aa, Artificial Sequence
  Description of Artificial Sequence: Synthetic polypeptide
DESEIRTTNPVATECWGSVSCINEPQDREGEPGP

SEQ ID NO: 130694 - protein, 34 aa, Artificial Sequence
  Description of Artificial Sequence: Synthetic polypeptide
DEEEIRTTNPVATEQYGSVSMPVGMDMRVPVSFI

SEQ ID NO: 130695 - protein, 30 aa, Artificial Sequence
  Description of Artificial Sequence: Synthetic polypeptide
AENEIACTNPVATEQWGEACENLQRGGGDA

SEQ ID NO: 130696 - protein, 34 aa, Artificial Sequence
  Description of Artificial Sequence: Synthetic polypeptide
DEAEIRTTNPVAYEQWGESVQIQRNDDVQRGDRR

SEQ ID NO: 130697 - protein, 34 aa, Artificial Sequence
  Description of Artificial Sequence: Synthetic polypeptide
CEEEISTTNPVATEQYGCVCSNTELAHFGSENQT

SEQ ID NO: 130698 - protein, 30 aa, Artificial Sequence
  Description of Artificial Sequence: Synthetic polypeptide
DENEIRTTNPVATEQWGQVSEIEMNAAEDD

SEQ ID NO: 130699 - protein, 30 aa, Artificial Sequence
  Description of Artificial Sequence: Synthetic polypeptide
DENEIRTTNPVATEQWGQVSEIEMNAAEDA

SEQ ID NO: 130700 - protein, 31 aa, Artificial Sequence
  Description of Artificial Sequence: Synthetic polypeptide
DEAEIRTTNPVATEQYGCVCSWEHANNSDQS

SEQ ID NO: 130701 - protein, 30 aa, Artificial Sequence
  Description of Artificial Sequence: Synthetic polypeptide
DENEIRTTNPVATEQWGQVSEIEHNAAEDA

SEQ ID NO: 130702 - protein, 30 aa, Artificial Sequence
  Description of Artificial Sequence: Synthetic polypeptide
DENEIRTTNPVATEQWGQVSEGEMNAAEDA

SEQ ID NO: 130703 - protein, 34 aa, Artificial Sequence
  Description of Artificial Sequence: Synthetic polypeptide
DEECIATTNPVAYECYGSVATENELSQSGGNYMH

SEQ ID NO: 130704 - protein, 34 aa, Artificial Sequence
  Description of Artificial Sequence: Synthetic polypeptide
DSEEIRTTNPVGYECWGMVSRTNDLQQDRNGSDR

SEQ ID NO: 130705 - protein, 33 aa, Artificial Sequence
  Description of Artificial Sequence: Synthetic polypeptide
DSEEIRTTNPVGYEQWGCVRHNDDQQDRQGNVR

SEQ ID NO: 130706 - protein, 31 aa, Artificial Sequence
  Description of Artificial Sequence: Synthetic polypeptide
DENEIRTTNPVATEQWGQDVSEIEMNGPEEA

SEQ ID NO: 130707 - protein, 33 aa, Artificial Sequence
  Description of Artificial Sequence: Synthetic polypeptide
DSEEIRTTNPVGYEQWGCVRHNDLQQDRDGEGR

SEQ ID NO: 130708 - protein, 32 aa, Artificial Sequence
  Description of Artificial Sequence: Synthetic polypeptide
DEECIATTNPVAYEEYSEEVTTGNGQDDGNTR

SEQ ID NO: 130709 - protein, 29 aa, Artificial Sequence
  Description of Artificial Sequence: Synthetic peptide
AENEIACTNPVATEQWGDASENEQNREGA

SEQ ID NO: 130710 - protein, 29 aa, Artificial Sequence
  Description of Artificial Sequence: Synthetic peptide
AENEIACTNPVATEQWGDASENEMRAGGA

SEQ ID NO: 130711 - protein, 29 aa, Artificial Sequence
  Description of Artificial Sequence: Synthetic peptide
AENEIACTNPVATEQWGDASEIEQNREDR

SEQ ID NO: 130712 - protein, 30 aa, Artificial Sequence
  Description of Artificial Sequence: Synthetic polypeptide
AENEIACTNPVATEQFGEASEVLQRGDGQQ

SEQ ID NO: 130713 - protein, 32 aa, Artificial Sequence
  Description of Artificial Sequence: Synthetic polypeptide
DSEEIRTTNPVSYEQYGSTVPCFNLSPGGGDT

SEQ ID NO: 130714 - protein, 32 aa, Artificial Sequence
  Description of Artificial Sequence: Synthetic polypeptide
DSEEIRTTNPVSYEQYGSTVPCLNHSQGGGQT

SEQ ID NO: 130715 - protein, 33 aa, Artificial Sequence
  Description of Artificial Sequence: Synthetic polypeptide
DSEEIRTTNPVSYEQYGSTVPCYFNLSQGGGQM

SEQ ID NO: 130716 - protein, 33 aa, Artificial Sequence
  Description of Artificial Sequence: Synthetic polypeptide
DENEIRTTNPVATEQWGNVSTVTISTNVAEDGA

SEQ ID NO: 130717 - protein, 30 aa, Artificial Sequence
  Description of Artificial Sequence: Synthetic polypeptide
DENEIRTTNPVATEQWGQVSEIEMNAATDA

SEQ ID NO: 130718 - protein, 31 aa, Artificial Sequence
  Description of Artificial Sequence: Synthetic polypeptide
DEDEIATTNPVATEQWGAVAENDQTNDNMES

SEQ ID NO: 130719 - protein, 34 aa, Artificial Sequence
  Description of Artificial Sequence: Synthetic polypeptide
DSEEIRTTNPVGYECWGMVSRTNDLDQDRNGDMR

SEQ ID NO: 130720 - protein, 34 aa, Artificial Sequence
  Description of Artificial Sequence: Synthetic polypeptide
DEAEIRTTNPVAYEQWGEVCSTDNGDERIGGNNQ

SEQ ID NO: 130721 - protein, 34 aa, Artificial Sequence
  Description of Artificial Sequence: Synthetic polypeptide
CEEEISTTNPVATEQYGCVCSNTELQENFGSDAS

SEQ ID NO: 130722 - protein, 33 aa, Artificial Sequence
  Description of Artificial Sequence: Synthetic polypeptide
DEAEIRTTNPVATEQYGCVCSWELNFNFNSEQA

SEQ ID NO: 130723 - protein, 32 aa, Artificial Sequence
  Description of Artificial Sequence: Synthetic polypeptide
DEECIATTNPVAYECWGSVYNWTNDRQSEGNM

SEQ ID NO: 130724 - protein, 31 aa, Artificial Sequence
  Description of Artificial Sequence: Synthetic polypeptide
DENEIRTTNPVATEQWGSVSCIIEMNAAEDA

SEQ ID NO: 130725 - protein, 36 aa, Artificial Sequence
  Description of Artificial Sequence: Synthetic polypeptide
DEEEIRTTNPVATEQYGSVSTTIMMWQESTGEEEVE

SEQ ID NO: 130726 - protein, 34 aa, Artificial Sequence
  Description of Artificial Sequence: Synthetic polypeptide
CEEEISTTNPVATEQYGCVCSNTELQEYFGSEQN

SEQ ID NO: 130727 - protein, 33 aa, Artificial Sequence
  Description of Artificial Sequence: Synthetic polypeptide
DEAEIRTTNPVATEQYGCVCSWEHNQHFPSNQS

SEQ ID NO: 130728 - protein, 35 aa, Artificial Sequence
  Description of Artificial Sequence: Synthetic polypeptide
DSEEIRTTNPVGTEQYGSVVASCTGHMPARGGNND

SEQ ID NO: 130729 - protein, 34 aa, Artificial Sequence
  Description of Artificial Sequence: Synthetic polypeptide
DSEEIRTTNPVGTEQYGSVVQSCTGHPATGGNND

SEQ ID NO: 130730 - protein, 35 aa, Artificial Sequence
  Description of Artificial Sequence: Synthetic polypeptide
DSEEIRTTNPVGTEQYGSVVSCTGHAPNARGGNND

SEQ ID NO: 130731 - protein, 30 aa, Artificial Sequence
  Description of Artificial Sequence: Synthetic polypeptide
DSEEIRTTNPVGTEWWGMVCINLEREVQQE

SEQ ID NO: 130732 - protein, 31 aa, Artificial Sequence
  Description of Artificial Sequence: Synthetic polypeptide
DENEIRTTNPVATEQWGSDVSEIEMNAAEDA

SEQ ID NO: 130733 - protein, 32 aa, Artificial Sequence
  Description of Artificial Sequence: Synthetic polypeptide
DEECIATTNPVAYECWGSVYNWTNDVQREGHN

SEQ ID NO: 130734 - protein, 32 aa, Artificial Sequence
  Description of Artificial Sequence: Synthetic polypeptide
DEAEIRTTNPVATEQYGCVCSWEHINFGSEQS

SEQ ID NO: 130735 - protein, 30 aa, Artificial Sequence
  Description of Artificial Sequence: Synthetic polypeptide
DENEIRTTNPVATEQWGRVSEIEMNAAEDL

SEQ ID NO: 130736 - protein, 30 aa, Artificial Sequence
  Description of Artificial Sequence: Synthetic polypeptide
DENEIRTTNPVATEQWGRVSEIEMNAAEDA

SEQ ID NO: 130737 - protein, 33 aa, Artificial Sequence
  Description of Artificial Sequence: Synthetic polypeptide
DEQEIATTNPVATEQYGSVSATDLEVHLSEDLF

SEQ ID NO: 130738 - protein, 30 aa, Artificial Sequence
  Description of Artificial Sequence: Synthetic polypeptide
DSEEIRTTNPVGTEWWGMVVTNMEREVQQE

SEQ ID NO: 130739 - protein, 33 aa, Artificial Sequence
  Description of Artificial Sequence: Synthetic polypeptide
DEAEIRTTNPVAYEQWGEVCSTDEGHQIGGNEQ

SEQ ID NO: 130740 - protein, 33 aa, Artificial Sequence
  Description of Artificial Sequence: Synthetic polypeptide
DENEIRTTNPVATEQWGQVSEIESMNAAVGDNA

SEQ ID NO: 130741 - protein, 33 aa, Artificial Sequence
  Description of Artificial Sequence: Synthetic polypeptide
DSEEIRTTNPVGTEQWGCVCSTNHQNFGSVTQA

SEQ ID NO: 130742 - protein, 35 aa, Artificial Sequence
  Description of Artificial Sequence: Synthetic polypeptide
DEEEIRTTNPVATEQYGSVSNAGNLEWPATEVEEE

SEQ ID NO: 130743 - protein, 30 aa, Artificial Sequence
  Description of Artificial Sequence: Synthetic polypeptide
DENEIRTTNPVATEQWGTISEDEQQQAEDA

SEQ ID NO: 130744 - protein, 35 aa, Artificial Sequence
  Description of Artificial Sequence: Synthetic polypeptide
DSEEIRTTNPVATERYGKVQHTNVSQQRTGGSERQ

SEQ ID NO: 130745 - protein, 35 aa, Artificial Sequence
  Description of Artificial Sequence: Synthetic polypeptide
DSEEIRTTNPVATERYGKVSVNEVSQQRTGGSERQ

SEQ ID NO: 130746 - protein, 30 aa, Artificial Sequence
  Description of Artificial Sequence: Synthetic polypeptide
DENEIRTTNPVATEQWGTVSEWEMNATEDS

SEQ ID NO: 130747 - protein, 36 aa, Artificial Sequence
  Description of Artificial Sequence: Synthetic polypeptide
DSEEIRTTNPVATEYYGCVCSTENELSGKTGGNNRG

SEQ ID NO: 130748 - protein, 30 aa, Artificial Sequence
  Description of Artificial Sequence: Synthetic polypeptide
DENEIRTTNPVATEQWGTVSEQESNEAEDA

SEQ ID NO: 130749 - protein, 30 aa, Artificial Sequence
  Description of Artificial Sequence: Synthetic polypeptide
DENEIRTTNPVATEQWGTVSEIWMNAAEDA

SEQ ID NO: 130750 - protein, 30 aa, Artificial Sequence
  Description of Artificial Sequence: Synthetic polypeptide
DENEIRTTNPVATEQWGTVSEIPMNFEEDA

SEQ ID NO: 130751 - protein, 30 aa, Artificial Sequence
  Description of Artificial Sequence: Synthetic polypeptide
DENEIRTTNPVATEQWGTVSEIPENFEEDA

SEQ ID NO: 130752 - protein, 32 aa, Artificial Sequence
  Description of Artificial Sequence: Synthetic polypeptide
DEDEIATTNPVATEQWGCVAGTGLAQRPDQDL

SEQ ID NO: 130753 - protein, 34 aa, Artificial Sequence
  Description of Artificial Sequence: Synthetic polypeptide
DSEEIRTTNPVAWERYGKVFTNVSQQRTGGSERP

SEQ ID NO: 130754 - protein, 30 aa, Artificial Sequence
  Description of Artificial Sequence: Synthetic polypeptide
DEDEIATTNPVATEQWGCVAGTGLAATDQD

SEQ ID NO: 130755 - protein, 34 aa, Artificial Sequence
  Description of Artificial Sequence: Synthetic polypeptide
DESEIRTTNPVATECWGSVSCINEPQDRKVENGM

SEQ ID NO: 130756 - protein, 36 aa, Artificial Sequence
  Description of Artificial Sequence: Synthetic polypeptide
DSEEIRTTNPVAYEQWGSVPSTTLMGSNQRNGGNPV

SEQ ID NO: 130757 - protein, 32 aa, Artificial Sequence
  Description of Artificial Sequence: Synthetic polypeptide
DEDEIATTNPVATEQWGCVAATANLERIADTE

SEQ ID NO: 130758 - protein, 33 aa, Artificial Sequence
  Description of Artificial Sequence: Synthetic polypeptide
DEQEIATTNPVATEQYGSVSATDLEEDHEMEDL

SEQ ID NO: 130759 - protein, 31 aa, Artificial Sequence
  Description of Artificial Sequence: Synthetic polypeptide
DEDEIATTNPVATEQWGCVAAKANLMMPGQN

SEQ ID NO: 130760 - protein, 34 aa, Artificial Sequence
  Description of Artificial Sequence: Synthetic polypeptide
DEAEIRTTNPVATEQYGCVSYNDEQQGIGIEDQN

SEQ ID NO: 130761 - protein, 33 aa, Artificial Sequence
  Description of Artificial Sequence: Synthetic polypeptide
DEAEIRTTNPVATEQYGCVSYDTEGTGPQFDRF

SEQ ID NO: 130762 - protein, 30 aa, Artificial Sequence
  Description of Artificial Sequence: Synthetic polypeptide
DENEIRTTNPVATEQWGTVSEIIMNAAEDH

SEQ ID NO: 130763 - protein, 35 aa, Artificial Sequence
  Description of Artificial Sequence: Synthetic polypeptide
DSEEIRTTNPVATERYGKVPFTNVSQVRTGGSERQ

SEQ ID NO: 130764 - protein, 30 aa, Artificial Sequence
  Description of Artificial Sequence: Synthetic polypeptide
DENEIRTTNPVATEQWGTVSEIIMNAAEDA

SEQ ID NO: 130765 - protein, 34 aa, Artificial Sequence
  Description of Artificial Sequence: Synthetic polypeptide
DESEIRTTNPVATECWGSVSCINEPQDTEGENLG

SEQ ID NO: 130766 - protein, 31 aa, Artificial Sequence
  Description of Artificial Sequence: Synthetic polypeptide
DENEIRTTNPVATEQWGTVSTEAETNAAEDA

SEQ ID NO: 130767 - protein, 33 aa, Artificial Sequence
  Description of Artificial Sequence: Synthetic polypeptide
DEDEIATTNPVATEQWGSVAIANNLEQGGGMQE

SEQ ID NO: 130768 - protein, 31 aa, Artificial Sequence
  Description of Artificial Sequence: Synthetic polypeptide
AENEIACTNPVATEQYGCSCSSNDQNFGSDQ

SEQ ID NO: 130769 - protein, 38 aa, Artificial Sequence
  Description of Artificial Sequence: Synthetic polypeptide
DEEEIRTTNPVATEQYGSVTSLCPNLENVSRVGNMAED

SEQ ID NO: 130770 - protein, 33 aa, Artificial Sequence
  Description of Artificial Sequence: Synthetic polypeptide
DENEIRTTNPVATEQWGTVSTEQQGNNNADEDA

SEQ ID NO: 130771 - protein, 36 aa, Artificial Sequence
  Description of Artificial Sequence: Synthetic polypeptide
DEEEIRTTNPVATEQYGSVSTTMEVFMEPVNLEPDN

SEQ ID NO: 130772 - protein, 33 aa, Artificial Sequence
  Description of Artificial Sequence: Synthetic polypeptide
DENEIRTTNPVATEQWGTVSTEQQEATNNAEDA

SEQ ID NO: 130773 - protein, 32 aa, Artificial Sequence
  Description of Artificial Sequence: Synthetic polypeptide
DENEIRTTNPVATEQWGTVSTEQGNNAAEDTE

SEQ ID NO: 130774 - protein, 34 aa, Artificial Sequence
  Description of Artificial Sequence: Synthetic polypeptide
DEDEIATTNPVATEQWGSVAIANGLEQGGGMPRE

SEQ ID NO: 130775 - protein, 32 aa, Artificial Sequence
  Description of Artificial Sequence: Synthetic polypeptide
DENEIRTTNPVATEQWGTVSTEQENNNAAEDG

SEQ ID NO: 130776 - protein, 32 aa, Artificial Sequence
  Description of Artificial Sequence: Synthetic polypeptide
AENEIACTNPVATEQYGCSCSSGNLQYFGSGQ

SEQ ID NO: 130777 - protein, 32 aa, Artificial Sequence
  Description of Artificial Sequence: Synthetic polypeptide
DEDEIATTNPVATEQWGNTTTATNELAGMGNN

SEQ ID NO: 130778 - protein, 32 aa, Artificial Sequence
  Description of Artificial Sequence: Synthetic polypeptide
DENEIRTTNPVATEQWGTVSTEQANNNATEDA

SEQ ID NO: 130779 - protein, 33 aa, Artificial Sequence
  Description of Artificial Sequence: Synthetic polypeptide
DENEIRTTNPVATEQWGTVSTEQAGNNNAAEDA

SEQ ID NO: 130780 - protein, 33 aa, Artificial Sequence
  Description of Artificial Sequence: Synthetic polypeptide
DENEIRTTNPVATEQWGTVSTEQAGNNAAEDED

SEQ ID NO: 130781 - protein, 34 aa, Artificial Sequence
  Description of Artificial Sequence: Synthetic polypeptide
DEEEIRTTNPVATEQYGSVTSNGFGEFTGEGVES

SEQ ID NO: 130782 - protein, 32 aa, Artificial Sequence
  Description of Artificial Sequence: Synthetic polypeptide
DENEIRTTNPVATEQWGTVSTEISTTNAGEDA

SEQ ID NO: 130783 - protein, 33 aa, Artificial Sequence
  Description of Artificial Sequence: Synthetic polypeptide
DESEIRTTNPVATECWGSVSCINEPQGRSFEGG

SEQ ID NO: 130784 - protein, 32 aa, Artificial Sequence
  Description of Artificial Sequence: Synthetic polypeptide
AENEIACTNPVATEQYGCSCSSGNLQNGSGQS

SEQ ID NO: 130785 - protein, 34 aa, Artificial Sequence
  Description of Artificial Sequence: Synthetic polypeptide
DESEIRTTNPVATECWGSVSCINEPQDVEGENGD

SEQ ID NO: 130786 - protein, 35 aa, Artificial Sequence
  Description of Artificial Sequence: Synthetic polypeptide
DSEEIRTTNPVATERYGKVFTNEVSQQRTGGPERQ

SEQ ID NO: 130787 - protein, 33 aa, Artificial Sequence
  Description of Artificial Sequence: Synthetic polypeptide
DENEIRTTNPVATEQWGNVSTVQIGTTNNAEDA

SEQ ID NO: 130788 - protein, 30 aa, Artificial Sequence
  Description of Artificial Sequence: Synthetic polypeptide
DEDEIATTNPVATEQWGCVAAKANLMMPDP

SEQ ID NO: 130789 - protein, 36 aa, Artificial Sequence
  Description of Artificial Sequence: Synthetic polypeptide
DEEEIRTTNPVATEQYGSVTSPELYQDNMGGQLQID

SEQ ID NO: 130790 - protein, 31 aa, Artificial Sequence
  Description of Artificial Sequence: Synthetic polypeptide
DENEIRTTNPVATEQWGTVCSTIEMNAAEDA

SEQ ID NO: 130791 - protein, 31 aa, Artificial Sequence
  Description of Artificial Sequence: Synthetic polypeptide
AENEIACTNPVATEQYGCFCSWGNDQRGSGQ

SEQ ID NO: 130792 - protein, 30 aa, Artificial Sequence
  Description of Artificial Sequence: Synthetic polypeptide
AENEIACTNPVATEQYGCFCSWELQYGSDQ

SEQ ID NO: 130793 - protein, 37 aa, Artificial Sequence
  Description of Artificial Sequence: Synthetic polypeptide
DEEEIRTTNPVATEQYGSVSNCMNNLQAPRVDEFEGI

SEQ ID NO: 130794 - protein, 32 aa, Artificial Sequence
  Description of Artificial Sequence: Synthetic polypeptide
DSEEIRTTNPVGTEQWGCVCSSELQNFGSVQS

SEQ ID NO: 130795 - protein, 34 aa, Artificial Sequence
  Description of Artificial Sequence: Synthetic polypeptide
DESEIRTTNPVATECWGSVSCINEPQDREVENGG

SEQ ID NO: 130796 - protein, 32 aa, Artificial Sequence
  Description of Artificial Sequence: Synthetic polypeptide
DSEEIRTTNPVGTEQWGCVCSTEPQHFGSVQS

SEQ ID NO: 130797 - protein, 31 aa, Artificial Sequence
  Description of Artificial Sequence: Synthetic polypeptide
DENEIRTTNPVATEQWGTISMIIQQQQNGDH

SEQ ID NO: 130798 - protein, 32 aa, Artificial Sequence
  Description of Artificial Sequence: Synthetic polypeptide
DENEIRTTNPVATEQWGTISMEIEQQQANGNA

SEQ ID NO: 130799 - protein, 32 aa, Artificial Sequence
  Description of Artificial Sequence: Synthetic polypeptide
DENEIRTTNPVATEQWGTISMEIEQMQANGNA

SEQ ID NO: 130800 - protein, 32 aa, Artificial Sequence
  Description of Artificial Sequence: Synthetic polypeptide
DENEIRTTNPVATEQWGTISMEIEQMQAAGNA

SEQ ID NO: 130801 - protein, 35 aa, Artificial Sequence
  Description of Artificial Sequence: Synthetic polypeptide
DEAEIRTTNPVATEQYGCVSTNYELDSGIGIEDTA

SEQ ID NO: 130802 - protein, 30 aa, Artificial Sequence
  Description of Artificial Sequence: Synthetic polypeptide
DENEIRTTNPVATEQWGTISMDEQQQAEDA

SEQ ID NO: 130803 - protein, 30 aa, Artificial Sequence
  Description of Artificial Sequence: Synthetic polypeptide
DEDEIATTNPVATEQWGCTAGNGLADDGDA

SEQ ID NO: 130804 - protein, 34 aa, Artificial Sequence
  Description of Artificial Sequence: Synthetic polypeptide
DESEIRTTNPVATECWGSVSCINEPQDRESENGG

SEQ ID NO: 130805 - protein, 33 aa, Artificial Sequence
  Description of Artificial Sequence: Synthetic polypeptide
DESEIRTTNPVATECWGSVSCINEPQDREIEGG

SEQ ID NO: 130806 - protein, 30 aa, Artificial Sequence
  Description of Artificial Sequence: Synthetic polypeptide
DENEIRTTNPVATEQWGTISEIEQQQAEDA

SEQ ID NO: 130807 - protein, 30 aa, Artificial Sequence
  Description of Artificial Sequence: Synthetic polypeptide
DENEIRTTNPVATEQWGTISEIEQNQAEDA

SEQ ID NO: 130808 - protein, 30 aa, Artificial Sequence
  Description of Artificial Sequence: Synthetic polypeptide
DENEIRTTNPVATEQWGTISEIEQNAAEDA

SEQ ID NO: 130809 - protein, 31 aa, Artificial Sequence
  Description of Artificial Sequence: Synthetic polypeptide
DEDEIATTNPVATEQWGCVAAKANLMDDPGN

SEQ ID NO: 130810 - protein, 35 aa, Artificial Sequence
  Description of Artificial Sequence: Synthetic polypeptide
DEEEIRTTNPVATEQYGSVTSPELEDNMGGQQSID

SEQ ID NO: 130811 - protein, 35 aa, Artificial Sequence
  Description of Artificial Sequence: Synthetic polypeptide
DEAEIRTTNPVATEQYGCVSTYNIEQQGIGIEDQA

SEQ ID NO: 130812 - protein, 30 aa, Artificial Sequence
  Description of Artificial Sequence: Synthetic polypeptide
DENEIRTTNPVATEQWGTVSCIEMNAAEDA

SEQ ID NO: 130813 - protein, 35 aa, Artificial Sequence
  Description of Artificial Sequence: Synthetic polypeptide
DEAEIRTTNPVATEQYGCVSWTTHNHFGIGENQQN

SEQ ID NO: 130814 - protein, 36 aa, Artificial Sequence
  Description of Artificial Sequence: Synthetic polypeptide
DSEEIRTTNPVAYEQYGSVPSTTLAGSNQSNGGNPV

SEQ ID NO: 130815 - protein, 30 aa, Artificial Sequence
  Description of Artificial Sequence: Synthetic polypeptide
DENEIRTTNPVATEQWGTVSEIEMNFEEDA

SEQ ID NO: 130816 - protein, 31 aa, Artificial Sequence
  Description of Artificial Sequence: Synthetic polypeptide
DENEIRTTNPVATEQWGTVSEIEMNATETDA

SEQ ID NO: 130817 - protein, 30 aa, Artificial Sequence
  Description of Artificial Sequence: Synthetic polypeptide
DENEIRTTNPVATEQWGTVSEIEMNAEEDA

SEQ ID NO: 130818 - protein, 32 aa, Artificial Sequence
  Description of Artificial Sequence: Synthetic polypeptide
DSEEIRTTNPVAYEQYGTISCHNEFSHKTENR

SEQ ID NO: 130819 - protein, 33 aa, Artificial Sequence
  Description of Artificial Sequence: Synthetic polypeptide
DESEIRTTNPVATECWGSVSCINEPQDREYETG

SEQ ID NO: 130820 - protein, 31 aa, Artificial Sequence
  Description of Artificial Sequence: Synthetic polypeptide
DENEIRTTNPVATEQWGTVSEIEMNAAEDDA

SEQ ID NO: 130821 - protein, 30 aa, Artificial Sequence
  Description of Artificial Sequence: Synthetic polypeptide
DENEIRTTNPVATEQWGTVSEIEMNAAEDD

SEQ ID NO: 130822 - protein, 30 aa, Artificial Sequence
  Description of Artificial Sequence: Synthetic polypeptide
DENEIRTTNPVATEQWGTVSEIEMNAAEDA

SEQ ID NO: 130823 - protein, 30 aa, Artificial Sequence
  Description of Artificial Sequence: Synthetic polypeptide
DENEIRTTNPVATEQWGTVSEIEENAEEDA

SEQ ID NO: 130824 - protein, 34 aa, Artificial Sequence
  Description of Artificial Sequence: Synthetic polypeptide
DEAEIRTTNPVATEQYGCVSVQMNDEQQGGIEVI

SEQ ID NO: 130825 - protein, 32 aa, Artificial Sequence
  Description of Artificial Sequence: Synthetic polypeptide
DENEIRTTNPVATEQWGTVSEGVEMNAALDNA

SEQ ID NO: 130826 - protein, 35 aa, Artificial Sequence
  Description of Artificial Sequence: Synthetic polypeptide
DEEEIRTTNPVATEQYGSVSNDDSLNENQSVAEDQ

SEQ ID NO: 130827 - protein, 35 aa, Artificial Sequence
  Description of Artificial Sequence: Synthetic polypeptide
DEEEIRTTNPVATEQYGSVTSSVFGEQQLEMENEI

SEQ ID NO: 130828 - protein, 32 aa, Artificial Sequence
  Description of Artificial Sequence: Synthetic polypeptide
DENEIRTTNPVATEQWGTVSEGEQMNAAEDNA

SEQ ID NO: 130829 - protein, 31 aa, Artificial Sequence
  Description of Artificial Sequence: Synthetic polypeptide
DENEIRTTNPVATEQWGTVSEGEMNAAEDYA

SEQ ID NO: 130830 - protein, 31 aa, Artificial Sequence
  Description of Artificial Sequence: Synthetic polypeptide
DENEIRTTNPVATEQWGTVSEDIEENAAGDA

SEQ ID NO: 130831 - protein, 32 aa, Artificial Sequence
  Description of Artificial Sequence: Synthetic polypeptide
DSEEIRTTNPVCTEQWGAVVSTINLEFMEVQQ

SEQ ID NO: 130832 - protein, 34 aa, Artificial Sequence
  Description of Artificial Sequence: Synthetic polypeptide
DEAEIRTTNPVAYEQWGCSYNVRNDLDQRGHEGR

SEQ ID NO: 130833 - protein, 33 aa, Artificial Sequence
  Description of Artificial Sequence: Synthetic polypeptide
DSEEISTTNPVAYTQWGSTVSTNAPSARGGNEI

SEQ ID NO: 130834 - protein, 32 aa, Artificial Sequence
  Description of Artificial Sequence: Synthetic polypeptide
DSEEISTTNPVAYTQWGSTVSTNAPSMIGGNH

SEQ ID NO: 130835 - protein, 33 aa, Artificial Sequence
  Description of Artificial Sequence: Synthetic polypeptide
DSEEISTTNPVAYTQWGSTVSTNAVSMRGGNLI

SEQ ID NO: 130836 - protein, 33 aa, Artificial Sequence
  Description of Artificial Sequence: Synthetic polypeptide
DESEIRTTNPVATECWGSVSCINEPQDMEFENG

SEQ ID NO: 130837 - protein, 34 aa, Artificial Sequence
  Description of Artificial Sequence: Synthetic polypeptide
DEQEIATTNPVATEQYGSVSATDLNEDHEGKEDL

SEQ ID NO: 130838 - protein, 33 aa, Artificial Sequence
  Description of Artificial Sequence: Synthetic polypeptide
DEAEIRTTNPVATEQYGCVCSTEHAENFNSNQP

SEQ ID NO: 130839 - protein, 34 aa, Artificial Sequence
  Description of Artificial Sequence: Synthetic polypeptide
DESEIRTTNPVATECWGSVSCINEPQDKEGENGC

SEQ ID NO: 130840 - protein, 35 aa, Artificial Sequence
  Description of Artificial Sequence: Synthetic polypeptide
DEQEIATTNPVATEQYGSVSATDLNERHQGLEDEN

SEQ ID NO: 130841 - protein, 34 aa, Artificial Sequence
  Description of Artificial Sequence: Synthetic polypeptide
DEQEIATTNPVATEQYGSVSATDLNEVHQGEDEM

SEQ ID NO: 130842 - protein, 29 aa, Artificial Sequence
  Description of Artificial Sequence: Synthetic peptide
DENEIRTTNPVATEQWGEVPEIEMHAEDA

SEQ ID NO: 130843 - protein, 34 aa, Artificial Sequence
  Description of Artificial Sequence: Synthetic polypeptide
DEAEIRTTNPVATEQYGCVCSTEEHEGFGSENQG

SEQ ID NO: 130844 - protein, 32 aa, Artificial Sequence
  Description of Artificial Sequence: Synthetic polypeptide
DTEAEIATTNPVAYEQYGSVATADQNQGDEQM

SEQ ID NO: 130845 - protein, 31 aa, Artificial Sequence
  Description of Artificial Sequence: Synthetic polypeptide
DENEIRTTNPVATEQWGESVSEIEMNAAEDA

SEQ ID NO: 130846 - protein, 32 aa, Artificial Sequence
  Description of Artificial Sequence: Synthetic polypeptide
DENEIRTTNPVATEQWGELAHTTYYVSGGNNR

SEQ ID NO: 130847 - protein, 34 aa, Artificial Sequence
  Description of Artificial Sequence: Synthetic polypeptide
DEAEIRTTNPVAYEQWGSCVYSDEVNDHQRNSNP

SEQ ID NO: 130848 - protein, 33 aa, Artificial Sequence
  Description of Artificial Sequence: Synthetic polypeptide
DESEIRTTNPVATECWGSVSCINEPQDHEWENG

SEQ ID NO: 130849 - protein, 34 aa, Artificial Sequence
  Description of Artificial Sequence: Synthetic polypeptide
DESEIRTTNPVATECWGSVSCINEPQDHEGENPG

SEQ ID NO: 130850 - protein, 35 aa, Artificial Sequence
  Description of Artificial Sequence: Synthetic polypeptide
DEECIATVNPVATEAYGCSVPSCMNLSERGGNNRD

SEQ ID NO: 130851 - protein, 29 aa, Artificial Sequence
  Description of Artificial Sequence: Synthetic peptide
DENEIRTTNPVATEQWGEASEICMNHEDA

SEQ ID NO: 130852 - protein, 35 aa, Artificial Sequence
  Description of Artificial Sequence: Synthetic polypeptide
DEEEIRTTNPVATEQYGSVSLTVNPSIETITQDQT

SEQ ID NO: 130853 - protein, 31 aa, Artificial Sequence
  Description of Artificial Sequence: Synthetic polypeptide
DENEIRTTNPVATEQWGDYVSEIEMNANEDA

SEQ ID NO: 130854 - protein, 36 aa, Artificial Sequence
  Description of Artificial Sequence: Synthetic polypeptide
DEEEIRTTNPVATEQYGSVSLTVNPNIETETLQDST

SEQ ID NO: 130855 - protein, 34 aa, Artificial Sequence
  Description of Artificial Sequence: Synthetic polypeptide
DEAEIRTTNPVAYEQWGSCVYSDESNDTQRNSNQ

SEQ ID NO: 130856 - protein, 34 aa, Artificial Sequence
  Description of Artificial Sequence: Synthetic polypeptide
DEAEIRTTNPVAYEQWGSCVYSDEWNDGQRSQNE

SEQ ID NO: 130857 - protein, 33 aa, Artificial Sequence
  Description of Artificial Sequence: Synthetic polypeptide
DESEIRTTNPVATECWGSVSCINEPQDNEKENG

SEQ ID NO: 130858 - protein, 33 aa, Artificial Sequence
  Description of Artificial Sequence: Synthetic polypeptide
DESEIRTTNPVATECWGSVSCINEPQDQEGEFG

SEQ ID NO: 130859 - protein, 30 aa, Artificial Sequence
  Description of Artificial Sequence: Synthetic polypeptide
DENEIRTTNPVATEQWGGVSEIEKNAAEDA

SEQ ID NO: 130860 - protein, 30 aa, Artificial Sequence
  Description of Artificial Sequence: Synthetic polypeptide
DENEIRTTNPVATEQWGFVSEIEMNAAEEA

SEQ ID NO: 130861 - protein, 30 aa, Artificial Sequence
  Description of Artificial Sequence: Synthetic polypeptide
DENEIRTTNPVATEQWGFVSEIEMNAAEDA

SEQ ID NO: 130862 - protein, 32 aa, Artificial Sequence
  Description of Artificial Sequence: Synthetic polypeptide
DTEAEIACTNPVAYEQYGSCATNLQNGGDTDM

SEQ ID NO: 130863 - protein, 35 aa, Artificial Sequence
  Description of Artificial Sequence: Synthetic polypeptide
DEAEIRTTNPVAYEQWGEVVSTNNILGEDGGNNRR

SEQ ID NO: 130864 - protein, 30 aa, Artificial Sequence
  Description of Artificial Sequence: Synthetic polypeptide
DENEIRTTNPVATEQWGEVSGIEMNAAEDA

SEQ ID NO: 130865 - protein, 34 aa, Artificial Sequence
  Description of Artificial Sequence: Synthetic polypeptide
DEAEIRTTNPVATEQYGCVCSTGEHNQNFNSEQA

SEQ ID NO: 130866 - protein, 33 aa, Artificial Sequence
  Description of Artificial Sequence: Synthetic polypeptide
DEAEIRTTNPVATEQYGCVCSTGEHIGFGSEQG

SEQ ID NO: 130867 - protein, 34 aa, Artificial Sequence
  Description of Artificial Sequence: Synthetic polypeptide
DEAEIRTTNPVATEQYGCVCSTGEHEGFISENQA

SEQ ID NO: 130868 - protein, 34 aa, Artificial Sequence
  Description of Artificial Sequence: Synthetic polypeptide
DESEIRTTNPVATECWGSVSCINEPQDREGEAGE

SEQ ID NO: 130869 - protein, 34 aa, Artificial Sequence
  Description of Artificial Sequence: Synthetic polypeptide
DESEIRTTNPVATECWGSVSCINEPQDREFEGSY

SEQ ID NO: 130870 - protein, 33 aa, Artificial Sequence
  Description of Artificial Sequence: Synthetic polypeptide
DESEIRTTNPVATECWGSVSCINEPQDREEEEG

SEQ ID NO: 130871 - protein, 30 aa, Artificial Sequence
  Description of Artificial Sequence: Synthetic polypeptide
DENEIRTTNPVATEQWGEVSEIEMNHAEEA

SEQ ID NO: 130872 - protein, 30 aa, Artificial Sequence
  Description of Artificial Sequence: Synthetic polypeptide
DENEIRTTNPVATEQWGEVSEIEMNAKEDA

SEQ ID NO: 130873 - protein, 30 aa, Artificial Sequence
  Description of Artificial Sequence: Synthetic polypeptide
DENEIRTTNPVATEQWGEVSEIEMNAAEDQ

SEQ ID NO: 130874 - protein, 30 aa, Artificial Sequence
  Description of Artificial Sequence: Synthetic polypeptide
DENEIRTTNPVATEQWGEVSEIEMNAAEDK

SEQ ID NO: 130875 - protein, 30 aa, Artificial Sequence
  Description of Artificial Sequence: Synthetic polypeptide
DENEIRTTNPVATEQWGEVSEIEMNAAEDA

SEQ ID NO: 130876 - protein, 30 aa, Artificial Sequence
  Description of Artificial Sequence: Synthetic polypeptide
DENEIRTTNPVATEQWGEVSEICMNHAEDA

SEQ ID NO: 130877 - protein, 34 aa, Artificial Sequence
  Description of Artificial Sequence: Synthetic polypeptide
DESEIRTTNPVATECWGSVSCINEPQDREDENKG

SEQ ID NO: 130878 - protein, 30 aa, Artificial Sequence
  Description of Artificial Sequence: Synthetic polypeptide
DENEIRTTNPVATEQWGEVSEICMNAAEDA

SEQ ID NO: 130879 - protein, 30 aa, Artificial Sequence
  Description of Artificial Sequence: Synthetic polypeptide
DENEIRTTNPVATEQWGGVSEIEMNAAEDA

SEQ ID NO: 130880 - protein, 36 aa, Artificial Sequence
  Description of Artificial Sequence: Synthetic polypeptide
DEEEIRTTNPVATEQYGSVSLTVNPAIETQSVQDQT

SEQ ID NO: 130881 - protein, 34 aa, Artificial Sequence
  Description of Artificial Sequence: Synthetic polypeptide
DEAEIRTTNPVAYEQWGSCVYSLEVNDTQNNMNR

SEQ ID NO: 130882 - protein, 37 aa, Artificial Sequence
  Description of Artificial Sequence: Synthetic polypeptide
DEEEIRTTNPVATEQYGSVSLTPLGLSQPVEVENPLA

SEQ ID NO: 130883 - protein, 34 aa, Artificial Sequence
  Description of Artificial Sequence: Synthetic polypeptide
DESEIRTTNPVATECWGSVSCINEPQDFEGENNG

SEQ ID NO: 130884 - protein, 36 aa, Artificial Sequence
  Description of Artificial Sequence: Synthetic polypeptide
DEEEIRTTNPVATEQYGSVSLTPLDWFPVELENPLF

SEQ ID NO: 130885 - protein, 37 aa, Artificial Sequence
  Description of Artificial Sequence: Synthetic polypeptide
DEEEIRTTNPVATEQYGSVSLTPLALMGPVELENPLF

SEQ ID NO: 130886 - protein, 30 aa, Artificial Sequence
  Description of Artificial Sequence: Synthetic polypeptide
DENEIRTTNPVATEQWGDVVLIEMNGVEDA

SEQ ID NO: 130887 - protein, 33 aa, Artificial Sequence
  Description of Artificial Sequence: Synthetic polypeptide
DEAEIRTTNPVAYEQWGSVAINGNDHQMNGGNT

SEQ ID NO: 130888 - protein, 33 aa, Artificial Sequence
  Description of Artificial Sequence: Synthetic polypeptide
DEAEIRTTNPVAYEQWGSVAINGNDHQMNGNDH

SEQ ID NO: 130889 - protein, 31 aa, Artificial Sequence
  Description of Artificial Sequence: Synthetic polypeptide
DENEIRTTNPVATEQWGDVVEIEMNAAEDNA

SEQ ID NO: 130890 - protein, 33 aa, Artificial Sequence
  Description of Artificial Sequence: Synthetic polypeptide
DEAEIRTTNPVAYEQWGSVAINGNDHQMNGNDQ

SEQ ID NO: 130891 - protein, 29 aa, Artificial Sequence
  Description of Artificial Sequence: Synthetic peptide
DENEIRTTNPVATEQWGDVVEIEMAAEDA

SEQ ID NO: 130892 - protein, 34 aa, Artificial Sequence
  Description of Artificial Sequence: Synthetic polypeptide
DEQEIATTNPVATEQYGSVSATDLREDHEGEDLH

SEQ ID NO: 130893 - protein, 33 aa, Artificial Sequence
  Description of Artificial Sequence: Synthetic polypeptide
DEECIATVNPVATECYGSVVCIDSNDERDGNER

SEQ ID NO: 130894 - protein, 30 aa, Artificial Sequence
  Description of Artificial Sequence: Synthetic polypeptide
DENEIRTTNPVATEQWGDVVDTEMNAAEDA

SEQ ID NO: 130895 - protein, 34 aa, Artificial Sequence
  Description of Artificial Sequence: Synthetic polypeptide
DESEIRTTNPVATECWGSVSCINEPQDEEGENGM

SEQ ID NO: 130896 - protein, 35 aa, Artificial Sequence
  Description of Artificial Sequence: Synthetic polypeptide
DEAEIRTTNPVAYEQWGSVATTNGAQDRADGNHTN

SEQ ID NO: 130897 - protein, 34 aa, Artificial Sequence
  Description of Artificial Sequence: Synthetic polypeptide
DEQEIATTNPVATEQYGSVSATDLSEDHEGMEDL

SEQ ID NO: 130898 - protein, 32 aa, Artificial Sequence
  Description of Artificial Sequence: Synthetic polypeptide
DEECIATVNPVAYEWWGSVSCDNLSEKGGNNR

SEQ ID NO: 130899 - protein, 32 aa, Artificial Sequence
  Description of Artificial Sequence: Synthetic polypeptide
DEECIATVNPVAYEWYGSVACDNLSESGGNNR

SEQ ID NO: 130900 - protein, 30 aa, Artificial Sequence
  Description of Artificial Sequence: Synthetic polypeptide
AENEIACTNPVATCQYGEASMEVLQRGDGQ

SEQ ID NO: 130901 - protein, 36 aa, Artificial Sequence
  Description of Artificial Sequence: Synthetic polypeptide
DEEEIRTTNPVATEQYGSVSLTPLLMEPAPLVNPLF

SEQ ID NO: 130902 - protein, 34 aa, Artificial Sequence
  Description of Artificial Sequence: Synthetic polypeptide
DEDEIATTNPVATAQWGGCVSTALPQNQMGNDRN

SEQ ID NO: 130903 - protein, 36 aa, Artificial Sequence
  Description of Artificial Sequence: Synthetic polypeptide
DEEEIRTTNPVATEQYGSVSLTPLLVDPVELENPLA

SEQ ID NO: 130904 - protein, 33 aa, Artificial Sequence
  Description of Artificial Sequence: Synthetic polypeptide
DEAEIRTTNPVAYEQWGSTVTTNDGQQNMGGEK

SEQ ID NO: 130905 - protein, 32 aa, Artificial Sequence
  Description of Artificial Sequence: Synthetic polypeptide
DTEAEIATTNPVAYEQYGSVATNPDNGGDQDM

SEQ ID NO: 130906 - protein, 31 aa, Artificial Sequence
  Description of Artificial Sequence: Synthetic polypeptide
DENEIRTTNPVATEQWGDVYSTIEMNAAEDA

SEQ ID NO: 130907 - protein, 34 aa, Artificial Sequence
  Description of Artificial Sequence: Synthetic polypeptide
DEECIATVNPVATEAYGSVPSCDNLSESGGNNVR

SEQ ID NO: 130908 - protein, 35 aa, Artificial Sequence
  Description of Artificial Sequence: Synthetic polypeptide
DEECIATVNPVATEAYGSVPSCDVNLSERGGNNER

SEQ ID NO: 130909 - protein, 32 aa, Artificial Sequence
  Description of Artificial Sequence: Synthetic polypeptide
DTEEIAATNPVAYEQWGCSYQSDNDLDRNGTR

SEQ ID NO: 130910 - protein, 35 aa, Artificial Sequence
  Description of Artificial Sequence: Synthetic polypeptide
DEECIATVNPVATEAYGSVPSCEENLSERGGNNRR

SEQ ID NO: 130911 - protein, 35 aa, Artificial Sequence
  Description of Artificial Sequence: Synthetic polypeptide
DEECIATVNPVATEAYGSVPSCMNLSERNGGVNVR

SEQ ID NO: 130912 - protein, 33 aa, Artificial Sequence
  Description of Artificial Sequence: Synthetic polypeptide
DTEEIATTNPCATEHWGSVYFNELDQDRQENDR

SEQ ID NO: 130913 - protein, 34 aa, Artificial Sequence
  Description of Artificial Sequence: Synthetic polypeptide
DESEIRTTNPVATECWGSVSCINEPQDHEGENDG

SEQ ID NO: 130914 - protein, 33 aa, Artificial Sequence
  Description of Artificial Sequence: Synthetic polypeptide
DEAEIRTTNPVAYEQWGSTSTNPNGNGMGGGER

SEQ ID NO: 130915 - protein, 33 aa, Artificial Sequence
  Description of Artificial Sequence: Synthetic polypeptide
DEECIATVNPVATECYGSVVCIDHNDENRGNER

SEQ ID NO: 130916 - protein, 31 aa, Artificial Sequence
  Description of Artificial Sequence: Synthetic polypeptide
DTEEIATTNPCAYEAWGSVYFVDLTQREGND

SEQ ID NO: 130917 - protein, 34 aa, Artificial Sequence
  Description of Artificial Sequence: Synthetic polypeptide
DEECIATVNPVATECYGSVVCIDHNDQERGGNER

SEQ ID NO: 130918 - protein, 32 aa, Artificial Sequence
  Description of Artificial Sequence: Synthetic polypeptide
DTEEIATTNPCAYEEWGSVYYVDLQRQEGNER

SEQ ID NO: 130919 - protein, 32 aa, Artificial Sequence
  Description of Artificial Sequence: Synthetic polypeptide
DTEEIATTNPCAYEPWGSVYFVELDQRGQGNR

SEQ ID NO: 130920 - protein, 33 aa, Artificial Sequence
  Description of Artificial Sequence: Synthetic polypeptide
DEAEIRTTNPVAYEQWGSTVTNNLDGEGQQGEH

SEQ ID NO: 130921 - protein, 33 aa, Artificial Sequence
  Description of Artificial Sequence: Synthetic polypeptide
DEAEIRTTNPVAYEQWGSTVTNPNGQDMGNNEV

SEQ ID NO: 130922 - protein, 32 aa, Artificial Sequence
  Description of Artificial Sequence: Synthetic polypeptide
DEECIATVNPVATECYGSVVCIDNDHERGGSR

SEQ ID NO: 130923 - protein, 33 aa, Artificial Sequence
  Description of Artificial Sequence: Synthetic polypeptide
DEECIATVNPVATECYGSVVCIDNDHNRGDNSR

SEQ ID NO: 130924 - protein, 36 aa, Artificial Sequence
  Description of Artificial Sequence: Synthetic polypeptide
DEEEIRTTNPVATEQYGSVSLTPLVSQPVELEEPLA

SEQ ID NO: 130925 - protein, 32 aa, Artificial Sequence
  Description of Artificial Sequence: Synthetic polypeptide
AENEIACTNPVATEQYGCSCSSNHQRFGSGQS

SEQ ID NO: 130926 - protein, 31 aa, Artificial Sequence
  Description of Artificial Sequence: Synthetic polypeptide
DENEIRTTNPVATEQWGGVSKENEMNAAEDA

SEQ ID NO: 130927 - protein, 35 aa, Artificial Sequence
  Description of Artificial Sequence: Synthetic polypeptide
DEAEIRTTNPVAYEQWGEVVSTNNILGEDAGGNGR

SEQ ID NO: 130928 - protein, 34 aa, Artificial Sequence
  Description of Artificial Sequence: Synthetic polypeptide
DSMEIRTTNPVATEQYGCVSTVNHEMEENNQDGN

SEQ ID NO: 130929 - protein, 34 aa, Artificial Sequence
  Description of Artificial Sequence: Synthetic polypeptide
DEECIATTNPVAYEQWGETVRQTNDHLQRNGIPR

SEQ ID NO: 130930 - protein, 35 aa, Artificial Sequence
  Description of Artificial Sequence: Synthetic polypeptide
DSNEIRTTNPVATEQYGCVCMTNELSGKTGGNNRR

SEQ ID NO: 130931 - protein, 30 aa, Artificial Sequence
  Description of Artificial Sequence: Synthetic polypeptide
DENEIRTTNPVATEQWGMVSEYEMNIAEDA

SEQ ID NO: 130932 - protein, 31 aa, Artificial Sequence
  Description of Artificial Sequence: Synthetic polypeptide
DENEIRTTNPVATEQWGMVSENGEMNAAEDA

SEQ ID NO: 130933 - protein, 34 aa, Artificial Sequence
  Description of Artificial Sequence: Synthetic polypeptide
DEQEIATTNPVATEQYGSVSATDLFEDTEGEDLG

SEQ ID NO: 130934 - protein, 31 aa, Artificial Sequence
  Description of Artificial Sequence: Synthetic polypeptide
DENEIRTTNPVATEQWGMVSEINEMNAAEDA

SEQ ID NO: 130935 - protein, 30 aa, Artificial Sequence
  Description of Artificial Sequence: Synthetic polypeptide
DENEIRTTNPVATEQWGMVSEIIMNAAEDA

SEQ ID NO: 130936 - protein, 30 aa, Artificial Sequence
  Description of Artificial Sequence: Synthetic polypeptide
DENEIRTTNPVATEQWGMVSEIEMNFAEDA

SEQ ID NO: 130937 - protein, 30 aa, Artificial Sequence
  Description of Artificial Sequence: Synthetic polypeptide
DENEIRTTNPVATEQWGMVSEIEMNAAEDA

SEQ ID NO: 130938 - protein, 30 aa, Artificial Sequence
  Description of Artificial Sequence: Synthetic polypeptide
DENEIRTTNPVATEQWGMVSEIEINAAEDA

SEQ ID NO: 130939 - protein, 30 aa, Artificial Sequence
  Description of Artificial Sequence: Synthetic polypeptide
DENEIRTTNPVATEQWGLVSEVEENIAEDF

SEQ ID NO: 130940 - protein, 30 aa, Artificial Sequence
  Description of Artificial Sequence: Synthetic polypeptide
DENEIRTTNPVATEQWGLVSEVDMNIPEDA

SEQ ID NO: 130941 - protein, 30 aa, Artificial Sequence
  Description of Artificial Sequence: Synthetic polypeptide
DENEIRTTNPVATEQWGLVSEIVMNAAEDA

SEQ ID NO: 130942 - protein, 30 aa, Artificial Sequence
  Description of Artificial Sequence: Synthetic polypeptide
DENEIRTTNPVATEQWGLVSEIESNAAEDA

SEQ ID NO: 130943 - protein, 35 aa, Artificial Sequence
  Description of Artificial Sequence: Synthetic polypeptide
DEAEIRTTNPVAYEQWGEVCSTDNGNEQRGQENEQ

SEQ ID NO: 130944 - protein, 30 aa, Artificial Sequence
  Description of Artificial Sequence: Synthetic polypeptide
DENEIRTTNPVATEQWGLVSEIEMNAAEDK

SEQ ID NO: 130945 - protein, 30 aa, Artificial Sequence
  Description of Artificial Sequence: Synthetic polypeptide
DENEIRTTNPVATEQWGLVSEIEMNAAEDA

SEQ ID NO: 130946 - protein, 35 aa, Artificial Sequence
  Description of Artificial Sequence: Synthetic polypeptide
DSNEIRTTNPVATEQYGSVSTWNSLEFGEFEQQVE

SEQ ID NO: 130947 - protein, 31 aa, Artificial Sequence
  Description of Artificial Sequence: Synthetic polypeptide
DEECIATTNPVAYEQWGCVYQWNDWQDHGNH

SEQ ID NO: 130948 - protein, 33 aa, Artificial Sequence
  Description of Artificial Sequence: Synthetic polypeptide
DEECIATTNPVAYEQWGSVACTNNGLQDHQDMR

SEQ ID NO: 130949 - protein, 35 aa, Artificial Sequence
  Description of Artificial Sequence: Synthetic polypeptide
DSGEIRTTNPVAYEQYGSTVCSTENMLSQTGMTSL

SEQ ID NO: 130950 - protein, 32 aa, Artificial Sequence
  Description of Artificial Sequence: Synthetic polypeptide
DSGEIRTTNPVATEQWGKCTTTELLQRGTQYM

SEQ ID NO: 130951 - protein, 31 aa, Artificial Sequence
  Description of Artificial Sequence: Synthetic polypeptide
DENEIRTTNPVATEQWGNVSNIMEMNAAEDA

SEQ ID NO: 130952 - protein, 31 aa, Artificial Sequence
  Description of Artificial Sequence: Synthetic polypeptide
DENEIRTTNPVATEQWGNVSEREMNAAEDAL

SEQ ID NO: 130953 - protein, 32 aa, Artificial Sequence
  Description of Artificial Sequence: Synthetic polypeptide
DEAEIRTTNPVATEQYGCVCSWEDINFNSNQA

SEQ ID NO: 130954 - protein, 36 aa, Artificial Sequence
  Description of Artificial Sequence: Synthetic polypeptide
DSEEIVTTNPVATEQYGCVCSNTNELSGKTGGNNRG

SEQ ID NO: 130955 - protein, 34 aa, Artificial Sequence
  Description of Artificial Sequence: Synthetic polypeptide
DEAEIRTTNPVAYEQWGEVCSTDNGDERLGGNEP

SEQ ID NO: 130956 - protein, 30 aa, Artificial Sequence
  Description of Artificial Sequence: Synthetic polypeptide
DENEIRTTNPVATEQWGNVSEIEMNAAETA

SEQ ID NO: 130957 - protein, 30 aa, Artificial Sequence
  Description of Artificial Sequence: Synthetic polypeptide
DENEIRTTNPVATEQWGNVSEIEMNAAEDA

SEQ ID NO: 130958 - protein, 30 aa, Artificial Sequence
  Description of Artificial Sequence: Synthetic polypeptide
DENEIRTTNPVATEQWGNVSEIEMIAAMDA

SEQ ID NO: 130959 - protein, 34 aa, Artificial Sequence
  Description of Artificial Sequence: Synthetic polypeptide
DSFEIRTTNPVATERYGKVSTNMVSQQTTGGSRP

SEQ ID NO: 130960 - protein, 34 aa, Artificial Sequence
  Description of Artificial Sequence: Synthetic polypeptide
DEAEIRTTNPVAYEQWGEVCSTDNGHEQMGGNHQ

SEQ ID NO: 130961 - protein, 34 aa, Artificial Sequence
  Description of Artificial Sequence: Synthetic polypeptide
DEAEIRTTNPVAYEQWGEVCSTDNGHEQRGGGEQ

SEQ ID NO: 130962 - protein, 31 aa, Artificial Sequence
  Description of Artificial Sequence: Synthetic polypeptide
DENEIRTTNPVATEQWGNVSEGEMNAAEMDA

SEQ ID NO: 130963 - protein, 32 aa, Artificial Sequence
  Description of Artificial Sequence: Synthetic polypeptide
DENEIRTTNPVATEQWGNVSEGEMNAAEDNAW

SEQ ID NO: 130964 - protein, 30 aa, Artificial Sequence
  Description of Artificial Sequence: Synthetic polypeptide
DENEIRTTNPVATEQWGNVSEAEMNAAEDA

SEQ ID NO: 130965 - protein, 32 aa, Artificial Sequence
  Description of Artificial Sequence: Synthetic polypeptide
DENEIRTTNPVATEQWGNVHSEIPMLAAENDA

SEQ ID NO: 130966 - protein, 32 aa, Artificial Sequence
  Description of Artificial Sequence: Synthetic polypeptide
DSGEICTVNPVAYECYGSVPSTNELSTEGGNH

SEQ ID NO: 130967 - protein, 34 aa, Artificial Sequence
  Description of Artificial Sequence: Synthetic polypeptide
DEAEIRTTNPVAYEQWGEVCSTDNGHQIGQGNHQ

SEQ ID NO: 130968 - protein, 34 aa, Artificial Sequence
  Description of Artificial Sequence: Synthetic polypeptide
DEQEIATTNPVATEQYGSVSATDLFEDEEGDEDL

SEQ ID NO: 130969 - protein, 36 aa, Artificial Sequence
  Description of Artificial Sequence: Synthetic polypeptide
DEEEIRTTNPVATEQYGSVSMNLGLSEAQPFYVQVA

SEQ ID NO: 130970 - protein, 31 aa, Artificial Sequence
  Description of Artificial Sequence: Synthetic polypeptide
DENEIRTTNPVATEQWGNDVSEIEMNLAEDA

SEQ ID NO: 130971 - protein, 34 aa, Artificial Sequence
  Description of Artificial Sequence: Synthetic polypeptide
DEQEIATTNPVATEQYGSVSATDLLEDHEGEDLD

SEQ ID NO: 130972 - protein, 33 aa, Artificial Sequence
  Description of Artificial Sequence: Synthetic polypeptide
DENEIRTTNPVATEQWGKVSEIFSMNAAEGDNA

SEQ ID NO: 130973 - protein, 33 aa, Artificial Sequence
  Description of Artificial Sequence: Synthetic polypeptide
DEAEIRTTNPVAYEQWGEVCSTDNHDTIGGNNH

SEQ ID NO: 130974 - protein, 32 aa, Artificial Sequence
  Description of Artificial Sequence: Synthetic polypeptide
DTAEIATTNPVAYEQYGSTTAGTNLTAEGNNN

SEQ ID NO: 130975 - protein, 36 aa, Artificial Sequence
  Description of Artificial Sequence: Synthetic polypeptide
DTAEIRTTNPVATEQWGSTPSCTNNLQQRTGGDNEG

SEQ ID NO: 130976 - protein, 34 aa, Artificial Sequence
  Description of Artificial Sequence: Synthetic polypeptide
DEAEIRTTNPVAYEQWGEVSWTEHDNRGGGNQRW

SEQ ID NO: 130977 - protein, 30 aa, Artificial Sequence
  Description of Artificial Sequence: Synthetic polypeptide
DENEIRTTNPVATEQWGIVSEIEMNAAEDA

SEQ ID NO: 130978 - protein, 36 aa, Artificial Sequence
  Description of Artificial Sequence: Synthetic polypeptide
DTAEIRTTNPVATEQWGSTPSCTNPLSQQRGGDNEL

SEQ ID NO: 130979 - protein, 31 aa, Artificial Sequence
  Description of Artificial Sequence: Synthetic polypeptide
AENEIACTNPVATEGYGCSCSSNLQNFGSGQ

SEQ ID NO: 130980 - protein, 31 aa, Artificial Sequence
  Description of Artificial Sequence: Synthetic polypeptide
AENEIACTNPVATEFYGEIALEHNLQRGGPR

SEQ ID NO: 130981 - protein, 35 aa, Artificial Sequence
  Description of Artificial Sequence: Synthetic polypeptide
DEEEIRTTNPVATEQYGSVSMENELIPEMIVDEPL

SEQ ID NO: 130982 - protein, 36 aa, Artificial Sequence
  Description of Artificial Sequence: Synthetic polypeptide
DTAEIRTTNPVATEQYGISTPSTNNLSQQGGGDNEL

SEQ ID NO: 130983 - protein, 31 aa, Artificial Sequence
  Description of Artificial Sequence: Synthetic polypeptide
DENEIRTTNPVATEQWGHVSEIERMNAAEDA

SEQ ID NO: 130984 - protein, 30 aa, Artificial Sequence
  Description of Artificial Sequence: Synthetic polypeptide
DENEIRTTNPVATEQWGHVSEIEMNAAEDA

SEQ ID NO: 130985 - protein, 35 aa, Artificial Sequence
  Description of Artificial Sequence: Synthetic polypeptide
DEEEIRTTNPVATEQYGSVSMENDHQADEISDLEG

SEQ ID NO: 130986 - protein, 36 aa, Artificial Sequence
  Description of Artificial Sequence: Synthetic polypeptide
DENEIRTTNPVATEQWGHSNVSYTNMLQHGPEMGFE

SEQ ID NO: 130987 - protein, 36 aa, Artificial Sequence
  Description of Artificial Sequence: Synthetic polypeptide
DENEIRTTNPVATEQWGHSNVSYTNMLQHGPEGDAE

SEQ ID NO: 130988 - protein, 34 aa, Artificial Sequence
  Description of Artificial Sequence: Synthetic polypeptide
DEAEIRTTNPVATEQYGCVCSTGEHNQNFPSNQS

SEQ ID NO: 130989 - protein, 34 aa, Artificial Sequence
  Description of Artificial Sequence: Synthetic polypeptide
DESEIRTTNPVATECWGSVSCINEPQDREGEAGL

SEQ ID NO: 130990 - protein, 36 aa, Artificial Sequence
  Description of Artificial Sequence: Synthetic polypeptide
DENEIRTTNPVATEQWGHSNVSNTNMLQHDGPEGFE

SEQ ID NO: 130991 - protein, 35 aa, Artificial Sequence
  Description of Artificial Sequence: Synthetic polypeptide
DENEIRTTNPVATEQWGHSEHSYTNMLQHGPEGFE

SEQ ID NO: 130992 - protein, 34 aa, Artificial Sequence
  Description of Artificial Sequence: Synthetic polypeptide
DEECIATTNPVAYEQYGQCTVSMDNELAQSGGER

SEQ ID NO: 130993 - protein, 34 aa, Artificial Sequence
  Description of Artificial Sequence: Synthetic polypeptide
DEEEIRTTNPVATEQYGSVSMEPGHQEQEPEFVD

SEQ ID NO: 130994 - protein, 34 aa, Artificial Sequence
  Description of Artificial Sequence: Synthetic polypeptide
DEAEIRTTNPVATEQYGCVCSTGEPQENFGSEQS

SEQ ID NO: 130995 - protein, 32 aa, Artificial Sequence
  Description of Artificial Sequence: Synthetic polypeptide
DENEIRTTNPVATEQWGKTVSEIEMNAAVGDA

SEQ ID NO: 130996 - protein, 34 aa, Artificial Sequence
  Description of Artificial Sequence: Synthetic polypeptide
DEECIATTNPVAYEQWGTVCSTNDLKDQNGQNNS

SEQ ID NO: 130997 - protein, 30 aa, Artificial Sequence
  Description of Artificial Sequence: Synthetic polypeptide
DENEIRTTNPVATEQWGKVSEIEMNAAEDA

SEQ ID NO: 130998 - protein, 32 aa, Artificial Sequence
  Description of Artificial Sequence: Synthetic polypeptide
DENEIRTTNPVATEQWGKVSEIEHMNAAEDNA

SEQ ID NO: 130999 - protein, 34 aa, Artificial Sequence
  Description of Artificial Sequence: Synthetic polypeptide
CEEEISTTNPVATEQYGCVCSNTELQNFNSDTQS

SEQ ID NO: 131000 - protein, 33 aa, Artificial Sequence
  Description of Artificial Sequence: Synthetic polypeptide
DENEIRTTNPVATEQWGKVSCEIESTNAAEGDN

SEQ ID NO: 131001 - protein, 32 aa, Artificial Sequence
  Description of Artificial Sequence: Synthetic polypeptide
DENEIRTTNPVATEQWGKVSCEHEMNAAEGDA

SEQ ID NO: 131002 - protein, 34 aa, Artificial Sequence
  Description of Artificial Sequence: Synthetic polypeptide
DSQEIATTNPVATEQYGSVSCTDELSEDHEGENL

SEQ ID NO: 131003 - protein, 34 aa, Artificial Sequence
  Description of Artificial Sequence: Synthetic polypeptide
DSSEIRTTNPVATECWGQSVSCINEPQDREGENG

SEQ ID NO: 131004 - protein, 34 aa, Artificial Sequence
  Description of Artificial Sequence: Synthetic polypeptide
DSSEIRTTNPVATECWGSEVSCINEPQDREGENG

SEQ ID NO: 131005 - protein, 36 aa, Artificial Sequence
  Description of Artificial Sequence: Synthetic polypeptide
DEEEIRTTNPVATEQYGSVSMMDDLETPHVVNSDRF

SEQ ID NO: 131006 - protein, 33 aa, Artificial Sequence
  Description of Artificial Sequence: Synthetic polypeptide
DSSEIRTTNPVATECWGSVSCINEPQDREFENG

SEQ ID NO: 131007 - protein, 32 aa, Artificial Sequence
  Description of Artificial Sequence: Synthetic polypeptide
DEECIATTNPVAYEQWGSYWSLDNDGQRGVDT

SEQ ID NO: 131008 - protein, 35 aa, Artificial Sequence
  Description of Artificial Sequence: Synthetic polypeptide
DESEIRTTNPVATECWGSVSCINEPQDREGENFGC

SEQ ID NO: 131009 - protein, 33 aa, Artificial Sequence
  Description of Artificial Sequence: Synthetic polypeptide
DEAEIRTTNPVAYEQWGEVSGGNNQHNEGNGNG

SEQ ID NO: 131010 - protein, 34 aa, Artificial Sequence
  Description of Artificial Sequence: Synthetic polypeptide
DEECIATTNPVAYEQWGTVCSTNDLHDQNGQNME

SEQ ID NO: 131011 - protein, 34 aa, Artificial Sequence
  Description of Artificial Sequence: Synthetic polypeptide
DEAEIRTTNPVAYEQWGEVSTGNGPNRNEDNQRD

SEQ ID NO: 131012 - protein, 37 aa, Artificial Sequence
  Description of Artificial Sequence: Synthetic polypeptide
DSSEIRTTNPVATEQYGSVSSCTMNSHSQTFGGNNRA

SEQ ID NO: 131013 - protein, 34 aa, Artificial Sequence
  Description of Artificial Sequence: Synthetic polypeptide
DEECIATTNPVAYEQWGTVCSTNDLHDQNLGDNS

SEQ ID NO: 131014 - protein, 34 aa, Artificial Sequence
  Description of Artificial Sequence: Synthetic polypeptide
DEEEIRTTNPVATEQYGSVSMIGYEEALDGSVED

SEQ ID NO: 131015 - protein, 33 aa, Artificial Sequence
  Description of Artificial Sequence: Synthetic polypeptide
DSSEIRTTNPVAYECWGSVSCPNESQDREGGNG

SEQ ID NO: 131016 - protein, 35 aa, Artificial Sequence
  Description of Artificial Sequence: Synthetic polypeptide
DSYEIRTTNPVATEQYGSVTPTNGDETTQSGQDNS

SEQ ID NO: 131017 - protein, 36 aa, Artificial Sequence
  Description of Artificial Sequence: Synthetic polypeptide
DEEEIRTTNPVATEQYGSVSTTMGLEPEVQLLELKV

SEQ ID NO: 131018 - protein, 34 aa, Artificial Sequence
  Description of Artificial Sequence: Synthetic polypeptide
DEAEIRTTNPVAYEHWGAVSTSNGLAGNAGENSR

SEQ ID NO: 131019 - protein, 32 aa, Artificial Sequence
  Description of Artificial Sequence: Synthetic polypeptide
AENEIACTNPVATEQYGCSCSSNLNQNFGSEQ

SEQ ID NO: 131020 - protein, 33 aa, Artificial Sequence
  Description of Artificial Sequence: Synthetic polypeptide
DQQEIATTNPVATEQYGSVSATDDLEPHEGEDL

SEQ ID NO: 131021 - protein, 36 aa, Artificial Sequence
  Description of Artificial Sequence: Synthetic polypeptide
DEEEIRTTNPVATEQYGSVTPPVNTEILTMGEQSRV

SEQ ID NO: 131022 - protein, 33 aa, Artificial Sequence
  Description of Artificial Sequence: Synthetic polypeptide
DEDEIATTNPVATEQYGSVCAAMHGQDSGENNH

SEQ ID NO: 131023 - protein, 34 aa, Artificial Sequence
  Description of Artificial Sequence: Synthetic polypeptide
DQQEIATTNPVATEQYGSVSATDNLEEDHTGEDL

SEQ ID NO: 131024 - protein, 33 aa, Artificial Sequence
  Description of Artificial Sequence: Synthetic polypeptide
DQQEIATTNPVATEQYGSVSATLDLEDHEGEDT

SEQ ID NO: 131025 - protein, 35 aa, Artificial Sequence
  Description of Artificial Sequence: Synthetic polypeptide
DEEEIRTTNPVATEQYGSVTPTCGADETTQGQDRQ

SEQ ID NO: 131026 - protein, 33 aa, Artificial Sequence
  Description of Artificial Sequence: Synthetic polypeptide
DQQEIATTNPVATEQYGSVSVTDLEDHIGDEDL

SEQ ID NO: 131027 - protein, 34 aa, Artificial Sequence
  Description of Artificial Sequence: Synthetic polypeptide
DEDEIATTNPVATEQYGSVCAAMHGQDSDGNDRH

SEQ ID NO: 131028 - protein, 35 aa, Artificial Sequence
  Description of Artificial Sequence: Synthetic polypeptide
DEEEIRTTNPVATEQYGSVSNTGLLEEPAMAVEEE

SEQ ID NO: 131029 - protein, 35 aa, Artificial Sequence
  Description of Artificial Sequence: Synthetic polypeptide
DEEEIRTTNPVATEQYGSVTPTDGDEQTQTQDTRQ

SEQ ID NO: 131030 - protein, 35 aa, Artificial Sequence
  Description of Artificial Sequence: Synthetic polypeptide
DEEEIRTTNPVATEQYGSVTPTDGIDEQTQGQDDQ

SEQ ID NO: 131031 - protein, 32 aa, Artificial Sequence
  Description of Artificial Sequence: Synthetic polypeptide
DENEIRTTNPVATEQYGDVCSEIEVMNAAEND

SEQ ID NO: 131032 - protein, 32 aa, Artificial Sequence
  Description of Artificial Sequence: Synthetic polypeptide
DENEIRTTNPVATEQYGDVCSEIEVMNAAENA

SEQ ID NO: 131033 - protein, 32 aa, Artificial Sequence
  Description of Artificial Sequence: Synthetic polypeptide
DENEIRTTNPVATEQYGDVCSEIEVENAAENA

SEQ ID NO: 131034 - protein, 33 aa, Artificial Sequence
  Description of Artificial Sequence: Synthetic polypeptide
DEDEIATTNPVATEQYGSVCAAMHGQAMPNQRN

SEQ ID NO: 131035 - protein, 35 aa, Artificial Sequence
  Description of Artificial Sequence: Synthetic polypeptide
DEDEIATTNPVATEQYGSVATGAPTNPGAQTEGNN

SEQ ID NO: 131036 - protein, 35 aa, Artificial Sequence
  Description of Artificial Sequence: Synthetic polypeptide
DEDEIATTNPVATEQYGSVATAPPQNPGNQTEGNN

SEQ ID NO: 131037 - protein, 32 aa, Artificial Sequence
  Description of Artificial Sequence: Synthetic polypeptide
DENEIRTTNPVATEQYGDVCSEDIPMNAAENA

SEQ ID NO: 131038 - protein, 32 aa, Artificial Sequence
  Description of Artificial Sequence: Synthetic polypeptide
DENEIRTTNPVATEQYGDVCSEDIPENFAEND

SEQ ID NO: 131039 - protein, 34 aa, Artificial Sequence
  Description of Artificial Sequence: Synthetic polypeptide
DEDEIATTNPVATEQYGSVCAANNHQEADGTDNH

SEQ ID NO: 131040 - protein, 32 aa, Artificial Sequence
  Description of Artificial Sequence: Synthetic polypeptide
DENEIRTTNPVATEQYGDVCSEDIPENAAEND

SEQ ID NO: 131041 - protein, 33 aa, Artificial Sequence
  Description of Artificial Sequence: Synthetic polypeptide
DQGEIRTTNPVATEQYGSVTPVNNLELMIEGQQ

SEQ ID NO: 131042 - protein, 36 aa, Artificial Sequence
  Description of Artificial Sequence: Synthetic polypeptide
DEEEIRTTNPVATEQYGSVTPNLNMMMQEEGEEEIN

SEQ ID NO: 131043 - protein, 33 aa, Artificial Sequence
  Description of Artificial Sequence: Synthetic polypeptide
DEAEIRTTNPVATEQYGFSCINTHELDNQENIE

SEQ ID NO: 131044 - protein, 33 aa, Artificial Sequence
  Description of Artificial Sequence: Synthetic polypeptide
DQEEIRTTNPVAYEQYGKVFTENLSDGKVGTEL

SEQ ID NO: 131045 - protein, 33 aa, Artificial Sequence
  Description of Artificial Sequence: Synthetic polypeptide
DEEEIRTTNPVATEQYGSVTPADNEIGTAQAQT

SEQ ID NO: 131046 - protein, 36 aa, Artificial Sequence
  Description of Artificial Sequence: Synthetic polypeptide
DEEEIRTTNPVATEQYGSVSNTGQSGQGEIEDTGDI

SEQ ID NO: 131047 - protein, 31 aa, Artificial Sequence
  Description of Artificial Sequence: Synthetic polypeptide
DENEIRTTNPVATEQYGDVSEDIPMNAAEDA

SEQ ID NO: 131048 - protein, 31 aa, Artificial Sequence
  Description of Artificial Sequence: Synthetic polypeptide
DENEIRTTNPVATEQYGDVSEDIEMNAAEDA

SEQ ID NO: 131049 - protein, 34 aa, Artificial Sequence
  Description of Artificial Sequence: Synthetic polypeptide
DEEEIRTTNPVATEQYGSVTPDNGDETTQGQDSQ

SEQ ID NO: 131050 - protein, 33 aa, Artificial Sequence
  Description of Artificial Sequence: Synthetic polypeptide
DESEIRTTNPVATECWGSVSCPAGPNDRNGENG

SEQ ID NO: 131051 - protein, 32 aa, Artificial Sequence
  Description of Artificial Sequence: Synthetic polypeptide
DENEIRTTNPVATEQYGDVSEDGPVENAAENA

SEQ ID NO: 131052 - protein, 33 aa, Artificial Sequence
  Description of Artificial Sequence: Synthetic polypeptide
DESEIRTTNPVATECWGSVSCPAEPNDRNGENG

SEQ ID NO: 131053 - protein, 35 aa, Artificial Sequence
  Description of Artificial Sequence: Synthetic polypeptide
DEEEIRTTNPVATEQYGSVTPFDGDEQTQGQDERQ

SEQ ID NO: 131054 - protein, 31 aa, Artificial Sequence
  Description of Artificial Sequence: Synthetic polypeptide
AENEIACTNPVATEQYGEARSEVLQRGDGQY

SEQ ID NO: 131055 - protein, 35 aa, Artificial Sequence
  Description of Artificial Sequence: Synthetic polypeptide
DEEEIRTTNPVATEQYGSVTPILNIQQIRTPEEFV

SEQ ID NO: 131056 - protein, 35 aa, Artificial Sequence
  Description of Artificial Sequence: Synthetic polypeptide
DEEEIRTTNPVATEQYGSVTPILNLQQMMDPEEFV

SEQ ID NO: 131057 - protein, 33 aa, Artificial Sequence
  Description of Artificial Sequence: Synthetic polypeptide
DQEEISTTNPVATEQYGCVCSTEHQEFFGSEQG

SEQ ID NO: 131058 - protein, 34 aa, Artificial Sequence
  Description of Artificial Sequence: Synthetic polypeptide
DEDEIATTNPVATEQYGSVCAANNLQDSDGTVHH

SEQ ID NO: 131059 - protein, 34 aa, Artificial Sequence
  Description of Artificial Sequence: Synthetic polypeptide
DEEEIRTTNPVATEQYGSVTPIPLKESLGEEEEQ

SEQ ID NO: 131060 - protein, 34 aa, Artificial Sequence
  Description of Artificial Sequence: Synthetic polypeptide
DQEEISTTNPVATHQYGCVCSTNGDQNFGSDNQA

SEQ ID NO: 131061 - protein, 33 aa, Artificial Sequence
  Description of Artificial Sequence: Synthetic polypeptide
DQGEIRTTNPVATEQYGSCTTVNKLELMGGQQE

SEQ ID NO: 131062 - protein, 32 aa, Artificial Sequence
  Description of Artificial Sequence: Synthetic polypeptide
DENEIRTTNPVATEQYGDVSAEIEEDAEGDDL

SEQ ID NO: 131063 - protein, 38 aa, Artificial Sequence
  Description of Artificial Sequence: Synthetic polypeptide
DEEEIRTTNPVATEQYGSVSTTNLQNQNGTEQGTTDED

SEQ ID NO: 131064 - protein, 32 aa, Artificial Sequence
  Description of Artificial Sequence: Synthetic polypeptide
DENEIRTTNPVATEQYGDVCSEDIPENAAENA

SEQ ID NO: 131065 - protein, 34 aa, Artificial Sequence
  Description of Artificial Sequence: Synthetic polypeptide
DESEIRTTNPVATECWGSVSCIYCEPQDREGENG

SEQ ID NO: 131066 - protein, 32 aa, Artificial Sequence
  Description of Artificial Sequence: Synthetic polypeptide
DSAEIRNTNPVAYEGYGSVSTGHGLNQAPGGL

SEQ ID NO: 131067 - protein, 35 aa, Artificial Sequence
  Description of Artificial Sequence: Synthetic polypeptide
DEEEIRTTNPVATEQYGSVTPTNGDETTQSEQDKQ

SEQ ID NO: 131068 - protein, 32 aa, Artificial Sequence
  Description of Artificial Sequence: Synthetic polypeptide
DENEIRTTNPVATEQYGCVSVLLLENHLDEQW

SEQ ID NO: 131069 - protein, 33 aa, Artificial Sequence
  Description of Artificial Sequence: Synthetic polypeptide
DEAEIRTTNPVAYEAWGVVATNLAQGDAGGNQS

SEQ ID NO: 131070 - protein, 31 aa, Artificial Sequence
  Description of Artificial Sequence: Synthetic polypeptide
DSAEIRSTNPVAYECWGSISCTTHQRTGGNN

SEQ ID NO: 131071 - protein, 34 aa, Artificial Sequence
  Description of Artificial Sequence: Synthetic polypeptide
DEEAIRTTNPVATEQWGCVCGTTNNHQHFGSNQS

SEQ ID NO: 131072 - protein, 36 aa, Artificial Sequence
  Description of Artificial Sequence: Synthetic polypeptide
DSAEIRTTNPVATEQWGQSQVPSCTTELQGTGTNRH

SEQ ID NO: 131073 - protein, 37 aa, Artificial Sequence
  Description of Artificial Sequence: Synthetic polypeptide
DEEEIRTTNPVATEQYGSVTPTNGWDETTQSGQDQNQ

SEQ ID NO: 131074 - protein, 36 aa, Artificial Sequence
  Description of Artificial Sequence: Synthetic polypeptide
DSAEIRTTNPVATEQWGSTPSCTNNLQQRAGGDNEL

SEQ ID NO: 131075 - protein, 34 aa, Artificial Sequence
  Description of Artificial Sequence: Synthetic polypeptide
DEEAIRTTNPVATEQWGCVCQTNEHNQGFGSNQA

SEQ ID NO: 131076 - protein, 33 aa, Artificial Sequence
  Description of Artificial Sequence: Synthetic polypeptide
DEEAIRTTNPVATEQWGCVCQTNNHQGFGSQQA

SEQ ID NO: 131077 - protein, 34 aa, Artificial Sequence
  Description of Artificial Sequence: Synthetic polypeptide
DESEIRTTNPVATECWGSVSCIRYPQDREGENCG

SEQ ID NO: 131078 - protein, 33 aa, Artificial Sequence
  Description of Artificial Sequence: Synthetic polypeptide
CEEEISTTNPVATEQYGCVCSNSELQNFGSEQS

SEQ ID NO: 131079 - protein, 34 aa, Artificial Sequence
  Description of Artificial Sequence: Synthetic polypeptide
DEEEIRTTNPVATEQYGSVSNSVLEEPAAVVEEE

SEQ ID NO: 131080 - protein, 30 aa, Artificial Sequence
  Description of Artificial Sequence: Synthetic polypeptide
AENEIACTNPVATEQYGEAPEVLQRGDGYQ

SEQ ID NO: 131081 - protein, 33 aa, Artificial Sequence
  Description of Artificial Sequence: Synthetic polypeptide
DENEIRTTNPVATEQYGCVSTLNMDDEDEDMIT

SEQ ID NO: 131082 - protein, 32 aa, Artificial Sequence
  Description of Artificial Sequence: Synthetic polypeptide
DEAEIRTTNPVAYECWGCTSTNLNGNDGQNGQ

SEQ ID NO: 131083 - protein, 34 aa, Artificial Sequence
  Description of Artificial Sequence: Synthetic polypeptide
DENEIRTTNPVATEQYGCVSTEVNEIGIMVDFRH

SEQ ID NO: 131084 - protein, 34 aa, Artificial Sequence
  Description of Artificial Sequence: Synthetic polypeptide
DESEIRTTNPVATECWGSVSCIQEPQDREGENGQ

SEQ ID NO: 131085 - protein, 34 aa, Artificial Sequence
  Description of Artificial Sequence: Synthetic polypeptide
DEDEIATTNPVATEQYGSVAITNPEPGNQDNSDA

SEQ ID NO: 131086 - protein, 33 aa, Artificial Sequence
  Description of Artificial Sequence: Synthetic polypeptide
DENEIRTTNPVATEQYGDVCSATIPVMNAEEND

SEQ ID NO: 131087 - protein, 35 aa, Artificial Sequence
  Description of Artificial Sequence: Synthetic polypeptide
DEDEIATTNPVATEQYGSVAMNGLTNPDNQGENRV

SEQ ID NO: 131088 - protein, 34 aa, Artificial Sequence
  Description of Artificial Sequence: Synthetic polypeptide
DEEAIRTTNPVATEQWGCVCGTNNLQEHFNSDQA

SEQ ID NO: 131089 - protein, 33 aa, Artificial Sequence
  Description of Artificial Sequence: Synthetic polypeptide
DESEIRTTNPVATECWGSVSCIWEPYDREGENG

SEQ ID NO: 131090 - protein, 32 aa, Artificial Sequence
  Description of Artificial Sequence: Synthetic polypeptide
DENEIRTTNPVATEQYGDVCSAEDIPEFEEND

SEQ ID NO: 131091 - protein, 33 aa, Artificial Sequence
  Description of Artificial Sequence: Synthetic polypeptide
DESEIRTTNPVATECWGSVSCIWEPQDRENENG

SEQ ID NO: 131092 - protein, 33 aa, Artificial Sequence
  Description of Artificial Sequence: Synthetic polypeptide
DEEAIRTTNPVATECYGKIHSEWNELQPPSNEF

SEQ ID NO: 131093 - protein, 33 aa, Artificial Sequence
  Description of Artificial Sequence: Synthetic polypeptide
DQSEIRTTNPVATECWGSVSCINEPQDFEGENG

SEQ ID NO: 131094 - protein, 36 aa, Artificial Sequence
  Description of Artificial Sequence: Synthetic polypeptide
DEEEIRTTNPVATEQYGSVTPTLNMMMQEEGEEEVP

SEQ ID NO: 131095 - protein, 30 aa, Artificial Sequence
  Description of Artificial Sequence: Synthetic polypeptide
DENEIRTTNPVATEQYGDISMIIMNAAEDA

SEQ ID NO: 131096 - protein, 34 aa, Artificial Sequence
  Description of Artificial Sequence: Synthetic polypeptide
DQSEIRTTNPVATECWGSVSCINEPQDREGENGS

SEQ ID NO: 131097 - protein, 31 aa, Artificial Sequence
  Description of Artificial Sequence: Synthetic polypeptide
DENEIRTTNPVATEQYGDISEDIQQNAAEDA

SEQ ID NO: 131098 - protein, 39 aa, Artificial Sequence
  Description of Artificial Sequence: Synthetic polypeptide
DEEEIRTTNPVATEQYGSVSTTNLQAGNNQAGNNNQQND

SEQ ID NO: 131099 - protein, 32 aa, Artificial Sequence
  Description of Artificial Sequence: Synthetic polypeptide
DEAEIRTTNPVAYEAWGCVSTNLNGDTQNDTQ

SEQ ID NO: 131100 - protein, 39 aa, Artificial Sequence
  Description of Artificial Sequence: Synthetic polypeptide
DEEEIRTTNPVATEQYGSVSTTNLNQLQAGTEQGTNVED

SEQ ID NO: 131101 - protein, 33 aa, Artificial Sequence
  Description of Artificial Sequence: Synthetic polypeptide
DEDEIATTNPVATEQYGSVANNGNGEYGDEGGR

SEQ ID NO: 131102 - protein, 34 aa, Artificial Sequence
  Description of Artificial Sequence: Synthetic polypeptide
DESEIRTTNPVATECWGSVSCIWEPQDREGENEG

SEQ ID NO: 131103 - protein, 34 aa, Artificial Sequence
  Description of Artificial Sequence: Synthetic polypeptide
DEAEIRTTNPVAYEAWGEVCSTNDGQHDGDGNTR

SEQ ID NO: 131104 - protein, 31 aa, Artificial Sequence
  Description of Artificial Sequence: Synthetic polypeptide
DQTDIACTNPVATEQYGCVATNHQQRDSNSL

SEQ ID NO: 131105 - protein, 31 aa, Artificial Sequence
  Description of Artificial Sequence: Synthetic polypeptide
DQTDIACTNPVATEQYGCVATNHQRDSNDSQ

SEQ ID NO: 131106 - protein, 33 aa, Artificial Sequence
  Description of Artificial Sequence: Synthetic polypeptide
DESEIRTTNPVATECWGSVSCIWEPQDMEGENG

SEQ ID NO: 131107 - protein, 34 aa, Artificial Sequence
  Description of Artificial Sequence: Synthetic polypeptide
DEEAIRTTNPVATEQWGCVCGTNNLQEHFGSEQS

SEQ ID NO: 131108 - protein, 34 aa, Artificial Sequence
  Description of Artificial Sequence: Synthetic polypeptide
DESEIRTTNPVATECWGSVSCIVEPQDREGENMG

SEQ ID NO: 131109 - protein, 34 aa, Artificial Sequence
  Description of Artificial Sequence: Synthetic polypeptide
DENEIRTTNPVATEQYGCVSTEDASEIPQMGIQN

SEQ ID NO: 131110 - protein, 36 aa, Artificial Sequence
  Description of Artificial Sequence: Synthetic polypeptide
DEEEIRTTNPVATEQYGSVTNNEVELEVLGNDETLD

SEQ ID NO: 131111 - protein, 35 aa, Artificial Sequence
  Description of Artificial Sequence: Synthetic polypeptide
DQEEIRTTNPVAYEQYGCVASCTNLSGNKGGDSRY

SEQ ID NO: 131112 - protein, 33 aa, Artificial Sequence
  Description of Artificial Sequence: Synthetic polypeptide
DEDEIATTNPVATEQYGSVCAGTNPAPDGPAQE

SEQ ID NO: 131113 - protein, 33 aa, Artificial Sequence
  Description of Artificial Sequence: Synthetic polypeptide
DEQEIATTNPVATEQYGSVSATDLEDHEFHEDL

SEQ ID NO: 131114 - protein, 35 aa, Artificial Sequence
  Description of Artificial Sequence: Synthetic polypeptide
DQEEIRTTNPVATEQYGCVSTTNSAMTLEANEDND

SEQ ID NO: 131115 - protein, 35 aa, Artificial Sequence
  Description of Artificial Sequence: Synthetic polypeptide
DQEEIRTTNPVATEQYGSVCSTVVFLENIGDMQQD

SEQ ID NO: 131116 - protein, 36 aa, Artificial Sequence
  Description of Artificial Sequence: Synthetic polypeptide
DQEEIRTTNPVATEQYGSVSSDTPAGPNMRNGMNPV

SEQ ID NO: 131117 - protein, 36 aa, Artificial Sequence
  Description of Artificial Sequence: Synthetic polypeptide
DQEEIRTTNPVATEQYGSVSSTTPAGPNMRNGMNPV

SEQ ID NO: 131118 - protein, 36 aa, Artificial Sequence
  Description of Artificial Sequence: Synthetic polypeptide
DQEEIRTTNPVATEQYGSVSSTTPAGPNMRTGMNPV

SEQ ID NO: 131119 - protein, 33 aa, Artificial Sequence
  Description of Artificial Sequence: Synthetic polypeptide
DEEAEIATTNPVAYECWGSVSGGNHQETGQNGE

SEQ ID NO: 131120 - protein, 33 aa, Artificial Sequence
  Description of Artificial Sequence: Synthetic polypeptide
DEDEIATTNPVATEQYGSVCAGTNPAPDEDNQM

SEQ ID NO: 131121 - protein, 34 aa, Artificial Sequence
  Description of Artificial Sequence: Synthetic polypeptide
DEEAEIATTNPVAYEQWGSVAITGNDHQMNGGND

SEQ ID NO: 131122 - protein, 34 aa, Artificial Sequence
  Description of Artificial Sequence: Synthetic polypeptide
DEEAEIATTNPVAYEQWGSVSGPNGNQGGHNGPD

SEQ ID NO: 131123 - protein, 35 aa, Artificial Sequence
  Description of Artificial Sequence: Synthetic polypeptide
DEEAEIATTNPVAYEQWGTVCSNDNFGQERGNNDR

SEQ ID NO: 131124 - protein, 35 aa, Artificial Sequence
  Description of Artificial Sequence: Synthetic polypeptide
DESEIRTTNPVATECWGSVSECINSEPQDREGENG

SEQ ID NO: 131125 - protein, 34 aa, Artificial Sequence
  Description of Artificial Sequence: Synthetic polypeptide
DESEIRTTNPVATECWGSVSECINEPQDTEGENG

SEQ ID NO: 131126 - protein, 34 aa, Artificial Sequence
  Description of Artificial Sequence: Synthetic polypeptide
DEQEIATTNPVATEQYGSVSATDLEDHEGCEDLG

SEQ ID NO: 131127 - protein, 34 aa, Artificial Sequence
  Description of Artificial Sequence: Synthetic polypeptide
DEEAEIATTNPVAYERWGSVPTNLQGNDAGGNME

SEQ ID NO: 131128 - protein, 34 aa, Artificial Sequence
  Description of Artificial Sequence: Synthetic polypeptide
DEAEIRTTNPVATEQYGISCSTMLLDDAGEEMID

SEQ ID NO: 131129 - protein, 33 aa, Artificial Sequence
  Description of Artificial Sequence: Synthetic polypeptide
DENEIRTTNPVATEQYGEMTSGNGDQDEGGDDG

SEQ ID NO: 131130 - protein, 34 aa, Artificial Sequence
  Description of Artificial Sequence: Synthetic polypeptide
DEQEIATTNPVATEQYGSVSATDLEDHEGDEDLW

SEQ ID NO: 131131 - protein, 31 aa, Artificial Sequence
  Description of Artificial Sequence: Synthetic polypeptide
DESEIRTTNPVATECWGSVSEIEQNAAEEDA

SEQ ID NO: 131132 - protein, 35 aa, Artificial Sequence
  Description of Artificial Sequence: Synthetic polypeptide
DEDEIATTNPVATEQYGSVCADTNNLQDQGMMTEN

SEQ ID NO: 131133 - protein, 33 aa, Artificial Sequence
  Description of Artificial Sequence: Synthetic polypeptide
DESEIRTTNPVATECWGSVSEINEPQDREDEGG

SEQ ID NO: 131134 - protein, 34 aa, Artificial Sequence
  Description of Artificial Sequence: Synthetic polypeptide
DEDTIRTTNPVATEQYGSVDSIGGQGGENQGDTG

SEQ ID NO: 131135 - protein, 32 aa, Artificial Sequence
  Description of Artificial Sequence: Synthetic polypeptide
DQEEIATTNPVATTQWGEVSTGEGDAGNGNHR

SEQ ID NO: 131136 - protein, 33 aa, Artificial Sequence
  Description of Artificial Sequence: Synthetic polypeptide
DQEEIATTNPVATTQWGEVSTNGDAGNHGGNHR

SEQ ID NO: 131137 - protein, 33 aa, Artificial Sequence
  Description of Artificial Sequence: Synthetic polypeptide
DEDEIVTTNPVATEQYGAVVSATDGMEEFEGND

SEQ ID NO: 131138 - protein, 33 aa, Artificial Sequence
  Description of Artificial Sequence: Synthetic polypeptide
DEDEIVTTNPVATEQYGTVCSATDGPVEFEGND

SEQ ID NO: 131139 - protein, 36 aa, Artificial Sequence
  Description of Artificial Sequence: Synthetic polypeptide
DENEIRTTNPVATEQYGQVVSVTLNELSQMTSGSAL

SEQ ID NO: 131140 - protein, 33 aa, Artificial Sequence
  Description of Artificial Sequence: Synthetic polypeptide
DEDEIVTTNPVATEQYGTVCSATDGPVEFNGND

SEQ ID NO: 131141 - protein, 33 aa, Artificial Sequence
  Description of Artificial Sequence: Synthetic polypeptide
DEDEIVTTNPVATEQYGTVCSATTGPVEFEGND

SEQ ID NO: 131142 - protein, 36 aa, Artificial Sequence
  Description of Artificial Sequence: Synthetic polypeptide
DENEIRTTNPVATEQYGQTVSVTPNELSQMTVGSAL

SEQ ID NO: 131143 - protein, 36 aa, Artificial Sequence
  Description of Artificial Sequence: Synthetic polypeptide
DENEIRTTNPVATEQYGQTVSVTNNELSQMTSGSYL

SEQ ID NO: 131144 - protein, 36 aa, Artificial Sequence
  Description of Artificial Sequence: Synthetic polypeptide
DENEIRTTNPVATEQYGQTVCSVTLNELSQQSGSAL

SEQ ID NO: 131145 - protein, 34 aa, Artificial Sequence
  Description of Artificial Sequence: Synthetic polypeptide
DEDEIVTTNPVATEQYGTVVSATDGNEEFEGGND

SEQ ID NO: 131146 - protein, 33 aa, Artificial Sequence
  Description of Artificial Sequence: Synthetic polypeptide
DEDEIVTTNPVATEQYGTVVSNTDGPEEGEGND

SEQ ID NO: 131147 - protein, 34 aa, Artificial Sequence
  Description of Artificial Sequence: Synthetic polypeptide
DEDEIVTTNPVATEQYGVVVSATDGGQEEFEGND

SEQ ID NO: 131148 - protein, 32 aa, Artificial Sequence
  Description of Artificial Sequence: Synthetic polypeptide
DEDENRTTNPVAYEQWGVVSGGNLQDHPNGGS

SEQ ID NO: 131149 - protein, 36 aa, Artificial Sequence
  Description of Artificial Sequence: Synthetic polypeptide
DEEEIRTTNPVATEQYGSVSNTPDDMEQKMIHNDQE

SEQ ID NO: 131150 - protein, 34 aa, Artificial Sequence
  Description of Artificial Sequence: Synthetic polypeptide
DESEIRTTNPVATECWGSVSFCIGEPQDREGENG

SEQ ID NO: 131151 - protein, 34 aa, Artificial Sequence
  Description of Artificial Sequence: Synthetic polypeptide
DQEEIRTTNPVATCQYGCVCSTEGDQNFGSDNQS

SEQ ID NO: 131152 - protein, 35 aa, Artificial Sequence
  Description of Artificial Sequence: Synthetic polypeptide
DQEEIRTTNPVATCQYGCVCSTNGPNQNFGSNNQS

SEQ ID NO: 131153 - protein, 35 aa, Artificial Sequence
  Description of Artificial Sequence: Synthetic polypeptide
DQEEIRTTNPVATDQYGQVVSCTENLSDGTVGTRL

SEQ ID NO: 131154 - protein, 34 aa, Artificial Sequence
  Description of Artificial Sequence: Synthetic polypeptide
DQEEIRTTNPVATEAYGSVPSCATELSTFTVNLP

SEQ ID NO: 131155 - protein, 39 aa, Artificial Sequence
  Description of Artificial Sequence: Synthetic polypeptide
DEEEIRTTNPVATEQYGSVSTTNLQNQNGTNEQGTNNND

SEQ ID NO: 131156 - protein, 35 aa, Artificial Sequence
  Description of Artificial Sequence: Synthetic polypeptide
DEEEIRTTNPVATEQYGSVTHTGEDHNDEEGEEQA

SEQ ID NO: 131157 - protein, 34 aa, Artificial Sequence
  Description of Artificial Sequence: Synthetic polypeptide
DESEIRTTNPVATECWGSVSDCIIEPQDREGENG

SEQ ID NO: 131158 - protein, 31 aa, Artificial Sequence
  Description of Artificial Sequence: Synthetic polypeptide
AENEIACTNPVATEQYGEASAENLVEREGGD

SEQ ID NO: 131159 - protein, 35 aa, Artificial Sequence
  Description of Artificial Sequence: Synthetic polypeptide
DQEEIRTTNPVATWQYGSVSTAVGVSQPNGENQVD

SEQ ID NO: 131160 - protein, 33 aa, Artificial Sequence
  Description of Artificial Sequence: Synthetic polypeptide
DEDEIATTNPVATEQYGSVCAATMGEAPDNGNS

SEQ ID NO: 131161 - protein, 39 aa, Artificial Sequence
  Description of Artificial Sequence: Synthetic polypeptide
DEEEIRTTNPVATEQYGSVSTTNLQQGNNLNGNNNNQND

SEQ ID NO: 131162 - protein, 34 aa, Artificial Sequence
  Description of Artificial Sequence: Synthetic polypeptide
DEEAICTVNPVATEAYGSVSTDQNNQENGNNEQD

SEQ ID NO: 131163 - protein, 35 aa, Artificial Sequence
  Description of Artificial Sequence: Synthetic polypeptide
DEEAICTVNPVATEAYGSVSTNNQLQENNQGNNQD

SEQ ID NO: 131164 - protein, 35 aa, Artificial Sequence
  Description of Artificial Sequence: Synthetic polypeptide
DEEAICTVNPVATEAYGSVSTVNLQSGNEGGNQQG

SEQ ID NO: 131165 - protein, 35 aa, Artificial Sequence
  Description of Artificial Sequence: Synthetic polypeptide
DEEEIRTTNPVATEQYGSVTLEDIELQLTVVEERQ

SEQ ID NO: 131166 - protein, 36 aa, Artificial Sequence
  Description of Artificial Sequence: Synthetic polypeptide
DEEEIRTTNPVATEQYGSVTMNVNGIGQEDDGENEG

SEQ ID NO: 131167 - protein, 34 aa, Artificial Sequence
  Description of Artificial Sequence: Synthetic polypeptide
DQEEIRTTNPVAYEAYGSVSTENMLSDGKVGTEL

SEQ ID NO: 131168 - protein, 34 aa, Artificial Sequence
  Description of Artificial Sequence: Synthetic polypeptide
DEDEIATTNPVATEQYGSVCAATAQLAAAEGGNQ

SEQ ID NO: 131169 - protein, 34 aa, Artificial Sequence
  Description of Artificial Sequence: Synthetic polypeptide
DEAEIRTTNPVATETYGCVATGGNQGLTDGEGRR

SEQ ID NO: 131170 - protein, 34 aa, Artificial Sequence
  Description of Artificial Sequence: Synthetic polypeptide
DQEEIRTTNPVAYEAYGSVVCTENELDGPVGTRL

SEQ ID NO: 131171 - protein, 33 aa, Artificial Sequence
  Description of Artificial Sequence: Synthetic polypeptide
DEDEIATTNPVATEQYGSVCAAPLFDHQGDENQ

SEQ ID NO: 131172 - protein, 35 aa, Artificial Sequence
  Description of Artificial Sequence: Synthetic polypeptide
DEEEIRTTNPVATEQYGSVSNTMFMETSGTEQVEM

SEQ ID NO: 131173 - protein, 33 aa, Artificial Sequence
  Description of Artificial Sequence: Synthetic polypeptide
DEDEIATTNPVATEQYGSVCAANNPQDGPPDQH

SEQ ID NO: 131174 - protein, 35 aa, Artificial Sequence
  Description of Artificial Sequence: Synthetic polypeptide
DEDEIATTNPVATEQYGSVCAANNPLQDSDGNGHK

SEQ ID NO: 131175 - protein, 33 aa, Artificial Sequence
  Description of Artificial Sequence: Synthetic polypeptide
DEDEIATTNPVATEQYGSVCAANNLTEAGSEDT

SEQ ID NO: 131176 - protein, 34 aa, Artificial Sequence
  Description of Artificial Sequence: Synthetic polypeptide
DEDEIATTNPVATEQYGSVCAANNLQEAPGTAES

SEQ ID NO: 131177 - protein, 35 aa, Artificial Sequence
  Description of Artificial Sequence: Synthetic polypeptide
DEEAICTVNPVATEAYGSVSTDNNLQENNNGNNQE

SEQ ID NO: 131178 - protein, 36 aa, Artificial Sequence
  Description of Artificial Sequence: Synthetic polypeptide
DEEEIRTTNPVATEQYGSVTHTGEDHNDENGEENQH

SEQ ID NO: 131179 - protein, 31 aa, Artificial Sequence
  Description of Artificial Sequence: Synthetic polypeptide
DENEIRTTNPVATEQYGDVSEPIEMMAAEDA

SEQ ID NO: 131180 - protein, 35 aa, Artificial Sequence
  Description of Artificial Sequence: Synthetic polypeptide
DEAEIRTTNPVATESYGSVCQTNDQNQDGQGGNTE

SEQ ID NO: 131181 - protein, 34 aa, Artificial Sequence
  Description of Artificial Sequence: Synthetic polypeptide
DEEAEIRTTNPVAYEHYGEVSTGNQGNHGEGDGR

SEQ ID NO: 131182 - protein, 35 aa, Artificial Sequence
  Description of Artificial Sequence: Synthetic polypeptide
DENEIRTTNPVATEQYGDVSTTPAGPNMRNGMNPV

SEQ ID NO: 131183 - protein, 35 aa, Artificial Sequence
  Description of Artificial Sequence: Synthetic polypeptide
DENEIRTTNPVATEQYGDVSTTPAGPNMANGMNPV

SEQ ID NO: 131184 - protein, 34 aa, Artificial Sequence
  Description of Artificial Sequence: Synthetic polypeptide
DEEEIRTTNPVATEQYGSVTHTMEDHNDENMEEG

SEQ ID NO: 131185 - protein, 35 aa, Artificial Sequence
  Description of Artificial Sequence: Synthetic polypeptide
DEEEIRTTNPVATEQYGSVTHTPEDHNDENQEEQE

SEQ ID NO: 131186 - protein, 35 aa, Artificial Sequence
  Description of Artificial Sequence: Synthetic polypeptide
DEEEIRTTNPVATEQYGSVTHTTEDHNDNENGEEG

SEQ ID NO: 131187 - protein, 35 aa, Artificial Sequence
  Description of Artificial Sequence: Synthetic polypeptide
DEEAEIRTTNPVAYEQWGSVCSTQLNDNHGQNDMG

SEQ ID NO: 131188 - protein, 34 aa, Artificial Sequence
  Description of Artificial Sequence: Synthetic polypeptide
DEEEIRTTNPVATEQYGSVTHTTEDHNDTNYEEQ

SEQ ID NO: 131189 - protein, 35 aa, Artificial Sequence
  Description of Artificial Sequence: Synthetic polypeptide
DEEEIRTTNPVATEQYGSVTHTTEDHNNWENGEEQ

SEQ ID NO: 131190 - protein, 34 aa, Artificial Sequence
  Description of Artificial Sequence: Synthetic polypeptide
DENEIRTTNPVATEQYGDVSTEPAEPMNANGMNV

SEQ ID NO: 131191 - protein, 34 aa, Artificial Sequence
  Description of Artificial Sequence: Synthetic polypeptide
DENEIRTTNPVATEQYGDVSTEPAEPMMANGMNV

SEQ ID NO: 131192 - protein, 33 aa, Artificial Sequence
  Description of Artificial Sequence: Synthetic polypeptide
DEAEIRTTNPVATESWGCVSGGNGEERNMNGNA

SEQ ID NO: 131193 - protein, 34 aa, Artificial Sequence
  Description of Artificial Sequence: Synthetic polypeptide
DEEAEIRTTNPVAYESWGCVSTNLNQGDAGGQQP

SEQ ID NO: 131194 - protein, 30 aa, Artificial Sequence
  Description of Artificial Sequence: Synthetic polypeptide
AENEIACTNPVATEQYGEASEAGPNRGGPR

SEQ ID NO: 131195 - protein, 35 aa, Artificial Sequence
  Description of Artificial Sequence: Synthetic polypeptide
DENEIRTTNPVATEQYGDVSSTTAGPNMRNGMNPV

SEQ ID NO: 131196 - protein, 35 aa, Artificial Sequence
  Description of Artificial Sequence: Synthetic polypeptide
DEEAICTTNPVATEAYGSVATTVNNLTQQGTNQQT

SEQ ID NO: 131197 - protein, 33 aa, Artificial Sequence
  Description of Artificial Sequence: Synthetic polypeptide
DEEAICTTNPVATEAYGSVATVNTDQGTEENED

SEQ ID NO: 131198 - protein, 34 aa, Artificial Sequence
  Description of Artificial Sequence: Synthetic polypeptide
DEEAICTTNPVATEIWGQVATNTNGDHQRGSNER

SEQ ID NO: 131199 - protein, 39 aa, Artificial Sequence
  Description of Artificial Sequence: Synthetic polypeptide
DEEEIRTTNPVATEQYGSVSTTNLQQQNGTTEQGTTNED

SEQ ID NO: 131200 - protein, 31 aa, Artificial Sequence
  Description of Artificial Sequence: Synthetic polypeptide
DENEIRTTNPVATEQYGDVSEPIEMNAAEDA

SEQ ID NO: 131201 - protein, 34 aa, Artificial Sequence
  Description of Artificial Sequence: Synthetic polypeptide
DEEEIRTTNPVATEQYGSVTEMLELGESEQMVDE

SEQ ID NO: 131202 - protein, 35 aa, Artificial Sequence
  Description of Artificial Sequence: Synthetic polypeptide
DSAEIRTTNPVATESYGSTPSTNNLSQQMGGDNEL

SEQ ID NO: 131203 - protein, 34 aa, Artificial Sequence
  Description of Artificial Sequence: Synthetic polypeptide
DEQEIATTNPVATEQYGSVSATDLEDHEGIEDLT

SEQ ID NO: 131204 - protein, 31 aa, Artificial Sequence
  Description of Artificial Sequence: Synthetic polypeptide
DENEIRTTNPVATEQWGYVSEIEMNAAEDHA

SEQ ID NO: 131205 - protein, 30 aa, Artificial Sequence
  Description of Artificial Sequence: Synthetic polypeptide
DENEIRTTNPVATEQWGYVSEIEMNAAEDA

SEQ ID NO: 131206 - protein, 35 aa, Artificial Sequence
  Description of Artificial Sequence: Synthetic polypeptide
DSEEIRTTNPVATEQYGCVCSMNELSGKTGGNNMG

SEQ ID NO: 131207 - protein, 36 aa, Artificial Sequence
  Description of Artificial Sequence: Synthetic polypeptide
DSEEIRTTNPVATEQYGCVCSQDNELSGKTGGNNRG

SEQ ID NO: 131208 - protein, 34 aa, Artificial Sequence
  Description of Artificial Sequence: Synthetic polypeptide
DEEEIRTTNPVATEQYGSVSNGHLEEPAAVEEEE

SEQ ID NO: 131209 - protein, 35 aa, Artificial Sequence
  Description of Artificial Sequence: Synthetic polypeptide
DEEEIRTTNPVATEQYGSVSNGFIGENAEGNNGGN

SEQ ID NO: 131210 - protein, 30 aa, Artificial Sequence
  Description of Artificial Sequence: Synthetic polypeptide
DENEIRTTNPVATEQWGWVSEIEMNIAEDA

SEQ ID NO: 131211 - protein, 32 aa, Artificial Sequence
  Description of Artificial Sequence: Synthetic polypeptide
DEDEIATTNPVATEQYGCVAATANGMMNPSNT

SEQ ID NO: 131212 - protein, 30 aa, Artificial Sequence
  Description of Artificial Sequence: Synthetic polypeptide
DENEIRTTNPVATEQWGWVSEIEMNAAEDA

SEQ ID NO: 131213 - protein, 30 aa, Artificial Sequence
  Description of Artificial Sequence: Synthetic polypeptide
DENEIRTTNPVATEQWGWVSEIDMNAAEDA

SEQ ID NO: 131214 - protein, 35 aa, Artificial Sequence
  Description of Artificial Sequence: Synthetic polypeptide
DESEIRTTNPVATECWGSVSCINIEPQDREGENGE

SEQ ID NO: 131215 - protein, 31 aa, Artificial Sequence
  Description of Artificial Sequence: Synthetic polypeptide
DENEIRTTNPVATEQWGVVVSVVNNNAAEDA

SEQ ID NO: 131216 - protein, 31 aa, Artificial Sequence
  Description of Artificial Sequence: Synthetic polypeptide
DENEIRTTNPVATEQWGVVVSVVENNAAEDA

SEQ ID NO: 131217 - protein, 33 aa, Artificial Sequence
  Description of Artificial Sequence: Synthetic polypeptide
DEDEIATTNPVATEQYGCVAANNLADSGDGNQQ

SEQ ID NO: 131218 - protein, 31 aa, Artificial Sequence
  Description of Artificial Sequence: Synthetic polypeptide
AENEIACTNPVATEQYGCSCSWELQGFGSGQ

SEQ ID NO: 131219 - protein, 34 aa, Artificial Sequence
  Description of Artificial Sequence: Synthetic polypeptide
DENEIRTTNPVATEQWGVVSYEIESTNAAEGDNA

SEQ ID NO: 131220 - protein, 30 aa, Artificial Sequence
  Description of Artificial Sequence: Synthetic polypeptide
DENEIRTTNPVATEQWGVVSWAEANAIEDA

SEQ ID NO: 131221 - protein, 34 aa, Artificial Sequence
  Description of Artificial Sequence: Synthetic polypeptide
DESEIRTTNPVATECWGSVSCINIEPQDREGEMG

SEQ ID NO: 131222 - protein, 32 aa, Artificial Sequence
  Description of Artificial Sequence: Synthetic polypeptide
DENEIRTTNPVATEQWGVVSVVTNVNNAAEDA

SEQ ID NO: 131223 - protein, 30 aa, Artificial Sequence
  Description of Artificial Sequence: Synthetic polypeptide
DENEIRTTNPVATEQWGYVSEIEMNAAPDA

SEQ ID NO: 131224 - protein, 31 aa, Artificial Sequence
  Description of Artificial Sequence: Synthetic polypeptide
DENEIRTTNPVATEQWGVVSVVNNNAAEDEQ

SEQ ID NO: 131225 - protein, 31 aa, Artificial Sequence
  Description of Artificial Sequence: Synthetic polypeptide
DENEIRTTNPVATEQWGYVSENIEMNAAEDA

SEQ ID NO: 131226 - protein, 34 aa, Artificial Sequence
  Description of Artificial Sequence: Synthetic polypeptide
DEEEIRTTNPVATEQYGSVSNGLEWPAPEVVEDE

SEQ ID NO: 131227 - protein, 34 aa, Artificial Sequence
  Description of Artificial Sequence: Synthetic polypeptide
CEEEISTTNPVATEQYGCVCSNTEELQHFISNQS

SEQ ID NO: 131228 - protein, 33 aa, Artificial Sequence
  Description of Artificial Sequence: Synthetic polypeptide
DEDEIATTNPVATEQYGCVAATNPQAESGTPDH

SEQ ID NO: 131229 - protein, 36 aa, Artificial Sequence
  Description of Artificial Sequence: Synthetic polypeptide
DSEEIRTTNPVATEAYGQSTCSCLPEMLSQRDGNLR

SEQ ID NO: 131230 - protein, 35 aa, Artificial Sequence
  Description of Artificial Sequence: Synthetic polypeptide
DEEEIRTTNPVATEQYGSVSNLSNNLNNVSIQVID

SEQ ID NO: 131231 - protein, 35 aa, Artificial Sequence
  Description of Artificial Sequence: Synthetic polypeptide
DSEEIRTTNPVATEMYGCVCSTYELSGKTGGNNRG

SEQ ID NO: 131232 - protein, 34 aa, Artificial Sequence
  Description of Artificial Sequence: Synthetic polypeptide
DEDEIATTNPVATEQYGCVAATNPQAESGGTDRQ

SEQ ID NO: 131233 - protein, 33 aa, Artificial Sequence
  Description of Artificial Sequence: Synthetic polypeptide
AENEIACTNPVATEQYGCSCSWNLQNFGSDNQM

SEQ ID NO: 131234 - protein, 32 aa, Artificial Sequence
  Description of Artificial Sequence: Synthetic polypeptide
AENEIACTNPVATEQYGCSCSWNDQRFGSQQA

SEQ ID NO: 131235 - protein, 36 aa, Artificial Sequence
  Description of Artificial Sequence: Synthetic polypeptide
DSEEIRTTNPVATEQWGCSVPSCTTELDERTGTNLM

SEQ ID NO: 131236 - protein, 34 aa, Artificial Sequence
  Description of Artificial Sequence: Synthetic polypeptide
DEEEIRTTNPVATEQYGSVSNHLSEIPSEEVSEF

SEQ ID NO: 131237 - protein, 35 aa, Artificial Sequence
  Description of Artificial Sequence: Synthetic polypeptide
DEEEIRTTNPVATEQYGSVSNGNLVEVAMAFVEEE

SEQ ID NO: 131238 - protein, 33 aa, Artificial Sequence
  Description of Artificial Sequence: Synthetic polypeptide
DSEEIRTTNPVATEQWGLCTTTELLQRQGTQYM

SEQ ID NO: 131239 - protein, 36 aa, Artificial Sequence
  Description of Artificial Sequence: Synthetic polypeptide
DSEEIRTTNPVATEQWGQSVPSCTGELQVGTGTNNH

SEQ ID NO: 131240 - protein, 33 aa, Artificial Sequence
  Description of Artificial Sequence: Synthetic polypeptide
DSEEIRTTNPVATEQWGSCTTTELLWRIGTQDL

SEQ ID NO: 131241 - protein, 33 aa, Artificial Sequence
  Description of Artificial Sequence: Synthetic polypeptide
DEQEIATTNPVATEQYGSVSATDLEDHEWEDLY

SEQ ID NO: 131242 - protein, 33 aa, Artificial Sequence
  Description of Artificial Sequence: Synthetic polypeptide
DEQEIATTNPVATEQYGSVSATDLEDHEWFEDL

SEQ ID NO: 131243 - protein, 31 aa, Artificial Sequence
  Description of Artificial Sequence: Synthetic polypeptide
AENEIACTNPVATEQYGCSCSWENDQYGSDQ

SEQ ID NO: 131244 - protein, 32 aa, Artificial Sequence
  Description of Artificial Sequence: Synthetic polypeptide
DEDEIATTNPVATEQYGCVAATANLMTDDPGT

SEQ ID NO: 131245 - protein, 35 aa, Artificial Sequence
  Description of Artificial Sequence: Synthetic polypeptide
DSEEIRTTNPVATEQYGCVCFTNELSGKTGGNNDG

SEQ ID NO: 131246 - protein, 36 aa, Artificial Sequence
  Description of Artificial Sequence: Synthetic polypeptide
DSEEIRTTNPVATEQYGCVCQGTNELSGKTGGNNRG

SEQ ID NO: 131247 - protein, 34 aa, Artificial Sequence
  Description of Artificial Sequence: Synthetic polypeptide
DEAEIRTTNPVATEQYGCVYVWENGIQKTGNTDP

SEQ ID NO: 131248 - protein, 32 aa, Artificial Sequence
  Description of Artificial Sequence: Synthetic polypeptide
DEDEIATTNPVATEQYGCVAANNLADPGDEDP

SEQ ID NO: 131249 - protein, 32 aa, Artificial Sequence
  Description of Artificial Sequence: Synthetic polypeptide
DENEIRTTNPVATEQWGVVSTVTISTNNAEDA

SEQ ID NO: 131250 - protein, 33 aa, Artificial Sequence
  Description of Artificial Sequence: Synthetic polypeptide
DESEIRTTNPVATECWGSVSCINEPYDREGEPG

SEQ ID NO: 131251 - protein, 33 aa, Artificial Sequence
  Description of Artificial Sequence: Synthetic polypeptide
DESEIRTTNPVATECWGSVSCINEPYDGEGENG

SEQ ID NO: 131252 - protein, 36 aa, Artificial Sequence
  Description of Artificial Sequence: Synthetic polypeptide
DEDEIATTNPVATEQWGSVTSAGNPLDQRGNDNPDG

SEQ ID NO: 131253 - protein, 34 aa, Artificial Sequence
  Description of Artificial Sequence: Synthetic polypeptide
DEAEIRTTNPVAYEEWGSVCSGLNDLQDQNGGNV

SEQ ID NO: 131254 - protein, 38 aa, Artificial Sequence
  Description of Artificial Sequence: Synthetic polypeptide
DSEEIRTTNPVATEQYGSVSSCTINSHSQTGAGGNNRA

SEQ ID NO: 131255 - protein, 34 aa, Artificial Sequence
  Description of Artificial Sequence: Synthetic polypeptide
DEAEIRTTNPVAYEEWGSVCSGLNDLQIDGDNNV

SEQ ID NO: 131256 - protein, 36 aa, Artificial Sequence
  Description of Artificial Sequence: Synthetic polypeptide
DSEEIRTTNPVATEQYGSVSSRTPAGPNMRNGMNPV

SEQ ID NO: 131257 - protein, 33 aa, Artificial Sequence
  Description of Artificial Sequence: Synthetic polypeptide
DESEIRTTNPVATECWGSVSCINEPTDREVENG

SEQ ID NO: 131258 - protein, 33 aa, Artificial Sequence
  Description of Artificial Sequence: Synthetic polypeptide
DESEIRTTNPVATECWGSVSCINEPSDREFENG

SEQ ID NO: 131259 - protein, 36 aa, Artificial Sequence
  Description of Artificial Sequence: Synthetic polypeptide
DSEEIRTTNPVATEQYGSVSSTTPAGPNMRNGMNPV

SEQ ID NO: 131260 - protein, 33 aa, Artificial Sequence
  Description of Artificial Sequence: Synthetic polypeptide
DESEIRTTNPVATECWGSVSCINEPSDREEENG

SEQ ID NO: 131261 - protein, 32 aa, Artificial Sequence
  Description of Artificial Sequence: Synthetic polypeptide
DEDEIATTNPVATEQWGSVSQGPPQNHMNEAM

SEQ ID NO: 131262 - protein, 33 aa, Artificial Sequence
  Description of Artificial Sequence: Synthetic polypeptide
DEAEIRTTNPVATEQYGCVWMPDHWLEQEDSRD

SEQ ID NO: 131263 - protein, 33 aa, Artificial Sequence
  Description of Artificial Sequence: Synthetic polypeptide
DESEIRTTNPVATECWGSVSCINEPRDRECENG

SEQ ID NO: 131264 - protein, 32 aa, Artificial Sequence
  Description of Artificial Sequence: Synthetic polypeptide
DENEIRTTNPVATEQWGTVSTVIGTNNAEDTA

SEQ ID NO: 131265 - protein, 32 aa, Artificial Sequence
  Description of Artificial Sequence: Synthetic polypeptide
DENEIRTTNPVATEQWGTVSTVIGTNNAAEDA

SEQ ID NO: 131266 - protein, 32 aa, Artificial Sequence
  Description of Artificial Sequence: Synthetic polypeptide
DENEIRTTNPVATEQWGTVSTVEENNNAAEDA

SEQ ID NO: 131267 - protein, 33 aa, Artificial Sequence
  Description of Artificial Sequence: Synthetic polypeptide
AENEIACTNPVATEQYGCSCSSNLNQRFGSVQS

SEQ ID NO: 131268 - protein, 32 aa, Artificial Sequence
  Description of Artificial Sequence: Synthetic polypeptide
AENEIACTNPVATEQYGCSCSSNLNQNGSQQS

SEQ ID NO: 131269 - protein, 35 aa, Artificial Sequence
  Description of Artificial Sequence: Synthetic polypeptide
DEEEIRTTNPVATEQYGSVSNDYDPMDLQSMQDFY

SEQ ID NO: 131270 - protein, 32 aa, Artificial Sequence
  Description of Artificial Sequence: Synthetic polypeptide
DENEIRTTNPVATEQWGVVSTVTNTNNAAEDA

SEQ ID NO: 131271 - protein, 35 aa, Artificial Sequence
  Description of Artificial Sequence: Synthetic polypeptide
DEEEIRTTNPVATEQYGSVSNEDDPVQTGVGGTFI

SEQ ID NO: 131272 - protein, 34 aa, Artificial Sequence
  Description of Artificial Sequence: Synthetic polypeptide
DESEIRTTNPVATECWGSVSCINFEPQDGEGENG

SEQ ID NO: 131273 - protein, 31 aa, Artificial Sequence
  Description of Artificial Sequence: Synthetic polypeptide
DENEIRTTNPVATEQWGVVSTVIETNAAEDA

SEQ ID NO: 131274 - protein, 37 aa, Artificial Sequence
  Description of Artificial Sequence: Synthetic polypeptide
DSEEIRTTNPVATEQYGQSVSCQISSLSQTFGGNNRA

SEQ ID NO: 131275 - protein, 30 aa, Artificial Sequence
  Description of Artificial Sequence: Synthetic polypeptide
DENEIRTTNPVATEQWGVVSEVEENIIEDA

SEQ ID NO: 131276 - protein, 30 aa, Artificial Sequence
  Description of Artificial Sequence: Synthetic polypeptide
DEDEIATTNPVATEQYGCVAAKAGDMMPNH

SEQ ID NO: 131277 - protein, 30 aa, Artificial Sequence
  Description of Artificial Sequence: Synthetic polypeptide
DENEIRTTNPVATEQWGVVSEPEMNASEDA

SEQ ID NO: 131278 - protein, 36 aa, Artificial Sequence
  Description of Artificial Sequence: Synthetic polypeptide
DSEEIRTTNPVATEQYGSVNSTVPAEPNMEIGMNDD

SEQ ID NO: 131279 - protein, 30 aa, Artificial Sequence
  Description of Artificial Sequence: Synthetic polypeptide
DENEIRTTNPVATEQWGVVSEIEWNAAEDA

SEQ ID NO: 131280 - protein, 34 aa, Artificial Sequence
  Description of Artificial Sequence: Synthetic polypeptide
DESEIRTTNPVATECWGSVSCINGEPMDREGENG

SEQ ID NO: 131281 - protein, 31 aa, Artificial Sequence
  Description of Artificial Sequence: Synthetic polypeptide
DENEIRTTNPVATEQWGVVSEIEMNAAEDAF

SEQ ID NO: 131282 - protein, 30 aa, Artificial Sequence
  Description of Artificial Sequence: Synthetic polypeptide
DENEIRTTNPVATEQWGVVSEIEMNAAEDA

SEQ ID NO: 131283 - protein, 33 aa, Artificial Sequence
  Description of Artificial Sequence: Synthetic polypeptide
DEAEIRTTNPVATEQYGCVWSDHWLENREDSID

SEQ ID NO: 131284 - protein, 31 aa, Artificial Sequence
  Description of Artificial Sequence: Synthetic polypeptide
DEDEIATTNPVATEQYGCTAGNNGLADDGDS

SEQ ID NO: 131285 - protein, 32 aa, Artificial Sequence
  Description of Artificial Sequence: Synthetic polypeptide
DEDEIATTNPVATEQYGCTAGNGLADDGNDSM

SEQ ID NO: 131286 - protein, 31 aa, Artificial Sequence
  Description of Artificial Sequence: Synthetic polypeptide
DEDEIATTNPVATEQYGCTAGNGLADDGDPE

SEQ ID NO: 131287 - protein, 34 aa, Artificial Sequence
  Description of Artificial Sequence: Synthetic polypeptide
DESEIRTTNPVATECWGSVSCINFEPQDREGEFG

SEQ ID NO: 131288 - protein, 30 aa, Artificial Sequence
  Description of Artificial Sequence: Synthetic polypeptide
DENEIRTTNPVATEQWGVVSEAEGNATEDD

SEQ ID NO: 131289 - protein, 30 aa, Artificial Sequence
  Description of Artificial Sequence: Synthetic polypeptide
DENEIRTTNPVATEQWGVVSDIEMNAAEDA

SEQ ID NO: 131290 - protein, 36 aa, Artificial Sequence
  Description of Artificial Sequence: Synthetic polypeptide
DEEEIRTTNPVATEQYGSVSTTMNMVMPPVQEEPED

SEQ ID NO: 131291 - protein, 30 aa, Artificial Sequence
  Description of Artificial Sequence: Synthetic polypeptide
DENEIRTTNPVATEQWGVVSAIEMNIAEDA

SEQ ID NO: 131292 - protein, 30 aa, Artificial Sequence
  Description of Artificial Sequence: Synthetic polypeptide
DENEIRTTNPVATEQWGVVSADEMNAFEDA

SEQ ID NO: 131293 - protein, 36 aa, Artificial Sequence
  Description of Artificial Sequence: Synthetic polypeptide
DEEEIRTTNPVATEQYGSVTPTNNMMMQEPNEEEVN

SEQ ID NO: 131294 - protein, 31 aa, Artificial Sequence
  Description of Artificial Sequence: Synthetic polypeptide
AENEIACTNPVATEQYGCYCSWNDQRFGSDQ

SEQ ID NO: 131295 - protein, 34 aa, Artificial Sequence
  Description of Artificial Sequence: Synthetic polypeptide
DEQEIATTNPVATEQYGSVSATDLEDHEMQEDLI

SEQ ID NO: 131296 - protein, 33 aa, Artificial Sequence
  Description of Artificial Sequence: Synthetic polypeptide
DEEAIRTTNPVATEQYGCVCSWEENIYFGSDQS

SEQ ID NO: 131297 - protein, 33 aa, Artificial Sequence
  Description of Artificial Sequence: Synthetic polypeptide
DEEAIRTTNPVATEQYGCVCSWGEHQNFGSEQM

SEQ ID NO: 131298 - protein, 34 aa, Artificial Sequence
  Description of Artificial Sequence: Synthetic polypeptide
DESEIRTTNPVATECWGSVSCINTEPQDREWENG

SEQ ID NO: 131299 - protein, 34 aa, Artificial Sequence
  Description of Artificial Sequence: Synthetic polypeptide
CEEEIATTNPVAYEQYGSVCSAGNLPFAHGDNEQ

SEQ ID NO: 131300 - protein, 35 aa, Artificial Sequence
  Description of Artificial Sequence: Synthetic polypeptide
DESEIRTTNPVATECWGSVSCINPEPQDRLGENGM

SEQ ID NO: 131301 - protein, 35 aa, Artificial Sequence
  Description of Artificial Sequence: Synthetic polypeptide
DSEEIASTNPVATEQYGSTVCSCTNESSQARNVQR

SEQ ID NO: 131302 - protein, 34 aa, Artificial Sequence
  Description of Artificial Sequence: Synthetic polypeptide
DESEIRTTNPVATECWGSVSCINPEPQDREVENG

SEQ ID NO: 131303 - protein, 36 aa, Artificial Sequence
  Description of Artificial Sequence: Synthetic polypeptide
DSEEIATTNPVATEQYGSVACQINSLSQTFGGNNRA

SEQ ID NO: 131304 - protein, 33 aa, Artificial Sequence
  Description of Artificial Sequence: Synthetic polypeptide
DSEEIATTNPVAYEQYGSVPFCTNACAFGGGKR

SEQ ID NO: 131305 - protein, 35 aa, Artificial Sequence
  Description of Artificial Sequence: Synthetic polypeptide
DESEIRTTNPVATECWGSVSCINPEPQDREGENGM

SEQ ID NO: 131306 - protein, 34 aa, Artificial Sequence
  Description of Artificial Sequence: Synthetic polypeptide
DEEAIRTTNPVATEQYGQCVCSWEELQNFGSDQS

SEQ ID NO: 131307 - protein, 36 aa, Artificial Sequence
  Description of Artificial Sequence: Synthetic polypeptide
DEEAIRTTNPVATEQYGSVASPLDDVSINFQEGVRN

SEQ ID NO: 131308 - protein, 36 aa, Artificial Sequence
  Description of Artificial Sequence: Synthetic polypeptide
DEEEIRTTNPVATEQYGSVSTTNIPHNQQSLVVEPV

SEQ ID NO: 131309 - protein, 34 aa, Artificial Sequence
  Description of Artificial Sequence: Synthetic polypeptide
DSEEIATTNPVGYEQWGMVCSRTNDLQDRTGDVR

SEQ ID NO: 131310 - protein, 34 aa, Artificial Sequence
  Description of Artificial Sequence: Synthetic polypeptide
DSEEIATTNPVGYEQWGMVSRTNDLEQDRQGDVR

SEQ ID NO: 131311 - protein, 34 aa, Artificial Sequence
  Description of Artificial Sequence: Synthetic polypeptide
DEAEIRTTNPVAYECWGSVCYTNQDIDLGQNGNH

SEQ ID NO: 131312 - protein, 35 aa, Artificial Sequence
  Description of Artificial Sequence: Synthetic polypeptide
DEEEIRTTNPVATEQYGSVTPWVLPVQPEVGEQES

SEQ ID NO: 131313 - protein, 34 aa, Artificial Sequence
  Description of Artificial Sequence: Synthetic polypeptide
DEEEIRTTNPVATEQYGSVTPYSNAPDDTQNEED

SEQ ID NO: 131314 - protein, 35 aa, Artificial Sequence
  Description of Artificial Sequence: Synthetic polypeptide
DEEAIRTTNPVATEQYGSVNSTEEQDDDRMEEEED

SEQ ID NO: 131315 - protein, 31 aa, Artificial Sequence
  Description of Artificial Sequence: Synthetic polypeptide
DSEDIATTNPVATEQYGCVAGTGDQRVDDLV

SEQ ID NO: 131316 - protein, 35 aa, Artificial Sequence
  Description of Artificial Sequence: Synthetic polypeptide
DEEAIRTTNPVATEQYGSVNSTEEQPDDDRVEELG

SEQ ID NO: 131317 - protein, 30 aa, Artificial Sequence
  Description of Artificial Sequence: Synthetic polypeptide
DSEDIATTNPVATEQWGCVAGTGGQRVDDL

SEQ ID NO: 131318 - protein, 30 aa, Artificial Sequence
  Description of Artificial Sequence: Synthetic polypeptide
AENEIACTNPVATEQYGEANVENMEQRGGY

SEQ ID NO: 131319 - protein, 34 aa, Artificial Sequence
  Description of Artificial Sequence: Synthetic polypeptide
DSAEIRTTNPVAYEPYGSTVCSTVMLSQTGGTRL

SEQ ID NO: 131320 - protein, 33 aa, Artificial Sequence
  Description of Artificial Sequence: Synthetic polypeptide
DSAEIRTTNPVAYEQYGCTCSCARELQHGTNNR

SEQ ID NO: 131321 - protein, 36 aa, Artificial Sequence
  Description of Artificial Sequence: Synthetic polypeptide
DSCEIRTTNPVATEQYGCVCSTDNELSGKTGGNNRA

SEQ ID NO: 131322 - protein, 34 aa, Artificial Sequence
  Description of Artificial Sequence: Synthetic polypeptide
DENEIRTTNPVATEQYGCVSFTDMVNRQEVSQFD

SEQ ID NO: 131323 - protein, 35 aa, Artificial Sequence
  Description of Artificial Sequence: Synthetic polypeptide
DEEEIRTTNPVATEQYGSVTPTQGDETTQSGQDTQ

SEQ ID NO: 131324 - protein, 32 aa, Artificial Sequence
  Description of Artificial Sequence: Synthetic polypeptide
DSDEIATTNPVAYEPDGSIAATANLSQRGGNS

SEQ ID NO: 131325 - protein, 32 aa, Artificial Sequence
  Description of Artificial Sequence: Synthetic polypeptide
DSDEIATTNPVAYEPDGSIATANLSQRGGNTG

SEQ ID NO: 131326 - protein, 33 aa, Artificial Sequence
  Description of Artificial Sequence: Synthetic polypeptide
DENEIRTTNPVATEQYGCVSALLLENHGSDEEL

SEQ ID NO: 131327 - protein, 31 aa, Artificial Sequence
  Description of Artificial Sequence: Synthetic polypeptide
DSDEIATTNPVAYEPDGSIATANPSQYGGNR

SEQ ID NO: 131328 - protein, 31 aa, Artificial Sequence
  Description of Artificial Sequence: Synthetic polypeptide
DSDEIATTNPVAYEPDGSIATATLSQRGGND

SEQ ID NO: 131329 - protein, 28 aa, Artificial Sequence
  Description of Artificial Sequence: Synthetic peptide
AENEIACTNPVATEQYGEAPEVCQHGEK

SEQ ID NO: 131330 - protein, 32 aa, Artificial Sequence
  Description of Artificial Sequence: Synthetic polypeptide
DEAEIRTTNPVAYECWGSVAWNENDQHGDGNK

SEQ ID NO: 131331 - protein, 33 aa, Artificial Sequence
  Description of Artificial Sequence: Synthetic polypeptide
DEEAIRTTNPVATEQYGCVCSSGEHQNFGSDQG

SEQ ID NO: 131332 - protein, 33 aa, Artificial Sequence
  Description of Artificial Sequence: Synthetic polypeptide
DESEIRTTNPVATECWGSVSCIQEPQDRECENG

SEQ ID NO: 131333 - protein, 32 aa, Artificial Sequence
  Description of Artificial Sequence: Synthetic polypeptide
DEDEIATTNPVATEQYGSVAANPANDNPPGQP

SEQ ID NO: 131334 - protein, 34 aa, Artificial Sequence
  Description of Artificial Sequence: Synthetic polypeptide
DENEIRTTNPVATEQYGCVFDDSMNLEEGDEEAT

SEQ ID NO: 131335 - protein, 35 aa, Artificial Sequence
  Description of Artificial Sequence: Synthetic polypeptide
DEEAIRTTNPVATEQYGCVCSTGEHNQNFGSDNDP

SEQ ID NO: 131336 - protein, 34 aa, Artificial Sequence
  Description of Artificial Sequence: Synthetic polypeptide
DEEAIRTTNPVATEQYGCVCSTGEHQENFGSDQF

SEQ ID NO: 131337 - protein, 33 aa, Artificial Sequence
  Description of Artificial Sequence: Synthetic polypeptide
DENEIRTTNPVATEQYGCVDTTSVSQNSIEESS

SEQ ID NO: 131338 - protein, 30 aa, Artificial Sequence
  Description of Artificial Sequence: Synthetic polypeptide
DSEDIATTNPVATEQWGCVAGEGHQRVNLT

SEQ ID NO: 131339 - protein, 31 aa, Artificial Sequence
  Description of Artificial Sequence: Synthetic polypeptide
AENEIACTNPVATEQYGCYCSWNDQRGSGQS

SEQ ID NO: 131340 - protein, 37 aa, Artificial Sequence
  Description of Artificial Sequence: Synthetic polypeptide
DEEEIRTTNPVATEQYGSVTQPTMAGPNMQNGMNPTV

SEQ ID NO: 131341 - protein, 34 aa, Artificial Sequence
  Description of Artificial Sequence: Synthetic polypeptide
DENEIRTTNPVATEQYGCVCSTEEHQFFGSQTQS

SEQ ID NO: 131342 - protein, 33 aa, Artificial Sequence
  Description of Artificial Sequence: Synthetic polypeptide
DEEAIRTTNPVAYEQWGCVCGTNELQHFGSDQA

SEQ ID NO: 131343 - protein, 34 aa, Artificial Sequence
  Description of Artificial Sequence: Synthetic polypeptide
DENEIRTTNPVATEQYGCCSTTVVLEQTGPEDEQ

SEQ ID NO: 131344 - protein, 34 aa, Artificial Sequence
  Description of Artificial Sequence: Synthetic polypeptide
DENEIRTTNPVATEQYGCCSPTPALQLDTGDEKV

SEQ ID NO: 131345 - protein, 37 aa, Artificial Sequence
  Description of Artificial Sequence: Synthetic polypeptide
DEEEIRTTNPVATEQYGSVSNMSGGNNDQDEFGNGGI

SEQ ID NO: 131346 - protein, 34 aa, Artificial Sequence
  Description of Artificial Sequence: Synthetic polypeptide
DENEIRTTNPVATEQYGCCSPTIPANLDTGDEKI

SEQ ID NO: 131347 - protein, 37 aa, Artificial Sequence
  Description of Artificial Sequence: Synthetic polypeptide
DSEEIRSTNPVATEQYGSTVCSCTGNELSQATNVQQR

SEQ ID NO: 131348 - protein, 31 aa, Artificial Sequence
  Description of Artificial Sequence: Synthetic polypeptide
DEDEIATTNPVATEQYGCVAGTGLAANIEQD

SEQ ID NO: 131349 - protein, 36 aa, Artificial Sequence
  Description of Artificial Sequence: Synthetic polypeptide
DSEEIRSTNPVATEQYGSTVCSCTNELSEATNVEQR

SEQ ID NO: 131350 - protein, 36 aa, Artificial Sequence
  Description of Artificial Sequence: Synthetic polypeptide
DSEEIRSTNPVATEQYGSTVCSCTNEPSQARNVSQR

SEQ ID NO: 131351 - protein, 34 aa, Artificial Sequence
  Description of Artificial Sequence: Synthetic polypeptide
DENEIRTTNPVATEQYGCCSPAVEDNDRGSNQQS

SEQ ID NO: 131352 - protein, 34 aa, Artificial Sequence
  Description of Artificial Sequence: Synthetic polypeptide
DENEIRTTNPVATEQYGCCPTTPVWLQDGNENFM

SEQ ID NO: 131353 - protein, 30 aa, Artificial Sequence
  Description of Artificial Sequence: Synthetic polypeptide
AENEIACTNPVATEQYGDASEILQNAAGGA

SEQ ID NO: 131354 - protein, 33 aa, Artificial Sequence
  Description of Artificial Sequence: Synthetic polypeptide
DEQEIATTNPVATEQYGSVSATDLEDHEKPEDL

SEQ ID NO: 131355 - protein, 34 aa, Artificial Sequence
  Description of Artificial Sequence: Synthetic polypeptide
DEEAIRTVNPVATEQYGCVCATTNALAALRPGLS

SEQ ID NO: 131356 - protein, 32 aa, Artificial Sequence
  Description of Artificial Sequence: Synthetic polypeptide
DEEAISTTNPDATEGYGSCSTPLAFRYGEYDG

SEQ ID NO: 131357 - protein, 35 aa, Artificial Sequence
  Description of Artificial Sequence: Synthetic polypeptide
DSEEIRSTNPVAYEQWGSTVSCTNELQASNGNQNS

SEQ ID NO: 131358 - protein, 31 aa, Artificial Sequence
  Description of Artificial Sequence: Synthetic polypeptide
AENEIACTNPVATEQYGCYCSWNLQNFGSEQ

SEQ ID NO: 131359 - protein, 34 aa, Artificial Sequence
  Description of Artificial Sequence: Synthetic polypeptide
DESEIRTTNPVATECWGSVSCINMEPQDGEGENG

SEQ ID NO: 131360 - protein, 35 aa, Artificial Sequence
  Description of Artificial Sequence: Synthetic polypeptide
DSEEIRSTNPVAYEQYGSTVSCTNELSQASNMQNS

SEQ ID NO: 131361 - protein, 33 aa, Artificial Sequence
  Description of Artificial Sequence: Synthetic polypeptide
DEEAIRTTNPVAYEEWGQCSTTGGDHQRGSNQR

SEQ ID NO: 131362 - protein, 34 aa, Artificial Sequence
  Description of Artificial Sequence: Synthetic polypeptide
DEAEIRTTNPVAYECWGSVSGENLGEEREGNNNH

SEQ ID NO: 131363 - protein, 34 aa, Artificial Sequence
  Description of Artificial Sequence: Synthetic polypeptide
DEEAIRTTNPVAYECWGVVATNTNGDHQRGMNER

SEQ ID NO: 131364 - protein, 34 aa, Artificial Sequence
  Description of Artificial Sequence: Synthetic polypeptide
DEQEIATTNPVATEQYGSVSATDLEDHEGYEDLC

SEQ ID NO: 131365 - protein, 37 aa, Artificial Sequence
  Description of Artificial Sequence: Synthetic polypeptide
DEEEIRTTNPVATEQYGSVTQPTPAGPNEQNGMNPVV

SEQ ID NO: 131366 - protein, 34 aa, Artificial Sequence
  Description of Artificial Sequence: Synthetic polypeptide
DEAEIRTTNPVAYECWGSVSGENLGEERGGDNNA

SEQ ID NO: 131367 - protein, 30 aa, Artificial Sequence
  Description of Artificial Sequence: Synthetic polypeptide
AENEIACTNPVATEQYGEACSWNDQNGSDQ

SEQ ID NO: 131368 - protein, 31 aa, Artificial Sequence
  Description of Artificial Sequence: Synthetic polypeptide
AENEIACTNPVATEQYGEACSSNLQHFGSQQ

SEQ ID NO: 131369 - protein, 34 aa, Artificial Sequence
  Description of Artificial Sequence: Synthetic polypeptide
DENEIRTTNPVATEQYGCVCSDTEDTQNFNSEQS

SEQ ID NO: 131370 - protein, 39 aa, Artificial Sequence
  Description of Artificial Sequence: Synthetic polypeptide
DEEEIRTTNPVATEQYGSVSTTNGNNLQEGTEQGTNVEQ

SEQ ID NO: 131371 - protein, 36 aa, Artificial Sequence
  Description of Artificial Sequence: Synthetic polypeptide
DEEAIRTTNPVATEQYGSVSATTPAGPNMRNGMNPV

SEQ ID NO: 131372 - protein, 34 aa, Artificial Sequence
  Description of Artificial Sequence: Synthetic polypeptide
DENEIRTTNPVATEQYGCVATSVPNHERNGQYYF

SEQ ID NO: 131373 - protein, 36 aa, Artificial Sequence
  Description of Artificial Sequence: Synthetic polypeptide
DEEEIRTTNPVATEQYGSVSNNLGLSQAVPPVVQVA

SEQ ID NO: 131374 - protein, 36 aa, Artificial Sequence
  Description of Artificial Sequence: Synthetic polypeptide
DEEEIRTTNPVATEQYGSVSNNLGLSQAVPFQVQVL

SEQ ID NO: 131375 - protein, 32 aa, Artificial Sequence
  Description of Artificial Sequence: Synthetic polypeptide
DEDEIATTNPVATEQYGCVAGTGLATANPIQD

SEQ ID NO: 131376 - protein, 35 aa, Artificial Sequence
  Description of Artificial Sequence: Synthetic polypeptide
DEEAIRTTNPVATEQYGSVSSPLDDVSINFVEGVR

SEQ ID NO: 131377 - protein, 36 aa, Artificial Sequence
  Description of Artificial Sequence: Synthetic polypeptide
DEEAIRTTNPVATEQYGSVSSTTPAGPMMRNGMNPV

SEQ ID NO: 131378 - protein, 36 aa, Artificial Sequence
  Description of Artificial Sequence: Synthetic polypeptide
DEEAIRTTNPVATEQYGSVSSTTPAGPNFRNGMNPV

SEQ ID NO: 131379 - protein, 36 aa, Artificial Sequence
  Description of Artificial Sequence: Synthetic polypeptide
DEEAIRTTNPVATEQYGSVSSTTPAGPNMRNGMNPV

SEQ ID NO: 131380 - protein, 31 aa, Artificial Sequence
  Description of Artificial Sequence: Synthetic polypeptide
DEDEIATTNPVATEQYGCVAGTGLAMNPSQD

SEQ ID NO: 131381 - protein, 32 aa, Artificial Sequence
  Description of Artificial Sequence: Synthetic polypeptide
DEAEIRTTNPVAYECWGSVSIPNGNDMGNNEV

SEQ ID NO: 131382 - protein, 33 aa, Artificial Sequence
  Description of Artificial Sequence: Synthetic polypeptide
DEEAIRTTNPVATEQYRYCVKAQEVLQVRGDGQ

SEQ ID NO: 131383 - protein, 35 aa, Artificial Sequence
  Description of Artificial Sequence: Synthetic polypeptide
DEEEIRTTNPVATEQYGSVSNNDSMDGEEMGEGDI

SEQ ID NO: 131384 - protein, 33 aa, Artificial Sequence
  Description of Artificial Sequence: Synthetic polypeptide
DEAEIRTTNPVAYECWGSVSWNENDQHGQGNIQ

SEQ ID NO: 131385 - protein, 34 aa, Artificial Sequence
  Description of Artificial Sequence: Synthetic polypeptide
DEEEIRTTNPVATEGYGSVSNMTVGMEGQGDDGD

SEQ ID NO: 131386 - protein, 34 aa, Artificial Sequence
  Description of Artificial Sequence: Synthetic polypeptide
DEEEIRTTNPVATEQYGSVLFVGTDDTRFLVTPQ

SEQ ID NO: 131387 - protein, 34 aa, Artificial Sequence
  Description of Artificial Sequence: Synthetic polypeptide
CTGEIRTTNPVATEQYGSVSNTDTNGQIIGEGGQ

SEQ ID NO: 131388 - protein, 37 aa, Artificial Sequence
  Description of Artificial Sequence: Synthetic polypeptide
AEEEIRTTNPVATEQYGSVSTVNQNNNNQNDNGNNVE

SEQ ID NO: 131389 - protein, 34 aa, Artificial Sequence
  Description of Artificial Sequence: Synthetic polypeptide
DEEEIRTTNPVATEQYGQCVCSWEDNQNFNSEQA

SEQ ID NO: 131390 - protein, 36 aa, Artificial Sequence
  Description of Artificial Sequence: Synthetic polypeptide
DEEEIRTTNPVATSQYGSVSSTTPAGPNRRNGMNPV

SEQ ID NO: 131391 - protein, 37 aa, Artificial Sequence
  Description of Artificial Sequence: Synthetic polypeptide
AEEEIRTTNPVATEQYGSVSTVNQNLLSNDEGTNGED

SEQ ID NO: 131392 - protein, 36 aa, Artificial Sequence
  Description of Artificial Sequence: Synthetic polypeptide
DEEEIRTTNPVATTQYGSVSSTTPAGPNMRNGMNPV

SEQ ID NO: 131393 - protein, 36 aa, Artificial Sequence
  Description of Artificial Sequence: Synthetic polypeptide
AEEEIRTTNPVATEQYGSVSTVNQNGNQQIGTEEDE

SEQ ID NO: 131394 - protein, 35 aa, Artificial Sequence
  Description of Artificial Sequence: Synthetic polypeptide
DEEEIRTTNPVATEQYGQCVCSVTMEHQFFNSEQT

SEQ ID NO: 131395 - protein, 36 aa, Artificial Sequence
  Description of Artificial Sequence: Synthetic polypeptide
AEEEIRTTNPVATEQYGSVSTVNQNGENQQGSEEGS

SEQ ID NO: 131396 - protein, 36 aa, Artificial Sequence
  Description of Artificial Sequence: Synthetic polypeptide
DEEEIRTTNPVATVQYGSVSSTTPAGPNMDNGMNPV

SEQ ID NO: 131397 - protein, 36 aa, Artificial Sequence
  Description of Artificial Sequence: Synthetic polypeptide
DEEEIRTTNPVATSQYGSVSSTTPAGPNMRNGMNPV

SEQ ID NO: 131398 - protein, 36 aa, Artificial Sequence
  Description of Artificial Sequence: Synthetic polypeptide
DEEEIRTTNPVATVQYGSVSSTTPAGPNMRNGMNPV

SEQ ID NO: 131399 - protein, 33 aa, Artificial Sequence
  Description of Artificial Sequence: Synthetic polypeptide
DEAEIACTNPVATEQYGSVAITNDNNGAEGVRS

SEQ ID NO: 131400 - protein, 36 aa, Artificial Sequence
  Description of Artificial Sequence: Synthetic polypeptide
AEEEIRTTNPVATEQYGSVSTVNQLGNQQSTTEEDE

SEQ ID NO: 131401 - protein, 35 aa, Artificial Sequence
  Description of Artificial Sequence: Synthetic polypeptide
DEEEIRTTNPVATEQYGQCVCSTWEHQNFGSETQA

SEQ ID NO: 131402 - protein, 33 aa, Artificial Sequence
  Description of Artificial Sequence: Synthetic polypeptide
DEESICTTNPVATEAYGSVATVNTDQGTEENTE

SEQ ID NO: 131403 - protein, 37 aa, Artificial Sequence
  Description of Artificial Sequence: Synthetic polypeptide
AEEEIRTTNPVATEQYGSVSTVNNQQQNGDEGTNNND

SEQ ID NO: 131404 - protein, 36 aa, Artificial Sequence
  Description of Artificial Sequence: Synthetic polypeptide
DEEEIRTTNPVATEQYGQCVCSTWEDLQNFNSENQA

SEQ ID NO: 131405 - protein, 35 aa, Artificial Sequence
  Description of Artificial Sequence: Synthetic polypeptide
DEEEIRGTNPVATEQYGSVTPTPVEQGNLGQGQVD

SEQ ID NO: 131406 - protein, 35 aa, Artificial Sequence
  Description of Artificial Sequence: Synthetic polypeptide
DEEEIRTTNPVATEQYGQCVCSTVEDHQHFGSEQS

SEQ ID NO: 131407 - protein, 36 aa, Artificial Sequence
  Description of Artificial Sequence: Synthetic polypeptide
AEEEIRTTNPVATEQYGSVSTVNNQQNQNEQGTEAL

SEQ ID NO: 131408 - protein, 36 aa, Artificial Sequence
  Description of Artificial Sequence: Synthetic polypeptide
DEEEIRTTNPVATVQYGSVSSTTPATPNMRNGMNPV

SEQ ID NO: 131409 - protein, 34 aa, Artificial Sequence
  Description of Artificial Sequence: Synthetic polypeptide
DEEEIRTTNPVATEQYGQCVCSWEEDQFFNSNQA

SEQ ID NO: 131410 - protein, 37 aa, Artificial Sequence
  Description of Artificial Sequence: Synthetic polypeptide
AEEEIRTTNPVATEQYGSVSTVNQNNQQNGTEAGNED

SEQ ID NO: 131411 - protein, 34 aa, Artificial Sequence
  Description of Artificial Sequence: Synthetic polypeptide
DEEEIRTTNPVATEQYGQCVCSWEEHQFSGSEQA

SEQ ID NO: 131412 - protein, 37 aa, Artificial Sequence
  Description of Artificial Sequence: Synthetic polypeptide
AEEEIRTTNPVATEQYGSVSTVNTDGGNGNQLNGNDD

SEQ ID NO: 131413 - protein, 36 aa, Artificial Sequence
  Description of Artificial Sequence: Synthetic polypeptide
DEEEIRTTNPVATNQYGSVSSTTPAGPNMRNGMNPV

SEQ ID NO: 131414 - protein, 36 aa, Artificial Sequence
  Description of Artificial Sequence: Synthetic polypeptide
DEEEIRTTNPVATNQYGSVSWTTPAGPNMRNGMNPV

SEQ ID NO: 131415 - protein, 32 aa, Artificial Sequence
  Description of Artificial Sequence: Synthetic polypeptide
DDEEISTTNPVATEQWGCVTSWELQNFGSEQN

SEQ ID NO: 131416 - protein, 36 aa, Artificial Sequence
  Description of Artificial Sequence: Synthetic polypeptide
AEEEIRTTNPVATEQYGSVSTVNQQQSNNNGDEMED

SEQ ID NO: 131417 - protein, 34 aa, Artificial Sequence
  Description of Artificial Sequence: Synthetic polypeptide
DEEEIRTTNPVATEQYGQCVCSWGAHQNFGSDQA

SEQ ID NO: 131418 - protein, 35 aa, Artificial Sequence
  Description of Artificial Sequence: Synthetic polypeptide
DEEEIRTTNPVATEQYGQCVCSWGAHQENFGSNQS

SEQ ID NO: 131419 - protein, 36 aa, Artificial Sequence
  Description of Artificial Sequence: Synthetic polypeptide
DEEEIRTTNPVATQQYGSVSSTTPAGPNHRNGMNPV

SEQ ID NO: 131420 - protein, 35 aa, Artificial Sequence
  Description of Artificial Sequence: Synthetic polypeptide
DEEEIRTTNPVATEQYGQCVCSWENHQEHFGSEQS

SEQ ID NO: 131421 - protein, 34 aa, Artificial Sequence
  Description of Artificial Sequence: Synthetic polypeptide
DEEEIRTTNPVATEQYGQCVCSWEHNQNFNSDQA

SEQ ID NO: 131422 - protein, 36 aa, Artificial Sequence
  Description of Artificial Sequence: Synthetic polypeptide
DEEEIRTTNPVATQQYGSVSSTTPAGPNMRNGMNPV

SEQ ID NO: 131423 - protein, 36 aa, Artificial Sequence
  Description of Artificial Sequence: Synthetic polypeptide
DEEEIRTTNPVATQQYGSVSSTTPAGPNMRNGTNPV

SEQ ID NO: 131424 - protein, 35 aa, Artificial Sequence
  Description of Artificial Sequence: Synthetic polypeptide
DEEEIRTTNPVATEQYGQCVCSWEHNQNFGSENQS

SEQ ID NO: 131425 - protein, 35 aa, Artificial Sequence
  Description of Artificial Sequence: Synthetic polypeptide
DEEEIRTTNPVATEQYGQCVCSWEHNQNFGSENQA

SEQ ID NO: 131426 - protein, 34 aa, Artificial Sequence
  Description of Artificial Sequence: Synthetic polypeptide
DEEEIRTTNPVATEQYGQCVCSWEHNQHFNSDQS

SEQ ID NO: 131427 - protein, 34 aa, Artificial Sequence
  Description of Artificial Sequence: Synthetic polypeptide
DEESIMTTNPVATECYGSVFNTNTLTQPEGQFMG

SEQ ID NO: 131428 - protein, 35 aa, Artificial Sequence
  Description of Artificial Sequence: Synthetic polypeptide
DEEEIRTTNPVATEQYGQCVCSWEHNQFFGSDNQS

SEQ ID NO: 131429 - protein, 36 aa, Artificial Sequence
  Description of Artificial Sequence: Synthetic polypeptide
DEEEIRTTNPVATRQYGSVSSTTPAGPNMRNGMNPV

SEQ ID NO: 131430 - protein, 34 aa, Artificial Sequence
  Description of Artificial Sequence: Synthetic polypeptide
DEEEIRTTNPVATEQYGQCVCSWEETQNFNSQQA

SEQ ID NO: 131431 - protein, 35 aa, Artificial Sequence
  Description of Artificial Sequence: Synthetic polypeptide
DEEEIRTTNPVATEQYGQCVCSWEELQNFGSDTQA

SEQ ID NO: 131432 - protein, 37 aa, Artificial Sequence
  Description of Artificial Sequence: Synthetic polypeptide
AEEEIRTTNPVATEQYGSVSTVNQQGNNSDEGNNQSD

SEQ ID NO: 131433 - protein, 37 aa, Artificial Sequence
  Description of Artificial Sequence: Synthetic polypeptide
AEEEIRTTNPVATEQYGSVSTVNNQQNQNDEGGNNND

SEQ ID NO: 131434 - protein, 37 aa, Artificial Sequence
  Description of Artificial Sequence: Synthetic polypeptide
AEEEIRTTNPVATEQYGSVSTVNTDGGNNQLGGNEDA

SEQ ID NO: 131435 - protein, 37 aa, Artificial Sequence
  Description of Artificial Sequence: Synthetic polypeptide
AEEEIRTTNPVATEQYGSVSTVNNQQNQGEEGTNNND

SEQ ID NO: 131436 - protein, 36 aa, Artificial Sequence
  Description of Artificial Sequence: Synthetic polypeptide
DEEEIRTTNPVATWQYGSVSSTTPAGPNMRNGMNPV

SEQ ID NO: 131437 - protein, 35 aa, Artificial Sequence
  Description of Artificial Sequence: Synthetic polypeptide
DEEEIRTTNPVATEQYGQCVCSTGEPNQNFGSDQA

SEQ ID NO: 131438 - protein, 33 aa, Artificial Sequence
  Description of Artificial Sequence: Synthetic polypeptide
DEAEIACTNPVATEQYGSCATGVDQNQMPGNDR

SEQ ID NO: 131439 - protein, 35 aa, Artificial Sequence
  Description of Artificial Sequence: Synthetic polypeptide
DEEEIRTTNPVATEQYGQCVCSTGEPHQNFGSQQA

SEQ ID NO: 131440 - protein, 34 aa, Artificial Sequence
  Description of Artificial Sequence: Synthetic polypeptide
DEESIATTNPVATEQYGCSNAATANPLQAPMENN

SEQ ID NO: 131441 - protein, 33 aa, Artificial Sequence
  Description of Artificial Sequence: Synthetic polypeptide
DEESIATTNPVATEQWGSVAITNNLENGMGVGD

SEQ ID NO: 131442 - protein, 32 aa, Artificial Sequence
  Description of Artificial Sequence: Synthetic polypeptide
DEESIATTNPVATEQWGCVAGMNNDQEAGHNH

SEQ ID NO: 131443 - protein, 37 aa, Artificial Sequence
  Description of Artificial Sequence: Synthetic polypeptide
AEEEIRTTNPVATEQYGSVSTVNNNLEQNENGETEED

SEQ ID NO: 131444 - protein, 37 aa, Artificial Sequence
  Description of Artificial Sequence: Synthetic polypeptide
AEEEIRTTNPVATEQYGSVSTVNNNLEQGTEEGTTEE

SEQ ID NO: 131445 - protein, 37 aa, Artificial Sequence
  Description of Artificial Sequence: Synthetic polypeptide
AEEEIRTTNPVATEQYGSVSTVNNNLEQGTDENTEED

SEQ ID NO: 131446 - protein, 34 aa, Artificial Sequence
  Description of Artificial Sequence: Synthetic polypeptide
DEEEIRTTNPVATEQYGQCVCSTGETINFNSNQN

SEQ ID NO: 131447 - protein, 37 aa, Artificial Sequence
  Description of Artificial Sequence: Synthetic polypeptide
AEEEIRTTNPVATEQYGSVSTVNNNLEQGENGSTEDE

SEQ ID NO: 131448 - protein, 36 aa, Artificial Sequence
  Description of Artificial Sequence: Synthetic polypeptide
AEEEIRTTNPVATEQYGSVSTVNNNEQGTTTNNEET

SEQ ID NO: 131449 - protein, 36 aa, Artificial Sequence
  Description of Artificial Sequence: Synthetic polypeptide
AEEEIRTTNPVATEQYGSVSTVNNNEQGTNQQNENQ

SEQ ID NO: 131450 - protein, 36 aa, Artificial Sequence
  Description of Artificial Sequence: Synthetic polypeptide
AEEEIRTTNPVATEQYGSVSTVNNNEQGTNQQDEEA

SEQ ID NO: 131451 - protein, 35 aa, Artificial Sequence
  Description of Artificial Sequence: Synthetic polypeptide
DEESIATTNPVATECYGSVYNWTNDHQQQREGNDM

SEQ ID NO: 131452 - protein, 36 aa, Artificial Sequence
  Description of Artificial Sequence: Synthetic polypeptide
AEEEIRTTNPVATEQYGSVSTVNNNEQGTNNTEEET

SEQ ID NO: 131453 - protein, 35 aa, Artificial Sequence
  Description of Artificial Sequence: Synthetic polypeptide
DEEEIRTTNPVATEQYGQCVCSTGEHQEGFGSQQN

SEQ ID NO: 131454 - protein, 36 aa, Artificial Sequence
  Description of Artificial Sequence: Synthetic polypeptide
AEEEIRTTNPVATEQYGSVSTVNNNEQGTNNNDETN

SEQ ID NO: 131455 - protein, 36 aa, Artificial Sequence
  Description of Artificial Sequence: Synthetic polypeptide
AEEEIRTTNPVATEQYGSVSTVNNNEQGTNNATELF

SEQ ID NO: 131456 - protein, 36 aa, Artificial Sequence
  Description of Artificial Sequence: Synthetic polypeptide
DEEEIRTTNPVATEQYGQCVCSTGEHNQNFGSENQL

SEQ ID NO: 131457 - protein, 36 aa, Artificial Sequence
  Description of Artificial Sequence: Synthetic polypeptide
AEEEIRTTNPVATEQYGSVSTVNNNEQLGETEETEE

SEQ ID NO: 131458 - protein, 34 aa, Artificial Sequence
  Description of Artificial Sequence: Synthetic polypeptide
DDEEISTTNPVATEQYGCVCSNWELQNFGSENQS

SEQ ID NO: 131459 - protein, 36 aa, Artificial Sequence
  Description of Artificial Sequence: Synthetic polypeptide
DEEEIRTTNPVATEQYGQCVCSTGETNQENFGSNQT

SEQ ID NO: 131460 - protein, 36 aa, Artificial Sequence
  Description of Artificial Sequence: Synthetic polypeptide
DEEEIRTTNPVATEQYGQCVCSTGNHNQNFNSEFQF

SEQ ID NO: 131461 - protein, 36 aa, Artificial Sequence
  Description of Artificial Sequence: Synthetic polypeptide
DEEEIRTTNPVATEQYGQCVCSTTGEDHQNFGSNAS

SEQ ID NO: 131462 - protein, 34 aa, Artificial Sequence
  Description of Artificial Sequence: Synthetic polypeptide
DEEEIRTTNPVATEQYGQCVCSTPEHEGFGSDQS

SEQ ID NO: 131463 - protein, 36 aa, Artificial Sequence
  Description of Artificial Sequence: Synthetic polypeptide
DEEEIRGTNPVATEQYGSVTSGNMTDQGQEGGNNDD

SEQ ID NO: 131464 - protein, 37 aa, Artificial Sequence
  Description of Artificial Sequence: Synthetic polypeptide
AEEEIRTTNPVATEQYGSVSTVNNQGNNQDEGTNQDD

SEQ ID NO: 131465 - protein, 37 aa, Artificial Sequence
  Description of Artificial Sequence: Synthetic polypeptide
AEEEIRTTNPVATEQYGSVSTVNNQAGNQQQATNNNE

SEQ ID NO: 131466 - protein, 37 aa, Artificial Sequence
  Description of Artificial Sequence: Synthetic polypeptide
AEEEIRTTNPVATEQYGSVSTVNNNQQQQTNGNNDEN

SEQ ID NO: 131467 - protein, 36 aa, Artificial Sequence
  Description of Artificial Sequence: Synthetic polypeptide
AEEEIRTTNPVATEQYGSVSTVNNNQQQNDENNNNE

SEQ ID NO: 131468 - protein, 36 aa, Artificial Sequence
  Description of Artificial Sequence: Synthetic polypeptide
DEEEIRTTNPVATYQYGSVSGTTPAGPNMRNGMNPV

SEQ ID NO: 131469 - protein, 36 aa, Artificial Sequence
  Description of Artificial Sequence: Synthetic polypeptide
DEEEIRTTNPVATYQYGSVSSETPAGPNMRNGMNPV

SEQ ID NO: 131470 - protein, 35 aa, Artificial Sequence
  Description of Artificial Sequence: Synthetic polypeptide
DEEEIRTTNPVATEQYGQCVCSTNEHQENFDSEQA

SEQ ID NO: 131471 - protein, 37 aa, Artificial Sequence
  Description of Artificial Sequence: Synthetic polypeptide
AEEEIRTTNPVATEQYGSVSTVNNNQNNQNDEGTNVE

SEQ ID NO: 131472 - protein, 38 aa, Artificial Sequence
  Description of Artificial Sequence: Synthetic polypeptide
AEEEIRTTNPVATEQYGSVSTVNNNQLGNQQAGNNQGD

SEQ ID NO: 131473 - protein, 37 aa, Artificial Sequence
  Description of Artificial Sequence: Synthetic polypeptide
AEEEIRTTNPVATEQYGSVSTVNNNQLGNEQGTNDEQ

SEQ ID NO: 131474 - protein, 35 aa, Artificial Sequence
  Description of Artificial Sequence: Synthetic polypeptide
DEEEIRTTNPVATEQYGQCVCSTNAHQENFMSQQA

SEQ ID NO: 131475 - protein, 36 aa, Artificial Sequence
  Description of Artificial Sequence: Synthetic polypeptide
DEEEIRTTNPVATYQYGSVSSTTKAGPNMRNGMNPV

SEQ ID NO: 131476 - protein, 37 aa, Artificial Sequence
  Description of Artificial Sequence: Synthetic polypeptide
AEEEIRTTNPVATEQYGSVSTVNNNNQQEEEGTNGTQ

SEQ ID NO: 131477 - protein, 32 aa, Artificial Sequence
  Description of Artificial Sequence: Synthetic polypeptide
DEESIATTNPVAYECWGSVYNWTNDQQREGHD

SEQ ID NO: 131478 - protein, 36 aa, Artificial Sequence
  Description of Artificial Sequence: Synthetic polypeptide
DEEEIRTTNPVATYQYGSVSSTTMAGPNMRNGMNPV

SEQ ID NO: 131479 - protein, 35 aa, Artificial Sequence
  Description of Artificial Sequence: Synthetic polypeptide
DEEEIRTTNPVATEQYGQCVCSTMEHDQNFGSDQS

SEQ ID NO: 131480 - protein, 35 aa, Artificial Sequence
  Description of Artificial Sequence: Synthetic polypeptide
DEEEIRTTNPVATEQYGQCVCSTGPDHQFFNSDQS

SEQ ID NO: 131481 - protein, 36 aa, Artificial Sequence
  Description of Artificial Sequence: Synthetic polypeptide
DEEEIRTTNPVATYQYGSVSSTTPAGPNMRNGMNPV

SEQ ID NO: 131482 - protein, 36 aa, Artificial Sequence
  Description of Artificial Sequence: Synthetic polypeptide
DEEEIRTTNPVATWQYGSVSSTTPAGHNMRNGMNPV

SEQ ID NO: 131483 - protein, 35 aa, Artificial Sequence
  Description of Artificial Sequence: Synthetic polypeptide
DEEEIRTTNPVATEQYGQCVCSTGEHNQGFGSDQM

SEQ ID NO: 131484 - protein, 36 aa, Artificial Sequence
  Description of Artificial Sequence: Synthetic polypeptide
AEEEIRTTNPVATEQYGSVSTVNTNDESGTVNNVTN

SEQ ID NO: 131485 - protein, 37 aa, Artificial Sequence
  Description of Artificial Sequence: Synthetic polypeptide
AEEEIRTTNPVATEQYGSVSTVNTNLEQGTTEENEEE

SEQ ID NO: 131486 - protein, 34 aa, Artificial Sequence
  Description of Artificial Sequence: Synthetic polypeptide
DEEEIRGTNPVATEQYGSVSVFVQHDVVSAVSRN

SEQ ID NO: 131487 - protein, 33 aa, Artificial Sequence
  Description of Artificial Sequence: Synthetic polypeptide
DEEEIRGTNPVATEQYGSVSVVQHDAHGAESTN

SEQ ID NO: 131488 - protein, 34 aa, Artificial Sequence
  Description of Artificial Sequence: Synthetic polypeptide
DEETICTTNPVATEAYGSVATTVNTQQGTEENEM

SEQ ID NO: 131489 - protein, 34 aa, Artificial Sequence
  Description of Artificial Sequence: Synthetic polypeptide
DEAEIACTNPVATEQYGSVCAANNLQETDDNARG

SEQ ID NO: 131490 - protein, 37 aa, Artificial Sequence
  Description of Artificial Sequence: Synthetic polypeptide
AEEEIRTTNPVATEQYGSVSTVQNQNLGNDEGNNVEE

SEQ ID NO: 131491 - protein, 35 aa, Artificial Sequence
  Description of Artificial Sequence: Synthetic polypeptide
SEEEIATTNPVATEQYGSVAITNNDEQTGEQNDQQ

SEQ ID NO: 131492 - protein, 34 aa, Artificial Sequence
  Description of Artificial Sequence: Synthetic polypeptide
DEEEIRTTNPVATEQYGQCVCSWNHIENFGSEQS

SEQ ID NO: 131493 - protein, 32 aa, Artificial Sequence
  Description of Artificial Sequence: Synthetic polypeptide
DEETIATTNPVATEFYGQVVNIMNGQGGDNDE

SEQ ID NO: 131494 - protein, 32 aa, Artificial Sequence
  Description of Artificial Sequence: Synthetic polypeptide
DEETIATTNPVATECYGSVPEPVIGLQIGALH

SEQ ID NO: 131495 - protein, 36 aa, Artificial Sequence
  Description of Artificial Sequence: Synthetic polypeptide
AEEEIRTTNPVATEQYGSVSTVQQLQQTNATNVATE

SEQ ID NO: 131496 - protein, 33 aa, Artificial Sequence
  Description of Artificial Sequence: Synthetic polypeptide
SEEEIATTNPVATEQYGSVANPNDPAEANPERQ

SEQ ID NO: 131497 - protein, 33 aa, Artificial Sequence
  Description of Artificial Sequence: Synthetic polypeptide
DDEEISTTNPVATEGYGCVCSTEELQNFGSEQV

SEQ ID NO: 131498 - protein, 36 aa, Artificial Sequence
  Description of Artificial Sequence: Synthetic polypeptide
DEEEIRTTNPVATMQYGSVSSTTPAGPNMRNGMNPV

SEQ ID NO: 131499 - protein, 37 aa, Artificial Sequence
  Description of Artificial Sequence: Synthetic polypeptide
AEEEIRTTNPVATEQYGSVSTVQNNQAGSEEGTNVEE

SEQ ID NO: 131500 - protein, 32 aa, Artificial Sequence
  Description of Artificial Sequence: Synthetic polypeptide
DEETEIATTNPVAYERWGEVSTNLNGDTGDTS

SEQ ID NO: 131501 - protein, 36 aa, Artificial Sequence
  Description of Artificial Sequence: Synthetic polypeptide
DEEEIRTTNPVATMQYGSVSSTTPAGPNRRNGMNPV

SEQ ID NO: 131502 - protein, 36 aa, Artificial Sequence
  Description of Artificial Sequence: Synthetic polypeptide
DEEEIRTTNPVATMQYGSVSSTTPAHPNMRNGMNPV

SEQ ID NO: 131503 - protein, 35 aa, Artificial Sequence
  Description of Artificial Sequence: Synthetic polypeptide
DEEEIRTTNPVATEQYGQCVCSWGNHQNFGSDTQL

SEQ ID NO: 131504 - protein, 32 aa, Artificial Sequence
  Description of Artificial Sequence: Synthetic polypeptide
DEAEIACTNPVATEQYGSVATTNLTHPMDEPL

SEQ ID NO: 131505 - protein, 33 aa, Artificial Sequence
  Description of Artificial Sequence: Synthetic polypeptide
DEETEIATTNPVAYEQWGSVSGGNGNSGNEGNA

SEQ ID NO: 131506 - protein, 37 aa, Artificial Sequence
  Description of Artificial Sequence: Synthetic polypeptide
AEEEIRTTNPVATEQYGSVSTVQNNQQASEEGTNVEY

SEQ ID NO: 131507 - protein, 36 aa, Artificial Sequence
  Description of Artificial Sequence: Synthetic polypeptide
DEEEIRGTNPVATEQYGSVSSTTPYGPNMVNGMNPV

SEQ ID NO: 131508 - protein, 33 aa, Artificial Sequence
  Description of Artificial Sequence: Synthetic polypeptide
SEEEIATTNPVATEQYGSCPATHLEAPDDQGGR

SEQ ID NO: 131509 - protein, 35 aa, Artificial Sequence
  Description of Artificial Sequence: Synthetic polypeptide
SEEEIATTNPVATEQYGSACATNPLQPDAQMGDNV

SEQ ID NO: 131510 - protein, 34 aa, Artificial Sequence
  Description of Artificial Sequence: Synthetic polypeptide
DEETICTTNPVATEGYGSVVTGNTGEQDEDGGNI

SEQ ID NO: 131511 - protein, 34 aa, Artificial Sequence
  Description of Artificial Sequence: Synthetic polypeptide
SEEEIATTNPVATEMWGSVSATANLENNASNSRV

SEQ ID NO: 131512 - protein, 32 aa, Artificial Sequence
  Description of Artificial Sequence: Synthetic polypeptide
SEEEIATTNPVATEQWGSVAANNTEGDGNSKD

SEQ ID NO: 131513 - protein, 34 aa, Artificial Sequence
  Description of Artificial Sequence: Synthetic polypeptide
SEEEIATTNPVATEQWGSVAITNNDEQTGEQNDA

SEQ ID NO: 131514 - protein, 37 aa, Artificial Sequence
  Description of Artificial Sequence: Synthetic polypeptide
AEEEIRTTNPVATEQYGSVSTVQQQLQEGTEQGNVAE

SEQ ID NO: 131515 - protein, 33 aa, Artificial Sequence
  Description of Artificial Sequence: Synthetic polypeptide
SEEEIATTNPVATEQWGSVSGQGNPPQNHVNDS

SEQ ID NO: 131516 - protein, 33 aa, Artificial Sequence
  Description of Artificial Sequence: Synthetic polypeptide
SEEEIATTNPVATEQWGSVSQENPLNHAGPQDN

SEQ ID NO: 131517 - protein, 36 aa, Artificial Sequence
  Description of Artificial Sequence: Synthetic polypeptide
AEEEIRTTNPVATEQYGSVSTVQQQLGNDEGTNVEQ

SEQ ID NO: 131518 - protein, 31 aa, Artificial Sequence
  Description of Artificial Sequence: Synthetic polypeptide
SEEEIATTNPVATEQYGCAPMNHGQDSEGED

SEQ ID NO: 131519 - protein, 36 aa, Artificial Sequence
  Description of Artificial Sequence: Synthetic polypeptide
DEEEIRGTNPVATEQYGSVQCTESGEIENLSMGMRL

SEQ ID NO: 131520 - protein, 29 aa, Artificial Sequence
  Description of Artificial Sequence: Synthetic peptide
SEEEIATTNPVATEQYGEALPEVCQHEEK

SEQ ID NO: 131521 - protein, 29 aa, Artificial Sequence
  Description of Artificial Sequence: Synthetic peptide
SEEEIATTNPVATEQYGEAPEVCQHEEKE

SEQ ID NO: 131522 - protein, 33 aa, Artificial Sequence
  Description of Artificial Sequence: Synthetic polypeptide
DEEEIRGTNPVATEQYGSVSDPVGQIETMVQTV

SEQ ID NO: 131523 - protein, 34 aa, Artificial Sequence
  Description of Artificial Sequence: Synthetic polypeptide
DEETICTTNPVATEFYGSVNMTDNQGEQGEGGNI

SEQ ID NO: 131524 - protein, 34 aa, Artificial Sequence
  Description of Artificial Sequence: Synthetic polypeptide
DEETICTTNPVATEFYGSVNMTDNNFEQDEGGNI

SEQ ID NO: 131525 - protein, 34 aa, Artificial Sequence
  Description of Artificial Sequence: Synthetic polypeptide
DEEEIRGTNPVATEQYGSVSETGNDINPTSAVEN

SEQ ID NO: 131526 - protein, 28 aa, Artificial Sequence
  Description of Artificial Sequence: Synthetic peptide
SEEEIATTNPVATEQYGEAPEVCYHEEK

SEQ ID NO: 131527 - protein, 36 aa, Artificial Sequence
  Description of Artificial Sequence: Synthetic polypeptide
DEEEIRGTNPVATEQYGSVSSTTPAGPNMRNGMNPP

SEQ ID NO: 131528 - protein, 29 aa, Artificial Sequence
  Description of Artificial Sequence: Synthetic peptide
SEEEIATTNPVATEQYGEAPWADQHEEQA

SEQ ID NO: 131529 - protein, 36 aa, Artificial Sequence
  Description of Artificial Sequence: Synthetic polypeptide
DEEEIRGTNPVATEQYGSVSSTTPAGPNMRNGMNPV

SEQ ID NO: 131530 - protein, 36 aa, Artificial Sequence
  Description of Artificial Sequence: Synthetic polypeptide
DEEEIRGTNPVATEQYGSVSSTTPDGPNMGNGENDI

SEQ ID NO: 131531 - protein, 37 aa, Artificial Sequence
  Description of Artificial Sequence: Synthetic polypeptide
AEEEIRTTNPVATEQYGSVSTVQNNQAGNDEGNNVEE

SEQ ID NO: 131532 - protein, 36 aa, Artificial Sequence
  Description of Artificial Sequence: Synthetic polypeptide
DEEEIRTTNPVATEQYGQCVCSWGEDLQHFGSENQS

SEQ ID NO: 131533 - protein, 34 aa, Artificial Sequence
  Description of Artificial Sequence: Synthetic polypeptide
DEEEIRTTNPVATEQYGQCVCSWGEPQFFGSDQA

SEQ ID NO: 131534 - protein, 37 aa, Artificial Sequence
  Description of Artificial Sequence: Synthetic polypeptide
AEEEIRTTNPVATEQYGSVSTVQNLLQEGTEQGTVAE

SEQ ID NO: 131535 - protein, 34 aa, Artificial Sequence
  Description of Artificial Sequence: Synthetic polypeptide
DEESIRTTNPVAYEAYGTTPSYTAEHSQRGGNRM

SEQ ID NO: 131536 - protein, 33 aa, Artificial Sequence
  Description of Artificial Sequence: Synthetic polypeptide
SEEEIATTNPVATEQYGSVCAATNPLHDSLDHM

SEQ ID NO: 131537 - protein, 36 aa, Artificial Sequence
  Description of Artificial Sequence: Synthetic polypeptide
AEEEIRTTNPVATEQYGSVSTVNTQLGSEEGTTEDE

SEQ ID NO: 131538 - protein, 34 aa, Artificial Sequence
  Description of Artificial Sequence: Synthetic polypeptide
SEEEIATTNPVATEQYGSVCAGTEPGAVAGIDNR

SEQ ID NO: 131539 - protein, 35 aa, Artificial Sequence
  Description of Artificial Sequence: Synthetic polypeptide
SEEEIATTNPVATEQYGSVCAMTEGGAVAQIGDNR

SEQ ID NO: 131540 - protein, 35 aa, Artificial Sequence
  Description of Artificial Sequence: Synthetic polypeptide
SEEEIATTNPVATEQYGSVCAQNGLEQTDDGGVNL

SEQ ID NO: 131541 - protein, 36 aa, Artificial Sequence
  Description of Artificial Sequence: Synthetic polypeptide
DEESIRTTNPVATEQYGSVSSTTPAGPNMRNGMNPV

SEQ ID NO: 131542 - protein, 33 aa, Artificial Sequence
  Description of Artificial Sequence: Synthetic polypeptide
SEEEIATTNPVATEQYGSVCATNNLHDSLMDHM

SEQ ID NO: 131543 - protein, 33 aa, Artificial Sequence
  Description of Artificial Sequence: Synthetic polypeptide
SEEEIATTNPVATEQYGSVCATNNLNDSLADHQ

SEQ ID NO: 131544 - protein, 34 aa, Artificial Sequence
  Description of Artificial Sequence: Synthetic polypeptide
DEESIRTTNPVAYEGYGSTVNTLGNFSQQRSNNE

SEQ ID NO: 131545 - protein, 33 aa, Artificial Sequence
  Description of Artificial Sequence: Synthetic polypeptide
SEEEIATTNPVATEQYGSVCATNPLHDSLADHA

SEQ ID NO: 131546 - protein, 36 aa, Artificial Sequence
  Description of Artificial Sequence: Synthetic polypeptide
SEEEIATTNPVATEQYGSVCATNPLPQEHQDGNAHQ

SEQ ID NO: 131547 - protein, 36 aa, Artificial Sequence
  Description of Artificial Sequence: Synthetic polypeptide
SEEEIATTNPVATEQYGSVCATNPQLNPDDQMGDRA

SEQ ID NO: 131548 - protein, 33 aa, Artificial Sequence
  Description of Artificial Sequence: Synthetic polypeptide
SEEEIATTNPVATEQYGSVCAVTNNLHDSLDHQ

SEQ ID NO: 131549 - protein, 37 aa, Artificial Sequence
  Description of Artificial Sequence: Synthetic polypeptide
AEEEIRTTNPVATEQYGSVSTVNTQGGNQNQEGGNDD

SEQ ID NO: 131550 - protein, 37 aa, Artificial Sequence
  Description of Artificial Sequence: Synthetic polypeptide
AEEEIRTTNPVATEQYGSVSTVNTQGGNNQLGGNDDT

SEQ ID NO: 131551 - protein, 36 aa, Artificial Sequence
  Description of Artificial Sequence: Synthetic polypeptide
AEEEIRTTNPVATEQYGSVSTVNTNQQGEEEEEEEG

SEQ ID NO: 131552 - protein, 36 aa, Artificial Sequence
  Description of Artificial Sequence: Synthetic polypeptide
DEEEIRTTNPVATNQYGSVSSTTPADPNMRNGMNPV

SEQ ID NO: 131553 - protein, 37 aa, Artificial Sequence
  Description of Artificial Sequence: Synthetic polypeptide
AEEEIRTTNPVATEQYGSVSTVNTNPNNQEDEGTNVE

SEQ ID NO: 131554 - protein, 36 aa, Artificial Sequence
  Description of Artificial Sequence: Synthetic polypeptide
DEEEIRTTNPVATNQYGSVSSTTPAGKNMRNGMNPV

SEQ ID NO: 131555 - protein, 33 aa, Artificial Sequence
  Description of Artificial Sequence: Synthetic polypeptide
SEEEIATTNPVATEQYGSVCATNPLHDSSEHHL

SEQ ID NO: 131556 - protein, 34 aa, Artificial Sequence
  Description of Artificial Sequence: Synthetic polypeptide
SEEEIATTNPVATEQYGSVCAANNLDEAGNNVHH

SEQ ID NO: 131557 - protein, 34 aa, Artificial Sequence
  Description of Artificial Sequence: Synthetic polypeptide
DEESIRTTNPVAYEGYGSTVNTTGNGSQERSSNE

SEQ ID NO: 131558 - protein, 34 aa, Artificial Sequence
  Description of Artificial Sequence: Synthetic polypeptide
DEESIRTTNPVAYENYGSTVNTTGNGSGQRSNNE

SEQ ID NO: 131559 - protein, 34 aa, Artificial Sequence
  Description of Artificial Sequence: Synthetic polypeptide
DEEEIRTTNPVATEQYGQCVCSWGEHQNFGSQQV

SEQ ID NO: 131560 - protein, 34 aa, Artificial Sequence
  Description of Artificial Sequence: Synthetic polypeptide
DEEEIRTTNPVATEQYGQCVCSWGEHQNFGSDDG

SEQ ID NO: 131561 - protein, 37 aa, Artificial Sequence
  Description of Artificial Sequence: Synthetic polypeptide
AEEEIRTTNPVATEQYGSVSTVQNGNQQQGTEENEQE

SEQ ID NO: 131562 - protein, 37 aa, Artificial Sequence
  Description of Artificial Sequence: Synthetic polypeptide
AEEEIRTTNPVATEQYGSVSTVQNGNQQQGNNNNQQE

SEQ ID NO: 131563 - protein, 37 aa, Artificial Sequence
  Description of Artificial Sequence: Synthetic polypeptide
AEEEIRTTNPVATEQYGSVSTVQNGNQQNGTNPNEQE

SEQ ID NO: 131564 - protein, 37 aa, Artificial Sequence
  Description of Artificial Sequence: Synthetic polypeptide
AEEEIRTTNPVATEQYGSVSTVQNGNQQIGTEENTTE

SEQ ID NO: 131565 - protein, 33 aa, Artificial Sequence
  Description of Artificial Sequence: Synthetic polypeptide
DEAEIACTNPVATEQYGSVATNLTQNPDDQDGM

SEQ ID NO: 131566 - protein, 34 aa, Artificial Sequence
  Description of Artificial Sequence: Synthetic polypeptide
DEEEIRTTNPVATEQYGQCVCSWGEHQFFGSDQE

SEQ ID NO: 131567 - protein, 37 aa, Artificial Sequence
  Description of Artificial Sequence: Synthetic polypeptide
AEEEIRTTNPVATEQYGSVSTVQNGNQQAGTNGNNQE

SEQ ID NO: 131568 - protein, 35 aa, Artificial Sequence
  Description of Artificial Sequence: Synthetic polypeptide
DEESIRTTNPVAYEQYRGSTVNTTGNGSVQRSNNE

SEQ ID NO: 131569 - protein, 37 aa, Artificial Sequence
  Description of Artificial Sequence: Synthetic polypeptide
AEEEIRTTNPVATEQYGSVSTVQLNQNGNNEGNNVED

SEQ ID NO: 131570 - protein, 35 aa, Artificial Sequence
  Description of Artificial Sequence: Synthetic polypeptide
DEESIRTTNPVAYEQYGSTVQNTTGNGSVQRSNNN

SEQ ID NO: 131571 - protein, 37 aa, Artificial Sequence
  Description of Artificial Sequence: Synthetic polypeptide
AEEEIRTTNPVATEQYGSVSTVQGNQQASEQGTNVEE

SEQ ID NO: 131572 - protein, 34 aa, Artificial Sequence
  Description of Artificial Sequence: Synthetic polypeptide
DEESIRTTNPVAYEQYGSTVNTTGNGSQYPSSNE

SEQ ID NO: 131573 - protein, 35 aa, Artificial Sequence
  Description of Artificial Sequence: Synthetic polypeptide
DEESIRTTNPVAYEQYGSTVNTTGNGSQYDSNNER

SEQ ID NO: 131574 - protein, 36 aa, Artificial Sequence
  Description of Artificial Sequence: Synthetic polypeptide
AEEEIRTTNPVATEQYGSVSTVQGNQNGNDEGNNVE

SEQ ID NO: 131575 - protein, 36 aa, Artificial Sequence
  Description of Artificial Sequence: Synthetic polypeptide
AEEEIRTTNPVATEQYGSVSTVQAGNQEQGNNNDDE

SEQ ID NO: 131576 - protein, 38 aa, Artificial Sequence
  Description of Artificial Sequence: Synthetic polypeptide
AEEEIRTTNPVATEQYGSVSTVNTTNQLGNQQGNNQGD

SEQ ID NO: 131577 - protein, 35 aa, Artificial Sequence
  Description of Artificial Sequence: Synthetic polypeptide
DEEEIRTTNPVATEQYGQCVCSWGEHNQNFGSNQA

SEQ ID NO: 131578 - protein, 37 aa, Artificial Sequence
  Description of Artificial Sequence: Synthetic polypeptide
AEEEIRTTNPVATEQYGSVSTVNTTNLQSGTTDTETD

SEQ ID NO: 131579 - protein, 33 aa, Artificial Sequence
  Description of Artificial Sequence: Synthetic polypeptide
SEEEIATTNPVATEQYGSVCAAGGLDEDNDNRM

SEQ ID NO: 131580 - protein, 35 aa, Artificial Sequence
  Description of Artificial Sequence: Synthetic polypeptide
DEEEIRTTNPVATEQYGQCVCSWGELNQNFGSEQS

SEQ ID NO: 131581 - protein, 35 aa, Artificial Sequence
  Description of Artificial Sequence: Synthetic polypeptide
DEEEIRTTNPVATEQYGQCVVSTNDEVNGTDQIDE

SEQ ID NO: 131582 - protein, 35 aa, Artificial Sequence
  Description of Artificial Sequence: Synthetic polypeptide
DEEEIRTTNPVATEQYGQCVCSTGEHNQGFGSDQA

SEQ ID NO: 131583 - protein, 36 aa, Artificial Sequence
  Description of Artificial Sequence: Synthetic polypeptide
DEEEIRTTNPVAVEQYGSVSETNKHSSEGPMGSDRN

SEQ ID NO: 131584 - protein, 37 aa, Artificial Sequence
  Description of Artificial Sequence: Synthetic polypeptide
AEEEIRTTNPVATEQYGSVSTVDNGNQEIGTNPNQQE

SEQ ID NO: 131585 - protein, 36 aa, Artificial Sequence
  Description of Artificial Sequence: Synthetic polypeptide
AEEEIRTTNPVATEQYGSVSTVDNGNNSEEGNNQII

SEQ ID NO: 131586 - protein, 33 aa, Artificial Sequence
  Description of Artificial Sequence: Synthetic polypeptide
DDEEISTTNPVATEQYGCVCSWGELQHFGSEQA

SEQ ID NO: 131587 - protein, 36 aa, Artificial Sequence
  Description of Artificial Sequence: Synthetic polypeptide
AEEEIRTTNPVATEQYGSVSTVDNGNNAEEGNNQTD

SEQ ID NO: 131588 - protein, 36 aa, Artificial Sequence
  Description of Artificial Sequence: Synthetic polypeptide
AEEEIRTTNPVATEQYGSVSTVDNGNISEEGNNQGD

SEQ ID NO: 131589 - protein, 36 aa, Artificial Sequence
  Description of Artificial Sequence: Synthetic polypeptide
AEEEIRTTNPVATEQYGSVSTVDNGNGEEIGNNQIG

SEQ ID NO: 131590 - protein, 36 aa, Artificial Sequence
  Description of Artificial Sequence: Synthetic polypeptide
AEEEIRTTNPVATEQYGSVSTVDNGNGDEQGNNQED

SEQ ID NO: 131591 - protein, 36 aa, Artificial Sequence
  Description of Artificial Sequence: Synthetic polypeptide
AEEEIRTTNPVATEQYGSVSTVDENGNSEEGNNQED

SEQ ID NO: 131592 - protein, 36 aa, Artificial Sequence
  Description of Artificial Sequence: Synthetic polypeptide
AEEEIRTTNPVATEQYGSVSTVDDNGNSEQGNNQTD

SEQ ID NO: 131593 - protein, 35 aa, Artificial Sequence
  Description of Artificial Sequence: Synthetic polypeptide
DEEEIRTTNPVATEQYGQCVCSNTGEHQHSNSNQA

SEQ ID NO: 131594 - protein, 36 aa, Artificial Sequence
  Description of Artificial Sequence: Synthetic polypeptide
AEEEIRTTNPVATEQYGSVSTVANQQQANNNNNTTD

SEQ ID NO: 131595 - protein, 37 aa, Artificial Sequence
  Description of Artificial Sequence: Synthetic polypeptide
AEEEIRTTNPVATEQYGSVSTVANLSNANEQGTNNVE

SEQ ID NO: 131596 - protein, 37 aa, Artificial Sequence
  Description of Artificial Sequence: Synthetic polypeptide
AEEEIRTTNPVATEQYGSVSTVANLSNADEQGTNVEE

SEQ ID NO: 131597 - protein, 38 aa, Artificial Sequence
  Description of Artificial Sequence: Synthetic polypeptide
AEEEIRTTNPVATEQYGSVSTVANLQNGNEEQGNNNVE

SEQ ID NO: 131598 - protein, 36 aa, Artificial Sequence
  Description of Artificial Sequence: Synthetic polypeptide
DEEEIRTTNPVATEQYGQCVCSNTGEGHQNFGSNQP

SEQ ID NO: 131599 - protein, 37 aa, Artificial Sequence
  Description of Artificial Sequence: Synthetic polypeptide
AEEEIRTTNPVATEQYGSVSTVANGNQQNGTNNNQQE

SEQ ID NO: 131600 - protein, 37 aa, Artificial Sequence
  Description of Artificial Sequence: Synthetic polypeptide
AEEEIRTTNPVATEQYGSVSTVANGNNQDEQGTNNVD

SEQ ID NO: 131601 - protein, 37 aa, Artificial Sequence
  Description of Artificial Sequence: Synthetic polypeptide
AEEEIRTTNPVATEQYGSVSTTVTNNQNGDEAGNEDG

SEQ ID NO: 131602 - protein, 35 aa, Artificial Sequence
  Description of Artificial Sequence: Synthetic polypeptide
DEEEIRTTNPVATEQYGQCVCSNTEYPQHFNSDQS

SEQ ID NO: 131603 - protein, 35 aa, Artificial Sequence
  Description of Artificial Sequence: Synthetic polypeptide
DEEEIRTTNPVATEQYGQCVCSNTETNQSFGSEQS

SEQ ID NO: 131604 - protein, 37 aa, Artificial Sequence
  Description of Artificial Sequence: Synthetic polypeptide
AEEEIRTTNPVATEQYGSVSTVANQQNADEQGTNNVE

SEQ ID NO: 131605 - protein, 37 aa, Artificial Sequence
  Description of Artificial Sequence: Synthetic polypeptide
DEEEIRTTNPVATEQYGQCVCSNTGELEQGFGSDNQS

SEQ ID NO: 131606 - protein, 37 aa, Artificial Sequence
  Description of Artificial Sequence: Synthetic polypeptide
AEEEIRTTNPVATEQYGSVSTVDNGNQQIGTNNEQQE

SEQ ID NO: 131607 - protein, 37 aa, Artificial Sequence
  Description of Artificial Sequence: Synthetic polypeptide
AEEEIRTTNPVATEQYGSVSTVDNGNQQIGTNPNNQD

SEQ ID NO: 131608 - protein, 37 aa, Artificial Sequence
  Description of Artificial Sequence: Synthetic polypeptide
DEEEIRTTNPVAVEQYGSVSTVNNNNNANQLGNTNDD

SEQ ID NO: 131609 - protein, 38 aa, Artificial Sequence
  Description of Artificial Sequence: Synthetic polypeptide
DEEEIRTTNPVAVEQYGSVSTVNNNNNLQAGNEQGTTQ

SEQ ID NO: 131610 - protein, 32 aa, Artificial Sequence
  Description of Artificial Sequence: Synthetic polypeptide
SEEEIRCTNPIATEQYGCVCSWNLAENFNSNQ

SEQ ID NO: 131611 - protein, 32 aa, Artificial Sequence
  Description of Artificial Sequence: Synthetic polypeptide
SEEEIRCTNPIATEQYGCVCSWNLAHFGSDQF

SEQ ID NO: 131612 - protein, 34 aa, Artificial Sequence
  Description of Artificial Sequence: Synthetic polypeptide
DDEEISTTNPVATEQYGCVCSTGELNQNFNSQQS

SEQ ID NO: 131613 - protein, 36 aa, Artificial Sequence
  Description of Artificial Sequence: Synthetic polypeptide
AEEEIRTTNPVATEQYGSVSTVDNQNGSEEGNNQIG

SEQ ID NO: 131614 - protein, 36 aa, Artificial Sequence
  Description of Artificial Sequence: Synthetic polypeptide
DEEEIRTTNPVAVEQYGSVSTVNNNNNNQNSEQGTE

SEQ ID NO: 131615 - protein, 35 aa, Artificial Sequence
  Description of Artificial Sequence: Synthetic polypeptide
DEEEIRPTNPVASEQYGSVSSTTPAGNMRNGMNPV

SEQ ID NO: 131616 - protein, 37 aa, Artificial Sequence
  Description of Artificial Sequence: Synthetic polypeptide
AEEEIRTTNPVATEQYGSVSTVDNGNQQQGTNNNGDE

SEQ ID NO: 131617 - protein, 37 aa, Artificial Sequence
  Description of Artificial Sequence: Synthetic polypeptide
AEEEIRTTNPVATEQYGSVSTVDNGNQQQGTENNTQE

SEQ ID NO: 131618 - protein, 36 aa, Artificial Sequence
  Description of Artificial Sequence: Synthetic polypeptide
DEEEIRTTNPVAVEQYGSVSTVNNNNNQNDEQGETQ

SEQ ID NO: 131619 - protein, 36 aa, Artificial Sequence
  Description of Artificial Sequence: Synthetic polypeptide
DEEEIRTTNPVAVEQYGSVSTVNNNNNQNNDEQGTE

SEQ ID NO: 131620 - protein, 36 aa, Artificial Sequence
  Description of Artificial Sequence: Synthetic polypeptide
DEEEIRTTNPVAVEQYGSVSTVNNNNNQNTEQGVTE

SEQ ID NO: 131621 - protein, 35 aa, Artificial Sequence
  Description of Artificial Sequence: Synthetic polypeptide
DEEEIRTTNPVATEQYGQCVCSNTGYNQNFNSDQS

SEQ ID NO: 131622 - protein, 37 aa, Artificial Sequence
  Description of Artificial Sequence: Synthetic polypeptide
DEEEIRTTNPVAVEQYGSVSTVNNNNNQQGDEQGNTE

SEQ ID NO: 131623 - protein, 37 aa, Artificial Sequence
  Description of Artificial Sequence: Synthetic polypeptide
DEEEIRTTNPVAVEQYGSVSTVNNNNNQQGNNQGEDS

SEQ ID NO: 131624 - protein, 36 aa, Artificial Sequence
  Description of Artificial Sequence: Synthetic polypeptide
DEEEIRTTNPVATEQYGQCVCSNTGYLQENFNSDNQ

SEQ ID NO: 131625 - protein, 37 aa, Artificial Sequence
  Description of Artificial Sequence: Synthetic polypeptide
AEEEIRTTNPVATEQYGSVSTVDNGNQQQGNNNEGQE

SEQ ID NO: 131626 - protein, 37 aa, Artificial Sequence
  Description of Artificial Sequence: Synthetic polypeptide
AEEEIRTTNPVATEQYGSVSTVDNGNQQNGNNNNDQE

SEQ ID NO: 131627 - protein, 36 aa, Artificial Sequence
  Description of Artificial Sequence: Synthetic polypeptide
DEEEIRTTNPVATEQYGQCVCSNTGELQSFGSDTQE

SEQ ID NO: 131628 - protein, 37 aa, Artificial Sequence
  Description of Artificial Sequence: Synthetic polypeptide
AEEEIRTTNPVATEQYGSVSTVDNGNQQLGTNNNNQE

SEQ ID NO: 131629 - protein, 35 aa, Artificial Sequence
  Description of Artificial Sequence: Synthetic polypeptide
DEEEIRTTNPVATEQYGQCVCSNTEPQENFNSDQS

SEQ ID NO: 131630 - protein, 32 aa, Artificial Sequence
  Description of Artificial Sequence: Synthetic polypeptide
SEEEIRCTNPIATEQYGCVCSWNDANFGSNQI

SEQ ID NO: 131631 - protein, 36 aa, Artificial Sequence
  Description of Artificial Sequence: Synthetic polypeptide
DEEEIRTTNPVATEQYGQCVCSNTENQENFGSENQA

SEQ ID NO: 131632 - protein, 35 aa, Artificial Sequence
  Description of Artificial Sequence: Synthetic polypeptide
DEEEIRTTNPVATEQYGQCVCSNTELEEGFGSDQS

SEQ ID NO: 131633 - protein, 35 aa, Artificial Sequence
  Description of Artificial Sequence: Synthetic polypeptide
DEEEIRTTNPVATEQYGQCVCSMWGELQFFGSDQS

SEQ ID NO: 131634 - protein, 36 aa, Artificial Sequence
  Description of Artificial Sequence: Synthetic polypeptide
AEEEIRTTNPVATEQYGSVSTTVNNGQQIGTTTDEQ

SEQ ID NO: 131635 - protein, 36 aa, Artificial Sequence
  Description of Artificial Sequence: Synthetic polypeptide
AEEEIRTTNPVATEQYGSVSTTVNNANNQQGTEQGQ

SEQ ID NO: 131636 - protein, 34 aa, Artificial Sequence
  Description of Artificial Sequence: Synthetic polypeptide
DEEEIRTTNPVATEQYGQCVCSMWEHQYFNSDQS

SEQ ID NO: 131637 - protein, 35 aa, Artificial Sequence
  Description of Artificial Sequence: Synthetic polypeptide
DEEEIRTTNPVATEQYGQCVCSMWEHQYFGSENQS

SEQ ID NO: 131638 - protein, 36 aa, Artificial Sequence
  Description of Artificial Sequence: Synthetic polypeptide
DEEQIRTTNPVATEQYGSSVSSTTPAGPNMRNGNPP

SEQ ID NO: 131639 - protein, 35 aa, Artificial Sequence
  Description of Artificial Sequence: Synthetic polypeptide
DEEEIRPTNPVASEQYGSVSSTTPAGPNMRNGMTR

SEQ ID NO: 131640 - protein, 35 aa, Artificial Sequence
  Description of Artificial Sequence: Synthetic polypeptide
DEEEIRTTNPVATEQYGQCVCSMTGEDQHFGSEQV

SEQ ID NO: 131641 - protein, 37 aa, Artificial Sequence
  Description of Artificial Sequence: Synthetic polypeptide
AEEEIRTTNPVATEQYGSVSTTVNGNQQGTNNENEEF

SEQ ID NO: 131642 - protein, 38 aa, Artificial Sequence
  Description of Artificial Sequence: Synthetic polypeptide
AEEEIRTTNPVATEQYGSVSTTVNNLQNADEQGTNNVE

SEQ ID NO: 131643 - protein, 37 aa, Artificial Sequence
  Description of Artificial Sequence: Synthetic polypeptide
AEEEIRTTNPVATEQYGSVSTTVNGNQQGEGEENEEG

SEQ ID NO: 131644 - protein, 35 aa, Artificial Sequence
  Description of Artificial Sequence: Synthetic polypeptide
DEEEIRTTNPVATEQYGQCVCSMTEHEQNFGSVQA

SEQ ID NO: 131645 - protein, 35 aa, Artificial Sequence
  Description of Artificial Sequence: Synthetic polypeptide
AEEEIRTTNPVATEQYGSVSTTVNDNGTVNNNNAQ

SEQ ID NO: 131646 - protein, 36 aa, Artificial Sequence
  Description of Artificial Sequence: Synthetic polypeptide
AEEEIRTTNPVATEQYGSVSTTVNDNGNTQGNNTTE

SEQ ID NO: 131647 - protein, 37 aa, Artificial Sequence
  Description of Artificial Sequence: Synthetic polypeptide
DEEEIRTTNPVAVEQYGSVSTVNNNQQLGNNGGNEDE

SEQ ID NO: 131648 - protein, 37 aa, Artificial Sequence
  Description of Artificial Sequence: Synthetic polypeptide
DEEEIRTTNPVAVEQYGSVSTVNNNQQLGNNGNGNDE

SEQ ID NO: 131649 - protein, 37 aa, Artificial Sequence
  Description of Artificial Sequence: Synthetic polypeptide
DEEEIRTTNPVAVEQYGSVSTVNNNQQLGNNNTEEDE

SEQ ID NO: 131650 - protein, 36 aa, Artificial Sequence
  Description of Artificial Sequence: Synthetic polypeptide
DEEEIRTTNPVATEQYGQCVCSMTEELQENFGSDQS

SEQ ID NO: 131651 - protein, 37 aa, Artificial Sequence
  Description of Artificial Sequence: Synthetic polypeptide
AEEEIRTTNPVATEQYGSVSTTVGTNNNQQGSTNSGV

SEQ ID NO: 131652 - protein, 37 aa, Artificial Sequence
  Description of Artificial Sequence: Synthetic polypeptide
AEEEIRTTNPVATEQYGSVSTTVDENGNQEQGNNQTD

SEQ ID NO: 131653 - protein, 36 aa, Artificial Sequence
  Description of Artificial Sequence: Synthetic polypeptide
AEEEIRTTNPVATEQYGSVSTTVNGNGNQQGTEEDE

SEQ ID NO: 131654 - protein, 37 aa, Artificial Sequence
  Description of Artificial Sequence: Synthetic polypeptide
AEEEIRTTNPVATEQYGSVSTTVNNNDNQQQGTNVAE

SEQ ID NO: 131655 - protein, 37 aa, Artificial Sequence
  Description of Artificial Sequence: Synthetic polypeptide
AEEEIRTTNPVATEQYGSVSTTVNNNNQDEQGTNNAT

SEQ ID NO: 131656 - protein, 37 aa, Artificial Sequence
  Description of Artificial Sequence: Synthetic polypeptide
AEEEIRTTNPVATEQYGSVSTTVNNNNQQQIGTNVGE

SEQ ID NO: 131657 - protein, 35 aa, Artificial Sequence
  Description of Artificial Sequence: Synthetic polypeptide
DEEEIRTTNPVATEQYGQCVCSNTEHQEFFPSNQS

SEQ ID NO: 131658 - protein, 36 aa, Artificial Sequence
  Description of Artificial Sequence: Synthetic polypeptide
DEEEIRTTNPVATEQYGQCVCSNTEHNQENFGSNQT

SEQ ID NO: 131659 - protein, 36 aa, Artificial Sequence
  Description of Artificial Sequence: Synthetic polypeptide
DEEEIRTTNPVATEQYGQCVCSNTEHDQGFGSDNQS

SEQ ID NO: 131660 - protein, 34 aa, Artificial Sequence
  Description of Artificial Sequence: Synthetic polypeptide
DEEEIRTTNPVATEQYGQCVCSNTEHAFFGSDQP

SEQ ID NO: 131661 - protein, 35 aa, Artificial Sequence
  Description of Artificial Sequence: Synthetic polypeptide
DEEEIRTTNPVATEQYGQCVCSNTEEHQSFGSDQS

SEQ ID NO: 131662 - protein, 36 aa, Artificial Sequence
  Description of Artificial Sequence: Synthetic polypeptide
AEEEIRTTNPVATEQYGSVSTTVNQQQNATEQGTDE

SEQ ID NO: 131663 - protein, 37 aa, Artificial Sequence
  Description of Artificial Sequence: Synthetic polypeptide
AEEEIRTTNPVATEQYGSVSTTVNQQNGNQQGTNQTE

SEQ ID NO: 131664 - protein, 37 aa, Artificial Sequence
  Description of Artificial Sequence: Synthetic polypeptide
AEEEIRTTNPVATEQYGSVSTTVNQQLNGTEAGNEDE

SEQ ID NO: 131665 - protein, 36 aa, Artificial Sequence
  Description of Artificial Sequence: Synthetic polypeptide
AEEEIRTTNPVATEQYGSVSTTVNQNNQQLANNEED

SEQ ID NO: 131666 - protein, 35 aa, Artificial Sequence
  Description of Artificial Sequence: Synthetic polypeptide
DEEEIRTTNPVATEQYGQCVCSNTEDQHFNSDNQA

SEQ ID NO: 131667 - protein, 35 aa, Artificial Sequence
  Description of Artificial Sequence: Synthetic polypeptide
DEEEIRTTNPVATEQYGQCVCSNTEDQESFGSDQS

SEQ ID NO: 131668 - protein, 37 aa, Artificial Sequence
  Description of Artificial Sequence: Synthetic polypeptide
AEEEIRTTNPVATEQYGSVSTTVNQLQNNNNGEEDED

SEQ ID NO: 131669 - protein, 37 aa, Artificial Sequence
  Description of Artificial Sequence: Synthetic polypeptide
AEEEIRTTNPVATEQYGSVSTTVNQLGNNENGNTQGD

SEQ ID NO: 131670 - protein, 36 aa, Artificial Sequence
  Description of Artificial Sequence: Synthetic polypeptide
AEEEIRTTNPVATEQYGSVSTTVNQLGNLNEENSEE

SEQ ID NO: 131671 - protein, 37 aa, Artificial Sequence
  Description of Artificial Sequence: Synthetic polypeptide
AEEEIRTTNPVATEQYGSVSTTVNNQNENQQGTNATE

SEQ ID NO: 131672 - protein, 38 aa, Artificial Sequence
  Description of Artificial Sequence: Synthetic polypeptide
AEEEIRTTNPVATEQYGSVSTTVNNQLQQNEQGNNTNE

SEQ ID NO: 131673 - protein, 36 aa, Artificial Sequence
  Description of Artificial Sequence: Synthetic polypeptide
DEEQIRTTNPVATEQYGSVSSTTPAGPNMRNGMNPV

SEQ ID NO: 131674 - protein, 36 aa, Artificial Sequence
  Description of Artificial Sequence: Synthetic polypeptide
DEEQIRTTNPVATEQYGSVSSTMPAGPNMRNGMNPV

SEQ ID NO: 131675 - protein, 36 aa, Artificial Sequence
  Description of Artificial Sequence: Synthetic polypeptide
DEEQIRTTNPVATEQYGSVSSTKPAGPNMRNGMNPV

SEQ ID NO: 131676 - protein, 36 aa, Artificial Sequence
  Description of Artificial Sequence: Synthetic polypeptide
DEEQIRTTNPVATEQYGSVSRTTPAGPNMRNGMNPV

SEQ ID NO: 131677 - protein, 37 aa, Artificial Sequence
  Description of Artificial Sequence: Synthetic polypeptide
AEEEIRTTNPVATEQYGSVSTTVNNNNQQTEGTNNVD

SEQ ID NO: 131678 - protein, 36 aa, Artificial Sequence
  Description of Artificial Sequence: Synthetic polypeptide
DEEEIRTTNPVATEQYGQCVCSNTELNQENFGSDQE

SEQ ID NO: 131679 - protein, 36 aa, Artificial Sequence
  Description of Artificial Sequence: Synthetic polypeptide
AEEEIRTTNPVATEQYGSVSTVNNLQQNEDEETEGT

SEQ ID NO: 131680 - protein, 33 aa, Artificial Sequence
  Description of Artificial Sequence: Synthetic polypeptide
SEEEIRCTNPIATEQYGCVCSWNDAERFGSNQS

SEQ ID NO: 131681 - protein, 33 aa, Artificial Sequence
  Description of Artificial Sequence: Synthetic polypeptide
SEEEIRCTNPIATEQYGCVCSWGNLMNFGSNQM

SEQ ID NO: 131682 - protein, 33 aa, Artificial Sequence
  Description of Artificial Sequence: Synthetic polypeptide
SEEEIRCTNPCATEQYGCVCSWGNLAHFGSNQS

SEQ ID NO: 131683 - protein, 31 aa, Artificial Sequence
  Description of Artificial Sequence: Synthetic polypeptide
SEEEIRCTNPCATEQYGCVCSWNDANFGSDQ

SEQ ID NO: 131684 - protein, 33 aa, Artificial Sequence
  Description of Artificial Sequence: Synthetic polypeptide
SEEEIRCTNPCATEQYGCVCSWNLAENFGSNQS

SEQ ID NO: 131685 - protein, 32 aa, Artificial Sequence
  Description of Artificial Sequence: Synthetic polypeptide
SEEEIRCTNPCATEQYGCVCSWNLAYFGSEQA

SEQ ID NO: 131686 - protein, 35 aa, Artificial Sequence
  Description of Artificial Sequence: Synthetic polypeptide
DEEEIRTTNPVATEQYGQCVCSTEDHQENFNSQQA

SEQ ID NO: 131687 - protein, 35 aa, Artificial Sequence
  Description of Artificial Sequence: Synthetic polypeptide
DEEEIRTTNPVAVEQYGSVSTNWHSSETPMGSDDH

SEQ ID NO: 131688 - protein, 33 aa, Artificial Sequence
  Description of Artificial Sequence: Synthetic polypeptide
DEAEIACTNPVATEQYGCVATNLTENPGGDSRM

SEQ ID NO: 131689 - protein, 35 aa, Artificial Sequence
  Description of Artificial Sequence: Synthetic polypeptide
DDEEISTTNPVATEQYGCVCSTEEDLQEFFGSNQN

SEQ ID NO: 131690 - protein, 32 aa, Artificial Sequence
  Description of Artificial Sequence: Synthetic polypeptide
DEAEIACTNPVATEQYGCVATNLTENPGEDSP

SEQ ID NO: 131691 - protein, 36 aa, Artificial Sequence
  Description of Artificial Sequence: Synthetic polypeptide
DEEEIRTTNPVATEQYGQCVCSTEDLNQNFNSEPQA

SEQ ID NO: 131692 - protein, 33 aa, Artificial Sequence
  Description of Artificial Sequence: Synthetic polypeptide
DEESIACTNPVATEQYGSVAITNPEPGQGDNEL

SEQ ID NO: 131693 - protein, 35 aa, Artificial Sequence
  Description of Artificial Sequence: Synthetic polypeptide
DEEEIRTTNPVATEQYGQCVCSSGEHQNFGSENQQ

SEQ ID NO: 131694 - protein, 34 aa, Artificial Sequence
  Description of Artificial Sequence: Synthetic polypeptide
DEEEIRTTNPVATEQYGQCVCSSGEHQHFGSQQS

SEQ ID NO: 131695 - protein, 38 aa, Artificial Sequence
  Description of Artificial Sequence: Synthetic polypeptide
AEEEIRTTNPVATEQYGSVSTVNLQLNGNEEIGTTQDD

SEQ ID NO: 131696 - protein, 34 aa, Artificial Sequence
  Description of Artificial Sequence: Synthetic polypeptide
DEEEIRTTNPVATEQYGQCVCSSGEDQNFGSEQS

SEQ ID NO: 131697 - protein, 32 aa, Artificial Sequence
  Description of Artificial Sequence: Synthetic polypeptide
DEAEIACTNPVATEQYGCVATNLQAMAEKEHE

SEQ ID NO: 131698 - protein, 31 aa, Artificial Sequence
  Description of Artificial Sequence: Synthetic polypeptide
DEESIACTNPVATEQYGCVAGTNDATMGDSL

SEQ ID NO: 131699 - protein, 33 aa, Artificial Sequence
  Description of Artificial Sequence: Synthetic polypeptide
DEEEIRTTNPVATEQYGQCVCSSEHQNFISEQQ

SEQ ID NO: 131700 - protein, 37 aa, Artificial Sequence
  Description of Artificial Sequence: Synthetic polypeptide
AEEEIRTTNPVATEQYGSVSTVNLNQLGSEEGTTEDD

SEQ ID NO: 131701 - protein, 35 aa, Artificial Sequence
  Description of Artificial Sequence: Synthetic polypeptide
DEEEIRTTNPVATEQYGQCVCSNWGNHQHFGSEQS

SEQ ID NO: 131702 - protein, 35 aa, Artificial Sequence
  Description of Artificial Sequence: Synthetic polypeptide
DEEEIRGTNPVGTEQYGSVSTADNNGQGGGGQPTT

SEQ ID NO: 131703 - protein, 34 aa, Artificial Sequence
  Description of Artificial Sequence: Synthetic polypeptide
DEEEIRTTNPVATEQYGQCVCSTEDPQFFISDQS

SEQ ID NO: 131704 - protein, 36 aa, Artificial Sequence
  Description of Artificial Sequence: Synthetic polypeptide
DEEEIRTTNPVATEQYGQCVCSTEEHDQGFGSNNQS

SEQ ID NO: 131705 - protein, 36 aa, Artificial Sequence
  Description of Artificial Sequence: Synthetic polypeptide
DEEEIRTTNPVATEQYGQCVCSTEEHNQERFGSDQS

SEQ ID NO: 131706 - protein, 35 aa, Artificial Sequence
  Description of Artificial Sequence: Synthetic polypeptide
DEEEIRTTNPVATEQYGQCVCSTGEHINFQSDFQA

SEQ ID NO: 131707 - protein, 36 aa, Artificial Sequence
  Description of Artificial Sequence: Synthetic polypeptide
DEEEIRTTNPVATEQYGQCVCSTGEDTQNFGSNNQY

SEQ ID NO: 131708 - protein, 36 aa, Artificial Sequence
  Description of Artificial Sequence: Synthetic polypeptide
DEEEIRTTNPVAVEQYGSVSSTTPAGPNMRNGMNPV

SEQ ID NO: 131709 - protein, 33 aa, Artificial Sequence
  Description of Artificial Sequence: Synthetic polypeptide
DEESIATTNPVATECWGSVYNWGNDHQGREGNM

SEQ ID NO: 131710 - protein, 36 aa, Artificial Sequence
  Description of Artificial Sequence: Synthetic polypeptide
DEEEIRTTNPVATEQYGQCVCSTENNQENFNSENQS

SEQ ID NO: 131711 - protein, 32 aa, Artificial Sequence
  Description of Artificial Sequence: Synthetic polypeptide
DEESIAFCTNPVATEQWGCVAGTNDQDGNEMW

SEQ ID NO: 131712 - protein, 34 aa, Artificial Sequence
  Description of Artificial Sequence: Synthetic polypeptide
DEEEIRTTNPVATEQYGQCVCSTEHQENFSSDQS

SEQ ID NO: 131713 - protein, 34 aa, Artificial Sequence
  Description of Artificial Sequence: Synthetic polypeptide
DEEEIRTTNPVATEQYGQCVCSTEHNQNFISEQS

SEQ ID NO: 131714 - protein, 35 aa, Artificial Sequence
  Description of Artificial Sequence: Synthetic polypeptide
DEEEIRTTNPVATEQYGQCVCSTEHNQNFGSETQS

SEQ ID NO: 131715 - protein, 35 aa, Artificial Sequence
  Description of Artificial Sequence: Synthetic polypeptide
DEEEIRTTNPVATEQYGQCVCSTEHNQGFGSDFQT

SEQ ID NO: 131716 - protein, 35 aa, Artificial Sequence
  Description of Artificial Sequence: Synthetic polypeptide
DEEEIRTTNPVATEQYGQCVCSTEHNQFFNSNTQE

SEQ ID NO: 131717 - protein, 35 aa, Artificial Sequence
  Description of Artificial Sequence: Synthetic polypeptide
DEEEIRTTNPVATEQYGQCVCSTEHNQENFGSDQN

SEQ ID NO: 131718 - protein, 34 aa, Artificial Sequence
  Description of Artificial Sequence: Synthetic polypeptide
DEEEIRTTNPVATEQYGQCVCSTEHASFGSEFQA

SEQ ID NO: 131719 - protein, 32 aa, Artificial Sequence
  Description of Artificial Sequence: Synthetic polypeptide
DEESIACTNPVATESYGCVATGSLQEAEGGNH

SEQ ID NO: 131720 - protein, 33 aa, Artificial Sequence
  Description of Artificial Sequence: Synthetic polypeptide
DEESIACTNPVATESYGCVAGTNLQATPGDNAY

SEQ ID NO: 131721 - protein, 35 aa, Artificial Sequence
  Description of Artificial Sequence: Synthetic polypeptide
DEEEIRTTNPVATEQYGQCVCSTEETNQNFNSQQA

SEQ ID NO: 131722 - protein, 33 aa, Artificial Sequence
  Description of Artificial Sequence: Synthetic polypeptide
DEESIACTNPVATESYGCVAGTGLQATPGDNRM

SEQ ID NO: 131723 - protein, 35 aa, Artificial Sequence
  Description of Artificial Sequence: Synthetic polypeptide
DEEEIRTTNPVATEQYGQCVCSTEEHQYFQSDNQS

SEQ ID NO: 131724 - protein, 35 aa, Artificial Sequence
  Description of Artificial Sequence: Synthetic polypeptide
DEEEIRTTNPVATEQYGQCVCSTEEHNQSFGSDQN

SEQ ID NO: 131725 - protein, 35 aa, Artificial Sequence
  Description of Artificial Sequence: Synthetic polypeptide
DEEEIRTTNPVATEQYGQCVCSTEEHNQGFGSDQV

SEQ ID NO: 131726 - protein, 35 aa, Artificial Sequence
  Description of Artificial Sequence: Synthetic polypeptide
DEEEIRTTNPVATEQYGQCVCSTEEHNQFFISNQA

SEQ ID NO: 131727 - protein, 37 aa, Artificial Sequence
  Description of Artificial Sequence: Synthetic polypeptide
AEEEIRTTNPVATEQYGSVSTVNLNLNQQQNDTNNAT

SEQ ID NO: 131728 - protein, 33 aa, Artificial Sequence
  Description of Artificial Sequence: Synthetic polypeptide
SEEEIRCTNPIATEQYGCVCSWGNLTRFGSDQS

SEQ ID NO: 131729 - protein, 36 aa, Artificial Sequence
  Description of Artificial Sequence: Synthetic polypeptide
AEEEIRTTNPVATEQYGSVSTVNLLNDNNNNENDEA

SEQ ID NO: 131730 - protein, 36 aa, Artificial Sequence
  Description of Artificial Sequence: Synthetic polypeptide
AEEEIRTTNPVATEQYGSVSTVNGNQNQNNNQNEDQ

SEQ ID NO: 131731 - protein, 35 aa, Artificial Sequence
  Description of Artificial Sequence: Synthetic polypeptide
DEEEIRTTNPVATEQYGQCVCSNWELQEFFGSDQE

SEQ ID NO: 131732 - protein, 36 aa, Artificial Sequence
  Description of Artificial Sequence: Synthetic polypeptide
DEEEIRTTNPVATEQYGQCVCSNWELDQNFGSENQP

SEQ ID NO: 131733 - protein, 35 aa, Artificial Sequence
  Description of Artificial Sequence: Synthetic polypeptide
DEEEIRTTNPVATEQYGQCVCSNWEHQNFGSDNQF

SEQ ID NO: 131734 - protein, 35 aa, Artificial Sequence
  Description of Artificial Sequence: Synthetic polypeptide
DEEEIRTTNPVATEQYGQCVCSNWEHQNFGSDNQA

SEQ ID NO: 131735 - protein, 35 aa, Artificial Sequence
  Description of Artificial Sequence: Synthetic polypeptide
DEEEIRTTNPVATEQYGQCVCSNWEHNQNFGSNQS

SEQ ID NO: 131736 - protein, 35 aa, Artificial Sequence
  Description of Artificial Sequence: Synthetic polypeptide
AEEEIRTTNPVATEQYGSVSTVEQQQQNANNVATE

SEQ ID NO: 131737 - protein, 31 aa, Artificial Sequence
  Description of Artificial Sequence: Synthetic polypeptide
SEEEIRCTNPIATEQYGATVWAENWAERGPI

SEQ ID NO: 131738 - protein, 36 aa, Artificial Sequence
  Description of Artificial Sequence: Synthetic polypeptide
AEEEIRTTNPVATEQYGSVSTVDTNGNSEEGNNQIG

SEQ ID NO: 131739 - protein, 35 aa, Artificial Sequence
  Description of Artificial Sequence: Synthetic polypeptide
DEEEIRTTNPVATEQYGQCVCSNWEELQFFNSDQA

SEQ ID NO: 131740 - protein, 36 aa, Artificial Sequence
  Description of Artificial Sequence: Synthetic polypeptide
DEEEIRTTNPVATEQYGQCVCSNWETNQNFGSENQS

SEQ ID NO: 131741 - protein, 36 aa, Artificial Sequence
  Description of Artificial Sequence: Synthetic polypeptide
AEEEIRTTNPVATEQYGSVSTVDQQGNSEQGTTVSE

SEQ ID NO: 131742 - protein, 36 aa, Artificial Sequence
  Description of Artificial Sequence: Synthetic polypeptide
AEEEIRTTNPVATEQYGSVSTVDQNGNTEEGNNQII

SEQ ID NO: 131743 - protein, 37 aa, Artificial Sequence
  Description of Artificial Sequence: Synthetic polypeptide
AEEEIRTTNPVATEQYGSVSTVDQNGNQEEIGNNQQG

SEQ ID NO: 131744 - protein, 32 aa, Artificial Sequence
  Description of Artificial Sequence: Synthetic polypeptide
SEEEIRCTNPIATEQYGCVCSTWEHANFGSNQ

SEQ ID NO: 131745 - protein, 34 aa, Artificial Sequence
  Description of Artificial Sequence: Synthetic polypeptide
SEEEIRCTNPIATEQYGCVCSTWNLAENFGSNQA

SEQ ID NO: 131746 - protein, 31 aa, Artificial Sequence
  Description of Artificial Sequence: Synthetic polypeptide
SEEEIRCTNPIATEQYGCVCSWEDINFGSNQ

SEQ ID NO: 131747 - protein, 32 aa, Artificial Sequence
  Description of Artificial Sequence: Synthetic polypeptide
SEEEIRCTNPIATEQYGCVCSWELAERFGSDQ

SEQ ID NO: 131748 - protein, 31 aa, Artificial Sequence
  Description of Artificial Sequence: Synthetic polypeptide
SEEEIRCTNPIATEQYGCVCSWELMNFGSQQ

SEQ ID NO: 131749 - protein, 32 aa, Artificial Sequence
  Description of Artificial Sequence: Synthetic polypeptide
SEEEIRCTNPIATEQYGCVCSWGNHAHFGSNQ

SEQ ID NO: 131750 - protein, 32 aa, Artificial Sequence
  Description of Artificial Sequence: Synthetic polypeptide
SEEEIRCTNPIATEQYGCVCSWGNLMHFGSEQ

SEQ ID NO: 131751 - protein, 32 aa, Artificial Sequence
  Description of Artificial Sequence: Synthetic polypeptide
SEEEIRCTNPIATEQYGCVCSNWNLANFGSDQ

SEQ ID NO: 131752 - protein, 35 aa, Artificial Sequence
  Description of Artificial Sequence: Synthetic polypeptide
AEEEIRTTNPVATEQYGSVSTVGNNNNEQGDEQGS

SEQ ID NO: 131753 - protein, 35 aa, Artificial Sequence
  Description of Artificial Sequence: Synthetic polypeptide
AEEEIRTTNPVATEQYGSVSTVGNNNNNQQDEEGV

SEQ ID NO: 131754 - protein, 30 aa, Artificial Sequence
  Description of Artificial Sequence: Synthetic polypeptide
DEESIACTNPVATASWGCVATNNLQDNSNM

SEQ ID NO: 131755 - protein, 38 aa, Artificial Sequence
  Description of Artificial Sequence: Synthetic polypeptide
AEEEIRTTNPVATEQYGSVSTVNGNQLNGNQIGTNEDE

SEQ ID NO: 131756 - protein, 31 aa, Artificial Sequence
  Description of Artificial Sequence: Synthetic polypeptide
DEESIACTNPVATEQWGCVAGMNNLQAEHNH

SEQ ID NO: 131757 - protein, 30 aa, Artificial Sequence
  Description of Artificial Sequence: Synthetic polypeptide
SEEEIRCTNPIATECYGATSNENLAEPGPI

SEQ ID NO: 131758 - protein, 36 aa, Artificial Sequence
  Description of Artificial Sequence: Synthetic polypeptide
AEEEIRTTNPVATEQYGSVSTVNGNQANNNNENDDT

SEQ ID NO: 131759 - protein, 33 aa, Artificial Sequence
  Description of Artificial Sequence: Synthetic polypeptide
SEEEIRCTNPIATECYGSTTWSEENLARKGNYI

SEQ ID NO: 131760 - protein, 37 aa, Artificial Sequence
  Description of Artificial Sequence: Synthetic polypeptide
AEEEIRTTNPVATEQYGSVSTVNGNLEQGTDEENEES

SEQ ID NO: 131761 - protein, 37 aa, Artificial Sequence
  Description of Artificial Sequence: Synthetic polypeptide
AEEEIRTTNPVATEQYGSVSTVNGNDQNGNIGTNNGD

SEQ ID NO: 131762 - protein, 38 aa, Artificial Sequence
  Description of Artificial Sequence: Synthetic polypeptide
AEEEIRTTNPVATEQYGSVSTVNELQSGNTEQGNNADE

SEQ ID NO: 131763 - protein, 36 aa, Artificial Sequence
  Description of Artificial Sequence: Synthetic polypeptide
AEEEIRTTNPVATEQYGSVSTVNDNNGTEQGTNEDA

SEQ ID NO: 131764 - protein, 37 aa, Artificial Sequence
  Description of Artificial Sequence: Synthetic polypeptide
AEEEIRTTNPVATEQYGSVSTVNANQSTTEQYGSNYE

SEQ ID NO: 131765 - protein, 38 aa, Artificial Sequence
  Description of Artificial Sequence: Synthetic polypeptide
AEEEIRTTNPVATEQYGSVSTVNANLQNNGEQGNNNVE

SEQ ID NO: 131766 - protein, 38 aa, Artificial Sequence
  Description of Artificial Sequence: Synthetic polypeptide
AEEEIRTTNPVATEQYGSVSTVNANLQNGNLEQGNNVE

SEQ ID NO: 131767 - protein, 32 aa, Artificial Sequence
  Description of Artificial Sequence: Synthetic polypeptide
DEESIACTNPVATEIYGCVAGTNLQDADDNAE

SEQ ID NO: 131768 - protein, 34 aa, Artificial Sequence
  Description of Artificial Sequence: Synthetic polypeptide
DDEEISTTNPVATEQYGCVCSTEHNQGFGSNNQS

SEQ ID NO: 131769 - protein, 36 aa, Artificial Sequence
  Description of Artificial Sequence: Synthetic polypeptide
AEEEIRTTNPVATEQYGSVSTVLQLNDNEEIGTTDA

SEQ ID NO: 131770 - protein, 37 aa, Artificial Sequence
  Description of Artificial Sequence: Synthetic polypeptide
AEEEIRTTNPVATEQYGSVSTVLQAGNNNDNGNNNSD

SEQ ID NO: 131771 - protein, 33 aa, Artificial Sequence
  Description of Artificial Sequence: Synthetic polypeptide
DEESIACTNPVATASYGGCVATNLQDRGDNTAM

SEQ ID NO: 131772 - protein, 31 aa, Artificial Sequence
  Description of Artificial Sequence: Synthetic polypeptide
DEESIACTNPVATASYGCVATNELQDNSNVD

SEQ ID NO: 131773 - protein, 37 aa, Artificial Sequence
  Description of Artificial Sequence: Synthetic polypeptide
AEEEIRTTNPVATEQYGSVSTVLQAGNNADEGNNNSE

SEQ ID NO: 131774 - protein, 35 aa, Artificial Sequence
  Description of Artificial Sequence: Synthetic polypeptide
AEEEIRTTNPVATEQYGSVSTVIGNNNNQNDEQGS

SEQ ID NO: 131775 - protein, 36 aa, Artificial Sequence
  Description of Artificial Sequence: Synthetic polypeptide
AEEEIRTTNPVATEQYGSVSTVGSNNNQQGSTETGV

SEQ ID NO: 131776 - protein, 37 aa, Artificial Sequence
  Description of Artificial Sequence: Synthetic polypeptide
AEEEIRTTNPVATEQYGSVSTVNGQQQNNNIGTNMME

SEQ ID NO: 131777 - protein, 38 aa, Artificial Sequence
  Description of Artificial Sequence: Synthetic polypeptide
AEEEIRTTNPVATEQYGSVSTTVANLQNATEQGTNGDE

SEQ ID NO: 131778 - protein, 36 aa, Artificial Sequence
  Description of Artificial Sequence: Synthetic polypeptide
AEEEIRTTNPVATEQYGSVSTVSNGNGTEEGNNQII

SEQ ID NO: 131779 - protein, 37 aa, Artificial Sequence
  Description of Artificial Sequence: Synthetic polypeptide
AEEEIRTTNPVATEQYGSVSTVSNNDQQGTNQTNNQD

SEQ ID NO: 131780 - protein, 37 aa, Artificial Sequence
  Description of Artificial Sequence: Synthetic polypeptide
AEEEIRTTNPVATEQYGSVSTVTNNQISTESGNNNIS

SEQ ID NO: 131781 - protein, 37 aa, Artificial Sequence
  Description of Artificial Sequence: Synthetic polypeptide
AEEEIRTTNPVATEQYGSVSTVTNNQGNSENGNNDTD

SEQ ID NO: 131782 - protein, 36 aa, Artificial Sequence
  Description of Artificial Sequence: Synthetic polypeptide
DEETIRTTNPVATEQYGVVSTTNQQNQQQNGNQEED

SEQ ID NO: 131783 - protein, 36 aa, Artificial Sequence
  Description of Artificial Sequence: Synthetic polypeptide
DEETIRTTNPVATEQYGVVSTTNQQLQQNENNEEED

SEQ ID NO: 131784 - protein, 36 aa, Artificial Sequence
  Description of Artificial Sequence: Synthetic polypeptide
DEEEIRTTNPVATEVYGSVDSTDLIMNQEGGEGQEF

SEQ ID NO: 131785 - protein, 36 aa, Artificial Sequence
  Description of Artificial Sequence: Synthetic polypeptide
DEETIRTTNPVATEQYGVVSTTNQQLQGNNNQDEED

SEQ ID NO: 131786 - protein, 35 aa, Artificial Sequence
  Description of Artificial Sequence: Synthetic polypeptide
DEEEIRCTNPVATEQYGEASSTEPAGQMRNGMGPR

SEQ ID NO: 131787 - protein, 32 aa, Artificial Sequence
  Description of Artificial Sequence: Synthetic polypeptide
SEDEIRTTNPVAYEEYGVVSTNQQGNEQNDEN

SEQ ID NO: 131788 - protein, 34 aa, Artificial Sequence
  Description of Artificial Sequence: Synthetic polypeptide
DEEEIRTTNPVATEQYGSASTMNAEENETEETDN

SEQ ID NO: 131789 - protein, 37 aa, Artificial Sequence
  Description of Artificial Sequence: Synthetic polypeptide
AEEEIRTTNPVATEQYGSVSTVTNNQLGNEQGENDED

SEQ ID NO: 131790 - protein, 35 aa, Artificial Sequence
  Description of Artificial Sequence: Synthetic polypeptide
DEETIRTTNPVATEQYGVVSTTNNQQQQQGTDEED

SEQ ID NO: 131791 - protein, 36 aa, Artificial Sequence
  Description of Artificial Sequence: Synthetic polypeptide
DEETIRTTNPVATEQYGVVSTTNNQLQQQANNQEED

SEQ ID NO: 131792 - protein, 34 aa, Artificial Sequence
  Description of Artificial Sequence: Synthetic polypeptide
SEDEIRTTNPVAYEQWGSVCSTNDDGGHQGENHR

SEQ ID NO: 131793 - protein, 34 aa, Artificial Sequence
  Description of Artificial Sequence: Synthetic polypeptide
DEEEIRCTNPVATEQYGEASSTPAGPQMRGMGPV

SEQ ID NO: 131794 - protein, 33 aa, Artificial Sequence
  Description of Artificial Sequence: Synthetic polypeptide
SEDEIRTTNPVAYEQWGVVCSTENDGHQGGQRS

SEQ ID NO: 131795 - protein, 36 aa, Artificial Sequence
  Description of Artificial Sequence: Synthetic polypeptide
DEEEIRTTNPVATEVYGSVSDGMGTNLGNDGGEAGE

SEQ ID NO: 131796 - protein, 37 aa, Artificial Sequence
  Description of Artificial Sequence: Synthetic polypeptide
DEETIRTTNPVATEQYGTVVTVVSTTNLQQIGTNTEE

SEQ ID NO: 131797 - protein, 37 aa, Artificial Sequence
  Description of Artificial Sequence: Synthetic polypeptide
DEETIRTTNPVATEQYGTVVTVVSTNLQQIIGTNPEE

SEQ ID NO: 131798 - protein, 37 aa, Artificial Sequence
  Description of Artificial Sequence: Synthetic polypeptide
DEETIRTTNPVATEQYGTVVTVVSTNLNQQIGTNEEE

SEQ ID NO: 131799 - protein, 35 aa, Artificial Sequence
  Description of Artificial Sequence: Synthetic polypeptide
DDEEIRTTNPVATEQYGSVVSGVPEEQGGGNGNGD

SEQ ID NO: 131800 - protein, 32 aa, Artificial Sequence
  Description of Artificial Sequence: Synthetic polypeptide
SEDEIRTTNPVAYEQWGSVAKMLEQMNGGTER

SEQ ID NO: 131801 - protein, 34 aa, Artificial Sequence
  Description of Artificial Sequence: Synthetic polypeptide
DEAEIATTNPVATEAYGSVCLGNEDHQGDTGNDR

SEQ ID NO: 131802 - protein, 38 aa, Artificial Sequence
  Description of Artificial Sequence: Synthetic polypeptide
AEEEIRTTNPVATEQYGSVSTVTNNQLGNQNNGNNEQG

SEQ ID NO: 131803 - protein, 33 aa, Artificial Sequence
  Description of Artificial Sequence: Synthetic polypeptide
DEEEIRCTNPVATEQYGCVCSWNTDEHFGSDTQ

SEQ ID NO: 131804 - protein, 33 aa, Artificial Sequence
  Description of Artificial Sequence: Synthetic polypeptide
DEEEIRCTNPVATEQYGCVCSWGNHDHFNSDTQ

SEQ ID NO: 131805 - protein, 38 aa, Artificial Sequence
  Description of Artificial Sequence: Synthetic polypeptide
AEEEIRTTNPVATEQYGSVSTVTNNQLQGNEQGNNNNA

SEQ ID NO: 131806 - protein, 37 aa, Artificial Sequence
  Description of Artificial Sequence: Synthetic polypeptide
AEEEIRTTNPVATEQYGSVSTVTNNQLNSNQGTNNTT

SEQ ID NO: 131807 - protein, 37 aa, Artificial Sequence
  Description of Artificial Sequence: Synthetic polypeptide
DEETIRTTNPVATEQYGVVSTVNQLQQLQAGNNQDDE

SEQ ID NO: 131808 - protein, 37 aa, Artificial Sequence
  Description of Artificial Sequence: Synthetic polypeptide
DEETIRTTNPVATEQYGVVSTVNNQLQSGNNTQQEED

SEQ ID NO: 131809 - protein, 37 aa, Artificial Sequence
  Description of Artificial Sequence: Synthetic polypeptide
AEEEIRTTNPVATEQYGSVSTVTNNQLNNNNGTNQTD

SEQ ID NO: 131810 - protein, 36 aa, Artificial Sequence
  Description of Artificial Sequence: Synthetic polypeptide
DEETIRTTNPVATEQYGVVSTVNNDQSGNNQQDEQD

SEQ ID NO: 131811 - protein, 37 aa, Artificial Sequence
  Description of Artificial Sequence: Synthetic polypeptide
DEETIRTTNPVATEQYGVVSTVNLNQQLQAGNNQQDE

SEQ ID NO: 131812 - protein, 36 aa, Artificial Sequence
  Description of Artificial Sequence: Synthetic polypeptide
DEETIRTTNPVATEQYGVVSTTVQQQLQAGNNDEED

SEQ ID NO: 131813 - protein, 36 aa, Artificial Sequence
  Description of Artificial Sequence: Synthetic polypeptide
AEEEIRTTNPVATEQYGSVSTVTNNQLNDEEGTEDT

SEQ ID NO: 131814 - protein, 36 aa, Artificial Sequence
  Description of Artificial Sequence: Synthetic polypeptide
DEETIRTTNPVATEQYGVVSTTNQQQQQQQGNDEED

SEQ ID NO: 131815 - protein, 36 aa, Artificial Sequence
  Description of Artificial Sequence: Synthetic polypeptide
DEETIRTTNPVATEQYGVVSTTNQQQQQQGGNQGED

SEQ ID NO: 131816 - protein, 38 aa, Artificial Sequence
  Description of Artificial Sequence: Synthetic polypeptide
AEEEIRTTNPVATEQYGSVSTVTNNQLGNTQAGNNNGD

SEQ ID NO: 131817 - protein, 36 aa, Artificial Sequence
  Description of Artificial Sequence: Synthetic polypeptide
DEETIRTTNPVATEQYGVVSTTNQQQQNQAGNQQDE

SEQ ID NO: 131818 - protein, 35 aa, Artificial Sequence
  Description of Artificial Sequence: Synthetic polypeptide
DEETIRTTNPVATEQYGVVSTTNQQQQLQQNEDED

SEQ ID NO: 131819 - protein, 37 aa, Artificial Sequence
  Description of Artificial Sequence: Synthetic polypeptide
DEETIRTTNPVATEQYGVVSTTNQQQQLQQGENNEDE

SEQ ID NO: 131820 - protein, 37 aa, Artificial Sequence
  Description of Artificial Sequence: Synthetic polypeptide
DEETIRTTNPVATEQYGVVSTTNQQQQLQAGNNQQNQ

SEQ ID NO: 131821 - protein, 37 aa, Artificial Sequence
  Description of Artificial Sequence: Synthetic polypeptide
DEETIRTTNPVATEQYGVVSTTNQQQQLQAGNNQEEE

SEQ ID NO: 131822 - protein, 37 aa, Artificial Sequence
  Description of Artificial Sequence: Synthetic polypeptide
DEETIRTTNPVATEQYGVVSTTNQQQQLQAGNNEQGE

SEQ ID NO: 131823 - protein, 36 aa, Artificial Sequence
  Description of Artificial Sequence: Synthetic polypeptide
DEETIRTTNPVATEQYGVVSTTNQQQNQQGGNNQQD

SEQ ID NO: 131824 - protein, 33 aa, Artificial Sequence
  Description of Artificial Sequence: Synthetic polypeptide
DEEEIRCTNPVATEQYGCVCSWNHDYFGSETAM

SEQ ID NO: 131825 - protein, 36 aa, Artificial Sequence
  Description of Artificial Sequence: Synthetic polypeptide
DEEEIRTTNPVATEVYGSVSSTCPAGPNMRNGMNPV

SEQ ID NO: 131826 - protein, 34 aa, Artificial Sequence
  Description of Artificial Sequence: Synthetic polypeptide
DEEEIRTTNPVATEQYGSASVWGQLIERELVVEI

SEQ ID NO: 131827 - protein, 36 aa, Artificial Sequence
  Description of Artificial Sequence: Synthetic polypeptide
AEEEIRTTNPVATEQYGSVSTVTNNNTEQGTTNLDE

SEQ ID NO: 131828 - protein, 36 aa, Artificial Sequence
  Description of Artificial Sequence: Synthetic polypeptide
DEEEIRTTNPVATEQYGSASSTTPAGPNMRNGMNPV

SEQ ID NO: 131829 - protein, 35 aa, Artificial Sequence
  Description of Artificial Sequence: Synthetic polypeptide
DEEEIRCTNPVATEQYGSASSTEAGPNMRNGMGPR

SEQ ID NO: 131830 - protein, 35 aa, Artificial Sequence
  Description of Artificial Sequence: Synthetic polypeptide
DEEEIRTTNPVATEQYGSASPTEACPQMRNEMEPV

SEQ ID NO: 131831 - protein, 30 aa, Artificial Sequence
  Description of Artificial Sequence: Synthetic polypeptide
SEECIACTNPTYYEQYGSVASNLNRGNESM

SEQ ID NO: 131832 - protein, 37 aa, Artificial Sequence
  Description of Artificial Sequence: Synthetic polypeptide
AEEEIRTTNPVATEQYGSVSTVTNNNQNSENGTNQTE

SEQ ID NO: 131833 - protein, 36 aa, Artificial Sequence
  Description of Artificial Sequence: Synthetic polypeptide
DEETIRTTNPVATEQYGSVSVKTPAGPNMRNGMNPV

SEQ ID NO: 131834 - protein, 37 aa, Artificial Sequence
  Description of Artificial Sequence: Synthetic polypeptide
AEEEIRTTNPVATEQYGSVSTVTNNNQNGDEAGNEDS

SEQ ID NO: 131835 - protein, 35 aa, Artificial Sequence
  Description of Artificial Sequence: Synthetic polypeptide
DEEEIRTTNPVATEQYGSASPCVVPHIQQTIPNAR

SEQ ID NO: 131836 - protein, 32 aa, Artificial Sequence
  Description of Artificial Sequence: Synthetic polypeptide
DEAEIATTNPVATCQYGCVCSTGAHQYFGSDQ

SEQ ID NO: 131837 - protein, 35 aa, Artificial Sequence
  Description of Artificial Sequence: Synthetic polypeptide
DEEEIRTTNPVATEQYGSASPCEVPHIQQIIGNAD

SEQ ID NO: 131838 - protein, 36 aa, Artificial Sequence
  Description of Artificial Sequence: Synthetic polypeptide
DEEEIRTTNPVATEQYGSASPTETHLQQMNDVAEFF

SEQ ID NO: 131839 - protein, 32 aa, Artificial Sequence
  Description of Artificial Sequence: Synthetic polypeptide
SEECIRTTNPVAWEQYGQVCTINVNQGDNNNV

SEQ ID NO: 131840 - protein, 32 aa, Artificial Sequence
  Description of Artificial Sequence: Synthetic polypeptide
DEAEIATTNPVATCQYGCVCSTAHQNFGSEQS

SEQ ID NO: 131841 - protein, 32 aa, Artificial Sequence
  Description of Artificial Sequence: Synthetic polypeptide
SEECIRTTNPVAWEQYGQVCYINVNQGGNMNV

SEQ ID NO: 131842 - protein, 35 aa, Artificial Sequence
  Description of Artificial Sequence: Synthetic polypeptide
DEEEIRCTNPVATEQYGSASSTTPAGPNMRNGNPV

SEQ ID NO: 131843 - protein, 37 aa, Artificial Sequence
  Description of Artificial Sequence: Synthetic polypeptide
DEETIRTTNPVATEQYGSVSTTVNGNQAGNNQEDEQD

SEQ ID NO: 131844 - protein, 37 aa, Artificial Sequence
  Description of Artificial Sequence: Synthetic polypeptide
DEEEIRCTNPVATEQYGSVDSNGVNGQLGQEGGQNDT

SEQ ID NO: 131845 - protein, 36 aa, Artificial Sequence
  Description of Artificial Sequence: Synthetic polypeptide
DEEEIRTTNPVATEQYGSASGATNEDTQVEVNDEEQ

SEQ ID NO: 131846 - protein, 37 aa, Artificial Sequence
  Description of Artificial Sequence: Synthetic polypeptide
AEEEIRTTNPVATEQYGSVSTVTNNNQGNGDEENEDT

SEQ ID NO: 131847 - protein, 37 aa, Artificial Sequence
  Description of Artificial Sequence: Synthetic polypeptide
DEETIRTTNPVATEQYGSVSTTNQQQQLGNNGNNDTD

SEQ ID NO: 131848 - protein, 36 aa, Artificial Sequence
  Description of Artificial Sequence: Synthetic polypeptide
AEEEIRTTNPVATEQYGSVSTVTNNNNTDEGNNQSD

SEQ ID NO: 131849 - protein, 33 aa, Artificial Sequence
  Description of Artificial Sequence: Synthetic polypeptide
DEAEIATTNPVATCQYGCVCSTAHQYFGSDNQA

SEQ ID NO: 131850 - protein, 36 aa, Artificial Sequence
  Description of Artificial Sequence: Synthetic polypeptide
DEEEIRTTNPVATEQYGSASPTFSGLQYGDEVEELK

SEQ ID NO: 131851 - protein, 34 aa, Artificial Sequence
  Description of Artificial Sequence: Synthetic polypeptide
DEEEIRCTNPVATEQYGQCVCSTTETQNFGSEQS

SEQ ID NO: 131852 - protein, 35 aa, Artificial Sequence
  Description of Artificial Sequence: Synthetic polypeptide
DEEEIRTTNPVATEQYGSASPVTSQQQRSEVEEDG

SEQ ID NO: 131853 - protein, 34 aa, Artificial Sequence
  Description of Artificial Sequence: Synthetic polypeptide
SEEAISTTNPVATEQFTGSVQSTNDSQRLLNDDV

SEQ ID NO: 131854 - protein, 35 aa, Artificial Sequence
  Description of Artificial Sequence: Synthetic polypeptide
DEEEIRTTNPVATEQYGSASSTTPAGNMRNGMGPV

SEQ ID NO: 131855 - protein, 36 aa, Artificial Sequence
  Description of Artificial Sequence: Synthetic polypeptide
AEEEIRTTNPVATEQYGSVSTVTNNNQQGTTQQAED

SEQ ID NO: 131856 - protein, 36 aa, Artificial Sequence
  Description of Artificial Sequence: Synthetic polypeptide
DEEEIRTTNPVATEQYGSASSTEPACPNMRNGMNPV

SEQ ID NO: 131857 - protein, 32 aa, Artificial Sequence
  Description of Artificial Sequence: Synthetic polypeptide
SEECIACTNPIAYEEQYGSVSENLMNRGDDRW

SEQ ID NO: 131858 - protein, 31 aa, Artificial Sequence
  Description of Artificial Sequence: Synthetic polypeptide
SEECIACTNPIAYEEQYGSVSENLMRGDDLM

SEQ ID NO: 131859 - protein, 31 aa, Artificial Sequence
  Description of Artificial Sequence: Synthetic polypeptide
SEECIACTNPIAYEEQYGSVSENLMRGDGMD

SEQ ID NO: 131860 - protein, 31 aa, Artificial Sequence
  Description of Artificial Sequence: Synthetic polypeptide
SEECIACTNPIAYEEQYGSVSENNLMRGDDD

SEQ ID NO: 131861 - protein, 36 aa, Artificial Sequence
  Description of Artificial Sequence: Synthetic polypeptide
DEEEIRTTNPVATEVYGSVSSTTPAGPNMRNGMNPC

SEQ ID NO: 131862 - protein, 36 aa, Artificial Sequence
  Description of Artificial Sequence: Synthetic polypeptide
DEEEIRTTNPVATEVYGSVSSTTPAGPNMRNGMNPD

SEQ ID NO: 131863 - protein, 36 aa, Artificial Sequence
  Description of Artificial Sequence: Synthetic polypeptide
DEEEIRTTNPVATEVYGSVSSTTPAGPNMRNGMNPV

SEQ ID NO: 131864 - protein, 36 aa, Artificial Sequence
  Description of Artificial Sequence: Synthetic polypeptide
DEEEIRTTNPVATEVYGSVSSTTPAGPNPRNGMNPV

SEQ ID NO: 131865 - protein, 35 aa, Artificial Sequence
  Description of Artificial Sequence: Synthetic polypeptide
DEEEIRTTNPVATEQYGSASSTEACPQMRNEMEPV

SEQ ID NO: 131866 - protein, 37 aa, Artificial Sequence
  Description of Artificial Sequence: Synthetic polypeptide
AEEEIRTTNPVATEQYGSVSTVTNNNQQGNDEQNEED

SEQ ID NO: 131867 - protein, 37 aa, Artificial Sequence
  Description of Artificial Sequence: Synthetic polypeptide
DEETIRTTNPVATEQYGTVSTVVSTNNNLQQGDEEDE

SEQ ID NO: 131868 - protein, 34 aa, Artificial Sequence
  Description of Artificial Sequence: Synthetic polypeptide
DEEEIRTTNPVATEQYGSASSEAGPQMHNGMEPV

SEQ ID NO: 131869 - protein, 36 aa, Artificial Sequence
  Description of Artificial Sequence: Synthetic polypeptide
DEEEIRTTNPVATEQYGSASSATNEDTQVENDEEQI

SEQ ID NO: 131870 - protein, 36 aa, Artificial Sequence
  Description of Artificial Sequence: Synthetic polypeptide
DEETIRTTNPVATEQYGTVSTVNTNNQLQQGDEEEE

SEQ ID NO: 131871 - protein, 35 aa, Artificial Sequence
  Description of Artificial Sequence: Synthetic polypeptide
DEEEIRTTNPVATEQYGSASSAMNEDGQAENDEKQ

SEQ ID NO: 131872 - protein, 37 aa, Artificial Sequence
  Description of Artificial Sequence: Synthetic polypeptide
AEEEIRTTNPVATEQYGSVSTVTNNNQQEEEGNNNTT

SEQ ID NO: 131873 - protein, 35 aa, Artificial Sequence
  Description of Artificial Sequence: Synthetic polypeptide
DEEEIRTTNPVATEQYGSASPVTSVIPRSEVLGIG

SEQ ID NO: 131874 - protein, 37 aa, Artificial Sequence
  Description of Artificial Sequence: Synthetic polypeptide
AEEEIRTTNPVATEQYGSVSTVTNNNQQQQIGTNEGE

SEQ ID NO: 131875 - protein, 35 aa, Artificial Sequence
  Description of Artificial Sequence: Synthetic polypeptide
DEEEIRTTNPVATEQYGSAQQVMNELQEVSELANL

SEQ ID NO: 131876 - protein, 33 aa, Artificial Sequence
  Description of Artificial Sequence: Synthetic polypeptide
DEEEIRCTNPVATEQYGCVCSWEPDGFGSDNQA

SEQ ID NO: 131877 - protein, 37 aa, Artificial Sequence
  Description of Artificial Sequence: Synthetic polypeptide
DEETIRTTNPVATEQYGVVSTVVNNLQAGNNNQDEGD

SEQ ID NO: 131878 - protein, 33 aa, Artificial Sequence
  Description of Artificial Sequence: Synthetic polypeptide
DEEVIACTNPVATEQYGSVSTDHGPLGAPGGET

SEQ ID NO: 131879 - protein, 36 aa, Artificial Sequence
  Description of Artificial Sequence: Synthetic polypeptide
DEEEIRTTNPVATETYGSCSNRENDLSQTIGENNEP

SEQ ID NO: 131880 - protein, 37 aa, Artificial Sequence
  Description of Artificial Sequence: Synthetic polypeptide
DEEEIRTTNPVATEQYGSAVSSTTPAGPNMRNGMNPG

SEQ ID NO: 131881 - protein, 32 aa, Artificial Sequence
  Description of Artificial Sequence: Synthetic polypeptide
DEEVIACTNPVATEQYGCVATVGLPDNEQNPR

SEQ ID NO: 131882 - protein, 34 aa, Artificial Sequence
  Description of Artificial Sequence: Synthetic polypeptide
DEAEIATTNPVATEPYGCVCPTNDLQDQDGQSNQ

SEQ ID NO: 131883 - protein, 32 aa, Artificial Sequence
  Description of Artificial Sequence: Synthetic polypeptide
DEEVIACTNPVATEQYGCVATNLPDNNEQNHV

SEQ ID NO: 131884 - protein, 31 aa, Artificial Sequence
  Description of Artificial Sequence: Synthetic polypeptide
SEAEIATTNPVAYEQWGSVAGNGGQNAGNSD

SEQ ID NO: 131885 - protein, 37 aa, Artificial Sequence
  Description of Artificial Sequence: Synthetic polypeptide
DEEEIRTTNPVATEQYGSAVSSATPAGPNMRNGMNPV

SEQ ID NO: 131886 - protein, 34 aa, Artificial Sequence
  Description of Artificial Sequence: Synthetic polypeptide
SEAEIATTNPVAYEQYGSVAGTNLQDTPDGNDNN

SEQ ID NO: 131887 - protein, 37 aa, Artificial Sequence
  Description of Artificial Sequence: Synthetic polypeptide
DEEEIRTTNPVATEQYGSAVSSTTPAGPNMRNGMNPV

SEQ ID NO: 131888 - protein, 35 aa, Artificial Sequence
  Description of Artificial Sequence: Synthetic polypeptide
DEEEIRTTNPVATEQYGSAVSPWNQMEFQQQVSEE

SEQ ID NO: 131889 - protein, 31 aa, Artificial Sequence
  Description of Artificial Sequence: Synthetic polypeptide
SEAEIATTNPVAYEQYGSVATHLEADNQNQD

SEQ ID NO: 131890 - protein, 36 aa, Artificial Sequence
  Description of Artificial Sequence: Synthetic polypeptide
AEEEIRTTNPVATEQYGSVSTVTNQENSENGNNNTE

SEQ ID NO: 131891 - protein, 36 aa, Artificial Sequence
  Description of Artificial Sequence: Synthetic polypeptide
AEEEIRTTNPVATEQYGSVSTVTNQAGTESGTNEAG

SEQ ID NO: 131892 - protein, 36 aa, Artificial Sequence
  Description of Artificial Sequence: Synthetic polypeptide
DEEEIRTTNPVATEQYGSAVSMSNEDEQQEWNDEQD

SEQ ID NO: 131893 - protein, 35 aa, Artificial Sequence
  Description of Artificial Sequence: Synthetic polypeptide
DEEEIRTTNPVATEQYGSAVSAMNEDESTENDEKQ

SEQ ID NO: 131894 - protein, 36 aa, Artificial Sequence
  Description of Artificial Sequence: Synthetic polypeptide
AEEEIRTTNPVATEQYGSVSTVTNQAGTEIGTNEEE

SEQ ID NO: 131895 - protein, 37 aa, Artificial Sequence
  Description of Artificial Sequence: Synthetic polypeptide
AEEEIRTTNPVATEQYGSVSTVTNNQSSTESGTNNIG

SEQ ID NO: 131896 - protein, 34 aa, Artificial Sequence
  Description of Artificial Sequence: Synthetic polypeptide
DEETITTTNPVATEFYGSVNTDNTGEQDEDGGNI

SEQ ID NO: 131897 - protein, 37 aa, Artificial Sequence
  Description of Artificial Sequence: Synthetic polypeptide
AEEEIRTTNPVATEQYGSVSTVTNNQQQQGNNNNTDN

SEQ ID NO: 131898 - protein, 32 aa, Artificial Sequence
  Description of Artificial Sequence: Synthetic polypeptide
DEEEIRCTNPVATEQYGCVCSSEHQNFFSEQP

SEQ ID NO: 131899 - protein, 33 aa, Artificial Sequence
  Description of Artificial Sequence: Synthetic polypeptide
DEEEIRCTNPVATEQYGCVCSNWNHDHGSDTQS

SEQ ID NO: 131900 - protein, 36 aa, Artificial Sequence
  Description of Artificial Sequence: Synthetic polypeptide
AEEEIRTTNPVATEQYGSVSTVTNQLGDEEGTTEDE

SEQ ID NO: 131901 - protein, 37 aa, Artificial Sequence
  Description of Artificial Sequence: Synthetic polypeptide
AEEEIRTTNPVATEQYGSVSTVTNQLNNNDEGTNVTN

SEQ ID NO: 131902 - protein, 34 aa, Artificial Sequence
  Description of Artificial Sequence: Synthetic polypeptide
DEEVIATTNPVAYEQWGTVCSTNDLHDQNGQNEQ

SEQ ID NO: 131903 - protein, 34 aa, Artificial Sequence
  Description of Artificial Sequence: Synthetic polypeptide
DEEVIATTNPVAYEQWGTVCSTNDLHDNGGQNQR

SEQ ID NO: 131904 - protein, 35 aa, Artificial Sequence
  Description of Artificial Sequence: Synthetic polypeptide
DEEEIRTTNPVATEQYGSAYGVTCNEDQVENDEDQ

SEQ ID NO: 131905 - protein, 37 aa, Artificial Sequence
  Description of Artificial Sequence: Synthetic polypeptide
AEEEIRTTNPVATEQYGSVSTVTNQNNQDEQGNNEEI

SEQ ID NO: 131906 - protein, 34 aa, Artificial Sequence
  Description of Artificial Sequence: Synthetic polypeptide
DDEEIRTTNPVATEQYGSVTDDQLIGDNEGQEQE

SEQ ID NO: 131907 - protein, 34 aa, Artificial Sequence
  Description of Artificial Sequence: Synthetic polypeptide
DEAEIATTNPVATEPYGSVCQTNDLNQDEGGDDQ

SEQ ID NO: 131908 - protein, 34 aa, Artificial Sequence
  Description of Artificial Sequence: Synthetic polypeptide
DEAEIATTNPVATEPYGSVCPTDNDNNDEGGNGR

SEQ ID NO: 131909 - protein, 35 aa, Artificial Sequence
  Description of Artificial Sequence: Synthetic polypeptide
DEEEIRTTNPVATEQYGSAWYSGEPLDQADIENGQ

SEQ ID NO: 131910 - protein, 35 aa, Artificial Sequence
  Description of Artificial Sequence: Synthetic polypeptide
DDEEIRTTNPVATEQYGSVTDTGGEDEQGENGNND

SEQ ID NO: 131911 - protein, 35 aa, Artificial Sequence
  Description of Artificial Sequence: Synthetic polypeptide
DEAEIATTNPVATEPYGSVCFTNDQNQDEGGQNDR

SEQ ID NO: 131912 - protein, 35 aa, Artificial Sequence
  Description of Artificial Sequence: Synthetic polypeptide
DDEEIRTTNPVATEQYGSVTDTTGDEQGGGNGNND

SEQ ID NO: 131913 - protein, 33 aa, Artificial Sequence
  Description of Artificial Sequence: Synthetic polypeptide
SEAEIACTNPVATEQYGSCAAATNLQDGAGTNQ

SEQ ID NO: 131914 - protein, 37 aa, Artificial Sequence
  Description of Artificial Sequence: Synthetic polypeptide
AEEEIRTTNPVATEQYGSVSTVTNQNNNQEIGNNTED

SEQ ID NO: 131915 - protein, 34 aa, Artificial Sequence
  Description of Artificial Sequence: Synthetic polypeptide
DEEEIRTTNPVATEQYGSAVVTLVSHFENSQEES

SEQ ID NO: 131916 - protein, 33 aa, Artificial Sequence
  Description of Artificial Sequence: Synthetic polypeptide
SEAEIACTNPVATEQYGSVCATNLQALAEATRN

SEQ ID NO: 131917 - protein, 32 aa, Artificial Sequence
  Description of Artificial Sequence: Synthetic polypeptide
SEAEIACTNPVATEQYGSVCSTNPLHDSLDHQ

SEQ ID NO: 131918 - protein, 35 aa, Artificial Sequence
  Description of Artificial Sequence: Synthetic polypeptide
DEEVIATTNPVATEMYGCSVVSTNAHSDNTGQNNR

SEQ ID NO: 131919 - protein, 31 aa, Artificial Sequence
  Description of Artificial Sequence: Synthetic polypeptide
SEAEIACTNPVAYEQYGEASCENLSQVVGGR

SEQ ID NO: 131920 - protein, 37 aa, Artificial Sequence
  Description of Artificial Sequence: Synthetic polypeptide
AEEEIRTTNPVATEQYGSVSTVTNQNDTNLQGTNNQD

SEQ ID NO: 131921 - protein, 35 aa, Artificial Sequence
  Description of Artificial Sequence: Synthetic polypeptide
SEAEIATTNPVATEQYGSVANANNLPQEAPGENAR

SEQ ID NO: 131922 - protein, 32 aa, Artificial Sequence
  Description of Artificial Sequence: Synthetic polypeptide
DEEVIATTNPDATEGYGSCSTPLARYGMEDDD

SEQ ID NO: 131923 - protein, 37 aa, Artificial Sequence
  Description of Artificial Sequence: Synthetic polypeptide
AEEEIRTTNPVATEQYGSVSTVTNNQQQLGNNNVEQL

SEQ ID NO: 131924 - protein, 29 aa, Artificial Sequence
  Description of Artificial Sequence: Synthetic peptide
SEDCIACTNPTYYEAYGSVASNLNRGNER

SEQ ID NO: 131925 - protein, 36 aa, Artificial Sequence
  Description of Artificial Sequence: Synthetic polypeptide
AEEEIRTTNPVATEQYGSVSTVTNNQQNQQAINTTE

SEQ ID NO: 131926 - protein, 36 aa, Artificial Sequence
  Description of Artificial Sequence: Synthetic polypeptide
DEEEIRTTNPVATETYGSVSSTTPAGPNMRNGMNPV

SEQ ID NO: 131927 - protein, 30 aa, Artificial Sequence
  Description of Artificial Sequence: Synthetic polypeptide
SECEICATNPCTTEIYGVVSTNSTLQEGDI

SEQ ID NO: 131928 - protein, 29 aa, Artificial Sequence
  Description of Artificial Sequence: Synthetic peptide
SECEICATNPCTTEIYGVVSTSALQSGDI

SEQ ID NO: 131929 - protein, 29 aa, Artificial Sequence
  Description of Artificial Sequence: Synthetic peptide
SECEICATNPCTTEIYGVVSTSGLQNGDG

SEQ ID NO: 131930 - protein, 30 aa, Artificial Sequence
  Description of Artificial Sequence: Synthetic polypeptide
SECEICATNPCTTEIYGVVSTSQNLQNGDE

SEQ ID NO: 131931 - protein, 30 aa, Artificial Sequence
  Description of Artificial Sequence: Synthetic polypeptide
SECEICATNPCTTEIYGVVSTSTLQNGDNA

SEQ ID NO: 131932 - protein, 30 aa, Artificial Sequence
  Description of Artificial Sequence: Synthetic polypeptide
SECEICATNPCTTEIYGVVSTSTLQNGNDS

SEQ ID NO: 131933 - protein, 38 aa, Artificial Sequence
  Description of Artificial Sequence: Synthetic polypeptide
DEETIRTTNPVATEQYGVVSTVVSTNNNNLQQIGDNVT

SEQ ID NO: 131934 - protein, 29 aa, Artificial Sequence
  Description of Artificial Sequence: Synthetic peptide
SECEICATNPCTTEIYGVVSTSTLQNGTE

SEQ ID NO: 131935 - protein, 38 aa, Artificial Sequence
  Description of Artificial Sequence: Synthetic polypeptide
DEETIRTTNPVATEQYGVVSTVVSTNNNLNQQGDEENE

SEQ ID NO: 131936 - protein, 34 aa, Artificial Sequence
  Description of Artificial Sequence: Synthetic polypeptide
DEAEIATTNPVATEHYGCVVCTDNHDQDGDNNER

SEQ ID NO: 131937 - protein, 37 aa, Artificial Sequence
  Description of Artificial Sequence: Synthetic polypeptide
AEEEIRTTNPVATEQYGSVSTVTNNQNNTEQGNNTED

SEQ ID NO: 131938 - protein, 37 aa, Artificial Sequence
  Description of Artificial Sequence: Synthetic polypeptide
AEEEIRTTNPVATEQYGSVSTVTNNQNNQNEGNNQED

SEQ ID NO: 131939 - protein, 37 aa, Artificial Sequence
  Description of Artificial Sequence: Synthetic polypeptide
DEETIRTTNPVATEQYGVVSTVVSNNNNLQQIGENVE

SEQ ID NO: 131940 - protein, 36 aa, Artificial Sequence
  Description of Artificial Sequence: Synthetic polypeptide
AEEEIRTTNPVATEQYGSVSTVTNNQNNQDEATNED

SEQ ID NO: 131941 - protein, 37 aa, Artificial Sequence
  Description of Artificial Sequence: Synthetic polypeptide
DEETIRTTNPVATEQYGVVSTVVSNLQAGNNQEDEQD

SEQ ID NO: 131942 - protein, 37 aa, Artificial Sequence
  Description of Artificial Sequence: Synthetic polypeptide
DEETIRTTNPVATEQYGVVSTVVSNLQAGNNNQDEQE

SEQ ID NO: 131943 - protein, 31 aa, Artificial Sequence
  Description of Artificial Sequence: Synthetic polypeptide
SECHIRPTNPIATEQYGAVPVEMNGMRGNDR

SEQ ID NO: 131944 - protein, 36 aa, Artificial Sequence
  Description of Artificial Sequence: Synthetic polypeptide
DEETIRTTNPVATEQYGVVSTVVNNLQLQQGTEESE

SEQ ID NO: 131945 - protein, 37 aa, Artificial Sequence
  Description of Artificial Sequence: Synthetic polypeptide
DEETIRTTNPVATEQYGVVSTVVNNLQAGNNQQQEED

SEQ ID NO: 131946 - protein, 37 aa, Artificial Sequence
  Description of Artificial Sequence: Synthetic polypeptide
DEETIRTTNPVATEQYGVVSTVVNNLQAGNNQQDEDE

SEQ ID NO: 131947 - protein, 29 aa, Artificial Sequence
  Description of Artificial Sequence: Synthetic peptide
SECEICSTNPCTTEIYGVVSTGTLQNGDI

SEQ ID NO: 131948 - protein, 37 aa, Artificial Sequence
  Description of Artificial Sequence: Synthetic polypeptide
DEETIRTTNPVATEQYGVVSTVVTNLQAGNNQQDESD

SEQ ID NO: 131949 - protein, 37 aa, Artificial Sequence
  Description of Artificial Sequence: Synthetic polypeptide
DEETIRTTNPVATEQYGVVSTVVTNLQSGNNQQDEQA

SEQ ID NO: 131950 - protein, 32 aa, Artificial Sequence
  Description of Artificial Sequence: Synthetic polypeptide
SECEIATTNPVAYEGWGSVATNLQGDTGGNQI

SEQ ID NO: 131951 - protein, 37 aa, Artificial Sequence
  Description of Artificial Sequence: Synthetic polypeptide
AEEEIRTTNPVATEQYGSVSTVTNNQQGNADEAGNED

SEQ ID NO: 131952 - protein, 37 aa, Artificial Sequence
  Description of Artificial Sequence: Synthetic polypeptide
AEEEIRTTNPVATEQYGSVSTVTNNQQGDEEGNTEDT

SEQ ID NO: 131953 - protein, 33 aa, Artificial Sequence
  Description of Artificial Sequence: Synthetic polypeptide
SEAEIRCTNPVATEQYGSVYCTWNDQHHQGHDQ

SEQ ID NO: 131954 - protein, 37 aa, Artificial Sequence
  Description of Artificial Sequence: Synthetic polypeptide
AEEEIRTTNPVATEQYGSVSTVTNNQQANQEGTNTNE

SEQ ID NO: 131955 - protein, 34 aa, Artificial Sequence
  Description of Artificial Sequence: Synthetic polypeptide
DEAEIATTNPVATENYGSVSGGNAGNAGGNDNQR

SEQ ID NO: 131956 - protein, 34 aa, Artificial Sequence
  Description of Artificial Sequence: Synthetic polypeptide
DEEEIRCTNPVATEQYGCVCSTEHQENFNSETQS

SEQ ID NO: 131957 - protein, 37 aa, Artificial Sequence
  Description of Artificial Sequence: Synthetic polypeptide
DEEEIRTTNPVATEQYGSAVPSPTTGENTSVGEENQF

SEQ ID NO: 131958 - protein, 34 aa, Artificial Sequence
  Description of Artificial Sequence: Synthetic polypeptide
DDEEIRTTNPVATEQYGSVVNMDNIGLGEGGGIS

SEQ ID NO: 131959 - protein, 35 aa, Artificial Sequence
  Description of Artificial Sequence: Synthetic polypeptide
DEEEIRTTNPVATEQYGSAVPPANMVVELEVEGPS

SEQ ID NO: 131960 - protein, 35 aa, Artificial Sequence
  Description of Artificial Sequence: Synthetic polypeptide
SEAEIRTTNPVATEQYGSVISVTHDLQTGGSEQML

SEQ ID NO: 131961 - protein, 37 aa, Artificial Sequence
  Description of Artificial Sequence: Synthetic polypeptide
DEETIRTTNPVATEQYGVVVTVVSTNQLQQIGTNSEE

SEQ ID NO: 131962 - protein, 37 aa, Artificial Sequence
  Description of Artificial Sequence: Synthetic polypeptide
DEETIRTTNPVATEQYGVVVTVVSTNQLQQIGTNQEQ

SEQ ID NO: 131963 - protein, 35 aa, Artificial Sequence
  Description of Artificial Sequence: Synthetic polypeptide
SEAEIRTTNPVATEQYGSVISVTHDLTTGGSEQRT

SEQ ID NO: 131964 - protein, 37 aa, Artificial Sequence
  Description of Artificial Sequence: Synthetic polypeptide
DEETIRTTNPVATEQYGVVSVVTNQQLQQNGNNDEED

SEQ ID NO: 131965 - protein, 36 aa, Artificial Sequence
  Description of Artificial Sequence: Synthetic polypeptide
DEETIRTTNPVATEQYGVVSVTVTQQLQAGNNEEEA

SEQ ID NO: 131966 - protein, 37 aa, Artificial Sequence
  Description of Artificial Sequence: Synthetic polypeptide
DEETIRTTNPVATEQYGVVSVTVNQQLQAGTNNEEQD

SEQ ID NO: 131967 - protein, 37 aa, Artificial Sequence
  Description of Artificial Sequence: Synthetic polypeptide
DEETIRTTNPVATEQYGVVSVTTNQQLQQGTNNDEED

SEQ ID NO: 131968 - protein, 37 aa, Artificial Sequence
  Description of Artificial Sequence: Synthetic polypeptide
AEEEIRTTNPVATEQYGSVSTVTNNQNQQGENGNNED

SEQ ID NO: 131969 - protein, 37 aa, Artificial Sequence
  Description of Artificial Sequence: Synthetic polypeptide
AEEEIRTTNPVATEQYGSVSTVTNNQNQNIIGTNTDE

SEQ ID NO: 131970 - protein, 32 aa, Artificial Sequence
  Description of Artificial Sequence: Synthetic polypeptide
SEAVEIATTNPVAYEGWGSVATNLQGDTGGNQ

SEQ ID NO: 131971 - protein, 32 aa, Artificial Sequence
  Description of Artificial Sequence: Synthetic polypeptide
SECAEIATTNPVAYEGWGSVATNLQGDTGGNE

SEQ ID NO: 131972 - protein, 37 aa, Artificial Sequence
  Description of Artificial Sequence: Synthetic polypeptide
AEEEIRTTNPVATEQYGSVSTVTNNQQNGTEAGNEDS

SEQ ID NO: 131973 - protein, 35 aa, Artificial Sequence
  Description of Artificial Sequence: Synthetic polypeptide
DEEEIRTTNPVATEQYGQISCCGSNVSQGPGGSYR

SEQ ID NO: 131974 - protein, 37 aa, Artificial Sequence
  Description of Artificial Sequence: Synthetic polypeptide
AEEEIRTTNPVATEQYGSVSTVTNNNNQQQIGTNTEE

SEQ ID NO: 131975 - protein, 36 aa, Artificial Sequence
  Description of Artificial Sequence: Synthetic polypeptide
DEEEIRTTNPVATEVYGSVTDGEGNLNQEENGGNIQ

SEQ ID NO: 131976 - protein, 36 aa, Artificial Sequence
  Description of Artificial Sequence: Synthetic polypeptide
DEEEIRTTNPVATFQYGSVSSTTPAGPNMHNGMNPV

SEQ ID NO: 131977 - protein, 36 aa, Artificial Sequence
  Description of Artificial Sequence: Synthetic polypeptide
DEEEIRTTNPVATFQYGSVSSTTPAGPNMRNGMNPV

SEQ ID NO: 131978 - protein, 33 aa, Artificial Sequence
  Description of Artificial Sequence: Synthetic polypeptide
SEEEIACTNPVATEQYGSVCSMTNPLHDSLDHL

SEQ ID NO: 131979 - protein, 33 aa, Artificial Sequence
  Description of Artificial Sequence: Synthetic polypeptide
DEAEIACTNPVAYEQYGSVATNLQAHGGDLEAM

SEQ ID NO: 131980 - protein, 37 aa, Artificial Sequence
  Description of Artificial Sequence: Synthetic polypeptide
AEEEIRTTNPVATEQYGSVSTVTNGEQQGNQQGNNTE

SEQ ID NO: 131981 - protein, 33 aa, Artificial Sequence
  Description of Artificial Sequence: Synthetic polypeptide
DEEEIRGTNPVATEQWGDVVSTLLILGGGQDGD

SEQ ID NO: 131982 - protein, 36 aa, Artificial Sequence
  Description of Artificial Sequence: Synthetic polypeptide
AEEEIRTTNPVATEQYGSVSTVTNDNQQLGTEEGTE

SEQ ID NO: 131983 - protein, 37 aa, Artificial Sequence
  Description of Artificial Sequence: Synthetic polypeptide
AEEEIRTTNPVATEQYGSVSTVTNDNQQGNTEENNTD

SEQ ID NO: 131984 - protein, 37 aa, Artificial Sequence
  Description of Artificial Sequence: Synthetic polypeptide
DEEEIRTTNPVATEQYGQSVSSTTPAGPNMRNGMNPV

SEQ ID NO: 131985 - protein, 32 aa, Artificial Sequence
  Description of Artificial Sequence: Synthetic polypeptide
SEEEIACTNPVATEQYGSVCATNPLHDSLDAQ

SEQ ID NO: 131986 - protein, 37 aa, Artificial Sequence
  Description of Artificial Sequence: Synthetic polypeptide
DEEEIRTTNPVATEQYGQSVSSTTPAGPNMRNGMNPQ

SEQ ID NO: 131987 - protein, 37 aa, Artificial Sequence
  Description of Artificial Sequence: Synthetic polypeptide
DEEEIRTTNPVATEQYGQSVSSTTPAGPNMRNGDNPV

SEQ ID NO: 131988 - protein, 37 aa, Artificial Sequence
  Description of Artificial Sequence: Synthetic polypeptide
DEEEIRTTNPVATEQYGQSVSSTTPAGINMRNGMNPV

SEQ ID NO: 131989 - protein, 35 aa, Artificial Sequence
  Description of Artificial Sequence: Synthetic polypeptide
DEEEIRGTNPVATEQWGITSVSTLGIQRGGGQDGD

SEQ ID NO: 131990 - protein, 36 aa, Artificial Sequence
  Description of Artificial Sequence: Synthetic polypeptide
AEEEIRTTNPVATEQYGSVSTVTLNNDEQGTNNVTE

SEQ ID NO: 131991 - protein, 36 aa, Artificial Sequence
  Description of Artificial Sequence: Synthetic polypeptide
DEEEIRTTNPVATGQYGSVSSTTPAGPNMRNGMNPV

SEQ ID NO: 131992 - protein, 37 aa, Artificial Sequence
  Description of Artificial Sequence: Synthetic polypeptide
AEEEIRTTNPVATEQYGSVSTVTGNQAGNQQGNNGGD

SEQ ID NO: 131993 - protein, 38 aa, Artificial Sequence
  Description of Artificial Sequence: Synthetic polypeptide
AEEEIRTTNPVATEQYGSVSTVTGNLEQGTEQGTNEDQ

SEQ ID NO: 131994 - protein, 29 aa, Artificial Sequence
  Description of Artificial Sequence: Synthetic peptide
SEEEIASTNPISTEGYGNVAETIQRVGQR

SEQ ID NO: 131995 - protein, 35 aa, Artificial Sequence
  Description of Artificial Sequence: Synthetic polypeptide
DEEEIRGTNPVATEQWGSSIVSNTLGIERGGGNED

SEQ ID NO: 131996 - protein, 33 aa, Artificial Sequence
  Description of Artificial Sequence: Synthetic polypeptide
SEEEIACTNPVATESYGCVATNLQEAPGGNDDQ

SEQ ID NO: 131997 - protein, 33 aa, Artificial Sequence
  Description of Artificial Sequence: Synthetic polypeptide
DEETIRTTNPVATEQWGAVMEVENLQVLQVNEF

SEQ ID NO: 131998 - protein, 33 aa, Artificial Sequence
  Description of Artificial Sequence: Synthetic polypeptide
DEETIRTTNPVATEQWGAVMEVENLQVLQVNWD

SEQ ID NO: 131999 - protein, 33 aa, Artificial Sequence
  Description of Artificial Sequence: Synthetic polypeptide
SEEEIACTNPVATEQYGSVCATGGLDEADNNRN

SEQ ID NO: 132000 - protein, 35 aa, Artificial Sequence
  Description of Artificial Sequence: Synthetic polypeptide
DEETIRTTNPVATEQWGSVATTNNNNQLAGNNTTE

SEQ ID NO: 132001 - protein, 36 aa, Artificial Sequence
  Description of Artificial Sequence: Synthetic polypeptide
DEEEIRTTNPVATEQYGQVSSTTQAGPNMRNGMNPV

SEQ ID NO: 132002 - protein, 36 aa, Artificial Sequence
  Description of Artificial Sequence: Synthetic polypeptide
DEEEIRTTNPVATEQYGQVSSTTPAGPNMPNGMNPV

SEQ ID NO: 132003 - protein, 36 aa, Artificial Sequence
  Description of Artificial Sequence: Synthetic polypeptide
DEEEIRTTNPVATEYYGSVSSTTPAGPNMRNGYNPV

SEQ ID NO: 132004 - protein, 37 aa, Artificial Sequence
  Description of Artificial Sequence: Synthetic polypeptide
AEEEIRTTNPVATEQYGSVSTVTNLNQQQNIGTDESN

SEQ ID NO: 132005 - protein, 37 aa, Artificial Sequence
  Description of Artificial Sequence: Synthetic polypeptide
AEEEIRTTNPVATEQYGSVSTVTNLNNSTEQGTNEEE

SEQ ID NO: 132006 - protein, 34 aa, Artificial Sequence
  Description of Artificial Sequence: Synthetic polypeptide
DEEEIRTTNPVATEYYGSVSTGDGEGQGEEFEEQ

SEQ ID NO: 132007 - protein, 37 aa, Artificial Sequence
  Description of Artificial Sequence: Synthetic polypeptide
AEEEIRTTNPVATEQYGSVSTVTNLNDTNLGGNNNLI

SEQ ID NO: 132008 - protein, 37 aa, Artificial Sequence
  Description of Artificial Sequence: Synthetic polypeptide
AEEEIRTTNPVATEQYGSVSTVTNLLQNQNIGTDESG

SEQ ID NO: 132009 - protein, 37 aa, Artificial Sequence
  Description of Artificial Sequence: Synthetic polypeptide
DEEEIRTTNPVATEQYGQSVSYTTPAGPNMRNGMNPV

SEQ ID NO: 132010 - protein, 33 aa, Artificial Sequence
  Description of Artificial Sequence: Synthetic polypeptide
DEEEIRGTNPVATECYGAMSTGNGEEDGDTNEG

SEQ ID NO: 132011 - protein, 37 aa, Artificial Sequence
  Description of Artificial Sequence: Synthetic polypeptide
AEEEIRTTNPVATEQYGSVSTVTNISTTEQYGSNNYG

SEQ ID NO: 132012 - protein, 37 aa, Artificial Sequence
  Description of Artificial Sequence: Synthetic polypeptide
AEEEIRTTNPVATEQYGSVSTVTNGQLGNTEAGNNLG

SEQ ID NO: 132013 - protein, 37 aa, Artificial Sequence
  Description of Artificial Sequence: Synthetic polypeptide
AEEEIRTTNPVATEQYGSVSTVTNGQANGTEAGNEDE

SEQ ID NO: 132014 - protein, 37 aa, Artificial Sequence
  Description of Artificial Sequence: Synthetic polypeptide
AEEEIRTTNPVATEQYGSVSTVTNGNQQNEIGNNDET

SEQ ID NO: 132015 - protein, 37 aa, Artificial Sequence
  Description of Artificial Sequence: Synthetic polypeptide
AEEEIRTTNPVATEQYGSVSTVTNGNQQAGTNNNEQE

SEQ ID NO: 132016 - protein, 32 aa, Artificial Sequence
  Description of Artificial Sequence: Synthetic polypeptide
DEAEIACTNPVAYEQYGSVATNLQVIDPDDLH

SEQ ID NO: 132017 - protein, 36 aa, Artificial Sequence
  Description of Artificial Sequence: Synthetic polypeptide
AEEEIRTTNPVATEQYGSVSTVTNGNNNDEGNNNSD

SEQ ID NO: 132018 - protein, 33 aa, Artificial Sequence
  Description of Artificial Sequence: Synthetic polypeptide
SEEEIACTNPVATEQYGSVATNNEETRGGQDQT

SEQ ID NO: 132019 - protein, 36 aa, Artificial Sequence
  Description of Artificial Sequence: Synthetic polypeptide
AEEEIRTTNPVATEQYGSVSTVTNGGNNDEGTNNSD

SEQ ID NO: 132020 - protein, 33 aa, Artificial Sequence
  Description of Artificial Sequence: Synthetic polypeptide
SEEEIACTNPVATEQYGSVATVNHQAEDPHNDQ

SEQ ID NO: 132021 - protein, 33 aa, Artificial Sequence
  Description of Artificial Sequence: Synthetic polypeptide
DDEEISTTNPVATCQYGCVCSTENPIHFGSNQA

SEQ ID NO: 132022 - protein, 36 aa, Artificial Sequence
  Description of Artificial Sequence: Synthetic polypeptide
DEEEIRTTNPVATEYYGSVSSTTPAGPNMRNGMNPV

SEQ ID NO: 132023 - protein, 36 aa, Artificial Sequence
  Description of Artificial Sequence: Synthetic polypeptide
DEEEIRTTNPVATGQYGSVSSTTWAGPNMRNGMNPV

SEQ ID NO: 132024 - protein, 36 aa, Artificial Sequence
  Description of Artificial Sequence: Synthetic polypeptide
AEEEIRTTNPVATEQYGSVSTVTASEQGNTEAGNQM

SEQ ID NO: 132025 - protein, 34 aa, Artificial Sequence
  Description of Artificial Sequence: Synthetic polypeptide
DEAEIACTNPVATEQYGSVSGTGPPQEADGTARE

SEQ ID NO: 132026 - protein, 32 aa, Artificial Sequence
  Description of Artificial Sequence: Synthetic polypeptide
DEAEIACTNPVATEQYGSVCSVDPTANDMGGM

SEQ ID NO: 132027 - protein, 31 aa, Artificial Sequence
  Description of Artificial Sequence: Synthetic polypeptide
SEEEIASVNPVCTEQYGVVSWELQSGSNNQS

SEQ ID NO: 132028 - protein, 38 aa, Artificial Sequence
  Description of Artificial Sequence: Synthetic polypeptide
AEEEIRTTNPVATEQYGSVSTVTANLQAGNGEQGNNVE

SEQ ID NO: 132029 - protein, 37 aa, Artificial Sequence
  Description of Artificial Sequence: Synthetic polypeptide
AEEEIRTTNPVATEQYGSVSTVSVNQQASEEGTNVEQ

SEQ ID NO: 132030 - protein, 36 aa, Artificial Sequence
  Description of Artificial Sequence: Synthetic polypeptide
DEEEIRGTNPVATEQYGSVCTEASGQIERMMGMERL

SEQ ID NO: 132031 - protein, 33 aa, Artificial Sequence
  Description of Artificial Sequence: Synthetic polypeptide
DEAEIACTNPVATEQYGSVCATNLAGTGAEDGN

SEQ ID NO: 132032 - protein, 36 aa, Artificial Sequence
  Description of Artificial Sequence: Synthetic polypeptide
DEEEIRTTNPVATLQYGSVSSTFPAGPNMRNGMNPV

SEQ ID NO: 132033 - protein, 36 aa, Artificial Sequence
  Description of Artificial Sequence: Synthetic polypeptide
DEEEIRTTNPVATLQYGSVSSTTPAGPNMRNGMNPV

SEQ ID NO: 132034 - protein, 34 aa, Artificial Sequence
  Description of Artificial Sequence: Synthetic polypeptide
DEAEIACTNPVATEQYGSVVAAAANLPQEATGNL

SEQ ID NO: 132035 - protein, 35 aa, Artificial Sequence
  Description of Artificial Sequence: Synthetic polypeptide
DEEEIRGTNPVATEQYGSVDNGDNGQDEGGQNITL

SEQ ID NO: 132036 - protein, 34 aa, Artificial Sequence
  Description of Artificial Sequence: Synthetic polypeptide
DEEEIRGTNPVATEQYGSVISPTVEGAEVGTPEL

SEQ ID NO: 132037 - protein, 37 aa, Artificial Sequence
  Description of Artificial Sequence: Synthetic polypeptide
AEEEIRTTNPVATEQYGSVSTVSNNNQQGTNGTNAQD

SEQ ID NO: 132038 - protein, 28 aa, Artificial Sequence
  Description of Artificial Sequence: Synthetic peptide
SEEEIATTNPVATAQYGEAPEVCQHEEK

SEQ ID NO: 132039 - protein, 31 aa, Artificial Sequence
  Description of Artificial Sequence: Synthetic polypeptide
SEEEIATTNPVATASWGCVAGTNLARDGDQD

SEQ ID NO: 132040 - protein, 30 aa, Artificial Sequence
  Description of Artificial Sequence: Synthetic polypeptide
SEEEIATTNPVATASYGCVAGTNLAAPDQG

SEQ ID NO: 132041 - protein, 35 aa, Artificial Sequence
  Description of Artificial Sequence: Synthetic polypeptide
DEEEIRGTNPVATEQYGSVMSVVVQHDVQGAVSRN

SEQ ID NO: 132042 - protein, 31 aa, Artificial Sequence
  Description of Artificial Sequence: Synthetic polypeptide
SEEEIATTNPVATASYGCVAGTNLAPDPDQR

SEQ ID NO: 132043 - protein, 37 aa, Artificial Sequence
  Description of Artificial Sequence: Synthetic polypeptide
AEEEIRTTNPVATEQYGSVSTVSNNDQQGTNTTNDDD

SEQ ID NO: 132044 - protein, 37 aa, Artificial Sequence
  Description of Artificial Sequence: Synthetic polypeptide
AEEEIRTTNPVATEQYGSVSTVSNNDQQGTNTNNQQD

SEQ ID NO: 132045 - protein, 36 aa, Artificial Sequence
  Description of Artificial Sequence: Synthetic polypeptide
DEEEIRGTNPVATEQYGSVISGNLAEGGGQTEGETG

SEQ ID NO: 132046 - protein, 31 aa, Artificial Sequence
  Description of Artificial Sequence: Synthetic polypeptide
SEEEIASVNPVCTEQYGVVSWELQESGSNQG

SEQ ID NO: 132047 - protein, 36 aa, Artificial Sequence
  Description of Artificial Sequence: Synthetic polypeptide
DEEEIRTTNPVATHQYGSVSSTTPAGPNMRNGMNPV

SEQ ID NO: 132048 - protein, 36 aa, Artificial Sequence
  Description of Artificial Sequence: Synthetic polypeptide
DEEEIRTTNPVATHQYGSVSSRTPAGTNMRNGMNPV

SEQ ID NO: 132049 - protein, 37 aa, Artificial Sequence
  Description of Artificial Sequence: Synthetic polypeptide
DEEEIRGTNPVATEQWGYSNVSATNELQHERPGQGGS

SEQ ID NO: 132050 - protein, 35 aa, Artificial Sequence
  Description of Artificial Sequence: Synthetic polypeptide
DEEEIRGTNPVATEQYGAIWSLTINHGQGEGNQNV

SEQ ID NO: 132051 - protein, 32 aa, Artificial Sequence
  Description of Artificial Sequence: Synthetic polypeptide
DDEEISTTNPVATCQYGCVCSTGNPTNFGSDQ

SEQ ID NO: 132052 - protein, 33 aa, Artificial Sequence
  Description of Artificial Sequence: Synthetic polypeptide
DDEEISTTNPVATCQYGCVCSTNPIERFGSDQS

SEQ ID NO: 132053 - protein, 32 aa, Artificial Sequence
  Description of Artificial Sequence: Synthetic polypeptide
DDEEISTTNPVATCQYGCVCSTNPIGFGSDQA

SEQ ID NO: 132054 - protein, 33 aa, Artificial Sequence
  Description of Artificial Sequence: Synthetic polypeptide
DDEEISTTNPVATCQYGCVCSTNPINFGSNNQN

SEQ ID NO: 132055 - protein, 37 aa, Artificial Sequence
  Description of Artificial Sequence: Synthetic polypeptide
AEEEIRTTNPVATEQYGSVSTVTANQQGNQQGNNNGD

SEQ ID NO: 132056 - protein, 31 aa, Artificial Sequence
  Description of Artificial Sequence: Synthetic polypeptide
SEEEIASVNPVCTEQYGVVCSDNHQESGSNQ

SEQ ID NO: 132057 - protein, 30 aa, Artificial Sequence
  Description of Artificial Sequence: Synthetic polypeptide
SEEEIASVNPVCTEQYGVVCSWELQSFGEQ

SEQ ID NO: 132058 - protein, 35 aa, Artificial Sequence
  Description of Artificial Sequence: Synthetic polypeptide
DEETIRATNPVATEQYGVVSTVTNQQQQQGNNQDE

SEQ ID NO: 132059 - protein, 31 aa, Artificial Sequence
  Description of Artificial Sequence: Synthetic polypeptide
SEEEIASVNPVCTEQYGVVCSWELQSSGNQA

SEQ ID NO: 132060 - protein, 36 aa, Artificial Sequence
  Description of Artificial Sequence: Synthetic polypeptide
DEETIRATNPVATEQYGVVSTVTNLQQQQNGNQQDE

SEQ ID NO: 132061 - protein, 30 aa, Artificial Sequence
  Description of Artificial Sequence: Synthetic polypeptide
SEEEIASVNPVCTEQYGVVSDEDQSFGSNQ

SEQ ID NO: 132062 - protein, 35 aa, Artificial Sequence
  Description of Artificial Sequence: Synthetic polypeptide
DEETIRATNPVATEQYGVVSTVNTQQQQNGNNQDD

SEQ ID NO: 132063 - protein, 34 aa, Artificial Sequence
  Description of Artificial Sequence: Synthetic polypeptide
DEEEIRGTNPVATEQYGDVVMTNGFEGGGANNNN

SEQ ID NO: 132064 - protein, 37 aa, Artificial Sequence
  Description of Artificial Sequence: Synthetic polypeptide
AEEEIRTTNPVATEQYGSVSTVTANNQNGTEQGNEDS

SEQ ID NO: 132065 - protein, 38 aa, Artificial Sequence
  Description of Artificial Sequence: Synthetic polypeptide
AEEEIRTTNPVATEQYGSVSTVTANLQNGNEQGNNEDE

SEQ ID NO: 132066 - protein, 36 aa, Artificial Sequence
  Description of Artificial Sequence: Synthetic polypeptide
DEETIRATNPVATEQYGSVSTVTNQENQEQGNNQGD

SEQ ID NO: 132067 - protein, 36 aa, Artificial Sequence
  Description of Artificial Sequence: Synthetic polypeptide
DEETIRATNPVATEQYGSVSTVTNNQQQNQGNNQLE

SEQ ID NO: 132068 - protein, 31 aa, Artificial Sequence
  Description of Artificial Sequence: Synthetic polypeptide
SEEEIASVNPVCTEQYGVVSSGNLQSFGSQQ

SEQ ID NO: 132069 - protein, 35 aa, Artificial Sequence
  Description of Artificial Sequence: Synthetic polypeptide
DEEEIRGTNPVATEQYGNVALMTVGLVQVAGENQP

SEQ ID NO: 132070 - protein, 37 aa, Artificial Sequence
  Description of Artificial Sequence: Synthetic polypeptide
AEEEIRTTNPVATEQYGSVSTVTDGQNGNLQGTNDEE

SEQ ID NO: 132071 - protein, 36 aa, Artificial Sequence
  Description of Artificial Sequence: Synthetic polypeptide
DEEEIRTTNPVATEVYGSVSTTTPAGPNMRNGMNPV

SEQ ID NO: 132072 - protein, 36 aa, Artificial Sequence
  Description of Artificial Sequence: Synthetic polypeptide
DEEEIRTTNPVATEQYGQVSSTWPAGPNMRNGMNPV

SEQ ID NO: 132073 - protein, 35 aa, Artificial Sequence
  Description of Artificial Sequence: Synthetic polypeptide
DEETIRTTNPVATEQWGSVATTNNNNQQQGTNTDE

SEQ ID NO: 132074 - protein, 33 aa, Artificial Sequence
  Description of Artificial Sequence: Synthetic polypeptide
DEEEIRTTNPVATEQYGSANSCIQDDDSSNEMM

SEQ ID NO: 132075 - protein, 34 aa, Artificial Sequence
  Description of Artificial Sequence: Synthetic polypeptide
DDEEIRTTNPVATEQYGVVSGDNLIDGDGGEGEQ

SEQ ID NO: 132076 - protein, 34 aa, Artificial Sequence
  Description of Artificial Sequence: Synthetic polypeptide
DEEEIRTTNPVATEQYGSANSCINSDDDPSNEME

SEQ ID NO: 132077 - protein, 35 aa, Artificial Sequence
  Description of Artificial Sequence: Synthetic polypeptide
DDEEIRTTNPVATEQYGVVSILNGQGEGQGGNITN

SEQ ID NO: 132078 - protein, 34 aa, Artificial Sequence
  Description of Artificial Sequence: Synthetic polypeptide
DEEEIRTTNPVATEQYGSANNVINNDDDPSNEDM

SEQ ID NO: 132079 - protein, 35 aa, Artificial Sequence
  Description of Artificial Sequence: Synthetic polypeptide
DDEEIRTTNPVATEQYGVVSTDNGGQGNQGDEGEI

SEQ ID NO: 132080 - protein, 34 aa, Artificial Sequence
  Description of Artificial Sequence: Synthetic polypeptide
DEEEIRTTNPVATEQYGSANGILLDDDRSNEQMQ

SEQ ID NO: 132081 - protein, 38 aa, Artificial Sequence
  Description of Artificial Sequence: Synthetic polypeptide
AEEEIRTTNPVATEQYGSVSTVTNNLNNQQGNGNNNVE

SEQ ID NO: 132082 - protein, 37 aa, Artificial Sequence
  Description of Artificial Sequence: Synthetic polypeptide
AEEEIRTTNPVATEQYGSVSTVTNNLNGTELGNNTQI

SEQ ID NO: 132083 - protein, 37 aa, Artificial Sequence
  Description of Artificial Sequence: Synthetic polypeptide
AEEEIRTTNPVATEQYGSVSTVTNNLNYGNQGTNNVT

SEQ ID NO: 132084 - protein, 33 aa, Artificial Sequence
  Description of Artificial Sequence: Synthetic polypeptide
DDEEIRTTNPVATEQYGVVTDGGDEQGGNGGND

SEQ ID NO: 132085 - protein, 35 aa, Artificial Sequence
  Description of Artificial Sequence: Synthetic polypeptide
DDEEIRTTNPVATEQYGVVVAGTDQNDLEGEGNEG

SEQ ID NO: 132086 - protein, 29 aa, Artificial Sequence
  Description of Artificial Sequence: Synthetic peptide
SEEEIACTNPISTEGYGNVAETIQRVGQR

SEQ ID NO: 132087 - protein, 37 aa, Artificial Sequence
  Description of Artificial Sequence: Synthetic polypeptide
AEEEIRTTNPVATEQYGSVSTVTNNGQNGDEAGNNDE

SEQ ID NO: 132088 - protein, 32 aa, Artificial Sequence
  Description of Artificial Sequence: Synthetic polypeptide
SEEEIACTNPVATASYGCVAGTNLADRPGDQR

SEQ ID NO: 132089 - protein, 36 aa, Artificial Sequence
  Description of Artificial Sequence: Synthetic polypeptide
AEEEIRTTNPVATEQYGSVSTVTNNDNQQNTEENTD

SEQ ID NO: 132090 - protein, 36 aa, Artificial Sequence
  Description of Artificial Sequence: Synthetic polypeptide
DEETIRTTNPVATEQYGSVSSTTPAGPNMRNGYNPV

SEQ ID NO: 132091 - protein, 36 aa, Artificial Sequence
  Description of Artificial Sequence: Synthetic polypeptide
DEETIRTTNPVATEQYGSVSSTTPAGPNMRNGMNPV

SEQ ID NO: 132092 - protein, 37 aa, Artificial Sequence
  Description of Artificial Sequence: Synthetic polypeptide
AEEEIRTTNPVATEQYGSVSTVTNNDNQQGTEENTTE

SEQ ID NO: 132093 - protein, 36 aa, Artificial Sequence
  Description of Artificial Sequence: Synthetic polypeptide
AEEEIRTTNPVATEQYGSVSTVTNNDNQQANEENDT

SEQ ID NO: 132094 - protein, 37 aa, Artificial Sequence
  Description of Artificial Sequence: Synthetic polypeptide
AEEEIRTTNPVATEQYGSVSTVTNNLNGTELGNNEGV

SEQ ID NO: 132095 - protein, 38 aa, Artificial Sequence
  Description of Artificial Sequence: Synthetic polypeptide
AEEEIRTTNPVATEQYGSVSTVTNNLQQGTEQGTNTEQ

SEQ ID NO: 132096 - protein, 37 aa, Artificial Sequence
  Description of Artificial Sequence: Synthetic polypeptide
AEEEIRTTNPVATEQYGSVSTVTNNLQQNQENGTTQN

SEQ ID NO: 132097 - protein, 36 aa, Artificial Sequence
  Description of Artificial Sequence: Synthetic polypeptide
DEEEIRTTNPVATEWYGSVSSTTPCGPNMRNGMNPV

SEQ ID NO: 132098 - protein, 37 aa, Artificial Sequence
  Description of Artificial Sequence: Synthetic polypeptide
AEEEIRTTNPVATEQYGSVSTVTNNNNQNDEGTNNVE

SEQ ID NO: 132099 - protein, 36 aa, Artificial Sequence
  Description of Artificial Sequence: Synthetic polypeptide
AEEEIRTTNPVATEQYGSVSTVTNNNNQGDEENNVE

SEQ ID NO: 132100 - protein, 37 aa, Artificial Sequence
  Description of Artificial Sequence: Synthetic polypeptide
DEETIRTTNPVATEQYGSVSTTNNQLQGNNNGQDEQD

SEQ ID NO: 132101 - protein, 37 aa, Artificial Sequence
  Description of Artificial Sequence: Synthetic polypeptide
AEEEIRTTNPVATEQYGSVSTVTNNNNNQDNGTNNVE

SEQ ID NO: 132102 - protein, 36 aa, Artificial Sequence
  Description of Artificial Sequence: Synthetic polypeptide
AEEEIRTTNPVATEQYGSVSTVTNNNNDTELGNNLI

SEQ ID NO: 132103 - protein, 28 aa, Artificial Sequence
  Description of Artificial Sequence: Synthetic peptide
SEEEIACTNPIATEQYGEAPEVCQHGEK

SEQ ID NO: 132104 - protein, 34 aa, Artificial Sequence
  Description of Artificial Sequence: Synthetic polypeptide
DEEEIRTTNPVATEQYGSAPASDEEHVRNETNQD

SEQ ID NO: 132105 - protein, 38 aa, Artificial Sequence
  Description of Artificial Sequence: Synthetic polypeptide
AEEEIRTTNPVATEQYGSVSTVTNNNLQNQEQGTNTTD

SEQ ID NO: 132106 - protein, 34 aa, Artificial Sequence
  Description of Artificial Sequence: Synthetic polypeptide
DEEEIRTTNPVATEQYGSANSVINDDDPSNETDM

SEQ ID NO: 132107 - protein, 38 aa, Artificial Sequence
  Description of Artificial Sequence: Synthetic polypeptide
AEEEIRTTNPVATEQYGSVSTVTNNNLQAGTTEENTNY

SEQ ID NO: 132108 - protein, 37 aa, Artificial Sequence
  Description of Artificial Sequence: Synthetic polypeptide
AEEEIRTTNPVATEQYGSVSTVTNNNLQAGTEEGTDE

SEQ ID NO: 132109 - protein, 35 aa, Artificial Sequence
  Description of Artificial Sequence: Synthetic polypeptide
DEEEIRTTNPVATEQYGSANSILLTDDDRSNEEMM

SEQ ID NO: 132110 - protein, 37 aa, Artificial Sequence
  Description of Artificial Sequence: Synthetic polypeptide
AEEEIRTTNPVATEQYGSVSTVTNNNLNDENGTNGTE

SEQ ID NO: 132111 - protein, 34 aa, Artificial Sequence
  Description of Artificial Sequence: Synthetic polypeptide
DEEEIRTTNPVATEQYGSANSILLDDDDSNEMMM

SEQ ID NO: 132112 - protein, 34 aa, Artificial Sequence
  Description of Artificial Sequence: Synthetic polypeptide
DDEEIRTTNPVATEQYGTVVTDNGGQGNIGEGEI

SEQ ID NO: 132113 - protein, 36 aa, Artificial Sequence
  Description of Artificial Sequence: Synthetic polypeptide
AEEEIRTTNPVATEQYGSVSTVTNNNDTNLGGNNLI

SEQ ID NO: 132114 - protein, 36 aa, Artificial Sequence
  Description of Artificial Sequence: Synthetic polypeptide
DEEEIRTTNPVATEWYGSVSSETPAGPNMRNGMNPV

SEQ ID NO: 132115 - protein, 36 aa, Artificial Sequence
  Description of Artificial Sequence: Synthetic polypeptide
AEEEIRTTNPVATEQYGSVSTVTNNMEQGTNNVTEE

SEQ ID NO: 132116 - protein, 36 aa, Artificial Sequence
  Description of Artificial Sequence: Synthetic polypeptide
DEEEIRTTNPVATEWYGSVSSTQPAGPNMRNGMNPV

SEQ ID NO: 132117 - protein, 36 aa, Artificial Sequence
  Description of Artificial Sequence: Synthetic polypeptide
DEEEIRTTNPVATEWYGSVSSTTPAGPNMRNGMNPV

SEQ ID NO: 132118 - protein, 36 aa, Artificial Sequence
  Description of Artificial Sequence: Synthetic polypeptide
AEEEIRTTNPVATEQYGSVSTVTNNMEQGTNNNTDE

SEQ ID NO: 132119 - protein, 36 aa, Artificial Sequence
  Description of Artificial Sequence: Synthetic polypeptide
DEEEIRTTNPVATEQYGSAISPEEVAHIQDTIGNAR

SEQ ID NO: 132120 - protein, 35 aa, Artificial Sequence
  Description of Artificial Sequence: Synthetic polypeptide
DEETIRTTNPVATEQWGSVATTNNNNQQLGNNTQD

SEQ ID NO: 132121 - protein, 36 aa, Artificial Sequence
  Description of Artificial Sequence: Synthetic polypeptide
AEEEIRTTNPVATEQYGSVSTVTNNDEQGTNTNNDG

SEQ ID NO: 132122 - protein, 36 aa, Artificial Sequence
  Description of Artificial Sequence: Synthetic polypeptide
AEEEIRTTNPVATEQYGSVSTVTNNDEQGSTETNND

SEQ ID NO: 132123 - protein, 32 aa, Artificial Sequence
  Description of Artificial Sequence: Synthetic polypeptide
SEEEIACTNPVATEQYGCVATNPAAEGGNNDD

SEQ ID NO: 132124 - protein, 37 aa, Artificial Sequence
  Description of Artificial Sequence: Synthetic polypeptide
DEEEIRTTNPVATEQYGRSVSSTTFAGPNMRNGMNPV

SEQ ID NO: 132125 - protein, 28 aa, Artificial Sequence
  Description of Artificial Sequence: Synthetic peptide
SEEEIACTNPVATEQYGEAPEVCQHEEK

SEQ ID NO: 132126 - protein, 36 aa, Artificial Sequence
  Description of Artificial Sequence: Synthetic polypeptide
DEEEIRTTNPVATEQYGQVVTPTNGDETTQSGQDNQ

SEQ ID NO: 132127 - protein, 36 aa, Artificial Sequence
  Description of Artificial Sequence: Synthetic polypeptide
AEEEIRTTNPVATEQYGSVSTVTNLQLQQIATEEDE

SEQ ID NO: 132128 - protein, 35 aa, Artificial Sequence
  Description of Artificial Sequence: Synthetic polypeptide
DEETIRTTNPVATEQWGVVVTVNNNNLQAGNNQDT

SEQ ID NO: 132129 - protein, 36 aa, Artificial Sequence
  Description of Artificial Sequence: Synthetic polypeptide
AEEEIRTTNPVATEQYGSVSTVTNLQLQQEATEDED

SEQ ID NO: 132130 - protein, 35 aa, Artificial Sequence
  Description of Artificial Sequence: Synthetic polypeptide
SEEEIACTNPVATEQYGSVAITNLPQDNPGENAEE

SEQ ID NO: 132131 - protein, 34 aa, Artificial Sequence
  Description of Artificial Sequence: Synthetic polypeptide
DEEEIRTTNPVATEQYGQVVCSWEHQENFGSEQF

SEQ ID NO: 132132 - protein, 37 aa, Artificial Sequence
  Description of Artificial Sequence: Synthetic polypeptide
DEEEIRTTNPVATEQYGRSVSSTTPAGPNMRNGMNIV

SEQ ID NO: 132133 - protein, 35 aa, Artificial Sequence
  Description of Artificial Sequence: Synthetic polypeptide
DEETIRTTNPVATEQWGVVATTNNNNLQAGNNQET

SEQ ID NO: 132134 - protein, 36 aa, Artificial Sequence
  Description of Artificial Sequence: Synthetic polypeptide
DEEEIRTTNPVATEQYGQVSTWTNTTQTVEVVEQNI

SEQ ID NO: 132135 - protein, 36 aa, Artificial Sequence
  Description of Artificial Sequence: Synthetic polypeptide
DEEEIRCTNPVATEVYGSVSSTTPAGPLMRNGMNPV

SEQ ID NO: 132136 - protein, 38 aa, Artificial Sequence
  Description of Artificial Sequence: Synthetic polypeptide
AEEEIRTTNPVATEQYGSVSTVTNLQLNQQIGTNSEDN

SEQ ID NO: 132137 - protein, 38 aa, Artificial Sequence
  Description of Artificial Sequence: Synthetic polypeptide
AEEEIRTTNPVATEQYGSVSTVTNLQAGNQLAGNNEGD

SEQ ID NO: 132138 - protein, 35 aa, Artificial Sequence
  Description of Artificial Sequence: Synthetic polypeptide
DEETIRTTNPVATEQWGSVATVNNNNQQQGNNNDE

SEQ ID NO: 132139 - protein, 35 aa, Artificial Sequence
  Description of Artificial Sequence: Synthetic polypeptide
DEEEIRTTNPVATEQYGQVSTMTDGFEGGGENNNE

SEQ ID NO: 132140 - protein, 36 aa, Artificial Sequence
  Description of Artificial Sequence: Synthetic polypeptide
DEEEIRTTNPVATEQYGQVSTDNGFGGNDDQGEQDT

SEQ ID NO: 132141 - protein, 35 aa, Artificial Sequence
  Description of Artificial Sequence: Synthetic polypeptide
DEETIRTTNPVATEQWGSVATVNNNNEQLGNNTTE

SEQ ID NO: 132142 - protein, 32 aa, Artificial Sequence
  Description of Artificial Sequence: Synthetic polypeptide
DEAEIATTNGVAYCFYGSVSTLNALQQGGEDE

SEQ ID NO: 132143 - protein, 34 aa, Artificial Sequence
  Description of Artificial Sequence: Synthetic polypeptide
DEEEIRTTNPVATEYYGSVISCGVAVSQGTGGSV

SEQ ID NO: 132144 - protein, 37 aa, Artificial Sequence
  Description of Artificial Sequence: Synthetic polypeptide
DEEEIRTTNPVATEQYGRSVSSTTPAGPNMRNGMNPV

SEQ ID NO: 132145 - protein, 37 aa, Artificial Sequence
  Description of Artificial Sequence: Synthetic polypeptide
DEEEIRTTNPVATEQYGRVSPTTMANGPNMRNGMNDV

SEQ ID NO: 132146 - protein, 36 aa, Artificial Sequence
  Description of Artificial Sequence: Synthetic polypeptide
DEEEIRTTNPVATEQYGRVSSTTPAGPNMREGMNPV

SEQ ID NO: 132147 - protein, 36 aa, Artificial Sequence
  Description of Artificial Sequence: Synthetic polypeptide
AEEEIRTTNPVATEQYGSVSTVTNNDEQGSTEENEE

SEQ ID NO: 132148 - protein, 36 aa, Artificial Sequence
  Description of Artificial Sequence: Synthetic polypeptide
AEEEIRTTNPVATEQYGSVSTVTNNDEQGNTEENTD

SEQ ID NO: 132149 - protein, 36 aa, Artificial Sequence
  Description of Artificial Sequence: Synthetic polypeptide
AEEEIRTTNPVATEQYGSVSTVTNMEQGTNNVTDED

SEQ ID NO: 132150 - protein, 37 aa, Artificial Sequence
  Description of Artificial Sequence: Synthetic polypeptide
DEEEIRCTNPVATEQYGSVSNGVNGQLGQEGGQNDGQ

SEQ ID NO: 132151 - protein, 36 aa, Artificial Sequence
  Description of Artificial Sequence: Synthetic polypeptide
DEEEIRCTNPVATEQYGSVSNGVNGQTGQEGGQNDA

SEQ ID NO: 132152 - protein, 36 aa, Artificial Sequence
  Description of Artificial Sequence: Synthetic polypeptide
DEEEIRTTNPVATEQYGSAEVAANLEIPRMGEEVSE

SEQ ID NO: 132153 - protein, 35 aa, Artificial Sequence
  Description of Artificial Sequence: Synthetic polypeptide
DEEEIRTTNPVATEQYGSACTNTNAQIPQTQEGLG

SEQ ID NO: 132154 - protein, 36 aa, Artificial Sequence
  Description of Artificial Sequence: Synthetic polypeptide
DEEEIRCTNPVATEQYGSVSSTTPAGPNMRNGMNPV

SEQ ID NO: 132155 - protein, 36 aa, Artificial Sequence
  Description of Artificial Sequence: Synthetic polypeptide
DEEEIRTTNPVATEQYGSACSATNDQQEHQDGTAQK

SEQ ID NO: 132156 - protein, 35 aa, Artificial Sequence
  Description of Artificial Sequence: Synthetic polypeptide
DEEEIRTTNPVATEQYGSACATNPEPQEHDDNLAG

SEQ ID NO: 132157 - protein, 36 aa, Artificial Sequence
  Description of Artificial Sequence: Synthetic polypeptide
DEEEIRTTNPVATEQYGSACATNPELQEHQDDNLAQ

SEQ ID NO: 132158 - protein, 35 aa, Artificial Sequence
  Description of Artificial Sequence: Synthetic polypeptide
DEEEIRTTNPVATEQYGSACATNPELGQEHDDQAG

SEQ ID NO: 132159 - protein, 37 aa, Artificial Sequence
  Description of Artificial Sequence: Synthetic polypeptide
DEEEIRTTNPVATEQYGSAASPTNPGGLSQVQENPVV

SEQ ID NO: 132160 - protein, 37 aa, Artificial Sequence
  Description of Artificial Sequence: Synthetic polypeptide
AEEEIRTTNPVATEQYGSVSTVTNLQLQQQGTTTEDE

SEQ ID NO: 132161 - protein, 36 aa, Artificial Sequence
  Description of Artificial Sequence: Synthetic polypeptide
DEEEIRTTNPVATEQYGSAANSSTNEDQVANDEDGV

SEQ ID NO: 132162 - protein, 36 aa, Artificial Sequence
  Description of Artificial Sequence: Synthetic polypeptide
DEEEIRTTNPVATEQYGSAANSSTNEDDQVRNDEDG

SEQ ID NO: 132163 - protein, 36 aa, Artificial Sequence
  Description of Artificial Sequence: Synthetic polypeptide
DEEEIRTTNPVATEQYGSAAEPIGNLLQPNTVNERR

SEQ ID NO: 132164 - protein, 33 aa, Artificial Sequence
  Description of Artificial Sequence: Synthetic polypeptide
SEEEIACTNPVATEQYGCVATNLQNDDLMENQD

SEQ ID NO: 132165 - protein, 33 aa, Artificial Sequence
  Description of Artificial Sequence: Synthetic polypeptide
DDEEIRTTNPVGTEQWGCVCSTELNQNFGSVQA

SEQ ID NO: 132166 - protein, 36 aa, Artificial Sequence
  Description of Artificial Sequence: Synthetic polypeptide
AEEEIRTTNPVATEQYGSVSTVTNLQLQQISTTEDE

SEQ ID NO: 132167 - protein, 36 aa, Artificial Sequence
  Description of Artificial Sequence: Synthetic polypeptide
DEEEIRTTNPVATEQYGRVSSTTPAGPNMRNGMNPV

SEQ ID NO: 132168 - protein, 36 aa, Artificial Sequence
  Description of Artificial Sequence: Synthetic polypeptide
AEEEIRTTNPVATEQYGSVSTVTNNDEQGTEDGTDQ

SEQ ID NO: 132169 - protein, 37 aa, Artificial Sequence
  Description of Artificial Sequence: Synthetic polypeptide
AEEEIRTTNPVATEQYGSVSTVTNQNNQGENGNNEED

SEQ ID NO: 132170 - protein, 38 aa, Artificial Sequence
  Description of Artificial Sequence: Synthetic polypeptide
AEEEIRTTNPVATEQYGSVSTTVANLQNATEEGTNQVE

SEQ ID NO: 132171 - protein, 37 aa, Artificial Sequence
  Description of Artificial Sequence: Synthetic polypeptide
AEEEIRTTNPVATEQYGSVSTTVANLNADEQGTNVVE

SEQ ID NO: 132172 - protein, 38 aa, Artificial Sequence
  Description of Artificial Sequence: Synthetic polypeptide
AEEEIRTTNPVATEQYGSVSTTNNNQLQQGTEAGNTDD

SEQ ID NO: 132173 - protein, 32 aa, Artificial Sequence
  Description of Artificial Sequence: Synthetic polypeptide
DDQEIASTNPVATEQYGSVSATTIQDHVGQDL

SEQ ID NO: 132174 - protein, 37 aa, Artificial Sequence
  Description of Artificial Sequence: Synthetic polypeptide
AEEEIRTTNPVATEQYGSVSTTNNNQGNNQLQGTNVD

SEQ ID NO: 132175 - protein, 31 aa, Artificial Sequence
  Description of Artificial Sequence: Synthetic polypeptide
DDQEIATTNPVATEGYGNVSATDLEDHVGEL

SEQ ID NO: 132176 - protein, 37 aa, Artificial Sequence
  Description of Artificial Sequence: Synthetic polypeptide
AEEEIRTTNPVATEQYGSVSTTNNNNQQQTNGTNNAD

SEQ ID NO: 132177 - protein, 36 aa, Artificial Sequence
  Description of Artificial Sequence: Synthetic polypeptide
AEEEIRTTNPVATEQYGSVSTTNNNNQQQIGTDEGT

SEQ ID NO: 132178 - protein, 34 aa, Artificial Sequence
  Description of Artificial Sequence: Synthetic polypeptide
DEEEIVTTNPVATEQYGTVCSATDGPVEMFEGND

SEQ ID NO: 132179 - protein, 35 aa, Artificial Sequence
  Description of Artificial Sequence: Synthetic polypeptide
DEEEIRTTNPVATEQYGFCISPSGVLEKNRDGEHQ

SEQ ID NO: 132180 - protein, 34 aa, Artificial Sequence
  Description of Artificial Sequence: Synthetic polypeptide
DEEEIVTTNPVATEQYGTVCSATDGPVEFEGNED

SEQ ID NO: 132181 - protein, 35 aa, Artificial Sequence
  Description of Artificial Sequence: Synthetic polypeptide
DEEEIRTTNPVATEQYGFICQCTPNDIGQEQENNR

SEQ ID NO: 132182 - protein, 34 aa, Artificial Sequence
  Description of Artificial Sequence: Synthetic polypeptide
DEEEIVTTNPVATEQYGTVCSATDGPVEFEGNDN

SEQ ID NO: 132183 - protein, 37 aa, Artificial Sequence
  Description of Artificial Sequence: Synthetic polypeptide
AEEEIRTTNPVATEQYGSVSTTNNNNQQQGNGNNDEQ

SEQ ID NO: 132184 - protein, 37 aa, Artificial Sequence
  Description of Artificial Sequence: Synthetic polypeptide
AEEEIRTTNPVATEQYGSVSTTNNNNQQGTNNNNQNF

SEQ ID NO: 132185 - protein, 32 aa, Artificial Sequence
  Description of Artificial Sequence: Synthetic polypeptide
DEEEIRTTNPVAYEGYGQVNTTLSTPVTNNQC

SEQ ID NO: 132186 - protein, 34 aa, Artificial Sequence
  Description of Artificial Sequence: Synthetic polypeptide
DEEEIVTTNPVATEQYGTVCSATDAGVEMFEGND

SEQ ID NO: 132187 - protein, 37 aa, Artificial Sequence
  Description of Artificial Sequence: Synthetic polypeptide
AEEEIRTTNPVATEQYGSVSTTNNNNQQGSEQGNNEQ

SEQ ID NO: 132188 - protein, 36 aa, Artificial Sequence
  Description of Artificial Sequence: Synthetic polypeptide
AEEEIRTTNPVATEQYGSVSTTNNNNQNTTNNNELF

SEQ ID NO: 132189 - protein, 31 aa, Artificial Sequence
  Description of Artificial Sequence: Synthetic polypeptide
DEEEIVTTNPVATEQYGTVCPAEDGPEFENK

SEQ ID NO: 132190 - protein, 34 aa, Artificial Sequence
  Description of Artificial Sequence: Synthetic polypeptide
DEEEIRTTNPCATEGYGCCCSTENLAEYFGSNQS

SEQ ID NO: 132191 - protein, 36 aa, Artificial Sequence
  Description of Artificial Sequence: Synthetic polypeptide
AEEEIRTTNPVATEQYGSVSTTNNNNNQQTNNNELF

SEQ ID NO: 132192 - protein, 36 aa, Artificial Sequence
  Description of Artificial Sequence: Synthetic polypeptide
DEEEIRTTNPVATEQYGEVVSTTPDGPNMRNGMNPV

SEQ ID NO: 132193 - protein, 33 aa, Artificial Sequence
  Description of Artificial Sequence: Synthetic polypeptide
DDPTIRTTNPVATEQYGAVSTNMQQVRVAQPTT

SEQ ID NO: 132194 - protein, 35 aa, Artificial Sequence
  Description of Artificial Sequence: Synthetic polypeptide
DEEEIRTTNPVATEQYGFICQFTPNEIPEQEANRD

SEQ ID NO: 132195 - protein, 34 aa, Artificial Sequence
  Description of Artificial Sequence: Synthetic polypeptide
DEEEIVTTNPVATEQYGTVCSTTDGGVEFEGNPD

SEQ ID NO: 132196 - protein, 34 aa, Artificial Sequence
  Description of Artificial Sequence: Synthetic polypeptide
DEEEIVTTNPVATEQYGTVSSATPAPPNFEGMNV

SEQ ID NO: 132197 - protein, 35 aa, Artificial Sequence
  Description of Artificial Sequence: Synthetic polypeptide
DEEEIRTTNPVATEQYGFVNSTTNDDENSGQEEID

SEQ ID NO: 132198 - protein, 35 aa, Artificial Sequence
  Description of Artificial Sequence: Synthetic polypeptide
DEEEIVTTNPVATEQYGTVSSATPAGVNMREGNPV

SEQ ID NO: 132199 - protein, 37 aa, Artificial Sequence
  Description of Artificial Sequence: Synthetic polypeptide
AEEEIRTTNPVATEQYGSVSTTNNNQQQIGNGTNNQD

SEQ ID NO: 132200 - protein, 37 aa, Artificial Sequence
  Description of Artificial Sequence: Synthetic polypeptide
AEEEIRTTNPVATEQYGSVSTTNNNQQQIGNGNNTQE

SEQ ID NO: 132201 - protein, 35 aa, Artificial Sequence
  Description of Artificial Sequence: Synthetic polypeptide
DEEEIVTTNPVATEQYGTVSSATPAGPEMRNGMND

SEQ ID NO: 132202 - protein, 34 aa, Artificial Sequence
  Description of Artificial Sequence: Synthetic polypeptide
DEEEIVTTNPVATEQYGTVSSATDAGVEMFEGND

SEQ ID NO: 132203 - protein, 37 aa, Artificial Sequence
  Description of Artificial Sequence: Synthetic polypeptide
DEEEIRTTNPVATEQYGFSVSSTTPAGSNMRNGMNPV

SEQ ID NO: 132204 - protein, 37 aa, Artificial Sequence
  Description of Artificial Sequence: Synthetic polypeptide
DEEEIRTTNPVATEQYGFSVSSTTPAGPNMRNGMNPV

SEQ ID NO: 132205 - protein, 37 aa, Artificial Sequence
  Description of Artificial Sequence: Synthetic polypeptide
AEEEIRTTNPVATEQYGSVSTTNNNQQQGEQGTNDED

SEQ ID NO: 132206 - protein, 32 aa, Artificial Sequence
  Description of Artificial Sequence: Synthetic polypeptide
DEEEIVTTNPVATEQYGTVPATDGPVQFEEEK

SEQ ID NO: 132207 - protein, 32 aa, Artificial Sequence
  Description of Artificial Sequence: Synthetic polypeptide
DEEEIVTTNPVATEQYGTVPATDGPVEFEGEK

SEQ ID NO: 132208 - protein, 36 aa, Artificial Sequence
  Description of Artificial Sequence: Synthetic polypeptide
AEEEIRTTNPVATEQYGSVSTTNNNQQQANEQGTDE

SEQ ID NO: 132209 - protein, 37 aa, Artificial Sequence
  Description of Artificial Sequence: Synthetic polypeptide
DEEEIRTTNPVATEQYGFSVSHTTPAGPNMRNGMNPV

SEQ ID NO: 132210 - protein, 35 aa, Artificial Sequence
  Description of Artificial Sequence: Synthetic polypeptide
DEEEIRTTNPVATEQYGFSGDSVDDTGQGGGNGQE

SEQ ID NO: 132211 - protein, 36 aa, Artificial Sequence
  Description of Artificial Sequence: Synthetic polypeptide
AEEEIRTTNPVATEQYGSVSTTNNNQQLQISTEQGD

SEQ ID NO: 132212 - protein, 36 aa, Artificial Sequence
  Description of Artificial Sequence: Synthetic polypeptide
AEEEIRTTNPVATEQYGSVSTTNNNQQLQEATEEGD

SEQ ID NO: 132213 - protein, 36 aa, Artificial Sequence
  Description of Artificial Sequence: Synthetic polypeptide
DEEEIRTTNPVATEQYGFICQSTCNEIQEQEANSRD

SEQ ID NO: 132214 - protein, 35 aa, Artificial Sequence
  Description of Artificial Sequence: Synthetic polypeptide
DEEEIRTTNPVATEQYGFICQSPPNVIQEQEANRD

SEQ ID NO: 132215 - protein, 36 aa, Artificial Sequence
  Description of Artificial Sequence: Synthetic polypeptide
DEEEIRTTNPVATEQYGFICQSCTQNEIQEQEANRD

SEQ ID NO: 132216 - protein, 37 aa, Artificial Sequence
  Description of Artificial Sequence: Synthetic polypeptide
AEEEIRTTNPVATEQYGSVSTTNNNQQGQTNGTNDEE

SEQ ID NO: 132217 - protein, 37 aa, Artificial Sequence
  Description of Artificial Sequence: Synthetic polypeptide
AEEEIRTTNPVATEQYGSVSTTNNNNNQQTNGNNDED

SEQ ID NO: 132218 - protein, 36 aa, Artificial Sequence
  Description of Artificial Sequence: Synthetic polypeptide
DEEEIRTTNPVATEQYGFVSSTTCAGPNMRNGMNPV

SEQ ID NO: 132219 - protein, 37 aa, Artificial Sequence
  Description of Artificial Sequence: Synthetic polypeptide
AEEEIRTTNPVATEQYGSVSTTNNNNNQQGNGTNTDD

SEQ ID NO: 132220 - protein, 36 aa, Artificial Sequence
  Description of Artificial Sequence: Synthetic polypeptide
AEEEIRTTNPVATEQYGSVSTTNNNNNQNENGETED

SEQ ID NO: 132221 - protein, 37 aa, Artificial Sequence
  Description of Artificial Sequence: Synthetic polypeptide
AEEEIRTTNPVATEQYGSVSTTNNNLQIGSTDEETME

SEQ ID NO: 132222 - protein, 36 aa, Artificial Sequence
  Description of Artificial Sequence: Synthetic polypeptide
DEEEIVTTNPVATEQYGSVCSATPAGPNMRNGMNPV

SEQ ID NO: 132223 - protein, 36 aa, Artificial Sequence
  Description of Artificial Sequence: Synthetic polypeptide
DEEEIVTTNPVATEQYGSVCSATPAGPNMREGMNPV

SEQ ID NO: 132224 - protein, 36 aa, Artificial Sequence
  Description of Artificial Sequence: Synthetic polypeptide
DEEEIVTTNPVATEQYGSVCSATPAGPEMREGMNPV

SEQ ID NO: 132225 - protein, 37 aa, Artificial Sequence
  Description of Artificial Sequence: Synthetic polypeptide
AEEEIRTTNPVATEQYGSVSTTNNNLQGNEGGETEED

SEQ ID NO: 132226 - protein, 33 aa, Artificial Sequence
  Description of Artificial Sequence: Synthetic polypeptide
DEEEIRTTNPCATEPYGSCAATNLATAHGDEEA

SEQ ID NO: 132227 - protein, 34 aa, Artificial Sequence
  Description of Artificial Sequence: Synthetic polypeptide
DEEEIRTTNPCATEPYGSCAATNLATAPGDNMNH

SEQ ID NO: 132228 - protein, 33 aa, Artificial Sequence
  Description of Artificial Sequence: Synthetic polypeptide
DEEEIRTTNPCATEPYGSCAATNLATAPGGEAQ

SEQ ID NO: 132229 - protein, 37 aa, Artificial Sequence
  Description of Artificial Sequence: Synthetic polypeptide
AEEEIRTTNPVATEQYGSVSTTNNNLNQVEQGTTEED

SEQ ID NO: 132230 - protein, 37 aa, Artificial Sequence
  Description of Artificial Sequence: Synthetic polypeptide
AEEEIRTTNPVATEQYGSVSTTNNNLQQATNQQGTDE

SEQ ID NO: 132231 - protein, 32 aa, Artificial Sequence
  Description of Artificial Sequence: Synthetic polypeptide
DDQEVATTNPVATEQYGSVSATDLESHVGQDL

SEQ ID NO: 132232 - protein, 37 aa, Artificial Sequence
  Description of Artificial Sequence: Synthetic polypeptide
AEEEIRTTNPVATEQYGSVSTTNNNLNQNENGEEQED

SEQ ID NO: 132233 - protein, 33 aa, Artificial Sequence
  Description of Artificial Sequence: Synthetic polypeptide
DEEEIVTTNPVATEQYGEVCPATDGCVEFEGNK

SEQ ID NO: 132234 - protein, 37 aa, Artificial Sequence
  Description of Artificial Sequence: Synthetic polypeptide
AEEEIRTTNPVATEQYGSVSTTNNNLNQNEAGETETD

SEQ ID NO: 132235 - protein, 32 aa, Artificial Sequence
  Description of Artificial Sequence: Synthetic polypeptide
DEEEIRTTNPCATEPYGSCAGTNHMNPGDEAM

SEQ ID NO: 132236 - protein, 33 aa, Artificial Sequence
  Description of Artificial Sequence: Synthetic polypeptide
DEEEIRTTNPCATEPYGSCAGTNHMNPQGNEAM

SEQ ID NO: 132237 - protein, 37 aa, Artificial Sequence
  Description of Artificial Sequence: Synthetic polypeptide
AEEEIRTTNPVATEQYGSVSTTNNNLNQDEQGETEEE

SEQ ID NO: 132238 - protein, 36 aa, Artificial Sequence
  Description of Artificial Sequence: Synthetic polypeptide
DEEEIRTTNPVAYEPYGISVFYEGNLAQDRAVTNNR

SEQ ID NO: 132239 - protein, 37 aa, Artificial Sequence
  Description of Artificial Sequence: Synthetic polypeptide
AEEEIRTTNPVATEQYGSVSTTNNNLNQDEIGTTDED

SEQ ID NO: 132240 - protein, 37 aa, Artificial Sequence
  Description of Artificial Sequence: Synthetic polypeptide
AEEEIRTTNPVATEQYGSVSTTNNNLNQDEEGETTED

SEQ ID NO: 132241 - protein, 37 aa, Artificial Sequence
  Description of Artificial Sequence: Synthetic polypeptide
AEEEIRTTNPVATEQYGSVSTTNNNLNQNNIGETEED

SEQ ID NO: 132242 - protein, 36 aa, Artificial Sequence
  Description of Artificial Sequence: Synthetic polypeptide
DEEEIRTTNPVATEQYGEVAATNPDGPNMRNGMNHV

SEQ ID NO: 132243 - protein, 32 aa, Artificial Sequence
  Description of Artificial Sequence: Synthetic polypeptide
DEEEIRTTNPCATEPYGSCAASNHMNRQNEAM

SEQ ID NO: 132244 - protein, 37 aa, Artificial Sequence
  Description of Artificial Sequence: Synthetic polypeptide
AEEEIRTTNPVATEQYGSVSTTNNNLQQGSTQGTEDE

SEQ ID NO: 132245 - protein, 33 aa, Artificial Sequence
  Description of Artificial Sequence: Synthetic polypeptide
DEEEIRTTNPCATEGYGCCCSTMNHAYFGSNQS

SEQ ID NO: 132246 - protein, 32 aa, Artificial Sequence
  Description of Artificial Sequence: Synthetic polypeptide
DEEEIRTTNPCATEGYGCCCSTNHASFGSDQS

SEQ ID NO: 132247 - protein, 38 aa, Artificial Sequence
  Description of Artificial Sequence: Synthetic polypeptide
AEEEIRTTNPVATEQYGSVSTTNNNNLGNQLQGNNNVD

SEQ ID NO: 132248 - protein, 36 aa, Artificial Sequence
  Description of Artificial Sequence: Synthetic polypeptide
DEEEIRTTNPVATEQYGEVSSTTPAGPNYRNGMNPV

SEQ ID NO: 132249 - protein, 36 aa, Artificial Sequence
  Description of Artificial Sequence: Synthetic polypeptide
DEEEIRTTNPVATEQYGEVSSTTPAGPNMRNGMNPV

SEQ ID NO: 132250 - protein, 36 aa, Artificial Sequence
  Description of Artificial Sequence: Synthetic polypeptide
DEEEIRTTNPVATEQYGEVSSTTPAGPNMRGGMNPV

SEQ ID NO: 132251 - protein, 30 aa, Artificial Sequence
  Description of Artificial Sequence: Synthetic polypeptide
DEEEIVTTNPVATEQYGTAPATGCVEHEEK

SEQ ID NO: 132252 - protein, 32 aa, Artificial Sequence
  Description of Artificial Sequence: Synthetic polypeptide
DDQEIATTNPVATEQYGSVAANTLEDHEGQDL

SEQ ID NO: 132253 - protein, 32 aa, Artificial Sequence
  Description of Artificial Sequence: Synthetic polypeptide
DDQEIATTNPVATEQYGSVNATDLEDHEGEDL

SEQ ID NO: 132254 - protein, 33 aa, Artificial Sequence
  Description of Artificial Sequence: Synthetic polypeptide
SEEEIRCTNPTAYEQWGSVSGENDDDMRGQNKR

SEQ ID NO: 132255 - protein, 33 aa, Artificial Sequence
  Description of Artificial Sequence: Synthetic polypeptide
DDQEIATTNPVATEQYGSVSATLDLEDHIGEDP

SEQ ID NO: 132256 - protein, 32 aa, Artificial Sequence
  Description of Artificial Sequence: Synthetic polypeptide
SEEEIRCTNPTAYEQWGSVSGENDNDMRGANS

SEQ ID NO: 132257 - protein, 31 aa, Artificial Sequence
  Description of Artificial Sequence: Synthetic polypeptide
SEEEIRCTNPTAYEQWGSVYKENDMHRGDAR

SEQ ID NO: 132258 - protein, 34 aa, Artificial Sequence
  Description of Artificial Sequence: Synthetic polypeptide
DEEEIRTTNPVAYEMYGSVCCLGNDSHTRGGTRL

SEQ ID NO: 132259 - protein, 34 aa, Artificial Sequence
  Description of Artificial Sequence: Synthetic polypeptide
DEEEIRTTNPVATEQYGEVSSTPAGPNHNGMEPV

SEQ ID NO: 132260 - protein, 37 aa, Artificial Sequence
  Description of Artificial Sequence: Synthetic polypeptide
AEEEIRTTNPVATEQYGSVSTTNNNLQQNENGETDED

SEQ ID NO: 132261 - protein, 36 aa, Artificial Sequence
  Description of Artificial Sequence: Synthetic polypeptide
DEEEIVTTNPVATEQYGSVSSTTPAGPNMRNGMNPV

SEQ ID NO: 132262 - protein, 33 aa, Artificial Sequence
  Description of Artificial Sequence: Synthetic polypeptide
DEEEIRTTNPVATEQYGEVPTTPVGPNHGMEPV

SEQ ID NO: 132263 - protein, 37 aa, Artificial Sequence
  Description of Artificial Sequence: Synthetic polypeptide
AEEEIRTTNPVATEQYGSVSTTNNNLQQGTDEGETED

SEQ ID NO: 132264 - protein, 36 aa, Artificial Sequence
  Description of Artificial Sequence: Synthetic polypeptide
DEEEIVTTNPVATEQYGSVSSATPAPPNMFEGMNPV

SEQ ID NO: 132265 - protein, 35 aa, Artificial Sequence
  Description of Artificial Sequence: Synthetic polypeptide
DEEEIVTTNPVATEQYGSVSSATDAGVEMFNGNPD

SEQ ID NO: 132266 - protein, 37 aa, Artificial Sequence
  Description of Artificial Sequence: Synthetic polypeptide
AEEEIRTTNPVATEQYGSVSTTNNNNNQQGNGENQDE

SEQ ID NO: 132267 - protein, 36 aa, Artificial Sequence
  Description of Artificial Sequence: Synthetic polypeptide
AEEEIRTTNPVATEQYGSVSTTNNNLNNEIGETEED

SEQ ID NO: 132268 - protein, 36 aa, Artificial Sequence
  Description of Artificial Sequence: Synthetic polypeptide
DEEEIRTTNPVATEQYGFVSSTTPAGPFMRNGMNPV

SEQ ID NO: 132269 - protein, 35 aa, Artificial Sequence
  Description of Artificial Sequence: Synthetic polypeptide
DEEEIVTTNPVATEQYGTVSSATPGPVEMREGNPD

SEQ ID NO: 132270 - protein, 36 aa, Artificial Sequence
  Description of Artificial Sequence: Synthetic polypeptide
DEEEIRTTNPVATEQYGHVSSTTPAFPNMRNGMNPV

SEQ ID NO: 132271 - protein, 36 aa, Artificial Sequence
  Description of Artificial Sequence: Synthetic polypeptide
DEEEIRTTNPVATEQYGHVSSTTDAGPNMRNGMNPV

SEQ ID NO: 132272 - protein, 36 aa, Artificial Sequence
  Description of Artificial Sequence: Synthetic polypeptide
DEEEIRTTNPVATEQYGHVHSTTPAGPNMRNGMNPV

SEQ ID NO: 132273 - protein, 37 aa, Artificial Sequence
  Description of Artificial Sequence: Synthetic polypeptide
DEEEIRTTNPVATEQYGHSVWSTTPAGPNMRNGMNPV

SEQ ID NO: 132274 - protein, 37 aa, Artificial Sequence
  Description of Artificial Sequence: Synthetic polypeptide
DEEEIRTTNPVATEQYGHSVSVTTPAGPNMRNGMNPV

SEQ ID NO: 132275 - protein, 30 aa, Artificial Sequence
  Description of Artificial Sequence: Synthetic polypeptide
DDNEIRTTNPVATEQWGDVSEIEMNAAGDA

SEQ ID NO: 132276 - protein, 33 aa, Artificial Sequence
  Description of Artificial Sequence: Synthetic polypeptide
DEEEIRTTNPVAYECYGQKISTLNMESQQVNNF

SEQ ID NO: 132277 - protein, 37 aa, Artificial Sequence
  Description of Artificial Sequence: Synthetic polypeptide
DEEEIRTTNPVATEQYGHSVSSTTPAGPNMRNGMNPV

SEQ ID NO: 132278 - protein, 37 aa, Artificial Sequence
  Description of Artificial Sequence: Synthetic polypeptide
DEEEIRTTNPVATEQYGHSVSSTTPAGPNFRNGMNPV

SEQ ID NO: 132279 - protein, 36 aa, Artificial Sequence
  Description of Artificial Sequence: Synthetic polypeptide
DEEEIRTTNPVATEQYGHVSSTTPAGPNARNGMNPV

SEQ ID NO: 132280 - protein, 37 aa, Artificial Sequence
  Description of Artificial Sequence: Synthetic polypeptide
AEEEIRTTNPVATEQYGSVSTTNNQLGGTEQGTNEDG

SEQ ID NO: 132281 - protein, 37 aa, Artificial Sequence
  Description of Artificial Sequence: Synthetic polypeptide
AEEEIRTTNPVATEQYGSVSTTNNQLGGNNGGNNISE

SEQ ID NO: 132282 - protein, 37 aa, Artificial Sequence
  Description of Artificial Sequence: Synthetic polypeptide
AEEEIRTTNPVATEQYGSVSTTNNQLGGNEAGTNIQE

SEQ ID NO: 132283 - protein, 34 aa, Artificial Sequence
  Description of Artificial Sequence: Synthetic polypeptide
DEEEIRTTNPVAYECYGQKTITSTNMESQRVNNM

SEQ ID NO: 132284 - protein, 36 aa, Artificial Sequence
  Description of Artificial Sequence: Synthetic polypeptide
AEEEIRTTNPVATEQYGSVSTTNNQLGDEEGTTEDT

SEQ ID NO: 132285 - protein, 37 aa, Artificial Sequence
  Description of Artificial Sequence: Synthetic polypeptide
AEEEIRTTNPVATEQYGSVSTTNNQLEGNTETGNTVQ

SEQ ID NO: 132286 - protein, 37 aa, Artificial Sequence
  Description of Artificial Sequence: Synthetic polypeptide
AEEEIRTTNPVATEQYGSVSTTNNQLAGNNIGENISE

SEQ ID NO: 132287 - protein, 36 aa, Artificial Sequence
  Description of Artificial Sequence: Synthetic polypeptide
DEEELRTTNPVATEQYGSVSSTTPIGPNMRNGMNPV

SEQ ID NO: 132288 - protein, 36 aa, Artificial Sequence
  Description of Artificial Sequence: Synthetic polypeptide
DEEELRTTNPVATEQYGSVSSTTPAGPNMRNGMNPV

SEQ ID NO: 132289 - protein, 36 aa, Artificial Sequence
  Description of Artificial Sequence: Synthetic polypeptide
DEEELRTTNPVATEQYGSVSSTTPAGPNMRNGMNDV

SEQ ID NO: 132290 - protein, 30 aa, Artificial Sequence
  Description of Artificial Sequence: Synthetic polypeptide
DDNEIRTTNPVATEQYGNVSEIIMNAAEDA

SEQ ID NO: 132291 - protein, 36 aa, Artificial Sequence
  Description of Artificial Sequence: Synthetic polypeptide
DEEEIRTTNPVATEQYGHVSSTTPAGPNMDNGMNPV

SEQ ID NO: 132292 - protein, 36 aa, Artificial Sequence
  Description of Artificial Sequence: Synthetic polypeptide
DEEEIRTTNPVATEQYGHVSSTTPAGPNMRGGMNPV

SEQ ID NO: 132293 - protein, 36 aa, Artificial Sequence
  Description of Artificial Sequence: Synthetic polypeptide
DEEEIRTTNPVATEQYGHVSSTTPAGPNMRNGMNPV

SEQ ID NO: 132294 - protein, 35 aa, Artificial Sequence
  Description of Artificial Sequence: Synthetic polypeptide
DEEEIRTTNPCATEAYGSVTVTVTNLEAGTNNNTA

SEQ ID NO: 132295 - protein, 37 aa, Artificial Sequence
  Description of Artificial Sequence: Synthetic polypeptide
AEEEIRTTNPVATEQYGSVSTTNNQNNNDENGNNQED

SEQ ID NO: 132296 - protein, 37 aa, Artificial Sequence
  Description of Artificial Sequence: Synthetic polypeptide
AEEEIRTTNPVATEQYGSVSTTNNQNGSTEQGTNSET

SEQ ID NO: 132297 - protein, 36 aa, Artificial Sequence
  Description of Artificial Sequence: Synthetic polypeptide
AEEEIRTTNPVATEQYGSVSTTNNQNGSEQGTTTET

SEQ ID NO: 132298 - protein, 37 aa, Artificial Sequence
  Description of Artificial Sequence: Synthetic polypeptide
AEEEIRTTNPVATEQYGSVSTTNNQNGNTEQGTNFEQ

SEQ ID NO: 132299 - protein, 30 aa, Artificial Sequence
  Description of Artificial Sequence: Synthetic polypeptide
DEEEVATTNPVATEGYGEAAAEVIQSREQR

SEQ ID NO: 132300 - protein, 37 aa, Artificial Sequence
  Description of Artificial Sequence: Synthetic polypeptide
AEEEIRTTNPVATEQYGSVSTTNNQNGITEQGTNEEE

SEQ ID NO: 132301 - protein, 37 aa, Artificial Sequence
  Description of Artificial Sequence: Synthetic polypeptide
AEEEIRTTNPVATEQYGSVSTTNNQNEQGTTNNNELF

SEQ ID NO: 132302 - protein, 28 aa, Artificial Sequence
  Description of Artificial Sequence: Synthetic peptide
DDNEIASTNPVSTEGYGNVSETIQREQL

SEQ ID NO: 132303 - protein, 35 aa, Artificial Sequence
  Description of Artificial Sequence: Synthetic polypeptide
DEEEVASTNPVATEQYGSVSSATPTGPNMRNGMNR

SEQ ID NO: 132304 - protein, 33 aa, Artificial Sequence
  Description of Artificial Sequence: Synthetic polypeptide
DEEEIRTTNPVAYEAYGTTPSTAEHSQGGGNDH

SEQ ID NO: 132305 - protein, 28 aa, Artificial Sequence
  Description of Artificial Sequence: Synthetic peptide
DDNEIASTNPVSTEGYGNVSNTIQREQL

SEQ ID NO: 132306 - protein, 32 aa, Artificial Sequence
  Description of Artificial Sequence: Synthetic polypeptide
DEEEVASTNPVATEGYGNVATTPTGQSRVGQR

SEQ ID NO: 132307 - protein, 32 aa, Artificial Sequence
  Description of Artificial Sequence: Synthetic polypeptide
DEEEVASTNPVATEGYGNVATTPTGQMRVGQR

SEQ ID NO: 132308 - protein, 36 aa, Artificial Sequence
  Description of Artificial Sequence: Synthetic polypeptide
DEEEIRTTNPCATEAYGSVTVVVTTNLQAGSTNETE

SEQ ID NO: 132309 - protein, 37 aa, Artificial Sequence
  Description of Artificial Sequence: Synthetic polypeptide
AEEEIRTTNPVATEQYGSVSTTNNQLQQGTEQGSTTD

SEQ ID NO: 132310 - protein, 33 aa, Artificial Sequence
  Description of Artificial Sequence: Synthetic polypeptide
DEEEIRTTNPVAYECYGCNPCLETNLQGHMNTD

SEQ ID NO: 132311 - protein, 36 aa, Artificial Sequence
  Description of Artificial Sequence: Synthetic polypeptide
DEEEIRTTNPVATEQYGHVWSTTPAGPNMRNGMNPV

SEQ ID NO: 132312 - protein, 30 aa, Artificial Sequence
  Description of Artificial Sequence: Synthetic polypeptide
DDNEIATTNPVSTEPYGNVANDIQQRNGNH

SEQ ID NO: 132313 - protein, 30 aa, Artificial Sequence
  Description of Artificial Sequence: Synthetic polypeptide
DDNEIATTNPVSTEPYGTVANDIQQRNGNH

SEQ ID NO: 132314 - protein, 36 aa, Artificial Sequence
  Description of Artificial Sequence: Synthetic polypeptide
DEEEIRTTNPVATEQYGHVSSTTPDGPNMRNGMNPV

SEQ ID NO: 132315 - protein, 37 aa, Artificial Sequence
  Description of Artificial Sequence: Synthetic polypeptide
AEEEIRTTNPVATEQYGSVSTTNNQGQQIGTTNAEEQ

SEQ ID NO: 132316 - protein, 36 aa, Artificial Sequence
  Description of Artificial Sequence: Synthetic polypeptide
DEEEIRTTNPVATEQYGFVSSTTPAGPNMRMGMNPS

SEQ ID NO: 132317 - protein, 36 aa, Artificial Sequence
  Description of Artificial Sequence: Synthetic polypeptide
AEEEIRTTNPVATEQYGSVSTTNNQGNSNANDEQGE

SEQ ID NO: 132318 - protein, 36 aa, Artificial Sequence
  Description of Artificial Sequence: Synthetic polypeptide
AEEEIRTTNPVATEQYGSVSTTNNQAGTEQGTEEEE

SEQ ID NO: 132319 - protein, 32 aa, Artificial Sequence
  Description of Artificial Sequence: Synthetic polypeptide
SEEEIRCTNPIAYEQWGSVSGENDDDMRGADR

SEQ ID NO: 132320 - protein, 32 aa, Artificial Sequence
  Description of Artificial Sequence: Synthetic polypeptide
SEEEIRCTNPIAYEQWGSVSGENDDDMRGLNS

SEQ ID NO: 132321 - protein, 33 aa, Artificial Sequence
  Description of Artificial Sequence: Synthetic polypeptide
SEEEIRCTNPIAYEQWGSVSGENDDDMRGNNER

SEQ ID NO: 132322 - protein, 33 aa, Artificial Sequence
  Description of Artificial Sequence: Synthetic polypeptide
SEEEIRCTNPIAYEQWGSVSGENDDDMRPGINR

SEQ ID NO: 132323 - protein, 33 aa, Artificial Sequence
  Description of Artificial Sequence: Synthetic polypeptide
SEEEIRCTNPIAYEQWGSVSGENDDDMRQGNGR

SEQ ID NO: 132324 - protein, 33 aa, Artificial Sequence
  Description of Artificial Sequence: Synthetic polypeptide
SEEEIRCTNPIAYEQWGSVSGENDDDRRGANDR

SEQ ID NO: 132325 - protein, 32 aa, Artificial Sequence
  Description of Artificial Sequence: Synthetic polypeptide
DEEEIRTTNPCATEEYGCVCQTNHANFGSDAM

SEQ ID NO: 132326 - protein, 31 aa, Artificial Sequence
  Description of Artificial Sequence: Synthetic polypeptide
DDNEVATTNPVSTEPYGNVANETIQQRNGNR

SEQ ID NO: 132327 - protein, 33 aa, Artificial Sequence
  Description of Artificial Sequence: Synthetic polypeptide
SEEEIRCTNPIAYEQWGSVSGENDDMRAGTNMR

SEQ ID NO: 132328 - protein, 33 aa, Artificial Sequence
  Description of Artificial Sequence: Synthetic polypeptide
SEEEIRCTNPIAYEQWGSVSGEINDDDMRGNNR

SEQ ID NO: 132329 - protein, 33 aa, Artificial Sequence
  Description of Artificial Sequence: Synthetic polypeptide
DEEEIRTTNPCATEEYGCVCQTNHGSFGSDNAA

SEQ ID NO: 132330 - protein, 33 aa, Artificial Sequence
  Description of Artificial Sequence: Synthetic polypeptide
SEEEIRCTNPIAYEQWGSVSGENDMNRHGQNDR

SEQ ID NO: 132331 - protein, 35 aa, Artificial Sequence
  Description of Artificial Sequence: Synthetic polypeptide
DEEEIVTTNPVATEQYGTVSSTTPGPVEMRNGNPD

SEQ ID NO: 132332 - protein, 35 aa, Artificial Sequence
  Description of Artificial Sequence: Synthetic polypeptide
DEEEIVTTNPVATEQYGTVSSTTPGPVEMREGNPD

SEQ ID NO: 132333 - protein, 35 aa, Artificial Sequence
  Description of Artificial Sequence: Synthetic polypeptide
DEEEIVTTNPVATEQYGTVSSTTPAPVEREGMNPD

SEQ ID NO: 132334 - protein, 32 aa, Artificial Sequence
  Description of Artificial Sequence: Synthetic polypeptide
SEEEIRCTNPIAYEQWGSVWGENDDHRDGHNR

SEQ ID NO: 132335 - protein, 31 aa, Artificial Sequence
  Description of Artificial Sequence: Synthetic polypeptide
DEEEIRTTNPCATEEYGCVCQWNHANGSDAA

SEQ ID NO: 132336 - protein, 33 aa, Artificial Sequence
  Description of Artificial Sequence: Synthetic polypeptide
SEEEIRCTNPIAYEQYGISVVSENAHSMDGGNR

SEQ ID NO: 132337 - protein, 36 aa, Artificial Sequence
  Description of Artificial Sequence: Synthetic polypeptide
DEEEIRTTNPVATEQYGFVSSTTPRGGNMRNGMNPV

SEQ ID NO: 132338 - protein, 36 aa, Artificial Sequence
  Description of Artificial Sequence: Synthetic polypeptide
DEEEIRTTNPVATEQYGFVSSTTPAGPNMRNGMNPV

SEQ ID NO: 132339 - protein, 33 aa, Artificial Sequence
  Description of Artificial Sequence: Synthetic polypeptide
DEEEIRTTNPCATEEYGCVCQTNHTRFGSDTAA

SEQ ID NO: 132340 - protein, 32 aa, Artificial Sequence
  Description of Artificial Sequence: Synthetic polypeptide
SEEEIRCTNPIAYEQWGSVFGENDDMRAGNNR

SEQ ID NO: 132341 - protein, 33 aa, Artificial Sequence
  Description of Artificial Sequence: Synthetic polypeptide
SEEEIRCTNPIAYEQWGSVCSGEQNDMRSGGNR

SEQ ID NO: 132342 - protein, 36 aa, Artificial Sequence
  Description of Artificial Sequence: Synthetic polypeptide
DEEEIWTTNPVATEQYGSVSSTTPAGPNMREGMNPV

SEQ ID NO: 132343 - protein, 36 aa, Artificial Sequence
  Description of Artificial Sequence: Synthetic polypeptide
AEEEIRTTNPVATEQYGSVSTTNNQAGSEIGTEEEQ

SEQ ID NO: 132344 - protein, 36 aa, Artificial Sequence
  Description of Artificial Sequence: Synthetic polypeptide
AEEEIRTTNPVATEQYGSVSTTNNQAGSEEGTTQDE

SEQ ID NO: 132345 - protein, 30 aa, Artificial Sequence
  Description of Artificial Sequence: Synthetic polypeptide
DDNEIRTTNPVSTEPYGTVAMDIQQQNGQR

SEQ ID NO: 132346 - protein, 32 aa, Artificial Sequence
  Description of Artificial Sequence: Synthetic polypeptide
DEEEIRTTNPCATEEYGCVCGTGEHGRGSDAS

SEQ ID NO: 132347 - protein, 36 aa, Artificial Sequence
  Description of Artificial Sequence: Synthetic polypeptide
AEEEIRTTNPVATEQYGSVSTTNNNQQQQNGTEGQE

SEQ ID NO: 132348 - protein, 36 aa, Artificial Sequence
  Description of Artificial Sequence: Synthetic polypeptide
AEEEIRTTNPVATEQYGSVSTTNNNQQQQNGTEEGD

SEQ ID NO: 132349 - protein, 36 aa, Artificial Sequence
  Description of Artificial Sequence: Synthetic polypeptide
AEEEIRTTNPVATEQYGSVSTTNNNQQQQNATNDEE

SEQ ID NO: 132350 - protein, 36 aa, Artificial Sequence
  Description of Artificial Sequence: Synthetic polypeptide
DEEEIYTTNPVATEQYGSVSSTYPADGPNRNDMNPV

SEQ ID NO: 132351 - protein, 36 aa, Artificial Sequence
  Description of Artificial Sequence: Synthetic polypeptide
DEEEIYTTNPVATEQYGSVSSTTPAGPNMRNGMNPV

SEQ ID NO: 132352 - protein, 36 aa, Artificial Sequence
  Description of Artificial Sequence: Synthetic polypeptide
DEEEIRTTNPVATEQYGGVSSTTPAGPNMRNGMNPV

SEQ ID NO: 132353 - protein, 36 aa, Artificial Sequence
  Description of Artificial Sequence: Synthetic polypeptide
DEEEIRTTNPVATEQYGGVSSTTPAGPNMRNGMNPN

SEQ ID NO: 132354 - protein, 36 aa, Artificial Sequence
  Description of Artificial Sequence: Synthetic polypeptide
AEEEIRTTNPVATEQYGSVSTTNNNQQQQIGTEESE

SEQ ID NO: 132355 - protein, 37 aa, Artificial Sequence
  Description of Artificial Sequence: Synthetic polypeptide
AEEEIRTTNPVATEQYGSVSTTNNNQQQQGNGEQQNT

SEQ ID NO: 132356 - protein, 32 aa, Artificial Sequence
  Description of Artificial Sequence: Synthetic polypeptide
DEEEIRTTNPCATEEYGCVCQTAHGRFGSDAA

SEQ ID NO: 132357 - protein, 31 aa, Artificial Sequence
  Description of Artificial Sequence: Synthetic polypeptide
SEEEIRCTNPIAYEQWGCVWGENDMHQGGNR

SEQ ID NO: 132358 - protein, 32 aa, Artificial Sequence
  Description of Artificial Sequence: Synthetic polypeptide
SEEEIRCTNPIAYEQWGMVSGENDDDMRGQNR

SEQ ID NO: 132359 - protein, 31 aa, Artificial Sequence
  Description of Artificial Sequence: Synthetic polypeptide
SEEEIRCTNPIAYEQWGSCSGENDMRAGTDR

SEQ ID NO: 132360 - protein, 30 aa, Artificial Sequence
  Description of Artificial Sequence: Synthetic polypeptide
DDNEVASTNPVSTEGYGNVSAENIQSRGQR

SEQ ID NO: 132361 - protein, 33 aa, Artificial Sequence
  Description of Artificial Sequence: Synthetic polypeptide
SEEEIRCTNPIAYEQWGSVCSGENDDMRGQNRS

SEQ ID NO: 132362 - protein, 36 aa, Artificial Sequence
  Description of Artificial Sequence: Synthetic polypeptide
DEEEIWTTNPVATEQYGSVSSTTPAGPNMRNGMNPV

SEQ ID NO: 132363 - protein, 36 aa, Artificial Sequence
  Description of Artificial Sequence: Synthetic polypeptide
DEEEIWTTNPVATEQYGSVSSTTPAGPNMRNGLNPV

SEQ ID NO: 132364 - protein, 37 aa, Artificial Sequence
  Description of Artificial Sequence: Synthetic polypeptide
AEEEIRTTNPVATEQYGSVSTTNNQGNQIGTTNQGDQ

SEQ ID NO: 132365 - protein, 37 aa, Artificial Sequence
  Description of Artificial Sequence: Synthetic polypeptide
AEEEIRTTNPVATEQYGSVSTTNNQNNQDEQGNNVED

SEQ ID NO: 132366 - protein, 38 aa, Artificial Sequence
  Description of Artificial Sequence: Synthetic polypeptide
AEEEIRTTNPVATEQYGSVSTTNNNLLQQNEQGNNNNE

SEQ ID NO: 132367 - protein, 36 aa, Artificial Sequence
  Description of Artificial Sequence: Synthetic polypeptide
AEEEIRTTNPVATEQYGSVSTTNNNLGNDEQGEAQG

SEQ ID NO: 132368 - protein, 33 aa, Artificial Sequence
  Description of Artificial Sequence: Synthetic polypeptide
SEEEIRTTNPVATEGYGCTSIGNEGQGGGGNNQ

SEQ ID NO: 132369 - protein, 33 aa, Artificial Sequence
  Description of Artificial Sequence: Synthetic polypeptide
SEEEIRTTNPVATEGYGCTSIMNEGQNGGGGNI

SEQ ID NO: 132370 - protein, 35 aa, Artificial Sequence
  Description of Artificial Sequence: Synthetic polypeptide
DEEEIRTTNPVATEQYGDVSTGMGQFGQEGIEEIT

SEQ ID NO: 132371 - protein, 33 aa, Artificial Sequence
  Description of Artificial Sequence: Synthetic polypeptide
SEEEIRTTNPVATEGYGCTSIMNIIGQGGGGNN

SEQ ID NO: 132372 - protein, 34 aa, Artificial Sequence
  Description of Artificial Sequence: Synthetic polypeptide
SEEEIRTTNPVATEGYGCTSIMNLIGQGGGGNTN

SEQ ID NO: 132373 - protein, 32 aa, Artificial Sequence
  Description of Artificial Sequence: Synthetic polypeptide
SEEEIRTTNPVATEGYGCTSIMNNGEGGGGNT

SEQ ID NO: 132374 - protein, 34 aa, Artificial Sequence
  Description of Artificial Sequence: Synthetic polypeptide
DEEEIRTTNPCATEQYGQCVCQTELQNFGSDTAS

SEQ ID NO: 132375 - protein, 34 aa, Artificial Sequence
  Description of Artificial Sequence: Synthetic polypeptide
SEEEIRTTNPVATEGYGCTVSIMNLGFGGGGNET

SEQ ID NO: 132376 - protein, 32 aa, Artificial Sequence
  Description of Artificial Sequence: Synthetic polypeptide
SEEEIRTTNPVATEGYGCVCGTAHQNFGSDQA

SEQ ID NO: 132377 - protein, 35 aa, Artificial Sequence
  Description of Artificial Sequence: Synthetic polypeptide
DEEEIRTTNPCATEQYGIVSSTPAGPNMRNGMNPV

SEQ ID NO: 132378 - protein, 35 aa, Artificial Sequence
  Description of Artificial Sequence: Synthetic polypeptide
DEEEIRTTNPVATEQYGDVSSTTPIGPNNRNGMDV

SEQ ID NO: 132379 - protein, 33 aa, Artificial Sequence
  Description of Artificial Sequence: Synthetic polypeptide
SEEEIRTTNPVATEGYGCVCSNTNHIHFGSDTQ

SEQ ID NO: 132380 - protein, 34 aa, Artificial Sequence
  Description of Artificial Sequence: Synthetic polypeptide
SEEEIRTTNPVATEGYGCVCSNTNLINFGSDTQQ

SEQ ID NO: 132381 - protein, 35 aa, Artificial Sequence
  Description of Artificial Sequence: Synthetic polypeptide
DEEEIRTTNPVATEQYGDVSSTTPAGPNNRNGMDV

SEQ ID NO: 132382 - protein, 34 aa, Artificial Sequence
  Description of Artificial Sequence: Synthetic polypeptide
SEEEIRTTNPVATEGYGCVSNTGNLANFGSDTQA

SEQ ID NO: 132383 - protein, 36 aa, Artificial Sequence
  Description of Artificial Sequence: Synthetic polypeptide
DEEEIRTTNPVATEQYGDVSSTTPAGPNMRNGSNPV

SEQ ID NO: 132384 - protein, 36 aa, Artificial Sequence
  Description of Artificial Sequence: Synthetic polypeptide
DEEEIRTTNPVATEQYGDVSSTTPAGPNMRNGMNPV

SEQ ID NO: 132385 - protein, 35 aa, Artificial Sequence
  Description of Artificial Sequence: Synthetic polypeptide
DEEEIRTTNPVATEQYGDVSSTTPAGPNMRNGMDV

SEQ ID NO: 132386 - protein, 36 aa, Artificial Sequence
  Description of Artificial Sequence: Synthetic polypeptide
DEEEIRTTNPVATEQYGDVSSTTPAGPMNRNGMNPV

SEQ ID NO: 132387 - protein, 36 aa, Artificial Sequence
  Description of Artificial Sequence: Synthetic polypeptide
DEEEIRTTNPVATEQYGDVSSTTPAGPMMRNGMNPV

SEQ ID NO: 132388 - protein, 34 aa, Artificial Sequence
  Description of Artificial Sequence: Synthetic polypeptide
SEEEIRTTNPVATEGYGCVCSNTGELARFGSDTQ

SEQ ID NO: 132389 - protein, 34 aa, Artificial Sequence
  Description of Artificial Sequence: Synthetic polypeptide
SEEEIRTTNPVATEFYGSVMGNTNLVMEGDGQGE

SEQ ID NO: 132390 - protein, 34 aa, Artificial Sequence
  Description of Artificial Sequence: Synthetic polypeptide
SEEEIRTTNPVATEFYGSVMGDTNLVFEGDGQDE

SEQ ID NO: 132391 - protein, 33 aa, Artificial Sequence
  Description of Artificial Sequence: Synthetic polypeptide
DEEEIRTTNPCATEQYGCVCSWPHNANFGSDQS

SEQ ID NO: 132392 - protein, 36 aa, Artificial Sequence
  Description of Artificial Sequence: Synthetic polypeptide
DEEEIRTTNPVATEQYGDVVDDQTNGQQEIGGENNQ

SEQ ID NO: 132393 - protein, 36 aa, Artificial Sequence
  Description of Artificial Sequence: Synthetic polypeptide
AEEEIRTTNPVATEQYGSVSTTNNENGTELGGNNLI

SEQ ID NO: 132394 - protein, 36 aa, Artificial Sequence
  Description of Artificial Sequence: Synthetic polypeptide
SEEEIRTTNPIATEQYGSVSSTTPALPNMRNGMNPV

SEQ ID NO: 132395 - protein, 33 aa, Artificial Sequence
  Description of Artificial Sequence: Synthetic polypeptide
DEEEIRTTNPVATEQYGDVTDGNMVTGEGGEQG

SEQ ID NO: 132396 - protein, 36 aa, Artificial Sequence
  Description of Artificial Sequence: Synthetic polypeptide
AEEEIRTTNPVATEQYGSVSTTNNDNGNTQGTNQAN

SEQ ID NO: 132397 - protein, 35 aa, Artificial Sequence
  Description of Artificial Sequence: Synthetic polypeptide
DEEEIRTTNPVATEQYGDVSVTGEMDLEDDGGGGT

SEQ ID NO: 132398 - protein, 36 aa, Artificial Sequence
  Description of Artificial Sequence: Synthetic polypeptide
SEEEIRTTNPMATEQYGSVVACTGNALSQVDGGNYA

SEQ ID NO: 132399 - protein, 36 aa, Artificial Sequence
  Description of Artificial Sequence: Synthetic polypeptide
SEEEIRTTNPMATEQYGSVVVACTNALSQVVGGNYA

SEQ ID NO: 132400 - protein, 33 aa, Artificial Sequence
  Description of Artificial Sequence: Synthetic polypeptide
DEEEIRTTNPCATEQYGCVCGTEHQNFGSQTAS

SEQ ID NO: 132401 - protein, 34 aa, Artificial Sequence
  Description of Artificial Sequence: Synthetic polypeptide
DEEEIRTTNPCATEQYGCVCGTELQEHFGSDTAS

SEQ ID NO: 132402 - protein, 34 aa, Artificial Sequence
  Description of Artificial Sequence: Synthetic polypeptide
DEEEIRTTNPCATEQYGCVCQNWELQNFGSDTAS

SEQ ID NO: 132403 - protein, 34 aa, Artificial Sequence
  Description of Artificial Sequence: Synthetic polypeptide
DEEEIRTTNPCATEQYGCVCQTELQENFGSDTAA

SEQ ID NO: 132404 - protein, 34 aa, Artificial Sequence
  Description of Artificial Sequence: Synthetic polypeptide
DEEEIRTTNPCATEQYGCVCQWEELQNFGSNTAS

SEQ ID NO: 132405 - protein, 33 aa, Artificial Sequence
  Description of Artificial Sequence: Synthetic polypeptide
DEEEIRTTNPCATEQYGCVCSTGEHINFNSDQL

SEQ ID NO: 132406 - protein, 32 aa, Artificial Sequence
  Description of Artificial Sequence: Synthetic polypeptide
DEEEIRTTNPCATEQYGCVCSWEDAHFGSDQA

SEQ ID NO: 132407 - protein, 33 aa, Artificial Sequence
  Description of Artificial Sequence: Synthetic polypeptide
DEEEIRTTNPCATEQYGCVCSWEDNANFGSDQG

SEQ ID NO: 132408 - protein, 34 aa, Artificial Sequence
  Description of Artificial Sequence: Synthetic polypeptide
SEEEIRTTNPVATEEYGCVCSNTGNLANFGSDQQ

SEQ ID NO: 132409 - protein, 33 aa, Artificial Sequence
  Description of Artificial Sequence: Synthetic polypeptide
DEEEIRTTNPCATEQYGCVCSWEHNFNFGSDQA

SEQ ID NO: 132410 - protein, 32 aa, Artificial Sequence
  Description of Artificial Sequence: Synthetic polypeptide
DEEEIRTTNPCATEQYGCVCSWEIANFGSDDS

SEQ ID NO: 132411 - protein, 33 aa, Artificial Sequence
  Description of Artificial Sequence: Synthetic polypeptide
DEEEIRTTNPCATEQYGCVCSWGNHAYFGSDQS

SEQ ID NO: 132412 - protein, 33 aa, Artificial Sequence
  Description of Artificial Sequence: Synthetic polypeptide
DEEEIRTTNPCATEQYGCVCSWNHNTYFGSDQS

SEQ ID NO: 132413 - protein, 36 aa, Artificial Sequence
  Description of Artificial Sequence: Synthetic polypeptide
DEEEIRTTNPVATEQYGDVSSTTPAGANMRNGMNPV

SEQ ID NO: 132414 - protein, 36 aa, Artificial Sequence
  Description of Artificial Sequence: Synthetic polypeptide
AEEEIRTTNPVATEQYGSVSTTNNGNQIGTTTQGDQ

SEQ ID NO: 132415 - protein, 34 aa, Artificial Sequence
  Description of Artificial Sequence: Synthetic polypeptide
DEEEIRTTNPVATEQYGDVSSGIGGGNGQGEEIE

SEQ ID NO: 132416 - protein, 35 aa, Artificial Sequence
  Description of Artificial Sequence: Synthetic polypeptide
DEEEIRTTNPCATEQYGSCAAGTNLQATPGDIEAP

SEQ ID NO: 132417 - protein, 35 aa, Artificial Sequence
  Description of Artificial Sequence: Synthetic polypeptide
DEEEIRTTNPVATEQYGDVMGSDPNEMTGGGNTGN

SEQ ID NO: 132418 - protein, 35 aa, Artificial Sequence
  Description of Artificial Sequence: Synthetic polypeptide
DEEEIRTTNPVATEQYGDVMGSDPNEMTGGGNEGF

SEQ ID NO: 132419 - protein, 34 aa, Artificial Sequence
  Description of Artificial Sequence: Synthetic polypeptide
DEEEIRTTNPVATEQYGDVMGSDPNEMTGGGEGG

SEQ ID NO: 132420 - protein, 35 aa, Artificial Sequence
  Description of Artificial Sequence: Synthetic polypeptide
DEEEIRTTNPVATEQYGDVMGSDPNEMTGGANNGQ

SEQ ID NO: 132421 - protein, 34 aa, Artificial Sequence
  Description of Artificial Sequence: Synthetic polypeptide
SEEEIRTTNPVATEQYGCVCGNTALQNFGSDTQA

SEQ ID NO: 132422 - protein, 35 aa, Artificial Sequence
  Description of Artificial Sequence: Synthetic polypeptide
DEEEISTTNPVAYEQYGCVCSTGELNQNFGSENQS

SEQ ID NO: 132423 - protein, 33 aa, Artificial Sequence
  Description of Artificial Sequence: Synthetic polypeptide
SEEEIRTTNPVATEQYGCVCGSAHNQNFNSDQS

SEQ ID NO: 132424 - protein, 34 aa, Artificial Sequence
  Description of Artificial Sequence: Synthetic polypeptide
DEEEISTTNPVAYEQYGCVCSTGEHQFFGSDNQT

SEQ ID NO: 132425 - protein, 33 aa, Artificial Sequence
  Description of Artificial Sequence: Synthetic polypeptide
SEEEIRTTNPVATEQYGCVCGTAHQNFNSDNQA

SEQ ID NO: 132426 - protein, 35 aa, Artificial Sequence
  Description of Artificial Sequence: Synthetic polypeptide
DEEEIRTTNPVATEQYGDVMGSNPNIEFTGGGNGG

SEQ ID NO: 132427 - protein, 33 aa, Artificial Sequence
  Description of Artificial Sequence: Synthetic polypeptide
SEEEIRTTNPVATEQYGCVCGTGALANFGSDQA

SEQ ID NO: 132428 - protein, 32 aa, Artificial Sequence
  Description of Artificial Sequence: Synthetic polypeptide
DEEEISTTNPVAYEQYGCVCSSEHQNFNSDQS

SEQ ID NO: 132429 - protein, 35 aa, Artificial Sequence
  Description of Artificial Sequence: Synthetic polypeptide
DEEEIRTTNPVATEQYGDVISGNNMDDGEGNDDGG

SEQ ID NO: 132430 - protein, 36 aa, Artificial Sequence
  Description of Artificial Sequence: Synthetic polypeptide
DEEEIRTTNPVATEQYGDVGSTMNFDEGGNGDDDQQ

SEQ ID NO: 132431 - protein, 36 aa, Artificial Sequence
  Description of Artificial Sequence: Synthetic polypeptide
DEEEIRTTNPVATEQYGDVDSGVNGLGEGGDNNDQT

SEQ ID NO: 132432 - protein, 35 aa, Artificial Sequence
  Description of Artificial Sequence: Synthetic polypeptide
SEEEIRTTNPVATEQYGCVCSTGNHDQYFNSDTQA

SEQ ID NO: 132433 - protein, 34 aa, Artificial Sequence
  Description of Artificial Sequence: Synthetic polypeptide
DEEEIRTTNPVATEQYGDVCSWMSGANQMQMVVQ

SEQ ID NO: 132434 - protein, 35 aa, Artificial Sequence
  Description of Artificial Sequence: Synthetic polypeptide
SEEEIRTTNPVATEQYGCVCSTMEHDQNFGSNTQS

SEQ ID NO: 132435 - protein, 34 aa, Artificial Sequence
  Description of Artificial Sequence: Synthetic polypeptide
SEEEIRTTNPVATEQYGCVCSTNHAENFNSDFQG

SEQ ID NO: 132436 - protein, 34 aa, Artificial Sequence
  Description of Artificial Sequence: Synthetic polypeptide
SEEEIRTTNPVATEQYGCVCSTNHDANFNSNFQG

SEQ ID NO: 132437 - protein, 33 aa, Artificial Sequence
  Description of Artificial Sequence: Synthetic polypeptide
SEEEIRTTNPVATEQYGCVCSSEHDQNFNSEQA

SEQ ID NO: 132438 - protein, 34 aa, Artificial Sequence
  Description of Artificial Sequence: Synthetic polypeptide
SEEEIRTTNPVATEQYGCSCSTEDNQEYFQSDQS

SEQ ID NO: 132439 - protein, 33 aa, Artificial Sequence
  Description of Artificial Sequence: Synthetic polypeptide
SEEEIRTTNPVATEQYGCMNTSVPLEDRPENKE

SEQ ID NO: 132440 - protein, 35 aa, Artificial Sequence
  Description of Artificial Sequence: Synthetic polypeptide
DEEEIRTTNPVATEQYGDVMGSNPNIEMTGGGNGT

SEQ ID NO: 132441 - protein, 36 aa, Artificial Sequence
  Description of Artificial Sequence: Synthetic polypeptide
DEEEIRTTNPCATEQYGSCAASGNLGQATPGDNEAM

SEQ ID NO: 132442 - protein, 34 aa, Artificial Sequence
  Description of Artificial Sequence: Synthetic polypeptide
DEEEIRTTNPCATEQYGSCAASNTQATPGDNMAM

SEQ ID NO: 132443 - protein, 37 aa, Artificial Sequence
  Description of Artificial Sequence: Synthetic polypeptide
DEEEIRTTNPVATEQYGDVSMGNLNDGGNGQTGNGGI

SEQ ID NO: 132444 - protein, 34 aa, Artificial Sequence
  Description of Artificial Sequence: Synthetic polypeptide
DEEEIRTTNPVATEQYGDVSLMEAIPNQMQMSVQ

SEQ ID NO: 132445 - protein, 35 aa, Artificial Sequence
  Description of Artificial Sequence: Synthetic polypeptide
DEEEIRTTNPCATEQYGSCAATNLDQTMHGDEAAE

SEQ ID NO: 132446 - protein, 34 aa, Artificial Sequence
  Description of Artificial Sequence: Synthetic polypeptide
DEEEIRTTNPCATEQYGSCAATNLQATPDDFAAE

SEQ ID NO: 132447 - protein, 34 aa, Artificial Sequence
  Description of Artificial Sequence: Synthetic polypeptide
DEEEIRTTNPCATEQYGSCAATNLQATPDDMMAH

SEQ ID NO: 132448 - protein, 34 aa, Artificial Sequence
  Description of Artificial Sequence: Synthetic polypeptide
SEEEIRTTNPVATEPYGSVFVWINEQDRKMGGDH

SEQ ID NO: 132449 - protein, 35 aa, Artificial Sequence
  Description of Artificial Sequence: Synthetic polypeptide
DEEEIRTTNPVATEQYGDVSDENQNNADVEGGNNT

SEQ ID NO: 132450 - protein, 34 aa, Artificial Sequence
  Description of Artificial Sequence: Synthetic polypeptide
DEEEIRTTNPVATEQYGDVSCMEVIENQMQMSVQ

SEQ ID NO: 132451 - protein, 36 aa, Artificial Sequence
  Description of Artificial Sequence: Synthetic polypeptide
DEEEIRTTNPVATEQYGDVQGTMNDGQQDGEGENTA

SEQ ID NO: 132452 - protein, 36 aa, Artificial Sequence
  Description of Artificial Sequence: Synthetic polypeptide
DEEEIRTTNPVATEQYGDVQGSNMNDGQGGQGENTA

SEQ ID NO: 132453 - protein, 36 aa, Artificial Sequence
  Description of Artificial Sequence: Synthetic polypeptide
DEEEIRTTNPVAYEPYGSTVHCTNSISHQNSGNERA

SEQ ID NO: 132454 - protein, 35 aa, Artificial Sequence
  Description of Artificial Sequence: Synthetic polypeptide
DEEEIRTTNPVATEQYGDVNSTSDDQQYEGEDEYS

SEQ ID NO: 132455 - protein, 35 aa, Artificial Sequence
  Description of Artificial Sequence: Synthetic polypeptide
DEEEIRTTNPVATEQYGDVNSTLNDDENSGQEEIS

SEQ ID NO: 132456 - protein, 35 aa, Artificial Sequence
  Description of Artificial Sequence: Synthetic polypeptide
DEEEIRTTNPVATEQYGDVNQNDDNEQGNIGGGNI

SEQ ID NO: 132457 - protein, 36 aa, Artificial Sequence
  Description of Artificial Sequence: Synthetic polypeptide
DEEEIRTTNPVATEQYGDVMSTTPAGPNMRNGMNPV

SEQ ID NO: 132458 - protein, 33 aa, Artificial Sequence
  Description of Artificial Sequence: Synthetic polypeptide
DEEEIRTTNPVATEQYGDVMSGIGGNGDGEIIA

SEQ ID NO: 132459 - protein, 33 aa, Artificial Sequence
  Description of Artificial Sequence: Synthetic polypeptide
DEEEIRTTNPVATEQYGDVMSGIGGNDGGEEIG

SEQ ID NO: 132460 - protein, 33 aa, Artificial Sequence
  Description of Artificial Sequence: Synthetic polypeptide
DEEEIRTTNPVATEQYGDVMSGIGGGNGGEETF

SEQ ID NO: 132461 - protein, 33 aa, Artificial Sequence
  Description of Artificial Sequence: Synthetic polypeptide
SEEEIRTTNPVATEQYGCCYSTSVDERGQEESI

SEQ ID NO: 132462 - protein, 34 aa, Artificial Sequence
  Description of Artificial Sequence: Synthetic polypeptide
DEEEIRTTNPVATEQYGDVSSEPAGPNMRAEMNV

SEQ ID NO: 132463 - protein, 32 aa, Artificial Sequence
  Description of Artificial Sequence: Synthetic polypeptide
DEEEIRTTNPCATEPYGSCATNHMNRQMDSAM

SEQ ID NO: 132464 - protein, 35 aa, Artificial Sequence
  Description of Artificial Sequence: Synthetic polypeptide
DEEEIRTTNPVATEQYGDVVDFGNLNLQEEGEGGL

SEQ ID NO: 132465 - protein, 35 aa, Artificial Sequence
  Description of Artificial Sequence: Synthetic polypeptide
DEEEIRTTNPVATEQYGDVVDGGNLNEQDEGETGI

SEQ ID NO: 132466 - protein, 37 aa, Artificial Sequence
  Description of Artificial Sequence: Synthetic polypeptide
AEEEIRTTNPVATEQYGSVSTTNNNDEQGTTEAGNED

SEQ ID NO: 132467 - protein, 33 aa, Artificial Sequence
  Description of Artificial Sequence: Synthetic polypeptide
DEEEIRTTNPCATEPYGSVAASNHAGRGGDIEA

SEQ ID NO: 132468 - protein, 33 aa, Artificial Sequence
  Description of Artificial Sequence: Synthetic polypeptide
DEEEIRTTNPVATEQYGEASTPACPNHNEMEPV

SEQ ID NO: 132469 - protein, 36 aa, Artificial Sequence
  Description of Artificial Sequence: Synthetic polypeptide
DEEEIRTTNPVAYEPYGISVVYTGNLSQDKAVTNNR

SEQ ID NO: 132470 - protein, 31 aa, Artificial Sequence
  Description of Artificial Sequence: Synthetic polypeptide
DDSEIACTNPVATEGYGEVSAETIQSRVGGR

SEQ ID NO: 132471 - protein, 33 aa, Artificial Sequence
  Description of Artificial Sequence: Synthetic polypeptide
DEEEIRTTNPVAYEPYGKISFENEESPNRVGNF

SEQ ID NO: 132472 - protein, 30 aa, Artificial Sequence
  Description of Artificial Sequence: Synthetic polypeptide
DDSEIACTNPVSTEQYGNVANTIMSRVGQR

SEQ ID NO: 132473 - protein, 36 aa, Artificial Sequence
  Description of Artificial Sequence: Synthetic polypeptide
DEEEITTTNPVATEQYGSVSSTTPAGPNMRNGMNPV

SEQ ID NO: 132474 - protein, 28 aa, Artificial Sequence
  Description of Artificial Sequence: Synthetic peptide
DDSEIAPTNPCSSEQYGNVANTIQRGTR

SEQ ID NO: 132475 - protein, 32 aa, Artificial Sequence
  Description of Artificial Sequence: Synthetic polypeptide
DEEEIVATNPVSTELYGVVSCENGEQQEGNDL

SEQ ID NO: 132476 - protein, 35 aa, Artificial Sequence
  Description of Artificial Sequence: Synthetic polypeptide
DEEEIRTTNPVATEQYGDVVTGIQNDGQGGGQDET

SEQ ID NO: 132477 - protein, 36 aa, Artificial Sequence
  Description of Artificial Sequence: Synthetic polypeptide
DEEEIRTTNPVATEQYGDVVTGIQNDEGQQGGNQEE

SEQ ID NO: 132478 - protein, 36 aa, Artificial Sequence
  Description of Artificial Sequence: Synthetic polypeptide
DEEEIRTTNPVATEQYGDVVSTMDGLGQEEGQEAQE

SEQ ID NO: 132479 - protein, 33 aa, Artificial Sequence
  Description of Artificial Sequence: Synthetic polypeptide
DEEEISTVNPVATEQYGCVCSTEHNQNFNSQQG

SEQ ID NO: 132480 - protein, 35 aa, Artificial Sequence
  Description of Artificial Sequence: Synthetic polypeptide
DEEEIRTTNPVATEQYGDVVSNADGDQNEGENQIT

SEQ ID NO: 132481 - protein, 35 aa, Artificial Sequence
  Description of Artificial Sequence: Synthetic polypeptide
DEEEIRTTNPVATEQYGDVVSISNGFGQTGQGEIY

SEQ ID NO: 132482 - protein, 34 aa, Artificial Sequence
  Description of Artificial Sequence: Synthetic polypeptide
DEEEIRTTNPVAYEPYGQSVSINEGSTSGPGVSR

SEQ ID NO: 132483 - protein, 36 aa, Artificial Sequence
  Description of Artificial Sequence: Synthetic polypeptide
DEEEIRTTNPVATEQYGDVVSISNGFGQTGNGGNEQ

SEQ ID NO: 132484 - protein, 34 aa, Artificial Sequence
  Description of Artificial Sequence: Synthetic polypeptide
DEEEIRTTNPVAYEPYGQSVSINESSTSPTGPSR

SEQ ID NO: 132485 - protein, 35 aa, Artificial Sequence
  Description of Artificial Sequence: Synthetic polypeptide
DEEEIRTTNPVATEQYGDVVSISNGFGQTGDGEMI

SEQ ID NO: 132486 - protein, 34 aa, Artificial Sequence
  Description of Artificial Sequence: Synthetic polypeptide
DEEEIRTTNPVATEQYGDVVTGIQNDGQGDEQEE

SEQ ID NO: 132487 - protein, 34 aa, Artificial Sequence
  Description of Artificial Sequence: Synthetic polypeptide
DEEEIVATTNPVATEAYGTCSQTNGSQNSGVNSI

SEQ ID NO: 132488 - protein, 37 aa, Artificial Sequence
  Description of Artificial Sequence: Synthetic polypeptide
AEEEIRTTNPVATEQYGSVSTTNNNDNQIGNNNNTQD

SEQ ID NO: 132489 - protein, 35 aa, Artificial Sequence
  Description of Artificial Sequence: Synthetic polypeptide
DEEEIRTTNPVATEQYGEMGDGTGNLNTIDGNGGE

SEQ ID NO: 132490 - protein, 38 aa, Artificial Sequence
  Description of Artificial Sequence: Synthetic polypeptide
DEEEIRTTNPVATEQYGESVSSTTPANGPNMRNGMNPV

SEQ ID NO: 132491 - protein, 37 aa, Artificial Sequence
  Description of Artificial Sequence: Synthetic polypeptide
DEEEIRTTNPVATEQYGESVSSTTPAGPNMRNGMNPV

SEQ ID NO: 132492 - protein, 37 aa, Artificial Sequence
  Description of Artificial Sequence: Synthetic polypeptide
AEEEIRTTNPVATEQYGSVSTTNNNLEQGTTEENEEA

SEQ ID NO: 132493 - protein, 32 aa, Artificial Sequence
  Description of Artificial Sequence: Synthetic polypeptide
DEEEIVSTNPVCTEQYGVVCSADGPVQFEGNQ

SEQ ID NO: 132494 - protein, 32 aa, Artificial Sequence
  Description of Artificial Sequence: Synthetic polypeptide
DEEEIVSTNPVCTEQYGTVCSADGPVQFEGNQ

SEQ ID NO: 132495 - protein, 35 aa, Artificial Sequence
  Description of Artificial Sequence: Synthetic polypeptide
DEEEIVRTTNPVAYEVYGSTVPCTNTSQNRVNNGI

SEQ ID NO: 132496 - protein, 37 aa, Artificial Sequence
  Description of Artificial Sequence: Synthetic polypeptide
DEEEIRTTNPVATEQYGESVNSTTPAGPNMRNGMNPV

SEQ ID NO: 132497 - protein, 37 aa, Artificial Sequence
  Description of Artificial Sequence: Synthetic polypeptide
AEEEIRTTNPVATEQYGSVSTTNNNLEQGTEEGVTED

SEQ ID NO: 132498 - protein, 37 aa, Artificial Sequence
  Description of Artificial Sequence: Synthetic polypeptide
AEEEIRTTNPVATEQYGSVSTTNNNLEQGTEEENVEE

SEQ ID NO: 132499 - protein, 37 aa, Artificial Sequence
  Description of Artificial Sequence: Synthetic polypeptide
AEEEIRTTNPVATEQYGSVSTTNNNLEQGTDEGTTTE

SEQ ID NO: 132500 - protein, 37 aa, Artificial Sequence
  Description of Artificial Sequence: Synthetic polypeptide
AEEEIRTTNPVATEQYGSVSTTNNNLEQGTDEENEDE

SEQ ID NO: 132501 - protein, 33 aa, Artificial Sequence
  Description of Artificial Sequence: Synthetic polypeptide
DEEEIVCTNPVATEQYGTVCSATDGPVMFEGND

SEQ ID NO: 132502 - protein, 36 aa, Artificial Sequence
  Description of Artificial Sequence: Synthetic polypeptide
AEEEIRTTNPVATEQYGSVSTTNNNLEQGTDEATED

SEQ ID NO: 132503 - protein, 33 aa, Artificial Sequence
  Description of Artificial Sequence: Synthetic polypeptide
DEEEIVCTNPVATEQYGTVCSATDGPVEFEGND

SEQ ID NO: 132504 - protein, 33 aa, Artificial Sequence
  Description of Artificial Sequence: Synthetic polypeptide
DEEEIVCTNPVATEQYGTVCSAEDNPVMFEGND

SEQ ID NO: 132505 - protein, 33 aa, Artificial Sequence
  Description of Artificial Sequence: Synthetic polypeptide
DEEEIVCTNPVATEQYGTVCSAEDGPVEREGND

SEQ ID NO: 132506 - protein, 37 aa, Artificial Sequence
  Description of Artificial Sequence: Synthetic polypeptide
AEEEIRTTNPVATEQYGSVSTTNNNLEQGSNQSNEDD

SEQ ID NO: 132507 - protein, 37 aa, Artificial Sequence
  Description of Artificial Sequence: Synthetic polypeptide
AEEEIRTTNPVATEQYGSVSTTNNNLEQGSNQPNNND

SEQ ID NO: 132508 - protein, 37 aa, Artificial Sequence
  Description of Artificial Sequence: Synthetic polypeptide
AEEEIRTTNPVATEQYGSVSTTNNNLEQGNNQTNNDD

SEQ ID NO: 132509 - protein, 31 aa, Artificial Sequence
  Description of Artificial Sequence: Synthetic polypeptide
DEEEIVCTNPIATEQYGTVCSEGPVMFEGND

SEQ ID NO: 132510 - protein, 36 aa, Artificial Sequence
  Description of Artificial Sequence: Synthetic polypeptide
AEEEIRTTNPVATEQYGSVSTTNNNINDEQGTNVDE

SEQ ID NO: 132511 - protein, 35 aa, Artificial Sequence
  Description of Artificial Sequence: Synthetic polypeptide
DEEEIRTTNPVATEQYGDVVSISNGFGDQTGQGDI

SEQ ID NO: 132512 - protein, 34 aa, Artificial Sequence
  Description of Artificial Sequence: Synthetic polypeptide
DEEEIRTTNPVATEQYGDVVDFMNNGPEGGQNDQ

SEQ ID NO: 132513 - protein, 33 aa, Artificial Sequence
  Description of Artificial Sequence: Synthetic polypeptide
DEEEISTTNPVCTEHYGCVCSWPELQNFGSNLG

SEQ ID NO: 132514 - protein, 34 aa, Artificial Sequence
  Description of Artificial Sequence: Synthetic polypeptide
DEEEIRTTNPVATEQYGDVVSDGMTGQGDGQDEQ

SEQ ID NO: 132515 - protein, 35 aa, Artificial Sequence
  Description of Artificial Sequence: Synthetic polypeptide
DEEEIRTTNPVATEQYGDVVGSVQNGGQGQGEDGT

SEQ ID NO: 132516 - protein, 37 aa, Artificial Sequence
  Description of Artificial Sequence: Synthetic polypeptide
DEEEIRTTNPVATEQYGDVVGSGMGNLNQTVDDGNDD

SEQ ID NO: 132517 - protein, 35 aa, Artificial Sequence
  Description of Artificial Sequence: Synthetic polypeptide
DEEEISTTNPVAYEQYGQCVCSTNDLNQSFGSEQA

SEQ ID NO: 132518 - protein, 34 aa, Artificial Sequence
  Description of Artificial Sequence: Synthetic polypeptide
DEEEISTTNPVAYEQYGQCVCSTELQHFNSEFQS

SEQ ID NO: 132519 - protein, 34 aa, Artificial Sequence
  Description of Artificial Sequence: Synthetic polypeptide
DEEEIRTTNPVATEQYGDVVGSGMDQVEGGGEEY

SEQ ID NO: 132520 - protein, 34 aa, Artificial Sequence
  Description of Artificial Sequence: Synthetic polypeptide
SEEEIRTTNPIATEQYGSTTWSNAENLAERGPYI

SEQ ID NO: 132521 - protein, 34 aa, Artificial Sequence
  Description of Artificial Sequence: Synthetic polypeptide
SEEEIRTTNPIATEQYGSTTWSNEENLAERGPYI

SEQ ID NO: 132522 - protein, 35 aa, Artificial Sequence
  Description of Artificial Sequence: Synthetic polypeptide
DEEEIRTTNPVATEQYGDVVGGMTNDLNVEGEGGQ

SEQ ID NO: 132523 - protein, 34 aa, Artificial Sequence
  Description of Artificial Sequence: Synthetic polypeptide
DEEEIRTTNPVATEQYGDVVGDENLNEIGGEGGE

SEQ ID NO: 132524 - protein, 33 aa, Artificial Sequence
  Description of Artificial Sequence: Synthetic polypeptide
DEEEIRTTNPVATEQYGDVVGVGNMNDGDGGQG

SEQ ID NO: 132525 - protein, 34 aa, Artificial Sequence
  Description of Artificial Sequence: Synthetic polypeptide
DEEEIRTTNPVATEQYGDVVGDENLNEGGGQGEQ

SEQ ID NO: 132526 - protein, 35 aa, Artificial Sequence
  Description of Artificial Sequence: Synthetic polypeptide
DEEEIRTTNPVATEQYGDVVDVGNLNDQGENENGD

SEQ ID NO: 132527 - protein, 36 aa, Artificial Sequence
  Description of Artificial Sequence: Synthetic polypeptide
DEEEIRTTNPVATEQYGDVVDTQNIIDQMEGQGNFG

SEQ ID NO: 132528 - protein, 34 aa, Artificial Sequence
  Description of Artificial Sequence: Synthetic polypeptide
DEEEIRTTNPVATEQYGDVVDTNNMVEDEFDNQN

SEQ ID NO: 132529 - protein, 35 aa, Artificial Sequence
  Description of Artificial Sequence: Synthetic polypeptide
DEEEIRTTNPVATEQYGDVVDTNMDDMEGENIQEQ

SEQ ID NO: 132530 - protein, 35 aa, Artificial Sequence
  Description of Artificial Sequence: Synthetic polypeptide
DEEEIRTTNPVATEQYGDVVDTNINMVEDEFGNEG

SEQ ID NO: 132531 - protein, 37 aa, Artificial Sequence
  Description of Artificial Sequence: Synthetic polypeptide
AEEEIRTTNPVATEQYGSVSTTNNLLQDTEQGTTEDE

SEQ ID NO: 132532 - protein, 35 aa, Artificial Sequence
  Description of Artificial Sequence: Synthetic polypeptide
DEEEIRTTNPVATEQYGDVVDIANMGLGNEGQGND

SEQ ID NO: 132533 - protein, 35 aa, Artificial Sequence
  Description of Artificial Sequence: Synthetic polypeptide
DEEEIRTTNPVATEQYGDVVDGTGNGQTQDQNEGE

SEQ ID NO: 132534 - protein, 35 aa, Artificial Sequence
  Description of Artificial Sequence: Synthetic polypeptide
DEEEIRTTNPVATEQYGDVVDGNFTDQQNIGGNDG

SEQ ID NO: 132535 - protein, 37 aa, Artificial Sequence
  Description of Artificial Sequence: Synthetic polypeptide
AEEEIRTTNPVATEQYGSVSTTNNLNNQGTNNNNELF

SEQ ID NO: 132536 - protein, 33 aa, Artificial Sequence
  Description of Artificial Sequence: Synthetic polypeptide
DEEEIRTTNPVATEQYGDVVGVGNMTDGEGGFG

SEQ ID NO: 132537 - protein, 34 aa, Artificial Sequence
  Description of Artificial Sequence: Synthetic polypeptide
DEEEIRTTNPVATEQYGDVVNDNENMTQDGGQGE

SEQ ID NO: 132538 - protein, 34 aa, Artificial Sequence
  Description of Artificial Sequence: Synthetic polypeptide
DEEEIRTTNPVATEQYGDVVNFEGEGQDEAGNES

SEQ ID NO: 132539 - protein, 34 aa, Artificial Sequence
  Description of Artificial Sequence: Synthetic polypeptide
DEEEIRTTNPVATEQYGDVVSDGMSGQGEGEDEG

SEQ ID NO: 132540 - protein, 36 aa, Artificial Sequence
  Description of Artificial Sequence: Synthetic polypeptide
DEEEIRTTNPVATEQYGDVVSDEMTMGQGEGEDNEG

SEQ ID NO: 132541 - protein, 34 aa, Artificial Sequence
  Description of Artificial Sequence: Synthetic polypeptide
DEEEIRTTNPVATEQYGDVVQTDNMNGTGGEEGD

SEQ ID NO: 132542 - protein, 35 aa, Artificial Sequence
  Description of Artificial Sequence: Synthetic polypeptide
DEEEISTTNPVAYEVYGKTVYSCTNATSQNRGNNG

SEQ ID NO: 132543 - protein, 35 aa, Artificial Sequence
  Description of Artificial Sequence: Synthetic polypeptide
DEEEIRTTNPVATEQYGDVVQDQTNMNQGIGGQDE

SEQ ID NO: 132544 - protein, 34 aa, Artificial Sequence
  Description of Artificial Sequence: Synthetic polypeptide
DEEEIRTTNPVAYEPYGQSVSINMGSQDPPGPSH

SEQ ID NO: 132545 - protein, 33 aa, Artificial Sequence
  Description of Artificial Sequence: Synthetic polypeptide
DEEEISTTNPVAYERYGSVPFCTNAVAFGGGKR

SEQ ID NO: 132546 - protein, 30 aa, Artificial Sequence
  Description of Artificial Sequence: Synthetic polypeptide
DDSEIASTNPISTEGYGSVAANTIQRVGQR

SEQ ID NO: 132547 - protein, 37 aa, Artificial Sequence
  Description of Artificial Sequence: Synthetic polypeptide
DEEEIRTTNPVATEQYGDVVNSNGQNLGQSEFGGNEG

SEQ ID NO: 132548 - protein, 35 aa, Artificial Sequence
  Description of Artificial Sequence: Synthetic polypeptide
DEEEIRTTNPVAYEPYGQSVVSINMGSQSPTGISR

SEQ ID NO: 132549 - protein, 30 aa, Artificial Sequence
  Description of Artificial Sequence: Synthetic polypeptide
DDSEIASTNPVATEGYGEVANTIQSRVGGR

SEQ ID NO: 132550 - protein, 34 aa, Artificial Sequence
  Description of Artificial Sequence: Synthetic polypeptide
DEEEISTTNPVAYEQYGSVPFCTNAHAFGGGKRS

SEQ ID NO: 132551 - protein, 33 aa, Artificial Sequence
  Description of Artificial Sequence: Synthetic polypeptide
DEEEISTTNPVAYEQYGSVPFCTNACSFEGGKK

SEQ ID NO: 132552 - protein, 34 aa, Artificial Sequence
  Description of Artificial Sequence: Synthetic polypeptide
DEEEISTTNPVAYEQYGSVPFCTNACATGGGMLR

SEQ ID NO: 132553 - protein, 34 aa, Artificial Sequence
  Description of Artificial Sequence: Synthetic polypeptide
DEEEISTTNPVAYEQYGSVCFITNASSFGTGGER

SEQ ID NO: 132554 - protein, 34 aa, Artificial Sequence
  Description of Artificial Sequence: Synthetic polypeptide
DEEEISTTNPVAYEQYGSVCFITGNAFSFGGGKR

SEQ ID NO: 132555 - protein, 30 aa, Artificial Sequence
  Description of Artificial Sequence: Synthetic polypeptide
DDSEIASTNPVATEGYGNVAAENIMSRGQR

SEQ ID NO: 132556 - protein, 36 aa, Artificial Sequence
  Description of Artificial Sequence: Synthetic polypeptide
DEEEIRTTNPVAYEPYGSTVCSCTQNADSNNRGNNG

SEQ ID NO: 132557 - protein, 35 aa, Artificial Sequence
  Description of Artificial Sequence: Synthetic polypeptide
DEEEIRTTNPVATEQYGDVVNNDTMNVTNGMGQND

SEQ ID NO: 132558 - protein, 30 aa, Artificial Sequence
  Description of Artificial Sequence: Synthetic polypeptide
SEEEIRTTNPIATECYGSTTAEDWMPGPYR

SEQ ID NO: 132559 - protein, 31 aa, Artificial Sequence
  Description of Artificial Sequence: Synthetic polypeptide
SEEEIRTTNPIATECYGSTVANADWAEPGNI

SEQ ID NO: 132560 - protein, 37 aa, Artificial Sequence
  Description of Artificial Sequence: Synthetic polypeptide
DEEEIRTTNPVATEQYGDVVSDLMNELGQGEGQNSEQ

SEQ ID NO: 132561 - protein, 38 aa, Artificial Sequence
  Description of Artificial Sequence: Synthetic polypeptide
AEEEIRTTNPVATEQYGSVSTTVANLQEATNEQGTNVE

SEQ ID NO: 132562 - protein, 35 aa, Artificial Sequence
  Description of Artificial Sequence: Synthetic polypeptide
DEEEVATTNPVATEQYGSVATTPTGPQMRNGMNPV

SEQ ID NO: 132563 - protein, 31 aa, Artificial Sequence
  Description of Artificial Sequence: Synthetic polypeptide
DDNEIASTNPVSTEGYGNASAENLQSRVGGR

SEQ ID NO: 132564 - protein, 35 aa, Artificial Sequence
  Description of Artificial Sequence: Synthetic polypeptide
DEEEIRTTNPVATEQYGNVMTDDNFNGQTGGQGEG

SEQ ID NO: 132565 - protein, 36 aa, Artificial Sequence
  Description of Artificial Sequence: Synthetic polypeptide
DEEEIRTTNPVATEQYGNVMSGGVNQDQGEGENEIG

SEQ ID NO: 132566 - protein, 37 aa, Artificial Sequence
  Description of Artificial Sequence: Synthetic polypeptide
AEEEIRTTNPVATEQYGSVSTTSNQQQQNQNGTTNAG

SEQ ID NO: 132567 - protein, 30 aa, Artificial Sequence
  Description of Artificial Sequence: Synthetic polypeptide
DDEEVASTNPVSTEGYGVVANNIQSRVGQR

SEQ ID NO: 132568 - protein, 36 aa, Artificial Sequence
  Description of Artificial Sequence: Synthetic polypeptide
AEEEIRTTNPVATEQYGSVSTTSNQGNANEQGNTGG

SEQ ID NO: 132569 - protein, 29 aa, Artificial Sequence
  Description of Artificial Sequence: Synthetic peptide
DDEEVATTNPVSTEGYGEVPAEVCQHGQR

SEQ ID NO: 132570 - protein, 36 aa, Artificial Sequence
  Description of Artificial Sequence: Synthetic polypeptide
AEEEIRTTNPVATEQYGSVSTTSNNNEQGNNNNQQD

SEQ ID NO: 132571 - protein, 34 aa, Artificial Sequence
  Description of Artificial Sequence: Synthetic polypeptide
DEEEIRSTNPVATEQYGMSGNGQTDEGQGGQENQ

SEQ ID NO: 132572 - protein, 33 aa, Artificial Sequence
  Description of Artificial Sequence: Synthetic polypeptide
DEEEIRSTNPVATEQYGMVGITGMGNEEDNGGQ

SEQ ID NO: 132573 - protein, 35 aa, Artificial Sequence
  Description of Artificial Sequence: Synthetic polypeptide
DEEEIRTTNPVAWEGYGKVPSCIGNELSTQGQNRA

SEQ ID NO: 132574 - protein, 37 aa, Artificial Sequence
  Description of Artificial Sequence: Synthetic polypeptide
DEEEIRTTNPVATEQYGNSVSSTTPTGPNMRNGMNPV

SEQ ID NO: 132575 - protein, 37 aa, Artificial Sequence
  Description of Artificial Sequence: Synthetic polypeptide
DEEEIRTTNPVATEQYGNSVSSTTPAGPNMRNGMNPV

SEQ ID NO: 132576 - protein, 36 aa, Artificial Sequence
  Description of Artificial Sequence: Synthetic polypeptide
DEEEIRTTNPVAWEQYGKVPSCIANELSTQGQNQRA

SEQ ID NO: 132577 - protein, 34 aa, Artificial Sequence
  Description of Artificial Sequence: Synthetic polypeptide
DEEEIRTTNPVAWEQYGKVPSCIRELSTQGQERA

SEQ ID NO: 132578 - protein, 37 aa, Artificial Sequence
  Description of Artificial Sequence: Synthetic polypeptide
AEEEIRTTNPVATEQYGSVSTTSNGTQQNTEQGTNEQ

SEQ ID NO: 132579 - protein, 34 aa, Artificial Sequence
  Description of Artificial Sequence: Synthetic polypeptide
DEEPIATTNPVAYEQWGTVCSTNDLHDQNGDNVS

SEQ ID NO: 132580 - protein, 33 aa, Artificial Sequence
  Description of Artificial Sequence: Synthetic polypeptide
DEEEIRTTNPVATEQYGMYTDDEMDQDEGNGNG

SEQ ID NO: 132581 - protein, 36 aa, Artificial Sequence
  Description of Artificial Sequence: Synthetic polypeptide
AEEEIRTTNPVATEQYGSVSTTSNEGQQIGTTTTEQ

SEQ ID NO: 132582 - protein, 36 aa, Artificial Sequence
  Description of Artificial Sequence: Synthetic polypeptide
AEEEIRTTNPVATEQYGSVSTTSNAGNANTEEGNNG

SEQ ID NO: 132583 - protein, 37 aa, Artificial Sequence
  Description of Artificial Sequence: Synthetic polypeptide
AEEEIRTTNPVATEQYGSVSTTSGNNQQGSEGGNNNT

SEQ ID NO: 132584 - protein, 37 aa, Artificial Sequence
  Description of Artificial Sequence: Synthetic polypeptide
DEEEIRTTNPVATEQYGNSVSSTTPAGPNWRNGMNPV

SEQ ID NO: 132585 - protein, 28 aa, Artificial Sequence
  Description of Artificial Sequence: Synthetic peptide
DDEELAPTNPVATEMYGFVATVLCAEEV

SEQ ID NO: 132586 - protein, 36 aa, Artificial Sequence
  Description of Artificial Sequence: Synthetic polypeptide
DEEEIRTTNPVATEQYGNVMTTGTDQLIDQGEGNGT

SEQ ID NO: 132587 - protein, 36 aa, Artificial Sequence
  Description of Artificial Sequence: Synthetic polypeptide
DEAEAEIRTTNPVAYEQWGSVCSTNDNQGEGQNMGQ

SEQ ID NO: 132588 - protein, 37 aa, Artificial Sequence
  Description of Artificial Sequence: Synthetic polypeptide
AEEEIRTTNPVATEQYGSVSTTTNLLNGTELGNNQLI

SEQ ID NO: 132589 - protein, 30 aa, Artificial Sequence
  Description of Artificial Sequence: Synthetic polypeptide
DEEEIRSTNPVATEQWGDVSEIEMNAAEDA

SEQ ID NO: 132590 - protein, 30 aa, Artificial Sequence
  Description of Artificial Sequence: Synthetic polypeptide
DEEEIRSTNPVATEQWGDVSEIEMNAAEDQ

SEQ ID NO: 132591 - protein, 30 aa, Artificial Sequence
  Description of Artificial Sequence: Synthetic polypeptide
DEEEIRSTNPVATEQWGDVSEIEMNSAEDA

SEQ ID NO: 132592 - protein, 37 aa, Artificial Sequence
  Description of Artificial Sequence: Synthetic polypeptide
AEEEIRTTNPVATEQYGSVSTTTNGNQQGNQQGNETE

SEQ ID NO: 132593 - protein, 37 aa, Artificial Sequence
  Description of Artificial Sequence: Synthetic polypeptide
AEEEIRTTNPVATEQYGSVSTTTNGNQQGEQEGNEEG

SEQ ID NO: 132594 - protein, 37 aa, Artificial Sequence
  Description of Artificial Sequence: Synthetic polypeptide
AEEEIRTTNPVATEQYGSVSTTTNGNLQNENGTEQGE

SEQ ID NO: 132595 - protein, 36 aa, Artificial Sequence
  Description of Artificial Sequence: Synthetic polypeptide
DEEPIRTTNPVATEQYGSVSSWTPAGPNMRNGMNPV

SEQ ID NO: 132596 - protein, 36 aa, Artificial Sequence
  Description of Artificial Sequence: Synthetic polypeptide
AEEEIRTTNPVATEQYGSVSTTTNGNGNQEQGTEDE

SEQ ID NO: 132597 - protein, 37 aa, Artificial Sequence
  Description of Artificial Sequence: Synthetic polypeptide
AEEEIRTTNPVATEQYGSVSTTTNGLGNQEIGEEEDE

SEQ ID NO: 132598 - protein, 36 aa, Artificial Sequence
  Description of Artificial Sequence: Synthetic polypeptide
DEEPIRTTNPVATEQYGSVSSTTPAGPNMRNGMNPW

SEQ ID NO: 132599 - protein, 36 aa, Artificial Sequence
  Description of Artificial Sequence: Synthetic polypeptide
DEEPIRTTNPVATEQYGSVSSTTPAGPNMRNGMNPV

SEQ ID NO: 132600 - protein, 36 aa, Artificial Sequence
  Description of Artificial Sequence: Synthetic polypeptide
DEEPIRTTNPVATEQYGSVSSTTPAGPNHRNGMNPV

SEQ ID NO: 132601 - protein, 36 aa, Artificial Sequence
  Description of Artificial Sequence: Synthetic polypeptide
DEEPIRTTNPVATEQYGSVSSTTHAGPNMRNGMNPV

SEQ ID NO: 132602 - protein, 30 aa, Artificial Sequence
  Description of Artificial Sequence: Synthetic polypeptide
DEEEIRSTNPVATEQWGVVSDIEMNAAEDA

SEQ ID NO: 132603 - protein, 36 aa, Artificial Sequence
  Description of Artificial Sequence: Synthetic polypeptide
DEEEIRTTNPVATEQYGNVSSTTPWGPNMRNGMNPV

SEQ ID NO: 132604 - protein, 36 aa, Artificial Sequence
  Description of Artificial Sequence: Synthetic polypeptide
DEEEIRTTNPVATEQYGNVSSTTPAGPNMRNGMNPV

SEQ ID NO: 132605 - protein, 35 aa, Artificial Sequence
  Description of Artificial Sequence: Synthetic polypeptide
DEEEIRSTNPVATEQYGASVPCNTQNLFQTMIATE

SEQ ID NO: 132606 - protein, 33 aa, Artificial Sequence
  Description of Artificial Sequence: Synthetic polypeptide
DEEEIRSTNPVATEQYGAVNDNFDQIGEDEIEG

SEQ ID NO: 132607 - protein, 37 aa, Artificial Sequence
  Description of Artificial Sequence: Synthetic polypeptide
AEEEIRTTNPVATEQYGSVSTTTDNLNNTEQGNNQIA

SEQ ID NO: 132608 - protein, 37 aa, Artificial Sequence
  Description of Artificial Sequence: Synthetic polypeptide
AEEEIRTTNPVATEQYGSVSTTTDGGNNLLQGTNDED

SEQ ID NO: 132609 - protein, 36 aa, Artificial Sequence
  Description of Artificial Sequence: Synthetic polypeptide
AEEEIRTTNPVATEQYGSVSTTQQQQQQNIGNTETG

SEQ ID NO: 132610 - protein, 30 aa, Artificial Sequence
  Description of Artificial Sequence: Synthetic polypeptide
DEEEIRSTNPVATEQWGDVSDIEMNAAEDQ

SEQ ID NO: 132611 - protein, 35 aa, Artificial Sequence
  Description of Artificial Sequence: Synthetic polypeptide
DEEEIRTTNPVATEQYGMVTGTMNLGMEGGGDEDD

SEQ ID NO: 132612 - protein, 36 aa, Artificial Sequence
  Description of Artificial Sequence: Synthetic polypeptide
DEEEIRTTNPVATEQYGMVSVEGMGGNQGQEGNEFT

SEQ ID NO: 132613 - protein, 35 aa, Artificial Sequence
  Description of Artificial Sequence: Synthetic polypeptide
DEEEIRTTNPVAYCAYGSTVSCTQNADSNNRGNNG

SEQ ID NO: 132614 - protein, 36 aa, Artificial Sequence
  Description of Artificial Sequence: Synthetic polypeptide
DEEEIRSTNPVATEQYGSVSSTTPAIPNMRNGMNPV

SEQ ID NO: 132615 - protein, 35 aa, Artificial Sequence
  Description of Artificial Sequence: Synthetic polypeptide
DEEEIRTTNPVATEQYGMVSTGIGGQSGEGDETDD

SEQ ID NO: 132616 - protein, 36 aa, Artificial Sequence
  Description of Artificial Sequence: Synthetic polypeptide
AEEEIRTTNPVATEQYGSVSTTQLQAGTEQGTTDED

SEQ ID NO: 132617 - protein, 36 aa, Artificial Sequence
  Description of Artificial Sequence: Synthetic polypeptide
DEEEIRSTNPVATEQYGSVVGSTMNLEDPEGQGDIT

SEQ ID NO: 132618 - protein, 38 aa, Artificial Sequence
  Description of Artificial Sequence: Synthetic polypeptide
AEEEIRTTNPVATEQYGSVSTTQANLQNATEQGTNVVE

SEQ ID NO: 132619 - protein, 36 aa, Artificial Sequence
  Description of Artificial Sequence: Synthetic polypeptide
AEEEIRTTNPVATEQYGSVSTTPTQQNQIGTTNVEQ

SEQ ID NO: 132620 - protein, 36 aa, Artificial Sequence
  Description of Artificial Sequence: Synthetic polypeptide
DEEEIRSTNPVATEQYGVVSSTTPNGPNMRNGMNPQ

SEQ ID NO: 132621 - protein, 36 aa, Artificial Sequence
  Description of Artificial Sequence: Synthetic polypeptide
DEEEIRTTNPVATEQYGMVSSTTPAVPNMRNGMNPV

SEQ ID NO: 132622 - protein, 36 aa, Artificial Sequence
  Description of Artificial Sequence: Synthetic polypeptide
DEEEIRSTNPVATEQYGSVSSTTPAGPNMRNGMNPV

SEQ ID NO: 132623 - protein, 36 aa, Artificial Sequence
  Description of Artificial Sequence: Synthetic polypeptide
DEEEIRTTNPVATEQYGMVSSTTPAGPNMRNGMNPV

SEQ ID NO: 132624 - protein, 35 aa, Artificial Sequence
  Description of Artificial Sequence: Synthetic polypeptide
DDETIRTTNPVATEQYGAVVDTPNEGQRGQTNEGG

SEQ ID NO: 132625 - protein, 36 aa, Artificial Sequence
  Description of Artificial Sequence: Synthetic polypeptide
DEEEIRTTNPVATEQYGMVSSTTAAGPNMGNGMNPV

SEQ ID NO: 132626 - protein, 36 aa, Artificial Sequence
  Description of Artificial Sequence: Synthetic polypeptide
DEEEIRSTNPVATEQYGVVSSTTPNGPNMRNGMNPV

SEQ ID NO: 132627 - protein, 34 aa, Artificial Sequence
  Description of Artificial Sequence: Synthetic polypeptide
DDETIRTTNPVATEQYGAVVIGNEGQRGQENEGG

SEQ ID NO: 132628 - protein, 35 aa, Artificial Sequence
  Description of Artificial Sequence: Synthetic polypeptide
DEEEIRTTNPVATEQYGMVSNMNIFEDDGGGNEQQ

SEQ ID NO: 132629 - protein, 35 aa, Artificial Sequence
  Description of Artificial Sequence: Synthetic polypeptide
DEEEIRTTNPVATEQYGMVSNMGNIADDGGGNGQE

SEQ ID NO: 132630 - protein, 37 aa, Artificial Sequence
  Description of Artificial Sequence: Synthetic polypeptide
AEEEIRTTNPVATEQYGSVSTTNTNNLEQGSNENNDD

SEQ ID NO: 132631 - protein, 35 aa, Artificial Sequence
  Description of Artificial Sequence: Synthetic polypeptide
DDETIRTTNPVATEQYGAVVVGTNEGQRGQNNEGG

SEQ ID NO: 132632 - protein, 35 aa, Artificial Sequence
  Description of Artificial Sequence: Synthetic polypeptide
DEEEIRTTNPVAYEAYGCVASCTPNLSGKGGDSRW

SEQ ID NO: 132633 - protein, 36 aa, Artificial Sequence
  Description of Artificial Sequence: Synthetic polypeptide
DEEEIRTTNPVATEQYGMVSSTTPAGPNMRNGMNIV

SEQ ID NO: 132634 - protein, 36 aa, Artificial Sequence
  Description of Artificial Sequence: Synthetic polypeptide
DEEEIRSTNPVATEQYGSVSSTTPAGPNMPNGMNPV

SEQ ID NO: 132635 - protein, 36 aa, Artificial Sequence
  Description of Artificial Sequence: Synthetic polypeptide
DEEEIRSTNPVATEQYGSVSSPTPAGPNMRNGMNPV

SEQ ID NO: 132636 - protein, 36 aa, Artificial Sequence
  Description of Artificial Sequence: Synthetic polypeptide
DEENIRTTNPVATEQYGSVSSTTPAGPNMRNGMNPV

SEQ ID NO: 132637 - protein, 36 aa, Artificial Sequence
  Description of Artificial Sequence: Synthetic polypeptide
DEEEIRTTNPVAWEQYGSVSSCTPAGPNMRNGMNPV

SEQ ID NO: 132638 - protein, 38 aa, Artificial Sequence
  Description of Artificial Sequence: Synthetic polypeptide
AEEEIRTTNPVATEQYGSVSTTQQNLQNATTEQGTNVE

SEQ ID NO: 132639 - protein, 36 aa, Artificial Sequence
  Description of Artificial Sequence: Synthetic polypeptide
DEEEIRTTNPVAWEQYGSVSSTTPAGPNMRNGMNPV

SEQ ID NO: 132640 - protein, 36 aa, Artificial Sequence
  Description of Artificial Sequence: Synthetic polypeptide
AEEEIRTTNPVATEQYGSVSTTQQNDGTEQGTNDNE

SEQ ID NO: 132641 - protein, 36 aa, Artificial Sequence
  Description of Artificial Sequence: Synthetic polypeptide
AEEEIRTTNPVATEQYGSVSTTQQLNNNDEGTNVTE

SEQ ID NO: 132642 - protein, 33 aa, Artificial Sequence
  Description of Artificial Sequence: Synthetic polypeptide
DDENIRTTNPVATEQYGSVSTTGGEGGDGGETQ

SEQ ID NO: 132643 - protein, 37 aa, Artificial Sequence
  Description of Artificial Sequence: Synthetic polypeptide
AEEEIRTTNPVATEQYGSVSTTQQLLQNEISTENGNQ

SEQ ID NO: 132644 - protein, 37 aa, Artificial Sequence
  Description of Artificial Sequence: Synthetic polypeptide
AEEEIRTTNPVATEQYGSVSTTQNQNQEQGIGNNDET

SEQ ID NO: 132645 - protein, 33 aa, Artificial Sequence
  Description of Artificial Sequence: Synthetic polypeptide
DEENIRTTNPVAYEPYGQVNCTNEASEEGGNRV

SEQ ID NO: 132646 - protein, 35 aa, Artificial Sequence
  Description of Artificial Sequence: Synthetic polypeptide
DEEEIRTTNPVATEQYGMVSTSMMMVQESGEEEVE

SEQ ID NO: 132647 - protein, 37 aa, Artificial Sequence
  Description of Artificial Sequence: Synthetic polypeptide
AEEEIRTTNPVATEQYGSVSTTQNNNNQQTIGTNANE

SEQ ID NO: 132648 - protein, 32 aa, Artificial Sequence
  Description of Artificial Sequence: Synthetic polypeptide
DDEPIRTTNPLAYEAYGKVSTNEHDRAVGNNV

SEQ ID NO: 132649 - protein, 32 aa, Artificial Sequence
  Description of Artificial Sequence: Synthetic polypeptide
DDEPIRTTNPLAYEAYGKVSTNEHQHAVGNNF

SEQ ID NO: 132650 - protein, 35 aa, Artificial Sequence
  Description of Artificial Sequence: Synthetic polypeptide
DEEEIRSTNPVATEQYGSVMGTQMNFGNGGDNDDE

SEQ ID NO: 132651 - protein, 34 aa, Artificial Sequence
  Description of Artificial Sequence: Synthetic polypeptide
DDESEIRTTNPVAYECWGSVSCGNESQDRNGGNG

SEQ ID NO: 132652 - protein, 36 aa, Artificial Sequence
  Description of Artificial Sequence: Synthetic polypeptide
DEEEIRSTNPVATEQYGSVSATTPTGPNMRNGMNPI

SEQ ID NO: 132653 - protein, 34 aa, Artificial Sequence
  Description of Artificial Sequence: Synthetic polypeptide
DEEEIRSTNPVATEQYGSVSGNGNIEDGGQTEED

SEQ ID NO: 132654 - protein, 35 aa, Artificial Sequence
  Description of Artificial Sequence: Synthetic polypeptide
DEEEIRSTNPVATEQYGSVSGNGQGQNEFGQGEGN

SEQ ID NO: 132655 - protein, 32 aa, Artificial Sequence
  Description of Artificial Sequence: Synthetic polypeptide
DDETIRTTNPVATEQYGAVSSVGHQQVRVQLT

SEQ ID NO: 132656 - protein, 35 aa, Artificial Sequence
  Description of Artificial Sequence: Synthetic polypeptide
DEEEIRSTNPVATEQYGSVSNTDNMNIVEGEFDGE

SEQ ID NO: 132657 - protein, 36 aa, Artificial Sequence
  Description of Artificial Sequence: Synthetic polypeptide
DEENIRTTNPVATEQYGSVSSTTPAGPNSRWGMNPV

SEQ ID NO: 132658 - protein, 37 aa, Artificial Sequence
  Description of Artificial Sequence: Synthetic polypeptide
AEEEIRTTNPVATEQYGSVSTTQQQLTQEISTEQGNE

SEQ ID NO: 132659 - protein, 33 aa, Artificial Sequence
  Description of Artificial Sequence: Synthetic polypeptide
DDETIRTTNPVATEQYGSVCSTGGEGGDGGEDT

SEQ ID NO: 132660 - protein, 36 aa, Artificial Sequence
  Description of Artificial Sequence: Synthetic polypeptide
DEEEIRSTNPVATEGYGSVSATTPTGPQMRNGMNPI

SEQ ID NO: 132661 - protein, 37 aa, Artificial Sequence
  Description of Artificial Sequence: Synthetic polypeptide
AEEEIRTTNPVATEQYGSVSTTTNLNNGTEQGTNQEE

SEQ ID NO: 132662 - protein, 37 aa, Artificial Sequence
  Description of Artificial Sequence: Synthetic polypeptide
AEEEIRTTNPVATEQYGSVSTTTNQLQSSEQGTTEDE

SEQ ID NO: 132663 - protein, 38 aa, Artificial Sequence
  Description of Artificial Sequence: Synthetic polypeptide
DEEEIRTTNPVAVEQYGSVSTVVNNGNLQAGNNQDEDE

SEQ ID NO: 132664 - protein, 37 aa, Artificial Sequence
  Description of Artificial Sequence: Synthetic polypeptide
AEEEIRTTNPVATEQYGSVSTTTNQLNQEGTEQGTSG

SEQ ID NO: 132665 - protein, 37 aa, Artificial Sequence
  Description of Artificial Sequence: Synthetic polypeptide
AEEEIRTTNPVATEQYGSVSTTTNQLNGNDEAGNTTN

SEQ ID NO: 132666 - protein, 36 aa, Artificial Sequence
  Description of Artificial Sequence: Synthetic polypeptide
AEEEIRTTNPVATEQYGSVSTTTNQLGGNENNNNIY

SEQ ID NO: 132667 - protein, 37 aa, Artificial Sequence
  Description of Artificial Sequence: Synthetic polypeptide
DEEEIRTTNPVAVEQYGSVSTVVNNLNLLAGNNQDED

SEQ ID NO: 132668 - protein, 33 aa, Artificial Sequence
  Description of Artificial Sequence: Synthetic polypeptide
DEEQIATTNPVATEQWGSVSGEHGPLASGEGNT

SEQ ID NO: 132669 - protein, 36 aa, Artificial Sequence
  Description of Artificial Sequence: Synthetic polypeptide
DEEEIRTTNPVAVEQYGSVSTVVNNNDEAGNNQDED

SEQ ID NO: 132670 - protein, 36 aa, Artificial Sequence
  Description of Artificial Sequence: Synthetic polypeptide
DEEEIRTTNPVAVEQYGSVSTVVNNNNDEQGNTNTV

SEQ ID NO: 132671 - protein, 36 aa, Artificial Sequence
  Description of Artificial Sequence: Synthetic polypeptide
AEEEIRTTNPVATEQYGSVSTTTNQNNTEAGNNTED

SEQ ID NO: 132672 - protein, 37 aa, Artificial Sequence
  Description of Artificial Sequence: Synthetic polypeptide
AEEEIRTTNPVATEQYGSVSTTTNQLEIGTTNQNEQE

SEQ ID NO: 132673 - protein, 36 aa, Artificial Sequence
  Description of Artificial Sequence: Synthetic polypeptide
AEEEIRTTNPVATEQYGSVSTTTNQEQGTNNVTEEQ

SEQ ID NO: 132674 - protein, 36 aa, Artificial Sequence
  Description of Artificial Sequence: Synthetic polypeptide
DEEEIRTTNPVAVEQYGSVSTVVNNNNNNETGNTDS

SEQ ID NO: 132675 - protein, 37 aa, Artificial Sequence
  Description of Artificial Sequence: Synthetic polypeptide
AEEEIRTTNPVATEQYGSVSTTTNNQQQNQEQGTNVD

SEQ ID NO: 132676 - protein, 37 aa, Artificial Sequence
  Description of Artificial Sequence: Synthetic polypeptide
DEEEIRTTNPVAVEQYGSVSTVVNNNNNNQTGNTTDN

SEQ ID NO: 132677 - protein, 37 aa, Artificial Sequence
  Description of Artificial Sequence: Synthetic polypeptide
AEEEIRTTNPVATEQYGSVSTTTNNQQQGEGENNEEG

SEQ ID NO: 132678 - protein, 37 aa, Artificial Sequence
  Description of Artificial Sequence: Synthetic polypeptide
AEEEIRTTNPVATEQYGSVSTTTNNQQNQEQGTNDED

SEQ ID NO: 132679 - protein, 37 aa, Artificial Sequence
  Description of Artificial Sequence: Synthetic polypeptide
AEEEIRTTNPVATEQYGSVSTTTNNQQGNDNGTNTTN

SEQ ID NO: 132680 - protein, 37 aa, Artificial Sequence
  Description of Artificial Sequence: Synthetic polypeptide
AEEEIRTTNPVATEQYGSVSTTTNNQNQQQIGTNSGE

SEQ ID NO: 132681 - protein, 37 aa, Artificial Sequence
  Description of Artificial Sequence: Synthetic polypeptide
AEEEIRTTNPVATEQYGSVSTTTNNQNQQNEGNNDET

SEQ ID NO: 132682 - protein, 36 aa, Artificial Sequence
  Description of Artificial Sequence: Synthetic polypeptide
AEEEIRTTNPVATEQYGSVSTTTNQGNQIGTTTQDT

SEQ ID NO: 132683 - protein, 37 aa, Artificial Sequence
  Description of Artificial Sequence: Synthetic polypeptide
AEEEIRTTNPVATEQYGSVSTTTNQNQNTEQGTNVEQ

SEQ ID NO: 132684 - protein, 36 aa, Artificial Sequence
  Description of Artificial Sequence: Synthetic polypeptide
AEEEIRTTNPVATEQYGSVSTTTNQNQQQNATNNED

SEQ ID NO: 132685 - protein, 38 aa, Artificial Sequence
  Description of Artificial Sequence: Synthetic polypeptide
AEEEIRTTNPVATEQYGSVSTTTNQQLLQEIGTNSEEE

SEQ ID NO: 132686 - protein, 38 aa, Artificial Sequence
  Description of Artificial Sequence: Synthetic polypeptide
AEEEIRTTNPVATEQYGSVSTTVANLLNNQGEQGTNVE

SEQ ID NO: 132687 - protein, 37 aa, Artificial Sequence
  Description of Artificial Sequence: Synthetic polypeptide
AEEEIRTTNPVATEQYGSVSTTVANGNQDEQGNNNVD

SEQ ID NO: 132688 - protein, 37 aa, Artificial Sequence
  Description of Artificial Sequence: Synthetic polypeptide
AEEEIRTTNPVATEQYGSVSTTVANAQNADEQGTNVE

SEQ ID NO: 132689 - protein, 37 aa, Artificial Sequence
  Description of Artificial Sequence: Synthetic polypeptide
AEEEIRTTNPVATEQYGSVSTTTVTNLQLQIGTEEGS

SEQ ID NO: 132690 - protein, 37 aa, Artificial Sequence
  Description of Artificial Sequence: Synthetic polypeptide
AEEEIRTTNPVATEQYGSVSTTTVNLQAGTEAGSEEG

SEQ ID NO: 132691 - protein, 36 aa, Artificial Sequence
  Description of Artificial Sequence: Synthetic polypeptide
AEEEIRTTNPVATEQYGSVSTTTTNMEQGTNNVTEQ

SEQ ID NO: 132692 - protein, 38 aa, Artificial Sequence
  Description of Artificial Sequence: Synthetic polypeptide
AEEEIRTTNPVATEQYGSVSTTTTNLQLAGTEAGNNEG

SEQ ID NO: 132693 - protein, 34 aa, Artificial Sequence
  Description of Artificial Sequence: Synthetic polypeptide
DEEEIRTTNPVATEQYGQCVCSMSEHQNFGSIQP

SEQ ID NO: 132694 - protein, 36 aa, Artificial Sequence
  Description of Artificial Sequence: Synthetic polypeptide
DEEEIRTTNPVAVEQYGSVSTVTNNDEQGNNNVEEQ

SEQ ID NO: 132695 - protein, 37 aa, Artificial Sequence
  Description of Artificial Sequence: Synthetic polypeptide
AEEEIRTTNPVATEQYGSVSTTTQNLQAGTEAGAEAG

SEQ ID NO: 132696 - protein, 36 aa, Artificial Sequence
  Description of Artificial Sequence: Synthetic polypeptide
DEEEIRTTNPVAVEQYGSVSTVTNNNDEQGNNNVDQ

SEQ ID NO: 132697 - protein, 36 aa, Artificial Sequence
  Description of Artificial Sequence: Synthetic polypeptide
DEEEIRTTNPVATEQYGQCVCSDTGNHQNFGSETQP

SEQ ID NO: 132698 - protein, 37 aa, Artificial Sequence
  Description of Artificial Sequence: Synthetic polypeptide
AEEEIRTTNPVATEQYGSVSTTTNYGEQIGTTNSEEQ

SEQ ID NO: 132699 - protein, 37 aa, Artificial Sequence
  Description of Artificial Sequence: Synthetic polypeptide
DEEEIRTTNPVAVEQYGSVSTVTNNNNQQGNNQGENN

SEQ ID NO: 132700 - protein, 34 aa, Artificial Sequence
  Description of Artificial Sequence: Synthetic polypeptide
DEEEIRTTNPVATEQYGQCVCQWEHQENFGSNQS

SEQ ID NO: 132701 - protein, 37 aa, Artificial Sequence
  Description of Artificial Sequence: Synthetic polypeptide
AEEEIRTTNPVATEQYGSVSTTTNQQQQGENEENEEG

SEQ ID NO: 132702 - protein, 37 aa, Artificial Sequence
  Description of Artificial Sequence: Synthetic polypeptide
AEEEIRTTNPVATEQYGSVSTTTNQQQGNNQAGNNEA

SEQ ID NO: 132703 - protein, 35 aa, Artificial Sequence
  Description of Artificial Sequence: Synthetic polypeptide
DEEEIRTTNPVATEQYGQCVCQNTELQENFGSEQT

SEQ ID NO: 132704 - protein, 36 aa, Artificial Sequence
  Description of Artificial Sequence: Synthetic polypeptide
AEEEIRTTNPVATEQYGSVSTTTNQQQANTNNNTTD

SEQ ID NO: 132705 - protein, 37 aa, Artificial Sequence
  Description of Artificial Sequence: Synthetic polypeptide
AEEEIRTTNPVATEQYGSVSTTTNQQNENDEGTNVTE

SEQ ID NO: 132706 - protein, 38 aa, Artificial Sequence
  Description of Artificial Sequence: Synthetic polypeptide
AEEEIRTTNPVATEQYGSVSTTTNQQLQNQEQGTNVVD

SEQ ID NO: 132707 - protein, 37 aa, Artificial Sequence
  Description of Artificial Sequence: Synthetic polypeptide
AEEEIRTTNPVATEQYGSVSTTTNNQNQQGTTNNNVD

SEQ ID NO: 132708 - protein, 35 aa, Artificial Sequence
  Description of Artificial Sequence: Synthetic polypeptide
DEEEIRSTNPVATEGYGNVSAATPAIPQMRNGNPV

SEQ ID NO: 132709 - protein, 35 aa, Artificial Sequence
  Description of Artificial Sequence: Synthetic polypeptide
DEEEIRPTNPVASEQYGSVSSTTPAGPNMSNGMTR

SEQ ID NO: 132710 - protein, 38 aa, Artificial Sequence
  Description of Artificial Sequence: Synthetic polypeptide
AEEEIRTTNPVATEQYGSVSTTTNNQLNNQEQGTNVTD

SEQ ID NO: 132711 - protein, 36 aa, Artificial Sequence
  Description of Artificial Sequence: Synthetic polypeptide
DEEEIRPTNPVATEQYGSVSSFNPAGPNMRNGMNPV

SEQ ID NO: 132712 - protein, 36 aa, Artificial Sequence
  Description of Artificial Sequence: Synthetic polypeptide
DEEEIRPTNPVATEQYGSVSSTTIAGPNMRNGMNPV

SEQ ID NO: 132713 - protein, 36 aa, Artificial Sequence
  Description of Artificial Sequence: Synthetic polypeptide
DEEEIRPTNPVATEQYGSVSSTTPAGPNMRNGMNPV

SEQ ID NO: 132714 - protein, 35 aa, Artificial Sequence
  Description of Artificial Sequence: Synthetic polypeptide
DEEEIRPTNPVATEQYGSVSSTTPAGPNMRNGMTV

SEQ ID NO: 132715 - protein, 35 aa, Artificial Sequence
  Description of Artificial Sequence: Synthetic polypeptide
DEEEIRTTNPVAVEQYGSVVTNKHSSETVMGSDRH

SEQ ID NO: 132716 - protein, 34 aa, Artificial Sequence
  Description of Artificial Sequence: Synthetic polypeptide
DEEEIRTTNPVATEQYGNVVMGTNDNGGGDDEIQ

SEQ ID NO: 132717 - protein, 35 aa, Artificial Sequence
  Description of Artificial Sequence: Synthetic polypeptide
DEEEIRTTNPVATEQYGNVVDTMNGGQGGEEEDQQ

SEQ ID NO: 132718 - protein, 37 aa, Artificial Sequence
  Description of Artificial Sequence: Synthetic polypeptide
AEEEIRTTNPVATEQYGSVSTTTNLQQAGTEAGEEEG

SEQ ID NO: 132719 - protein, 36 aa, Artificial Sequence
  Description of Artificial Sequence: Synthetic polypeptide
DEEEIRQTNPVATEQYGSVSSTTPAGPNMRNGMNEV

SEQ ID NO: 132720 - protein, 35 aa, Artificial Sequence
  Description of Artificial Sequence: Synthetic polypeptide
DEEEIRTTNPVATEQYGQCAVCSTEHQENFGSQQS

SEQ ID NO: 132721 - protein, 37 aa, Artificial Sequence
  Description of Artificial Sequence: Synthetic polypeptide
AEEEIRTTNPVATEQYGSVSTTTNLQLANEQGTTEGQ

SEQ ID NO: 132722 - protein, 36 aa, Artificial Sequence
  Description of Artificial Sequence: Synthetic polypeptide
DEEEIRQTNPVATEQYGSVSSTTPAGPNMRNGMNPV

SEQ ID NO: 132723 - protein, 35 aa, Artificial Sequence
  Description of Artificial Sequence: Synthetic polypeptide
DEEEIRSTNPVATEAYGSVCIWVNDQDQRGMQKNN

SEQ ID NO: 132724 - protein, 34 aa, Artificial Sequence
  Description of Artificial Sequence: Synthetic polypeptide
DEEEIRSTNPVATEAYGSVCIWVNDQDQRGSDSN

SEQ ID NO: 132725 - protein, 34 aa, Artificial Sequence
  Description of Artificial Sequence: Synthetic polypeptide
DEEPIRTTNPVAYEGYGSTVNTTGNGSEQRSNNE

SEQ ID NO: 132726 - protein, 35 aa, Artificial Sequence
  Description of Artificial Sequence: Synthetic polypeptide
DEEEIRSTNPVATEAYGSVCIWVNDQDQRGSNQEE

SEQ ID NO: 132727 - protein, 36 aa, Artificial Sequence
  Description of Artificial Sequence: Synthetic polypeptide
DEEEIRTTNPVAVEQYGVVSTVNNNNNQQGNNQDED

SEQ ID NO: 132728 - protein, 33 aa, Artificial Sequence
  Description of Artificial Sequence: Synthetic polypeptide
DEEPIRTTNPVATEWYSEEVVSTYNELHIGGQT

SEQ ID NO: 132729 - protein, 36 aa, Artificial Sequence
  Description of Artificial Sequence: Synthetic polypeptide
DEEEIRSTNPVATEAYGSVCIWVNDQMDQRQGNNDR

SEQ ID NO: 132730 - protein, 35 aa, Artificial Sequence
  Description of Artificial Sequence: Synthetic polypeptide
DEEEIRSTNPVATEGYGNVSAATPAGPQMRNGNPV

SEQ ID NO: 132731 - protein, 35 aa, Artificial Sequence
  Description of Artificial Sequence: Synthetic polypeptide
DEEPIRTTNPVAYEQWRWEVSCTGNELSQITGGNR

SEQ ID NO: 132732 - protein, 36 aa, Artificial Sequence
  Description of Artificial Sequence: Synthetic polypeptide
DEEEIRTTNPVAVEQYGSVSTVVTNNNNQQGTTDED

SEQ ID NO: 132733 - protein, 38 aa, Artificial Sequence
  Description of Artificial Sequence: Synthetic polypeptide
AEEEIRTTNPVATEQYGSVSTTTNNLLQNNEQGNNQNE

SEQ ID NO: 132734 - protein, 37 aa, Artificial Sequence
  Description of Artificial Sequence: Synthetic polypeptide
AEEEIRTTNPVATEQYGSVSTTTNNLNGTELGNTELY

SEQ ID NO: 132735 - protein, 37 aa, Artificial Sequence
  Description of Artificial Sequence: Synthetic polypeptide
AEEEIRTTNPVATEQYGSVSTTTNNQGQQGNVTNNND

SEQ ID NO: 132736 - protein, 37 aa, Artificial Sequence
  Description of Artificial Sequence: Synthetic polypeptide
DEEEIRTTNPVAVEQYGSVSTVVNNNNQQQGTNTQDE

SEQ ID NO: 132737 - protein, 37 aa, Artificial Sequence
  Description of Artificial Sequence: Synthetic polypeptide
AEEEIRTTNPVATEQYGSVSTTTNNNQQQQIGTNTTE

SEQ ID NO: 132738 - protein, 37 aa, Artificial Sequence
  Description of Artificial Sequence: Synthetic polypeptide
AEEEIRTTNPVATEQYGSVSTTTNNNQQNQIGTNEGD

SEQ ID NO: 132739 - protein, 37 aa, Artificial Sequence
  Description of Artificial Sequence: Synthetic polypeptide
DEEEIRTTNPVAVEQYGSVSTVVNNQQAGTNNNNEDE

SEQ ID NO: 132740 - protein, 37 aa, Artificial Sequence
  Description of Artificial Sequence: Synthetic polypeptide
DEEEIRTTNPVAVEQYGSVSTVVNNQQLGNNENEEDG

SEQ ID NO: 132741 - protein, 37 aa, Artificial Sequence
  Description of Artificial Sequence: Synthetic polypeptide
AEEEIRTTNPVATEQYGSVSTTTNNNQQLQIGTEEGE

SEQ ID NO: 132742 - protein, 37 aa, Artificial Sequence
  Description of Artificial Sequence: Synthetic polypeptide
DEEEIRTTNPVAVEQYGSVSTVVNNQQLGNNNNEEDE

SEQ ID NO: 132743 - protein, 37 aa, Artificial Sequence
  Description of Artificial Sequence: Synthetic polypeptide
AEEEIRTTNPVATEQYGSVSTTTNNNQQGNIGTNEGE

SEQ ID NO: 132744 - protein, 37 aa, Artificial Sequence
  Description of Artificial Sequence: Synthetic polypeptide
AEEEIRTTNPVATEQYGSVSTTTNNNQNNENGNAQGD

SEQ ID NO: 132745 - protein, 33 aa, Artificial Sequence
  Description of Artificial Sequence: Synthetic polypeptide
DEEQIACTNPVATEQWGSVSGTGHGLASGGNET

SEQ ID NO: 132746 - protein, 37 aa, Artificial Sequence
  Description of Artificial Sequence: Synthetic polypeptide
DEEEIRTTNPVAVEQYGSVSTVVNNQQLGNNTNNGND

SEQ ID NO: 132747 - protein, 37 aa, Artificial Sequence
  Description of Artificial Sequence: Synthetic polypeptide
DEEEIRTTNPVAVEQYGSVSTVVTNNNNNQQIGNTDD

SEQ ID NO: 132748 - protein, 36 aa, Artificial Sequence
  Description of Artificial Sequence: Synthetic polypeptide
AEEEIRTTNPVATEQYGSVSTTTNNNNSEQGTNQEN

SEQ ID NO: 132749 - protein, 36 aa, Artificial Sequence
  Description of Artificial Sequence: Synthetic polypeptide
DEEEIRTTNPVATEQYGQCSCSTGNPHNQNFISNQA

SEQ ID NO: 132750 - protein, 37 aa, Artificial Sequence
  Description of Artificial Sequence: Synthetic polypeptide
AEEEIRTTNPVATEQYGSVSTTTNNNNQNQIGTNQGN

SEQ ID NO: 132751 - protein, 38 aa, Artificial Sequence
  Description of Artificial Sequence: Synthetic polypeptide
AEEEIRTTNPVATEQYGSVSTTTNNNLQNQEQGTNSVD

SEQ ID NO: 132752 - protein, 38 aa, Artificial Sequence
  Description of Artificial Sequence: Synthetic polypeptide
AEEEIRTTNPVATEQYGSVSTTTNNNLEQGTEGGNVTD

SEQ ID NO: 132753 - protein, 37 aa, Artificial Sequence
  Description of Artificial Sequence: Synthetic polypeptide
AEEEIRTTNPVATEQYGSVSTTTNNNGNQQIGTNEGD

SEQ ID NO: 132754 - protein, 35 aa, Artificial Sequence
  Description of Artificial Sequence: Synthetic polypeptide
DEEEIRTTNPVATEQYGQCQVCSTGEDQNFGSEQS

SEQ ID NO: 132755 - protein, 34 aa, Artificial Sequence
  Description of Artificial Sequence: Synthetic polypeptide
DEEEIRTTNPVATEQYGQCQVCSTEHTNFNSNQV

SEQ ID NO: 132756 - protein, 37 aa, Artificial Sequence
  Description of Artificial Sequence: Synthetic polypeptide
AEEEIRTTNPVATEQYGSVSTTTNNQLNNTEQGTNVD

SEQ ID NO: 132757 - protein, 36 aa, Artificial Sequence
  Description of Artificial Sequence: Synthetic polypeptide
DEEEVATTNPVATEQYGSVSSATPTGPNMRNGMNPR

SEQ ID NO: 132758 - protein, 34 aa, Artificial Sequence
  Description of Artificial Sequence: Synthetic polypeptide
DEEEIRTTNPVAYEAYGCVCYTGFQARNGGNNQI

SEQ ID NO: 132759 - protein, 35 aa, Artificial Sequence
  Description of Artificial Sequence: Synthetic polypeptide
DEEEIRTTNPVATEQYGMVSIMNGQGEDIGGQGEA

SEQ ID NO: 132760 - protein, 37 aa, Artificial Sequence
  Description of Artificial Sequence: Synthetic polypeptide
AEEEIRTTNPVATEQYGSVSTTNNQQQQQGNGENNND

SEQ ID NO: 132761 - protein, 37 aa, Artificial Sequence
  Description of Artificial Sequence: Synthetic polypeptide
AEEEIRTTNPVATEQYGSVSTTNNQQQQNNQGTNNVD

SEQ ID NO: 132762 - protein, 36 aa, Artificial Sequence
  Description of Artificial Sequence: Synthetic polypeptide
AEEEIRTTNPVATEQYGSVSTTNNQQQQNNATNATE

SEQ ID NO: 132763 - protein, 36 aa, Artificial Sequence
  Description of Artificial Sequence: Synthetic polypeptide
DEEEIRTTNPVATEQYGLVSSTTPAGPTMRNGMNPV

SEQ ID NO: 132764 - protein, 36 aa, Artificial Sequence
  Description of Artificial Sequence: Synthetic polypeptide
DEEEIRTTNPVATEQYGLVSSTTPAGPNMRNGMNPV

SEQ ID NO: 132765 - protein, 37 aa, Artificial Sequence
  Description of Artificial Sequence: Synthetic polypeptide
AEEEIRTTNPVATEQYGSVSTTNNQQQQNGNGENGNT

SEQ ID NO: 132766 - protein, 34 aa, Artificial Sequence
  Description of Artificial Sequence: Synthetic polypeptide
DEEEIRTTNPVATEQYGLVNYTVEDFDPNNEDER

SEQ ID NO: 132767 - protein, 37 aa, Artificial Sequence
  Description of Artificial Sequence: Synthetic polypeptide
DEEEIRTTNPVATEQYGLSVSSTTPAGPNMRNGMNPV

SEQ ID NO: 132768 - protein, 36 aa, Artificial Sequence
  Description of Artificial Sequence: Synthetic polypeptide
DEEEIRTTNPAATEQYGSVSSHTPAGPNMRNGMNPV

SEQ ID NO: 132769 - protein, 37 aa, Artificial Sequence
  Description of Artificial Sequence: Synthetic polypeptide
AEEEIRTTNPVATEQYGSVSTTNNQQQQQGNNTNQND

SEQ ID NO: 132770 - protein, 36 aa, Artificial Sequence
  Description of Artificial Sequence: Synthetic polypeptide
DEEEIRTTNPAATEQYGSVSSTRPAGPNMRNGMNPV

SEQ ID NO: 132771 - protein, 36 aa, Artificial Sequence
  Description of Artificial Sequence: Synthetic polypeptide
DEEEIRTTNPAATEQYGSVSSTTPAGPNMRNGMNPM

SEQ ID NO: 132772 - protein, 36 aa, Artificial Sequence
  Description of Artificial Sequence: Synthetic polypeptide
DEEEIRTTNPAATEQYGSVSSTTPAGPNMRNGMNPV

SEQ ID NO: 132773 - protein, 36 aa, Artificial Sequence
  Description of Artificial Sequence: Synthetic polypeptide
DEEGIRTTNPVATEQYGSVSSTTPAGPNMRNGMNPV

SEQ ID NO: 132774 - protein, 36 aa, Artificial Sequence
  Description of Artificial Sequence: Synthetic polypeptide
DEEGIRTTNPVATEQYGSVSCTRPAGPNMRNGMNPV

SEQ ID NO: 132775 - protein, 36 aa, Artificial Sequence
  Description of Artificial Sequence: Synthetic polypeptide
DEEEIRTTNPVATEQYGKVSSTTPAGPNVRNGMNPV

SEQ ID NO: 132776 - protein, 36 aa, Artificial Sequence
  Description of Artificial Sequence: Synthetic polypeptide
DEEEIRTTNPVATEQYGKVSSTTPAGPNMRNGMNPV

SEQ ID NO: 132777 - protein, 36 aa, Artificial Sequence
  Description of Artificial Sequence: Synthetic polypeptide
DEEEIRTTNPVATEQYGKVSSTTPAGPNMRNGMNCV

SEQ ID NO: 132778 - protein, 36 aa, Artificial Sequence
  Description of Artificial Sequence: Synthetic polypeptide
AEEEIRTTNPVATEQYGSVSTTNNQQQQANNNNTTD

SEQ ID NO: 132779 - protein, 37 aa, Artificial Sequence
  Description of Artificial Sequence: Synthetic polypeptide
AEEEIRTTNPVATEQYGSVSTTNNQQQQANNGTNNDE

SEQ ID NO: 132780 - protein, 37 aa, Artificial Sequence
  Description of Artificial Sequence: Synthetic polypeptide
AEEEIRTTNPVATEQYGSVSTTNNQQQQGEQGNNNET

SEQ ID NO: 132781 - protein, 36 aa, Artificial Sequence
  Description of Artificial Sequence: Synthetic polypeptide
DEEEIRTTNPVATEQYGLVWSTTPAGPNMRNGMNPV

SEQ ID NO: 132782 - protein, 37 aa, Artificial Sequence
  Description of Artificial Sequence: Synthetic polypeptide
AEEEIRTTNPVATEQYGSVSTTNNQQQQQGTTNNATD

SEQ ID NO: 132783 - protein, 37 aa, Artificial Sequence
  Description of Artificial Sequence: Synthetic polypeptide
AEEEIRTTNPVATEQYGSVSTTNNQQQQQGTVNNNVD

SEQ ID NO: 132784 - protein, 36 aa, Artificial Sequence
  Description of Artificial Sequence: Synthetic polypeptide
DEEEIRTCNPVAYEQYGSTVSCTRLSQQDTVGQNET

SEQ ID NO: 132785 - protein, 37 aa, Artificial Sequence
  Description of Artificial Sequence: Synthetic polypeptide
DEEEIRTTNPVATEQYGMSVSSTTPAGPNMRNGMNPV

SEQ ID NO: 132786 - protein, 31 aa, Artificial Sequence
  Description of Artificial Sequence: Synthetic polypeptide
DDMEIATTNPVSTEQYGNVAATDGIQFEGQR

SEQ ID NO: 132787 - protein, 35 aa, Artificial Sequence
  Description of Artificial Sequence: Synthetic polypeptide
DEEEIRTTNCVATEQYGSVSSTQGQQGQEGQGGEG

SEQ ID NO: 132788 - protein, 31 aa, Artificial Sequence
  Description of Artificial Sequence: Synthetic polypeptide
DDMEIATTNPVSTEQYGTVCSATTPEFEGND

SEQ ID NO: 132789 - protein, 38 aa, Artificial Sequence
  Description of Artificial Sequence: Synthetic polypeptide
AEEEIRTTNPVATEQYGSVSTTNQLNLQAGTEAGNEEG

SEQ ID NO: 132790 - protein, 35 aa, Artificial Sequence
  Description of Artificial Sequence: Synthetic polypeptide
DEEHIRATNPVATDQYGFVSMTNLFQTGIGENFEG

SEQ ID NO: 132791 - protein, 33 aa, Artificial Sequence
  Description of Artificial Sequence: Synthetic polypeptide
DEEHIRATNPVATDQYGFVSMADLFQTGSENEG

SEQ ID NO: 132792 - protein, 37 aa, Artificial Sequence
  Description of Artificial Sequence: Synthetic polypeptide
DEEEIRTTNPVATEQYGMSSTVSTDGFGQDEGGNTSD

SEQ ID NO: 132793 - protein, 36 aa, Artificial Sequence
  Description of Artificial Sequence: Synthetic polypeptide
AEEEIRTTNPVATEQYGSVSTTNQLNDNEEIGTTQD

SEQ ID NO: 132794 - protein, 36 aa, Artificial Sequence
  Description of Artificial Sequence: Synthetic polypeptide
AEEEIRTTNPVATEQYGSVSTTNQLIGNNIGTTEME

SEQ ID NO: 132795 - protein, 36 aa, Artificial Sequence
  Description of Artificial Sequence: Synthetic polypeptide
AEEEIRTTNPVATEQYGSVSTTNQGEQIGTTTQEDQ

SEQ ID NO: 132796 - protein, 37 aa, Artificial Sequence
  Description of Artificial Sequence: Synthetic polypeptide
DEEEIRTTNPVATEQYGMSGTGMETGNLNDQGGGNNG

SEQ ID NO: 132797 - protein, 34 aa, Artificial Sequence
  Description of Artificial Sequence: Synthetic polypeptide
DDMEIRTTNPVATEQYGCVSTLLATQINGTQDQE

SEQ ID NO: 132798 - protein, 36 aa, Artificial Sequence
  Description of Artificial Sequence: Synthetic polypeptide
DEEEIRTTNPVATEQYGMSGTFGETGNLDEGGNENG

SEQ ID NO: 132799 - protein, 35 aa, Artificial Sequence
  Description of Artificial Sequence: Synthetic polypeptide
DEEEIRTTNPVATEQYGMSGSNMNIFDTGGGDQND

SEQ ID NO: 132800 - protein, 35 aa, Artificial Sequence
  Description of Artificial Sequence: Synthetic polypeptide
DEEEIRTTNPVATEQYGMSGNGQTDEGQEGGGNEE

SEQ ID NO: 132801 - protein, 37 aa, Artificial Sequence
  Description of Artificial Sequence: Synthetic polypeptide
AEEEIRTTNPVATEQYGSVSTTNNQQQSNNNGNNDED

SEQ ID NO: 132802 - protein, 33 aa, Artificial Sequence
  Description of Artificial Sequence: Synthetic polypeptide
DEEEIRTTNGVCYEHYGSVSMPNAAPQTPGNQL

SEQ ID NO: 132803 - protein, 34 aa, Artificial Sequence
  Description of Artificial Sequence: Synthetic polypeptide
DEEEIRTTNPVATEQYGMCGSDGDENDDLGGNEQ

SEQ ID NO: 132804 - protein, 36 aa, Artificial Sequence
  Description of Artificial Sequence: Synthetic polypeptide
AEEEIRTTNPVATEQYGSVSTTNNQQQQQIGTEQGQ

SEQ ID NO: 132805 - protein, 36 aa, Artificial Sequence
  Description of Artificial Sequence: Synthetic polypeptide
DEEEIRTTNPVATEQYGKVSSTTPAGPNMRNGDNPV

SEQ ID NO: 132806 - protein, 32 aa, Artificial Sequence
  Description of Artificial Sequence: Synthetic polypeptide
DDMEIATTNPVATEQYGTVCSATGPVEFEGND

SEQ ID NO: 132807 - protein, 36 aa, Artificial Sequence
  Description of Artificial Sequence: Synthetic polypeptide
DEEEIRTTNPVATEQYGKVSSTTPAGPNMRHGMNSV

SEQ ID NO: 132808 - protein, 36 aa, Artificial Sequence
  Description of Artificial Sequence: Synthetic polypeptide
AEEEIRTTNPVATEQYGSVSTTNNQQQNNQGTTTQE

SEQ ID NO: 132809 - protein, 35 aa, Artificial Sequence
  Description of Artificial Sequence: Synthetic polypeptide
DEEEIRTTNPCATEAYGSVATTNQQGNQQGNNNAT

SEQ ID NO: 132810 - protein, 37 aa, Artificial Sequence
  Description of Artificial Sequence: Synthetic polypeptide
AEEEIRTTNPVATEQYGSVSTTNNQQGTEQIGTNEED

SEQ ID NO: 132811 - protein, 36 aa, Artificial Sequence
  Description of Artificial Sequence: Synthetic polypeptide
AEEEIRTTNPVATEQYGSVSTTNNQQGQQQGTEDEE

SEQ ID NO: 132812 - protein, 37 aa, Artificial Sequence
  Description of Artificial Sequence: Synthetic polypeptide
AEEEIRTTNPVATEQYGSVSTTNNQQGQNQIGTNQSG

SEQ ID NO: 132813 - protein, 36 aa, Artificial Sequence
  Description of Artificial Sequence: Synthetic polypeptide
AEEEIRTTNPVATEQYGSVSTTNNQQGQEQGTTEED

SEQ ID NO: 132814 - protein, 36 aa, Artificial Sequence
  Description of Artificial Sequence: Synthetic polypeptide
DEEEIRTTNPVATEQYGIVSSTTPAGPNMRNGMNPV

SEQ ID NO: 132815 - protein, 37 aa, Artificial Sequence
  Description of Artificial Sequence: Synthetic polypeptide
AEEEIRTTNPVATEQYGSVSTTNNQQGNNDEAGNTDE

SEQ ID NO: 132816 - protein, 36 aa, Artificial Sequence
  Description of Artificial Sequence: Synthetic polypeptide
DEEEIRTTNPVATEQYGIVSSTTPAGPNMINGMNPV

SEQ ID NO: 132817 - protein, 36 aa, Artificial Sequence
  Description of Artificial Sequence: Synthetic polypeptide
DEEEVRTTNPVATEQYGSVSSTTPAGPNMRNGMNPV

SEQ ID NO: 132818 - protein, 36 aa, Artificial Sequence
  Description of Artificial Sequence: Synthetic polypeptide
AEEEIRTTNPVATEQYGSVSTTNNQQNAENGTTDDE

SEQ ID NO: 132819 - protein, 36 aa, Artificial Sequence
  Description of Artificial Sequence: Synthetic polypeptide
DEEEVRTTNPVATEQYGSVSSTTPAGPNMRNGMNPD

SEQ ID NO: 132820 - protein, 35 aa, Artificial Sequence
  Description of Artificial Sequence: Synthetic polypeptide
DEEEVRTTNPVATEQYGNVSSTTPAGPNSRNGMNV

SEQ ID NO: 132821 - protein, 37 aa, Artificial Sequence
  Description of Artificial Sequence: Synthetic polypeptide
DEEEIRTTNPCATEAYGSVSVSVTTNLQAGTTTNSTE

SEQ ID NO: 132822 - protein, 37 aa, Artificial Sequence
  Description of Artificial Sequence: Synthetic polypeptide
DEEEIRTTNPVATEQYGISVTPTNGDETTQSGQDDNQ

SEQ ID NO: 132823 - protein, 36 aa, Artificial Sequence
  Description of Artificial Sequence: Synthetic polypeptide
AEEEIRTTNPVATEQYGSVSTTNNQNQQQGTEEGQE

SEQ ID NO: 132824 - protein, 38 aa, Artificial Sequence
  Description of Artificial Sequence: Synthetic polypeptide
DEEEIRTTNPVATEQYGISVSSTTPAQPNMRQGMNPSD

SEQ ID NO: 132825 - protein, 37 aa, Artificial Sequence
  Description of Artificial Sequence: Synthetic polypeptide
DEEEIRTTNPVATEQYGISVSSTTPAGPNMRNGMNPV

SEQ ID NO: 132826 - protein, 37 aa, Artificial Sequence
  Description of Artificial Sequence: Synthetic polypeptide
DEEEIRTTNPVATEQYGISVSSTTPAGPNMRNGMNAV

SEQ ID NO: 132827 - protein, 31 aa, Artificial Sequence
  Description of Artificial Sequence: Synthetic polypeptide
DDNEIASTNPVSTEGYGEASAENLQSRVGGR

SEQ ID NO: 132828 - protein, 37 aa, Artificial Sequence
  Description of Artificial Sequence: Synthetic polypeptide
DEEEIRTTNPCATEAYGSVTVSVTNNNLQAGTTTNTE

SEQ ID NO: 132829 - protein, 35 aa, Artificial Sequence
  Description of Artificial Sequence: Synthetic polypeptide
DEEEIRTTNPVATEQYGIVSSGGNGGGDGEGGNED

SEQ ID NO: 132830 - protein, 37 aa, Artificial Sequence
  Description of Artificial Sequence: Synthetic polypeptide
AEEEIRTTNPVATEQYGSVSTTNNQQNAEQIGTNVDE

SEQ ID NO: 132831 - protein, 36 aa, Artificial Sequence
  Description of Artificial Sequence: Synthetic polypeptide
AEEEIRTTNPVATEQYGSVSTTNNQQNQEIGTDEEQ

SEQ ID NO: 132832 - protein, 36 aa, Artificial Sequence
  Description of Artificial Sequence: Synthetic polypeptide
AEEEIRTTNPVATEQYGSVSTTNNQQNQQEATNTTG

SEQ ID NO: 132833 - protein, 37 aa, Artificial Sequence
  Description of Artificial Sequence: Synthetic polypeptide
AEEEIRTTNPVATEQYGSVSTTNNQQQNGDEAGNVDE

SEQ ID NO: 132834 - protein, 36 aa, Artificial Sequence
  Description of Artificial Sequence: Synthetic polypeptide
DEEEIRTTNPVATEQYGKVPSTTPAGPNARTGGNNV

SEQ ID NO: 132835 - protein, 33 aa, Artificial Sequence
  Description of Artificial Sequence: Synthetic polypeptide
DEEEIRTTNPCATEAYGSVALMLEHEVRTTNQA

SEQ ID NO: 132836 - protein, 37 aa, Artificial Sequence
  Description of Artificial Sequence: Synthetic polypeptide
AEEEIRTTNPVATEQYGSVSTTNNQQQGSEAGTNNEE

SEQ ID NO: 132837 - protein, 34 aa, Artificial Sequence
  Description of Artificial Sequence: Synthetic polypeptide
DEEEIRTTNPCATEAYGSVALTALEHEVRTVNEA

SEQ ID NO: 132838 - protein, 32 aa, Artificial Sequence
  Description of Artificial Sequence: Synthetic polypeptide
DEEEIRTTNPCATEAYGSVALTLEHEVNTNEA

SEQ ID NO: 132839 - protein, 35 aa, Artificial Sequence
  Description of Artificial Sequence: Synthetic polypeptide
DEEEIRTTNPCATEAYGSVATTNNDNGNQQGNQAD

SEQ ID NO: 132840 - protein, 37 aa, Artificial Sequence
  Description of Artificial Sequence: Synthetic polypeptide
DEEEIRTTNPVATEQYGKSVSSTYPAGPNMRNGMNPV

SEQ ID NO: 132841 - protein, 37 aa, Artificial Sequence
  Description of Artificial Sequence: Synthetic polypeptide
DEEEIRTTNPVATEQYGKSVSSTTPAGPNMRNGMNPV

SEQ ID NO: 132842 - protein, 36 aa, Artificial Sequence
  Description of Artificial Sequence: Synthetic polypeptide
AEEEIRTTNPVATEQYGSVSTTNNQQQANVNNNTTE

SEQ ID NO: 132843 - protein, 36 aa, Artificial Sequence
  Description of Artificial Sequence: Synthetic polypeptide
AEEEIRTTNPVATEQYGSVSTTNNQQQANNEQGEDE

SEQ ID NO: 132844 - protein, 31 aa, Artificial Sequence
  Description of Artificial Sequence: Synthetic polypeptide
DDMEVATTNPVATEQYGNVCAANTPQREGQD

SEQ ID NO: 132845 - protein, 36 aa, Artificial Sequence
  Description of Artificial Sequence: Synthetic polypeptide
AEEEIRTTNPVATEQYGSVSTTNNQQQANANNATTD

SEQ ID NO: 132846 - protein, 34 aa, Artificial Sequence
  Description of Artificial Sequence: Synthetic polypeptide
DEEGIQTTNPVATEQYGSVSTGGQGDENGQEEGQ

SEQ ID NO: 132847 - protein, 34 aa, Artificial Sequence
  Description of Artificial Sequence: Synthetic polypeptide
DEEGIGTTNPVATEQYGSVSTGGLGDENGQQEGD

SEQ ID NO: 132848 - protein, 34 aa, Artificial Sequence
  Description of Artificial Sequence: Synthetic polypeptide
DEEGIGTTNPVATEQYGSVGTMNADDGNGGQNGQ

SEQ ID NO: 132849 - protein, 34 aa, Artificial Sequence
  Description of Artificial Sequence: Synthetic polypeptide
DEEGIETTNPVATEQYGSVSTGGLGDENDGQTGD

SEQ ID NO: 132850 - protein, 35 aa, Artificial Sequence
  Description of Artificial Sequence: Synthetic polypeptide
DEEEIRTTNPCATEAYGSVATTNNEQGNQQGTNEA

SEQ ID NO: 132851 - protein, 35 aa, Artificial Sequence
  Description of Artificial Sequence: Synthetic polypeptide
DEEEIRTTNPCATEAYGSVATTNNQDGNQQGNNAD

SEQ ID NO: 132852 - protein, 36 aa, Artificial Sequence
  Description of Artificial Sequence: Synthetic polypeptide
AEEEIRTTNPVATEQYGSVSTTNNQQNQQSNTNNTS

SEQ ID NO: 132853 - protein, 35 aa, Artificial Sequence
  Description of Artificial Sequence: Synthetic polypeptide
DEEEIRTTNPCATEAYGSVATTNNQGNQQGTNVAQ

SEQ ID NO: 132854 - protein, 36 aa, Artificial Sequence
  Description of Artificial Sequence: Synthetic polypeptide
DEEEIRTTNPVATEQYGKVSSTIPAGPNMRNGMNPV

SEQ ID NO: 132855 - protein, 37 aa, Artificial Sequence
  Description of Artificial Sequence: Synthetic polypeptide
AEEEIRTTNPVATEQYGSVSTTNTNLEQGSNQDENED

SEQ ID NO: 132856 - protein, 33 aa, Artificial Sequence
  Description of Artificial Sequence: Synthetic polypeptide
DDMEIATTNPVATEQYGTVCSATDGIVQFEGND

SEQ ID NO: 132857 - protein, 35 aa, Artificial Sequence
  Description of Artificial Sequence: Synthetic polypeptide
DEEEIRTCNPVATEQYGSVVVGNRGLQTDNGQGEI

SEQ ID NO: 132858 - protein, 35 aa, Artificial Sequence
  Description of Artificial Sequence: Synthetic polypeptide
DEENICTTNPVATEAYGVVSTTVNNLQQLGSNQED

SEQ ID NO: 132859 - protein, 36 aa, Artificial Sequence
  Description of Artificial Sequence: Synthetic polypeptide
AEEEIRTTNPVATEQYGSVSTTNQQQQQNNTNNDET

SEQ ID NO: 132860 - protein, 35 aa, Artificial Sequence
  Description of Artificial Sequence: Synthetic polypeptide
DEEEIRTTNPVAYEAYGQCVSYTGFQAGNGGNNRI

SEQ ID NO: 132861 - protein, 36 aa, Artificial Sequence
  Description of Artificial Sequence: Synthetic polypeptide
AEEEIRTTNPVATEQYGSVSTTNQQQQQNNIGTELG

SEQ ID NO: 132862 - protein, 37 aa, Artificial Sequence
  Description of Artificial Sequence: Synthetic polypeptide
AEEEIRTTNPVATEQYGSVSTTNQQQQQGNLGNTEEG

SEQ ID NO: 132863 - protein, 35 aa, Artificial Sequence
  Description of Artificial Sequence: Synthetic polypeptide
DEENICTTNPVATEAYGVVSTTTGNNLQQGTNEEQ

SEQ ID NO: 132864 - protein, 34 aa, Artificial Sequence
  Description of Artificial Sequence: Synthetic polypeptide
DEEEIRTTNPVATEQYGMVNGSMDGEFGPGGNND

SEQ ID NO: 132865 - protein, 34 aa, Artificial Sequence
  Description of Artificial Sequence: Synthetic polypeptide
DEEEIRTTNPVATEQYGMVNGSMDGEFGPGGNGG

SEQ ID NO: 132866 - protein, 34 aa, Artificial Sequence
  Description of Artificial Sequence: Synthetic polypeptide
DEEEIRTTNPVATEQYGMVNGSMDGEFGPGENQE

SEQ ID NO: 132867 - protein, 36 aa, Artificial Sequence
  Description of Artificial Sequence: Synthetic polypeptide
AEEEIRTTNPVATEQYGSVSTTNQQQQQNQGTTEEG

SEQ ID NO: 132868 - protein, 37 aa, Artificial Sequence
  Description of Artificial Sequence: Synthetic polypeptide
AEEEIRTTNPVATEQYGSVSTTNQQQQNNNIGTNIME

SEQ ID NO: 132869 - protein, 34 aa, Artificial Sequence
  Description of Artificial Sequence: Synthetic polypeptide
DEEEIRTTNPVATEQYGMVNGSMDGEEFGPGENI

SEQ ID NO: 132870 - protein, 34 aa, Artificial Sequence
  Description of Artificial Sequence: Synthetic polypeptide
DEEEIRTTNPVATEQYGMVNFEQGGQDEGGENEG

SEQ ID NO: 132871 - protein, 37 aa, Artificial Sequence
  Description of Artificial Sequence: Synthetic polypeptide
AEEEIRTTNPVATEQYGSVSTTNQQQNSVEQGTNVSE

SEQ ID NO: 132872 - protein, 37 aa, Artificial Sequence
  Description of Artificial Sequence: Synthetic polypeptide
AEEEIRTTNPVATEQYGSVSTTNQQQNQDEQGTNNAE

SEQ ID NO: 132873 - protein, 34 aa, Artificial Sequence
  Description of Artificial Sequence: Synthetic polypeptide
DEEEIRTTNPVATEQYGMVNFEQGGQDEGENEEQ

SEQ ID NO: 132874 - protein, 33 aa, Artificial Sequence
  Description of Artificial Sequence: Synthetic polypeptide
DEEEIRTTNPVATEQYGMVNFEQGGQDEGEDGQ

SEQ ID NO: 132875 - protein, 33 aa, Artificial Sequence
  Description of Artificial Sequence: Synthetic polypeptide
DEENIATTNPVATEIYGQVWTTNLERFQSNMFE

SEQ ID NO: 132876 - protein, 35 aa, Artificial Sequence
  Description of Artificial Sequence: Synthetic polypeptide
DEEEIRSTNPVCTEQYGVVSSTPNGPNMRNGMNPQ

SEQ ID NO: 132877 - protein, 33 aa, Artificial Sequence
  Description of Artificial Sequence: Synthetic polypeptide
DEENIATTNPVATEIYGQSVTTNLEVDFQSNMF

SEQ ID NO: 132878 - protein, 34 aa, Artificial Sequence
  Description of Artificial Sequence: Synthetic polypeptide
DEEEIRTTNPVATEQYGMVNGSMDGEFGPGENEA

SEQ ID NO: 132879 - protein, 35 aa, Artificial Sequence
  Description of Artificial Sequence: Synthetic polypeptide
DEEEIRTTNPVATEQYGMVSAEGMGGNQGQEGEGL

SEQ ID NO: 132880 - protein, 37 aa, Artificial Sequence
  Description of Artificial Sequence: Synthetic polypeptide
AEEEIRTTNPVATEQYGSVSTTNQQQQQQNIGNTEDT

SEQ ID NO: 132881 - protein, 36 aa, Artificial Sequence
  Description of Artificial Sequence: Synthetic polypeptide
AEEEIRTTNPVATEQYGSVSTTNQQQQQQNNGTTED

SEQ ID NO: 132882 - protein, 35 aa, Artificial Sequence
  Description of Artificial Sequence: Synthetic polypeptide
DEEEIRTTNPVATEQYGMVSIMNGEMQEGEGEQGM

SEQ ID NO: 132883 - protein, 34 aa, Artificial Sequence
  Description of Artificial Sequence: Synthetic polypeptide
DEEEIRTTNPVATEQYGMVSIMDNGIGGGDDEGT

SEQ ID NO: 132884 - protein, 34 aa, Artificial Sequence
  Description of Artificial Sequence: Synthetic polypeptide
DDETIRTTNPVATEQYGSVSTTGGEGQGDGGETG

SEQ ID NO: 132885 - protein, 34 aa, Artificial Sequence
  Description of Artificial Sequence: Synthetic polypeptide
DDETIRTTNPVATEQYGSVSTTNGGEEGGDGGEQ

SEQ ID NO: 132886 - protein, 38 aa, Artificial Sequence
  Description of Artificial Sequence: Synthetic polypeptide
AEEEIRTTNPVATEQYGSVSTTNTANLQAGTEAGNNEG

SEQ ID NO: 132887 - protein, 34 aa, Artificial Sequence
  Description of Artificial Sequence: Synthetic polypeptide
DEEEIRTTNPVATEQYGMVSIMDGEMQNGDGEQG

SEQ ID NO: 132888 - protein, 30 aa, Artificial Sequence
  Description of Artificial Sequence: Synthetic polypeptide
DDGEIAPTNPVSSEQYGNVSCNIQSSVGTR

SEQ ID NO: 132889 - protein, 34 aa, Artificial Sequence
  Description of Artificial Sequence: Synthetic polypeptide
DEEEIRTTNPVATEQYGMVSIMDGEMQEGGGESS

SEQ ID NO: 132890 - protein, 35 aa, Artificial Sequence
  Description of Artificial Sequence: Synthetic polypeptide
DEENICTTNPVATEIYGVVSTVTTNNLQQGSNGIG

SEQ ID NO: 132891 - protein, 35 aa, Artificial Sequence
  Description of Artificial Sequence: Synthetic polypeptide
DEEEIRTTNPVAYEAYGKVVSCWTNEWSNFKGTNR

SEQ ID NO: 132892 - protein, 36 aa, Artificial Sequence
  Description of Artificial Sequence: Synthetic polypeptide
DEEEIRTTNPVATEQYGMVSIFTGVGQFTGNEEGGN

SEQ ID NO: 132893 - protein, 37 aa, Artificial Sequence
  Description of Artificial Sequence: Synthetic polypeptide
AEEEIRTTNPVATEQYGSVSTTNQQSGNNNIGTTDMD

SEQ ID NO: 132894 - protein, 37 aa, Artificial Sequence
  Description of Artificial Sequence: Synthetic polypeptide
AEEEIRTTNPVATEQYGSVSTTNQQSGNNNIGTNIMT

SEQ ID NO: 132895 - protein, 37 aa, Artificial Sequence
  Description of Artificial Sequence: Synthetic polypeptide
AEEEIRTTNPVATEQYGSVSTTNQQSGNNNIGTNATD

SEQ ID NO: 132896 - protein, 35 aa, Artificial Sequence
  Description of Artificial Sequence: Synthetic polypeptide
DEENICTTNPVATEAYGVVSTVTNTNLQQGSNLED

SEQ ID NO: 132897 - protein, 34 aa, Artificial Sequence
  Description of Artificial Sequence: Synthetic polypeptide
DEEEIRTTNPVATEQYGMVSIFGMGNGGNENNDN

SEQ ID NO: 132898 - protein, 34 aa, Artificial Sequence
  Description of Artificial Sequence: Synthetic polypeptide
DEEEIRTTNPVATEQYGMVSIFGMGGNGGNNLQA

SEQ ID NO: 132899 - protein, 35 aa, Artificial Sequence
  Description of Artificial Sequence: Synthetic polypeptide
DEEEIRTTNPVATEQYGMVSIFGGEMQEGGGENDQ

SEQ ID NO: 132900 - protein, 36 aa, Artificial Sequence
  Description of Artificial Sequence: Synthetic polypeptide
AEEEIRTTNPVATEQYGSVSTTNQQQQQTNNNNDEQ

SEQ ID NO: 132901 - protein, 35 aa, Artificial Sequence
  Description of Artificial Sequence: Synthetic polypeptide
DEENICTTNPVATEAYGVVSTVTNNLQNQGSNLED

SEQ ID NO: 132902 - protein, 35 aa, Artificial Sequence
  Description of Artificial Sequence: Synthetic polypeptide
DEENICTTNPVATEAYGVVSTVTNLNQQNGSNVED

SEQ ID NO: 132903 - protein, 32 aa, Artificial Sequence
  Description of Artificial Sequence: Synthetic polypeptide
DEEEIRSTNPVSTEPYGTVSMEDIQQQSNGNH

SEQ ID NO: 132904 - protein, 36 aa, Artificial Sequence
  Description of Artificial Sequence: Synthetic polypeptide
AEEEIRTTNPVATEQYGSVSTTNQNDGTEQGTNPNA

SEQ ID NO: 132905 - protein, 30 aa, Artificial Sequence
  Description of Artificial Sequence: Synthetic polypeptide
DDGEIASTNPVSTEGYGNVANNIQSRVGTR

SEQ ID NO: 132906 - protein, 36 aa, Artificial Sequence
  Description of Artificial Sequence: Synthetic polypeptide
DEEMIRTTNPVATEQYGSVSSTTYAGPNMRNGMNPV

SEQ ID NO: 132907 - protein, 30 aa, Artificial Sequence
  Description of Artificial Sequence: Synthetic polypeptide
DEEEIRSVNPVCTEQWGVVSEIEQNSAGDQ

SEQ ID NO: 132908 - protein, 37 aa, Artificial Sequence
  Description of Artificial Sequence: Synthetic polypeptide
AEEEIRTTNPVATEQYGSVSTTNQQAGNNEQGTNQMG

SEQ ID NO: 132909 - protein, 36 aa, Artificial Sequence
  Description of Artificial Sequence: Synthetic polypeptide
AEEEIRTTNPVATEQYGSVSTTNQNTNTEQGTNTNE

SEQ ID NO: 132910 - protein, 34 aa, Artificial Sequence
  Description of Artificial Sequence: Synthetic polypeptide
DEEEIRTTNPVATEQYGMVGSGNMNNNDIFNNEM

SEQ ID NO: 132911 - protein, 35 aa, Artificial Sequence
  Description of Artificial Sequence: Synthetic polypeptide
DEEEIRTTNPVATEQYGMVGSGNMNNGQDIFNNNQ

SEQ ID NO: 132912 - protein, 35 aa, Artificial Sequence
  Description of Artificial Sequence: Synthetic polypeptide
DEEEIRTTNPVATEQYGMVGSGNMDQEGGGQDIQE

SEQ ID NO: 132913 - protein, 35 aa, Artificial Sequence
  Description of Artificial Sequence: Synthetic polypeptide
DEEEIRTTNPVATEQYGMVGNGQTDEGNQGGGENQ

SEQ ID NO: 132914 - protein, 36 aa, Artificial Sequence
  Description of Artificial Sequence: Synthetic polypeptide
AEEEIRTTNPVATEQYGSVSTTNQNQQNNIGTEQGQ

SEQ ID NO: 132915 - protein, 36 aa, Artificial Sequence
  Description of Artificial Sequence: Synthetic polypeptide
AEEEIRTTNPVATEQYGSVSTTNQNQQNANEQGTTE

SEQ ID NO: 132916 - protein, 36 aa, Artificial Sequence
  Description of Artificial Sequence: Synthetic polypeptide
DEEIIRTTNPVATEQYGFVSSTTPANPNMRAGMNPV

SEQ ID NO: 132917 - protein, 31 aa, Artificial Sequence
  Description of Artificial Sequence: Synthetic polypeptide
DDMEIASTNPVATEQYGTVAANDTIQRVGQD

SEQ ID NO: 132918 - protein, 38 aa, Artificial Sequence
  Description of Artificial Sequence: Synthetic polypeptide
AEEEIRTTNPVATEQYGSVSTTNQNQLQQGTEQGNTTQ

SEQ ID NO: 132919 - protein, 36 aa, Artificial Sequence
  Description of Artificial Sequence: Synthetic polypeptide
AEEEIRTTNPVATEQYGSVSTTNQNNQQQNATNTED

SEQ ID NO: 132920 - protein, 34 aa, Artificial Sequence
  Description of Artificial Sequence: Synthetic polypeptide
DEEEIRTTNPVATEQYGMVGCPTPLDEQQLVTEH

SEQ ID NO: 132921 - protein, 34 aa, Artificial Sequence
  Description of Artificial Sequence: Synthetic polypeptide
DEEHIRTTNPVAYEQYGSTVNTTGNGSVQSSNNE

SEQ ID NO: 132922 - protein, 34 aa, Artificial Sequence
  Description of Artificial Sequence: Synthetic polypeptide
DDMEIATTNPVATEGYGTVCSANDTIVQSREGNR

SEQ ID NO: 132923 - protein, 36 aa, Artificial Sequence
  Description of Artificial Sequence: Synthetic polypeptide
DEEHIRTTNPVATEQYGSVSSTTPAGPNMRNGMNPV

SEQ ID NO: 132924 - protein, 36 aa, Artificial Sequence
  Description of Artificial Sequence: Synthetic polypeptide
DEEHIRTTNPVATEQYGSVSSTTPAGPGMRNGMNPV

SEQ ID NO: 132925 - protein, 34 aa, Artificial Sequence
  Description of Artificial Sequence: Synthetic polypeptide
DDMEIATTNPVATEGYGTVCSANDTIVQSRVGNR

SEQ ID NO: 132926 - protein, 36 aa, Artificial Sequence
  Description of Artificial Sequence: Synthetic polypeptide
AEEEIRTTNPVATEQYGSVSTTNQNNENSEQGNTTN

SEQ ID NO: 132927 - protein, 34 aa, Artificial Sequence
  Description of Artificial Sequence: Synthetic polypeptide
DEEEIRTTNPVATEQYGMVGITGMGGNEEDNGGG

SEQ ID NO: 132928 - protein, 30 aa, Artificial Sequence
  Description of Artificial Sequence: Synthetic polypeptide
DEEEIRSVNPVCTEQWGVVSEIEQNAAGDQ

SEQ ID NO: 132929 - protein, 34 aa, Artificial Sequence
  Description of Artificial Sequence: Synthetic polypeptide
DEEEIRTTNPVATEQYGMVGSIDFLGDGGQGEEQ

SEQ ID NO: 132930 - protein, 36 aa, Artificial Sequence
  Description of Artificial Sequence: Synthetic polypeptide
DEEIIRTTNPVATEQYGSVSSTTPAGPGMRNGMNPV

SEQ ID NO: 132931 - protein, 36 aa, Artificial Sequence
  Description of Artificial Sequence: Synthetic polypeptide
DEEMIRTTNPVATEQYGSVSSTTPSGWNMRNGMNPV

SEQ ID NO: 132932 - protein, 36 aa, Artificial Sequence
  Description of Artificial Sequence: Synthetic polypeptide
DEEMIRTTNPVATEQYGSVSSTTPEGPNMRNGMNPV

SEQ ID NO: 132933 - protein, 36 aa, Artificial Sequence
  Description of Artificial Sequence: Synthetic polypeptide
DEEMIRTTNPVATEQYGSVSSTTPAGPNMSNGMNPV

SEQ ID NO: 132934 - protein, 36 aa, Artificial Sequence
  Description of Artificial Sequence: Synthetic polypeptide
DEEMIRTTNPVATEQYGSVSSTTPAGPNMRNGMNPV

SEQ ID NO: 132935 - protein, 36 aa, Artificial Sequence
  Description of Artificial Sequence: Synthetic polypeptide
DEEMIRTTNPVATEQYGSVSSTMPAGPNMRNGMNPV

SEQ ID NO: 132936 - protein, 32 aa, Artificial Sequence
  Description of Artificial Sequence: Synthetic polypeptide
DEEEIRSTNPVSTEPYGVVSMEDIQQQQNGNH

SEQ ID NO: 132937 - protein, 36 aa, Artificial Sequence
  Description of Artificial Sequence: Synthetic polypeptide
AEEEIRTTNPVATEQYGSVSTTNQQLQQNDEDTEEA

SEQ ID NO: 132938 - protein, 37 aa, Artificial Sequence
  Description of Artificial Sequence: Synthetic polypeptide
DEELIRTTNPVATEQYGSVSSTTPAQGPNMRNGMNPV

SEQ ID NO: 132939 - protein, 36 aa, Artificial Sequence
  Description of Artificial Sequence: Synthetic polypeptide
DEELIRTTNPVATEQYGSVSSTTPAGPNMRNGMNPV

SEQ ID NO: 132940 - protein, 35 aa, Artificial Sequence
  Description of Artificial Sequence: Synthetic polypeptide
DEEEIRTTNPVATEQYGMVGSNMNLIEGGGEDEMN

SEQ ID NO: 132941 - protein, 35 aa, Artificial Sequence
  Description of Artificial Sequence: Synthetic polypeptide
DEEEIRTTNPVATEQYGMVGSNMNIFDDEGGNGQE

SEQ ID NO: 132942 - protein, 35 aa, Artificial Sequence
  Description of Artificial Sequence: Synthetic polypeptide
DEEEIRTTNPVATEQYGMVGSNMNIFDDEGGNEQD

SEQ ID NO: 132943 - protein, 35 aa, Artificial Sequence
  Description of Artificial Sequence: Synthetic polypeptide
DEEEIRTTNPVATEQYGMVGSIMNLSEDGGEDEED

SEQ ID NO: 132944 - protein, 36 aa, Artificial Sequence
  Description of Artificial Sequence: Synthetic polypeptide
DEEEIRTTNPVATEQYGMVGSIMNLQIEGDGEDEEA

SEQ ID NO: 132945 - protein, 36 aa, Artificial Sequence
  Description of Artificial Sequence: Synthetic polypeptide
AEEEIRTTNPVATEQYGSVSTTNQQLNQNEQEEEEV

SEQ ID NO: 132946 - protein, 35 aa, Artificial Sequence
  Description of Artificial Sequence: Synthetic polypeptide
DEEEIRTTNPVATEQYGMVGSIMNLNDGDGEGEEA

SEQ ID NO: 132947 - protein, 35 aa, Artificial Sequence
  Description of Artificial Sequence: Synthetic polypeptide
DEEEIRTTNPVATEQYGMVGSIMNLFEGEGEDEED

SEQ ID NO: 132948 - protein, 35 aa, Artificial Sequence
  Description of Artificial Sequence: Synthetic polypeptide
DEEEIRTTNPVATEQYGMVGSIMNDEVGGNGNGDV

SEQ ID NO: 132949 - protein, 34 aa, Artificial Sequence
  Description of Artificial Sequence: Synthetic polypeptide
DEEEIRTTNPVATEQYGMVGSIDINGEGDGEGEI

SEQ ID NO: 132950 - protein, 34 aa, Artificial Sequence
  Description of Artificial Sequence: Synthetic polypeptide
DEEEIRTTNPVATEQYGMVGSIDGLGEDGGQGET

SEQ ID NO: 132951 - protein, 36 aa, Artificial Sequence
  Description of Artificial Sequence: Synthetic polypeptide
DEEIIRTTNPVATEQYGSVSSTTPAGPNMRNGMNPV

SEQ ID NO: 132952 - protein, 32 aa, Artificial Sequence
  Description of Artificial Sequence: Synthetic polypeptide
DEEEIRSTNPVSTEPYGVISMENIQQQQNGNQ

SEQ ID NO: 132953 - protein, 36 aa, Artificial Sequence
  Description of Artificial Sequence: Synthetic polypeptide
DEEEIRTTNPVATEQYGDMVTIMTNGTGQGGENEGN

SEQ ID NO: 132954 - protein, 33 aa, Artificial Sequence
  Description of Artificial Sequence: Synthetic polypeptide
SDSEIRTTNPVATEQYGSVWVTYLFQENQNDDQ

SEQ ID NO: 132955 - protein, 34 aa, Artificial Sequence
  Description of Artificial Sequence: Synthetic polypeptide
DEEEIRTTNPVATEQYGSAYSGCIEDVQVENDEQ

SEQ ID NO: 132956 - protein, 34 aa, Artificial Sequence
  Description of Artificial Sequence: Synthetic polypeptide
DEGEIATTNPVAYEQYGSVCAATNPLQAGEVPDD

SEQ ID NO: 132957 - protein, 34 aa, Artificial Sequence
  Description of Artificial Sequence: Synthetic polypeptide
DEGEIATTNPVAYEQYGSVCAATNPLNQREDTDS

SEQ ID NO: 132958 - protein, 35 aa, Artificial Sequence
  Description of Artificial Sequence: Synthetic polypeptide
DEGEIATTNPVAYEQYGSVCAATNPLNQRAEDNDQ

SEQ ID NO: 132959 - protein, 34 aa, Artificial Sequence
  Description of Artificial Sequence: Synthetic polypeptide
DEGEIATTNPVAYEQYGSVCAATNPLNQMEDNDL

SEQ ID NO: 132960 - protein, 29 aa, Artificial Sequence
  Description of Artificial Sequence: Synthetic peptide
QESEIASTNPVGTEGYGVMASTELQHGDI

SEQ ID NO: 132961 - protein, 29 aa, Artificial Sequence
  Description of Artificial Sequence: Synthetic peptide
QESEIASTNPVGTEGYGVMASTFLQHGDI

SEQ ID NO: 132962 - protein, 29 aa, Artificial Sequence
  Description of Artificial Sequence: Synthetic peptide
QESEIASTNPVGTEGYGVMASTGLQHGDI

SEQ ID NO: 132963 - protein, 34 aa, Artificial Sequence
  Description of Artificial Sequence: Synthetic polypeptide
DEGEIATTNPVAYEQYGSVCAADNGLNQREDNDS

SEQ ID NO: 132964 - protein, 29 aa, Artificial Sequence
  Description of Artificial Sequence: Synthetic peptide
QESEIASTNPVGTEGYGVMASTHLQHGDI

SEQ ID NO: 132965 - protein, 35 aa, Artificial Sequence
  Description of Artificial Sequence: Synthetic polypeptide
DEGEIATTNPVAYEQYGSVCAATNVLDNQREDNDS

SEQ ID NO: 132966 - protein, 33 aa, Artificial Sequence
  Description of Artificial Sequence: Synthetic polypeptide
DEGEIATTNPVAYEQYGSVATTNLADDPGGEAH

SEQ ID NO: 132967 - protein, 29 aa, Artificial Sequence
  Description of Artificial Sequence: Synthetic peptide
QESEIASTNPVGTEGYGVMASTKLQHGDI

SEQ ID NO: 132968 - protein, 30 aa, Artificial Sequence
  Description of Artificial Sequence: Synthetic polypeptide
QESEIASTNPVGTEGYGVMASTKLQHRGDI

SEQ ID NO: 132969 - protein, 28 aa, Artificial Sequence
  Description of Artificial Sequence: Synthetic peptide
QESEIASTNPVGTEGYGVMASTKQRGDI

SEQ ID NO: 132970 - protein, 28 aa, Artificial Sequence
  Description of Artificial Sequence: Synthetic peptide
QESEIASTNPVGTEGYGVMASTLARGDI

SEQ ID NO: 132971 - protein, 37 aa, Artificial Sequence
  Description of Artificial Sequence: Synthetic polypeptide
DEEEIRTTNPVATEQYGVVSVVVSNLQAGSEGGTNTQ

SEQ ID NO: 132972 - protein, 37 aa, Artificial Sequence
  Description of Artificial Sequence: Synthetic polypeptide
DEEEIRTTNPVATEQYGVVSVVVSNLQAGTVEGGNNQ

SEQ ID NO: 132973 - protein, 38 aa, Artificial Sequence
  Description of Artificial Sequence: Synthetic polypeptide
DEEEIRTTNPVATEQYGVVSVVVSTNNDQSGTNQDTDE

SEQ ID NO: 132974 - protein, 34 aa, Artificial Sequence
  Description of Artificial Sequence: Synthetic polypeptide
DEGEIATTNPVAYEQYGSVATNLDQGTPQEQTNQ

SEQ ID NO: 132975 - protein, 33 aa, Artificial Sequence
  Description of Artificial Sequence: Synthetic polypeptide
DEGEIATTNPVAYEQYGSVATNHTQTRNPADEA

SEQ ID NO: 132976 - protein, 29 aa, Artificial Sequence
  Description of Artificial Sequence: Synthetic peptide
QESEIASTNPVGTEGYGVMASTILQHGDI

SEQ ID NO: 132977 - protein, 29 aa, Artificial Sequence
  Description of Artificial Sequence: Synthetic peptide
QESEIASTNPVGTEGYGVMASTDLQHGDS

SEQ ID NO: 132978 - protein, 30 aa, Artificial Sequence
  Description of Artificial Sequence: Synthetic polypeptide
QESEIASTNPVGTEGYGVMASTDLQHGDNI

SEQ ID NO: 132979 - protein, 29 aa, Artificial Sequence
  Description of Artificial Sequence: Synthetic peptide
QESEIASTNPVGTEGYGVMASTDLQHGDI

SEQ ID NO: 132980 - protein, 30 aa, Artificial Sequence
  Description of Artificial Sequence: Synthetic polypeptide
DEGEIATTNPVSSEQYGIVSACDLEDHGEL

SEQ ID NO: 132981 - protein, 37 aa, Artificial Sequence
  Description of Artificial Sequence: Synthetic polypeptide
DEEEIRTTNPVATEQYGVVSVVTVTTNLQAGTTEESD

SEQ ID NO: 132982 - protein, 29 aa, Artificial Sequence
  Description of Artificial Sequence: Synthetic peptide
QESEIASTNPVGTEGYGVMASFTLQHGNI

SEQ ID NO: 132983 - protein, 34 aa, Artificial Sequence
  Description of Artificial Sequence: Synthetic polypeptide
DEGEIATTNPVGTEQWGSVPSCTTLSTRTGTNFV

SEQ ID NO: 132984 - protein, 29 aa, Artificial Sequence
  Description of Artificial Sequence: Synthetic peptide
QESEIASTNPVGTEGYGVMASINLQHGDI

SEQ ID NO: 132985 - protein, 28 aa, Artificial Sequence
  Description of Artificial Sequence: Synthetic peptide
QESEIASTNPVGTEGYGVMASNLQHGDI

SEQ ID NO: 132986 - protein, 34 aa, Artificial Sequence
  Description of Artificial Sequence: Synthetic polypeptide
DEGEIATTNPVAYEQYGSVSVANGAQEHGDNTAQ

SEQ ID NO: 132987 - protein, 28 aa, Artificial Sequence
  Description of Artificial Sequence: Synthetic peptide
QESEIASTNPVGTEGYGVMASNLQHGDQ

SEQ ID NO: 132988 - protein, 28 aa, Artificial Sequence
  Description of Artificial Sequence: Synthetic peptide
QESEIASTNPVGTEGYGVMASNLQHGTI

SEQ ID NO: 132989 - protein, 33 aa, Artificial Sequence
  Description of Artificial Sequence: Synthetic polypeptide
DEGEIATTNPVAYEQYGSVSCAEALQNVANPMT

SEQ ID NO: 132990 - protein, 28 aa, Artificial Sequence
  Description of Artificial Sequence: Synthetic peptide
QESEIASTNPVGTEGYGVMASNLQSGDI

SEQ ID NO: 132991 - protein, 32 aa, Artificial Sequence
  Description of Artificial Sequence: Synthetic polypeptide
DEGEIATTNPVAYEQYGSVPSAANQSDNNPPT

SEQ ID NO: 132992 - protein, 33 aa, Artificial Sequence
  Description of Artificial Sequence: Synthetic polypeptide
DEGEIATTNPVAYEQYGSVCSTNEQDATLTKDQ

SEQ ID NO: 132993 - protein, 29 aa, Artificial Sequence
  Description of Artificial Sequence: Synthetic peptide
QESEIASTNPVGTEGYGVMASTALQHGDD

SEQ ID NO: 132994 - protein, 29 aa, Artificial Sequence
  Description of Artificial Sequence: Synthetic peptide
QESEIASTNPVGTEGYGVMASTALQHGDI

SEQ ID NO: 132995 - protein, 34 aa, Artificial Sequence
  Description of Artificial Sequence: Synthetic polypeptide
DEGEIATTNPVAYEQYGSVCQATNVLQENEANDS

SEQ ID NO: 132996 - protein, 33 aa, Artificial Sequence
  Description of Artificial Sequence: Synthetic polypeptide
DEGEIATTNPVAYEQYGSVCATTGANAVGGNQV

SEQ ID NO: 132997 - protein, 29 aa, Artificial Sequence
  Description of Artificial Sequence: Synthetic peptide
QESEIASTNPVGTEGYGVMASTCLQHGDI

SEQ ID NO: 132998 - protein, 33 aa, Artificial Sequence
  Description of Artificial Sequence: Synthetic polypeptide
DEGEIATTNPVAYEQYGSVCATNEQDATLTGDM

SEQ ID NO: 132999 - protein, 32 aa, Artificial Sequence
  Description of Artificial Sequence: Synthetic polypeptide
DEGEIATTNPVAYEQYGSVCASNTLNTDGEMQ

SEQ ID NO: 133000 - protein, 33 aa, Artificial Sequence
  Description of Artificial Sequence: Synthetic polypeptide
DEGEIATTNPVAYEQYGSVCANNLEATPGDNAE

SEQ ID NO: 133001 - protein, 28 aa, Artificial Sequence
  Description of Artificial Sequence: Synthetic peptide
QESEIASTNPVGTEGYGVMASTLHHGDR

SEQ ID NO: 133002 - protein, 33 aa, Artificial Sequence
  Description of Artificial Sequence: Synthetic polypeptide
DDEEIRTTNPVATEGYGCVCSTEEPQNFGSEQS

SEQ ID NO: 133003 - protein, 38 aa, Artificial Sequence
  Description of Artificial Sequence: Synthetic polypeptide
DEEEIRTTNPVATEQYGVVSVVVSTNQQAGNSEQGTTE

SEQ ID NO: 133004 - protein, 38 aa, Artificial Sequence
  Description of Artificial Sequence: Synthetic polypeptide
DEEEIRTTNPVATEQYGVVSVVVSTNQQAGNTEQGIVE

SEQ ID NO: 133005 - protein, 28 aa, Artificial Sequence
  Description of Artificial Sequence: Synthetic peptide
QESEIASTNPVGTEGYGVMASTLQEGTI

SEQ ID NO: 133006 - protein, 37 aa, Artificial Sequence
  Description of Artificial Sequence: Synthetic polypeptide
DEEEIRTTNPVATEQYGVVSVVVTNLQLQQIGTTEES

SEQ ID NO: 133007 - protein, 28 aa, Artificial Sequence
  Description of Artificial Sequence: Synthetic peptide
QESEIASTNPVGTEGYGVMASTLQFGDI

SEQ ID NO: 133008 - protein, 34 aa, Artificial Sequence
  Description of Artificial Sequence: Synthetic polypeptide
DEGEIATTNPVAYEQYGSTACAANNLQDPDGNRN

SEQ ID NO: 133009 - protein, 28 aa, Artificial Sequence
  Description of Artificial Sequence: Synthetic peptide
QESEIASTNPVGTEGYGVMASTLQGGDI

SEQ ID NO: 133010 - protein, 38 aa, Artificial Sequence
  Description of Artificial Sequence: Synthetic polypeptide
DEEEIRTTNPVATEQYGVVSVVVTNLQNGNQQGTEQGS

SEQ ID NO: 133011 - protein, 33 aa, Artificial Sequence
  Description of Artificial Sequence: Synthetic polypeptide
DEGEIATTNPVAYEQYGSCATNLQGAPQEQTNQ

SEQ ID NO: 133012 - protein, 32 aa, Artificial Sequence
  Description of Artificial Sequence: Synthetic polypeptide
DEGEIATTNPVAYEQYGSCATNLADDPMDNDH

SEQ ID NO: 133013 - protein, 28 aa, Artificial Sequence
  Description of Artificial Sequence: Synthetic peptide
QESEIASTNPVGTEGYGVMASTLQGNDI

SEQ ID NO: 133014 - protein, 28 aa, Artificial Sequence
  Description of Artificial Sequence: Synthetic peptide
QESEIASTNPVGTEGYGVMASTLQEGDP

SEQ ID NO: 133015 - protein, 28 aa, Artificial Sequence
  Description of Artificial Sequence: Synthetic peptide
QESEIASTNPVGTEGYGVMASTLQHGAI

SEQ ID NO: 133016 - protein, 37 aa, Artificial Sequence
  Description of Artificial Sequence: Synthetic polypeptide
DEEEIRTTNPVATEQYGVVSVVVTTNLEQGNNEEEGE

SEQ ID NO: 133017 - protein, 28 aa, Artificial Sequence
  Description of Artificial Sequence: Synthetic peptide
QESEIASTNPVGTEGYGVMASTLQHGDC

SEQ ID NO: 133018 - protein, 28 aa, Artificial Sequence
  Description of Artificial Sequence: Synthetic peptide
QESEIASTNPVGTEGYGVMASTLQHGDD

SEQ ID NO: 133019 - protein, 38 aa, Artificial Sequence
  Description of Artificial Sequence: Synthetic polypeptide
DEEEIRTTNPVATEQYGVVSVVVTTNLQAGNSEQGEEE

SEQ ID NO: 133020 - protein, 28 aa, Artificial Sequence
  Description of Artificial Sequence: Synthetic peptide
QESEIASTNPVGTEGYGVMASTLQHGDE

SEQ ID NO: 133021 - protein, 38 aa, Artificial Sequence
  Description of Artificial Sequence: Synthetic polypeptide
DEEEIRTTNPVATEQYGVVSVVVTTNLQAGNTEAGNQE

SEQ ID NO: 133022 - protein, 33 aa, Artificial Sequence
  Description of Artificial Sequence: Synthetic polypeptide
DEGEIATTNPVAYEQYGCVATNLADTPGEDGRW

SEQ ID NO: 133023 - protein, 32 aa, Artificial Sequence
  Description of Artificial Sequence: Synthetic polypeptide
DEGEIATTNPVAYEQYGCVATGLDNRGEMLQW

SEQ ID NO: 133024 - protein, 28 aa, Artificial Sequence
  Description of Artificial Sequence: Synthetic peptide
QESEIASTNPVGTEGYGVMASTLQHGDF

SEQ ID NO: 133025 - protein, 28 aa, Artificial Sequence
  Description of Artificial Sequence: Synthetic peptide
QESEIASTNPVGTEGYGVMASTLQHGDA

SEQ ID NO: 133026 - protein, 28 aa, Artificial Sequence
  Description of Artificial Sequence: Synthetic peptide
QESEIASTNPVGTEGYGVMASTLQEGDI

SEQ ID NO: 133027 - protein, 29 aa, Artificial Sequence
  Description of Artificial Sequence: Synthetic peptide
QESEIASTNPVGTEGYGVMASTLQDHGNI

SEQ ID NO: 133028 - protein, 38 aa, Artificial Sequence
  Description of Artificial Sequence: Synthetic polypeptide
DEEEIRTTNPVATEQYGVVSVVVTNLQLQNQNGNNNEQ

SEQ ID NO: 133029 - protein, 38 aa, Artificial Sequence
  Description of Artificial Sequence: Synthetic polypeptide
DEEEIRTTNPVATEQYGVVSVVVSTNQQAGNVEQGEAE

SEQ ID NO: 133030 - protein, 32 aa, Artificial Sequence
  Description of Artificial Sequence: Synthetic polypeptide
DEGEIATTNPVAYEQYGSVATHGQDSNGSDEH

SEQ ID NO: 133031 - protein, 33 aa, Artificial Sequence
  Description of Artificial Sequence: Synthetic polypeptide
DEGEIATTNPVAYEQYGSVATHGQARPNDSVDG

SEQ ID NO: 133032 - protein, 32 aa, Artificial Sequence
  Description of Artificial Sequence: Synthetic polypeptide
DEGEIATTNPVAYEQYGSVANTNLEATTQDDQ

SEQ ID NO: 133033 - protein, 29 aa, Artificial Sequence
  Description of Artificial Sequence: Synthetic peptide
QESEIASTNPVGTEGYGVMASTLLQHGAI

SEQ ID NO: 133034 - protein, 29 aa, Artificial Sequence
  Description of Artificial Sequence: Synthetic peptide
QESEIASTNPVGTEGYGVMASTLLQHGDI

SEQ ID NO: 133035 - protein, 35 aa, Artificial Sequence
  Description of Artificial Sequence: Synthetic polypeptide
DEGEIATTNPVAYEQYGSVANANNLHQRTGNPLEE

SEQ ID NO: 133036 - protein, 33 aa, Artificial Sequence
  Description of Artificial Sequence: Synthetic polypeptide
DEGEIATTNPVAYEQYGSVAMNLQGTPDGSEEN

SEQ ID NO: 133037 - protein, 39 aa, Artificial Sequence
  Description of Artificial Sequence: Synthetic polypeptide
DEEEIRTTNPVATEQYGVVSVVVSTTNLQQGTEQGNTTD

SEQ ID NO: 133038 - protein, 38 aa, Artificial Sequence
  Description of Artificial Sequence: Synthetic polypeptide
DEEEIRTTNPVATEQYGVVSVVVSTTNNNQQQGNNVTD

SEQ ID NO: 133039 - protein, 34 aa, Artificial Sequence
  Description of Artificial Sequence: Synthetic polypeptide
DEGEIATTNPVAYEQYGSVAITNLEQTGGVGQDD

SEQ ID NO: 133040 - protein, 33 aa, Artificial Sequence
  Description of Artificial Sequence: Synthetic polypeptide
DEGEIATTNPVAYEQYGSVAITNDEATGNGDEQ

SEQ ID NO: 133041 - protein, 28 aa, Artificial Sequence
  Description of Artificial Sequence: Synthetic peptide
QESEIASTNPVGTEGYGVMASTLQAGDF

SEQ ID NO: 133042 - protein, 33 aa, Artificial Sequence
  Description of Artificial Sequence: Synthetic polypeptide
DEGEIATTNPVAYEQYGSVAGTNLQPDPQEEGD

SEQ ID NO: 133043 - protein, 33 aa, Artificial Sequence
  Description of Artificial Sequence: Synthetic polypeptide
DEGEIATTNPVAYEQYGSVAGTNLADDPPGEAH

SEQ ID NO: 133044 - protein, 28 aa, Artificial Sequence
  Description of Artificial Sequence: Synthetic peptide
QESEIASTNPVGTEGYGVMASTLQAGDI

SEQ ID NO: 133045 - protein, 32 aa, Artificial Sequence
  Description of Artificial Sequence: Synthetic polypeptide
DEGEIATTNPVAYEQYGSVAGEGDQNSDNPRN

SEQ ID NO: 133046 - protein, 28 aa, Artificial Sequence
  Description of Artificial Sequence: Synthetic peptide
QESEIASTNPVGTEGYGVMASTLQCGDI

SEQ ID NO: 133047 - protein, 32 aa, Artificial Sequence
  Description of Artificial Sequence: Synthetic polypeptide
DEGEIATTNPVAYEQYGSVAANLQGAPAAPKH

SEQ ID NO: 133048 - protein, 34 aa, Artificial Sequence
  Description of Artificial Sequence: Synthetic polypeptide
DEGEIATTNPVAYEQYGSVAANGLQPDDQMGGRE

SEQ ID NO: 133049 - protein, 28 aa, Artificial Sequence
  Description of Artificial Sequence: Synthetic peptide
QESEIASTNPVGTEGYGVMASTLQDGDI

SEQ ID NO: 133050 - protein, 33 aa, Artificial Sequence
  Description of Artificial Sequence: Synthetic polypeptide
DEGEIATTNPVAYEQYGSVATNGPTGAEGGNMI

SEQ ID NO: 133051 - protein, 33 aa, Artificial Sequence
  Description of Artificial Sequence: Synthetic polypeptide
DEGEIATTNPVAYEQYGCVAGNGLQRAEAGDTA

SEQ ID NO: 133052 - protein, 32 aa, Artificial Sequence
  Description of Artificial Sequence: Synthetic polypeptide
DEGEIATTNPVSTECYGIVSCINEQDREGETG

SEQ ID NO: 133053 - protein, 29 aa, Artificial Sequence
  Description of Artificial Sequence: Synthetic peptide
QESEIASTNPVGTEGYGVMASDTLQRGDI

SEQ ID NO: 133054 - protein, 38 aa, Artificial Sequence
  Description of Artificial Sequence: Synthetic polypeptide
DEEEIRTTNPVATEQYGVVSVTVATNLQAGNDEEDEDE

SEQ ID NO: 133055 - protein, 30 aa, Artificial Sequence
  Description of Artificial Sequence: Synthetic polypeptide
DEGEIRTTNPVATEQWGDVSEGEMNATEDA

SEQ ID NO: 133056 - protein, 38 aa, Artificial Sequence
  Description of Artificial Sequence: Synthetic polypeptide
DEEEIRTTNPVATEQYGVVSVTVNLNLQQGTNDEDEEE

SEQ ID NO: 133057 - protein, 30 aa, Artificial Sequence
  Description of Artificial Sequence: Synthetic polypeptide
DEGEIRTTNPVATEQWGDVSCIEMNAAEDA

SEQ ID NO: 133058 - protein, 33 aa, Artificial Sequence
  Description of Artificial Sequence: Synthetic polypeptide
DEGEIRTTNPVATEQWGCWSTIPPLNENRENNN

SEQ ID NO: 133059 - protein, 28 aa, Artificial Sequence
  Description of Artificial Sequence: Synthetic peptide
QESEIASTNPVGTEGYGSMASDLQHGDI

SEQ ID NO: 133060 - protein, 29 aa, Artificial Sequence
  Description of Artificial Sequence: Synthetic peptide
QESEIASTNPVGTEGYGSMASTLPQHGDI

SEQ ID NO: 133061 - protein, 29 aa, Artificial Sequence
  Description of Artificial Sequence: Synthetic peptide
QESEIASTNPVGTEGYGSMASTLQAGDIV

SEQ ID NO: 133062 - protein, 29 aa, Artificial Sequence
  Description of Artificial Sequence: Synthetic peptide
QESEIASTNPVGTEGYGSMASTLQHGDDI

SEQ ID NO: 133063 - protein, 30 aa, Artificial Sequence
  Description of Artificial Sequence: Synthetic polypeptide
DEGEIRTTNPVATEQWGDVSEIEMNAAEDA

SEQ ID NO: 133064 - protein, 29 aa, Artificial Sequence
  Description of Artificial Sequence: Synthetic peptide
QESEIASTNPVGTEGYGSMASTLQHGDIS

SEQ ID NO: 133065 - protein, 29 aa, Artificial Sequence
  Description of Artificial Sequence: Synthetic peptide
QESEIASTNPVGTEGYGSMASTLQHNGDI

SEQ ID NO: 133066 - protein, 38 aa, Artificial Sequence
  Description of Artificial Sequence: Synthetic polypeptide
DEEEIRTTNPVATEQYGVVSVTVNQNLQQGNNQDEEDE

SEQ ID NO: 133067 - protein, 38 aa, Artificial Sequence
  Description of Artificial Sequence: Synthetic polypeptide
DEEEIRTTNPVATEQYGVVSVTVNQQLQQGNNNTDEDE

SEQ ID NO: 133068 - protein, 29 aa, Artificial Sequence
  Description of Artificial Sequence: Synthetic peptide
QESEIASTNPVGTEGYGSMATTLQHGDDI

SEQ ID NO: 133069 - protein, 38 aa, Artificial Sequence
  Description of Artificial Sequence: Synthetic polypeptide
DEEEIRTTNPVATEQYGVVSVTVTNLQAGTEQGTNQDE

SEQ ID NO: 133070 - protein, 38 aa, Artificial Sequence
  Description of Artificial Sequence: Synthetic polypeptide
DEEEIRTTNPVATEQYGVVSVTVTNLQQLQGNNNNNNE

SEQ ID NO: 133071 - protein, 29 aa, Artificial Sequence
  Description of Artificial Sequence: Synthetic peptide
QESEIASTNPVGTEGYGSVAASTLDHGDI

SEQ ID NO: 133072 - protein, 30 aa, Artificial Sequence
  Description of Artificial Sequence: Synthetic polypeptide
QESEIASTNPVGTEGYGSVMASTLQHGMDI

SEQ ID NO: 133073 - protein, 28 aa, Artificial Sequence
  Description of Artificial Sequence: Synthetic peptide
QESEIASTNPVGTEGYGTMASTLQHGDI

SEQ ID NO: 133074 - protein, 29 aa, Artificial Sequence
  Description of Artificial Sequence: Synthetic peptide
QESEIASTNPVGTEGYGSMASTLQHGEDI

SEQ ID NO: 133075 - protein, 29 aa, Artificial Sequence
  Description of Artificial Sequence: Synthetic peptide
QESEIASTNPVGTEGYGRVMASTLQHGDI

SEQ ID NO: 133076 - protein, 30 aa, Artificial Sequence
  Description of Artificial Sequence: Synthetic polypeptide
DEGEIRTTNPVATEQWGDVSEIEPNAAEDA

SEQ ID NO: 133077 - protein, 30 aa, Artificial Sequence
  Description of Artificial Sequence: Synthetic polypeptide
DEGEIRTTNPVATEQWGDVSEPEMNAAEDA

SEQ ID NO: 133078 - protein, 28 aa, Artificial Sequence
  Description of Artificial Sequence: Synthetic peptide
QESEIASTNPVGTEGYGLMASTLQEGDI

SEQ ID NO: 133079 - protein, 28 aa, Artificial Sequence
  Description of Artificial Sequence: Synthetic peptide
QESEIASTNPVGTEGYGLMASTLQHGDI

SEQ ID NO: 133080 - protein, 28 aa, Artificial Sequence
  Description of Artificial Sequence: Synthetic peptide
QESEIASTNPVGTEGYGMMASTLQHGDI

SEQ ID NO: 133081 - protein, 28 aa, Artificial Sequence
  Description of Artificial Sequence: Synthetic peptide
QESEIASTNPVGTEGYGMMASTLQPGDI

SEQ ID NO: 133082 - protein, 29 aa, Artificial Sequence
  Description of Artificial Sequence: Synthetic peptide
QESEIASTNPVGTEGYGMVMASTLQHGDI

SEQ ID NO: 133083 - protein, 28 aa, Artificial Sequence
  Description of Artificial Sequence: Synthetic peptide
QESEIASTNPVGTEGYGNMASTLQHGDI

SEQ ID NO: 133084 - protein, 28 aa, Artificial Sequence
  Description of Artificial Sequence: Synthetic peptide
QESEIASTNPVGTEGYGNMASTLQHGDN

SEQ ID NO: 133085 - protein, 35 aa, Artificial Sequence
  Description of Artificial Sequence: Synthetic polypeptide
DEGEIRTTNPVATEQYGCCTVTTVNLQDFTGFDDS

SEQ ID NO: 133086 - protein, 28 aa, Artificial Sequence
  Description of Artificial Sequence: Synthetic peptide
QESEIASTNPVGTEGYGNMASTLQHGQI

SEQ ID NO: 133087 - protein, 36 aa, Artificial Sequence
  Description of Artificial Sequence: Synthetic polypeptide
DEGEIRTTNPVATEQYGCCSVTTVNLQDFTEFNDDG

SEQ ID NO: 133088 - protein, 28 aa, Artificial Sequence
  Description of Artificial Sequence: Synthetic peptide
QESEIASTNPVGTEGYGNVASTIQHGDI

SEQ ID NO: 133089 - protein, 29 aa, Artificial Sequence
  Description of Artificial Sequence: Synthetic peptide
QESEIASTNPVGTEGYGNVMASTLQHGDI

SEQ ID NO: 133090 - protein, 28 aa, Artificial Sequence
  Description of Artificial Sequence: Synthetic peptide
QESEIASTNPVGTEGYGQMASTLQHGDI

SEQ ID NO: 133091 - protein, 29 aa, Artificial Sequence
  Description of Artificial Sequence: Synthetic peptide
QESEIASTNPVGTEGYGQVMASTLQHGDI

SEQ ID NO: 133092 - protein, 29 aa, Artificial Sequence
  Description of Artificial Sequence: Synthetic peptide
QESEIASTNPVGTEGYGQVMASTLQHGDV

SEQ ID NO: 133093 - protein, 33 aa, Artificial Sequence
  Description of Artificial Sequence: Synthetic polypeptide
DEGEIRTTNPVATEQWGKVSYTEESTNAAEGDD

SEQ ID NO: 133094 - protein, 28 aa, Artificial Sequence
  Description of Artificial Sequence: Synthetic peptide
QESEIASTNPVGTEGYGRMASTLQHGDI

SEQ ID NO: 133095 - protein, 29 aa, Artificial Sequence
  Description of Artificial Sequence: Synthetic peptide
QESEIASTNPVGTEGYGRVMASTLQHGDH

SEQ ID NO: 133096 - protein, 37 aa, Artificial Sequence
  Description of Artificial Sequence: Synthetic polypeptide
DEEEIRTTNPVATEQYGVVSVTTTNQQQGNQAGTEDE

SEQ ID NO: 133097 - protein, 34 aa, Artificial Sequence
  Description of Artificial Sequence: Synthetic polypeptide
DEGEIRTTNPVATEQWGHCNVSATNHLQHDPPGF

SEQ ID NO: 133098 - protein, 30 aa, Artificial Sequence
  Description of Artificial Sequence: Synthetic polypeptide
DEGEIRTTNPVATEQWGDVSLIEMNAAEDA

SEQ ID NO: 133099 - protein, 29 aa, Artificial Sequence
  Description of Artificial Sequence: Synthetic peptide
QESEIASTNPVGTEGYGTMASTLQHGDIR

SEQ ID NO: 133100 - protein, 30 aa, Artificial Sequence
  Description of Artificial Sequence: Synthetic polypeptide
QESEIASTNPVGTEGYGVMASDTNLQHGDI

SEQ ID NO: 133101 - protein, 29 aa, Artificial Sequence
  Description of Artificial Sequence: Synthetic peptide
QESEIASTNPVGTEGYGTMASTLQQHGNH

SEQ ID NO: 133102 - protein, 29 aa, Artificial Sequence
  Description of Artificial Sequence: Synthetic peptide
QESEIASTNPVGTEGYGTVMASTLQHGDI

SEQ ID NO: 133103 - protein, 28 aa, Artificial Sequence
  Description of Artificial Sequence: Synthetic peptide
QESEIASTNPVGTEGYGVLASTLQHGDI

SEQ ID NO: 133104 - protein, 30 aa, Artificial Sequence
  Description of Artificial Sequence: Synthetic polypeptide
DEGEIRPTNPCSSEPYGTISCENLQQQGNH

SEQ ID NO: 133105 - protein, 28 aa, Artificial Sequence
  Description of Artificial Sequence: Synthetic peptide
QESEIASTNPVGTEGYGVLASTLQMGDI

SEQ ID NO: 133106 - protein, 38 aa, Artificial Sequence
  Description of Artificial Sequence: Synthetic polypeptide
DEEEIRTTNPVATEQYGVVSVTVVTNLQAGNNDEDEDD

SEQ ID NO: 133107 - protein, 34 aa, Artificial Sequence
  Description of Artificial Sequence: Synthetic polypeptide
DEGEIRCTNPVATEQYGSVYTPDEDLNRFENMQE

SEQ ID NO: 133108 - protein, 38 aa, Artificial Sequence
  Description of Artificial Sequence: Synthetic polypeptide
DEEEIRTTNPVATEQYGVVSVTVVTNLQAGNQEEDEEE

SEQ ID NO: 133109 - protein, 34 aa, Artificial Sequence
  Description of Artificial Sequence: Synthetic polypeptide
DEGEIRATNPVATEPYGSVCIVNDQHDRQGSGSR

SEQ ID NO: 133110 - protein, 28 aa, Artificial Sequence
  Description of Artificial Sequence: Synthetic peptide
QESEIASTNPVGTEGYGVMACTLQHGNI

SEQ ID NO: 133111 - protein, 28 aa, Artificial Sequence
  Description of Artificial Sequence: Synthetic peptide
QESEIASTNPVGTEGYGVMACTLQHGTR

SEQ ID NO: 133112 - protein, 32 aa, Artificial Sequence
  Description of Artificial Sequence: Synthetic polypeptide
DEGEIRPTNPCSTEQYGIVSTTNLNMSGMTPV

SEQ ID NO: 133113 - protein, 28 aa, Artificial Sequence
  Description of Artificial Sequence: Synthetic peptide
QESEIASTNPVGTEGYGVMAENLQHGDI

SEQ ID NO: 133114 - protein, 38 aa, Artificial Sequence
  Description of Artificial Sequence: Synthetic polypeptide
DEEEIRTTNPVATEQYGVVSVTVVTNLQAGNTEQGIAE

SEQ ID NO: 133115 - protein, 28 aa, Artificial Sequence
  Description of Artificial Sequence: Synthetic peptide
QESEIASTNPVGTEGYGVMANTIQHGQR

SEQ ID NO: 133116 - protein, 28 aa, Artificial Sequence
  Description of Artificial Sequence: Synthetic peptide
QESEIASTNPVGTEGYGVMANTLQHGDI

SEQ ID NO: 133117 - protein, 28 aa, Artificial Sequence
  Description of Artificial Sequence: Synthetic peptide
QESEIASTNPVGTEGYGVMANTLQHGDP

SEQ ID NO: 133118 - protein, 37 aa, Artificial Sequence
  Description of Artificial Sequence: Synthetic polypeptide
DEEEIRTTNPVATEQYGSGVSSTTPAGPNTRNGMNPV

SEQ ID NO: 133119 - protein, 38 aa, Artificial Sequence
  Description of Artificial Sequence: Synthetic polypeptide
DEEEIRTTNPVATEQYGVVSVTVVTNLQQGNNEEDEDE

SEQ ID NO: 133120 - protein, 38 aa, Artificial Sequence
  Description of Artificial Sequence: Synthetic polypeptide
DEEEIRTTNPVATEQYGVVSVTVVTNLQQGTEQGSTNQ

SEQ ID NO: 133121 - protein, 28 aa, Artificial Sequence
  Description of Artificial Sequence: Synthetic peptide
QESEIASTNPVGTEGYGVMASALQRGDI

SEQ ID NO: 133122 - protein, 37 aa, Artificial Sequence
  Description of Artificial Sequence: Synthetic polypeptide
DEEEIRTTNPVATEQYGVVSVTVVTNLQQGTTEETTE

SEQ ID NO: 133123 - protein, 28 aa, Artificial Sequence
  Description of Artificial Sequence: Synthetic peptide
QESEIASTNPVGTEGYGVMAETLQHGDR

SEQ ID NO: 133124 - protein, 39 aa, Artificial Sequence
  Description of Artificial Sequence: Synthetic polypeptide
DEEEIRTTNPVATEQYGVVSVTVVSTNLQQGNNEEEEDE

SEQ ID NO: 133125 - protein, 28 aa, Artificial Sequence
  Description of Artificial Sequence: Synthetic peptide
QESEIASTNPVGTEGYGVIASTLQQGDI

SEQ ID NO: 133126 - protein, 37 aa, Artificial Sequence
  Description of Artificial Sequence: Synthetic polypeptide
DEEEIRTTNPVATEQYGSGVSSTTPWGPNMRNGMNPV

SEQ ID NO: 133127 - protein, 32 aa, Artificial Sequence
  Description of Artificial Sequence: Synthetic polypeptide
DEGEIRTTNPIATECWGSCSKNEDNDQGGGNS

SEQ ID NO: 133128 - protein, 28 aa, Artificial Sequence
  Description of Artificial Sequence: Synthetic peptide
QESEIASTNPVGTEGYGVAAETLQHGDR

SEQ ID NO: 133129 - protein, 28 aa, Artificial Sequence
  Description of Artificial Sequence: Synthetic peptide
QESEIASTNPVGTEGYGVAASTLQGGDI

SEQ ID NO: 133130 - protein, 28 aa, Artificial Sequence
  Description of Artificial Sequence: Synthetic peptide
QESEIASTNPVGTEGYGVAASTLQHGDI

SEQ ID NO: 133131 - protein, 33 aa, Artificial Sequence
  Description of Artificial Sequence: Synthetic polypeptide
DEGEIRTTNPCSTEQYGIVSTTNLNMSNGMTPV

SEQ ID NO: 133132 - protein, 28 aa, Artificial Sequence
  Description of Artificial Sequence: Synthetic peptide
QESEIASTNPVGTEGYGVATSTLQHGDH

SEQ ID NO: 133133 - protein, 29 aa, Artificial Sequence
  Description of Artificial Sequence: Synthetic peptide
DEGEIRTTNPCSTEQWGIVSEILMSAETA

SEQ ID NO: 133134 - protein, 38 aa, Artificial Sequence
  Description of Artificial Sequence: Synthetic polypeptide
DEEEIRTTNPVATEQYGVVSVTVTTNLQQGNNQQDEDE

SEQ ID NO: 133135 - protein, 28 aa, Artificial Sequence
  Description of Artificial Sequence: Synthetic peptide
QESEIASTNPVGTEGYGVCASTLQHGDI

SEQ ID NO: 133136 - protein, 29 aa, Artificial Sequence
  Description of Artificial Sequence: Synthetic peptide
DEGEIRTTNPCSSEPYGIISMDIQSNGNH

SEQ ID NO: 133137 - protein, 28 aa, Artificial Sequence
  Description of Artificial Sequence: Synthetic peptide
QESEIASTNPVGTEGYGVCASTLQHGSI

SEQ ID NO: 133138 - protein, 28 aa, Artificial Sequence
  Description of Artificial Sequence: Synthetic peptide
QESEIASTNPVGTEGYGVCYSTLQHGDI

SEQ ID NO: 133139 - protein, 28 aa, Artificial Sequence
  Description of Artificial Sequence: Synthetic peptide
QESEIASTNPVGTEGYGVEASTLQHGDI

SEQ ID NO: 133140 - protein, 28 aa, Artificial Sequence
  Description of Artificial Sequence: Synthetic peptide
QESEIASTNPVGTEGYGVFASTLQHGDI

SEQ ID NO: 133141 - protein, 28 aa, Artificial Sequence
  Description of Artificial Sequence: Synthetic peptide
QESEIASTNPVGTEGYGVGASTLQHGDI

SEQ ID NO: 133142 - protein, 28 aa, Artificial Sequence
  Description of Artificial Sequence: Synthetic peptide
QESEIASTNPVGTEGYGVGASTLQHGDY

SEQ ID NO: 133143 - protein, 28 aa, Artificial Sequence
  Description of Artificial Sequence: Synthetic peptide
QESEIASTNPVGTEGYGVHASTLQHGDI

SEQ ID NO: 133144 - protein, 35 aa, Artificial Sequence
  Description of Artificial Sequence: Synthetic polypeptide
DDEEIRTTNPVATEFYGSVSTGMGQQTEEGGNNEG

SEQ ID NO: 133145 - protein, 32 aa, Artificial Sequence
  Description of Artificial Sequence: Synthetic polypeptide
DEGEIRPTNPVSTEPYGTVSCENIQQQSNGNH

SEQ ID NO: 133146 - protein, 28 aa, Artificial Sequence
  Description of Artificial Sequence: Synthetic peptide
QESEIASTNPVGTEGYGVIASTLQHGDI

SEQ ID NO: 133147 - protein, 36 aa, Artificial Sequence
  Description of Artificial Sequence: Synthetic polypeptide
DDEEIRTTNPVATEFYGSVSTPGDLEQIEEGGNEEG

SEQ ID NO: 133148 - protein, 29 aa, Artificial Sequence
  Description of Artificial Sequence: Synthetic peptide
QESEIASTNPVGTEGYGTVATTLEFEGNI

SEQ ID NO: 133149 - protein, 29 aa, Artificial Sequence
  Description of Artificial Sequence: Synthetic peptide
QESEIASTNPVGTEGYGKVMASTLQHGDS

SEQ ID NO: 133150 - protein, 28 aa, Artificial Sequence
  Description of Artificial Sequence: Synthetic peptide
QESEIASTNPVGTEGYGVMASTLQHGDG

SEQ ID NO: 133151 - protein, 38 aa, Artificial Sequence
  Description of Artificial Sequence: Synthetic polypeptide
DEEEIRTTNPVATEQYGVVSVVVTTNLQQLQQGTNSTD

SEQ ID NO: 133152 - protein, 37 aa, Artificial Sequence
  Description of Artificial Sequence: Synthetic polypeptide
DEEEIRTTNPVATEQYGVVTVVVTENLLQQGIGNNTE

SEQ ID NO: 133153 - protein, 37 aa, Artificial Sequence
  Description of Artificial Sequence: Synthetic polypeptide
DEEEIRTTNPVATEQYGVVTVVVTENNLQLGIGNQTD

SEQ ID NO: 133154 - protein, 35 aa, Artificial Sequence
  Description of Artificial Sequence: Synthetic polypeptide
DEGEIATTNPVATEQYGSVAITNLPTANPGENTED

SEQ ID NO: 133155 - protein, 37 aa, Artificial Sequence
  Description of Artificial Sequence: Synthetic polypeptide
DEEEIRTTNPVATEQYGVVTVVVTNLQLQGQGNNEEA

SEQ ID NO: 133156 - protein, 33 aa, Artificial Sequence
  Description of Artificial Sequence: Synthetic polypeptide
DEGEIATTNPVATEQYGSVAAGNLEANASNNDS

SEQ ID NO: 133157 - protein, 28 aa, Artificial Sequence
  Description of Artificial Sequence: Synthetic peptide
QESEIASTNPVGTEGYGVMCSTLQHGDI

SEQ ID NO: 133158 - protein, 35 aa, Artificial Sequence
  Description of Artificial Sequence: Synthetic polypeptide
DEGEIATTNPVATEQYGSTCAMTNHLEATRDGDRM

SEQ ID NO: 133159 - protein, 34 aa, Artificial Sequence
  Description of Artificial Sequence: Synthetic polypeptide
DEGEIATTNPVATEQYGSTCAMNNHLEARDPDNR

SEQ ID NO: 133160 - protein, 28 aa, Artificial Sequence
  Description of Artificial Sequence: Synthetic peptide
QESEIASTNPVGTEGYGVMDSTLQHGDI

SEQ ID NO: 133161 - protein, 30 aa, Artificial Sequence
  Description of Artificial Sequence: Synthetic polypeptide
QESEIASTNPVGTEGYGVMAVSTRLQHGDI

SEQ ID NO: 133162 - protein, 28 aa, Artificial Sequence
  Description of Artificial Sequence: Synthetic peptide
QESEIASTNPVGTEGYGVMFSTLQHGDI

SEQ ID NO: 133163 - protein, 28 aa, Artificial Sequence
  Description of Artificial Sequence: Synthetic peptide
QESEIASTNPVGTEGYGVMGSTLQHGDI

SEQ ID NO: 133164 - protein, 28 aa, Artificial Sequence
  Description of Artificial Sequence: Synthetic peptide
QESEIASTNPVGTEGYGVMHSTNQHGDI

SEQ ID NO: 133165 - protein, 28 aa, Artificial Sequence
  Description of Artificial Sequence: Synthetic peptide
QESEIASTNPVGTEGYGVMMSTLQHGDI

SEQ ID NO: 133166 - protein, 28 aa, Artificial Sequence
  Description of Artificial Sequence: Synthetic peptide
QESEIASTNPVGTEGYGVMMSTLQHGDV

SEQ ID NO: 133167 - protein, 28 aa, Artificial Sequence
  Description of Artificial Sequence: Synthetic peptide
QESEIASTNPVGTEGYGVMNSTLQHGDI

SEQ ID NO: 133168 - protein, 37 aa, Artificial Sequence
  Description of Artificial Sequence: Synthetic polypeptide
DEEEIRTTNPVATEQYGVVTVVVTNLQNQLGGNDEEQ

SEQ ID NO: 133169 - protein, 28 aa, Artificial Sequence
  Description of Artificial Sequence: Synthetic peptide
QESEIASTNPVGTEGYGVMPSTLQHGDI

SEQ ID NO: 133170 - protein, 28 aa, Artificial Sequence
  Description of Artificial Sequence: Synthetic peptide
QESEIASTNPVGTEGYGVMQSTLQHGDI

SEQ ID NO: 133171 - protein, 29 aa, Artificial Sequence
  Description of Artificial Sequence: Synthetic peptide
QESEIASTNPVGTEGYGVMSASTLNRGDI

SEQ ID NO: 133172 - protein, 29 aa, Artificial Sequence
  Description of Artificial Sequence: Synthetic peptide
QESEIASTNPVGTEGYGVMGSTDLQHGDI

SEQ ID NO: 133173 - protein, 29 aa, Artificial Sequence
  Description of Artificial Sequence: Synthetic peptide
QESEIASTNPVGTEGYGVMAVSTLQHGDI

SEQ ID NO: 133174 - protein, 29 aa, Artificial Sequence
  Description of Artificial Sequence: Synthetic peptide
QESEIASTNPVGTEGYGVMAVSTLQHGDA

SEQ ID NO: 133175 - protein, 37 aa, Artificial Sequence
  Description of Artificial Sequence: Synthetic polypeptide
DEEEIRTTNPVATEQYGVVTVVTNNNLQQGEDEGNNN

SEQ ID NO: 133176 - protein, 29 aa, Artificial Sequence
  Description of Artificial Sequence: Synthetic peptide
QESEIASTNPVGTEGYGVMASTPLQHGDI

SEQ ID NO: 133177 - protein, 35 aa, Artificial Sequence
  Description of Artificial Sequence: Synthetic polypeptide
DEGEIATTNPVATEQYGSVCAAMHLQAMGPENDRH

SEQ ID NO: 133178 - protein, 29 aa, Artificial Sequence
  Description of Artificial Sequence: Synthetic peptide
QESEIASTNPVGTEGYGVMASTQLQHGDI

SEQ ID NO: 133179 - protein, 33 aa, Artificial Sequence
  Description of Artificial Sequence: Synthetic polypeptide
DEGEIATTNPVATEQYGSVCAAMHGQDSDGNNE

SEQ ID NO: 133180 - protein, 29 aa, Artificial Sequence
  Description of Artificial Sequence: Synthetic peptide
QESEIASTNPVGTEGYGVMASTQLQIGDI

SEQ ID NO: 133181 - protein, 29 aa, Artificial Sequence
  Description of Artificial Sequence: Synthetic peptide
QESEIASTNPVGTEGYGVMASTRLQHGDI

SEQ ID NO: 133182 - protein, 29 aa, Artificial Sequence
  Description of Artificial Sequence: Synthetic peptide
QESEIASTNPVGTEGYGVMASTSLQHGDI

SEQ ID NO: 133183 - protein, 29 aa, Artificial Sequence
  Description of Artificial Sequence: Synthetic peptide
QESEIASTNPVGTEGYGVMASTTLQHGDI

SEQ ID NO: 133184 - protein, 33 aa, Artificial Sequence
  Description of Artificial Sequence: Synthetic polypeptide
DDEEIRTTNPVATEQWGCVTSTEEDQNFGSDAA

SEQ ID NO: 133185 - protein, 29 aa, Artificial Sequence
  Description of Artificial Sequence: Synthetic peptide
QESEIASTNPVGTEGYGVMASTVLQHGDI

SEQ ID NO: 133186 - protein, 29 aa, Artificial Sequence
  Description of Artificial Sequence: Synthetic peptide
QESEIASTNPVGTEGYGVMASTWLQHGDI

SEQ ID NO: 133187 - protein, 29 aa, Artificial Sequence
  Description of Artificial Sequence: Synthetic peptide
QESEIASTNPVGTEGYGVMASTYLQHGDI

SEQ ID NO: 133188 - protein, 32 aa, Artificial Sequence
  Description of Artificial Sequence: Synthetic polypeptide
DEAEIATTNPVATEQYGSVANPSDPAEANPER

SEQ ID NO: 133189 - protein, 33 aa, Artificial Sequence
  Description of Artificial Sequence: Synthetic polypeptide
DDEEIRTTNPVATEQWGCVTSWELQENFGSEAA

SEQ ID NO: 133190 - protein, 33 aa, Artificial Sequence
  Description of Artificial Sequence: Synthetic polypeptide
DDEEIRTTNPVATEQWGCVTSWGELQNFGSDAM

SEQ ID NO: 133191 - protein, 34 aa, Artificial Sequence
  Description of Artificial Sequence: Synthetic polypeptide
DDEEIRTTNPVATEQWGFVVTSGLRLQREGQGDQ

SEQ ID NO: 133192 - protein, 28 aa, Artificial Sequence
  Description of Artificial Sequence: Synthetic peptide
QESEIASTNPVGTEGYGVMATTLQFGDI

SEQ ID NO: 133193 - protein, 28 aa, Artificial Sequence
  Description of Artificial Sequence: Synthetic peptide
QESEIASTNPVGTEGYGVMATTLQHGDI

SEQ ID NO: 133194 - protein, 28 aa, Artificial Sequence
  Description of Artificial Sequence: Synthetic peptide
QESEIASTNPVGTEGYGVMATTLQHGDL

SEQ ID NO: 133195 - protein, 28 aa, Artificial Sequence
  Description of Artificial Sequence: Synthetic peptide
QESEIASTNPVGTEGYGVMATTLQHGEI

SEQ ID NO: 133196 - protein, 38 aa, Artificial Sequence
  Description of Artificial Sequence: Synthetic polypeptide
DEEEIRTTNPVATEQYGVVTVSVTTNLLQAGIGTNDTE

SEQ ID NO: 133197 - protein, 29 aa, Artificial Sequence
  Description of Artificial Sequence: Synthetic peptide
QESEIASTNPVGTEGYGVMSASTLQHGDI

SEQ ID NO: 133198 - protein, 28 aa, Artificial Sequence
  Description of Artificial Sequence: Synthetic peptide
QESEIASTNPVGTEGYGVMASTNQTGDI

SEQ ID NO: 133199 - protein, 29 aa, Artificial Sequence
  Description of Artificial Sequence: Synthetic peptide
QESEIASTNPVGTEGYGVMSATTLQHGEI

SEQ ID NO: 133200 - protein, 35 aa, Artificial Sequence
  Description of Artificial Sequence: Synthetic polypeptide
DDEEIRTTNPVATEQWGSVVNSGLRLQREGQGDQG

SEQ ID NO: 133201 - protein, 33 aa, Artificial Sequence
  Description of Artificial Sequence: Synthetic polypeptide
DEGEIATTNPVATEQYGCVADTWLEQNNSQNNH

SEQ ID NO: 133202 - protein, 29 aa, Artificial Sequence
  Description of Artificial Sequence: Synthetic peptide
QESEIASTNPVGTEGYGVRASTELQHGDI

SEQ ID NO: 133203 - protein, 28 aa, Artificial Sequence
  Description of Artificial Sequence: Synthetic peptide
QESEIASTNPVGTEGYGVRASTLQHGDI

SEQ ID NO: 133204 - protein, 33 aa, Artificial Sequence
  Description of Artificial Sequence: Synthetic polypeptide
DEGEIATTNPVATEQYGCVAATNLTENPGGQQV

SEQ ID NO: 133205 - protein, 28 aa, Artificial Sequence
  Description of Artificial Sequence: Synthetic peptide
QESEIASTNPVGTEGYGVSASALQHGDA

SEQ ID NO: 133206 - protein, 29 aa, Artificial Sequence
  Description of Artificial Sequence: Synthetic peptide
QESEIASTNPVGTEGYGVSASHTLQHGDI

SEQ ID NO: 133207 - protein, 29 aa, Artificial Sequence
  Description of Artificial Sequence: Synthetic peptide
QESEIASTNPVGTEGYGVSASTLQHGRDI

SEQ ID NO: 133208 - protein, 29 aa, Artificial Sequence
  Description of Artificial Sequence: Synthetic peptide
QESEIASTNPVGTEGYGVSASTLQWHGDI

SEQ ID NO: 133209 - protein, 29 aa, Artificial Sequence
  Description of Artificial Sequence: Synthetic peptide
QESEIASTNPVGTEGYGVSMASTLQHGDI

SEQ ID NO: 133210 - protein, 28 aa, Artificial Sequence
  Description of Artificial Sequence: Synthetic peptide
QESEIASTNPVGTEGYGVQASTLQHGDI

SEQ ID NO: 133211 - protein, 33 aa, Artificial Sequence
  Description of Artificial Sequence: Synthetic polypeptide
DEGEIATTNPVATEQYGCVAATNLAPSNEGEMW

SEQ ID NO: 133212 - protein, 29 aa, Artificial Sequence
  Description of Artificial Sequence: Synthetic peptide
QESEIASTNPVGTEGYGVSMASTLQHGMI

SEQ ID NO: 133213 - protein, 33 aa, Artificial Sequence
  Description of Artificial Sequence: Synthetic polypeptide
DEGEIATTNPVATEQYGCVAATNLAPPNENVMW

SEQ ID NO: 133214 - protein, 33 aa, Artificial Sequence
  Description of Artificial Sequence: Synthetic polypeptide
DEGEIATTNPVATEQYGCVAATNLAPPAEEGRN

SEQ ID NO: 133215 - protein, 34 aa, Artificial Sequence
  Description of Artificial Sequence: Synthetic polypeptide
DEGEIATTNPVATEQYGCVAATNLADTGGGNDHI

SEQ ID NO: 133216 - protein, 29 aa, Artificial Sequence
  Description of Artificial Sequence: Synthetic peptide
QESEIASTNPVGTEGYGVSMMSTLQHGDI

SEQ ID NO: 133217 - protein, 28 aa, Artificial Sequence
  Description of Artificial Sequence: Synthetic peptide
QESEIASTNPVGTEGYGVTASTLQHGDI

SEQ ID NO: 133218 - protein, 34 aa, Artificial Sequence
  Description of Artificial Sequence: Synthetic polypeptide
DEGEIATTNPVATEQYGCVAATNLADASGPGSRP

SEQ ID NO: 133219 - protein, 33 aa, Artificial Sequence
  Description of Artificial Sequence: Synthetic polypeptide
DEGEIATTNPVATEQYGCVAATNETDPGENTNN

SEQ ID NO: 133220 - protein, 29 aa, Artificial Sequence
  Description of Artificial Sequence: Synthetic peptide
QESEIASTNPVGTEGYGVTSASTLQHGDI

SEQ ID NO: 133221 - protein, 33 aa, Artificial Sequence
  Description of Artificial Sequence: Synthetic polypeptide
DEGEIATTNPVATEQYGCVAATNLAPPPEEGTP

SEQ ID NO: 133222 - protein, 34 aa, Artificial Sequence
  Description of Artificial Sequence: Synthetic polypeptide
DEGEIATTNPVATEQYGCVAGTGQLQNRMGGSLD

SEQ ID NO: 133223 - protein, 28 aa, Artificial Sequence
  Description of Artificial Sequence: Synthetic peptide
QESEIASTNPVGTEGYGVNASTLQHGDI

SEQ ID NO: 133224 - protein, 29 aa, Artificial Sequence
  Description of Artificial Sequence: Synthetic peptide
QESEIASTNPVGTEGYGVNASTELQHGDI

SEQ ID NO: 133225 - protein, 37 aa, Artificial Sequence
  Description of Artificial Sequence: Synthetic polypeptide
DEEEIRTTNPVATEQYGVVTVVVTNNNLQLGIGENTD

SEQ ID NO: 133226 - protein, 28 aa, Artificial Sequence
  Description of Artificial Sequence: Synthetic peptide
QESEIASTNPVGTEGYGVMSETLQHGDI

SEQ ID NO: 133227 - protein, 28 aa, Artificial Sequence
  Description of Artificial Sequence: Synthetic peptide
QESEIASTNPVGTEGYGVMSMTLQHGDI

SEQ ID NO: 133228 - protein, 28 aa, Artificial Sequence
  Description of Artificial Sequence: Synthetic peptide
QESEIASTNPVGTEGYGVMSSTLQHGDI

SEQ ID NO: 133229 - protein, 28 aa, Artificial Sequence
  Description of Artificial Sequence: Synthetic peptide
QESEIASTNPVGTEGYGVMSSTLQHGDP

SEQ ID NO: 133230 - protein, 28 aa, Artificial Sequence
  Description of Artificial Sequence: Synthetic peptide
QESEIASTNPVGTEGYGVMSSTLQHGDQ

SEQ ID NO: 133231 - protein, 34 aa, Artificial Sequence
  Description of Artificial Sequence: Synthetic polypeptide
DEGEIATTNPVATEQYGCVATNLTQPDDQDNSDM

SEQ ID NO: 133232 - protein, 28 aa, Artificial Sequence
  Description of Artificial Sequence: Synthetic peptide
QESEIASTNPVGTEGYGVMSSTLQHGEI

SEQ ID NO: 133233 - protein, 28 aa, Artificial Sequence
  Description of Artificial Sequence: Synthetic peptide
QESEIASTNPVGTEGYGVMSSTLQSGTI

SEQ ID NO: 133234 - protein, 35 aa, Artificial Sequence
  Description of Artificial Sequence: Synthetic polypeptide
DDEEIRTTNPVATEQWGSVVTQGLRLQREGQTEQE

SEQ ID NO: 133235 - protein, 29 aa, Artificial Sequence
  Description of Artificial Sequence: Synthetic peptide
QESEIASTNPVGTEGYGVMSTSTLQHGDI

SEQ ID NO: 133236 - protein, 29 aa, Artificial Sequence
  Description of Artificial Sequence: Synthetic peptide
QESEIASTNPVGTEGYGVMSTTLQHEGDI

SEQ ID NO: 133237 - protein, 34 aa, Artificial Sequence
  Description of Artificial Sequence: Synthetic polypeptide
DEEEIRTTNPVATEQYGVVVEMGDNGQGEGQEDT

SEQ ID NO: 133238 - protein, 36 aa, Artificial Sequence
  Description of Artificial Sequence: Synthetic polypeptide
DEEEIRTTNPVATEQYGVVVGDEMGNLGQNEGGNIE

SEQ ID NO: 133239 - protein, 28 aa, Artificial Sequence
  Description of Artificial Sequence: Synthetic peptide
QESEIASTNPVGTEGYGVMTSTLQHGDI

SEQ ID NO: 133240 - protein, 29 aa, Artificial Sequence
  Description of Artificial Sequence: Synthetic peptide
QESEIASTNPVGTEGYGVMVASTLQHGDI

SEQ ID NO: 133241 - protein, 28 aa, Artificial Sequence
  Description of Artificial Sequence: Synthetic peptide
QESEIASTNPVGTEGYGVMVSTLDHGDI

SEQ ID NO: 133242 - protein, 28 aa, Artificial Sequence
  Description of Artificial Sequence: Synthetic peptide
QESEIASTNPVGTEGYGVMWSTLQHGDI

SEQ ID NO: 133243 - protein, 36 aa, Artificial Sequence
  Description of Artificial Sequence: Synthetic polypeptide
DEEEIRTTNPVATEQYGVVVGSGQNDEGQNNEGNND

SEQ ID NO: 133244 - protein, 28 aa, Artificial Sequence
  Description of Artificial Sequence: Synthetic peptide
QESEIASTNPVGTEGYGVMYSTLQHGDI

SEQ ID NO: 133245 - protein, 34 aa, Artificial Sequence
  Description of Artificial Sequence: Synthetic polypeptide
DEEEIRTTNPVATEQYGVVVMTNGIEEDTGQGEF

SEQ ID NO: 133246 - protein, 28 aa, Artificial Sequence
  Description of Artificial Sequence: Synthetic peptide
QESEIASTNPVGTEGYGVMSCTLQSGTI

SEQ ID NO: 133247 - protein, 28 aa, Artificial Sequence
  Description of Artificial Sequence: Synthetic peptide
QESEIASTNPVGTEGYGVMASTLQHGDH

SEQ ID NO: 133248 - protein, 35 aa, Artificial Sequence
  Description of Artificial Sequence: Synthetic polypeptide
DEGEIATTNPVATEQYGSVCAAMTHGQDSDGNDRQ

SEQ ID NO: 133249 - protein, 34 aa, Artificial Sequence
  Description of Artificial Sequence: Synthetic polypeptide
DEEEIRTTNPVATEQYGSGSPMNMVVTNNVENLL

SEQ ID NO: 133250 - protein, 32 aa, Artificial Sequence
  Description of Artificial Sequence: Synthetic polypeptide
DEGEIATTNPVATESYGCNVANNNLQDAGTSN

SEQ ID NO: 133251 - protein, 28 aa, Artificial Sequence
  Description of Artificial Sequence: Synthetic peptide
QESEIASTNPVGTEGYGVMASTLQHGHI

SEQ ID NO: 133252 - protein, 33 aa, Artificial Sequence
  Description of Artificial Sequence: Synthetic polypeptide
DEGEIATTNPVATEQYGTVCSATMGGVEDEGND

SEQ ID NO: 133253 - protein, 28 aa, Artificial Sequence
  Description of Artificial Sequence: Synthetic peptide
QESEIASTNPVGTEGYGVMASTLQHGII

SEQ ID NO: 133254 - protein, 28 aa, Artificial Sequence
  Description of Artificial Sequence: Synthetic peptide
QESEIASTNPVGTEGYGVMASTLQHGKI

SEQ ID NO: 133255 - protein, 37 aa, Artificial Sequence
  Description of Artificial Sequence: Synthetic polypeptide
DEEEIRTTNPVATEQYGVVSVVVVNLNQAGNNDEQQD

SEQ ID NO: 133256 - protein, 28 aa, Artificial Sequence
  Description of Artificial Sequence: Synthetic peptide
QESEIASTNPVGTEGYGVMASTLQHGLI

SEQ ID NO: 133257 - protein, 28 aa, Artificial Sequence
  Description of Artificial Sequence: Synthetic peptide
QESEIASTNPVGTEGYGVMASTLQHGMI

SEQ ID NO: 133258 - protein, 29 aa, Artificial Sequence
  Description of Artificial Sequence: Synthetic peptide
QESEIASTNPVGTEGYGVMASTLQHGNDI

SEQ ID NO: 133259 - protein, 31 aa, Artificial Sequence
  Description of Artificial Sequence: Synthetic polypeptide
DEGEIATTNPVATESYGCVANNNLNTDAGGH

SEQ ID NO: 133260 - protein, 36 aa, Artificial Sequence
  Description of Artificial Sequence: Synthetic polypeptide
DEEEIRATNPVATEQYGCNVAITNHVDEQAGMGNRN

SEQ ID NO: 133261 - protein, 28 aa, Artificial Sequence
  Description of Artificial Sequence: Synthetic peptide
QESEIASTNPVGTEGYGVMASTLQHGPI

SEQ ID NO: 133262 - protein, 28 aa, Artificial Sequence
  Description of Artificial Sequence: Synthetic peptide
QESEIASTNPVGTEGYGVMASTLQHGQI

SEQ ID NO: 133263 - protein, 28 aa, Artificial Sequence
  Description of Artificial Sequence: Synthetic peptide
QESEIASTNPVGTEGYGVMASTLQHGRI

SEQ ID NO: 133264 - protein, 28 aa, Artificial Sequence
  Description of Artificial Sequence: Synthetic peptide
QESEIASTNPVGTEGYGVMASTLQHGSI

SEQ ID NO: 133265 - protein, 28 aa, Artificial Sequence
  Description of Artificial Sequence: Synthetic peptide
QESEIASTNPVGTEGYGVMASTLQHGTI

SEQ ID NO: 133266 - protein, 28 aa, Artificial Sequence
  Description of Artificial Sequence: Synthetic peptide
QESEIASTNPVGTEGYGVMASTLQHGVI

SEQ ID NO: 133267 - protein, 28 aa, Artificial Sequence
  Description of Artificial Sequence: Synthetic peptide
QESEIASTNPVGTEGYGVMASTLQHGYI

SEQ ID NO: 133268 - protein, 29 aa, Artificial Sequence
  Description of Artificial Sequence: Synthetic peptide
QESEIASTNPVGTEGYGVMASTLQHGYNI

SEQ ID NO: 133269 - protein, 37 aa, Artificial Sequence
  Description of Artificial Sequence: Synthetic polypeptide
DEEEIRTTNPVATEQYGVVSVVVVTNLEQGNTTEEED

SEQ ID NO: 133270 - protein, 38 aa, Artificial Sequence
  Description of Artificial Sequence: Synthetic polypeptide
DEEEIRTTNPVATEQYGVVSVVVVNNNTNLQQGTNVAE

SEQ ID NO: 133271 - protein, 32 aa, Artificial Sequence
  Description of Artificial Sequence: Synthetic polypeptide
DEGEIATTNPVATESYGCVANNNLQDAGDGHH

SEQ ID NO: 133272 - protein, 32 aa, Artificial Sequence
  Description of Artificial Sequence: Synthetic polypeptide
DEGEIATTNPVATESYGSVAANNNLNTDGGTH

SEQ ID NO: 133273 - protein, 28 aa, Artificial Sequence
  Description of Artificial Sequence: Synthetic peptide
QESEIASTNPVGTEGYGVMASTLQHGGI

SEQ ID NO: 133274 - protein, 30 aa, Artificial Sequence
  Description of Artificial Sequence: Synthetic polypeptide
DEGEIATTNPVAYEQWGSCWTDTIREMNNS

SEQ ID NO: 133275 - protein, 32 aa, Artificial Sequence
  Description of Artificial Sequence: Synthetic polypeptide
DEGEIATTNPVAYEQWGSCWTDLIREMNNTSR

SEQ ID NO: 133276 - protein, 31 aa, Artificial Sequence
  Description of Artificial Sequence: Synthetic polypeptide
DEGEIATTNPVAYEQWGSCWTDLIREMNNNH

SEQ ID NO: 133277 - protein, 31 aa, Artificial Sequence
  Description of Artificial Sequence: Synthetic polypeptide
DEGEIATTNPVAYEQWGSCWTDDIREMNNTR

SEQ ID NO: 133278 - protein, 29 aa, Artificial Sequence
  Description of Artificial Sequence: Synthetic peptide
QESEIASTNPVGTEGYGVMASTLQHGDIR

SEQ ID NO: 133279 - protein, 28 aa, Artificial Sequence
  Description of Artificial Sequence: Synthetic peptide
QESEIASTNPVGTEGYGVMASTLQHGDK

SEQ ID NO: 133280 - protein, 28 aa, Artificial Sequence
  Description of Artificial Sequence: Synthetic peptide
QESEIASTNPVGTEGYGVMASTLQHGDL

SEQ ID NO: 133281 - protein, 28 aa, Artificial Sequence
  Description of Artificial Sequence: Synthetic peptide
QESEIASTNPVGTEGYGVMASTLQHGDM

SEQ ID NO: 133282 - protein, 28 aa, Artificial Sequence
  Description of Artificial Sequence: Synthetic peptide
QESEIASTNPVGTEGYGVMASTLQHGDN

SEQ ID NO: 133283 - protein, 29 aa, Artificial Sequence
  Description of Artificial Sequence: Synthetic peptide
QESEIASTNPVGTEGYGVMASTLQHGDNI

SEQ ID NO: 133284 - protein, 28 aa, Artificial Sequence
  Description of Artificial Sequence: Synthetic peptide
QESEIASTNPVGTEGYGVMASTLQHGDP

SEQ ID NO: 133285 - protein, 28 aa, Artificial Sequence
  Description of Artificial Sequence: Synthetic peptide
QESEIASTNPVGTEGYGVMASTLQHGDQ

SEQ ID NO: 133286 - protein, 37 aa, Artificial Sequence
  Description of Artificial Sequence: Synthetic polypeptide
DEEEIRTTNPVATEQYGSGVSSTTPAGPNMRNGMNPV

SEQ ID NO: 133287 - protein, 29 aa, Artificial Sequence
  Description of Artificial Sequence: Synthetic peptide
QESEIASTNPVGTEGYGVMASTLQHGDRI

SEQ ID NO: 133288 - protein, 28 aa, Artificial Sequence
  Description of Artificial Sequence: Synthetic peptide
QESEIASTNPVGTEGYGVMASTLQHGDS

SEQ ID NO: 133289 - protein, 28 aa, Artificial Sequence
  Description of Artificial Sequence: Synthetic peptide
QESEIASTNPVGTEGYGVMASTLQHGDT

SEQ ID NO: 133290 - protein, 28 aa, Artificial Sequence
  Description of Artificial Sequence: Synthetic peptide
QESEIASTNPVGTEGYGVMASTLQHGDV

SEQ ID NO: 133291 - protein, 28 aa, Artificial Sequence
  Description of Artificial Sequence: Synthetic peptide
QESEIASTNPVGTEGYGVMASTLQHGDW

SEQ ID NO: 133292 - protein, 28 aa, Artificial Sequence
  Description of Artificial Sequence: Synthetic peptide
QESEIASTNPVGTEGYGVMASTLQHGDY

SEQ ID NO: 133293 - protein, 28 aa, Artificial Sequence
  Description of Artificial Sequence: Synthetic peptide
QESEIASTNPVGTEGYGVMASTLQHGEI

SEQ ID NO: 133294 - protein, 28 aa, Artificial Sequence
  Description of Artificial Sequence: Synthetic peptide
QESEIASTNPVGTEGYGVMASTLQHGFI

SEQ ID NO: 133295 - protein, 35 aa, Artificial Sequence
  Description of Artificial Sequence: Synthetic polypeptide
DEGEIATTNPVATEQYGSVCSTNDQQEHQDGTAEK

SEQ ID NO: 133296 - protein, 28 aa, Artificial Sequence
  Description of Artificial Sequence: Synthetic peptide
QESEIASTNPVGTEGYGVMASTNQHGDI

SEQ ID NO: 133297 - protein, 35 aa, Artificial Sequence
  Description of Artificial Sequence: Synthetic polypeptide
DEGEIATTNPVATEQYGSVCSPTGNGHVDDGDQNN

SEQ ID NO: 133298 - protein, 33 aa, Artificial Sequence
  Description of Artificial Sequence: Synthetic polypeptide
DEGEIATTNPVATEQYGSVCATVLEAPDNQDND

SEQ ID NO: 133299 - protein, 37 aa, Artificial Sequence
  Description of Artificial Sequence: Synthetic polypeptide
DEEEIRTTNPVATEQYGSGVDSTTPAGPNMRNGMNPV

SEQ ID NO: 133300 - protein, 29 aa, Artificial Sequence
  Description of Artificial Sequence: Synthetic peptide
QESEIASTNPVGTEGYGVMASTLQRHGDI

SEQ ID NO: 133301 - protein, 29 aa, Artificial Sequence
  Description of Artificial Sequence: Synthetic peptide
QESEIASTNPVGTEGYGVMASTLQRVGQI

SEQ ID NO: 133302 - protein, 28 aa, Artificial Sequence
  Description of Artificial Sequence: Synthetic peptide
QESEIASTNPVGTEGYGVMASTLQSGDE

SEQ ID NO: 133303 - protein, 28 aa, Artificial Sequence
  Description of Artificial Sequence: Synthetic peptide
QESEIASTNPVGTEGYGVMASTLQSGDI

SEQ ID NO: 133304 - protein, 35 aa, Artificial Sequence
  Description of Artificial Sequence: Synthetic polypeptide
DEGEIATTNPVATEQYGSVCAATNNLEEETEDNRN

SEQ ID NO: 133305 - protein, 28 aa, Artificial Sequence
  Description of Artificial Sequence: Synthetic peptide
QESEIASTNPVGTEGYGVMASTLQSGDV

SEQ ID NO: 133306 - protein, 29 aa, Artificial Sequence
  Description of Artificial Sequence: Synthetic peptide
QESEIASTNPVGTEGYGVMASTLQSHGDR

SEQ ID NO: 133307 - protein, 28 aa, Artificial Sequence
  Description of Artificial Sequence: Synthetic peptide
QESEIASTNPVGTEGYGVMASTLQTGDI

SEQ ID NO: 133308 - protein, 36 aa, Artificial Sequence
  Description of Artificial Sequence: Synthetic polypeptide
DEEEIRATNPVATEQYGCNVAITNNDEQAGMGMNSR

SEQ ID NO: 133309 - protein, 28 aa, Artificial Sequence
  Description of Artificial Sequence: Synthetic peptide
QESEIASTNPVGTEGYGVMASTLQVGDI

SEQ ID NO: 133310 - protein, 33 aa, Artificial Sequence
  Description of Artificial Sequence: Synthetic polypeptide
DEGEIATTNPVATEQYGSVCAATAQLDAAEGGM

SEQ ID NO: 133311 - protein, 34 aa, Artificial Sequence
  Description of Artificial Sequence: Synthetic polypeptide
DEGEIATTNPVATEQYGSVCAATANDTDMPGENN

SEQ ID NO: 133312 - protein, 35 aa, Artificial Sequence
  Description of Artificial Sequence: Synthetic polypeptide
DEGEIATTNPVATEQYGSVCAATANDQDPPGENGN

SEQ ID NO: 133313 - protein, 28 aa, Artificial Sequence
  Description of Artificial Sequence: Synthetic peptide
QESEIASTNPVGTEGYGVMASTLQYGDI

SEQ ID NO: 133314 - protein, 34 aa, Artificial Sequence
  Description of Artificial Sequence: Synthetic polypeptide
DEGEIATTNPVATEQYGSVCAAQANDQDLPGENN

SEQ ID NO: 133315 - protein, 28 aa, Artificial Sequence
  Description of Artificial Sequence: Synthetic peptide
QESEIASTNPVGTEGYGVMASTLTHGDR

SEQ ID NO: 133316 - protein, 36 aa, Artificial Sequence
  Description of Artificial Sequence: Synthetic polypeptide
DEEEIRTTNPVATEQYGVVSVVVVTNQQAGTTEESE

SEQ ID NO: 133317 - protein, 35 aa, Artificial Sequence
  Description of Artificial Sequence: Synthetic polypeptide
DEGEIATTNPVATEQYGSVCAANNLQEADGNNDDT

SEQ ID NO: 133318 - protein, 29 aa, Artificial Sequence
  Description of Artificial Sequence: Synthetic peptide
QESEIASTNPVGTEGYGVMASTMLQHGDI

SEQ ID NO: 133319 - protein, 28 aa, Artificial Sequence
  Description of Artificial Sequence: Synthetic peptide
QESEIASTNPVGTEGYGVMASTLQWGDI

SEQ ID NO: 133320 - protein, 28 aa, Artificial Sequence
  Description of Artificial Sequence: Synthetic peptide
QESEIASTNPVGTEGYGVMASTLQQGDI

SEQ ID NO: 133321 - protein, 29 aa, Artificial Sequence
  Description of Artificial Sequence: Synthetic peptide
QESEIASTNPVGTEGYGVMASTLQPGDIR

SEQ ID NO: 133322 - protein, 28 aa, Artificial Sequence
  Description of Artificial Sequence: Synthetic peptide
QESEIASTNPVGTEGYGVMASTLQPGDI

SEQ ID NO: 133323 - protein, 34 aa, Artificial Sequence
  Description of Artificial Sequence: Synthetic polypeptide
DEGEIATTNPVATEQYGSVCATVLEAPDNQDGEM

SEQ ID NO: 133324 - protein, 35 aa, Artificial Sequence
  Description of Artificial Sequence: Synthetic polypeptide
DEGEIATTNPVATEQYGSVCATNPMQQGNQDQGTM

SEQ ID NO: 133325 - protein, 36 aa, Artificial Sequence
  Description of Artificial Sequence: Synthetic polypeptide
DEGEIATTNPVATEQYGSVCATNPMLQEHQDGNQNQ

SEQ ID NO: 133326 - protein, 35 aa, Artificial Sequence
  Description of Artificial Sequence: Synthetic polypeptide
DEGEIATTNPVATEQYGSVCATNPLQEHQDGIQHQ

SEQ ID NO: 133327 - protein, 38 aa, Artificial Sequence
  Description of Artificial Sequence: Synthetic polypeptide
DEEEIRTTNPVATEQYGVVSVVVVTNLQAGTDEDNEDE

SEQ ID NO: 133328 - protein, 35 aa, Artificial Sequence
  Description of Artificial Sequence: Synthetic polypeptide
DEGEIATTNPVATEQYGSVCATNNPMQQGNQTEGD

SEQ ID NO: 133329 - protein, 29 aa, Artificial Sequence
  Description of Artificial Sequence: Synthetic peptide
QESEIASTNPVGTEGYGVMASTLQHRGDI

SEQ ID NO: 133330 - protein, 34 aa, Artificial Sequence
  Description of Artificial Sequence: Synthetic polypeptide
DEGEIATTNPVATEQYGSVCATNNEPTGDLENDG

SEQ ID NO: 133331 - protein, 37 aa, Artificial Sequence
  Description of Artificial Sequence: Synthetic polypeptide
DEEEIRTTNPVATEQYGVVSVVVVTNLQAGTTDEEED

SEQ ID NO: 133332 - protein, 34 aa, Artificial Sequence
  Description of Artificial Sequence: Synthetic polypeptide
DEGEIATTNPVATEQYGSVCATNLTAPDNQAEGA

SEQ ID NO: 133333 - protein, 34 aa, Artificial Sequence
  Description of Artificial Sequence: Synthetic polypeptide
DDEEIRTTNPVATEQWGCVTSTEDQENFGSDNAA

SEQ ID NO: 133334 - protein, 29 aa, Artificial Sequence
  Description of Artificial Sequence: Synthetic peptide
QESEIASTNPVGTEGYGVMASTLQHVGDR

SEQ ID NO: 133335 - protein, 36 aa, Artificial Sequence
  Description of Artificial Sequence: Synthetic polypeptide
DEGEIATTNPVATEQYGSVCAMTNGELQDNPGEGRH

SEQ ID NO: 133336 - protein, 28 aa, Artificial Sequence
  Description of Artificial Sequence: Synthetic peptide
QESEIASTNPVGTEGYGVMASTLQIGDI

SEQ ID NO: 133337 - protein, 28 aa, Artificial Sequence
  Description of Artificial Sequence: Synthetic peptide
QESEIASTNPVGTEGYGVMASTLQKGDI

SEQ ID NO: 133338 - protein, 28 aa, Artificial Sequence
  Description of Artificial Sequence: Synthetic peptide
QESEIASTNPVGTEGYGVMASTLQLGDI

SEQ ID NO: 133339 - protein, 34 aa, Artificial Sequence
  Description of Artificial Sequence: Synthetic polypeptide
DEGEIATTNPVATEQYGSVCAGTNLTQPDQEEAM

SEQ ID NO: 133340 - protein, 33 aa, Artificial Sequence
  Description of Artificial Sequence: Synthetic polypeptide
DEGEIATTNPVATEQYGSVCAGTDPAPDGPNQH

SEQ ID NO: 133341 - protein, 28 aa, Artificial Sequence
  Description of Artificial Sequence: Synthetic peptide
QESEIASTNPVGTEGYGVMASTLQMGDI

SEQ ID NO: 133342 - protein, 36 aa, Artificial Sequence
  Description of Artificial Sequence: Synthetic polypeptide
DEEEIRTTNPVATEQYGVVSVVVVTNLQQETTEEED

SEQ ID NO: 133343 - protein, 28 aa, Artificial Sequence
  Description of Artificial Sequence: Synthetic peptide
QESEIASTNPVGTEGYGVMASTLQNGDI

SEQ ID NO: 133344 - protein, 38 aa, Artificial Sequence
  Description of Artificial Sequence: Synthetic polypeptide
DEEEIRTTNPVATEQYGVVSVVVVTNLQAGNTEQGQQE

SEQ ID NO: 133345 - protein, 29 aa, Artificial Sequence
  Description of Artificial Sequence: Synthetic peptide
QESEIASTNPVGTEGYGVVAASTLQHGDI

SEQ ID NO: 133346 - protein, 29 aa, Artificial Sequence
  Description of Artificial Sequence: Synthetic peptide
QESEIASTNPVGTEGYGKVMASTLQHGDI

SEQ ID NO: 133347 - protein, 29 aa, Artificial Sequence
  Description of Artificial Sequence: Synthetic peptide
QESEIASTNPVGTEGYGKMASTELQHGDI

SEQ ID NO: 133348 - protein, 32 aa, Artificial Sequence
  Description of Artificial Sequence: Synthetic polypeptide
QEQEIHTTNPVATEQYGSVSACDLEDHEGEDL

SEQ ID NO: 133349 - protein, 36 aa, Artificial Sequence
  Description of Artificial Sequence: Synthetic polypeptide
DEEEIRTTNPVATEQYGSISLTPNMDMQPNAGVVDQ

SEQ ID NO: 133350 - protein, 38 aa, Artificial Sequence
  Description of Artificial Sequence: Synthetic polypeptide
DEEEIRTTNPVATEQYGVVSTVVVSNLQQGTNEEDETE

SEQ ID NO: 133351 - protein, 29 aa, Artificial Sequence
  Description of Artificial Sequence: Synthetic peptide
QEREIACTNPCSYEQYGCVSCNLQSGEQG

SEQ ID NO: 133352 - protein, 29 aa, Artificial Sequence
  Description of Artificial Sequence: Synthetic peptide
QEREIACTNPCSYEQYGCVSWENLQSGTQ

SEQ ID NO: 133353 - protein, 29 aa, Artificial Sequence
  Description of Artificial Sequence: Synthetic peptide
QEREIACTNPCSYEQYGCVSWNLQSIGQQ

SEQ ID NO: 133354 - protein, 35 aa, Artificial Sequence
  Description of Artificial Sequence: Synthetic polypeptide
DEEEIRTTNPVATEQYGSISLTPNDAPNAGVQLQQ

SEQ ID NO: 133355 - protein, 28 aa, Artificial Sequence
  Description of Artificial Sequence: Synthetic peptide
QEREIASTNPVGTEGYGVMASTLQHGDI

SEQ ID NO: 133356 - protein, 28 aa, Artificial Sequence
  Description of Artificial Sequence: Synthetic peptide
QEREIATTNPVATEQYGEAPEVCQHEEK

SEQ ID NO: 133357 - protein, 29 aa, Artificial Sequence
  Description of Artificial Sequence: Synthetic peptide
QEQEICSTNPVCTEAYGVVNNSTLQNGDI

SEQ ID NO: 133358 - protein, 37 aa, Artificial Sequence
  Description of Artificial Sequence: Synthetic polypeptide
AEEEIRTTNPVATEQYGSVSTVVNGNNQQGNEENEED

SEQ ID NO: 133359 - protein, 38 aa, Artificial Sequence
  Description of Artificial Sequence: Synthetic polypeptide
DEEEIRTTNPVATEQYGVVSTVVVTNLQAGNEEDEDTV

SEQ ID NO: 133360 - protein, 28 aa, Artificial Sequence
  Description of Artificial Sequence: Synthetic peptide
QESDIASTNPVATEGYGVMASTLQHGDI

SEQ ID NO: 133361 - protein, 28 aa, Artificial Sequence
  Description of Artificial Sequence: Synthetic peptide
QESDIASTNPVGTEGYGVMASTLQHGDR

SEQ ID NO: 133362 - protein, 38 aa, Artificial Sequence
  Description of Artificial Sequence: Synthetic polypeptide
DEEEIRTTNPVATEQYGVVSTVVVTNLQAGNEQGTTDE

SEQ ID NO: 133363 - protein, 38 aa, Artificial Sequence
  Description of Artificial Sequence: Synthetic polypeptide
DEEEIRTTNPVATEQYGVVSTVVVTNLQAGNNDEDEDE

SEQ ID NO: 133364 - protein, 28 aa, Artificial Sequence
  Description of Artificial Sequence: Synthetic peptide
QESEIAATNPVGTEGYGVMASTLQHGDI

SEQ ID NO: 133365 - protein, 29 aa, Artificial Sequence
  Description of Artificial Sequence: Synthetic peptide
QESEIAATNPVGTEGYGVMASTLQHGDNI

SEQ ID NO: 133366 - protein, 33 aa, Artificial Sequence
  Description of Artificial Sequence: Synthetic polypeptide
DDEEIRTTNPCATEHYGCVCSWMNLQNFNSDQS

SEQ ID NO: 133367 - protein, 38 aa, Artificial Sequence
  Description of Artificial Sequence: Synthetic polypeptide
DEEEIRTTNPVATEQYGVVSTVVVTNLQAGNNQNEQTD

SEQ ID NO: 133368 - protein, 37 aa, Artificial Sequence
  Description of Artificial Sequence: Synthetic polypeptide
DEEEIRTTNPVATEQYGVVSTVVVTNLEQGNNVEEED

SEQ ID NO: 133369 - protein, 35 aa, Artificial Sequence
  Description of Artificial Sequence: Synthetic polypeptide
DEEEIRTTNPVATEQYGSISNASGIEEVQIAFVNR

SEQ ID NO: 133370 - protein, 32 aa, Artificial Sequence
  Description of Artificial Sequence: Synthetic polypeptide
QEQEIATTNPVSTEQYGSVSATDLEDSEGEDL

SEQ ID NO: 133371 - protein, 35 aa, Artificial Sequence
  Description of Artificial Sequence: Synthetic polypeptide
DEEEIRTTNPVATEQYGSISNTSLDPEQQITVEEL

SEQ ID NO: 133372 - protein, 28 aa, Artificial Sequence
  Description of Artificial Sequence: Synthetic peptide
QEQEIATTNPVAYECWGVVSECLQHEEM

SEQ ID NO: 133373 - protein, 35 aa, Artificial Sequence
  Description of Artificial Sequence: Synthetic polypeptide
DEEEIRTTNPVATEQYGSISSMPDGPNMRNGMNPV

SEQ ID NO: 133374 - protein, 36 aa, Artificial Sequence
  Description of Artificial Sequence: Synthetic polypeptide
DEGEIRTTNPVATEQYGSVSTYLDANEDEGMFNGQI

SEQ ID NO: 133375 - protein, 37 aa, Artificial Sequence
  Description of Artificial Sequence: Synthetic polypeptide
DEEEIRTTNPVATEQYGVVSTVVVNNNQQGNNNQNTE

SEQ ID NO: 133376 - protein, 37 aa, Artificial Sequence
  Description of Artificial Sequence: Synthetic polypeptide
DEEEIRTTNPVATEQYGVVSTVVVNNNQQGNNQTEDE

SEQ ID NO: 133377 - protein, 34 aa, Artificial Sequence
  Description of Artificial Sequence: Synthetic polypeptide
DEGEIRTTNPVATEQYGSVSTVPTEQANSDQEEH

SEQ ID NO: 133378 - protein, 30 aa, Artificial Sequence
  Description of Artificial Sequence: Synthetic polypeptide
QEQEIATTNPVGTEGYGVMSATTLQHGEDI

SEQ ID NO: 133379 - protein, 32 aa, Artificial Sequence
  Description of Artificial Sequence: Synthetic polypeptide
DEEEIRATNPTATECWGSCSKNEDDQGGGGNM

SEQ ID NO: 133380 - protein, 37 aa, Artificial Sequence
  Description of Artificial Sequence: Synthetic polypeptide
DEEEIRTTNPVATEQYGVVSTVVVNNQNQQGNNQQND

SEQ ID NO: 133381 - protein, 37 aa, Artificial Sequence
  Description of Artificial Sequence: Synthetic polypeptide
DEEEIRTTNPVATEQYGVVSTVVVNNQQGNQEEEEED

SEQ ID NO: 133382 - protein, 34 aa, Artificial Sequence
  Description of Artificial Sequence: Synthetic polypeptide
DEGEIRTTNPVATEQYGSVSTPNNPSIPISVQQV

SEQ ID NO: 133383 - protein, 29 aa, Artificial Sequence
  Description of Artificial Sequence: Synthetic peptide
QEQEIATTNPVGTEGYGVVSSTLEHEGEL

SEQ ID NO: 133384 - protein, 35 aa, Artificial Sequence
  Description of Artificial Sequence: Synthetic polypeptide
DEEEIRTTNPVATEQYGSISPTPLQVSVQMQEIQT

SEQ ID NO: 133385 - protein, 31 aa, Artificial Sequence
  Description of Artificial Sequence: Synthetic polypeptide
QEQEIATTNPVGTEQYGSVSASDLEHEGEDL

SEQ ID NO: 133386 - protein, 31 aa, Artificial Sequence
  Description of Artificial Sequence: Synthetic polypeptide
QEQEIATTNPVGTEQYGSVSASTLEHEGEDL

SEQ ID NO: 133387 - protein, 32 aa, Artificial Sequence
  Description of Artificial Sequence: Synthetic polypeptide
QEQEIATTNPVGTEQYGSVSATDLEDHEGEDL

SEQ ID NO: 133388 - protein, 29 aa, Artificial Sequence
  Description of Artificial Sequence: Synthetic peptide
QEQEIATTNPVGTEQYGVMASTLEHGEDI

SEQ ID NO: 133389 - protein, 34 aa, Artificial Sequence
  Description of Artificial Sequence: Synthetic polypeptide
DEEEIRTTNPVATEQYGSISPTPAEVSIQMQEQT

SEQ ID NO: 133390 - protein, 32 aa, Artificial Sequence
  Description of Artificial Sequence: Synthetic polypeptide
QEQEIATTNPVSTEQYGSVSATDLEDHEGEDL

SEQ ID NO: 133391 - protein, 34 aa, Artificial Sequence
  Description of Artificial Sequence: Synthetic polypeptide
DDEEIRTTNCVATEQWGSVVTRGLRLQREGQGDQ

SEQ ID NO: 133392 - protein, 38 aa, Artificial Sequence
  Description of Artificial Sequence: Synthetic polypeptide
DEEEIRTTNPVATEQYGVVSTVVVSNGNLQAGNTEQGQ

SEQ ID NO: 133393 - protein, 33 aa, Artificial Sequence
  Description of Artificial Sequence: Synthetic polypeptide
DDEEIRTTNPCATEHYGCVCSWNLQNFNSNNQA

SEQ ID NO: 133394 - protein, 34 aa, Artificial Sequence
  Description of Artificial Sequence: Synthetic polypeptide
DEGEIRTTNPVATEQYGSVSVLDMNEDEDQNNQI

SEQ ID NO: 133395 - protein, 38 aa, Artificial Sequence
  Description of Artificial Sequence: Synthetic polypeptide
DEEEIRTTNPVATEQYGVVSTVVVTNLQAGNQEDEETD

SEQ ID NO: 133396 - protein, 38 aa, Artificial Sequence
  Description of Artificial Sequence: Synthetic polypeptide
DEEEIRTTNPVATEQYGVVSTVVVTNLQAGNQEEEEDE

SEQ ID NO: 133397 - protein, 29 aa, Artificial Sequence
  Description of Artificial Sequence: Synthetic peptide
QESEIACTNPVGTEGYGHVMASTLQHGDI

SEQ ID NO: 133398 - protein, 38 aa, Artificial Sequence
  Description of Artificial Sequence: Synthetic polypeptide
DEEEIRTTNPVATEQYGVVSTVVVTNLQAGNTEQGTAE

SEQ ID NO: 133399 - protein, 35 aa, Artificial Sequence
  Description of Artificial Sequence: Synthetic polypeptide
DEGEIRTTNPVATEQYGSVSFNTASVTQENNNDHD

SEQ ID NO: 133400 - protein, 36 aa, Artificial Sequence
  Description of Artificial Sequence: Synthetic polypeptide
DEEEIRTTNPVATEQYGSIPSESFQMLDQIQVNPRT

SEQ ID NO: 133401 - protein, 28 aa, Artificial Sequence
  Description of Artificial Sequence: Synthetic peptide
QESEIACTNPVGTEGYGVMAENLQHGDI

SEQ ID NO: 133402 - protein, 28 aa, Artificial Sequence
  Description of Artificial Sequence: Synthetic peptide
QESEIACTNPVGTEGYGVMAETLQHGDR

SEQ ID NO: 133403 - protein, 28 aa, Artificial Sequence
  Description of Artificial Sequence: Synthetic peptide
QESEIACTNPVGTEGYGVMASNLQHGDI

SEQ ID NO: 133404 - protein, 28 aa, Artificial Sequence
  Description of Artificial Sequence: Synthetic peptide
QESEIACTNPVGTEGYGVMASTLQHGDI

SEQ ID NO: 133405 - protein, 35 aa, Artificial Sequence
  Description of Artificial Sequence: Synthetic polypeptide
DEGEIRTTNPVATEQYGSVSDTYLSLEDGVQQHEY

SEQ ID NO: 133406 - protein, 28 aa, Artificial Sequence
  Description of Artificial Sequence: Synthetic peptide
QESEIACTNPVGTEGYGEMAETLQHGDR

SEQ ID NO: 133407 - protein, 28 aa, Artificial Sequence
  Description of Artificial Sequence: Synthetic peptide
QESEIACTNPVGTEQYGVMASTLMHGDI

SEQ ID NO: 133408 - protein, 28 aa, Artificial Sequence
  Description of Artificial Sequence: Synthetic peptide
QESEIAGTNPVGTEGYGVMASTLQHGDI

SEQ ID NO: 133409 - protein, 28 aa, Artificial Sequence
  Description of Artificial Sequence: Synthetic peptide
QESEIAPTNPCGSEQYGIVACNLQSGDI

SEQ ID NO: 133410 - protein, 38 aa, Artificial Sequence
  Description of Artificial Sequence: Synthetic polypeptide
DEEEIRTTNPVATEQYGVVSTVVVTNLQQGNNDEEEDT

SEQ ID NO: 133411 - protein, 36 aa, Artificial Sequence
  Description of Artificial Sequence: Synthetic polypeptide
DEGEIRTTNPVATEQYGSVSATPSDLQMEGSDFEQQ

SEQ ID NO: 133412 - protein, 28 aa, Artificial Sequence
  Description of Artificial Sequence: Synthetic peptide
QESEIAPTNPCSSEGYGIVSCNLQHGDI

SEQ ID NO: 133413 - protein, 38 aa, Artificial Sequence
  Description of Artificial Sequence: Synthetic polypeptide
DEEEIRTTNPVATEQYGVVSTVVVTNLQQGNNTEDEDE

SEQ ID NO: 133414 - protein, 38 aa, Artificial Sequence
  Description of Artificial Sequence: Synthetic polypeptide
DEEEIRTTNPVATEQYGVVSTVVVTNLQQGNQEEDEED

SEQ ID NO: 133415 - protein, 34 aa, Artificial Sequence
  Description of Artificial Sequence: Synthetic polypeptide
DEGEIRTTNPVATEQYGSVSAEQDPTQEGFEDGD

SEQ ID NO: 133416 - protein, 28 aa, Artificial Sequence
  Description of Artificial Sequence: Synthetic peptide
QESEIAPTNPCSSEGYGIVSCNLQSGTI

SEQ ID NO: 133417 - protein, 38 aa, Artificial Sequence
  Description of Artificial Sequence: Synthetic polypeptide
DEEEIRTTNPVATEQYGVVSTVVVTNLQQGNDEEDEDE

SEQ ID NO: 133418 - protein, 38 aa, Artificial Sequence
  Description of Artificial Sequence: Synthetic polypeptide
DEEEIRTTNPVATEQYGVVSTVVVTNLQAGNQTEEGTE

SEQ ID NO: 133419 - protein, 38 aa, Artificial Sequence
  Description of Artificial Sequence: Synthetic polypeptide
DEEEIRTTNPVATEQYGVVSTVVVTNLQAGNQQSTEDE

SEQ ID NO: 133420 - protein, 38 aa, Artificial Sequence
  Description of Artificial Sequence: Synthetic polypeptide
DEEEIRTTNPVATEQYGVVSTVVVTNLQAGNQQGEEDE

SEQ ID NO: 133421 - protein, 29 aa, Artificial Sequence
  Description of Artificial Sequence: Synthetic peptide
QESEIAATNPVGTEGYGVMASTWLQHGDI

SEQ ID NO: 133422 - protein, 36 aa, Artificial Sequence
  Description of Artificial Sequence: Synthetic polypeptide
DEGEIRTTNPVATEQYGSVSSTTPAGPNMRYGMNPV

SEQ ID NO: 133423 - protein, 28 aa, Artificial Sequence
  Description of Artificial Sequence: Synthetic peptide
QESEIACTNPIATEQYGVMASTLMHGDI

SEQ ID NO: 133424 - protein, 28 aa, Artificial Sequence
  Description of Artificial Sequence: Synthetic peptide
QESEIACTNPIATEQYGVMSSTLMHGDI

SEQ ID NO: 133425 - protein, 36 aa, Artificial Sequence
  Description of Artificial Sequence: Synthetic polypeptide
DEGEIRTTNPVATEQYGSVSSTTPAGPNMRNGMNPV

SEQ ID NO: 133426 - protein, 36 aa, Artificial Sequence
  Description of Artificial Sequence: Synthetic polypeptide
DEGEIRTTNPVATEQYGSVSSTTPAGPNMRNGMNPQ

SEQ ID NO: 133427 - protein, 38 aa, Artificial Sequence
  Description of Artificial Sequence: Synthetic polypeptide
DEEEIRTTNPVATEQYGVVSTVVVTNLQAGNQEEEEDT

SEQ ID NO: 133428 - protein, 38 aa, Artificial Sequence
  Description of Artificial Sequence: Synthetic polypeptide
DEEEIRTTNPVATEQYGVVSTVVVTNLQAGNQEEEEED

SEQ ID NO: 133429 - protein, 38 aa, Artificial Sequence
  Description of Artificial Sequence: Synthetic polypeptide
DEEEIRTTNPVATEQYGVVSTVVVTNLQAGNQEETDTN

SEQ ID NO: 133430 - protein, 36 aa, Artificial Sequence
  Description of Artificial Sequence: Synthetic polypeptide
DEEEIRTTNPVATEQYGSISDYSDNIWGGESNEDRG

SEQ ID NO: 133431 - protein, 38 aa, Artificial Sequence
  Description of Artificial Sequence: Synthetic polypeptide
DEEEIRTTNPVATEQYGVVSTVVVTNLQAGNQEGEQDE

SEQ ID NO: 133432 - protein, 38 aa, Artificial Sequence
  Description of Artificial Sequence: Synthetic polypeptide
DEEEIRTTNPVATEQYGVVSTVVVTNLQAGNQENEDEM

SEQ ID NO: 133433 - protein, 35 aa, Artificial Sequence
  Description of Artificial Sequence: Synthetic polypeptide
DEEEIRTTNPVATEQYGSISCVVDLQQPNSQIDEQ

SEQ ID NO: 133434 - protein, 37 aa, Artificial Sequence
  Description of Artificial Sequence: Synthetic polypeptide
AEEEIRTTNPVATEQYGSVSTVVNGGNNQDEGNNQSG

SEQ ID NO: 133435 - protein, 38 aa, Artificial Sequence
  Description of Artificial Sequence: Synthetic polypeptide
DEEEIRTTNPVATEQYGVVSTVVVTNLQAGNQENENDD

SEQ ID NO: 133436 - protein, 35 aa, Artificial Sequence
  Description of Artificial Sequence: Synthetic polypeptide
DEEEIRTTNPVATEQYGSISCCGSNVSQGAGGSYE

SEQ ID NO: 133437 - protein, 38 aa, Artificial Sequence
  Description of Artificial Sequence: Synthetic polypeptide
DEEEIRTTNPVATEQYGVVSTVVVTNLQAGNQETEDDG

SEQ ID NO: 133438 - protein, 35 aa, Artificial Sequence
  Description of Artificial Sequence: Synthetic polypeptide
DEGEIRTTNPVATEQYGSVSNTWDYNTEEPQNQIQ

SEQ ID NO: 133439 - protein, 35 aa, Artificial Sequence
  Description of Artificial Sequence: Synthetic polypeptide
DEGEIRTTNPVATEQYGSVSNTPETQANSDQEEHP

SEQ ID NO: 133440 - protein, 34 aa, Artificial Sequence
  Description of Artificial Sequence: Synthetic polypeptide
DEEEIRTTNPVATEQYGSISCAGSNVSGSPGSYE

SEQ ID NO: 133441 - protein, 37 aa, Artificial Sequence
  Description of Artificial Sequence: Synthetic polypeptide
AEEEIRTTNPVATEQYGSVSTVVNGGNNQDEGGNNSD

SEQ ID NO: 133442 - protein, 36 aa, Artificial Sequence
  Description of Artificial Sequence: Synthetic polypeptide
DEGEIRTTNPVATEQYGSVSSTTSAGPNMRNGMNPV

SEQ ID NO: 133443 - protein, 34 aa, Artificial Sequence
  Description of Artificial Sequence: Synthetic polypeptide
DEGEIRTTNPVATEQYGSVSAENIHSQEQFEDGD

SEQ ID NO: 133444 - protein, 34 aa, Artificial Sequence
  Description of Artificial Sequence: Synthetic polypeptide
DEGEIRTTNPVATEQYGSVSVLTLGTESGGQQVD

SEQ ID NO: 133445 - protein, 31 aa, Artificial Sequence
  Description of Artificial Sequence: Synthetic polypeptide
QEQEIATTNPVATEQYGVVAATDLEDHGEDL

SEQ ID NO: 133446 - protein, 33 aa, Artificial Sequence
  Description of Artificial Sequence: Synthetic polypeptide
DEGEIRTTNPVATEQYGVVSDWTLERSESYQQG

SEQ ID NO: 133447 - protein, 34 aa, Artificial Sequence
  Description of Artificial Sequence: Synthetic polypeptide
DEGEIRTTNPVATEQYGVVCSVVVLHQNTQEDRN

SEQ ID NO: 133448 - protein, 31 aa, Artificial Sequence
  Description of Artificial Sequence: Synthetic polypeptide
QEQEIATTNPVATEGYGVVSATTLEHEGEDL

SEQ ID NO: 133449 - protein, 36 aa, Artificial Sequence
  Description of Artificial Sequence: Synthetic polypeptide
AEEEIRTTNPVATEQYGSVSTVVNLNNNEQGTDEDE

SEQ ID NO: 133450 - protein, 38 aa, Artificial Sequence
  Description of Artificial Sequence: Synthetic polypeptide
DEEEIRTTNPVATEQYGVVSTVVTTNLQAGNQEGTEDE

SEQ ID NO: 133451 - protein, 32 aa, Artificial Sequence
  Description of Artificial Sequence: Synthetic polypeptide
QEQEIATTNPVATEQYGDVSATDLEDHEGEDL

SEQ ID NO: 133452 - protein, 34 aa, Artificial Sequence
  Description of Artificial Sequence: Synthetic polypeptide
DEGEIRTTNPVATEQYGSYWSPLDNMNEFDNQRP

SEQ ID NO: 133453 - protein, 36 aa, Artificial Sequence
  Description of Artificial Sequence: Synthetic polypeptide
DEGEIRTTNPVATEQYGSYWSPLDNMLEREDENQRV

SEQ ID NO: 133454 - protein, 34 aa, Artificial Sequence
  Description of Artificial Sequence: Synthetic polypeptide
DEGEIRTTNPVATEQYGSYWSPLDNMLERDTQEP

SEQ ID NO: 133455 - protein, 30 aa, Artificial Sequence
  Description of Artificial Sequence: Synthetic polypeptide
QEQEIATTNPVATEGYGVMSATTLEHGEDI

SEQ ID NO: 133456 - protein, 33 aa, Artificial Sequence
  Description of Artificial Sequence: Synthetic polypeptide
DEGEIRTTNPVATEQYGSYVYTWDDQESLQDEI

SEQ ID NO: 133457 - protein, 28 aa, Artificial Sequence
  Description of Artificial Sequence: Synthetic peptide
QEQEIATTNPVATEQYGEAPEVCQHEEK

SEQ ID NO: 133458 - protein, 28 aa, Artificial Sequence
  Description of Artificial Sequence: Synthetic peptide
QEQEIATTNPVATEQYGEAPEVCQHLEK

SEQ ID NO: 133459 - protein, 35 aa, Artificial Sequence
  Description of Artificial Sequence: Synthetic polypeptide
DEGEIRTTNPVATEQYGSVYSTVNDNTQETTFEEQ

SEQ ID NO: 133460 - protein, 36 aa, Artificial Sequence
  Description of Artificial Sequence: Synthetic polypeptide
DEGEIRTTNPVATEQYGSVYSDTYNSLEFDGVQQEG

SEQ ID NO: 133461 - protein, 29 aa, Artificial Sequence
  Description of Artificial Sequence: Synthetic peptide
QEQEIATTNPVATEQYGEAPEVLQDHEEK

SEQ ID NO: 133462 - protein, 34 aa, Artificial Sequence
  Description of Artificial Sequence: Synthetic polypeptide
DEGEIRTTNPVATEQYGSVYITEDNTQETDFEEQ

SEQ ID NO: 133463 - protein, 34 aa, Artificial Sequence
  Description of Artificial Sequence: Synthetic polypeptide
DEGEIRTTNPVATEQYGSVWYVTAETQGEGMEDQ

SEQ ID NO: 133464 - protein, 34 aa, Artificial Sequence
  Description of Artificial Sequence: Synthetic polypeptide
DEGEIRTTNPVATEQYGSVWWVVTDEHEGFEERQ

SEQ ID NO: 133465 - protein, 35 aa, Artificial Sequence
  Description of Artificial Sequence: Synthetic polypeptide
DEGEIRTTNPVATEQYGSVWWTNCMDEIEQNEDRN

SEQ ID NO: 133466 - protein, 29 aa, Artificial Sequence
  Description of Artificial Sequence: Synthetic peptide
QEQEIATTNPVATEQYGEAPAEDCQHGEK

SEQ ID NO: 133467 - protein, 31 aa, Artificial Sequence
  Description of Artificial Sequence: Synthetic polypeptide
QEQEIATTNPVATEGYGSMAATTLQDHGDDI

SEQ ID NO: 133468 - protein, 31 aa, Artificial Sequence
  Description of Artificial Sequence: Synthetic polypeptide
QEQEIATTNPVATEGYGSMAATDLQDHGDDI

SEQ ID NO: 133469 - protein, 35 aa, Artificial Sequence
  Description of Artificial Sequence: Synthetic polypeptide
DEEEIRTTNPVATEQYGSIVCITTEDEGGNEQPTA

SEQ ID NO: 133470 - protein, 28 aa, Artificial Sequence
  Description of Artificial Sequence: Synthetic peptide
QEQEIASTNPVGTEGYGKMASTLQHGDI

SEQ ID NO: 133471 - protein, 28 aa, Artificial Sequence
  Description of Artificial Sequence: Synthetic peptide
QEQEIASTNPVGTEGYGVMASTLQHGDI

SEQ ID NO: 133472 - protein, 28 aa, Artificial Sequence
  Description of Artificial Sequence: Synthetic peptide
QEQEIASTNPVGTEGYGVVASTLEHGDI

SEQ ID NO: 133473 - protein, 29 aa, Artificial Sequence
  Description of Artificial Sequence: Synthetic peptide
QEQEIASTNPVGTEGYGVVASTLQDHGDI

SEQ ID NO: 133474 - protein, 29 aa, Artificial Sequence
  Description of Artificial Sequence: Synthetic peptide
QEQEIASTNPVGTEGYGVVASTLQDHGDL

SEQ ID NO: 133475 - protein, 34 aa, Artificial Sequence
  Description of Artificial Sequence: Synthetic polypeptide
DEEEIRTTNPVATEQYGSIVNNSESDVGGDTEVG

SEQ ID NO: 133476 - protein, 28 aa, Artificial Sequence
  Description of Artificial Sequence: Synthetic peptide
QEQEIASTNPVGTEGYGVVSSTLEHGDL

SEQ ID NO: 133477 - protein, 37 aa, Artificial Sequence
  Description of Artificial Sequence: Synthetic polypeptide
DEEEIRTTNPVATEQYGVVSTVVTNQQNGNQQNTEEE

SEQ ID NO: 133478 - protein, 31 aa, Artificial Sequence
  Description of Artificial Sequence: Synthetic polypeptide
QEQEIASTNPVGTEQYGSVSATDLEDHEGEI

SEQ ID NO: 133479 - protein, 37 aa, Artificial Sequence
  Description of Artificial Sequence: Synthetic polypeptide
DEEEIRTTNPVATEQYGVVSTVVTNQQQGNNEEEEDE

SEQ ID NO: 133480 - protein, 30 aa, Artificial Sequence
  Description of Artificial Sequence: Synthetic polypeptide
QEQEIATTNPCSTEQYGIVSCNLESEGEDL

SEQ ID NO: 133481 - protein, 37 aa, Artificial Sequence
  Description of Artificial Sequence: Synthetic polypeptide
DEEEIRTTNPVATEQYGSIVNGTEELDDQTGSNETQN

SEQ ID NO: 133482 - protein, 37 aa, Artificial Sequence
  Description of Artificial Sequence: Synthetic polypeptide
DEEEIRTTNPVATEQYGVVSTVVTNQQQGTTTTTNVE

SEQ ID NO: 133483 - protein, 31 aa, Artificial Sequence
  Description of Artificial Sequence: Synthetic polypeptide
QEQEIATTNPCSTEQYGIVSTNLEDSEGEDL

SEQ ID NO: 133484 - protein, 31 aa, Artificial Sequence
  Description of Artificial Sequence: Synthetic polypeptide
QEQEIATTNPCSTEQYGSVSACNLESEGEDL

SEQ ID NO: 133485 - protein, 37 aa, Artificial Sequence
  Description of Artificial Sequence: Synthetic polypeptide
DEEEIRTTNPVATEQYGVVSTVVTNQTNQQGNNQQGD

SEQ ID NO: 133486 - protein, 30 aa, Artificial Sequence
  Description of Artificial Sequence: Synthetic polypeptide
QEQEIATTNPVASEQYGIVSACDLEDSGTL

SEQ ID NO: 133487 - protein, 28 aa, Artificial Sequence
  Description of Artificial Sequence: Synthetic peptide
QEQEIATTNPVATECWGAVAECLQHEET

SEQ ID NO: 133488 - protein, 37 aa, Artificial Sequence
  Description of Artificial Sequence: Synthetic polypeptide
DEEEIRTTNPVATEQYGSIVNGETLNDDQTGSNQGEI

SEQ ID NO: 133489 - protein, 34 aa, Artificial Sequence
  Description of Artificial Sequence: Synthetic polypeptide
DDEEIRSTNPVATEQYGCVCSNTELQENSGSQQA

SEQ ID NO: 133490 - protein, 31 aa, Artificial Sequence
  Description of Artificial Sequence: Synthetic polypeptide
QEQEIATTNPVATECYGSVSAEDLQHEEEDL

SEQ ID NO: 133491 - protein, 33 aa, Artificial Sequence
  Description of Artificial Sequence: Synthetic polypeptide
DEGEIRTTNPVATEQYGSVWWPWPEQDTNESQA

SEQ ID NO: 133492 - protein, 36 aa, Artificial Sequence
  Description of Artificial Sequence: Synthetic polypeptide
DEEEIRTTNPVATEQYGSISSTTPAGPNMRNGMNPV

SEQ ID NO: 133493 - protein, 28 aa, Artificial Sequence
  Description of Artificial Sequence: Synthetic peptide
QEQEIATTNPVATEQYGEAPPVCQHEEK

SEQ ID NO: 133494 - protein, 34 aa, Artificial Sequence
  Description of Artificial Sequence: Synthetic polypeptide
DEGEIRTTNPVATEQYGSVWTPDDDLNRFEMQVH

SEQ ID NO: 133495 - protein, 36 aa, Artificial Sequence
  Description of Artificial Sequence: Synthetic polypeptide
DEEEINTTNPVATEQYGSVSSTTPAMPNMRNGMNPV

SEQ ID NO: 133496 - protein, 35 aa, Artificial Sequence
  Description of Artificial Sequence: Synthetic polypeptide
DEEEINTTNPVATEQYGSVVCTRASSNANGGNNED

SEQ ID NO: 133497 - protein, 36 aa, Artificial Sequence
  Description of Artificial Sequence: Synthetic polypeptide
DEEEIQTTNPVATEQYGSVSSTTPAGPNMRNGMNPV

SEQ ID NO: 133498 - protein, 36 aa, Artificial Sequence
  Description of Artificial Sequence: Synthetic polypeptide
DEEEIQTTNPVATEQYGSVSSTTPAGPNPRNGMNPV

SEQ ID NO: 133499 - protein, 36 aa, Artificial Sequence
  Description of Artificial Sequence: Synthetic polypeptide
DEEEIRTTNPVATEQYGSISSTTPDGPNMRNGMNPV

SEQ ID NO: 133500 - protein, 34 aa, Artificial Sequence
  Description of Artificial Sequence: Synthetic polypeptide
DEGEIRTTNPVATEQYGSVSWENNDEDMYQQEST

SEQ ID NO: 133501 - protein, 36 aa, Artificial Sequence
  Description of Artificial Sequence: Synthetic polypeptide
DEEEIRTTNPVATEQYGSISSTTPAYPNMRNGMNPV

SEQ ID NO: 133502 - protein, 37 aa, Artificial Sequence
  Description of Artificial Sequence: Synthetic polypeptide
DEEEIRTTNPVATEQYGSISSTTPAQGPNMRNGMNPV

SEQ ID NO: 133503 - protein, 36 aa, Artificial Sequence
  Description of Artificial Sequence: Synthetic polypeptide
DEEEIRTTNPVATEQYGSISSTTPAHPNMRNGMNPV

SEQ ID NO: 133504 - protein, 35 aa, Artificial Sequence
  Description of Artificial Sequence: Synthetic polypeptide
DEGEIRTTNPVATEQYGSVSYTTASVTQENNNDEN

SEQ ID NO: 133505 - protein, 38 aa, Artificial Sequence
  Description of Artificial Sequence: Synthetic polypeptide
DEEEIRTTNPVATEQYGVVSTVVVNLQAGNQNGNEEDD

SEQ ID NO: 133506 - protein, 35 aa, Artificial Sequence
  Description of Artificial Sequence: Synthetic polypeptide
DEGEIRTTNPVATEQYGSVSVTTASVEQENNNDED

SEQ ID NO: 133507 - protein, 35 aa, Artificial Sequence
  Description of Artificial Sequence: Synthetic polypeptide
DEGEIRTTNPVATEQYGSVSVTTADVTQENNEEED

SEQ ID NO: 133508 - protein, 38 aa, Artificial Sequence
  Description of Artificial Sequence: Synthetic polypeptide
DEEEIRTTNPVATEQYGVVSTVVVNLQAGTEGNNVEEA

SEQ ID NO: 133509 - protein, 35 aa, Artificial Sequence
  Description of Artificial Sequence: Synthetic polypeptide
DEGEIRTTNPVATEQYGSVSVTNEVDEESNSNVSE

SEQ ID NO: 133510 - protein, 34 aa, Artificial Sequence
  Description of Artificial Sequence: Synthetic polypeptide
DEGEIRTTNPVATEQYGSVSVSWDNTEEPQVQIQ

SEQ ID NO: 133511 - protein, 35 aa, Artificial Sequence
  Description of Artificial Sequence: Synthetic polypeptide
DDEEIRSTNPVATEQYGSVSATTAIPNMRNGMNPV

SEQ ID NO: 133512 - protein, 38 aa, Artificial Sequence
  Description of Artificial Sequence: Synthetic polypeptide
DEEEIRTTNPVATEQYGVVSTVVVNLQGNQAGNNTEGS

SEQ ID NO: 133513 - protein, 34 aa, Artificial Sequence
  Description of Artificial Sequence: Synthetic polypeptide
DEGEIRTTNPVATEQYGSVSVQLMLEEIVQEDSD

SEQ ID NO: 133514 - protein, 30 aa, Artificial Sequence
  Description of Artificial Sequence: Synthetic polypeptide
QEQEIATTNPVATEQYGVMAATDLEDHGDL

SEQ ID NO: 133515 - protein, 38 aa, Artificial Sequence
  Description of Artificial Sequence: Synthetic polypeptide
DEEEIRTTNPVATEQYGVVSTVVVNLQAGTEENEDEDT

SEQ ID NO: 133516 - protein, 33 aa, Artificial Sequence
  Description of Artificial Sequence: Synthetic polypeptide
QEQEIATTNPVATEQYGSVSATDLEDHEGKEDL

SEQ ID NO: 133517 - protein, 35 aa, Artificial Sequence
  Description of Artificial Sequence: Synthetic polypeptide
DEGEIRTTNPVATEQYGSVTPTNGDETTQSGQDAQ

SEQ ID NO: 133518 - protein, 36 aa, Artificial Sequence
  Description of Artificial Sequence: Synthetic polypeptide
DEEEINTTNPVATEQYGSVSSTTPAGPNMRNGMNPV

SEQ ID NO: 133519 - protein, 31 aa, Artificial Sequence
  Description of Artificial Sequence: Synthetic polypeptide
QEQEIATTNPVATEQYGEASAEVLQDHEGEK

SEQ ID NO: 133520 - protein, 28 aa, Artificial Sequence
  Description of Artificial Sequence: Synthetic peptide
QEQEIATTNPVATEQYGEAVEVCQHEEK

SEQ ID NO: 133521 - protein, 36 aa, Artificial Sequence
  Description of Artificial Sequence: Synthetic polypeptide
DEGEIRTTNPVATEQYGSVWTDTTNIQEIEQGDNQE

SEQ ID NO: 133522 - protein, 34 aa, Artificial Sequence
  Description of Artificial Sequence: Synthetic polypeptide
DEGEIRTTNPVATEQYGSVWSDDNHQDSSQIDDQ

SEQ ID NO: 133523 - protein, 36 aa, Artificial Sequence
  Description of Artificial Sequence: Synthetic polypeptide
DEGEIRTTNPVATEQYGSVWPTTNLHVIEGSNEDVI

SEQ ID NO: 133524 - protein, 33 aa, Artificial Sequence
  Description of Artificial Sequence: Synthetic polypeptide
DEEEIRTTNPVATEQYGSITATTEDHNDEIEEQ

SEQ ID NO: 133525 - protein, 33 aa, Artificial Sequence
  Description of Artificial Sequence: Synthetic polypeptide
QEQEIATTNPVATEQYGSCVSATDLEDHEGEDL

SEQ ID NO: 133526 - protein, 32 aa, Artificial Sequence
  Description of Artificial Sequence: Synthetic polypeptide
QEQEIATTNPVATEQYGSMSATDLEDHEGEDL

SEQ ID NO: 133527 - protein, 32 aa, Artificial Sequence
  Description of Artificial Sequence: Synthetic polypeptide
QEQEIATTNPVATEQYGSVAATDLEDHEGEDL

SEQ ID NO: 133528 - protein, 32 aa, Artificial Sequence
  Description of Artificial Sequence: Synthetic polypeptide
QEQEIATTNPVATEQYGSVPATVLEDHEGEDL

SEQ ID NO: 133529 - protein, 33 aa, Artificial Sequence
  Description of Artificial Sequence: Synthetic polypeptide
DEGEIRTTNPVATEQYGSVVTLVYSHFENSEDK

SEQ ID NO: 133530 - protein, 31 aa, Artificial Sequence
  Description of Artificial Sequence: Synthetic polypeptide
QEQEIATTNPVATEQYGSVPTDCEDHEGEDL

SEQ ID NO: 133531 - protein, 32 aa, Artificial Sequence
  Description of Artificial Sequence: Synthetic polypeptide
QEQEIATTNPVATEQYGSVSAECLQDHEEEDL

SEQ ID NO: 133532 - protein, 34 aa, Artificial Sequence
  Description of Artificial Sequence: Synthetic polypeptide
DEGEIRTTNPVATEQYGSVTYVLDNLQPEVQDSQ

SEQ ID NO: 133533 - protein, 37 aa, Artificial Sequence
  Description of Artificial Sequence: Synthetic polypeptide
DEEEINTTNPVATEQYGSAVSSTTPQGPNMRNGMNPV

SEQ ID NO: 133534 - protein, 32 aa, Artificial Sequence
  Description of Artificial Sequence: Synthetic polypeptide
QEQEIATTNPVATEQYGSVSAEDLEDHEGEDL

SEQ ID NO: 133535 - protein, 36 aa, Artificial Sequence
  Description of Artificial Sequence: Synthetic polypeptide
DEEEINTTNPVATEQYGSNVSSTTPAGPNMRNGMNV

SEQ ID NO: 133536 - protein, 36 aa, Artificial Sequence
  Description of Artificial Sequence: Synthetic polypeptide
DEEEINTTNPVATEQYGSTVSELNEFSQESTGGNEL

SEQ ID NO: 133537 - protein, 36 aa, Artificial Sequence
  Description of Artificial Sequence: Synthetic polypeptide
DEEEINTTNPVATEQYGSVSSTTPADPNMRNGMNPV

SEQ ID NO: 133538 - protein, 33 aa, Artificial Sequence
  Description of Artificial Sequence: Synthetic polypeptide
QEQEIATTNPVATEQYGSVSATDGEDQEGEDGI

SEQ ID NO: 133539 - protein, 32 aa, Artificial Sequence
  Description of Artificial Sequence: Synthetic polypeptide
QEQEIATTNPVATEQYGSVSATDLEDHEEEDL

SEQ ID NO: 133540 - protein, 34 aa, Artificial Sequence
  Description of Artificial Sequence: Synthetic polypeptide
DEGEIRTTNPVATEQYGSVWVVTAETQFNGAEDQ

SEQ ID NO: 133541 - protein, 28 aa, Artificial Sequence
  Description of Artificial Sequence: Synthetic peptide
QESEIASTNPVGTEGYGKMASTLQHGDI

SEQ ID NO: 133542 - protein, 34 aa, Artificial Sequence
  Description of Artificial Sequence: Synthetic polypeptide
DEGEIRTTNPVATEQYGSVSAENDWTGEGFEDGD

SEQ ID NO: 133543 - protein, 34 aa, Artificial Sequence
  Description of Artificial Sequence: Synthetic polypeptide
DEGEIRTTNPVATEQYGSVSAENDDTQEQFEDGV

SEQ ID NO: 133544 - protein, 30 aa, Artificial Sequence
  Description of Artificial Sequence: Synthetic polypeptide
QESEIASTNPVGTEAYGVVIASTELQHGDI

SEQ ID NO: 133545 - protein, 30 aa, Artificial Sequence
  Description of Artificial Sequence: Synthetic polypeptide
QESEIASTNPVGTECWGVVSSITLQRGENG

SEQ ID NO: 133546 - protein, 29 aa, Artificial Sequence
  Description of Artificial Sequence: Synthetic peptide
QESEIASTNPVGTECYGVMASTLLQHGDI

SEQ ID NO: 133547 - protein, 28 aa, Artificial Sequence
  Description of Artificial Sequence: Synthetic peptide
QESEIASTNPVGTECYGVMASTLQHGDI

SEQ ID NO: 133548 - protein, 35 aa, Artificial Sequence
  Description of Artificial Sequence: Synthetic polypeptide
DEGEIRTTNPVATEQYGSCSTNYWWEQTFNGQIVE

SEQ ID NO: 133549 - protein, 28 aa, Artificial Sequence
  Description of Artificial Sequence: Synthetic peptide
QESEIASTNPVGTECYGVMASTLQHGDL

SEQ ID NO: 133550 - protein, 28 aa, Artificial Sequence
  Description of Artificial Sequence: Synthetic peptide
QESEIASTNPVGTECYGVMASTLQHGEI

SEQ ID NO: 133551 - protein, 28 aa, Artificial Sequence
  Description of Artificial Sequence: Synthetic peptide
QESEIASTNPVGTECYGVMASTLQHGEL

SEQ ID NO: 133552 - protein, 29 aa, Artificial Sequence
  Description of Artificial Sequence: Synthetic peptide
QESEIASTNPVGTECYGVVACNLQHEGDG

SEQ ID NO: 133553 - protein, 28 aa, Artificial Sequence
  Description of Artificial Sequence: Synthetic peptide
QESEIASTNPVGTEAYGVMASTLQHGDI

SEQ ID NO: 133554 - protein, 34 aa, Artificial Sequence
  Description of Artificial Sequence: Synthetic polypeptide
DEGEIRTTNPVATEQYGSCQVTYDNLIRFEMQEH

SEQ ID NO: 133555 - protein, 28 aa, Artificial Sequence
  Description of Artificial Sequence: Synthetic peptide
QESEIASTNPVGTECYGVVSECLQHEDI

SEQ ID NO: 133556 - protein, 28 aa, Artificial Sequence
  Description of Artificial Sequence: Synthetic peptide
QESEIASTNPVGTEEYGVIASTLQHGDI

SEQ ID NO: 133557 - protein, 35 aa, Artificial Sequence
  Description of Artificial Sequence: Synthetic polypeptide
DEGEIRTTNPVATEQYGSCLWTLVLEQGGENYEDH

SEQ ID NO: 133558 - protein, 34 aa, Artificial Sequence
  Description of Artificial Sequence: Synthetic polypeptide
DEGEIRTTNPVATEQYGSCISVLNGQDQTIDGRI

SEQ ID NO: 133559 - protein, 28 aa, Artificial Sequence
  Description of Artificial Sequence: Synthetic peptide
QESEIASTNPVGTEEYGVMASTLQHGDI

SEQ ID NO: 133560 - protein, 28 aa, Artificial Sequence
  Description of Artificial Sequence: Synthetic peptide
QESEIASTNPVGTEFYGVMASTLQHGDI

SEQ ID NO: 133561 - protein, 29 aa, Artificial Sequence
  Description of Artificial Sequence: Synthetic peptide
QESEIASTNPVGTEFYGVMASTLQHGDRI

SEQ ID NO: 133562 - protein, 28 aa, Artificial Sequence
  Description of Artificial Sequence: Synthetic peptide
QESEIASTNPVGTEGWGVMSCTLQHGNI

SEQ ID NO: 133563 - protein, 28 aa, Artificial Sequence
  Description of Artificial Sequence: Synthetic peptide
QESEIASTNPVGTEGWGVSASTLQHGMH

SEQ ID NO: 133564 - protein, 30 aa, Artificial Sequence
  Description of Artificial Sequence: Synthetic polypeptide
QESEIASTNPVGTECYGVVACNLQREGEDG

SEQ ID NO: 133565 - protein, 28 aa, Artificial Sequence
  Description of Artificial Sequence: Synthetic peptide
QESEIASTNPVGTEAYGVFASTLQHGDI

SEQ ID NO: 133566 - protein, 34 aa, Artificial Sequence
  Description of Artificial Sequence: Synthetic polypeptide
DEGEIRTTNPVATEQYGSLYSDVNQQIEDTNDVE

SEQ ID NO: 133567 - protein, 33 aa, Artificial Sequence
  Description of Artificial Sequence: Synthetic polypeptide
DEGEIRTTNPVATEQYGSSSLNIDDPNQGEDGQ

SEQ ID NO: 133568 - protein, 35 aa, Artificial Sequence
  Description of Artificial Sequence: Synthetic polypeptide
DDEEIRTTNPVATDQYGSVSVDQNGGEQNDGGNDN

SEQ ID NO: 133569 - protein, 37 aa, Artificial Sequence
  Description of Artificial Sequence: Synthetic polypeptide
DEEEIRTTNPVATEQYGSHVSSTTPAGPNMRNGMNPV

SEQ ID NO: 133570 - protein, 37 aa, Artificial Sequence
  Description of Artificial Sequence: Synthetic polypeptide
DEEEIRTTNPVATEQYGSHVSSTTPAGPNMRAGMNPV

SEQ ID NO: 133571 - protein, 37 aa, Artificial Sequence
  Description of Artificial Sequence: Synthetic polypeptide
DEEEIRTTNPVATEQYGSHVSITTPAGPNMRNGMNPV

SEQ ID NO: 133572 - protein, 30 aa, Artificial Sequence
  Description of Artificial Sequence: Synthetic polypeptide
QESEIASTNPVATEQYGVVASTGQMHGDPI

SEQ ID NO: 133573 - protein, 31 aa, Artificial Sequence
  Description of Artificial Sequence: Synthetic polypeptide
QESEIASTNPVATEQYGVVATPAGQMRGDPI

SEQ ID NO: 133574 - protein, 31 aa, Artificial Sequence
  Description of Artificial Sequence: Synthetic polypeptide
QESEIASTNPVATEQYGVVATPTGQMRGDPI

SEQ ID NO: 133575 - protein, 30 aa, Artificial Sequence
  Description of Artificial Sequence: Synthetic polypeptide
QESEIASTNPVATEQYGVVATTGQMHGDPI

SEQ ID NO: 133576 - protein, 28 aa, Artificial Sequence
  Description of Artificial Sequence: Synthetic peptide
QESEIASTNPVCTEGYGVMASNLQHGDQ

SEQ ID NO: 133577 - protein, 35 aa, Artificial Sequence
  Description of Artificial Sequence: Synthetic polypeptide
DEEEIRATNPVATEQWGGCVAITNNLEQTGMENSN

SEQ ID NO: 133578 - protein, 28 aa, Artificial Sequence
  Description of Artificial Sequence: Synthetic peptide
QESEIASTNPVCTEGYGVMASTLQHGDI

SEQ ID NO: 133579 - protein, 28 aa, Artificial Sequence
  Description of Artificial Sequence: Synthetic peptide
QESEIASTNPVCTEGYGVMSSTLQSGDI

SEQ ID NO: 133580 - protein, 35 aa, Artificial Sequence
  Description of Artificial Sequence: Synthetic polypeptide
DDEEIRTTNPVATDQYGSVSVVQNGGEQNEGGGNT

SEQ ID NO: 133581 - protein, 36 aa, Artificial Sequence
  Description of Artificial Sequence: Synthetic polypeptide
DEEEIRATNPVATEQWGGCVAITNPLEQTGMENDRE

SEQ ID NO: 133582 - protein, 34 aa, Artificial Sequence
  Description of Artificial Sequence: Synthetic polypeptide
DEEEIRATNPVATEQWGNTTTSTNELAGMPGNNH

SEQ ID NO: 133583 - protein, 34 aa, Artificial Sequence
  Description of Artificial Sequence: Synthetic polypeptide
DEEEIRATNPVATEQWGSVAAANNDTQGNGNDNP

SEQ ID NO: 133584 - protein, 28 aa, Artificial Sequence
  Description of Artificial Sequence: Synthetic peptide
QESEIASTNPVGFEGYGVMASTLQRGDI

SEQ ID NO: 133585 - protein, 36 aa, Artificial Sequence
  Description of Artificial Sequence: Synthetic polypeptide
DEGEIRTTNPVATEQYGSTVSSPVDNLAENRIGDTE

SEQ ID NO: 133586 - protein, 28 aa, Artificial Sequence
  Description of Artificial Sequence: Synthetic peptide
QESEIASTNPVGSEGYGIVACTLQHGDR

SEQ ID NO: 133587 - protein, 28 aa, Artificial Sequence
  Description of Artificial Sequence: Synthetic peptide
QESEIASTNPVGSEGYGVMASNLQHGTR

SEQ ID NO: 133588 - protein, 28 aa, Artificial Sequence
  Description of Artificial Sequence: Synthetic peptide
QESEIASTNPVGSEGYGVMASTLQSGTR

SEQ ID NO: 133589 - protein, 28 aa, Artificial Sequence
  Description of Artificial Sequence: Synthetic peptide
QESEIASTNPVGTEGYGAMASTLQHGDI

SEQ ID NO: 133590 - protein, 36 aa, Artificial Sequence
  Description of Artificial Sequence: Synthetic polypeptide
DDEEIRTTNPVATDQYGSVSTTNNGVEQGNFGNGGI

SEQ ID NO: 133591 - protein, 36 aa, Artificial Sequence
  Description of Artificial Sequence: Synthetic polypeptide
DEEEIRTTNPVATEQYGSHSSTTTAGPNMRNGMNPV

SEQ ID NO: 133592 - protein, 28 aa, Artificial Sequence
  Description of Artificial Sequence: Synthetic peptide
QESEIASTNPVGTEGYGCMASTLQHGDI

SEQ ID NO: 133593 - protein, 29 aa, Artificial Sequence
  Description of Artificial Sequence: Synthetic peptide
QESEIASTNPVGTEGYGHVMSSTLQHGDI

SEQ ID NO: 133594 - protein, 34 aa, Artificial Sequence
  Description of Artificial Sequence: Synthetic polypeptide
DEGEIRTTNPVATEQYGCVSTEIVMDERQEDNDV

SEQ ID NO: 133595 - protein, 38 aa, Artificial Sequence
  Description of Artificial Sequence: Synthetic polypeptide
DEEEIRTTNPVATEQYGVVSVSVTNQQAGNQQGTEEED

SEQ ID NO: 133596 - protein, 33 aa, Artificial Sequence
  Description of Artificial Sequence: Synthetic polypeptide
DEGEIRTTNPVATEQYGCVSTEIVDEFSEDNFV

SEQ ID NO: 133597 - protein, 36 aa, Artificial Sequence
  Description of Artificial Sequence: Synthetic polypeptide
DEEEIRTTNPVATEQYGVVSVTDGFGQNNDGNPETF

SEQ ID NO: 133598 - protein, 34 aa, Artificial Sequence
  Description of Artificial Sequence: Synthetic polypeptide
DEGEIRTTNPVATEQYGCVSTDYLTTTEETQNDD

SEQ ID NO: 133599 - protein, 28 aa, Artificial Sequence
  Description of Artificial Sequence: Synthetic peptide
QESEIASTNPVGTEGYGIMASTLQHGDI

SEQ ID NO: 133600 - protein, 34 aa, Artificial Sequence
  Description of Artificial Sequence: Synthetic polypeptide
DEGEIRTTNPVATEQYGCVSDVDTLTQEHINDGQ

SEQ ID NO: 133601 - protein, 28 aa, Artificial Sequence
  Description of Artificial Sequence: Synthetic peptide
QESEIASTNPVGTEGYGIMASTLQHGPI

SEQ ID NO: 133602 - protein, 34 aa, Artificial Sequence
  Description of Artificial Sequence: Synthetic polypeptide
DEGEIRTTNPVATEQYGCVSTLDFLQESQQEMSN

SEQ ID NO: 133603 - protein, 28 aa, Artificial Sequence
  Description of Artificial Sequence: Synthetic peptide
QESEIASTNPVGTEGYGIVACTLQHGDI

SEQ ID NO: 133604 - protein, 38 aa, Artificial Sequence
  Description of Artificial Sequence: Synthetic polypeptide
DEEEIRTTNPVATEQYGVVSVTTNLQQGNTEAGTVQDD

SEQ ID NO: 133605 - protein, 30 aa, Artificial Sequence
  Description of Artificial Sequence: Synthetic polypeptide
QESEIASTNPVGTEGYGIVMASTLLQHGDI

SEQ ID NO: 133606 - protein, 29 aa, Artificial Sequence
  Description of Artificial Sequence: Synthetic peptide
QESEIASTNPVGTEGYGIVMASTLQHGDI

SEQ ID NO: 133607 - protein, 29 aa, Artificial Sequence
  Description of Artificial Sequence: Synthetic peptide
QESEIASTNPVGTEGYGIVMASTLQIGDI

SEQ ID NO: 133608 - protein, 35 aa, Artificial Sequence
  Description of Artificial Sequence: Synthetic polypeptide
DEGEIRTTNPVATEQYGCSWSFTINPLEYEENQNE

SEQ ID NO: 133609 - protein, 36 aa, Artificial Sequence
  Description of Artificial Sequence: Synthetic polypeptide
DEGEIRTTNPVATEQYGCSWSFTINPLERDEHPQNE

SEQ ID NO: 133610 - protein, 35 aa, Artificial Sequence
  Description of Artificial Sequence: Synthetic polypeptide
DEGEIRTTNPVATEQYGCSSPTINPLERDEHNQDE

SEQ ID NO: 133611 - protein, 36 aa, Artificial Sequence
  Description of Artificial Sequence: Synthetic polypeptide
DEGEIRTTNPVATEQYGCSFSFTENPLDEREHNQNE

SEQ ID NO: 133612 - protein, 35 aa, Artificial Sequence
  Description of Artificial Sequence: Synthetic polypeptide
DEGEIRTTNPVATEQYGCSAFTINPLERTEHNQNE

SEQ ID NO: 133613 - protein, 28 aa, Artificial Sequence
  Description of Artificial Sequence: Synthetic peptide
QESEIASTNPVGTEGYGIVACTLQHGTI

SEQ ID NO: 133614 - protein, 36 aa, Artificial Sequence
  Description of Artificial Sequence: Synthetic polypeptide
DEEEIRTTNPVATEQYGVVSVSITGMGEGNDDENET

SEQ ID NO: 133615 - protein, 29 aa, Artificial Sequence
  Description of Artificial Sequence: Synthetic peptide
QESEIASTNPVGTEGYGHVMASTLQQGDI

SEQ ID NO: 133616 - protein, 29 aa, Artificial Sequence
  Description of Artificial Sequence: Synthetic peptide
QESEIASTNPVGTEGYGHVMASTLQHGDI

SEQ ID NO: 133617 - protein, 28 aa, Artificial Sequence
  Description of Artificial Sequence: Synthetic peptide
QESEIASTNPVGTEGYGCMCSTLQHGDI

SEQ ID NO: 133618 - protein, 29 aa, Artificial Sequence
  Description of Artificial Sequence: Synthetic peptide
QESEIASTNPVGTEGYGCVMASTLQHGDI

SEQ ID NO: 133619 - protein, 28 aa, Artificial Sequence
  Description of Artificial Sequence: Synthetic peptide
QESEIASTNPVGTEGYGDMASTLQHGDA

SEQ ID NO: 133620 - protein, 29 aa, Artificial Sequence
  Description of Artificial Sequence: Synthetic peptide
QESEIASTNPVGTEGYGDVASTLQAAGDI

SEQ ID NO: 133621 - protein, 33 aa, Artificial Sequence
  Description of Artificial Sequence: Synthetic polypeptide
DEGEIRTTNPVATEQYGCVWHEDLEIHGNEDGA

SEQ ID NO: 133622 - protein, 36 aa, Artificial Sequence
  Description of Artificial Sequence: Synthetic polypeptide
DEEEIRTTNPVATEQYGSHSSTTPCGPNMRNGMNPV

SEQ ID NO: 133623 - protein, 28 aa, Artificial Sequence
  Description of Artificial Sequence: Synthetic peptide
QESEIASTNPVGTEGYGEMAENLQHGDI

SEQ ID NO: 133624 - protein, 35 aa, Artificial Sequence
  Description of Artificial Sequence: Synthetic polypeptide
DEGEIRTTNPVATEQYGCVSYTDEIVDERQEDNRV

SEQ ID NO: 133625 - protein, 34 aa, Artificial Sequence
  Description of Artificial Sequence: Synthetic polypeptide
DEGEIRTTNPVATEQYGCVSWTWPESQESTNEQA

SEQ ID NO: 133626 - protein, 36 aa, Artificial Sequence
  Description of Artificial Sequence: Synthetic polypeptide
DEEEIRTTNPVATEQYGSHSSTTPAGPNMTNGMNPV

SEQ ID NO: 133627 - protein, 28 aa, Artificial Sequence
  Description of Artificial Sequence: Synthetic peptide
QESEIASTNPVGTEGYGEMAETLQRGDI

SEQ ID NO: 133628 - protein, 28 aa, Artificial Sequence
  Description of Artificial Sequence: Synthetic peptide
QESEIASTNPVGTEGYGEMASTLQHGDI

SEQ ID NO: 133629 - protein, 34 aa, Artificial Sequence
  Description of Artificial Sequence: Synthetic polypeptide
DEGEIRTTNPVATEQYGCVSWEDAEIHLGNEDRA

SEQ ID NO: 133630 - protein, 36 aa, Artificial Sequence
  Description of Artificial Sequence: Synthetic polypeptide
DEEEIRTTNPVATEQYGSHSSTTPAGPNMRNGMNPV

SEQ ID NO: 133631 - protein, 34 aa, Artificial Sequence
  Description of Artificial Sequence: Synthetic polypeptide
DEEEIRATNPVATEQWGSVSGTGGPLDNPAGEPG

SEQ ID NO: 133632 - protein, 35 aa, Artificial Sequence
  Description of Artificial Sequence: Synthetic polypeptide
DEEEIRTTNPVATEQYGSHISHTTLEDHNDEGQEQ

SEQ ID NO: 133633 - protein, 29 aa, Artificial Sequence
  Description of Artificial Sequence: Synthetic peptide
QESEIASTNPVGTEGYGEVMASTLQHGDI

SEQ ID NO: 133634 - protein, 33 aa, Artificial Sequence
  Description of Artificial Sequence: Synthetic polypeptide
DDEEIRTTNPVATEFYGNVVVGNENGQGGNNGD

SEQ ID NO: 133635 - protein, 29 aa, Artificial Sequence
  Description of Artificial Sequence: Synthetic peptide
QESEIASTNPVGTEGYGFVMASTLQHGDI

SEQ ID NO: 133636 - protein, 29 aa, Artificial Sequence
  Description of Artificial Sequence: Synthetic peptide
QESEIASTNPVGTEGYGFVMASTLQVGDI

SEQ ID NO: 133637 - protein, 28 aa, Artificial Sequence
  Description of Artificial Sequence: Synthetic peptide
QESEIASTNPVGTEGYGHMASTLQHGDI

SEQ ID NO: 133638 - protein, 29 aa, Artificial Sequence
  Description of Artificial Sequence: Synthetic peptide
QESEIASTNPVGTEGYGAVMASTLQHGDI

SEQ ID NO: 133639 - protein, 34 aa, Artificial Sequence
  Description of Artificial Sequence: Synthetic polypeptide
DEGEIRTTNPVATEQYGSVSAENDHNQEQFEDGT

SEQ ID NO: 133640 - protein, 34 aa, Artificial Sequence
  Description of Artificial Sequence: Synthetic polypeptide
DDEEIRTTNPVATDQYGSVSTQEGGQNVGGMGDT

SEQ ID NO: 133641 - protein, 31 aa, Artificial Sequence
  Description of Artificial Sequence: Synthetic polypeptide
QESEIASTNPVATEQYGSMSATDLEHEGEDL

SEQ ID NO: 133642 - protein, 35 aa, Artificial Sequence
  Description of Artificial Sequence: Synthetic polypeptide
DEGEIRTTNPVATEQYGSVQCTHASSNPNGGNNET

SEQ ID NO: 133643 - protein, 30 aa, Artificial Sequence
  Description of Artificial Sequence: Synthetic polypeptide
QESEIAPTNPVSSECYGIVSCNLQDSEGTR

SEQ ID NO: 133644 - protein, 32 aa, Artificial Sequence
  Description of Artificial Sequence: Synthetic polypeptide
QESEIAPTNPVSSECYGSVSCINLPQDREGTR

SEQ ID NO: 133645 - protein, 38 aa, Artificial Sequence
  Description of Artificial Sequence: Synthetic polypeptide
DEEEIRTTNPVATEQYGVVSTVVVTNLQSGNNQDEETD

SEQ ID NO: 133646 - protein, 31 aa, Artificial Sequence
  Description of Artificial Sequence: Synthetic polypeptide
QESEIAPTNPVSSECYGSVSCINLQDSEGTR

SEQ ID NO: 133647 - protein, 28 aa, Artificial Sequence
  Description of Artificial Sequence: Synthetic peptide
QESEIAPTNPVSSEGYGIVACTLQHGDR

SEQ ID NO: 133648 - protein, 28 aa, Artificial Sequence
  Description of Artificial Sequence: Synthetic peptide
QESEIAPTNPVSSEGYGIVACTLQSGDR

SEQ ID NO: 133649 - protein, 34 aa, Artificial Sequence
  Description of Artificial Sequence: Synthetic polypeptide
DEEEIRTTNPVATEQYGSIHHTTLEDHNDEQDEM

SEQ ID NO: 133650 - protein, 28 aa, Artificial Sequence
  Description of Artificial Sequence: Synthetic peptide
QESEIAPTNPVSTEGYGIMSSTLQSGDI

SEQ ID NO: 133651 - protein, 35 aa, Artificial Sequence
  Description of Artificial Sequence: Synthetic polypeptide
DDEEIRTTNPVATDQYGSVISTQEGGQNVGGNGET

SEQ ID NO: 133652 - protein, 28 aa, Artificial Sequence
  Description of Artificial Sequence: Synthetic peptide
QESEIAPTNPVSTEGYGVMSSTLQSGDI

SEQ ID NO: 133653 - protein, 35 aa, Artificial Sequence
  Description of Artificial Sequence: Synthetic polypeptide
DEGEIRTTNPVATEQYGSVNTATVNESMIGNEDIA

SEQ ID NO: 133654 - protein, 34 aa, Artificial Sequence
  Description of Artificial Sequence: Synthetic polypeptide
DEGEIRTTNPVATEQYGSVNSVWDNEAEEGQDDN

SEQ ID NO: 133655 - protein, 29 aa, Artificial Sequence
  Description of Artificial Sequence: Synthetic peptide
QESEIAQTNPVGTEGYGVMASTILQHGDI

SEQ ID NO: 133656 - protein, 28 aa, Artificial Sequence
  Description of Artificial Sequence: Synthetic peptide
QESEIAQTNPVGTEGYGVMASTLQHGDI

SEQ ID NO: 133657 - protein, 36 aa, Artificial Sequence
  Description of Artificial Sequence: Synthetic polypeptide
DEGEIRTTNPVATEQYGSVNSTPPAGPNMENGMNDD

SEQ ID NO: 133658 - protein, 28 aa, Artificial Sequence
  Description of Artificial Sequence: Synthetic peptide
QESEIASTNPCGTEQYGIMASNLQHGTI

SEQ ID NO: 133659 - protein, 28 aa, Artificial Sequence
  Description of Artificial Sequence: Synthetic peptide
QESEIASTNPCSTEGYGVMSSNLQHGDI

SEQ ID NO: 133660 - protein, 28 aa, Artificial Sequence
  Description of Artificial Sequence: Synthetic peptide
QESEIASTNPCSTEGYGVMSSNLQHGTI

SEQ ID NO: 133661 - protein, 28 aa, Artificial Sequence
  Description of Artificial Sequence: Synthetic peptide
QESEIASTNPIATECYGVMASTLQHGDI

SEQ ID NO: 133662 - protein, 29 aa, Artificial Sequence
  Description of Artificial Sequence: Synthetic peptide
QESEIAQTNPVGTEGYGTVMASTLQHGDI

SEQ ID NO: 133663 - protein, 35 aa, Artificial Sequence
  Description of Artificial Sequence: Synthetic polypeptide
DEEEIRTTNPVATEQYGSIISEHPELQVTPNSVDQ

SEQ ID NO: 133664 - protein, 28 aa, Artificial Sequence
  Description of Artificial Sequence: Synthetic peptide
QESEIAPTNPVGTEGYGVMSSTLQSGDI

SEQ ID NO: 133665 - protein, 28 aa, Artificial Sequence
  Description of Artificial Sequence: Synthetic peptide
QESEIAPTNPVGTEGYGVMASTLQHGTI

SEQ ID NO: 133666 - protein, 34 aa, Artificial Sequence
  Description of Artificial Sequence: Synthetic polypeptide
DEGEIRTTNPVATEQYGSVSAENDATEEQFEDGD

SEQ ID NO: 133667 - protein, 28 aa, Artificial Sequence
  Description of Artificial Sequence: Synthetic peptide
QESEIAPTNPCSSEGYGIVSSNLQSGTI

SEQ ID NO: 133668 - protein, 34 aa, Artificial Sequence
  Description of Artificial Sequence: Synthetic polypeptide
DEGEIRTTNPVATEQYGSVSAEGDHTMEQFEDGD

SEQ ID NO: 133669 - protein, 38 aa, Artificial Sequence
  Description of Artificial Sequence: Synthetic polypeptide
DEEEIRTTNPVATEQYGVVSTVVVTNLQQGNQQGTTEE

SEQ ID NO: 133670 - protein, 38 aa, Artificial Sequence
  Description of Artificial Sequence: Synthetic polypeptide
DEEEIRTTNPVATEQYGVVSTVVVTNLQQGQNQDEEED

SEQ ID NO: 133671 - protein, 28 aa, Artificial Sequence
  Description of Artificial Sequence: Synthetic peptide
QESEIAPTNPCSSEGYGVVASNLQHGTR

SEQ ID NO: 133672 - protein, 38 aa, Artificial Sequence
  Description of Artificial Sequence: Synthetic polypeptide
DEEEIRTTNPVATEQYGVVSTVVVTNLQQGTNQEDEDE

SEQ ID NO: 133673 - protein, 29 aa, Artificial Sequence
  Description of Artificial Sequence: Synthetic peptide
QESEIAPTNPCSSEQWGSVSCNEQDSGTR

SEQ ID NO: 133674 - protein, 33 aa, Artificial Sequence
  Description of Artificial Sequence: Synthetic polypeptide
DDEEIRTTNPEATEHYGCVCSWNLQNFNSDTQS

SEQ ID NO: 133675 - protein, 28 aa, Artificial Sequence
  Description of Artificial Sequence: Synthetic peptide
QESEIAPTNPCSSEQYGIMACNLQSGTR

SEQ ID NO: 133676 - protein, 35 aa, Artificial Sequence
  Description of Artificial Sequence: Synthetic polypeptide
DEEEIRTTNPVATEQYGSILSFTELIEENLELNDE

SEQ ID NO: 133677 - protein, 30 aa, Artificial Sequence
  Description of Artificial Sequence: Synthetic polypeptide
QESEIAPTNPCSSEQYGIVSCNLPQSGETR

SEQ ID NO: 133678 - protein, 28 aa, Artificial Sequence
  Description of Artificial Sequence: Synthetic peptide
QESEIAPTNPCSSEQYGVMACNLQSGTR

SEQ ID NO: 133679 - protein, 28 aa, Artificial Sequence
  Description of Artificial Sequence: Synthetic peptide
QESEIAPTNPCSTEGYGIMSSNLQSGTI

SEQ ID NO: 133680 - protein, 30 aa, Artificial Sequence
  Description of Artificial Sequence: Synthetic polypeptide
QESEIAPTNPCSYEQYGITVSCNMLQSGTR

SEQ ID NO: 133681 - protein, 30 aa, Artificial Sequence
  Description of Artificial Sequence: Synthetic polypeptide
QESEIAPTNPCSYEQYGVTVSCNLQSGGTR

SEQ ID NO: 133682 - protein, 31 aa, Artificial Sequence
  Description of Artificial Sequence: Synthetic polypeptide
QESEIAPTNPVATECYGIVSCNEQDREGETG

SEQ ID NO: 133683 - protein, 28 aa, Artificial Sequence
  Description of Artificial Sequence: Synthetic peptide
QESEIAPTNPVGSEGYGVVASTLQHGDI

SEQ ID NO: 133684 - protein, 28 aa, Artificial Sequence
  Description of Artificial Sequence: Synthetic peptide
QESEIAPTNPVGSEQYGVVACTLQHGDI

SEQ ID NO: 133685 - protein, 28 aa, Artificial Sequence
  Description of Artificial Sequence: Synthetic peptide
QESEIAPTNPVGTEGYGVMASTLQHGDI

SEQ ID NO: 133686 - protein, 37 aa, Artificial Sequence
  Description of Artificial Sequence: Synthetic polypeptide
DEEEIRTTNPVATEQYGVVSTVVVTNLQQGTTTEEED

SEQ ID NO: 133687 - protein, 36 aa, Artificial Sequence
  Description of Artificial Sequence: Synthetic polypeptide
DEGEIRTTNPVATEQYGSVMPTVNLHVIEGSNEDVP

SEQ ID NO: 133688 - protein, 34 aa, Artificial Sequence
  Description of Artificial Sequence: Synthetic polypeptide
DEEEIRATNPVATEQWGGCVAITNLEQTGMEGSF

SEQ ID NO: 133689 - protein, 28 aa, Artificial Sequence
  Description of Artificial Sequence: Synthetic peptide
QESEIASTNPIGTEQYGVMASTLQHGDI

SEQ ID NO: 133690 - protein, 29 aa, Artificial Sequence
  Description of Artificial Sequence: Synthetic peptide
QESEIASTNPVATECWGVMASTLQRGEDG

SEQ ID NO: 133691 - protein, 28 aa, Artificial Sequence
  Description of Artificial Sequence: Synthetic peptide
QESEIASTNPVATEGYGVMASTCQHGEI

SEQ ID NO: 133692 - protein, 28 aa, Artificial Sequence
  Description of Artificial Sequence: Synthetic peptide
QESEIASTNPVATEGYGVMASTGQHGDI

SEQ ID NO: 133693 - protein, 29 aa, Artificial Sequence
  Description of Artificial Sequence: Synthetic peptide
QESEIASTNPVATEGYGVMASTLMQHGDI

SEQ ID NO: 133694 - protein, 35 aa, Artificial Sequence
  Description of Artificial Sequence: Synthetic polypeptide
DEEEIRTTNPVATEQYGSICSESQNQQTRVVELEQ

SEQ ID NO: 133695 - protein, 28 aa, Artificial Sequence
  Description of Artificial Sequence: Synthetic peptide
QESEIASTNPVATEGYGVMASVLQHGDK

SEQ ID NO: 133696 - protein, 29 aa, Artificial Sequence
  Description of Artificial Sequence: Synthetic peptide
QESEIASTNPVATEGYGVMATDTLQHGDI

SEQ ID NO: 133697 - protein, 28 aa, Artificial Sequence
  Description of Artificial Sequence: Synthetic peptide
QESEIASTNPVATEGYGVMPETLQHGEI

SEQ ID NO: 133698 - protein, 29 aa, Artificial Sequence
  Description of Artificial Sequence: Synthetic peptide
QESEIASTNPVATEGYGVMSSITLQHGDI

SEQ ID NO: 133699 - protein, 29 aa, Artificial Sequence
  Description of Artificial Sequence: Synthetic peptide
QESEIASTNPVATEGYGVMSTTLEHEGDI

SEQ ID NO: 133700 - protein, 28 aa, Artificial Sequence
  Description of Artificial Sequence: Synthetic peptide
QESEIASTNPVATEGYGVMASTCQHGDI

SEQ ID NO: 133701 - protein, 29 aa, Artificial Sequence
  Description of Artificial Sequence: Synthetic peptide
QESEIASTNPVATEGYGVTMASTLQHGDI

SEQ ID NO: 133702 - protein, 28 aa, Artificial Sequence
  Description of Artificial Sequence: Synthetic peptide
QESEIASTNPVATEGYGVVAETLQHEDI

SEQ ID NO: 133703 - protein, 30 aa, Artificial Sequence
  Description of Artificial Sequence: Synthetic polypeptide
QESEIASTNPVATEGYGVVASTLQDHGEDI

SEQ ID NO: 133704 - protein, 28 aa, Artificial Sequence
  Description of Artificial Sequence: Synthetic peptide
QESEIASTNPVATEQYGDMAETLQHEDA

SEQ ID NO: 133705 - protein, 30 aa, Artificial Sequence
  Description of Artificial Sequence: Synthetic polypeptide
QESEIASTNPVATEQYGDVAEILQNHAGDA

SEQ ID NO: 133706 - protein, 30 aa, Artificial Sequence
  Description of Artificial Sequence: Synthetic polypeptide
QESEIASTNPVATEQYGDVAEILQNHAGDI

SEQ ID NO: 133707 - protein, 28 aa, Artificial Sequence
  Description of Artificial Sequence: Synthetic peptide
QESEIASTNPVATEQYGEMPEVLQHEEI

SEQ ID NO: 133708 - protein, 28 aa, Artificial Sequence
  Description of Artificial Sequence: Synthetic peptide
QESEIASTNPVATEQYGEMPEVLQHEEK

SEQ ID NO: 133709 - protein, 31 aa, Artificial Sequence
  Description of Artificial Sequence: Synthetic polypeptide
QESEIASTNPVATEQYGSMSATDLEHEGEDI

SEQ ID NO: 133710 - protein, 35 aa, Artificial Sequence
  Description of Artificial Sequence: Synthetic polypeptide
DEGEIRTTNPVATEQYGSVCSDVNEPQDEGIEDDM

SEQ ID NO: 133711 - protein, 30 aa, Artificial Sequence
  Description of Artificial Sequence: Synthetic polypeptide
QESEIASTNPVATEGYGVTTANSTLQHGDI

SEQ ID NO: 133712 - protein, 29 aa, Artificial Sequence
  Description of Artificial Sequence: Synthetic peptide
QESEIASTNPVATEGYGVMASPTLQHGDI

SEQ ID NO: 133713 - protein, 30 aa, Artificial Sequence
  Description of Artificial Sequence: Synthetic polypeptide
QESEIASTNPVATEGYGVMASITLQHEGNI

SEQ ID NO: 133714 - protein, 29 aa, Artificial Sequence
  Description of Artificial Sequence: Synthetic peptide
QESEIASTNPVATEGYGVMASDTLQHGDI

SEQ ID NO: 133715 - protein, 28 aa, Artificial Sequence
  Description of Artificial Sequence: Synthetic peptide
QESEIASTNPVATECYGVMASCLQHGDI

SEQ ID NO: 133716 - protein, 30 aa, Artificial Sequence
  Description of Artificial Sequence: Synthetic polypeptide
QESEIASTNPVATEGWGSVACNEQREGEDG

SEQ ID NO: 133717 - protein, 28 aa, Artificial Sequence
  Description of Artificial Sequence: Synthetic peptide
QESEIASTNPVATEGWGVMASTLQHGDI

SEQ ID NO: 133718 - protein, 28 aa, Artificial Sequence
  Description of Artificial Sequence: Synthetic peptide
QESEIASTNPVATEGWGVTASTLQHGDI

SEQ ID NO: 133719 - protein, 29 aa, Artificial Sequence
  Description of Artificial Sequence: Synthetic peptide
QESEIASTNPVATEGYGDMASTLQHAGDI

SEQ ID NO: 133720 - protein, 28 aa, Artificial Sequence
  Description of Artificial Sequence: Synthetic peptide
QESEIASTNPVATEGYGDMASTLQHEDI

SEQ ID NO: 133721 - protein, 35 aa, Artificial Sequence
  Description of Artificial Sequence: Synthetic polypeptide
DEGEIRTTNPVATEQYGSVIETLLLHDEGSNEDVP

SEQ ID NO: 133722 - protein, 28 aa, Artificial Sequence
  Description of Artificial Sequence: Synthetic peptide
QESEIASTNPVATEGYGEMPEVLQHGEI

SEQ ID NO: 133723 - protein, 34 aa, Artificial Sequence
  Description of Artificial Sequence: Synthetic polypeptide
DEGEIRTTNPVATEQYGSVGTPDVDLNRFEQTQE

SEQ ID NO: 133724 - protein, 29 aa, Artificial Sequence
  Description of Artificial Sequence: Synthetic peptide
QESEIASTNPVATEGYGSMAASTLEHGEI

SEQ ID NO: 133725 - protein, 35 aa, Artificial Sequence
  Description of Artificial Sequence: Synthetic polypeptide
DDEEIRTTNPVATDQYGSVSTDQEDGQNVGGNGDT

SEQ ID NO: 133726 - protein, 30 aa, Artificial Sequence
  Description of Artificial Sequence: Synthetic polypeptide
QESEIASTNPVATEGYGSMAATTLQHGDDI

SEQ ID NO: 133727 - protein, 31 aa, Artificial Sequence
  Description of Artificial Sequence: Synthetic polypeptide
QESEIASTNPVATEGYGSMATSPAGQRGMNI

SEQ ID NO: 133728 - protein, 34 aa, Artificial Sequence
  Description of Artificial Sequence: Synthetic polypeptide
DEGEIRTTNPVATEQYGSVFSWQWPEQDTNEIQA

SEQ ID NO: 133729 - protein, 34 aa, Artificial Sequence
  Description of Artificial Sequence: Synthetic polypeptide
DEEEIRTTNPVATEQYGSIFTTSQLNYPGESDQE

SEQ ID NO: 133730 - protein, 32 aa, Artificial Sequence
  Description of Artificial Sequence: Synthetic polypeptide
QESEIASTNPVATEGYGSMSATSPAGQRGMNI

SEQ ID NO: 133731 - protein, 30 aa, Artificial Sequence
  Description of Artificial Sequence: Synthetic polypeptide
QESEIASTNPVATEGYGTVCATTLEFEGNI

SEQ ID NO: 133732 - protein, 28 aa, Artificial Sequence
  Description of Artificial Sequence: Synthetic peptide
QESEIASTNPVATEGYGVMAETLQHGDI

SEQ ID NO: 133733 - protein, 28 aa, Artificial Sequence
  Description of Artificial Sequence: Synthetic peptide
QESEIASTNPVATEGYGVMAETLQHGEI

SEQ ID NO: 133734 - protein, 34 aa, Artificial Sequence
  Description of Artificial Sequence: Synthetic polypeptide
DEGEIRTTNPVATEQYGSVEVTNMDEIEQFEDIN

SEQ ID NO: 133735 - protein, 28 aa, Artificial Sequence
  Description of Artificial Sequence: Synthetic peptide
QESEIASTNPVATEGYGVMASDLQHGDI

SEQ ID NO: 133736 - protein, 36 aa, Artificial Sequence
  Description of Artificial Sequence: Synthetic polypeptide
DEGEIRTTNPVATEQYGSVMPTLNLHLIEGSNEDVT

SEQ ID NO: 133737 - protein, 34 aa, Artificial Sequence
  Description of Artificial Sequence: Synthetic polypeptide
DEEEIRTTNPVATEQYGSAYPTGLEQAMQLMPMI

SEQ ID NO: 133738 - protein, 28 aa, Artificial Sequence
  Description of Artificial Sequence: Synthetic peptide
QESEIASTNPVGTEGYGVVACTLQHGDI

SEQ ID NO: 133739 - protein, 30 aa, Artificial Sequence
  Description of Artificial Sequence: Synthetic polypeptide
QESEIASTNPVGTEGYGVVANTLQSRVGQR

SEQ ID NO: 133740 - protein, 32 aa, Artificial Sequence
  Description of Artificial Sequence: Synthetic polypeptide
DEFEIRTTNPVATEQWGSAVSEIQEMNGMEEM

SEQ ID NO: 133741 - protein, 31 aa, Artificial Sequence
  Description of Artificial Sequence: Synthetic polypeptide
DEFEIRTTNPVATEQWGDVSELIEMNAAEDA

SEQ ID NO: 133742 - protein, 31 aa, Artificial Sequence
  Description of Artificial Sequence: Synthetic polypeptide
DEFEIRTTNPVATEQWGDVSEIEMNAAEDAM

SEQ ID NO: 133743 - protein, 30 aa, Artificial Sequence
  Description of Artificial Sequence: Synthetic polypeptide
DEFEIRTTNPVATEQWGDVSEIEMNAAEDA

SEQ ID NO: 133744 - protein, 35 aa, Artificial Sequence
  Description of Artificial Sequence: Synthetic polypeptide
DEEEIRTTNPVATESYGSVMGNINQGLEEEQDGIG

SEQ ID NO: 133745 - protein, 35 aa, Artificial Sequence
  Description of Artificial Sequence: Synthetic polypeptide
DDEEIRTTNPVATEQYGNVSSTDNGGQGNQGEGEI

SEQ ID NO: 133746 - protein, 34 aa, Artificial Sequence
  Description of Artificial Sequence: Synthetic polypeptide
DEEEIRTTNPVATESYGSVMGNSGEGGGGNNGQE

SEQ ID NO: 133747 - protein, 28 aa, Artificial Sequence
  Description of Artificial Sequence: Synthetic peptide
QESEISSTNPVGTEGYGVMASTLQHGDI

SEQ ID NO: 133748 - protein, 28 aa, Artificial Sequence
  Description of Artificial Sequence: Synthetic peptide
QESEITSTNPVGTEGYGVMASTLQHGDI

SEQ ID NO: 133749 - protein, 32 aa, Artificial Sequence
  Description of Artificial Sequence: Synthetic polypeptide
QESEIRTTNPVGTEQYGSVATSAGNHNGMNPV

SEQ ID NO: 133750 - protein, 33 aa, Artificial Sequence
  Description of Artificial Sequence: Synthetic polypeptide
DEEEIRCTNPAATEQYGSVVVNLNIFDDGGEGD

SEQ ID NO: 133751 - protein, 28 aa, Artificial Sequence
  Description of Artificial Sequence: Synthetic peptide
QESEIVSTNPVGTEQYGVMATGLEHGDI

SEQ ID NO: 133752 - protein, 29 aa, Artificial Sequence
  Description of Artificial Sequence: Synthetic peptide
QESEIVSTNPVGTEQYGVVATGLVEHGDI

SEQ ID NO: 133753 - protein, 28 aa, Artificial Sequence
  Description of Artificial Sequence: Synthetic peptide
QESEVASTNPVGTEGYGNVASTLQHGDI

SEQ ID NO: 133754 - protein, 29 aa, Artificial Sequence
  Description of Artificial Sequence: Synthetic peptide
QESEVASTNPVGTEGYGVIASTNLQHGDI

SEQ ID NO: 133755 - protein, 28 aa, Artificial Sequence
  Description of Artificial Sequence: Synthetic peptide
QESEVASTNPVGTEGYGVMASTLQRGDI

SEQ ID NO: 133756 - protein, 29 aa, Artificial Sequence
  Description of Artificial Sequence: Synthetic peptide
QESEVASTNPVGTEGYGVVASTLQSHGDR

SEQ ID NO: 133757 - protein, 29 aa, Artificial Sequence
  Description of Artificial Sequence: Synthetic peptide
QESEVASTNPVSTEGYGNVAANTLQRGDI

SEQ ID NO: 133758 - protein, 34 aa, Artificial Sequence
  Description of Artificial Sequence: Synthetic polypeptide
DEFEICTVNPVAYEQYGSVSTTNNELSTEVGNNH

SEQ ID NO: 133759 - protein, 29 aa, Artificial Sequence
  Description of Artificial Sequence: Synthetic peptide
QESEVASTNPVSTEGYGNVAANTLQRGQI

SEQ ID NO: 133760 - protein, 31 aa, Artificial Sequence
  Description of Artificial Sequence: Synthetic polypeptide
DEEEIRCTNPIATECWGSVAAENWMEPGPYR

SEQ ID NO: 133761 - protein, 32 aa, Artificial Sequence
  Description of Artificial Sequence: Synthetic polypeptide
DEFEIRTTNPVATEQWGSDVSEHQEINGMEEA

SEQ ID NO: 133762 - protein, 33 aa, Artificial Sequence
  Description of Artificial Sequence: Synthetic polypeptide
DEFEIRTTNPVATEQWGSDVSEIQEMNGMEGEE

SEQ ID NO: 133763 - protein, 30 aa, Artificial Sequence
  Description of Artificial Sequence: Synthetic polypeptide
QESEIRTTNPVGTEGYGVVSETLMNAAGDI

SEQ ID NO: 133764 - protein, 32 aa, Artificial Sequence
  Description of Artificial Sequence: Synthetic polypeptide
QESEIRTTNPVGTECYGVVSCINEQDREGEDG

SEQ ID NO: 133765 - protein, 34 aa, Artificial Sequence
  Description of Artificial Sequence: Synthetic polypeptide
DDEEIRTTNPVATEQYGMVGSDTGEGGDGGNEGA

SEQ ID NO: 133766 - protein, 35 aa, Artificial Sequence
  Description of Artificial Sequence: Synthetic polypeptide
DDEEIRTTNPVATEQYGMVSTGNGGQGDNDDNEED

SEQ ID NO: 133767 - protein, 36 aa, Artificial Sequence
  Description of Artificial Sequence: Synthetic polypeptide
DEFEIRTTNPVATEQYGSVSSTTPAGPNMRNGVNPV

SEQ ID NO: 133768 - protein, 36 aa, Artificial Sequence
  Description of Artificial Sequence: Synthetic polypeptide
DEFEIRTTNPVATEQYGSVSSTTPAGPNMRNGMNPV

SEQ ID NO: 133769 - protein, 36 aa, Artificial Sequence
  Description of Artificial Sequence: Synthetic polypeptide
DEFEIRTTNPVATEQYGSVSSTTPAGPNERNGMNPV

SEQ ID NO: 133770 - protein, 34 aa, Artificial Sequence
  Description of Artificial Sequence: Synthetic polypeptide
DEEEIRTTNPVATESYGSVMGFGGTEDGEGQNVI

SEQ ID NO: 133771 - protein, 34 aa, Artificial Sequence
  Description of Artificial Sequence: Synthetic polypeptide
DEFEIRTTNPVATEQYGSVSCTVELTHETSEDDQ

SEQ ID NO: 133772 - protein, 35 aa, Artificial Sequence
  Description of Artificial Sequence: Synthetic polypeptide
DEFEIRTTNPVATEQYGSVSCTVELFQETSEEDIQ

SEQ ID NO: 133773 - protein, 30 aa, Artificial Sequence
  Description of Artificial Sequence: Synthetic polypeptide
QESEIRTTNPVGTEGWGVMSSNEPQRGEDI

SEQ ID NO: 133774 - protein, 29 aa, Artificial Sequence
  Description of Artificial Sequence: Synthetic peptide
QESEIRTTNPVGTEGWGVMSSNEQHGEDI

SEQ ID NO: 133775 - protein, 34 aa, Artificial Sequence
  Description of Artificial Sequence: Synthetic polypeptide
DEEEIRTTNPVATESYGSVMGFNNIQQDEEQGQE

SEQ ID NO: 133776 - protein, 33 aa, Artificial Sequence
  Description of Artificial Sequence: Synthetic polypeptide
DEEEIRATNPVTTEQYGSVATNVATEEGTTVTN

SEQ ID NO: 133777 - protein, 33 aa, Artificial Sequence
  Description of Artificial Sequence: Synthetic polypeptide
DEEEIRATNPVTTEQYGSVATNVATEGGTTTTE

SEQ ID NO: 133778 - protein, 34 aa, Artificial Sequence
  Description of Artificial Sequence: Synthetic polypeptide
DEEEIRATNPVTTEQYGSVATNVATENGTTTNTE

SEQ ID NO: 133779 - protein, 30 aa, Artificial Sequence
  Description of Artificial Sequence: Synthetic polypeptide
DEFEIRTTNPVATEQWGWVSEIEMNAAEDA

SEQ ID NO: 133780 - protein, 36 aa, Artificial Sequence
  Description of Artificial Sequence: Synthetic polypeptide
DEEEIRTTNPVATEQYGSCSPTLNMNMQEEGEEEVN

SEQ ID NO: 133781 - protein, 33 aa, Artificial Sequence
  Description of Artificial Sequence: Synthetic polypeptide
DEFEIRTTNPVATEQWGSDVSSIIQEMNGMEEA

SEQ ID NO: 133782 - protein, 33 aa, Artificial Sequence
  Description of Artificial Sequence: Synthetic polypeptide
DEFEIRTTNPVATEQWGSDVSEWIQEMNGMFEA

SEQ ID NO: 133783 - protein, 33 aa, Artificial Sequence
  Description of Artificial Sequence: Synthetic polypeptide
DEFEIRTTNPVATEQWGSDVSEQQETMNGMREA

SEQ ID NO: 133784 - protein, 35 aa, Artificial Sequence
  Description of Artificial Sequence: Synthetic polypeptide
DEEEIRTTNPVATESYGSVMGGFNNQDQGNGGGQG

SEQ ID NO: 133785 - protein, 34 aa, Artificial Sequence
  Description of Artificial Sequence: Synthetic polypeptide
DEFEICTVNPVAYEQYGSVSTNELSTSETVGNNH

SEQ ID NO: 133786 - protein, 35 aa, Artificial Sequence
  Description of Artificial Sequence: Synthetic polypeptide
DDEEIRTTNPVATEQYGDVVTGGQNDGQGGNQEET

SEQ ID NO: 133787 - protein, 33 aa, Artificial Sequence
  Description of Artificial Sequence: Synthetic polypeptide
DEFEICTVNPVAYEQYGKVSTNELSTEPVGQNH

SEQ ID NO: 133788 - protein, 32 aa, Artificial Sequence
  Description of Artificial Sequence: Synthetic polypeptide
DEFEICTVNPVAYEAYGSVSCTNEISTEGGNH

SEQ ID NO: 133789 - protein, 37 aa, Artificial Sequence
  Description of Artificial Sequence: Synthetic polypeptide
DEEEIRTTNPVATESYGSVSSTTPAQGPNMRNGMNPV

SEQ ID NO: 133790 - protein, 28 aa, Artificial Sequence
  Description of Artificial Sequence: Synthetic peptide
QETEIATTNPVATEQYGEAPEVCQHEEK

SEQ ID NO: 133791 - protein, 28 aa, Artificial Sequence
  Description of Artificial Sequence: Synthetic peptide
QETEIATTNPVATEQYGEAPEVCQHTEK

SEQ ID NO: 133792 - protein, 36 aa, Artificial Sequence
  Description of Artificial Sequence: Synthetic polypeptide
DEEEIRTTNPVATESYGSVSSTTPSGPNMRNGMNPV

SEQ ID NO: 133793 - protein, 28 aa, Artificial Sequence
  Description of Artificial Sequence: Synthetic peptide
QETEIATTNPVATEQYGNAPEVCQHEEK

SEQ ID NO: 133794 - protein, 33 aa, Artificial Sequence
  Description of Artificial Sequence: Synthetic polypeptide
DEFEIATVNPVATEQYGSVSWTEDLMDEGGGTH

SEQ ID NO: 133795 - protein, 32 aa, Artificial Sequence
  Description of Artificial Sequence: Synthetic polypeptide
DEAEIATTNPVATEQWGSVSAADHGNDDSNGN

SEQ ID NO: 133796 - protein, 35 aa, Artificial Sequence
  Description of Artificial Sequence: Synthetic polypeptide
DEAEIATTNPVATEQWGSVCPTDNHDLQSGDGNVE

SEQ ID NO: 133797 - protein, 34 aa, Artificial Sequence
  Description of Artificial Sequence: Synthetic polypeptide
DEEEIRTTNPVATEQYGSCSAGDALGNHPDAQAN

SEQ ID NO: 133798 - protein, 36 aa, Artificial Sequence
  Description of Artificial Sequence: Synthetic polypeptide
DEEEIRTTNPVATESYGSVSSTTPAGPNMRNGMNPV

SEQ ID NO: 133799 - protein, 33 aa, Artificial Sequence
  Description of Artificial Sequence: Synthetic polypeptide
DEAEIATTNPVATEQWGSVAITAPEQGDGNSDA

SEQ ID NO: 133800 - protein, 37 aa, Artificial Sequence
  Description of Artificial Sequence: Synthetic polypeptide
AEEEIRTTNPVATEQYGSVSTVTTNQLGSEEGTTEND

SEQ ID NO: 133801 - protein, 34 aa, Artificial Sequence
  Description of Artificial Sequence: Synthetic polypeptide
DEFEIATTNPVAYEQYGSVVPVTNSHQELTEGKR

SEQ ID NO: 133802 - protein, 28 aa, Artificial Sequence
  Description of Artificial Sequence: Synthetic peptide
QEVEIASTNPVGTEGYGVMASTLQHGDI

SEQ ID NO: 133803 - protein, 34 aa, Artificial Sequence
  Description of Artificial Sequence: Synthetic polypeptide
DEEEIRTTNPVATEQYGSCPCPTPLLEQQLVTEH

SEQ ID NO: 133804 - protein, 32 aa, Artificial Sequence
  Description of Artificial Sequence: Synthetic polypeptide
DEFEIATTNPVAYEQWGEVSTNLNGDHGGGEQ

SEQ ID NO: 133805 - protein, 28 aa, Artificial Sequence
  Description of Artificial Sequence: Synthetic peptide
QEVEIATTNPVATEQYGEAPEVCQHEEK

SEQ ID NO: 133806 - protein, 36 aa, Artificial Sequence
  Description of Artificial Sequence: Synthetic polypeptide
DDEEIRTTNPVATEQYGSVDDSTDNQAGEMGQGGQG

SEQ ID NO: 133807 - protein, 29 aa, Artificial Sequence
  Description of Artificial Sequence: Synthetic peptide
QEVEIATTNPVATEQYGEASECVAQHEEF

SEQ ID NO: 133808 - protein, 33 aa, Artificial Sequence
  Description of Artificial Sequence: Synthetic polypeptide
DEFEIATTNPVATEQWGSVAPTWNDHQEQDMDR

SEQ ID NO: 133809 - protein, 34 aa, Artificial Sequence
  Description of Artificial Sequence: Synthetic polypeptide
DEAEIATTNPVATEQWGNTNTSANNELTQGNGNR

SEQ ID NO: 133810 - protein, 35 aa, Artificial Sequence
  Description of Artificial Sequence: Synthetic polypeptide
DEEEIRTTNPVATEQYGSCSAGNALGQNHPDAQAN

SEQ ID NO: 133811 - protein, 36 aa, Artificial Sequence
  Description of Artificial Sequence: Synthetic polypeptide
DEEEIRTTNPVATESYGSVSSTTPAGPNMENGMNPV

SEQ ID NO: 133812 - protein, 34 aa, Artificial Sequence
  Description of Artificial Sequence: Synthetic polypeptide
DEFEICTVNPVATEQYGSVPYTTMNLYFGEGNHD

SEQ ID NO: 133813 - protein, 29 aa, Artificial Sequence
  Description of Artificial Sequence: Synthetic peptide
QESEVASTNPVSTEGYGNVAASTLQRGDI

SEQ ID NO: 133814 - protein, 28 aa, Artificial Sequence
  Description of Artificial Sequence: Synthetic peptide
QESEVASTNPVSTEGYGNVASTLQHGDI

SEQ ID NO: 133815 - protein, 28 aa, Artificial Sequence
  Description of Artificial Sequence: Synthetic peptide
QESEVASTNPVSTEGYGVVASTLQHGDI

SEQ ID NO: 133816 - protein, 29 aa, Artificial Sequence
  Description of Artificial Sequence: Synthetic peptide
QESEVASTNPVSTEQYGNVPNVIQSRGQR

SEQ ID NO: 133817 - protein, 30 aa, Artificial Sequence
  Description of Artificial Sequence: Synthetic polypeptide
QESEVATTNPVATECYGNVSAECIQRVEQR

SEQ ID NO: 133818 - protein, 30 aa, Artificial Sequence
  Description of Artificial Sequence: Synthetic polypeptide
QESEVATTNPVATECYGNVSAECLQRVEQL

SEQ ID NO: 133819 - protein, 30 aa, Artificial Sequence
  Description of Artificial Sequence: Synthetic polypeptide
QESEVATTNPVATECYGNVSAETIQRVEQR

SEQ ID NO: 133820 - protein, 33 aa, Artificial Sequence
  Description of Artificial Sequence: Synthetic polypeptide
QETAEIACTNPVATEQYGCVATNLQEAGHTDRS

SEQ ID NO: 133821 - protein, 32 aa, Artificial Sequence
  Description of Artificial Sequence: Synthetic polypeptide
DEEEIRCTNPIATEQYGATVSNADWMEPKGNI

SEQ ID NO: 133822 - protein, 34 aa, Artificial Sequence
  Description of Artificial Sequence: Synthetic polypeptide
DEEEIRTTNPVATESYGSVMTVGFTGDQGDENGD

SEQ ID NO: 133823 - protein, 28 aa, Artificial Sequence
  Description of Artificial Sequence: Synthetic peptide
QETEIASTNPVGTEGYGVMASTLQHGDI

SEQ ID NO: 133824 - protein, 34 aa, Artificial Sequence
  Description of Artificial Sequence: Synthetic polypeptide
DEEEIRTTNPVATESYGSVRCTEESSFNEGNNED

SEQ ID NO: 133825 - protein, 34 aa, Artificial Sequence
  Description of Artificial Sequence: Synthetic polypeptide
DDEEIRTTNPVATEQYGQCVCSWENHQHFNSEQA

SEQ ID NO: 133826 - protein, 28 aa, Artificial Sequence
  Description of Artificial Sequence: Synthetic peptide
QETEIATTNPCSSECWGIVSCNWQSGTR

SEQ ID NO: 133827 - protein, 33 aa, Artificial Sequence
  Description of Artificial Sequence: Synthetic polypeptide
DEAEIATTNPVATEQWGSVSGEGPPQNQGGNPV

SEQ ID NO: 133828 - protein, 29 aa, Artificial Sequence
  Description of Artificial Sequence: Synthetic peptide
QETEIATTNPCSSEQYGIVACNWQSKGTR

SEQ ID NO: 133829 - protein, 31 aa, Artificial Sequence
  Description of Artificial Sequence: Synthetic polypeptide
QETEIATTNPCSTECYGITVSNANLQPGTYR

SEQ ID NO: 133830 - protein, 33 aa, Artificial Sequence
  Description of Artificial Sequence: Synthetic polypeptide
DEFEICTVNPVATEQYGSVSTIEMEFTEGFNHN

SEQ ID NO: 133831 - protein, 33 aa, Artificial Sequence
  Description of Artificial Sequence: Synthetic polypeptide
DEAEIATTNPVATEQWGSVSATGDLEDHNGEDL

SEQ ID NO: 133832 - protein, 36 aa, Artificial Sequence
  Description of Artificial Sequence: Synthetic polypeptide
DEEEIRTTNPVATESYGSVSSTTHAGPNMRNGMNPV

SEQ ID NO: 133833 - protein, 36 aa, Artificial Sequence
  Description of Artificial Sequence: Synthetic polypeptide
DEEEIRTTNPVATESYGSVSSTTPAGFNMRNGMNPV

SEQ ID NO: 133834 - protein, 33 aa, Artificial Sequence
  Description of Artificial Sequence: Synthetic polypeptide
DEFEICTVNPVAYEPYGSVSCTNELSFEGGNNH

SEQ ID NO: 133835 - protein, 33 aa, Artificial Sequence
  Description of Artificial Sequence: Synthetic polypeptide
DEFCIRTTNPVAYHAWGSVSCTNLSQEPGTPER

SEQ ID NO: 133836 - protein, 36 aa, Artificial Sequence
  Description of Artificial Sequence: Synthetic polypeptide
DDEEIRTTNPVATEQYGDVVSTGQQIINGQGGDNGN

SEQ ID NO: 133837 - protein, 35 aa, Artificial Sequence
  Description of Artificial Sequence: Synthetic polypeptide
DDEEIRTTNPVATEQYGDVVSGTGGNGQGEEENGM

SEQ ID NO: 133838 - protein, 37 aa, Artificial Sequence
  Description of Artificial Sequence: Synthetic polypeptide
DEEEIRATNPVATEQYGVVSTTNNQQLQAGNNVNQQG

SEQ ID NO: 133839 - protein, 37 aa, Artificial Sequence
  Description of Artificial Sequence: Synthetic polypeptide
AEEEIRTTNPVATEQYGSVSTVTVNGQNGTEAGNVDE

SEQ ID NO: 133840 - protein, 34 aa, Artificial Sequence
  Description of Artificial Sequence: Synthetic polypeptide
DEAEIATTNPVATEQYGCVAAATNQQTGAGPTRQ

SEQ ID NO: 133841 - protein, 33 aa, Artificial Sequence
  Description of Artificial Sequence: Synthetic polypeptide
DEAEIATTNPVATEQYGCVAAANHLTAMAENRN

SEQ ID NO: 133842 - protein, 35 aa, Artificial Sequence
  Description of Artificial Sequence: Synthetic polypeptide
DDEEIRTTNPVATEQYGCVCSTTEELQEFFNSDQN

SEQ ID NO: 133843 - protein, 33 aa, Artificial Sequence
  Description of Artificial Sequence: Synthetic polypeptide
QESEIRTTNPVATECWGDVSCINEPQDREGENG

SEQ ID NO: 133844 - protein, 33 aa, Artificial Sequence
  Description of Artificial Sequence: Synthetic polypeptide
QESEIRTTNPVATECWGMVSCINEPQDRTGENG

SEQ ID NO: 133845 - protein, 34 aa, Artificial Sequence
  Description of Artificial Sequence: Synthetic polypeptide
QESEIRTTNPVATECWGSAVSCINEPQDREGENG

SEQ ID NO: 133846 - protein, 34 aa, Artificial Sequence
  Description of Artificial Sequence: Synthetic polypeptide
QESEIRTTNPVATECWGSKVSCINEPQDREGENG

SEQ ID NO: 133847 - protein, 36 aa, Artificial Sequence
  Description of Artificial Sequence: Synthetic polypeptide
DEEEIRTTNPVATERYGSVVSCTLELSQMTGGTQYW

SEQ ID NO: 133848 - protein, 36 aa, Artificial Sequence
  Description of Artificial Sequence: Synthetic polypeptide
DEEEIRATNPVATEQYGVVSTTNQQQGQNGNNQQED

SEQ ID NO: 133849 - protein, 33 aa, Artificial Sequence
  Description of Artificial Sequence: Synthetic polypeptide
QESEIRTTNPVATECWGSVPCINEPQDREGENK

SEQ ID NO: 133850 - protein, 33 aa, Artificial Sequence
  Description of Artificial Sequence: Synthetic polypeptide
DDEEIRTTNPVATEQYGCVCSWEEHQHFGSDQA

SEQ ID NO: 133851 - protein, 33 aa, Artificial Sequence
  Description of Artificial Sequence: Synthetic polypeptide
QESEIRTTNPVATECWGSVPEINCPQDREGENK

SEQ ID NO: 133852 - protein, 33 aa, Artificial Sequence
  Description of Artificial Sequence: Synthetic polypeptide
QESEIRTTNPVATECWGSVPEINEPQDREGENK

SEQ ID NO: 133853 - protein, 32 aa, Artificial Sequence
  Description of Artificial Sequence: Synthetic polypeptide
DEFVIGTTNPVATEQWGCVCSWEDLQYFGSNQ

SEQ ID NO: 133854 - protein, 33 aa, Artificial Sequence
  Description of Artificial Sequence: Synthetic polypeptide
DDEEIRTTNPVATEQYGCVCSWEHQEGFISDQS

SEQ ID NO: 133855 - protein, 37 aa, Artificial Sequence
  Description of Artificial Sequence: Synthetic polypeptide
DEEEIRATNPVATEQYGVVSTTNQQQLQAGTNNQTED

SEQ ID NO: 133856 - protein, 32 aa, Artificial Sequence
  Description of Artificial Sequence: Synthetic polypeptide
DEEEIRTTNPVATESYGDVMGLSGEGGGNNGQ

SEQ ID NO: 133857 - protein, 32 aa, Artificial Sequence
  Description of Artificial Sequence: Synthetic polypeptide
QESEIRTTNPVATECWGSVSCICEPQDREENG

SEQ ID NO: 133858 - protein, 33 aa, Artificial Sequence
  Description of Artificial Sequence: Synthetic polypeptide
QESEIRTTNPVATECWGSVMCINEPQDREGENG

SEQ ID NO: 133859 - protein, 32 aa, Artificial Sequence
  Description of Artificial Sequence: Synthetic polypeptide
DEFVIRTTNPVATEQYGCVETDWPGETFGNQF

SEQ ID NO: 133860 - protein, 31 aa, Artificial Sequence
  Description of Artificial Sequence: Synthetic polypeptide
DEAEIATTNPVATEQYGCVAANGNTNMEMNN

SEQ ID NO: 133861 - protein, 34 aa, Artificial Sequence
  Description of Artificial Sequence: Synthetic polypeptide
DDEEIRTTNPVATEQYGCVCSTNAHQENFMSDQA

SEQ ID NO: 133862 - protein, 32 aa, Artificial Sequence
  Description of Artificial Sequence: Synthetic polypeptide
DEAEIATTNPVATEQYGCVAANNGDTTGGNPV

SEQ ID NO: 133863 - protein, 29 aa, Artificial Sequence
  Description of Artificial Sequence: Synthetic peptide
QESEIRSTNPVGTEGYGVVASTLMAAGDI

SEQ ID NO: 133864 - protein, 33 aa, Artificial Sequence
  Description of Artificial Sequence: Synthetic polypeptide
DDEEIRTTNPVATEQYGCVCSTGEDQNFISEQA

SEQ ID NO: 133865 - protein, 34 aa, Artificial Sequence
  Description of Artificial Sequence: Synthetic polypeptide
DDEEIRTTNPVATEQYGCVCSTGEHEQYFGSDQS

SEQ ID NO: 133866 - protein, 37 aa, Artificial Sequence
  Description of Artificial Sequence: Synthetic polypeptide
AEEEIRTTNPVATEQYGSVSTVTVNNQGNGDEAGNTD

SEQ ID NO: 133867 - protein, 37 aa, Artificial Sequence
  Description of Artificial Sequence: Synthetic polypeptide
DEEEIRATNPVATEQYGTVVVIGTSISTNNEQLGNIR

SEQ ID NO: 133868 - protein, 32 aa, Artificial Sequence
  Description of Artificial Sequence: Synthetic polypeptide
QESEIRSTNPVGTEQYGSVATSTGNHNGMNPV

SEQ ID NO: 133869 - protein, 32 aa, Artificial Sequence
  Description of Artificial Sequence: Synthetic polypeptide
DEEEIRATNPVATEQYGVVSNGFGEFTGGGEA

SEQ ID NO: 133870 - protein, 37 aa, Artificial Sequence
  Description of Artificial Sequence: Synthetic polypeptide
DEEEIRATNPVATEQYGVVSTTNNNLLQQGNGNNEDD

SEQ ID NO: 133871 - protein, 31 aa, Artificial Sequence
  Description of Artificial Sequence: Synthetic polypeptide
DEAEIATTNPVATEQYGCVAANNGDTMNNNP

SEQ ID NO: 133872 - protein, 37 aa, Artificial Sequence
  Description of Artificial Sequence: Synthetic polypeptide
DEEEIRATNPVATEQYGVVSTTNNQLLQQGENNQGED

SEQ ID NO: 133873 - protein, 36 aa, Artificial Sequence
  Description of Artificial Sequence: Synthetic polypeptide
DEEEIRTTNPVATERYGSVSSTTPAGPNMRNGMNGV

SEQ ID NO: 133874 - protein, 36 aa, Artificial Sequence
  Description of Artificial Sequence: Synthetic polypeptide
DEEEIRTTNPVATERYGSVSSTTPAGPNMRNGMNPV

SEQ ID NO: 133875 - protein, 34 aa, Artificial Sequence
  Description of Artificial Sequence: Synthetic polypeptide
DDEEIRTTNPVATEQYGCVCSTGEHNQSFGSDQS

SEQ ID NO: 133876 - protein, 34 aa, Artificial Sequence
  Description of Artificial Sequence: Synthetic polypeptide
DDEEIRTTNPVATEQYGCVCSTGEHQHFNSQTQS

SEQ ID NO: 133877 - protein, 36 aa, Artificial Sequence
  Description of Artificial Sequence: Synthetic polypeptide
AEEEIRTTNPVATEQYGSVSTVTVNNMEQGTNVTED

SEQ ID NO: 133878 - protein, 32 aa, Artificial Sequence
  Description of Artificial Sequence: Synthetic polypeptide
QESEIRTTNPCSTECWGIVSCINEPQDRGENR

SEQ ID NO: 133879 - protein, 36 aa, Artificial Sequence
  Description of Artificial Sequence: Synthetic polypeptide
DEEEIRATNPVATEQYGVVSTTNNQNNQLGGNNEDD

SEQ ID NO: 133880 - protein, 36 aa, Artificial Sequence
  Description of Artificial Sequence: Synthetic polypeptide
DEEEIRATNPVATEQYGVVSTTNNQNQQLGNNEQQD

SEQ ID NO: 133881 - protein, 37 aa, Artificial Sequence
  Description of Artificial Sequence: Synthetic polypeptide
DEEEIRATNPVATEQYGVVSTTNNQQLQAGNGNNQQD

SEQ ID NO: 133882 - protein, 33 aa, Artificial Sequence
  Description of Artificial Sequence: Synthetic polypeptide
DEAEIATTNPVATEQYGCVAANGPAATAGGNRE

SEQ ID NO: 133883 - protein, 33 aa, Artificial Sequence
  Description of Artificial Sequence: Synthetic polypeptide
QESEIRTTNPVATECWGSVSCINEPQDHEGENK

SEQ ID NO: 133884 - protein, 32 aa, Artificial Sequence
  Description of Artificial Sequence: Synthetic polypeptide
QESEIRTTNPVGTECWGVVSCINEQDREGENG

SEQ ID NO: 133885 - protein, 33 aa, Artificial Sequence
  Description of Artificial Sequence: Synthetic polypeptide
QESEIRTTNPVATECWGSVSCINEPQDHEGENL

SEQ ID NO: 133886 - protein, 37 aa, Artificial Sequence
  Description of Artificial Sequence: Synthetic polypeptide
DEEEIRATNPVATEQYGVVSTVNLQQLQQGNNNQQED

SEQ ID NO: 133887 - protein, 31 aa, Artificial Sequence
  Description of Artificial Sequence: Synthetic polypeptide
QESEIRTTNPVATEQWGSAPEIVEPQREENG

SEQ ID NO: 133888 - protein, 34 aa, Artificial Sequence
  Description of Artificial Sequence: Synthetic polypeptide
DEEEIRATNPVTTEQYGSVATNCATEQYGVTDDE

SEQ ID NO: 133889 - protein, 36 aa, Artificial Sequence
  Description of Artificial Sequence: Synthetic polypeptide
DEEEIRTTNPVATEQYGSCSSTTPHGPNMRNGMNPV

SEQ ID NO: 133890 - protein, 34 aa, Artificial Sequence
  Description of Artificial Sequence: Synthetic polypeptide
DEEEIRTTNPVATESYGQVSTMTDGFEGGGENIN

SEQ ID NO: 133891 - protein, 33 aa, Artificial Sequence
  Description of Artificial Sequence: Synthetic polypeptide
DEFEIVTTNPVATEQYGTVCSATDGPVEFEGND
